United States Patent 7,250,496 (BIOINFORMATICALLY DETECTABLE GROUP OF NOVEL REGULATORY GENES AND USES THEREOF) - sequence listing, part 21

SEQ ID NO: 879850 - RNA, 24 nt, Human
ugcugggauuacaggcgugagcca

SEQ ID NO: 879851 - RNA, 18 nt, Human
uggaagguaguggcaggu

SEQ ID NO: 879852 - RNA, 24 nt, Human
uggaucaccugaggucaggaguuc

SEQ ID NO: 879853 - RNA, 26 nt, Human
uggaucaccugaggucaggaguucga

SEQ ID NO: 879854 - RNA, 26 nt, Human
uggcagguggaucaccugaggucagg

SEQ ID NO: 879855 - RNA, 24 nt, Human
uggcugacgccuguaaucccagca

SEQ ID NO: 879856 - RNA, 21 nt, Human
ugggacuacaggcgcccgcca

SEQ ID NO: 879857 - RNA, 22 nt, Human
ugggacuacaggcgcccgccac

SEQ ID NO: 879858 - RNA, 22 nt, Human
ugggacuacaggcgcccgccac

SEQ ID NO: 879859 - RNA, 24 nt, Human
ugggacuacaggcgcccgccacua

SEQ ID NO: 879860 - RNA, 22 nt, Human
ugggauaaccagguaguuuuaa

SEQ ID NO: 879861 - RNA, 18 nt, Human
ugggauuacaggcgugag

SEQ ID NO: 879862 - RNA, 19 nt, Human
ugggauuacaggcgugagc

SEQ ID NO: 879863 - RNA, 21 nt, Human
ugggauuacaggcgugagcca

SEQ ID NO: 879864 - RNA, 22 nt, Human
ugggauuacaggcgugagccac

SEQ ID NO: 879865 - RNA, 23 nt, Human
ugggauuacaggcgugagccacc

SEQ ID NO: 879866 - RNA, 24 nt, Human
ugggauuacaggcgugagccaccg

SEQ ID NO: 879867 - RNA, 21 nt, Human
ugggugacagagugggacucu

SEQ ID NO: 879868 - RNA, 24 nt, Human
ugguggcugacgccuguaauccca

SEQ ID NO: 879869 - RNA, 19 nt, Human
ugguugaaaacagaugaug

SEQ ID NO: 879870 - RNA, 21 nt, Human
ugugagaagaagauggcgagg

SEQ ID NO: 879871 - RNA, 24 nt, Human
ugugauccggccgccucagccucc

SEQ ID NO: 879872 - RNA, 20 nt, Human
uguguauccaagacccaguu

SEQ ID NO: 879873 - RNA, 24 nt, Human
uguuacaaaaaacgaacuuuaaag

SEQ ID NO: 879874 - RNA, 22 nt, Human
uuagcugggcauuguagcaugc

SEQ ID NO: 879875 - RNA, 24 nt, Human
uuaguagagacaggguuucgccau

SEQ ID NO: 879876 - RNA, 24 nt, Human
uugcaagcuccgccucccagguuc

SEQ ID NO: 879877 - RNA, 23 nt, Human
uugcaccacugcacuccagccug

SEQ ID NO: 879878 - RNA, 22 nt, Human
uugcagugagccaagauugcac

SEQ ID NO: 879879 - RNA, 23 nt, Human
uuucucaauuuuccuaucaugca

SEQ ID NO: 879880 - RNA, 20 nt, Human
uuuguugggagacaguucuu

SEQ ID NO: 879881 - RNA, 23 nt, Human
uuuuuaguagagacaggguuucg

SEQ ID NO: 879882 - RNA, 24 nt, Human
uuuuuaguagagacaggguuucgc

SEQ ID NO: 879883 - RNA, 21 nt, Human
uuuuuguauuuuuaguagaga

SEQ ID NO: 879884 - RNA, 24 nt, Human
uuuuuuguauuuuuaguagagaca

SEQ ID NO: 879885 - RNA, 25 nt, Human
uuuuuuuuguuugagacagagucuc

SEQ ID NO: 879886 - RNA, 19 nt, Human
aaacgacagcgaagagcgu

SEQ ID NO: 879887 - RNA, 28 nt, Human
ccggacaguggcggcgccgacacuuccu

SEQ ID NO: 879888 - RNA, 22 nt, Human
cgagaccacaaacgacagcgaa

SEQ ID NO: 879889 - RNA, 18 nt, Human
cgcgagaccacaaacgac

SEQ ID NO: 879890 - RNA, 18 nt, Human
cgcgagaccacaaacgac

SEQ ID NO: 879891 - RNA, 20 nt, Human
cgcgagaccacaaacgacag

SEQ ID NO: 879892 - RNA, 18 nt, Human
gagaccacaaacgacagc

SEQ ID NO: 879893 - RNA, 20 nt, Human
ugcgcgagaccacaaacgaa

SEQ ID NO: 879894 - RNA, 23 nt, Human
uguggccggacaguggcggcgcc

SEQ ID NO: 879895 - RNA, 20 nt, Human
cggaugggggcacccaucuc

SEQ ID NO: 879896 - RNA, 24 nt, Human
gaacccagucuuuauuuugaaaca

SEQ ID NO: 879897 - RNA, 18 nt, Human
gcggggcccaguguccgg

SEQ ID NO: 879898 - RNA, 19 nt, Human
uccugguggcuggaacgug

SEQ ID NO: 879899 - RNA, 24 nt, Human
ucuuuauuuugaaacaauaggugg

SEQ ID NO: 879900 - RNA, 22 nt, Human
uggccaaaggacagugugcgga

SEQ ID NO: 879901 - RNA, 20 nt, Human
uguccgguggccaaaggaca

SEQ ID NO: 879902 - RNA, 22 nt, Human
uugaaacaauagguggccuccu

SEQ ID NO: 879903 - RNA, 22 nt, Human
aaaugauauuaauagaaagucc

SEQ ID NO: 879904 - RNA, 21 nt, Human
aaaugcaaaagcuguaaagcu

SEQ ID NO: 879905 - RNA, 19 nt, Human
aauggcugagaauaaauac

SEQ ID NO: 879906 - RNA, 19 nt, Human
acccugcuacccagagagc

SEQ ID NO: 879907 - RNA, 25 nt, Human
acccugcuacccagagagccgcuaa

SEQ ID NO: 879908 - RNA, 24 nt, Human
acucuguauagaccacaguuauug

SEQ ID NO: 879909 - RNA, 25 nt, Human
agaauacccaaaguggcaacaagga

SEQ ID NO: 879910 - RNA, 19 nt, Human
agaauccgagcaccucucc

SEQ ID NO: 879911 - RNA, 18 nt, Human
agagagccgcuaaaaacc

SEQ ID NO: 879912 - RNA, 18 nt, Human
agcaccucuccgagcccc

SEQ ID NO: 879913 - RNA, 21 nt, Human
aguggcaacaaggaacguuug

SEQ ID NO: 879914 - RNA, 23 nt, Human
caaaagcuguaaagcuaagggca

SEQ ID NO: 879915 - RNA, 19 nt, Human
caagagaaaaucucagaau

SEQ ID NO: 879916 - RNA, 30 nt, Human
caccacccugcuacccagagagccgcuaaa

SEQ ID NO: 879917 - RNA, 23 nt, Human
cacccugcuacccagagagcccu

SEQ ID NO: 879918 - RNA, 20 nt, Human
cagcuacgagaauccgagca

SEQ ID NO: 879919 - RNA, 20 nt, Human
cagucugauuauaaagauac

SEQ ID NO: 879920 - RNA, 22 nt, Human
ccacccugcuacccagagagcc

SEQ ID NO: 879921 - RNA, 27 nt, Human
ccacccugcuacccagagagccgcuaa

SEQ ID NO: 879922 - RNA, 21 nt, Human
cccagagagccgcuaaaaacc

SEQ ID NO: 879923 - RNA, 22 nt, Human
ccccucgcugccgcuaucacac

SEQ ID NO: 879924 - RNA, 19 nt, Human
cgagaauccgagcaccucu

SEQ ID NO: 879925 - RNA, 24 nt, Human
cgcuaucacaccacccugcuaccc

SEQ ID NO: 879926 - RNA, 18 nt, Human
gaaaugcaaaagcuguaa

SEQ ID NO: 879927 - RNA, 19 nt, Human
gagaauccgagcaccucuc

SEQ ID NO: 879928 - RNA, 21 nt, Human
gccccucgcugccgcuaucac

SEQ ID NO: 879929 - RNA, 31 nt, Human
guagguuaaauuacccuauuuuuuauucugg

SEQ ID NO: 879930 - RNA, 23 nt, Human
uauaaagauacauaugcccaaaa

SEQ ID NO: 879931 - RNA, 21 nt, Human
uaucacaccacccugcuaccc

SEQ ID NO: 879932 - RNA, 22 nt, Human
uggcugagaauaaauacaacag

SEQ ID NO: 879933 - RNA, 21 nt, Human
uguaaagcuaagggcaugcaa

SEQ ID NO: 879934 - RNA, 21 nt, Human
uucagaaaaaaucgagcgaau

SEQ ID NO: 879935 - RNA, 26 nt, Human
aaacagaaaacaaaaaucucuuucug

SEQ ID NO: 879936 - RNA, 20 nt, Human
aaaucagaacucccagaagc

SEQ ID NO: 879937 - RNA, 22 nt, Human
aagcaaaagugcuggaccauuc

SEQ ID NO: 879938 - RNA, 18 nt, Human
accuaaaggacugaggaa

SEQ ID NO: 879939 - RNA, 23 nt, Human
aggucaaagccagcaacuaagga

SEQ ID NO: 879940 - RNA, 24 nt, Human
caacauaaaaggucaaagccagca

SEQ ID NO: 879941 - RNA, 18 nt, Human
caccccagguaauacaac

SEQ ID NO: 879942 - RNA, 18 nt, Human
cacuuuucagcuuugacc

SEQ ID NO: 879943 - RNA, 18 nt, Human
caggaagcugccuggguu

SEQ ID NO: 879944 - RNA, 18 nt, Human
cauaaaaggucaaagcca

SEQ ID NO: 879945 - RNA, 19 nt, Human
ccacuuuucagcuuugacc

SEQ ID NO: 879946 - RNA, 21 nt, Human
cccacggcccacuuugaugcu

SEQ ID NO: 879947 - RNA, 25 nt, Human
ccugccucggccaccucgccccgac

SEQ ID NO: 879948 - RNA, 20 nt, Human
cgccucuuccuagggacaag

SEQ ID NO: 879949 - RNA, 20 nt, Human
cugcaccucgaggucuccgc

SEQ ID NO: 879950 - RNA, 25 nt, Human
gaaaucagaacucccagaagcuuuu

SEQ ID NO: 879951 - RNA, 21 nt, Human
gcccacuuugaugcuccaaau

SEQ ID NO: 879952 - RNA, 20 nt, Human
gccucggccaccucgccccg

SEQ ID NO: 879953 - RNA, 18 nt, Human
uaaaacagaaaacaaaaa

SEQ ID NO: 879954 - RNA, 27 nt, Human
uaaaaggucaaagccagcaacuaagga

SEQ ID NO: 879955 - RNA, 22 nt, Human
uaaaggacugaggaaaucagaa

SEQ ID NO: 879956 - RNA, 23 nt, Human
uauggcaguugagaaaauagaug

SEQ ID NO: 879957 - RNA, 19 nt, Human
ucaaagccagcaacuaagg

SEQ ID NO: 879958 - RNA, 22 nt, Human
ucugcaguagacaccccaggua

SEQ ID NO: 879959 - RNA, 18 nt, Human
ucugucagcuuccuccug

SEQ ID NO: 879960 - RNA, 23 nt, Human
ugaaauaucugcaguagacaccc

SEQ ID NO: 879961 - RNA, 18 nt, Human
ugaggaaaucagaacucc

SEQ ID NO: 879962 - RNA, 18 nt, Human
ugccaggaagcugccugg

SEQ ID NO: 879963 - RNA, 20 nt, Human
ugccaggaagcugccugggu

SEQ ID NO: 879964 - RNA, 24 nt, Human
uggcacugccaggaagcugccugg

SEQ ID NO: 879965 - RNA, 23 nt, Human
uuaaaaauuucccgaccuucuga

SEQ ID NO: 879966 - RNA, 23 nt, Human
uuauggguacuccaagcccccua

SEQ ID NO: 879967 - RNA, 22 nt, Human
uucugucagcuuccuccuggcg

SEQ ID NO: 879968 - RNA, 26 nt, Human
uucuucaucauccuuauuugaugaaa

SEQ ID NO: 879969 - RNA, 22 nt, Human
uuuaaaaauuucccgaccuucu

SEQ ID NO: 879970 - RNA, 23 nt, Human
aauaaaaaagugcauagaaaaga

SEQ ID NO: 879971 - RNA, 20 nt, Human
aggcuaggggcaagauggca

SEQ ID NO: 879972 - RNA, 20 nt, Human
aggggcuagggagcccccag

SEQ ID NO: 879973 - RNA, 19 nt, Human
agugcauagaaaagaaggg

SEQ ID NO: 879974 - RNA, 21 nt, Human
cacccugaacaugaggguggg

SEQ ID NO: 879975 - RNA, 18 nt, Human
cagcgacggcagcaggag

SEQ ID NO: 879976 - RNA, 18 nt, Human
cccacauccacccugaac

SEQ ID NO: 879977 - RNA, 19 nt, Human
cccccaggcuaggggcaag

SEQ ID NO: 879978 - RNA, 19 nt, Human
cccccagggcagaaagggg

SEQ ID NO: 879979 - RNA, 19 nt, Human
ccugaacaugagggugggg

SEQ ID NO: 879980 - RNA, 21 nt, Human
ccugggcccccagggcagaaa

SEQ ID NO: 879981 - RNA, 22 nt, Human
cgacggcagcaggaggugugag

SEQ ID NO: 879982 - RNA, 21 nt, Human
gcaugcccacauccacccuga

SEQ ID NO: 879983 - RNA, 24 nt, Human
gcaugcccacauccacccugaaca

SEQ ID NO: 879984 - RNA, 19 nt, Human
gcucugggaggggcuaggg

SEQ ID NO: 879985 - RNA, 23 nt, Human
ggaggcagggcccuugucaccug

SEQ ID NO: 879986 - RNA, 20 nt, Human
ggcaagauggcagcgacggc

SEQ ID NO: 879987 - RNA, 23 nt, Human
ggcagaaagggggcgauugcugg

SEQ ID NO: 879988 - RNA, 23 nt, Human
ggcagcgacggcagcaggaggug

SEQ ID NO: 879989 - RNA, 21 nt, Human
gggcaagauggcagcgacggc

SEQ ID NO: 879990 - RNA, 21 nt, Human
ggggcaagauggcagcgacgg

SEQ ID NO: 879991 - RNA, 18 nt, Human
ggguggaggcagggcccu

SEQ ID NO: 879992 - RNA, 19 nt, Human
ggguggaggcagggcccuu

SEQ ID NO: 879993 - RNA, 23 nt, Human
gugggggugagaugcucugggag

SEQ ID NO: 879994 - RNA, 23 nt, Human
ugagaugcucugggaggggcuag

SEQ ID NO: 879995 - RNA, 24 nt, Human
ugagaugcucugggaggggcuagg

SEQ ID NO: 879996 - RNA, 23 nt, Human
ugagggugggggugagaugcucu

SEQ ID NO: 879997 - RNA, 21 nt, Human
uggcagcgacggcagcaggag

SEQ ID NO: 879998 - RNA, 22 nt, Human
uggcagcgacggcagcaggagg

SEQ ID NO: 879999 - RNA, 19 nt, Human
aaauggcaaugaccaaacc

SEQ ID NO: 880000 - RNA, 18 nt, Human
accaaaccaaauaaaaau

SEQ ID NO: 880001 - RNA, 21 nt, Human
auucugaacaguaauuguggc

SEQ ID NO: 880002 - RNA, 19 nt, Human
ccaaaccaaauaaaaaugg

SEQ ID NO: 880003 - RNA, 25 nt, Human
cccggcuccacacacccccucccca

SEQ ID NO: 880004 - RNA, 21 nt, Human
cuaaugaacaaccaauaaaaa

SEQ ID NO: 880005 - RNA, 22 nt, Human
cuaccagugguagguuuuuuuu

SEQ ID NO: 880006 - RNA, 24 nt, Human
cuccacacacccccuccccaaaca

SEQ ID NO: 880007 - RNA, 25 nt, Human
cuccgcaccuccgcgaacaggcgac

SEQ ID NO: 880008 - RNA, 18 nt, Human
gcaugccagccacagugc

SEQ ID NO: 880009 - RNA, 23 nt, Human
uaauaguucaguguggcauuauu

SEQ ID NO: 880010 - RNA, 23 nt, Human
uacuauggaguccuaugcauugg

SEQ ID NO: 880011 - RNA, 23 nt, Human
uagaaauagcuaccagugguagg

SEQ ID NO: 880012 - RNA, 24 nt, Human
uagguuuuuuuuuuuuuuugcaua

SEQ ID NO: 880013 - RNA, 24 nt, Human
uccccaaacagcagcgcgcagccu

SEQ ID NO: 880014 - RNA, 18 nt, Human
ucuccgcaccuccgcgaa

SEQ ID NO: 880015 - RNA, 25 nt, Human
ucucuaaugaacaaccaauaaaaau

SEQ ID NO: 880016 - RNA, 25 nt, Human
ugaacaaccaauaaaaauacaagau

SEQ ID NO: 880017 - RNA, 21 nt, Human
uggcaaugaccaaaccaaaua

SEQ ID NO: 880018 - RNA, 22 nt, Human
ugguauccaaaacacuggggca

SEQ ID NO: 880019 - RNA, 23 nt, Human
ugguauccaaaacacuggggcau

SEQ ID NO: 880020 - RNA, 25 nt, Human
uuagcuaauaaaagacauucugaac

SEQ ID NO: 880021 - RNA, 20 nt, Human
uuuaaugagaaccuuauugu

SEQ ID NO: 880022 - RNA, 23 nt, Human
aaaggcagccagaugaagugcua

SEQ ID NO: 880023 - RNA, 23 nt, Human
acaaagcaacaagaaaacuaauc

SEQ ID NO: 880024 - RNA, 26 nt, Human
acaaagcaacaagaaaacuaaucaaa

SEQ ID NO: 880025 - RNA, 25 nt, Human
aggcagccagaugaagugcuagaac

SEQ ID NO: 880026 - RNA, 23 nt, Human
aguuucuuguugcguuucuucau

SEQ ID NO: 880027 - RNA, 23 nt, Human
caaaacuaguuguguaccaacua

SEQ ID NO: 880028 - RNA, 23 nt, Human
caaacaaaagagcauauuucaac

SEQ ID NO: 880029 - RNA, 22 nt, Human
caacaaagcaacaagaaaacua

SEQ ID NO: 880030 - RNA, 23 nt, Human
caacaaagcaacaagaaaacuaa

SEQ ID NO: 880031 - RNA, 25 nt, Human
caacaaagcaacaagaaaacuaauc

SEQ ID NO: 880032 - RNA, 26 nt, Human
caacaaagcaacaagaaaacuaauca

SEQ ID NO: 880033 - RNA, 20 nt, Human
caacuauauuaaauucuuga

SEQ ID NO: 880034 - RNA, 20 nt, Human
caacuuguacaauaaaauca

SEQ ID NO: 880035 - RNA, 24 nt, Human
cacguuccgcacaggagucaggag

SEQ ID NO: 880036 - RNA, 18 nt, Human
cagugcaacaaagcaaca

SEQ ID NO: 880037 - RNA, 20 nt, Human
cccaccuccccuccaccgcc

SEQ ID NO: 880038 - RNA, 19 nt, Human
ccccccaccuccccuccac

SEQ ID NO: 880039 - RNA, 26 nt, Human
ccccccaccuccccuccaccgccucc

SEQ ID NO: 880040 - RNA, 21 nt, Human
cccuccaccgccuccuccgcc

SEQ ID NO: 880041 - RNA, 18 nt, Human
ccuccuccgccuccuccu

SEQ ID NO: 880042 - RNA, 19 nt, Human
ccuccuccuccucagcguc

SEQ ID NO: 880043 - RNA, 28 nt, Human
ccuugcugauuccccccaccuccccucc

SEQ ID NO: 880044 - RNA, 24 nt, Human
cucagcgucuucccuccccaccuc

SEQ ID NO: 880045 - RNA, 18 nt, Human
cuccccuccaccgccucc

SEQ ID NO: 880046 - RNA, 23 nt, Human
cuccuccuccuccucagcgucuu

SEQ ID NO: 880047 - RNA, 20 nt, Human
gcaacaaagcaacaagaaaa

SEQ ID NO: 880048 - RNA, 18 nt, Human
gcaagcauacuguaaccc

SEQ ID NO: 880049 - RNA, 18 nt, Human
gcagcaauuaauccuuug

SEQ ID NO: 880050 - RNA, 24 nt, Human
uaaauucuugaguugauaaacaua

SEQ ID NO: 880051 - RNA, 27 nt, Human
uaaauuuucuuuccauguucaaaaaac

SEQ ID NO: 880052 - RNA, 20 nt, Human
uaagggguaggggcauggga

SEQ ID NO: 880053 - RNA, 18 nt, Human
uacaauaaaaucaaguag

SEQ ID NO: 880054 - RNA, 23 nt, Human
uagaacagcaggauaggcagugg

SEQ ID NO: 880055 - RNA, 23 nt, Human
uauuaaauuuucuuuccauguuc

SEQ ID NO: 880056 - RNA, 18 nt, Human
uccccuccaccgccuccu

SEQ ID NO: 880057 - RNA, 22 nt, Human
uccccuccaccgccuccuccgc

SEQ ID NO: 880058 - RNA, 24 nt, Human
uccucagcgucuucccuccccacc

SEQ ID NO: 880059 - RNA, 20 nt, Human
uccuccucagcgucuucccu

SEQ ID NO: 880060 - RNA, 21 nt, Human
ugacuuagagcaagcauacug

SEQ ID NO: 880061 - RNA, 21 nt, Human
ugcguuucuucauagcuguag

SEQ ID NO: 880062 - RNA, 20 nt, Human
uuccauguucaaaaaacugg

SEQ ID NO: 880063 - RNA, 20 nt, Human
uuccccccaccuccccucca

SEQ ID NO: 880064 - RNA, 24 nt, Human
uuccccccaccuccccuccaccgc

SEQ ID NO: 880065 - RNA, 19 nt, Human
uuggaauuugacuuagagc

SEQ ID NO: 880066 - RNA, 22 nt, Human
uuuugcuauuugcaucuccaau

SEQ ID NO: 880067 - RNA, 19 nt, Human
aaaaaaaccgacgagagcg

SEQ ID NO: 880068 - RNA, 23 nt, Human
aaaaaaaccgacgagagcgcagg

SEQ ID NO: 880069 - RNA, 22 nt, Human
aaacaucaacaggccagacccc

SEQ ID NO: 880070 - RNA, 24 nt, Human
aaacaucaacaggccagaccccac

SEQ ID NO: 880071 - RNA, 20 nt, Human
accccacuuccuccagccag

SEQ ID NO: 880072 - RNA, 18 nt, Human
acccccaccugccaccca

SEQ ID NO: 880073 - RNA, 21 nt, Human
accgcaguccggcuccgcggg

SEQ ID NO: 880074 - RNA, 20 nt, Human
agagcaaucugguccuccag

SEQ ID NO: 880075 - RNA, 19 nt, Human
agaugaagagccccuucau

SEQ ID NO: 880076 - RNA, 20 nt, Human
agcaaucugguccuccagga

SEQ ID NO: 880077 - RNA, 23 nt, Human
agccaguggggccccggagucca

SEQ ID NO: 880078 - RNA, 21 nt, Human
aggaggcccugggaggagggg

SEQ ID NO: 880079 - RNA, 24 nt, Human
aggaggcccugggaggagggggac

SEQ ID NO: 880080 - RNA, 21 nt, Human
aggcugcccugcccugcccag

SEQ ID NO: 880081 - RNA, 30 nt, Human
auaauccuaaaaaaaccgacgagagcgcag

SEQ ID NO: 880082 - RNA, 21 nt, Human
caaaggucccccaggaggccc

SEQ ID NO: 880083 - RNA, 18 nt, Human
caacaggccagaccccac

SEQ ID NO: 880084 - RNA, 23 nt, Human
caacaggccagaccccacuuccu

SEQ ID NO: 880085 - RNA, 18 nt, Human
caagucaggugccuagcc

SEQ ID NO: 880086 - RNA, 19 nt, Human
caagucaggugccuagccc

SEQ ID NO: 880087 - RNA, 18 nt, Human
cacccacuccccaacaag

SEQ ID NO: 880088 - RNA, 21 nt, Human
caccccacagccugcucaguc

SEQ ID NO: 880089 - RNA, 21 nt, Human
caccccacagccugcucaguc

SEQ ID NO: 880090 - RNA, 18 nt, Human
caccugccacccacuccc

SEQ ID NO: 880091 - RNA, 20 nt, Human
cacuccccaacaaggguccc

SEQ ID NO: 880092 - RNA, 23 nt, Human
cacugcguggcucgguggagggu

SEQ ID NO: 880093 - RNA, 22 nt, Human
cagcagcccacccccaccugcc

SEQ ID NO: 880094 - RNA, 18 nt, Human
cagcccacccccaccugc

SEQ ID NO: 880095 - RNA, 21 nt, Human
cagucagucaacuccaggcac

SEQ ID NO: 880096 - RNA, 21 nt, Human
cauguaaacaucaacaggccu

SEQ ID NO: 880097 - RNA, 19 nt, Human
ccacccacuccccaacaag

SEQ ID NO: 880098 - RNA, 19 nt, Human
ccagggcccugguccuccc

SEQ ID NO: 880099 - RNA, 22 nt, Human
cccacccccaccugccacccac

SEQ ID NO: 880100 - RNA, 21 nt, Human
cccaccugccacccacucccc

SEQ ID NO: 880101 - RNA, 22 nt, Human
cccaccugccacccacucccca

SEQ ID NO: 880102 - RNA, 20 nt, Human
cccagccaagucaggugccu

SEQ ID NO: 880103 - RNA, 18 nt, Human
ccccacuuccuccagcca

SEQ ID NO: 880104 - RNA, 21 nt, Human
cccccaccugccacccacucc

SEQ ID NO: 880105 - RNA, 22 nt, Human
ccccuucaucuucacacgggug

SEQ ID NO: 880106 - RNA, 23 nt, Human
ccuagcccagacccugcccuggc

SEQ ID NO: 880107 - RNA, 19 nt, Human
ccucagcagcagggcugcu

SEQ ID NO: 880108 - RNA, 18 nt, Human
ccuucaucuucacacggg

SEQ ID NO: 880109 - RNA, 25 nt, Human
cgccccaaccgcaguccggcuccgc

SEQ ID NO: 880110 - RNA, 22 nt, Human
cucuggaagugguggcgacagg

SEQ ID NO: 880111 - RNA, 21 nt, Human
gacaggacccuggcccgcagg

SEQ ID NO: 880112 - RNA, 21 nt, Human
gagcgcaggcagaugaagagc

SEQ ID NO: 880113 - RNA, 22 nt, Human
gaggagggggacagccugggag

SEQ ID NO: 880114 - RNA, 21 nt, Human
gcagcgcgagcccaacuggca

SEQ ID NO: 880115 - RNA, 26 nt, Human
ggcucuucccgccccaaccgcagucc

SEQ ID NO: 880116 - RNA, 19 nt, Human
gggcccugguccuccccag

SEQ ID NO: 880117 - RNA, 18 nt, Human
gggcggggagggcgcggc

SEQ ID NO: 880118 - RNA, 22 nt, Human
uaaaaaaaccgacgagagcgca

SEQ ID NO: 880119 - RNA, 25 nt, Human
uaaaaaaaccgacgagagcgcaggc

SEQ ID NO: 880120 - RNA, 29 nt, Human
uaauccuaaaaaaaccgacgagagcgcag

SEQ ID NO: 880121 - RNA, 24 nt, Human
ucaacaggccagaccccacuuccu

SEQ ID NO: 880122 - RNA, 24 nt, Human
ucagccacggccccggcucuuccc

SEQ ID NO: 880123 - RNA, 24 nt, Human
ucccagacucuuucaauaauccua

SEQ ID NO: 880124 - RNA, 21 nt, Human
ucccaugugggcagcgcgagc

SEQ ID NO: 880125 - RNA, 22 nt, Human
uccccaacaagggucccagacu

SEQ ID NO: 880126 - RNA, 18 nt, Human
ugcccugcccugcccagg

SEQ ID NO: 880127 - RNA, 28 nt, Human
uggcaagguggggcagagcaaucugguc

SEQ ID NO: 880128 - RNA, 23 nt, Human
uggcucgguggagggugacagcc

SEQ ID NO: 880129 - RNA, 19 nt, Human
uggcuuaauacaaaggucc

SEQ ID NO: 880130 - RNA, 22 nt, Human
uggggccaggucccaugugggc

SEQ ID NO: 880131 - RNA, 23 nt, Human
uggggccaggucccaugugggca

SEQ ID NO: 880132 - RNA, 23 nt, Human
uguaaacaucaacaggccagacc

SEQ ID NO: 880133 - RNA, 22 nt, Human
uuccuccagccaguggggcccc

SEQ ID NO: 880134 - RNA, 19 nt, Human
uuucuggcucuggaagugg

SEQ ID NO: 880135 - RNA, 22 nt, Human
aaaaaaaaaaaaaagagagaaa

SEQ ID NO: 880136 - RNA, 19 nt, Human
aaaaaaaaaaaaagagaga

SEQ ID NO: 880137 - RNA, 18 nt, Human
aaaaaaaaaaaagagaga

SEQ ID NO: 880138 - RNA, 23 nt, Human
aaaagagagaaaaauagcacaaa

SEQ ID NO: 880139 - RNA, 19 nt, Human
aaagagagaaaaauagcac

SEQ ID NO: 880140 - RNA, 21 nt, Human
aaagagagaaaaauagcacaa

SEQ ID NO: 880141 - RNA, 18 nt, Human
aacugcuugaacccggga

SEQ ID NO: 880142 - RNA, 21 nt, Human
aagauggugaaacccugucuc

SEQ ID NO: 880143 - RNA, 20 nt, Human
aaguccucagcaaaaagucu

SEQ ID NO: 880144 - RNA, 18 nt, Human
aaugugauucuguucacu

SEQ ID NO: 880145 - RNA, 21 nt, Human
acaacuucuuuggcucguauu

SEQ ID NO: 880146 - RNA, 23 nt, Human
acacccauuuccuuucacauaca

SEQ ID NO: 880147 - RNA, 25 nt, Human
accccaaaacauuuccuaaagucuc

SEQ ID NO: 880148 - RNA, 24 nt, Human
acccugucucuacugaaaauacaa

SEQ ID NO: 880149 - RNA, 22 nt, Human
agaccucugcggucaagacccu

SEQ ID NO: 880150 - RNA, 27 nt, Human
agagaaaaauagcacaauugaguaggg

SEQ ID NO: 880151 - RNA, 18 nt, Human
agagguugcagugagcug

SEQ ID NO: 880152 - RNA, 20 nt, Human
agagguugcagugagcuggc

SEQ ID NO: 880153 - RNA, 24 nt, Human
agcacuuugggaggcugaggccgg

SEQ ID NO: 880154 - RNA, 19 nt, Human
aggaaugguggcaggcacc

SEQ ID NO: 880155 - RNA, 24 nt, Human
aggaaugguggcaggcaccuguaa

SEQ ID NO: 880156 - RNA, 23 nt, Human
aggcagagaacugcuugaacccg

SEQ ID NO: 880157 - RNA, 20 nt, Human
aggcagagguugcagugagc

SEQ ID NO: 880158 - RNA, 24 nt, Human
aggcagagguugcagugagcugag

SEQ ID NO: 880159 - RNA, 20 nt, Human
aggccgguggaucccgaggu

SEQ ID NO: 880160 - RNA, 24 nt, Human
aggccgguggaucccgaggucagg

SEQ ID NO: 880161 - RNA, 23 nt, Human
aggcugaggcagagaacugcuug

SEQ ID NO: 880162 - RNA, 20 nt, Human
auagaguauuccaccacccc

SEQ ID NO: 880163 - RNA, 24 nt, Human
auagaguauuccaccaccccaaaa

SEQ ID NO: 880164 - RNA, 24 nt, Human
augcgcugcacuccagccugggca

SEQ ID NO: 880165 - RNA, 25 nt, Human
caaaaaaaaaaaaaagagagaaaaa

SEQ ID NO: 880166 - RNA, 24 nt, Human
caagauggugaaacccugucucua

SEQ ID NO: 880167 - RNA, 20 nt, Human
caaucacuggacaccaggaa

SEQ ID NO: 880168 - RNA, 23 nt, Human
caccaccccaaaacauuuccuaa

SEQ ID NO: 880169 - RNA, 18 nt, Human
cacccauaaggacacuca

SEQ ID NO: 880170 - RNA, 21 nt, Human
caccuggaaacgcagagaggc

SEQ ID NO: 880171 - RNA, 23 nt, Human
caccuguaaucccagcuacuugg

SEQ ID NO: 880172 - RNA, 24 nt, Human
caccuguaaucccagcuacuuggg

SEQ ID NO: 880173 - RNA, 24 nt, Human
cacgucuguaaucccagcacuuug

SEQ ID NO: 880174 - RNA, 25 nt, Human
cagcacuuugggaggcugaggccgg

SEQ ID NO: 880175 - RNA, 20 nt, Human
cagcauagacugggcgaggg

SEQ ID NO: 880176 - RNA, 24 nt, Human
cagcuacuugggaggcugaggcag

SEQ ID NO: 880177 - RNA, 22 nt, Human
caggagggcccuguucauuucc

SEQ ID NO: 880178 - RNA, 18 nt, Human
caggccaagauggugaaa

SEQ ID NO: 880179 - RNA, 21 nt, Human
ccaagauggugaaacccuguc

SEQ ID NO: 880180 - RNA, 24 nt, Human
ccaccccaaaacauuuccuaaagu

SEQ ID NO: 880181 - RNA, 24 nt, Human
ccaggccaagauggugaaacccug

SEQ ID NO: 880182 - RNA, 21 nt, Human
ccaugcgcugcacuccagccu

SEQ ID NO: 880183 - RNA, 19 nt, Human
cccgaggucaggaguucaa

SEQ ID NO: 880184 - RNA, 25 nt, Human
ccucugaacugccuacauguggcuc

SEQ ID NO: 880185 - RNA, 21 nt, Human
ccucugcggucaaguagaaau

SEQ ID NO: 880186 - RNA, 21 nt, Human
ccuguaaucccagcuacuugg

SEQ ID NO: 880187 - RNA, 21 nt, Human
cgcugcacuccagccugggca

SEQ ID NO: 880188 - RNA, 23 nt, Human
cgcugcacuccagccugggcaac

SEQ ID NO: 880189 - RNA, 24 nt, Human
cgcugcacuccagccugggcaacu

SEQ ID NO: 880190 - RNA, 24 nt, Human
cgggaggcagagguugcagugagc

SEQ ID NO: 880191 - RNA, 24 nt, Human
cgguggaucccgaggucaggaguu

SEQ ID NO: 880192 - RNA, 24 nt, Human
cucaaaaaaaaaaaaaagagagaa

SEQ ID NO: 880193 - RNA, 25 nt, Human
cucaaaaaaaaaaaaaagagagaaa

SEQ ID NO: 880194 - RNA, 24 nt, Human
cucacgucuguaaucccagcacuu

SEQ ID NO: 880195 - RNA, 19 nt, Human
cucagagucacacccauuu

SEQ ID NO: 880196 - RNA, 19 nt, Human
cuccgucucaaaaaaaaaa

SEQ ID NO: 880197 - RNA, 21 nt, Human
cuccugaaucagaauuaaaaa

SEQ ID NO: 880198 - RNA, 18 nt, Human
cugcacuccagccugggc

SEQ ID NO: 880199 - RNA, 20 nt, Human
cugcacuccagccugggcaa

SEQ ID NO: 880200 - RNA, 21 nt, Human
cugcacuccagccugggcaac

SEQ ID NO: 880201 - RNA, 24 nt, Human
cugcuugaacccgggaggcagagg

SEQ ID NO: 880202 - RNA, 21 nt, Human
cuguaaucccagcacuuuggg

SEQ ID NO: 880203 - RNA, 21 nt, Human
cuguaaucccagcuacuuggg

SEQ ID NO: 880204 - RNA, 22 nt, Human
cugucucuacuccaccuggaaa

SEQ ID NO: 880205 - RNA, 25 nt, Human
cugucucuacuccaccuggaaacgc

SEQ ID NO: 880206 - RNA, 19 nt, Human
cuucagaccucugcgguca

SEQ ID NO: 880207 - RNA, 25 nt, Human
gaaucagaauuaaaaaggcuuccuc

SEQ ID NO: 880208 - RNA, 24 nt, Human
gaccaugcgcugcacuccagccug

SEQ ID NO: 880209 - RNA, 22 nt, Human
gagaccaugcgcugcacuccag

SEQ ID NO: 880210 - RNA, 24 nt, Human
gaucccgaggucaggaguucaaga

SEQ ID NO: 880211 - RNA, 24 nt, Human
gcaguauccuggaaaaauaagcac

SEQ ID NO: 880212 - RNA, 24 nt, Human
gccaagauggugaaacccugucuc

SEQ ID NO: 880213 - RNA, 21 nt, Human
gcgcugcacuccagccugggc

SEQ ID NO: 880214 - RNA, 24 nt, Human
gcgcugcacuccagccugggcaac

SEQ ID NO: 880215 - RNA, 24 nt, Human
ggcaccuguaaucccagcuacuug

SEQ ID NO: 880216 - RNA, 23 nt, Human
ggcacgguggcucacgucuguaa

SEQ ID NO: 880217 - RNA, 19 nt, Human
ggccaagauggugaaaccc

SEQ ID NO: 880218 - RNA, 21 nt, Human
ggccgggcacgguggcucacg

SEQ ID NO: 880219 - RNA, 24 nt, Human
gguggcaggcaccuguaaucccag

SEQ ID NO: 880220 - RNA, 23 nt, Human
gguggcucacgucuguaauccca

SEQ ID NO: 880221 - RNA, 24 nt, Human
gguggcucacgucuguaaucccag

SEQ ID NO: 880222 - RNA, 20 nt, Human
gucucaaaaaaaaaaaaaag

SEQ ID NO: 880223 - RNA, 21 nt, Human
gugaaacccugucucuacuga

SEQ ID NO: 880224 - RNA, 33 nt, Human
gugauucuguucacuguucucuucucaccccac

SEQ ID NO: 880225 - RNA, 23 nt, Human
guggaucccgaggucaggaguuc

SEQ ID NO: 880226 - RNA, 19 nt, Human
guucacuguucucuucuca

SEQ ID NO: 880227 - RNA, 19 nt, Human
guugcagugagcugagacc

SEQ ID NO: 880228 - RNA, 26 nt, Human
uaaaaaggcuuccucagagucacacc

SEQ ID NO: 880229 - RNA, 21 nt, Human
uacuccaccuggaaacgcaga

SEQ ID NO: 880230 - RNA, 24 nt, Human
uagcuggaacaacuucuuuggcuc

SEQ ID NO: 880231 - RNA, 22 nt, Human
uagggccccuuccaaucuucag

SEQ ID NO: 880232 - RNA, 21 nt, Human
uaguucuggaucacagaaccu

SEQ ID NO: 880233 - RNA, 19 nt, Human
uauuccaccaccccaaaac

SEQ ID NO: 880234 - RNA, 18 nt, Human
ucagccaggccaagaugg

SEQ ID NO: 880235 - RNA, 24 nt, Human
ucccagcaacucuagcuggaacaa

SEQ ID NO: 880236 - RNA, 24 nt, Human
ucccgaggucaggaguucaagauc

SEQ ID NO: 880237 - RNA, 22 nt, Human
uccgucucaaaaaaaaaaaaaa

SEQ ID NO: 880238 - RNA, 23 nt, Human
uccgucucaaaaaaaaaaaaaag

SEQ ID NO: 880239 - RNA, 21 nt, Human
ucucuacccauuacugucucu

SEQ ID NO: 880240 - RNA, 21 nt, Human
ucucuacugaaaauacaaaaa

SEQ ID NO: 880241 - RNA, 18 nt, Human
ucucuugcacccauaagg

SEQ ID NO: 880242 - RNA, 19 nt, Human
ucugaacugccuacaugug

SEQ ID NO: 880243 - RNA, 21 nt, Human
ugaaaauacaaaaauuagcca

SEQ ID NO: 880244 - RNA, 23 nt, Human
ugaggcagagaacugcuugaacc

SEQ ID NO: 880245 - RNA, 24 nt, Human
ugaggcagagaacugcuugaaccc

SEQ ID NO: 880246 - RNA, 24 nt, Human
ugaggccgguggaucccgagguca

SEQ ID NO: 880247 - RNA, 18 nt, Human
ugaguagggccccuucca

SEQ ID NO: 880248 - RNA, 23 nt, Human
ugcaguauccuggaaaaauaagc

SEQ ID NO: 880249 - RNA, 22 nt, Human
ugcgcugcacuccagccugggc

SEQ ID NO: 880250 - RNA, 22 nt, Human
uggaaaaauaagcacaggaggg

SEQ ID NO: 880251 - RNA, 18 nt, Human
uggaaacgcagagaggca

SEQ ID NO: 880252 - RNA, 22 nt, Human
uggaacaaaaucaaguggcauc

SEQ ID NO: 880253 - RNA, 22 nt, Human
uggaacaacuucuuuggcucgu

SEQ ID NO: 880254 - RNA, 19 nt, Human
uggacugacugcccaucag

SEQ ID NO: 880255 - RNA, 22 nt, Human
uggaucccgaggucaggaguuc

SEQ ID NO: 880256 - RNA, 22 nt, Human
uggcucacgucuguaaucccag

SEQ ID NO: 880257 - RNA, 24 nt, Human
uggcucacgucuguaaucccagca

SEQ ID NO: 880258 - RNA, 19 nt, Human
ugggaggcugaggcagaga

SEQ ID NO: 880259 - RNA, 24 nt, Human
ugguggcaggcaccuguaauccca

SEQ ID NO: 880260 - RNA, 24 nt, Human
uguccuguagagaaauagcaggau

SEQ ID NO: 880261 - RNA, 19 nt, Human
uucaagaucagccaggcca

SEQ ID NO: 880262 - RNA, 18 nt, Human
uugcagugagcugagacc

SEQ ID NO: 880263 - RNA, 21 nt, Human
uugcagugagcugagaccaug

SEQ ID NO: 880264 - RNA, 24 nt, Human
uugcagugagcugagaccaugcgc

SEQ ID NO: 880265 - RNA, 18 nt, Human
uugggaggcugaggcaga

SEQ ID NO: 880266 - RNA, 18 nt, Human
uuuuuuuuuuuuagaguc

SEQ ID NO: 880267 - RNA, 30 nt, Human
aaaaaaaaaaaaacacaauauaugagaaga

SEQ ID NO: 880268 - RNA, 28 nt, Human
aaaaaaaaaaacacaauauaugagaaga

SEQ ID NO: 880269 - RNA, 22 nt, Human
aaaaaaaaaacacaauauauga

SEQ ID NO: 880270 - RNA, 24 nt, Human
aaaaaaaaaacacaauauaugaga

SEQ ID NO: 880271 - RNA, 20 nt, Human
aaaaauuuacaaaaaacuaa

SEQ ID NO: 880272 - RNA, 23 nt, Human
aaacacaauauaugagaagaugc

SEQ ID NO: 880273 - RNA, 19 nt, Human
aaauaucacuccacugagc

SEQ ID NO: 880274 - RNA, 22 nt, Human
aaggcauagagaaaaaguugga

SEQ ID NO: 880275 - RNA, 18 nt, Human
aauuuucuucuuaaaaag

SEQ ID NO: 880276 - RNA, 19 nt, Human
acaaaaaacuaaaguuucu

SEQ ID NO: 880277 - RNA, 22 nt, Human
acaaauccaaguaacaacuuua

SEQ ID NO: 880278 - RNA, 24 nt, Human
acaguaaaacaacaggcauccaga

SEQ ID NO: 880279 - RNA, 22 nt, Human
accccacucccaagugccauaa

SEQ ID NO: 880280 - RNA, 19 nt, Human
acugcaguuuuuaaaaauu

SEQ ID NO: 880281 - RNA, 21 nt, Human
agaagaugcaaaggaaaggca

SEQ ID NO: 880282 - RNA, 19 nt, Human
agaugcaaaggaaaggcag

SEQ ID NO: 880283 - RNA, 21 nt, Human
auacagaaaaaacauuuaucc

SEQ ID NO: 880284 - RNA, 19 nt, Human
auagaaacaauuuucuucu

SEQ ID NO: 880285 - RNA, 18 nt, Human
aucacugguaaaccaagc

SEQ ID NO: 880286 - RNA, 23 nt, Human
augaaacaugguaaaaaguagug

SEQ ID NO: 880287 - RNA, 19 nt, Human
caaagcaacuauuaacaac

SEQ ID NO: 880288 - RNA, 20 nt, Human
cacaauauaugagaagaugc

SEQ ID NO: 880289 - RNA, 21 nt, Human
caccaaacaggcaauacaacu

SEQ ID NO: 880290 - RNA, 22 nt, Human
caccaacaagagagauuaauca

SEQ ID NO: 880291 - RNA, 22 nt, Human
caccggcggccgggcgcgcggc

SEQ ID NO: 880292 - RNA, 22 nt, Human
cacuguggaaagagacccugaa

SEQ ID NO: 880293 - RNA, 27 nt, Human
cagaaaaaacauuuauccacuguggaa

SEQ ID NO: 880294 - RNA, 18 nt, Human
cagaaaugugaauuuaug

SEQ ID NO: 880295 - RNA, 23 nt, Human
caguaaaacaacaggcauccaga

SEQ ID NO: 880296 - RNA, 25 nt, Human
cauuacuaggaaacaggcaauauca

SEQ ID NO: 880297 - RNA, 26 nt, Human
ccagcagauggccaucacaacaauac

SEQ ID NO: 880298 - RNA, 23 nt, Human
ccuuuauacuuucacaguaauua

SEQ ID NO: 880299 - RNA, 19 nt, Human
cgcggcccucaugggcuug

SEQ ID NO: 880300 - RNA, 21 nt, Human
cuaaaggcaagccuauuucau

SEQ ID NO: 880301 - RNA, 20 nt, Human
cucaccccacucccaagugc

SEQ ID NO: 880302 - RNA, 18 nt, Human
gaagagaauguggcaaag

SEQ ID NO: 880303 - RNA, 22 nt, Human
gaauguugacugcuugcugcaa

SEQ ID NO: 880304 - RNA, 23 nt, Human
gcugcaaaaauuuacaacaugaa

SEQ ID NO: 880305 - RNA, 22 nt, Human
ggaaacaggcaauaucagcacc

SEQ ID NO: 880306 - RNA, 21 nt, Human
ggaaagagacccugaagagaa

SEQ ID NO: 880307 - RNA, 23 nt, Human
guaaaccaagcuaggucaaguau

SEQ ID NO: 880308 - RNA, 20 nt, Human
guaguaaaaucuguaaaauu

SEQ ID NO: 880309 - RNA, 21 nt, Human
gugaggcagaaaauuccagaa

SEQ ID NO: 880310 - RNA, 21 nt, Human
gugcaguuauuuuuuuucuuu

SEQ ID NO: 880311 - RNA, 19 nt, Human
uaaaaaagaaccauguuau

SEQ ID NO: 880312 - RNA, 22 nt, Human
uaaaacaacaggcauccagaug

SEQ ID NO: 880313 - RNA, 21 nt, Human
uaagagguuggcagaaaaguu

SEQ ID NO: 880314 - RNA, 24 nt, Human
uacacaguaaaacaacaggcaucc

SEQ ID NO: 880315 - RNA, 18 nt, Human
uacagcacaauuuuuaca

SEQ ID NO: 880316 - RNA, 20 nt, Human
uacagcacaauuuuuacauu

SEQ ID NO: 880317 - RNA, 25 nt, Human
uaccuugccuauuuaacucgccagc

SEQ ID NO: 880318 - RNA, 24 nt, Human
ucaccccacucccaagugccauaa

SEQ ID NO: 880319 - RNA, 19 nt, Human
ucagaagagguauaauguu

SEQ ID NO: 880320 - RNA, 19 nt, Human
uccucgggggccaggagcu

SEQ ID NO: 880321 - RNA, 22 nt, Human
ucuaggaaaaaaaaaaaaaaac

SEQ ID NO: 880322 - RNA, 24 nt, Human
ucuaggaaaaaaaaaaaaaaacac

SEQ ID NO: 880323 - RNA, 22 nt, Human
ucucaccccacucccaagugcc

SEQ ID NO: 880324 - RNA, 23 nt, Human
ucucaccccacucccaagugcca

SEQ ID NO: 880325 - RNA, 21 nt, Human
ucuguccaugauucuuuaccu

SEQ ID NO: 880326 - RNA, 18 nt, Human
uggaaagagacccugaag

SEQ ID NO: 880327 - RNA, 19 nt, Human
uggcaaaggcauagagaaa

SEQ ID NO: 880328 - RNA, 26 nt, Human
ugggaaaguaauagaaacaauuuucu

SEQ ID NO: 880329 - RNA, 24 nt, Human
uguaaguucuguccaugauucuuu

SEQ ID NO: 880330 - RNA, 22 nt, Human
ugugcaauguuuagcucucacc

SEQ ID NO: 880331 - RNA, 22 nt, Human
uuaaaacaccaacaagagagau

SEQ ID NO: 880332 - RNA, 21 nt, Human
uuaaaugaauccacaaaguua

SEQ ID NO: 880333 - RNA, 20 nt, Human
uuagcucucaccccacuccc

SEQ ID NO: 880334 - RNA, 21 nt, Human
uucaaaagauauaaagucagu

SEQ ID NO: 880335 - RNA, 22 nt, Human
uucaaaagauauaaagucagug

SEQ ID NO: 880336 - RNA, 23 nt, Human
uuuaaaauaaauaucaaacugac

SEQ ID NO: 880337 - RNA, 21 nt, Human
uuugguugguguuaucacugg

SEQ ID NO: 880338 - RNA, 24 nt, Human
acacugggucgccgcuagcugcac

SEQ ID NO: 880339 - RNA, 23 nt, Human
agauacuggaagacaaugcaccu

SEQ ID NO: 880340 - RNA, 18 nt, Human
agcagcgggugggcgugg

SEQ ID NO: 880341 - RNA, 23 nt, Human
aggcaggcuuggcaugguuggcc

SEQ ID NO: 880342 - RNA, 18 nt, Human
aguugauugucucuacag

SEQ ID NO: 880343 - RNA, 18 nt, Human
augcaccuugaagggugg

SEQ ID NO: 880344 - RNA, 19 nt, Human
augcaccuugaaggguggg

SEQ ID NO: 880345 - RNA, 24 nt, Human
cacccuaggccaggcgcagaggcc

SEQ ID NO: 880346 - RNA, 23 nt, Human
cacugggucgccgcuagcugcac

SEQ ID NO: 880347 - RNA, 19 nt, Human
cagaguugugacgggggca

SEQ ID NO: 880348 - RNA, 18 nt, Human
cagcgcggcagggccuug

SEQ ID NO: 880349 - RNA, 19 nt, Human
cccaucagcagggcucugg

SEQ ID NO: 880350 - RNA, 19 nt, Human
ccuccgagcagcggguggg

SEQ ID NO: 880351 - RNA, 21 nt, Human
ccuccgagcagcgggugggcg

SEQ ID NO: 880352 - RNA, 19 nt, Human
cgcuagcugcaccuucgca

SEQ ID NO: 880353 - RNA, 19 nt, Human
cuacagaguugugacgggg

SEQ ID NO: 880354 - RNA, 18 nt, Human
cugaagcuguagauacug

SEQ ID NO: 880355 - RNA, 21 nt, Human
cugcacccuaggccaggcgca

SEQ ID NO: 880356 - RNA, 18 nt, Human
gcaugguuggccggggcg

SEQ ID NO: 880357 - RNA, 20 nt, Human
ggcagguggcugcacccuag

SEQ ID NO: 880358 - RNA, 23 nt, Human
ucagcagggcucuggacgggaga

SEQ ID NO: 880359 - RNA, 19 nt, Human
ucccugggugucaggcagg

SEQ ID NO: 880360 - RNA, 24 nt, Human
ucccugggugucaggcagguggcu

SEQ ID NO: 880361 - RNA, 24 nt, Human
ucucuacagaguugugacgggggc

SEQ ID NO: 880362 - RNA, 21 nt, Human
ugaaagcauuuacuuagcuca

SEQ ID NO: 880363 - RNA, 24 nt, Human
ugaaagcauuuacuuagcucaagu

SEQ ID NO: 880364 - RNA, 20 nt, Human
uggcaugguuggccggggcg

SEQ ID NO: 880365 - RNA, 21 nt, Human
uggcaugguuggccggggcgg

SEQ ID NO: 880366 - RNA, 20 nt, Human
ugugaagggggcuccggucc

SEQ ID NO: 880367 - RNA, 19 nt, Human
ugugacgggggcacugagc

SEQ ID NO: 880368 - RNA, 21 nt, Human
uuuuuugaaagcauuuacuua

SEQ ID NO: 880369 - RNA, 18 nt, Human
uuuuuuuuuuuuuuuuug

SEQ ID NO: 880370 - RNA, 19 nt, Human
aagggccuggcuggccaga

SEQ ID NO: 880371 - RNA, 22 nt, Human
agcagggaaacccaggcuuguu

SEQ ID NO: 880372 - RNA, 23 nt, Human
agccuaggccaaugcacccacaa

SEQ ID NO: 880373 - RNA, 27 nt, Human
agcuguacgaccccagccuagggcccu

SEQ ID NO: 880374 - RNA, 21 nt, Human
agggaguaguuugcccaggac

SEQ ID NO: 880375 - RNA, 21 nt, Human
aguggauagagagggcucugg

SEQ ID NO: 880376 - RNA, 26 nt, Human
cacccacaacuucagcuguacgaccc

SEQ ID NO: 880377 - RNA, 20 nt, Human
cacccugggcacagccccca

SEQ ID NO: 880378 - RNA, 21 nt, Human
cagagcugccccucagacccu

SEQ ID NO: 880379 - RNA, 18 nt, Human
cagcagggaaacccaggc

SEQ ID NO: 880380 - RNA, 23 nt, Human
cagcccccauaauucccugcccc

SEQ ID NO: 880381 - RNA, 24 nt, Human
caggggcuccuccuggcauggucc

SEQ ID NO: 880382 - RNA, 21 nt, Human
ccacaggggcuccuccuggca

SEQ ID NO: 880383 - RNA, 18 nt, Human
ccagaccaaguggauaga

SEQ ID NO: 880384 - RNA, 19 nt, Human
ccagccaggaguggagcug

SEQ ID NO: 880385 - RNA, 21 nt, Human
cccacagagggugccggguuc

SEQ ID NO: 880386 - RNA, 23 nt, Human
cccaggcuuguugcucacugugu

SEQ ID NO: 880387 - RNA, 20 nt, Human
ccccacgcucagccuaggcc

SEQ ID NO: 880388 - RNA, 18 nt, Human
cccccauaauucccugcc

SEQ ID NO: 880389 - RNA, 20 nt, Human
cccccauaauucccugcccc

SEQ ID NO: 880390 - RNA, 19 nt, Human
ccccucagacccuggugag

SEQ ID NO: 880391 - RNA, 20 nt, Human
cccuaaauccugggucuccg

SEQ ID NO: 880392 - RNA, 22 nt, Human
cccuuaaguagggaguaguuug

SEQ ID NO: 880393 - RNA, 21 nt, Human
ccggauggagccuggccuauu

SEQ ID NO: 880394 - RNA, 21 nt, Human
ccuccggauggagccuggccu

SEQ ID NO: 880395 - RNA, 18 nt, Human
ccugcagcaugugacccu

SEQ ID NO: 880396 - RNA, 21 nt, Human
ccugcagcaugugacccuaaa

SEQ ID NO: 880397 - RNA, 25 nt, Human
ccugccugcagcaugugacccuaaa

SEQ ID NO: 880398 - RNA, 19 nt, Human
cuaggccaaugcacccaca

SEQ ID NO: 880399 - RNA, 22 nt, Human
gaagcagggguccuguagccuu

SEQ ID NO: 880400 - RNA, 24 nt, Human
gacagugggguggggguaggggga

SEQ ID NO: 880401 - RNA, 19 nt, Human
gacccagcugggccacagc

SEQ ID NO: 880402 - RNA, 20 nt, Human
gcagcaugugacccuaaauc

SEQ ID NO: 880403 - RNA, 20 nt, Human
gccuaggccaaugcacccac

SEQ ID NO: 880404 - RNA, 19 nt, Human
gccuuggaggacagugggg

SEQ ID NO: 880405 - RNA, 20 nt, Human
gcuccuccuggcaugguccc

SEQ ID NO: 880406 - RNA, 22 nt, Human
ggacagaaggcuggcagcuggg

SEQ ID NO: 880407 - RNA, 20 nt, Human
gggguggggguagggggaca

SEQ ID NO: 880408 - RNA, 20 nt, Human
guggagcagguuuccugagg

SEQ ID NO: 880409 - RNA, 20 nt, Human
guuccagccaggaguggagc

SEQ ID NO: 880410 - RNA, 21 nt, Human
uagggcccugcuggcccuggu

SEQ ID NO: 880411 - RNA, 22 nt, Human
ucacugugucagaagcaggggu

SEQ ID NO: 880412 - RNA, 19 nt, Human
ucagacccagcugggccac

SEQ ID NO: 880413 - RNA, 19 nt, Human
ucccacagagggugccggg

SEQ ID NO: 880414 - RNA, 21 nt, Human
ucccugccccacgcucagccu

SEQ ID NO: 880415 - RNA, 22 nt, Human
uccugggucuccgaagagaccc

SEQ ID NO: 880416 - RNA, 23 nt, Human
ucucccggaugggggaugagagc

SEQ ID NO: 880417 - RNA, 24 nt, Human
ucugccagcagggaaacccaggcu

SEQ ID NO: 880418 - RNA, 21 nt, Human
ugacaaguggagcagguuucc

SEQ ID NO: 880419 - RNA, 19 nt, Human
ugaggaagggccuggcugg

SEQ ID NO: 880420 - RNA, 20 nt, Human
ugccgugaccacaggggccg

SEQ ID NO: 880421 - RNA, 22 nt, Human
uggacaccacaggaugccguga

SEQ ID NO: 880422 - RNA, 18 nt, Human
ugggguggggguaggggg

SEQ ID NO: 880423 - RNA, 19 nt, Human
ugggguggggguaggggga

SEQ ID NO: 880424 - RNA, 24 nt, Human
ugggguggggguagggggacaucu

SEQ ID NO: 880425 - RNA, 20 nt, Human
ugugguaccucauggacacc

SEQ ID NO: 880426 - RNA, 18 nt, Human
uugcucacugugucagaa

SEQ ID NO: 880427 - RNA, 23 nt, Human
uuggaggacaguggggugggggu

SEQ ID NO: 880428 - RNA, 18 nt, Human
aaaaagccagggacuggu

SEQ ID NO: 880429 - RNA, 18 nt, Human
aaaaagccagggacuggu

SEQ ID NO: 880430 - RNA, 19 nt, Human
aacugagccaggggguccu

SEQ ID NO: 880431 - RNA, 19 nt, Human
aacugagccaggggguccu

SEQ ID NO: 880432 - RNA, 22 nt, Human
aagggccucugagguuggagac

SEQ ID NO: 880433 - RNA, 22 nt, Human
aagggccucugagguuggagac

SEQ ID NO: 880434 - RNA, 20 nt, Human
acucagaggcuucuaagagg

SEQ ID NO: 880435 - RNA, 20 nt, Human
acucagaggcuucuaagagg

SEQ ID NO: 880436 - RNA, 23 nt, Human
acucuguguccugaccccacaaa

SEQ ID NO: 880437 - RNA, 23 nt, Human
acucuguguccugaccccacaaa

SEQ ID NO: 880438 - RNA, 24 nt, Human
agaagagggcggcgucaggauggc

SEQ ID NO: 880439 - RNA, 20 nt, Human
agcccgggcagugccugccc

SEQ ID NO: 880440 - RNA, 20 nt, Human
agcccgggcagugccugccc

SEQ ID NO: 880441 - RNA, 21 nt, Human
agccgaagaaacaaaggccug

SEQ ID NO: 880442 - RNA, 22 nt, Human
aggauagaaguccucggaggaa

SEQ ID NO: 880443 - RNA, 20 nt, Human
aggcagacagacuuccagau

SEQ ID NO: 880444 - RNA, 20 nt, Human
aggcagacagacuuccagau

SEQ ID NO: 880445 - RNA, 20 nt, Human
aggcccccugcccggcacag

SEQ ID NO: 880446 - RNA, 19 nt, Human
agggaagaagagggcggcg

SEQ ID NO: 880447 - RNA, 19 nt, Human
caaagggccucugagguug

SEQ ID NO: 880448 - RNA, 19 nt, Human
caaagggccucugagguug

SEQ ID NO: 880449 - RNA, 25 nt, Human
cacccccaccuccauguggugggga

SEQ ID NO: 880450 - RNA, 25 nt, Human
cacccccaccuccauguggugggga

SEQ ID NO: 880451 - RNA, 21 nt, Human
cagcccauccagggcagcucg

SEQ ID NO: 880452 - RNA, 24 nt, Human
caggcccccugcccggcacagcug

SEQ ID NO: 880453 - RNA, 22 nt, Human
caguagcggucaucucggaaga

SEQ ID NO: 880454 - RNA, 21 nt, Human
cauccagggcagcucgguggc

SEQ ID NO: 880455 - RNA, 24 nt, Human
ccaccaguuucugaggugaggagg

SEQ ID NO: 880456 - RNA, 24 nt, Human
ccaccaguuucugaggugaggagg

SEQ ID NO: 880457 - RNA, 25 nt, Human
ccagccccagacaaaaagccaggga

SEQ ID NO: 880458 - RNA, 25 nt, Human
ccagccccagacaaaaagccaggga

SEQ ID NO: 880459 - RNA, 22 nt, Human
cccagugcuguuaccucuugaa

SEQ ID NO: 880460 - RNA, 22 nt, Human
cccagugcuguuaccucuugaa

SEQ ID NO: 880461 - RNA, 21 nt, Human
ccccggaaccuccagcaucga

SEQ ID NO: 880462 - RNA, 19 nt, Human
cccggggaugggacugcuc

SEQ ID NO: 880463 - RNA, 19 nt, Human
cccggggaugggacugcuc

SEQ ID NO: 880464 - RNA, 24 nt, Human
ccggcagucagccgcgcccgggac

SEQ ID NO: 880465 - RNA, 24 nt, Human
ccggcagucagccgcgcccgggac

SEQ ID NO: 880466 - RNA, 18 nt, Human
ccuccagcaucgaccccc

SEQ ID NO: 880467 - RNA, 21 nt, Human
ccuccgcugcccuucgccggg

SEQ ID NO: 880468 - RNA, 21 nt, Human
ccuccgcugcccuucgccggg

SEQ ID NO: 880469 - RNA, 20 nt, Human
ccuccggugcagcccggcuc

SEQ ID NO: 880470 - RNA, 20 nt, Human
ccuccggugcagcccggcuc

SEQ ID NO: 880471 - RNA, 24 nt, Human
ccugcaucagucucccucccacuc

SEQ ID NO: 880472 - RNA, 26 nt, Human
ccugcccgcggguccgccggccccgg

SEQ ID NO: 880473 - RNA, 19 nt, Human
ccuggggguggggccucug

SEQ ID NO: 880474 - RNA, 23 nt, Human
ccuucauccccauccaugcuucc

SEQ ID NO: 880475 - RNA, 23 nt, Human
ccuuuagccgaagaaacaaaggc

SEQ ID NO: 880476 - RNA, 23 nt, Human
ccuuuagccgaagaaacaaaggc

SEQ ID NO: 880477 - RNA, 19 nt, Human
cgaagaaacaaaggccugg

SEQ ID NO: 880478 - RNA, 20 nt, Human
cgcacggagagggacugucc

SEQ ID NO: 880479 - RNA, 20 nt, Human
cgcacggagagggacugucc

SEQ ID NO: 880480 - RNA, 25 nt, Human
cgccagugcccuagcugcgcgcucu

SEQ ID NO: 880481 - RNA, 22 nt, Human
cgcccgggaccccggggauggg

SEQ ID NO: 880482 - RNA, 22 nt, Human
cgcccgggaccccggggauggg

SEQ ID NO: 880483 - RNA, 26 nt, Human
cgggagccggccagacgucguccagc

SEQ ID NO: 880484 - RNA, 19 nt, Human
cgggguuucgccagugccc

SEQ ID NO: 880485 - RNA, 19 nt, Human
cgggguuucgccagugccc

SEQ ID NO: 880486 - RNA, 24 nt, Human
cgucaggauggcggggcaggcccc

SEQ ID NO: 880487 - RNA, 22 nt, Human
cuccccaguccugcagacuucg

SEQ ID NO: 880488 - RNA, 19 nt, Human
cucucggcccaccagcuga

SEQ ID NO: 880489 - RNA, 19 nt, Human
cucucggcccaccagcuga

SEQ ID NO: 880490 - RNA, 23 nt, Human
cugaccccacaaagggccucuga

SEQ ID NO: 880491 - RNA, 23 nt, Human
cugaccccacaaagggccucuga

SEQ ID NO: 880492 - RNA, 21 nt, Human
cugaccuccucagggaugccu

SEQ ID NO: 880493 - RNA, 22 nt, Human
cugaccuccucagggaugccuc

SEQ ID NO: 880494 - RNA, 23 nt, Human
cugcaucagucucccucccacuc

SEQ ID NO: 880495 - RNA, 22 nt, Human
cugcauucuucaaggaacaaag

SEQ ID NO: 880496 - RNA, 22 nt, Human
cugcauucuucaaggaacaaag

SEQ ID NO: 880497 - RNA, 22 nt, Human
cugcccggucuucugcagaggg

SEQ ID NO: 880498 - RNA, 22 nt, Human
cugcccggucuucugcagaggg

SEQ ID NO: 880499 - RNA, 21 nt, Human
cugcgcgcucugggccgcucc

SEQ ID NO: 880500 - RNA, 22 nt, Human
cuucauccccauccaugcuucc

SEQ ID NO: 880501 - RNA, 21 nt, Human
gaaccuccagcaucgaccccc

SEQ ID NO: 880502 - RNA, 18 nt, Human
gaagaaacaaaggccugg

SEQ ID NO: 880503 - RNA, 18 nt, Human
gaggaaagggccaaggga

SEQ ID NO: 880504 - RNA, 18 nt, Human
gaggaaagggccaaggga

SEQ ID NO: 880505 - RNA, 23 nt, Human
gaggauagaaguccucggaggaa

SEQ ID NO: 880506 - RNA, 19 nt, Human
gccagugcccuagcugcgc

SEQ ID NO: 880507 - RNA, 24 nt, Human
gccagugcccuagcugcgcgcucu

SEQ ID NO: 880508 - RNA, 23 nt, Human
gccccggaaccuccagcaucgac

SEQ ID NO: 880509 - RNA, 21 nt, Human
gccgcccccgcacggagaggg

SEQ ID NO: 880510 - RNA, 21 nt, Human
gccgcccccgcacggagaggg

SEQ ID NO: 880511 - RNA, 19 nt, Human
gcgcgcucugggccgcucc

SEQ ID NO: 880512 - RNA, 21 nt, Human
gcucugggccgcuccuccgcu

SEQ ID NO: 880513 - RNA, 21 nt, Human
gcucugggccgcuccuccgcu

SEQ ID NO: 880514 - RNA, 24 nt, Human
ggagcccacgaugguugguauuca

SEQ ID NO: 880515 - RNA, 24 nt, Human
ggagccggccagacgucguccagc

SEQ ID NO: 880516 - RNA, 21 nt, Human
ggccuggggaggauagaaguc

SEQ ID NO: 880517 - RNA, 21 nt, Human
ggccuggggaggauagaaguc

SEQ ID NO: 880518 - RNA, 23 nt, Human
gggaagaagagggcggcgucagg

SEQ ID NO: 880519 - RNA, 22 nt, Human
ggguucugccccgggggugggg

SEQ ID NO: 880520 - RNA, 22 nt, Human
ggguucugccccgggggugggg

SEQ ID NO: 880521 - RNA, 24 nt, Human
gguggcccagcggcccgagguggu

SEQ ID NO: 880522 - RNA, 20 nt, Human
guaggccugcaucagucucc

SEQ ID NO: 880523 - RNA, 20 nt, Human
guaggccugcaucagucucc

SEQ ID NO: 880524 - RNA, 22 nt, Human
uagccgaagaaacaaaggccug

SEQ ID NO: 880525 - RNA, 22 nt, Human
uagcgggcacccuugaagagga

SEQ ID NO: 880526 - RNA, 20 nt, Human
uaguagggcuccacuugcag

SEQ ID NO: 880527 - RNA, 18 nt, Human
uccagcaucgacccccuc

SEQ ID NO: 880528 - RNA, 21 nt, Human
uccaugcuuccuggggguggg

SEQ ID NO: 880529 - RNA, 21 nt, Human
uccaugcuuccuggggguggg

SEQ ID NO: 880530 - RNA, 18 nt, Human
ucccacucuguguccuga

SEQ ID NO: 880531 - RNA, 18 nt, Human
ucccacucuguguccuga

SEQ ID NO: 880532 - RNA, 24 nt, Human
uccuaagauugaucccacccccac

SEQ ID NO: 880533 - RNA, 24 nt, Human
uccuaagauugaucccacccccac

SEQ ID NO: 880534 - RNA, 21 nt, Human
ucgccagugcccuagcugcgc

SEQ ID NO: 880535 - RNA, 25 nt, Human
ucugcugaguuuuucaucccccugc

SEQ ID NO: 880536 - RNA, 25 nt, Human
ucugcugaguuuuucaucccccugc

SEQ ID NO: 880537 - RNA, 20 nt, Human
ugaaaggaacuguaccuuua

SEQ ID NO: 880538 - RNA, 20 nt, Human
ugaaaggaacuguaccuuua

SEQ ID NO: 880539 - RNA, 20 nt, Human
ugacuaaauaugacaccguu

SEQ ID NO: 880540 - RNA, 20 nt, Human
ugacuaaauaugacaccguu

SEQ ID NO: 880541 - RNA, 25 nt, Human
ugagagcaccaccaguuucugaggu

SEQ ID NO: 880542 - RNA, 25 nt, Human
ugagagcaccaccaguuucugaggu

SEQ ID NO: 880543 - RNA, 24 nt, Human
ugcagagggacucagaggcuucua

SEQ ID NO: 880544 - RNA, 24 nt, Human
ugcagagggacucagaggcuucua

SEQ ID NO: 880545 - RNA, 23 nt, Human
ugccuucauccccauccaugcuu

SEQ ID NO: 880546 - RNA, 23 nt, Human
ugccuucauccccauccaugcuu

SEQ ID NO: 880547 - RNA, 18 nt, Human
ugugguggggacagacaa

SEQ ID NO: 880548 - RNA, 18 nt, Human
ugugguggggacagacaa

SEQ ID NO: 880549 - RNA, 20 nt, Human
uucagaacagggcgcucccc

SEQ ID NO: 880550 - RNA, 22 nt, Human
uuccagccccagacaaaaagcc

SEQ ID NO: 880551 - RNA, 22 nt, Human
uuccagccccagacaaaaagcc

SEQ ID NO: 880552 - RNA, 22 nt, Human
uuccugccucucggcccaccag

SEQ ID NO: 880553 - RNA, 23 nt, Human
uuccugccucucggcccaccagg

SEQ ID NO: 880554 - RNA, 18 nt, Human
uuccuggggguggggccu

SEQ ID NO: 880555 - RNA, 18 nt, Human
uuccuggggguggggccu

SEQ ID NO: 880556 - RNA, 21 nt, Human
uuccuggggguggggccucug

SEQ ID NO: 880557 - RNA, 22 nt, Human
uucgccagugcccuagcugcgc

SEQ ID NO: 880558 - RNA, 18 nt, Human
uucgccgggagccggcca

SEQ ID NO: 880559 - RNA, 18 nt, Human
uucgccgggagccggcca

SEQ ID NO: 880560 - RNA, 24 nt, Human
uugaucccacccccaccuccaugu

SEQ ID NO: 880561 - RNA, 24 nt, Human
uugaucccacccccaccuccaugu

SEQ ID NO: 880562 - RNA, 23 nt, Human
uugcaaaauggucucgaauuucu

SEQ ID NO: 880563 - RNA, 23 nt, Human
uugcaaaauggucucgaauuucu

SEQ ID NO: 880564 - RNA, 22 nt, Human
uugcagucccccucgggccagc

SEQ ID NO: 880565 - RNA, 20 nt, Human
uugcuuuuccuaagauugau

SEQ ID NO: 880566 - RNA, 20 nt, Human
uugcuuuuccuaagauugau

SEQ ID NO: 880567 - RNA, 21 nt, Human
uuuuuugcuuuuccuaagauu

SEQ ID NO: 880568 - RNA, 21 nt, Human
uuuuuugcuuuuccuaagauu

SEQ ID NO: 880569 - RNA, 25 nt, Human
aaaaaagaaaaagaaaauaaaagag

SEQ ID NO: 880570 - RNA, 19 nt, Human
aaaaagaaaauaaaagaaa

SEQ ID NO: 880571 - RNA, 20 nt, Human
aaaaagaaaauaaaagaaac

SEQ ID NO: 880572 - RNA, 21 nt, Human
aaaagaaaaaaaaagaaaaag

SEQ ID NO: 880573 - RNA, 23 nt, Human
aaaagaaaaaaaaagaaaaagaa

SEQ ID NO: 880574 - RNA, 23 nt, Human
aaaagaaaaagaaaauaaaagaa

SEQ ID NO: 880575 - RNA, 19 nt, Human
aaacccagcacuuuuggag

SEQ ID NO: 880576 - RNA, 18 nt, Human
aaacuuaagagggcggug

SEQ ID NO: 880577 - RNA, 26 nt, Human
aacaggaacagcaggacaccuccaga

SEQ ID NO: 880578 - RNA, 18 nt, Human
aagaaaaaaaaagaaaaa

SEQ ID NO: 880579 - RNA, 21 nt, Human
aagaaaaagaaaauaaaagaa

SEQ ID NO: 880580 - RNA, 20 nt, Human
aagaccuucccucauuccug

SEQ ID NO: 880581 - RNA, 24 nt, Human
aagauccagagaacacacagagga

SEQ ID NO: 880582 - RNA, 19 nt, Human
aagggccucauaauggagu

SEQ ID NO: 880583 - RNA, 24 nt, Human
aaucgcuggagcccgggaggugga

SEQ ID NO: 880584 - RNA, 19 nt, Human
acagaauaaggccccgucu

SEQ ID NO: 880585 - RNA, 24 nt, Human
acagaauaaggccccgucucaaaa

SEQ ID NO: 880586 - RNA, 18 nt, Human
acaggcgguacuugucag

SEQ ID NO: 880587 - RNA, 18 nt, Human
accauagaguugcugcag

SEQ ID NO: 880588 - RNA, 24 nt, Human
accaugucauugcacuccagccug

SEQ ID NO: 880589 - RNA, 25 nt, Human
acccccaccccaggucuuccuccau

SEQ ID NO: 880590 - RNA, 23 nt, Human
agaaaauaaaagaaacuuaagag

SEQ ID NO: 880591 - RNA, 21 nt, Human
agaacacagccugccggcccc

SEQ ID NO: 880592 - RNA, 21 nt, Human
agacaggcgguacuugucagg

SEQ ID NO: 880593 - RNA, 24 nt, Human
agcacuuuuggagucccagguggg

SEQ ID NO: 880594 - RNA, 23 nt, Human
agcgacccccacccgucuccccc

SEQ ID NO: 880595 - RNA, 22 nt, Human
aggagaaucgcuggagcccggg

SEQ ID NO: 880596 - RNA, 24 nt, Human
aggaucgcuugagcccaagaguuc

SEQ ID NO: 880597 - RNA, 24 nt, Human
aggcaggagaaucgcuggagcccg

SEQ ID NO: 880598 - RNA, 20 nt, Human
aggcugaggcagggaggcag

SEQ ID NO: 880599 - RNA, 25 nt, Human
agggccucauaauggaguugggggc

SEQ ID NO: 880600 - RNA, 20 nt, Human
agguggaggcugcagugacg

SEQ ID NO: 880601 - RNA, 23 nt, Human
aggugggaggaucgcuugagccc

SEQ ID NO: 880602 - RNA, 24 nt, Human
agucccaggugggaggaucgcuug

SEQ ID NO: 880603 - RNA, 26 nt, Human
aucccuugaguccuccauccccccuc

SEQ ID NO: 880604 - RNA, 19 nt, Human
augccuguaaacccagcac

SEQ ID NO: 880605 - RNA, 18 nt, Human
auugcacuccagccugga

SEQ ID NO: 880606 - RNA, 24 nt, Human
auugcacuccagccuggaggacag

SEQ ID NO: 880607 - RNA, 23 nt, Human
cacagagcuccucuagcaggcac

SEQ ID NO: 880608 - RNA, 24 nt, Human
cacccccaccccaggucuuccucc

SEQ ID NO: 880609 - RNA, 18 nt, Human
cacccggccuugcuccca

SEQ ID NO: 880610 - RNA, 19 nt, Human
cacuggaccacagggcuga

SEQ ID NO: 880611 - RNA, 24 nt, Human
cagcacuuuuggagucccaggugg

SEQ ID NO: 880612 - RNA, 20 nt, Human
cagccccagcccugggagca

SEQ ID NO: 880613 - RNA, 22 nt, Human
cagcgacccccacccgucuccc

SEQ ID NO: 880614 - RNA, 19 nt, Human
caggaaggcccugcgagug

SEQ ID NO: 880615 - RNA, 18 nt, Human
caggcagccccagcccug

SEQ ID NO: 880616 - RNA, 19 nt, Human
cagggcugaaaagauccag

SEQ ID NO: 880617 - RNA, 21 nt, Human
cauccccccucccccaucucc

SEQ ID NO: 880618 - RNA, 24 nt, Human
cauccccuccucccagcuacaguc

SEQ ID NO: 880619 - RNA, 26 nt, Human
cauccccuccucccagcuacagucua

SEQ ID NO: 880620 - RNA, 23 nt, Human
caucccuccucaagccauauccc

SEQ ID NO: 880621 - RNA, 18 nt, Human
caucucccuguucacagc

SEQ ID NO: 880622 - RNA, 25 nt, Human
caugccuguaaacccagcacuuuug

SEQ ID NO: 880623 - RNA, 18 nt, Human
cauugcacuccagccugg

SEQ ID NO: 880624 - RNA, 19 nt, Human
cauugcacuccagccugga

SEQ ID NO: 880625 - RNA, 19 nt, Human
cauugcacuccagccugga

SEQ ID NO: 880626 - RNA, 19 nt, Human
cauugcacuccagccugga

SEQ ID NO: 880627 - RNA, 23 nt, Human
cauugcacuccagccuggaggac

SEQ ID NO: 880628 - RNA, 24 nt, Human
cauugcacuccagccuggaggaca

SEQ ID NO: 880629 - RNA, 24 nt, Human
cauugcacuccagccuggaggaca

SEQ ID NO: 880630 - RNA, 22 nt, Human
ccaggcccagggcguggccaaa

SEQ ID NO: 880631 - RNA, 20 nt, Human
ccaggucuuccuccaucucc

SEQ ID NO: 880632 - RNA, 18 nt, Human
cccaagaccuucccucau

SEQ ID NO: 880633 - RNA, 25 nt, Human
cccagcacccggccuugcucccagc

SEQ ID NO: 880634 - RNA, 21 nt, Human
cccaggcugaggcagggaggc

SEQ ID NO: 880635 - RNA, 19 nt, Human
cccaucccuccucaagcca

SEQ ID NO: 880636 - RNA, 19 nt, Human
ccccccucccccaucuccc

SEQ ID NO: 880637 - RNA, 18 nt, Human
ccccuccucucccuaccc

SEQ ID NO: 880638 - RNA, 21 nt, Human
cccggccuugcucccagccuc

SEQ ID NO: 880639 - RNA, 19 nt, Human
cccugguagaagggccuca

SEQ ID NO: 880640 - RNA, 22 nt, Human
ccggccccagcacccggccuug

SEQ ID NO: 880641 - RNA, 20 nt, Human
ccggccuugcucccagccuc

SEQ ID NO: 880642 - RNA, 18 nt, Human
ccucaagccauaucccuu

SEQ ID NO: 880643 - RNA, 22 nt, Human
ccuccagagguggccccagcuc

SEQ ID NO: 880644 - RNA, 19 nt, Human
ccuccaucuccuugggaac

SEQ ID NO: 880645 - RNA, 21 nt, Human
ccucucccuacccuguaccac

SEQ ID NO: 880646 - RNA, 21 nt, Human
ccugggagcauccccuccucc

SEQ ID NO: 880647 - RNA, 19 nt, Human
ccuguggucccagcuacuc

SEQ ID NO: 880648 - RNA, 21 nt, Human
ccuguggucccagcuacucag

SEQ ID NO: 880649 - RNA, 26 nt, Human
cgugccauucucuucaggcagcccca

SEQ ID NO: 880650 - RNA, 19 nt, Human
cucaaaaaaaguaaaaaga

SEQ ID NO: 880651 - RNA, 23 nt, Human
cucaggucccaggcugaggcagg

SEQ ID NO: 880652 - RNA, 18 nt, Human
cucauaauggaguugggg

SEQ ID NO: 880653 - RNA, 24 nt, Human
cucaugccuguaaacccagcacuu

SEQ ID NO: 880654 - RNA, 18 nt, Human
cucccccuugccaccccc

SEQ ID NO: 880655 - RNA, 24 nt, Human
cucccccuugccacccccaucugc

SEQ ID NO: 880656 - RNA, 22 nt, Human
cucugccccuccucucccuacc

SEQ ID NO: 880657 - RNA, 20 nt, Human
cuuccuccaucuccuuggga

SEQ ID NO: 880658 - RNA, 20 nt, Human
gaacacagccugccggcccc

SEQ ID NO: 880659 - RNA, 21 nt, Human
gaacucuccaucaucccuguc

SEQ ID NO: 880660 - RNA, 23 nt, Human
gacagaauaaggccccgucucaa

SEQ ID NO: 880661 - RNA, 21 nt, Human
gaccaugucauugcacuccag

SEQ ID NO: 880662 - RNA, 20 nt, Human
gacccccacccgucuccccc

SEQ ID NO: 880663 - RNA, 23 nt, Human
gagaaucgcuggagcccgggagg

SEQ ID NO: 880664 - RNA, 18 nt, Human
gaggcagggaggcaggag

SEQ ID NO: 880665 - RNA, 19 nt, Human
gagugcagcuggggccaac

SEQ ID NO: 880666 - RNA, 24 nt, Human
gaguugcugcaggccaucgcgguc

SEQ ID NO: 880667 - RNA, 26 nt, Human
gaucgcuugagcccaagaguucaaga

SEQ ID NO: 880668 - RNA, 24 nt, Human
gcacccggccuugcucccagccuc

SEQ ID NO: 880669 - RNA, 22 nt, Human
gccaggagugguggcgcaugcc

SEQ ID NO: 880670 - RNA, 22 nt, Human
gccccagcucucugcccagccc

SEQ ID NO: 880671 - RNA, 24 nt, Human
gcccgggagguggaggcugcagug

SEQ ID NO: 880672 - RNA, 18 nt, Human
gccggccccagcacccgg

SEQ ID NO: 880673 - RNA, 23 nt, Human
gccuggacaacauaaggagaucc

SEQ ID NO: 880674 - RNA, 19 nt, Human
gcugggugugguggcucau

SEQ ID NO: 880675 - RNA, 24 nt, Human
ggaggagcugggugugguggcuca

SEQ ID NO: 880676 - RNA, 19 nt, Human
ggaggcaggagaaucgcug

SEQ ID NO: 880677 - RNA, 23 nt, Human
ggaucgcuugagcccaagaguuc

SEQ ID NO: 880678 - RNA, 22 nt, Human
ggcaaacaggucgguccccucg

SEQ ID NO: 880679 - RNA, 21 nt, Human
ggcucaugccuguaaacccag

SEQ ID NO: 880680 - RNA, 20 nt, Human
gggaggagcuggguguggug

SEQ ID NO: 880681 - RNA, 21 nt, Human
ggggaggagcuggguguggug

SEQ ID NO: 880682 - RNA, 23 nt, Human
ggugugguggcucaugccuguaa

SEQ ID NO: 880683 - RNA, 19 nt, Human
guagaagggccucauaaug

SEQ ID NO: 880684 - RNA, 22 nt, Human
guagaagggccucauaauggag

SEQ ID NO: 880685 - RNA, 24 nt, Human
gucagcgacccccacccgucuccc

SEQ ID NO: 880686 - RNA, 19 nt, Human
gugagggcaggagccuaca

SEQ ID NO: 880687 - RNA, 21 nt, Human
gugcagcuggggccaacagga

SEQ ID NO: 880688 - RNA, 24 nt, Human
gugcagcuggggccaacaggaacc

SEQ ID NO: 880689 - RNA, 19 nt, Human
guggcccaggcccagggcg

SEQ ID NO: 880690 - RNA, 20 nt, Human
guggccccagcucucugccc

SEQ ID NO: 880691 - RNA, 23 nt, Human
guggcucaugccuguaaacccag

SEQ ID NO: 880692 - RNA, 20 nt, Human
guuugagggggaggagcugg

SEQ ID NO: 880693 - RNA, 25 nt, Human
uaaaaagaaaaaaaaagaaaaagaa

SEQ ID NO: 880694 - RNA, 24 nt, Human
uaaaagaaacuuaagagggcggug

SEQ ID NO: 880695 - RNA, 26 nt, Human
uacaucccuugaguccuccauccccc

SEQ ID NO: 880696 - RNA, 20 nt, Human
ucagaacacagccugccggc

SEQ ID NO: 880697 - RNA, 22 nt, Human
ucaugccuguaaacccagcacu

SEQ ID NO: 880698 - RNA, 18 nt, Human
ucauugcacuccagccug

SEQ ID NO: 880699 - RNA, 19 nt, Human
ucauugcacuccagccugg

SEQ ID NO: 880700 - RNA, 21 nt, Human
ucauugcacuccagccuggag

SEQ ID NO: 880701 - RNA, 24 nt, Human
ucauugcacuccagccuggaggac

SEQ ID NO: 880702 - RNA, 23 nt, Human
uccaucuccuugggaacacagag

SEQ ID NO: 880703 - RNA, 19 nt, Human
ucccaggcugaggcaggga

SEQ ID NO: 880704 - RNA, 22 nt, Human
ucccaggcugaggcagggaggc

SEQ ID NO: 880705 - RNA, 19 nt, Human
uccccccucccccaucucc

SEQ ID NO: 880706 - RNA, 22 nt, Human
uccccuggccuugcugcagagg

SEQ ID NO: 880707 - RNA, 19 nt, Human
ucccuacccuguaccaccc

SEQ ID NO: 880708 - RNA, 21 nt, Human
uccuccauccccccuccccca

SEQ ID NO: 880709 - RNA, 19 nt, Human
uccucccagcuacagucua

SEQ ID NO: 880710 - RNA, 21 nt, Human
ucgccgucugcaggagaaagu

SEQ ID NO: 880711 - RNA, 20 nt, Human
ucgcuggagcccgggaggug

SEQ ID NO: 880712 - RNA, 24 nt, Human
ucgcuggagcccgggagguggagg

SEQ ID NO: 880713 - RNA, 23 nt, Human
ucgcuugagcccaagaguucaag

SEQ ID NO: 880714 - RNA, 18 nt, Human
ucugccccuccucucccc

SEQ ID NO: 880715 - RNA, 19 nt, Human
ucuuccuccaucuccuugg

SEQ ID NO: 880716 - RNA, 18 nt, Human
ugacccaagaccuucccu

SEQ ID NO: 880717 - RNA, 19 nt, Human
ugacccaagaccuucccuc

SEQ ID NO: 880718 - RNA, 21 nt, Human
ugagacaggcgguacuuguca

SEQ ID NO: 880719 - RNA, 23 nt, Human
ugagcccaagaguucaagacugg

SEQ ID NO: 880720 - RNA, 22 nt, Human
ugcacuccagccuggaggacag

SEQ ID NO: 880721 - RNA, 23 nt, Human
ugcaggagaaagugggugagagc

SEQ ID NO: 880722 - RNA, 20 nt, Human
ugccccuccucucccuaccc

SEQ ID NO: 880723 - RNA, 24 nt, Human
ugccuguggucccagcuacucagg

SEQ ID NO: 880724 - RNA, 23 nt, Human
ugcuuggggaaaggggccacagg

SEQ ID NO: 880725 - RNA, 19 nt, Human
uggccaggagugguggcgc

SEQ ID NO: 880726 - RNA, 24 nt, Human
uggcgcaugccuguggucccagcu

SEQ ID NO: 880727 - RNA, 21 nt, Human
uggcucaugccuguaaaccca

SEQ ID NO: 880728 - RNA, 24 nt, Human
uggcucaugccuguaaacccagca

SEQ ID NO: 880729 - RNA, 23 nt, Human
ugggagcauccccuccucccagc

SEQ ID NO: 880730 - RNA, 21 nt, Human
uggggccaacaggaacagcag

SEQ ID NO: 880731 - RNA, 23 nt, Human
ugggggcugaggaguggcccagg

SEQ ID NO: 880732 - RNA, 18 nt, Human
ugggugugguggcucaug

SEQ ID NO: 880733 - RNA, 24 nt, Human
ugguggcgcaugccugugguccca

SEQ ID NO: 880734 - RNA, 24 nt, Human
ugguggcucaugccuguaaaccca

SEQ ID NO: 880735 - RNA, 18 nt, Human
uguaccacccccacccca

SEQ ID NO: 880736 - RNA, 21 nt, Human
uugagcccaagaguucaagac

SEQ ID NO: 880737 - RNA, 22 nt, Human
aaaaaccaaaacagagcagaug

SEQ ID NO: 880738 - RNA, 23 nt, Human
aaacagagcagaugugcaagcaa

SEQ ID NO: 880739 - RNA, 19 nt, Human
aagcaagguagcucaugug

SEQ ID NO: 880740 - RNA, 25 nt, Human
acagagcagaugugcaagcaaagau

SEQ ID NO: 880741 - RNA, 18 nt, Human
aguugauuuucauuuccu

SEQ ID NO: 880742 - RNA, 18 nt, Human
caaaacagagcagaugug

SEQ ID NO: 880743 - RNA, 22 nt, Human
ggaaagaaaacugugacugaua

SEQ ID NO: 880744 - RNA, 18 nt, Human
uagaaaaaccaaaacaga

SEQ ID NO: 880745 - RNA, 25 nt, Human
ucaauaaaggugauagucuguuuuu

SEQ ID NO: 880746 - RNA, 19 nt, Human
ugcaagcaaagauaaauga

SEQ ID NO: 880747 - RNA, 24 nt, Human
ugcaagcaaagauaaaugaaaaca

SEQ ID NO: 880748 - RNA, 21 nt, Human
uguguuauauauuuauauaca

SEQ ID NO: 880749 - RNA, 22 nt, Human
uucauuuccuguagaaaaacca

SEQ ID NO: 880750 - RNA, 22 nt, Human
agaaauauggacucuuauguuc

SEQ ID NO: 880751 - RNA, 23 nt, Human
agacaacaucugccagcccuggu

SEQ ID NO: 880752 - RNA, 18 nt, Human
agaggccuagcauuugug

SEQ ID NO: 880753 - RNA, 21 nt, Human
agcauuugugcugugucugug

SEQ ID NO: 880754 - RNA, 20 nt, Human
agccaugcaacagaggccua

SEQ ID NO: 880755 - RNA, 22 nt, Human
auaucgccccuuuucugacaua

SEQ ID NO: 880756 - RNA, 19 nt, Human
augcacucaccccucagca

SEQ ID NO: 880757 - RNA, 21 nt, Human
auuugugcugugucuguggga

SEQ ID NO: 880758 - RNA, 25 nt, Human
caagugucucacacacacuuauuuu

SEQ ID NO: 880759 - RNA, 19 nt, Human
cacucauaugcacucaccc

SEQ ID NO: 880760 - RNA, 25 nt, Human
cagcagcauaucgccccuuuucuga

SEQ ID NO: 880761 - RNA, 25 nt, Human
cagggccacacucauaugcacuccu

SEQ ID NO: 880762 - RNA, 20 nt, Human
cagguagacaacaucugcca

SEQ ID NO: 880763 - RNA, 23 nt, Human
ccacacucauaugcacucacccc

SEQ ID NO: 880764 - RNA, 26 nt, Human
cccaggacccuagaucuuucuucaaa

SEQ ID NO: 880765 - RNA, 23 nt, Human
cucaccccucagcagcauaucgc

SEQ ID NO: 880766 - RNA, 21 nt, Human
cugcuuuggggaagauggcuc

SEQ ID NO: 880767 - RNA, 20 nt, Human
cuuuguacagccaugcaaca

SEQ ID NO: 880768 - RNA, 26 nt, Human
gauggcucaacaguuaguaaucccag

SEQ ID NO: 880769 - RNA, 19 nt, Human
ggggaagauggcucaacag

SEQ ID NO: 880770 - RNA, 19 nt, Human
uauaaaugcaagagaccca

SEQ ID NO: 880771 - RNA, 19 nt, Human
ucuaggccaggacugaggg

SEQ ID NO: 880772 - RNA, 23 nt, Human
ucugacauauaaaugcaagagac

SEQ ID NO: 880773 - RNA, 21 nt, Human
ucugugggaaaggcagucaga

SEQ ID NO: 880774 - RNA, 23 nt, Human
ugacauauaaaugcaagagaccc

SEQ ID NO: 880775 - RNA, 20 nt, Human
ugcacucaccccucagcagc

SEQ ID NO: 880776 - RNA, 20 nt, Human
ugugcugugucugugggaaa

SEQ ID NO: 880777 - RNA, 24 nt, Human
uugugcugugucugugggaaaggc

SEQ ID NO: 880778 - RNA, 25 nt, Human
caccuuuaccuccacuuagugguuu

SEQ ID NO: 880779 - RNA, 18 nt, Human
cccauagauuggcagaca

SEQ ID NO: 880780 - RNA, 22 nt, Human
gacaguuuacaagugucaccag

SEQ ID NO: 880781 - RNA, 18 nt, Human
gaccuucuuccuccacca

SEQ ID NO: 880782 - RNA, 22 nt, Human
gcauggcucuuacacgaccuuc

SEQ ID NO: 880783 - RNA, 21 nt, Human
ucagagauaggcacaccaaaa

SEQ ID NO: 880784 - RNA, 21 nt, Human
ucagugcacucugguucaagc

SEQ ID NO: 880785 - RNA, 23 nt, Human
ucgagcccugacagcggcccaua

SEQ ID NO: 880786 - RNA, 18 nt, Human
uuuuuuuuuuuuuuuuug

SEQ ID NO: 880787 - RNA, 21 nt, Human
uuuuuuuuuuuuuuuuuuggg

SEQ ID NO: 880788 - RNA, 20 nt, Human
aaaaaccacuuccaguauaa

SEQ ID NO: 880789 - RNA, 25 nt, Human
aaaaaccacuuccaguauaauaguc

SEQ ID NO: 880790 - RNA, 25 nt, Human
aaaugucaaaaaauucuagaaagcu

SEQ ID NO: 880791 - RNA, 23 nt, Human
aagaaaccuugaagcaguguuga

SEQ ID NO: 880792 - RNA, 19 nt, Human
aagacguuucuuccacuug

SEQ ID NO: 880793 - RNA, 22 nt, Human
acaaaacccacgaagucugaac

SEQ ID NO: 880794 - RNA, 22 nt, Human
acacacagcacuacaccacaaa

SEQ ID NO: 880795 - RNA, 18 nt, Human
acaccacaaagccaggac

SEQ ID NO: 880796 - RNA, 22 nt, Human
accacacucucauccauacauu

SEQ ID NO: 880797 - RNA, 21 nt, Human
acggcagcggcaggggccucc

SEQ ID NO: 880798 - RNA, 22 nt, Human
acuaacuccauacacacagcac

SEQ ID NO: 880799 - RNA, 19 nt, Human
acuacaccacaaagccagg

SEQ ID NO: 880800 - RNA, 24 nt, Human
acuacaccacaaagccaggacacc

SEQ ID NO: 880801 - RNA, 30 nt, Human
acuccauacacacagcacuacaccacaaaa

SEQ ID NO: 880802 - RNA, 18 nt, Human
acugaauacaaaggacug

SEQ ID NO: 880803 - RNA, 21 nt, Human
acugcacucagaucgccaaca

SEQ ID NO: 880804 - RNA, 23 nt, Human
agaaagaaaaggugcucuacaga

SEQ ID NO: 880805 - RNA, 18 nt, Human
agaagacauuguucugcc

SEQ ID NO: 880806 - RNA, 18 nt, Human
agagaaagcccacaugug

SEQ ID NO: 880807 - RNA, 23 nt, Human
agagauuuuuuuuucaaggagac

SEQ ID NO: 880808 - RNA, 25 nt, Human
agaucgccaacaaagaugggugcaa

SEQ ID NO: 880809 - RNA, 20 nt, Human
agcacuacaccacaaagcca

SEQ ID NO: 880810 - RNA, 22 nt, Human
agcacuacaccacaaagccagg

SEQ ID NO: 880811 - RNA, 18 nt, Human
agcagauuagcaguaaug

SEQ ID NO: 880812 - RNA, 24 nt, Human
agcuuggcaagaagacguuucuuc

SEQ ID NO: 880813 - RNA, 18 nt, Human
aggggcucccgcggcugc

SEQ ID NO: 880814 - RNA, 24 nt, Human
aggguuaaaaaucacauuaaguaa

SEQ ID NO: 880815 - RNA, 20 nt, Human
agguaacugaauacaaagga

SEQ ID NO: 880816 - RNA, 19 nt, Human
agugccugaugcugaauag

SEQ ID NO: 880817 - RNA, 22 nt, Human
aguggcucggacgcucggcccc

SEQ ID NO: 880818 - RNA, 22 nt, Human
aucgcagcuuauugauggcacc

SEQ ID NO: 880819 - RNA, 25 nt, Human
augaucauaacuucaaaugcaacau

SEQ ID NO: 880820 - RNA, 24 nt, Human
auuuuaauaaaaauaaaauauauc

SEQ ID NO: 880821 - RNA, 19 nt, Human
auuuuggauaguuccccuc

SEQ ID NO: 880822 - RNA, 23 nt, Human
caacaaagaugggugcaaacaca

SEQ ID NO: 880823 - RNA, 26 nt, Human
cacacagcacuacaccacaaagccag

SEQ ID NO: 880824 - RNA, 22 nt, Human
cacagcacuacaccacaaagcc

SEQ ID NO: 880825 - RNA, 19 nt, Human
caccacaaagccaggacac

SEQ ID NO: 880826 - RNA, 20 nt, Human
caccacaaagccaggacacc

SEQ ID NO: 880827 - RNA, 22 nt, Human
caccacaaagccaggacaccac

SEQ ID NO: 880828 - RNA, 23 nt, Human
caccacaucacggccaagucuuc

SEQ ID NO: 880829 - RNA, 27 nt, Human
cacuaacuccauacacacagcacuaca

SEQ ID NO: 880830 - RNA, 20 nt, Human
cacuacaccacaaagccagg

SEQ ID NO: 880831 - RNA, 25 nt, Human
cacuacaccacaaagccaggacacc

SEQ ID NO: 880832 - RNA, 20 nt, Human
cagaacucccguagcacagu

SEQ ID NO: 880833 - RNA, 23 nt, Human
cagcagcagcuacgaucuccaac

SEQ ID NO: 880834 - RNA, 21 nt, Human
cagcauuaaggaacaggacau

SEQ ID NO: 880835 - RNA, 23 nt, Human
cagccauguucagaacucccgac

SEQ ID NO: 880836 - RNA, 19 nt, Human
cagcggcaggggccuccgc

SEQ ID NO: 880837 - RNA, 20 nt, Human
cagcggcaggggccuccgcu

SEQ ID NO: 880838 - RNA, 28 nt, Human
cagcuacgaucuccaaccuggacugaaa

SEQ ID NO: 880839 - RNA, 22 nt, Human
cagcugcagccaugcugaauuu

SEQ ID NO: 880840 - RNA, 21 nt, Human
caggaagguguggcugacuga

SEQ ID NO: 880841 - RNA, 21 nt, Human
caggacaccacaucacggcca

SEQ ID NO: 880842 - RNA, 18 nt, Human
caggugugcacuugccac

SEQ ID NO: 880843 - RNA, 23 nt, Human
ccaaaguuuuaauuauucaguuc

SEQ ID NO: 880844 - RNA, 23 nt, Human
ccaaccuggacugaaaaacaaaa

SEQ ID NO: 880845 - RNA, 20 nt, Human
ccacaaagccaggacaccac

SEQ ID NO: 880846 - RNA, 19 nt, Human
ccacacugcacucagaucg

SEQ ID NO: 880847 - RNA, 24 nt, Human
ccauuuaaaagaaaugagcauucu

SEQ ID NO: 880848 - RNA, 20 nt, Human
cccgcggcggcggcggcugc

SEQ ID NO: 880849 - RNA, 18 nt, Human
cccuucaacauauccagg

SEQ ID NO: 880850 - RNA, 21 nt, Human
ccgccgcgcugcugcgcucgc

SEQ ID NO: 880851 - RNA, 23 nt, Human
ccgccgcgcugcugcgcucgcuu

SEQ ID NO: 880852 - RNA, 21 nt, Human
ccgccgcuucgggcugcucgu

SEQ ID NO: 880853 - RNA, 18 nt, Human
ccgcugcacuccgccugu

SEQ ID NO: 880854 - RNA, 22 nt, Human
ccguccucggccgccgccgcuu

SEQ ID NO: 880855 - RNA, 19 nt, Human
ccugugcuacggggcuggg

SEQ ID NO: 880856 - RNA, 19 nt, Human
ccuuccuaaacauccaaga

SEQ ID NO: 880857 - RNA, 22 nt, Human
ccuugaagcaguguugaaauga

SEQ ID NO: 880858 - RNA, 27 nt, Human
cgcugcugcgcucgcuugggcugcggc

SEQ ID NO: 880859 - RNA, 20 nt, Human
cggccccuccguugucuucc

SEQ ID NO: 880860 - RNA, 19 nt, Human
cggccgccgccgcuucggg

SEQ ID NO: 880861 - RNA, 20 nt, Human
cggcugcgcgggcggacgcc

SEQ ID NO: 880862 - RNA, 19 nt, Human
cuaaaaugaacagauacca

SEQ ID NO: 880863 - RNA, 19 nt, Human
cuaaaccacacucucaucc

SEQ ID NO: 880864 - RNA, 19 nt, Human
cuacgaccucacugccaaa

SEQ ID NO: 880865 - RNA, 19 nt, Human
cuagcaaagaauaaucaua

SEQ ID NO: 880866 - RNA, 24 nt, Human
cucacugccaaaguggaagcuguu

SEQ ID NO: 880867 - RNA, 23 nt, Human
cuccgcgucgucgcuguccccgu

SEQ ID NO: 880868 - RNA, 19 nt, Human
cuccguugucuuccgcccg

SEQ ID NO: 880869 - RNA, 21 nt, Human
cugacacgcugcacccucacu

SEQ ID NO: 880870 - RNA, 19 nt, Human
cugacgcagggaugccagg

SEQ ID NO: 880871 - RNA, 19 nt, Human
cugaugcugaauagcuaac

SEQ ID NO: 880872 - RNA, 20 nt, Human
cugcacuccgccugugcuac

SEQ ID NO: 880873 - RNA, 20 nt, Human
gaugggugcaaacacauagg

SEQ ID NO: 880874 - RNA, 18 nt, Human
gcaaacucugauuuguca

SEQ ID NO: 880875 - RNA, 21 nt, Human
gccuucaugaacccagccaug

SEQ ID NO: 880876 - RNA, 21 nt, Human
ggacugaaaaacaaaagggua

SEQ ID NO: 880877 - RNA, 21 nt, Human
ggccccuccguugucuuccgc

SEQ ID NO: 880878 - RNA, 18 nt, Human
ggcguucccuucucugcc

SEQ ID NO: 880879 - RNA, 18 nt, Human
gggcggacgccugcccag

SEQ ID NO: 880880 - RNA, 22 nt, Human
uaaaaccugcugaaacagcaau

SEQ ID NO: 880881 - RNA, 19 nt, Human
uaaaaggcuacgaccucac

SEQ ID NO: 880882 - RNA, 21 nt, Human
uaaaaugaacagauaccauuc

SEQ ID NO: 880883 - RNA, 24 nt, Human
uaaaaugaacagauaccauucuaa

SEQ ID NO: 880884 - RNA, 25 nt, Human
uaaaaugaauaaggccaauaggaug

SEQ ID NO: 880885 - RNA, 21 nt, Human
uaaaauuaacaaauacccuuc

SEQ ID NO: 880886 - RNA, 22 nt, Human
uaaagacagucuugagaaaugc

SEQ ID NO: 880887 - RNA, 18 nt, Human
uaacauagauguuuauug

SEQ ID NO: 880888 - RNA, 18 nt, Human
uaacauagauguuuauug

SEQ ID NO: 880889 - RNA, 19 nt, Human
uaacauagauguuuauugg

SEQ ID NO: 880890 - RNA, 20 nt, Human
uaacugaauacaaaggacug

SEQ ID NO: 880891 - RNA, 22 nt, Human
uaagaauuauauacaaaagaaa

SEQ ID NO: 880892 - RNA, 18 nt, Human
uaagagaagccaaaguuu

SEQ ID NO: 880893 - RNA, 22 nt, Human
uacaaaagaaaccuugaagcag

SEQ ID NO: 880894 - RNA, 18 nt, Human
uacaccacaaagccagga

SEQ ID NO: 880895 - RNA, 21 nt, Human
uacaccacaaagccaggacac

SEQ ID NO: 880896 - RNA, 21 nt, Human
uacagggccagccagauauuc

SEQ ID NO: 880897 - RNA, 18 nt, Human
uagaagacauuguucugc

SEQ ID NO: 880898 - RNA, 26 nt, Human
uaugagcauucauuguuuuucgaacg

SEQ ID NO: 880899 - RNA, 23 nt, Human
uaugaggcuucuuuacacuuuua

SEQ ID NO: 880900 - RNA, 19 nt, Human
ucacagaucuggcagauuc

SEQ ID NO: 880901 - RNA, 24 nt, Human
ucaguaucaauuuauucgcauguc

SEQ ID NO: 880902 - RNA, 25 nt, Human
uccauacacacagcacuacaccaca

SEQ ID NO: 880903 - RNA, 24 nt, Human
ucccgcggcugccgccgcgcugcu

SEQ ID NO: 880904 - RNA, 24 nt, Human
uccucggccgccgccgcuucgggc

SEQ ID NO: 880905 - RNA, 24 nt, Human
ucgcuugggcugcggcugcugcug

SEQ ID NO: 880906 - RNA, 20 nt, Human
ugaaaaguaaaauuaacaaa

SEQ ID NO: 880907 - RNA, 22 nt, Human
ugaaacagcaauugggaggccc

SEQ ID NO: 880908 - RNA, 21 nt, Human
ugaaaugaaaugcaagguguc

SEQ ID NO: 880909 - RNA, 18 nt, Human
ugaaaugacacaaagauc

SEQ ID NO: 880910 - RNA, 20 nt, Human
ugaaguauuucaauuacaua

SEQ ID NO: 880911 - RNA, 22 nt, Human
ugaauucugaaaugacacaaag

SEQ ID NO: 880912 - RNA, 22 nt, Human
ugacgcagggaugccaggugug

SEQ ID NO: 880913 - RNA, 21 nt, Human
ugaucugaaguauuucaauua

SEQ ID NO: 880914 - RNA, 24 nt, Human
ugcacccucacuucuuccaccuaa

SEQ ID NO: 880915 - RNA, 19 nt, Human
ugcccaggggcucccgcgg

SEQ ID NO: 880916 - RNA, 20 nt, Human
ugcccaggggcucccgcggc

SEQ ID NO: 880917 - RNA, 23 nt, Human
ugcccuagugugcaagcagcagc

SEQ ID NO: 880918 - RNA, 21 nt, Human
ugccugaugcugaauagcuaa

SEQ ID NO: 880919 - RNA, 21 nt, Human
ugcugaauuuggauuuaacau

SEQ ID NO: 880920 - RNA, 24 nt, Human
ugggcugcggcugcugcugugggg

SEQ ID NO: 880921 - RNA, 19 nt, Human
uggggcccggcgccgccuu

SEQ ID NO: 880922 - RNA, 20 nt, Human
ugguuuacuuucuuuuucuu

SEQ ID NO: 880923 - RNA, 19 nt, Human
uguaauccauguuuuuaca

SEQ ID NO: 880924 - RNA, 24 nt, Human
ugugcccuagugugcaagcagcag

SEQ ID NO: 880925 - RNA, 22 nt, Human
uguggcugacugagcuccaggg

SEQ ID NO: 880926 - RNA, 22 nt, Human
uuccaauguaagaguaacauga

SEQ ID NO: 880927 - RNA, 18 nt, Human
uuccucugcuguacaaau

SEQ ID NO: 880928 - RNA, 22 nt, Human
uuccuuaggagaaagaaaaugc

SEQ ID NO: 880929 - RNA, 20 nt, Human
uugccacacugcacucagau

SEQ ID NO: 880930 - RNA, 22 nt, Human
uuucuggagcuauuuuccuaac

SEQ ID NO: 880931 - RNA, 18 nt, Human
uuuuuuuuuuuuuuuuug

SEQ ID NO: 880932 - RNA, 25 nt, Human
aaaaauggaagagauuggggaggga

SEQ ID NO: 880933 - RNA, 20 nt, Human
aaaauucuuggccgggcaca

SEQ ID NO: 880934 - RNA, 19 nt, Human
aacacggugaaacccuguc

SEQ ID NO: 880935 - RNA, 20 nt, Human
aacacggugaaacccugucu

SEQ ID NO: 880936 - RNA, 21 nt, Human
aacacggugaaacccugucuc

SEQ ID NO: 880937 - RNA, 20 nt, Human
aacauggugaaaucuugucu

SEQ ID NO: 880938 - RNA, 18 nt, Human
aagcaggagaaucacuug

SEQ ID NO: 880939 - RNA, 24 nt, Human
aagcaggagaaucacuugaaccca

SEQ ID NO: 880940 - RNA, 25 nt, Human
aagcaggagaaucacuugaacccag

SEQ ID NO: 880941 - RNA, 23 nt, Human
aagcugcguggccgggcugcugg

SEQ ID NO: 880942 - RNA, 24 nt, Human
aaucacuugaacccaggaggugga

SEQ ID NO: 880943 - RNA, 24 nt, Human
aauggcgugaaucugggaggcgga

SEQ ID NO: 880944 - RNA, 25 nt, Human
acaggcccaggcagggcuguggcca

SEQ ID NO: 880945 - RNA, 23 nt, Human
acaguggagaagacaaggcagga

SEQ ID NO: 880946 - RNA, 22 nt, Human
acccuggaagccauccagccuc

SEQ ID NO: 880947 - RNA, 23 nt, Human
acccugucucuacuaaaauacaa

SEQ ID NO: 880948 - RNA, 21 nt, Human
acgaaacacucaccaagcccc

SEQ ID NO: 880949 - RNA, 21 nt, Human
acugcacuccagccugguuag

SEQ ID NO: 880950 - RNA, 19 nt, Human
agaagaacggaagaagcag

SEQ ID NO: 880951 - RNA, 20 nt, Human
agaagaacggaagaagcaga

SEQ ID NO: 880952 - RNA, 21 nt, Human
agaagaacggaagaagcagag

SEQ ID NO: 880953 - RNA, 25 nt, Human
agaagccggggugcaggggacuagu

SEQ ID NO: 880954 - RNA, 18 nt, Human
agaggcugccugggucca

SEQ ID NO: 880955 - RNA, 24 nt, Human
agcacuuugggaggccgaggaugg

SEQ ID NO: 880956 - RNA, 24 nt, Human
agcacuuugggaggcugaggcugg

SEQ ID NO: 880957 - RNA, 19 nt, Human
agccagggagaggaggugg

SEQ ID NO: 880958 - RNA, 21 nt, Human
agccuggccaacauggugaaa

SEQ ID NO: 880959 - RNA, 23 nt, Human
aggaaagaggcugccugggucca

SEQ ID NO: 880960 - RNA, 23 nt, Human
aggaacaguggagaagacaaggc

SEQ ID NO: 880961 - RNA, 23 nt, Human
aggagccugggagccacccaggg

SEQ ID NO: 880962 - RNA, 20 nt, Human
aggaguuugagaccagccug

SEQ ID NO: 880963 - RNA, 24 nt, Human
aggaucacuggaggccaggaguuc

SEQ ID NO: 880964 - RNA, 20 nt, Human
aggaugcagugagccgagau

SEQ ID NO: 880965 - RNA, 20 nt, Human
aggcagaaguuccaggagcc

SEQ ID NO: 880966 - RNA, 20 nt, Human
aggcaggagaauggcgugaa

SEQ ID NO: 880967 - RNA, 24 nt, Human
aggcaggagaauggcgugaaucug

SEQ ID NO: 880968 - RNA, 19 nt, Human
aggccgagcaagcugggug

SEQ ID NO: 880969 - RNA, 21 nt, Human
aggccgaggauggaggaucac

SEQ ID NO: 880970 - RNA, 22 nt, Human
aggccgggugcaguagcucaug

SEQ ID NO: 880971 - RNA, 25 nt, Human
aggcggagcuugcagugacaacggu

SEQ ID NO: 880972 - RNA, 24 nt, Human
aggcggagcuugcagugagccgag

SEQ ID NO: 880973 - RNA, 24 nt, Human
aggcugaagcaggagaaucacuug

SEQ ID NO: 880974 - RNA, 19 nt, Human
aggcugaggcaggagaaug

SEQ ID NO: 880975 - RNA, 24 nt, Human
aggcugguggaucacaaggucagg

SEQ ID NO: 880976 - RNA, 19 nt, Human
agggaggaaagaggcugcc

SEQ ID NO: 880977 - RNA, 26 nt, Human
agguaggcggaucaccugaagucagg

SEQ ID NO: 880978 - RNA, 21 nt, Human
agguggaggaugcagugagcc

SEQ ID NO: 880979 - RNA, 24 nt, Human
agguggaggaugcagugagccgag

SEQ ID NO: 880980 - RNA, 23 nt, Human
aguagcucaugccuguaauccca

SEQ ID NO: 880981 - RNA, 24 nt, Human
aguagcucaugccuguaaucccag

SEQ ID NO: 880982 - RNA, 24 nt, Human
aguggcucacgccuguaaucccag

SEQ ID NO: 880983 - RNA, 21 nt, Human
auaaaaaucaaacccuuuaug

SEQ ID NO: 880984 - RNA, 24 nt, Human
aucccaccacugcacuccagccug

SEQ ID NO: 880985 - RNA, 23 nt, Human
aucccaggcgcccagaggugacc

SEQ ID NO: 880986 - RNA, 22 nt, Human
augcagugagccgagauugugc

SEQ ID NO: 880987 - RNA, 19 nt, Human
augccuguaaucccagcac

SEQ ID NO: 880988 - RNA, 18 nt, Human
caaaguggacaucguucc

SEQ ID NO: 880989 - RNA, 24 nt, Human
caacauggugaaaucuugucucua

SEQ ID NO: 880990 - RNA, 24 nt, Human
caagaccauccuggcuaacacggu

SEQ ID NO: 880991 - RNA, 19 nt, Human
caagguaggcggaucaccu

SEQ ID NO: 880992 - RNA, 26 nt, Human
caagguaggcggaucaccugaaguca

SEQ ID NO: 880993 - RNA, 23 nt, Human
cacaccuguaaucccagcuacuu

SEQ ID NO: 880994 - RNA, 30 nt, Human
cacccagggcaaggagugacccuggaagcc

SEQ ID NO: 880995 - RNA, 24 nt, Human
caccccugugauuccagcacuuug

SEQ ID NO: 880996 - RNA, 23 nt, Human
caccugaagucaggaguuugaga

SEQ ID NO: 880997 - RNA, 20 nt, Human
caccuguaaucccagcuacu

SEQ ID NO: 880998 - RNA, 24 nt, Human
caccuguaaucccagcuacuuggg

SEQ ID NO: 880999 - RNA, 24 nt, Human
cacgccuguaaucccagcacuuug

SEQ ID NO: 881000 - RNA, 18 nt, Human
cacugcacuccagccugg

SEQ ID NO: 881001 - RNA, 18 nt, Human
cacugcacuccagccugg

SEQ ID NO: 881002 - RNA, 21 nt, Human
cacugcacuccagccugguua

SEQ ID NO: 881003 - RNA, 22 nt, Human
cacugcacuccagccugguuag

SEQ ID NO: 881004 - RNA, 24 nt, Human
cacuggacuccagucugggcgaca

SEQ ID NO: 881005 - RNA, 25 nt, Human
cagcacuuugggaggccgaggaugg

SEQ ID NO: 881006 - RNA, 23 nt, Human
cagcacuuugggaggcugaggcu

SEQ ID NO: 881007 - RNA, 25 nt, Human
cagcacuuugggaggcugaggcugg

SEQ ID NO: 881008 - RNA, 24 nt, Human
cagcacuuuuggaggccaagguag

SEQ ID NO: 881009 - RNA, 25 nt, Human
cagcacuuuuggaggccaagguagg

SEQ ID NO: 881010 - RNA, 19 nt, Human
caggagccugggagccacc

SEQ ID NO: 881011 - RNA, 29 nt, Human
caggagguggaggaugcagugacaacggu

SEQ ID NO: 881012 - RNA, 20 nt, Human
cagugagccgagaucccacc

SEQ ID NO: 881013 - RNA, 20 nt, Human
caugccuguaaucccagcac

SEQ ID NO: 881014 - RNA, 25 nt, Human
caugccuguaaucccagcacuuuug

SEQ ID NO: 881015 - RNA, 24 nt, Human
ccaagccccacagcucucccgcgg

SEQ ID NO: 881016 - RNA, 26 nt, Human
ccaagccccacagcucucccgcggac

SEQ ID NO: 881017 - RNA, 25 nt, Human
ccaccacugcacuccagccugguua

SEQ ID NO: 881018 - RNA, 19 nt, Human
ccacgaaacacucaccaag

SEQ ID NO: 881019 - RNA, 23 nt, Human
ccacgaaacacucaccaagcccc

SEQ ID NO: 881020 - RNA, 19 nt, Human
ccacugcacuccagccugg

SEQ ID NO: 881021 - RNA, 19 nt, Human
ccacugcacuccagccugg

SEQ ID NO: 881022 - RNA, 19 nt, Human
ccacugcacuccagccugg

SEQ ID NO: 881023 - RNA, 19 nt, Human
ccacugcacuccagccugg

SEQ ID NO: 881024 - RNA, 20 nt, Human
ccacugcacuccagccuggu

SEQ ID NO: 881025 - RNA, 21 nt, Human
ccacuggacuccagucugggc

SEQ ID NO: 881026 - RNA, 23 nt, Human
ccacuggacuccagucugggcga

SEQ ID NO: 881027 - RNA, 23 nt, Human
ccaggcgcccagaggugaccaga

SEQ ID NO: 881028 - RNA, 19 nt, Human
ccccacagcucucccgcgg

SEQ ID NO: 881029 - RNA, 22 nt, Human
cccgagcccugggggagacaga

SEQ ID NO: 881030 - RNA, 21 nt, Human
cccuccgcucugcucuucucg

SEQ ID NO: 881031 - RNA, 21 nt, Human
cccugggggagacagaggugu

SEQ ID NO: 881032 - RNA, 19 nt, Human
ccgggcgugacggugggug

SEQ ID NO: 881033 - RNA, 22 nt, Human
ccuccccgagcccaccugggaa

SEQ ID NO: 881034 - RNA, 19 nt, Human
ccucuugccuccccaacgg

SEQ ID NO: 881035 - RNA, 22 nt, Human
ccugaagucaggaguuugagac

SEQ ID NO: 881036 - RNA, 23 nt, Human
ccugaagucaggaguuugagacc

SEQ ID NO: 881037 - RNA, 19 nt, Human
ccuggccaacauggugaaa

SEQ ID NO: 881038 - RNA, 21 nt, Human
ccuggccaacauggugaaauc

SEQ ID NO: 881039 - RNA, 24 nt, Human
ccuggccaacauggugaaaucuug

SEQ ID NO: 881040 - RNA, 22 nt, Human
ccuggcuaacacggugaaaccc

SEQ ID NO: 881041 - RNA, 24 nt, Human
ccuggcuaacacggugaaacccug

SEQ ID NO: 881042 - RNA, 22 nt, Human
ccuguaaucccagcacuuuggg

SEQ ID NO: 881043 - RNA, 21 nt, Human
ccuguaaucccagcuacuugg

SEQ ID NO: 881044 - RNA, 18 nt, Human
ccuguagucccagcugcu

SEQ ID NO: 881045 - RNA, 21 nt, Human
ccuguagucccagcugcuggg

SEQ ID NO: 881046 - RNA, 22 nt, Human
ccuguagucccagcugcugggg

SEQ ID NO: 881047 - RNA, 22 nt, Human
ccuuuaugauacacaaaggggc

SEQ ID NO: 881048 - RNA, 18 nt, Human
cgaaacacucaccaagcc

SEQ ID NO: 881049 - RNA, 24 nt, Human
cgagaccccugucucuaguaugac

SEQ ID NO: 881050 - RNA, 22 nt, Human
cgagaucccaccacugcacucc

SEQ ID NO: 881051 - RNA, 24 nt, Human
cgcagccccaggggccacacagaa

SEQ ID NO: 881052 - RNA, 24 nt, Human
cgcccagaggugaccagacuucug

SEQ ID NO: 881053 - RNA, 26 nt, Human
cgcucugcucuucucggauuccucca

SEQ ID NO: 881054 - RNA, 21 nt, Human
cggaucaccugaagucaggag

SEQ ID NO: 881055 - RNA, 24 nt, Human
cggaucaccugaagucaggaguuu

SEQ ID NO: 881056 - RNA, 22 nt, Human
cggauuccuccaggaacagugg

SEQ ID NO: 881057 - RNA, 22 nt, Human
cgggcaccgggagacccgcggg

SEQ ID NO: 881058 - RNA, 22 nt, Human
cuaaaacuacaauaauuuccug

SEQ ID NO: 881059 - RNA, 22 nt, Human
cuaguaugaccaaaaaaaaaaa

SEQ ID NO: 881060 - RNA, 24 nt, Human
cucaccccugugauuccagcacuu

SEQ ID NO: 881061 - RNA, 22 nt, Human
cucacgccuguaaucccagcac

SEQ ID NO: 881062 - RNA, 24 nt, Human
cucacgccuguaaucccagcacuu

SEQ ID NO: 881063 - RNA, 24 nt, Human
cucaugccuguaaucccagcacuu

SEQ ID NO: 881064 - RNA, 21 nt, Human
cucccaccuccccgagcccac

SEQ ID NO: 881065 - RNA, 18 nt, Human
cuccugaggaccaacacc

SEQ ID NO: 881066 - RNA, 28 nt, Human
cucuaguaugaccaaaaaaaaaaaaauc

SEQ ID NO: 881067 - RNA, 22 nt, Human
cucuucggugaccaucccaggc

SEQ ID NO: 881068 - RNA, 24 nt, Human
cuggccaacauggugaaaucuugu

SEQ ID NO: 881069 - RNA, 18 nt, Human
cuggcuaacacggugaaa

SEQ ID NO: 881070 - RNA, 24 nt, Human
cuggcuaacacggugaaacccugu

SEQ ID NO: 881071 - RNA, 22 nt, Human
cugggccagcuggcugggggug

SEQ ID NO: 881072 - RNA, 19 nt, Human
cugguggaucacaagguca

SEQ ID NO: 881073 - RNA, 21 nt, Human
cuguaaucccagcuacuuggg

SEQ ID NO: 881074 - RNA, 23 nt, Human
cuucucggauuccuccaggaaca

SEQ ID NO: 881075 - RNA, 21 nt, Human
cuugaacccaggagguggagg

SEQ ID NO: 881076 - RNA, 19 nt, Human
cuugcagugagccgagauc

SEQ ID NO: 881077 - RNA, 24 nt, Human
cuuggccgggcacaguggcucacg

SEQ ID NO: 881078 - RNA, 20 nt, Human
cuuggugacgccugcucucc

SEQ ID NO: 881079 - RNA, 20 nt, Human
cuugucucuacuaaaacuac

SEQ ID NO: 881080 - RNA, 20 nt, Human
gaaacacucaccaagcccca

SEQ ID NO: 881081 - RNA, 22 nt, Human
gaaacacucaccaagccccaca

SEQ ID NO: 881082 - RNA, 20 nt, Human
gaaggaucaaggacaagucc

SEQ ID NO: 881083 - RNA, 18 nt, Human
gaccaacaccugcucagc

SEQ ID NO: 881084 - RNA, 19 nt, Human
gaccacuguggugaaaggc

SEQ ID NO: 881085 - RNA, 23 nt, Human
gagaaucacuugaacccaggagg

SEQ ID NO: 881086 - RNA, 24 nt, Human
gagaggccacgaaacacucaccaa

SEQ ID NO: 881087 - RNA, 23 nt, Human
gagaucccaccacugcacuccag

SEQ ID NO: 881088 - RNA, 19 nt, Human
gagccugggagccacccag

SEQ ID NO: 881089 - RNA, 18 nt, Human
gagcuugcagugagccga

SEQ ID NO: 881090 - RNA, 22 nt, Human
gagcuugcagugagccgagauc

SEQ ID NO: 881091 - RNA, 23 nt, Human
gaggaugcagugagccgagauug

SEQ ID NO: 881092 - RNA, 19 nt, Human
gaggauggaggaucacugg

SEQ ID NO: 881093 - RNA, 21 nt, Human
gaggcagagagcucacuaugu

SEQ ID NO: 881094 - RNA, 18 nt, Human
gagggguccugggccagc

SEQ ID NO: 881095 - RNA, 22 nt, Human
gagguggauggagugagggugg

SEQ ID NO: 881096 - RNA, 24 nt, Human
gaucaccugaagucaggaguuuga

SEQ ID NO: 881097 - RNA, 24 nt, Human
gaucacuggaggccaggaguucag

SEQ ID NO: 881098 - RNA, 18 nt, Human
gauggagugaggguggag

SEQ ID NO: 881099 - RNA, 21 nt, Human
gaugguuccagagcguccucc

SEQ ID NO: 881100 - RNA, 18 nt, Human
gcagaagccaggagagac

SEQ ID NO: 881101 - RNA, 18 nt, Human
gcagggcuguggccacag

SEQ ID NO: 881102 - RNA, 24 nt, Human
gccaacauggugaaaucuugucuc

SEQ ID NO: 881103 - RNA, 18 nt, Human
gccacgaaacacucacca

SEQ ID NO: 881104 - RNA, 18 nt, Human
gcgguggcucaccccugu

SEQ ID NO: 881105 - RNA, 24 nt, Human
gcuaacacggugaaacccugucuc

SEQ ID NO: 881106 - RNA, 22 nt, Human
gcucccuccgcucugcucuucu

SEQ ID NO: 881107 - RNA, 25 nt, Human
gcucugcucuucucggauuccucca

SEQ ID NO: 881108 - RNA, 22 nt, Human
gcugaggcaggagaauggcgug

SEQ ID NO: 881109 - RNA, 21 nt, Human
gcugggggugcugaccaaccc

SEQ ID NO: 881110 - RNA, 19 nt, Human
ggaagagagagggcugggc

SEQ ID NO: 881111 - RNA, 19 nt, Human
ggaagugguuuaaaaacac

SEQ ID NO: 881112 - RNA, 19 nt, Human
ggagacagaggugugggug

SEQ ID NO: 881113 - RNA, 18 nt, Human
ggagcuugcagugagccg

SEQ ID NO: 881114 - RNA, 22 nt, Human
ggaggaugcagugagccgagau

SEQ ID NO: 881115 - RNA, 24 nt, Human
ggaggaugcagugagccgagauug

SEQ ID NO: 881116 - RNA, 22 nt, Human
ggaggccaagguaggcggauca

SEQ ID NO: 881117 - RNA, 19 nt, Human
ggaggcugaggcuggugga

SEQ ID NO: 881118 - RNA, 18 nt, Human
ggaggggacagagauggu

SEQ ID NO: 881119 - RNA, 21 nt, Human
ggaguccaggaagcccuggau

SEQ ID NO: 881120 - RNA, 22 nt, Human
ggaucaccugaagucaggaguu

SEQ ID NO: 881121 - RNA, 25 nt, Human
ggaucaccugaagucaggaguuuga

SEQ ID NO: 881122 - RNA, 22 nt, Human
ggcaaggagugacccuggaagc

SEQ ID NO: 881123 - RNA, 23 nt, Human
ggcacaguggcucacgccuguaa

SEQ ID NO: 881124 - RNA, 21 nt, Human
ggcucggccccuggucucccu

SEQ ID NO: 881125 - RNA, 18 nt, Human
gggcacaguggcucacgc

SEQ ID NO: 881126 - RNA, 24 nt, Human
gggcgcgguggcucaccccuguga

SEQ ID NO: 881127 - RNA, 24 nt, Human
gggcgugguggcgcacaccuguaa

SEQ ID NO: 881128 - RNA, 18 nt, Human
gggcucccuccgcucugc

SEQ ID NO: 881129 - RNA, 20 nt, Human
gggcucccuccgcucugcuc

SEQ ID NO: 881130 - RNA, 22 nt, Human
gggcuucaucuuccagguacaa

SEQ ID NO: 881131 - RNA, 22 nt, Human
ggggagugcggaguaaaggccu

SEQ ID NO: 881132 - RNA, 23 nt, Human
ggguggcagggguucagccaggg

SEQ ID NO: 881133 - RNA, 25 nt, Human
ggguguuugggcuucaucuuccagg

SEQ ID NO: 881134 - RNA, 21 nt, Human
gguccugggccagcuggcugg

SEQ ID NO: 881135 - RNA, 20 nt, Human
ggucugggacagugcagggc

SEQ ID NO: 881136 - RNA, 23 nt, Human
ggugcaguagcucaugccuguaa

SEQ ID NO: 881137 - RNA, 21 nt, Human
gguggaggaugcagugagccg

SEQ ID NO: 881138 - RNA, 24 nt, Human
gguggaggcagaaguuccaggagc

SEQ ID NO: 881139 - RNA, 21 nt, Human
gguggaucacaaggucaggag

SEQ ID NO: 881140 - RNA, 24 nt, Human
gguggcgcacaccuguaaucccag

SEQ ID NO: 881141 - RNA, 23 nt, Human
gguggcucaccccugugauucca

SEQ ID NO: 881142 - RNA, 24 nt, Human
gguggcucaccccugugauuccag

SEQ ID NO: 881143 - RNA, 20 nt, Human
ggugggugccuguaguccca

SEQ ID NO: 881144 - RNA, 21 nt, Human
gguuaggccgggugcaguagc

SEQ ID NO: 881145 - RNA, 20 nt, Human
gguuguaaaugugacuauaa

SEQ ID NO: 881146 - RNA, 19 nt, Human
gucucuacuaaaacuacaa

SEQ ID NO: 881147 - RNA, 18 nt, Human
gucugggacagugcaggg

SEQ ID NO: 881148 - RNA, 21 nt, Human
gugaaacccugucucuacuaa

SEQ ID NO: 881149 - RNA, 23 nt, Human
gugcugaccaacccgagaggcca

SEQ ID NO: 881150 - RNA, 23 nt, Human
guggcucaccccugugauuccag

SEQ ID NO: 881151 - RNA, 22 nt, Human
guucaaaaaaaauaaaaaucuc

SEQ ID NO: 881152 - RNA, 19 nt, Human
guuccugauuucauggagu

SEQ ID NO: 881153 - RNA, 22 nt, Human
uaacacggugaaacccugucuc

SEQ ID NO: 881154 - RNA, 24 nt, Human
uaacacggugaaacccugucucua

SEQ ID NO: 881155 - RNA, 21 nt, Human
uagccgggcgugacggugggu

SEQ ID NO: 881156 - RNA, 22 nt, Human
uagcucaugccuguaaucccag

SEQ ID NO: 881157 - RNA, 24 nt, Human
uagcucaugccuguaaucccagca

SEQ ID NO: 881158 - RNA, 24 nt, Human
uaggcggaucaccugaagucagga

SEQ ID NO: 881159 - RNA, 22 nt, Human
uaugaccaaaaaaaaaaaaauc

SEQ ID NO: 881160 - RNA, 18 nt, Human
ucacaaggucaggagauc

SEQ ID NO: 881161 - RNA, 24 nt, Human
ucacaaggucaggagaucaagacc

SEQ ID NO: 881162 - RNA, 19 nt, Human
ucaccugaagucaggaguu

SEQ ID NO: 881163 - RNA, 20 nt, Human
ucagaagaacggaagaagca

SEQ ID NO: 881164 - RNA, 22 nt, Human
ucaugccuguaaucccagcacu

SEQ ID NO: 881165 - RNA, 20 nt, Human
uccaagugccggaccuggug

SEQ ID NO: 881166 - RNA, 22 nt, Human
uccccgagcccaccugggaagc

SEQ ID NO: 881167 - RNA, 18 nt, Human
ucccugagaugcucaggc

SEQ ID NO: 881168 - RNA, 25 nt, Human
ucccugcucccaccuccccgagccc

SEQ ID NO: 881169 - RNA, 22 nt, Human
uccgaggccccagcggcgguuc

SEQ ID NO: 881170 - RNA, 23 nt, Human
uccgggguuggagcuccugagga

SEQ ID NO: 881171 - RNA, 21 nt, Human
uccuccaagucuccgaggccc

SEQ ID NO: 881172 - RNA, 22 nt, Human
uccugaggaccaacaccugcuc

SEQ ID NO: 881173 - RNA, 18 nt, Human
ucucagggcccugcucuc

SEQ ID NO: 881174 - RNA, 24 nt, Human
ucucccgcggaccgugucuggggc

SEQ ID NO: 881175 - RNA, 23 nt, Human
ucucuacuaaaauacaaaaaaau

SEQ ID NO: 881176 - RNA, 22 nt, Human
ucugcucuucucggauuccucc

SEQ ID NO: 881177 - RNA, 20 nt, Human
ugaagcaggagaaucacuug

SEQ ID NO: 881178 - RNA, 24 nt, Human
ugaagcaggagaaucacuugaacc

SEQ ID NO: 881179 - RNA, 23 nt, Human
ugaaucugggaggcggagcuugc

SEQ ID NO: 881180 - RNA, 23 nt, Human
ugaccaaaaaaaaaaaaaucugu

SEQ ID NO: 881181 - RNA, 24 nt, Human
ugaccaaaaaaaaaaaaaucugua

SEQ ID NO: 881182 - RNA, 21 nt, Human
ugaccagacuucugugugguc

SEQ ID NO: 881183 - RNA, 23 nt, Human
ugagaccagccuggccaacaugg

SEQ ID NO: 881184 - RNA, 24 nt, Human
ugagaccagccuggccaacauggu

SEQ ID NO: 881185 - RNA, 21 nt, Human
ugagccgagauugugccacug

SEQ ID NO: 881186 - RNA, 24 nt, Human
ugagccgagauugugccacuggac

SEQ ID NO: 881187 - RNA, 23 nt, Human
ugaggaagagagagggcugggcg

SEQ ID NO: 881188 - RNA, 23 nt, Human
ugaggcaggagaauggcgugaau

SEQ ID NO: 881189 - RNA, 24 nt, Human
ugaggcaggagaauggcgugaauc

SEQ ID NO: 881190 - RNA, 25 nt, Human
ugaggcaggagaauggcgugaaucu

SEQ ID NO: 881191 - RNA, 24 nt, Human
ugaggcugguggaucacaagguca

SEQ ID NO: 881192 - RNA, 18 nt, Human
ugagggcucggcugggag

SEQ ID NO: 881193 - RNA, 24 nt, Human
ugccacuggacuccagucugggcg

SEQ ID NO: 881194 - RNA, 18 nt, Human
ugccuguaaucccagcac

SEQ ID NO: 881195 - RNA, 20 nt, Human
ugccuguagucccagcugcu

SEQ ID NO: 881196 - RNA, 18 nt, Human
ugcuggagacaucccgag

SEQ ID NO: 881197 - RNA, 20 nt, Human
ugcuggggaggcugaggcag

SEQ ID NO: 881198 - RNA, 22 nt, Human
uggaagagauuggggagggagg

SEQ ID NO: 881199 - RNA, 18 nt, Human
uggaagccauccagccuc

SEQ ID NO: 881200 - RNA, 21 nt, Human
uggacuucuguagaggggucc

SEQ ID NO: 881201 - RNA, 22 nt, Human
uggagcuccugaggaccaacac

SEQ ID NO: 881202 - RNA, 26 nt, Human
uggaggaugcagugagccgagauugu

SEQ ID NO: 881203 - RNA, 18 nt, Human
uggauggagugagggugg

SEQ ID NO: 881204 - RNA, 23 nt, Human
uggcagaacuggaagauuccaga

SEQ ID NO: 881205 - RNA, 20 nt, Human
uggcagaagccaggagagac

SEQ ID NO: 881206 - RNA, 24 nt, Human
uggccaacauggugaaaucuuguc

SEQ ID NO: 881207 - RNA, 22 nt, Human
uggccacagcagcccugggggc

SEQ ID NO: 881208 - RNA, 20 nt, Human
uggccgggcugcuggagaca

SEQ ID NO: 881209 - RNA, 22 nt, Human
uggcgcacaccuguaaucccag

SEQ ID NO: 881210 - RNA, 21 nt, Human
uggcucaccccugugauucca

SEQ ID NO: 881211 - RNA, 24 nt, Human
uggcucaccccugugauuccagca

SEQ ID NO: 881212 - RNA, 24 nt, Human
uggcucacgccuguaaucccagca

SEQ ID NO: 881213 - RNA, 19 nt, Human
uggcugccuuuucucaggg

SEQ ID NO: 881214 - RNA, 24 nt, Human
ugggaaaggccaauucuggcagaa

SEQ ID NO: 881215 - RNA, 24 nt, Human
ugggaggccgaggauggaggauca

SEQ ID NO: 881216 - RNA, 24 nt, Human
ugggaggcggagcuugcagugagc

SEQ ID NO: 881217 - RNA, 24 nt, Human
ugggaggcugaagcaggagaauca

SEQ ID NO: 881218 - RNA, 19 nt, Human
ugggaggcugaggcuggug

SEQ ID NO: 881219 - RNA, 24 nt, Human
ugggaggcugaggcugguggauca

SEQ ID NO: 881220 - RNA, 19 nt, Human
uggggagggaggaaagagg

SEQ ID NO: 881221 - RNA, 21 nt, Human
uggucucgcagccccaggggc

SEQ ID NO: 881222 - RNA, 21 nt, Human
uggucugggacagugcagggc

SEQ ID NO: 881223 - RNA, 22 nt, Human
uggucugggacagugcagggcu

SEQ ID NO: 881224 - RNA, 24 nt, Human
ugguggcgcacaccuguaauccca

SEQ ID NO: 881225 - RNA, 21 nt, Human
uguaggaggccgagcaagcug

SEQ ID NO: 881226 - RNA, 25 nt, Human
ugugaagagacaccagcggcugcca

SEQ ID NO: 881227 - RNA, 22 nt, Human
ugugacuauaaaaaucaaaccc

SEQ ID NO: 881228 - RNA, 22 nt, Human
uguggugaaaggccacugacaa

SEQ ID NO: 881229 - RNA, 24 nt, Human
uuagccgggcgugacggugggugc

SEQ ID NO: 881230 - RNA, 20 nt, Human
uucacguuuuagucccagac

SEQ ID NO: 881231 - RNA, 23 nt, Human
uucagaagaacggaagaagcaga

SEQ ID NO: 881232 - RNA, 20 nt, Human
uucaucuuccagguacaagg

SEQ ID NO: 881233 - RNA, 21 nt, Human
uucaucuuccagguacaagga

SEQ ID NO: 881234 - RNA, 18 nt, Human
uuccguaucuggcugggg

SEQ ID NO: 881235 - RNA, 21 nt, Human
uucuggugaggaguagggugg

SEQ ID NO: 881236 - RNA, 19 nt, Human
uugcagugagccgagaucc

SEQ ID NO: 881237 - RNA, 22 nt, Human
uugcagugagccgagaucccac

SEQ ID NO: 881238 - RNA, 21 nt, Human
uugcagugagccgagaucccc

SEQ ID NO: 881239 - RNA, 20 nt, Human
uugcagugagccgagauccg

SEQ ID NO: 881240 - RNA, 25 nt, Human
uugggaggccgaggauggaggauca

SEQ ID NO: 881241 - RNA, 25 nt, Human
uugggaggcugaagcaggagaauca

SEQ ID NO: 881242 - RNA, 25 nt, Human
uugggaggcugaggcugguggauca

SEQ ID NO: 881243 - RNA, 18 nt, Human
uuuagucccagacgggag

SEQ ID NO: 881244 - RNA, 23 nt, Human
uuucaggcuucggcaguaacagu

SEQ ID NO: 881245 - RNA, 20 nt, Human
uuugagggcucggcugggag

SEQ ID NO: 881246 - RNA, 22 nt, Human
uuuucuggcagaagccaggaga

SEQ ID NO: 881247 - RNA, 18 nt, Human
uuuuuuuuuuuuuuuccg

SEQ ID NO: 881248 - RNA, 18 nt, Human
aaaaggccaaauagaaug

SEQ ID NO: 881249 - RNA, 27 nt, Human
aaaaggccaaauagaauggugggcacc

SEQ ID NO: 881250 - RNA, 19 nt, Human
aacauggugaaacccccuc

SEQ ID NO: 881251 - RNA, 20 nt, Human
aacauggugaaacccccucu

SEQ ID NO: 881252 - RNA, 20 nt, Human
aacauggugaaacccccucu

SEQ ID NO: 881253 - RNA, 18 nt, Human
aaucgcuugaaccuggga

SEQ ID NO: 881254 - RNA, 24 nt, Human
aaucgcuugaaccugggaggcgga

SEQ ID NO: 881255 - RNA, 24 nt, Human
acagagagagauuccaucucaaaa

SEQ ID NO: 881256 - RNA, 20 nt, Human
acagauccgaaguauauaau

SEQ ID NO: 881257 - RNA, 18 nt, Human
acuacacuccagccuggg

SEQ ID NO: 881258 - RNA, 24 nt, Human
acuacacuccagccugggcaacag

SEQ ID NO: 881259 - RNA, 23 nt, Human
agccaggcgugguggcgugcgcc

SEQ ID NO: 881260 - RNA, 24 nt, Human
agccugacaaacauggugaaaccc

SEQ ID NO: 881261 - RNA, 24 nt, Human
agccugggcaacagagagagauuc

SEQ ID NO: 881262 - RNA, 22 nt, Human
aggcaggagaaucgcuugaacc

SEQ ID NO: 881263 - RNA, 24 nt, Human
aggcaggagaaucgcuugaaccug

SEQ ID NO: 881264 - RNA, 20 nt, Human
aggcaggcggaucacgaggu

SEQ ID NO: 881265 - RNA, 24 nt, Human
aggcaggcggaucacgaggucagg

SEQ ID NO: 881266 - RNA, 20 nt, Human
aggcggagguugcagugagc

SEQ ID NO: 881267 - RNA, 24 nt, Human
aggcggagguugcagugagcugag

SEQ ID NO: 881268 - RNA, 24 nt, Human
aggcggaucacgaggucaggaguu

SEQ ID NO: 881269 - RNA, 24 nt, Human
aggcgugguggcgugcgccuguaa

SEQ ID NO: 881270 - RNA, 20 nt, Human
aggcugaggcaggagaaucg

SEQ ID NO: 881271 - RNA, 24 nt, Human
aggcugaggcaggagaaucgcuug

SEQ ID NO: 881272 - RNA, 18 nt, Human
auacuaauucaaaaggcc

SEQ ID NO: 881273 - RNA, 19 nt, Human
aucacgaggucaggaguuc

SEQ ID NO: 881274 - RNA, 24 nt, Human
aucgcaccacuacacuccagccug

SEQ ID NO: 881275 - RNA, 28 nt, Human
aucgcaccacuacacuccagccugggca

SEQ ID NO: 881276 - RNA, 23 nt, Human
caacagagagagauuccaucuca

SEQ ID NO: 881277 - RNA, 21 nt, Human
cacagauacuguagaaucccc

SEQ ID NO: 881278 - RNA, 24 nt, Human
cacgccuguaaucccagcacucug

SEQ ID NO: 881279 - RNA, 25 nt, Human
cacuacacuccagccugggcaacaa

SEQ ID NO: 881280 - RNA, 24 nt, Human
cagcacucugggaagucgaggcag

SEQ ID NO: 881281 - RNA, 22 nt, Human
cagccugggcaacagagagaga

SEQ ID NO: 881282 - RNA, 24 nt, Human
cagcuacucaggaggcugaggcag

SEQ ID NO: 881283 - RNA, 19 nt, Human
cauguaaaugaucugcagu

SEQ ID NO: 881284 - RNA, 19 nt, Human
cauuuugacugggggaggu

SEQ ID NO: 881285 - RNA, 21 nt, Human
ccacuacacuccagccugggc

SEQ ID NO: 881286 - RNA, 23 nt, Human
ccacuacacuccagccugggcaa

SEQ ID NO: 881287 - RNA, 24 nt, Human
ccacuacacuccagccugggcaac

SEQ ID NO: 881288 - RNA, 22 nt, Human
ccccucuguacuaaaaauacaa

SEQ ID NO: 881289 - RNA, 18 nt, Human
ccuguaaucccagcacuc

SEQ ID NO: 881290 - RNA, 22 nt, Human
ccuguaaucccagcacucuggg

SEQ ID NO: 881291 - RNA, 21 nt, Human
ccuguaaucccagcuacucag

SEQ ID NO: 881292 - RNA, 22 nt, Human
ccuguaaucccagcuacucagg

SEQ ID NO: 881293 - RNA, 24 nt, Human
cgagaccagccugacaaacauggu

SEQ ID NO: 881294 - RNA, 24 nt, Human
cgaggcaggcggaucacgagguca

SEQ ID NO: 881295 - RNA, 24 nt, Human
cgccuguaaucccagcuacucagg

SEQ ID NO: 881296 - RNA, 20 nt, Human
cucaaaaaaaaaaaaaucuc

SEQ ID NO: 881297 - RNA, 23 nt, Human
cucacgccuguaaucccagcacu

SEQ ID NO: 881298 - RNA, 24 nt, Human
cucacgccuguaaucccagcacuc

SEQ ID NO: 881299 - RNA, 20 nt, Human
cuccgugugcugaaaaaaaa

SEQ ID NO: 881300 - RNA, 20 nt, Human
cuguacuaaaaauacaaaaa

SEQ ID NO: 881301 - RNA, 19 nt, Human
cuugaaccugggaggcgga

SEQ ID NO: 881302 - RNA, 21 nt, Human
gaaguauauaaucugugaaaa

SEQ ID NO: 881303 - RNA, 23 nt, Human
gagaaucgcuugaaccugggagg

SEQ ID NO: 881304 - RNA, 23 nt, Human
gagguugcagugagcugagaucg

SEQ ID NO: 881305 - RNA, 22 nt, Human
gaucacgaggucaggaguucga

SEQ ID NO: 881306 - RNA, 24 nt, Human
gaucacgaggucaggaguucgaga

SEQ ID NO: 881307 - RNA, 20 nt, Human
gcauuuugacugggggaggu

SEQ ID NO: 881308 - RNA, 22 nt, Human
gcgugcgccuguaaucccagcu

SEQ ID NO: 881309 - RNA, 20 nt, Human
gcugagaucgcaccacuaca

SEQ ID NO: 881310 - RNA, 21 nt, Human
ggaagucgaggcaggcggauc

SEQ ID NO: 881311 - RNA, 22 nt, Human
ggagguugcagugagcugagau

SEQ ID NO: 881312 - RNA, 24 nt, Human
ggagguugcagugagcugagaucg

SEQ ID NO: 881313 - RNA, 21 nt, Human
ggaucacgaggucaggaguuc

SEQ ID NO: 881314 - RNA, 20 nt, Human
gggaagucgaggcaggcgga

SEQ ID NO: 881315 - RNA, 18 nt, Human
gggagggugugguggcuc

SEQ ID NO: 881316 - RNA, 21 nt, Human
gggagggugugguggcucacg

SEQ ID NO: 881317 - RNA, 24 nt, Human
gguggcgugcgccuguaaucccag

SEQ ID NO: 881318 - RNA, 24 nt, Human
gguggcucacgccuguaaucccag

SEQ ID NO: 881319 - RNA, 23 nt, Human
ggugugguggcucacgccuguaa

SEQ ID NO: 881320 - RNA, 23 nt, Human
guggcucacgccuguaaucccag

SEQ ID NO: 881321 - RNA, 19 nt, Human
guugcagugagcugagauc

SEQ ID NO: 881322 - RNA, 21 nt, Human
uaaaaauacaaaaauuagcca

SEQ ID NO: 881323 - RNA, 19 nt, Human
uaacugaacaguaaacaga

SEQ ID NO: 881324 - RNA, 20 nt, Human
uaccgaaaaaugcaaacaag

SEQ ID NO: 881325 - RNA, 19 nt, Human
uauucuaucaucugaaaua

SEQ ID NO: 881326 - RNA, 21 nt, Human
ucaaaaaaaaaaaaaucucau

SEQ ID NO: 881327 - RNA, 18 nt, Human
ucacgaggucaggaguuc

SEQ ID NO: 881328 - RNA, 24 nt, Human
ucacgaggucaggaguucgagacc

SEQ ID NO: 881329 - RNA, 20 nt, Human
ucagacuacaaaggugguuu

SEQ ID NO: 881330 - RNA, 23 nt, Human
uccaucucaaaaaaaaaaaaauc

SEQ ID NO: 881331 - RNA, 23 nt, Human
uccauuaauaagucauucaucca

SEQ ID NO: 881332 - RNA, 24 nt, Human
ucgcuugaaccugggaggcggagg

SEQ ID NO: 881333 - RNA, 22 nt, Human
ucucagaaacgguauaauccau

SEQ ID NO: 881334 - RNA, 24 nt, Human
ugaaccugggaggcggagguugca

SEQ ID NO: 881335 - RNA, 19 nt, Human
ugagcugagaucgcaccac

SEQ ID NO: 881336 - RNA, 20 nt, Human
ugaggcaggagaaucgcuug

SEQ ID NO: 881337 - RNA, 24 nt, Human
ugaggcaggagaaucgcuugaacc

SEQ ID NO: 881338 - RNA, 25 nt, Human
ugaggcaggagaaucgcuugaaccu

SEQ ID NO: 881339 - RNA, 19 nt, Human
ugcaaaauccugucacguu

SEQ ID NO: 881340 - RNA, 21 nt, Human
uggcgugcgccuguaauccca

SEQ ID NO: 881341 - RNA, 22 nt, Human
uggcgugcgccuguaaucccag

SEQ ID NO: 881342 - RNA, 24 nt, Human
uggcucacgccuguaaucccagca

SEQ ID NO: 881343 - RNA, 29 nt, Human
ugggaggcggagguugcagugacaacggu

SEQ ID NO: 881344 - RNA, 24 nt, Human
ugggaggcggagguugcagugagc

SEQ ID NO: 881345 - RNA, 24 nt, Human
ugguggcgugcgccuguaauccca

SEQ ID NO: 881346 - RNA, 24 nt, Human
ugguggcucacgccuguaauccca

SEQ ID NO: 881347 - RNA, 24 nt, Human
uugaaccugggaggcggagguugc

SEQ ID NO: 881348 - RNA, 18 nt, Human
uugcagugagcugagauc

SEQ ID NO: 881349 - RNA, 19 nt, Human
uugcagugagcugagaucg

SEQ ID NO: 881350 - RNA, 20 nt, Human
uugcagugagcugagaucgc

SEQ ID NO: 881351 - RNA, 22 nt, Human
uugcagugagcugagaucgcac

SEQ ID NO: 881352 - RNA, 20 nt, Human
uuuuaaaacuccuuauaaaa

SEQ ID NO: 881353 - RNA, 23 nt, Human
uuuuuuuucagacuacaaaggug

SEQ ID NO: 881354 - RNA, 22 nt, Human
uuuuuuuuuuuuuuuuuuucag

SEQ ID NO: 881355 - RNA, 23 nt, Human
aaaaaaaaaaaaagagaaaagga

SEQ ID NO: 881356 - RNA, 19 nt, Human
aaaaaaggagcacaaaugg

SEQ ID NO: 881357 - RNA, 23 nt, Human
aaaaacaauuccuaaaagauuga

SEQ ID NO: 881358 - RNA, 26 nt, Human
aaaaauuuaaugaagaucugaaaaac

SEQ ID NO: 881359 - RNA, 27 nt, Human
aaacagaaaacaaacaucaagggaccc

SEQ ID NO: 881360 - RNA, 23 nt, Human
aagaacaaaaauguguuuaugga

SEQ ID NO: 881361 - RNA, 22 nt, Human
aagagauagacuaagaacaaaa

SEQ ID NO: 881362 - RNA, 18 nt, Human
aagcagaggcccaugaaa

SEQ ID NO: 881363 - RNA, 21 nt, Human
acaaaaacugugaaacaagcc

SEQ ID NO: 881364 - RNA, 19 nt, Human
acaaauacaaaaacuguga

SEQ ID NO: 881365 - RNA, 20 nt, Human
agcauucaaaagcagcuuug

SEQ ID NO: 881366 - RNA, 19 nt, Human
aggcaauaaaacacucuac

SEQ ID NO: 881367 - RNA, 24 nt, Human
aguacucugcucuccggaacccac

SEQ ID NO: 881368 - RNA, 22 nt, Human
auggaugacuugcaaaggaugg

SEQ ID NO: 881369 - RNA, 20 nt, Human
auggcaaccuuuacacacuu

SEQ ID NO: 881370 - RNA, 25 nt, Human
cacaaauacaaaaacugugaaacaa

SEQ ID NO: 881371 - RNA, 21 nt, Human
caccauuaaaaaaaaaaagga

SEQ ID NO: 881372 - RNA, 25 nt, Human
cagcaacuuugaaaugaaaaaaaaa

SEQ ID NO: 881373 - RNA, 23 nt, Human
caucguuuguacaagagauagac

SEQ ID NO: 881374 - RNA, 18 nt, Human
ccacuguaauguauaaag

SEQ ID NO: 881375 - RNA, 21 nt, Human
ccacuguaauguauaaaguau

SEQ ID NO: 881376 - RNA, 22 nt, Human
cccucugcauacugcuccugau

SEQ ID NO: 881377 - RNA, 21 nt, Human
cgcucacccuccuggaauuua

SEQ ID NO: 881378 - RNA, 23 nt, Human
cucuccggaacccacucauccca

SEQ ID NO: 881379 - RNA, 18 nt, Human
cugcauacugcuccugau

SEQ ID NO: 881380 - RNA, 19 nt, Human
cuucagcaccauuuauaag

SEQ ID NO: 881381 - RNA, 22 nt, Human
gaaaaaaaaaaaaaaaaaagag

SEQ ID NO: 881382 - RNA, 23 nt, Human
guacucugcucuccggaacccac

SEQ ID NO: 881383 - RNA, 19 nt, Human
guauucaguuauauacacu

SEQ ID NO: 881384 - RNA, 22 nt, Human
uaaaacacucuacagcauaucc

SEQ ID NO: 881385 - RNA, 23 nt, Human
uaaaacacucuacagcauauccc

SEQ ID NO: 881386 - RNA, 20 nt, Human
uaaaaugccuaaguaacaac

SEQ ID NO: 881387 - RNA, 23 nt, Human
uaaagcagaggcccaugaaacca

SEQ ID NO: 881388 - RNA, 23 nt, Human
uaacaacauggaugacuugcaaa

SEQ ID NO: 881389 - RNA, 22 nt, Human
uaagugauuugccaccuccucc

SEQ ID NO: 881390 - RNA, 20 nt, Human
ucaaaagcagcuuugucaac

SEQ ID NO: 881391 - RNA, 22 nt, Human
ucaaagcacaucguuuguacaa

SEQ ID NO: 881392 - RNA, 20 nt, Human
ucgcucacccuccuggaauu

SEQ ID NO: 881393 - RNA, 20 nt, Human
ugaaaaacaauuccuaaaag

SEQ ID NO: 881394 - RNA, 24 nt, Human
ugaaaaacaauuccuaaaagauug

SEQ ID NO: 881395 - RNA, 27 nt, Human
ugaaaacacuggcagcaacuuugaaau

SEQ ID NO: 881396 - RNA, 20 nt, Human
ugaaaugaaaaaaaaaaaaa

SEQ ID NO: 881397 - RNA, 22 nt, Human
ugaaccuuuggcacuaggaauc

SEQ ID NO: 881398 - RNA, 22 nt, Human
ugacuugcaaaggaugggcucu

SEQ ID NO: 881399 - RNA, 20 nt, Human
ugauuugccaccuccuccuu

SEQ ID NO: 881400 - RNA, 23 nt, Human
ugcuucagcaccauuuauaagug

SEQ ID NO: 881401 - RNA, 28 nt, Human
uggcagcaacuuugaaaugaaaaaaaaa

SEQ ID NO: 881402 - RNA, 20 nt, Human
ugugaaacaagccauucuuc

SEQ ID NO: 881403 - RNA, 25 nt, Human
ugugaaacaagccauucuucaacaa

SEQ ID NO: 881404 - RNA, 23 nt, Human
uguuguccaucauugaaaacacu

SEQ ID NO: 881405 - RNA, 25 nt, Human
uuauaagugauuugccaccuccuuc

SEQ ID NO: 881406 - RNA, 21 nt, Human
uuauggcaaccuuuacacacu

SEQ ID NO: 881407 - RNA, 24 nt, Human
uucaacaauuugagccaagauaaa

SEQ ID NO: 881408 - RNA, 20 nt, Human
uuugagccaagauaaaaugc

SEQ ID NO: 881409 - RNA, 18 nt, Human
uuugccaccuccuccuuc

SEQ ID NO: 881410 - RNA, 21 nt, Human
aaacaagauguccccagcagc

SEQ ID NO: 881411 - RNA, 18 nt, Human
aaacaauggggaaaucaa

SEQ ID NO: 881412 - RNA, 26 nt, Human
aaacaccccuccaacccacgccaucc

SEQ ID NO: 881413 - RNA, 20 nt, Human
aaacccuccagcagcagguc

SEQ ID NO: 881414 - RNA, 21 nt, Human
aaacugaauucagccaugcaa

SEQ ID NO: 881415 - RNA, 23 nt, Human
aaagagccaucaggaaagagggg

SEQ ID NO: 881416 - RNA, 20 nt, Human
aaagggacagacacaaggag

SEQ ID NO: 881417 - RNA, 24 nt, Human
aaagugcugggauuacagguguga

SEQ ID NO: 881418 - RNA, 19 nt, Human
aacaagauguccccagcag

SEQ ID NO: 881419 - RNA, 20 nt, Human
aacacccaaacagaagugaa

SEQ ID NO: 881420 - RNA, 22 nt, Human
aacaccccuccaacccacgcca

SEQ ID NO: 881421 - RNA, 26 nt, Human
aacaggucugggccugaaacaucacc

SEQ ID NO: 881422 - RNA, 21 nt, Human
aacucccuccuuuugcuucug

SEQ ID NO: 881423 - RNA, 24 nt, Human
aagaaggcaccguaggcacaggcu

SEQ ID NO: 881424 - RNA, 20 nt, Human
aagaaggcugagaaggggga

SEQ ID NO: 881425 - RNA, 26 nt, Human
aagaaucagcaaaaaacaagacuuuc

SEQ ID NO: 881426 - RNA, 22 nt, Human
aagacuuucccauuccucauag

SEQ ID NO: 881427 - RNA, 19 nt, Human
aaggaccauccugauaagc

SEQ ID NO: 881428 - RNA, 24 nt, Human
aagugaucugccugccuuggccuc

SEQ ID NO: 881429 - RNA, 18 nt, Human
aagugcugggauuacagg

SEQ ID NO: 881430 - RNA, 19 nt, Human
aagugcugggauuacaggu

SEQ ID NO: 881431 - RNA, 26 nt, Human
aagugcugggauuacaggugugagcc

SEQ ID NO: 881432 - RNA, 23 nt, Human
acagcaacauccucaacgccccu

SEQ ID NO: 881433 - RNA, 18 nt, Human
acaggguuuuaccauguu

SEQ ID NO: 881434 - RNA, 21 nt, Human
acaggguuuuaccauguuggc

SEQ ID NO: 881435 - RNA, 24 nt, Human
acaggguuuuaccauguuggccag

SEQ ID NO: 881436 - RNA, 25 nt, Human
acagguuucaucuggagcaacaggg

SEQ ID NO: 881437 - RNA, 18 nt, Human
accauguuggccaggcug

SEQ ID NO: 881438 - RNA, 20 nt, Human
accauguuggccaggcuggu

SEQ ID NO: 881439 - RNA, 23 nt, Human
accauguuggccaggcuggucuc

SEQ ID NO: 881440 - RNA, 24 nt, Human
acggagucuugcuguggugcccag

SEQ ID NO: 881441 - RNA, 18 nt, Human
agacuggcucaccuccca

SEQ ID NO: 881442 - RNA, 23 nt, Human
agagcccacugcgccugggggcu

SEQ ID NO: 881443 - RNA, 22 nt, Human
agcaaaaaacaagacuuuccca

SEQ ID NO: 881444 - RNA, 25 nt, Human
agcaaccgucgccugagagcuuugc

SEQ ID NO: 881445 - RNA, 24 nt, Human
agcacugggagcugguuggagaga

SEQ ID NO: 881446 - RNA, 25 nt, Human
agcagccccaaaggaaggggaacgc

SEQ ID NO: 881447 - RNA, 23 nt, Human
agcuggcuuccagauggugacau

SEQ ID NO: 881448 - RNA, 22 nt, Human
aggaagagcuggaggaaagggg

SEQ ID NO: 881449 - RNA, 24 nt, Human
aggaagccucuagugggacacuga

SEQ ID NO: 881450 - RNA, 21 nt, Human
aggcaaacaggucugggccug

SEQ ID NO: 881451 - RNA, 25 nt, Human
aggcaaacaggucugggccugaaac

SEQ ID NO: 881452 - RNA, 26 nt, Human
aggcaaacaggucugggccugaaaca

SEQ ID NO: 881453 - RNA, 20 nt, Human
aggcaagaaggcaccguagg

SEQ ID NO: 881454 - RNA, 20 nt, Human
aggcagagaggcgaccuggg

SEQ ID NO: 881455 - RNA, 21 nt, Human
aggcagagaggcgaccugggu

SEQ ID NO: 881456 - RNA, 24 nt, Human
aggcagagcggaggguggaucaga

SEQ ID NO: 881457 - RNA, 20 nt, Human
aggcugacauucugugcccu

SEQ ID NO: 881458 - RNA, 25 nt, Human
aggcuggagugcaguggcacgaucu

SEQ ID NO: 881459 - RNA, 22 nt, Human
agggagagggagguggcugagu

SEQ ID NO: 881460 - RNA, 20 nt, Human
agggaggggggcguggcaag

SEQ ID NO: 881461 - RNA, 19 nt, Human
agggccccuccucucuuuu

SEQ ID NO: 881462 - RNA, 18 nt, Human
aggggcccaggaucacug

SEQ ID NO: 881463 - RNA, 19 nt, Human
aggggcucagggagacaaa

SEQ ID NO: 881464 - RNA, 22 nt, Human
agguacaagugauucuccugcc

SEQ ID NO: 881465 - RNA, 23 nt, Human
agguacaagugauucuccugccu

SEQ ID NO: 881466 - RNA, 25 nt, Human
agguggggagguggggggaggagug

SEQ ID NO: 881467 - RNA, 20 nt, Human
agguuaugugggcccuugag

SEQ ID NO: 881468 - RNA, 19 nt, Human
aguagcugggacuacaggc

SEQ ID NO: 881469 - RNA, 23 nt, Human
aguagcugggacuacaggcaugu

SEQ ID NO: 881470 - RNA, 24 nt, Human
agucuugcuguggugcccaggcug

SEQ ID NO: 881471 - RNA, 24 nt, Human
agugauucuccugccucagccucu

SEQ ID NO: 881472 - RNA, 21 nt, Human
agugcaguggcacgaucucag

SEQ ID NO: 881473 - RNA, 23 nt, Human
agugcaguggcacgaucucagcu

SEQ ID NO: 881474 - RNA, 24 nt, Human
agugcaguggcacgaucucagcuc

SEQ ID NO: 881475 - RNA, 20 nt, Human
aguggagagggaggugaagc

SEQ ID NO: 881476 - RNA, 20 nt, Human
aucaccguagcccugacuug

SEQ ID NO: 881477 - RNA, 21 nt, Human
aucuggagcagaucagggaac

SEQ ID NO: 881478 - RNA, 24 nt, Human
auguugugccccaaaagccaggga

SEQ ID NO: 881479 - RNA, 24 nt, Human
auguuuguguuuuuaguagagaca

SEQ ID NO: 881480 - RNA, 20 nt, Human
auucaucccucuuuacuccu

SEQ ID NO: 881481 - RNA, 19 nt, Human
auuuuaugcuagaccucug

SEQ ID NO: 881482 - RNA, 21 nt, Human
caaagggcuuugugaccagug

SEQ ID NO: 881483 - RNA, 24 nt, Human
caaagugcugggauuacaggugug

SEQ ID NO: 881484 - RNA, 20 nt, Human
caacacccaaacagaaguga

SEQ ID NO: 881485 - RNA, 23 nt, Human
caagauguccccagcagccccaa

SEQ ID NO: 881486 - RNA, 22 nt, Human
caagugaucugccugccuuggc

SEQ ID NO: 881487 - RNA, 18 nt, Human
caagugauucuccugccu

SEQ ID NO: 881488 - RNA, 20 nt, Human
caagugauucuccugccuca

SEQ ID NO: 881489 - RNA, 21 nt, Human
caagugauucuccugccucag

SEQ ID NO: 881490 - RNA, 25 nt, Human
cacacacacagcaacauccucaacg

SEQ ID NO: 881491 - RNA, 24 nt, Human
cacacagcaacauccucaacgccc

SEQ ID NO: 881492 - RNA, 24 nt, Human
cacccaaacagaagugaauuucua

SEQ ID NO: 881493 - RNA, 21 nt, Human
caccccaucagcggcuaucca

SEQ ID NO: 881494 - RNA, 24 nt, Human
caccccuccaacccacgccauccc

SEQ ID NO: 881495 - RNA, 22 nt, Human
cacuccccccaccgcacacaca

SEQ ID NO: 881496 - RNA, 22 nt, Human
cacugaagauuaauucuugcug

SEQ ID NO: 881497 - RNA, 22 nt, Human
cagaacccuugaaagggacaga

SEQ ID NO: 881498 - RNA, 21 nt, Human
cagaagccuggacuggguuuu

SEQ ID NO: 881499 - RNA, 18 nt, Human
cagaggcaaacaggucug

SEQ ID NO: 881500 - RNA, 21 nt, Human
cagaguccugggcuggaagcc

SEQ ID NO: 881501 - RNA, 23 nt, Human
cagcaaaaaacaagacuuuccca

SEQ ID NO: 881502 - RNA, 19 nt, Human
cagcauggccagguggcug

SEQ ID NO: 881503 - RNA, 20 nt, Human
cagccaaacccuccagcagc

SEQ ID NO: 881504 - RNA, 22 nt, Human
cagcucacugcaaccuccuccu

SEQ ID NO: 881505 - RNA, 23 nt, Human
caggaaaacaccccuccaaccca

SEQ ID NO: 881506 - RNA, 21 nt, Human
caggagacuggcucaccuccc

SEQ ID NO: 881507 - RNA, 19 nt, Human
cagggauucccaaaagguc

SEQ ID NO: 881508 - RNA, 24 nt, Human
caggguuuuaccauguuggccagg

SEQ ID NO: 881509 - RNA, 24 nt, Human
caucaggaaagagggggacagacc

SEQ ID NO: 881510 - RNA, 21 nt, Human
caugcaauagggcugccuuaa

SEQ ID NO: 881511 - RNA, 21 nt, Human
caugugccagucucuagugca

SEQ ID NO: 881512 - RNA, 24 nt, Human
cauguuggccaggcuggucucaaa

SEQ ID NO: 881513 - RNA, 18 nt, Human
ccaaacccuccagcagca

SEQ ID NO: 881514 - RNA, 23 nt, Human
ccaaagcucaggugaaagggcuu

SEQ ID NO: 881515 - RNA, 21 nt, Human
ccaaagugcugggauuacagg

SEQ ID NO: 881516 - RNA, 21 nt, Human
ccaaagugcugggauuacagg

SEQ ID NO: 881517 - RNA, 24 nt, Human
ccaaagugcugggauuacaggugu

SEQ ID NO: 881518 - RNA, 18 nt, Human
ccagagcccuuucacagc

SEQ ID NO: 881519 - RNA, 19 nt, Human
ccagcagcaggucuugcag

SEQ ID NO: 881520 - RNA, 20 nt, Human
ccagcagcaggucuugcagc

SEQ ID NO: 881521 - RNA, 21 nt, Human
ccagcagcaggucuugcagcc

SEQ ID NO: 881522 - RNA, 26 nt, Human
ccagugaccuccucgauguccaaucc

SEQ ID NO: 881523 - RNA, 24 nt, Human
cccaccgcacacacacagcaacau

SEQ ID NO: 881524 - RNA, 22 nt, Human
cccaccugacuaucagauucac

SEQ ID NO: 881525 - RNA, 21 nt, Human
cccaccuucuugucuugauuu

SEQ ID NO: 881526 - RNA, 18 nt, Human
cccacugcgccugggggc

SEQ ID NO: 881527 - RNA, 23 nt, Human
cccagaaagcugacucaccccau

SEQ ID NO: 881528 - RNA, 18 nt, Human
cccaggaaaacaccccuc

SEQ ID NO: 881529 - RNA, 22 nt, Human
ccccaaaagccagggauuccca

SEQ ID NO: 881530 - RNA, 22 nt, Human
ccccuaaaaagugagaccugaa

SEQ ID NO: 881531 - RNA, 20 nt, Human
cccuacccaccuaacaaagc

SEQ ID NO: 881532 - RNA, 18 nt, Human
cccugguuuucuuuuucu

SEQ ID NO: 881533 - RNA, 21 nt, Human
ccucaggacuccaugugccag

SEQ ID NO: 881534 - RNA, 23 nt, Human
ccucccagcuucagccucgguuu

SEQ ID NO: 881535 - RNA, 24 nt, Human
ccucccagguacaagugauucucc

SEQ ID NO: 881536 - RNA, 23 nt, Human
ccucugggaaccauuggaaguuu

SEQ ID NO: 881537 - RNA, 21 nt, Human
ccugaccucaagugaucugcc

SEQ ID NO: 881538 - RNA, 23 nt, Human
ccugaccucaagugaucugccug

SEQ ID NO: 881539 - RNA, 26 nt, Human
ccugcagggccaggcuggcauagacc

SEQ ID NO: 881540 - RNA, 22 nt, Human
ccugccuuggccucccaaagug

SEQ ID NO: 881541 - RNA, 20 nt, Human
ccugggcuggaagccaggag

SEQ ID NO: 881542 - RNA, 21 nt, Human
ccugguuuuuucaguuagggc

SEQ ID NO: 881543 - RNA, 18 nt, Human
ccugugcccaccuccacg

SEQ ID NO: 881544 - RNA, 21 nt, Human
ccuguucuggcugacccaaaa

SEQ ID NO: 881545 - RNA, 22 nt, Human
ccuguucuggcugacccaaaag

SEQ ID NO: 881546 - RNA, 22 nt, Human
ccuuggucccagcgccuuccca

SEQ ID NO: 881547 - RNA, 21 nt, Human
cgcacacacacagcaacaucc

SEQ ID NO: 881548 - RNA, 18 nt, Human
cuaacaaagcugcugugu

SEQ ID NO: 881549 - RNA, 20 nt, Human
cucaagugaucugccugccu

SEQ ID NO: 881550 - RNA, 23 nt, Human
cucacugcaaccuccuccuccca

SEQ ID NO: 881551 - RNA, 24 nt, Human
cucacugcaaccuccuccucccag

SEQ ID NO: 881552 - RNA, 24 nt, Human
cucagccucuugaguagcugggac

SEQ ID NO: 881553 - RNA, 21 nt, Human
cucaggaagagcuggaggaaa

SEQ ID NO: 881554 - RNA, 19 nt, Human
cucccagguacaagugauu

SEQ ID NO: 881555 - RNA, 22 nt, Human
cucccccuacccaccuaacaaa

SEQ ID NO: 881556 - RNA, 25 nt, Human
cucuaaagagccaucaggaaagagg

SEQ ID NO: 881557 - RNA, 19 nt, Human
cucuaaugaaggaggugag

SEQ ID NO: 881558 - RNA, 21 nt, Human
cugaaagaagugagggaggcu

SEQ ID NO: 881559 - RNA, 22 nt, Human
cugaggcugacauucugugccc

SEQ ID NO: 881560 - RNA, 22 nt, Human
cugcaaccuccuccucccaggu

SEQ ID NO: 881561 - RNA, 23 nt, Human
cugccucagccucuugaguagcu

SEQ ID NO: 881562 - RNA, 23 nt, Human
cugccuuggccucccaaagugcu

SEQ ID NO: 881563 - RNA, 19 nt, Human
cuggggccagcuggcaggg

SEQ ID NO: 881564 - RNA, 23 nt, Human
cuguaaacugaauucagccaugc

SEQ ID NO: 881565 - RNA, 19 nt, Human
cugucaguagggacagguu

SEQ ID NO: 881566 - RNA, 23 nt, Human
cuguggugcccaggcuggagugc

SEQ ID NO: 881567 - RNA, 19 nt, Human
cuguuccucuuucccaaag

SEQ ID NO: 881568 - RNA, 23 nt, Human
cuugaguagcugggacuacaggc

SEQ ID NO: 881569 - RNA, 24 nt, Human
cuugaguagcugggacuacaggca

SEQ ID NO: 881570 - RNA, 25 nt, Human
gaaacaagauguccccagcagcccc

SEQ ID NO: 881571 - RNA, 20 nt, Human
gaaccauuggaaguuuuaaa

SEQ ID NO: 881572 - RNA, 18 nt, Human
gaagccuugucacucccc

SEQ ID NO: 881573 - RNA, 23 nt, Human
gaagccuugucacuccccccacc

SEQ ID NO: 881574 - RNA, 27 nt, Human
gaagccuugucacuccccccaccgcac

SEQ ID NO: 881575 - RNA, 22 nt, Human
gacaagucccuuacucuucuca

SEQ ID NO: 881576 - RNA, 24 nt, Human
gaccucaagugaucugccugccuu

SEQ ID NO: 881577 - RNA, 24 nt, Human
gacuacaggcaugugccaccauac

SEQ ID NO: 881578 - RNA, 27 nt, Human
gacugagcccugauaacuccaaaagcc

SEQ ID NO: 881579 - RNA, 19 nt, Human
gagauauuuaggcucugag

SEQ ID NO: 881580 - RNA, 25 nt, Human
gagcuguuccucuuucccaaagcuc

SEQ ID NO: 881581 - RNA, 20 nt, Human
gaggagcccccuaggcagag

SEQ ID NO: 881582 - RNA, 24 nt, Human
gaggggauuggacaugcuguuacc

SEQ ID NO: 881583 - RNA, 18 nt, Human
gagguggcugagugagca

SEQ ID NO: 881584 - RNA, 18 nt, Human
gagguggggggaggagug

SEQ ID NO: 881585 - RNA, 25 nt, Human
gaguagcugggacuacaggcaugug

SEQ ID NO: 881586 - RNA, 18 nt, Human
gauuacaggugugagcca

SEQ ID NO: 881587 - RNA, 22 nt, Human
gauuacaggugugagccaugac

SEQ ID NO: 881588 - RNA, 18 nt, Human
gcaauugugcaagaaccc

SEQ ID NO: 881589 - RNA, 25 nt, Human
gcaggguggggcccaccugacuauc

SEQ ID NO: 881590 - RNA, 21 nt, Human
gcaguggagagggaggugaag

SEQ ID NO: 881591 - RNA, 19 nt, Human
gcccaggcuggagugcagu

SEQ ID NO: 881592 - RNA, 22 nt, Human
gcccagggcccugcuuuuccug

SEQ ID NO: 881593 - RNA, 19 nt, Human
gcccucugagauccacucu

SEQ ID NO: 881594 - RNA, 19 nt, Human
gcccugguuuucuuuuucu

SEQ ID NO: 881595 - RNA, 23 nt, Human
gccucgguuucuccaccuguagg

SEQ ID NO: 881596 - RNA, 22 nt, Human
gccuuggccucccaaagugcug

SEQ ID NO: 881597 - RNA, 22 nt, Human
gcucacugcaaccuccuccucc

SEQ ID NO: 881598 - RNA, 19 nt, Human
gcucugugcccuuggacaa

SEQ ID NO: 881599 - RNA, 19 nt, Human
gcuggagugcaguggcacg

SEQ ID NO: 881600 - RNA, 21 nt, Human
gcuggguuucuauccucuggg

SEQ ID NO: 881601 - RNA, 21 nt, Human
gcuguguggacccaacgagcu

SEQ ID NO: 881602 - RNA, 21 nt, Human
ggaaaacaccccuccaaccca

SEQ ID NO: 881603 - RNA, 25 nt, Human
ggaaaugugcacuuucccaggauuc

SEQ ID NO: 881604 - RNA, 23 nt, Human
ggaaguuuuaaagcaggagggug

SEQ ID NO: 881605 - RNA, 22 nt, Human
ggacagacacaaggaccauccu

SEQ ID NO: 881606 - RNA, 19 nt, Human
ggacuacaggcaugugcca

SEQ ID NO: 881607 - RNA, 27 nt, Human
ggagacaguggaaguuaaccgguaccc

SEQ ID NO: 881608 - RNA, 19 nt, Human
ggaggacuugagggccggg

SEQ ID NO: 881609 - RNA, 23 nt, Human
ggagucuugcuguggugcccagg

SEQ ID NO: 881610 - RNA, 20 nt, Human
ggagugcagaguccugggcu

SEQ ID NO: 881611 - RNA, 22 nt, Human
gggaauggaggagcccccuagg

SEQ ID NO: 881612 - RNA, 23 nt, Human
ggggagguggggggaggagugca

SEQ ID NO: 881613 - RNA, 20 nt, Human
ggggauuugaccagaugacc

SEQ ID NO: 881614 - RNA, 21 nt, Human
ggggccagcuggcaggguggg

SEQ ID NO: 881615 - RNA, 22 nt, Human
ggggccagcuggcagggugggg

SEQ ID NO: 881616 - RNA, 19 nt, Human
ggggcguggcaagaggagg

SEQ ID NO: 881617 - RNA, 22 nt, Human
ggggcuagugagcaggagugug

SEQ ID NO: 881618 - RNA, 18 nt, Human
ggguugagguggggagcu

SEQ ID NO: 881619 - RNA, 22 nt, Human
ggguuuuaccauguuggccagg

SEQ ID NO: 881620 - RNA, 21 nt, Human
gguacaaggcauaagaagaga

SEQ ID NO: 881621 - RNA, 21 nt, Human
gguggggggaggagugcagag

SEQ ID NO: 881622 - RNA, 20 nt, Human
guacaagugauucuccugcc

SEQ ID NO: 881623 - RNA, 21 nt, Human
gucaguagggacagguuucau

SEQ ID NO: 881624 - RNA, 19 nt, Human
guccuuagcacaugucugg

SEQ ID NO: 881625 - RNA, 24 nt, Human
gucuugcuguggugcccaggcugg

SEQ ID NO: 881626 - RNA, 24 nt, Human
gugaagcagacaccaccgggcccu

SEQ ID NO: 881627 - RNA, 22 nt, Human
gugagggaggcuggccagggag

SEQ ID NO: 881628 - RNA, 22 nt, Human
gugauucuccugccucagccuc

SEQ ID NO: 881629 - RNA, 24 nt, Human
gugcccaggcuggagugcaguggc

SEQ ID NO: 881630 - RNA, 21 nt, Human
guucuugucuuuggacauaaa

SEQ ID NO: 881631 - RNA, 22 nt, Human
uaagugccaaggggcucaggga

SEQ ID NO: 881632 - RNA, 19 nt, Human
uaauccaagacggagacag

SEQ ID NO: 881633 - RNA, 23 nt, Human
uaaugaaggaggugagaguccug

SEQ ID NO: 881634 - RNA, 24 nt, Human
uaauguuuguguuuuuaguagaga

SEQ ID NO: 881635 - RNA, 18 nt, Human
uaauucugggucuugugc

SEQ ID NO: 881636 - RNA, 24 nt, Human
uacaagugauucuccugccucagc

SEQ ID NO: 881637 - RNA, 18 nt, Human
uacaggacuuacgcgucu

SEQ ID NO: 881638 - RNA, 23 nt, Human
uacaggcaugugccaccauaccc

SEQ ID NO: 881639 - RNA, 23 nt, Human
uacaggugugagccaugacgccu

SEQ ID NO: 881640 - RNA, 20 nt, Human
uaccagcccugugcccaccu

SEQ ID NO: 881641 - RNA, 21 nt, Human
uaccauguuggccaggcuggu

SEQ ID NO: 881642 - RNA, 24 nt, Human
uaccauguuggccaggcuggucuc

SEQ ID NO: 881643 - RNA, 26 nt, Human
uacccaccuaacaaagcugcugugau

SEQ ID NO: 881644 - RNA, 18 nt, Human
uagaaacaagaugucccc

SEQ ID NO: 881645 - RNA, 22 nt, Human
uagagacaggguuuuaccaugu

SEQ ID NO: 881646 - RNA, 20 nt, Human
uagggccccuccucucuuuu

SEQ ID NO: 881647 - RNA, 19 nt, Human
uagguggggaggugggggg

SEQ ID NO: 881648 - RNA, 24 nt, Human
uaguagagacaggguuuuaccaug

SEQ ID NO: 881649 - RNA, 22 nt, Human
uagugagcaggagugugagggu

SEQ ID NO: 881650 - RNA, 19 nt, Human
uauccugaugcugugccuu

SEQ ID NO: 881651 - RNA, 18 nt, Human
uaucuggacagaucaggg

SEQ ID NO: 881652 - RNA, 18 nt, Human
ucacugcaaccuccuccc

SEQ ID NO: 881653 - RNA, 18 nt, Human
ucacugcaaccuccuccu

SEQ ID NO: 881654 - RNA, 24 nt, Human
ucacugcaaccuccuccucccagg

SEQ ID NO: 881655 - RNA, 18 nt, Human
ucagaguacuaacguaca

SEQ ID NO: 881656 - RNA, 23 nt, Human
ucagccucuugaguagcugggac

SEQ ID NO: 881657 - RNA, 25 nt, Human
ucagcucacugcaaccuccuccucc

SEQ ID NO: 881658 - RNA, 24 nt, Human
uccaacacccaaacagaagugaau

SEQ ID NO: 881659 - RNA, 20 nt, Human
uccaacccacgccaucccuu

SEQ ID NO: 881660 - RNA, 18 nt, Human
uccagaggcaaacagguc

SEQ ID NO: 881661 - RNA, 22 nt, Human
uccaugugccagucucuagugc

SEQ ID NO: 881662 - RNA, 21 nt, Human
ucccaaaaggucugccgggcc

SEQ ID NO: 881663 - RNA, 23 nt, Human
ucccaaagugcugggauuacagg

SEQ ID NO: 881664 - RNA, 18 nt, Human
ucccagcgccuucccacg

SEQ ID NO: 881665 - RNA, 20 nt, Human
ucccaggauucucucagcuc

SEQ ID NO: 881666 - RNA, 21 nt, Human
ucccagguacaagugauucuc

SEQ ID NO: 881667 - RNA, 24 nt, Human
ucccagguacaagugauucuccug

SEQ ID NO: 881668 - RNA, 23 nt, Human
uccccagcagccccaaaggaagc

SEQ ID NO: 881669 - RNA, 23 nt, Human
uccccccaccgcacacacacagc

SEQ ID NO: 881670 - RNA, 23 nt, Human
ucccuuacucuucucagccucag

SEQ ID NO: 881671 - RNA, 25 nt, Human
uccgcagacccugcagggccaggcu

SEQ ID NO: 881672 - RNA, 25 nt, Human
uccugaccucaagugaucugccugc

SEQ ID NO: 881673 - RNA, 18 nt, Human
uccuugcuaagcugcugc

SEQ ID NO: 881674 - RNA, 23 nt, Human
ucucccccuacccaccuaacaaa

SEQ ID NO: 881675 - RNA, 24 nt, Human
ucuccugccucagccucuugagua

SEQ ID NO: 881676 - RNA, 23 nt, Human
ucucuaaugaaggaggugagagu

SEQ ID NO: 881677 - RNA, 26 nt, Human
ucucucagcucuuugcauuuuuuagu

SEQ ID NO: 881678 - RNA, 19 nt, Human
ucugguguauaacgauggc

SEQ ID NO: 881679 - RNA, 24 nt, Human
ucuugaguagcugggacuacaggc

SEQ ID NO: 881680 - RNA, 23 nt, Human
ucuugcuguggugcccaggcugg

SEQ ID NO: 881681 - RNA, 24 nt, Human
ucuugcuguggugcccaggcugga

SEQ ID NO: 881682 - RNA, 19 nt, Human
ucuuucuuucuuucuuuuu

SEQ ID NO: 881683 - RNA, 21 nt, Human
ucuuucuuucuuucuuuuucu

SEQ ID NO: 881684 - RNA, 21 nt, Human
ucuuucuuucuuuuucuuuuu

SEQ ID NO: 881685 - RNA, 25 nt, Human
ucuuucuuuuucuuuuuuuuuuuuu

SEQ ID NO: 881686 - RNA, 19 nt, Human
ucuuuuucuuucuuucuuu

SEQ ID NO: 881687 - RNA, 19 nt, Human
ugaaacaucaccguagccc

SEQ ID NO: 881688 - RNA, 21 nt, Human
ugaaacaucaccguagcccuu

SEQ ID NO: 881689 - RNA, 24 nt, Human
ugaaagggacagacacaaggacca

SEQ ID NO: 881690 - RNA, 19 nt, Human
ugaacucccccugaggcug

SEQ ID NO: 881691 - RNA, 21 nt, Human
ugaagaaucagcaaaaaacaa

SEQ ID NO: 881692 - RNA, 24 nt, Human
ugaagagggagagggagguggcug

SEQ ID NO: 881693 - RNA, 22 nt, Human
ugaagcagacaccaccgggccc

SEQ ID NO: 881694 - RNA, 20 nt, Human
ugaaggaggugagaguccug

SEQ ID NO: 881695 - RNA, 20 nt, Human
ugaaguagguggggaggugg

SEQ ID NO: 881696 - RNA, 19 nt, Human
ugacacaggggcccugucu

SEQ ID NO: 881697 - RNA, 19 nt, Human
ugacacaggggcccugucu

SEQ ID NO: 881698 - RNA, 18 nt, Human
ugacccaaaaggaggcag

SEQ ID NO: 881699 - RNA, 18 nt, Human
ugaccucaagugaucugc

SEQ ID NO: 881700 - RNA, 24 nt, Human
ugaccucaagugaucugccugccu

SEQ ID NO: 881701 - RNA, 18 nt, Human
ugaccuugaacucccccu

SEQ ID NO: 881702 - RNA, 19 nt, Human
ugacucaccccaucagcgg

SEQ ID NO: 881703 - RNA, 21 nt, Human
ugagaagggggaguugggcau

SEQ ID NO: 881704 - RNA, 18 nt, Human
ugagagauauuuaggcuc

SEQ ID NO: 881705 - RNA, 22 nt, Human
ugagcaaccgucgccugagagc

SEQ ID NO: 881706 - RNA, 20 nt, Human
ugaggaacugaaagaaguga

SEQ ID NO: 881707 - RNA, 22 nt, Human
ugaggagugacuugauccaugg

SEQ ID NO: 881708 - RNA, 19 nt, Human
ugagugagcagggaaugga

SEQ ID NO: 881709 - RNA, 23 nt, Human
ugaugcugugccuugguacgggg

SEQ ID NO: 881710 - RNA, 20 nt, Human
ugauucuccugccucagccu

SEQ ID NO: 881711 - RNA, 21 nt, Human
ugcaagaacccaggaaaacac

SEQ ID NO: 881712 - RNA, 22 nt, Human
ugcaagaacccaggaaaacacc

SEQ ID NO: 881713 - RNA, 24 nt, Human
ugcaauuuuugguucuuccacauc

SEQ ID NO: 881714 - RNA, 18 nt, Human
ugcccaggcuggagugca

SEQ ID NO: 881715 - RNA, 21 nt, Human
ugcccaggcuggagugcagug

SEQ ID NO: 881716 - RNA, 22 nt, Human
ugcccaggcuggagugcagugg

SEQ ID NO: 881717 - RNA, 24 nt, Human
ugcccaggcuggagugcaguggca

SEQ ID NO: 881718 - RNA, 26 nt, Human
ugccccaaaagccagggauucccaaa

SEQ ID NO: 881719 - RNA, 24 nt, Human
ugccucagccucuugaguagcugg

SEQ ID NO: 881720 - RNA, 18 nt, Human
ugccugccuuggccuccc

SEQ ID NO: 881721 - RNA, 19 nt, Human
ugcucugugcccuuggaca

SEQ ID NO: 881722 - RNA, 19 nt, Human
ugcugcaguggagagggag

SEQ ID NO: 881723 - RNA, 24 nt, Human
ugcugggauuacaggugugagcca

SEQ ID NO: 881724 - RNA, 24 nt, Human
ugcuguggugcccaggcuggagug

SEQ ID NO: 881725 - RNA, 24 nt, Human
uggacaagucccuuacucuucuca

SEQ ID NO: 881726 - RNA, 21 nt, Human
uggagagggaggugaagcaga

SEQ ID NO: 881727 - RNA, 19 nt, Human
uggaggagcccccuaggca

SEQ ID NO: 881728 - RNA, 23 nt, Human
uggagugcaguggcacgaucuca

SEQ ID NO: 881729 - RNA, 24 nt, Human
uggagugcaguggcacgaucucag

SEQ ID NO: 881730 - RNA, 21 nt, Human
uggcaagaggagggccugggg

SEQ ID NO: 881731 - RNA, 23 nt, Human
uggcaagaggagggccugggggc

SEQ ID NO: 881732 - RNA, 24 nt, Human
uggcaagaggagggccugggggcc

SEQ ID NO: 881733 - RNA, 24 nt, Human
uggcacgaucucagcucacugcaa

SEQ ID NO: 881734 - RNA, 21 nt, Human
uggcaggcagagcggagggug

SEQ ID NO: 881735 - RNA, 24 nt, Human
uggccaggcuggucucaaaguccu

SEQ ID NO: 881736 - RNA, 22 nt, Human
uggcccagcuggcuuccagaug

SEQ ID NO: 881737 - RNA, 22 nt, Human
uggcucaccucccagcuucagc

SEQ ID NO: 881738 - RNA, 23 nt, Human
ugggaaaugugcacuuucccagg

SEQ ID NO: 881739 - RNA, 22 nt, Human
ugggacccggcacagggcuggg

SEQ ID NO: 881740 - RNA, 21 nt, Human
ugggacuacaggcaugugcca

SEQ ID NO: 881741 - RNA, 22 nt, Human
ugggacuacaggcaugugccac

SEQ ID NO: 881742 - RNA, 24 nt, Human
ugggacuacaggcaugugccacca

SEQ ID NO: 881743 - RNA, 27 nt, Human
ugggagcugguuggagagaaugaguac

SEQ ID NO: 881744 - RNA, 18 nt, Human
ugggauuacaggugugag

SEQ ID NO: 881745 - RNA, 19 nt, Human
ugggauuacaggugugagc

SEQ ID NO: 881746 - RNA, 21 nt, Human
ugggauuacaggugugagcca

SEQ ID NO: 881747 - RNA, 21 nt, Human
ugggauuacaggugugagcca

SEQ ID NO: 881748 - RNA, 21 nt, Human
ugggauuacaggugugagcca

SEQ ID NO: 881749 - RNA, 22 nt, Human
ugggauuacaggugugagccau

SEQ ID NO: 881750 - RNA, 23 nt, Human
ugggauuacaggugugagccaug

SEQ ID NO: 881751 - RNA, 27 nt, Human
ugggauuacaggugugagccaugacgc

SEQ ID NO: 881752 - RNA, 24 nt, Human
uggggagguggggggaggagugca

SEQ ID NO: 881753 - RNA, 20 nt, Human
uggggccagcuggcagggug

SEQ ID NO: 881754 - RNA, 22 nt, Human
ugggucuugugcugucaguagg

SEQ ID NO: 881755 - RNA, 25 nt, Human
ugggucuugugcugucaguagggac

SEQ ID NO: 881756 - RNA, 22 nt, Human
uggucccagcgccuucccacgg

SEQ ID NO: 881757 - RNA, 20 nt, Human
ugguggaggggaggaaaggg

SEQ ID NO: 881758 - RNA, 23 nt, Human
ugucacuccccccaccgcacaca

SEQ ID NO: 881759 - RNA, 22 nt, Human
ugucauugggcaguccugggaa

SEQ ID NO: 881760 - RNA, 18 nt, Human
ugugaggguugagguggg

SEQ ID NO: 881761 - RNA, 24 nt, Human
uguggugcccaggcuggagugcag

SEQ ID NO: 881762 - RNA, 20 nt, Human
uuaaagcaggagggugacuu

SEQ ID NO: 881763 - RNA, 24 nt, Human
uuaguagagacaggguuuuaccau

SEQ ID NO: 881764 - RNA, 24 nt, Human
uucuuucuuucuuucuuuuucuuu

SEQ ID NO: 881765 - RNA, 22 nt, Human
uugaagaaucagcaaaaaacaa

SEQ ID NO: 881766 - RNA, 24 nt, Human
uugcuguggugcccaggcuggagu

SEQ ID NO: 881767 - RNA, 18 nt, Human
uugcuucugggaggcugc

SEQ ID NO: 881768 - RNA, 18 nt, Human
uuggccucccaaagugcu

SEQ ID NO: 881769 - RNA, 22 nt, Human
uuggcucugaugcaucugccuc

SEQ ID NO: 881770 - RNA, 22 nt, Human
uuggugaugauuaaacaauggg

SEQ ID NO: 881771 - RNA, 23 nt, Human
uuggugguccccaggauguugug

SEQ ID NO: 881772 - RNA, 24 nt, Human
uuucuauccucuggguaccaggga

SEQ ID NO: 881773 - RNA, 24 nt, Human
uuugagacugagcccugauaacuc

SEQ ID NO: 881774 - RNA, 25 nt, Human
uuuggauuuuaugcuagaccucugg

SEQ ID NO: 881775 - RNA, 18 nt, Human
uuuguguuuuuaguagag

SEQ ID NO: 881776 - RNA, 23 nt, Human
uuuguuccuuuauccccagcacu

SEQ ID NO: 881777 - RNA, 18 nt, Human
uuuuaguuuacccggcca

SEQ ID NO: 881778 - RNA, 24 nt, Human
uuuuuaguagagacaggguuuuac

SEQ ID NO: 881779 - RNA, 25 nt, Human
uuuuucuuuuuuuuuuuuagacgga

SEQ ID NO: 881780 - RNA, 23 nt, Human
uuuuuuuuuuuuagacggagucu

SEQ ID NO: 881781 - RNA, 24 nt, Human
acaaaaauagauuuggccuagagc

SEQ ID NO: 881782 - RNA, 19 nt, Human
acagcgaaggcggcagcga

SEQ ID NO: 881783 - RNA, 19 nt, Human
agcaaagggcuggggagcc

SEQ ID NO: 881784 - RNA, 23 nt, Human
agcgacucuaucggaagagauuc

SEQ ID NO: 881785 - RNA, 22 nt, Human
aggcggcagcgaggcggggcgu

SEQ ID NO: 881786 - RNA, 25 nt, Human
augcuuccucccgucccuuucgcug

SEQ ID NO: 881787 - RNA, 23 nt, Human
caaacagaagugguaggugcggg

SEQ ID NO: 881788 - RNA, 19 nt, Human
cacauccuccggccggggc

SEQ ID NO: 881789 - RNA, 24 nt, Human
ccaaaguagaaaacacugguuuau

SEQ ID NO: 881790 - RNA, 19 nt, Human
ccccuuagauagcucaguu

SEQ ID NO: 881791 - RNA, 23 nt, Human
ccgccgccgaucggcgccacuca

SEQ ID NO: 881792 - RNA, 18 nt, Human
ccgccgccucccgccgcc

SEQ ID NO: 881793 - RNA, 22 nt, Human
ccgccgccucccgccgcccgcc

SEQ ID NO: 881794 - RNA, 23 nt, Human
ccgucccgcggcgccggucuccg

SEQ ID NO: 881795 - RNA, 19 nt, Human
ccucccgucccuuucgcug

SEQ ID NO: 881796 - RNA, 21 nt, Human
ccucccgucccuuucgcuggg

SEQ ID NO: 881797 - RNA, 21 nt, Human
ccucugguuccuuucuuuccu

SEQ ID NO: 881798 - RNA, 22 nt, Human
ccuggcucgcccaggccaucug

SEQ ID NO: 881799 - RNA, 20 nt, Human
ccuuucgcuggguauccucg

SEQ ID NO: 881800 - RNA, 21 nt, Human
ccuuucuucuuucuguucucc

SEQ ID NO: 881801 - RNA, 24 nt, Human
ccuuucuuuccuuucuucuuucug

SEQ ID NO: 881802 - RNA, 20 nt, Human
cgaggagggaggccggcggc

SEQ ID NO: 881803 - RNA, 19 nt, Human
cgccguggagcgcggggcg

SEQ ID NO: 881804 - RNA, 20 nt, Human
cgccguggagcgcggggcgu

SEQ ID NO: 881805 - RNA, 19 nt, Human
cgcugccgcucacggugcg

SEQ ID NO: 881806 - RNA, 21 nt, Human
cgggcacgagaggcgcgcggg

SEQ ID NO: 881807 - RNA, 20 nt, Human
cgggucggggggcucugccg

SEQ ID NO: 881808 - RNA, 21 nt, Human
cuccagccggagcuccgcgcc

SEQ ID NO: 881809 - RNA, 19 nt, Human
cucugcggccgagccuuuc

SEQ ID NO: 881810 - RNA, 22 nt, Human
cuuuccuuucuucuuucuguuu

SEQ ID NO: 881811 - RNA, 21 nt, Human
gagccgcggcuucgccuccgg

SEQ ID NO: 881812 - RNA, 18 nt, Human
gaggccggcggcgcugcc

SEQ ID NO: 881813 - RNA, 24 nt, Human
gcccgggggcuccgucugagcgcu

SEQ ID NO: 881814 - RNA, 18 nt, Human
gcgagucagagcgcggcc

SEQ ID NO: 881815 - RNA, 24 nt, Human
gcgcggggcgagggcgccguggag

SEQ ID NO: 881816 - RNA, 18 nt, Human
gcggcagcgaggcggggc

SEQ ID NO: 881817 - RNA, 20 nt, Human
gcggcgaggagggaggccgg

SEQ ID NO: 881818 - RNA, 22 nt, Human
ggaauccgugaaacagacacac

SEQ ID NO: 881819 - RNA, 19 nt, Human
ggaggccggcggcgcugcc

SEQ ID NO: 881820 - RNA, 22 nt, Human
ggcggcagcgaggcggggcgug

SEQ ID NO: 881821 - RNA, 20 nt, Human
gggagcggggccucagaccu

SEQ ID NO: 881822 - RNA, 20 nt, Human
gggcgcauggcucaggcugg

SEQ ID NO: 881823 - RNA, 21 nt, Human
gggcuggggagccgcggcuuc

SEQ ID NO: 881824 - RNA, 18 nt, Human
ggggcuccgucugagcgc

SEQ ID NO: 881825 - RNA, 22 nt, Human
gguuuugucuuuuuuguuuuga

SEQ ID NO: 881826 - RNA, 20 nt, Human
guauuuauauauuuauauau

SEQ ID NO: 881827 - RNA, 24 nt, Human
gugaaacagacacacggcgucugc

SEQ ID NO: 881828 - RNA, 27 nt, Human
gugaaacagacacacggcgucugcccu

SEQ ID NO: 881829 - RNA, 18 nt, Human
guguguguguguguuugu

SEQ ID NO: 881830 - RNA, 21 nt, Human
uaaauaaaucagauuuuguaa

SEQ ID NO: 881831 - RNA, 26 nt, Human
uaggugcggggacccucccccuuaau

SEQ ID NO: 881832 - RNA, 19 nt, Human
ucccgcggcgccggucucc

SEQ ID NO: 881833 - RNA, 21 nt, Human
ucccggcgcgcggcucuugcc

SEQ ID NO: 881834 - RNA, 18 nt, Human
uccggccggggcgcgggg

SEQ ID NO: 881835 - RNA, 18 nt, Human
uccuagguuucggaugcu

SEQ ID NO: 881836 - RNA, 22 nt, Human
ucgcugggccccggcucugcgg

SEQ ID NO: 881837 - RNA, 23 nt, Human
ucgcugggccccggcucugcggc

SEQ ID NO: 881838 - RNA, 18 nt, Human
ucucucugccucugguuc

SEQ ID NO: 881839 - RNA, 24 nt, Human
ucugccucugguuccuuucuuucc

SEQ ID NO: 881840 - RNA, 23 nt, Human
ucugguuccuuucuuuccuuucu

SEQ ID NO: 881841 - RNA, 18 nt, Human
ucuuuccuuucuucuuuc

SEQ ID NO: 881842 - RNA, 28 nt, Human
ugaaacagacacacggcgucugcccccu

SEQ ID NO: 881843 - RNA, 22 nt, Human
ugcccccaggagguaaaaaaga

SEQ ID NO: 881844 - RNA, 23 nt, Human
ugguaggugcggggacccuccuc

SEQ ID NO: 881845 - RNA, 20 nt, Human
uuccucccgucccuuucgcu

SEQ ID NO: 881846 - RNA, 20 nt, Human
uucuccaaagaaaacucugg

SEQ ID NO: 881847 - RNA, 25 nt, Human
uuuauauauguauauuaaccagaaa

SEQ ID NO: 881848 - RNA, 22 nt, Human
uuucccaccggcaaacagaagu

SEQ ID NO: 881849 - RNA, 18 nt, Human
uuuuguuuguuuuguuuu

SEQ ID NO: 881850 - RNA, 19 nt, Human
uuuuguuuguuuuguuuuu

SEQ ID NO: 881851 - RNA, 21 nt, Human
aaacucccucccccagccuuc

SEQ ID NO: 881852 - RNA, 23 nt, Human
aacucccucccccagccuuccug

SEQ ID NO: 881853 - RNA, 21 nt, Human
acucccucccccagccuuccu

SEQ ID NO: 881854 - RNA, 23 nt, Human
agcaggggaggggguggaauggc

SEQ ID NO: 881855 - RNA, 19 nt, Human
aggcaguuaaggcuuggcu

SEQ ID NO: 881856 - RNA, 25 nt, Human
auagaacaagauuuuguuuucagag

SEQ ID NO: 881857 - RNA, 23 nt, Human
auucuccccagcaggggaggggg

SEQ ID NO: 881858 - RNA, 22 nt, Human
cagccuuccugucccuuggagg

SEQ ID NO: 881859 - RNA, 19 nt, Human
cccagccuuccugucccuu

SEQ ID NO: 881860 - RNA, 21 nt, Human
cgagaaggcugggugcugugu

SEQ ID NO: 881861 - RNA, 21 nt, Human
cugguucagggucaggcaggc

SEQ ID NO: 881862 - RNA, 21 nt, Human
cuugaugugucauucucccca

SEQ ID NO: 881863 - RNA, 27 nt, Human
ggcaguucagcuggguucugguucagg

SEQ ID NO: 881864 - RNA, 20 nt, Human
ggggaggggguggaauggcu

SEQ ID NO: 881865 - RNA, 24 nt, Human
ggguuguaaacucccucccccagc

SEQ ID NO: 881866 - RNA, 23 nt, Human
gguuguaaacucccucccccagc

SEQ ID NO: 881867 - RNA, 20 nt, Human
ucccuuggaggggcaguuca

SEQ ID NO: 881868 - RNA, 21 nt, Human
ucuuccuuccccuucccccaa

SEQ ID NO: 881869 - RNA, 18 nt, Human
ugaugugucauucucccc

SEQ ID NO: 881870 - RNA, 22 nt, Human
uggcuggugcgagaaggcuggg

SEQ ID NO: 881871 - RNA, 18 nt, Human
uggcuuggguuguaaacu

SEQ ID NO: 881872 - RNA, 18 nt, Human
uggugcgagaaggcuggg

SEQ ID NO: 881873 - RNA, 23 nt, Human
uggugcgagaaggcugggugcug

SEQ ID NO: 881874 - RNA, 21 nt, Human
ugugucauucuccccagcagg

SEQ ID NO: 881875 - RNA, 21 nt, Human
uucagggucaggcaggcaguu

SEQ ID NO: 881876 - RNA, 19 nt, Human
uuuuuuuuuuuuuuuuugc

SEQ ID NO: 881877 - RNA, 24 nt, Human
uuuuuuuuuuuuuuuuuugcauag

SEQ ID NO: 881878 - RNA, 20 nt, Human
uuuuuuuuuuuuuuuuuugg

SEQ ID NO: 881879 - RNA, 22 nt, Human
caucccgcugcuuccuccgguc

SEQ ID NO: 881880 - RNA, 20 nt, Human
cccguucguagcugcagccg

SEQ ID NO: 881881 - RNA, 19 nt, Human
cccuguccaucagcccuuc

SEQ ID NO: 881882 - RNA, 20 nt, Human
ccgccgccauuuuccccucg

SEQ ID NO: 881883 - RNA, 18 nt, Human
ccgccgccgccgccgccg

SEQ ID NO: 881884 - RNA, 23 nt, Human
ccuuugggauaguugccugaccc

SEQ ID NO: 881885 - RNA, 18 nt, Human
cuacugcugcauccaccu

SEQ ID NO: 881886 - RNA, 24 nt, Human
cuacugcugcauccaccuccaucc

SEQ ID NO: 881887 - RNA, 20 nt, Human
cuccaucccgcugcuuccuu

SEQ ID NO: 881888 - RNA, 23 nt, Human
cugcuuccuccggucccguucgu

SEQ ID NO: 881889 - RNA, 21 nt, Human
cuggggacuacugcugcaucc

SEQ ID NO: 881890 - RNA, 27 nt, Human
cuuuuauuaaugacagcgguuucucuc

SEQ ID NO: 881891 - RNA, 22 nt, Human
gcagccgccgccgccgccgccg

SEQ ID NO: 881892 - RNA, 22 nt, Human
gcugcagccgccgccgccgccg

SEQ ID NO: 881893 - RNA, 21 nt, Human
gugcucaggggcugcuccccu

SEQ ID NO: 881894 - RNA, 24 nt, Human
ucguagcugcagccgccgccgccg

SEQ ID NO: 881895 - RNA, 22 nt, Human
ucucaaggaaguguagugcccu

SEQ ID NO: 881896 - RNA, 20 nt, Human
ugaccccuguccaucagccc

SEQ ID NO: 881897 - RNA, 26 nt, Human
uuuuuuuuuuuuuuuggugcucaggg

SEQ ID NO: 881898 - RNA, 18 nt, Human
uuuuuuuuuuuuuuuuug

SEQ ID NO: 881899 - RNA, 20 nt, Human
uuuuuuuuuuuuuuuuuggu

SEQ ID NO: 881900 - RNA, 18 nt, Human
aaaaauaucaaaaugcca

SEQ ID NO: 881901 - RNA, 24 nt, Human
aaaacaaaaacaaaauuguugaga

SEQ ID NO: 881902 - RNA, 22 nt, Human
aaacaaaaaaacuuacuuuagc

SEQ ID NO: 881903 - RNA, 18 nt, Human
aaacgagccugccaguac

SEQ ID NO: 881904 - RNA, 24 nt, Human
aaauaucaaaaugccaguuaagcu

SEQ ID NO: 881905 - RNA, 19 nt, Human
aagggcuuuggcgacacuc

SEQ ID NO: 881906 - RNA, 21 nt, Human
aguugcccuuuauuuuuagau

SEQ ID NO: 881907 - RNA, 21 nt, Human
caacagcccagacuugauacu

SEQ ID NO: 881908 - RNA, 21 nt, Human
caaugaaccucuuccugguca

SEQ ID NO: 881909 - RNA, 24 nt, Human
cagcccaaagcugguagacugaug

SEQ ID NO: 881910 - RNA, 21 nt, Human
cagcccagacuugauacuaaa

SEQ ID NO: 881911 - RNA, 21 nt, Human
caguacaaccuccaccaacag

SEQ ID NO: 881912 - RNA, 21 nt, Human
caucuucaaauccuuucucaa

SEQ ID NO: 881913 - RNA, 22 nt, Human
caugauuauuucaaugaaccuc

SEQ ID NO: 881914 - RNA, 22 nt, Human
ccugccaguacaaagugaaaau

SEQ ID NO: 881915 - RNA, 19 nt, Human
cuauuauaaaacaaaaaca

SEQ ID NO: 881916 - RNA, 19 nt, Human
cuccaccaacagcccagac

SEQ ID NO: 881917 - RNA, 22 nt, Human
gcgcuucaugcaugauuauuuc

SEQ ID NO: 881918 - RNA, 18 nt, Human
guacaaccuccaccaaca

SEQ ID NO: 881919 - RNA, 21 nt, Human
gucuauuauaaaacaaaaaca

SEQ ID NO: 881920 - RNA, 20 nt, Human
gugcagucgagcgccacggc

SEQ ID NO: 881921 - RNA, 20 nt, Human
uaagcuaguaacaagacaaa

SEQ ID NO: 881922 - RNA, 18 nt, Human
uacaaagugaaaauucua

SEQ ID NO: 881923 - RNA, 23 nt, Human
uaccacagaugauuguuuauaac

SEQ ID NO: 881924 - RNA, 23 nt, Human
uaccacaguacaaccuccaccaa

SEQ ID NO: 881925 - RNA, 21 nt, Human
uacuuuagcccuguuuuguuc

SEQ ID NO: 881926 - RNA, 22 nt, Human
uauuucaaugaaccucuuccug

SEQ ID NO: 881927 - RNA, 18 nt, Human
uccaccaacagcccagac

SEQ ID NO: 881928 - RNA, 26 nt, Human
ugaaguaaagccucaauucgaucauc

SEQ ID NO: 881929 - RNA, 21 nt, Human
ugaguuuuugacucgccaguc

SEQ ID NO: 881930 - RNA, 19 nt, Human
ugcagucgagcgccacggc

SEQ ID NO: 881931 - RNA, 19 nt, Human
uugauacuaaaauccuagu

SEQ ID NO: 881932 - RNA, 20 nt, Human
uuuaaaguaaucuauuucac

SEQ ID NO: 881933 - RNA, 23 nt, Human
aagaguuuccacugugggauuuu

SEQ ID NO: 881934 - RNA, 18 nt, Human
acagcccgagagagaagc

SEQ ID NO: 881935 - RNA, 27 nt, Human
acagccugugguuguagcuuucuuucu

SEQ ID NO: 881936 - RNA, 26 nt, Human
agagaagcugguguugauagagagag

SEQ ID NO: 881937 - RNA, 20 nt, Human
aggcagagggccagcacgug

SEQ ID NO: 881938 - RNA, 19 nt, Human
agucccagcagccgcccuc

SEQ ID NO: 881939 - RNA, 24 nt, Human
caaacagcccgagagagaagcugg

SEQ ID NO: 881940 - RNA, 23 nt, Human
caaauguaaaagcauauucacau

SEQ ID NO: 881941 - RNA, 23 nt, Human
caacagcacuuuagagaaggcag

SEQ ID NO: 881942 - RNA, 22 nt, Human
cacagcagccccaugagguaga

SEQ ID NO: 881943 - RNA, 20 nt, Human
cacuuuagagaaggcagagg

SEQ ID NO: 881944 - RNA, 19 nt, Human
cagaauugacaggucggaa

SEQ ID NO: 881945 - RNA, 20 nt, Human
cagagggccagcacguggcu

SEQ ID NO: 881946 - RNA, 19 nt, Human
cagcccgagagagaagcug

SEQ ID NO: 881947 - RNA, 21 nt, Human
caggacacagcagacacagcg

SEQ ID NO: 881948 - RNA, 19 nt, Human
cccaaacccacacagcagc

SEQ ID NO: 881949 - RNA, 22 nt, Human
cccaaacccacacagcagcccc

SEQ ID NO: 881950 - RNA, 23 nt, Human
cccacacagcagccccaugaggu

SEQ ID NO: 881951 - RNA, 20 nt, Human
ccccaggacacagcagacac

SEQ ID NO: 881952 - RNA, 19 nt, Human
cccugagcaaacagcccga

SEQ ID NO: 881953 - RNA, 22 nt, Human
ccucccaaacccacacagcagc

SEQ ID NO: 881954 - RNA, 18 nt, Human
ccuggcuauuucugacuu

SEQ ID NO: 881955 - RNA, 21 nt, Human
cgcugcgcugcugcgagccug

SEQ ID NO: 881956 - RNA, 21 nt, Human
cucccaaacccacacagcagc

SEQ ID NO: 881957 - RNA, 20 nt, Human
gagagaagcugguguugaua

SEQ ID NO: 881958 - RNA, 22 nt, Human
gcgagccuggcuauuucugacu

SEQ ID NO: 881959 - RNA, 19 nt, Human
gcuccauccccugucccca

SEQ ID NO: 881960 - RNA, 20 nt, Human
guccauccccaucuccucca

SEQ ID NO: 881961 - RNA, 20 nt, Human
gugaagcuuucaaacagccu

SEQ ID NO: 881962 - RNA, 18 nt, Human
uaagaguuuccacugugg

SEQ ID NO: 881963 - RNA, 20 nt, Human
uagagaaggcagagggccag

SEQ ID NO: 881964 - RNA, 21 nt, Human
uagauguggcaccuaugggau

SEQ ID NO: 881965 - RNA, 21 nt, Human
uaguuaggggcuccuucccag

SEQ ID NO: 881966 - RNA, 19 nt, Human
ucaguccauccccaucucc

SEQ ID NO: 881967 - RNA, 26 nt, Human
uccacuaucuagucccagcagccgcc

SEQ ID NO: 881968 - RNA, 22 nt, Human
ucccaaacccacacagcagccc

SEQ ID NO: 881969 - RNA, 25 nt, Human
uccccaugugaagaggcugccccac

SEQ ID NO: 881970 - RNA, 18 nt, Human
ucccugagcaaacagccc

SEQ ID NO: 881971 - RNA, 20 nt, Human
ucccuugaagaugcuugacc

SEQ ID NO: 881972 - RNA, 22 nt, Human
ucuacgcauuuucuaaauuucc

SEQ ID NO: 881973 - RNA, 21 nt, Human
ugacuugcccuaguuaggggc

SEQ ID NO: 881974 - RNA, 24 nt, Human
ugacuugcccuaguuaggggcucc

SEQ ID NO: 881975 - RNA, 19 nt, Human
ugcuccauccccugucccc

SEQ ID NO: 881976 - RNA, 18 nt, Human
ugggaacuggaggaaugu

SEQ ID NO: 881977 - RNA, 24 nt, Human
ugugggaacuggaggaaugugggg

SEQ ID NO: 881978 - RNA, 20 nt, Human
uuacauugguaauaaagaaa

SEQ ID NO: 881979 - RNA, 28 nt, Human
uucauccacuaucuagucccagcagccg

SEQ ID NO: 881980 - RNA, 22 nt, Human
uuucuugccuucccugagcaaa

SEQ ID NO: 881981 - RNA, 19 nt, Human
uuuuucugcuuugcagaaa

SEQ ID NO: 881982 - RNA, 19 nt, Human
uuuuuuuuuuuuuuuuugu

SEQ ID NO: 881983 - RNA, 20 nt, Human
uuuuuuuuuuuuuuuuuugg

SEQ ID NO: 881984 - RNA, 22 nt, Human
aaccgcgcggcaaagaugcgcc

SEQ ID NO: 881985 - RNA, 22 nt, Human
agccagagccaauggcagcgcg

SEQ ID NO: 881986 - RNA, 22 nt, Human
caacuuggauuucagagccgaa

SEQ ID NO: 881987 - RNA, 23 nt, Human
caacuuggauuucagagccgaaa

SEQ ID NO: 881988 - RNA, 24 nt, Human
cagcgaccuucgccacgccccuga

SEQ ID NO: 881989 - RNA, 24 nt, Human
ccaauggcagcgcgagcgcuuucu

SEQ ID NO: 881990 - RNA, 22 nt, Human
ccgcccggaaaccgcgcggcaa

SEQ ID NO: 881991 - RNA, 19 nt, Human
ccgcggcgcacagguuccg

SEQ ID NO: 881992 - RNA, 23 nt, Human
cguuuuguauuuuucaggggccc

SEQ ID NO: 881993 - RNA, 23 nt, Human
gaauuuuauuauaaaacagaaca

SEQ ID NO: 881994 - RNA, 21 nt, Human
gcgagcgcuuucgcaggaggg

SEQ ID NO: 881995 - RNA, 19 nt, Human
gucagcccaaacgccuuuc

SEQ ID NO: 881996 - RNA, 25 nt, Human
uaaaacagaacaaugacacaauaua

SEQ ID NO: 881997 - RNA, 18 nt, Human
ugggaaacaaaaaucucc

SEQ ID NO: 881998 - RNA, 23 nt, Human
uucaacucucuccaaacuucguu

SEQ ID NO: 881999 - RNA, 22 nt, Human
aggggcuccuggccccgggggu

SEQ ID NO: 882000 - RNA, 21 nt, Human
cacaggugcaacagcagcgcu

SEQ ID NO: 882001 - RNA, 21 nt, Human
cgggcaggcugggugcagagc

SEQ ID NO: 882002 - RNA, 18 nt, Human
gcagagcucugcucaagg

SEQ ID NO: 882003 - RNA, 18 nt, Human
gcugggugcagagcucug

SEQ ID NO: 882004 - RNA, 20 nt, Human
ggcaggcugggugcagagcu

SEQ ID NO: 882005 - RNA, 21 nt, Human
ggugugggcgggcaggcuggg

SEQ ID NO: 882006 - RNA, 19 nt, Human
gugcagagcucugcucaag

SEQ ID NO: 882007 - RNA, 18 nt, Human
ugggaggaccagcaggau

SEQ ID NO: 882008 - RNA, 20 nt, Human
ugggaggaccagcaggaugg

SEQ ID NO: 882009 - RNA, 21 nt, Human
ugggaggaccagcaggauggu

SEQ ID NO: 882010 - RNA, 22 nt, Human
ugggaggaccagcaggauggug

SEQ ID NO: 882011 - RNA, 20 nt, Human
ugggcgggcaggcugggugc

SEQ ID NO: 882012 - RNA, 21 nt, Human
ugggcgggcaggcugggugca

SEQ ID NO: 882013 - RNA, 22 nt, Human
uggugugggcgggcaggcuggg

SEQ ID NO: 882014 - RNA, 23 nt, Human
uggugugggcgggcaggcugggu

SEQ ID NO: 882015 - RNA, 19 nt, Human
acuguacagaugcaaccuu

SEQ ID NO: 882016 - RNA, 22 nt, Human
augagaaaacagauuuguugua

SEQ ID NO: 882017 - RNA, 21 nt, Human
ccacuugauucuaacaugauc

SEQ ID NO: 882018 - RNA, 22 nt, Human
cuggggccaccaggcccuuccu

SEQ ID NO: 882019 - RNA, 19 nt, Human
gccaccaggcccuuccugg

SEQ ID NO: 882020 - RNA, 19 nt, Human
ggggccaccaggcccuucc

SEQ ID NO: 882021 - RNA, 24 nt, Human
uacauacuguacagaugcaaccuu

SEQ ID NO: 882022 - RNA, 24 nt, Human
uauacacauaaucccaagugugug

SEQ ID NO: 882023 - RNA, 18 nt, Human
uauagcaugagaacagua

SEQ ID NO: 882024 - RNA, 22 nt, Human
ucuaacaugaucucugcccaaa

SEQ ID NO: 882025 - RNA, 19 nt, Human
ugagaaaacagauuuguug

SEQ ID NO: 882026 - RNA, 24 nt, Human
ugagaaaacagauuuguuguagag

SEQ ID NO: 882027 - RNA, 21 nt, Human
ugauaaaaaugagaaaacaga

SEQ ID NO: 882028 - RNA, 21 nt, Human
ugauucuaacaugaucucugc

SEQ ID NO: 882029 - RNA, 18 nt, Human
ugcuggggccaccaggcc

SEQ ID NO: 882030 - RNA, 20 nt, Human
uuauguauacacauaauccc

SEQ ID NO: 882031 - RNA, 21 nt, Human
uuccugggggaacaaggacuc

SEQ ID NO: 882032 - RNA, 22 nt, Human
uuugcaguuacucauuucagug

SEQ ID NO: 882033 - RNA, 20 nt, Human
accaucuuuucaucaugcaa

SEQ ID NO: 882034 - RNA, 21 nt, Human
acccgcgccggguggcaccuc

SEQ ID NO: 882035 - RNA, 18 nt, Human
agacaauggguacauaug

SEQ ID NO: 882036 - RNA, 19 nt, Human
agauuaaaaggccaugucu

SEQ ID NO: 882037 - RNA, 25 nt, Human
agcccggguccccgcugagguuggc

SEQ ID NO: 882038 - RNA, 19 nt, Human
aggcaaaccauuucuaaau

SEQ ID NO: 882039 - RNA, 21 nt, Human
aggccaugucuacuggaaaua

SEQ ID NO: 882040 - RNA, 18 nt, Human
aucauagcaucuccaucc

SEQ ID NO: 882041 - RNA, 18 nt, Human
cacccgcgccggguggca

SEQ ID NO: 882042 - RNA, 18 nt, Human
cacugcagucgccgccgc

SEQ ID NO: 882043 - RNA, 19 nt, Human
cauagcaucuccauccucc

SEQ ID NO: 882044 - RNA, 22 nt, Human
cauguaaggcuaacaauugccc

SEQ ID NO: 882045 - RNA, 19 nt, Human
ccacgccgcgcuccccacu

SEQ ID NO: 882046 - RNA, 27 nt, Human
ccacugcagucgccgccgccgccgccg

SEQ ID NO: 882047 - RNA, 25 nt, Human
ccaucuuuucaucaugcaacacugg

SEQ ID NO: 882048 - RNA, 18 nt, Human
ccgccgccgccgccgcgu

SEQ ID NO: 882049 - RNA, 20 nt, Human
ccgccgccgccgccgcgucc

SEQ ID NO: 882050 - RNA, 19 nt, Human
ccuccacgccgcgcucccc

SEQ ID NO: 882051 - RNA, 20 nt, Human
cgccgccgccgccgcguccc

SEQ ID NO: 882052 - RNA, 24 nt, Human
cguuacaaaaguucucaagcaaag

SEQ ID NO: 882053 - RNA, 18 nt, Human
cuggaaauacuacaggau

SEQ ID NO: 882054 - RNA, 23 nt, Human
cuuccaucauagcaucuccaucc

SEQ ID NO: 882055 - RNA, 18 nt, Human
ggcucggcuuggggaaga

SEQ ID NO: 882056 - RNA, 21 nt, Human
gucccugagcccggguccccg

SEQ ID NO: 882057 - RNA, 21 nt, Human
uaaaugcuaagacuaaucagu

SEQ ID NO: 882058 - RNA, 21 nt, Human
uaaggcaaaccauuucuaaau

SEQ ID NO: 882059 - RNA, 21 nt, Human
uagaaucauaccaucuuuuca

SEQ ID NO: 882060 - RNA, 24 nt, Human
uauacauauccuuuguacacaucu

SEQ ID NO: 882061 - RNA, 22 nt, Human
ucagucuuaagcccuuagauua

SEQ ID NO: 882062 - RNA, 23 nt, Human
ucccugagcccggguccccgcug

SEQ ID NO: 882063 - RNA, 21 nt, Human
ucuccaaggcuaaauguggua

SEQ ID NO: 882064 - RNA, 18 nt, Human
ucugaaaucucccaauug

SEQ ID NO: 882065 - RNA, 23 nt, Human
ugaaaagaaaguacaaaaacagc

SEQ ID NO: 882066 - RNA, 19 nt, Human
ugaaaucucccaauuguaa

SEQ ID NO: 882067 - RNA, 21 nt, Human
ugagaaaaacuucaaaaaaac

SEQ ID NO: 882068 - RNA, 21 nt, Human
ugaggauauguucuagguauu

SEQ ID NO: 882069 - RNA, 20 nt, Human
ugcuuccaucauagcaucuc

SEQ ID NO: 882070 - RNA, 23 nt, Human
uggcucggcuuggggaagaggcu

SEQ ID NO: 882071 - RNA, 24 nt, Human
uugcugaggauauguucuagguau

SEQ ID NO: 882072 - RNA, 22 nt, Human
uugucuccauuaaggcaaacca

SEQ ID NO: 882073 - RNA, 23 nt, Human
uuuaaaaccgauacuuuuuacuc

SEQ ID NO: 882074 - RNA, 25 nt, Human
uuuagugagaaaaacuucaaaaaaa

SEQ ID NO: 882075 - RNA, 23 nt, Human
uuuuuuuuuuaaaaccgauacuu

SEQ ID NO: 882076 - RNA, 21 nt, Human
aaaauaaagggcgugggcagg

SEQ ID NO: 882077 - RNA, 19 nt, Human
aaacaagaaaacaacugcc

SEQ ID NO: 882078 - RNA, 22 nt, Human
aaccaugcugagacuggaaagc

SEQ ID NO: 882079 - RNA, 22 nt, Human
aagcacugacagcagcaaagcc

SEQ ID NO: 882080 - RNA, 24 nt, Human
aagcuucagcuccaaaccaugcug

SEQ ID NO: 882081 - RNA, 20 nt, Human
aagggcgugggcaggcccug

SEQ ID NO: 882082 - RNA, 21 nt, Human
aagggcgugggcaggcccugc

SEQ ID NO: 882083 - RNA, 20 nt, Human
acaccgccagcaccccgccc

SEQ ID NO: 882084 - RNA, 21 nt, Human
acacuacagcggggaaaagua

SEQ ID NO: 882085 - RNA, 23 nt, Human
acaucaccugccaccaguggccu

SEQ ID NO: 882086 - RNA, 20 nt, Human
accccgccccuccaacucca

SEQ ID NO: 882087 - RNA, 25 nt, Human
accccgccccuccaacuccauccac

SEQ ID NO: 882088 - RNA, 19 nt, Human
acgccccgcugcagccacc

SEQ ID NO: 882089 - RNA, 21 nt, Human
agaagguaaaguaucuguucc

SEQ ID NO: 882090 - RNA, 21 nt, Human
agacagagaaugugaccagga

SEQ ID NO: 882091 - RNA, 27 nt, Human
agacaggaagcagauacacugcugccu

SEQ ID NO: 882092 - RNA, 20 nt, Human
aggcaaaauaaagggcgugg

SEQ ID NO: 882093 - RNA, 21 nt, Human
aggcuguagacucugcauccg

SEQ ID NO: 882094 - RNA, 23 nt, Human
caaaacaccaaaauccuggggga

SEQ ID NO: 882095 - RNA, 22 nt, Human
caaaauccugggggagagcccc

SEQ ID NO: 882096 - RNA, 21 nt, Human
cacaccgccagcaccccgccc

SEQ ID NO: 882097 - RNA, 22 nt, Human
caccgccagcaccccgccccuc

SEQ ID NO: 882098 - RNA, 19 nt, Human
caccugcaaacaagaaaac

SEQ ID NO: 882099 - RNA, 20 nt, Human
caccugcaaacaagaaaaca

SEQ ID NO: 882100 - RNA, 21 nt, Human
cacgccccgcugcagccaccc

SEQ ID NO: 882101 - RNA, 18 nt, Human
cacugacagcagcaaagc

SEQ ID NO: 882102 - RNA, 23 nt, Human
cagcaccccgccccuccaacucc

SEQ ID NO: 882103 - RNA, 18 nt, Human
caggaugcagcaguguca

SEQ ID NO: 882104 - RNA, 19 nt, Human
caguggccuaucccagccc

SEQ ID NO: 882105 - RNA, 22 nt, Human
caguggcuccagccggcagcgc

SEQ ID NO: 882106 - RNA, 23 nt, Human
caucugaaccccuggcuucguuc

SEQ ID NO: 882107 - RNA, 18 nt, Human
ccacacacccggccgcac

SEQ ID NO: 882108 - RNA, 19 nt, Human
ccacugcuccuaaacuccu

SEQ ID NO: 882109 - RNA, 23 nt, Human
ccacuugaggugggagcauucca

SEQ ID NO: 882110 - RNA, 20 nt, Human
cccacgccccgcugcagcca

SEQ ID NO: 882111 - RNA, 25 nt, Human
cccccccgccacaccgccagcaccc

SEQ ID NO: 882112 - RNA, 22 nt, Human
cccccgccacaccgccagcacc

SEQ ID NO: 882113 - RNA, 21 nt, Human
ccccggcccacgccccgcugc

SEQ ID NO: 882114 - RNA, 19 nt, Human
ccccggggcuccgcccggg

SEQ ID NO: 882115 - RNA, 21 nt, Human
ccccggggcuccgcccgggcc

SEQ ID NO: 882116 - RNA, 21 nt, Human
ccccuccaacuccauccaccc

SEQ ID NO: 882117 - RNA, 18 nt, Human
cccgccacaccgccagca

SEQ ID NO: 882118 - RNA, 22 nt, Human
cccgccacaccgccagcacccc

SEQ ID NO: 882119 - RNA, 20 nt, Human
cccuccaacuccauccaccc

SEQ ID NO: 882120 - RNA, 24 nt, Human
ccgccacaccgccagcaccccgcc

SEQ ID NO: 882121 - RNA, 20 nt, Human
ccgggccggaguccggaucu

SEQ ID NO: 882122 - RNA, 21 nt, Human
ccucguaguccgggccggagu

SEQ ID NO: 882123 - RNA, 18 nt, Human
ccugcccccccgccacac

SEQ ID NO: 882124 - RNA, 25 nt, Human
cgccacaccgccagcaccccgcccc

SEQ ID NO: 882125 - RNA, 23 nt, Human
cgccagcaccccgccccuccaac

SEQ ID NO: 882126 - RNA, 24 nt, Human
cgccugcccccccgccacaccgcc

SEQ ID NO: 882127 - RNA, 19 nt, Human
cggccgcaccugcaaacaa

SEQ ID NO: 882128 - RNA, 20 nt, Human
cgggcagcugggucaggcug

SEQ ID NO: 882129 - RNA, 24 nt, Human
cggggcuccgcccgggcccugccg

SEQ ID NO: 882130 - RNA, 25 nt, Human
cguucagcccccucaugggccucca

SEQ ID NO: 882131 - RNA, 22 nt, Human
cuaguccaaaagauggggaccc

SEQ ID NO: 882132 - RNA, 21 nt, Human
cucacaccccagacaggaagc

SEQ ID NO: 882133 - RNA, 24 nt, Human
cuccacuugaggugggagcauucc

SEQ ID NO: 882134 - RNA, 18 nt, Human
cuccccgccgccggcccc

SEQ ID NO: 882135 - RNA, 18 nt, Human
cuccgcccgggcccugcc

SEQ ID NO: 882136 - RNA, 19 nt, Human
cugagacuggaaagcacug

SEQ ID NO: 882137 - RNA, 21 nt, Human
cugcaucaugaaguaauguug

SEQ ID NO: 882138 - RNA, 18 nt, Human
cugcccccccgccacacc

SEQ ID NO: 882139 - RNA, 20 nt, Human
cuguggugugcuuugcugca

SEQ ID NO: 882140 - RNA, 21 nt, Human
gacagcagcaaagcccaaaga

SEQ ID NO: 882141 - RNA, 19 nt, Human
gagagccccucuaccuucc

SEQ ID NO: 882142 - RNA, 22 nt, Human
gagcauuccaggagacagagaa

SEQ ID NO: 882143 - RNA, 18 nt, Human
gccagcaccccgccccuc

SEQ ID NO: 882144 - RNA, 19 nt, Human
gcccugccgccugcccccc

SEQ ID NO: 882145 - RNA, 19 nt, Human
gcccugcgccuguugcugu

SEQ ID NO: 882146 - RNA, 24 nt, Human
gccgcaccugcaaacaagaaaaca

SEQ ID NO: 882147 - RNA, 18 nt, Human
gccgccggccccccggcc

SEQ ID NO: 882148 - RNA, 22 nt, Human
ggaaccaggggaaugagcugcu

SEQ ID NO: 882149 - RNA, 19 nt, Human
ggccccccggcccacgccc

SEQ ID NO: 882150 - RNA, 19 nt, Human
uaaaugcagcucacacccc

SEQ ID NO: 882151 - RNA, 18 nt, Human
uaggaaggccagcucaag

SEQ ID NO: 882152 - RNA, 25 nt, Human
ucaccugccaccaguggccuauccc

SEQ ID NO: 882153 - RNA, 20 nt, Human
ucagcccccucaugggccuc

SEQ ID NO: 882154 - RNA, 19 nt, Human
ucaugggccuccauaggcc

SEQ ID NO: 882155 - RNA, 21 nt, Human
ucaugggccuccauaggcccu

SEQ ID NO: 882156 - RNA, 19 nt, Human
uccccggggcuccgcccgg

SEQ ID NO: 882157 - RNA, 22 nt, Human
uccccggggcuccgcccgggcc

SEQ ID NO: 882158 - RNA, 21 nt, Human
ugacagcagcaaagcccaaag

SEQ ID NO: 882159 - RNA, 20 nt, Human
ugaccaggaugcagcagugu

SEQ ID NO: 882160 - RNA, 19 nt, Human
ugaggucccccagugaagg

SEQ ID NO: 882161 - RNA, 25 nt, Human
ugcaaacaagaaaacaacugccaca

SEQ ID NO: 882162 - RNA, 26 nt, Human
ugcaggccccggccuccccgccgccg

SEQ ID NO: 882163 - RNA, 19 nt, Human
ugcguggugacaguggcuc

SEQ ID NO: 882164 - RNA, 20 nt, Human
ugcuccaggaucccugccac

SEQ ID NO: 882165 - RNA, 21 nt, Human
ugcuccaggaucccugccacg

SEQ ID NO: 882166 - RNA, 19 nt, Human
uggcaggaacugguguuag

SEQ ID NO: 882167 - RNA, 18 nt, Human
uguaaggccaagagagcu

SEQ ID NO: 882168 - RNA, 18 nt, Human
ugugcguggugacagugg

SEQ ID NO: 882169 - RNA, 25 nt, Human
uuaaaggcuuuuuauuaggaaccag

SEQ ID NO: 882170 - RNA, 20 nt, Human
uuuuuauuaggaaccagggg

SEQ ID NO: 882171 - RNA, 18 nt, Human
aauaaccaacaacaccca

SEQ ID NO: 882172 - RNA, 23 nt, Human
aauaaccaacaacacccaacccg

SEQ ID NO: 882173 - RNA, 19 nt, Human
accaaauaaccaacaacac

SEQ ID NO: 882174 - RNA, 18 nt, Human
accaacaacacccaaccc

SEQ ID NO: 882175 - RNA, 22 nt, Human
agccugcgccggugaggaggca

SEQ ID NO: 882176 - RNA, 24 nt, Human
auaaccaacaacacccaacccgaa

SEQ ID NO: 882177 - RNA, 21 nt, Human
caaauaaccaacaacacccaa

SEQ ID NO: 882178 - RNA, 24 nt, Human
caaauaaccaacaacacccaaccc

SEQ ID NO: 882179 - RNA, 23 nt, Human
caacacccaacccgaaaagaagg

SEQ ID NO: 882180 - RNA, 23 nt, Human
cccugcccaccugcccuucuccc

SEQ ID NO: 882181 - RNA, 19 nt, Human
ccgaaaagaagggggaagg

SEQ ID NO: 882182 - RNA, 22 nt, Human
ccgcccccuccuagccugcgcc

SEQ ID NO: 882183 - RNA, 19 nt, Human
ccgcgcgcuccagccccgg

SEQ ID NO: 882184 - RNA, 20 nt, Human
ccgcgcgcuccagccccggc

SEQ ID NO: 882185 - RNA, 20 nt, Human
ccugcccuucucccuuccuc

SEQ ID NO: 882186 - RNA, 20 nt, Human
ccuugggccaaggguugugg

SEQ ID NO: 882187 - RNA, 21 nt, Human
cucccugcccaccugcccuuc

SEQ ID NO: 882188 - RNA, 24 nt, Human
gacccugucuugcucccugcccac

SEQ ID NO: 882189 - RNA, 21 nt, Human
gggcuggccaggccaccguca

SEQ ID NO: 882190 - RNA, 18 nt, Human
gggggcccaaggggcaac

SEQ ID NO: 882191 - RNA, 18 nt, Human
guaccaaguccuugggcc

SEQ ID NO: 882192 - RNA, 21 nt, Human
uaaccaaauaaccaacaacac

SEQ ID NO: 882193 - RNA, 26 nt, Human
uccaaacaacaugggggggcccaagg

SEQ ID NO: 882194 - RNA, 18 nt, Human
ucucuuuugaagaaggug

SEQ ID NO: 882195 - RNA, 20 nt, Human
ugcaguuagguggggagggg

SEQ ID NO: 882196 - RNA, 22 nt, Human
ugguuucagugcaguuaggugg

SEQ ID NO: 882197 - RNA, 22 nt, Human
caggggcauggcccgggugucc

SEQ ID NO: 882198 - RNA, 22 nt, Human
ccccuggcagcaguaccugccu

SEQ ID NO: 882199 - RNA, 25 nt, Human
ccccuggcagcaguaccugccuguu

SEQ ID NO: 882200 - RNA, 22 nt, Human
cccgcggcgcccgccccgagac

SEQ ID NO: 882201 - RNA, 24 nt, Human
cccgcggcgcccgccccgagaccc

SEQ ID NO: 882202 - RNA, 22 nt, Human
ccuggguagcaggcacuaguuc

SEQ ID NO: 882203 - RNA, 22 nt, Human
cucccagcgccuuauaacaacu

SEQ ID NO: 882204 - RNA, 26 nt, Human
cuggguccucugcuccugggcucagg

SEQ ID NO: 882205 - RNA, 21 nt, Human
ggcccggagaggucccgcggc

SEQ ID NO: 882206 - RNA, 18 nt, Human
guacacaacaccaugggc

SEQ ID NO: 882207 - RNA, 23 nt, Human
guucagagcccccuggcagcagu

SEQ ID NO: 882208 - RNA, 24 nt, Human
uccgugggcaaccugggugcuucg

SEQ ID NO: 882209 - RNA, 23 nt, Human
ugagauaaacccaguuuucccac

SEQ ID NO: 882210 - RNA, 24 nt, Human
ugcccauccucucccagcgccuua

SEQ ID NO: 882211 - RNA, 20 nt, Human
ugccuugagauaaacccagu

SEQ ID NO: 882212 - RNA, 21 nt, Human
uucccacugccuucuucuuca

SEQ ID NO: 882213 - RNA, 22 nt, Human
aaacaugaaccacagugcauga

SEQ ID NO: 882214 - RNA, 26 nt, Human
aaagaaaaagucgccaagggacaaaa

SEQ ID NO: 882215 - RNA, 25 nt, Human
aagaaaaagucgccaagggacaaaa

SEQ ID NO: 882216 - RNA, 21 nt, Human
aaggaagacaucuagaacggu

SEQ ID NO: 882217 - RNA, 19 nt, Human
aagguccgugcaagccaca

SEQ ID NO: 882218 - RNA, 21 nt, Human
agcaagaaugaaugaaaucca

SEQ ID NO: 882219 - RNA, 22 nt, Human
agcaagaaugaaugaaauccac

SEQ ID NO: 882220 - RNA, 18 nt, Human
agguggaauugaaaagcc

SEQ ID NO: 882221 - RNA, 22 nt, Human
aucaugaaguuuuagcccagag

SEQ ID NO: 882222 - RNA, 21 nt, Human
aucuucuaggaaagcaaagcu

SEQ ID NO: 882223 - RNA, 18 nt, Human
caaaauuccaagggcauu

SEQ ID NO: 882224 - RNA, 21 nt, Human
cacaacacauaggauuauggg

SEQ ID NO: 882225 - RNA, 22 nt, Human
cacuguuuaggguugacugccu

SEQ ID NO: 882226 - RNA, 19 nt, Human
ccacuggagugaguugggc

SEQ ID NO: 882227 - RNA, 26 nt, Human
cccacaaaguccugaccauucucaac

SEQ ID NO: 882228 - RNA, 21 nt, Human
ccccccaggucugccuucucc

SEQ ID NO: 882229 - RNA, 24 nt, Human
ccucaguuuucacugguccagcgu

SEQ ID NO: 882230 - RNA, 21 nt, Human
ccuucuguccauuccuuccca

SEQ ID NO: 882231 - RNA, 20 nt, Human
cgccaagggacaaaauucuu

SEQ ID NO: 882232 - RNA, 26 nt, Human
cuagaacgguaauccuagcuuuuucu

SEQ ID NO: 882233 - RNA, 19 nt, Human
cuagcuuuuucuccccacc

SEQ ID NO: 882234 - RNA, 23 nt, Human
cuguccauuccuucccaaggccu

SEQ ID NO: 882235 - RNA, 21 nt, Human
gaaaagaaugagaacagaaga

SEQ ID NO: 882236 - RNA, 18 nt, Human
gaaguuuuagcccagagc

SEQ ID NO: 882237 - RNA, 18 nt, Human
gccuaguaggaagagcuc

SEQ ID NO: 882238 - RNA, 19 nt, Human
ggaaauaggaaaaagagcc

SEQ ID NO: 882239 - RNA, 19 nt, Human
ggaauugaaaagccuugua

SEQ ID NO: 882240 - RNA, 20 nt, Human
ggaggaaauaaaguuuagag

SEQ ID NO: 882241 - RNA, 21 nt, Human
ggagugaaaagaaugagaaca

SEQ ID NO: 882242 - RNA, 21 nt, Human
ggcaguacuggggguagcuga

SEQ ID NO: 882243 - RNA, 22 nt, Human
gguggcagggaaauaggaaaaa

SEQ ID NO: 882244 - RNA, 24 nt, Human
gguggcagggaaauaggaaaaaga

SEQ ID NO: 882245 - RNA, 23 nt, Human
uaggaaagcaaagcugguggcag

SEQ ID NO: 882246 - RNA, 19 nt, Human
uaguaggaagagcucucau

SEQ ID NO: 882247 - RNA, 21 nt, Human
uccccaccacaacacauagga

SEQ ID NO: 882248 - RNA, 21 nt, Human
uccccccaggucugccuucuc

SEQ ID NO: 882249 - RNA, 23 nt, Human
uccccccaggucugccuucuccu

SEQ ID NO: 882250 - RNA, 25 nt, Human
uccgugcaagccacacggugagccg

SEQ ID NO: 882251 - RNA, 22 nt, Human
uccucgccauggucgcuauuuc

SEQ ID NO: 882252 - RNA, 23 nt, Human
ucuucaucuucuaggaaagcaaa

SEQ ID NO: 882253 - RNA, 18 nt, Human
ugaaaacaguguuccuuc

SEQ ID NO: 882254 - RNA, 23 nt, Human
ugagaacagaagaacccgcagcc

SEQ ID NO: 882255 - RNA, 19 nt, Human
ugagagaggcacuguugua

SEQ ID NO: 882256 - RNA, 23 nt, Human
ugccggcugguccucucuuccca

SEQ ID NO: 882257 - RNA, 18 nt, Human
uggaaggcuuuacaaaau

SEQ ID NO: 882258 - RNA, 19 nt, Human
uggaauugaaaagccuugu

SEQ ID NO: 882259 - RNA, 21 nt, Human
uggauauaugugcauguccuc

SEQ ID NO: 882260 - RNA, 22 nt, Human
uggcagggaaauaggaaaaaga

SEQ ID NO: 882261 - RNA, 19 nt, Human
ugggaggaaauaaaguuua

SEQ ID NO: 882262 - RNA, 26 nt, Human
ugggaggaaauaaaguuuagagcugg

SEQ ID NO: 882263 - RNA, 23 nt, Human
ugguuuggaaggcuuuacaaaau

SEQ ID NO: 882264 - RNA, 23 nt, Human
uucacaaucaccuuuucggaaac

SEQ ID NO: 882265 - RNA, 19 nt, Human
uucccacaacagcuggagc

SEQ ID NO: 882266 - RNA, 21 nt, Human
uugagaacgucuuugaaguug

SEQ ID NO: 882267 - RNA, 24 nt, Human
uuggcguacaucuuacaaagaaaa

SEQ ID NO: 882268 - RNA, 22 nt, Human
uuucuuccucguccucccccca

SEQ ID NO: 882269 - RNA, 20 nt, Human
uuuggaaggcuuuacaaaau

SEQ ID NO: 882270 - RNA, 20 nt, Human
uuuucacugguccagcgugg

SEQ ID NO: 882271 - RNA, 20 nt, Human
aaaaaaaacaaaagcacaaa

SEQ ID NO: 882272 - RNA, 23 nt, Human
aaaaacaauuccuaaaagauuga

SEQ ID NO: 882273 - RNA, 22 nt, Human
aaaaccaugaaacaagccacca

SEQ ID NO: 882274 - RNA, 20 nt, Human
aaacaaaagcacaaauggau

SEQ ID NO: 882275 - RNA, 21 nt, Human
aaacaaaagcacaaauggaug

SEQ ID NO: 882276 - RNA, 26 nt, Human
aaacagaaaacaaacaucaagggacc

SEQ ID NO: 882277 - RNA, 20 nt, Human
aacaagccaccauucuucaa

SEQ ID NO: 882278 - RNA, 23 nt, Human
aagaacaaaaauguguuuacgga

SEQ ID NO: 882279 - RNA, 19 nt, Human
aagaagaaaaaaggagcua

SEQ ID NO: 882280 - RNA, 22 nt, Human
aagagauagacuaagaacaaaa

SEQ ID NO: 882281 - RNA, 24 nt, Human
accacccccgacuaccgcccccua

SEQ ID NO: 882282 - RNA, 22 nt, Human
accauaaaaaaaaacaaaagca

SEQ ID NO: 882283 - RNA, 19 nt, Human
acuagcuacacaaugcauu

SEQ ID NO: 882284 - RNA, 19 nt, Human
agacacaaauacaaaaacc

SEQ ID NO: 882285 - RNA, 20 nt, Human
agcauucaaaagcagcuuug

SEQ ID NO: 882286 - RNA, 19 nt, Human
aggcaauaaaacacucuac

SEQ ID NO: 882287 - RNA, 22 nt, Human
auaagugauucgccgccuccuu

SEQ ID NO: 882288 - RNA, 22 nt, Human
auggaugacuugcaaaggaugg

SEQ ID NO: 882289 - RNA, 24 nt, Human
caaaaaccaugaaacaagccacca

SEQ ID NO: 882290 - RNA, 22 nt, Human
caaauacaaaaaccaugaaaca

SEQ ID NO: 882291 - RNA, 25 nt, Human
cacaaauacaaaaaccaugaaacaa

SEQ ID NO: 882292 - RNA, 24 nt, Human
cacccccgacuaccgcccccuacu

SEQ ID NO: 882293 - RNA, 25 nt, Human
cagcaauuuugaaaugaaaaaaaaa

SEQ ID NO: 882294 - RNA, 22 nt, Human
cauaaaaaaaaacaaaagcaca

SEQ ID NO: 882295 - RNA, 25 nt, Human
cauaaaaaaaaacaaaagcacaaau

SEQ ID NO: 882296 - RNA, 26 nt, Human
cauaaaaaaaaacaaaagcacaaaug

SEQ ID NO: 882297 - RNA, 23 nt, Human
caucguuuguacaagagauagac

SEQ ID NO: 882298 - RNA, 18 nt, Human
caugaaacaagccaccau

SEQ ID NO: 882299 - RNA, 25 nt, Human
caugaaacaagccaccauucuucaa

SEQ ID NO: 882300 - RNA, 21 nt, Human
ccauaaaaaaaaacaaaagca

SEQ ID NO: 882301 - RNA, 19 nt, Human
cccaccacccccgacuacc

SEQ ID NO: 882302 - RNA, 22 nt, Human
cccccuacucucuaccccaccc

SEQ ID NO: 882303 - RNA, 19 nt, Human
cccccuuuuauuuuuucuc

SEQ ID NO: 882304 - RNA, 22 nt, Human
cccuacucucuaccccacccaa

SEQ ID NO: 882305 - RNA, 23 nt, Human
cccucuguuguccaucauugaaa

SEQ ID NO: 882306 - RNA, 24 nt, Human
ccuucucccaccacccccgacuac

SEQ ID NO: 882307 - RNA, 23 nt, Human
cgcccccuacucucuaccccacc

SEQ ID NO: 882308 - RNA, 20 nt, Human
cuacucucuaccccacccaa

SEQ ID NO: 882309 - RNA, 18 nt, Human
cuccuucucccaccaccc

SEQ ID NO: 882310 - RNA, 19 nt, Human
cuccuucucccaccacccc

SEQ ID NO: 882311 - RNA, 19 nt, Human
gaaaaaaaaaaagaaagaa

SEQ ID NO: 882312 - RNA, 21 nt, Human
gaaaaaaaaaaagaaagaaga

SEQ ID NO: 882313 - RNA, 20 nt, Human
gacuaccgcccccuacucuc

SEQ ID NO: 882314 - RNA, 20 nt, Human
gauucgccgccuccuccuuc

SEQ ID NO: 882315 - RNA, 20 nt, Human
gucaaaggaauagaaccacc

SEQ ID NO: 882316 - RNA, 22 nt, Human
uaaaaaaaaacaaaagcacaaa

SEQ ID NO: 882317 - RNA, 22 nt, Human
uaaaacacucuacagcauaucc

SEQ ID NO: 882318 - RNA, 25 nt, Human
uaaaacacucuacagcauaucccuc

SEQ ID NO: 882319 - RNA, 20 nt, Human
uaaaaugccuaaguaacaac

SEQ ID NO: 882320 - RNA, 23 nt, Human
uaacaacauggaugacuugcaaa

SEQ ID NO: 882321 - RNA, 23 nt, Human
uaagcaccauaaaaaaaaacaaa

SEQ ID NO: 882322 - RNA, 22 nt, Human
uaagugauucgccgccuccucc

SEQ ID NO: 882323 - RNA, 22 nt, Human
uacaaaaaccaugaaacaagcc

SEQ ID NO: 882324 - RNA, 18 nt, Human
uaccgcccccuacucucu

SEQ ID NO: 882325 - RNA, 23 nt, Human
uagacacaaauacaaaaaccaug

SEQ ID NO: 882326 - RNA, 18 nt, Human
ucaaaagcagcuuuguca

SEQ ID NO: 882327 - RNA, 22 nt, Human
ucaaagcacaucguuuguacaa

SEQ ID NO: 882328 - RNA, 19 nt, Human
ucaaaggaauagaaccacc

SEQ ID NO: 882329 - RNA, 20 nt, Human
ugaaaaacaauuccuaaaag

SEQ ID NO: 882330 - RNA, 23 nt, Human
ugaaaaacaauuccuaaaagauu

SEQ ID NO: 882331 - RNA, 24 nt, Human
ugaaaaacaauuccuaaaagauug

SEQ ID NO: 882332 - RNA, 23 nt, Human
ugaaaacacuggcagcaauuuug

SEQ ID NO: 882333 - RNA, 27 nt, Human
ugaaaacacuggcagcaauuuugaaau

SEQ ID NO: 882334 - RNA, 18 nt, Human
ugaaaugaaaaaaaaaaa

SEQ ID NO: 882335 - RNA, 23 nt, Human
ugaaaugaaaaaaaaaaagaaag

SEQ ID NO: 882336 - RNA, 22 nt, Human
ugaaccuuuggcacuaggaauc

SEQ ID NO: 882337 - RNA, 22 nt, Human
ugacuugcaaaggaugggcucu

SEQ ID NO: 882338 - RNA, 23 nt, Human
uguuguccaucauugaaaacacu

SEQ ID NO: 882339 - RNA, 23 nt, Human
uuaagcaccauaaaaaaaaacaa

SEQ ID NO: 882340 - RNA, 24 nt, Human
uucaacaauuugagccaagauaaa

SEQ ID NO: 882341 - RNA, 25 nt, Human
uuuaagcaccauaaaaaaaaacaaa

SEQ ID NO: 882342 - RNA, 20 nt, Human
uuugagccaagauaaaaugc

SEQ ID NO: 882343 - RNA, 25 nt, Human
accaaggagacugcagucaaauaaa

SEQ ID NO: 882344 - RNA, 23 nt, Human
agacuaacaaauccaccuuggca

SEQ ID NO: 882345 - RNA, 18 nt, Human
caccaccugugccucugc

SEQ ID NO: 882346 - RNA, 18 nt, Human
caccaccugugccucugc

SEQ ID NO: 882347 - RNA, 19 nt, Human
cuacugucugccaccaccu

SEQ ID NO: 882348 - RNA, 24 nt, Human
cucacagcuuuggccacgcacucc

SEQ ID NO: 882349 - RNA, 21 nt, Human
gaaaaguacugaaaaugcuau

SEQ ID NO: 882350 - RNA, 20 nt, Human
gacuugggcaauguggccag

SEQ ID NO: 882351 - RNA, 25 nt, Human
gccucuacugucugccaccaccugu

SEQ ID NO: 882352 - RNA, 21 nt, Human
gggcaauguggccaggagggc

SEQ ID NO: 882353 - RNA, 20 nt, Human
ggucagaaaaaucaacauuu

SEQ ID NO: 882354 - RNA, 27 nt, Human
uaaauacauaauacagaagccugugug

SEQ ID NO: 882355 - RNA, 18 nt, Human
uauuagcugaauuuguga

SEQ ID NO: 882356 - RNA, 20 nt, Human
uauuucaaauauauuuucac

SEQ ID NO: 882357 - RNA, 19 nt, Human
uauuuuucccauuuuguuu

SEQ ID NO: 882358 - RNA, 18 nt, Human
uccuaggccgaggcuaug

SEQ ID NO: 882359 - RNA, 22 nt, Human
ugaguuauccuuauuuuuccca

SEQ ID NO: 882360 - RNA, 24 nt, Human
ugaguuauccuuauuuuucccauu

SEQ ID NO: 882361 - RNA, 19 nt, Human
ugccaccaccugugccucu

SEQ ID NO: 882362 - RNA, 18 nt, Human
uguccuaggccgaggcua

SEQ ID NO: 882363 - RNA, 24 nt, Human
uuagcugaauuugugauuuccuuu

SEQ ID NO: 882364 - RNA, 24 nt, Human
uuauggucagaaaaaucaacauuu

SEQ ID NO: 882365 - RNA, 24 nt, Human
aaagcccccaucaaguaucucaua

SEQ ID NO: 882366 - RNA, 18 nt, Human
aaaguguugggauuacag

SEQ ID NO: 882367 - RNA, 20 nt, Human
aaaguguugggauuacaggc

SEQ ID NO: 882368 - RNA, 24 nt, Human
aaaguguugggauuacaggcguga

SEQ ID NO: 882369 - RNA, 23 nt, Human
aaccuccgcuucauugcaaccuc

SEQ ID NO: 882370 - RNA, 20 nt, Human
aagccugcaccaacauaccc

SEQ ID NO: 882371 - RNA, 20 nt, Human
aaguagcugggauugcaagc

SEQ ID NO: 882372 - RNA, 24 nt, Human
aagugauccgcccgccuuggacuc

SEQ ID NO: 882373 - RNA, 21 nt, Human
aaguguugggauuacaggcgu

SEQ ID NO: 882374 - RNA, 26 nt, Human
aaguguugggauuacaggcgugagcc

SEQ ID NO: 882375 - RNA, 19 nt, Human
acggguuuuaucaccuugg

SEQ ID NO: 882376 - RNA, 19 nt, Human
agagaagcggggagcccag

SEQ ID NO: 882377 - RNA, 20 nt, Human
agagaagcggggagcccagg

SEQ ID NO: 882378 - RNA, 24 nt, Human
agcuggucuugaacuccugaccuc

SEQ ID NO: 882379 - RNA, 22 nt, Human
aggaaaucccuaucuuccuauc

SEQ ID NO: 882380 - RNA, 22 nt, Human
aggcgaagaaggaguucccuag

SEQ ID NO: 882381 - RNA, 24 nt, Human
agugcagcggcaugcucucggcuc

SEQ ID NO: 882382 - RNA, 21 nt, Human
auuaguagagacggguuuuau

SEQ ID NO: 882383 - RNA, 24 nt, Human
auugcaaccucugccucugagguu

SEQ ID NO: 882384 - RNA, 22 nt, Human
cacacaagcuacaguuuuucag

SEQ ID NO: 882385 - RNA, 18 nt, Human
caccgccuccccuccaga

SEQ ID NO: 882386 - RNA, 21 nt, Human
caccucagcgucccaaguagc

SEQ ID NO: 882387 - RNA, 24 nt, Human
caccucagcgucccaaguagcugg

SEQ ID NO: 882388 - RNA, 18 nt, Human
cagcaggcgaagaaggag

SEQ ID NO: 882389 - RNA, 23 nt, Human
cagucucccaggcuggagugcag

SEQ ID NO: 882390 - RNA, 26 nt, Human
caucaaguaucucauacuuaagcaaa

SEQ ID NO: 882391 - RNA, 22 nt, Human
cauuguggcuuuauugcagcuu

SEQ ID NO: 882392 - RNA, 24 nt, Human
ccaaaggcucauuuucacacaagc

SEQ ID NO: 882393 - RNA, 19 nt, Human
cccaaguagcugggauugc

SEQ ID NO: 882394 - RNA, 19 nt, Human
cccgcaccgccuccccucc

SEQ ID NO: 882395 - RNA, 22 nt, Human
cccgccuuggacuccuaaagug

SEQ ID NO: 882396 - RNA, 23 nt, Human
ccuaaaguguugggauuacaggc

SEQ ID NO: 882397 - RNA, 23 nt, Human
ccucccaccucagcgucccaagu

SEQ ID NO: 882398 - RNA, 24 nt, Human
ccucccaccucagcgucccaagua

SEQ ID NO: 882399 - RNA, 18 nt, Human
ccugaccucaagugaucc

SEQ ID NO: 882400 - RNA, 19 nt, Human
ccugaccucaagugauccg

SEQ ID NO: 882401 - RNA, 22 nt, Human
ccugaccucaagugauccgccc

SEQ ID NO: 882402 - RNA, 25 nt, Human
cggcgggaccuggagagagcagcgg

SEQ ID NO: 882403 - RNA, 22 nt, Human
cuaaaguguugggauuacaggc

SEQ ID NO: 882404 - RNA, 24 nt, Human
cuaaaguguugggauuacaggcgu

SEQ ID NO: 882405 - RNA, 26 nt, Human
cuccugaccucaagugauccgcccgc

SEQ ID NO: 882406 - RNA, 24 nt, Human
gaccucaagugauccgcccgccuu

SEQ ID NO: 882407 - RNA, 18 nt, Human
gacggguuuuaucaccuu

SEQ ID NO: 882408 - RNA, 18 nt, Human
gauuacaggcgugagcca

SEQ ID NO: 882409 - RNA, 22 nt, Human
gauuacaggcgugagccaccgc

SEQ ID NO: 882410 - RNA, 23 nt, Human
gauuacaggcgugagccaccgca

SEQ ID NO: 882411 - RNA, 24 nt, Human
gcaagccugcaccaacauacccag

SEQ ID NO: 882412 - RNA, 18 nt, Human
gcgcggcgggaccuggag

SEQ ID NO: 882413 - RNA, 21 nt, Human
gcucucggcucacugcaaccu

SEQ ID NO: 882414 - RNA, 19 nt, Human
gcuggagugcagcggcaug

SEQ ID NO: 882415 - RNA, 19 nt, Human
ggaccuggagagagcagcg

SEQ ID NO: 882416 - RNA, 19 nt, Human
ggucuugaacuccugaccu

SEQ ID NO: 882417 - RNA, 25 nt, Human
guaguaaaaucccggaaaauguuuu

SEQ ID NO: 882418 - RNA, 19 nt, Human
uaaagacugguccaaaggc

SEQ ID NO: 882419 - RNA, 23 nt, Human
uaaagacugguccaaaggcucau

SEQ ID NO: 882420 - RNA, 23 nt, Human
uacaggcgugagccaccgcaccc

SEQ ID NO: 882421 - RNA, 21 nt, Human
uaucaccuuggccaagcuggu

SEQ ID NO: 882422 - RNA, 18 nt, Human
ucacugcaaccuccgcuu

SEQ ID NO: 882423 - RNA, 19 nt, Human
ucacugcaaccuccgcuuc

SEQ ID NO: 882424 - RNA, 23 nt, Human
ucacugcaaccuccgcuucauug

SEQ ID NO: 882425 - RNA, 25 nt, Human
ucacugcaaccuccgcuucauugca

SEQ ID NO: 882426 - RNA, 28 nt, Human
ucacugcaaccuccgcuucgggcccucc

SEQ ID NO: 882427 - RNA, 28 nt, Human
ucacugcaaccuccgcuucggguccucc

SEQ ID NO: 882428 - RNA, 19 nt, Human
ucauugcaaccucugccuc

SEQ ID NO: 882429 - RNA, 20 nt, Human
ucauugcaaccucugccucu

SEQ ID NO: 882430 - RNA, 21 nt, Human
ucauugcaaccucugccucug

SEQ ID NO: 882431 - RNA, 22 nt, Human
ucauugcaaccucugccucuga

SEQ ID NO: 882432 - RNA, 23 nt, Human
ucauugcaaccucugccucugag

SEQ ID NO: 882433 - RNA, 24 nt, Human
ucauugcaaccucugccucugagg

SEQ ID NO: 882434 - RNA, 22 nt, Human
uccauaaaauccaagggugacg

SEQ ID NO: 882435 - RNA, 24 nt, Human
ucccaggcuggagugcagcggcau

SEQ ID NO: 882436 - RNA, 21 nt, Human
ucccgcaccgccuccccucca

SEQ ID NO: 882437 - RNA, 24 nt, Human
uccuaaaguguugggauuacaggc

SEQ ID NO: 882438 - RNA, 18 nt, Human
ucucccaggcuggagugc

SEQ ID NO: 882439 - RNA, 21 nt, Human
ucugagguucaggcgauccuc

SEQ ID NO: 882440 - RNA, 21 nt, Human
ucuugaacuccugaccucaag

SEQ ID NO: 882441 - RNA, 18 nt, Human
ugaaaccacaggacagca

SEQ ID NO: 882442 - RNA, 18 nt, Human
ugaccucaagugauccgc

SEQ ID NO: 882443 - RNA, 24 nt, Human
ugaccucaagugauccgcccgccu

SEQ ID NO: 882444 - RNA, 18 nt, Human
ugcaaccuccgcuucauu

SEQ ID NO: 882445 - RNA, 24 nt, Human
uggagugcagcggcaugcucucgg

SEQ ID NO: 882446 - RNA, 24 nt, Human
uggccaagcuggucuugaacuccu

SEQ ID NO: 882447 - RNA, 18 nt, Human
ugggauuacaggcgugag

SEQ ID NO: 882448 - RNA, 19 nt, Human
ugggauuacaggcgugagc

SEQ ID NO: 882449 - RNA, 21 nt, Human
ugggauuacaggcgugagcca

SEQ ID NO: 882450 - RNA, 22 nt, Human
ugggauuacaggcgugagccac

SEQ ID NO: 882451 - RNA, 23 nt, Human
ugggauuacaggcgugagccacc

SEQ ID NO: 882452 - RNA, 24 nt, Human
ugggauuacaggcgugagccaccg

SEQ ID NO: 882453 - RNA, 18 nt, Human
uuagagcucuagauauuc

SEQ ID NO: 882454 - RNA, 20 nt, Human
uuaguagagacggguuuuau

SEQ ID NO: 882455 - RNA, 24 nt, Human
uucaggcgauccucccaccucagc

SEQ ID NO: 882456 - RNA, 22 nt, Human
uucauugcaaccucugccucug

SEQ ID NO: 882457 - RNA, 19 nt, Human
uugcaaccucugccucuga

SEQ ID NO: 882458 - RNA, 23 nt, Human
uugcaaccucugccucugagguu

SEQ ID NO: 882459 - RNA, 24 nt, Human
uugcaaccucugccucugagguuc

SEQ ID NO: 882460 - RNA, 18 nt, Human
uuuuuguauuaguagaga

SEQ ID NO: 882461 - RNA, 18 nt, Human
uuuuuuguauuaguagag

SEQ ID NO: 882462 - RNA, 21 nt, Human
uuuuuuuguauuaguagagac

SEQ ID NO: 882463 - RNA, 19 nt, Human
aagcccaagaagaugacag

SEQ ID NO: 882464 - RNA, 28 nt, Human
acagagaaaauacaaagccguuuccuca

SEQ ID NO: 882465 - RNA, 29 nt, Human
acagggaaaaguacaguuucccuucucca

SEQ ID NO: 882466 - RNA, 22 nt, Human
agagaaaauacaaagccguuuc

SEQ ID NO: 882467 - RNA, 20 nt, Human
caacagcacaccaaauaagc

SEQ ID NO: 882468 - RNA, 19 nt, Human
caccgcccaccuacgcccc

SEQ ID NO: 882469 - RNA, 24 nt, Human
cacgaguacuaaggcgaagacagc

SEQ ID NO: 882470 - RNA, 23 nt, Human
cagaugagccuuuuccgaaguuc

SEQ ID NO: 882471 - RNA, 24 nt, Human
cagcacaccaaauaagcccaagaa

SEQ ID NO: 882472 - RNA, 25 nt, Human
ccagggugacagaugagccuuuucc

SEQ ID NO: 882473 - RNA, 25 nt, Human
ccccgccaacuucacacgaguacua

SEQ ID NO: 882474 - RNA, 23 nt, Human
cccuucaacagcacaccaaauaa

SEQ ID NO: 882475 - RNA, 22 nt, Human
ccgcccaccuacgccccauccg

SEQ ID NO: 882476 - RNA, 22 nt, Human
ccuucaacagcacaccaaauaa

SEQ ID NO: 882477 - RNA, 20 nt, Human
cguccccgccaacuucacac

SEQ ID NO: 882478 - RNA, 21 nt, Human
gaagacagccaucuugggccu

SEQ ID NO: 882479 - RNA, 23 nt, Human
gacaggaaccguccccgccaacu

SEQ ID NO: 882480 - RNA, 20 nt, Human
gcaccgcccaccuacgcccc

SEQ ID NO: 882481 - RNA, 21 nt, Human
uacagagaaaauacaaagccg

SEQ ID NO: 882482 - RNA, 24 nt, Human
ucuccagggugacagaugagccuu

SEQ ID NO: 882483 - RNA, 21 nt, Human
uucucuagucuccccccuuca

SEQ ID NO: 882484 - RNA, 22 nt, Human
uuuuuuuuuuccaaagaagccc

SEQ ID NO: 882485 - RNA, 23 nt, Human
aaccacugaaaguaauuucacaa

SEQ ID NO: 882486 - RNA, 20 nt, Human
caagacaucaaauguaaaaa

SEQ ID NO: 882487 - RNA, 25 nt, Human
caaguaugaucaauaacaagacauc

SEQ ID NO: 882488 - RNA, 19 nt, Human
cccaugcaccuuacggccg

SEQ ID NO: 882489 - RNA, 22 nt, Human
cuuggaaaggcuaugccuuuga

SEQ ID NO: 882490 - RNA, 23 nt, Human
uaaaaaaagguuccguucuagaa

SEQ ID NO: 882491 - RNA, 27 nt, Human
uaacaagacaucaaauguaaaaaaggg

SEQ ID NO: 882492 - RNA, 20 nt, Human
ucuacccaugcaccuuacgg

SEQ ID NO: 882493 - RNA, 21 nt, Human
ugggaagaauuaaaaaaaggu

SEQ ID NO: 882494 - RNA, 24 nt, Human
uuuuuuuuuuuuuuuuuuuuucag

SEQ ID NO: 882495 - RNA, 24 nt, Human
aaaccaagugacaaacacacuccc

SEQ ID NO: 882496 - RNA, 23 nt, Human
aaaggaacuaauacacguacagc

SEQ ID NO: 882497 - RNA, 22 nt, Human
aaauggaauccucugcaucucc

SEQ ID NO: 882498 - RNA, 18 nt, Human
aacugcaugaccuugagc

SEQ ID NO: 882499 - RNA, 18 nt, Human
aaguggcccuauaccuga

SEQ ID NO: 882500 - RNA, 19 nt, Human
aaguggcccuauaccugac

SEQ ID NO: 882501 - RNA, 19 nt, Human
aaguucuuccacauguccc

SEQ ID NO: 882502 - RNA, 24 nt, Human
accugaugaggaagcucuagugua

SEQ ID NO: 882503 - RNA, 21 nt, Human
acguacagcacucagcacaaa

SEQ ID NO: 882504 - RNA, 20 nt, Human
agagcagagggcuugguuca

SEQ ID NO: 882505 - RNA, 21 nt, Human
agcaagaggcagugaccaagg

SEQ ID NO: 882506 - RNA, 18 nt, Human
agugcucccaaacuuuuc

SEQ ID NO: 882507 - RNA, 22 nt, Human
caaacuuuucacagcguacacc

SEQ ID NO: 882508 - RNA, 20 nt, Human
caagugacaaacacacuccc

SEQ ID NO: 882509 - RNA, 20 nt, Human
caccuggaugguggauggga

SEQ ID NO: 882510 - RNA, 22 nt, Human
cagcaggcucucaccaggugcc

SEQ ID NO: 882511 - RNA, 21 nt, Human
caggagcccgugcagcaagag

SEQ ID NO: 882512 - RNA, 19 nt, Human
cauccaagcacaccuggau

SEQ ID NO: 882513 - RNA, 27 nt, Human
caugucccauugaggagagcacagcca

SEQ ID NO: 882514 - RNA, 19 nt, Human
cccaaacuuuucacagcgu

SEQ ID NO: 882515 - RNA, 22 nt, Human
cccaaguugggaaaacuaagga

SEQ ID NO: 882516 - RNA, 23 nt, Human
ccuggcacacagcaggcucucac

SEQ ID NO: 882517 - RNA, 22 nt, Human
ccuugagcaagccacuuaauuu

SEQ ID NO: 882518 - RNA, 22 nt, Human
cgcagggcuggcuaaacaggcu

SEQ ID NO: 882519 - RNA, 19 nt, Human
cguacagcacucagcacaa

SEQ ID NO: 882520 - RNA, 21 nt, Human
cgugcagcaagaggcagugac

SEQ ID NO: 882521 - RNA, 22 nt, Human
cuucucugugaaauggguacaa

SEQ ID NO: 882522 - RNA, 23 nt, Human
gaucucugccuuggaccuggaga

SEQ ID NO: 882523 - RNA, 23 nt, Human
gggcucaggagcccgugcagcaa

SEQ ID NO: 882524 - RNA, 19 nt, Human
gugaccaaggaggcagggg

SEQ ID NO: 882525 - RNA, 21 nt, Human
gugcucccaaacuuuucacag

SEQ ID NO: 882526 - RNA, 19 nt, Human
guucugccacuuacuaacu

SEQ ID NO: 882527 - RNA, 18 nt, Human
uaaagcagugcucccaaa

SEQ ID NO: 882528 - RNA, 19 nt, Human
uaaagcagugcucccaaac

SEQ ID NO: 882529 - RNA, 20 nt, Human
uaacugcaugaccuugagca

SEQ ID NO: 882530 - RNA, 23 nt, Human
uaacugcaugaccuugagcaagc

SEQ ID NO: 882531 - RNA, 23 nt, Human
ucagcacaaagccuggcacacag

SEQ ID NO: 882532 - RNA, 21 nt, Human
ucccaaguugggaaaacuaag

SEQ ID NO: 882533 - RNA, 19 nt, Human
uccccgaccccaaguucuu

SEQ ID NO: 882534 - RNA, 22 nt, Human
ucuccaaguggcccuauaccuu

SEQ ID NO: 882535 - RNA, 22 nt, Human
ucucugcuccuucucuggggcc

SEQ ID NO: 882536 - RNA, 26 nt, Human
ucuuccacaugucccauugaggagag

SEQ ID NO: 882537 - RNA, 22 nt, Human
ugaaauggguacaaugugguca

SEQ ID NO: 882538 - RNA, 19 nt, Human
ugacaaacacacuccccga

SEQ ID NO: 882539 - RNA, 25 nt, Human
ugacaaacacacuccccgaccccaa

SEQ ID NO: 882540 - RNA, 19 nt, Human
uggagaacauccaagcaca

SEQ ID NO: 882541 - RNA, 21 nt, Human
ugggcucaggagcccgugcag

SEQ ID NO: 882542 - RNA, 20 nt, Human
uugguugagcuacuguggca

SEQ ID NO: 882543 - RNA, 19 nt, Human
uuuuuuuuuuaaaggaagu

SEQ ID NO: 882544 - RNA, 23 nt, Human
uuuuuuuuuuuuuaaaggaagua

SEQ ID NO: 882545 - RNA, 22 nt, Human
aggauguuuauucaggccugau

SEQ ID NO: 882546 - RNA, 19 nt, Human
caccucaggggagcagcaa

SEQ ID NO: 882547 - RNA, 24 nt, Human
caugaaaaccaucaucauauuggu

SEQ ID NO: 882548 - RNA, 23 nt, Human
cugggaguugguggggcaaggga

SEQ ID NO: 882549 - RNA, 23 nt, Human
gagcagcaagagcgaagcucugg

SEQ ID NO: 882550 - RNA, 21 nt, Human
ggauguuuauucaggccugau

SEQ ID NO: 882551 - RNA, 21 nt, Human
ugggaguugguggggcaaggg

SEQ ID NO: 882552 - RNA, 25 nt, Human
uguacaaaaauauaucauucaaagu

SEQ ID NO: 882553 - RNA, 21 nt, Human
uucaaagucaugaaaaccauc

SEQ ID NO: 882554 - RNA, 20 nt, Human
aaacugcggaaaaccgacgg

SEQ ID NO: 882555 - RNA, 25 nt, Human
aaggagcauauaaugcaguuauuua

SEQ ID NO: 882556 - RNA, 18 nt, Human
acucagccuuacuggccc

SEQ ID NO: 882557 - RNA, 18 nt, Human
acuugucggcuucucccu

SEQ ID NO: 882558 - RNA, 24 nt, Human
agaaaguuucaaucacuucacugu

SEQ ID NO: 882559 - RNA, 23 nt, Human
agucuucuccacggcagcaauuu

SEQ ID NO: 882560 - RNA, 21 nt, Human
aguuguuuuacuccauccugu

SEQ ID NO: 882561 - RNA, 24 nt, Human
auuacauaaaaaugguucuauaaa

SEQ ID NO: 882562 - RNA, 22 nt, Human
cacccaagcaggacaguuccua

SEQ ID NO: 882563 - RNA, 23 nt, Human
caggacaguuccuagcccgucga

SEQ ID NO: 882564 - RNA, 24 nt, Human
cuagcaggaccguacguccuucuc

SEQ ID NO: 882565 - RNA, 26 nt, Human
cucaucagaagaaaguuucaaucacu

SEQ ID NO: 882566 - RNA, 21 nt, Human
gcggaaaaccgacggaggaca

SEQ ID NO: 882567 - RNA, 23 nt, Human
gcgggaaacgcuaacacccaagc

SEQ ID NO: 882568 - RNA, 22 nt, Human
uagcccgucgagcacuugucgg

SEQ ID NO: 882569 - RNA, 20 nt, Human
uaguagccacgccgggucac

SEQ ID NO: 882570 - RNA, 19 nt, Human
ucacuucacuguuauuuuc

SEQ ID NO: 882571 - RNA, 24 nt, Human
ucaucagaagaaaguuucaaucac

SEQ ID NO: 882572 - RNA, 20 nt, Human
uccauccuguagguuagaga

SEQ ID NO: 882573 - RNA, 22 nt, Human
uccauccuguagguuagagaaa

SEQ ID NO: 882574 - RNA, 23 nt, Human
ucucccucuuccucgaguuuccu

SEQ ID NO: 882575 - RNA, 25 nt, Human
ucuccuaguagccacgccgggucac

SEQ ID NO: 882576 - RNA, 28 nt, Human
ugaaaggagcauauaaugcaguuauuua

SEQ ID NO: 882577 - RNA, 18 nt, Human
uggaaaaacugcggaaaa

SEQ ID NO: 882578 - RNA, 20 nt, Human
uggaaaaacugcggaaaacc

SEQ ID NO: 882579 - RNA, 22 nt, Human
uggaaaaacugcggaaaaccga

SEQ ID NO: 882580 - RNA, 25 nt, Human
uguuauuuucugcaauucuuauucc

SEQ ID NO: 882581 - RNA, 18 nt, Human
uucacuguuauuuucugc

SEQ ID NO: 882582 - RNA, 21 nt, Human
uucacuguuauuuucugcaau

SEQ ID NO: 882583 - RNA, 23 nt, Human
uuccuccagucuucuccacggca

SEQ ID NO: 882584 - RNA, 24 nt, Human
agccauguggcucccaagcucccu

SEQ ID NO: 882585 - RNA, 21 nt, Human
agcgccgccuucgccccacgc

SEQ ID NO: 882586 - RNA, 19 nt, Human
aucccgccgcgggccccac

SEQ ID NO: 882587 - RNA, 18 nt, Human
ccauucacgaguccugca

SEQ ID NO: 882588 - RNA, 27 nt, Human
cccaccagccaagcgccgccuucgccc

SEQ ID NO: 882589 - RNA, 20 nt, Human
ccgcccgggaaaaucccgcc

SEQ ID NO: 882590 - RNA, 20 nt, Human
ccugcaaccagaggccuggg

SEQ ID NO: 882591 - RNA, 19 nt, Human
cgccgcgggccccaccagc

SEQ ID NO: 882592 - RNA, 21 nt, Human
cgccuucgccccacgcggccu

SEQ ID NO: 882593 - RNA, 19 nt, Human
gcaaccagaggccugggcu

SEQ ID NO: 882594 - RNA, 23 nt, Human
uaaaugaauacauuuauucucuc

SEQ ID NO: 882595 - RNA, 18 nt, Human
uacauuuauucucucaca

SEQ ID NO: 882596 - RNA, 19 nt, Human
uagcaaaagggugguucuc

SEQ ID NO: 882597 - RNA, 21 nt, Human
ucagaacugcuccauucacga

SEQ ID NO: 882598 - RNA, 19 nt, Human
ucccuuagcaaaagggugg

SEQ ID NO: 882599 - RNA, 20 nt, Human
uggcucccaagcucccuuag

SEQ ID NO: 882600 - RNA, 23 nt, Human
uuuuuuuuuuuuuuuuuuaaaug

SEQ ID NO: 882601 - RNA, 20 nt, Human
acuuucaagggcgcccugag

SEQ ID NO: 882602 - RNA, 19 nt, Human
aguacacugaaaaguaaca

SEQ ID NO: 882603 - RNA, 23 nt, Human
aguacucuuuaacaacucugcuu

SEQ ID NO: 882604 - RNA, 21 nt, Human
augaaaaugagacauaugagu

SEQ ID NO: 882605 - RNA, 19 nt, Human
caucuggaaaauuauacau

SEQ ID NO: 882606 - RNA, 22 nt, Human
ccaguacucuuuaacaacucug

SEQ ID NO: 882607 - RNA, 24 nt, Human
gcccugagcugcucggaggcccca

SEQ ID NO: 882608 - RNA, 24 nt, Human
uacacugaaaaguaacaucaccau

SEQ ID NO: 882609 - RNA, 19 nt, Human
ucaagggcgcccugagcug

SEQ ID NO: 882610 - RNA, 21 nt, Human
uccaguacucuuuaacaacuc

SEQ ID NO: 882611 - RNA, 23 nt, Human
ucuuuaacaacucugcuuccuug

SEQ ID NO: 882612 - RNA, 19 nt, Human
aagagcuacccaaagacuu

SEQ ID NO: 882613 - RNA, 24 nt, Human
aagagcuacccaaagacuucagug

SEQ ID NO: 882614 - RNA, 19 nt, Human
aagcagcggcgcuccacua

SEQ ID NO: 882615 - RNA, 25 nt, Human
caacaaauaacauuguuuuucagaa

SEQ ID NO: 882616 - RNA, 22 nt, Human
ccagcgacuccggcugucuccu

SEQ ID NO: 882617 - RNA, 18 nt, Human
ccccagcgacuccggcug

SEQ ID NO: 882618 - RNA, 26 nt, Human
cccccagcgacuccggcugucuccug

SEQ ID NO: 882619 - RNA, 18 nt, Human
gcagaauccuucuuucag

SEQ ID NO: 882620 - RNA, 19 nt, Human
ggagcucccccagcgacuc

SEQ ID NO: 882621 - RNA, 23 nt, Human
uauggcuuaagagcuacccaaag

SEQ ID NO: 882622 - RNA, 21 nt, Human
ucccccagcgacuccggcugu

SEQ ID NO: 882623 - RNA, 20 nt, Human
ugcacccagguaagcagcgg

SEQ ID NO: 882624 - RNA, 21 nt, Human
uuaaaucaacaaauaacauug

SEQ ID NO: 882625 - RNA, 27 nt, Human
uuuuuuuuuuuuuuuuuuuuccugggg

SEQ ID NO: 882626 - RNA, 26 nt, Human
aaaaacagaaaggggaggaggaugac

SEQ ID NO: 882627 - RNA, 18 nt, Human
aaacagaaaggggaggag

SEQ ID NO: 882628 - RNA, 19 nt, Human
aagcccaagagaggggcag

SEQ ID NO: 882629 - RNA, 23 nt, Human
aagccuuuggcugcuguagaucc

SEQ ID NO: 882630 - RNA, 21 nt, Human
auugcuguaaaacuuccaagc

SEQ ID NO: 882631 - RNA, 19 nt, Human
caagccuuuggcugcugua

SEQ ID NO: 882632 - RNA, 19 nt, Human
cagccauauaaagucaggg

SEQ ID NO: 882633 - RNA, 20 nt, Human
ccucgccucuuuuuccucac

SEQ ID NO: 882634 - RNA, 24 nt, Human
cgccaggagcagccauauaaaguc

SEQ ID NO: 882635 - RNA, 24 nt, Human
cuuccaagcuggcuguucuuccag

SEQ ID NO: 882636 - RNA, 25 nt, Human
guaguucuugauuuaaaaaaacaga

SEQ ID NO: 882637 - RNA, 22 nt, Human
uaaaaaaacagaaaggggagga

SEQ ID NO: 882638 - RNA, 22 nt, Human
uaauuuauaaacaacuucugac

SEQ ID NO: 882639 - RNA, 19 nt, Human
ugauuuaaaaaaacagaaa

SEQ ID NO: 882640 - RNA, 22 nt, Human
ugcuguaaaacuuccaagcugg

SEQ ID NO: 882641 - RNA, 20 nt, Human
uuaaaaaaacagaaagggga

SEQ ID NO: 882642 - RNA, 24 nt, Human
uuaaaaaaacagaaaggggaggag

SEQ ID NO: 882643 - RNA, 26 nt, Human
uugauggcuguaguggcugacagauu

SEQ ID NO: 882644 - RNA, 20 nt, Human
uuuaaaaaaacagaaagggg

SEQ ID NO: 882645 - RNA, 21 nt, Human
uuuuuuuuuuuuuaagaguuc

SEQ ID NO: 882646 - RNA, 19 nt, Human
uuuuuuuuuuuuuuuuuaa

SEQ ID NO: 882647 - RNA, 23 nt, Human
aaaauauauccucuuagagccaa

SEQ ID NO: 882648 - RNA, 19 nt, Human
accugauaguggguacaug

SEQ ID NO: 882649 - RNA, 26 nt, Human
acuucuauuguagcuuugccuccaau

SEQ ID NO: 882650 - RNA, 20 nt, Human
agcccagugccccgcugcaa

SEQ ID NO: 882651 - RNA, 24 nt, Human
aucccaccuauucccuuugcucag

SEQ ID NO: 882652 - RNA, 18 nt, Human
ccaugccagcuagcucac

SEQ ID NO: 882653 - RNA, 19 nt, Human
ccuccaauaagcaaaugga

SEQ ID NO: 882654 - RNA, 23 nt, Human
gcugcaaugcaggccgccaugcc

SEQ ID NO: 882655 - RNA, 25 nt, Human
ucaaaauauauccucuuagagccaa

SEQ ID NO: 882656 - RNA, 22 nt, Human
ucuuagagccaauguaucuucu

SEQ ID NO: 882657 - RNA, 28 nt, Human
ugaauuguuucacaauuaaaaaaaaaau

SEQ ID NO: 882658 - RNA, 23 nt, Human
ugcucugacuucuauuguagcuu

SEQ ID NO: 882659 - RNA, 23 nt, Human
uuaauaaaacaaugaaugcuuag

SEQ ID NO: 882660 - RNA, 22 nt, Human
uucacaauuaaaaaaaaaauuc

SEQ ID NO: 882661 - RNA, 25 nt, Human
uugguccauuuggcaugucgcacgg

SEQ ID NO: 882662 - RNA, 22 nt, Human
uuuggcauguguaauucucuuu

SEQ ID NO: 882663 - RNA, 24 nt, Human
cagcacgacacccuuacuuuuagc

SEQ ID NO: 882664 - RNA, 23 nt, Human
uacagauuaaaacgggggggggg

SEQ ID NO: 882665 - RNA, 22 nt, Human
uuuuuuuuuuuuuuuuuuacag

SEQ ID NO: 882666 - RNA, 23 nt, Human
aaaaaaccgggguacguuagaug

SEQ ID NO: 882667 - RNA, 18 nt, Human
aaaaauagcuugguggcg

SEQ ID NO: 882668 - RNA, 23 nt, Human
aaaacagcaaaaacccagcuggg

SEQ ID NO: 882669 - RNA, 24 nt, Human
aaaauuaaaaacagcaaaaaccca

SEQ ID NO: 882670 - RNA, 27 nt, Human
aaacaaaaguauaaaucaaacaaacug

SEQ ID NO: 882671 - RNA, 20 nt, Human
aaacaaacugcaaauuacuu

SEQ ID NO: 882672 - RNA, 18 nt, Human
aaacagcaaaaacccagc

SEQ ID NO: 882673 - RNA, 20 nt, Human
aacauggcggaacccggucu

SEQ ID NO: 882674 - RNA, 18 nt, Human
aagggaagggaagccacc

SEQ ID NO: 882675 - RNA, 18 nt, Human
aaucgcuugaacccggga

SEQ ID NO: 882676 - RNA, 20 nt, Human
acagcgcgagacuccgucuc

SEQ ID NO: 882677 - RNA, 24 nt, Human
acagcgcgagacuccgucucgggg

SEQ ID NO: 882678 - RNA, 24 nt, Human
acccggucucuacuaaaaauacaa

SEQ ID NO: 882679 - RNA, 24 nt, Human
agacuggggcgggaaaaucgcuug

SEQ ID NO: 882680 - RNA, 22 nt, Human
agaucgcgccauugcacuccag

SEQ ID NO: 882681 - RNA, 18 nt, Human
agcagcagcgacuagggc

SEQ ID NO: 882682 - RNA, 24 nt, Human
agccugggugacagcgcgagacuc

SEQ ID NO: 882683 - RNA, 23 nt, Human
agcuugguggcgcacaccugcag

SEQ ID NO: 882684 - RNA, 20 nt, Human
aggcagccaaagauuugaaa

SEQ ID NO: 882685 - RNA, 21 nt, Human
aggcaggcagaucauuucaga

SEQ ID NO: 882686 - RNA, 24 nt, Human
aucgcgccauugcacuccagccug

SEQ ID NO: 882687 - RNA, 21 nt, Human
auugcacuccagccuggguga

SEQ ID NO: 882688 - RNA, 24 nt, Human
auugcacuccagccugggugacag

SEQ ID NO: 882689 - RNA, 22 nt, Human
caaaauuaaaaacagcaaaaac

SEQ ID NO: 882690 - RNA, 24 nt, Human
caaaauuaaaaacagcaaaaaccc

SEQ ID NO: 882691 - RNA, 19 nt, Human
caacaguccucagugguac

SEQ ID NO: 882692 - RNA, 23 nt, Human
caacauggcggaacccggucucu

SEQ ID NO: 882693 - RNA, 19 nt, Human
cacaguuacucgggagacu

SEQ ID NO: 882694 - RNA, 23 nt, Human
caccacggcagcagauaguagcc

SEQ ID NO: 882695 - RNA, 23 nt, Human
caccggagggaugagagcagcag

SEQ ID NO: 882696 - RNA, 24 nt, Human
cacgccuguaaucccagcacuuug

SEQ ID NO: 882697 - RNA, 20 nt, Human
cacuccagccugggugacag

SEQ ID NO: 882698 - RNA, 20 nt, Human
cacuccagccugggugacag

SEQ ID NO: 882699 - RNA, 20 nt, Human
cacuccagccugggugacag

SEQ ID NO: 882700 - RNA, 24 nt, Human
cacucuggaaaaaaugccuucagg

SEQ ID NO: 882701 - RNA, 19 nt, Human
cacuuugggagggcaaggc

SEQ ID NO: 882702 - RNA, 25 nt, Human
cagagagacagggccaucccucaug

SEQ ID NO: 882703 - RNA, 18 nt, Human
cagagcugaaauaagaaa

SEQ ID NO: 882704 - RNA, 21 nt, Human
cagcacuuugggagggcaagg

SEQ ID NO: 882705 - RNA, 24 nt, Human
cagcacuuugggagggcaaggcag

SEQ ID NO: 882706 - RNA, 19 nt, Human
cauugcacuccagccuggg

SEQ ID NO: 882707 - RNA, 21 nt, Human
cauugcacuccagccugggug

SEQ ID NO: 882708 - RNA, 22 nt, Human
cauugcacuccagccuggguga

SEQ ID NO: 882709 - RNA, 24 nt, Human
cauugcacuccagccugggugaca

SEQ ID NO: 882710 - RNA, 25 nt, Human
cauugcacuccagccugggugacag

SEQ ID NO: 882711 - RNA, 21 nt, Human
ccaaagggaagggaagccacc

SEQ ID NO: 882712 - RNA, 20 nt, Human
ccauugcacuccagccuggg

SEQ ID NO: 882713 - RNA, 21 nt, Human
ccauugcacuccagccugggu

SEQ ID NO: 882714 - RNA, 21 nt, Human
ccauugcacuccagccugggu

SEQ ID NO: 882715 - RNA, 22 nt, Human
ccauugcacuccagccugggug

SEQ ID NO: 882716 - RNA, 24 nt, Human
ccauugcacuccagccugggugac

SEQ ID NO: 882717 - RNA, 26 nt, Human
cccagagagacagggccaucccucau

SEQ ID NO: 882718 - RNA, 24 nt, Human
ccccaaggcagcagcaaauccuuu

SEQ ID NO: 882719 - RNA, 21 nt, Human
ccugcaggcccgcgucccgaa

SEQ ID NO: 882720 - RNA, 22 nt, Human
ccugggugacagcgcgagacuc

SEQ ID NO: 882721 - RNA, 26 nt, Human
cgccauugcacuccagccugggugac

SEQ ID NO: 882722 - RNA, 23 nt, Human
cgccuguaaucccagcacuuugg

SEQ ID NO: 882723 - RNA, 24 nt, Human
cgccuguaaucccagcacuuuggg

SEQ ID NO: 882724 - RNA, 21 nt, Human
cgggaguggugaggcgcagua

SEQ ID NO: 882725 - RNA, 21 nt, Human
cgucucgggguaagaaaaaaa

SEQ ID NO: 882726 - RNA, 26 nt, Human
cuaaaaguaaauagcaaaaucaguga

SEQ ID NO: 882727 - RNA, 19 nt, Human
cuaaauucccaaugagcgc

SEQ ID NO: 882728 - RNA, 22 nt, Human
cucacgccuguaaucccagcac

SEQ ID NO: 882729 - RNA, 24 nt, Human
cucacgccuguaaucccagcacuu

SEQ ID NO: 882730 - RNA, 19 nt, Human
cugaaauaagaaaacauga

SEQ ID NO: 882731 - RNA, 19 nt, Human
gaacccgggagacgagguu

SEQ ID NO: 882732 - RNA, 20 nt, Human
gaacccgggagacgagguug

SEQ ID NO: 882733 - RNA, 24 nt, Human
gacagcgcgagacuccgucucggg

SEQ ID NO: 882734 - RNA, 20 nt, Human
gagcagcagcgacuagggcg

SEQ ID NO: 882735 - RNA, 20 nt, Human
gagggcaaggcaggcagauc

SEQ ID NO: 882736 - RNA, 24 nt, Human
gaucauuucagaucuggaguucga

SEQ ID NO: 882737 - RNA, 24 nt, Human
gcagcgacuagggcgguggcuggc

SEQ ID NO: 882738 - RNA, 19 nt, Human
gccauugcacuccagccug

SEQ ID NO: 882739 - RNA, 24 nt, Human
gccauugcacuccagccuggguga

SEQ ID NO: 882740 - RNA, 19 nt, Human
gcgccagccucccagaaau

SEQ ID NO: 882741 - RNA, 22 nt, Human
gcuggauacuucaguccauguu

SEQ ID NO: 882742 - RNA, 21 nt, Human
ggagggcaaggcaggcagauc

SEQ ID NO: 882743 - RNA, 22 nt, Human
ggaggguuggcaaggggcuggg

SEQ ID NO: 882744 - RNA, 23 nt, Human
ggcgggaaaaucgcuugaacccg

SEQ ID NO: 882745 - RNA, 21 nt, Human
gggcaaggcaggcagaucauu

SEQ ID NO: 882746 - RNA, 24 nt, Human
gggcacggugucucacgccuguaa

SEQ ID NO: 882747 - RNA, 18 nt, Human
gggcgguggcuggcgacg

SEQ ID NO: 882748 - RNA, 19 nt, Human
ggggcuggguugacuucag

SEQ ID NO: 882749 - RNA, 24 nt, Human
ggugucucacgccuguaaucccag

SEQ ID NO: 882750 - RNA, 21 nt, Human
guaauucgauuaauccagagc

SEQ ID NO: 882751 - RNA, 18 nt, Human
guggaggcgccagccucc

SEQ ID NO: 882752 - RNA, 21 nt, Human
uaaaaacagcaaaaacccagc

SEQ ID NO: 882753 - RNA, 20 nt, Human
uaagaaaaaaaaaccggggu

SEQ ID NO: 882754 - RNA, 22 nt, Human
uaagaaaaaaaaaccgggguac

SEQ ID NO: 882755 - RNA, 23 nt, Human
uaagaaaacaugaagauacuuaa

SEQ ID NO: 882756 - RNA, 18 nt, Human
uaagcgaaaucaagaccc

SEQ ID NO: 882757 - RNA, 18 nt, Human
uagcaaaaucagugagcu

SEQ ID NO: 882758 - RNA, 18 nt, Human
uagcaaaaucagugagcu

SEQ ID NO: 882759 - RNA, 19 nt, Human
uccagagcugaaauaagaa

SEQ ID NO: 882760 - RNA, 23 nt, Human
uccagccugggugacagcgcgag

SEQ ID NO: 882761 - RNA, 24 nt, Human
uccagccugggugacagcgcgaga

SEQ ID NO: 882762 - RNA, 23 nt, Human
ucgcgccauugcacuccagccug

SEQ ID NO: 882763 - RNA, 23 nt, Human
ucgcuugaacccgggagacgagg

SEQ ID NO: 882764 - RNA, 22 nt, Human
ucucuacuaaaaauacaaaaaa

SEQ ID NO: 882765 - RNA, 23 nt, Human
ugaaauaagaaaacaugaagaua

SEQ ID NO: 882766 - RNA, 22 nt, Human
ugacuucuggauguuauguccc

SEQ ID NO: 882767 - RNA, 21 nt, Human
ugagagcagcagcgacuaggg

SEQ ID NO: 882768 - RNA, 22 nt, Human
ugagagcagcagcgacuagggc

SEQ ID NO: 882769 - RNA, 19 nt, Human
ugcgggggguuccgggugg

SEQ ID NO: 882770 - RNA, 20 nt, Human
uggaggguuggcaaggggcu

SEQ ID NO: 882771 - RNA, 24 nt, Human
ugggagggcaaggcaggcagauca

SEQ ID NO: 882772 - RNA, 22 nt, Human
uggugaggcgcaguaaugaggc

SEQ ID NO: 882773 - RNA, 21 nt, Human
ugucucacgccuguaauccca

SEQ ID NO: 882774 - RNA, 22 nt, Human
ugucucacgccuguaaucccag

SEQ ID NO: 882775 - RNA, 24 nt, Human
ugucucacgccuguaaucccagca

SEQ ID NO: 882776 - RNA, 24 nt, Human
uucaaaauuaaaaacagcaaaaac

SEQ ID NO: 882777 - RNA, 26 nt, Human
uucaaaauuaaaaacagcaaaaaccc

SEQ ID NO: 882778 - RNA, 18 nt, Human
uguggagucugaaucucc

SEQ ID NO: 882779 - RNA, 21 nt, Human
uguggagucugaaucuccuca

SEQ ID NO: 882780 - RNA, 23 nt, Human
uuuuuugccuucaauuuuuguuu

SEQ ID NO: 882781 - RNA, 22 nt, Human
uuuuuuuuugccuucaauuuuu

SEQ ID NO: 882782 - RNA, 19 nt, Human
uuuuuuuuuuuuuuuugcc

SEQ ID NO: 882783 - RNA, 22 nt, Human
uuuuuuuuuuuuuuuuugccuu

SEQ ID NO: 882784 - RNA, 23 nt, Human
uuuuuuuuuuuuuuuuuugccuu

SEQ ID NO: 882785 - RNA, 20 nt, Human
uuuuuuuuuuuuuuuuuugg

SEQ ID NO: 882786 - RNA, 22 nt, Human
aaaaagaagugccucagccuuc

SEQ ID NO: 882787 - RNA, 23 nt, Human
aaaaagaagugccucagccuuca

SEQ ID NO: 882788 - RNA, 19 nt, Human
aaaccuuccuugucagcuc

SEQ ID NO: 882789 - RNA, 24 nt, Human
agcacaugggcccucagcgucccc

SEQ ID NO: 882790 - RNA, 23 nt, Human
auuuucagcacaugggcccucag

SEQ ID NO: 882791 - RNA, 19 nt, Human
caaaacgcucgaaaccuuc

SEQ ID NO: 882792 - RNA, 21 nt, Human
cagcaaaacgcucgaaaccuu

SEQ ID NO: 882793 - RNA, 21 nt, Human
caucugaaaaagaagugccuc

SEQ ID NO: 882794 - RNA, 19 nt, Human
cccucagcguccccucccc

SEQ ID NO: 882795 - RNA, 22 nt, Human
cccucagcguccccucccccgc

SEQ ID NO: 882796 - RNA, 19 nt, Human
ccuuccuugucagcucucc

SEQ ID NO: 882797 - RNA, 21 nt, Human
cucagccuucaaggcugggac

SEQ ID NO: 882798 - RNA, 31 nt, Human
cucgaaaccuuccuugucagcucuccacuuu

SEQ ID NO: 882799 - RNA, 24 nt, Human
cugggacagaaguuggggaggagc

SEQ ID NO: 882800 - RNA, 23 nt, Human
gcacuucggauuuucagcacaug

SEQ ID NO: 882801 - RNA, 20 nt, Human
gcugggacagaaguugggga

SEQ ID NO: 882802 - RNA, 19 nt, Human
ggacagaaguuggggagga

SEQ ID NO: 882803 - RNA, 19 nt, Human
ggauuuucagcacaugggc

SEQ ID NO: 882804 - RNA, 21 nt, Human
uaagaaaucccuuugccagca

SEQ ID NO: 882805 - RNA, 19 nt, Human
ugccucagccuucaaggcu

SEQ ID NO: 882806 - RNA, 21 nt, Human
ugccucagccuucaaggcugg

SEQ ID NO: 882807 - RNA, 19 nt, Human
ugggacagaaguuggggag

SEQ ID NO: 882808 - RNA, 23 nt, Human
uggggaggagcugcucugcccca

SEQ ID NO: 882809 - RNA, 19 nt, Human
uucggauuuucagcacaug

SEQ ID NO: 882810 - RNA, 21 nt, Human
aaaaagaaucgaguccacaaa

SEQ ID NO: 882811 - RNA, 23 nt, Human
aaagauugacaaaacuuuaauaa

SEQ ID NO: 882812 - RNA, 22 nt, Human
aacaccaauuucagcaaaucca

SEQ ID NO: 882813 - RNA, 21 nt, Human
acccaaauagguugcacuaua

SEQ ID NO: 882814 - RNA, 18 nt, Human
acgccaccgccacgugga

SEQ ID NO: 882815 - RNA, 18 nt, Human
acuuucuccauuuuagca

SEQ ID NO: 882816 - RNA, 18 nt, Human
auugucuuuccuuugucc

SEQ ID NO: 882817 - RNA, 24 nt, Human
ccacgccaccgccacguggacgca

SEQ ID NO: 882818 - RNA, 22 nt, Human
ccccacgccaccgccacgugga

SEQ ID NO: 882819 - RNA, 19 nt, Human
ccgggcgcccugccgcucu

SEQ ID NO: 882820 - RNA, 21 nt, Human
ccgggcgcccugccgcucugc

SEQ ID NO: 882821 - RNA, 20 nt, Human
cgacuuccgggcgcccugcc

SEQ ID NO: 882822 - RNA, 23 nt, Human
cuauaguccccauaugguuuucu

SEQ ID NO: 882823 - RNA, 21 nt, Human
cucacgacuuccgggcgcccu

SEQ ID NO: 882824 - RNA, 19 nt, Human
cuggcucaucgaagcucac

SEQ ID NO: 882825 - RNA, 23 nt, Human
cuugacaaagaugacauguguga

SEQ ID NO: 882826 - RNA, 18 nt, Human
gagaguaugauuucuggu

SEQ ID NO: 882827 - RNA, 23 nt, Human
gcccaacaccaauuucagcaaau

SEQ ID NO: 882828 - RNA, 21 nt, Human
guugugacuaagaaaggagag

SEQ ID NO: 882829 - RNA, 19 nt, Human
uaagguucugccacgucca

SEQ ID NO: 882830 - RNA, 18 nt, Human
uagcccgggaagacucga

SEQ ID NO: 882831 - RNA, 24 nt, Human
uaguaaaaaagaaucgaguccaca

SEQ ID NO: 882832 - RNA, 20 nt, Human
ucagcaaauccaaucuacuu

SEQ ID NO: 882833 - RNA, 18 nt, Human
uggacgcaguagccgugg

SEQ ID NO: 882834 - RNA, 20 nt, Human
uucacaaagauugacaaaaa

SEQ ID NO: 882835 - RNA, 24 nt, Human
uuuacccaaauagguugcacuaua

SEQ ID NO: 882836 - RNA, 23 nt, Human
uuuauugucuuuccuuuguccgg

SEQ ID NO: 882837 - RNA, 25 nt, Human
uuuuuuuuuuuuuuuuuuaaacagg

SEQ ID NO: 882838 - RNA, 23 nt, Human
aaaaaagaaaaaugcauuuagaa

SEQ ID NO: 882839 - RNA, 20 nt, Human
agaggaagaacuaccaagug

SEQ ID NO: 882840 - RNA, 23 nt, Human
aggcggcacccgcuaaaccuuca

SEQ ID NO: 882841 - RNA, 20 nt, Human
caagugcuacacucaaagcc

SEQ ID NO: 882842 - RNA, 24 nt, Human
cagaacauuaacgaaaaaagaaaa

SEQ ID NO: 882843 - RNA, 18 nt, Human
cagugagcgcgaccucca

SEQ ID NO: 882844 - RNA, 18 nt, Human
ccuccgaagggaagcaga

SEQ ID NO: 882845 - RNA, 22 nt, Human
gaacuaccaagugcuacacuca

SEQ ID NO: 882846 - RNA, 21 nt, Human
gggaagcagagcagaggaaga

SEQ ID NO: 882847 - RNA, 26 nt, Human
uuuuuuuuuuuuuuuuuuuaguuuuu

SEQ ID NO: 882848 - RNA, 19 nt, Human
aaacaagcacaacaacgua

SEQ ID NO: 882849 - RNA, 20 nt, Human
aaacaagcacaacaacguaa

SEQ ID NO: 882850 - RNA, 21 nt, Human
aagaaucuuccucuauuucag

SEQ ID NO: 882851 - RNA, 24 nt, Human
aagcacaacaacguaaagaaucuu

SEQ ID NO: 882852 - RNA, 19 nt, Human
acugaugauuuaaaaacaa

SEQ ID NO: 882853 - RNA, 26 nt, Human
auaaacaaaauuuucggaguuuacuc

SEQ ID NO: 882854 - RNA, 20 nt, Human
auaauauauucuucaaauua

SEQ ID NO: 882855 - RNA, 21 nt, Human
auuaucccacacaaaacugcu

SEQ ID NO: 882856 - RNA, 25 nt, Human
auuuuuguucuggaaauuuuauguu

SEQ ID NO: 882857 - RNA, 21 nt, Human
ccggucccgcccugcuuucag

SEQ ID NO: 882858 - RNA, 23 nt, Human
uccauugagccuuuggauaaaca

SEQ ID NO: 882859 - RNA, 21 nt, Human
ugagccuuuggauaaacaaaa

SEQ ID NO: 882860 - RNA, 21 nt, Human
ugaugauuuaaaaacaagcac

SEQ ID NO: 882861 - RNA, 22 nt, Human
uucaaauuaucccacacaaaac

SEQ ID NO: 882862 - RNA, 19 nt, Human
uuuuuguucuggaaauuuu

SEQ ID NO: 882863 - RNA, 19 nt, Human
aaaaggcccccaaccaaca

SEQ ID NO: 882864 - RNA, 21 nt, Human
aaggcccccaaccaacaacaa

SEQ ID NO: 882865 - RNA, 23 nt, Human
aaggcccccaaccaacaacaacu

SEQ ID NO: 882866 - RNA, 22 nt, Human
agaaagauaaauaaaugugaug

SEQ ID NO: 882867 - RNA, 23 nt, Human
caaaaggcccccaaccaacaaca

SEQ ID NO: 882868 - RNA, 20 nt, Human
caaaucacaggaggcaguga

SEQ ID NO: 882869 - RNA, 18 nt, Human
caccggccaaaaggcccc

SEQ ID NO: 882870 - RNA, 26 nt, Human
caccggccaaaaggcccccaaccaac

SEQ ID NO: 882871 - RNA, 23 nt, Human
cagaaagauaaauaaaugugaug

SEQ ID NO: 882872 - RNA, 22 nt, Human
caugccauuuccucuucuuuua

SEQ ID NO: 882873 - RNA, 22 nt, Human
ccccgcccucagucuucucuuu

SEQ ID NO: 882874 - RNA, 18 nt, Human
cggccaaaaggcccccaa

SEQ ID NO: 882875 - RNA, 20 nt, Human
cugcauuguuuuccuucaca

SEQ ID NO: 882876 - RNA, 20 nt, Human
gcagugauuccaugccauuu

SEQ ID NO: 882877 - RNA, 23 nt, Human
gucaccggccaaaaggcccccaa

SEQ ID NO: 882878 - RNA, 22 nt, Human
uauaaaaauacccagaaagaua

SEQ ID NO: 882879 - RNA, 19 nt, Human
uaucuguccuaauaugaag

SEQ ID NO: 882880 - RNA, 22 nt, Human
uauuacacgcuacaggauuucu

SEQ ID NO: 882881 - RNA, 18 nt, Human
ucaccggccaaaaggccc

SEQ ID NO: 882882 - RNA, 21 nt, Human
uccuucacaauggccuucaaa

SEQ ID NO: 882883 - RNA, 26 nt, Human
ucuuucacugcauuguuuuccuucac

SEQ ID NO: 882884 - RNA, 22 nt, Human
ugaccacaccugggcagucucc

SEQ ID NO: 882885 - RNA, 20 nt, Human
uucacaauggccuucaaauc

SEQ ID NO: 882886 - RNA, 22 nt, Human
uuuuuuuuuuuuucgauuuuaa

SEQ ID NO: 882887 - RNA, 18 nt, Human
uuuuuuuuuuuuuuuucg

SEQ ID NO: 882888 - RNA, 24 nt, Human
uuuuuuuuuuuuuuuuucgauuuu

SEQ ID NO: 882889 - RNA, 19 nt, Human
aaaagaacucaggaugggg

SEQ ID NO: 882890 - RNA, 21 nt, Human
aagguccgaggcgagggcgau

SEQ ID NO: 882891 - RNA, 20 nt, Human
agguccgaggcguuccugcu

SEQ ID NO: 882892 - RNA, 30 nt, Human
caagcucccauccagacuucaaccccacaa

SEQ ID NO: 882893 - RNA, 21 nt, Human
caguaccggcugcgggcgauu

SEQ ID NO: 882894 - RNA, 19 nt, Human
ccagacuucaaccccacaa

SEQ ID NO: 882895 - RNA, 23 nt, Human
cccugcaaaaauagcgccaggca

SEQ ID NO: 882896 - RNA, 21 nt, Human
cuuggcaagcucccauccaga

SEQ ID NO: 882897 - RNA, 21 nt, Human
ggcgauuccggagcccagagc

SEQ ID NO: 882898 - RNA, 23 nt, Human
gguuguagguagucgguagucag

SEQ ID NO: 882899 - RNA, 19 nt, Human
uacagaagaaauaauccga

SEQ ID NO: 882900 - RNA, 22 nt, Human
uacauucugaaauauuuacaga

SEQ ID NO: 882901 - RNA, 21 nt, Human
uauggagagcacucagguccg

SEQ ID NO: 882902 - RNA, 20 nt, Human
ucuuuuggaugugauaagcu

SEQ ID NO: 882903 - RNA, 19 nt, Human
ugaaauauuuacagaagaa

SEQ ID NO: 882904 - RNA, 25 nt, Human
ugagaucagcuucaaaagaacuccu

SEQ ID NO: 882905 - RNA, 22 nt, Human
ugagggucccgccgacugcguc

SEQ ID NO: 882906 - RNA, 25 nt, Human
uggcaagcucccauccagacuucaa

SEQ ID NO: 882907 - RNA, 25 nt, Human
uggggcagggacggguuguagguag

SEQ ID NO: 882908 - RNA, 18 nt, Human
uuccugcuccccagcucc

SEQ ID NO: 882909 - RNA, 21 nt, Human
uuggcaagcucccauccagac

SEQ ID NO: 882910 - RNA, 19 nt, Human
uuucaaaauuauugauaau

SEQ ID NO: 882911 - RNA, 25 nt, Human
uuuguacuguucuuuggucuguugg

SEQ ID NO: 882912 - RNA, 23 nt, Human
uuuuuuuuuugcaaguggaacuu

SEQ ID NO: 882913 - RNA, 21 nt, Human
uuuuuuuuuuuuuugcaagug

SEQ ID NO: 882914 - RNA, 21 nt, Human
uuuuuuuuuuuuuuuuugcaa

SEQ ID NO: 882915 - RNA, 23 nt, Human
uuuuuuuuuuuuuuuuugcaagu

SEQ ID NO: 882916 - RNA, 20 nt, Human
uuuuuuuuuuuuuuuuuugg

SEQ ID NO: 882917 - RNA, 18 nt, Human
aaaaagaagcaagucaca

SEQ ID NO: 882918 - RNA, 21 nt, Human
aacagagcaaaacuccugucu

SEQ ID NO: 882919 - RNA, 27 nt, Human
aacauccaccuuccccugcugaggagc

SEQ ID NO: 882920 - RNA, 18 nt, Human
aaccaaaucuggcaaagu

SEQ ID NO: 882921 - RNA, 25 nt, Human
aacuaaaagagcauaacugaaacaa

SEQ ID NO: 882922 - RNA, 24 nt, Human
aagcugaggcaggaggaccacuug

SEQ ID NO: 882923 - RNA, 23 nt, Human
aauaacugagaaacaagugaaac

SEQ ID NO: 882924 - RNA, 22 nt, Human
acaaaggaacagaaacuguaag

SEQ ID NO: 882925 - RNA, 20 nt, Human
acaaguguuaugaacacaau

SEQ ID NO: 882926 - RNA, 23 nt, Human
acaugaaaucugaaguggauaaa

SEQ ID NO: 882927 - RNA, 24 nt, Human
accacccaauuucuacucuuccug

SEQ ID NO: 882928 - RNA, 22 nt, Human
accacugcacuccagccugggc

SEQ ID NO: 882929 - RNA, 19 nt, Human
accauucuaaauuucuguu

SEQ ID NO: 882930 - RNA, 22 nt, Human
accuccaagugaaacugcucac

SEQ ID NO: 882931 - RNA, 18 nt, Human
accuuccccugcugagga

SEQ ID NO: 882932 - RNA, 18 nt, Human
acuaaaagagcauaacug

SEQ ID NO: 882933 - RNA, 24 nt, Human
acugcacuccagccugggcaacag

SEQ ID NO: 882934 - RNA, 24 nt, Human
acugcacuccagccugggcaacag

SEQ ID NO: 882935 - RNA, 22 nt, Human
agccugggcaacagagcaaaac

SEQ ID NO: 882936 - RNA, 24 nt, Human
agccugggcaacagagcaaaacuc

SEQ ID NO: 882937 - RNA, 18 nt, Human
aggagcugaaggucauca

SEQ ID NO: 882938 - RNA, 18 nt, Human
aggcaggaggaccacuug

SEQ ID NO: 882939 - RNA, 24 nt, Human
aggcaggaggaccacuugagccca

SEQ ID NO: 882940 - RNA, 22 nt, Human
augauaagcccuccuacccaca

SEQ ID NO: 882941 - RNA, 19 nt, Human
augcaccauucuaaauuuc

SEQ ID NO: 882942 - RNA, 26 nt, Human
augcaugcagagcccaagccuaaaca

SEQ ID NO: 882943 - RNA, 24 nt, Human
auugcaccacugcacuccagccug

SEQ ID NO: 882944 - RNA, 18 nt, Human
caaaaguauccuucuccc

SEQ ID NO: 882945 - RNA, 22 nt, Human
caacagagcaaaacuccugucu

SEQ ID NO: 882946 - RNA, 19 nt, Human
caccccaugugaaccucca

SEQ ID NO: 882947 - RNA, 19 nt, Human
cacugcacuccagccuggg

SEQ ID NO: 882948 - RNA, 21 nt, Human
cacugcacuccagccugggca

SEQ ID NO: 882949 - RNA, 22 nt, Human
cacugcacuccagccugggcaa

SEQ ID NO: 882950 - RNA, 23 nt, Human
cacugcacuccagccugggcaac

SEQ ID NO: 882951 - RNA, 24 nt, Human
cacugcacuccagccugggcaaca

SEQ ID NO: 882952 - RNA, 25 nt, Human
cacugcacuccagccugggcaacaa

SEQ ID NO: 882953 - RNA, 27 nt, Human
cacugcacuccagccugggcaacagag

SEQ ID NO: 882954 - RNA, 22 nt, Human
cagaacuucaauuucauaauuu

SEQ ID NO: 882955 - RNA, 26 nt, Human
cagagcccaagccuaaacauccaccu

SEQ ID NO: 882956 - RNA, 24 nt, Human
caguaagcugaggcaggaggacca

SEQ ID NO: 882957 - RNA, 21 nt, Human
caugcagagcccaagccuaaa

SEQ ID NO: 882958 - RNA, 19 nt, Human
cauggaggcugugcaaaag

SEQ ID NO: 882959 - RNA, 20 nt, Human
ccacaaaacaaaaaucguau

SEQ ID NO: 882960 - RNA, 20 nt, Human
ccacugcacuccagccuggg

SEQ ID NO: 882961 - RNA, 21 nt, Human
ccacugcacuccagccugggc

SEQ ID NO: 882962 - RNA, 22 nt, Human
ccacugcacuccagccugggca

SEQ ID NO: 882963 - RNA, 23 nt, Human
ccacugcacuccagccugggcaa

SEQ ID NO: 882964 - RNA, 24 nt, Human
ccacugcacuccagccugggcaac

SEQ ID NO: 882965 - RNA, 18 nt, Human
ccaggcaggugacaaaga

SEQ ID NO: 882966 - RNA, 26 nt, Human
ccccaugugaaccuccaagugaaacu

SEQ ID NO: 882967 - RNA, 18 nt, Human
ccccuguaacagagaccc

SEQ ID NO: 882968 - RNA, 23 nt, Human
cccuccuacccacaaaacaaaaa

SEQ ID NO: 882969 - RNA, 19 nt, Human
ccuccuacccacaaaacaa

SEQ ID NO: 882970 - RNA, 20 nt, Human
cgaagaaaugaaaauccauc

SEQ ID NO: 882971 - RNA, 18 nt, Human
cgucucagaagugcgaag

SEQ ID NO: 882972 - RNA, 19 nt, Human
cuaaacauccaccuucccc

SEQ ID NO: 882973 - RNA, 19 nt, Human
cugagaaacaagugaaacu

SEQ ID NO: 882974 - RNA, 20 nt, Human
cuggcccaguuaaauucccu

SEQ ID NO: 882975 - RNA, 22 nt, Human
gaaaauccaucaaaacagaaug

SEQ ID NO: 882976 - RNA, 24 nt, Human
gaaggugcucugaggccccuguaa

SEQ ID NO: 882977 - RNA, 24 nt, Human
gaccacuugagcccaggagugcga

SEQ ID NO: 882978 - RNA, 21 nt, Human
gagaaacgaaggugcucugag

SEQ ID NO: 882979 - RNA, 18 nt, Human
gagcaaaacuccugucuc

SEQ ID NO: 882980 - RNA, 26 nt, Human
gagcaggagccaggcaggugacaaag

SEQ ID NO: 882981 - RNA, 20 nt, Human
gaggcugugcaaaaguaucc

SEQ ID NO: 882982 - RNA, 22 nt, Human
gaucugaaacaguaauucaugc

SEQ ID NO: 882983 - RNA, 20 nt, Human
gcaaaaagaagcaagucaca

SEQ ID NO: 882984 - RNA, 21 nt, Human
gcaaaaguauccuucucccca

SEQ ID NO: 882985 - RNA, 24 nt, Human
gcacuccagccugggcaacagagc

SEQ ID NO: 882986 - RNA, 22 nt, Human
gcccacuucaaguaaacaaugc

SEQ ID NO: 882987 - RNA, 22 nt, Human
gcuguguagagaaguuggugaa

SEQ ID NO: 882988 - RNA, 21 nt, Human
ggcuauuuacucuccuaugaa

SEQ ID NO: 882989 - RNA, 22 nt, Human
guacacaaagauacauauccaa

SEQ ID NO: 882990 - RNA, 18 nt, Human
gugguuccugaauucccu

SEQ ID NO: 882991 - RNA, 20 nt, Human
guuaagugugcugccacccc

SEQ ID NO: 882992 - RNA, 18 nt, Human
uaaacauccaccuucccc

SEQ ID NO: 882993 - RNA, 23 nt, Human
uaaguaugcaaaagcuguguaga

SEQ ID NO: 882994 - RNA, 25 nt, Human
uaaguuaugugccugucagccaucc

SEQ ID NO: 882995 - RNA, 25 nt, Human
uagaaaaaauaaauaccuaucuuuc

SEQ ID NO: 882996 - RNA, 26 nt, Human
uagagagaauggaguuaacaaugcaa

SEQ ID NO: 882997 - RNA, 20 nt, Human
uauaaaaucaguguugauga

SEQ ID NO: 882998 - RNA, 19 nt, Human
uauccaauaacugagaaac

SEQ ID NO: 882999 - RNA, 20 nt, Human
uauguacacaaagauacaua

SEQ ID NO: 883000 - RNA, 18 nt, Human
uauuggucccauaaguag

SEQ ID NO: 883001 - RNA, 19 nt, Human
uccaucucacuacccagag

SEQ ID NO: 883002 - RNA, 21 nt, Human
ucccauaaguagacacgcacu

SEQ ID NO: 883003 - RNA, 18 nt, Human
ucccguaaguuaugugcc

SEQ ID NO: 883004 - RNA, 22 nt, Human
ucccuuggcaauuggagacuag

SEQ ID NO: 883005 - RNA, 22 nt, Human
ucugcaggcaccauuuccaucu

SEQ ID NO: 883006 - RNA, 23 nt, Human
ugagaaacaagugaaacuucuga

SEQ ID NO: 883007 - RNA, 20 nt, Human
ugaggcaggaggaccacuug

SEQ ID NO: 883008 - RNA, 24 nt, Human
ugaggcaggaggaccacuugagcc

SEQ ID NO: 883009 - RNA, 25 nt, Human
ugaggcaggaggaccacuugagccc

SEQ ID NO: 883010 - RNA, 20 nt, Human
ugagugggagaugggguugg

SEQ ID NO: 883011 - RNA, 21 nt, Human
ugcaccacugcacuccagccu

SEQ ID NO: 883012 - RNA, 21 nt, Human
ugccaguccuuaucucuacac

SEQ ID NO: 883013 - RNA, 20 nt, Human
ugcucugaggccccuguaac

SEQ ID NO: 883014 - RNA, 23 nt, Human
ugcugcaugcaaaccugcuaaua

SEQ ID NO: 883015 - RNA, 20 nt, Human
uggaaggcuucuaagugguu

SEQ ID NO: 883016 - RNA, 21 nt, Human
uggcacauauccuugaaauaa

SEQ ID NO: 883017 - RNA, 22 nt, Human
ugggaaaaguuuauccuuacaa

SEQ ID NO: 883018 - RNA, 23 nt, Human
ugggaaaaguuuauccuuacaaa

SEQ ID NO: 883019 - RNA, 24 nt, Human
ugggagaugggguuggugagguga

SEQ ID NO: 883020 - RNA, 23 nt, Human
uucaaaacuugcauaaaaagccc

SEQ ID NO: 883021 - RNA, 20 nt, Human
uucccuggcacauauccuug

SEQ ID NO: 883022 - RNA, 21 nt, Human
uugcaacuaaaagagcauaac

SEQ ID NO: 883023 - RNA, 23 nt, Human
uugcaccacugcacuccagccug

SEQ ID NO: 883024 - RNA, 21 nt, Human
uugucagauuauaaaaucagu

SEQ ID NO: 883025 - RNA, 26 nt, Human
uuucccuaaccaaaucuggcaaaguc

SEQ ID NO: 883026 - RNA, 22 nt, Human
uuucuaaaacaacugagauuac

SEQ ID NO: 883027 - RNA, 19 nt, Human
uuucuacucuuccugaggc

SEQ ID NO: 883028 - RNA, 18 nt, Human
cccggcgccgaccccugc

SEQ ID NO: 883029 - RNA, 21 nt, Human
cuugaugugauaauuccuucc

SEQ ID NO: 883030 - RNA, 19 nt, Human
guuguggugaauccggccg

SEQ ID NO: 883031 - RNA, 20 nt, Human
uaagauacaaccauucuccc

SEQ ID NO: 883032 - RNA, 18 nt, Human
ugaugcgaugacgaguau

SEQ ID NO: 883033 - RNA, 19 nt, Human
uguggugaauccggccgca

SEQ ID NO: 883034 - RNA, 19 nt, Human
aggcaagagggguuucagg

SEQ ID NO: 883035 - RNA, 22 nt, Human
ccacggggcccaggcccucuuc

SEQ ID NO: 883036 - RNA, 18 nt, Human
cuccaccuggaccccgcc

SEQ ID NO: 883037 - RNA, 18 nt, Human
gaccuccaccuggacccc

SEQ ID NO: 883038 - RNA, 23 nt, Human
gagagcagcaggccaaacgggca

SEQ ID NO: 883039 - RNA, 18 nt, Human
gagcagcaggccaaacgg

SEQ ID NO: 883040 - RNA, 19 nt, Human
gauagccucaagaccucca

SEQ ID NO: 883041 - RNA, 25 nt, Human
gggcacugaggcuccacggggccca

SEQ ID NO: 883042 - RNA, 20 nt, Human
ggguuucaggauucagaggg

SEQ ID NO: 883043 - RNA, 20 nt, Human
uggaagagaggcaagagggg

SEQ ID NO: 883044 - RNA, 21 nt, Human
uggaagagaggcaagaggggu

SEQ ID NO: 883045 - RNA, 23 nt, Human
uuccucuguugcuuuacuuugau

SEQ ID NO: 883046 - RNA, 22 nt, Human
aaaaaacaaaaagagggaaugg

SEQ ID NO: 883047 - RNA, 24 nt, Human
aaacaaaaagagggaauggaugca

SEQ ID NO: 883048 - RNA, 21 nt, Human
aaggacccuccguaacacugg

SEQ ID NO: 883049 - RNA, 27 nt, Human
aauuuucacuccugccucaaggagggg

SEQ ID NO: 883050 - RNA, 23 nt, Human
acgccgcccuacccccgcccgac

SEQ ID NO: 883051 - RNA, 22 nt, Human
caccccaggacuaacccccaga

SEQ ID NO: 883052 - RNA, 21 nt, Human
cacgacgcgggaggucaaggc

SEQ ID NO: 883053 - RNA, 25 nt, Human
cacuccugccucaaggacccuccgu

SEQ ID NO: 883054 - RNA, 22 nt, Human
ccaauggcgauggccgcucccu

SEQ ID NO: 883055 - RNA, 27 nt, Human
ccaauggcgauggccgcucccuguggc

SEQ ID NO: 883056 - RNA, 20 nt, Human
ccaauuuucacuccugccuc

SEQ ID NO: 883057 - RNA, 22 nt, Human
ccaggggcucggccuggcucag

SEQ ID NO: 883058 - RNA, 23 nt, Human
cccaggacuaacccccagaccca

SEQ ID NO: 883059 - RNA, 25 nt, Human
ccccaggacuaacccccagacccaa

SEQ ID NO: 883060 - RNA, 20 nt, Human
ccccgcccgacuccgcgcug

SEQ ID NO: 883061 - RNA, 23 nt, Human
cccgcccgacuccgcgcuggaaa

SEQ ID NO: 883062 - RNA, 20 nt, Human
ccgacccggcgugcccagac

SEQ ID NO: 883063 - RNA, 18 nt, Human
ccgcuggaugacgucacg

SEQ ID NO: 883064 - RNA, 27 nt, Human
ccuccaccccaggacuaacccccagac

SEQ ID NO: 883065 - RNA, 18 nt, Human
ccucgaagggugggcgug

SEQ ID NO: 883066 - RNA, 21 nt, Human
ccuguggccucagcuuccucc

SEQ ID NO: 883067 - RNA, 18 nt, Human
cgcgggaggucaaggcca

SEQ ID NO: 883068 - RNA, 22 nt, Human
cuccaccccaggacuaaccccc

SEQ ID NO: 883069 - RNA, 19 nt, Human
ggaaugaagggggccaggu

SEQ ID NO: 883070 - RNA, 25 nt, Human
gggcucggccuggcucagaagaggu

SEQ ID NO: 883071 - RNA, 22 nt, Human
uaaaaaacaaaaagagggaaug

SEQ ID NO: 883072 - RNA, 22 nt, Human
uaacacuggggaacgcgaccuc

SEQ ID NO: 883073 - RNA, 20 nt, Human
uaacccccagacccaauuuu

SEQ ID NO: 883074 - RNA, 27 nt, Human
uaacccccagacccaauuuucacuccu

SEQ ID NO: 883075 - RNA, 28 nt, Human
uaacccccagacccaauuuucacuccuu

SEQ ID NO: 883076 - RNA, 19 nt, Human
ucagaagaggugcuucaca

SEQ ID NO: 883077 - RNA, 22 nt, Human
uccaccccaggacuaaccccca

SEQ ID NO: 883078 - RNA, 20 nt, Human
uccgcgcuggaaagcggggu

SEQ ID NO: 883079 - RNA, 22 nt, Human
uuaaaaaacaaaaagagggaau

SEQ ID NO: 883080 - RNA, 21 nt, Human
uuuaaaaaacaaaaagaggga

SEQ ID NO: 883081 - RNA, 25 nt, Human
uuuauuuuaaaaaacaaaaagaggg

SEQ ID NO: 883082 - RNA, 19 nt, Human
acccggccucgaccuugcu

SEQ ID NO: 883083 - RNA, 22 nt, Human
cccggccucgaccuugcuccgc

SEQ ID NO: 883084 - RNA, 30 nt, Human
cccggcuccggcgccaacccggccucgacc

SEQ ID NO: 883085 - RNA, 21 nt, Human
ccgcgcccuggaccggagacc

SEQ ID NO: 883086 - RNA, 23 nt, Human
ccggagaccccacacgagcucca

SEQ ID NO: 883087 - RNA, 18 nt, Human
ccggcuccggcgccaacc

SEQ ID NO: 883088 - RNA, 24 nt, Human
cggccccggcuccggcgccaaccc

SEQ ID NO: 883089 - RNA, 19 nt, Human
cggcgccaacccggccucg

SEQ ID NO: 883090 - RNA, 23 nt, Human
gcccuggaccggagaccccacac

SEQ ID NO: 883091 - RNA, 20 nt, Human
gggcaggccgccccuccccc

SEQ ID NO: 883092 - RNA, 22 nt, Human
uaauagaaaugagaugagggca

SEQ ID NO: 883093 - RNA, 20 nt, Human
aaaaagaaaaaagaaaauag

SEQ ID NO: 883094 - RNA, 19 nt, Human
aacacuaaaauagaaaaag

SEQ ID NO: 883095 - RNA, 21 nt, Human
aacacuaaaauagaaaaagaa

SEQ ID NO: 883096 - RNA, 24 nt, Human
acuaaaauagaaaaagaaaaaaga

SEQ ID NO: 883097 - RNA, 25 nt, Human
augaaaaaagauguucugaagagaa

SEQ ID NO: 883098 - RNA, 19 nt, Human
cacuauggaaaaguccuaa

SEQ ID NO: 883099 - RNA, 27 nt, Human
ccaauaaaccuacuaucaguugaaaau

SEQ ID NO: 883100 - RNA, 21 nt, Human
ccagaauuacuuuauauaaaa

SEQ ID NO: 883101 - RNA, 26 nt, Human
cccguuuuauaauaaaguguugaauu

SEQ ID NO: 883102 - RNA, 19 nt, Human
ccgccaucuuguuucaauc

SEQ ID NO: 883103 - RNA, 19 nt, Human
ccuacuguuuagcaaaauu

SEQ ID NO: 883104 - RNA, 22 nt, Human
ccugucuuaaauaugcucagaa

SEQ ID NO: 883105 - RNA, 22 nt, Human
cuaaaauagaaaaagaaaaaag

SEQ ID NO: 883106 - RNA, 23 nt, Human
cugcuucuaagcauaccaauuuc

SEQ ID NO: 883107 - RNA, 23 nt, Human
gaaaaaagauguucugaagagaa

SEQ ID NO: 883108 - RNA, 24 nt, Human
uaacaaugcuuggcugaugauuaa

SEQ ID NO: 883109 - RNA, 24 nt, Human
ucccaauaaaccuacuaucaguug

SEQ ID NO: 883110 - RNA, 21 nt, Human
ugaaaaaagauguucugaaga

SEQ ID NO: 883111 - RNA, 20 nt, Human
ugaaaagauauuuuaucauu

SEQ ID NO: 883112 - RNA, 22 nt, Human
ugaagagaaacugcuuuuagaa

SEQ ID NO: 883113 - RNA, 18 nt, Human
ugaauacaccagacugca

SEQ ID NO: 883114 - RNA, 19 nt, Human
ugauucccccaggaaccuc

SEQ ID NO: 883115 - RNA, 21 nt, Human
uggcaaaugaggcacauuucu

SEQ ID NO: 883116 - RNA, 19 nt, Human
uggcacuauggaaaagucc

SEQ ID NO: 883117 - RNA, 25 nt, Human
uuaaaaauacuuaaaucacaguaga

SEQ ID NO: 883118 - RNA, 21 nt, Human
uuacaguagccuacuguuuag

SEQ ID NO: 883119 - RNA, 24 nt, Human
uucucaaauggcaaaugaggcacu

SEQ ID NO: 883120 - RNA, 20 nt, Human
uugaaaaugcuagccugucu

SEQ ID NO: 883121 - RNA, 23 nt, Human
aaaaugagugguucacaagguca

SEQ ID NO: 883122 - RNA, 22 nt, Human
aaagugccuagcccaucacagc

SEQ ID NO: 883123 - RNA, 18 nt, Human
aagggcccuguaaaaccc

SEQ ID NO: 883124 - RNA, 19 nt, Human
agcuuggaggccgcggagc

SEQ ID NO: 883125 - RNA, 18 nt, Human
agugccuagcccaucacg

SEQ ID NO: 883126 - RNA, 22 nt, Human
caaggucacugcccccagaagc

SEQ ID NO: 883127 - RNA, 19 nt, Human
cacuggaaagaaacaggca

SEQ ID NO: 883128 - RNA, 19 nt, Human
cagaagcaggcacuggaaa

SEQ ID NO: 883129 - RNA, 18 nt, Human
cagagcucuccguagcuc

SEQ ID NO: 883130 - RNA, 22 nt, Human
cagauauaaagugccuagccca

SEQ ID NO: 883131 - RNA, 22 nt, Human
ccccagaagcaggcacuggaaa

SEQ ID NO: 883132 - RNA, 26 nt, Human
cuucagaagccagccuucagaccucu

SEQ ID NO: 883133 - RNA, 24 nt, Human
cuuccucaucucagguuuuaggga

SEQ ID NO: 883134 - RNA, 22 nt, Human
cuuggaggccgcggagccuaag

SEQ ID NO: 883135 - RNA, 21 nt, Human
gcagagcucuccguagcucag

SEQ ID NO: 883136 - RNA, 23 nt, Human
gcagagcucuccguagcucagug

SEQ ID NO: 883137 - RNA, 20 nt, Human
gggaugccacuugcauaaaa

SEQ ID NO: 883138 - RNA, 20 nt, Human
uaaaaaacaagggcccugua

SEQ ID NO: 883139 - RNA, 23 nt, Human
ucacaaggucacugcccccagaa

SEQ ID NO: 883140 - RNA, 20 nt, Human
ucacugcccccagaagcagg

SEQ ID NO: 883141 - RNA, 20 nt, Human
ugagaucauuauuaucaauu

SEQ ID NO: 883142 - RNA, 21 nt, Human
ugagugguucacaaggucacu

SEQ ID NO: 883143 - RNA, 20 nt, Human
ugccuagcccaucacagcag

SEQ ID NO: 883144 - RNA, 20 nt, Human
uggaaagaaacaggcagcuc

SEQ ID NO: 883145 - RNA, 21 nt, Human
uucauuaucccaagcagaacc

SEQ ID NO: 883146 - RNA, 23 nt, Human
aaaaaaaaaaagauuugaucaaa

SEQ ID NO: 883147 - RNA, 20 nt, Human
aaaaagauuugaucaaacca

SEQ ID NO: 883148 - RNA, 22 nt, Human
aacacaguaaaaaacagaaaca

SEQ ID NO: 883149 - RNA, 22 nt, Human
aacacugugacuugguuaacau

SEQ ID NO: 883150 - RNA, 20 nt, Human
aacuuggugaaaccccaucu

SEQ ID NO: 883151 - RNA, 21 nt, Human
aacuuggugaaaccccaucuc

SEQ ID NO: 883152 - RNA, 24 nt, Human
aaucgcuugaaccugugaggugga

SEQ ID NO: 883153 - RNA, 26 nt, Human
acagaaacaaaacaucuauuucuuca

SEQ ID NO: 883154 - RNA, 24 nt, Human
acagaguaagacuccaucucaaga

SEQ ID NO: 883155 - RNA, 21 nt, Human
acagcaaaaaauucacauaag

SEQ ID NO: 883156 - RNA, 18 nt, Human
acaguaaaaaacagaaac

SEQ ID NO: 883157 - RNA, 24 nt, Human
accacugcaguccagccugggcga

SEQ ID NO: 883158 - RNA, 24 nt, Human
accugaggucaggaguucaagacu

SEQ ID NO: 883159 - RNA, 24 nt, Human
acugcaguccagccugggcgacag

SEQ ID NO: 883160 - RNA, 26 nt, Human
acugcaguccagccugggcgacagag

SEQ ID NO: 883161 - RNA, 21 nt, Human
agaaaaacaaaaccaaaaaca

SEQ ID NO: 883162 - RNA, 24 nt, Human
agccacgagaaucgcuugaaccug

SEQ ID NO: 883163 - RNA, 23 nt, Human
agccagguaugguggugugugcc

SEQ ID NO: 883164 - RNA, 24 nt, Human
agccugggcgacagaguaagacuc

SEQ ID NO: 883165 - RNA, 23 nt, Human
aggaguucaagacuagucuagcc

SEQ ID NO: 883166 - RNA, 21 nt, Human
aggccaaggcggguggaucac

SEQ ID NO: 883167 - RNA, 22 nt, Human
aggcggguggaucaccugaggu

SEQ ID NO: 883168 - RNA, 26 nt, Human
aggcggguggaucaccugaggucagg

SEQ ID NO: 883169 - RNA, 18 nt, Human
agguaugguggugugugc

SEQ ID NO: 883170 - RNA, 24 nt, Human
agguaugguggugugugccuguaa

SEQ ID NO: 883171 - RNA, 24 nt, Human
agguggagguugcagugagccgag

SEQ ID NO: 883172 - RNA, 24 nt, Human
aguggcucacaccuguaaucccag

SEQ ID NO: 883173 - RNA, 22 nt, Human
aucccagcacuuugggaggcca

SEQ ID NO: 883174 - RNA, 24 nt, Human
aucgcaccacugcaguccagccug

SEQ ID NO: 883175 - RNA, 24 nt, Human
auuuuuuugcaaaaaugucaaaaa

SEQ ID NO: 883176 - RNA, 21 nt, Human
caaaaauacaaaaauuagcca

SEQ ID NO: 883177 - RNA, 22 nt, Human
caacuuggugaaaccccaucuc

SEQ ID NO: 883178 - RNA, 24 nt, Human
caaggcggguggaucaccugaggu

SEQ ID NO: 883179 - RNA, 26 nt, Human
caaggcggguggaucaccugagguca

SEQ ID NO: 883180 - RNA, 24 nt, Human
cacaccuguaaucccagcacuuug

SEQ ID NO: 883181 - RNA, 23 nt, Human
cacaguaaaaaacagaaacaaaa

SEQ ID NO: 883182 - RNA, 25 nt, Human
cacaguaaaaaacagaaacaaaaca

SEQ ID NO: 883183 - RNA, 23 nt, Human
caccugaggucaggaguucaaga

SEQ ID NO: 883184 - RNA, 23 nt, Human
caccuguaaucccagcacuuugg

SEQ ID NO: 883185 - RNA, 24 nt, Human
caccuguaaucccagcacuuuggg

SEQ ID NO: 883186 - RNA, 21 nt, Human
cacugcaguccagccugggcg

SEQ ID NO: 883187 - RNA, 23 nt, Human
cacuuucgcucucaaguuucagg

SEQ ID NO: 883188 - RNA, 24 nt, Human
cagcacuuugggaggccaaggcgg

SEQ ID NO: 883189 - RNA, 23 nt, Human
caguccagccugggcgacagagu

SEQ ID NO: 883190 - RNA, 20 nt, Human
ccacugcaguccagccuggg

SEQ ID NO: 883191 - RNA, 21 nt, Human
ccacugcaguccagccugggc

SEQ ID NO: 883192 - RNA, 24 nt, Human
ccacugcaguccagccugggcgac

SEQ ID NO: 883193 - RNA, 19 nt, Human
ccucaaagcuagaggcaaa

SEQ ID NO: 883194 - RNA, 22 nt, Human
ccugggcgacagaguaagacuc

SEQ ID NO: 883195 - RNA, 22 nt, Human
ccuguaaucccagcuacuaggg

SEQ ID NO: 883196 - RNA, 21 nt, Human
ccugugagguggagguugcag

SEQ ID NO: 883197 - RNA, 21 nt, Human
cgcaccacugcaguccagccu

SEQ ID NO: 883198 - RNA, 24 nt, Human
cggguggaucaccugaggucagga

SEQ ID NO: 883199 - RNA, 23 nt, Human
cuagccaacuuggugaaacccca

SEQ ID NO: 883200 - RNA, 21 nt, Human
cucaagagaaaaaaaaaaaga

SEQ ID NO: 883201 - RNA, 24 nt, Human
cucaagagaaaaaaaaaaagauuu

SEQ ID NO: 883202 - RNA, 22 nt, Human
cucacaccuguaaucccagcac

SEQ ID NO: 883203 - RNA, 24 nt, Human
cucacaccuguaaucccagcacuu

SEQ ID NO: 883204 - RNA, 20 nt, Human
cucuaccaaaaauacaaaaa

SEQ ID NO: 883205 - RNA, 24 nt, Human
gaacacaguaaaaaacagaaacaa

SEQ ID NO: 883206 - RNA, 23 nt, Human
gagguugcagugagccgagaucg

SEQ ID NO: 883207 - RNA, 23 nt, Human
gaucaccugaggucaggaguuca

SEQ ID NO: 883208 - RNA, 24 nt, Human
gaucaccugaggucaggaguucaa

SEQ ID NO: 883209 - RNA, 20 nt, Human
gcaccacugcaguccagccu

SEQ ID NO: 883210 - RNA, 28 nt, Human
gcaccacugcaguccagccugggcgaca

SEQ ID NO: 883211 - RNA, 24 nt, Human
gccaacuuggugaaaccccaucuc

SEQ ID NO: 883212 - RNA, 20 nt, Human
gccgagaucgcaccacugca

SEQ ID NO: 883213 - RNA, 20 nt, Human
ggagguugcagugagccgag

SEQ ID NO: 883214 - RNA, 22 nt, Human
ggagguugcagugagccgagau

SEQ ID NO: 883215 - RNA, 24 nt, Human
ggagguugcagugagccgagaucg

SEQ ID NO: 883216 - RNA, 22 nt, Human
ggaucaccugaggucaggaguu

SEQ ID NO: 883217 - RNA, 22 nt, Human
gggaggcugagccacgagaauc

SEQ ID NO: 883218 - RNA, 23 nt, Human
gguauaguggcucacaccuguaa

SEQ ID NO: 883219 - RNA, 18 nt, Human
ggucggguauaguggcuc

SEQ ID NO: 883220 - RNA, 21 nt, Human
ggucggguauaguggcucaca

SEQ ID NO: 883221 - RNA, 24 nt, Human
gguggugugugccuguaaucccag

SEQ ID NO: 883222 - RNA, 23 nt, Human
guggugugugccuguaaucccag

SEQ ID NO: 883223 - RNA, 24 nt, Human
guggugugugccuguaaucccagc

SEQ ID NO: 883224 - RNA, 19 nt, Human
guugcagugagccgagauc

SEQ ID NO: 883225 - RNA, 19 nt, Human
uaagauacauaaauuauga

SEQ ID NO: 883226 - RNA, 18 nt, Human
uacaauuaaaucaagaac

SEQ ID NO: 883227 - RNA, 21 nt, Human
uaccaaaaauacaaaaauuag

SEQ ID NO: 883228 - RNA, 24 nt, Human
uaccaaaaauacaaaaauuagcca

SEQ ID NO: 883229 - RNA, 20 nt, Human
uaccucaaagcuagaggcaa

SEQ ID NO: 883230 - RNA, 24 nt, Human
uaguggcucacaccuguaauccca

SEQ ID NO: 883231 - RNA, 23 nt, Human
ucaccugaggucaggaguucaag

SEQ ID NO: 883232 - RNA, 21 nt, Human
ucagaaaaacaaaaccaaaaa

SEQ ID NO: 883233 - RNA, 23 nt, Human
ucagaaaaacaaaaccaaaaaca

SEQ ID NO: 883234 - RNA, 24 nt, Human
ucagaaaaacaaaaccaaaaacac

SEQ ID NO: 883235 - RNA, 24 nt, Human
uccagccugggcgacagaguaaga

SEQ ID NO: 883236 - RNA, 23 nt, Human
ucgcaccacugcaguccagccug

SEQ ID NO: 883237 - RNA, 24 nt, Human
ucgcuugaaccugugagguggagg

SEQ ID NO: 883238 - RNA, 20 nt, Human
ugaaaaugucuggcuugaaa

SEQ ID NO: 883239 - RNA, 21 nt, Human
ugaaacaccuuugacauuuau

SEQ ID NO: 883240 - RNA, 22 nt, Human
ugagccgagaucgcaccacugc

SEQ ID NO: 883241 - RNA, 19 nt, Human
ugagguggagguugcagug

SEQ ID NO: 883242 - RNA, 23 nt, Human
ugccuguaaucccagcuacuagg

SEQ ID NO: 883243 - RNA, 24 nt, Human
uggaucaccugaggucaggaguuc

SEQ ID NO: 883244 - RNA, 27 nt, Human
uggaucaccugaggucaggaguucaag

SEQ ID NO: 883245 - RNA, 21 nt, Human
uggcucacaccuguaauccca

SEQ ID NO: 883246 - RNA, 22 nt, Human
uggcucacaccuguaaucccag

SEQ ID NO: 883247 - RNA, 24 nt, Human
uggcucacaccuguaaucccagca

SEQ ID NO: 883248 - RNA, 19 nt, Human
ugggaacacaguaaaaaac

SEQ ID NO: 883249 - RNA, 19 nt, Human
ugggaacacaguaaaaaac

SEQ ID NO: 883250 - RNA, 24 nt, Human
ugggaggccaaggcggguggauca

SEQ ID NO: 883251 - RNA, 24 nt, Human
ugguggugugugccuguaauccca

SEQ ID NO: 883252 - RNA, 21 nt, Human
uggugugugccuguaauccca

SEQ ID NO: 883253 - RNA, 22 nt, Human
uggugugugccuguaaucccag

SEQ ID NO: 883254 - RNA, 24 nt, Human
uggugugugccuguaaucccagcu

SEQ ID NO: 883255 - RNA, 24 nt, Human
ugugagguggagguugcagugagc

SEQ ID NO: 883256 - RNA, 24 nt, Human
uuagccagguaugguggugugugc

SEQ ID NO: 883257 - RNA, 24 nt, Human
uugaaccugugagguggagguugc

SEQ ID NO: 883258 - RNA, 22 nt, Human
uugcaaaaaugucaaaaaaaga

SEQ ID NO: 883259 - RNA, 18 nt, Human
uugcagugagccgagauc

SEQ ID NO: 883260 - RNA, 19 nt, Human
uugcagugagccgagaucg

SEQ ID NO: 883261 - RNA, 20 nt, Human
uugcagugagccgagaucgc

SEQ ID NO: 883262 - RNA, 22 nt, Human
uugcagugagccgagaucgcac

SEQ ID NO: 883263 - RNA, 23 nt, Human
aaaauuuuuccaacacccugaca

SEQ ID NO: 883264 - RNA, 24 nt, Human
acuucaaagcuuccagcagccuca

SEQ ID NO: 883265 - RNA, 24 nt, Human
caaaauuuuuccaacacccugaca

SEQ ID NO: 883266 - RNA, 24 nt, Human
cacccaggcuucacccuagaaguc

SEQ ID NO: 883267 - RNA, 19 nt, Human
cacuaauuauucuucccca

SEQ ID NO: 883268 - RNA, 23 nt, Human
cauaaaaugcaaaugcugauuca

SEQ ID NO: 883269 - RNA, 19 nt, Human
ccaugcccagccugaacca

SEQ ID NO: 883270 - RNA, 25 nt, Human
ccauggccauguuauaccugccuug

SEQ ID NO: 883271 - RNA, 18 nt, Human
cccaggcuucacccuaga

SEQ ID NO: 883272 - RNA, 24 nt, Human
ccugugauuacaaagaggaugcug

SEQ ID NO: 883273 - RNA, 21 nt, Human
cucacagucccugcuguggga

SEQ ID NO: 883274 - RNA, 20 nt, Human
cucaucacccaggcuucacc

SEQ ID NO: 883275 - RNA, 21 nt, Human
cugaaggcugguccaugccca

SEQ ID NO: 883276 - RNA, 18 nt, Human
cugauauccaauguucuc

SEQ ID NO: 883277 - RNA, 22 nt, Human
gaugaugagacugcugaaaaga

SEQ ID NO: 883278 - RNA, 18 nt, Human
gauuacaaagaggaugcu

SEQ ID NO: 883279 - RNA, 25 nt, Human
guaguucuuuuuauagcaugagggg

SEQ ID NO: 883280 - RNA, 27 nt, Human
guccauggccauguuauaccugccacc

SEQ ID NO: 883281 - RNA, 18 nt, Human
uacaaagaggaugcugcu

SEQ ID NO: 883282 - RNA, 24 nt, Human
uccaugcccagccugaaccagggg

SEQ ID NO: 883283 - RNA, 28 nt, Human
uccauggccauguuauaccugccaccuu

SEQ ID NO: 883284 - RNA, 20 nt, Human
ucucacagucccugcugugg

SEQ ID NO: 883285 - RNA, 21 nt, Human
ucucucacagucccugcugug

SEQ ID NO: 883286 - RNA, 21 nt, Human
ugaaaagaccugagcaggaug

SEQ ID NO: 883287 - RNA, 27 nt, Human
ugacaacauuucauuucaaacucugau

SEQ ID NO: 883288 - RNA, 22 nt, Human
ugggaaaaacugauauccaaug

SEQ ID NO: 883289 - RNA, 23 nt, Human
ugggaaaaacugauauccaaugu

SEQ ID NO: 883290 - RNA, 18 nt, Human
ugggagagaacaaaggua

SEQ ID NO: 883291 - RNA, 19 nt, Human
ugugauuacaaagaggaug

SEQ ID NO: 883292 - RNA, 20 nt, Human
ugugcagaacucaccaaaau

SEQ ID NO: 883293 - RNA, 18 nt, Human
uuccccagucuucauuuc

SEQ ID NO: 883294 - RNA, 20 nt, Human
uuuuuuuuuuuuuaagggau

SEQ ID NO: 883295 - RNA, 23 nt, Human
uuuuuuuuuuuuuuuuuuaaggg

SEQ ID NO: 883296 - RNA, 19 nt, Human
aaguagcugggauuacagg

SEQ ID NO: 883297 - RNA, 23 nt, Human
agauccugucugauuaauuccuu

SEQ ID NO: 883298 - RNA, 18 nt, Human
aggugauccgcccgccuc

SEQ ID NO: 883299 - RNA, 21 nt, Human
aguguaguggcacgaucucag

SEQ ID NO: 883300 - RNA, 24 nt, Human
aguguaguggcacgaucucagcuc

SEQ ID NO: 883301 - RNA, 22 nt, Human
cacacaauucugguuuuucgcu

SEQ ID NO: 883302 - RNA, 22 nt, Human
cacccucacucagguugucaca

SEQ ID NO: 883303 - RNA, 23 nt, Human
caccuccgccucucggguucaag

SEQ ID NO: 883304 - RNA, 21 nt, Human
cacgaucucagcucacugcca

SEQ ID NO: 883305 - RNA, 20 nt, Human
cacugcuggcaugaaagggu

SEQ ID NO: 883306 - RNA, 22 nt, Human
cacugcuguuucuccagaaaga

SEQ ID NO: 883307 - RNA, 23 nt, Human
cagagucuagaaauucuccugcu

SEQ ID NO: 883308 - RNA, 29 nt, Human
cagcaauaucccaccgagacucacucaac

SEQ ID NO: 883309 - RNA, 23 nt, Human
cagcucacugccaccuccgccuc

SEQ ID NO: 883310 - RNA, 19 nt, Human
caggugcccgccaccacgc

SEQ ID NO: 883311 - RNA, 21 nt, Human
caggugcccgccaccacgccc

SEQ ID NO: 883312 - RNA, 24 nt, Human
caguaagcucuucucuuuggcacu

SEQ ID NO: 883313 - RNA, 24 nt, Human
cauguuugucaggcuggucuugaa

SEQ ID NO: 883314 - RNA, 21 nt, Human
ccaaguagcugggauuacagg

SEQ ID NO: 883315 - RNA, 23 nt, Human
ccaaguagcugggauuacaggug

SEQ ID NO: 883316 - RNA, 21 nt, Human
ccauguuugucaggcuggucu

SEQ ID NO: 883317 - RNA, 21 nt, Human
ccauguuugucaggcuggucu

SEQ ID NO: 883318 - RNA, 18 nt, Human
cccgaccucaggugaucc

SEQ ID NO: 883319 - RNA, 22 nt, Human
cccgaccucaggugauccgccc

SEQ ID NO: 883320 - RNA, 21 nt, Human
cccgccuaauuuuuauauuuu

SEQ ID NO: 883321 - RNA, 22 nt, Human
ccggacccugcagccgcguucc

SEQ ID NO: 883322 - RNA, 22 nt, Human
ccucucggguucaagcaauucu

SEQ ID NO: 883323 - RNA, 18 nt, Human
cgaccucaggugauccgc

SEQ ID NO: 883324 - RNA, 24 nt, Human
cgaccucaggugauccgcccgccu

SEQ ID NO: 883325 - RNA, 21 nt, Human
cggguucaagcaauucugucu

SEQ ID NO: 883326 - RNA, 28 nt, Human
cucacugccaccuccgccucucggguuc

SEQ ID NO: 883327 - RNA, 22 nt, Human
cucagcucacugccaccuccgc

SEQ ID NO: 883328 - RNA, 26 nt, Human
cucccgaccucaggugauccgcccgc

SEQ ID NO: 883329 - RNA, 24 nt, Human
cucgcucuguugcgcaggcuggag

SEQ ID NO: 883330 - RNA, 24 nt, Human
cugcagcagauuuuuauuagaugg

SEQ ID NO: 883331 - RNA, 20 nt, Human
cuugaccaggugcagcagca

SEQ ID NO: 883332 - RNA, 22 nt, Human
gaaauucuccugcuuuccaccc

SEQ ID NO: 883333 - RNA, 22 nt, Human
gacccugcagccgcguucccag

SEQ ID NO: 883334 - RNA, 23 nt, Human
gaccucaggugauccgcccgccu

SEQ ID NO: 883335 - RNA, 24 nt, Human
gaccucaggugauccgcccgccuc

SEQ ID NO: 883336 - RNA, 24 nt, Human
gagaugagguuucuccauguuugu

SEQ ID NO: 883337 - RNA, 22 nt, Human
gaggagugaggacauuacuggc

SEQ ID NO: 883338 - RNA, 18 nt, Human
gauuacaggugcccgcca

SEQ ID NO: 883339 - RNA, 23 nt, Human
gcuggucuugaacucccgaccuc

SEQ ID NO: 883340 - RNA, 24 nt, Human
ggcuggucuugaacucccgaccuc

SEQ ID NO: 883341 - RNA, 18 nt, Human
guagcugggauuacaggu

SEQ ID NO: 883342 - RNA, 21 nt, Human
gugauccgcccgccucggccu

SEQ ID NO: 883343 - RNA, 24 nt, Human
uaagugguaagaaauggcaaguac

SEQ ID NO: 883344 - RNA, 24 nt, Human
uaauuuuuauauuuuuacuagaga

SEQ ID NO: 883345 - RNA, 23 nt, Human
uacaggugcccgccaccacgccc

SEQ ID NO: 883346 - RNA, 24 nt, Human
uacuagagaugagguuucuccaug

SEQ ID NO: 883347 - RNA, 26 nt, Human
ucacauucacugcuguuucuccagaa

SEQ ID NO: 883348 - RNA, 18 nt, Human
ucacugccaccuccgccu

SEQ ID NO: 883349 - RNA, 23 nt, Human
ucacugccaccuccgccucucgg

SEQ ID NO: 883350 - RNA, 24 nt, Human
ucacugccaccuccgccucucggg

SEQ ID NO: 883351 - RNA, 23 nt, Human
ucacugcuguuucuccagaaaga

SEQ ID NO: 883352 - RNA, 22 nt, Human
uccaaguagcugggauuacagg

SEQ ID NO: 883353 - RNA, 23 nt, Human
uccaaguagcugggauuacaggu

SEQ ID NO: 883354 - RNA, 24 nt, Human
uccaaguagcugggauuacaggug

SEQ ID NO: 883355 - RNA, 22 nt, Human
uccacccucacucagguuguca

SEQ ID NO: 883356 - RNA, 24 nt, Human
uccgccucucggguucaagcaauu

SEQ ID NO: 883357 - RNA, 20 nt, Human
uccggaagcuucugaaauuc

SEQ ID NO: 883358 - RNA, 24 nt, Human
ucuccaaguagcugggauuacagg

SEQ ID NO: 883359 - RNA, 24 nt, Human
ucuccauguuugucaggcuggucu

SEQ ID NO: 883360 - RNA, 20 nt, Human
ucuccugcuuuccacccuca

SEQ ID NO: 883361 - RNA, 23 nt, Human
ucucgcucuguugcgcaggcugg

SEQ ID NO: 883362 - RNA, 24 nt, Human
ucucgcucuguugcgcaggcugga

SEQ ID NO: 883363 - RNA, 21 nt, Human
ucucggguucaagcaauucug

SEQ ID NO: 883364 - RNA, 24 nt, Human
ucuguugcgcaggcuggaguguag

SEQ ID NO: 883365 - RNA, 26 nt, Human
ugaaaacacugacggaacuggagacc

SEQ ID NO: 883366 - RNA, 22 nt, Human
ugaccaggugcagcagcaauau

SEQ ID NO: 883367 - RNA, 22 nt, Human
ugagacggagucucgcucuguu

SEQ ID NO: 883368 - RNA, 18 nt, Human
ugauuuguuaccaccucu

SEQ ID NO: 883369 - RNA, 20 nt, Human
ugcccgccaccacgcccgcc

SEQ ID NO: 883370 - RNA, 24 nt, Human
ugcgcaggcuggaguguaguggca

SEQ ID NO: 883371 - RNA, 23 nt, Human
uggaguguaguggcacgaucuca

SEQ ID NO: 883372 - RNA, 24 nt, Human
uggaguguaguggcacgaucucag

SEQ ID NO: 883373 - RNA, 24 nt, Human
uggcacgaucucagcucacugcca

SEQ ID NO: 883374 - RNA, 20 nt, Human
uggcaugaaagggucuacag

SEQ ID NO: 883375 - RNA, 21 nt, Human
uggcaugaaagggucuacagu

SEQ ID NO: 883376 - RNA, 21 nt, Human
ugggauuacaggugcccgcca

SEQ ID NO: 883377 - RNA, 22 nt, Human
ugggauuacaggugcccgccac

SEQ ID NO: 883378 - RNA, 24 nt, Human
ugggauuacaggugcccgccacca

SEQ ID NO: 883379 - RNA, 22 nt, Human
ugucaggcuggucuugaacucc

SEQ ID NO: 883380 - RNA, 21 nt, Human
ugucuccaaguagcugggauu

SEQ ID NO: 883381 - RNA, 24 nt, Human
uugcgcaggcuggaguguaguggc

SEQ ID NO: 883382 - RNA, 24 nt, Human
uuuacuagagaugagguuucucca

SEQ ID NO: 883383 - RNA, 18 nt, Human
acagugcccucucaaaac

SEQ ID NO: 883384 - RNA, 22 nt, Human
agagaacaguucugguaguauu

SEQ ID NO: 883385 - RNA, 19 nt, Human
agaucuaaugagcagcccc

SEQ ID NO: 883386 - RNA, 24 nt, Human
agcaaauaugaaaauagaaagucc

SEQ ID NO: 883387 - RNA, 24 nt, Human
aguaucaaaagaucuaaugagcag

SEQ ID NO: 883388 - RNA, 20 nt, Human
auuucacaugguaaaguauc

SEQ ID NO: 883389 - RNA, 22 nt, Human
caaauaugaaaauagaaagucc

SEQ ID NO: 883390 - RNA, 22 nt, Human
caauguguuucucuuccgaauu

SEQ ID NO: 883391 - RNA, 26 nt, Human
cccaaguugacagugcccucucaaaa

SEQ ID NO: 883392 - RNA, 20 nt, Human
ccuccugucuuaaacccaag

SEQ ID NO: 883393 - RNA, 25 nt, Human
ccuccugucuuaaacccaaguugac

SEQ ID NO: 883394 - RNA, 19 nt, Human
ccucuacagaaaaaguggg

SEQ ID NO: 883395 - RNA, 24 nt, Human
uaauaugagaaaaaaaaagaugau

SEQ ID NO: 883396 - RNA, 24 nt, Human
uacacaacauacuuuuauguuucu

SEQ ID NO: 883397 - RNA, 23 nt, Human
uaucuaauaaaaguuuauuugug

SEQ ID NO: 883398 - RNA, 21 nt, Human
uaucuuagauaugaauccuaa

SEQ ID NO: 883399 - RNA, 20 nt, Human
ugaaaauacuuucuugcaac

SEQ ID NO: 883400 - RNA, 24 nt, Human
ugaaaggugugaacuugcaauguc

SEQ ID NO: 883401 - RNA, 19 nt, Human
uguaauaugagaaaaaaaa

SEQ ID NO: 883402 - RNA, 22 nt, Human
uuuguccauuuguaauaugaga

SEQ ID NO: 883403 - RNA, 21 nt, Human
uuuuucacuuuaacaaaucua

SEQ ID NO: 883404 - RNA, 19 nt, Human
uuuuuuuuuuuuucacuuu

SEQ ID NO: 883405 - RNA, 23 nt, Human
uuuuuuuuuuuuuuuuucacuuu

SEQ ID NO: 883406 - RNA, 27 nt, Human
uuuuuuuuuuuuuuuuuuucacuuuaa

SEQ ID NO: 883407 - RNA, 21 nt, Human
accuccgccccggaagaacuc

SEQ ID NO: 883408 - RNA, 21 nt, Human
ccggaagaacucgugcaggcg

SEQ ID NO: 883409 - RNA, 23 nt, Human
cgccccggaagaacucgugcagg

SEQ ID NO: 883410 - RNA, 20 nt, Human
gccggcugcuuagcaggccu

SEQ ID NO: 883411 - RNA, 19 nt, Human
gcgggauagacuuccggcc

SEQ ID NO: 883412 - RNA, 19 nt, Human
gcgugaggccgugaauggc

SEQ ID NO: 883413 - RNA, 24 nt, Human
uagacuuccggccgccggcugcuu

SEQ ID NO: 883414 - RNA, 23 nt, Human
ugaccuccgccccggaagaacuc

SEQ ID NO: 883415 - RNA, 21 nt, Human
uguccuaguccacgcuaaaau

SEQ ID NO: 883416 - RNA, 21 nt, Human
uuuugcgcuccgugacccuuc

SEQ ID NO: 883417 - RNA, 19 nt, Human
uuuuuuuuuuuuuuugugg

SEQ ID NO: 883418 - RNA, 27 nt, Human
uuuuuuuuuuuuuuugugguagcaggg

SEQ ID NO: 883419 - RNA, 19 nt, Human
uuuuuuuuuuuuuuuuugu

SEQ ID NO: 883420 - RNA, 22 nt, Human
uuuuuuuuuuuuuuuuuugugg

SEQ ID NO: 883421 - RNA, 20 nt, Human
aaaauaguguuaagaugcga

SEQ ID NO: 883422 - RNA, 19 nt, Human
aaacaaacacauauguaga

SEQ ID NO: 883423 - RNA, 24 nt, Human
aaaguguugggauuacaggcguga

SEQ ID NO: 883424 - RNA, 21 nt, Human
aaguguugggauuacaggcgu

SEQ ID NO: 883425 - RNA, 26 nt, Human
aaguguugggauuacaggcgugagcc

SEQ ID NO: 883426 - RNA, 23 nt, Human
acaguaugaaaacaauuaaaaac

SEQ ID NO: 883427 - RNA, 19 nt, Human
acauuggccaggcuggucu

SEQ ID NO: 883428 - RNA, 18 nt, Human
acccggcccugaaugucc

SEQ ID NO: 883429 - RNA, 20 nt, Human
acugcaacuccaccuccugg

SEQ ID NO: 883430 - RNA, 21 nt, Human
acugcaacuccaccuccuggg

SEQ ID NO: 883431 - RNA, 22 nt, Human
acugcaacuccaccuccugggu

SEQ ID NO: 883432 - RNA, 24 nt, Human
acugcaacuccaccuccuggguuc

SEQ ID NO: 883433 - RNA, 21 nt, Human
agaaaacagacauguagaaaa

SEQ ID NO: 883434 - RNA, 26 nt, Human
agaaacaaacacauauguagacagaa

SEQ ID NO: 883435 - RNA, 19 nt, Human
aggcacccgccaccacacc

SEQ ID NO: 883436 - RNA, 19 nt, Human
aggcacccgccaccacacc

SEQ ID NO: 883437 - RNA, 24 nt, Human
aggugauccacccaccucggccuu

SEQ ID NO: 883438 - RNA, 24 nt, Human
agugcaggggcacgaucuuggcuu

SEQ ID NO: 883439 - RNA, 18 nt, Human
aucacgucuacaacuuau

SEQ ID NO: 883440 - RNA, 22 nt, Human
augagaaaacagacauguagaa

SEQ ID NO: 883441 - RNA, 24 nt, Human
augcaaaugcgguaaacuaacauu

SEQ ID NO: 883442 - RNA, 24 nt, Human
auugcuaucuuucaucaaaggguc

SEQ ID NO: 883443 - RNA, 24 nt, Human
caaaguguugggauuacaggcgug

SEQ ID NO: 883444 - RNA, 22 nt, Human
caacuccaccuccuggguucaa

SEQ ID NO: 883445 - RNA, 20 nt, Human
caagcgauucuccugccuca

SEQ ID NO: 883446 - RNA, 22 nt, Human
caagcgauucuccugccucagc

SEQ ID NO: 883447 - RNA, 24 nt, Human
cacauuggccaggcuggucuugaa

SEQ ID NO: 883448 - RNA, 21 nt, Human
caccacauuggccaggcuggu

SEQ ID NO: 883449 - RNA, 24 nt, Human
caccacauuggccaggcuggucuu

SEQ ID NO: 883450 - RNA, 27 nt, Human
caccacauuggccaggcuggucuugaa

SEQ ID NO: 883451 - RNA, 22 nt, Human
cacccaccucggccuuccaaag

SEQ ID NO: 883452 - RNA, 23 nt, Human
cacccaccucggccuuccaaagu

SEQ ID NO: 883453 - RNA, 24 nt, Human
cacucuuucgcccagccugaagug

SEQ ID NO: 883454 - RNA, 20 nt, Human
cacuuuacagaugagaaaac

SEQ ID NO: 883455 - RNA, 24 nt, Human
cagaaagguaaugcaaaugcggua

SEQ ID NO: 883456 - RNA, 19 nt, Human
cagccugaagugcaggggc

SEQ ID NO: 883457 - RNA, 22 nt, Human
cauuggccaggcuggucuugaa

SEQ ID NO: 883458 - RNA, 22 nt, Human
ccaaaguguugggauuacaggc

SEQ ID NO: 883459 - RNA, 22 nt, Human
ccaaaguguugggauuacaggc

SEQ ID NO: 883460 - RNA, 24 nt, Human
ccaaaguguugggauuacaggcgu

SEQ ID NO: 883461 - RNA, 24 nt, Human
ccaccuccuggguucaagcgauuc

SEQ ID NO: 883462 - RNA, 21 nt, Human
ccacugcacccggcccugaau

SEQ ID NO: 883463 - RNA, 23 nt, Human
cccgcguggcugggauuauaggc

SEQ ID NO: 883464 - RNA, 24 nt, Human
ccuccuggguucaagcgauucucc

SEQ ID NO: 883465 - RNA, 24 nt, Human
ccugaccucaggugauccacccac

SEQ ID NO: 883466 - RNA, 23 nt, Human
ccugccucagccucccgcguggc

SEQ ID NO: 883467 - RNA, 23 nt, Human
ccuggguucaagcgauucuccug

SEQ ID NO: 883468 - RNA, 21 nt, Human
cuccuggguucaagcgauucu

SEQ ID NO: 883469 - RNA, 22 nt, Human
cugcaacuccaccuccuggguu

SEQ ID NO: 883470 - RNA, 23 nt, Human
cugccucagccucccgcguggcu

SEQ ID NO: 883471 - RNA, 24 nt, Human
cuuacugcaacuccaccuccuggg

SEQ ID NO: 883472 - RNA, 24 nt, Human
gaccucaggugauccacccaccuc

SEQ ID NO: 883473 - RNA, 18 nt, Human
gauuacaggcgugagcca

SEQ ID NO: 883474 - RNA, 22 nt, Human
gauuacaggcgugagccacugc

SEQ ID NO: 883475 - RNA, 23 nt, Human
gauuacaggcgugagccacugca

SEQ ID NO: 883476 - RNA, 21 nt, Human
gauucuccugccucagccucc

SEQ ID NO: 883477 - RNA, 18 nt, Human
gcaaaugcgguaaacuaa

SEQ ID NO: 883478 - RNA, 24 nt, Human
gcgauucuccugccucagccuccc

SEQ ID NO: 883479 - RNA, 23 nt, Human
gcuggucuugaacuccugaccuc

SEQ ID NO: 883480 - RNA, 18 nt, Human
ggaauggaaacaaagaaa

SEQ ID NO: 883481 - RNA, 24 nt, Human
ggcuggucuugaacuccugaccuc

SEQ ID NO: 883482 - RNA, 19 nt, Human
ggucuugaacuccugaccu

SEQ ID NO: 883483 - RNA, 25 nt, Human
guagaaaagcucccaaaauguggca

SEQ ID NO: 883484 - RNA, 18 nt, Human
gucucacucuuucgccca

SEQ ID NO: 883485 - RNA, 24 nt, Human
gugauccacccaccucggccuucc

SEQ ID NO: 883486 - RNA, 24 nt, Human
uaauuuuugcauuuuuaguagaga

SEQ ID NO: 883487 - RNA, 19 nt, Human
uacaggcgugagccacugc

SEQ ID NO: 883488 - RNA, 23 nt, Human
uacaggcgugagccacugcaccc

SEQ ID NO: 883489 - RNA, 22 nt, Human
uacugcaacuccaccuccuggg

SEQ ID NO: 883490 - RNA, 28 nt, Human
uaguagagagaggguugauuucaccaca

SEQ ID NO: 883491 - RNA, 19 nt, Human
ucaagcgauucuccugccu

SEQ ID NO: 883492 - RNA, 23 nt, Human
uccaaaguguugggauuacaggc

SEQ ID NO: 883493 - RNA, 24 nt, Human
uccaaaguguugggauuacaggcg

SEQ ID NO: 883494 - RNA, 24 nt, Human
ucccgcguggcugggauuauaggc

SEQ ID NO: 883495 - RNA, 21 nt, Human
uccuggguucaagcgauucuc

SEQ ID NO: 883496 - RNA, 24 nt, Human
uccuggguucaagcgauucuccug

SEQ ID NO: 883497 - RNA, 24 nt, Human
ucucacucuuucgcccagccugaa

SEQ ID NO: 883498 - RNA, 26 nt, Human
ucuccugccucagccucccgcguggc

SEQ ID NO: 883499 - RNA, 23 nt, Human
ucuugaacuccugaccucaggug

SEQ ID NO: 883500 - RNA, 24 nt, Human
ugaagugcaggggcacgaucuugg

SEQ ID NO: 883501 - RNA, 21 nt, Human
ugaccucaggugauccaccca

SEQ ID NO: 883502 - RNA, 24 nt, Human
ugaccucaggugauccacccaccu

SEQ ID NO: 883503 - RNA, 19 nt, Human
ugagaaaacagacauguag

SEQ ID NO: 883504 - RNA, 24 nt, Human
ugauccacccaccucggccuucca

SEQ ID NO: 883505 - RNA, 21 nt, Human
ugcacccggcccugaaugucc

SEQ ID NO: 883506 - RNA, 24 nt, Human
ugccucagccucccgcguggcugg

SEQ ID NO: 883507 - RNA, 18 nt, Human
uggaaacaaagaaaauuu

SEQ ID NO: 883508 - RNA, 24 nt, Human
uggccaggcuggucuugaacuccu

SEQ ID NO: 883509 - RNA, 18 nt, Human
ugggauuacaggcgugag

SEQ ID NO: 883510 - RNA, 19 nt, Human
ugggauuacaggcgugagc

SEQ ID NO: 883511 - RNA, 21 nt, Human
ugggauuacaggcgugagcca

SEQ ID NO: 883512 - RNA, 22 nt, Human
ugggauuacaggcgugagccac

SEQ ID NO: 883513 - RNA, 22 nt, Human
ugggauuacaggcgugagccac

SEQ ID NO: 883514 - RNA, 24 nt, Human
ugggauuacaggcgugagccacug

SEQ ID NO: 883515 - RNA, 26 nt, Human
ugggauuacaggcgugagccacugca

SEQ ID NO: 883516 - RNA, 21 nt, Human
ugggauuauaggcacccgcca

SEQ ID NO: 883517 - RNA, 22 nt, Human
ugggauuauaggcacccgccac

SEQ ID NO: 883518 - RNA, 24 nt, Human
ugggauuauaggcacccgccacca

SEQ ID NO: 883519 - RNA, 23 nt, Human
uggguucaagcgauucuccugcc

SEQ ID NO: 883520 - RNA, 24 nt, Human
uggguucaagcgauucuccugccu

SEQ ID NO: 883521 - RNA, 19 nt, Human
uggugggugcaauuuuggu

SEQ ID NO: 883522 - RNA, 23 nt, Human
uuacugcaacuccaccuccuggg

SEQ ID NO: 883523 - RNA, 19 nt, Human
uuauaggcacccgccacca

SEQ ID NO: 883524 - RNA, 21 nt, Human
uucaagcgauucuccugccuc

SEQ ID NO: 883525 - RNA, 23 nt, Human
uucaagcgauucuccugccucag

SEQ ID NO: 883526 - RNA, 24 nt, Human
uucaagcgauucuccugccucagc

SEQ ID NO: 883527 - RNA, 25 nt, Human
uuuauaaacauguuuuacuuccuuu

SEQ ID NO: 883528 - RNA, 20 nt, Human
uuuuugcauuuuuaguagag

SEQ ID NO: 883529 - RNA, 19 nt, Human
aaguacuggagacaauggc

SEQ ID NO: 883530 - RNA, 19 nt, Human
aaguacuggagacaauggc

SEQ ID NO: 883531 - RNA, 21 nt, Human
aggaagaagcuaaacagguuu

SEQ ID NO: 883532 - RNA, 25 nt, Human
agggugcuugcacauuucugcucca

SEQ ID NO: 883533 - RNA, 18 nt, Human
caaaucuacagccuggua

SEQ ID NO: 883534 - RNA, 18 nt, Human
cacugcucccgauucugc

SEQ ID NO: 883535 - RNA, 18 nt, Human
caggaaaggcccccgcca

SEQ ID NO: 883536 - RNA, 21 nt, Human
caggaaaggcccccgccagug

SEQ ID NO: 883537 - RNA, 24 nt, Human
cauuucugcuccacugcucccgau

SEQ ID NO: 883538 - RNA, 19 nt, Human
ccaauggaggaagaagcua

SEQ ID NO: 883539 - RNA, 18 nt, Human
ccacugcucccgauucug

SEQ ID NO: 883540 - RNA, 24 nt, Human
cuggagacaauggcuggcucuccu

SEQ ID NO: 883541 - RNA, 23 nt, Human
gaaaggcccccgccagugcugcc

SEQ ID NO: 883542 - RNA, 18 nt, Human
gacaauggcuggcucucc

SEQ ID NO: 883543 - RNA, 21 nt, Human
gccagugcugccugcggcgcg

SEQ ID NO: 883544 - RNA, 19 nt, Human
ggaggaagaagcuaaacag

SEQ ID NO: 883545 - RNA, 19 nt, Human
ggagugagaucagggugcu

SEQ ID NO: 883546 - RNA, 19 nt, Human
uacugcaucuagcuuauca

SEQ ID NO: 883547 - RNA, 19 nt, Human
uccaauggaggaagaagcu

SEQ ID NO: 883548 - RNA, 22 nt, Human
ucccaauaaacuccaauggagg

SEQ ID NO: 883549 - RNA, 24 nt, Human
ucuacagccugguacuucuggaac

SEQ ID NO: 883550 - RNA, 19 nt, Human
ucuacugcaucuagcuuau

SEQ ID NO: 883551 - RNA, 23 nt, Human
ucuguauuuggucagagcuggga

SEQ ID NO: 883552 - RNA, 24 nt, Human
ugagaaugaggcaaguacuggaga

SEQ ID NO: 883553 - RNA, 21 nt, Human
ugagaccugagggaggacccc

SEQ ID NO: 883554 - RNA, 25 nt, Human
uggaugaugagaaugaggcaaguac

SEQ ID NO: 883555 - RNA, 18 nt, Human
uggcaaaaaugaagaauu

SEQ ID NO: 883556 - RNA, 23 nt, Human
ugggagugagaucagggugcuug

SEQ ID NO: 883557 - RNA, 20 nt, Human
ugguacuucuggaacaggac

SEQ ID NO: 883558 - RNA, 21 nt, Human
uuuuuuuuuuuuaaaaagaac

SEQ ID NO: 883559 - RNA, 24 nt, Human
aaacagagugacauuuaccaaaau

SEQ ID NO: 883560 - RNA, 24 nt, Human
aaagaugugcaggaaaccacaaaa

SEQ ID NO: 883561 - RNA, 24 nt, Human
aaagugcugggauuacaggcguga

SEQ ID NO: 883562 - RNA, 18 nt, Human
aaaguuccauucccugcc

SEQ ID NO: 883563 - RNA, 24 nt, Human
aaauagcaaaaacuuuaagggagc

SEQ ID NO: 883564 - RNA, 22 nt, Human
aaaucaucucagcuggaagcac

SEQ ID NO: 883565 - RNA, 26 nt, Human
aacacacugauaccugauagcauuac

SEQ ID NO: 883566 - RNA, 19 nt, Human
aagugcugggauuacaggc

SEQ ID NO: 883567 - RNA, 19 nt, Human
aagugcugggauuacaggc

SEQ ID NO: 883568 - RNA, 26 nt, Human
aagugcugggauuacaggcgugagcc

SEQ ID NO: 883569 - RNA, 18 nt, Human
acgggguuucaccguguu

SEQ ID NO: 883570 - RNA, 19 nt, Human
acgggguuucaccguguua

SEQ ID NO: 883571 - RNA, 20 nt, Human
acgggguuucaccguguuag

SEQ ID NO: 883572 - RNA, 24 nt, Human
acgggguuucaccguguuagccag

SEQ ID NO: 883573 - RNA, 18 nt, Human
agaagcuuaauaaagaaa

SEQ ID NO: 883574 - RNA, 19 nt, Human
agagacgggguuucaccgu

SEQ ID NO: 883575 - RNA, 25 nt, Human
agcacuucucugggguugcuauacc

SEQ ID NO: 883576 - RNA, 22 nt, Human
aggaaaaaagaauaggcaaugc

SEQ ID NO: 883577 - RNA, 23 nt, Human
aggcgugagccaccgugccuggc

SEQ ID NO: 883578 - RNA, 25 nt, Human
aggcuggagugcaguggcgcgaucu

SEQ ID NO: 883579 - RNA, 23 nt, Human
aguagcugggauuacaggcacgu

SEQ ID NO: 883580 - RNA, 20 nt, Human
agugcaguggcgcgaucucg

SEQ ID NO: 883581 - RNA, 24 nt, Human
agugcaguggcgcgaucucgucuc

SEQ ID NO: 883582 - RNA, 22 nt, Human
aguucugggcuccaagaagagg

SEQ ID NO: 883583 - RNA, 24 nt, Human
caaagugcugggauuacaggcgug

SEQ ID NO: 883584 - RNA, 20 nt, Human
caccaguagcguaacaaaau

SEQ ID NO: 883585 - RNA, 24 nt, Human
caccauguccagcuaauuuuugua

SEQ ID NO: 883586 - RNA, 18 nt, Human
caccguguuagccaggau

SEQ ID NO: 883587 - RNA, 22 nt, Human
caccguguuagccaggaugguc

SEQ ID NO: 883588 - RNA, 22 nt, Human
cacgcgauucuccugccucagc

SEQ ID NO: 883589 - RNA, 22 nt, Human
cacucuccacuuaaacauacuc

SEQ ID NO: 883590 - RNA, 18 nt, Human
cacugcagccuccaccgg

SEQ ID NO: 883591 - RNA, 19 nt, Human
cagacaucuccuaacaaac

SEQ ID NO: 883592 - RNA, 20 nt, Human
cagccuccugaguagcuggg

SEQ ID NO: 883593 - RNA, 22 nt, Human
ccaaagugcugggauuacaggc

SEQ ID NO: 883594 - RNA, 22 nt, Human
ccaaagugcugggauuacaggc

SEQ ID NO: 883595 - RNA, 24 nt, Human
ccaaagugcugggauuacaggcgu

SEQ ID NO: 883596 - RNA, 26 nt, Human
ccacccucauuucaaauuuaggcaaa

SEQ ID NO: 883597 - RNA, 26 nt, Human
ccccaaauuagcauaugccagccugc

SEQ ID NO: 883598 - RNA, 25 nt, Human
cccccaaauuagcauaugccagccu

SEQ ID NO: 883599 - RNA, 20 nt, Human
cccggguucacgcgauucuc

SEQ ID NO: 883600 - RNA, 23 nt, Human
cccggguucacgcgauucuccug

SEQ ID NO: 883601 - RNA, 22 nt, Human
ccuccaccgggcccggguucac

SEQ ID NO: 883602 - RNA, 23 nt, Human
ccugaguagcugggauuacaggc

SEQ ID NO: 883603 - RNA, 24 nt, Human
ccugaguagcugggauuacaggca

SEQ ID NO: 883604 - RNA, 23 nt, Human
ccugccucagccuccugaguagc

SEQ ID NO: 883605 - RNA, 23 nt, Human
cgcucugucgccaggcuggagug

SEQ ID NO: 883606 - RNA, 24 nt, Human
cgggguuucaccguguuagccagg

SEQ ID NO: 883607 - RNA, 28 nt, Human
cgugagccaccgugccuggccugcuuug

SEQ ID NO: 883608 - RNA, 22 nt, Human
cucaaucugaauuaaccaaaga

SEQ ID NO: 883609 - RNA, 18 nt, Human
cucacugcagccuccacc

SEQ ID NO: 883610 - RNA, 24 nt, Human
cucagccuccugaguagcugggau

SEQ ID NO: 883611 - RNA, 22 nt, Human
cuccugccucagccuccugagu

SEQ ID NO: 883612 - RNA, 23 nt, Human
cucgcucugucgccaggcuggag

SEQ ID NO: 883613 - RNA, 19 nt, Human
cucuauaaaguucugggcu

SEQ ID NO: 883614 - RNA, 24 nt, Human
cucuugaccucgugauccgccugc

SEQ ID NO: 883615 - RNA, 23 nt, Human
cugaguagcugggauuacaggca

SEQ ID NO: 883616 - RNA, 23 nt, Human
cugccucagccuccugaguagcu

SEQ ID NO: 883617 - RNA, 23 nt, Human
cugccucggccucccaaagugcu

SEQ ID NO: 883618 - RNA, 22 nt, Human
gaccucgugauccgccugccuc

SEQ ID NO: 883619 - RNA, 22 nt, Human
gaccucgugauccgccugccuc

SEQ ID NO: 883620 - RNA, 24 nt, Human
gaccucgugauccgccugccucgg

SEQ ID NO: 883621 - RNA, 19 nt, Human
gagaagcuuaauaaagaaa

SEQ ID NO: 883622 - RNA, 24 nt, Human
gagacgggguuucaccguguuagc

SEQ ID NO: 883623 - RNA, 21 nt, Human
gagcaguuaggacagacucaa

SEQ ID NO: 883624 - RNA, 25 nt, Human
gaguagcugggauuacaggcacgug

SEQ ID NO: 883625 - RNA, 25 nt, Human
gaucucgucucacugcagccuccac

SEQ ID NO: 883626 - RNA, 18 nt, Human
gauuacaggcacgugcca

SEQ ID NO: 883627 - RNA, 18 nt, Human
gauuacaggcgugagcca

SEQ ID NO: 883628 - RNA, 21 nt, Human
gauuacaggcgugagccaccg

SEQ ID NO: 883629 - RNA, 24 nt, Human
gauuacaggcgugagccaccgugc

SEQ ID NO: 883630 - RNA, 24 nt, Human
gcagccuccaccgggcccggguuc

SEQ ID NO: 883631 - RNA, 24 nt, Human
gcccggguucacgcgauucuccug

SEQ ID NO: 883632 - RNA, 24 nt, Human
gcgauucuccugccucagccuccu

SEQ ID NO: 883633 - RNA, 19 nt, Human
gcugcaauucuuuuaaugg

SEQ ID NO: 883634 - RNA, 19 nt, Human
gcuggagugcaguggcgcg

SEQ ID NO: 883635 - RNA, 20 nt, Human
ggaaaccacaaaagacaugg

SEQ ID NO: 883636 - RNA, 23 nt, Human
gggcuccaagaagaggucagugc

SEQ ID NO: 883637 - RNA, 23 nt, Human
gggguuucaccguguuagccagg

SEQ ID NO: 883638 - RNA, 19 nt, Human
ggguacuuaacuacagugc

SEQ ID NO: 883639 - RNA, 18 nt, Human
guaacccugguaggcaac

SEQ ID NO: 883640 - RNA, 18 nt, Human
guagcugggauuacaggc

SEQ ID NO: 883641 - RNA, 19 nt, Human
gucaaagugguuugcucau

SEQ ID NO: 883642 - RNA, 24 nt, Human
gucucgcucugucgccaggcugga

SEQ ID NO: 883643 - RNA, 20 nt, Human
guuccauucccugcccucag

SEQ ID NO: 883644 - RNA, 22 nt, Human
uaaaaaaaaauaaggguacgaa

SEQ ID NO: 883645 - RNA, 23 nt, Human
uaaaguuuaugcaguaaaagcuu

SEQ ID NO: 883646 - RNA, 24 nt, Human
uaauuuuuguauuuuuauuagaga

SEQ ID NO: 883647 - RNA, 24 nt, Human
uacaggcacgugccaccaugucca

SEQ ID NO: 883648 - RNA, 22 nt, Human
uacaggcgugagccaccgugcc

SEQ ID NO: 883649 - RNA, 23 nt, Human
uacaggcgugagccaccgugccu

SEQ ID NO: 883650 - RNA, 21 nt, Human
uaccaaaauaaagagggcuuc

SEQ ID NO: 883651 - RNA, 18 nt, Human
uagagacgggguuucacc

SEQ ID NO: 883652 - RNA, 18 nt, Human
uagagacgggguuucacc

SEQ ID NO: 883653 - RNA, 22 nt, Human
uagagacgggguuucaccgugu

SEQ ID NO: 883654 - RNA, 20 nt, Human
uagcaaaaacuuuaacugcu

SEQ ID NO: 883655 - RNA, 24 nt, Human
uaggauaaauaauacaacuaguaa

SEQ ID NO: 883656 - RNA, 18 nt, Human
uauaccaacuguuucagc

SEQ ID NO: 883657 - RNA, 24 nt, Human
uauuagagacgggguuucaccgug

SEQ ID NO: 883658 - RNA, 26 nt, Human
uauuagagacgggguuucaccguguu

SEQ ID NO: 883659 - RNA, 24 nt, Human
ucaccguguuagccaggauggucu

SEQ ID NO: 883660 - RNA, 19 nt, Human
ucacugcagccuccaccgg

SEQ ID NO: 883661 - RNA, 20 nt, Human
ucacugcagccuccaccggg

SEQ ID NO: 883662 - RNA, 21 nt, Human
ucacugcagccuccaccgggc

SEQ ID NO: 883663 - RNA, 26 nt, Human
ucacugcagccuccaccgggcccggg

SEQ ID NO: 883664 - RNA, 20 nt, Human
ucagccuccugaguagcugg

SEQ ID NO: 883665 - RNA, 21 nt, Human
ucagucaaagugguuugcuca

SEQ ID NO: 883666 - RNA, 24 nt, Human
ucccaaagugcugggauuacaggc

SEQ ID NO: 883667 - RNA, 24 nt, Human
uccugaguagcugggauuacaggc

SEQ ID NO: 883668 - RNA, 24 nt, Human
ucgccaggcuggagugcaguggcg

SEQ ID NO: 883669 - RNA, 18 nt, Human
ucggccucccaaagugcu

SEQ ID NO: 883670 - RNA, 21 nt, Human
ucuccuaacaaacagagugac

SEQ ID NO: 883671 - RNA, 22 nt, Human
ucucgcucugucgccaggcugg

SEQ ID NO: 883672 - RNA, 23 nt, Human
ucucgcucugucgccaggcugga

SEQ ID NO: 883673 - RNA, 18 nt, Human
ucugucgccaggcuggag

SEQ ID NO: 883674 - RNA, 21 nt, Human
ucugucgccaggcuggagugc

SEQ ID NO: 883675 - RNA, 23 nt, Human
ucugucgccaggcuggagugcag

SEQ ID NO: 883676 - RNA, 26 nt, Human
ucuuaaaaaaaaauaaggguacgaac

SEQ ID NO: 883677 - RNA, 20 nt, Human
ugaaggucauggggcacaag

SEQ ID NO: 883678 - RNA, 22 nt, Human
ugagacggugucucgcucuguc

SEQ ID NO: 883679 - RNA, 24 nt, Human
ugccucagccuccugaguagcugg

SEQ ID NO: 883680 - RNA, 21 nt, Human
ugccucggccucccaaagugc

SEQ ID NO: 883681 - RNA, 24 nt, Human
ugccucggccucccaaagugcugg

SEQ ID NO: 883682 - RNA, 22 nt, Human
ugcugaaaucagaacugaaaca

SEQ ID NO: 883683 - RNA, 24 nt, Human
ugcugggauuacaggcgugagcca

SEQ ID NO: 883684 - RNA, 23 nt, Human
uggagugcaguggcgcgaucucg

SEQ ID NO: 883685 - RNA, 18 nt, Human
ugggauuacaggcacgug

SEQ ID NO: 883686 - RNA, 21 nt, Human
ugggauuacaggcacgugcca

SEQ ID NO: 883687 - RNA, 22 nt, Human
ugggauuacaggcacgugccac

SEQ ID NO: 883688 - RNA, 24 nt, Human
ugggauuacaggcacgugccacca

SEQ ID NO: 883689 - RNA, 18 nt, Human
ugggauuacaggcgugag

SEQ ID NO: 883690 - RNA, 21 nt, Human
ugggauuacaggcgugagcca

SEQ ID NO: 883691 - RNA, 22 nt, Human
ugggauuacaggcgugagccac

SEQ ID NO: 883692 - RNA, 23 nt, Human
ugggauuacaggcgugagccacc

SEQ ID NO: 883693 - RNA, 23 nt, Human
ugggauuacaggcgugagccacc

SEQ ID NO: 883694 - RNA, 24 nt, Human
ugggauuacaggcgugagccaccg

SEQ ID NO: 883695 - RNA, 20 nt, Human
ugguaggcaacucuauaaag

SEQ ID NO: 883696 - RNA, 18 nt, Human
ugucucgcucugucgcca

SEQ ID NO: 883697 - RNA, 19 nt, Human
uuagagacgggguuucacc

SEQ ID NO: 883698 - RNA, 24 nt, Human
uuauuagagacgggguuucaccgu

SEQ ID NO: 883699 - RNA, 18 nt, Human
uucacgcgauucuccugc

SEQ ID NO: 883700 - RNA, 18 nt, Human
uucugggcuccaagaaga

SEQ ID NO: 883701 - RNA, 19 nt, Human
uuucaccguguuagccagg

SEQ ID NO: 883702 - RNA, 26 nt, Human
uuucagggcuuuagccacuauuucau

SEQ ID NO: 883703 - RNA, 22 nt, Human
uuugcucauguuugcugaaauc

SEQ ID NO: 883704 - RNA, 23 nt, Human
uuuucuuuuuuuuuuuuuuuggg

SEQ ID NO: 883705 - RNA, 24 nt, Human
uuuuuauuagagacgggguuucac

SEQ ID NO: 883706 - RNA, 20 nt, Human
uuuuuguauuuuuauuagag

SEQ ID NO: 883707 - RNA, 23 nt, Human
uuuuuguauuuuuauuagagacg

SEQ ID NO: 883708 - RNA, 25 nt, Human
uuuuuuuuuuuugagacggugucuc

SEQ ID NO: 883709 - RNA, 22 nt, Human
aucuccaacaagcauauucugg

SEQ ID NO: 883710 - RNA, 19 nt, Human
auugaccccagucaguuuc

SEQ ID NO: 883711 - RNA, 22 nt, Human
cacacccaucuccagcuggagg

SEQ ID NO: 883712 - RNA, 26 nt, Human
cacccccuccauaugcgaaugguucg

SEQ ID NO: 883713 - RNA, 21 nt, Human
cacuguguaaggaggcaaaac

SEQ ID NO: 883714 - RNA, 19 nt, Human
cagcuggaggugcaagcaa

SEQ ID NO: 883715 - RNA, 23 nt, Human
ccaugagugccugucggggaggg

SEQ ID NO: 883716 - RNA, 18 nt, Human
ccccuguagcuccccucu

SEQ ID NO: 883717 - RNA, 21 nt, Human
ccucuuguaagagaugcaaag

SEQ ID NO: 883718 - RNA, 24 nt, Human
cugagauggugggucacccccucc

SEQ ID NO: 883719 - RNA, 19 nt, Human
gagagcucugacagggagc

SEQ ID NO: 883720 - RNA, 19 nt, Human
ucuagcaguuccgggacuu

SEQ ID NO: 883721 - RNA, 24 nt, Human
ugaggucagguccaagugcaggcc

SEQ ID NO: 883722 - RNA, 24 nt, Human
uggggcacacccaucuccagcugg

SEQ ID NO: 883723 - RNA, 20 nt, Human
uuacuucuggggcacaccca

SEQ ID NO: 883724 - RNA, 25 nt, Human
uucauuagguccacugaauauuuuu

SEQ ID NO: 883725 - RNA, 25 nt, Human
uuucacuguaguucaccaggggauu

SEQ ID NO: 883726 - RNA, 21 nt, Human
uuucucagagcagaguuuggg

SEQ ID NO: 883727 - RNA, 23 nt, Human
aaaaaucuuugcuugcuggaacu

SEQ ID NO: 883728 - RNA, 18 nt, Human
aaacuuaaaaggagggua

SEQ ID NO: 883729 - RNA, 19 nt, Human
aaggaggguauaaaaaaca

SEQ ID NO: 883730 - RNA, 18 nt, Human
aaggggagcucugcaggu

SEQ ID NO: 883731 - RNA, 21 nt, Human
acuuucaaggacuuaaagagg

SEQ ID NO: 883732 - RNA, 25 nt, Human
agagaaaagauaauucacugacaug

SEQ ID NO: 883733 - RNA, 21 nt, Human
auaaaaauagggaauauauac

SEQ ID NO: 883734 - RNA, 19 nt, Human
auggagacuuucaaggacu

SEQ ID NO: 883735 - RNA, 24 nt, Human
caaaaaccccuauauguuacuaaa

SEQ ID NO: 883736 - RNA, 18 nt, Human
cagcaaagcuaguccagg

SEQ ID NO: 883737 - RNA, 20 nt, Human
caucacaagaagaaguggag

SEQ ID NO: 883738 - RNA, 19 nt, Human
cucugcaggucagcaaagc

SEQ ID NO: 883739 - RNA, 19 nt, Human
cugacaugaaacacccaaa

SEQ ID NO: 883740 - RNA, 21 nt, Human
cugcaagcucaauagguucug

SEQ ID NO: 883741 - RNA, 20 nt, Human
cugcaagcuuggcuucccug

SEQ ID NO: 883742 - RNA, 24 nt, Human
cuggaacugcaagcuuggcuuccc

SEQ ID NO: 883743 - RNA, 18 nt, Human
cuuggcuucccugcaagc

SEQ ID NO: 883744 - RNA, 18 nt, Human
gggagcucugcaggucag

SEQ ID NO: 883745 - RNA, 20 nt, Human
ggggagcucugcaggucagc

SEQ ID NO: 883746 - RNA, 21 nt, Human
uaacaauaauaguuaagggga

SEQ ID NO: 883747 - RNA, 20 nt, Human
uaauucacugacaugaaaca

SEQ ID NO: 883748 - RNA, 19 nt, Human
ucacaagaagaaguggagc

SEQ ID NO: 883749 - RNA, 24 nt, Human
uccaggauuacaaacugccauaca

SEQ ID NO: 883750 - RNA, 20 nt, Human
ugaaacacccaaaugucuuc

SEQ ID NO: 883751 - RNA, 25 nt, Human
uguuauggauuaaauaaacauaaaa

SEQ ID NO: 883752 - RNA, 21 nt, Human
uucacugacaugaaacaccca

SEQ ID NO: 883753 - RNA, 18 nt, Human
cccgcgccgcggccgccg

SEQ ID NO: 883754 - RNA, 23 nt, Human
cucuaacccccgcggggcccgcg

SEQ ID NO: 883755 - RNA, 18 nt, Human
aagaaccugcaagccgac

SEQ ID NO: 883756 - RNA, 22 nt, Human
aagaaccugcaagccgacacca

SEQ ID NO: 883757 - RNA, 25 nt, Human
aagcccgaaaaccucgacuccggaa

SEQ ID NO: 883758 - RNA, 19 nt, Human
aagcgguacaagcccgaaa

SEQ ID NO: 883759 - RNA, 26 nt, Human
aagcgguacaagcccgaaaaccucga

SEQ ID NO: 883760 - RNA, 19 nt, Human
agagaacaaacacagaaag

SEQ ID NO: 883761 - RNA, 30 nt, Human
agagaacaaacacagaaagaaccugcaagg

SEQ ID NO: 883762 - RNA, 18 nt, Human
agggcagagaacaaacac

SEQ ID NO: 883763 - RNA, 19 nt, Human
cacagaaagaaccugcaag

SEQ ID NO: 883764 - RNA, 19 nt, Human
caccaggccgcaccgccaa

SEQ ID NO: 883765 - RNA, 24 nt, Human
caggauacuccauuuauugaacuc

SEQ ID NO: 883766 - RNA, 18 nt, Human
ccgcuacccgcacgcacc

SEQ ID NO: 883767 - RNA, 19 nt, Human
ccucgacuccggaagcgga

SEQ ID NO: 883768 - RNA, 21 nt, Human
ccugcaagccgacaccaggcc

SEQ ID NO: 883769 - RNA, 21 nt, Human
cgacaccaggccgcaccgcca

SEQ ID NO: 883770 - RNA, 23 nt, Human
cgcugcaguguuucaaaaggacc

SEQ ID NO: 883771 - RNA, 20 nt, Human
cucuacggccuuggcagggc

SEQ ID NO: 883772 - RNA, 24 nt, Human
cugcaagccgacaccaggccgcac

SEQ ID NO: 883773 - RNA, 23 nt, Human
gaacaaacacagaaagaaccugc

SEQ ID NO: 883774 - RNA, 21 nt, Human
gaaccugcaagccgacaccag

SEQ ID NO: 883775 - RNA, 25 nt, Human
gaccuuguucccacugcuaugcuca

SEQ ID NO: 883776 - RNA, 19 nt, Human
gagaacaaacacagaaaga

SEQ ID NO: 883777 - RNA, 24 nt, Human
gcagggcagagaacaaacacagaa

SEQ ID NO: 883778 - RNA, 18 nt, Human
gccgcaccgccaagcggu

SEQ ID NO: 883779 - RNA, 21 nt, Human
uacaagcccgaaaaccucgac

SEQ ID NO: 883780 - RNA, 19 nt, Human
uacccgcacgcaccagcuc

SEQ ID NO: 883781 - RNA, 19 nt, Human
uacggccuuggcagggcag

SEQ ID NO: 883782 - RNA, 18 nt, Human
uccucggagagccccgcu

SEQ ID NO: 883783 - RNA, 18 nt, Human
ugcaagccgacaccaggc

SEQ ID NO: 883784 - RNA, 22 nt, Human
uggcagggcagagaacaaacac

SEQ ID NO: 883785 - RNA, 20 nt, Human
acaccacagagaaacuggac

SEQ ID NO: 883786 - RNA, 18 nt, Human
acaguuugugaugaaacu

SEQ ID NO: 883787 - RNA, 22 nt, Human
accacagagaaacuggacacag

SEQ ID NO: 883788 - RNA, 18 nt, Human
acuuagaaaaauuucuuu

SEQ ID NO: 883789 - RNA, 21 nt, Human
agagaaacuggacacaguuug

SEQ ID NO: 883790 - RNA, 18 nt, Human
agcuauuucauaaacacc

SEQ ID NO: 883791 - RNA, 21 nt, Human
cuuuagauccuucuuccacuc

SEQ ID NO: 883792 - RNA, 20 nt, Human
uagauccuucuuccacuccc

SEQ ID NO: 883793 - RNA, 19 nt, Human
uccauaacauaaacauguc

SEQ ID NO: 883794 - RNA, 22 nt, Human
uuuagauccuucuuccacuccc

SEQ ID NO: 883795 - RNA, 18 nt, Human
uuuuuuuuuuuuuuuuug

SEQ ID NO: 883796 - RNA, 19 nt, Human
uuuuuuuuuuuuuuuuugu

SEQ ID NO: 883797 - RNA, 21 nt, Human
aaaacuccuguccccagcacu

SEQ ID NO: 883798 - RNA, 21 nt, Human
acccaauggguaagcccauga

SEQ ID NO: 883799 - RNA, 19 nt, Human
acccccugcacuucccaag

SEQ ID NO: 883800 - RNA, 18 nt, Human
aggaacucuggaagcacu

SEQ ID NO: 883801 - RNA, 26 nt, Human
agggacccaacugcccugccugccuc

SEQ ID NO: 883802 - RNA, 18 nt, Human
auaguuguggccaagggc

SEQ ID NO: 883803 - RNA, 22 nt, Human
caauugacucauuggccccauc

SEQ ID NO: 883804 - RNA, 21 nt, Human
cacugcguugggcaaaacucc

SEQ ID NO: 883805 - RNA, 24 nt, Human
caggugcaggaggaacucuggaag

SEQ ID NO: 883806 - RNA, 20 nt, Human
cauguuggagggaccaggcc

SEQ ID NO: 883807 - RNA, 20 nt, Human
ccagcacaggugcaggagga

SEQ ID NO: 883808 - RNA, 18 nt, Human
ccaggccaucgugguggg

SEQ ID NO: 883809 - RNA, 25 nt, Human
cccaggacccccugcacuucccaag

SEQ ID NO: 883810 - RNA, 19 nt, Human
cccccugcacuucccaagc

SEQ ID NO: 883811 - RNA, 18 nt, Human
cugcccugccugccucua

SEQ ID NO: 883812 - RNA, 24 nt, Human
gagcgcacacccaauggguaagcc

SEQ ID NO: 883813 - RNA, 22 nt, Human
ggaguauaguuguggccaaggg

SEQ ID NO: 883814 - RNA, 25 nt, Human
uaagccccauagcagcuggcaaggg

SEQ ID NO: 883815 - RNA, 19 nt, Human
uacugugcaggccaagggu

SEQ ID NO: 883816 - RNA, 23 nt, Human
uagucccacuguccccuguccau

SEQ ID NO: 883817 - RNA, 24 nt, Human
uaugacacugcguugggcaaaacu

SEQ ID NO: 883818 - RNA, 19 nt, Human
uccaugcauguuggaggga

SEQ ID NO: 883819 - RNA, 22 nt, Human
uccaugcauguuggagggacca

SEQ ID NO: 883820 - RNA, 19 nt, Human
ucccacuguccccuguccc

SEQ ID NO: 883821 - RNA, 24 nt, Human
ugacucaaugcucagcacccagcu

SEQ ID NO: 883822 - RNA, 19 nt, Human
ugcccaggacccccugcac

SEQ ID NO: 883823 - RNA, 24 nt, Human
ugcccugccugccucuagcuccca

SEQ ID NO: 883824 - RNA, 26 nt, Human
ugcccugccugccucuagcucccagc

SEQ ID NO: 883825 - RNA, 21 nt, Human
ugccugccucuagcucccagc

SEQ ID NO: 883826 - RNA, 24 nt, Human
uggcaagggacccaacugcccugc

SEQ ID NO: 883827 - RNA, 21 nt, Human
uggccuaagccccauagcagc

SEQ ID NO: 883828 - RNA, 19 nt, Human
ugggccuccuacuccccag

SEQ ID NO: 883829 - RNA, 23 nt, Human
uggggugggacaggaguauaguu

SEQ ID NO: 883830 - RNA, 20 nt, Human
uggguaagcccaugaaccca

SEQ ID NO: 883831 - RNA, 25 nt, Human
uuggagggaccaggccaucguggug

SEQ ID NO: 883832 - RNA, 19 nt, Human
aaagugcugggauuacagg

SEQ ID NO: 883833 - RNA, 19 nt, Human
aaagugcugggauuacagg

SEQ ID NO: 883834 - RNA, 24 nt, Human
aaagugcugggauuacaggaguga

SEQ ID NO: 883835 - RNA, 20 nt, Human
aaccuccgccuccugggauc

SEQ ID NO: 883836 - RNA, 18 nt, Human
aagugcugggauuacagg

SEQ ID NO: 883837 - RNA, 22 nt, Human
aagugcugggauuacaggaguc

SEQ ID NO: 883838 - RNA, 26 nt, Human
aagugcugggauuacaggagugagcc

SEQ ID NO: 883839 - RNA, 21 nt, Human
accacccgcccucagccucaa

SEQ ID NO: 883840 - RNA, 24 nt, Human
acccaggcuggagugcaggggugu

SEQ ID NO: 883841 - RNA, 18 nt, Human
acgagguuucaccauggu

SEQ ID NO: 883842 - RNA, 21 nt, Human
acgagguuucaccauggugcc

SEQ ID NO: 883843 - RNA, 24 nt, Human
acgagguuucaccauggugcccag

SEQ ID NO: 883844 - RNA, 20 nt, Human
acugcaacucacugcaaccu

SEQ ID NO: 883845 - RNA, 25 nt, Human
acugcaacucacugcaaccuccgcc

SEQ ID NO: 883846 - RNA, 22 nt, Human
agcccagcccaucuauuuacaa

SEQ ID NO: 883847 - RNA, 22 nt, Human
agguuucaccauggugcccagg

SEQ ID NO: 883848 - RNA, 21 nt, Human
auccuaccuuagccuccccaa

SEQ ID NO: 883849 - RNA, 23 nt, Human
auuguguaaaagcugaguuggua

SEQ ID NO: 883850 - RNA, 24 nt, Human
caaagugcugggauuacaggagug

SEQ ID NO: 883851 - RNA, 24 nt, Human
caauaguugagacuacaggugugc

SEQ ID NO: 883852 - RNA, 23 nt, Human
cacauaaaccuacauacacauua

SEQ ID NO: 883853 - RNA, 24 nt, Human
caccacacccagcuaauuuuugua

SEQ ID NO: 883854 - RNA, 24 nt, Human
caccauggugcccaggcuggucuc

SEQ ID NO: 883855 - RNA, 27 nt, Human
caccauggugcccaggcuggucucaaa

SEQ ID NO: 883856 - RNA, 18 nt, Human
cacgccuggccucucuuc

SEQ ID NO: 883857 - RNA, 25 nt, Human
cacgccuggccucucuucccagucu

SEQ ID NO: 883858 - RNA, 21 nt, Human
cacugcaaccuccgccuccug

SEQ ID NO: 883859 - RNA, 23 nt, Human
cacugcaaccuccgccuccuggg

SEQ ID NO: 883860 - RNA, 26 nt, Human
cacuggccacaaaagacacaacucuu

SEQ ID NO: 883861 - RNA, 18 nt, Human
cagcccaccuuggcuucc

SEQ ID NO: 883862 - RNA, 22 nt, Human
cagggucuagcugucacccagg

SEQ ID NO: 883863 - RNA, 24 nt, Human
cauggugcccaggcuggucucaaa

SEQ ID NO: 883864 - RNA, 19 nt, Human
ccaaagugcugggauuaca

SEQ ID NO: 883865 - RNA, 20 nt, Human
ccaaagugcugggauuacag

SEQ ID NO: 883866 - RNA, 21 nt, Human
ccaaagugcugggauuacagg

SEQ ID NO: 883867 - RNA, 24 nt, Human
ccaaagugcugggauuacaggagu

SEQ ID NO: 883868 - RNA, 19 nt, Human
cccauacacaucuguacca

SEQ ID NO: 883869 - RNA, 27 nt, Human
ccuacauacacauuaucuccuaguccc

SEQ ID NO: 883870 - RNA, 22 nt, Human
ccucagccucaagauuuauccc

SEQ ID NO: 883871 - RNA, 22 nt, Human
ccugggaucaagugaucagccc

SEQ ID NO: 883872 - RNA, 19 nt, Human
ccugggaucaagugauccu

SEQ ID NO: 883873 - RNA, 20 nt, Human
cgagguuucaccauggugcc

SEQ ID NO: 883874 - RNA, 20 nt, Human
cuaauuuuuguauuuuuugg

SEQ ID NO: 883875 - RNA, 26 nt, Human
cuacauacacauuaucuccuaguccc

SEQ ID NO: 883876 - RNA, 22 nt, Human
cuagucccucuagcucucuucc

SEQ ID NO: 883877 - RNA, 24 nt, Human
cuagucccucuagcucucuuccca

SEQ ID NO: 883878 - RNA, 24 nt, Human
cucacugcaaccuccgccuccugg

SEQ ID NO: 883879 - RNA, 25 nt, Human
cucacugcaaccuccgccuccuggg

SEQ ID NO: 883880 - RNA, 29 nt, Human
cucacugcaaccuccgccuccugggauca

SEQ ID NO: 883881 - RNA, 24 nt, Human
cugcaaccuccgccuccugggauc

SEQ ID NO: 883882 - RNA, 19 nt, Human
cugggaucaagugaucagc

SEQ ID NO: 883883 - RNA, 18 nt, Human
cugucacccaggcuggag

SEQ ID NO: 883884 - RNA, 18 nt, Human
gauuacaggagugagcca

SEQ ID NO: 883885 - RNA, 18 nt, Human
gcccaggacaggaauuga

SEQ ID NO: 883886 - RNA, 23 nt, Human
gcuggagugcaggggugugacug

SEQ ID NO: 883887 - RNA, 21 nt, Human
gguaaagacgagguuucacca

SEQ ID NO: 883888 - RNA, 21 nt, Human
guaaagacgagguuucaccau

SEQ ID NO: 883889 - RNA, 26 nt, Human
gucccucuagcucucuucccagucuu

SEQ ID NO: 883890 - RNA, 23 nt, Human
gucuagcugucacccaggcugga

SEQ ID NO: 883891 - RNA, 20 nt, Human
gugagccaccacgccuggcc

SEQ ID NO: 883892 - RNA, 21 nt, Human
gugauccuaccuuagccuccc

SEQ ID NO: 883893 - RNA, 18 nt, Human
uaaaagcugaguugguag

SEQ ID NO: 883894 - RNA, 19 nt, Human
uacaauauauagggguugg

SEQ ID NO: 883895 - RNA, 22 nt, Human
uacaggagugagccaccacgcc

SEQ ID NO: 883896 - RNA, 22 nt, Human
uacaggagugagccaccacgcc

SEQ ID NO: 883897 - RNA, 23 nt, Human
uacaggagugagccaccacgccu

SEQ ID NO: 883898 - RNA, 23 nt, Human
uacaggagugagccaccacgccu

SEQ ID NO: 883899 - RNA, 24 nt, Human
uacaggugugcaccaccacaccca

SEQ ID NO: 883900 - RNA, 18 nt, Human
uagcucucuucccagucu

SEQ ID NO: 883901 - RNA, 18 nt, Human
ucacccaggcuggagugc

SEQ ID NO: 883902 - RNA, 23 nt, Human
ucacugcaaccuccgccuccugg

SEQ ID NO: 883903 - RNA, 23 nt, Human
ucacugcaaccuccgccuccugg

SEQ ID NO: 883904 - RNA, 24 nt, Human
ucacugcaaccuccgccuccuggg

SEQ ID NO: 883905 - RNA, 25 nt, Human
ucacugcaaccuccgccuccugggg

SEQ ID NO: 883906 - RNA, 20 nt, Human
ucacuggccacaaaagacac

SEQ ID NO: 883907 - RNA, 20 nt, Human
ucagcccaccuuggcuuccc

SEQ ID NO: 883908 - RNA, 18 nt, Human
ucccaaagugcugggauu

SEQ ID NO: 883909 - RNA, 23 nt, Human
ucccaaagugcugggauuacagg

SEQ ID NO: 883910 - RNA, 22 nt, Human
uccccaauaguugagacuacag

SEQ ID NO: 883911 - RNA, 24 nt, Human
ucccucuagcucucuucccagucu

SEQ ID NO: 883912 - RNA, 19 nt, Human
uccuaccuuagccucccca

SEQ ID NO: 883913 - RNA, 21 nt, Human
ucuagcugucacccaggcugg

SEQ ID NO: 883914 - RNA, 22 nt, Human
ucuagcugucacccaggcugga

SEQ ID NO: 883915 - RNA, 24 nt, Human
ucuagcugucacccaggcuggagu

SEQ ID NO: 883916 - RNA, 24 nt, Human
ugaaacggcaacaauguuuagccc

SEQ ID NO: 883917 - RNA, 19 nt, Human
ugagacagggucuagcugu

SEQ ID NO: 883918 - RNA, 21 nt, Human
ugagacuacaggugugcacca

SEQ ID NO: 883919 - RNA, 24 nt, Human
ugagacuacaggugugcaccacca

SEQ ID NO: 883920 - RNA, 31 nt, Human
ugcaacucacugcaaccuccgccuccugggg

SEQ ID NO: 883921 - RNA, 24 nt, Human
ugcccaggcuggucucaaacuccu

SEQ ID NO: 883922 - RNA, 19 nt, Human
uggagugcaggggugugac

SEQ ID NO: 883923 - RNA, 18 nt, Human
ugggauuacaggagugag

SEQ ID NO: 883924 - RNA, 19 nt, Human
ugggauuacaggagugagc

SEQ ID NO: 883925 - RNA, 22 nt, Human
ugggauuacaggagugagccac

SEQ ID NO: 883926 - RNA, 23 nt, Human
ugggauuacaggagugagccacc

SEQ ID NO: 883927 - RNA, 24 nt, Human
ugggauuacaggagugagccacca

SEQ ID NO: 883928 - RNA, 24 nt, Human
ugguaaagacgagguuucaccaug

SEQ ID NO: 883929 - RNA, 21 nt, Human
ugucacccaggcuggagugca

SEQ ID NO: 883930 - RNA, 25 nt, Human
ugucacuggccacaaaagacacaac

SEQ ID NO: 883931 - RNA, 18 nt, Human
ugugcaccaccacaccca

SEQ ID NO: 883932 - RNA, 24 nt, Human
uugguaaagacgagguuucaccau

SEQ ID NO: 883933 - RNA, 19 nt, Human
uuuaucccuaucagcaaca

SEQ ID NO: 883934 - RNA, 24 nt, Human
uuuuugguaaagacgagguuucac

SEQ ID NO: 883935 - RNA, 24 nt, Human
uuuuuuuuuugagacagggucuag

SEQ ID NO: 883936 - RNA, 20 nt, Human
uuuuuuuuuuugagacaggg

SEQ ID NO: 883937 - RNA, 21 nt, Human
uuuuuuuuuuuuacccagaga

SEQ ID NO: 883938 - RNA, 23 nt, Human
uuuuuuuuuuuugagacaggguc

SEQ ID NO: 883939 - RNA, 24 nt, Human
uuuuuuuuuuuuuuugagacaggg

SEQ ID NO: 883940 - RNA, 23 nt, Human
uuuuuuuuuuuuuuuuuacccag

SEQ ID NO: 883941 - RNA, 24 nt, Human
uuuuuuuuuuuuuuuuuuacccag

SEQ ID NO: 883942 - RNA, 24 nt, Human
aaucauucugaacaguuuuaauuc

SEQ ID NO: 883943 - RNA, 24 nt, Human
aggccaguggaacucagaacugau

SEQ ID NO: 883944 - RNA, 22 nt, Human
aucaucucuucauguaaaagac

SEQ ID NO: 883945 - RNA, 25 nt, Human
caacauagauaaaaugugaugagug

SEQ ID NO: 883946 - RNA, 20 nt, Human
cagcaccacuauccauccca

SEQ ID NO: 883947 - RNA, 22 nt, Human
cagcaccacuauccaucccaau

SEQ ID NO: 883948 - RNA, 20 nt, Human
caucccaauguaacauuucu

SEQ ID NO: 883949 - RNA, 23 nt, Human
ccucacuccucaaacacuuuucu

SEQ ID NO: 883950 - RNA, 21 nt, Human
gguaugaaggggaagugucau

SEQ ID NO: 883951 - RNA, 25 nt, Human
uaaaucaucucuucauguaaaagac

SEQ ID NO: 883952 - RNA, 22 nt, Human
uaaaugacaaucacacagaacc

SEQ ID NO: 883953 - RNA, 18 nt, Human
uacauauauacauguaug

SEQ ID NO: 883954 - RNA, 18 nt, Human
uauuagugguaacgugaa

SEQ ID NO: 883955 - RNA, 20 nt, Human
uauuuuguccuucugugaca

SEQ ID NO: 883956 - RNA, 21 nt, Human
ucaguauuggcaucauacaac

SEQ ID NO: 883957 - RNA, 22 nt, Human
ucauucuuuaccucacuccuca

SEQ ID NO: 883958 - RNA, 21 nt, Human
uccgcguuucuuccacuuccu

SEQ ID NO: 883959 - RNA, 24 nt, Human
ucgucuaggaauauuuuguccuuc

SEQ ID NO: 883960 - RNA, 19 nt, Human
ugauacauauauacaugua

SEQ ID NO: 883961 - RNA, 21 nt, Human
ugcuaguuggaaaaucauucu

SEQ ID NO: 883962 - RNA, 18 nt, Human
uuagugguaacgugauag

SEQ ID NO: 883963 - RNA, 21 nt, Human
uucaacauagauaaaauguga

SEQ ID NO: 883964 - RNA, 21 nt, Human
aaaacagcccccuggaaccag

SEQ ID NO: 883965 - RNA, 19 nt, Human
aagcggcccaccugaaagg

SEQ ID NO: 883966 - RNA, 20 nt, Human
aaggggccguucugcacaug

SEQ ID NO: 883967 - RNA, 19 nt, Human
aaucaggucaucuggccug

SEQ ID NO: 883968 - RNA, 22 nt, Human
acaaaacagcccccuggaacca

SEQ ID NO: 883969 - RNA, 22 nt, Human
accagguagccaaggaagcggc

SEQ ID NO: 883970 - RNA, 24 nt, Human
agcagcaucucauuacaaaacagc

SEQ ID NO: 883971 - RNA, 20 nt, Human
agcagcuuggccauaccagc

SEQ ID NO: 883972 - RNA, 19 nt, Human
aggggucacggugaaggga

SEQ ID NO: 883973 - RNA, 19 nt, Human
caaaacagcccccuggaaa

SEQ ID NO: 883974 - RNA, 24 nt, Human
caaaacagcccccuggaaccaggu

SEQ ID NO: 883975 - RNA, 26 nt, Human
cacugacccagggcuggggaagggga

SEQ ID NO: 883976 - RNA, 25 nt, Human
cagcagcaucuucuagcagcuuggc

SEQ ID NO: 883977 - RNA, 20 nt, Human
cccaccaacccagcugggag

SEQ ID NO: 883978 - RNA, 21 nt, Human
cccaccugaaaggcauuuaga

SEQ ID NO: 883979 - RNA, 21 nt, Human
cccagggcuggggaaggggac

SEQ ID NO: 883980 - RNA, 19 nt, Human
ccgcucagccacugguucu

SEQ ID NO: 883981 - RNA, 23 nt, Human
ccucugaguggccugccagcagc

SEQ ID NO: 883982 - RNA, 25 nt, Human
ccugaaaggcauuuagauugagaag

SEQ ID NO: 883983 - RNA, 21 nt, Human
cggcccaccugaaaggcauuu

SEQ ID NO: 883984 - RNA, 18 nt, Human
cggugaagggagggcugc

SEQ ID NO: 883985 - RNA, 20 nt, Human
cucagacaggcuuggcugug

SEQ ID NO: 883986 - RNA, 18 nt, Human
cugugguuugcuuuggga

SEQ ID NO: 883987 - RNA, 20 nt, Human
cuuugggaggagagugaaca

SEQ ID NO: 883988 - RNA, 22 nt, Human
gaggaugccacugacccagggc

SEQ ID NO: 883989 - RNA, 18 nt, Human
gcuggaaucaggucaucu

SEQ ID NO: 883990 - RNA, 22 nt, Human
gcuggggaaggggacucccagc

SEQ ID NO: 883991 - RNA, 20 nt, Human
ggcuuggcugugguuugcuu

SEQ ID NO: 883992 - RNA, 18 nt, Human
ucacagggacagcagcau

SEQ ID NO: 883993 - RNA, 25 nt, Human
ucccaccaacccagcugggagccuc

SEQ ID NO: 883994 - RNA, 21 nt, Human
uccgcucagccacugguucug

SEQ ID NO: 883995 - RNA, 18 nt, Human
ugaagggagggcugcugg

SEQ ID NO: 883996 - RNA, 19 nt, Human
ugaagggagggcugcuggg

SEQ ID NO: 883997 - RNA, 21 nt, Human
ugaagggagggcugcugggau

SEQ ID NO: 883998 - RNA, 21 nt, Human
ugaggaugccacugacccagg

SEQ ID NO: 883999 - RNA, 18 nt, Human
ugcacaugucgcucaccc

SEQ ID NO: 884000 - RNA, 21 nt, Human
ugcucuguuccccacagagca

SEQ ID NO: 884001 - RNA, 18 nt, Human
ugcugggaucacagggac

SEQ ID NO: 884002 - RNA, 18 nt, Human
ugggaucacagggacagc

SEQ ID NO: 884003 - RNA, 23 nt, Human
uggggaaggggacucccagcuca

SEQ ID NO: 884004 - RNA, 22 nt, Human
ugugguuugcuuugggaggaga

SEQ ID NO: 884005 - RNA, 21 nt, Human
aaagagaaacgcaacauaaua

SEQ ID NO: 884006 - RNA, 18 nt, Human
aacauaauacaaacuaca

SEQ ID NO: 884007 - RNA, 20 nt, Human
aacauaauacaaacuacacc

SEQ ID NO: 884008 - RNA, 18 nt, Human
aaggaugauggagaaagg

SEQ ID NO: 884009 - RNA, 26 nt, Human
agaaaagagauggagagaagggaccc

SEQ ID NO: 884010 - RNA, 21 nt, Human
agaaaagagauggcagcaggg

SEQ ID NO: 884011 - RNA, 19 nt, Human
agaaagagaaacgcaacau

SEQ ID NO: 884012 - RNA, 27 nt, Human
agaaagagaaacgcaacauaauacaaa

SEQ ID NO: 884013 - RNA, 18 nt, Human
agaagaaaagagauggca

SEQ ID NO: 884014 - RNA, 22 nt, Human
agaagaaaagagauggcagcag

SEQ ID NO: 884015 - RNA, 24 nt, Human
agaagaaaagagauggcagcaggg

SEQ ID NO: 884016 - RNA, 23 nt, Human
agagauggcagcagggcguuacc

SEQ ID NO: 884017 - RNA, 21 nt, Human
agccagccuuccuuuccccaa

SEQ ID NO: 884018 - RNA, 23 nt, Human
agggguugaguugggaguugggg

SEQ ID NO: 884019 - RNA, 19 nt, Human
auaauacaaacuacaccgc

SEQ ID NO: 884020 - RNA, 24 nt, Human
augaggguuucgcacugggugucc

SEQ ID NO: 884021 - RNA, 23 nt, Human
auggcagcagggcguuaccacaa

SEQ ID NO: 884022 - RNA, 23 nt, Human
augguaauaggaaaugggauugu

SEQ ID NO: 884023 - RNA, 21 nt, Human
caaccaccacacauaguucca

SEQ ID NO: 884024 - RNA, 21 nt, Human
caagccagccuuccuuucccc

SEQ ID NO: 884025 - RNA, 19 nt, Human
caccacacauaguuccaaa

SEQ ID NO: 884026 - RNA, 22 nt, Human
caccgcgcggcuuauuuaggau

SEQ ID NO: 884027 - RNA, 20 nt, Human
caccucgcgcgcucaguacc

SEQ ID NO: 884028 - RNA, 21 nt, Human
ccaaaagggguugaguuggga

SEQ ID NO: 884029 - RNA, 19 nt, Human
ccgcgcggcuuauuuagga

SEQ ID NO: 884030 - RNA, 22 nt, Human
ccuaaaggaugauggagaaagg

SEQ ID NO: 884031 - RNA, 18 nt, Human
ccugcacaacuccucacc

SEQ ID NO: 884032 - RNA, 23 nt, Human
cucgccaagccagccuuccuuuc

SEQ ID NO: 884033 - RNA, 20 nt, Human
cucucgccaagccagccuuc

SEQ ID NO: 884034 - RNA, 22 nt, Human
cugcacaacuccucaccucgcg

SEQ ID NO: 884035 - RNA, 23 nt, Human
gaugauggagaaagggcgaggaa

SEQ ID NO: 884036 - RNA, 24 nt, Human
gccacagggucccaaccaccacac

SEQ ID NO: 884037 - RNA, 23 nt, Human
ggcgaggaaagcagaaagagaaa

SEQ ID NO: 884038 - RNA, 22 nt, Human
gggcgaggaaagcagaaagaga

SEQ ID NO: 884039 - RNA, 20 nt, Human
ggggaaggacucuuuguugg

SEQ ID NO: 884040 - RNA, 22 nt, Human
uagacgugaaucguugucucuu

SEQ ID NO: 884041 - RNA, 19 nt, Human
ucaguaccuagcccaccgg

SEQ ID NO: 884042 - RNA, 19 nt, Human
ucaguaccuagcccaccgg

SEQ ID NO: 884043 - RNA, 19 nt, Human
uccccaaacccugcacaac

SEQ ID NO: 884044 - RNA, 24 nt, Human
uccccaaacccugcacaacuccuc

SEQ ID NO: 884045 - RNA, 27 nt, Human
ucucuuauucucacugccaguccaaau

SEQ ID NO: 884046 - RNA, 22 nt, Human
ucuuuggaaaagggggcgaaag

SEQ ID NO: 884047 - RNA, 20 nt, Human
ugagaaggacacgagcgaca

SEQ ID NO: 884048 - RNA, 23 nt, Human
ugaguugggaguuggggaaggac

SEQ ID NO: 884049 - RNA, 22 nt, Human
ugaguuuauugcagagaauggu

SEQ ID NO: 884050 - RNA, 19 nt, Human
ugccaguccaaauccucgc

SEQ ID NO: 884051 - RNA, 25 nt, Human
uggaugaggguuucgcacugggugu

SEQ ID NO: 884052 - RNA, 24 nt, Human
uggcagcagggcguuaccacaaag

SEQ ID NO: 884053 - RNA, 21 nt, Human
uggggaaggacucuuuguugg

SEQ ID NO: 884054 - RNA, 21 nt, Human
uggggaaggacucuuuguugg

SEQ ID NO: 884055 - RNA, 22 nt, Human
uguagagccucgcgcgcucagu

SEQ ID NO: 884056 - RNA, 20 nt, Human
uuccccaaacccugcacaac

SEQ ID NO: 884057 - RNA, 18 nt, Human
aaccaugauacugagcuu

SEQ ID NO: 884058 - RNA, 18 nt, Human
aagagaaggcaaacauaa

SEQ ID NO: 884059 - RNA, 22 nt, Human
agaaauaacuaagagaaggccg

SEQ ID NO: 884060 - RNA, 24 nt, Human
agaaggcaaacauaauaccuuaga

SEQ ID NO: 884061 - RNA, 28 nt, Human
aggcaaacauaauaccuuagagaucaag

SEQ ID NO: 884062 - RNA, 22 nt, Human
caagaaacauuuacacaguuca

SEQ ID NO: 884063 - RNA, 22 nt, Human
caagaaacauuuacacaguuca

SEQ ID NO: 884064 - RNA, 22 nt, Human
gcaaacauaauaccuuagagau

SEQ ID NO: 884065 - RNA, 24 nt, Human
gggaauucuuuauuuaguaauguc

SEQ ID NO: 884066 - RNA, 26 nt, Human
gggaauucuuuauuuaguaauguccu

SEQ ID NO: 884067 - RNA, 27 nt, Human
uaacauaaaaguucacauaacugcuuc

SEQ ID NO: 884068 - RNA, 21 nt, Human
uaagagaaggcaaacauaaua

SEQ ID NO: 884069 - RNA, 21 nt, Human
ugacaacccagaaauaacuaa

SEQ ID NO: 884070 - RNA, 24 nt, Human
ugagcuuugugacaacccagaaau

SEQ ID NO: 884071 - RNA, 24 nt, Human
uguccuaacauaaaaguucacaua

SEQ ID NO: 884072 - RNA, 21 nt, Human
uucaacuguuuaaaaauagcu

SEQ ID NO: 884073 - RNA, 18 nt, Human
aauagcagaugagagacu

SEQ ID NO: 884074 - RNA, 22 nt, Human
accauuccuuucccacguuucc

SEQ ID NO: 884075 - RNA, 18 nt, Human
auaccauuccuuucccac

SEQ ID NO: 884076 - RNA, 22 nt, Human
cauuucccccacauaccauucc

SEQ ID NO: 884077 - RNA, 19 nt, Human
ccucaguccucugagggga

SEQ ID NO: 884078 - RNA, 23 nt, Human
gcuacagcuugauggaaaaaagg

SEQ ID NO: 884079 - RNA, 24 nt, Human
uucccacguuuccauucucugcag

SEQ ID NO: 884080 - RNA, 23 nt, Human
uuuuuuuuuuuuuuuuuuucaag

SEQ ID NO: 884081 - RNA, 25 nt, Human
aaaguaaucccauuccaaucucccc

SEQ ID NO: 884082 - RNA, 21 nt, Human
agaaaggacuagcuagcaccc

SEQ ID NO: 884083 - RNA, 21 nt, Human
agacccuccucucccacaucc

SEQ ID NO: 884084 - RNA, 20 nt, Human
agcacccgcgcggaucucac

SEQ ID NO: 884085 - RNA, 19 nt, Human
agcagagcagggauauuca

SEQ ID NO: 884086 - RNA, 22 nt, Human
aucccauuccaaucuccccacu

SEQ ID NO: 884087 - RNA, 18 nt, Human
cagcccacagugaccgug

SEQ ID NO: 884088 - RNA, 21 nt, Human
caucaccccagcccacaguga

SEQ ID NO: 884089 - RNA, 21 nt, Human
ccccacgggccgcgagccgag

SEQ ID NO: 884090 - RNA, 18 nt, Human
cccgcgcggaucucacgc

SEQ ID NO: 884091 - RNA, 24 nt, Human
cgagaaaggacuagcuagcacccg

SEQ ID NO: 884092 - RNA, 20 nt, Human
cgagccgagcagcgacgaga

SEQ ID NO: 884093 - RNA, 19 nt, Human
gacccuccucucccacauc

SEQ ID NO: 884094 - RNA, 23 nt, Human
gagcagcgacgagaaaggacuag

SEQ ID NO: 884095 - RNA, 21 nt, Human
gcuucagacccuccucuccca

SEQ ID NO: 884096 - RNA, 21 nt, Human
gggccgcgagccgagcagcga

SEQ ID NO: 884097 - RNA, 22 nt, Human
uaaaguccuuuuaaugcaaaag

SEQ ID NO: 884098 - RNA, 19 nt, Human
ucccauuccaaucucccca

SEQ ID NO: 884099 - RNA, 21 nt, Human
ucccauuccaaucuccccacu

SEQ ID NO: 884100 - RNA, 20 nt, Human
ucucacgcggcuucucccca

SEQ ID NO: 884101 - RNA, 21 nt, Human
uuuuacacagguguguaaagu

SEQ ID NO: 884102 - RNA, 19 nt, Human
uuuuuuuuuuuuuuuugcu

SEQ ID NO: 884103 - RNA, 18 nt, Human
uuuuuuuuuuuuuuuuug

SEQ ID NO: 884104 - RNA, 20 nt, Human
uuuuuuuuuuuuuuuuugcu

SEQ ID NO: 884105 - RNA, 26 nt, Human
uuuuuuuuuuuuuuuuuugcuauuag

SEQ ID NO: 884106 - RNA, 23 nt, Human
aaacaggaagcaggcacguuugg

SEQ ID NO: 884107 - RNA, 19 nt, Human
accuggcugccugaggggg

SEQ ID NO: 884108 - RNA, 21 nt, Human
aggaagcaggcacguuuggcc

SEQ ID NO: 884109 - RNA, 23 nt, Human
aguggugacagcagagggcaaag

SEQ ID NO: 884110 - RNA, 21 nt, Human
auggucccuggcgggcacugu

SEQ ID NO: 884111 - RNA, 18 nt, Human
cacugcguuuggaaguuu

SEQ ID NO: 884112 - RNA, 19 nt, Human
cacugcguuuggaaguuuc

SEQ ID NO: 884113 - RNA, 25 nt, Human
ccaaguggugacagcagagggcaaa

SEQ ID NO: 884114 - RNA, 21 nt, Human
cgccaugauacauacaugguc

SEQ ID NO: 884115 - RNA, 22 nt, Human
cuagggucuccuggugcgcuga

SEQ ID NO: 884116 - RNA, 24 nt, Human
cuccuggugcgcugaggcuguacc

SEQ ID NO: 884117 - RNA, 19 nt, Human
cugccugagggggcugugg

SEQ ID NO: 884118 - RNA, 21 nt, Human
guaaucuucccaucacuacuc

SEQ ID NO: 884119 - RNA, 20 nt, Human
uaagcaacaccaacugcuuu

SEQ ID NO: 884120 - RNA, 19 nt, Human
uacucagaugaccuggcug

SEQ ID NO: 884121 - RNA, 23 nt, Human
ucucugugagauggaaaccacuc

SEQ ID NO: 884122 - RNA, 22 nt, Human
ugagauggaaaccacucuaggg

SEQ ID NO: 884123 - RNA, 22 nt, Human
ugauacauacauggucccuggc

SEQ ID NO: 884124 - RNA, 22 nt, Human
ugccugagggggcuguggcccu

SEQ ID NO: 884125 - RNA, 24 nt, Human
ugccugagggggcuguggcccugu

SEQ ID NO: 884126 - RNA, 20 nt, Human
ugcgcugaggcuguacacac

SEQ ID NO: 884127 - RNA, 19 nt, Human
ugcuuuauuccaggucagg

SEQ ID NO: 884128 - RNA, 21 nt, Human
uggugacagcagagggcaaaa

SEQ ID NO: 884129 - RNA, 24 nt, Human
uguacacaccggcagaacagggca

SEQ ID NO: 884130 - RNA, 22 nt, Human
uuacaaaaacaggaagcaggca

SEQ ID NO: 884131 - RNA, 23 nt, Human
uuggcccucagacuguaaucuuc

SEQ ID NO: 884132 - RNA, 18 nt, Human
uuuuuuuuuuuuuuuuug

SEQ ID NO: 884133 - RNA, 23 nt, Human
uuuuuuuuuuuuuuuuuuguguu

SEQ ID NO: 884134 - RNA, 22 nt, Human
aaaaaacaaaaacaacaaaaaa

SEQ ID NO: 884135 - RNA, 20 nt, Human
aaaacaacaaaaaacaaaag

SEQ ID NO: 884136 - RNA, 22 nt, Human
aaacaaaaacaacaaaaaacaa

SEQ ID NO: 884137 - RNA, 30 nt, Human
aaacaaaaacaacaaaaaacaaaagccugg

SEQ ID NO: 884138 - RNA, 20 nt, Human
aaacaaaagccugugcuuca

SEQ ID NO: 884139 - RNA, 23 nt, Human
aaacaacaaaaaacaaaagccug

SEQ ID NO: 884140 - RNA, 18 nt, Human
aaagaagauggguagagg

SEQ ID NO: 884141 - RNA, 19 nt, Human
aacauggugaaaccccauc

SEQ ID NO: 884142 - RNA, 20 nt, Human
aacauggugaaaccccaucu

SEQ ID NO: 884143 - RNA, 20 nt, Human
aacauggugaaaccccaucu

SEQ ID NO: 884144 - RNA, 21 nt, Human
aacauggugaaaccccaucuc

SEQ ID NO: 884145 - RNA, 18 nt, Human
aauugcuugaaccuggga

SEQ ID NO: 884146 - RNA, 24 nt, Human
aauugcuugaaccugggagucgga

SEQ ID NO: 884147 - RNA, 24 nt, Human
acagaaugagacucugucucaaaa

SEQ ID NO: 884148 - RNA, 24 nt, Human
accaacauggugaaaccccaucuc

SEQ ID NO: 884149 - RNA, 19 nt, Human
accacuguacuuaagggca

SEQ ID NO: 884150 - RNA, 18 nt, Human
accccaucucuacuaaaa

SEQ ID NO: 884151 - RNA, 22 nt, Human
acgauggagaagccaauccaaa

SEQ ID NO: 884152 - RNA, 20 nt, Human
acuaaaggaggccgaggcag

SEQ ID NO: 884153 - RNA, 18 nt, Human
acugcacuccagccuggg

SEQ ID NO: 884154 - RNA, 24 nt, Human
acugcacuccagccugggugacag

SEQ ID NO: 884155 - RNA, 24 nt, Human
acuugaggucaggagguugagacc

SEQ ID NO: 884156 - RNA, 22 nt, Human
agaaaagaagauggguagagga

SEQ ID NO: 884157 - RNA, 18 nt, Human
agaaaggagacucaggga

SEQ ID NO: 884158 - RNA, 19 nt, Human
agaaaggagacucagggac

SEQ ID NO: 884159 - RNA, 20 nt, Human
agagcacaaucuugaauaaa

SEQ ID NO: 884160 - RNA, 24 nt, Human
agcacuuugggaggcugaggcggg

SEQ ID NO: 884161 - RNA, 24 nt, Human
agccugaccaacauggugaaaccc

SEQ ID NO: 884162 - RNA, 24 nt, Human
agccugggugacagaaugagacuc

SEQ ID NO: 884163 - RNA, 18 nt, Human
aggaagcugaggcuguug

SEQ ID NO: 884164 - RNA, 22 nt, Human
aggcaggagaauugcuugaacc

SEQ ID NO: 884165 - RNA, 24 nt, Human
aggcaggagaauugcuugaaccug

SEQ ID NO: 884166 - RNA, 19 nt, Human
aggccacugcugaguccug

SEQ ID NO: 884167 - RNA, 21 nt, Human
aggccgaggcaggagaauugc

SEQ ID NO: 884168 - RNA, 24 nt, Human
aggccgaggcaggagaauugcuug

SEQ ID NO: 884169 - RNA, 21 nt, Human
aggcgggcagaucacuugagg

SEQ ID NO: 884170 - RNA, 22 nt, Human
aggcgggcagaucacuugaggu

SEQ ID NO: 884171 - RNA, 23 nt, Human
aggcgggcagaucacuugagguc

SEQ ID NO: 884172 - RNA, 26 nt, Human
aggcgggcagaucacuugaggucagg

SEQ ID NO: 884173 - RNA, 24 nt, Human
aggcugaggcgggcagaucacuug

SEQ ID NO: 884174 - RNA, 25 nt, Human
agggagaccauucaaaagccugugc

SEQ ID NO: 884175 - RNA, 19 nt, Human
aggucaggagguugagacc

SEQ ID NO: 884176 - RNA, 19 nt, Human
agguggggcccugggggac

SEQ ID NO: 884177 - RNA, 24 nt, Human
agguguggugguaugcaccuguaa

SEQ ID NO: 884178 - RNA, 25 nt, Human
agucauggugccuugccauguaggg

SEQ ID NO: 884179 - RNA, 24 nt, Human
agucggagguugcagugagccaag

SEQ ID NO: 884180 - RNA, 21 nt, Human
auguaccugggcuggggagag

SEQ ID NO: 884181 - RNA, 24 nt, Human
auugcgccacugcacuccagccug

SEQ ID NO: 884182 - RNA, 24 nt, Human
auuuuacaucuccugacaguuuua

SEQ ID NO: 884183 - RNA, 26 nt, Human
caaaaaacaaaaacaacaaaaaacaa

SEQ ID NO: 884184 - RNA, 24 nt, Human
caacaaaaaacaaaagccugugcu

SEQ ID NO: 884185 - RNA, 24 nt, Human
caacauggugaaaccccaucucua

SEQ ID NO: 884186 - RNA, 24 nt, Human
caagauugcgccacugcacuccag

SEQ ID NO: 884187 - RNA, 18 nt, Human
cacaaguugugugugcgu

SEQ ID NO: 884188 - RNA, 18 nt, Human
caccuguaaucccaccua

SEQ ID NO: 884189 - RNA, 19 nt, Human
caccuguaaucccaccuac

SEQ ID NO: 884190 - RNA, 24 nt, Human
cacgccuaucaucccagcacuuug

SEQ ID NO: 884191 - RNA, 20 nt, Human
cacuacauaguaagcaaaau

SEQ ID NO: 884192 - RNA, 18 nt, Human
cacuccagccugggugac

SEQ ID NO: 884193 - RNA, 22 nt, Human
cacuccagccugggugacagaa

SEQ ID NO: 884194 - RNA, 24 nt, Human
cacuccagccugggugacagaaug

SEQ ID NO: 884195 - RNA, 19 nt, Human
cacugcacuccagccuggg

SEQ ID NO: 884196 - RNA, 19 nt, Human
cacugcacuccagccuggg

SEQ ID NO: 884197 - RNA, 22 nt, Human
cacugcacuccagccuggguga

SEQ ID NO: 884198 - RNA, 23 nt, Human
cacugcacuccagccugggugac

SEQ ID NO: 884199 - RNA, 24 nt, Human
cacugcacuccagccugggugaca

SEQ ID NO: 884200 - RNA, 25 nt, Human
cacugcacuccagccugggugacag

SEQ ID NO: 884201 - RNA, 19 nt, Human
cacuguacuuaagggcaac

SEQ ID NO: 884202 - RNA, 22 nt, Human
cagaaaggagacucagggacac

SEQ ID NO: 884203 - RNA, 27 nt, Human
cagaucacuugaggucaggagguugag

SEQ ID NO: 884204 - RNA, 22 nt, Human
cagcacuuugggaggcugaggc

SEQ ID NO: 884205 - RNA, 24 nt, Human
cagcacuuugggaggcugaggcgg

SEQ ID NO: 884206 - RNA, 20 nt, Human
cagucugaccacuagccacc

SEQ ID NO: 884207 - RNA, 19 nt, Human
cauccuaaaaacaucccua

SEQ ID NO: 884208 - RNA, 20 nt, Human
ccacugcacuccagccuggg

SEQ ID NO: 884209 - RNA, 20 nt, Human
ccacugcacuccagccuggg

SEQ ID NO: 884210 - RNA, 21 nt, Human
ccacugcacuccagccugggu

SEQ ID NO: 884211 - RNA, 21 nt, Human
ccacugcacuccagccugggu

SEQ ID NO: 884212 - RNA, 23 nt, Human
ccacugcacuccagccuggguga

SEQ ID NO: 884213 - RNA, 24 nt, Human
ccacugcacuccagccugggugac

SEQ ID NO: 884214 - RNA, 21 nt, Human
ccagaagggcgagauguggca

SEQ ID NO: 884215 - RNA, 22 nt, Human
cccacagccagcucacagugcc

SEQ ID NO: 884216 - RNA, 18 nt, Human
cccaucucucauuuucua

SEQ ID NO: 884217 - RNA, 26 nt, Human
cccuaugggugccuaaaaauggaaau

SEQ ID NO: 884218 - RNA, 22 nt, Human
ccuaugggugccuaaaaaugga

SEQ ID NO: 884219 - RNA, 19 nt, Human
ccucauguaccugggcugg

SEQ ID NO: 884220 - RNA, 24 nt, Human
ccugaccaacauggugaaacccca

SEQ ID NO: 884221 - RNA, 21 nt, Human
ccugggagucggagguugcag

SEQ ID NO: 884222 - RNA, 19 nt, Human
ccugggcuggggagaggga

SEQ ID NO: 884223 - RNA, 22 nt, Human
ccugggugacagaaugagacuc

SEQ ID NO: 884224 - RNA, 24 nt, Human
cgaggcaggagaauugcuugaacc

SEQ ID NO: 884225 - RNA, 26 nt, Human
cgccacugcacuccagccugggugac

SEQ ID NO: 884226 - RNA, 24 nt, Human
cgggcagaucacuugaggucagga

SEQ ID NO: 884227 - RNA, 24 nt, Human
cucacgccuaucaucccagcacuu

SEQ ID NO: 884228 - RNA, 22 nt, Human
cucccaguacugucacuggguc

SEQ ID NO: 884229 - RNA, 20 nt, Human
cugucucaaaaaacaaaaac

SEQ ID NO: 884230 - RNA, 26 nt, Human
cuucaagccccaacccaucucucauu

SEQ ID NO: 884231 - RNA, 27 nt, Human
cuucaugcuagagcuagcuuucuccuc

SEQ ID NO: 884232 - RNA, 18 nt, Human
cuuggccggguguggugg

SEQ ID NO: 884233 - RNA, 20 nt, Human
gaaaggagacucagggacac

SEQ ID NO: 884234 - RNA, 23 nt, Human
gacagaaugagacucugucucaa

SEQ ID NO: 884235 - RNA, 24 nt, Human
gacagaaugagacucugucucaaa

SEQ ID NO: 884236 - RNA, 23 nt, Human
gaggcaggagaauugcuugaacc

SEQ ID NO: 884237 - RNA, 18 nt, Human
gagguugcagugagccaa

SEQ ID NO: 884238 - RNA, 23 nt, Human
gagguugcagugagccaagauug

SEQ ID NO: 884239 - RNA, 24 nt, Human
gaucacuugaggucaggagguuga

SEQ ID NO: 884240 - RNA, 19 nt, Human
gccacugcacuccagccug

SEQ ID NO: 884241 - RNA, 24 nt, Human
gccacugcacuccagccuggguga

SEQ ID NO: 884242 - RNA, 21 nt, Human
gccgggugugguggcucacgc

SEQ ID NO: 884243 - RNA, 23 nt, Human
gcgugcacaugugccucugugug

SEQ ID NO: 884244 - RNA, 18 nt, Human
ggagaagccaauccaaaa

SEQ ID NO: 884245 - RNA, 20 nt, Human
ggagguugcagugagccaag

SEQ ID NO: 884246 - RNA, 22 nt, Human
ggagguugcagugagccaagau

SEQ ID NO: 884247 - RNA, 24 nt, Human
ggagguugcagugagccaagauug

SEQ ID NO: 884248 - RNA, 27 nt, Human
ggccgaggcaggagaauugcuugaacc

SEQ ID NO: 884249 - RNA, 21 nt, Human
ggccgggugugguggcucacg

SEQ ID NO: 884250 - RNA, 21 nt, Human
gggaaaaaaaaaauuggaaaa

SEQ ID NO: 884251 - RNA, 28 nt, Human
gggaaaaaaaaaauuggaaaaaaaaugu

SEQ ID NO: 884252 - RNA, 21 nt, Human
gggcuggggagagggagacca

SEQ ID NO: 884253 - RNA, 21 nt, Human
gggugugguggcucacgccua

SEQ ID NO: 884254 - RNA, 22 nt, Human
ggucaggagguugagaccagcc

SEQ ID NO: 884255 - RNA, 24 nt, Human
gguggcucacgccuaucaucccag

SEQ ID NO: 884256 - RNA, 20 nt, Human
uaacuaaucccugugcccca

SEQ ID NO: 884257 - RNA, 23 nt, Human
uaaucccugugccccaggaacuc

SEQ ID NO: 884258 - RNA, 21 nt, Human
uaccugggcuggggagaggga

SEQ ID NO: 884259 - RNA, 23 nt, Human
uaccugggcuggggagagggaga

SEQ ID NO: 884260 - RNA, 22 nt, Human
uagaagagcacaaucuugaaua

SEQ ID NO: 884261 - RNA, 22 nt, Human
ucacgccuaucaucccagcacu

SEQ ID NO: 884262 - RNA, 22 nt, Human
ucagaaaggagacucagggaca

SEQ ID NO: 884263 - RNA, 20 nt, Human
ucagggacacaaggucucag

SEQ ID NO: 884264 - RNA, 24 nt, Human
uccagccugggugacagaaugaga

SEQ ID NO: 884265 - RNA, 21 nt, Human
uccauuaugagccucaagagu

SEQ ID NO: 884266 - RNA, 26 nt, Human
ucucaaaaaacaaaaacaacaaaaaa

SEQ ID NO: 884267 - RNA, 23 nt, Human
ucucuacuaaaaaugcaaaaauu

SEQ ID NO: 884268 - RNA, 19 nt, Human
ugaaaccccaucucuacua

SEQ ID NO: 884269 - RNA, 24 nt, Human
ugaaccugggagucggagguugca

SEQ ID NO: 884270 - RNA, 24 nt, Human
ugaccaacauggugaaaccccauc

SEQ ID NO: 884271 - RNA, 23 nt, Human
ugagaccagccugaccaacaugg

SEQ ID NO: 884272 - RNA, 24 nt, Human
ugagaccagccugaccaacauggu

SEQ ID NO: 884273 - RNA, 22 nt, Human
ugagccaagauugcgccacugc

SEQ ID NO: 884274 - RNA, 24 nt, Human
ugaggcgggcagaucacuugaggu

SEQ ID NO: 884275 - RNA, 26 nt, Human
ugaggcgggcagaucacuugagguca

SEQ ID NO: 884276 - RNA, 22 nt, Human
ugaugcacuucaagccccaacc

SEQ ID NO: 884277 - RNA, 20 nt, Human
ugccauguagggcacauagc

SEQ ID NO: 884278 - RNA, 20 nt, Human
ugcuugaaccugggagucgg

SEQ ID NO: 884279 - RNA, 18 nt, Human
ugcuuuaagaaaagaaga

SEQ ID NO: 884280 - RNA, 23 nt, Human
ugcuuuaagaaaagaagaugggu

SEQ ID NO: 884281 - RNA, 18 nt, Human
uggaaaaaaaauguuacc

SEQ ID NO: 884282 - RNA, 21 nt, Human
uggcagaaaggagaauguggg

SEQ ID NO: 884283 - RNA, 23 nt, Human
uggcagaaaggagaaugugggaa

SEQ ID NO: 884284 - RNA, 19 nt, Human
uggccgggugugguggcuc

SEQ ID NO: 884285 - RNA, 22 nt, Human
uggcucacgccuaucaucccag

SEQ ID NO: 884286 - RNA, 24 nt, Human
uggcucacgccuaucaucccagca

SEQ ID NO: 884287 - RNA, 20 nt, Human
ugggaggcugaggcgggcag

SEQ ID NO: 884288 - RNA, 24 nt, Human
ugggaggcugaggcgggcagauca

SEQ ID NO: 884289 - RNA, 24 nt, Human
ugggagucggagguugcagugagc

SEQ ID NO: 884290 - RNA, 24 nt, Human
ugguggcucacgccuaucauccca

SEQ ID NO: 884291 - RNA, 24 nt, Human
uggugguaugcaccuguaauccca

SEQ ID NO: 884292 - RNA, 18 nt, Human
ugugugcgugcacaugug

SEQ ID NO: 884293 - RNA, 23 nt, Human
uguguucacaaguugugugugcg

SEQ ID NO: 884294 - RNA, 20 nt, Human
uucauggccuugaguucacu

SEQ ID NO: 884295 - RNA, 21 nt, Human
uucuaacuucuuuaacagaaa

SEQ ID NO: 884296 - RNA, 26 nt, Human
uucuccucagaaacuuacauccuaaa

SEQ ID NO: 884297 - RNA, 24 nt, Human
uugaaccugggagucggagguugc

SEQ ID NO: 884298 - RNA, 22 nt, Human
uugcagugagccaagauugcgc

SEQ ID NO: 884299 - RNA, 23 nt, Human
uugcgccacugcacuccagccug

SEQ ID NO: 884300 - RNA, 24 nt, Human
uugcuugaaccugggagucggagg

SEQ ID NO: 884301 - RNA, 22 nt, Human
uuggccgggugugguggcucac

SEQ ID NO: 884302 - RNA, 25 nt, Human
uugggaggcugaggcgggcagauca

SEQ ID NO: 884303 - RNA, 18 nt, Human
uugugugugcgugcacau

SEQ ID NO: 884304 - RNA, 19 nt, Human
aaggagucaauccacuaag

SEQ ID NO: 884305 - RNA, 20 nt, Human
uaacugacuucagcaaagga

SEQ ID NO: 884306 - RNA, 23 nt, Human
cggacccagaggucaacuuaagc

SEQ ID NO: 884307 - RNA, 22 nt, Human
uauuguuccuucaguaaaauuu

SEQ ID NO: 884308 - RNA, 20 nt, Human
uuguuccuucaguaaaauuu

SEQ ID NO: 884309 - RNA, 19 nt, Human
uuugcccgcgauuccggac

SEQ ID NO: 884310 - RNA, 19 nt, Human
uuuuuuuuuuuuuuugucu

SEQ ID NO: 884311 - RNA, 23 nt, Human
uuuuuuuuuuuuuuuugucucaa

SEQ ID NO: 884312 - RNA, 19 nt, Human
uuuuuuuuuuuuuuuuugu

SEQ ID NO: 884313 - RNA, 20 nt, Human
uuuuuuuuuuuuuuuuuugg

SEQ ID NO: 884314 - RNA, 24 nt, Human
uuuuuuuuuuuuuuuuuugucuca

SEQ ID NO: 884315 - RNA, 22 nt, Human
aaaccagccacaauguaaccgg

SEQ ID NO: 884316 - RNA, 22 nt, Human
aauaaaugcacuuucuucucuc

SEQ ID NO: 884317 - RNA, 24 nt, Human
aguuagaauguguucaagaaacca

SEQ ID NO: 884318 - RNA, 19 nt, Human
caagaaaccagccacaaug

SEQ ID NO: 884319 - RNA, 23 nt, Human
caauaaaugcacuuucuucucuc

SEQ ID NO: 884320 - RNA, 21 nt, Human
cacaauguaaccggauuagau

SEQ ID NO: 884321 - RNA, 28 nt, Human
cacuuucuucucuccgccacugaggaag

SEQ ID NO: 884322 - RNA, 21 nt, Human
cagagaaacugagccuucuac

SEQ ID NO: 884323 - RNA, 23 nt, Human
cauuacacggccaaggccaagau

SEQ ID NO: 884324 - RNA, 25 nt, Human
ccaccacccaaagcuacagugccga

SEQ ID NO: 884325 - RNA, 23 nt, Human
ccacccaaagcuacagugccgaa

SEQ ID NO: 884326 - RNA, 18 nt, Human
cccaccacccaaagcuac

SEQ ID NO: 884327 - RNA, 24 nt, Human
cccaccacccaaagcuacagugcc

SEQ ID NO: 884328 - RNA, 25 nt, Human
cucuccgccacugaggaagaaaguc

SEQ ID NO: 884329 - RNA, 18 nt, Human
gagccuucuacuguuaac

SEQ ID NO: 884330 - RNA, 20 nt, Human
gcacaguuagaauguguuca

SEQ ID NO: 884331 - RNA, 23 nt, Human
uaaacuucauuuaggaagaugac

SEQ ID NO: 884332 - RNA, 23 nt, Human
uccuccaauauguggaaagacaa

SEQ ID NO: 884333 - RNA, 22 nt, Human
ucugcagcccaccacccaaagc

SEQ ID NO: 884334 - RNA, 19 nt, Human
ugagcagagaaacugagcc

SEQ ID NO: 884335 - RNA, 21 nt, Human
ugcagcccaccacccaaagcu

SEQ ID NO: 884336 - RNA, 21 nt, Human
uggcaaggaguuagaguuccg

SEQ ID NO: 884337 - RNA, 22 nt, Human
aggcagagagagcacuaauggg

SEQ ID NO: 884338 - RNA, 23 nt, Human
aggcagagagagcacuaaugggg

SEQ ID NO: 884339 - RNA, 20 nt, Human
cacagccccuaaggccaccc

SEQ ID NO: 884340 - RNA, 24 nt, Human
cagagagagcacuaaugggggaaa

SEQ ID NO: 884341 - RNA, 18 nt, Human
cagccccuaaggccaccc

SEQ ID NO: 884342 - RNA, 28 nt, Human
cagguggcgauuugccccagcccucccc

SEQ ID NO: 884343 - RNA, 20 nt, Human
ccagcccuccccccuaagau

SEQ ID NO: 884344 - RNA, 26 nt, Human
cccagcccuccccccuaagaugcaga

SEQ ID NO: 884345 - RNA, 22 nt, Human
ccccacugccucacagccccua

SEQ ID NO: 884346 - RNA, 18 nt, Human
cucacagccccuaaggcc

SEQ ID NO: 884347 - RNA, 20 nt, Human
gaggaaaggcacagguggcg

SEQ ID NO: 884348 - RNA, 24 nt, Human
gaguugggugugggggcagcaggg

SEQ ID NO: 884349 - RNA, 20 nt, Human
gauuugccccagcccucccc

SEQ ID NO: 884350 - RNA, 21 nt, Human
gccgggauccaggcagagaga

SEQ ID NO: 884351 - RNA, 18 nt, Human
ggcagcagggccagagga

SEQ ID NO: 884352 - RNA, 20 nt, Human
ggccagaggaaaggcacagg

SEQ ID NO: 884353 - RNA, 18 nt, Human
ggugugggggcagcaggg

SEQ ID NO: 884354 - RNA, 27 nt, Human
ggugugggggcagcagggccagaggaa

SEQ ID NO: 884355 - RNA, 20 nt, Human
gugggcccucggaguugggu

SEQ ID NO: 884356 - RNA, 21 nt, Human
uaagguccccacugccucaca

SEQ ID NO: 884357 - RNA, 19 nt, Human
uacuucuuuucucuuuauu

SEQ ID NO: 884358 - RNA, 21 nt, Human
ucagaacacgucgcggaaggu

SEQ ID NO: 884359 - RNA, 21 nt, Human
ucccgcuuuccccagcguggg

SEQ ID NO: 884360 - RNA, 20 nt, Human
ugccucacagccccuaaggc

SEQ ID NO: 884361 - RNA, 20 nt, Human
ugggggaaagggagcgagcg

SEQ ID NO: 884362 - RNA, 18 nt, Human
ugggugugggggcagcag

SEQ ID NO: 884363 - RNA, 19 nt, Human
uuacuucuuuucucuuuaa

SEQ ID NO: 884364 - RNA, 22 nt, Human
uuucaucaauaagguccccacu

SEQ ID NO: 884365 - RNA, 25 nt, Human
aaaugagccccacaaucuagaaagu

SEQ ID NO: 884366 - RNA, 18 nt, Human
aagaagaaaucagagacc

SEQ ID NO: 884367 - RNA, 22 nt, Human
acacagcccggaacugcaaguc

SEQ ID NO: 884368 - RNA, 18 nt, Human
acaugaauaccaaagcua

SEQ ID NO: 884369 - RNA, 18 nt, Human
acugaauugacagcuaca

SEQ ID NO: 884370 - RNA, 24 nt, Human
agaaauaaaaucaaaacacuuuag

SEQ ID NO: 884371 - RNA, 19 nt, Human
agacagcagucaugugaac

SEQ ID NO: 884372 - RNA, 21 nt, Human
agcuguggcagcucuaacugg

SEQ ID NO: 884373 - RNA, 21 nt, Human
auacugaauugacagcuacau

SEQ ID NO: 884374 - RNA, 20 nt, Human
cacaaucuagaaaguaggau

SEQ ID NO: 884375 - RNA, 23 nt, Human
cacagcccggaacugcaagucaa

SEQ ID NO: 884376 - RNA, 22 nt, Human
cagcagucaugugaacacagcc

SEQ ID NO: 884377 - RNA, 19 nt, Human
cagguuagagaauacuccu

SEQ ID NO: 884378 - RNA, 23 nt, Human
cauaaaauuaauaaaucaagcag

SEQ ID NO: 884379 - RNA, 22 nt, Human
ccaagaagaaaucagagaccuc

SEQ ID NO: 884380 - RNA, 18 nt, Human
ccagguaaccaaaaccau

SEQ ID NO: 884381 - RNA, 21 nt, Human
ccccacaaucuagaaaguagg

SEQ ID NO: 884382 - RNA, 20 nt, Human
cuauuauguagaaauaaaau

SEQ ID NO: 884383 - RNA, 22 nt, Human
cugggccugccuucccagguaa

SEQ ID NO: 884384 - RNA, 22 nt, Human
gaaugcaggguuucccagggua

SEQ ID NO: 884385 - RNA, 22 nt, Human
gcaaaaugagccccacaaucua

SEQ ID NO: 884386 - RNA, 19 nt, Human
gccucaucuuuuuccugag

SEQ ID NO: 884387 - RNA, 23 nt, Human
uaaaaauacugaauugacagcua

SEQ ID NO: 884388 - RNA, 18 nt, Human
uaaaugcauguauauaca

SEQ ID NO: 884389 - RNA, 23 nt, Human
uaaccagaguugacaaaugugaa

SEQ ID NO: 884390 - RNA, 23 nt, Human
uaacucugaggaaaaaaaaugau

SEQ ID NO: 884391 - RNA, 19 nt, Human
uaacuggggcacccagaga

SEQ ID NO: 884392 - RNA, 22 nt, Human
uagaaauaaaaucaaaacacuu

SEQ ID NO: 884393 - RNA, 19 nt, Human
uagaccaagaagaaaucag

SEQ ID NO: 884394 - RNA, 22 nt, Human
uaggaugcuaaacaaaguugaa

SEQ ID NO: 884395 - RNA, 23 nt, Human
uauguagaaauaaaaucaaaaca

SEQ ID NO: 884396 - RNA, 25 nt, Human
uauguagaaauaaaaucaaaacacu

SEQ ID NO: 884397 - RNA, 19 nt, Human
ucaaaacacuuuagaccaa

SEQ ID NO: 884398 - RNA, 23 nt, Human
ucacaauuaaaugcauguauaua

SEQ ID NO: 884399 - RNA, 28 nt, Human
ucagagaccuccuagucuauugccccag

SEQ ID NO: 884400 - RNA, 22 nt, Human
ucaugugaacacagcccggaac

SEQ ID NO: 884401 - RNA, 22 nt, Human
uccugagcuguggcagcucuaa

SEQ ID NO: 884402 - RNA, 21 nt, Human
ucuaacuggggcacccagaga

SEQ ID NO: 884403 - RNA, 18 nt, Human
ugaaaugccagcuugugg

SEQ ID NO: 884404 - RNA, 23 nt, Human
ugaaugcaggguuucccaggguc

SEQ ID NO: 884405 - RNA, 19 nt, Human
ugagggaaauaauuuuaac

SEQ ID NO: 884406 - RNA, 20 nt, Human
ugauaaaaucacaauuaaau

SEQ ID NO: 884407 - RNA, 23 nt, Human
ugauuuuuuaacauuuucaauuu

SEQ ID NO: 884408 - RNA, 21 nt, Human
ugcuaaacaaaguugaaucaa

SEQ ID NO: 884409 - RNA, 19 nt, Human
uggguucugggccugccuu

SEQ ID NO: 884410 - RNA, 22 nt, Human
uggguucugggccugccuuccc

SEQ ID NO: 884411 - RNA, 18 nt, Human
ugguaagaaacagcugac

SEQ ID NO: 884412 - RNA, 25 nt, Human
uuaaaaauacugaauugacagcuac

SEQ ID NO: 884413 - RNA, 19 nt, Human
uuaaucacaaccaucgaag

SEQ ID NO: 884414 - RNA, 24 nt, Human
uugaaugcaggguuucccagggua

SEQ ID NO: 884415 - RNA, 19 nt, Human
caaguguccaucuaaauuu

SEQ ID NO: 884416 - RNA, 27 nt, Human
ccaagauacauaaauuaggaaauacaa

SEQ ID NO: 884417 - RNA, 23 nt, Human
cccccgagaaggggcaguuuccg

SEQ ID NO: 884418 - RNA, 18 nt, Human
gaugacaaacagcagcca

SEQ ID NO: 884419 - RNA, 20 nt, Human
uaggaaauacaaguguccau

SEQ ID NO: 884420 - RNA, 23 nt, Human
uauugucugaugacaaacagcag

SEQ ID NO: 884421 - RNA, 22 nt, Human
uccuuuauuguaaagacaauuc

SEQ ID NO: 884422 - RNA, 18 nt, Human
ugacaaacagcagccacc

SEQ ID NO: 884423 - RNA, 22 nt, Human
uggaaguccuuuauuguaaaga

SEQ ID NO: 884424 - RNA, 20 nt, Human
uggagaagcugaccaagaua

SEQ ID NO: 884425 - RNA, 20 nt, Human
ugucugaugacaaacagcag

SEQ ID NO: 884426 - RNA, 20 nt, Human
uuucucaucugucauuuugg

SEQ ID NO: 884427 - RNA, 22 nt, Human
aaacaaaaggcaagguaacauc

SEQ ID NO: 884428 - RNA, 21 nt, Human
aggcccgaguccacgcagcag

SEQ ID NO: 884429 - RNA, 19 nt, Human
caaaacaaacaaaaggcaa

SEQ ID NO: 884430 - RNA, 20 nt, Human
cagcacaggaacuggcugca

SEQ ID NO: 884431 - RNA, 22 nt, Human
cagcacaggaacuggcugcaca

SEQ ID NO: 884432 - RNA, 19 nt, Human
ccaaagaguuuaaagauua

SEQ ID NO: 884433 - RNA, 21 nt, Human
ccaccgccuaccgcgacugcu

SEQ ID NO: 884434 - RNA, 24 nt, Human
cccucaaaacaaacaaaaggcaag

SEQ ID NO: 884435 - RNA, 23 nt, Human
ccgcagcggaauuccugaggccc

SEQ ID NO: 884436 - RNA, 22 nt, Human
ccuugcccaccgccuaccgcga

SEQ ID NO: 884437 - RNA, 20 nt, Human
cgcccagggcagccuugccc

SEQ ID NO: 884438 - RNA, 21 nt, Human
cgcgccucggccuccgcccag

SEQ ID NO: 884439 - RNA, 25 nt, Human
cggaauuccugaggcccgaguccac

SEQ ID NO: 884440 - RNA, 22 nt, Human
cucaaaacaaacaaaaggcaag

SEQ ID NO: 884441 - RNA, 22 nt, Human
cucggccuccgcccagggcagc

SEQ ID NO: 884442 - RNA, 25 nt, Human
gccacacugcaggcggagcccggcg

SEQ ID NO: 884443 - RNA, 18 nt, Human
ggaauuccugaggcccga

SEQ ID NO: 884444 - RNA, 18 nt, Human
ggcgcgaccgcggacagc

SEQ ID NO: 884445 - RNA, 18 nt, Human
uaacaucccaagcuguga

SEQ ID NO: 884446 - RNA, 22 nt, Human
uaccgcgacugcuccucgucaa

SEQ ID NO: 884447 - RNA, 19 nt, Human
ucaaaacaaacaaaaggca

SEQ ID NO: 884448 - RNA, 24 nt, Human
uccacgcagcagcgcaggccgggg

SEQ ID NO: 884449 - RNA, 22 nt, Human
ucccucaaaacaaacaaaaggc

SEQ ID NO: 884450 - RNA, 25 nt, Human
uguccggacgggccacacugcaggg

SEQ ID NO: 884451 - RNA, 20 nt, Human
uuccugaggcccgaguccac

SEQ ID NO: 884452 - RNA, 20 nt, Human
uuuuuuuuuuuuuuuuuugg

SEQ ID NO: 884453 - RNA, 19 nt, Human
aacuugcaaauucuuccuu

SEQ ID NO: 884454 - RNA, 21 nt, Human
acagcaccugcaacacaugcu

SEQ ID NO: 884455 - RNA, 21 nt, Human
agaaaaaucaaacagcaccug

SEQ ID NO: 884456 - RNA, 28 nt, Human
agcaaaggggaucaagggcuaaaaauac

SEQ ID NO: 884457 - RNA, 25 nt, Human
aggggaucaagggcuaaaaauaccu

SEQ ID NO: 884458 - RNA, 18 nt, Human
augacacuaaugaaaaca

SEQ ID NO: 884459 - RNA, 24 nt, Human
augacacuaaugaaaacaaaauca

SEQ ID NO: 884460 - RNA, 23 nt, Human
caaaaucaagaaugauccacugg

SEQ ID NO: 884461 - RNA, 18 nt, Human
caagcaaaggggaucaag

SEQ ID NO: 884462 - RNA, 20 nt, Human
cccgggacgcgaaggggcgg

SEQ ID NO: 884463 - RNA, 29 nt, Human
ccucucgcaagcaaaggggaucaagggcu

SEQ ID NO: 884464 - RNA, 18 nt, Human
cgaaggggcgggacggcg

SEQ ID NO: 884465 - RNA, 23 nt, Human
gaaaaguccucaaugacaaagaa

SEQ ID NO: 884466 - RNA, 19 nt, Human
gggacaguggggaccuaga

SEQ ID NO: 884467 - RNA, 18 nt, Human
ggggaccuagaaacugcu

SEQ ID NO: 884468 - RNA, 21 nt, Human
uaaugaaaacaaaaucaagaa

SEQ ID NO: 884469 - RNA, 20 nt, Human
uacacaggcugaaugacuag

SEQ ID NO: 884470 - RNA, 21 nt, Human
uacugcagguuacagagaagc

SEQ ID NO: 884471 - RNA, 21 nt, Human
uagcucacaaucccaggaggu

SEQ ID NO: 884472 - RNA, 23 nt, Human
uauauaaaggccaaacuugcaaa

SEQ ID NO: 884473 - RNA, 21 nt, Human
ucaaacagcaccugcaacaca

SEQ ID NO: 884474 - RNA, 26 nt, Human
ucaauuuuuauuuccacaugguuaau

SEQ ID NO: 884475 - RNA, 21 nt, Human
uccccaccucucgcaagcaaa

SEQ ID NO: 884476 - RNA, 24 nt, Human
ucccuacaaucaaguuuauuacuc

SEQ ID NO: 884477 - RNA, 20 nt, Human
ugacaaagaaaugacacuaa

SEQ ID NO: 884478 - RNA, 23 nt, Human
ugagcaguuccccaccucucgca

SEQ ID NO: 884479 - RNA, 18 nt, Human
ugcugcccaaaugugaag

SEQ ID NO: 884480 - RNA, 20 nt, Human
uguaaggggaaaaguccuca

SEQ ID NO: 884481 - RNA, 27 nt, Human
aacugcuuuuuauacauuaucuuuagg

SEQ ID NO: 884482 - RNA, 18 nt, Human
aagagaaaacagcccuga

SEQ ID NO: 884483 - RNA, 19 nt, Human
aaggacaacucuggaaaca

SEQ ID NO: 884484 - RNA, 19 nt, Human
agagaaaacagcccugagg

SEQ ID NO: 884485 - RNA, 18 nt, Human
aggaaauaggggcagaga

SEQ ID NO: 884486 - RNA, 22 nt, Human
agugacgggaaacgggugaaaa

SEQ ID NO: 884487 - RNA, 23 nt, Human
caaagaaagaaggauuaacggau

SEQ ID NO: 884488 - RNA, 24 nt, Human
caaaggaacuacauccuuaaccca

SEQ ID NO: 884489 - RNA, 19 nt, Human
caagucaaugugcucccuc

SEQ ID NO: 884490 - RNA, 21 nt, Human
cagcccugaguuuccuggagg

SEQ ID NO: 884491 - RNA, 19 nt, Human
ccaaaaggaaacccuugcc

SEQ ID NO: 884492 - RNA, 22 nt, Human
ccacagguaguuuucagcgugg

SEQ ID NO: 884493 - RNA, 21 nt, Human
cccugggcuccuccuggagac

SEQ ID NO: 884494 - RNA, 23 nt, Human
ccucuuuacaaggaaauaggggc

SEQ ID NO: 884495 - RNA, 22 nt, Human
cgccugagcgagugacgggaaa

SEQ ID NO: 884496 - RNA, 18 nt, Human
cggcagagggcccugggc

SEQ ID NO: 884497 - RNA, 25 nt, Human
gaaaaagacuccucaggguccuaaa

SEQ ID NO: 884498 - RNA, 25 nt, Human
gagggcccugggcuccuccuggaga

SEQ ID NO: 884499 - RNA, 20 nt, Human
gcugcaccacaugcuacacc

SEQ ID NO: 884500 - RNA, 18 nt, Human
gggaaacgggugaaaaag

SEQ ID NO: 884501 - RNA, 19 nt, Human
uacaaaggaacuacauccu

SEQ ID NO: 884502 - RNA, 23 nt, Human
uaggggcagagagagcaaguucc

SEQ ID NO: 884503 - RNA, 21 nt, Human
uauuuccuccagccaguuuca

SEQ ID NO: 884504 - RNA, 21 nt, Human
ucagcguggcaguagcucaca

SEQ ID NO: 884505 - RNA, 20 nt, Human
uccuccagccaguuucacug

SEQ ID NO: 884506 - RNA, 24 nt, Human
uggcaguagcucacacuguuucuu

SEQ ID NO: 884507 - RNA, 19 nt, Human
uggccacgaggaccccaca

SEQ ID NO: 884508 - RNA, 18 nt, Human
uuccuggaggaaauuccc

SEQ ID NO: 884509 - RNA, 22 nt, Human
uuuuuuuuuuuuuuuucaccag

SEQ ID NO: 884510 - RNA, 23 nt, Human
uuuuuuuuuuuuuuuuucaccag

SEQ ID NO: 884511 - RNA, 20 nt, Human
acugugugucugccacaugu

SEQ ID NO: 884512 - RNA, 23 nt, Human
cagcucaaagaaauuucugacag

SEQ ID NO: 884513 - RNA, 19 nt, Human
caggaccggaggggugagg

SEQ ID NO: 884514 - RNA, 21 nt, Human
ccacaugucggcacauauaua

SEQ ID NO: 884515 - RNA, 22 nt, Human
ccucuccuuuccugggagcaaa

SEQ ID NO: 884516 - RNA, 23 nt, Human
gcgcaggcgcuaauggcgcgggg

SEQ ID NO: 884517 - RNA, 21 nt, Human
ggaccggaggggugagggggc

SEQ ID NO: 884518 - RNA, 19 nt, Human
ugacaguacugcccucaug

SEQ ID NO: 884519 - RNA, 23 nt, Human
ugagggggcggggccuagagacg

SEQ ID NO: 884520 - RNA, 24 nt, Human
ugccacaugucggcacauauauau

SEQ ID NO: 884521 - RNA, 21 nt, Human
aaaaaaaacuucaguauccac

SEQ ID NO: 884522 - RNA, 20 nt, Human
aaaagggggcaaauacaaga

SEQ ID NO: 884523 - RNA, 23 nt, Human
agaagcaggcagcagccagaccc

SEQ ID NO: 884524 - RNA, 20 nt, Human
agaaucaggaaauucacaug

SEQ ID NO: 884525 - RNA, 20 nt, Human
agcaagaagcaggcagcagc

SEQ ID NO: 884526 - RNA, 24 nt, Human
caaguuccuacgcuucauucagca

SEQ ID NO: 884527 - RNA, 24 nt, Human
cagaccccagaccuucaugccgga

SEQ ID NO: 884528 - RNA, 21 nt, Human
cagcagccagaccccagaccu

SEQ ID NO: 884529 - RNA, 22 nt, Human
ccuguaacuaccauaaaaaaaa

SEQ ID NO: 884530 - RNA, 25 nt, Human
cuucaugccggacgcuggcugcucc

SEQ ID NO: 884531 - RNA, 23 nt, Human
guuuccuguaacuaccauaaaaa

SEQ ID NO: 884532 - RNA, 25 nt, Human
uaaaaaaaagggggcaaauacaaga

SEQ ID NO: 884533 - RNA, 23 nt, Human
uaaagcucaaacuuacagagucu

SEQ ID NO: 884534 - RNA, 19 nt, Human
uaccauaaaaaaaacuuca

SEQ ID NO: 884535 - RNA, 25 nt, Human
uagucaccugagaaucaggaaauuc

SEQ ID NO: 884536 - RNA, 28 nt, Human
ucccuauacugacaaagaacuauagcua

SEQ ID NO: 884537 - RNA, 18 nt, Human
ugacaaagaacuauagcu

SEQ ID NO: 884538 - RNA, 22 nt, Human
ugacucuauacaagaaaauaau

SEQ ID NO: 884539 - RNA, 18 nt, Human
ugcuggagcaagaagcag

SEQ ID NO: 884540 - RNA, 26 nt, Human
uuaaagcucaaacuuacagagucugu

SEQ ID NO: 884541 - RNA, 20 nt, Human
uuagucaccugagaaucagg

SEQ ID NO: 884542 - RNA, 22 nt, Human
aaaugggaagauagucacuuug

SEQ ID NO: 884543 - RNA, 18 nt, Human
aacaccggaggucaaacc

SEQ ID NO: 884544 - RNA, 22 nt, Human
aagaacaucaagucacugugua

SEQ ID NO: 884545 - RNA, 24 nt, Human
accaauuacagagaggaaaaaaga

SEQ ID NO: 884546 - RNA, 22 nt, Human
accagcuggccucagggcucag

SEQ ID NO: 884547 - RNA, 25 nt, Human
acugcccccuaccuccuccuccccc

SEQ ID NO: 884548 - RNA, 25 nt, Human
acugcccccuaccuccuccuccccc

SEQ ID NO: 884549 - RNA, 21 nt, Human
acuuugcaacuccaaauucca

SEQ ID NO: 884550 - RNA, 21 nt, Human
agaacccuuccucaugaccuu

SEQ ID NO: 884551 - RNA, 20 nt, Human
agaagacccugggccagcgc

SEQ ID NO: 884552 - RNA, 19 nt, Human
agcaaauucuuccugauaa

SEQ ID NO: 884553 - RNA, 22 nt, Human
agcuggccucagggcucagggc

SEQ ID NO: 884554 - RNA, 18 nt, Human
aggaaaaaagagaguaag

SEQ ID NO: 884555 - RNA, 21 nt, Human
aggcugaaguuauugaaaaug

SEQ ID NO: 884556 - RNA, 23 nt, Human
aguuauugaaaaugagaugggaa

SEQ ID NO: 884557 - RNA, 19 nt, Human
auaauggcagggaaagccg

SEQ ID NO: 884558 - RNA, 26 nt, Human
auuucauuuccuccggcucucuggcu

SEQ ID NO: 884559 - RNA, 21 nt, Human
caaaccaggcuaggagagggc

SEQ ID NO: 884560 - RNA, 20 nt, Human
caacaccggaggucaaacca

SEQ ID NO: 884561 - RNA, 19 nt, Human
caagccacagugagagccg

SEQ ID NO: 884562 - RNA, 19 nt, Human
caccggaggucaaaccagg

SEQ ID NO: 884563 - RNA, 23 nt, Human
caccugagcuaggggcaggagac

SEQ ID NO: 884564 - RNA, 21 nt, Human
cacuccggccuggcucggggg

SEQ ID NO: 884565 - RNA, 20 nt, Human
cacuggacacuguccuggcc

SEQ ID NO: 884566 - RNA, 22 nt, Human
caggcuaggagagggcauuugg

SEQ ID NO: 884567 - RNA, 20 nt, Human
ccaccugagcuaggggcagg

SEQ ID NO: 884568 - RNA, 24 nt, Human
ccccacccgccuggagccuccagc

SEQ ID NO: 884569 - RNA, 22 nt, Human
ccccauggcaacucgugccacu

SEQ ID NO: 884570 - RNA, 18 nt, Human
cccccuaccuccuccucc

SEQ ID NO: 884571 - RNA, 19 nt, Human
ccccgcuccuuacccccaa

SEQ ID NO: 884572 - RNA, 27 nt, Human
ccccuaccuccuccucccccgugcccc

SEQ ID NO: 884573 - RNA, 19 nt, Human
ccgaguguuaaaagaaccc

SEQ ID NO: 884574 - RNA, 19 nt, Human
ccucagggcucagggcagg

SEQ ID NO: 884575 - RNA, 19 nt, Human
ccuccagcaagcaugugag

SEQ ID NO: 884576 - RNA, 18 nt, Human
ccuccucccccgugcccc

SEQ ID NO: 884577 - RNA, 24 nt, Human
ccucugggagccccacuccggccu

SEQ ID NO: 884578 - RNA, 19 nt, Human
ccugcagaucuccccaccc

SEQ ID NO: 884579 - RNA, 24 nt, Human
ccugcgguaggaggacccuaaaac

SEQ ID NO: 884580 - RNA, 21 nt, Human
cgagaagccucuggcugcaga

SEQ ID NO: 884581 - RNA, 18 nt, Human
cggagccacaagccacag

SEQ ID NO: 884582 - RNA, 23 nt, Human
cggccuggcucgggggauaaugg

SEQ ID NO: 884583 - RNA, 19 nt, Human
cuccuccucccccgugccc

SEQ ID NO: 884584 - RNA, 18 nt, Human
cuccucuggccagccucc

SEQ ID NO: 884585 - RNA, 20 nt, Human
cuccugcgguaggaggaccc

SEQ ID NO: 884586 - RNA, 21 nt, Human
cucuggccagccuccuuucac

SEQ ID NO: 884587 - RNA, 22 nt, Human
cugggagccccacuccggccug

SEQ ID NO: 884588 - RNA, 20 nt, Human
gaaagaaugggaggcugaag

SEQ ID NO: 884589 - RNA, 22 nt, Human
gaagauagucacuuugcaacuc

SEQ ID NO: 884590 - RNA, 21 nt, Human
gaaguuauugaaaaugagaug

SEQ ID NO: 884591 - RNA, 20 nt, Human
gagaagccucuggcugcaga

SEQ ID NO: 884592 - RNA, 18 nt, Human
gagccuggagaagacccu

SEQ ID NO: 884593 - RNA, 20 nt, Human
gccacuggacacuguccugg

SEQ ID NO: 884594 - RNA, 26 nt, Human
ggaaagccgaccagcuggccgaagac

SEQ ID NO: 884595 - RNA, 24 nt, Human
ggcaguccccauggcaacucgugc

SEQ ID NO: 884596 - RNA, 21 nt, Human
gggaaagggugguagucugag

SEQ ID NO: 884597 - RNA, 19 nt, Human
gggcauuuggaauuucauu

SEQ ID NO: 884598 - RNA, 18 nt, Human
uacagagaggaaaaaaga

SEQ ID NO: 884599 - RNA, 20 nt, Human
uacagagaggaaaaaagaga

SEQ ID NO: 884600 - RNA, 20 nt, Human
uacaucuggcuccggagcuc

SEQ ID NO: 884601 - RNA, 26 nt, Human
uacugcccccuaccuccuccuccccc

SEQ ID NO: 884602 - RNA, 19 nt, Human
uaggguguuagucauuaag

SEQ ID NO: 884603 - RNA, 18 nt, Human
uccaaauuccaggucuga

SEQ ID NO: 884604 - RNA, 19 nt, Human
uccaagaacaucaagucac

SEQ ID NO: 884605 - RNA, 22 nt, Human
uccaagaacaucaagucacugu

SEQ ID NO: 884606 - RNA, 22 nt, Human
uccucugggagccccacuccgg

SEQ ID NO: 884607 - RNA, 22 nt, Human
ugacguuauacuuggggaaagg

SEQ ID NO: 884608 - RNA, 21 nt, Human
ugagaugggaaaugggaagau

SEQ ID NO: 884609 - RNA, 23 nt, Human
ugagaugggaaaugggaagauag

SEQ ID NO: 884610 - RNA, 26 nt, Human
ugagccuggagaagacccugggccag

SEQ ID NO: 884611 - RNA, 18 nt, Human
ugccccgcuccuuacccc

SEQ ID NO: 884612 - RNA, 22 nt, Human
ugccccgcuccuuacccccaac

SEQ ID NO: 884613 - RNA, 21 nt, Human
ugccgaguguuaaaagaaccc

SEQ ID NO: 884614 - RNA, 18 nt, Human
uggcaguccccauggcaa

SEQ ID NO: 884615 - RNA, 21 nt, Human
uggcucgggggauaauggcag

SEQ ID NO: 884616 - RNA, 19 nt, Human
ugggaagauagucacuuug

SEQ ID NO: 884617 - RNA, 18 nt, Human
ugggagccccacuccggc

SEQ ID NO: 884618 - RNA, 19 nt, Human
ugggaggcugaaguuauug

SEQ ID NO: 884619 - RNA, 21 nt, Human
uggggcagucgcucacccugg

SEQ ID NO: 884620 - RNA, 19 nt, Human
uuauacuuggggaaagggu

SEQ ID NO: 884621 - RNA, 19 nt, Human
uuauucuccuuuccuccuc

SEQ ID NO: 884622 - RNA, 21 nt, Human
uuauugaaaaugagaugggaa

SEQ ID NO: 884623 - RNA, 18 nt, Human
uuccaaaggaaagaaugg

SEQ ID NO: 884624 - RNA, 19 nt, Human
uuccuccggcucucuggcu

SEQ ID NO: 884625 - RNA, 24 nt, Human
uugaguuugcaucaacaccggagg

SEQ ID NO: 884626 - RNA, 24 nt, Human
uugcaacuccaaauuccaggucug

SEQ ID NO: 884627 - RNA, 19 nt, Human
uuucugagaagccuuuccu

SEQ ID NO: 884628 - RNA, 19 nt, Human
uuuuuuucugagaagccuu

SEQ ID NO: 884629 - RNA, 24 nt, Human
uuuuuuuuuuuucugagaagccuu

SEQ ID NO: 884630 - RNA, 18 nt, Human
cauauccagcaucaugag

SEQ ID NO: 884631 - RNA, 23 nt, Human
cccaagaagucaauaguucuuca

SEQ ID NO: 884632 - RNA, 28 nt, Human
ucauauccagcaucaugagucgucuuug

SEQ ID NO: 884633 - RNA, 18 nt, Human
ucccaagaagucaauagu

SEQ ID NO: 884634 - RNA, 22 nt, Human
ucccaagaagucaauaguucuu

SEQ ID NO: 884635 - RNA, 18 nt, Human
ugaggacaugaguaacca

SEQ ID NO: 884636 - RNA, 18 nt, Human
ugaggacaugaguaacca

SEQ ID NO: 884637 - RNA, 18 nt, Human
aaaagccgggagcuuggg

SEQ ID NO: 884638 - RNA, 23 nt, Human
aagacuaaaaacccaggccggga

SEQ ID NO: 884639 - RNA, 21 nt, Human
aaggagaauccagcggaaacu

SEQ ID NO: 884640 - RNA, 21 nt, Human
accuagcccugcgagcagcgg

SEQ ID NO: 884641 - RNA, 22 nt, Human
acgaacccggcccagagaagcc

SEQ ID NO: 884642 - RNA, 18 nt, Human
agagcgugagcgccccuc

SEQ ID NO: 884643 - RNA, 26 nt, Human
aggcaaaacguggucgcccagauccg

SEQ ID NO: 884644 - RNA, 20 nt, Human
agguaggagcaggagcgggg

SEQ ID NO: 884645 - RNA, 19 nt, Human
aucacaguuccagggaaag

SEQ ID NO: 884646 - RNA, 18 nt, Human
cacaguuccagggaaagg

SEQ ID NO: 884647 - RNA, 18 nt, Human
cacgucuagaccucuguc

SEQ ID NO: 884648 - RNA, 21 nt, Human
cagccacacccgccaccuguc

SEQ ID NO: 884649 - RNA, 20 nt, Human
cagcggccuuccucccgccc

SEQ ID NO: 884650 - RNA, 18 nt, Human
cagggaggccgaacggcc

SEQ ID NO: 884651 - RNA, 20 nt, Human
caucucacgagcucucccuu

SEQ ID NO: 884652 - RNA, 23 nt, Human
ccaccugucacgaucacaguucc

SEQ ID NO: 884653 - RNA, 19 nt, Human
ccccccuggccagucucgc

SEQ ID NO: 884654 - RNA, 22 nt, Human
cccgccugcggugaucugggaa

SEQ ID NO: 884655 - RNA, 19 nt, Human
cccguugucccccuugccc

SEQ ID NO: 884656 - RNA, 21 nt, Human
ccgggagcuugggaaggagac

SEQ ID NO: 884657 - RNA, 21 nt, Human
ccguucccuaaccauuguguc

SEQ ID NO: 884658 - RNA, 20 nt, Human
ccuagcccugcgagcagcgg

SEQ ID NO: 884659 - RNA, 18 nt, Human
ccuggcggaggcggaggc

SEQ ID NO: 884660 - RNA, 21 nt, Human
ccuuccgcucccuggcggagg

SEQ ID NO: 884661 - RNA, 25 nt, Human
ccuugcccacacgcguccucuuucc

SEQ ID NO: 884662 - RNA, 19 nt, Human
cgaaaggccggggcugugu

SEQ ID NO: 884663 - RNA, 20 nt, Human
cgcaggaucacuugcuaugg

SEQ ID NO: 884664 - RNA, 25 nt, Human
cgcccagauccggcgcagcuguagc

SEQ ID NO: 884665 - RNA, 20 nt, Human
cgcgaaaggccggggcugug

SEQ ID NO: 884666 - RNA, 20 nt, Human
cgcguccucuuuccuccccc

SEQ ID NO: 884667 - RNA, 21 nt, Human
cgggagcuugggaaggagacg

SEQ ID NO: 884668 - RNA, 19 nt, Human
cuagcccugcgagcagcgg

SEQ ID NO: 884669 - RNA, 20 nt, Human
gaaaaagccgggagcuuggg

SEQ ID NO: 884670 - RNA, 22 nt, Human
gaaacuucuucccaucucacga

SEQ ID NO: 884671 - RNA, 19 nt, Human
gaagaagccacccggcagg

SEQ ID NO: 884672 - RNA, 21 nt, Human
gagagucuggagucggagcug

SEQ ID NO: 884673 - RNA, 22 nt, Human
gagcgccccucugcugaccccg

SEQ ID NO: 884674 - RNA, 19 nt, Human
gaguuagucuacagagcua

SEQ ID NO: 884675 - RNA, 22 nt, Human
gcaagggcgcguucccuaucgc

SEQ ID NO: 884676 - RNA, 18 nt, Human
gcagugacagccacaccc

SEQ ID NO: 884677 - RNA, 18 nt, Human
gcccagauccggcgcagc

SEQ ID NO: 884678 - RNA, 20 nt, Human
gcgcggggugagaaagcgag

SEQ ID NO: 884679 - RNA, 23 nt, Human
gcggcaggacgugguguuggagu

SEQ ID NO: 884680 - RNA, 18 nt, Human
gcuccaaggaagacuaaa

SEQ ID NO: 884681 - RNA, 25 nt, Human
ggaagugugucuccaccuagcccug

SEQ ID NO: 884682 - RNA, 19 nt, Human
ggaguuggggcgcccggag

SEQ ID NO: 884683 - RNA, 22 nt, Human
ggauguagagcgcguucuaacc

SEQ ID NO: 884684 - RNA, 21 nt, Human
gggaggcccgaagaagacccc

SEQ ID NO: 884685 - RNA, 20 nt, Human
ggggaagaaccugcgcggca

SEQ ID NO: 884686 - RNA, 18 nt, Human
gucacuuaaaacccuguc

SEQ ID NO: 884687 - RNA, 19 nt, Human
guccucuuuccuccccccu

SEQ ID NO: 884688 - RNA, 19 nt, Human
ucccuaucgcaggaucacu

SEQ ID NO: 884689 - RNA, 20 nt, Human
ucccuggcggaggcggaggc

SEQ ID NO: 884690 - RNA, 19 nt, Human
ucgcugucuccgccuuccg

SEQ ID NO: 884691 - RNA, 23 nt, Human
ucuacagagcuagggcccgaggg

SEQ ID NO: 884692 - RNA, 20 nt, Human
ucucgcugucuccgccuucc

SEQ ID NO: 884693 - RNA, 22 nt, Human
ucucgcugucuccgccuuccgc

SEQ ID NO: 884694 - RNA, 22 nt, Human
ugagcgccccucugcugacccc

SEQ ID NO: 884695 - RNA, 24 nt, Human
ugcuggaguacgaacccggcccag

SEQ ID NO: 884696 - RNA, 18 nt, Human
uggaguggggagaccuga

SEQ ID NO: 884697 - RNA, 22 nt, Human
uggcccccaaacacucgcauuu

SEQ ID NO: 884698 - RNA, 18 nt, Human
ugggaaggagacgggauu

SEQ ID NO: 884699 - RNA, 23 nt, Human
ugggaaggagacgggauugaaga

SEQ ID NO: 884700 - RNA, 22 nt, Human
ugggcugucuggcgcgggcugg

SEQ ID NO: 884701 - RNA, 22 nt, Human
ugucuuuaaagcggauguagag

SEQ ID NO: 884702 - RNA, 20 nt, Human
ugugguagugcagccucggg

SEQ ID NO: 884703 - RNA, 20 nt, Human
aaagcacccccgaggugguc

SEQ ID NO: 884704 - RNA, 20 nt, Human
acucuccugcccagaggugg

SEQ ID NO: 884705 - RNA, 24 nt, Human
acucuccugcccagagguggagac

SEQ ID NO: 884706 - RNA, 23 nt, Human
agagguggggagggguuuagggg

SEQ ID NO: 884707 - RNA, 27 nt, Human
aggcugugggggguucauggcucgucu

SEQ ID NO: 884708 - RNA, 22 nt, Human
agguggggcccugggaccgugc

SEQ ID NO: 884709 - RNA, 19 nt, Human
caaaggacacacugugagg

SEQ ID NO: 884710 - RNA, 27 nt, Human
caacaugacuucuccccucuccggucu

SEQ ID NO: 884711 - RNA, 21 nt, Human
cacucccugccccccaccccc

SEQ ID NO: 884712 - RNA, 22 nt, Human
cagcuguuaggugaggggccgg

SEQ ID NO: 884713 - RNA, 20 nt, Human
cagucgggggagguggucag

SEQ ID NO: 884714 - RNA, 28 nt, Human
ccaaaugcagaggcugugggggguucau

SEQ ID NO: 884715 - RNA, 25 nt, Human
ccagagcaagccuggccuucccugu

SEQ ID NO: 884716 - RNA, 21 nt, Human
cccccacgggccgcuuggucu

SEQ ID NO: 884717 - RNA, 22 nt, Human
ccccucagaagcagcuauagau

SEQ ID NO: 884718 - RNA, 20 nt, Human
cccggcucccagccccucag

SEQ ID NO: 884719 - RNA, 19 nt, Human
cccucagaagcagcuauag

SEQ ID NO: 884720 - RNA, 22 nt, Human
cccugccccccaccccccacgg

SEQ ID NO: 884721 - RNA, 21 nt, Human
ccucuccggucugguaggaac

SEQ ID NO: 884722 - RNA, 21 nt, Human
ccucugggagcauaaaagucc

SEQ ID NO: 884723 - RNA, 20 nt, Human
ccuucccuguccucccuccc

SEQ ID NO: 884724 - RNA, 18 nt, Human
cuaccaggggccgggggg

SEQ ID NO: 884725 - RNA, 19 nt, Human
cucccaugucuguccugca

SEQ ID NO: 884726 - RNA, 20 nt, Human
cucccugccccccacccccc

SEQ ID NO: 884727 - RNA, 20 nt, Human
cugcucagcuccuuugcccu

SEQ ID NO: 884728 - RNA, 21 nt, Human
cuggguccuccagcugguggg

SEQ ID NO: 884729 - RNA, 24 nt, Human
gagaaagcacccccgagguggucg

SEQ ID NO: 884730 - RNA, 24 nt, Human
gcccugggaccgugccccagcccc

SEQ ID NO: 884731 - RNA, 21 nt, Human
gcugugggggguucauggcuc

SEQ ID NO: 884732 - RNA, 18 nt, Human
ggacgagggcggacucgu

SEQ ID NO: 884733 - RNA, 21 nt, Human
ggaggugggcugggcuuggga

SEQ ID NO: 884734 - RNA, 23 nt, Human
ggcccggcucccagccccucaga

SEQ ID NO: 884735 - RNA, 19 nt, Human
ggccgggggagggaggugg

SEQ ID NO: 884736 - RNA, 20 nt, Human
ggccgggggagggagguggg

SEQ ID NO: 884737 - RNA, 19 nt, Human
ggcugggcuugggauggcu

SEQ ID NO: 884738 - RNA, 20 nt, Human
gggagggaggugggcugggc

SEQ ID NO: 884739 - RNA, 22 nt, Human
gggcugggcuugggauggcugc

SEQ ID NO: 884740 - RNA, 22 nt, Human
ggggagggaggugggcugggcc

SEQ ID NO: 884741 - RNA, 22 nt, Human
ggguaaggaggguggcuggggc

SEQ ID NO: 884742 - RNA, 21 nt, Human
ggguggcauggaguggggccu

SEQ ID NO: 884743 - RNA, 23 nt, Human
gugguacacucccugccccccac

SEQ ID NO: 884744 - RNA, 22 nt, Human
uaaggaacagcuauuaggucca

SEQ ID NO: 884745 - RNA, 18 nt, Human
uaaggugagguccccaaa

SEQ ID NO: 884746 - RNA, 24 nt, Human
uacacucccugccccccacccccc

SEQ ID NO: 884747 - RNA, 23 nt, Human
uaccaggggccgggggagggagg

SEQ ID NO: 884748 - RNA, 24 nt, Human
uagguccagaguggcagucggggg

SEQ ID NO: 884749 - RNA, 23 nt, Human
uaguugggguaagccggccuggg

SEQ ID NO: 884750 - RNA, 19 nt, Human
ucccagagcaagccuggcc

SEQ ID NO: 884751 - RNA, 19 nt, Human
ucccugccccccacccccc

SEQ ID NO: 884752 - RNA, 23 nt, Human
ucccugccccccaccccccacgg

SEQ ID NO: 884753 - RNA, 20 nt, Human
ucccuguccucccucccaug

SEQ ID NO: 884754 - RNA, 21 nt, Human
ucuccuaaggugaggucccca

SEQ ID NO: 884755 - RNA, 21 nt, Human
ucugcacggcggcggccgucg

SEQ ID NO: 884756 - RNA, 19 nt, Human
ugagcugggggcaggcggu

SEQ ID NO: 884757 - RNA, 22 nt, Human
ugaggcuggguccuccagcugg

SEQ ID NO: 884758 - RNA, 23 nt, Human
ugcccuggcggaagcuguaaaug

SEQ ID NO: 884759 - RNA, 20 nt, Human
ugccuaccaggggccggggg

SEQ ID NO: 884760 - RNA, 27 nt, Human
uggaguggggccuaaggaacagcuauu

SEQ ID NO: 884761 - RNA, 26 nt, Human
uggcacaaaggacacacugugaggcu

SEQ ID NO: 884762 - RNA, 23 nt, Human
uggcucgucucucccaggggccc

SEQ ID NO: 884763 - RNA, 18 nt, Human
uggcugcucagcuccuuu

SEQ ID NO: 884764 - RNA, 21 nt, Human
uggcuggggcgggguaguugg

SEQ ID NO: 884765 - RNA, 22 nt, Human
uggcuggggcgggguaguuggg

SEQ ID NO: 884766 - RNA, 19 nt, Human
ugggauggcugcucagcuc

SEQ ID NO: 884767 - RNA, 21 nt, Human
ugggcugggcuugggauggcu

SEQ ID NO: 884768 - RNA, 18 nt, Human
uggggagggguuuagggg

SEQ ID NO: 884769 - RNA, 20 nt, Human
ugggggcaggcggucccuuu

SEQ ID NO: 884770 - RNA, 27 nt, Human
ugguacacucccugccccccacccccc

SEQ ID NO: 884771 - RNA, 19 nt, Human
ugucaggguugcagcaggg

SEQ ID NO: 884772 - RNA, 20 nt, Human
ugugggggguucauggcucg

SEQ ID NO: 884773 - RNA, 23 nt, Human
uuaggggcaacaugacuucuccc

SEQ ID NO: 884774 - RNA, 24 nt, Human
acgcgcuuaucuuccuccuccccc

SEQ ID NO: 884775 - RNA, 19 nt, Human
cacgcgcuuaucuuccucc

SEQ ID NO: 884776 - RNA, 19 nt, Human
ccaccggagucucaggagg

SEQ ID NO: 884777 - RNA, 23 nt, Human
ccucacgcgcuuaucuuccuccu

SEQ ID NO: 884778 - RNA, 20 nt, Human
gagucucaggaggcugggga

SEQ ID NO: 884779 - RNA, 23 nt, Human
uaaacuuuauuccuaauaugaaa

SEQ ID NO: 884780 - RNA, 22 nt, Human
ucgcagcguuuucccgccuuuu

SEQ ID NO: 884781 - RNA, 21 nt, Human
ucucaggaggcuggggaggac

SEQ ID NO: 884782 - RNA, 24 nt, Human
ugaaggcccuguggggcgagucgu

SEQ ID NO: 884783 - RNA, 24 nt, Human
ugaccgaccgccacgagccugcaa

SEQ ID NO: 884784 - RNA, 23 nt, Human
uggaaagaaggggucugaaggcc

SEQ ID NO: 884785 - RNA, 18 nt, Human
uggggaggacacuggaag

SEQ ID NO: 884786 - RNA, 23 nt, Human
uuuuuuuuuuuuuucuucaaaau

SEQ ID NO: 884787 - RNA, 23 nt, Human
uuuuuuuuuuuuuuuuuucuuca

SEQ ID NO: 884788 - RNA, 22 nt, Human
uuuuuuuuuuuuuuuuuuucuu

SEQ ID NO: 884789 - RNA, 22 nt, Human
aaaaaaccaagccccacagcga

SEQ ID NO: 884790 - RNA, 21 nt, Human
agcccccccgcccccccaccc

SEQ ID NO: 884791 - RNA, 19 nt, Human
aucuccgcucccuccuccc

SEQ ID NO: 884792 - RNA, 19 nt, Human
caaaaaaccaagccccaca

SEQ ID NO: 884793 - RNA, 20 nt, Human
caaaaaaccaagccccacag

SEQ ID NO: 884794 - RNA, 21 nt, Human
caagccccacagcgaucggag

SEQ ID NO: 884795 - RNA, 21 nt, Human
cacauuuaaaagcuguugucu

SEQ ID NO: 884796 - RNA, 20 nt, Human
cacccccaaaaaaccaagcc

SEQ ID NO: 884797 - RNA, 27 nt, Human
caccuaaacaaagggccacucagaaac

SEQ ID NO: 884798 - RNA, 22 nt, Human
ccaagccccacagcgaucggag

SEQ ID NO: 884799 - RNA, 19 nt, Human
ccacccccaaaaaaccaag

SEQ ID NO: 884800 - RNA, 20 nt, Human
cccaaaaaaccaagccccac

SEQ ID NO: 884801 - RNA, 22 nt, Human
cccacccccaaaaaaccaagcc

SEQ ID NO: 884802 - RNA, 18 nt, Human
ccccaaaaaaccaagccc

SEQ ID NO: 884803 - RNA, 21 nt, Human
ccccacccccaaaaaaccaag

SEQ ID NO: 884804 - RNA, 30 nt, Human
ccccacccccaaaaaaccaagccccacagg

SEQ ID NO: 884805 - RNA, 19 nt, Human
cccccaaaaaaccaagccc

SEQ ID NO: 884806 - RNA, 22 nt, Human
cccccaaaaaaccaagccccac

SEQ ID NO: 884807 - RNA, 25 nt, Human
cccccacccccaaaaaaccaagccc

SEQ ID NO: 884808 - RNA, 24 nt, Human
cccccccgcccccccacccccaaa

SEQ ID NO: 884809 - RNA, 19 nt, Human
ccccccgcccccccacccc

SEQ ID NO: 884810 - RNA, 22 nt, Human
ccccccgcccccccacccccaa

SEQ ID NO: 884811 - RNA, 18 nt, Human
cccccgcccccccacccc

SEQ ID NO: 884812 - RNA, 28 nt, Human
cccccgcccccccacccccaaaaaacca

SEQ ID NO: 884813 - RNA, 21 nt, Human
ccccgcccccccacccccaaa

SEQ ID NO: 884814 - RNA, 22 nt, Human
cccgcccccccacccccaaaaa

SEQ ID NO: 884815 - RNA, 21 nt, Human
cccgggcuccuccgaaucucu

SEQ ID NO: 884816 - RNA, 18 nt, Human
cccuccucccccuccucc

SEQ ID NO: 884817 - RNA, 21 nt, Human
ccgagccccgagaucuccgcu

SEQ ID NO: 884818 - RNA, 22 nt, Human
ccgagccccgagaucuccgcuc

SEQ ID NO: 884819 - RNA, 20 nt, Human
ccggggcagcggcgagccuc

SEQ ID NO: 884820 - RNA, 19 nt, Human
ccucccccuccuccucccc

SEQ ID NO: 884821 - RNA, 20 nt, Human
ccuccgaaucucucugcgag

SEQ ID NO: 884822 - RNA, 21 nt, Human
ccuccucccccccgcccgggc

SEQ ID NO: 884823 - RNA, 25 nt, Human
cgagaucuccgcucccuccuccccc

SEQ ID NO: 884824 - RNA, 20 nt, Human
cgaucggagcggagcggcgg

SEQ ID NO: 884825 - RNA, 20 nt, Human
cgcccccccacccccaaaaa

SEQ ID NO: 884826 - RNA, 21 nt, Human
cggagcggagcggcggccggc

SEQ ID NO: 884827 - RNA, 21 nt, Human
cggcggagccggggcagcggc

SEQ ID NO: 884828 - RNA, 20 nt, Human
cggggcagcggcgagccucg

SEQ ID NO: 884829 - RNA, 22 nt, Human
gagcccccccgcccccccaccc

SEQ ID NO: 884830 - RNA, 23 nt, Human
gagcccccccgcccccccacccc

SEQ ID NO: 884831 - RNA, 18 nt, Human
gagcggagcggcggccgg

SEQ ID NO: 884832 - RNA, 28 nt, Human
gccccacagcgaucggagcggagcggcg

SEQ ID NO: 884833 - RNA, 19 nt, Human
ggagugaggcugguggggg

SEQ ID NO: 884834 - RNA, 19 nt, Human
ucccuccucccccuccucc

SEQ ID NO: 884835 - RNA, 21 nt, Human
uccgcucccuccucccccucc

SEQ ID NO: 884836 - RNA, 19 nt, Human
ucugaggacaucaccuaaa

SEQ ID NO: 884837 - RNA, 20 nt, Human
ucuuauauuacagcagauuc

SEQ ID NO: 884838 - RNA, 25 nt, Human
ugagcccccccgcccccccaccccc

SEQ ID NO: 884839 - RNA, 19 nt, Human
ugggauggggagugaggcu

SEQ ID NO: 884840 - RNA, 21 nt, Human
uggggagugaggcuggugggg

SEQ ID NO: 884841 - RNA, 18 nt, Human
uuuuuuuuuuuuuugggu

SEQ ID NO: 884842 - RNA, 22 nt, Human
uuuuuuuuuuuuuuuuuggguu

SEQ ID NO: 884843 - RNA, 21 nt, Human
uuuuuuuuuuuuuuuuuuggg

SEQ ID NO: 884844 - RNA, 24 nt, Human
aaaaaaggcuggggaaggcccagg

SEQ ID NO: 884845 - RNA, 19 nt, Human
aacuuagauccuucagcag

SEQ ID NO: 884846 - RNA, 20 nt, Human
aagcacagcaccacaaaaga

SEQ ID NO: 884847 - RNA, 22 nt, Human
aagcugcauccaccaaaaccca

SEQ ID NO: 884848 - RNA, 23 nt, Human
acacacacacacacacacacaca

SEQ ID NO: 884849 - RNA, 23 nt, Human
acacacacacacacacacacaca

SEQ ID NO: 884850 - RNA, 25 nt, Human
acacacacacacacacacacagagg

SEQ ID NO: 884851 - RNA, 18 nt, Human
acacauaugcacacacac

SEQ ID NO: 884852 - RNA, 19 nt, Human
acagcacaguccgacuggu

SEQ ID NO: 884853 - RNA, 18 nt, Human
acagugaauccucaucuc

SEQ ID NO: 884854 - RNA, 21 nt, Human
accacaaaagacucugacggg

SEQ ID NO: 884855 - RNA, 22 nt, Human
acgacauuucccaugaaucccc

SEQ ID NO: 884856 - RNA, 25 nt, Human
acgacauuucccaugaauccccugg

SEQ ID NO: 884857 - RNA, 21 nt, Human
acguugaugauuugcaggaac

SEQ ID NO: 884858 - RNA, 25 nt, Human
acugaaagguggagaaagcugagaa

SEQ ID NO: 884859 - RNA, 18 nt, Human
agaaucuuuaaaaauacc

SEQ ID NO: 884860 - RNA, 20 nt, Human
agaggaauaggugccccaga

SEQ ID NO: 884861 - RNA, 19 nt, Human
agaguugacagcucugcug

SEQ ID NO: 884862 - RNA, 22 nt, Human
agccccaucagccccugcccag

SEQ ID NO: 884863 - RNA, 20 nt, Human
agccggugcugugcagagca

SEQ ID NO: 884864 - RNA, 23 nt, Human
agcuggcgaguccaggcacguug

SEQ ID NO: 884865 - RNA, 18 nt, Human
agcugggcuaggcugggc

SEQ ID NO: 884866 - RNA, 22 nt, Human
agcuuucucuccauagcaguuu

SEQ ID NO: 884867 - RNA, 19 nt, Human
aggaacauccacgguacuc

SEQ ID NO: 884868 - RNA, 21 nt, Human
aggcaguccaccuggaccucc

SEQ ID NO: 884869 - RNA, 21 nt, Human
aggcuuuuagcuggcgagucc

SEQ ID NO: 884870 - RNA, 19 nt, Human
auaaaauaaaacccgcccc

SEQ ID NO: 884871 - RNA, 21 nt, Human
aucuuggccccuggcuucuca

SEQ ID NO: 884872 - RNA, 20 nt, Human
augaugccacacauggccag

SEQ ID NO: 884873 - RNA, 23 nt, Human
auggacacuccuguaggaacauc

SEQ ID NO: 884874 - RNA, 18 nt, Human
cacacacacacacacaca

SEQ ID NO: 884875 - RNA, 20 nt, Human
cacacacacacacacacaca

SEQ ID NO: 884876 - RNA, 20 nt, Human
cacacacacacacacacaca

SEQ ID NO: 884877 - RNA, 20 nt, Human
cacacacacacacacacaca

SEQ ID NO: 884878 - RNA, 20 nt, Human
cacacacacacacacacaca

SEQ ID NO: 884879 - RNA, 20 nt, Human
cacacacacacacacacaca

SEQ ID NO: 884880 - RNA, 22 nt, Human
cacacacacacacacacacaca

SEQ ID NO: 884881 - RNA, 26 nt, Human
cacacacacacacacacacacacaca

SEQ ID NO: 884882 - RNA, 26 nt, Human
cacacacacacacacacacacacaca

SEQ ID NO: 884883 - RNA, 18 nt, Human
cacacagaggcagcagac

SEQ ID NO: 884884 - RNA, 20 nt, Human
cacacauaugcacacacaca

SEQ ID NO: 884885 - RNA, 26 nt, Human
cacacauggccagucaccauggccag

SEQ ID NO: 884886 - RNA, 23 nt, Human
cacagcaccacaaaagacucuga

SEQ ID NO: 884887 - RNA, 27 nt, Human
cacagcaccacaaaagacucugacggg

SEQ ID NO: 884888 - RNA, 20 nt, Human
caccacaaaagacucugacg

SEQ ID NO: 884889 - RNA, 22 nt, Human
caccacaaaagacucugacggg

SEQ ID NO: 884890 - RNA, 21 nt, Human
cagcagccggugcugugcaga

SEQ ID NO: 884891 - RNA, 18 nt, Human
cagcagggggucugggug

SEQ ID NO: 884892 - RNA, 19 nt, Human
cagccucuccagcuugcuc

SEQ ID NO: 884893 - RNA, 22 nt, Human
cagccucuccagcuugcucuuc

SEQ ID NO: 884894 - RNA, 18 nt, Human
cagcuugcucuucugggg

SEQ ID NO: 884895 - RNA, 23 nt, Human
cagcuuuucaccgaagacggucc

SEQ ID NO: 884896 - RNA, 21 nt, Human
caggacagcuccugggaauga

SEQ ID NO: 884897 - RNA, 20 nt, Human
ccaaaacccacgauccaucc

SEQ ID NO: 884898 - RNA, 30 nt, Human
ccaacuuagauccuucagcagggcugccuu

SEQ ID NO: 884899 - RNA, 18 nt, Human
ccaccugggccgcuggca

SEQ ID NO: 884900 - RNA, 26 nt, Human
ccagaaauauucuguaggacucuaag

SEQ ID NO: 884901 - RNA, 20 nt, Human
ccagagucuucacagcagcc

SEQ ID NO: 884902 - RNA, 19 nt, Human
ccagcuugcucuucugggg

SEQ ID NO: 884903 - RNA, 21 nt, Human
ccaggacagcaauggcgccac

SEQ ID NO: 884904 - RNA, 21 nt, Human
ccauccaucuauggacacucc

SEQ ID NO: 884905 - RNA, 22 nt, Human
ccccagcagcuugugaccaaau

SEQ ID NO: 884906 - RNA, 19 nt, Human
cccugggggucuugggcug

SEQ ID NO: 884907 - RNA, 20 nt, Human
cccuugagcggccauggccu

SEQ ID NO: 884908 - RNA, 26 nt, Human
ccgccccagcagcuugugaccaaaug

SEQ ID NO: 884909 - RNA, 26 nt, Human
ccucccuggggccccugggagccuac

SEQ ID NO: 884910 - RNA, 20 nt, Human
ccugggaugcagaaacaguu

SEQ ID NO: 884911 - RNA, 24 nt, Human
cucauaaagccaacgggagcagcu

SEQ ID NO: 884912 - RNA, 18 nt, Human
cucuccagcuugcucuuc

SEQ ID NO: 884913 - RNA, 21 nt, Human
cucuccagcuugcucuucugg

SEQ ID NO: 884914 - RNA, 22 nt, Human
cuggcagaggaauaggugcccc

SEQ ID NO: 884915 - RNA, 23 nt, Human
cuuggccccuggcuucucaaccg

SEQ ID NO: 884916 - RNA, 22 nt, Human
gaagaccaucgcugggggcugc

SEQ ID NO: 884917 - RNA, 23 nt, Human
gacuggugacauccacggcacca

SEQ ID NO: 884918 - RNA, 21 nt, Human
gagaagaaaucccaaaguccc

SEQ ID NO: 884919 - RNA, 19 nt, Human
gagcccugggaugcagaaa

SEQ ID NO: 884920 - RNA, 23 nt, Human
gagcggccauggccugccugagc

SEQ ID NO: 884921 - RNA, 25 nt, Human
gaguggcaaugcacacauaugcaca

SEQ ID NO: 884922 - RNA, 18 nt, Human
gccagcccaaacaaggau

SEQ ID NO: 884923 - RNA, 24 nt, Human
gccccagaaaaaaggcuggggaag

SEQ ID NO: 884924 - RNA, 20 nt, Human
ggaauaggugccccagaaaa

SEQ ID NO: 884925 - RNA, 22 nt, Human
ggaauaggugccccagaaaaaa

SEQ ID NO: 884926 - RNA, 19 nt, Human
ggagcaggacuggcagagg

SEQ ID NO: 884927 - RNA, 19 nt, Human
ggccauggccugccugagc

SEQ ID NO: 884928 - RNA, 22 nt, Human
ggcuucuggacuuuuuggagaa

SEQ ID NO: 884929 - RNA, 18 nt, Human
gggggcugcugcagacag

SEQ ID NO: 884930 - RNA, 21 nt, Human
gguuucugaaaaacuugggag

SEQ ID NO: 884931 - RNA, 26 nt, Human
uagcuuucucuccauagcaguuuuua

SEQ ID NO: 884932 - RNA, 24 nt, Human
uaugcacacacacacacacacaca

SEQ ID NO: 884933 - RNA, 25 nt, Human
uaugcacacacacacacacacacac

SEQ ID NO: 884934 - RNA, 21 nt, Human
ucagagaagcaagaauuccca

SEQ ID NO: 884935 - RNA, 20 nt, Human
ucauaaagccaacgggagca

SEQ ID NO: 884936 - RNA, 19 nt, Human
uccaccaaaacccacgauc

SEQ ID NO: 884937 - RNA, 19 nt, Human
uccagcuugcucuucuggg

SEQ ID NO: 884938 - RNA, 20 nt, Human
uccaucuauggacacuccug

SEQ ID NO: 884939 - RNA, 18 nt, Human
uccaucuuggccccuggc

SEQ ID NO: 884940 - RNA, 22 nt, Human
ucccaaagucccaggacagcuc

SEQ ID NO: 884941 - RNA, 23 nt, Human
ucccaggacagcaauggcgccac

SEQ ID NO: 884942 - RNA, 18 nt, Human
ucccaggacagcuccugg

SEQ ID NO: 884943 - RNA, 18 nt, Human
ucccaugaauccccuggg

SEQ ID NO: 884944 - RNA, 19 nt, Human
uccccaguguacccagccc

SEQ ID NO: 884945 - RNA, 20 nt, Human
uccccaguguacccagcccc

SEQ ID NO: 884946 - RNA, 22 nt, Human
ucccugaguaucuccuaggggc

SEQ ID NO: 884947 - RNA, 19 nt, Human
ucccuggggccccugggag

SEQ ID NO: 884948 - RNA, 24 nt, Human
uccuccaggcuuagcugaugucga

SEQ ID NO: 884949 - RNA, 20 nt, Human
ucgcugggggcugcugcaga

SEQ ID NO: 884950 - RNA, 22 nt, Human
ucuccagguaauuuccagccuu

SEQ ID NO: 884951 - RNA, 19 nt, Human
ucucugaggggaagagucc

SEQ ID NO: 884952 - RNA, 18 nt, Human
ucuggacuuuuuggagaa

SEQ ID NO: 884953 - RNA, 22 nt, Human
ugaaacaacugagaaacugaaa

SEQ ID NO: 884954 - RNA, 22 nt, Human
ugacauccacggcaccagcagg

SEQ ID NO: 884955 - RNA, 23 nt, Human
ugagaagaaaucccaaaguccca

SEQ ID NO: 884956 - RNA, 19 nt, Human
ugagaagcacagcaccaca

SEQ ID NO: 884957 - RNA, 19 nt, Human
ugagcugggcuaggcuggg

SEQ ID NO: 884958 - RNA, 25 nt, Human
ugcacacacacacacacacacacac

SEQ ID NO: 884959 - RNA, 31 nt, Human
ugcacacauaugcacacacacacacacacag

SEQ ID NO: 884960 - RNA, 21 nt, Human
ugccccagaaaaaaggcuggg

SEQ ID NO: 884961 - RNA, 18 nt, Human
ugccugagcugggcuagg

SEQ ID NO: 884962 - RNA, 22 nt, Human
ugccugagcugggcuaggcugg

SEQ ID NO: 884963 - RNA, 24 nt, Human
uggcagaggaauaggugccccaga

SEQ ID NO: 884964 - RNA, 22 nt, Human
uggccagagucuucacagcagc

SEQ ID NO: 884965 - RNA, 21 nt, Human
uggccccuggcuucucaaccu

SEQ ID NO: 884966 - RNA, 18 nt, Human
uggcuucucaaccugccc

SEQ ID NO: 884967 - RNA, 22 nt, Human
ugggcucugggcuccaccuccu

SEQ ID NO: 884968 - RNA, 23 nt, Human
uggggaaggcccaggcuuuuagc

SEQ ID NO: 884969 - RNA, 24 nt, Human
uggggccccugggagccuacgcgg

SEQ ID NO: 884970 - RNA, 19 nt, Human
ugggggcugcugcagacag

SEQ ID NO: 884971 - RNA, 19 nt, Human
ugugcagagcagcaggcca

SEQ ID NO: 884972 - RNA, 26 nt, Human
uuuuaggucacacaacuuuuauugcu

SEQ ID NO: 884973 - RNA, 23 nt, Human
uuuuuuuuuuuuuuuuuuuuagg

SEQ ID NO: 884974 - RNA, 19 nt, Human
aagcaaagcauuagaauuc

SEQ ID NO: 884975 - RNA, 21 nt, Human
aagcaaagcauuagaauucau

SEQ ID NO: 884976 - RNA, 19 nt, Human
accccagaagacacaggaa

SEQ ID NO: 884977 - RNA, 20 nt, Human
agaagacacaggaaaccgca

SEQ ID NO: 884978 - RNA, 22 nt, Human
agaagacacaggaaaccgcaca

SEQ ID NO: 884979 - RNA, 22 nt, Human
agacacaggaaaccgcacagcu

SEQ ID NO: 884980 - RNA, 23 nt, Human
agaccccagaagacacaggaaac

SEQ ID NO: 884981 - RNA, 18 nt, Human
agccgaaggguggucccg

SEQ ID NO: 884982 - RNA, 22 nt, Human
auacuucgguaaacccaaucug

SEQ ID NO: 884983 - RNA, 20 nt, Human
auccuguccagcaaccuccc

SEQ ID NO: 884984 - RNA, 26 nt, Human
auuaaaacaaacauuucucauagcuc

SEQ ID NO: 884985 - RNA, 18 nt, Human
caaccucccagcucacac

SEQ ID NO: 884986 - RNA, 20 nt, Human
caaccucccagcucacaccu

SEQ ID NO: 884987 - RNA, 25 nt, Human
cacucccaccauaacuuauuaggag

SEQ ID NO: 884988 - RNA, 19 nt, Human
cagaccccagaagacacag

SEQ ID NO: 884989 - RNA, 22 nt, Human
cagaccccagaagacacaggaa

SEQ ID NO: 884990 - RNA, 23 nt, Human
cagaccccagaagacacaggaaa

SEQ ID NO: 884991 - RNA, 27 nt, Human
cagcaaccucccagcucacaccuuagc

SEQ ID NO: 884992 - RNA, 26 nt, Human
cagcaucccugcuaucuucacucaga

SEQ ID NO: 884993 - RNA, 22 nt, Human
cauuucucauagcucuaagcaa

SEQ ID NO: 884994 - RNA, 21 nt, Human
ccaagaagggugaacacagca

SEQ ID NO: 884995 - RNA, 22 nt, Human
ccccagaagacacaggaaaccc

SEQ ID NO: 884996 - RNA, 18 nt, Human
ccgcacagcuccacuccc

SEQ ID NO: 884997 - RNA, 21 nt, Human
ccggcagcggagccgcagccg

SEQ ID NO: 884998 - RNA, 25 nt, Human
cggcagagagugggguccgcggcca

SEQ ID NO: 884999 - RNA, 23 nt, Human
cggcaggggcgcgggcgggcggc

SEQ ID NO: 885000 - RNA, 21 nt, Human
cgggcggcgcggggcgcugcu

SEQ ID NO: 885001 - RNA, 22 nt, Human
cgguaaacccaaucuguauaaa

SEQ ID NO: 885002 - RNA, 20 nt, Human
cugaggcuauacacguuugc

SEQ ID NO: 885003 - RNA, 23 nt, Human
cuggggucccccauccuguccag

SEQ ID NO: 885004 - RNA, 24 nt, Human
gagccgcagccggaacggcagaga

SEQ ID NO: 885005 - RNA, 26 nt, Human
gccggaacggcagagagugggguccg

SEQ ID NO: 885006 - RNA, 21 nt, Human
gcgcgggcgggcggcgcgggg

SEQ ID NO: 885007 - RNA, 18 nt, Human
ggacuucugggguccccc

SEQ ID NO: 885008 - RNA, 23 nt, Human
ggcgcgggcgggcggcgcggggc

SEQ ID NO: 885009 - RNA, 19 nt, Human
uaccaagaagggugaacac

SEQ ID NO: 885010 - RNA, 27 nt, Human
uaccaagaagggugaacacagcauccc

SEQ ID NO: 885011 - RNA, 23 nt, Human
uagcuucuaccaagaagggugaa

SEQ ID NO: 885012 - RNA, 24 nt, Human
uauuaggagauaagucacauuuua

SEQ ID NO: 885013 - RNA, 24 nt, Human
ucacaccuuagcuucuaccaagaa

SEQ ID NO: 885014 - RNA, 20 nt, Human
uccacucccaccauaacuua

SEQ ID NO: 885015 - RNA, 22 nt, Human
uccgcggccggaaccggggggc

SEQ ID NO: 885016 - RNA, 23 nt, Human
uccgcggccggaaccggggggcg

SEQ ID NO: 885017 - RNA, 22 nt, Human
ucucauagcucuaagcaaagca

SEQ ID NO: 885018 - RNA, 23 nt, Human
ugaaagcauuuuuacuggaaccu

SEQ ID NO: 885019 - RNA, 19 nt, Human
uggaaccucaaaggcccac

SEQ ID NO: 885020 - RNA, 23 nt, Human
uuuacuggaaccucaaaggccca

SEQ ID NO: 885021 - RNA, 18 nt, Human
uuugcaaauuguaaggca

SEQ ID NO: 885022 - RNA, 18 nt, Human
aaaaaggcaucacccaca

SEQ ID NO: 885023 - RNA, 24 nt, Human
aaaaauauucauuuaacccauaac

SEQ ID NO: 885024 - RNA, 26 nt, Human
aaacauuagcuaucaaaacuaaauau

SEQ ID NO: 885025 - RNA, 19 nt, Human
aaaccccuaaaacacugga

SEQ ID NO: 885026 - RNA, 21 nt, Human
aaacugugcagauccaaacaa

SEQ ID NO: 885027 - RNA, 27 nt, Human
aaagaauuuucuuggcauacaacacca

SEQ ID NO: 885028 - RNA, 24 nt, Human
aacugugcaaucuaauuuaaccuu

SEQ ID NO: 885029 - RNA, 18 nt, Human
aagaaaaaggcaucaccc

SEQ ID NO: 885030 - RNA, 20 nt, Human
aauagcuucuuccaaaucuu

SEQ ID NO: 885031 - RNA, 19 nt, Human
aaucauugagcugccugga

SEQ ID NO: 885032 - RNA, 21 nt, Human
acagaaaucauccuguacuau

SEQ ID NO: 885033 - RNA, 20 nt, Human
acagggucucaaaugugaua

SEQ ID NO: 885034 - RNA, 18 nt, Human
accuagaaacagauuaca

SEQ ID NO: 885035 - RNA, 23 nt, Human
acuagaauacaggugaaacuagu

SEQ ID NO: 885036 - RNA, 21 nt, Human
acuguaauugugcuucaguua

SEQ ID NO: 885037 - RNA, 22 nt, Human
agaaauagggauacuuaaaagc

SEQ ID NO: 885038 - RNA, 19 nt, Human
agaugauuauaaacuguaa

SEQ ID NO: 885039 - RNA, 20 nt, Human
agcuaucaaaacuaaauauc

SEQ ID NO: 885040 - RNA, 18 nt, Human
auaggcaccaauaaaaag

SEQ ID NO: 885041 - RNA, 22 nt, Human
aucagauauuuaaucacaugac

SEQ ID NO: 885042 - RNA, 19 nt, Human
auccaaaaggcacauggag

SEQ ID NO: 885043 - RNA, 24 nt, Human
augaagaacaaaaauauauaaaua

SEQ ID NO: 885044 - RNA, 21 nt, Human
caccuagaaacagauuacagg

SEQ ID NO: 885045 - RNA, 22 nt, Human
caccuagaaacagauuacagga

SEQ ID NO: 885046 - RNA, 21 nt, Human
cauuaaaaauaauuguuacaa

SEQ ID NO: 885047 - RNA, 18 nt, Human
cccgccgcugaagcagcc

SEQ ID NO: 885048 - RNA, 19 nt, Human
cccgccgcugaagcagccg

SEQ ID NO: 885049 - RNA, 21 nt, Human
cccgccgcugaagcagccgcg

SEQ ID NO: 885050 - RNA, 25 nt, Human
ccuagaaacagauuacaggacgaau

SEQ ID NO: 885051 - RNA, 22 nt, Human
ccucuguugcuguacauugccu

SEQ ID NO: 885052 - RNA, 21 nt, Human
ccuucaacauuaccaaacacc

SEQ ID NO: 885053 - RNA, 18 nt, Human
cgccgcugaagcagccgc

SEQ ID NO: 885054 - RNA, 21 nt, Human
cuccgcuucugcggcgguggc

SEQ ID NO: 885055 - RNA, 21 nt, Human
cuuggcauacaacaccacaac

SEQ ID NO: 885056 - RNA, 22 nt, Human
cuuuguguggacagaaaucauc

SEQ ID NO: 885057 - RNA, 19 nt, Human
gaaaaaggcaucacccaca

SEQ ID NO: 885058 - RNA, 24 nt, Human
gaaagguauucauccucguaacuu

SEQ ID NO: 885059 - RNA, 24 nt, Human
gcaaaauuaucuccagacuucuac

SEQ ID NO: 885060 - RNA, 25 nt, Human
gcaaaauuaucuccagacuucuaca

SEQ ID NO: 885061 - RNA, 21 nt, Human
gcuugauaauuuacaaaagcu

SEQ ID NO: 885062 - RNA, 22 nt, Human
ggugaugacugggaccugggcu

SEQ ID NO: 885063 - RNA, 25 nt, Human
guaaaauugccucuucuaccuaaaa

SEQ ID NO: 885064 - RNA, 23 nt, Human
uaaaagaaaaaggcaucacccac

SEQ ID NO: 885065 - RNA, 24 nt, Human
uaagaaauagggauacuuaaaagc

SEQ ID NO: 885066 - RNA, 19 nt, Human
uacaaaaauauucauuuaa

SEQ ID NO: 885067 - RNA, 19 nt, Human
uacaacaccacaacaacuu

SEQ ID NO: 885068 - RNA, 22 nt, Human
uagcuauaaugaauaagcaaua

SEQ ID NO: 885069 - RNA, 21 nt, Human
uaguaccauaaauauaaguga

SEQ ID NO: 885070 - RNA, 22 nt, Human
uaguaccauaaauauaagugaa

SEQ ID NO: 885071 - RNA, 18 nt, Human
uccaaauccaagcagaua

SEQ ID NO: 885072 - RNA, 22 nt, Human
ucccaggcuuuucgaucggggc

SEQ ID NO: 885073 - RNA, 23 nt, Human
ucggcggcccucccaggcuuuuc

SEQ ID NO: 885074 - RNA, 23 nt, Human
ucucaacauuuacuagaauacag

SEQ ID NO: 885075 - RNA, 19 nt, Human
ucugcggcgguggcgccuu

SEQ ID NO: 885076 - RNA, 18 nt, Human
ugaaaauuaacugugcaa

SEQ ID NO: 885077 - RNA, 21 nt, Human
ugaagaacaaaaauauauaaa

SEQ ID NO: 885078 - RNA, 24 nt, Human
ugacugugaaauuuaaauauuuau

SEQ ID NO: 885079 - RNA, 20 nt, Human
ugacuuauuuacaccucccc

SEQ ID NO: 885080 - RNA, 19 nt, Human
ugagcugccuggaauauca

SEQ ID NO: 885081 - RNA, 21 nt, Human
ugauaaacgccaucacaaaau

SEQ ID NO: 885082 - RNA, 24 nt, Human
ugcauuaaaaauaauuguuacaau

SEQ ID NO: 885083 - RNA, 22 nt, Human
uggcauacaacaccacaacaac

SEQ ID NO: 885084 - RNA, 18 nt, Human
uggggcucucugggucca

SEQ ID NO: 885085 - RNA, 23 nt, Human
ugugcaaaaaccaaacugugcag

SEQ ID NO: 885086 - RNA, 19 nt, Human
uguguggacagaaaucauc

SEQ ID NO: 885087 - RNA, 22 nt, Human
uuaaacauuagcuaucaaaacu

SEQ ID NO: 885088 - RNA, 21 nt, Human
uugaagcuugauaauuuacaa

SEQ ID NO: 885089 - RNA, 22 nt, Human
uugaagcuugauaauuuacaaa

SEQ ID NO: 885090 - RNA, 19 nt, Human
uugacguagguuugguggg

SEQ ID NO: 885091 - RNA, 21 nt, Human
uuuucgaucggggccuuucug

SEQ ID NO: 885092 - RNA, 23 nt, Human
uuuuuuuuuuuaaaaaaaaagcu

SEQ ID NO: 885093 - RNA, 23 nt, Human
aaaaguaucuccaggcuccaagg

SEQ ID NO: 885094 - RNA, 20 nt, Human
aaacaaacaugaacacagac

SEQ ID NO: 885095 - RNA, 19 nt, Human
aaaggcuugaucccuaaac

SEQ ID NO: 885096 - RNA, 19 nt, Human
aaaguucucacauacacuu

SEQ ID NO: 885097 - RNA, 18 nt, Human
aagaaccagaaacagagc

SEQ ID NO: 885098 - RNA, 22 nt, Human
aagaaccagaaacagagcugga

SEQ ID NO: 885099 - RNA, 22 nt, Human
aagcugcaauuaucaacaagcu

SEQ ID NO: 885100 - RNA, 18 nt, Human
aagggagugucacccaaa

SEQ ID NO: 885101 - RNA, 19 nt, Human
aaggggcccggcagccugc

SEQ ID NO: 885102 - RNA, 23 nt, Human
acaagcucuaggcccaaagccac

SEQ ID NO: 885103 - RNA, 23 nt, Human
acagacacaaaccagacccaaag

SEQ ID NO: 885104 - RNA, 20 nt, Human
acaggaucuggguguagcac

SEQ ID NO: 885105 - RNA, 18 nt, Human
acccaaaaagcccacaua

SEQ ID NO: 885106 - RNA, 24 nt, Human
acccaaaaagcccacauaggaagu

SEQ ID NO: 885107 - RNA, 27 nt, Human
agaaccagaaacagagcuggacacuua

SEQ ID NO: 885108 - RNA, 20 nt, Human
agacacaaaccagacccaaa

SEQ ID NO: 885109 - RNA, 22 nt, Human
agaggagcgggaucccagggag

SEQ ID NO: 885110 - RNA, 25 nt, Human
agauaccucugguggccuccaacug

SEQ ID NO: 885111 - RNA, 18 nt, Human
aggaagcagggagcucag

SEQ ID NO: 885112 - RNA, 21 nt, Human
aggagcgggaucccagggagg

SEQ ID NO: 885113 - RNA, 21 nt, Human
aggcaaagacaagggggucug

SEQ ID NO: 885114 - RNA, 21 nt, Human
aggcccaaagccacauggcag

SEQ ID NO: 885115 - RNA, 26 nt, Human
agggagugggggcggugagaggaggc

SEQ ID NO: 885116 - RNA, 18 nt, Human
aucccuuaaacaaacaug

SEQ ID NO: 885117 - RNA, 24 nt, Human
caaaaguaucuccaggcuccaagg

SEQ ID NO: 885118 - RNA, 26 nt, Human
caaacacacaggaaccaggaguggac

SEQ ID NO: 885119 - RNA, 24 nt, Human
caacaagcucuaggcccaaagcca

SEQ ID NO: 885120 - RNA, 19 nt, Human
caagcacacguccccaccc

SEQ ID NO: 885121 - RNA, 20 nt, Human
caagcucuaggcccaaagcc

SEQ ID NO: 885122 - RNA, 23 nt, Human
caagcucuaggcccaaagccaca

SEQ ID NO: 885123 - RNA, 21 nt, Human
caagggaagcagaaggggccc

SEQ ID NO: 885124 - RNA, 21 nt, Human
cacaaaccagacccaaaguua

SEQ ID NO: 885125 - RNA, 24 nt, Human
cacaaaccagacccaaaguuaucu

SEQ ID NO: 885126 - RNA, 18 nt, Human
cacauaggaagucgacac

SEQ ID NO: 885127 - RNA, 21 nt, Human
cacccaaaaagcccacauagg

SEQ ID NO: 885128 - RNA, 27 nt, Human
cacucuacacuguguaaaaaucagagg

SEQ ID NO: 885129 - RNA, 22 nt, Human
cagacacaaaccagacccaaag

SEQ ID NO: 885130 - RNA, 18 nt, Human
caggacaacucucagaau

SEQ ID NO: 885131 - RNA, 21 nt, Human
caggacaacucucagaauugu

SEQ ID NO: 885132 - RNA, 18 nt, Human
cagggcaguaaguacaaa

SEQ ID NO: 885133 - RNA, 19 nt, Human
cccaaaaagcccacauagg

SEQ ID NO: 885134 - RNA, 20 nt, Human
cccacaagcacacgucccca

SEQ ID NO: 885135 - RNA, 18 nt, Human
cccacagucacacauauc

SEQ ID NO: 885136 - RNA, 18 nt, Human
cccacauaggaagucgac

SEQ ID NO: 885137 - RNA, 19 nt, Human
cccauccaucaccugacgc

SEQ ID NO: 885138 - RNA, 20 nt, Human
cccuuaaacaaacaugaaca

SEQ ID NO: 885139 - RNA, 21 nt, Human
ccggcagccugcacaggaucu

SEQ ID NO: 885140 - RNA, 27 nt, Human
ccucugagaaccgagaaagccuggcuc

SEQ ID NO: 885141 - RNA, 19 nt, Human
ccuugucaagcaauaccaa

SEQ ID NO: 885142 - RNA, 26 nt, Human
cgacacccacaaaaauaaauauugca

SEQ ID NO: 885143 - RNA, 19 nt, Human
cgagaaagccuggcuccaa

SEQ ID NO: 885144 - RNA, 24 nt, Human
cgccaccugugccccacaagcaca

SEQ ID NO: 885145 - RNA, 19 nt, Human
cggggcuggaguuggggaa

SEQ ID NO: 885146 - RNA, 24 nt, Human
cuagcaaagcaguggggauugugc

SEQ ID NO: 885147 - RNA, 30 nt, Human
cuggggcugguggugugagggugucccugg

SEQ ID NO: 885148 - RNA, 18 nt, Human
gaaaagucggaggacgca

SEQ ID NO: 885149 - RNA, 24 nt, Human
gaacacagacacaaaccagaccca

SEQ ID NO: 885150 - RNA, 24 nt, Human
gaaccgagaaagccuggcuccaaa

SEQ ID NO: 885151 - RNA, 18 nt, Human
gaagcagaaggggcccgg

SEQ ID NO: 885152 - RNA, 18 nt, Human
gaggagccugggagguag

SEQ ID NO: 885153 - RNA, 19 nt, Human
gaggagccugggagguagg

SEQ ID NO: 885154 - RNA, 21 nt, Human
gaggaggccggcucggucucu

SEQ ID NO: 885155 - RNA, 19 nt, Human
gcagggcaguaaguacaaa

SEQ ID NO: 885156 - RNA, 22 nt, Human
gccuugucaagcaauaccaaaa

SEQ ID NO: 885157 - RNA, 18 nt, Human
ggaaggaggcugaagagg

SEQ ID NO: 885158 - RNA, 19 nt, Human
ggaaggaggcugaagagga

SEQ ID NO: 885159 - RNA, 22 nt, Human
ggaccugcuggggcuggaggau

SEQ ID NO: 885160 - RNA, 23 nt, Human
ggccaaacacacaggaaccagga

SEQ ID NO: 885161 - RNA, 19 nt, Human
gggaaggaggcugaagagg

SEQ ID NO: 885162 - RNA, 21 nt, Human
ggggaaggaggcugaagagga

SEQ ID NO: 885163 - RNA, 24 nt, Human
gggguaguuuaugagcuaugccug

SEQ ID NO: 885164 - RNA, 18 nt, Human
gggucaaucaggagaaca

SEQ ID NO: 885165 - RNA, 21 nt, Human
gucagauggccuuccuggagu

SEQ ID NO: 885166 - RNA, 18 nt, Human
gugcagaggagccuggga

SEQ ID NO: 885167 - RNA, 23 nt, Human
uaaacaaacaugaacacagacac

SEQ ID NO: 885168 - RNA, 22 nt, Human
uaaacaaagccuugcacccaaa

SEQ ID NO: 885169 - RNA, 20 nt, Human
uacaaaaugaaggcauacaa

SEQ ID NO: 885170 - RNA, 23 nt, Human
uacaacugucacaggcagggcag

SEQ ID NO: 885171 - RNA, 25 nt, Human
uaggcgcugcgcccagccgggcucc

SEQ ID NO: 885172 - RNA, 25 nt, Human
uauaaaacgguaacgauucccuuga

SEQ ID NO: 885173 - RNA, 23 nt, Human
uaugaaauaggaagcagggagcu

SEQ ID NO: 885174 - RNA, 21 nt, Human
ucagaggcaaagacaaggggg

SEQ ID NO: 885175 - RNA, 21 nt, Human
ucccagugagcaccaggccaa

SEQ ID NO: 885176 - RNA, 26 nt, Human
uccccacccacagucacacauauccc

SEQ ID NO: 885177 - RNA, 24 nt, Human
ucccuaaacaaagccuugcaccca

SEQ ID NO: 885178 - RNA, 18 nt, Human
ugaacacagacacaaacc

SEQ ID NO: 885179 - RNA, 24 nt, Human
ugaacacagacacaaaccagaccc

SEQ ID NO: 885180 - RNA, 25 nt, Human
ugaaggcauacaacugucacaggca

SEQ ID NO: 885181 - RNA, 22 nt, Human
ugagcaccaggccaaagaccag

SEQ ID NO: 885182 - RNA, 21 nt, Human
ugagcuaugccugucacaggg

SEQ ID NO: 885183 - RNA, 18 nt, Human
ugauuguuuuaaaguuuu

SEQ ID NO: 885184 - RNA, 24 nt, Human
ugccacaagcugcaauuaucaaca

SEQ ID NO: 885185 - RNA, 23 nt, Human
ugccccacaagcacacgucccca

SEQ ID NO: 885186 - RNA, 24 nt, Human
ugcccgggccaaacacacaggaac

SEQ ID NO: 885187 - RNA, 24 nt, Human
uggauacaaaaugaaggcauacaa

SEQ ID NO: 885188 - RNA, 24 nt, Human
uggccuccaacugcaggacaacuc

SEQ ID NO: 885189 - RNA, 25 nt, Human
uggccuccaacugcaggacaacucu

SEQ ID NO: 885190 - RNA, 21 nt, Human
ugggggcggugagaggaggcc

SEQ ID NO: 885191 - RNA, 23 nt, Human
uggugugagggugucccugccug

SEQ ID NO: 885192 - RNA, 22 nt, Human
ugucacccaaaaagcccacaua

SEQ ID NO: 885193 - RNA, 19 nt, Human
uuaaaguuuuauuguagac

SEQ ID NO: 885194 - RNA, 22 nt, Human
aaaaggagauacagugaaaagu

SEQ ID NO: 885195 - RNA, 25 nt, Human
aaaaggagauacagugaaaagucuc

SEQ ID NO: 885196 - RNA, 19 nt, Human
aacccucccuuuuccccuu

SEQ ID NO: 885197 - RNA, 22 nt, Human
aauuaguauagggaccuagagc

SEQ ID NO: 885198 - RNA, 22 nt, Human
acaagcuuuuugaucuuugcca

SEQ ID NO: 885199 - RNA, 20 nt, Human
acccuccccacaaaccacca

SEQ ID NO: 885200 - RNA, 20 nt, Human
acccugucacccuccccaca

SEQ ID NO: 885201 - RNA, 22 nt, Human
acccugucacccuccccacaaa

SEQ ID NO: 885202 - RNA, 22 nt, Human
acccugucacccuccccacaaa

SEQ ID NO: 885203 - RNA, 23 nt, Human
acccugucacccuccccacaaac

SEQ ID NO: 885204 - RNA, 25 nt, Human
acccugucacccuccccacaaacca

SEQ ID NO: 885205 - RNA, 18 nt, Human
aggauuauuggauaauua

SEQ ID NO: 885206 - RNA, 22 nt, Human
auccacccugucacccucccca

SEQ ID NO: 885207 - RNA, 19 nt, Human
auccuguaccuauccaccc

SEQ ID NO: 885208 - RNA, 18 nt, Human
aucucaauuaguauaggg

SEQ ID NO: 885209 - RNA, 27 nt, Human
caaaaggagauacagugaaaagucucc

SEQ ID NO: 885210 - RNA, 23 nt, Human
caccauugguucuaagaauuuau

SEQ ID NO: 885211 - RNA, 19 nt, Human
cacccuccccacaaaccac

SEQ ID NO: 885212 - RNA, 25 nt, Human
cacccugucacccuccccacaaacc

SEQ ID NO: 885213 - RNA, 26 nt, Human
cacccugucacccuccccacaaacca

SEQ ID NO: 885214 - RNA, 22 nt, Human
ccauauuguccucuucaauaug

SEQ ID NO: 885215 - RNA, 27 nt, Human
cccucccuuuuccccuuaauuuguuuu

SEQ ID NO: 885216 - RNA, 21 nt, Human
ccuuuuuuaaggguuccauaa

SEQ ID NO: 885217 - RNA, 24 nt, Human
cucccaauccuguaccuauccacc

SEQ ID NO: 885218 - RNA, 22 nt, Human
cuguaccuauccacccugucac

SEQ ID NO: 885219 - RNA, 23 nt, Human
gaaguggaaacuacuggaucaaa

SEQ ID NO: 885220 - RNA, 24 nt, Human
gauacauaugguacaaaauucaaa

SEQ ID NO: 885221 - RNA, 26 nt, Human
gcaauuaauuguuucuaaucuuuagc

SEQ ID NO: 885222 - RNA, 20 nt, Human
guaccuauccacccugucac

SEQ ID NO: 885223 - RNA, 23 nt, Human
uacaaaauucaaaaaaauacaaa

SEQ ID NO: 885224 - RNA, 25 nt, Human
ucccaauccuguaccuauccacccu

SEQ ID NO: 885225 - RNA, 25 nt, Human
uccucuucaauauguacuucuguca

SEQ ID NO: 885226 - RNA, 23 nt, Human
ucuuugccaaucugacaguuuua

SEQ ID NO: 885227 - RNA, 21 nt, Human
uggaucaaagaguuagugcuu

SEQ ID NO: 885228 - RNA, 21 nt, Human
ugucacccuccccacaaacca

SEQ ID NO: 885229 - RNA, 23 nt, Human
uuaauuuguuuuggauaucuuuc

SEQ ID NO: 885230 - RNA, 22 nt, Human
uuacaugcuguuaugcaacccu

SEQ ID NO: 885231 - RNA, 18 nt, Human
uuauguuacaugcuguua

SEQ ID NO: 885232 - RNA, 23 nt, Human
uuuuccccuuaauuuguuuugga

SEQ ID NO: 885233 - RNA, 18 nt, Human
uuuuuuuuuuuuuuuuug

SEQ ID NO: 885234 - RNA, 19 nt, Human
uuuuuuuuuuuuuuuuugu

SEQ ID NO: 885235 - RNA, 25 nt, Human
uuuuuuuuuuuuuuuuuguauuuaa

SEQ ID NO: 885236 - RNA, 22 nt, Human
aaagagccuugugcgaagcaag

SEQ ID NO: 885237 - RNA, 20 nt, Human
aaauggccugcuagggagac

SEQ ID NO: 885238 - RNA, 22 nt, Human
aacucaguuucaaccaagcuga

SEQ ID NO: 885239 - RNA, 21 nt, Human
aagaggaagggaggaacaggg

SEQ ID NO: 885240 - RNA, 18 nt, Human
aagaggcugauuuguagu

SEQ ID NO: 885241 - RNA, 21 nt, Human
aagccagauauggacaggaaa

SEQ ID NO: 885242 - RNA, 22 nt, Human
aauaugugugauugugguuaca

SEQ ID NO: 885243 - RNA, 25 nt, Human
acccaaauauguuaaauauuuccuc

SEQ ID NO: 885244 - RNA, 18 nt, Human
agaggaagggaggaacag

SEQ ID NO: 885245 - RNA, 18 nt, Human
agaggaagggaggaacag

SEQ ID NO: 885246 - RNA, 23 nt, Human
agaggaagggaggaacaggggcc

SEQ ID NO: 885247 - RNA, 23 nt, Human
agaggcugauuuguaguuucucu

SEQ ID NO: 885248 - RNA, 18 nt, Human
agauauggacaggaaacc

SEQ ID NO: 885249 - RNA, 19 nt, Human
agccuugugcgaagcaagu

SEQ ID NO: 885250 - RNA, 21 nt, Human
aggcaguuuggcaaaaaccua

SEQ ID NO: 885251 - RNA, 21 nt, Human
aggcugauuuguaguuucucu

SEQ ID NO: 885252 - RNA, 23 nt, Human
auaaaccaagaugcaccaaacuu

SEQ ID NO: 885253 - RNA, 24 nt, Human
augcaagccagauauggacaggaa

SEQ ID NO: 885254 - RNA, 21 nt, Human
caaaauucuaaagauaaacac

SEQ ID NO: 885255 - RNA, 21 nt, Human
caagaugcaccaaacuucaug

SEQ ID NO: 885256 - RNA, 19 nt, Human
caaguaacuugcaagaggc

SEQ ID NO: 885257 - RNA, 20 nt, Human
cagaaccuauuuggugaaaa

SEQ ID NO: 885258 - RNA, 25 nt, Human
cagcauaaaccaagaugcaccaaac

SEQ ID NO: 885259 - RNA, 19 nt, Human
caggugagagaacaaguaa

SEQ ID NO: 885260 - RNA, 22 nt, Human
cauguccaaaaccuacauagaa

SEQ ID NO: 885261 - RNA, 18 nt, Human
ccaggaaaaagggaaaaa

SEQ ID NO: 885262 - RNA, 19 nt, Human
ccauucaaagccaggaguc

SEQ ID NO: 885263 - RNA, 18 nt, Human
ccccuuucuucccuuucu

SEQ ID NO: 885264 - RNA, 19 nt, Human
ccccuuucuucccuuucuu

SEQ ID NO: 885265 - RNA, 18 nt, Human
cccuuucuucccuuucuu

SEQ ID NO: 885266 - RNA, 21 nt, Human
ccuucuccccuuucuucccuu

SEQ ID NO: 885267 - RNA, 22 nt, Human
cuaaacuugcuaaacucccagg

SEQ ID NO: 885268 - RNA, 23 nt, Human
cuacauagaauugccuaccccuu

SEQ ID NO: 885269 - RNA, 24 nt, Human
cuccccuuucuucccuuucuuuuc

SEQ ID NO: 885270 - RNA, 20 nt, Human
cuucccuucuccccuuucuc

SEQ ID NO: 885271 - RNA, 23 nt, Human
cuucuccccuuucuucccuuucu

SEQ ID NO: 885272 - RNA, 24 nt, Human
cuugcuaaacucccaggaaaaagg

SEQ ID NO: 885273 - RNA, 22 nt, Human
cuuucuggcacaugcaagccag

SEQ ID NO: 885274 - RNA, 25 nt, Human
ggaacaggggcaagguggggaggaa

SEQ ID NO: 885275 - RNA, 20 nt, Human
ggaggaacaggggcaaggug

SEQ ID NO: 885276 - RNA, 22 nt, Human
gggaggaacaggggcaaggugg

SEQ ID NO: 885277 - RNA, 18 nt, Human
uaaaaagaacuuuuggca

SEQ ID NO: 885278 - RNA, 19 nt, Human
uacuucauucuccuggcug

SEQ ID NO: 885279 - RNA, 21 nt, Human
uauauaaauguugaagaggcu

SEQ ID NO: 885280 - RNA, 18 nt, Human
uauggacaggaaacccuc

SEQ ID NO: 885281 - RNA, 22 nt, Human
ucaaauccugacacuauaugac

SEQ ID NO: 885282 - RNA, 18 nt, Human
ucagaaccuauuugguga

SEQ ID NO: 885283 - RNA, 20 nt, Human
uccccuuucuucccuuucuc

SEQ ID NO: 885284 - RNA, 20 nt, Human
uccuaaacuugcuaaacucu

SEQ ID NO: 885285 - RNA, 21 nt, Human
ucuccccuuucuucccuuucu

SEQ ID NO: 885286 - RNA, 25 nt, Human
ucuccccuuucuucccuuucuuuuc

SEQ ID NO: 885287 - RNA, 19 nt, Human
ucucuuuguuuugucuaug

SEQ ID NO: 885288 - RNA, 26 nt, Human
ucuuccgaagaugaguugcuaguugc

SEQ ID NO: 885289 - RNA, 24 nt, Human
ugaagagacuauaagccagagagg

SEQ ID NO: 885290 - RNA, 22 nt, Human
ugaaguuggacccaaauauguu

SEQ ID NO: 885291 - RNA, 20 nt, Human
ugacacuauaugacauaaaa

SEQ ID NO: 885292 - RNA, 22 nt, Human
ugagagaacaaguaacuugcaa

SEQ ID NO: 885293 - RNA, 24 nt, Human
ugcaaagggagaagaggaagggag

SEQ ID NO: 885294 - RNA, 18 nt, Human
ugccucaguuaguucugc

SEQ ID NO: 885295 - RNA, 19 nt, Human
ugcuuuauuuauccagaag

SEQ ID NO: 885296 - RNA, 21 nt, Human
uggcaaaaaccuagaagggaa

SEQ ID NO: 885297 - RNA, 24 nt, Human
uguugucguuguuguugccguggc

SEQ ID NO: 885298 - RNA, 22 nt, Human
uucaugacuauucucuccuaaa

SEQ ID NO: 885299 - RNA, 19 nt, Human
uucccuucuccccuuucuu

SEQ ID NO: 885300 - RNA, 19 nt, Human
uugaagaggcugauuugua

SEQ ID NO: 885301 - RNA, 22 nt, Human
uuuaauagcaguugagccagca

SEQ ID NO: 885302 - RNA, 20 nt, Human
uuuuuuuuuuuuuuuuuugg

SEQ ID NO: 885303 - RNA, 21 nt, Human
uuuuuuuuuuuuuuuuuuguu

SEQ ID NO: 885304 - RNA, 23 nt, Human
aacugcuggcauucuugacuagu

SEQ ID NO: 885305 - RNA, 19 nt, Human
acaguuaaaaaaagaggaa

SEQ ID NO: 885306 - RNA, 26 nt, Human
caaagggaacaguuaaaaaaagagga

SEQ ID NO: 885307 - RNA, 18 nt, Human
caguuaaaaaaagaggaa

SEQ ID NO: 885308 - RNA, 23 nt, Human
cauuuccuucccugagaaaaggg

SEQ ID NO: 885309 - RNA, 24 nt, Human
ccccacuuaaaaaaaaaaaauauc

SEQ ID NO: 885310 - RNA, 18 nt, Human
ccccugcccuguuggcuu

SEQ ID NO: 885311 - RNA, 22 nt, Human
ccugagugauguccacggaagg

SEQ ID NO: 885312 - RNA, 24 nt, Human
ccugcccuguuggcuuuuuguuuc

SEQ ID NO: 885313 - RNA, 23 nt, Human
cucaaacaugguccaagaaagca

SEQ ID NO: 885314 - RNA, 22 nt, Human
gcccuguuggcuuuuuguuucc

SEQ ID NO: 885315 - RNA, 19 nt, Human
ggagagcucaaaggcuuaa

SEQ ID NO: 885316 - RNA, 25 nt, Human
ggcaaagggaacaguuaaaaaaaga

SEQ ID NO: 885317 - RNA, 21 nt, Human
ggcagaaaggcccauucuucu

SEQ ID NO: 885318 - RNA, 18 nt, Human
uaaaauguucagaaugua

SEQ ID NO: 885319 - RNA, 18 nt, Human
uaagaggcugaucugugu

SEQ ID NO: 885320 - RNA, 21 nt, Human
ucgccccucccccacagaggu

SEQ ID NO: 885321 - RNA, 20 nt, Human
ucugcaguuugaagggcaaa

SEQ ID NO: 885322 - RNA, 24 nt, Human
ucuucagauucauccacaaggucc

SEQ ID NO: 885323 - RNA, 19 nt, Human
ugaagggcaaagggaacag

SEQ ID NO: 885324 - RNA, 21 nt, Human
ugaagggcaaagggaacaguu

SEQ ID NO: 885325 - RNA, 26 nt, Human
ugaagggcaaagggaacaguuaaaac

SEQ ID NO: 885326 - RNA, 22 nt, Human
uggcacuugaugagcagaaguc

SEQ ID NO: 885327 - RNA, 23 nt, Human
uggcuuuuuguuuccauuuccuu

SEQ ID NO: 885328 - RNA, 19 nt, Human
uguaagaggcugaucugug

SEQ ID NO: 885329 - RNA, 22 nt, Human
uguaugggggagggguggagaa

SEQ ID NO: 885330 - RNA, 24 nt, Human
uguccacggaaggguccuuuccuu

SEQ ID NO: 885331 - RNA, 22 nt, Human
uugaauuggcacuugaugagca

SEQ ID NO: 885332 - RNA, 20 nt, Human
uuuuguggauuuuguauggg

SEQ ID NO: 885333 - RNA, 24 nt, Human
uuuuguggauuuuguaugggggag

SEQ ID NO: 885334 - RNA, 24 nt, Human
aaaauaaaaaucaauacgguucuc

SEQ ID NO: 885335 - RNA, 19 nt, Human
aagauaucuucaaacugaa

SEQ ID NO: 885336 - RNA, 19 nt, Human
acaaagcauugcauaacaa

SEQ ID NO: 885337 - RNA, 22 nt, Human
agucccguccucccugauucua

SEQ ID NO: 885338 - RNA, 22 nt, Human
cacagcauaagucccguccucc

SEQ ID NO: 885339 - RNA, 23 nt, Human
ccaagauaucuucaaacugaaga

SEQ ID NO: 885340 - RNA, 20 nt, Human
cuggcuuugaggcccuuccc

SEQ ID NO: 885341 - RNA, 22 nt, Human
gcuuugaggcccuucccccuca

SEQ ID NO: 885342 - RNA, 22 nt, Human
uagaaguuuuuuucuguugccu

SEQ ID NO: 885343 - RNA, 23 nt, Human
uagguucucacauauuaacauuu

SEQ ID NO: 885344 - RNA, 19 nt, Human
ucagugaggaaauuaacug

SEQ ID NO: 885345 - RNA, 22 nt, Human
ucagugaggaaauuaacuguac

SEQ ID NO: 885346 - RNA, 18 nt, Human
ugaaugcucaaacuaugg

SEQ ID NO: 885347 - RNA, 23 nt, Human
uuaaaauacuuccuagguucuca

SEQ ID NO: 885348 - RNA, 21 nt, Human
uucucaguuaagcccucugug

SEQ ID NO: 885349 - RNA, 19 nt, Human
uucuggugguuuauuugug

SEQ ID NO: 885350 - RNA, 24 nt, Human
uugcuuugaaugcucaaacuaugg

SEQ ID NO: 885351 - RNA, 24 nt, Human
uuuuuuuuuuuuuuuuucauuuuu

SEQ ID NO: 885352 - RNA, 23 nt, Human
aaacucccggacucaagcaaucc

SEQ ID NO: 885353 - RNA, 24 nt, Human
aaagugcugggauuacaggcauga

SEQ ID NO: 885354 - RNA, 25 nt, Human
aagcgauccucccaucucagucucc

SEQ ID NO: 885355 - RNA, 24 nt, Human
aagggucucacuauguuccccagg

SEQ ID NO: 885356 - RNA, 19 nt, Human
aagugcugggauuacaggc

SEQ ID NO: 885357 - RNA, 21 nt, Human
aagugcugggauuacaggcau

SEQ ID NO: 885358 - RNA, 26 nt, Human
aagugcugggauuacaggcaugagcc

SEQ ID NO: 885359 - RNA, 24 nt, Human
acccagacuggagugcaguggcau

SEQ ID NO: 885360 - RNA, 24 nt, Human
accggccgggugcaguggcucaug

SEQ ID NO: 885361 - RNA, 22 nt, Human
acucaagcaauccacucaccuc

SEQ ID NO: 885362 - RNA, 19 nt, Human
acuggagugcaguggcaug

SEQ ID NO: 885363 - RNA, 19 nt, Human
agauaccacgucacugugg

SEQ ID NO: 885364 - RNA, 19 nt, Human
agcaauccacucaccucag

SEQ ID NO: 885365 - RNA, 21 nt, Human
agcaauccacucaccucagcc

SEQ ID NO: 885366 - RNA, 21 nt, Human
agugcaguggcaugaucauag

SEQ ID NO: 885367 - RNA, 23 nt, Human
agugcaguggcaugaucauagcu

SEQ ID NO: 885368 - RNA, 24 nt, Human
agugcaguggcaugaucauagcuc

SEQ ID NO: 885369 - RNA, 23 nt, Human
aguggcucaugccuauaauuuuu

SEQ ID NO: 885370 - RNA, 24 nt, Human
auagcucacugcagacucaaacuc

SEQ ID NO: 885371 - RNA, 21 nt, Human
aucucagucucccaaagugcu

SEQ ID NO: 885372 - RNA, 18 nt, Human
augggaggcaacauggua

SEQ ID NO: 885373 - RNA, 24 nt, Human
caaagugcugggauuacaggcaug

SEQ ID NO: 885374 - RNA, 27 nt, Human
caagcgauccucccaucucagucuccc

SEQ ID NO: 885375 - RNA, 24 nt, Human
caauccacucaccucagccuccua

SEQ ID NO: 885376 - RNA, 24 nt, Human
cacaccaccaugcucagauaauuu

SEQ ID NO: 885377 - RNA, 24 nt, Human
cacuauguuccccaggcuggucuc

SEQ ID NO: 885378 - RNA, 23 nt, Human
ccaaagugcugggauuacaggca

SEQ ID NO: 885379 - RNA, 24 nt, Human
ccaaagugcugggauuacaggcau

SEQ ID NO: 885380 - RNA, 21 nt, Human
ccacugugccuggccuaaaaa

SEQ ID NO: 885381 - RNA, 24 nt, Human
cccaaagugcugggauuacaggca

SEQ ID NO: 885382 - RNA, 23 nt, Human
ccucagccccauccggccacucu

SEQ ID NO: 885383 - RNA, 26 nt, Human
ccucccaucucagucucccaaagugc

SEQ ID NO: 885384 - RNA, 21 nt, Human
ccuccuaacugggacuacagg

SEQ ID NO: 885385 - RNA, 22 nt, Human
ccucgcccgcaggaagaggcag

SEQ ID NO: 885386 - RNA, 24 nt, Human
cucaagcgauccucccaucucagu

SEQ ID NO: 885387 - RNA, 25 nt, Human
cucacugcagacucaaacucccgga

SEQ ID NO: 885388 - RNA, 18 nt, Human
cuccuaacugggacuaca

SEQ ID NO: 885389 - RNA, 21 nt, Human
cuguguggaggacacgaagca

SEQ ID NO: 885390 - RNA, 19 nt, Human
gacuacaggugcacaccac

SEQ ID NO: 885391 - RNA, 23 nt, Human
gacucaagcaauccacucaccuc

SEQ ID NO: 885392 - RNA, 18 nt, Human
gauuacaggcaugagcca

SEQ ID NO: 885393 - RNA, 22 nt, Human
gauuacaggcaugagccaccac

SEQ ID NO: 885394 - RNA, 26 nt, Human
gauuacaggcaugagccaccacugug

SEQ ID NO: 885395 - RNA, 21 nt, Human
gcaauacuaaaaucaauacac

SEQ ID NO: 885396 - RNA, 18 nt, Human
ggaggacacgaagcaaua

SEQ ID NO: 885397 - RNA, 26 nt, Human
ggauuacaggcaugagccaccacugu

SEQ ID NO: 885398 - RNA, 23 nt, Human
ggccgggugcaguggcucaugcc

SEQ ID NO: 885399 - RNA, 23 nt, Human
ggcgauaaaagacgcacgaguac

SEQ ID NO: 885400 - RNA, 23 nt, Human
ggugcaguggcucaugccuauaa

SEQ ID NO: 885401 - RNA, 23 nt, Human
gucuugcugucacccagacugga

SEQ ID NO: 885402 - RNA, 19 nt, Human
uaauaauucuuucuccccu

SEQ ID NO: 885403 - RNA, 25 nt, Human
uacaggcaugagccaccacugugcc

SEQ ID NO: 885404 - RNA, 22 nt, Human
uagagaaagggucucacuaugu

SEQ ID NO: 885405 - RNA, 23 nt, Human
uauguuccccaggcuggucucaa

SEQ ID NO: 885406 - RNA, 23 nt, Human
uauguuccccaggcuggucucaa

SEQ ID NO: 885407 - RNA, 24 nt, Human
uauguuccccaggcuggucucaag

SEQ ID NO: 885408 - RNA, 19 nt, Human
ucagccccauccggccacu

SEQ ID NO: 885409 - RNA, 23 nt, Human
ucauagcucacugcagacucaaa

SEQ ID NO: 885410 - RNA, 24 nt, Human
ucccaaagugcugggauuacaggc

SEQ ID NO: 885411 - RNA, 22 nt, Human
uccccaggcuggucucaagcga

SEQ ID NO: 885412 - RNA, 20 nt, Human
uccuaacugggacuacaggu

SEQ ID NO: 885413 - RNA, 24 nt, Human
ucucacuauguuccccaggcuggu

SEQ ID NO: 885414 - RNA, 22 nt, Human
ucuugcugucacccagacugga

SEQ ID NO: 885415 - RNA, 24 nt, Human
ucuugcugucacccagacuggagu

SEQ ID NO: 885416 - RNA, 25 nt, Human
ugagccaccacugugccuggccuaa

SEQ ID NO: 885417 - RNA, 20 nt, Human
ugcuaguuuucaacaaaugu

SEQ ID NO: 885418 - RNA, 19 nt, Human
uggagugcaguggcaugau

SEQ ID NO: 885419 - RNA, 19 nt, Human
uggagugcaguggcaugau

SEQ ID NO: 885420 - RNA, 21 nt, Human
uggagugcaguggcaugauca

SEQ ID NO: 885421 - RNA, 18 nt, Human
uggcaugaucauagcuca

SEQ ID NO: 885422 - RNA, 24 nt, Human
uggcaugaucauagcucacugcag

SEQ ID NO: 885423 - RNA, 19 nt, Human
uggcucaugccuauaauuu

SEQ ID NO: 885424 - RNA, 22 nt, Human
ugggacuacaggugcacaccac

SEQ ID NO: 885425 - RNA, 24 nt, Human
ugggacuacaggugcacaccacca

SEQ ID NO: 885426 - RNA, 18 nt, Human
ugggauuacaggcaugag

SEQ ID NO: 885427 - RNA, 22 nt, Human
ugggauuacaggcaugagccac

SEQ ID NO: 885428 - RNA, 24 nt, Human
ugggauuacaggcaugagccacca

SEQ ID NO: 885429 - RNA, 24 nt, Human
ugggauuacaggcaugagccacca

SEQ ID NO: 885430 - RNA, 25 nt, Human
ugggauuacaggcaugagccaccac

SEQ ID NO: 885431 - RNA, 25 nt, Human
ugggauuacaggcaugagccaccac

SEQ ID NO: 885432 - RNA, 26 nt, Human
ugggauuacaggcaugagccaccacu

SEQ ID NO: 885433 - RNA, 24 nt, Human
uguagagaaagggucucacuaugu

SEQ ID NO: 885434 - RNA, 18 nt, Human
uguguggaggacacgaag

SEQ ID NO: 885435 - RNA, 21 nt, Human
uuaaaauugucuugaaaguau

SEQ ID NO: 885436 - RNA, 22 nt, Human
uuguuuuuucagaagaugggag

SEQ ID NO: 885437 - RNA, 21 nt, Human
uuuuguuuuuucagaagaugg

SEQ ID NO: 885438 - RNA, 23 nt, Human
aaccccacaucuggacagacaca

SEQ ID NO: 885439 - RNA, 22 nt, Human
aagcaggagaaugaugcuccca

SEQ ID NO: 885440 - RNA, 19 nt, Human
acaaagcaggagaaugaug

SEQ ID NO: 885441 - RNA, 20 nt, Human
acaaagcaggagaaugauga

SEQ ID NO: 885442 - RNA, 24 nt, Human
accaauacauuuauuugcgggaga

SEQ ID NO: 885443 - RNA, 20 nt, Human
acccaauccacugggugcag

SEQ ID NO: 885444 - RNA, 19 nt, Human
accucgccucaccuucccu

SEQ ID NO: 885445 - RNA, 25 nt, Human
accucgccucaccuucccuaggucu

SEQ ID NO: 885446 - RNA, 18 nt, Human
accugggcccccauaagc

SEQ ID NO: 885447 - RNA, 18 nt, Human
agcauuagaugaggagga

SEQ ID NO: 885448 - RNA, 18 nt, Human
agcccggcugggcuggag

SEQ ID NO: 885449 - RNA, 21 nt, Human
auaagccauucucuggcccuc

SEQ ID NO: 885450 - RNA, 30 nt, Human
auucugccaacuccccaccucgccucaccu

SEQ ID NO: 885451 - RNA, 22 nt, Human
caaagcaggagaaugaugcucc

SEQ ID NO: 885452 - RNA, 25 nt, Human
caaagcaggagaaugaugcucccag

SEQ ID NO: 885453 - RNA, 20 nt, Human
caccauuaaacagaugagca

SEQ ID NO: 885454 - RNA, 25 nt, Human
cacccacgguggccagguugagacc

SEQ ID NO: 885455 - RNA, 26 nt, Human
cagccccacccccgcucaaccccaca

SEQ ID NO: 885456 - RNA, 21 nt, Human
caggagaaugaugcucccagc

SEQ ID NO: 885457 - RNA, 18 nt, Human
ccauucucuggcccucug

SEQ ID NO: 885458 - RNA, 22 nt, Human
ccccacccccgcucaaccccac

SEQ ID NO: 885459 - RNA, 24 nt, Human
ccccaccucgccucaccuucccua

SEQ ID NO: 885460 - RNA, 24 nt, Human
ccccauuagccuuuccccauccag

SEQ ID NO: 885461 - RNA, 21 nt, Human
ccuuuccccauccaaccuggg

SEQ ID NO: 885462 - RNA, 22 nt, Human
cgggguggggucugaccccauu

SEQ ID NO: 885463 - RNA, 25 nt, Human
cugcacaagacagacucagcaaauc

SEQ ID NO: 885464 - RNA, 19 nt, Human
cugcacagguaaccagauc

SEQ ID NO: 885465 - RNA, 21 nt, Human
gaugagcauuagaugaggagg

SEQ ID NO: 885466 - RNA, 19 nt, Human
gccaacuccccaccucgcc

SEQ ID NO: 885467 - RNA, 22 nt, Human
gccaacuccccaccucgccuca

SEQ ID NO: 885468 - RNA, 19 nt, Human
gccccacccccgcucaacc

SEQ ID NO: 885469 - RNA, 21 nt, Human
ggcaaauauggaacugaagcc

SEQ ID NO: 885470 - RNA, 21 nt, Human
ggguauucacaacugcacagg

SEQ ID NO: 885471 - RNA, 20 nt, Human
uaggccuagacaugauggug

SEQ ID NO: 885472 - RNA, 21 nt, Human
ugacccaauccacugggugca

SEQ ID NO: 885473 - RNA, 22 nt, Human
ugaugguggccacgugccaggg

SEQ ID NO: 885474 - RNA, 21 nt, Human
ugcagccccacccccgcucaa

SEQ ID NO: 885475 - RNA, 22 nt, Human
uggaacugaagcccggcugggc

SEQ ID NO: 885476 - RNA, 24 nt, Human
uucccuaggucugccgggugaccc

SEQ ID NO: 885477 - RNA, 21 nt, Human
aaaaaaaaaaaaaaaaagucc

SEQ ID NO: 885478 - RNA, 19 nt, Human
aaaaaaaaaaaaguccaga

SEQ ID NO: 885479 - RNA, 24 nt, Human
aaaaauacaaaaauuagcugcgug

SEQ ID NO: 885480 - RNA, 19 nt, Human
aacauggugaaaccccauc

SEQ ID NO: 885481 - RNA, 20 nt, Human
aacauggugaaaccccaucu

SEQ ID NO: 885482 - RNA, 21 nt, Human
aacauggugaaaccccaucuc

SEQ ID NO: 885483 - RNA, 21 nt, Human
aacauggugaaaccccaucuc

SEQ ID NO: 885484 - RNA, 18 nt, Human
aauucaaguaaaaaaaaa

SEQ ID NO: 885485 - RNA, 24 nt, Human
aauugcuugaaccugggaggcgga

SEQ ID NO: 885486 - RNA, 24 nt, Human
acagagugagacucugucucaaaa

SEQ ID NO: 885487 - RNA, 24 nt, Human
accaacauggugaaaccccaucuc

SEQ ID NO: 885488 - RNA, 24 nt, Human
accccaucucuacuaaaaauacaa

SEQ ID NO: 885489 - RNA, 24 nt, Human
acuggauuccagccugggugacag

SEQ ID NO: 885490 - RNA, 26 nt, Human
acuggauuccagccugggugacagag

SEQ ID NO: 885491 - RNA, 24 nt, Human
agcacuuugggaggcugagguggg

SEQ ID NO: 885492 - RNA, 24 nt, Human
agccugaccaacauggugaaaccc

SEQ ID NO: 885493 - RNA, 24 nt, Human
agccugggugacagagugagacuc

SEQ ID NO: 885494 - RNA, 23 nt, Human
agcugcgugugguggcgugugcc

SEQ ID NO: 885495 - RNA, 24 nt, Human
aggcacgguggcucacgucuguaa

SEQ ID NO: 885496 - RNA, 22 nt, Human
aggcaggagaauugcuugaacc

SEQ ID NO: 885497 - RNA, 24 nt, Human
aggcaggagaauugcuugaaccug

SEQ ID NO: 885498 - RNA, 20 nt, Human
aggcggagguugcagugagc

SEQ ID NO: 885499 - RNA, 24 nt, Human
aggcggagguugcagugagcugag

SEQ ID NO: 885500 - RNA, 21 nt, Human
aggcugaggcaggagaauugc

SEQ ID NO: 885501 - RNA, 24 nt, Human
aggcugaggcaggagaauugcuug

SEQ ID NO: 885502 - RNA, 21 nt, Human
aggcugaggugggcagaucac

SEQ ID NO: 885503 - RNA, 24 nt, Human
aggugggcagaucacaaggucagg

SEQ ID NO: 885504 - RNA, 24 nt, Human
auagugccacuggauuccagccug

SEQ ID NO: 885505 - RNA, 21 nt, Human
aucacaaggucaggaguucga

SEQ ID NO: 885506 - RNA, 24 nt, Human
caacauggugaaaccccaucucua

SEQ ID NO: 885507 - RNA, 24 nt, Human
cacgucuguaaucauagcacuuug

SEQ ID NO: 885508 - RNA, 21 nt, Human
cacuggauuccagccugggug

SEQ ID NO: 885509 - RNA, 20 nt, Human
cagccugggugacagaguga

SEQ ID NO: 885510 - RNA, 22 nt, Human
cagcgccucgcgggcgaacugg

SEQ ID NO: 885511 - RNA, 24 nt, Human
cagcuacucaggaggcugaggcag

SEQ ID NO: 885512 - RNA, 20 nt, Human
ccacuggauuccagccuggg

SEQ ID NO: 885513 - RNA, 21 nt, Human
ccacuggauuccagccugggu

SEQ ID NO: 885514 - RNA, 21 nt, Human
ccacuggauuccagccugggu

SEQ ID NO: 885515 - RNA, 24 nt, Human
ccacuggauuccagccugggugac

SEQ ID NO: 885516 - RNA, 26 nt, Human
ccaggccaggcacgguggcucacguc

SEQ ID NO: 885517 - RNA, 24 nt, Human
ccugaccaacauggugaaacccca

SEQ ID NO: 885518 - RNA, 19 nt, Human
ccugggaggcggagguugc

SEQ ID NO: 885519 - RNA, 22 nt, Human
ccugggugacagagugagacuc

SEQ ID NO: 885520 - RNA, 21 nt, Human
ccuguaaucccagcuacucag

SEQ ID NO: 885521 - RNA, 24 nt, Human
cgagaccagccugaccaacauggu

SEQ ID NO: 885522 - RNA, 18 nt, Human
cucaaaaaaaaaaaaaaa

SEQ ID NO: 885523 - RNA, 24 nt, Human
cucacgucuguaaucauagcacuu

SEQ ID NO: 885524 - RNA, 19 nt, Human
cucugucucaaaaaaaaaa

SEQ ID NO: 885525 - RNA, 21 nt, Human
cuguaaucauagcacuuuggg

SEQ ID NO: 885526 - RNA, 23 nt, Human
cuuugggaggcugaggugggcag

SEQ ID NO: 885527 - RNA, 24 nt, Human
gacagagugagacucugucucaaa

SEQ ID NO: 885528 - RNA, 23 nt, Human
gagaauugcuugaaccugggagg

SEQ ID NO: 885529 - RNA, 21 nt, Human
gagguugcagugagcugagau

SEQ ID NO: 885530 - RNA, 21 nt, Human
gaucacaaggucaggaguucg

SEQ ID NO: 885531 - RNA, 22 nt, Human
gaucacaaggucaggaguucga

SEQ ID NO: 885532 - RNA, 24 nt, Human
gaucacaaggucaggaguucgaga

SEQ ID NO: 885533 - RNA, 24 nt, Human
gauuccagccugggugacagagug

SEQ ID NO: 885534 - RNA, 24 nt, Human
gccacuggauuccagccuggguga

SEQ ID NO: 885535 - RNA, 21 nt, Human
gcugcgugugguggcgugugc

SEQ ID NO: 885536 - RNA, 18 nt, Human
ggagguugcagugagcug

SEQ ID NO: 885537 - RNA, 22 nt, Human
ggagguugcagugagcugagau

SEQ ID NO: 885538 - RNA, 22 nt, Human
ggagguugcagugagcugagau

SEQ ID NO: 885539 - RNA, 24 nt, Human
ggagguugcagugagcugagauag

SEQ ID NO: 885540 - RNA, 23 nt, Human
ggcagaucacaaggucaggaguu

SEQ ID NO: 885541 - RNA, 19 nt, Human
gguccgugccgaagaagag

SEQ ID NO: 885542 - RNA, 24 nt, Human
gguggcgugugccuguaaucccag

SEQ ID NO: 885543 - RNA, 24 nt, Human
gguggcucacgucuguaaucauag

SEQ ID NO: 885544 - RNA, 24 nt, Human
gugacagagugagacucugucuca

SEQ ID NO: 885545 - RNA, 24 nt, Human
guugcagugagcugagauagugcc

SEQ ID NO: 885546 - RNA, 24 nt, Human
uagcacuuugggaggcugaggugg

SEQ ID NO: 885547 - RNA, 20 nt, Human
ucaaaaaaaaaaaaaaaaaa

SEQ ID NO: 885548 - RNA, 22 nt, Human
ucaaaaaaaaaaaaaaaaaaaa

SEQ ID NO: 885549 - RNA, 23 nt, Human
ucaaaaaaaaaaaaaaaaaaaaa

SEQ ID NO: 885550 - RNA, 24 nt, Human
ucacaaggucaggaguucgagacc

SEQ ID NO: 885551 - RNA, 19 nt, Human
uccagccugggugacagag

SEQ ID NO: 885552 - RNA, 19 nt, Human
uccagccugggugacagag

SEQ ID NO: 885553 - RNA, 23 nt, Human
uccagccugggugacagagugag

SEQ ID NO: 885554 - RNA, 24 nt, Human
uccagccugggugacagagugaga

SEQ ID NO: 885555 - RNA, 27 nt, Human
uccaucuuuucggcaauaaucuucucu

SEQ ID NO: 885556 - RNA, 21 nt, Human
ucucuacuaaaaauacaaaaa

SEQ ID NO: 885557 - RNA, 19 nt, Human
ucuggagucccggcagucc

SEQ ID NO: 885558 - RNA, 24 nt, Human
ucuguaaucauagcacuuugggag

SEQ ID NO: 885559 - RNA, 23 nt, Human
ucugucucaaaaaaaaaaaaaaa

SEQ ID NO: 885560 - RNA, 19 nt, Human
ugaaaccccaucucuacua

SEQ ID NO: 885561 - RNA, 24 nt, Human
ugaaccugggaggcggagguugca

SEQ ID NO: 885562 - RNA, 24 nt, Human
ugaccaacauggugaaaccccauc

SEQ ID NO: 885563 - RNA, 21 nt, Human
ugagcugagauagugccacug

SEQ ID NO: 885564 - RNA, 24 nt, Human
ugaggcaggagaauugcuugaacc

SEQ ID NO: 885565 - RNA, 24 nt, Human
ugaggcaggagaauugcuugaacc

SEQ ID NO: 885566 - RNA, 26 nt, Human
ugaggugggcagaucacaaggucagg

SEQ ID NO: 885567 - RNA, 21 nt, Human
ugccaucuucuuugaaagucc

SEQ ID NO: 885568 - RNA, 24 nt, Human
ugccuguaaucccagcuacucagg

SEQ ID NO: 885569 - RNA, 21 nt, Human
ugcuugaaccugggaggcgga

SEQ ID NO: 885570 - RNA, 19 nt, Human
uggaaagugaggcaaucca

SEQ ID NO: 885571 - RNA, 21 nt, Human
uggcgugugccuguaauccca

SEQ ID NO: 885572 - RNA, 24 nt, Human
uggcgugugccuguaaucccagcu

SEQ ID NO: 885573 - RNA, 18 nt, Human
uggcucacgucuguaauc

SEQ ID NO: 885574 - RNA, 18 nt, Human
uggcucacgucuguaauc

SEQ ID NO: 885575 - RNA, 24 nt, Human
uggcucacgucuguaaucauagca

SEQ ID NO: 885576 - RNA, 29 nt, Human
ugggaggcggagguugcagugacaacggu

SEQ ID NO: 885577 - RNA, 24 nt, Human
ugggaggcggagguugcagugagc

SEQ ID NO: 885578 - RNA, 20 nt, Human
ugggaggcugaggugggcag

SEQ ID NO: 885579 - RNA, 24 nt, Human
ugggaggcugaggugggcagauca

SEQ ID NO: 885580 - RNA, 22 nt, Human
ugggcagaucacaaggucagga

SEQ ID NO: 885581 - RNA, 21 nt, Human
ugggugacagagugagacucu

SEQ ID NO: 885582 - RNA, 24 nt, Human
ugguggcgugugccuguaauccca

SEQ ID NO: 885583 - RNA, 19 nt, Human
uuagcugcgugugguggcg

SEQ ID NO: 885584 - RNA, 24 nt, Human
uuagcugcgugugguggcgugugc

SEQ ID NO: 885585 - RNA, 25 nt, Human
uuccaggccaggcacgguggcucac

SEQ ID NO: 885586 - RNA, 24 nt, Human
uugaaccugggaggcggagguugc

SEQ ID NO: 885587 - RNA, 22 nt, Human
uugcagugagcugagauagugc

SEQ ID NO: 885588 - RNA, 24 nt, Human
uugcuugaaccugggaggcggagg

SEQ ID NO: 885589 - RNA, 25 nt, Human
uugggaggcugaggugggcagauca

SEQ ID NO: 885590 - RNA, 24 nt, Human
uuuuuuguaauucaaguaaaaaaa

SEQ ID NO: 885591 - RNA, 20 nt, Human
agugggccugaauagacacu

SEQ ID NO: 885592 - RNA, 23 nt, Human
caaacuuguuuccuuuuauucug

SEQ ID NO: 885593 - RNA, 19 nt, Human
cagugggccugaauagaca

SEQ ID NO: 885594 - RNA, 24 nt, Human
ccgcugcccacgauggacaccacc

SEQ ID NO: 885595 - RNA, 20 nt, Human
cuaaaguaaacagacaugca

SEQ ID NO: 885596 - RNA, 24 nt, Human
uaguccgcugcccacgauggacac

SEQ ID NO: 885597 - RNA, 20 nt, Human
ugacuucuggggaaacuccu

SEQ ID NO: 885598 - RNA, 18 nt, Human
ugcccacgauggacacca

SEQ ID NO: 885599 - RNA, 24 nt, Human
ugcccacgauggacaccaccaaua

SEQ ID NO: 885600 - RNA, 20 nt, Human
uggaacgucacuaaaguaaa

SEQ ID NO: 885601 - RNA, 22 nt, Human
uggccagacuuucaaaguagcu

SEQ ID NO: 885602 - RNA, 21 nt, Human
uucaaaguagcuucuugaaga

SEQ ID NO: 885603 - RNA, 24 nt, Human
aacauuuucccaauaaacugacua

SEQ ID NO: 885604 - RNA, 19 nt, Human
aagaaagaaaacccuuuaa

SEQ ID NO: 885605 - RNA, 24 nt, Human
aagauacaccaaagaaacuauaca

SEQ ID NO: 885606 - RNA, 21 nt, Human
aagcaggcagcugcugacagu

SEQ ID NO: 885607 - RNA, 21 nt, Human
aagccaaauaugacaacacac

SEQ ID NO: 885608 - RNA, 23 nt, Human
aaggcgaauguguaacugaggug

SEQ ID NO: 885609 - RNA, 26 nt, Human
aaucagaaagucugauuaaauucaau

SEQ ID NO: 885610 - RNA, 21 nt, Human
acagauguguuuuauuaaaaa

SEQ ID NO: 885611 - RNA, 23 nt, Human
agaaaagcaggcagcugcugaca

SEQ ID NO: 885612 - RNA, 21 nt, Human
aggcgaauguguaacugaggu

SEQ ID NO: 885613 - RNA, 18 nt, Human
auugcauuucuauuggcc

SEQ ID NO: 885614 - RNA, 24 nt, Human
caaauaugacaacacacauguaua

SEQ ID NO: 885615 - RNA, 26 nt, Human
caauaguaacucaaacucuuaaaaaa

SEQ ID NO: 885616 - RNA, 26 nt, Human
caucacagaaaagcaggcagcugcug

SEQ ID NO: 885617 - RNA, 18 nt, Human
ccaagcugcccaaaugau

SEQ ID NO: 885618 - RNA, 22 nt, Human
ccaauaaacugacuaagccuca

SEQ ID NO: 885619 - RNA, 23 nt, Human
cccaaaugauuaucaagccaagu

SEQ ID NO: 885620 - RNA, 24 nt, Human
ccucaaaaggacagcuuaggaaaa

SEQ ID NO: 885621 - RNA, 23 nt, Human
cucaaaaggacagcuuaggaaaa

SEQ ID NO: 885622 - RNA, 24 nt, Human
cuugacaaagugaagcauccaucc

SEQ ID NO: 885623 - RNA, 23 nt, Human
gaaaacccuuuaaucagaaaguc

SEQ ID NO: 885624 - RNA, 24 nt, Human
gaaaagaauccuuucaguccuaga

SEQ ID NO: 885625 - RNA, 19 nt, Human
gaacucaaaaggucuggua

SEQ ID NO: 885626 - RNA, 22 nt, Human
gcccaaaugauuaucaagccaa

SEQ ID NO: 885627 - RNA, 22 nt, Human
gggagggaagcgcgcgcgcggg

SEQ ID NO: 885628 - RNA, 19 nt, Human
ggugacugcgccgggaggg

SEQ ID NO: 885629 - RNA, 27 nt, Human
guauauagcaaaagccaaauaugacag

SEQ ID NO: 885630 - RNA, 18 nt, Human
uaaaaugaguacuaauag

SEQ ID NO: 885631 - RNA, 27 nt, Human
uaauagcaaggaauaauccuaaacauu

SEQ ID NO: 885632 - RNA, 22 nt, Human
uacaauacaaaaauuuaacaau

SEQ ID NO: 885633 - RNA, 23 nt, Human
uacauacaucacagaaaagcagg

SEQ ID NO: 885634 - RNA, 24 nt, Human
uagaaaagaauccuuucaguccua

SEQ ID NO: 885635 - RNA, 19 nt, Human
uagaaaaggcgaaugugua

SEQ ID NO: 885636 - RNA, 21 nt, Human
uagcaacacuuuuccuuuggu

SEQ ID NO: 885637 - RNA, 23 nt, Human
uagcaacacuuuuccuuugguuu

SEQ ID NO: 885638 - RNA, 21 nt, Human
uauagcaaaagccaaauauga

SEQ ID NO: 885639 - RNA, 20 nt, Human
ucacagaaaagcaggcagcu

SEQ ID NO: 885640 - RNA, 21 nt, Human
ucagaaagucugauuaaauuc

SEQ ID NO: 885641 - RNA, 24 nt, Human
ucccuggugagguacugcagaggu

SEQ ID NO: 885642 - RNA, 19 nt, Human
uccuggcuagaucacagga

SEQ ID NO: 885643 - RNA, 21 nt, Human
ugagguacugcagagguaugu

SEQ ID NO: 885644 - RNA, 19 nt, Human
ugcuuugcuucuugagcug

SEQ ID NO: 885645 - RNA, 19 nt, Human
uggggagaacuuacugaag

SEQ ID NO: 885646 - RNA, 24 nt, Human
uggggagaacuuacugaaggguaa

SEQ ID NO: 885647 - RNA, 21 nt, Human
uguuauugcaauagcacuugg

SEQ ID NO: 885648 - RNA, 18 nt, Human
uuacccaagcugcccaaa

SEQ ID NO: 885649 - RNA, 20 nt, Human
uuucugcucaauuacuacca

SEQ ID NO: 885650 - RNA, 20 nt, Human
uuuucaaaaauagguuuuaa

SEQ ID NO: 885651 - RNA, 20 nt, Human
agcugaaaaucacaggcuga

SEQ ID NO: 885652 - RNA, 23 nt, Human
cucucauauaaaacacugauuau

SEQ ID NO: 885653 - RNA, 21 nt, Human
aaaguuauuuguauuacagcu

SEQ ID NO: 885654 - RNA, 24 nt, Human
aaaucuaucugacuuugaagcuga

SEQ ID NO: 885655 - RNA, 19 nt, Human
aacaagagacaaucugcag

SEQ ID NO: 885656 - RNA, 19 nt, Human
aacacgcugaaugauaaga

SEQ ID NO: 885657 - RNA, 22 nt, Human
caacaagagacaaucugcaggg

SEQ ID NO: 885658 - RNA, 23 nt, Human
cagcuccuuaaagaaagaguaca

SEQ ID NO: 885659 - RNA, 20 nt, Human
cauauacacgaaaaagcaca

SEQ ID NO: 885660 - RNA, 21 nt, Human
cccauaguaaccuaauaaagc

SEQ ID NO: 885661 - RNA, 22 nt, Human
ccugaagaaguacagauuucug

SEQ ID NO: 885662 - RNA, 20 nt, Human
cuuaaagaaagaguacaaau

SEQ ID NO: 885663 - RNA, 19 nt, Human
cuuucacccuacauacuau

SEQ ID NO: 885664 - RNA, 18 nt, Human
cuuucauuaauguucaaa

SEQ ID NO: 885665 - RNA, 21 nt, Human
cuuugaugaacacugcacaaa

SEQ ID NO: 885666 - RNA, 18 nt, Human
gaaaaagcacaauuauaa

SEQ ID NO: 885667 - RNA, 20 nt, Human
gagaaaaaucuaucugacuu

SEQ ID NO: 885668 - RNA, 23 nt, Human
guuuuauuccagguucaguuuua

SEQ ID NO: 885669 - RNA, 23 nt, Human
uacauacuauauuccaauaguau

SEQ ID NO: 885670 - RNA, 18 nt, Human
ucaaaaaaacuuacgcaa

SEQ ID NO: 885671 - RNA, 23 nt, Human
ucagaaauuaauggcaaacccau

SEQ ID NO: 885672 - RNA, 23 nt, Human
ucuauacuguuguauugaucaaa

SEQ ID NO: 885673 - RNA, 18 nt, Human
ucuggauaauuuuauaua

SEQ ID NO: 885674 - RNA, 20 nt, Human
ugaggauuuccugaagaagu

SEQ ID NO: 885675 - RNA, 18 nt, Human
ugaguaggcaaaucugca

SEQ ID NO: 885676 - RNA, 23 nt, Human
uggcaaacccauaguaaccuaau

SEQ ID NO: 885677 - RNA, 22 nt, Human
uuaaagaaagaguacaaauugu

SEQ ID NO: 885678 - RNA, 24 nt, Human
uuccagguucaguuuuagguucac

SEQ ID NO: 885679 - RNA, 24 nt, Human
uuccugaagaaguacagauuucug

SEQ ID NO: 885680 - RNA, 21 nt, Human
aaacccggaggcucucggcag

SEQ ID NO: 885681 - RNA, 26 nt, Human
agcacauacauaagauacauuauaua

SEQ ID NO: 885682 - RNA, 24 nt, Human
caacagcagcggcggcugcaguga

SEQ ID NO: 885683 - RNA, 25 nt, Human
cagcagcggcggcugcagugaggcc

SEQ ID NO: 885684 - RNA, 21 nt, Human
cagcggcggcugcagugaggc

SEQ ID NO: 885685 - RNA, 24 nt, Human
cagcggcggcugcagugaggcccc

SEQ ID NO: 885686 - RNA, 24 nt, Human
ccaccgcaaacccggaggcucucg

SEQ ID NO: 885687 - RNA, 20 nt, Human
ccccaagguuaccgccaggc

SEQ ID NO: 885688 - RNA, 19 nt, Human
cgcaaacccggaggcucuc

SEQ ID NO: 885689 - RNA, 23 nt, Human
cgcaaagcccacuccaacagcag

SEQ ID NO: 885690 - RNA, 18 nt, Human
gccaggccuggcuaggga

SEQ ID NO: 885691 - RNA, 18 nt, Human
gccccccacgggccucag

SEQ ID NO: 885692 - RNA, 19 nt, Human
gcccgggugccugcccccc

SEQ ID NO: 885693 - RNA, 22 nt, Human
gguuaccgccaggccuggcuag

SEQ ID NO: 885694 - RNA, 19 nt, Human
uaaaugcaugcauguuuca

SEQ ID NO: 885695 - RNA, 23 nt, Human
uaagacuccugagacuaacacau

SEQ ID NO: 885696 - RNA, 18 nt, Human
uaucagauuaaauaauuc

SEQ ID NO: 885697 - RNA, 21 nt, Human
ucaaaaagcaguaauuugguu

SEQ ID NO: 885698 - RNA, 18 nt, Human
ucugacaccaauaucuaa

SEQ ID NO: 885699 - RNA, 21 nt, Human
ugaggcccccaagguuaccgc

SEQ ID NO: 885700 - RNA, 24 nt, Human
ugaggcccccaagguuaccgccag

SEQ ID NO: 885701 - RNA, 24 nt, Human
ugggaggcccggcgcccgggugcc

SEQ ID NO: 885702 - RNA, 20 nt, Human
uucaaggaaacaaaaauuuc

SEQ ID NO: 885703 - RNA, 23 nt, Human
uuuaaaauucugacaccaauauc

SEQ ID NO: 885704 - RNA, 18 nt, Human
aagaagguggaucccagg

SEQ ID NO: 885705 - RNA, 20 nt, Human
aaugcuggggagcuuuccuc

SEQ ID NO: 885706 - RNA, 23 nt, Human
aaugguucuuguugcccuaccag

SEQ ID NO: 885707 - RNA, 22 nt, Human
accaccucucugacaagcgcua

SEQ ID NO: 885708 - RNA, 20 nt, Human
accucagaaaccuacacccc

SEQ ID NO: 885709 - RNA, 18 nt, Human
agaaaacaacccuaacca

SEQ ID NO: 885710 - RNA, 25 nt, Human
agaaauaaaaaaggacacuaauaac

SEQ ID NO: 885711 - RNA, 25 nt, Human
agagauaugucucuuuccagucuuc

SEQ ID NO: 885712 - RNA, 18 nt, Human
agucuuucuaaacacucu

SEQ ID NO: 885713 - RNA, 21 nt, Human
aucaaaaaguuccuggauucc

SEQ ID NO: 885714 - RNA, 23 nt, Human
cacaauuaacagucaagaacaaa

SEQ ID NO: 885715 - RNA, 21 nt, Human
cacagcugagccucugucacc

SEQ ID NO: 885716 - RNA, 21 nt, Human
caccagagaaggcugaggccc

SEQ ID NO: 885717 - RNA, 19 nt, Human
cacccuuugccagacaguu

SEQ ID NO: 885718 - RNA, 19 nt, Human
caccucagaaaccuacacc

SEQ ID NO: 885719 - RNA, 21 nt, Human
caccucagaaaccuacacccc

SEQ ID NO: 885720 - RNA, 24 nt, Human
cacgccuccugaaaaagcugagag

SEQ ID NO: 885721 - RNA, 20 nt, Human
cagcugagccucugucacca

SEQ ID NO: 885722 - RNA, 18 nt, Human
cauucagagaggcuggca

SEQ ID NO: 885723 - RNA, 23 nt, Human
cauugguugggggccauggcggg

SEQ ID NO: 885724 - RNA, 18 nt, Human
ccagacaguuugucucca

SEQ ID NO: 885725 - RNA, 21 nt, Human
cccacccaguuuccuuugccu

SEQ ID NO: 885726 - RNA, 22 nt, Human
ccccggaggccagaucuuuacu

SEQ ID NO: 885727 - RNA, 24 nt, Human
ccuaaggcucuuacuccuggauuu

SEQ ID NO: 885728 - RNA, 23 nt, Human
ccuuugccagacaguuugucucc

SEQ ID NO: 885729 - RNA, 28 nt, Human
cuaauugauccuccccacccaguuuccu

SEQ ID NO: 885730 - RNA, 23 nt, Human
cucucugccccuucugccuccua

SEQ ID NO: 885731 - RNA, 18 nt, Human
gacacuaauaacauuugu

SEQ ID NO: 885732 - RNA, 28 nt, Human
gagggauagaagcagugucccuauucug

SEQ ID NO: 885733 - RNA, 28 nt, Human
gccccaauggcacaccucagaaaccuac

SEQ ID NO: 885734 - RNA, 20 nt, Human
gcucugggcuguucaaaggu

SEQ ID NO: 885735 - RNA, 23 nt, Human
ggcuggacuccugagcacaagcu

SEQ ID NO: 885736 - RNA, 18 nt, Human
guugccagaaucucucca

SEQ ID NO: 885737 - RNA, 19 nt, Human
uaaaauaacuuuuaagagg

SEQ ID NO: 885738 - RNA, 21 nt, Human
uaagaaaacaacccuaaccau

SEQ ID NO: 885739 - RNA, 26 nt, Human
uaccaggaaaagaauuaagaaaacaa

SEQ ID NO: 885740 - RNA, 27 nt, Human
uaccaggaaaagaauuaagaaaacaac

SEQ ID NO: 885741 - RNA, 23 nt, Human
uccuggauucccaggcacgccuc

SEQ ID NO: 885742 - RNA, 21 nt, Human
ucucauccccucggaccucca

SEQ ID NO: 885743 - RNA, 22 nt, Human
ucucuaauugauccuccccacc

SEQ ID NO: 885744 - RNA, 24 nt, Human
ucucuccauuggagggauagaagc

SEQ ID NO: 885745 - RNA, 19 nt, Human
ucucugccccuucugccuc

SEQ ID NO: 885746 - RNA, 21 nt, Human
ucucuuuccagucuucuuggg

SEQ ID NO: 885747 - RNA, 22 nt, Human
ucugccccuucugccuccuccc

SEQ ID NO: 885748 - RNA, 24 nt, Human
ucugucaccagagaaggcugaggc

SEQ ID NO: 885749 - RNA, 19 nt, Human
ugacaagcgcuaauagcau

SEQ ID NO: 885750 - RNA, 19 nt, Human
ugagcuggauucguugcaa

SEQ ID NO: 885751 - RNA, 20 nt, Human
ugcccuaccaggaaaagaag

SEQ ID NO: 885752 - RNA, 21 nt, Human
uggacuccugagcacaagcuc

SEQ ID NO: 885753 - RNA, 23 nt, Human
uggacuccugagcacaagcuccc

SEQ ID NO: 885754 - RNA, 24 nt, Human
uggaggaggggaccuaaggaagaa

SEQ ID NO: 885755 - RNA, 22 nt, Human
uggcacaccucagaaaccuaca

SEQ ID NO: 885756 - RNA, 22 nt, Human
ugggugaggcuagguugcaagc

SEQ ID NO: 885757 - RNA, 23 nt, Human
ugguggccacagcugagccucug

SEQ ID NO: 885758 - RNA, 24 nt, Human
ugguugugugugugugguugugug

SEQ ID NO: 885759 - RNA, 20 nt, Human
ugucucaguacuuuguacug

SEQ ID NO: 885760 - RNA, 21 nt, Human
ugugugugugguugugugugu

SEQ ID NO: 885761 - RNA, 23 nt, Human
ugugugugugguugugugugugu

SEQ ID NO: 885762 - RNA, 24 nt, Human
ugugugugugguugugugugugug

SEQ ID NO: 885763 - RNA, 20 nt, Human
ugugugugugugguugugug

SEQ ID NO: 885764 - RNA, 21 nt, Human
ugugugugugugguugugugu

SEQ ID NO: 885765 - RNA, 19 nt, Human
uguguguugguggccacag

SEQ ID NO: 885766 - RNA, 22 nt, Human
uguguugguggccacagcugag

SEQ ID NO: 885767 - RNA, 23 nt, Human
uuccucuagauuggaaaugguuc

SEQ ID NO: 885768 - RNA, 19 nt, Human
uugauccuccccacccagu

SEQ ID NO: 885769 - RNA, 21 nt, Human
uugccagaaucucuccauugg

SEQ ID NO: 885770 - RNA, 24 nt, Human
uugccagaaucucuccauuggagg

SEQ ID NO: 885771 - RNA, 18 nt, Human
uugcccaggagcaagcaa

SEQ ID NO: 885772 - RNA, 27 nt, Human
uugcccuaccaggaaaagaauuaagaa

SEQ ID NO: 885773 - RNA, 22 nt, Human
uugugugugugugguugugugu

SEQ ID NO: 885774 - RNA, 24 nt, Human
uuuaagaggacaaggcauuagaaa

SEQ ID NO: 885775 - RNA, 21 nt, Human
uuugugugugugguugugugu

SEQ ID NO: 885776 - RNA, 21 nt, Human
uuuuuuuuuuuuuuuuucacc

SEQ ID NO: 885777 - RNA, 20 nt, Human
aggcaccccaggcaccggca

SEQ ID NO: 885778 - RNA, 18 nt, Human
cccuggcugggggaaagg

SEQ ID NO: 885779 - RNA, 22 nt, Human
aagaugguaugcaauaauucuu

SEQ ID NO: 885780 - RNA, 24 nt, Human
acccgccugcucagccagaucaac

SEQ ID NO: 885781 - RNA, 19 nt, Human
agauagauacuuguaugcc

SEQ ID NO: 885782 - RNA, 22 nt, Human
cacccgccugcucagccagauc

SEQ ID NO: 885783 - RNA, 21 nt, Human
cagcacugcugucucuccucu

SEQ ID NO: 885784 - RNA, 21 nt, Human
cagccagaucaaccaaaucaa

SEQ ID NO: 885785 - RNA, 20 nt, Human
caggaaagccuagccugaua

SEQ ID NO: 885786 - RNA, 21 nt, Human
cagugagggaggacggggaca

SEQ ID NO: 885787 - RNA, 22 nt, Human
ccaaaucaauccuggcgaucaa

SEQ ID NO: 885788 - RNA, 21 nt, Human
ccagauagauacuuguaugcc

SEQ ID NO: 885789 - RNA, 20 nt, Human
cuuugaaaaaugagcaggaa

SEQ ID NO: 885790 - RNA, 22 nt, Human
gaaggcucucaaugggaaaaug

SEQ ID NO: 885791 - RNA, 22 nt, Human
ggagaagaaguggucacaggug

SEQ ID NO: 885792 - RNA, 18 nt, Human
guaaagugcaugcagucc

SEQ ID NO: 885793 - RNA, 19 nt, Human
gugaaagauguugcaguca

SEQ ID NO: 885794 - RNA, 19 nt, Human
uaccaaaagguaaaugcuc

SEQ ID NO: 885795 - RNA, 19 nt, Human
uacccucaaaucuggagcg

SEQ ID NO: 885796 - RNA, 21 nt, Human
uaggagggacacauauggggc

SEQ ID NO: 885797 - RNA, 21 nt, Human
uaugcaauaauucuuaugaga

SEQ ID NO: 885798 - RNA, 19 nt, Human
uccuccucuaucagagaag

SEQ ID NO: 885799 - RNA, 22 nt, Human
ucguccucuucaacugagcaug

SEQ ID NO: 885800 - RNA, 22 nt, Human
ucucccagcacugcugucucuc

SEQ ID NO: 885801 - RNA, 22 nt, Human
ucucuccucuuucuccuuggua

SEQ ID NO: 885802 - RNA, 22 nt, Human
ugaggggaggaacaucucugag

SEQ ID NO: 885803 - RNA, 20 nt, Human
ugaguucccauggaaggcuc

SEQ ID NO: 885804 - RNA, 21 nt, Human
ugcugucucuccucuuucucc

SEQ ID NO: 885805 - RNA, 23 nt, Human
ugggaucuccucacucccagacu

SEQ ID NO: 885806 - RNA, 22 nt, Human
ugguaaguacagggcuuguuuc

SEQ ID NO: 885807 - RNA, 20 nt, Human
ugugcuggugucaacaggag

SEQ ID NO: 885808 - RNA, 18 nt, Human
uucuauuugagaaucucc

SEQ ID NO: 885809 - RNA, 21 nt, Human
uuggagaagaaguggucacag

SEQ ID NO: 885810 - RNA, 20 nt, Human
aaagagaaaaaaggugacag

SEQ ID NO: 885811 - RNA, 19 nt, Human
aagaagcccccuauacuuc

SEQ ID NO: 885812 - RNA, 23 nt, Human
aagaagcccccuauacuucucua

SEQ ID NO: 885813 - RNA, 21 nt, Human
aagguaugaaaggguuugagg

SEQ ID NO: 885814 - RNA, 19 nt, Human
accacuguaaccuccuggc

SEQ ID NO: 885815 - RNA, 19 nt, Human
accccuaaccucugccugc

SEQ ID NO: 885816 - RNA, 24 nt, Human
agaaaaaaggugacagaaagagaa

SEQ ID NO: 885817 - RNA, 18 nt, Human
agaaugccuguuugcugg

SEQ ID NO: 885818 - RNA, 22 nt, Human
agagaaaaaaggugacagaaag

SEQ ID NO: 885819 - RNA, 21 nt, Human
agcccagcagggaagaagccc

SEQ ID NO: 885820 - RNA, 24 nt, Human
aggcaggaacccaggggcagggga

SEQ ID NO: 885821 - RNA, 19 nt, Human
cagcagggaagaagccccc

SEQ ID NO: 885822 - RNA, 21 nt, Human
ccagcagggaagaagcccccu

SEQ ID NO: 885823 - RNA, 20 nt, Human
cccaggggcaggggagggga

SEQ ID NO: 885824 - RNA, 23 nt, Human
cccugcaagcugaugguaccgag

SEQ ID NO: 885825 - RNA, 20 nt, Human
ccuaaccucugccugcggcc

SEQ ID NO: 885826 - RNA, 18 nt, Human
cgcccgcggaccgccauc

SEQ ID NO: 885827 - RNA, 21 nt, Human
cucagugcaagggaagaagga

SEQ ID NO: 885828 - RNA, 21 nt, Human
cucaucaaggccuccaggacc

SEQ ID NO: 885829 - RNA, 22 nt, Human
gaaaaaagagaaaaaaggugac

SEQ ID NO: 885830 - RNA, 18 nt, Human
gaaagauagaacuggugg

SEQ ID NO: 885831 - RNA, 26 nt, Human
gcuugaggagggaaggcaggaaccca

SEQ ID NO: 885832 - RNA, 18 nt, Human
gggcaggggaggggaucu

SEQ ID NO: 885833 - RNA, 20 nt, Human
gguaugacuaaggggauguu

SEQ ID NO: 885834 - RNA, 18 nt, Human
ggugacagaaagagaaag

SEQ ID NO: 885835 - RNA, 19 nt, Human
guugggguucugggcagcc

SEQ ID NO: 885836 - RNA, 26 nt, Human
uacuugggugugguaugacuaagggg

SEQ ID NO: 885837 - RNA, 20 nt, Human
uaggacggcuccauaagcga

SEQ ID NO: 885838 - RNA, 20 nt, Human
uauaaacccagcugugagaa

SEQ ID NO: 885839 - RNA, 23 nt, Human
ucagcaauuaugaugaccacugu

SEQ ID NO: 885840 - RNA, 18 nt, Human
ucagugcaagggaagaag

SEQ ID NO: 885841 - RNA, 24 nt, Human
ucugggcagcccaugcuucagccc

SEQ ID NO: 885842 - RNA, 21 nt, Human
ucuuagcaaagccuccucggg

SEQ ID NO: 885843 - RNA, 21 nt, Human
ugacagaaagagaaagauaga

SEQ ID NO: 885844 - RNA, 21 nt, Human
ugagagcagugugguaagccc

SEQ ID NO: 885845 - RNA, 22 nt, Human
ugaggagggaaggcaggaaccc

SEQ ID NO: 885846 - RNA, 23 nt, Human
ugaugguaccgagcaugagacug

SEQ ID NO: 885847 - RNA, 22 nt, Human
ugcuucagccccugcaagcuga

SEQ ID NO: 885848 - RNA, 19 nt, Human
uggggaagaaugugaauua

SEQ ID NO: 885849 - RNA, 22 nt, Human
ugggguucugggcagcccaugc

SEQ ID NO: 885850 - RNA, 24 nt, Human
uuauucuaaagaaauuucgaagaa

SEQ ID NO: 885851 - RNA, 22 nt, Human
acaccugggcggccgcaggacu

SEQ ID NO: 885852 - RNA, 23 nt, Human
accacauccgcucccuagcuccg

SEQ ID NO: 885853 - RNA, 21 nt, Human
accugggcggccgcaggacuc

SEQ ID NO: 885854 - RNA, 21 nt, Human
agcugcccaugggcccggggu

SEQ ID NO: 885855 - RNA, 24 nt, Human
aggaguccggccagcccaccacau

SEQ ID NO: 885856 - RNA, 24 nt, Human
cacacccaggccgugggcagccac

SEQ ID NO: 885857 - RNA, 20 nt, Human
caccccuucuccaagcggca

SEQ ID NO: 885858 - RNA, 27 nt, Human
cacccuccgagacaccugggccggggg

SEQ ID NO: 885859 - RNA, 19 nt, Human
cagcacagugaccccuucc

SEQ ID NO: 885860 - RNA, 19 nt, Human
cagcacagugaccccuucc

SEQ ID NO: 885861 - RNA, 21 nt, Human
cagugaccccuucccuggucc

SEQ ID NO: 885862 - RNA, 20 nt, Human
cauacccccuccccauccca

SEQ ID NO: 885863 - RNA, 19 nt, Human
cauccgaggcacuuggugg

SEQ ID NO: 885864 - RNA, 19 nt, Human
cauuccagccacacccagg

SEQ ID NO: 885865 - RNA, 22 nt, Human
cauuccagccacacccaggccg

SEQ ID NO: 885866 - RNA, 23 nt, Human
cauuccagccacacccaggccgu

SEQ ID NO: 885867 - RNA, 19 nt, Human
cccaggaguccggccagcc

SEQ ID NO: 885868 - RNA, 21 nt, Human
ccccacugagcuccuuucuca

SEQ ID NO: 885869 - RNA, 23 nt, Human
ccccaucccaucuuggcaaagcg

SEQ ID NO: 885870 - RNA, 19 nt, Human
ccccauggccaccggggcc

SEQ ID NO: 885871 - RNA, 25 nt, Human
ccccuccccaucccaucuuggcaaa

SEQ ID NO: 885872 - RNA, 19 nt, Human
ccggcgaggccaccccuuc

SEQ ID NO: 885873 - RNA, 29 nt, Human
ccuccgagacaccugggccgggggcaggg

SEQ ID NO: 885874 - RNA, 18 nt, Human
ccugaggcccaaggaggc

SEQ ID NO: 885875 - RNA, 21 nt, Human
ccugcacugccccacagcaag

SEQ ID NO: 885876 - RNA, 20 nt, Human
ccugggcggccgcaggacuc

SEQ ID NO: 885877 - RNA, 26 nt, Human
cggggucaagccaccacccacauguc

SEQ ID NO: 885878 - RNA, 22 nt, Human
cgugggcagccacccuccgaga

SEQ ID NO: 885879 - RNA, 22 nt, Human
cucauacccccuccccauccca

SEQ ID NO: 885880 - RNA, 24 nt, Human
cuccugccaccauuccagccacac

SEQ ID NO: 885881 - RNA, 20 nt, Human
cuggugcagcuuagggcagc

SEQ ID NO: 885882 - RNA, 22 nt, Human
gaccaccuccccacugagcucc

SEQ ID NO: 885883 - RNA, 18 nt, Human
gaccccuucccugguccg

SEQ ID NO: 885884 - RNA, 20 nt, Human
gccaccccuucuccaagcgg

SEQ ID NO: 885885 - RNA, 25 nt, Human
gcccacuccugccaccauuccagcc

SEQ ID NO: 885886 - RNA, 22 nt, Human
gcccggggucaagccaccaccc

SEQ ID NO: 885887 - RNA, 23 nt, Human
gcuuagggcagcugaagcacucg

SEQ ID NO: 885888 - RNA, 18 nt, Human
ggcauagccagagcuggg

SEQ ID NO: 885889 - RNA, 21 nt, Human
ggccgggggcagggucucagc

SEQ ID NO: 885890 - RNA, 21 nt, Human
guucucauacccccuccccau

SEQ ID NO: 885891 - RNA, 23 nt, Human
ucccagcacagugaccccuuccc

SEQ ID NO: 885892 - RNA, 24 nt, Human
uccgcuggagggaccaccucccca

SEQ ID NO: 885893 - RNA, 23 nt, Human
uccugccaccauuccagccacac

SEQ ID NO: 885894 - RNA, 22 nt, Human
ucucauacccccuccccauccc

SEQ ID NO: 885895 - RNA, 20 nt, Human
ugcagcuuagggcagcugaa

SEQ ID NO: 885896 - RNA, 22 nt, Human
ugcccacuccugccaccauucc

SEQ ID NO: 885897 - RNA, 20 nt, Human
uggggugagaaagcccuuca

SEQ ID NO: 885898 - RNA, 22 nt, Human
ugguuuccugaggcccaaggag

SEQ ID NO: 885899 - RNA, 18 nt, Human
uuccagccacacccaggc

SEQ ID NO: 885900 - RNA, 25 nt, Human
uuggcagcaaugcugguuuauuccc

SEQ ID NO: 885901 - RNA, 22 nt, Human
uuggugguuuccugaggcccaa

SEQ ID NO: 885902 - RNA, 20 nt, Human
uuuuuuggcagcaaugcugg

SEQ ID NO: 885903 - RNA, 22 nt, Human
uuuuuuuuuuuuuuuuuggcag

SEQ ID NO: 885904 - RNA, 24 nt, Human
aaaaaagccaggagaaaacccaga

SEQ ID NO: 885905 - RNA, 25 nt, Human
aaaaagccaggagaaaacccagaua

SEQ ID NO: 885906 - RNA, 21 nt, Human
aaacagaagcuaaaaagguau

SEQ ID NO: 885907 - RNA, 26 nt, Human
aaacagaagcuaaaaagguaugccug

SEQ ID NO: 885908 - RNA, 21 nt, Human
aaacauuauauaccacaaacu

SEQ ID NO: 885909 - RNA, 24 nt, Human
aaagccaggagaaaacccagauaa

SEQ ID NO: 885910 - RNA, 19 nt, Human
aacccugacuguaaccguu

SEQ ID NO: 885911 - RNA, 18 nt, Human
aacuccacaaacagaagc

SEQ ID NO: 885912 - RNA, 19 nt, Human
aacucucucuucagguucu

SEQ ID NO: 885913 - RNA, 26 nt, Human
aagcaacagcaaacaccuucccucac

SEQ ID NO: 885914 - RNA, 23 nt, Human
aagcagggcuuuuuugcacagcc

SEQ ID NO: 885915 - RNA, 20 nt, Human
aagccguagccggacucgga

SEQ ID NO: 885916 - RNA, 23 nt, Human
aauccccgacgucgggcaucuaa

SEQ ID NO: 885917 - RNA, 23 nt, Human
acaacuccacaaacagaagcuaa

SEQ ID NO: 885918 - RNA, 22 nt, Human
acacagagggaaaaaaaagcca

SEQ ID NO: 885919 - RNA, 25 nt, Human
acagcaguaaagcaacagcaaacac

SEQ ID NO: 885920 - RNA, 23 nt, Human
acaugaaaggaguaagaggaugg

SEQ ID NO: 885921 - RNA, 21 nt, Human
accccccgccgccgccgccac

SEQ ID NO: 885922 - RNA, 20 nt, Human
acccccgcccccuacgccuc

SEQ ID NO: 885923 - RNA, 21 nt, Human
agacagcaguaaagcaacagc

SEQ ID NO: 885924 - RNA, 20 nt, Human
agacugccaggacucaucca

SEQ ID NO: 885925 - RNA, 18 nt, Human
agcaaacaccuucccuca

SEQ ID NO: 885926 - RNA, 19 nt, Human
agcaggcgagccguacccc

SEQ ID NO: 885927 - RNA, 27 nt, Human
agcaggcgagccguacccccgcccccu

SEQ ID NO: 885928 - RNA, 21 nt, Human
aggaacaacauggagggugau

SEQ ID NO: 885929 - RNA, 19 nt, Human
aggaauuccugcaugaugu

SEQ ID NO: 885930 - RNA, 18 nt, Human
aggaugggggugaaggga

SEQ ID NO: 885931 - RNA, 23 nt, Human
aggaugggggugaagggaaggga

SEQ ID NO: 885932 - RNA, 21 nt, Human
auugggaaggcacaucuccuc

SEQ ID NO: 885933 - RNA, 21 nt, Human
caacuccacaaacagaagcua

SEQ ID NO: 885934 - RNA, 24 nt, Human
caacuccacaaacagaagcuaaaa

SEQ ID NO: 885935 - RNA, 18 nt, Human
caacugaggacagcuucc

SEQ ID NO: 885936 - RNA, 18 nt, Human
caaucugauuggccacau

SEQ ID NO: 885937 - RNA, 23 nt, Human
cacaaacagaagcuaaaaaggua

SEQ ID NO: 885938 - RNA, 20 nt, Human
caccuccguuccugugaggg

SEQ ID NO: 885939 - RNA, 23 nt, Human
caccuucccucacacaaacauuc

SEQ ID NO: 885940 - RNA, 25 nt, Human
cacgacccgcgggccgccgccuccc

SEQ ID NO: 885941 - RNA, 21 nt, Human
cacuucccugggagucgagga

SEQ ID NO: 885942 - RNA, 22 nt, Human
cagacagcaguaaagcaacagc

SEQ ID NO: 885943 - RNA, 25 nt, Human
cagagcccaauguucuuucuacugu

SEQ ID NO: 885944 - RNA, 26 nt, Human
cagagggaaaaaaaagccaggagaaa

SEQ ID NO: 885945 - RNA, 26 nt, Human
cagcaaacaccuucccucacacaaac

SEQ ID NO: 885946 - RNA, 21 nt, Human
caguaaagcaacagcaaacac

SEQ ID NO: 885947 - RNA, 18 nt, Human
cagucaagacggcuacaa

SEQ ID NO: 885948 - RNA, 22 nt, Human
cauagccuuuuagagccggaag

SEQ ID NO: 885949 - RNA, 18 nt, Human
ccacaaacuucucaccau

SEQ ID NO: 885950 - RNA, 23 nt, Human
ccccccgccgccgccgccaccuc

SEQ ID NO: 885951 - RNA, 23 nt, Human
cccccgacgcgcgcgcccgaucc

SEQ ID NO: 885952 - RNA, 21 nt, Human
cccccgccgccgccgccaccu

SEQ ID NO: 885953 - RNA, 18 nt, Human
cccccgccgccguucccg

SEQ ID NO: 885954 - RNA, 19 nt, Human
ccccgcacguugaagccgu

SEQ ID NO: 885955 - RNA, 23 nt, Human
ccccgccgccgccgccaccuccg

SEQ ID NO: 885956 - RNA, 24 nt, Human
ccccgccgccgccgccaccuccgu

SEQ ID NO: 885957 - RNA, 21 nt, Human
ccgccgccaccuccguuccug

SEQ ID NO: 885958 - RNA, 19 nt, Human
ccgccgccguucccggcgc

SEQ ID NO: 885959 - RNA, 21 nt, Human
ccgccgccucccccgccgccg

SEQ ID NO: 885960 - RNA, 18 nt, Human
ccggcgcgugcucgcccu

SEQ ID NO: 885961 - RNA, 18 nt, Human
ccucacacaaacauucuu

SEQ ID NO: 885962 - RNA, 19 nt, Human
ccuccaaggccucccggcg

SEQ ID NO: 885963 - RNA, 23 nt, Human
ccucccccgccgccguucccggc

SEQ ID NO: 885964 - RNA, 19 nt, Human
cgacccgcgggccgccgcc

SEQ ID NO: 885965 - RNA, 25 nt, Human
cgcaguggagcccagaccccccgcc

SEQ ID NO: 885966 - RNA, 19 nt, Human
cgccuagaaagacugccag

SEQ ID NO: 885967 - RNA, 20 nt, Human
cgccuagaaagacugccagg

SEQ ID NO: 885968 - RNA, 18 nt, Human
cggaagggaccuuggaua

SEQ ID NO: 885969 - RNA, 20 nt, Human
cuacaacugaggacagcuuc

SEQ ID NO: 885970 - RNA, 23 nt, Human
cuccucuuaucuggagacaacuc

SEQ ID NO: 885971 - RNA, 22 nt, Human
cucgcccugccuggcagccgga

SEQ ID NO: 885972 - RNA, 21 nt, Human
cuggaaaauguucugaaagga

SEQ ID NO: 885973 - RNA, 18 nt, Human
cuggagacaacuccacaa

SEQ ID NO: 885974 - RNA, 20 nt, Human
cuguaguacuguucuuuuua

SEQ ID NO: 885975 - RNA, 18 nt, Human
gaaaggaaaaaaaaaaga

SEQ ID NO: 885976 - RNA, 18 nt, Human
gaaucuuccaaauucugu

SEQ ID NO: 885977 - RNA, 26 nt, Human
gacaugaaaggaguaagaggauggaa

SEQ ID NO: 885978 - RNA, 24 nt, Human
gacccgcgggccgccgccuccccc

SEQ ID NO: 885979 - RNA, 20 nt, Human
gagccguacccccgcccccu

SEQ ID NO: 885980 - RNA, 19 nt, Human
gcgcaguggagcccagacc

SEQ ID NO: 885981 - RNA, 19 nt, Human
gcgggccgccgccuccccc

SEQ ID NO: 885982 - RNA, 23 nt, Human
gcucgcccugccuggcagccgga

SEQ ID NO: 885983 - RNA, 23 nt, Human
gcugugaccucgccaucuggaaa

SEQ ID NO: 885984 - RNA, 25 nt, Human
ggaauuccugcaugaugucacucuu

SEQ ID NO: 885985 - RNA, 22 nt, Human
ggcaaacucucucuucagguuc

SEQ ID NO: 885986 - RNA, 19 nt, Human
ggccacuucccugggaguc

SEQ ID NO: 885987 - RNA, 27 nt, Human
guaaagcaacagcaaacaccuucccuc

SEQ ID NO: 885988 - RNA, 21 nt, Human
guacuguucuuuuuaacccug

SEQ ID NO: 885989 - RNA, 25 nt, Human
gugguucuuggccccgcacguugaa

SEQ ID NO: 885990 - RNA, 24 nt, Human
uaaggaaaggcuagguggccacau

SEQ ID NO: 885991 - RNA, 24 nt, Human
uacccccgcccccuacgccuccaa

SEQ ID NO: 885992 - RNA, 18 nt, Human
uaccgcuuagaacacagc

SEQ ID NO: 885993 - RNA, 19 nt, Human
uaccgcuuagaacacagcu

SEQ ID NO: 885994 - RNA, 21 nt, Human
uaccgcuuagaacacagcugc

SEQ ID NO: 885995 - RNA, 22 nt, Human
uacucguauugaacacacuuuu

SEQ ID NO: 885996 - RNA, 24 nt, Human
uagaacacagcugccucccugcca

SEQ ID NO: 885997 - RNA, 22 nt, Human
ucaagacggcuacaacugagga

SEQ ID NO: 885998 - RNA, 23 nt, Human
uccacaaacagaagcuaaaaagg

SEQ ID NO: 885999 - RNA, 33 nt, Human
uccccugugggucaggaacaacauggaggguug

SEQ ID NO: 886000 - RNA, 22 nt, Human
ucccucacacaaacauucuugg

SEQ ID NO: 886001 - RNA, 23 nt, Human
ucuagacaagggaagaagcaggg

SEQ ID NO: 886002 - RNA, 19 nt, Human
ugaaaggaaaaaaaaaaga

SEQ ID NO: 886003 - RNA, 19 nt, Human
ugaagccguagccggacuc

SEQ ID NO: 886004 - RNA, 20 nt, Human
ugcuggaagaauguccuggc

SEQ ID NO: 886005 - RNA, 18 nt, Human
ugcuugcuuuucugugua

SEQ ID NO: 886006 - RNA, 21 nt, Human
uggagcccagaccccccgccg

SEQ ID NO: 886007 - RNA, 18 nt, Human
uggcacauacagacagca

SEQ ID NO: 886008 - RNA, 25 nt, Human
uggcagaggaggguccaugaaguca

SEQ ID NO: 886009 - RNA, 25 nt, Human
ugggucaggaacaacauggagggug

SEQ ID NO: 886010 - RNA, 19 nt, Human
uguaaacauuauauaccac

SEQ ID NO: 886011 - RNA, 18 nt, Human
uguagccaauguccaccc

SEQ ID NO: 886012 - RNA, 19 nt, Human
uguccuggcucacaugaga

SEQ ID NO: 886013 - RNA, 22 nt, Human
uguccuggcucacaugagauaa

SEQ ID NO: 886014 - RNA, 18 nt, Human
uguguaaucauaaaauga

SEQ ID NO: 886015 - RNA, 23 nt, Human
uguguaaucauaaaaugauuguc

SEQ ID NO: 886016 - RNA, 22 nt, Human
ugugucgcccccucaacauuca

SEQ ID NO: 886017 - RNA, 21 nt, Human
uuaacccugacuguaaccguu

SEQ ID NO: 886018 - RNA, 24 nt, Human
uucaccauccagaggccaaccuug

SEQ ID NO: 886019 - RNA, 20 nt, Human
uucagaaucuuccaaauucc

SEQ ID NO: 886020 - RNA, 22 nt, Human
uucagguucugguguaggauag

SEQ ID NO: 886021 - RNA, 22 nt, Human
uuccccugugggucaggaacaa

SEQ ID NO: 886022 - RNA, 21 nt, Human
uuuaaaaaacuggcagaggag

SEQ ID NO: 886023 - RNA, 20 nt, Human
uuuuuuuuuuuuuuuuuugg

SEQ ID NO: 886024 - RNA, 21 nt, Human
uuuuuuuuuuuuuuuuuuguu

SEQ ID NO: 886025 - RNA, 19 nt, Human
aaaaucugggcaccaggug

SEQ ID NO: 886026 - RNA, 19 nt, Human
aaacaggacaauaaagucc

SEQ ID NO: 886027 - RNA, 20 nt, Human
aaagugcugggauuacaggg

SEQ ID NO: 886028 - RNA, 24 nt, Human
aaagugcugggauuacagggguga

SEQ ID NO: 886029 - RNA, 21 nt, Human
aaaugaccuuuuuuucuuuuc

SEQ ID NO: 886030 - RNA, 24 nt, Human
aagcgauucuccuguucagccucc

SEQ ID NO: 886031 - RNA, 18 nt, Human
aagugcugggauuacagg

SEQ ID NO: 886032 - RNA, 21 nt, Human
aagugcugggauuacaggggu

SEQ ID NO: 886033 - RNA, 26 nt, Human
aagugcugggauuacaggggugagcc

SEQ ID NO: 886034 - RNA, 18 nt, Human
aaugaaauaagacaaacc

SEQ ID NO: 886035 - RNA, 20 nt, Human
acagaucuguagaaggaucc

SEQ ID NO: 886036 - RNA, 21 nt, Human
acaggacaauaaaguccagag

SEQ ID NO: 886037 - RNA, 21 nt, Human
acaguucauaucccaguucua

SEQ ID NO: 886038 - RNA, 19 nt, Human
accaaaugaccuuuuuuuc

SEQ ID NO: 886039 - RNA, 19 nt, Human
acugcaggugcauaccacc

SEQ ID NO: 886040 - RNA, 18 nt, Human
acuguuauucaacaaagc

SEQ ID NO: 886041 - RNA, 21 nt, Human
agaaaaaaaauaugcaaagaa

SEQ ID NO: 886042 - RNA, 25 nt, Human
agaaaaaaaauaugcaaagaauuuu

SEQ ID NO: 886043 - RNA, 24 nt, Human
agacuuggguucugaguucugggg

SEQ ID NO: 886044 - RNA, 24 nt, Human
agcagaaaaaaaauaugcaaagaa

SEQ ID NO: 886045 - RNA, 24 nt, Human
agcuguggccuuucagagauccuu

SEQ ID NO: 886046 - RNA, 18 nt, Human
aggaggaccacagaggua

SEQ ID NO: 886047 - RNA, 19 nt, Human
aggcuggagugcaguggca

SEQ ID NO: 886048 - RNA, 24 nt, Human
aggugauccgccugcuuuggccuc

SEQ ID NO: 886049 - RNA, 20 nt, Human
agugcaguggcaugaccuug

SEQ ID NO: 886050 - RNA, 23 nt, Human
agugcaguggcaugaccuuggcu

SEQ ID NO: 886051 - RNA, 24 nt, Human
agugcaguggcaugaccuuggcuc

SEQ ID NO: 886052 - RNA, 23 nt, Human
augaccuuuuuuucuuuucgugg

SEQ ID NO: 886053 - RNA, 18 nt, Human
auuucuccacuguaaagu

SEQ ID NO: 886054 - RNA, 21 nt, Human
caaaguaagauauucuaaaau

SEQ ID NO: 886055 - RNA, 24 nt, Human
caaaguaagauauucuaaaauccc

SEQ ID NO: 886056 - RNA, 24 nt, Human
caaagugcugggauuacaggggug

SEQ ID NO: 886057 - RNA, 19 nt, Human
cacaagagauuuguuccca

SEQ ID NO: 886058 - RNA, 21 nt, Human
cacaagauacucuaggcucau

SEQ ID NO: 886059 - RNA, 18 nt, Human
caccauguuggcccggcu

SEQ ID NO: 886060 - RNA, 24 nt, Human
caccauguuggcccggcuggucuc

SEQ ID NO: 886061 - RNA, 20 nt, Human
caggugcauaccaccacccc

SEQ ID NO: 886062 - RNA, 26 nt, Human
caggugugcucccauucuaguuguuu

SEQ ID NO: 886063 - RNA, 24 nt, Human
cauaccaccaccccuggcuaauuu

SEQ ID NO: 886064 - RNA, 21 nt, Human
cauuuucuaaggaguccuggu

SEQ ID NO: 886065 - RNA, 19 nt, Human
ccaaagugcugggauuaca

SEQ ID NO: 886066 - RNA, 20 nt, Human
ccaaagugcugggauuacag

SEQ ID NO: 886067 - RNA, 21 nt, Human
ccaaagugcugggauuacagg

SEQ ID NO: 886068 - RNA, 24 nt, Human
ccaaagugcugggauuacaggggu

SEQ ID NO: 886069 - RNA, 22 nt, Human
cccaggcuggagugcaguggca

SEQ ID NO: 886070 - RNA, 19 nt, Human
cccauucuaguuguuuucu

SEQ ID NO: 886071 - RNA, 21 nt, Human
ccucuuggcugugaccauguc

SEQ ID NO: 886072 - RNA, 18 nt, Human
ccugaccucaggugaucc

SEQ ID NO: 886073 - RNA, 21 nt, Human
ccugaccucaggugauccgcc

SEQ ID NO: 886074 - RNA, 23 nt, Human
ccugaccucaggugauccgccug

SEQ ID NO: 886075 - RNA, 22 nt, Human
ccugcuuuggccucccaaagug

SEQ ID NO: 886076 - RNA, 24 nt, Human
ccugcuuuggccucccaaagugcu

SEQ ID NO: 886077 - RNA, 26 nt, Human
ccuucaguucgaucaugcugacauac

SEQ ID NO: 886078 - RNA, 18 nt, Human
ccuuuuuuccucaaagaa

SEQ ID NO: 886079 - RNA, 21 nt, Human
cgaucaugcugacauacuccc

SEQ ID NO: 886080 - RNA, 21 nt, Human
cggguucaagcgauucuccug

SEQ ID NO: 886081 - RNA, 20 nt, Human
cuaaaaucccuuuaaagcca

SEQ ID NO: 886082 - RNA, 20 nt, Human
cucauuguuucuaguacuuu

SEQ ID NO: 886083 - RNA, 22 nt, Human
cucccauguugcugggacugca

SEQ ID NO: 886084 - RNA, 26 nt, Human
cuccugaccucaggugauccgccugc

SEQ ID NO: 886085 - RNA, 20 nt, Human
cucugcaaggaagucacuau

SEQ ID NO: 886086 - RNA, 20 nt, Human
cucugucucccaggcuggag

SEQ ID NO: 886087 - RNA, 20 nt, Human
gaccacagagguaaagugcc

SEQ ID NO: 886088 - RNA, 20 nt, Human
gaccaugucucagauuuucc

SEQ ID NO: 886089 - RNA, 18 nt, Human
gaccucaggugauccgcc

SEQ ID NO: 886090 - RNA, 23 nt, Human
gacgagguugcaccauguuggcc

SEQ ID NO: 886091 - RNA, 18 nt, Human
gauuacaggggugagcca

SEQ ID NO: 886092 - RNA, 19 nt, Human
gcaguggcaugaccuuggc

SEQ ID NO: 886093 - RNA, 19 nt, Human
gcuggagugcaguggcaug

SEQ ID NO: 886094 - RNA, 23 nt, Human
gcuggucucaaacuccugaccuc

SEQ ID NO: 886095 - RNA, 22 nt, Human
gcuuuggccucccaaagugcug

SEQ ID NO: 886096 - RNA, 19 nt, Human
ggaauguccuccaacgcuu

SEQ ID NO: 886097 - RNA, 24 nt, Human
ggcuggucucaaacuccugaccuc

SEQ ID NO: 886098 - RNA, 19 nt, Human
gguucaagcgauucuccug

SEQ ID NO: 886099 - RNA, 20 nt, Human
gguucugaguucuggggagg

SEQ ID NO: 886100 - RNA, 19 nt, Human
guaaaguuacucuuuuccc

SEQ ID NO: 886101 - RNA, 18 nt, Human
uaaauaagugcuuaaaaa

SEQ ID NO: 886102 - RNA, 22 nt, Human
uaagcagaaaaaaaauaugcaa

SEQ ID NO: 886103 - RNA, 23 nt, Human
uaaguaagucuaagcagaaaaaa

SEQ ID NO: 886104 - RNA, 19 nt, Human
uacaggggugagccaccgc

SEQ ID NO: 886105 - RNA, 23 nt, Human
uacaggggugagccaccgcaccc

SEQ ID NO: 886106 - RNA, 24 nt, Human
uaguaaagacgagguugcaccaug

SEQ ID NO: 886107 - RNA, 18 nt, Human
uaucccaguucuagaauc

SEQ ID NO: 886108 - RNA, 18 nt, Human
ucaacaaagcuuuucccc

SEQ ID NO: 886109 - RNA, 21 nt, Human
ucagauauuaucaucauuacu

SEQ ID NO: 886110 - RNA, 23 nt, Human
ucagcucuagagaacaaugagcu

SEQ ID NO: 886111 - RNA, 24 nt, Human
ucaggcuccucuuggcugugaagc

SEQ ID NO: 886112 - RNA, 24 nt, Human
ucaguucauuuucuaaggaguccu

SEQ ID NO: 886113 - RNA, 24 nt, Human
ucaugcugacauacucccaaucac

SEQ ID NO: 886114 - RNA, 23 nt, Human
ucccaaagugcugggauuacagg

SEQ ID NO: 886115 - RNA, 24 nt, Human
ucccaggcuggagugcaguggcau

SEQ ID NO: 886116 - RNA, 23 nt, Human
ucccauguugcugggacugcagg

SEQ ID NO: 886117 - RNA, 24 nt, Human
ucgcggguucaagcgauucuccug

SEQ ID NO: 886118 - RNA, 21 nt, Human
ucuacaaugaacacuuugcuc

SEQ ID NO: 886119 - RNA, 21 nt, Human
ucuaguacuuuacaugcuuuc

SEQ ID NO: 886120 - RNA, 18 nt, Human
ucucaggcuccucuuggc

SEQ ID NO: 886121 - RNA, 24 nt, Human
ucucccaggcuggagugcaguggc

SEQ ID NO: 886122 - RNA, 23 nt, Human
ucuggggaggaggaccacagagg

SEQ ID NO: 886123 - RNA, 19 nt, Human
ucugucucccaggcuggag

SEQ ID NO: 886124 - RNA, 24 nt, Human
ucugucucccaggcuggagugcag

SEQ ID NO: 886125 - RNA, 19 nt, Human
ucuugcucugucucccagg

SEQ ID NO: 886126 - RNA, 23 nt, Human
ucuugcucugucucccaggcugg

SEQ ID NO: 886127 - RNA, 24 nt, Human
ucuugcucugucucccaggcugga

SEQ ID NO: 886128 - RNA, 21 nt, Human
ugaaauaagacaaaccaucaa

SEQ ID NO: 886129 - RNA, 22 nt, Human
ugaccucaggugauccgccugc

SEQ ID NO: 886130 - RNA, 24 nt, Human
ugaccucaggugauccgccugcuu

SEQ ID NO: 886131 - RNA, 21 nt, Human
ugagaaguacugguuagguau

SEQ ID NO: 886132 - RNA, 22 nt, Human
ugagauggagucuugcucuguc

SEQ ID NO: 886133 - RNA, 19 nt, Human
ugaguucuggggaggagga

SEQ ID NO: 886134 - RNA, 24 nt, Human
ugauguuaaccucaaucaccuggc

SEQ ID NO: 886135 - RNA, 22 nt, Human
ugcauaccaccaccccuggcua

SEQ ID NO: 886136 - RNA, 18 nt, Human
ugcuucacucuggcuaca

SEQ ID NO: 886137 - RNA, 23 nt, Human
uggagugcaguggcaugaccuug

SEQ ID NO: 886138 - RNA, 24 nt, Human
uggagugcaguggcaugaccuugg

SEQ ID NO: 886139 - RNA, 21 nt, Human
uggcagagaggccuaaaugcc

SEQ ID NO: 886140 - RNA, 22 nt, Human
uggcagagaggccuaaaugcca

SEQ ID NO: 886141 - RNA, 24 nt, Human
uggcccggcuggucucaaacuccu

SEQ ID NO: 886142 - RNA, 21 nt, Human
uggcuaaacuaucaauagcac

SEQ ID NO: 886143 - RNA, 21 nt, Human
ugggacugcaggugcauacca

SEQ ID NO: 886144 - RNA, 19 nt, Human
ugggauuacaggggugagc

SEQ ID NO: 886145 - RNA, 22 nt, Human
ugggauuacaggggugagccac

SEQ ID NO: 886146 - RNA, 23 nt, Human
ugggauuacaggggugagccacc

SEQ ID NO: 886147 - RNA, 24 nt, Human
ugggauuacaggggugagccaccg

SEQ ID NO: 886148 - RNA, 18 nt, Human
uggguucugaguucuggg

SEQ ID NO: 886149 - RNA, 23 nt, Human
uguuacucaaauugcuccagcug

SEQ ID NO: 886150 - RNA, 18 nt, Human
uguugcugggacugcagg

SEQ ID NO: 886151 - RNA, 20 nt, Human
uguuguuguuuuguuuuguu

SEQ ID NO: 886152 - RNA, 20 nt, Human
uuauuuuguuacucaaauug

SEQ ID NO: 886153 - RNA, 22 nt, Human
uucaagcgauucuccuguucag

SEQ ID NO: 886154 - RNA, 20 nt, Human
uucagaauuuccaaaucucc

SEQ ID NO: 886155 - RNA, 24 nt, Human
uucuggggaggaggaccacagagg

SEQ ID NO: 886156 - RNA, 19 nt, Human
uugaaauucuucugcacaa

SEQ ID NO: 886157 - RNA, 21 nt, Human
uugagauggagucuugcucug

SEQ ID NO: 886158 - RNA, 18 nt, Human
uugcucugucucccaggc

SEQ ID NO: 886159 - RNA, 26 nt, Human
uuggcugugaccaugucucagauuuu

SEQ ID NO: 886160 - RNA, 19 nt, Human
uugugccugaguuuuuuug

SEQ ID NO: 886161 - RNA, 18 nt, Human
uuguuguuguuuuguuuu

SEQ ID NO: 886162 - RNA, 21 nt, Human
uuguuguuuuguuuuguuuuu

SEQ ID NO: 886163 - RNA, 28 nt, Human
uuguuguuuuguuuuguuuuuguuuuug

SEQ ID NO: 886164 - RNA, 24 nt, Human
uuguuuuuguauuuuuaguaaaga

SEQ ID NO: 886165 - RNA, 21 nt, Human
uuuaaagaaugcuucucaauu

SEQ ID NO: 886166 - RNA, 23 nt, Human
uuuaaagccaaugaaaccauuuu

SEQ ID NO: 886167 - RNA, 19 nt, Human
uuuggccucccaaagugcu

SEQ ID NO: 886168 - RNA, 22 nt, Human
uuuuguuuuguuuuuguuuuug

SEQ ID NO: 886169 - RNA, 22 nt, Human
uuuuguuuuugagauggagucu

SEQ ID NO: 886170 - RNA, 19 nt, Human
uuuuucuuuucgugguaua

SEQ ID NO: 886171 - RNA, 21 nt, Human
uuuuuguauuuuuaguaaaga

SEQ ID NO: 886172 - RNA, 23 nt, Human
uuuuuguauuuuuaguaaagacg

SEQ ID NO: 886173 - RNA, 22 nt, Human
aaaaaacagcgagaagaauaau

SEQ ID NO: 886174 - RNA, 26 nt, Human
aaaaacagcgagaagaauaaucaggc

SEQ ID NO: 886175 - RNA, 19 nt, Human
aaacgcccuaagacaagca

SEQ ID NO: 886176 - RNA, 22 nt, Human
aaacgcccuaagacaagcacuc

SEQ ID NO: 886177 - RNA, 21 nt, Human
aacaauaauccagagaccccc

SEQ ID NO: 886178 - RNA, 20 nt, Human
aaccagugaaacuccaaggc

SEQ ID NO: 886179 - RNA, 22 nt, Human
aaucacuucaugggggaggagg

SEQ ID NO: 886180 - RNA, 23 nt, Human
acacaacacacucaaagacaccg

SEQ ID NO: 886181 - RNA, 26 nt, Human
acacaacacacucaaagacaccgaag

SEQ ID NO: 886182 - RNA, 20 nt, Human
agaacaauaauccagagacc

SEQ ID NO: 886183 - RNA, 23 nt, Human
aucccccucuccucccucccuca

SEQ ID NO: 886184 - RNA, 24 nt, Human
caaagacaccgaaggacuggagac

SEQ ID NO: 886185 - RNA, 22 nt, Human
cacacaacacacucaaagacac

SEQ ID NO: 886186 - RNA, 20 nt, Human
cacaggcucuccugcccucc

SEQ ID NO: 886187 - RNA, 19 nt, Human
caccgaaggacccuaaggc

SEQ ID NO: 886188 - RNA, 19 nt, Human
cagaacaauaauccagaga

SEQ ID NO: 886189 - RNA, 23 nt, Human
cagaacaauaauccagagacccc

SEQ ID NO: 886190 - RNA, 22 nt, Human
caguccccacuagagacauaau

SEQ ID NO: 886191 - RNA, 22 nt, Human
ccagagaccccccgauacucag

SEQ ID NO: 886192 - RNA, 24 nt, Human
ccccccaaccacaagcagggguug

SEQ ID NO: 886193 - RNA, 24 nt, Human
ccccccgauacucagaaucacuuc

SEQ ID NO: 886194 - RNA, 19 nt, Human
ccuccugauggaaaauaag

SEQ ID NO: 886195 - RNA, 21 nt, Human
cgagaauccgccaacgggcac

SEQ ID NO: 886196 - RNA, 20 nt, Human
cugcugcaaaccuuggcuau

SEQ ID NO: 886197 - RNA, 19 nt, Human
cuuccugccaggcaccuuc

SEQ ID NO: 886198 - RNA, 25 nt, Human
cuuugcacaggcucuccugcccucc

SEQ ID NO: 886199 - RNA, 22 nt, Human
gaacaaacaagcuuugcacagg

SEQ ID NO: 886200 - RNA, 21 nt, Human
gacccaaguaugcagaaauaa

SEQ ID NO: 886201 - RNA, 20 nt, Human
gcugauugaacaaacaagcu

SEQ ID NO: 886202 - RNA, 20 nt, Human
ggaggaggacgaggacgggg

SEQ ID NO: 886203 - RNA, 24 nt, Human
uaaaauauguacacacaacacacu

SEQ ID NO: 886204 - RNA, 22 nt, Human
uaaguuagaaaacgcccuaaga

SEQ ID NO: 886205 - RNA, 18 nt, Human
uagaaaacgcccuaagac

SEQ ID NO: 886206 - RNA, 21 nt, Human
uagaacgaacaguccccacua

SEQ ID NO: 886207 - RNA, 23 nt, Human
uagaacgaacaguccccacuaga

SEQ ID NO: 886208 - RNA, 19 nt, Human
uauauuuauaaacuuuaag

SEQ ID NO: 886209 - RNA, 24 nt, Human
uaucccccucuccucccucccuca

SEQ ID NO: 886210 - RNA, 21 nt, Human
uaugcagaaauaaaauaaacc

SEQ ID NO: 886211 - RNA, 25 nt, Human
uauguacacacaacacacucaaaga

SEQ ID NO: 886212 - RNA, 25 nt, Human
ucaaugaaaguuguauccaaaguac

SEQ ID NO: 886213 - RNA, 19 nt, Human
ucacuucaugggggaggag

SEQ ID NO: 886214 - RNA, 24 nt, Human
uccagagaccccccgauacucaga

SEQ ID NO: 886215 - RNA, 20 nt, Human
ucuccugcccuccugaugga

SEQ ID NO: 886216 - RNA, 19 nt, Human
uggaaaauaaguuagaaaa

SEQ ID NO: 886217 - RNA, 20 nt, Human
uuuggguuagccuguuacag

SEQ ID NO: 886218 - RNA, 23 nt, Human
accugcggggacccaggacaggc

SEQ ID NO: 886219 - RNA, 22 nt, Human
agcaagcaaacacuggcaggug

SEQ ID NO: 886220 - RNA, 23 nt, Human
agguugcucuuccuuuucaggcc

SEQ ID NO: 886221 - RNA, 20 nt, Human
caggaggaacgacuaaagca

SEQ ID NO: 886222 - RNA, 22 nt, Human
cauauggccugacaaaugccug

SEQ ID NO: 886223 - RNA, 19 nt, Human
ccccuccuuuuccuuuccu

SEQ ID NO: 886224 - RNA, 21 nt, Human
ccugacaaaugccugccaggg

SEQ ID NO: 886225 - RNA, 19 nt, Human
ccugcggcucgcugaagcc

SEQ ID NO: 886226 - RNA, 24 nt, Human
ccugcggcucgcugaagccggggc

SEQ ID NO: 886227 - RNA, 22 nt, Human
cgcugaagcccgcucgcugcuc

SEQ ID NO: 886228 - RNA, 23 nt, Human
cgucucugcaaugcacaugugug

SEQ ID NO: 886229 - RNA, 19 nt, Human
gaacaacagacgcgcagac

SEQ ID NO: 886230 - RNA, 19 nt, Human
gauucuggacagguugcuc

SEQ ID NO: 886231 - RNA, 20 nt, Human
ggggacccaggacaggccug

SEQ ID NO: 886232 - RNA, 21 nt, Human
uaaaacauauggccugacaaa

SEQ ID NO: 886233 - RNA, 24 nt, Human
ucgagauuuccccuccuuuuccuu

SEQ ID NO: 886234 - RNA, 21 nt, Human
ucugcuacugaaacauagagc

SEQ ID NO: 886235 - RNA, 19 nt, Human
ugaagcccgcucgcugcuc

SEQ ID NO: 886236 - RNA, 21 nt, Human
ugguagcaggaggaacgacua

SEQ ID NO: 886237 - RNA, 18 nt, Human
aaaaaaaaaaggcucaga

SEQ ID NO: 886238 - RNA, 18 nt, Human
aaggagucaugggccagu

SEQ ID NO: 886239 - RNA, 20 nt, Human
acaaaaaaaaaaggcucaga

SEQ ID NO: 886240 - RNA, 22 nt, Human
acaaaaaaaaaaggcucagaaa

SEQ ID NO: 886241 - RNA, 18 nt, Human
aggcugcugggagcaguc

SEQ ID NO: 886242 - RNA, 22 nt, Human
agggaauaucaaaaggagcuug

SEQ ID NO: 886243 - RNA, 25 nt, Human
caaacccaaggaaucaaucauuuug

SEQ ID NO: 886244 - RNA, 23 nt, Human
caccagacuuucucuccugguuu

SEQ ID NO: 886245 - RNA, 25 nt, Human
cacccccaaacccaaggaaucaauc

SEQ ID NO: 886246 - RNA, 22 nt, Human
caggacaccagacuuucucucc

SEQ ID NO: 886247 - RNA, 24 nt, Human
cauucccacucagcuuccuuuccu

SEQ ID NO: 886248 - RNA, 20 nt, Human
ccuauucacccccaaaccca

SEQ ID NO: 886249 - RNA, 24 nt, Human
ccuccuccauuuuucaaaauauuu

SEQ ID NO: 886250 - RNA, 26 nt, Human
cuauucacccccaaacccaaggaauc

SEQ ID NO: 886251 - RNA, 22 nt, Human
cuggagaaucuuggucuuccuc

SEQ ID NO: 886252 - RNA, 19 nt, Human
cugugacaaaaaaaaaagg

SEQ ID NO: 886253 - RNA, 18 nt, Human
ggagaaucuuggucuucc

SEQ ID NO: 886254 - RNA, 20 nt, Human
ggcacugugacaaaaaaaaa

SEQ ID NO: 886255 - RNA, 19 nt, Human
gggaauaucaaaaggagcc

SEQ ID NO: 886256 - RNA, 20 nt, Human
gggcacugugacaaaaaaaa

SEQ ID NO: 886257 - RNA, 18 nt, Human
gugacaaaaaaaaaaggc

SEQ ID NO: 886258 - RNA, 19 nt, Human
uaccagcuggcauucccac

SEQ ID NO: 886259 - RNA, 23 nt, Human
uagaaaagacuggauaucaggac

SEQ ID NO: 886260 - RNA, 26 nt, Human
uauuuuaaaucagcucuggguucugg

SEQ ID NO: 886261 - RNA, 20 nt, Human
ucagaaauuucccagccuag

SEQ ID NO: 886262 - RNA, 23 nt, Human
ucccagccuauucacccccaaac

SEQ ID NO: 886263 - RNA, 24 nt, Human
ucccagccuauucacccccaaacc

SEQ ID NO: 886264 - RNA, 19 nt, Human
ucuccauggacagaugagc

SEQ ID NO: 886265 - RNA, 19 nt, Human
ucugccuccuccauuuuuc

SEQ ID NO: 886266 - RNA, 26 nt, Human
ucuggguucuggucaugagcucuggg

SEQ ID NO: 886267 - RNA, 22 nt, Human
ugacaaaaaaaaaaggcucaga

SEQ ID NO: 886268 - RNA, 26 nt, Human
ugccuccuccauuuuucaaaauauuu

SEQ ID NO: 886269 - RNA, 20 nt, Human
uggagaaucuuggucuuccu

SEQ ID NO: 886270 - RNA, 22 nt, Human
uggcuagugaccuccaucccug

SEQ ID NO: 886271 - RNA, 21 nt, Human
ugggagcagucugccuccucc

SEQ ID NO: 886272 - RNA, 21 nt, Human
ugggccagugcagccugcgcu

SEQ ID NO: 886273 - RNA, 20 nt, Human
ugugacaaaaaaaaaaggcu

SEQ ID NO: 886274 - RNA, 21 nt, Human
uuaaaaaucacugcuuuggau

SEQ ID NO: 886275 - RNA, 18 nt, Human
uuccugacuuagaaguug

SEQ ID NO: 886276 - RNA, 22 nt, Human
uucuauguaagauuuguuuuug

SEQ ID NO: 886277 - RNA, 18 nt, Human
uucucuccugguuuggaa

SEQ ID NO: 886278 - RNA, 21 nt, Human
uugaaaaacauuuaaaaauca

SEQ ID NO: 886279 - RNA, 24 nt, Human
uuucccccugcaguucucccuaac

SEQ ID NO: 886280 - RNA, 21 nt, Human
acacuugucacacauacaucc

SEQ ID NO: 886281 - RNA, 19 nt, Human
accagucugugcaacaccc

SEQ ID NO: 886282 - RNA, 20 nt, Human
accagucugugcaacacccc

SEQ ID NO: 886283 - RNA, 19 nt, Human
acucaggacugcccgacaa

SEQ ID NO: 886284 - RNA, 23 nt, Human
aggccacccuccuuuuaccccaa

SEQ ID NO: 886285 - RNA, 19 nt, Human
auagcaggccagaaaggcc

SEQ ID NO: 886286 - RNA, 22 nt, Human
cacccuccuuuuaccccaaaga

SEQ ID NO: 886287 - RNA, 26 nt, Human
cacucaggacugcccgacaacugccc

SEQ ID NO: 886288 - RNA, 26 nt, Human
caggagcccuguggaccagucuguua

SEQ ID NO: 886289 - RNA, 22 nt, Human
caggggcuuccuucaggagccc

SEQ ID NO: 886290 - RNA, 25 nt, Human
ccacccuccuuuuaccccaaagauc

SEQ ID NO: 886291 - RNA, 22 nt, Human
ccaggcuccuggcacggggcug

SEQ ID NO: 886292 - RNA, 19 nt, Human
ccccaaagauccaggggcu

SEQ ID NO: 886293 - RNA, 18 nt, Human
cccuccaggcuccuggca

SEQ ID NO: 886294 - RNA, 20 nt, Human
ccuggccauccccaggagcc

SEQ ID NO: 886295 - RNA, 23 nt, Human
cuuuuaccccaaagauccagggg

SEQ ID NO: 886296 - RNA, 21 nt, Human
uaccuggccauccccaggagc

SEQ ID NO: 886297 - RNA, 22 nt, Human
uaccuggccauccccaggagcc

SEQ ID NO: 886298 - RNA, 21 nt, Human
ucaggagcccuguggaccagu

SEQ ID NO: 886299 - RNA, 23 nt, Human
ucucugugacugcacuuaucuuu

SEQ ID NO: 886300 - RNA, 22 nt, Human
ucugugcaacacccacucagga

SEQ ID NO: 886301 - RNA, 18 nt, Human
ugcccgacaacugcccug

SEQ ID NO: 886302 - RNA, 23 nt, Human
ugcccugcugaucccccaucgca

SEQ ID NO: 886303 - RNA, 24 nt, Human
ugggaagacauagcaggccagaaa

SEQ ID NO: 886304 - RNA, 19 nt, Human
uuccccaacuucccuccag

SEQ ID NO: 886305 - RNA, 21 nt, Human
uugaggccacccuccuuuuac

SEQ ID NO: 886306 - RNA, 19 nt, Human
uuuccccaacuucccucca

SEQ ID NO: 886307 - RNA, 23 nt, Human
uuuccccaacuucccuccaggcu

SEQ ID NO: 886308 - RNA, 24 nt, Human
uuuuaccccaaagauccaggggcu

SEQ ID NO: 886309 - RNA, 23 nt, Human
aaagccccuuucacaguuugcuc

SEQ ID NO: 886310 - RNA, 21 nt, Human
aaauagaugcaaugaugaaac

SEQ ID NO: 886311 - RNA, 21 nt, Human
aacaagccucggacacaaaac

SEQ ID NO: 886312 - RNA, 22 nt, Human
aaccaagggccuggaguuuguc

SEQ ID NO: 886313 - RNA, 18 nt, Human
aacccagcgacccgcaac

SEQ ID NO: 886314 - RNA, 22 nt, Human
aagcacagucaaaacugaauac

SEQ ID NO: 886315 - RNA, 22 nt, Human
aauaugggaauacaagaaaaga

SEQ ID NO: 886316 - RNA, 19 nt, Human
aauucuuccuaauagaugu

SEQ ID NO: 886317 - RNA, 23 nt, Human
accauguuuuauaaaauggucuc

SEQ ID NO: 886318 - RNA, 21 nt, Human
acuguauugccuccucuggcu

SEQ ID NO: 886319 - RNA, 19 nt, Human
acugucccacuguauugcc

SEQ ID NO: 886320 - RNA, 19 nt, Human
acuugauguggcugaggag

SEQ ID NO: 886321 - RNA, 20 nt, Human
agacuuuuccagaagguaug

SEQ ID NO: 886322 - RNA, 20 nt, Human
agauguuaaagcuuuuaacc

SEQ ID NO: 886323 - RNA, 21 nt, Human
agcgacugagugacgaccacg

SEQ ID NO: 886324 - RNA, 20 nt, Human
aggaaaaaugaaggagucac

SEQ ID NO: 886325 - RNA, 20 nt, Human
aggaaggaaucccguagcuu

SEQ ID NO: 886326 - RNA, 24 nt, Human
aggcuccauaaaccucauugacaa

SEQ ID NO: 886327 - RNA, 19 nt, Human
auagaugcaaugaugaaac

SEQ ID NO: 886328 - RNA, 23 nt, Human
auauauguguccugugugugucu

SEQ ID NO: 886329 - RNA, 21 nt, Human
augaugaaacaaucuguuuaa

SEQ ID NO: 886330 - RNA, 21 nt, Human
augucaacauucaggaagaug

SEQ ID NO: 886331 - RNA, 22 nt, Human
auguguccugugugugucuaua

SEQ ID NO: 886332 - RNA, 21 nt, Human
auucaggaagauggcaucugu

SEQ ID NO: 886333 - RNA, 20 nt, Human
auuugcuugcaaaagcugcc

SEQ ID NO: 886334 - RNA, 22 nt, Human
caagccucggacacaaaaccaa

SEQ ID NO: 886335 - RNA, 19 nt, Human
caccccuccuacucuuucc

SEQ ID NO: 886336 - RNA, 22 nt, Human
caccccuccuacucuuuccaaa

SEQ ID NO: 886337 - RNA, 18 nt, Human
cacugaaauagcauugau

SEQ ID NO: 886338 - RNA, 18 nt, Human
cagcaccugacucacccc

SEQ ID NO: 886339 - RNA, 18 nt, Human
ccagcgacccgcaaccaa

SEQ ID NO: 886340 - RNA, 23 nt, Human
ccaggaauauuaugguccuuucu

SEQ ID NO: 886341 - RNA, 23 nt, Human
cccaacgauauagccaggguacc

SEQ ID NO: 886342 - RNA, 21 nt, Human
cccuugggggauggacauggu

SEQ ID NO: 886343 - RNA, 19 nt, Human
ccuucuaugcacagaccag

SEQ ID NO: 886344 - RNA, 18 nt, Human
cuagagagguacaugaua

SEQ ID NO: 886345 - RNA, 21 nt, Human
cucauugacaaacuuggaaca

SEQ ID NO: 886346 - RNA, 22 nt, Human
cucauugacaaacuuggaacaa

SEQ ID NO: 886347 - RNA, 21 nt, Human
cucgaggggcagggccccccu

SEQ ID NO: 886348 - RNA, 24 nt, Human
cuucaaguaaacagagcaggcgca

SEQ ID NO: 886349 - RNA, 24 nt, Human
gaccacggcgcugccccaauaacc

SEQ ID NO: 886350 - RNA, 18 nt, Human
gacgaccacggcgcugcc

SEQ ID NO: 886351 - RNA, 26 nt, Human
gcagagccaggcgguucgggagacca

SEQ ID NO: 886352 - RNA, 22 nt, Human
gccccaauaacccagcgacccg

SEQ ID NO: 886353 - RNA, 23 nt, Human
gccuccucuggcuuccugcaacu

SEQ ID NO: 886354 - RNA, 20 nt, Human
gcggucaggugucugguggu

SEQ ID NO: 886355 - RNA, 22 nt, Human
gcuuccgauccagcccaccccu

SEQ ID NO: 886356 - RNA, 21 nt, Human
gggacaccaucgacucgaggg

SEQ ID NO: 886357 - RNA, 21 nt, Human
guaaccccaaauggguguugc

SEQ ID NO: 886358 - RNA, 21 nt, Human
guagugucuaaggcacuuucc

SEQ ID NO: 886359 - RNA, 23 nt, Human
guggcugaggagucgggggccac

SEQ ID NO: 886360 - RNA, 22 nt, Human
uaacccagcgacccgcaaccaa

SEQ ID NO: 886361 - RNA, 22 nt, Human
uacaagaaaagauauuugcggu

SEQ ID NO: 886362 - RNA, 21 nt, Human
uacaguaugcauaggcuggag

SEQ ID NO: 886363 - RNA, 20 nt, Human
uaccugucuguaugacagag

SEQ ID NO: 886364 - RNA, 23 nt, Human
uagccauuggagagaaaccugua

SEQ ID NO: 886365 - RNA, 18 nt, Human
uccaaagggaagggagaa

SEQ ID NO: 886366 - RNA, 21 nt, Human
uccauggcugccaccuggggc

SEQ ID NO: 886367 - RNA, 19 nt, Human
ucccacuguauugccuccu

SEQ ID NO: 886368 - RNA, 24 nt, Human
ucgcauuuccaaaugauuccagaa

SEQ ID NO: 886369 - RNA, 23 nt, Human
ucuuguuuauugaggucucuuua

SEQ ID NO: 886370 - RNA, 23 nt, Human
ugaaggaaaugagagagacaagu

SEQ ID NO: 886371 - RNA, 19 nt, Human
ugacgaccacggcgcugcc

SEQ ID NO: 886372 - RNA, 25 nt, Human
ugaggucucuuuauucuccacgggu

SEQ ID NO: 886373 - RNA, 20 nt, Human
ugaugaaacaaucuguuuaa

SEQ ID NO: 886374 - RNA, 19 nt, Human
ugccccaauaacccagcga

SEQ ID NO: 886375 - RNA, 19 nt, Human
ugcgggacaccaucgacuc

SEQ ID NO: 886376 - RNA, 30 nt, Human
ugcggucaggugucugguggucaacagccc

SEQ ID NO: 886377 - RNA, 24 nt, Human
ugcuuaacuaccaaccaaaaacag

SEQ ID NO: 886378 - RNA, 24 nt, Human
uggaacaagccucggacacaaaac

SEQ ID NO: 886379 - RNA, 23 nt, Human
uggcugccaccuggggccucagc

SEQ ID NO: 886380 - RNA, 18 nt, Human
ugggggauggacauggua

SEQ ID NO: 886381 - RNA, 23 nt, Human
ugguaaccccaaauggguguugc

SEQ ID NO: 886382 - RNA, 19 nt, Human
ugucuagaaauaugggaau

SEQ ID NO: 886383 - RNA, 20 nt, Human
ugucuugcugucccggaaua

SEQ ID NO: 886384 - RNA, 22 nt, Human
uucauugucacugaaugucugu

SEQ ID NO: 886385 - RNA, 20 nt, Human
uucccagcaccugacucacc

SEQ ID NO: 886386 - RNA, 24 nt, Human
uuccuaauagauguuaaagcuuuu

SEQ ID NO: 886387 - RNA, 21 nt, Human
uuuaaaaagggucuuaccaug

SEQ ID NO: 886388 - RNA, 19 nt, Human
aagggccucggcgugcuuc

SEQ ID NO: 886389 - RNA, 20 nt, Human
aagggccucggcgugcuucu

SEQ ID NO: 886390 - RNA, 24 nt, Human
acuccuugugcuuggggcccaggg

SEQ ID NO: 886391 - RNA, 23 nt, Human
acucuucucgccuuccagcgccu

SEQ ID NO: 886392 - RNA, 23 nt, Human
agagcuccagcuggauccgcagc

SEQ ID NO: 886393 - RNA, 19 nt, Human
agccugcgccugcucgugg

SEQ ID NO: 886394 - RNA, 19 nt, Human
aggacuguguuuuuccucc

SEQ ID NO: 886395 - RNA, 24 nt, Human
aggcagcagggggcgaugcagaga

SEQ ID NO: 886396 - RNA, 23 nt, Human
aucucacucuucucgccuuccag

SEQ ID NO: 886397 - RNA, 20 nt, Human
caagcucagccuccagcucc

SEQ ID NO: 886398 - RNA, 22 nt, Human
cacuucugcuuugaccugggag

SEQ ID NO: 886399 - RNA, 21 nt, Human
cagccgcugcuccucgucccg

SEQ ID NO: 886400 - RNA, 22 nt, Human
cagcucccguaccucuuggccu

SEQ ID NO: 886401 - RNA, 22 nt, Human
cagcuuguccaccagguccugc

SEQ ID NO: 886402 - RNA, 21 nt, Human
cagggaaggcugaaggcagca

SEQ ID NO: 886403 - RNA, 18 nt, Human
caggugugcacuuguguc

SEQ ID NO: 886404 - RNA, 20 nt, Human
cagugauggccuuuuuggcc

SEQ ID NO: 886405 - RNA, 21 nt, Human
caguuccuggaugcucuuccc

SEQ ID NO: 886406 - RNA, 22 nt, Human
caguuccuggaugcucuuccca

SEQ ID NO: 886407 - RNA, 22 nt, Human
ccaaaagcuccugcucugccag

SEQ ID NO: 886408 - RNA, 19 nt, Human
ccagccgcugcuccucguc

SEQ ID NO: 886409 - RNA, 21 nt, Human
ccagcgccuucuugguuuucu

SEQ ID NO: 886410 - RNA, 20 nt, Human
cccgcagcuccuccagcucc

SEQ ID NO: 886411 - RNA, 20 nt, Human
cccguaccucuuggccucca

SEQ ID NO: 886412 - RNA, 22 nt, Human
ccgccaugucugcccgcuccuc

SEQ ID NO: 886413 - RNA, 18 nt, Human
ccgcucagcugggccaag

SEQ ID NO: 886414 - RNA, 22 nt, Human
ccucagccucccgccucuccug

SEQ ID NO: 886415 - RNA, 19 nt, Human
ccuccagcucccguaccuc

SEQ ID NO: 886416 - RNA, 28 nt, Human
ccuccagcuucuucuucugggggccgcc

SEQ ID NO: 886417 - RNA, 18 nt, Human
ccuccuccaccuccccgc

SEQ ID NO: 886418 - RNA, 20 nt, Human
ccucgucccgcccugccugc

SEQ ID NO: 886419 - RNA, 25 nt, Human
ccucgucccgcccugccugcuccuc

SEQ ID NO: 886420 - RNA, 24 nt, Human
ccucgucuuucucugccagcuucc

SEQ ID NO: 886421 - RNA, 24 nt, Human
ccucuccugugcagccuccuccac

SEQ ID NO: 886422 - RNA, 21 nt, Human
ccugaaccccaaagaaaagaa

SEQ ID NO: 886423 - RNA, 23 nt, Human
ccugacggguggcauggcccagc

SEQ ID NO: 886424 - RNA, 21 nt, Human
ccugcucguggagcucagcug

SEQ ID NO: 886425 - RNA, 24 nt, Human
ccuugcgauacuuggccagguugg

SEQ ID NO: 886426 - RNA, 25 nt, Human
cgccuccagcuucuucuucugguuu

SEQ ID NO: 886427 - RNA, 23 nt, Human
cgcuccagagccugcgccugcuc

SEQ ID NO: 886428 - RNA, 18 nt, Human
cgguggccuccaaaagcu

SEQ ID NO: 886429 - RNA, 23 nt, Human
cgucuuggucuccuccagcucca

SEQ ID NO: 886430 - RNA, 21 nt, Human
cuccaggucguugaggucacc

SEQ ID NO: 886431 - RNA, 23 nt, Human
cuccagugcagccuggaucucac

SEQ ID NO: 886432 - RNA, 20 nt, Human
cuccugaaccccaaagaaaa

SEQ ID NO: 886433 - RNA, 23 nt, Human
cugaaccccaaagaaaagaauga

SEQ ID NO: 886434 - RNA, 19 nt, Human
cugcagcuuguccaccagg

SEQ ID NO: 886435 - RNA, 19 nt, Human
cugccagucgccggcugcg

SEQ ID NO: 886436 - RNA, 18 nt, Human
cugggccucuguggccug

SEQ ID NO: 886437 - RNA, 18 nt, Human
cuucccagagggaccaaa

SEQ ID NO: 886438 - RNA, 21 nt, Human
cuuccgguccacuucugcuuu

SEQ ID NO: 886439 - RNA, 23 nt, Human
cuuccucccugagaggaucuggu

SEQ ID NO: 886440 - RNA, 24 nt, Human
gaaaagaaugagaaggaaacuggc

SEQ ID NO: 886441 - RNA, 24 nt, Human
gaccuugcucugcagcuuguccac

SEQ ID NO: 886442 - RNA, 19 nt, Human
gagcuccuugacacggcgc

SEQ ID NO: 886443 - RNA, 19 nt, Human
gagcucgcgcaccgucugc

SEQ ID NO: 886444 - RNA, 23 nt, Human
gaucucacucuucucgccuucca

SEQ ID NO: 886445 - RNA, 24 nt, Human
gaucucacucuucucgccuuccag

SEQ ID NO: 886446 - RNA, 22 nt, Human
gcaucaagcucagccuccagcu

SEQ ID NO: 886447 - RNA, 23 nt, Human
gcccgugucucugcauccaggga

SEQ ID NO: 886448 - RNA, 21 nt, Human
gcgagccagguucuuccuguc

SEQ ID NO: 886449 - RNA, 21 nt, Human
gcgauacuuggccagguuggu

SEQ ID NO: 886450 - RNA, 24 nt, Human
gcuccagggcccccucugccuccu

SEQ ID NO: 886451 - RNA, 18 nt, Human
gcuccucgucccgcccug

SEQ ID NO: 886452 - RNA, 18 nt, Human
gcucgugcugggccuugc

SEQ ID NO: 886453 - RNA, 20 nt, Human
gcuuggggcccagggcgucc

SEQ ID NO: 886454 - RNA, 21 nt, Human
ggacuccacagcucgcuggug

SEQ ID NO: 886455 - RNA, 19 nt, Human
ggcccagggaaggcugaag

SEQ ID NO: 886456 - RNA, 18 nt, Human
gguggcauggcccagcug

SEQ ID NO: 886457 - RNA, 19 nt, Human
gugcaacagcagacauucc

SEQ ID NO: 886458 - RNA, 21 nt, Human
guguuggccugcugcuccgcc

SEQ ID NO: 886459 - RNA, 21 nt, Human
ucaagcucagccuccagcucc

SEQ ID NO: 886460 - RNA, 20 nt, Human
uccaaaagcuccugcucugc

SEQ ID NO: 886461 - RNA, 24 nt, Human
uccagcucgugcugggccuugcga

SEQ ID NO: 886462 - RNA, 28 nt, Human
ucccagagggaccaaagugacgauuuug

SEQ ID NO: 886463 - RNA, 19 nt, Human
uccccgcucagcugggcca

SEQ ID NO: 886464 - RNA, 22 nt, Human
uccccgcucagcugggccaagu

SEQ ID NO: 886465 - RNA, 23 nt, Human
ucccguaccucuuggccuccagc

SEQ ID NO: 886466 - RNA, 18 nt, Human
ucccugagaggaucuggu

SEQ ID NO: 886467 - RNA, 18 nt, Human
uccgugcccgcagcuugu

SEQ ID NO: 886468 - RNA, 21 nt, Human
uccgugcccgcagcuuguugg

SEQ ID NO: 886469 - RNA, 20 nt, Human
uccugaaccccaaagaaaag

SEQ ID NO: 886470 - RNA, 18 nt, Human
ucguugaggucacccucc

SEQ ID NO: 886471 - RNA, 21 nt, Human
ucugcaccugcuucuucccgc

SEQ ID NO: 886472 - RNA, 23 nt, Human
ucugcagcuuguccaccaggucc

SEQ ID NO: 886473 - RNA, 21 nt, Human
ucuguggccugacggguggca

SEQ ID NO: 886474 - RNA, 18 nt, Human
ucuugagccgcagcgccu

SEQ ID NO: 886475 - RNA, 23 nt, Human
ugacggguggcauggcccagcug

SEQ ID NO: 886476 - RNA, 27 nt, Human
ugagaaggaaacuggcugugguguuua

SEQ ID NO: 886477 - RNA, 18 nt, Human
ugagaggaucugguagua

SEQ ID NO: 886478 - RNA, 22 nt, Human
ugcagccuccuccaccuccccg

SEQ ID NO: 886479 - RNA, 23 nt, Human
ugcuucuucccgccacggagggc

SEQ ID NO: 886480 - RNA, 19 nt, Human
uggcagccugggccucugu

SEQ ID NO: 886481 - RNA, 21 nt, Human
uggcaggaucggggcaggugg

SEQ ID NO: 886482 - RNA, 21 nt, Human
uggccuccagcuucugcaccu

SEQ ID NO: 886483 - RNA, 22 nt, Human
ugggagagcuccagcuggaucc

SEQ ID NO: 886484 - RNA, 20 nt, Human
ugggccucuguggccugacg

SEQ ID NO: 886485 - RNA, 24 nt, Human
uggggcccagggcgucccgggucc

SEQ ID NO: 886486 - RNA, 20 nt, Human
uggguuuccgccaugucugc

SEQ ID NO: 886487 - RNA, 20 nt, Human
uguagcucuugaccuugcuc

SEQ ID NO: 886488 - RNA, 18 nt, Human
uguccugcuccuucuuca

SEQ ID NO: 886489 - RNA, 23 nt, Human
ugugcagccuccuccaccucccc

SEQ ID NO: 886490 - RNA, 18 nt, Human
uguucugcgaaugcagaa

SEQ ID NO: 886491 - RNA, 20 nt, Human
uguuggccugcugcuccgcc

SEQ ID NO: 886492 - RNA, 20 nt, Human
uuccagcgccuucuugguuu

SEQ ID NO: 886493 - RNA, 22 nt, Human
uuccaggugugcacuugugucc

SEQ ID NO: 886494 - RNA, 22 nt, Human
uuggucuccuccagcuccaggg

SEQ ID NO: 886495 - RNA, 23 nt, Human
uuuggccuucuccucagccuccc

SEQ ID NO: 886496 - RNA, 23 nt, Human
uuuuggccuucuccucagccucc

SEQ ID NO: 886497 - RNA, 20 nt, Human
acugcucagcucuccgggac

SEQ ID NO: 886498 - RNA, 20 nt, Human
acugcucagcucuccgggac

SEQ ID NO: 886499 - RNA, 23 nt, Human
agacaagaugggaaaguugcuga

SEQ ID NO: 886500 - RNA, 23 nt, Human
agacaagaugggaaaguugcuga

SEQ ID NO: 886501 - RNA, 23 nt, Human
agacaagaugggaaaguugcuga

SEQ ID NO: 886502 - RNA, 23 nt, Human
agccauucagcaccaugcggacg

SEQ ID NO: 886503 - RNA, 23 nt, Human
agccauucagcaccaugcggacg

SEQ ID NO: 886504 - RNA, 18 nt, Human
cacauccccacacuggcu

SEQ ID NO: 886505 - RNA, 18 nt, Human
cacauccccacacuggcu

SEQ ID NO: 886506 - RNA, 19 nt, Human
caggaucuugccaucaccu

SEQ ID NO: 886507 - RNA, 19 nt, Human
caggaucuugccaucaccu

SEQ ID NO: 886508 - RNA, 21 nt, Human
cccagagagcaaguuuauuug

SEQ ID NO: 886509 - RNA, 21 nt, Human
cccagagagcaaguuuauuug

SEQ ID NO: 886510 - RNA, 21 nt, Human
cccagagagcaaguuuauuug

SEQ ID NO: 886511 - RNA, 22 nt, Human
ccgggaccuuuuccugcaguaa

SEQ ID NO: 886512 - RNA, 23 nt, Human
cuggcuguacaggaucuugccau

SEQ ID NO: 886513 - RNA, 23 nt, Human
cuggcuguacaggaucuugccau

SEQ ID NO: 886514 - RNA, 20 nt, Human
gagcuccgccccaugggccc

SEQ ID NO: 886515 - RNA, 22 nt, Human
gugaaugcugacggcaaacauc

SEQ ID NO: 886516 - RNA, 22 nt, Human
gugaaugcugacggcaaacauc

SEQ ID NO: 886517 - RNA, 22 nt, Human
gugaaugcugacggcaaacauc

SEQ ID NO: 886518 - RNA, 20 nt, Human
uucagcaccaugcggacgag

SEQ ID NO: 886519 - RNA, 20 nt, Human
uucagcaccaugcggacgag

SEQ ID NO: 886520 - RNA, 18 nt, Human
aaagggggaucccugagc

SEQ ID NO: 886521 - RNA, 22 nt, Human
aaggggugucugaucccaggac

SEQ ID NO: 886522 - RNA, 23 nt, Human
acccuaaccccucaaagggggau

SEQ ID NO: 886523 - RNA, 24 nt, Human
acgcacuucuccuggccuguuucu

SEQ ID NO: 886524 - RNA, 22 nt, Human
acugggacccuaaccccucaaa

SEQ ID NO: 886525 - RNA, 19 nt, Human
agagacuauagcccagggc

SEQ ID NO: 886526 - RNA, 19 nt, Human
aggggucagagacuauagc

SEQ ID NO: 886527 - RNA, 18 nt, Human
cagauguccacgcugccc

SEQ ID NO: 886528 - RNA, 18 nt, Human
ccccuucccuuccuccuc

SEQ ID NO: 886529 - RNA, 21 nt, Human
ccccuucccuuccuccucggg

SEQ ID NO: 886530 - RNA, 19 nt, Human
ccucuagguccugcccucc

SEQ ID NO: 886531 - RNA, 20 nt, Human
cgacuccugagcacacuccu

SEQ ID NO: 886532 - RNA, 23 nt, Human
cggaauggggccuucccuuggug

SEQ ID NO: 886533 - RNA, 21 nt, Human
cggcaguggccggucagggug

SEQ ID NO: 886534 - RNA, 19 nt, Human
cuccagcccauguccccag

SEQ ID NO: 886535 - RNA, 18 nt, Human
cuggcgggggcuggggug

SEQ ID NO: 886536 - RNA, 19 nt, Human
gacuccugagcacacuccc

SEQ ID NO: 886537 - RNA, 18 nt, Human
gccucuagguccugcccu

SEQ ID NO: 886538 - RNA, 19 nt, Human
gcggcaguggccggucagg

SEQ ID NO: 886539 - RNA, 24 nt, Human
gcuggggugucagggggcuggggu

SEQ ID NO: 886540 - RNA, 19 nt, Human
ggcaguggccggucagggu

SEQ ID NO: 886541 - RNA, 21 nt, Human
ggggcacacagagccccuucc

SEQ ID NO: 886542 - RNA, 30 nt, Human
ggggcuggggugucagggggcugggguggg

SEQ ID NO: 886543 - RNA, 26 nt, Human
gggggcuggggugucagggggcuggg

SEQ ID NO: 886544 - RNA, 20 nt, Human
ggggugucagggggcugggg

SEQ ID NO: 886545 - RNA, 21 nt, Human
gugcggggaggggugacuggc

SEQ ID NO: 886546 - RNA, 23 nt, Human
guggcgugcucugggugggugug

SEQ ID NO: 886547 - RNA, 20 nt, Human
ucagggccucuuccuccugg

SEQ ID NO: 886548 - RNA, 18 nt, Human
ucaugggcagggagcugg

SEQ ID NO: 886549 - RNA, 23 nt, Human
uccacugggaacugggacccuaa

SEQ ID NO: 886550 - RNA, 21 nt, Human
ucccugagcgagggucauggg

SEQ ID NO: 886551 - RNA, 23 nt, Human
ucggcacgcacuucuccuggccu

SEQ ID NO: 886552 - RNA, 19 nt, Human
ucuauuggagauucugccc

SEQ ID NO: 886553 - RNA, 18 nt, Human
ugagaggggaccuuggug

SEQ ID NO: 886554 - RNA, 21 nt, Human
ugagcacacucccauggcggg

SEQ ID NO: 886555 - RNA, 23 nt, Human
ugccucagcucggcacgcacuuc

SEQ ID NO: 886556 - RNA, 20 nt, Human
ugcucugggugggugugcgg

SEQ ID NO: 886557 - RNA, 24 nt, Human
uggcgugcucugggugggugugcg

SEQ ID NO: 886558 - RNA, 22 nt, Human
ugggaacaucugccucagcucg

SEQ ID NO: 886559 - RNA, 22 nt, Human
ugggacagauguccacgcugcc

SEQ ID NO: 886560 - RNA, 20 nt, Human
ugguauggacgggugugugc

SEQ ID NO: 886561 - RNA, 21 nt, Human
uguccacgcugcccgcgacuc

SEQ ID NO: 886562 - RNA, 22 nt, Human
ugugcggggaggggugacuggc

SEQ ID NO: 886563 - RNA, 25 nt, Human
uucccuuccuccucggggaacagcc

SEQ ID NO: 886564 - RNA, 23 nt, Human
uuccuuggaggggucagagacua

SEQ ID NO: 886565 - RNA, 22 nt, Human
aaacccagcuggccugaaggcu

SEQ ID NO: 886566 - RNA, 19 nt, Human
aagcaggugcgcuccggga

SEQ ID NO: 886567 - RNA, 21 nt, Human
aagccaaggccaggccaucga

SEQ ID NO: 886568 - RNA, 26 nt, Human
aggcaggggagggucuccuccugggg

SEQ ID NO: 886569 - RNA, 23 nt, Human
agggaagaggggaacagcagucg

SEQ ID NO: 886570 - RNA, 20 nt, Human
aggugccuucccaaccucag

SEQ ID NO: 886571 - RNA, 19 nt, Human
aucccacccucagcccccc

SEQ ID NO: 886572 - RNA, 19 nt, Human
cacucaccagcaugauguc

SEQ ID NO: 886573 - RNA, 20 nt, Human
cagggaggcaaacucuggcu

SEQ ID NO: 886574 - RNA, 24 nt, Human
caucaaacggagcugggagucgcu

SEQ ID NO: 886575 - RNA, 26 nt, Human
ccaaccucagcacucagucccaaucu

SEQ ID NO: 886576 - RNA, 24 nt, Human
ccacccucagccccccaacagcuu

SEQ ID NO: 886577 - RNA, 21 nt, Human
cccaaccagcugcggcggcau

SEQ ID NO: 886578 - RNA, 21 nt, Human
cccacccucagccccccaaca

SEQ ID NO: 886579 - RNA, 22 nt, Human
ccccaaccagcugcggcggcau

SEQ ID NO: 886580 - RNA, 21 nt, Human
ccccccaacagcuuccucagc

SEQ ID NO: 886581 - RNA, 23 nt, Human
ccccccaacagcuuccucagcuu

SEQ ID NO: 886582 - RNA, 21 nt, Human
ccucagccccccaacagcuuc

SEQ ID NO: 886583 - RNA, 23 nt, Human
ccucgggcuaaacccagcuggcc

SEQ ID NO: 886584 - RNA, 23 nt, Human
cgagaaucccacccucagccccc

SEQ ID NO: 886585 - RNA, 20 nt, Human
cucuccgaaggugaaguggg

SEQ ID NO: 886586 - RNA, 19 nt, Human
cuugcguucccccuucugu

SEQ ID NO: 886587 - RNA, 21 nt, Human
gaaggugaagugggggaagca

SEQ ID NO: 886588 - RNA, 24 nt, Human
gcaggcagaugaggucuugggaug

SEQ ID NO: 886589 - RNA, 21 nt, Human
gcguucccccuucugugggag

SEQ ID NO: 886590 - RNA, 23 nt, Human
ggcaggggagggucuccuccugg

SEQ ID NO: 886591 - RNA, 22 nt, Human
ggccugaaggcucaacucacau

SEQ ID NO: 886592 - RNA, 18 nt, Human
gggaagcaggugcgcucc

SEQ ID NO: 886593 - RNA, 18 nt, Human
gucccaaucucucuucca

SEQ ID NO: 886594 - RNA, 24 nt, Human
guuccuguaaacauccaucgcagc

SEQ ID NO: 886595 - RNA, 25 nt, Human
guuccuguaaacauccaucgcagcu

SEQ ID NO: 886596 - RNA, 24 nt, Human
uaagaccagccucgggcuaaaccc

SEQ ID NO: 886597 - RNA, 25 nt, Human
ucagccccccaacagcuuccucagg

SEQ ID NO: 886598 - RNA, 21 nt, Human
ucccaaccucagcacucaguc

SEQ ID NO: 886599 - RNA, 25 nt, Human
ucccacccucagccccccaacagcu

SEQ ID NO: 886600 - RNA, 24 nt, Human
ucgcagcugcaaauaaucagaagc

SEQ ID NO: 886601 - RNA, 24 nt, Human
ucuccuggguucaaacaggaacug

SEQ ID NO: 886602 - RNA, 18 nt, Human
ucugagucaccccugaaa

SEQ ID NO: 886603 - RNA, 21 nt, Human
ucuuccacucuccuggguuca

SEQ ID NO: 886604 - RNA, 23 nt, Human
ucuucugagucaccccugaaaca

SEQ ID NO: 886605 - RNA, 20 nt, Human
ugaaggagcgagaaucccac

SEQ ID NO: 886606 - RNA, 19 nt, Human
ugacacugcaggcagauga

SEQ ID NO: 886607 - RNA, 25 nt, Human
ugcccccaaccagcugcggcggcau

SEQ ID NO: 886608 - RNA, 18 nt, Human
ugccuucccaaccucagc

SEQ ID NO: 886609 - RNA, 22 nt, Human
ugcuuagacagguuuaucagaa

SEQ ID NO: 886610 - RNA, 22 nt, Human
uggcacgaagcuuuugagggaa

SEQ ID NO: 886611 - RNA, 24 nt, Human
uggccugaaggcucaacucacauc

SEQ ID NO: 886612 - RNA, 20 nt, Human
uuaauccaaagaaguaagcc

SEQ ID NO: 886613 - RNA, 18 nt, Human
uuccucagcuucuuuuuc

SEQ ID NO: 886614 - RNA, 18 nt, Human
uuugacacugcaggcaga

SEQ ID NO: 886615 - RNA, 25 nt, Human
uuugcguguguccgcaguuugaagu

SEQ ID NO: 886616 - RNA, 25 nt, Human
aaaaacaccaaauaucuacuuaaaa

SEQ ID NO: 886617 - RNA, 18 nt, Human
aaaagugcugaccauugg

SEQ ID NO: 886618 - RNA, 20 nt, Human
aaaagugcugaccauugguu

SEQ ID NO: 886619 - RNA, 24 nt, Human
aaaauaauggucacaacucaaaug

SEQ ID NO: 886620 - RNA, 28 nt, Human
aaagccaaaaauaaaaacaaacauugcc

SEQ ID NO: 886621 - RNA, 20 nt, Human
aaaugaagggcaauucuaaa

SEQ ID NO: 886622 - RNA, 22 nt, Human
aacacacucuugggcugauacu

SEQ ID NO: 886623 - RNA, 26 nt, Human
aacacuucuaccaccgauagcaaccc

SEQ ID NO: 886624 - RNA, 20 nt, Human
aacucaaguacauuuuccuc

SEQ ID NO: 886625 - RNA, 26 nt, Human
aagccaaaaauaaaaacaaagggacc

SEQ ID NO: 886626 - RNA, 22 nt, Human
aauaagugacggugaauggcaa

SEQ ID NO: 886627 - RNA, 22 nt, Human
acccaaggggggaacacaguuu

SEQ ID NO: 886628 - RNA, 22 nt, Human
agaaaauaaaacucauccaccc

SEQ ID NO: 886629 - RNA, 21 nt, Human
agccaaaaauaaaaacaaaca

SEQ ID NO: 886630 - RNA, 21 nt, Human
auauuaauagagaaauagcac

SEQ ID NO: 886631 - RNA, 23 nt, Human
augcaccuuaccagagauguuug

SEQ ID NO: 886632 - RNA, 21 nt, Human
caacccaaggggggaacacag

SEQ ID NO: 886633 - RNA, 19 nt, Human
cauuuuuguuucauuagaa

SEQ ID NO: 886634 - RNA, 19 nt, Human
cucagauaacucaaaccaa

SEQ ID NO: 886635 - RNA, 22 nt, Human
gcugauacuaucguggauuuug

SEQ ID NO: 886636 - RNA, 23 nt, Human
gucacaacugaaucacauuaacu

SEQ ID NO: 886637 - RNA, 27 nt, Human
gucacaacugaaucacauuaacuggcu

SEQ ID NO: 886638 - RNA, 22 nt, Human
uaaaaagugcauaacaggagua

SEQ ID NO: 886639 - RNA, 26 nt, Human
uaaaacauaaacugaaucaaauuuug

SEQ ID NO: 886640 - RNA, 24 nt, Human
uaaaauucauuuugaaaauacaau

SEQ ID NO: 886641 - RNA, 22 nt, Human
uaacaauauauuaauagagaaa

SEQ ID NO: 886642 - RNA, 27 nt, Human
uaacaggaguaagagaggcuuaccaaa

SEQ ID NO: 886643 - RNA, 22 nt, Human
uaaggcagcuuuaaaagaaaau

SEQ ID NO: 886644 - RNA, 22 nt, Human
uauauuaauagagaaauagcac

SEQ ID NO: 886645 - RNA, 21 nt, Human
uauuuuuaugcauaguuuaug

SEQ ID NO: 886646 - RNA, 21 nt, Human
ucacaacugaaucacauuaac

SEQ ID NO: 886647 - RNA, 23 nt, Human
ucagaauggaauuuuacccuuga

SEQ ID NO: 886648 - RNA, 20 nt, Human
ucucagauaacucaaaccaa

SEQ ID NO: 886649 - RNA, 22 nt, Human
ugagggcaggaaaauuuuaaaa

SEQ ID NO: 886650 - RNA, 22 nt, Human
uggcaacacuucuaccaccgau

SEQ ID NO: 886651 - RNA, 21 nt, Human
uuaaaaagcucucuguggagu

SEQ ID NO: 886652 - RNA, 24 nt, Human
uugaucuugaucaacuaacacaau

SEQ ID NO: 886653 - RNA, 21 nt, Human
uuucuccagaauacucaguuc

SEQ ID NO: 886654 - RNA, 23 nt, Human
uuugacaagauaaaaacaccaaa

SEQ ID NO: 886655 - RNA, 25 nt, Human
uuuuccucaucuccaauauuuuaga

SEQ ID NO: 886656 - RNA, 25 nt, Human
aacaguccuaccccuaucugcaccc

SEQ ID NO: 886657 - RNA, 22 nt, Human
acacacuuauacauacacagga

SEQ ID NO: 886658 - RNA, 19 nt, Human
accacacugggagcccagc

SEQ ID NO: 886659 - RNA, 19 nt, Human
accacacugggagcccagc

SEQ ID NO: 886660 - RNA, 23 nt, Human
agaggacacagaucacaggaacc

SEQ ID NO: 886661 - RNA, 21 nt, Human
agaggaggaggaaggucaugg

SEQ ID NO: 886662 - RNA, 20 nt, Human
agccgggaaagcaggagcga

SEQ ID NO: 886663 - RNA, 21 nt, Human
aggaaggucauggcauguaga

SEQ ID NO: 886664 - RNA, 19 nt, Human
caccccaucaacucucugg

SEQ ID NO: 886665 - RNA, 21 nt, Human
cacggaaugaggcuuuacaga

SEQ ID NO: 886666 - RNA, 20 nt, Human
cacugggagcccagcauccc

SEQ ID NO: 886667 - RNA, 23 nt, Human
cagaacuucugcaaagaggacac

SEQ ID NO: 886668 - RNA, 21 nt, Human
cauucaucauucaucaguuuc

SEQ ID NO: 886669 - RNA, 19 nt, Human
ccacacacaccgacacaca

SEQ ID NO: 886670 - RNA, 23 nt, Human
ccaugcuggcuggcucuggccac

SEQ ID NO: 886671 - RNA, 22 nt, Human
cccaccgagccgggaaagcagg

SEQ ID NO: 886672 - RNA, 23 nt, Human
cccagguagcaaggccauagaga

SEQ ID NO: 886673 - RNA, 23 nt, Human
cccggguggccgcgaagggaccc

SEQ ID NO: 886674 - RNA, 23 nt, Human
cgcgaagggaccccaccgagccg

SEQ ID NO: 886675 - RNA, 21 nt, Human
cgggaaagcaggagcgaagga

SEQ ID NO: 886676 - RNA, 24 nt, Human
cuccacacacaccgacacacaucc

SEQ ID NO: 886677 - RNA, 19 nt, Human
cucuccacacacaccgaca

SEQ ID NO: 886678 - RNA, 18 nt, Human
cuggccaccggggaggcc

SEQ ID NO: 886679 - RNA, 24 nt, Human
gaaggcacagaugcccaggaguca

SEQ ID NO: 886680 - RNA, 21 nt, Human
gagaaauagaaguauacaccc

SEQ ID NO: 886681 - RNA, 21 nt, Human
gcgaagggaccccaccgagcc

SEQ ID NO: 886682 - RNA, 20 nt, Human
ggcucuggccaccggggagg

SEQ ID NO: 886683 - RNA, 20 nt, Human
guucuauucuaacaguccua

SEQ ID NO: 886684 - RNA, 18 nt, Human
uacacacaguuuggguug

SEQ ID NO: 886685 - RNA, 19 nt, Human
uacacacaguuuggguugg

SEQ ID NO: 886686 - RNA, 19 nt, Human
uauacaccccaaacuacac

SEQ ID NO: 886687 - RNA, 22 nt, Human
uauacauacacaggauagagaa

SEQ ID NO: 886688 - RNA, 21 nt, Human
uaucaggaaagacuuccugga

SEQ ID NO: 886689 - RNA, 27 nt, Human
uauucuaacaguccuaccccuaucugc

SEQ ID NO: 886690 - RNA, 19 nt, Human
ucaacacuuuauuuuguuc

SEQ ID NO: 886691 - RNA, 20 nt, Human
uccacacacaccgacacaca

SEQ ID NO: 886692 - RNA, 23 nt, Human
uccacacacaccgacacacaucc

SEQ ID NO: 886693 - RNA, 24 nt, Human
uccacacacaccgacacacauccc

SEQ ID NO: 886694 - RNA, 20 nt, Human
uccccgcaggauaugccucu

SEQ ID NO: 886695 - RNA, 18 nt, Human
uccccggguggccgcgaa

SEQ ID NO: 886696 - RNA, 23 nt, Human
uccccggguggccgcgaagggac

SEQ ID NO: 886697 - RNA, 19 nt, Human
uccuaccccuaucugcacc

SEQ ID NO: 886698 - RNA, 21 nt, Human
ucuuuggcucauucauucauu

SEQ ID NO: 886699 - RNA, 20 nt, Human
ugagaugaugagaugagaug

SEQ ID NO: 886700 - RNA, 18 nt, Human
ugagauggagcuuccugc

SEQ ID NO: 886701 - RNA, 21 nt, Human
ugagauggagcuuccugccag

SEQ ID NO: 886702 - RNA, 20 nt, Human
ugccucugugggcucaucuc

SEQ ID NO: 886703 - RNA, 19 nt, Human
uggccaccggggaggccug

SEQ ID NO: 886704 - RNA, 21 nt, Human
uggcucuggccaccggggagg

SEQ ID NO: 886705 - RNA, 26 nt, Human
uggcuggcucuggccaccggggaggc

SEQ ID NO: 886706 - RNA, 18 nt, Human
ugggagcccagcaucccc

SEQ ID NO: 886707 - RNA, 20 nt, Human
ugugugggcucauuuauuug

SEQ ID NO: 886708 - RNA, 22 nt, Human
uucaguuugauauaucaggaaa

SEQ ID NO: 886709 - RNA, 23 nt, Human
uucaucauucaucaguuucuuga

SEQ ID NO: 886710 - RNA, 18 nt, Human
uugaaugcuuguacacac

SEQ ID NO: 886711 - RNA, 20 nt, Human
uuuacagacacacgcagcac

SEQ ID NO: 886712 - RNA, 24 nt, Human
aggcggccggagccccugcgggug

SEQ ID NO: 886713 - RNA, 24 nt, Human
cauagagcucacggcccugguacc

SEQ ID NO: 886714 - RNA, 21 nt, Human
ccucggggugcggcgggugcg

SEQ ID NO: 886715 - RNA, 19 nt, Human
ccugcgggugaggcgggag

SEQ ID NO: 886716 - RNA, 18 nt, Human
cggcccugguaccuggcg

SEQ ID NO: 886717 - RNA, 20 nt, Human
cggccggagccccugcgggu

SEQ ID NO: 886718 - RNA, 23 nt, Human
gccccugcgggugaggcgggagc

SEQ ID NO: 886719 - RNA, 22 nt, Human
gcggcguuggccacagcauaga

SEQ ID NO: 886720 - RNA, 23 nt, Human
ggcccauacaggggcagcuccug

SEQ ID NO: 886721 - RNA, 19 nt, Human
ggccggagccccugcgggu

SEQ ID NO: 886722 - RNA, 22 nt, Human
gggagcggcgagcaggagggcu

SEQ ID NO: 886723 - RNA, 24 nt, Human
ggggcggacaauuggcggccucgg

SEQ ID NO: 886724 - RNA, 22 nt, Human
uaccuggcgauggccucaggcc

SEQ ID NO: 886725 - RNA, 19 nt, Human
aaagaagcugaccccauau

SEQ ID NO: 886726 - RNA, 22 nt, Human
aaagagacagaggcuuucucag

SEQ ID NO: 886727 - RNA, 22 nt, Human
aaagauggacaagaucaggucc

SEQ ID NO: 886728 - RNA, 24 nt, Human
aaagugcugggauuacaggccuga

SEQ ID NO: 886729 - RNA, 19 nt, Human
aagugcugggauuacaggc

SEQ ID NO: 886730 - RNA, 19 nt, Human
aagugcugggauuacaggc

SEQ ID NO: 886731 - RNA, 26 nt, Human
aagugcugggauuacaggccugagcc

SEQ ID NO: 886732 - RNA, 24 nt, Human
aaucauauguaacauacaauugaa

SEQ ID NO: 886733 - RNA, 19 nt, Human
acaaagauggacaagauca

SEQ ID NO: 886734 - RNA, 22 nt, Human
accagcagaacacuucaggccc

SEQ ID NO: 886735 - RNA, 20 nt, Human
accagugaauggagaguuac

SEQ ID NO: 886736 - RNA, 24 nt, Human
accauguuggucaggcuggucucg

SEQ ID NO: 886737 - RNA, 23 nt, Human
acccucuaccaagcccugugcua

SEQ ID NO: 886738 - RNA, 18 nt, Human
acgggguuucaccauguu

SEQ ID NO: 886739 - RNA, 23 nt, Human
acgggguuucaccauguugguca

SEQ ID NO: 886740 - RNA, 24 nt, Human
acgggguuucaccauguuggucag

SEQ ID NO: 886741 - RNA, 24 nt, Human
acuucaugauccgcccaucuuggc

SEQ ID NO: 886742 - RNA, 25 nt, Human
agaaaagcccagcaaaggugggagg

SEQ ID NO: 886743 - RNA, 18 nt, Human
agaagagugcaggaaagg

SEQ ID NO: 886744 - RNA, 18 nt, Human
agagagggguuauuugcc

SEQ ID NO: 886745 - RNA, 21 nt, Human
agauaugcuuguguaacuuag

SEQ ID NO: 886746 - RNA, 20 nt, Human
agccaccgcacccggcuuuu

SEQ ID NO: 886747 - RNA, 23 nt, Human
aggaagcacaauuuaauguugag

SEQ ID NO: 886748 - RNA, 18 nt, Human
aggaugaagaaaaaaagg

SEQ ID NO: 886749 - RNA, 19 nt, Human
aggcauggaccauaugucc

SEQ ID NO: 886750 - RNA, 22 nt, Human
aguagagacgggguuucaccau

SEQ ID NO: 886751 - RNA, 22 nt, Human
agugauagaaaagcccagcaaa

SEQ ID NO: 886752 - RNA, 24 nt, Human
agugcugggauuacaggccugagc

SEQ ID NO: 886753 - RNA, 18 nt, Human
aucacacugcaauuuguc

SEQ ID NO: 886754 - RNA, 18 nt, Human
auggagcccugacucugg

SEQ ID NO: 886755 - RNA, 18 nt, Human
augugggagagugguaga

SEQ ID NO: 886756 - RNA, 18 nt, Human
caaaggugggaggaugga

SEQ ID NO: 886757 - RNA, 24 nt, Human
caaagugacagguccaaacuuucc

SEQ ID NO: 886758 - RNA, 24 nt, Human
caaagugcugggauuacaggccug

SEQ ID NO: 886759 - RNA, 22 nt, Human
caccaaagugacagguccaaac

SEQ ID NO: 886760 - RNA, 21 nt, Human
caccauguuggucaggcuggu

SEQ ID NO: 886761 - RNA, 24 nt, Human
caccauguuggucaggcuggucuc

SEQ ID NO: 886762 - RNA, 18 nt, Human
cagcagaacacuucaggc

SEQ ID NO: 886763 - RNA, 20 nt, Human
cagcagaacacuucaggccc

SEQ ID NO: 886764 - RNA, 19 nt, Human
ccaaagaagcugaccccau

SEQ ID NO: 886765 - RNA, 19 nt, Human
ccaaagugacagguccaaa

SEQ ID NO: 886766 - RNA, 19 nt, Human
ccaaagugcugggauuaca

SEQ ID NO: 886767 - RNA, 22 nt, Human
ccaaagugcugggauuacaggc

SEQ ID NO: 886768 - RNA, 24 nt, Human
ccaaagugcugggauuacaggccu

SEQ ID NO: 886769 - RNA, 19 nt, Human
ccagcagaacacuucaggc

SEQ ID NO: 886770 - RNA, 22 nt, Human
cccaucuuggccucccaaagug

SEQ ID NO: 886771 - RNA, 20 nt, Human
cccugugcuaggcucugugc

SEQ ID NO: 886772 - RNA, 28 nt, Human
cuagagaaauggucuuauagggcuucuu

SEQ ID NO: 886773 - RNA, 22 nt, Human
cucagcaucauaauuaacaagg

SEQ ID NO: 886774 - RNA, 20 nt, Human
cuccugacuucaugauccgc

SEQ ID NO: 886775 - RNA, 22 nt, Human
cuuccacuguagccacugauag

SEQ ID NO: 886776 - RNA, 27 nt, Human
cuuggcaaggugaaauaaagagacaga

SEQ ID NO: 886777 - RNA, 24 nt, Human
cuuucccucucauuccuuucuuuu

SEQ ID NO: 886778 - RNA, 20 nt, Human
gaagguaacauuccugucag

SEQ ID NO: 886779 - RNA, 19 nt, Human
gacagaggcuuucucagca

SEQ ID NO: 886780 - RNA, 23 nt, Human
gagacgggguuucaccauguugg

SEQ ID NO: 886781 - RNA, 24 nt, Human
gagacgggguuucaccauguuggu

SEQ ID NO: 886782 - RNA, 19 nt, Human
gagcaaaagagucuccuuu

SEQ ID NO: 886783 - RNA, 20 nt, Human
gaggauggagaagagugcag

SEQ ID NO: 886784 - RNA, 20 nt, Human
gauaugcuuguguaacuuag

SEQ ID NO: 886785 - RNA, 18 nt, Human
gauuacaggccugagcca

SEQ ID NO: 886786 - RNA, 23 nt, Human
gauuacaggccugagccaccgca

SEQ ID NO: 886787 - RNA, 23 nt, Human
gauuuguaauauucaucuucccc

SEQ ID NO: 886788 - RNA, 18 nt, Human
gcaagugguucaguaagg

SEQ ID NO: 886789 - RNA, 20 nt, Human
gcccugacucugggggaggu

SEQ ID NO: 886790 - RNA, 18 nt, Human
ggaguuauuugaccagug

SEQ ID NO: 886791 - RNA, 24 nt, Human
ggcuggucucgaacuccugacuuc

SEQ ID NO: 886792 - RNA, 21 nt, Human
gggaggauggagaagagugca

SEQ ID NO: 886793 - RNA, 23 nt, Human
gggguuucaccauguuggucagg

SEQ ID NO: 886794 - RNA, 22 nt, Human
ggguuucaccauguuggucagg

SEQ ID NO: 886795 - RNA, 23 nt, Human
guagagacgggguuucaccaugu

SEQ ID NO: 886796 - RNA, 21 nt, Human
uaagaaaaauauuaagaacau

SEQ ID NO: 886797 - RNA, 23 nt, Human
uacaggccugagccaccgcaccc

SEQ ID NO: 886798 - RNA, 24 nt, Human
uaccaugaauguuccuacucugga

SEQ ID NO: 886799 - RNA, 22 nt, Human
uagagacgggguuucaccaugu

SEQ ID NO: 886800 - RNA, 24 nt, Human
uaguagagacgggguuucaccaug

SEQ ID NO: 886801 - RNA, 25 nt, Human
uaguagagacgggguuucaccaugu

SEQ ID NO: 886802 - RNA, 23 nt, Human
ucaccaaagugacagguccaaac

SEQ ID NO: 886803 - RNA, 20 nt, Human
uccaaacuuucccucucauu

SEQ ID NO: 886804 - RNA, 18 nt, Human
uccaugauuagacugggg

SEQ ID NO: 886805 - RNA, 19 nt, Human
uccauguauucuccauuca

SEQ ID NO: 886806 - RNA, 24 nt, Human
ucccaaagugcugggauuacaggc

SEQ ID NO: 886807 - RNA, 19 nt, Human
uccugggucuccacugggg

SEQ ID NO: 886808 - RNA, 18 nt, Human
ucuagagaaauggucuua

SEQ ID NO: 886809 - RNA, 21 nt, Human
ucucgaacuccugacuucaug

SEQ ID NO: 886810 - RNA, 20 nt, Human
ucuuccuagacacugggggc

SEQ ID NO: 886811 - RNA, 20 nt, Human
ucuuggccucccaaagugcu

SEQ ID NO: 886812 - RNA, 25 nt, Human
ugaaaaguaacuugauaggaaaaau

SEQ ID NO: 886813 - RNA, 19 nt, Human
ugaagaaaaaaaggaaggg

SEQ ID NO: 886814 - RNA, 21 nt, Human
ugaagaaaaaaaggaagggug

SEQ ID NO: 886815 - RNA, 18 nt, Human
ugagaaaggaaggcagcg

SEQ ID NO: 886816 - RNA, 24 nt, Human
ugauccgcccaucuuggccuccca

SEQ ID NO: 886817 - RNA, 18 nt, Human
ugauuacaucacacugca

SEQ ID NO: 886818 - RNA, 18 nt, Human
ugcacaacacauguggga

SEQ ID NO: 886819 - RNA, 25 nt, Human
ugcaggaaaggaacuccugggucuc

SEQ ID NO: 886820 - RNA, 20 nt, Human
ugccuuguagaaagaaucug

SEQ ID NO: 886821 - RNA, 21 nt, Human
ugccuuguagaaagaaucuga

SEQ ID NO: 886822 - RNA, 18 nt, Human
ugggauuacaggccugag

SEQ ID NO: 886823 - RNA, 19 nt, Human
ugggauuacaggccugagc

SEQ ID NO: 886824 - RNA, 21 nt, Human
ugggauuacaggccugagcca

SEQ ID NO: 886825 - RNA, 22 nt, Human
ugggauuacaggccugagccac

SEQ ID NO: 886826 - RNA, 23 nt, Human
ugggauuacaggccugagccacc

SEQ ID NO: 886827 - RNA, 24 nt, Human
ugggauuacaggccugagccaccg

SEQ ID NO: 886828 - RNA, 24 nt, Human
uggucaggcuggucucgaacuccu

SEQ ID NO: 886829 - RNA, 19 nt, Human
uguaauauucaucuucccc

SEQ ID NO: 886830 - RNA, 23 nt, Human
uguagaaagaaucugaaagauuu

SEQ ID NO: 886831 - RNA, 18 nt, Human
uuaguagagacgggguuu

SEQ ID NO: 886832 - RNA, 22 nt, Human
uuaguagagacgggguuucacc

SEQ ID NO: 886833 - RNA, 24 nt, Human
uuaguagagacgggguuucaccau

SEQ ID NO: 886834 - RNA, 24 nt, Human
uuucaccauguuggucaggcuggu

SEQ ID NO: 886835 - RNA, 24 nt, Human
uuuuuaguagagacgggguuucac

SEQ ID NO: 886836 - RNA, 23 nt, Human
uuuuuuaguagagacgggguuuc

SEQ ID NO: 886837 - RNA, 24 nt, Human
aaaaaaaaaaaaaaauuuagaagg

SEQ ID NO: 886838 - RNA, 18 nt, Human
aaaauuagcugggcgugg

SEQ ID NO: 886839 - RNA, 19 nt, Human
aaacagaaggugcaauugg

SEQ ID NO: 886840 - RNA, 21 nt, Human
aaacggcauggcaauuaagcu

SEQ ID NO: 886841 - RNA, 19 nt, Human
aacauggugaaaccugucu

SEQ ID NO: 886842 - RNA, 20 nt, Human
aacauggugaaaccugucuc

SEQ ID NO: 886843 - RNA, 20 nt, Human
aagagaacuuuuggcagguc

SEQ ID NO: 886844 - RNA, 24 nt, Human
aagcggagguugcaauaagccgag

SEQ ID NO: 886845 - RNA, 18 nt, Human
aaucacagcugucaccug

SEQ ID NO: 886846 - RNA, 23 nt, Human
aauguauugaaaugaacuaaacu

SEQ ID NO: 886847 - RNA, 24 nt, Human
aauuguuugaacccaggaagcgga

SEQ ID NO: 886848 - RNA, 23 nt, Human
accagucuguauuauagaaucac

SEQ ID NO: 886849 - RNA, 23 nt, Human
acuacacuccagccuggcgauag

SEQ ID NO: 886850 - RNA, 25 nt, Human
acuacacuccagccuggcgauagag

SEQ ID NO: 886851 - RNA, 19 nt, Human
agaaaacuuggaagccacu

SEQ ID NO: 886852 - RNA, 22 nt, Human
agaauuguuugaacccaggaag

SEQ ID NO: 886853 - RNA, 24 nt, Human
agcacuuugggaggcugagguggg

SEQ ID NO: 886854 - RNA, 23 nt, Human
agccaggcgcgguggcacacgcc

SEQ ID NO: 886855 - RNA, 23 nt, Human
agcccugccacaagacagaacag

SEQ ID NO: 886856 - RNA, 21 nt, Human
agccuggcgauagagcgagac

SEQ ID NO: 886857 - RNA, 23 nt, Human
agccuggcgauagagcgagacuc

SEQ ID NO: 886858 - RNA, 23 nt, Human
agcugggcgugguggcaggugcc

SEQ ID NO: 886859 - RNA, 23 nt, Human
aggcaggagaauuguuugaaccc

SEQ ID NO: 886860 - RNA, 24 nt, Human
aggcaggagaauuguuugaaccca

SEQ ID NO: 886861 - RNA, 24 nt, Human
aggcgcgguggcacacgccuguaa

SEQ ID NO: 886862 - RNA, 21 nt, Human
aggcugaggcaggagaauugu

SEQ ID NO: 886863 - RNA, 24 nt, Human
aggcugaggcaggagaauuguuug

SEQ ID NO: 886864 - RNA, 22 nt, Human
aggcugaggugggcggaucacg

SEQ ID NO: 886865 - RNA, 24 nt, Human
aggugggcggaucacgaggucaag

SEQ ID NO: 886866 - RNA, 27 nt, Human
auagagcgagacuccggagucucaaaa

SEQ ID NO: 886867 - RNA, 24 nt, Human
aucaugccacuacacuccagccug

SEQ ID NO: 886868 - RNA, 21 nt, Human
auccuggccaacauggugaaa

SEQ ID NO: 886869 - RNA, 22 nt, Human
augccacuacacuccagccugg

SEQ ID NO: 886870 - RNA, 22 nt, Human
cacaagacagaacagaucaaga

SEQ ID NO: 886871 - RNA, 21 nt, Human
caccagucuguauuauagaau

SEQ ID NO: 886872 - RNA, 22 nt, Human
caccugugacugucagaaacag

SEQ ID NO: 886873 - RNA, 20 nt, Human
cacgccuguaauccuagcac

SEQ ID NO: 886874 - RNA, 22 nt, Human
cacgccuguaauccuagcacuu

SEQ ID NO: 886875 - RNA, 24 nt, Human
cacgccuguaauccuagcacuuug

SEQ ID NO: 886876 - RNA, 23 nt, Human
cacuacacuccagccuggcgaua

SEQ ID NO: 886877 - RNA, 22 nt, Human
cacuccagccuggcgauagagc

SEQ ID NO: 886878 - RNA, 23 nt, Human
cacuccagccuggcgauagagcg

SEQ ID NO: 886879 - RNA, 19 nt, Human
cagaacagaucaagaggca

SEQ ID NO: 886880 - RNA, 19 nt, Human
cagcaggcauggggcaaga

SEQ ID NO: 886881 - RNA, 24 nt, Human
cagcuacucaggaggcugaggcag

SEQ ID NO: 886882 - RNA, 20 nt, Human
cagcuuuguaaauguacuca

SEQ ID NO: 886883 - RNA, 20 nt, Human
cagggcauuuucaguaaaaa

SEQ ID NO: 886884 - RNA, 19 nt, Human
ccacuacacuccagccugg

SEQ ID NO: 886885 - RNA, 20 nt, Human
ccacuacacuccagccuggc

SEQ ID NO: 886886 - RNA, 22 nt, Human
ccacuacacuccagccuggcga

SEQ ID NO: 886887 - RNA, 23 nt, Human
ccacuacacuccagccuggcgau

SEQ ID NO: 886888 - RNA, 28 nt, Human
cccauaaaacuugggaaacggcggaccg

SEQ ID NO: 886889 - RNA, 21 nt, Human
ccuggccaacauggugaaacc

SEQ ID NO: 886890 - RNA, 21 nt, Human
ccuggccaacauggugaaacc

SEQ ID NO: 886891 - RNA, 23 nt, Human
ccuggccaacauggugaaaccug

SEQ ID NO: 886892 - RNA, 22 nt, Human
ccuguaauccuagcacuuuggg

SEQ ID NO: 886893 - RNA, 21 nt, Human
ccuguagucccagcuacucag

SEQ ID NO: 886894 - RNA, 22 nt, Human
ccuguagucccagcuacucagg

SEQ ID NO: 886895 - RNA, 24 nt, Human
cgagaucaugccacuacacuccag

SEQ ID NO: 886896 - RNA, 24 nt, Human
cgaggccauccuggccaacauggu

SEQ ID NO: 886897 - RNA, 18 nt, Human
cgccuguaauccuagcac

SEQ ID NO: 886898 - RNA, 24 nt, Human
cuccagccuggcgauagagcgaga

SEQ ID NO: 886899 - RNA, 18 nt, Human
cugucaccugugacuguc

SEQ ID NO: 886900 - RNA, 24 nt, Human
cuucauaaucauguauuauuccua

SEQ ID NO: 886901 - RNA, 21 nt, Human
gacagaauagcacuggaucca

SEQ ID NO: 886902 - RNA, 20 nt, Human
gagcaaaagucuguuuucuu

SEQ ID NO: 886903 - RNA, 24 nt, Human
gagcagcauugucacugugaguga

SEQ ID NO: 886904 - RNA, 22 nt, Human
gagugagagaugauguggucca

SEQ ID NO: 886905 - RNA, 18 nt, Human
gcacuggauccacaggcc

SEQ ID NO: 886906 - RNA, 22 nt, Human
gcaggagaauuguuugaaccca

SEQ ID NO: 886907 - RNA, 19 nt, Human
gccaacauggugaaaccug

SEQ ID NO: 886908 - RNA, 20 nt, Human
gccgagaucaugccacuaca

SEQ ID NO: 886909 - RNA, 22 nt, Human
ggaagacucagcacuagaaucc

SEQ ID NO: 886910 - RNA, 24 nt, Human
ggagguugcaauaagccgagauca

SEQ ID NO: 886911 - RNA, 24 nt, Human
ggccaacauggugaaaccugucuc

SEQ ID NO: 886912 - RNA, 20 nt, Human
gggaggcugaggugggcgga

SEQ ID NO: 886913 - RNA, 19 nt, Human
gggcggaucacgaggucaa

SEQ ID NO: 886914 - RNA, 21 nt, Human
gguggcacacgccuguaaucc

SEQ ID NO: 886915 - RNA, 24 nt, Human
gguggcacacgccuguaauccuag

SEQ ID NO: 886916 - RNA, 19 nt, Human
guccccagcaggcaugggg

SEQ ID NO: 886917 - RNA, 24 nt, Human
gugagugagagaugauguggucca

SEQ ID NO: 886918 - RNA, 18 nt, Human
gugugaauucuuacaaaa

SEQ ID NO: 886919 - RNA, 18 nt, Human
guugcaauaagccgagau

SEQ ID NO: 886920 - RNA, 19 nt, Human
uaagacaccagucuguauu

SEQ ID NO: 886921 - RNA, 19 nt, Human
uagaaucacagcugucacc

SEQ ID NO: 886922 - RNA, 22 nt, Human
uagagcccugccacaagacaga

SEQ ID NO: 886923 - RNA, 20 nt, Human
uagagcgagacuccggaguc

SEQ ID NO: 886924 - RNA, 21 nt, Human
uagagcgagacuccggagucu

SEQ ID NO: 886925 - RNA, 24 nt, Human
uagcacuuugggaggcugaggugg

SEQ ID NO: 886926 - RNA, 20 nt, Human
uagguuggugacagaauagc

SEQ ID NO: 886927 - RNA, 19 nt, Human
uaugagcccuccaggaauu

SEQ ID NO: 886928 - RNA, 24 nt, Human
ucacgaggucaagagaucgaggcc

SEQ ID NO: 886929 - RNA, 18 nt, Human
ucagaaacagaaggugca

SEQ ID NO: 886930 - RNA, 23 nt, Human
ucagccaggcgcgguggcacacg

SEQ ID NO: 886931 - RNA, 19 nt, Human
ucauguauuauuccuaccu

SEQ ID NO: 886932 - RNA, 22 nt, Human
uccagccuggcgauagagcgag

SEQ ID NO: 886933 - RNA, 26 nt, Human
uccggagucucaaaaaaaaaaaaaaa

SEQ ID NO: 886934 - RNA, 18 nt, Human
ucucaaaaaaaaaaaaaa

SEQ ID NO: 886935 - RNA, 21 nt, Human
ugaaaccugucuccacuaaaa

SEQ ID NO: 886936 - RNA, 19 nt, Human
ugaaaggaaggaaugagaa

SEQ ID NO: 886937 - RNA, 19 nt, Human
ugagcccuccaggaauuuc

SEQ ID NO: 886938 - RNA, 24 nt, Human
ugaggcaggagaauuguuugaacc

SEQ ID NO: 886939 - RNA, 25 nt, Human
ugaggcaggagaauuguuugaaccc

SEQ ID NO: 886940 - RNA, 20 nt, Human
ugaggugggcggaucacgag

SEQ ID NO: 886941 - RNA, 21 nt, Human
ugaggugggcggaucacgagg

SEQ ID NO: 886942 - RNA, 24 nt, Human
ugaggugggcggaucacgagguca

SEQ ID NO: 886943 - RNA, 23 nt, Human
ugaggugggcggaucacgagguu

SEQ ID NO: 886944 - RNA, 22 nt, Human
ugcaauaagccgagaucaugcc

SEQ ID NO: 886945 - RNA, 23 nt, Human
ugccacaagacagaacagaucaa

SEQ ID NO: 886946 - RNA, 24 nt, Human
ugccuguagucccagcuacucagg

SEQ ID NO: 886947 - RNA, 19 nt, Human
uggaagccacugugucccc

SEQ ID NO: 886948 - RNA, 19 nt, Human
uggcacacgccuguaaucc

SEQ ID NO: 886949 - RNA, 21 nt, Human
uggcacacgccuguaauccua

SEQ ID NO: 886950 - RNA, 24 nt, Human
uggcacacgccuguaauccuagca

SEQ ID NO: 886951 - RNA, 19 nt, Human
uggcaggucacgguggcca

SEQ ID NO: 886952 - RNA, 22 nt, Human
uggcaggucacgguggccaaac

SEQ ID NO: 886953 - RNA, 23 nt, Human
uggccaacauggugaaaccuguc

SEQ ID NO: 886954 - RNA, 18 nt, Human
ugggaggcugaggugggc

SEQ ID NO: 886955 - RNA, 19 nt, Human
ugggaggcugaggugggcg

SEQ ID NO: 886956 - RNA, 24 nt, Human
ugggaggcugaggugggcggauca

SEQ ID NO: 886957 - RNA, 24 nt, Human
uggugaauauguuggcagguaaga

SEQ ID NO: 886958 - RNA, 24 nt, Human
ugguggcaggugccuguaguccca

SEQ ID NO: 886959 - RNA, 21 nt, Human
ugucagaaacagaaggugcaa

SEQ ID NO: 886960 - RNA, 24 nt, Human
uuagcugggcgugguggcaggugc

SEQ ID NO: 886961 - RNA, 19 nt, Human
uuagguugcuuuuucaauc

SEQ ID NO: 886962 - RNA, 23 nt, Human
uuauguauuagcagggugaugcu

SEQ ID NO: 886963 - RNA, 22 nt, Human
uucaugaaaaccuucugucccc

SEQ ID NO: 886964 - RNA, 25 nt, Human
uugggaggcugaggugggcggauca

SEQ ID NO: 886965 - RNA, 24 nt, Human
uuguuugaacccaggaagcggagg

SEQ ID NO: 886966 - RNA, 21 nt, Human
uuuuaaaugcagggcauuuuc

SEQ ID NO: 886967 - RNA, 20 nt, Human
uuuuuuuuuuuuuuuuuggu

SEQ ID NO: 886968 - RNA, 20 nt, Human
uuuuuuuuuuuuuuuuuugg

SEQ ID NO: 886969 - RNA, 19 nt, Human
aagaggacagacgugaaaa

SEQ ID NO: 886970 - RNA, 23 nt, Human
accaucauucaaugucccuccaa

SEQ ID NO: 886971 - RNA, 20 nt, Human
acccaaaccauucacaccca

SEQ ID NO: 886972 - RNA, 22 nt, Human
agaaauaauagggaggagaagc

SEQ ID NO: 886973 - RNA, 22 nt, Human
agauaaagaaaaacaauuaaag

SEQ ID NO: 886974 - RNA, 20 nt, Human
agggaggagaagcaugaagg

SEQ ID NO: 886975 - RNA, 22 nt, Human
agggaggagaagcaugaaggac

SEQ ID NO: 886976 - RNA, 25 nt, Human
caaauuuucuuucucuucuccagac

SEQ ID NO: 886977 - RNA, 24 nt, Human
caagccacgagggcccgucgaaaa

SEQ ID NO: 886978 - RNA, 19 nt, Human
cagacaguaggcugugcuu

SEQ ID NO: 886979 - RNA, 23 nt, Human
cagcugcagcaaaucccaauucc

SEQ ID NO: 886980 - RNA, 22 nt, Human
ccaaaccauucacacccaaguc

SEQ ID NO: 886981 - RNA, 24 nt, Human
ccaacuucauucaagucuucuccu

SEQ ID NO: 886982 - RNA, 25 nt, Human
ccaauuccgccccacgacacauucg

SEQ ID NO: 886983 - RNA, 22 nt, Human
ccucuguaacaacacacgagac

SEQ ID NO: 886984 - RNA, 23 nt, Human
cgaaaagcacaucaccucuguaa

SEQ ID NO: 886985 - RNA, 24 nt, Human
cucauccuuaacccaaaccauuca

SEQ ID NO: 886986 - RNA, 21 nt, Human
cuuucucuucuccagacagua

SEQ ID NO: 886987 - RNA, 20 nt, Human
gaccugacauuauuucccuc

SEQ ID NO: 886988 - RNA, 20 nt, Human
gggcaaauuuucuuucucuu

SEQ ID NO: 886989 - RNA, 23 nt, Human
uaacaacacacgagacacggcca

SEQ ID NO: 886990 - RNA, 20 nt, Human
uaacccaaaccauucacacc

SEQ ID NO: 886991 - RNA, 21 nt, Human
uaacccaaaccauucacaccc

SEQ ID NO: 886992 - RNA, 23 nt, Human
uaacccaaaccauucacacccaa

SEQ ID NO: 886993 - RNA, 18 nt, Human
ucaagccagaaauaauag

SEQ ID NO: 886994 - RNA, 18 nt, Human
ucacacccaagucacaca

SEQ ID NO: 886995 - RNA, 26 nt, Human
ucacacccaagucacacaggccggcu

SEQ ID NO: 886996 - RNA, 23 nt, Human
ucccuccaacuucauucaagucu

SEQ ID NO: 886997 - RNA, 21 nt, Human
uccuuaacccaaaccauucac

SEQ ID NO: 886998 - RNA, 23 nt, Human
ucuuugguuuggggcucaacuug

SEQ ID NO: 886999 - RNA, 25 nt, Human
ugaaggacgucucauccuuaaccca

SEQ ID NO: 887000 - RNA, 22 nt, Human
ugaauaaucaucuaacagcaga

SEQ ID NO: 887001 - RNA, 18 nt, Human
ugguuuggggcucaacuu

SEQ ID NO: 887002 - RNA, 19 nt, Human
uucgucugcccucugacca

SEQ ID NO: 887003 - RNA, 24 nt, Human
uuuuuuuuuuuuuuuuuuuucggg

SEQ ID NO: 887004 - RNA, 19 nt, Human
aaaacagguaaacaccaaa

SEQ ID NO: 887005 - RNA, 18 nt, Human
aaacagguaaacaccaaa

SEQ ID NO: 887006 - RNA, 19 nt, Human
aaacagguaaacaccaaaa

SEQ ID NO: 887007 - RNA, 22 nt, Human
aaagcauguacuccccaguuac

SEQ ID NO: 887008 - RNA, 22 nt, Human
aaauggcaugaugggagccuca

SEQ ID NO: 887009 - RNA, 19 nt, Human
aacaagucuagaugaugau

SEQ ID NO: 887010 - RNA, 23 nt, Human
aagcugccaauucaaauuacuua

SEQ ID NO: 887011 - RNA, 26 nt, Human
aaggacacaccaaccauuuucucccc

SEQ ID NO: 887012 - RNA, 19 nt, Human
aggaauugauacugauuuc

SEQ ID NO: 887013 - RNA, 22 nt, Human
auggauggcacuugggccugau

SEQ ID NO: 887014 - RNA, 19 nt, Human
auggcacuugggccugaug

SEQ ID NO: 887015 - RNA, 18 nt, Human
cacagcauugggauuugu

SEQ ID NO: 887016 - RNA, 23 nt, Human
cacaguccuucuuccuaucuccu

SEQ ID NO: 887017 - RNA, 24 nt, Human
caccaacuuccacacuacaaacac

SEQ ID NO: 887018 - RNA, 20 nt, Human
caccagaaaggacacaccaa

SEQ ID NO: 887019 - RNA, 23 nt, Human
cacuugaaaaacuuacacuguaa

SEQ ID NO: 887020 - RNA, 21 nt, Human
cauauuauuuucucaugguca

SEQ ID NO: 887021 - RNA, 20 nt, Human
cauccagaauaaauuaccua

SEQ ID NO: 887022 - RNA, 22 nt, Human
cauugggauuugugaaacuuga

SEQ ID NO: 887023 - RNA, 19 nt, Human
ccuugcuguuagauugugc

SEQ ID NO: 887024 - RNA, 26 nt, Human
cuccuugacuuaaugcuaaaugaaua

SEQ ID NO: 887025 - RNA, 21 nt, Human
cuuccacacuacaaacacaga

SEQ ID NO: 887026 - RNA, 23 nt, Human
cuugacuuaaugcuaaaugaaua

SEQ ID NO: 887027 - RNA, 19 nt, Human
ggagauggacuauggaugg

SEQ ID NO: 887028 - RNA, 23 nt, Human
guaaacaccaaaacuuauaaaua

SEQ ID NO: 887029 - RNA, 21 nt, Human
gugaaaacaaaauuaugaaug

SEQ ID NO: 887030 - RNA, 18 nt, Human
gugaagcugucaauuacc

SEQ ID NO: 887031 - RNA, 23 nt, Human
uaaacaucuaucacagaagucuu

SEQ ID NO: 887032 - RNA, 21 nt, Human
uaacaagucuagaugaugauu

SEQ ID NO: 887033 - RNA, 19 nt, Human
uaacugaauugaaauggga

SEQ ID NO: 887034 - RNA, 23 nt, Human
uaacugaauugaauuuuggagaa

SEQ ID NO: 887035 - RNA, 26 nt, Human
uaguuuaucacagaugccaacauuau

SEQ ID NO: 887036 - RNA, 24 nt, Human
uauacaaauucucuacaauaauau

SEQ ID NO: 887037 - RNA, 19 nt, Human
uaucuccuaaacuuuaucu

SEQ ID NO: 887038 - RNA, 23 nt, Human
ucaaaacauauugaaaagugcaa

SEQ ID NO: 887039 - RNA, 19 nt, Human
uccacacuacaaacacaga

SEQ ID NO: 887040 - RNA, 25 nt, Human
ucucugcuauaaacaucuaucacag

SEQ ID NO: 887041 - RNA, 27 nt, Human
ucugcuauaaacaucuaucacagaagu

SEQ ID NO: 887042 - RNA, 18 nt, Human
ucugggcacaccuugguc

SEQ ID NO: 887043 - RNA, 22 nt, Human
ugaaaaacuuacacuguaauaa

SEQ ID NO: 887044 - RNA, 23 nt, Human
ugaaaaaugcaagugcuuugcca

SEQ ID NO: 887045 - RNA, 24 nt, Human
ugaauucugggcacaccuuggucc

SEQ ID NO: 887046 - RNA, 24 nt, Human
ugaugggagccucauugauaguuu

SEQ ID NO: 887047 - RNA, 18 nt, Human
ugauucuagauuccacuu

SEQ ID NO: 887048 - RNA, 19 nt, Human
uggauucuuuaaaccaggu

SEQ ID NO: 887049 - RNA, 19 nt, Human
uggcaugaugggagccuca

SEQ ID NO: 887050 - RNA, 20 nt, Human
uggcaugaugggagccucau

SEQ ID NO: 887051 - RNA, 20 nt, Human
ugucagaaaaggaaaaucac

SEQ ID NO: 887052 - RNA, 20 nt, Human
ugucauaugcuucuucaauu

SEQ ID NO: 887053 - RNA, 23 nt, Human
uuaaaacagguaaacaccaaaac

SEQ ID NO: 887054 - RNA, 19 nt, Human
uuagaauucuaagagugac

SEQ ID NO: 887055 - RNA, 18 nt, Human
uucaugcccuuuguuuuu

SEQ ID NO: 887056 - RNA, 21 nt, Human
uuccacacuacaaacacagau

SEQ ID NO: 887057 - RNA, 21 nt, Human
uugaaaaacuuacacuguaau

SEQ ID NO: 887058 - RNA, 23 nt, Human
uugaaugucagaaaaggaaaauc

SEQ ID NO: 887059 - RNA, 18 nt, Human
uuuaucugauaguuuucc

SEQ ID NO: 887060 - RNA, 18 nt, Human
uuuguaaacauguaaugu

SEQ ID NO: 887061 - RNA, 24 nt, Human
uuuguaaacauguaauguugcaac

SEQ ID NO: 887062 - RNA, 24 nt, Human
uuuuucagcggggaugaaucccag

SEQ ID NO: 887063 - RNA, 24 nt, Human
uuuuuuuuuuuuuuuuuuaauaug

SEQ ID NO: 887064 - RNA, 22 nt, Human
aacuuggugaccucugaagcca

SEQ ID NO: 887065 - RNA, 19 nt, Human
acccucaagauuaacaccu

SEQ ID NO: 887066 - RNA, 24 nt, Human
augggaccucaauaggcaggaggg

SEQ ID NO: 887067 - RNA, 23 nt, Human
caccucugucgggaagcugagag

SEQ ID NO: 887068 - RNA, 18 nt, Human
caggcccccgagacuggg

SEQ ID NO: 887069 - RNA, 19 nt, Human
caggcccccgagacugggg

SEQ ID NO: 887070 - RNA, 21 nt, Human
gaccucugaagccauuugcaa

SEQ ID NO: 887071 - RNA, 22 nt, Human
ggauguuaccaggcccccgagg

SEQ ID NO: 887072 - RNA, 18 nt, Human
uaggcaggagggaaucuu

SEQ ID NO: 887073 - RNA, 20 nt, Human
uccacaagucuuggcuccgg

SEQ ID NO: 887074 - RNA, 20 nt, Human
ugaaggcccuucuucaacug

SEQ ID NO: 887075 - RNA, 24 nt, Human
ugaagugcuguccacaagucuugg

SEQ ID NO: 887076 - RNA, 26 nt, Human
uucuucaacugugaagugcuguccac

SEQ ID NO: 887077 - RNA, 22 nt, Human
aaagaaucacagaauauugaaa

SEQ ID NO: 887078 - RNA, 23 nt, Human
acuacugaggauccagagaaggg

SEQ ID NO: 887079 - RNA, 20 nt, Human
agccugaagcaaguccgcga

SEQ ID NO: 887080 - RNA, 20 nt, Human
augugugaguaugugugugu

SEQ ID NO: 887081 - RNA, 20 nt, Human
caagacgggggguggccagc

SEQ ID NO: 887082 - RNA, 18 nt, Human
caccgcgccucaguacgc

SEQ ID NO: 887083 - RNA, 22 nt, Human
caugugugaguaugugugugua

SEQ ID NO: 887084 - RNA, 21 nt, Human
ccaccgcgccucaguacgccc

SEQ ID NO: 887085 - RNA, 19 nt, Human
cccagggcaccugccgcaa

SEQ ID NO: 887086 - RNA, 21 nt, Human
cgcccagggcaccugccgcaa

SEQ ID NO: 887087 - RNA, 24 nt, Human
cucaacacagaugaugaaacaaga

SEQ ID NO: 887088 - RNA, 20 nt, Human
gugcauuuuuaaagggagaa

SEQ ID NO: 887089 - RNA, 23 nt, Human
gugugcaugugugaguaugugug

SEQ ID NO: 887090 - RNA, 22 nt, Human
uagacuaaagaaucacagaaua

SEQ ID NO: 887091 - RNA, 19 nt, Human
ucucagacagagcuuagcu

SEQ ID NO: 887092 - RNA, 19 nt, Human
ugaaacaagacggggggug

SEQ ID NO: 887093 - RNA, 21 nt, Human
ugcauuuuuaaagggagaaaa

SEQ ID NO: 887094 - RNA, 27 nt, Human
ugggaagaacuacugaggauccagaga

SEQ ID NO: 887095 - RNA, 26 nt, Human
ugugcaugugugaguaugugugugua

SEQ ID NO: 887096 - RNA, 22 nt, Human
ugugcaugugugagugugcaug

SEQ ID NO: 887097 - RNA, 22 nt, Human
ugugggaagaacuacugaggau

SEQ ID NO: 887098 - RNA, 24 nt, Human
ugugugaguauguguguguauaaa

SEQ ID NO: 887099 - RNA, 20 nt, Human
ugugugagugugcaugugug

SEQ ID NO: 887100 - RNA, 18 nt, Human
uguguguauacaagugca

SEQ ID NO: 887101 - RNA, 20 nt, Human
uguguguauacaagugcauu

SEQ ID NO: 887102 - RNA, 23 nt, Human
uguguguguauacaagugcauuu

SEQ ID NO: 887103 - RNA, 23 nt, Human
agaacugacuuuauuaaaaaaau

SEQ ID NO: 887104 - RNA, 22 nt, Human
agccaggaggcucagguccggc

SEQ ID NO: 887105 - RNA, 20 nt, Human
aggcucagguccggcagcag

SEQ ID NO: 887106 - RNA, 22 nt, Human
guccggcagcaggggccaggcu

SEQ ID NO: 887107 - RNA, 19 nt, Human
ugggagccaggaggcucag

SEQ ID NO: 887108 - RNA, 18 nt, Human
aaacaaaaggaacccaaa

SEQ ID NO: 887109 - RNA, 25 nt, Human
aaacagaaaacgcacuuucuucagc

SEQ ID NO: 887110 - RNA, 19 nt, Human
aaacccgcccgcggccacc

SEQ ID NO: 887111 - RNA, 19 nt, Human
aaagaaaaccaaaaugucu

SEQ ID NO: 887112 - RNA, 19 nt, Human
aacccaaaauggaaaaaga

SEQ ID NO: 887113 - RNA, 19 nt, Human
aagaugccacucacaccac

SEQ ID NO: 887114 - RNA, 19 nt, Human
aaucaugaaauuuacaugg

SEQ ID NO: 887115 - RNA, 21 nt, Human
acaaaauuaaauaauuuacag

SEQ ID NO: 887116 - RNA, 24 nt, Human
acacgcaaacgcgacacgagaaac

SEQ ID NO: 887117 - RNA, 21 nt, Human
acagaaaacgcacuuucuuca

SEQ ID NO: 887118 - RNA, 25 nt, Human
acagauagggccaccacggccccaa

SEQ ID NO: 887119 - RNA, 19 nt, Human
acagccugugagccuggcg

SEQ ID NO: 887120 - RNA, 21 nt, Human
acauuguguuuuuaacacauu

SEQ ID NO: 887121 - RNA, 19 nt, Human
acccggagaauguggcagu

SEQ ID NO: 887122 - RNA, 24 nt, Human
accgcaagagccgacacgcaaacg

SEQ ID NO: 887123 - RNA, 22 nt, Human
accgggccccaaacgggaaguc

SEQ ID NO: 887124 - RNA, 19 nt, Human
acgcaaacgcgacacgaga

SEQ ID NO: 887125 - RNA, 24 nt, Human
acgguguggugggcugggacacuu

SEQ ID NO: 887126 - RNA, 21 nt, Human
acuccaccgcaagagccgaca

SEQ ID NO: 887127 - RNA, 23 nt, Human
agaacagagcuuuguuccacccu

SEQ ID NO: 887128 - RNA, 24 nt, Human
agaagccagaguggucccuagacg

SEQ ID NO: 887129 - RNA, 23 nt, Human
agccgacacgcaaacgcgacacg

SEQ ID NO: 887130 - RNA, 20 nt, Human
aggagggucacaguauugga

SEQ ID NO: 887131 - RNA, 18 nt, Human
agggagccucgugggagc

SEQ ID NO: 887132 - RNA, 20 nt, Human
agggagcugugacccaaggc

SEQ ID NO: 887133 - RNA, 21 nt, Human
agggagcugugacccaaggcc

SEQ ID NO: 887134 - RNA, 23 nt, Human
agggugcccugguguggggucua

SEQ ID NO: 887135 - RNA, 23 nt, Human
aucacccugcaaacacaccacgg

SEQ ID NO: 887136 - RNA, 19 nt, Human
augaugucauugccaccuc

SEQ ID NO: 887137 - RNA, 20 nt, Human
cacacagauagggccaccac

SEQ ID NO: 887138 - RNA, 23 nt, Human
cacagccucagcgccagcugccc

SEQ ID NO: 887139 - RNA, 21 nt, Human
cacagcuauugucuguccucu

SEQ ID NO: 887140 - RNA, 25 nt, Human
caccacccacccaccacgcucacgg

SEQ ID NO: 887141 - RNA, 24 nt, Human
caccacgcucacggcuacccuccc

SEQ ID NO: 887142 - RNA, 19 nt, Human
caccacggccccaagccug

SEQ ID NO: 887143 - RNA, 21 nt, Human
cacccacccaccacgcucacg

SEQ ID NO: 887144 - RNA, 26 nt, Human
cacccugcaaacacaccacggagugc

SEQ ID NO: 887145 - RNA, 19 nt, Human
caccucggaacucauuuuc

SEQ ID NO: 887146 - RNA, 19 nt, Human
caccucugauuuaacagcu

SEQ ID NO: 887147 - RNA, 22 nt, Human
cacggugcggggcagggcgagg

SEQ ID NO: 887148 - RNA, 22 nt, Human
cagaguggucccuagacgugga

SEQ ID NO: 887149 - RNA, 26 nt, Human
cagcaacaggacuccaccgcaagagc

SEQ ID NO: 887150 - RNA, 25 nt, Human
caggagucucccagguuaaaauucc

SEQ ID NO: 887151 - RNA, 19 nt, Human
cauuagaccaagggaaaac

SEQ ID NO: 887152 - RNA, 24 nt, Human
cauugccaccuccgucaccaugga

SEQ ID NO: 887153 - RNA, 21 nt, Human
ccaaaauggaaaaagaaaacc

SEQ ID NO: 887154 - RNA, 21 nt, Human
ccaagcacacacaucugcgcu

SEQ ID NO: 887155 - RNA, 18 nt, Human
ccacaccgggccccaaac

SEQ ID NO: 887156 - RNA, 25 nt, Human
ccacccaccacgcucacggcuaccc

SEQ ID NO: 887157 - RNA, 21 nt, Human
ccacccacccaccacgcucac

SEQ ID NO: 887158 - RNA, 19 nt, Human
ccacucacaccacccaccc

SEQ ID NO: 887159 - RNA, 22 nt, Human
ccacucacaccacccacccacc

SEQ ID NO: 887160 - RNA, 24 nt, Human
ccagccaucccuuuggauaaaccc

SEQ ID NO: 887161 - RNA, 22 nt, Human
ccaggccaagaugccacucaca

SEQ ID NO: 887162 - RNA, 22 nt, Human
ccccuuagugugcgaacuccua

SEQ ID NO: 887163 - RNA, 18 nt, Human
cccgcccgcggccacacc

SEQ ID NO: 887164 - RNA, 24 nt, Human
cccgcggccacaccgggccccaaa

SEQ ID NO: 887165 - RNA, 21 nt, Human
cccuagacguggaucccagac

SEQ ID NO: 887166 - RNA, 20 nt, Human
ccucagcgccagcugccccc

SEQ ID NO: 887167 - RNA, 25 nt, Human
ccucugggaggccuauuccuaacuu

SEQ ID NO: 887168 - RNA, 18 nt, Human
ccugcaaacacaccacgg

SEQ ID NO: 887169 - RNA, 20 nt, Human
ccugcagcugcuggccuugc

SEQ ID NO: 887170 - RNA, 23 nt, Human
ccugcagcugcuggccuugccuc

SEQ ID NO: 887171 - RNA, 20 nt, Human
cgagaaacacgcccaagcac

SEQ ID NO: 887172 - RNA, 23 nt, Human
cgcgacacgagaaacacgcccaa

SEQ ID NO: 887173 - RNA, 22 nt, Human
cguggaucccagacccaggguc

SEQ ID NO: 887174 - RNA, 18 nt, Human
cucacaccacccacccac

SEQ ID NO: 887175 - RNA, 20 nt, Human
cucauuuucuuuccccacag

SEQ ID NO: 887176 - RNA, 21 nt, Human
cuccaaaacuucccugagaac

SEQ ID NO: 887177 - RNA, 21 nt, Human
cugcagccccaguagggagcu

SEQ ID NO: 887178 - RNA, 19 nt, Human
cugggacacuucuggguac

SEQ ID NO: 887179 - RNA, 22 nt, Human
cuugcagugucugcccaggugu

SEQ ID NO: 887180 - RNA, 27 nt, Human
gaaaacgcacuuucuucagcggcccuc

SEQ ID NO: 887181 - RNA, 22 nt, Human
gacacuucuggguaccacacgg

SEQ ID NO: 887182 - RNA, 23 nt, Human
gaccaagggaaaacaaaaucccc

SEQ ID NO: 887183 - RNA, 22 nt, Human
gagccuggcggugacucgaggc

SEQ ID NO: 887184 - RNA, 21 nt, Human
gcaauuucucuauuuuuaaau

SEQ ID NO: 887185 - RNA, 22 nt, Human
gcccugguguggggucuaguug

SEQ ID NO: 887186 - RNA, 19 nt, Human
gcugcagccccaguaggga

SEQ ID NO: 887187 - RNA, 19 nt, Human
gcugcuggccuugccuccg

SEQ ID NO: 887188 - RNA, 21 nt, Human
ggaaaaagaaaaccaaaaugu

SEQ ID NO: 887189 - RNA, 20 nt, Human
ggacggguggcacagccugu

SEQ ID NO: 887190 - RNA, 25 nt, Human
ggagaauguggcagugaugggucgg

SEQ ID NO: 887191 - RNA, 21 nt, Human
ggcagggcgagggagguaaac

SEQ ID NO: 887192 - RNA, 20 nt, Human
ggggaggagagggaaggcag

SEQ ID NO: 887193 - RNA, 21 nt, Human
gggggugcaggguggacuggg

SEQ ID NO: 887194 - RNA, 24 nt, Human
gggucgggggccuggguggaugca

SEQ ID NO: 887195 - RNA, 19 nt, Human
ggguucaacgcgcuuccug

SEQ ID NO: 887196 - RNA, 18 nt, Human
ggugacucgaggcugccu

SEQ ID NO: 887197 - RNA, 22 nt, Human
gguggacugggggaggagaggg

SEQ ID NO: 887198 - RNA, 18 nt, Human
guggaucccagacccagg

SEQ ID NO: 887199 - RNA, 24 nt, Human
guuauaucaagauuuuuuguggcc

SEQ ID NO: 887200 - RNA, 24 nt, Human
uaaaauuaauaaauaaaaauguua

SEQ ID NO: 887201 - RNA, 18 nt, Human
uaaacccgcccgcggcca

SEQ ID NO: 887202 - RNA, 20 nt, Human
uaaacccgcccgcggccaca

SEQ ID NO: 887203 - RNA, 19 nt, Human
uaaacuaacuacuuuuuaa

SEQ ID NO: 887204 - RNA, 22 nt, Human
uaacagcucaccucggaacuca

SEQ ID NO: 887205 - RNA, 23 nt, Human
uaauaaauacagaauuccauuug

SEQ ID NO: 887206 - RNA, 19 nt, Human
uagacguggaucccagacc

SEQ ID NO: 887207 - RNA, 27 nt, Human
uagcagcgguggcacgggcuggcggag

SEQ ID NO: 887208 - RNA, 23 nt, Human
uagggagcugugacccaaggcca

SEQ ID NO: 887209 - RNA, 22 nt, Human
ucaaaauuccucaguuacaaaa

SEQ ID NO: 887210 - RNA, 24 nt, Human
uccaaaacuucccugagaaccuuu

SEQ ID NO: 887211 - RNA, 22 nt, Human
uccacccuuaacacaaaacuga

SEQ ID NO: 887212 - RNA, 23 nt, Human
uccaugagcuuccacuggagacc

SEQ ID NO: 887213 - RNA, 24 nt, Human
ucccagacccagggucuaaaggcu

SEQ ID NO: 887214 - RNA, 19 nt, Human
ucccucuagaacagagcuu

SEQ ID NO: 887215 - RNA, 22 nt, Human
uccgugccugaaacaaaaggaa

SEQ ID NO: 887216 - RNA, 23 nt, Human
uccgugccugaaacaaaaggaac

SEQ ID NO: 887217 - RNA, 30 nt, Human
ucuagaacagagcuuuguuccacccuuaaa

SEQ ID NO: 887218 - RNA, 19 nt, Human
ucuucagcggcccucauug

SEQ ID NO: 887219 - RNA, 19 nt, Human
ucuuuccccacagcuauug

SEQ ID NO: 887220 - RNA, 23 nt, Human
ugaaaccuuuguggucuccuguu

SEQ ID NO: 887221 - RNA, 20 nt, Human
ugacccggagaauguggcag

SEQ ID NO: 887222 - RNA, 20 nt, Human
ugacucgaggcugccugcgg

SEQ ID NO: 887223 - RNA, 20 nt, Human
ugcagugucugcccaggugu

SEQ ID NO: 887224 - RNA, 19 nt, Human
ugccacucacaccacccac

SEQ ID NO: 887225 - RNA, 18 nt, Human
ugccugaaacaaaaggaa

SEQ ID NO: 887226 - RNA, 22 nt, Human
uggaaaaagaaaaccaaaaugu

SEQ ID NO: 887227 - RNA, 19 nt, Human
uggacugggggaggagagg

SEQ ID NO: 887228 - RNA, 22 nt, Human
ugggggaggagagggaaggcag

SEQ ID NO: 887229 - RNA, 18 nt, Human
uggggucuaguugaaaua

SEQ ID NO: 887230 - RNA, 19 nt, Human
uuaacacaaaacugaauua

SEQ ID NO: 887231 - RNA, 23 nt, Human
uuaacagcucaccucggaacuca

SEQ ID NO: 887232 - RNA, 23 nt, Human
uuagcagcgguggcacgggcuuu

SEQ ID NO: 887233 - RNA, 21 nt, Human
uuccaggaagugcaauuucuc

SEQ ID NO: 887234 - RNA, 24 nt, Human
uuccauuugcuguuauccgugccu

SEQ ID NO: 887235 - RNA, 21 nt, Human
uuccccacagcuauugucugu

SEQ ID NO: 887236 - RNA, 23 nt, Human
uucuuucagaaaacaaaaauaaa

SEQ ID NO: 887237 - RNA, 22 nt, Human
uugucuguccucuuucaaaaug

SEQ ID NO: 887238 - RNA, 21 nt, Human
uuugaauucacuuuuuucccc

SEQ ID NO: 887239 - RNA, 20 nt, Human
aaccgcucacaagcgaaaga

SEQ ID NO: 887240 - RNA, 19 nt, Human
agaaaacccuguuccacca

SEQ ID NO: 887241 - RNA, 21 nt, Human
agacgcagaaaagguggcuuu

SEQ ID NO: 887242 - RNA, 18 nt, Human
agaguuucaucacuacag

SEQ ID NO: 887243 - RNA, 26 nt, Human
agcaaaaaacaagaggcauccuuuuu

SEQ ID NO: 887244 - RNA, 24 nt, Human
agcagcuauaaacauuacauggca

SEQ ID NO: 887245 - RNA, 21 nt, Human
agccgcacacaccucguccuu

SEQ ID NO: 887246 - RNA, 19 nt, Human
auacacagacagggaagaa

SEQ ID NO: 887247 - RNA, 23 nt, Human
caaaauacacagacagggaagaa

SEQ ID NO: 887248 - RNA, 21 nt, Human
caagaggcauccuuuuuaagc

SEQ ID NO: 887249 - RNA, 27 nt, Human
cacaaguuugaaaggaugaugagacac

SEQ ID NO: 887250 - RNA, 18 nt, Human
caccuccaucuuacagga

SEQ ID NO: 887251 - RNA, 21 nt, Human
cacgcugugaucccucaaaug

SEQ ID NO: 887252 - RNA, 21 nt, Human
cacugccgucacagccagggg

SEQ ID NO: 887253 - RNA, 21 nt, Human
cagaaauagauauacccccaa

SEQ ID NO: 887254 - RNA, 24 nt, Human
cagaaauagauauacccccaaaug

SEQ ID NO: 887255 - RNA, 19 nt, Human
cagcaaaaaacaagaggca

SEQ ID NO: 887256 - RNA, 28 nt, Human
cagcagcaaaaaacaagaggcauccuaa

SEQ ID NO: 887257 - RNA, 23 nt, Human
cagcgugacuccuggcaggacgc

SEQ ID NO: 887258 - RNA, 18 nt, Human
caggaagucuucucuccu

SEQ ID NO: 887259 - RNA, 23 nt, Human
caggcaacagccgcacacaccuc

SEQ ID NO: 887260 - RNA, 19 nt, Human
caugaccacugccgucaca

SEQ ID NO: 887261 - RNA, 18 nt, Human
cauggaaacguacaaaau

SEQ ID NO: 887262 - RNA, 22 nt, Human
cauuacauggcagaacacuaug

SEQ ID NO: 887263 - RNA, 18 nt, Human
ccacgggaacucgaaccc

SEQ ID NO: 887264 - RNA, 25 nt, Human
ccagcuugugacuguggcaaaguca

SEQ ID NO: 887265 - RNA, 21 nt, Human
cccucacaaugaccacaaccg

SEQ ID NO: 887266 - RNA, 23 nt, Human
ccuccaucuuacaggaagucuuc

SEQ ID NO: 887267 - RNA, 24 nt, Human
ccuguuccaccacaaguuugaaag

SEQ ID NO: 887268 - RNA, 19 nt, Human
ccuuggcuacagccuccuc

SEQ ID NO: 887269 - RNA, 23 nt, Human
cucaugacccgcccucacaauga

SEQ ID NO: 887270 - RNA, 21 nt, Human
cucuuguauggcugguuccac

SEQ ID NO: 887271 - RNA, 19 nt, Human
cugugucuugcauauuugc

SEQ ID NO: 887272 - RNA, 23 nt, Human
cuguuuaucuuguguuuuucuuu

SEQ ID NO: 887273 - RNA, 24 nt, Human
cuuccgccgucgaccaggguuuga

SEQ ID NO: 887274 - RNA, 18 nt, Human
gaaauagauauaccccca

SEQ ID NO: 887275 - RNA, 25 nt, Human
gaugccgcuucuccucgguguccac

SEQ ID NO: 887276 - RNA, 18 nt, Human
gcagaaaagguggcuuuu

SEQ ID NO: 887277 - RNA, 20 nt, Human
uacacuucugugucuugcau

SEQ ID NO: 887278 - RNA, 21 nt, Human
uacaggaagucuucucuccua

SEQ ID NO: 887279 - RNA, 21 nt, Human
uagcuugaaagaugcaaacac

SEQ ID NO: 887280 - RNA, 23 nt, Human
uagcuugaaagaugcaaacacuu

SEQ ID NO: 887281 - RNA, 22 nt, Human
uaggagcagguuccuggggcug

SEQ ID NO: 887282 - RNA, 24 nt, Human
ucaccaauucuccucugaguucau

SEQ ID NO: 887283 - RNA, 21 nt, Human
ucacuuaaucucucuaugccu

SEQ ID NO: 887284 - RNA, 23 nt, Human
uccaccacaaguuugaaaggaug

SEQ ID NO: 887285 - RNA, 18 nt, Human
uccaucuuuagguggcuc

SEQ ID NO: 887286 - RNA, 19 nt, Human
uccucagucccaucacugu

SEQ ID NO: 887287 - RNA, 21 nt, Human
uccucgguguccaccuccauc

SEQ ID NO: 887288 - RNA, 21 nt, Human
uccugguccucuccagcuugu

SEQ ID NO: 887289 - RNA, 20 nt, Human
ucucuccuaggaacggaggc

SEQ ID NO: 887290 - RNA, 21 nt, Human
ucugguaaguuacagcagcaa

SEQ ID NO: 887291 - RNA, 21 nt, Human
ucuuguguuuuucuuuuuuuc

SEQ ID NO: 887292 - RNA, 23 nt, Human
ugaaaaaauuaaaaugcacccac

SEQ ID NO: 887293 - RNA, 26 nt, Human
ugacaugaccacugccgucacagcca

SEQ ID NO: 887294 - RNA, 20 nt, Human
ugaguauggauaucauaacc

SEQ ID NO: 887295 - RNA, 18 nt, Human
ugccaccaagacgcagaa

SEQ ID NO: 887296 - RNA, 23 nt, Human
uggauuggacaaacguccaggca

SEQ ID NO: 887297 - RNA, 19 nt, Human
uggcucaaaauacacagac

SEQ ID NO: 887298 - RNA, 21 nt, Human
uggcucaaaauacacagacag

SEQ ID NO: 887299 - RNA, 19 nt, Human
uuacagcagcaaaaaacaa

SEQ ID NO: 887300 - RNA, 21 nt, Human
uuacagcagcaaaaaacaaga

SEQ ID NO: 887301 - RNA, 19 nt, Human
uuccaccagauguggccac

SEQ ID NO: 887302 - RNA, 19 nt, Human
aaaaggaaauggagauagg

SEQ ID NO: 887303 - RNA, 27 nt, Human
aaaggaaauggagauaggugggcugac

SEQ ID NO: 887304 - RNA, 22 nt, Human
aaggaaauggagauaggugggc

SEQ ID NO: 887305 - RNA, 20 nt, Human
agagcuuucccacacgccaa

SEQ ID NO: 887306 - RNA, 18 nt, Human
aggaagagggggucagag

SEQ ID NO: 887307 - RNA, 19 nt, Human
cagaaugaacucccaggcc

SEQ ID NO: 887308 - RNA, 24 nt, Human
cagaaugaacucccaggcccccga

SEQ ID NO: 887309 - RNA, 21 nt, Human
cagaggggggauuggaggggu

SEQ ID NO: 887310 - RNA, 21 nt, Human
cugacacuuguccccucccca

SEQ ID NO: 887311 - RNA, 24 nt, Human
cugcugacacuuguccccucccca

SEQ ID NO: 887312 - RNA, 23 nt, Human
gaagagggggucagaggggggau

SEQ ID NO: 887313 - RNA, 24 nt, Human
gaccccaugugaggaagagggggu

SEQ ID NO: 887314 - RNA, 19 nt, Human
gggauuggaggggugaggg

SEQ ID NO: 887315 - RNA, 21 nt, Human
gggggauuggaggggugaggg

SEQ ID NO: 887316 - RNA, 24 nt, Human
ggggggccagugcccagcucaaga

SEQ ID NO: 887317 - RNA, 21 nt, Human
gugaacacacagccaccucgu

SEQ ID NO: 887318 - RNA, 21 nt, Human
gugugugugugugugugugug

SEQ ID NO: 887319 - RNA, 21 nt, Human
gugugugugugugugugugug

SEQ ID NO: 887320 - RNA, 22 nt, Human
ucagaggggggauuggaggggu

SEQ ID NO: 887321 - RNA, 23 nt, Human
ugaacucccaggcccccgacccc

SEQ ID NO: 887322 - RNA, 18 nt, Human
ugaggaagagggggucag

SEQ ID NO: 887323 - RNA, 20 nt, Human
ugcugugugcugugcugaug

SEQ ID NO: 887324 - RNA, 23 nt, Human
uggcaagucucaaagucuguaua

SEQ ID NO: 887325 - RNA, 22 nt, Human
uguccccuccccaccggccuca

SEQ ID NO: 887326 - RNA, 22 nt, Human
ugugcugauggcaagucucaaa

SEQ ID NO: 887327 - RNA, 21 nt, Human
ugugugugaacacacagccac

SEQ ID NO: 887328 - RNA, 18 nt, Human
ugugugugugugugugug

SEQ ID NO: 887329 - RNA, 18 nt, Human
ugugugugugugugugug

SEQ ID NO: 887330 - RNA, 18 nt, Human
ugugugugugugugugug

SEQ ID NO: 887331 - RNA, 18 nt, Human
ugugugugugugugugug

SEQ ID NO: 887332 - RNA, 18 nt, Human
ugugugugugugugugug

SEQ ID NO: 887333 - RNA, 18 nt, Human
ugugugugugugugugug

SEQ ID NO: 887334 - RNA, 18 nt, Human
ugugugugugugugugug

SEQ ID NO: 887335 - RNA, 18 nt, Human
ugugugugugugugugug

SEQ ID NO: 887336 - RNA, 18 nt, Human
ugugugugugugugugug

SEQ ID NO: 887337 - RNA, 18 nt, Human
ugugugugugugugugug

SEQ ID NO: 887338 - RNA, 21 nt, Human
ugugugugugugugugugugu

SEQ ID NO: 887339 - RNA, 21 nt, Human
ugugugugugugugugugugu

SEQ ID NO: 887340 - RNA, 21 nt, Human
ugugugugugugugugugugu

SEQ ID NO: 887341 - RNA, 21 nt, Human
ugugugugugugugugugugu

SEQ ID NO: 887342 - RNA, 21 nt, Human
ugugugugugugugugugugu

SEQ ID NO: 887343 - RNA, 21 nt, Human
ugugugugugugugugugugu

SEQ ID NO: 887344 - RNA, 21 nt, Human
ugugugugugugugugugugu

SEQ ID NO: 887345 - RNA, 21 nt, Human
ugugugugugugugugugugu

SEQ ID NO: 887346 - RNA, 21 nt, Human
ugugugugugugugugugugu

SEQ ID NO: 887347 - RNA, 21 nt, Human
ugugugugugugugugugugu

SEQ ID NO: 887348 - RNA, 21 nt, Human
ugugugugugugugugugugu

SEQ ID NO: 887349 - RNA, 21 nt, Human
ugugugugugugugugugugu

SEQ ID NO: 887350 - RNA, 21 nt, Human
ugugugugugugugugugugu

SEQ ID NO: 887351 - RNA, 21 nt, Human
ugugugugugugugugugugu

SEQ ID NO: 887352 - RNA, 21 nt, Human
ugugugugugugugugugugu

SEQ ID NO: 887353 - RNA, 21 nt, Human
ugugugugugugugugugugu

SEQ ID NO: 887354 - RNA, 22 nt, Human
ugugugugugugugugugugug

SEQ ID NO: 887355 - RNA, 22 nt, Human
ugugugugugugugugugugug

SEQ ID NO: 887356 - RNA, 22 nt, Human
ugugugugugugugugugugug

SEQ ID NO: 887357 - RNA, 22 nt, Human
ugugugugugugugugugugug

SEQ ID NO: 887358 - RNA, 22 nt, Human
ugugugugugugugugugugug

SEQ ID NO: 887359 - RNA, 22 nt, Human
ugugugugugugugugugugug

SEQ ID NO: 887360 - RNA, 22 nt, Human
ugugugugugugugugugugug

SEQ ID NO: 887361 - RNA, 19 nt, Human
aaacaguucugaacaggca

SEQ ID NO: 887362 - RNA, 20 nt, Human
aacagaaaauguuaaaucug

SEQ ID NO: 887363 - RNA, 22 nt, Human
agaaaaaagcugguuuugaaaa

SEQ ID NO: 887364 - RNA, 24 nt, Human
aggcagaaaauguagacuuuccuu

SEQ ID NO: 887365 - RNA, 23 nt, Human
aggcggcgucggcccuucccggc

SEQ ID NO: 887366 - RNA, 25 nt, Human
cacuuuuuuuuuuauuuauuuauaa

SEQ ID NO: 887367 - RNA, 26 nt, Human
cagaaaauguuaaaucuguaauagca

SEQ ID NO: 887368 - RNA, 21 nt, Human
cagcgaaccccuccgccccuu

SEQ ID NO: 887369 - RNA, 18 nt, Human
cccccgcccgcgccccgc

SEQ ID NO: 887370 - RNA, 25 nt, Human
cccccucagcuugcugccgcugcuc

SEQ ID NO: 887371 - RNA, 24 nt, Human
ccccgccgcccgcccucaggcccg

SEQ ID NO: 887372 - RNA, 21 nt, Human
ccccuccgccccuuugccgcc

SEQ ID NO: 887373 - RNA, 18 nt, Human
cccgcccucaggcccggc

SEQ ID NO: 887374 - RNA, 19 nt, Human
ccgcccgcgccccgccgcc

SEQ ID NO: 887375 - RNA, 20 nt, Human
ccgcccgcgccccgccgccc

SEQ ID NO: 887376 - RNA, 25 nt, Human
ccgcccgcgccccgccgcccgcccu

SEQ ID NO: 887377 - RNA, 20 nt, Human
ccgccgcccgcccucaggcc

SEQ ID NO: 887378 - RNA, 23 nt, Human
ccgccucgcccccgcccgcgccc

SEQ ID NO: 887379 - RNA, 22 nt, Human
ccggcggcggcgacgcccccuc

SEQ ID NO: 887380 - RNA, 21 nt, Human
cgcccccgcccgcgccccgcc

SEQ ID NO: 887381 - RNA, 18 nt, Human
cgccgggggccggcggcg

SEQ ID NO: 887382 - RNA, 21 nt, Human
cgccucgcccccgcccgcgcc

SEQ ID NO: 887383 - RNA, 24 nt, Human
cggcggcggcgacgcccccucagc

SEQ ID NO: 887384 - RNA, 24 nt, Human
cuauaccaucccgccacgaccgca

SEQ ID NO: 887385 - RNA, 24 nt, Human
cugggaaauaaguuucuucacauu

SEQ ID NO: 887386 - RNA, 18 nt, Human
cuguacaacugcguuuac

SEQ ID NO: 887387 - RNA, 18 nt, Human
gaucagccagcccugagc

SEQ ID NO: 887388 - RNA, 22 nt, Human
gcuauuaaacaguucugaacag

SEQ ID NO: 887389 - RNA, 18 nt, Human
gcugccgcugcucccaag

SEQ ID NO: 887390 - RNA, 23 nt, Human
guagacuuuccuuuaacagaaaa

SEQ ID NO: 887391 - RNA, 23 nt, Human
gugagcuugaguuugaucagcca

SEQ ID NO: 887392 - RNA, 23 nt, Human
uaacagaaaauguuaaaucugua

SEQ ID NO: 887393 - RNA, 23 nt, Human
uaagaaagcaacacuuuuuuuuu

SEQ ID NO: 887394 - RNA, 19 nt, Human
uaccaucccgccacgaccg

SEQ ID NO: 887395 - RNA, 21 nt, Human
uaccaucccgccacgaccgca

SEQ ID NO: 887396 - RNA, 18 nt, Human
uagcagcauaauuuauau

SEQ ID NO: 887397 - RNA, 25 nt, Human
uauuuauuuauaaaggcuaaccaua

SEQ ID NO: 887398 - RNA, 22 nt, Human
ucaggcggcgucggcccuuccc

SEQ ID NO: 887399 - RNA, 19 nt, Human
ucccgcggcggcgccgggg

SEQ ID NO: 887400 - RNA, 23 nt, Human
uggcagcgaaccccuccgccccu

SEQ ID NO: 887401 - RNA, 21 nt, Human
uugcuggcagcgaaccccucc

SEQ ID NO: 887402 - RNA, 24 nt, Human
uuuauaaaggcuaaccauauccau

SEQ ID NO: 887403 - RNA, 20 nt, Human
aaaaugcacacagaagaaca

SEQ ID NO: 887404 - RNA, 23 nt, Human
aaagugcugggauuacaggcgug

SEQ ID NO: 887405 - RNA, 24 nt, Human
aaagugcugggauuacaggcgugg

SEQ ID NO: 887406 - RNA, 25 nt, Human
aaagugcugggauuacaggcguggg

SEQ ID NO: 887407 - RNA, 27 nt, Human
aagcagaagaaagggcaaaagggaccc

SEQ ID NO: 887408 - RNA, 20 nt, Human
aagcagaagaaagggcaaag

SEQ ID NO: 887409 - RNA, 21 nt, Human
aagcgguucuccugccucagc

SEQ ID NO: 887410 - RNA, 19 nt, Human
aaguagcugggauuacagg

SEQ ID NO: 887411 - RNA, 24 nt, Human
aaguagcugggauuacaggcacac

SEQ ID NO: 887412 - RNA, 19 nt, Human
aagugcugggauuacaggc

SEQ ID NO: 887413 - RNA, 19 nt, Human
aagugcugggauuacaggc

SEQ ID NO: 887414 - RNA, 19 nt, Human
acaaagcagaagaaagggc

SEQ ID NO: 887415 - RNA, 23 nt, Human
acaaagcagaagaaagggcaaaa

SEQ ID NO: 887416 - RNA, 19 nt, Human
acaguucuagaagcauuuc

SEQ ID NO: 887417 - RNA, 23 nt, Human
acaucuggaagauauuuaaccau

SEQ ID NO: 887418 - RNA, 22 nt, Human
accauguuggccaggcuggucu

SEQ ID NO: 887419 - RNA, 18 nt, Human
acggggauucaccauguu

SEQ ID NO: 887420 - RNA, 24 nt, Human
acggggauucaccauguuggccag

SEQ ID NO: 887421 - RNA, 24 nt, Human
agaacaaaagguaaaagaucaagg

SEQ ID NO: 887422 - RNA, 19 nt, Human
agaagaacagaacaaaagg

SEQ ID NO: 887423 - RNA, 23 nt, Human
agaucaaggucauauacaaagca

SEQ ID NO: 887424 - RNA, 25 nt, Human
agccggugccgcgucgucgaacgca

SEQ ID NO: 887425 - RNA, 24 nt, Human
agcgguucuccugccucagccucc

SEQ ID NO: 887426 - RNA, 24 nt, Human
aggcgauccaccuaccucggccuc

SEQ ID NO: 887427 - RNA, 23 nt, Human
agggcaaaagcaugucuuccuuc

SEQ ID NO: 887428 - RNA, 18 nt, Human
agugcaguggugugaucu

SEQ ID NO: 887429 - RNA, 19 nt, Human
agugcaguggugugaucuc

SEQ ID NO: 887430 - RNA, 20 nt, Human
agugcaguggugugaucucg

SEQ ID NO: 887431 - RNA, 21 nt, Human
agugcaguggugugaucucga

SEQ ID NO: 887432 - RNA, 21 nt, Human
auaaggcagcaacaucuggaa

SEQ ID NO: 887433 - RNA, 23 nt, Human
auacaaagcagaagaaagggcaa

SEQ ID NO: 887434 - RNA, 22 nt, Human
augcaaacucuacaccucuucu

SEQ ID NO: 887435 - RNA, 23 nt, Human
augcacacagaagaacagaacaa

SEQ ID NO: 887436 - RNA, 22 nt, Human
caaagcacuuuaaauaccucuc

SEQ ID NO: 887437 - RNA, 24 nt, Human
caaagugcugggauuacaggcgug

SEQ ID NO: 887438 - RNA, 24 nt, Human
caaccuccaccucccagguuuaag

SEQ ID NO: 887439 - RNA, 27 nt, Human
cacaauccagcaguaaaaagacugucu

SEQ ID NO: 887440 - RNA, 24 nt, Human
caccacacccagcuaauuuuugua

SEQ ID NO: 887441 - RNA, 21 nt, Human
caccauguuggccaggcuggu

SEQ ID NO: 887442 - RNA, 22 nt, Human
caccauguuggccaggcugguc

SEQ ID NO: 887443 - RNA, 23 nt, Human
caccauguuggccaggcuggucu

SEQ ID NO: 887444 - RNA, 24 nt, Human
caccauguuggccaggcuggucuu

SEQ ID NO: 887445 - RNA, 23 nt, Human
caccuaccucggccucccaaagu

SEQ ID NO: 887446 - RNA, 20 nt, Human
cacugcaaccuccaccuccc

SEQ ID NO: 887447 - RNA, 18 nt, Human
cacugcgcucucccgcgc

SEQ ID NO: 887448 - RNA, 23 nt, Human
caggcgugggccaccacaccagg

SEQ ID NO: 887449 - RNA, 24 nt, Human
cauguuggccaggcuggucuugaa

SEQ ID NO: 887450 - RNA, 22 nt, Human
ccaaagugcugggauuacaggc

SEQ ID NO: 887451 - RNA, 22 nt, Human
ccaaagugcugggauuacaggc

SEQ ID NO: 887452 - RNA, 24 nt, Human
ccaaagugcugggauuacaggcgu

SEQ ID NO: 887453 - RNA, 24 nt, Human
ccaacaugucuucuuacugcuucu

SEQ ID NO: 887454 - RNA, 23 nt, Human
ccaaguagcugggauuacaggca

SEQ ID NO: 887455 - RNA, 20 nt, Human
ccaggcugagugcaguggug

SEQ ID NO: 887456 - RNA, 23 nt, Human
cccaaguagcugggauuacaggc

SEQ ID NO: 887457 - RNA, 24 nt, Human
cccaaguagcugggauuacaggca

SEQ ID NO: 887458 - RNA, 19 nt, Human
cccaggcugagugcagugg

SEQ ID NO: 887459 - RNA, 23 nt, Human
cccagguuuaagcgguucuccug

SEQ ID NO: 887460 - RNA, 24 nt, Human
ccgcagcccuuucccgccggcgcc

SEQ ID NO: 887461 - RNA, 24 nt, Human
ccucccagguuuaagcgguucucc

SEQ ID NO: 887462 - RNA, 24 nt, Human
ccucucacaaaagacuuuuaggac

SEQ ID NO: 887463 - RNA, 23 nt, Human
ccugccucagccucccaaguagc

SEQ ID NO: 887464 - RNA, 24 nt, Human
ccugccucagccucccaaguagcu

SEQ ID NO: 887465 - RNA, 24 nt, Human
cgauccaccuaccucggccuccca

SEQ ID NO: 887466 - RNA, 23 nt, Human
cgcagcccuuucccgccggcgcc

SEQ ID NO: 887467 - RNA, 20 nt, Human
cgguucuccugccucagccu

SEQ ID NO: 887468 - RNA, 26 nt, Human
cgucgucgaacgcacaacgcggcgcc

SEQ ID NO: 887469 - RNA, 23 nt, Human
cuaauuuuuguauuuuuaauaga

SEQ ID NO: 887470 - RNA, 23 nt, Human
cucagccucccaaguagcuggga

SEQ ID NO: 887471 - RNA, 18 nt, Human
cugaaaaccuuucugucu

SEQ ID NO: 887472 - RNA, 23 nt, Human
cugaccucaggcgauccaccuac

SEQ ID NO: 887473 - RNA, 23 nt, Human
cugcaaccuccaccucccagguu

SEQ ID NO: 887474 - RNA, 24 nt, Human
cugcaaccuccaccucccagguuu

SEQ ID NO: 887475 - RNA, 20 nt, Human
cuugaacuucugaccucagg

SEQ ID NO: 887476 - RNA, 21 nt, Human
cuuuggggggcaugaaucagg

SEQ ID NO: 887477 - RNA, 24 nt, Human
gaccucaggcgauccaccuaccuc

SEQ ID NO: 887478 - RNA, 21 nt, Human
gagugcaguggugugaucucg

SEQ ID NO: 887479 - RNA, 18 nt, Human
gauuacaggcgugggcca

SEQ ID NO: 887480 - RNA, 21 nt, Human
gauuacaggcgugggccacca

SEQ ID NO: 887481 - RNA, 22 nt, Human
gauuacaggcgugggccaccac

SEQ ID NO: 887482 - RNA, 24 nt, Human
gcgauccaccuaccucggccuccc

SEQ ID NO: 887483 - RNA, 25 nt, Human
gcucugucacccaggcugagugcag

SEQ ID NO: 887484 - RNA, 22 nt, Human
ggagacggagucuugcucuguc

SEQ ID NO: 887485 - RNA, 20 nt, Human
ggcaaaagcaugucuuccuu

SEQ ID NO: 887486 - RNA, 21 nt, Human
ggcugagugcaguggugugau

SEQ ID NO: 887487 - RNA, 24 nt, Human
ggcuggucuugaacuucugaccuc

SEQ ID NO: 887488 - RNA, 22 nt, Human
gggauucaccauguuggccagg

SEQ ID NO: 887489 - RNA, 23 nt, Human
gggcgucgaagccggugccgcgu

SEQ ID NO: 887490 - RNA, 23 nt, Human
ggggauucaccauguuggccagg

SEQ ID NO: 887491 - RNA, 19 nt, Human
ggucuugaacuucugaccu

SEQ ID NO: 887492 - RNA, 20 nt, Human
gucgucgaacgcacaacgcg

SEQ ID NO: 887493 - RNA, 25 nt, Human
gucgucgaacgcacaacgcggcgcc

SEQ ID NO: 887494 - RNA, 21 nt, Human
guucuccugccucagccuccc

SEQ ID NO: 887495 - RNA, 23 nt, Human
uaaaaaaucaaaccucacuugca

SEQ ID NO: 887496 - RNA, 23 nt, Human
uaaaaagacugucugucuagcau

SEQ ID NO: 887497 - RNA, 19 nt, Human
uaaccauuucuuuuucucu

SEQ ID NO: 887498 - RNA, 26 nt, Human
uaagcgguucuccugccucagccucc

SEQ ID NO: 887499 - RNA, 19 nt, Human
uaauagaauuuuaaccuac

SEQ ID NO: 887500 - RNA, 24 nt, Human
uaauagagacggggauucaccaug

SEQ ID NO: 887501 - RNA, 24 nt, Human
uaauuuuuguauuuuuaauagaga

SEQ ID NO: 887502 - RNA, 26 nt, Human
uacaaagcagaagaaagggcaaaagc

SEQ ID NO: 887503 - RNA, 24 nt, Human
uacaggcacacgccaccacaccca

SEQ ID NO: 887504 - RNA, 22 nt, Human
uacaggcgugggccaccacacc

SEQ ID NO: 887505 - RNA, 24 nt, Human
uaccucggccucccaaagugcugg

SEQ ID NO: 887506 - RNA, 19 nt, Human
uagaauuuuaaccuacugc

SEQ ID NO: 887507 - RNA, 22 nt, Human
uagagacggggauucaccaugu

SEQ ID NO: 887508 - RNA, 23 nt, Human
uaugcaaacucuacaccucuucu

SEQ ID NO: 887509 - RNA, 23 nt, Human
ucacugcaaccuccaccucccag

SEQ ID NO: 887510 - RNA, 24 nt, Human
ucacugcaaccuccaccucccagg

SEQ ID NO: 887511 - RNA, 25 nt, Human
ucacugcaaccuccaccucccaggu

SEQ ID NO: 887512 - RNA, 27 nt, Human
ucacugcaaccuccaccucccagguuu

SEQ ID NO: 887513 - RNA, 18 nt, Human
ucagccucccaaguagcu

SEQ ID NO: 887514 - RNA, 20 nt, Human
ucagccucccaaguagcugg

SEQ ID NO: 887515 - RNA, 24 nt, Human
ucccaaagugcugggauuacaggc

SEQ ID NO: 887516 - RNA, 24 nt, Human
ucccaaguagcugggauuacaggc

SEQ ID NO: 887517 - RNA, 21 nt, Human
ucccagguuuaagcgguucuc

SEQ ID NO: 887518 - RNA, 24 nt, Human
ucccagguuuaagcgguucuccug

SEQ ID NO: 887519 - RNA, 18 nt, Human
ucgaacgcacaacgcggc

SEQ ID NO: 887520 - RNA, 18 nt, Human
ucggccucccaaagugcu

SEQ ID NO: 887521 - RNA, 23 nt, Human
ucuacaccucuucuuguuaucca

SEQ ID NO: 887522 - RNA, 26 nt, Human
ucuccugccucagccucccaaguagc

SEQ ID NO: 887523 - RNA, 23 nt, Human
ucugucacccaggcugagugcag

SEQ ID NO: 887524 - RNA, 19 nt, Human
ucuugcucugucacccagg

SEQ ID NO: 887525 - RNA, 23 nt, Human
ucuugcucugucacccaggcuga

SEQ ID NO: 887526 - RNA, 24 nt, Human
ucuugcucugucacccaggcugag

SEQ ID NO: 887527 - RNA, 21 nt, Human
ugaaucaggucucaaagcacu

SEQ ID NO: 887528 - RNA, 19 nt, Human
ugaccucaggcgauccacc

SEQ ID NO: 887529 - RNA, 21 nt, Human
ugaccucaggcgauccaccua

SEQ ID NO: 887530 - RNA, 22 nt, Human
ugagaaacaaucagagcauuuu

SEQ ID NO: 887531 - RNA, 18 nt, Human
ugagugcaguggugugau

SEQ ID NO: 887532 - RNA, 21 nt, Human
ugagugcaguggugugaucuc

SEQ ID NO: 887533 - RNA, 30 nt, Human
ugagugcaguggugugaucucgaucucggg

SEQ ID NO: 887534 - RNA, 21 nt, Human
ugcacacagaagaacagaaca

SEQ ID NO: 887535 - RNA, 22 nt, Human
ugcacacagaagaacagaacaa

SEQ ID NO: 887536 - RNA, 24 nt, Human
ugccucagccucccaaguagcugg

SEQ ID NO: 887537 - RNA, 23 nt, Human
ugcucugucacccaggcugagug

SEQ ID NO: 887538 - RNA, 24 nt, Human
ugcugggauuacaggcgugggcca

SEQ ID NO: 887539 - RNA, 24 nt, Human
uggccaggcuggucuugaacuucu

SEQ ID NO: 887540 - RNA, 21 nt, Human
ugggauuacaggcacacgcca

SEQ ID NO: 887541 - RNA, 22 nt, Human
ugggauuacaggcacacgccac

SEQ ID NO: 887542 - RNA, 24 nt, Human
ugggauuacaggcacacgccacca

SEQ ID NO: 887543 - RNA, 19 nt, Human
ugggauuacaggcgugggc

SEQ ID NO: 887544 - RNA, 21 nt, Human
ugggauuacaggcgugggcca

SEQ ID NO: 887545 - RNA, 22 nt, Human
ugggauuacaggcgugggccac

SEQ ID NO: 887546 - RNA, 23 nt, Human
ugggauuacaggcgugggccacc

SEQ ID NO: 887547 - RNA, 24 nt, Human
ugggauuacaggcgugggccacca

SEQ ID NO: 887548 - RNA, 24 nt, Human
uggucuugaacuucugaccucagg

SEQ ID NO: 887549 - RNA, 24 nt, Human
uuaauagagacggggauucaccau

SEQ ID NO: 887550 - RNA, 20 nt, Human
uuagaucuccuuuuuuucuu

SEQ ID NO: 887551 - RNA, 26 nt, Human
uuauaaacaaaauauuuucuauauuu

SEQ ID NO: 887552 - RNA, 20 nt, Human
uucaccauguuggccaggcu

SEQ ID NO: 887553 - RNA, 21 nt, Human
uuuaaccauuucuuuuucucu

SEQ ID NO: 887554 - RNA, 20 nt, Human
uuuaaccuacaaaccuucau

SEQ ID NO: 887555 - RNA, 23 nt, Human
uuuaagcgguucuccugccucag

SEQ ID NO: 887556 - RNA, 21 nt, Human
uuuccauaaaaugcacacaga

SEQ ID NO: 887557 - RNA, 20 nt, Human
uuuuuguauuuuuaauagag

SEQ ID NO: 887558 - RNA, 23 nt, Human
uuuuuguauuuuuaauagagacg

SEQ ID NO: 887559 - RNA, 25 nt, Human
aaaaaggaaagagaaaaaaccccau

SEQ ID NO: 887560 - RNA, 19 nt, Human
aaacacacccccucagaca

SEQ ID NO: 887561 - RNA, 25 nt, Human
aaagcaaaaugaaaccaugagaccc

SEQ ID NO: 887562 - RNA, 23 nt, Human
aaaugaaaccaugagacccaccu

SEQ ID NO: 887563 - RNA, 22 nt, Human
aacccauaagcuugcccaccuc

SEQ ID NO: 887564 - RNA, 19 nt, Human
aagcaaaaugaaaccauga

SEQ ID NO: 887565 - RNA, 21 nt, Human
aagcacgcaaugcauggcagc

SEQ ID NO: 887566 - RNA, 21 nt, Human
aagcccuaucagggcagggga

SEQ ID NO: 887567 - RNA, 21 nt, Human
aagcuugcccaccuccucucc

SEQ ID NO: 887568 - RNA, 19 nt, Human
aaggagacaggcaaaccaa

SEQ ID NO: 887569 - RNA, 22 nt, Human
aaggcgucggcucgggccggga

SEQ ID NO: 887570 - RNA, 26 nt, Human
aagggcuugccaagguaaggaggagg

SEQ ID NO: 887571 - RNA, 21 nt, Human
acaauuacagcagcacagaaa

SEQ ID NO: 887572 - RNA, 18 nt, Human
acacacccaccacccaca

SEQ ID NO: 887573 - RNA, 26 nt, Human
acaccacccuaccccggccggguguc

SEQ ID NO: 887574 - RNA, 18 nt, Human
acacccaccacccacaag

SEQ ID NO: 887575 - RNA, 26 nt, Human
acaccuguggucgguuggccccagag

SEQ ID NO: 887576 - RNA, 18 nt, Human
acaguguugcugcuguca

SEQ ID NO: 887577 - RNA, 18 nt, Human
accaagaaacccauaagc

SEQ ID NO: 887578 - RNA, 22 nt, Human
acccacuccccacuggcuguac

SEQ ID NO: 887579 - RNA, 25 nt, Human
accuggccacucccccuuucccucc

SEQ ID NO: 887580 - RNA, 23 nt, Human
accuucugacaguguugcugcug

SEQ ID NO: 887581 - RNA, 19 nt, Human
acuggaucccuccucuccu

SEQ ID NO: 887582 - RNA, 28 nt, Human
agaaaaaaccccauacgguuauugugaa

SEQ ID NO: 887583 - RNA, 18 nt, Human
agaaucuauuucuggcuc

SEQ ID NO: 887584 - RNA, 21 nt, Human
agacaccacccuaccccggca

SEQ ID NO: 887585 - RNA, 20 nt, Human
agacaggaggugggugcggg

SEQ ID NO: 887586 - RNA, 21 nt, Human
agacaggaggugggugcgggg

SEQ ID NO: 887587 - RNA, 24 nt, Human
agacaggcaaaccaacaauuacag

SEQ ID NO: 887588 - RNA, 23 nt, Human
agacaggcgcagggcacacccuc

SEQ ID NO: 887589 - RNA, 24 nt, Human
agacagugcacacgccucauucuc

SEQ ID NO: 887590 - RNA, 21 nt, Human
agagaaaaaaccccauacggu

SEQ ID NO: 887591 - RNA, 21 nt, Human
agagaaauguacccagcccca

SEQ ID NO: 887592 - RNA, 18 nt, Human
agagcacuucuaggggcc

SEQ ID NO: 887593 - RNA, 19 nt, Human
agccagacagaaccugugu

SEQ ID NO: 887594 - RNA, 27 nt, Human
agccagcugggaacucccauggcccuc

SEQ ID NO: 887595 - RNA, 24 nt, Human
agcccacggccccacuggaucccu

SEQ ID NO: 887596 - RNA, 21 nt, Human
aggagggagugcccaggcagg

SEQ ID NO: 887597 - RNA, 19 nt, Human
aggcaagguggggugggga

SEQ ID NO: 887598 - RNA, 21 nt, Human
aggcagagcacuucuaggggc

SEQ ID NO: 887599 - RNA, 20 nt, Human
aggcaggggaggcggugagu

SEQ ID NO: 887600 - RNA, 21 nt, Human
aggcagguguggguuuuaggg

SEQ ID NO: 887601 - RNA, 20 nt, Human
aggcggugaguucagggcag

SEQ ID NO: 887602 - RNA, 20 nt, Human
aggcucccaaacacaccccu

SEQ ID NO: 887603 - RNA, 26 nt, Human
agggagggaggcagacaggagguggg

SEQ ID NO: 887604 - RNA, 22 nt, Human
agggaggggcugcccugaggug

SEQ ID NO: 887605 - RNA, 18 nt, Human
aggggcugcccugaggug

SEQ ID NO: 887606 - RNA, 22 nt, Human
aggggcugggguggggcggggg

SEQ ID NO: 887607 - RNA, 23 nt, Human
aggggcugggguggggcgggggg

SEQ ID NO: 887608 - RNA, 21 nt, Human
agguaagcccuaucagggcag

SEQ ID NO: 887609 - RNA, 24 nt, Human
agugaaggacuggaggccccagag

SEQ ID NO: 887610 - RNA, 23 nt, Human
agugguugccaggggcuggggug

SEQ ID NO: 887611 - RNA, 18 nt, Human
auaaacacaccaucccca

SEQ ID NO: 887612 - RNA, 19 nt, Human
auaagcuugcccaccuccu

SEQ ID NO: 887613 - RNA, 19 nt, Human
aucagggcaggggaccgag

SEQ ID NO: 887614 - RNA, 20 nt, Human
aucauucuuuuucuuuucug

SEQ ID NO: 887615 - RNA, 25 nt, Human
augcugggggggugacagaacugua

SEQ ID NO: 887616 - RNA, 21 nt, Human
augggguagaggguggggcca

SEQ ID NO: 887617 - RNA, 22 nt, Human
caaaaugaaaccaugagaccca

SEQ ID NO: 887618 - RNA, 18 nt, Human
caaacacacccccucaga

SEQ ID NO: 887619 - RNA, 25 nt, Human
caaacacacccccucagacacaccc

SEQ ID NO: 887620 - RNA, 21 nt, Human
caaaccaacaauuacagcagc

SEQ ID NO: 887621 - RNA, 26 nt, Human
caaagcaaaaugaaaccaugagaccc

SEQ ID NO: 887622 - RNA, 24 nt, Human
caagaaacccauaagcuugcccac

SEQ ID NO: 887623 - RNA, 20 nt, Human
caaggcacccuacccagccc

SEQ ID NO: 887624 - RNA, 27 nt, Human
caaggcacccuacccagcccacggccc

SEQ ID NO: 887625 - RNA, 26 nt, Human
cacaaccaggacccaccuguggggcc

SEQ ID NO: 887626 - RNA, 18 nt, Human
cacacccucccacugacc

SEQ ID NO: 887627 - RNA, 20 nt, Human
cacagcaccuggcgcccagu

SEQ ID NO: 887628 - RNA, 25 nt, Human
caccagugccuucuggagcuguggu

SEQ ID NO: 887629 - RNA, 20 nt, Human
cacccacuccccacuggcug

SEQ ID NO: 887630 - RNA, 20 nt, Human
caccccaagcucaaacccau

SEQ ID NO: 887631 - RNA, 20 nt, Human
caccccaccccaagcucaaa

SEQ ID NO: 887632 - RNA, 21 nt, Human
caccccagccuccuucccugg

SEQ ID NO: 887633 - RNA, 19 nt, Human
cacccccucagacacaccc

SEQ ID NO: 887634 - RNA, 26 nt, Human
cacccuacccagcccacggccccacu

SEQ ID NO: 887635 - RNA, 20 nt, Human
cacccucccacugaccacug

SEQ ID NO: 887636 - RNA, 18 nt, Human
cacucacaagggcccagc

SEQ ID NO: 887637 - RNA, 21 nt, Human
cacucccccuuucccuccuca

SEQ ID NO: 887638 - RNA, 23 nt, Human
cacuggcuuuuggaggccaggcu

SEQ ID NO: 887639 - RNA, 24 nt, Human
cacuucuaggggccccccacuccu

SEQ ID NO: 887640 - RNA, 24 nt, Human
cacuuuuguuuuuguugcaagaag

SEQ ID NO: 887641 - RNA, 24 nt, Human
cagacaggcgcagggcacacccuc

SEQ ID NO: 887642 - RNA, 21 nt, Human
cagauaacuucucagaaguuc

SEQ ID NO: 887643 - RNA, 19 nt, Human
cagcacagaaagagcugac

SEQ ID NO: 887644 - RNA, 19 nt, Human
cagcagcacagaaagagcu

SEQ ID NO: 887645 - RNA, 28 nt, Human
cagccagacagaaccuguguuccaggac

SEQ ID NO: 887646 - RNA, 23 nt, Human
cagcccagcucccuaaucgcugg

SEQ ID NO: 887647 - RNA, 25 nt, Human
cagcccaggucuccagccucucucc

SEQ ID NO: 887648 - RNA, 20 nt, Human
cagcccuugcgcgucgcagc

SEQ ID NO: 887649 - RNA, 21 nt, Human
cagcguauucugagccucugg

SEQ ID NO: 887650 - RNA, 23 nt, Human
cagcugcuucaugguggcgacgc

SEQ ID NO: 887651 - RNA, 19 nt, Human
caggccccuggccauggag

SEQ ID NO: 887652 - RNA, 21 nt, Human
caggcucccaaacacaccccc

SEQ ID NO: 887653 - RNA, 19 nt, Human
caggggaccgagggccuug

SEQ ID NO: 887654 - RNA, 21 nt, Human
cauaagcuugcccaccuccuc

SEQ ID NO: 887655 - RNA, 21 nt, Human
ccaaagcaaaaugaaaccaug

SEQ ID NO: 887656 - RNA, 23 nt, Human
ccaacacacaugcccaguggcca

SEQ ID NO: 887657 - RNA, 24 nt, Human
ccaacccagacacuggcuuuugga

SEQ ID NO: 887658 - RNA, 19 nt, Human
ccaagaggcccagggagcu

SEQ ID NO: 887659 - RNA, 18 nt, Human
ccacagcagacagugcac

SEQ ID NO: 887660 - RNA, 24 nt, Human
ccaccccaccccaagcucaaaccc

SEQ ID NO: 887661 - RNA, 19 nt, Human
ccacucacacagccagaca

SEQ ID NO: 887662 - RNA, 19 nt, Human
ccacuggccaugggaggag

SEQ ID NO: 887663 - RNA, 23 nt, Human
ccagagccacccagccggcuggg

SEQ ID NO: 887664 - RNA, 19 nt, Human
ccagcccaggucuccagcc

SEQ ID NO: 887665 - RNA, 21 nt, Human
ccagcccaggucuccagccuc

SEQ ID NO: 887666 - RNA, 19 nt, Human
ccagccuucccaccaagaa

SEQ ID NO: 887667 - RNA, 19 nt, Human
ccagcucaugccucacacc

SEQ ID NO: 887668 - RNA, 18 nt, Human
ccaugcagacaggcgcag

SEQ ID NO: 887669 - RNA, 20 nt, Human
cccacacucacaagggccca

SEQ ID NO: 887670 - RNA, 18 nt, Human
cccaccagugccuucugg

SEQ ID NO: 887671 - RNA, 23 nt, Human
cccaccuguggggccugaggggc

SEQ ID NO: 887672 - RNA, 18 nt, Human
cccagagccacccagccg

SEQ ID NO: 887673 - RNA, 18 nt, Human
cccagaggcagggagccc

SEQ ID NO: 887674 - RNA, 22 nt, Human
cccagccuccuucccuggagga

SEQ ID NO: 887675 - RNA, 22 nt, Human
cccaggcucagguucagcucuc

SEQ ID NO: 887676 - RNA, 20 nt, Human
ccccacacucacaagggccc

SEQ ID NO: 887677 - RNA, 19 nt, Human
ccccacuggaucccuccuc

SEQ ID NO: 887678 - RNA, 18 nt, Human
ccccagaggcagggagcc

SEQ ID NO: 887679 - RNA, 23 nt, Human
ccccagaggcagggagcccagca

SEQ ID NO: 887680 - RNA, 19 nt, Human
ccccagccuccuucucugg

SEQ ID NO: 887681 - RNA, 21 nt, Human
ccccagcucaugccucacacc

SEQ ID NO: 887682 - RNA, 24 nt, Human
ccccccagcucaugccucacaccc

SEQ ID NO: 887683 - RNA, 21 nt, Human
cccccuacaucugggccuggc

SEQ ID NO: 887684 - RNA, 20 nt, Human
cccccucagacacacccacc

SEQ ID NO: 887685 - RNA, 23 nt, Human
ccccgcgcggauuugaacccucc

SEQ ID NO: 887686 - RNA, 18 nt, Human
ccccuacuuaauaaugcc

SEQ ID NO: 887687 - RNA, 21 nt, Human
ccccucagacacacccaccac

SEQ ID NO: 887688 - RNA, 21 nt, Human
cccggcaaugcccacagcuuu

SEQ ID NO: 887689 - RNA, 24 nt, Human
cccucagacacacccaccacccac

SEQ ID NO: 887690 - RNA, 21 nt, Human
cccucccccuacaucugggcc

SEQ ID NO: 887691 - RNA, 22 nt, Human
cccuccucuccuugcgccuccc

SEQ ID NO: 887692 - RNA, 22 nt, Human
cccugaaaaagggggccccccc

SEQ ID NO: 887693 - RNA, 24 nt, Human
cccuggagucccugugcuuggcac

SEQ ID NO: 887694 - RNA, 19 nt, Human
ccucaaucccgaccaucca

SEQ ID NO: 887695 - RNA, 18 nt, Human
ccucccacccacucccca

SEQ ID NO: 887696 - RNA, 21 nt, Human
ccucccacccacuccccacug

SEQ ID NO: 887697 - RNA, 22 nt, Human
ccucccacccacuccccacugg

SEQ ID NO: 887698 - RNA, 20 nt, Human
ccuggcuugacaggccccug

SEQ ID NO: 887699 - RNA, 21 nt, Human
ccuggggcccagccuucccac

SEQ ID NO: 887700 - RNA, 19 nt, Human
ccugucagggaagagacug

SEQ ID NO: 887701 - RNA, 21 nt, Human
ccuugcgcgucgcagcucccc

SEQ ID NO: 887702 - RNA, 18 nt, Human
ccuugcugugguaaaggc

SEQ ID NO: 887703 - RNA, 24 nt, Human
cuaacuccacuucacaaccaggac

SEQ ID NO: 887704 - RNA, 20 nt, Human
cuaagcccccaccugccaag

SEQ ID NO: 887705 - RNA, 18 nt, Human
cuaucagggcaggggacc

SEQ ID NO: 887706 - RNA, 20 nt, Human
cucccucugaccugcccuuc

SEQ ID NO: 887707 - RNA, 19 nt, Human
cucuaaguaagcccaaagc

SEQ ID NO: 887708 - RNA, 18 nt, Human
cugaggggcccucuggag

SEQ ID NO: 887709 - RNA, 24 nt, Human
cugcaccuuccuacgaacagggaa

SEQ ID NO: 887710 - RNA, 18 nt, Human
cugcucccaacacacaug

SEQ ID NO: 887711 - RNA, 23 nt, Human
cuggcacagcugccaaguuuugg

SEQ ID NO: 887712 - RNA, 19 nt, Human
cuggcucugaggggcccuc

SEQ ID NO: 887713 - RNA, 21 nt, Human
cuguguuccaggccgggcacc

SEQ ID NO: 887714 - RNA, 24 nt, Human
cuucaugguggcgacgcgcucgcc

SEQ ID NO: 887715 - RNA, 25 nt, Human
gaaggaaugggguagaggguggggc

SEQ ID NO: 887716 - RNA, 20 nt, Human
gacauccaugugcacuaacu

SEQ ID NO: 887717 - RNA, 18 nt, Human
gacuggccugccugaccu

SEQ ID NO: 887718 - RNA, 19 nt, Human
gagaaauguacccagcccc

SEQ ID NO: 887719 - RNA, 18 nt, Human
gagccccguugcugaugg

SEQ ID NO: 887720 - RNA, 18 nt, Human
gagggccuuguccuggcu

SEQ ID NO: 887721 - RNA, 27 nt, Human
gcacacccucccacugaccacuggcca

SEQ ID NO: 887722 - RNA, 18 nt, Human
gcacagcaccuggcgccc

SEQ ID NO: 887723 - RNA, 20 nt, Human
gcacagcaccuggcgcccag

SEQ ID NO: 887724 - RNA, 20 nt, Human
gccaagggggauggguuauc

SEQ ID NO: 887725 - RNA, 19 nt, Human
gccacucccccuuucccuc

SEQ ID NO: 887726 - RNA, 19 nt, Human
gcccuccagccucuccucu

SEQ ID NO: 887727 - RNA, 23 nt, Human
gcccucuuugcagaaaccucaac

SEQ ID NO: 887728 - RNA, 20 nt, Human
gcccuucgggaccuuggggc

SEQ ID NO: 887729 - RNA, 30 nt, Human
gccggcccgcggcuccgcagcccuugcgcc

SEQ ID NO: 887730 - RNA, 19 nt, Human
gccucccacccacucccca

SEQ ID NO: 887731 - RNA, 18 nt, Human
gccuccccagccccgggc

SEQ ID NO: 887732 - RNA, 18 nt, Human
gcguauucugagccucug

SEQ ID NO: 887733 - RNA, 20 nt, Human
gcugggaagcugaggccccg

SEQ ID NO: 887734 - RNA, 19 nt, Human
gcugggguggggcgggggg

SEQ ID NO: 887735 - RNA, 20 nt, Human
gcuggugaucccccagccuc

SEQ ID NO: 887736 - RNA, 21 nt, Human
gcugugaucaaggcaucuggc

SEQ ID NO: 887737 - RNA, 20 nt, Human
ggaaauguucccauuccuug

SEQ ID NO: 887738 - RNA, 23 nt, Human
ggaaggcuccagcccaggucucc

SEQ ID NO: 887739 - RNA, 22 nt, Human
ggaaugggguagaggguggggc

SEQ ID NO: 887740 - RNA, 20 nt, Human
ggaccgagggccuuggccac

SEQ ID NO: 887741 - RNA, 23 nt, Human
ggagcaaaggcccagagggcaag

SEQ ID NO: 887742 - RNA, 23 nt, Human
ggagcugcuggaagggaugacac

SEQ ID NO: 887743 - RNA, 24 nt, Human
ggagggagggaggcagacaggagg

SEQ ID NO: 887744 - RNA, 21 nt, Human
ggcacagcugccaaguuuugg

SEQ ID NO: 887745 - RNA, 24 nt, Human
ggccaggcucccaaacacaccccc

SEQ ID NO: 887746 - RNA, 23 nt, Human
ggccccagagccacccagccggc

SEQ ID NO: 887747 - RNA, 22 nt, Human
ggccgggcacccagcgggggag

SEQ ID NO: 887748 - RNA, 22 nt, Human
ggccugagccuguggauacucc

SEQ ID NO: 887749 - RNA, 25 nt, Human
ggccugcgcccucuuugcagaaacc

SEQ ID NO: 887750 - RNA, 20 nt, Human
ggcgacgcgcucgccggccc

SEQ ID NO: 887751 - RNA, 19 nt, Human
ggcugcagggaaggcuaag

SEQ ID NO: 887752 - RNA, 23 nt, Human
ggcugcagggaaggcuaagccag

SEQ ID NO: 887753 - RNA, 23 nt, Human
ggcugggguggggcggggggugg

SEQ ID NO: 887754 - RNA, 21 nt, Human
gggaggggcugcccugaggug

SEQ ID NO: 887755 - RNA, 19 nt, Human
gggcagcugggaagcugag

SEQ ID NO: 887756 - RNA, 22 nt, Human
gggcugggguggggcggggggu

SEQ ID NO: 887757 - RNA, 19 nt, Human
ggggaggggcugcagggaa

SEQ ID NO: 887758 - RNA, 21 nt, Human
ggggaggggcugcagggaagg

SEQ ID NO: 887759 - RNA, 19 nt, Human
ggggcugggguggggcggg

SEQ ID NO: 887760 - RNA, 21 nt, Human
gggggugacagaacuguaucu

SEQ ID NO: 887761 - RNA, 21 nt, Human
gggugcggggaggggcauggc

SEQ ID NO: 887762 - RNA, 24 nt, Human
gguagaggguggggccaagaaggg

SEQ ID NO: 887763 - RNA, 23 nt, Human
gucccugugcuuggcacagaccu

SEQ ID NO: 887764 - RNA, 21 nt, Human
gucggcucgggccgggacugc

SEQ ID NO: 887765 - RNA, 23 nt, Human
gugcggggaggggcauggccuga

SEQ ID NO: 887766 - RNA, 25 nt, Human
gugggugcggggaggggcauggccu

SEQ ID NO: 887767 - RNA, 18 nt, Human
gugugggccugcaugggu

SEQ ID NO: 887768 - RNA, 20 nt, Human
uaacuucucagaaguucccu

SEQ ID NO: 887769 - RNA, 20 nt, Human
uaagcccaaagcaaaaugag

SEQ ID NO: 887770 - RNA, 22 nt, Human
uaaguaagcccaaagcaaaaug

SEQ ID NO: 887771 - RNA, 24 nt, Human
uacauggccauaaacacaccaucc

SEQ ID NO: 887772 - RNA, 22 nt, Human
uauggaugccuaagcccccacc

SEQ ID NO: 887773 - RNA, 18 nt, Human
ucagcucucgugcccucc

SEQ ID NO: 887774 - RNA, 22 nt, Human
ucagggcaccuucugacagugu

SEQ ID NO: 887775 - RNA, 23 nt, Human
uccaccccaccccaagcucaaac

SEQ ID NO: 887776 - RNA, 26 nt, Human
uccaccccaccccaagcucaaaccca

SEQ ID NO: 887777 - RNA, 23 nt, Human
uccacuucacaaccaggacccac

SEQ ID NO: 887778 - RNA, 19 nt, Human
uccagccucucucccucuc

SEQ ID NO: 887779 - RNA, 21 nt, Human
uccagccuggaugagcugacg

SEQ ID NO: 887780 - RNA, 18 nt, Human
ucccaccaagaagacauu

SEQ ID NO: 887781 - RNA, 22 nt, Human
ucccagagauuuccguuugggg

SEQ ID NO: 887782 - RNA, 18 nt, Human
ucccauggcccuccagcc

SEQ ID NO: 887783 - RNA, 22 nt, Human
uccccagccccgggcuggccuc

SEQ ID NO: 887784 - RNA, 19 nt, Human
ucccccuacaucugggccu

SEQ ID NO: 887785 - RNA, 19 nt, Human
ucccccuuucccuccucag

SEQ ID NO: 887786 - RNA, 23 nt, Human
ucccuccucuccuugcgccuccc

SEQ ID NO: 887787 - RNA, 23 nt, Human
ucccuggaggaaggcuccagccc

SEQ ID NO: 887788 - RNA, 19 nt, Human
uccucaccugagaaggccc

SEQ ID NO: 887789 - RNA, 18 nt, Human
ucugcucccaacacacau

SEQ ID NO: 887790 - RNA, 23 nt, Human
ucugggccacauccacuccagga

SEQ ID NO: 887791 - RNA, 24 nt, Human
ucugggccacauccacuccaggaa

SEQ ID NO: 887792 - RNA, 21 nt, Human
ugaaaccaugagacccaccuc

SEQ ID NO: 887793 - RNA, 23 nt, Human
ugaagacaccacccuaccccggc

SEQ ID NO: 887794 - RNA, 19 nt, Human
ugaagggauggaccaagag

SEQ ID NO: 887795 - RNA, 20 nt, Human
ugacauguguggucucccuc

SEQ ID NO: 887796 - RNA, 19 nt, Human
ugaccuggccacucccccu

SEQ ID NO: 887797 - RNA, 20 nt, Human
ugacggagauuggcaugggg

SEQ ID NO: 887798 - RNA, 22 nt, Human
ugaggcaaggaguaggacuccu

SEQ ID NO: 887799 - RNA, 23 nt, Human
ugaggcagagcacuucuaggggc

SEQ ID NO: 887800 - RNA, 21 nt, Human
ugaggccccgccagcuggagg

SEQ ID NO: 887801 - RNA, 20 nt, Human
ugccaagacagacuggggcu

SEQ ID NO: 887802 - RNA, 19 nt, Human
ugcccaggcaggggaggcg

SEQ ID NO: 887803 - RNA, 19 nt, Human
ugcccuagagccccguugc

SEQ ID NO: 887804 - RNA, 20 nt, Human
ugccuaagcccccaccugcc

SEQ ID NO: 887805 - RNA, 21 nt, Human
ugccucacacccguccccuga

SEQ ID NO: 887806 - RNA, 18 nt, Human
ugccucccacccacuccc

SEQ ID NO: 887807 - RNA, 20 nt, Human
ugcuccugacuccacauccc

SEQ ID NO: 887808 - RNA, 20 nt, Human
ugcuuccuccugggagagcu

SEQ ID NO: 887809 - RNA, 21 nt, Human
uggccauaaacacaccauccc

SEQ ID NO: 887810 - RNA, 19 nt, Human
uggccaugcagacaggcgc

SEQ ID NO: 887811 - RNA, 18 nt, Human
uggccugccugaccuggc

SEQ ID NO: 887812 - RNA, 21 nt, Human
uggcuuugguuucuggcacag

SEQ ID NO: 887813 - RNA, 20 nt, Human
ugggaauggguaccaagggg

SEQ ID NO: 887814 - RNA, 28 nt, Human
ugggaauggguaccaaggggguguguag

SEQ ID NO: 887815 - RNA, 21 nt, Human
ugggacacaggcuccacccaa

SEQ ID NO: 887816 - RNA, 23 nt, Human
ugggacacaggcuccacccaagc

SEQ ID NO: 887817 - RNA, 19 nt, Human
ugggccccuggcuugacag

SEQ ID NO: 887818 - RNA, 20 nt, Human
uggggaaugcuuccuccugg

SEQ ID NO: 887819 - RNA, 24 nt, Human
uggggaggggcugcagggaaggcu

SEQ ID NO: 887820 - RNA, 21 nt, Human
uggggccugaggggcugccag

SEQ ID NO: 887821 - RNA, 23 nt, Human
ugggggcugugggcgcagggagg

SEQ ID NO: 887822 - RNA, 18 nt, Human
ugggguagaggguggggc

SEQ ID NO: 887823 - RNA, 22 nt, Human
ugggguagaggguggggccaag

SEQ ID NO: 887824 - RNA, 23 nt, Human
ugggguggggaaugcuuccuccu

SEQ ID NO: 887825 - RNA, 20 nt, Human
ugggguggggcggggggugg

SEQ ID NO: 887826 - RNA, 18 nt, Human
uggguuuuagggaccagc

SEQ ID NO: 887827 - RNA, 25 nt, Human
ugguugacuugcccuuuguuuuuuu

SEQ ID NO: 887828 - RNA, 20 nt, Human
ugucagaagccugaagggau

SEQ ID NO: 887829 - RNA, 26 nt, Human
ugugaucaaggcaucuggccagcacc

SEQ ID NO: 887830 - RNA, 18 nt, Human
uguggggccugaggggcu

SEQ ID NO: 887831 - RNA, 19 nt, Human
uguuggggaggggcugcag

SEQ ID NO: 887832 - RNA, 20 nt, Human
uucaugguggcgacgcgcuc

SEQ ID NO: 887833 - RNA, 19 nt, Human
uucccuggaggaaggcucc

SEQ ID NO: 887834 - RNA, 22 nt, Human
uuccguuugggguuugggguuu

SEQ ID NO: 887835 - RNA, 20 nt, Human
uucucaaaaugccuugguug

SEQ ID NO: 887836 - RNA, 20 nt, Human
uugggguuugggguuuggag

SEQ ID NO: 887837 - RNA, 18 nt, Human
uuugaaguccuuuauugu

SEQ ID NO: 887838 - RNA, 22 nt, Human
uuugcagaaaccucaacacuua

SEQ ID NO: 887839 - RNA, 24 nt, Human
uuuggaggaguuugugaaauggga

SEQ ID NO: 887840 - RNA, 25 nt, Human
uuuguugcaagaagcaucauucuuu

SEQ ID NO: 887841 - RNA, 21 nt, Human
uuuuccgccugccuggcccca

SEQ ID NO: 887842 - RNA, 23 nt, Human
uuuuucuuuucugaauccaauau

SEQ ID NO: 887843 - RNA, 20 nt, Human
acugaaagggaauguuccac

SEQ ID NO: 887844 - RNA, 19 nt, Human
uccaguaguucugggcaca

SEQ ID NO: 887845 - RNA, 18 nt, Human
uuccaguaguucugggca

SEQ ID NO: 887846 - RNA, 21 nt, Human
uuuuuuuuuuuuuuuuuauuu

SEQ ID NO: 887847 - RNA, 22 nt, Human
aaaaaaaaggcuuugcagauga

SEQ ID NO: 887848 - RNA, 20 nt, Human
aaaaaaaggcuuugcagaug

SEQ ID NO: 887849 - RNA, 22 nt, Human
aaaagaccaaagccuauaauca

SEQ ID NO: 887850 - RNA, 21 nt, Human
accacaguuuauacauucguc

SEQ ID NO: 887851 - RNA, 23 nt, Human
acuuuuaaagagcaaaaaaaaaa

SEQ ID NO: 887852 - RNA, 18 nt, Human
agacuuuuagcaacaccu

SEQ ID NO: 887853 - RNA, 18 nt, Human
aggaguuuuuuacuucau

SEQ ID NO: 887854 - RNA, 18 nt, Human
aggcuuugcagaugaaaa

SEQ ID NO: 887855 - RNA, 25 nt, Human
augacaugaaaagaguuuagaacac

SEQ ID NO: 887856 - RNA, 19 nt, Human
auuagauuaacacuuugcu

SEQ ID NO: 887857 - RNA, 22 nt, Human
cccacacucacaaugucugaga

SEQ ID NO: 887858 - RNA, 27 nt, Human
ccuauaaucaaaacaugaccggggucc

SEQ ID NO: 887859 - RNA, 18 nt, Human
ccuccccaaccugccacu

SEQ ID NO: 887860 - RNA, 18 nt, Human
cugccacuuggcccaggc

SEQ ID NO: 887861 - RNA, 21 nt, Human
cuugaggaccgagcuuggggc

SEQ ID NO: 887862 - RNA, 19 nt, Human
cuuugcagccauccucccc

SEQ ID NO: 887863 - RNA, 22 nt, Human
gagcaaaaaaaaaaaaggcuuu

SEQ ID NO: 887864 - RNA, 20 nt, Human
gccaaacuguuuucaaaagu

SEQ ID NO: 887865 - RNA, 23 nt, Human
gcccaggcaaucacuaaucuaau

SEQ ID NO: 887866 - RNA, 22 nt, Human
ggaaacugccaaacuguuuuca

SEQ ID NO: 887867 - RNA, 18 nt, Human
ggaauucuggaguccuaa

SEQ ID NO: 887868 - RNA, 23 nt, Human
uaacacuacagauuaguuugcca

SEQ ID NO: 887869 - RNA, 22 nt, Human
uaacuuuauaggaaacugccaa

SEQ ID NO: 887870 - RNA, 19 nt, Human
uagcaacaccuuuaauggc

SEQ ID NO: 887871 - RNA, 21 nt, Human
uagcaacaccuuuaauggcua

SEQ ID NO: 887872 - RNA, 25 nt, Human
uaucagaaaggugaauuuuauccuc

SEQ ID NO: 887873 - RNA, 24 nt, Human
ucccacacucacaaugucugagaa

SEQ ID NO: 887874 - RNA, 22 nt, Human
uccccaaccugccacuuggccc

SEQ ID NO: 887875 - RNA, 18 nt, Human
uccuucaacaaugucugc

SEQ ID NO: 887876 - RNA, 21 nt, Human
uccuucaacaaugucugccaa

SEQ ID NO: 887877 - RNA, 21 nt, Human
ucugccacacaggaguuuuuu

SEQ ID NO: 887878 - RNA, 25 nt, Human
ugaaaagaccaaagccuauaaucaa

SEQ ID NO: 887879 - RNA, 18 nt, Human
ugcagccauccuccccaa

SEQ ID NO: 887880 - RNA, 21 nt, Human
uuaaagagcaaaaaaaaaaaa

SEQ ID NO: 887881 - RNA, 24 nt, Human
uucccacacucacaaugucugaga

SEQ ID NO: 887882 - RNA, 24 nt, Human
uucuuugcagccauccuccccaac

SEQ ID NO: 887883 - RNA, 19 nt, Human
uuugcagccauccucccca

SEQ ID NO: 887884 - RNA, 18 nt, Human
uuuuacuuucugccacac

SEQ ID NO: 887885 - RNA, 25 nt, Human
uuuuauaaucacguuuauugaggcu

SEQ ID NO: 887886 - RNA, 24 nt, Human
aagacuuuuaaaaaacacaaagca

SEQ ID NO: 887887 - RNA, 25 nt, Human
acaaagcacuuuguaaauauaaagc

SEQ ID NO: 887888 - RNA, 23 nt, Human
accggaguaaagggagggcuggu

SEQ ID NO: 887889 - RNA, 18 nt, Human
aguaaagggagggcugaa

SEQ ID NO: 887890 - RNA, 24 nt, Human
aguaaagggagggcugaagaaaga

SEQ ID NO: 887891 - RNA, 24 nt, Human
uguaaauauaaagcaccggaguaa

SEQ ID NO: 887892 - RNA, 18 nt, Human
accaagauggcaggugug

SEQ ID NO: 887893 - RNA, 18 nt, Human
cagcggcugcgccguggc

SEQ ID NO: 887894 - RNA, 19 nt, Human
cgcgccccgcugcgccggg

SEQ ID NO: 887895 - RNA, 18 nt, Human
cgggcuccgcagcggcgg

SEQ ID NO: 887896 - RNA, 24 nt, Human
cgggcuccgcagcggcggcugggg

SEQ ID NO: 887897 - RNA, 22 nt, Human
cggggggucccggcgggcuccg

SEQ ID NO: 887898 - RNA, 21 nt, Human
cucggccuccgccuccgcggc

SEQ ID NO: 887899 - RNA, 21 nt, Human
gccgggccugggcccggggcg

SEQ ID NO: 887900 - RNA, 21 nt, Human
gggccgggccugggcccgggg

SEQ ID NO: 887901 - RNA, 19 nt, Human
uagcucaugaccaagauga

SEQ ID NO: 887902 - RNA, 19 nt, Human
uccgcagcggcggcugggg

SEQ ID NO: 887903 - RNA, 18 nt, Human
ugaccaagauggcaggug

SEQ ID NO: 887904 - RNA, 21 nt, Human
ugggaggggaaguguguggcc

SEQ ID NO: 887905 - RNA, 20 nt, Human
aaacagcucaguucagggac

SEQ ID NO: 887906 - RNA, 24 nt, Human
aauagcuauccagggauggacagc

SEQ ID NO: 887907 - RNA, 21 nt, Human
acccaucucagccucucaucc

SEQ ID NO: 887908 - RNA, 22 nt, Human
accucagggccuggcagcuuca

SEQ ID NO: 887909 - RNA, 19 nt, Human
agacaaacccacacuuccc

SEQ ID NO: 887910 - RNA, 22 nt, Human
aggaagggggucuuggcugccu

SEQ ID NO: 887911 - RNA, 18 nt, Human
aggaguuuuucccaguca

SEQ ID NO: 887912 - RNA, 22 nt, Human
aggccuccagcuauggggucca

SEQ ID NO: 887913 - RNA, 18 nt, Human
aucucagccucucaucca

SEQ ID NO: 887914 - RNA, 22 nt, Human
augaaagccuucuggguggagc

SEQ ID NO: 887915 - RNA, 23 nt, Human
auggcaacuagagggccugaaac

SEQ ID NO: 887916 - RNA, 20 nt, Human
cacccuaaucugggcuucug

SEQ ID NO: 887917 - RNA, 25 nt, Human
cauccagcugaggcucuggccacac

SEQ ID NO: 887918 - RNA, 22 nt, Human
ccacaggccuccagcuaugggg

SEQ ID NO: 887919 - RNA, 19 nt, Human
ccacccaucucagccucuc

SEQ ID NO: 887920 - RNA, 25 nt, Human
cccacacuucccacagcuccucaca

SEQ ID NO: 887921 - RNA, 22 nt, Human
ccccccguagcacuccuagggc

SEQ ID NO: 887922 - RNA, 19 nt, Human
ccccggagacuggcacgga

SEQ ID NO: 887923 - RNA, 18 nt, Human
cccggacacgccgcccca

SEQ ID NO: 887924 - RNA, 18 nt, Human
cccguagcacuccuaggg

SEQ ID NO: 887925 - RNA, 19 nt, Human
cccguagcacuccuagggc

SEQ ID NO: 887926 - RNA, 22 nt, Human
ccucagggccuggcagcuucag

SEQ ID NO: 887927 - RNA, 20 nt, Human
cggccccccguagcacuccu

SEQ ID NO: 887928 - RNA, 20 nt, Human
cggcccgggcaaggcuccgg

SEQ ID NO: 887929 - RNA, 21 nt, Human
cucagccucucauccagcuga

SEQ ID NO: 887930 - RNA, 23 nt, Human
cugaggcucuggccacaccgugc

SEQ ID NO: 887931 - RNA, 22 nt, Human
cuggaggcuucugcaaggaugg

SEQ ID NO: 887932 - RNA, 20 nt, Human
cuggcagcuucaggcuggcg

SEQ ID NO: 887933 - RNA, 21 nt, Human
cuggcgccccucggcggacgu

SEQ ID NO: 887934 - RNA, 19 nt, Human
cuucaggcuggcgccccuc

SEQ ID NO: 887935 - RNA, 21 nt, Human
cuugaagcaaaaauuaaacac

SEQ ID NO: 887936 - RNA, 21 nt, Human
gcaacuagagggccugaaacc

SEQ ID NO: 887937 - RNA, 20 nt, Human
gcagcagggaaggaguuuuu

SEQ ID NO: 887938 - RNA, 20 nt, Human
gccccgaauccagggacggg

SEQ ID NO: 887939 - RNA, 26 nt, Human
gccccgaauccagggacggggcagcg

SEQ ID NO: 887940 - RNA, 21 nt, Human
gccccgcuugcugcguccagc

SEQ ID NO: 887941 - RNA, 21 nt, Human
gccgggggcccggacacgccg

SEQ ID NO: 887942 - RNA, 18 nt, Human
gcggacguggcuggcaug

SEQ ID NO: 887943 - RNA, 18 nt, Human
gcugccucccacucuuag

SEQ ID NO: 887944 - RNA, 26 nt, Human
gcuucuggcaccacaggccuccagcu

SEQ ID NO: 887945 - RNA, 22 nt, Human
ggacugguguacaagcuggcca

SEQ ID NO: 887946 - RNA, 20 nt, Human
ggccuggcagcuucaggcug

SEQ ID NO: 887947 - RNA, 23 nt, Human
ggccuucucccaucugugauggc

SEQ ID NO: 887948 - RNA, 20 nt, Human
ggggcagguccugcuacaga

SEQ ID NO: 887949 - RNA, 20 nt, Human
gucauggcaacuagagggcc

SEQ ID NO: 887950 - RNA, 22 nt, Human
gucauggcaacuagagggccug

SEQ ID NO: 887951 - RNA, 18 nt, Human
gugauggcuucagcaagg

SEQ ID NO: 887952 - RNA, 21 nt, Human
uaaacagcucaguucagggac

SEQ ID NO: 887953 - RNA, 20 nt, Human
uacugugaguggugguggag

SEQ ID NO: 887954 - RNA, 19 nt, Human
uagggcuccuggacggggg

SEQ ID NO: 887955 - RNA, 23 nt, Human
ucacucccagcagaguacaaaug

SEQ ID NO: 887956 - RNA, 20 nt, Human
ucagcagcagggaaggaguu

SEQ ID NO: 887957 - RNA, 20 nt, Human
uccagggauggacagccacc

SEQ ID NO: 887958 - RNA, 19 nt, Human
ucccacagcuccucacaga

SEQ ID NO: 887959 - RNA, 21 nt, Human
uccucacagagggguaggggu

SEQ ID NO: 887960 - RNA, 23 nt, Human
uccuggaggcuucugcaaggaug

SEQ ID NO: 887961 - RNA, 22 nt, Human
ucucuucuguucuggagacaaa

SEQ ID NO: 887962 - RNA, 26 nt, Human
ugcaaguggcuucuaguuccgaccac

SEQ ID NO: 887963 - RNA, 23 nt, Human
ugccgggggcccggacacgccgc

SEQ ID NO: 887964 - RNA, 23 nt, Human
ugcgaggacggggagcuugggga

SEQ ID NO: 887965 - RNA, 24 nt, Human
ugcgaggacggggagcuuggggac

SEQ ID NO: 887966 - RNA, 19 nt, Human
ugcugcguccagccccgaa

SEQ ID NO: 887967 - RNA, 22 nt, Human
uggagacaaacccacacuuccc

SEQ ID NO: 887968 - RNA, 19 nt, Human
uggcaccacaggccuccag

SEQ ID NO: 887969 - RNA, 19 nt, Human
uggcacggacgcguggguc

SEQ ID NO: 887970 - RNA, 18 nt, Human
uggcucugcaagaugaag

SEQ ID NO: 887971 - RNA, 19 nt, Human
ugggaaaguccccggagac

SEQ ID NO: 887972 - RNA, 20 nt, Human
ugggaaaguccccggagacc

SEQ ID NO: 887973 - RNA, 21 nt, Human
ugggcuucuggcaccacaggc

SEQ ID NO: 887974 - RNA, 25 nt, Human
uggugguggagagggccccagagcc

SEQ ID NO: 887975 - RNA, 19 nt, Human
ugugauggcuucagcaagg

SEQ ID NO: 887976 - RNA, 24 nt, Human
uugaagcaaaaauuaaacacacac

SEQ ID NO: 887977 - RNA, 20 nt, Human
uuggauuuauguccaugauu

SEQ ID NO: 887978 - RNA, 21 nt, Human
caggaaagcacuggcguggug

SEQ ID NO: 887979 - RNA, 23 nt, Human
gauuuuggcucggaaaggagaac

SEQ ID NO: 887980 - RNA, 23 nt, Human
gcuaggagcuccucuuuccaucu

SEQ ID NO: 887981 - RNA, 18 nt, Human
gcucggaaaggagaacca

SEQ ID NO: 887982 - RNA, 22 nt, Human
ggagaaccagcccuaccccggc

SEQ ID NO: 887983 - RNA, 27 nt, Human
ggagaaccagcccuaccccggcuuaag

SEQ ID NO: 887984 - RNA, 23 nt, Human
uaagugagcuaggagcuccucuu

SEQ ID NO: 887985 - RNA, 20 nt, Human
ugagcuaggagcuccucuuu

SEQ ID NO: 887986 - RNA, 20 nt, Human
uuggcucggaaaggagaacc

SEQ ID NO: 887987 - RNA, 24 nt, Human
aaaaaaaucaaaauaauacaaaua

SEQ ID NO: 887988 - RNA, 22 nt, Human
aacugcucucccucacauagaa

SEQ ID NO: 887989 - RNA, 22 nt, Human
aagagaaagaagagauaaagug

SEQ ID NO: 887990 - RNA, 24 nt, Human
aagcagagaagcuacugcaugugg

SEQ ID NO: 887991 - RNA, 19 nt, Human
aagggggagaguaggaggg

SEQ ID NO: 887992 - RNA, 21 nt, Human
aagugggacuaagagaaagag

SEQ ID NO: 887993 - RNA, 19 nt, Human
acagcacacugcaggcccc

SEQ ID NO: 887994 - RNA, 18 nt, Human
acucuuagaaauguagaa

SEQ ID NO: 887995 - RNA, 23 nt, Human
agaaaaccuaaucacaccagcuc

SEQ ID NO: 887996 - RNA, 20 nt, Human
agaaagaagagauaaagugg

SEQ ID NO: 887997 - RNA, 22 nt, Human
agaacaaagacacaguuccuuu

SEQ ID NO: 887998 - RNA, 20 nt, Human
agagaaagggggagaguagg

SEQ ID NO: 887999 - RNA, 19 nt, Human
agaguaggagggagagggg

SEQ ID NO: 888000 - RNA, 20 nt, Human
aggagggagaggggaaaagg

SEQ ID NO: 888001 - RNA, 21 nt, Human
aggagggagaggggaaaagga

SEQ ID NO: 888002 - RNA, 21 nt, Human
aggagggagaggggaaaagga

SEQ ID NO: 888003 - RNA, 23 nt, Human
agggaagagaggaagaacaaaga

SEQ ID NO: 888004 - RNA, 19 nt, Human
cacagagggugcuaggagc

SEQ ID NO: 888005 - RNA, 20 nt, Human
cagaaacccaacugcucucc

SEQ ID NO: 888006 - RNA, 18 nt, Human
cagagggugcuaggagcc

SEQ ID NO: 888007 - RNA, 19 nt, Human
cagcacacugcaggccccc

SEQ ID NO: 888008 - RNA, 28 nt, Human
cagcaccacagacuugccaauucagcca

SEQ ID NO: 888009 - RNA, 19 nt, Human
cauguggacugacuugacu

SEQ ID NO: 888010 - RNA, 19 nt, Human
cccaaagagcagcaccaca

SEQ ID NO: 888011 - RNA, 24 nt, Human
ccccagcccuaaucuaucaggauc

SEQ ID NO: 888012 - RNA, 25 nt, Human
cgagcgucuccccaaguaaaauucu

SEQ ID NO: 888013 - RNA, 19 nt, Human
cuuagaauccccuucccag

SEQ ID NO: 888014 - RNA, 24 nt, Human
gacacaguuccuuuaaacaucagg

SEQ ID NO: 888015 - RNA, 19 nt, Human
gagagaaagggggagagua

SEQ ID NO: 888016 - RNA, 20 nt, Human
gcaugugcaugcauugugug

SEQ ID NO: 888017 - RNA, 21 nt, Human
ggagaggggaaaaggaggagg

SEQ ID NO: 888018 - RNA, 21 nt, Human
ggaggagagaaagggggagag

SEQ ID NO: 888019 - RNA, 20 nt, Human
ggcaacggaugggacacauc

SEQ ID NO: 888020 - RNA, 21 nt, Human
gggaauaaaaggacaaguagc

SEQ ID NO: 888021 - RNA, 23 nt, Human
gggagaggggaaaaggaggaggg

SEQ ID NO: 888022 - RNA, 18 nt, Human
ggggaaaaggaggaggga

SEQ ID NO: 888023 - RNA, 22 nt, Human
ggggagaguaggagggagaggg

SEQ ID NO: 888024 - RNA, 22 nt, Human
guagaaucuugggcagcacccc

SEQ ID NO: 888025 - RNA, 18 nt, Human
gugcaugcauugugugga

SEQ ID NO: 888026 - RNA, 20 nt, Human
guuccuuuaaacaucagggc

SEQ ID NO: 888027 - RNA, 19 nt, Human
uaaaauucuggccgccaca

SEQ ID NO: 888028 - RNA, 22 nt, Human
uaaaauucuggccgccacacau

SEQ ID NO: 888029 - RNA, 18 nt, Human
uaagagaaagagggaaga

SEQ ID NO: 888030 - RNA, 22 nt, Human
uaaggggagggaaaggcaaaga

SEQ ID NO: 888031 - RNA, 23 nt, Human
uaaucacaccagcucacucaagc

SEQ ID NO: 888032 - RNA, 22 nt, Human
ucuggaaaaccccuaccacaga

SEQ ID NO: 888033 - RNA, 21 nt, Human
ucuugggcagcaccccagccc

SEQ ID NO: 888034 - RNA, 18 nt, Human
ugaucaggugcggcaggc

SEQ ID NO: 888035 - RNA, 24 nt, Human
ugaugggaaauggcuuagaauccc

SEQ ID NO: 888036 - RNA, 22 nt, Human
ugcaggaagccgucugcagaga

SEQ ID NO: 888037 - RNA, 21 nt, Human
ugccaccgucauccagggacu

SEQ ID NO: 888038 - RNA, 22 nt, Human
uggcuuagaauccccuucccag

SEQ ID NO: 888039 - RNA, 19 nt, Human
ugggaagggaauaaaagga

SEQ ID NO: 888040 - RNA, 18 nt, Human
ugggcagcaccccagccc

SEQ ID NO: 888041 - RNA, 22 nt, Human
ugggcagcaccccagcccuaau

SEQ ID NO: 888042 - RNA, 24 nt, Human
ugguuuauggucugugggaaggga

SEQ ID NO: 888043 - RNA, 22 nt, Human
uuagccuaaacauguggacuga

SEQ ID NO: 888044 - RNA, 26 nt, Human
uuccaaaugggaauuuauuucaaaga

SEQ ID NO: 888045 - RNA, 18 nt, Human
uuuuuuuuuuuuuuuuug

SEQ ID NO: 888046 - RNA, 21 nt, Human
aaaaggagaaaggaagcaaaa

SEQ ID NO: 888047 - RNA, 24 nt, Human
aagacuccuuccuuucagacccag

SEQ ID NO: 888048 - RNA, 20 nt, Human
auuuucuucuauguuuguuu

SEQ ID NO: 888049 - RNA, 23 nt, Human
gcaaaagacuccuuccuuucaga

SEQ ID NO: 888050 - RNA, 19 nt, Human
ggaggggguggagccggga

SEQ ID NO: 888051 - RNA, 21 nt, Human
ugagcuuggaggggguggagc

SEQ ID NO: 888052 - RNA, 21 nt, Human
caacauccgacgacgccggcu

SEQ ID NO: 888053 - RNA, 18 nt, Human
ccgcccgccccgagcucg

SEQ ID NO: 888054 - RNA, 22 nt, Human
cuucggccacgcgggcuccgcc

SEQ ID NO: 888055 - RNA, 23 nt, Human
ugggaaaacuuuauuagguuugg

SEQ ID NO: 888056 - RNA, 25 nt, Human
ugguuuccagcuucggccacgcggg

SEQ ID NO: 888057 - RNA, 21 nt, Human
uuagguuugguuuccagcuuc

SEQ ID NO: 888058 - RNA, 19 nt, Human
aaacaucuagcccagcaau

SEQ ID NO: 888059 - RNA, 20 nt, Human
aaucauggcuaaaacaucua

SEQ ID NO: 888060 - RNA, 21 nt, Human
cacaggcaguucaccaacacc

SEQ ID NO: 888061 - RNA, 23 nt, Human
caccuggaaaaucgaugacuuca

SEQ ID NO: 888062 - RNA, 18 nt, Human
cagguugagaaagcucua

SEQ ID NO: 888063 - RNA, 20 nt, Human
cauggcuaaaacaucuagcc

SEQ ID NO: 888064 - RNA, 20 nt, Human
cuaaaacaucuagcccagca

SEQ ID NO: 888065 - RNA, 22 nt, Human
cucaauauacccgugauacaga

SEQ ID NO: 888066 - RNA, 21 nt, Human
ggagcucccaacaccuggccc

SEQ ID NO: 888067 - RNA, 19 nt, Human
gggccggggaggagaggag

SEQ ID NO: 888068 - RNA, 20 nt, Human
gggccggggaggagaggagu

SEQ ID NO: 888069 - RNA, 23 nt, Human
uaaaacagaggcagaaucauggc

SEQ ID NO: 888070 - RNA, 22 nt, Human
uagcccagcaaugaacucauua

SEQ ID NO: 888071 - RNA, 23 nt, Human
ucauauguaacaaagauaaggau

SEQ ID NO: 888072 - RNA, 18 nt, Human
ucccugagggguaggggc

SEQ ID NO: 888073 - RNA, 19 nt, Human
ucgccggcggagaugaggg

SEQ ID NO: 888074 - RNA, 22 nt, Human
ugaaugcucucaccuuuauuuc

SEQ ID NO: 888075 - RNA, 27 nt, Human
ugaaugcucucaccuuuauuucucuca

SEQ ID NO: 888076 - RNA, 22 nt, Human
ugcucucaccuuuauuucucuc

SEQ ID NO: 888077 - RNA, 18 nt, Human
uggcuaaaacaucuagcc

SEQ ID NO: 888078 - RNA, 20 nt, Human
ugugcagguauaaaacagag

SEQ ID NO: 888079 - RNA, 20 nt, Human
uucauggagaaugaaugacu

SEQ ID NO: 888080 - RNA, 20 nt, Human
uuuuuuuuuuugugaaugcu

SEQ ID NO: 888081 - RNA, 20 nt, Human
uuuuuuuuuuuuuuugugaa

SEQ ID NO: 888082 - RNA, 19 nt, Human
uuuuuuuuuuuuuuuuugu

SEQ ID NO: 888083 - RNA, 20 nt, Human
uuuuuuuuuuuuuuuuuugg

SEQ ID NO: 888084 - RNA, 19 nt, Human
aaaaaaaaaaagcacauag

SEQ ID NO: 888085 - RNA, 24 nt, Human
aaaaaaaaaaagcacauagugucu

SEQ ID NO: 888086 - RNA, 23 nt, Human
aaaaaaaagcacauagugucuaa

SEQ ID NO: 888087 - RNA, 20 nt, Human
aaaaaaaguucaaccccaaa

SEQ ID NO: 888088 - RNA, 21 nt, Human
aaaaaaaguucaaccccaaaa

SEQ ID NO: 888089 - RNA, 23 nt, Human
aaaaacaaaaacaagcaaacaaa

SEQ ID NO: 888090 - RNA, 23 nt, Human
aaaacaaaaacaagcaaacaaag

SEQ ID NO: 888091 - RNA, 19 nt, Human
aaaacugaguauaacccuu

SEQ ID NO: 888092 - RNA, 22 nt, Human
aaaauucuucugcaaaccacau

SEQ ID NO: 888093 - RNA, 24 nt, Human
aaacaaaaacaagcaaacaaacaa

SEQ ID NO: 888094 - RNA, 19 nt, Human
aaacaagcaaacaaacaac

SEQ ID NO: 888095 - RNA, 24 nt, Human
aaacaagcaaacaaacaacgaguc

SEQ ID NO: 888096 - RNA, 24 nt, Human
aacaugcgugacagaauuugugca

SEQ ID NO: 888097 - RNA, 18 nt, Human
aagaaaauacaaaaacau

SEQ ID NO: 888098 - RNA, 24 nt, Human
aagaaaauucuucugcaaaccaca

SEQ ID NO: 888099 - RNA, 21 nt, Human
aagcaaacaaacaacaaauaa

SEQ ID NO: 888100 - RNA, 19 nt, Human
aagcagaagguagacccua

SEQ ID NO: 888101 - RNA, 20 nt, Human
aagguagacccuaccacaaa

SEQ ID NO: 888102 - RNA, 23 nt, Human
aagguagacccuaccacaaagaa

SEQ ID NO: 888103 - RNA, 24 nt, Human
acacugacgucccuuaaaacuuca

SEQ ID NO: 888104 - RNA, 19 nt, Human
accauagaagcuuggggcc

SEQ ID NO: 888105 - RNA, 19 nt, Human
acuagguauuaucuacacc

SEQ ID NO: 888106 - RNA, 23 nt, Human
acuuuacaguuaacuaugucacc

SEQ ID NO: 888107 - RNA, 18 nt, Human
agaaaacagcaucaauca

SEQ ID NO: 888108 - RNA, 23 nt, Human
agaaaagaugcuuaguuaaugga

SEQ ID NO: 888109 - RNA, 23 nt, Human
agaaaauucuucugcaaaccaca

SEQ ID NO: 888110 - RNA, 20 nt, Human
agaagcacggguaagugaca

SEQ ID NO: 888111 - RNA, 18 nt, Human
agaauggaauggaaucau

SEQ ID NO: 888112 - RNA, 20 nt, Human
agcaauaagaauuagaagaa

SEQ ID NO: 888113 - RNA, 20 nt, Human
agcaggaggcggcgccgcga

SEQ ID NO: 888114 - RNA, 18 nt, Human
agcaucucguuccaaagc

SEQ ID NO: 888115 - RNA, 23 nt, Human
aggaaaaaauuacaaaaaaaaaa

SEQ ID NO: 888116 - RNA, 24 nt, Human
agguauuaucuacaccuucacuuu

SEQ ID NO: 888117 - RNA, 18 nt, Human
aguuguuaauuuucauag

SEQ ID NO: 888118 - RNA, 19 nt, Human
auagcaucucguuccaaag

SEQ ID NO: 888119 - RNA, 20 nt, Human
aucaaaaauaucugaaaaca

SEQ ID NO: 888120 - RNA, 20 nt, Human
auccucaaggccacauacau

SEQ ID NO: 888121 - RNA, 19 nt, Human
auguguuaaaaacugagua

SEQ ID NO: 888122 - RNA, 23 nt, Human
auuuuuuuuuuuuuuuuuaaaag

SEQ ID NO: 888123 - RNA, 26 nt, Human
caaaaaaaguucaaccccaaaauuaa

SEQ ID NO: 888124 - RNA, 18 nt, Human
caaaaacaaaaacaagca

SEQ ID NO: 888125 - RNA, 21 nt, Human
caaauaucggcgacuaguaug

SEQ ID NO: 888126 - RNA, 24 nt, Human
caagcaaacaaacaacaaauaacu

SEQ ID NO: 888127 - RNA, 23 nt, Human
caaggaaaaaauuacaaaaaaaa

SEQ ID NO: 888128 - RNA, 22 nt, Human
cacuacaaacaauguguucaca

SEQ ID NO: 888129 - RNA, 21 nt, Human
cacugcauuucuguaacaaag

SEQ ID NO: 888130 - RNA, 22 nt, Human
cacugcauuucuguaacaaagu

SEQ ID NO: 888131 - RNA, 23 nt, Human
cacuggcauuacaaauaggccca

SEQ ID NO: 888132 - RNA, 20 nt, Human
cacuucuauaaaaauaggag

SEQ ID NO: 888133 - RNA, 19 nt, Human
cagcagcagcgggaggagc

SEQ ID NO: 888134 - RNA, 24 nt, Human
cagcagcagcgggaggagcaggag

SEQ ID NO: 888135 - RNA, 24 nt, Human
cagcggcagcagcagcgggaggag

SEQ ID NO: 888136 - RNA, 23 nt, Human
cagcuaauccaagcggacuuaac

SEQ ID NO: 888137 - RNA, 21 nt, Human
ccucaaggccacauacauccu

SEQ ID NO: 888138 - RNA, 19 nt, Human
cgggaggagcaggaggcgg

SEQ ID NO: 888139 - RNA, 21 nt, Human
cgggaggagcaggaggcggcg

SEQ ID NO: 888140 - RNA, 23 nt, Human
cguuccaaagcugguaccuuuuc

SEQ ID NO: 888141 - RNA, 20 nt, Human
cuaccaagaaaauacaaaaa

SEQ ID NO: 888142 - RNA, 20 nt, Human
cuauaaaaauaggagccaca

SEQ ID NO: 888143 - RNA, 21 nt, Human
cuaugguuaaaaaaaaaaagc

SEQ ID NO: 888144 - RNA, 23 nt, Human
cucaaggccacauacauccugcu

SEQ ID NO: 888145 - RNA, 23 nt, Human
cugcaaaaacaaaaacaagcaaa

SEQ ID NO: 888146 - RNA, 22 nt, Human
gaagaaaccauagaagcuuggg

SEQ ID NO: 888147 - RNA, 26 nt, Human
gcaaaaacaaaaacaagcaaacaaac

SEQ ID NO: 888148 - RNA, 22 nt, Human
gcagcggcagcagcagcgggag

SEQ ID NO: 888149 - RNA, 23 nt, Human
gcaggaaaucuagaccuuccucu

SEQ ID NO: 888150 - RNA, 19 nt, Human
gcuauuauaauugguuaag

SEQ ID NO: 888151 - RNA, 18 nt, Human
ggaacuggaaaaauggca

SEQ ID NO: 888152 - RNA, 20 nt, Human
ggcaucuuuugucaaaaaua

SEQ ID NO: 888153 - RNA, 18 nt, Human
gggaggagcaggaggcgg

SEQ ID NO: 888154 - RNA, 21 nt, Human
gucacugcauuucuguaacaa

SEQ ID NO: 888155 - RNA, 19 nt, Human
uaaaaauaggagccacaca

SEQ ID NO: 888156 - RNA, 22 nt, Human
uaacaaaguaaugaaaggcaca

SEQ ID NO: 888157 - RNA, 27 nt, Human
uaacaaaguaaugaaaggcacagcuaa

SEQ ID NO: 888158 - RNA, 26 nt, Human
uaacaagauugagaaacauuauauga

SEQ ID NO: 888159 - RNA, 18 nt, Human
uaacuucugaaaaucccu

SEQ ID NO: 888160 - RNA, 19 nt, Human
uaagagcaggaaaucuaga

SEQ ID NO: 888161 - RNA, 23 nt, Human
uaagauuuucuuccucuuuuuuu

SEQ ID NO: 888162 - RNA, 25 nt, Human
uaagugacauacucauacccugaag

SEQ ID NO: 888163 - RNA, 19 nt, Human
uaauggagguuaaauuuaa

SEQ ID NO: 888164 - RNA, 24 nt, Human
uacaaaaaaaaaaaaaagguauuu

SEQ ID NO: 888165 - RNA, 21 nt, Human
uacaaaaacauaaggcuguaa

SEQ ID NO: 888166 - RNA, 18 nt, Human
uaccaagaaaauacaaaa

SEQ ID NO: 888167 - RNA, 20 nt, Human
uaccaagaaaauacaaaaac

SEQ ID NO: 888168 - RNA, 21 nt, Human
uaccaagaaaauacaaaaaca

SEQ ID NO: 888169 - RNA, 21 nt, Human
uaccucuaaaaaucaauucaa

SEQ ID NO: 888170 - RNA, 24 nt, Human
uacuucaaauuucuagaauggaau

SEQ ID NO: 888171 - RNA, 20 nt, Human
uacuucuaccugaauuggua

SEQ ID NO: 888172 - RNA, 24 nt, Human
uagcacuacaaacaauguguucaa

SEQ ID NO: 888173 - RNA, 21 nt, Human
uagcugcaaaaacaaaaacaa

SEQ ID NO: 888174 - RNA, 21 nt, Human
uagguagaacaaauuggucuu

SEQ ID NO: 888175 - RNA, 20 nt, Human
uauccucaaggccacauaca

SEQ ID NO: 888176 - RNA, 20 nt, Human
uaugguuaaaaaaaaaaagc

SEQ ID NO: 888177 - RNA, 19 nt, Human
ucaaaaauaucugaaaaca

SEQ ID NO: 888178 - RNA, 19 nt, Human
ucacugcauuucuguaaca

SEQ ID NO: 888179 - RNA, 24 nt, Human
ucagaaaggaaguuuucauuaccu

SEQ ID NO: 888180 - RNA, 23 nt, Human
ucauacuggaaauucuuaaccau

SEQ ID NO: 888181 - RNA, 18 nt, Human
uccaagcggacuuaaccc

SEQ ID NO: 888182 - RNA, 19 nt, Human
uccacccucacugucaaaa

SEQ ID NO: 888183 - RNA, 18 nt, Human
uccagggaagcagaaggu

SEQ ID NO: 888184 - RNA, 22 nt, Human
ucuaaaaagagugcugacugcc

SEQ ID NO: 888185 - RNA, 18 nt, Human
ucucuagcucuaacccaa

SEQ ID NO: 888186 - RNA, 22 nt, Human
ucugcaaaccacauccccuuua

SEQ ID NO: 888187 - RNA, 23 nt, Human
ucuuugaaguucagaaaaagcug

SEQ ID NO: 888188 - RNA, 21 nt, Human
ucuuuuuuuuuuuuuuuuaca

SEQ ID NO: 888189 - RNA, 20 nt, Human
ugaaaauaaagaaaaaaagc

SEQ ID NO: 888190 - RNA, 23 nt, Human
ugaacaaaaugcuuagugucaca

SEQ ID NO: 888191 - RNA, 20 nt, Human
ugacucagggcggcagcggc

SEQ ID NO: 888192 - RNA, 22 nt, Human
ugagguaguuagguaaacagua

SEQ ID NO: 888193 - RNA, 19 nt, Human
ugccuuaacacauccauga

SEQ ID NO: 888194 - RNA, 18 nt, Human
uggauagcacuacaaaca

SEQ ID NO: 888195 - RNA, 18 nt, Human
uggcauuacaaauaggcc

SEQ ID NO: 888196 - RNA, 19 nt, Human
uggguguggucauacugga

SEQ ID NO: 888197 - RNA, 18 nt, Human
ugucaaaaaaaguucaac

SEQ ID NO: 888198 - RNA, 19 nt, Human
ugucuuaguauaagucacu

SEQ ID NO: 888199 - RNA, 20 nt, Human
uuaaaagaaaacagcaucaa

SEQ ID NO: 888200 - RNA, 24 nt, Human
uuaaaagaaaacagcaucaaucac

SEQ ID NO: 888201 - RNA, 21 nt, Human
uuaacuaugucaccuaaaaca

SEQ ID NO: 888202 - RNA, 21 nt, Human
uuaagucucaugacuacaaua

SEQ ID NO: 888203 - RNA, 20 nt, Human
uuagguaaacaguacuaccc

SEQ ID NO: 888204 - RNA, 24 nt, Human
uuccaagaccuuaacacuaacuuc

SEQ ID NO: 888205 - RNA, 25 nt, Human
uuccaagaccuuaacacuaacuucu

SEQ ID NO: 888206 - RNA, 25 nt, Human
uucuuaaccauauaguugucuugcc

SEQ ID NO: 888207 - RNA, 24 nt, Human
uuggaacuggaaaaauggcauaaa

SEQ ID NO: 888208 - RNA, 18 nt, Human
uuuaagcaauaagaauuu

SEQ ID NO: 888209 - RNA, 24 nt, Human
uuucauagcuguacuccaagagcu

SEQ ID NO: 888210 - RNA, 27 nt, Human
uuuccacuuuaagucucaugacuacaa

SEQ ID NO: 888211 - RNA, 24 nt, Human
uuuuuuuuuuuuuuuacacuugau

SEQ ID NO: 888212 - RNA, 27 nt, Human
aaaaagaaaaacaacaacagcgaaaaa

SEQ ID NO: 888213 - RNA, 23 nt, Human
aaaaugaagcaggcacaacaaaa

SEQ ID NO: 888214 - RNA, 22 nt, Human
aaacaaaaauagaaaaagaaaa

SEQ ID NO: 888215 - RNA, 26 nt, Human
aaacaaaaauagaaaaagaaaaacaa

SEQ ID NO: 888216 - RNA, 22 nt, Human
aaaccuccacaggaaaagacuc

SEQ ID NO: 888217 - RNA, 24 nt, Human
aacacuacaagaaaaauacagaac

SEQ ID NO: 888218 - RNA, 19 nt, Human
aacacuucaccgacaaaca

SEQ ID NO: 888219 - RNA, 24 nt, Human
aagaaaaauacagaacacaaggcu

SEQ ID NO: 888220 - RNA, 26 nt, Human
aagcaggcacaacaaaauuaaaucca

SEQ ID NO: 888221 - RNA, 19 nt, Human
aagcaguggcgaccugggc

SEQ ID NO: 888222 - RNA, 20 nt, Human
acaggaaaagacucaccgaa

SEQ ID NO: 888223 - RNA, 21 nt, Human
accgaaauaucagaagcggcg

SEQ ID NO: 888224 - RNA, 23 nt, Human
acuacaagaaaaauacagaacac

SEQ ID NO: 888225 - RNA, 22 nt, Human
agaaaaacaacaacagcgaaaa

SEQ ID NO: 888226 - RNA, 23 nt, Human
agaaaaagaaaaacaacaacagc

SEQ ID NO: 888227 - RNA, 28 nt, Human
agaaaaagaaaaacaacaacagcgaaaa

SEQ ID NO: 888228 - RNA, 20 nt, Human
agaccaaaccuccacaggaa

SEQ ID NO: 888229 - RNA, 23 nt, Human
agagccggagacugcagagagcu

SEQ ID NO: 888230 - RNA, 18 nt, Human
aggagagagccggagacu

SEQ ID NO: 888231 - RNA, 23 nt, Human
aguaaacaaaaauagaaaaagaa

SEQ ID NO: 888232 - RNA, 18 nt, Human
auaaaauacaagagccua

SEQ ID NO: 888233 - RNA, 19 nt, Human
augaagcaggcacaacaaa

SEQ ID NO: 888234 - RNA, 18 nt, Human
auuaagcuacacaacacu

SEQ ID NO: 888235 - RNA, 21 nt, Human
caaaaugguaaagugaucacu

SEQ ID NO: 888236 - RNA, 20 nt, Human
caaacaaauauugaucucac

SEQ ID NO: 888237 - RNA, 21 nt, Human
caagaaaaaaacggugccgca

SEQ ID NO: 888238 - RNA, 19 nt, Human
caagaaaaauacagaacac

SEQ ID NO: 888239 - RNA, 21 nt, Human
caauaaccucaauauaacuaa

SEQ ID NO: 888240 - RNA, 25 nt, Human
cacaacacuauacuaguguuuuaaa

SEQ ID NO: 888241 - RNA, 23 nt, Human
caccgaaauaucagaagcggcgg

SEQ ID NO: 888242 - RNA, 24 nt, Human
cauccaaguuuuaaauucuacugc

SEQ ID NO: 888243 - RNA, 22 nt, Human
ccuccacaggaaaagacucacc

SEQ ID NO: 888244 - RNA, 19 nt, Human
ccugggcugggugcagagg

SEQ ID NO: 888245 - RNA, 20 nt, Human
cgacaaacaauaaccucaau

SEQ ID NO: 888246 - RNA, 20 nt, Human
cuacugcugcaagaaaaaaa

SEQ ID NO: 888247 - RNA, 22 nt, Human
cugcagugggcagaccuccucc

SEQ ID NO: 888248 - RNA, 22 nt, Human
gaaaaacaacaacagcgaaaac

SEQ ID NO: 888249 - RNA, 24 nt, Human
gaaaaacaacaacagcgaaaaccc

SEQ ID NO: 888250 - RNA, 21 nt, Human
gacaaaaagacuucagaagga

SEQ ID NO: 888251 - RNA, 22 nt, Human
gacuaaguaaacaaaaauagaa

SEQ ID NO: 888252 - RNA, 20 nt, Human
gaucacuuucaaugaaugau

SEQ ID NO: 888253 - RNA, 22 nt, Human
gcaaacuuuugaaaauacugga

SEQ ID NO: 888254 - RNA, 18 nt, Human
gcaagaaaaaaacggugc

SEQ ID NO: 888255 - RNA, 21 nt, Human
gcaguggcgaccugggcuggg

SEQ ID NO: 888256 - RNA, 19 nt, Human
gcugcagugggcagaccuc

SEQ ID NO: 888257 - RNA, 24 nt, Human
gcuguuauuaacaauaaauguagu

SEQ ID NO: 888258 - RNA, 20 nt, Human
guaauaggaaaagagaauua

SEQ ID NO: 888259 - RNA, 24 nt, Human
uaaguaaacaaaaauagaaaaaga

SEQ ID NO: 888260 - RNA, 25 nt, Human
uaauaggaaaagagaauuaaacacu

SEQ ID NO: 888261 - RNA, 26 nt, Human
uacacaacacuauacuaguguuuuaa

SEQ ID NO: 888262 - RNA, 21 nt, Human
uacaugacaaaaagacuucag

SEQ ID NO: 888263 - RNA, 19 nt, Human
ucaccgacaaacaauaacc

SEQ ID NO: 888264 - RNA, 24 nt, Human
ucacuuagcauuucugaucauuuc

SEQ ID NO: 888265 - RNA, 24 nt, Human
ucagaagcggcgguggucggaccu

SEQ ID NO: 888266 - RNA, 19 nt, Human
ucagaaggauuaagcuaca

SEQ ID NO: 888267 - RNA, 22 nt, Human
uccacaggaaaagacucaccga

SEQ ID NO: 888268 - RNA, 18 nt, Human
uccgcaagcagcuacugc

SEQ ID NO: 888269 - RNA, 25 nt, Human
uccgcaagcagcuacugcugcaaga

SEQ ID NO: 888270 - RNA, 21 nt, Human
ugaaaauacugugacuaacac

SEQ ID NO: 888271 - RNA, 25 nt, Human
ugaaagaacacgaaauaucuuuuca

SEQ ID NO: 888272 - RNA, 21 nt, Human
ugcagugggcagaccuccucc

SEQ ID NO: 888273 - RNA, 21 nt, Human
uggcuaccacagagaucggga

SEQ ID NO: 888274 - RNA, 23 nt, Human
ugugacuaacacuucaccgacaa

SEQ ID NO: 888275 - RNA, 20 nt, Human
uuaacuaacacuacaagaaa

SEQ ID NO: 888276 - RNA, 21 nt, Human
uuaguuuuugaacuuuucuua

SEQ ID NO: 888277 - RNA, 19 nt, Human
uuauucuuuuuauuuugca

SEQ ID NO: 888278 - RNA, 20 nt, Human
uuauuuaucacaguuacaua

SEQ ID NO: 888279 - RNA, 22 nt, Human
uuucagggccauguauacucug

SEQ ID NO: 888280 - RNA, 24 nt, Human
uuucagggccauguauacucugcu

SEQ ID NO: 888281 - RNA, 22 nt, Human
uuugaaaauacugugacuaaca

SEQ ID NO: 888282 - RNA, 18 nt, Human
uuuuuuuuuuuuuuuuug

SEQ ID NO: 888283 - RNA, 21 nt, Human
aaacagcaggucucagcggcu

SEQ ID NO: 888284 - RNA, 22 nt, Human
accucaaagcauuagggaagga

SEQ ID NO: 888285 - RNA, 18 nt, Human
agcagguguggggcuggg

SEQ ID NO: 888286 - RNA, 25 nt, Human
agggaaggagcagguguggggcugg

SEQ ID NO: 888287 - RNA, 24 nt, Human
aucccuaagcuccagggcccaggg

SEQ ID NO: 888288 - RNA, 22 nt, Human
cacaaagggacucagcaaagcg

SEQ ID NO: 888289 - RNA, 19 nt, Human
cagcaaagcgccugacccu

SEQ ID NO: 888290 - RNA, 19 nt, Human
cagcagaaacagcaggucu

SEQ ID NO: 888291 - RNA, 18 nt, Human
cagcaggucucagcggcu

SEQ ID NO: 888292 - RNA, 18 nt, Human
cagggcccagggucuaac

SEQ ID NO: 888293 - RNA, 23 nt, Human
cccccagcagaaacagcaggucu

SEQ ID NO: 888294 - RNA, 18 nt, Human
cccuaagcuccagggccc

SEQ ID NO: 888295 - RNA, 20 nt, Human
cccugacccugggaagacuc

SEQ ID NO: 888296 - RNA, 18 nt, Human
ccugacccugacccuggg

SEQ ID NO: 888297 - RNA, 20 nt, Human
cgggagccucccggggcugg

SEQ ID NO: 888298 - RNA, 22 nt, Human
cggggcugcaggaagcuccggg

SEQ ID NO: 888299 - RNA, 19 nt, Human
cugcagcuuccaaccaaga

SEQ ID NO: 888300 - RNA, 18 nt, Human
cuggggggcugggugggg

SEQ ID NO: 888301 - RNA, 18 nt, Human
gaagaggagccugccccc

SEQ ID NO: 888302 - RNA, 30 nt, Human
gccugacccugacccugggaagacucagcc

SEQ ID NO: 888303 - RNA, 24 nt, Human
gggaaggagcagguguggggcugg

SEQ ID NO: 888304 - RNA, 20 nt, Human
gggagccucccggggcuggg

SEQ ID NO: 888305 - RNA, 23 nt, Human
gggcacuggggggcugggugggg

SEQ ID NO: 888306 - RNA, 18 nt, Human
gggcugggggaagaggag

SEQ ID NO: 888307 - RNA, 19 nt, Human
gggcugggguggggagaau

SEQ ID NO: 888308 - RNA, 24 nt, Human
guuuuuuuuuuuuuuuuuugcaaa

SEQ ID NO: 888309 - RNA, 21 nt, Human
guuuuuuuuuuuuuuuuuugg

SEQ ID NO: 888310 - RNA, 19 nt, Human
ucagcaaagcgccugaccc

SEQ ID NO: 888311 - RNA, 24 nt, Human
uccaaccaagaaaaccucaaagca

SEQ ID NO: 888312 - RNA, 18 nt, Human
ucccuaagcuccagggcc

SEQ ID NO: 888313 - RNA, 18 nt, Human
uccgggagccucccgggg

SEQ ID NO: 888314 - RNA, 29 nt, Human
ucucucugagcagaugggacagcgaagac

SEQ ID NO: 888315 - RNA, 23 nt, Human
ugacccugacccugggaagacuc

SEQ ID NO: 888316 - RNA, 21 nt, Human
ugggacagcgaagacgggcac

SEQ ID NO: 888317 - RNA, 18 nt, Human
uuagagcuuggcucucuc

SEQ ID NO: 888318 - RNA, 22 nt, Human
aaaaaaaaaacaaaaaacaaaa

SEQ ID NO: 888319 - RNA, 26 nt, Human
aaaaaaaaaacaaaaaacaaaacaaa

SEQ ID NO: 888320 - RNA, 23 nt, Human
aaaaaaaacaaaaaacaaaacaa

SEQ ID NO: 888321 - RNA, 28 nt, Human
aaacaaaaaacaaaacaaacaaacaaac

SEQ ID NO: 888322 - RNA, 21 nt, Human
aaacaaacaaaaagguauuca

SEQ ID NO: 888323 - RNA, 29 nt, Human
aaacaaacaaaaagguauucauuacccag

SEQ ID NO: 888324 - RNA, 21 nt, Human
aaacaaacaaacaaaaaggua

SEQ ID NO: 888325 - RNA, 28 nt, Human
aacaaacaaacaaacaaacaaaaaggua

SEQ ID NO: 888326 - RNA, 20 nt, Human
aacauggagcaacuccaucu

SEQ ID NO: 888327 - RNA, 25 nt, Human
acaaaacaaacaaacaaacaaacaa

SEQ ID NO: 888328 - RNA, 26 nt, Human
acaaaacaaacaaacaaacaaacaaa

SEQ ID NO: 888329 - RNA, 18 nt, Human
acaaacaaacaaacaaac

SEQ ID NO: 888330 - RNA, 18 nt, Human
acccugacaacaaacaau

SEQ ID NO: 888331 - RNA, 23 nt, Human
acccuuaaaaaaaaaaacaaaaa

SEQ ID NO: 888332 - RNA, 24 nt, Human
acuccagccugggcaaaagaguga

SEQ ID NO: 888333 - RNA, 18 nt, Human
acugcacuccagccuggg

SEQ ID NO: 888334 - RNA, 24 nt, Human
acugcacuccagccugggcaaaag

SEQ ID NO: 888335 - RNA, 24 nt, Human
acugcacuccagccugggcaaaag

SEQ ID NO: 888336 - RNA, 20 nt, Human
agaaauauaucuguauuaga

SEQ ID NO: 888337 - RNA, 23 nt, Human
agacaauuuuccuuguaaacacc

SEQ ID NO: 888338 - RNA, 26 nt, Human
aggcagauggcuugagcuuaggaguu

SEQ ID NO: 888339 - RNA, 23 nt, Human
aggcaggcagauggcuugagcuu

SEQ ID NO: 888340 - RNA, 21 nt, Human
aguucuggaagacaauuuucc

SEQ ID NO: 888341 - RNA, 22 nt, Human
aucccagcacuuugggaggcca

SEQ ID NO: 888342 - RNA, 23 nt, Human
augucuacauauagcuuguucau

SEQ ID NO: 888343 - RNA, 24 nt, Human
auugugccacugcacuccagccug

SEQ ID NO: 888344 - RNA, 19 nt, Human
caaacaauauccccaaguc

SEQ ID NO: 888345 - RNA, 24 nt, Human
caaacaauauccccaaguccuggu

SEQ ID NO: 888346 - RNA, 27 nt, Human
caaaugucuacauauagcuuguucaua

SEQ ID NO: 888347 - RNA, 24 nt, Human
caacaaaaaaaauaaaaaaaaaau

SEQ ID NO: 888348 - RNA, 25 nt, Human
caacauggagcaacuccaucucaac

SEQ ID NO: 888349 - RNA, 31 nt, Human
caacuccaucucaacaaaaaaaauaaaaaaa

SEQ ID NO: 888350 - RNA, 19 nt, Human
cacacagaauaacccugac

SEQ ID NO: 888351 - RNA, 24 nt, Human
cacacagaauaacccugacaacaa

SEQ ID NO: 888352 - RNA, 24 nt, Human
cacagaauaacccugacaacaaac

SEQ ID NO: 888353 - RNA, 22 nt, Human
cacuccagccugggcaaaagag

SEQ ID NO: 888354 - RNA, 22 nt, Human
cacuccagccugggcaaaagag

SEQ ID NO: 888355 - RNA, 24 nt, Human
cacuccagccugggcaaaagagug

SEQ ID NO: 888356 - RNA, 19 nt, Human
cacugcacuccagccuggg

SEQ ID NO: 888357 - RNA, 21 nt, Human
cacugcacuccagccugggca

SEQ ID NO: 888358 - RNA, 22 nt, Human
cacugcacuccagccugggcaa

SEQ ID NO: 888359 - RNA, 23 nt, Human
cacugcacuccagccugggcaaa

SEQ ID NO: 888360 - RNA, 18 nt, Human
cagagaggacugaagaua

SEQ ID NO: 888361 - RNA, 24 nt, Human
cagcacuuugggaggccaaggcag

SEQ ID NO: 888362 - RNA, 25 nt, Human
cagcacuuugggaggccaaggcagg

SEQ ID NO: 888363 - RNA, 18 nt, Human
cauuaauaaaaaugaggu

SEQ ID NO: 888364 - RNA, 27 nt, Human
cauucuucccuuucagcuaaguuuuca

SEQ ID NO: 888365 - RNA, 20 nt, Human
ccacugcacuccagccuggg

SEQ ID NO: 888366 - RNA, 20 nt, Human
ccacugcacuccagccuggg

SEQ ID NO: 888367 - RNA, 21 nt, Human
ccacugcacuccagccugggc

SEQ ID NO: 888368 - RNA, 24 nt, Human
ccacugcacuccagccugggcaaa

SEQ ID NO: 888369 - RNA, 26 nt, Human
cccugacaacaaacaauauccccaag

SEQ ID NO: 888370 - RNA, 22 nt, Human
ccucaccgugggcaggaagggu

SEQ ID NO: 888371 - RNA, 21 nt, Human
ccugacaacaaacaauauccc

SEQ ID NO: 888372 - RNA, 30 nt, Human
cggauaucccuaaucuauucccaaguccuu

SEQ ID NO: 888373 - RNA, 20 nt, Human
cuaaaggauacaagcugcaa

SEQ ID NO: 888374 - RNA, 18 nt, Human
cucaagauagaaacuuac

SEQ ID NO: 888375 - RNA, 21 nt, Human
cucauucuuacaauguuagaa

SEQ ID NO: 888376 - RNA, 22 nt, Human
cugacaacaaacaauaucccca

SEQ ID NO: 888377 - RNA, 21 nt, Human
cugacguggagagagggugac

SEQ ID NO: 888378 - RNA, 21 nt, Human
cuuguaaacaccaaguuuugc

SEQ ID NO: 888379 - RNA, 18 nt, Human
gagccgugauugugccac

SEQ ID NO: 888380 - RNA, 21 nt, Human
gauugugccacugcacuccag

SEQ ID NO: 888381 - RNA, 22 nt, Human
gccacugcacuccagccugggc

SEQ ID NO: 888382 - RNA, 24 nt, Human
gccacugcacuccagccugggcaa

SEQ ID NO: 888383 - RNA, 23 nt, Human
ggaaaaagaaaauguauaaaugu

SEQ ID NO: 888384 - RNA, 21 nt, Human
ggcaggaagggugaaggaggc

SEQ ID NO: 888385 - RNA, 23 nt, Human
gguggcuuaugucuacaauccca

SEQ ID NO: 888386 - RNA, 24 nt, Human
gguggcuuaugucuacaaucccag

SEQ ID NO: 888387 - RNA, 18 nt, Human
gugaugacaguggaguuc

SEQ ID NO: 888388 - RNA, 24 nt, Human
uaaaaaauuuuuucccccagacuu

SEQ ID NO: 888389 - RNA, 23 nt, Human
uaaauagucuacaguaucuuuaa

SEQ ID NO: 888390 - RNA, 22 nt, Human
uaaaugcaaaugucuacauaua

SEQ ID NO: 888391 - RNA, 23 nt, Human
uaauaaaaaugaggugcuaccug

SEQ ID NO: 888392 - RNA, 22 nt, Human
uacaagcugcaaugaugggauc

SEQ ID NO: 888393 - RNA, 25 nt, Human
uacaagcugcaaugaugggaucuuu

SEQ ID NO: 888394 - RNA, 21 nt, Human
uaggaaauaacuauaaaggau

SEQ ID NO: 888395 - RNA, 24 nt, Human
uauccccaaguccugguuauucaa

SEQ ID NO: 888396 - RNA, 24 nt, Human
uaugucuacaaucccagcacuuug

SEQ ID NO: 888397 - RNA, 25 nt, Human
uauucuacucaucagaguugggaaa

SEQ ID NO: 888398 - RNA, 23 nt, Human
uccagccugggcaaaagagugag

SEQ ID NO: 888399 - RNA, 24 nt, Human
uccagccugggcaaaagagugaga

SEQ ID NO: 888400 - RNA, 20 nt, Human
ucccuuuucuuuucagcaag

SEQ ID NO: 888401 - RNA, 24 nt, Human
ucccuuuucuuuucagcaagcaaa

SEQ ID NO: 888402 - RNA, 20 nt, Human
ucuacaguaucuuuaaagua

SEQ ID NO: 888403 - RNA, 23 nt, Human
ugaaacaaauauuccuuaccaca

SEQ ID NO: 888404 - RNA, 21 nt, Human
ugaagauauuuauagaucacu

SEQ ID NO: 888405 - RNA, 26 nt, Human
ugaaguacggauaucccuaaucuauu

SEQ ID NO: 888406 - RNA, 18 nt, Human
ugacaguggaguucugga

SEQ ID NO: 888407 - RNA, 24 nt, Human
ugagaacagccugugcaacaugga

SEQ ID NO: 888408 - RNA, 25 nt, Human
ugcaaugaugggaucuuugaaacac

SEQ ID NO: 888409 - RNA, 18 nt, Human
ugcacuucaucaucaccu

SEQ ID NO: 888410 - RNA, 24 nt, Human
ugccacugcacuccagccugggca

SEQ ID NO: 888411 - RNA, 21 nt, Human
uggagggaagaaauauaucug

SEQ ID NO: 888412 - RNA, 22 nt, Human
uggcuuaugucuacaaucccag

SEQ ID NO: 888413 - RNA, 24 nt, Human
uggcuuaugucuacaaucccagca

SEQ ID NO: 888414 - RNA, 24 nt, Human
ugggaaaaauaggaauaaagcaga

SEQ ID NO: 888415 - RNA, 18 nt, Human
ugggagccgugauugugc

SEQ ID NO: 888416 - RNA, 19 nt, Human
ugggaggccaaggcaggca

SEQ ID NO: 888417 - RNA, 21 nt, Human
ugggcaaaagagugagacccu

SEQ ID NO: 888418 - RNA, 24 nt, Human
uggucaagaaccaaguagauuuga

SEQ ID NO: 888419 - RNA, 21 nt, Human
uguaacagaacauugaauauu

SEQ ID NO: 888420 - RNA, 19 nt, Human
ugugaaacaaauauuccuu

SEQ ID NO: 888421 - RNA, 20 nt, Human
uuccauacagaaauaccgua

SEQ ID NO: 888422 - RNA, 20 nt, Human
uucccccagacuuuaauggg

SEQ ID NO: 888423 - RNA, 24 nt, Human
uugcacuuuggacuaugcucucaa

SEQ ID NO: 888424 - RNA, 23 nt, Human
uugugccacugcacuccagccug

SEQ ID NO: 888425 - RNA, 27 nt, Human
uuuuaaauauugucuuucuaaaaccaa

SEQ ID NO: 888426 - RNA, 21 nt, Human
uuuuuuuuuuuuuugauuugg

SEQ ID NO: 888427 - RNA, 25 nt, Human
uuuuuuuuuuuuuuuuugauuuggg

SEQ ID NO: 888428 - RNA, 19 nt, Human
uuuuuuuuuuuuuuuuuug

SEQ ID NO: 888429 - RNA, 27 nt, Human
uuuuuuuuuuuuuuuuuuuuuuugggg

SEQ ID NO: 888430 - RNA, 25 nt, Human
aagcaccgggagacugggacaccuc

SEQ ID NO: 888431 - RNA, 18 nt, Human
aggccgggcgccucagcc

SEQ ID NO: 888432 - RNA, 19 nt, Human
cacugcccgccgcccgcgg

SEQ ID NO: 888433 - RNA, 18 nt, Human
ccacugcccgccgcccgc

SEQ ID NO: 888434 - RNA, 24 nt, Human
ccccaagagcagcuggaaggcccu

SEQ ID NO: 888435 - RNA, 23 nt, Human
cccgcggcccuuuguuguccucc

SEQ ID NO: 888436 - RNA, 22 nt, Human
cccuuuguuguccucccccgac

SEQ ID NO: 888437 - RNA, 22 nt, Human
cuggccccaagagcagcuggaa

SEQ ID NO: 888438 - RNA, 24 nt, Human
cuuggcucuggccccaagagcagc

SEQ ID NO: 888439 - RNA, 21 nt, Human
gcucuggccccaagagcagcu

SEQ ID NO: 888440 - RNA, 20 nt, Human
uuuuuuuuuuuuugagcggu

SEQ ID NO: 888441 - RNA, 22 nt, Human
uuuuuuuuuuuuuuuugagcgg

SEQ ID NO: 888442 - RNA, 18 nt, Human
uuuuuuuuuuuuuuuuug

SEQ ID NO: 888443 - RNA, 23 nt, Human
aaaaagaauccuccaaaagugaa

SEQ ID NO: 888444 - RNA, 22 nt, Human
accaccuuuccugccuuuucag

SEQ ID NO: 888445 - RNA, 18 nt, Human
accuccacugcagugccc

SEQ ID NO: 888446 - RNA, 21 nt, Human
acucaagaaccaccuuuccug

SEQ ID NO: 888447 - RNA, 23 nt, Human
acugcagugcccugcuuuucuag

SEQ ID NO: 888448 - RNA, 25 nt, Human
acuucugauccagccucuaaggcug

SEQ ID NO: 888449 - RNA, 24 nt, Human
agacugaagagccuccuccacuag

SEQ ID NO: 888450 - RNA, 22 nt, Human
agcagacgauccuucagccucc

SEQ ID NO: 888451 - RNA, 20 nt, Human
agccucuaaggcugaggccu

SEQ ID NO: 888452 - RNA, 19 nt, Human
agcucccugggcuaccuug

SEQ ID NO: 888453 - RNA, 22 nt, Human
agcucuagguucccaaucuccu

SEQ ID NO: 888454 - RNA, 21 nt, Human
aucaggagacugaagagccuc

SEQ ID NO: 888455 - RNA, 20 nt, Human
aucuccacugccuccguucc

SEQ ID NO: 888456 - RNA, 23 nt, Human
auuuucuuuaucauccucuucca

SEQ ID NO: 888457 - RNA, 21 nt, Human
caaaaacacuuucccuuggga

SEQ ID NO: 888458 - RNA, 20 nt, Human
caaaaagaauccuccaaaag

SEQ ID NO: 888459 - RNA, 22 nt, Human
caagcucuagguucccaaucuc

SEQ ID NO: 888460 - RNA, 21 nt, Human
cacccucuuuuaucuguucgu

SEQ ID NO: 888461 - RNA, 19 nt, Human
caccuccggugacucuuca

SEQ ID NO: 888462 - RNA, 24 nt, Human
cagcagacgauccuucagccuccu

SEQ ID NO: 888463 - RNA, 23 nt, Human
cagccuccacuguccccuccacu

SEQ ID NO: 888464 - RNA, 19 nt, Human
cagccucuguugucaccuc

SEQ ID NO: 888465 - RNA, 18 nt, Human
cagugcccugcuuuucua

SEQ ID NO: 888466 - RNA, 19 nt, Human
caucuucuguuuuuucucc

SEQ ID NO: 888467 - RNA, 25 nt, Human
cauuauauacaaaaacacuuucccu

SEQ ID NO: 888468 - RNA, 20 nt, Human
ccgguuuccucuucuuucug

SEQ ID NO: 888469 - RNA, 21 nt, Human
ccucuaaggcugaggccucug

SEQ ID NO: 888470 - RNA, 19 nt, Human
ccucuaguccugagccauc

SEQ ID NO: 888471 - RNA, 24 nt, Human
ccucugcagccucuguugucaccu

SEQ ID NO: 888472 - RNA, 20 nt, Human
cucaauuucuuucuuguauu

SEQ ID NO: 888473 - RNA, 21 nt, Human
cuccaaaagugaaaaaauaca

SEQ ID NO: 888474 - RNA, 20 nt, Human
cuccacuguccccuccacug

SEQ ID NO: 888475 - RNA, 23 nt, Human
cuccuccacuaggagugaaaccu

SEQ ID NO: 888476 - RNA, 20 nt, Human
cuccuccauguuuuccaaaa

SEQ ID NO: 888477 - RNA, 18 nt, Human
cuccucuggcucgucccc

SEQ ID NO: 888478 - RNA, 24 nt, Human
cuccuucuuccucuuccacaugca

SEQ ID NO: 888479 - RNA, 18 nt, Human
cucuagguucccaaucuc

SEQ ID NO: 888480 - RNA, 24 nt, Human
cucuuccacaugcacaccauccaa

SEQ ID NO: 888481 - RNA, 18 nt, Human
cucuucuacagacagcuu

SEQ ID NO: 888482 - RNA, 18 nt, Human
cuggcucguccccaccca

SEQ ID NO: 888483 - RNA, 24 nt, Human
cugggcaacauaaagcugggcuuu

SEQ ID NO: 888484 - RNA, 19 nt, Human
cuguagccuccugcccagg

SEQ ID NO: 888485 - RNA, 21 nt, Human
gaguagcuuucagagccaguu

SEQ ID NO: 888486 - RNA, 19 nt, Human
gccugggcaacauaaagcu

SEQ ID NO: 888487 - RNA, 18 nt, Human
gcucuagguucccaaucu

SEQ ID NO: 888488 - RNA, 24 nt, Human
gcucugaccuucuccucuaguccu

SEQ ID NO: 888489 - RNA, 24 nt, Human
ggaacuccuccacagcuugcacau

SEQ ID NO: 888490 - RNA, 20 nt, Human
ggaagcaccaucuguuggcu

SEQ ID NO: 888491 - RNA, 19 nt, Human
ggacagcaucuccacugcc

SEQ ID NO: 888492 - RNA, 19 nt, Human
ggacuggaacuccuccaca

SEQ ID NO: 888493 - RNA, 18 nt, Human
guagagcucuccaccaga

SEQ ID NO: 888494 - RNA, 22 nt, Human
guagagcucuccaccagaguag

SEQ ID NO: 888495 - RNA, 20 nt, Human
guauucagcagacgauccuu

SEQ ID NO: 888496 - RNA, 23 nt, Human
guccugagccaucuuuuguuucu

SEQ ID NO: 888497 - RNA, 23 nt, Human
ucaacucuuuccuugcuuccuca

SEQ ID NO: 888498 - RNA, 19 nt, Human
ucagagccaguucagcuac

SEQ ID NO: 888499 - RNA, 24 nt, Human
ucagccuccuccuccauguuuucc

SEQ ID NO: 888500 - RNA, 21 nt, Human
ucagcuacauucccaguaguc

SEQ ID NO: 888501 - RNA, 20 nt, Human
uccaaaacuucauuuccacu

SEQ ID NO: 888502 - RNA, 22 nt, Human
uccacuggggacagcaucucca

SEQ ID NO: 888503 - RNA, 20 nt, Human
uccagccuccacuguccccu

SEQ ID NO: 888504 - RNA, 19 nt, Human
ucccaaucuccuccucuuc

SEQ ID NO: 888505 - RNA, 22 nt, Human
ucccaaucuccuccucuucauu

SEQ ID NO: 888506 - RNA, 24 nt, Human
ucccaggcaagcucuagguuccca

SEQ ID NO: 888507 - RNA, 20 nt, Human
ucccugggcuaccuugguau

SEQ ID NO: 888508 - RNA, 18 nt, Human
ucuacagacagcuuaguc

SEQ ID NO: 888509 - RNA, 22 nt, Human
ucuagaaucaccacagucugcu

SEQ ID NO: 888510 - RNA, 21 nt, Human
ucuccuccucuucauuuucuu

SEQ ID NO: 888511 - RNA, 22 nt, Human
ucuccucuaguccugagccauc

SEQ ID NO: 888512 - RNA, 21 nt, Human
ucugaccuucuccucuagucc

SEQ ID NO: 888513 - RNA, 20 nt, Human
ucugcagccucuguugucac

SEQ ID NO: 888514 - RNA, 22 nt, Human
ucugcucuucugaaacuucuuu

SEQ ID NO: 888515 - RNA, 18 nt, Human
ucuucacccucuuuuauc

SEQ ID NO: 888516 - RNA, 20 nt, Human
ucuuuccagggacucuguuc

SEQ ID NO: 888517 - RNA, 26 nt, Human
ucuuuccagggacucuguuccuccgg

SEQ ID NO: 888518 - RNA, 18 nt, Human
ugaaaccugaaguagagc

SEQ ID NO: 888519 - RNA, 22 nt, Human
ugaacugugccacugccucauc

SEQ ID NO: 888520 - RNA, 19 nt, Human
ugacgguccauugaccgca

SEQ ID NO: 888521 - RNA, 24 nt, Human
ugaggccucugcagccucuguugu

SEQ ID NO: 888522 - RNA, 23 nt, Human
ugcagccucuguugucaccuccg

SEQ ID NO: 888523 - RNA, 20 nt, Human
ugcccaggcuuuucagagac

SEQ ID NO: 888524 - RNA, 21 nt, Human
ugcccugcuuuucuagaauca

SEQ ID NO: 888525 - RNA, 27 nt, Human
ugccucagacucuucuacagacagcuu

SEQ ID NO: 888526 - RNA, 18 nt, Human
ugccugggcaacauaaag

SEQ ID NO: 888527 - RNA, 21 nt, Human
ugccugggcaacauaaagcug

SEQ ID NO: 888528 - RNA, 24 nt, Human
ugcucugaccuucuccucuagucc

SEQ ID NO: 888529 - RNA, 22 nt, Human
uggggacagcaucuccacugcc

SEQ ID NO: 888530 - RNA, 20 nt, Human
ugucagucuuucuauagaag

SEQ ID NO: 888531 - RNA, 20 nt, Human
uguccccuccacugccgccc

SEQ ID NO: 888532 - RNA, 18 nt, Human
uucaauagauuugcugaa

SEQ ID NO: 888533 - RNA, 18 nt, Human
uucagagccaguucagcu

SEQ ID NO: 888534 - RNA, 22 nt, Human
uucagagguaacuaccuucucc

SEQ ID NO: 888535 - RNA, 18 nt, Human
uucauuagcagcuaucug

SEQ ID NO: 888536 - RNA, 19 nt, Human
uucauuagcagcuaucuga

SEQ ID NO: 888537 - RNA, 19 nt, Human
uuccaaaacuucauuucca

SEQ ID NO: 888538 - RNA, 22 nt, Human
uucuagaaucaccacagucugc

SEQ ID NO: 888539 - RNA, 18 nt, Human
uucuugaagagacuuguu

SEQ ID NO: 888540 - RNA, 19 nt, Human
uugcuuccucaucuaugcu

SEQ ID NO: 888541 - RNA, 20 nt, Human
uugggucuaaagacucugcu

SEQ ID NO: 888542 - RNA, 18 nt, Human
uuuccaaaacuucauuuc

SEQ ID NO: 888543 - RNA, 22 nt, Human
uuucccaauacaccauucucga

SEQ ID NO: 888544 - RNA, 18 nt, Human
uuucugucagucuuucua

SEQ ID NO: 888545 - RNA, 23 nt, Human
uuugcaucuucugucuuuucugu

SEQ ID NO: 888546 - RNA, 18 nt, Human
uuuggcauuucuucagcc

SEQ ID NO: 888547 - RNA, 21 nt, Human
uuuggcauuucuucagccuua

SEQ ID NO: 888548 - RNA, 22 nt, Human
uuuucuccuucuuccucuucca

SEQ ID NO: 888549 - RNA, 21 nt, Human
aagaccccgcgcccgcccugc

SEQ ID NO: 888550 - RNA, 19 nt, Human
aagcuucaauuaacaguuc

SEQ ID NO: 888551 - RNA, 21 nt, Human
aucugccuaagaaccacugcc

SEQ ID NO: 888552 - RNA, 22 nt, Human
ccgccgccgcuuccgaagaccg

SEQ ID NO: 888553 - RNA, 25 nt, Human
ccgccgccgcuuccgaagaccguuc

SEQ ID NO: 888554 - RNA, 18 nt, Human
ccgcgcccgcccugccgg

SEQ ID NO: 888555 - RNA, 19 nt, Human
ccugccggaagucucccgg

SEQ ID NO: 888556 - RNA, 22 nt, Human
cgccaagaccccgcgcccgccc

SEQ ID NO: 888557 - RNA, 23 nt, Human
cgccaagaccccgcgcccgcccu

SEQ ID NO: 888558 - RNA, 19 nt, Human
cucaggcacagaacugagg

SEQ ID NO: 888559 - RNA, 21 nt, Human
cuggagcaagucuuuucccua

SEQ ID NO: 888560 - RNA, 19 nt, Human
gagacuggagcaagucuuu

SEQ ID NO: 888561 - RNA, 20 nt, Human
gcagcagugguucucaggca

SEQ ID NO: 888562 - RNA, 22 nt, Human
uaaaauaaauugauaaccugua

SEQ ID NO: 888563 - RNA, 25 nt, Human
uaaauugauaaccuguauuguaaua

SEQ ID NO: 888564 - RNA, 24 nt, Human
uacuuuucuccuaauagagcucca

SEQ ID NO: 888565 - RNA, 18 nt, Human
uccauaaagcaucuagag

SEQ ID NO: 888566 - RNA, 19 nt, Human
ucgccaagaccccgcgccc

SEQ ID NO: 888567 - RNA, 23 nt, Human
ugaggaggagacuggagcaaguc

SEQ ID NO: 888568 - RNA, 23 nt, Human
ugauauugcuaacuggaaacaau

SEQ ID NO: 888569 - RNA, 22 nt, Human
uggaaacaaugagauuuaaaau

SEQ ID NO: 888570 - RNA, 21 nt, Human
uuaaagcuucaauuaacaguu

SEQ ID NO: 888571 - RNA, 20 nt, Human
uuccuucugaccuagcugcc

SEQ ID NO: 888572 - RNA, 20 nt, Human
uucgccaagaccccgcgccc

SEQ ID NO: 888573 - RNA, 19 nt, Human
uucuccuaauagagcucca

SEQ ID NO: 888574 - RNA, 18 nt, Human
uuuuuuuuuuuuagaguc

SEQ ID NO: 888575 - RNA, 29 nt, Human
aaacaagaagucaagggaaaggggacccc

SEQ ID NO: 888576 - RNA, 24 nt, Human
aaagaggagaggggagaggaggaa

SEQ ID NO: 888577 - RNA, 22 nt, Human
aacgcuuuguugaaggaacuuc

SEQ ID NO: 888578 - RNA, 24 nt, Human
aagguacagcaccaagaaccuguc

SEQ ID NO: 888579 - RNA, 18 nt, Human
acaaguucccaaacgcca

SEQ ID NO: 888580 - RNA, 20 nt, Human
acuugauggagggugaagca

SEQ ID NO: 888581 - RNA, 18 nt, Human
agaggaggccaguaaaug

SEQ ID NO: 888582 - RNA, 18 nt, Human
agaggggagaggaggagc

SEQ ID NO: 888583 - RNA, 18 nt, Human
aggaacugcugcaguguu

SEQ ID NO: 888584 - RNA, 18 nt, Human
aggagaggggagaggagg

SEQ ID NO: 888585 - RNA, 23 nt, Human
aggaguuguuggcaguggugaug

SEQ ID NO: 888586 - RNA, 19 nt, Human
aucaucuuuuccccaaagu

SEQ ID NO: 888587 - RNA, 21 nt, Human
auggagggugaagcagucucu

SEQ ID NO: 888588 - RNA, 21 nt, Human
caaagguacagcaccaagaac

SEQ ID NO: 888589 - RNA, 19 nt, Human
caacucuuuuuuuucuucu

SEQ ID NO: 888590 - RNA, 19 nt, Human
caaguucccaaacgccacc

SEQ ID NO: 888591 - RNA, 25 nt, Human
cagaucucccucacaagacugucuc

SEQ ID NO: 888592 - RNA, 22 nt, Human
cagcaccaagaaccugucccuc

SEQ ID NO: 888593 - RNA, 21 nt, Human
cagccuaguguggggggcugg

SEQ ID NO: 888594 - RNA, 20 nt, Human
cauccuugcugcugccgauu

SEQ ID NO: 888595 - RNA, 24 nt, Human
ccaagaaccugucccuccucuuuc

SEQ ID NO: 888596 - RNA, 24 nt, Human
cccaaacgccaccccaccauuccu

SEQ ID NO: 888597 - RNA, 22 nt, Human
cccagaaucaucuuuuccccaa

SEQ ID NO: 888598 - RNA, 20 nt, Human
cccccagaucucccucacaa

SEQ ID NO: 888599 - RNA, 20 nt, Human
cccucggugacaucagugcc

SEQ ID NO: 888600 - RNA, 24 nt, Human
ccgggggugacagugauugccgaa

SEQ ID NO: 888601 - RNA, 18 nt, Human
ccuccucccuccuguucu

SEQ ID NO: 888602 - RNA, 19 nt, Human
ccuccuggggcuggagagc

SEQ ID NO: 888603 - RNA, 20 nt, Human
ccuccuucuucucuggcucc

SEQ ID NO: 888604 - RNA, 20 nt, Human
ccuccuucuucucuggcucc

SEQ ID NO: 888605 - RNA, 18 nt, Human
ccuguucuccuccugggg

SEQ ID NO: 888606 - RNA, 20 nt, Human
cgaaguucuuuggguguggu

SEQ ID NO: 888607 - RNA, 23 nt, Human
cucaggguugcuugugagaauca

SEQ ID NO: 888608 - RNA, 25 nt, Human
cuccgauaccuccuucuucucuggc

SEQ ID NO: 888609 - RNA, 22 nt, Human
cucugggggaggaguuguuggc

SEQ ID NO: 888610 - RNA, 20 nt, Human
cucuuuuuuuucuucuuuuu

SEQ ID NO: 888611 - RNA, 19 nt, Human
cugggggaggaguuguugg

SEQ ID NO: 888612 - RNA, 19 nt, Human
cuuucaucuccuccucccu

SEQ ID NO: 888613 - RNA, 23 nt, Human
gacuugggccccuuuuuuauacu

SEQ ID NO: 888614 - RNA, 18 nt, Human
gagaggggagaggaggag

SEQ ID NO: 888615 - RNA, 18 nt, Human
gagaugcuaucugaggag

SEQ ID NO: 888616 - RNA, 22 nt, Human
gaggaggagcuaagauagcuga

SEQ ID NO: 888617 - RNA, 24 nt, Human
gccaacucuuuuuuuucuucuuuu

SEQ ID NO: 888618 - RNA, 18 nt, Human
gcuagugaugcuguugag

SEQ ID NO: 888619 - RNA, 19 nt, Human
gcucccugaaugacugccu

SEQ ID NO: 888620 - RNA, 24 nt, Human
gcuccgauaccuccuucuucucug

SEQ ID NO: 888621 - RNA, 18 nt, Human
gcugggugagcagggccc

SEQ ID NO: 888622 - RNA, 21 nt, Human
ggggagaggaggagcuaagau

SEQ ID NO: 888623 - RNA, 23 nt, Human
ggggcacaaguucccaaacgcca

SEQ ID NO: 888624 - RNA, 20 nt, Human
guaguuugggggaugagggg

SEQ ID NO: 888625 - RNA, 22 nt, Human
gucggguguagcaaucuccucu

SEQ ID NO: 888626 - RNA, 18 nt, Human
uaaaccacaugcuucuuu

SEQ ID NO: 888627 - RNA, 20 nt, Human
uagaggaggccaguaaaugu

SEQ ID NO: 888628 - RNA, 21 nt, Human
uagcucagagcgcagcuccga

SEQ ID NO: 888629 - RNA, 23 nt, Human
uaggaacugcugcaguguuuuga

SEQ ID NO: 888630 - RNA, 22 nt, Human
uagggggcacaaguucccaaac

SEQ ID NO: 888631 - RNA, 21 nt, Human
ucagugcccacggaggacgag

SEQ ID NO: 888632 - RNA, 23 nt, Human
ucccaaacgccaccccaccauuc

SEQ ID NO: 888633 - RNA, 21 nt, Human
ucccauagcucagagcgcagc

SEQ ID NO: 888634 - RNA, 25 nt, Human
uccccaaagucauuagaggaggcca

SEQ ID NO: 888635 - RNA, 22 nt, Human
uccccagaaagcccaggaguuu

SEQ ID NO: 888636 - RNA, 21 nt, Human
ucccugaaugacugccugggc

SEQ ID NO: 888637 - RNA, 18 nt, Human
uccgauaccuccuucuuc

SEQ ID NO: 888638 - RNA, 21 nt, Human
uccuucuucucuggcuccucc

SEQ ID NO: 888639 - RNA, 19 nt, Human
uccuugcugcugccgaugc

SEQ ID NO: 888640 - RNA, 24 nt, Human
ucucucaggguugcuugugagaau

SEQ ID NO: 888641 - RNA, 18 nt, Human
ucucuggcuccuccuccu

SEQ ID NO: 888642 - RNA, 22 nt, Human
ucucugggggaggaguuguugg

SEQ ID NO: 888643 - RNA, 19 nt, Human
ucugaaccccuccccagaa

SEQ ID NO: 888644 - RNA, 23 nt, Human
ugaaagaggagaggggagaggag

SEQ ID NO: 888645 - RNA, 18 nt, Human
ugaaggaacuucgaagcc

SEQ ID NO: 888646 - RNA, 22 nt, Human
ugagggggcugaagagucgggu

SEQ ID NO: 888647 - RNA, 23 nt, Human
ugagggggcugaagagucgggug

SEQ ID NO: 888648 - RNA, 22 nt, Human
ugccucccccagaucucccuca

SEQ ID NO: 888649 - RNA, 22 nt, Human
ugccugggccucagaguucuuu

SEQ ID NO: 888650 - RNA, 22 nt, Human
ugggaagggucugugagaaaau

SEQ ID NO: 888651 - RNA, 22 nt, Human
uggggcuggagagccagugcuc

SEQ ID NO: 888652 - RNA, 18 nt, Human
ugggggaggaguuguugg

SEQ ID NO: 888653 - RNA, 27 nt, Human
uguggggggcugggugaaaccuggagg

SEQ ID NO: 888654 - RNA, 18 nt, Human
uuccugccucccccagau

SEQ ID NO: 888655 - RNA, 23 nt, Human
uuccugccucccccagaucuccc

SEQ ID NO: 888656 - RNA, 25 nt, Human
uucugaaccccuccccagaaagccc

SEQ ID NO: 888657 - RNA, 18 nt, Human
uucuuugggugugguuuc

SEQ ID NO: 888658 - RNA, 26 nt, Human
uugaaacaagaagucaagggaaagac

SEQ ID NO: 888659 - RNA, 19 nt, Human
uuuucugaaccccucccca

SEQ ID NO: 888660 - RNA, 23 nt, Human
uuuuuuuuuuuuuuuuuaccuuu

SEQ ID NO: 888661 - RNA, 24 nt, Human
aaaaaacaaaaacaauagggaagg

SEQ ID NO: 888662 - RNA, 24 nt, Human
aaaaacaaaaacaauagggaagga

SEQ ID NO: 888663 - RNA, 20 nt, Human
aaaaacaaccuuauaaaacc

SEQ ID NO: 888664 - RNA, 23 nt, Human
aaaaacaacuguaaauacaggac

SEQ ID NO: 888665 - RNA, 19 nt, Human
aaaauguauacagacaaau

SEQ ID NO: 888666 - RNA, 29 nt, Human
aaacaaaaggaagggacaaaagggacccc

SEQ ID NO: 888667 - RNA, 20 nt, Human
aaacacaccagauaauacag

SEQ ID NO: 888668 - RNA, 18 nt, Human
aaagaggaaacaaagaaa

SEQ ID NO: 888669 - RNA, 20 nt, Human
aaagcaaagucuuuucccuu

SEQ ID NO: 888670 - RNA, 20 nt, Human
aaauacacguccuaaaagua

SEQ ID NO: 888671 - RNA, 22 nt, Human
aacacaaacacuacugaagccc

SEQ ID NO: 888672 - RNA, 22 nt, Human
aagaggaaacaaagaaagucca

SEQ ID NO: 888673 - RNA, 24 nt, Human
aaucucagcaagugaaacaccucc

SEQ ID NO: 888674 - RNA, 18 nt, Human
aaugaaaagacaguggaa

SEQ ID NO: 888675 - RNA, 20 nt, Human
acaguggaaauuaccaaugg

SEQ ID NO: 888676 - RNA, 21 nt, Human
acauauuauacaagggaaacu

SEQ ID NO: 888677 - RNA, 23 nt, Human
acuuugugacacucugaaaacug

SEQ ID NO: 888678 - RNA, 26 nt, Human
agaggaaacaaaaggaagggacaaaa

SEQ ID NO: 888679 - RNA, 18 nt, Human
aggcagugagacagcacc

SEQ ID NO: 888680 - RNA, 23 nt, Human
aggcagugagacagcaccauagg

SEQ ID NO: 888681 - RNA, 19 nt, Human
agggugcacauuugcaaaa

SEQ ID NO: 888682 - RNA, 20 nt, Human
auaaaccaauagaaaauaca

SEQ ID NO: 888683 - RNA, 19 nt, Human
auaaagcccuaaaaaagcc

SEQ ID NO: 888684 - RNA, 24 nt, Human
auagcaaucaaaacaacaugcguc

SEQ ID NO: 888685 - RNA, 18 nt, Human
auggaauuucgccacaug

SEQ ID NO: 888686 - RNA, 24 nt, Human
caaaacucauuaaaaaaacaaaaa

SEQ ID NO: 888687 - RNA, 24 nt, Human
caaagaaaguccaguuuggcuauc

SEQ ID NO: 888688 - RNA, 21 nt, Human
caaauacacguccuaaaagua

SEQ ID NO: 888689 - RNA, 20 nt, Human
caacucugggucagggcccu

SEQ ID NO: 888690 - RNA, 25 nt, Human
cacaacacaaacacuacugaagccc

SEQ ID NO: 888691 - RNA, 26 nt, Human
caccauaggaaauguuccuucuuuca

SEQ ID NO: 888692 - RNA, 21 nt, Human
caccguguggcacaaaggagg

SEQ ID NO: 888693 - RNA, 19 nt, Human
cacucugaaaacugcacag

SEQ ID NO: 888694 - RNA, 19 nt, Human
cacugauagcuccugcaua

SEQ ID NO: 888695 - RNA, 27 nt, Human
cagccccucagaggaaacaaaaggaag

SEQ ID NO: 888696 - RNA, 20 nt, Human
cagggcccuugacagggugc

SEQ ID NO: 888697 - RNA, 22 nt, Human
ccaguagacugugcaaaucuaa

SEQ ID NO: 888698 - RNA, 23 nt, Human
ccuagcccuuggguuucauaaac

SEQ ID NO: 888699 - RNA, 19 nt, Human
ccucagaggaaacaaaagg

SEQ ID NO: 888700 - RNA, 19 nt, Human
cuacugaagcccugugacc

SEQ ID NO: 888701 - RNA, 23 nt, Human
cuccugccuucugaaacucuuuc

SEQ ID NO: 888702 - RNA, 23 nt, Human
cuccuuggagaccacaacucugg

SEQ ID NO: 888703 - RNA, 19 nt, Human
cugaaaaggcucaaacaaa

SEQ ID NO: 888704 - RNA, 22 nt, Human
gaccacugugguaaaaacaacc

SEQ ID NO: 888705 - RNA, 18 nt, Human
gaccagcaccguguggca

SEQ ID NO: 888706 - RNA, 23 nt, Human
gcacaacacaaacacuacugaag

SEQ ID NO: 888707 - RNA, 25 nt, Human
gcacaacacaaacacuacugaagcc

SEQ ID NO: 888708 - RNA, 21 nt, Human
gcagugagacagcaccauagg

SEQ ID NO: 888709 - RNA, 19 nt, Human
gccuggggcgaacagcccc

SEQ ID NO: 888710 - RNA, 20 nt, Human
ggacuggccucuuggauuug

SEQ ID NO: 888711 - RNA, 22 nt, Human
gggcaggugguuuaaaaagacc

SEQ ID NO: 888712 - RNA, 21 nt, Human
gggcuuuacaaagacuacaaa

SEQ ID NO: 888713 - RNA, 25 nt, Human
guaaacuuuuaaagaggaaacaaag

SEQ ID NO: 888714 - RNA, 22 nt, Human
gucaaaaacaacuguaaauaca

SEQ ID NO: 888715 - RNA, 26 nt, Human
uaaaaaaacaaaaacaauagggaagg

SEQ ID NO: 888716 - RNA, 20 nt, Human
uaaaagcaaagucuuuuccc

SEQ ID NO: 888717 - RNA, 22 nt, Human
uaaaccaauagaaaauacauca

SEQ ID NO: 888718 - RNA, 21 nt, Human
uaaacuuaaaaccuguccuuu

SEQ ID NO: 888719 - RNA, 22 nt, Human
uaacucauugaaaaaggccaac

SEQ ID NO: 888720 - RNA, 23 nt, Human
uaaguccauugacaccaaguacu

SEQ ID NO: 888721 - RNA, 19 nt, Human
uacaauaccuacccaguag

SEQ ID NO: 888722 - RNA, 21 nt, Human
uacaguauaaacgcuuccucu

SEQ ID NO: 888723 - RNA, 21 nt, Human
uaccauggccuagcccuuggg

SEQ ID NO: 888724 - RNA, 26 nt, Human
uagaaaauacaucauccaaccuucag

SEQ ID NO: 888725 - RNA, 20 nt, Human
uagagaugaggcuacuaugu

SEQ ID NO: 888726 - RNA, 19 nt, Human
uagcaaucaaaacaacaug

SEQ ID NO: 888727 - RNA, 24 nt, Human
uauaaaaccagugacucauauacu

SEQ ID NO: 888728 - RNA, 19 nt, Human
uauaaaauguauacagaca

SEQ ID NO: 888729 - RNA, 25 nt, Human
uauuucacuguuucugccuauuuac

SEQ ID NO: 888730 - RNA, 21 nt, Human
uauuuuggaggauaggcaaag

SEQ ID NO: 888731 - RNA, 22 nt, Human
ucaguguucuuuaaugcugaau

SEQ ID NO: 888732 - RNA, 24 nt, Human
uccacagauauaaaaaaugcuuag

SEQ ID NO: 888733 - RNA, 24 nt, Human
uccacagugaccuuaccgcuucag

SEQ ID NO: 888734 - RNA, 21 nt, Human
ucccuuaacuuuuuucacccu

SEQ ID NO: 888735 - RNA, 21 nt, Human
ucuccuauccauuucuucaaa

SEQ ID NO: 888736 - RNA, 20 nt, Human
ucuucaaaaaaaaaaaaaaa

SEQ ID NO: 888737 - RNA, 21 nt, Human
ucuuccacagugaccuuaccg

SEQ ID NO: 888738 - RNA, 24 nt, Human
ucuuccacagugaccuuaccgcuu

SEQ ID NO: 888739 - RNA, 19 nt, Human
ugaaaauaccuuucuuuug

SEQ ID NO: 888740 - RNA, 21 nt, Human
ugaaacaccucuuaacaccaa

SEQ ID NO: 888741 - RNA, 21 nt, Human
ugaucaguuuucaugcacucu

SEQ ID NO: 888742 - RNA, 19 nt, Human
ugggauguauugcaggaaa

SEQ ID NO: 888743 - RNA, 21 nt, Human
uggggugagcgcacaacacaa

SEQ ID NO: 888744 - RNA, 21 nt, Human
ugggucagggcccuugacagg

SEQ ID NO: 888745 - RNA, 22 nt, Human
ugguaacuucuccaaugacuga

SEQ ID NO: 888746 - RNA, 18 nt, Human
uggucacagagaguagca

SEQ ID NO: 888747 - RNA, 23 nt, Human
ugucauagaaaucuguuuuaagg

SEQ ID NO: 888748 - RNA, 20 nt, Human
ugugcaaucuguucaguugc

SEQ ID NO: 888749 - RNA, 20 nt, Human
uuaaaaagaccacugugguu

SEQ ID NO: 888750 - RNA, 20 nt, Human
uuagaacuggauggaauuuc

SEQ ID NO: 888751 - RNA, 24 nt, Human
uucaaaaucuccugccuucugaaa

SEQ ID NO: 888752 - RNA, 24 nt, Human
uucacaaggcuaaaaauacugauc

SEQ ID NO: 888753 - RNA, 20 nt, Human
uucagaugauuuauuucacu

SEQ ID NO: 888754 - RNA, 22 nt, Human
uuggggcuuuacaaagacuaca

SEQ ID NO: 888755 - RNA, 18 nt, Human
uuuacaguauaaacgcuu

SEQ ID NO: 888756 - RNA, 23 nt, Human
uuugaagcaugcucacucuagca

SEQ ID NO: 888757 - RNA, 22 nt, Human
uuugugcuuauggaggacuggc

SEQ ID NO: 888758 - RNA, 23 nt, Human
aaaaaaagagcccugaagaccuc

SEQ ID NO: 888759 - RNA, 22 nt, Human
aaccccgccccuucagaucucc

SEQ ID NO: 888760 - RNA, 21 nt, Human
aaccgggcagcauucaagucc

SEQ ID NO: 888761 - RNA, 23 nt, Human
aagagaccaccccccccaaaaaa

SEQ ID NO: 888762 - RNA, 19 nt, Human
aagcccgggaccucagcag

SEQ ID NO: 888763 - RNA, 18 nt, Human
acaagcuccagaagcccg

SEQ ID NO: 888764 - RNA, 23 nt, Human
acaggaagagaccacccccccca

SEQ ID NO: 888765 - RNA, 23 nt, Human
acaggaagagaccacccccccca

SEQ ID NO: 888766 - RNA, 21 nt, Human
acagugcggggcacuaacauu

SEQ ID NO: 888767 - RNA, 20 nt, Human
agaagagcagacgcagacag

SEQ ID NO: 888768 - RNA, 22 nt, Human
agaauuggggagcuagagagag

SEQ ID NO: 888769 - RNA, 24 nt, Human
agacaggaagagaccacccccccc

SEQ ID NO: 888770 - RNA, 22 nt, Human
agaggagggggaugcucgucuu

SEQ ID NO: 888771 - RNA, 21 nt, Human
agaugcucacacuaagcccgg

SEQ ID NO: 888772 - RNA, 23 nt, Human
aggaagccagagaaaggcccgga

SEQ ID NO: 888773 - RNA, 21 nt, Human
aggcaagccaaggaagccaga

SEQ ID NO: 888774 - RNA, 18 nt, Human
aggcaggaggcagugggc

SEQ ID NO: 888775 - RNA, 18 nt, Human
aggcagugggcuggcagc

SEQ ID NO: 888776 - RNA, 19 nt, Human
agggagaggagggggaugc

SEQ ID NO: 888777 - RNA, 24 nt, Human
agggaggaggcaggcagaauuggg

SEQ ID NO: 888778 - RNA, 21 nt, Human
aggggaggaagaguugggggg

SEQ ID NO: 888779 - RNA, 25 nt, Human
agggggaugcucgucuucagggaug

SEQ ID NO: 888780 - RNA, 24 nt, Human
agugggcuggcagccacccugggc

SEQ ID NO: 888781 - RNA, 19 nt, Human
aucuuggauggccuccccc

SEQ ID NO: 888782 - RNA, 19 nt, Human
caaaaaaagagcccugaag

SEQ ID NO: 888783 - RNA, 22 nt, Human
caaaaaaagagcccugaagacc

SEQ ID NO: 888784 - RNA, 21 nt, Human
caagaugcucacacuaagccc

SEQ ID NO: 888785 - RNA, 19 nt, Human
cacccccagggaccuuagc

SEQ ID NO: 888786 - RNA, 23 nt, Human
caccccccccaaaaaaagagccc

SEQ ID NO: 888787 - RNA, 23 nt, Human
cagacaggaagagaccacccccc

SEQ ID NO: 888788 - RNA, 21 nt, Human
caggaagagaccacccccccc

SEQ ID NO: 888789 - RNA, 21 nt, Human
cagugggcuggcagccacccu

SEQ ID NO: 888790 - RNA, 26 nt, Human
caguggucuuucuagcccagcccucc

SEQ ID NO: 888791 - RNA, 25 nt, Human
caugggcccgccugcccugucccuc

SEQ ID NO: 888792 - RNA, 19 nt, Human
ccaccccaggcaggaggca

SEQ ID NO: 888793 - RNA, 18 nt, Human
cccaaaaaaagagcccug

SEQ ID NO: 888794 - RNA, 23 nt, Human
cccaaaaaaagagcccugaagac

SEQ ID NO: 888795 - RNA, 19 nt, Human
cccacaggcacaucucuag

SEQ ID NO: 888796 - RNA, 21 nt, Human
ccccaaaaaaagagcccugaa

SEQ ID NO: 888797 - RNA, 22 nt, Human
cccccaaaaaaagagcccugaa

SEQ ID NO: 888798 - RNA, 28 nt, Human
cccccaaaaaaagagcccugaagaccuc

SEQ ID NO: 888799 - RNA, 24 nt, Human
cccccagggaccuuagcccgauuc

SEQ ID NO: 888800 - RNA, 23 nt, Human
ccccccaaaaaaagagcccugaa

SEQ ID NO: 888801 - RNA, 19 nt, Human
ccccgccccuucagaucuc

SEQ ID NO: 888802 - RNA, 21 nt, Human
ccccuccuccccuucccccac

SEQ ID NO: 888803 - RNA, 19 nt, Human
cccgccccuucagaucucc

SEQ ID NO: 888804 - RNA, 22 nt, Human
cccgcgccacgagucagcaggg

SEQ ID NO: 888805 - RNA, 20 nt, Human
cccgcgcgcgcccgccgguc

SEQ ID NO: 888806 - RNA, 22 nt, Human
cccgcgcgcgcccgccgguccu

SEQ ID NO: 888807 - RNA, 23 nt, Human
cccgcgcgcgcccgccgguccug

SEQ ID NO: 888808 - RNA, 25 nt, Human
cccgcgcgcgcccgccgguccugcg

SEQ ID NO: 888809 - RNA, 19 nt, Human
cccuccccccaggucccca

SEQ ID NO: 888810 - RNA, 21 nt, Human
cccugaagaccucugcuuccu

SEQ ID NO: 888811 - RNA, 22 nt, Human
cccugucccuccccccaggucc

SEQ ID NO: 888812 - RNA, 26 nt, Human
cccuucccccaccaggcaagccaagg

SEQ ID NO: 888813 - RNA, 21 nt, Human
ccgccuagggccucuggaacc

SEQ ID NO: 888814 - RNA, 22 nt, Human
ccuccagagcccgcgcgcgccc

SEQ ID NO: 888815 - RNA, 23 nt, Human
ccuccagagcccgcgcgcgcccg

SEQ ID NO: 888816 - RNA, 25 nt, Human
ccuccagagcccgcgcgcgcccgcc

SEQ ID NO: 888817 - RNA, 26 nt, Human
ccucccacaggcacaucucuagaagc

SEQ ID NO: 888818 - RNA, 21 nt, Human
ccucccucaagccugaggcug

SEQ ID NO: 888819 - RNA, 21 nt, Human
ccucuggaaccuuggggcgag

SEQ ID NO: 888820 - RNA, 31 nt, Human
ccugaagaccucugcuuccuccccccacucu

SEQ ID NO: 888821 - RNA, 21 nt, Human
ccugcccugucccucccccca

SEQ ID NO: 888822 - RNA, 20 nt, Human
ccuggcucccagcucccgcc

SEQ ID NO: 888823 - RNA, 25 nt, Human
ccuucuuccccuccuccccuucccc

SEQ ID NO: 888824 - RNA, 18 nt, Human
ccuuggggaaaccugugg

SEQ ID NO: 888825 - RNA, 20 nt, Human
cgccccaggaggcucggcga

SEQ ID NO: 888826 - RNA, 21 nt, Human
cggagccuccuguuucugccg

SEQ ID NO: 888827 - RNA, 18 nt, Human
cuaacagggagaggaggg

SEQ ID NO: 888828 - RNA, 24 nt, Human
cuagcccagcccucccucaagccu

SEQ ID NO: 888829 - RNA, 22 nt, Human
cucacacuaagcccgggaccuc

SEQ ID NO: 888830 - RNA, 23 nt, Human
cucacucccacacccauccgaua

SEQ ID NO: 888831 - RNA, 21 nt, Human
cucagcaguaccaucugcacc

SEQ ID NO: 888832 - RNA, 27 nt, Human
cucccacacccauccgauauuuacaaa

SEQ ID NO: 888833 - RNA, 19 nt, Human
cuggcagcuuucugggggg

SEQ ID NO: 888834 - RNA, 24 nt, Human
cuggcagcuuucuggggggccuag

SEQ ID NO: 888835 - RNA, 18 nt, Human
cuucccuuuccuucuucc

SEQ ID NO: 888836 - RNA, 25 nt, Human
gaccucugcuuccuccccccacucu

SEQ ID NO: 888837 - RNA, 20 nt, Human
gagaggggagaaggcggccc

SEQ ID NO: 888838 - RNA, 20 nt, Human
gaggaagaguugggggggcc

SEQ ID NO: 888839 - RNA, 18 nt, Human
gcagcauucaaguccgag

SEQ ID NO: 888840 - RNA, 22 nt, Human
gccaggccaccccaggcaggag

SEQ ID NO: 888841 - RNA, 20 nt, Human
gccaguggucuuucuagccc

SEQ ID NO: 888842 - RNA, 23 nt, Human
gcccugaagaccucugcuuccuu

SEQ ID NO: 888843 - RNA, 18 nt, Human
gccuagggccucuggaac

SEQ ID NO: 888844 - RNA, 21 nt, Human
gccugacucccaaaccccucc

SEQ ID NO: 888845 - RNA, 23 nt, Human
ggaaaccugugggccggagccuc

SEQ ID NO: 888846 - RNA, 24 nt, Human
ggaggaggcaggcagaauugggga

SEQ ID NO: 888847 - RNA, 19 nt, Human
ggcagaauuggggagcuag

SEQ ID NO: 888848 - RNA, 23 nt, Human
ggcagcauucaaguccgagucug

SEQ ID NO: 888849 - RNA, 18 nt, Human
ggccggcagggcgggggg

SEQ ID NO: 888850 - RNA, 19 nt, Human
ggccggcagggcggggggc

SEQ ID NO: 888851 - RNA, 24 nt, Human
ggcgaggcggccggcagggcgggg

SEQ ID NO: 888852 - RNA, 20 nt, Human
ggcuggcagccacccugggc

SEQ ID NO: 888853 - RNA, 19 nt, Human
gggcacagaagagcagacg

SEQ ID NO: 888854 - RNA, 18 nt, Human
gggcacuaacauuucuaa

SEQ ID NO: 888855 - RNA, 22 nt, Human
gggcggggggcggccccgcgac

SEQ ID NO: 888856 - RNA, 22 nt, Human
ggggggcuucagcuucuccccu

SEQ ID NO: 888857 - RNA, 23 nt, Human
gguuaaagugcagcugggaggga

SEQ ID NO: 888858 - RNA, 22 nt, Human
guccuccucguccuggaguucc

SEQ ID NO: 888859 - RNA, 18 nt, Human
guccuggaguuccucgag

SEQ ID NO: 888860 - RNA, 19 nt, Human
uaaccccucacucccacac

SEQ ID NO: 888861 - RNA, 21 nt, Human
uaaccccucacucccacaccc

SEQ ID NO: 888862 - RNA, 22 nt, Human
uacaaagagcaucccugggaga

SEQ ID NO: 888863 - RNA, 21 nt, Human
uagagagagcccaagugaacc

SEQ ID NO: 888864 - RNA, 24 nt, Human
ucagcuucuccccugacuucccca

SEQ ID NO: 888865 - RNA, 19 nt, Human
uccacagggggaugagagg

SEQ ID NO: 888866 - RNA, 21 nt, Human
uccccagagagugagacccaa

SEQ ID NO: 888867 - RNA, 26 nt, Human
ucccccaccaggcaagccaaggaagc

SEQ ID NO: 888868 - RNA, 19 nt, Human
uccccuccuccccuucccc

SEQ ID NO: 888869 - RNA, 20 nt, Human
uccccuccuccccuuccccc

SEQ ID NO: 888870 - RNA, 18 nt, Human
ucccugggagaggggaga

SEQ ID NO: 888871 - RNA, 22 nt, Human
ucugcuuccuccccccacucuu

SEQ ID NO: 888872 - RNA, 24 nt, Human
ugaagaccucugcuuccucccccc

SEQ ID NO: 888873 - RNA, 23 nt, Human
ugaagccaaguccauccagugcc

SEQ ID NO: 888874 - RNA, 21 nt, Human
ugagaggggaggaagaguugg

SEQ ID NO: 888875 - RNA, 27 nt, Human
ugcccugucccuccccccaggucccca

SEQ ID NO: 888876 - RNA, 19 nt, Human
ugcugggcaacgaggggcu

SEQ ID NO: 888877 - RNA, 18 nt, Human
ugggaaguggggugagag

SEQ ID NO: 888878 - RNA, 19 nt, Human
ugggagaggggagaaggcg

SEQ ID NO: 888879 - RNA, 21 nt, Human
ugggccggagccuccuguuuc

SEQ ID NO: 888880 - RNA, 24 nt, Human
uggggcgagggagguaaccccuca

SEQ ID NO: 888881 - RNA, 21 nt, Human
ugggugcgggggucgcgggcc

SEQ ID NO: 888882 - RNA, 23 nt, Human
uggucuuucuagcccagcccucc

SEQ ID NO: 888883 - RNA, 18 nt, Human
uuggcucuaaccccgccc

SEQ ID NO: 888884 - RNA, 21 nt, Human
aaagcacuaagcuuccaacca

SEQ ID NO: 888885 - RNA, 24 nt, Human
aaagugcugggacuacaggcauga

SEQ ID NO: 888886 - RNA, 19 nt, Human
aagugcugggacuacaggc

SEQ ID NO: 888887 - RNA, 26 nt, Human
aagugcugggacuacaggcaugagcc

SEQ ID NO: 888888 - RNA, 18 nt, Human
accccagaggauggggaa

SEQ ID NO: 888889 - RNA, 26 nt, Human
agcugcucucgcuauguuggccaggc

SEQ ID NO: 888890 - RNA, 20 nt, Human
augaaccaccugccucggcc

SEQ ID NO: 888891 - RNA, 20 nt, Human
auguuggccaggcuggucuc

SEQ ID NO: 888892 - RNA, 21 nt, Human
auguuggccaggcuggucucg

SEQ ID NO: 888893 - RNA, 24 nt, Human
caaagugcugggacuacaggcaug

SEQ ID NO: 888894 - RNA, 21 nt, Human
caaggauuuuucuggaggcuu

SEQ ID NO: 888895 - RNA, 18 nt, Human
caccaugccugcccucgg

SEQ ID NO: 888896 - RNA, 18 nt, Human
caccggagcugcucucgc

SEQ ID NO: 888897 - RNA, 23 nt, Human
caccugccucggccucccaaagu

SEQ ID NO: 888898 - RNA, 24 nt, Human
cagcucugcuccccaccccagagg

SEQ ID NO: 888899 - RNA, 19 nt, Human
ccaaagugcugggacuaca

SEQ ID NO: 888900 - RNA, 24 nt, Human
ccaaagugcugggacuacaggcau

SEQ ID NO: 888901 - RNA, 22 nt, Human
ccagaccuuagaugaaccaccu

SEQ ID NO: 888902 - RNA, 20 nt, Human
ccagcucugcuccccacccc

SEQ ID NO: 888903 - RNA, 24 nt, Human
cccaaagugcugggacuacaggca

SEQ ID NO: 888904 - RNA, 21 nt, Human
ccccaaauaaggagcccacca

SEQ ID NO: 888905 - RNA, 21 nt, Human
ccccagaggauggggaauggg

SEQ ID NO: 888906 - RNA, 22 nt, Human
cccucggagcugcuaaaugaac

SEQ ID NO: 888907 - RNA, 23 nt, Human
cccucggagcugcuaaaugaaca

SEQ ID NO: 888908 - RNA, 19 nt, Human
ccgcugccacuccucccgc

SEQ ID NO: 888909 - RNA, 20 nt, Human
ccgcugccacuccucccgcc

SEQ ID NO: 888910 - RNA, 21 nt, Human
ccucuucaucuuccucaucca

SEQ ID NO: 888911 - RNA, 21 nt, Human
ccucuugggcucuuccauggg

SEQ ID NO: 888912 - RNA, 24 nt, Human
ccugccucggccucccaaagugcu

SEQ ID NO: 888913 - RNA, 23 nt, Human
ccuggccgcugccacuccucccg

SEQ ID NO: 888914 - RNA, 24 nt, Human
cgcuauguuggccaggcuggucuc

SEQ ID NO: 888915 - RNA, 19 nt, Human
cgcugaucuccucuugggc

SEQ ID NO: 888916 - RNA, 18 nt, Human
cuagagggcaggcacuuu

SEQ ID NO: 888917 - RNA, 21 nt, Human
cucugcuccccaccccagagg

SEQ ID NO: 888918 - RNA, 22 nt, Human
cucugcuccccaccccagagga

SEQ ID NO: 888919 - RNA, 21 nt, Human
cugaccuuuuucuugggcauc

SEQ ID NO: 888920 - RNA, 21 nt, Human
gacuacaggcaugagccacca

SEQ ID NO: 888921 - RNA, 24 nt, Human
gacuacaggcaugagccaccaugc

SEQ ID NO: 888922 - RNA, 22 nt, Human
gacuaccuuuuauuggcagcac

SEQ ID NO: 888923 - RNA, 24 nt, Human
ggacuacaggcaugagccaccaug

SEQ ID NO: 888924 - RNA, 22 nt, Human
ggagccuugaugugugcuuccu

SEQ ID NO: 888925 - RNA, 21 nt, Human
gggcauccuggcagcagggaa

SEQ ID NO: 888926 - RNA, 20 nt, Human
ggucucgaacuccagaccuu

SEQ ID NO: 888927 - RNA, 20 nt, Human
ggugccaggugccugcuggc

SEQ ID NO: 888928 - RNA, 18 nt, Human
guggagcugaccuuuuuc

SEQ ID NO: 888929 - RNA, 18 nt, Human
uaagcuuccaaccauagu

SEQ ID NO: 888930 - RNA, 24 nt, Human
uaagcuuccaaccauaguuaggua

SEQ ID NO: 888931 - RNA, 22 nt, Human
uacaggcaugagccaccaugcc

SEQ ID NO: 888932 - RNA, 21 nt, Human
uagaggcuagagggcaggcac

SEQ ID NO: 888933 - RNA, 19 nt, Human
uauguuggccaggcugguc

SEQ ID NO: 888934 - RNA, 24 nt, Human
uauguuggccaggcuggucucgaa

SEQ ID NO: 888935 - RNA, 20 nt, Human
uccagcaccucuucaucuuc

SEQ ID NO: 888936 - RNA, 24 nt, Human
ucccaaagugcugggacuacaggc

SEQ ID NO: 888937 - RNA, 19 nt, Human
uccccaaauaaggagccca

SEQ ID NO: 888938 - RNA, 19 nt, Human
uccugggcuuccagcaccu

SEQ ID NO: 888939 - RNA, 20 nt, Human
uccugggcuuccagcaccuc

SEQ ID NO: 888940 - RNA, 21 nt, Human
uccugggcuuccagcaccucu

SEQ ID NO: 888941 - RNA, 24 nt, Human
uccuucgcugcugccuuuuucggc

SEQ ID NO: 888942 - RNA, 18 nt, Human
ucggccucccaaagugcu

SEQ ID NO: 888943 - RNA, 23 nt, Human
ucucgcuauguuggccaggcugg

SEQ ID NO: 888944 - RNA, 24 nt, Human
ucucgcuauguuggccaggcuggu

SEQ ID NO: 888945 - RNA, 23 nt, Human
ugaaagcacuaagcuuccaacca

SEQ ID NO: 888946 - RNA, 19 nt, Human
ugcaccauccucccggcac

SEQ ID NO: 888947 - RNA, 20 nt, Human
ugcaccauccucccggcaca

SEQ ID NO: 888948 - RNA, 21 nt, Human
ugccucggccucccaaagugc

SEQ ID NO: 888949 - RNA, 24 nt, Human
ugccucggccucccaaagugcugg

SEQ ID NO: 888950 - RNA, 20 nt, Human
uggauguguucgccaaccca

SEQ ID NO: 888951 - RNA, 18 nt, Human
uggcagcagggaaggugg

SEQ ID NO: 888952 - RNA, 21 nt, Human
uggcagcagggaaggugggug

SEQ ID NO: 888953 - RNA, 23 nt, Human
uggccaggcuggucucgaacucc

SEQ ID NO: 888954 - RNA, 22 nt, Human
uggccgcggugugccuacagcc

SEQ ID NO: 888955 - RNA, 21 nt, Human
uggccgcugccacuccucccg

SEQ ID NO: 888956 - RNA, 18 nt, Human
ugggacuacaggcaugag

SEQ ID NO: 888957 - RNA, 22 nt, Human
ugggacuacaggcaugagccac

SEQ ID NO: 888958 - RNA, 24 nt, Human
ugggacuacaggcaugagccacca

SEQ ID NO: 888959 - RNA, 22 nt, Human
ugggcucuuccauggcagcccc

SEQ ID NO: 888960 - RNA, 19 nt, Human
uggggugcaccauccuccc

SEQ ID NO: 888961 - RNA, 22 nt, Human
uuccugggcuuccagcaccucu

SEQ ID NO: 888962 - RNA, 21 nt, Human
uugaugugugcuuccugggcu

SEQ ID NO: 888963 - RNA, 22 nt, Human
uuggcagcacccugcuggcaag

SEQ ID NO: 888964 - RNA, 20 nt, Human
uuuucggcuucgcuuccacu

SEQ ID NO: 888965 - RNA, 24 nt, Human
uuuuuuuugcacuuuugugucuga

SEQ ID NO: 888966 - RNA, 19 nt, Human
uuuuuuuuuuuuuuuugca

SEQ ID NO: 888967 - RNA, 19 nt, Human
uuuuuuuuuuuuuuuuugc

SEQ ID NO: 888968 - RNA, 27 nt, Human
uuuuuuuuuuuuuuuuuuuuuuugggg

SEQ ID NO: 888969 - RNA, 20 nt, Human
aaaccuugacaugaggaaaa

SEQ ID NO: 888970 - RNA, 18 nt, Human
aagcaagcauucaaacca

SEQ ID NO: 888971 - RNA, 22 nt, Human
aagcauucaaaccaucaaaaaa

SEQ ID NO: 888972 - RNA, 23 nt, Human
aaggauacuacaagaaagcaagc

SEQ ID NO: 888973 - RNA, 24 nt, Human
aggagaaaaaaaauaacaaacuga

SEQ ID NO: 888974 - RNA, 19 nt, Human
auucacuguccucuucccc

SEQ ID NO: 888975 - RNA, 18 nt, Human
ccuuaaggagaaaaaaaa

SEQ ID NO: 888976 - RNA, 21 nt, Human
gccuuaaggagaaaaaaaaua

SEQ ID NO: 888977 - RNA, 18 nt, Human
uacuggguagcuggguaa

SEQ ID NO: 888978 - RNA, 22 nt, Human
ucauggucauagucacauuacu

SEQ ID NO: 888979 - RNA, 24 nt, Human
uccccgagcugugaaaaguuaugc

SEQ ID NO: 888980 - RNA, 20 nt, Human
uccucuuccccuuuguuucc

SEQ ID NO: 888981 - RNA, 21 nt, Human
uugacaugaggaaaaaaugac

SEQ ID NO: 888982 - RNA, 18 nt, Human
uuucagggcaauuaaaag

SEQ ID NO: 888983 - RNA, 22 nt, Human
aaaagaauauaaaacacauuaa

SEQ ID NO: 888984 - RNA, 18 nt, Human
aaaaugaacaguguaucc

SEQ ID NO: 888985 - RNA, 24 nt, Human
aaaguguugggauuacacguguga

SEQ ID NO: 888986 - RNA, 19 nt, Human
aacauagcacaacuccauu

SEQ ID NO: 888987 - RNA, 19 nt, Human
aagaauauaaaacacauua

SEQ ID NO: 888988 - RNA, 23 nt, Human
aagguacuuuguugcuaagugaa

SEQ ID NO: 888989 - RNA, 26 nt, Human
aaguguugggauuacacgugugagcc

SEQ ID NO: 888990 - RNA, 24 nt, Human
acaauuucugaccugguaacaaaa

SEQ ID NO: 888991 - RNA, 26 nt, Human
acacugacaucuuuugaaaaacgugu

SEQ ID NO: 888992 - RNA, 23 nt, Human
accugguaacaaaauuguucuga

SEQ ID NO: 888993 - RNA, 19 nt, Human
acggggucuugcuauguug

SEQ ID NO: 888994 - RNA, 24 nt, Human
acggggucuugcuauguugcccag

SEQ ID NO: 888995 - RNA, 24 nt, Human
acggggucuugcuauguugcccag

SEQ ID NO: 888996 - RNA, 20 nt, Human
acuacaaaagaauauaaaac

SEQ ID NO: 888997 - RNA, 19 nt, Human
acuccccucccuguagaga

SEQ ID NO: 888998 - RNA, 24 nt, Human
agaaaacaaauucaauugucaaac

SEQ ID NO: 888999 - RNA, 18 nt, Human
agaauauaaaacacauua

SEQ ID NO: 889000 - RNA, 19 nt, Human
agagaagcggaccacaaug

SEQ ID NO: 889001 - RNA, 20 nt, Human
aggcaucugcugcaggaacc

SEQ ID NO: 889002 - RNA, 25 nt, Human
agucuagucucaaacuccuggccuc

SEQ ID NO: 889003 - RNA, 24 nt, Human
aguguugggauuacacgugugagc

SEQ ID NO: 889004 - RNA, 18 nt, Human
aguuauguuguuuuacua

SEQ ID NO: 889005 - RNA, 20 nt, Human
auguugcccagucuagucuc

SEQ ID NO: 889006 - RNA, 24 nt, Human
auuugaggaaaaaaaugagaaaug

SEQ ID NO: 889007 - RNA, 20 nt, Human
caaaguguugggauuacacg

SEQ ID NO: 889008 - RNA, 21 nt, Human
caaauaaaaccacugucuccu

SEQ ID NO: 889009 - RNA, 25 nt, Human
caaauaaauucccuagacuccccuc

SEQ ID NO: 889010 - RNA, 18 nt, Human
caaauucaacaggccaaa

SEQ ID NO: 889011 - RNA, 24 nt, Human
caacaucacugaaaaugaaaagaa

SEQ ID NO: 889012 - RNA, 22 nt, Human
caagauucucagacaagaauua

SEQ ID NO: 889013 - RNA, 20 nt, Human
caauuucugaccugguaaca

SEQ ID NO: 889014 - RNA, 19 nt, Human
cagcucuuuuaaaaauuca

SEQ ID NO: 889015 - RNA, 23 nt, Human
caggccccaauguagaucaugaa

SEQ ID NO: 889016 - RNA, 19 nt, Human
caguaaagacacugaucaa

SEQ ID NO: 889017 - RNA, 21 nt, Human
cagucuagucucaaacuccug

SEQ ID NO: 889018 - RNA, 23 nt, Human
cauucccaacaucacugaaaaug

SEQ ID NO: 889019 - RNA, 19 nt, Human
ccaaaguguugggauuaca

SEQ ID NO: 889020 - RNA, 22 nt, Human
ccaaaguguugggauuacacgu

SEQ ID NO: 889021 - RNA, 22 nt, Human
ccaaaguguugggauuacacgu

SEQ ID NO: 889022 - RNA, 24 nt, Human
ccaaaguguugggauuacacgugu

SEQ ID NO: 889023 - RNA, 24 nt, Human
ccaacaucacugaaaaugaaaaga

SEQ ID NO: 889024 - RNA, 22 nt, Human
cccaguccauucccaacaucac

SEQ ID NO: 889025 - RNA, 22 nt, Human
ccuaccccugaaauuauuuaga

SEQ ID NO: 889026 - RNA, 18 nt, Human
ccucagccucccaaagug

SEQ ID NO: 889027 - RNA, 18 nt, Human
ccuguagagaccaucagc

SEQ ID NO: 889028 - RNA, 23 nt, Human
cggggucuugcuauguugcccag

SEQ ID NO: 889029 - RNA, 24 nt, Human
cuccucagccucccaaaguguugg

SEQ ID NO: 889030 - RNA, 19 nt, Human
cugcugcaggaaccuucug

SEQ ID NO: 889031 - RNA, 20 nt, Human
cuguggagauugcuuuugcc

SEQ ID NO: 889032 - RNA, 24 nt, Human
cuucagccccaacuuucacggacu

SEQ ID NO: 889033 - RNA, 18 nt, Human
gaggaaaaaaaugagaaa

SEQ ID NO: 889034 - RNA, 18 nt, Human
gauuacacgugugagcca

SEQ ID NO: 889035 - RNA, 24 nt, Human
gauuacacgugugagccaccaugc

SEQ ID NO: 889036 - RNA, 23 nt, Human
gauucucagacaagaauuaaagg

SEQ ID NO: 889037 - RNA, 24 nt, Human
ggauuacacgugugagccaccaug

SEQ ID NO: 889038 - RNA, 19 nt, Human
ggcauucuuuuggauucug

SEQ ID NO: 889039 - RNA, 21 nt, Human
gggucuugcuauguugcccag

SEQ ID NO: 889040 - RNA, 18 nt, Human
guagagacggggucuugc

SEQ ID NO: 889041 - RNA, 21 nt, Human
guccucaugucaaggcagugu

SEQ ID NO: 889042 - RNA, 26 nt, Human
uaaaaaaauaaucccaggccccaauu

SEQ ID NO: 889043 - RNA, 24 nt, Human
uacacgugugagccaccaugccug

SEQ ID NO: 889044 - RNA, 21 nt, Human
uacagauccaaucuguuguca

SEQ ID NO: 889045 - RNA, 24 nt, Human
uagagaccaucagcucacugugaa

SEQ ID NO: 889046 - RNA, 22 nt, Human
uagagacggggucuugcuaugu

SEQ ID NO: 889047 - RNA, 20 nt, Human
uaugacaaacccuugcuuuu

SEQ ID NO: 889048 - RNA, 24 nt, Human
uauguugcccagucuagucucaaa

SEQ ID NO: 889049 - RNA, 18 nt, Human
uauugacaacaucucccc

SEQ ID NO: 889050 - RNA, 25 nt, Human
uauuggaaauuagaagguacuuugu

SEQ ID NO: 889051 - RNA, 20 nt, Human
ucagacaagaauuaaaggca

SEQ ID NO: 889052 - RNA, 19 nt, Human
ucagaggcuuccagcucag

SEQ ID NO: 889053 - RNA, 25 nt, Human
uccauucccaacaucacugaaaaug

SEQ ID NO: 889054 - RNA, 18 nt, Human
ucccaaaguguugggauu

SEQ ID NO: 889055 - RNA, 21 nt, Human
ucccaaaguguugggauuaca

SEQ ID NO: 889056 - RNA, 21 nt, Human
ucccaggccccaauguagauc

SEQ ID NO: 889057 - RNA, 21 nt, Human
ucccucuucaagcucccuuuu

SEQ ID NO: 889058 - RNA, 19 nt, Human
ucugacacauggccaagau

SEQ ID NO: 889059 - RNA, 25 nt, Human
ucuguccuuuaauaacuuucagagg

SEQ ID NO: 889060 - RNA, 18 nt, Human
ucuugcuauguugcccag

SEQ ID NO: 889061 - RNA, 22 nt, Human
ucuugcuauguugcccagucua

SEQ ID NO: 889062 - RNA, 18 nt, Human
ugacaacaucuccccuac

SEQ ID NO: 889063 - RNA, 21 nt, Human
ugacaacaucuccccuacccc

SEQ ID NO: 889064 - RNA, 18 nt, Human
ugaccucuaagcaugccu

SEQ ID NO: 889065 - RNA, 19 nt, Human
ugaccucuaagcaugccuu

SEQ ID NO: 889066 - RNA, 22 nt, Human
ugagaaauggcuaaaagaggca

SEQ ID NO: 889067 - RNA, 18 nt, Human
ugggauuacacgugugag

SEQ ID NO: 889068 - RNA, 22 nt, Human
ugggauuacacgugugagccac

SEQ ID NO: 889069 - RNA, 23 nt, Human
ugggauuacacgugugagccacc

SEQ ID NO: 889070 - RNA, 24 nt, Human
ugggauuacacgugugagccacca

SEQ ID NO: 889071 - RNA, 25 nt, Human
ugggauuacacgugugagccaccau

SEQ ID NO: 889072 - RNA, 24 nt, Human
uguagagacggggucuugcuaugu

SEQ ID NO: 889073 - RNA, 21 nt, Human
ugucaaagaacacaauuucug

SEQ ID NO: 889074 - RNA, 20 nt, Human
ugugaaggcuugagccucag

SEQ ID NO: 889075 - RNA, 19 nt, Human
uguugcuaagugaaaaaaa

SEQ ID NO: 889076 - RNA, 21 nt, Human
uguugggauuacacgugugag

SEQ ID NO: 889077 - RNA, 23 nt, Human
uuaaaugagcaauaacucagaua

SEQ ID NO: 889078 - RNA, 21 nt, Human
uucacagaaaacaaauucaau

SEQ ID NO: 889079 - RNA, 18 nt, Human
uuccugauguaugaagca

SEQ ID NO: 889080 - RNA, 18 nt, Human
uugcccagucuagucuca

SEQ ID NO: 889081 - RNA, 24 nt, Human
uuguagagacggggucuugcuaug

SEQ ID NO: 889082 - RNA, 20 nt, Human
uuugaggaaaaaaaugagaa

SEQ ID NO: 889083 - RNA, 20 nt, Human
uuuguagagacggggucuug

SEQ ID NO: 889084 - RNA, 24 nt, Human
uuuguagagacggggucuugcuau

SEQ ID NO: 889085 - RNA, 23 nt, Human
uuuuuuaaguucauccagcuuua

SEQ ID NO: 889086 - RNA, 23 nt, Human
uuuuuuuuuaaguucauccagcu

SEQ ID NO: 889087 - RNA, 24 nt, Human
uuuuuuuuuuaaguucauccagcu

SEQ ID NO: 889088 - RNA, 19 nt, Human
uuuuuuuuuuuuuuuuuaa

SEQ ID NO: 889089 - RNA, 21 nt, Human
aacaucuaggcagggccaaca

SEQ ID NO: 889090 - RNA, 18 nt, Human
aagaagcuaagagauuuu

SEQ ID NO: 889091 - RNA, 20 nt, Human
aagcuaagagauuuugcauc

SEQ ID NO: 889092 - RNA, 22 nt, Human
agaagcuaagagauuuugcauc

SEQ ID NO: 889093 - RNA, 21 nt, Human
agacaaacuguaacacagucc

SEQ ID NO: 889094 - RNA, 22 nt, Human
cacaacaucuaggcagggccaa

SEQ ID NO: 889095 - RNA, 19 nt, Human
cacaguccaugggccugca

SEQ ID NO: 889096 - RNA, 19 nt, Human
caccaugcccgguccgggc

SEQ ID NO: 889097 - RNA, 20 nt, Human
caccaugcccgguccgggcg

SEQ ID NO: 889098 - RNA, 21 nt, Human
cagacaacucuucagaagccc

SEQ ID NO: 889099 - RNA, 18 nt, Human
caugaggacgggagaggg

SEQ ID NO: 889100 - RNA, 20 nt, Human
cccaacaccaugcccggucc

SEQ ID NO: 889101 - RNA, 21 nt, Human
ccccgagacaggcgaggcggg

SEQ ID NO: 889102 - RNA, 19 nt, Human
ccggcgcccaacaccaugc

SEQ ID NO: 889103 - RNA, 24 nt, Human
cucuugcuguuucauguuagagac

SEQ ID NO: 889104 - RNA, 21 nt, Human
cugcgaguuacacugaacaca

SEQ ID NO: 889105 - RNA, 20 nt, Human
cugcugccuuuacccugggc

SEQ ID NO: 889106 - RNA, 22 nt, Human
gagcaugaggacgggagagggg

SEQ ID NO: 889107 - RNA, 18 nt, Human
ggacugagagggagcaug

SEQ ID NO: 889108 - RNA, 18 nt, Human
gggagagggggcuaccuc

SEQ ID NO: 889109 - RNA, 18 nt, Human
uaagagaucuacagugaa

SEQ ID NO: 889110 - RNA, 21 nt, Human
uaagagaucuacagugaauga

SEQ ID NO: 889111 - RNA, 21 nt, Human
uaagcagacaacucuucagaa

SEQ ID NO: 889112 - RNA, 23 nt, Human
uaagguaagcagacaacucuuca

SEQ ID NO: 889113 - RNA, 20 nt, Human
uacccugggcuccccgagac

SEQ ID NO: 889114 - RNA, 22 nt, Human
uauuuauguugaauucuccauc

SEQ ID NO: 889115 - RNA, 23 nt, Human
ucagaagcccaaacacauuuucu

SEQ ID NO: 889116 - RNA, 21 nt, Human
ucaugaagauggucuucuuca

SEQ ID NO: 889117 - RNA, 24 nt, Human
uccaggggacugagagggaggaag

SEQ ID NO: 889118 - RNA, 22 nt, Human
ugaaaauacaaacuaaaugaac

SEQ ID NO: 889119 - RNA, 18 nt, Human
ugagagggagcaugagga

SEQ ID NO: 889120 - RNA, 19 nt, Human
ugaggacgggagagggggc

SEQ ID NO: 889121 - RNA, 22 nt, Human
ugaguucauuacaacuucuuaa

SEQ ID NO: 889122 - RNA, 21 nt, Human
uguagcggguaucuuauugcc

SEQ ID NO: 889123 - RNA, 18 nt, Human
ugugcagaaaaccaauuu

SEQ ID NO: 889124 - RNA, 19 nt, Human
uuuuuuuuuuuuucuuugu

SEQ ID NO: 889125 - RNA, 23 nt, Human
uuuuuuuuuuuuuuuucuuuggg

SEQ ID NO: 889126 - RNA, 21 nt, Human
aaaaacaauaaaacagaaggc

SEQ ID NO: 889127 - RNA, 23 nt, Human
aaacaauaaaacagaaggccaag

SEQ ID NO: 889128 - RNA, 21 nt, Human
aaacuguaauauuagaagcaa

SEQ ID NO: 889129 - RNA, 26 nt, Human
aaagaaaaaaacaauaaaacagaagg

SEQ ID NO: 889130 - RNA, 21 nt, Human
aaagauuaacacucuccaaga

SEQ ID NO: 889131 - RNA, 19 nt, Human
aaaggaaaggcaauaaagg

SEQ ID NO: 889132 - RNA, 20 nt, Human
aaagggaaaacagcaaagaa

SEQ ID NO: 889133 - RNA, 19 nt, Human
aaccauaacagaacagggu

SEQ ID NO: 889134 - RNA, 23 nt, Human
aagaaaaaaacaauaaaacagaa

SEQ ID NO: 889135 - RNA, 20 nt, Human
acacaauauacuugguauuu

SEQ ID NO: 889136 - RNA, 20 nt, Human
acccaacauuuucucagucu

SEQ ID NO: 889137 - RNA, 22 nt, Human
agaaaaaaacaauaaaacagaa

SEQ ID NO: 889138 - RNA, 18 nt, Human
agaaggccaaggauaagg

SEQ ID NO: 889139 - RNA, 19 nt, Human
agacacaauauacuuggua

SEQ ID NO: 889140 - RNA, 19 nt, Human
agggaaaacagcaaagaaa

SEQ ID NO: 889141 - RNA, 21 nt, Human
cacagcagucacuucugguca

SEQ ID NO: 889142 - RNA, 24 nt, Human
ccaaucaagcacgacuggacccaa

SEQ ID NO: 889143 - RNA, 19 nt, Human
cgcuccgccgccgccgcgu

SEQ ID NO: 889144 - RNA, 21 nt, Human
cuccaggacgccacugcggcc

SEQ ID NO: 889145 - RNA, 25 nt, Human
gaagcaaagggaaaacagcaaagaa

SEQ ID NO: 889146 - RNA, 24 nt, Human
gacccaacauuuucucagucuuca

SEQ ID NO: 889147 - RNA, 22 nt, Human
gagggcuccaggacgccacugc

SEQ ID NO: 889148 - RNA, 24 nt, Human
ggagggcuccaggacgccacugcg

SEQ ID NO: 889149 - RNA, 22 nt, Human
ggcacgaggccugcgcuccgcc

SEQ ID NO: 889150 - RNA, 21 nt, Human
uaaaacagaaggccaaggaua

SEQ ID NO: 889151 - RNA, 27 nt, Human
uaaaggauuucuuccauauaaagauuc

SEQ ID NO: 889152 - RNA, 22 nt, Human
uaauauuagaagcaaagggaaa

SEQ ID NO: 889153 - RNA, 24 nt, Human
uacacagcagucacuucuggucag

SEQ ID NO: 889154 - RNA, 21 nt, Human
uaguauauauguaugggcuga

SEQ ID NO: 889155 - RNA, 23 nt, Human
uaugcagaugcacugcauacaua

SEQ ID NO: 889156 - RNA, 20 nt, Human
ucauauauagauauaauaau

SEQ ID NO: 889157 - RNA, 26 nt, Human
uccacuuauuauugcuauuuagucac

SEQ ID NO: 889158 - RNA, 21 nt, Human
uccaggacgccacugcggccg

SEQ ID NO: 889159 - RNA, 21 nt, Human
ugacaaauauaauaccuggaa

SEQ ID NO: 889160 - RNA, 22 nt, Human
ugacugaagacaaugaauguau

SEQ ID NO: 889161 - RNA, 18 nt, Human
ugcauacauaguauauau

SEQ ID NO: 889162 - RNA, 25 nt, Human
ugcuguaugacugaagacaaugaau

SEQ ID NO: 889163 - RNA, 19 nt, Human
uggccguaacggcacgagg

SEQ ID NO: 889164 - RNA, 19 nt, Human
uguaaauuaaaauuguaca

SEQ ID NO: 889165 - RNA, 20 nt, Human
ugucucaugugucuugcugu

SEQ ID NO: 889166 - RNA, 21 nt, Human
ugucuugcuguaugacugaag

SEQ ID NO: 889167 - RNA, 21 nt, Human
uuacaaaauacaaaacuguaa

SEQ ID NO: 889168 - RNA, 21 nt, Human
uuuacaaggaaacaaaggaaa

SEQ ID NO: 889169 - RNA, 28 nt, Human
uuuuuuuuuuuuuuuuuuuuuuuggggg

SEQ ID NO: 889170 - RNA, 21 nt, Human
aaaacaauccccccaaaccca

SEQ ID NO: 889171 - RNA, 18 nt, Human
aaacaggagcggaggccu

SEQ ID NO: 889172 - RNA, 19 nt, Human
aaaccaaacaaaaucccaa

SEQ ID NO: 889173 - RNA, 19 nt, Human
aaaccaaacaaaaucccaa

SEQ ID NO: 889174 - RNA, 19 nt, Human
aaaccaaacaaaaucccaa

SEQ ID NO: 889175 - RNA, 22 nt, Human
aaccuugugcccccccaacccc

SEQ ID NO: 889176 - RNA, 20 nt, Human
aagaaaacaauccccccaaa

SEQ ID NO: 889177 - RNA, 24 nt, Human
aagaaaacaaucgccauaaaccag

SEQ ID NO: 889178 - RNA, 22 nt, Human
aagcagagcuggcucagcagaa

SEQ ID NO: 889179 - RNA, 20 nt, Human
aagcccagacaacacggcag

SEQ ID NO: 889180 - RNA, 20 nt, Human
aaggagcugagccucugugg

SEQ ID NO: 889181 - RNA, 18 nt, Human
aagggacagggaaaacca

SEQ ID NO: 889182 - RNA, 20 nt, Human
aauccagagcccaguggaag

SEQ ID NO: 889183 - RNA, 22 nt, Human
acaauccccccaaacccaguaa

SEQ ID NO: 889184 - RNA, 19 nt, Human
acagggaaaaccauaccga

SEQ ID NO: 889185 - RNA, 23 nt, Human
accaaaacaggagcggaggccug

SEQ ID NO: 889186 - RNA, 21 nt, Human
accacagacagaaacauucaa

SEQ ID NO: 889187 - RNA, 20 nt, Human
accccaaaugccaaacaaca

SEQ ID NO: 889188 - RNA, 21 nt, Human
accuugugcccccccaacccc

SEQ ID NO: 889189 - RNA, 23 nt, Human
agaaaacaauccccccaaaccca

SEQ ID NO: 889190 - RNA, 22 nt, Human
agaaaacaaucgccauaaacca

SEQ ID NO: 889191 - RNA, 21 nt, Human
agacagaaacauucaaccaau

SEQ ID NO: 889192 - RNA, 18 nt, Human
agagcacaucucagggac

SEQ ID NO: 889193 - RNA, 19 nt, Human
agcagugguggccucuggg

SEQ ID NO: 889194 - RNA, 21 nt, Human
aggagcggaggccugaggaca

SEQ ID NO: 889195 - RNA, 22 nt, Human
aggaggagggauuggaaucagu

SEQ ID NO: 889196 - RNA, 32 nt, Human
aggcaggaaagggugggugggcaugacccaag

SEQ ID NO: 889197 - RNA, 24 nt, Human
agggacagggaaaaccauaccgaa

SEQ ID NO: 889198 - RNA, 26 nt, Human
agggugggugggcaugacccaaggag

SEQ ID NO: 889199 - RNA, 23 nt, Human
aggugggggagcgaggauggggc

SEQ ID NO: 889200 - RNA, 21 nt, Human
caaaagaaaacaaucccccca

SEQ ID NO: 889201 - RNA, 18 nt, Human
caaacaacaagagcacau

SEQ ID NO: 889202 - RNA, 22 nt, Human
caaacccaguaaccuaggcauc

SEQ ID NO: 889203 - RNA, 23 nt, Human
caagaaaccagugucuguaacuc

SEQ ID NO: 889204 - RNA, 19 nt, Human
caagagccaguggucaggg

SEQ ID NO: 889205 - RNA, 21 nt, Human
caagcccagacaacacggcag

SEQ ID NO: 889206 - RNA, 20 nt, Human
caccacagacagaaacauuc

SEQ ID NO: 889207 - RNA, 23 nt, Human
caccacagacagaaacauucaac

SEQ ID NO: 889208 - RNA, 18 nt, Human
caccucauggauggguag

SEQ ID NO: 889209 - RNA, 23 nt, Human
cagcagcgccaccgaggccagga

SEQ ID NO: 889210 - RNA, 20 nt, Human
caggagagacgaacgccgug

SEQ ID NO: 889211 - RNA, 20 nt, Human
caguguugccuggcucaggc

SEQ ID NO: 889212 - RNA, 21 nt, Human
caugcauacuccaacacaucu

SEQ ID NO: 889213 - RNA, 20 nt, Human
ccaaaaccuugugccccccc

SEQ ID NO: 889214 - RNA, 21 nt, Human
ccaaacccaguaaccuaggca

SEQ ID NO: 889215 - RNA, 21 nt, Human
ccaaaugcucucuguaaucaa

SEQ ID NO: 889216 - RNA, 21 nt, Human
ccaggaagcagagcuggcuca

SEQ ID NO: 889217 - RNA, 23 nt, Human
ccagugucuguaacuccugcaug

SEQ ID NO: 889218 - RNA, 23 nt, Human
ccccaaaagaaaacaaucccccc

SEQ ID NO: 889219 - RNA, 24 nt, Human
cccccaaaagaaaacaaucccccc

SEQ ID NO: 889220 - RNA, 20 nt, Human
cccccaaacccaguaaccua

SEQ ID NO: 889221 - RNA, 21 nt, Human
cccccaaccccaggggacgcc

SEQ ID NO: 889222 - RNA, 21 nt, Human
ccccccaaacccaguaaccua

SEQ ID NO: 889223 - RNA, 23 nt, Human
cccccccaaccccaggggacgcc

SEQ ID NO: 889224 - RNA, 23 nt, Human
cccccuccucucuauuucuucaa

SEQ ID NO: 889225 - RNA, 21 nt, Human
ccuccaggaagggaggggugc

SEQ ID NO: 889226 - RNA, 21 nt, Human
ccugggccaccaaaacaggag

SEQ ID NO: 889227 - RNA, 21 nt, Human
cgacagcgaccagagcagcag

SEQ ID NO: 889228 - RNA, 22 nt, Human
cgccguggccccgggggccugu

SEQ ID NO: 889229 - RNA, 20 nt, Human
cuagaaucucagucacuguu

SEQ ID NO: 889230 - RNA, 22 nt, Human
cuccaaaaccuugugccccccc

SEQ ID NO: 889231 - RNA, 23 nt, Human
cuggcaccucauggauggguagu

SEQ ID NO: 889232 - RNA, 20 nt, Human
cugggccggcuuggcggagg

SEQ ID NO: 889233 - RNA, 22 nt, Human
cuucugcucucgcaggcucgac

SEQ ID NO: 889234 - RNA, 22 nt, Human
cuugugcccccccaaccccagg

SEQ ID NO: 889235 - RNA, 22 nt, Human
gaaaaccauaccgaaugaauga

SEQ ID NO: 889236 - RNA, 19 nt, Human
gaagaaaaggaguaaaagg

SEQ ID NO: 889237 - RNA, 18 nt, Human
gaaggacguuugcccaag

SEQ ID NO: 889238 - RNA, 18 nt, Human
gacagcgaccagagcagc

SEQ ID NO: 889239 - RNA, 22 nt, Human
gagcagcagcgccaccgaggcc

SEQ ID NO: 889240 - RNA, 21 nt, Human
gagcgaggauggggcagggga

SEQ ID NO: 889241 - RNA, 18 nt, Human
gaggauggggcaggggag

SEQ ID NO: 889242 - RNA, 24 nt, Human
gaggcaggaaagggugggugggca

SEQ ID NO: 889243 - RNA, 21 nt, Human
gaggcguccuuggcuauaaaa

SEQ ID NO: 889244 - RNA, 19 nt, Human
gccugaggacagcacagga

SEQ ID NO: 889245 - RNA, 23 nt, Human
gccugggccaccaaaacaggagc

SEQ ID NO: 889246 - RNA, 21 nt, Human
gccuugcccaguggcuccucu

SEQ ID NO: 889247 - RNA, 19 nt, Human
ggaaggacguuugcccaag

SEQ ID NO: 889248 - RNA, 23 nt, Human
ggaugucuucacacggaggaggc

SEQ ID NO: 889249 - RNA, 21 nt, Human
ggcaggaaagggugggugggc

SEQ ID NO: 889250 - RNA, 19 nt, Human
ggccaggaagcagagcugg

SEQ ID NO: 889251 - RNA, 23 nt, Human
ggccaggaagcagagcuggcuca

SEQ ID NO: 889252 - RNA, 22 nt, Human
ggcccccaaaagaaaacaaucc

SEQ ID NO: 889253 - RNA, 20 nt, Human
gggcaggggagagccugggc

SEQ ID NO: 889254 - RNA, 22 nt, Human
ggguaguuuguuuaacuggggc

SEQ ID NO: 889255 - RNA, 23 nt, Human
gucacucccugucaccccaaaug

SEQ ID NO: 889256 - RNA, 18 nt, Human
guccaagaaaacaaucgc

SEQ ID NO: 889257 - RNA, 23 nt, Human
gugaggaaggacguuugcccaag

SEQ ID NO: 889258 - RNA, 20 nt, Human
gugguggccucugggucacu

SEQ ID NO: 889259 - RNA, 20 nt, Human
uaaaaagcacuacauccaug

SEQ ID NO: 889260 - RNA, 19 nt, Human
uaaaaggggaaggccccca

SEQ ID NO: 889261 - RNA, 24 nt, Human
uaaaccagugcaaaaugugcaaca

SEQ ID NO: 889262 - RNA, 19 nt, Human
uaaaguaaauacaagggac

SEQ ID NO: 889263 - RNA, 21 nt, Human
uaaccuaggcaucaucuccaa

SEQ ID NO: 889264 - RNA, 23 nt, Human
uaacuuaaaaaaggaggagggau

SEQ ID NO: 889265 - RNA, 24 nt, Human
uaaucaacgggcccccuccucucu

SEQ ID NO: 889266 - RNA, 20 nt, Human
uaccaaguggcaaauuggga

SEQ ID NO: 889267 - RNA, 21 nt, Human
uagaaagaaccuagugagaaa

SEQ ID NO: 889268 - RNA, 19 nt, Human
uagugagaaagagauggug

SEQ ID NO: 889269 - RNA, 21 nt, Human
uauugcacagaaaagaaggag

SEQ ID NO: 889270 - RNA, 19 nt, Human
ucaccccaaaugccaaaca

SEQ ID NO: 889271 - RNA, 22 nt, Human
ucacucccugucaccccaaaug

SEQ ID NO: 889272 - RNA, 20 nt, Human
ucacuguuuaaaaauggagc

SEQ ID NO: 889273 - RNA, 18 nt, Human
ucaggccaguuagcagcc

SEQ ID NO: 889274 - RNA, 18 nt, Human
uccaaaaccuugugcccc

SEQ ID NO: 889275 - RNA, 23 nt, Human
uccaaaaccuugugcccccccaa

SEQ ID NO: 889276 - RNA, 21 nt, Human
uccaacacaucugggaugcaa

SEQ ID NO: 889277 - RNA, 22 nt, Human
uccguccaagaaaacaaucgcc

SEQ ID NO: 889278 - RNA, 25 nt, Human
uccuccaaaaccuugugccccccca

SEQ ID NO: 889279 - RNA, 23 nt, Human
ucggggaagcuucuguuuuugac

SEQ ID NO: 889280 - RNA, 20 nt, Human
ucucuguaaucaacgggccc

SEQ ID NO: 889281 - RNA, 23 nt, Human
ucucuguaaucaacgggcccccu

SEQ ID NO: 889282 - RNA, 23 nt, Human
ucucuguuuucuccuucccuggc

SEQ ID NO: 889283 - RNA, 18 nt, Human
ucuuccuccaaaaccuug

SEQ ID NO: 889284 - RNA, 19 nt, Human
ugagaaagagauggugaug

SEQ ID NO: 889285 - RNA, 18 nt, Human
ugagcgagucugcaugua

SEQ ID NO: 889286 - RNA, 19 nt, Human
ugagcgagucugcauguaa

SEQ ID NO: 889287 - RNA, 21 nt, Human
ugagcgagucugcauguaaca

SEQ ID NO: 889288 - RNA, 18 nt, Human
ugagggaaguugucuucu

SEQ ID NO: 889289 - RNA, 27 nt, Human
ugcacagaaaagaaggagcugagccuc

SEQ ID NO: 889290 - RNA, 23 nt, Human
ugccuggcaccucauggaugggu

SEQ ID NO: 889291 - RNA, 24 nt, Human
uggaaaagucacguggauguugga

SEQ ID NO: 889292 - RNA, 19 nt, Human
uggaagaaaaggaguaaaa

SEQ ID NO: 889293 - RNA, 18 nt, Human
uggagcuggaaaagucac

SEQ ID NO: 889294 - RNA, 21 nt, Human
uggcggaggcgccccgugagg

SEQ ID NO: 889295 - RNA, 20 nt, Human
uggcucaggccaguuagcag

SEQ ID NO: 889296 - RNA, 21 nt, Human
uggcucaggccaguuagcagc

SEQ ID NO: 889297 - RNA, 21 nt, Human
ugucaguucucuguuuucucc

SEQ ID NO: 889298 - RNA, 18 nt, Human
ugugguuucaaagguguc

SEQ ID NO: 889299 - RNA, 20 nt, Human
ugugguuucaaaggugucag

SEQ ID NO: 889300 - RNA, 21 nt, Human
ugugugacucggggugcggcc

SEQ ID NO: 889301 - RNA, 22 nt, Human
uuaauccagagcccaguggaag

SEQ ID NO: 889302 - RNA, 25 nt, Human
uuaaugcugguucgcaccacagaau

SEQ ID NO: 889303 - RNA, 19 nt, Human
uucccuggccaucccucca

SEQ ID NO: 889304 - RNA, 18 nt, Human
uucuuccuccaaaaccuu

SEQ ID NO: 889305 - RNA, 22 nt, Human
uugcacagaaaagaaggagcug

SEQ ID NO: 889306 - RNA, 21 nt, Human
uugcccaguggcuccucuaaa

SEQ ID NO: 889307 - RNA, 21 nt, Human
uuuacacuauccguccaagaa

SEQ ID NO: 889308 - RNA, 21 nt, Human
uuuguagcagguuauuuuuac

SEQ ID NO: 889309 - RNA, 22 nt, Human
uuuucuccuucccuggccaucc

SEQ ID NO: 889310 - RNA, 18 nt, Human
aaaacacauaaguucuca

SEQ ID NO: 889311 - RNA, 21 nt, Human
aaaacaccuuuaggagacauu

SEQ ID NO: 889312 - RNA, 21 nt, Human
aaacaaauagacacagcucuc

SEQ ID NO: 889313 - RNA, 22 nt, Human
aaacaaauagacacagcucucc

SEQ ID NO: 889314 - RNA, 23 nt, Human
aaacaaauagacacagcucucca

SEQ ID NO: 889315 - RNA, 19 nt, Human
aaacagugcagaagaucua

SEQ ID NO: 889316 - RNA, 20 nt, Human
aaaccagugucuggaaccga

SEQ ID NO: 889317 - RNA, 21 nt, Human
aaacuucggcuuagucagcac

SEQ ID NO: 889318 - RNA, 24 nt, Human
aaagcaagaaaccagugucuggaa

SEQ ID NO: 889319 - RNA, 23 nt, Human
aacaaagcaagaaaccagugucu

SEQ ID NO: 889320 - RNA, 23 nt, Human
aaccgaacaggaacagaacaaga

SEQ ID NO: 889321 - RNA, 19 nt, Human
aagaaaccagugucuggaa

SEQ ID NO: 889322 - RNA, 24 nt, Human
aagaagagaugcugauucaagcug

SEQ ID NO: 889323 - RNA, 18 nt, Human
aagcagaaucacaagguu

SEQ ID NO: 889324 - RNA, 21 nt, Human
aauagacacagcucuccagac

SEQ ID NO: 889325 - RNA, 21 nt, Human
acaaggaaaaaauauuugcua

SEQ ID NO: 889326 - RNA, 19 nt, Human
acagcccucucacaggcuc

SEQ ID NO: 889327 - RNA, 23 nt, Human
acagcgcuguccacggugucugu

SEQ ID NO: 889328 - RNA, 19 nt, Human
acugugacuuuguuggucu

SEQ ID NO: 889329 - RNA, 20 nt, Human
acuuugcucuucuccuugcc

SEQ ID NO: 889330 - RNA, 21 nt, Human
agcagaaucacaagguuuaga

SEQ ID NO: 889331 - RNA, 19 nt, Human
agcccucucacaggcuccu

SEQ ID NO: 889332 - RNA, 24 nt, Human
agccgaguggacgccacccuggga

SEQ ID NO: 889333 - RNA, 21 nt, Human
auaaaaagucuuaagucuaca

SEQ ID NO: 889334 - RNA, 22 nt, Human
caaaacuucggcuuagucagca

SEQ ID NO: 889335 - RNA, 25 nt, Human
caauauguauaccucacaaaaauua

SEQ ID NO: 889336 - RNA, 18 nt, Human
cacccugggaaccagggc

SEQ ID NO: 889337 - RNA, 18 nt, Human
cacugcuaaaaaacaaaa

SEQ ID NO: 889338 - RNA, 21 nt, Human
cagcacugcuaaaaaacaaaa

SEQ ID NO: 889339 - RNA, 19 nt, Human
cagggccaggccugucugc

SEQ ID NO: 889340 - RNA, 19 nt, Human
cauugcuaugaagauaucu

SEQ ID NO: 889341 - RNA, 25 nt, Human
cccaaauucaggcuuuagcuuaaaa

SEQ ID NO: 889342 - RNA, 22 nt, Human
cccccagauaaaaucuuaaucu

SEQ ID NO: 889343 - RNA, 23 nt, Human
ccuccugccacagccgaguggac

SEQ ID NO: 889344 - RNA, 23 nt, Human
cgaacaggaacagaacaagagca

SEQ ID NO: 889345 - RNA, 21 nt, Human
cgccgucaggugccggcugcc

SEQ ID NO: 889346 - RNA, 24 nt, Human
gagaagaggcagcuccuccugcca

SEQ ID NO: 889347 - RNA, 18 nt, Human
gccgucaggugccggcug

SEQ ID NO: 889348 - RNA, 19 nt, Human
gccuguaaacagugcagaa

SEQ ID NO: 889349 - RNA, 22 nt, Human
gcgagcuucagacugucaagag

SEQ ID NO: 889350 - RNA, 22 nt, Human
ggaaaaaauauuugcuaauguu

SEQ ID NO: 889351 - RNA, 22 nt, Human
gggaaugagagaggggaaggga

SEQ ID NO: 889352 - RNA, 18 nt, Human
ggggaaugagagagggga

SEQ ID NO: 889353 - RNA, 19 nt, Human
ggggaaugagagaggggaa

SEQ ID NO: 889354 - RNA, 25 nt, Human
gucaggcugacagggaagaagagau

SEQ ID NO: 889355 - RNA, 19 nt, Human
uaaaaaacacauggcagag

SEQ ID NO: 889356 - RNA, 24 nt, Human
uaaaaagucuuaagucuacaaauu

SEQ ID NO: 889357 - RNA, 23 nt, Human
uaaaagggacuuaauuuagaaau

SEQ ID NO: 889358 - RNA, 18 nt, Human
uaaaugcauuuuuuuuuu

SEQ ID NO: 889359 - RNA, 23 nt, Human
uaagcagaaucacaagguuuaga

SEQ ID NO: 889360 - RNA, 18 nt, Human
uaaggaaauaaagggcuu

SEQ ID NO: 889361 - RNA, 18 nt, Human
uaaggaaauaaagggcuu

SEQ ID NO: 889362 - RNA, 28 nt, Human
uacaaaacaccuuuaggagacauugcua

SEQ ID NO: 889363 - RNA, 24 nt, Human
uagauuagauaaaugacuuauaag

SEQ ID NO: 889364 - RNA, 21 nt, Human
uagccaaauccaagagaaauc

SEQ ID NO: 889365 - RNA, 21 nt, Human
ucaacauuuacuuggggagga

SEQ ID NO: 889366 - RNA, 22 nt, Human
ucagcacugcuaaaaaacaaaa

SEQ ID NO: 889367 - RNA, 21 nt, Human
ucggcucgggucggucacgcc

SEQ ID NO: 889368 - RNA, 22 nt, Human
ucucccauuuuggaggccagag

SEQ ID NO: 889369 - RNA, 24 nt, Human
ucucccauuuuggaggccagaguu

SEQ ID NO: 889370 - RNA, 19 nt, Human
ucuuaagucuacaaauuag

SEQ ID NO: 889371 - RNA, 23 nt, Human
ugaaacaaauagacacagcucuc

SEQ ID NO: 889372 - RNA, 22 nt, Human
ugagagaggggaagggaagagu

SEQ ID NO: 889373 - RNA, 24 nt, Human
ugccacagccgaguggacgccacc

SEQ ID NO: 889374 - RNA, 22 nt, Human
ugcuaaaaaacaaaauaaaaaa

SEQ ID NO: 889375 - RNA, 24 nt, Human
uggauuuuauguaccuuacaaaac

SEQ ID NO: 889376 - RNA, 27 nt, Human
uggggaacagaauaaacaugcuuccaa

SEQ ID NO: 889377 - RNA, 22 nt, Human
uguagccgaggcugcggccgcc

SEQ ID NO: 889378 - RNA, 22 nt, Human
ugucaagagaagaggcagcucc

SEQ ID NO: 889379 - RNA, 19 nt, Human
ugucuggaaccgaacagga

SEQ ID NO: 889380 - RNA, 24 nt, Human
uuaacagcccucucacaggcuccu

SEQ ID NO: 889381 - RNA, 21 nt, Human
uugcucuucuccuugccagua

SEQ ID NO: 889382 - RNA, 24 nt, Human
uuuaacaaagaaaaaacaaggaaa

SEQ ID NO: 889383 - RNA, 24 nt, Human
aaaaaaaaaaaacaaaacaaaaaa

SEQ ID NO: 889384 - RNA, 20 nt, Human
aaaaaacaaaacaaaaaaag

SEQ ID NO: 889385 - RNA, 22 nt, Human
aaacaaaaaaagauacagcccc

SEQ ID NO: 889386 - RNA, 18 nt, Human
aaacaaaacaaaaaaaga

SEQ ID NO: 889387 - RNA, 22 nt, Human
aaaugcaguauaaacuuuguaa

SEQ ID NO: 889388 - RNA, 27 nt, Human
aacaaaaaaagauacagccccaaaugc

SEQ ID NO: 889389 - RNA, 22 nt, Human
aacaaaacaaaaaaagauacag

SEQ ID NO: 889390 - RNA, 24 nt, Human
aacaaaacaaaaaaagauacagcc

SEQ ID NO: 889391 - RNA, 22 nt, Human
aacaacacaagaguuccaaaga

SEQ ID NO: 889392 - RNA, 23 nt, Human
aacacaagaguuccaaagaggaa

SEQ ID NO: 889393 - RNA, 21 nt, Human
aagagagagcaggugguagaa

SEQ ID NO: 889394 - RNA, 19 nt, Human
aagaggaaaaaaaaaaaaa

SEQ ID NO: 889395 - RNA, 22 nt, Human
aagaggaaaaaaaaaaaaacaa

SEQ ID NO: 889396 - RNA, 24 nt, Human
aagaggaaaaaaaaaaaaacaaaa

SEQ ID NO: 889397 - RNA, 19 nt, Human
aagcaacacagccuugggc

SEQ ID NO: 889398 - RNA, 18 nt, Human
aaguaagugggaggaggc

SEQ ID NO: 889399 - RNA, 22 nt, Human
aaguaagugggaggaggccagg

SEQ ID NO: 889400 - RNA, 23 nt, Human
acaaaaaaagauacagccccaaa

SEQ ID NO: 889401 - RNA, 25 nt, Human
acaaaacaaaaaaagauacagcccc

SEQ ID NO: 889402 - RNA, 25 nt, Human
acaaaacaaaaaaagauacagcccc

SEQ ID NO: 889403 - RNA, 26 nt, Human
acaaaacaaaaaaagauacagcccca

SEQ ID NO: 889404 - RNA, 26 nt, Human
aggaaaaaaaaaaaaacaaaacaaaa

SEQ ID NO: 889405 - RNA, 28 nt, Human
aggaaaaaaaaaaaaacaaaacaaaaaa

SEQ ID NO: 889406 - RNA, 24 nt, Human
aggugguagaaauugaugacacuu

SEQ ID NO: 889407 - RNA, 20 nt, Human
aguauaaacuuuguaaggaa

SEQ ID NO: 889408 - RNA, 22 nt, Human
caaaaaaagauacagccccaaa

SEQ ID NO: 889409 - RNA, 18 nt, Human
caaaacaaaaaaagauac

SEQ ID NO: 889410 - RNA, 21 nt, Human
cagccccaaaugcaguauaaa

SEQ ID NO: 889411 - RNA, 18 nt, Human
ccgccgcugccgccuccg

SEQ ID NO: 889412 - RNA, 18 nt, Human
ccgcugccgccuccgcgu

SEQ ID NO: 889413 - RNA, 24 nt, Human
ccgcugccgccuccgcgucggccc

SEQ ID NO: 889414 - RNA, 21 nt, Human
ccggccgcuccuucgccucag

SEQ ID NO: 889415 - RNA, 21 nt, Human
ccuccgcgucggcccaccugc

SEQ ID NO: 889416 - RNA, 23 nt, Human
ccugcccgccguaggacaaaggc

SEQ ID NO: 889417 - RNA, 22 nt, Human
cggcgggcucccggccgcuccu

SEQ ID NO: 889418 - RNA, 21 nt, Human
gaacauccuccaaacagcucu

SEQ ID NO: 889419 - RNA, 18 nt, Human
gcagaagagagagcaggu

SEQ ID NO: 889420 - RNA, 21 nt, Human
gcagagaacauccuccaaaca

SEQ ID NO: 889421 - RNA, 20 nt, Human
guaaggaauaagcaacacag

SEQ ID NO: 889422 - RNA, 21 nt, Human
uaacaacacaagaguuccaaa

SEQ ID NO: 889423 - RNA, 20 nt, Human
ugggaggaggccaggggaug

SEQ ID NO: 889424 - RNA, 22 nt, Human
uuauuaauaucgcuaccagcgc

SEQ ID NO: 889425 - RNA, 23 nt, Human
aaaaacucuacaucucaacccuc

SEQ ID NO: 889426 - RNA, 20 nt, Human
aaaaggucaucuauuuacag

SEQ ID NO: 889427 - RNA, 18 nt, Human
aaccacaaaaacuagaga

SEQ ID NO: 889428 - RNA, 19 nt, Human
aagagugauuuaaagacau

SEQ ID NO: 889429 - RNA, 18 nt, Human
agguuuuugaccugcuac

SEQ ID NO: 889430 - RNA, 22 nt, Human
caaaaacuagagaucccucucc

SEQ ID NO: 889431 - RNA, 21 nt, Human
caggagggcagguuuuugacc

SEQ ID NO: 889432 - RNA, 18 nt, Human
caucucaacccuccacua

SEQ ID NO: 889433 - RNA, 20 nt, Human
ccaccgggagcuggcuaagc

SEQ ID NO: 889434 - RNA, 21 nt, Human
cccuccacuauuauuauaguc

SEQ ID NO: 889435 - RNA, 20 nt, Human
ccgccgccgccgccgcggcu

SEQ ID NO: 889436 - RNA, 21 nt, Human
ccgccgccgccgccgcggcug

SEQ ID NO: 889437 - RNA, 22 nt, Human
ccgccgccgccgccgcggcugc

SEQ ID NO: 889438 - RNA, 21 nt, Human
ccgccgccgcggcugcugcuu

SEQ ID NO: 889439 - RNA, 24 nt, Human
ccgcggcugcugcuucgccaccuu

SEQ ID NO: 889440 - RNA, 26 nt, Human
cgagucggacgcucacuccagccgcc

SEQ ID NO: 889441 - RNA, 23 nt, Human
cgggagcuggcuaagcgugggag

SEQ ID NO: 889442 - RNA, 23 nt, Human
cuaaaaauuaaaccacaaaaacu

SEQ ID NO: 889443 - RNA, 19 nt, Human
cucacuccagccgccgccg

SEQ ID NO: 889444 - RNA, 18 nt, Human
cugcacccuguuccccuc

SEQ ID NO: 889445 - RNA, 20 nt, Human
gaacuuccaucauuucuuca

SEQ ID NO: 889446 - RNA, 22 nt, Human
gacucuccaaaugaacuuccau

SEQ ID NO: 889447 - RNA, 21 nt, Human
gagaucaaugccaauaaacaa

SEQ ID NO: 889448 - RNA, 19 nt, Human
gggagccgacgugcgcccc

SEQ ID NO: 889449 - RNA, 21 nt, Human
gggcuggcucuccugaaaagu

SEQ ID NO: 889450 - RNA, 22 nt, Human
uagagaucccucuccugcaccc

SEQ ID NO: 889451 - RNA, 20 nt, Human
ucacaggagggcagguuuuu

SEQ ID NO: 889452 - RNA, 24 nt, Human
ucacuccagccgccgccgccgccg

SEQ ID NO: 889453 - RNA, 18 nt, Human
ucagggaauaagucacag

SEQ ID NO: 889454 - RNA, 20 nt, Human
uccacuauuauuauagucca

SEQ ID NO: 889455 - RNA, 23 nt, Human
uccugcacccuguuccccucacu

SEQ ID NO: 889456 - RNA, 23 nt, Human
ucgccaccuuggccgccaucuug

SEQ ID NO: 889457 - RNA, 18 nt, Human
ucuacaucucaacccucc

SEQ ID NO: 889458 - RNA, 22 nt, Human
ugcuucgccaccuuggccgcca

SEQ ID NO: 889459 - RNA, 25 nt, Human
uuaaaaacucuacaucucaacccuc

SEQ ID NO: 889460 - RNA, 23 nt, Human
uuaaaccacaaaaacuagagauc

SEQ ID NO: 889461 - RNA, 23 nt, Human
uuaaagacauuaugguuuucuuu

SEQ ID NO: 889462 - RNA, 27 nt, Human
uuuaaaaacucuacaucucaacccucc

SEQ ID NO: 889463 - RNA, 20 nt, Human
uuuguuuguuuuuuucccau

SEQ ID NO: 889464 - RNA, 22 nt, Human
uuuuuacacugcaaaaagguca

SEQ ID NO: 889465 - RNA, 24 nt, Human
uuuuuuuuuuuuuuuuuuacacug

SEQ ID NO: 889466 - RNA, 22 nt, Human
aaaaagaagaugaaacaugaga

SEQ ID NO: 889467 - RNA, 22 nt, Human
aaaacaaguuauuucccugcaa

SEQ ID NO: 889468 - RNA, 23 nt, Human
aaaagaagaugaaacaugagaaa

SEQ ID NO: 889469 - RNA, 23 nt, Human
aaacaauucuuagauuauaccca

SEQ ID NO: 889470 - RNA, 22 nt, Human
aacaauucuuagauuauaccca

SEQ ID NO: 889471 - RNA, 24 nt, Human
aacucuucuaucccuauacauucu

SEQ ID NO: 889472 - RNA, 23 nt, Human
aagcagaucaaauagugagacua

SEQ ID NO: 889473 - RNA, 22 nt, Human
acuuacaaggaucaaaaaaagg

SEQ ID NO: 889474 - RNA, 20 nt, Human
agaaacagaguacucaauaa

SEQ ID NO: 889475 - RNA, 25 nt, Human
agagggcaggggguggugauaacag

SEQ ID NO: 889476 - RNA, 21 nt, Human
caaagcagaucaaauagugag

SEQ ID NO: 889477 - RNA, 21 nt, Human
caaguuauuucccugcaaagc

SEQ ID NO: 889478 - RNA, 19 nt, Human
cagucugaaugucuagaua

SEQ ID NO: 889479 - RNA, 23 nt, Human
cauccagugacaaagaugugauc

SEQ ID NO: 889480 - RNA, 21 nt, Human
cccggccgcugccaccuccuc

SEQ ID NO: 889481 - RNA, 20 nt, Human
ccgcugccaccuccucucca

SEQ ID NO: 889482 - RNA, 23 nt, Human
ccuauacauucuacauacguagu

SEQ ID NO: 889483 - RNA, 21 nt, Human
ccucucagcgcggcucgggcg

SEQ ID NO: 889484 - RNA, 23 nt, Human
cguagaaacagaguacucaauaa

SEQ ID NO: 889485 - RNA, 24 nt, Human
cuaaacuuacaaggaucaaaaaaa

SEQ ID NO: 889486 - RNA, 26 nt, Human
cucccggccgcugccaccuccucucc

SEQ ID NO: 889487 - RNA, 22 nt, Human
ggcagcagagggcagggggugg

SEQ ID NO: 889488 - RNA, 22 nt, Human
ggcucgggcggacggggccugg

SEQ ID NO: 889489 - RNA, 19 nt, Human
gggcaggggguggugauaa

SEQ ID NO: 889490 - RNA, 20 nt, Human
gucacagaaugagcaauucc

SEQ ID NO: 889491 - RNA, 24 nt, Human
uaaacaauucuuagauuauaccca

SEQ ID NO: 889492 - RNA, 20 nt, Human
uacauacguagaaacagagu

SEQ ID NO: 889493 - RNA, 23 nt, Human
uagaaacagaguacucaauaagu

SEQ ID NO: 889494 - RNA, 19 nt, Human
uaggacacaaauaaaguca

SEQ ID NO: 889495 - RNA, 19 nt, Human
ucagcgcggcucgggcgga

SEQ ID NO: 889496 - RNA, 19 nt, Human
uccacgcggccgcugcccu

SEQ ID NO: 889497 - RNA, 20 nt, Human
uccacgcggccgcugcccuc

SEQ ID NO: 889498 - RNA, 21 nt, Human
uccacgcggccgcugcccucu

SEQ ID NO: 889499 - RNA, 20 nt, Human
ucccuuuaagcaggacguaa

SEQ ID NO: 889500 - RNA, 20 nt, Human
ugaaacaugagaaaaaacaa

SEQ ID NO: 889501 - RNA, 20 nt, Human
ugacaaagaugugaucucau

SEQ ID NO: 889502 - RNA, 25 nt, Human
ugagaaaaaacaaguuauuucccug

SEQ ID NO: 889503 - RNA, 19 nt, Human
uggcagcagagggcagggg

SEQ ID NO: 889504 - RNA, 22 nt, Human
uuacaaggaucaaaaaaaggaa

SEQ ID NO: 889505 - RNA, 21 nt, Human
uucaaagggcaauauaggaaa

SEQ ID NO: 889506 - RNA, 20 nt, Human
uuuuguaaacaauucuuaga

SEQ ID NO: 889507 - RNA, 18 nt, Human
aaaaauggcgggaaaggc

SEQ ID NO: 889508 - RNA, 18 nt, Human
agagccccucagagcccc

SEQ ID NO: 889509 - RNA, 23 nt, Human
agccgcugccgggcgucagcgca

SEQ ID NO: 889510 - RNA, 25 nt, Human
agccggcaccgcgcgcagcgcggcc

SEQ ID NO: 889511 - RNA, 18 nt, Human
agcuggggccccuggagc

SEQ ID NO: 889512 - RNA, 18 nt, Human
aggcagcgccagaagccc

SEQ ID NO: 889513 - RNA, 21 nt, Human
agggcgccgggguccccgaaa

SEQ ID NO: 889514 - RNA, 21 nt, Human
cacccccucuauugcuucgcc

SEQ ID NO: 889515 - RNA, 21 nt, Human
cacccggagcagccgcgcccg

SEQ ID NO: 889516 - RNA, 18 nt, Human
caccgcuccgggcccggc

SEQ ID NO: 889517 - RNA, 20 nt, Human
cagcagcaucccugugcacu

SEQ ID NO: 889518 - RNA, 20 nt, Human
cagccgcugccgggcgucag

SEQ ID NO: 889519 - RNA, 24 nt, Human
cagcucccgaccacccgccggaga

SEQ ID NO: 889520 - RNA, 18 nt, Human
ccagcggcggcgcgcucc

SEQ ID NO: 889521 - RNA, 29 nt, Human
cccucagagccccagcucccgaccacccc

SEQ ID NO: 889522 - RNA, 22 nt, Human
ccgaccacccgccggagaauuu

SEQ ID NO: 889523 - RNA, 20 nt, Human
ccggugguggaggagcccuc

SEQ ID NO: 889524 - RNA, 20 nt, Human
ccgugccagccgcugccggg

SEQ ID NO: 889525 - RNA, 19 nt, Human
ccucaaggccugccgcucc

SEQ ID NO: 889526 - RNA, 19 nt, Human
ccucagagccccagcuccc

SEQ ID NO: 889527 - RNA, 31 nt, Human
ccucgacgacagccucaaggccugccgcucu

SEQ ID NO: 889528 - RNA, 18 nt, Human
ccucugagcuggccgugc

SEQ ID NO: 889529 - RNA, 21 nt, Human
cgccgggguccccgaaacagc

SEQ ID NO: 889530 - RNA, 23 nt, Human
cgccgggguccccgaaacagcag

SEQ ID NO: 889531 - RNA, 22 nt, Human
cgcgcaacgccgcuagagcccc

SEQ ID NO: 889532 - RNA, 24 nt, Human
cggcgccucagguuccagcgaggg

SEQ ID NO: 889533 - RNA, 21 nt, Human
cggggcuggccaaggcagggc

SEQ ID NO: 889534 - RNA, 19 nt, Human
cuagagccccucagagccc

SEQ ID NO: 889535 - RNA, 20 nt, Human
cucaaggccugccgcuccuc

SEQ ID NO: 889536 - RNA, 28 nt, Human
cuccagcacccccucuauugcuucgccc

SEQ ID NO: 889537 - RNA, 18 nt, Human
gagcccucgacgacagcc

SEQ ID NO: 889538 - RNA, 22 nt, Human
gagucccucaggaaagcagcuc

SEQ ID NO: 889539 - RNA, 21 nt, Human
gccagcuggggccccuggagc

SEQ ID NO: 889540 - RNA, 21 nt, Human
gcccaagucccggguggccuc

SEQ ID NO: 889541 - RNA, 18 nt, Human
gccgaggagaaccgccgg

SEQ ID NO: 889542 - RNA, 22 nt, Human
gccguggucggugucuucuuuc

SEQ ID NO: 889543 - RNA, 20 nt, Human
ggccccuggagcuuccuugc

SEQ ID NO: 889544 - RNA, 19 nt, Human
uaacggcagugaagugaaa

SEQ ID NO: 889545 - RNA, 19 nt, Human
uagagccccucagagcccc

SEQ ID NO: 889546 - RNA, 20 nt, Human
ucagagccccagcucccgac

SEQ ID NO: 889547 - RNA, 23 nt, Human
ucagagccccagcucccgaccac

SEQ ID NO: 889548 - RNA, 21 nt, Human
ucccauuggccagcccggccc

SEQ ID NO: 889549 - RNA, 18 nt, Human
ucccggguggccucgugc

SEQ ID NO: 889550 - RNA, 20 nt, Human
uccucacgcgcccggcugcc

SEQ ID NO: 889551 - RNA, 21 nt, Human
uccucacgcgcccggcugcca

SEQ ID NO: 889552 - RNA, 19 nt, Human
ucggugguuggggaggaug

SEQ ID NO: 889553 - RNA, 18 nt, Human
ucucggcgccucagguuc

SEQ ID NO: 889554 - RNA, 25 nt, Human
ugagaugcccgggguggacaacccu

SEQ ID NO: 889555 - RNA, 18 nt, Human
ugagggaugagaugcccg

SEQ ID NO: 889556 - RNA, 19 nt, Human
uggacgcaggcagccgcgc

SEQ ID NO: 889557 - RNA, 18 nt, Human
uggccgugcaucugcgca

SEQ ID NO: 889558 - RNA, 21 nt, Human
ugggccgaggagaaccgccgg

SEQ ID NO: 889559 - RNA, 27 nt, Human
uggggaggaugccucaggggaucccau

SEQ ID NO: 889560 - RNA, 21 nt, Human
uuggccagcccggcccccucc

SEQ ID NO: 889561 - RNA, 18 nt, Human
uuuuacaguugagggaug

SEQ ID NO: 889562 - RNA, 22 nt, Human
uuuuuuuuuuuuuuuugucagg

SEQ ID NO: 889563 - RNA, 18 nt, Human
uuuuuuuuuuuuuuuuug

SEQ ID NO: 889564 - RNA, 19 nt, Human
uuuuuuuuuuuuuuuuugu

SEQ ID NO: 889565 - RNA, 23 nt, Human
aaaaaaaaaaaaaaaagaaagaa

SEQ ID NO: 889566 - RNA, 22 nt, Human
aaacaaucauuuggagaaagca

SEQ ID NO: 889567 - RNA, 22 nt, Human
aaagaaagaaagcaagccaggg

SEQ ID NO: 889568 - RNA, 19 nt, Human
aaagcccaguaggaacaca

SEQ ID NO: 889569 - RNA, 20 nt, Human
aacauagugaaacccugucu

SEQ ID NO: 889570 - RNA, 21 nt, Human
aacauagugaaacccugucuc

SEQ ID NO: 889571 - RNA, 18 nt, Human
aaucgcuugaaccuggga

SEQ ID NO: 889572 - RNA, 24 nt, Human
aaucgcuugaaccugggaggcaga

SEQ ID NO: 889573 - RNA, 21 nt, Human
aauggcagugggacaacuugg

SEQ ID NO: 889574 - RNA, 24 nt, Human
acccugucucuacuaaaaacacaa

SEQ ID NO: 889575 - RNA, 24 nt, Human
acgugaggccaggaguucgagacc

SEQ ID NO: 889576 - RNA, 21 nt, Human
acucaagggcugacuuugaau

SEQ ID NO: 889577 - RNA, 24 nt, Human
acugcaaacccauaguugcuaaca

SEQ ID NO: 889578 - RNA, 26 nt, Human
acuguuucaaaaaaaaaaaaaaaaaa

SEQ ID NO: 889579 - RNA, 19 nt, Human
agaggcuguagugagucaa

SEQ ID NO: 889580 - RNA, 22 nt, Human
agccuggccaacauagugaaac

SEQ ID NO: 889581 - RNA, 24 nt, Human
agccuggccaacauagugaaaccc

SEQ ID NO: 889582 - RNA, 20 nt, Human
agccugggugacagagagag

SEQ ID NO: 889583 - RNA, 18 nt, Human
agcggcagcagggcugag

SEQ ID NO: 889584 - RNA, 22 nt, Human
aggaaauaucagagaguagaaa

SEQ ID NO: 889585 - RNA, 18 nt, Human
aggaacacagagcuauag

SEQ ID NO: 889586 - RNA, 19 nt, Human
aggcagaggcuguagugag

SEQ ID NO: 889587 - RNA, 22 nt, Human
aggcaggaucuugacucauaua

SEQ ID NO: 889588 - RNA, 22 nt, Human
aggcaugagaaucgcuugaacc

SEQ ID NO: 889589 - RNA, 24 nt, Human
aggcaugagaaucgcuugaaccug

SEQ ID NO: 889590 - RNA, 26 nt, Human
aggcuguagugagucaacugcgccau

SEQ ID NO: 889591 - RNA, 24 nt, Human
aguggcucacgcuuguaaucccag

SEQ ID NO: 889592 - RNA, 21 nt, Human
aucacgugaggccaggaguuc

SEQ ID NO: 889593 - RNA, 19 nt, Human
auuaccuaagucccugaaa

SEQ ID NO: 889594 - RNA, 22 nt, Human
caaaacagaagaccauaaauug

SEQ ID NO: 889595 - RNA, 24 nt, Human
caacaauaaaagcuauguacauag

SEQ ID NO: 889596 - RNA, 21 nt, Human
caacauagugaaacccugucu

SEQ ID NO: 889597 - RNA, 24 nt, Human
caacauagugaaacccugucucua

SEQ ID NO: 889598 - RNA, 18 nt, Human
caagauaacugccaggac

SEQ ID NO: 889599 - RNA, 18 nt, Human
caagauaacugccaggac

SEQ ID NO: 889600 - RNA, 24 nt, Human
cacaccuguaaucccagcuacuug

SEQ ID NO: 889601 - RNA, 21 nt, Human
caccuccuuccccaccucaag

SEQ ID NO: 889602 - RNA, 20 nt, Human
caccuguaaucccagcuacu

SEQ ID NO: 889603 - RNA, 24 nt, Human
caccuguaaucccagcuacuuggg

SEQ ID NO: 889604 - RNA, 24 nt, Human
cacgcuuguaaucccagcacuuug

SEQ ID NO: 889605 - RNA, 24 nt, Human
cagaucacgugaggccaggaguuc

SEQ ID NO: 889606 - RNA, 24 nt, Human
cagcacaguggcucacgcuuguaa

SEQ ID NO: 889607 - RNA, 22 nt, Human
cagccugggugacagagagaga

SEQ ID NO: 889608 - RNA, 20 nt, Human
caucuucauuuuaucaagga

SEQ ID NO: 889609 - RNA, 19 nt, Human
cauugcacgccagccuggg

SEQ ID NO: 889610 - RNA, 22 nt, Human
cauugcacgccagccuggguga

SEQ ID NO: 889611 - RNA, 24 nt, Human
cauugcacgccagccugggugaca

SEQ ID NO: 889612 - RNA, 25 nt, Human
cauugcacgccagccugggugacag

SEQ ID NO: 889613 - RNA, 25 nt, Human
ccacacugcuccuuuuaaaaaaaau

SEQ ID NO: 889614 - RNA, 20 nt, Human
ccaggaguucgagaccagcc

SEQ ID NO: 889615 - RNA, 21 nt, Human
ccauugcacgccagccugggu

SEQ ID NO: 889616 - RNA, 22 nt, Human
ccauugcacgccagccugggug

SEQ ID NO: 889617 - RNA, 24 nt, Human
ccauugcacgccagccugggugac

SEQ ID NO: 889618 - RNA, 19 nt, Human
cccacaaggauggcagcag

SEQ ID NO: 889619 - RNA, 19 nt, Human
cccaggguuaggacugaga

SEQ ID NO: 889620 - RNA, 19 nt, Human
cccauaguugcuaacaauc

SEQ ID NO: 889621 - RNA, 22 nt, Human
ccucggaccaaucucuggcccc

SEQ ID NO: 889622 - RNA, 22 nt, Human
ccuggccaacauagugaaaccc

SEQ ID NO: 889623 - RNA, 24 nt, Human
ccuggccaacauagugaaacccug

SEQ ID NO: 889624 - RNA, 21 nt, Human
ccuguaaucccagcuacuugg

SEQ ID NO: 889625 - RNA, 19 nt, Human
ccuucccauagcccuuuug

SEQ ID NO: 889626 - RNA, 18 nt, Human
ccuuguacugagacccuc

SEQ ID NO: 889627 - RNA, 24 nt, Human
cgagaccagccuggccaacauagu

SEQ ID NO: 889628 - RNA, 20 nt, Human
cgccauugcacgccagccug

SEQ ID NO: 889629 - RNA, 24 nt, Human
cucaaccucggaccaaucucuggc

SEQ ID NO: 889630 - RNA, 24 nt, Human
cucacgcuuguaaucccagcacuu

SEQ ID NO: 889631 - RNA, 27 nt, Human
cucacgcuuguaaucccagcacuuugg

SEQ ID NO: 889632 - RNA, 18 nt, Human
cuccuuccccaccucaag

SEQ ID NO: 889633 - RNA, 21 nt, Human
cuguaaucccagcuacuuggg

SEQ ID NO: 889634 - RNA, 26 nt, Human
cugugacuaggacaauaccggggucc

SEQ ID NO: 889635 - RNA, 18 nt, Human
gagaaagcaacaccaagg

SEQ ID NO: 889636 - RNA, 24 nt, Human
gaucacgugaggccaggaguucga

SEQ ID NO: 889637 - RNA, 20 nt, Human
gcagcagaagcccuuaacag

SEQ ID NO: 889638 - RNA, 24 nt, Human
gccaacauagugaaacccugucuc

SEQ ID NO: 889639 - RNA, 19 nt, Human
gccauugcacgccagccug

SEQ ID NO: 889640 - RNA, 24 nt, Human
gccauugcacgccagccuggguga

SEQ ID NO: 889641 - RNA, 23 nt, Human
gcggcacacaccuguaaucccag

SEQ ID NO: 889642 - RNA, 19 nt, Human
ggacugagaacaaauacac

SEQ ID NO: 889643 - RNA, 19 nt, Human
ggcagugggacaacuugga

SEQ ID NO: 889644 - RNA, 18 nt, Human
ggccucgggcccagcaca

SEQ ID NO: 889645 - RNA, 21 nt, Human
gugaaacccugucucuacuaa

SEQ ID NO: 889646 - RNA, 22 nt, Human
guuucaucaccuccuuccccac

SEQ ID NO: 889647 - RNA, 18 nt, Human
uaacuccacuguuagcgg

SEQ ID NO: 889648 - RNA, 20 nt, Human
uaagaaaggauuuacaacaa

SEQ ID NO: 889649 - RNA, 22 nt, Human
uaagacaggugaagagaaauca

SEQ ID NO: 889650 - RNA, 24 nt, Human
uaaggcaugagaaucgcuugaacc

SEQ ID NO: 889651 - RNA, 21 nt, Human
uacucagaaaacugcaaaccc

SEQ ID NO: 889652 - RNA, 18 nt, Human
uagaaagugcuaaccaga

SEQ ID NO: 889653 - RNA, 24 nt, Human
uagcggcagcagggcugaguaaau

SEQ ID NO: 889654 - RNA, 20 nt, Human
uaguugcuaacaauccuauu

SEQ ID NO: 889655 - RNA, 22 nt, Human
ucaaaaaaaaaaaaaaaaaaaa

SEQ ID NO: 889656 - RNA, 25 nt, Human
ucaaaaaaaaaaaaaaaaaaaagaa

SEQ ID NO: 889657 - RNA, 23 nt, Human
ucaccuccuuccccaccucaaga

SEQ ID NO: 889658 - RNA, 21 nt, Human
ucagaucagugacauaacucc

SEQ ID NO: 889659 - RNA, 23 nt, Human
ucagucccugaggggauagaaaa

SEQ ID NO: 889660 - RNA, 18 nt, Human
ucgcuugaaccugggagg

SEQ ID NO: 889661 - RNA, 24 nt, Human
ucgggcccagcacaguggcucacg

SEQ ID NO: 889662 - RNA, 23 nt, Human
ucucuacuaaaaacacaaaaauu

SEQ ID NO: 889663 - RNA, 22 nt, Human
ucucuggccccaggguuaggac

SEQ ID NO: 889664 - RNA, 23 nt, Human
ucucuggccccaggguuaggacu

SEQ ID NO: 889665 - RNA, 19 nt, Human
ucucuguauacauccaaga

SEQ ID NO: 889666 - RNA, 27 nt, Human
ucugugacugaaacaauaccggggucc

SEQ ID NO: 889667 - RNA, 18 nt, Human
ucuuugggggcugagaaa

SEQ ID NO: 889668 - RNA, 19 nt, Human
ucuuugggggcugagaaau

SEQ ID NO: 889669 - RNA, 20 nt, Human
ucuuugggggcugagaaauu

SEQ ID NO: 889670 - RNA, 22 nt, Human
ugaaccugggaggcagaggcug

SEQ ID NO: 889671 - RNA, 26 nt, Human
ugaaguggacagaucacgugaggcca

SEQ ID NO: 889672 - RNA, 21 nt, Human
ugagaaaccuuugguauccaa

SEQ ID NO: 889673 - RNA, 20 nt, Human
ugagucaacugcgccauuga

SEQ ID NO: 889674 - RNA, 22 nt, Human
ugcacgccagccugggugacag

SEQ ID NO: 889675 - RNA, 18 nt, Human
uggaaaguuacagcaaga

SEQ ID NO: 889676 - RNA, 20 nt, Human
uggaaaguuacagcaagaaa

SEQ ID NO: 889677 - RNA, 22 nt, Human
uggaagucucuguagugaccac

SEQ ID NO: 889678 - RNA, 24 nt, Human
uggacagaucacgugaggccagga

SEQ ID NO: 889679 - RNA, 24 nt, Human
uggacggcugaaguggacagauca

SEQ ID NO: 889680 - RNA, 21 nt, Human
uggcagcagaagcccuuaaca

SEQ ID NO: 889681 - RNA, 24 nt, Human
uggccaacauagugaaacccuguc

SEQ ID NO: 889682 - RNA, 22 nt, Human
uggcuagucuaaaacaaucauu

SEQ ID NO: 889683 - RNA, 24 nt, Human
uggcucacgcuuguaaucccagca

SEQ ID NO: 889684 - RNA, 22 nt, Human
uguacauaggaaauaucagaga

SEQ ID NO: 889685 - RNA, 21 nt, Human
uguuucaucaccuccuucccc

SEQ ID NO: 889686 - RNA, 24 nt, Human
uguuucaucaccuccuuccccacc

SEQ ID NO: 889687 - RNA, 25 nt, Human
uuaaucuuaagacaggugaagagaa

SEQ ID NO: 889688 - RNA, 20 nt, Human
uucaaaaguuuuuguggaag

SEQ ID NO: 889689 - RNA, 21 nt, Human
uucaucuucauuuuaucaagg

SEQ ID NO: 889690 - RNA, 24 nt, Human
uugggaggcuaaggcaugagaauc

SEQ ID NO: 889691 - RNA, 23 nt, Human
uuuacccauauucaaaacucacc

SEQ ID NO: 889692 - RNA, 21 nt, Human
uuuaucaaggaugaaaucaaa

SEQ ID NO: 889693 - RNA, 19 nt, Human
uuuccauuuguucaguccc

SEQ ID NO: 889694 - RNA, 25 nt, Human
uuuuuuuuuuuuuuuuuuuuuaagg

SEQ ID NO: 889695 - RNA, 18 nt, Human
aaaacccaagcagcacca

SEQ ID NO: 889696 - RNA, 18 nt, Human
aaaacccaagcagcacca

SEQ ID NO: 889697 - RNA, 26 nt, Human
aaaacccaagcagcaccagcagcccc

SEQ ID NO: 889698 - RNA, 26 nt, Human
aaaacccaagcagcaccagcagcccc

SEQ ID NO: 889699 - RNA, 22 nt, Human
aaacaccacacugcuacugaug

SEQ ID NO: 889700 - RNA, 24 nt, Human
aaacauuaaaaguucaccuugacc

SEQ ID NO: 889701 - RNA, 24 nt, Human
aaacauuaaaaguucaccuugacc

SEQ ID NO: 889702 - RNA, 20 nt, Human
aacccaaaacccaagcagca

SEQ ID NO: 889703 - RNA, 20 nt, Human
aacccaaaacccaagcagca

SEQ ID NO: 889704 - RNA, 25 nt, Human
aacccaagcagcaccagcagccccu

SEQ ID NO: 889705 - RNA, 25 nt, Human
aacccaagcagcaccagcagccccu

SEQ ID NO: 889706 - RNA, 21 nt, Human
aaccccauuuccuccccuuug

SEQ ID NO: 889707 - RNA, 23 nt, Human
aaccccuugacgccccugccugc

SEQ ID NO: 889708 - RNA, 22 nt, Human
aaccuccagaagaacaccacac

SEQ ID NO: 889709 - RNA, 22 nt, Human
aaccuccagaagaacaccacac

SEQ ID NO: 889710 - RNA, 21 nt, Human
aaccugggggcaaaaaagggg

SEQ ID NO: 889711 - RNA, 27 nt, Human
aagcagcaccagcagccccccaguagg

SEQ ID NO: 889712 - RNA, 27 nt, Human
aagcagcaccagcagccccccaguagg

SEQ ID NO: 889713 - RNA, 18 nt, Human
aauguuugugacauucuc

SEQ ID NO: 889714 - RNA, 18 nt, Human
aauguuugugacauucuc

SEQ ID NO: 889715 - RNA, 19 nt, Human
acaaccuccagaagaacac

SEQ ID NO: 889716 - RNA, 20 nt, Human
acaaccuccagaagaacacc

SEQ ID NO: 889717 - RNA, 23 nt, Human
acacacacacacacacacacaca

SEQ ID NO: 889718 - RNA, 23 nt, Human
acacacacacacacacacacaca

SEQ ID NO: 889719 - RNA, 23 nt, Human
acacacacacacacacacacaca

SEQ ID NO: 889720 - RNA, 23 nt, Human
acacacacacacacacacacaca

SEQ ID NO: 889721 - RNA, 23 nt, Human
acacacacacacacacacacaca

SEQ ID NO: 889722 - RNA, 23 nt, Human
acacacacacacacacacacaua

SEQ ID NO: 889723 - RNA, 23 nt, Human
acacacacacacacacacauaua

SEQ ID NO: 889724 - RNA, 23 nt, Human
acacacacacacacacacauaua

SEQ ID NO: 889725 - RNA, 30 nt, Human
acacacacacacacacacauauaauguaua

SEQ ID NO: 889726 - RNA, 30 nt, Human; identical to SEQ ID NO: 889725

SEQ ID NO: 889727 - RNA, 22 nt, Human
acaggugugcuugguggagggu

SEQ ID NO: 889728 - RNA, 31 nt, Human
acccaaaacccaagcagcaccagcagccccc

SEQ ID NO: 889729 - RNA, 31 nt, Human; identical to SEQ ID NO: 889728

SEQ ID NO: 889730 - RNA, 19 nt, Human
acccaagcagcaccagcag

SEQ ID NO: 889731 - RNA, 19 nt, Human
acccaagcagcaccagcag

SEQ ID NO: 889732 - RNA, 18 nt, Human
accccugccucuggccac

SEQ ID NO: 889733 - RNA, 21 nt, Human
acccgccacaacccuuccccc

SEQ ID NO: 889734 - RNA, 21 nt, Human
acccgccacaacccuuccccc

SEQ ID NO: 889735 - RNA, 22 nt, Human
acccuucccccguccacagccc

SEQ ID NO: 889736 - RNA, 18 nt, Human
accuugaccaaagagaca

SEQ ID NO: 889737 - RNA, 19 nt, Human
agaaaccccuugacgcccc

SEQ ID NO: 889738 - RNA, 23 nt, Human
agaagaacaccacacaugggagg

SEQ ID NO: 889739 - RNA, 24 nt, Human
agacaaccuccagaagaacaccac

SEQ ID NO: 889740 - RNA, 24 nt, Human
agacaaccuccagaagaacaccac

SEQ ID NO: 889741 - RNA, 22 nt, Human
agagaaaccccuugacgccccu

SEQ ID NO: 889742 - RNA, 24 nt, Human
agagcucugccugaaacaccacac

SEQ ID NO: 889743 - RNA, 18 nt, Human
agcaaaaaacaaaauucc

SEQ ID NO: 889744 - RNA, 18 nt, Human
agcaaaaaacaaaauucc

SEQ ID NO: 889745 - RNA, 19 nt, Human
agcaaaaaacaaaauucca

SEQ ID NO: 889746 - RNA, 19 nt, Human
agcaaaaaacaaaauucca

SEQ ID NO: 889747 - RNA, 21 nt, Human
agcaaaaaacaaaauuccaag

SEQ ID NO: 889748 - RNA, 21 nt, Human
agcaaaaaacaaaauuccaag

SEQ ID NO: 889749 - RNA, 22 nt, Human
agcaaaaaacaaaauuccaaga

SEQ ID NO: 889750 - RNA, 22 nt, Human
agcaaaaaacaaaauuccaaga

SEQ ID NO: 889751 - RNA, 24 nt, Human
agcagcaccagcagccccugccca

SEQ ID NO: 889752 - RNA, 24 nt, Human
agcagcaccagcagccccugccca

SEQ ID NO: 889753 - RNA, 23 nt, Human
aggaacucagcuaccccugccuc

SEQ ID NO: 889754 - RNA, 22 nt, Human
aggcggggagcggggcuucggc

SEQ ID NO: 889755 - RNA, 19 nt, Human
agucaggucacugugggga

SEQ ID NO: 889756 - RNA, 19 nt, Human
aucucaugacagcagccac

SEQ ID NO: 889757 - RNA, 19 nt, Human
aucucaugacagcagccac

SEQ ID NO: 889758 - RNA, 24 nt, Human
augacagcagccaccagaauacac

SEQ ID NO: 889759 - RNA, 24 nt, Human
augacagcagccaccagaauacac

SEQ ID NO: 889760 - RNA, 22 nt, Human
auguuuucacugcucucucccg

SEQ ID NO: 889761 - RNA, 25 nt, Human
auucuguuucuccaaaagccuccca

SEQ ID NO: 889762 - RNA, 25 nt, Human
auucuguuucuccaaaagccuccca

SEQ ID NO: 889763 - RNA, 24 nt, Human
auugggacagggccaggagguggc

SEQ ID NO: 889764 - RNA, 22 nt, Human
caaaaaaggggucuccaggaac

SEQ ID NO: 889765 - RNA, 19 nt, Human
caaacagaaccccauuucc

SEQ ID NO: 889766 - RNA, 19 nt, Human
caacccaaaacccaagcag

SEQ ID NO: 889767 - RNA, 19 nt, Human
caacccaaaacccaagcag

SEQ ID NO: 889768 - RNA, 18 nt, Human
caaccuccagaagaacac

SEQ ID NO: 889769 - RNA, 18 nt, Human
caaccuccagaagaacac

SEQ ID NO: 889770 - RNA, 22 nt, Human
caaccuccagaagaacaccaca

SEQ ID NO: 889771 - RNA, 22 nt, Human
caaccuccagaagaacaccaca

SEQ ID NO: 889772 - RNA, 20 nt, Human
cacacacacacacacacaca

SEQ ID NO: 889773 - RNA, 20 nt, Human
cacacacacacacacacaca

SEQ ID NO: 889774 - RNA, 20 nt, Human
cacacacacacacacacaca

SEQ ID NO: 889775 - RNA, 20 nt, Human
cacacacacacacacacaca

SEQ ID NO: 889776 - RNA, 20 nt, Human
cacacacacacacacacaca

SEQ ID NO: 889777 - RNA, 20 nt, Human
cacacacacacacacacaca

SEQ ID NO: 889778 - RNA, 20 nt, Human
cacacacacacacacacaca

SEQ ID NO: 889779 - RNA, 20 nt, Human
cacacacacacacacacaca

SEQ ID NO: 889780 - RNA, 20 nt, Human
cacacacacacacacacaca

SEQ ID NO: 889781 - RNA, 22 nt, Human
cacacacacacacacacacaca

SEQ ID NO: 889782 - RNA, 22 nt, Human
cacacacacacacacacacaca

SEQ ID NO: 889783 - RNA, 26 nt, Human
cacacacacacacacacacacacaca

SEQ ID NO: 889784 - RNA, 26 nt, Human
cacacacacacacacacacacacaca

SEQ ID NO: 889785 - RNA, 26 nt, Human
cacacacacacacacacacacacaca

SEQ ID NO: 889786 - RNA, 26 nt, Human
cacacacacacacacacacacacaca

SEQ ID NO: 889787 - RNA, 26 nt, Human
cacacacacacacacacacacacaua

SEQ ID NO: 889788 - RNA, 26 nt, Human
cacacacacacacacacacacauaua

SEQ ID NO: 889789 - RNA, 22 nt, Human
cacacacacacacacacacaua

SEQ ID NO: 889790 - RNA, 30 nt, Human
cacacacacacacacacacauauaauguag

SEQ ID NO: 889791 - RNA, 30 nt, Human; identical to SEQ ID NO: 889790

SEQ ID NO: 889792 - RNA, 20 nt, Human
cacacacacacacacacaua

SEQ ID NO: 889793 - RNA, 20 nt, Human
cacacacacacacacacaua

SEQ ID NO: 889794 - RNA, 19 nt, Human
cacacacacacacacauau

SEQ ID NO: 889795 - RNA, 19 nt, Human
cacacacacacacacauau

SEQ ID NO: 889796 - RNA, 20 nt, Human
cacagccuggccagagcucu

SEQ ID NO: 889797 - RNA, 21 nt, Human
caccacaaaguucucaggggc

SEQ ID NO: 889798 - RNA, 18 nt, Human
cacccccagucaggucac

SEQ ID NO: 889799 - RNA, 22 nt, Human
cacccucaacccaaaacccaag

SEQ ID NO: 889800 - RNA, 22 nt, Human
cacccucaacccaaaacccaag

SEQ ID NO: 889801 - RNA, 21 nt, Human
caccugcgggcucccaaaggc

SEQ ID NO: 889802 - RNA, 19 nt, Human
caccuugaccaaagagaca

SEQ ID NO: 889803 - RNA, 18 nt, Human
cacgccaccaggcuaguc

SEQ ID NO: 889804 - RNA, 18 nt, Human
cacgccaccaggcuaguc

SEQ ID NO: 889805 - RNA, 23 nt, Human
cagaacacccgccacaacccuuc

SEQ ID NO: 889806 - RNA, 23 nt, Human
cagaacacccgccacaacccuuc

SEQ ID NO: 889807 - RNA, 23 nt, Human
cagagcucugccugaaacaccac

SEQ ID NO: 889808 - RNA, 27 nt, Human
cagcaaaaaacaaaauuccaagauuug

SEQ ID NO: 889809 - RNA, 27 nt, Human
cagcaaaaaacaaaauuccaagauuug

SEQ ID NO: 889810 - RNA, 18 nt, Human
cagcccccaguaagcccc

SEQ ID NO: 889811 - RNA, 23 nt, Human
caucuccaaacaugccugcccaa

SEQ ID NO: 889812 - RNA, 20 nt, Human
cauguccagaaccuucagcc

SEQ ID NO: 889813 - RNA, 24 nt, Human
cauuaaaaguucaccuugaccaaa

SEQ ID NO: 889814 - RNA, 24 nt, Human
cauuaaaaguucaccuugaccaaa

SEQ ID NO: 889815 - RNA, 23 nt, Human
cauucaguauucagaagaagcac

SEQ ID NO: 889816 - RNA, 23 nt, Human
cauucaguauucagaagaagcac

SEQ ID NO: 889817 - RNA, 21 nt, Human
cauucuguuucuccaaaagcc

SEQ ID NO: 889818 - RNA, 20 nt, Human
ccacaaaguucucaggggca

SEQ ID NO: 889819 - RNA, 25 nt, Human
ccagaagaacaccacacaugggagg

SEQ ID NO: 889820 - RNA, 21 nt, Human
cccagcacccacccucucgaa

SEQ ID NO: 889821 - RNA, 22 nt, Human
ccccgcaccccuguggcccagc

SEQ ID NO: 889822 - RNA, 25 nt, Human
ccccgcaccccuguggcccagcacc

SEQ ID NO: 889823 - RNA, 21 nt, Human
ccccuugacgccccugccugc

SEQ ID NO: 889824 - RNA, 22 nt, Human
ccccuuugcccucacaaaaaua

SEQ ID NO: 889825 - RNA, 21 nt, Human
cccgcaccccuguggcccagc

SEQ ID NO: 889826 - RNA, 21 nt, Human
cccgccacaacccuucccccg

SEQ ID NO: 889827 - RNA, 21 nt, Human
cccgccacaacccuucccccg

SEQ ID NO: 889828 - RNA, 18 nt, Human
cccucaacccaaaaccca

SEQ ID NO: 889829 - RNA, 18 nt, Human
cccucaacccaaaaccca

SEQ ID NO: 889830 - RNA, 21 nt, Human
cccuucccccguccacagccc

SEQ ID NO: 889831 - RNA, 20 nt, Human
ccgcaccccuguggcccagc

SEQ ID NO: 889832 - RNA, 26 nt, Human
ccuagcacccucaacccaaaacccaa

SEQ ID NO: 889833 - RNA, 26 nt, Human
ccuagcacccucaacccaaaacccaa

SEQ ID NO: 889834 - RNA, 20 nt, Human
ccuccagaagaacaccacac

SEQ ID NO: 889835 - RNA, 20 nt, Human
ccuccagaagaacaccacac

SEQ ID NO: 889836 - RNA, 21 nt, Human
ccucucagcuucagaacaccc

SEQ ID NO: 889837 - RNA, 22 nt, Human
ccugcauguuuucacugcucuc

SEQ ID NO: 889838 - RNA, 22 nt, Human
ccugcauguuuucacugcucuc

SEQ ID NO: 889839 - RNA, 24 nt, Human
ccugcccaagggcucacccaggaa

SEQ ID NO: 889840 - RNA, 18 nt, Human
ccuggccagagcucugcc

SEQ ID NO: 889841 - RNA, 18 nt, Human
ccuuaaaacaccuggaga

SEQ ID NO: 889842 - RNA, 22 nt, Human
cgaagccucucucaucuccaaa

SEQ ID NO: 889843 - RNA, 18 nt, Human
cgcaccccuguggcccag

SEQ ID NO: 889844 - RNA, 24 nt, Human
cgccacaacccuucccccguccac

SEQ ID NO: 889845 - RNA, 21 nt, Human
cggggaggccuuggcucagaa

SEQ ID NO: 889846 - RNA, 22 nt, Human
cuccaggaacucagcuaccccu

SEQ ID NO: 889847 - RNA, 21 nt, Human
cucccuauggcccugcccuuc

SEQ ID NO: 889848 - RNA, 18 nt, Human
cucuccuagcacccucaa

SEQ ID NO: 889849 - RNA, 18 nt, Human
cucuccuagcacccucaa

SEQ ID NO: 889850 - RNA, 19 nt, Human
cuggagacuguucugcuca

SEQ ID NO: 889851 - RNA, 20 nt, Human
cuggagacuguucugcugca

SEQ ID NO: 889852 - RNA, 18 nt, Human
cuugaccaaagagacaac

SEQ ID NO: 889853 - RNA, 18 nt, Human
cuugaccaaagagacaac

SEQ ID NO: 889854 - RNA, 18 nt, Human
cuuguucauguccagaac

SEQ ID NO: 889855 - RNA, 23 nt, Human
gaaaccccuugacgccccugccu

SEQ ID NO: 889856 - RNA, 23 nt, Human
gaaccuucagcccccaguaagcc

SEQ ID NO: 889857 - RNA, 19 nt, Human
gaagccuuucucuucuacc

SEQ ID NO: 889858 - RNA, 30 nt, Human
gacccgauguacacacacacacacacacag

SEQ ID NO: 889859 - RNA, 30 nt, Human; identical to SEQ ID NO: 889858

SEQ ID NO: 889860 - RNA, 18 nt, Human
gagaugggaugaggagga

SEQ ID NO: 889861 - RNA, 23 nt, Human
gaggggguagaacugggcagaaa

SEQ ID NO: 889862 - RNA, 21 nt, Human
gauccguagcgaaucucccuc

SEQ ID NO: 889863 - RNA, 21 nt, Human
gcagcaucuaagauccccuca

SEQ ID NO: 889864 - RNA, 23 nt, Human
gccacaacccuucccccguccac

SEQ ID NO: 889865 - RNA, 18 nt, Human
gccaggagguggcagagu

SEQ ID NO: 889866 - RNA, 18 nt, Human
gccagugccugagcuggc

SEQ ID NO: 889867 - RNA, 19 nt, Human
gcuacugauggcguugccc

SEQ ID NO: 889868 - RNA, 21 nt, Human
ggaaagcauacaacgcagucc

SEQ ID NO: 889869 - RNA, 22 nt, Human
ggaaagcauacaacgcaguccu

SEQ ID NO: 889870 - RNA, 19 nt, Human
ggaagccuuucucuucuac

SEQ ID NO: 889871 - RNA, 21 nt, Human
ggagaagaaaauaauaaacau

SEQ ID NO: 889872 - RNA, 21 nt, Human
ggagaagaaaauaauaaacau

SEQ ID NO: 889873 - RNA, 19 nt, Human
ggcaaaaaaggggucucca

SEQ ID NO: 889874 - RNA, 19 nt, Human
ggcaaaaaaggggucuccg

SEQ ID NO: 889875 - RNA, 19 nt, Human
ggccaggagguggcagagu

SEQ ID NO: 889876 - RNA, 19 nt, Human
gggacacacuggcacagcc

SEQ ID NO: 889877 - RNA, 24 nt, Human
gggaugaggaggacugagccccuu

SEQ ID NO: 889878 - RNA, 25 nt, Human
ggggaaccugggggcaaaaaagggg

SEQ ID NO: 889879 - RNA, 21 nt, Human
ggggguagaacugggcagaaa

SEQ ID NO: 889880 - RNA, 21 nt, Human
ggguuugugauuauugauuua

SEQ ID NO: 889881 - RNA, 23 nt, Human
gguaaggugaguggauggaaagc

SEQ ID NO: 889882 - RNA, 20 nt, Human
ggugugggacuguagaagcc

SEQ ID NO: 889883 - RNA, 20 nt, Human
gguuugugauuauugauuua

SEQ ID NO: 889884 - RNA, 21 nt, Human
guggagcaggaggccgcggag

SEQ ID NO: 889885 - RNA, 25 nt, Human
guguccucucagccucagaacaccc

SEQ ID NO: 889886 - RNA, 25 nt, Human
guguccucucagcuucagaacaccc

SEQ ID NO: 889887 - RNA, 23 nt, Human
guucauguccagaaccuucagcc

SEQ ID NO: 889888 - RNA, 30 nt, Human
uaaaaguucaccuugaccaaagagacaacu

SEQ ID NO: 889889 - RNA, 30 nt, Human; identical to SEQ ID NO: 889888

SEQ ID NO: 889890 - RNA, 22 nt, Human
uaacacgccaccaggcuaguca

SEQ ID NO: 889891 - RNA, 22 nt, Human
uaacacgccaccaggcuaguca

SEQ ID NO: 889892 - RNA, 19 nt, Human
uacaacgcaguccugggcu

SEQ ID NO: 889893 - RNA, 20 nt, Human
uacacacacacacacacaca

SEQ ID NO: 889894 - RNA, 20 nt, Human
uacacacacacacacacaca

SEQ ID NO: 889895 - RNA, 25 nt, Human
uacacacacacacacacacacacac

SEQ ID NO: 889896 - RNA, 23 nt, Human
uagaaggggggugauguguguag

SEQ ID NO: 889897 - RNA, 23 nt, Human
uagaaggggggugauguguguag

SEQ ID NO: 889898 - RNA, 18 nt, Human
uagguguccucucagccu

SEQ ID NO: 889899 - RNA, 18 nt, Human
uagguguccucucagcuu

SEQ ID NO: 889900 - RNA, 24 nt, Human
uauggcccugcccuucugugccug

SEQ ID NO: 889901 - RNA, 22 nt, Human
uaugggguaaggugaaguggau

SEQ ID NO: 889902 - RNA, 22 nt, Human
uauucagaagaagcacaugagg

SEQ ID NO: 889903 - RNA, 22 nt, Human
uauucagaagaagcacaugagg

SEQ ID NO: 889904 - RNA, 21 nt, Human
ucaacccaaaacccaagcagc

SEQ ID NO: 889905 - RNA, 21 nt, Human
ucaacccaaaacccaagcagc

SEQ ID NO: 889906 - RNA, 19 nt, Human
uccacagcccugcauguuu

SEQ ID NO: 889907 - RNA, 19 nt, Human
uccacagcccugcauguuu

SEQ ID NO: 889908 - RNA, 18 nt, Human
uccagaagaacaccacac

SEQ ID NO: 889909 - RNA, 18 nt, Human
uccagaagaacaccacac

SEQ ID NO: 889910 - RNA, 20 nt, Human
ucccaaaggcagucaccaca

SEQ ID NO: 889911 - RNA, 20 nt, Human
ucccaaaggcagucaccacg

SEQ ID NO: 889912 - RNA, 19 nt, Human
ucccagggcucccacgcca

SEQ ID NO: 889913 - RNA, 24 nt, Human
ucccaugaugggcauggcaucacc

SEQ ID NO: 889914 - RNA, 24 nt, Human
ucccaugaugggcauggcaucacc

SEQ ID NO: 889915 - RNA, 21 nt, Human
uccccuuugcccucacaaaaa

SEQ ID NO: 889916 - RNA, 23 nt, Human
uccuagcacccucaacccaaaac

SEQ ID NO: 889917 - RNA, 23 nt, Human
uccuagcacccucaacccaaaac

SEQ ID NO: 889918 - RNA, 24 nt, Human
uccuccccuuugcccucacaaaaa

SEQ ID NO: 889919 - RNA, 18 nt, Human
uccuugggcagagaaacc

SEQ ID NO: 889920 - RNA, 24 nt, Human
ucggggaggccuuggcucagaauu

SEQ ID NO: 889921 - RNA, 30 nt, Human
ucuccaaacaugccugcccaagggcucacu

SEQ ID NO: 889922 - RNA, 18 nt, Human
ucuccauguucugucuuc

SEQ ID NO: 889923 - RNA, 20 nt, Human
ucuccuagcacccucaaccc

SEQ ID NO: 889924 - RNA, 20 nt, Human
ucuccuagcacccucaaccc

SEQ ID NO: 889925 - RNA, 20 nt, Human
ucucuccuccuucucccuca

SEQ ID NO: 889926 - RNA, 19 nt, Human
ugaaacaccacacugcuac

SEQ ID NO: 889927 - RNA, 23 nt, Human
ugaaacaccacacugcuacuguc

SEQ ID NO: 889928 - RNA, 22 nt, Human
ugaccaaagagacaaccuccag

SEQ ID NO: 889929 - RNA, 22 nt, Human
ugaccaaagagacaaccuccag

SEQ ID NO: 889930 - RNA, 29 nt, Human
ugaccaaagagacaaccuccagaagaaca

SEQ ID NO: 889931 - RNA, 29 nt, Human
ugaccaaagagacaaccuccagaagaaca

SEQ ID NO: 889932 - RNA, 19 nt, Human
ugaccuggauccguagcga

SEQ ID NO: 889933 - RNA, 24 nt, Human
ugagacaaauggcucugguuucug

SEQ ID NO: 889934 - RNA, 24 nt, Human
ugagacaaauggcucugguuucug

SEQ ID NO: 889935 - RNA, 18 nt, Human
ugagaggggucaaguugg

SEQ ID NO: 889936 - RNA, 19 nt, Human
ugagaugggaugaggagga

SEQ ID NO: 889937 - RNA, 19 nt, Human
ugagcuggccccgcacccc

SEQ ID NO: 889938 - RNA, 21 nt, Human
ugagcuggccccgcaccccug

SEQ ID NO: 889939 - RNA, 24 nt, Human
ugaggggguagaacugggcagaaa

SEQ ID NO: 889940 - RNA, 24 nt, Human
ugaggggguagaacugggcagaaa

SEQ ID NO: 889941 - RNA, 22 nt, Human
ugaugcguccgggacacacuga

SEQ ID NO: 889942 - RNA, 24 nt, Human
uggaaacagcaaaaaacaaaauuc

SEQ ID NO: 889943 - RNA, 24 nt, Human
uggaaacagcaaaaaacaaaauuc

SEQ ID NO: 889944 - RNA, 22 nt, Human
uggaagggacagucuguggggu

SEQ ID NO: 889945 - RNA, 21 nt, Human
uggagcaggaggccgcggaga

SEQ ID NO: 889946 - RNA, 18 nt, Human
uggagggugggggaaggg

SEQ ID NO: 889947 - RNA, 19 nt, Human
uggagggugggggaagggg

SEQ ID NO: 889948 - RNA, 21 nt, Human
uggcagagugugggcuggaag

SEQ ID NO: 889949 - RNA, 19 nt, Human
uggccaccugcgggcuccc

SEQ ID NO: 889950 - RNA, 19 nt, Human
uggcucagaauugggacag

SEQ ID NO: 889951 - RNA, 18 nt, Human
uggcugccugguccgagc

SEQ ID NO: 889952 - RNA, 18 nt, Human
ugggaugagaggggucaa

SEQ ID NO: 889953 - RNA, 20 nt, Human
ugggcagaaacuaacacgcc

SEQ ID NO: 889954 - RNA, 20 nt, Human
ugggcagaaacuaacacgcc

SEQ ID NO: 889955 - RNA, 18 nt, Human
ugggcuggaagggacagu

SEQ ID NO: 889956 - RNA, 21 nt, Human
ugggggcaaaaaaggggucuc

SEQ ID NO: 889957 - RNA, 23 nt, Human
uggggugugggacuguagaagcc

SEQ ID NO: 889958 - RNA, 20 nt, Human
ugggguuccugcccugacgg

SEQ ID NO: 889959 - RNA, 18 nt, Human
ugguuucugggccgcaag

SEQ ID NO: 889960 - RNA, 18 nt, Human
ugguuucugggccgcaag

SEQ ID NO: 889961 - RNA, 25 nt, Human
uguacacacacacacacacacacac

SEQ ID NO: 889962 - RNA, 25 nt, Human
uguacacacacacacacacacacag

SEQ ID NO: 889963 - RNA, 25 nt, Human
uguacacacacacacacacacacag

SEQ ID NO: 889964 - RNA, 25 nt, Human
uguacacacacacacacacacacau

SEQ ID NO: 889965 - RNA, 22 nt, Human
uguccagaaccuucagccccca

SEQ ID NO: 889966 - RNA, 23 nt, Human
uguccucucagcuucagaacacc

SEQ ID NO: 889967 - RNA, 22 nt, Human
ugugacguguacuggaaauaga

SEQ ID NO: 889968 - RNA, 22 nt, Human
ugugacguguacuggaaauaga

SEQ ID NO: 889969 - RNA, 23 nt, Human
uguggcccagcacccacccucuc

SEQ ID NO: 889970 - RNA, 21 nt, Human
uguuuucacugcucucucccg

SEQ ID NO: 889971 - RNA, 23 nt, Human
uucaccuugaccaaagagacaac

SEQ ID NO: 889972 - RNA, 23 nt, Human
uucaccuugaccaaagagacaac

SEQ ID NO: 889973 - RNA, 26 nt, Human
uucacugcucucucccguuuuggggg

SEQ ID NO: 889974 - RNA, 26 nt, Human
uucacugcucucucccguuuuggggg

SEQ ID NO: 889975 - RNA, 22 nt, Human
uucauguccagaaccuucagcc

SEQ ID NO: 889976 - RNA, 25 nt, Human
uucuccauguucugucuuccuuggg

SEQ ID NO: 889977 - RNA, 19 nt, Human
uucuguuucuccaaaagcc

SEQ ID NO: 889978 - RNA, 19 nt, Human
uugaccaaagagacaaccu

SEQ ID NO: 889979 - RNA, 19 nt, Human
uugaccaaagagacaaccu

SEQ ID NO: 889980 - RNA, 18 nt, Human
accauaaaaaguuaaaag

SEQ ID NO: 889981 - RNA, 23 nt, Human
accauaaaaaguuaaaagaaaag

SEQ ID NO: 889982 - RNA, 19 nt, Human
acuaugccaacagaagcac

SEQ ID NO: 889983 - RNA, 23 nt, Human
agccaucaaacugcuaccaagcu

SEQ ID NO: 889984 - RNA, 24 nt, Human
caagugguagcaacaccaguccuu

SEQ ID NO: 889985 - RNA, 23 nt, Human
ccaguacucucauguuauguaac

SEQ ID NO: 889986 - RNA, 18 nt, Human
ccuggcccaguacucuca

SEQ ID NO: 889987 - RNA, 26 nt, Human
cugaaaaugcuugagaaaguugcaau

SEQ ID NO: 889988 - RNA, 18 nt, Human
gcaagacccgucgccaag

SEQ ID NO: 889989 - RNA, 20 nt, Human
gcaauagauggaaaagaaac

SEQ ID NO: 889990 - RNA, 22 nt, Human
ggaagaaacuguucuuuuuucu

SEQ ID NO: 889991 - RNA, 22 nt, Human
ggacucacagaaaauacagucu

SEQ ID NO: 889992 - RNA, 23 nt, Human
gugguagcaacaccaguccuggc

SEQ ID NO: 889993 - RNA, 18 nt, Human
uagcaacaccaguccugg

SEQ ID NO: 889994 - RNA, 18 nt, Human
uccacgugccagcacaug

SEQ ID NO: 889995 - RNA, 22 nt, Human
uccagcuacuuuuccaaucucu

SEQ ID NO: 889996 - RNA, 21 nt, Human
ucuggaagcuuuggaaaaggu

SEQ ID NO: 889997 - RNA, 21 nt, Human
ucuggaauuaaaguucagagc

SEQ ID NO: 889998 - RNA, 24 nt, Human
uucagagcugaaaaugcuugagaa

SEQ ID NO: 889999 - RNA, 20 nt, Human
uuuguaucacuugaucagga

SEQ ID NO: 890000 - RNA, 19 nt, Human
aaaccucuguucagcacac

SEQ ID NO: 890001 - RNA, 27 nt, Human
aagcauuucaauauuuuuuccuuacgg

SEQ ID NO: 890002 - RNA, 23 nt, Human
acaccagggagcagaccgaguac

SEQ ID NO: 890003 - RNA, 18 nt, Human
acagcaaaaaggcuauga

SEQ ID NO: 890004 - RNA, 18 nt, Human
agagcacucucuagcucc

SEQ ID NO: 890005 - RNA, 18 nt, Human
agcacaccguuaaaaugc

SEQ ID NO: 890006 - RNA, 20 nt, Human
agcacaccguuaaaaugcag

SEQ ID NO: 890007 - RNA, 26 nt, Human
agugcugcugugccucuuguuuagcu

SEQ ID NO: 890008 - RNA, 19 nt, Human
caacaauauuccaagagca

SEQ ID NO: 890009 - RNA, 22 nt, Human
caauacugagaauugcugcaga

SEQ ID NO: 890010 - RNA, 24 nt, Human
cacacauuguccuuuucaaaacaa

SEQ ID NO: 890011 - RNA, 19 nt, Human
cagaccgaguacagcaaaa

SEQ ID NO: 890012 - RNA, 25 nt, Human
cagaccgaguacagcaaaaaggcua

SEQ ID NO: 890013 - RNA, 23 nt, Human
cagcuuccuucuuggacacgaga

SEQ ID NO: 890014 - RNA, 24 nt, Human
cagcuuccuucuuggacacgagaa

SEQ ID NO: 890015 - RNA, 23 nt, Human
caugagauauccaguauucaggu

SEQ ID NO: 890016 - RNA, 20 nt, Human
cauuucaauauuuugucuuu

SEQ ID NO: 890017 - RNA, 20 nt, Human
cugcuccugcucugcuguug

SEQ ID NO: 890018 - RNA, 20 nt, Human
cugugccucuuguuuagcug

SEQ ID NO: 890019 - RNA, 22 nt, Human
cuuucaguucaugcaaucugcc

SEQ ID NO: 890020 - RNA, 23 nt, Human
gagcacaacugaguuaaagcugg

SEQ ID NO: 890021 - RNA, 22 nt, Human
gagcuuucaguucaugcaaucu

SEQ ID NO: 890022 - RNA, 24 nt, Human
gaguacagcaaaaaggcuaugaga

SEQ ID NO: 890023 - RNA, 21 nt, Human
guuuuggaagcuuuuucccaa

SEQ ID NO: 890024 - RNA, 24 nt, Human
uaaaaguaucuugagaggcuuagu

SEQ ID NO: 890025 - RNA, 21 nt, Human
uaaaguaugagauguugcaaa

SEQ ID NO: 890026 - RNA, 21 nt, Human
ucaguucaugcaaucugccuc

SEQ ID NO: 890027 - RNA, 22 nt, Human
ucuugagaggcuuaguucuugu

SEQ ID NO: 890028 - RNA, 27 nt, Human
ugcugcugugccucuuguuccgucacg

SEQ ID NO: 890029 - RNA, 21 nt, Human
ugcuguugcuagugcugcugu

SEQ ID NO: 890030 - RNA, 23 nt, Human
ugucugaacucuuccagcagagu

SEQ ID NO: 890031 - RNA, 23 nt, Human
uuaaaaugcagcuuccuucuugg

SEQ ID NO: 890032 - RNA, 19 nt, Human
uugaagggagcacaacuga

SEQ ID NO: 890033 - RNA, 22 nt, Human
uuuucaaaacaagcagccagcu

SEQ ID NO: 890034 - RNA, 21 nt, Human
ggaggggccgccucugucagu

SEQ ID NO: 890035 - RNA, 21 nt, Human
uugguuuucacauuuuuauug

SEQ ID NO: 890036 - RNA, 18 nt, Human
uuuuuuuuuuuuuuuuug

SEQ ID NO: 890037 - RNA, 24 nt, Human
uuuuuuuuuuuuuuuuuugguuuu

SEQ ID NO: 890038 - RNA, 22 nt, Human
aaaggagagaaccgaccuagcc

SEQ ID NO: 890039 - RNA, 21 nt, Human
agagaaccgaccuagccacca

SEQ ID NO: 890040 - RNA, 24 nt, Human
aucauuguaaucuccaauagagau

SEQ ID NO: 890041 - RNA, 19 nt, Human
ccaccaggcccuaagcuaa

SEQ ID NO: 890042 - RNA, 24 nt, Human
ccaccaggcccuaagcuaaaaauu

SEQ ID NO: 890043 - RNA, 18 nt, Human
gaagaccuucauucuaaa

SEQ ID NO: 890044 - RNA, 20 nt, Human
gagaaccgaccuagccacca

SEQ ID NO: 890045 - RNA, 22 nt, Human
uaaagcagcguuauagugaaac

SEQ ID NO: 890046 - RNA, 19 nt, Human
uaaguggaaaauugugcgg

SEQ ID NO: 890047 - RNA, 26 nt, Human
ucuccaauagagauuacaauagagau

SEQ ID NO: 890048 - RNA, 22 nt, Human
ucuccgacuggaaaggagagaa

SEQ ID NO: 890049 - RNA, 18 nt, Human
ucuggaagaccuucauuc

SEQ ID NO: 890050 - RNA, 22 nt, Human
uggaaaggagagaaccgaccua

SEQ ID NO: 890051 - RNA, 22 nt, Human
uuagaggagaaauauuuccugg

SEQ ID NO: 890052 - RNA, 23 nt, Human
aacaggagaauugcuugaacucg

SEQ ID NO: 890053 - RNA, 24 nt, Human
aauugcuugaacucgggaggcaga

SEQ ID NO: 890054 - RNA, 18 nt, Human
acgccacuacacuccagc

SEQ ID NO: 890055 - RNA, 18 nt, Human
acuacacuccagccuggg

SEQ ID NO: 890056 - RNA, 18 nt, Human
acuacacuccagccuggg

SEQ ID NO: 890057 - RNA, 18 nt, Human
agagguugcagugagcug

SEQ ID NO: 890058 - RNA, 22 nt, Human
agagguugcagugagcugagau

SEQ ID NO: 890059 - RNA, 23 nt, Human
agagguugcagugagcugagaug

SEQ ID NO: 890060 - RNA, 20 nt, Human
agagguugcagugagcuggc

SEQ ID NO: 890061 - RNA, 26 nt, Human
aggcaacaggagaauugcuugaacuc

SEQ ID NO: 890062 - RNA, 20 nt, Human
aggcagagguugcagugagc

SEQ ID NO: 890063 - RNA, 24 nt, Human
aggcagagguugcagugagcugag

SEQ ID NO: 890064 - RNA, 24 nt, Human
augacgccacuacacuccagccug

SEQ ID NO: 890065 - RNA, 24 nt, Human
caacaggagaauugcuugaacucg

SEQ ID NO: 890066 - RNA, 19 nt, Human
caaggcaacaggagaauug

SEQ ID NO: 890067 - RNA, 25 nt, Human
cacuacacuccagccugggggauac

SEQ ID NO: 890068 - RNA, 23 nt, Human
cacuccagccugggggauacagc

SEQ ID NO: 890069 - RNA, 18 nt, Human
cagcgagucucugcagcc

SEQ ID NO: 890070 - RNA, 20 nt, Human
ccacuacacuccagccuggg

SEQ ID NO: 890071 - RNA, 23 nt, Human
ccacuacacuccagccuggggga

SEQ ID NO: 890072 - RNA, 24 nt, Human
ccacuacacuccagccugggggau

SEQ ID NO: 890073 - RNA, 19 nt, Human
ccgagaccaaggcaacagg

SEQ ID NO: 890074 - RNA, 21 nt, Human
ccuacagcgaccccgagacca

SEQ ID NO: 890075 - RNA, 27 nt, Human
cgccacuacacuccagccugggggaua

SEQ ID NO: 890076 - RNA, 23 nt, Human
cgccuacagcgaccccgagaccc

SEQ ID NO: 890077 - RNA, 24 nt, Human
cgggaggcagagguugcagugagc

SEQ ID NO: 890078 - RNA, 23 nt, Human
gagaauugcuugaacucgggagg

SEQ ID NO: 890079 - RNA, 19 nt, Human
gagaccaaggcaacaggag

SEQ ID NO: 890080 - RNA, 19 nt, Human
gcgaccccgagaccaaggc

SEQ ID NO: 890081 - RNA, 24 nt, Human
guugcagugagcugagaugacgcc

SEQ ID NO: 890082 - RNA, 20 nt, Human
ucagcgccuacagcgacccc

SEQ ID NO: 890083 - RNA, 18 nt, Human
uugcagugagcugagaug

SEQ ID NO: 890084 - RNA, 20 nt, Human
uugcagugagcugagaugac

SEQ ID NO: 890085 - RNA, 18 nt, Human
uugcuugaacucgggagg

SEQ ID NO: 890086 - RNA, 24 nt, Human
uugcuugaacucgggaggcagagg

SEQ ID NO: 890087 - RNA, 24 nt, Human
uuuuuuuuuuuuuuuuuuuuucag

SEQ ID NO: 890088 - RNA, 18 nt, Human
aaugugcaauaugaaguc

SEQ ID NO: 890089 - RNA, 23 nt, Human
caagccacuuuaauuuguaacuu

SEQ ID NO: 890090 - RNA, 21 nt, Human
cagccgccucgccccugccua

SEQ ID NO: 890091 - RNA, 23 nt, Human
ccuggcucuuguacagagugagg

SEQ ID NO: 890092 - RNA, 23 nt, Human
cgccccgcgguccccagccgccu

SEQ ID NO: 890093 - RNA, 22 nt, Human
guccccagccgccucgccccug

SEQ ID NO: 890094 - RNA, 18 nt, Human
uccccagccgccucgccc

SEQ ID NO: 890095 - RNA, 24 nt, Human
uccccagccgccucgccccugccu

SEQ ID NO: 890096 - RNA, 26 nt, Human
uccccagccgccucgccccugccuac

SEQ ID NO: 890097 - RNA, 18 nt, Human
uaggcaggaauacauaua

SEQ ID NO: 890098 - RNA, 18 nt, Human
uagucaucauugccagac

SEQ ID NO: 890099 - RNA, 22 nt, Human
aaacaaaagccucaaucugaac

SEQ ID NO: 890100 - RNA, 23 nt, Human
aaacaaaagccucaaucugaacc

SEQ ID NO: 890101 - RNA, 22 nt, Human
acaaaagccucaaucugaacca

SEQ ID NO: 890102 - RNA, 18 nt, Human
acaucuacaguacaggca

SEQ ID NO: 890103 - RNA, 21 nt, Human
acggagagcaaaaauacagaa

SEQ ID NO: 890104 - RNA, 19 nt, Human
acuuuguauuuggagaaaa

SEQ ID NO: 890105 - RNA, 24 nt, Human
agccaaacuccucaaacaaaagcc

SEQ ID NO: 890106 - RNA, 22 nt, Human
caaaauacuauaauuacuggug

SEQ ID NO: 890107 - RNA, 24 nt, Human
caaacuccucaaacaaaagccuca

SEQ ID NO: 890108 - RNA, 26 nt, Human
caacacugagagacaguaaugucaga

SEQ ID NO: 890109 - RNA, 20 nt, Human
caguaaugucagaggcucuu

SEQ ID NO: 890110 - RNA, 20 nt, Human
ccccucaauaauacagacaa

SEQ ID NO: 890111 - RNA, 20 nt, Human
cuuaaaauccugaguugccc

SEQ ID NO: 890112 - RNA, 21 nt, Human
cuuuguauuuggagaaaaaaa

SEQ ID NO: 890113 - RNA, 20 nt, Human
guauuuggagaaaaaaaggc

SEQ ID NO: 890114 - RNA, 22 nt, Human
uaaaacacuaaccuuucaaagu

SEQ ID NO: 890115 - RNA, 21 nt, Human
uaaaauccugaguugccccuc

SEQ ID NO: 890116 - RNA, 19 nt, Human
uacaaaauacuauaauuac

SEQ ID NO: 890117 - RNA, 21 nt, Human
uauggaacuuaaaauccugag

SEQ ID NO: 890118 - RNA, 23 nt, Human
ucaaacaaaagccucaaucugaa

SEQ ID NO: 890119 - RNA, 19 nt, Human
ucaauaauacagacaucua

SEQ ID NO: 890120 - RNA, 21 nt, Human
ucacaaauuccuauuucucca

SEQ ID NO: 890121 - RNA, 22 nt, Human
ucuauaacuuccauuugucagg

SEQ ID NO: 890122 - RNA, 23 nt, Human
uuuauggaacuuaaaauccugag

SEQ ID NO: 890123 - RNA, 20 nt, Human
uuuguacaaaauacuauaau

SEQ ID NO: 890124 - RNA, 23 nt, Human
uuuguauuuggagaaaaaaaggc

SEQ ID NO: 890125 - RNA, 29 nt, Human
aaaggacacggcgcacccucgaacuacgg

SEQ ID NO: 890126 - RNA, 19 nt, Human
aagcgaccuugcgggaacc

SEQ ID NO: 890127 - RNA, 18 nt, Human
acuuaggcucauaagccu

SEQ ID NO: 890128 - RNA, 24 nt, Human
uaauauaggaacaaacuuaggcuc

SEQ ID NO: 890129 - RNA, 20 nt, Human
uuacuuuuccagaaaauuca

SEQ ID NO: 890130 - RNA, 18 nt, Human
uuuuuuuuuuuuuuucug

SEQ ID NO: 890131 - RNA, 21 nt, Human
aaaaaaaaaaaaaauaccaca

SEQ ID NO: 890132 - RNA, 18 nt, Human
aaagacaacuuggcaaca

SEQ ID NO: 890133 - RNA, 24 nt, Human
aaagugcugggauuacaggcauga

SEQ ID NO: 890134 - RNA, 19 nt, Human
aacauggugaaaccccguc

SEQ ID NO: 890135 - RNA, 20 nt, Human
aacauggugaaaccccgucu

SEQ ID NO: 890136 - RNA, 21 nt, Human
aacauggugaaaccccgucuc

SEQ ID NO: 890137 - RNA, 20 nt, Human
aaggcagguggaucacaagg

SEQ ID NO: 890138 - RNA, 19 nt, Human
aagugcugggauuacaggc

SEQ ID NO: 890139 - RNA, 21 nt, Human
aagugcugggauuacaggcau

SEQ ID NO: 890140 - RNA, 26 nt, Human
aagugcugggauuacaggcaugagcc

SEQ ID NO: 890141 - RNA, 19 nt, Human
aauccuccauaaucuggcu

SEQ ID NO: 890142 - RNA, 24 nt, Human
aauugcuugaacccaggaggugga

SEQ ID NO: 890143 - RNA, 19 nt, Human
accauguugcccaaguugg

SEQ ID NO: 890144 - RNA, 24 nt, Human
accauguugcccaaguuggucucg

SEQ ID NO: 890145 - RNA, 24 nt, Human
accccgucucuacuaaaaacacaa

SEQ ID NO: 890146 - RNA, 20 nt, Human
accucagccuuaugaguagc

SEQ ID NO: 890147 - RNA, 23 nt, Human
accuguagucccagcuacucggg

SEQ ID NO: 890148 - RNA, 21 nt, Human
acgacgaccacuacccgggcc

SEQ ID NO: 890149 - RNA, 19 nt, Human
acuaaaaacacaaaaauca

SEQ ID NO: 890150 - RNA, 23 nt, Human
acugcacuccagccugaugacag

SEQ ID NO: 890151 - RNA, 25 nt, Human
acugcacuccagccugaugacagag

SEQ ID NO: 890152 - RNA, 19 nt, Human
acuuuuuuuuuugacgggg

SEQ ID NO: 890153 - RNA, 19 nt, Human
agaccacgaacuacaagga

SEQ ID NO: 890154 - RNA, 22 nt, Human
agaccaggcgcgguggcucacg

SEQ ID NO: 890155 - RNA, 26 nt, Human
agcaagacugucucaaaaaaaaaaaa

SEQ ID NO: 890156 - RNA, 23 nt, Human
agccugaugacagagcaagacug

SEQ ID NO: 890157 - RNA, 23 nt, Human
aggcaggagaauugcuugaaccc

SEQ ID NO: 890158 - RNA, 24 nt, Human
aggcaggagaauugcuugaaccca

SEQ ID NO: 890159 - RNA, 18 nt, Human
aggcagguggaucacaag

SEQ ID NO: 890160 - RNA, 24 nt, Human
aggcagguggaucacaaggucaag

SEQ ID NO: 890161 - RNA, 24 nt, Human
aggcgcgguggcucacgccuguaa

SEQ ID NO: 890162 - RNA, 21 nt, Human
aggcugaggcaggagaauugc

SEQ ID NO: 890163 - RNA, 24 nt, Human
aggcugaggcaggagaauugcuug

SEQ ID NO: 890164 - RNA, 21 nt, Human
agguggagguugcagugagcc

SEQ ID NO: 890165 - RNA, 22 nt, Human
agguggagguugcagugagccg

SEQ ID NO: 890166 - RNA, 18 nt, Human
agguggaucacaagguca

SEQ ID NO: 890167 - RNA, 19 nt, Human
agguggaucacaaggucaa

SEQ ID NO: 890168 - RNA, 23 nt, Human
aguagcugggauugcaggaacgu

SEQ ID NO: 890169 - RNA, 21 nt, Human
agugaacugugacacaaccac

SEQ ID NO: 890170 - RNA, 18 nt, Human
agugcugggauuacaggc

SEQ ID NO: 890171 - RNA, 19 nt, Human
agugucacccaggcugcag

SEQ ID NO: 890172 - RNA, 21 nt, Human
auacaaaccugacuguaugau

SEQ ID NO: 890173 - RNA, 21 nt, Human
aucugcccugccucagccucu

SEQ ID NO: 890174 - RNA, 21 nt, Human
aucuuggccaacauggugaaa

SEQ ID NO: 890175 - RNA, 24 nt, Human
auugcgccacugcacuccagccug

SEQ ID NO: 890176 - RNA, 23 nt, Human
caaagugcugggauuacaggcau

SEQ ID NO: 890177 - RNA, 24 nt, Human
caaagugcugggauuacaggcaug

SEQ ID NO: 890178 - RNA, 21 nt, Human
caacaauaaagagucagagua

SEQ ID NO: 890179 - RNA, 24 nt, Human
caacauggugaaaccccgucucua

SEQ ID NO: 890180 - RNA, 21 nt, Human
caaggaaaaccacgacgacca

SEQ ID NO: 890181 - RNA, 22 nt, Human
caaggcagguggaucacaaggu

SEQ ID NO: 890182 - RNA, 24 nt, Human
caaggcagguggaucacaagguca

SEQ ID NO: 890183 - RNA, 18 nt, Human
caauuaauugcauccucg

SEQ ID NO: 890184 - RNA, 24 nt, Human
caccacgcccagcuaauuuuugua

SEQ ID NO: 890185 - RNA, 24 nt, Human
caccauguugcccaaguuggucuc

SEQ ID NO: 890186 - RNA, 21 nt, Human
caccuguagucccagcuacuc

SEQ ID NO: 890187 - RNA, 24 nt, Human
caccuguagucccagcuacucggg

SEQ ID NO: 890188 - RNA, 24 nt, Human
cacgccuguaauuccaacacuuug

SEQ ID NO: 890189 - RNA, 18 nt, Human
cacugcacuccagccuga

SEQ ID NO: 890190 - RNA, 20 nt, Human
cacugcacuccagccugaug

SEQ ID NO: 890191 - RNA, 23 nt, Human
cacugcacuccagccugaugaca

SEQ ID NO: 890192 - RNA, 23 nt, Human
cacugcacuccagccugaugaca

SEQ ID NO: 890193 - RNA, 23 nt, Human
cagaauccuccauaaucuggcuc

SEQ ID NO: 890194 - RNA, 24 nt, Human
cagcuacucgggaggcugaggcag

SEQ ID NO: 890195 - RNA, 22 nt, Human
caggaacgugccaccacgccca

SEQ ID NO: 890196 - RNA, 29 nt, Human
caggagguggagguugcagugacaacggu

SEQ ID NO: 890197 - RNA, 24 nt, Human
caggagguggagguugcagugagc

SEQ ID NO: 890198 - RNA, 28 nt, Human
caggauaacccaccuaagagcaaagaca

SEQ ID NO: 890199 - RNA, 18 nt, Human
caguguuucaccauguug

SEQ ID NO: 890200 - RNA, 22 nt, Human
cauauacuuuaucuccaaaacc

SEQ ID NO: 890201 - RNA, 24 nt, Human
cauguugcccaaguuggucucgaa

SEQ ID NO: 890202 - RNA, 19 nt, Human
ccaacacuuuggaaggcca

SEQ ID NO: 890203 - RNA, 20 nt, Human
ccaccacgcccagcuaauuu

SEQ ID NO: 890204 - RNA, 18 nt, Human
ccacugcacuccagccug

SEQ ID NO: 890205 - RNA, 19 nt, Human
ccacugcacuccagccuga

SEQ ID NO: 890206 - RNA, 20 nt, Human
ccacugcacuccagccugau

SEQ ID NO: 890207 - RNA, 23 nt, Human
ccacugcacuccagccugaugac

SEQ ID NO: 890208 - RNA, 22 nt, Human
ccaggagguggagguugcagug

SEQ ID NO: 890209 - RNA, 20 nt, Human
ccagggcucaauagauccuc

SEQ ID NO: 890210 - RNA, 21 nt, Human
cccaggagguggagguugcag

SEQ ID NO: 890211 - RNA, 24 nt, Human
ccucccaccucagccuuaugagua

SEQ ID NO: 890212 - RNA, 24 nt, Human
ccugccucagccucucaaagugcu

SEQ ID NO: 890213 - RNA, 21 nt, Human
ccuguagucccagcuacucgg

SEQ ID NO: 890214 - RNA, 24 nt, Human
cgaaauugcgccacugcacuccag

SEQ ID NO: 890215 - RNA, 26 nt, Human
cgccacugcacuccagccugaugaca

SEQ ID NO: 890216 - RNA, 23 nt, Human
cgccuguaauuccaacacuuugg

SEQ ID NO: 890217 - RNA, 18 nt, Human
cggcgcagcgcggugccc

SEQ ID NO: 890218 - RNA, 23 nt, Human
cuaacucuaaacuagaauucaac

SEQ ID NO: 890219 - RNA, 19 nt, Human
cuaagcggucagcuuucuc

SEQ ID NO: 890220 - RNA, 24 nt, Human
cucacgccuguaauuccaacacuu

SEQ ID NO: 890221 - RNA, 24 nt, Human
cucagccuuaugaguagcugggau

SEQ ID NO: 890222 - RNA, 20 nt, Human
cuccugggcucaugcaaucu

SEQ ID NO: 890223 - RNA, 21 nt, Human
cuccuuugucacccaggcugg

SEQ ID NO: 890224 - RNA, 23 nt, Human
cuccuuugucacccaggcuggag

SEQ ID NO: 890225 - RNA, 24 nt, Human
cuccuuugucacccaggcuggagu

SEQ ID NO: 890226 - RNA, 24 nt, Human
cuggagucuccuccuucgaaacca

SEQ ID NO: 890227 - RNA, 22 nt, Human
cugucucaaaaaaaaaaaaaaa

SEQ ID NO: 890228 - RNA, 24 nt, Human
cuuggccaacauggugaaaccccg

SEQ ID NO: 890229 - RNA, 20 nt, Human
cuuugucacccaggcuggag

SEQ ID NO: 890230 - RNA, 23 nt, Human
gaacuccugggcucaugcaaucu

SEQ ID NO: 890231 - RNA, 23 nt, Human
gacagagcaagacugucucaaaa

SEQ ID NO: 890232 - RNA, 23 nt, Human
gagaauugcuugaacccaggagg

SEQ ID NO: 890233 - RNA, 21 nt, Human
gagguugcagugagccgaaau

SEQ ID NO: 890234 - RNA, 23 nt, Human
gagguugcagugagccgaaauug

SEQ ID NO: 890235 - RNA, 18 nt, Human
gauuacaggcaugagcca

SEQ ID NO: 890236 - RNA, 19 nt, Human
gauuacaggcaugagccac

SEQ ID NO: 890237 - RNA, 23 nt, Human
gauuacaggcaugagccacugca

SEQ ID NO: 890238 - RNA, 20 nt, Human
gcaaucugcccugccucagc

SEQ ID NO: 890239 - RNA, 23 nt, Human
gcacuccagccugaugacagagc

SEQ ID NO: 890240 - RNA, 22 nt, Human
gcaggagaauugcuugaaccca

SEQ ID NO: 890241 - RNA, 24 nt, Human
gccaacauggugaaaccccgucuc

SEQ ID NO: 890242 - RNA, 22 nt, Human
gcccagcuaauuuuuguauuuu

SEQ ID NO: 890243 - RNA, 22 nt, Human
ggagguugcagugagccgaaau

SEQ ID NO: 890244 - RNA, 24 nt, Human
ggagguugcagugagccgaaauug

SEQ ID NO: 890245 - RNA, 22 nt, Human
ggauuacaggcaugagccacug

SEQ ID NO: 890246 - RNA, 18 nt, Human
gggcacggcgcagcgcgg

SEQ ID NO: 890247 - RNA, 20 nt, Human
gggccaggacaagcauuuga

SEQ ID NO: 890248 - RNA, 24 nt, Human
gggcgucguggcaugcaccuguag

SEQ ID NO: 890249 - RNA, 23 nt, Human
gguggcucacgccuguaauucca

SEQ ID NO: 890250 - RNA, 21 nt, Human
guacuuuuuuuuuugacgggg

SEQ ID NO: 890251 - RNA, 22 nt, Human
guagcugggauugcaggaacgu

SEQ ID NO: 890252 - RNA, 24 nt, Human
gucuccuuugucacccaggcugga

SEQ ID NO: 890253 - RNA, 22 nt, Human
guggcaugcaccuguaguccca

SEQ ID NO: 890254 - RNA, 25 nt, Human
uaaaaacacaaaaaucagcugggcg

SEQ ID NO: 890255 - RNA, 24 nt, Human
uaauuuuuguauuuuauguagaga

SEQ ID NO: 890256 - RNA, 24 nt, Human
uacaaggaaaaccacgacgaccac

SEQ ID NO: 890257 - RNA, 20 nt, Human
uacaggcaugagccacugca

SEQ ID NO: 890258 - RNA, 25 nt, Human
uaccacauauacuuuaucuccaaaa

SEQ ID NO: 890259 - RNA, 22 nt, Human
uacccgggccuaagcggucagc

SEQ ID NO: 890260 - RNA, 22 nt, Human
uagagacaguguuucaccaugu

SEQ ID NO: 890261 - RNA, 22 nt, Human
uagauccucccaccucagccuu

SEQ ID NO: 890262 - RNA, 20 nt, Human
uagcuccugaguccauuuuc

SEQ ID NO: 890263 - RNA, 27 nt, Human
uaggucucuaucacaacuacucaauuc

SEQ ID NO: 890264 - RNA, 20 nt, Human
uauacuuuaucuccaaaacc

SEQ ID NO: 890265 - RNA, 23 nt, Human
uaugaguagcugggauugcagga

SEQ ID NO: 890266 - RNA, 25 nt, Human
ucaaaaaaaaaaaaaaaauaccaca

SEQ ID NO: 890267 - RNA, 23 nt, Human
ucaaagugcugggauuacaggca

SEQ ID NO: 890268 - RNA, 24 nt, Human
ucaaagugcugggauuacaggcau

SEQ ID NO: 890269 - RNA, 18 nt, Human
ucaaccucaucuuaaaau

SEQ ID NO: 890270 - RNA, 24 nt, Human
ucacaaggucaagagauugagacc

SEQ ID NO: 890271 - RNA, 19 nt, Human
ucacccaggcuggaguguc

SEQ ID NO: 890272 - RNA, 22 nt, Human
ucagcugggcgucguggcaugc

SEQ ID NO: 890273 - RNA, 23 nt, Human
uccauaaucuggcucacucuaaa

SEQ ID NO: 890274 - RNA, 20 nt, Human
uccugggcucaugcaaucug

SEQ ID NO: 890275 - RNA, 23 nt, Human
ucgggaggcugaggcaggagaau

SEQ ID NO: 890276 - RNA, 23 nt, Human
ucuaaagcacuuuccucaaccua

SEQ ID NO: 890277 - RNA, 18 nt, Human
ucuaauugcaccaagcuc

SEQ ID NO: 890278 - RNA, 24 nt, Human
ucucaaagugcugggauuacaggc

SEQ ID NO: 890279 - RNA, 19 nt, Human
ucucagaccacgaacuaca

SEQ ID NO: 890280 - RNA, 23 nt, Human
ucuccuuugucacccaggcugga

SEQ ID NO: 890281 - RNA, 19 nt, Human
ucucgaacuccugggcuca

SEQ ID NO: 890282 - RNA, 19 nt, Human
ucucgaacuccugggcuca

SEQ ID NO: 890283 - RNA, 19 nt, Human
ugaaaucacauauagacca

SEQ ID NO: 890284 - RNA, 24 nt, Human
ugagaccaucuuggccaacauggu

SEQ ID NO: 890285 - RNA, 20 nt, Human
ugagcauggcuguguuccaa

SEQ ID NO: 890286 - RNA, 22 nt, Human
ugagccgaaauugcgccacugc

SEQ ID NO: 890287 - RNA, 24 nt, Human
ugaggcaggagaauugcuugaacc

SEQ ID NO: 890288 - RNA, 25 nt, Human
ugaggcaggagaauugcuugaaccc

SEQ ID NO: 890289 - RNA, 19 nt, Human
ugcaccuguagucccagcu

SEQ ID NO: 890290 - RNA, 24 nt, Human
ugcccaaguuggucucgaacuccu

SEQ ID NO: 890291 - RNA, 25 nt, Human
ugcccagaaaccaucugcuuauauu

SEQ ID NO: 890292 - RNA, 19 nt, Human
ugcccugccucagccucuc

SEQ ID NO: 890293 - RNA, 24 nt, Human
ugccucagccucucaaagugcugg

SEQ ID NO: 890294 - RNA, 24 nt, Human
uggaaggccaaggcagguggauca

SEQ ID NO: 890295 - RNA, 22 nt, Human
uggcaugcaccuguagucccag

SEQ ID NO: 890296 - RNA, 20 nt, Human
uggccaacauggugaaaccc

SEQ ID NO: 890297 - RNA, 21 nt, Human
uggccaacauggugaaacccc

SEQ ID NO: 890298 - RNA, 24 nt, Human
uggccaacauggugaaaccccguc

SEQ ID NO: 890299 - RNA, 24 nt, Human
uggcucacgccuguaauuccaaca

SEQ ID NO: 890300 - RNA, 18 nt, Human
ugggauuacaggcaugag

SEQ ID NO: 890301 - RNA, 19 nt, Human
ugggauuacaggcaugagc

SEQ ID NO: 890302 - RNA, 21 nt, Human
ugggauuacaggcaugagcca

SEQ ID NO: 890303 - RNA, 22 nt, Human
ugggauuacaggcaugagccac

SEQ ID NO: 890304 - RNA, 22 nt, Human
ugggauuacaggcaugagccac

SEQ ID NO: 890305 - RNA, 24 nt, Human
ugggauuacaggcaugagccacug

SEQ ID NO: 890306 - RNA, 24 nt, Human
ugggauuacaggcaugagccacug

SEQ ID NO: 890307 - RNA, 24 nt, Human
ugggauugcaggaacgugccacca

SEQ ID NO: 890308 - RNA, 21 nt, Human
ugggugaauggaaacugacca

SEQ ID NO: 890309 - RNA, 21 nt, Human
uguagagacaguguuucacca

SEQ ID NO: 890310 - RNA, 23 nt, Human
uguagagacaguguuucaccaug

SEQ ID NO: 890311 - RNA, 25 nt, Human
ugugacacaaccacaauuaauugca

SEQ ID NO: 890312 - RNA, 19 nt, Human
uguguuccaaugagacuuu

SEQ ID NO: 890313 - RNA, 24 nt, Human
uuacaauugguacucaagaaaaua

SEQ ID NO: 890314 - RNA, 21 nt, Human
uuccaguuagguacagucuuu

SEQ ID NO: 890315 - RNA, 24 nt, Human
uugaacccaggagguggagguugc

SEQ ID NO: 890316 - RNA, 20 nt, Human
uugcagugagccgaaauugc

SEQ ID NO: 890317 - RNA, 22 nt, Human
uugcagugagccgaaauugcgc

SEQ ID NO: 890318 - RNA, 23 nt, Human
uugcgccacugcacuccagccug

SEQ ID NO: 890319 - RNA, 24 nt, Human
uugcuugaacccaggagguggagg

SEQ ID NO: 890320 - RNA, 19 nt, Human
uuggcagugggccagauuu

SEQ ID NO: 890321 - RNA, 19 nt, Human
uuucaccauguugcccaag

SEQ ID NO: 890322 - RNA, 18 nt, Human
uuugucacccaggcugga

SEQ ID NO: 890323 - RNA, 20 nt, Human
uuuuuguauuuuauguagag

SEQ ID NO: 890324 - RNA, 23 nt, Human
uuuuuguauuuuauguagagaca

SEQ ID NO: 890325 - RNA, 23 nt, Human
aaaagccacucccaaccuuugcc

SEQ ID NO: 890326 - RNA, 19 nt, Human
aaccgcacccaaagcagac

SEQ ID NO: 890327 - RNA, 20 nt, Human
aagcagacauucuguacagg

SEQ ID NO: 890328 - RNA, 25 nt, Human
aagcagacauucuguacaggggggu

SEQ ID NO: 890329 - RNA, 26 nt, Human
aagcagaggcaguucaggccccagag

SEQ ID NO: 890330 - RNA, 20 nt, Human
aagcuccuuuuaguaguuug

SEQ ID NO: 890331 - RNA, 19 nt, Human
acaaaaccgcacccaaagc

SEQ ID NO: 890332 - RNA, 20 nt, Human
acaggggggugggugggcug

SEQ ID NO: 890333 - RNA, 21 nt, Human
accagcccugccccuuacccu

SEQ ID NO: 890334 - RNA, 19 nt, Human
accaggaagggggcacagg

SEQ ID NO: 890335 - RNA, 21 nt, Human
accaucccguuucuggguucc

SEQ ID NO: 890336 - RNA, 21 nt, Human
acccaaaugcagagaagccag

SEQ ID NO: 890337 - RNA, 23 nt, Human
accgaguacaaaaccgcacccag

SEQ ID NO: 890338 - RNA, 19 nt, Human
acggaaagggcugagggca

SEQ ID NO: 890339 - RNA, 26 nt, Human
acuucacucuccuccuaacacuccag

SEQ ID NO: 890340 - RNA, 21 nt, Human
agagcccccagcugaaaccag

SEQ ID NO: 890341 - RNA, 19 nt, Human
agagucuuggguaagagug

SEQ ID NO: 890342 - RNA, 18 nt, Human
agccugaauccccggggg

SEQ ID NO: 890343 - RNA, 19 nt, Human
aggcugaaaggagggcugg

SEQ ID NO: 890344 - RNA, 23 nt, Human
aucacuuucccauugcuauggaa

SEQ ID NO: 890345 - RNA, 18 nt, Human
caacccuccccucccccc

SEQ ID NO: 890346 - RNA, 22 nt, Human
caaccuuugccgacaaccaucc

SEQ ID NO: 890347 - RNA, 24 nt, Human
caagguggcaccugccucccuguc

SEQ ID NO: 890348 - RNA, 23 nt, Human
caccuccauccuuccucuccaaa

SEQ ID NO: 890349 - RNA, 19 nt, Human
cagcugaaaccagcccugc

SEQ ID NO: 890350 - RNA, 24 nt, Human
cagcugaaaccagcccugccccuu

SEQ ID NO: 890351 - RNA, 24 nt, Human
cagugaagcuccuuuuaguaguuu

SEQ ID NO: 890352 - RNA, 19 nt, Human
cauccuuccucuccaaauc

SEQ ID NO: 890353 - RNA, 22 nt, Human
ccaaaccgaguacaaaaccgca

SEQ ID NO: 890354 - RNA, 22 nt, Human
ccaaagcagacauucuguacag

SEQ ID NO: 890355 - RNA, 23 nt, Human
ccagcaguccccacagggccccu

SEQ ID NO: 890356 - RNA, 18 nt, Human
ccaggaagggggcacagg

SEQ ID NO: 890357 - RNA, 19 nt, Human
ccaugggaggagugguugc

SEQ ID NO: 890358 - RNA, 18 nt, Human
ccccagggcuccugccuc

SEQ ID NO: 890359 - RNA, 21 nt, Human
ccccagggcuccugccucucc

SEQ ID NO: 890360 - RNA, 23 nt, Human
ccccccgcccuccucccucccca

SEQ ID NO: 890361 - RNA, 23 nt, Human
cccccgagccgcuucggagcccg

SEQ ID NO: 890362 - RNA, 24 nt, Human
ccccucagggggggaagcagaggc

SEQ ID NO: 890363 - RNA, 24 nt, Human
ccccucuacuucacucuccuccua

SEQ ID NO: 890364 - RNA, 20 nt, Human
cccugccccuuacccuuccu

SEQ ID NO: 890365 - RNA, 19 nt, Human
cccuggcugggcgcuggcg

SEQ ID NO: 890366 - RNA, 21 nt, Human
cccuggcugggcgcuggcgag

SEQ ID NO: 890367 - RNA, 27 nt, Human
ccgcacccaaagcagacaguggaccuc

SEQ ID NO: 890368 - RNA, 20 nt, Human
ccuccccccgcccuccuccc

SEQ ID NO: 890369 - RNA, 21 nt, Human
ccuccccuccccccgcccucc

SEQ ID NO: 890370 - RNA, 18 nt, Human
ccuccucccuccccauuc

SEQ ID NO: 890371 - RNA, 19 nt, Human
ccuccucccuccccauucc

SEQ ID NO: 890372 - RNA, 21 nt, Human
ccucuccagccuggagacaga

SEQ ID NO: 890373 - RNA, 21 nt, Human
ccuuugccgacaaccaucccg

SEQ ID NO: 890374 - RNA, 24 nt, Human
cgagccugaauccccgggggcugg

SEQ ID NO: 890375 - RNA, 20 nt, Human
cggagcccggggccgaggug

SEQ ID NO: 890376 - RNA, 22 nt, Human
cguccuccccagguuacagucc

SEQ ID NO: 890377 - RNA, 18 nt, Human
cucagggggggaagcaga

SEQ ID NO: 890378 - RNA, 19 nt, Human
cuccuuuuaguaguuuguu

SEQ ID NO: 890379 - RNA, 24 nt, Human
cugaaaccagcccugccccuuacc

SEQ ID NO: 890380 - RNA, 20 nt, Human
cuucccggccggcucccugg

SEQ ID NO: 890381 - RNA, 20 nt, Human
gaauccccgggggcugggga

SEQ ID NO: 890382 - RNA, 22 nt, Human
gaauggggugagaguccaccuc

SEQ ID NO: 890383 - RNA, 25 nt, Human
gagacagauuugcuuugggauuguu

SEQ ID NO: 890384 - RNA, 20 nt, Human
gagcaagcgggaggggcggc

SEQ ID NO: 890385 - RNA, 20 nt, Human
gaggggccccucaggggggg

SEQ ID NO: 890386 - RNA, 26 nt, Human
gcaacccuccccuccccccgcccucc

SEQ ID NO: 890387 - RNA, 18 nt, Human
gcaggaagugggcaggcg

SEQ ID NO: 890388 - RNA, 19 nt, Human
gccucuccagccuggagac

SEQ ID NO: 890389 - RNA, 19 nt, Human
gcugcugagggaggaagga

SEQ ID NO: 890390 - RNA, 24 nt, Human
ggcaacccuccccuccccccgccc

SEQ ID NO: 890391 - RNA, 20 nt, Human
ggcaguucaggccccagagc

SEQ ID NO: 890392 - RNA, 19 nt, Human
gggaagcagaggcaguuca

SEQ ID NO: 890393 - RNA, 19 nt, Human
gggcuccugccucuccagc

SEQ ID NO: 890394 - RNA, 19 nt, Human
gggcuggggagcaagcggg

SEQ ID NO: 890395 - RNA, 24 nt, Human
gggcuggggagcaagcgggagggg

SEQ ID NO: 890396 - RNA, 21 nt, Human
ggggaauggggugagagucca

SEQ ID NO: 890397 - RNA, 18 nt, Human
ggggauggggagggggug

SEQ ID NO: 890398 - RNA, 19 nt, Human
ggggauggggagggggugg

SEQ ID NO: 890399 - RNA, 18 nt, Human
ggggcacaggguggccgg

SEQ ID NO: 890400 - RNA, 20 nt, Human
ggggcuggggauggggaggg

SEQ ID NO: 890401 - RNA, 22 nt, Human
ggggggugggugggcuggggag

SEQ ID NO: 890402 - RNA, 18 nt, Human
gguuuuguuuuuuguuug

SEQ ID NO: 890403 - RNA, 19 nt, Human
guugggaccaggaaggggg

SEQ ID NO: 890404 - RNA, 20 nt, Human
uacaaaaccgcacccaaagc

SEQ ID NO: 890405 - RNA, 22 nt, Human
uacaaaaccgcacccaaagcag

SEQ ID NO: 890406 - RNA, 19 nt, Human
uacaggggggugggugggc

SEQ ID NO: 890407 - RNA, 23 nt, Human
uaccagaggaaaagccacuccca

SEQ ID NO: 890408 - RNA, 21 nt, Human
uccaagggcaguuccuaugga

SEQ ID NO: 890409 - RNA, 18 nt, Human
uccccagguuacaguccu

SEQ ID NO: 890410 - RNA, 21 nt, Human
uccccgggggcuggggauggg

SEQ ID NO: 890411 - RNA, 20 nt, Human
ucccgcacucaucacuuucc

SEQ ID NO: 890412 - RNA, 21 nt, Human
ucugggaagcugcucuguugu

SEQ ID NO: 890413 - RNA, 24 nt, Human
ucuggguuccuggagaagucuggg

SEQ ID NO: 890414 - RNA, 23 nt, Human
ucuuggguaagagugaggggccc

SEQ ID NO: 890415 - RNA, 24 nt, Human
ugaaaccagcccugccccuuaccc

SEQ ID NO: 890416 - RNA, 23 nt, Human
ugagagcccccagcugaaaccag

SEQ ID NO: 890417 - RNA, 21 nt, Human
ugcuggagcaaggaggggcag

SEQ ID NO: 890418 - RNA, 21 nt, Human
uggaaagggcccggcuuuguu

SEQ ID NO: 890419 - RNA, 18 nt, Human
uggaagagaggugucaag

SEQ ID NO: 890420 - RNA, 20 nt, Human
uggcugcauguugucugcag

SEQ ID NO: 890421 - RNA, 23 nt, Human
ugggaccaggaagggggcacagg

SEQ ID NO: 890422 - RNA, 22 nt, Human
ugggcgcuggcgagccugaauc

SEQ ID NO: 890423 - RNA, 23 nt, Human
uggggugagaguccaccuccauc

SEQ ID NO: 890424 - RNA, 18 nt, Human
uggguuccuggagaaguc

SEQ ID NO: 890425 - RNA, 21 nt, Human
uggguuccuggagaagucugg

SEQ ID NO: 890426 - RNA, 21 nt, Human
uguuuguuuuuugcuuuucuc

SEQ ID NO: 890427 - RNA, 20 nt, Human
uugcuauggaagagaggugu

SEQ ID NO: 890428 - RNA, 21 nt, Human
uugcuuuucucaccccagggc

SEQ ID NO: 890429 - RNA, 22 nt, Human
uuucuggguuccuggagaaguc

SEQ ID NO: 890430 - RNA, 24 nt, Human
uuugcuuuucucaccccagggcuc

SEQ ID NO: 890431 - RNA, 20 nt, Human
uuuuguuuguuuuuugcuuu

SEQ ID NO: 890432 - RNA, 20 nt, Human
uuuuguuuuuuguuuguuuu

SEQ ID NO: 890433 - RNA, 22 nt, Human
uuuuuugcuuuucucaccccag

SEQ ID NO: 890434 - RNA, 18 nt, Human
uuuuuuuuuuuuuuuuug

SEQ ID NO: 890435 - RNA, 22 nt, Human
uuuuuuuuuuuuuuuuugcagu

SEQ ID NO: 890436 - RNA, 18 nt, Human
aaaauaaaugagacagcc

SEQ ID NO: 890437 - RNA, 20 nt, Human
aaacaaccuagcaucagaau

SEQ ID NO: 890438 - RNA, 21 nt, Human
aacacuuuucaacccaagcca

SEQ ID NO: 890439 - RNA, 21 nt, Human
aaccaguauuaguggagaaca

SEQ ID NO: 890440 - RNA, 22 nt, Human
aagaagauggcggcagcaccga

SEQ ID NO: 890441 - RNA, 23 nt, Human
aagauggcggcagcaccgagcug

SEQ ID NO: 890442 - RNA, 19 nt, Human
aagcaaagaucuccaagug

SEQ ID NO: 890443 - RNA, 22 nt, Human
aagcagauggccuugcaccaag

SEQ ID NO: 890444 - RNA, 21 nt, Human
aagcccaccaacagaccccaa

SEQ ID NO: 890445 - RNA, 21 nt, Human
aaggagacaagugcccacuga

SEQ ID NO: 890446 - RNA, 18 nt, Human
acaaaaaugaaaaaaccc

SEQ ID NO: 890447 - RNA, 20 nt, Human
acaaacauaaaagcaaggaa

SEQ ID NO: 890448 - RNA, 22 nt, Human
acaauaagccauaacauauagc

SEQ ID NO: 890449 - RNA, 20 nt, Human
acagaccagguguggcuucg

SEQ ID NO: 890450 - RNA, 18 nt, Human
acagccugcacacaaaaa

SEQ ID NO: 890451 - RNA, 20 nt, Human
acagugcacagaaaacagac

SEQ ID NO: 890452 - RNA, 23 nt, Human
acaucaaagucuuuuaaaaauua

SEQ ID NO: 890453 - RNA, 18 nt, Human
acuuuucaacccaagcca

SEQ ID NO: 890454 - RNA, 29 nt, Human
agaaaaggaagacauucaccucacaaaac

SEQ ID NO: 890455 - RNA, 24 nt, Human
agagaggcggucgcgggagggcag

SEQ ID NO: 890456 - RNA, 24 nt, Human
aggagagaggcggucgcgggaggg

SEQ ID NO: 890457 - RNA, 21 nt, Human
aggauaaccaguauuagugga

SEQ ID NO: 890458 - RNA, 25 nt, Human
aggcaucagagguucagggcaccuc

SEQ ID NO: 890459 - RNA, 21 nt, Human
aggcggucgcgggagggcagg

SEQ ID NO: 890460 - RNA, 21 nt, Human
aggcggucgcgggagggcagg

SEQ ID NO: 890461 - RNA, 23 nt, Human
aggcuucaggggcaagcccacca

SEQ ID NO: 890462 - RNA, 18 nt, Human
agugcuuuauugauaaaa

SEQ ID NO: 890463 - RNA, 19 nt, Human
aucagagguucagggcacc

SEQ ID NO: 890464 - RNA, 25 nt, Human
augagacagccugcacacaaaaaga

SEQ ID NO: 890465 - RNA, 19 nt, Human
augugguaagcagauggcc

SEQ ID NO: 890466 - RNA, 27 nt, Human
caaaacacagagugugacacagccggc

SEQ ID NO: 890467 - RNA, 20 nt, Human
caacccaagccaggcuucag

SEQ ID NO: 890468 - RNA, 24 nt, Human
caacccaagccaggcuucaggggc

SEQ ID NO: 890469 - RNA, 19 nt, Human
cacaaaaaugaaaaaaccc

SEQ ID NO: 890470 - RNA, 20 nt, Human
cacaaaaugaaugaaacgac

SEQ ID NO: 890471 - RNA, 18 nt, Human
cacagaaaacagaccagg

SEQ ID NO: 890472 - RNA, 25 nt, Human
caccaacagaccccaauuuccacag

SEQ ID NO: 890473 - RNA, 19 nt, Human
cacuagccuaugcuacaga

SEQ ID NO: 890474 - RNA, 21 nt, Human
cagaccccaauuuccacaggg

SEQ ID NO: 890475 - RNA, 22 nt, Human
ccaacugcuaauuuuccuuaaa

SEQ ID NO: 890476 - RNA, 22 nt, Human
ccacaggggaggcagaucuucu

SEQ ID NO: 890477 - RNA, 21 nt, Human
cccccacaaaaaugaaaaaac

SEQ ID NO: 890478 - RNA, 23 nt, Human
cccccacaaaaaugaaaaaaccc

SEQ ID NO: 890479 - RNA, 22 nt, Human
cccugcauagcuguuaccagga

SEQ ID NO: 890480 - RNA, 23 nt, Human
cgggaacacuuuucaacccaagc

SEQ ID NO: 890481 - RNA, 29 nt, Human
cuaaaaauaaaugagacagccugcacaca

SEQ ID NO: 890482 - RNA, 20 nt, Human
cuacacaaccauugucuccu

SEQ ID NO: 890483 - RNA, 24 nt, Human
cuacacaaccauugucuccuuuca

SEQ ID NO: 890484 - RNA, 23 nt, Human
cucuccuccuguccuccaagaag

SEQ ID NO: 890485 - RNA, 23 nt, Human
cuucuugauaugugcacaucacc

SEQ ID NO: 890486 - RNA, 22 nt, Human
gauaaaaaaggcaaccgcugga

SEQ ID NO: 890487 - RNA, 19 nt, Human
gcccccacaaaaaugaaaa

SEQ ID NO: 890488 - RNA, 20 nt, Human
gcggaccugcccacuagccu

SEQ ID NO: 890489 - RNA, 21 nt, Human
gcgggaacacuuuucaaccca

SEQ ID NO: 890490 - RNA, 18 nt, Human
ggaccugcccacuagccu

SEQ ID NO: 890491 - RNA, 20 nt, Human
gggagggcaggugguggcgg

SEQ ID NO: 890492 - RNA, 25 nt, Human
guaacuggaguggggggaaggccgu

SEQ ID NO: 890493 - RNA, 21 nt, Human
guacuguuaaaauguggaugg

SEQ ID NO: 890494 - RNA, 21 nt, Human
gugcggaccugcccacuagcc

SEQ ID NO: 890495 - RNA, 25 nt, Human
uaaaaaccaaauuaguucacuggaa

SEQ ID NO: 890496 - RNA, 21 nt, Human
uaaaauguggauggcacccuc

SEQ ID NO: 890497 - RNA, 21 nt, Human
uaaaugagacagccugcacac

SEQ ID NO: 890498 - RNA, 22 nt, Human
uaaaugagacagccugcacaca

SEQ ID NO: 890499 - RNA, 21 nt, Human
uaagcaacagugaagggcaaa

SEQ ID NO: 890500 - RNA, 24 nt, Human
uaagcagauggccuugcaccaagu

SEQ ID NO: 890501 - RNA, 19 nt, Human
uaaggagacacaagaagaa

SEQ ID NO: 890502 - RNA, 23 nt, Human
uaaguauaaagauauaucucauu

SEQ ID NO: 890503 - RNA, 21 nt, Human
uacaucacuaggcacacaccu

SEQ ID NO: 890504 - RNA, 18 nt, Human
uaccaggaggcagcgugc

SEQ ID NO: 890505 - RNA, 25 nt, Human
uacggaaaacuggagcuuaugacug

SEQ ID NO: 890506 - RNA, 21 nt, Human
uagaaggagacaagugcccac

SEQ ID NO: 890507 - RNA, 27 nt, Human
uaguucacuggaaucucauuuuguagg

SEQ ID NO: 890508 - RNA, 19 nt, Human
uauuaaaugucaaacucaa

SEQ ID NO: 890509 - RNA, 19 nt, Human
ucaaaauacauuucuauag

SEQ ID NO: 890510 - RNA, 18 nt, Human
ucaccucacaaaacacag

SEQ ID NO: 890511 - RNA, 22 nt, Human
ucacuagcaaacuuguuuuucu

SEQ ID NO: 890512 - RNA, 21 nt, Human
ucagggcaccaaggccuuagg

SEQ ID NO: 890513 - RNA, 23 nt, Human
uccaagaagauggcggcagcacc

SEQ ID NO: 890514 - RNA, 22 nt, Human
ucuauaccuacagugacagaaa

SEQ ID NO: 890515 - RNA, 19 nt, Human
ucuauuauguuuuauuugg

SEQ ID NO: 890516 - RNA, 19 nt, Human
ucuccaaguggugugaugu

SEQ ID NO: 890517 - RNA, 21 nt, Human
ucugucaauuucugggguuga

SEQ ID NO: 890518 - RNA, 22 nt, Human
ucuuuaaaacucaccucuaaaa

SEQ ID NO: 890519 - RNA, 18 nt, Human
ugccucauuuuauguuuu

SEQ ID NO: 890520 - RNA, 19 nt, Human
ugcuacagauuugaaaugu

SEQ ID NO: 890521 - RNA, 18 nt, Human
uggcggcagcaccgagcu

SEQ ID NO: 890522 - RNA, 19 nt, Human
uggcggcagcaccgagcug

SEQ ID NO: 890523 - RNA, 22 nt, Human
uggcuaaaaauaaaugagacag

SEQ ID NO: 890524 - RNA, 22 nt, Human
ugggguugaauuucccaacuuc

SEQ ID NO: 890525 - RNA, 24 nt, Human
ugugacacagcaaugaaauacaua

SEQ ID NO: 890526 - RNA, 18 nt, Human
ugugaugugguaagcaga

SEQ ID NO: 890527 - RNA, 24 nt, Human
ugugaugugguaagcagauggccg

SEQ ID NO: 890528 - RNA, 23 nt, Human
uguggauggcacccucccaagga

SEQ ID NO: 890529 - RNA, 25 nt, Human
uguggauggcacccucccaaggauu

SEQ ID NO: 890530 - RNA, 23 nt, Human
uuaaaaacaaccuagcaucagaa

SEQ ID NO: 890531 - RNA, 23 nt, Human
uuaacagauaaaaucgcagacga

SEQ ID NO: 890532 - RNA, 22 nt, Human
uuacacaaaaugaaugaaacga

SEQ ID NO: 890533 - RNA, 22 nt, Human
uucacuggaaucucauuuugua

SEQ ID NO: 890534 - RNA, 25 nt, Human
uucuacaucacuaggcacacaccuc

SEQ ID NO: 890535 - RNA, 20 nt, Human
uucuuggaaaucaauucuaa

SEQ ID NO: 890536 - RNA, 21 nt, Human
uuugaaaugucuuucacuuug

SEQ ID NO: 890537 - RNA, 21 nt, Human
uuuuucuagcccccacaaaaa

SEQ ID NO: 890538 - RNA, 24 nt, Human
acugaauccugggauccucacagu

SEQ ID NO: 890539 - RNA, 19 nt, Human
acugggcauccaggggagg

SEQ ID NO: 890540 - RNA, 18 nt, Human
agggggcaguggcuaugg

SEQ ID NO: 890541 - RNA, 24 nt, Human
cacacaggacugcaaacuaacacc

SEQ ID NO: 890542 - RNA, 20 nt, Human
cacccaguagccagcaaggc

SEQ ID NO: 890543 - RNA, 23 nt, Human
caguagccagcaaggcccucugg

SEQ ID NO: 890544 - RNA, 22 nt, Human
ccaguagccagcaaggcccucu

SEQ ID NO: 890545 - RNA, 18 nt, Human
ccgcugccgcccuccagc

SEQ ID NO: 890546 - RNA, 20 nt, Human
ccggucgccgcugccgcccu

SEQ ID NO: 890547 - RNA, 23 nt, Human
cucacagucucccaccaguagac

SEQ ID NO: 890548 - RNA, 26 nt, Human
cuccagcacucuugccugcaagggcc

SEQ ID NO: 890549 - RNA, 21 nt, Human
cugcaaacuaacacccaguag

SEQ ID NO: 890550 - RNA, 21 nt, Human
cugcuccuaccgcuccggucg

SEQ ID NO: 890551 - RNA, 20 nt, Human
gcauccaggggagggggcag

SEQ ID NO: 890552 - RNA, 19 nt, Human
gcugcacacggauaaauug

SEQ ID NO: 890553 - RNA, 22 nt, Human
gggcauccaggggagggggcag

SEQ ID NO: 890554 - RNA, 18 nt, Human
gugagaggauauaugaug

SEQ ID NO: 890555 - RNA, 23 nt, Human
uacugggcauccaggggaggggg

SEQ ID NO: 890556 - RNA, 18 nt, Human
ucuugccugcaagggcca

SEQ ID NO: 890557 - RNA, 21 nt, Human
ugacaaccagggacacaguca

SEQ ID NO: 890558 - RNA, 19 nt, Human
ugagaggauauaugaugcc

SEQ ID NO: 890559 - RNA, 26 nt, Human
ugcaaacuaacacccaguagccagca

SEQ ID NO: 890560 - RNA, 20 nt, Human
ugccucauuaugagcgacag

SEQ ID NO: 890561 - RNA, 21 nt, Human
aacaacaaaaaaaggcgagga

SEQ ID NO: 890562 - RNA, 26 nt, Human
aacagcagcgacgagccagagcggag

SEQ ID NO: 890563 - RNA, 18 nt, Human
aagcaacaacaacaacaa

SEQ ID NO: 890564 - RNA, 21 nt, Human
acaaacaucaucacggccugc

SEQ ID NO: 890565 - RNA, 23 nt, Human
accaugagaguugugcagggaac

SEQ ID NO: 890566 - RNA, 22 nt, Human
accugacuucccacugccuggc

SEQ ID NO: 890567 - RNA, 20 nt, Human
agaagcgcagccaagcaaca

SEQ ID NO: 890568 - RNA, 18 nt, Human
agagucucugaaaucaga

SEQ ID NO: 890569 - RNA, 22 nt, Human
agcaacaacaacaacaaaaaaa

SEQ ID NO: 890570 - RNA, 21 nt, Human
agcggagucgccugcagcugc

SEQ ID NO: 890571 - RNA, 19 nt, Human
aggcccuagggacccggug

SEQ ID NO: 890572 - RNA, 20 nt, Human
aggcgaggagguagacccaa

SEQ ID NO: 890573 - RNA, 21 nt, Human
agggccuguuugcaccuucag

SEQ ID NO: 890574 - RNA, 21 nt, Human
aguccuggcugggggguggcg

SEQ ID NO: 890575 - RNA, 23 nt, Human
aguugugcagggaacagccguag

SEQ ID NO: 890576 - RNA, 20 nt, Human
caaaaaaaggcgaggaggua

SEQ ID NO: 890577 - RNA, 21 nt, Human
caaaaauucagacccccagau

SEQ ID NO: 890578 - RNA, 20 nt, Human
caacaaaaaaaggcgaggaa

SEQ ID NO: 890579 - RNA, 22 nt, Human
caacaacaacaacaaaaaaagg

SEQ ID NO: 890580 - RNA, 25 nt, Human
caacaacaacaacaaaaaaaggcga

SEQ ID NO: 890581 - RNA, 27 nt, Human
caacaacaacaacaaaaaaaggcgagg

SEQ ID NO: 890582 - RNA, 21 nt, Human
caagcaacaacaacaacaaaa

SEQ ID NO: 890583 - RNA, 23 nt, Human
cacccccagcaggaaacagcagc

SEQ ID NO: 890584 - RNA, 22 nt, Human
ccagagcggagucgccugcagc

SEQ ID NO: 890585 - RNA, 20 nt, Human
cccaaaaauucagaccccca

SEQ ID NO: 890586 - RNA, 20 nt, Human
ccccgggucgccgcugucuc

SEQ ID NO: 890587 - RNA, 22 nt, Human
ccgcugucucugcgguuggggg

SEQ ID NO: 890588 - RNA, 23 nt, Human
ccgggucgccgcugucucugcgg

SEQ ID NO: 890589 - RNA, 19 nt, Human
ccugcagcugcgcgcagga

SEQ ID NO: 890590 - RNA, 18 nt, Human
ccugcucccaaaaauuca

SEQ ID NO: 890591 - RNA, 22 nt, Human
cgugcacaggugcgcgguacgc

SEQ ID NO: 890592 - RNA, 18 nt, Human
cucauaaacaaacaucau

SEQ ID NO: 890593 - RNA, 21 nt, Human
cucccaaaaauucagaccccc

SEQ ID NO: 890594 - RNA, 22 nt, Human
cuucagauauugccugcuccca

SEQ ID NO: 890595 - RNA, 18 nt, Human
gcaacaacaacaacaaaa

SEQ ID NO: 890596 - RNA, 23 nt, Human
gcaagacaauaagaaagggugag

SEQ ID NO: 890597 - RNA, 18 nt, Human
gcagaguccuggcugggg

SEQ ID NO: 890598 - RNA, 22 nt, Human
gcagccaagcaacaacaacaac

SEQ ID NO: 890599 - RNA, 23 nt, Human
gccaagcaacaacaacaacaaaa

SEQ ID NO: 890600 - RNA, 21 nt, Human
gccccgggucgccgcugucuc

SEQ ID NO: 890601 - RNA, 24 nt, Human
gcgcagccaagcaacaacaacaac

SEQ ID NO: 890602 - RNA, 21 nt, Human
ggacagggucggcacccccag

SEQ ID NO: 890603 - RNA, 27 nt, Human
ggcugggggguggcggaagaaccugau

SEQ ID NO: 890604 - RNA, 21 nt, Human
guucuguugcggagagucucu

SEQ ID NO: 890605 - RNA, 27 nt, Human
uaaacaaacaucaucacggccugcccu

SEQ ID NO: 890606 - RNA, 18 nt, Human
uacaauuaaaaccaugag

SEQ ID NO: 890607 - RNA, 18 nt, Human
ucauaaacaaacaucauc

SEQ ID NO: 890608 - RNA, 23 nt, Human
ucccaaaaauucagacccccaga

SEQ ID NO: 890609 - RNA, 19 nt, Human
ugagaguugugcagggaac

SEQ ID NO: 890610 - RNA, 20 nt, Human
ugagaugguucuguugcgga

SEQ ID NO: 890611 - RNA, 24 nt, Human
ugagggaggguggcagaguccugg

SEQ ID NO: 890612 - RNA, 18 nt, Human
ugcacaggugcgcgguac

SEQ ID NO: 890613 - RNA, 19 nt, Human
ugcgcgcaggacgugcaca

SEQ ID NO: 890614 - RNA, 21 nt, Human
ugggggguggcggaagaaccu

SEQ ID NO: 890615 - RNA, 21 nt, Human
ugugcagggaacagccguagg

SEQ ID NO: 890616 - RNA, 23 nt, Human
uuuuuuuuuucaaauguaucagu

SEQ ID NO: 890617 - RNA, 21 nt, Human
aaaaaaaaaaacccacaucau

SEQ ID NO: 890618 - RNA, 22 nt, Human
aaaaaaucuaacccuaugaaaa

SEQ ID NO: 890619 - RNA, 19 nt, Human
aaaaaucagccgagcauca

SEQ ID NO: 890620 - RNA, 22 nt, Human
aaaacaaaaacaaaacacagga

SEQ ID NO: 890621 - RNA, 21 nt, Human
aaacaaaaacaaaacacagga

SEQ ID NO: 890622 - RNA, 19 nt, Human
aaacaaaaaucagccgagc

SEQ ID NO: 890623 - RNA, 19 nt, Human
aaacaaaacacaggagcua

SEQ ID NO: 890624 - RNA, 22 nt, Human
aacauuuugggagaccaaggug

SEQ ID NO: 890625 - RNA, 24 nt, Human
aacauuuugggagaccaagguggg

SEQ ID NO: 890626 - RNA, 21 nt, Human
aagccgccucugcaacagccu

SEQ ID NO: 890627 - RNA, 20 nt, Human
aauccuguuuuccugcuuuc

SEQ ID NO: 890628 - RNA, 22 nt, Human
acaaaacaaaaacaaaacacag

SEQ ID NO: 890629 - RNA, 18 nt, Human
acaaaacacaggagcuag

SEQ ID NO: 890630 - RNA, 19 nt, Human
acaaaacacaggagcuagc

SEQ ID NO: 890631 - RNA, 27 nt, Human
acaaacaaccaaaaaaaaaaaaaaaaa

SEQ ID NO: 890632 - RNA, 26 nt, Human
acaaccaaaaaaaaaaaaaaaaaccc

SEQ ID NO: 890633 - RNA, 21 nt, Human
acagagcaagacucucucuca

SEQ ID NO: 890634 - RNA, 24 nt, Human
acagagcaagacucucucucaaaa

SEQ ID NO: 890635 - RNA, 20 nt, Human
acauccuccuuucuggacac

SEQ ID NO: 890636 - RNA, 20 nt, Human
accaaaaaaaaaaaaaaaaa

SEQ ID NO: 890637 - RNA, 23 nt, Human
accaaaguuacaaaacaaaaaca

SEQ ID NO: 890638 - RNA, 23 nt, Human
acccacacuauccucuguacccc

SEQ ID NO: 890639 - RNA, 23 nt, Human
acccagcaggaggcugaauccaa

SEQ ID NO: 890640 - RNA, 23 nt, Human
acuucgaagagucgcugaagaug

SEQ ID NO: 890641 - RNA, 21 nt, Human
agacggaggagggcccggggc

SEQ ID NO: 890642 - RNA, 19 nt, Human
agcucccugcuccaccccc

SEQ ID NO: 890643 - RNA, 21 nt, Human
agcugggcgcgguggcucaca

SEQ ID NO: 890644 - RNA, 23 nt, Human
aggaaugcuugaguuguaggagu

SEQ ID NO: 890645 - RNA, 21 nt, Human
aggccgcagaucuaccggagg

SEQ ID NO: 890646 - RNA, 18 nt, Human
aggcuuucuuuuuccuug

SEQ ID NO: 890647 - RNA, 21 nt, Human
aguuguaggaguucaaaccag

SEQ ID NO: 890648 - RNA, 21 nt, Human
auaaaaaaaaaaaaauccugu

SEQ ID NO: 890649 - RNA, 21 nt, Human
aucuaccggagggcgggcggc

SEQ ID NO: 890650 - RNA, 18 nt, Human
caaaacacaggagcuagc

SEQ ID NO: 890651 - RNA, 25 nt, Human
caacauaacuccagggagaugaaua

SEQ ID NO: 890652 - RNA, 24 nt, Human
caacauuuugggagaccaaggugg

SEQ ID NO: 890653 - RNA, 19 nt, Human
caagauaaaaaaaaaaaaa

SEQ ID NO: 890654 - RNA, 21 nt, Human
cacaccaccacacccuagcca

SEQ ID NO: 890655 - RNA, 24 nt, Human
cacacccguggucccaacauuuug

SEQ ID NO: 890656 - RNA, 19 nt, Human
cacccuagccagggagaca

SEQ ID NO: 890657 - RNA, 24 nt, Human
cagagcaagacucucucucaaaac

SEQ ID NO: 890658 - RNA, 23 nt, Human
cagcaggaggcugaauccaagca

SEQ ID NO: 890659 - RNA, 19 nt, Human
caggagcuagcugggcgcg

SEQ ID NO: 890660 - RNA, 23 nt, Human
caggcggcugagacggaggaggg

SEQ ID NO: 890661 - RNA, 19 nt, Human
cagggaagaggagggguug

SEQ ID NO: 890662 - RNA, 22 nt, Human
cagugagcuuuauuuucauguc

SEQ ID NO: 890663 - RNA, 18 nt, Human
ccacacccuagccaggga

SEQ ID NO: 890664 - RNA, 19 nt, Human
ccacacccuagccagggag

SEQ ID NO: 890665 - RNA, 22 nt, Human
ccacacuauccucuguaccccg

SEQ ID NO: 890666 - RNA, 21 nt, Human
ccacauccuccuuucuggaca

SEQ ID NO: 890667 - RNA, 21 nt, Human
ccagcaggaggcugaauccaa

SEQ ID NO: 890668 - RNA, 24 nt, Human
ccaguuggaugccugauccucuuc

SEQ ID NO: 890669 - RNA, 19 nt, Human
ccauuucccauaggcuuuc

SEQ ID NO: 890670 - RNA, 21 nt, Human
cccaacggcaagguuccauga

SEQ ID NO: 890671 - RNA, 22 nt, Human
cccacauccuccuuucuggaca

SEQ ID NO: 890672 - RNA, 25 nt, Human
ccccgccucuuggugccuguaucca

SEQ ID NO: 890673 - RNA, 21 nt, Human
cccuagccagggagacagagc

SEQ ID NO: 890674 - RNA, 22 nt, Human
cccucccuuccuguccccuccc

SEQ ID NO: 890675 - RNA, 18 nt, Human
cccucgggcccucccugc

SEQ ID NO: 890676 - RNA, 21 nt, Human
ccgggaaguuuuccccuuacc

SEQ ID NO: 890677 - RNA, 21 nt, Human
ccucaucccuggauccuccag

SEQ ID NO: 890678 - RNA, 22 nt, Human
ccucugcaacagccuugaaaga

SEQ ID NO: 890679 - RNA, 18 nt, Human
ccugaaaaucuccggaca

SEQ ID NO: 890680 - RNA, 19 nt, Human
ccuguagucccagcuacuc

SEQ ID NO: 890681 - RNA, 22 nt, Human
ccuguagucccagcuacucugg

SEQ ID NO: 890682 - RNA, 23 nt, Human
ccuguagucccagcuacucugga

SEQ ID NO: 890683 - RNA, 22 nt, Human
ccuguccccucccgacuucucc

SEQ ID NO: 890684 - RNA, 22 nt, Human
ccuugccccauugccuuccggg

SEQ ID NO: 890685 - RNA, 23 nt, Human
cggaggagggcccggggcccgcc

SEQ ID NO: 890686 - RNA, 22 nt, Human
cgugggcagcaccuccgcaggc

SEQ ID NO: 890687 - RNA, 19 nt, Human
cucaggccacucuauccuc

SEQ ID NO: 890688 - RNA, 21 nt, Human
cucaucccuggauccuccagg

SEQ ID NO: 890689 - RNA, 23 nt, Human
cuccagggaacaagauaaaaaaa

SEQ ID NO: 890690 - RNA, 22 nt, Human
cucccugcuccacccccgccuc

SEQ ID NO: 890691 - RNA, 19 nt, Human
cuccggguggguggcacgu

SEQ ID NO: 890692 - RNA, 23 nt, Human
cucuacacaccaccgggcacccc

SEQ ID NO: 890693 - RNA, 18 nt, Human
cucucaaaacaaacaacc

SEQ ID NO: 890694 - RNA, 19 nt, Human
cucugccucggggugcggg

SEQ ID NO: 890695 - RNA, 20 nt, Human
cugacccacacuauccucug

SEQ ID NO: 890696 - RNA, 19 nt, Human
cuggcaccucugacccaca

SEQ ID NO: 890697 - RNA, 21 nt, Human
gagguggggggucuaagacca

SEQ ID NO: 890698 - RNA, 22 nt, Human
gcaacagccuugaaagaugaga

SEQ ID NO: 890699 - RNA, 20 nt, Human
gccaagaucacaccaccaca

SEQ ID NO: 890700 - RNA, 21 nt, Human
gcgcagcucccugcuccaccc

SEQ ID NO: 890701 - RNA, 19 nt, Human
ggagauggacaggugggaa

SEQ ID NO: 890702 - RNA, 18 nt, Human
ggagggcccggggcccgc

SEQ ID NO: 890703 - RNA, 23 nt, Human
ggaguuucuccacagcccuugau

SEQ ID NO: 890704 - RNA, 22 nt, Human
ggcaaggcugccgugagccaag

SEQ ID NO: 890705 - RNA, 20 nt, Human
ggcccggggcccgcccuccc

SEQ ID NO: 890706 - RNA, 18 nt, Human
ggccgcagaucuaccgga

SEQ ID NO: 890707 - RNA, 21 nt, Human
ggcgcgguggcucacacccgu

SEQ ID NO: 890708 - RNA, 19 nt, Human
gggcccucccugcccgggg

SEQ ID NO: 890709 - RNA, 27 nt, Human
gggccuccaggcgugggcagcaccucc

SEQ ID NO: 890710 - RNA, 19 nt, Human
ggucccaacauuuugggag

SEQ ID NO: 890711 - RNA, 22 nt, Human
gucccaacauuuugggagacca

SEQ ID NO: 890712 - RNA, 21 nt, Human
uaaaaaaaaucuaacccuaug

SEQ ID NO: 890713 - RNA, 24 nt, Human
uaaaaaguaaacaaaaaucagccg

SEQ ID NO: 890714 - RNA, 24 nt, Human
uaaacaaaaaucagccgagcauca

SEQ ID NO: 890715 - RNA, 22 nt, Human
uaacagugagcuuuauuuucau

SEQ ID NO: 890716 - RNA, 23 nt, Human
uacaaaacaaaaacaaaacacag

SEQ ID NO: 890717 - RNA, 25 nt, Human
uauggcaagaccccaucucucuaaa

SEQ ID NO: 890718 - RNA, 21 nt, Human
ucagccgagcaucauaucaca

SEQ ID NO: 890719 - RNA, 23 nt, Human
uccagcagaaggacccagcagga

SEQ ID NO: 890720 - RNA, 18 nt, Human
ucccugcuccacccccgc

SEQ ID NO: 890721 - RNA, 19 nt, Human
ucccugcuccacccccgcc

SEQ ID NO: 890722 - RNA, 20 nt, Human
ucuaaaaaguaaacaaaaau

SEQ ID NO: 890723 - RNA, 22 nt, Human
ucuacacaccaccgggcacccc

SEQ ID NO: 890724 - RNA, 27 nt, Human
ucucucuaaaaaguaaacaaaaauugg

SEQ ID NO: 890725 - RNA, 27 nt, Human
ucugacccacacuauccucuguacccc

SEQ ID NO: 890726 - RNA, 19 nt, Human
ugaaagaugagacgcggaa

SEQ ID NO: 890727 - RNA, 22 nt, Human
ugaaaugcaccaaguccugaaa

SEQ ID NO: 890728 - RNA, 23 nt, Human
ugagaugaagacugcuugagcca

SEQ ID NO: 890729 - RNA, 21 nt, Human
ugagccaagaucacaccacca

SEQ ID NO: 890730 - RNA, 24 nt, Human
ugccuguagucccagcuacucugg

SEQ ID NO: 890731 - RNA, 23 nt, Human
uggcacgucggcccgacccagca

SEQ ID NO: 890732 - RNA, 18 nt, Human
ugggagaccaagguggga

SEQ ID NO: 890733 - RNA, 20 nt, Human
ugucuccgccguucucuucc

SEQ ID NO: 890734 - RNA, 24 nt, Human
uuaacugaacuagaaaaggauaaa

SEQ ID NO: 890735 - RNA, 21 nt, Human
uuacaaaacaaaaacaaaaca

SEQ ID NO: 890736 - RNA, 23 nt, Human
uucaacaaaucaacagucaccaa

SEQ ID NO: 890737 - RNA, 20 nt, Human
uuucccaucuuucacgaugg

SEQ ID NO: 890738 - RNA, 19 nt, Human
aaaacaaguacuagacaga

SEQ ID NO: 890739 - RNA, 19 nt, Human
aacagaaagaaguucaaca

SEQ ID NO: 890740 - RNA, 23 nt, Human
aacagaaagaaguucaacaggcc

SEQ ID NO: 890741 - RNA, 20 nt, Human
aacaggcaaacauuucccuc

SEQ ID NO: 890742 - RNA, 23 nt, Human
aacauacugauagugcugcaaga

SEQ ID NO: 890743 - RNA, 24 nt, Human
aaccauggaauucaaugaacaaaa

SEQ ID NO: 890744 - RNA, 26 nt, Human
aagucaguguuaaauccacagacuaa

SEQ ID NO: 890745 - RNA, 19 nt, Human
aaguccaucuuaaaucuga

SEQ ID NO: 890746 - RNA, 18 nt, Human
aaguucaacaggcaaaca

SEQ ID NO: 890747 - RNA, 23 nt, Human
acugucacagugucaaaauaaaa

SEQ ID NO: 890748 - RNA, 23 nt, Human
agaaaaaagaucaugcuuaaaga

SEQ ID NO: 890749 - RNA, 24 nt, Human
agacagaaaaaagaucaugcuuaa

SEQ ID NO: 890750 - RNA, 20 nt, Human
auaagccaaauucaaaugcu

SEQ ID NO: 890751 - RNA, 18 nt, Human
aucaugcuuaaagacucc

SEQ ID NO: 890752 - RNA, 25 nt, Human
auuguccuugaagcuuauguaugga

SEQ ID NO: 890753 - RNA, 24 nt, Human
cagaaugaaaacaaguacuagaca

SEQ ID NO: 890754 - RNA, 23 nt, Human
cagguucugggucaauguuuccu

SEQ ID NO: 890755 - RNA, 20 nt, Human
cauaguaaaucuucaaaacc

SEQ ID NO: 890756 - RNA, 19 nt, Human
cccuaggauccuaguuacc

SEQ ID NO: 890757 - RNA, 21 nt, Human
ccucucauaacagaaagaagu

SEQ ID NO: 890758 - RNA, 21 nt, Human
cuaagucaguguuaaauccac

SEQ ID NO: 890759 - RNA, 22 nt, Human
cucccuaggauccuaguuacca

SEQ ID NO: 890760 - RNA, 24 nt, Human
cuccuuuuuaacaucuuauugucc

SEQ ID NO: 890761 - RNA, 22 nt, Human
gaaaaaagaucaugcuuaaaga

SEQ ID NO: 890762 - RNA, 18 nt, Human
gaacaucuggacuguaga

SEQ ID NO: 890763 - RNA, 22 nt, Human
gcugaaacucaaaguuacccua

SEQ ID NO: 890764 - RNA, 19 nt, Human
gcuggccagaaugaaaaca

SEQ ID NO: 890765 - RNA, 22 nt, Human
guaaaucuucaaaaccauuaag

SEQ ID NO: 890766 - RNA, 22 nt, Human
uaaauaauugcuguauuuccca

SEQ ID NO: 890767 - RNA, 25 nt, Human
uaauugcuguauuucccacugaagc

SEQ ID NO: 890768 - RNA, 22 nt, Human
uacauauuaugccaaccagccu

SEQ ID NO: 890769 - RNA, 22 nt, Human
uaucauaaaauaaacacacaua

SEQ ID NO: 890770 - RNA, 21 nt, Human
uauggaggaaguuaaaaacca

SEQ ID NO: 890771 - RNA, 19 nt, Human
uauuagaaauaauauacau

SEQ ID NO: 890772 - RNA, 20 nt, Human
uauuagaaauaauauacaua

SEQ ID NO: 890773 - RNA, 22 nt, Human
ucaacaucuuaaugaccuaacu

SEQ ID NO: 890774 - RNA, 21 nt, Human
uccuuaaagagaaauaaaggc

SEQ ID NO: 890775 - RNA, 21 nt, Human
ugaaaaaccacagacaggucc

SEQ ID NO: 890776 - RNA, 23 nt, Human
ugagaauauaaacuuuaaggcua

SEQ ID NO: 890777 - RNA, 26 nt, Human
ugcaauaagaaaguccaucuuaaauc

SEQ ID NO: 890778 - RNA, 22 nt, Human
uguaaacagagcccuugacaag

SEQ ID NO: 890779 - RNA, 22 nt, Human
ugugaucaacaucuuaaugacc

SEQ ID NO: 890780 - RNA, 30 nt, Human
uuagaaauaauauacauaauaaauucaacc

SEQ ID NO: 890781 - RNA, 21 nt, Human
uugcauaguaaaucuucaaaa

SEQ ID NO: 890782 - RNA, 22 nt, Human
uuugcugaaacucaaaguuacc

SEQ ID NO: 890783 - RNA, 24 nt, Human
aaagaagccaguacuucugaugag

SEQ ID NO: 890784 - RNA, 23 nt, Human
aagagcacacggcuucuccccgg

SEQ ID NO: 890785 - RNA, 19 nt, Human
aagucgagaaacuccaaaa

SEQ ID NO: 890786 - RNA, 22 nt, Human
acugagcucuguccuccagcug

SEQ ID NO: 890787 - RNA, 20 nt, Human
agaagucgagaaacuccaaa

SEQ ID NO: 890788 - RNA, 19 nt, Human
aggaauugaaagucaagau

SEQ ID NO: 890789 - RNA, 26 nt, Human
aggaauugaaagucaagaugggagcu

SEQ ID NO: 890790 - RNA, 19 nt, Human
aggcagucaggcacugagc

SEQ ID NO: 890791 - RNA, 19 nt, Human
aggcaugucuggcuucugg

SEQ ID NO: 890792 - RNA, 21 nt, Human
auggaagggcaaaaguggacc

SEQ ID NO: 890793 - RNA, 23 nt, Human
caaaaacaggucagcuaagacag

SEQ ID NO: 890794 - RNA, 21 nt, Human
caagggagccaaacuugaucu

SEQ ID NO: 890795 - RNA, 22 nt, Human
caugagacccuaggcagucagg

SEQ ID NO: 890796 - RNA, 21 nt, Human
ccaagcauaggcagccaugcu

SEQ ID NO: 890797 - RNA, 26 nt, Human
ccuacaguccaugagacccuaggcag

SEQ ID NO: 890798 - RNA, 21 nt, Human
ccugcuggaagcccugagggc

SEQ ID NO: 890799 - RNA, 18 nt, Human
cgagaaacuccaaaaucu

SEQ ID NO: 890800 - RNA, 18 nt, Human
cgcacaugagagaaaugc

SEQ ID NO: 890801 - RNA, 23 nt, Human
gaaaauaaugaagagcacacggc

SEQ ID NO: 890802 - RNA, 18 nt, Human
gagaaacuccaaaaucuc

SEQ ID NO: 890803 - RNA, 24 nt, Human
gagcucugcuuuugucguccggga

SEQ ID NO: 890804 - RNA, 22 nt, Human
gaggaauugaaagucaagaugg

SEQ ID NO: 890805 - RNA, 18 nt, Human
gcuucugggcuguagcuc

SEQ ID NO: 890806 - RNA, 20 nt, Human
uaggcuagaguccagugacc

SEQ ID NO: 890807 - RNA, 19 nt, Human
ugaggaauugaaagucaag

SEQ ID NO: 890808 - RNA, 19 nt, Human
ugcuggaagcccugagggc

SEQ ID NO: 890809 - RNA, 22 nt, Human
uggaagcccugagggcgcacau

SEQ ID NO: 890810 - RNA, 19 nt, Human
uguagcucagcauguugua

SEQ ID NO: 890811 - RNA, 22 nt, Human
uguaugaaauacacacauaucu

SEQ ID NO: 890812 - RNA, 21 nt, Human
ugucuggcuucugggcuguag

SEQ ID NO: 890813 - RNA, 21 nt, Human
uguguaugaaauacacacaua

SEQ ID NO: 890814 - RNA, 26 nt, Human
uguguguaugaaauacacacauaucu

SEQ ID NO: 890815 - RNA, 25 nt, Human
uguguguguaugaaauacacacaua

SEQ ID NO: 890816 - RNA, 23 nt, Human
uucugggcuguagcucagcaugu

SEQ ID NO: 890817 - RNA, 24 nt, Human
uuuggauuuuuaauccagguccuu

SEQ ID NO: 890818 - RNA, 20 nt, Human
uuuuuuuuuuuuucacuuuu

SEQ ID NO: 890819 - RNA, 23 nt, Human
uuuuuuuuuuuuuuuucacuuuu

SEQ ID NO: 890820 - RNA, 26 nt, Human
uuuuuuuuuuuuuuuucacuuuuugg

SEQ ID NO: 890821 - RNA, 19 nt, Human
aaacagacgugggaagaaa

SEQ ID NO: 890822 - RNA, 21 nt, Human
acgcaggaaagggucccaggg

SEQ ID NO: 890823 - RNA, 18 nt, Human
aggaaagggauuaccugg

SEQ ID NO: 890824 - RNA, 24 nt, Human
aggaaggaagacauucccuuauau

SEQ ID NO: 890825 - RNA, 23 nt, Human
aggaaggagacacauacgcagga

SEQ ID NO: 890826 - RNA, 20 nt, Human
aggcuugggggcugaggcau

SEQ ID NO: 890827 - RNA, 23 nt, Human
auagacgggaaaaaggaaaggga

SEQ ID NO: 890828 - RNA, 20 nt, Human
caccacaggcccacccacca

SEQ ID NO: 890829 - RNA, 22 nt, Human
ccacccaccaaggguguccagg

SEQ ID NO: 890830 - RNA, 19 nt, Human
cccggaacuccgggagcgg

SEQ ID NO: 890831 - RNA, 20 nt, Human
cccggaacuccgggagcggg

SEQ ID NO: 890832 - RNA, 21 nt, Human
ccugcccugcuagggccugua

SEQ ID NO: 890833 - RNA, 18 nt, Human
cuggagggcaauuccuuu

SEQ ID NO: 890834 - RNA, 19 nt, Human
gcaggaaagggucccaggg

SEQ ID NO: 890835 - RNA, 21 nt, Human
gccauuccauucccaggugac

SEQ ID NO: 890836 - RNA, 18 nt, Human
gggauggccgcgcucacc

SEQ ID NO: 890837 - RNA, 18 nt, Human
ggggaagauuccacacag

SEQ ID NO: 890838 - RNA, 19 nt, Human
gguauaggagggaagaagg

SEQ ID NO: 890839 - RNA, 19 nt, Human
ggugacaggaaggagacac

SEQ ID NO: 890840 - RNA, 19 nt, Human
uacagguggguauaggagg

SEQ ID NO: 890841 - RNA, 19 nt, Human
uagacgggaaaaaggaaag

SEQ ID NO: 890842 - RNA, 26 nt, Human
uagcagaaacagacgugggaagaaga

SEQ ID NO: 890843 - RNA, 18 nt, Human
uaggagggaagaaggaaa

SEQ ID NO: 890844 - RNA, 25 nt, Human
uaggcuugggggcugaggcauguau

SEQ ID NO: 890845 - RNA, 20 nt, Human
uauuuggaagaagagcagau

SEQ ID NO: 890846 - RNA, 21 nt, Human
ugacaggaaggagacacauac

SEQ ID NO: 890847 - RNA, 26 nt, Human
ugcagagggaaaaugcuucugggauu

SEQ ID NO: 890848 - RNA, 21 nt, Human
uggaagaagagcagauuucac

SEQ ID NO: 890849 - RNA, 22 nt, Human
ugggaagaaacgucauuuugca

SEQ ID NO: 890850 - RNA, 22 nt, Human
uggguauaggagggaagaagga

SEQ ID NO: 890851 - RNA, 22 nt, Human
uguauuguacuggcacagucca

SEQ ID NO: 890852 - RNA, 22 nt, Human
uugggggcugaggcauguauug

SEQ ID NO: 890853 - RNA, 23 nt, Human
aaaaacaauaugaagacgauugc

SEQ ID NO: 890854 - RNA, 22 nt, Human
aaaaacacagaaggaaaaccua

SEQ ID NO: 890855 - RNA, 21 nt, Human
aaacacagaaggaaaaccuag

SEQ ID NO: 890856 - RNA, 22 nt, Human
aaacaguuacaaagacauucuc

SEQ ID NO: 890857 - RNA, 18 nt, Human
aaacaucuaguauugcua

SEQ ID NO: 890858 - RNA, 24 nt, Human
aaagguaaguacagggaaaggucc

SEQ ID NO: 890859 - RNA, 21 nt, Human
acaaaauaauaaacaaaucaa

SEQ ID NO: 890860 - RNA, 20 nt, Human
acacagaaggaaaaccuaga

SEQ ID NO: 890861 - RNA, 18 nt, Human
acagggaaagguccuuuc

SEQ ID NO: 890862 - RNA, 21 nt, Human
acucucagcaaucuuuucuaa

SEQ ID NO: 890863 - RNA, 21 nt, Human
acuucugggcugagagggauu

SEQ ID NO: 890864 - RNA, 21 nt, Human
aggcauuucagugucuaaaaa

SEQ ID NO: 890865 - RNA, 22 nt, Human
agggagccagcuuccccaaaaa

SEQ ID NO: 890866 - RNA, 22 nt, Human
cacgcuggggcaccuuaggaac

SEQ ID NO: 890867 - RNA, 19 nt, Human
cagaaggaaaaccuagaaa

SEQ ID NO: 890868 - RNA, 20 nt, Human
cuagaggagcagguguggug

SEQ ID NO: 890869 - RNA, 23 nt, Human
gacuccauuuuuagcugaaauga

SEQ ID NO: 890870 - RNA, 19 nt, Human
gaugccucgugucucuaga

SEQ ID NO: 890871 - RNA, 18 nt, Human
ggaaaaccuagaaauaaa

SEQ ID NO: 890872 - RNA, 18 nt, Human
ggaaagguccuuucagaa

SEQ ID NO: 890873 - RNA, 19 nt, Human
ggaacugguuguguuugug

SEQ ID NO: 890874 - RNA, 23 nt, Human
ggagcacguggugucugcuuggg

SEQ ID NO: 890875 - RNA, 19 nt, Human
gggcugagagggauuuuag

SEQ ID NO: 890876 - RNA, 19 nt, Human
uaaaaacacagaaggaaaa

SEQ ID NO: 890877 - RNA, 18 nt, Human
uaaaagggaugccucgug

SEQ ID NO: 890878 - RNA, 20 nt, Human
uaaaaugguaggcaaucuca

SEQ ID NO: 890879 - RNA, 21 nt, Human
uaaaaugguaggcaaucucau

SEQ ID NO: 890880 - RNA, 20 nt, Human
uaaaugugaaaauucggacc

SEQ ID NO: 890881 - RNA, 21 nt, Human
uagcugaaaugaaauuuacug

SEQ ID NO: 890882 - RNA, 22 nt, Human
uagggagccagcuuccccaaaa

SEQ ID NO: 890883 - RNA, 24 nt, Human
uaucucaaaacaucauuacaacag

SEQ ID NO: 890884 - RNA, 25 nt, Human
ucuaauaauaaacaucuaguauugc

SEQ ID NO: 890885 - RNA, 21 nt, Human
ucucaucgugcauuaucuuuu

SEQ ID NO: 890886 - RNA, 22 nt, Human
ucucuagaggagcagguguggu

SEQ ID NO: 890887 - RNA, 21 nt, Human
ugaaaaauacaaaauguagcg

SEQ ID NO: 890888 - RNA, 24 nt, Human
ugaaacagaagguaacuuugugca

SEQ ID NO: 890889 - RNA, 21 nt, Human
ugacaaagcauauucagauau

SEQ ID NO: 890890 - RNA, 23 nt, Human
ugcugaagauaauuugauccaau

SEQ ID NO: 890891 - RNA, 26 nt, Human
ugcuugggagcagguuuggugugugu

SEQ ID NO: 890892 - RNA, 21 nt, Human
ugggcugagagggauuuuagg

SEQ ID NO: 890893 - RNA, 23 nt, Human
ugguggguaaaaauguaucuuuu

SEQ ID NO: 890894 - RNA, 21 nt, Human
ugguguaugacacuucuggac

SEQ ID NO: 890895 - RNA, 24 nt, Human
uguugcuaaaaaauugaaguuuaa

SEQ ID NO: 890896 - RNA, 18 nt, Human
uugcaguaacacgcuggg

SEQ ID NO: 890897 - RNA, 23 nt, Human
uuggugugugucacuucugggcu

SEQ ID NO: 890898 - RNA, 20 nt, Human
uuguguuugugggauucuug

SEQ ID NO: 890899 - RNA, 20 nt, Human
uuucuuaaaaugacuuugua

SEQ ID NO: 890900 - RNA, 19 nt, Human
aaaacaaagaaucucuaaa

SEQ ID NO: 890901 - RNA, 25 nt, Human
aaagaccagacuacauucugaauaa

SEQ ID NO: 890902 - RNA, 21 nt, Human
aaauacaguaaaaugcacuuu

SEQ ID NO: 890903 - RNA, 25 nt, Human
aaccaugcugccucaaaacauaacu

SEQ ID NO: 890904 - RNA, 22 nt, Human
aagaaucucuaaauugucacau

SEQ ID NO: 890905 - RNA, 19 nt, Human
aaguccuuucugaaucaac

SEQ ID NO: 890906 - RNA, 20 nt, Human
agaagccccauccuuucacc

SEQ ID NO: 890907 - RNA, 24 nt, Human
agaagccccauccuuucaccacau

SEQ ID NO: 890908 - RNA, 25 nt, Human
agccccauccuuucaccacauccua

SEQ ID NO: 890909 - RNA, 24 nt, Human
aguggguaugacaucugucuucag

SEQ ID NO: 890910 - RNA, 22 nt, Human
auacaaaaaaucccugaucagc

SEQ ID NO: 890911 - RNA, 20 nt, Human
caaaacauaacuguguucag

SEQ ID NO: 890912 - RNA, 20 nt, Human
caaaauacaguaaaaugcag

SEQ ID NO: 890913 - RNA, 22 nt, Human
cagaagaauagaucgcugagua

SEQ ID NO: 890914 - RNA, 23 nt, Human
caggaaaggcuaaaaauaaugau

SEQ ID NO: 890915 - RNA, 24 nt, Human
ccauccucauuuuaaagcauagaa

SEQ ID NO: 890916 - RNA, 22 nt, Human
ccccauccuuucaccacauccu

SEQ ID NO: 890917 - RNA, 21 nt, Human
cggaaaugcuaaucaaaccau

SEQ ID NO: 890918 - RNA, 19 nt, Human
cuuucugaaucaacuaagu

SEQ ID NO: 890919 - RNA, 24 nt, Human
gagaaaaagaacacuauuuucugu

SEQ ID NO: 890920 - RNA, 23 nt, Human
uaaaaaguguuuagugucaaaaa

SEQ ID NO: 890921 - RNA, 23 nt, Human
uaaaacaaagaaucucuaaauug

SEQ ID NO: 890922 - RNA, 18 nt, Human
uaaaacaaguuugugguu

SEQ ID NO: 890923 - RNA, 18 nt, Human
uaaaaugcacuuuuccca

SEQ ID NO: 890924 - RNA, 26 nt, Human
uaagggcaucaauuauuguccaggug

SEQ ID NO: 890925 - RNA, 23 nt, Human
uaaguuaugugcaaauuuucuua

SEQ ID NO: 890926 - RNA, 18 nt, Human
uacacaggcuacacagug

SEQ ID NO: 890927 - RNA, 20 nt, Human
uacacaggcuacacaguggg

SEQ ID NO: 890928 - RNA, 25 nt, Human
uacuuuauauacuaguugguagaag

SEQ ID NO: 890929 - RNA, 22 nt, Human
uagaauaguauaugcuuaggug

SEQ ID NO: 890930 - RNA, 24 nt, Human
uagcuugcucuuuuaagugguaau

SEQ ID NO: 890931 - RNA, 21 nt, Human
uauacagauuuaacacagacu

SEQ ID NO: 890932 - RNA, 20 nt, Human
uaucagaacugaaaucgacu

SEQ ID NO: 890933 - RNA, 24 nt, Human
uauggcaacauuuuuauuucuaca

SEQ ID NO: 890934 - RNA, 27 nt, Human
ucaaccuuuacuauggcuccaguccca

SEQ ID NO: 890935 - RNA, 21 nt, Human
ucaccacauccuacucccaag

SEQ ID NO: 890936 - RNA, 19 nt, Human
ucagugaaauaaaacaaag

SEQ ID NO: 890937 - RNA, 23 nt, Human
ugagaaauaaacaaaauacacaa

SEQ ID NO: 890938 - RNA, 26 nt, Human
uggagaaaaagaacacuauuuucugu

SEQ ID NO: 890939 - RNA, 18 nt, Human
ugucaaaaagagucuuca

SEQ ID NO: 890940 - RNA, 19 nt, Human
uuaguacuuuauauacuag

SEQ ID NO: 890941 - RNA, 22 nt, Human
uugcauggaugcggaaaugcua

SEQ ID NO: 890942 - RNA, 23 nt, Human
uuucugaaucaacuaaguuaugu

SEQ ID NO: 890943 - RNA, 28 nt, Human
uuugugguuuucuucugugacauuucuu

SEQ ID NO: 890944 - RNA, 19 nt, Human
uuuuccuuuucauaauggu

SEQ ID NO: 890945 - RNA, 21 nt, Human
aaacaaaagaagguuccagga

SEQ ID NO: 890946 - RNA, 19 nt, Human
aagcccaucagugccgggg

SEQ ID NO: 890947 - RNA, 23 nt, Human
acuccacccacugagaaguccga

SEQ ID NO: 890948 - RNA, 21 nt, Human
agaagcccaucagugccgggg

SEQ ID NO: 890949 - RNA, 18 nt, Human
aggcaggguagguggggu

SEQ ID NO: 890950 - RNA, 23 nt, Human
aggcugaggcaggguaggugggg

SEQ ID NO: 890951 - RNA, 24 nt, Human
aggcugaggcaggguagguggggu

SEQ ID NO: 890952 - RNA, 20 nt, Human
aggggucauaucuggagagc

SEQ ID NO: 890953 - RNA, 19 nt, Human
aggugggguagggcaggcu

SEQ ID NO: 890954 - RNA, 28 nt, Human
aggugggguagggcaggcuguggggggu

SEQ ID NO: 890955 - RNA, 21 nt, Human
agugccggggguuccuccgga

SEQ ID NO: 890956 - RNA, 22 nt, Human
cacccugucgucuuuggcaaau

SEQ ID NO: 890957 - RNA, 19 nt, Human
cagcagggcggggugggca

SEQ ID NO: 890958 - RNA, 20 nt, Human
cagcagggcggggugggcac

SEQ ID NO: 890959 - RNA, 20 nt, Human
ccacccugucgucuuuggca

SEQ ID NO: 890960 - RNA, 20 nt, Human
cccgccccgccaggugcccc

SEQ ID NO: 890961 - RNA, 23 nt, Human
ccucccuggcacuccacccaacc

SEQ ID NO: 890962 - RNA, 22 nt, Human
ccucccuggcacuccacccacu

SEQ ID NO: 890963 - RNA, 22 nt, Human
ccuccggagcgcaccccagccc

SEQ ID NO: 890964 - RNA, 21 nt, Human
ccuccuccucccuggcacucc

SEQ ID NO: 890965 - RNA, 23 nt, Human
ccuggaaacaccuuggcugcuga

SEQ ID NO: 890966 - RNA, 22 nt, Human
cgccaggugccccaugguggcc

SEQ ID NO: 890967 - RNA, 23 nt, Human
cgcgcccgcaggaccuggggguc

SEQ ID NO: 890968 - RNA, 18 nt, Human
cucaauccucuucccucc

SEQ ID NO: 890969 - RNA, 20 nt, Human
cucaauccucuucccuccac

SEQ ID NO: 890970 - RNA, 21 nt, Human
cuccuccucccuggcacucca

SEQ ID NO: 890971 - RNA, 18 nt, Human
cucucugaacuuccugga

SEQ ID NO: 890972 - RNA, 24 nt, Human
cugacaaacaaaagaagguuccag

SEQ ID NO: 890973 - RNA, 21 nt, Human
cuguggggggugggugcaggg

SEQ ID NO: 890974 - RNA, 20 nt, Human
cuguucucucugaacuuccu

SEQ ID NO: 890975 - RNA, 20 nt, Human
gagagcgcaggcaggugaca

SEQ ID NO: 890976 - RNA, 22 nt, Human
gcaggcuguggggggugggugc

SEQ ID NO: 890977 - RNA, 19 nt, Human
gccccgagccccaggucuc

SEQ ID NO: 890978 - RNA, 21 nt, Human
gccccgagccccaggucuccg

SEQ ID NO: 890979 - RNA, 20 nt, Human
gcucaauccucuucccucca

SEQ ID NO: 890980 - RNA, 19 nt, Human
ggaaacaccuuggcugcug

SEQ ID NO: 890981 - RNA, 20 nt, Human
ggacaaagugucagugugag

SEQ ID NO: 890982 - RNA, 22 nt, Human
ggcagcagggcggggugggcac

SEQ ID NO: 890983 - RNA, 22 nt, Human
ggcaggggcagaagcccaucag

SEQ ID NO: 890984 - RNA, 21 nt, Human
gggcagaagcccaucagugcc

SEQ ID NO: 890985 - RNA, 22 nt, Human
gggcagcagggcggggugggca

SEQ ID NO: 890986 - RNA, 26 nt, Human
gggggugggugcaggggucauaucug

SEQ ID NO: 890987 - RNA, 20 nt, Human
gggguagggcaggcuguggg

SEQ ID NO: 890988 - RNA, 26 nt, Human
gggugggugcaggggucauaucugga

SEQ ID NO: 890989 - RNA, 19 nt, Human
gguagggcaggcugugggg

SEQ ID NO: 890990 - RNA, 19 nt, Human
gguaucuccacggggcggg

SEQ ID NO: 890991 - RNA, 21 nt, Human
ggucauaucuggagagcgcag

SEQ ID NO: 890992 - RNA, 24 nt, Human
ggugcaggggucauaucuggagag

SEQ ID NO: 890993 - RNA, 25 nt, Human
ggugggugcaggggucauaucugga

SEQ ID NO: 890994 - RNA, 21 nt, Human
gucgucuuuggcaaauacgca

SEQ ID NO: 890995 - RNA, 19 nt, Human
uaggugggguagggcaggc

SEQ ID NO: 890996 - RNA, 21 nt, Human
uccacagggcagcagggcggg

SEQ ID NO: 890997 - RNA, 19 nt, Human
ucccuggcacuccacccac

SEQ ID NO: 890998 - RNA, 20 nt, Human
uccucccuggcacuccaccc

SEQ ID NO: 890999 - RNA, 18 nt, Human
ugaacuuccuggaaacac

SEQ ID NO: 891000 - RNA, 19 nt, Human
ugacacaaagcucaauccu

SEQ ID NO: 891001 - RNA, 22 nt, Human
ugagaaguccgaggcugaggca

SEQ ID NO: 891002 - RNA, 21 nt, Human
ugcaggaauccaggggccccg

SEQ ID NO: 891003 - RNA, 18 nt, Human
uggaaacaccuuggcugc

SEQ ID NO: 891004 - RNA, 18 nt, Human
uggcaaauacgcauaugc

SEQ ID NO: 891005 - RNA, 19 nt, Human
uggggggugggugcagggg

SEQ ID NO: 891006 - RNA, 24 nt, Human
ugugccuccuccucccuggcacuc

SEQ ID NO: 891007 - RNA, 21 nt, Human
uguggggggugggugcagggg

SEQ ID NO: 891008 - RNA, 20 nt, Human
uuccgcgcccgcaggaccug

SEQ ID NO: 891009 - RNA, 18 nt, Human
uugcccagaggccggcag

SEQ ID NO: 891010 - RNA, 25 nt, Human
uuuggcaaauacgcauaugcagaug

SEQ ID NO: 891011 - RNA, 18 nt, Human
uuuuuuuuuuuuuaaccc

SEQ ID NO: 891012 - RNA, 25 nt, Human
aaaacucguuccauucugaggcacc

SEQ ID NO: 891013 - RNA, 24 nt, Human
aaaauuaaaccacaauuuccuaag

SEQ ID NO: 891014 - RNA, 19 nt, Human
aaacaugcauacacaaaga

SEQ ID NO: 891015 - RNA, 23 nt, Human
aaacauguagagaaacauagagu

SEQ ID NO: 891016 - RNA, 22 nt, Human
aaagaaaaaaacauguagagaa

SEQ ID NO: 891017 - RNA, 21 nt, Human
aaagaccaaaaaaaauuggga

SEQ ID NO: 891018 - RNA, 22 nt, Human
acacaucuuuccuaaaaagacc

SEQ ID NO: 891019 - RNA, 20 nt, Human
acagcacagugcuacauaua

SEQ ID NO: 891020 - RNA, 22 nt, Human
accacaauuuccuaagacauaa

SEQ ID NO: 891021 - RNA, 24 nt, Human
accacaauuuccuaagacauaacu

SEQ ID NO: 891022 - RNA, 20 nt, Human
agcaacggaaagaaaaaaac

SEQ ID NO: 891023 - RNA, 28 nt, Human
auacuuucugauuuuaauaaauuuccac

SEQ ID NO: 891024 - RNA, 22 nt, Human
auauaauuccacuaucaauaag

SEQ ID NO: 891025 - RNA, 22 nt, Human
caacacagugguaccauacaaa

SEQ ID NO: 891026 - RNA, 25 nt, Human
cacagugcuacauauaauuauacca

SEQ ID NO: 891027 - RNA, 22 nt, Human
caccauauaaccaacacagugg

SEQ ID NO: 891028 - RNA, 24 nt, Human
caccauauaaccaacacaguggua

SEQ ID NO: 891029 - RNA, 20 nt, Human
caccgagcuucagagaccac

SEQ ID NO: 891030 - RNA, 18 nt, Human
cccuuaacauaacaggau

SEQ ID NO: 891031 - RNA, 18 nt, Human
ccuugccuuuggggccug

SEQ ID NO: 891032 - RNA, 24 nt, Human
cgaucaauucuuccauuacuuucu

SEQ ID NO: 891033 - RNA, 22 nt, Human
gccggggccuggggcugcagug

SEQ ID NO: 891034 - RNA, 19 nt, Human
ggccggggccuggggcugc

SEQ ID NO: 891035 - RNA, 20 nt, Human
ggccggggccuggggcugca

SEQ ID NO: 891036 - RNA, 21 nt, Human
ggccggggccuggggcugcag

SEQ ID NO: 891037 - RNA, 19 nt, Human
gggcagcaacgcagacgug

SEQ ID NO: 891038 - RNA, 24 nt, Human
gggcagcaacgcagacguggguga

SEQ ID NO: 891039 - RNA, 25 nt, Human
gggcagcaacgcagacguggguggg

SEQ ID NO: 891040 - RNA, 21 nt, Human
ggggccggggccuggggcugc

SEQ ID NO: 891041 - RNA, 26 nt, Human
ggguggggggccggggccuggggcug

SEQ ID NO: 891042 - RNA, 24 nt, Human
uaaacuggcaaauggagcuuaaca

SEQ ID NO: 891043 - RNA, 24 nt, Human
uaacaggaucucauacuuucugau

SEQ ID NO: 891044 - RNA, 20 nt, Human
uaagaaaggccacaguggac

SEQ ID NO: 891045 - RNA, 22 nt, Human
uaagaaaggccacaguggacag

SEQ ID NO: 891046 - RNA, 23 nt, Human
uaagguacuuuuccagauagugu

SEQ ID NO: 891047 - RNA, 18 nt, Human
uaauuccacuaucaauaa

SEQ ID NO: 891048 - RNA, 22 nt, Human
uaauuuuuuaacagaauauaca

SEQ ID NO: 891049 - RNA, 23 nt, Human
uauacagagccacacaauacgau

SEQ ID NO: 891050 - RNA, 25 nt, Human
uaucuacacagcacagugcuacaua

SEQ ID NO: 891051 - RNA, 21 nt, Human
ucagcaacggaaagaaaaaaa

SEQ ID NO: 891052 - RNA, 23 nt, Human
ucagcaacggaaagaaaaaaaca

SEQ ID NO: 891053 - RNA, 20 nt, Human
ucccuuaacauaacaggauc

SEQ ID NO: 891054 - RNA, 22 nt, Human
uccuugccuuuggggccuggcc

SEQ ID NO: 891055 - RNA, 27 nt, Human
ucgaucaauucuuccauuacuuucuuu

SEQ ID NO: 891056 - RNA, 22 nt, Human
ugcagugcgcggcgcgcgcgcg

SEQ ID NO: 891057 - RNA, 24 nt, Human
uggacagugcccgacaaugaauac

SEQ ID NO: 891058 - RNA, 20 nt, Human
uggcccaggcggggcagcaa

SEQ ID NO: 891059 - RNA, 22 nt, Human
uggggcugcagugcgcggcgac

SEQ ID NO: 891060 - RNA, 19 nt, Human
uggggggccggggccuggg

SEQ ID NO: 891061 - RNA, 19 nt, Human
uguccuugccuuuggggcc

SEQ ID NO: 891062 - RNA, 24 nt, Human
uuauaccagugagauguacguuca

SEQ ID NO: 891063 - RNA, 22 nt, Human
uuccauucugauggaggcugaa

SEQ ID NO: 891064 - RNA, 21 nt, Human
uucugcagguaaaaaugcuaa

SEQ ID NO: 891065 - RNA, 19 nt, Human
uucuuccauuacuuucuuu

SEQ ID NO: 891066 - RNA, 24 nt, Human
uuuccuaaaaagaccaaaaaaaau

SEQ ID NO: 891067 - RNA, 24 nt, Human
uuuuuaccacaacacaucuuuccu

SEQ ID NO: 891068 - RNA, 20 nt, Human
uuuuucagcaacggaaagaa

SEQ ID NO: 891069 - RNA, 22 nt, Human
aaaaaacuaggcucaaggaagc

SEQ ID NO: 891070 - RNA, 19 nt, Human
acagcucuucccuccugcc

SEQ ID NO: 891071 - RNA, 21 nt, Human
agaugcccuucccuccugccc

SEQ ID NO: 891072 - RNA, 26 nt, Human
agccagcgcucguggccccaccugcg

SEQ ID NO: 891073 - RNA, 21 nt, Human
agccccgccaccggcguucuc

SEQ ID NO: 891074 - RNA, 22 nt, Human
agcugccauggcaggcugggcc

SEQ ID NO: 891075 - RNA, 19 nt, Human
aggccccaggugggcacag

SEQ ID NO: 891076 - RNA, 22 nt, Human
aggccgugggaccuacacacag

SEQ ID NO: 891077 - RNA, 19 nt, Human
aggugcuacaaaacugccu

SEQ ID NO: 891078 - RNA, 26 nt, Human
caaaaaaaugaauguuacaaaaauca

SEQ ID NO: 891079 - RNA, 18 nt, Human
caaggaagcagccgcccu

SEQ ID NO: 891080 - RNA, 23 nt, Human
cacacagcccuggcuuuggucag

SEQ ID NO: 891081 - RNA, 18 nt, Human
cacacaggcacacacagc

SEQ ID NO: 891082 - RNA, 20 nt, Human
cacagauuccagagcugccu

SEQ ID NO: 891083 - RNA, 22 nt, Human
cacucccucuccccaauuacag

SEQ ID NO: 891084 - RNA, 23 nt, Human
cagaugcccuucccuccugcccc

SEQ ID NO: 891085 - RNA, 19 nt, Human
cagcucuucccuccugccc

SEQ ID NO: 891086 - RNA, 21 nt, Human
caggccccaggugggcacaga

SEQ ID NO: 891087 - RNA, 24 nt, Human
ccagccccgccaccggcguucucu

SEQ ID NO: 891088 - RNA, 19 nt, Human
ccaggccccaggugggcac

SEQ ID NO: 891089 - RNA, 21 nt, Human
ccccacgauguugacugagag

SEQ ID NO: 891090 - RNA, 24 nt, Human
ccccaggccccaggugggcacaga

SEQ ID NO: 891091 - RNA, 21 nt, Human
cccuggggaggcagaggccgu

SEQ ID NO: 891092 - RNA, 20 nt, Human
ccgcccuugcaagagggcuc

SEQ ID NO: 891093 - RNA, 19 nt, Human
ccuggggaggcagaggccg

SEQ ID NO: 891094 - RNA, 22 nt, Human
ccuguagcccaggccuggagaa

SEQ ID NO: 891095 - RNA, 21 nt, Human
cguggccccaccugcggcugc

SEQ ID NO: 891096 - RNA, 19 nt, Human
cucccuggggaggcagagg

SEQ ID NO: 891097 - RNA, 24 nt, Human
cucccuggggaggcagaggccgug

SEQ ID NO: 891098 - RNA, 24 nt, Human
cugagaagaggccaaccuggccau

SEQ ID NO: 891099 - RNA, 23 nt, Human
gaagaggccaaccuggccauggg

SEQ ID NO: 891100 - RNA, 21 nt, Human
gcccugagcagagccucaggc

SEQ ID NO: 891101 - RNA, 20 nt, Human
ggcagaggggccgcagcccu

SEQ ID NO: 891102 - RNA, 19 nt, Human
ggccccaccugcggcugcc

SEQ ID NO: 891103 - RNA, 20 nt, Human
ggcucugcucccuggggagg

SEQ ID NO: 891104 - RNA, 21 nt, Human
gggcacagauuccagagcugc

SEQ ID NO: 891105 - RNA, 18 nt, Human
guuggagcugccauggca

SEQ ID NO: 891106 - RNA, 22 nt, Human
uaggggaggcccaggcucugcu

SEQ ID NO: 891107 - RNA, 18 nt, Human
uagucagaaacuccuguu

SEQ ID NO: 891108 - RNA, 20 nt, Human
uccccagaugcccuucccuc

SEQ ID NO: 891109 - RNA, 24 nt, Human
uccccagaugcccuucccuccugc

SEQ ID NO: 891110 - RNA, 22 nt, Human
uccccgcgcggguuacgggggc

SEQ ID NO: 891111 - RNA, 20 nt, Human
uccccuguagcccaggccug

SEQ ID NO: 891112 - RNA, 20 nt, Human
ucccucagccagcgcucgug

SEQ ID NO: 891113 - RNA, 20 nt, Human
ucccuggggaggcagaggcc

SEQ ID NO: 891114 - RNA, 24 nt, Human
ucccuggggaggcagaggccgugg

SEQ ID NO: 891115 - RNA, 20 nt, Human
ucggggaaagccucuuaggg

SEQ ID NO: 891116 - RNA, 18 nt, Human
ugagaagaggccaaccug

SEQ ID NO: 891117 - RNA, 19 nt, Human
ugagaagaggccaaccugg

SEQ ID NO: 891118 - RNA, 22 nt, Human
ugagaagaggccaaccuggcca

SEQ ID NO: 891119 - RNA, 19 nt, Human
ugcccuucccuccugcccc

SEQ ID NO: 891120 - RNA, 23 nt, Human
uggagcugccauggcaggcuggg

SEQ ID NO: 891121 - RNA, 24 nt, Human
uggcuuuggucaguacugagugug

SEQ ID NO: 891122 - RNA, 19 nt, Human
ugggaggcugagaagaggc

SEQ ID NO: 891123 - RNA, 24 nt, Human
uggggaggcagaggccgugggacc

SEQ ID NO: 891124 - RNA, 24 nt, Human
ugugggcagaggggccgcagcccu

SEQ ID NO: 891125 - RNA, 22 nt, Human
uuaggggaggcccaggcucugc

SEQ ID NO: 891126 - RNA, 21 nt, Human
aaaaagaacacagaaaaacau

SEQ ID NO: 891127 - RNA, 18 nt, Human
aaacaaaagugaaacuga

SEQ ID NO: 891128 - RNA, 22 nt, Human
aaacuccucagcugaagaauuc

SEQ ID NO: 891129 - RNA, 22 nt, Human
aaagcaagaaggaaauaaaggg

SEQ ID NO: 891130 - RNA, 21 nt, Human
aacacucuguagauccugcua

SEQ ID NO: 891131 - RNA, 26 nt, Human
aagaacacagaaaaacagcaggaacu

SEQ ID NO: 891132 - RNA, 19 nt, Human
aagaacacagaaaaacaua

SEQ ID NO: 891133 - RNA, 25 nt, Human
aagacauaaaacaacauagaaacaa

SEQ ID NO: 891134 - RNA, 26 nt, Human
aagcaagaaggaaauaaaggggaccc

SEQ ID NO: 891135 - RNA, 19 nt, Human
aaggagaggcaaacaauga

SEQ ID NO: 891136 - RNA, 18 nt, Human
aaggagcacuugguggcc

SEQ ID NO: 891137 - RNA, 21 nt, Human
acaaagacauaaaacaacaua

SEQ ID NO: 891138 - RNA, 24 nt, Human
acacagaaaaacauaucuggggca

SEQ ID NO: 891139 - RNA, 21 nt, Human
acugacaauaaaaauaaaguu

SEQ ID NO: 891140 - RNA, 19 nt, Human
agagaggggccagaaggua

SEQ ID NO: 891141 - RNA, 19 nt, Human
agcaauuucauuuuuaaau

SEQ ID NO: 891142 - RNA, 22 nt, Human
aguccauggcgauaagaaacua

SEQ ID NO: 891143 - RNA, 22 nt, Human
auaaaacaacauagaaacaaaa

SEQ ID NO: 891144 - RNA, 18 nt, Human
auagaaacaaaagugaaa

SEQ ID NO: 891145 - RNA, 23 nt, Human
aucaacguucugggcaccacagc

SEQ ID NO: 891146 - RNA, 23 nt, Human
aucccuacaauaauaacagaaaa

SEQ ID NO: 891147 - RNA, 21 nt, Human
auuguuugagcaaaauguguu

SEQ ID NO: 891148 - RNA, 21 nt, Human
caaagcaagaaggaaauaaag

SEQ ID NO: 891149 - RNA, 24 nt, Human
caaguuuccaguuaaucucaaaau

SEQ ID NO: 891150 - RNA, 18 nt, Human
cacagcauccagagauga

SEQ ID NO: 891151 - RNA, 23 nt, Human
caccacagcauccagagaugaga

SEQ ID NO: 891152 - RNA, 22 nt, Human
cacgaaacacucuguagauccu

SEQ ID NO: 891153 - RNA, 23 nt, Human
cagcagcauccccaccgugacug

SEQ ID NO: 891154 - RNA, 18 nt, Human
cagcauccagagaugaga

SEQ ID NO: 891155 - RNA, 21 nt, Human
caguggcggggggaggacagg

SEQ ID NO: 891156 - RNA, 21 nt, Human
cauaucuggggcaaacagcaa

SEQ ID NO: 891157 - RNA, 24 nt, Human
ccacgcugcagccagauccggaug

SEQ ID NO: 891158 - RNA, 23 nt, Human
cccacgcugcagccagauccgga

SEQ ID NO: 891159 - RNA, 18 nt, Human
ccgcgcagccagcagcau

SEQ ID NO: 891160 - RNA, 18 nt, Human
ccucagcgccgcgcagcc

SEQ ID NO: 891161 - RNA, 23 nt, Human
cgauaagaaacuaaagcaaaacu

SEQ ID NO: 891162 - RNA, 21 nt, Human
cgcuggcccucagcgccgcgc

SEQ ID NO: 891163 - RNA, 20 nt, Human
cgggaagacuuccaguggcg

SEQ ID NO: 891164 - RNA, 26 nt, Human
cucaaaauguauuuaaaaacuaagga

SEQ ID NO: 891165 - RNA, 19 nt, Human
cucuucagcuuuuacuguu

SEQ ID NO: 891166 - RNA, 21 nt, Human
cugaaugaagagaggggccag

SEQ ID NO: 891167 - RNA, 24 nt, Human
gaaacacucuguagauccugcuaa

SEQ ID NO: 891168 - RNA, 26 nt, Human
gcaaacaaugagaacagcuccaugac

SEQ ID NO: 891169 - RNA, 19 nt, Human
gcaaacuuucuccagaaag

SEQ ID NO: 891170 - RNA, 23 nt, Human
gcaaagcaagaaggaaauaaagg

SEQ ID NO: 891171 - RNA, 24 nt, Human
gcaaagcaagaaggaaauaaaggg

SEQ ID NO: 891172 - RNA, 28 nt, Human
gccccgggcgggcucucgcucucgcugg

SEQ ID NO: 891173 - RNA, 20 nt, Human
gcggggggaggacagggucg

SEQ ID NO: 891174 - RNA, 20 nt, Human
gggcgggcucucgcucucgc

SEQ ID NO: 891175 - RNA, 19 nt, Human
gguaaaaaggaggaaaagg

SEQ ID NO: 891176 - RNA, 22 nt, Human
uaaaaagaacacagaaaaacau

SEQ ID NO: 891177 - RNA, 24 nt, Human
uaaaaagauuguaauacaagaaua

SEQ ID NO: 891178 - RNA, 22 nt, Human
uaaaacaacauagaaacaaaag

SEQ ID NO: 891179 - RNA, 19 nt, Human
uaaagcaaaacuccucagc

SEQ ID NO: 891180 - RNA, 25 nt, Human
uaagaaacuaaagcaaaacuccuca

SEQ ID NO: 891181 - RNA, 22 nt, Human
uagguaaagguuuagaaaccag

SEQ ID NO: 891182 - RNA, 22 nt, Human
uagguguguauaguccauaacc

SEQ ID NO: 891183 - RNA, 22 nt, Human
uaucauauauaaaauaacauuu

SEQ ID NO: 891184 - RNA, 19 nt, Human
ucaggaacgcacuauucuc

SEQ ID NO: 891185 - RNA, 22 nt, Human
uccaugguccacacugucacuu

SEQ ID NO: 891186 - RNA, 23 nt, Human
ucccuacaauaauaacagaaaaa

SEQ ID NO: 891187 - RNA, 21 nt, Human
uccgagcccacgcugcagcca

SEQ ID NO: 891188 - RNA, 20 nt, Human
ucucucggaaugggcgaaua

SEQ ID NO: 891189 - RNA, 19 nt, Human
ucuucaaguuuccaguuaa

SEQ ID NO: 891190 - RNA, 19 nt, Human
ugaggaaaggaauccuggg

SEQ ID NO: 891191 - RNA, 20 nt, Human
uggcggggggaggacaggga

SEQ ID NO: 891192 - RNA, 21 nt, Human
uuaauugcaaaauaaguuuua

SEQ ID NO: 891193 - RNA, 21 nt, Human
uuacucagaucaaagucaugu

SEQ ID NO: 891194 - RNA, 22 nt, Human
uuccaugguccacacugucacu

SEQ ID NO: 891195 - RNA, 24 nt, Human
uucuccagaaagauugagcaaaca

SEQ ID NO: 891196 - RNA, 19 nt, Human
uugcaaucuaguaauuuua

SEQ ID NO: 891197 - RNA, 19 nt, Human
uuguauuauugucuuggca

SEQ ID NO: 891198 - RNA, 19 nt, Human
uuuuuguuuaaaaaacauu

SEQ ID NO: 891199 - RNA, 24 nt, Human
uuuuuuuucacauaucacacaaug

SEQ ID NO: 891200 - RNA, 18 nt, Human
aaacuaaauacaguaaca

SEQ ID NO: 891201 - RNA, 18 nt, Human
aacaaaauauagaaaaca

SEQ ID NO: 891202 - RNA, 18 nt, Human
aacgaagaggcagccuga

SEQ ID NO: 891203 - RNA, 21 nt, Human
aagaagaaacagaugggugaa

SEQ ID NO: 891204 - RNA, 21 nt, Human
aagaggcagccugagccuggc

SEQ ID NO: 891205 - RNA, 19 nt, Human
aauacaguaacaaaaggaa

SEQ ID NO: 891206 - RNA, 21 nt, Human
acaauuugauaaaugaguucc

SEQ ID NO: 891207 - RNA, 20 nt, Human
acacacccuaagaauucaca

SEQ ID NO: 891208 - RNA, 18 nt, Human
acagagauuagccaagaa

SEQ ID NO: 891209 - RNA, 22 nt, Human
acagagcuguuaucagucaaga

SEQ ID NO: 891210 - RNA, 19 nt, Human
acaguaacaaaaggaaaga

SEQ ID NO: 891211 - RNA, 20 nt, Human
agaaagagcuuauguccaca

SEQ ID NO: 891212 - RNA, 22 nt, Human
agaaagagcuuauguccacauu

SEQ ID NO: 891213 - RNA, 19 nt, Human
agaaaggaaaaauaaaagg

SEQ ID NO: 891214 - RNA, 22 nt, Human
agaugggugaaauacaacuggg

SEQ ID NO: 891215 - RNA, 21 nt, Human
agcuagaaaaaugucaugucc

SEQ ID NO: 891216 - RNA, 23 nt, Human
aggcagaaguacagagauuagcc

SEQ ID NO: 891217 - RNA, 27 nt, Human
aggcagaaguacagagauuagccaaga

SEQ ID NO: 891218 - RNA, 21 nt, Human
aguaacaaaaggaaagaaaga

SEQ ID NO: 891219 - RNA, 24 nt, Human
aguacagagauuagccaagaagaa

SEQ ID NO: 891220 - RNA, 20 nt, Human
agugaaaaauuuaucacaaa

SEQ ID NO: 891221 - RNA, 24 nt, Human
aguugugaugggagaaaaggguug

SEQ ID NO: 891222 - RNA, 20 nt, Human
auaccauaaaaaaagucaaa

SEQ ID NO: 891223 - RNA, 20 nt, Human
auucuugauaagagcuagaa

SEQ ID NO: 891224 - RNA, 21 nt, Human
auuuaucacaaacuaaauaca

SEQ ID NO: 891225 - RNA, 19 nt, Human
caaggcucauccaauuucu

SEQ ID NO: 891226 - RNA, 20 nt, Human
caaggcucauccaauuucua

SEQ ID NO: 891227 - RNA, 21 nt, Human
cagaaugggagcuauguaaca

SEQ ID NO: 891228 - RNA, 20 nt, Human
cauccaaccaccucuucuaa

SEQ ID NO: 891229 - RNA, 18 nt, Human
caucuugauuuaauaaag

SEQ ID NO: 891230 - RNA, 18 nt, Human
cauugagaauuuacuaac

SEQ ID NO: 891231 - RNA, 22 nt, Human
cuagaaaaaugucaugucccag

SEQ ID NO: 891232 - RNA, 20 nt, Human
cugagaaaacacauauaugu

SEQ ID NO: 891233 - RNA, 20 nt, Human
gaacaaaugccuauacugaa

SEQ ID NO: 891234 - RNA, 22 nt, Human
gacacacucaagaacaaaugcc

SEQ ID NO: 891235 - RNA, 21 nt, Human
gcaaaaccaacagaaugggag

SEQ ID NO: 891236 - RNA, 22 nt, Human
gcuaaaacgaagaggcagccug

SEQ ID NO: 891237 - RNA, 20 nt, Human
gguaaacuucaaaggcuugc

SEQ ID NO: 891238 - RNA, 24 nt, Human
guaaaacgauaggcuuauaaaaca

SEQ ID NO: 891239 - RNA, 21 nt, Human
guaacaaucuagcgaagagaa

SEQ ID NO: 891240 - RNA, 23 nt, Human
uaaaacgaagaggcagccugagc

SEQ ID NO: 891241 - RNA, 24 nt, Human
uaaaacgauaggcuuauaaaacaa

SEQ ID NO: 891242 - RNA, 22 nt, Human
uaacaaaauauagaaaacaaga

SEQ ID NO: 891243 - RNA, 19 nt, Human
uaacaaucuagcgaagaga

SEQ ID NO: 891244 - RNA, 22 nt, Human
uaacuggcagugcuuccuauaa

SEQ ID NO: 891245 - RNA, 18 nt, Human
uaagauccacaaccuugg

SEQ ID NO: 891246 - RNA, 24 nt, Human
uacaauguauauuuuaauauggga

SEQ ID NO: 891247 - RNA, 26 nt, Human
uacaauguauauuuuaauaugggauu

SEQ ID NO: 891248 - RNA, 24 nt, Human
uaccauaugcuguaagcaaaacca

SEQ ID NO: 891249 - RNA, 21 nt, Human
uacuaacaaaauauagaaaac

SEQ ID NO: 891250 - RNA, 19 nt, Human
uaucccaggauuaugaaau

SEQ ID NO: 891251 - RNA, 21 nt, Human
ucaagagcagucuucuuguug

SEQ ID NO: 891252 - RNA, 20 nt, Human
ugauaagagcuagaaaaaug

SEQ ID NO: 891253 - RNA, 19 nt, Human
ugccugagagaauaaaaac

SEQ ID NO: 891254 - RNA, 26 nt, Human
uggaaugaaugggcugucacugaaug

SEQ ID NO: 891255 - RNA, 23 nt, Human
ugggagcuauguaacaaucuagc

SEQ ID NO: 891256 - RNA, 20 nt, Human
ugugaugggagaaaaggguu

SEQ ID NO: 891257 - RNA, 21 nt, Human
uuauagcguccagguccaaca

SEQ ID NO: 891258 - RNA, 22 nt, Human
uuggcacaguaacuagcuguau

SEQ ID NO: 891259 - RNA, 24 nt, Human
uuuauaccauaaaaaaagucaaaa

SEQ ID NO: 891260 - RNA, 22 nt, Human
uuucauugagaauuuacuaaca

SEQ ID NO: 891261 - RNA, 23 nt, Human
uuuuauaccauaaaaaaagucaa

SEQ ID NO: 891262 - RNA, 22 nt, Human
aagcagccaguaaacaagugcc

SEQ ID NO: 891263 - RNA, 18 nt, Human
aagcccagagcagggcca

SEQ ID NO: 891264 - RNA, 25 nt, Human
aagcccagagcagggccaggggugc

SEQ ID NO: 891265 - RNA, 18 nt, Human
acacucccacgguggcac

SEQ ID NO: 891266 - RNA, 25 nt, Human
acagcacagccccucgcagcacagg

SEQ ID NO: 891267 - RNA, 24 nt, Human
acccagagcagagacaagggccca

SEQ ID NO: 891268 - RNA, 18 nt, Human
acccugggcuaccugcgg

SEQ ID NO: 891269 - RNA, 19 nt, Human
acucccagccgcugcuccc

SEQ ID NO: 891270 - RNA, 19 nt, Human
agaaagcagccaguaaaca

SEQ ID NO: 891271 - RNA, 21 nt, Human
agagcagagacaagggcccac

SEQ ID NO: 891272 - RNA, 24 nt, Human
agccaguaaacaagugcugccacc

SEQ ID NO: 891273 - RNA, 21 nt, Human
agggagcuggccacgucucag

SEQ ID NO: 891274 - RNA, 21 nt, Human
agggcccacugugcgggcagc

SEQ ID NO: 891275 - RNA, 19 nt, Human
agggcccacuucgugcccc

SEQ ID NO: 891276 - RNA, 19 nt, Human
auuccaccccucugcccca

SEQ ID NO: 891277 - RNA, 24 nt, Human
cacaacacccugggcuaccugcgg

SEQ ID NO: 891278 - RNA, 21 nt, Human
cacccaggagccacacagacg

SEQ ID NO: 891279 - RNA, 23 nt, Human
cacccagggcccacuucgugccc

SEQ ID NO: 891280 - RNA, 22 nt, Human
caccccaacguauuccaccccu

SEQ ID NO: 891281 - RNA, 25 nt, Human
caccccucugccccaggcacccaag

SEQ ID NO: 891282 - RNA, 24 nt, Human
cacgguggcacggcuccacugaag

SEQ ID NO: 891283 - RNA, 23 nt, Human
cacuaagagccccccccacagcu

SEQ ID NO: 891284 - RNA, 19 nt, Human
cacugugcgggcagcaggc

SEQ ID NO: 891285 - RNA, 21 nt, Human
cagccccucgcagcacaggcc

SEQ ID NO: 891286 - RNA, 19 nt, Human
caggagggcuccgugagug

SEQ ID NO: 891287 - RNA, 21 nt, Human
caggcacccaaggggcauggg

SEQ ID NO: 891288 - RNA, 21 nt, Human
caggucaaugcacucaacacu

SEQ ID NO: 891289 - RNA, 19 nt, Human
ccacccugcccccacccug

SEQ ID NO: 891290 - RNA, 20 nt, Human
ccaguaaacaagugcugcca

SEQ ID NO: 891291 - RNA, 24 nt, Human
cccaacguauuccaccccucugcc

SEQ ID NO: 891292 - RNA, 20 nt, Human
cccacaacacccugggcuac

SEQ ID NO: 891293 - RNA, 21 nt, Human
cccacccugcccccacccugc

SEQ ID NO: 891294 - RNA, 19 nt, Human
cccacccugcccugcucac

SEQ ID NO: 891295 - RNA, 22 nt, Human
cccacccugcccugcucacucc

SEQ ID NO: 891296 - RNA, 23 nt, Human
cccacuucgugcccccacccugc

SEQ ID NO: 891297 - RNA, 20 nt, Human
cccagccgcugcuccccuuc

SEQ ID NO: 891298 - RNA, 19 nt, Human
cccaggagccacacagacg

SEQ ID NO: 891299 - RNA, 19 nt, Human
ccccacccugcccccaccc

SEQ ID NO: 891300 - RNA, 19 nt, Human
ccccaggcacccaaggggc

SEQ ID NO: 891301 - RNA, 25 nt, Human
cccccacagcuaucguggggcaccc

SEQ ID NO: 891302 - RNA, 18 nt, Human
cccccacccugcccccac

SEQ ID NO: 891303 - RNA, 25 nt, Human
ccccucugccccaggcacccaaggg

SEQ ID NO: 891304 - RNA, 20 nt, Human
ccccuggcacagcacagccc

SEQ ID NO: 891305 - RNA, 21 nt, Human
cccugcccccacccugcccug

SEQ ID NO: 891306 - RNA, 22 nt, Human
cccugcccccacccugcccugc

SEQ ID NO: 891307 - RNA, 18 nt, Human
ccucggaagggagcugug

SEQ ID NO: 891308 - RNA, 23 nt, Human
ccucugccccaggcacccaaggg

SEQ ID NO: 891309 - RNA, 22 nt, Human
ccuggcccugcagccucggaag

SEQ ID NO: 891310 - RNA, 18 nt, Human
cgugcccccacccugccc

SEQ ID NO: 891311 - RNA, 21 nt, Human
cuacgucaggacccuggacac

SEQ ID NO: 891312 - RNA, 24 nt, Human
cuccccuggcacagcacagccccc

SEQ ID NO: 891313 - RNA, 21 nt, Human
cuucgugcccccacccugccc

SEQ ID NO: 891314 - RNA, 19 nt, Human
cuugcacuaagagcccccc

SEQ ID NO: 891315 - RNA, 22 nt, Human
gagcagggccaggggugcagau

SEQ ID NO: 891316 - RNA, 25 nt, Human
gccacacagacgcccgggaccagca

SEQ ID NO: 891317 - RNA, 18 nt, Human
gccaggggugcagauggg

SEQ ID NO: 891318 - RNA, 22 nt, Human
gccccaggcacccaaggggcau

SEQ ID NO: 891319 - RNA, 21 nt, Human
gcccugcucacucccagccgc

SEQ ID NO: 891320 - RNA, 19 nt, Human
gcggcccugccaggagggc

SEQ ID NO: 891321 - RNA, 27 nt, Human
ggacacgggggugcgcccuccaacaag

SEQ ID NO: 891322 - RNA, 21 nt, Human
ggagcuggccacgucucaggg

SEQ ID NO: 891323 - RNA, 21 nt, Human
gggacaggcccagcugugagg

SEQ ID NO: 891324 - RNA, 22 nt, Human
gggaccagcacaggcuccccuc

SEQ ID NO: 891325 - RNA, 22 nt, Human
ggggugcugaggacacgggggu

SEQ ID NO: 891326 - RNA, 20 nt, Human
gggugcugaggacacggggg

SEQ ID NO: 891327 - RNA, 24 nt, Human
ggguggcugccucgccugacccag

SEQ ID NO: 891328 - RNA, 23 nt, Human
guaaacaagugcugccacccaca

SEQ ID NO: 891329 - RNA, 23 nt, Human
gucaggacccuggacacucccac

SEQ ID NO: 891330 - RNA, 18 nt, Human
ucacccagggcccacuuc

SEQ ID NO: 891331 - RNA, 25 nt, Human
ucacccagggcccacuucgugcccc

SEQ ID NO: 891332 - RNA, 19 nt, Human
uccacaggaucuugcacua

SEQ ID NO: 891333 - RNA, 21 nt, Human
uccaccccucugccccaggca

SEQ ID NO: 891334 - RNA, 23 nt, Human
ucccacgguggcacggcuccacu

SEQ ID NO: 891335 - RNA, 18 nt, Human
ucccagccgcugcucccc

SEQ ID NO: 891336 - RNA, 20 nt, Human
uccucugggcuucccgggug

SEQ ID NO: 891337 - RNA, 28 nt, Human
ucgccugacccagagcagagacaagggc

SEQ ID NO: 891338 - RNA, 19 nt, Human
ugacccagagcagagacaa

SEQ ID NO: 891339 - RNA, 19 nt, Human
ugaccucccagagggacac

SEQ ID NO: 891340 - RNA, 18 nt, Human
ugaggccgcaguugaccu

SEQ ID NO: 891341 - RNA, 22 nt, Human
ugagugcacacucuccucuggg

SEQ ID NO: 891342 - RNA, 23 nt, Human
ugcacuaagagccccccccacag

SEQ ID NO: 891343 - RNA, 21 nt, Human
ugcccccacccugcccugcuc

SEQ ID NO: 891344 - RNA, 23 nt, Human
ugcccccacccugcccugcucac

SEQ ID NO: 891345 - RNA, 20 nt, Human
ugccucgccugacccagagc

SEQ ID NO: 891346 - RNA, 24 nt, Human
uggcacggcuccacugaagcccag

SEQ ID NO: 891347 - RNA, 22 nt, Human
ugugggggucacccagggccca

SEQ ID NO: 891348 - RNA, 23 nt, Human
uucuaauccacaggaucuugcac

SEQ ID NO: 891349 - RNA, 21 nt, Human
uugcacuaagagcccccccca

SEQ ID NO: 891350 - RNA, 23 nt, Human
uugcacuaagagccccccccaca

SEQ ID NO: 891351 - RNA, 23 nt, Human
uuucgagccagaaagcagccagu

SEQ ID NO: 891352 - RNA, 23 nt, Human
uuuuuuuuuuuuuuuuucacaag

SEQ ID NO: 891353 - RNA, 19 nt, Human
aaccaauggcagaagccau

SEQ ID NO: 891354 - RNA, 21 nt, Human
aagaagaaacaagggccgcug

SEQ ID NO: 891355 - RNA, 29 nt, Human
aagaaggaaaugaggucagaagggacccc

SEQ ID NO: 891356 - RNA, 19 nt, Human
aagcaagaagagugaguac

SEQ ID NO: 891357 - RNA, 20 nt, Human
aaucggauugcuuguuucug

SEQ ID NO: 891358 - RNA, 18 nt, Human
acaacacaugcaacacgg

SEQ ID NO: 891359 - RNA, 24 nt, Human
acaauaacugccuguaagcaugcc

SEQ ID NO: 891360 - RNA, 21 nt, Human
acacccggcgccaagggggcg

SEQ ID NO: 891361 - RNA, 19 nt, Human
acaggaaguuugaaucuau

SEQ ID NO: 891362 - RNA, 20 nt, Human
accaauugacuaaguugucc

SEQ ID NO: 891363 - RNA, 23 nt, Human
acgucacuaaugaagggaccagu

SEQ ID NO: 891364 - RNA, 19 nt, Human
agaaggaaaugaggucaga

SEQ ID NO: 891365 - RNA, 21 nt, Human
agcucuuuccucccacagucc

SEQ ID NO: 891366 - RNA, 19 nt, Human
agcugaacaccugacgcug

SEQ ID NO: 891367 - RNA, 18 nt, Human
agggaccaguggucccgg

SEQ ID NO: 891368 - RNA, 23 nt, Human
aguccaggcucaacaccucuucc

SEQ ID NO: 891369 - RNA, 22 nt, Human
caagaaggaaaugaggucagaa

SEQ ID NO: 891370 - RNA, 22 nt, Human
cacagaaaauuguaacaacaca

SEQ ID NO: 891371 - RNA, 24 nt, Human
cacuaaugaagggaccaguggucc

SEQ ID NO: 891372 - RNA, 18 nt, Human
cagaagccaugcguggaa

SEQ ID NO: 891373 - RNA, 18 nt, Human
cagcgagugacggcggcg

SEQ ID NO: 891374 - RNA, 28 nt, Human
cagcucuuuccucccacaguccaggcuc

SEQ ID NO: 891375 - RNA, 21 nt, Human
caggacacccggcgccaaggg

SEQ ID NO: 891376 - RNA, 18 nt, Human
caugcguggaagcagaau

SEQ ID NO: 891377 - RNA, 22 nt, Human
ccaagggggcgcggccuggagc

SEQ ID NO: 891378 - RNA, 22 nt, Human
ccaauagggccugggcccgcca

SEQ ID NO: 891379 - RNA, 18 nt, Human
ccagaaagcuaacaccua

SEQ ID NO: 891380 - RNA, 18 nt, Human
ccaggcucaacaccucuc

SEQ ID NO: 891381 - RNA, 19 nt, Human
cccacaguccaggcucaac

SEQ ID NO: 891382 - RNA, 20 nt, Human
cccacaguccaggcucaaca

SEQ ID NO: 891383 - RNA, 18 nt, Human
cccccgggucgcgaaccc

SEQ ID NO: 891384 - RNA, 19 nt, Human
ccggcgccaagggggcgcg

SEQ ID NO: 891385 - RNA, 18 nt, Human
ccugcagcucccguuccu

SEQ ID NO: 891386 - RNA, 19 nt, Human
ccugcagcucccguuccuc

SEQ ID NO: 891387 - RNA, 22 nt, Human
ccugggcccgccaccccccggg

SEQ ID NO: 891388 - RNA, 18 nt, Human
cgccaagggggcgcggcc

SEQ ID NO: 891389 - RNA, 23 nt, Human
cgcugcgcaagcagcggcaggac

SEQ ID NO: 891390 - RNA, 21 nt, Human
cucccguuccuccggcuccca

SEQ ID NO: 891391 - RNA, 21 nt, Human
cugaacaccugacgcugcgcc

SEQ ID NO: 891392 - RNA, 18 nt, Human
gaacucucuaaacugaug

SEQ ID NO: 891393 - RNA, 23 nt, Human
gcaagaagagugaguacugaagg

SEQ ID NO: 891394 - RNA, 23 nt, Human
gccaccccccgggucgcgaaccc

SEQ ID NO: 891395 - RNA, 20 nt, Human
gccaugcguggaagcagaau

SEQ ID NO: 891396 - RNA, 24 nt, Human
gccuaagcaagaagagugaguacc

SEQ ID NO: 891397 - RNA, 21 nt, Human
gcgcggccuggagcgccgggg

SEQ ID NO: 891398 - RNA, 18 nt, Human
gcggcgcaaacgcgcccg

SEQ ID NO: 891399 - RNA, 18 nt, Human
ggcaaacuuuucacuucu

SEQ ID NO: 891400 - RNA, 18 nt, Human
ggcccugcuucaagcuga

SEQ ID NO: 891401 - RNA, 23 nt, Human
ggcuuucaacacacagagagccu

SEQ ID NO: 891402 - RNA, 21 nt, Human
gggccgcugcgcaagcagcgg

SEQ ID NO: 891403 - RNA, 23 nt, Human
gggcgcggccuggagcgccgggg

SEQ ID NO: 891404 - RNA, 21 nt, Human
ggggcacgaggcccugcuuca

SEQ ID NO: 891405 - RNA, 21 nt, Human
gucacuaaugaagggaccagu

SEQ ID NO: 891406 - RNA, 22 nt, Human
uaacaacacaugcaacacggga

SEQ ID NO: 891407 - RNA, 24 nt, Human
uaagaagaaacaagggccgcugcg

SEQ ID NO: 891408 - RNA, 21 nt, Human
ucaacaccucuuccuauucca

SEQ ID NO: 891409 - RNA, 19 nt, Human
uccucccacaguccaggcu

SEQ ID NO: 891410 - RNA, 19 nt, Human
ucgggguccggcucccggc

SEQ ID NO: 891411 - RNA, 22 nt, Human
ugagggcccggggagaagccgg

SEQ ID NO: 891412 - RNA, 22 nt, Human
ugcaacacgggauggcuuucaa

SEQ ID NO: 891413 - RNA, 18 nt, Human
ugucguuucagggugcug

SEQ ID NO: 891414 - RNA, 22 nt, Human
uguuaguguucacugaucaaga

SEQ ID NO: 891415 - RNA, 24 nt, Human
uguucacugaucaagaaggaaaug

SEQ ID NO: 891416 - RNA, 23 nt, Human
uuucacuucuucucaaacauaaa

SEQ ID NO: 891417 - RNA, 24 nt, Human
uuuuuuuuuuuuuuugcuacauuu

SEQ ID NO: 891418 - RNA, 19 nt, Human
uuuuuuuuuuuuuuuugcu

SEQ ID NO: 891419 - RNA, 20 nt, Human
uuuuuuuuuuuuuuuugcua

SEQ ID NO: 891420 - RNA, 18 nt, Human
uuuuuuuuuuuuuuuuug

SEQ ID NO: 891421 - RNA, 20 nt, Human
uuuuuuuuuuuuuuuuugcu

SEQ ID NO: 891422 - RNA, 19 nt, Human
aagccucugggcagcuccu

SEQ ID NO: 891423 - RNA, 23 nt, Human
agacucucggucacuggccguuc

SEQ ID NO: 891424 - RNA, 22 nt, Human
agccucugacuugcugcaguuu

SEQ ID NO: 891425 - RNA, 22 nt, Human
aggacagucagagaagccaagu

SEQ ID NO: 891426 - RNA, 18 nt, Human
caggaccacaagccucug

SEQ ID NO: 891427 - RNA, 20 nt, Human
caguaccuccucucccuggu

SEQ ID NO: 891428 - RNA, 20 nt, Human
caguuuugauugcucuccca

SEQ ID NO: 891429 - RNA, 20 nt, Human
ccagccgaaagacacgccca

SEQ ID NO: 891430 - RNA, 20 nt, Human
ccgaaagacacgcccacuug

SEQ ID NO: 891431 - RNA, 18 nt, Human
cggucacuggccguuccu

SEQ ID NO: 891432 - RNA, 20 nt, Human
cucccuuuuccccagccgaa

SEQ ID NO: 891433 - RNA, 21 nt, Human
cuccucccuuuuccccagccg

SEQ ID NO: 891434 - RNA, 21 nt, Human
cucucggucacuggccguucc

SEQ ID NO: 891435 - RNA, 21 nt, Human
cucucuggccggagccucuga

SEQ ID NO: 891436 - RNA, 22 nt, Human
cucucuggccggagccucugac

SEQ ID NO: 891437 - RNA, 18 nt, Human
cugcucucuggccggagc

SEQ ID NO: 891438 - RNA, 20 nt, Human
cugggcagcuccugcucucu

SEQ ID NO: 891439 - RNA, 18 nt, Human
gaguuccguaugcuccuc

SEQ ID NO: 891440 - RNA, 23 nt, Human
gauuccaccgggucugguuucuc

SEQ ID NO: 891441 - RNA, 24 nt, Human
ggagccucugacuugcugcaguuu

SEQ ID NO: 891442 - RNA, 20 nt, Human
gggaggagugauguugccca

SEQ ID NO: 891443 - RNA, 21 nt, Human
guuaccucuuagagauuccac

SEQ ID NO: 891444 - RNA, 18 nt, Human
uaacuccucccuuuuccc

SEQ ID NO: 891445 - RNA, 20 nt, Human
uagaagagacgcuuucagcg

SEQ ID NO: 891446 - RNA, 19 nt, Human
uagcuccccggagaggagc

SEQ ID NO: 891447 - RNA, 19 nt, Human
ucccugaccauccagaugg

SEQ ID NO: 891448 - RNA, 20 nt, Human
ucuccgcugcagccaguuua

SEQ ID NO: 891449 - RNA, 22 nt, Human
uuagagauuccaccgggucugg

SEQ ID NO: 891450 - RNA, 26 nt, Human
uuagcuccccggagaggagcuuucag

SEQ ID NO: 891451 - RNA, 20 nt, Human
acugcagaaacuaguaaaca

SEQ ID NO: 891452 - RNA, 18 nt, Human
agaaacuaguaaacaccu

SEQ ID NO: 891453 - RNA, 20 nt, Human
caauaguugaaacacacugc

SEQ ID NO: 891454 - RNA, 20 nt, Human
caggggaggugaaugaccac

SEQ ID NO: 891455 - RNA, 20 nt, Human
cuccuggagucucuagaucu

SEQ ID NO: 891456 - RNA, 22 nt, Human
cucuagaucuguguauaucugc

SEQ ID NO: 891457 - RNA, 24 nt, Human
gccaauuacucagcccacaagcau

SEQ ID NO: 891458 - RNA, 19 nt, Human
guauaucugcacuaucuca

SEQ ID NO: 891459 - RNA, 24 nt, Human
uaguaaacaccuuagauagaguug

SEQ ID NO: 891460 - RNA, 19 nt, Human
ucaguuuucauuuuggguc

SEQ ID NO: 891461 - RNA, 23 nt, Human
ugugccaauuacucagcccacaa

SEQ ID NO: 891462 - RNA, 20 nt, Human
uguuuauuuucauuuuccuc

SEQ ID NO: 891463 - RNA, 18 nt, Human
uuaaauuaccuuagguuu

SEQ ID NO: 891464 - RNA, 20 nt, Human
aaggaacaagugcuuuugag

SEQ ID NO: 891465 - RNA, 23 nt, Human
aaugcccacuucgcgcgggcagc

SEQ ID NO: 891466 - RNA, 21 nt, Human
acccaagacggugggcggcuc

SEQ ID NO: 891467 - RNA, 21 nt, Human
agaaaagaagagagaaugggg

SEQ ID NO: 891468 - RNA, 22 nt, Human
agaaaagaagagagaauggggg

SEQ ID NO: 891469 - RNA, 18 nt, Human
agagagaaugggguccga

SEQ ID NO: 891470 - RNA, 21 nt, Human
agagagcgaugagcagcgagg

SEQ ID NO: 891471 - RNA, 18 nt, Human
agcacccacagcccagcg

SEQ ID NO: 891472 - RNA, 19 nt, Human
agcagaaggaacaagugcu

SEQ ID NO: 891473 - RNA, 19 nt, Human
cagcgagggccguggggag

SEQ ID NO: 891474 - RNA, 23 nt, Human
ccaaaggagaaaagaagagagaa

SEQ ID NO: 891475 - RNA, 23 nt, Human
ccccgccugggaguugccccagc

SEQ ID NO: 891476 - RNA, 22 nt, Human
ccgccugggaguugccccagcc

SEQ ID NO: 891477 - RNA, 20 nt, Human
cgacccaagacggugggcgg

SEQ ID NO: 891478 - RNA, 23 nt, Human
cgcaaaagaauagagagcgauga

SEQ ID NO: 891479 - RNA, 21 nt, Human
cuacggcucccggcucccucc

SEQ ID NO: 891480 - RNA, 20 nt, Human
cucccucucccuuacccuua

SEQ ID NO: 891481 - RNA, 20 nt, Human
cugcaggcgcccccgccugg

SEQ ID NO: 891482 - RNA, 19 nt, Human
gaacccagccuaccgcccc

SEQ ID NO: 891483 - RNA, 19 nt, Human
gaagcagaaggaacaagug

SEQ ID NO: 891484 - RNA, 18 nt, Human
gaggguagggcgacccaa

SEQ ID NO: 891485 - RNA, 21 nt, Human
gauuauggggugguggcagag

SEQ ID NO: 891486 - RNA, 18 nt, Human
gcagaaggaacaagugcu

SEQ ID NO: 891487 - RNA, 18 nt, Human
gcagagaggaggccuaaa

SEQ ID NO: 891488 - RNA, 18 nt, Human
gcagcagcaaggguugcg

SEQ ID NO: 891489 - RNA, 21 nt, Human
gcgcgggcagcagcaaggguu

SEQ ID NO: 891490 - RNA, 27 nt, Human
gcgcgggcagcagcaaggguugcgugc

SEQ ID NO: 891491 - RNA, 23 nt, Human
gcuuuugagggccgccgccgucg

SEQ ID NO: 891492 - RNA, 20 nt, Human
ggagaagcagaaggaacaag

SEQ ID NO: 891493 - RNA, 19 nt, Human
gugguggcagagaggaggc

SEQ ID NO: 891494 - RNA, 19 nt, Human
guucagcugagcugcaggc

SEQ ID NO: 891495 - RNA, 19 nt, Human
ucccggcucccucccucuc

SEQ ID NO: 891496 - RNA, 22 nt, Human
ucuacggcucccggcucccucc

SEQ ID NO: 891497 - RNA, 21 nt, Human
ucucccuuacccuuagcaccc

SEQ ID NO: 891498 - RNA, 21 nt, Human
uggcgcggcucggagggccgg

SEQ ID NO: 891499 - RNA, 18 nt, Human
uucagcugagcugcaggc

SEQ ID NO: 891500 - RNA, 18 nt, Human
aaaaaagagaagaagaaa

SEQ ID NO: 891501 - RNA, 23 nt, Human
aaaaaagagaagaagaaaaguga

SEQ ID NO: 891502 - RNA, 24 nt, Human
aaaaauuaauagaauaaaagauaa

SEQ ID NO: 891503 - RNA, 21 nt, Human
acagaaaagauggauguagua

SEQ ID NO: 891504 - RNA, 24 nt, Human
agaggggaggggagcuaguaguca

SEQ ID NO: 891505 - RNA, 24 nt, Human
cagcaaaucuacccuucacaguuc

SEQ ID NO: 891506 - RNA, 21 nt, Human
cuaaaaaagagaagaagaaaa

SEQ ID NO: 891507 - RNA, 19 nt, Human
cuacccuucacaguuccug

SEQ ID NO: 891508 - RNA, 24 nt, Human
cuuugaagacuguuaugaaaagga

SEQ ID NO: 891509 - RNA, 18 nt, Human
ggagaggggaggggagcu

SEQ ID NO: 891510 - RNA, 20 nt, Human
ggagaggggaggggagcuag

SEQ ID NO: 891511 - RNA, 18 nt, Human
gggagaggggaggggagc

SEQ ID NO: 891512 - RNA, 18 nt, Human
ggggaggggagcuaguag

SEQ ID NO: 891513 - RNA, 19 nt, Human
uaaaaaagagaagaagaaa

SEQ ID NO: 891514 - RNA, 22 nt, Human
uaagaagucagcauaguggcac

SEQ ID NO: 891515 - RNA, 20 nt, Human
uaauaggcgauaaaucugau

SEQ ID NO: 891516 - RNA, 23 nt, Human
uagaauaaaagauaaaaagagug

SEQ ID NO: 891517 - RNA, 23 nt, Human
uaugaaaaggaauaagaagucag

SEQ ID NO: 891518 - RNA, 30 nt, Human
ucagcauaguggcacuccugguuuccuuuu

SEQ ID NO: 891519 - RNA, 18 nt, Human
ucagcuaaaaaagagaag

SEQ ID NO: 891520 - RNA, 23 nt, Human
ucagcuaaaaaagagaagaagaa

SEQ ID NO: 891521 - RNA, 21 nt, Human
uccagggagaggggaggggag

SEQ ID NO: 891522 - RNA, 18 nt, Human
ucuaugggaaauacaguc

SEQ ID NO: 891523 - RNA, 20 nt, Human
ugauuuuaaggaaaaaaaaa

SEQ ID NO: 891524 - RNA, 23 nt, Human
uggaaaagaaguaggcauucuuu

SEQ ID NO: 891525 - RNA, 22 nt, Human
uggagugaaagagaaaguucca

SEQ ID NO: 891526 - RNA, 21 nt, Human
uuaauagaauaaaagauaaaa

SEQ ID NO: 891527 - RNA, 19 nt, Human
uuggccccgccacagaaaa

SEQ ID NO: 891528 - RNA, 18 nt, Human
aaaaaggauucuccuggg

SEQ ID NO: 891529 - RNA, 18 nt, Human
aaacacaccucccaacca

SEQ ID NO: 891530 - RNA, 22 nt, Human
aaacacaccucccaaccaaacc

SEQ ID NO: 891531 - RNA, 19 nt, Human
aaacagagacauugggucu

SEQ ID NO: 891532 - RNA, 21 nt, Human
aaagggcaggggaggaaugag

SEQ ID NO: 891533 - RNA, 18 nt, Human
aagaaaacagagacauug

SEQ ID NO: 891534 - RNA, 21 nt, Human
aaggagccaagcccagcucag

SEQ ID NO: 891535 - RNA, 27 nt, Human
aaggagccaagcccagcucagcaacug

SEQ ID NO: 891536 - RNA, 21 nt, Human
acaaagcgaaauuaagacaau

SEQ ID NO: 891537 - RNA, 22 nt, Human
acagugugguggaacgcucggg

SEQ ID NO: 891538 - RNA, 20 nt, Human
accaugucaaacaagagccu

SEQ ID NO: 891539 - RNA, 23 nt, Human
acccuccugaaacugaccucagc

SEQ ID NO: 891540 - RNA, 20 nt, Human
accgggcaaggggccaggcu

SEQ ID NO: 891541 - RNA, 23 nt, Human
accucagcugcagaaacagcuaa

SEQ ID NO: 891542 - RNA, 20 nt, Human
accucaggguccccugauau

SEQ ID NO: 891543 - RNA, 26 nt, Human
accugcucagucuuggggcaaguccc

SEQ ID NO: 891544 - RNA, 20 nt, Human
agaagugagcacagugcccc

SEQ ID NO: 891545 - RNA, 21 nt, Human
agaagugagcacagugccccc

SEQ ID NO: 891546 - RNA, 19 nt, Human
agaauccacuuauucuuuc

SEQ ID NO: 891547 - RNA, 18 nt, Human
agagaaaagggcagggga

SEQ ID NO: 891548 - RNA, 21 nt, Human
aggaggcaugaaguccaaacc

SEQ ID NO: 891549 - RNA, 20 nt, Human
aggcagaggggcugggggcc

SEQ ID NO: 891550 - RNA, 18 nt, Human
aggcaugaaguccaaacc

SEQ ID NO: 891551 - RNA, 27 nt, Human
aggccaagggcggacagugugguggaa

SEQ ID NO: 891552 - RNA, 25 nt, Human
aggccgaggcagaggggcugggggc

SEQ ID NO: 891553 - RNA, 18 nt, Human
aggggcugggggccaggg

SEQ ID NO: 891554 - RNA, 19 nt, Human
agguggggaggaugaaggc

SEQ ID NO: 891555 - RNA, 21 nt, Human
aggugguuugaauauuacagg

SEQ ID NO: 891556 - RNA, 22 nt, Human
aucacaacacugaguacggugc

SEQ ID NO: 891557 - RNA, 25 nt, Human
aucagcuucacccuccugaaacuga

SEQ ID NO: 891558 - RNA, 25 nt, Human
augagaagucccguaaccaacagaa

SEQ ID NO: 891559 - RNA, 19 nt, Human
augaggagcaagagguaaa

SEQ ID NO: 891560 - RNA, 26 nt, Human
caaacacaccagcaaagcuggagacc

SEQ ID NO: 891561 - RNA, 24 nt, Human
caaaccagagagcagcaaggaggc

SEQ ID NO: 891562 - RNA, 21 nt, Human
caagagguaaacacaccuccc

SEQ ID NO: 891563 - RNA, 18 nt, Human
cacacaccaugucaaaca

SEQ ID NO: 891564 - RNA, 21 nt, Human
cacacaccaugucaaacaaga

SEQ ID NO: 891565 - RNA, 19 nt, Human
cacagcuuggcagaccccc

SEQ ID NO: 891566 - RNA, 18 nt, Human
caccaugucaaacaagag

SEQ ID NO: 891567 - RNA, 18 nt, Human
caccugauuuucuucugc

SEQ ID NO: 891568 - RNA, 18 nt, Human
caccuucucccugccaaa

SEQ ID NO: 891569 - RNA, 18 nt, Human
cagaggaggcucuguucc

SEQ ID NO: 891570 - RNA, 24 nt, Human
cagcaacugacaaggccgaggcag

SEQ ID NO: 891571 - RNA, 19 nt, Human
cagccuuuuucuucucucc

SEQ ID NO: 891572 - RNA, 18 nt, Human
cagcuucacccuccugaa

SEQ ID NO: 891573 - RNA, 22 nt, Human
caggggaggaaugaggagcaag

SEQ ID NO: 891574 - RNA, 18 nt, Human
cagugcccccaagaccag

SEQ ID NO: 891575 - RNA, 20 nt, Human
caucacaggguuccaucucc

SEQ ID NO: 891576 - RNA, 18 nt, Human
cauugggucuggagggga

SEQ ID NO: 891577 - RNA, 18 nt, Human
ccaaaccagagagcagca

SEQ ID NO: 891578 - RNA, 21 nt, Human
ccaaccaaaccagagagcagc

SEQ ID NO: 891579 - RNA, 28 nt, Human
ccaaccaaaccagagagcagcaaggagg

SEQ ID NO: 891580 - RNA, 21 nt, Human
ccacacaccaugucaaacaag

SEQ ID NO: 891581 - RNA, 24 nt, Human
ccauccacacaccaugucaaacaa

SEQ ID NO: 891582 - RNA, 26 nt, Human
ccauccacacaccaugucaaacaaga

SEQ ID NO: 891583 - RNA, 24 nt, Human
cccaagaccagacaccugauuuuc

SEQ ID NO: 891584 - RNA, 24 nt, Human
cccccaagaccagacaccugauuu

SEQ ID NO: 891585 - RNA, 19 nt, Human
cccccucuccuucucuguc

SEQ ID NO: 891586 - RNA, 18 nt, Human
ccccucuccuucucuguc

SEQ ID NO: 891587 - RNA, 21 nt, Human
cccuggucuggcccaggcccc

SEQ ID NO: 891588 - RNA, 21 nt, Human
ccuacagaauuggcugagaag

SEQ ID NO: 891589 - RNA, 18 nt, Human
ccucauucagccucuucc

SEQ ID NO: 891590 - RNA, 20 nt, Human
ccuccagcugagcucagcca

SEQ ID NO: 891591 - RNA, 22 nt, Human
ccucccaaccaaaccagagagc

SEQ ID NO: 891592 - RNA, 24 nt, Human
ccuccugaaacugaccucagcugc

SEQ ID NO: 891593 - RNA, 25 nt, Human
ccucgagccgcuuuaacugggccuc

SEQ ID NO: 891594 - RNA, 20 nt, Human
ccuuaugccccaaacacaca

SEQ ID NO: 891595 - RNA, 21 nt, Human
cgagaccgggcaaggggccag

SEQ ID NO: 891596 - RNA, 24 nt, Human
cucaagaucucccccucuccuucu

SEQ ID NO: 891597 - RNA, 23 nt, Human
cucccccucuccuucucugucuc

SEQ ID NO: 891598 - RNA, 22 nt, Human
cuccccuccucccacuugcaaa

SEQ ID NO: 891599 - RNA, 22 nt, Human
cucucccacacugguggcaccc

SEQ ID NO: 891600 - RNA, 24 nt, Human
cugaaacugaccucagcugcagaa

SEQ ID NO: 891601 - RNA, 19 nt, Human
cugugcccauggcagcuga

SEQ ID NO: 891602 - RNA, 18 nt, Human
cuucugcuggagguacac

SEQ ID NO: 891603 - RNA, 25 nt, Human
cuucugcuggagguacacagucacu

SEQ ID NO: 891604 - RNA, 22 nt, Human
cuucugguccugccggaacacu

SEQ ID NO: 891605 - RNA, 18 nt, Human
cuugcagggggggagcug

SEQ ID NO: 891606 - RNA, 18 nt, Human
cuuuaacugggccuccug

SEQ ID NO: 891607 - RNA, 22 nt, Human
cuuuuccagggacucuuuuuca

SEQ ID NO: 891608 - RNA, 26 nt, Human
gaaguccuuucuaucagugcccacuc

SEQ ID NO: 891609 - RNA, 21 nt, Human
gagagcagcaaggaggccugc

SEQ ID NO: 891610 - RNA, 19 nt, Human
gagcccuggucuggcccag

SEQ ID NO: 891611 - RNA, 19 nt, Human
gaggaaugaggagcaagag

SEQ ID NO: 891612 - RNA, 20 nt, Human
gaggcagaggggcugggggc

SEQ ID NO: 891613 - RNA, 20 nt, Human
gagguaaacacaccucccaa

SEQ ID NO: 891614 - RNA, 23 nt, Human
gagguaaacacaccucccaacca

SEQ ID NO: 891615 - RNA, 22 nt, Human
gcacaaagcgaaauuaagacaa

SEQ ID NO: 891616 - RNA, 19 nt, Human
gcaccuucucccugccaaa

SEQ ID NO: 891617 - RNA, 20 nt, Human
gcagugguuuugucuccccu

SEQ ID NO: 891618 - RNA, 22 nt, Human
gcccacuccuguuccucaaacg

SEQ ID NO: 891619 - RNA, 19 nt, Human
gcccucuaucuacauccug

SEQ ID NO: 891620 - RNA, 19 nt, Human
gcccugcucccugcucccc

SEQ ID NO: 891621 - RNA, 20 nt, Human
ggaaaagaaaacagagacau

SEQ ID NO: 891622 - RNA, 23 nt, Human
ggcacccggggcugaaggggggu

SEQ ID NO: 891623 - RNA, 20 nt, Human
ggcagcaccuucggucugag

SEQ ID NO: 891624 - RNA, 18 nt, Human
ggcccugcucccugcucc

SEQ ID NO: 891625 - RNA, 19 nt, Human
ggcccuggccacguggaca

SEQ ID NO: 891626 - RNA, 18 nt, Human
ggccgaggcagaggggcu

SEQ ID NO: 891627 - RNA, 21 nt, Human
ggcuugcagggggggagcugg

SEQ ID NO: 891628 - RNA, 18 nt, Human
gggcaaguccccauccac

SEQ ID NO: 891629 - RNA, 18 nt, Human
gggcaggggaggaaugag

SEQ ID NO: 891630 - RNA, 19 nt, Human
gggcugggggccaggggag

SEQ ID NO: 891631 - RNA, 24 nt, Human
uaccuuugguuucaaaaaugcauu

SEQ ID NO: 891632 - RNA, 24 nt, Human
uauacaccccaaugaaagggcaga

SEQ ID NO: 891633 - RNA, 27 nt, Human
uaucagugcccacuccuguuccucaaa

SEQ ID NO: 891634 - RNA, 25 nt, Human
ucaaaaggaaaagaaaacagagaca

SEQ ID NO: 891635 - RNA, 21 nt, Human
ucagcaacugacaaggccgag

SEQ ID NO: 891636 - RNA, 21 nt, Human
ucauugggagggggcuugugg

SEQ ID NO: 891637 - RNA, 19 nt, Human
uccccagcacucggggucu

SEQ ID NO: 891638 - RNA, 20 nt, Human
uccuggacagcacucagcuu

SEQ ID NO: 891639 - RNA, 20 nt, Human
ucgugguaggucugcagugg

SEQ ID NO: 891640 - RNA, 21 nt, Human
ucuccuggagauagacguugc

SEQ ID NO: 891641 - RNA, 22 nt, Human
ucugccucauucagccucuucc

SEQ ID NO: 891642 - RNA, 21 nt, Human
ucuuucuuuuccagggacucu

SEQ ID NO: 891643 - RNA, 24 nt, Human
ugaaggggggucauugggaggggg

SEQ ID NO: 891644 - RNA, 18 nt, Human
ugagaacugcaggucugc

SEQ ID NO: 891645 - RNA, 19 nt, Human
ugagaacugcaggucugcg

SEQ ID NO: 891646 - RNA, 21 nt, Human
ugagaagaugauaucugcuag

SEQ ID NO: 891647 - RNA, 24 nt, Human
ugagaagaugauaucugcuagaga

SEQ ID NO: 891648 - RNA, 23 nt, Human
ugagcacagugcccccaagacca

SEQ ID NO: 891649 - RNA, 19 nt, Human
ugaggcuagguaccuuugg

SEQ ID NO: 891650 - RNA, 19 nt, Human
ugauauguauacaccccaa

SEQ ID NO: 891651 - RNA, 24 nt, Human
ugcaaaaaggauucuccuggggga

SEQ ID NO: 891652 - RNA, 25 nt, Human
ugcggagggaagguaaacuccagga

SEQ ID NO: 891653 - RNA, 23 nt, Human
uggcagccggagaggcucaaauc

SEQ ID NO: 891654 - RNA, 25 nt, Human
uggcccaggcccccuggcuggcagc

SEQ ID NO: 891655 - RNA, 19 nt, Human
uggcugcgagaccgggcaa

SEQ ID NO: 891656 - RNA, 18 nt, Human
uggcugugccuggguggg

SEQ ID NO: 891657 - RNA, 21 nt, Human
uggcuucgugguaggucugca

SEQ ID NO: 891658 - RNA, 19 nt, Human
uggcuugguggcuacuggu

SEQ ID NO: 891659 - RNA, 18 nt, Human
ugggaacuccagggacag

SEQ ID NO: 891660 - RNA, 20 nt, Human
ugggagggggcuugugggug

SEQ ID NO: 891661 - RNA, 18 nt, Human
uggggaggaugaaggcag

SEQ ID NO: 891662 - RNA, 23 nt, Human
ugggggccaggggaggcauaugg

SEQ ID NO: 891663 - RNA, 18 nt, Human
ugguauggauucaauccu

SEQ ID NO: 891664 - RNA, 24 nt, Human
ugguggaacgcucgggguggcugc

SEQ ID NO: 891665 - RNA, 23 nt, Human
uuagacucaagaucucccccucu

SEQ ID NO: 891666 - RNA, 22 nt, Human
uuccuggggaucagcuucaccc

SEQ ID NO: 891667 - RNA, 21 nt, Human
uugcuggaggcuucaaggcuu

SEQ ID NO: 891668 - RNA, 25 nt, Human
aaaaaaaaaaaaaagaacagaaaag

SEQ ID NO: 891669 - RNA, 24 nt, Human
aaaaaagauuccuucacuuuggcc

SEQ ID NO: 891670 - RNA, 24 nt, Human
aaaaagaauuaucuuaguucugga

SEQ ID NO: 891671 - RNA, 26 nt, Human
aaaaagaggugaaaaguaagggaccc

SEQ ID NO: 891672 - RNA, 24 nt, Human
aaacaaaaagaaggaaaaaucugg

SEQ ID NO: 891673 - RNA, 22 nt, Human
aaacacacauuagauauaaacc

SEQ ID NO: 891674 - RNA, 22 nt, Human
aaacagauauuguaacagaaau

SEQ ID NO: 891675 - RNA, 23 nt, Human
aaacagguaaaaagcaaaccuca

SEQ ID NO: 891676 - RNA, 23 nt, Human
aaacaugagaaaaaagagaaaaa

SEQ ID NO: 891677 - RNA, 19 nt, Human
aaaccauccaaaacuugaa

SEQ ID NO: 891678 - RNA, 20 nt, Human
aaacccauuucuuaauuagg

SEQ ID NO: 891679 - RNA, 20 nt, Human
aaaccccacccccccucacc

SEQ ID NO: 891680 - RNA, 22 nt, Human
aaaccccaucucuacuaaaaaa

SEQ ID NO: 891681 - RNA, 22 nt, Human
aaacgagaacacuuaaauguaa

SEQ ID NO: 891682 - RNA, 22 nt, Human
aaacggacaaggauaccaaaac

SEQ ID NO: 891683 - RNA, 23 nt, Human
aaagaaacaauucuagcaaugua

SEQ ID NO: 891684 - RNA, 19 nt, Human
aaagaaagggguggaggug

SEQ ID NO: 891685 - RNA, 19 nt, Human
aaagagaaaaagcaaaaga

SEQ ID NO: 891686 - RNA, 20 nt, Human
aaagagaaaaagcaaaagag

SEQ ID NO: 891687 - RNA, 23 nt, Human
aaagagauaagcuccaagcauua

SEQ ID NO: 891688 - RNA, 20 nt, Human
aaagagcccauucaaagaac

SEQ ID NO: 891689 - RNA, 23 nt, Human
aaagcagcccuaucccaaaggua

SEQ ID NO: 891690 - RNA, 21 nt, Human
aaagggagggaggaaggaaag

SEQ ID NO: 891691 - RNA, 24 nt, Human
aaauacucaauaaagacauaacaa

SEQ ID NO: 891692 - RNA, 18 nt, Human
aaauagauucucagucau

SEQ ID NO: 891693 - RNA, 19 nt, Human
aaauagugaaaaaugaaau

SEQ ID NO: 891694 - RNA, 19 nt, Human
aacaaaccccacccccccu

SEQ ID NO: 891695 - RNA, 20 nt, Human
aacaaaccccacccccccuc

SEQ ID NO: 891696 - RNA, 20 nt, Human
aacaguuuuucuuuuuucug

SEQ ID NO: 891697 - RNA, 19 nt, Human
aacauggcaaaaccccauc

SEQ ID NO: 891698 - RNA, 21 nt, Human
aacauggcaaaaccccaucuc

SEQ ID NO: 891699 - RNA, 21 nt, Human
aacauggcaaaaccccaucuc

SEQ ID NO: 891700 - RNA, 22 nt, Human
aacauuaucucaacacauagaa

SEQ ID NO: 891701 - RNA, 23 nt, Human
aaccaacaccacaauuccgcaca

SEQ ID NO: 891702 - RNA, 21 nt, Human
aaccacuugagaacagguuaa

SEQ ID NO: 891703 - RNA, 21 nt, Human
aagaacacccaaaacuguaua

SEQ ID NO: 891704 - RNA, 24 nt, Human
aagaagaaaacauucaaauuuuuc

SEQ ID NO: 891705 - RNA, 25 nt, Human
aagaagaaaacauucaaauuuuucu

SEQ ID NO: 891706 - RNA, 19 nt, Human
aagaagaaaagguggcuca

SEQ ID NO: 891707 - RNA, 23 nt, Human
aagaagcaucuaugaagcagaga

SEQ ID NO: 891708 - RNA, 21 nt, Human
aagagcccauucaaagaacaa

SEQ ID NO: 891709 - RNA, 20 nt, Human
aagaggagggagcugaagaa

SEQ ID NO: 891710 - RNA, 25 nt, Human
aagcagacacauucauuagaucaaa

SEQ ID NO: 891711 - RNA, 21 nt, Human
aagcagcccuaucccaaaggu

SEQ ID NO: 891712 - RNA, 20 nt, Human
aagcaucuaugaagcagaga

SEQ ID NO: 891713 - RNA, 24 nt, Human
aagcugaauuuacaugaagaacaa

SEQ ID NO: 891714 - RNA, 19 nt, Human
aagcugccuuuagcccacu

SEQ ID NO: 891715 - RNA, 18 nt, Human
aagcuuguauuacacugc

SEQ ID NO: 891716 - RNA, 20 nt, Human
aaggagaaacaaagaaggca

SEQ ID NO: 891717 - RNA, 19 nt, Human
aaggcagggaggaggggga

SEQ ID NO: 891718 - RNA, 18 nt, Human
aaggcauagaauacagaa

SEQ ID NO: 891719 - RNA, 22 nt, Human
aaggcuugugggaaccaucagg

SEQ ID NO: 891720 - RNA, 25 nt, Human
aagggaagaagggaggcagggaggg

SEQ ID NO: 891721 - RNA, 29 nt, Human
aagguaagcagacacauucauuagaucaa

SEQ ID NO: 891722 - RNA, 24 nt, Human
aagugaauuuauacucacugcaga

SEQ ID NO: 891723 - RNA, 21 nt, Human
aaguggccaaagaugcuacag

SEQ ID NO: 891724 - RNA, 22 nt, Human
aauacaaaauauagcuuuccaa

SEQ ID NO: 891725 - RNA, 24 nt, Human
aaucgcuugaaccugggaggugga

SEQ ID NO: 891726 - RNA, 20 nt, Human
aauggaaaaaguaaaagcug

SEQ ID NO: 891727 - RNA, 19 nt, Human
aauggcauaaaaauaaaug

SEQ ID NO: 891728 - RNA, 23 nt, Human
acaaaaauguaacccuuauauca

SEQ ID NO: 891729 - RNA, 20 nt, Human
acaaaggaagaucaucccaa

SEQ ID NO: 891730 - RNA, 22 nt, Human
acaacccuguaaagccuaaggc

SEQ ID NO: 891731 - RNA, 22 nt, Human
acaauaaaccucuugcuaaacc

SEQ ID NO: 891732 - RNA, 23 nt, Human
acacacacacacacacacacaca

SEQ ID NO: 891733 - RNA, 23 nt, Human
acacacacacacacacacacagu

SEQ ID NO: 891734 - RNA, 23 nt, Human
acacacacacacacacacacaua

SEQ ID NO: 891735 - RNA, 23 nt, Human
acacacacacacacacacauaca

SEQ ID NO: 891736 - RNA, 23 nt, Human
acacacacacacacacauacaca

SEQ ID NO: 891737 - RNA, 27 nt, Human
acacacacacacacacauacacacaca

SEQ ID NO: 891738 - RNA, 23 nt, Human
acacacacacauacacacacaca

SEQ ID NO: 891739 - RNA, 23 nt, Human
acacacauacacacacacacaca

SEQ ID NO: 891740 - RNA, 24 nt, Human
acagagcaagacuccaucucaaaa

SEQ ID NO: 891741 - RNA, 21 nt, Human
acaguuuuucuuuuuucuguu

SEQ ID NO: 891742 - RNA, 22 nt, Human
acauaaaauacacuguaucucu

SEQ ID NO: 891743 - RNA, 19 nt, Human
acauacacacacacacaca

SEQ ID NO: 891744 - RNA, 24 nt, Human
acaucaaggaacuaacugccugau

SEQ ID NO: 891745 - RNA, 18 nt, Human
accccaucucuacuaaaa

SEQ ID NO: 891746 - RNA, 22 nt, Human
accugcuggguuugcuuugucu

SEQ ID NO: 891747 - RNA, 24 nt, Human
accugggagguggaggcugcagug

SEQ ID NO: 891748 - RNA, 24 nt, Human
acuaaaacaaugcaggaaagaaaa

SEQ ID NO: 891749 - RNA, 22 nt, Human
acuagagcagcucccaacaguu

SEQ ID NO: 891750 - RNA, 23 nt, Human
acuccccuccuaccuuuggaggc

SEQ ID NO: 891751 - RNA, 20 nt, Human
acugaguuuuugcucuugcu

SEQ ID NO: 891752 - RNA, 18 nt, Human
acuggacacagaagucug

SEQ ID NO: 891753 - RNA, 22 nt, Human
acuucagaacagcaccguucau

SEQ ID NO: 891754 - RNA, 26 nt, Human
agaaaaaaaaaaaaaaaagaacagaa

SEQ ID NO: 891755 - RNA, 25 nt, Human
agaaaaaagagaaaaagcaaaagag

SEQ ID NO: 891756 - RNA, 19 nt, Human
agaaaauaaugaagaacaa

SEQ ID NO: 891757 - RNA, 19 nt, Human
agaaagagauaagcuccaa

SEQ ID NO: 891758 - RNA, 20 nt, Human
agaaaggagggagggaggaa

SEQ ID NO: 891759 - RNA, 20 nt, Human
agaaaggagggagggaggaa

SEQ ID NO: 891760 - RNA, 21 nt, Human
agaaagggguggagguggagg

SEQ ID NO: 891761 - RNA, 22 nt, Human
agaacaucagacaaacucacaa

SEQ ID NO: 891762 - RNA, 19 nt, Human
agaagaaaagguggcucac

SEQ ID NO: 891763 - RNA, 18 nt, Human
agaagggaggcagggagg

SEQ ID NO: 891764 - RNA, 19 nt, Human
agaagggaggcagggaggg

SEQ ID NO: 891765 - RNA, 25 nt, Human
agaagggaggcagggaggggaggaa

SEQ ID NO: 891766 - RNA, 24 nt, Human
agacaaacucacaaauuuaccaca

SEQ ID NO: 891767 - RNA, 22 nt, Human
agacagagccgagagaagcgag

SEQ ID NO: 891768 - RNA, 20 nt, Human
agacauaacaaaccccaccc

SEQ ID NO: 891769 - RNA, 27 nt, Human
agacauaacaaaccccacccccccuca

SEQ ID NO: 891770 - RNA, 18 nt, Human
agagaaaaagggaauaag

SEQ ID NO: 891771 - RNA, 22 nt, Human
agagaaaggaaggggagaggga

SEQ ID NO: 891772 - RNA, 24 nt, Human
agagcagcucccaacaguuugccu

SEQ ID NO: 891773 - RNA, 18 nt, Human
agaugaagacaaauuuag

SEQ ID NO: 891774 - RNA, 20 nt, Human
agcaaaagagcccauucaaa

SEQ ID NO: 891775 - RNA, 23 nt, Human
agcacuuugggacgccgaggcag

SEQ ID NO: 891776 - RNA, 19 nt, Human
agcagagcugagcgcagga

SEQ ID NO: 891777 - RNA, 22 nt, Human
agcagcaacaacagcuggagga

SEQ ID NO: 891778 - RNA, 18 nt, Human
agccuggccaacauggca

SEQ ID NO: 891779 - RNA, 24 nt, Human
agccuggccaacauggcaaaaccc

SEQ ID NO: 891780 - RNA, 21 nt, Human
agcggcgguggcggcggcacc

SEQ ID NO: 891781 - RNA, 21 nt, Human
agcggcgguggcggcggcacc

SEQ ID NO: 891782 - RNA, 20 nt, Human
agcgggagggggggagcggc

SEQ ID NO: 891783 - RNA, 20 nt, Human
agcgggagggggggagcggc

SEQ ID NO: 891784 - RNA, 23 nt, Human
aggaaaaacagguaaaaagcaaa

SEQ ID NO: 891785 - RNA, 23 nt, Human
aggaaaaugagacauaagcaugu

SEQ ID NO: 891786 - RNA, 31 nt, Human
aggaaacacacacacacacacacacacauag

SEQ ID NO: 891787 - RNA, 22 nt, Human
aggaaagaaaauaaugaagaac

SEQ ID NO: 891788 - RNA, 23 nt, Human
aggaaagaaaauaaugaagaaca

SEQ ID NO: 891789 - RNA, 24 nt, Human
aggaaagaaaauaaugaagaacaa

SEQ ID NO: 891790 - RNA, 26 nt, Human
aggaaauggcaaaccguaucccaaaa

SEQ ID NO: 891791 - RNA, 22 nt, Human
aggaaauugcauuauuagcaca

SEQ ID NO: 891792 - RNA, 19 nt, Human
aggaagaggagggagcuga

SEQ ID NO: 891793 - RNA, 20 nt, Human
aggaaggaagggagaaagga

SEQ ID NO: 891794 - RNA, 23 nt, Human
aggagggagggaggaauaaggga

SEQ ID NO: 891795 - RNA, 19 nt, Human
aggcaaaauaugacuuuga

SEQ ID NO: 891796 - RNA, 23 nt, Human
aggcaaaauuaacaaaaaccaag

SEQ ID NO: 891797 - RNA, 26 nt, Human
aggcaaagauggaggaagagggaccc

SEQ ID NO: 891798 - RNA, 22 nt, Human
aggcaggagaaucgcuugaacc

SEQ ID NO: 891799 - RNA, 24 nt, Human
aggcaggagaaucgcuugaaccug

SEQ ID NO: 891800 - RNA, 25 nt, Human
aggcagggaggagggggagauggaa

SEQ ID NO: 891801 - RNA, 22 nt, Human
aggcagguggaucacuggaggg

SEQ ID NO: 891802 - RNA, 18 nt, Human
aggcaucccacggguggc

SEQ ID NO: 891803 - RNA, 20 nt, Human
aggcugaggcaggagaaucg

SEQ ID NO: 891804 - RNA, 24 nt, Human
aggcugaggcaggagaaucgcuug

SEQ ID NO: 891805 - RNA, 25 nt, Human
agggaagaaaacaugagaaaaaaga

SEQ ID NO: 891806 - RNA, 22 nt, Human
agggaagaaauggagaaaagaa

SEQ ID NO: 891807 - RNA, 26 nt, Human
agggaagaaauggagaaaagggaccc

SEQ ID NO: 891808 - RNA, 22 nt, Human
agggaagaagggaggcagggag

SEQ ID NO: 891809 - RNA, 19 nt, Human
agggaggaauaagggaagg

SEQ ID NO: 891810 - RNA, 22 nt, Human
agggaggagggggagauggaag

SEQ ID NO: 891811 - RNA, 21 nt, Human
agggaggcagggaggggagga

SEQ ID NO: 891812 - RNA, 25 nt, Human
agggagggaggaauaagggaaggag

SEQ ID NO: 891813 - RNA, 22 nt, Human
aggggaagggggagagccaaag

SEQ ID NO: 891814 - RNA, 22 nt, Human
aggggaagggggagagccaaag

SEQ ID NO: 891815 - RNA, 19 nt, Human
aggggagagggagggagaa

SEQ ID NO: 891816 - RNA, 20 nt, Human
aggggccuggcuggcccggg

SEQ ID NO: 891817 - RNA, 21 nt, Human
aggggccuggcuggcccgggg

SEQ ID NO: 891818 - RNA, 22 nt, Human
aggggcugggggagaagagaua

SEQ ID NO: 891819 - RNA, 20 nt, Human
agggguggagguggagggaa

SEQ ID NO: 891820 - RNA, 18 nt, Human
agggucaugaagccagua

SEQ ID NO: 891821 - RNA, 18 nt, Human
aggguuagaauuuuacau

SEQ ID NO: 891822 - RNA, 20 nt, Human
agguaaaaagcaaaccucaa

SEQ ID NO: 891823 - RNA, 24 nt, Human
agguggaggcugcagugagcugag

SEQ ID NO: 891824 - RNA, 22 nt, Human
agguggagggggaacuccacgg

SEQ ID NO: 891825 - RNA, 22 nt, Human
agguggagggggaacuccacgg

SEQ ID NO: 891826 - RNA, 23 nt, Human
aguaagugguaggaaaaugccaa

SEQ ID NO: 891827 - RNA, 18 nt, Human
agucauuuuagaaaaauc

SEQ ID NO: 891828 - RNA, 18 nt, Human
agugaccacuucaaacug

SEQ ID NO: 891829 - RNA, 22 nt, Human
agugcaguauuaacaaucaucc

SEQ ID NO: 891830 - RNA, 24 nt, Human
aguggagggugccuguaauccugg

SEQ ID NO: 891831 - RNA, 18 nt, Human
agugucaucgcccggacg

SEQ ID NO: 891832 - RNA, 24 nt, Human
aguuggcuauccaaaagaaaaggg

SEQ ID NO: 891833 - RNA, 18 nt, Human
auaaagcccuuaaaaacu

SEQ ID NO: 891834 - RNA, 18 nt, Human
auaacaaaccccaccccc

SEQ ID NO: 891835 - RNA, 33 nt, Human
auaaggaaacacacacacacacacacacacagu

SEQ ID NO: 891836 - RNA, 21 nt, Human
auaaucaggcuuuaccuaaac

SEQ ID NO: 891837 - RNA, 21 nt, Human
auacaaaauauagcuuuccaa

SEQ ID NO: 891838 - RNA, 20 nt, Human
auagaauacagaaaggccag

SEQ ID NO: 891839 - RNA, 25 nt, Human
auagauaaccagguuaagcugaauu

SEQ ID NO: 891840 - RNA, 18 nt, Human
auagauauauauaaaaag

SEQ ID NO: 891841 - RNA, 24 nt, Human
auagugagcaaagacugaauggcu

SEQ ID NO: 891842 - RNA, 19 nt, Human
auauauguauauauauaaa

SEQ ID NO: 891843 - RNA, 19 nt, Human
augaaaauucugugauggg

SEQ ID NO: 891844 - RNA, 18 nt, Human
augaagaacaaaaguaaa

SEQ ID NO: 891845 - RNA, 19 nt, Human
augccuguaauccuagcac

SEQ ID NO: 891846 - RNA, 20 nt, Human
augcuacaacugccaaguuc

SEQ ID NO: 891847 - RNA, 24 nt, Human
caaaaaauaaaaauaaaaggcaag

SEQ ID NO: 891848 - RNA, 27 nt, Human
caaaagccauuacuugacuaaaacaau

SEQ ID NO: 891849 - RNA, 21 nt, Human
caaaccucaacgcuacucuuc

SEQ ID NO: 891850 - RNA, 21 nt, Human
caaauagauucucagucauca

SEQ ID NO: 891851 - RNA, 18 nt, Human
caacuccuaauaauuccu

SEQ ID NO: 891852 - RNA, 22 nt, Human
caagaaguacacuaacauaaac

SEQ ID NO: 891853 - RNA, 21 nt, Human
caagacuccaucucaaaaaaa

SEQ ID NO: 891854 - RNA, 21 nt, Human
caagcugaauguucuaaaaug

SEQ ID NO: 891855 - RNA, 18 nt, Human
caaggcacuccaucugac

SEQ ID NO: 891856 - RNA, 20 nt, Human
caauguacucacucaguaca

SEQ ID NO: 891857 - RNA, 19 nt, Human
cacaaauaucaaccacuga

SEQ ID NO: 891858 - RNA, 20 nt, Human
cacacacacacacacacaca

SEQ ID NO: 891859 - RNA, 20 nt, Human
cacacacacacacacacaca

SEQ ID NO: 891860 - RNA, 25 nt, Human
cacacacacacacacacacacauac

SEQ ID NO: 891861 - RNA, 20 nt, Human
cacacacacacacacacaua

SEQ ID NO: 891862 - RNA, 26 nt, Human
cacacacacacacacacauacacaca

SEQ ID NO: 891863 - RNA, 19 nt, Human
cacacacacacacacauac

SEQ ID NO: 891864 - RNA, 28 nt, Human
cacacacacacauacacacacacacaca

SEQ ID NO: 891865 - RNA, 22 nt, Human
cacacacacauacacacacaca

SEQ ID NO: 891866 - RNA, 22 nt, Human
cacacacauacacacacacaca

SEQ ID NO: 891867 - RNA, 23 nt, Human
cacaggugguagugagaagcagg

SEQ ID NO: 891868 - RNA, 21 nt, Human
cacccuagauuaaaguggcca

SEQ ID NO: 891869 - RNA, 18 nt, Human
caccuccucuccgggacc

SEQ ID NO: 891870 - RNA, 18 nt, Human
caccuccucuccgggacc

SEQ ID NO: 891871 - RNA, 22 nt, Human
cacggggaaagcagcccuaucc

SEQ ID NO: 891872 - RNA, 24 nt, Human
cacugggccgaggaccgaggaaac

SEQ ID NO: 891873 - RNA, 20 nt, Human
cagaaaaguagccuucaaca

SEQ ID NO: 891874 - RNA, 21 nt, Human
cagauaagaccuaccauuagc

SEQ ID NO: 891875 - RNA, 18 nt, Human
cagauacaacuuucucau

SEQ ID NO: 891876 - RNA, 21 nt, Human
cagcaacaacagcuggaggag

SEQ ID NO: 891877 - RNA, 21 nt, Human
cagcagcaacaacagcuggag

SEQ ID NO: 891878 - RNA, 23 nt, Human
cagcucuaugaaaauucugugau

SEQ ID NO: 891879 - RNA, 19 nt, Human
caggacggggaaggggaag

SEQ ID NO: 891880 - RNA, 19 nt, Human
caggacggggaaggggaag

SEQ ID NO: 891881 - RNA, 18 nt, Human
cauaaaauacacuguauc

SEQ ID NO: 891882 - RNA, 19 nt, Human
cauaaagguaacaugauca

SEQ ID NO: 891883 - RNA, 18 nt, Human
caucaaggaacuaacugc

SEQ ID NO: 891884 - RNA, 20 nt, Human
caucaaggaacuaacugccu

SEQ ID NO: 891885 - RNA, 19 nt, Human
caucccaaaacaaaaagaa

SEQ ID NO: 891886 - RNA, 24 nt, Human
caucuuggaaucaggauuuucuuc

SEQ ID NO: 891887 - RNA, 24 nt, Human
caugccuguaauccuagcacuuug

SEQ ID NO: 891888 - RNA, 23 nt, Human
ccaaaagaaaagggacauaacaa

SEQ ID NO: 891889 - RNA, 21 nt, Human
ccaaagguagaacuauccuga

SEQ ID NO: 891890 - RNA, 21 nt, Human
ccacaauuccgcacaguucaa

SEQ ID NO: 891891 - RNA, 21 nt, Human
ccacaugccaaaaggaaaaug

SEQ ID NO: 891892 - RNA, 20 nt, Human
ccaccuggcuguucuagagg

SEQ ID NO: 891893 - RNA, 19 nt, Human
ccaggucuagguccgcgcu

SEQ ID NO: 891894 - RNA, 20 nt, Human
ccauagcauuugaucuagau

SEQ ID NO: 891895 - RNA, 22 nt, Human
ccaucucaaaaaaaaaaaagaa

SEQ ID NO: 891896 - RNA, 18 nt, Human
cccaaaacaaaaagaagg

SEQ ID NO: 891897 - RNA, 25 nt, Human
cccaaaacaaaaagaaggaaaaauc

SEQ ID NO: 891898 - RNA, 19 nt, Human
cccaaagguagaacuaucc

SEQ ID NO: 891899 - RNA, 23 nt, Human
cccaucucuacuaaaaaaauaca

SEQ ID NO: 891900 - RNA, 22 nt, Human
cccccagagaacaaacugaaaa

SEQ ID NO: 891901 - RNA, 18 nt, Human
ccccggggagggaaaagg

SEQ ID NO: 891902 - RNA, 19 nt, Human
cccggcccgagggcagcgg

SEQ ID NO: 891903 - RNA, 19 nt, Human
cccggcccgagggcagcgg

SEQ ID NO: 891904 - RNA, 21 nt, Human
cccugugcugcaggauugcua

SEQ ID NO: 891905 - RNA, 18 nt, Human
ccgccaccgccgccgccg

SEQ ID NO: 891906 - RNA, 21 nt, Human
ccgcugccuccuccucgaggg

SEQ ID NO: 891907 - RNA, 22 nt, Human
ccuaagacaguacucucugccc

SEQ ID NO: 891908 - RNA, 20 nt, Human
ccuaggaaaauaauaacaau

SEQ ID NO: 891909 - RNA, 19 nt, Human
ccuccacacagucuaaggc

SEQ ID NO: 891910 - RNA, 22 nt, Human
ccucgaggguagugacuuccac

SEQ ID NO: 891911 - RNA, 22 nt, Human
ccucgaggguagugacuuccac

SEQ ID NO: 891912 - RNA, 22 nt, Human
ccugagagacagagcaagacuc

SEQ ID NO: 891913 - RNA, 24 nt, Human
ccuggccaacauggcaaaacccca

SEQ ID NO: 891914 - RNA, 19 nt, Human
ccugggagguggaggcugc

SEQ ID NO: 891915 - RNA, 22 nt, Human
ccuguaauccuggcuacuuggg

SEQ ID NO: 891916 - RNA, 22 nt, Human
ccugugcugcaggauugcuagg

SEQ ID NO: 891917 - RNA, 19 nt, Human
ccuuuggaggcugaaauuu

SEQ ID NO: 891918 - RNA, 23 nt, Human
cgagggcaucgcagcucgaccca

SEQ ID NO: 891919 - RNA, 18 nt, Human
cgcaggcgcggagggggg

SEQ ID NO: 891920 - RNA, 25 nt, Human
cgcggaagagccguggcggcccccg

SEQ ID NO: 891921 - RNA, 18 nt, Human
cggcaagaagccuguacu

SEQ ID NO: 891922 - RNA, 18 nt, Human
cggcccccggagggcggg

SEQ ID NO: 891923 - RNA, 19 nt, Human
cgggagggggggagcggcg

SEQ ID NO: 891924 - RNA, 24 nt, Human
cggugaccaggagagggguucagg

SEQ ID NO: 891925 - RNA, 20 nt, Human
cuaaaaaaauacaaaaaaaa

SEQ ID NO: 891926 - RNA, 20 nt, Human
cuacuaaaaaaauacaaaaa

SEQ ID NO: 891927 - RNA, 24 nt, Human
cucaugccuguaauccuagcacuu

SEQ ID NO: 891928 - RNA, 19 nt, Human
cuccaucucaaaaaaaaaa

SEQ ID NO: 891929 - RNA, 20 nt, Human
cucggugaccaggagagggg

SEQ ID NO: 891930 - RNA, 20 nt, Human
cucggugaccaggagagggg

SEQ ID NO: 891931 - RNA, 20 nt, Human
cucuagccugagagacagag

SEQ ID NO: 891932 - RNA, 19 nt, Human
cucucccaaagaaacaauu

SEQ ID NO: 891933 - RNA, 19 nt, Human
cucucugauugugcugggg

SEQ ID NO: 891934 - RNA, 24 nt, Human
cugaagcacuggauuguguggcug

SEQ ID NO: 891935 - RNA, 19 nt, Human
cugaguggaagaaaaacuc

SEQ ID NO: 891936 - RNA, 19 nt, Human
cugcagcuguuuacagaaa

SEQ ID NO: 891937 - RNA, 22 nt, Human
cugcagugagcugagaucgcac

SEQ ID NO: 891938 - RNA, 24 nt, Human
cugcucuagccugagagacagagc

SEQ ID NO: 891939 - RNA, 23 nt, Human
cuggccaacauggcaaaacccca

SEQ ID NO: 891940 - RNA, 22 nt, Human
cugggccgaggaccgaggaaac

SEQ ID NO: 891941 - RNA, 20 nt, Human
cugguggcggcgagccugag

SEQ ID NO: 891942 - RNA, 18 nt, Human
cuuccugccggcgcggcc

SEQ ID NO: 891943 - RNA, 19 nt, Human
cuugaaccugggaggugga

SEQ ID NO: 891944 - RNA, 22 nt, Human
cuuuuaguaagugguaggaaaa

SEQ ID NO: 891945 - RNA, 24 nt, Human
cuuuucuguucguggagcuaaaag

SEQ ID NO: 891946 - RNA, 21 nt, Human
cuuuuuuuuuuuuuuuccuuu

SEQ ID NO: 891947 - RNA, 22 nt, Human
cuuuuuuuuuuuuuuuccuuuu

SEQ ID NO: 891948 - RNA, 18 nt, Human
gaaaaacagguaaaaagc

SEQ ID NO: 891949 - RNA, 19 nt, Human
gaaaaacagguaaaaagca

SEQ ID NO: 891950 - RNA, 26 nt, Human
gaaaaagcaaaagagcccauucaaag

SEQ ID NO: 891951 - RNA, 21 nt, Human
gaaaacguaauucaaugccuc

SEQ ID NO: 891952 - RNA, 18 nt, Human
gaaacgagaaaugcccaa

SEQ ID NO: 891953 - RNA, 21 nt, Human
gaaaggaaggggagagggagg

SEQ ID NO: 891954 - RNA, 20 nt, Human
gaacagaaaaguagccuuca

SEQ ID NO: 891955 - RNA, 18 nt, Human
gaagaacgcauuuaacug

SEQ ID NO: 891956 - RNA, 24 nt, Human
gaagaagauuagaacaauuaugga

SEQ ID NO: 891957 - RNA, 23 nt, Human
gaagaugaauacucuuuguagcc

SEQ ID NO: 891958 - RNA, 21 nt, Human
gaagggaggcagggaggggag

SEQ ID NO: 891959 - RNA, 20 nt, Human
gaccaggagagggguucagg

SEQ ID NO: 891960 - RNA, 21 nt, Human
gagaaaaaagagaaaaagcaa

SEQ ID NO: 891961 - RNA, 23 nt, Human
gagaaaaaagagaaaaagcaaaa

SEQ ID NO: 891962 - RNA, 23 nt, Human
gagaaucgcuugaaccugggagg

SEQ ID NO: 891963 - RNA, 18 nt, Human
gagacagagccgagagaa

SEQ ID NO: 891964 - RNA, 23 nt, Human
gagacagagccgagagaagcgag

SEQ ID NO: 891965 - RNA, 21 nt, Human
gagagggagggagaauaugag

SEQ ID NO: 891966 - RNA, 21 nt, Human
gagagggagggagaauaugag

SEQ ID NO: 891967 - RNA, 18 nt, Human
gagccgagagaagcgaga

SEQ ID NO: 891968 - RNA, 19 nt, Human
gaggaaagggagggaggaa

SEQ ID NO: 891969 - RNA, 18 nt, Human
gaggagggggagauggaa

SEQ ID NO: 891970 - RNA, 23 nt, Human
gaggcagggaggggaggaaaggg

SEQ ID NO: 891971 - RNA, 19 nt, Human
gaggcagguggaucacugg

SEQ ID NO: 891972 - RNA, 23 nt, Human
gaggcugcagugagcugagaucg

SEQ ID NO: 891973 - RNA, 24 nt, Human
gagggggggagcggcgguggcggc

SEQ ID NO: 891974 - RNA, 24 nt, Human
gagggggggagcggcgguggcggc

SEQ ID NO: 891975 - RNA, 30 nt, Human
gagggggggagcggcgguggcggcggcaac

SEQ ID NO: 891976 - RNA, 19 nt, Human
gagguacugaauuacacaa

SEQ ID NO: 891977 - RNA, 20 nt, Human
gagguucugaugagcaagaa

SEQ ID NO: 891978 - RNA, 24 nt, Human
gaucacuggagguuaggaguucga

SEQ ID NO: 891979 - RNA, 18 nt, Human
gcaagaacacccaaaacu

SEQ ID NO: 891980 - RNA, 19 nt, Human
gcacagcgcaggcgcggag

SEQ ID NO: 891981 - RNA, 21 nt, Human
gcagcaacaugggccucgcuu

SEQ ID NO: 891982 - RNA, 20 nt, Human
gcaggagacagagccgagag

SEQ ID NO: 891983 - RNA, 21 nt, Human
gcauagaauacagaaaggcca

SEQ ID NO: 891984 - RNA, 25 nt, Human
gccaauuaauaauaacaauaacaac

SEQ ID NO: 891985 - RNA, 22 nt, Human
gccgcugccuccuccucgaggg

SEQ ID NO: 891986 - RNA, 20 nt, Human
gccuaaggcuugugggaacc

SEQ ID NO: 891987 - RNA, 25 nt, Human
gcggcgguggcggcggcaccuccuc

SEQ ID NO: 891988 - RNA, 21 nt, Human
gcgggagggggggagcggcgg

SEQ ID NO: 891989 - RNA, 21 nt, Human
gcgggagggggggagcggcgg

SEQ ID NO: 891990 - RNA, 21 nt, Human
gcuaaaccacagaagucagca

SEQ ID NO: 891991 - RNA, 24 nt, Human
gcuaaaccccuuaguagaaaccca

SEQ ID NO: 891992 - RNA, 21 nt, Human
gcuacaacugccaaguucugg

SEQ ID NO: 891993 - RNA, 20 nt, Human
gcucaccugagucucuccca

SEQ ID NO: 891994 - RNA, 27 nt, Human
gcucugaaaucccaacuaugaaagcca

SEQ ID NO: 891995 - RNA, 21 nt, Human
gcugcagugagcugagaucgc

SEQ ID NO: 891996 - RNA, 22 nt, Human
gcugcugcuguuccugagccgg

SEQ ID NO: 891997 - RNA, 26 nt, Human
gcugggggagaagagauacacugaga

SEQ ID NO: 891998 - RNA, 22 nt, Human
gcuguguaaacaaaaccaacac

SEQ ID NO: 891999 - RNA, 22 nt, Human
ggaaaaacagguaaaaagcaaa

SEQ ID NO: 892000 - RNA, 24 nt, Human
ggaaagcagcccuaucccaaaggu

SEQ ID NO: 892001 - RNA, 19 nt, Human
ggaagaacgcauuuaacug

SEQ ID NO: 892002 - RNA, 18 nt, Human
ggaccccagaggccggcg

SEQ ID NO: 892003 - RNA, 22 nt, Human
ggacuaggcaaagauggaggaa

SEQ ID NO: 892004 - RNA, 21 nt, Human
ggagcggcgguggcggcggca

SEQ ID NO: 892005 - RNA, 21 nt, Human
ggaggagggggagauggaagg

SEQ ID NO: 892006 - RNA, 18 nt, Human
ggaggcugcagugagcug

SEQ ID NO: 892007 - RNA, 24 nt, Human
ggaggcugcagugagcugagaucg

SEQ ID NO: 892008 - RNA, 23 nt, Human
ggagggagggaggaauaagggaa

SEQ ID NO: 892009 - RNA, 19 nt, Human
ggagucccuccacacaguc

SEQ ID NO: 892010 - RNA, 18 nt, Human
ggagugucaucgcccgga

SEQ ID NO: 892011 - RNA, 24 nt, Human
ggaugugguggcucaugccuguaa

SEQ ID NO: 892012 - RNA, 20 nt, Human
ggcagguggaucacuggagg

SEQ ID NO: 892013 - RNA, 26 nt, Human
ggccggccccgagcagagcugagcgc

SEQ ID NO: 892014 - RNA, 25 nt, Human
ggcuaaaccccuuaguagaaaccca

SEQ ID NO: 892015 - RNA, 18 nt, Human
ggcucaugccuguaaucc

SEQ ID NO: 892016 - RNA, 22 nt, Human
ggcuggcccggggucucgcagg

SEQ ID NO: 892017 - RNA, 22 nt, Human
ggcuguguaaacaaaaccaaca

SEQ ID NO: 892018 - RNA, 20 nt, Human
gggaaaagguauuugcaacg

SEQ ID NO: 892019 - RNA, 25 nt, Human
gggaacuccacggggacugauucuc

SEQ ID NO: 892020 - RNA, 25 nt, Human
gggaacuccacggggacugauucuc

SEQ ID NO: 892021 - RNA, 24 nt, Human
gggaaggagaaacaaagaaggcag

SEQ ID NO: 892022 - RNA, 21 nt, Human
gggaggcugggagguggccgc

SEQ ID NO: 892023 - RNA, 18 nt, Human
gggagggggggagcggcg

SEQ ID NO: 892024 - RNA, 19 nt, Human
gggcacagcgcaggcgcgg

SEQ ID NO: 892025 - RNA, 19 nt, Human
gggccgaggaccgaggaaa

SEQ ID NO: 892026 - RNA, 19 nt, Human
gggccgaggaccgaggaaa

SEQ ID NO: 892027 - RNA, 24 nt, Human
gggccuaguggagggugccuguaa

SEQ ID NO: 892028 - RNA, 18 nt, Human
gggccuggcuggcccggg

SEQ ID NO: 892029 - RNA, 19 nt, Human
gggcugggggagaagagau

SEQ ID NO: 892030 - RNA, 22 nt, Human
ggggaagggggagagccaaagg

SEQ ID NO: 892031 - RNA, 22 nt, Human
ggggaagggggagagccaaagg

SEQ ID NO: 892032 - RNA, 23 nt, Human
ggggagaagagauacacugagga

SEQ ID NO: 892033 - RNA, 20 nt, Human
gggggaggcugggagguggc

SEQ ID NO: 892034 - RNA, 23 nt, Human
ggggggagcggcgguggcggcgg

SEQ ID NO: 892035 - RNA, 23 nt, Human
ggggggagcggcgguggcggcgg

SEQ ID NO: 892036 - RNA, 24 nt, Human
ggugaccaggagagggguucagga

SEQ ID NO: 892037 - RNA, 24 nt, Human
ggugaccaggagagggguucagga

SEQ ID NO: 892038 - RNA, 24 nt, Human
ggugccuguaauccuggcuacuug

SEQ ID NO: 892039 - RNA, 24 nt, Human
gguggcucaugccuguaauccuag

SEQ ID NO: 892040 - RNA, 22 nt, Human
gguucagagaauuuauaaagua

SEQ ID NO: 892041 - RNA, 22 nt, Human
guaagauuacuauuucugguga

SEQ ID NO: 892042 - RNA, 22 nt, Human
guaagugguaggaaaaugccaa

SEQ ID NO: 892043 - RNA, 20 nt, Human
guaauccuggcuacuuggga

SEQ ID NO: 892044 - RNA, 23 nt, Human
gucacaaugacuucagugcagga

SEQ ID NO: 892045 - RNA, 20 nt, Human
gucacccauguuggugugga

SEQ ID NO: 892046 - RNA, 18 nt, Human
gucuagccaggcaaaacu

SEQ ID NO: 892047 - RNA, 23 nt, Human
gugacacaaacaagcagagaaga

SEQ ID NO: 892048 - RNA, 20 nt, Human
guggaggcugcagugagcug

SEQ ID NO: 892049 - RNA, 20 nt, Human
guggcucaugccuguaaucc

SEQ ID NO: 892050 - RNA, 22 nt, Human
gugguuccuaaacuuuaaagug

SEQ ID NO: 892051 - RNA, 18 nt, Human
guguauguaugugugugu

SEQ ID NO: 892052 - RNA, 18 nt, Human
guguauguaugugugugu

SEQ ID NO: 892053 - RNA, 18 nt, Human
guuucugacucaguaugu

SEQ ID NO: 892054 - RNA, 23 nt, Human
guuucuuuuuuuuuuuuuuuccu

SEQ ID NO: 892055 - RNA, 19 nt, Human
guuuucuuagugucuuuau

SEQ ID NO: 892056 - RNA, 24 nt, Human
uaaaaaauaaaugaaacggacaaa

SEQ ID NO: 892057 - RNA, 18 nt, Human
uaaaaagcaaaccucaac

SEQ ID NO: 892058 - RNA, 22 nt, Human
uaaaagaagugaaugaaacuca

SEQ ID NO: 892059 - RNA, 21 nt, Human
uaaaaggaaacaagguaagca

SEQ ID NO: 892060 - RNA, 23 nt, Human
uaaaaucuaucaguuuacucaaa

SEQ ID NO: 892061 - RNA, 25 nt, Human
uaaaaugaugugcuaaagcauaauu

SEQ ID NO: 892062 - RNA, 23 nt, Human
uaaaauuccaaacuacagcacau

SEQ ID NO: 892063 - RNA, 24 nt, Human
uaaaauuccaaacuacagcacaug

SEQ ID NO: 892064 - RNA, 21 nt, Human
uaaaccacuugagaacagguu

SEQ ID NO: 892065 - RNA, 23 nt, Human
uaaaccccuuaguagaaacccag

SEQ ID NO: 892066 - RNA, 18 nt, Human
uaaagacauaacaaaccc

SEQ ID NO: 892067 - RNA, 19 nt, Human
uaaagcccuuaaaaacuug

SEQ ID NO: 892068 - RNA, 23 nt, Human
uaaaguaacuagagcacugggac

SEQ ID NO: 892069 - RNA, 24 nt, Human
uaaauacaaggaaugaugauuuug

SEQ ID NO: 892070 - RNA, 21 nt, Human
uaacaaaaaccaaggcacucc

SEQ ID NO: 892071 - RNA, 23 nt, Human
uaacagguuauuuuuuguacacu

SEQ ID NO: 892072 - RNA, 24 nt, Human
uaacccuuauaucauugcaggaca

SEQ ID NO: 892073 - RNA, 19 nt, Human
uaagaccuaccauuagcug

SEQ ID NO: 892074 - RNA, 27 nt, Human
uaagcagacacauucauuagaucaaaa

SEQ ID NO: 892075 - RNA, 21 nt, Human
uaaggaaacacacacacacac

SEQ ID NO: 892076 - RNA, 19 nt, Human
uaauaauucucauggaacc

SEQ ID NO: 892077 - RNA, 21 nt, Human
uaauacauguuaugagauucu

SEQ ID NO: 892078 - RNA, 19 nt, Human
uaaugaagaacaaaaguaa

SEQ ID NO: 892079 - RNA, 28 nt, Human
uaaugaagaacaaaaguaaacaugauag

SEQ ID NO: 892080 - RNA, 18 nt, Human
uaaugcagacacucccug

SEQ ID NO: 892081 - RNA, 24 nt, Human
uaaugcuacaacugccaaguucug

SEQ ID NO: 892082 - RNA, 21 nt, Human
uaauuuaucauauauuauccc

SEQ ID NO: 892083 - RNA, 26 nt, Human
uacaaaaaauaaaaauaaaaggcaag

SEQ ID NO: 892084 - RNA, 19 nt, Human
uacacacaucuggugcaug

SEQ ID NO: 892085 - RNA, 30 nt, Human
uacaggauagaaaaaaaaaaaaaaaagaaa

SEQ ID NO: 892086 - RNA, 21 nt, Human
uacucugagaaccacugguug

SEQ ID NO: 892087 - RNA, 20 nt, Human
uagaaacccagagaacuaac

SEQ ID NO: 892088 - RNA, 23 nt, Human
uagaauacagaaaggccaauuaa

SEQ ID NO: 892089 - RNA, 22 nt, Human
uagaaugcuuuggguacaggaa

SEQ ID NO: 892090 - RNA, 22 nt, Human
uagaggcaaaauuaacaaaaac

SEQ ID NO: 892091 - RNA, 21 nt, Human
uagauauaaaccauccaaaac

SEQ ID NO: 892092 - RNA, 26 nt, Human
uagcacuuugggacgccgaggcaggu

SEQ ID NO: 892093 - RNA, 19 nt, Human
uagcccacuacugacauca

SEQ ID NO: 892094 - RNA, 19 nt, Human
uagcuaaaaacauagaugc

SEQ ID NO: 892095 - RNA, 19 nt, Human
uagcuaaaccacuugagaa

SEQ ID NO: 892096 - RNA, 22 nt, Human
uaggaaaaugccaaacuaaauu

SEQ ID NO: 892097 - RNA, 22 nt, Human
uaggucacccuagauuaaagug

SEQ ID NO: 892098 - RNA, 23 nt, Human
uaggucucuuucugaaaaguucc

SEQ ID NO: 892099 - RNA, 22 nt, Human
uaguauuaaggaaagacagcag

SEQ ID NO: 892100 - RNA, 22 nt, Human
uaguggagggugccuguaaucc

SEQ ID NO: 892101 - RNA, 21 nt, Human
uauaauaagcaaucccuacaa

SEQ ID NO: 892102 - RNA, 24 nt, Human
uauauacauggcacaaaauauaua

SEQ ID NO: 892103 - RNA, 18 nt, Human
uauauauauguauauaua

SEQ ID NO: 892104 - RNA, 18 nt, Human
uauauauguauauauaua

SEQ ID NO: 892105 - RNA, 19 nt, Human
uauauguauauauauaaau

SEQ ID NO: 892106 - RNA, 21 nt, Human
uauguguguguguguagacgu

SEQ ID NO: 892107 - RNA, 18 nt, Human
uauuaaggaaagacagca

SEQ ID NO: 892108 - RNA, 26 nt, Human
uauuaaggaaagacagcaguggugau

SEQ ID NO: 892109 - RNA, 21 nt, Human
uauucggagugggacauagaa

SEQ ID NO: 892110 - RNA, 19 nt, Human
ucaaaagaaauuagaucaa

SEQ ID NO: 892111 - RNA, 23 nt, Human
ucaaaagauacuuaaauacucaa

SEQ ID NO: 892112 - RNA, 24 nt, Human
ucaaaagauacuuaaauacucaaa

SEQ ID NO: 892113 - RNA, 23 nt, Human
ucaaaccaggcaaaugacuucug

SEQ ID NO: 892114 - RNA, 23 nt, Human
ucaacuccuaauaauuccuaaga

SEQ ID NO: 892115 - RNA, 22 nt, Human
ucacuuuccuaaaacaagcauu

SEQ ID NO: 892116 - RNA, 21 nt, Human
ucagauacaacuuucucauuu

SEQ ID NO: 892117 - RNA, 25 nt, Human
ucaggacggggaaggggaaggggga

SEQ ID NO: 892118 - RNA, 25 nt, Human
ucaggacggggaaggggaaggggga

SEQ ID NO: 892119 - RNA, 22 nt, Human
ucagugcaggaguuuuuuacug

SEQ ID NO: 892120 - RNA, 22 nt, Human
ucauaaagguaacaugaucaag

SEQ ID NO: 892121 - RNA, 22 nt, Human
ucaugugaauccaccuggcugu

SEQ ID NO: 892122 - RNA, 21 nt, Human
ucauugaugcuacagauguuu

SEQ ID NO: 892123 - RNA, 20 nt, Human
uccaaaaaaaugaaacacac

SEQ ID NO: 892124 - RNA, 18 nt, Human
uccacacagucuaaggca

SEQ ID NO: 892125 - RNA, 24 nt, Human
uccagaguuucugacucaguaugu

SEQ ID NO: 892126 - RNA, 22 nt, Human
uccagcaaacacacaguaagcu

SEQ ID NO: 892127 - RNA, 20 nt, Human
uccaucucaaaaaaaaaaaa

SEQ ID NO: 892128 - RNA, 20 nt, Human
ucccaaaacaaaaagaagga

SEQ ID NO: 892129 - RNA, 22 nt, Human
ucccaaagaaacaauucuagca

SEQ ID NO: 892130 - RNA, 20 nt, Human
ucccaaagguagaacuaucc

SEQ ID NO: 892131 - RNA, 18 nt, Human
uccccuaacacuccccuc

SEQ ID NO: 892132 - RNA, 21 nt, Human
ucccuacaaaauauuucaaac

SEQ ID NO: 892133 - RNA, 24 nt, Human
uccuaccuuuggaggcugaaauuu

SEQ ID NO: 892134 - RNA, 21 nt, Human
uccugacccuaacacuuggcc

SEQ ID NO: 892135 - RNA, 22 nt, Human
ucgccgccaccgccgccgccgc

SEQ ID NO: 892136 - RNA, 26 nt, Human
ucgccgccaccgccgccgccgcugac

SEQ ID NO: 892137 - RNA, 24 nt, Human
ucgcuugaaccugggagguggagg

SEQ ID NO: 892138 - RNA, 20 nt, Human
ucuagaggaaaaacagguaa

SEQ ID NO: 892139 - RNA, 20 nt, Human
ucuauaauaaagcccuuaaa

SEQ ID NO: 892140 - RNA, 20 nt, Human
ucucgcgaguagagggacuu

SEQ ID NO: 892141 - RNA, 22 nt, Human
ucugauuccaagcccacucuuc

SEQ ID NO: 892142 - RNA, 27 nt, Human
ucuuaaguccuauauagucauuuuaga

SEQ ID NO: 892143 - RNA, 21 nt, Human
ugaaaaagaggugaaaaguaa

SEQ ID NO: 892144 - RNA, 21 nt, Human
ugaaacaccauuugacgccau

SEQ ID NO: 892145 - RNA, 25 nt, Human
ugaaacaccauuugacgccauugcc

SEQ ID NO: 892146 - RNA, 21 nt, Human
ugaaacgagaacacuuaaaug

SEQ ID NO: 892147 - RNA, 25 nt, Human
ugaaacggacaaggauaccaaaaca

SEQ ID NO: 892148 - RNA, 20 nt, Human
ugaaacuauuuguuuaugug

SEQ ID NO: 892149 - RNA, 20 nt, Human
ugaaagagaaaguaaaaaca

SEQ ID NO: 892150 - RNA, 24 nt, Human
ugaaccugggagguggaggcugca

SEQ ID NO: 892151 - RNA, 22 nt, Human
ugaagcacuggauuguguggcu

SEQ ID NO: 892152 - RNA, 22 nt, Human
ugaagcagagaacuacagguca

SEQ ID NO: 892153 - RNA, 23 nt, Human
ugaauucccaaacauguagguua

SEQ ID NO: 892154 - RNA, 18 nt, Human
ugaccacuucaaacuguu

SEQ ID NO: 892155 - RNA, 24 nt, Human
ugacuucagugcaggaguuuuuua

SEQ ID NO: 892156 - RNA, 21 nt, Human
ugagaaccauacucugagaac

SEQ ID NO: 892157 - RNA, 20 nt, Human
ugagaagcaggcaucccacg

SEQ ID NO: 892158 - RNA, 23 nt, Human
ugagaagcaggcaucccacgggu

SEQ ID NO: 892159 - RNA, 22 nt, Human
ugagaugaaguccgagggcauc

SEQ ID NO: 892160 - RNA, 19 nt, Human
ugagcaaagacugaauggc

SEQ ID NO: 892161 - RNA, 18 nt, Human
ugaggaaaauacuuuugg

SEQ ID NO: 892162 - RNA, 22 nt, Human
ugaggaaaauacuuuugguuca

SEQ ID NO: 892163 - RNA, 20 nt, Human
ugaggcaggagaaucgcuug

SEQ ID NO: 892164 - RNA, 24 nt, Human
ugaggcaggagaaucgcuugaacc

SEQ ID NO: 892165 - RNA, 24 nt, Human
ugaggcaggagaaucgcuugaacc

SEQ ID NO: 892166 - RNA, 19 nt, Human
ugagguucaucagcuaaaa

SEQ ID NO: 892167 - RNA, 19 nt, Human
ugagugguccagccuugaa

SEQ ID NO: 892168 - RNA, 18 nt, Human
ugauacaacccuguaaag

SEQ ID NO: 892169 - RNA, 23 nt, Human
ugcaguauuaacaaucauccuaa

SEQ ID NO: 892170 - RNA, 22 nt, Human
ugcauagcaguguguacaaagg

SEQ ID NO: 892171 - RNA, 26 nt, Human
ugcccgggagcgcggaagagccgugg

SEQ ID NO: 892172 - RNA, 23 nt, Human
ugccuguaauccuagcacuuugg

SEQ ID NO: 892173 - RNA, 23 nt, Human
ugccuguaauccuagcacuuugg

SEQ ID NO: 892174 - RNA, 24 nt, Human
ugccuguaauccuagcacuuuggg

SEQ ID NO: 892175 - RNA, 23 nt, Human
ugccuguaauccuggcuacuugg

SEQ ID NO: 892176 - RNA, 24 nt, Human
ugccuguaauccuggcuacuuggg

SEQ ID NO: 892177 - RNA, 19 nt, Human
ugcgaguauacaaauguuc

SEQ ID NO: 892178 - RNA, 19 nt, Human
ugcguguauguaugugugu

SEQ ID NO: 892179 - RNA, 24 nt, Human
ugcguguauguaugugugugugug

SEQ ID NO: 892180 - RNA, 22 nt, Human
ugcuacaacugccaaguucugg

SEQ ID NO: 892181 - RNA, 26 nt, Human
ugcuacagauguuucucuagauggag

SEQ ID NO: 892182 - RNA, 21 nt, Human
uggaaauagugaaaaaugaaa

SEQ ID NO: 892183 - RNA, 23 nt, Human
uggaagaaaggaaggaagggaga

SEQ ID NO: 892184 - RNA, 21 nt, Human
uggaagaaggcaguucagugg

SEQ ID NO: 892185 - RNA, 19 nt, Human
uggaagagagagaaaggaa

SEQ ID NO: 892186 - RNA, 21 nt, Human
uggaagagagagaaaggaagg

SEQ ID NO: 892187 - RNA, 19 nt, Human
uggaagggaagaagggagg

SEQ ID NO: 892188 - RNA, 22 nt, Human
uggaggaggcgagccugccuca

SEQ ID NO: 892189 - RNA, 18 nt, Human
uggaggcugcagugagcu

SEQ ID NO: 892190 - RNA, 19 nt, Human
uggagguggagggaagaaa

SEQ ID NO: 892191 - RNA, 24 nt, Human
uggaucacuggagguuaggaguuc

SEQ ID NO: 892192 - RNA, 22 nt, Human
uggcaaaccguaucccaaaaac

SEQ ID NO: 892193 - RNA, 19 nt, Human
uggcaagaacacccaaaac

SEQ ID NO: 892194 - RNA, 23 nt, Human
uggcuaaaccccuuaguagaaac

SEQ ID NO: 892195 - RNA, 24 nt, Human
uggcuaaaccccuuaguagaaacc

SEQ ID NO: 892196 - RNA, 24 nt, Human
uggcuacuugggaggcugaggcag

SEQ ID NO: 892197 - RNA, 24 nt, Human
uggcucaugccuguaauccuagca

SEQ ID NO: 892198 - RNA, 24 nt, Human
ugggacgccgaggcagguggauca

SEQ ID NO: 892199 - RNA, 19 nt, Human
ugggaggcugaggcaggag

SEQ ID NO: 892200 - RNA, 23 nt, Human
ugggaggcugaggcaggagaauc

SEQ ID NO: 892201 - RNA, 18 nt, Human
ugggagggggggaggcug

SEQ ID NO: 892202 - RNA, 18 nt, Human
ugggagguggaggcugca

SEQ ID NO: 892203 - RNA, 24 nt, Human
ugggagguggaggcugcagugagc

SEQ ID NO: 892204 - RNA, 18 nt, Human
ugggauggggccaaagaa

SEQ ID NO: 892205 - RNA, 25 nt, Human
ugggauggggccaaagaauuuacau

SEQ ID NO: 892206 - RNA, 25 nt, Human
uggggccaaagaauuuacauuucua

SEQ ID NO: 892207 - RNA, 21 nt, Human
ugguaaggagcuggaauagag

SEQ ID NO: 892208 - RNA, 21 nt, Human
ugguagugagaagcaggcauc

SEQ ID NO: 892209 - RNA, 22 nt, Human
ugguggcucaugccuguaaucc

SEQ ID NO: 892210 - RNA, 22 nt, Human
uguaaacaaaaccaacaccaca

SEQ ID NO: 892211 - RNA, 18 nt, Human
uguaaacagugggaagaa

SEQ ID NO: 892212 - RNA, 19 nt, Human
uguauguaugugugugugu

SEQ ID NO: 892213 - RNA, 23 nt, Human
uguauguauguguguguguguaa

SEQ ID NO: 892214 - RNA, 22 nt, Human
ugucaucgcccggacagccgcc

SEQ ID NO: 892215 - RNA, 21 nt, Human
ugucugaaauuucaaccaacc

SEQ ID NO: 892216 - RNA, 21 nt, Human
ugugcguguauguaugugugu

SEQ ID NO: 892217 - RNA, 20 nt, Human
ugugguagaacaucagacaa

SEQ ID NO: 892218 - RNA, 25 nt, Human
ugugguagaaugcuuuggguacagg

SEQ ID NO: 892219 - RNA, 20 nt, Human
uguggucugcugguaaagua

SEQ ID NO: 892220 - RNA, 19 nt, Human
ugugugcguguauguaugu

SEQ ID NO: 892221 - RNA, 20 nt, Human
ugugugcguguauguaugug

SEQ ID NO: 892222 - RNA, 25 nt, Human
ugugugcguguauguaugugugugu

SEQ ID NO: 892223 - RNA, 20 nt, Human
uguguguguguagacguugu

SEQ ID NO: 892224 - RNA, 19 nt, Human
uguguguguguguagacgu

SEQ ID NO: 892225 - RNA, 26 nt, Human
uguuucuuuuuuuuuuuuuuuccuuu

SEQ ID NO: 892226 - RNA, 24 nt, Human
uuaaaauaaacauagaacauugca

SEQ ID NO: 892227 - RNA, 19 nt, Human
uuacagauaauuauuuuuc

SEQ ID NO: 892228 - RNA, 20 nt, Human
uuacccucucccaaagaaac

SEQ ID NO: 892229 - RNA, 20 nt, Human
uuacuggacacagaagucug

SEQ ID NO: 892230 - RNA, 24 nt, Human
uuagaccggaugugguggcucaug

SEQ ID NO: 892231 - RNA, 24 nt, Human
uuagaucaaguucacuggaaucag

SEQ ID NO: 892232 - RNA, 23 nt, Human
uuauauacauggcacaaaauaua

SEQ ID NO: 892233 - RNA, 20 nt, Human
uuauugaacaagaauauggu

SEQ ID NO: 892234 - RNA, 19 nt, Human
uucaaugccucucaaucag

SEQ ID NO: 892235 - RNA, 25 nt, Human
uucaucagcuaaaauaauauaauaa

SEQ ID NO: 892236 - RNA, 22 nt, Human
uuccugaaagagaaaguaaaaa

SEQ ID NO: 892237 - RNA, 22 nt, Human
uuccugagccgggaaagggccc

SEQ ID NO: 892238 - RNA, 31 nt, Human
uucuguuucuuuuuuuuuuuuuuuccuuuuu

SEQ ID NO: 892239 - RNA, 20 nt, Human
uucuucuauaauaaagcccu

SEQ ID NO: 892240 - RNA, 20 nt, Human
uucuuggcuucuuuggaaug

SEQ ID NO: 892241 - RNA, 21 nt, Human
uugaaccugggagguggaggc

SEQ ID NO: 892242 - RNA, 20 nt, Human
uugcacauacuacauaugua

SEQ ID NO: 892243 - RNA, 22 nt, Human
uugcuggcucaccugagucucu

SEQ ID NO: 892244 - RNA, 24 nt, Human
uugggaggcugaggcaggagaauc

SEQ ID NO: 892245 - RNA, 25 nt, Human
uuucuuuuuuuuuuuuuuuccuuuu

SEQ ID NO: 892246 - RNA, 22 nt, Human
uuugauacuauuuuuccuaggu

SEQ ID NO: 892247 - RNA, 19 nt, Human
uuugcaguccucagugcca

SEQ ID NO: 892248 - RNA, 22 nt, Human
uuugcauagcaguguguacaaa

SEQ ID NO: 892249 - RNA, 18 nt, Human
uuugcuggcucaccugag

SEQ ID NO: 892250 - RNA, 21 nt, Human
uuuguaaacagugggaagaag

SEQ ID NO: 892251 - RNA, 19 nt, Human
uuuguucugaggguugguc

SEQ ID NO: 892252 - RNA, 22 nt, Human
uuuuauaaguguaucaucugcc

SEQ ID NO: 892253 - RNA, 18 nt, Human
uuuucuuuuuucuguuuc

SEQ ID NO: 892254 - RNA, 20 nt, Human
uuuugcucuugcuuuucugu

SEQ ID NO: 892255 - RNA, 18 nt, Human
aaacugcagcaguuaugg

SEQ ID NO: 892256 - RNA, 26 nt, Human
aagaagcccuguccaccuggaaagcc

SEQ ID NO: 892257 - RNA, 24 nt, Human
aaguaccaaaaccugcaacaggcu

SEQ ID NO: 892258 - RNA, 18 nt, Human
accagaagagcacauagc

SEQ ID NO: 892259 - RNA, 20 nt, Human
acugaaacuucccuucccca

SEQ ID NO: 892260 - RNA, 24 nt, Human
acugaaacuucccuuccccagugg

SEQ ID NO: 892261 - RNA, 18 nt, Human
acugagaaaacaccugca

SEQ ID NO: 892262 - RNA, 25 nt, Human
agagcaaaaaguuacauuucuaaag

SEQ ID NO: 892263 - RNA, 24 nt, Human
agauggacaccucucaggguucug

SEQ ID NO: 892264 - RNA, 22 nt, Human
agcaagaagauggacaccucuc

SEQ ID NO: 892265 - RNA, 23 nt, Human
agcagaaggggauggugggaggg

SEQ ID NO: 892266 - RNA, 26 nt, Human
agccagcggccagcggaagugccgcg

SEQ ID NO: 892267 - RNA, 20 nt, Human
agccugggcccaaacugcag

SEQ ID NO: 892268 - RNA, 23 nt, Human
aggcaaacaggcuucacccagga

SEQ ID NO: 892269 - RNA, 21 nt, Human
aggcucuggccacagcagucc

SEQ ID NO: 892270 - RNA, 23 nt, Human
aguuauggcuccggcuuccagau

SEQ ID NO: 892271 - RNA, 23 nt, Human
auuugcagaggggagugagucug

SEQ ID NO: 892272 - RNA, 21 nt, Human
caaaaccccucacugaggacu

SEQ ID NO: 892273 - RNA, 19 nt, Human
caaaaccugcaacaggcuc

SEQ ID NO: 892274 - RNA, 21 nt, Human
caacagcaagaagauggacac

SEQ ID NO: 892275 - RNA, 20 nt, Human
caagagaggcaaacaggcuu

SEQ ID NO: 892276 - RNA, 21 nt, Human
cacagcaccaucuucacccuc

SEQ ID NO: 892277 - RNA, 25 nt, Human
cacuucaccccucaggcccuuucca

SEQ ID NO: 892278 - RNA, 23 nt, Human
cagaauaaacugcuuacuggaag

SEQ ID NO: 892279 - RNA, 21 nt, Human
cagcacagcaccaucuucacc

SEQ ID NO: 892280 - RNA, 18 nt, Human
cagcgagccagcggccag

SEQ ID NO: 892281 - RNA, 21 nt, Human
caggcucauggaacagagccu

SEQ ID NO: 892282 - RNA, 20 nt, Human
cagucccuagggcaccagaa

SEQ ID NO: 892283 - RNA, 21 nt, Human
cauccccuuuccucagcacag

SEQ ID NO: 892284 - RNA, 22 nt, Human
cauggaacagagccuagggauc

SEQ ID NO: 892285 - RNA, 27 nt, Human
cauuuugcccuuucagccagcucccuc

SEQ ID NO: 892286 - RNA, 19 nt, Human
ccaaacuccccaaaacccc

SEQ ID NO: 892287 - RNA, 25 nt, Human
ccaaacuccccaaaaccccucacug

SEQ ID NO: 892288 - RNA, 21 nt, Human
ccagaagagcacauagccugg

SEQ ID NO: 892289 - RNA, 26 nt, Human
cccaaaaccccucacugaggacuguc

SEQ ID NO: 892290 - RNA, 20 nt, Human
ccccaaacuccccaaaaccc

SEQ ID NO: 892291 - RNA, 21 nt, Human
ccccaaacuccccaaaacccc

SEQ ID NO: 892292 - RNA, 22 nt, Human
ccccaguggcucaguucagagc

SEQ ID NO: 892293 - RNA, 25 nt, Human
cccccugcgcucccgccgccgccuc

SEQ ID NO: 892294 - RNA, 23 nt, Human
ccccugcgcucccgccgccgccu

SEQ ID NO: 892295 - RNA, 22 nt, Human
ccccugcugcagagcuggucug

SEQ ID NO: 892296 - RNA, 19 nt, Human
cccgccgccgccuccagga

SEQ ID NO: 892297 - RNA, 19 nt, Human
ccgcgcgcccccugcgcuc

SEQ ID NO: 892298 - RNA, 24 nt, Human
ccuacaccgcuugugcuuuucuca

SEQ ID NO: 892299 - RNA, 25 nt, Human
ccuccaggagcggccagcgagccag

SEQ ID NO: 892300 - RNA, 21 nt, Human
ccugcaacaggcucauggaac

SEQ ID NO: 892301 - RNA, 19 nt, Human
ccuuuccucagcacagcac

SEQ ID NO: 892302 - RNA, 23 nt, Human
cucagcacagcaccaucuucacc

SEQ ID NO: 892303 - RNA, 22 nt, Human
cuccccaaaaccccucacugag

SEQ ID NO: 892304 - RNA, 23 nt, Human
cucuugaccccaaacuccccaaa

SEQ ID NO: 892305 - RNA, 22 nt, Human
cugcagcaguuauggcuccggc

SEQ ID NO: 892306 - RNA, 22 nt, Human
cugcgcucccgccgccgccucc

SEQ ID NO: 892307 - RNA, 23 nt, Human
cugggcuccccaauccccugcug

SEQ ID NO: 892308 - RNA, 22 nt, Human
cuguacuggcuggccccaggcu

SEQ ID NO: 892309 - RNA, 18 nt, Human
gaaagcagcauuggagcc

SEQ ID NO: 892310 - RNA, 20 nt, Human
gaagcccuguccaccuggaa

SEQ ID NO: 892311 - RNA, 23 nt, Human
gaccccaaacuccccaaaacccc

SEQ ID NO: 892312 - RNA, 24 nt, Human
gaguaacuggaaccuaccuaugcc

SEQ ID NO: 892313 - RNA, 24 nt, Human
gcagagcuggucugugauacugag

SEQ ID NO: 892314 - RNA, 21 nt, Human
gccuccugggcuccccaaucc

SEQ ID NO: 892315 - RNA, 20 nt, Human
gcugccuccugggcucccca

SEQ ID NO: 892316 - RNA, 23 nt, Human
ggaaagcagcauuggagccuaca

SEQ ID NO: 892317 - RNA, 27 nt, Human
ggaggugguggugcugggcagggcucu

SEQ ID NO: 892318 - RNA, 21 nt, Human
ggauaccuggggcuuuggggg

SEQ ID NO: 892319 - RNA, 19 nt, Human
ggcagggcucugcaucccc

SEQ ID NO: 892320 - RNA, 18 nt, Human
ggccgcgcgcccccugcg

SEQ ID NO: 892321 - RNA, 18 nt, Human
ggcuccccaauccccugc

SEQ ID NO: 892322 - RNA, 20 nt, Human
gggaaugcgaguccccgggc

SEQ ID NO: 892323 - RNA, 18 nt, Human
gggcccaaacugcagcag

SEQ ID NO: 892324 - RNA, 24 nt, Human
ggggaaccggggaaugcgaguccc

SEQ ID NO: 892325 - RNA, 19 nt, Human
ggggauggugggagggucc

SEQ ID NO: 892326 - RNA, 19 nt, Human
gggggucuuccaagaagcc

SEQ ID NO: 892327 - RNA, 21 nt, Human
gggugacuuaaggcaaaaggg

SEQ ID NO: 892328 - RNA, 18 nt, Human
uaagaaaugcagguauuu

SEQ ID NO: 892329 - RNA, 22 nt, Human
uaaggcaaaagggaaggcugcc

SEQ ID NO: 892330 - RNA, 18 nt, Human
uacccccggggcucagaa

SEQ ID NO: 892331 - RNA, 22 nt, Human
uagccugggcccaaacugcagc

SEQ ID NO: 892332 - RNA, 25 nt, Human
uauuucagucucuucucacucagga

SEQ ID NO: 892333 - RNA, 19 nt, Human
ucacuucaccccucaggcc

SEQ ID NO: 892334 - RNA, 22 nt, Human
ucagcacagcaccaucuucacc

SEQ ID NO: 892335 - RNA, 23 nt, Human
uccagacuggcucucuuccacuu

SEQ ID NO: 892336 - RNA, 18 nt, Human
uccaggagcauaggaggu

SEQ ID NO: 892337 - RNA, 21 nt, Human
ucccgccgccgccuccaggag

SEQ ID NO: 892338 - RNA, 21 nt, Human
ucuaaaguaccaaaaccugca

SEQ ID NO: 892339 - RNA, 23 nt, Human
ucucaggguucugcuugcuccua

SEQ ID NO: 892340 - RNA, 22 nt, Human
ucuuccaagaagcccuguccac

SEQ ID NO: 892341 - RNA, 25 nt, Human
ugaccccaaacuccccaaaaccccu

SEQ ID NO: 892342 - RNA, 20 nt, Human
ugagucuggaagguggcaga

SEQ ID NO: 892343 - RNA, 21 nt, Human
ugauacugagaaaacaccugc

SEQ ID NO: 892344 - RNA, 25 nt, Human
ugcaacaggcucauggaacagagcc

SEQ ID NO: 892345 - RNA, 25 nt, Human
ugccuccugggcuccccaauccccu

SEQ ID NO: 892346 - RNA, 20 nt, Human
uggaacagagccuagggauc

SEQ ID NO: 892347 - RNA, 21 nt, Human
uggagagguggagcccugagg

SEQ ID NO: 892348 - RNA, 19 nt, Human
uggcagagcacagcuaggg

SEQ ID NO: 892349 - RNA, 24 nt, Human
ugggaagaguaacuggaaccuacc

SEQ ID NO: 892350 - RNA, 22 nt, Human
ugggggucuuccaagaagcccu

SEQ ID NO: 892351 - RNA, 23 nt, Human
ugggguggagggggaaccgggga

SEQ ID NO: 892352 - RNA, 21 nt, Human
ugugauacugagaaaacaccu

SEQ ID NO: 892353 - RNA, 24 nt, Human
ugugugaagucuuuaaacaacggu

SEQ ID NO: 892354 - RNA, 22 nt, Human
uucaggcugacccaacaugggu

SEQ ID NO: 892355 - RNA, 21 nt, Human
uucuaaaguaccaaaaccugc

SEQ ID NO: 892356 - RNA, 20 nt, Human
uugcagaggggagugagucu

SEQ ID NO: 892357 - RNA, 25 nt, Human
acacuaauggaacuaucaaugcacc

SEQ ID NO: 892358 - RNA, 25 nt, Human
agaaggaaguugcuggaagccuggc

SEQ ID NO: 892359 - RNA, 20 nt, Human
agaggcagggagagccaaua

SEQ ID NO: 892360 - RNA, 24 nt, Human
aggaauagacaagggauuucugac

SEQ ID NO: 892361 - RNA, 22 nt, Human
aggaggacaaauaacugggaca

SEQ ID NO: 892362 - RNA, 22 nt, Human
caaacagaguccagagcucaga

SEQ ID NO: 892363 - RNA, 18 nt, Human
caacacaggacaguuguc

SEQ ID NO: 892364 - RNA, 19 nt, Human
caauaggcugcugaaggcc

SEQ ID NO: 892365 - RNA, 24 nt, Human
cacacucaugcuuuggauguguca

SEQ ID NO: 892366 - RNA, 20 nt, Human
ccaaauaaagcccaauaguc

SEQ ID NO: 892367 - RNA, 21 nt, Human
ccaggcagaggggaacgggca

SEQ ID NO: 892368 - RNA, 20 nt, Human
cccgugccgcagaaccuaga

SEQ ID NO: 892369 - RNA, 22 nt, Human
ccuagggaaagcaacacaggac

SEQ ID NO: 892370 - RNA, 19 nt, Human
ccuccaggcuggaggggug

SEQ ID NO: 892371 - RNA, 21 nt, Human
cuucuaggucuagaacugauc

SEQ ID NO: 892372 - RNA, 24 nt, Human
gaaguugcuggaagccuggccucc

SEQ ID NO: 892373 - RNA, 18 nt, Human
gaucacauugaaaaugcc

SEQ ID NO: 892374 - RNA, 19 nt, Human
ggacaacugaggcuaugac

SEQ ID NO: 892375 - RNA, 23 nt, Human
ggauuucugacacacucaugcuu

SEQ ID NO: 892376 - RNA, 18 nt, Human
guaaagcagccugacccc

SEQ ID NO: 892377 - RNA, 20 nt, Human
uaaagcaagcaaugucuguc

SEQ ID NO: 892378 - RNA, 21 nt, Human
uaauuuaauuaagugcuuguu

SEQ ID NO: 892379 - RNA, 21 nt, Human
uagaauucuguaaagcagccu

SEQ ID NO: 892380 - RNA, 19 nt, Human
ucacagugaugguguaaag

SEQ ID NO: 892381 - RNA, 22 nt, Human
ucugcuggcaaauaagucucca

SEQ ID NO: 892382 - RNA, 18 nt, Human
ugagaagugccagggacu

SEQ ID NO: 892383 - RNA, 26 nt, Human
ugauugcauaccuagugaccauacaa

SEQ ID NO: 892384 - RNA, 18 nt, Human
ugcuuuggaugugucagu

SEQ ID NO: 892385 - RNA, 20 nt, Human
uggaauauucaaacagaguc

SEQ ID NO: 892386 - RNA, 19 nt, Human
uggcaaauaagucuccacu

SEQ ID NO: 892387 - RNA, 21 nt, Human
ugggacaacugaggcuaugac

SEQ ID NO: 892388 - RNA, 19 nt, Human
ugguuuguccaaauaaagc

SEQ ID NO: 892389 - RNA, 25 nt, Human
uucagacuaaaaaauucauuugugc

SEQ ID NO: 892390 - RNA, 19 nt, Human
uugcucuagggcagaagga

SEQ ID NO: 892391 - RNA, 20 nt, Human
uugcucucuauauuuccuac

SEQ ID NO: 892392 - RNA, 24 nt, Human
uuuuuuuuuuuuuuuuuuuuaaag

SEQ ID NO: 892393 - RNA, 22 nt, Human
aagcuucacugguuugagugcu

SEQ ID NO: 892394 - RNA, 22 nt, Human
aaggggccaagacacaugagca

SEQ ID NO: 892395 - RNA, 23 nt, Human
aaggggccaagacacaugagcac

SEQ ID NO: 892396 - RNA, 19 nt, Human
aagugauauuugcuuuucu

SEQ ID NO: 892397 - RNA, 23 nt, Human
accauaaucgauacaagaugcag

SEQ ID NO: 892398 - RNA, 24 nt, Human
acucugucccagagagcccacagc

SEQ ID NO: 892399 - RNA, 22 nt, Human
agagcccccccccccccaccuu

SEQ ID NO: 892400 - RNA, 21 nt, Human
agcaaggggccaagacacaug

SEQ ID NO: 892401 - RNA, 23 nt, Human
agccagaggcuggcagaggccug

SEQ ID NO: 892402 - RNA, 24 nt, Human
agcugggcucucaguccuggaacc

SEQ ID NO: 892403 - RNA, 21 nt, Human
augcaggcccugcucccgcug

SEQ ID NO: 892404 - RNA, 23 nt, Human
caaggggccaagacacaugagca

SEQ ID NO: 892405 - RNA, 22 nt, Human
cacaggcgcuccacucuguccc

SEQ ID NO: 892406 - RNA, 19 nt, Human
cacugcgugggcagggaug

SEQ ID NO: 892407 - RNA, 22 nt, Human
cagagcccccccccccccaccu

SEQ ID NO: 892408 - RNA, 21 nt, Human
caggcccugcucccgcuggcc

SEQ ID NO: 892409 - RNA, 23 nt, Human
caugagcacucacugcgugggca

SEQ ID NO: 892410 - RNA, 20 nt, Human
ccaagacacaugagcacuca

SEQ ID NO: 892411 - RNA, 19 nt, Human
ccaagcucuggcaggccug

SEQ ID NO: 892412 - RNA, 23 nt, Human
ccaauucauuccuuaaaacaccu

SEQ ID NO: 892413 - RNA, 19 nt, Human
ccagagagcccacagccaa

SEQ ID NO: 892414 - RNA, 24 nt, Human
cccacccccuuccacccccucgga

SEQ ID NO: 892415 - RNA, 24 nt, Human
cccagagcccccccccccccaccu

SEQ ID NO: 892416 - RNA, 20 nt, Human
ccccaagccagauccugcca

SEQ ID NO: 892417 - RNA, 18 nt, Human
ccccccccccccaccuuc

SEQ ID NO: 892418 - RNA, 23 nt, Human
ccccccccccccaccuucugucg

SEQ ID NO: 892419 - RNA, 20 nt, Human
cccccccccccccaccuucu

SEQ ID NO: 892420 - RNA, 18 nt, Human
cccccuuccacccccucc

SEQ ID NO: 892421 - RNA, 18 nt, Human
ccccucggaggcaugagg

SEQ ID NO: 892422 - RNA, 23 nt, Human
cccugcucccgcuggcccccugg

SEQ ID NO: 892423 - RNA, 18 nt, Human
cccugggggccaggggca

SEQ ID NO: 892424 - RNA, 21 nt, Human
ccucagagaguguuccucccu

SEQ ID NO: 892425 - RNA, 22 nt, Human
ccuggaaccggagaccaagggc

SEQ ID NO: 892426 - RNA, 24 nt, Human
cgugggcagggaugagggccgggc

SEQ ID NO: 892427 - RNA, 22 nt, Human
cuggggaggugcuggccugugc

SEQ ID NO: 892428 - RNA, 22 nt, Human
cuucacugguuugagugcugcc

SEQ ID NO: 892429 - RNA, 23 nt, Human
cuucccagagccccccccccccc

SEQ ID NO: 892430 - RNA, 24 nt, Human
gagcaggaugguguguccccggcu

SEQ ID NO: 892431 - RNA, 19 nt, Human
gcagccagaggcuggcaga

SEQ ID NO: 892432 - RNA, 21 nt, Human
ggcauggggggcccuggagug

SEQ ID NO: 892433 - RNA, 22 nt, Human
gggcacccuuuauccaguuugc

SEQ ID NO: 892434 - RNA, 25 nt, Human
gggcacccuuuauccaguuugcgag

SEQ ID NO: 892435 - RNA, 20 nt, Human
gggcccuggagugugcccac

SEQ ID NO: 892436 - RNA, 18 nt, Human
gugcagccagaggcuggc

SEQ ID NO: 892437 - RNA, 24 nt, Human
gugcagccagaggcuggcagaggc

SEQ ID NO: 892438 - RNA, 19 nt, Human
uaaauccacaggcgcucca

SEQ ID NO: 892439 - RNA, 25 nt, Human
ucacugcgugggcagggaugagggc

SEQ ID NO: 892440 - RNA, 18 nt, Human
ucagggagccagaggcgg

SEQ ID NO: 892441 - RNA, 25 nt, Human
ucagggagccagaggcgggaggggu

SEQ ID NO: 892442 - RNA, 28 nt, Human
uccaagguagaggaggacgcgugcagga

SEQ ID NO: 892443 - RNA, 19 nt, Human
uccagcccaucagggagcc

SEQ ID NO: 892444 - RNA, 21 nt, Human
ucccagagagcccacagccaa

SEQ ID NO: 892445 - RNA, 21 nt, Human
ucccagagccccccccccccc

SEQ ID NO: 892446 - RNA, 24 nt, Human
ucccagagcccccccccccccacc

SEQ ID NO: 892447 - RNA, 18 nt, Human
ucccucguccccuguccu

SEQ ID NO: 892448 - RNA, 19 nt, Human
ucccugggggccaggggca

SEQ ID NO: 892449 - RNA, 19 nt, Human
ucucagaaccauaaucgau

SEQ ID NO: 892450 - RNA, 24 nt, Human
ucucaguccuggaaccggagacca

SEQ ID NO: 892451 - RNA, 22 nt, Human
ugcaggcccugcucccgcuggc

SEQ ID NO: 892452 - RNA, 19 nt, Human
ugcccacccccuuccaccc

SEQ ID NO: 892453 - RNA, 18 nt, Human
ugccucccacagggacac

SEQ ID NO: 892454 - RNA, 18 nt, Human
ugccucccacagggacac

SEQ ID NO: 892455 - RNA, 21 nt, Human
ugccugguagauucuaacugc

SEQ ID NO: 892456 - RNA, 23 nt, Human
ugcuggccugugcuucccagagc

SEQ ID NO: 892457 - RNA, 25 nt, Human
ugcuucccagagccccccccccccc

SEQ ID NO: 892458 - RNA, 26 nt, Human
ugcuucccagagccccccccccccca

SEQ ID NO: 892459 - RNA, 22 nt, Human
ugcuucuuuuaaugcagccaaa

SEQ ID NO: 892460 - RNA, 19 nt, Human
ugggcagaggcagcugggc

SEQ ID NO: 892461 - RNA, 18 nt, Human
uggggaagggugggcaga

SEQ ID NO: 892462 - RNA, 19 nt, Human
ugggggccaggggcauggg

SEQ ID NO: 892463 - RNA, 26 nt, Human
uggggggcccuggagugucgguagac

SEQ ID NO: 892464 - RNA, 20 nt, Human
ugucccagagagcccacagc

SEQ ID NO: 892465 - RNA, 21 nt, Human
ugucggggucucaugcaggcc

SEQ ID NO: 892466 - RNA, 24 nt, Human
ugugccugguagauucuaacugcu

SEQ ID NO: 892467 - RNA, 25 nt, Human
ugugccugguagauucuaacugcuu

SEQ ID NO: 892468 - RNA, 20 nt, Human
uuccuuaaaacaccugggcu

SEQ ID NO: 892469 - RNA, 25 nt, Human
uugggagccucuuccagucccuggg

SEQ ID NO: 892470 - RNA, 23 nt, Human
uuucccaagcuucacugguuuga

SEQ ID NO: 892471 - RNA, 20 nt, Human
uuucucagcagaacgacugg

SEQ ID NO: 892472 - RNA, 20 nt, Human
aagcaugcacugaaccaaca

SEQ ID NO: 892473 - RNA, 20 nt, Human
acagggugguaacugccaac

SEQ ID NO: 892474 - RNA, 20 nt, Human
cacagggugguaacugccaa

SEQ ID NO: 892475 - RNA, 18 nt, Human
cacugaaccaacagacua

SEQ ID NO: 892476 - RNA, 22 nt, Human
cagggugguaacugccaacuaa

SEQ ID NO: 892477 - RNA, 24 nt, Human
ccaacagacuacuucaguaagucc

SEQ ID NO: 892478 - RNA, 20 nt, Human
ccgccgccgccccucgcucc

SEQ ID NO: 892479 - RNA, 20 nt, Human
guccuugauuauugccagcu

SEQ ID NO: 892480 - RNA, 23 nt, Human
ugauggauagcuagcaaaagaaa

SEQ ID NO: 892481 - RNA, 21 nt, Human
ugccagcuuuucuauaauguu

SEQ ID NO: 892482 - RNA, 20 nt, Human
aacagauuauauucaucuuc

SEQ ID NO: 892483 - RNA, 20 nt, Human
aacagcuugcaugcaacccc

SEQ ID NO: 892484 - RNA, 25 nt, Human
aacccuuuggcuuuuuucagagaaa

SEQ ID NO: 892485 - RNA, 19 nt, Human
aacugugacguuaaaucuc

SEQ ID NO: 892486 - RNA, 22 nt, Human
aagugcagaguauacucaaaac

SEQ ID NO: 892487 - RNA, 24 nt, Human
aaugaaccaggacuauuugaaugg

SEQ ID NO: 892488 - RNA, 21 nt, Human
acccaggccaauaaaauuuuc

SEQ ID NO: 892489 - RNA, 20 nt, Human
agaaaaaaaaaagcugucau

SEQ ID NO: 892490 - RNA, 19 nt, Human
agaacaauucauguccaca

SEQ ID NO: 892491 - RNA, 27 nt, Human
agcacuuaucuuuucuuuuuuuuauua

SEQ ID NO: 892492 - RNA, 18 nt, Human
agcaggaugaguaacagg

SEQ ID NO: 892493 - RNA, 24 nt, Human
agccgcccaugaccgcgagcugcc

SEQ ID NO: 892494 - RNA, 23 nt, Human
agggucugggaaaugccugucag

SEQ ID NO: 892495 - RNA, 21 nt, Human
auaaaauuuucuugccucauc

SEQ ID NO: 892496 - RNA, 22 nt, Human
auggaaagagaaaaaaaaaagc

SEQ ID NO: 892497 - RNA, 21 nt, Human
caaaauaguuccaggcgccaa

SEQ ID NO: 892498 - RNA, 18 nt, Human
caaacuuccuucgagagg

SEQ ID NO: 892499 - RNA, 20 nt, Human
caaccccuaaguguaccccu

SEQ ID NO: 892500 - RNA, 25 nt, Human
caccccaaguaugccauugucuuug

SEQ ID NO: 892501 - RNA, 21 nt, Human
cagagaaagacuucagccaaa

SEQ ID NO: 892502 - RNA, 23 nt, Human
caggaccacaaagggcugagugu

SEQ ID NO: 892503 - RNA, 20 nt, Human
ccacagaucacaccuuccac

SEQ ID NO: 892504 - RNA, 20 nt, Human
ccagacagucccacagauca

SEQ ID NO: 892505 - RNA, 24 nt, Human
cccaggccaauaaaauuuucuugc

SEQ ID NO: 892506 - RNA, 18 nt, Human
ccccuauaacccuuuggc

SEQ ID NO: 892507 - RNA, 18 nt, Human
cccgcugcuagcuccugg

SEQ ID NO: 892508 - RNA, 31 nt, Human
cccuauaacccuuuggcuuuuuucagagaaa

SEQ ID NO: 892509 - RNA, 19 nt, Human
cccuguaugcauuuccucu

SEQ ID NO: 892510 - RNA, 23 nt, Human
ccgcgcccgcugcuagcuccugg

SEQ ID NO: 892511 - RNA, 23 nt, Human
ccuccauuuccgcuuagcuucuc

SEQ ID NO: 892512 - RNA, 18 nt, Human
ccucguggaagcagaagu

SEQ ID NO: 892513 - RNA, 21 nt, Human
ccugcaauacuauucccuccu

SEQ ID NO: 892514 - RNA, 22 nt, Human
ccuuaagagauggugaaguagg

SEQ ID NO: 892515 - RNA, 22 nt, Human
ccuucgagaggcgagagacagg

SEQ ID NO: 892516 - RNA, 20 nt, Human
cgagaggcgagagacaggag

SEQ ID NO: 892517 - RNA, 21 nt, Human
cgagaggcgagagacaggagg

SEQ ID NO: 892518 - RNA, 21 nt, Human
cuaaguguaccccuauaaccc

SEQ ID NO: 892519 - RNA, 19 nt, Human
cucugaaauuaagagcaaa

SEQ ID NO: 892520 - RNA, 23 nt, Human
cuguucuacuucagugcgcacgu

SEQ ID NO: 892521 - RNA, 19 nt, Human
cuucugggaaugaaccagg

SEQ ID NO: 892522 - RNA, 19 nt, Human
cuuucagucuuacccaggc

SEQ ID NO: 892523 - RNA, 23 nt, Human
gaaagacuucagccaaauugucc

SEQ ID NO: 892524 - RNA, 21 nt, Human
gaagaagggcugccacaggua

SEQ ID NO: 892525 - RNA, 18 nt, Human
gaagcagaaguagccgug

SEQ ID NO: 892526 - RNA, 21 nt, Human
gagggucugggaaaugccugu

SEQ ID NO: 892527 - RNA, 19 nt, Human
gcccaugaccgcgagcugc

SEQ ID NO: 892528 - RNA, 19 nt, Human
gccugugcugagcgcggaa

SEQ ID NO: 892529 - RNA, 18 nt, Human
ggacaaaugccgaguccu

SEQ ID NO: 892530 - RNA, 18 nt, Human
ggcaggaccacaaagggc

SEQ ID NO: 892531 - RNA, 18 nt, Human
ggcaugauugccucugug

SEQ ID NO: 892532 - RNA, 25 nt, Human
gugauugcagaaagccacagaguac

SEQ ID NO: 892533 - RNA, 25 nt, Human
uaaaaagccuuaaagugcacaagaa

SEQ ID NO: 892534 - RNA, 24 nt, Human
uaacuuagcuaagcccuuugcaca

SEQ ID NO: 892535 - RNA, 25 nt, Human
uaagcccuuugcacagucuaagccu

SEQ ID NO: 892536 - RNA, 19 nt, Human
uaaguguaccccuauaacc

SEQ ID NO: 892537 - RNA, 23 nt, Human
uacauuugcauucucaaacaaaa

SEQ ID NO: 892538 - RNA, 18 nt, Human
uagaacaauucaugucca

SEQ ID NO: 892539 - RNA, 22 nt, Human
uagcuaagcccuuugcacaguc

SEQ ID NO: 892540 - RNA, 24 nt, Human
uaguagggacugaaguuuuugaug

SEQ ID NO: 892541 - RNA, 24 nt, Human
uaugccauugucuuuguaauucuu

SEQ ID NO: 892542 - RNA, 19 nt, Human
ucacuggaggcaagagggu

SEQ ID NO: 892543 - RNA, 19 nt, Human
ucauucauuuugugcccuu

SEQ ID NO: 892544 - RNA, 19 nt, Human
ucccugcaauacuauuccc

SEQ ID NO: 892545 - RNA, 21 nt, Human
ucccugcaauacuauucccuc

SEQ ID NO: 892546 - RNA, 18 nt, Human
uccucagcucccucucac

SEQ ID NO: 892547 - RNA, 21 nt, Human
uccucagcucccucucacccc

SEQ ID NO: 892548 - RNA, 24 nt, Human
uccuucucacuggaggcaagaggg

SEQ ID NO: 892549 - RNA, 23 nt, Human
ucucuugaaucuauugggcauga

SEQ ID NO: 892550 - RNA, 24 nt, Human
ucugguuuuauuauucaaauuaag

SEQ ID NO: 892551 - RNA, 25 nt, Human
ucuuuauucauuuauuuauuuauuu

SEQ ID NO: 892552 - RNA, 27 nt, Human
ugaaauuaagagcaaacuuccuucgag

SEQ ID NO: 892553 - RNA, 21 nt, Human
ugaauggaaagagaaaaaaaa

SEQ ID NO: 892554 - RNA, 18 nt, Human
ugccacagguacacuggg

SEQ ID NO: 892555 - RNA, 22 nt, Human
ugcccucguccagcuggcugga

SEQ ID NO: 892556 - RNA, 20 nt, Human
uggaaagagaaaaaaaaaag

SEQ ID NO: 892557 - RNA, 20 nt, Human
uggaagcagaaguagccgug

SEQ ID NO: 892558 - RNA, 26 nt, Human
ugggcaugauugccucugugggggcu

SEQ ID NO: 892559 - RNA, 19 nt, Human
ugucugaagaagggcugcc

SEQ ID NO: 892560 - RNA, 23 nt, Human
ugugcugagcgcggaaacugccc

SEQ ID NO: 892561 - RNA, 24 nt, Human
uuagcuucucuugaaucuauuggg

SEQ ID NO: 892562 - RNA, 19 nt, Human
uuaugcuagaacaagcacu

SEQ ID NO: 892563 - RNA, 23 nt, Human
uucucaaacaaaauuaaaaagcc

SEQ ID NO: 892564 - RNA, 20 nt, Human
uugaaucuauugggcaugau

SEQ ID NO: 892565 - RNA, 23 nt, Human
acuacguucuccaacuggaaugg

SEQ ID NO: 892566 - RNA, 21 nt, Human
acuccgaggcccagccccgcg

SEQ ID NO: 892567 - RNA, 19 nt, Human
aguuuugcguggcugagaa

SEQ ID NO: 892568 - RNA, 22 nt, Human
ccacgcauggcucucgaauccc

SEQ ID NO: 892569 - RNA, 22 nt, Human
cccuggcuccacugaaagacuc

SEQ ID NO: 892570 - RNA, 22 nt, Human
ccucacgacaaaccagacccug

SEQ ID NO: 892571 - RNA, 20 nt, Human
cggggcaaacuccgaggccc

SEQ ID NO: 892572 - RNA, 21 nt, Human
gacucacuacguucuccaacu

SEQ ID NO: 892573 - RNA, 25 nt, Human
gcgcagcgcuggggguugcgggccu

SEQ ID NO: 892574 - RNA, 18 nt, Human
gcucugggcugggcgggu

SEQ ID NO: 892575 - RNA, 22 nt, Human
ggcaaacuccgaggcccagccc

SEQ ID NO: 892576 - RNA, 19 nt, Human
gggcaaacuccgaggccca

SEQ ID NO: 892577 - RNA, 24 nt, Human
gggcugggcggguuucucuagcgc

SEQ ID NO: 892578 - RNA, 21 nt, Human
uauuaugacaucuucaaaaga

SEQ ID NO: 892579 - RNA, 26 nt, Human
ucaauaggcauuugcugagcaccugc

SEQ ID NO: 892580 - RNA, 18 nt, Human
ucugaacaucaaagugca

SEQ ID NO: 892581 - RNA, 23 nt, Human
ugacaucuucaaaagacaaucaa

SEQ ID NO: 892582 - RNA, 20 nt, Human
ugagaacaaaguggguuucu

SEQ ID NO: 892583 - RNA, 28 nt, Human
uggguuucugaacaucaaagugcaauuc

SEQ ID NO: 892584 - RNA, 21 nt, Human
aaaccuggaacagggaaggug

SEQ ID NO: 892585 - RNA, 19 nt, Human
aaccuggaacagggaaggu

SEQ ID NO: 892586 - RNA, 20 nt, Human
aagcagccugucuugcacau

SEQ ID NO: 892587 - RNA, 21 nt, Human
aagccagacccggccugaaaa

SEQ ID NO: 892588 - RNA, 18 nt, Human
aagcugcaacacaucugg

SEQ ID NO: 892589 - RNA, 23 nt, Human
acaacgggaacuuggauggauac

SEQ ID NO: 892590 - RNA, 24 nt, Human
acauuaagaauaacacccgaaugc

SEQ ID NO: 892591 - RNA, 20 nt, Human
agaaaaaagcgcuacugggg

SEQ ID NO: 892592 - RNA, 20 nt, Human
auggaagacaucucacucca

SEQ ID NO: 892593 - RNA, 20 nt, Human
augucaggaaagcugcaaca

SEQ ID NO: 892594 - RNA, 21 nt, Human
caggaaagcugcaacacaucu

SEQ ID NO: 892595 - RNA, 18 nt, Human
caggugccaaaacauucc

SEQ ID NO: 892596 - RNA, 22 nt, Human
ccaacucucaccuuuggaauua

SEQ ID NO: 892597 - RNA, 23 nt, Human
ccaagccagacccggccugaaaa

SEQ ID NO: 892598 - RNA, 21 nt, Human
ccagacccggccugaaaacag

SEQ ID NO: 892599 - RNA, 21 nt, Human
ccagcuccgccgaagcgacgg

SEQ ID NO: 892600 - RNA, 22 nt, Human
ccccgcuguccuggcuggucag

SEQ ID NO: 892601 - RNA, 21 nt, Human
cccuaaacccaaacaguuccc

SEQ ID NO: 892602 - RNA, 26 nt, Human
ccgaagcgacggcgccuggguccccu

SEQ ID NO: 892603 - RNA, 18 nt, Human
ccuggguccccuggagcu

SEQ ID NO: 892604 - RNA, 18 nt, Human
cgacggcgccuggguccc

SEQ ID NO: 892605 - RNA, 19 nt, Human
cgccuggguccccuggagc

SEQ ID NO: 892606 - RNA, 21 nt, Human
cgccuggguccccuggagcuc

SEQ ID NO: 892607 - RNA, 27 nt, Human
cggcgccuggguccccuggagcucccu

SEQ ID NO: 892608 - RNA, 26 nt, Human
cucccuaccucgcgcagaauuguucg

SEQ ID NO: 892609 - RNA, 24 nt, Human
gaagacaucucacuccaacucuca

SEQ ID NO: 892610 - RNA, 18 nt, Human
gacgccuuccagcuuccc

SEQ ID NO: 892611 - RNA, 19 nt, Human
gagcuccccggccauuucc

SEQ ID NO: 892612 - RNA, 18 nt, Human
gccagacccggccugaaa

SEQ ID NO: 892613 - RNA, 20 nt, Human
gccuggguccccuggagcuc

SEQ ID NO: 892614 - RNA, 20 nt, Human
uaagaugcccuaaacccaaa

SEQ ID NO: 892615 - RNA, 21 nt, Human
uaagaugcccuaaacccaaac

SEQ ID NO: 892616 - RNA, 18 nt, Human
uaucaggugccaaaacau

SEQ ID NO: 892617 - RNA, 24 nt, Human
uccacauucaccaacuuccccacu

SEQ ID NO: 892618 - RNA, 22 nt, Human
uccccuggagcuccccggccau

SEQ ID NO: 892619 - RNA, 20 nt, Human
uccgagggcggcccggcaag

SEQ ID NO: 892620 - RNA, 20 nt, Human
ucuaagaacucuggauacaa

SEQ ID NO: 892621 - RNA, 19 nt, Human
ucuaagaugcccuaaaccc

SEQ ID NO: 892622 - RNA, 21 nt, Human
ugcccuaaacccaaacaguuc

SEQ ID NO: 892623 - RNA, 22 nt, Human
uggaauuaaauaaaccuggaac

SEQ ID NO: 892624 - RNA, 23 nt, Human
uggauacaacgggaacuuggaug

SEQ ID NO: 892625 - RNA, 23 nt, Human
uggcggacaggcaggagagcugg

SEQ ID NO: 892626 - RNA, 18 nt, Human
ugggaaaggagaacgacg

SEQ ID NO: 892627 - RNA, 19 nt, Human
uuccaucaaucaacucuaa

SEQ ID NO: 892628 - RNA, 20 nt, Human
uuuuaagaagcuuugacaga

SEQ ID NO: 892629 - RNA, 23 nt, Human
uuuuuuuuuuuuuuuuuuacuga

SEQ ID NO: 892630 - RNA, 18 nt, Human
aacagguuuuucucacau

SEQ ID NO: 892631 - RNA, 18 nt, Human
aagaaccagagggaaaca

SEQ ID NO: 892632 - RNA, 18 nt, Human
aaggaagaauugaguugc

SEQ ID NO: 892633 - RNA, 20 nt, Human
aagugaccuugcagaugaag

SEQ ID NO: 892634 - RNA, 20 nt, Human
acugaacucccccgagaaaa

SEQ ID NO: 892635 - RNA, 18 nt, Human
agacagagcacccccaug

SEQ ID NO: 892636 - RNA, 24 nt, Human
agagcacccccaugccaggagcuc

SEQ ID NO: 892637 - RNA, 22 nt, Human
agagggaaacagguuuuucuca

SEQ ID NO: 892638 - RNA, 20 nt, Human
aggcaggcagaucaggaaug

SEQ ID NO: 892639 - RNA, 24 nt, Human
aggccaaggcaggcagaucaggaa

SEQ ID NO: 892640 - RNA, 21 nt, Human
aucucuuggaaaggggcaggc

SEQ ID NO: 892641 - RNA, 19 nt, Human
augccuguaaucccagcac

SEQ ID NO: 892642 - RNA, 21 nt, Human
caacacuuggaaugcacagga

SEQ ID NO: 892643 - RNA, 18 nt, Human
caagacauacugcaguac

SEQ ID NO: 892644 - RNA, 18 nt, Human
caaugagaacccuuacuu

SEQ ID NO: 892645 - RNA, 21 nt, Human
cagcacuuuggaaggccaagg

SEQ ID NO: 892646 - RNA, 24 nt, Human
cagcacuuuggaaggccaaggcag

SEQ ID NO: 892647 - RNA, 21 nt, Human
caggcccucagauggggacac

SEQ ID NO: 892648 - RNA, 23 nt, Human
caggccgggcgcgguggcucaug

SEQ ID NO: 892649 - RNA, 19 nt, Human
caggugagaacagagggug

SEQ ID NO: 892650 - RNA, 24 nt, Human
caugccuguaaucccagcacuuug

SEQ ID NO: 892651 - RNA, 24 nt, Human
ccaaaccaagucugggugggcaca

SEQ ID NO: 892652 - RNA, 23 nt, Human
ccaggaagaaccagagggaaaca

SEQ ID NO: 892653 - RNA, 25 nt, Human
ccccugagaauccugaaucugugaa

SEQ ID NO: 892654 - RNA, 25 nt, Human
ccucuuaaaaggcaacaaugagaac

SEQ ID NO: 892655 - RNA, 21 nt, Human
ccuuacuuggacccacucccc

SEQ ID NO: 892656 - RNA, 24 nt, Human
cucaugccuguaaucccagcacuu

SEQ ID NO: 892657 - RNA, 24 nt, Human
cugugaauguggcccagacagaac

SEQ ID NO: 892658 - RNA, 24 nt, Human
cuuacugcauaccaggcccucaga

SEQ ID NO: 892659 - RNA, 21 nt, Human
cuuacuuggacccacucccca

SEQ ID NO: 892660 - RNA, 19 nt, Human
gcaggcagaucaggaaugu

SEQ ID NO: 892661 - RNA, 19 nt, Human
ggaaauacacuucagccuc

SEQ ID NO: 892662 - RNA, 18 nt, Human
ggaagaaccagagggaaa

SEQ ID NO: 892663 - RNA, 21 nt, Human
ggcaggccgggcgcgguggcu

SEQ ID NO: 892664 - RNA, 23 nt, Human
ggccgggcgcgguggcucaugcc

SEQ ID NO: 892665 - RNA, 24 nt, Human
gggcgcgguggcucaugccuguaa

SEQ ID NO: 892666 - RNA, 20 nt, Human
ggggcaggccgggcgcggug

SEQ ID NO: 892667 - RNA, 20 nt, Human
ggguagaaggaagaauugag

SEQ ID NO: 892668 - RNA, 23 nt, Human
gguggcucaugccuguaauccca

SEQ ID NO: 892669 - RNA, 24 nt, Human
gguggcucaugccuguaaucccag

SEQ ID NO: 892670 - RNA, 21 nt, Human
gugaauguggcccagacagaa

SEQ ID NO: 892671 - RNA, 22 nt, Human
gugcaaagccaggaagaaccag

SEQ ID NO: 892672 - RNA, 23 nt, Human
guggcccaaaccaagucugggug

SEQ ID NO: 892673 - RNA, 22 nt, Human
ucaugccuguaaucccagcacu

SEQ ID NO: 892674 - RNA, 23 nt, Human
ucaugcugaaguaacacgguaag

SEQ ID NO: 892675 - RNA, 21 nt, Human
ucugguggcccaaaccaaguc

SEQ ID NO: 892676 - RNA, 18 nt, Human
ugagaacagaggguggcc

SEQ ID NO: 892677 - RNA, 22 nt, Human
ugagaacagaggguggccacca

SEQ ID NO: 892678 - RNA, 20 nt, Human
ugagaacccuuacuuggacc

SEQ ID NO: 892679 - RNA, 22 nt, Human
ugagaacccuuacuuggaccca

SEQ ID NO: 892680 - RNA, 18 nt, Human
ugagccacacacaugucc

SEQ ID NO: 892681 - RNA, 18 nt, Human
ugcaaagccaggaagaac

SEQ ID NO: 892682 - RNA, 22 nt, Human
ugcagccaggcgaagacagagc

SEQ ID NO: 892683 - RNA, 25 nt, Human
ugcagccaggcgaagacagagcacc

SEQ ID NO: 892684 - RNA, 18 nt, Human
ugccuguaaucccagcac

SEQ ID NO: 892685 - RNA, 23 nt, Human
ugccuguaaucccagcacuuugg

SEQ ID NO: 892686 - RNA, 21 nt, Human
uggaaaggggcaggccgggcg

SEQ ID NO: 892687 - RNA, 24 nt, Human
uggaaggccaaggcaggcagauca

SEQ ID NO: 892688 - RNA, 24 nt, Human
uggaguguuuuuggguagaaggaa

SEQ ID NO: 892689 - RNA, 24 nt, Human
uggcucaugccuguaaucccagca

SEQ ID NO: 892690 - RNA, 20 nt, Human
uggggcuauguaagugaccu

SEQ ID NO: 892691 - RNA, 22 nt, Human
uggguagaaggaagaauugagu

SEQ ID NO: 892692 - RNA, 22 nt, Human
ugugaauguggcccagacagaa

SEQ ID NO: 892693 - RNA, 18 nt, Human
uuaugcugagcauaucuc

SEQ ID NO: 892694 - RNA, 18 nt, Human
uugcagaugaagucgcca

SEQ ID NO: 892695 - RNA, 19 nt, Human
uuuuuuuuuuuuuuuugca

SEQ ID NO: 892696 - RNA, 18 nt, Human
uuuuuuuuuuuuuuuuug

SEQ ID NO: 892697 - RNA, 22 nt, Human
uuuuuuuuuuuuuuuuugcauu

SEQ ID NO: 892698 - RNA, 18 nt, Human
aacuugcaauaacaaccu

SEQ ID NO: 892699 - RNA, 23 nt, Human
acaguaguaaagauugagguauc

SEQ ID NO: 892700 - RNA, 20 nt, Human
auuccuuuuuuacuuucuuu

SEQ ID NO: 892701 - RNA, 18 nt, Human
cagaaggaauccauggca

SEQ ID NO: 892702 - RNA, 21 nt, Human
gaguaaucuagaaaauuuuaa

SEQ ID NO: 892703 - RNA, 21 nt, Human
ggaucagaaaaugcaaauuga

SEQ ID NO: 892704 - RNA, 24 nt, Human
uaauugguccuuucccaucaguuc

SEQ ID NO: 892705 - RNA, 21 nt, Human
uacaaaauguucaucuuggau

SEQ ID NO: 892706 - RNA, 18 nt, Human
uaucagcuuuucacaaaa

SEQ ID NO: 892707 - RNA, 20 nt, Human
ucuuugccuuugcagucacu

SEQ ID NO: 892708 - RNA, 22 nt, Human
ugaaugaauuugaucuuuuaaa

SEQ ID NO: 892709 - RNA, 25 nt, Human
ugauuguaaacuccaagucuuccuu

SEQ ID NO: 892710 - RNA, 18 nt, Human
ugcucaggaacgucuaau

SEQ ID NO: 892711 - RNA, 23 nt, Human
uuuagagucuuaaacucuaauuc

SEQ ID NO: 892712 - RNA, 18 nt, Human
aaaccuggagcgaggcag

SEQ ID NO: 892713 - RNA, 26 nt, Human
aggcagggaaaagguacaucaauguc

SEQ ID NO: 892714 - RNA, 21 nt, Human
cacggccagggcccucgugcc

SEQ ID NO: 892715 - RNA, 21 nt, Human
ccggcucuuucgccacggcca

SEQ ID NO: 892716 - RNA, 19 nt, Human
cggccagggcccucgugcc

SEQ ID NO: 892717 - RNA, 19 nt, Human
gagcgaggcagggaaaagg

SEQ ID NO: 892718 - RNA, 22 nt, Human
gggucuccggcuccgccggcuc

SEQ ID NO: 892719 - RNA, 20 nt, Human
ucuccgggagcgggucuccg

SEQ ID NO: 892720 - RNA, 24 nt, Human
ucuccgggagcgggucuccggcuc

SEQ ID NO: 892721 - RNA, 23 nt, Human
aaaaaugggaagcuuaagaagga

SEQ ID NO: 892722 - RNA, 23 nt, Human
aaacagacauaauuccugcccau

SEQ ID NO: 892723 - RNA, 21 nt, Human
aaugagggagcaagguagaga

SEQ ID NO: 892724 - RNA, 27 nt, Human
acuagacccggggauccaacggaaagc

SEQ ID NO: 892725 - RNA, 19 nt, Human
agacccggggauccaacgg

SEQ ID NO: 892726 - RNA, 22 nt, Human
agcaaaacagacauaauuccug

SEQ ID NO: 892727 - RNA, 18 nt, Human
agcaaacucaauuuauag

SEQ ID NO: 892728 - RNA, 22 nt, Human
aggaagccgagauucagggcag

SEQ ID NO: 892729 - RNA, 23 nt, Human
aggaagcggcuucugaacaucua

SEQ ID NO: 892730 - RNA, 20 nt, Human
caagauggcgccaaauucuu

SEQ ID NO: 892731 - RNA, 22 nt, Human
caccgaguccacuuuuccuaac

SEQ ID NO: 892732 - RNA, 18 nt, Human
cacgcguccgccuucugg

SEQ ID NO: 892733 - RNA, 19 nt, Human
cacuuugaccuucucaaga

SEQ ID NO: 892734 - RNA, 19 nt, Human
cagaacaaugaaacugugu

SEQ ID NO: 892735 - RNA, 23 nt, Human
cagacauaauuccugcccauuaa

SEQ ID NO: 892736 - RNA, 18 nt, Human
cagagcgacgccgagggg

SEQ ID NO: 892737 - RNA, 21 nt, Human
ccaaggucgcuaaggacuuau

SEQ ID NO: 892738 - RNA, 18 nt, Human
ccacgccucucgggggcg

SEQ ID NO: 892739 - RNA, 20 nt, Human
ccaucuugccggcuugcgcc

SEQ ID NO: 892740 - RNA, 23 nt, Human
ccgccaucuugccggcuugcgcc

SEQ ID NO: 892741 - RNA, 18 nt, Human
ccucagggcuucugcagu

SEQ ID NO: 892742 - RNA, 18 nt, Human
ccugcaguuuucuuugcg

SEQ ID NO: 892743 - RNA, 20 nt, Human
ccugguucgguuccuuccug

SEQ ID NO: 892744 - RNA, 21 nt, Human
cgcagcagcagagccgaugcc

SEQ ID NO: 892745 - RNA, 21 nt, Human
cgggcgggcaggcgggggcuc

SEQ ID NO: 892746 - RNA, 19 nt, Human
cucauagcucuucagugga

SEQ ID NO: 892747 - RNA, 21 nt, Human
cuggccccgccuugaccacgc

SEQ ID NO: 892748 - RNA, 23 nt, Human
cuugcaugagagucauaacguga

SEQ ID NO: 892749 - RNA, 19 nt, Human
gaagaaucacuuugaccuu

SEQ ID NO: 892750 - RNA, 22 nt, Human
gacugcacagcaggugggaaac

SEQ ID NO: 892751 - RNA, 20 nt, Human
gagggcuuguccugggugcu

SEQ ID NO: 892752 - RNA, 21 nt, Human
gagggcuuguccugggugcug

SEQ ID NO: 892753 - RNA, 20 nt, Human
gaguccacuuuuccuaaccc

SEQ ID NO: 892754 - RNA, 20 nt, Human
gcaaaacagacauaauuccu

SEQ ID NO: 892755 - RNA, 20 nt, Human
gcagagccgaugccgcccgc

SEQ ID NO: 892756 - RNA, 20 nt, Human
gcagcagcagagccgaugcc

SEQ ID NO: 892757 - RNA, 19 nt, Human
gcaggcgggggcuccgcag

SEQ ID NO: 892758 - RNA, 22 nt, Human
gccucagacggaaagccccagc

SEQ ID NO: 892759 - RNA, 18 nt, Human
gccugcgccaguccagag

SEQ ID NO: 892760 - RNA, 20 nt, Human
gccugcgcuuuaccgcuccg

SEQ ID NO: 892761 - RNA, 21 nt, Human
gcuggagggcuuguccugggu

SEQ ID NO: 892762 - RNA, 23 nt, Human
gcuggagggcuuguccugggugc

SEQ ID NO: 892763 - RNA, 19 nt, Human
ggaaagccccagccgccgc

SEQ ID NO: 892764 - RNA, 18 nt, Human
gggccggggccgacagcu

SEQ ID NO: 892765 - RNA, 18 nt, Human
ggggcgggcggggucggg

SEQ ID NO: 892766 - RNA, 21 nt, Human
ggggcgggcggggucgggagc

SEQ ID NO: 892767 - RNA, 20 nt, Human
gguguggccugcuggaggcu

SEQ ID NO: 892768 - RNA, 18 nt, Human
guaaacccaagcgccagg

SEQ ID NO: 892769 - RNA, 18 nt, Human
uaaaacaacagcaaacuc

SEQ ID NO: 892770 - RNA, 19 nt, Human
uacauauauauauaugcgc

SEQ ID NO: 892771 - RNA, 23 nt, Human
uagauacuuaugcacuucacggg

SEQ ID NO: 892772 - RNA, 18 nt, Human
uauacauauauauauaug

SEQ ID NO: 892773 - RNA, 20 nt, Human
uauacauauauauauaugcg

SEQ ID NO: 892774 - RNA, 23 nt, Human
uaugucuauuuuucucucuaaaa

SEQ ID NO: 892775 - RNA, 27 nt, Human
uauuauuuuuuauacauauauauauau

SEQ ID NO: 892776 - RNA, 22 nt, Human
ucaaaaaugggaagcuuaagaa

SEQ ID NO: 892777 - RNA, 22 nt, Human
uccaacggaaagcaaaacagac

SEQ ID NO: 892778 - RNA, 20 nt, Human
ucccuagacgaaugguaccg

SEQ ID NO: 892779 - RNA, 24 nt, Human
ucccuagacgaaugguaccggcuc

SEQ ID NO: 892780 - RNA, 24 nt, Human
uccuaacccuauuuugcagcuaag

SEQ ID NO: 892781 - RNA, 23 nt, Human
ucgcuggagggcuuguccugggu

SEQ ID NO: 892782 - RNA, 23 nt, Human
ucgguuccuuccuggcugugugu

SEQ ID NO: 892783 - RNA, 18 nt, Human
ucuaaaacaacagcaaac

SEQ ID NO: 892784 - RNA, 23 nt, Human
ucuaaaacaacagcaaacucaau

SEQ ID NO: 892785 - RNA, 21 nt, Human
ucuacuagacccggggaucca

SEQ ID NO: 892786 - RNA, 18 nt, Human
ucuacugguaauuucccc

SEQ ID NO: 892787 - RNA, 21 nt, Human
ucuacugguaauuucccccca

SEQ ID NO: 892788 - RNA, 27 nt, Human
ucucuaaaacaacagcaaacucaauuu

SEQ ID NO: 892789 - RNA, 22 nt, Human
ugaaaaaaaaugaauaugucua

SEQ ID NO: 892790 - RNA, 21 nt, Human
ugaaagaaaccacaggauuca

SEQ ID NO: 892791 - RNA, 19 nt, Human
ugaggcgcaguugcugggg

SEQ ID NO: 892792 - RNA, 19 nt, Human
uggagaggaagcggcuucu

SEQ ID NO: 892793 - RNA, 20 nt, Human
ugggaaauggauuuuucucu

SEQ ID NO: 892794 - RNA, 22 nt, Human
ugguguggccugcuggaggcuc

SEQ ID NO: 892795 - RNA, 21 nt, Human
ugucuauuuuucucucuaaaa

SEQ ID NO: 892796 - RNA, 24 nt, Human
ugugucgaguaccuacuauguguc

SEQ ID NO: 892797 - RNA, 19 nt, Human
uucacaaaucccgcugcgg

SEQ ID NO: 892798 - RNA, 18 nt, Human
uucagaacaaugaaacug

SEQ ID NO: 892799 - RNA, 19 nt, Human
uuccugcccauuaagccug

SEQ ID NO: 892800 - RNA, 19 nt, Human
uuccuggcugugugucccu

SEQ ID NO: 892801 - RNA, 18 nt, Human
uuccuuccuggcugugug

SEQ ID NO: 892802 - RNA, 22 nt, Human
uugcaugagagucauaacguga

SEQ ID NO: 892803 - RNA, 20 nt, Human
uuuauacauauauauauauu

SEQ ID NO: 892804 - RNA, 20 nt, Human
uuuuauacauauauauauau

SEQ ID NO: 892805 - RNA, 21 nt, Human
agcccacagugcucaccuucu

SEQ ID NO: 892806 - RNA, 22 nt, Human
ccgcgcccagcgcgcucggcuc

SEQ ID NO: 892807 - RNA, 22 nt, Human
cgcccgcacagccggcagcccg

SEQ ID NO: 892808 - RNA, 18 nt, Human
cggcucgggcggccgcga

SEQ ID NO: 892809 - RNA, 20 nt, Human
cgggaaccauggccgcuggc

SEQ ID NO: 892810 - RNA, 19 nt, Human
cucccggcucgggcggccg

SEQ ID NO: 892811 - RNA, 23 nt, Human
cugguguuuucugucgcuguuca

SEQ ID NO: 892812 - RNA, 18 nt, Human
gggcuuggcggcggcagc

SEQ ID NO: 892813 - RNA, 24 nt, Human
guuuucugucgcuguucagucaac

SEQ ID NO: 892814 - RNA, 20 nt, Human
ucaggcgcccggcgccgccg

SEQ ID NO: 892815 - RNA, 18 nt, Human
ucagucaacuuccagagc

SEQ ID NO: 892816 - RNA, 20 nt, Human
uggcgcacuccgggcuuggc

SEQ ID NO: 892817 - RNA, 19 nt, Human
uggcggcggcagcgggacg

SEQ ID NO: 892818 - RNA, 19 nt, Human
ugguguuuucugucgcugu

SEQ ID NO: 892819 - RNA, 23 nt, Human
aaaggaaaaaaagcaaaaggaaa

SEQ ID NO: 892820 - RNA, 19 nt, Human
aaccuggaggccgagaccc

SEQ ID NO: 892821 - RNA, 18 nt, Human
aggaaaaaaagcaaaagg

SEQ ID NO: 892822 - RNA, 18 nt, Human
ccacaggccgcccccggg

SEQ ID NO: 892823 - RNA, 21 nt, Human
cgcccccgggcuccgaaagcc

SEQ ID NO: 892824 - RNA, 24 nt, Human
cggagggagaaaaggaaaaaaagc

SEQ ID NO: 892825 - RNA, 24 nt, Human
cgggcuccgaaagccgggggagcc

SEQ ID NO: 892826 - RNA, 18 nt, Human
cucagcagcagggggagg

SEQ ID NO: 892827 - RNA, 20 nt, Human
gcagcagggggagggcugga

SEQ ID NO: 892828 - RNA, 21 nt, Human
aaaaaaaaaaaaaaaaagccu

SEQ ID NO: 892829 - RNA, 23 nt, Human
aaaaaaaaaaaaaaaagccuuug

SEQ ID NO: 892830 - RNA, 21 nt, Human
aaaaaaaaaagccuuugucau

SEQ ID NO: 892831 - RNA, 20 nt, Human
aacauggagaaaccccgucu

SEQ ID NO: 892832 - RNA, 21 nt, Human
aacauggagaaaccccgucuc

SEQ ID NO: 892833 - RNA, 18 nt, Human
aaccagcauccuuaagcc

SEQ ID NO: 892834 - RNA, 22 nt, Human
aaccccacuuuuccuuccacac

SEQ ID NO: 892835 - RNA, 22 nt, Human
aagaaaccuuuauagauauaga

SEQ ID NO: 892836 - RNA, 24 nt, Human
aagccgggcagacuuggccuuaga

SEQ ID NO: 892837 - RNA, 24 nt, Human
aagggaaaauugaggccuucagag

SEQ ID NO: 892838 - RNA, 18 nt, Human
aaucgcuugaaccuggga

SEQ ID NO: 892839 - RNA, 24 nt, Human
aaucgcuugaaccugggaggcgga

SEQ ID NO: 892840 - RNA, 18 nt, Human
aauuagccaggcauggug

SEQ ID NO: 892841 - RNA, 22 nt, Human
accaagcugacccccagccuca

SEQ ID NO: 892842 - RNA, 21 nt, Human
accaggaagguauggcuggca

SEQ ID NO: 892843 - RNA, 21 nt, Human
accaggccuuguucccaccug

SEQ ID NO: 892844 - RNA, 21 nt, Human
acccagaccccugucccccaa

SEQ ID NO: 892845 - RNA, 23 nt, Human
accccgucucuacuaaaaauaca

SEQ ID NO: 892846 - RNA, 24 nt, Human
accugaggucaggaguucaagacc

SEQ ID NO: 892847 - RNA, 22 nt, Human
acuccagccuagccaacaagag

SEQ ID NO: 892848 - RNA, 23 nt, Human
acuccagccuagccaacaagagc

SEQ ID NO: 892849 - RNA, 19 nt, Human
acuuuuuaacucaggugcu

SEQ ID NO: 892850 - RNA, 22 nt, Human
acuuuuuuuuuuuuuuuuuuuu

SEQ ID NO: 892851 - RNA, 18 nt, Human
agaaccagcauccuuaag

SEQ ID NO: 892852 - RNA, 22 nt, Human
agaaggaagcagugggguagag

SEQ ID NO: 892853 - RNA, 21 nt, Human
agaagggaaaauugaggccug

SEQ ID NO: 892854 - RNA, 19 nt, Human
agacaaucuagaagccccc

SEQ ID NO: 892855 - RNA, 22 nt, Human
agacgggcagaucaccugaggu

SEQ ID NO: 892856 - RNA, 26 nt, Human
agacgggcagaucaccugaggucagg

SEQ ID NO: 892857 - RNA, 18 nt, Human
agagcuaggagaucuggg

SEQ ID NO: 892858 - RNA, 23 nt, Human
agaucaccugaggucaggaguuc

SEQ ID NO: 892859 - RNA, 25 nt, Human
agaucaccugaggucaggaguucaa

SEQ ID NO: 892860 - RNA, 24 nt, Human
agcacuuugggaggccgagacggg

SEQ ID NO: 892861 - RNA, 23 nt, Human
agccaggcaugguggugcaugcc

SEQ ID NO: 892862 - RNA, 22 nt, Human
agcugacccccagccucacccc

SEQ ID NO: 892863 - RNA, 20 nt, Human
aggcagaaguuccaggccca

SEQ ID NO: 892864 - RNA, 22 nt, Human
aggcaggaaaaucgcuugaacc

SEQ ID NO: 892865 - RNA, 24 nt, Human
aggcaggaaaaucgcuugaaccug

SEQ ID NO: 892866 - RNA, 24 nt, Human
aggcaugguggugcaugccuguaa

SEQ ID NO: 892867 - RNA, 19 nt, Human
aggcccagaaccugggucc

SEQ ID NO: 892868 - RNA, 21 nt, Human
aggcccagaaccuggguccca

SEQ ID NO: 892869 - RNA, 24 nt, Human
aggcgcaguggcucaugccgguaa

SEQ ID NO: 892870 - RNA, 20 nt, Human
aggcggaggugcagugagcc

SEQ ID NO: 892871 - RNA, 23 nt, Human
aggcggaggugcagugagccgag

SEQ ID NO: 892872 - RNA, 21 nt, Human
aggcugaggcaggaaaaucgc

SEQ ID NO: 892873 - RNA, 24 nt, Human
aggcugaggcaggaaaaucgcuug

SEQ ID NO: 892874 - RNA, 23 nt, Human
agggcccaguggugaccugccuc

SEQ ID NO: 892875 - RNA, 23 nt, Human
agguccagcagaugcuaccagga

SEQ ID NO: 892876 - RNA, 18 nt, Human
aguggcaguggaagggca

SEQ ID NO: 892877 - RNA, 24 nt, Human
aguggcucaugccgguaaucccag

SEQ ID NO: 892878 - RNA, 22 nt, Human
auaucaaagccuuugucggcca

SEQ ID NO: 892879 - RNA, 24 nt, Human
aucaccugaggucaggaguucaag

SEQ ID NO: 892880 - RNA, 20 nt, Human
auccagaccacccagcccca

SEQ ID NO: 892881 - RNA, 22 nt, Human
auccagcaaugaaaucugagua

SEQ ID NO: 892882 - RNA, 18 nt, Human
auccuguauauauuuugg

SEQ ID NO: 892883 - RNA, 20 nt, Human
augaagcacuggaugggacc

SEQ ID NO: 892884 - RNA, 21 nt, Human
caaacccagaccccugucccc

SEQ ID NO: 892885 - RNA, 22 nt, Human
caaacccagaccccuguccccc

SEQ ID NO: 892886 - RNA, 21 nt, Human
caaacuccuauucacacuccc

SEQ ID NO: 892887 - RNA, 24 nt, Human
caacauggagaaaccccgucucua

SEQ ID NO: 892888 - RNA, 18 nt, Human
caacuccuagccaauccc

SEQ ID NO: 892889 - RNA, 20 nt, Human
caacuuuuuuuuuuuuuuuu

SEQ ID NO: 892890 - RNA, 20 nt, Human
caacuuuuuuuuuuuuuuuu

SEQ ID NO: 892891 - RNA, 24 nt, Human
caagauggaagucccuuagaccaa

SEQ ID NO: 892892 - RNA, 22 nt, Human
cacacuccccaaccuaagaccc

SEQ ID NO: 892893 - RNA, 21 nt, Human
caccuccugccuagacaaucu

SEQ ID NO: 892894 - RNA, 23 nt, Human
caccugaggucaggaguucaaga

SEQ ID NO: 892895 - RNA, 26 nt, Human
caccugcacacacgugugaguguaug

SEQ ID NO: 892896 - RNA, 18 nt, Human
caccuggagccaaacccg

SEQ ID NO: 892897 - RNA, 19 nt, Human
cagaaccagcauccuuaag

SEQ ID NO: 892898 - RNA, 23 nt, Human
cagaaccagcauccuuaagccgg

SEQ ID NO: 892899 - RNA, 20 nt, Human
cagaagccagagcuaggaga

SEQ ID NO: 892900 - RNA, 18 nt, Human
cagaagcucuccugggcu

SEQ ID NO: 892901 - RNA, 21 nt, Human
cagaccacccagccccaaccc

SEQ ID NO: 892902 - RNA, 22 nt, Human
cagaccccugucccccaacuuu

SEQ ID NO: 892903 - RNA, 20 nt, Human
cagagcuaggagaucugggg

SEQ ID NO: 892904 - RNA, 24 nt, Human
cagaucaccugaggucaggaguuc

SEQ ID NO: 892905 - RNA, 18 nt, Human
cagcacagguuaaucccu

SEQ ID NO: 892906 - RNA, 24 nt, Human
cagcacuuugggaggccgagacgg

SEQ ID NO: 892907 - RNA, 19 nt, Human
cagcagaugcuaccaggaa

SEQ ID NO: 892908 - RNA, 24 nt, Human
cagccugaccaacauggagaaacc

SEQ ID NO: 892909 - RNA, 24 nt, Human
cagcuacucgggaggcugaggcag

SEQ ID NO: 892910 - RNA, 22 nt, Human
caggaaacacugaauggauaaa

SEQ ID NO: 892911 - RNA, 20 nt, Human
caggcccagaaccugggucc

SEQ ID NO: 892912 - RNA, 24 nt, Human
cagugagccgagaucgcaccauuu

SEQ ID NO: 892913 - RNA, 22 nt, Human
caguucauucugauaucaaagc

SEQ ID NO: 892914 - RNA, 24 nt, Human
caugccgguaaucccagcacuuug

SEQ ID NO: 892915 - RNA, 19 nt, Human
cauuuuacaagaagggaaa

SEQ ID NO: 892916 - RNA, 22 nt, Human
cauuuuacaagaagggaaaauu

SEQ ID NO: 892917 - RNA, 18 nt, Human
cauuuuacuccagccuag

SEQ ID NO: 892918 - RNA, 23 nt, Human
ccaaacccagaccccuguccccc

SEQ ID NO: 892919 - RNA, 21 nt, Human
ccaacacuuguggcugggcuu

SEQ ID NO: 892920 - RNA, 25 nt, Human
ccaaccccacuuuuccuuccacacu

SEQ ID NO: 892921 - RNA, 24 nt, Human
ccaggcccagaaccugggucccag

SEQ ID NO: 892922 - RNA, 19 nt, Human
ccauuuuacuccagccuag

SEQ ID NO: 892923 - RNA, 20 nt, Human
ccauuuuacuccagccuagc

SEQ ID NO: 892924 - RNA, 24 nt, Human
cccagccucaccccagugaguggc

SEQ ID NO: 892925 - RNA, 22 nt, Human
ccccaaccccacuuuuccuucc

SEQ ID NO: 892926 - RNA, 18 nt, Human
ccccaauccucaccaagc

SEQ ID NO: 892927 - RNA, 20 nt, Human
ccccagcaacuccuagccaa

SEQ ID NO: 892928 - RNA, 21 nt, Human
cccuaaauccaagaauuggcc

SEQ ID NO: 892929 - RNA, 22 nt, Human
ccgguaaucccagcacuuuggg

SEQ ID NO: 892930 - RNA, 23 nt, Human
ccuaagacccugagggucccagg

SEQ ID NO: 892931 - RNA, 22 nt, Human
ccuagccaaucccuaaauccaa

SEQ ID NO: 892932 - RNA, 25 nt, Human
ccucaccaagcugacccccagccuc

SEQ ID NO: 892933 - RNA, 24 nt, Human
ccuccaggcuccgccgucugaguc

SEQ ID NO: 892934 - RNA, 19 nt, Human
ccucugaugugggaugccc

SEQ ID NO: 892935 - RNA, 23 nt, Human
ccugaccaacauggagaaacccc

SEQ ID NO: 892936 - RNA, 24 nt, Human
ccugaccaacauggagaaaccccg

SEQ ID NO: 892937 - RNA, 21 nt, Human
ccugccuagacaaucuagaag

SEQ ID NO: 892938 - RNA, 19 nt, Human
ccugcgucugagcucagga

SEQ ID NO: 892939 - RNA, 22 nt, Human
ccuggagccaaacccagacccc

SEQ ID NO: 892940 - RNA, 22 nt, Human
ccuguaaccccagcuacucggg

SEQ ID NO: 892941 - RNA, 26 nt, Human
cgagacgggcagaucaccugagguca

SEQ ID NO: 892942 - RNA, 21 nt, Human
cgcaccauuuuacuccagccu

SEQ ID NO: 892943 - RNA, 21 nt, Human
cgcuugaaccugggaggcgga

SEQ ID NO: 892944 - RNA, 24 nt, Human
cggccaggcgcaguggcucaugcc

SEQ ID NO: 892945 - RNA, 24 nt, Human
cgggcagaucaccugaggucagga

SEQ ID NO: 892946 - RNA, 18 nt, Human
cucaaaaaaaaaaaaaaa

SEQ ID NO: 892947 - RNA, 18 nt, Human
cucaaaaaaaaaaaaaaa

SEQ ID NO: 892948 - RNA, 22 nt, Human
cucaccaagcugacccccagcu

SEQ ID NO: 892949 - RNA, 24 nt, Human
cucaggacuucagaccaagaugga

SEQ ID NO: 892950 - RNA, 24 nt, Human
cucaugccgguaaucccagcacuu

SEQ ID NO: 892951 - RNA, 19 nt, Human
cuccagcaccucccuugac

SEQ ID NO: 892952 - RNA, 20 nt, Human
cucccugggcaaggagcugg

SEQ ID NO: 892953 - RNA, 21 nt, Human
cuccucaaaaaaaaaaaaaaa

SEQ ID NO: 892954 - RNA, 21 nt, Human
cuccuccaggcuccgccgucu

SEQ ID NO: 892955 - RNA, 20 nt, Human
cucugccuggaaugcccuuc

SEQ ID NO: 892956 - RNA, 18 nt, Human
cugcagccucugggggag

SEQ ID NO: 892957 - RNA, 23 nt, Human
cugggauagugacugaaggagua

SEQ ID NO: 892958 - RNA, 19 nt, Human
cuucagaccaagauggaag

SEQ ID NO: 892959 - RNA, 22 nt, Human
cuuucagaagcucuccugggcu

SEQ ID NO: 892960 - RNA, 21 nt, Human
gaaccagcauccuuaagccgg

SEQ ID NO: 892961 - RNA, 20 nt, Human
gaaccugggaggcggaggug

SEQ ID NO: 892962 - RNA, 24 nt, Human
gacaaucuagaagccccaauccuc

SEQ ID NO: 892963 - RNA, 19 nt, Human
gaccccugucccccaacuu

SEQ ID NO: 892964 - RNA, 21 nt, Human
gagaaaccccgucucuacuaa

SEQ ID NO: 892965 - RNA, 19 nt, Human
gaguggcaguggaagggca

SEQ ID NO: 892966 - RNA, 23 nt, Human
gaucaccugaggucaggaguuca

SEQ ID NO: 892967 - RNA, 24 nt, Human
gaucaccugaggucaggaguucaa

SEQ ID NO: 892968 - RNA, 20 nt, Human
gcaccauuuuacuccagccu

SEQ ID NO: 892969 - RNA, 21 nt, Human
gcaguggaagggcaagcugga

SEQ ID NO: 892970 - RNA, 19 nt, Human
gcuccaacacuuguggcug

SEQ ID NO: 892971 - RNA, 21 nt, Human
ggagccaaacccagaccccug

SEQ ID NO: 892972 - RNA, 23 nt, Human
ggaggugcagugagccgagaucg

SEQ ID NO: 892973 - RNA, 28 nt, Human
ggcagaaguuccaggcccagaaccuggg

SEQ ID NO: 892974 - RNA, 25 nt, Human
ggcagaucaccugaggucaggaguu

SEQ ID NO: 892975 - RNA, 25 nt, Human
ggcaugguggugcaugccuguaacc

SEQ ID NO: 892976 - RNA, 21 nt, Human
ggccaggcgcaguggcucaug

SEQ ID NO: 892977 - RNA, 19 nt, Human
gggauagugacugaaggag

SEQ ID NO: 892978 - RNA, 24 nt, Human
gguggugcaugccuguaaccccag

SEQ ID NO: 892979 - RNA, 22 nt, Human
guaacaagggaaccaggagaga

SEQ ID NO: 892980 - RNA, 22 nt, Human
gugcagugagccgagaucgcac

SEQ ID NO: 892981 - RNA, 23 nt, Human
gugcuguggguagggagcaaggg

SEQ ID NO: 892982 - RNA, 27 nt, Human
gugggacacagaagccagagcuaggag

SEQ ID NO: 892983 - RNA, 21 nt, Human
gugugcaccugcacacacgug

SEQ ID NO: 892984 - RNA, 18 nt, Human
uaacaagggaaccaggag

SEQ ID NO: 892985 - RNA, 25 nt, Human
uaacauaaaaaucacuuuuuaacuc

SEQ ID NO: 892986 - RNA, 21 nt, Human
uaauccagaccacccagcccc

SEQ ID NO: 892987 - RNA, 23 nt, Human
uaauccagaccacccagccccaa

SEQ ID NO: 892988 - RNA, 20 nt, Human
uaaucccucuccagcaccuc

SEQ ID NO: 892989 - RNA, 22 nt, Human
uaccaggaagguauggcuggca

SEQ ID NO: 892990 - RNA, 22 nt, Human
uaccaggccuuguucccaccug

SEQ ID NO: 892991 - RNA, 25 nt, Human
uacuccagccuagccaacaagagcg

SEQ ID NO: 892992 - RNA, 19 nt, Human
uagacaaucuagaagcccc

SEQ ID NO: 892993 - RNA, 22 nt, Human
ucaaaaaaaaaaaaaaaaaaaa

SEQ ID NO: 892994 - RNA, 23 nt, Human
ucaaaaaaaaaaaaaaaaaaaaa

SEQ ID NO: 892995 - RNA, 22 nt, Human
ucacacuccccaaccuaagacc

SEQ ID NO: 892996 - RNA, 25 nt, Human
ucaccaagcugacccccagccucac

SEQ ID NO: 892997 - RNA, 19 nt, Human
ucagaagcucuccugggcu

SEQ ID NO: 892998 - RNA, 21 nt, Human
ucaggacuucagaccaagaug

SEQ ID NO: 892999 - RNA, 18 nt, Human
ucaggugcuguggguagg

SEQ ID NO: 893000 - RNA, 21 nt, Human
uccagcagaugcuaccaggaa

SEQ ID NO: 893001 - RNA, 18 nt, Human
ucccugggcaaggagcug

SEQ ID NO: 893002 - RNA, 20 nt, Human
ucccugggcaaggagcuggg

SEQ ID NO: 893003 - RNA, 21 nt, Human
ucccuugacaguucauucuga

SEQ ID NO: 893004 - RNA, 21 nt, Human
uccgcauccagcaaugaaauc

SEQ ID NO: 893005 - RNA, 20 nt, Human
uccucaaaaaaaaaaaaaaa

SEQ ID NO: 893006 - RNA, 24 nt, Human
uccucaaaaaaaaaaaaaaaaaaa

SEQ ID NO: 893007 - RNA, 24 nt, Human
ucgcuugaaccugggaggcggagg

SEQ ID NO: 893008 - RNA, 24 nt, Human
ucgggaggcugaggcaggaaaauc

SEQ ID NO: 893009 - RNA, 21 nt, Human
ucucccugggcaaggagcugg

SEQ ID NO: 893010 - RNA, 22 nt, Human
ucucuacuaaaaauacagaaaa

SEQ ID NO: 893011 - RNA, 21 nt, Human
ucugcacagguuucccucugc

SEQ ID NO: 893012 - RNA, 23 nt, Human
ucugcacagguuucccucugccu

SEQ ID NO: 893013 - RNA, 23 nt, Human
ucugcagcuccaacacuuguggc

SEQ ID NO: 893014 - RNA, 23 nt, Human
ugaaggaguaugaagcacuggau

SEQ ID NO: 893015 - RNA, 19 nt, Human
ugacccccagccucacccc

SEQ ID NO: 893016 - RNA, 19 nt, Human
ugacugaaggaguaugaag

SEQ ID NO: 893017 - RNA, 18 nt, Human
ugagccgagaucgcacca

SEQ ID NO: 893018 - RNA, 20 nt, Human
ugaggcaggaaaaucgcuug

SEQ ID NO: 893019 - RNA, 24 nt, Human
ugaggcaggaaaaucgcuugaacc

SEQ ID NO: 893020 - RNA, 25 nt, Human
ugaggcaggaaaaucgcuugaaccu

SEQ ID NO: 893021 - RNA, 21 nt, Human
ugcccucaagucccuucacac

SEQ ID NO: 893022 - RNA, 23 nt, Human
ugccgguaaucccagcacuuugg

SEQ ID NO: 893023 - RNA, 18 nt, Human
ugccuagacaaucuagaa

SEQ ID NO: 893024 - RNA, 21 nt, Human
ugccuagacaaucuagaagcc

SEQ ID NO: 893025 - RNA, 18 nt, Human
ugccuggaaugcccuucc

SEQ ID NO: 893026 - RNA, 23 nt, Human
ugccuguaaccccagcuacucgg

SEQ ID NO: 893027 - RNA, 24 nt, Human
ugccuguaaccccagcuacucggg

SEQ ID NO: 893028 - RNA, 22 nt, Human
uggaagggcaagcuggaguggc

SEQ ID NO: 893029 - RNA, 24 nt, Human
uggagccaaacccagaccccuguc

SEQ ID NO: 893030 - RNA, 19 nt, Human
uggcaguaccugcgucuga

SEQ ID NO: 893031 - RNA, 24 nt, Human
uggcucaugccgguaaucccagca

SEQ ID NO: 893032 - RNA, 18 nt, Human
uggcugcagccucugggg

SEQ ID NO: 893033 - RNA, 21 nt, Human
ugggaacaggccgugugggac

SEQ ID NO: 893034 - RNA, 19 nt, Human
ugggaggccgagacgggca

SEQ ID NO: 893035 - RNA, 24 nt, Human
ugggaggccgagacgggcagauca

SEQ ID NO: 893036 - RNA, 23 nt, Human
ugggaggcggaggugcagugagc

SEQ ID NO: 893037 - RNA, 22 nt, Human
ugggguagagucagaaccagca

SEQ ID NO: 893038 - RNA, 21 nt, Human
uggugcaugccuguaacccca

SEQ ID NO: 893039 - RNA, 22 nt, Human
uggugcaugccuguaaccccag

SEQ ID NO: 893040 - RNA, 23 nt, Human
uggugcaugccuguaaccccagc

SEQ ID NO: 893041 - RNA, 24 nt, Human
ugguggugcaugccuguaacccca

SEQ ID NO: 893042 - RNA, 29 nt, Human
ugugcaccugcacacacgugugaguguau

SEQ ID NO: 893043 - RNA, 22 nt, Human
uguggguagggagcaagggcag

SEQ ID NO: 893044 - RNA, 19 nt, Human
uuaaucccucuccagcacc

SEQ ID NO: 893045 - RNA, 20 nt, Human
uucaagggacaguaagaucc

SEQ ID NO: 893046 - RNA, 22 nt, Human
uuccaggcccagaaccuggguc

SEQ ID NO: 893047 - RNA, 21 nt, Human
uugaaccugggaggcggaggu

SEQ ID NO: 893048 - RNA, 20 nt, Human
uuuaccaggccuuguuccca

SEQ ID NO: 893049 - RNA, 22 nt, Human
uuuuuuuuuuuuuuggauuuga

SEQ ID NO: 893050 - RNA, 18 nt, Human
uuuuuuuuuuuuuuuuug

SEQ ID NO: 893051 - RNA, 23 nt, Human
aaaaaaacagaaagcaauaaaac

SEQ ID NO: 893052 - RNA, 24 nt, Human
aaaaaagaaaaaaaaaugaaagga

SEQ ID NO: 893053 - RNA, 27 nt, Human
aaaaagaaaaaaaaaugaaaggaagaa

SEQ ID NO: 893054 - RNA, 29 nt, Human
aaaagaaaaaaaaaugaaaggaagaaaga

SEQ ID NO: 893055 - RNA, 23 nt, Human
aaacagaaagcaauaaaacccaa

SEQ ID NO: 893056 - RNA, 22 nt, Human
aaagaggaaccaaacacgauuc

SEQ ID NO: 893057 - RNA, 21 nt, Human
aaagcaauaaaacccaaaccc

SEQ ID NO: 893058 - RNA, 24 nt, Human
aaaggaagaaagaaagaaacagag

SEQ ID NO: 893059 - RNA, 23 nt, Human
aacaccuguccaauaacugcccu

SEQ ID NO: 893060 - RNA, 19 nt, Human
aagaaagaaacagaggaag

SEQ ID NO: 893061 - RNA, 21 nt, Human
aagaaagaaacagaggaagga

SEQ ID NO: 893062 - RNA, 22 nt, Human
aagaaagaaacagaggaaggaa

SEQ ID NO: 893063 - RNA, 21 nt, Human
aagaaagaaagaaacagagga

SEQ ID NO: 893064 - RNA, 18 nt, Human
aagcaauaaaacccaaac

SEQ ID NO: 893065 - RNA, 21 nt, Human
aagcagaaggugccuacaaag

SEQ ID NO: 893066 - RNA, 20 nt, Human
aagggcuccauuucauuacc

SEQ ID NO: 893067 - RNA, 18 nt, Human
aaggugccuacaaaguuu

SEQ ID NO: 893068 - RNA, 18 nt, Human
aaguggcagcgggacagg

SEQ ID NO: 893069 - RNA, 21 nt, Human
acaggaacaaugaagcagaga

SEQ ID NO: 893070 - RNA, 19 nt, Human
acugguuaguuccagggaa

SEQ ID NO: 893071 - RNA, 18 nt, Human
acuuagucacacaacauc

SEQ ID NO: 893072 - RNA, 23 nt, Human
agaaaaaaacagaaagcaauaaa

SEQ ID NO: 893073 - RNA, 21 nt, Human
agaggaaggaaggaaugaaag

SEQ ID NO: 893074 - RNA, 20 nt, Human
agagugucacuguacuggaa

SEQ ID NO: 893075 - RNA, 22 nt, Human
aggaacaaugaagcagagaagc

SEQ ID NO: 893076 - RNA, 23 nt, Human
aggaagaaagaaagaaacagagg

SEQ ID NO: 893077 - RNA, 18 nt, Human
aggagugggcuggaugag

SEQ ID NO: 893078 - RNA, 20 nt, Human
aggauggagcugaugcgccc

SEQ ID NO: 893079 - RNA, 21 nt, Human
aggggaaaaggagugggcugg

SEQ ID NO: 893080 - RNA, 22 nt, Human
aucugccaaugggcaccagagu

SEQ ID NO: 893081 - RNA, 19 nt, Human
augaaacaaccaaucuacc

SEQ ID NO: 893082 - RNA, 23 nt, Human
augaaaggaagaaagaaagaaac

SEQ ID NO: 893083 - RNA, 19 nt, Human
augaagcagagaagcagaa

SEQ ID NO: 893084 - RNA, 26 nt, Human
caacaucaaggacugguuaguuccag

SEQ ID NO: 893085 - RNA, 23 nt, Human
caaugugaggcuguuuugggcac

SEQ ID NO: 893086 - RNA, 22 nt, Human
cacaacaucaaggacugguuag

SEQ ID NO: 893087 - RNA, 24 nt, Human
cacaaugcaguagaaccaaacaac

SEQ ID NO: 893088 - RNA, 24 nt, Human
cacacaacaucaaggacugguuag

SEQ ID NO: 893089 - RNA, 18 nt, Human
cacagaguaguucugaaa

SEQ ID NO: 893090 - RNA, 18 nt, Human
cagaaggugccuacaaag

SEQ ID NO: 893091 - RNA, 24 nt, Human
cagaaggugccuacaaaguuuuac

SEQ ID NO: 893092 - RNA, 21 nt, Human
cagaguaguucugaaaaggag

SEQ ID NO: 893093 - RNA, 19 nt, Human
caguagaaccaaacaacac

SEQ ID NO: 893094 - RNA, 18 nt, Human
caguagcugcucugccug

SEQ ID NO: 893095 - RNA, 21 nt, Human
ccaggggccucucugcccaug

SEQ ID NO: 893096 - RNA, 23 nt, Human
ccuauaggcagcaugaacggucc

SEQ ID NO: 893097 - RNA, 20 nt, Human
ccuccuguaacaaugugagg

SEQ ID NO: 893098 - RNA, 22 nt, Human
ccuguaacaaugugaggcuguu

SEQ ID NO: 893099 - RNA, 22 nt, Human
cgcucuuaaaaaagaaaaaaaa

SEQ ID NO: 893100 - RNA, 19 nt, Human
cuccacaaugcaguagaac

SEQ ID NO: 893101 - RNA, 19 nt, Human
cugccaaugggcaccagag

SEQ ID NO: 893102 - RNA, 21 nt, Human
cugcucugccugccggcauca

SEQ ID NO: 893103 - RNA, 22 nt, Human
cuucggcugggccuugcccucc

SEQ ID NO: 893104 - RNA, 25 nt, Human
gaaaggaagaaagaaagaaacagaa

SEQ ID NO: 893105 - RNA, 24 nt, Human
gcagagaagcagaaggugccuaca

SEQ ID NO: 893106 - RNA, 27 nt, Human
gcagagaagcagaaggugccuacaaag

SEQ ID NO: 893107 - RNA, 22 nt, Human
gcagagccgcucgcucuuaaaa

SEQ ID NO: 893108 - RNA, 20 nt, Human
gccaaugggcaccagagugu

SEQ ID NO: 893109 - RNA, 24 nt, Human
gcccaccccaaaccgccaccgcag

SEQ ID NO: 893110 - RNA, 22 nt, Human
gccgagugugaagugacacccc

SEQ ID NO: 893111 - RNA, 24 nt, Human
ggacagguuuggucaucugcagug

SEQ ID NO: 893112 - RNA, 18 nt, Human
ggucaguucucuuccccc

SEQ ID NO: 893113 - RNA, 21 nt, Human
guucaaagucaguagcugcuc

SEQ ID NO: 893114 - RNA, 21 nt, Human
uaauaacaacaggacuaucac

SEQ ID NO: 893115 - RNA, 26 nt, Human
uaauggauguuuuuaaacccugcaac

SEQ ID NO: 893116 - RNA, 25 nt, Human
uacaauagaauguuuaaauaacacc

SEQ ID NO: 893117 - RNA, 21 nt, Human
uacaguaauggccucuuaaga

SEQ ID NO: 893118 - RNA, 20 nt, Human
uacuggaaggggaaaaggag

SEQ ID NO: 893119 - RNA, 21 nt, Human
uagaaccaaacaacacauuca

SEQ ID NO: 893120 - RNA, 25 nt, Human
ucaguagcugcucugccugccggca

SEQ ID NO: 893121 - RNA, 24 nt, Human
ucgccaucugccaaugggcaccag

SEQ ID NO: 893122 - RNA, 23 nt, Human
ucgcucuuaaaaaagaaaaaaaa

SEQ ID NO: 893123 - RNA, 20 nt, Human
ucggcggcgcccaccccaaa

SEQ ID NO: 893124 - RNA, 25 nt, Human
ucgggaaaagaaaaaaacagaaagc

SEQ ID NO: 893125 - RNA, 21 nt, Human
ugaaaggaagaaagaaagaaa

SEQ ID NO: 893126 - RNA, 21 nt, Human
ugaagcagagaagcagaaggu

SEQ ID NO: 893127 - RNA, 21 nt, Human
ugaagugacacccccagcaga

SEQ ID NO: 893128 - RNA, 26 nt, Human
ugcaguggaguagaaagaggaaccaa

SEQ ID NO: 893129 - RNA, 18 nt, Human
ugcaugccgagugugaag

SEQ ID NO: 893130 - RNA, 23 nt, Human
ugccaaugggcaccagaguguca

SEQ ID NO: 893131 - RNA, 25 nt, Human
ugccuauucuccuggggcauuuuua

SEQ ID NO: 893132 - RNA, 18 nt, Human
ugcgcccauacuggcaga

SEQ ID NO: 893133 - RNA, 25 nt, Human
uggggcauuuuuaguggaacuucgg

SEQ ID NO: 893134 - RNA, 23 nt, Human
ugguuaaaaaugucauguuguac

SEQ ID NO: 893135 - RNA, 21 nt, Human
uguaauaacaacaggacuauc

SEQ ID NO: 893136 - RNA, 18 nt, Human
ugugcugucgggaaaaga

SEQ ID NO: 893137 - RNA, 18 nt, Human
uuaaacccugcaacccuc

SEQ ID NO: 893138 - RNA, 26 nt, Human
uuaguggaacuucggcugggccuugc

SEQ ID NO: 893139 - RNA, 26 nt, Human
uuuauuagcuuucauguuaauggaug

SEQ ID NO: 893140 - RNA, 18 nt, Human
uuuggcaagccagccggu

SEQ ID NO: 893141 - RNA, 20 nt, Human
uuuuuagauuggauugguua

SEQ ID NO: 893142 - RNA, 20 nt, Human
cccccgccccgcucgccucg

SEQ ID NO: 893143 - RNA, 20 nt, Human
ccccgaccgccuccggcccc

SEQ ID NO: 893144 - RNA, 18 nt, Human
ccccgcucgccucgcugc

SEQ ID NO: 893145 - RNA, 19 nt, Human
ccccgcucgccucgcugcc

SEQ ID NO: 893146 - RNA, 22 nt, Human
cccgggcccggccccgaccgcc

SEQ ID NO: 893147 - RNA, 20 nt, Human
cccugcucugagcacagccc

SEQ ID NO: 893148 - RNA, 21 nt, Human
ccgccccgcucgccucgcugc

SEQ ID NO: 893149 - RNA, 22 nt, Human
ccgccccgcucgccucgcugcc

SEQ ID NO: 893150 - RNA, 23 nt, Human
ccgccuccggccccgaacggacu

SEQ ID NO: 893151 - RNA, 19 nt, Human
ccggccccgaccgccuccg

SEQ ID NO: 893152 - RNA, 22 nt, Human
ccggcggcuacgcgcgcuccuc

SEQ ID NO: 893153 - RNA, 27 nt, Human
ccgggcccggccccgaccgccuccggc

SEQ ID NO: 893154 - RNA, 22 nt, Human
ccucgcugccgccaccgcagcc

SEQ ID NO: 893155 - RNA, 20 nt, Human
cgccgcgcccgcgcccccgc

SEQ ID NO: 893156 - RNA, 18 nt, Human
cgccucgcugccgccacc

SEQ ID NO: 893157 - RNA, 20 nt, Human
cgcgcccgcgcccccgcccc

SEQ ID NO: 893158 - RNA, 20 nt, Human
cgcugccgccaccgcagccg

SEQ ID NO: 893159 - RNA, 19 nt, Human
cugccgccaccgcagccgc

SEQ ID NO: 893160 - RNA, 18 nt, Human
gcccgcgcccccgccccg

SEQ ID NO: 893161 - RNA, 19 nt, Human
gcccgcgcccccgccccgc

SEQ ID NO: 893162 - RNA, 22 nt, Human
gccgccaccgcagccgccgccg

SEQ ID NO: 893163 - RNA, 23 nt, Human
uacgcgcgcuccucgcgcuuccc

SEQ ID NO: 893164 - RNA, 20 nt, Human
uccucgcgcuucccgggccc

SEQ ID NO: 893165 - RNA, 20 nt, Human
uucccgggcccggccccgac

SEQ ID NO: 893166 - RNA, 23 nt, Human
aaacagacggcacacggacagac

SEQ ID NO: 893167 - RNA, 27 nt, Human
aaacagacggcacacggacagaccaga

SEQ ID NO: 893168 - RNA, 19 nt, Human
aacuugguccauaaaauaa

SEQ ID NO: 893169 - RNA, 22 nt, Human
aaguuaacaucacucugugcac

SEQ ID NO: 893170 - RNA, 19 nt, Human
agaaggcaggugguggggc

SEQ ID NO: 893171 - RNA, 22 nt, Human
agacggucagacccagcgugca

SEQ ID NO: 893172 - RNA, 19 nt, Human
agagccuggucgcuggaca

SEQ ID NO: 893173 - RNA, 27 nt, Human
agagccuggucgcuggacaaaggccga

SEQ ID NO: 893174 - RNA, 20 nt, Human
agcagcagaggggccgccgg

SEQ ID NO: 893175 - RNA, 19 nt, Human
agccagggagggguggggg

SEQ ID NO: 893176 - RNA, 19 nt, Human
agccggacccgucaggccc

SEQ ID NO: 893177 - RNA, 20 nt, Human
aggaagcagccaaggauugc

SEQ ID NO: 893178 - RNA, 23 nt, Human
aggcagacaggugggcagggucc

SEQ ID NO: 893179 - RNA, 22 nt, Human
aggcaggugguggggcgugggg

SEQ ID NO: 893180 - RNA, 21 nt, Human
aggcccgaggacgugaggcag

SEQ ID NO: 893181 - RNA, 19 nt, Human
aggcccugggacaaucucc

SEQ ID NO: 893182 - RNA, 25 nt, Human
aggccgaggccaggcaggcucuccc

SEQ ID NO: 893183 - RNA, 25 nt, Human
aggcggggagugaggagccgugggg

SEQ ID NO: 893184 - RNA, 20 nt, Human
agggacggauggggagaugg

SEQ ID NO: 893185 - RNA, 22 nt, Human
agggacggauggggagaugggg

SEQ ID NO: 893186 - RNA, 21 nt, Human
agggagcacuguguggugcgg

SEQ ID NO: 893187 - RNA, 19 nt, Human
aggugguggggcguggggg

SEQ ID NO: 893188 - RNA, 19 nt, Human
aggugguggggcguggggg

SEQ ID NO: 893189 - RNA, 22 nt, Human
agugaggguggccaguggaugg

SEQ ID NO: 893190 - RNA, 18 nt, Human
augcaugucaacggggcu

SEQ ID NO: 893191 - RNA, 20 nt, Human
auggcugccugcccugaagc

SEQ ID NO: 893192 - RNA, 22 nt, Human
caagaggagaaugugccaaaag

SEQ ID NO: 893193 - RNA, 20 nt, Human
caaggucacgcuuggugcug

SEQ ID NO: 893194 - RNA, 22 nt, Human
cacucugugcaccuccccagcc

SEQ ID NO: 893195 - RNA, 20 nt, Human
cacuggccugggcuccaggc

SEQ ID NO: 893196 - RNA, 24 nt, Human
cacuuccgggaaagccgaggagca

SEQ ID NO: 893197 - RNA, 21 nt, Human
cagacggcacacggacagacc

SEQ ID NO: 893198 - RNA, 18 nt, Human
cagacggucagacccagc

SEQ ID NO: 893199 - RNA, 21 nt, Human
cagaguagaaauucaguggga

SEQ ID NO: 893200 - RNA, 18 nt, Human
caggcagacaggugggca

SEQ ID NO: 893201 - RNA, 23 nt, Human
caggcggggagugaggagccgug

SEQ ID NO: 893202 - RNA, 23 nt, Human
cagggccccugacaggggcugug

SEQ ID NO: 893203 - RNA, 23 nt, Human
caguacugaaagaguuaagaaaa

SEQ ID NO: 893204 - RNA, 18 nt, Human
caguguggaggggcugcu

SEQ ID NO: 893205 - RNA, 18 nt, Human
cauggcccagagaaacag

SEQ ID NO: 893206 - RNA, 25 nt, Human
ccacacagggcaaaaugucugggag

SEQ ID NO: 893207 - RNA, 20 nt, Human
ccagcccguggccugaggcu

SEQ ID NO: 893208 - RNA, 18 nt, Human
ccaggcccacgucagugc

SEQ ID NO: 893209 - RNA, 24 nt, Human
ccaggcccacgucagugcgugugc

SEQ ID NO: 893210 - RNA, 18 nt, Human
ccagggaggggugggggg

SEQ ID NO: 893211 - RNA, 19 nt, Human
ccagggagggguggggggu

SEQ ID NO: 893212 - RNA, 19 nt, Human
ccaggggacuauugcuguu

SEQ ID NO: 893213 - RNA, 24 nt, Human
ccauccuggggcugguggucccug

SEQ ID NO: 893214 - RNA, 22 nt, Human
cccacccaccccagaguagaaa

SEQ ID NO: 893215 - RNA, 22 nt, Human
cccacgucagugcgugugccca

SEQ ID NO: 893216 - RNA, 27 nt, Human
ccccacccaccccagaguagaaauuca

SEQ ID NO: 893217 - RNA, 19 nt, Human
ccccuggggagaggcugag

SEQ ID NO: 893218 - RNA, 20 nt, Human
cccguggccugaggcuggaa

SEQ ID NO: 893219 - RNA, 19 nt, Human
cccguguccuccacaaggc

SEQ ID NO: 893220 - RNA, 20 nt, Human
ccgcgcugcacucacggugc

SEQ ID NO: 893221 - RNA, 19 nt, Human
ccgcugggagagccccagg

SEQ ID NO: 893222 - RNA, 19 nt, Human
ccguugagcgccacagcca

SEQ ID NO: 893223 - RNA, 20 nt, Human
ccguugagcgccacagccaa

SEQ ID NO: 893224 - RNA, 21 nt, Human
cgcuuggugcuggggagagag

SEQ ID NO: 893225 - RNA, 19 nt, Human
cggcccguguccuccacaa

SEQ ID NO: 893226 - RNA, 19 nt, Human
cgggaggggcugagacgug

SEQ ID NO: 893227 - RNA, 19 nt, Human
cggggcuggccacccuggc

SEQ ID NO: 893228 - RNA, 18 nt, Human
cucugccgcacuggagcc

SEQ ID NO: 893229 - RNA, 21 nt, Human
cucuguauagacccacuuuug

SEQ ID NO: 893230 - RNA, 23 nt, Human
cugaaacaacaaaaagcuacauc

SEQ ID NO: 893231 - RNA, 18 nt, Human
cuggggcugguggucccu

SEQ ID NO: 893232 - RNA, 18 nt, Human
gaaacaacaaaaagcuac

SEQ ID NO: 893233 - RNA, 19 nt, Human
gaaggcaggugguggggcg

SEQ ID NO: 893234 - RNA, 20 nt, Human
gacccagaaccaggcuggaa

SEQ ID NO: 893235 - RNA, 18 nt, Human
gagaaugugccaaaagga

SEQ ID NO: 893236 - RNA, 21 nt, Human
gagcacuguguggugcggccc

SEQ ID NO: 893237 - RNA, 22 nt, Human
gagcagcagaggggccgccgga

SEQ ID NO: 893238 - RNA, 19 nt, Human
gaggagccgugggggagcu

SEQ ID NO: 893239 - RNA, 23 nt, Human
gagugaggagccgugggggagcu

SEQ ID NO: 893240 - RNA, 19 nt, Human
gaugcggggacagcaggga

SEQ ID NO: 893241 - RNA, 21 nt, Human
gcagaacauuuacacgacccu

SEQ ID NO: 893242 - RNA, 20 nt, Human
gcagcagaggggccgccgga

SEQ ID NO: 893243 - RNA, 18 nt, Human
gcaggcucucccacuucc

SEQ ID NO: 893244 - RNA, 19 nt, Human
gcggggacagcagggacgg

SEQ ID NO: 893245 - RNA, 20 nt, Human
gcgugugcccaggccaggcc

SEQ ID NO: 893246 - RNA, 21 nt, Human
gcuggaaacaacacuggccug

SEQ ID NO: 893247 - RNA, 25 nt, Human
gcuugcacgaggcucugccgcacca

SEQ ID NO: 893248 - RNA, 23 nt, Human
ggacccagaaccaggcuggacuc

SEQ ID NO: 893249 - RNA, 18 nt, Human
ggacccgucaggcccgag

SEQ ID NO: 893250 - RNA, 19 nt, Human
ggaccugggagugagggug

SEQ ID NO: 893251 - RNA, 21 nt, Human
ggacuucuaggcaagguuccu

SEQ ID NO: 893252 - RNA, 20 nt, Human
ggagggguggggggucucug

SEQ ID NO: 893253 - RNA, 19 nt, Human
ggcaggcagacaggugggc

SEQ ID NO: 893254 - RNA, 21 nt, Human
ggcaggcagacaggugggcag

SEQ ID NO: 893255 - RNA, 23 nt, Human
ggccaagagaggaggaggcacug

SEQ ID NO: 893256 - RNA, 21 nt, Human
ggccaggcaggcucucccacu

SEQ ID NO: 893257 - RNA, 18 nt, Human
ggcuggcggcugggcagg

SEQ ID NO: 893258 - RNA, 19 nt, Human
ggcugggcaggcaggcggg

SEQ ID NO: 893259 - RNA, 18 nt, Human
gggaggggcugagacgug

SEQ ID NO: 893260 - RNA, 24 nt, Human
gggagugaggagccgugggggagc

SEQ ID NO: 893261 - RNA, 19 nt, Human
gggcaggcaggcggggagu

SEQ ID NO: 893262 - RNA, 21 nt, Human
gggcaggcugcccaccuugcc

SEQ ID NO: 893263 - RNA, 23 nt, Human
gggcaggguccggggugcagaaa

SEQ ID NO: 893264 - RNA, 19 nt, Human
ggggaccugggagugaggg

SEQ ID NO: 893265 - RNA, 21 nt, Human
ggggagcugccccccugggga

SEQ ID NO: 893266 - RNA, 18 nt, Human
ggggccaagagaggagga

SEQ ID NO: 893267 - RNA, 20 nt, Human
ggggccaagagaggaggagg

SEQ ID NO: 893268 - RNA, 21 nt, Human
ggggcgugggggugugguggg

SEQ ID NO: 893269 - RNA, 18 nt, Human
gggggagcugccccccug

SEQ ID NO: 893270 - RNA, 20 nt, Human
ggggguggcagucagcaagg

SEQ ID NO: 893271 - RNA, 22 nt, Human
gguggggcguggggguguggug

SEQ ID NO: 893272 - RNA, 18 nt, Human
gucccucugccauccugg

SEQ ID NO: 893273 - RNA, 19 nt, Human
gugauggggugggcagugg

SEQ ID NO: 893274 - RNA, 22 nt, Human
guggaaagcagaccuggauaca

SEQ ID NO: 893275 - RNA, 22 nt, Human
guggauggggagguggcaggcu

SEQ ID NO: 893276 - RNA, 24 nt, Human
uaaauagcuuucacucuguauaga

SEQ ID NO: 893277 - RNA, 22 nt, Human
uacagagcacacucaggcccaa

SEQ ID NO: 893278 - RNA, 18 nt, Human
uagcaccauggagacccc

SEQ ID NO: 893279 - RNA, 21 nt, Human
uaggaggugguaaugggucuc

SEQ ID NO: 893280 - RNA, 21 nt, Human
uauugcacuuucacugcaaca

SEQ ID NO: 893281 - RNA, 20 nt, Human
ucacugcaacaguuacaugg

SEQ ID NO: 893282 - RNA, 20 nt, Human
ucagauauugcacuuucacu

SEQ ID NO: 893283 - RNA, 18 nt, Human
ucagugcgugugcccagg

SEQ ID NO: 893284 - RNA, 19 nt, Human
ucagugcgugugcccaggc

SEQ ID NO: 893285 - RNA, 19 nt, Human
ucagugugguuguaggucc

SEQ ID NO: 893286 - RNA, 21 nt, Human
ucccaacaccagacccagguc

SEQ ID NO: 893287 - RNA, 21 nt, Human
ucuaacaggccuggggggugg

SEQ ID NO: 893288 - RNA, 22 nt, Human
ucucuggauggcuggucuccca

SEQ ID NO: 893289 - RNA, 19 nt, Human
ucugcugaaucccucuuua

SEQ ID NO: 893290 - RNA, 19 nt, Human
ugaaagaguuaagaaaagg

SEQ ID NO: 893291 - RNA, 21 nt, Human
ugagaaguagaaaggcguaga

SEQ ID NO: 893292 - RNA, 22 nt, Human
ugagcccugcagcucagcaccc

SEQ ID NO: 893293 - RNA, 25 nt, Human
ugcacaaaauaaauagcuuucacuc

SEQ ID NO: 893294 - RNA, 23 nt, Human
ugcaggacagcaugguccuuguu

SEQ ID NO: 893295 - RNA, 27 nt, Human
ugcccaggccaggccuccuggcggggc

SEQ ID NO: 893296 - RNA, 19 nt, Human
ugcggcccguguccuccac

SEQ ID NO: 893297 - RNA, 20 nt, Human
ugcggggacagcagggacgg

SEQ ID NO: 893298 - RNA, 19 nt, Human
ugcuggggagagagggcag

SEQ ID NO: 893299 - RNA, 18 nt, Human
uggaaacaacacuggccu

SEQ ID NO: 893300 - RNA, 23 nt, Human
uggccaguggauggggagguggc

SEQ ID NO: 893301 - RNA, 20 nt, Human
uggcccagagaaacagacgg

SEQ ID NO: 893302 - RNA, 18 nt, Human
uggcggcugggcaggcag

SEQ ID NO: 893303 - RNA, 23 nt, Human
uggcggggcuggccacccuggcc

SEQ ID NO: 893304 - RNA, 24 nt, Human
ugggaggggaccugggagugaggg

SEQ ID NO: 893305 - RNA, 19 nt, Human
uggggagagagggcagacg

SEQ ID NO: 893306 - RNA, 20 nt, Human
uggggagaggcugagcccac

SEQ ID NO: 893307 - RNA, 24 nt, Human
uggggagaggcugagcccacugcc

SEQ ID NO: 893308 - RNA, 23 nt, Human
ugggggguggcagucagcaaggc

SEQ ID NO: 893309 - RNA, 25 nt, Human
uggugcuggggagagagggcagacg

SEQ ID NO: 893310 - RNA, 18 nt, Human
ugguggggcgugggggug

SEQ ID NO: 893311 - RNA, 23 nt, Human
ugguggggcguggggguguggug

SEQ ID NO: 893312 - RNA, 22 nt, Human
uguauagacccacuuuugcaga

SEQ ID NO: 893313 - RNA, 24 nt, Human
uguggcuucuuagauucggcauga

SEQ ID NO: 893314 - RNA, 22 nt, Human
uguggugggagugggacuaagg

SEQ ID NO: 893315 - RNA, 24 nt, Human
uguggugggagugggacuaaggcu

SEQ ID NO: 893316 - RNA, 24 nt, Human
ugugugccccacccaccccagagu

SEQ ID NO: 893317 - RNA, 24 nt, Human
uuaaaaaaaccucauagaaaucag

SEQ ID NO: 893318 - RNA, 19 nt, Human
uucccaugggggggcaggc

SEQ ID NO: 893319 - RNA, 23 nt, Human
uuccgggaaagccgaggagcagc

SEQ ID NO: 893320 - RNA, 20 nt, Human
uuggagcugcuaccaaaugg

SEQ ID NO: 893321 - RNA, 21 nt, Human
uuucaguguggaggggcugcu

SEQ ID NO: 893322 - RNA, 23 nt, Human
aacaaaggacuggacucgacacu

SEQ ID NO: 893323 - RNA, 21 nt, Human
aacagcaacagcaacaaagga

SEQ ID NO: 893324 - RNA, 21 nt, Human
aacagcaacagcaacagcaac

SEQ ID NO: 893325 - RNA, 21 nt, Human
aacagcaacagcaacagcaac

SEQ ID NO: 893326 - RNA, 21 nt, Human
aacagcaacagcaacagcaac

SEQ ID NO: 893327 - RNA, 20 nt, Human
aagagaaagucagacccaca

SEQ ID NO: 893328 - RNA, 25 nt, Human
aaggacguguagaagagaaagucag

SEQ ID NO: 893329 - RNA, 18 nt, Human
acagcaacagcaacaaag

SEQ ID NO: 893330 - RNA, 19 nt, Human
acagcaacagcaacagcaa

SEQ ID NO: 893331 - RNA, 22 nt, Human
acagcaacagcaacagcaacaa

SEQ ID NO: 893332 - RNA, 24 nt, Human
acagcaacagcaacagcaacaaag

SEQ ID NO: 893333 - RNA, 25 nt, Human
acagcaacagcaacagcaacagcaa

SEQ ID NO: 893334 - RNA, 25 nt, Human
acagcaacagcaacagcaacagcaa

SEQ ID NO: 893335 - RNA, 18 nt, Human
accaccugugggaggcug

SEQ ID NO: 893336 - RNA, 21 nt, Human
acuuugaagaacaauaugggg

SEQ ID NO: 893337 - RNA, 24 nt, Human
agcaacagcaacagcaacaaagga

SEQ ID NO: 893338 - RNA, 20 nt, Human
agcaacagcaacagcaacag

SEQ ID NO: 893339 - RNA, 21 nt, Human
agcaacagcaacagcaacagc

SEQ ID NO: 893340 - RNA, 21 nt, Human
agcaacagcaacagcaacagc

SEQ ID NO: 893341 - RNA, 23 nt, Human
agcaagaugccaacagcaacagc

SEQ ID NO: 893342 - RNA, 23 nt, Human
aggaaaggacguguagaagagaa

SEQ ID NO: 893343 - RNA, 23 nt, Human
aggauuagcagcaagaugccaac

SEQ ID NO: 893344 - RNA, 18 nt, Human
caacagcaacagcaacag

SEQ ID NO: 893345 - RNA, 22 nt, Human
caacagcaacagcaacagcaac

SEQ ID NO: 893346 - RNA, 22 nt, Human
caacagcaacagcaacagcaac

SEQ ID NO: 893347 - RNA, 22 nt, Human
caacagcaacagcaacagcaac

SEQ ID NO: 893348 - RNA, 24 nt, Human
caacagcaacagcaacagcaacag

SEQ ID NO: 893349 - RNA, 22 nt, Human
caagaugccaacagcaacagca

SEQ ID NO: 893350 - RNA, 23 nt, Human
cacgcuuggugcuggcagcucca

SEQ ID NO: 893351 - RNA, 22 nt, Human
cagcaacaaaggacuggacucg

SEQ ID NO: 893352 - RNA, 26 nt, Human
cagcaacaaaggacuggacucgacac

SEQ ID NO: 893353 - RNA, 22 nt, Human
cagcaacagcaacaaaggacug

SEQ ID NO: 893354 - RNA, 23 nt, Human
cagcaacagcaacagcaacagca

SEQ ID NO: 893355 - RNA, 21 nt, Human
cagcaagaugccaacagcaac

SEQ ID NO: 893356 - RNA, 22 nt, Human
cagcuccagguccccugccccc

SEQ ID NO: 893357 - RNA, 23 nt, Human
ccaacaugagaaagaauuaacac

SEQ ID NO: 893358 - RNA, 24 nt, Human
ccugcccccacgggcucucccaag

SEQ ID NO: 893359 - RNA, 19 nt, Human
cuccagguccccugccccc

SEQ ID NO: 893360 - RNA, 21 nt, Human
cuggcagcuccagguccccug

SEQ ID NO: 893361 - RNA, 21 nt, Human
gaacacaaaagccugcugccc

SEQ ID NO: 893362 - RNA, 22 nt, Human
gcugacagcacaccgacagccc

SEQ ID NO: 893363 - RNA, 22 nt, Human
ggcagcuccagguccccugccc

SEQ ID NO: 893364 - RNA, 20 nt, Human
ggcccggcauucucacuccc

SEQ ID NO: 893365 - RNA, 21 nt, Human
ucaggcuggacacgacaggcu

SEQ ID NO: 893366 - RNA, 20 nt, Human
uccagguccccugcccccac

SEQ ID NO: 893367 - RNA, 23 nt, Human
ugcacggcuguaccaccuguggg

SEQ ID NO: 893368 - RNA, 18 nt, Human
uggaauagagaauacagg

SEQ ID NO: 893369 - RNA, 24 nt, Human
uggaauagagaauacaggcagugg

SEQ ID NO: 893370 - RNA, 24 nt, Human
ugggaggcugacagcacaccgaca

SEQ ID NO: 893371 - RNA, 26 nt, Human
uuggugcuggcagcuccagguccccu

SEQ ID NO: 893372 - RNA, 24 nt, Human
aagcagcccaucuguguuccauca

SEQ ID NO: 893373 - RNA, 18 nt, Human
aagugaggggagcugugc

SEQ ID NO: 893374 - RNA, 21 nt, Human
aggggcaggucuaaacucaca

SEQ ID NO: 893375 - RNA, 19 nt, Human
caggguccgauccggaggg

SEQ ID NO: 893376 - RNA, 19 nt, Human
cagggugggggugggaggg

SEQ ID NO: 893377 - RNA, 18 nt, Human
ccaccuuucugaaacugc

SEQ ID NO: 893378 - RNA, 23 nt, Human
ccauucgcaggguccgauccgga

SEQ ID NO: 893379 - RNA, 21 nt, Human
cgcaggguccgauccggaggg

SEQ ID NO: 893380 - RNA, 25 nt, Human
cuauauaaaauuccaccuuucugaa

SEQ ID NO: 893381 - RNA, 21 nt, Human
cugaaacugcagucugaccuc

SEQ ID NO: 893382 - RNA, 19 nt, Human
gauaggccgcagcgagugg

SEQ ID NO: 893383 - RNA, 18 nt, Human
ggagccagauaggccgca

SEQ ID NO: 893384 - RNA, 18 nt, Human
ggggagcugugccuggau

SEQ ID NO: 893385 - RNA, 24 nt, Human
gggugggggugggaggggcagguc

SEQ ID NO: 893386 - RNA, 18 nt, Human
gucugaccucaggugaag

SEQ ID NO: 893387 - RNA, 20 nt, Human
ucaagagagucaagguucuc

SEQ ID NO: 893388 - RNA, 27 nt, Human
ucaaugccagugcugcucagcccucag

SEQ ID NO: 893389 - RNA, 25 nt, Human
ucauaguggcagggugggggugggg

SEQ ID NO: 893390 - RNA, 19 nt, Human
uccaccuuucugaaacugc

SEQ ID NO: 893391 - RNA, 22 nt, Human
uccaccuuucugaaacugcagu

SEQ ID NO: 893392 - RNA, 22 nt, Human
ugcucagcccucagcagaacuu

SEQ ID NO: 893393 - RNA, 24 nt, Human
uggauccugccuccaagucacauu

SEQ ID NO: 893394 - RNA, 18 nt, Human
uuuuuuuuuuuuuuuuug

SEQ ID NO: 893395 - RNA, 24 nt, Human
uuuuuuuuuuuuuuuuuugacuuu

SEQ ID NO: 893396 - RNA, 24 nt, Human
aucguccuauucugugacacauua

SEQ ID NO: 893397 - RNA, 25 nt, Human
ucauaucguccuauucugugacaca

SEQ ID NO: 893398 - RNA, 25 nt, Human
uuuuuuuuuuuuuuuuuaaauuuuu

SEQ ID NO: 893399 - RNA, 22 nt, Human
aaaaagaaaaucuggauugagu

SEQ ID NO: 893400 - RNA, 21 nt, Human
aauacaaaaagaaaaucugga

SEQ ID NO: 893401 - RNA, 22 nt, Human
caaacacuaagacuuaaauaua

SEQ ID NO: 893402 - RNA, 22 nt, Human
caagagcuucuuucaugaauuc

SEQ ID NO: 893403 - RNA, 25 nt, Human
cuuaaauauacaacuugaucauaca

SEQ ID NO: 893404 - RNA, 24 nt, Human
gguaaaauacaaaaagaaaaucug

SEQ ID NO: 893405 - RNA, 18 nt, Human
uaaaauacaaaaagaaaa

SEQ ID NO: 893406 - RNA, 21 nt, Human
uaaauagcaauccuaugaaca

SEQ ID NO: 893407 - RNA, 19 nt, Human
uacaaaaagaaaaucugga

SEQ ID NO: 893408 - RNA, 25 nt, Human
ugaucaaaaacuuuggucaagagcu

SEQ ID NO: 893409 - RNA, 26 nt, Human
uugaucauacaauuaucucaaaacau

SEQ ID NO: 893410 - RNA, 19 nt, Human
uuuuuuuuuuuuuuguucu

SEQ ID NO: 893411 - RNA, 27 nt, Human
aagaugccagggcgacagcagugggca

SEQ ID NO: 893412 - RNA, 19 nt, Human
acaggacagcugagggagg

SEQ ID NO: 893413 - RNA, 22 nt, Human
accccaccagccugagaguggg

SEQ ID NO: 893414 - RNA, 18 nt, Human
agacucgggacagcuggc

SEQ ID NO: 893415 - RNA, 22 nt, Human
agaguggggaggggcagaggga

SEQ ID NO: 893416 - RNA, 20 nt, Human
aggcagggggacugagugug

SEQ ID NO: 893417 - RNA, 22 nt, Human
ccaggaaugggcugcuuucccc

SEQ ID NO: 893418 - RNA, 19 nt, Human
ccccaccccaccagccuga

SEQ ID NO: 893419 - RNA, 21 nt, Human
ccccaccccaccagccugaga

SEQ ID NO: 893420 - RNA, 22 nt, Human
ccccaccccaccagccugagag

SEQ ID NO: 893421 - RNA, 24 nt, Human
cccuggcugggccccugcucccuc

SEQ ID NO: 893422 - RNA, 18 nt, Human
ccucugagcugggguggg

SEQ ID NO: 893423 - RNA, 18 nt, Human
ccugagaguggggagggg

SEQ ID NO: 893424 - RNA, 21 nt, Human
cgggacagcuggcuggggccu

SEQ ID NO: 893425 - RNA, 19 nt, Human
cucugagcccaggaauggg

SEQ ID NO: 893426 - RNA, 20 nt, Human
cugagcccaggaaugggcug

SEQ ID NO: 893427 - RNA, 18 nt, Human
cugggccccugcucccuc

SEQ ID NO: 893428 - RNA, 23 nt, Human
gaaugggcugcuuuccccacccc

SEQ ID NO: 893429 - RNA, 19 nt, Human
gagcuggggugggagucuc

SEQ ID NO: 893430 - RNA, 18 nt, Human
gaggguccgucccuggcu

SEQ ID NO: 893431 - RNA, 20 nt, Human
gcggugacggggagggcaaa

SEQ ID NO: 893432 - RNA, 22 nt, Human
ggcugggccccugcucccucug

SEQ ID NO: 893433 - RNA, 19 nt, Human
ucagagcugcggcaggaac

SEQ ID NO: 893434 - RNA, 19 nt, Human
ucaggguaucuccccugcc

SEQ ID NO: 893435 - RNA, 22 nt, Human
ucccucugagcuggggugggag

SEQ ID NO: 893436 - RNA, 23 nt, Human
ucccucugagcuggggugggagu

SEQ ID NO: 893437 - RNA, 18 nt, Human
ucccugggaggaaugagg

SEQ ID NO: 893438 - RNA, 23 nt, Human
ucgggacagcuggcuggggccuc

SEQ ID NO: 893439 - RNA, 22 nt, Human
ugagcuggggugggagucucug

SEQ ID NO: 893440 - RNA, 18 nt, Human
ugcgcggugacggggagg

SEQ ID NO: 893441 - RNA, 21 nt, Human
ugcuuuccccaccccaccagc

SEQ ID NO: 893442 - RNA, 19 nt, Human
uggggugggagucucugag

SEQ ID NO: 893443 - RNA, 24 nt, Human
uggggugggagucucugagcccag

SEQ ID NO: 893444 - RNA, 22 nt, Human
ugggugcgcggugacggggagg

SEQ ID NO: 893445 - RNA, 25 nt, Human
uuuuuuuuuuuuuuuuuuucagggg

SEQ ID NO: 893446 - RNA, 21 nt, Human
agaugcugcagaucccgagcc

SEQ ID NO: 893447 - RNA, 19 nt, Human
aggcugggguggggcagag

SEQ ID NO: 893448 - RNA, 18 nt, Human
agggcucccuggcucugg

SEQ ID NO: 893449 - RNA, 21 nt, Human
aggguggggcccuggggaggg

SEQ ID NO: 893450 - RNA, 22 nt, Human
caaaaccagagucauuuccugg

SEQ ID NO: 893451 - RNA, 19 nt, Human
cagagucauuuccugggcu

SEQ ID NO: 893452 - RNA, 19 nt, Human
cagaguugaggcuaagggc

SEQ ID NO: 893453 - RNA, 19 nt, Human
cagaucccgagccccgagg

SEQ ID NO: 893454 - RNA, 18 nt, Human
caggccacucaaaaccag

SEQ ID NO: 893455 - RNA, 24 nt, Human
caggccacucaaaaccagagucau

SEQ ID NO: 893456 - RNA, 23 nt, Human
caggguggggcccuggggagggg

SEQ ID NO: 893457 - RNA, 25 nt, Human
caggguggggcccuggggaggggcu

SEQ ID NO: 893458 - RNA, 18 nt, Human
ccccgagggagccucugc

SEQ ID NO: 893459 - RNA, 24 nt, Human
ccucugcccauuacaggccacuca

SEQ ID NO: 893460 - RNA, 23 nt, Human
gaucccgagccccgagggagccu

SEQ ID NO: 893461 - RNA, 23 nt, Human
ggaagggugugggcugauccaca

SEQ ID NO: 893462 - RNA, 20 nt, Human
ggcaggguggggcccugggg

SEQ ID NO: 893463 - RNA, 22 nt, Human
ggguggggcccuggggaggggc

SEQ ID NO: 893464 - RNA, 20 nt, Human
uagaucuucuacauguaggc

SEQ ID NO: 893465 - RNA, 18 nt, Human
uagcuaaauauuagugga

SEQ ID NO: 893466 - RNA, 22 nt, Human
ucccgagccccgagggagccuc

SEQ ID NO: 893467 - RNA, 22 nt, Human
ucuguguuuccauagaucuucu

SEQ ID NO: 893468 - RNA, 20 nt, Human
uggaagaggcuggggugggg

SEQ ID NO: 893469 - RNA, 19 nt, Human
ugggaagggugugggcuga

SEQ ID NO: 893470 - RNA, 19 nt, Human
ugggguggggcagaguuga

SEQ ID NO: 893471 - RNA, 23 nt, Human
ugggguggggcagaguugaggcu

SEQ ID NO: 893472 - RNA, 23 nt, Human
aagagcagagggcgccugggccu

SEQ ID NO: 893473 - RNA, 20 nt, Human
agguggggggugggggcugg

SEQ ID NO: 893474 - RNA, 18 nt, Human
auggguuacacagacgag

SEQ ID NO: 893475 - RNA, 25 nt, Human
caaggugcaccaccuccaucaugcc

SEQ ID NO: 893476 - RNA, 19 nt, Human
cacacagccggcagcugcu

SEQ ID NO: 893477 - RNA, 21 nt, Human
caucaugccagcaccugcagu

SEQ ID NO: 893478 - RNA, 22 nt, Human
cuccccaugggcacacagccgg

SEQ ID NO: 893479 - RNA, 22 nt, Human
cugcucccugcccugaggucga

SEQ ID NO: 893480 - RNA, 22 nt, Human
cuucagauguguucaccgccau

SEQ ID NO: 893481 - RNA, 20 nt, Human
ggagguggggggugggggcu

SEQ ID NO: 893482 - RNA, 21 nt, Human
gggugggggcugggcucccca

SEQ ID NO: 893483 - RNA, 20 nt, Human
gguggggggugggggcuggg

SEQ ID NO: 893484 - RNA, 20 nt, Human
uggcuucagauguguucacc

SEQ ID NO: 893485 - RNA, 19 nt, Human
uggggggugggggcugggc

SEQ ID NO: 893486 - RNA, 19 nt, Human
ugugcugggagcgaggugu

SEQ ID NO: 893487 - RNA, 20 nt, Human
uuagagccaggaaacauagu

SEQ ID NO: 893488 - RNA, 21 nt, Human
uuagagccaggaaacauagug

SEQ ID NO: 893489 - RNA, 23 nt, Human
uugcuguuugcugucggaggugg

SEQ ID NO: 893490 - RNA, 26 nt, Human
uugcuguuugcugucggagguggggg

SEQ ID NO: 893491 - RNA, 24 nt, Human
uuuuauggguuacacagacgagcc

SEQ ID NO: 893492 - RNA, 22 nt, Human
acucaucuugccgcucuugccu

SEQ ID NO: 893493 - RNA, 22 nt, Human
acucuugaaucucagagagaag

SEQ ID NO: 893494 - RNA, 19 nt, Human
agaaacaagaggaggggcc

SEQ ID NO: 893495 - RNA, 25 nt, Human
agagaaggaggcugugcacccagac

SEQ ID NO: 893496 - RNA, 21 nt, Human
aggaggggcuggggaagggcu

SEQ ID NO: 893497 - RNA, 21 nt, Human
auaagcucagggcuucugggu

SEQ ID NO: 893498 - RNA, 24 nt, Human
cagagagaaggaggcugugcaccc

SEQ ID NO: 893499 - RNA, 24 nt, Human
ccagaugaggccuuuggaauacaa

SEQ ID NO: 893500 - RNA, 21 nt, Human
ggaggggcuggggaagggcug

SEQ ID NO: 893501 - RNA, 22 nt, Human
ggaggggcuggggaagggcugg

SEQ ID NO: 893502 - RNA, 24 nt, Human
uaggaccagacuuucccgaggcuc

SEQ ID NO: 893503 - RNA, 19 nt, Human
ucaaaacucaucuugccgc

SEQ ID NO: 893504 - RNA, 25 nt, Human
ucccgaggcuccagaugaggccuuc

SEQ ID NO: 893505 - RNA, 23 nt, Human
uccuggaggaggaagaggcugcu

SEQ ID NO: 893506 - RNA, 20 nt, Human
ugaaugaagaaacaagagga

SEQ ID NO: 893507 - RNA, 19 nt, Human
uggaauacaacgcucaaaa

SEQ ID NO: 893508 - RNA, 23 nt, Human
uggaggaggaagaggcugcugau

SEQ ID NO: 893509 - RNA, 21 nt, Human
uggggaagggcuggaagggcg

SEQ ID NO: 893510 - RNA, 24 nt, Human
uuuuuuuuuuuuuuuuuuuuccag

SEQ ID NO: 893511 - RNA, 19 nt, Human
acagaagguaacagucaca

SEQ ID NO: 893512 - RNA, 25 nt, Human
agaaaaccccaacuccuagaagccc

SEQ ID NO: 893513 - RNA, 23 nt, Human
agagcauaucccuagcccccucc

SEQ ID NO: 893514 - RNA, 21 nt, Human
aggcaggagugugcucacagc

SEQ ID NO: 893515 - RNA, 21 nt, Human
auccauuccuuucccuuucug

SEQ ID NO: 893516 - RNA, 20 nt, Human
caacccagagcuaggggcaa

SEQ ID NO: 893517 - RNA, 19 nt, Human
caagaauaaccucucuauc

SEQ ID NO: 893518 - RNA, 28 nt, Human
caagcccaacccagagcuaggggcaaaa

SEQ ID NO: 893519 - RNA, 19 nt, Human
caagucaaggcgugggcag

SEQ ID NO: 893520 - RNA, 21 nt, Human
cacaaauuuauucuccugcaa

SEQ ID NO: 893521 - RNA, 20 nt, Human
cacacccacguccacuucca

SEQ ID NO: 893522 - RNA, 19 nt, Human
cacguccacuuccaucauc

SEQ ID NO: 893523 - RNA, 23 nt, Human
caguuucaaugggcucaagucaa

SEQ ID NO: 893524 - RNA, 18 nt, Human
cauucauggccccugcuc

SEQ ID NO: 893525 - RNA, 19 nt, Human
ccaacuccuagaagccccc

SEQ ID NO: 893526 - RNA, 27 nt, Human
cccaugaaagccccagagcauaucccc

SEQ ID NO: 893527 - RNA, 21 nt, Human
ccccaagcccaacccagagcu

SEQ ID NO: 893528 - RNA, 22 nt, Human
ccccagagcauaucccuagccc

SEQ ID NO: 893529 - RNA, 19 nt, Human
ccuagaagcccccugagac

SEQ ID NO: 893530 - RNA, 19 nt, Human
ccugggguccaagaaggag

SEQ ID NO: 893531 - RNA, 25 nt, Human
cucacgucacacccacguccacuuc

SEQ ID NO: 893532 - RNA, 22 nt, Human
cugaaucagcaagaauaaccuc

SEQ ID NO: 893533 - RNA, 23 nt, Human
cugcacugucccuuucugccaca

SEQ ID NO: 893534 - RNA, 20 nt, Human
cugcucacgucacacccacg

SEQ ID NO: 893535 - RNA, 25 nt, Human
cuuggccccaagcccaacccagagc

SEQ ID NO: 893536 - RNA, 20 nt, Human
gaccuucuggccucuuucuu

SEQ ID NO: 893537 - RNA, 18 nt, Human
gaggccaggagcucaaga

SEQ ID NO: 893538 - RNA, 24 nt, Human
gccccagagcauaucccuagcccc

SEQ ID NO: 893539 - RNA, 20 nt, Human
gcggcauucauggccccugc

SEQ ID NO: 893540 - RNA, 22 nt, Human
ggaggccaggagcucaagauca

SEQ ID NO: 893541 - RNA, 19 nt, Human
gggcagggcugguuucuuu

SEQ ID NO: 893542 - RNA, 19 nt, Human
uacaucugcacugucccuu

SEQ ID NO: 893543 - RNA, 20 nt, Human
ucgaugaggcaggagugugc

SEQ ID NO: 893544 - RNA, 21 nt, Human
ucuucaucauucccaugaaag

SEQ ID NO: 893545 - RNA, 19 nt, Human
ugaaagccccagagcauau

SEQ ID NO: 893546 - RNA, 18 nt, Human
ugauaacauuuuucucau

SEQ ID NO: 893547 - RNA, 24 nt, Human
ugcaauucuggaggccaggagcuc

SEQ ID NO: 893548 - RNA, 21 nt, Human
ugccacagaagguaacaguca

SEQ ID NO: 893549 - RNA, 22 nt, Human
ugccacagaagguaacagucac

SEQ ID NO: 893550 - RNA, 18 nt, Human
uggccccaagcccaaccc

SEQ ID NO: 893551 - RNA, 20 nt, Human
uggccccaagcccaacccag

SEQ ID NO: 893552 - RNA, 20 nt, Human
uggugauauuuugggcccac

SEQ ID NO: 893553 - RNA, 18 nt, Human
uguaggagaggaggggac

SEQ ID NO: 893554 - RNA, 21 nt, Human
uuauucuccugcaauucuggu

SEQ ID NO: 893555 - RNA, 18 nt, Human
uuuuuuuuuuuuuuuuug

SEQ ID NO: 893556 - RNA, 18 nt, Human
uuuuuuuuuuuuuuuuug

SEQ ID NO: 893557 - RNA, 22 nt, Human
uuuuuuuuuuuuuuuuuuuggc

SEQ ID NO: 893558 - RNA, 23 nt, Human
aaaaaacaaacccaaacaagcca

SEQ ID NO: 893559 - RNA, 24 nt, Human
aaaaaacaaacccaaacaagccac

SEQ ID NO: 893560 - RNA, 22 nt, Human
aaaaacaaaaacaaaacaaaaa

SEQ ID NO: 893561 - RNA, 21 nt, Human
aaaacaaaaacaaaacaaaaa

SEQ ID NO: 893562 - RNA, 23 nt, Human
aaaacaaaacaaaaaacaaaccc

SEQ ID NO: 893563 - RNA, 22 nt, Human
aaacaaaacaaaaaacaaaccc

SEQ ID NO: 893564 - RNA, 23 nt, Human
aaacaaaacaaaaaacaaaccca

SEQ ID NO: 893565 - RNA, 25 nt, Human
aaacaaaacaaaaaacaaacccaaa

SEQ ID NO: 893566 - RNA, 18 nt, Human
aaacaaacccaaacaagc

SEQ ID NO: 893567 - RNA, 22 nt, Human
aaacaaacccaaacaagccaca

SEQ ID NO: 893568 - RNA, 20 nt, Human
aaacccaaacaagccacaaa

SEQ ID NO: 893569 - RNA, 24 nt, Human
aaacgcaaaaacaaaaacaaaaca

SEQ ID NO: 893570 - RNA, 18 nt, Human
aaagaaaggaguuggacc

SEQ ID NO: 893571 - RNA, 26 nt, Human
aacaaaaaacaaacccaaacaagcca

SEQ ID NO: 893572 - RNA, 22 nt, Human
aacgcaaaaacaaaaacaaaac

SEQ ID NO: 893573 - RNA, 25 nt, Human
aacgcaaaaacaaaaacaaaacaaa

SEQ ID NO: 893574 - RNA, 28 nt, Human
aacgcaaaaacaaaaacaaaacaaaaaa

SEQ ID NO: 893575 - RNA, 25 nt, Human
aagaaagcaggggaaaaccgguacc

SEQ ID NO: 893576 - RNA, 24 nt, Human
aagaaagcaggggaaaacgcaaaa

SEQ ID NO: 893577 - RNA, 31 nt, Human
aagcaggggaaaacgcaaaaacaaaaacaaa

SEQ ID NO: 893578 - RNA, 18 nt, Human
aauucguggcgcuccccu

SEQ ID NO: 893579 - RNA, 20 nt, Human
aauucguggcgcuccccugc

SEQ ID NO: 893580 - RNA, 22 nt, Human
acaaaacaaaaaacaaacccaa

SEQ ID NO: 893581 - RNA, 23 nt, Human
acaaaacaaaaaacaaacccaaa

SEQ ID NO: 893582 - RNA, 24 nt, Human
acaaaacaaaaaacaaacccaaac

SEQ ID NO: 893583 - RNA, 20 nt, Human
acaaacccaaacaagccaca

SEQ ID NO: 893584 - RNA, 24 nt, Human
acaaacccaaacaagccacaaaga

SEQ ID NO: 893585 - RNA, 24 nt, Human
acaaagaaaggaguuggacccaga

SEQ ID NO: 893586 - RNA, 23 nt, Human
accgccgccgggguggggccugg

SEQ ID NO: 893587 - RNA, 22 nt, Human
acgaaagcaggggugggggguc

SEQ ID NO: 893588 - RNA, 23 nt, Human
agaaggagaggcaugggcagagc

SEQ ID NO: 893589 - RNA, 21 nt, Human
agcuggguggguggaaucugc

SEQ ID NO: 893590 - RNA, 22 nt, Human
agcuggguggguggaaucugcc

SEQ ID NO: 893591 - RNA, 19 nt, Human
caaaacaaaaaacaaaccc

SEQ ID NO: 893592 - RNA, 25 nt, Human
caaaacaaaaaacaaacccaaacaa

SEQ ID NO: 893593 - RNA, 24 nt, Human
caaacaagccacaaagaaaggagu

SEQ ID NO: 893594 - RNA, 19 nt, Human
caaacccaaacaagccaca

SEQ ID NO: 893595 - RNA, 20 nt, Human
caaacccaaacaagccacaa

SEQ ID NO: 893596 - RNA, 19 nt, Human
caaccucccggcgccuccc

SEQ ID NO: 893597 - RNA, 18 nt, Human
caagugacgacauuaacg

SEQ ID NO: 893598 - RNA, 19 nt, Human
caagugacgacauuaacgc

SEQ ID NO: 893599 - RNA, 23 nt, Human
caccgccgccgggguggggccug

SEQ ID NO: 893600 - RNA, 19 nt, Human
cacuuggucaauucguggc

SEQ ID NO: 893601 - RNA, 24 nt, Human
cccggaggacagggcagagggcuc

SEQ ID NO: 893602 - RNA, 19 nt, Human
ccgccgccgggguggggcc

SEQ ID NO: 893603 - RNA, 21 nt, Human
ccgccgccgggguggggccug

SEQ ID NO: 893604 - RNA, 21 nt, Human
ccucccuaguggagccgagag

SEQ ID NO: 893605 - RNA, 21 nt, Human
ccuccucgccgccaccgccgc

SEQ ID NO: 893606 - RNA, 20 nt, Human
cucacacaaacauauuuuac

SEQ ID NO: 893607 - RNA, 25 nt, Human
cuccucgccgccaccgccgccgggg

SEQ ID NO: 893608 - RNA, 21 nt, Human
gaaaacgcaaaaacaaaaaca

SEQ ID NO: 893609 - RNA, 19 nt, Human
gaagaaagcaggggaaaac

SEQ ID NO: 893610 - RNA, 23 nt, Human
gagcuggguggguggaaucugcc

SEQ ID NO: 893611 - RNA, 21 nt, Human
gaggacagggcagagggcucc

SEQ ID NO: 893612 - RNA, 24 nt, Human
gaguucagcccucucccaagguuc

SEQ ID NO: 893613 - RNA, 22 nt, Human
gcaaaaacaaaaacaaaacaaa

SEQ ID NO: 893614 - RNA, 21 nt, Human
gcagagggcucccugccuaca

SEQ ID NO: 893615 - RNA, 19 nt, Human
gcgggcgggggagggggga

SEQ ID NO: 893616 - RNA, 19 nt, Human
ggaggggggagugggggga

SEQ ID NO: 893617 - RNA, 23 nt, Human
ggaggggggaguggggggaggga

SEQ ID NO: 893618 - RNA, 18 nt, Human
ggcaugggcagagcuggg

SEQ ID NO: 893619 - RNA, 23 nt, Human
ggccugggccuggggccgcgagu

SEQ ID NO: 893620 - RNA, 18 nt, Human
ggccuggggccgcgaguc

SEQ ID NO: 893621 - RNA, 20 nt, Human
gggcagagggcucccugccu

SEQ ID NO: 893622 - RNA, 24 nt, Human
ggggaggggggaguggggggaggg

SEQ ID NO: 893623 - RNA, 22 nt, Human
ggguggaaucugccacuccaag

SEQ ID NO: 893624 - RNA, 20 nt, Human
ggguggggccugggccuggg

SEQ ID NO: 893625 - RNA, 24 nt, Human
guggggccugggccuggggccgcg

SEQ ID NO: 893626 - RNA, 24 nt, Human
uaaaaaaaggaagaaauucucugu

SEQ ID NO: 893627 - RNA, 23 nt, Human
uaauaauaauaauaaccaccaua

SEQ ID NO: 893628 - RNA, 20 nt, Human
uacaaaaugcacgaaagcag

SEQ ID NO: 893629 - RNA, 22 nt, Human
uacauggccauaaauauuuagc

SEQ ID NO: 893630 - RNA, 20 nt, Human
uagcuucacuuggucaauuc

SEQ ID NO: 893631 - RNA, 20 nt, Human
uaucgcuacucacacaaaca

SEQ ID NO: 893632 - RNA, 22 nt, Human
ucacuuggucaauucguggcgc

SEQ ID NO: 893633 - RNA, 21 nt, Human
ucagcccucucccaagguuca

SEQ ID NO: 893634 - RNA, 24 nt, Human
uccccccggggagaggcaaagaag

SEQ ID NO: 893635 - RNA, 18 nt, Human
ucgccgccaccgccgccg

SEQ ID NO: 893636 - RNA, 21 nt, Human
ucgccgccaccgccgccgggg

SEQ ID NO: 893637 - RNA, 22 nt, Human
ucugcgcccggcgcuguugggg

SEQ ID NO: 893638 - RNA, 22 nt, Human
uggaaucugccacuccaaggag

SEQ ID NO: 893639 - RNA, 25 nt, Human
uggacccagacgggaaacaggccgg

SEQ ID NO: 893640 - RNA, 19 nt, Human
uggccauaaauauuuagca

SEQ ID NO: 893641 - RNA, 18 nt, Human
ugggcagagcuggguggg

SEQ ID NO: 893642 - RNA, 19 nt, Human
ugggcagagcugggugggu

SEQ ID NO: 893643 - RNA, 20 nt, Human
ugucgcaaaguuguagcuuc

SEQ ID NO: 893644 - RNA, 22 nt, Human
uuccauauuugagaaauguuug

SEQ ID NO: 893645 - RNA, 23 nt, Human
uuuccauauuugagaaauguuug

SEQ ID NO: 893646 - RNA, 22 nt, Human
aaacccgguaacaccuccggug

SEQ ID NO: 893647 - RNA, 23 nt, Human
acauauuuuuuuaacgaggggac

SEQ ID NO: 893648 - RNA, 18 nt, Human
acccgccccgucccuacc

SEQ ID NO: 893649 - RNA, 25 nt, Human
acgaaacagaaaggaaacccgguaa

SEQ ID NO: 893650 - RNA, 23 nt, Human
agcgcggccaggguccuagccuc

SEQ ID NO: 893651 - RNA, 22 nt, Human
aggcagagggagagaagcccuu

SEQ ID NO: 893652 - RNA, 23 nt, Human
aggcagcgcggcggcuccagcuc

SEQ ID NO: 893653 - RNA, 25 nt, Human
aggguccuagccuccuggucuccuc

SEQ ID NO: 893654 - RNA, 22 nt, Human
agugagcugcgauccgaagccc

SEQ ID NO: 893655 - RNA, 18 nt, Human
cagaaaggaaacccggua

SEQ ID NO: 893656 - RNA, 24 nt, Human
cagccuccccccacccccaacuuu

SEQ ID NO: 893657 - RNA, 21 nt, Human
caggcccggaugcccugcaag

SEQ ID NO: 893658 - RNA, 19 nt, Human
cagucauccuccucgcccc

SEQ ID NO: 893659 - RNA, 18 nt, Human
ccaggcccgcaaaggggg

SEQ ID NO: 893660 - RNA, 18 nt, Human
ccagucauccuccucgcc

SEQ ID NO: 893661 - RNA, 21 nt, Human
ccaguccaaauaauaaauccc

SEQ ID NO: 893662 - RNA, 20 nt, Human
ccccauuuuucucuccuuca

SEQ ID NO: 893663 - RNA, 18 nt, Human
ccccgccaacgcuucgcg

SEQ ID NO: 893664 - RNA, 27 nt, Human
ccccggcgcccagccggcguuucugcc

SEQ ID NO: 893665 - RNA, 22 nt, Human
ccccgucccuaccaggcccgga

SEQ ID NO: 893666 - RNA, 24 nt, Human
ccccugaguccccuuccccagggg

SEQ ID NO: 893667 - RNA, 24 nt, Human
cccggcgcccagccggcguuucug

SEQ ID NO: 893668 - RNA, 21 nt, Human
cccugaggagcuagacguaca

SEQ ID NO: 893669 - RNA, 18 nt, Human
cccuggugcaacggcugu

SEQ ID NO: 893670 - RNA, 19 nt, Human
cccuggugcaacggcugug

SEQ ID NO: 893671 - RNA, 22 nt, Human
ccuccggugggccaccaggucc

SEQ ID NO: 893672 - RNA, 21 nt, Human
ccuccuggucuccucucgcug

SEQ ID NO: 893673 - RNA, 18 nt, Human
cgaagcccugaggagcua

SEQ ID NO: 893674 - RNA, 20 nt, Human
cgacaauccggagaucugga

SEQ ID NO: 893675 - RNA, 21 nt, Human
cgccaacgcuucgcggaggcc

SEQ ID NO: 893676 - RNA, 18 nt, Human
cgccaggcugcgcugggg

SEQ ID NO: 893677 - RNA, 18 nt, Human
cgccccgucccuaccagg

SEQ ID NO: 893678 - RNA, 19 nt, Human
cgcggccaggguccuagcc

SEQ ID NO: 893679 - RNA, 18 nt, Human
cgcugccgccgcugccga

SEQ ID NO: 893680 - RNA, 18 nt, Human
cgcuuuggaagaaccaag

SEQ ID NO: 893681 - RNA, 23 nt, Human
cggcgccaggcugcgcuggggug

SEQ ID NO: 893682 - RNA, 19 nt, Human
cggcugcaguacccuggug

SEQ ID NO: 893683 - RNA, 22 nt, Human
cucgccccugaguccccuuccc

SEQ ID NO: 893684 - RNA, 18 nt, Human
gaagaguccugcgucccc

SEQ ID NO: 893685 - RNA, 20 nt, Human
gaugcccugcaaggugcccu

SEQ ID NO: 893686 - RNA, 22 nt, Human
gccccugaguccccuuccccag

SEQ ID NO: 893687 - RNA, 21 nt, Human
gccuccccccacccccaacuu

SEQ ID NO: 893688 - RNA, 21 nt, Human
gcggcggcuccagcucuccuc

SEQ ID NO: 893689 - RNA, 22 nt, Human
gcuccagcucuccuccuggacu

SEQ ID NO: 893690 - RNA, 19 nt, Human
ggacccagucauccuccuc

SEQ ID NO: 893691 - RNA, 23 nt, Human
ggccgcggaaaggcagagggaga

SEQ ID NO: 893692 - RNA, 23 nt, Human
ggcggcuccagcucuccuccugg

SEQ ID NO: 893693 - RNA, 18 nt, Human
gggaccugggggucuggg

SEQ ID NO: 893694 - RNA, 22 nt, Human
gggcuuuugacagacgcggucc

SEQ ID NO: 893695 - RNA, 20 nt, Human
gggugcccgccgcgugaccc

SEQ ID NO: 893696 - RNA, 18 nt, Human
gugcgcugccgccgcugc

SEQ ID NO: 893697 - RNA, 24 nt, Human
guuuguucagccuccccccacccc

SEQ ID NO: 893698 - RNA, 20 nt, Human
uacagaauacgaaacagaaa

SEQ ID NO: 893699 - RNA, 20 nt, Human
uacccuggugcaacggcugu

SEQ ID NO: 893700 - RNA, 24 nt, Human
uagauagauagauaacaugugcug

SEQ ID NO: 893701 - RNA, 23 nt, Human
ucaggcccuucucgagcuucagu

SEQ ID NO: 893702 - RNA, 21 nt, Human
uccccaggccucgagugagcu

SEQ ID NO: 893703 - RNA, 24 nt, Human
ucccccgacaauccggagaucugg

SEQ ID NO: 893704 - RNA, 19 nt, Human
uccccggcgcccagccggc

SEQ ID NO: 893705 - RNA, 20 nt, Human
uccuccuggacuccgccgcu

SEQ ID NO: 893706 - RNA, 21 nt, Human
ucgccccugaguccccuuccc

SEQ ID NO: 893707 - RNA, 19 nt, Human
ucugccucagagacagucc

SEQ ID NO: 893708 - RNA, 21 nt, Human
ugaguuuguucagccuccccc

SEQ ID NO: 893709 - RNA, 22 nt, Human
ugccagggucggggccaucguc

SEQ ID NO: 893710 - RNA, 23 nt, Human
ugcgcuggggugcccgccgcgug

SEQ ID NO: 893711 - RNA, 18 nt, Human
uggaauuucucaagccac

SEQ ID NO: 893712 - RNA, 24 nt, Human
ugugguuauaguuauauagauaga

SEQ ID NO: 893713 - RNA, 27 nt, Human
uuuuuuuuuuuuuuuuuuuuuuugggg

SEQ ID NO: 893714 - RNA, 23 nt, Human
aaccccacagaaggucccaccuc

SEQ ID NO: 893715 - RNA, 19 nt, Human
aaggaugggcaaggaggca

SEQ ID NO: 893716 - RNA, 24 nt, Human
aauccuuucccucccuccccccaa

SEQ ID NO: 893717 - RNA, 18 nt, Human
acaccgccugguggggcu

SEQ ID NO: 893718 - RNA, 20 nt, Human
acccugcccccaggaagcag

SEQ ID NO: 893719 - RNA, 21 nt, Human
acccuucccucucuccuuccc

SEQ ID NO: 893720 - RNA, 20 nt, Human
accuccccucccuccaaggc

SEQ ID NO: 893721 - RNA, 26 nt, Human
agaaggcacuuaaaugggaaggccac

SEQ ID NO: 893722 - RNA, 18 nt, Human
agacagaaaaagggagca

SEQ ID NO: 893723 - RNA, 21 nt, Human
agcacaacgacaucaccacuu

SEQ ID NO: 893724 - RNA, 24 nt, Human
agcaggcagggccccccagguccc

SEQ ID NO: 893725 - RNA, 24 nt, Human
agccagcaggggaucaggcagggg

SEQ ID NO: 893726 - RNA, 22 nt, Human
agccugcugccccuacaccgcc

SEQ ID NO: 893727 - RNA, 21 nt, Human
aggaacccugcccccaggaag

SEQ ID NO: 893728 - RNA, 18 nt, Human
aggaagcagaaccggaag

SEQ ID NO: 893729 - RNA, 22 nt, Human
aggagauggguuggcacagggg

SEQ ID NO: 893730 - RNA, 21 nt, Human
aggaugggcaaggaggcacug

SEQ ID NO: 893731 - RNA, 21 nt, Human
aggcaccggugaaggaugggc

SEQ ID NO: 893732 - RNA, 19 nt, Human
aggcagaagucugagguca

SEQ ID NO: 893733 - RNA, 23 nt, Human
aggcagaagucugaggucauugc

SEQ ID NO: 893734 - RNA, 25 nt, Human
aggcagaggcaaagguugguagggg

SEQ ID NO: 893735 - RNA, 23 nt, Human
aggcaggaacccugcccccagga

SEQ ID NO: 893736 - RNA, 20 nt, Human
agggagcagcccucagcugu

SEQ ID NO: 893737 - RNA, 18 nt, Human
agggaggagguggggcag

SEQ ID NO: 893738 - RNA, 19 nt, Human
agggaggagguggggcagg

SEQ ID NO: 893739 - RNA, 22 nt, Human
agggaggagguggggcaggggg

SEQ ID NO: 893740 - RNA, 22 nt, Human
aggggcccucucagucccaagg

SEQ ID NO: 893741 - RNA, 18 nt, Human
auguuaggaggaggggcu

SEQ ID NO: 893742 - RNA, 24 nt, Human
caaacauggaacccaggcgccguu

SEQ ID NO: 893743 - RNA, 26 nt, Human
caacgacaucaccacuugacaucccc

SEQ ID NO: 893744 - RNA, 20 nt, Human
cacugguauguggguccccu

SEQ ID NO: 893745 - RNA, 20 nt, Human
cagaaacaguuggaaggcag

SEQ ID NO: 893746 - RNA, 19 nt, Human
cagacuccugcugccuucc

SEQ ID NO: 893747 - RNA, 18 nt, Human
cagcagagaaacauggca

SEQ ID NO: 893748 - RNA, 22 nt, Human
cagcagagaaacauggcagcau

SEQ ID NO: 893749 - RNA, 18 nt, Human
cagcaggcagggcccccc

SEQ ID NO: 893750 - RNA, 25 nt, Human
cagcauggacagagacagaaaaagg

SEQ ID NO: 893751 - RNA, 19 nt, Human
cagggccccccaggucccc

SEQ ID NO: 893752 - RNA, 21 nt, Human
cagguucuaggggggaggggg

SEQ ID NO: 893753 - RNA, 23 nt, Human
ccaaccauauucaccccccgccc

SEQ ID NO: 893754 - RNA, 21 nt, Human
ccacagaaggucccaccuccu

SEQ ID NO: 893755 - RNA, 20 nt, Human
ccaccuccuacagauccccc

SEQ ID NO: 893756 - RNA, 18 nt, Human
ccagacuggggguccaag

SEQ ID NO: 893757 - RNA, 21 nt, Human
cccagacuggggguccaaggc

SEQ ID NO: 893758 - RNA, 23 nt, Human
ccccaaaccccacagaagguccc

SEQ ID NO: 893759 - RNA, 21 nt, Human
ccccacagaaggucccaccuc

SEQ ID NO: 893760 - RNA, 20 nt, Human
cccccacacacacuuagcug

SEQ ID NO: 893761 - RNA, 20 nt, Human
ccccugagaauaggggagga

SEQ ID NO: 893762 - RNA, 24 nt, Human
cccucucuccuuccccuaaaaauc

SEQ ID NO: 893763 - RNA, 19 nt, Human
cccuggggagagcccaagg

SEQ ID NO: 893764 - RNA, 20 nt, Human
ccggaaucggggcgcggggg

SEQ ID NO: 893765 - RNA, 25 nt, Human
ccuacagaucccccaaaggcaccgg

SEQ ID NO: 893766 - RNA, 21 nt, Human
ccucagugcagccugcugccc

SEQ ID NO: 893767 - RNA, 19 nt, Human
ccucccccccggcuggggc

SEQ ID NO: 893768 - RNA, 26 nt, Human
ccuccuacagaucccccaaaggcugg

SEQ ID NO: 893769 - RNA, 26 nt, Human
ccugacccuucccucucuccuucccc

SEQ ID NO: 893770 - RNA, 19 nt, Human
ccugcccccaggaagcaga

SEQ ID NO: 893771 - RNA, 19 nt, Human
ccugcccccaggaagcaga

SEQ ID NO: 893772 - RNA, 24 nt, Human
ccuggagauccccaaaccccacag

SEQ ID NO: 893773 - RNA, 19 nt, Human
ccugggagcugcccccagc

SEQ ID NO: 893774 - RNA, 20 nt, Human
ccugggccccuuggcccagc

SEQ ID NO: 893775 - RNA, 19 nt, Human
ccuuucccucccucccccc

SEQ ID NO: 893776 - RNA, 19 nt, Human
cgcuccgcuccggccggac

SEQ ID NO: 893777 - RNA, 24 nt, Human
cuacagaucccccaaaggcaccgg

SEQ ID NO: 893778 - RNA, 20 nt, Human
cuccuacagaucccccaaag

SEQ ID NO: 893779 - RNA, 23 nt, Human
cuggagcucacgguccucagugc

SEQ ID NO: 893780 - RNA, 19 nt, Human
cugguucuccccucccagc

SEQ ID NO: 893781 - RNA, 22 nt, Human
cuucugggaccggcgcggcuag

SEQ ID NO: 893782 - RNA, 19 nt, Human
gagauccccaaaccccaca

SEQ ID NO: 893783 - RNA, 21 nt, Human
gagcccaaggccuugaccucc

SEQ ID NO: 893784 - RNA, 23 nt, Human
gagcugcccccagccagcagggg

SEQ ID NO: 893785 - RNA, 22 nt, Human
gagcuggcguagagacccccca

SEQ ID NO: 893786 - RNA, 23 nt, Human
gagcuggcguagagaccccccac

SEQ ID NO: 893787 - RNA, 19 nt, Human
gcacuuaaaugggaaggcc

SEQ ID NO: 893788 - RNA, 26 nt, Human
gcagcagagaaacauggcagcaugga

SEQ ID NO: 893789 - RNA, 20 nt, Human
gccggaaucggggcgcgggg

SEQ ID NO: 893790 - RNA, 21 nt, Human
gccugcugccccuacaccgcc

SEQ ID NO: 893791 - RNA, 18 nt, Human
gccugggccccuuggccc

SEQ ID NO: 893792 - RNA, 20 nt, Human
gcggggaagagggggcucua

SEQ ID NO: 893793 - RNA, 25 nt, Human
ggaaagcugggcggggaagaggggg

SEQ ID NO: 893794 - RNA, 22 nt, Human
ggaaggcaggauauccugggag

SEQ ID NO: 893795 - RNA, 18 nt, Human
ggaaucggggcgcggggg

SEQ ID NO: 893796 - RNA, 20 nt, Human
ggacagagacagaaaaaggg

SEQ ID NO: 893797 - RNA, 18 nt, Human
ggagauggguuggcacag

SEQ ID NO: 893798 - RNA, 22 nt, Human
ggagcaaaggggugugagggac

SEQ ID NO: 893799 - RNA, 24 nt, Human
ggaggagguggggcagggggaggg

SEQ ID NO: 893800 - RNA, 21 nt, Human
ggaggggaggggugggaggga

SEQ ID NO: 893801 - RNA, 21 nt, Human
ggagguggggcagggggaggg

SEQ ID NO: 893802 - RNA, 24 nt, Human
ggcaaggaggcacugaugagcugg

SEQ ID NO: 893803 - RNA, 21 nt, Human
ggcccaauuuggcagcagaga

SEQ ID NO: 893804 - RNA, 18 nt, Human
ggccugggcagucuuccu

SEQ ID NO: 893805 - RNA, 23 nt, Human
ggccugggcagucuuccugggag

SEQ ID NO: 893806 - RNA, 19 nt, Human
ggccugggccccuuggccc

SEQ ID NO: 893807 - RNA, 22 nt, Human
gggacagaggacagggccuggg

SEQ ID NO: 893808 - RNA, 19 nt, Human
gggagacgcccgcuucccc

SEQ ID NO: 893809 - RNA, 22 nt, Human
gggcccaauuuggcagcagaga

SEQ ID NO: 893810 - RNA, 23 nt, Human
gggcccaauuuggcagcagagaa

SEQ ID NO: 893811 - RNA, 19 nt, Human
gggcccaggaaaggggcaa

SEQ ID NO: 893812 - RNA, 21 nt, Human
gggccggaaucggggcgcggg

SEQ ID NO: 893813 - RNA, 25 nt, Human
gggccggaaucggggcgcggggggg

SEQ ID NO: 893814 - RNA, 20 nt, Human
gggcgcgggggggaggggag

SEQ ID NO: 893815 - RNA, 22 nt, Human
ggggaggggaggggugggaggg

SEQ ID NO: 893816 - RNA, 18 nt, Human
gggggagggagggggcgc

SEQ ID NO: 893817 - RNA, 19 nt, Human
gggugugagggacagagga

SEQ ID NO: 893818 - RNA, 18 nt, Human
ggugugagggacagagga

SEQ ID NO: 893819 - RNA, 19 nt, Human
gugaaggaugggcaaggag

SEQ ID NO: 893820 - RNA, 18 nt, Human
guucuccccucccagccu

SEQ ID NO: 893821 - RNA, 18 nt, Human
uaaaaaauguaaaaaucc

SEQ ID NO: 893822 - RNA, 25 nt, Human
uaaaaauccuuucccucccuccccc

SEQ ID NO: 893823 - RNA, 19 nt, Human
uaacagaccuccccucccu

SEQ ID NO: 893824 - RNA, 21 nt, Human
uaaggcagaagucugagguca

SEQ ID NO: 893825 - RNA, 24 nt, Human
uauacacauguacauauuuauaug

SEQ ID NO: 893826 - RNA, 19 nt, Human
uauauacacauguacauau

SEQ ID NO: 893827 - RNA, 20 nt, Human
ucagaaacaguuggaaggca

SEQ ID NO: 893828 - RNA, 22 nt, Human
ucccaccuccuacagauccccc

SEQ ID NO: 893829 - RNA, 24 nt, Human
ucccaccuccuacagaucccccaa

SEQ ID NO: 893830 - RNA, 24 nt, Human
uccccaaaccccacagaagguccc

SEQ ID NO: 893831 - RNA, 26 nt, Human
uccccaaaccccacagaaggucccac

SEQ ID NO: 893832 - RNA, 25 nt, Human
ucccuccaaggcagaggcaaagguu

SEQ ID NO: 893833 - RNA, 20 nt, Human
uccggaggggaggggagcca

SEQ ID NO: 893834 - RNA, 22 nt, Human
ucuccuuccccuaaaaaucuau

SEQ ID NO: 893835 - RNA, 22 nt, Human
ugaaggcacugacacggggccu

SEQ ID NO: 893836 - RNA, 24 nt, Human
ugacccuucccucucuccuucccc

SEQ ID NO: 893837 - RNA, 23 nt, Human
uggcagcauggacagagacagaa

SEQ ID NO: 893838 - RNA, 18 nt, Human
ugggaaggccaccugaug

SEQ ID NO: 893839 - RNA, 18 nt, Human
ugggccccuuggcccagc

SEQ ID NO: 893840 - RNA, 18 nt, Human
ugggcggggaagaggggg

SEQ ID NO: 893841 - RNA, 18 nt, Human
uggggagagcccaaggcc

SEQ ID NO: 893842 - RNA, 21 nt, Human
uggggcagggggaggggcugg

SEQ ID NO: 893843 - RNA, 23 nt, Human
uggguuuuccuaacaaaggccug

SEQ ID NO: 893844 - RNA, 20 nt, Human
ugguaacagaccuccccucc

SEQ ID NO: 893845 - RNA, 22 nt, Human
ugguggggcuggugggggagac

SEQ ID NO: 893846 - RNA, 24 nt, Human
ugguggggcuggugggggagacgc

SEQ ID NO: 893847 - RNA, 24 nt, Human
uguccaccguucccagacuggggg

SEQ ID NO: 893848 - RNA, 18 nt, Human
uguggcggcggcccaugg

SEQ ID NO: 893849 - RNA, 25 nt, Human
uguggggccugaaggacagacuccu

SEQ ID NO: 893850 - RNA, 19 nt, Human
uucaccccccgcccacccg

SEQ ID NO: 893851 - RNA, 20 nt, Human
uucugggcccaggaaagggg

SEQ ID NO: 893852 - RNA, 18 nt, Human
uuggcacaggggaagggg

SEQ ID NO: 893853 - RNA, 26 nt, Human
uuggcacugguauguggguccccuua

SEQ ID NO: 893854 - RNA, 23 nt, Human
uuggucaggggcagguccuggcc

SEQ ID NO: 893855 - RNA, 20 nt, Human
uuuuuuuuuuuaggggucug

SEQ ID NO: 893856 - RNA, 20 nt, Human
uuuuuuuuuuuuaggggucu

SEQ ID NO: 893857 - RNA, 26 nt, Human
uuuuuuuuuuuuuuuuaggggucugg

SEQ ID NO: 893858 - RNA, 22 nt, Human
uuuuuuuuuuuuuuuuuuaggg

SEQ ID NO: 893859 - RNA, 23 nt, Human
aaguacaaaacuucaagauacaa

SEQ ID NO: 893860 - RNA, 22 nt, Human
acaaaacuucaagauacaagaa

SEQ ID NO: 893861 - RNA, 19 nt, Human
acugaaauggaggaacgua

SEQ ID NO: 893862 - RNA, 21 nt, Human
agaaaagacaaaacugaaaug

SEQ ID NO: 893863 - RNA, 20 nt, Human
aggcauauuccccuggccuu

SEQ ID NO: 893864 - RNA, 23 nt, Human
caaaacucccuucaguuuccagg

SEQ ID NO: 893865 - RNA, 22 nt, Human
ccgcagaggccacccucgugcc

SEQ ID NO: 893866 - RNA, 22 nt, Human
cgcugagaggcuggcggcggcg

SEQ ID NO: 893867 - RNA, 28 nt, Human
cuggcggcggcgggcgcgugguccuucu

SEQ ID NO: 893868 - RNA, 19 nt, Human
cuucaagauacaagaagga

SEQ ID NO: 893869 - RNA, 19 nt, Human
gcgcgugguccuucggcgu

SEQ ID NO: 893870 - RNA, 20 nt, Human
ggcggcagcgccucggcgcc

SEQ ID NO: 893871 - RNA, 24 nt, Human
gggcggcgaggcgggcggcagcgc

SEQ ID NO: 893872 - RNA, 26 nt, Human
guggggcggcgaggcgggcggcagcg

SEQ ID NO: 893873 - RNA, 25 nt, Human
uaaaauuagaaaacaaaaggauguc

SEQ ID NO: 893874 - RNA, 21 nt, Human
uagugggucuuuucuuagguc

SEQ ID NO: 893875 - RNA, 18 nt, Human
uauacaaagauaaaugca

SEQ ID NO: 893876 - RNA, 26 nt, Human
uaugcaggcaaaggagaggucacacc

SEQ ID NO: 893877 - RNA, 27 nt, Human
ucaauuuaaaaauucuuagcccucuua

SEQ ID NO: 893878 - RNA, 27 nt, Human
uccaagaaaauauuuaccagaagaaug

SEQ ID NO: 893879 - RNA, 21 nt, Human
uccagaaaucccaaguacaaa

SEQ ID NO: 893880 - RNA, 24 nt, Human
uccccuggccuugagguaugcagg

SEQ ID NO: 893881 - RNA, 25 nt, Human
uccuccagacauggacggcuaccaa

SEQ ID NO: 893882 - RNA, 21 nt, Human
ucgacuuguccuccagacaug

SEQ ID NO: 893883 - RNA, 25 nt, Human
ugacugaacuuuagacagaaaagac

SEQ ID NO: 893884 - RNA, 21 nt, Human
ugagaggcuggcggcggcggg

SEQ ID NO: 893885 - RNA, 18 nt, Human
ugagguaugcaggcaaag

SEQ ID NO: 893886 - RNA, 19 nt, Human
uggcggcggcgggcgcgug

SEQ ID NO: 893887 - RNA, 23 nt, Human
uucaagauacaagaaggaucaaa

SEQ ID NO: 893888 - RNA, 23 nt, Human
aaaaaaauucccuugcuugcaga

SEQ ID NO: 893889 - RNA, 18 nt, Human
agacgcauggacuugagc

SEQ ID NO: 893890 - RNA, 18 nt, Human
aguuccauucaaaauuac

SEQ ID NO: 893891 - RNA, 25 nt, Human
auauauacauguaugcauauauaca

SEQ ID NO: 893892 - RNA, 23 nt, Human
cccuugcuugcagaguuuuuguu

SEQ ID NO: 893893 - RNA, 22 nt, Human
ccuuaugaauauauacauguau

SEQ ID NO: 893894 - RNA, 23 nt, Human
ccuuaugaauauauacauguaug

SEQ ID NO: 893895 - RNA, 21 nt, Human
cuugagaagagcggaccgcuc

SEQ ID NO: 893896 - RNA, 19 nt, Human
ggaaggccuuuuuccgccu

SEQ ID NO: 893897 - RNA, 20 nt, Human
ggaaggccuuuuuccgccuc

SEQ ID NO: 893898 - RNA, 20 nt, Human
gucaucuucucgcgccuggg

SEQ ID NO: 893899 - RNA, 23 nt, Human
uaagaaaaaaaucaaauuuaaaa

SEQ ID NO: 893900 - RNA, 24 nt, Human
uauauacauguaugcauauauaca

SEQ ID NO: 893901 - RNA, 22 nt, Human
uaugaauauauacauguaugca

SEQ ID NO: 893902 - RNA, 23 nt, Human
ugagaagagcggaccgcucugac

SEQ ID NO: 893903 - RNA, 26 nt, Human
uguaugcauauauacaucucuguaug

SEQ ID NO: 893904 - RNA, 24 nt, Human
uuuaaaaucacuauugauggaagc

SEQ ID NO: 893905 - RNA, 18 nt, Human
uuuuuuuuuuuuuuuuug

SEQ ID NO: 893906 - RNA, 25 nt, Human
uuuuuuuuuuuuuuuuuuuuugggg

SEQ ID NO: 893907 - RNA, 21 nt, Human
ccggcugcgguucaccuuucc

SEQ ID NO: 893908 - RNA, 18 nt, Human
uaccacuggucuucauag

SEQ ID NO: 893909 - RNA, 19 nt, Human
aaagugcuccuguccagca

SEQ ID NO: 893910 - RNA, 22 nt, Human
agcgcggcuacagggcucucca

SEQ ID NO: 893911 - RNA, 21 nt, Human
cacggccgcggcgcccccgcc

SEQ ID NO: 893912 - RNA, 19 nt, Human
ccgccgcagcucccgcccc

SEQ ID NO: 893913 - RNA, 20 nt, Human
ccgcggcgcccccgccggcu

SEQ ID NO: 893914 - RNA, 21 nt, Human
ccgcggcgcccccgccggcuu

SEQ ID NO: 893915 - RNA, 22 nt, Human
ccuguccagcagaacucaaaag

SEQ ID NO: 893916 - RNA, 22 nt, Human
cgccgcagcucccgcccgcgcc

SEQ ID NO: 893917 - RNA, 21 nt, Human
cggagcgcgcagggcaugggc

SEQ ID NO: 893918 - RNA, 19 nt, Human
cggccgcggcgcccccgcc

SEQ ID NO: 893919 - RNA, 24 nt, Human
cggcggcagcuacgacccccggag

SEQ ID NO: 893920 - RNA, 20 nt, Human
cggcucggcggcagcuacga

SEQ ID NO: 893921 - RNA, 22 nt, Human
cgucagcggcggggcuggguuu

SEQ ID NO: 893922 - RNA, 30 nt, Human
cuggugacaguguguacaaagucuucucuu

SEQ ID NO: 893923 - RNA, 19 nt, Human
gaagagaguagggucucca

SEQ ID NO: 893924 - RNA, 19 nt, Human
gagcgcgcagggcaugggc

SEQ ID NO: 893925 - RNA, 19 nt, Human
gccccgggucgggaguggg

SEQ ID NO: 893926 - RNA, 23 nt, Human
gccgcagcucccgcccgcgccag

SEQ ID NO: 893927 - RNA, 21 nt, Human
gccggcuuccggagccccggc

SEQ ID NO: 893928 - RNA, 21 nt, Human
uagcggccguucucagcgaag

SEQ ID NO: 893929 - RNA, 23 nt, Human
uauccgccgcagcucccgcccgc

SEQ ID NO: 893930 - RNA, 21 nt, Human
ucagcggcggggcuggguuuc

SEQ ID NO: 893931 - RNA, 19 nt, Human
ucaguccccgcuagcggcc

SEQ ID NO: 893932 - RNA, 20 nt, Human
uccgucagcggcggggcugg

SEQ ID NO: 893933 - RNA, 24 nt, Human
ucggcggcagcuacgacccccgga

SEQ ID NO: 893934 - RNA, 21 nt, Human
ucggcggccacuggcucccuu

SEQ ID NO: 893935 - RNA, 21 nt, Human
ucuccacagcacgcaaggguu

SEQ ID NO: 893936 - RNA, 18 nt, Human
ucuccaggagcccagaaa

SEQ ID NO: 893937 - RNA, 21 nt, Human
ugggcucccggccuucagucc

SEQ ID NO: 893938 - RNA, 23 nt, Human
ugggcucccggccuucagucccc

SEQ ID NO: 893939 - RNA, 24 nt, Human
uuaaaagcaaauaacacauuuaac

SEQ ID NO: 893940 - RNA, 19 nt, Human
aagcccgcccaccugggcc

SEQ ID NO: 893941 - RNA, 24 nt, Human
acccuccaugcaacguccagacag

SEQ ID NO: 893942 - RNA, 19 nt, Human
acccuguacgccagggauu

SEQ ID NO: 893943 - RNA, 20 nt, Human
aggacaguguccuggcacgu

SEQ ID NO: 893944 - RNA, 20 nt, Human
cagcagcccguccaaaggga

SEQ ID NO: 893945 - RNA, 20 nt, Human
ccacccuccaugcaacgucc

SEQ ID NO: 893946 - RNA, 22 nt, Human
ccagaagcccgcccaccugggc

SEQ ID NO: 893947 - RNA, 20 nt, Human
ccguccaaagggaugcucca

SEQ ID NO: 893948 - RNA, 23 nt, Human
ccguccaaagggaugcuccaagc

SEQ ID NO: 893949 - RNA, 21 nt, Human
gaagcccgcccaccugggccc

SEQ ID NO: 893950 - RNA, 23 nt, Human
gagaggccugcgccacccuccau

SEQ ID NO: 893951 - RNA, 20 nt, Human
gcgcugugggguggggccag

SEQ ID NO: 893952 - RNA, 20 nt, Human
gcugugggguggggccagaa

SEQ ID NO: 893953 - RNA, 21 nt, Human
ggcccuggaggaggcuggagu

SEQ ID NO: 893954 - RNA, 19 nt, Human
ggcuccuggagcagcuccu

SEQ ID NO: 893955 - RNA, 23 nt, Human
uauaaaaaaacguuggaccacgu

SEQ ID NO: 893956 - RNA, 18 nt, Human
uccaugcaacguccagac

SEQ ID NO: 893957 - RNA, 26 nt, Human
uggaggaggcuggagugugagagccu

SEQ ID NO: 893958 - RNA, 24 nt, Human
uggagugugagagccucugugacg

SEQ ID NO: 893959 - RNA, 22 nt, Human
ugggcccuggaggaggcuggag

SEQ ID NO: 893960 - RNA, 23 nt, Human
ugggguggggccagaagcccgcc

SEQ ID NO: 893961 - RNA, 21 nt, Human
ugugggguggggccagaagcc

SEQ ID NO: 893962 - RNA, 23 nt, Human
accaccaccaccaccaucauacg

SEQ ID NO: 893963 - RNA, 25 nt, Human
accaccaccaccaucauacgguuac

SEQ ID NO: 893964 - RNA, 22 nt, Human
caacggacaauaaaagaaugaa

SEQ ID NO: 893965 - RNA, 21 nt, Human
caccaccaccaccaccaucau

SEQ ID NO: 893966 - RNA, 18 nt, Human
cagguuaaaacaacggac

SEQ ID NO: 893967 - RNA, 20 nt, Human
cagucagguuaaaacaacgg

SEQ ID NO: 893968 - RNA, 24 nt, Human
caucauacgguuacucaggcaaca

SEQ ID NO: 893969 - RNA, 23 nt, Human
ccaccaccaccaccaucauacgg

SEQ ID NO: 893970 - RNA, 23 nt, Human
ccaccaccaccaucauacgguua

SEQ ID NO: 893971 - RNA, 18 nt, Human
cucagcacuagaaaauag

SEQ ID NO: 893972 - RNA, 25 nt, Human
cuuguauucagucagguuaaaacaa

SEQ ID NO: 893973 - RNA, 20 nt, Human
gcaguaccccauagacuggu

SEQ ID NO: 893974 - RNA, 20 nt, Human
uaaaaagcaaugcaguaccc

SEQ ID NO: 893975 - RNA, 19 nt, Human
uacagugcaaaauccaugu

SEQ ID NO: 893976 - RNA, 25 nt, Human
ucagucagguuaaaacaacggacaa

SEQ ID NO: 893977 - RNA, 19 nt, Human
ugagacaggaagacaccac

SEQ ID NO: 893978 - RNA, 21 nt, Human
ugagacaggaagacaccacca

SEQ ID NO: 893979 - RNA, 20 nt, Human
ugccaggaguacagugcucu

SEQ ID NO: 893980 - RNA, 23 nt, Human
uguaauaauugccaggaguacag

SEQ ID NO: 893981 - RNA, 18 nt, Human
aaaaauguagcagaagca

SEQ ID NO: 893982 - RNA, 21 nt, Human
aagaaaaacauucauagauca

SEQ ID NO: 893983 - RNA, 21 nt, Human
aauaagcacaaacuuuuagac

SEQ ID NO: 893984 - RNA, 21 nt, Human
acccuaaaaauguagcagaag

SEQ ID NO: 893985 - RNA, 18 nt, Human
agcagaagcauuuccgca

SEQ ID NO: 893986 - RNA, 20 nt, Human
aguuugugcagaaauguuuu

SEQ ID NO: 893987 - RNA, 23 nt, Human
auagaguacucuucagaagaaag

SEQ ID NO: 893988 - RNA, 22 nt, Human
caaacccuaaaaauguagcaga

SEQ ID NO: 893989 - RNA, 20 nt, Human
cagaaauguuuccacuagau

SEQ ID NO: 893990 - RNA, 23 nt, Human
cagugcaguuauugcugcacucc

SEQ ID NO: 893991 - RNA, 26 nt, Human
ccauaaaaauauuuucucuuccauuu

SEQ ID NO: 893992 - RNA, 18 nt, Human
cgccgggcggugcgcacg

SEQ ID NO: 893993 - RNA, 21 nt, Human
uaagaaaaacauucauagauc

SEQ ID NO: 893994 - RNA, 21 nt, Human
uagauuuauagaguacucuuc

SEQ ID NO: 893995 - RNA, 23 nt, Human
uauagaguacucuucagaagaaa

SEQ ID NO: 893996 - RNA, 18 nt, Human
uauccagagcccaaaaaa

SEQ ID NO: 893997 - RNA, 19 nt, Human
ucaccuggacgccgggcgg

SEQ ID NO: 893998 - RNA, 21 nt, Human
uccaccgcgcuccgcaggcca

SEQ ID NO: 893999 - RNA, 23 nt, Human
uccagagcccaaaaaauguagac

SEQ ID NO: 894000 - RNA, 21 nt, Human
uccgcaggccaacugcgggcc

SEQ ID NO: 894001 - RNA, 24 nt, Human
ugaaauuucaugguucaaauguau

SEQ ID NO: 894002 - RNA, 23 nt, Human
ugcagaaauguuuccacuagauu

SEQ ID NO: 894003 - RNA, 24 nt, Human
uuccuuauccagagcccaaaaaau

SEQ ID NO: 894004 - RNA, 24 nt, Human
aaacaaauaaacaaacaaaaacuu

SEQ ID NO: 894005 - RNA, 24 nt, Human
aaagugcugggauuacagguguga

SEQ ID NO: 894006 - RNA, 20 nt, Human
aaccugugccucccggguuc

SEQ ID NO: 894007 - RNA, 19 nt, Human
aaguagcugggacuacagg

SEQ ID NO: 894008 - RNA, 23 nt, Human
aaguagcugggacuacaggagcc

SEQ ID NO: 894009 - RNA, 23 nt, Human
aaguagcugggacuacaggagcc

SEQ ID NO: 894010 - RNA, 20 nt, Human
aaguagcugggacuacaggc

SEQ ID NO: 894011 - RNA, 20 nt, Human
aaguagcugggacuacaggc

SEQ ID NO: 894012 - RNA, 27 nt, Human
aaguagcugggacuacaggcgugagcc

SEQ ID NO: 894013 - RNA, 18 nt, Human
aaguagcugggauuauag

SEQ ID NO: 894014 - RNA, 24 nt, Human
aaguagcugggauuauaguuaugc

SEQ ID NO: 894015 - RNA, 25 nt, Human
aagugauucuccugccucagccucc

SEQ ID NO: 894016 - RNA, 18 nt, Human
aagugcugggauuacagg

SEQ ID NO: 894017 - RNA, 19 nt, Human
aagugcugggauuacaggu

SEQ ID NO: 894018 - RNA, 26 nt, Human
aagugcugggauuacaggugugagcc

SEQ ID NO: 894019 - RNA, 22 nt, Human
accauauuggccaggcuggucu

SEQ ID NO: 894020 - RNA, 19 nt, Human
acccaggcuggagugcaau

SEQ ID NO: 894021 - RNA, 21 nt, Human
accggagaucaccagcggccc

SEQ ID NO: 894022 - RNA, 24 nt, Human
accuggggucaagugauucuccug

SEQ ID NO: 894023 - RNA, 21 nt, Human
acugcaaccucugccucccag

SEQ ID NO: 894024 - RNA, 22 nt, Human
acugcaaccucugccucccagg

SEQ ID NO: 894025 - RNA, 24 nt, Human
agcgauucuccugccucagccucc

SEQ ID NO: 894026 - RNA, 24 nt, Human
agcgauucuccugccucagccucc

SEQ ID NO: 894027 - RNA, 21 nt, Human
agcugggacuacaggagccca

SEQ ID NO: 894028 - RNA, 19 nt, Human
aggcuggagugcaguggca

SEQ ID NO: 894029 - RNA, 24 nt, Human
agugcaauggcacgaucuuggcuu

SEQ ID NO: 894030 - RNA, 23 nt, Human
agugcaauggugcaaucuuggcu

SEQ ID NO: 894031 - RNA, 24 nt, Human
agugcaauggugcaaucuuggcuc

SEQ ID NO: 894032 - RNA, 20 nt, Human
agugcaguggcacaaccuug

SEQ ID NO: 894033 - RNA, 23 nt, Human
auauuggccaggcuggucuugaa

SEQ ID NO: 894034 - RNA, 19 nt, Human
aucacaacuucuuucccca

SEQ ID NO: 894035 - RNA, 18 nt, Human
augggguuucaccauauu

SEQ ID NO: 894036 - RNA, 20 nt, Human
augggguuucaccauauugg

SEQ ID NO: 894037 - RNA, 24 nt, Human
augggguuucaccauauuggccag

SEQ ID NO: 894038 - RNA, 24 nt, Human
caaagugcugggauuacaggugug

SEQ ID NO: 894039 - RNA, 22 nt, Human
caagcgauucuccugccucagc

SEQ ID NO: 894040 - RNA, 22 nt, Human
caagcgauucuccugccucagc

SEQ ID NO: 894041 - RNA, 27 nt, Human
caagcgauucuccugccucagccuccc

SEQ ID NO: 894042 - RNA, 27 nt, Human
caagcgauucuccugccucagccuccc

SEQ ID NO: 894043 - RNA, 22 nt, Human
caagugauucuccugccucagc

SEQ ID NO: 894044 - RNA, 24 nt, Human
cacaaccuuggcccacuggaaccu

SEQ ID NO: 894045 - RNA, 21 nt, Human
caccauauuggccaggcuggu

SEQ ID NO: 894046 - RNA, 23 nt, Human
caccauauuggccaggcuggucu

SEQ ID NO: 894047 - RNA, 27 nt, Human
caccauauuggccaggcuggucuugaa

SEQ ID NO: 894048 - RNA, 19 nt, Human
caggagcccaccaccaugc

SEQ ID NO: 894049 - RNA, 24 nt, Human
cauauuggccaggcuggucuugaa

SEQ ID NO: 894050 - RNA, 24 nt, Human
caucucaaaaacaaauaaacaaac

SEQ ID NO: 894051 - RNA, 20 nt, Human
ccaaagugcugggauuacag

SEQ ID NO: 894052 - RNA, 21 nt, Human
ccaaagugcugggauuacagg

SEQ ID NO: 894053 - RNA, 21 nt, Human
ccaaagugcugggauuacagg

SEQ ID NO: 894054 - RNA, 24 nt, Human
ccaaagugcugggauuacaggugu

SEQ ID NO: 894055 - RNA, 24 nt, Human
ccaaguagcugggacuacaggagc

SEQ ID NO: 894056 - RNA, 22 nt, Human
ccacccacuuaggccucccaaa

SEQ ID NO: 894057 - RNA, 24 nt, Human
ccaccuggggucaagugauucucc

SEQ ID NO: 894058 - RNA, 24 nt, Human
ccacuggaaccugugccucccggg

SEQ ID NO: 894059 - RNA, 23 nt, Human
cccaaguagcugggacuacagga

SEQ ID NO: 894060 - RNA, 23 nt, Human
cccaaguagcugggacuacaggc

SEQ ID NO: 894061 - RNA, 23 nt, Human
cccaaguagcugggacuacaggc

SEQ ID NO: 894062 - RNA, 23 nt, Human
cccaaguagcugggauuauaguu

SEQ ID NO: 894063 - RNA, 19 nt, Human
cccaggcuggagugcagug

SEQ ID NO: 894064 - RNA, 23 nt, Human
cccagguucaagcgauucuccug

SEQ ID NO: 894065 - RNA, 20 nt, Human
cccggguucaagcgauucuc

SEQ ID NO: 894066 - RNA, 23 nt, Human
cccggguucaagcgauucuccug

SEQ ID NO: 894067 - RNA, 24 nt, Human
ccggacgccagcgaguggaacauc

SEQ ID NO: 894068 - RNA, 24 nt, Human
ccucccagguucaagcgauucucc

SEQ ID NO: 894069 - RNA, 24 nt, Human
ccucccggguucaagcgauucucc

SEQ ID NO: 894070 - RNA, 23 nt, Human
ccugccucagccucccaaguagc

SEQ ID NO: 894071 - RNA, 23 nt, Human
ccugccucagccucccaaguagc

SEQ ID NO: 894072 - RNA, 23 nt, Human
ccugccucagccucccaaguagc

SEQ ID NO: 894073 - RNA, 24 nt, Human
ccugccucagccucccaaguagcu

SEQ ID NO: 894074 - RNA, 24 nt, Human
cgcucugucacccaggcuggagug

SEQ ID NO: 894075 - RNA, 18 nt, Human
cggcaccaugccuggcua

SEQ ID NO: 894076 - RNA, 18 nt, Human
cggcccggacgccagcga

SEQ ID NO: 894077 - RNA, 24 nt, Human
cucacugcaaccuccaccaccugg

SEQ ID NO: 894078 - RNA, 23 nt, Human
cucagccucccaaguagcuggga

SEQ ID NO: 894079 - RNA, 24 nt, Human
cucagccucccaaguagcugggac

SEQ ID NO: 894080 - RNA, 24 nt, Human
cucagccucccaaguagcugggac

SEQ ID NO: 894081 - RNA, 21 nt, Human
cucgcucugucacccaggcug

SEQ ID NO: 894082 - RNA, 24 nt, Human
cucgcucugucacccaggcuggag

SEQ ID NO: 894083 - RNA, 23 nt, Human
cugcaaccucugccucccagguu

SEQ ID NO: 894084 - RNA, 24 nt, Human
cugcaaccucugccucccagguuc

SEQ ID NO: 894085 - RNA, 23 nt, Human
cugccucagccucccaaguagcu

SEQ ID NO: 894086 - RNA, 23 nt, Human
cugccucagccucccaaguagcu

SEQ ID NO: 894087 - RNA, 20 nt, Human
cuugcucugucgccaggcug

SEQ ID NO: 894088 - RNA, 19 nt, Human
cuuuuuugcccaggcugga

SEQ ID NO: 894089 - RNA, 24 nt, Human
gacagagucuugcucugucgccag

SEQ ID NO: 894090 - RNA, 21 nt, Human
gaccucacgugauccacccac

SEQ ID NO: 894091 - RNA, 18 nt, Human
gacuacaggcgugagcca

SEQ ID NO: 894092 - RNA, 21 nt, Human
gacuacaggcgugagccacug

SEQ ID NO: 894093 - RNA, 24 nt, Human
gacuacaggcgugagccacugugc

SEQ ID NO: 894094 - RNA, 23 nt, Human
gagaugggguuucaccauauugg

SEQ ID NO: 894095 - RNA, 24 nt, Human
gagaugggguuucaccauauuggc

SEQ ID NO: 894096 - RNA, 18 nt, Human
gauuacaggugugagcca

SEQ ID NO: 894097 - RNA, 21 nt, Human
gauuacaggugugagccacca

SEQ ID NO: 894098 - RNA, 22 nt, Human
gauuacaggugugagccaccac

SEQ ID NO: 894099 - RNA, 21 nt, Human
gauucuccugccucagccucc

SEQ ID NO: 894100 - RNA, 22 nt, Human
gcaaccuccaccaccugggguc

SEQ ID NO: 894101 - RNA, 19 nt, Human
gcccaggcuggagugcagu

SEQ ID NO: 894102 - RNA, 23 nt, Human
gccuggcuaauuuuuuguauuuu

SEQ ID NO: 894103 - RNA, 24 nt, Human
gcgauucuccugccucagccuccc

SEQ ID NO: 894104 - RNA, 24 nt, Human
gcgauucuccugccucagccuccc

SEQ ID NO: 894105 - RNA, 27 nt, Human
gcucugucacccaggcuggagugcaau

SEQ ID NO: 894106 - RNA, 19 nt, Human
gcuggagugcaauggcacg

SEQ ID NO: 894107 - RNA, 19 nt, Human
gcuggagugcaguggcaca

SEQ ID NO: 894108 - RNA, 21 nt, Human
gcuuacugcaaccucugccuc

SEQ ID NO: 894109 - RNA, 20 nt, Human
gcuuuuuugcccaggcugga

SEQ ID NO: 894110 - RNA, 20 nt, Human
ggacuacaggcgugagccac

SEQ ID NO: 894111 - RNA, 24 nt, Human
ggacuacaggcgugagccacugug

SEQ ID NO: 894112 - RNA, 20 nt, Human
ggagaucaccagcggcccgg

SEQ ID NO: 894113 - RNA, 22 nt, Human
gggguuucaccauauuggccag

SEQ ID NO: 894114 - RNA, 19 nt, Human
ggucuugaacucuugaccu

SEQ ID NO: 894115 - RNA, 20 nt, Human
ggucuuuuuuuuuuuucucu

SEQ ID NO: 894116 - RNA, 24 nt, Human
gucuugcucugucgccaggcugga

SEQ ID NO: 894117 - RNA, 23 nt, Human
gucuuuuuuuuuuuucucuuuga

SEQ ID NO: 894118 - RNA, 24 nt, Human
gugauccacccacuuaggccuccc

SEQ ID NO: 894119 - RNA, 24 nt, Human
gugauucuccugccucagccuccc

SEQ ID NO: 894120 - RNA, 24 nt, Human
guuuugcuuuuuugcccaggcugg

SEQ ID NO: 894121 - RNA, 24 nt, Human
uaauuuuuuguauucuuaguagag

SEQ ID NO: 894122 - RNA, 24 nt, Human
uaauuuuuuguauuuuuaguagag

SEQ ID NO: 894123 - RNA, 25 nt, Human
uaauuuuuuguauuuuuaguagaga

SEQ ID NO: 894124 - RNA, 23 nt, Human
uacaggcgugagccacugugccc

SEQ ID NO: 894125 - RNA, 24 nt, Human
uacaggcgugagccacugugccca

SEQ ID NO: 894126 - RNA, 23 nt, Human
uacaggugugagccaccacaccc

SEQ ID NO: 894127 - RNA, 24 nt, Human
uaccggagaucaccagcggcccgg

SEQ ID NO: 894128 - RNA, 21 nt, Human
uacugcaaccucugccuccca

SEQ ID NO: 894129 - RNA, 23 nt, Human
uacugcaaccucugccucccagg

SEQ ID NO: 894130 - RNA, 24 nt, Human
uagagacuccaucucaaaaacaaa

SEQ ID NO: 894131 - RNA, 19 nt, Human
uaguagagaugggguuuca

SEQ ID NO: 894132 - RNA, 23 nt, Human
uaguagagaugggguuucaccau

SEQ ID NO: 894133 - RNA, 26 nt, Human
uaguagagaugggguuucaccauauu

SEQ ID NO: 894134 - RNA, 19 nt, Human
ucaagugauucuccugccu

SEQ ID NO: 894135 - RNA, 22 nt, Human
ucaagugauucuccugccucag

SEQ ID NO: 894136 - RNA, 18 nt, Human
ucacccaggcuggagugc

SEQ ID NO: 894137 - RNA, 19 nt, Human
ucacugcaaccuccaccac

SEQ ID NO: 894138 - RNA, 23 nt, Human
ucacugcaaccuccaccaccugg

SEQ ID NO: 894139 - RNA, 24 nt, Human
ucacugcaaccuccaccaccuggg

SEQ ID NO: 894140 - RNA, 27 nt, Human
ucacugcaaccuccaccaccugggguc

SEQ ID NO: 894141 - RNA, 18 nt, Human
ucagccucccaaguagcu

SEQ ID NO: 894142 - RNA, 18 nt, Human
ucagccucccaaguagcu

SEQ ID NO: 894143 - RNA, 20 nt, Human
ucagccucccaaguagcugg

SEQ ID NO: 894144 - RNA, 20 nt, Human
ucagccucccaaguagcugg

SEQ ID NO: 894145 - RNA, 20 nt, Human
ucagccucccaaguagcugg

SEQ ID NO: 894146 - RNA, 23 nt, Human
ucccaaagugcugggauuacagg

SEQ ID NO: 894147 - RNA, 18 nt, Human
ucccaaguagcugggacu

SEQ ID NO: 894148 - RNA, 24 nt, Human
ucccaaguagcugggacuacaggc

SEQ ID NO: 894149 - RNA, 23 nt, Human
ucccaaguagcugggauuauagu

SEQ ID NO: 894150 - RNA, 21 nt, Human
ucccagguucaagcgauucuc

SEQ ID NO: 894151 - RNA, 24 nt, Human
ucccagguucaagcgauucuccug

SEQ ID NO: 894152 - RNA, 21 nt, Human
ucccggguucaagcgauucuc

SEQ ID NO: 894153 - RNA, 24 nt, Human
ucccggguucaagcgauucuccug

SEQ ID NO: 894154 - RNA, 21 nt, Human
ucccuuguugucgcgcccuca

SEQ ID NO: 894155 - RNA, 24 nt, Human
ucgcucugucacccaggcuggagu

SEQ ID NO: 894156 - RNA, 26 nt, Human
ucuccugccucagccucccaaguagc

SEQ ID NO: 894157 - RNA, 26 nt, Human
ucuccugccucagccucccaaguagc

SEQ ID NO: 894158 - RNA, 26 nt, Human
ucuccugccucagccucccaaguagc

SEQ ID NO: 894159 - RNA, 19 nt, Human
ucucgcucugucacccagg

SEQ ID NO: 894160 - RNA, 23 nt, Human
ucucgcucugucacccaggcugg

SEQ ID NO: 894161 - RNA, 24 nt, Human
ucucgcucugucacccaggcugga

SEQ ID NO: 894162 - RNA, 26 nt, Human
ucucgcucugucacccaggcuggagu

SEQ ID NO: 894163 - RNA, 27 nt, Human
ucucgcucugucacccaggcuggagug

SEQ ID NO: 894164 - RNA, 24 nt, Human
ucugucacccaggcuggagugcaa

SEQ ID NO: 894165 - RNA, 18 nt, Human
ucugucgccaggcuggag

SEQ ID NO: 894166 - RNA, 21 nt, Human
ucugucgccaggcuggagugc

SEQ ID NO: 894167 - RNA, 23 nt, Human
ucugucgccaggcuggagugcaa

SEQ ID NO: 894168 - RNA, 21 nt, Human
ucuugcucugucgccaggcug

SEQ ID NO: 894169 - RNA, 21 nt, Human
ucuugcucugucgccaggcug

SEQ ID NO: 894170 - RNA, 22 nt, Human
ucuugcucugucgccaggcugg

SEQ ID NO: 894171 - RNA, 23 nt, Human
ucuugcucugucgccaggcugga

SEQ ID NO: 894172 - RNA, 22 nt, Human
ugaccucacgugauccacccac

SEQ ID NO: 894173 - RNA, 18 nt, Human
ugagacagagucuugcuc

SEQ ID NO: 894174 - RNA, 22 nt, Human
ugagacagagucuugcucuguc

SEQ ID NO: 894175 - RNA, 22 nt, Human
ugagauggagucucgcucuguc

SEQ ID NO: 894176 - RNA, 20 nt, Human
ugauucuccugccucagccu

SEQ ID NO: 894177 - RNA, 23 nt, Human
ugcaauggugcaaucuuggcucc

SEQ ID NO: 894178 - RNA, 20 nt, Human
ugcaguggcacaaccuuggc

SEQ ID NO: 894179 - RNA, 18 nt, Human
ugcccaggcuggagugca

SEQ ID NO: 894180 - RNA, 22 nt, Human
ugcccaggcuggagugcagugg

SEQ ID NO: 894181 - RNA, 24 nt, Human
ugcccaggcuggagugcaguggca

SEQ ID NO: 894182 - RNA, 24 nt, Human
ugccucagccucccaaguagcugg

SEQ ID NO: 894183 - RNA, 24 nt, Human
ugccucagccucccaaguagcugg

SEQ ID NO: 894184 - RNA, 24 nt, Human
ugccucagccucccaaguagcugg

SEQ ID NO: 894185 - RNA, 23 nt, Human
ugcucugucgccaggcuggagug

SEQ ID NO: 894186 - RNA, 24 nt, Human
ugcugggauuacaggugugagcca

SEQ ID NO: 894187 - RNA, 23 nt, Human
uggagugcaauggcacgaucuug

SEQ ID NO: 894188 - RNA, 24 nt, Human
uggagugcaauggcacgaucuugg

SEQ ID NO: 894189 - RNA, 23 nt, Human
uggagugcaauggugcaaucuug

SEQ ID NO: 894190 - RNA, 24 nt, Human
uggagugcaauggugcaaucuugg

SEQ ID NO: 894191 - RNA, 23 nt, Human
uggagugcaguggcacaaccuug

SEQ ID NO: 894192 - RNA, 24 nt, Human
uggagugcaguggcacaaccuugg

SEQ ID NO: 894193 - RNA, 24 nt, Human
uggaguuuugcuuuuuugcccagg

SEQ ID NO: 894194 - RNA, 20 nt, Human
uggcacaaccuuggcccacu

SEQ ID NO: 894195 - RNA, 23 nt, Human
uggcacaaccuuggcccacugga

SEQ ID NO: 894196 - RNA, 24 nt, Human
uggccaggcuggucuugaacucuu

SEQ ID NO: 894197 - RNA, 19 nt, Human
ugggacuacaggagcccac

SEQ ID NO: 894198 - RNA, 21 nt, Human
ugggacuacaggagcccacca

SEQ ID NO: 894199 - RNA, 24 nt, Human
ugggacuacaggagcccaccacca

SEQ ID NO: 894200 - RNA, 21 nt, Human
ugggacuacaggcgugagcca

SEQ ID NO: 894201 - RNA, 22 nt, Human
ugggacuacaggcgugagccac

SEQ ID NO: 894202 - RNA, 22 nt, Human
ugggacuacaggcgugagccac

SEQ ID NO: 894203 - RNA, 22 nt, Human
ugggacuacaggcgugagccac

SEQ ID NO: 894204 - RNA, 24 nt, Human
ugggacuacaggcgugagccacug

SEQ ID NO: 894205 - RNA, 26 nt, Human
ugggacuacaggcgugagccacugug

SEQ ID NO: 894206 - RNA, 18 nt, Human
ugggauuacaggugugag

SEQ ID NO: 894207 - RNA, 19 nt, Human
ugggauuacaggugugagc

SEQ ID NO: 894208 - RNA, 22 nt, Human
ugggauuacaggugugagccac

SEQ ID NO: 894209 - RNA, 23 nt, Human
ugggauuacaggugugagccacc

SEQ ID NO: 894210 - RNA, 24 nt, Human
ugggauuacaggugugagccacca

SEQ ID NO: 894211 - RNA, 25 nt, Human
ugggauuauaguuaugcggcaccau

SEQ ID NO: 894212 - RNA, 23 nt, Human
uggggucaagugauucuccugcc

SEQ ID NO: 894213 - RNA, 24 nt, Human
ugggguuucaccauauuggccagg

SEQ ID NO: 894214 - RNA, 20 nt, Human
ugucacccaggcuggagugc

SEQ ID NO: 894215 - RNA, 19 nt, Human
uuacugcaaccucugccuc

SEQ ID NO: 894216 - RNA, 24 nt, Human
uuacugcaaccucugccucccagg

SEQ ID NO: 894217 - RNA, 25 nt, Human
uuacugcaaccucugccucccaggu

SEQ ID NO: 894218 - RNA, 21 nt, Human
uuaggccucccaaagugcugg

SEQ ID NO: 894219 - RNA, 18 nt, Human
uuaguagagaugggguuu

SEQ ID NO: 894220 - RNA, 22 nt, Human
uuaguagagaugggguuucacc

SEQ ID NO: 894221 - RNA, 24 nt, Human
uuaguagagaugggguuucaccau

SEQ ID NO: 894222 - RNA, 21 nt, Human
uucaagcgauucuccugccuc

SEQ ID NO: 894223 - RNA, 21 nt, Human
uucaagcgauucuccugccuc

SEQ ID NO: 894224 - RNA, 23 nt, Human
uucaagcgauucuccugccucag

SEQ ID NO: 894225 - RNA, 23 nt, Human
uucaagcgauucuccugccucag

SEQ ID NO: 894226 - RNA, 24 nt, Human
uucaagcgauucuccugccucagc

SEQ ID NO: 894227 - RNA, 24 nt, Human
uucaagcgauucuccugccucagc

SEQ ID NO: 894228 - RNA, 24 nt, Human
uucuuaguagagaugggguuucac

SEQ ID NO: 894229 - RNA, 24 nt, Human
uugcccaggcuggagugcaguggc

SEQ ID NO: 894230 - RNA, 22 nt, Human
uugcuuuuuugcccaggcugga

SEQ ID NO: 894231 - RNA, 24 nt, Human
uuucaccauauuggccaggcuggu

SEQ ID NO: 894232 - RNA, 24 nt, Human
uuuugcuuuuuugcccaggcugga

SEQ ID NO: 894233 - RNA, 21 nt, Human
uuuuuguauucuuaguagaga

SEQ ID NO: 894234 - RNA, 21 nt, Human
uuuuuguauuuuuaguagaga

SEQ ID NO: 894235 - RNA, 23 nt, Human
uuuuuucucuuugagauggaguu

SEQ ID NO: 894236 - RNA, 24 nt, Human
uuuuuugcccaggcuggagugcag

SEQ ID NO: 894237 - RNA, 24 nt, Human
uuuuuuguauucuuaguagagaug

SEQ ID NO: 894238 - RNA, 18 nt, Human
uuuuuuguauuuuuagua

SEQ ID NO: 894239 - RNA, 20 nt, Human
uuuuuuuuuuugagacagag

SEQ ID NO: 894240 - RNA, 18 nt, Human
uuuuuuuuuuuucucuuu

SEQ ID NO: 894241 - RNA, 24 nt, Human
uuuuuuuuuuuugagacagagucu

SEQ ID NO: 894242 - RNA, 25 nt, Human
uuuuuuuuuuuugagauggagucuc

SEQ ID NO: 894243 - RNA, 22 nt, Human
uuuuuuuuuuuuuugagaugga

SEQ ID NO: 894244 - RNA, 18 nt, Human
uuuuuuuuuuuuuuuuug

SEQ ID NO: 894245 - RNA, 21 nt, Human
aacccugcacaagcccuccug

SEQ ID NO: 894246 - RNA, 18 nt, Human
acagagcccccucccccc

SEQ ID NO: 894247 - RNA, 18 nt, Human
acccugcacaagcccucc

SEQ ID NO: 894248 - RNA, 21 nt, Human
acugagaugaggcccagcuuc

SEQ ID NO: 894249 - RNA, 24 nt, Human
agauuccccccaccccccccccaa

SEQ ID NO: 894250 - RNA, 18 nt, Human
agugaaaugaugugaaug

SEQ ID NO: 894251 - RNA, 23 nt, Human
augaugugaaugucccaccccac

SEQ ID NO: 894252 - RNA, 22 nt, Human
auggggacagccgcgcgccaca

SEQ ID NO: 894253 - RNA, 18 nt, Human
augugaaugucccacccc

SEQ ID NO: 894254 - RNA, 23 nt, Human
caaaacccugcacaagcccuccc

SEQ ID NO: 894255 - RNA, 24 nt, Human
cacaagcccuccugcccauccccu

SEQ ID NO: 894256 - RNA, 19 nt, Human
cacagccuucagcaccucc

SEQ ID NO: 894257 - RNA, 24 nt, Human
caccccacagagcccccucccccc

SEQ ID NO: 894258 - RNA, 20 nt, Human
caccccccccccaaacccua

SEQ ID NO: 894259 - RNA, 20 nt, Human
caccccccccccaaacccua

SEQ ID NO: 894260 - RNA, 24 nt, Human
caccccccccccaaacccuaauuc

SEQ ID NO: 894261 - RNA, 21 nt, Human
cauagauuccccccacccccc

SEQ ID NO: 894262 - RNA, 22 nt, Human
cauagauuccccccaccccccc

SEQ ID NO: 894263 - RNA, 22 nt, Human
ccaaacccuaauucuaccccuc

SEQ ID NO: 894264 - RNA, 22 nt, Human
ccaccccccccccaaacccuaa

SEQ ID NO: 894265 - RNA, 22 nt, Human
ccauagauuccccccacccccc

SEQ ID NO: 894266 - RNA, 21 nt, Human
ccaugguucucaggccaccac

SEQ ID NO: 894267 - RNA, 20 nt, Human
cccacagagcccccuccccc

SEQ ID NO: 894268 - RNA, 22 nt, Human
cccacagagcccccucccccca

SEQ ID NO: 894269 - RNA, 23 nt, Human
cccacagagcccccuccccccau

SEQ ID NO: 894270 - RNA, 19 nt, Human
cccaccccccccccaaacc

SEQ ID NO: 894271 - RNA, 22 nt, Human
ccccaaacccuaauucuacccc

SEQ ID NO: 894272 - RNA, 20 nt, Human
ccccacagagcccccucccc

SEQ ID NO: 894273 - RNA, 21 nt, Human
ccccacagagcccccuccccc

SEQ ID NO: 894274 - RNA, 20 nt, Human
ccccauagauuccccccacc

SEQ ID NO: 894275 - RNA, 22 nt, Human
cccccaccccccccccaaaccc

SEQ ID NO: 894276 - RNA, 25 nt, Human
cccccauagauuccccccacccccc

SEQ ID NO: 894277 - RNA, 20 nt, Human
ccccccaccccccccccaaa

SEQ ID NO: 894278 - RNA, 24 nt, Human
ccccccaccccccccccaaacccu

SEQ ID NO: 894279 - RNA, 23 nt, Human
cccccccccaaacccuaauucua

SEQ ID NO: 894280 - RNA, 18 nt, Human
cccugcacaagcccuccu

SEQ ID NO: 894281 - RNA, 20 nt, Human
cccugggcuccgacccuggg

SEQ ID NO: 894282 - RNA, 24 nt, Human
cccugggcuccgacccugggccuu

SEQ ID NO: 894283 - RNA, 18 nt, Human
cgccgucaccgugcuccg

SEQ ID NO: 894284 - RNA, 24 nt, Human
cuccccccauagauuccccccacc

SEQ ID NO: 894285 - RNA, 20 nt, Human
cugcacaagcccuccugccc

SEQ ID NO: 894286 - RNA, 19 nt, Human
cugggcuccgacccugggc

SEQ ID NO: 894287 - RNA, 25 nt, Human
cuuccggucccccgcugcugccggg

SEQ ID NO: 894288 - RNA, 22 nt, Human
gacaggaagggagaggcccugg

SEQ ID NO: 894289 - RNA, 20 nt, Human
gagaggcccugggcuccgac

SEQ ID NO: 894290 - RNA, 20 nt, Human
gagccuccgcgagccacuuc

SEQ ID NO: 894291 - RNA, 19 nt, Human
gcaccuccucgugccgaau

SEQ ID NO: 894292 - RNA, 21 nt, Human
gcccccuccccccauagauuc

SEQ ID NO: 894293 - RNA, 18 nt, Human
ggccaccacucagaccag

SEQ ID NO: 894294 - RNA, 21 nt, Human
ggugguccaugccaccauggu

SEQ ID NO: 894295 - RNA, 23 nt, Human
uaagagggugacaguucuuccuu

SEQ ID NO: 894296 - RNA, 20 nt, Human
uaaugaaacuagaucacugc

SEQ ID NO: 894297 - RNA, 19 nt, Human
uagaucacugcuuacaaaa

SEQ ID NO: 894298 - RNA, 18 nt, Human
uagauuccccccaccccc

SEQ ID NO: 894299 - RNA, 19 nt, Human
uagauuccccccacccccc

SEQ ID NO: 894300 - RNA, 18 nt, Human
uagcuucugagccuccgc

SEQ ID NO: 894301 - RNA, 19 nt, Human
ucagaccagagugaaaugg

SEQ ID NO: 894302 - RNA, 28 nt, Human
ucccaccccacagagcccccuccccccu

SEQ ID NO: 894303 - RNA, 22 nt, Human
uccccccaccccccccccaaac

SEQ ID NO: 894304 - RNA, 23 nt, Human
uccccccaccccccccccaaacc

SEQ ID NO: 894305 - RNA, 23 nt, Human
uccgggacuagcuucugagccuc

SEQ ID NO: 894306 - RNA, 21 nt, Human
uccugcccauccccuucacag

SEQ ID NO: 894307 - RNA, 19 nt, Human
ucuacugagaugaggccca

SEQ ID NO: 894308 - RNA, 23 nt, Human
ugagaugaggcccagcuuccauc

SEQ ID NO: 894309 - RNA, 21 nt, Human
ugggcuccgacccugggccuu

SEQ ID NO: 894310 - RNA, 18 nt, Human
uggguguggaacagccac

SEQ ID NO: 894311 - RNA, 23 nt, Human
uuaagagggugacaguucuuccu

SEQ ID NO: 894312 - RNA, 19 nt, Human
uuccccccacccccccccc

SEQ ID NO: 894313 - RNA, 20 nt, Human
uuccccccacccccccccca

SEQ ID NO: 894314 - RNA, 25 nt, Human
uuccccccaccccccccccaaaccc

SEQ ID NO: 894315 - RNA, 21 nt, Human
aaaagccaagacaaaaaggug

SEQ ID NO: 894316 - RNA, 23 nt, Human
aaacagcaucagcgaaaaucaga

SEQ ID NO: 894317 - RNA, 21 nt, Human
aaaccacaccaaaacccacag

SEQ ID NO: 894318 - RNA, 20 nt, Human
aaacgagcccuauacaggcc

SEQ ID NO: 894319 - RNA, 21 nt, Human
aaccacaccaaaacccacagc

SEQ ID NO: 894320 - RNA, 18 nt, Human
aaccgaaacagagcucac

SEQ ID NO: 894321 - RNA, 18 nt, Human
aagaaauggcuaaugggu

SEQ ID NO: 894322 - RNA, 21 nt, Human
aagaauucaggaccacaggga

SEQ ID NO: 894323 - RNA, 19 nt, Human
aagcagcccacaagccaaa

SEQ ID NO: 894324 - RNA, 22 nt, Human
aagugagauguauugagcagaa

SEQ ID NO: 894325 - RNA, 22 nt, Human
aauggaaugaaauuguccucaa

SEQ ID NO: 894326 - RNA, 24 nt, Human
acaaccaucacuaccacaaaaauc

SEQ ID NO: 894327 - RNA, 25 nt, Human
acaccaaaacccacagccugcaaca

SEQ ID NO: 894328 - RNA, 19 nt, Human
acagaagccucuucagaaa

SEQ ID NO: 894329 - RNA, 18 nt, Human
acagagcucacuccagag

SEQ ID NO: 894330 - RNA, 21 nt, Human
accacaaaaauccacaaaaca

SEQ ID NO: 894331 - RNA, 24 nt, Human
accacaaaaauccacaaaacagca

SEQ ID NO: 894332 - RNA, 20 nt, Human
accacacugcagggcuccug

SEQ ID NO: 894333 - RNA, 22 nt, Human
acccacagccugcaacaagccc

SEQ ID NO: 894334 - RNA, 19 nt, Human
acuccugccuagccacccc

SEQ ID NO: 894335 - RNA, 19 nt, Human
acucuggggcuugaggcac

SEQ ID NO: 894336 - RNA, 23 nt, Human
acugcagggcuccuguggggagg

SEQ ID NO: 894337 - RNA, 19 nt, Human
acuugcaggcuguaucuug

SEQ ID NO: 894338 - RNA, 23 nt, Human
agacuggaguccguggucaaaug

SEQ ID NO: 894339 - RNA, 24 nt, Human
agagcucacuccagagauccgcac

SEQ ID NO: 894340 - RNA, 19 nt, Human
agaggugacggcagcaagg

SEQ ID NO: 894341 - RNA, 20 nt, Human
agaucaagacuaggacaggg

SEQ ID NO: 894342 - RNA, 22 nt, Human
agcacugacaaccaucacuacc

SEQ ID NO: 894343 - RNA, 20 nt, Human
agcccaaaucucagaggcag

SEQ ID NO: 894344 - RNA, 21 nt, Human
agccggccaccugguuucagu

SEQ ID NO: 894345 - RNA, 19 nt, Human
agcugggugugggcuggcc

SEQ ID NO: 894346 - RNA, 22 nt, Human
aggaaaccaugaacugugccaa

SEQ ID NO: 894347 - RNA, 24 nt, Human
aggaacaaugggaaaagggagggc

SEQ ID NO: 894348 - RNA, 19 nt, Human
aggacagggagccuuucca

SEQ ID NO: 894349 - RNA, 19 nt, Human
aggagguccaagggccucu

SEQ ID NO: 894350 - RNA, 21 nt, Human
aggcacaggccaggggcuggu

SEQ ID NO: 894351 - RNA, 19 nt, Human
agguugguuaaaugcuggu

SEQ ID NO: 894352 - RNA, 20 nt, Human
aguccguggucaaaugcaga

SEQ ID NO: 894353 - RNA, 21 nt, Human
aucacuucuugcuaccacuug

SEQ ID NO: 894354 - RNA, 20 nt, Human
aucccaugagaucugagccu

SEQ ID NO: 894355 - RNA, 18 nt, Human
auggcagcugggaggacu

SEQ ID NO: 894356 - RNA, 26 nt, Human
auuggaccaacaguggugggguucca

SEQ ID NO: 894357 - RNA, 21 nt, Human
caaaaaucagaugagcagcaa

SEQ ID NO: 894358 - RNA, 22 nt, Human
caaaacccacagccugcaacaa

SEQ ID NO: 894359 - RNA, 25 nt, Human
caaaccacaccaaaacccacagccu

SEQ ID NO: 894360 - RNA, 21 nt, Human
caaauaagacagaagccucuu

SEQ ID NO: 894361 - RNA, 25 nt, Human
caaccgaaacagagcucacuccaga

SEQ ID NO: 894362 - RNA, 27 nt, Human
cacagcccaaagaaaagccaagacaaa

SEQ ID NO: 894363 - RNA, 20 nt, Human
cacagcccaauuuugcccgg

SEQ ID NO: 894364 - RNA, 19 nt, Human
caccaaaacccacagccug

SEQ ID NO: 894365 - RNA, 25 nt, Human
caccaaaacccacagccugcaacaa

SEQ ID NO: 894366 - RNA, 25 nt, Human
caccacuugcuucucucuagagcaa

SEQ ID NO: 894367 - RNA, 23 nt, Human
cacgcagcccacgccaucgcaau

SEQ ID NO: 894368 - RNA, 23 nt, Human
cacuaccacaaaaauccacaaaa

SEQ ID NO: 894369 - RNA, 18 nt, Human
cacuuuguccuuugauau

SEQ ID NO: 894370 - RNA, 18 nt, Human
cagaacagaucaagacua

SEQ ID NO: 894371 - RNA, 23 nt, Human
cagaacagaucaagacuaggaca

SEQ ID NO: 894372 - RNA, 31 nt, Human
cagaaggcugccucacagguggguaggcacc

SEQ ID NO: 894373 - RNA, 18 nt, Human
cagagcgggcagcauucc

SEQ ID NO: 894374 - RNA, 19 nt, Human
cagaucaagacuaggacag

SEQ ID NO: 894375 - RNA, 18 nt, Human
cagaucugccucuaauca

SEQ ID NO: 894376 - RNA, 20 nt, Human
cagcaagcagcccacaagcc

SEQ ID NO: 894377 - RNA, 24 nt, Human
cagcaagcagcccacaagccaaac

SEQ ID NO: 894378 - RNA, 21 nt, Human
cagcaaggaaacccgcacacc

SEQ ID NO: 894379 - RNA, 22 nt, Human
cagcaaggaaacccgcacacca

SEQ ID NO: 894380 - RNA, 24 nt, Human
cagcccaaagaaaagccaagacaa

SEQ ID NO: 894381 - RNA, 21 nt, Human
caggccccugaugaaaaucca

SEQ ID NO: 894382 - RNA, 24 nt, Human
cagugcgcaucuugcuaagaacag

SEQ ID NO: 894383 - RNA, 20 nt, Human
caucacuaccacaaaaaucc

SEQ ID NO: 894384 - RNA, 20 nt, Human
cauggcaccugccugccagc

SEQ ID NO: 894385 - RNA, 18 nt, Human
ccacaaaaauccacaaaa

SEQ ID NO: 894386 - RNA, 24 nt, Human
ccacaccaaaacccacagccugca

SEQ ID NO: 894387 - RNA, 20 nt, Human
ccagauccucuuuuucccca

SEQ ID NO: 894388 - RNA, 21 nt, Human
ccaggccaucagaaggcugcc

SEQ ID NO: 894389 - RNA, 21 nt, Human
ccaucacuaccacaaaaaucc

SEQ ID NO: 894390 - RNA, 21 nt, Human
cccacagcccaaagaaaagcc

SEQ ID NO: 894391 - RNA, 18 nt, Human
ccccaagguaggaaagac

SEQ ID NO: 894392 - RNA, 21 nt, Human
ccccacgccacuccugccuag

SEQ ID NO: 894393 - RNA, 24 nt, Human
ccccccacagcccaaagaaaagcc

SEQ ID NO: 894394 - RNA, 22 nt, Human
ccccugccucuccgacuccccu

SEQ ID NO: 894395 - RNA, 20 nt, Human
cccuauacaggccucgaucc

SEQ ID NO: 894396 - RNA, 23 nt, Human
cccugacccccgggauggugcuc

SEQ ID NO: 894397 - RNA, 19 nt, Human
cccugcacaccugggcaga

SEQ ID NO: 894398 - RNA, 23 nt, Human
cccugcccagggucagccccagc

SEQ ID NO: 894399 - RNA, 21 nt, Human
ccggucacuuggcugaacacc

SEQ ID NO: 894400 - RNA, 18 nt, Human
ccgguucaguucugcucc

SEQ ID NO: 894401 - RNA, 19 nt, Human
ccuacacacagacuggagu

SEQ ID NO: 894402 - RNA, 20 nt, Human
ccucacagguggguaggcac

SEQ ID NO: 894403 - RNA, 21 nt, Human
ccucuucagaaauaggcaugu

SEQ ID NO: 894404 - RNA, 22 nt, Human
ccugcccagggucagccccagc

SEQ ID NO: 894405 - RNA, 23 nt, Human
ccuguuccaucuucccuuccuuc

SEQ ID NO: 894406 - RNA, 19 nt, Human
ccuuaguggaguugcuggc

SEQ ID NO: 894407 - RNA, 25 nt, Human
ccuuccaacagcaguugcucgagga

SEQ ID NO: 894408 - RNA, 24 nt, Human
cgcacaccacacgucaugcuaccu

SEQ ID NO: 894409 - RNA, 23 nt, Human
cgcacagcccaaaucucagaggc

SEQ ID NO: 894410 - RNA, 24 nt, Human
cgucagucacgauugcuggggccu

SEQ ID NO: 894411 - RNA, 27 nt, Human
cuaaggcuucauuccuguaacgucucg

SEQ ID NO: 894412 - RNA, 21 nt, Human
cuaccuccuucccaccacuug

SEQ ID NO: 894413 - RNA, 20 nt, Human
cucagaggcagcucaagcuc

SEQ ID NO: 894414 - RNA, 21 nt, Human
cucaguuucuuggagucaagg

SEQ ID NO: 894415 - RNA, 23 nt, Human
cucccccgucccuguucccagac

SEQ ID NO: 894416 - RNA, 22 nt, Human
cuccccuaggcuucugagagcc

SEQ ID NO: 894417 - RNA, 21 nt, Human
cuccuucccaccacuugcuuc

SEQ ID NO: 894418 - RNA, 22 nt, Human
cugaagccucaggccuccccug

SEQ ID NO: 894419 - RNA, 23 nt, Human
cugacccccgggauggugcucuc

SEQ ID NO: 894420 - RNA, 19 nt, Human
cugcacaccugggcagagu

SEQ ID NO: 894421 - RNA, 22 nt, Human
cugcagggcuccuguggggagg

SEQ ID NO: 894422 - RNA, 18 nt, Human
cuggcuaaggcuucauuc

SEQ ID NO: 894423 - RNA, 21 nt, Human
cuggguggcagaggguggggg

SEQ ID NO: 894424 - RNA, 21 nt, Human
cuucucaaagccagucauccc

SEQ ID NO: 894425 - RNA, 23 nt, Human
gaaacagagcucacuccagagau

SEQ ID NO: 894426 - RNA, 21 nt, Human
gaaggcacaggccaggggcug

SEQ ID NO: 894427 - RNA, 23 nt, Human
gacaaaaaggugaagcucccccg

SEQ ID NO: 894428 - RNA, 22 nt, Human
gacaaccaucacuaccacaaaa

SEQ ID NO: 894429 - RNA, 19 nt, Human
gacagcaguuagacaggag

SEQ ID NO: 894430 - RNA, 24 nt, Human
gagacagccauggcgcuaccacac

SEQ ID NO: 894431 - RNA, 24 nt, Human
gagaugcuggggccuuugccagga

SEQ ID NO: 894432 - RNA, 18 nt, Human
gagauguauugagcagaa

SEQ ID NO: 894433 - RNA, 20 nt, Human
gagcaaaaauuacauccaag

SEQ ID NO: 894434 - RNA, 21 nt, Human
gagcaggccaaggggauggaa

SEQ ID NO: 894435 - RNA, 24 nt, Human
gagccuguuccaucuucccuuccu

SEQ ID NO: 894436 - RNA, 18 nt, Human
gaggugacggcagcaagg

SEQ ID NO: 894437 - RNA, 23 nt, Human
gcaacaagccccugcuggccugu

SEQ ID NO: 894438 - RNA, 24 nt, Human
gcagaguucucaccgcaacauaaa

SEQ ID NO: 894439 - RNA, 18 nt, Human
gcagcugggaggacuggg

SEQ ID NO: 894440 - RNA, 20 nt, Human
gcagcugggaggacugggug

SEQ ID NO: 894441 - RNA, 24 nt, Human
gccaggggcugguggcugaagggg

SEQ ID NO: 894442 - RNA, 20 nt, Human
gcccaaaucucagaggcagc

SEQ ID NO: 894443 - RNA, 20 nt, Human
gccuucauuuugcagcagag

SEQ ID NO: 894444 - RNA, 23 nt, Human
gcugauucagaaggggagcugga

SEQ ID NO: 894445 - RNA, 23 nt, Human
ggaccaacaguggugggguucca

SEQ ID NO: 894446 - RNA, 19 nt, Human
ggagggcccugcaggcccc

SEQ ID NO: 894447 - RNA, 21 nt, Human
ggaugcccccccacagcccuu

SEQ ID NO: 894448 - RNA, 22 nt, Human
ggccuuccaacagcaguugcuc

SEQ ID NO: 894449 - RNA, 20 nt, Human
ggcugguggcugaagggguc

SEQ ID NO: 894450 - RNA, 20 nt, Human
ggcugguggcugaagggguc

SEQ ID NO: 894451 - RNA, 24 nt, Human
ggcugguggcugaaggggucuggg

SEQ ID NO: 894452 - RNA, 24 nt, Human
gggagcuggaugagguucuccaga

SEQ ID NO: 894453 - RNA, 20 nt, Human
gggaggacuggguggcagag

SEQ ID NO: 894454 - RNA, 19 nt, Human
gggcacuuuguccuuugau

SEQ ID NO: 894455 - RNA, 24 nt, Human
ggggccucaccguuuccauuccau

SEQ ID NO: 894456 - RNA, 18 nt, Human
ggucuccaaaggucccug

SEQ ID NO: 894457 - RNA, 19 nt, Human
gguggcagagggugggggc

SEQ ID NO: 894458 - RNA, 20 nt, Human
ggugugggcuggccuucaaa

SEQ ID NO: 894459 - RNA, 23 nt, Human
gguuuuggaaacucugcagaauu

SEQ ID NO: 894460 - RNA, 20 nt, Human
guggaaaagcaaaaucucac

SEQ ID NO: 894461 - RNA, 19 nt, Human
uaaaacugaagccucaggc

SEQ ID NO: 894462 - RNA, 23 nt, Human
uaaaacugaagccucaggccucc

SEQ ID NO: 894463 - RNA, 20 nt, Human
uaaaguagcugggugugggc

SEQ ID NO: 894464 - RNA, 18 nt, Human
uaacuggaaaacacggag

SEQ ID NO: 894465 - RNA, 21 nt, Human
uaccacaaaaauccacaaaac

SEQ ID NO: 894466 - RNA, 20 nt, Human
uaccacacugcagggcuccc

SEQ ID NO: 894467 - RNA, 21 nt, Human
uacguuuugggaaacuggcag

SEQ ID NO: 894468 - RNA, 22 nt, Human
uagccucugacaaaccacacca

SEQ ID NO: 894469 - RNA, 21 nt, Human
uauauauaauauauauauaua

SEQ ID NO: 894470 - RNA, 23 nt, Human
uauauauauaauauauauauaua

SEQ ID NO: 894471 - RNA, 18 nt, Human
ucagaaauaggcaugugu

SEQ ID NO: 894472 - RNA, 24 nt, Human
ucagaaggggagcuggaugagguu

SEQ ID NO: 894473 - RNA, 24 nt, Human
ucagaggcagcucaagcugggacc

SEQ ID NO: 894474 - RNA, 22 nt, Human
ucagaugagcagcaagcagccc

SEQ ID NO: 894475 - RNA, 27 nt, Human
ucaguggcuuuauccagaaucgcacug

SEQ ID NO: 894476 - RNA, 23 nt, Human
uccagagauccgcacagcccaaa

SEQ ID NO: 894477 - RNA, 23 nt, Human
uccagguucccccaagguaggaa

SEQ ID NO: 894478 - RNA, 21 nt, Human
uccaugaccugggucaaccga

SEQ ID NO: 894479 - RNA, 24 nt, Human
uccaugaccugggucaaccgaaac

SEQ ID NO: 894480 - RNA, 20 nt, Human
uccaugcaguuguccaagga

SEQ ID NO: 894481 - RNA, 20 nt, Human
ucccacggguggcacggccc

SEQ ID NO: 894482 - RNA, 19 nt, Human
ucccaugagaucugagccu

SEQ ID NO: 894483 - RNA, 19 nt, Human
uccccaugauaagccaagg

SEQ ID NO: 894484 - RNA, 20 nt, Human
ucccccgucccuguucccag

SEQ ID NO: 894485 - RNA, 23 nt, Human
ucccuugaucacggcugcaugag

SEQ ID NO: 894486 - RNA, 26 nt, Human
uccgcacagcccaaaucucagaggca

SEQ ID NO: 894487 - RNA, 23 nt, Human
ucucaccgcaacauaaagcagag

SEQ ID NO: 894488 - RNA, 23 nt, Human
ucucucccuacacacagacugga

SEQ ID NO: 894489 - RNA, 23 nt, Human
ucugccacuguccucggguccuc

SEQ ID NO: 894490 - RNA, 24 nt, Human
ugaaauuguccucaacagccuccg

SEQ ID NO: 894491 - RNA, 19 nt, Human
ugacaaaccacaccaaaac

SEQ ID NO: 894492 - RNA, 18 nt, Human
ugacaaccaucacuacca

SEQ ID NO: 894493 - RNA, 18 nt, Human
ugagagccagcaaguagg

SEQ ID NO: 894494 - RNA, 19 nt, Human
ugagagccagcaaguaggg

SEQ ID NO: 894495 - RNA, 19 nt, Human
ugagauguauugagcagaa

SEQ ID NO: 894496 - RNA, 21 nt, Human
ugagcagcaagcagcccacaa

SEQ ID NO: 894497 - RNA, 18 nt, Human
ugagccuggccuccuggc

SEQ ID NO: 894498 - RNA, 21 nt, Human
ugagccuguuccaucuucccu

SEQ ID NO: 894499 - RNA, 24 nt, Human
ugaguggcacagggcugagccugg

SEQ ID NO: 894500 - RNA, 22 nt, Human
ugcaacuguugucuguggggcu

SEQ ID NO: 894501 - RNA, 21 nt, Human
ugcagaauuagccucugacaa

SEQ ID NO: 894502 - RNA, 19 nt, Human
ugccaggagaucuguuucu

SEQ ID NO: 894503 - RNA, 20 nt, Human
ugccuagccaccccagggac

SEQ ID NO: 894504 - RNA, 22 nt, Human
uggaaaacacggagaccagaga

SEQ ID NO: 894505 - RNA, 20 nt, Human
uggaacaugaaagauauuua

SEQ ID NO: 894506 - RNA, 19 nt, Human
uggcagagggugggggcca

SEQ ID NO: 894507 - RNA, 20 nt, Human
uggcagcugggaggacuggg

SEQ ID NO: 894508 - RNA, 22 nt, Human
uggcugaaggggucuggguauu

SEQ ID NO: 894509 - RNA, 21 nt, Human
ugggacaaaaaucagaugagc

SEQ ID NO: 894510 - RNA, 27 nt, Human
ugggaggacuggguggcagaggguggg

SEQ ID NO: 894511 - RNA, 22 nt, Human
ugggguuccauuuccugguucg

SEQ ID NO: 894512 - RNA, 19 nt, Human
uggguaggcacugacggga

SEQ ID NO: 894513 - RNA, 19 nt, Human
ugguggcugaaggggucug

SEQ ID NO: 894514 - RNA, 22 nt, Human
ugguuaaaugcuggucgucuuu

SEQ ID NO: 894515 - RNA, 22 nt, Human
ugguucgaauuuucaguggcuu

SEQ ID NO: 894516 - RNA, 23 nt, Human
ugguuuuggaaacucugcagaau

SEQ ID NO: 894517 - RNA, 22 nt, Human
ugugaaaauuggaccaacagug

SEQ ID NO: 894518 - RNA, 22 nt, Human
uuaaaguagcugggugugggcu

SEQ ID NO: 894519 - RNA, 18 nt, Human
uuaauggaaugaaauugu

SEQ ID NO: 894520 - RNA, 20 nt, Human
uucccuuccuucucaaagcc

SEQ ID NO: 894521 - RNA, 18 nt, Human
uucccuugaucacggcug

SEQ ID NO: 894522 - RNA, 24 nt, Human
uucuccuagagugcagcuccaugc

SEQ ID NO: 894523 - RNA, 19 nt, Human
uugaguugcgagagcagcc

SEQ ID NO: 894524 - RNA, 24 nt, Human
uugcuggggccugcaauuugcagc

SEQ ID NO: 894525 - RNA, 19 nt, Human
uuggccccacgccacuccu

SEQ ID NO: 894526 - RNA, 20 nt, Human
aaacuaucaaugcccugaua

SEQ ID NO: 894527 - RNA, 24 nt, Human
aaagugcugggauuacaggcguga

SEQ ID NO: 894528 - RNA, 18 nt, Human
aacauucuagcuagaaac

SEQ ID NO: 894529 - RNA, 22 nt, Human
aagcaauccacugaccugguaa

SEQ ID NO: 894530 - RNA, 20 nt, Human
aagcagcugggacuacaggc

SEQ ID NO: 894531 - RNA, 24 nt, Human
aagcagcugggacuacaggcacac

SEQ ID NO: 894532 - RNA, 19 nt, Human
aagugcugggauuacaggc

SEQ ID NO: 894533 - RNA, 19 nt, Human
aagugcugggauuacaggc

SEQ ID NO: 894534 - RNA, 26 nt, Human
aagugcugggauuacaggcgugagcc

SEQ ID NO: 894535 - RNA, 26 nt, Human
acaggcucuuucuuuuuuuuuuuuuu

SEQ ID NO: 894536 - RNA, 18 nt, Human
acaguuuuuuauuuccuu

SEQ ID NO: 894537 - RNA, 19 nt, Human
acccaggcuggagugcagu

SEQ ID NO: 894538 - RNA, 24 nt, Human
accucaugaucugcccaccuuggc

SEQ ID NO: 894539 - RNA, 24 nt, Human
acgcucugucacccaggcuggagu

SEQ ID NO: 894540 - RNA, 18 nt, Human
acuauguuggccagaaug

SEQ ID NO: 894541 - RNA, 24 nt, Human
acuauguuggccagaauggucucg

SEQ ID NO: 894542 - RNA, 23 nt, Human
agaaaaacagucccuuuucuaag

SEQ ID NO: 894543 - RNA, 21 nt, Human
agaaguguugauuccauaaau

SEQ ID NO: 894544 - RNA, 26 nt, Human
agagacaggcaaaaauuugaaaauua

SEQ ID NO: 894545 - RNA, 23 nt, Human
agagagcacagugagugcuugca

SEQ ID NO: 894546 - RNA, 24 nt, Human
agcgauucuccugccucagccucc

SEQ ID NO: 894547 - RNA, 25 nt, Human
aggcuggagugcaguggcucgaucu

SEQ ID NO: 894548 - RNA, 20 nt, Human
agugcaguggcucgaucucg

SEQ ID NO: 894549 - RNA, 24 nt, Human
agugcaguggcucgaucucggcuc

SEQ ID NO: 894550 - RNA, 18 nt, Human
agugcugggauuacaggc

SEQ ID NO: 894551 - RNA, 20 nt, Human
augugcaauuuugcauaagu

SEQ ID NO: 894552 - RNA, 24 nt, Human
auuuuuguauuuuuaguagagaug

SEQ ID NO: 894553 - RNA, 24 nt, Human
caaagugcugggauuacaggcgug

SEQ ID NO: 894554 - RNA, 23 nt, Human
caaaugucacauguggacuuuug

SEQ ID NO: 894555 - RNA, 22 nt, Human
caagcgauucuccugccucagc

SEQ ID NO: 894556 - RNA, 27 nt, Human
caagcgauucuccugccucagccuccc

SEQ ID NO: 894557 - RNA, 28 nt, Human
cacacaauagcaaagauuuucuuacaug

SEQ ID NO: 894558 - RNA, 24 nt, Human
caccacgcccggcuaauuuuugua

SEQ ID NO: 894559 - RNA, 24 nt, Human
cacgccaccacgcccggcuaauuu

SEQ ID NO: 894560 - RNA, 24 nt, Human
cacuauguuggccagaauggucuc

SEQ ID NO: 894561 - RNA, 19 nt, Human
cagcauagaggaguaugug

SEQ ID NO: 894562 - RNA, 23 nt, Human
cagccucccaagcagcugggacu

SEQ ID NO: 894563 - RNA, 21 nt, Human
cagguucaagcgauucuccug

SEQ ID NO: 894564 - RNA, 21 nt, Human
caucccucccacaaauagguc

SEQ ID NO: 894565 - RNA, 21 nt, Human
caugaucugcccaccuuggcc

SEQ ID NO: 894566 - RNA, 22 nt, Human
ccaaagugcugggauuacaggc

SEQ ID NO: 894567 - RNA, 22 nt, Human
ccaaagugcugggauuacaggc

SEQ ID NO: 894568 - RNA, 24 nt, Human
ccaaagugcugggauuacaggcgu

SEQ ID NO: 894569 - RNA, 24 nt, Human
cccaagcagcugggacuacaggca

SEQ ID NO: 894570 - RNA, 18 nt, Human
cccacaaauaggucaaca

SEQ ID NO: 894571 - RNA, 24 nt, Human
ccucucagguucaagcgauucucc

SEQ ID NO: 894572 - RNA, 24 nt, Human
ccugccucagccucccaagcagcu

SEQ ID NO: 894573 - RNA, 19 nt, Human
cggugcucggggccgggcc

SEQ ID NO: 894574 - RNA, 21 nt, Human
cgugagccaccacgcccggcc

SEQ ID NO: 894575 - RNA, 23 nt, Human
cuccacacaauagcaaagauuuu

SEQ ID NO: 894576 - RNA, 20 nt, Human
cuccugaccucaugaucugc

SEQ ID NO: 894577 - RNA, 20 nt, Human
cucugucacccaggcuggag

SEQ ID NO: 894578 - RNA, 24 nt, Human
cugcacuuaaacaaccaccaccug

SEQ ID NO: 894579 - RNA, 18 nt, Human
cuuuuuuuuuuuuuuuug

SEQ ID NO: 894580 - RNA, 20 nt, Human
gagaugggguuucacuaugu

SEQ ID NO: 894581 - RNA, 24 nt, Human
gagaugggguuucacuauguuggc

SEQ ID NO: 894582 - RNA, 18 nt, Human
gauuacaggcgugagcca

SEQ ID NO: 894583 - RNA, 21 nt, Human
gauuacaggcgugagccacca

SEQ ID NO: 894584 - RNA, 22 nt, Human
gauuacaggcgugagccaccac

SEQ ID NO: 894585 - RNA, 21 nt, Human
gcaaccucaccucucagguuc

SEQ ID NO: 894586 - RNA, 22 nt, Human
gcaauuucucuccacacaauag

SEQ ID NO: 894587 - RNA, 22 nt, Human
gcccggcuaauuuuuguauuuu

SEQ ID NO: 894588 - RNA, 24 nt, Human
gcgauucuccugccucagccuccc

SEQ ID NO: 894589 - RNA, 25 nt, Human
gcucugucacccaggcuggagugca

SEQ ID NO: 894590 - RNA, 25 nt, Human
gcuggagugcaguggcucgaucucg

SEQ ID NO: 894591 - RNA, 19 nt, Human
ggauuacaggcgugagcca

SEQ ID NO: 894592 - RNA, 25 nt, Human
ggcucuuucuuuuuuuuuuuuuuuu

SEQ ID NO: 894593 - RNA, 19 nt, Human
ggcuggagugcaguggcuc

SEQ ID NO: 894594 - RNA, 22 nt, Human
gggguuucacuauguuggccag

SEQ ID NO: 894595 - RNA, 18 nt, Human
ggguuucacuauguuggc

SEQ ID NO: 894596 - RNA, 21 nt, Human
guaaagaucaaaguacaaacu

SEQ ID NO: 894597 - RNA, 19 nt, Human
gugcucuuuguagccuuuc

SEQ ID NO: 894598 - RNA, 24 nt, Human
uaaaaacauucaaacuaucaaugc

SEQ ID NO: 894599 - RNA, 21 nt, Human
uaagaaacagaaaugcagcaa

SEQ ID NO: 894600 - RNA, 24 nt, Human
uaauuuuuguauuuuuaguagaga

SEQ ID NO: 894601 - RNA, 23 nt, Human
uacaggcacacgccaccacgccc

SEQ ID NO: 894602 - RNA, 23 nt, Human
uacaggcgugagccaccacgccc

SEQ ID NO: 894603 - RNA, 19 nt, Human
uaccauguaaggugauacc

SEQ ID NO: 894604 - RNA, 22 nt, Human
uagagaugggguuucacuaugu

SEQ ID NO: 894605 - RNA, 25 nt, Human
uagcacgaauaaguuccaccaggca

SEQ ID NO: 894606 - RNA, 23 nt, Human
uaguagagaugggguuucacuau

SEQ ID NO: 894607 - RNA, 24 nt, Human
uaguagagaugggguuucacuaug

SEQ ID NO: 894608 - RNA, 26 nt, Human
uauucuucuuuggaauggcaguucca

SEQ ID NO: 894609 - RNA, 21 nt, Human
ucaaugcccugauagcacgaa

SEQ ID NO: 894610 - RNA, 24 nt, Human
ucacccaggcuggagugcaguggc

SEQ ID NO: 894611 - RNA, 23 nt, Human
ucacgcucugucacccaggcugg

SEQ ID NO: 894612 - RNA, 24 nt, Human
ucacgcucugucacccaggcugga

SEQ ID NO: 894613 - RNA, 18 nt, Human
ucacugcaaccucaccuc

SEQ ID NO: 894614 - RNA, 23 nt, Human
ucacugcaaccucaccucucagg

SEQ ID NO: 894615 - RNA, 20 nt, Human
ucagccucccaagcagcugg

SEQ ID NO: 894616 - RNA, 19 nt, Human
uccacacaauagcaaagau

SEQ ID NO: 894617 - RNA, 24 nt, Human
ucccaaagugcugggauuacaggc

SEQ ID NO: 894618 - RNA, 24 nt, Human
ucccaagcagcugggacuacaggc

SEQ ID NO: 894619 - RNA, 22 nt, Human
ucccacaaauaggucaacagua

SEQ ID NO: 894620 - RNA, 19 nt, Human
ucccuuuucuaagggugaa

SEQ ID NO: 894621 - RNA, 21 nt, Human
ucucagguucaagcgauucuc

SEQ ID NO: 894622 - RNA, 24 nt, Human
ucucagguucaagcgauucuccug

SEQ ID NO: 894623 - RNA, 21 nt, Human
ucuccacacaauagcaaagau

SEQ ID NO: 894624 - RNA, 23 nt, Human
ucuccugccucagccucccaagc

SEQ ID NO: 894625 - RNA, 24 nt, Human
ucugucacccaggcuggagugcag

SEQ ID NO: 894626 - RNA, 21 nt, Human
ugaauacuuauuuacaaauaa

SEQ ID NO: 894627 - RNA, 18 nt, Human
ugacucuguaacuucuac

SEQ ID NO: 894628 - RNA, 24 nt, Human
ugagacggagucucacgcucuguc

SEQ ID NO: 894629 - RNA, 20 nt, Human
ugauagcacgaauaaguucc

SEQ ID NO: 894630 - RNA, 24 nt, Human
ugaucugcccaccuuggccuccca

SEQ ID NO: 894631 - RNA, 22 nt, Human
ugcacuuaaacaaccaccaccu

SEQ ID NO: 894632 - RNA, 22 nt, Human
ugcaguggcucgaucucggcuc

SEQ ID NO: 894633 - RNA, 24 nt, Human
ugccucagccucccaagcagcugg

SEQ ID NO: 894634 - RNA, 24 nt, Human
ugcugggauuacaggcgugagcca

SEQ ID NO: 894635 - RNA, 23 nt, Human
ugcuuauggagaaauacauguac

SEQ ID NO: 894636 - RNA, 19 nt, Human
uggagugcaguggcucgau

SEQ ID NO: 894637 - RNA, 23 nt, Human
uggagugcaguggcucgaucucg

SEQ ID NO: 894638 - RNA, 24 nt, Human
uggagugcaguggcucgaucucgg

SEQ ID NO: 894639 - RNA, 21 nt, Human
ugggacuacaggcacacgcca

SEQ ID NO: 894640 - RNA, 22 nt, Human
ugggacuacaggcacacgccac

SEQ ID NO: 894641 - RNA, 24 nt, Human
ugggacuacaggcacacgccacca

SEQ ID NO: 894642 - RNA, 18 nt, Human
ugggauuacaggcgugag

SEQ ID NO: 894643 - RNA, 19 nt, Human
ugggauuacaggcgugagc

SEQ ID NO: 894644 - RNA, 22 nt, Human
ugggauuacaggcgugagccac

SEQ ID NO: 894645 - RNA, 23 nt, Human
ugggauuacaggcgugagccacc

SEQ ID NO: 894646 - RNA, 24 nt, Human
ugggauuacaggcgugagccacca

SEQ ID NO: 894647 - RNA, 23 nt, Human
ugggguuucacuauguuggccag

SEQ ID NO: 894648 - RNA, 19 nt, Human
ugguaaagaucaaaguaca

SEQ ID NO: 894649 - RNA, 21 nt, Human
uggucucgaucuccugaccuc

SEQ ID NO: 894650 - RNA, 21 nt, Human
uguauuuuuaguagagauggg

SEQ ID NO: 894651 - RNA, 21 nt, Human
uguucuguuacauggacaaau

SEQ ID NO: 894652 - RNA, 18 nt, Human
uuaguagagaugggguuu

SEQ ID NO: 894653 - RNA, 21 nt, Human
uuaguagagaugggguuucac

SEQ ID NO: 894654 - RNA, 21 nt, Human
uuaguagagaugggguuucac

SEQ ID NO: 894655 - RNA, 24 nt, Human
uuaguagagaugggguuucacuau

SEQ ID NO: 894656 - RNA, 23 nt, Human
uuaguccauagaaaaacaguccc

SEQ ID NO: 894657 - RNA, 21 nt, Human
uucaagcgauucuccugccuc

SEQ ID NO: 894658 - RNA, 23 nt, Human
uucaagcgauucuccugccucag

SEQ ID NO: 894659 - RNA, 24 nt, Human
uucaagcgauucuccugccucagc

SEQ ID NO: 894660 - RNA, 21 nt, Human
uucuuuggaauggcaguucca

SEQ ID NO: 894661 - RNA, 18 nt, Human
uuggccucccaaagugcu

SEQ ID NO: 894662 - RNA, 18 nt, Human
uuuacaguuuuuuauuuc

SEQ ID NO: 894663 - RNA, 19 nt, Human
uuucacuauguuggccaga

SEQ ID NO: 894664 - RNA, 21 nt, Human
uuuguagccuuucaucccucc

SEQ ID NO: 894665 - RNA, 24 nt, Human
uuuuuaguagagaugggguuucac

SEQ ID NO: 894666 - RNA, 20 nt, Human
uuuuuguauuuuuaguagag

SEQ ID NO: 894667 - RNA, 26 nt, Human
uuuuuuuuuuuugagacggagucuca

SEQ ID NO: 894668 - RNA, 22 nt, Human
uuuuuuuuuuuuuugagacgga

SEQ ID NO: 894669 - RNA, 20 nt, Human
accuggugcccugcugcgcc

SEQ ID NO: 894670 - RNA, 19 nt, Human
agaagaaaacaaaauguca

SEQ ID NO: 894671 - RNA, 23 nt, Human
cagaagaaaacaaaaugucagua

SEQ ID NO: 894672 - RNA, 20 nt, Human
ggcugcgggaggcucggugc

SEQ ID NO: 894673 - RNA, 22 nt, Human
uagggacgcugcgcugcgccac

SEQ ID NO: 894674 - RNA, 19 nt, Human
ucaacagaguacauuuagc

SEQ ID NO: 894675 - RNA, 20 nt, Human
ugcccugcugcgccucgggg

SEQ ID NO: 894676 - RNA, 19 nt, Human
uggugcccugcugcgccuc

SEQ ID NO: 894677 - RNA, 20 nt, Human
uuacaacugagaacauugac

SEQ ID NO: 894678 - RNA, 22 nt, Human
uuuucaacagaguacauuuagc

SEQ ID NO: 894679 - RNA, 19 nt, Human
aaaaaaaaaaaaaagaaaa

SEQ ID NO: 894680 - RNA, 20 nt, Human
aaaaaaaaaaaaacuagcaa

SEQ ID NO: 894681 - RNA, 21 nt, Human
aaaaaaaaaaaaacuagcaau

SEQ ID NO: 894682 - RNA, 22 nt, Human
aaaaaaaaaaaaagaaaaaagg

SEQ ID NO: 894683 - RNA, 23 nt, Human
aaaaaaaaaaaaagaaaaaagga

SEQ ID NO: 894684 - RNA, 31 nt, Human
aaaaaaaaaaaagaaaaaaggaaaacaaaag

SEQ ID NO: 894685 - RNA, 31 nt, Human
aaaaaaaaaagaaaaaaggaaaacaaaaaag

SEQ ID NO: 894686 - RNA, 25 nt, Human
aaaaaagagaaagcagucacgaaag

SEQ ID NO: 894687 - RNA, 21 nt, Human
aaaaagaaaaaaggaaaacaa

SEQ ID NO: 894688 - RNA, 23 nt, Human
aaaaaggaaaacaaaaaagagaa

SEQ ID NO: 894689 - RNA, 24 nt, Human
aaaaaggaaaacaaaaaagagaaa

SEQ ID NO: 894690 - RNA, 22 nt, Human
aaaagaaaaaaggaaaacaaaa

SEQ ID NO: 894691 - RNA, 21 nt, Human
aaagagaaagcagucacgaaa

SEQ ID NO: 894692 - RNA, 18 nt, Human
aaccauuuccauuaaugg

SEQ ID NO: 894693 - RNA, 21 nt, Human
aagaaaaaaggaaaacaaaaa

SEQ ID NO: 894694 - RNA, 19 nt, Human
aagagaaagcagucacgaa

SEQ ID NO: 894695 - RNA, 19 nt, Human
aagcagucacgaaagucac

SEQ ID NO: 894696 - RNA, 19 nt, Human
accagaucuaacucucagu

SEQ ID NO: 894697 - RNA, 23 nt, Human
acugcugccaagggacacugaug

SEQ ID NO: 894698 - RNA, 24 nt, Human
agaaaaaaggaaaacaaaaaagag

SEQ ID NO: 894699 - RNA, 22 nt, Human
agaaagcagucacgaaagucac

SEQ ID NO: 894700 - RNA, 19 nt, Human
aggaaaaaaaaaaaaaaag

SEQ ID NO: 894701 - RNA, 23 nt, Human
aggaaaacaaaaaagagaaagca

SEQ ID NO: 894702 - RNA, 19 nt, Human
agggacacugauguuggcu

SEQ ID NO: 894703 - RNA, 18 nt, Human
agugacagccugacucgg

SEQ ID NO: 894704 - RNA, 18 nt, Human
augacucaggacgaacca

SEQ ID NO: 894705 - RNA, 26 nt, Human
cagcacaauaaaacaaguuaugccuu

SEQ ID NO: 894706 - RNA, 26 nt, Human
cagcauugccacaaacuuucaauuuu

SEQ ID NO: 894707 - RNA, 21 nt, Human
caggaaaaaaaaaaaaaaaga

SEQ ID NO: 894708 - RNA, 18 nt, Human
caugccuuugggaagaaa

SEQ ID NO: 894709 - RNA, 19 nt, Human
cauugccacaaacuuucaa

SEQ ID NO: 894710 - RNA, 20 nt, Human
ccacaaacuuucaauuuuuu

SEQ ID NO: 894711 - RNA, 24 nt, Human
ccaggaaaaaaaaaaaaaaagaaa

SEQ ID NO: 894712 - RNA, 23 nt, Human
ccuuuccagucacguucuuggca

SEQ ID NO: 894713 - RNA, 23 nt, Human
gaaagucacaggcuucguaagga

SEQ ID NO: 894714 - RNA, 19 nt, Human
uaaaaaucaggcagucuug

SEQ ID NO: 894715 - RNA, 22 nt, Human
uaaaauccaaggccugagccuc

SEQ ID NO: 894716 - RNA, 18 nt, Human
uccuucuguggcucacag

SEQ ID NO: 894717 - RNA, 20 nt, Human
ucuguuucaagcugagccag

SEQ ID NO: 894718 - RNA, 22 nt, Human
ugacucaggacgaaccauuucc

SEQ ID NO: 894719 - RNA, 24 nt, Human
ugacucggaacguagaugacucag

SEQ ID NO: 894720 - RNA, 27 nt, Human
ugagaagcacaauaaaauucagcacaa

SEQ ID NO: 894721 - RNA, 18 nt, Human
ugagaaggcauacauuau

SEQ ID NO: 894722 - RNA, 27 nt, Human
ugagccaggaaaaaaaaaaaaaaagaa

SEQ ID NO: 894723 - RNA, 18 nt, Human
ugccaagggacacugaug

SEQ ID NO: 894724 - RNA, 22 nt, Human
uggaaagauaacuaaaaaucag

SEQ ID NO: 894725 - RNA, 20 nt, Human
uggaaagauaacuaaaaauu

SEQ ID NO: 894726 - RNA, 22 nt, Human
ugggagagagugagugcggacg

SEQ ID NO: 894727 - RNA, 23 nt, Human
ugggauguuccucucugaaguuu

SEQ ID NO: 894728 - RNA, 20 nt, Human
uguuggcuucucacaucaua

SEQ ID NO: 894729 - RNA, 21 nt, Human
uucguaaggaaggcugggaga

SEQ ID NO: 894730 - RNA, 22 nt, Human
aacacaaaaaauaugcacagaa

SEQ ID NO: 894731 - RNA, 18 nt, Human
acagauguacaucaccau

SEQ ID NO: 894732 - RNA, 18 nt, Human
gcauuauuagcuaacagc

SEQ ID NO: 894733 - RNA, 23 nt, Human
uagcuaacagcuugauccuuaau

SEQ ID NO: 894734 - RNA, 19 nt, Human
uauuugccuguucccaaaa

SEQ ID NO: 894735 - RNA, 22 nt, Human
ucagucuucauuuucuccaaga

SEQ ID NO: 894736 - RNA, 19 nt, Human
uccaagagcuuugcuacag

SEQ ID NO: 894737 - RNA, 19 nt, Human
ucucuauacaguuuuugcu

SEQ ID NO: 894738 - RNA, 23 nt, Human
ugcacagaaagacauuuagaauu

SEQ ID NO: 894739 - RNA, 22 nt, Human
ugcagagguggcauuauuagcu

SEQ ID NO: 894740 - RNA, 22 nt, Human
ugcuuugcuuucuucagucuuc

SEQ ID NO: 894741 - RNA, 23 nt, Human
ugcuuugcuuucuucagucuuca

SEQ ID NO: 894742 - RNA, 19 nt, Human
uuacugcuuuugaaaaauc

SEQ ID NO: 894743 - RNA, 24 nt, Human
uugcuuugcuuucuucagucuuca

SEQ ID NO: 894744 - RNA, 21 nt, Human
uuugccuguucccaaaacugc

SEQ ID NO: 894745 - RNA, 18 nt, Human
aaaacgccaccgacgcga

SEQ ID NO: 894746 - RNA, 23 nt, Human
aauuuuuauucuguugucaaggg

SEQ ID NO: 894747 - RNA, 24 nt, Human
agugccaaggagcuaaagggccca

SEQ ID NO: 894748 - RNA, 24 nt, Human
caagaugccagcuuggaagugcca

SEQ ID NO: 894749 - RNA, 18 nt, Human
caaggagcuaaagggccc

SEQ ID NO: 894750 - RNA, 20 nt, Human
caccagagccucgccugucc

SEQ ID NO: 894751 - RNA, 23 nt, Human
cacugccggccccagaacugucu

SEQ ID NO: 894752 - RNA, 24 nt, Human
gccaaggagcuaaagggcccagca

SEQ ID NO: 894753 - RNA, 19 nt, Human
guaagcaccagagccucgc

SEQ ID NO: 894754 - RNA, 18 nt, Human
gucaaggggcaagaugcc

SEQ ID NO: 894755 - RNA, 20 nt, Human
uagcgcagcacgcacgcggu

SEQ ID NO: 894756 - RNA, 25 nt, Human
uccacaaugugcucagcuccagaga

SEQ ID NO: 894757 - RNA, 19 nt, Human
ugccaaggagcuaaagggc

SEQ ID NO: 894758 - RNA, 23 nt, Human
ugccaaggagcuaaagggcccag

SEQ ID NO: 894759 - RNA, 22 nt, Human
ugucuguucaggcugugcagua

SEQ ID NO: 894760 - RNA, 20 nt, Human
uuuuuuuuuuuuggggcagc

SEQ ID NO: 894761 - RNA, 21 nt, Human
aacaaaaagcaauaggcugga

SEQ ID NO: 894762 - RNA, 20 nt, Human
acacacuaaaacaaaaagca

SEQ ID NO: 894763 - RNA, 21 nt, Human
acacacuaaaacaaaaagcaa

SEQ ID NO: 894764 - RNA, 19 nt, Human
agggaugggaagaggggag

SEQ ID NO: 894765 - RNA, 19 nt, Human
aggggaggaggguccgguu

SEQ ID NO: 894766 - RNA, 18 nt, Human
agguacuucagcuuucag

SEQ ID NO: 894767 - RNA, 19 nt, Human
caaaaugucauuaguggaa

SEQ ID NO: 894768 - RNA, 19 nt, Human
cacacuaaaacaaaaagca

SEQ ID NO: 894769 - RNA, 22 nt, Human
caccagcaaucaaugccccgug

SEQ ID NO: 894770 - RNA, 22 nt, Human
caccuuaacacaucacuuacgg

SEQ ID NO: 894771 - RNA, 21 nt, Human
cacuaaaacaaaaagcaauag

SEQ ID NO: 894772 - RNA, 24 nt, Human
cagaauuuaaauuuggcguugucc

SEQ ID NO: 894773 - RNA, 26 nt, Human
cagaggucagaguuccuuugaagcac

SEQ ID NO: 894774 - RNA, 22 nt, Human
caugaaaaaugcagccccggcc

SEQ ID NO: 894775 - RNA, 21 nt, Human
ccccgcgcucggccgcuggcc

SEQ ID NO: 894776 - RNA, 24 nt, Human
ccgcagcgggagccugcuuugggu

SEQ ID NO: 894777 - RNA, 19 nt, Human
ccugaggcaccaguccugg

SEQ ID NO: 894778 - RNA, 18 nt, Human
ccugcuuuggguggggga

SEQ ID NO: 894779 - RNA, 22 nt, Human
cgcaccuguucacccuaggcuc

SEQ ID NO: 894780 - RNA, 22 nt, Human
cgccgccgccucccccgcggac

SEQ ID NO: 894781 - RNA, 21 nt, Human
cggcuggcccagcuggaagcc

SEQ ID NO: 894782 - RNA, 24 nt, Human
cgguacaugucgcgcucgcucucc

SEQ ID NO: 894783 - RNA, 18 nt, Human
cguggagcucgacucgga

SEQ ID NO: 894784 - RNA, 19 nt, Human
cuaggcucaugaaaaaugc

SEQ ID NO: 894785 - RNA, 20 nt, Human
cucggccgcuggccggaugc

SEQ ID NO: 894786 - RNA, 21 nt, Human
cuggaacuggcgguacauguc

SEQ ID NO: 894787 - RNA, 19 nt, Human
cuggcccagcuggaagccc

SEQ ID NO: 894788 - RNA, 21 nt, Human
cuugaauuaagaauagauagc

SEQ ID NO: 894789 - RNA, 23 nt, Human
gauagcuucucaucuaccccuac

SEQ ID NO: 894790 - RNA, 22 nt, Human
gcaccuguucacccuaggcuca

SEQ ID NO: 894791 - RNA, 19 nt, Human
gccugcuuuggguggggga

SEQ ID NO: 894792 - RNA, 19 nt, Human
ggcgccgccgccucccccg

SEQ ID NO: 894793 - RNA, 22 nt, Human
uaaaacaaaaagcaauaggcug

SEQ ID NO: 894794 - RNA, 21 nt, Human
uacccgucguaaagauagcuu

SEQ ID NO: 894795 - RNA, 19 nt, Human
uagcuucucaucuaccccu

SEQ ID NO: 894796 - RNA, 21 nt, Human
uaggcuggacauacuaaagua

SEQ ID NO: 894797 - RNA, 20 nt, Human
uaucucuguugggaaaucaa

SEQ ID NO: 894798 - RNA, 19 nt, Human
ucaaccacagcuacccguc

SEQ ID NO: 894799 - RNA, 19 nt, Human
ucacuuacggaucaaggac

SEQ ID NO: 894800 - RNA, 20 nt, Human
ucacuuacggaucaaggacu

SEQ ID NO: 894801 - RNA, 21 nt, Human
uccuggaacuggcgguacaug

SEQ ID NO: 894802 - RNA, 21 nt, Human
ucuucaaccacagcuacccgu

SEQ ID NO: 894803 - RNA, 22 nt, Human
ugaccaggaccauccggacgcg

SEQ ID NO: 894804 - RNA, 20 nt, Human
ugagucaguagcaaauucca

SEQ ID NO: 894805 - RNA, 19 nt, Human
ugccagguacuucagcuuc

SEQ ID NO: 894806 - RNA, 19 nt, Human
ugcuuugggugggggaagg

SEQ ID NO: 894807 - RNA, 21 nt, Human
uggaacugcaaauuuagaccu

SEQ ID NO: 894808 - RNA, 18 nt, Human
uggagcucgacucggagc

SEQ ID NO: 894809 - RNA, 18 nt, Human
ugucauuaguggaacugc

SEQ ID NO: 894810 - RNA, 22 nt, Human
uugggcaccagcaaucaaugcc

SEQ ID NO: 894811 - RNA, 20 nt, Human
uuuuauaccacaagcuucuu

SEQ ID NO: 894812 - RNA, 27 nt, Human
auuuuuuuuuuuuuuuuuuuuuucuuu

SEQ ID NO: 894813 - RNA, 21 nt, Human
cuaugguaugccccaccuccc

SEQ ID NO: 894814 - RNA, 19 nt, Human
ggaauuuuuuuuuuuuuuu

SEQ ID NO: 894815 - RNA, 18 nt, Human
gggaacacgggcacaggg

SEQ ID NO: 894816 - RNA, 24 nt, Human
ucaggaauuuuuuuuuuuuuuuuu

SEQ ID NO: 894817 - RNA, 21 nt, Human
ucccuugcggccucaggaauu

SEQ ID NO: 894818 - RNA, 21 nt, Human
ugggaaaugucaccuugggcu

SEQ ID NO: 894819 - RNA, 18 nt, Human
uuuuuuuuuuuuuucuug

SEQ ID NO: 894820 - RNA, 27 nt, Human
uuuuuuuuuuuuuucuugugaauuugu

SEQ ID NO: 894821 - RNA, 23 nt, Human
uuuuuuuuuuuuuuuuuucuugu

SEQ ID NO: 894822 - RNA, 22 nt, Human
aagacccucaccuagagaccug

SEQ ID NO: 894823 - RNA, 25 nt, Human
aagacccucaccuagagaccugagg

SEQ ID NO: 894824 - RNA, 22 nt, Human
aaggaaggagacaacaaugaaa

SEQ ID NO: 894825 - RNA, 24 nt, Human
aagucuguacaaaacuaggaacac

SEQ ID NO: 894826 - RNA, 20 nt, Human
acagaaaaggaaggagacac

SEQ ID NO: 894827 - RNA, 23 nt, Human
accuacucuaaacuucuguccuc

SEQ ID NO: 894828 - RNA, 26 nt, Human
acuaggaacacagaaaaggaccaguc

SEQ ID NO: 894829 - RNA, 25 nt, Human
aggaacacagaaaaggaccgguacc

SEQ ID NO: 894830 - RNA, 26 nt, Human
aggaaggagacaacaaugaaaaugaa

SEQ ID NO: 894831 - RNA, 24 nt, Human
auaacauucccuuauuuugucccu

SEQ ID NO: 894832 - RNA, 26 nt, Human
aucaagacccucaccuagagaccuga

SEQ ID NO: 894833 - RNA, 26 nt, Human
cacccuugcuucaccgaagauggccu

SEQ ID NO: 894834 - RNA, 24 nt, Human
cacucaaaaacaagucuguacaaa

SEQ ID NO: 894835 - RNA, 19 nt, Human
cagguccacuggagaaagu

SEQ ID NO: 894836 - RNA, 20 nt, Human
ccagagaggauguuacacug

SEQ ID NO: 894837 - RNA, 18 nt, Human
ccaggcaauacgcgucac

SEQ ID NO: 894838 - RNA, 22 nt, Human
ccugcuacucaacacucaaaaa

SEQ ID NO: 894839 - RNA, 22 nt, Human
ccuugcuucaccgaagauggcc

SEQ ID NO: 894840 - RNA, 21 nt, Human
cuccaggcaauacgcgucacu

SEQ ID NO: 894841 - RNA, 19 nt, Human
gaucaucacccuugcuuca

SEQ ID NO: 894842 - RNA, 20 nt, Human
uacaaaacuaggaacacaga

SEQ ID NO: 894843 - RNA, 21 nt, Human
uaggaacacagaaaaggacca

SEQ ID NO: 894844 - RNA, 20 nt, Human
ucaagacccucaccuagaga

SEQ ID NO: 894845 - RNA, 21 nt, Human
uuucucaguaugaggacuuuc

SEQ ID NO: 894846 - RNA, 22 nt, Human
aggcaggaggaauaaagcaggu

SEQ ID NO: 894847 - RNA, 22 nt, Human
aguuggagcuggagcagccgcc

SEQ ID NO: 894848 - RNA, 24 nt, Human
caccaauggacccaaacccacccc

SEQ ID NO: 894849 - RNA, 19 nt, Human
cagacucccucucuccccc

SEQ ID NO: 894850 - RNA, 20 nt, Human
cagccgccucugagcaccag

SEQ ID NO: 894851 - RNA, 23 nt, Human
ccaaacccaccccagcugggcgc

SEQ ID NO: 894852 - RNA, 23 nt, Human
ccaaggcgaggguggcccucccc

SEQ ID NO: 894853 - RNA, 20 nt, Human
ccgcuccgguggcggcggcg

SEQ ID NO: 894854 - RNA, 18 nt, Human
ccucugagcaccagggag

SEQ ID NO: 894855 - RNA, 19 nt, Human
ccucugagcaccagggagc

SEQ ID NO: 894856 - RNA, 24 nt, Human
cgccucugagcaccagggagcagc

SEQ ID NO: 894857 - RNA, 22 nt, Human
cggcgccugccuccucugcucc

SEQ ID NO: 894858 - RNA, 20 nt, Human
cgggaagaagcuguggagcg

SEQ ID NO: 894859 - RNA, 21 nt, Human
cuccccccuaccuugucucca

SEQ ID NO: 894860 - RNA, 18 nt, Human
cuccccucccgggaagaa

SEQ ID NO: 894861 - RNA, 19 nt, Human
cuccgcggcgccugccucc

SEQ ID NO: 894862 - RNA, 20 nt, Human
cuccucugcuccccccuacc

SEQ ID NO: 894863 - RNA, 18 nt, Human
cugcuccccccuaccuug

SEQ ID NO: 894864 - RNA, 18 nt, Human
cugcuccccccuaccuug

SEQ ID NO: 894865 - RNA, 21 nt, Human
cugcuccccccuaccuugucu

SEQ ID NO: 894866 - RNA, 24 nt, Human
gagcagcugaugggaacgugugac

SEQ ID NO: 894867 - RNA, 18 nt, Human
gccccgggacgcaccgcu

SEQ ID NO: 894868 - RNA, 23 nt, Human
gcgaggguggcccuccccucccg

SEQ ID NO: 894869 - RNA, 18 nt, Human
gcggcgccugccuccucu

SEQ ID NO: 894870 - RNA, 20 nt, Human
ggcccuccccucccgggaag

SEQ ID NO: 894871 - RNA, 21 nt, Human
ggcugguggcugaagugcucg

SEQ ID NO: 894872 - RNA, 20 nt, Human
gggcacuggaaaaaaaaaaa

SEQ ID NO: 894873 - RNA, 21 nt, Human
guggcggcggcggagggacua

SEQ ID NO: 894874 - RNA, 22 nt, Human
guggcugaagugcucgcccaag

SEQ ID NO: 894875 - RNA, 25 nt, Human
ucaacaguuauugaucuuauaauaa

SEQ ID NO: 894876 - RNA, 18 nt, Human
ucccgggaagaagcugug

SEQ ID NO: 894877 - RNA, 20 nt, Human
ugaaugagaguuggagcugg

SEQ ID NO: 894878 - RNA, 21 nt, Human
ugacguucaacaguuauugau

SEQ ID NO: 894879 - RNA, 19 nt, Human
ugacuuuuuucaccaaugg

SEQ ID NO: 894880 - RNA, 24 nt, Human
ugauggggacagccuucggcgggu

SEQ ID NO: 894881 - RNA, 21 nt, Human
uggaaaaaaaaaaaaaaaaac

SEQ ID NO: 894882 - RNA, 23 nt, Human
uggagcuggagcagccgccucug

SEQ ID NO: 894883 - RNA, 23 nt, Human
uggggcacuggaaaaaaaaaaaa

SEQ ID NO: 894884 - RNA, 26 nt, Human
uucaacaguuauugaucuuauaauaa

SEQ ID NO: 894885 - RNA, 18 nt, Human
aggccgcagcgucccaau

SEQ ID NO: 894886 - RNA, 21 nt, Human
aggcugcggcugcuucucggc

SEQ ID NO: 894887 - RNA, 18 nt, Human
cacacucagagcagugac

SEQ ID NO: 894888 - RNA, 20 nt, Human
caccucacggcccaccucca

SEQ ID NO: 894889 - RNA, 23 nt, Human
caccucacggcccaccuccaagg

SEQ ID NO: 894890 - RNA, 19 nt, Human
ccaguggccugaaggccag

SEQ ID NO: 894891 - RNA, 24 nt, Human
cguuugaaaucaccagcaucgcuc

SEQ ID NO: 894892 - RNA, 23 nt, Human
cucacggcccaccuccaaggccc

SEQ ID NO: 894893 - RNA, 21 nt, Human
gaggaggcugcggcugcuucu

SEQ ID NO: 894894 - RNA, 21 nt, Human
gaggcugcggcugcuucucgg

SEQ ID NO: 894895 - RNA, 18 nt, Human
ggacucaaaacaggucag

SEQ ID NO: 894896 - RNA, 19 nt, Human
ggacuggugaagagccccg

SEQ ID NO: 894897 - RNA, 21 nt, Human
ggaggcugcggcugcuucucg

SEQ ID NO: 894898 - RNA, 22 nt, Human
ggcccugggacacacucagagc

SEQ ID NO: 894899 - RNA, 22 nt, Human
ugaaaucaccagcaucgcucug

SEQ ID NO: 894900 - RNA, 19 nt, Human
uggaaacgagcuggacugg

SEQ ID NO: 894901 - RNA, 21 nt, Human
uggacuggugaagagccccgg

SEQ ID NO: 894902 - RNA, 20 nt, Human
ugggauagguggagggaggg

SEQ ID NO: 894903 - RNA, 20 nt, Human
ugugacagcaaggugggagc

SEQ ID NO: 894904 - RNA, 18 nt, Human
uucgguagccaguggccu

SEQ ID NO: 894905 - RNA, 18 nt, Human
acucgggaggcugaaaug

SEQ ID NO: 894906 - RNA, 19 nt, Human
aggcgaaggucgugaugag

SEQ ID NO: 894907 - RNA, 24 nt, Human
aggcgaaggucgugaugagccaag

SEQ ID NO: 894908 - RNA, 20 nt, Human
aucgcaccauugcacuccag

SEQ ID NO: 894909 - RNA, 28 nt, Human
aucgcaccauugcacuccagccuaggca

SEQ ID NO: 894910 - RNA, 25 nt, Human
auugcacuccagccuaggcaacaag

SEQ ID NO: 894911 - RNA, 24 nt, Human
cacuccagccuaggcaacaagagu

SEQ ID NO: 894912 - RNA, 19 nt, Human
cauugcacuccagccuagg

SEQ ID NO: 894913 - RNA, 21 nt, Human
cauugcacuccagccuaggca

SEQ ID NO: 894914 - RNA, 22 nt, Human
cauugcacuccagccuaggcaa

SEQ ID NO: 894915 - RNA, 23 nt, Human
cauugcacuccagccuaggcaac

SEQ ID NO: 894916 - RNA, 24 nt, Human
cauugcacuccagccuaggcaaca

SEQ ID NO: 894917 - RNA, 25 nt, Human
cauugcacuccagccuaggcaacaa

SEQ ID NO: 894918 - RNA, 19 nt, Human
ccauugcacuccagccuag

SEQ ID NO: 894919 - RNA, 20 nt, Human
ccauugcacuccagccuagg

SEQ ID NO: 894920 - RNA, 21 nt, Human
ccauugcacuccagccuaggc

SEQ ID NO: 894921 - RNA, 24 nt, Human
ccauugcacuccagccuaggcaac

SEQ ID NO: 894922 - RNA, 20 nt, Human
cccucggucgcuuccucgug

SEQ ID NO: 894923 - RNA, 21 nt, Human
ccuguaaucccagcuacucgg

SEQ ID NO: 894924 - RNA, 21 nt, Human
cgcaccauugcacuccagccu

SEQ ID NO: 894925 - RNA, 18 nt, Human
cucccagucccucggucg

SEQ ID NO: 894926 - RNA, 21 nt, Human
cuguaaucccagcuacucggg

SEQ ID NO: 894927 - RNA, 20 nt, Human
gcaccauugcacuccagccu

SEQ ID NO: 894928 - RNA, 25 nt, Human
ucacuugaaccugggaggcgaaggu

SEQ ID NO: 894929 - RNA, 22 nt, Human
ugcacuccagccuaggcaacaa

SEQ ID NO: 894930 - RNA, 25 nt, Human
ugcacuccagccuaggcaacaagag

SEQ ID NO: 894931 - RNA, 21 nt, Human
uugaaccugggaggcgaaggu

SEQ ID NO: 894932 - RNA, 18 nt, Human
uuuuuuuuuugcgcaccc

SEQ ID NO: 894933 - RNA, 18 nt, Human
uuuuuuuuuuuuuuuuug

SEQ ID NO: 894934 - RNA, 21 nt, Human
aagggcagaguccaacccacc

SEQ ID NO: 894935 - RNA, 23 nt, Human
ccaccccagguccugaggguaga

SEQ ID NO: 894936 - RNA, 23 nt, Human
ccccagguccugaggguagacuc

SEQ ID NO: 894937 - RNA, 18 nt, Human
guccaacccaccccaggu

SEQ ID NO: 894938 - RNA, 20 nt, Human
guccugagggaaaggggugg

SEQ ID NO: 894939 - RNA, 23 nt, Human
uuuuuuggacuuagcaagguuua

SEQ ID NO: 894940 - RNA, 18 nt, Human
uuuuuuuuuuuuuuggac

SEQ ID NO: 894941 - RNA, 18 nt, Human
uuuuuuuuuuuuuuuuug

SEQ ID NO: 894942 - RNA, 23 nt, Human
uuuuuuuuuuuuuuuuuggacuu

SEQ ID NO: 894943 - RNA, 20 nt, Human
aagaggaggagaugggagga

SEQ ID NO: 894944 - RNA, 19 nt, Human
aagcacagggagggaggaa

SEQ ID NO: 894945 - RNA, 22 nt, Human
agaggagcaggacuacaccaag

SEQ ID NO: 894946 - RNA, 22 nt, Human
aggagcaggacuacaccaagcu

SEQ ID NO: 894947 - RNA, 18 nt, Human
aggaggagagggaagagg

SEQ ID NO: 894948 - RNA, 21 nt, Human
aggaggagagggaagaggagg

SEQ ID NO: 894949 - RNA, 20 nt, Human
agggaggaaggaggggucag

SEQ ID NO: 894950 - RNA, 22 nt, Human
caaaaugcaauauauacagaua

SEQ ID NO: 894951 - RNA, 21 nt, Human
cacacagaccugggcccuggg

SEQ ID NO: 894952 - RNA, 25 nt, Human
cagccccaucccaagaggagcagga

SEQ ID NO: 894953 - RNA, 26 nt, Human
cccagccccaucccaagaggagcagg

SEQ ID NO: 894954 - RNA, 18 nt, Human
ccccagccccaucccaag

SEQ ID NO: 894955 - RNA, 24 nt, Human
ccuaccccagccccaucccaagag

SEQ ID NO: 894956 - RNA, 19 nt, Human
cgggcuggggagggggcuu

SEQ ID NO: 894957 - RNA, 20 nt, Human
gacaggaagggucaggccca

SEQ ID NO: 894958 - RNA, 22 nt, Human
gagaugggaggagagaaaaggg

SEQ ID NO: 894959 - RNA, 24 nt, Human
gaguugggggggaggaggagaggg

SEQ ID NO: 894960 - RNA, 22 nt, Human
gcaauauauacagauaucacaa

SEQ ID NO: 894961 - RNA, 20 nt, Human
gcggcggcugcugcugcugc

SEQ ID NO: 894962 - RNA, 19 nt, Human
gcugcggcggcugcggcgg

SEQ ID NO: 894963 - RNA, 19 nt, Human
gcugcugcugcugcggcgg

SEQ ID NO: 894964 - RNA, 18 nt, Human
ggagagggaagaggagga

SEQ ID NO: 894965 - RNA, 24 nt, Human
gggaggaggagagggaagaggagg

SEQ ID NO: 894966 - RNA, 19 nt, Human
gggcuggggagggggcuuc

SEQ ID NO: 894967 - RNA, 21 nt, Human
gggcuucugagcccccuuccc

SEQ ID NO: 894968 - RNA, 19 nt, Human
ggggcggcggcugcugcug

SEQ ID NO: 894969 - RNA, 21 nt, Human
ggggggccuggggcggcggcu

SEQ ID NO: 894970 - RNA, 18 nt, Human
gggggggaggaggagagg

SEQ ID NO: 894971 - RNA, 20 nt, Human
gggggggccuggggcggcgg

SEQ ID NO: 894972 - RNA, 18 nt, Human
ucaggaguugggggggag

SEQ ID NO: 894973 - RNA, 18 nt, Human
ucaggcccagccaagcac

SEQ ID NO: 894974 - RNA, 21 nt, Human
ugcugcugcugcggcggcugc

SEQ ID NO: 894975 - RNA, 18 nt, Human
ugggaggagagaaaaggg

SEQ ID NO: 894976 - RNA, 21 nt, Human
ugggaggagagaaaagggugg

SEQ ID NO: 894977 - RNA, 20 nt, Human
ugggggggaggaggagaggg

SEQ ID NO: 894978 - RNA, 18 nt, Human
uuccgggcuggggagggg

SEQ ID NO: 894979 - RNA, 24 nt, Human
uugggggggaggaggagagggaag

SEQ ID NO: 894980 - RNA, 23 nt, Human
aagaauaacacaaagcuaugccu

SEQ ID NO: 894981 - RNA, 18 nt, Human
acaaagcuaugccuaccc

SEQ ID NO: 894982 - RNA, 23 nt, Human
acacaaagcuaugccuacccgac

SEQ ID NO: 894983 - RNA, 23 nt, Human
caacuggacccuaaacaaauuuc

SEQ ID NO: 894984 - RNA, 20 nt, Human
caagaaagccugauuuaaua

SEQ ID NO: 894985 - RNA, 18 nt, Human
caagaauaacacaaagcu

SEQ ID NO: 894986 - RNA, 24 nt, Human
caagaauaacacaaagcuaugccu

SEQ ID NO: 894987 - RNA, 18 nt, Human
cccagguucaaggaauuc

SEQ ID NO: 894988 - RNA, 22 nt, Human
cgaaauuuuccaagaauaacac

SEQ ID NO: 894989 - RNA, 22 nt, Human
cugaagcgccaacugagucuua

SEQ ID NO: 894990 - RNA, 21 nt, Human
cugagcaaagugcaaaggaga

SEQ ID NO: 894991 - RNA, 22 nt, Human
uaaaagauauuucuccaugccc

SEQ ID NO: 894992 - RNA, 22 nt, Human
uaacaaaaauacacaaaucaac

SEQ ID NO: 894993 - RNA, 24 nt, Human
uaacaaaaauacacaaaucaacug

SEQ ID NO: 894994 - RNA, 24 nt, Human
uacaacacgaauauuugcuucuga

SEQ ID NO: 894995 - RNA, 25 nt, Human
uccaagaauaacacaaagcuaugcc

SEQ ID NO: 894996 - RNA, 23 nt, Human
uccagucucgacgccgaaaaagc

SEQ ID NO: 894997 - RNA, 24 nt, Human
uuaaaugauaacaaaaauacacaa

SEQ ID NO: 894998 - RNA, 21 nt, Human
uucaagaaagccugauuuaau

SEQ ID NO: 894999 - RNA, 21 nt, Human
gaagagaagacacgcgcggca

SEQ ID NO: 895000 - RNA, 23 nt, Human
uuuuuuuuuuuuuuuuccacaag

SEQ ID NO: 895001 - RNA, 23 nt, Human
uuuuuuuuuuuuuuuuuuuucca

SEQ ID NO: 895002 - RNA, 29 nt, Human
uuuuuuuuuuuuuuuuuuuuccacaagaa

SEQ ID NO: 895003 - RNA, 24 nt, Human
uuuuuuuuuuuuuuuuuuuuuccu

SEQ ID NO: 895004 - RNA, 19 nt, Human
aaaacggcaggcaacuggu

SEQ ID NO: 895005 - RNA, 19 nt, Human
aaacagggcacauuguuua

SEQ ID NO: 895006 - RNA, 26 nt, Human
aaagaggggguggaauggggaccguc

SEQ ID NO: 895007 - RNA, 22 nt, Human
aacagaaacaaaaaccacccua

SEQ ID NO: 895008 - RNA, 21 nt, Human
aagaagacaaaacggcaggca

SEQ ID NO: 895009 - RNA, 26 nt, Human
aagaagacaaaacggcaggcaacugg

SEQ ID NO: 895010 - RNA, 22 nt, Human
aaggaauuaggaacagaaacaa

SEQ ID NO: 895011 - RNA, 22 nt, Human
aagucaggugaaagaaagaggg

SEQ ID NO: 895012 - RNA, 19 nt, Human
agaaauuaaguuuaagaac

SEQ ID NO: 895013 - RNA, 21 nt, Human
agaagaagacaaaacggcagg

SEQ ID NO: 895014 - RNA, 24 nt, Human
agaagaagacaaaacggcaggcaa

SEQ ID NO: 895015 - RNA, 23 nt, Human
aggaacagaaacaaaaaccaccc

SEQ ID NO: 895016 - RNA, 18 nt, Human
aggcaaaaaauaaacaua

SEQ ID NO: 895017 - RNA, 19 nt, Human
caaaacaacccaacacaca

SEQ ID NO: 895018 - RNA, 21 nt, Human
caaaacggcaggcaacugguc

SEQ ID NO: 895019 - RNA, 21 nt, Human
cagaaacaaaaaccacccuau

SEQ ID NO: 895020 - RNA, 24 nt, Human
cauaucaagaucuuuaugaagaaa

SEQ ID NO: 895021 - RNA, 23 nt, Human
ccaacacacaccuuagaagaaga

SEQ ID NO: 895022 - RNA, 23 nt, Human
cguggcgagagaagacgcugacc

SEQ ID NO: 895023 - RNA, 19 nt, Human
cuagucacaggccagaaau

SEQ ID NO: 895024 - RNA, 19 nt, Human
cuggccgggcccaggacgg

SEQ ID NO: 895025 - RNA, 20 nt, Human
gacaaaacggcaggcaacug

SEQ ID NO: 895026 - RNA, 23 nt, Human
gggguggaauggggaccgucgug

SEQ ID NO: 895027 - RNA, 21 nt, Human
uaggaacagaaacaaaaacca

SEQ ID NO: 895028 - RNA, 22 nt, Human
uaggaacagaaacaaaaaccac

SEQ ID NO: 895029 - RNA, 25 nt, Human
uaugaagaaaccccaaugguuguca

SEQ ID NO: 895030 - RNA, 22 nt, Human
ucaaagugcuagaauuaaaggu

SEQ ID NO: 895031 - RNA, 21 nt, Human
ucacaggccagaaauuaaguu

SEQ ID NO: 895032 - RNA, 21 nt, Human
ucaggugaaagaaagaggggg

SEQ ID NO: 895033 - RNA, 20 nt, Human
ucugacccucugaaggcaaa

SEQ ID NO: 895034 - RNA, 20 nt, Human
ucuuuaugaagaaaccccaa

SEQ ID NO: 895035 - RNA, 25 nt, Human
ugaaagaaagaggggguggaauggg

SEQ ID NO: 895036 - RNA, 21 nt, Human
ugcaaaggaaagcaaaacaac

SEQ ID NO: 895037 - RNA, 22 nt, Human
uggaauggggaccgucguggcg

SEQ ID NO: 895038 - RNA, 23 nt, Human
uggaauggggaccgucguggcga

SEQ ID NO: 895039 - RNA, 26 nt, Human
uggaauggggaccgucguggcgagag

SEQ ID NO: 895040 - RNA, 21 nt, Human
uucuagucacaggccagaaau

SEQ ID NO: 895041 - RNA, 19 nt, Human
uugaccacaagacugagua

SEQ ID NO: 895042 - RNA, 25 nt, Human
aaguauuggagcuggagaccaaacc

SEQ ID NO: 895043 - RNA, 23 nt, Human
acaggcagucucaugggaauggc

SEQ ID NO: 895044 - RNA, 19 nt, Human
accaaacccaacaccauuu

SEQ ID NO: 895045 - RNA, 20 nt, Human
agaaaaggccguggauggca

SEQ ID NO: 895046 - RNA, 20 nt, Human
agagcuguccaaaagcucgg

SEQ ID NO: 895047 - RNA, 22 nt, Human
agcggggagccaggccaggccu

SEQ ID NO: 895048 - RNA, 21 nt, Human
aggaggaggcacugcccaagg

SEQ ID NO: 895049 - RNA, 27 nt, Human
aggugacuuggaaacuggggacccacu

SEQ ID NO: 895050 - RNA, 24 nt, Human
aguggcugccgaccggccucccac

SEQ ID NO: 895051 - RNA, 18 nt, Human
auggagugugucuguucc

SEQ ID NO: 895052 - RNA, 21 nt, Human
cacaaggaagauccccauaac

SEQ ID NO: 895053 - RNA, 19 nt, Human
cacagcacagagccaggau

SEQ ID NO: 895054 - RNA, 27 nt, Human
cacccaggguaguggucaaccgggucg

SEQ ID NO: 895055 - RNA, 22 nt, Human
cacugcccaaggccuaggugac

SEQ ID NO: 895056 - RNA, 18 nt, Human
cagacuccuggguggccu

SEQ ID NO: 895057 - RNA, 19 nt, Human
cagaggagccaucaguggu

SEQ ID NO: 895058 - RNA, 20 nt, Human
cagaggagccaucaguggug

SEQ ID NO: 895059 - RNA, 19 nt, Human
caggaggggcuaauccaug

SEQ ID NO: 895060 - RNA, 23 nt, Human
caggcccgaggugaagaugggag

SEQ ID NO: 895061 - RNA, 24 nt, Human
ccaaacccaacaccauuuuccagg

SEQ ID NO: 895062 - RNA, 22 nt, Human
ccagcccagccccaagagcucc

SEQ ID NO: 895063 - RNA, 22 nt, Human
ccaggccucaggaacagccaag

SEQ ID NO: 895064 - RNA, 19 nt, Human
ccccaagagcucccagccu

SEQ ID NO: 895065 - RNA, 21 nt, Human
ccccaagagcucccagccuuc

SEQ ID NO: 895066 - RNA, 22 nt, Human
ccccauaacccuuugguucagg

SEQ ID NO: 895067 - RNA, 18 nt, Human
ccgaccggccucccacag

SEQ ID NO: 895068 - RNA, 20 nt, Human
ccgaggugaagaugggagga

SEQ ID NO: 895069 - RNA, 20 nt, Human
ccugccaacuuccagaccca

SEQ ID NO: 895070 - RNA, 18 nt, Human
ccugggcccuucucuugc

SEQ ID NO: 895071 - RNA, 24 nt, Human
cuccagugacaggcagucucaugg

SEQ ID NO: 895072 - RNA, 21 nt, Human
cucccagccuucagacuccug

SEQ ID NO: 895073 - RNA, 22 nt, Human
cucccagccuucagacuccugg

SEQ ID NO: 895074 - RNA, 18 nt, Human
cuuccagacccaggccca

SEQ ID NO: 895075 - RNA, 21 nt, Human
gaagaugggaggaccagccca

SEQ ID NO: 895076 - RNA, 22 nt, Human
gagccaggccaggccucaggaa

SEQ ID NO: 895077 - RNA, 19 nt, Human
gaggagccaucaguggugc

SEQ ID NO: 895078 - RNA, 18 nt, Human
gcagaccugcaggugcgc

SEQ ID NO: 895079 - RNA, 21 nt, Human
gccuucagacuccuggguggc

SEQ ID NO: 895080 - RNA, 19 nt, Human
gcugccgaccggccuccca

SEQ ID NO: 895081 - RNA, 21 nt, Human
ggccauagagccuagacaggg

SEQ ID NO: 895082 - RNA, 23 nt, Human
ggccauagagccuagacagggcc

SEQ ID NO: 895083 - RNA, 21 nt, Human
gggaguggcugccgaccggcc

SEQ ID NO: 895084 - RNA, 24 nt, Human
ggguaguggucauugucuguguuc

SEQ ID NO: 895085 - RNA, 20 nt, Human
gguugggcugguuugaggcc

SEQ ID NO: 895086 - RNA, 24 nt, Human
uaagacuuucgagagaggaacuga

SEQ ID NO: 895087 - RNA, 21 nt, Human
uagacagggccucuggcugua

SEQ ID NO: 895088 - RNA, 18 nt, Human
ucaguggugcugccugga

SEQ ID NO: 895089 - RNA, 19 nt, Human
ucaguggugcugccuggau

SEQ ID NO: 895090 - RNA, 27 nt, Human
ucaguggugcugccugggcggcuuacc

SEQ ID NO: 895091 - RNA, 18 nt, Human
uccccauaacccuuuggu

SEQ ID NO: 895092 - RNA, 18 nt, Human
uccuggguggccuugacu

SEQ ID NO: 895093 - RNA, 21 nt, Human
uccuggguggccuugacuggc

SEQ ID NO: 895094 - RNA, 23 nt, Human
ugaccaaggugcuuaugagagca

SEQ ID NO: 895095 - RNA, 18 nt, Human
ugagugugggacaaacau

SEQ ID NO: 895096 - RNA, 19 nt, Human
ugcccaaggccuaggugac

SEQ ID NO: 895097 - RNA, 19 nt, Human
ugccgaccggccucccaca

SEQ ID NO: 895098 - RNA, 20 nt, Human
ugccuggauaccucaagagc

SEQ ID NO: 895099 - RNA, 22 nt, Human
uggauggcagaccugcaggugc

SEQ ID NO: 895100 - RNA, 19 nt, Human
uggcucuuggccugagccu

SEQ ID NO: 895101 - RNA, 22 nt, Human
ugggaaggggucagcggggagc

SEQ ID NO: 895102 - RNA, 18 nt, Human
ugggaggaccagcccagc

SEQ ID NO: 895103 - RNA, 18 nt, Human
ugugggacaaacauggag

SEQ ID NO: 895104 - RNA, 28 nt, Human
uuccugggccuuaugagagcauccuucc

SEQ ID NO: 895105 - RNA, 24 nt, Human
uucucuugccagaaaaggccgugg

SEQ ID NO: 895106 - RNA, 27 nt, Human
uuuuuuuuuuuuuuuuuuuuucugggg

SEQ ID NO: 895107 - RNA, 24 nt, Human
aaaaggcuuaaccugugauaaucc

SEQ ID NO: 895108 - RNA, 21 nt, Human
aagugccucugcuucuaguuu

SEQ ID NO: 895109 - RNA, 18 nt, Human
acauuuuauauucuuugu

SEQ ID NO: 895110 - RNA, 25 nt, Human
caacaccuucugaaaaaagaguaac

SEQ ID NO: 895111 - RNA, 18 nt, Human
cacccaccucacacccug

SEQ ID NO: 895112 - RNA, 18 nt, Human
cagcagcauaagccccag

SEQ ID NO: 895113 - RNA, 22 nt, Human
ccacaccugacacaggucccca

SEQ ID NO: 895114 - RNA, 21 nt, Human
ccaggccaggcgacaacccuu

SEQ ID NO: 895115 - RNA, 26 nt, Human
ccaguuuccacuauggugucuccuca

SEQ ID NO: 895116 - RNA, 26 nt, Human
ccugcaggucaaaaccuggaagaggc

SEQ ID NO: 895117 - RNA, 24 nt, Human
ccugugauaaucccaacaccuucu

SEQ ID NO: 895118 - RNA, 26 nt, Human
cucagccucagucuccccuucuuagc

SEQ ID NO: 895119 - RNA, 23 nt, Human
cugccugcaggucaaaaccugga

SEQ ID NO: 895120 - RNA, 24 nt, Human
cuggaggcagcagcauaagccccu

SEQ ID NO: 895121 - RNA, 22 nt, Human
gacacagguccccacccaccuc

SEQ ID NO: 895122 - RNA, 19 nt, Human
gcagaaauggcuauccaca

SEQ ID NO: 895123 - RNA, 19 nt, Human
gcccgauguuccccagccu

SEQ ID NO: 895124 - RNA, 23 nt, Human
gcccgauguuccccagccucagc

SEQ ID NO: 895125 - RNA, 22 nt, Human
gccucagccucagucuccccuu

SEQ ID NO: 895126 - RNA, 20 nt, Human
ggccaggcgacaacccuuca

SEQ ID NO: 895127 - RNA, 20 nt, Human
gggccauggguaggggcggg

SEQ ID NO: 895128 - RNA, 22 nt, Human
guucagaagcugugaugguccu

SEQ ID NO: 895129 - RNA, 18 nt, Human
uaacaguacacagauugu

SEQ ID NO: 895130 - RNA, 24 nt, Human
ucagaagcugugaugguccuguua

SEQ ID NO: 895131 - RNA, 18 nt, Human
ucaggugcagacggggaa

SEQ ID NO: 895132 - RNA, 21 nt, Human
ucaguucagaagcugugaugg

SEQ ID NO: 895133 - RNA, 18 nt, Human
uccacaccugacacaggu

SEQ ID NO: 895134 - RNA, 21 nt, Human
uccccacccaccucacacccu

SEQ ID NO: 895135 - RNA, 21 nt, Human
ugaaaaaagaguaacagucau

SEQ ID NO: 895136 - RNA, 21 nt, Human
ugugaugguccuguuagagag

SEQ ID NO: 895137 - RNA, 25 nt, Human
uguuagagagcacugccugcagguc

SEQ ID NO: 895138 - RNA, 18 nt, Human
uuccccagccucagccuc

SEQ ID NO: 895139 - RNA, 19 nt, Human
uuccccagccucagccuca

SEQ ID NO: 895140 - RNA, 22 nt, Human
uugagcagaaauggcuauccac

SEQ ID NO: 895141 - RNA, 23 nt, Human
uuuuuuuuuuuuuuuuuuaacag

SEQ ID NO: 895142 - RNA, 22 nt, Human
aaaaugaacaagaauucacgaa

SEQ ID NO: 895143 - RNA, 25 nt, Human
aacuugucauugccuuucauucuuc

SEQ ID NO: 895144 - RNA, 22 nt, Human
aagccccagcccccaaaagagc

SEQ ID NO: 895145 - RNA, 23 nt, Human
aaggaaaccacguugaaccaaca

SEQ ID NO: 895146 - RNA, 23 nt, Human
aaucacggguaaggccaccuggu

SEQ ID NO: 895147 - RNA, 19 nt, Human
acggguaaggccaccuggg

SEQ ID NO: 895148 - RNA, 24 nt, Human
agcccccaaaagagcaugucucag

SEQ ID NO: 895149 - RNA, 18 nt, Human
agcuaaagccccagcccc

SEQ ID NO: 895150 - RNA, 22 nt, Human
aggagggaguuuggggaaugga

SEQ ID NO: 895151 - RNA, 22 nt, Human
agggaggagggaguuuggggaa

SEQ ID NO: 895152 - RNA, 24 nt, Human
auauuggagccccucucccuacca

SEQ ID NO: 895153 - RNA, 19 nt, Human
caaaauagucaaccaaggc

SEQ ID NO: 895154 - RNA, 23 nt, Human
caaguacaaggaaaccacguuga

SEQ ID NO: 895155 - RNA, 22 nt, Human
cagacccugggcuuuuccuccu

SEQ ID NO: 895156 - RNA, 28 nt, Human
cagacuccccaccaaauaauacuucucc

SEQ ID NO: 895157 - RNA, 24 nt, Human
cagagaugcuacagccucagccac

SEQ ID NO: 895158 - RNA, 22 nt, Human
cagccacagccccuuuaagcau

SEQ ID NO: 895159 - RNA, 19 nt, Human
caucaccacuuggcuggga

SEQ ID NO: 895160 - RNA, 19 nt, Human
ccagcagagaugcuacagc

SEQ ID NO: 895161 - RNA, 24 nt, Human
ccaguggcaugugagcccccgggg

SEQ ID NO: 895162 - RNA, 21 nt, Human
ccccaccaaauaauacuucuc

SEQ ID NO: 895163 - RNA, 24 nt, Human
ccccagcccccaaaagagcauguc

SEQ ID NO: 895164 - RNA, 21 nt, Human
cccugggcuuuuccuccuggg

SEQ ID NO: 895165 - RNA, 19 nt, Human
ccucuuagggcgagggagc

SEQ ID NO: 895166 - RNA, 22 nt, Human
cuagcuaaagccccagccccca

SEQ ID NO: 895167 - RNA, 22 nt, Human
cucagccacagccccuuuaagc

SEQ ID NO: 895168 - RNA, 21 nt, Human
cuggcaccuuuaauucauggu

SEQ ID NO: 895169 - RNA, 24 nt, Human
cuggcaccuuuaauucauggugcu

SEQ ID NO: 895170 - RNA, 21 nt, Human
cugguaaucuccauacucagu

SEQ ID NO: 895171 - RNA, 19 nt, Human
cuucugcugaguuucuaca

SEQ ID NO: 895172 - RNA, 21 nt, Human
gacuugcuauuacuggaccuu

SEQ ID NO: 895173 - RNA, 20 nt, Human
gagcauucgaggucaaauca

SEQ ID NO: 895174 - RNA, 18 nt, Human
gcaaagcccuguccaggg

SEQ ID NO: 895175 - RNA, 21 nt, Human
ggacagauaauacaagccagg

SEQ ID NO: 895176 - RNA, 24 nt, Human
ggccucugcccuggacagcagccu

SEQ ID NO: 895177 - RNA, 22 nt, Human
ggccugugcuucuagcccugug

SEQ ID NO: 895178 - RNA, 19 nt, Human
gggaaacaugaugcgaugg

SEQ ID NO: 895179 - RNA, 19 nt, Human
ggguaaggccaccugggga

SEQ ID NO: 895180 - RNA, 18 nt, Human
gguuuucuaccaugagcu

SEQ ID NO: 895181 - RNA, 20 nt, Human
gucccuguggacacucaggc

SEQ ID NO: 895182 - RNA, 21 nt, Human
gugaccuuaaaccuggcagaa

SEQ ID NO: 895183 - RNA, 21 nt, Human
guggaagcuaaaaaaaaaaac

SEQ ID NO: 895184 - RNA, 25 nt, Human
gugugaagguggaugagcaaaagag

SEQ ID NO: 895185 - RNA, 21 nt, Human
uaaaccuggcagaacuccuga

SEQ ID NO: 895186 - RNA, 21 nt, Human
uaaagccccagcccccaaaag

SEQ ID NO: 895187 - RNA, 23 nt, Human
uaauagcucuggaauuuuccaga

SEQ ID NO: 895188 - RNA, 23 nt, Human
uaaucuccauacucagucaucuc

SEQ ID NO: 895189 - RNA, 20 nt, Human
uaauucauggugcuucccuc

SEQ ID NO: 895190 - RNA, 21 nt, Human
uacaaggaaaccacguugaac

SEQ ID NO: 895191 - RNA, 23 nt, Human
uacagccucagccacagccccuu

SEQ ID NO: 895192 - RNA, 18 nt, Human
ucauuuccagacugucgg

SEQ ID NO: 895193 - RNA, 23 nt, Human
uccauacucagucaucucaggaa

SEQ ID NO: 895194 - RNA, 21 nt, Human
ucccuugguaaggaguaaaua

SEQ ID NO: 895195 - RNA, 21 nt, Human
ucuccauacucagucaucuca

SEQ ID NO: 895196 - RNA, 24 nt, Human
ugaagaggcuuccuuuuggacaga

SEQ ID NO: 895197 - RNA, 21 nt, Human
ugacugcaggaaugcaaaaug

SEQ ID NO: 895198 - RNA, 19 nt, Human
ugagcaaaagagaggaaga

SEQ ID NO: 895199 - RNA, 22 nt, Human
ugagcaaaagagaggaagagcc

SEQ ID NO: 895200 - RNA, 21 nt, Human
ugcaggugaccuuaaaccugg

SEQ ID NO: 895201 - RNA, 23 nt, Human
ugcccuggacagcagccuguccu

SEQ ID NO: 895202 - RNA, 25 nt, Human
ugcccuggacagcagccuguccucc

SEQ ID NO: 895203 - RNA, 22 nt, Human
ugccgaguaagaaucacgggua

SEQ ID NO: 895204 - RNA, 24 nt, Human
ugccugguaaucuccauacucagu

SEQ ID NO: 895205 - RNA, 24 nt, Human
ugcuuuuauucacaccucugucau

SEQ ID NO: 895206 - RNA, 18 nt, Human
uggagcucuggcaccuuu

SEQ ID NO: 895207 - RNA, 19 nt, Human
ugggaaacaugaugcgaug

SEQ ID NO: 895208 - RNA, 18 nt, Human
ugucucaggaacucauua

SEQ ID NO: 895209 - RNA, 24 nt, Human
uguuuuuaccagcuucugcugagu

SEQ ID NO: 895210 - RNA, 25 nt, Human
uucaggaggaucaaguacaaggaaa

SEQ ID NO: 895211 - RNA, 23 nt, Human
uuccuuuuggacagauaauacaa

SEQ ID NO: 895212 - RNA, 21 nt, Human
uucuucuagcuaaagccccag

SEQ ID NO: 895213 - RNA, 19 nt, Human
uuuauuggcacugucaaca

SEQ ID NO: 895214 - RNA, 18 nt, Human
uuucugguugugcccugg

SEQ ID NO: 895215 - RNA, 21 nt, Human
aaguaacaaacagaaacaagc

SEQ ID NO: 895216 - RNA, 24 nt, Human
aaguaacaaacagaaacaagcccc

SEQ ID NO: 895217 - RNA, 20 nt, Human
acagggcaccaggcaggcag

SEQ ID NO: 895218 - RNA, 21 nt, Human
accccggggugcagaaggccc

SEQ ID NO: 895219 - RNA, 20 nt, Human
acccggggcugcagcuuccc

SEQ ID NO: 895220 - RNA, 22 nt, Human
accucaagugaauucugagagg

SEQ ID NO: 895221 - RNA, 22 nt, Human
acgcaggugcccugcacaggac

SEQ ID NO: 895222 - RNA, 20 nt, Human
agcagcagcaggggccggcu

SEQ ID NO: 895223 - RNA, 23 nt, Human
aggcaggaggccucaccccgggg

SEQ ID NO: 895224 - RNA, 21 nt, Human
aggccccagggguagcaguuu

SEQ ID NO: 895225 - RNA, 24 nt, Human
agguccccugcagcaagucagcuc

SEQ ID NO: 895226 - RNA, 23 nt, Human
agguggugcagcugcccgagcag

SEQ ID NO: 895227 - RNA, 20 nt, Human
caaacccuaagcugucuccu

SEQ ID NO: 895228 - RNA, 23 nt, Human
cacaggaccuggggcugggacag

SEQ ID NO: 895229 - RNA, 24 nt, Human
cacaggaccuggggcugggacagg

SEQ ID NO: 895230 - RNA, 20 nt, Human
caccaaacccuaagcugucu

SEQ ID NO: 895231 - RNA, 21 nt, Human
caccaaacccuaagcugucuc

SEQ ID NO: 895232 - RNA, 18 nt, Human
cacccugcagggcagggc

SEQ ID NO: 895233 - RNA, 24 nt, Human
cagaaacaagccccagcgcuuccc

SEQ ID NO: 895234 - RNA, 23 nt, Human
cagaaagacaaaccaaaacccau

SEQ ID NO: 895235 - RNA, 20 nt, Human
cagcagcaggggccggcucu

SEQ ID NO: 895236 - RNA, 21 nt, Human
cagcagcaggggccggcucug

SEQ ID NO: 895237 - RNA, 21 nt, Human
cagcagcaggggccggcucug

SEQ ID NO: 895238 - RNA, 21 nt, Human
cagggcacgcggugcaggugg

SEQ ID NO: 895239 - RNA, 22 nt, Human
cagguccccugcagcaagucag

SEQ ID NO: 895240 - RNA, 18 nt, Human
ccagagcuccucggugac

SEQ ID NO: 895241 - RNA, 21 nt, Human
ccccacguucgccaucuuccu

SEQ ID NO: 895242 - RNA, 18 nt, Human
ccccggcuggaguaagag

SEQ ID NO: 895243 - RNA, 20 nt, Human
ccccugcagcaagucagcuc

SEQ ID NO: 895244 - RNA, 23 nt, Human
cccggcccggcccgccgcucggc

SEQ ID NO: 895245 - RNA, 20 nt, Human
ccgcgcucgccuggaacugc

SEQ ID NO: 895246 - RNA, 21 nt, Human
ccggcccgccgcucggccccc

SEQ ID NO: 895247 - RNA, 19 nt, Human
ccuaagcugucuccuaaaa

SEQ ID NO: 895248 - RNA, 24 nt, Human
ccuggaacugcagccccacguucg

SEQ ID NO: 895249 - RNA, 18 nt, Human
ccuggggcugggacaggg

SEQ ID NO: 895250 - RNA, 26 nt, Human
ccuggggcugggacagggcaccaggc

SEQ ID NO: 895251 - RNA, 23 nt, Human
cgcaggugcccugcacaggaccu

SEQ ID NO: 895252 - RNA, 21 nt, Human
cgccccggcccugcccggccc

SEQ ID NO: 895253 - RNA, 20 nt, Human
cggcccggcccgccgcucgg

SEQ ID NO: 895254 - RNA, 21 nt, Human
cggcucacccugcagggcagg

SEQ ID NO: 895255 - RNA, 20 nt, Human
cuaaaacuucagcuguuucc

SEQ ID NO: 895256 - RNA, 25 nt, Human
cuaaaacuucagcuguuuccaccac

SEQ ID NO: 895257 - RNA, 19 nt, Human
cugacgaccagaaagacaa

SEQ ID NO: 895258 - RNA, 19 nt, Human
cugacgaccagaaagacaa

SEQ ID NO: 895259 - RNA, 20 nt, Human
gacccggggcugcagcuucc

SEQ ID NO: 895260 - RNA, 21 nt, Human
gaccuggggcugggacagggc

SEQ ID NO: 895261 - RNA, 18 nt, Human
gagcagcagcaggggccg

SEQ ID NO: 895262 - RNA, 22 nt, Human
gcaggugcccugcacaggaccu

SEQ ID NO: 895263 - RNA, 19 nt, Human
gccggcccacgccccggcc

SEQ ID NO: 895264 - RNA, 22 nt, Human
gcggugcagguggugcagcugc

SEQ ID NO: 895265 - RNA, 20 nt, Human
gcuguugugccggcucaccc

SEQ ID NO: 895266 - RNA, 23 nt, Human
ggaccuggggcugggacagggca

SEQ ID NO: 895267 - RNA, 24 nt, Human
ggaugcgcuggcagccccggcugg

SEQ ID NO: 895268 - RNA, 26 nt, Human
ggccgaggggcuguuguugccacugg

SEQ ID NO: 895269 - RNA, 26 nt, Human
gggcacgcggugcagguggugcagcu

SEQ ID NO: 895270 - RNA, 20 nt, Human
gggcugggcuggcuggaugc

SEQ ID NO: 895271 - RNA, 24 nt, Human
ggugcccugcacaggaccuggggc

SEQ ID NO: 895272 - RNA, 23 nt, Human
guugggguugagcgugcucaggg

SEQ ID NO: 895273 - RNA, 18 nt, Human
uaaaacuucagcuguuuc

SEQ ID NO: 895274 - RNA, 21 nt, Human
uaacaaacagaaacaagcccc

SEQ ID NO: 895275 - RNA, 23 nt, Human
uaacaaacagaaacaagccccag

SEQ ID NO: 895276 - RNA, 19 nt, Human
uaagagccuggcugucagc

SEQ ID NO: 895277 - RNA, 22 nt, Human
uacagaagaugucucaguccug

SEQ ID NO: 895278 - RNA, 23 nt, Human
uagcaguuuacagaagaugucuc

SEQ ID NO: 895279 - RNA, 22 nt, Human
ucacagggcugggcuggcugga

SEQ ID NO: 895280 - RNA, 21 nt, Human
ucagcuccaucuuucacaggg

SEQ ID NO: 895281 - RNA, 18 nt, Human
ucaguccuguaaguaaca

SEQ ID NO: 895282 - RNA, 21 nt, Human
uccaccaccacgcugacgacc

SEQ ID NO: 895283 - RNA, 25 nt, Human
uccaccaccacgcugacgacccuag

SEQ ID NO: 895284 - RNA, 19 nt, Human
uccccugcagcaagucagc

SEQ ID NO: 895285 - RNA, 22 nt, Human
ucccgguccccuccccguggcc

SEQ ID NO: 895286 - RNA, 18 nt, Human
ugaagugggcggccgagg

SEQ ID NO: 895287 - RNA, 19 nt, Human
ugacuguauuuaauugaac

SEQ ID NO: 895288 - RNA, 19 nt, Human
ugagcgugcucagggcagc

SEQ ID NO: 895289 - RNA, 23 nt, Human
ugcagcaagucagcuccaucuuu

SEQ ID NO: 895290 - RNA, 21 nt, Human
ugcccgagcagcagcaggggc

SEQ ID NO: 895291 - RNA, 22 nt, Human
ugcccuauaaaucagguccccu

SEQ ID NO: 895292 - RNA, 24 nt, Human
ugccggcccacgccccggcccugc

SEQ ID NO: 895293 - RNA, 19 nt, Human
ugcucagggcagccugccc

SEQ ID NO: 895294 - RNA, 21 nt, Human
uggaguaagagccuggcuguc

SEQ ID NO: 895295 - RNA, 18 nt, Human
uggcagccccggcuggag

SEQ ID NO: 895296 - RNA, 19 nt, Human
uucgccaucuuccugccgg

SEQ ID NO: 895297 - RNA, 18 nt, Human
uuugagggggcgguguga

SEQ ID NO: 895298 - RNA, 20 nt, Human
uuuuuuuuuuuugagggggc

SEQ ID NO: 895299 - RNA, 19 nt, Human
uuuuuuuuuuuuugagggg

SEQ ID NO: 895300 - RNA, 22 nt, Human
uuuuuuuuuuuuuuuuugaggg

SEQ ID NO: 895301 - RNA, 19 nt, Human
aacauugacacuuuugggu

SEQ ID NO: 895302 - RNA, 20 nt, Human
acccccagccucacaguagc

SEQ ID NO: 895303 - RNA, 20 nt, Human
accugcuguucccccacccc

SEQ ID NO: 895304 - RNA, 22 nt, Human
cacccccagccucacaguagcc

SEQ ID NO: 895305 - RNA, 23 nt, Human
cacccccagccucacaguagccu

SEQ ID NO: 895306 - RNA, 21 nt, Human
caccuacccuccuacagccac

SEQ ID NO: 895307 - RNA, 19 nt, Human
cccacccccagccucacag

SEQ ID NO: 895308 - RNA, 23 nt, Human
cccacccccagccucacaguagc

SEQ ID NO: 895309 - RNA, 18 nt, Human
cccauggcgcccccagga

SEQ ID NO: 895310 - RNA, 21 nt, Human
ccuccuacagccaccccaacc

SEQ ID NO: 895311 - RNA, 26 nt, Human
cucccauggcgcccccaggacuucau

SEQ ID NO: 895312 - RNA, 19 nt, Human
cugcuguucccccaccccc

SEQ ID NO: 895313 - RNA, 23 nt, Human
uacccuccuacagccaccccaac

SEQ ID NO: 895314 - RNA, 20 nt, Human
uaggggaaucuagagcaggc

SEQ ID NO: 895315 - RNA, 20 nt, Human
ucccccacccccagccucac

SEQ ID NO: 895316 - RNA, 19 nt, Human
ccgcuaaggggcacccagg

SEQ ID NO: 895317 - RNA, 22 nt, Human
ccgcuaaggggcacccagguac

SEQ ID NO: 895318 - RNA, 24 nt, Human
gaagugcaaagccacaaaaagcaa

SEQ ID NO: 895319 - RNA, 21 nt, Human
gcgcggcaaagaaaaggaagc

SEQ ID NO: 895320 - RNA, 21 nt, Human
ggcaaagaaaaggaagcauca

SEQ ID NO: 895321 - RNA, 20 nt, Human
uagaguuaggauuaucacac

SEQ ID NO: 895322 - RNA, 22 nt, Human
uaguagaguuaggauuaucaca

SEQ ID NO: 895323 - RNA, 19 nt, Human
ucaccauuacuuggcucca

SEQ ID NO: 895324 - RNA, 23 nt, Human
ucaguaucaccauuacuuggcuc

SEQ ID NO: 895325 - RNA, 19 nt, Human
ucucuagaaauauauuuau

SEQ ID NO: 895326 - RNA, 18 nt, Human
ugcaaagccacaaaaagc

SEQ ID NO: 895327 - RNA, 18 nt, Human
ugcaaagccacaaaaagc

SEQ ID NO: 895328 - RNA, 23 nt, Human
uuaauuuuuuugccagagagggc

SEQ ID NO: 895329 - RNA, 23 nt, Human
uuuuuuuuuuuuuuuuuuaacug

SEQ ID NO: 895330 - RNA, 22 nt, Human
aaaaacaaaaagguaacaaaac

SEQ ID NO: 895331 - RNA, 19 nt, Human
aaaaagguaacaaaaccau

SEQ ID NO: 895332 - RNA, 21 nt, Human
aaaaggcaggcaaaagguaca

SEQ ID NO: 895333 - RNA, 23 nt, Human
aaacaauaacagaaacacaucaa

SEQ ID NO: 895334 - RNA, 22 nt, Human
aaagagaggaggaaagaggagg

SEQ ID NO: 895335 - RNA, 24 nt, Human
aaagugcugggauuacaggcguga

SEQ ID NO: 895336 - RNA, 19 nt, Human
aacaaaaaggcaggcaaaa

SEQ ID NO: 895337 - RNA, 18 nt, Human
aacagaaacacaucaagc

SEQ ID NO: 895338 - RNA, 19 nt, Human
aacauggagggggaagaac

SEQ ID NO: 895339 - RNA, 22 nt, Human
aacccaugacuggcugcauccc

SEQ ID NO: 895340 - RNA, 18 nt, Human
aaccuugcccuggacucu

SEQ ID NO: 895341 - RNA, 22 nt, Human
aagcaagaguuggagaagcagc

SEQ ID NO: 895342 - RNA, 18 nt, Human
aagcaggaucugggcgcg

SEQ ID NO: 895343 - RNA, 21 nt, Human
aagcgagggccucagcucacg

SEQ ID NO: 895344 - RNA, 19 nt, Human
aagcgcccagggaucauaa

SEQ ID NO: 895345 - RNA, 19 nt, Human
aagggcugaagcucuggcc

SEQ ID NO: 895346 - RNA, 19 nt, Human
aaggggucggaacacgucu

SEQ ID NO: 895347 - RNA, 28 nt, Human
aaguccccaaaguggcaggcaagggagg

SEQ ID NO: 895348 - RNA, 24 nt, Human
aagugaucugccugucucagccuc

SEQ ID NO: 895349 - RNA, 19 nt, Human
aagugcugggauuacaggc

SEQ ID NO: 895350 - RNA, 19 nt, Human
aagugcugggauuacaggc

SEQ ID NO: 895351 - RNA, 21 nt, Human
aagugguggcaaggggauugg

SEQ ID NO: 895352 - RNA, 21 nt, Human
aauaacagaaacacaucaagc

SEQ ID NO: 895353 - RNA, 22 nt, Human
aauccuacccuacugggggugc

SEQ ID NO: 895354 - RNA, 18 nt, Human
aauuucccuccccuuccc

SEQ ID NO: 895355 - RNA, 26 nt, Human
acaaaacagggagaggagaaaggggc

SEQ ID NO: 895356 - RNA, 21 nt, Human
acaauaacagaaacacaucaa

SEQ ID NO: 895357 - RNA, 24 nt, Human
acaauccuacccuacugggggugc

SEQ ID NO: 895358 - RNA, 25 nt, Human
acacacacacacacacgcacacaca

SEQ ID NO: 895359 - RNA, 23 nt, Human
acacacauacacacacacacaca

SEQ ID NO: 895360 - RNA, 22 nt, Human
acacauucccugaagcagcuga

SEQ ID NO: 895361 - RNA, 23 nt, Human
accucagcucuccauucugccga

SEQ ID NO: 895362 - RNA, 19 nt, Human
acgcacacacacgcacaca

SEQ ID NO: 895363 - RNA, 19 nt, Human
acucagguggggacagggg

SEQ ID NO: 895364 - RNA, 20 nt, Human
acugcaaccuccaccuccuc

SEQ ID NO: 895365 - RNA, 21 nt, Human
acugcagcccuuuggccuccu

SEQ ID NO: 895366 - RNA, 21 nt, Human
acugcuucaugcuucucccca

SEQ ID NO: 895367 - RNA, 19 nt, Human
agacacuugacccagcacu

SEQ ID NO: 895368 - RNA, 18 nt, Human
agagaggaggaaagagga

SEQ ID NO: 895369 - RNA, 21 nt, Human
agagaggaggaaagaggagga

SEQ ID NO: 895370 - RNA, 19 nt, Human
agagcccuuccuguccaaa

SEQ ID NO: 895371 - RNA, 23 nt, Human
agaggucucaucuucacugugac

SEQ ID NO: 895372 - RNA, 30 nt, Human
agcagaagauaggaaaagcgggacccaaaa

SEQ ID NO: 895373 - RNA, 21 nt, Human
agccagggagcaugcagcugc

SEQ ID NO: 895374 - RNA, 18 nt, Human
agccccccggccugcagc

SEQ ID NO: 895375 - RNA, 20 nt, Human
agccccuggacguaaccccc

SEQ ID NO: 895376 - RNA, 19 nt, Human
agcuggguggccuugaggg

SEQ ID NO: 895377 - RNA, 18 nt, Human
aggaaagaggaggaagag

SEQ ID NO: 895378 - RNA, 19 nt, Human
aggaaagaggaggaagagg

SEQ ID NO: 895379 - RNA, 27 nt, Human
aggaagagggaggcauggguggggggg

SEQ ID NO: 895380 - RNA, 28 nt, Human
aggaagagggaggcaugggugggggggg

SEQ ID NO: 895381 - RNA, 20 nt, Human
aggagcagcucaggauguga

SEQ ID NO: 895382 - RNA, 21 nt, Human
aggaggaaagaggaggaagag

SEQ ID NO: 895383 - RNA, 22 nt, Human
aggaggaagagggaggcauggg

SEQ ID NO: 895384 - RNA, 18 nt, Human
aggaggggggacucagug

SEQ ID NO: 895385 - RNA, 24 nt, Human
aggaggggggacucagugcugggg

SEQ ID NO: 895386 - RNA, 23 nt, Human
aggcaacauggagggggaagaac

SEQ ID NO: 895387 - RNA, 19 nt, Human
aggcaggcaaaagguacag

SEQ ID NO: 895388 - RNA, 19 nt, Human
aggcaugcaccaccuaacc

SEQ ID NO: 895389 - RNA, 23 nt, Human
aggcgugagccaccgugcccggc

SEQ ID NO: 895390 - RNA, 26 nt, Human
agggacaccucagcucuccauucugc

SEQ ID NO: 895391 - RNA, 18 nt, Human
agggagcugguuuuuuac

SEQ ID NO: 895392 - RNA, 20 nt, Human
aggggacacacucgcagggc

SEQ ID NO: 895393 - RNA, 21 nt, Human
aggggcagcagaagauaggaa

SEQ ID NO: 895394 - RNA, 22 nt, Human
agggggaagaacacugaagagg

SEQ ID NO: 895395 - RNA, 23 nt, Human
agggggaagaacacugaagaggg

SEQ ID NO: 895396 - RNA, 21 nt, Human
aggggggacucagugcugggg

SEQ ID NO: 895397 - RNA, 21 nt, Human
aggggucggaacacgucugga

SEQ ID NO: 895398 - RNA, 23 nt, Human
agggugcugggacacacaaagga

SEQ ID NO: 895399 - RNA, 23 nt, Human
aggugacuagcaggggagggaca

SEQ ID NO: 895400 - RNA, 18 nt, Human
agguguggguacagguga

SEQ ID NO: 895401 - RNA, 19 nt, Human
aguagcugggacuacaggc

SEQ ID NO: 895402 - RNA, 21 nt, Human
aguagcugggacuacaggcau

SEQ ID NO: 895403 - RNA, 23 nt, Human
aguagcugggacuacaggcaugc

SEQ ID NO: 895404 - RNA, 24 nt, Human
agugaucugccugucucagccucc

SEQ ID NO: 895405 - RNA, 20 nt, Human
agugcaauggcgugaucucg

SEQ ID NO: 895406 - RNA, 24 nt, Human
agugcaauggcgugaucucggcuc

SEQ ID NO: 895407 - RNA, 18 nt, Human
agugcugggauuacaggc

SEQ ID NO: 895408 - RNA, 24 nt, Human
aguuuuguauuuuuagugaagaug

SEQ ID NO: 895409 - RNA, 25 nt, Human
auagggaacaaaaaggcaggcaaaa

SEQ ID NO: 895410 - RNA, 22 nt, Human
aucacacacacauacacacaca

SEQ ID NO: 895411 - RNA, 20 nt, Human
auccaaagggagcugguuuu

SEQ ID NO: 895412 - RNA, 19 nt, Human
aucuggagagcaaaugacc

SEQ ID NO: 895413 - RNA, 24 nt, Human
augacacagaucacacacacauac

SEQ ID NO: 895414 - RNA, 18 nt, Human
augggcagggaggguggg

SEQ ID NO: 895415 - RNA, 18 nt, Human
augggguuucaccacguu

SEQ ID NO: 895416 - RNA, 20 nt, Human
augggguuucaccacguugg

SEQ ID NO: 895417 - RNA, 24 nt, Human
augggguuucaccacguuggccag

SEQ ID NO: 895418 - RNA, 19 nt, Human
augucacagugucagacaa

SEQ ID NO: 895419 - RNA, 23 nt, Human
caaaaacaaaaagguaacaaaac

SEQ ID NO: 895420 - RNA, 21 nt, Human
caaaaaggcaggcaaaaggua

SEQ ID NO: 895421 - RNA, 18 nt, Human
caagcaagaguuggagaa

SEQ ID NO: 895422 - RNA, 22 nt, Human
caagugaucugccugucucagc

SEQ ID NO: 895423 - RNA, 22 nt, Human
caauaacagaaacacaucaagc

SEQ ID NO: 895424 - RNA, 22 nt, Human
cacacacauacacacacacaca

SEQ ID NO: 895425 - RNA, 22 nt, Human
cacacauacacacacacacaca

SEQ ID NO: 895426 - RNA, 18 nt, Human
cacacucagccugggccc

SEQ ID NO: 895427 - RNA, 22 nt, Human
cacacucagccugggcccaugu

SEQ ID NO: 895428 - RNA, 18 nt, Human
cacagaucacacacacau

SEQ ID NO: 895429 - RNA, 18 nt, Human
caccaaggggacccuggc

SEQ ID NO: 895430 - RNA, 22 nt, Human
caccacguuggccaggcugacu

SEQ ID NO: 895431 - RNA, 23 nt, Human
caccacguuggccaggcugacuu

SEQ ID NO: 895432 - RNA, 26 nt, Human
caccacguuggccaggcugacuucga

SEQ ID NO: 895433 - RNA, 20 nt, Human
caccaggcagaugacaucac

SEQ ID NO: 895434 - RNA, 21 nt, Human
caccaggcagaugacaucacc

SEQ ID NO: 895435 - RNA, 24 nt, Human
cacguuggccaggcugacuucgaa

SEQ ID NO: 895436 - RNA, 20 nt, Human
cacucagccugggcccaugu

SEQ ID NO: 895437 - RNA, 31 nt, Human
cagcagaagauaggaaaagcgggacccaaaa

SEQ ID NO: 895438 - RNA, 21 nt, Human
cagccaggagcagcucaggau

SEQ ID NO: 895439 - RNA, 21 nt, Human
cagccccuggacguaaccccc

SEQ ID NO: 895440 - RNA, 24 nt, Human
cagcccuuuggccuccuggggucu

SEQ ID NO: 895441 - RNA, 18 nt, Human
cagcugagcccccuggca

SEQ ID NO: 895442 - RNA, 21 nt, Human
caggacaaacacgggcuccau

SEQ ID NO: 895443 - RNA, 24 nt, Human
caggcgugagccaccgugcccggc

SEQ ID NO: 895444 - RNA, 22 nt, Human
cagggcauucuggagguguggg

SEQ ID NO: 895445 - RNA, 21 nt, Human
cagggcuggcuaggaaccaag

SEQ ID NO: 895446 - RNA, 24 nt, Human
cagugggauuguacuggaggggcu

SEQ ID NO: 895447 - RNA, 19 nt, Human
caucccauccacugccgag

SEQ ID NO: 895448 - RNA, 22 nt, Human
caugcaagugcugucaccuccu

SEQ ID NO: 895449 - RNA, 22 nt, Human
caugcaccaccuaaccagcuaa

SEQ ID NO: 895450 - RNA, 22 nt, Human
ccaaagugcugggauuacaggc

SEQ ID NO: 895451 - RNA, 22 nt, Human
ccaaagugcugggauuacaggc

SEQ ID NO: 895452 - RNA, 24 nt, Human
ccaaagugcugggauuacaggcgu

SEQ ID NO: 895453 - RNA, 21 nt, Human
ccacugcccuugacuggcagc

SEQ ID NO: 895454 - RNA, 20 nt, Human
ccacugggccuguugcaugg

SEQ ID NO: 895455 - RNA, 23 nt, Human
ccagagguggggucuccugggcc

SEQ ID NO: 895456 - RNA, 24 nt, Human
ccagcaacagugccaguaugauga

SEQ ID NO: 895457 - RNA, 22 nt, Human
ccagcccaggcugaagcggucc

SEQ ID NO: 895458 - RNA, 21 nt, Human
ccagcuggguggccuugaggg

SEQ ID NO: 895459 - RNA, 20 nt, Human
ccaggcccagagagggcagg

SEQ ID NO: 895460 - RNA, 22 nt, Human
ccauugccuuuucuuccagugg

SEQ ID NO: 895461 - RNA, 21 nt, Human
cccaggcuggagugcaauggc

SEQ ID NO: 895462 - RNA, 21 nt, Human
cccagggaucauaaccuccuc

SEQ ID NO: 895463 - RNA, 20 nt, Human
cccauccuucucccaagucc

SEQ ID NO: 895464 - RNA, 23 nt, Human
cccgaguagcugggacuacaggc

SEQ ID NO: 895465 - RNA, 24 nt, Human
cccgaguagcugggacuacaggca

SEQ ID NO: 895466 - RNA, 21 nt, Human
cccugugggcugggaaagggg

SEQ ID NO: 895467 - RNA, 21 nt, Human
cccuuuggccuccuggggucu

SEQ ID NO: 895468 - RNA, 18 nt, Human
ccgaagcgcccagggauc

SEQ ID NO: 895469 - RNA, 24 nt, Human
ccgccauugccuuuucuuccagug

SEQ ID NO: 895470 - RNA, 20 nt, Human
ccggagccggagcuggagcu

SEQ ID NO: 895471 - RNA, 24 nt, Human
ccuaagaccccauccuucucccaa

SEQ ID NO: 895472 - RNA, 19 nt, Human
ccuccuggggucuuugucc

SEQ ID NO: 895473 - RNA, 21 nt, Human
ccugaccucaagugaucugcc

SEQ ID NO: 895474 - RNA, 23 nt, Human
ccugaccucaagugaucugccug

SEQ ID NO: 895475 - RNA, 21 nt, Human
ccuggcccuggggcuggccca

SEQ ID NO: 895476 - RNA, 22 nt, Human
ccuggcccuggggcuggcccac

SEQ ID NO: 895477 - RNA, 20 nt, Human
ccuggggucuuuguccccuu

SEQ ID NO: 895478 - RNA, 24 nt, Human
ccuggggucuuuguccccuucccu

SEQ ID NO: 895479 - RNA, 19 nt, Human
ccugguaggugacuagcag

SEQ ID NO: 895480 - RNA, 20 nt, Human
ccuucacuucaagcccugug

SEQ ID NO: 895481 - RNA, 25 nt, Human
cgaaauggaaagcaggaucugggcg

SEQ ID NO: 895482 - RNA, 21 nt, Human
cgaguccugggaucuaccccu

SEQ ID NO: 895483 - RNA, 19 nt, Human
cgcccgaggcccccggcag

SEQ ID NO: 895484 - RNA, 19 nt, Human
cgcgcugggccgagcgggg

SEQ ID NO: 895485 - RNA, 21 nt, Human
cggagccggagccggagccgg

SEQ ID NO: 895486 - RNA, 21 nt, Human
cggagccggagccggagccgg

SEQ ID NO: 895487 - RNA, 21 nt, Human
cggagccggagccggagcugg

SEQ ID NO: 895488 - RNA, 21 nt, Human
cgggagaugcucagcuuccuu

SEQ ID NO: 895489 - RNA, 23 nt, Human
cucaagugaucugccugucucag

SEQ ID NO: 895490 - RNA, 23 nt, Human
cucacugcaaccuccaccuccuc

SEQ ID NO: 895491 - RNA, 25 nt, Human
cucacugcaaccuccaccuccucag

SEQ ID NO: 895492 - RNA, 26 nt, Human
cuccugaccucaagugaucugccugu

SEQ ID NO: 895493 - RNA, 24 nt, Human
cucggccucccgaguagcugggac

SEQ ID NO: 895494 - RNA, 22 nt, Human
cucugccccaugcucugugauc

SEQ ID NO: 895495 - RNA, 22 nt, Human
cucugggagggagccccuuucc

SEQ ID NO: 895496 - RNA, 20 nt, Human
cucuguugcccaggcuggag

SEQ ID NO: 895497 - RNA, 21 nt, Human
cugagcuaaagaagggcugaa

SEQ ID NO: 895498 - RNA, 20 nt, Human
cugagucucugcugacccua

SEQ ID NO: 895499 - RNA, 19 nt, Human
cugcaaccuccaccuccuc

SEQ ID NO: 895500 - RNA, 18 nt, Human
cugccgaagcgcccaggg

SEQ ID NO: 895501 - RNA, 23 nt, Human
cugccucggccucccgaguagcu

SEQ ID NO: 895502 - RNA, 23 nt, Human
cuggugcagggcuuggccccaag

SEQ ID NO: 895503 - RNA, 21 nt, Human
cugguggaaagagggaggagg

SEQ ID NO: 895504 - RNA, 23 nt, Human
cugucucagccucccaaagugcu

SEQ ID NO: 895505 - RNA, 24 nt, Human
cugucucagccucccaaagugcug

SEQ ID NO: 895506 - RNA, 19 nt, Human
cuguugcccaggcuggagu

SEQ ID NO: 895507 - RNA, 21 nt, Human
cuugagacgcuccuccccacu

SEQ ID NO: 895508 - RNA, 24 nt, Human
gaaauggaaagcaggaucugggcg

SEQ ID NO: 895509 - RNA, 19 nt, Human
gaaccuugcccuggacucu

SEQ ID NO: 895510 - RNA, 23 nt, Human
gaacucuuccccauuucucacaa

SEQ ID NO: 895511 - RNA, 25 nt, Human
gaagggcugaagcucuggcccaugg

SEQ ID NO: 895512 - RNA, 28 nt, Human
gaccccauccuucucccaaguccuccac

SEQ ID NO: 895513 - RNA, 24 nt, Human
gaccucaagugaucugccugucuc

SEQ ID NO: 895514 - RNA, 19 nt, Human
gacuagcaggggagggaca

SEQ ID NO: 895515 - RNA, 20 nt, Human
gacugcagcccuuuggccuc

SEQ ID NO: 895516 - RNA, 24 nt, Human
gagcaauggugcccagauggcacu

SEQ ID NO: 895517 - RNA, 21 nt, Human
gagccccccggccugcagcuc

SEQ ID NO: 895518 - RNA, 20 nt, Human
gagccggagccggagccgga

SEQ ID NO: 895519 - RNA, 20 nt, Human
gagccggagccggagccgga

SEQ ID NO: 895520 - RNA, 20 nt, Human
gagccggagccggagccgga

SEQ ID NO: 895521 - RNA, 20 nt, Human
gagccggagccggagcugga

SEQ ID NO: 895522 - RNA, 24 nt, Human
gagcugguuuuuuacaauccaugc

SEQ ID NO: 895523 - RNA, 22 nt, Human
gaggaagagggaggcaugggug

SEQ ID NO: 895524 - RNA, 24 nt, Human
gaguagcugggacuacaggcaugc

SEQ ID NO: 895525 - RNA, 20 nt, Human
gaguccugggaucuaccccu

SEQ ID NO: 895526 - RNA, 21 nt, Human
gaucugccugucucagccucc

SEQ ID NO: 895527 - RNA, 18 nt, Human
gauuacaggcgugagcca

SEQ ID NO: 895528 - RNA, 21 nt, Human
gauuacaggcgugagccaccg

SEQ ID NO: 895529 - RNA, 24 nt, Human
gauuacaggcgugagccaccgugc

SEQ ID NO: 895530 - RNA, 22 nt, Human
gcaaccuccaccuccucaguuc

SEQ ID NO: 895531 - RNA, 19 nt, Human
gcaaggggauugguccccu

SEQ ID NO: 895532 - RNA, 19 nt, Human
gcaagugcugucaccuccu

SEQ ID NO: 895533 - RNA, 18 nt, Human
gcacagccaggagugggg

SEQ ID NO: 895534 - RNA, 25 nt, Human
gcagugccagauggcaggacaaaca

SEQ ID NO: 895535 - RNA, 19 nt, Human
gcauggguggggggggggg

SEQ ID NO: 895536 - RNA, 24 nt, Human
gcccaggcuggagugcaauggcgu

SEQ ID NO: 895537 - RNA, 18 nt, Human
gccccccggccugcagcc

SEQ ID NO: 895538 - RNA, 18 nt, Human
gcccuggacucugagucc

SEQ ID NO: 895539 - RNA, 21 nt, Human
gcccugugggcugggaaaggg

SEQ ID NO: 895540 - RNA, 21 nt, Human
gccucggccucccgaguagcu

SEQ ID NO: 895541 - RNA, 20 nt, Human
gccugggcccaugugagccc

SEQ ID NO: 895542 - RNA, 19 nt, Human
gccuugagggucgcucccc

SEQ ID NO: 895543 - RNA, 28 nt, Human
gcgcggcggcggggucggggcgcggagg

SEQ ID NO: 895544 - RNA, 20 nt, Human
gcggcggcggggucggggcg

SEQ ID NO: 895545 - RNA, 21 nt, Human
gcggcgggggcgcccgaggcc

SEQ ID NO: 895546 - RNA, 23 nt, Human
gcucacugcuucaugcuucuccc

SEQ ID NO: 895547 - RNA, 20 nt, Human
gcucccagcccaggcugaag

SEQ ID NO: 895548 - RNA, 27 nt, Human
gcucuguugcccaggcuggagugcaau

SEQ ID NO: 895549 - RNA, 23 nt, Human
gcugacuucgaacuccugaccuc

SEQ ID NO: 895550 - RNA, 22 nt, Human
gcuggagcugggaaaggaaugu

SEQ ID NO: 895551 - RNA, 19 nt, Human
gcuggagugcaauggcgug

SEQ ID NO: 895552 - RNA, 18 nt, Human
ggaaagaggaggaagagg

SEQ ID NO: 895553 - RNA, 18 nt, Human
ggaaaggaauguccugga

SEQ ID NO: 895554 - RNA, 21 nt, Human
ggaacaaaaaggcaggcaaaa

SEQ ID NO: 895555 - RNA, 24 nt, Human
ggaagaucuggcagauaacagcug

SEQ ID NO: 895556 - RNA, 18 nt, Human
ggacccuggcccuggggc

SEQ ID NO: 895557 - RNA, 18 nt, Human
ggagaaaggggcaaggcu

SEQ ID NO: 895558 - RNA, 20 nt, Human
ggagaaaggggcaaggcugg

SEQ ID NO: 895559 - RNA, 21 nt, Human
ggagacugagguggggcuggg

SEQ ID NO: 895560 - RNA, 19 nt, Human
ggaggggggacucagugcu

SEQ ID NO: 895561 - RNA, 23 nt, Human
ggagucuugcucuguugcccagg

SEQ ID NO: 895562 - RNA, 20 nt, Human
ggcaaggcuggggagggguu

SEQ ID NO: 895563 - RNA, 18 nt, Human
ggcaggagggaaggccag

SEQ ID NO: 895564 - RNA, 23 nt, Human
ggccgagcggggcaggcgcggga

SEQ ID NO: 895565 - RNA, 24 nt, Human
ggcgcggcggcggggucggggcga

SEQ ID NO: 895566 - RNA, 18 nt, Human
ggcggcgggggcgcccga

SEQ ID NO: 895567 - RNA, 22 nt, Human
ggcuggagugcaauggcgugau

SEQ ID NO: 895568 - RNA, 20 nt, Human
gggaaaggaauguccuggag

SEQ ID NO: 895569 - RNA, 19 nt, Human
gggagaugcucagcuuccu

SEQ ID NO: 895570 - RNA, 18 nt, Human
gggcaggagggaaggcca

SEQ ID NO: 895571 - RNA, 19 nt, Human
gggcaggagggaaggccag

SEQ ID NO: 895572 - RNA, 19 nt, Human
gggcaggcucccacuguuc

SEQ ID NO: 895573 - RNA, 18 nt, Human
gggcagggaggguggggu

SEQ ID NO: 895574 - RNA, 23 nt, Human
gggcggcgggggcgcccgaggcc

SEQ ID NO: 895575 - RNA, 18 nt, Human
gggcucaagugaccaugc

SEQ ID NO: 895576 - RNA, 20 nt, Human
ggggcagcagaagauaggaa

SEQ ID NO: 895577 - RNA, 18 nt, Human
gggguuucaccacguugg

SEQ ID NO: 895578 - RNA, 22 nt, Human
gggguuucaccacguuggccag

SEQ ID NO: 895579 - RNA, 25 nt, Human
gggugggaggugggggucuggggug

SEQ ID NO: 895580 - RNA, 22 nt, Human
ggguuucaccacguuggccagg

SEQ ID NO: 895581 - RNA, 27 nt, Human
gguagguaauguggcucugccagaggu

SEQ ID NO: 895582 - RNA, 24 nt, Human
ggugacugcagcccuuuggccucc

SEQ ID NO: 895583 - RNA, 24 nt, Human
gguggaaagagggaggaggguaag

SEQ ID NO: 895584 - RNA, 21 nt, Human
ggugggaggugggggucuggg

SEQ ID NO: 895585 - RNA, 18 nt, Human
gguggggggggggggagg

SEQ ID NO: 895586 - RNA, 20 nt, Human
gguguugcauaaaggaagau

SEQ ID NO: 895587 - RNA, 24 nt, Human
guagguaauguggcucugccagag

SEQ ID NO: 895588 - RNA, 19 nt, Human
gucacagugucagacaacu

SEQ ID NO: 895589 - RNA, 21 nt, Human
gucccaggugaugcaaagugg

SEQ ID NO: 895590 - RNA, 24 nt, Human
gugaucugccugucucagccuccc

SEQ ID NO: 895591 - RNA, 20 nt, Human
gugcugggacacacaaagga

SEQ ID NO: 895592 - RNA, 22 nt, Human
gugcuggggaaauuuguuccug

SEQ ID NO: 895593 - RNA, 21 nt, Human
gugggggucugggguggcagg

SEQ ID NO: 895594 - RNA, 24 nt, Human
guggucccaggugaugcaaagugg

SEQ ID NO: 895595 - RNA, 19 nt, Human
uaacagaaacacaucaagc

SEQ ID NO: 895596 - RNA, 20 nt, Human
uaaccuccuccccgcacuuc

SEQ ID NO: 895597 - RNA, 25 nt, Human
uaaccucugauguccucgucauccc

SEQ ID NO: 895598 - RNA, 21 nt, Human
uaaguuuuguauuuuuaguga

SEQ ID NO: 895599 - RNA, 23 nt, Human
uacaggcgugagccaccgugccc

SEQ ID NO: 895600 - RNA, 21 nt, Human
uaccaguggccaucacuaugg

SEQ ID NO: 895601 - RNA, 22 nt, Human
uaccaguggccaucacuauggg

SEQ ID NO: 895602 - RNA, 24 nt, Human
uagcugagcuaaagaagggcugaa

SEQ ID NO: 895603 - RNA, 24 nt, Human
uagugaagaugggguuucaccacg

SEQ ID NO: 895604 - RNA, 20 nt, Human
uaugaccccccucaaguccc

SEQ ID NO: 895605 - RNA, 21 nt, Human
uauuuuuuugagauggagucu

SEQ ID NO: 895606 - RNA, 23 nt, Human
ucacacacacauacacacacaca

SEQ ID NO: 895607 - RNA, 20 nt, Human
ucaccaaggggacccuggcc

SEQ ID NO: 895608 - RNA, 20 nt, Human
ucaccagagcuuuccccaca

SEQ ID NO: 895609 - RNA, 23 nt, Human
ucaccccagcaacagugccagua

SEQ ID NO: 895610 - RNA, 19 nt, Human
ucacugcaaccuccaccuc

SEQ ID NO: 895611 - RNA, 22 nt, Human
ucacugcaaccuccaccuccuc

SEQ ID NO: 895612 - RNA, 24 nt, Human
ucacugcaaccuccaccuccucag

SEQ ID NO: 895613 - RNA, 28 nt, Human
ucacugcaaccuccaccuccucaguuca

SEQ ID NO: 895614 - RNA, 19 nt, Human
ucaggccaagggugcuggg

SEQ ID NO: 895615 - RNA, 19 nt, Human
uccaaguccuguccuuggc

SEQ ID NO: 895616 - RNA, 19 nt, Human
uccaccuccucaguucaag

SEQ ID NO: 895617 - RNA, 22 nt, Human
uccagcuggguggccuugaggg

SEQ ID NO: 895618 - RNA, 24 nt, Human
ucccaaagugcugggauuacaggc

SEQ ID NO: 895619 - RNA, 18 nt, Human
ucccaaguccuccacaag

SEQ ID NO: 895620 - RNA, 21 nt, Human
uccccgggcuucagcuuccuc

SEQ ID NO: 895621 - RNA, 24 nt, Human
uccccgggcuucagcuuccucauc

SEQ ID NO: 895622 - RNA, 24 nt, Human
ucccgaguagcugggacuacaggc

SEQ ID NO: 895623 - RNA, 26 nt, Human
ucccugaacucuuccccauuucucac

SEQ ID NO: 895624 - RNA, 23 nt, Human
ucccugaagcagcugagcccccu

SEQ ID NO: 895625 - RNA, 19 nt, Human
ucgcuccccuccccgggcu

SEQ ID NO: 895626 - RNA, 23 nt, Human
ucggccucccgaguagcugggac

SEQ ID NO: 895627 - RNA, 20 nt, Human
ucuacagccuguuguggccc

SEQ ID NO: 895628 - RNA, 21 nt, Human
ucuacagccuguuguggcccc

SEQ ID NO: 895629 - RNA, 19 nt, Human
ucugccgaagcgcccaggg

SEQ ID NO: 895630 - RNA, 23 nt, Human
ucuggcagauaacagcugggaag

SEQ ID NO: 895631 - RNA, 18 nt, Human
ucuguugcccaggcugga

SEQ ID NO: 895632 - RNA, 24 nt, Human
ucuguugcccaggcuggagugcaa

SEQ ID NO: 895633 - RNA, 23 nt, Human
ucuugcucuguugcccaggcugg

SEQ ID NO: 895634 - RNA, 24 nt, Human
ucuugcucuguugcccaggcugga

SEQ ID NO: 895635 - RNA, 21 nt, Human
ugaagcucuggcccauggugg

SEQ ID NO: 895636 - RNA, 21 nt, Human
ugaaguucugaauucugccgu

SEQ ID NO: 895637 - RNA, 22 nt, Human
ugaaugcagucagaaggcuggg

SEQ ID NO: 895638 - RNA, 18 nt, Human
ugacaugcucacucacac

SEQ ID NO: 895639 - RNA, 18 nt, Human
ugaccucaagugaucugc

SEQ ID NO: 895640 - RNA, 20 nt, Human
ugaccucaagugaucugccu

SEQ ID NO: 895641 - RNA, 20 nt, Human
ugacugcagcccuuuggccu

SEQ ID NO: 895642 - RNA, 20 nt, Human
ugacugggccaugucugacu

SEQ ID NO: 895643 - RNA, 21 nt, Human
ugacugggccaugucugacuc

SEQ ID NO: 895644 - RNA, 20 nt, Human
ugacuucgaacuccugaccu

SEQ ID NO: 895645 - RNA, 20 nt, Human
ugagccccuuccccacccag

SEQ ID NO: 895646 - RNA, 24 nt, Human
ugaggaaggccaggcccagagagg

SEQ ID NO: 895647 - RNA, 25 nt, Human
ugaggaaggccaggcccagagaggg

SEQ ID NO: 895648 - RNA, 25 nt, Human
ugaggcgggcggcgggggcgccccc

SEQ ID NO: 895649 - RNA, 23 nt, Human
ugagggcuuuggccucuucucag

SEQ ID NO: 895650 - RNA, 18 nt, Human
ugaugagacacuugaccc

SEQ ID NO: 895651 - RNA, 24 nt, Human
ugcaccaccuaaccagcuaaguuu

SEQ ID NO: 895652 - RNA, 22 nt, Human
ugcaugggggacaagggggcgg

SEQ ID NO: 895653 - RNA, 23 nt, Human
ugcaugggggacaagggggcggg

SEQ ID NO: 895654 - RNA, 21 nt, Human
ugccagagguggggucuccug

SEQ ID NO: 895655 - RNA, 24 nt, Human
ugccagagguggggucuccugggc

SEQ ID NO: 895656 - RNA, 18 nt, Human
ugcccaggcuggagugca

SEQ ID NO: 895657 - RNA, 21 nt, Human
ugcccaggcuggagugcaaug

SEQ ID NO: 895658 - RNA, 21 nt, Human
ugcccaggcuggagugcaaug

SEQ ID NO: 895659 - RNA, 24 nt, Human
ugcccaggcuggagugcaauggcg

SEQ ID NO: 895660 - RNA, 20 nt, Human
ugccccaggaccaugcacag

SEQ ID NO: 895661 - RNA, 18 nt, Human
ugccgaagcgcccaggga

SEQ ID NO: 895662 - RNA, 20 nt, Human
ugccgaagcgcccagggauc

SEQ ID NO: 895663 - RNA, 21 nt, Human
ugccucggccucccgaguagc

SEQ ID NO: 895664 - RNA, 24 nt, Human
ugccucggccucccgaguagcugg

SEQ ID NO: 895665 - RNA, 20 nt, Human
ugccucuguuccuucacuuc

SEQ ID NO: 895666 - RNA, 24 nt, Human
ugcugggauuacaggcgugagcca

SEQ ID NO: 895667 - RNA, 24 nt, Human
uggaaagagggaggaggguaaguc

SEQ ID NO: 895668 - RNA, 22 nt, Human
uggagaagcagcaauuucccuc

SEQ ID NO: 895669 - RNA, 18 nt, Human
uggagacugagguggggc

SEQ ID NO: 895670 - RNA, 24 nt, Human
uggagucuugcucuguugcccagg

SEQ ID NO: 895671 - RNA, 19 nt, Human
uggagugcaauggcgugau

SEQ ID NO: 895672 - RNA, 23 nt, Human
uggagugcaauggcgugaucucg

SEQ ID NO: 895673 - RNA, 24 nt, Human
uggagugcaauggcgugaucucgg

SEQ ID NO: 895674 - RNA, 19 nt, Human
uggcaaccuaggucucagc

SEQ ID NO: 895675 - RNA, 19 nt, Human
uggcacggcuucaccaagg

SEQ ID NO: 895676 - RNA, 20 nt, Human
uggcaggcagcuggaauaaa

SEQ ID NO: 895677 - RNA, 18 nt, Human
uggcauggagggagagcg

SEQ ID NO: 895678 - RNA, 24 nt, Human
uggccaggcugacuucgaacuccu

SEQ ID NO: 895679 - RNA, 22 nt, Human
uggccaucacuaugggugagca

SEQ ID NO: 895680 - RNA, 24 nt, Human
uggcgucacugaaauugaaguucc

SEQ ID NO: 895681 - RNA, 20 nt, Human
uggcgugaucucggcucacu

SEQ ID NO: 895682 - RNA, 20 nt, Human
uggcucugccagaggugggg

SEQ ID NO: 895683 - RNA, 25 nt, Human
ugggaaaggaauguccuggagacug

SEQ ID NO: 895684 - RNA, 25 nt, Human
ugggaagcaacuggugcagggcuug

SEQ ID NO: 895685 - RNA, 21 nt, Human
ugggacuacaggcaugcacca

SEQ ID NO: 895686 - RNA, 26 nt, Human
ugggacuacaggcaugcaccaccuaa

SEQ ID NO: 895687 - RNA, 26 nt, Human
ugggaggcacagccaggaguggggca

SEQ ID NO: 895688 - RNA, 28 nt, Human
ugggaggcacagccaggaguggggcagg

SEQ ID NO: 895689 - RNA, 21 nt, Human
ugggauuacaggcgugagcca

SEQ ID NO: 895690 - RNA, 22 nt, Human
ugggauuacaggcgugagccac

SEQ ID NO: 895691 - RNA, 23 nt, Human
ugggauuacaggcgugagccacc

SEQ ID NO: 895692 - RNA, 23 nt, Human
ugggauuacaggcgugagccacc

SEQ ID NO: 895693 - RNA, 24 nt, Human
ugggauuacaggcgugagccaccg

SEQ ID NO: 895694 - RNA, 19 nt, Human
ugggcaggcucccacuguu

SEQ ID NO: 895695 - RNA, 19 nt, Human
ugggcagggaggguggggu

SEQ ID NO: 895696 - RNA, 21 nt, Human
ugggcucaagucucccguguc

SEQ ID NO: 895697 - RNA, 21 nt, Human
uggggggggggggaggcucca

SEQ ID NO: 895698 - RNA, 24 nt, Human
ugggguuucaccacguuggccagg

SEQ ID NO: 895699 - RNA, 23 nt, Human
uggugcagggcuuggccccaagc

SEQ ID NO: 895700 - RNA, 21 nt, Human
ugguggaaagagggaggaggg

SEQ ID NO: 895701 - RNA, 19 nt, Human
ugguggcaaggggauuggu

SEQ ID NO: 895702 - RNA, 21 nt, Human
uguauuuuuagugaagauggg

SEQ ID NO: 895703 - RNA, 18 nt, Human
uguccuggagacugaggu

SEQ ID NO: 895704 - RNA, 24 nt, Human
ugucucagccucccaaagugcugg

SEQ ID NO: 895705 - RNA, 20 nt, Human
ugugauccugugcaggucac

SEQ ID NO: 895706 - RNA, 18 nt, Human
ugugggcugggaaagggg

SEQ ID NO: 895707 - RNA, 18 nt, Human
uguucaggugucauguug

SEQ ID NO: 895708 - RNA, 20 nt, Human
uguugcccaggcuggagugc

SEQ ID NO: 895709 - RNA, 19 nt, Human
uguugugagaucaacagga

SEQ ID NO: 895710 - RNA, 24 nt, Human
uuacaaaaacaaaaagguaacaaa

SEQ ID NO: 895711 - RNA, 18 nt, Human
uuagugaagaugggguuu

SEQ ID NO: 895712 - RNA, 22 nt, Human
uuagugaagaugggguuucacc

SEQ ID NO: 895713 - RNA, 24 nt, Human
uuagugaagaugggguuucaccac

SEQ ID NO: 895714 - RNA, 25 nt, Human
uuagugaagaugggguuucaccacg

SEQ ID NO: 895715 - RNA, 22 nt, Human
uucaaaacaauaacagaaacac

SEQ ID NO: 895716 - RNA, 18 nt, Human
uucaagagauucuucugc

SEQ ID NO: 895717 - RNA, 20 nt, Human
uuccuuuucuuuuuuggcuc

SEQ ID NO: 895718 - RNA, 23 nt, Human
uucucccaaguccuccacaagag

SEQ ID NO: 895719 - RNA, 20 nt, Human
uucucgaaauggaaagcagg

SEQ ID NO: 895720 - RNA, 24 nt, Human
uugacaugcucacucacacucagc

SEQ ID NO: 895721 - RNA, 21 nt, Human
uugagauggagucuugcucug

SEQ ID NO: 895722 - RNA, 18 nt, Human
uugcccaggcuggagugc

SEQ ID NO: 895723 - RNA, 24 nt, Human
uugcucuguugcccaggcuggagu

SEQ ID NO: 895724 - RNA, 23 nt, Human
uuggagaagcagcaauuucccuc

SEQ ID NO: 895725 - RNA, 24 nt, Human
uuggccccaagcaagaguuggaga

SEQ ID NO: 895726 - RNA, 25 nt, Human
uuggccccaagcaagaguuggagaa

SEQ ID NO: 895727 - RNA, 18 nt, Human
uugguccccuugggaugu

SEQ ID NO: 895728 - RNA, 23 nt, Human
uuguauuuuuagugaagaugggg

SEQ ID NO: 895729 - RNA, 19 nt, Human
uuguuccuguucccuuugg

SEQ ID NO: 895730 - RNA, 21 nt, Human
uuucaccacguuggccaggcu

SEQ ID NO: 895731 - RNA, 18 nt, Human
uuuggaaggcugaguggg

SEQ ID NO: 895732 - RNA, 24 nt, Human
uuuuuagugaagaugggguuucac

SEQ ID NO: 895733 - RNA, 24 nt, Human
uuuuugagauggagucuugcucug

SEQ ID NO: 895734 - RNA, 18 nt, Human
uuuuuugagauggagucu

SEQ ID NO: 895735 - RNA, 18 nt, Human
acugcacuacugcacuug

SEQ ID NO: 895736 - RNA, 22 nt, Human
ccucauggugaacugcacuacu

SEQ ID NO: 895737 - RNA, 21 nt, Human
cuguuggcaaaugucuucuuu

SEQ ID NO: 895738 - RNA, 19 nt, Human
cuuguguggcccacaugac

SEQ ID NO: 895739 - RNA, 18 nt, Human
uuuuuuuuuuuuaaaaga

SEQ ID NO: 895740 - RNA, 23 nt, Human
aaacagaaaauauggggacagaa

SEQ ID NO: 895741 - RNA, 23 nt, Human
agaaaacagaaaauauggggaca

SEQ ID NO: 895742 - RNA, 19 nt, Human
agccauccggccaagaaaa

SEQ ID NO: 895743 - RNA, 18 nt, Human
aggccucagccauccggc

SEQ ID NO: 895744 - RNA, 19 nt, Human
cccaggaauguuugcccuu

SEQ ID NO: 895745 - RNA, 22 nt, Human
cggccaagaaaacagaaaauau

SEQ ID NO: 895746 - RNA, 20 nt, Human
gaggaucuccuugcccagcu

SEQ ID NO: 895747 - RNA, 21 nt, Human
uggagcccuggucauuaccaa

SEQ ID NO: 895748 - RNA, 19 nt, Human
uuugcccuucucagucugu

SEQ ID NO: 895749 - RNA, 18 nt, Human
aagaaauccaggaaacua

SEQ ID NO: 895750 - RNA, 19 nt, Human
acaauguagagaaaguugu

SEQ ID NO: 895751 - RNA, 23 nt, Human
agacaaugaggugaggaggagga

SEQ ID NO: 895752 - RNA, 26 nt, Human
agagaagcaguguucacuuugagcua

SEQ ID NO: 895753 - RNA, 19 nt, Human
aggcaaacagggcuugcca

SEQ ID NO: 895754 - RNA, 21 nt, Human
auuagaaugcaggauucccug

SEQ ID NO: 895755 - RNA, 18 nt, Human
caaaaugagauuuucccu

SEQ ID NO: 895756 - RNA, 20 nt, Human
cagaagaaauccaggaaacu

SEQ ID NO: 895757 - RNA, 20 nt, Human
cuuuucuucuuucacuccuu

SEQ ID NO: 895758 - RNA, 19 nt, Human
ggagacaaugaggugagga

SEQ ID NO: 895759 - RNA, 25 nt, Human
uaagaugagcaaaaugagauuuucc

SEQ ID NO: 895760 - RNA, 18 nt, Human
uagaaugcaggauucccu

SEQ ID NO: 895761 - RNA, 21 nt, Human
uagaaugcaggauucccugga

SEQ ID NO: 895762 - RNA, 25 nt, Human
ucaacagauagaauugaaguaacaa

SEQ ID NO: 895763 - RNA, 20 nt, Human
uccagaagaaauccaggaaa

SEQ ID NO: 895764 - RNA, 21 nt, Human
ucuaagucuucuuuucuucuu

SEQ ID NO: 895765 - RNA, 20 nt, Human
ugaaaugcacuuucuuuaug

SEQ ID NO: 895766 - RNA, 21 nt, Human
ugagagagaaaaaggagcuag

SEQ ID NO: 895767 - RNA, 22 nt, Human
ugaggaggaggagagagucucg

SEQ ID NO: 895768 - RNA, 22 nt, Human
ugaggugaggaggaggagagag

SEQ ID NO: 895769 - RNA, 22 nt, Human
ugggucagagauggacuuucaa

SEQ ID NO: 895770 - RNA, 20 nt, Human
uguccagaagaaauccagga

SEQ ID NO: 895771 - RNA, 22 nt, Human
ugucugaaguuucaucuugagg

SEQ ID NO: 895772 - RNA, 20 nt, Human
uucacuuugagcuauguuuc

SEQ ID NO: 895773 - RNA, 19 nt, Human
uugaaaugcacuuucuuua

SEQ ID NO: 895774 - RNA, 26 nt, Human
uuuucuguugccauuauguuugcuuu

SEQ ID NO: 895775 - RNA, 20 nt, Human
uuuuucuguugccauuaugu

SEQ ID NO: 895776 - RNA, 22 nt, Human
uuuuuuucuguugccauuauua

SEQ ID NO: 895777 - RNA, 18 nt, Human
uuuuuuuuuuuuuuucug

SEQ ID NO: 895778 - RNA, 22 nt, Human
uuuuuuuuuuuuuuuuucuguu

SEQ ID NO: 895779 - RNA, 19 nt, Human
accacugggcucccuuuga

SEQ ID NO: 895780 - RNA, 19 nt, Human
acgcuguugcugguuuucc

SEQ ID NO: 895781 - RNA, 22 nt, Human
cacgcuguugcugguuuuccuc

SEQ ID NO: 895782 - RNA, 25 nt, Human
cacgcuguugcugguuuuccucuga

SEQ ID NO: 895783 - RNA, 21 nt, Human
cacugggcucccuuugaaccc

SEQ ID NO: 895784 - RNA, 22 nt, Human
ccacugggcucccuuugaaccc

SEQ ID NO: 895785 - RNA, 23 nt, Human
ccagcaguggucagucauuuuuc

SEQ ID NO: 895786 - RNA, 21 nt, Human
ccuuugaacccggcccaaucu

SEQ ID NO: 895787 - RNA, 18 nt, Human
cuaggaaaaugaaguguc

SEQ ID NO: 895788 - RNA, 21 nt, Human
cugguauggaaugccucuccc

SEQ ID NO: 895789 - RNA, 24 nt, Human
gaaugccucuccccaaacucccac

SEQ ID NO: 895790 - RNA, 18 nt, Human
ggaaugccucuccccaaa

SEQ ID NO: 895791 - RNA, 22 nt, Human
ggaaugccucuccccaaacucc

SEQ ID NO: 895792 - RNA, 22 nt, Human
ggccacagaaucugguauggaa

SEQ ID NO: 895793 - RNA, 21 nt, Human
uaaggagaguuccuguaacuu

SEQ ID NO: 895794 - RNA, 30 nt, Human
ucccacgcuguugcugguuuuccucugauu

SEQ ID NO: 895795 - RNA, 19 nt, Human
ucuuucauugcaaccacug

SEQ ID NO: 895796 - RNA, 25 nt, Human
ucuuuggucccagcauuuucccacu

SEQ ID NO: 895797 - RNA, 18 nt, Human
ugagcuggggaaggaagu

SEQ ID NO: 895798 - RNA, 20 nt, Human
uggaaugccucuccccaaac

SEQ ID NO: 895799 - RNA, 23 nt, Human
ugguauggaaugccucuccccaa

SEQ ID NO: 895800 - RNA, 18 nt, Human
accgcuuuucgccccugc

SEQ ID NO: 895801 - RNA, 21 nt, Human
agauaaucaagaggugacagc

SEQ ID NO: 895802 - RNA, 18 nt, Human
cagcacugcagucacagu

SEQ ID NO: 895803 - RNA, 24 nt, Human
ccgcuuuucgccccugcugacucc

SEQ ID NO: 895804 - RNA, 18 nt, Human
cuuuucgccccugcugac

SEQ ID NO: 895805 - RNA, 22 nt, Human
gcaaagaacaguuaaguuuaca

SEQ ID NO: 895806 - RNA, 22 nt, Human
uaaaaauaccuuggauucuggu

SEQ ID NO: 895807 - RNA, 24 nt, Human
ugccucaaaagcagugaguucaau

SEQ ID NO: 895808 - RNA, 20 nt, Human
uuuaaaggaaucaggaagaa

SEQ ID NO: 895809 - RNA, 22 nt, Human
aaaauaaagacuaguauuuuac

SEQ ID NO: 895810 - RNA, 22 nt, Human
aaacagauauagauacauagac

SEQ ID NO: 895811 - RNA, 18 nt, Human
aauuuucacuucaauuuu

SEQ ID NO: 895812 - RNA, 18 nt, Human
acaaaaugaauaacaaug

SEQ ID NO: 895813 - RNA, 24 nt, Human
accagaaaaaaauacaaaacagau

SEQ ID NO: 895814 - RNA, 19 nt, Human
aggaaaucugguuuggaac

SEQ ID NO: 895815 - RNA, 21 nt, Human
auauauccacauccguccaca

SEQ ID NO: 895816 - RNA, 25 nt, Human
auucuuguuuccuuuuucuuuaugc

SEQ ID NO: 895817 - RNA, 24 nt, Human
cacuucaauuuuaauucuugaaga

SEQ ID NO: 895818 - RNA, 18 nt, Human
cccuccucccucccaccc

SEQ ID NO: 895819 - RNA, 21 nt, Human
ccuccucccucccacccagcc

SEQ ID NO: 895820 - RNA, 24 nt, Human
ccucugagucucuagggggacggg

SEQ ID NO: 895821 - RNA, 19 nt, Human
ccuuggcccaggugggucc

SEQ ID NO: 895822 - RNA, 23 nt, Human
cucccacccagccugccuggccc

SEQ ID NO: 895823 - RNA, 23 nt, Human
gaaaaaaauacaaaacagauaua

SEQ ID NO: 895824 - RNA, 22 nt, Human
gaaccagaaaaaaauacaaaac

SEQ ID NO: 895825 - RNA, 19 nt, Human
gcacucauuauaagaagca

SEQ ID NO: 895826 - RNA, 20 nt, Human
ggcccuccucccucccaccc

SEQ ID NO: 895827 - RNA, 20 nt, Human
ggggacggggcaggugggaa

SEQ ID NO: 895828 - RNA, 21 nt, Human
guguuucuacauaggcuucag

SEQ ID NO: 895829 - RNA, 21 nt, Human
uaaaauucucaugguccucuc

SEQ ID NO: 895830 - RNA, 19 nt, Human
uaauuauuuggaaaauguu

SEQ ID NO: 895831 - RNA, 18 nt, Human
uagcagggacaccugguc

SEQ ID NO: 895832 - RNA, 23 nt, Human
uauaagaagcaaaggguuauauc

SEQ ID NO: 895833 - RNA, 21 nt, Human
uccguccacaauaaauccugg

SEQ ID NO: 895834 - RNA, 20 nt, Human
ucucaugguccucucuucca

SEQ ID NO: 895835 - RNA, 19 nt, Human
uggaaccagaaaaaaauac

SEQ ID NO: 895836 - RNA, 24 nt, Human
uggaaccagaaaaaaauacaaaac

SEQ ID NO: 895837 - RNA, 22 nt, Human
uggcccagguggguccucugag

SEQ ID NO: 895838 - RNA, 20 nt, Human
ugucucggcccuccucccuc

SEQ ID NO: 895839 - RNA, 26 nt, Human
ugucucggcccuccucccucccaccc

SEQ ID NO: 895840 - RNA, 25 nt, Human
uguguguguguuucuacauaggcuu

SEQ ID NO: 895841 - RNA, 21 nt, Human
uguuauuuuccccuaauucuu

SEQ ID NO: 895842 - RNA, 19 nt, Human
uguuuuguuuuuccucgcc

SEQ ID NO: 895843 - RNA, 20 nt, Human
uuuggaguccuuggcccagg

SEQ ID NO: 895844 - RNA, 18 nt, Human
uuuuguuuguuuuguuuu

SEQ ID NO: 895845 - RNA, 23 nt, Human
aaaauuaaauuauaucuauaaaa

SEQ ID NO: 895846 - RNA, 21 nt, Human
aaacacaaccccaacacaaua

SEQ ID NO: 895847 - RNA, 22 nt, Human
aacacaaccccaacacaauacu

SEQ ID NO: 895848 - RNA, 20 nt, Human
aaccccaacacaauacucug

SEQ ID NO: 895849 - RNA, 18 nt, Human
aagaaggaaauuaaaagg

SEQ ID NO: 895850 - RNA, 20 nt, Human
aagggaucgacagggaaggu

SEQ ID NO: 895851 - RNA, 21 nt, Human
aagggcucagggcaagagggg

SEQ ID NO: 895852 - RNA, 23 nt, Human
aauacaaagcaacuauaauugga

SEQ ID NO: 895853 - RNA, 18 nt, Human
acaaccccaacacaauac

SEQ ID NO: 895854 - RNA, 25 nt, Human
acacauccuacccuggcgaacaacc

SEQ ID NO: 895855 - RNA, 20 nt, Human
acaggagcugcuuuuccucu

SEQ ID NO: 895856 - RNA, 23 nt, Human
acccccucccaccccauccccca

SEQ ID NO: 895857 - RNA, 18 nt, Human
acccuggcgaacaacccu

SEQ ID NO: 895858 - RNA, 21 nt, Human
acccuggcgaacaacccuugg

SEQ ID NO: 895859 - RNA, 22 nt, Human
agaacacaaccaaaacaguuac

SEQ ID NO: 895860 - RNA, 19 nt, Human
agaaggaaauuaaaaggaa

SEQ ID NO: 895861 - RNA, 18 nt, Human
agacuuaguaagacagca

SEQ ID NO: 895862 - RNA, 22 nt, Human
agagcugucccgaaaucugcac

SEQ ID NO: 895863 - RNA, 19 nt, Human
agagguuccgcgggcgucc

SEQ ID NO: 895864 - RNA, 19 nt, Human
agcggcuggugggggaugc

SEQ ID NO: 895865 - RNA, 18 nt, Human
agcugcuuuuccucuuaa

SEQ ID NO: 895866 - RNA, 18 nt, Human
agcuggaggggugggggg

SEQ ID NO: 895867 - RNA, 18 nt, Human
aggaagaaggaaauuaaa

SEQ ID NO: 895868 - RNA, 20 nt, Human
aggaaggacaggaaaugaua

SEQ ID NO: 895869 - RNA, 23 nt, Human
aggaggagcaggagcuggagggg

SEQ ID NO: 895870 - RNA, 19 nt, Human
agggaacucuggugggguu

SEQ ID NO: 895871 - RNA, 21 nt, Human
agggaucaaauacucaacuga

SEQ ID NO: 895872 - RNA, 24 nt, Human
agggcucagggcaagaggggugug

SEQ ID NO: 895873 - RNA, 18 nt, Human
agggguggggggcgggag

SEQ ID NO: 895874 - RNA, 20 nt, Human
agggguggggggcgggaggc

SEQ ID NO: 895875 - RNA, 23 nt, Human
agggugcuaggagaggaggcagc

SEQ ID NO: 895876 - RNA, 21 nt, Human
auaaaacacaaccccaacaca

SEQ ID NO: 895877 - RNA, 25 nt, Human
augaacuauaacccccucccacccc

SEQ ID NO: 895878 - RNA, 23 nt, Human
augcugcgaucccgacucauggg

SEQ ID NO: 895879 - RNA, 19 nt, Human
auuauccuuuuuuuuccug

SEQ ID NO: 895880 - RNA, 23 nt, Human
caccauuuguuaaaauaaaggaa

SEQ ID NO: 895881 - RNA, 23 nt, Human
caccccaucccccaaugccuaaa

SEQ ID NO: 895882 - RNA, 22 nt, Human
cacugggggggagucacagcug

SEQ ID NO: 895883 - RNA, 24 nt, Human
caggagcuggagggguggggggcg

SEQ ID NO: 895884 - RNA, 23 nt, Human
cagggcagggaucugguuccauc

SEQ ID NO: 895885 - RNA, 22 nt, Human
cagggcccgggcuugccccccg

SEQ ID NO: 895886 - RNA, 21 nt, Human
cauauagaauaaaggagaguu

SEQ ID NO: 895887 - RNA, 20 nt, Human
ccaggcucagggcccgggcu

SEQ ID NO: 895888 - RNA, 25 nt, Human
cccucccaccccaucccccaaugcc

SEQ ID NO: 895889 - RNA, 18 nt, Human
cccuggugcuuacccugu

SEQ ID NO: 895890 - RNA, 23 nt, Human
ccucccaccccaucccccaaugc

SEQ ID NO: 895891 - RNA, 24 nt, Human
ccucccaccccaucccccaaugcc

SEQ ID NO: 895892 - RNA, 19 nt, Human
ccucuuaaggaaggacagg

SEQ ID NO: 895893 - RNA, 24 nt, Human
cggcaagggcucagggcaagaggg

SEQ ID NO: 895894 - RNA, 23 nt, Human
cggcuggugggggaugcugcgau

SEQ ID NO: 895895 - RNA, 19 nt, Human
cgggagagcgaagugugug

SEQ ID NO: 895896 - RNA, 24 nt, Human
cgggaggggcguccagcugcggcg

SEQ ID NO: 895897 - RNA, 22 nt, Human
cuacaggagcugcuuuuccucu

SEQ ID NO: 895898 - RNA, 24 nt, Human
cuaguacucacacucauacuauuu

SEQ ID NO: 895899 - RNA, 25 nt, Human
cuauaacugaagcaaguuuagggaa

SEQ ID NO: 895900 - RNA, 19 nt, Human
cucaugggagagcacagcc

SEQ ID NO: 895901 - RNA, 18 nt, Human
cuuucaggauagcuggac

SEQ ID NO: 895902 - RNA, 19 nt, Human
gaagaaggaaauuaaaagg

SEQ ID NO: 895903 - RNA, 19 nt, Human
gaagggaucgacagggaag

SEQ ID NO: 895904 - RNA, 18 nt, Human
gaaggugaacacagccuc

SEQ ID NO: 895905 - RNA, 19 nt, Human
gacuccgcucucccggcug

SEQ ID NO: 895906 - RNA, 18 nt, Human
gagcggaggaggagcagg

SEQ ID NO: 895907 - RNA, 24 nt, Human
gaggaggagcaggagcuggagggg

SEQ ID NO: 895908 - RNA, 22 nt, Human
gauagcuggacagucagggcag

SEQ ID NO: 895909 - RNA, 23 nt, Human
gcaaacagccauuauuguuuugc

SEQ ID NO: 895910 - RNA, 18 nt, Human
gcagggaucugguuccau

SEQ ID NO: 895911 - RNA, 24 nt, Human
gcgaagcgccggcagugcugcccg

SEQ ID NO: 895912 - RNA, 18 nt, Human
gcggaggaggagcaggag

SEQ ID NO: 895913 - RNA, 23 nt, Human
gcucgcucucucggcacgucauu

SEQ ID NO: 895914 - RNA, 22 nt, Human
ggaggaggagcaggagcuggag

SEQ ID NO: 895915 - RNA, 23 nt, Human
ggaucgacagggaaggugaacac

SEQ ID NO: 895916 - RNA, 19 nt, Human
ggcuggugggggaugcugc

SEQ ID NO: 895917 - RNA, 22 nt, Human
gggaaggugaacacagccucug

SEQ ID NO: 895918 - RNA, 19 nt, Human
gggcagggaucugguucca

SEQ ID NO: 895919 - RNA, 20 nt, Human
gggcuugccgggcugcccuc

SEQ ID NO: 895920 - RNA, 20 nt, Human
ggggcugggggucucuccag

SEQ ID NO: 895921 - RNA, 19 nt, Human
uaaaacacaaccccaacac

SEQ ID NO: 895922 - RNA, 21 nt, Human
uaaaacacaaccccaacacaa

SEQ ID NO: 895923 - RNA, 24 nt, Human
uaaaggaagaaggaaauuaaaagg

SEQ ID NO: 895924 - RNA, 22 nt, Human
uaacccccucccaccccauccc

SEQ ID NO: 895925 - RNA, 22 nt, Human
uaaggaaaagagccagaaaaaa

SEQ ID NO: 895926 - RNA, 24 nt, Human
uaaggaaggacaggaaaugauagg

SEQ ID NO: 895927 - RNA, 21 nt, Human
uagaagcagggugcuaggaga

SEQ ID NO: 895928 - RNA, 21 nt, Human
uagagagcugucccgaaaucu

SEQ ID NO: 895929 - RNA, 22 nt, Human
uaggaggagcggacguccggcg

SEQ ID NO: 895930 - RNA, 22 nt, Human
uagguuuccaaaccuaucccuu

SEQ ID NO: 895931 - RNA, 26 nt, Human
ucagggcaagaggggugugagcggcg

SEQ ID NO: 895932 - RNA, 22 nt, Human
ucaugaacuauaacccccuccc

SEQ ID NO: 895933 - RNA, 26 nt, Human
ucaugaacuauaacccccucccaccc

SEQ ID NO: 895934 - RNA, 21 nt, Human
uccaggcucagggcccgggcu

SEQ ID NO: 895935 - RNA, 25 nt, Human
ucccaccccaucccccaaugccuaa

SEQ ID NO: 895936 - RNA, 18 nt, Human
uccgcgggcguccuggcu

SEQ ID NO: 895937 - RNA, 18 nt, Human
ucgagugagggagcgggu

SEQ ID NO: 895938 - RNA, 19 nt, Human
ucgcucgcucucucggcac

SEQ ID NO: 895939 - RNA, 23 nt, Human
ucuauaaaaauccuuauuguccc

SEQ ID NO: 895940 - RNA, 21 nt, Human
ucuccagcggaggcugagagu

SEQ ID NO: 895941 - RNA, 23 nt, Human
ucuccagcggaggcugagagugu

SEQ ID NO: 895942 - RNA, 22 nt, Human
ucuuaaggaaggacaggaaaug

SEQ ID NO: 895943 - RNA, 23 nt, Human
ucuugcgcgcugaaugguggggc

SEQ ID NO: 895944 - RNA, 23 nt, Human
ugaagcaaguuuagggaacucug

SEQ ID NO: 895945 - RNA, 24 nt, Human
ugacugccuccuuuuuauuuccau

SEQ ID NO: 895946 - RNA, 19 nt, Human
ugauuuguagguaauccuc

SEQ ID NO: 895947 - RNA, 22 nt, Human
ugcggcgccgcgcugcaccggc

SEQ ID NO: 895948 - RNA, 20 nt, Human
ugcguagaagcagggugcua

SEQ ID NO: 895949 - RNA, 20 nt, Human
ugcuuucuacaggagcugcu

SEQ ID NO: 895950 - RNA, 22 nt, Human
uggggagcggaggaggagcagg

SEQ ID NO: 895951 - RNA, 22 nt, Human
ugucccgaaaucugcacugggg

SEQ ID NO: 895952 - RNA, 21 nt, Human
ugucccggaagggcugcggug

SEQ ID NO: 895953 - RNA, 21 nt, Human
ugugugcgcgcuugugucugu

SEQ ID NO: 895954 - RNA, 18 nt, Human
ugugugcggagccugugu

SEQ ID NO: 895955 - RNA, 22 nt, Human
ugugugugugcggagccugugu

SEQ ID NO: 895956 - RNA, 20 nt, Human
uguuugcaccacauacguag

SEQ ID NO: 895957 - RNA, 23 nt, Human
uuauauuauccuuuuuuuuccug

SEQ ID NO: 895958 - RNA, 23 nt, Human
uuccugcugauuugcauguucuu

SEQ ID NO: 895959 - RNA, 18 nt, Human
uugauagaacacaaccaa

SEQ ID NO: 895960 - RNA, 22 nt, Human
uugccgggcugcccucuuccgc

SEQ ID NO: 895961 - RNA, 22 nt, Human
uugcuuucuacaggagcugcuu

SEQ ID NO: 895962 - RNA, 26 nt, Human
uuuaaaaaauugcacuuguuuaugga

SEQ ID NO: 895963 - RNA, 24 nt, Human
uuuauaaucugauccacuuucagg

SEQ ID NO: 895964 - RNA, 22 nt, Human
aagugccaguggccacuccacc

SEQ ID NO: 895965 - RNA, 21 nt, Human
accuccgccaggcccugccca

SEQ ID NO: 895966 - RNA, 19 nt, Human
accugcucaacuucucccu

SEQ ID NO: 895967 - RNA, 22 nt, Human
agaacucaggggcagcggccuc

SEQ ID NO: 895968 - RNA, 19 nt, Human
agcagggagggggcggggc

SEQ ID NO: 895969 - RNA, 22 nt, Human
agccagcgguguggcugcggcc

SEQ ID NO: 895970 - RNA, 20 nt, Human
agcggccucugggacggggc

SEQ ID NO: 895971 - RNA, 18 nt, Human
agcugggagcagggaggg

SEQ ID NO: 895972 - RNA, 19 nt, Human
aggaggaagggaugaccuc

SEQ ID NO: 895973 - RNA, 19 nt, Human
agggagggggcggggcggg

SEQ ID NO: 895974 - RNA, 18 nt, Human
agggggcggggcgggugg

SEQ ID NO: 895975 - RNA, 23 nt, Human
augcggagccagcgguguugcgc

SEQ ID NO: 895976 - RNA, 21 nt, Human
cacagugucagaacucagggg

SEQ ID NO: 895977 - RNA, 22 nt, Human
cacccaccuucccaaacacaca

SEQ ID NO: 895978 - RNA, 23 nt, Human
cacccaccuucccaaacacacag

SEQ ID NO: 895979 - RNA, 19 nt, Human
caccuccgccaggcccugc

SEQ ID NO: 895980 - RNA, 22 nt, Human
cagaggcucucccuccuggucu

SEQ ID NO: 895981 - RNA, 18 nt, Human
cagcgguguggcugcggc

SEQ ID NO: 895982 - RNA, 22 nt, Human
caggggcagcggccucugggac

SEQ ID NO: 895983 - RNA, 21 nt, Human
cccagccucacccaccuuccc

SEQ ID NO: 895984 - RNA, 24 nt, Human
cccagucccggccccgcccccggc

SEQ ID NO: 895985 - RNA, 21 nt, Human
cccccagucccggccccgccc

SEQ ID NO: 895986 - RNA, 21 nt, Human
ccccgcccaggccccgccccc

SEQ ID NO: 895987 - RNA, 22 nt, Human
ccccgcccccagucccgccccc

SEQ ID NO: 895988 - RNA, 18 nt, Human
cccgcccccggcccaggc

SEQ ID NO: 895989 - RNA, 24 nt, Human
cccggccccgcccccggcccaggc

SEQ ID NO: 895990 - RNA, 19 nt, Human
ccucacccaccuucccaaa

SEQ ID NO: 895991 - RNA, 24 nt, Human
cgcccccagucccgcccccagucc

SEQ ID NO: 895992 - RNA, 21 nt, Human
cuccccuaguugauaccugcu

SEQ ID NO: 895993 - RNA, 25 nt, Human
cuggagacccucucuccuccccuag

SEQ ID NO: 895994 - RNA, 21 nt, Human
cugggagcagggagggggcgg

SEQ ID NO: 895995 - RNA, 23 nt, Human
gagagcugggagcagggaggggg

SEQ ID NO: 895996 - RNA, 22 nt, Human
gagcagggagggggcggggcgg

SEQ ID NO: 895997 - RNA, 18 nt, Human
ggagagagagcugggagc

SEQ ID NO: 895998 - RNA, 21 nt, Human
ggagcagggagggggcggggc

SEQ ID NO: 895999 - RNA, 18 nt, Human
ggcugcggccccgcccag

SEQ ID NO: 896000 - RNA, 22 nt, Human
uccaggagagagagcugggagc

SEQ ID NO: 896001 - RNA, 24 nt, Human
uccccggaccugcaggcuucagac

SEQ ID NO: 896002 - RNA, 20 nt, Human
ucccgaaccuccuccccgga

SEQ ID NO: 896003 - RNA, 21 nt, Human
ucccggccccgcccccggccc

SEQ ID NO: 896004 - RNA, 22 nt, Human
ucccugucuguuuccaggagag

SEQ ID NO: 896005 - RNA, 22 nt, Human
uccgccaggcccugcccagccu

SEQ ID NO: 896006 - RNA, 21 nt, Human
ugcccagccucacccaccuuc

SEQ ID NO: 896007 - RNA, 22 nt, Human
ugcucaacuucucccugucugu

SEQ ID NO: 896008 - RNA, 18 nt, Human
ugggagcagggagggggc

SEQ ID NO: 896009 - RNA, 22 nt, Human
ugggagcagggagggggcgggg

SEQ ID NO: 896010 - RNA, 21 nt, Human
uggggcuccucggugggcauc

SEQ ID NO: 896011 - RNA, 23 nt, Human
aaaaaaacagacaaacaaacaaa

SEQ ID NO: 896012 - RNA, 25 nt, Human
aaaaaguagggauggccacaccccc

SEQ ID NO: 896013 - RNA, 26 nt, Human
aaacagacaaacaaacaaaaacucuu

SEQ ID NO: 896014 - RNA, 24 nt, Human
aaacagacaaacaaacaacgaguc

SEQ ID NO: 896015 - RNA, 18 nt, Human
aaagaguucaaagacaga

SEQ ID NO: 896016 - RNA, 24 nt, Human
aacaaaaacucuucuugcuaugga

SEQ ID NO: 896017 - RNA, 20 nt, Human
aacacacagccacuuugcuc

SEQ ID NO: 896018 - RNA, 19 nt, Human
aacagacaaacaaacaaaa

SEQ ID NO: 896019 - RNA, 20 nt, Human
aacuugcagaaccuuucccc

SEQ ID NO: 896020 - RNA, 23 nt, Human
aagaaaacaaggugaaaggagaa

SEQ ID NO: 896021 - RNA, 22 nt, Human
aaggggcagcugagccacucug

SEQ ID NO: 896022 - RNA, 21 nt, Human
aaucaucacucugcugguacc

SEQ ID NO: 896023 - RNA, 18 nt, Human
acacacgaacacacaaga

SEQ ID NO: 896024 - RNA, 20 nt, Human
acagaaauucuucugcccuu

SEQ ID NO: 896025 - RNA, 24 nt, Human
acagaccugguguagcgcuggcca

SEQ ID NO: 896026 - RNA, 21 nt, Human
accagaaagaaacaauuacaa

SEQ ID NO: 896027 - RNA, 20 nt, Human
acccuguuuaaaaaaagccc

SEQ ID NO: 896028 - RNA, 22 nt, Human
accuggguguaggcaggacaag

SEQ ID NO: 896029 - RNA, 24 nt, Human
acgaacacacaagaaucuucccac

SEQ ID NO: 896030 - RNA, 18 nt, Human
agaaauucuucugcccuu

SEQ ID NO: 896031 - RNA, 26 nt, Human
agaagacauuaaagacgguccacagg

SEQ ID NO: 896032 - RNA, 18 nt, Human
agacaaauguaugagucu

SEQ ID NO: 896033 - RNA, 18 nt, Human
agacauggacuacccagu

SEQ ID NO: 896034 - RNA, 18 nt, Human
agagagcaauuucuuuug

SEQ ID NO: 896035 - RNA, 22 nt, Human
agcaaagaacgaugcuguacac

SEQ ID NO: 896036 - RNA, 21 nt, Human
agccgggccauuaggaaccug

SEQ ID NO: 896037 - RNA, 22 nt, Human
agccugaaguuuucggauuuag

SEQ ID NO: 896038 - RNA, 21 nt, Human
agcuggagcuuuuccugagga

SEQ ID NO: 896039 - RNA, 20 nt, Human
agcugggaggcgaguccugu

SEQ ID NO: 896040 - RNA, 19 nt, Human
agcugguuuuucaaagggc

SEQ ID NO: 896041 - RNA, 21 nt, Human
aggagacagcaaacagccuuu

SEQ ID NO: 896042 - RNA, 23 nt, Human
aggagacagcaaacagccuuuga

SEQ ID NO: 896043 - RNA, 21 nt, Human
aggcagaagaaggugccgugg

SEQ ID NO: 896044 - RNA, 18 nt, Human
aggcaggacaagcaccug

SEQ ID NO: 896045 - RNA, 22 nt, Human
aggggaggagguugucaggagc

SEQ ID NO: 896046 - RNA, 22 nt, Human
aggggaggagguugucaggagc

SEQ ID NO: 896047 - RNA, 22 nt, Human
aggggaggggagaggaacagau

SEQ ID NO: 896048 - RNA, 18 nt, Human
aggugcuucuggcuccag

SEQ ID NO: 896049 - RNA, 24 nt, Human
aguggcugaccuaaugucuccacg

SEQ ID NO: 896050 - RNA, 18 nt, Human
aucccacccucucccuca

SEQ ID NO: 896051 - RNA, 22 nt, Human
aucuggaggaaagcagcucaga

SEQ ID NO: 896052 - RNA, 21 nt, Human
aucugugauaugugucuccuu

SEQ ID NO: 896053 - RNA, 21 nt, Human
augaccggcgcccuagucgcc

SEQ ID NO: 896054 - RNA, 19 nt, Human
caaaaucaucacucugcug

SEQ ID NO: 896055 - RNA, 24 nt, Human
caaaaucaucacucugcugguacc

SEQ ID NO: 896056 - RNA, 21 nt, Human
caaacaaaaacucuucuugcu

SEQ ID NO: 896057 - RNA, 26 nt, Human
caaacaaaaacucuucuugcuaugga

SEQ ID NO: 896058 - RNA, 23 nt, Human
caaggugaaaggagaauaaauca

SEQ ID NO: 896059 - RNA, 25 nt, Human
caccccccauuuccaucaccacugg

SEQ ID NO: 896060 - RNA, 19 nt, Human
cagcaaacagccuuugacu

SEQ ID NO: 896061 - RNA, 18 nt, Human
cagccgggccauuaggaa

SEQ ID NO: 896062 - RNA, 19 nt, Human
cagccgggccauuaggaac

SEQ ID NO: 896063 - RNA, 20 nt, Human
cagcugguuuuucaaagggc

SEQ ID NO: 896064 - RNA, 18 nt, Human
caucccacccucucccuc

SEQ ID NO: 896065 - RNA, 27 nt, Human
caucccacccucucccucaaaauacaa

SEQ ID NO: 896066 - RNA, 22 nt, Human
caugaccggcgcccuagucgcc

SEQ ID NO: 896067 - RNA, 22 nt, Human
caugaccggcgcccuagucgcc

SEQ ID NO: 896068 - RNA, 18 nt, Human
ccacagccuccaucuugg

SEQ ID NO: 896069 - RNA, 19 nt, Human
ccagaaagaaacaauuaca

SEQ ID NO: 896070 - RNA, 20 nt, Human
ccagcccuccaggccuuggc

SEQ ID NO: 896071 - RNA, 24 nt, Human
ccauacauucaacucugucgugaa

SEQ ID NO: 896072 - RNA, 18 nt, Human
cccaucccacccucuccc

SEQ ID NO: 896073 - RNA, 21 nt, Human
cccaucccacccucucccuca

SEQ ID NO: 896074 - RNA, 20 nt, Human
ccccaucccacccucucccu

SEQ ID NO: 896075 - RNA, 24 nt, Human
ccccccauuuccauugagguaguc

SEQ ID NO: 896076 - RNA, 19 nt, Human
cccgcgagcucccggccgc

SEQ ID NO: 896077 - RNA, 19 nt, Human
cccuuccaaccuacccagg

SEQ ID NO: 896078 - RNA, 18 nt, Human
cccuuccaggugcuucug

SEQ ID NO: 896079 - RNA, 18 nt, Human
ccgcgagcucccggccgc

SEQ ID NO: 896080 - RNA, 18 nt, Human
ccgcgagcucccggccgc

SEQ ID NO: 896081 - RNA, 20 nt, Human
ccgcgccccuccgcgccgcc

SEQ ID NO: 896082 - RNA, 21 nt, Human
ccuacuacccuuugaagaaaa

SEQ ID NO: 896083 - RNA, 19 nt, Human
ccuccaggccuuggcuggc

SEQ ID NO: 896084 - RNA, 18 nt, Human
ccugaggagggcgccugg

SEQ ID NO: 896085 - RNA, 19 nt, Human
ccuguccugcccacccaag

SEQ ID NO: 896086 - RNA, 19 nt, Human
ccuucaguauuggaggaac

SEQ ID NO: 896087 - RNA, 22 nt, Human
ccuugcccuacuacccuuugaa

SEQ ID NO: 896088 - RNA, 21 nt, Human
ccuugggcuuuguguccuggg

SEQ ID NO: 896089 - RNA, 22 nt, Human
cgaacacacaagaaucuuccca

SEQ ID NO: 896090 - RNA, 23 nt, Human
cgaacacacaagaaucuucccac

SEQ ID NO: 896091 - RNA, 23 nt, Human
cgccgcuccgcgccccuccgcgc

SEQ ID NO: 896092 - RNA, 19 nt, Human
cggcaaugaaugggcucuu

SEQ ID NO: 896093 - RNA, 22 nt, Human
cggcauugaggaguaauguucc

SEQ ID NO: 896094 - RNA, 20 nt, Human
cggcucggaacacacagcca

SEQ ID NO: 896095 - RNA, 22 nt, Human
cguaacauuucaccagaaagaa

SEQ ID NO: 896096 - RNA, 19 nt, Human
cgugaaaaacaugcuagcu

SEQ ID NO: 896097 - RNA, 23 nt, Human
cguggcucaauccucaccuccua

SEQ ID NO: 896098 - RNA, 24 nt, Human
cguggcucaauccucaccuccuac

SEQ ID NO: 896099 - RNA, 21 nt, Human
cuacuccacaaauuaacaacu

SEQ ID NO: 896100 - RNA, 22 nt, Human
cuccagcccuccaggccuuggc

SEQ ID NO: 896101 - RNA, 23 nt, Human
cuccgcgccccuccgcgccgccu

SEQ ID NO: 896102 - RNA, 24 nt, Human
cuccgcgccccuccgcgccgccuc

SEQ ID NO: 896103 - RNA, 25 nt, Human
cuccgcgccgcagagagaccuuccu

SEQ ID NO: 896104 - RNA, 24 nt, Human
cuccuaacaacacuuugcgcccuu

SEQ ID NO: 896105 - RNA, 19 nt, Human
cuccuggguagcuuuacua

SEQ ID NO: 896106 - RNA, 22 nt, Human
cucucuggcuuuucccuccaga

SEQ ID NO: 896107 - RNA, 22 nt, Human
cucuggagagaaaaggagaacu

SEQ ID NO: 896108 - RNA, 20 nt, Human
cucugggccccgagccgccc

SEQ ID NO: 896109 - RNA, 25 nt, Human
cucugggccccgagccgcccggcuc

SEQ ID NO: 896110 - RNA, 24 nt, Human
cucugggccuugggcuuugugucc

SEQ ID NO: 896111 - RNA, 18 nt, Human
cugggccccgagccgccc

SEQ ID NO: 896112 - RNA, 18 nt, Human
cugggccccgagccgccc

SEQ ID NO: 896113 - RNA, 18 nt, Human
cugggccccgagccgccc

SEQ ID NO: 896114 - RNA, 22 nt, Human
cuuagccccaucccacccucuc

SEQ ID NO: 896115 - RNA, 18 nt, Human
cuugcagaaccuuucccc

SEQ ID NO: 896116 - RNA, 22 nt, Human
cuugggcuuuguguccuggguc

SEQ ID NO: 896117 - RNA, 26 nt, Human
gaaagaaacaauuacaaucagacaug

SEQ ID NO: 896118 - RNA, 24 nt, Human
gaaauaaacagauacacacgaaca

SEQ ID NO: 896119 - RNA, 21 nt, Human
gaacacacagccacuuugcuc

SEQ ID NO: 896120 - RNA, 24 nt, Human
gaacacacagccacuuugcucuga

SEQ ID NO: 896121 - RNA, 21 nt, Human
gacauguucuugccucaucag

SEQ ID NO: 896122 - RNA, 19 nt, Human
gagcucccggccgcggcuc

SEQ ID NO: 896123 - RNA, 19 nt, Human
gagcucccggccgcggcuc

SEQ ID NO: 896124 - RNA, 18 nt, Human
gaggaaagcagcucagag

SEQ ID NO: 896125 - RNA, 21 nt, Human
gcaaugcaacacauucacuuu

SEQ ID NO: 896126 - RNA, 18 nt, Human
gcagaagacauuaaagac

SEQ ID NO: 896127 - RNA, 20 nt, Human
gcagcugagccacucugggc

SEQ ID NO: 896128 - RNA, 23 nt, Human
gccccaucccacccucucccuca

SEQ ID NO: 896129 - RNA, 18 nt, Human
gcucucggcaaugaaugg

SEQ ID NO: 896130 - RNA, 20 nt, Human
gcugaaguaaggggcagcug

SEQ ID NO: 896131 - RNA, 18 nt, Human
ggacguggcucaauccuc

SEQ ID NO: 896132 - RNA, 22 nt, Human
ggagcuuuuccugaggaacauu

SEQ ID NO: 896133 - RNA, 24 nt, Human
ggagugggaaggaggaaggugggc

SEQ ID NO: 896134 - RNA, 21 nt, Human
ggcagguagugagaggucaag

SEQ ID NO: 896135 - RNA, 21 nt, Human
ggcuccagcccuccaggccuu

SEQ ID NO: 896136 - RNA, 21 nt, Human
gggcagcugagccacucuggg

SEQ ID NO: 896137 - RNA, 22 nt, Human
gggcagcugagccacucugggc

SEQ ID NO: 896138 - RNA, 22 nt, Human
gggcagguagugagaggucaag

SEQ ID NO: 896139 - RNA, 18 nt, Human
gggcccuuccaaccuacc

SEQ ID NO: 896140 - RNA, 21 nt, Human
guaacauuucaccagaaagaa

SEQ ID NO: 896141 - RNA, 22 nt, Human
guaggcaggacaagcaccugaa

SEQ ID NO: 896142 - RNA, 20 nt, Human
guagggauggccacaccccc

SEQ ID NO: 896143 - RNA, 20 nt, Human
guccugggucccugaggaaa

SEQ ID NO: 896144 - RNA, 18 nt, Human
gugaaaaacaugcuagcu

SEQ ID NO: 896145 - RNA, 18 nt, Human
guggugcagggguaaggg

SEQ ID NO: 896146 - RNA, 24 nt, Human
guguaggcaggacaagcaccugaa

SEQ ID NO: 896147 - RNA, 24 nt, Human
guuuaaagccccccuucccuucca

SEQ ID NO: 896148 - RNA, 27 nt, Human
uaaaaaaacagacaaacaaacaaaaac

SEQ ID NO: 896149 - RNA, 24 nt, Human
uaaacagauacacacgaacacaca

SEQ ID NO: 896150 - RNA, 19 nt, Human
uaaagccccccuucccuuc

SEQ ID NO: 896151 - RNA, 23 nt, Human
uaaagccccccuucccuuccagg

SEQ ID NO: 896152 - RNA, 23 nt, Human
uaaauaggcagaagaaggugccg

SEQ ID NO: 896153 - RNA, 21 nt, Human
uaacaacacuuugcgcccuua

SEQ ID NO: 896154 - RNA, 23 nt, Human
uaaggaaacuagguagcuggggg

SEQ ID NO: 896155 - RNA, 21 nt, Human
uaaguggucugcuugccacac

SEQ ID NO: 896156 - RNA, 19 nt, Human
uacaauggcaacuugcaga

SEQ ID NO: 896157 - RNA, 18 nt, Human
uacccuguuuaaaaaaag

SEQ ID NO: 896158 - RNA, 26 nt, Human
uagaaauaaacagauacacacgaaca

SEQ ID NO: 896159 - RNA, 20 nt, Human
uagccccaucccacccucuc

SEQ ID NO: 896160 - RNA, 19 nt, Human
uagcuacacuccuaccuuc

SEQ ID NO: 896161 - RNA, 21 nt, Human
uagcuacacuccuaccuucuc

SEQ ID NO: 896162 - RNA, 19 nt, Human
uaggcaggacaagcaccug

SEQ ID NO: 896163 - RNA, 19 nt, Human
uauauagaaaaaugagguu

SEQ ID NO: 896164 - RNA, 18 nt, Human
ucccugaggaaaacuggu

SEQ ID NO: 896165 - RNA, 19 nt, Human
ucccugaggaaaacugguc

SEQ ID NO: 896166 - RNA, 19 nt, Human
ucccugaggaaaacugguc

SEQ ID NO: 896167 - RNA, 23 nt, Human
uccgcgccccuccgcgccgccuc

SEQ ID NO: 896168 - RNA, 22 nt, Human
uccgcgccgcuccgcgccccuc

SEQ ID NO: 896169 - RNA, 18 nt, Human
uccugcccacccaagacg

SEQ ID NO: 896170 - RNA, 19 nt, Human
uccuggguagcuuuacuag

SEQ ID NO: 896171 - RNA, 22 nt, Human
uccuggguagcuuuacuagguu

SEQ ID NO: 896172 - RNA, 21 nt, Human
ucuccuaacaacacuuugcgc

SEQ ID NO: 896173 - RNA, 23 nt, Human
ucuccuaacaacacuuugcgccc

SEQ ID NO: 896174 - RNA, 21 nt, Human
ucuuagccccaucccacccuc

SEQ ID NO: 896175 - RNA, 21 nt, Human
ucuuccuucucagagcaacug

SEQ ID NO: 896176 - RNA, 23 nt, Human
ugaaaaacaugcuagcuggagcu

SEQ ID NO: 896177 - RNA, 20 nt, Human
ugaagaaaacaaggugaaag

SEQ ID NO: 896178 - RNA, 23 nt, Human
ugaccuaaugucuccacgcugcu

SEQ ID NO: 896179 - RNA, 24 nt, Human
ugagaggucaaggaguccaggcca

SEQ ID NO: 896180 - RNA, 22 nt, Human
ugagauucugcagggcucucgg

SEQ ID NO: 896181 - RNA, 22 nt, Human
ugaggaacaugucucuuccuuc

SEQ ID NO: 896182 - RNA, 20 nt, Human
ugcagggguaaggggggcag

SEQ ID NO: 896183 - RNA, 24 nt, Human
ugcauucacacaaaagcaugugca

SEQ ID NO: 896184 - RNA, 20 nt, Human
ugccuaggguccgcgccggg

SEQ ID NO: 896185 - RNA, 20 nt, Human
ugccuaggguccgcgccggg

SEQ ID NO: 896186 - RNA, 18 nt, Human
ugcuagcuacacuccuac

SEQ ID NO: 896187 - RNA, 23 nt, Human
ugcucagcugguuuuucaaaggg

SEQ ID NO: 896188 - RNA, 22 nt, Human
ugcucuguucaauacuacguug

SEQ ID NO: 896189 - RNA, 24 nt, Human
uggaaaaaguagggauggccacac

SEQ ID NO: 896190 - RNA, 23 nt, Human
uggaaggacaccugccuuaaaua

SEQ ID NO: 896191 - RNA, 22 nt, Human
uggaggaaagcagcucagaguc

SEQ ID NO: 896192 - RNA, 18 nt, Human
ugggaaggaggaaggugg

SEQ ID NO: 896193 - RNA, 23 nt, Human
ugggaggcgaguccuguggauca

SEQ ID NO: 896194 - RNA, 22 nt, Human
uggggcagguagugagagguca

SEQ ID NO: 896195 - RNA, 19 nt, Human
ugguagacaaugauggugg

SEQ ID NO: 896196 - RNA, 20 nt, Human
uggugcccuccuggguagcu

SEQ ID NO: 896197 - RNA, 22 nt, Human
uggugcccuccuggguagcuuu

SEQ ID NO: 896198 - RNA, 21 nt, Human
ugguguagcgcuggccaaagu

SEQ ID NO: 896199 - RNA, 21 nt, Human
ugucaggagcccgcgagcucc

SEQ ID NO: 896200 - RNA, 21 nt, Human
ugucaggagcccgcgagcucc

SEQ ID NO: 896201 - RNA, 18 nt, Human
uuaaaaaaacagacaaac

SEQ ID NO: 896202 - RNA, 24 nt, Human
uuaaaaaaagcccacgucauaaaa

SEQ ID NO: 896203 - RNA, 20 nt, Human
uuaaauauggucacugugcc

SEQ ID NO: 896204 - RNA, 18 nt, Human
uuagaaauaaacagauac

SEQ ID NO: 896205 - RNA, 25 nt, Human
uuagccccaucccacccucucccuc

SEQ ID NO: 896206 - RNA, 21 nt, Human
uuaggacuuguuggguggaag

SEQ ID NO: 896207 - RNA, 19 nt, Human
uuccaggugcuucuggcuc

SEQ ID NO: 896208 - RNA, 20 nt, Human
uucccuuccaggugcuucug

SEQ ID NO: 896209 - RNA, 23 nt, Human
uuccgcgccgcuccgcgccccuc

SEQ ID NO: 896210 - RNA, 23 nt, Human
uucugcucagcugguuuuucaaa

SEQ ID NO: 896211 - RNA, 23 nt, Human
uugaggagacagcaaacagccuu

SEQ ID NO: 896212 - RNA, 23 nt, Human
uugcagaaccuuuccccuacucc

SEQ ID NO: 896213 - RNA, 20 nt, Human
uugggcuuuguguccugggu

SEQ ID NO: 896214 - RNA, 24 nt, Human
uuguguccugggucccugaggaaa

SEQ ID NO: 896215 - RNA, 23 nt, Human
uuuuuuggcaauuugcucucuga

SEQ ID NO: 896216 - RNA, 21 nt, Human
aaaacaaaggguauuuccucc

SEQ ID NO: 896217 - RNA, 22 nt, Human
aaaccgaaccuccaugaguuua

SEQ ID NO: 896218 - RNA, 19 nt, Human
aaagcauguuucaaauaua

SEQ ID NO: 896219 - RNA, 22 nt, Human
acacaccuuaaacaaacagaau

SEQ ID NO: 896220 - RNA, 19 nt, Human
acagugacuguuucccaag

SEQ ID NO: 896221 - RNA, 22 nt, Human
acauuuuaacccugaagauaag

SEQ ID NO: 896222 - RNA, 19 nt, Human
acccugaagauaagaaaaa

SEQ ID NO: 896223 - RNA, 28 nt, Human
acgcagccgcggagacugcggccccucu

SEQ ID NO: 896224 - RNA, 19 nt, Human
agaaugugcauuaacaaaa

SEQ ID NO: 896225 - RNA, 18 nt, Human
agcgauaggcgcugaagg

SEQ ID NO: 896226 - RNA, 19 nt, Human
caacaaccucaccacuucc

SEQ ID NO: 896227 - RNA, 21 nt, Human
caagucggagucauuagcuga

SEQ ID NO: 896228 - RNA, 23 nt, Human
cacacaccuuaaacaaacagaau

SEQ ID NO: 896229 - RNA, 20 nt, Human
cagccgcggagacugcggcc

SEQ ID NO: 896230 - RNA, 19 nt, Human
caggagaaaccgaaccucc

SEQ ID NO: 896231 - RNA, 25 nt, Human
cccacaguccaccagaugaagcauu

SEQ ID NO: 896232 - RNA, 21 nt, Human
ccucucugcgccccaagagcc

SEQ ID NO: 896233 - RNA, 18 nt, Human
ccucuuuuccccuuuucu

SEQ ID NO: 896234 - RNA, 24 nt, Human
ccugaagauaagaaaaauaacugu

SEQ ID NO: 896235 - RNA, 23 nt, Human
cggggaacauggaggggacugca

SEQ ID NO: 896236 - RNA, 20 nt, Human
cuccaugaguuuagcgucug

SEQ ID NO: 896237 - RNA, 21 nt, Human
cugaaggagcaacaaccucac

SEQ ID NO: 896238 - RNA, 22 nt, Human
cugcggccccucucugcgcccc

SEQ ID NO: 896239 - RNA, 23 nt, Human
gccccaagagccagcgauaggcg

SEQ ID NO: 896240 - RNA, 18 nt, Human
ggccccucucugcgcccc

SEQ ID NO: 896241 - RNA, 24 nt, Human
gggaacauggaggggaccgguacc

SEQ ID NO: 896242 - RNA, 22 nt, Human
guuuucccuuuucauuucuuuu

SEQ ID NO: 896243 - RNA, 23 nt, Human
uaaaaacaaaggguauuuccucc

SEQ ID NO: 896244 - RNA, 21 nt, Human
uaucaggagaaaccgaaccuc

SEQ ID NO: 896245 - RNA, 23 nt, Human
uaucucacacaccuuaaacaaac

SEQ ID NO: 896246 - RNA, 22 nt, Human
ucacacaccuuaaacaaacaga

SEQ ID NO: 896247 - RNA, 24 nt, Human
ucugcucccacaguccaccagaug

SEQ ID NO: 896248 - RNA, 21 nt, Human
ugaagauaagaaaaauaacug

SEQ ID NO: 896249 - RNA, 19 nt, Human
ugccucugcucccacaguc

SEQ ID NO: 896250 - RNA, 21 nt, Human
ugcggccccucucugcgcccc

SEQ ID NO: 896251 - RNA, 21 nt, Human
uggcauuauagauuaauuaca

SEQ ID NO: 896252 - RNA, 23 nt, Human
uuaaaaagcauaauaauuugguu

SEQ ID NO: 896253 - RNA, 22 nt, Human
uuauuuccucuuuuccccuuuu

SEQ ID NO: 896254 - RNA, 24 nt, Human
uugcuggauuaacgauuacuguau

SEQ ID NO: 896255 - RNA, 25 nt, Human
uuuuuuuuuuaaaacacaauuacuu

SEQ ID NO: 896256 - RNA, 25 nt, Human
aaaaauauauccccacaagauacag

SEQ ID NO: 896257 - RNA, 20 nt, Human
aaaccaaagaaucggcccua

SEQ ID NO: 896258 - RNA, 24 nt, Human
aaagacacaaacaguaacugcaca

SEQ ID NO: 896259 - RNA, 21 nt, Human
aacagcuccuuucuucaaguu

SEQ ID NO: 896260 - RNA, 25 nt, Human
aagccagucuuauaauugcucccac

SEQ ID NO: 896261 - RNA, 21 nt, Human
acacaaacaguaacugcacaa

SEQ ID NO: 896262 - RNA, 19 nt, Human
accacagcuguggugugcc

SEQ ID NO: 896263 - RNA, 20 nt, Human
accacagcuguggugugccu

SEQ ID NO: 896264 - RNA, 24 nt, Human
acucaaaaaaauuuagcaaaaacc

SEQ ID NO: 896265 - RNA, 23 nt, Human
agaauucuuuagguuccaauauc

SEQ ID NO: 896266 - RNA, 18 nt, Human
agauuuaccuaaaccacc

SEQ ID NO: 896267 - RNA, 23 nt, Human
agcacaauuuauugucaaacauu

SEQ ID NO: 896268 - RNA, 24 nt, Human
aggaugucuuuuuuaaaaagcuuc

SEQ ID NO: 896269 - RNA, 20 nt, Human
aggguaucuuggcuauaaaa

SEQ ID NO: 896270 - RNA, 23 nt, Human
aggguccuuagagaaauggcuga

SEQ ID NO: 896271 - RNA, 21 nt, Human
auaaaaccaaagaaucggccc

SEQ ID NO: 896272 - RNA, 21 nt, Human
auccucugggugaagagccug

SEQ ID NO: 896273 - RNA, 20 nt, Human
aucugauguauuugcuuccg

SEQ ID NO: 896274 - RNA, 23 nt, Human
auggcaauggauugaaauauauc

SEQ ID NO: 896275 - RNA, 22 nt, Human
auuguggucucuaucauuucuc

SEQ ID NO: 896276 - RNA, 19 nt, Human
auuuaccuaaaccaccacc

SEQ ID NO: 896277 - RNA, 25 nt, Human
caaacuacuaaaaucugagggacac

SEQ ID NO: 896278 - RNA, 21 nt, Human
caacccaucuuucucagcagc

SEQ ID NO: 896279 - RNA, 22 nt, Human
caacccaucuuucucagcagcu

SEQ ID NO: 896280 - RNA, 23 nt, Human
caagauacaguaaaucacuucca

SEQ ID NO: 896281 - RNA, 26 nt, Human
caagauacaguaaaucacuuccaaua

SEQ ID NO: 896282 - RNA, 18 nt, Human
caagcucguaaugcccac

SEQ ID NO: 896283 - RNA, 19 nt, Human
cacagcaauaucaaagaca

SEQ ID NO: 896284 - RNA, 23 nt, Human
cacagcaauaucaaagacacaaa

SEQ ID NO: 896285 - RNA, 25 nt, Human
cacagcaauaucaaagacacaaaca

SEQ ID NO: 896286 - RNA, 18 nt, Human
cacaucuucaacagcucc

SEQ ID NO: 896287 - RNA, 26 nt, Human
caccaagaacaaacaguucaagcuuc

SEQ ID NO: 896288 - RNA, 18 nt, Human
caccccaacugcuucugc

SEQ ID NO: 896289 - RNA, 24 nt, Human
cacccucucuacauccagaccaag

SEQ ID NO: 896290 - RNA, 22 nt, Human
cacuaugugaaaugaacaaggu

SEQ ID NO: 896291 - RNA, 20 nt, Human
cauggcccaccccaugagac

SEQ ID NO: 896292 - RNA, 20 nt, Human
cauuuuaucacccucucuac

SEQ ID NO: 896293 - RNA, 18 nt, Human
ccaccccaugagacuuac

SEQ ID NO: 896294 - RNA, 19 nt, Human
ccagaaauaagcgaaaaua

SEQ ID NO: 896295 - RNA, 20 nt, Human
ccagcggaggccugucaucc

SEQ ID NO: 896296 - RNA, 22 nt, Human
cccacaagauacaguaaaucac

SEQ ID NO: 896297 - RNA, 23 nt, Human
cccguaugcccucaccagauuua

SEQ ID NO: 896298 - RNA, 22 nt, Human
cuaauaaaccacuaugugaaau

SEQ ID NO: 896299 - RNA, 22 nt, Human
cucagaagccaauuugaauaga

SEQ ID NO: 896300 - RNA, 21 nt, Human
cucucugcaaggcaccaagaa

SEQ ID NO: 896301 - RNA, 23 nt, Human
cugaugaucuguucaauaucucu

SEQ ID NO: 896302 - RNA, 20 nt, Human
cugcuggauuaagcuaauac

SEQ ID NO: 896303 - RNA, 18 nt, Human
cuucagauugaaccaaag

SEQ ID NO: 896304 - RNA, 20 nt, Human
cuuucacugagauaggcucc

SEQ ID NO: 896305 - RNA, 21 nt, Human
gacacagcaauaucaaagaca

SEQ ID NO: 896306 - RNA, 22 nt, Human
gacauuuucaguaaaucuggaa

SEQ ID NO: 896307 - RNA, 19 nt, Human
gaggauggaaggaaccaug

SEQ ID NO: 896308 - RNA, 18 nt, Human
ggcuguguuuuugaagaa

SEQ ID NO: 896309 - RNA, 21 nt, Human
guaguuucugaugaucuguuc

SEQ ID NO: 896310 - RNA, 23 nt, Human
gucauccuuucauagacauacuc

SEQ ID NO: 896311 - RNA, 18 nt, Human
gugggcuguaccuauuua

SEQ ID NO: 896312 - RNA, 18 nt, Human
guuaaacugagcuguguc

SEQ ID NO: 896313 - RNA, 21 nt, Human
uaaaucuggaauuaagacugg

SEQ ID NO: 896314 - RNA, 23 nt, Human
uaacugcacaauaucaucugcug

SEQ ID NO: 896315 - RNA, 30 nt, Human
uaagacauacaaauauaaacucaaaaaaag

SEQ ID NO: 896316 - RNA, 18 nt, Human
uaaugauacuuacaaacu

SEQ ID NO: 896317 - RNA, 18 nt, Human
uacaguaaaucacuucca

SEQ ID NO: 896318 - RNA, 22 nt, Human
uaccacagcuguggugugccuu

SEQ ID NO: 896319 - RNA, 22 nt, Human
uaccacagcuguggugugccuu

SEQ ID NO: 896320 - RNA, 20 nt, Human
uaucacccucucuacaucca

SEQ ID NO: 896321 - RNA, 21 nt, Human
uauucagucuuuuaccaagcu

SEQ ID NO: 896322 - RNA, 19 nt, Human
ucaaacauucuauaacugg

SEQ ID NO: 896323 - RNA, 21 nt, Human
ucaaauggacucagaagccaa

SEQ ID NO: 896324 - RNA, 21 nt, Human
ucagcagcugauuuccaauau

SEQ ID NO: 896325 - RNA, 21 nt, Human
uccaauauuaucuucuuugau

SEQ ID NO: 896326 - RNA, 21 nt, Human
ucccacaagacuuuaucaaca

SEQ ID NO: 896327 - RNA, 23 nt, Human
ucccacaagacuuuaucaacagg

SEQ ID NO: 896328 - RNA, 18 nt, Human
ucccguaugcccucacca

SEQ ID NO: 896329 - RNA, 21 nt, Human
ucuacauccagaccaagcccu

SEQ ID NO: 896330 - RNA, 21 nt, Human
ucuaucauuucucaugaaaug

SEQ ID NO: 896331 - RNA, 18 nt, Human
ucucagcagcugauuucc

SEQ ID NO: 896332 - RNA, 18 nt, Human
ucucaugaaauggaauca

SEQ ID NO: 896333 - RNA, 21 nt, Human
ucucuuggcauuuuaucaccc

SEQ ID NO: 896334 - RNA, 24 nt, Human
ucugaucaacuuuggcuccuuuuu

SEQ ID NO: 896335 - RNA, 25 nt, Human
ucugaucaacuuuggcuccuuuuuu

SEQ ID NO: 896336 - RNA, 23 nt, Human
ucuuucuucuuuccagauccucu

SEQ ID NO: 896337 - RNA, 24 nt, Human
ucuuugauuugcuguuuguaagcc

SEQ ID NO: 896338 - RNA, 18 nt, Human
ucuuuuucuaccuaccac

SEQ ID NO: 896339 - RNA, 20 nt, Human
ugaagaauucucauaaacua

SEQ ID NO: 896340 - RNA, 18 nt, Human
ugaagagccuguauggca

SEQ ID NO: 896341 - RNA, 22 nt, Human
ugaagaguagaauuuguuaaaa

SEQ ID NO: 896342 - RNA, 20 nt, Human
ugaucuaguaggucuuccuu

SEQ ID NO: 896343 - RNA, 23 nt, Human
ugcaaggcaccaagaacaaacag

SEQ ID NO: 896344 - RNA, 21 nt, Human
ugcauuuccagcggaggccug

SEQ ID NO: 896345 - RNA, 22 nt, Human
uggaaaucacaugguagaaguu

SEQ ID NO: 896346 - RNA, 21 nt, Human
uggcaaagugagccaacucaa

SEQ ID NO: 896347 - RNA, 22 nt, Human
uguacagcacaauuuauuguca

SEQ ID NO: 896348 - RNA, 18 nt, Human
ugucaaagaucaaaggug

SEQ ID NO: 896349 - RNA, 26 nt, Human
ugucauucgguuaaacugagcugugu

SEQ ID NO: 896350 - RNA, 22 nt, Human
ugugucguucagcgugcacacg

SEQ ID NO: 896351 - RNA, 20 nt, Human
uuacaaaguuggcuuuucag

SEQ ID NO: 896352 - RNA, 26 nt, Human
uuagagaaauggcugauucuaagucu

SEQ ID NO: 896353 - RNA, 19 nt, Human
uuccagaaauaagcgaaaa

SEQ ID NO: 896354 - RNA, 24 nt, Human
uuuagcaaaaaccucaucuuuaau

SEQ ID NO: 896355 - RNA, 22 nt, Human
uuucucagcagcugauuuccaa

SEQ ID NO: 896356 - RNA, 19 nt, Human
uuucucaggguaaaauucc

SEQ ID NO: 896357 - RNA, 22 nt, Human
uuuggaggauggaaggaaccau

SEQ ID NO: 896358 - RNA, 18 nt, Human
uuuguaagccuccucugc

SEQ ID NO: 896359 - RNA, 18 nt, Human
uuuuuuuuuuuuuuucug

SEQ ID NO: 896360 - RNA, 19 nt, Human
aagcagccagggccuggau

SEQ ID NO: 896361 - RNA, 20 nt, Human
aagcagccagggccuggaug

SEQ ID NO: 896362 - RNA, 21 nt, Human
aagcagccagggccuggaugu

SEQ ID NO: 896363 - RNA, 22 nt, Human
accccugaggcgcagaggcaag

SEQ ID NO: 896364 - RNA, 18 nt, Human
agaugacuuccauacccc

SEQ ID NO: 896365 - RNA, 23 nt, Human
agccagggccuggauguuaagga

SEQ ID NO: 896366 - RNA, 24 nt, Human
aggaggcuguugagggggagagug

SEQ ID NO: 896367 - RNA, 19 nt, Human
aggcaaguaacagugccag

SEQ ID NO: 896368 - RNA, 18 nt, Human
aggggaguggucagggca

SEQ ID NO: 896369 - RNA, 18 nt, Human
agugggagaggaagaaca

SEQ ID NO: 896370 - RNA, 21 nt, Human
cagaaggggaccccugaggcg

SEQ ID NO: 896371 - RNA, 19 nt, Human
ccagggccuggauguuaag

SEQ ID NO: 896372 - RNA, 19 nt, Human
ccaggggaguggucagggc

SEQ ID NO: 896373 - RNA, 21 nt, Human
ccauaccccacucuuccuugc

SEQ ID NO: 896374 - RNA, 21 nt, Human
ccccugaggcgcagaggcaag

SEQ ID NO: 896375 - RNA, 21 nt, Human
cugacuuuuauuuuccugcag

SEQ ID NO: 896376 - RNA, 20 nt, Human
cugagcccagaggcagggcc

SEQ ID NO: 896377 - RNA, 18 nt, Human
gaagcagccagggccugg

SEQ ID NO: 896378 - RNA, 18 nt, Human
gaagccagcggugcagaa

SEQ ID NO: 896379 - RNA, 18 nt, Human
gcugaaacucagaauuua

SEQ ID NO: 896380 - RNA, 25 nt, Human
uaaacagugaagggacagaugacuu

SEQ ID NO: 896381 - RNA, 24 nt, Human
uaacagugccaggggaguggucag

SEQ ID NO: 896382 - RNA, 20 nt, Human
uagaaaaaggcugacuuuua

SEQ ID NO: 896383 - RNA, 20 nt, Human
ucaguccauggauuugggcc

SEQ ID NO: 896384 - RNA, 18 nt, Human
ucagugggagaggaagaa

SEQ ID NO: 896385 - RNA, 19 nt, Human
ucagugggagaggaagaac

SEQ ID NO: 896386 - RNA, 24 nt, Human
uccaccuucuuggaguggaagcca

SEQ ID NO: 896387 - RNA, 20 nt, Human
uccauggauuugggccucug

SEQ ID NO: 896388 - RNA, 23 nt, Human
ucuggcaugaagcagccagggcc

SEQ ID NO: 896389 - RNA, 24 nt, Human
ucuggcaugaagcagccagggccu

SEQ ID NO: 896390 - RNA, 23 nt, Human
ugaacuugcagacccugguccac

SEQ ID NO: 896391 - RNA, 19 nt, Human
ugacuuccauaccccacuc

SEQ ID NO: 896392 - RNA, 23 nt, Human
ugacuuccauaccccacucuucc

SEQ ID NO: 896393 - RNA, 20 nt, Human
ugacuuuuauuuuccugcag

SEQ ID NO: 896394 - RNA, 22 nt, Human
ugcagaaggggaccccugaggc

SEQ ID NO: 896395 - RNA, 19 nt, Human
ugccaggggaguggucagg

SEQ ID NO: 896396 - RNA, 23 nt, Human
uggaagccagcggugcagaaggg

SEQ ID NO: 896397 - RNA, 19 nt, Human
uggcaugaagcagccaggc

SEQ ID NO: 896398 - RNA, 19 nt, Human
uggcaugaagcagccaggg

SEQ ID NO: 896399 - RNA, 20 nt, Human
uggcaugaagcagccagggc

SEQ ID NO: 896400 - RNA, 20 nt, Human
uggcugaaacucagaauuua

SEQ ID NO: 896401 - RNA, 26 nt, Human
ugggccucuggcaugaagcagccagg

SEQ ID NO: 896402 - RNA, 24 nt, Human
uggugagaaguggaccuuggaguu

SEQ ID NO: 896403 - RNA, 18 nt, Human
uuccuucucaggaggcug

SEQ ID NO: 896404 - RNA, 19 nt, Human
uuccuugcuggugagaagu

SEQ ID NO: 896405 - RNA, 21 nt, Human
aaauaaaacacaagaaaucaa

SEQ ID NO: 896406 - RNA, 20 nt, Human
aacauuuaacaucccccccu

SEQ ID NO: 896407 - RNA, 18 nt, Human
aacauuuggcaaauaaaa

SEQ ID NO: 896408 - RNA, 18 nt, Human
accccagagauuuccuca

SEQ ID NO: 896409 - RNA, 18 nt, Human
agaaagagagggagcgag

SEQ ID NO: 896410 - RNA, 20 nt, Human
agagaaagagagggagcgag

SEQ ID NO: 896411 - RNA, 19 nt, Human
agagaaucacaacgucccc

SEQ ID NO: 896412 - RNA, 20 nt, Human
agcagauaaagcuaaccccu

SEQ ID NO: 896413 - RNA, 19 nt, Human
agugugggugggcgcgcgg

SEQ ID NO: 896414 - RNA, 25 nt, Human
auaaaacacaagaaaucaaacgaaa

SEQ ID NO: 896415 - RNA, 21 nt, Human
auaaaggcagugaacuuggac

SEQ ID NO: 896416 - RNA, 22 nt, Human
caaagccaacagucuguccuuu

SEQ ID NO: 896417 - RNA, 25 nt, Human
caagaaaucaaacgaaauaaaaaag

SEQ ID NO: 896418 - RNA, 21 nt, Human
cacugggaaggcagagggagg

SEQ ID NO: 896419 - RNA, 23 nt, Human
cagccccuucccucucucccucc

SEQ ID NO: 896420 - RNA, 26 nt, Human
ccaacagucuguccuuucgcuuuucu

SEQ ID NO: 896421 - RNA, 20 nt, Human
cccagagauuuccucagccc

SEQ ID NO: 896422 - RNA, 18 nt, Human
ccccaaagaacuaaugga

SEQ ID NO: 896423 - RNA, 23 nt, Human
ccccaaagaacuaauggaucuuc

SEQ ID NO: 896424 - RNA, 22 nt, Human
ccccagagauuuccucagcccc

SEQ ID NO: 896425 - RNA, 20 nt, Human
ccccuucccucucucccucc

SEQ ID NO: 896426 - RNA, 22 nt, Human
ccuccuauccuccaaacacaaa

SEQ ID NO: 896427 - RNA, 18 nt, Human
ccucucucccuccuaucc

SEQ ID NO: 896428 - RNA, 23 nt, Human
cuaauggaucuuccucucgauuu

SEQ ID NO: 896429 - RNA, 25 nt, Human
cucagccccuucccucucucccucc

SEQ ID NO: 896430 - RNA, 22 nt, Human
cuccucgccuuccuauuaggag

SEQ ID NO: 896431 - RNA, 26 nt, Human
cucucucccuccuauccuccaaacac

SEQ ID NO: 896432 - RNA, 23 nt, Human
cucucucucuuuuuuuuuuaaaa

SEQ ID NO: 896433 - RNA, 22 nt, Human
cucuugaauucauuccccuggc

SEQ ID NO: 896434 - RNA, 19 nt, Human
gaaagccaaaaaauaggca

SEQ ID NO: 896435 - RNA, 25 nt, Human
gagaacgcgggggaaagccgguacc

SEQ ID NO: 896436 - RNA, 21 nt, Human
gagagaaagagagggagcgag

SEQ ID NO: 896437 - RNA, 19 nt, Human
gagggaggagagaaagaga

SEQ ID NO: 896438 - RNA, 21 nt, Human
gcauggagugagugugggugg

SEQ ID NO: 896439 - RNA, 19 nt, Human
gccuucuccucuccucgcc

SEQ ID NO: 896440 - RNA, 24 nt, Human
ggaaaugaucaaaacaagauacug

SEQ ID NO: 896441 - RNA, 25 nt, Human
ggaaaugaucaaaacaagauacugu

SEQ ID NO: 896442 - RNA, 21 nt, Human
ggaagaacgacgugagcguga

SEQ ID NO: 896443 - RNA, 25 nt, Human
ggcaaauaaaacacaagaaaucaaa

SEQ ID NO: 896444 - RNA, 18 nt, Human
uaaaaaagagaaucagga

SEQ ID NO: 896445 - RNA, 19 nt, Human
uaaaacacaagaaaucaaa

SEQ ID NO: 896446 - RNA, 23 nt, Human
uaccccagagauuuccucagccc

SEQ ID NO: 896447 - RNA, 25 nt, Human
uagcaaaucuuuuuuugcugaauuu

SEQ ID NO: 896448 - RNA, 21 nt, Human
uauaugaguguuuucagcauc

SEQ ID NO: 896449 - RNA, 26 nt, Human
ucagugaccauagcagcaugucuucu

SEQ ID NO: 896450 - RNA, 20 nt, Human
ucccacaauccuauaugagu

SEQ ID NO: 896451 - RNA, 26 nt, Human
uccccuggccuucuccucuccucgac

SEQ ID NO: 896452 - RNA, 19 nt, Human
uccuccaaacacaaagcca

SEQ ID NO: 896453 - RNA, 19 nt, Human
ucuguccuuucgcuuuucu

SEQ ID NO: 896454 - RNA, 24 nt, Human
ucuuuuuuuuuuaaaaucaaggcu

SEQ ID NO: 896455 - RNA, 19 nt, Human
ugaagacggacuaaagcug

SEQ ID NO: 896456 - RNA, 19 nt, Human
ugaauucauuccccuggcc

SEQ ID NO: 896457 - RNA, 24 nt, Human
uguccuuucgcuuuucuugaggag

SEQ ID NO: 896458 - RNA, 21 nt, Human
ugugaagacggacuaaagcug

SEQ ID NO: 896459 - RNA, 25 nt, Human
uucuccucuccucgccuuccuauua

SEQ ID NO: 896460 - RNA, 21 nt, Human
uuucccacaauccuauaugag

SEQ ID NO: 896461 - RNA, 23 nt, Human
uuuuauacuucucuauacuuugu

SEQ ID NO: 896462 - RNA, 23 nt, Human
uuuuuuuuuucaaacaauaacuu

SEQ ID NO: 896463 - RNA, 21 nt, Human
aaacauacccucaacaaguca

SEQ ID NO: 896464 - RNA, 24 nt, Human
aaacauaguucugauaaaaccugc

SEQ ID NO: 896465 - RNA, 18 nt, Human
aaacugaagacugccacu

SEQ ID NO: 896466 - RNA, 24 nt, Human
aaaguaaaauaaccaaagucuuaa

SEQ ID NO: 896467 - RNA, 23 nt, Human
aaauauugguaggcauguaagcu

SEQ ID NO: 896468 - RNA, 19 nt, Human
aacccuaccccuuuuaccc

SEQ ID NO: 896469 - RNA, 22 nt, Human
aagcgggcgggaaucggcccaa

SEQ ID NO: 896470 - RNA, 24 nt, Human
aagggcccuuaaaaaacccaacug

SEQ ID NO: 896471 - RNA, 22 nt, Human
acacaaaacagaccuucaucuu

SEQ ID NO: 896472 - RNA, 18 nt, Human
acaccaagucaucccaac

SEQ ID NO: 896473 - RNA, 19 nt, Human
acucugcaaacugaagacu

SEQ ID NO: 896474 - RNA, 22 nt, Human
acucugcaaacugaagacugcc

SEQ ID NO: 896475 - RNA, 22 nt, Human
acucugcuucaauaacuccagc

SEQ ID NO: 896476 - RNA, 24 nt, Human
agaacacauacagauccauauuaa

SEQ ID NO: 896477 - RNA, 22 nt, Human
agaacucugaaguuugcacuca

SEQ ID NO: 896478 - RNA, 19 nt, Human
agccgcgccgaagcagcag

SEQ ID NO: 896479 - RNA, 19 nt, Human
aggaagggggagcgccacc

SEQ ID NO: 896480 - RNA, 19 nt, Human
aggaggaagcgggcgggaa

SEQ ID NO: 896481 - RNA, 23 nt, Human
auacccacccacccucuuuauuc

SEQ ID NO: 896482 - RNA, 22 nt, Human
caaggacaaaggaguguuaaaa

SEQ ID NO: 896483 - RNA, 20 nt, Human
cacccucuuuauucacaagg

SEQ ID NO: 896484 - RNA, 19 nt, Human
cagaauagucaccucaucc

SEQ ID NO: 896485 - RNA, 21 nt, Human
cagaauagucaccucauccca

SEQ ID NO: 896486 - RNA, 18 nt, Human
cagcccgcuuccgucucg

SEQ ID NO: 896487 - RNA, 19 nt, Human
caucuauacccacccaccc

SEQ ID NO: 896488 - RNA, 21 nt, Human
ccauaguacacauuugaggga

SEQ ID NO: 896489 - RNA, 24 nt, Human
cccacccacccucuuuauucacaa

SEQ ID NO: 896490 - RNA, 19 nt, Human
cccccucgcacgucaccac

SEQ ID NO: 896491 - RNA, 24 nt, Human
cccuacucugcaaacugaagacug

SEQ ID NO: 896492 - RNA, 22 nt, Human
cccucgcacgucaccacgugcg

SEQ ID NO: 896493 - RNA, 29 nt, Human
cccucgcacgucaccacgugcgcugccgg

SEQ ID NO: 896494 - RNA, 23 nt, Human
ccgcacccccucgcacgucaccc

SEQ ID NO: 896495 - RNA, 22 nt, Human
ccgccgacgccucccagcccgc

SEQ ID NO: 896496 - RNA, 24 nt, Human
ccgccgacgccucccagcccgcuu

SEQ ID NO: 896497 - RNA, 18 nt, Human
cgcacccccucgcacguc

SEQ ID NO: 896498 - RNA, 18 nt, Human
cgcgccgcacccccucgc

SEQ ID NO: 896499 - RNA, 21 nt, Human
cgggcgggaaucggcccaacg

SEQ ID NO: 896500 - RNA, 21 nt, Human
cucagaguuuaaaagacagac

SEQ ID NO: 896501 - RNA, 23 nt, Human
cugaauagaacacauacagaucc

SEQ ID NO: 896502 - RNA, 19 nt, Human
cugcagccaaggcaagaac

SEQ ID NO: 896503 - RNA, 22 nt, Human
gaacacauacagauccauauua

SEQ ID NO: 896504 - RNA, 23 nt, Human
gaacacauacagauccauauuaa

SEQ ID NO: 896505 - RNA, 20 nt, Human
gaccgcucgcgccgcacccc

SEQ ID NO: 896506 - RNA, 22 nt, Human
gagacugaaaggaagggggagc

SEQ ID NO: 896507 - RNA, 19 nt, Human
gcaagcauuaggacaugcu

SEQ ID NO: 896508 - RNA, 21 nt, Human
gcauucuugaaggaaaaaaac

SEQ ID NO: 896509 - RNA, 18 nt, Human
gccgccgccgaccgcucg

SEQ ID NO: 896510 - RNA, 23 nt, Human
gcgccgaagcagcaggcggagaa

SEQ ID NO: 896511 - RNA, 19 nt, Human
gcucgcgccgcacccccuc

SEQ ID NO: 896512 - RNA, 18 nt, Human
ggaaacauucauuucuag

SEQ ID NO: 896513 - RNA, 21 nt, Human
ggcccaacggaaagcgccaga

SEQ ID NO: 896514 - RNA, 21 nt, Human
gggaacucgcucgcucgccga

SEQ ID NO: 896515 - RNA, 19 nt, Human
ggguaugaagacagguggu

SEQ ID NO: 896516 - RNA, 24 nt, Human
gucaggguaugaagacaggugguu

SEQ ID NO: 896517 - RNA, 21 nt, Human
gugcgcugccgccgccgacgc

SEQ ID NO: 896518 - RNA, 23 nt, Human
gugugucuuaagcucuaauggug

SEQ ID NO: 896519 - RNA, 21 nt, Human
uaaaaaacccaacugucuaca

SEQ ID NO: 896520 - RNA, 23 nt, Human
uaaaaacaaaaauagucaauguc

SEQ ID NO: 896521 - RNA, 24 nt, Human
uaaaaccugcauucacaaccuaau

SEQ ID NO: 896522 - RNA, 20 nt, Human
uaaaagacagaccccuacuc

SEQ ID NO: 896523 - RNA, 21 nt, Human
uaaaagacagaccccuacucu

SEQ ID NO: 896524 - RNA, 22 nt, Human
uaaacccuaccccuuuuacccc

SEQ ID NO: 896525 - RNA, 23 nt, Human
uaagaugccaggugaguuauuuu

SEQ ID NO: 896526 - RNA, 19 nt, Human
uaaucugguucaucucuga

SEQ ID NO: 896527 - RNA, 22 nt, Human
uacacauuugagggaagaguca

SEQ ID NO: 896528 - RNA, 23 nt, Human
uacaucuuuaaacccuaccccuu

SEQ ID NO: 896529 - RNA, 19 nt, Human
uagacaccaagucauccca

SEQ ID NO: 896530 - RNA, 21 nt, Human
uagcacuacacauuagacacc

SEQ ID NO: 896531 - RNA, 21 nt, Human
uaugaacagauaaacugaaca

SEQ ID NO: 896532 - RNA, 24 nt, Human
uaugaacagauaaacugaacaaaa

SEQ ID NO: 896533 - RNA, 18 nt, Human
uauuaggcaaauucaauc

SEQ ID NO: 896534 - RNA, 23 nt, Human
uauuuaaaaccaguguuucaaau

SEQ ID NO: 896535 - RNA, 19 nt, Human
ucaaaacuuuuaguaauga

SEQ ID NO: 896536 - RNA, 22 nt, Human
ucaaauaccaaaaaucacagcu

SEQ ID NO: 896537 - RNA, 24 nt, Human
ucacaaguguaccucuacuaacca

SEQ ID NO: 896538 - RNA, 24 nt, Human
ucaccacgugcgcugccgccgccg

SEQ ID NO: 896539 - RNA, 18 nt, Human
ucagaauagucaccucau

SEQ ID NO: 896540 - RNA, 22 nt, Human
uccacaaauuucuuaagcucau

SEQ ID NO: 896541 - RNA, 23 nt, Human
uccacaaauuucuuaagcucauu

SEQ ID NO: 896542 - RNA, 22 nt, Human
uccuuuccaaauaaacccaaaa

SEQ ID NO: 896543 - RNA, 22 nt, Human
ucggcccaacggaaagcgccag

SEQ ID NO: 896544 - RNA, 18 nt, Human
ucucugaagagauggaac

SEQ ID NO: 896545 - RNA, 19 nt, Human
ucugcaaacugaagacugc

SEQ ID NO: 896546 - RNA, 19 nt, Human
ucugcaaacugaagacugc

SEQ ID NO: 896547 - RNA, 22 nt, Human
ucugcaaacugaagacugccac

SEQ ID NO: 896548 - RNA, 20 nt, Human
ucugucaauguaguuuuagu

SEQ ID NO: 896549 - RNA, 23 nt, Human
ucugugauaaugaugcaucauaa

SEQ ID NO: 896550 - RNA, 18 nt, Human
ugaaaggaagggggagcg

SEQ ID NO: 896551 - RNA, 24 nt, Human
ugaacagauaaacugaacaaaaac

SEQ ID NO: 896552 - RNA, 21 nt, Human
ugaaggaaaaaaacugcagcc

SEQ ID NO: 896553 - RNA, 18 nt, Human
ugaauagaacacauacag

SEQ ID NO: 896554 - RNA, 18 nt, Human
ugagaaaaaaaaaccuuu

SEQ ID NO: 896555 - RNA, 19 nt, Human
ugagagaaauaaaguggca

SEQ ID NO: 896556 - RNA, 23 nt, Human
ugauaaaaccugcauucacaacc

SEQ ID NO: 896557 - RNA, 20 nt, Human
ugccuccgccgccgccgacu

SEQ ID NO: 896558 - RNA, 23 nt, Human
uggcaaaacaaauguggaggaga

SEQ ID NO: 896559 - RNA, 19 nt, Human
uguaagcuuccuuuuaaua

SEQ ID NO: 896560 - RNA, 19 nt, Human
uuaaaaacagucaucauau

SEQ ID NO: 896561 - RNA, 25 nt, Human
uuuuacugcuauauaaugucuugcu

SEQ ID NO: 896562 - RNA, 18 nt, Human
uuuuccacaaauuucuua

SEQ ID NO: 896563 - RNA, 25 nt, Human
caauggguuauucuauaccaaaucc

SEQ ID NO: 896564 - RNA, 21 nt, Human
cacccucgcacagcagaaauu

SEQ ID NO: 896565 - RNA, 23 nt, Human
cccccauccacaccucgcguccc

SEQ ID NO: 896566 - RNA, 19 nt, Human
cccgccccaccgacuuggc

SEQ ID NO: 896567 - RNA, 25 nt, Human
ccgcacccagggcaccaucuccgua

SEQ ID NO: 896568 - RNA, 18 nt, Human
ccgcaggcugaggucgcg

SEQ ID NO: 896569 - RNA, 26 nt, Human
cugaggcagaggucaaggcgaccccc

SEQ ID NO: 896570 - RNA, 19 nt, Human
gaccccccauccacaccuc

SEQ ID NO: 896571 - RNA, 18 nt, Human
uaaaauuucagacagcga

SEQ ID NO: 896572 - RNA, 24 nt, Human
uaacuaaaauuucagacagcgaug

SEQ ID NO: 896573 - RNA, 25 nt, Human
uaagaauauacccaaaaaaguaaau

SEQ ID NO: 896574 - RNA, 22 nt, Human
uacccaaaaaaguaaauuucua

SEQ ID NO: 896575 - RNA, 27 nt, Human
uagucuuuauuaaaaacaaaaaauaac

SEQ ID NO: 896576 - RNA, 23 nt, Human
ugaggcagaggucaaggcgaccc

SEQ ID NO: 896577 - RNA, 24 nt, Human
uguacauaauauauauaagaauau

SEQ ID NO: 896578 - RNA, 19 nt, Human
uuucacuuuuaaucauuaa

SEQ ID NO: 896579 - RNA, 23 nt, Human
uuuuuuuuuuuuucacuuuuaau

SEQ ID NO: 896580 - RNA, 25 nt, Human
uuuuuuuuuuuuuuuucacuuuuaa

SEQ ID NO: 896581 - RNA, 24 nt, Human
uuuuuuuuuuuuuuuuucacuuuu

SEQ ID NO: 896582 - RNA, 30 nt, Human
uuuuuuuuuuuuuuuuuuuucacuuuuaaa

SEQ ID NO: 896583 - RNA, 23 nt, Human
aaaaagccgaaggcagucacugc

SEQ ID NO: 896584 - RNA, 19 nt, Human
aaaagcaaccugcagaaca

SEQ ID NO: 896585 - RNA, 18 nt, Human
aaaggcuguguuuauaaa

SEQ ID NO: 896586 - RNA, 21 nt, Human
aagcaaccugcagaacaagaa

SEQ ID NO: 896587 - RNA, 22 nt, Human
aagcaaccugcagaacaagaau

SEQ ID NO: 896588 - RNA, 19 nt, Human
aauuaugaaacuacauagg

SEQ ID NO: 896589 - RNA, 18 nt, Human
aauucacucacaaaguug

SEQ ID NO: 896590 - RNA, 22 nt, Human
acaauagaaaaaaauuaagcac

SEQ ID NO: 896591 - RNA, 19 nt, Human
agagauagaaggcagauua

SEQ ID NO: 896592 - RNA, 24 nt, Human
agccgaaggcagucacugccugac

SEQ ID NO: 896593 - RNA, 18 nt, Human
agggauggagguggggga

SEQ ID NO: 896594 - RNA, 23 nt, Human
auaaaaauauuuaucucuauuaa

SEQ ID NO: 896595 - RNA, 18 nt, Human
auuacaugaaaauaguuc

SEQ ID NO: 896596 - RNA, 22 nt, Human
caaaacacaaucaucgucagag

SEQ ID NO: 896597 - RNA, 26 nt, Human
caacauugugaauauacugacaacca

SEQ ID NO: 896598 - RNA, 20 nt, Human
cagaaaaaaagccgaaggca

SEQ ID NO: 896599 - RNA, 23 nt, Human
cagaaaaaaagccgaaggcaguc

SEQ ID NO: 896600 - RNA, 22 nt, Human
cagcagaaaaaaagccgaaggc

SEQ ID NO: 896601 - RNA, 23 nt, Human
cauauaacuuacacaacacgaaa

SEQ ID NO: 896602 - RNA, 21 nt, Human
cuaaagaaaggcuguguuuau

SEQ ID NO: 896603 - RNA, 23 nt, Human
cugaaauaaacauuuguauuuau

SEQ ID NO: 896604 - RNA, 24 nt, Human
cugaaauuaaaucaaugcuaaaga

SEQ ID NO: 896605 - RNA, 27 nt, Human
cuuuacaacaugaagguacauguuacc

SEQ ID NO: 896606 - RNA, 22 nt, Human
cuuuuuuugggaucccucacuu

SEQ ID NO: 896607 - RNA, 22 nt, Human
gaauacaauuucauuuuuccca

SEQ ID NO: 896608 - RNA, 21 nt, Human
gaauaggcaaauccauagaga

SEQ ID NO: 896609 - RNA, 18 nt, Human
gaggugggggauaaguug

SEQ ID NO: 896610 - RNA, 18 nt, Human
gcagaaaaaaagccgaag

SEQ ID NO: 896611 - RNA, 23 nt, Human
ggaauacaauuucauuuuuccca

SEQ ID NO: 896612 - RNA, 19 nt, Human
gucagcagaaaaaaagccg

SEQ ID NO: 896613 - RNA, 22 nt, Human
uaaaaauauuuaucucuauuaa

SEQ ID NO: 896614 - RNA, 19 nt, Human
uaaaagcaaccugcagaac

SEQ ID NO: 896615 - RNA, 21 nt, Human
uaaaagcaaccugcagaacaa

SEQ ID NO: 896616 - RNA, 18 nt, Human
uaagcacaauauuucacu

SEQ ID NO: 896617 - RNA, 22 nt, Human
uauaaaagcaaccugcagaaca

SEQ ID NO: 896618 - RNA, 24 nt, Human
uauaacaaaacacaaucaucguca

SEQ ID NO: 896619 - RNA, 23 nt, Human
uauagauaaauguuucauguuag

SEQ ID NO: 896620 - RNA, 22 nt, Human
ucaaugcuaaagaaaggcugug

SEQ ID NO: 896621 - RNA, 18 nt, Human
ucacauguauaaaagagu

SEQ ID NO: 896622 - RNA, 19 nt, Human
ucacucacaaaguugaaag

SEQ ID NO: 896623 - RNA, 20 nt, Human
ucagugaauauuaaauauuu

SEQ ID NO: 896624 - RNA, 21 nt, Human
ugaauaacacaauagaaaaaa

SEQ ID NO: 896625 - RNA, 23 nt, Human
ugggaagagacugcuaauuggug

SEQ ID NO: 896626 - RNA, 21 nt, Human
uucaccuucuuuauaaaagca

SEQ ID NO: 896627 - RNA, 20 nt, Human
uucacuagcuauauuuuuga

SEQ ID NO: 896628 - RNA, 24 nt, Human
uucagaauaggcaaauccauagag

SEQ ID NO: 896629 - RNA, 26 nt, Human
uucccaagcuaauaauaaaguuauau

SEQ ID NO: 896630 - RNA, 23 nt, Human
aaauggucaauaaaaacaucaac

SEQ ID NO: 896631 - RNA, 20 nt, Human
aagccaaaaaauuaacuaca

SEQ ID NO: 896632 - RNA, 25 nt, Human
aagcgcacgcggggucucccagcac

SEQ ID NO: 896633 - RNA, 20 nt, Human
aagcggcgguggcgaguggg

SEQ ID NO: 896634 - RNA, 24 nt, Human
aaugcagcccgaggagggagcaau

SEQ ID NO: 896635 - RNA, 22 nt, Human
aauucgcagcgccaucuuccuc

SEQ ID NO: 896636 - RNA, 22 nt, Human
acauuaauuaacaacuccacca

SEQ ID NO: 896637 - RNA, 22 nt, Human
agaaaaaaauaaacaucgugga

SEQ ID NO: 896638 - RNA, 18 nt, Human
agaccuggggcuggagag

SEQ ID NO: 896639 - RNA, 23 nt, Human
agccaggcgcucgcagcggcgcc

SEQ ID NO: 896640 - RNA, 22 nt, Human
auccacucuuaauggcccccag

SEQ ID NO: 896641 - RNA, 24 nt, Human
caauaaaaacaucaacacgauagg

SEQ ID NO: 896642 - RNA, 23 nt, Human
cacacauucaaguucccagacac

SEQ ID NO: 896643 - RNA, 19 nt, Human
caccaaagcagugaacccc

SEQ ID NO: 896644 - RNA, 21 nt, Human
caccaaagcagugaaccccuu

SEQ ID NO: 896645 - RNA, 20 nt, Human
cagaacaauaagcgcccuuc

SEQ ID NO: 896646 - RNA, 18 nt, Human
cagaaugcuuacaauauc

SEQ ID NO: 896647 - RNA, 18 nt, Human
cagaggagcugaacugug

SEQ ID NO: 896648 - RNA, 18 nt, Human
cagccccuuccccguucc

SEQ ID NO: 896649 - RNA, 19 nt, Human
cagcccgaggagggagcaa

SEQ ID NO: 896650 - RNA, 23 nt, Human
cauguccuuucuccccucagccc

SEQ ID NO: 896651 - RNA, 22 nt, Human
ccaaagcuguggacggugaaca

SEQ ID NO: 896652 - RNA, 19 nt, Human
cccccucccucuccuccaa

SEQ ID NO: 896653 - RNA, 22 nt, Human
cccccucccucuccuccaacuc

SEQ ID NO: 896654 - RNA, 23 nt, Human
cccgaaaccccaaacuccuuuaa

SEQ ID NO: 896655 - RNA, 21 nt, Human
cccggaaucccgaagugcugu

SEQ ID NO: 896656 - RNA, 20 nt, Human
cccgguuuacaucucaaggg

SEQ ID NO: 896657 - RNA, 27 nt, Human
cccucccucuccuccaacuccuuuaaa

SEQ ID NO: 896658 - RNA, 19 nt, Human
ccuccaggucugcgcuggc

SEQ ID NO: 896659 - RNA, 18 nt, Human
ccucccgggaccgggccg

SEQ ID NO: 896660 - RNA, 19 nt, Human
ccuuuuuuccaagaagggc

SEQ ID NO: 896661 - RNA, 28 nt, Human
cgaaaccccaaacuccuuuaaagucucc

SEQ ID NO: 896662 - RNA, 18 nt, Human
cgcguggggcugcggcuc

SEQ ID NO: 896663 - RNA, 23 nt, Human
cgggcccgggccaccggcggcgg

SEQ ID NO: 896664 - RNA, 19 nt, Human
cguggcggggcggggcaga

SEQ ID NO: 896665 - RNA, 23 nt, Human
cucccccucccucuccuccaacu

SEQ ID NO: 896666 - RNA, 20 nt, Human
cuccccucagccccuucccc

SEQ ID NO: 896667 - RNA, 27 nt, Human
cucccgaaaccccaaacuccuuuaaaa

SEQ ID NO: 896668 - RNA, 26 nt, Human
cucccucuccuccaacuccuuuaaaa

SEQ ID NO: 896669 - RNA, 22 nt, Human
cuccgcucuaccccgagccgaa

SEQ ID NO: 896670 - RNA, 21 nt, Human
cugcgcguggggcugcggcuc

SEQ ID NO: 896671 - RNA, 23 nt, Human
gaaaagccaaacuaaauauacug

SEQ ID NO: 896672 - RNA, 21 nt, Human
gaaagaaccggaggcaaacac

SEQ ID NO: 896673 - RNA, 18 nt, Human
gagacuuccugccgcugg

SEQ ID NO: 896674 - RNA, 21 nt, Human
gagcugaacugugcccuguag

SEQ ID NO: 896675 - RNA, 22 nt, Human
gaggagcugaacugugcccugu

SEQ ID NO: 896676 - RNA, 19 nt, Human
gaggcagaggggccggcag

SEQ ID NO: 896677 - RNA, 20 nt, Human
gcacaagggacaggcucgau

SEQ ID NO: 896678 - RNA, 18 nt, Human
gcgcguggcggggcgggg

SEQ ID NO: 896679 - RNA, 20 nt, Human
gcgcuggccggggcgccugc

SEQ ID NO: 896680 - RNA, 18 nt, Human
gcuguggcgaucaggcca

SEQ ID NO: 896681 - RNA, 21 nt, Human
gcuucccacgguggaaagaac

SEQ ID NO: 896682 - RNA, 19 nt, Human
ggaaaagccaaacuaaaua

SEQ ID NO: 896683 - RNA, 20 nt, Human
ggagggagcaaucaaggguu

SEQ ID NO: 896684 - RNA, 21 nt, Human
ggauaacccggaaucccgaag

SEQ ID NO: 896685 - RNA, 22 nt, Human
ggccacucaaggcagccagccc

SEQ ID NO: 896686 - RNA, 22 nt, Human
ggcgcccuuucggcccuggggc

SEQ ID NO: 896687 - RNA, 24 nt, Human
ggcuaugguguuguaacaaugcug

SEQ ID NO: 896688 - RNA, 19 nt, Human
gggaggcagaggggccggc

SEQ ID NO: 896689 - RNA, 21 nt, Human
gggaggcagaggggccggcag

SEQ ID NO: 896690 - RNA, 21 nt, Human
ggggaaggccauguccuuucu

SEQ ID NO: 896691 - RNA, 22 nt, Human
ggggaagggaagggagcgaggu

SEQ ID NO: 896692 - RNA, 22 nt, Human
ggugcgggggaggcagaggggc

SEQ ID NO: 896693 - RNA, 18 nt, Human
gguggggguggcguucgc

SEQ ID NO: 896694 - RNA, 22 nt, Human
gugaaccccuuaacugacagaa

SEQ ID NO: 896695 - RNA, 21 nt, Human
guucagaacaauaagcgcccu

SEQ ID NO: 896696 - RNA, 22 nt, Human
uaaaaacaucaacacgauaggc

SEQ ID NO: 896697 - RNA, 18 nt, Human
uaaagucuccuggucccc

SEQ ID NO: 896698 - RNA, 21 nt, Human
uaagacgaaagaggggacucg

SEQ ID NO: 896699 - RNA, 27 nt, Human
uaagcgcccuucacacauucaaguucc

SEQ ID NO: 896700 - RNA, 20 nt, Human
uaagcucuuagcuacaucca

SEQ ID NO: 896701 - RNA, 23 nt, Human
uaagcucuuagcuacauccacuc

SEQ ID NO: 896702 - RNA, 22 nt, Human
uacaauaucugagaaaaauaga

SEQ ID NO: 896703 - RNA, 18 nt, Human
uagcuaagcucuuagcua

SEQ ID NO: 896704 - RNA, 20 nt, Human
ucaacacgauaggcuuuguu

SEQ ID NO: 896705 - RNA, 19 nt, Human
ucaaggggaaagcgcacgc

SEQ ID NO: 896706 - RNA, 22 nt, Human
ucagaacaauaagcgcccuuca

SEQ ID NO: 896707 - RNA, 25 nt, Human
ucagccaggcgcucgcagcggcgcc

SEQ ID NO: 896708 - RNA, 23 nt, Human
ucaggauaacccggaaucccgaa

SEQ ID NO: 896709 - RNA, 23 nt, Human
ucauuuuuaaaacuuuauuucca

SEQ ID NO: 896710 - RNA, 18 nt, Human
uccaagaagggcuguggc

SEQ ID NO: 896711 - RNA, 19 nt, Human
uccacucuuaauggccccc

SEQ ID NO: 896712 - RNA, 22 nt, Human
uccccagcuuugaagauuucua

SEQ ID NO: 896713 - RNA, 18 nt, Human
ucccgaaaccccaaacuc

SEQ ID NO: 896714 - RNA, 21 nt, Human
uccgcucuaccccgagccgaa

SEQ ID NO: 896715 - RNA, 20 nt, Human
uccugggcugcgcguggggc

SEQ ID NO: 896716 - RNA, 22 nt, Human
ucuauguuaggaaaagccaaac

SEQ ID NO: 896717 - RNA, 18 nt, Human
ucugagaaaaauagagug

SEQ ID NO: 896718 - RNA, 21 nt, Human
ugaaaaacagaaugcuuacaa

SEQ ID NO: 896719 - RNA, 24 nt, Human
ugaaaugcagcccgaggagggagc

SEQ ID NO: 896720 - RNA, 19 nt, Human
ugaaccccuuaacugacag

SEQ ID NO: 896721 - RNA, 18 nt, Human
ugcgcacgcucggggcgg

SEQ ID NO: 896722 - RNA, 18 nt, Human
ugcggggaagggaaggga

SEQ ID NO: 896723 - RNA, 18 nt, Human
uggaaagaaccggaggca

SEQ ID NO: 896724 - RNA, 19 nt, Human
uggaaauccugcgaucugg

SEQ ID NO: 896725 - RNA, 25 nt, Human
uggaacacaaugucaggagaccugg

SEQ ID NO: 896726 - RNA, 20 nt, Human
uggaaccugaaacacggacg

SEQ ID NO: 896727 - RNA, 20 nt, Human
uggaauggugccauguccuc

SEQ ID NO: 896728 - RNA, 22 nt, Human
uggcgaggcgagggccaggagc

SEQ ID NO: 896729 - RNA, 19 nt, Human
uggcuuagcccgcagccug

SEQ ID NO: 896730 - RNA, 22 nt, Human
ugguuuauuccaaagcugugga

SEQ ID NO: 896731 - RNA, 25 nt, Human
uguccucccccucccucuccuccaa

SEQ ID NO: 896732 - RNA, 23 nt, Human
ugugugcgcacgcucggggcgac

SEQ ID NO: 896733 - RNA, 18 nt, Human
uuaacugacagaaauuca

SEQ ID NO: 896734 - RNA, 22 nt, Human
uuagcuaagcucuuagcuacau

SEQ ID NO: 896735 - RNA, 18 nt, Human
uucccugcucccgaaacc

SEQ ID NO: 896736 - RNA, 22 nt, Human
uucccugcucccgaaaccccaa

SEQ ID NO: 896737 - RNA, 22 nt, Human
uucucgccuccgaccggucugu

SEQ ID NO: 896738 - RNA, 22 nt, Human
uugaaaaacagaaugcuuacaa

SEQ ID NO: 896739 - RNA, 19 nt, Human
uuggaaauccugcgaucug

SEQ ID NO: 896740 - RNA, 22 nt, Human
uuucccaggaugguuuauucca

SEQ ID NO: 896741 - RNA, 21 nt, Human
uuuuuuuuuuuuuuuucccag

SEQ ID NO: 896742 - RNA, 23 nt, Human
uuuuuuuuuuuuuuuuucccagg

SEQ ID NO: 896743 - RNA, 25 nt, Human
aaaacagaaacauaccagagaggga

SEQ ID NO: 896744 - RNA, 25 nt, Human
aaacaaaugcaccuacacagucaga

SEQ ID NO: 896745 - RNA, 22 nt, Human
aaacaggaauuuguugaccuga

SEQ ID NO: 896746 - RNA, 20 nt, Human
aacagaaacauaccagagag

SEQ ID NO: 896747 - RNA, 25 nt, Human
aacagaaucuuggccaagccaauga

SEQ ID NO: 896748 - RNA, 20 nt, Human
aagaaacauuagauauagga

SEQ ID NO: 896749 - RNA, 18 nt, Human
aagaaaggcaauggggca

SEQ ID NO: 896750 - RNA, 27 nt, Human
aagaaccauaaaggacaaccgguaccc

SEQ ID NO: 896751 - RNA, 21 nt, Human
aaggaggccaaaucucuugug

SEQ ID NO: 896752 - RNA, 23 nt, Human
accauaaaggacaacaaaauaac

SEQ ID NO: 896753 - RNA, 21 nt, Human
acuggaguacaaagacaaaac

SEQ ID NO: 896754 - RNA, 23 nt, Human
acuuggggaaggccaccagugag

SEQ ID NO: 896755 - RNA, 18 nt, Human
agaauauauguaaacuga

SEQ ID NO: 896756 - RNA, 20 nt, Human
aggaagaguuuacuauagua

SEQ ID NO: 896757 - RNA, 27 nt, Human
aggcguuaaaagcugauagaggaagcc

SEQ ID NO: 896758 - RNA, 20 nt, Human
agugaaggggcuguaauaga

SEQ ID NO: 896759 - RNA, 18 nt, Human
auauguaaacugagauaa

SEQ ID NO: 896760 - RNA, 22 nt, Human
augggauuugagggcccucucu

SEQ ID NO: 896761 - RNA, 21 nt, Human
caaaacagaaacauaccagag

SEQ ID NO: 896762 - RNA, 21 nt, Human
caaaauaacaggccuucuucc

SEQ ID NO: 896763 - RNA, 23 nt, Human
caaagggccaggagcccagaagu

SEQ ID NO: 896764 - RNA, 22 nt, Human
caagccaaugaaaaauuaggca

SEQ ID NO: 896765 - RNA, 23 nt, Human
cacaaaacagaaacauaccagag

SEQ ID NO: 896766 - RNA, 22 nt, Human
cacaaaacagaaacauaccagg

SEQ ID NO: 896767 - RNA, 21 nt, Human
caccuauuagcacaugcugcu

SEQ ID NO: 896768 - RNA, 19 nt, Human
cagaagaauggaugcaauu

SEQ ID NO: 896769 - RNA, 23 nt, Human
ccaagcuuggagagcuuuccuaa

SEQ ID NO: 896770 - RNA, 24 nt, Human
cccaugguacauuucuaccuccac

SEQ ID NO: 896771 - RNA, 21 nt, Human
cccaugguacauuucuaccuu

SEQ ID NO: 896772 - RNA, 27 nt, Human
cucccacccugacaaaugccaagcuug

SEQ ID NO: 896773 - RNA, 27 nt, Human
cuccuaaucccaacagccauccuggga

SEQ ID NO: 896774 - RNA, 21 nt, Human
cucucuaggcuuucugaagua

SEQ ID NO: 896775 - RNA, 23 nt, Human
cucucuucucucuaggcuuucug

SEQ ID NO: 896776 - RNA, 22 nt, Human
cucuucgcuuauuuagcagucu

SEQ ID NO: 896777 - RNA, 18 nt, Human
gacagagaaaacauaaaa

SEQ ID NO: 896778 - RNA, 27 nt, Human
gacuuuaucccagaggcaauggggagu

SEQ ID NO: 896779 - RNA, 24 nt, Human
gccaggagcccagaagugaagggg

SEQ ID NO: 896780 - RNA, 20 nt, Human
gcuggaaugggauuugaggg

SEQ ID NO: 896781 - RNA, 21 nt, Human
ggagagacagggagacccagg

SEQ ID NO: 896782 - RNA, 23 nt, Human
guaacagaaucuuggccaagcca

SEQ ID NO: 896783 - RNA, 20 nt, Human
uaaacaaaugcaccuacaca

SEQ ID NO: 896784 - RNA, 22 nt, Human
uaaacaaaugcaccuacacagu

SEQ ID NO: 896785 - RNA, 18 nt, Human
uaaggcccacaaaaauca

SEQ ID NO: 896786 - RNA, 19 nt, Human
uagaggaagcccaguaguc

SEQ ID NO: 896787 - RNA, 24 nt, Human
uauaggaauauagacauacauuau

SEQ ID NO: 896788 - RNA, 21 nt, Human
ucauuuaggggcuggaauggg

SEQ ID NO: 896789 - RNA, 25 nt, Human
uccacuuuucuccuugugaugccac

SEQ ID NO: 896790 - RNA, 18 nt, Human
ucgcaaagggccaggagc

SEQ ID NO: 896791 - RNA, 23 nt, Human
ucuaauccacaaaacagaaacau

SEQ ID NO: 896792 - RNA, 19 nt, Human
ucuaccuccacuuuucucc

SEQ ID NO: 896793 - RNA, 20 nt, Human
ucugaaguacuucgcaaagg

SEQ ID NO: 896794 - RNA, 19 nt, Human
ucugacagagaaaacauaa

SEQ ID NO: 896795 - RNA, 19 nt, Human
ucuucucucuaggcuuucu

SEQ ID NO: 896796 - RNA, 21 nt, Human
ugagcaaaugggaaaaguaag

SEQ ID NO: 896797 - RNA, 18 nt, Human
ugcaccuacacagucaga

SEQ ID NO: 896798 - RNA, 23 nt, Human
ugcugagcucacuuggggaaggc

SEQ ID NO: 896799 - RNA, 22 nt, Human
uggcuggagagacagggagacc

SEQ ID NO: 896800 - RNA, 24 nt, Human
ugggaaaaguaaggcccacaaaaa

SEQ ID NO: 896801 - RNA, 24 nt, Human
ugggauaggaacacuagccucugg

SEQ ID NO: 896802 - RNA, 26 nt, Human
uguaauagacagauaacaaccuggua

SEQ ID NO: 896803 - RNA, 25 nt, Human
ugugaugccacuuucauuuaggggc

SEQ ID NO: 896804 - RNA, 22 nt, Human
uucaaaauuaacucuucgcuua

SEQ ID NO: 896805 - RNA, 19 nt, Human
uuccucauuccacuccuaa

SEQ ID NO: 896806 - RNA, 21 nt, Human
uuuuuuuuuuuuuugauagga

SEQ ID NO: 896807 - RNA, 21 nt, Human
aacaccagacuaucaccacuu

SEQ ID NO: 896808 - RNA, 20 nt, Human
aaccuuuccaaagaagcaaa

SEQ ID NO: 896809 - RNA, 20 nt, Human
aagcuagccauagcagucac

SEQ ID NO: 896810 - RNA, 22 nt, Human
acaaagcuccaguuuucaagag

SEQ ID NO: 896811 - RNA, 20 nt, Human
agacucucuuuugaggaccu

SEQ ID NO: 896812 - RNA, 19 nt, Human
agcacugguguuccugcuu

SEQ ID NO: 896813 - RNA, 20 nt, Human
agccaaaagaaguggcuucu

SEQ ID NO: 896814 - RNA, 18 nt, Human
agccauagcagucacaga

SEQ ID NO: 896815 - RNA, 21 nt, Human
agcgucuacacgacgagugac

SEQ ID NO: 896816 - RNA, 19 nt, Human
aggcagcgucuacacgacg

SEQ ID NO: 896817 - RNA, 21 nt, Human
aucauggugaucugcuggccc

SEQ ID NO: 896818 - RNA, 22 nt, Human
auccacauuuuugucuccccag

SEQ ID NO: 896819 - RNA, 23 nt, Human
caaaagaaguggcuucuguaaca

SEQ ID NO: 896820 - RNA, 18 nt, Human
caaaagguuuuccaaaaa

SEQ ID NO: 896821 - RNA, 24 nt, Human
cacaagguacccucgagagucugu

SEQ ID NO: 896822 - RNA, 19 nt, Human
cagcggcggcggugaggag

SEQ ID NO: 896823 - RNA, 23 nt, Human
cagcuccauuuccugucacuuuu

SEQ ID NO: 896824 - RNA, 22 nt, Human
cauuaugacuuacacagagaua

SEQ ID NO: 896825 - RNA, 21 nt, Human
cccugcucccacaacaggcac

SEQ ID NO: 896826 - RNA, 21 nt, Human
cgaccggggcagcuggggcga

SEQ ID NO: 896827 - RNA, 22 nt, Human
cgcagugaugauucuugugauc

SEQ ID NO: 896828 - RNA, 23 nt, Human
cgggagccaggaucgggcucugg

SEQ ID NO: 896829 - RNA, 21 nt, Human
cgugggaggcgcgaguccagc

SEQ ID NO: 896830 - RNA, 18 nt, Human
cucauucuuuuucuguuu

SEQ ID NO: 896831 - RNA, 22 nt, Human
gagcucguggagcugcugggga

SEQ ID NO: 896832 - RNA, 23 nt, Human
gcccugcucccacaacaggcaca

SEQ ID NO: 896833 - RNA, 18 nt, Human
gccucaucugauugcuca

SEQ ID NO: 896834 - RNA, 19 nt, Human
gcuggagcgagggcugccc

SEQ ID NO: 896835 - RNA, 21 nt, Human
ggauggagccuugguggaugg

SEQ ID NO: 896836 - RNA, 21 nt, Human
ggcaacaucucagcgagugau

SEQ ID NO: 896837 - RNA, 21 nt, Human
ggccaagggcuguucccucaa

SEQ ID NO: 896838 - RNA, 23 nt, Human
gggagguggauggaguccgggag

SEQ ID NO: 896839 - RNA, 19 nt, Human
ggggagguggauggagucc

SEQ ID NO: 896840 - RNA, 18 nt, Human
gguggaugggcuccggga

SEQ ID NO: 896841 - RNA, 18 nt, Human
gugaucugcuggcccugc

SEQ ID NO: 896842 - RNA, 18 nt, Human
uaaaacagugccuuaagc

SEQ ID NO: 896843 - RNA, 24 nt, Human
uaaaacagugccuuaagcaugcaa

SEQ ID NO: 896844 - RNA, 20 nt, Human
uaaguaagcuucuaaaacag

SEQ ID NO: 896845 - RNA, 18 nt, Human
uaccuaucuaauuauccu

SEQ ID NO: 896846 - RNA, 23 nt, Human
uauaaaacuaaguaagcuucuaa

SEQ ID NO: 896847 - RNA, 19 nt, Human
uauucuagaccauugacug

SEQ ID NO: 896848 - RNA, 19 nt, Human
ucaaaagguuuuccaaaaa

SEQ ID NO: 896849 - RNA, 21 nt, Human
ucaggagaaaaccuuuccaaa

SEQ ID NO: 896850 - RNA, 21 nt, Human
ucauuaugacuuacacagaga

SEQ ID NO: 896851 - RNA, 20 nt, Human
ucccacaacaggcacaugug

SEQ ID NO: 896852 - RNA, 20 nt, Human
ugacuuacacagagauaggu

SEQ ID NO: 896853 - RNA, 19 nt, Human
ugaggaccucauuccaggc

SEQ ID NO: 896854 - RNA, 22 nt, Human
ugaggagucaugcaggcuuggg

SEQ ID NO: 896855 - RNA, 20 nt, Human
ugcucccacaacaggcacau

SEQ ID NO: 896856 - RNA, 22 nt, Human
ugcuuaaccauacuccuucuac

SEQ ID NO: 896857 - RNA, 22 nt, Human
uggaaggggcaacaucucagcg

SEQ ID NO: 896858 - RNA, 24 nt, Human
uggauggaguccgggagcucgugg

SEQ ID NO: 896859 - RNA, 19 nt, Human
uggcaggggccaagggcug

SEQ ID NO: 896860 - RNA, 24 nt, Human
ugucagauuccuuucuuuuuucug

SEQ ID NO: 896861 - RNA, 20 nt, Human
uuccaaagaagcaaaguuuu

SEQ ID NO: 896862 - RNA, 24 nt, Human
uucuugugauccccucaucauggu

SEQ ID NO: 896863 - RNA, 19 nt, Human
uugcucagacgaacuccug

SEQ ID NO: 896864 - RNA, 20 nt, Human
uuucugcuucuagacucucu

SEQ ID NO: 896865 - RNA, 20 nt, Human
uuugucuccccagcuccauu

SEQ ID NO: 896866 - RNA, 25 nt, Human
uuuucaagagugugcuuaaccauac

SEQ ID NO: 896867 - RNA, 21 nt, Human
uuuucuguuugagagauguuu

SEQ ID NO: 896868 - RNA, 22 nt, Human
aaaaaaaaaaaaaaaaaaggac

SEQ ID NO: 896869 - RNA, 22 nt, Human
aaaaaaaaaaaaaaaaggacaa

SEQ ID NO: 896870 - RNA, 25 nt, Human
aaaaaaaaaaaaaaggacaaccuuu

SEQ ID NO: 896871 - RNA, 21 nt, Human
aacccagcgcggucugcggcc

SEQ ID NO: 896872 - RNA, 22 nt, Human
acaacacaaacuucucccguca

SEQ ID NO: 896873 - RNA, 23 nt, Human
agcggcagcggcaacccagcgcg

SEQ ID NO: 896874 - RNA, 18 nt, Human
aggcagcugcuuucuccu

SEQ ID NO: 896875 - RNA, 18 nt, Human
agggaggaggaaacagcg

SEQ ID NO: 896876 - RNA, 19 nt, Human
aguauugggaagaggaggg

SEQ ID NO: 896877 - RNA, 20 nt, Human
cccagcgcggucugcggccg

SEQ ID NO: 896878 - RNA, 24 nt, Human
cggcagcggcaacccagcgcgguc

SEQ ID NO: 896879 - RNA, 21 nt, Human
cugcgcccacucccaccgcgg

SEQ ID NO: 896880 - RNA, 19 nt, Human
cuggcacgauggcggcagc

SEQ ID NO: 896881 - RNA, 21 nt, Human
gagcaucuggaggagugggaa

SEQ ID NO: 896882 - RNA, 20 nt, Human
gcauugaaacaucugaacaa

SEQ ID NO: 896883 - RNA, 21 nt, Human
gcggcaacccagcgcggucuc

SEQ ID NO: 896884 - RNA, 20 nt, Human
ggagacccgaggggcuggca

SEQ ID NO: 896885 - RNA, 22 nt, Human
ggcggcagcggcagcggcaacc

SEQ ID NO: 896886 - RNA, 22 nt, Human
gggaauaguauugggaagagga

SEQ ID NO: 896887 - RNA, 29 nt, Human
ucaguagauuaaaaaaaaaaaaaaaaaaa

SEQ ID NO: 896888 - RNA, 18 nt, Human
ucaguggcagcagcgcac

SEQ ID NO: 896889 - RNA, 21 nt, Human
ucucccgucagaugcaacuag

SEQ ID NO: 896890 - RNA, 20 nt, Human
uggagcgucacccggccuca

SEQ ID NO: 896891 - RNA, 24 nt, Human
uggcggcagcggcagcggcaaccc

SEQ ID NO: 896892 - RNA, 18 nt, Human
ugggaagaggagggagga

SEQ ID NO: 896893 - RNA, 20 nt, Human
uuaaaaaaaaaaaaaaaaaa

SEQ ID NO: 896894 - RNA, 18 nt, Human
uuggagcaucuggaggag

SEQ ID NO: 896895 - RNA, 21 nt, Human
ccgggcucacaugguuuguac

SEQ ID NO: 896896 - RNA, 18 nt, Human
gccacgguucaguccagc

SEQ ID NO: 896897 - RNA, 21 nt, Human
gcgccgcggguucggcgccuu

SEQ ID NO: 896898 - RNA, 18 nt, Human
ggcucugauuauguacac

SEQ ID NO: 896899 - RNA, 20 nt, Human
ucacaugguuuguacaauaa

SEQ ID NO: 896900 - RNA, 21 nt, Human
ugauuauguacacgugagaug

SEQ ID NO: 896901 - RNA, 18 nt, Human
uggccuggcugggccggc

SEQ ID NO: 896902 - RNA, 18 nt, Human
uggcugggccggccgggc

SEQ ID NO: 896903 - RNA, 20 nt, Human
uggcugggccggccgggcuc

SEQ ID NO: 896904 - RNA, 23 nt, Human
uguggggcgggcucuccgcagcc

SEQ ID NO: 896905 - RNA, 18 nt, Human
uuuuuuuuuuuuuuuuug

SEQ ID NO: 896906 - RNA, 19 nt, Human
uuuuuuuuuuuuuuuuugu

SEQ ID NO: 896907 - RNA, 19 nt, Human
agcuugccccggcccugcc

SEQ ID NO: 896908 - RNA, 23 nt, Human
cccgcccggcccgcccgcccgcu

SEQ ID NO: 896909 - RNA, 20 nt, Human
cccggcccgcccgcccgcug

SEQ ID NO: 896910 - RNA, 21 nt, Human
ccgucucgcucgccccgcccu

SEQ ID NO: 896911 - RNA, 19 nt, Human
cgcccgcccgcugccucgg

SEQ ID NO: 896912 - RNA, 22 nt, Human
cgcccucgggcccgcccggccc

SEQ ID NO: 896913 - RNA, 23 nt, Human
cgcuggccggcgcgcacucacac

SEQ ID NO: 896914 - RNA, 20 nt, Human
cucgccccgcccucgggccc

SEQ ID NO: 896915 - RNA, 21 nt, Human
gcgcacucacacacacgagcg

SEQ ID NO: 896916 - RNA, 19 nt, Human
gcgcgcacucacacacacg

SEQ ID NO: 896917 - RNA, 21 nt, Human
aaaaaacagguaaauauaaug

SEQ ID NO: 896918 - RNA, 19 nt, Human
aacaaauucugugucuaca

SEQ ID NO: 896919 - RNA, 21 nt, Human
aauuuaaaguccauuuccccu

SEQ ID NO: 896920 - RNA, 19 nt, Human
acaaagcaauauauauaua

SEQ ID NO: 896921 - RNA, 23 nt, Human
acaaagcaauauauauauauauu

SEQ ID NO: 896922 - RNA, 26 nt, Human
agcacaacuucuuuuauauggucacu

SEQ ID NO: 896923 - RNA, 20 nt, Human
aggagccgggagcagccggg

SEQ ID NO: 896924 - RNA, 20 nt, Human
aguaacaucgcugaagcugg

SEQ ID NO: 896925 - RNA, 21 nt, Human
aucuucaccuaguuucuccaa

SEQ ID NO: 896926 - RNA, 18 nt, Human
auguaguggcagugcugc

SEQ ID NO: 896927 - RNA, 21 nt, Human
caaaagaaacuauguauagug

SEQ ID NO: 896928 - RNA, 23 nt, Human
caaagcugagacuucacgcauac

SEQ ID NO: 896929 - RNA, 22 nt, Human
caaguacaaaagaaacuaugua

SEQ ID NO: 896930 - RNA, 24 nt, Human
caccuacagaccaaaguucaugcg

SEQ ID NO: 896931 - RNA, 25 nt, Human
cacuguguucauguuuuguauauuc

SEQ ID NO: 896932 - RNA, 20 nt, Human
cccaugcauucaaacauuuc

SEQ ID NO: 896933 - RNA, 18 nt, Human
ccccgggaccauagccgg

SEQ ID NO: 896934 - RNA, 23 nt, Human
ccgccgccuccuccugggcgucc

SEQ ID NO: 896935 - RNA, 24 nt, Human
ccgccgccuccuccugggcguccu

SEQ ID NO: 896936 - RNA, 18 nt, Human
ccgccgcugaacuuugcg

SEQ ID NO: 896937 - RNA, 22 nt, Human
ccggcagcugggagccaggggc

SEQ ID NO: 896938 - RNA, 18 nt, Human
ccggccgccgccgccgcc

SEQ ID NO: 896939 - RNA, 18 nt, Human
ccuccuccgcuuuuccca

SEQ ID NO: 896940 - RNA, 18 nt, Human
ccucgggagggaacgggg

SEQ ID NO: 896941 - RNA, 20 nt, Human
ccucugggcugcgggaugaa

SEQ ID NO: 896942 - RNA, 21 nt, Human
cgccgccgccgccuccuccug

SEQ ID NO: 896943 - RNA, 18 nt, Human
cggccuggcugcgcugcc

SEQ ID NO: 896944 - RNA, 19 nt, Human
cgggagcagccgggccggg

SEQ ID NO: 896945 - RNA, 21 nt, Human
cgggagcagccgggccgggcg

SEQ ID NO: 896946 - RNA, 19 nt, Human
cgggaugaagcgccgccgu

SEQ ID NO: 896947 - RNA, 23 nt, Human
cgucauucauuacuuuaaguagc

SEQ ID NO: 896948 - RNA, 23 nt, Human
cucuucugguuuaguuuuuuaaa

SEQ ID NO: 896949 - RNA, 21 nt, Human
cugcgcugccccgcggagcgg

SEQ ID NO: 896950 - RNA, 21 nt, Human
cuucccggccgccgccgccgc

SEQ ID NO: 896951 - RNA, 24 nt, Human
cuucugguuuaguuuuuuaaaaag

SEQ ID NO: 896952 - RNA, 21 nt, Human
cuuucugguugcaucuucacc

SEQ ID NO: 896953 - RNA, 22 nt, Human
gagaaggcucuuuaacaaacac

SEQ ID NO: 896954 - RNA, 21 nt, Human
gcccugguuucuuccuccucc

SEQ ID NO: 896955 - RNA, 21 nt, Human
gcccugguuucuuccuccucc

SEQ ID NO: 896956 - RNA, 19 nt, Human
gccgccgccgccuccuccu

SEQ ID NO: 896957 - RNA, 19 nt, Human
gcgccgggcucggucagcg

SEQ ID NO: 896958 - RNA, 19 nt, Human
gcgcugccccgcggagcgg

SEQ ID NO: 896959 - RNA, 19 nt, Human
gcugaacuuugcgagaccu

SEQ ID NO: 896960 - RNA, 23 nt, Human
gcugccccgcggagcggcccugc

SEQ ID NO: 896961 - RNA, 24 nt, Human
ggcccugguuucuuccuccuccug

SEQ ID NO: 896962 - RNA, 20 nt, Human
gggccgggaccgcgcgggga

SEQ ID NO: 896963 - RNA, 25 nt, Human
gggcugcgggaugaagcgccgccgu

SEQ ID NO: 896964 - RNA, 18 nt, Human
ggucccgggcaccugggg

SEQ ID NO: 896965 - RNA, 19 nt, Human
gucugaggucuucuugcuc

SEQ ID NO: 896966 - RNA, 26 nt, Human
uaaaaaacagguaaauauaaugacua

SEQ ID NO: 896967 - RNA, 21 nt, Human
uaaaaaguuucaucauggcug

SEQ ID NO: 896968 - RNA, 23 nt, Human
uaagacccaugcauucaaacauu

SEQ ID NO: 896969 - RNA, 20 nt, Human
uaauaaugaaaaacugugau

SEQ ID NO: 896970 - RNA, 19 nt, Human
uacacauggagagguucca

SEQ ID NO: 896971 - RNA, 24 nt, Human
uacagaccaaaguucaugcguaac

SEQ ID NO: 896972 - RNA, 20 nt, Human
uacauuguguuaaaaaacag

SEQ ID NO: 896973 - RNA, 19 nt, Human
uacuauauacacauggaga

SEQ ID NO: 896974 - RNA, 24 nt, Human
uagccaagcauaugucuacauuua

SEQ ID NO: 896975 - RNA, 25 nt, Human
uagggguuuucauuucucuucauga

SEQ ID NO: 896976 - RNA, 20 nt, Human
uauaacaaauucugugucua

SEQ ID NO: 896977 - RNA, 18 nt, Human
ucccaccucuucuggcug

SEQ ID NO: 896978 - RNA, 21 nt, Human
ucccaccucuucuggcugccc

SEQ ID NO: 896979 - RNA, 21 nt, Human
ucggcgcccgcagccgccgcu

SEQ ID NO: 896980 - RNA, 18 nt, Human
ucgucugccgcuagcccg

SEQ ID NO: 896981 - RNA, 24 nt, Human
ucuacaauaauuuuugaaguguau

SEQ ID NO: 896982 - RNA, 23 nt, Human
ucucuuauuuuaaagucucuucu

SEQ ID NO: 896983 - RNA, 24 nt, Human
ucugaggucuucuugcucuaaagu

SEQ ID NO: 896984 - RNA, 18 nt, Human
ucugccgcuagcccgggg

SEQ ID NO: 896985 - RNA, 22 nt, Human
ugaggucuucuugcucuaaagu

SEQ ID NO: 896986 - RNA, 19 nt, Human
ugccccgcggagcggcccu

SEQ ID NO: 896987 - RNA, 21 nt, Human
ugccccggcuccgucccgucc

SEQ ID NO: 896988 - RNA, 19 nt, Human
uguacauagacaagugcca

SEQ ID NO: 896989 - RNA, 21 nt, Human
uucagaguuaaauagcacaac

SEQ ID NO: 896990 - RNA, 24 nt, Human
uucaugaaauaaaacuguauuuaa

SEQ ID NO: 896991 - RNA, 23 nt, Human
uucauguuuuguauauucaagua

SEQ ID NO: 896992 - RNA, 22 nt, Human
uucccggccgccgccgccgccu

SEQ ID NO: 896993 - RNA, 21 nt, Human
uugcaucuucaccuaguuucu

SEQ ID NO: 896994 - RNA, 18 nt, Human
acaagggaaaggccaagg

SEQ ID NO: 896995 - RNA, 22 nt, Human
agcugggggaguagaggcuaua

SEQ ID NO: 896996 - RNA, 20 nt, Human
agugcagggucaagagcaag

SEQ ID NO: 896997 - RNA, 22 nt, Human
auaaauacaagggaaaggccaa

SEQ ID NO: 896998 - RNA, 19 nt, Human
auggagguccaaaauucug

SEQ ID NO: 896999 - RNA, 18 nt, Human
caagagcaagaagcuggg

SEQ ID NO: 897000 - RNA, 21 nt, Human
ccaagggucuucuaucccuga

SEQ ID NO: 897001 - RNA, 22 nt, Human
cccccaguucagagguaagaac

SEQ ID NO: 897002 - RNA, 19 nt, Human
ccuccuggccccacccacc

SEQ ID NO: 897003 - RNA, 23 nt, Human
cuagaaacaagugaagugugcua

SEQ ID NO: 897004 - RNA, 20 nt, Human
cuuaugggagcccccaguuc

SEQ ID NO: 897005 - RNA, 20 nt, Human
gcccccaguucagagguaag

SEQ ID NO: 897006 - RNA, 19 nt, Human
uagccuaauaauagagauc

SEQ ID NO: 897007 - RNA, 21 nt, Human
uaucagcucaguauauccuuc

SEQ ID NO: 897008 - RNA, 19 nt, Human
uggagguccaaaauucugg

SEQ ID NO: 897009 - RNA, 22 nt, Human
ugucuugcccacuuuuuucaac

SEQ ID NO: 897010 - RNA, 26 nt, Human
uuucauagcaacguugguugauugcc

SEQ ID NO: 897011 - RNA, 18 nt, Human
uuuuuuuuuuuuuuuuug

SEQ ID NO: 897012 - RNA, 25 nt, Human
uuuuuuuuuuuuuuuuuuguuuuuu

SEQ ID NO: 897013 - RNA, 19 nt, Human
aagcagcuggucauuuugc

SEQ ID NO: 897014 - RNA, 22 nt, Human
agugagcaccuccucuucucug

SEQ ID NO: 897015 - RNA, 21 nt, Human
cacuacacagacgagggagcc

SEQ ID NO: 897016 - RNA, 22 nt, Human
cgcucccucccucucacugccc

SEQ ID NO: 897017 - RNA, 21 nt, Human
cuacgcaccagguucugugcu

SEQ ID NO: 897018 - RNA, 30 nt, Human
cucacugcccggagucugggcgagcugccu

SEQ ID NO: 897019 - RNA, 22 nt, Human
cugguuagugagcaccuccucu

SEQ ID NO: 897020 - RNA, 24 nt, Human
cugguuagugagcaccuccucuuc

SEQ ID NO: 897021 - RNA, 19 nt, Human
gaacugggagacacgcccc

SEQ ID NO: 897022 - RNA, 18 nt, Human
gagaugggugcuguucuu

SEQ ID NO: 897023 - RNA, 18 nt, Human
gagcugccugguuaguga

SEQ ID NO: 897024 - RNA, 21 nt, Human
gcccggagucugggcgagcug

SEQ ID NO: 897025 - RNA, 20 nt, Human
uagugagcaccuccucuucu

SEQ ID NO: 897026 - RNA, 25 nt, Human
uagugagcaccuccucuucucuggg

SEQ ID NO: 897027 - RNA, 21 nt, Human
uccacuacacagacgagggag

SEQ ID NO: 897028 - RNA, 24 nt, Human
ucucacugcccggagucugggcga

SEQ ID NO: 897029 - RNA, 24 nt, Human
ugaggcuaggaggggucacguggc

SEQ ID NO: 897030 - RNA, 19 nt, Human
ugaugagguugcucaccug

SEQ ID NO: 897031 - RNA, 19 nt, Human
ugccaggugacuaagcagc

SEQ ID NO: 897032 - RNA, 19 nt, Human
ugguuagugagcaccuccu

SEQ ID NO: 897033 - RNA, 22 nt, Human
uuagucucaggcaacacuaaga

SEQ ID NO: 897034 - RNA, 19 nt, Human
aaaagugguucuggaucca

SEQ ID NO: 897035 - RNA, 19 nt, Human
aacaaugaugguggucacc

SEQ ID NO: 897036 - RNA, 19 nt, Human
aacagcauugcuccuccag

SEQ ID NO: 897037 - RNA, 20 nt, Human
aacagcauugcuccuccagc

SEQ ID NO: 897038 - RNA, 19 nt, Human
aagaugggacccaggaagg

SEQ ID NO: 897039 - RNA, 19 nt, Human
aagugguucuggauccagg

SEQ ID NO: 897040 - RNA, 18 nt, Human
aggaaaacugaacaucug

SEQ ID NO: 897041 - RNA, 21 nt, Human
aggccccaugaacacccccaa

SEQ ID NO: 897042 - RNA, 18 nt, Human
agugguucuggauccagg

SEQ ID NO: 897043 - RNA, 23 nt, Human
auguguugugcauguaugugugu

SEQ ID NO: 897044 - RNA, 22 nt, Human
caggaaaacugaacaucugaga

SEQ ID NO: 897045 - RNA, 25 nt, Human
caggccccaugaacacccccaaaga

SEQ ID NO: 897046 - RNA, 19 nt, Human
cagugugaaaaugaacuaa

SEQ ID NO: 897047 - RNA, 19 nt, Human
cccaugaacacccccaaag

SEQ ID NO: 897048 - RNA, 23 nt, Human
cccaugaacacccccaaagaaug

SEQ ID NO: 897049 - RNA, 27 nt, Human
cccaugaacacccccaaagaaugcccc

SEQ ID NO: 897050 - RNA, 19 nt, Human
ccccaaagaaugccccucc

SEQ ID NO: 897051 - RNA, 20 nt, Human
ccccaaagaaugccccuccu

SEQ ID NO: 897052 - RNA, 21 nt, Human
ccccaaagaaugccccuccuc

SEQ ID NO: 897053 - RNA, 19 nt, Human
ccccaugaacacccccaaa

SEQ ID NO: 897054 - RNA, 28 nt, Human
ccccaugaacacccccaaagaaugcccu

SEQ ID NO: 897055 - RNA, 19 nt, Human
cccccaaagaaugccccuc

SEQ ID NO: 897056 - RNA, 27 nt, Human
ccucuuggaaauaaaagugguucuggg

SEQ ID NO: 897057 - RNA, 18 nt, Human
cuauaggaaaaaaagauc

SEQ ID NO: 897058 - RNA, 23 nt, Human
cuccucuuggaaauaaaaguggu

SEQ ID NO: 897059 - RNA, 20 nt, Human
gaacacccccaaagaaugcc

SEQ ID NO: 897060 - RNA, 20 nt, Human
gcauguauguguguugagga

SEQ ID NO: 897061 - RNA, 19 nt, Human
ggacccaggaagggauugc

SEQ ID NO: 897062 - RNA, 25 nt, Human
guaagaugggacccaggaagggauu

SEQ ID NO: 897063 - RNA, 21 nt, Human
uauguguugugcauguaugug

SEQ ID NO: 897064 - RNA, 21 nt, Human
uccaggccccaugaacacccc

SEQ ID NO: 897065 - RNA, 19 nt, Human
ugaacacccccaaagaaug

SEQ ID NO: 897066 - RNA, 21 nt, Human
ugaggaagaggauggggaaaa

SEQ ID NO: 897067 - RNA, 20 nt, Human
ugccccuccucuuggaaaua

SEQ ID NO: 897068 - RNA, 18 nt, Human
uguauauguguugugcau

SEQ ID NO: 897069 - RNA, 28 nt, Human
uguguugugcauguauguguguugagga

SEQ ID NO: 897070 - RNA, 19 nt, Human
uguugugcauguaugugug

SEQ ID NO: 897071 - RNA, 26 nt, Human
uguugugcauguauguguguugagga

SEQ ID NO: 897072 - RNA, 25 nt, Human
aaaaaaaaaaaaaguaauacgaaag

SEQ ID NO: 897073 - RNA, 25 nt, Human
aaaaaaaaaaaguaauacgaaagca

SEQ ID NO: 897074 - RNA, 19 nt, Human
aaaaaaaacucccuuaugg

SEQ ID NO: 897075 - RNA, 25 nt, Human
aaagaccgaggaugauaucaaauaa

SEQ ID NO: 897076 - RNA, 20 nt, Human
aaaugauaucaaacaaacaa

SEQ ID NO: 897077 - RNA, 24 nt, Human
aacaaacaagcuaccuagaauuca

SEQ ID NO: 897078 - RNA, 21 nt, Human
aacaccuacagcagagagaaa

SEQ ID NO: 897079 - RNA, 22 nt, Human
aaccacaaccauucuaaucuuc

SEQ ID NO: 897080 - RNA, 19 nt, Human
aagcaaagaugaauuagac

SEQ ID NO: 897081 - RNA, 21 nt, Human
aaggguaggguccagguggcu

SEQ ID NO: 897082 - RNA, 22 nt, Human
aaugucuuuuuaaaccacaacc

SEQ ID NO: 897083 - RNA, 21 nt, Human
acaccuacagcagagagaaac

SEQ ID NO: 897084 - RNA, 20 nt, Human
acagaguuuccuucaggaag

SEQ ID NO: 897085 - RNA, 21 nt, Human
acaguacccaaagcaaaauac

SEQ ID NO: 897086 - RNA, 22 nt, Human
acaugggcucuagauuuagaca

SEQ ID NO: 897087 - RNA, 18 nt, Human
accauucuaaucuucaau

SEQ ID NO: 897088 - RNA, 21 nt, Human
acccggggcuggguuuugggg

SEQ ID NO: 897089 - RNA, 21 nt, Human
acucauuuuaccacuuucccc

SEQ ID NO: 897090 - RNA, 23 nt, Human
acucauuuuaccacuuuccccaa

SEQ ID NO: 897091 - RNA, 21 nt, Human
acucgugagcgccuguguguc

SEQ ID NO: 897092 - RNA, 22 nt, Human
agaaacaaaugauaucaaacaa

SEQ ID NO: 897093 - RNA, 22 nt, Human
agaaaggacuuuuaaguauuca

SEQ ID NO: 897094 - RNA, 25 nt, Human
agaacaccuacagcagagagaaaca

SEQ ID NO: 897095 - RNA, 23 nt, Human
agagaagcagcuucuugccuagg

SEQ ID NO: 897096 - RNA, 18 nt, Human
aggagagacucgugagcg

SEQ ID NO: 897097 - RNA, 23 nt, Human
aguguugcaguuaaagaacaugg

SEQ ID NO: 897098 - RNA, 21 nt, Human
auaaaguaacaggaagcaaag

SEQ ID NO: 897099 - RNA, 19 nt, Human
auacuagaacuuaauagcc

SEQ ID NO: 897100 - RNA, 18 nt, Human
aucacaguacccaaagca

SEQ ID NO: 897101 - RNA, 20 nt, Human
caccuacagcagagagaaac

SEQ ID NO: 897102 - RNA, 22 nt, Human
caccuacagcagagagaaacaa

SEQ ID NO: 897103 - RNA, 23 nt, Human
cagcagagagaaacaaaugauau

SEQ ID NO: 897104 - RNA, 23 nt, Human
cagcagcagcagucgcgaaaggg

SEQ ID NO: 897105 - RNA, 18 nt, Human
cagcagucgcgaaagggu

SEQ ID NO: 897106 - RNA, 23 nt, Human
cauuuuaccacuuuccccaauuu

SEQ ID NO: 897107 - RNA, 28 nt, Human
cgaaguauuuaaaaaaaaaaaaaaaaaa

SEQ ID NO: 897108 - RNA, 27 nt, Human
cgggcagcagcagcagcagucgcgaaa

SEQ ID NO: 897109 - RNA, 19 nt, Human
cuaauugaauaaagggcaa

SEQ ID NO: 897110 - RNA, 21 nt, Human
cucauuuuaccacuuucccca

SEQ ID NO: 897111 - RNA, 22 nt, Human
cugcuuccacguccgggcagca

SEQ ID NO: 897112 - RNA, 24 nt, Human
cuugcauuugacuccaaauacuag

SEQ ID NO: 897113 - RNA, 21 nt, Human
gaggccgaagaggagcuguug

SEQ ID NO: 897114 - RNA, 23 nt, Human
gauguggagagcuuuagaacaau

SEQ ID NO: 897115 - RNA, 21 nt, Human
gcgaaaggguaggguccaggu

SEQ ID NO: 897116 - RNA, 22 nt, Human
ggguuuugggggucgccgcccu

SEQ ID NO: 897117 - RNA, 20 nt, Human
gguaauaaguuagccugaaa

SEQ ID NO: 897118 - RNA, 23 nt, Human
uaaaaauguaagcacacuuuuga

SEQ ID NO: 897119 - RNA, 20 nt, Human
uaaaaugguucugaaaauaa

SEQ ID NO: 897120 - RNA, 22 nt, Human
uaccacuuuccccaauuuccau

SEQ ID NO: 897121 - RNA, 25 nt, Human
uagaacaauggcugugauaaugaaa

SEQ ID NO: 897122 - RNA, 19 nt, Human
uauuugucuuuuuaaaaau

SEQ ID NO: 897123 - RNA, 22 nt, Human
ugauacagaguuuccuucagga

SEQ ID NO: 897124 - RNA, 27 nt, Human
ugcauuugacuccaaauacuagaacuu

SEQ ID NO: 897125 - RNA, 22 nt, Human
ugccuagguugggacccggggc

SEQ ID NO: 897126 - RNA, 22 nt, Human
uggauucugaauccguaugucc

SEQ ID NO: 897127 - RNA, 19 nt, Human
uggcagagaagcagcuucu

SEQ ID NO: 897128 - RNA, 25 nt, Human
uggcugugauaaugaaaaaaaaaaa

SEQ ID NO: 897129 - RNA, 21 nt, Human
uguaaaaucagcuacaauuua

SEQ ID NO: 897130 - RNA, 22 nt, Human
ugucagaaacaucuuuaucauc

SEQ ID NO: 897131 - RNA, 23 nt, Human
ugugauaaugaaaaaaaaaaaaa

SEQ ID NO: 897132 - RNA, 23 nt, Human
uuaaaaauguaagcacacuuuug

SEQ ID NO: 897133 - RNA, 20 nt, Human
uuacaaguuaaaaagucacu

SEQ ID NO: 897134 - RNA, 22 nt, Human
guagagaaugcccuuuauauau

SEQ ID NO: 897135 - RNA, 20 nt, Human
ucccggagcuggucgggucu

SEQ ID NO: 897136 - RNA, 20 nt, Human
ucuaaagaaaaguguacaaa

SEQ ID NO: 897137 - RNA, 18 nt, Human
ugacccaccccaucccgg

SEQ ID NO: 897138 - RNA, 18 nt, Human
uggaugugcugcccagug

SEQ ID NO: 897139 - RNA, 21 nt, Human
aaacacagaugacagcgaccc

SEQ ID NO: 897140 - RNA, 18 nt, Human
aaccgagcccaggccucu

SEQ ID NO: 897141 - RNA, 22 nt, Human
aagcucucccgcugacgcugcc

SEQ ID NO: 897142 - RNA, 18 nt, Human
accaggcagagcugcugg

SEQ ID NO: 897143 - RNA, 24 nt, Human
acgcagaccacggcacugcaggcc

SEQ ID NO: 897144 - RNA, 19 nt, Human
agcugcagagcacgcagac

SEQ ID NO: 897145 - RNA, 21 nt, Human
caaccaggcagagcugcuggu

SEQ ID NO: 897146 - RNA, 24 nt, Human
cagagcacgcagaccacggcacug

SEQ ID NO: 897147 - RNA, 21 nt, Human
ccugcagggcccgggaaccga

SEQ ID NO: 897148 - RNA, 22 nt, Human
ccugccccugcagggcccggga

SEQ ID NO: 897149 - RNA, 23 nt, Human
ccugccccugcagggcccgggaa

SEQ ID NO: 897150 - RNA, 19 nt, Human
cgcuaacuguguggacacg

SEQ ID NO: 897151 - RNA, 19 nt, Human
cggcugccaggggcacagg

SEQ ID NO: 897152 - RNA, 22 nt, Human
cggcugccaggggcacagguag

SEQ ID NO: 897153 - RNA, 21 nt, Human
cuaaacacagaugacagcgac

SEQ ID NO: 897154 - RNA, 20 nt, Human
cucacagcugcagagcacgc

SEQ ID NO: 897155 - RNA, 24 nt, Human
gaagcucucccgcugacgcugccu

SEQ ID NO: 897156 - RNA, 22 nt, Human
gccccugcagggcccgggaacu

SEQ ID NO: 897157 - RNA, 19 nt, Human
gcccgggaaccgagcccag

SEQ ID NO: 897158 - RNA, 19 nt, Human
gccugaggucaguucgccc

SEQ ID NO: 897159 - RNA, 21 nt, Human
ggaagagagcccaggccgccc

SEQ ID NO: 897160 - RNA, 18 nt, Human
ggcccuggaaagcggcug

SEQ ID NO: 897161 - RNA, 24 nt, Human
gggcugggcuggucggggagaagc

SEQ ID NO: 897162 - RNA, 21 nt, Human
ggggcugggcuggucggggag

SEQ ID NO: 897163 - RNA, 18 nt, Human
ggugcuggaggcccgggg

SEQ ID NO: 897164 - RNA, 18 nt, Human
gucucacagcugcagagc

SEQ ID NO: 897165 - RNA, 18 nt, Human
ucucccgcugacgcugcc

SEQ ID NO: 897166 - RNA, 23 nt, Human
ucucccgcugacgcugccugggc

SEQ ID NO: 897167 - RNA, 19 nt, Human
ucucugagaggcuggagca

SEQ ID NO: 897168 - RNA, 21 nt, Human
ucucugagaggcuggagcaga

SEQ ID NO: 897169 - RNA, 19 nt, Human
ugacgcugccugggccugc

SEQ ID NO: 897170 - RNA, 21 nt, Human
ugaggacugcagaaguccugc

SEQ ID NO: 897171 - RNA, 18 nt, Human
ugaggucaguucgccccc

SEQ ID NO: 897172 - RNA, 21 nt, Human
ugcaggccaaccaggcagagc

SEQ ID NO: 897173 - RNA, 21 nt, Human
ugccugggccugccccugcag

SEQ ID NO: 897174 - RNA, 20 nt, Human
uggggcugggcuggucgggg

SEQ ID NO: 897175 - RNA, 23 nt, Human
uuacaagacaugccugaggucag

SEQ ID NO: 897176 - RNA, 22 nt, Human
augagacaacugagauccagag

SEQ ID NO: 897177 - RNA, 24 nt, Human
auugagcagagaaaagggaaggga

SEQ ID NO: 897178 - RNA, 18 nt, Human
cagcgcacaaaccugucc

SEQ ID NO: 897179 - RNA, 21 nt, Human
gcagagaaaagggaagggagc

SEQ ID NO: 897180 - RNA, 25 nt, Human
uauugagcagagaaaagggaaggga

SEQ ID NO: 897181 - RNA, 23 nt, Human
ucuuccaaguucugguggacuuc

SEQ ID NO: 897182 - RNA, 19 nt, Human
ugaagagaugggucuuggc

SEQ ID NO: 897183 - RNA, 27 nt, Human
ugaagagaugggucuuggcuccuaauu

SEQ ID NO: 897184 - RNA, 22 nt, Human
ugacucguaacacguucuggcc

SEQ ID NO: 897185 - RNA, 19 nt, Human
ugagacaacugagauccag

SEQ ID NO: 897186 - RNA, 20 nt, Human
ugagcagagaaaagggaagg

SEQ ID NO: 897187 - RNA, 19 nt, Human
uuuaaaauauuuauugagc

SEQ ID NO: 897188 - RNA, 24 nt, Human
uuuaaaauauuuauugagcagaga

SEQ ID NO: 897189 - RNA, 23 nt, Human
aaaaaaaaaaaaaaaaaaaagag

SEQ ID NO: 897190 - RNA, 24 nt, Human
aaagaccaggaccccccccacccc

SEQ ID NO: 897191 - RNA, 20 nt, Human
aaagagagagagagagaaau

SEQ ID NO: 897192 - RNA, 22 nt, Human
aaaggggagggcuggcaaagag

SEQ ID NO: 897193 - RNA, 25 nt, Human
aagagaccaauagacaaaaagguaa

SEQ ID NO: 897194 - RNA, 24 nt, Human
aagcacugaaagcccaugagucaa

SEQ ID NO: 897195 - RNA, 21 nt, Human
aaggaucacuggcuccgaguc

SEQ ID NO: 897196 - RNA, 22 nt, Human
accaggaccccccccaccccgc

SEQ ID NO: 897197 - RNA, 22 nt, Human
agaaggagucuuuuccuuugau

SEQ ID NO: 897198 - RNA, 19 nt, Human
agacccuucauccccagau

SEQ ID NO: 897199 - RNA, 22 nt, Human
agaguuuuggcagccccugcuu

SEQ ID NO: 897200 - RNA, 20 nt, Human
agccaaagaccaggaccccc

SEQ ID NO: 897201 - RNA, 23 nt, Human
agcccaugagucaagccauagcc

SEQ ID NO: 897202 - RNA, 21 nt, Human
aguagguucuuuuuuuuuccu

SEQ ID NO: 897203 - RNA, 20 nt, Human
auaaaaucucuccccagacc

SEQ ID NO: 897204 - RNA, 21 nt, Human
auaaaaucucuccccagacca

SEQ ID NO: 897205 - RNA, 24 nt, Human
aucaucacuuuuaauccuccccag

SEQ ID NO: 897206 - RNA, 23 nt, Human
caaaaagcgaaguuucaauagug

SEQ ID NO: 897207 - RNA, 27 nt, Human
caagugaugaaauaaaaaagaaagccc

SEQ ID NO: 897208 - RNA, 23 nt, Human
cagaaggggcuucaucuucagac

SEQ ID NO: 897209 - RNA, 21 nt, Human
caggaccgagucgagaagcca

SEQ ID NO: 897210 - RNA, 21 nt, Human
caggaccgagucgagaagcca

SEQ ID NO: 897211 - RNA, 23 nt, Human
caggaccgagucgagaagccaaa

SEQ ID NO: 897212 - RNA, 22 nt, Human
cauugggaaaggggagggcugg

SEQ ID NO: 897213 - RNA, 21 nt, Human
ccagugauuaauuugacaugg

SEQ ID NO: 897214 - RNA, 20 nt, Human
cccacccucccuacaaggua

SEQ ID NO: 897215 - RNA, 18 nt, Human
cccacuuucccuuugccu

SEQ ID NO: 897216 - RNA, 23 nt, Human
cccauugcccacccucccuacaa

SEQ ID NO: 897217 - RNA, 22 nt, Human
ccccagaaggggcuucaucuuc

SEQ ID NO: 897218 - RNA, 18 nt, Human
ccccauugcccacccucc

SEQ ID NO: 897219 - RNA, 21 nt, Human
ccccauugcccacccucccua

SEQ ID NO: 897220 - RNA, 18 nt, Human
cccucuuuuuucuuuuuu

SEQ ID NO: 897221 - RNA, 19 nt, Human
ccgguuccucaucuucuuc

SEQ ID NO: 897222 - RNA, 19 nt, Human
cgagaagccaaagaccagg

SEQ ID NO: 897223 - RNA, 19 nt, Human
cuccccagaccaucaucac

SEQ ID NO: 897224 - RNA, 24 nt, Human
cuggcaggcuuuccgguuccucau

SEQ ID NO: 897225 - RNA, 22 nt, Human
cuucagacccuucauccccaga

SEQ ID NO: 897226 - RNA, 21 nt, Human
cuugguaaaauuuuauccaaa

SEQ ID NO: 897227 - RNA, 21 nt, Human
gaaacaggaccgagucgagaa

SEQ ID NO: 897228 - RNA, 23 nt, Human
gaaaggggagggcuggcaaagag

SEQ ID NO: 897229 - RNA, 18 nt, Human
gaagcuguggggcgaccc

SEQ ID NO: 897230 - RNA, 22 nt, Human
gacaaauggaaaaaagcacuga

SEQ ID NO: 897231 - RNA, 20 nt, Human
gagagagagagaaauguuac

SEQ ID NO: 897232 - RNA, 25 nt, Human
gauaacaagugaugaaauaaaaaag

SEQ ID NO: 897233 - RNA, 26 nt, Human
gccaaagaccaggaccccccccaccc

SEQ ID NO: 897234 - RNA, 18 nt, Human
ggaaaaaagcacugaaag

SEQ ID NO: 897235 - RNA, 24 nt, Human
ggaaaggggagggcuggcaaagag

SEQ ID NO: 897236 - RNA, 22 nt, Human
ggaaauaugaaaucaagaguuu

SEQ ID NO: 897237 - RNA, 19 nt, Human
ggcaaagagaccaauagac

SEQ ID NO: 897238 - RNA, 24 nt, Human
gggaaaggggagggcuggcaaaga

SEQ ID NO: 897239 - RNA, 21 nt, Human
gguucuuuuuuuuuccucccu

SEQ ID NO: 897240 - RNA, 23 nt, Human
guuccucaucuucuucuuuggga

SEQ ID NO: 897241 - RNA, 27 nt, Human
guuugcuuuaaaaaaaaaaaaaaaaaa

SEQ ID NO: 897242 - RNA, 18 nt, Human
uaacaagugaugaaauaa

SEQ ID NO: 897243 - RNA, 24 nt, Human
uaacaagugaugaaauaaaaaaga

SEQ ID NO: 897244 - RNA, 19 nt, Human
uaaggucggguaaccccau

SEQ ID NO: 897245 - RNA, 22 nt, Human
uaccugccucaucgguggaagu

SEQ ID NO: 897246 - RNA, 23 nt, Human
uagacaaaaagguaacuuaaaca

SEQ ID NO: 897247 - RNA, 23 nt, Human
uagcaaaaagcgaaguuucaaua

SEQ ID NO: 897248 - RNA, 21 nt, Human
uaggguuuuuuuuuuuuugga

SEQ ID NO: 897249 - RNA, 23 nt, Human
ucacuggacuuggcgucacugua

SEQ ID NO: 897250 - RNA, 18 nt, Human
ucacuggcuccgagucuc

SEQ ID NO: 897251 - RNA, 22 nt, Human
ucacuguagccuuuagucuggg

SEQ ID NO: 897252 - RNA, 18 nt, Human
ucauugggaaaggggagg

SEQ ID NO: 897253 - RNA, 20 nt, Human
uccagugauuaauuugacau

SEQ ID NO: 897254 - RNA, 18 nt, Human
ucccuacaagguaaaaaa

SEQ ID NO: 897255 - RNA, 23 nt, Human
ucuuauugcuuuacaaccguggu

SEQ ID NO: 897256 - RNA, 23 nt, Human
ugacaauugauuuuuuaaaaguc

SEQ ID NO: 897257 - RNA, 22 nt, Human
ugaguacuuuuaguaacaguuc

SEQ ID NO: 897258 - RNA, 20 nt, Human
ugcuuuacaaccgugguaca

SEQ ID NO: 897259 - RNA, 24 nt, Human
uggcagccccugcuuuuuuuuuuu

SEQ ID NO: 897260 - RNA, 24 nt, Human
ugguuugcuuuaaaaaaaaaaaaa

SEQ ID NO: 897261 - RNA, 20 nt, Human
uguagccuuuagucuggguu

SEQ ID NO: 897262 - RNA, 20 nt, Human
uuaaaaaaaaaaaaaaaaaa

SEQ ID NO: 897263 - RNA, 24 nt, Human
uucagacccuucauccccagauuu

SEQ ID NO: 897264 - RNA, 19 nt, Human
uucccuuugccuuucacug

SEQ ID NO: 897265 - RNA, 20 nt, Human
uuccucaucuucuucuuugg

SEQ ID NO: 897266 - RNA, 20 nt, Human
uuccucaucuucuucuuugg

SEQ ID NO: 897267 - RNA, 19 nt, Human
uucgcugucgaaacaggac

SEQ ID NO: 897268 - RNA, 23 nt, Human
uugcccacccucccuacaaggua

SEQ ID NO: 897269 - RNA, 23 nt, Human
uuuagcaaaaagcgaaguuucaa

SEQ ID NO: 897270 - RNA, 19 nt, Human
uuuccucccucuuuuuucu

SEQ ID NO: 897271 - RNA, 19 nt, Human
uuuccucccucuuuuuucu

SEQ ID NO: 897272 - RNA, 25 nt, Human
uuuccucccucuuuuuucuuuuuuu

SEQ ID NO: 897273 - RNA, 20 nt, Human
uuuucuggcaggcuuuccgg

SEQ ID NO: 897274 - RNA, 18 nt, Human
uuuuuuaaaaguccaggu

SEQ ID NO: 897275 - RNA, 22 nt, Human
uuuuuucuuuuuuuuucuuuuu

SEQ ID NO: 897276 - RNA, 21 nt, Human
uuuuuucuuuuuuuuuuuaau

SEQ ID NO: 897277 - RNA, 18 nt, Human
uuuuuuuuuuuuuuucug

SEQ ID NO: 897278 - RNA, 25 nt, Human
uuuuuuuuuuuuuuuuucugaguuu

SEQ ID NO: 897279 - RNA, 19 nt, Human
caagcccugaggcccacaa

SEQ ID NO: 897280 - RNA, 20 nt, Human
cagccuuucuccugaugccc

SEQ ID NO: 897281 - RNA, 23 nt, Human
caugccugccccaagcccugagg

SEQ ID NO: 897282 - RNA, 23 nt, Human
ccaagcccugaggcccacaaguc

SEQ ID NO: 897283 - RNA, 23 nt, Human
ccccgggaccugugugccugggc

SEQ ID NO: 897284 - RNA, 26 nt, Human
ccgauccacgucccggagcucugcac

SEQ ID NO: 897285 - RNA, 23 nt, Human
ccugugugccugggccaguccca

SEQ ID NO: 897286 - RNA, 22 nt, Human
cgcgccggcuccgauccacguc

SEQ ID NO: 897287 - RNA, 18 nt, Human
gccccaagcccugaggcc

SEQ ID NO: 897288 - RNA, 18 nt, Human
gccuuucuccugaugccc

SEQ ID NO: 897289 - RNA, 19 nt, Human
gccuuucuccugaugcccc

SEQ ID NO: 897290 - RNA, 22 nt, Human
gcucagccccaagaguucaggg

SEQ ID NO: 897291 - RNA, 21 nt, Human
ucagccccaagaguucaggga

SEQ ID NO: 897292 - RNA, 19 nt, Human
ugaggcccacaagucccag

SEQ ID NO: 897293 - RNA, 19 nt, Human
ugccccaagcccugaggcc

SEQ ID NO: 897294 - RNA, 19 nt, Human
ugccccgggaccugugugc

SEQ ID NO: 897295 - RNA, 21 nt, Human
uuaauguguaacaguaggccu

SEQ ID NO: 897296 - RNA, 21 nt, Human
uucagggaggaaaaaacaggg

SEQ ID NO: 897297 - RNA, 20 nt, Human
uuuuuuuuuuuuuuagcugg

SEQ ID NO: 897298 - RNA, 24 nt, Human
uuuuuuuuuuuuuuuuuagcuggg

SEQ ID NO: 897299 - RNA, 21 nt, Human
aagaagaaacccggcagaagc

SEQ ID NO: 897300 - RNA, 20 nt, Human
aagaagaagcugcaggacuu

SEQ ID NO: 897301 - RNA, 19 nt, Human
aagcugcaggacuuugcca

SEQ ID NO: 897302 - RNA, 21 nt, Human
aagcugcaggacuuugccagc

SEQ ID NO: 897303 - RNA, 22 nt, Human
agaaggagaucgagaaccucac

SEQ ID NO: 897304 - RNA, 21 nt, Human
agcggaacagccugcaagacc

SEQ ID NO: 897305 - RNA, 23 nt, Human
agcucuggaagaggggaagaaga

SEQ ID NO: 897306 - RNA, 24 nt, Human
agcucuggaagaggggaagaagag

SEQ ID NO: 897307 - RNA, 22 nt, Human
aggagacauggucuucgcuucu

SEQ ID NO: 897308 - RNA, 19 nt, Human
aggcagaucgcgguggagu

SEQ ID NO: 897309 - RNA, 21 nt, Human
agucuguggggccagggacag

SEQ ID NO: 897310 - RNA, 18 nt, Human
aucccccgcaggcagauc

SEQ ID NO: 897311 - RNA, 21 nt, Human
caagaagaaacccggcagaag

SEQ ID NO: 897312 - RNA, 23 nt, Human
cacccuuagaaugaaguugagag

SEQ ID NO: 897313 - RNA, 20 nt, Human
caccguggaagcucuggaag

SEQ ID NO: 897314 - RNA, 20 nt, Human
caccucaaguacuagcccau

SEQ ID NO: 897315 - RNA, 18 nt, Human
cccccucucacccuaccc

SEQ ID NO: 897316 - RNA, 20 nt, Human
cccuacccuggacgcugucc

SEQ ID NO: 897317 - RNA, 19 nt, Human
ccucucacccuacccugga

SEQ ID NO: 897318 - RNA, 21 nt, Human
ccucucacccuacccuggacg

SEQ ID NO: 897319 - RNA, 22 nt, Human
cgacucgaagaagaagcugcag

SEQ ID NO: 897320 - RNA, 20 nt, Human
cgccacaucuccacucucaa

SEQ ID NO: 897321 - RNA, 19 nt, Human
cggcgaggccaacgcggcg

SEQ ID NO: 897322 - RNA, 18 nt, Human
cuccaacgaggagacaug

SEQ ID NO: 897323 - RNA, 19 nt, Human
cucugcgcugagauccccc

SEQ ID NO: 897324 - RNA, 18 nt, Human
cuugcuuccuucaugggu

SEQ ID NO: 897325 - RNA, 20 nt, Human
gaccagcuggacgaggagau

SEQ ID NO: 897326 - RNA, 18 nt, Human
gagcgccacaucuccacu

SEQ ID NO: 897327 - RNA, 20 nt, Human
gcggcggcggcggcagaggc

SEQ ID NO: 897328 - RNA, 18 nt, Human
gcuugaccccccagcuuc

SEQ ID NO: 897329 - RNA, 20 nt, Human
ggaagagaucacucuccuug

SEQ ID NO: 897330 - RNA, 22 nt, Human
ggccaacgcggcggcggcggca

SEQ ID NO: 897331 - RNA, 20 nt, Human
ggccaagcagaaccuggagc

SEQ ID NO: 897332 - RNA, 21 nt, Human
gggaccugggggguggccuuc

SEQ ID NO: 897333 - RNA, 22 nt, Human
ggggcggcgaggccaacgcggc

SEQ ID NO: 897334 - RNA, 21 nt, Human
ggguggccuuccucggggcag

SEQ ID NO: 897335 - RNA, 23 nt, Human
uaaacuggaaaagaccaagaaca

SEQ ID NO: 897336 - RNA, 21 nt, Human
uacccuggacgcuguccuugu

SEQ ID NO: 897337 - RNA, 22 nt, Human
ucccccgcaggcagaucgcggu

SEQ ID NO: 897338 - RNA, 25 nt, Human
uccccugcuauuggguuucuccaac

SEQ ID NO: 897339 - RNA, 19 nt, Human
ucccucaguucccagcucc

SEQ ID NO: 897340 - RNA, 21 nt, Human
ucccucaguucccagcuccag

SEQ ID NO: 897341 - RNA, 24 nt, Human
ucccugggaccucuuugcaucccu

SEQ ID NO: 897342 - RNA, 21 nt, Human
uccugccacaucauccagggg

SEQ ID NO: 897343 - RNA, 20 nt, Human
uccuugcuuccuucaugggu

SEQ ID NO: 897344 - RNA, 20 nt, Human
ucucacccuacccuggacgg

SEQ ID NO: 897345 - RNA, 21 nt, Human
ucucagagucuguggggccag

SEQ ID NO: 897346 - RNA, 23 nt, Human
ugaacaccucaaguacuagccca

SEQ ID NO: 897347 - RNA, 19 nt, Human
ugaccccccagcuuccccu

SEQ ID NO: 897348 - RNA, 21 nt, Human
ugccacaucauccaggggacc

SEQ ID NO: 897349 - RNA, 19 nt, Human
ugcgcugagaucccccgca

SEQ ID NO: 897350 - RNA, 23 nt, Human
ugcuuccuucauggguccucuca

SEQ ID NO: 897351 - RNA, 22 nt, Human
uggaaaagaccaagaacaggcu

SEQ ID NO: 897352 - RNA, 21 nt, Human
uggggccagggacaggggcca

SEQ ID NO: 897353 - RNA, 22 nt, Human
uuuugaguaaaaagggcuccuu

SEQ ID NO: 897354 - RNA, 21 nt, Human
uuuuuuuucagagucccauaa

SEQ ID NO: 897355 - RNA, 19 nt, Human
aaaacacaacuaaauccua

SEQ ID NO: 897356 - RNA, 25 nt, Human
aagagaaaacaaaaacacuccaaag

SEQ ID NO: 897357 - RNA, 18 nt, Human
acaguaaaugcagcauga

SEQ ID NO: 897358 - RNA, 21 nt, Human
accacaugaugauccuauaca

SEQ ID NO: 897359 - RNA, 20 nt, Human
accccgagucugaggcgcac

SEQ ID NO: 897360 - RNA, 21 nt, Human
accccggagcuggcaccggcc

SEQ ID NO: 897361 - RNA, 22 nt, Human
accgaggggugaggcgugggug

SEQ ID NO: 897362 - RNA, 23 nt, Human
agaaaacaaaaacacuccaaaga

SEQ ID NO: 897363 - RNA, 21 nt, Human
agccaguauugauaucgcgca

SEQ ID NO: 897364 - RNA, 23 nt, Human
agcugcuuaaguaaaaucagaag

SEQ ID NO: 897365 - RNA, 19 nt, Human
aggcaccgaggggugaggc

SEQ ID NO: 897366 - RNA, 23 nt, Human
aggcagacggaggggcacggggc

SEQ ID NO: 897367 - RNA, 18 nt, Human
agggguggaguuggggga

SEQ ID NO: 897368 - RNA, 21 nt, Human
augccugggugggagcucagg

SEQ ID NO: 897369 - RNA, 23 nt, Human
caacuaaauccuaucaguacagc

SEQ ID NO: 897370 - RNA, 21 nt, Human
caauguccuaaaacacaacua

SEQ ID NO: 897371 - RNA, 22 nt, Human
caauguccuaaaacacaacuaa

SEQ ID NO: 897372 - RNA, 25 nt, Human
cacccuggaaccagccacucacccu

SEQ ID NO: 897373 - RNA, 22 nt, Human
cagacggaggggcacggggcug

SEQ ID NO: 897374 - RNA, 20 nt, Human
cagcacagaggcugggccug

SEQ ID NO: 897375 - RNA, 24 nt, Human
cagcacagaggcugggccugugug

SEQ ID NO: 897376 - RNA, 20 nt, Human
cagccccgagcuccacucag

SEQ ID NO: 897377 - RNA, 19 nt, Human
cagcuccccuacgcagccc

SEQ ID NO: 897378 - RNA, 21 nt, Human
cauggaaugguagcugcuuaa

SEQ ID NO: 897379 - RNA, 21 nt, Human
ccagaggcuccugccacgugg

SEQ ID NO: 897380 - RNA, 19 nt, Human
cccaggcaccgagggguga

SEQ ID NO: 897381 - RNA, 21 nt, Human
ccgugcggaggcagacggagg

SEQ ID NO: 897382 - RNA, 19 nt, Human
ccuauacagcugcccagag

SEQ ID NO: 897383 - RNA, 20 nt, Human
ccugacucuuugccagaaac

SEQ ID NO: 897384 - RNA, 24 nt, Human
ccuuggaagagaaaacaaaaacac

SEQ ID NO: 897385 - RNA, 20 nt, Human
cggggcugggcccaggcacc

SEQ ID NO: 897386 - RNA, 19 nt, Human
cuaaaacacaacuaaaucc

SEQ ID NO: 897387 - RNA, 18 nt, Human
cuaucaguacagcagagu

SEQ ID NO: 897388 - RNA, 19 nt, Human
cucaccccgagucugaggc

SEQ ID NO: 897389 - RNA, 19 nt, Human
cucacccuuccuaacacaa

SEQ ID NO: 897390 - RNA, 23 nt, Human
cugggcagggcccaguagccgcc

SEQ ID NO: 897391 - RNA, 22 nt, Human
cugugagggguggaguuggggg

SEQ ID NO: 897392 - RNA, 20 nt, Human
gaaacaggcccaaacuguga

SEQ ID NO: 897393 - RNA, 23 nt, Human
gagaaaacaaaaacacuccaaag

SEQ ID NO: 897394 - RNA, 18 nt, Human
gagcacuggagaugccug

SEQ ID NO: 897395 - RNA, 18 nt, Human
gagggguggaguuggggg

SEQ ID NO: 897396 - RNA, 18 nt, Human
gccccgagcuccacucag

SEQ ID NO: 897397 - RNA, 18 nt, Human
gcucugggaggcaagucc

SEQ ID NO: 897398 - RNA, 20 nt, Human
gcugggcccaggcaccgagg

SEQ ID NO: 897399 - RNA, 18 nt, Human
ggaggagggcaggagccc

SEQ ID NO: 897400 - RNA, 20 nt, Human
gggaaggcuggcgagaggcu

SEQ ID NO: 897401 - RNA, 24 nt, Human
gguuguuggaggagggcaggagcc

SEQ ID NO: 897402 - RNA, 22 nt, Human
gugaggcguggguguccugggu

SEQ ID NO: 897403 - RNA, 20 nt, Human
uaaaacacaacuaaauccua

SEQ ID NO: 897404 - RNA, 24 nt, Human
uaaaacacaacuaaauccuaucag

SEQ ID NO: 897405 - RNA, 20 nt, Human
uaaauaaaagcuacaaagcc

SEQ ID NO: 897406 - RNA, 20 nt, Human
uaacacaacgggacggcccu

SEQ ID NO: 897407 - RNA, 23 nt, Human
uaaguaaaaucagaaggugcaga

SEQ ID NO: 897408 - RNA, 27 nt, Human
uauggggcaggugugaugaauggguac

SEQ ID NO: 897409 - RNA, 26 nt, Human
ucaccuugcgacccacaaaagugcaa

SEQ ID NO: 897410 - RNA, 24 nt, Human
ucaccuugcgacccacaaaaguug

SEQ ID NO: 897411 - RNA, 20 nt, Human
ucagaaggugcagaaaaugu

SEQ ID NO: 897412 - RNA, 22 nt, Human
ucaggcaauaauguuuacaaac

SEQ ID NO: 897413 - RNA, 21 nt, Human
uccgcuggcccggccaggccc

SEQ ID NO: 897414 - RNA, 19 nt, Human
uccuauacagcugcccaga

SEQ ID NO: 897415 - RNA, 22 nt, Human
ugaauggguacuucugcaucca

SEQ ID NO: 897416 - RNA, 24 nt, Human
ugagaguaaucaaaggaugcacag

SEQ ID NO: 897417 - RNA, 19 nt, Human
ugagggguggaguuggggg

SEQ ID NO: 897418 - RNA, 19 nt, Human
ugaugaauggguacuucug

SEQ ID NO: 897419 - RNA, 21 nt, Human
ugcaaucaugugaaaccaacg

SEQ ID NO: 897420 - RNA, 22 nt, Human
ugccagccgugcggaggcagac

SEQ ID NO: 897421 - RNA, 20 nt, Human
ugcccagaggaggacaccau

SEQ ID NO: 897422 - RNA, 19 nt, Human
ugcccgccucccucacccc

SEQ ID NO: 897423 - RNA, 24 nt, Human
ugccugggugggagcucaggaggg

SEQ ID NO: 897424 - RNA, 19 nt, Human
uggaaccagccacucaccc

SEQ ID NO: 897425 - RNA, 22 nt, Human
uggaaugguagcugcuuaagua

SEQ ID NO: 897426 - RNA, 21 nt, Human
uggagaugccugggugggagc

SEQ ID NO: 897427 - RNA, 20 nt, Human
uguaaacaguaaaugcagca

SEQ ID NO: 897428 - RNA, 18 nt, Human
ugugagggguggaguugg

SEQ ID NO: 897429 - RNA, 18 nt, Human
uucaguaaccuuccugac

SEQ ID NO: 897430 - RNA, 20 nt, Human
uucugcauccagugaccaag

SEQ ID NO: 897431 - RNA, 19 nt, Human
uuuuuuguaaccacaugau

SEQ ID NO: 897432 - RNA, 18 nt, Human
uuuuuuuuuuuuuuucug

SEQ ID NO: 897433 - RNA, 24 nt, Human
uuuuuuuuuuuuuuucugugaaau

SEQ ID NO: 897434 - RNA, 19 nt, Human
aaaaaagcacaacaaaagg

SEQ ID NO: 897435 - RNA, 20 nt, Human
aaauggaucagugagagagg

SEQ ID NO: 897436 - RNA, 18 nt, Human
aaccagagcaagagucag

SEQ ID NO: 897437 - RNA, 19 nt, Human
aagagucagugguauagac

SEQ ID NO: 897438 - RNA, 24 nt, Human
aaggagugucccaagaugcaggaa

SEQ ID NO: 897439 - RNA, 20 nt, Human
acaaaagccacacacauggu

SEQ ID NO: 897440 - RNA, 20 nt, Human
acacagcuucagcaauuacc

SEQ ID NO: 897441 - RNA, 21 nt, Human
acaucaaaaaagcacaacaaa

SEQ ID NO: 897442 - RNA, 20 nt, Human
acucaauuaccccacacucg

SEQ ID NO: 897443 - RNA, 19 nt, Human
agaaaccagaugagcuguc

SEQ ID NO: 897444 - RNA, 19 nt, Human
agccaaauggaucagugag

SEQ ID NO: 897445 - RNA, 22 nt, Human
agccuccucucgccucucgcug

SEQ ID NO: 897446 - RNA, 20 nt, Human
agcuguguguacuggaaaag

SEQ ID NO: 897447 - RNA, 23 nt, Human
aggaaacaguguuuccucaaaga

SEQ ID NO: 897448 - RNA, 22 nt, Human
aggcagacacaucaaaaaagca

SEQ ID NO: 897449 - RNA, 18 nt, Human
aggcagccuccucgaggc

SEQ ID NO: 897450 - RNA, 20 nt, Human
aggcagccuccucucgccuc

SEQ ID NO: 897451 - RNA, 21 nt, Human
aguuguuacacgaaggacuga

SEQ ID NO: 897452 - RNA, 25 nt, Human
auagcauauacucuacuagcaccag

SEQ ID NO: 897453 - RNA, 23 nt, Human
auaucacacaucccauggcaaac

SEQ ID NO: 897454 - RNA, 18 nt, Human
augagcugucuucuuggg

SEQ ID NO: 897455 - RNA, 22 nt, Human
caaacauccaucacacagcuuc

SEQ ID NO: 897456 - RNA, 22 nt, Human
caacaauuuugcccucucucag

SEQ ID NO: 897457 - RNA, 28 nt, Human
caacauaaccacaguaccauaucacauc

SEQ ID NO: 897458 - RNA, 19 nt, Human
caaccagagcaagagucag

SEQ ID NO: 897459 - RNA, 21 nt, Human
caagaugcaggaagaaaccag

SEQ ID NO: 897460 - RNA, 20 nt, Human
cacaacauuauuuugcgucc

SEQ ID NO: 897461 - RNA, 21 nt, Human
cacacagcuucagcaauuacc

SEQ ID NO: 897462 - RNA, 22 nt, Human
cacaucaaaaaagcacaacaaa

SEQ ID NO: 897463 - RNA, 19 nt, Human
cagagcaagagucaguggu

SEQ ID NO: 897464 - RNA, 24 nt, Human
caucaaaaaagcacaacaaaaggc

SEQ ID NO: 897465 - RNA, 18 nt, Human
caucaaaaaagcacaacu

SEQ ID NO: 897466 - RNA, 21 nt, Human
caucuuaaaaaacaauaaauc

SEQ ID NO: 897467 - RNA, 21 nt, Human
ccacacacauggugccuagau

SEQ ID NO: 897468 - RNA, 21 nt, Human
cccaagaugcaggaagaaacc

SEQ ID NO: 897469 - RNA, 21 nt, Human
cccauggcaaacuccguaaga

SEQ ID NO: 897470 - RNA, 21 nt, Human
ccucgaggcagccuccucgag

SEQ ID NO: 897471 - RNA, 20 nt, Human
ccucucgcugcugugugggc

SEQ ID NO: 897472 - RNA, 22 nt, Human
cuagcaccagauuggaagggga

SEQ ID NO: 897473 - RNA, 24 nt, Human
cugguaucaugaggaagaguguca

SEQ ID NO: 897474 - RNA, 24 nt, Human
cuuguccucaaacaucuuacaacu

SEQ ID NO: 897475 - RNA, 25 nt, Human
cuuuugguaauuuguaaggagcuga

SEQ ID NO: 897476 - RNA, 18 nt, Human
gaacucucaaacauccau

SEQ ID NO: 897477 - RNA, 20 nt, Human
gaggcagcugaugcaagucc

SEQ ID NO: 897478 - RNA, 23 nt, Human
gauauagccuguuggcucuggca

SEQ ID NO: 897479 - RNA, 22 nt, Human
gcugaauuaagagucuauucac

SEQ ID NO: 897480 - RNA, 19 nt, Human
guguguacuggaaaaggga

SEQ ID NO: 897481 - RNA, 19 nt, Human
guucacaucaauguuucuu

SEQ ID NO: 897482 - RNA, 27 nt, Human
uaaaacaacauaaccacaguaccauaa

SEQ ID NO: 897483 - RNA, 22 nt, Human
uaaaagaaaaaaucaaacaaac

SEQ ID NO: 897484 - RNA, 24 nt, Human
uaaaauggaguccaagcuuuuauc

SEQ ID NO: 897485 - RNA, 21 nt, Human
uaaaucaagaaguuauauuuu

SEQ ID NO: 897486 - RNA, 25 nt, Human
uaagcaaaucaucaacaguacaaaa

SEQ ID NO: 897487 - RNA, 24 nt, Human
uagcagccucuuuccuaaaugccu

SEQ ID NO: 897488 - RNA, 20 nt, Human
ucacacagcuucagcaauua

SEQ ID NO: 897489 - RNA, 20 nt, Human
ucagcacaauacugaacauc

SEQ ID NO: 897490 - RNA, 22 nt, Human
ucagugagagaggcaaaagaaa

SEQ ID NO: 897491 - RNA, 18 nt, Human
ucgccucucgcugcugug

SEQ ID NO: 897492 - RNA, 20 nt, Human
ucucaaacauccaucacaca

SEQ ID NO: 897493 - RNA, 20 nt, Human
ugaaaacuacagccaaaugg

SEQ ID NO: 897494 - RNA, 18 nt, Human
ugaggaaacaguguuucc

SEQ ID NO: 897495 - RNA, 18 nt, Human
ugaggagcuagcugugug

SEQ ID NO: 897496 - RNA, 22 nt, Human
ugguauagacagggaaggagug

SEQ ID NO: 897497 - RNA, 25 nt, Human
uguaaggagcugaagacugcugaua

SEQ ID NO: 897498 - RNA, 21 nt, Human
uguacucaauuaccccacacu

SEQ ID NO: 897499 - RNA, 24 nt, Human
uucaucuauguacucaauuacccc

SEQ ID NO: 897500 - RNA, 19 nt, Human
uuuaaaaaaaccuucacuu

SEQ ID NO: 897501 - RNA, 22 nt, Human
uuuguaaggagcugaagacugc

SEQ ID NO: 897502 - RNA, 24 nt, Human
aaaacaaaauguauaacuacacuu

SEQ ID NO: 897503 - RNA, 18 nt, Human
aaaccuggaauuucacaa

SEQ ID NO: 897504 - RNA, 22 nt, Human
aaaucaauuucaaaauagccuu

SEQ ID NO: 897505 - RNA, 23 nt, Human
aacaauggaacccccaggaaaga

SEQ ID NO: 897506 - RNA, 19 nt, Human
aaggugaccacaguagagg

SEQ ID NO: 897507 - RNA, 25 nt, Human
acaaaauguauaacuacacuuguug

SEQ ID NO: 897508 - RNA, 19 nt, Human
acccaaauuuaacauaauc

SEQ ID NO: 897509 - RNA, 21 nt, Human
agaaaagaaaccgagagagaa

SEQ ID NO: 897510 - RNA, 18 nt, Human
agagagaaaaaguucaga

SEQ ID NO: 897511 - RNA, 21 nt, Human
agagagaaaaaguucagagaa

SEQ ID NO: 897512 - RNA, 18 nt, Human
agcaagugggacuacaau

SEQ ID NO: 897513 - RNA, 23 nt, Human
aggaagaaaagaaaccgagagag

SEQ ID NO: 897514 - RNA, 22 nt, Human
aguaaagaugcaaauuauacaa

SEQ ID NO: 897515 - RNA, 20 nt, Human
auacaucacucaucacaaaa

SEQ ID NO: 897516 - RNA, 18 nt, Human
auagcuuuucaccucuca

SEQ ID NO: 897517 - RNA, 23 nt, Human
augaaauaaagccaauguuuuaa

SEQ ID NO: 897518 - RNA, 23 nt, Human
augaauuugugauuaagacagaa

SEQ ID NO: 897519 - RNA, 18 nt, Human
auuaacaauauuugguaa

SEQ ID NO: 897520 - RNA, 19 nt, Human
cacaauguaaucuuagaau

SEQ ID NO: 897521 - RNA, 28 nt, Human
cacugcuagaacaauggaacccccagga

SEQ ID NO: 897522 - RNA, 20 nt, Human
cagcuaacucaagcuaauac

SEQ ID NO: 897523 - RNA, 18 nt, Human
gaaaaccuggaauuucac

SEQ ID NO: 897524 - RNA, 21 nt, Human
gaagaaaagaaaccgagagag

SEQ ID NO: 897525 - RNA, 30 nt, Human
gacuaaaaaaucaaugccagcuaacucaag

SEQ ID NO: 897526 - RNA, 18 nt, Human
gauauucauaaacuauaa

SEQ ID NO: 897527 - RNA, 22 nt, Human
ggaagaaaagaaaccgagagag

SEQ ID NO: 897528 - RNA, 22 nt, Human
ggggagaugaacaaaaaccaua

SEQ ID NO: 897529 - RNA, 25 nt, Human
uaaaaaaucaaugccagcuaacuca

SEQ ID NO: 897530 - RNA, 21 nt, Human
uaacaaaaggacuaaaaaauc

SEQ ID NO: 897531 - RNA, 24 nt, Human
uaacacagauacaucacucaucac

SEQ ID NO: 897532 - RNA, 24 nt, Human
uaacucaagcuaauacaagcuaaa

SEQ ID NO: 897533 - RNA, 20 nt, Human
uaagacagaacacuuugaaa

SEQ ID NO: 897534 - RNA, 22 nt, Human
uaauuuuaggucuaaaagagag

SEQ ID NO: 897535 - RNA, 20 nt, Human
uaccaauaagccuucaucaa

SEQ ID NO: 897536 - RNA, 21 nt, Human
uaguuccuuuuacagggagaa

SEQ ID NO: 897537 - RNA, 22 nt, Human
ucacaaaaugaaauaaagccaa

SEQ ID NO: 897538 - RNA, 22 nt, Human
uccuaagaaaaucacugcucau

SEQ ID NO: 897539 - RNA, 24 nt, Human
ugaaauaaagccaauguuuuaaau

SEQ ID NO: 897540 - RNA, 20 nt, Human
uggaauuucacaauguaauc

SEQ ID NO: 897541 - RNA, 19 nt, Human
ugguuugucuuaauaacag

SEQ ID NO: 897542 - RNA, 22 nt, Human
ugucaaggcuucuuagaaugug

SEQ ID NO: 897543 - RNA, 24 nt, Human
ugucuuaauaacagcuuuagguau

SEQ ID NO: 897544 - RNA, 22 nt, Human
ugugaaggaagaaaagaaaccg

SEQ ID NO: 897545 - RNA, 25 nt, Human
ugugauuaagacagaaccggggucc

SEQ ID NO: 897546 - RNA, 21 nt, Human
uuaauuaacaauauuugguaa

SEQ ID NO: 897547 - RNA, 24 nt, Human
uucagagaagacugacccaaauuu

SEQ ID NO: 897548 - RNA, 23 nt, Human
uucuacuauucuuuugaacuggc

SEQ ID NO: 897549 - RNA, 21 nt, Human
uuuacauagcuuuucaccucu

SEQ ID NO: 897550 - RNA, 18 nt, Human
uuuuuuuuuuuuuuuucg

SEQ ID NO: 897551 - RNA, 28 nt, Human
uuuuuuuuuuuuuuuuuuucgauuuuaa

SEQ ID NO: 897552 - RNA, 21 nt, Human
aaaugacugaacaagggccua

SEQ ID NO: 897553 - RNA, 18 nt, Human
aacuaaugcuucccccuu

SEQ ID NO: 897554 - RNA, 23 nt, Human
aauuucuuuuauuuuccccaaau

SEQ ID NO: 897555 - RNA, 21 nt, Human
agagcugaaaacagcgaaaaa

SEQ ID NO: 897556 - RNA, 21 nt, Human
agcaauagucuuuucccuggg

SEQ ID NO: 897557 - RNA, 20 nt, Human
aggaaaacaggcauggcaaa

SEQ ID NO: 897558 - RNA, 23 nt, Human
aggaauuucuuccauuaacacug

SEQ ID NO: 897559 - RNA, 22 nt, Human
aucuccaccaaucccuuuguua

SEQ ID NO: 897560 - RNA, 23 nt, Human
caacagagccucagggcaucuga

SEQ ID NO: 897561 - RNA, 19 nt, Human
caaguaacucaguaaugac

SEQ ID NO: 897562 - RNA, 19 nt, Human
cacuggcuuuuuugauugc

SEQ ID NO: 897563 - RNA, 18 nt, Human
cccccuucccccugauuu

SEQ ID NO: 897564 - RNA, 24 nt, Human
ccuacauccaaacuaaugcuuccc

SEQ ID NO: 897565 - RNA, 21 nt, Human
cuguaggcucacccuuugcuc

SEQ ID NO: 897566 - RNA, 18 nt, Human
gaaaacaggcauggcaaa

SEQ ID NO: 897567 - RNA, 18 nt, Human
gacagagcugaaaacagc

SEQ ID NO: 897568 - RNA, 24 nt, Human
gagcaugugacagagcugaaaaca

SEQ ID NO: 897569 - RNA, 22 nt, Human
gauuuuugacaguugacagcuc

SEQ ID NO: 897570 - RNA, 18 nt, Human
ggucucugaauucuuuuc

SEQ ID NO: 897571 - RNA, 22 nt, Human
gucuggagucccauugggauuc

SEQ ID NO: 897572 - RNA, 22 nt, Human
uaaacacaacauuaacaagcca

SEQ ID NO: 897573 - RNA, 20 nt, Human
uaacaagccauaugccagaa

SEQ ID NO: 897574 - RNA, 18 nt, Human
uaggaaaacaggcauggc

SEQ ID NO: 897575 - RNA, 26 nt, Human
ucccucaggaauaccaaggagcgauc

SEQ ID NO: 897576 - RNA, 22 nt, Human
ugaacaagggccuacauccaaa

SEQ ID NO: 897577 - RNA, 23 nt, Human
ugacagagcugaaaacagcgaaa

SEQ ID NO: 897578 - RNA, 24 nt, Human
ugacugaacaagggccuacaucca

SEQ ID NO: 897579 - RNA, 19 nt, Human
ugucuggagucccauuggg

SEQ ID NO: 897580 - RNA, 18 nt, Human
uuccucaacagagccuca

SEQ ID NO: 897581 - RNA, 20 nt, Human
uucucccuuauggcaucaua

SEQ ID NO: 897582 - RNA, 22 nt, Human
uugcucugcccuucugaggucc

SEQ ID NO: 897583 - RNA, 22 nt, Human
uuuacugucuggagucccauug

SEQ ID NO: 897584 - RNA, 18 nt, Human
uuucggggcaccuuccua

SEQ ID NO: 897585 - RNA, 21 nt, Human
uuuuucuuaauucuguaaggg

SEQ ID NO: 897586 - RNA, 20 nt, Human
aaaaacagaagaaaaagccc

SEQ ID NO: 897587 - RNA, 26 nt, Human
aaaaagccccaucacuuaacaccaaa

SEQ ID NO: 897588 - RNA, 19 nt, Human
aaacagaagaaaaagcccc

SEQ ID NO: 897589 - RNA, 20 nt, Human
aaacagaagaaaaagcccca

SEQ ID NO: 897590 - RNA, 23 nt, Human
aaacaggaacacuucagaaucca

SEQ ID NO: 897591 - RNA, 21 nt, Human
aacagaagaaaaagccccauc

SEQ ID NO: 897592 - RNA, 21 nt, Human
aagacaaacaggaacacuuca

SEQ ID NO: 897593 - RNA, 31 nt, Human
auaaaaaaaaaaaauuaaaaaucaaagaaag

SEQ ID NO: 897594 - RNA, 26 nt, Human
auaagacaaacaggaacacuucagaa

SEQ ID NO: 897595 - RNA, 19 nt, Human
auacugguaucuuuuaaua

SEQ ID NO: 897596 - RNA, 22 nt, Human
cacacccaacccccacccucaa

SEQ ID NO: 897597 - RNA, 18 nt, Human
cacccaacccccacccuc

SEQ ID NO: 897598 - RNA, 20 nt, Human
cacccaacccccacccucaa

SEQ ID NO: 897599 - RNA, 23 nt, Human
cagcaacauuaucaauacacccu

SEQ ID NO: 897600 - RNA, 23 nt, Human
cauuucucuuacaggaagucuuc

SEQ ID NO: 897601 - RNA, 22 nt, Human
cccaccaugccuuauuugaaag

SEQ ID NO: 897602 - RNA, 18 nt, Human
ccccaucacuuaacacca

SEQ ID NO: 897603 - RNA, 20 nt, Human
ccgcgugcgcgcgcgccccu

SEQ ID NO: 897604 - RNA, 19 nt, Human
ccucaauaaaaacagaaga

SEQ ID NO: 897605 - RNA, 24 nt, Human
ccuccgggcccgggugggggugcg

SEQ ID NO: 897606 - RNA, 21 nt, Human
cgugcgcgcgcgcccccggcu

SEQ ID NO: 897607 - RNA, 21 nt, Human
cucucuucagaggacugcagg

SEQ ID NO: 897608 - RNA, 25 nt, Human
gaagaaaaagccccaucacuuaaca

SEQ ID NO: 897609 - RNA, 21 nt, Human
gaaguggaaagagccagggug

SEQ ID NO: 897610 - RNA, 26 nt, Human
gcagugaaagugaccacucuacugaa

SEQ ID NO: 897611 - RNA, 20 nt, Human
gcgcccccggcucggccaag

SEQ ID NO: 897612 - RNA, 18 nt, Human
ggaagcagggagggggag

SEQ ID NO: 897613 - RNA, 18 nt, Human
gggugcggugcgggucgc

SEQ ID NO: 897614 - RNA, 19 nt, Human
gggugcggugcgggucgca

SEQ ID NO: 897615 - RNA, 23 nt, Human
uaaaaacagaagaaaaagcccca

SEQ ID NO: 897616 - RNA, 18 nt, Human
uacagcacauuauaggac

SEQ ID NO: 897617 - RNA, 19 nt, Human
ucaauaaaaacagaagaaa

SEQ ID NO: 897618 - RNA, 21 nt, Human
ucaauaaaaacagaagaaaaa

SEQ ID NO: 897619 - RNA, 23 nt, Human
ucucuucagaggacugcaggggu

SEQ ID NO: 897620 - RNA, 22 nt, Human
ugaaagaggaggccugugagaa

SEQ ID NO: 897621 - RNA, 27 nt, Human
ugaacuguacagcacauuauaggacaa

SEQ ID NO: 897622 - RNA, 23 nt, Human
uggaaguuuucaucucauacugg

SEQ ID NO: 897623 - RNA, 19 nt, Human
uggacggccgcgugcgcgc

SEQ ID NO: 897624 - RNA, 20 nt, Human
uggccagggccaggauaaga

SEQ ID NO: 897625 - RNA, 21 nt, Human
ugugagaaguggaaagagcca

SEQ ID NO: 897626 - RNA, 19 nt, Human
uuaacaccaaacagcaaca

SEQ ID NO: 897627 - RNA, 21 nt, Human
uuacacacccaacccccaccc

SEQ ID NO: 897628 - RNA, 24 nt, Human
uugcugcccaccaugccuuauuug

SEQ ID NO: 897629 - RNA, 24 nt, Human
uuggaaguuuucaucucauacugg

SEQ ID NO: 897630 - RNA, 21 nt, Human
aaaaagauuugaaagcaucug

SEQ ID NO: 897631 - RNA, 22 nt, Human
aaucugaugacaaaauaaacca

SEQ ID NO: 897632 - RNA, 22 nt, Human
acaaauccccaaaaauggcaaa

SEQ ID NO: 897633 - RNA, 20 nt, Human
acagaaauagcccaaaucug

SEQ ID NO: 897634 - RNA, 19 nt, Human
aucauacagaaauagccca

SEQ ID NO: 897635 - RNA, 21 nt, Human
caucugaaaaacaugcaaauu

SEQ ID NO: 897636 - RNA, 19 nt, Human
caugagacugcacauggug

SEQ ID NO: 897637 - RNA, 21 nt, Human
cccaaaaauggcaaauuaagc

SEQ ID NO: 897638 - RNA, 25 nt, Human
cuaaaauauucaccaacucuacaga

SEQ ID NO: 897639 - RNA, 23 nt, Human
gaaauagacaaccaaaauaauau

SEQ ID NO: 897640 - RNA, 20 nt, Human
gacgaggaaacgaaagaagc

SEQ ID NO: 897641 - RNA, 21 nt, Human
gcaucuaaacaaaaauuccac

SEQ ID NO: 897642 - RNA, 18 nt, Human
ggaaauagccguaucagg

SEQ ID NO: 897643 - RNA, 20 nt, Human
gucgacaaauccccaaaaau

SEQ ID NO: 897644 - RNA, 20 nt, Human
gugaaaauucagacaaaaug

SEQ ID NO: 897645 - RNA, 20 nt, Human
uaaaauauucaccaacucua

SEQ ID NO: 897646 - RNA, 18 nt, Human
uagcccaaaucuggaaau

SEQ ID NO: 897647 - RNA, 20 nt, Human
uaggggguuguggggugugg

SEQ ID NO: 897648 - RNA, 18 nt, Human
ugaaaaacaugcaaauug

SEQ ID NO: 897649 - RNA, 19 nt, Human
ugaaagcaucugaaaaaca

SEQ ID NO: 897650 - RNA, 24 nt, Human
ugaaagcaucugaaaaacaugcaa

SEQ ID NO: 897651 - RNA, 20 nt, Human
ugacgaggaaacgaaagaag

SEQ ID NO: 897652 - RNA, 23 nt, Human
ugacgaggaaacgaaagaagccu

SEQ ID NO: 897653 - RNA, 22 nt, Human
ugagaaaacaauuuugggguag

SEQ ID NO: 897654 - RNA, 18 nt, Human
ugagaaauagacaaccaa

SEQ ID NO: 897655 - RNA, 24 nt, Human
ugcugugagaaauagacaaccaaa

SEQ ID NO: 897656 - RNA, 24 nt, Human
uuugcaagcgucaaucagauguuu

SEQ ID NO: 897657 - RNA, 22 nt, Human
uuuuuuuuuuuuuuuuuuacag

SEQ ID NO: 897658 - RNA, 19 nt, Human
aacggaagaggacgaaaua

SEQ ID NO: 897659 - RNA, 20 nt, Human
aaguugaauacaaagucuua

SEQ ID NO: 897660 - RNA, 19 nt, Human
acagcccucaggugagaag

SEQ ID NO: 897661 - RNA, 20 nt, Human
acagcccucaggugagaagu

SEQ ID NO: 897662 - RNA, 22 nt, Human
accuccaagguguaggggugaa

SEQ ID NO: 897663 - RNA, 19 nt, Human
agacuggacuagaaaagua

SEQ ID NO: 897664 - RNA, 21 nt, Human
aggggugaagaacggaagagg

SEQ ID NO: 897665 - RNA, 31 nt, Human
caaccuaccuguaauuacaauuccauaccag

SEQ ID NO: 897666 - RNA, 20 nt, Human
cgaaauaacuagcuggaggc

SEQ ID NO: 897667 - RNA, 18 nt, Human
cugagcuguaguuaacuc

SEQ ID NO: 897668 - RNA, 18 nt, Human
cuugcauuuauauucuuu

SEQ ID NO: 897669 - RNA, 24 nt, Human
gcccucaggugagaaguucaccuc

SEQ ID NO: 897670 - RNA, 19 nt, Human
ggacuagaaaaguaacuga

SEQ ID NO: 897671 - RNA, 18 nt, Human
uaaguugaauacaaaguc

SEQ ID NO: 897672 - RNA, 19 nt, Human
uaaguugaauacaaagucu

SEQ ID NO: 897673 - RNA, 24 nt, Human
uacagcccucaggugagaaguuca

SEQ ID NO: 897674 - RNA, 21 nt, Human
uaccaaauaccccuguguucc

SEQ ID NO: 897675 - RNA, 22 nt, Human
uauauucuuuguuaauuuuagc

SEQ ID NO: 897676 - RNA, 21 nt, Human
uccagacuggacuagaaaagu

SEQ ID NO: 897677 - RNA, 24 nt, Human
uccauaccaccaccacaucuguuc

SEQ ID NO: 897678 - RNA, 30 nt, Human
ucucaauaccaaauaccccuguguuccagu

SEQ ID NO: 897679 - RNA, 23 nt, Human
ucuguugagcuuuaaaaaaauug

SEQ ID NO: 897680 - RNA, 20 nt, Human
ugagaaguucaccuccaagg

SEQ ID NO: 897681 - RNA, 19 nt, Human
uggccagugucauauuugg

SEQ ID NO: 897682 - RNA, 19 nt, Human
ugucagccgaugccggugc

SEQ ID NO: 897683 - RNA, 20 nt, Human
uuagugaagaaggccuggug

SEQ ID NO: 897684 - RNA, 27 nt, Human
aaagaggcuuuuaaaaugugcauguuu

SEQ ID NO: 897685 - RNA, 23 nt, Human
acagucagauguuuaaucaaucc

SEQ ID NO: 897686 - RNA, 22 nt, Human
auccaaaauguccacuauuucu

SEQ ID NO: 897687 - RNA, 25 nt, Human
auuagaaaaucacagucagauguuu

SEQ ID NO: 897688 - RNA, 24 nt, Human
cacagucagauguuuaaucaaucc

SEQ ID NO: 897689 - RNA, 23 nt, Human
uaugucauucguuagucuacaug

SEQ ID NO: 897690 - RNA, 19 nt, Human
uauuucuuaugucauucgu

SEQ ID NO: 897691 - RNA, 19 nt, Human
ucagauguuuaaucaaucc

SEQ ID NO: 897692 - RNA, 22 nt, Human
ucagauguuuaaucaauccaaa

SEQ ID NO: 897693 - RNA, 20 nt, Human
uuuuuuuuuuucuuuuucac

SEQ ID NO: 897694 - RNA, 20 nt, Human
uuuuuuuuuuucuuuuucac

SEQ ID NO: 897695 - RNA, 25 nt, Human
uuuuuuuuuuuuuuuuuuucuuuuu

SEQ ID NO: 897696 - RNA, 22 nt, Human
acaccccacagcuccgaguccc

SEQ ID NO: 897697 - RNA, 19 nt, Human
accucguaacuuuccccac

SEQ ID NO: 897698 - RNA, 19 nt, Human
caccccacagcuccgaguc

SEQ ID NO: 897699 - RNA, 18 nt, Human
cagcuccgagucccggcc

SEQ ID NO: 897700 - RNA, 24 nt, Human
ccacaccccacagcuccgaguccc

SEQ ID NO: 897701 - RNA, 21 nt, Human
ccagaccagcacgugacgccg

SEQ ID NO: 897702 - RNA, 24 nt, Human
ccccacaccccacagcuccgaguc

SEQ ID NO: 897703 - RNA, 25 nt, Human
ccccacgcguccgcccacgcguccg

SEQ ID NO: 897704 - RNA, 18 nt, Human
ccgaagccuccagcgcca

SEQ ID NO: 897705 - RNA, 20 nt, Human
ccuccgccuccccacacccc

SEQ ID NO: 897706 - RNA, 18 nt, Human
cgccgaagccuccagcgc

SEQ ID NO: 897707 - RNA, 25 nt, Human
cuaucuauaaaucacagaucaagag

SEQ ID NO: 897708 - RNA, 19 nt, Human
gccccgagggcggcuuugc

SEQ ID NO: 897709 - RNA, 19 nt, Human
gccuaucuauaaaucacag

SEQ ID NO: 897710 - RNA, 21 nt, Human
uaguuggugccuccgccuccc

SEQ ID NO: 897711 - RNA, 22 nt, Human
ugccuccgccuccccacacccc

SEQ ID NO: 897712 - RNA, 19 nt, Human
uucccgaacgggaguagcu

SEQ ID NO: 897713 - RNA, 23 nt, Human
aaacagaaaauuuuaauuuuuau

SEQ ID NO: 897714 - RNA, 21 nt, Human
aaacgcugauaucccuacaug

SEQ ID NO: 897715 - RNA, 19 nt, Human
aaagccuuuuccacacaca

SEQ ID NO: 897716 - RNA, 19 nt, Human
aagcagucugucccuaaaa

SEQ ID NO: 897717 - RNA, 21 nt, Human
aaugcaaaagaaaaaauuacu

SEQ ID NO: 897718 - RNA, 24 nt, Human
agcccuucgacccggaagcagucu

SEQ ID NO: 897719 - RNA, 22 nt, Human
caagcccuucgacccggaagca

SEQ ID NO: 897720 - RNA, 19 nt, Human
cacacagagaaacgcugau

SEQ ID NO: 897721 - RNA, 22 nt, Human
cacacagagaaacgcugauauc

SEQ ID NO: 897722 - RNA, 19 nt, Human
cccgcucuccggaagcaag

SEQ ID NO: 897723 - RNA, 24 nt, Human
cgacccggaagcagucugucccua

SEQ ID NO: 897724 - RNA, 25 nt, Human
gcugcaguuuagcuaccgcguuuua

SEQ ID NO: 897725 - RNA, 21 nt, Human
ggaagcaagcccuucgacccg

SEQ ID NO: 897726 - RNA, 19 nt, Human
uaacaagcacacagagaaa

SEQ ID NO: 897727 - RNA, 23 nt, Human
uaacaaguauauuuuauuaaaaa

SEQ ID NO: 897728 - RNA, 19 nt, Human
ucuccggaagcaagcccuu

SEQ ID NO: 897729 - RNA, 28 nt, Human
aaacagauaucaaacacccuagauucuc

SEQ ID NO: 897730 - RNA, 19 nt, Human
aaggagcagcgacuaggac

SEQ ID NO: 897731 - RNA, 21 nt, Human
aaucacaguuacauaacuauu

SEQ ID NO: 897732 - RNA, 23 nt, Human
acacuuauacagauuucauaaac

SEQ ID NO: 897733 - RNA, 23 nt, Human
accgaguacaggaacaacaacug

SEQ ID NO: 897734 - RNA, 23 nt, Human
acuccaaggagcagcgacuagga

SEQ ID NO: 897735 - RNA, 18 nt, Human
agaagugauuuguacaug

SEQ ID NO: 897736 - RNA, 18 nt, Human
aggacaagaacuccagaa

SEQ ID NO: 897737 - RNA, 19 nt, Human
aggacagcgagggaucugg

SEQ ID NO: 897738 - RNA, 19 nt, Human
aggcccacucuccuuuggu

SEQ ID NO: 897739 - RNA, 19 nt, Human
aucuggccgucagguugca

SEQ ID NO: 897740 - RNA, 20 nt, Human
caccgaguacaggaacaaca

SEQ ID NO: 897741 - RNA, 25 nt, Human
cagguggaaaaaacaagucacauaa

SEQ ID NO: 897742 - RNA, 20 nt, Human
caucucauaauaagucagca

SEQ ID NO: 897743 - RNA, 21 nt, Human
caugaguuaggcccacucucc

SEQ ID NO: 897744 - RNA, 22 nt, Human
cauuagcccuaacugaaacaga

SEQ ID NO: 897745 - RNA, 23 nt, Human
cgaguacaggaacaacaacugac

SEQ ID NO: 897746 - RNA, 24 nt, Human
cuagacauuucccauuagcccuaa

SEQ ID NO: 897747 - RNA, 24 nt, Human
gaaagggcaccgaguacaggaaca

SEQ ID NO: 897748 - RNA, 23 nt, Human
gaaccaggacaagaacuccagaa

SEQ ID NO: 897749 - RNA, 19 nt, Human
gccuaaaauuuguauaagg

SEQ ID NO: 897750 - RNA, 23 nt, Human
ggacaagaacuccagaaccuggg

SEQ ID NO: 897751 - RNA, 26 nt, Human
ggagcagcgacuaggacagcgaggga

SEQ ID NO: 897752 - RNA, 23 nt, Human
gugagaguaaaaagaaagggcac

SEQ ID NO: 897753 - RNA, 19 nt, Human
guggaaaaaacaagucaca

SEQ ID NO: 897754 - RNA, 23 nt, Human
uaacugaaacagauaucaaacac

SEQ ID NO: 897755 - RNA, 21 nt, Human
uagaaccaggacaagaacucc

SEQ ID NO: 897756 - RNA, 25 nt, Human
uagaaccaggacaagaacuccagaa

SEQ ID NO: 897757 - RNA, 21 nt, Human
ucaagcucacaugaguuaggc

SEQ ID NO: 897758 - RNA, 18 nt, Human
ucauuuauuauuuaugua

SEQ ID NO: 897759 - RNA, 18 nt, Human
uccagaaccugggaccac

SEQ ID NO: 897760 - RNA, 26 nt, Human
ucucauaauaagucagcaaaaguugg

SEQ ID NO: 897761 - RNA, 21 nt, Human
ugaguuaggcccacucuccuu

SEQ ID NO: 897762 - RNA, 22 nt, Human
uuaggcccacucuccuuugguu

SEQ ID NO: 897763 - RNA, 22 nt, Human
uuuauagccuaaaauuuguaua

SEQ ID NO: 897764 - RNA, 24 nt, Human
uuuauagccuaaaauuuguauaag

SEQ ID NO: 897765 - RNA, 22 nt, Human
uuucccauuagcccuaacugaa

SEQ ID NO: 897766 - RNA, 19 nt, Human
cagaaaggcggcuccggcc

SEQ ID NO: 897767 - RNA, 19 nt, Human
uccaccgggagaaugaggg

SEQ ID NO: 897768 - RNA, 20 nt, Human
aagcuaugccaucaacccug

SEQ ID NO: 897769 - RNA, 24 nt, Human
accacaugcacauaaucuucacaa

SEQ ID NO: 897770 - RNA, 19 nt, Human
acugaaugccuucaacguc

SEQ ID NO: 897771 - RNA, 18 nt, Human
aggcaaugaaucaagucu

SEQ ID NO: 897772 - RNA, 20 nt, Human
caaaauauguacuaaaaaua

SEQ ID NO: 897773 - RNA, 25 nt, Human
caaaguuugugaaucuaagguacag

SEQ ID NO: 897774 - RNA, 19 nt, Human
ccacaguguaggcagcauu

SEQ ID NO: 897775 - RNA, 24 nt, Human
uaaaagcaacugagacauuuucua

SEQ ID NO: 897776 - RNA, 23 nt, Human
uauacugaaugccuucaacgucu

SEQ ID NO: 897777 - RNA, 21 nt, Human
ucucugggcuccaagcuaugc

SEQ ID NO: 897778 - RNA, 23 nt, Human
ugaaugccuucaacgucugcuuc

SEQ ID NO: 897779 - RNA, 28 nt, Human
uuccugaauccccauucucaaagggauu

SEQ ID NO: 897780 - RNA, 23 nt, Human
aaaaaaaaaaaauugaacacagc

SEQ ID NO: 897781 - RNA, 21 nt, Human
aaaaaaaauugaacacagcua

SEQ ID NO: 897782 - RNA, 23 nt, Human
aaaaccuauucugaaaaaggaac

SEQ ID NO: 897783 - RNA, 18 nt, Human
aaaauuagcugggcgugg

SEQ ID NO: 897784 - RNA, 24 nt, Human
aaaauucuuuacucugaucauauc

SEQ ID NO: 897785 - RNA, 23 nt, Human
aaacaaaagcaaaguugggucua

SEQ ID NO: 897786 - RNA, 21 nt, Human
aacaaaagcaaaguugggucu

SEQ ID NO: 897787 - RNA, 19 nt, Human
aacacagugaaaccccauc

SEQ ID NO: 897788 - RNA, 20 nt, Human
aacacagugaaaccccaucu

SEQ ID NO: 897789 - RNA, 20 nt, Human
aacacagugaaaccccaucu

SEQ ID NO: 897790 - RNA, 21 nt, Human
aacacagugaaaccccaucuc

SEQ ID NO: 897791 - RNA, 18 nt, Human
aacauggugaaacccugu

SEQ ID NO: 897792 - RNA, 22 nt, Human
aacauggugaaacccugucguc

SEQ ID NO: 897793 - RNA, 24 nt, Human
aacauggugaaacccugucgucuc

SEQ ID NO: 897794 - RNA, 19 nt, Human
aaccuauucaucagcacca

SEQ ID NO: 897795 - RNA, 24 nt, Human
aacugcuugaacccgggaggugga

SEQ ID NO: 897796 - RNA, 20 nt, Human
aacuggugauuggcucaucu

SEQ ID NO: 897797 - RNA, 24 nt, Human
aagcagauucgaacauaacaacug

SEQ ID NO: 897798 - RNA, 25 nt, Human
aagcgucccaacacaaagcagauuc

SEQ ID NO: 897799 - RNA, 21 nt, Human
aaucccauauuuucaacuguc

SEQ ID NO: 897800 - RNA, 20 nt, Human
acaagagcaaaacuccaucu

SEQ ID NO: 897801 - RNA, 19 nt, Human
acaauaacugauggucucc

SEQ ID NO: 897802 - RNA, 21 nt, Human
acacagugaaaccccaucucc

SEQ ID NO: 897803 - RNA, 22 nt, Human
acacuauagguggcuaaaacaa

SEQ ID NO: 897804 - RNA, 23 nt, Human
acagugaaauauaauuuuccuca

SEQ ID NO: 897805 - RNA, 24 nt, Human
accccaucuccacuaaaauuacaa

SEQ ID NO: 897806 - RNA, 18 nt, Human
accuguggucaggaguuc

SEQ ID NO: 897807 - RNA, 24 nt, Human
accuguggucaggaguucgagacc

SEQ ID NO: 897808 - RNA, 28 nt, Human
acucugccucaaaaaaaaaaaaaaaaaa

SEQ ID NO: 897809 - RNA, 20 nt, Human
acugauguuuccccugcaaa

SEQ ID NO: 897810 - RNA, 22 nt, Human
acugcaccaccgcacuccagca

SEQ ID NO: 897811 - RNA, 24 nt, Human
agacugaggcaggagaacugcuug

SEQ ID NO: 897812 - RNA, 20 nt, Human
agcaauucuccugccucagc

SEQ ID NO: 897813 - RNA, 23 nt, Human
agcauggaguguacuacuaucug

SEQ ID NO: 897814 - RNA, 22 nt, Human
agcauuuugggaggcugaggca

SEQ ID NO: 897815 - RNA, 24 nt, Human
agcauuuugggaggcugaggcagg

SEQ ID NO: 897816 - RNA, 24 nt, Human
agccuggccaacacagugaaaccc

SEQ ID NO: 897817 - RNA, 24 nt, Human
aggaaauacuugcaauaaaaagaa

SEQ ID NO: 897818 - RNA, 19 nt, Human
aggacagaaaagcaaaacc

SEQ ID NO: 897819 - RNA, 24 nt, Human
aggaguucgagaccagcccuggcc

SEQ ID NO: 897820 - RNA, 18 nt, Human
aggcaggagaacugcuug

SEQ ID NO: 897821 - RNA, 24 nt, Human
aggcaggagaacugcuugaacccg

SEQ ID NO: 897822 - RNA, 27 nt, Human
aggcagguggaucaugaggucaguuca

SEQ ID NO: 897823 - RNA, 21 nt, Human
aggccgaggcgggcugauuac

SEQ ID NO: 897824 - RNA, 20 nt, Human
aggcugaggcagguggauca

SEQ ID NO: 897825 - RNA, 22 nt, Human
aggcugaggcagguggaucaug

SEQ ID NO: 897826 - RNA, 24 nt, Human
agguggagguugcagugagccgag

SEQ ID NO: 897827 - RNA, 24 nt, Human
aguggcucaagccuguaaucccag

SEQ ID NO: 897828 - RNA, 24 nt, Human
aguggcucacaccuguaaucacag

SEQ ID NO: 897829 - RNA, 24 nt, Human
auuaccuguggucaggaguucgag

SEQ ID NO: 897830 - RNA, 21 nt, Human
caacaagagcaaaacuccauc

SEQ ID NO: 897831 - RNA, 27 nt, Human
caacauggugaaacccugucgucucua

SEQ ID NO: 897832 - RNA, 24 nt, Human
caagagcaaaacuccaucucaaaa

SEQ ID NO: 897833 - RNA, 24 nt, Human
caagauccuguagcgaacgucucc

SEQ ID NO: 897834 - RNA, 22 nt, Human
caagcugaaagaguucugcuca

SEQ ID NO: 897835 - RNA, 21 nt, Human
cacacaacaccuguacauggu

SEQ ID NO: 897836 - RNA, 24 nt, Human
cacacacuaaaacccugccauaaa

SEQ ID NO: 897837 - RNA, 19 nt, Human
cacacccguaguuccagcc

SEQ ID NO: 897838 - RNA, 24 nt, Human
cacaccuguaaucacagcacuuug

SEQ ID NO: 897839 - RNA, 26 nt, Human
cacagcacuuuggaggccgaggcggg

SEQ ID NO: 897840 - RNA, 19 nt, Human
caccuguaaucacagcacu

SEQ ID NO: 897841 - RNA, 22 nt, Human
cacuauagguggcuaaaacaaa

SEQ ID NO: 897842 - RNA, 21 nt, Human
cacuccagcagagcaagacuc

SEQ ID NO: 897843 - RNA, 21 nt, Human
cacugcaaccucugccucccg

SEQ ID NO: 897844 - RNA, 23 nt, Human
cacugcaaccucugccucccggg

SEQ ID NO: 897845 - RNA, 23 nt, Human
cacugcugguugacugacagagu

SEQ ID NO: 897846 - RNA, 23 nt, Human
cacuuuggaggccgaggcgggcu

SEQ ID NO: 897847 - RNA, 23 nt, Human
cagagcaagacucugccucaaaa

SEQ ID NO: 897848 - RNA, 22 nt, Human
cagaguccaaguuuccaaaauc

SEQ ID NO: 897849 - RNA, 23 nt, Human
cagcaacaagagcaaaacuccau

SEQ ID NO: 897850 - RNA, 25 nt, Human
cagcaacaagagcaaaacuccaucu

SEQ ID NO: 897851 - RNA, 20 nt, Human
cagcaccagaaucccacuga

SEQ ID NO: 897852 - RNA, 21 nt, Human
cagcacuuuggaggccgaggc

SEQ ID NO: 897853 - RNA, 23 nt, Human
cagcacuuuggaggccgaggcgg

SEQ ID NO: 897854 - RNA, 24 nt, Human
cagcauuuugggaggcugaggcag

SEQ ID NO: 897855 - RNA, 24 nt, Human
cagcauuuugggaggcugaggcag

SEQ ID NO: 897856 - RNA, 24 nt, Human
cagcuuccuugugaucagcucuga

SEQ ID NO: 897857 - RNA, 24 nt, Human
caucaaaaauaaagaauuaguucc

SEQ ID NO: 897858 - RNA, 23 nt, Human
cauuaaagcgucccaacacaaag

SEQ ID NO: 897859 - RNA, 26 nt, Human
cauuuucaccuuaaaaaaauuucagg

SEQ ID NO: 897860 - RNA, 22 nt, Human
ccacaacaucaaaaauaaagaa

SEQ ID NO: 897861 - RNA, 20 nt, Human
ccaccgcacuccagcagagc

SEQ ID NO: 897862 - RNA, 21 nt, Human
ccaccgcacuccagcagagca

SEQ ID NO: 897863 - RNA, 23 nt, Human
ccaccgcacuccagcagagcaag

SEQ ID NO: 897864 - RNA, 25 nt, Human
ccaccgcacuccagcagagcaagac

SEQ ID NO: 897865 - RNA, 21 nt, Human
cccaacacaaagcagauucga

SEQ ID NO: 897866 - RNA, 19 nt, Human
cccggaggcagcggucgcc

SEQ ID NO: 897867 - RNA, 21 nt, Human
cccgggagguggagguugcag

SEQ ID NO: 897868 - RNA, 23 nt, Human
cccggguuugagcaauucuccug

SEQ ID NO: 897869 - RNA, 19 nt, Human
ccgggagcaguggcucaag

SEQ ID NO: 897870 - RNA, 21 nt, Human
ccucauugucccaagauccug

SEQ ID NO: 897871 - RNA, 24 nt, Human
ccucccggguuugagcaauucucc

SEQ ID NO: 897872 - RNA, 24 nt, Human
ccuggccaacacagugaaacccca

SEQ ID NO: 897873 - RNA, 22 nt, Human
ccuggccaacauggugaaaccc

SEQ ID NO: 897874 - RNA, 22 nt, Human
ccuggccaacauggugaaaccc

SEQ ID NO: 897875 - RNA, 24 nt, Human
ccuggccaacauggugaaacccug

SEQ ID NO: 897876 - RNA, 25 nt, Human
ccuguaaucacagcacuuuggaggc

SEQ ID NO: 897877 - RNA, 20 nt, Human
ccuguaaucccagcauuuug

SEQ ID NO: 897878 - RNA, 22 nt, Human
ccuguaaucccagcauuuuggg

SEQ ID NO: 897879 - RNA, 22 nt, Human
ccuguggucaggaguucgagac

SEQ ID NO: 897880 - RNA, 25 nt, Human
cgagaccagcccuggccaacauggu

SEQ ID NO: 897881 - RNA, 29 nt, Human
cgggagguggagguugcagugacaacggu

SEQ ID NO: 897882 - RNA, 24 nt, Human
cgggagguggagguugcagugagc

SEQ ID NO: 897883 - RNA, 18 nt, Human
cucaaaaaaaaaaaaaaa

SEQ ID NO: 897884 - RNA, 23 nt, Human
cucaaaaaaaaaaaaaaaaaaaa

SEQ ID NO: 897885 - RNA, 24 nt, Human
cucaagccuguaaucccagcauuu

SEQ ID NO: 897886 - RNA, 24 nt, Human
cucacaccuguaaucacagcacuu

SEQ ID NO: 897887 - RNA, 19 nt, Human
cucugccucaaaaaaaaaa

SEQ ID NO: 897888 - RNA, 22 nt, Human
cucugccucaaaaaaaaaaaaa

SEQ ID NO: 897889 - RNA, 19 nt, Human
cucuuuugcccaggcugga

SEQ ID NO: 897890 - RNA, 24 nt, Human
cugauggucuccuucaaacccucc

SEQ ID NO: 897891 - RNA, 19 nt, Human
cugcaaccucugccucccg

SEQ ID NO: 897892 - RNA, 23 nt, Human
cugcaaccucugccucccggguu

SEQ ID NO: 897893 - RNA, 23 nt, Human
cugcaaccucugccucccggguu

SEQ ID NO: 897894 - RNA, 23 nt, Human
cugccucagcaacaagagcaaaa

SEQ ID NO: 897895 - RNA, 24 nt, Human
cugcuugaacccgggagguggagg

SEQ ID NO: 897896 - RNA, 23 nt, Human
cuggccaacacagugaaacccca

SEQ ID NO: 897897 - RNA, 24 nt, Human
cuggccaacauggugaaacccugu

SEQ ID NO: 897898 - RNA, 23 nt, Human
gaaaaaggaacuugucaaaacau

SEQ ID NO: 897899 - RNA, 25 nt, Human
gaaaauucauuuauuuagugaaacc

SEQ ID NO: 897900 - RNA, 23 nt, Human
gagguugcagugagccgagacug

SEQ ID NO: 897901 - RNA, 21 nt, Human
gaucaugaggucaguucaaga

SEQ ID NO: 897902 - RNA, 22 nt, Human
gauuaccuguggucaggaguuc

SEQ ID NO: 897903 - RNA, 24 nt, Human
gauuaccuguggucaggaguucga

SEQ ID NO: 897904 - RNA, 21 nt, Human
gcaaccucugccucccggguu

SEQ ID NO: 897905 - RNA, 23 nt, Human
gcagugauuugucauuaaggucu

SEQ ID NO: 897906 - RNA, 22 nt, Human
gccaacauggugaaacccuguc

SEQ ID NO: 897907 - RNA, 20 nt, Human
gcucuuuugcccaggcugga

SEQ ID NO: 897908 - RNA, 23 nt, Human
ggaaauaaaguguggaaggauca

SEQ ID NO: 897909 - RNA, 24 nt, Human
ggaaggacugcagggccugugugg

SEQ ID NO: 897910 - RNA, 18 nt, Human
ggagguugcagugagccg

SEQ ID NO: 897911 - RNA, 20 nt, Human
ggagguugcagugagccgag

SEQ ID NO: 897912 - RNA, 22 nt, Human
ggagguugcagugagccgagac

SEQ ID NO: 897913 - RNA, 22 nt, Human
ggcgugguggcgcacacccgua

SEQ ID NO: 897914 - RNA, 23 nt, Human
ggcguuuugcucuuuugcccagg

SEQ ID NO: 897915 - RNA, 24 nt, Human
gggagcaguggcucaagccuguaa

SEQ ID NO: 897916 - RNA, 24 nt, Human
gggugcaguggcucacaccuguaa

SEQ ID NO: 897917 - RNA, 24 nt, Human
gguggcgcacacccguaguuccag

SEQ ID NO: 897918 - RNA, 22 nt, Human
gucuccuucaaacccuccauca

SEQ ID NO: 897919 - RNA, 29 nt, Human
gucugaaaucccauauuuucaacuguccc

SEQ ID NO: 897920 - RNA, 18 nt, Human
gugcaguggcucacaccu

SEQ ID NO: 897921 - RNA, 19 nt, Human
guugcagugagccgagacu

SEQ ID NO: 897922 - RNA, 21 nt, Human
guugcagugagccgagacugc

SEQ ID NO: 897923 - RNA, 24 nt, Human
guuuugcucuuuugcccaggcugg

SEQ ID NO: 897924 - RNA, 22 nt, Human
uaaagcgucccaacacaaagca

SEQ ID NO: 897925 - RNA, 21 nt, Human
uagcgaacgucuccgcggucu

SEQ ID NO: 897926 - RNA, 25 nt, Human
uaggaaauacuugcaauaaaaagaa

SEQ ID NO: 897927 - RNA, 18 nt, Human
uaggaaggacugcagggc

SEQ ID NO: 897928 - RNA, 21 nt, Human
ucaagccuguaaucccagcau

SEQ ID NO: 897929 - RNA, 20 nt, Human
ucacacacuaaaacccugcc

SEQ ID NO: 897930 - RNA, 23 nt, Human
ucacugcaaccucugccucccgg

SEQ ID NO: 897931 - RNA, 24 nt, Human
ucacugcaaccucugccucccggg

SEQ ID NO: 897932 - RNA, 25 nt, Human
ucacugcaaccucugccucccgggu

SEQ ID NO: 897933 - RNA, 23 nt, Human
ucagcaacaagagcaaaacucca

SEQ ID NO: 897934 - RNA, 25 nt, Human
ucaggccgggugcaguggcucacac

SEQ ID NO: 897935 - RNA, 21 nt, Human
ucaugaggucaguucaagacc

SEQ ID NO: 897936 - RNA, 21 nt, Human
uccaugccgaaagcggccgca

SEQ ID NO: 897937 - RNA, 21 nt, Human
ucccggguuugagcaauucuc

SEQ ID NO: 897938 - RNA, 24 nt, Human
ucccggguuugagcaauucuccug

SEQ ID NO: 897939 - RNA, 24 nt, Human
uccgcggucuguaaacuucccgga

SEQ ID NO: 897940 - RNA, 24 nt, Human
ucuccuucaaacccuccaucagag

SEQ ID NO: 897941 - RNA, 26 nt, Human
ucugaaaucccauauuuucaacuguc

SEQ ID NO: 897942 - RNA, 23 nt, Human
ucugccucaaaaaaaaaaaaaaa

SEQ ID NO: 897943 - RNA, 20 nt, Human
ucuguaaacuucccggaggc

SEQ ID NO: 897944 - RNA, 18 nt, Human
ucuugggucacugcaacc

SEQ ID NO: 897945 - RNA, 19 nt, Human
ugaaaccccaucuccacua

SEQ ID NO: 897946 - RNA, 22 nt, Human
ugaaaccccaucuccacuaaaa

SEQ ID NO: 897947 - RNA, 19 nt, Human
ugaaggaaaacuguuacac

SEQ ID NO: 897948 - RNA, 20 nt, Human
ugagcaauucuccugccuca

SEQ ID NO: 897949 - RNA, 20 nt, Human
ugagcuguaguccacugcug

SEQ ID NO: 897950 - RNA, 24 nt, Human
ugaggcaggagaacugcuugaacc

SEQ ID NO: 897951 - RNA, 25 nt, Human
ugaggcaggagaacugcuugaaccc

SEQ ID NO: 897952 - RNA, 24 nt, Human
ugaggcagguggaucaugagguca

SEQ ID NO: 897953 - RNA, 23 nt, Human
ugauuaccuguggucaggaguuc

SEQ ID NO: 897954 - RNA, 25 nt, Human
ugccauaaaguuguaucaauuaggg

SEQ ID NO: 897955 - RNA, 26 nt, Human
ugccauaaaguuguaucaauuagggc

SEQ ID NO: 897956 - RNA, 20 nt, Human
ugccaucagucaucuaucgg

SEQ ID NO: 897957 - RNA, 21 nt, Human
ugcccaggcuggagugaagug

SEQ ID NO: 897958 - RNA, 24 nt, Human
ugcccaggcuggagugaaguggca

SEQ ID NO: 897959 - RNA, 21 nt, Human
ugcucuuuugcccaggcugga

SEQ ID NO: 897960 - RNA, 24 nt, Human
ugcucuuuugcccaggcuggagug

SEQ ID NO: 897961 - RNA, 19 nt, Human
uggagugaaguggcacgau

SEQ ID NO: 897962 - RNA, 24 nt, Human
uggagugaaguggcacgaucuugg

SEQ ID NO: 897963 - RNA, 21 nt, Human
uggcacgaucuugggucacug

SEQ ID NO: 897964 - RNA, 24 nt, Human
uggccaacauggugaaacccuguc

SEQ ID NO: 897965 - RNA, 24 nt, Human
uggcucaagccuguaaucccagca

SEQ ID NO: 897966 - RNA, 18 nt, Human
uggcucacaccuguaauc

SEQ ID NO: 897967 - RNA, 24 nt, Human
uggcucacaccuguaaucacagca

SEQ ID NO: 897968 - RNA, 24 nt, Human
ugggaggcugaggcagguggauca

SEQ ID NO: 897969 - RNA, 24 nt, Human
uguugcacacaacaccuguacaug

SEQ ID NO: 897970 - RNA, 18 nt, Human
uuagcugggcgugguggc

SEQ ID NO: 897971 - RNA, 20 nt, Human
uuagcugggcgugguggcgc

SEQ ID NO: 897972 - RNA, 18 nt, Human
uucaaaaggcuaauugca

SEQ ID NO: 897973 - RNA, 24 nt, Human
uugaacccgggagguggagguugc

SEQ ID NO: 897974 - RNA, 18 nt, Human
uugcagugagccgagacu

SEQ ID NO: 897975 - RNA, 19 nt, Human
uugcagugagccgagacug

SEQ ID NO: 897976 - RNA, 22 nt, Human
uugcagugagccgagacugcac

SEQ ID NO: 897977 - RNA, 21 nt, Human
uugcccaggcuggagugaagu

SEQ ID NO: 897978 - RNA, 22 nt, Human
uugcucuuuugcccaggcugga

SEQ ID NO: 897979 - RNA, 24 nt, Human
uugcucuuuugcccaggcuggagu

SEQ ID NO: 897980 - RNA, 25 nt, Human
uugggaggcugaggcagguggauca

SEQ ID NO: 897981 - RNA, 28 nt, Human
uugucugaaaucccauauuuucaacugu

SEQ ID NO: 897982 - RNA, 19 nt, Human
uuuccuggucaaaaaacug

SEQ ID NO: 897983 - RNA, 24 nt, Human
uuugagcaauucuccugccucagc

SEQ ID NO: 897984 - RNA, 24 nt, Human
uuuugcucuuuugcccaggcugga

SEQ ID NO: 897985 - RNA, 22 nt, Human
uuuuuuuuuuuuuuuuuuucag

SEQ ID NO: 897986 - RNA, 24 nt, Human
aaaaccaguaccaaauccaaaacc

SEQ ID NO: 897987 - RNA, 18 nt, Human
aaaauagcaucucucuca

SEQ ID NO: 897988 - RNA, 23 nt, Human
aaaauugaaggccaugucgcgaa

SEQ ID NO: 897989 - RNA, 25 nt, Human
aaaccaguaccuaaaccaguacuag

SEQ ID NO: 897990 - RNA, 21 nt, Human
aaccaguaccaaauccaaaac

SEQ ID NO: 897991 - RNA, 24 nt, Human
aauaaaaaggcuuaaaaaacaaaa

SEQ ID NO: 897992 - RNA, 22 nt, Human
aaucccaguccaguucccaaac

SEQ ID NO: 897993 - RNA, 22 nt, Human
acucgcaguauuuaucagcugg

SEQ ID NO: 897994 - RNA, 18 nt, Human
aggagcuuguguaggcug

SEQ ID NO: 897995 - RNA, 21 nt, Human
aggugcccgagggagccccaa

SEQ ID NO: 897996 - RNA, 20 nt, Human
aguacaggcucaauggacaa

SEQ ID NO: 897997 - RNA, 24 nt, Human
aguccaguucccaaaccaguaccu

SEQ ID NO: 897998 - RNA, 21 nt, Human
caaaaaaccaauccaagaaag

SEQ ID NO: 897999 - RNA, 18 nt, Human
caaaaccaguaccaaauc

SEQ ID NO: 898000 - RNA, 23 nt, Human
cagaaaagcugaaugcagaaccu

SEQ ID NO: 898001 - RNA, 23 nt, Human
caguccaguucccaaaccaguac

SEQ ID NO: 898002 - RNA, 18 nt, Human
cauuucacaaaccuuuac

SEQ ID NO: 898003 - RNA, 23 nt, Human
cauuuugccaaaauagcaucucu

SEQ ID NO: 898004 - RNA, 19 nt, Human
ccaaaaccaguaccaaauc

SEQ ID NO: 898005 - RNA, 21 nt, Human
ccaaaaccaguaccaaaucca

SEQ ID NO: 898006 - RNA, 18 nt, Human
ccccaaaauugaaggccu

SEQ ID NO: 898007 - RNA, 22 nt, Human
cccuccauguggucgguuucau

SEQ ID NO: 898008 - RNA, 20 nt, Human
ccugcaguuguagauguugu

SEQ ID NO: 898009 - RNA, 19 nt, Human
cugaagagaccaccuaaug

SEQ ID NO: 898010 - RNA, 18 nt, Human
cugcuguguauuaaaucc

SEQ ID NO: 898011 - RNA, 20 nt, Human
gaagagcugugaggugacua

SEQ ID NO: 898012 - RNA, 19 nt, Human
gaaggccaugucgcgaaag

SEQ ID NO: 898013 - RNA, 27 nt, Human
gccgcgguggcugcagcggucguacac

SEQ ID NO: 898014 - RNA, 19 nt, Human
ggaauauuauuguugaaau

SEQ ID NO: 898015 - RNA, 23 nt, Human
gggccgcgguggcugcagcggua

SEQ ID NO: 898016 - RNA, 20 nt, Human
guuuucuuuuucccuccaug

SEQ ID NO: 898017 - RNA, 22 nt, Human
uaaaaaggcuuaaaaaacaaaa

SEQ ID NO: 898018 - RNA, 20 nt, Human
uaaaauaauauaaaaauaca

SEQ ID NO: 898019 - RNA, 23 nt, Human
uaaaauaauauaaaaauacauuu

SEQ ID NO: 898020 - RNA, 21 nt, Human
uaaggaaggucugaugcagua

SEQ ID NO: 898021 - RNA, 22 nt, Human
uacccuuuuccuguuccccaaa

SEQ ID NO: 898022 - RNA, 24 nt, Human
uaggagcuuguguaggcugacuga

SEQ ID NO: 898023 - RNA, 26 nt, Human
uauaaccuacugccuuaaaucggcaa

SEQ ID NO: 898024 - RNA, 18 nt, Human
uauagaacaaaaacaaaa

SEQ ID NO: 898025 - RNA, 21 nt, Human
ucccaaauccuccaaacccac

SEQ ID NO: 898026 - RNA, 25 nt, Human
uccccaaaaggccugcaguugauuc

SEQ ID NO: 898027 - RNA, 21 nt, Human
ucggcaaaagggauuuucuug

SEQ ID NO: 898028 - RNA, 22 nt, Human
ugaguaccaccaaagaguccag

SEQ ID NO: 898029 - RNA, 21 nt, Human
ugcugcuguguauuaaauccu

SEQ ID NO: 898030 - RNA, 22 nt, Human
uggaaagcagaguacaggcuca

SEQ ID NO: 898031 - RNA, 23 nt, Human
uggacaauaaucauuaaacacag

SEQ ID NO: 898032 - RNA, 19 nt, Human
uggggcagaaaagcugaau

SEQ ID NO: 898033 - RNA, 21 nt, Human
ugguaauuaugcacuucuuuu

SEQ ID NO: 898034 - RNA, 23 nt, Human
ugugaggugacuauuucagauuu

SEQ ID NO: 898035 - RNA, 21 nt, Human
uuauagaacaaaaacaaaaca

SEQ ID NO: 898036 - RNA, 20 nt, Human
uucacaaauacaaaaacugg

SEQ ID NO: 898037 - RNA, 25 nt, Human
uuucacaaaccuuuacacaaguuuu

SEQ ID NO: 898038 - RNA, 24 nt, Human
uuuguucugaguaccaccaaagag

SEQ ID NO: 898039 - RNA, 24 nt, Human
uuuuggauuuucuuuacuccuccc

SEQ ID NO: 898040 - RNA, 21 nt, Human
aaaaccuguuuggaaaacaga

SEQ ID NO: 898041 - RNA, 23 nt, Human
aaaagaagaauggugaaacaaaa

SEQ ID NO: 898042 - RNA, 29 nt, Human
aaacacaaggcaaagugagaagggacccc

SEQ ID NO: 898043 - RNA, 19 nt, Human
aaacagcccaucuccuguc

SEQ ID NO: 898044 - RNA, 19 nt, Human
aagcgagccaccaccaaaa

SEQ ID NO: 898045 - RNA, 20 nt, Human
acuacaaauaccacaugacc

SEQ ID NO: 898046 - RNA, 25 nt, Human
agaaacaagcgagccaccaccaaaa

SEQ ID NO: 898047 - RNA, 23 nt, Human
aggguggaaaacacaaggcaaag

SEQ ID NO: 898048 - RNA, 26 nt, Human
cacaaggcaaagugagaaaaaaaaaa

SEQ ID NO: 898049 - RNA, 24 nt, Human
ccauccauuuacaauaauuacuuc

SEQ ID NO: 898050 - RNA, 22 nt, Human
cccuguauaugaguaauuccau

SEQ ID NO: 898051 - RNA, 26 nt, Human
ccuacucugacucuaccucaaaagcc

SEQ ID NO: 898052 - RNA, 19 nt, Human
gaagcagaacaacagcccu

SEQ ID NO: 898053 - RNA, 23 nt, Human
gagccaccaccaaaaagguuuaa

SEQ ID NO: 898054 - RNA, 25 nt, Human
gugaaacaaaauauaugaucugcuc

SEQ ID NO: 898055 - RNA, 21 nt, Human
guuaauacuuccauaaaaaca

SEQ ID NO: 898056 - RNA, 23 nt, Human
uaaaaacagcccaucuccuguca

SEQ ID NO: 898057 - RNA, 25 nt, Human
uaacaggauaaaauuccacccugua

SEQ ID NO: 898058 - RNA, 23 nt, Human
uaauuucuugaggaagcagaaca

SEQ ID NO: 898059 - RNA, 21 nt, Human
uaccacaugaccacauuuaua

SEQ ID NO: 898060 - RNA, 23 nt, Human
uacucugacucuaccucaaaagc

SEQ ID NO: 898061 - RNA, 18 nt, Human
uacuuagucauauacaga

SEQ ID NO: 898062 - RNA, 26 nt, Human
uauaauugauugcuuuucacuuucaa

SEQ ID NO: 898063 - RNA, 20 nt, Human
uaucagagaaacaagcgagc

SEQ ID NO: 898064 - RNA, 19 nt, Human
uauuaggggcugauauuca

SEQ ID NO: 898065 - RNA, 20 nt, Human
uauuaggggcugauauucag

SEQ ID NO: 898066 - RNA, 25 nt, Human
uauuaggggcugauauucagaaaau

SEQ ID NO: 898067 - RNA, 18 nt, Human
ucuaaaaaugcuuaaauc

SEQ ID NO: 898068 - RNA, 20 nt, Human
ugaaacaaaauauaugaucu

SEQ ID NO: 898069 - RNA, 21 nt, Human
ugauuaacacccaucauuugg

SEQ ID NO: 898070 - RNA, 25 nt, Human
uggaaaacacaaggcaaagugagaa

SEQ ID NO: 898071 - RNA, 23 nt, Human
uggaaaauuuauuuuuccuuagg

SEQ ID NO: 898072 - RNA, 18 nt, Human
ugugaaaauauauacaua

SEQ ID NO: 898073 - RNA, 24 nt, Human
ugugauaacaggauaaaauuccac

SEQ ID NO: 898074 - RNA, 23 nt, Human
uguuuggaaaacagauuaguugu

SEQ ID NO: 898075 - RNA, 22 nt, Human
uucaaaauuuauuacaaaagaa

SEQ ID NO: 898076 - RNA, 19 nt, Human
uuuauacacuauacuguca

SEQ ID NO: 898077 - RNA, 25 nt, Human
uuuuuuuuuuuuuuuuuuuacuuaa

SEQ ID NO: 898078 - RNA, 20 nt, Human
aaaaaaaagaaaauaaaagg

SEQ ID NO: 898079 - RNA, 21 nt, Human
aaagaaaauaaaagggaaugg

SEQ ID NO: 898080 - RNA, 20 nt, Human
aacagagucuccaaacacgg

SEQ ID NO: 898081 - RNA, 19 nt, Human
aacauggugaaaccccauc

SEQ ID NO: 898082 - RNA, 20 nt, Human
aacauggugaaaccccaucu

SEQ ID NO: 898083 - RNA, 21 nt, Human
aacauggugaaaccccaucuc

SEQ ID NO: 898084 - RNA, 21 nt, Human
aacauggugaaaccccaucuc

SEQ ID NO: 898085 - RNA, 21 nt, Human
aagaaaauaaaagggaauggc

SEQ ID NO: 898086 - RNA, 22 nt, Human
aagaaaauaaaagggaauggca

SEQ ID NO: 898087 - RNA, 20 nt, Human
aagaggccaacaaccuaccu

SEQ ID NO: 898088 - RNA, 21 nt, Human
aaggaaggagggggaggagga

SEQ ID NO: 898089 - RNA, 18 nt, Human
aauaacgucucaggaggc

SEQ ID NO: 898090 - RNA, 24 nt, Human
acacaaggcccacccguggcugac

SEQ ID NO: 898091 - RNA, 24 nt, Human
acagagcaagacuccaucucaaaa

SEQ ID NO: 898092 - RNA, 24 nt, Human
accccagggugcuggcugaggagu

SEQ ID NO: 898093 - RNA, 24 nt, Human
accccaucucuacuaaaaauacaa

SEQ ID NO: 898094 - RNA, 25 nt, Human
accggauuuuccaaaucaauggucu

SEQ ID NO: 898095 - RNA, 24 nt, Human
accugaggucaggaguucgagacc

SEQ ID NO: 898096 - RNA, 24 nt, Human
acugcacuccagccugggcgacag

SEQ ID NO: 898097 - RNA, 26 nt, Human
acugcacuccagccugggcgacagag

SEQ ID NO: 898098 - RNA, 22 nt, Human
acuuggguggugggauucgggg

SEQ ID NO: 898099 - RNA, 19 nt, Human
agagaaggauucguuaaca

SEQ ID NO: 898100 - RNA, 22 nt, Human
agauggugccacugcacuccag

SEQ ID NO: 898101 - RNA, 24 nt, Human
agcaaggaacaacagugucaacag

SEQ ID NO: 898102 - RNA, 24 nt, Human
agcacuuugggaggccgaggcggg

SEQ ID NO: 898103 - RNA, 23 nt, Human
agccagguacgguggcgggugcc

SEQ ID NO: 898104 - RNA, 24 nt, Human
agccagguacgguggcgggugccu

SEQ ID NO: 898105 - RNA, 24 nt, Human
agccuagccaacauggugaaaccc

SEQ ID NO: 898106 - RNA, 24 nt, Human
agccugggcgacagagcaagacuc

SEQ ID NO: 898107 - RNA, 24 nt, Human
aggaaaaggcgaggcuucugguaa

SEQ ID NO: 898108 - RNA, 24 nt, Human
aggaacaacagugucaacagccgg

SEQ ID NO: 898109 - RNA, 20 nt, Human
aggaaggagggggaggagga

SEQ ID NO: 898110 - RNA, 21 nt, Human
aggagaaggcugaguuuuaaa

SEQ ID NO: 898111 - RNA, 18 nt, Human
aggcaggagaaucacuug

SEQ ID NO: 898112 - RNA, 22 nt, Human
aggcaggagaaucacuugaacc

SEQ ID NO: 898113 - RNA, 21 nt, Human
aggccgaggcggguggaucac

SEQ ID NO: 898114 - RNA, 22 nt, Human
aggcggguggaucaccugaggu

SEQ ID NO: 898115 - RNA, 26 nt, Human
aggcggguggaucaccugaggucagg

SEQ ID NO: 898116 - RNA, 24 nt, Human
aggcugaggcaggagaaucacuug

SEQ ID NO: 898117 - RNA, 18 nt, Human
agggggaggaggagaagg

SEQ ID NO: 898118 - RNA, 24 nt, Human
agguacgguggcgggugccuguaa

SEQ ID NO: 898119 - RNA, 21 nt, Human
aucaccugaggucaggaguuc

SEQ ID NO: 898120 - RNA, 21 nt, Human
augccugcuuuauuuccuacg

SEQ ID NO: 898121 - RNA, 24 nt, Human
auggugccacugcacuccagccug

SEQ ID NO: 898122 - RNA, 24 nt, Human
caacauggugaaaccccaucucua

SEQ ID NO: 898123 - RNA, 21 nt, Human
caagacuccaucucaaaaaaa

SEQ ID NO: 898124 - RNA, 23 nt, Human
caagacuccaucucaaaaaaaag

SEQ ID NO: 898125 - RNA, 18 nt, Human
caagggcccugcaaugac

SEQ ID NO: 898126 - RNA, 20 nt, Human
caagggcccugcaaugacuu

SEQ ID NO: 898127 - RNA, 22 nt, Human
caaugacuucccugaaggguuu

SEQ ID NO: 898128 - RNA, 25 nt, Human
cacccgcagcucuaagcggaggccc

SEQ ID NO: 898129 - RNA, 21 nt, Human
cacccucgcuccaucccgggg

SEQ ID NO: 898130 - RNA, 22 nt, Human
cacccucgcuccaucccggggc

SEQ ID NO: 898131 - RNA, 23 nt, Human
caccugaggucaggaguucgaga

SEQ ID NO: 898132 - RNA, 24 nt, Human
cacgccuguaaucccagcacuuug

SEQ ID NO: 898133 - RNA, 23 nt, Human
cacuccagccugggcgacagagc

SEQ ID NO: 898134 - RNA, 19 nt, Human
cacugcacuccagccuggg

SEQ ID NO: 898135 - RNA, 20 nt, Human
cacugcacuccagccugggc

SEQ ID NO: 898136 - RNA, 22 nt, Human
cacugcacuccagccugggcga

SEQ ID NO: 898137 - RNA, 23 nt, Human
cacugcacuccagccugggcgac

SEQ ID NO: 898138 - RNA, 24 nt, Human
cacugcacuccagccugggcgaca

SEQ ID NO: 898139 - RNA, 27 nt, Human
cacugcacuccagccugggcgacagag

SEQ ID NO: 898140 - RNA, 22 nt, Human
cagcacuuugggaggccgaggc

SEQ ID NO: 898141 - RNA, 24 nt, Human
cagcacuuugggaggccgaggcgg

SEQ ID NO: 898142 - RNA, 24 nt, Human
cagcuacucgggaggcugaggcag

SEQ ID NO: 898143 - RNA, 18 nt, Human
caggacccgggugaggcu

SEQ ID NO: 898144 - RNA, 18 nt, Human
cagguacgguggcgggug

SEQ ID NO: 898145 - RNA, 26 nt, Human
caucacauaacaagucuaaucgccaa

SEQ ID NO: 898146 - RNA, 20 nt, Human
caucucggaucaccagcagc

SEQ ID NO: 898147 - RNA, 20 nt, Human
ccacugcacuccagccuggg

SEQ ID NO: 898148 - RNA, 21 nt, Human
ccacugcacuccagccugggc

SEQ ID NO: 898149 - RNA, 21 nt, Human
ccacugcacuccagccugggc

SEQ ID NO: 898150 - RNA, 24 nt, Human
ccacugcacuccagccugggcgac

SEQ ID NO: 898151 - RNA, 24 nt, Human
cccaaaaaaccucuacaagcuucc

SEQ ID NO: 898152 - RNA, 18 nt, Human
cccaaguaagaggccaac

SEQ ID NO: 898153 - RNA, 20 nt, Human
cccgugcucccaaacagagu

SEQ ID NO: 898154 - RNA, 24 nt, Human
ccuagccaacauggugaaacccca

SEQ ID NO: 898155 - RNA, 21 nt, Human
ccuccacccucgcuccauccc

SEQ ID NO: 898156 - RNA, 22 nt, Human
ccugaggucaggaguucgagac

SEQ ID NO: 898157 - RNA, 22 nt, Human
ccugggcgacagagcaagacuc

SEQ ID NO: 898158 - RNA, 19 nt, Human
ccuguaaucccagcuacuc

SEQ ID NO: 898159 - RNA, 21 nt, Human
ccuguaaucccagcuacucgg

SEQ ID NO: 898160 - RNA, 23 nt, Human
ccuuagcuacauuuuucuucuca

SEQ ID NO: 898161 - RNA, 25 nt, Human
ccuugggcacagagcuggguggagc

SEQ ID NO: 898162 - RNA, 24 nt, Human
cgagaccagccuagccaacauggu

SEQ ID NO: 898163 - RNA, 20 nt, Human
cgaggcggguggaucaccug

SEQ ID NO: 898164 - RNA, 24 nt, Human
cgaggcggguggaucaccugaggu

SEQ ID NO: 898165 - RNA, 26 nt, Human
cgaggcggguggaucaccugagguca

SEQ ID NO: 898166 - RNA, 23 nt, Human
cgccuguaaucccagcacuuugg

SEQ ID NO: 898167 - RNA, 24 nt, Human
cgccuguaaucccagcacuuuggg

SEQ ID NO: 898168 - RNA, 22 nt, Human
cgcgcccuccacccucgcucca

SEQ ID NO: 898169 - RNA, 21 nt, Human
cggaaggaaggagggggagga

SEQ ID NO: 898170 - RNA, 24 nt, Human
cggcucacgccuguaaucccagca

SEQ ID NO: 898171 - RNA, 24 nt, Human
cggguggaucaccugaggucagga

SEQ ID NO: 898172 - RNA, 22 nt, Human
cucacgccuguaaucccagcac

SEQ ID NO: 898173 - RNA, 24 nt, Human
cucacgccuguaaucccagcacuu

SEQ ID NO: 898174 - RNA, 20 nt, Human
cucacugaaguacuguuuga

SEQ ID NO: 898175 - RNA, 25 nt, Human
cucagaccgaggaagacuguguugc

SEQ ID NO: 898176 - RNA, 19 nt, Human
cucaucuuuguaguucugc

SEQ ID NO: 898177 - RNA, 20 nt, Human
cucuacaagcuuccuuuugc

SEQ ID NO: 898178 - RNA, 21 nt, Human
cugcagaaacaaggcaccaca

SEQ ID NO: 898179 - RNA, 21 nt, Human
cugcccaggacacccuggcag

SEQ ID NO: 898180 - RNA, 19 nt, Human
cuggacacuuggguggugg

SEQ ID NO: 898181 - RNA, 20 nt, Human
cugguaauuucucaucuuug

SEQ ID NO: 898182 - RNA, 21 nt, Human
cuggugcuuaggaaaaggcga

SEQ ID NO: 898183 - RNA, 21 nt, Human
cuucugguaauuucucaucuu

SEQ ID NO: 898184 - RNA, 19 nt, Human
cuugggaagauguccaaag

SEQ ID NO: 898185 - RNA, 24 nt, Human
gaaggagggggaggaggagaaggc

SEQ ID NO: 898186 - RNA, 27 nt, Human
gacccaccggcccuccacgcucacucu

SEQ ID NO: 898187 - RNA, 20 nt, Human
gagcuggguggagcgagagg

SEQ ID NO: 898188 - RNA, 22 nt, Human
gaggaguuuacugcagaaacaa

SEQ ID NO: 898189 - RNA, 21 nt, Human
gagguugaagugagccaagau

SEQ ID NO: 898190 - RNA, 21 nt, Human
gaucaccugaggucaggaguu

SEQ ID NO: 898191 - RNA, 24 nt, Human
gaucaccugaggucaggaguucga

SEQ ID NO: 898192 - RNA, 24 nt, Human
gcacuccagccugggcgacagagc

SEQ ID NO: 898193 - RNA, 21 nt, Human
gcaggagaaucacuugaaccu

SEQ ID NO: 898194 - RNA, 24 nt, Human
gccaacauggugaaaccccaucuc

SEQ ID NO: 898195 - RNA, 22 nt, Human
gccacugcacuccagccugggc

SEQ ID NO: 898196 - RNA, 24 nt, Human
gccacugcacuccagccugggcga

SEQ ID NO: 898197 - RNA, 18 nt, Human
gcgaaagccaugcagccc

SEQ ID NO: 898198 - RNA, 20 nt, Human
gcgcccuccacccucgcucc

SEQ ID NO: 898199 - RNA, 20 nt, Human
gcgggugccuguaaucccag

SEQ ID NO: 898200 - RNA, 18 nt, Human
gcuacauuuuucuucuca

SEQ ID NO: 898201 - RNA, 23 nt, Human
gcugcugauuccacaccccaggg

SEQ ID NO: 898202 - RNA, 18 nt, Human
ggaaggaaggagggggag

SEQ ID NO: 898203 - RNA, 18 nt, Human
ggaaggaaggagggggag

SEQ ID NO: 898204 - RNA, 18 nt, Human
ggagguugaagugagcca

SEQ ID NO: 898205 - RNA, 20 nt, Human
ggagguugaagugagccaag

SEQ ID NO: 898206 - RNA, 24 nt, Human
ggagguugaagugagccaagaugg

SEQ ID NO: 898207 - RNA, 18 nt, Human
ggcggagguugaagugag

SEQ ID NO: 898208 - RNA, 23 nt, Human
ggcggagguugaagugagccaag

SEQ ID NO: 898209 - RNA, 24 nt, Human
ggcggcucacgccuguaaucccag

SEQ ID NO: 898210 - RNA, 20 nt, Human
ggcucacgccuguaauccca

SEQ ID NO: 898211 - RNA, 23 nt, Human
gggaggcugaggcaggagaauca

SEQ ID NO: 898212 - RNA, 24 nt, Human
gggcacggcggcucacgccuguaa

SEQ ID NO: 898213 - RNA, 23 nt, Human
gggcccccggccaucccgugcuc

SEQ ID NO: 898214 - RNA, 24 nt, Human
gggcggagguugaagugagccaag

SEQ ID NO: 898215 - RNA, 24 nt, Human
ggggaggaggagaaggcugaguuu

SEQ ID NO: 898216 - RNA, 24 nt, Human
gggggccgggcacggcggcucacg

SEQ ID NO: 898217 - RNA, 24 nt, Human
gggugaucgaacgugggugugggc

SEQ ID NO: 898218 - RNA, 21 nt, Human
gguggaucaccugaggucagg

SEQ ID NO: 898219 - RNA, 23 nt, Human
gguggcgggugccuguaauccca

SEQ ID NO: 898220 - RNA, 24 nt, Human
gguggcgggugccuguaaucccag

SEQ ID NO: 898221 - RNA, 21 nt, Human
uaaaaauacaaaaauuagcca

SEQ ID NO: 898222 - RNA, 21 nt, Human
uaaauaacgucucaggaggcc

SEQ ID NO: 898223 - RNA, 19 nt, Human
uaccugggccgauacaagg

SEQ ID NO: 898224 - RNA, 26 nt, Human
ucaaaaaaaagaaaauaaaagggaau

SEQ ID NO: 898225 - RNA, 24 nt, Human
ucacccgcagcucuaagcggaggc

SEQ ID NO: 898226 - RNA, 26 nt, Human
ucacccggcgguuccccucuggccgu

SEQ ID NO: 898227 - RNA, 20 nt, Human
ucaccugaggucaggaguuc

SEQ ID NO: 898228 - RNA, 18 nt, Human
ucaggaggccggagccac

SEQ ID NO: 898229 - RNA, 20 nt, Human
uccaauucagcaaggaacaa

SEQ ID NO: 898230 - RNA, 19 nt, Human
uccacgcucacucugccca

SEQ ID NO: 898231 - RNA, 20 nt, Human
uccagaccuucugggucauc

SEQ ID NO: 898232 - RNA, 24 nt, Human
uccagccugggcgacagagcaaga

SEQ ID NO: 898233 - RNA, 19 nt, Human
ucccggggcacagcuccuu

SEQ ID NO: 898234 - RNA, 21 nt, Human
ucccggggcacagcuccuucc

SEQ ID NO: 898235 - RNA, 19 nt, Human
ucccugaaggguuucgguc

SEQ ID NO: 898236 - RNA, 25 nt, Human
ucgggaggcugaggcaggagaauca

SEQ ID NO: 898237 - RNA, 22 nt, Human
ucuccagagacugcccauuguu

SEQ ID NO: 898238 - RNA, 23 nt, Human
ucucuacuaaaaauacaaaaauu

SEQ ID NO: 898239 - RNA, 22 nt, Human
ucugaacuacaagucaacaauc

SEQ ID NO: 898240 - RNA, 19 nt, Human
ugaaaccccaucucuacua

SEQ ID NO: 898241 - RNA, 19 nt, Human
ugaaggguuucggucccca

SEQ ID NO: 898242 - RNA, 21 nt, Human
ugagaacacaagagugggcug

SEQ ID NO: 898243 - RNA, 24 nt, Human
ugaggcaggagaaucacuugaacc

SEQ ID NO: 898244 - RNA, 25 nt, Human
ugaggcaggagaaucacuugaaccu

SEQ ID NO: 898245 - RNA, 24 nt, Human
ugccuguaaucccagcuacucggg

SEQ ID NO: 898246 - RNA, 20 nt, Human
ugcuccuccuaggacucagg

SEQ ID NO: 898247 - RNA, 24 nt, Human
uggaucaccugaggucaggaguuc

SEQ ID NO: 898248 - RNA, 27 nt, Human
uggaucaccugaggucaggaguucgag

SEQ ID NO: 898249 - RNA, 22 nt, Human
uggcgggugccuguaaucccag

SEQ ID NO: 898250 - RNA, 24 nt, Human
uggcgggugccuguaaucccagcu

SEQ ID NO: 898251 - RNA, 19 nt, Human
uggcuggcagagugcugag

SEQ ID NO: 898252 - RNA, 18 nt, Human
ugggaagauguccaaaga

SEQ ID NO: 898253 - RNA, 23 nt, Human
ugggaggccgaggcggguggauc

SEQ ID NO: 898254 - RNA, 24 nt, Human
ugggaggccgaggcggguggauca

SEQ ID NO: 898255 - RNA, 24 nt, Human
uucucacccaaaaaaccucuacaa

SEQ ID NO: 898256 - RNA, 25 nt, Human
uugggaggccgaggcggguggauca

SEQ ID NO: 898257 - RNA, 19 nt, Human
uuggguggugggauucggg

SEQ ID NO: 898258 - RNA, 21 nt, Human
uuggguggugggauucggggc

SEQ ID NO: 898259 - RNA, 22 nt, Human
uuugcgaaagccaugcagcccc

SEQ ID NO: 898260 - RNA, 22 nt, Human
uuuugcauuuggagauccccug

SEQ ID NO: 898261 - RNA, 25 nt, Human
aaaaauacacuuuggggaaccagaa

SEQ ID NO: 898262 - RNA, 24 nt, Human
aaaaauucaauacuguauaugacc

SEQ ID NO: 898263 - RNA, 26 nt, Human
aaacaaagguaaaaauaaagggaccc

SEQ ID NO: 898264 - RNA, 21 nt, Human
aaaccagcuucauaccaaaaa

SEQ ID NO: 898265 - RNA, 24 nt, Human
aaagaaacauuaaugcucaauuca

SEQ ID NO: 898266 - RNA, 19 nt, Human
aaccagaaaaaauugcaca

SEQ ID NO: 898267 - RNA, 20 nt, Human
aaccugaaaagcucuuggug

SEQ ID NO: 898268 - RNA, 20 nt, Human
acaaaacaugggaccaauaa

SEQ ID NO: 898269 - RNA, 19 nt, Human
acaaagccaggaacggccu

SEQ ID NO: 898270 - RNA, 18 nt, Human
acauuugaaugcauagaa

SEQ ID NO: 898271 - RNA, 22 nt, Human
accacauuugaaugcauagaau

SEQ ID NO: 898272 - RNA, 24 nt, Human
agaaaaaauugcacaaagcuuagg

SEQ ID NO: 898273 - RNA, 27 nt, Human
agaaaaauacacuuuggggaaccagaa

SEQ ID NO: 898274 - RNA, 19 nt, Human
agagaaaaauacacuuugg

SEQ ID NO: 898275 - RNA, 25 nt, Human
agcaaugauaaaacuuuggaaaaaa

SEQ ID NO: 898276 - RNA, 25 nt, Human
aggacaggaauuuauacaaaagaaa

SEQ ID NO: 898277 - RNA, 21 nt, Human
auaaaaacaaucuucauuuau

SEQ ID NO: 898278 - RNA, 23 nt, Human
aucauaucuauaaaacaaaauua

SEQ ID NO: 898279 - RNA, 18 nt, Human
auuacaauugugacagaa

SEQ ID NO: 898280 - RNA, 21 nt, Human
caaaacaugggaccaauaaag

SEQ ID NO: 898281 - RNA, 22 nt, Human
caaaagaaacauuaaugcucaa

SEQ ID NO: 898282 - RNA, 23 nt, Human
caaauaaaaacaaucuucauuua

SEQ ID NO: 898283 - RNA, 19 nt, Human
cacaaaacaugggaccaau

SEQ ID NO: 898284 - RNA, 21 nt, Human
cacaacaaaauccuggcaaaa

SEQ ID NO: 898285 - RNA, 18 nt, Human
cacuuuguguuuaaccgu

SEQ ID NO: 898286 - RNA, 23 nt, Human
cagaaaaaauugcacaaagcuua

SEQ ID NO: 898287 - RNA, 24 nt, Human
cagcacaacaaaauccuggcaaaa

SEQ ID NO: 898288 - RNA, 18 nt, Human
ccaaaagaauugagcaaa

SEQ ID NO: 898289 - RNA, 22 nt, Human
ccacuucaugcugacuaaacag

SEQ ID NO: 898290 - RNA, 19 nt, Human
gaaaaccagcuucauacca

SEQ ID NO: 898291 - RNA, 25 nt, Human
gacuuagagaaaaauacacuuuggg

SEQ ID NO: 898292 - RNA, 21 nt, Human
gauuaugguuuucagucuguu

SEQ ID NO: 898293 - RNA, 25 nt, Human
uaaaaauaaauagcaaugauaaaac

SEQ ID NO: 898294 - RNA, 24 nt, Human
uacaaaagaaacauuaaugcucaa

SEQ ID NO: 898295 - RNA, 24 nt, Human
uacuuuaucaggcaaauaaaaaca

SEQ ID NO: 898296 - RNA, 19 nt, Human
ucaaaguaaacuugguggc

SEQ ID NO: 898297 - RNA, 21 nt, Human
ucaaugccaacaauucacagg

SEQ ID NO: 898298 - RNA, 23 nt, Human
ugaaagcuguacaaccaaaagaa

SEQ ID NO: 898299 - RNA, 18 nt, Human
ugaauguucaaaaacaaa

SEQ ID NO: 898300 - RNA, 19 nt, Human
ugagaaagacugucuuccu

SEQ ID NO: 898301 - RNA, 18 nt, Human
ugagcgagcuacaaagcc

SEQ ID NO: 898302 - RNA, 22 nt, Human
ugagcgagcuacaaagccagga

SEQ ID NO: 898303 - RNA, 23 nt, Human
ugagcgagcuacaaagccaggaa

SEQ ID NO: 898304 - RNA, 20 nt, Human
uguaguauuguuugagaaag

SEQ ID NO: 898305 - RNA, 23 nt, Human
uguucaaaaacaaagguaaaaau

SEQ ID NO: 898306 - RNA, 25 nt, Human
uguuuaaccgugauuggcaaucuca

SEQ ID NO: 898307 - RNA, 18 nt, Human
uguuugagaaagacuguc

SEQ ID NO: 898308 - RNA, 18 nt, Human
uucaauacuguauaugac

SEQ ID NO: 898309 - RNA, 27 nt, Human
uuuaaaaauccuauuuaaacuccuuua

SEQ ID NO: 898310 - RNA, 18 nt, Human
uuuuauggcauguaauac

SEQ ID NO: 898311 - RNA, 20 nt, Human
uuuugcuuaccuuauuuuca

SEQ ID NO: 898312 - RNA, 24 nt, Human
agugcaccacguugccgaccaacg

SEQ ID NO: 898313 - RNA, 18 nt, Human
caggggacugaugauccu

SEQ ID NO: 898314 - RNA, 21 nt, Human
ccuccguggcaugcaccacuu

SEQ ID NO: 898315 - RNA, 22 nt, Human
uacauauguaucccucauuucc

SEQ ID NO: 898316 - RNA, 18 nt, Human
ucccaauccagccccucc

SEQ ID NO: 898317 - RNA, 22 nt, Human
ugccgaccaacgucccuggagc

SEQ ID NO: 898318 - RNA, 21 nt, Human
uggagcaucuuugucuuccca

SEQ ID NO: 898319 - RNA, 21 nt, Human
aaacaaagaaagaaagccaga

SEQ ID NO: 898320 - RNA, 24 nt, Human
aacacucccccaggaucccugcca

SEQ ID NO: 898321 - RNA, 19 nt, Human
aagaaccaagggcuuagcu

SEQ ID NO: 898322 - RNA, 23 nt, Human
aagaauuaagguuugggaggaaa

SEQ ID NO: 898323 - RNA, 20 nt, Human
aagcagauggaaauuacagc

SEQ ID NO: 898324 - RNA, 20 nt, Human
aaggcaagcugucccccucc

SEQ ID NO: 898325 - RNA, 18 nt, Human
aaugcaaggucaccagca

SEQ ID NO: 898326 - RNA, 22 nt, Human
acagacccaggaugaggaccca

SEQ ID NO: 898327 - RNA, 23 nt, Human
acauggccaaggccacgcagcaa

SEQ ID NO: 898328 - RNA, 19 nt, Human
accccaggguugccacuuc

SEQ ID NO: 898329 - RNA, 20 nt, Human
accccuugcccuugugagga

SEQ ID NO: 898330 - RNA, 22 nt, Human
acuccagucugaugaggggagg

SEQ ID NO: 898331 - RNA, 21 nt, Human
acugaugaaaucucccccucc

SEQ ID NO: 898332 - RNA, 19 nt, Human
acuucccuccccucccccc

SEQ ID NO: 898333 - RNA, 22 nt, Human
acuucccuccccuccccccacc

SEQ ID NO: 898334 - RNA, 23 nt, Human
acuuggcaucuccucgucuccac

SEQ ID NO: 898335 - RNA, 19 nt, Human
acuuggcccuggccccacu

SEQ ID NO: 898336 - RNA, 19 nt, Human
agaaauguggguaggaccc

SEQ ID NO: 898337 - RNA, 20 nt, Human
agaaccccuggucugggcaa

SEQ ID NO: 898338 - RNA, 18 nt, Human
agacagacacacagaaca

SEQ ID NO: 898339 - RNA, 22 nt, Human
agacagacacacagaacagauc

SEQ ID NO: 898340 - RNA, 23 nt, Human
agacagauggucaaucugucaag

SEQ ID NO: 898341 - RNA, 24 nt, Human
agacuucccuccccuccccccacc

SEQ ID NO: 898342 - RNA, 24 nt, Human
agaguucagccaggggaggugggg

SEQ ID NO: 898343 - RNA, 22 nt, Human
agcacugugggaggcugaacgg

SEQ ID NO: 898344 - RNA, 21 nt, Human
agcagccaggcuacuggggaa

SEQ ID NO: 898345 - RNA, 21 nt, Human
agccugguaaacuugucccag

SEQ ID NO: 898346 - RNA, 18 nt, Human
agcggaggguggucugga

SEQ ID NO: 898347 - RNA, 18 nt, Human
agcugcaggaggggagug

SEQ ID NO: 898348 - RNA, 23 nt, Human
agcugccuccguccccauaaaca

SEQ ID NO: 898349 - RNA, 22 nt, Human
aggaaaucuguuagcgaagucc

SEQ ID NO: 898350 - RNA, 22 nt, Human
aggaacugggaggccuugaacu

SEQ ID NO: 898351 - RNA, 24 nt, Human
aggaaguuggauggaccccuugcc

SEQ ID NO: 898352 - RNA, 20 nt, Human
aggaccuggcccuuuggggu

SEQ ID NO: 898353 - RNA, 18 nt, Human
aggcacugugaccuuggu

SEQ ID NO: 898354 - RNA, 26 nt, Human
aggcauccuucacuugaauuaucagg

SEQ ID NO: 898355 - RNA, 20 nt, Human
aggcccccggcagcccccag

SEQ ID NO: 898356 - RNA, 22 nt, Human
aggcccuguguccacaccccac

SEQ ID NO: 898357 - RNA, 19 nt, Human
aggcggcagugugcaugag

SEQ ID NO: 898358 - RNA, 20 nt, Human
aggcggcagugugcaugagg

SEQ ID NO: 898359 - RNA, 22 nt, Human
agggcagaggcagccuccaggu

SEQ ID NO: 898360 - RNA, 21 nt, Human
auacgccaagguaagcaaagc

SEQ ID NO: 898361 - RNA, 18 nt, Human
auccgaggugucuccccc

SEQ ID NO: 898362 - RNA, 19 nt, Human
auugcuuccuccuccuucc

SEQ ID NO: 898363 - RNA, 20 nt, Human
caaacaucagcgccaagggc

SEQ ID NO: 898364 - RNA, 21 nt, Human
caagcaaauguccugcggcca

SEQ ID NO: 898365 - RNA, 22 nt, Human
caagcaaauguccugcggccau

SEQ ID NO: 898366 - RNA, 21 nt, Human
caagccuccaggguggggagc

SEQ ID NO: 898367 - RNA, 23 nt, Human
caaugggccucgccaccugaauc

SEQ ID NO: 898368 - RNA, 19 nt, Human
cacacagaacagauccagc

SEQ ID NO: 898369 - RNA, 24 nt, Human
cacagagagcccacuccuccucca

SEQ ID NO: 898370 - RNA, 24 nt, Human
caccccagcccccgguucuccugg

SEQ ID NO: 898371 - RNA, 19 nt, Human
caccccaucuugccucugc

SEQ ID NO: 898372 - RNA, 22 nt, Human
cacuccuccuccagugcuccug

SEQ ID NO: 898373 - RNA, 22 nt, Human
cacugauggaggagacaaggcc

SEQ ID NO: 898374 - RNA, 21 nt, Human
cagagucccaaagggcccaac

SEQ ID NO: 898375 - RNA, 18 nt, Human
cagauccagcacaugcuc

SEQ ID NO: 898376 - RNA, 19 nt, Human
cagcaaaaugacggggcua

SEQ ID NO: 898377 - RNA, 26 nt, Human
cagcaaaaugacggggcuaggacccu

SEQ ID NO: 898378 - RNA, 23 nt, Human
cagcacugugggaggcugaacgg

SEQ ID NO: 898379 - RNA, 24 nt, Human
cagcagcaucagcauagaccuggg

SEQ ID NO: 898380 - RNA, 21 nt, Human
cagcagucucaagccuccagg

SEQ ID NO: 898381 - RNA, 19 nt, Human
cagcaucagcauagaccug

SEQ ID NO: 898382 - RNA, 21 nt, Human
cagcuucagguugggaccagc

SEQ ID NO: 898383 - RNA, 20 nt, Human
caggugcaucucgagcaaug

SEQ ID NO: 898384 - RNA, 25 nt, Human
caggugcucugaugccuaggaaaag

SEQ ID NO: 898385 - RNA, 18 nt, Human
cagugugcaugaggguga

SEQ ID NO: 898386 - RNA, 20 nt, Human
caucaccccagcccccgguu

SEQ ID NO: 898387 - RNA, 24 nt, Human
ccaaggaacacccucauuggccca

SEQ ID NO: 898388 - RNA, 22 nt, Human
ccacagacagacacacagaaca

SEQ ID NO: 898389 - RNA, 20 nt, Human
ccacaggaggagaggagcag

SEQ ID NO: 898390 - RNA, 19 nt, Human
ccacuccaagacuuuggca

SEQ ID NO: 898391 - RNA, 20 nt, Human
ccacuugagacuuggcccug

SEQ ID NO: 898392 - RNA, 19 nt, Human
ccagacagcgccuuugagc

SEQ ID NO: 898393 - RNA, 19 nt, Human
ccagcccuggccuggccuc

SEQ ID NO: 898394 - RNA, 21 nt, Human
ccagccugauggggagaucca

SEQ ID NO: 898395 - RNA, 20 nt, Human
ccaggguggggagcggaggg

SEQ ID NO: 898396 - RNA, 28 nt, Human
cccacagacagacacacagaacagaucc

SEQ ID NO: 898397 - RNA, 19 nt, Human
cccacucccagcgaugaca

SEQ ID NO: 898398 - RNA, 21 nt, Human
cccagcaccuggucaccccuc

SEQ ID NO: 898399 - RNA, 19 nt, Human
cccagccugauggggagau

SEQ ID NO: 898400 - RNA, 19 nt, Human
ccccacccaggccugcuga

SEQ ID NO: 898401 - RNA, 21 nt, Human
ccccauaaacacucccccagg

SEQ ID NO: 898402 - RNA, 21 nt, Human
ccccgauucucugaaaggccc

SEQ ID NO: 898403 - RNA, 18 nt, Human
ccccgccccacccgugcc

SEQ ID NO: 898404 - RNA, 19 nt, Human
ccccgccccacccgugccc

SEQ ID NO: 898405 - RNA, 19 nt, Human
ccccgccccacccgugccc

SEQ ID NO: 898406 - RNA, 19 nt, Human
ccccucccauccauagcac

SEQ ID NO: 898407 - RNA, 22 nt, Human
ccccuucucuuuucgggguccc

SEQ ID NO: 898408 - RNA, 18 nt, Human
cccggccccgccccaccc

SEQ ID NO: 898409 - RNA, 24 nt, Human
cccucccugcccuucagcugccuc

SEQ ID NO: 898410 - RNA, 19 nt, Human
cccuccugcacauacucac

SEQ ID NO: 898411 - RNA, 21 nt, Human
cccuguguccacaccccacuc

SEQ ID NO: 898412 - RNA, 23 nt, Human
cccuguguccacaccccacucca

SEQ ID NO: 898413 - RNA, 23 nt, Human
ccgcuugcucaucccaggaaagg

SEQ ID NO: 898414 - RNA, 20 nt, Human
ccuaaguugacaggcugucc

SEQ ID NO: 898415 - RNA, 21 nt, Human
ccuccccuccccccacccaca

SEQ ID NO: 898416 - RNA, 19 nt, Human
ccuccuccuuccugcaguc

SEQ ID NO: 898417 - RNA, 19 nt, Human
ccucgcucuccccuucucu

SEQ ID NO: 898418 - RNA, 19 nt, Human
ccucucagccauccauccu

SEQ ID NO: 898419 - RNA, 20 nt, Human
ccuggcuggagacagauggu

SEQ ID NO: 898420 - RNA, 19 nt, Human
ccuuacccaucaccccagc

SEQ ID NO: 898421 - RNA, 18 nt, Human
ccuuccugcuccuucagg

SEQ ID NO: 898422 - RNA, 22 nt, Human
cgaugacacuggaucacuuccc

SEQ ID NO: 898423 - RNA, 25 nt, Human
cgccaagggcgguuggaucccugcc

SEQ ID NO: 898424 - RNA, 26 nt, Human
cgccgucccaugcuccaguccccggc

SEQ ID NO: 898425 - RNA, 21 nt, Human
cggaaucuuuggaaguaacau

SEQ ID NO: 898426 - RNA, 22 nt, Human
cguuagaaauucuaauucuuag

SEQ ID NO: 898427 - RNA, 23 nt, Human
cuccagcaccgagcccaggguac

SEQ ID NO: 898428 - RNA, 22 nt, Human
cuccagugccccggggcaagcu

SEQ ID NO: 898429 - RNA, 19 nt, Human
cucccugcccuucagcugc

SEQ ID NO: 898430 - RNA, 19 nt, Human
cucccuguugcuaucuuuc

SEQ ID NO: 898431 - RNA, 19 nt, Human
cuccuccagcaccgagccc

SEQ ID NO: 898432 - RNA, 18 nt, Human
cucucccucccugagcug

SEQ ID NO: 898433 - RNA, 18 nt, Human
cucucuguggcuccgugg

SEQ ID NO: 898434 - RNA, 18 nt, Human
cugaaaggccccuucccc

SEQ ID NO: 898435 - RNA, 24 nt, Human
cugccacaaugcaaggucaccagc

SEQ ID NO: 898436 - RNA, 20 nt, Human
cugcugagaguucagccagg

SEQ ID NO: 898437 - RNA, 19 nt, Human
cuggccccaccccacccug

SEQ ID NO: 898438 - RNA, 21 nt, Human
cuuaccuuacugccaggacuc

SEQ ID NO: 898439 - RNA, 19 nt, Human
cuucccuccccucccccca

SEQ ID NO: 898440 - RNA, 21 nt, Human
cuugaucuggggccacacuga

SEQ ID NO: 898441 - RNA, 19 nt, Human
cuugccucugccuggcggg

SEQ ID NO: 898442 - RNA, 22 nt, Human
cuuggcccuggccccacuuggc

SEQ ID NO: 898443 - RNA, 19 nt, Human
gaaccccuggucugggcaa

SEQ ID NO: 898444 - RNA, 21 nt, Human
gaagaugcuacgcccuccucc

SEQ ID NO: 898445 - RNA, 19 nt, Human
gaaggcacugugaccuugg

SEQ ID NO: 898446 - RNA, 19 nt, Human
gaccagcacuugggacccu

SEQ ID NO: 898447 - RNA, 23 nt, Human
gagagcagccaggcuacugggga

SEQ ID NO: 898448 - RNA, 21 nt, Human
gagcgcuggugggcaggggcg

SEQ ID NO: 898449 - RNA, 21 nt, Human
gaggcugaacggcacacggug

SEQ ID NO: 898450 - RNA, 19 nt, Human
gaggcugcacagagagccc

SEQ ID NO: 898451 - RNA, 23 nt, Human
gagugacugacgcaggcccugug

SEQ ID NO: 898452 - RNA, 24 nt, Human
gaugaggacccagcuauaucuucc

SEQ ID NO: 898453 - RNA, 25 nt, Human
gcaagagugggaggccagcgcacuu

SEQ ID NO: 898454 - RNA, 22 nt, Human
gcacacgguggguguccauugg

SEQ ID NO: 898455 - RNA, 24 nt, Human
gcacacgguggguguccauuggug

SEQ ID NO: 898456 - RNA, 18 nt, Human
gcagcagcaucagcauag

SEQ ID NO: 898457 - RNA, 19 nt, Human
gcauggcaagagugggagg

SEQ ID NO: 898458 - RNA, 23 nt, Human
gcccacuccuccuccagugcucc

SEQ ID NO: 898459 - RNA, 21 nt, Human
gcgcggagcgcuggugggcag

SEQ ID NO: 898460 - RNA, 19 nt, Human
gcggcgccauccagauccg

SEQ ID NO: 898461 - RNA, 24 nt, Human
gcugaagggcagaggcagccucca

SEQ ID NO: 898462 - RNA, 18 nt, Human
gcugagaguucagccagg

SEQ ID NO: 898463 - RNA, 21 nt, Human
gcugccuccguccccauaaac

SEQ ID NO: 898464 - RNA, 23 nt, Human
gcuggagacagauggucaaucug

SEQ ID NO: 898465 - RNA, 22 nt, Human
ggaaagggaaggggggaagggg

SEQ ID NO: 898466 - RNA, 23 nt, Human
ggaaggggggaagggggggaagg

SEQ ID NO: 898467 - RNA, 25 nt, Human
ggaccuggcccuuuggggucugggc

SEQ ID NO: 898468 - RNA, 20 nt, Human
ggagacaaggcccccggcag

SEQ ID NO: 898469 - RNA, 18 nt, Human
ggagcgcuggugggcagg

SEQ ID NO: 898470 - RNA, 21 nt, Human
ggaggagaggagcaggagggg

SEQ ID NO: 898471 - RNA, 21 nt, Human
ggcaggggcgaaagguggggg

SEQ ID NO: 898472 - RNA, 18 nt, Human
ggccccacccaggccugc

SEQ ID NO: 898473 - RNA, 18 nt, Human
ggccccaccccacccugc

SEQ ID NO: 898474 - RNA, 20 nt, Human
ggcuucucagccccacccaa

SEQ ID NO: 898475 - RNA, 23 nt, Human
gggcagaguggggacagguuucu

SEQ ID NO: 898476 - RNA, 23 nt, Human
gggcaggggcgaaaggugggggg

SEQ ID NO: 898477 - RNA, 19 nt, Human
ggguggccuggcuggagac

SEQ ID NO: 898478 - RNA, 22 nt, Human
ggugggcuguaaccagauggcu

SEQ ID NO: 898479 - RNA, 24 nt, Human
gguuggagugugaguaggaccugg

SEQ ID NO: 898480 - RNA, 21 nt, Human
gguuugggaggaaaucuguua

SEQ ID NO: 898481 - RNA, 23 nt, Human
gugaggcugcacagagagcccac

SEQ ID NO: 898482 - RNA, 18 nt, Human
gugcccccagugccugcu

SEQ ID NO: 898483 - RNA, 24 nt, Human
gugccuuggugauggugccagcug

SEQ ID NO: 898484 - RNA, 19 nt, Human
gugggggggcaucaccaug

SEQ ID NO: 898485 - RNA, 24 nt, Human
guguccacaccccacuccagccug

SEQ ID NO: 898486 - RNA, 21 nt, Human
guuaggguggaggaccacggg

SEQ ID NO: 898487 - RNA, 20 nt, Human
guuccuucacuggcaugugg

SEQ ID NO: 898488 - RNA, 23 nt, Human
uaaguugacaggcuguccacacu

SEQ ID NO: 898489 - RNA, 19 nt, Human
uaccuuacugccaggacuc

SEQ ID NO: 898490 - RNA, 23 nt, Human
uacgccaagguaagcaaagcccu

SEQ ID NO: 898491 - RNA, 21 nt, Human
uacgcccuccuccagcaccga

SEQ ID NO: 898492 - RNA, 18 nt, Human
uagaaugaccuccagaag

SEQ ID NO: 898493 - RNA, 18 nt, Human
uauuagcuucacagagug

SEQ ID NO: 898494 - RNA, 23 nt, Human
ucacagagucccaaagggcccaa

SEQ ID NO: 898495 - RNA, 19 nt, Human
ucagcacacgacaaggggc

SEQ ID NO: 898496 - RNA, 21 nt, Human
ucaggcgcgccgucccaugcu

SEQ ID NO: 898497 - RNA, 19 nt, Human
uccagauccgggagaaccc

SEQ ID NO: 898498 - RNA, 23 nt, Human
uccagugcuccugugaucuaguc

SEQ ID NO: 898499 - RNA, 21 nt, Human
ucccagaggagccagcagggg

SEQ ID NO: 898500 - RNA, 22 nt, Human
ucccagaggcuccacugaugga

SEQ ID NO: 898501 - RNA, 25 nt, Human
ucccagcgaugacacugggguaccc

SEQ ID NO: 898502 - RNA, 21 nt, Human
ucccaugacuugaucuggggc

SEQ ID NO: 898503 - RNA, 22 nt, Human
ucccaugacuugaucuggggcc

SEQ ID NO: 898504 - RNA, 24 nt, Human
uccccauaaacacucccccaggau

SEQ ID NO: 898505 - RNA, 23 nt, Human
ucccccaggaucccugccaccca

SEQ ID NO: 898506 - RNA, 28 nt, Human
uccccccacccacagacagacacacaga

SEQ ID NO: 898507 - RNA, 23 nt, Human
ucccuugggaccaccugaccagg

SEQ ID NO: 898508 - RNA, 19 nt, Human
uccgaggugucucccccuc

SEQ ID NO: 898509 - RNA, 19 nt, Human
uccucaggauggcaagaac

SEQ ID NO: 898510 - RNA, 20 nt, Human
uccucuccucaagagggccc

SEQ ID NO: 898511 - RNA, 25 nt, Human
uccugcggagccauagccagagaug

SEQ ID NO: 898512 - RNA, 20 nt, Human
uccuuacccaucaccccagc

SEQ ID NO: 898513 - RNA, 25 nt, Human
uccuuccccuuccugcuccuucagg

SEQ ID NO: 898514 - RNA, 21 nt, Human
ucggggucccaggccuccuuc

SEQ ID NO: 898515 - RNA, 25 nt, Human
ucuccccuucucuuuucgggguccc

SEQ ID NO: 898516 - RNA, 21 nt, Human
ucucucuguggcuccguggca

SEQ ID NO: 898517 - RNA, 19 nt, Human
ucugaaaggccccuucccc

SEQ ID NO: 898518 - RNA, 18 nt, Human
ucugacaggugaggcuga

SEQ ID NO: 898519 - RNA, 25 nt, Human
ucuggcaagaacaguagggaccaga

SEQ ID NO: 898520 - RNA, 23 nt, Human
ucuggccccaccccacccugcug

SEQ ID NO: 898521 - RNA, 20 nt, Human
ugaacuucaagguccuuuga

SEQ ID NO: 898522 - RNA, 18 nt, Human
ugaagggcagaggcagcc

SEQ ID NO: 898523 - RNA, 22 nt, Human
ugaagggcagaggcagccucca

SEQ ID NO: 898524 - RNA, 21 nt, Human
ugaauccaucccuggugcagg

SEQ ID NO: 898525 - RNA, 19 nt, Human
ugacaggcuguccacacug

SEQ ID NO: 898526 - RNA, 18 nt, Human
ugaccagguggccuggga

SEQ ID NO: 898527 - RNA, 22 nt, Human
ugagcaaagcugaagggcagag

SEQ ID NO: 898528 - RNA, 18 nt, Human
ugaggagagcagccaggc

SEQ ID NO: 898529 - RNA, 24 nt, Human
ugaucuagucacuccacagcuuca

SEQ ID NO: 898530 - RNA, 19 nt, Human
ugaugagggaggcauggcc

SEQ ID NO: 898531 - RNA, 18 nt, Human
ugcaggaggggagugacu

SEQ ID NO: 898532 - RNA, 19 nt, Human
ugcaggaggggagugacug

SEQ ID NO: 898533 - RNA, 21 nt, Human
ugcaugagggugaaaugaagu

SEQ ID NO: 898534 - RNA, 20 nt, Human
ugccaaggauggggaacagg

SEQ ID NO: 898535 - RNA, 19 nt, Human
ugccaggaaggccgggccc

SEQ ID NO: 898536 - RNA, 21 nt, Human
ugcccacaggccucggggacc

SEQ ID NO: 898537 - RNA, 20 nt, Human
ugcgcggagcgcuggugggc

SEQ ID NO: 898538 - RNA, 23 nt, Human
ugcugagaguucagccaggggag

SEQ ID NO: 898539 - RNA, 25 nt, Human
uggaaagggguggccuggcuggaga

SEQ ID NO: 898540 - RNA, 22 nt, Human
uggaaguaacauuucugucucc

SEQ ID NO: 898541 - RNA, 20 nt, Human
uggacaacucugacuccagu

SEQ ID NO: 898542 - RNA, 22 nt, Human
uggagagggaagcccugagccc

SEQ ID NO: 898543 - RNA, 24 nt, Human
uggauggaccccuugcccuugugg

SEQ ID NO: 898544 - RNA, 23 nt, Human
uggcaagaacaguagggaccaga

SEQ ID NO: 898545 - RNA, 19 nt, Human
uggcaagagugggaggcca

SEQ ID NO: 898546 - RNA, 19 nt, Human
uggcagaagagggaauuuu

SEQ ID NO: 898547 - RNA, 21 nt, Human
uggcagcuggccauucugagg

SEQ ID NO: 898548 - RNA, 21 nt, Human
uggccuggcuggagacagaug

SEQ ID NO: 898549 - RNA, 23 nt, Human
uggccuuagugugggaggaccac

SEQ ID NO: 898550 - RNA, 25 nt, Human
uggcuucucagccccacccaacucu

SEQ ID NO: 898551 - RNA, 19 nt, Human
ugggaccaccugaccaggu

SEQ ID NO: 898552 - RNA, 23 nt, Human
ugggacccuuucucugccacuug

SEQ ID NO: 898553 - RNA, 19 nt, Human
ugggaggccagcgcacuuc

SEQ ID NO: 898554 - RNA, 25 nt, Human
ugggcaggggcgaaagguggggggu

SEQ ID NO: 898555 - RNA, 18 nt, Human
ugggcccuggagcagcag

SEQ ID NO: 898556 - RNA, 21 nt, Human
ugggcugcuccagugccagca

SEQ ID NO: 898557 - RNA, 20 nt, Human
uggggagggcgcccagggcc

SEQ ID NO: 898558 - RNA, 24 nt, Human
uggggcagaggugacgucuucuua

SEQ ID NO: 898559 - RNA, 18 nt, Human
uggggccacacugaucgg

SEQ ID NO: 898560 - RNA, 21 nt, Human
ugggggggcaucaccaugggg

SEQ ID NO: 898561 - RNA, 18 nt, Human
uggguaggacccagaaau

SEQ ID NO: 898562 - RNA, 26 nt, Human
uggugggcaggggcgaaagguggggg

SEQ ID NO: 898563 - RNA, 21 nt, Human
uggugggggggcaucaccaug

SEQ ID NO: 898564 - RNA, 23 nt, Human
ugugaguaggaccuggcccuuug

SEQ ID NO: 898565 - RNA, 18 nt, Human
ugugccuuggugauggug

SEQ ID NO: 898566 - RNA, 24 nt, Human
ugugggaggcugaacggcacacgg

SEQ ID NO: 898567 - RNA, 20 nt, Human
ugugggggaaacaagcuggg

SEQ ID NO: 898568 - RNA, 26 nt, Human
ugugggggaaacaagcugggucauuu

SEQ ID NO: 898569 - RNA, 19 nt, Human
uguugagggaccccucucc

SEQ ID NO: 898570 - RNA, 20 nt, Human
uguugagggaccccucuccg

SEQ ID NO: 898571 - RNA, 22 nt, Human
uuacagacccaggaugaggacc

SEQ ID NO: 898572 - RNA, 22 nt, Human
uuagaaauguggguaggaccca

SEQ ID NO: 898573 - RNA, 23 nt, Human
uuaggccccacccaggccugcug

SEQ ID NO: 898574 - RNA, 18 nt, Human
uucacagagugcuaggag

SEQ ID NO: 898575 - RNA, 22 nt, Human
uucaugucauagaggaagaaac

SEQ ID NO: 898576 - RNA, 24 nt, Human
uucucuuuucggggucccaggccu

SEQ ID NO: 898577 - RNA, 21 nt, Human
uucuugaagaugcuacgcccu

SEQ ID NO: 898578 - RNA, 23 nt, Human
uugaagaugcuacgcccuccucc

SEQ ID NO: 898579 - RNA, 20 nt, Human
uugagggaccccucuccggg

SEQ ID NO: 898580 - RNA, 21 nt, Human
uuucacaagacuucccucccc

SEQ ID NO: 898581 - RNA, 20 nt, Human
aaagaaguuucuuacugcuu

SEQ ID NO: 898582 - RNA, 21 nt, Human
accuaggcuggagugcagagc

SEQ ID NO: 898583 - RNA, 25 nt, Human
acucugucaccuaggcuggagugca

SEQ ID NO: 898584 - RNA, 23 nt, Human
cacucugucaccuaggcuggagu

SEQ ID NO: 898585 - RNA, 24 nt, Human
cacucugucaccuaggcuggagug

SEQ ID NO: 898586 - RNA, 20 nt, Human
ccagaguggacgauguagga

SEQ ID NO: 898587 - RNA, 19 nt, Human
ccuaggcuggagugcagag

SEQ ID NO: 898588 - RNA, 22 nt, Human
cgagguggagucucacucuguc

SEQ ID NO: 898589 - RNA, 24 nt, Human
cucacucugucaccuaggcuggag

SEQ ID NO: 898590 - RNA, 24 nt, Human
gcuggagugcagagcgagauucug

SEQ ID NO: 898591 - RNA, 26 nt, Human
gggaggcagcuuuauggaucuuucua

SEQ ID NO: 898592 - RNA, 18 nt, Human
ucaccuaggcuggagugc

SEQ ID NO: 898593 - RNA, 24 nt, Human
ucacucugucaccuaggcuggagu

SEQ ID NO: 898594 - RNA, 27 nt, Human
ucaugaauuuuucuucuaaaauaagua

SEQ ID NO: 898595 - RNA, 22 nt, Human
uccgagguggagucucacucug

SEQ ID NO: 898596 - RNA, 22 nt, Human
uccggacuuguccccgggaggc

SEQ ID NO: 898597 - RNA, 23 nt, Human
ucucacucugucaccuaggcugg

SEQ ID NO: 898598 - RNA, 24 nt, Human
ucucacucugucaccuaggcugga

SEQ ID NO: 898599 - RNA, 24 nt, Human
ucugucaccuaggcuggagugcag

SEQ ID NO: 898600 - RNA, 22 nt, Human
ugguaagauuuucaacauaagg

SEQ ID NO: 898601 - RNA, 20 nt, Human
ugucaccuaggcuggagugc

SEQ ID NO: 898602 - RNA, 21 nt, Human
uguccccgggaggcagcuuua

SEQ ID NO: 898603 - RNA, 22 nt, Human
uugacacagacuauugguaaga

SEQ ID NO: 898604 - RNA, 25 nt, Human
aaaaaaaaaaaacaaaacagauugu

SEQ ID NO: 898605 - RNA, 26 nt, Human
aaaauaccacacugcauauuugaaac

SEQ ID NO: 898606 - RNA, 20 nt, Human
aaacaaaugugacguugccu

SEQ ID NO: 898607 - RNA, 21 nt, Human
aaacaaaugugacguugccua

SEQ ID NO: 898608 - RNA, 24 nt, Human
aaagaagcacaauagaagaaauag

SEQ ID NO: 898609 - RNA, 18 nt, Human
aaaguaaacaaaauacca

SEQ ID NO: 898610 - RNA, 24 nt, Human
aaucccuggucccuucuccacccc

SEQ ID NO: 898611 - RNA, 22 nt, Human
acacugcauauuugaaacaaac

SEQ ID NO: 898612 - RNA, 22 nt, Human
accacacugcauauuugaaaca

SEQ ID NO: 898613 - RNA, 20 nt, Human
accugguccucgucgcccgc

SEQ ID NO: 898614 - RNA, 19 nt, Human
agaagaaauagacgcaaaa

SEQ ID NO: 898615 - RNA, 20 nt, Human
agcaucugugacagcccaca

SEQ ID NO: 898616 - RNA, 21 nt, Human
aggaagcagucuuuauuugau

SEQ ID NO: 898617 - RNA, 19 nt, Human
aggaggccguaaccugguc

SEQ ID NO: 898618 - RNA, 19 nt, Human
aucacacuuuacaaaggcg

SEQ ID NO: 898619 - RNA, 22 nt, Human
aucacacuuuacaaaggcggcu

SEQ ID NO: 898620 - RNA, 20 nt, Human
auuauuuucccuuuugaaug

SEQ ID NO: 898621 - RNA, 23 nt, Human
auuccuggggagaaagucaagga

SEQ ID NO: 898622 - RNA, 22 nt, Human
caaaaaaaaaaaacaaaacaga

SEQ ID NO: 898623 - RNA, 24 nt, Human
caaaagagaguuaacuacuaaagg

SEQ ID NO: 898624 - RNA, 22 nt, Human
caaagaagcacaauagaagaaa

SEQ ID NO: 898625 - RNA, 24 nt, Human
caaagaagcacaauagaagaaaua

SEQ ID NO: 898626 - RNA, 19 nt, Human
caagaacaagccucagguu

SEQ ID NO: 898627 - RNA, 21 nt, Human
caagaacaagccucagguucc

SEQ ID NO: 898628 - RNA, 19 nt, Human
caauagaagaaauagacgc

SEQ ID NO: 898629 - RNA, 20 nt, Human
cacagcaucugugacagccc

SEQ ID NO: 898630 - RNA, 20 nt, Human
cacccugacucugcaauaac

SEQ ID NO: 898631 - RNA, 22 nt, Human
cacccugacucugcaauaacuu

SEQ ID NO: 898632 - RNA, 21 nt, Human
cagaaauuaccuaugagucac

SEQ ID NO: 898633 - RNA, 20 nt, Human
cagcacagauuacccauuuc

SEQ ID NO: 898634 - RNA, 23 nt, Human
cagggagcagccuggaugggccc

SEQ ID NO: 898635 - RNA, 22 nt, Human
cagugcccuuggcuguauuccc

SEQ ID NO: 898636 - RNA, 21 nt, Human
cauagaucacacuuuacaaag

SEQ ID NO: 898637 - RNA, 20 nt, Human
ccccgcgccccgcggcguuc

SEQ ID NO: 898638 - RNA, 24 nt, Human
cccgccccaagucucggccccggc

SEQ ID NO: 898639 - RNA, 21 nt, Human
cccuuggcuguauuccccagg

SEQ ID NO: 898640 - RNA, 24 nt, Human
ccgcgcccaccccgcgccccgcgg

SEQ ID NO: 898641 - RNA, 22 nt, Human
ccgcggcguucccgcccgcgcu

SEQ ID NO: 898642 - RNA, 18 nt, Human
ccucacugcagccauucc

SEQ ID NO: 898643 - RNA, 23 nt, Human
ccucacugcagccauuccaagaa

SEQ ID NO: 898644 - RNA, 19 nt, Human
ccuuagcccuagggcccug

SEQ ID NO: 898645 - RNA, 21 nt, Human
cggccccggcggggucucccg

SEQ ID NO: 898646 - RNA, 20 nt, Human
cggccggcucagggaccagg

SEQ ID NO: 898647 - RNA, 22 nt, Human
cggggucgccggccggcucagg

SEQ ID NO: 898648 - RNA, 20 nt, Human
cggggucucccgcgcccgcc

SEQ ID NO: 898649 - RNA, 20 nt, Human
gaaaaucugguuaaaaugua

SEQ ID NO: 898650 - RNA, 18 nt, Human
gaagagccauggagcucc

SEQ ID NO: 898651 - RNA, 19 nt, Human
gagcaagcgagcguagggc

SEQ ID NO: 898652 - RNA, 21 nt, Human
gcccacuucaagaacaagccu

SEQ ID NO: 898653 - RNA, 20 nt, Human
ggaaauccuucacucaugca

SEQ ID NO: 898654 - RNA, 20 nt, Human
ggacaggauuagcugccuuu

SEQ ID NO: 898655 - RNA, 23 nt, Human
ggagcagccuggaugggcccagg

SEQ ID NO: 898656 - RNA, 20 nt, Human
ggcccugguugacacagcau

SEQ ID NO: 898657 - RNA, 18 nt, Human
gggcccugguugacacag

SEQ ID NO: 898658 - RNA, 22 nt, Human
ggucccuucuccaccccaggga

SEQ ID NO: 898659 - RNA, 22 nt, Human
guaaacaaaauaccacacugca

SEQ ID NO: 898660 - RNA, 20 nt, Human
guagaacacaccugguuugg

SEQ ID NO: 898661 - RNA, 21 nt, Human
gugaaauggaauuaaaagcac

SEQ ID NO: 898662 - RNA, 25 nt, Human
gugaacacauauaugaaaaacacug

SEQ ID NO: 898663 - RNA, 18 nt, Human
gugucuacguggaaaucc

SEQ ID NO: 898664 - RNA, 18 nt, Human
gugucuacguggaaaucc

SEQ ID NO: 898665 - RNA, 23 nt, Human
uaaaaaauagauuuauccagaaa

SEQ ID NO: 898666 - RNA, 20 nt, Human
uaaaagcacccugacucugc

SEQ ID NO: 898667 - RNA, 21 nt, Human
uaaggagaucagcacagauua

SEQ ID NO: 898668 - RNA, 24 nt, Human
uaccacacugcauauuugaaacaa

SEQ ID NO: 898669 - RNA, 19 nt, Human
uauacuggccucaugugca

SEQ ID NO: 898670 - RNA, 20 nt, Human
uauccaaaaaaggccugaga

SEQ ID NO: 898671 - RNA, 21 nt, Human
uaucugggaacguuucacugg

SEQ ID NO: 898672 - RNA, 22 nt, Human
ucacuggcaacacuaacuguau

SEQ ID NO: 898673 - RNA, 20 nt, Human
ucagauagauggaggaagaa

SEQ ID NO: 898674 - RNA, 24 nt, Human
ucagcacagauuacccauuuccuc

SEQ ID NO: 898675 - RNA, 19 nt, Human
uccaagaaguaucuuugcu

SEQ ID NO: 898676 - RNA, 24 nt, Human
uccccaaagaagcacaauagaaga

SEQ ID NO: 898677 - RNA, 18 nt, Human
ucccugguucugcaccuc

SEQ ID NO: 898678 - RNA, 23 nt, Human
ucgucgcccgccccaagucucgg

SEQ ID NO: 898679 - RNA, 23 nt, Human
ucuaaaaagcaacguggaaucau

SEQ ID NO: 898680 - RNA, 19 nt, Human
ucuccuccccuuagccugg

SEQ ID NO: 898681 - RNA, 20 nt, Human
ucucuuccuauccccaaaga

SEQ ID NO: 898682 - RNA, 26 nt, Human
ugaaaaacacugcaacagguugacac

SEQ ID NO: 898683 - RNA, 20 nt, Human
ugaaacaaacaaaugugacg

SEQ ID NO: 898684 - RNA, 22 nt, Human
ugacaaaaaaaaaaaacaaaac

SEQ ID NO: 898685 - RNA, 25 nt, Human
ugacaaaaaaaaaaaacaaaacaga

SEQ ID NO: 898686 - RNA, 21 nt, Human
ugacaauguccuagaaacccu

SEQ ID NO: 898687 - RNA, 22 nt, Human
ugaccugcaagccaauacagcu

SEQ ID NO: 898688 - RNA, 19 nt, Human
ugagucacuuuugugagcc

SEQ ID NO: 898689 - RNA, 18 nt, Human
ugcaaauaguuaacaaua

SEQ ID NO: 898690 - RNA, 21 nt, Human
ugcaugcacgcaaggugcagg

SEQ ID NO: 898691 - RNA, 19 nt, Human
ugccugcugcaugcacgca

SEQ ID NO: 898692 - RNA, 22 nt, Human
ugcugcaugcacgcaaggugca

SEQ ID NO: 898693 - RNA, 18 nt, Human
uggaaauccuucacucau

SEQ ID NO: 898694 - RNA, 19 nt, Human
uggaaggaauggaaucaga

SEQ ID NO: 898695 - RNA, 21 nt, Human
uggagaauccugcucucaaaa

SEQ ID NO: 898696 - RNA, 24 nt, Human
ugggaguuguuuuuauaucuuuua

SEQ ID NO: 898697 - RNA, 20 nt, Human
ugggcccaggagucccuggg

SEQ ID NO: 898698 - RNA, 20 nt, Human
uggggagaaagucaaggacc

SEQ ID NO: 898699 - RNA, 26 nt, Human
uggucagacaaugacaaaaaaaaaaa

SEQ ID NO: 898700 - RNA, 21 nt, Human
ugucuaaagcugguaguaaaa

SEQ ID NO: 898701 - RNA, 19 nt, Human
ugugcagaaggaauuuugg

SEQ ID NO: 898702 - RNA, 20 nt, Human
ugugcagaaggaauuuuggu

SEQ ID NO: 898703 - RNA, 22 nt, Human
ugugcagaaggaauuuugguca

SEQ ID NO: 898704 - RNA, 21 nt, Human
ugugcagaaggaauuuugguu

SEQ ID NO: 898705 - RNA, 19 nt, Human
ugugcagaggcucacaggc

SEQ ID NO: 898706 - RNA, 20 nt, Human
uuaccagguuauuucagugc

SEQ ID NO: 898707 - RNA, 25 nt, Human
uucacuggcaacacuaacuguauga

SEQ ID NO: 898708 - RNA, 19 nt, Human
uucuauauguaucuccucu

SEQ ID NO: 898709 - RNA, 21 nt, Human
uucuuuguaucugggaacguu

SEQ ID NO: 898710 - RNA, 24 nt, Human
uuggucagacaaugacaaaaaaaa

SEQ ID NO: 898711 - RNA, 24 nt, Human
uuugacaaaagagaguuaacuacu

SEQ ID NO: 898712 - RNA, 23 nt, Human
uuuuaagugaauuccuggggaga

SEQ ID NO: 898713 - RNA, 24 nt, Human
aaaaacaaaacaagccaaagaaga

SEQ ID NO: 898714 - RNA, 22 nt, Human
aaacaaaacaagccaaagaaga

SEQ ID NO: 898715 - RNA, 21 nt, Human
aaacaaauaugguuauaacac

SEQ ID NO: 898716 - RNA, 23 nt, Human
aaagaagaaagacucuaagagaa

SEQ ID NO: 898717 - RNA, 19 nt, Human
aaagaggcaaaaaucccug

SEQ ID NO: 898718 - RNA, 25 nt, Human
aaagaggcaaaaaucccugcccuuu

SEQ ID NO: 898719 - RNA, 23 nt, Human
aaauaugguuauaacacacauac

SEQ ID NO: 898720 - RNA, 21 nt, Human
aacaagccaaagaagaaagac

SEQ ID NO: 898721 - RNA, 25 nt, Human
aacagaagacaaauugaccacagaa

SEQ ID NO: 898722 - RNA, 22 nt, Human
aagaagaaagacucuaagagaa

SEQ ID NO: 898723 - RNA, 22 nt, Human
aauacagacuuggugacugccu

SEQ ID NO: 898724 - RNA, 18 nt, Human
aaucacaacagaagacaa

SEQ ID NO: 898725 - RNA, 21 nt, Human
acagaagacaaauugaccaca

SEQ ID NO: 898726 - RNA, 22 nt, Human
agaaaaacaaaacaagccaaag

SEQ ID NO: 898727 - RNA, 24 nt, Human
agaaaaacaaaacaagccaaagaa

SEQ ID NO: 898728 - RNA, 21 nt, Human
agaagacaaauugaccacaga

SEQ ID NO: 898729 - RNA, 23 nt, Human
agacaaauugaccacagaauaag

SEQ ID NO: 898730 - RNA, 22 nt, Human
aggaacaacagaagaauucuaa

SEQ ID NO: 898731 - RNA, 21 nt, Human
aggauagaaaaacaaaacaag

SEQ ID NO: 898732 - RNA, 20 nt, Human
auaauaauaaaagcaguacc

SEQ ID NO: 898733 - RNA, 19 nt, Human
augaaacagagaaauggga

SEQ ID NO: 898734 - RNA, 23 nt, Human
augaaacagagaaaugggaggau

SEQ ID NO: 898735 - RNA, 22 nt, Human
auucaucuagcuccuggaaaac

SEQ ID NO: 898736 - RNA, 20 nt, Human
auuugcagacuuggaggcac

SEQ ID NO: 898737 - RNA, 21 nt, Human
caauccaguauaagaaguaaa

SEQ ID NO: 898738 - RNA, 26 nt, Human
caaugaacaucuucacucaauuaaac

SEQ ID NO: 898739 - RNA, 20 nt, Human
cacaacagaagacaaauuga

SEQ ID NO: 898740 - RNA, 26 nt, Human
caccaggauagaaaaacaaaacaagc

SEQ ID NO: 898741 - RNA, 19 nt, Human
cagaagacaaauugaccac

SEQ ID NO: 898742 - RNA, 19 nt, Human
cauucaaugaacaucuuca

SEQ ID NO: 898743 - RNA, 20 nt, Human
cauuccuagacaaacaacaa

SEQ ID NO: 898744 - RNA, 21 nt, Human
ccaccaggauagaaaaacaaa

SEQ ID NO: 898745 - RNA, 24 nt, Human
ccuacaauuuaaacauuuuuccac

SEQ ID NO: 898746 - RNA, 19 nt, Human
ccuagacaaacaacaacua

SEQ ID NO: 898747 - RNA, 20 nt, Human
gaaacagagaaaugggagga

SEQ ID NO: 898748 - RNA, 24 nt, Human
gauaagaaggacuuuuagaggaaa

SEQ ID NO: 898749 - RNA, 19 nt, Human
gcaugguaaaauuagcuua

SEQ ID NO: 898750 - RNA, 22 nt, Human
uacauuccuagacaaacaacaa

SEQ ID NO: 898751 - RNA, 22 nt, Human
uagaaaaacaaaacaagccaaa

SEQ ID NO: 898752 - RNA, 19 nt, Human
uauaacacacauacaucua

SEQ ID NO: 898753 - RNA, 22 nt, Human
uauguaaaaaucacaacagaag

SEQ ID NO: 898754 - RNA, 20 nt, Human
ucaaaaagauauuacccaaa

SEQ ID NO: 898755 - RNA, 21 nt, Human
uccaccaggauagaaaaacaa

SEQ ID NO: 898756 - RNA, 22 nt, Human
uccaccaggauagaaaaacaaa

SEQ ID NO: 898757 - RNA, 26 nt, Human
uccaccaggauagaaaaacaaaacaa

SEQ ID NO: 898758 - RNA, 24 nt, Human
ucgaaugugugugauccauagaag

SEQ ID NO: 898759 - RNA, 21 nt, Human
ucuuacauuccuagacaaaca

SEQ ID NO: 898760 - RNA, 29 nt, Human
ucuuacauuccuagacaaacaacaacuag

SEQ ID NO: 898761 - RNA, 22 nt, Human
ugaaacagagaaaugggaggau

SEQ ID NO: 898762 - RNA, 23 nt, Human
ugaaacagagaaaugggaggaug

SEQ ID NO: 898763 - RNA, 22 nt, Human
ugaacaaaagaggcaaaaaucc

SEQ ID NO: 898764 - RNA, 19 nt, Human
ugaacaucuucacucaauu

SEQ ID NO: 898765 - RNA, 21 nt, Human
ugaccgagaagacagcugaau

SEQ ID NO: 898766 - RNA, 22 nt, Human
ugggaggauggauuuacgaagg

SEQ ID NO: 898767 - RNA, 18 nt, Human
ugggcaaaauggguuguu

SEQ ID NO: 898768 - RNA, 20 nt, Human
uguaaagaaaaggaggagau

SEQ ID NO: 898769 - RNA, 22 nt, Human
uucccuccaaaagaaauaauuu

SEQ ID NO: 898770 - RNA, 18 nt, Human
uuccuagacaaacaacaa

SEQ ID NO: 898771 - RNA, 18 nt, Human
uugaccacagaauaagua

SEQ ID NO: 898772 - RNA, 23 nt, Human
uuuaaaauauuguccuacaauuu

SEQ ID NO: 898773 - RNA, 27 nt, Human
uuuuuuuuuuuuauauauaacgucuca

SEQ ID NO: 898774 - RNA, 18 nt, Human
aaccagauguuagacugc

SEQ ID NO: 898775 - RNA, 20 nt, Human
aagagauggcaugugaccau

SEQ ID NO: 898776 - RNA, 24 nt, Human
accauguacuucugcuagaaggau

SEQ ID NO: 898777 - RNA, 18 nt, Human
agacaaaaaauugaaagg

SEQ ID NO: 898778 - RNA, 20 nt, Human
agacaaaaaauugaaagggu

SEQ ID NO: 898779 - RNA, 21 nt, Human
caaaucggacacuuauaugcc

SEQ ID NO: 898780 - RNA, 24 nt, Human
cacacaaaaauccacucacugagg

SEQ ID NO: 898781 - RNA, 25 nt, Human
cauggaacaaauccacaacaauuga

SEQ ID NO: 898782 - RNA, 22 nt, Human
ccacaugucuugcauuuuacuu

SEQ ID NO: 898783 - RNA, 18 nt, Human
ccauugguaguaaggaug

SEQ ID NO: 898784 - RNA, 19 nt, Human
cccauugguaguaaggaug

SEQ ID NO: 898785 - RNA, 25 nt, Human
cuagaagcugaaauuggagacgcag

SEQ ID NO: 898786 - RNA, 24 nt, Human
cucaggaagagaagauagcgggga

SEQ ID NO: 898787 - RNA, 26 nt, Human
cucaggaagagaagauagcggggaaa

SEQ ID NO: 898788 - RNA, 27 nt, Human
cugcaaugauguaaccuguaaaggggc

SEQ ID NO: 898789 - RNA, 26 nt, Human
gaagauagcggggaaauaauuccagc

SEQ ID NO: 898790 - RNA, 22 nt, Human
gaaguucuucucaguuccacau

SEQ ID NO: 898791 - RNA, 24 nt, Human
uaaguccacagagaucacucagcu

SEQ ID NO: 898792 - RNA, 19 nt, Human
uagaagcugaaauuggaga

SEQ ID NO: 898793 - RNA, 22 nt, Human
ucaaaugcacacaaaaauccac

SEQ ID NO: 898794 - RNA, 20 nt, Human
ucugucuugcuguucuugau

SEQ ID NO: 898795 - RNA, 21 nt, Human
uggcaaagacaaaaaauugaa

SEQ ID NO: 898796 - RNA, 22 nt, Human
ugguuguccugaggaaaguucu

SEQ ID NO: 898797 - RNA, 22 nt, Human
uucaaccagauguuagacugcu

SEQ ID NO: 898798 - RNA, 20 nt, Human
uuggacuagaagcugaaauu

SEQ ID NO: 898799 - RNA, 22 nt, Human
aaaccugcgacaggauucccga

SEQ ID NO: 898800 - RNA, 21 nt, Human
aaagaaaaagccggcuuuuca

SEQ ID NO: 898801 - RNA, 25 nt, Human
aaugagccugggggaagacaucacc

SEQ ID NO: 898802 - RNA, 19 nt, Human
aaugcaaugugauccuucg

SEQ ID NO: 898803 - RNA, 21 nt, Human
accacgaggauaugaaaggag

SEQ ID NO: 898804 - RNA, 22 nt, Human
accccgcaaccauuuuuggcua

SEQ ID NO: 898805 - RNA, 20 nt, Human
acucaucuuucuucccagcc

SEQ ID NO: 898806 - RNA, 21 nt, Human
agagcuuuauuacacuggugc

SEQ ID NO: 898807 - RNA, 19 nt, Human
agcuaguccucggaucagc

SEQ ID NO: 898808 - RNA, 21 nt, Human
aggacaccacugcccccagga

SEQ ID NO: 898809 - RNA, 19 nt, Human
agggaggcgaagaaguggg

SEQ ID NO: 898810 - RNA, 21 nt, Human
aguggaaaggauuuggagauc

SEQ ID NO: 898811 - RNA, 19 nt, Human
aguuuugcucuucauccau

SEQ ID NO: 898812 - RNA, 20 nt, Human
auucuguauuacuuauagcu

SEQ ID NO: 898813 - RNA, 20 nt, Human
auuuaaguucagaaggcauu

SEQ ID NO: 898814 - RNA, 22 nt, Human
caacuaagaagcuaccuggcgg

SEQ ID NO: 898815 - RNA, 18 nt, Human
caaucguucagucaugga

SEQ ID NO: 898816 - RNA, 20 nt, Human
cacagcacugguacuucagc

SEQ ID NO: 898817 - RNA, 21 nt, Human
cacccaagagagggaggcgaa

SEQ ID NO: 898818 - RNA, 18 nt, Human
cacuggugcuugaagacc

SEQ ID NO: 898819 - RNA, 19 nt, Human
cacuugaguggaaaggauu

SEQ ID NO: 898820 - RNA, 23 nt, Human
cacuuucauccucuaagaggggg

SEQ ID NO: 898821 - RNA, 21 nt, Human
cagcuguaagagugagguccu

SEQ ID NO: 898822 - RNA, 23 nt, Human
caggacaccacugcccccaggau

SEQ ID NO: 898823 - RNA, 21 nt, Human
caggggaaugagccuggggga

SEQ ID NO: 898824 - RNA, 23 nt, Human
cagggguuccuccccgaucaucu

SEQ ID NO: 898825 - RNA, 18 nt, Human
caguucuuugggucuucc

SEQ ID NO: 898826 - RNA, 23 nt, Human
cauucaaucucugcuccacuuga

SEQ ID NO: 898827 - RNA, 20 nt, Human
ccaagagagggaggcgaaga

SEQ ID NO: 898828 - RNA, 19 nt, Human
cccaggacaccacugcccc

SEQ ID NO: 898829 - RNA, 23 nt, Human
cccaggacaccacugcccccagg

SEQ ID NO: 898830 - RNA, 20 nt, Human
cccccaggaugccagacaag

SEQ ID NO: 898831 - RNA, 18 nt, Human
ccuggcucugugcucauc

SEQ ID NO: 898832 - RNA, 21 nt, Human
cgggucauagcagaggcagcu

SEQ ID NO: 898833 - RNA, 23 nt, Human
cgucuuuggccuuugcugggcuu

SEQ ID NO: 898834 - RNA, 24 nt, Human
cuaaagaaaaagccggcuuuucau

SEQ ID NO: 898835 - RNA, 19 nt, Human
cuggcggauguugcgagag

SEQ ID NO: 898836 - RNA, 19 nt, Human
cuugaagaccacuugggaa

SEQ ID NO: 898837 - RNA, 18 nt, Human
cuugauggccacuucaga

SEQ ID NO: 898838 - RNA, 19 nt, Human
cuuggccucgucuuuggcc

SEQ ID NO: 898839 - RNA, 24 nt, Human
cuuggccucgucuuuggccuuugg

SEQ ID NO: 898840 - RNA, 24 nt, Human
cuuuggccuuugcugggcuugaug

SEQ ID NO: 898841 - RNA, 19 nt, Human
gaccccgcaaccauuuuug

SEQ ID NO: 898842 - RNA, 18 nt, Human
gcccgcauccccaguaga

SEQ ID NO: 898843 - RNA, 18 nt, Human
gcucaaugacccaggaca

SEQ ID NO: 898844 - RNA, 18 nt, Human
ggaagacaucaccgucag

SEQ ID NO: 898845 - RNA, 22 nt, Human
ggcauugagacaucuaaagaaa

SEQ ID NO: 898846 - RNA, 21 nt, Human
ggcugucucagagcguagggc

SEQ ID NO: 898847 - RNA, 18 nt, Human
gggaaugagccuggggga

SEQ ID NO: 898848 - RNA, 23 nt, Human
guccuagaguggauuccaaucuc

SEQ ID NO: 898849 - RNA, 22 nt, Human
guccucaguuuugcucuucauc

SEQ ID NO: 898850 - RNA, 21 nt, Human
uaaggacacuguagguuacau

SEQ ID NO: 898851 - RNA, 19 nt, Human
uaugaaaggagccugcaug

SEQ ID NO: 898852 - RNA, 24 nt, Human
uauuucacucaucuuucuucccag

SEQ ID NO: 898853 - RNA, 24 nt, Human
ucagauucuucagaaacuguagga

SEQ ID NO: 898854 - RNA, 18 nt, Human
uccaugcuacagcuugua

SEQ ID NO: 898855 - RNA, 18 nt, Human
uccuagacgcuucagccc

SEQ ID NO: 898856 - RNA, 22 nt, Human
uccuccuuauucuuuggauauu

SEQ ID NO: 898857 - RNA, 19 nt, Human
uccugaggacuguugcuua

SEQ ID NO: 898858 - RNA, 24 nt, Human
ugagaaucaacaucuuuugagagc

SEQ ID NO: 898859 - RNA, 24 nt, Human
ugagacaucuaaagaaaaagccgg

SEQ ID NO: 898860 - RNA, 21 nt, Human
ugauggccacuucagauucuu

SEQ ID NO: 898861 - RNA, 21 nt, Human
ugccaccuagcucaaugaccc

SEQ ID NO: 898862 - RNA, 21 nt, Human
ugcccuagugcaccaacacag

SEQ ID NO: 898863 - RNA, 18 nt, Human
ugcuugaagaccacuugg

SEQ ID NO: 898864 - RNA, 20 nt, Human
uggaaaggauuuggagaucu

SEQ ID NO: 898865 - RNA, 20 nt, Human
uggcaaaaagaugaguaauc

SEQ ID NO: 898866 - RNA, 21 nt, Human
uggugcggccucagucccacu

SEQ ID NO: 898867 - RNA, 22 nt, Human
uggugucauuuaggaggaguuu

SEQ ID NO: 898868 - RNA, 21 nt, Human
uguuuagagucucucucuuuc

SEQ ID NO: 898869 - RNA, 25 nt, Human
uuagagucucucucuuucgucuucu

SEQ ID NO: 898870 - RNA, 19 nt, Human
uucagaaacuguaggaggu

SEQ ID NO: 898871 - RNA, 18 nt, Human
uucaucucuaugugacag

SEQ ID NO: 898872 - RNA, 18 nt, Human
uucuuugggucuuccgaa

SEQ ID NO: 898873 - RNA, 24 nt, Human
uugagagcuuuauuacacuggugg

SEQ ID NO: 898874 - RNA, 20 nt, Human
agccacagcaucugccaacu

SEQ ID NO: 898875 - RNA, 21 nt, Human
caccggcuucccaacguccca

SEQ ID NO: 898876 - RNA, 24 nt, Human
ccagccacagcaucugccaacacc

SEQ ID NO: 898877 - RNA, 22 nt, Human
cgucuggacuccucccagccac

SEQ ID NO: 898878 - RNA, 21 nt, Human
cucccagccacagcaucugcc

SEQ ID NO: 898879 - RNA, 22 nt, Human
cugcccaaaacuccuaagcagg

SEQ ID NO: 898880 - RNA, 22 nt, Human
gaguggaugcccuugccucuuc

SEQ ID NO: 898881 - RNA, 22 nt, Human
gccacagcaucugccaacaccg

SEQ ID NO: 898882 - RNA, 18 nt, Human
ggacuccucccagccaca

SEQ ID NO: 898883 - RNA, 24 nt, Human
uccuaagcaguuguggcucagccc

SEQ ID NO: 898884 - RNA, 21 nt, Human
ucuuucuuuuggugacaagcu

SEQ ID NO: 898885 - RNA, 24 nt, Human
ucuuucuuuuggugacaagcuuuu

SEQ ID NO: 898886 - RNA, 25 nt, Human
ugagauuaaugaaacauagaguguc

SEQ ID NO: 898887 - RNA, 18 nt, Human
ugcccaaaacuccuaagc

SEQ ID NO: 898888 - RNA, 24 nt, Human
ugccucuucuucugggauaucuua

SEQ ID NO: 898889 - RNA, 23 nt, Human
uggaguggaugcccuugccucuu

SEQ ID NO: 898890 - RNA, 18 nt, Human
uuagugguagugccugcu

SEQ ID NO: 898891 - RNA, 22 nt, Human
uuagugguagugccugcucccu

SEQ ID NO: 898892 - RNA, 27 nt, Human
uuuuucgaguccaacuugcugagaaua

SEQ ID NO: 898893 - RNA, 25 nt, Human
uuuuuuuucgaguccaacuugcuga

SEQ ID NO: 898894 - RNA, 18 nt, Human
uuuuuuuuuuucgagucc

SEQ ID NO: 898895 - RNA, 22 nt, Human
uuuuuuuuuuuuuuuuucgagu

SEQ ID NO: 898896 - RNA, 21 nt, Human
uuuuuuuuuuuuuuuuuucgg

SEQ ID NO: 898897 - RNA, 23 nt, Human
caccggcggcaggugcugggcgu

SEQ ID NO: 898898 - RNA, 20 nt, Human
cacuggcccagggaaacaac

SEQ ID NO: 898899 - RNA, 24 nt, Human
cagccucggugcacuggcccaggg

SEQ ID NO: 898900 - RNA, 19 nt, Human
cgaagucagucccccaccg

SEQ ID NO: 898901 - RNA, 23 nt, Human
gcccccuccucucucagugauuc

SEQ ID NO: 898902 - RNA, 18 nt, Human
gcugcccccuccucucuc

SEQ ID NO: 898903 - RNA, 22 nt, Human
ggcggcaggugcugggcguugg

SEQ ID NO: 898904 - RNA, 20 nt, Human
uacugcugauggucucucca

SEQ ID NO: 898905 - RNA, 21 nt, Human
uccgccgaagucaguccccca

SEQ ID NO: 898906 - RNA, 20 nt, Human
ugaaaagagucauaguccgu

SEQ ID NO: 898907 - RNA, 21 nt, Human
ugaaaagagucauaguccguu

SEQ ID NO: 898908 - RNA, 20 nt, Human
uggcccagggaaacaacucc

SEQ ID NO: 898909 - RNA, 20 nt, Human
uguuaagugaaaagcugcuu

SEQ ID NO: 898910 - RNA, 24 nt, Human
uuucuucuugcuuugauguuaagu

SEQ ID NO: 898911 - RNA, 22 nt, Human
uuuuuuuuuuuugaaaagaguc

SEQ ID NO: 898912 - RNA, 18 nt, Human
uuuuuuuuuuuuuuuuug

SEQ ID NO: 898913 - RNA, 18 nt, Human
aaaagacaaauauucuua

SEQ ID NO: 898914 - RNA, 26 nt, Human
aaacaacaaauccaagagcugaagca

SEQ ID NO: 898915 - RNA, 23 nt, Human
aaaggcagggaacaaaagcagag

SEQ ID NO: 898916 - RNA, 24 nt, Human
aaaggcagggaacaaaagcagagg

SEQ ID NO: 898917 - RNA, 24 nt, Human
aaaucacagacagcaaucuggaau

SEQ ID NO: 898918 - RNA, 22 nt, Human
aaaugccuauuuuucccuuucu

SEQ ID NO: 898919 - RNA, 21 nt, Human
aaauggcauuaucaugccucu

SEQ ID NO: 898920 - RNA, 21 nt, Human
aacacccaacaggcaaaucca

SEQ ID NO: 898921 - RNA, 22 nt, Human
aaccugaccaccgcagauccag

SEQ ID NO: 898922 - RNA, 20 nt, Human
aagaauaucuuaauucacgg

SEQ ID NO: 898923 - RNA, 23 nt, Human
aagacaaauauucuuauuaacac

SEQ ID NO: 898924 - RNA, 23 nt, Human
aagagucagugauaucaagcagc

SEQ ID NO: 898925 - RNA, 21 nt, Human
aagcagaggcaaaccugacca

SEQ ID NO: 898926 - RNA, 18 nt, Human
aauaugccaggauuuugg

SEQ ID NO: 898927 - RNA, 20 nt, Human
aauaugccaggauuuugggu

SEQ ID NO: 898928 - RNA, 20 nt, Human
aauauuuacugauugauuua

SEQ ID NO: 898929 - RNA, 21 nt, Human
aaucacaguuuuucccacuug

SEQ ID NO: 898930 - RNA, 21 nt, Human
acaccauuuguauccuagaaa

SEQ ID NO: 898931 - RNA, 18 nt, Human
acacuacuacauuaugga

SEQ ID NO: 898932 - RNA, 18 nt, Human
accuggcaauaugccagg

SEQ ID NO: 898933 - RNA, 19 nt, Human
acuuguaugcuucuuccuc

SEQ ID NO: 898934 - RNA, 21 nt, Human
agaaacaacaaauccaagagc

SEQ ID NO: 898935 - RNA, 21 nt, Human
agaaacugguaggaagcccag

SEQ ID NO: 898936 - RNA, 18 nt, Human
agaagaaaaaaaauggca

SEQ ID NO: 898937 - RNA, 21 nt, Human
agaagaaaaaaaauggcauua

SEQ ID NO: 898938 - RNA, 21 nt, Human
agaccuggcaauaugccagga

SEQ ID NO: 898939 - RNA, 21 nt, Human
agcagcauuuauuaauggaau

SEQ ID NO: 898940 - RNA, 21 nt, Human
aggcagggaacaaaagcagag

SEQ ID NO: 898941 - RNA, 19 nt, Human
aucacaguuuuucccacuu

SEQ ID NO: 898942 - RNA, 21 nt, Human
augaagcaccccaggccaccc

SEQ ID NO: 898943 - RNA, 22 nt, Human
augaagcaccccaggccacccc

SEQ ID NO: 898944 - RNA, 19 nt, Human
auggagacaaaguccacua

SEQ ID NO: 898945 - RNA, 19 nt, Human
auggagccaauguuuggau

SEQ ID NO: 898946 - RNA, 20 nt, Human
caacacccaacaggcaaauc

SEQ ID NO: 898947 - RNA, 21 nt, Human
caacaggcaaauccacagacc

SEQ ID NO: 898948 - RNA, 18 nt, Human
cacagcccuggcauggag

SEQ ID NO: 898949 - RNA, 18 nt, Human
cacccaacaggcaaaucc

SEQ ID NO: 898950 - RNA, 24 nt, Human
caccccaggccaccccucucuaac

SEQ ID NO: 898951 - RNA, 19 nt, Human
cagcauuuauuaauggaau

SEQ ID NO: 898952 - RNA, 25 nt, Human
cagcgacacugucucagaauaacac

SEQ ID NO: 898953 - RNA, 21 nt, Human
cagucacagcccuggcaugga

SEQ ID NO: 898954 - RNA, 22 nt, Human
cagugauaucaagcagcgacac

SEQ ID NO: 898955 - RNA, 19 nt, Human
caguucuuggcugccuugu

SEQ ID NO: 898956 - RNA, 27 nt, Human
ccaacacccaacaggcaaauccacaga

SEQ ID NO: 898957 - RNA, 20 nt, Human
ccaacaggcaaauccacaga

SEQ ID NO: 898958 - RNA, 20 nt, Human
ccacuuguaugcuucuuccu

SEQ ID NO: 898959 - RNA, 22 nt, Human
ccaggccaccccucucuaaccu

SEQ ID NO: 898960 - RNA, 23 nt, Human
ccaguuguacagaagaaaaaaaa

SEQ ID NO: 898961 - RNA, 18 nt, Human
cccacacauaaaucuaaa

SEQ ID NO: 898962 - RNA, 21 nt, Human
cccacacauaaaucuaaaaga

SEQ ID NO: 898963 - RNA, 19 nt, Human
ccccaggccaccccucucu

SEQ ID NO: 898964 - RNA, 19 nt, Human
ccccaugguccuacacagg

SEQ ID NO: 898965 - RNA, 21 nt, Human
ccccaugguccuacacaggcu

SEQ ID NO: 898966 - RNA, 22 nt, Human
cccugcaguguagacaggccuu

SEQ ID NO: 898967 - RNA, 18 nt, Human
ccucugcugccaaggaaa

SEQ ID NO: 898968 - RNA, 23 nt, Human
ccugaccaccgcagauccaggaa

SEQ ID NO: 898969 - RNA, 23 nt, Human
cggaaaggcagggaacaaaagca

SEQ ID NO: 898970 - RNA, 18 nt, Human
cuaggagagaacagaaaa

SEQ ID NO: 898971 - RNA, 18 nt, Human
cucaugaagcaccccagg

SEQ ID NO: 898972 - RNA, 25 nt, Human
cucaugaagcaccccaggccacccc

SEQ ID NO: 898973 - RNA, 21 nt, Human
cugaaaugaccauacuuucaa

SEQ ID NO: 898974 - RNA, 20 nt, Human
gaaaccucucccagucaggg

SEQ ID NO: 898975 - RNA, 21 nt, Human
gaauagcugaaaugaccauac

SEQ ID NO: 898976 - RNA, 24 nt, Human
gaaugaacaaggcugaauuuuaga

SEQ ID NO: 898977 - RNA, 18 nt, Human
gagucaauucuaauuaag

SEQ ID NO: 898978 - RNA, 19 nt, Human
gcagggaacaaaagcagag

SEQ ID NO: 898979 - RNA, 19 nt, Human
gcccuagcgcccccccccc

SEQ ID NO: 898980 - RNA, 22 nt, Human
ggcauggagccaauguuuggau

SEQ ID NO: 898981 - RNA, 24 nt, Human
gggagguaagcaaucucaguguuu

SEQ ID NO: 898982 - RNA, 25 nt, Human
uaacacacuacuacauuauggaaaa

SEQ ID NO: 898983 - RNA, 18 nt, Human
uaacacucucuuccuauu

SEQ ID NO: 898984 - RNA, 21 nt, Human
uaaguguacaucaccuccucu

SEQ ID NO: 898985 - RNA, 19 nt, Human
uacugauugauuuauaaaa

SEQ ID NO: 898986 - RNA, 19 nt, Human
uaggagagaacagaaaaug

SEQ ID NO: 898987 - RNA, 19 nt, Human
uaucaugccucucuuaaua

SEQ ID NO: 898988 - RNA, 21 nt, Human
uauuucucaaaagguguguga

SEQ ID NO: 898989 - RNA, 19 nt, Human
ucaaagccaugagacaacc

SEQ ID NO: 898990 - RNA, 19 nt, Human
ucacagcccuggcauggag

SEQ ID NO: 898991 - RNA, 26 nt, Human
ucccugcagaggcaugaccucuugug

SEQ ID NO: 898992 - RNA, 19 nt, Human
ucccuggagcaguuuacua

SEQ ID NO: 898993 - RNA, 18 nt, Human
ucggcccuagcgcccccc

SEQ ID NO: 898994 - RNA, 23 nt, Human
ucugugauaaacaggaccggggc

SEQ ID NO: 898995 - RNA, 25 nt, Human
ugaacaaggcugaauuuuagaagug

SEQ ID NO: 898996 - RNA, 21 nt, Human
ugaagcaccccaggccacccc

SEQ ID NO: 898997 - RNA, 24 nt, Human
ugacucugaacuccccaugguccu

SEQ ID NO: 898998 - RNA, 23 nt, Human
ugagguucacuguuagugauuuc

SEQ ID NO: 898999 - RNA, 20 nt, Human
ugauuacuagaaagcuuugg

SEQ ID NO: 899000 - RNA, 26 nt, Human
ugauucccugcagaggcaugaccucu

SEQ ID NO: 899001 - RNA, 24 nt, Human
uggcaaauguuuuuaaaaggcucu

SEQ ID NO: 899002 - RNA, 21 nt, Human
uguacagaagaaaaaaaaugg

SEQ ID NO: 899003 - RNA, 22 nt, Human
uguacagaagaaaaaaaauggc

SEQ ID NO: 899004 - RNA, 20 nt, Human
uguccuaucccaugcccucc

SEQ ID NO: 899005 - RNA, 21 nt, Human
ugugauguggcggaaaggcag

SEQ ID NO: 899006 - RNA, 23 nt, Human
uuaugagucaauucuaauuaagu

SEQ ID NO: 899007 - RNA, 18 nt, Human
uucucagcaaauaaaaau

SEQ ID NO: 899008 - RNA, 23 nt, Human
uuucucaugaagcaccccaggcc

SEQ ID NO: 899009 - RNA, 19 nt, Human
aagacuuuucuuuccuuca

SEQ ID NO: 899010 - RNA, 22 nt, Human
aagcuguuggcaugucuaguuc

SEQ ID NO: 899011 - RNA, 19 nt, Human
accccuuagaccuacuguu

SEQ ID NO: 899012 - RNA, 21 nt, Human
accuacuguuuuuuuaaccug

SEQ ID NO: 899013 - RNA, 22 nt, Human
aguuccauagaauuuucuccag

SEQ ID NO: 899014 - RNA, 21 nt, Human
auagaauuuucuccaguuuca

SEQ ID NO: 899015 - RNA, 22 nt, Human
auagaauuuucuccaguuucag

SEQ ID NO: 899016 - RNA, 20 nt, Human
augucagaauauuaaaugag

SEQ ID NO: 899017 - RNA, 18 nt, Human
caaccuggcuccugccug

SEQ ID NO: 899018 - RNA, 23 nt, Human
caaucuugcauauuauguuccag

SEQ ID NO: 899019 - RNA, 22 nt, Human
cacugcacaaccuggcuccugc

SEQ ID NO: 899020 - RNA, 23 nt, Human
cagaaucuugucaccccaacccc

SEQ ID NO: 899021 - RNA, 19 nt, Human
cagcacugcacaaccuggc

SEQ ID NO: 899022 - RNA, 19 nt, Human
cauuagugaaagaugaggg

SEQ ID NO: 899023 - RNA, 21 nt, Human
cauuagugaaagaugagggua

SEQ ID NO: 899024 - RNA, 18 nt, Human
ccguguauaguuugcccc

SEQ ID NO: 899025 - RNA, 21 nt, Human
ccugcugaacuugaaaauaag

SEQ ID NO: 899026 - RNA, 22 nt, Human
cucaaacuguuguccauagacc

SEQ ID NO: 899027 - RNA, 23 nt, Human
cucaaacuguuguccauagacca

SEQ ID NO: 899028 - RNA, 22 nt, Human
cugcugaacuugaaaauaagaa

SEQ ID NO: 899029 - RNA, 22 nt, Human
cuugaagaccuugcuccucaaa

SEQ ID NO: 899030 - RNA, 20 nt, Human
cuuuucuuuccuucaggcuu

SEQ ID NO: 899031 - RNA, 25 nt, Human
gaacauuugacaugucagaauauua

SEQ ID NO: 899032 - RNA, 19 nt, Human
ggaagccagacacagcugc

SEQ ID NO: 899033 - RNA, 21 nt, Human
ucaagaacauuugacauguca

SEQ ID NO: 899034 - RNA, 21 nt, Human
ucaguccauaaugagagcuug

SEQ ID NO: 899035 - RNA, 20 nt, Human
uccagucuucuggaacacau

SEQ ID NO: 899036 - RNA, 20 nt, Human
uccauaaugagagcuugaag

SEQ ID NO: 899037 - RNA, 21 nt, Human
uccauaaugagagcuugaaga

SEQ ID NO: 899038 - RNA, 18 nt, Human
uccauacacagcacugca

SEQ ID NO: 899039 - RNA, 20 nt, Human
uccauacacagcacugcaca

SEQ ID NO: 899040 - RNA, 21 nt, Human
uccccaagcuguuggcauguc

SEQ ID NO: 899041 - RNA, 20 nt, Human
ucuccaguuucaguccauaa

SEQ ID NO: 899042 - RNA, 25 nt, Human
ucugccauuagugaaagaugagggu

SEQ ID NO: 899043 - RNA, 21 nt, Human
ugccauuagugaaagaugagg

SEQ ID NO: 899044 - RNA, 19 nt, Human
ugcugcccagccaugagag

SEQ ID NO: 899045 - RNA, 26 nt, Human
uguuccagucuucuggaacacauuca

SEQ ID NO: 899046 - RNA, 19 nt, Human
uugaagaccuugcuccuca

SEQ ID NO: 899047 - RNA, 19 nt, Human
aagcaaagcagaacauaac

SEQ ID NO: 899048 - RNA, 26 nt, Human
aaugguccuucucuuacuauuuguug

SEQ ID NO: 899049 - RNA, 18 nt, Human
aggaagaaauaauguaca

SEQ ID NO: 899050 - RNA, 21 nt, Human
cauggugaaacaagaggcaag

SEQ ID NO: 899051 - RNA, 19 nt, Human
uguacaaaugaaauggucc

SEQ ID NO: 899052 - RNA, 18 nt, Human
ugugccaagcaaagcaga

SEQ ID NO: 899053 - RNA, 21 nt, Human
ugugccaagcaaagcagaaca

SEQ ID NO: 899054 - RNA, 21 nt, Human
uuacauuuauuuugugccaag

SEQ ID NO: 899055 - RNA, 22 nt, Human
uuagaacacucuggaaaucauc

SEQ ID NO: 899056 - RNA, 21 nt, Human
uuugugccaagcaaagcagaa

SEQ ID NO: 899057 - RNA, 18 nt, Human
uuuuuuuuuuuuuuuuug

SEQ ID NO: 899058 - RNA, 19 nt, Human
uuuuuuuuuuuuuuuuugu

SEQ ID NO: 899059 - RNA, 18 nt, Human
aaauagaagcuuggugag

SEQ ID NO: 899060 - RNA, 23 nt, Human
auagauucuccccagugcggaag

SEQ ID NO: 899061 - RNA, 23 nt, Human
augcucaggggccugcugcacau

SEQ ID NO: 899062 - RNA, 24 nt, Human
cacuccuuuccuucaucucuuggg

SEQ ID NO: 899063 - RNA, 21 nt, Human
cccgcccauucugagagcaca

SEQ ID NO: 899064 - RNA, 19 nt, Human
ccuacuucccuuucacucc

SEQ ID NO: 899065 - RNA, 19 nt, Human
cuugcauagauucucccca

SEQ ID NO: 899066 - RNA, 26 nt, Human
cuuucaaguuuuaaauuagauaaaua

SEQ ID NO: 899067 - RNA, 22 nt, Human
ggcauggagguggcauaugccg

SEQ ID NO: 899068 - RNA, 22 nt, Human
ggugcaguggcgaggacguggu

SEQ ID NO: 899069 - RNA, 21 nt, Human
uccauuuugcuuccuuccacu

SEQ ID NO: 899070 - RNA, 19 nt, Human
ucccgggaucucugucucc

SEQ ID NO: 899071 - RNA, 19 nt, Human
ucuccaucccgauaauccc

SEQ ID NO: 899072 - RNA, 23 nt, Human
ucucuugggcccgcccauucuga

SEQ ID NO: 899073 - RNA, 20 nt, Human
ugaaugcugcaaaguggugu

SEQ ID NO: 899074 - RNA, 19 nt, Human
ugcaguggcgaggacgugg

SEQ ID NO: 899075 - RNA, 22 nt, Human
ugcucaggggccugcugcacau

SEQ ID NO: 899076 - RNA, 26 nt, Human
uggcauggagguggcauaugccgagg

SEQ ID NO: 899077 - RNA, 18 nt, Human
ugucccgggaucucuguc

SEQ ID NO: 899078 - RNA, 23 nt, Human
uuccguuuccuauuaccacuucu

SEQ ID NO: 899079 - RNA, 23 nt, Human
uuccuuccacuucucugguccua

SEQ ID NO: 899080 - RNA, 24 nt, Human
uucuuccuugguugcaguuuucuc

SEQ ID NO: 899081 - RNA, 19 nt, Human
uugcuaggccagcucuggc

SEQ ID NO: 899082 - RNA, 24 nt, Human
uugugucucucaucugcugacuuu

SEQ ID NO: 899083 - RNA, 25 nt, Human
uuuuuuuuuuuuuuuuuuuucaugg

SEQ ID NO: 899084 - RNA, 22 nt, Human
aaaggccucuccugacccgccc

SEQ ID NO: 899085 - RNA, 22 nt, Human
caaaggccucuccugacccgcc

SEQ ID NO: 899086 - RNA, 26 nt, Human
caagugaaauacaauaguagcuauaa

SEQ ID NO: 899087 - RNA, 21 nt, Human
cagaaaacuacuauaauuuau

SEQ ID NO: 899088 - RNA, 23 nt, Human
cagaaaacuacuauaauuuaugc

SEQ ID NO: 899089 - RNA, 21 nt, Human
cagucuuucccuucuaggccc

SEQ ID NO: 899090 - RNA, 19 nt, Human
cccgcccacggaguggggg

SEQ ID NO: 899091 - RNA, 23 nt, Human
cuuccaaaggccucuccugaccc

SEQ ID NO: 899092 - RNA, 22 nt, Human
cuucuaggcccuccugccaaca

SEQ ID NO: 899093 - RNA, 21 nt, Human
gaaauacaauaguagcuauaa

SEQ ID NO: 899094 - RNA, 19 nt, Human
gcggugggagagaagaggc

SEQ ID NO: 899095 - RNA, 21 nt, Human
uaauuuaugcuaaacuuccuu

SEQ ID NO: 899096 - RNA, 19 nt, Human
uacaauaguagcuauaaaa

SEQ ID NO: 899097 - RNA, 28 nt, Human
uacaauaguagcuauaaaacuauggaga

SEQ ID NO: 899098 - RNA, 18 nt, Human
uacuuuaauucaacaagu

SEQ ID NO: 899099 - RNA, 19 nt, Human
uaguagcuauaaaacuaug

SEQ ID NO: 899100 - RNA, 24 nt, Human
uccaaaggccucuccugacccgcc

SEQ ID NO: 899101 - RNA, 18 nt, Human
ucuauaauuuucuauuca

SEQ ID NO: 899102 - RNA, 19 nt, Human
ugacccgcccacggagugg

SEQ ID NO: 899103 - RNA, 24 nt, Human
ugcuaaacuuccuuuuaucacuac

SEQ ID NO: 899104 - RNA, 23 nt, Human
uugguaucaacgcacagucuuuc

SEQ ID NO: 899105 - RNA, 24 nt, Human
uuuuuuuuuuuuuaaaagaauuca

SEQ ID NO: 899106 - RNA, 23 nt, Human
uuuuuuuuuuuuuuuuuuaaaag

SEQ ID NO: 899107 - RNA, 21 nt, Human
aagaacaaauuguuugagugc

SEQ ID NO: 899108 - RNA, 18 nt, Human
aagaagaaugaaaaucug

SEQ ID NO: 899109 - RNA, 22 nt, Human
agcaugcccuucauuuuuuugu

SEQ ID NO: 899110 - RNA, 19 nt, Human
cagaacucuaguaagggaa

SEQ ID NO: 899111 - RNA, 23 nt, Human
cagaagaagaaugaaaaucugcc

SEQ ID NO: 899112 - RNA, 18 nt, Human
cugauugcagguccccug

SEQ ID NO: 899113 - RNA, 21 nt, Human
gaaagagugagcaaacauugc

SEQ ID NO: 899114 - RNA, 18 nt, Human
gagaacacagauuggagg

SEQ ID NO: 899115 - RNA, 21 nt, Human
gagcaaacauugccgcccaaa

SEQ ID NO: 899116 - RNA, 18 nt, Human
gcauguuagucagagucu

SEQ ID NO: 899117 - RNA, 20 nt, Human
gcgugcuggguuuggacuuc

SEQ ID NO: 899118 - RNA, 23 nt, Human
gugagcaaacauugccgcccaaa

SEQ ID NO: 899119 - RNA, 18 nt, Human
uagauuggacaaauaggc

SEQ ID NO: 899120 - RNA, 25 nt, Human
ugagugcucagcaugcccuucauuu

SEQ ID NO: 899121 - RNA, 22 nt, Human
ugcuggguuuggacuucuuggu

SEQ ID NO: 899122 - RNA, 21 nt, Human
ugcuuuauaaucuuuguuucu

SEQ ID NO: 899123 - RNA, 18 nt, Human
ugguauagagcuuucugc

SEQ ID NO: 899124 - RNA, 25 nt, Human
ugguauagagcuuucugcuuuaggg

SEQ ID NO: 899125 - RNA, 19 nt, Human
uguuagucagagucuucag

SEQ ID NO: 899126 - RNA, 26 nt, Human
uguucugaaucuagauuggacaaaua

SEQ ID NO: 899127 - RNA, 19 nt, Human
uucuauggcagaacucuag

SEQ ID NO: 899128 - RNA, 24 nt, Human
uucugaaucuagauuggacaaaua

SEQ ID NO: 899129 - RNA, 20 nt, Human
uuuaaguaagaacaaauuga

SEQ ID NO: 899130 - RNA, 21 nt, Human
uuuuuguaaguuaaugaggug

SEQ ID NO: 899131 - RNA, 22 nt, Human
aagcccaggcucuaccagcaag

SEQ ID NO: 899132 - RNA, 21 nt, Human
aauccccuccugcagaggauc

SEQ ID NO: 899133 - RNA, 20 nt, Human
accagacuucuugaagugac

SEQ ID NO: 899134 - RNA, 20 nt, Human
accccacacugaugcccccc

SEQ ID NO: 899135 - RNA, 18 nt, Human
caagggcuccugcuggac

SEQ ID NO: 899136 - RNA, 24 nt, Human
cacagcaagcccaggcucuaccag

SEQ ID NO: 899137 - RNA, 27 nt, Human
caccccacacugaugcccccccccgcu

SEQ ID NO: 899138 - RNA, 23 nt, Human
cagugaccacccuuccccuagac

SEQ ID NO: 899139 - RNA, 20 nt, Human
ccaacagccuuccugcuccc

SEQ ID NO: 899140 - RNA, 20 nt, Human
ccacacugaugccccccccc

SEQ ID NO: 899141 - RNA, 21 nt, Human
cccaacagccuuccugcuccc

SEQ ID NO: 899142 - RNA, 22 nt, Human
ccccacacugaugccccccccc

SEQ ID NO: 899143 - RNA, 27 nt, Human
ccccuagacaggccacaccuccagccu

SEQ ID NO: 899144 - RNA, 24 nt, Human
ccuuagcugcuauaauccccuccu

SEQ ID NO: 899145 - RNA, 23 nt, Human
cugcccccuuggcacagcaagcc

SEQ ID NO: 899146 - RNA, 21 nt, Human
gcacagcaagcccaggcucua

SEQ ID NO: 899147 - RNA, 20 nt, Human
gccacaccuccagccuggca

SEQ ID NO: 899148 - RNA, 21 nt, Human
gccacaccuccagccuggcag

SEQ ID NO: 899149 - RNA, 24 nt, Human
uaacauaguuguuucucuggggac

SEQ ID NO: 899150 - RNA, 18 nt, Human
uaggucucagacacaaac

SEQ ID NO: 899151 - RNA, 23 nt, Human
ucccaccccacacugaugccccc

SEQ ID NO: 899152 - RNA, 25 nt, Human
uccccaacagccuuccugcucccac

SEQ ID NO: 899153 - RNA, 21 nt, Human
ucucuggggaccaccagacuu

SEQ ID NO: 899154 - RNA, 21 nt, Human
ucuuggagaugccgugguggg

SEQ ID NO: 899155 - RNA, 21 nt, Human
ugcccuuagcugcuauaaucc

SEQ ID NO: 899156 - RNA, 27 nt, Human
ugcucugcccccuuggcacagcaagcc

SEQ ID NO: 899157 - RNA, 19 nt, Human
ugucaagggcuccugcugg

SEQ ID NO: 899158 - RNA, 18 nt, Human
uugaagaguuuauuuauu

SEQ ID NO: 899159 - RNA, 20 nt, Human
uugcucugcccccuuggcac

SEQ ID NO: 899160 - RNA, 19 nt, Human
aaaacaaacaaacaaacca

SEQ ID NO: 899161 - RNA, 22 nt, Human
aaaacaaacaaacaaaccaaaa

SEQ ID NO: 899162 - RNA, 22 nt, Human
aaacaaacaaaccaaaaaaaca

SEQ ID NO: 899163 - RNA, 25 nt, Human
aaacaaacaaaccaaaaaaacacua

SEQ ID NO: 899164 - RNA, 27 nt, Human
aaacaaacaaaccaaaaaaacacuaca

SEQ ID NO: 899165 - RNA, 22 nt, Human
aaacaaaccaaaaaaacacuac

SEQ ID NO: 899166 - RNA, 26 nt, Human
acaaacaaaccaaaaaaacacuacaa

SEQ ID NO: 899167 - RNA, 18 nt, Human
acaaagcacaaggcaaag

SEQ ID NO: 899168 - RNA, 24 nt, Human
acagauuacuucauaccucuuuca

SEQ ID NO: 899169 - RNA, 19 nt, Human
acucuccagaacugggagu

SEQ ID NO: 899170 - RNA, 20 nt, Human
acugggaguggcucauuccc

SEQ ID NO: 899171 - RNA, 18 nt, Human
agaguuugggcuuuggcc

SEQ ID NO: 899172 - RNA, 20 nt, Human
aggcaagguuaccaaggggg

SEQ ID NO: 899173 - RNA, 21 nt, Human
aggcgggagggauccauggcc

SEQ ID NO: 899174 - RNA, 24 nt, Human
agggaaggaaggaaauggggaagg

SEQ ID NO: 899175 - RNA, 20 nt, Human
agguggagucagauuucagg

SEQ ID NO: 899176 - RNA, 23 nt, Human
caaagaaauuauaaacaaagcac

SEQ ID NO: 899177 - RNA, 23 nt, Human
caaagcacaaggcaaaguugcaa

SEQ ID NO: 899178 - RNA, 21 nt, Human
caaccccacccuccgcagaag

SEQ ID NO: 899179 - RNA, 23 nt, Human
caaccccacccuccgcagaagaa

SEQ ID NO: 899180 - RNA, 24 nt, Human
caauucuugguagaaagagucgaa

SEQ ID NO: 899181 - RNA, 23 nt, Human
cacaccccaaaacugagagcaga

SEQ ID NO: 899182 - RNA, 20 nt, Human
caccccaaaacugagagcag

SEQ ID NO: 899183 - RNA, 18 nt, Human
caccuugacaguugaguu

SEQ ID NO: 899184 - RNA, 23 nt, Human
cagaucaaccccacccuccgcag

SEQ ID NO: 899185 - RNA, 22 nt, Human
cagcaaauaucuguguucuuuu

SEQ ID NO: 899186 - RNA, 22 nt, Human
cagcagagucgaaaucuaggcc

SEQ ID NO: 899187 - RNA, 24 nt, Human
cagcagagucgaaaucuaggccug

SEQ ID NO: 899188 - RNA, 25 nt, Human
cagguggagucagauuucaggcggg

SEQ ID NO: 899189 - RNA, 25 nt, Human
cauccucacucuccagaacugggag

SEQ ID NO: 899190 - RNA, 23 nt, Human
ccagcagagucgaaaucuaggcc

SEQ ID NO: 899191 - RNA, 23 nt, Human
cccacaccccaaaacugagagca

SEQ ID NO: 899192 - RNA, 19 nt, Human
ccccaaaacugagagcaga

SEQ ID NO: 899193 - RNA, 23 nt, Human
ccccacaccccaaaacugagagc

SEQ ID NO: 899194 - RNA, 23 nt, Human
ccucuggagccacugacuugccc

SEQ ID NO: 899195 - RNA, 24 nt, Human
cugcuauggcaaagacaugcugcu

SEQ ID NO: 899196 - RNA, 21 nt, Human
cuggagccacugacuugccca

SEQ ID NO: 899197 - RNA, 19 nt, Human
cugguacaauggacaccuu

SEQ ID NO: 899198 - RNA, 22 nt, Human
cuuuuuaaaauaaaaguuguag

SEQ ID NO: 899199 - RNA, 19 nt, Human
gaaggaaggaaauggggaa

SEQ ID NO: 899200 - RNA, 22 nt, Human
gagcagaucaaccccacccucc

SEQ ID NO: 899201 - RNA, 20 nt, Human
ggaaaacaaacaaacaaacc

SEQ ID NO: 899202 - RNA, 21 nt, Human
ggacugggaaagaagaucuuc

SEQ ID NO: 899203 - RNA, 20 nt, Human
gggaaaacaaacaaacaaac

SEQ ID NO: 899204 - RNA, 18 nt, Human
gggaaagaagaucuucgu

SEQ ID NO: 899205 - RNA, 26 nt, Human
gggaaggaaggaaauggggaagggaa

SEQ ID NO: 899206 - RNA, 18 nt, Human
gugaagugcugcuauggc

SEQ ID NO: 899207 - RNA, 19 nt, Human
guggcucauucccacuccc

SEQ ID NO: 899208 - RNA, 21 nt, Human
guugaguugacgaccuggccu

SEQ ID NO: 899209 - RNA, 18 nt, Human
uaaaagcagcaaauaucu

SEQ ID NO: 899210 - RNA, 19 nt, Human
uaacuaggaauugcugcca

SEQ ID NO: 899211 - RNA, 25 nt, Human
uaagaccccucuggagccacugacu

SEQ ID NO: 899212 - RNA, 22 nt, Human
uaagugaaaaauaaccagguac

SEQ ID NO: 899213 - RNA, 23 nt, Human
uaauaauuuccuaaacugacacu

SEQ ID NO: 899214 - RNA, 21 nt, Human
uacuucauaccucuuucaagc

SEQ ID NO: 899215 - RNA, 18 nt, Human
uauauuaguaauguaaca

SEQ ID NO: 899216 - RNA, 24 nt, Human
ucuccagaacugggaguggcucau

SEQ ID NO: 899217 - RNA, 20 nt, Human
ucugguuccagaaaguggag

SEQ ID NO: 899218 - RNA, 19 nt, Human
ucuuaaaagcagcaaauau

SEQ ID NO: 899219 - RNA, 20 nt, Human
ugaaaaauaaccagguacaa

SEQ ID NO: 899220 - RNA, 24 nt, Human
ugaaaaauaaccagguacaaaacu

SEQ ID NO: 899221 - RNA, 24 nt, Human
uggagauggucauccucacucucc

SEQ ID NO: 899222 - RNA, 21 nt, Human
uggcucauucccacuccccgg

SEQ ID NO: 899223 - RNA, 24 nt, Human
ugggcugcagagaaauaaucuugg

SEQ ID NO: 899224 - RNA, 21 nt, Human
ugguuccagaaaguggagaug

SEQ ID NO: 899225 - RNA, 24 nt, Human
ugugguuugcuugcuuguuuuugu

SEQ ID NO: 899226 - RNA, 21 nt, Human
uuaaaauaaaaguuguaggcc

SEQ ID NO: 899227 - RNA, 24 nt, Human
uuaaaauaaaaguuguaggccagg

SEQ ID NO: 899228 - RNA, 21 nt, Human
uucauaccucuuucaagcuua

SEQ ID NO: 899229 - RNA, 18 nt, Human
uuccagaaaguggagaug

SEQ ID NO: 899230 - RNA, 24 nt, Human
uucuugaucaucuuuuuaaaauaa

SEQ ID NO: 899231 - RNA, 22 nt, Human
uuucugagucucagagaagaug

SEQ ID NO: 899232 - RNA, 21 nt, Human
aagugaaaacagacccauuua

SEQ ID NO: 899233 - RNA, 18 nt, Human
agauguuaaggcuagcuu

SEQ ID NO: 899234 - RNA, 23 nt, Human
ccuuaaaugcccacauucuuuca

SEQ ID NO: 899235 - RNA, 19 nt, Human
uagcuggcuagacuauugc

SEQ ID NO: 899236 - RNA, 18 nt, Human
ugaagaaaaaugagcaaa

SEQ ID NO: 899237 - RNA, 18 nt, Human
uggaaaaauuucuuagau

SEQ ID NO: 899238 - RNA, 19 nt, Human
uucaguguuuaagaccuua

SEQ ID NO: 899239 - RNA, 23 nt, Human
cagauuacuugcuaaaagaauuu

SEQ ID NO: 899240 - RNA, 25 nt, Human
ccaaauaucuaauuuuucaaguaac

SEQ ID NO: 899241 - RNA, 19 nt, Human
ccaccucugaagucauccu

SEQ ID NO: 899242 - RNA, 21 nt, Human
ccccuuugcagaaaauaauuu

SEQ ID NO: 899243 - RNA, 23 nt, Human
cuagguuaauuuuuccaccucug

SEQ ID NO: 899244 - RNA, 18 nt, Human
cuguagagccguuucucc

SEQ ID NO: 899245 - RNA, 19 nt, Human
gugauucuuccuuguuuca

SEQ ID NO: 899246 - RNA, 21 nt, Human
gugauucuuccuuguuucagc

SEQ ID NO: 899247 - RNA, 25 nt, Human
uccucacuuagaagucuuuccccag

SEQ ID NO: 899248 - RNA, 18 nt, Human
ucugaagucauccugaau

SEQ ID NO: 899249 - RNA, 23 nt, Human
ugaaucuuugacaaaaaccaucu

SEQ ID NO: 899250 - RNA, 24 nt, Human
ugaccuguagagccguuucuccuc

SEQ ID NO: 899251 - RNA, 26 nt, Human
uguagagccguuucuccucacuuaga

SEQ ID NO: 899252 - RNA, 18 nt, Human
uucacuuucgaagaagac

SEQ ID NO: 899253 - RNA, 19 nt, Human
uuccaaauacaauuaacuc

SEQ ID NO: 899254 - RNA, 22 nt, Human
uucuauggugauucuuccuugu

SEQ ID NO: 899255 - RNA, 18 nt, Human
uucuuaaaaucuucaaaa

SEQ ID NO: 899256 - RNA, 23 nt, Human
uuucacaugaauauaacugcacc

SEQ ID NO: 899257 - RNA, 18 nt, Human
uuuuuuuuuuuuuuugca

SEQ ID NO: 899258 - RNA, 19 nt, Human
uuuuuuuuuuuuuuugcau

SEQ ID NO: 899259 - RNA, 18 nt, Human
aaaaauaaauagagggaa

SEQ ID NO: 899260 - RNA, 21 nt, Human
aaaaggagccucuuugcagug

SEQ ID NO: 899261 - RNA, 22 nt, Human
caaaccgcagcaacucugccga

SEQ ID NO: 899262 - RNA, 21 nt, Human
ccuucgagagcuggagguggg

SEQ ID NO: 899263 - RNA, 19 nt, Human
cgagagcuggaggugggag

SEQ ID NO: 899264 - RNA, 22 nt, Human
cgcaagggcacaaaccgcagca

SEQ ID NO: 899265 - RNA, 23 nt, Human
gcagugcccucaggaaaagcucc

SEQ ID NO: 899266 - RNA, 22 nt, Human
gcuggaggugggaguuugacuc

SEQ ID NO: 899267 - RNA, 18 nt, Human
ggcacaaaccgcagcaac

SEQ ID NO: 899268 - RNA, 25 nt, Human
uagcagggaaauaaaagucuauaaa

SEQ ID NO: 899269 - RNA, 24 nt, Human
uauauauauguucagcaugccagu

SEQ ID NO: 899270 - RNA, 24 nt, Human
ucagaaaaagaaaucgcaagggca

SEQ ID NO: 899271 - RNA, 22 nt, Human
ucagcaugccaguucaccuggu

SEQ ID NO: 899272 - RNA, 21 nt, Human
ucgagagcuggaggugggagu

SEQ ID NO: 899273 - RNA, 21 nt, Human
ugaaagaaaaggagccucuuu

SEQ ID NO: 899274 - RNA, 19 nt, Human
ugagccuauauauauauau

SEQ ID NO: 899275 - RNA, 24 nt, Human
ugcagugcccucaggaaaagcucc

SEQ ID NO: 899276 - RNA, 21 nt, Human
uuuaauagcagggaaauaaaa

SEQ ID NO: 899277 - RNA, 19 nt, Human
aacaugcugguggcacagg

SEQ ID NO: 899278 - RNA, 21 nt, Human
aacaugcugguggcacaggua

SEQ ID NO: 899279 - RNA, 18 nt, Human
agcagcugcagcgccccc

SEQ ID NO: 899280 - RNA, 19 nt, Human
aggacaggauccuugguuu

SEQ ID NO: 899281 - RNA, 21 nt, Human
augcugguggcacagguaggg

SEQ ID NO: 899282 - RNA, 18 nt, Human
cagcagcugcagcgcccc

SEQ ID NO: 899283 - RNA, 20 nt, Human
cagcagcugcagcgcccccc

SEQ ID NO: 899284 - RNA, 21 nt, Human
uccgaggguggccucuguggg

SEQ ID NO: 899285 - RNA, 24 nt, Human
ucucuaggacaggauccuugguuu

SEQ ID NO: 899286 - RNA, 18 nt, Human
uggccacaucuucagucc

SEQ ID NO: 899287 - RNA, 20 nt, Human
aaaacaagggaggggcgaag

SEQ ID NO: 899288 - RNA, 19 nt, Human
aaggacggauggauguugg

SEQ ID NO: 899289 - RNA, 19 nt, Human
aauuucuguucuuggucuc

SEQ ID NO: 899290 - RNA, 21 nt, Human
acaauaucuuaggggauuggc

SEQ ID NO: 899291 - RNA, 23 nt, Human
agcggcuugggcagcagcagggg

SEQ ID NO: 899292 - RNA, 21 nt, Human
aggaggcaggggcacgaggcg

SEQ ID NO: 899293 - RNA, 24 nt, Human
aggcaggggcacgaggcggauccg

SEQ ID NO: 899294 - RNA, 18 nt, Human
aggcccagcggcuugggc

SEQ ID NO: 899295 - RNA, 21 nt, Human
aggcccagcggcuugggcagc

SEQ ID NO: 899296 - RNA, 23 nt, Human
aggggugucugugaguggggugc

SEQ ID NO: 899297 - RNA, 24 nt, Human
auaaaacaagggaggggcgaaggg

SEQ ID NO: 899298 - RNA, 22 nt, Human
caagaacuccucuucuggguac

SEQ ID NO: 899299 - RNA, 20 nt, Human
cacugggcuucccucacucu

SEQ ID NO: 899300 - RNA, 18 nt, Human
cagcagcaggggggugcc

SEQ ID NO: 899301 - RNA, 22 nt, Human
cagcagcaggggggugccaggg

SEQ ID NO: 899302 - RNA, 19 nt, Human
caggugugggggcagggag

SEQ ID NO: 899303 - RNA, 20 nt, Human
cauaaaauauaaaacaaggg

SEQ ID NO: 899304 - RNA, 23 nt, Human
ccagagcuccugccugagcgcug

SEQ ID NO: 899305 - RNA, 24 nt, Human
ccagagcuccugccugagcgcugg

SEQ ID NO: 899306 - RNA, 19 nt, Human
ccagggcggcggcgcgccc

SEQ ID NO: 899307 - RNA, 19 nt, Human
ccaguccagagcuccugcc

SEQ ID NO: 899308 - RNA, 20 nt, Human
ccuuccacugggcuucccuc

SEQ ID NO: 899309 - RNA, 18 nt, Human
cggcuugggcagcagcag

SEQ ID NO: 899310 - RNA, 22 nt, Human
cggguuagugagcaagaacucc

SEQ ID NO: 899311 - RNA, 21 nt, Human
cucccgggacccccuuccacu

SEQ ID NO: 899312 - RNA, 20 nt, Human
cugggaaguggagccuuuuc

SEQ ID NO: 899313 - RNA, 19 nt, Human
gaaggagaaugagaacaga

SEQ ID NO: 899314 - RNA, 19 nt, Human
gacggauggauguuggugg

SEQ ID NO: 899315 - RNA, 20 nt, Human
gaugcugcaucuuuuuuuuu

SEQ ID NO: 899316 - RNA, 27 nt, Human
gaugcugcaucuuuuuuuuuuuuuuuu

SEQ ID NO: 899317 - RNA, 19 nt, Human
gcagccggcucccgggacc

SEQ ID NO: 899318 - RNA, 21 nt, Human
gcaucuuuuuuuuuuuuuuuu

SEQ ID NO: 899319 - RNA, 22 nt, Human
ggaaugggaagcuccaggaggc

SEQ ID NO: 899320 - RNA, 18 nt, Human
ggcaaggaagggcuggga

SEQ ID NO: 899321 - RNA, 18 nt, Human
ggcccagcggcuugggca

SEQ ID NO: 899322 - RNA, 21 nt, Human
gggcugggaaguggagccuuu

SEQ ID NO: 899323 - RNA, 18 nt, Human
gggcuucccucacuccag

SEQ ID NO: 899324 - RNA, 22 nt, Human
uaauaaaaaauaagguucauua

SEQ ID NO: 899325 - RNA, 25 nt, Human
uagucccucuuuccugggccaggga

SEQ ID NO: 899326 - RNA, 18 nt, Human
ucaggggcaaggaagggc

SEQ ID NO: 899327 - RNA, 23 nt, Human
uccacugggcuucccucacucca

SEQ ID NO: 899328 - RNA, 23 nt, Human
ucuuuccugggccagggagcagc

SEQ ID NO: 899329 - RNA, 22 nt, Human
ucuuuuuuuuuuuuuuuuuggg

SEQ ID NO: 899330 - RNA, 25 nt, Human
ucuuuuuuuuuuuuuuuuuggguuu

SEQ ID NO: 899331 - RNA, 19 nt, Human
ugagaaggacggauggaug

SEQ ID NO: 899332 - RNA, 18 nt, Human
ugagcugaugaagagagc

SEQ ID NO: 899333 - RNA, 23 nt, Human
ugagcugaugaagagagcaguuu

SEQ ID NO: 899334 - RNA, 18 nt, Human
ugccaggugagggucagg

SEQ ID NO: 899335 - RNA, 21 nt, Human
ugcugagcugaugaagagagc

SEQ ID NO: 899336 - RNA, 20 nt, Human
ugggaaggagaaugagaacc

SEQ ID NO: 899337 - RNA, 18 nt, Human
ugggcagcagcagggggg

SEQ ID NO: 899338 - RNA, 18 nt, Human
ugggggugggguaagggg

SEQ ID NO: 899339 - RNA, 18 nt, Human
ugggugcagguguggggg

SEQ ID NO: 899340 - RNA, 24 nt, Human
uggucucuguacaguggggguggg

SEQ ID NO: 899341 - RNA, 21 nt, Human
uguugggcauaugagagagga

SEQ ID NO: 899342 - RNA, 21 nt, Human
uguuugggugcaggugugggg

SEQ ID NO: 899343 - RNA, 19 nt, Human
uucuggguaccaggggucc

SEQ ID NO: 899344 - RNA, 18 nt, Human
uuuuuuuuuuuuuugggu

SEQ ID NO: 899345 - RNA, 18 nt, Human
uuuuuuuuuuuuuuuuug

SEQ ID NO: 899346 - RNA, 24 nt, Human
uuuuuuuuuuuuuuuuugaugcug

SEQ ID NO: 899347 - RNA, 22 nt, Human
aaaacaaaacaacagaaacaga

SEQ ID NO: 899348 - RNA, 19 nt, Human
aagaauggagaucuggugg

SEQ ID NO: 899349 - RNA, 19 nt, Human
acaaaacaacagaaacaga

SEQ ID NO: 899350 - RNA, 25 nt, Human
acaccgccaugauagauccgcaggc

SEQ ID NO: 899351 - RNA, 20 nt, Human
acacgucggagccaaugaca

SEQ ID NO: 899352 - RNA, 19 nt, Human
acuguguaaagggcagggc

SEQ ID NO: 899353 - RNA, 20 nt, Human
agaauggagaucuggugggg

SEQ ID NO: 899354 - RNA, 20 nt, Human
aggcagggagggaggugggg

SEQ ID NO: 899355 - RNA, 24 nt, Human
aggcagggagggagguggggagga

SEQ ID NO: 899356 - RNA, 21 nt, Human
aggcagggagggagguggggu

SEQ ID NO: 899357 - RNA, 21 nt, Human
aggcaguggcaaaggcugugc

SEQ ID NO: 899358 - RNA, 23 nt, Human
aggcgcaacuccucgggucggga

SEQ ID NO: 899359 - RNA, 19 nt, Human
agggguggcuugaagggcu

SEQ ID NO: 899360 - RNA, 19 nt, Human
agugccaaagcagagcucc

SEQ ID NO: 899361 - RNA, 18 nt, Human
caccugagugaggaugga

SEQ ID NO: 899362 - RNA, 18 nt, Human
ccagucagauagaaguga

SEQ ID NO: 899363 - RNA, 20 nt, Human
ccccauacgaccagcucagc

SEQ ID NO: 899364 - RNA, 28 nt, Human
ccgaauaucuacacgcaauugcagguaa

SEQ ID NO: 899365 - RNA, 19 nt, Human
cgcucucggccugucaguc

SEQ ID NO: 899366 - RNA, 25 nt, Human
cgucagugaugaccguuucucagcc

SEQ ID NO: 899367 - RNA, 19 nt, Human
cguucagcagguaccgcca

SEQ ID NO: 899368 - RNA, 25 nt, Human
cucaaaucaaaggcucggaugagga

SEQ ID NO: 899369 - RNA, 21 nt, Human
cuuucgcagcgagggcuccac

SEQ ID NO: 899370 - RNA, 27 nt, Human
gaaacagaauaaauaggcguggccucu

SEQ ID NO: 899371 - RNA, 21 nt, Human
gagaucugguggggccgaugg

SEQ ID NO: 899372 - RNA, 20 nt, Human
gaggugaucuggggaucuac

SEQ ID NO: 899373 - RNA, 22 nt, Human
gagguggggucucauguguugg

SEQ ID NO: 899374 - RNA, 24 nt, Human
gauagauccgcaggcgcaacuccu

SEQ ID NO: 899375 - RNA, 21 nt, Human
gauccgcaggcgcaacuccuc

SEQ ID NO: 899376 - RNA, 19 nt, Human
gcagguaccgccacaccac

SEQ ID NO: 899377 - RNA, 23 nt, Human
gcagugccaaagcagagcuccac

SEQ ID NO: 899378 - RNA, 18 nt, Human
gcccagguagcugaugcc

SEQ ID NO: 899379 - RNA, 24 nt, Human
gcccucauggcaaagaauggagau

SEQ ID NO: 899380 - RNA, 19 nt, Human
gccuggggaggaagggcuc

SEQ ID NO: 899381 - RNA, 18 nt, Human
ggcagugccaaagcagag

SEQ ID NO: 899382 - RNA, 22 nt, Human
ggcaguggcaaaggcugugcug

SEQ ID NO: 899383 - RNA, 20 nt, Human
gggcagugccaaagcagagc

SEQ ID NO: 899384 - RNA, 23 nt, Human
ggggcagugccaaagcagagcuc

SEQ ID NO: 899385 - RNA, 22 nt, Human
ggguggcuugaagggcuugaca

SEQ ID NO: 899386 - RNA, 23 nt, Human
uacuuaggccuggggaggaaggg

SEQ ID NO: 899387 - RNA, 23 nt, Human
uagaagugagagguaaacuuccu

SEQ ID NO: 899388 - RNA, 22 nt, Human
uaugcuccaacaagucuagggc

SEQ ID NO: 899389 - RNA, 19 nt, Human
ucccacucaaaucaaaggc

SEQ ID NO: 899390 - RNA, 18 nt, Human
ucgggucgggagagcugg

SEQ ID NO: 899391 - RNA, 27 nt, Human
ucuucuagcaaugggcuguccuccgag

SEQ ID NO: 899392 - RNA, 23 nt, Human
ugagugaggauggacuguguaaa

SEQ ID NO: 899393 - RNA, 23 nt, Human
ugccaaaguucuucuucccacuc

SEQ ID NO: 899394 - RNA, 19 nt, Human
uggcuugaagggcuugaca

SEQ ID NO: 899395 - RNA, 21 nt, Human
ugucccagucuucuagcaaug

SEQ ID NO: 899396 - RNA, 18 nt, Human
uguuaaaaacaaaacaac

SEQ ID NO: 899397 - RNA, 20 nt, Human
uguuaaaaacaaaacaacag

SEQ ID NO: 899398 - RNA, 18 nt, Human
uugcagguaagguuugga

SEQ ID NO: 899399 - RNA, 20 nt, Human
aagaaagaaaagaaggcaca

SEQ ID NO: 899400 - RNA, 20 nt, Human
acugaguuuuguugguuuga

SEQ ID NO: 899401 - RNA, 22 nt, Human
agccgcgugaggaggcagccuc

SEQ ID NO: 899402 - RNA, 23 nt, Human
aggcaggcgccucgcgcgucccg

SEQ ID NO: 899403 - RNA, 18 nt, Human
aguuuuguugguuugagg

SEQ ID NO: 899404 - RNA, 22 nt, Human
augauaugcaccgccauucccc

SEQ ID NO: 899405 - RNA, 21 nt, Human
caaccaacaaaacuaaauucu

SEQ ID NO: 899406 - RNA, 19 nt, Human
caagcucaccuuuguuugg

SEQ ID NO: 899407 - RNA, 18 nt, Human
cacccugcgccgggggug

SEQ ID NO: 899408 - RNA, 23 nt, Human
caccugggacuggggcugggggc

SEQ ID NO: 899409 - RNA, 18 nt, Human
cagaacucacaguaggug

SEQ ID NO: 899410 - RNA, 18 nt, Human
cauccugaucacagacac

SEQ ID NO: 899411 - RNA, 22 nt, Human
caugguuuugcuaaccguguac

SEQ ID NO: 899412 - RNA, 21 nt, Human
ccaccugggacuggggcuggg

SEQ ID NO: 899413 - RNA, 21 nt, Human
ccccuccgccgccgccgccgc

SEQ ID NO: 899414 - RNA, 18 nt, Human
cccugcgccggggguggg

SEQ ID NO: 899415 - RNA, 18 nt, Human
ccgccgccgccgccgccg

SEQ ID NO: 899416 - RNA, 22 nt, Human
ccgccgccgccgccgccgccgc

SEQ ID NO: 899417 - RNA, 25 nt, Human
ccgccgccgccgccgccgccgccgg

SEQ ID NO: 899418 - RNA, 23 nt, Human
ccgccgccgccgccgccgccgcu

SEQ ID NO: 899419 - RNA, 19 nt, Human
ccgccgccgccgccgcugg

SEQ ID NO: 899420 - RNA, 23 nt, Human
ccgccugggcucgcggcacccuc

SEQ ID NO: 899421 - RNA, 22 nt, Human
ccuccgccgccgccgccgccgc

SEQ ID NO: 899422 - RNA, 24 nt, Human
ccuccgccgccgccgccgccgccg

SEQ ID NO: 899423 - RNA, 23 nt, Human
ccugcgccgggggugggggggca

SEQ ID NO: 899424 - RNA, 21 nt, Human
ccugggacuggggcugggggc

SEQ ID NO: 899425 - RNA, 21 nt, Human
cgaagccgggcccagucaguc

SEQ ID NO: 899426 - RNA, 21 nt, Human
cgaggcgcccagugcauccuu

SEQ ID NO: 899427 - RNA, 21 nt, Human
cgccgggggugggggggcacu

SEQ ID NO: 899428 - RNA, 19 nt, Human
cgcggccaggagcgagugc

SEQ ID NO: 899429 - RNA, 22 nt, Human
cgcugggcccgcggccaggagc

SEQ ID NO: 899430 - RNA, 19 nt, Human
cgggggugggggggcacuu

SEQ ID NO: 899431 - RNA, 21 nt, Human
cgucccgggcucauccccucc

SEQ ID NO: 899432 - RNA, 19 nt, Human
cuccguccagccgaagaga

SEQ ID NO: 899433 - RNA, 25 nt, Human
cugcacauacauuuuuccaaucaaa

SEQ ID NO: 899434 - RNA, 20 nt, Human
gagcggcgggaggggggcac

SEQ ID NO: 899435 - RNA, 19 nt, Human
gaggaggcagccuccgucc

SEQ ID NO: 899436 - RNA, 24 nt, Human
gccgacuagcgagucugucagucu

SEQ ID NO: 899437 - RNA, 20 nt, Human
gcgugaggaggcagccuccg

SEQ ID NO: 899438 - RNA, 24 nt, Human
ggagagaagcggggaaaggcucuc

SEQ ID NO: 899439 - RNA, 20 nt, Human
ggcagggguccgcgcgguac

SEQ ID NO: 899440 - RNA, 25 nt, Human
ggcccagucagucuugcccaccugg

SEQ ID NO: 899441 - RNA, 18 nt, Human
gggacuggggcugggggc

SEQ ID NO: 899442 - RNA, 24 nt, Human
gggcacuuagcgcugcuguccgua

SEQ ID NO: 899443 - RNA, 22 nt, Human
ggguguucgccgccugggcucg

SEQ ID NO: 899444 - RNA, 21 nt, Human
gugcacccugcgccgggggug

SEQ ID NO: 899445 - RNA, 22 nt, Human
uaaaaaaaagaaagaaagaaaa

SEQ ID NO: 899446 - RNA, 21 nt, Human
uaacacaacggaaaugggaac

SEQ ID NO: 899447 - RNA, 24 nt, Human
uaaccguguaccucagccuguacc

SEQ ID NO: 899448 - RNA, 21 nt, Human
uagcugauggcacccaagcac

SEQ ID NO: 899449 - RNA, 18 nt, Human
ucacaguagguguucaua

SEQ ID NO: 899450 - RNA, 21 nt, Human
uccccuccgccgccgccgcua

SEQ ID NO: 899451 - RNA, 19 nt, Human
ucgcugcgccagggguacc

SEQ ID NO: 899452 - RNA, 23 nt, Human
ucuaaaaacuuugauuuggaaau

SEQ ID NO: 899453 - RNA, 20 nt, Human
ucuugcccaccugggacugg

SEQ ID NO: 899454 - RNA, 22 nt, Human
ugaguagagcggcgggaggggg

SEQ ID NO: 899455 - RNA, 24 nt, Human
ugaguagagcggcgggaggggggc

SEQ ID NO: 899456 - RNA, 22 nt, Human
ugcgaggcgcccagugcauccu

SEQ ID NO: 899457 - RNA, 20 nt, Human
ugcuguccguacagcauccc

SEQ ID NO: 899458 - RNA, 19 nt, Human
uggcugaguagagcggcgg

SEQ ID NO: 899459 - RNA, 20 nt, Human
uguaacaugcugcacauaca

SEQ ID NO: 899460 - RNA, 21 nt, Human
uucccaugguuuugcuaaccg

SEQ ID NO: 899461 - RNA, 26 nt, Human
uuguuucucaagucgccauuuucaau

SEQ ID NO: 899462 - RNA, 27 nt, Human
aaaaauuaaaaggaaauauucagacaa

SEQ ID NO: 899463 - RNA, 22 nt, Human
aaacaagaaagaaaaaaaagaa

SEQ ID NO: 899464 - RNA, 26 nt, Human
aaacaagaaagaaaaaaaagaagcaa

SEQ ID NO: 899465 - RNA, 22 nt, Human
aaagaaaaaaaagaagcaaaga

SEQ ID NO: 899466 - RNA, 20 nt, Human
aagaaagaaaaaaaagaagc

SEQ ID NO: 899467 - RNA, 23 nt, Human
aagaaagaaaaaaaagaagcaaa

SEQ ID NO: 899468 - RNA, 28 nt, Human
aagaaagaaaaaaaagaagcaaagaaaa

SEQ ID NO: 899469 - RNA, 19 nt, Human
acaagaaagaaaaaaaaga

SEQ ID NO: 899470 - RNA, 21 nt, Human
agaaaaaaaagaagcaaagaa

SEQ ID NO: 899471 - RNA, 25 nt, Human
agaaagaaaaaaaagaagcaaagaa

SEQ ID NO: 899472 - RNA, 24 nt, Human
agcaggacaauaaaaaauacugag

SEQ ID NO: 899473 - RNA, 18 nt, Human
aggaacaaaggacaauag

SEQ ID NO: 899474 - RNA, 20 nt, Human
aggggguggggggguggggg

SEQ ID NO: 899475 - RNA, 18 nt, Human
agucuaaaagcacacuag

SEQ ID NO: 899476 - RNA, 20 nt, Human
aucaauauaauacaugaagg

SEQ ID NO: 899477 - RNA, 20 nt, Human
aucacuguccggugaacugg

SEQ ID NO: 899478 - RNA, 18 nt, Human
augacacuuugauuggau

SEQ ID NO: 899479 - RNA, 24 nt, Human
auugcaauuaaaaaguaguuaacc

SEQ ID NO: 899480 - RNA, 19 nt, Human
caauagccuuaaaaagcag

SEQ ID NO: 899481 - RNA, 18 nt, Human
caggacaauaaaaaauac

SEQ ID NO: 899482 - RNA, 21 nt, Human
caggacaauaaaaaauacuga

SEQ ID NO: 899483 - RNA, 24 nt, Human
caucuggguugcaaaugacacuuu

SEQ ID NO: 899484 - RNA, 19 nt, Human
cggcgucuccggcaagccu

SEQ ID NO: 899485 - RNA, 22 nt, Human
gaugcacaauuaccuagaauug

SEQ ID NO: 899486 - RNA, 18 nt, Human
gcagcgccucauggccaa

SEQ ID NO: 899487 - RNA, 19 nt, Human
gcccuccccacggcgucuc

SEQ ID NO: 899488 - RNA, 22 nt, Human
gcggcggaaagucuaaaagcac

SEQ ID NO: 899489 - RNA, 22 nt, Human
ggaaagucuaaaagcacacuag

SEQ ID NO: 899490 - RNA, 20 nt, Human
gggaagaaaaacaagaaaga

SEQ ID NO: 899491 - RNA, 18 nt, Human
gguggggggguggggggg

SEQ ID NO: 899492 - RNA, 22 nt, Human
gugggggggaagaaaaacaaga

SEQ ID NO: 899493 - RNA, 21 nt, Human
guugcaaaugacacuuugauu

SEQ ID NO: 899494 - RNA, 22 nt, Human
uaaaaaauacugagcauggaau

SEQ ID NO: 899495 - RNA, 20 nt, Human
uaaaagcacacuagcuguag

SEQ ID NO: 899496 - RNA, 23 nt, Human
uacaugaaggaacaaaggacaau

SEQ ID NO: 899497 - RNA, 24 nt, Human
uagcaggacaauaaaaaauacuga

SEQ ID NO: 899498 - RNA, 21 nt, Human
uagccuuaaaaagcagguuuc

SEQ ID NO: 899499 - RNA, 21 nt, Human
uauucagacaauagccaagca

SEQ ID NO: 899500 - RNA, 23 nt, Human
ucugcggcggaaagucuaaaagc

SEQ ID NO: 899501 - RNA, 25 nt, Human
ugaacuggcaaauccaaucaaagca

SEQ ID NO: 899502 - RNA, 21 nt, Human
uguaauguucaaauggcccuc

SEQ ID NO: 899503 - RNA, 20 nt, Human
uucaaauggcccuccccacc

SEQ ID NO: 899504 - RNA, 20 nt, Human
aaaccaggaaaaccuccgcu

SEQ ID NO: 899505 - RNA, 21 nt, Human
accaggaaaaccuccgcugcg

SEQ ID NO: 899506 - RNA, 22 nt, Human
aggaaaaccuccgcugcgucuc

SEQ ID NO: 899507 - RNA, 24 nt, Human
ccccaggggccggaugcccagccc

SEQ ID NO: 899508 - RNA, 19 nt, Human
ccgaaaccaggaaaaccuc

SEQ ID NO: 899509 - RNA, 19 nt, Human
ccgaaaccaggaaaaccuc

SEQ ID NO: 899510 - RNA, 23 nt, Human
ccgaaaccaggaaaaccuccgcu

SEQ ID NO: 899511 - RNA, 18 nt, Human
ccgccgccgcugcucgcc

SEQ ID NO: 899512 - RNA, 19 nt, Human
ccgccgccgcugcucgccg

SEQ ID NO: 899513 - RNA, 19 nt, Human
ccgccgccgcugcucgccg

SEQ ID NO: 899514 - RNA, 18 nt, Human
ccgcgccgccgccgcugc

SEQ ID NO: 899515 - RNA, 18 nt, Human
ccgcgccgccgccgcugc

SEQ ID NO: 899516 - RNA, 22 nt, Human
ccggccgcugggguccgaaacc

SEQ ID NO: 899517 - RNA, 18 nt, Human
cgaaaccaggaaaaccuc

SEQ ID NO: 899518 - RNA, 21 nt, Human
cgccgccgccgcugcucgccg

SEQ ID NO: 899519 - RNA, 18 nt, Human
cuccgcgccgccgccgcu

SEQ ID NO: 899520 - RNA, 19 nt, Human
ggagugagcguuuauuugc

SEQ ID NO: 899521 - RNA, 24 nt, Human
guggccccaggggccggaugccca

SEQ ID NO: 899522 - RNA, 18 nt, Human
uagaauuaaagcaaauac

SEQ ID NO: 899523 - RNA, 22 nt, Human
ucaguaucacaaacacaauauu

SEQ ID NO: 899524 - RNA, 25 nt, Human
uccgcgccgccgccgcugcucgccg

SEQ ID NO: 899525 - RNA, 21 nt, Human
uccuacccacccggcugacaa

SEQ ID NO: 899526 - RNA, 18 nt, Human
ucuccgcgccgccgccgc

SEQ ID NO: 899527 - RNA, 23 nt, Human
ucuccgcgccgccgccgcugcuc

SEQ ID NO: 899528 - RNA, 18 nt, Human
uuccuacccacccggcug

SEQ ID NO: 899529 - RNA, 18 nt, Human
aaaaaacaacucaaggac

SEQ ID NO: 899530 - RNA, 22 nt, Human
aaaaaacaacucaaggacacug

SEQ ID NO: 899531 - RNA, 24 nt, Human
aaaaaagcccugguggugggagua

SEQ ID NO: 899532 - RNA, 22 nt, Human
aaaagccuauacucaggagccc

SEQ ID NO: 899533 - RNA, 23 nt, Human
aaacaacucaaggacacugccca

SEQ ID NO: 899534 - RNA, 21 nt, Human
aaacaagauuaagccagcuua

SEQ ID NO: 899535 - RNA, 22 nt, Human
aaacagaaagccaacagcaggg

SEQ ID NO: 899536 - RNA, 24 nt, Human
aaacagaaagccaacagcagggaa

SEQ ID NO: 899537 - RNA, 22 nt, Human
aaagaaaauacacaagucuuaa

SEQ ID NO: 899538 - RNA, 23 nt, Human
aaaugccagaauaacacuaagcu

SEQ ID NO: 899539 - RNA, 20 nt, Human
aagaaagaaaauacacaagu

SEQ ID NO: 899540 - RNA, 24 nt, Human
aagaaagaaaauacacaagucuua

SEQ ID NO: 899541 - RNA, 24 nt, Human
aagcccagguaagagugucaaaaa

SEQ ID NO: 899542 - RNA, 18 nt, Human
aaguauccagucccuaag

SEQ ID NO: 899543 - RNA, 19 nt, Human
aauaggcaacccucacccu

SEQ ID NO: 899544 - RNA, 22 nt, Human
acacagagaagcccagguaaga

SEQ ID NO: 899545 - RNA, 23 nt, Human
acagcgaggagcccucucgucug

SEQ ID NO: 899546 - RNA, 19 nt, Human
acaggaagcaaagaaagaa

SEQ ID NO: 899547 - RNA, 23 nt, Human
acccaaucuagaucucucccccu

SEQ ID NO: 899548 - RNA, 22 nt, Human
acccugagccccucaguguccu

SEQ ID NO: 899549 - RNA, 22 nt, Human
accuuggggccugggccugcag

SEQ ID NO: 899550 - RNA, 18 nt, Human
acuuccccucuuccccca

SEQ ID NO: 899551 - RNA, 27 nt, Human
agaaagccaacagcagggaaaccugag

SEQ ID NO: 899552 - RNA, 21 nt, Human
agacagucccucccccucuag

SEQ ID NO: 899553 - RNA, 20 nt, Human
agauggaugagugggugggu

SEQ ID NO: 899554 - RNA, 22 nt, Human
agcaaagaaagaaaauacacaa

SEQ ID NO: 899555 - RNA, 23 nt, Human
agccaggagcaagaacuccuggc

SEQ ID NO: 899556 - RNA, 24 nt, Human
agccaggagcaagaacuccuggca

SEQ ID NO: 899557 - RNA, 18 nt, Human
aggcaacccucacccuga

SEQ ID NO: 899558 - RNA, 22 nt, Human
aggcaucccccaaaaaagcccu

SEQ ID NO: 899559 - RNA, 20 nt, Human
aguguccuucccuagacagc

SEQ ID NO: 899560 - RNA, 24 nt, Human
auggaaaacaauuucaacgaguca

SEQ ID NO: 899561 - RNA, 21 nt, Human
caaaaaacaacucaaggacac

SEQ ID NO: 899562 - RNA, 23 nt, Human
caacccucacccugagccccuca

SEQ ID NO: 899563 - RNA, 20 nt, Human
caagaaggagaccuuggggc

SEQ ID NO: 899564 - RNA, 24 nt, Human
caauaggcaacccucacccugagc

SEQ ID NO: 899565 - RNA, 18 nt, Human
cacaguaacacaacacac

SEQ ID NO: 899566 - RNA, 18 nt, Human
caccgccgccgccgccgc

SEQ ID NO: 899567 - RNA, 18 nt, Human
cacuucuacacucccagc

SEQ ID NO: 899568 - RNA, 24 nt, Human
cagagcagagucucagacacuacu

SEQ ID NO: 899569 - RNA, 19 nt, Human
cagcagggaaaccugagcc

SEQ ID NO: 899570 - RNA, 22 nt, Human
caggcaucccccaaaaaagccc

SEQ ID NO: 899571 - RNA, 20 nt, Human
ccaaaaaagcccugguggug

SEQ ID NO: 899572 - RNA, 26 nt, Human
ccaaaugccagaauaacacuaagcug

SEQ ID NO: 899573 - RNA, 22 nt, Human
ccaacugacccuucccggccgu

SEQ ID NO: 899574 - RNA, 22 nt, Human
ccagcuuaaccaaaugccagaa

SEQ ID NO: 899575 - RNA, 22 nt, Human
ccaggccagacgcaaaugcaca

SEQ ID NO: 899576 - RNA, 18 nt, Human
cccagacagucccucccc

SEQ ID NO: 899577 - RNA, 18 nt, Human
cccccaaaaaagcccugg

SEQ ID NO: 899578 - RNA, 19 nt, Human
cccccucuaggcaaugucc

SEQ ID NO: 899579 - RNA, 19 nt, Human
cccccucuaggcaaugucc

SEQ ID NO: 899580 - RNA, 23 nt, Human
ccccgucccccucacccaaucua

SEQ ID NO: 899581 - RNA, 23 nt, Human
ccccugaacccagacagucccuc

SEQ ID NO: 899582 - RNA, 20 nt, Human
cccugaacccagacaguccc

SEQ ID NO: 899583 - RNA, 18 nt, Human
ccgccgccgccgccgccg

SEQ ID NO: 899584 - RNA, 18 nt, Human
ccgccgccgccgccgccg

SEQ ID NO: 899585 - RNA, 22 nt, Human
ccucuaggcaauguccuccccu

SEQ ID NO: 899586 - RNA, 22 nt, Human
cgaggagcccucucgucugucc

SEQ ID NO: 899587 - RNA, 20 nt, Human
cggcucugcucagggugggg

SEQ ID NO: 899588 - RNA, 23 nt, Human
cgggccgagcgccuccuuuugcc

SEQ ID NO: 899589 - RNA, 20 nt, Human
cgucugucccagggcugccu

SEQ ID NO: 899590 - RNA, 22 nt, Human
cuaaugccaguucauaaacauc

SEQ ID NO: 899591 - RNA, 22 nt, Human
cuccaggccaugccccugaacc

SEQ ID NO: 899592 - RNA, 21 nt, Human
cucccccucuaggcaaugucc

SEQ ID NO: 899593 - RNA, 19 nt, Human
gaaaacaguuaagggcagg

SEQ ID NO: 899594 - RNA, 20 nt, Human
gaaccugguggggaggcagc

SEQ ID NO: 899595 - RNA, 18 nt, Human
gacaggaagcaaagaaag

SEQ ID NO: 899596 - RNA, 19 nt, Human
gagcaagaacuccuggcag

SEQ ID NO: 899597 - RNA, 22 nt, Human
gccccugaacccagacaguccc

SEQ ID NO: 899598 - RNA, 18 nt, Human
gcccuccaggccaugccc

SEQ ID NO: 899599 - RNA, 23 nt, Human
gccgucaccgccgccgccgccgg

SEQ ID NO: 899600 - RNA, 20 nt, Human
gccuccaacugacccuuccc

SEQ ID NO: 899601 - RNA, 21 nt, Human
gcgcuacccuaggcccugcag

SEQ ID NO: 899602 - RNA, 19 nt, Human
ggagaccuuggggccuggg

SEQ ID NO: 899603 - RNA, 21 nt, Human
ggccaugccccugaacccaga

SEQ ID NO: 899604 - RNA, 23 nt, Human
ggccugggccugcagccaggagc

SEQ ID NO: 899605 - RNA, 22 nt, Human
ggugacaggaagcaaagaaaga

SEQ ID NO: 899606 - RNA, 22 nt, Human
ggugacaggaagcaaagaaaga

SEQ ID NO: 899607 - RNA, 24 nt, Human
guggcucuuggguaaagcaucccc

SEQ ID NO: 899608 - RNA, 20 nt, Human
uaaaggcccaggcauccccc

SEQ ID NO: 899609 - RNA, 22 nt, Human
uaacacaacacacuugccuccc

SEQ ID NO: 899610 - RNA, 20 nt, Human
uaaccaaaacagaaagccaa

SEQ ID NO: 899611 - RNA, 24 nt, Human
uaauaaccaaaacagaaagccaac

SEQ ID NO: 899612 - RNA, 20 nt, Human
uacccuaggcccugcagagc

SEQ ID NO: 899613 - RNA, 18 nt, Human
uacugauaacauuaaaca

SEQ ID NO: 899614 - RNA, 19 nt, Human
uagaaaaagcuguuuagug

SEQ ID NO: 899615 - RNA, 24 nt, Human
uaggcaacccucacccugagcccc

SEQ ID NO: 899616 - RNA, 30 nt, Human
uauacuguucuuuauggaaaacaauuucaa

SEQ ID NO: 899617 - RNA, 21 nt, Human
ucaaaaaacaacucaaggaca

SEQ ID NO: 899618 - RNA, 22 nt, Human
ucacccugagccccucaguguc

SEQ ID NO: 899619 - RNA, 24 nt, Human
ucaccgccgccgccgccgccgccg

SEQ ID NO: 899620 - RNA, 23 nt, Human
ucagccagccagaaguauccagu

SEQ ID NO: 899621 - RNA, 19 nt, Human
uccagucccuaagaacgga

SEQ ID NO: 899622 - RNA, 19 nt, Human
ucccagcgcuacccuaggc

SEQ ID NO: 899623 - RNA, 22 nt, Human
ucccagcgcuacccuaggcccu

SEQ ID NO: 899624 - RNA, 19 nt, Human
ucccagggcugccuaacuu

SEQ ID NO: 899625 - RNA, 21 nt, Human
uccccuaggcuagauagaaca

SEQ ID NO: 899626 - RNA, 22 nt, Human
ucccuaagaacggauugcccca

SEQ ID NO: 899627 - RNA, 18 nt, Human
ugaaaacaguuaagggca

SEQ ID NO: 899628 - RNA, 22 nt, Human
ugacaggaagcaaagaaagaaa

SEQ ID NO: 899629 - RNA, 19 nt, Human
ugagugggugggugugggg

SEQ ID NO: 899630 - RNA, 19 nt, Human
ugccccacaauucccaggc

SEQ ID NO: 899631 - RNA, 18 nt, Human
ugccccugaacccagaca

SEQ ID NO: 899632 - RNA, 22 nt, Human
ugccccugaacccagacagucc

SEQ ID NO: 899633 - RNA, 23 nt, Human
ugccucccugacauccccguccc

SEQ ID NO: 899634 - RNA, 23 nt, Human
uggaaaacaauuucaacgaguca

SEQ ID NO: 899635 - RNA, 24 nt, Human
uggauagauggaugaguggguggg

SEQ ID NO: 899636 - RNA, 19 nt, Human
ugggaggaggcggcgcagg

SEQ ID NO: 899637 - RNA, 22 nt, Human
ugggaggaggcggcgcagggag

SEQ ID NO: 899638 - RNA, 22 nt, Human
ugggaguaaauuucaaugcccc

SEQ ID NO: 899639 - RNA, 21 nt, Human
ugucaggccgcgggccgagcg

SEQ ID NO: 899640 - RNA, 23 nt, Human
uuaaccaaaugccagaauaacac

SEQ ID NO: 899641 - RNA, 23 nt, Human
uuacugcuguuugugaccccaag

SEQ ID NO: 899642 - RNA, 19 nt, Human
uucccggccgucaccgccg

SEQ ID NO: 899643 - RNA, 21 nt, Human
uugcuauauauuccucuuccu

SEQ ID NO: 899644 - RNA, 20 nt, Human
accucuuacaaggcaguuuu

SEQ ID NO: 899645 - RNA, 19 nt, Human
agacagaggggcgacaccu

SEQ ID NO: 899646 - RNA, 20 nt, Human
ccucaaagcguuggaauaag

SEQ ID NO: 899647 - RNA, 21 nt, Human
cuguggcaaagugaaguucac

SEQ ID NO: 899648 - RNA, 18 nt, Human
gcaguuuuucaguucagu

SEQ ID NO: 899649 - RNA, 23 nt, Human
ucacagguggguggcagagguuu

SEQ ID NO: 899650 - RNA, 19 nt, Human
ucccggagagugauccggu

SEQ ID NO: 899651 - RNA, 20 nt, Human
ucccuguggcaaagugaagu

SEQ ID NO: 899652 - RNA, 22 nt, Human
uccugaaucacaucccgggccc

SEQ ID NO: 899653 - RNA, 23 nt, Human
uccugaaucacaucccgggcccc

SEQ ID NO: 899654 - RNA, 20 nt, Human
ugucaaggcuuccagccccu

SEQ ID NO: 899655 - RNA, 20 nt, Human
aaaaaacaguaaaaucuaca

SEQ ID NO: 899656 - RNA, 24 nt, Human
aaaacccuucaaaacaguccauau

SEQ ID NO: 899657 - RNA, 18 nt, Human
aaacugauacaucucuca

SEQ ID NO: 899658 - RNA, 23 nt, Human
aaagacaagagacgggccaccaa

SEQ ID NO: 899659 - RNA, 21 nt, Human
aaaggaugagaagaggcagag

SEQ ID NO: 899660 - RNA, 19 nt, Human
aaauuauuuuuccacacug

SEQ ID NO: 899661 - RNA, 23 nt, Human
aagccgaaagucauaaaccagga

SEQ ID NO: 899662 - RNA, 18 nt, Human
aagcgcggcaccgacacc

SEQ ID NO: 899663 - RNA, 24 nt, Human
aaggagaaauagaacagcgcaggc

SEQ ID NO: 899664 - RNA, 23 nt, Human
aaugaaaaaugcaccgagccaaa

SEQ ID NO: 899665 - RNA, 21 nt, Human
acaaagccgaaagucauaaac

SEQ ID NO: 899666 - RNA, 20 nt, Human
acacugcagagcagcagagc

SEQ ID NO: 899667 - RNA, 22 nt, Human
accuccauggacaaguugggag

SEQ ID NO: 899668 - RNA, 25 nt, Human
agaaacugauacaucucucaaauaa

SEQ ID NO: 899669 - RNA, 20 nt, Human
agaagaaaggcgcgggcugg

SEQ ID NO: 899670 - RNA, 26 nt, Human
agacaagagacgggccaccaagccua

SEQ ID NO: 899671 - RNA, 23 nt, Human
agacaagagacgggccaccaagg

SEQ ID NO: 899672 - RNA, 20 nt, Human
agagcagcagagcgagaaag

SEQ ID NO: 899673 - RNA, 18 nt, Human
agcagcagagcgagaaag

SEQ ID NO: 899674 - RNA, 19 nt, Human
aggcaaaagaagaaaggcg

SEQ ID NO: 899675 - RNA, 23 nt, Human
aggcaaaagaagaaaggcgcggg

SEQ ID NO: 899676 - RNA, 18 nt, Human
agucauaaaccaggaaag

SEQ ID NO: 899677 - RNA, 19 nt, Human
augcaccgagccaaacaaa

SEQ ID NO: 899678 - RNA, 18 nt, Human
caaaguuuuagccugaaa

SEQ ID NO: 899679 - RNA, 20 nt, Human
caagauaauucuggcagcaa

SEQ ID NO: 899680 - RNA, 20 nt, Human
caagcuuaaccugcaacuuc

SEQ ID NO: 899681 - RNA, 24 nt, Human
cacaaagccgaaagucauaaacca

SEQ ID NO: 899682 - RNA, 19 nt, Human
cacauucuaaauacacuaa

SEQ ID NO: 899683 - RNA, 19 nt, Human
cacugcagagcagcagagc

SEQ ID NO: 899684 - RNA, 21 nt, Human
cagcaacagcccacuugacac

SEQ ID NO: 899685 - RNA, 22 nt, Human
cagcaacagcccacuugacacc

SEQ ID NO: 899686 - RNA, 19 nt, Human
cagcaguggcggcggcggc

SEQ ID NO: 899687 - RNA, 24 nt, Human
cagcccacuugacaccaagcugga

SEQ ID NO: 899688 - RNA, 19 nt, Human
cauaaaccaggaaagacaa

SEQ ID NO: 899689 - RNA, 23 nt, Human
ccaccaagccuaugucugggucc

SEQ ID NO: 899690 - RNA, 26 nt, Human
ccacuaagucauccauuuuguugcau

SEQ ID NO: 899691 - RNA, 19 nt, Human
ccgagccaaacaaaacuua

SEQ ID NO: 899692 - RNA, 22 nt, Human
ccuccauggacaaguugggaga

SEQ ID NO: 899693 - RNA, 22 nt, Human
cgagaaaggaugagaagaggca

SEQ ID NO: 899694 - RNA, 23 nt, Human
cgagccaaacaaaacuuaacugg

SEQ ID NO: 899695 - RNA, 18 nt, Human
cguugaagucgaacugcu

SEQ ID NO: 899696 - RNA, 19 nt, Human
cuagcuagccccuuuccca

SEQ ID NO: 899697 - RNA, 25 nt, Human
cuauacagcacuucuccuaggcccu

SEQ ID NO: 899698 - RNA, 19 nt, Human
cucuauacagcacuucucc

SEQ ID NO: 899699 - RNA, 20 nt, Human
cugggugaaagacaugaacu

SEQ ID NO: 899700 - RNA, 22 nt, Human
cugggugggaagaggauucgga

SEQ ID NO: 899701 - RNA, 22 nt, Human
cuugacaccaagcuggaugaau

SEQ ID NO: 899702 - RNA, 18 nt, Human
gaaagacaagagacgggc

SEQ ID NO: 899703 - RNA, 18 nt, Human
gaaggagaaauagaacag

SEQ ID NO: 899704 - RNA, 22 nt, Human
gacggcagaagaaaaaaggaaa

SEQ ID NO: 899705 - RNA, 21 nt, Human
gagcagcagagcgagaaagga

SEQ ID NO: 899706 - RNA, 24 nt, Human
gaggcagagaaggcgacggcagaa

SEQ ID NO: 899707 - RNA, 20 nt, Human
gcugcgggaacgacuugggg

SEQ ID NO: 899708 - RNA, 21 nt, Human
ggccugggccauaggcugcgg

SEQ ID NO: 899709 - RNA, 19 nt, Human
ggcgacggcagaagaaaaa

SEQ ID NO: 899710 - RNA, 21 nt, Human
gggcugggugggaagaggauu

SEQ ID NO: 899711 - RNA, 21 nt, Human
uaaaccaggaaagacaagaga

SEQ ID NO: 899712 - RNA, 26 nt, Human
uaaagaaaaaaacccuucaaaacagu

SEQ ID NO: 899713 - RNA, 22 nt, Human
uaaaugaaaaaugcaccgagcc

SEQ ID NO: 899714 - RNA, 23 nt, Human
uaacugggcuauaaagaaaaaaa

SEQ ID NO: 899715 - RNA, 21 nt, Human
uaaugggcuuccaucuccacu

SEQ ID NO: 899716 - RNA, 20 nt, Human
uacaagacuuuaaacacaaa

SEQ ID NO: 899717 - RNA, 19 nt, Human
uagaacagcgcaggcaaaa

SEQ ID NO: 899718 - RNA, 21 nt, Human
uagaacagcgcaggcaaaaga

SEQ ID NO: 899719 - RNA, 20 nt, Human
uagccugaaaaaacaguaaa

SEQ ID NO: 899720 - RNA, 24 nt, Human
uagcuagccccuuucccaaaguuu

SEQ ID NO: 899721 - RNA, 19 nt, Human
uaggucaacaaauacuaug

SEQ ID NO: 899722 - RNA, 20 nt, Human
uauacagcacuucuccuagg

SEQ ID NO: 899723 - RNA, 23 nt, Human
ucaaauaaucacaagauaauucu

SEQ ID NO: 899724 - RNA, 23 nt, Human
ucacacugcagagcagcagagcg

SEQ ID NO: 899725 - RNA, 24 nt, Human
ucagaagaaacugauacaucucuc

SEQ ID NO: 899726 - RNA, 22 nt, Human
ucauacaaggguuacauuaggu

SEQ ID NO: 899727 - RNA, 23 nt, Human
uccacaaagccgaaagucauaaa

SEQ ID NO: 899728 - RNA, 23 nt, Human
uccacacuggaauguugaccaga

SEQ ID NO: 899729 - RNA, 25 nt, Human
uccccaaugaauuauagaugaaagc

SEQ ID NO: 899730 - RNA, 24 nt, Human
ucuaaaucucccauuauccccaau

SEQ ID NO: 899731 - RNA, 25 nt, Human
ucuccuaggcccucuggguaguugu

SEQ ID NO: 899732 - RNA, 19 nt, Human
ucucuauacagcacuucuc

SEQ ID NO: 899733 - RNA, 25 nt, Human
ugaaaaaacaguaaaaucuacacaa

SEQ ID NO: 899734 - RNA, 21 nt, Human
ugaauuauagaugaaagcuga

SEQ ID NO: 899735 - RNA, 20 nt, Human
ugagaagaggcagagaaggc

SEQ ID NO: 899736 - RNA, 21 nt, Human
ugagaagaggcagagaaggcg

SEQ ID NO: 899737 - RNA, 23 nt, Human
ugagaagaggcagagaaggcgac

SEQ ID NO: 899738 - RNA, 19 nt, Human
ugagauaacggcccaaaga

SEQ ID NO: 899739 - RNA, 22 nt, Human
ugagauaacggcccaaagaguc

SEQ ID NO: 899740 - RNA, 20 nt, Human
ugagcagaaauacccaaggc

SEQ ID NO: 899741 - RNA, 18 nt, Human
ugcaacaaacugcuacaa

SEQ ID NO: 899742 - RNA, 22 nt, Human
ugggaagaggauucggacucgu

SEQ ID NO: 899743 - RNA, 20 nt, Human
uguugccaaaagaauuaaga

SEQ ID NO: 899744 - RNA, 18 nt, Human
uucuggcagcaacagccc

SEQ ID NO: 899745 - RNA, 19 nt, Human
agcaucagggcugugcgcc

SEQ ID NO: 899746 - RNA, 19 nt, Human
aggggcgccagcccagggc

SEQ ID NO: 899747 - RNA, 18 nt, Human
caccacaguggaaggucu

SEQ ID NO: 899748 - RNA, 20 nt, Human
caccacaguggaaggucucc

SEQ ID NO: 899749 - RNA, 21 nt, Human
caccacaguggugauggucuc

SEQ ID NO: 899750 - RNA, 20 nt, Human
cacccugcgggcccaucuuc

SEQ ID NO: 899751 - RNA, 18 nt, Human
cacgcacuagcccgcgcg

SEQ ID NO: 899752 - RNA, 18 nt, Human
cacgcugagcagcacagg

SEQ ID NO: 899753 - RNA, 19 nt, Human
cacugcagccacgagcugc

SEQ ID NO: 899754 - RNA, 21 nt, Human
cagcucacacucguagagccc

SEQ ID NO: 899755 - RNA, 19 nt, Human
cagugugggcaccacgggc

SEQ ID NO: 899756 - RNA, 21 nt, Human
ccacacugccucuggcaucca

SEQ ID NO: 899757 - RNA, 22 nt, Human
ccacacugccucuggcauccac

SEQ ID NO: 899758 - RNA, 22 nt, Human
ccacaguggaaggucuccccuu

SEQ ID NO: 899759 - RNA, 22 nt, Human
ccaccgugggcuccccgaucuc

SEQ ID NO: 899760 - RNA, 19 nt, Human
ccagcaccuggcagguaca

SEQ ID NO: 899761 - RNA, 20 nt, Human
ccaggcugcccaugccagaa

SEQ ID NO: 899762 - RNA, 24 nt, Human
cccaagccaccauggcagcagcau

SEQ ID NO: 899763 - RNA, 18 nt, Human
cccacagccgagcggggc

SEQ ID NO: 899764 - RNA, 19 nt, Human
cccaucuucuucacccgga

SEQ ID NO: 899765 - RNA, 23 nt, Human
cccccucuuccucucccgccucc

SEQ ID NO: 899766 - RNA, 21 nt, Human
cccugcgggcccaucuucuuc

SEQ ID NO: 899767 - RNA, 19 nt, Human
ccgucucccccacuguccc

SEQ ID NO: 899768 - RNA, 18 nt, Human
ccgucuucccccucuucc

SEQ ID NO: 899769 - RNA, 20 nt, Human
ccucaggaggacccagggcu

SEQ ID NO: 899770 - RNA, 23 nt, Human
ccucaggaggacccagggcugcu

SEQ ID NO: 899771 - RNA, 20 nt, Human
ccuccacccacuugggcugg

SEQ ID NO: 899772 - RNA, 23 nt, Human
ccuccaccuccacccacuugggc

SEQ ID NO: 899773 - RNA, 21 nt, Human
ccugcagcauggggcucugaa

SEQ ID NO: 899774 - RNA, 19 nt, Human
ccuggccucagcgggcugg

SEQ ID NO: 899775 - RNA, 25 nt, Human
ccugugacacugcuccugggccugc

SEQ ID NO: 899776 - RNA, 19 nt, Human
cgcugccccaagccaccau

SEQ ID NO: 899777 - RNA, 21 nt, Human
cggggcuggccagcaccuggc

SEQ ID NO: 899778 - RNA, 18 nt, Human
cuccaggcugcccaugcc

SEQ ID NO: 899779 - RNA, 20 nt, Human
cuccgucuucccccucuucc

SEQ ID NO: 899780 - RNA, 23 nt, Human
cuccgucuucccccucuuccucu

SEQ ID NO: 899781 - RNA, 23 nt, Human
cucucuggaucaccgagaccucg

SEQ ID NO: 899782 - RNA, 23 nt, Human
cugcagccacgagcugcucccug

SEQ ID NO: 899783 - RNA, 20 nt, Human
gacccagugcaugccccacg

SEQ ID NO: 899784 - RNA, 20 nt, Human
gagcagcgggaaggugagcg

SEQ ID NO: 899785 - RNA, 22 nt, Human
gagccccagguccuccuugcug

SEQ ID NO: 899786 - RNA, 25 nt, Human
gagccccagguccuccuugcuggcc

SEQ ID NO: 899787 - RNA, 20 nt, Human
gaucaccagcacuagcaggc

SEQ ID NO: 899788 - RNA, 18 nt, Human
gcaccgggcagugugaag

SEQ ID NO: 899789 - RNA, 21 nt, Human
gcagagcagcgggaaggugag

SEQ ID NO: 899790 - RNA, 21 nt, Human
gcagcagcaucagggcugugc

SEQ ID NO: 899791 - RNA, 19 nt, Human
gcagccacgagcugcuccc

SEQ ID NO: 899792 - RNA, 22 nt, Human
gccccaagccaccauggcagca

SEQ ID NO: 899793 - RNA, 29 nt, Human
gccuccuccauggugcccuccuccuccaa

SEQ ID NO: 899794 - RNA, 21 nt, Human
gcgcagucacgcacuagcccg

SEQ ID NO: 899795 - RNA, 23 nt, Human
gcucuggguggaaagcucugugg

SEQ ID NO: 899796 - RNA, 21 nt, Human
ggagagugggccucggccucc

SEQ ID NO: 899797 - RNA, 27 nt, Human
ggagggggacuugcugggggggauccc

SEQ ID NO: 899798 - RNA, 22 nt, Human
ggcagguacagcaggucggggg

SEQ ID NO: 899799 - RNA, 18 nt, Human
ggcagugugaagagaugc

SEQ ID NO: 899800 - RNA, 20 nt, Human
gggcagagcuggagaguggg

SEQ ID NO: 899801 - RNA, 24 nt, Human
gggccucaggaggacccagggcug

SEQ ID NO: 899802 - RNA, 21 nt, Human
gggucccuccgggauccgcac

SEQ ID NO: 899803 - RNA, 20 nt, Human
gguacagcaggucgggggcc

SEQ ID NO: 899804 - RNA, 20 nt, Human
ggugaccgucucccccacug

SEQ ID NO: 899805 - RNA, 18 nt, Human
gugaagcugcucuggcca

SEQ ID NO: 899806 - RNA, 21 nt, Human
guggcggcggggaccucucuc

SEQ ID NO: 899807 - RNA, 21 nt, Human
guggugggagacacacccugc

SEQ ID NO: 899808 - RNA, 19 nt, Human
uacagugugggcaccacgg

SEQ ID NO: 899809 - RNA, 23 nt, Human
uagucucuugcucagugacuucc

SEQ ID NO: 899810 - RNA, 20 nt, Human
uaugaugacgguuuucuugg

SEQ ID NO: 899811 - RNA, 18 nt, Human
ucaccgagaccucgcagg

SEQ ID NO: 899812 - RNA, 18 nt, Human
ucagugacuuccacugca

SEQ ID NO: 899813 - RNA, 22 nt, Human
ucagugacuuccacugcagcca

SEQ ID NO: 899814 - RNA, 24 nt, Human
ucagugacuuccacugcagccacg

SEQ ID NO: 899815 - RNA, 22 nt, Human
uccaggcugcccaugccagaag

SEQ ID NO: 899816 - RNA, 21 nt, Human
uccccaggcacguaaucuucc

SEQ ID NO: 899817 - RNA, 22 nt, Human
uccccaggcacguaaucuucca

SEQ ID NO: 899818 - RNA, 22 nt, Human
ucccugugacacugcuccuggg

SEQ ID NO: 899819 - RNA, 25 nt, Human
ucccugugacacugcuccugggccu

SEQ ID NO: 899820 - RNA, 23 nt, Human
uccgcaccgggcagugugaagag

SEQ ID NO: 899821 - RNA, 19 nt, Human
uccgcagaacgccggaugc

SEQ ID NO: 899822 - RNA, 20 nt, Human
uccgggcagagcuggagagu

SEQ ID NO: 899823 - RNA, 20 nt, Human
uccuaggcccaaggacacuc

SEQ ID NO: 899824 - RNA, 24 nt, Human
uccugggccugcagcauggggcuc

SEQ ID NO: 899825 - RNA, 20 nt, Human
ucucuggaucaccgagaccu

SEQ ID NO: 899826 - RNA, 22 nt, Human
ucuguggugaagcugcucuggc

SEQ ID NO: 899827 - RNA, 23 nt, Human
ugaggcgggcacguccuaggccc

SEQ ID NO: 899828 - RNA, 25 nt, Human
ugccccaagccaccauggcagcagc

SEQ ID NO: 899829 - RNA, 24 nt, Human
ugcccuccuccuccaggcugccca

SEQ ID NO: 899830 - RNA, 24 nt, Human
ugccugggcccaggccuccugggc

SEQ ID NO: 899831 - RNA, 18 nt, Human
ugcgggcccaucuucuuc

SEQ ID NO: 899832 - RNA, 19 nt, Human
ugcucagugacuuccacug

SEQ ID NO: 899833 - RNA, 23 nt, Human
uggaaagcucuguggugaagcug

SEQ ID NO: 899834 - RNA, 24 nt, Human
uggccugguucugccuccggcugc

SEQ ID NO: 899835 - RNA, 19 nt, Human
ugggccugcagcauggggc

SEQ ID NO: 899836 - RNA, 19 nt, Human
ugggcuggggccccgagag

SEQ ID NO: 899837 - RNA, 21 nt, Human
uggggucacgauccccaaggc

SEQ ID NO: 899838 - RNA, 19 nt, Human
uggugaagcugcucuggcc

SEQ ID NO: 899839 - RNA, 22 nt, Human
uguccugggacuccuccgucac

SEQ ID NO: 899840 - RNA, 19 nt, Human
ugucugggcagaugugaag

SEQ ID NO: 899841 - RNA, 20 nt, Human
uguguccugggacuccuccg

SEQ ID NO: 899842 - RNA, 20 nt, Human
uguguguguccugggacucc

SEQ ID NO: 899843 - RNA, 22 nt, Human
uucaauggucuccuccaccucc

SEQ ID NO: 899844 - RNA, 24 nt, Human
uucaauggucuccuccaccuccac

SEQ ID NO: 899845 - RNA, 18 nt, Human
uucccccucuuccucucc

SEQ ID NO: 899846 - RNA, 23 nt, Human
aaaaucacccccugcagaagcuu

SEQ ID NO: 899847 - RNA, 23 nt, Human
aagccugcuuccuuccucuucug

SEQ ID NO: 899848 - RNA, 21 nt, Human
aagcgguagacgccccgaagc

SEQ ID NO: 899849 - RNA, 23 nt, Human
aaggaacaaaaggaaacuaggca

SEQ ID NO: 899850 - RNA, 22 nt, Human
aaggagggggcgucuggggccc

SEQ ID NO: 899851 - RNA, 21 nt, Human
aagugcccaucugaaucaaac

SEQ ID NO: 899852 - RNA, 19 nt, Human
aaguuccuggccagccaaa

SEQ ID NO: 899853 - RNA, 23 nt, Human
acccccugcagaagcuugggaac

SEQ ID NO: 899854 - RNA, 21 nt, Human
acugagugcaaggauagcugg

SEQ ID NO: 899855 - RNA, 20 nt, Human
agaaagggguguccuuggga

SEQ ID NO: 899856 - RNA, 20 nt, Human
agaccccuuuccucccacuc

SEQ ID NO: 899857 - RNA, 22 nt, Human
agacgacagguggcauuagaac

SEQ ID NO: 899858 - RNA, 21 nt, Human
agagacaggaauuccugagca

SEQ ID NO: 899859 - RNA, 21 nt, Human
agaggaggaggagcaggugga

SEQ ID NO: 899860 - RNA, 30 nt, Human
agaggaggaggagcagguggagaaaggggu

SEQ ID NO: 899861 - RNA, 24 nt, Human
agcaagaaaggagggggcgucugg

SEQ ID NO: 899862 - RNA, 20 nt, Human
agccagcagcgcucaccggg

SEQ ID NO: 899863 - RNA, 19 nt, Human
agccauaguggaaagcuuc

SEQ ID NO: 899864 - RNA, 23 nt, Human
agccugucugcugaccagagaau

SEQ ID NO: 899865 - RNA, 21 nt, Human
aggaacaaaaggaaacuaggc

SEQ ID NO: 899866 - RNA, 18 nt, Human
aggaaccguaucggcguc

SEQ ID NO: 899867 - RNA, 20 nt, Human
aggcagcaagaaaggagggg

SEQ ID NO: 899868 - RNA, 18 nt, Human
aggcagcccccucugagu

SEQ ID NO: 899869 - RNA, 24 nt, Human
aggcagggaaggggaagaaaagug

SEQ ID NO: 899870 - RNA, 21 nt, Human
aggcguugcuguccucugcuu

SEQ ID NO: 899871 - RNA, 23 nt, Human
aggcuggaaccgccggcagcagc

SEQ ID NO: 899872 - RNA, 18 nt, Human
agggcacaucuuguggug

SEQ ID NO: 899873 - RNA, 19 nt, Human
agggggaggcuagccuugu

SEQ ID NO: 899874 - RNA, 25 nt, Human
aggugccaugaggucaaugucacuu

SEQ ID NO: 899875 - RNA, 23 nt, Human
agguuccgagucagaggaggagg

SEQ ID NO: 899876 - RNA, 22 nt, Human
aguuccuggccagccaaacucc

SEQ ID NO: 899877 - RNA, 24 nt, Human
auaguggaaagcuucgcaugggcc

SEQ ID NO: 899878 - RNA, 20 nt, Human
caagagcaaaaaucaccccc

SEQ ID NO: 899879 - RNA, 19 nt, Human
caaggaacaaaaggaaacu

SEQ ID NO: 899880 - RNA, 18 nt, Human
caaguuccuggccagcca

SEQ ID NO: 899881 - RNA, 24 nt, Human
caccccaaaacagcuucccuucuu

SEQ ID NO: 899882 - RNA, 22 nt, Human
cacgccuuggggccaaagcccc

SEQ ID NO: 899883 - RNA, 19 nt, Human
cacugccccugcuccaggc

SEQ ID NO: 899884 - RNA, 21 nt, Human
cacuguuauuucucaggacaa

SEQ ID NO: 899885 - RNA, 19 nt, Human
cagcaaggaguguucggga

SEQ ID NO: 899886 - RNA, 27 nt, Human
cagcccccucugaguuugcaggcugga

SEQ ID NO: 899887 - RNA, 19 nt, Human
cagcuucuaagcaugcccu

SEQ ID NO: 899888 - RNA, 24 nt, Human
ccaucugaaucaaacuucagcugc

SEQ ID NO: 899889 - RNA, 20 nt, Human
ccccaaaacagcuucccuuc

SEQ ID NO: 899890 - RNA, 23 nt, Human
ccccacaccccaaaacagcuucc

SEQ ID NO: 899891 - RNA, 18 nt, Human
ccccaggucgguucuccu

SEQ ID NO: 899892 - RNA, 28 nt, Human
cccccucaucauugccaccucuucucca

SEQ ID NO: 899893 - RNA, 24 nt, Human
cccccucugaguuugcaggcugga

SEQ ID NO: 899894 - RNA, 21 nt, Human
ccccucucugagcugcgccac

SEQ ID NO: 899895 - RNA, 21 nt, Human
ccccugcagaagcuugggaac

SEQ ID NO: 899896 - RNA, 20 nt, Human
ccccuuuccucccacucaca

SEQ ID NO: 899897 - RNA, 25 nt, Human
cccgcagcaaagagucccaaauuua

SEQ ID NO: 899898 - RNA, 20 nt, Human
cccuuugggugccuccgcuu

SEQ ID NO: 899899 - RNA, 20 nt, Human
ccgggccgggucggaaacgc

SEQ ID NO: 899900 - RNA, 21 nt, Human
ccgucaggccccucacccggu

SEQ ID NO: 899901 - RNA, 21 nt, Human
ccuccuugcagauccucacug

SEQ ID NO: 899902 - RNA, 30 nt, Human
ccucgccgccucuugcgggcgugcgccugg

SEQ ID NO: 899903 - RNA, 24 nt, Human
ccugcauguguggucuuccuugag

SEQ ID NO: 899904 - RNA, 22 nt, Human
ccugcuggggacuggauccagg

SEQ ID NO: 899905 - RNA, 19 nt, Human
ccugcuuccuuccucuucu

SEQ ID NO: 899906 - RNA, 20 nt, Human
ccuggauccuggggcuuggg

SEQ ID NO: 899907 - RNA, 18 nt, Human
ccuggggcuuggggcugu

SEQ ID NO: 899908 - RNA, 19 nt, Human
ccuggggcuuggggcuguc

SEQ ID NO: 899909 - RNA, 22 nt, Human
ccuggggcuuggggcugucuuc

SEQ ID NO: 899910 - RNA, 18 nt, Human
ccuuucuccuucuuuccc

SEQ ID NO: 899911 - RNA, 22 nt, Human
cgaguccagucuccccuguucc

SEQ ID NO: 899912 - RNA, 19 nt, Human
cgccggcagcagcaaggag

SEQ ID NO: 899913 - RNA, 26 nt, Human
cgccuaagaaaaauccuucagguucc

SEQ ID NO: 899914 - RNA, 23 nt, Human
cgcgcaguacugaagggggcgca

SEQ ID NO: 899915 - RNA, 26 nt, Human
cggcagcagcaaggaguguucgggag

SEQ ID NO: 899916 - RNA, 20 nt, Human
cggcagguggccugagucac

SEQ ID NO: 899917 - RNA, 22 nt, Human
cggcagguggccugagucacug

SEQ ID NO: 899918 - RNA, 18 nt, Human
cggggcugucccagccug

SEQ ID NO: 899919 - RNA, 20 nt, Human
cgggggucuuccaggacugg

SEQ ID NO: 899920 - RNA, 25 nt, Human
cuagcacauggugcagugcgucuua

SEQ ID NO: 899921 - RNA, 21 nt, Human
cuccucgcugugcgucgcugu

SEQ ID NO: 899922 - RNA, 19 nt, Human
cugcauguguggucuuccu

SEQ ID NO: 899923 - RNA, 23 nt, Human
cugcauguguggucuuccuugag

SEQ ID NO: 899924 - RNA, 23 nt, Human
cugcguggacucaaggaacaaaa

SEQ ID NO: 899925 - RNA, 18 nt, Human
cuggaccgacucugccgu

SEQ ID NO: 899926 - RNA, 21 nt, Human
cuguccucugcuuggaggcuu

SEQ ID NO: 899927 - RNA, 22 nt, Human
cuguccucugcuuggaggcuuc

SEQ ID NO: 899928 - RNA, 19 nt, Human
cuuccuuccucuucugucc

SEQ ID NO: 899929 - RNA, 24 nt, Human
gaacaaaaggaaacuaggcaggga

SEQ ID NO: 899930 - RNA, 18 nt, Human
gaaccgccggcagcagca

SEQ ID NO: 899931 - RNA, 23 nt, Human
gacaagagcaaaaaucacccccu

SEQ ID NO: 899932 - RNA, 21 nt, Human
gaccccuuuccucccacucac

SEQ ID NO: 899933 - RNA, 23 nt, Human
gaccuggauccuggggcuugggg

SEQ ID NO: 899934 - RNA, 24 nt, Human
gaccuggauccuggggcuuggggc

SEQ ID NO: 899935 - RNA, 21 nt, Human
gacggcccucugcugcgccuc

SEQ ID NO: 899936 - RNA, 18 nt, Human
gagaauggaauucugcgu

SEQ ID NO: 899937 - RNA, 19 nt, Human
gcaaaaaucacccccugca

SEQ ID NO: 899938 - RNA, 18 nt, Human
gcaaagccugcuuccuuc

SEQ ID NO: 899939 - RNA, 20 nt, Human
gcauuagaacuacuuggcua

SEQ ID NO: 899940 - RNA, 23 nt, Human
gcuuucccuucuuaacccccuuc

SEQ ID NO: 899941 - RNA, 25 nt, Human
ggagaggguugcagaguucaccgag

SEQ ID NO: 899942 - RNA, 18 nt, Human
ggaggaaccguaucggcg

SEQ ID NO: 899943 - RNA, 23 nt, Human
ggaggaggaugguggggacgggg

SEQ ID NO: 899944 - RNA, 24 nt, Human
ggaggaggaugguggggacggggc

SEQ ID NO: 899945 - RNA, 20 nt, Human
ggaggggacuugcacccucu

SEQ ID NO: 899946 - RNA, 19 nt, Human
ggagguggggguaggggcu

SEQ ID NO: 899947 - RNA, 22 nt, Human
ggaguuucauuagccgagccag

SEQ ID NO: 899948 - RNA, 23 nt, Human
ggcagguggccugagucacuguc

SEQ ID NO: 899949 - RNA, 20 nt, Human
ggccgggucggaaacgcugg

SEQ ID NO: 899950 - RNA, 19 nt, Human
ggcguugcuguccucugcu

SEQ ID NO: 899951 - RNA, 25 nt, Human
ggcugguggaccuggauccuggggc

SEQ ID NO: 899952 - RNA, 20 nt, Human
gggaacuauguacagaacuu

SEQ ID NO: 899953 - RNA, 20 nt, Human
gggcuuggggcugucuucuu

SEQ ID NO: 899954 - RNA, 18 nt, Human
ggggccccaggaggggac

SEQ ID NO: 899955 - RNA, 19 nt, Human
ggucuggcacuuccggcug

SEQ ID NO: 899956 - RNA, 20 nt, Human
gguuuggucccuuccuucag

SEQ ID NO: 899957 - RNA, 21 nt, Human
gucccaccuccggcucuccag

SEQ ID NO: 899958 - RNA, 24 nt, Human
gucuucuugguggggccagccaga

SEQ ID NO: 899959 - RNA, 27 nt, Human
gucuucuugguggggccagccagaguu

SEQ ID NO: 899960 - RNA, 28 nt, Human
uaggagagauaaugaauacucaugugaa

SEQ ID NO: 899961 - RNA, 19 nt, Human
uaggagagauaaugaauag

SEQ ID NO: 899962 - RNA, 22 nt, Human
uauguacagaacuuuacagaau

SEQ ID NO: 899963 - RNA, 23 nt, Human
ucacgccuuggggccaaagcccc

SEQ ID NO: 899964 - RNA, 19 nt, Human
ucagcaggggaagcguagc

SEQ ID NO: 899965 - RNA, 21 nt, Human
ucaggacaagagcaaaaauca

SEQ ID NO: 899966 - RNA, 20 nt, Human
ucauugccaccucuucucca

SEQ ID NO: 899967 - RNA, 21 nt, Human
ucccaccuccggcucuccagc

SEQ ID NO: 899968 - RNA, 23 nt, Human
uccccaggucgguucuccugauc

SEQ ID NO: 899969 - RNA, 20 nt, Human
ucccuucuuaacccccuuca

SEQ ID NO: 899970 - RNA, 24 nt, Human
uccgggccgggucggaaacgcugg

SEQ ID NO: 899971 - RNA, 23 nt, Human
uccuuccucuucuguccuucagg

SEQ ID NO: 899972 - RNA, 18 nt, Human
uccuugggaucacgaaua

SEQ ID NO: 899973 - RNA, 19 nt, Human
ucuacgguccccugcuccc

SEQ ID NO: 899974 - RNA, 19 nt, Human
ucuccaggcggcauugcuc

SEQ ID NO: 899975 - RNA, 22 nt, Human
ucuccaggcggcauugcuccug

SEQ ID NO: 899976 - RNA, 22 nt, Human
ucucccgcuuuacagaccccuu

SEQ ID NO: 899977 - RNA, 24 nt, Human
ucucccgcuuuacagaccccuuuc

SEQ ID NO: 899978 - RNA, 22 nt, Human
ucuccuucuuucccccucauca

SEQ ID NO: 899979 - RNA, 24 nt, Human
ucuuccauuuuggcuccucgcugg

SEQ ID NO: 899980 - RNA, 21 nt, Human
ugaaugaguuuaaagucaaaa

SEQ ID NO: 899981 - RNA, 22 nt, Human
ugacaauacagacccccuagga

SEQ ID NO: 899982 - RNA, 19 nt, Human
ugaggugccaugaggucaa

SEQ ID NO: 899983 - RNA, 21 nt, Human
ugaguuggcugguggaccugg

SEQ ID NO: 899984 - RNA, 19 nt, Human
ugauaagacgacagguggc

SEQ ID NO: 899985 - RNA, 22 nt, Human
ugcagauccucacugagugcaa

SEQ ID NO: 899986 - RNA, 24 nt, Human
ugcccaucugaaucaaacuucagc

SEQ ID NO: 899987 - RNA, 23 nt, Human
ugcuccugcccuuugggugccuc

SEQ ID NO: 899988 - RNA, 24 nt, Human
uggaaagcuucgcaugggccucgc

SEQ ID NO: 899989 - RNA, 18 nt, Human
uggcugaggugccaugag

SEQ ID NO: 899990 - RNA, 19 nt, Human
ugggaucacgaauagucuc

SEQ ID NO: 899991 - RNA, 21 nt, Human
uggggccaaagccccuagagu

SEQ ID NO: 899992 - RNA, 25 nt, Human
uggggcugucuucuugguggggcca

SEQ ID NO: 899993 - RNA, 23 nt, Human
uggggcuuggggcugucuucuug

SEQ ID NO: 899994 - RNA, 21 nt, Human
ugguggaccuggauccugggg

SEQ ID NO: 899995 - RNA, 24 nt, Human
ugguggggacggggcugucccagg

SEQ ID NO: 899996 - RNA, 20 nt, Human
uguacagaacuuuacagaau

SEQ ID NO: 899997 - RNA, 21 nt, Human
ugugcgucgcuguccgggcag

SEQ ID NO: 899998 - RNA, 21 nt, Human
ugugcgucgcuguccgggcag

SEQ ID NO: 899999 - RNA, 20 nt, Human
uuagccgagccagcagcgcu

SEQ ID NO: 900000 - RNA, 23 nt, Human
uuccugagcauggguauccucag

SEQ ID NO: 900001 - RNA, 22 nt, Human
uugacaauacagacccccuagg

SEQ ID NO: 900002 - RNA, 19 nt, Human
uuuacagaccccuuuccuc

SEQ ID NO: 900003 - RNA, 23 nt, Human
uuucucaggacaagagcaaaaau

SEQ ID NO: 900004 - RNA, 21 nt, Human
uuucuccuucuuucccccuca

SEQ ID NO: 900005 - RNA, 20 nt, Human
uuuuucuuuccuuucuccuu

SEQ ID NO: 900006 - RNA, 18 nt, Human
uuuuuuuuuuuuccuuug

SEQ ID NO: 900007 - RNA, 22 nt, Human
uuuuuuuuuuuuuuuuuccuuu

SEQ ID NO: 900008 - RNA, 23 nt, Human
uuuuuuuuuuuuuuuuuuccuuu

SEQ ID NO: 900009 - RNA, 23 nt, Human
aaucaugaccaccuagaugaagc

SEQ ID NO: 900010 - RNA, 19 nt, Human
agaaaauacuggagaaaaa

SEQ ID NO: 900011 - RNA, 23 nt, Human
agccgcaagaagucauccagaca

SEQ ID NO: 900012 - RNA, 19 nt, Human
agggggcagggagggagaa

SEQ ID NO: 900013 - RNA, 22 nt, Human
agggggcagggagggagaaaag

SEQ ID NO: 900014 - RNA, 18 nt, Human
agguaccgcggggagggg

SEQ ID NO: 900015 - RNA, 24 nt, Human
caaaugaaucccuaaggugaguac

SEQ ID NO: 900016 - RNA, 20 nt, Human
caauucaacaugcagauauc

SEQ ID NO: 900017 - RNA, 20 nt, Human
cagcagcaggcgacugcaag

SEQ ID NO: 900018 - RNA, 22 nt, Human
caggggcagaaggcccggaggg

SEQ ID NO: 900019 - RNA, 22 nt, Human
ccauagaagucaaaccacaaaa

SEQ ID NO: 900020 - RNA, 21 nt, Human
cccauccaccccaauucaaca

SEQ ID NO: 900021 - RNA, 19 nt, Human
cccccauccaccccaauuc

SEQ ID NO: 900022 - RNA, 22 nt, Human
ccccccauccaccccaauucaa

SEQ ID NO: 900023 - RNA, 26 nt, Human
ccgacgacagcagcaggcgacugcaa

SEQ ID NO: 900024 - RNA, 30 nt, Human
cgacgacagcagcaggcgacugcaaggaag

SEQ ID NO: 900025 - RNA, 21 nt, Human
cucgagagggggcagggaggg

SEQ ID NO: 900026 - RNA, 30 nt, Human
cuuaaaaauuaugcuugcuccccccauccu

SEQ ID NO: 900027 - RNA, 20 nt, Human
gaaacuccuucauguccaau

SEQ ID NO: 900028 - RNA, 21 nt, Human
gaaucccuaaggugaguacau

SEQ ID NO: 900029 - RNA, 19 nt, Human
gcaaagcuucacacuuaaa

SEQ ID NO: 900030 - RNA, 20 nt, Human
gcaaagcuucacacuuaaaa

SEQ ID NO: 900031 - RNA, 19 nt, Human
ggagggggagggguagaac

SEQ ID NO: 900032 - RNA, 19 nt, Human
ggcagggagggagaaaagu

SEQ ID NO: 900033 - RNA, 24 nt, Human
ggggagggggagggguagaacagc

SEQ ID NO: 900034 - RNA, 21 nt, Human
uaacacuaaaaaucuguguuu

SEQ ID NO: 900035 - RNA, 27 nt, Human
uaugcuugcuccccccauccaccccaa

SEQ ID NO: 900036 - RNA, 23 nt, Human
ucaaaccacaaaaacccaggauc

SEQ ID NO: 900037 - RNA, 23 nt, Human
ucaggggcagaaggcccggaggg

SEQ ID NO: 900038 - RNA, 18 nt, Human
uccccccauccaccccaa

SEQ ID NO: 900039 - RNA, 21 nt, Human
uccccccauccaccccaauuc

SEQ ID NO: 900040 - RNA, 23 nt, Human
ucuuugcccuugcaacaauuuca

SEQ ID NO: 900041 - RNA, 21 nt, Human
ugcaaagcuucacacuuaaaa

SEQ ID NO: 900042 - RNA, 19 nt, Human
ugcuccccccauccacccc

SEQ ID NO: 900043 - RNA, 19 nt, Human
uggacucgagagggggcag

SEQ ID NO: 900044 - RNA, 24 nt, Human
uugaaacuccuucauguccaauga

SEQ ID NO: 900045 - RNA, 23 nt, Human
uuuuuuuggcauguuccuuuaca

SEQ ID NO: 900046 - RNA, 18 nt, Human
uuuuuuuuuuuuuuuuug

SEQ ID NO: 900047 - RNA, 18 nt, Human
uuuuuuuuuuuuuuuuug

SEQ ID NO: 900048 - RNA, 23 nt, Human
uuuuuuuuuuuuuuuuuggcaug

SEQ ID NO: 900049 - RNA, 22 nt, Human
uuuuuuuuuuuuuuuuuuuggc

SEQ ID NO: 900050 - RNA, 19 nt, Human
aaacaaagccacacugaga

SEQ ID NO: 900051 - RNA, 24 nt, Human
aaagugcugggauuauaggcauga

SEQ ID NO: 900052 - RNA, 18 nt, Human
aaauucauguuccagcaa

SEQ ID NO: 900053 - RNA, 24 nt, Human
aagaaguugguuauauagaggagc

SEQ ID NO: 900054 - RNA, 22 nt, Human
aaggauaaauguuaaaucugcc

SEQ ID NO: 900055 - RNA, 19 nt, Human
aagugcugggauuauaggc

SEQ ID NO: 900056 - RNA, 21 nt, Human
aagugcugggauuauaggcau

SEQ ID NO: 900057 - RNA, 21 nt, Human
acacagaauccgagaacuuca

SEQ ID NO: 900058 - RNA, 24 nt, Human
acacaggucccaaggccacccaau

SEQ ID NO: 900059 - RNA, 23 nt, Human
acaccacaggaguuaccacaaac

SEQ ID NO: 900060 - RNA, 23 nt, Human
accucggccucccaaagugcugg

SEQ ID NO: 900061 - RNA, 18 nt, Human
agccaccaugcccagccc

SEQ ID NO: 900062 - RNA, 21 nt, Human
aggcaugagccaccaugccca

SEQ ID NO: 900063 - RNA, 19 nt, Human
aggucccaaggccacccaa

SEQ ID NO: 900064 - RNA, 24 nt, Human
augauccacccaccucggccuccc

SEQ ID NO: 900065 - RNA, 25 nt, Human
auuuacaccacaggaguuaccacca

SEQ ID NO: 900066 - RNA, 20 nt, Human
caaaaacaaagccacacuga

SEQ ID NO: 900067 - RNA, 21 nt, Human
caaaaacaaagccacacugag

SEQ ID NO: 900068 - RNA, 21 nt, Human
caaaagcuaaugugggcuggg

SEQ ID NO: 900069 - RNA, 24 nt, Human
caaagugcugggauuauaggcaug

SEQ ID NO: 900070 - RNA, 25 nt, Human
caaauugcaaaaacaaagccacacu

SEQ ID NO: 900071 - RNA, 22 nt, Human
cacacaggucccaaggccaccc

SEQ ID NO: 900072 - RNA, 22 nt, Human
cacagaauccgagaacuucaaa

SEQ ID NO: 900073 - RNA, 22 nt, Human
cacccaccucggccucccaaag

SEQ ID NO: 900074 - RNA, 23 nt, Human
cacccaccucggccucccaaagu

SEQ ID NO: 900075 - RNA, 20 nt, Human
cacucugcuaggagcagaau

SEQ ID NO: 900076 - RNA, 24 nt, Human
cauacuaggaauauaaaaaaaaga

SEQ ID NO: 900077 - RNA, 21 nt, Human
cauacugcccucccaaaacuc

SEQ ID NO: 900078 - RNA, 24 nt, Human
caugagccaccaugcccagcccau

SEQ ID NO: 900079 - RNA, 24 nt, Human
ccaaagugcugggauuauaggcau

SEQ ID NO: 900080 - RNA, 22 nt, Human
ccaccaaacuacagucuaugcu

SEQ ID NO: 900081 - RNA, 21 nt, Human
cccacauacugcccucccaaa

SEQ ID NO: 900082 - RNA, 24 nt, Human
ccugaccucagaugauccacccac

SEQ ID NO: 900083 - RNA, 18 nt, Human
cgagaaggauaaauguua

SEQ ID NO: 900084 - RNA, 20 nt, Human
cugcaaauccugaaaccugc

SEQ ID NO: 900085 - RNA, 22 nt, Human
cugcuagacugauggacuaugu

SEQ ID NO: 900086 - RNA, 23 nt, Human
cuucaaaagcuaaugugggcucc

SEQ ID NO: 900087 - RNA, 24 nt, Human
gaccucagaugauccacccaccuc

SEQ ID NO: 900088 - RNA, 21 nt, Human
gauuauaggcaugagccacca

SEQ ID NO: 900089 - RNA, 24 nt, Human
gauuauaggcaugagccaccaugc

SEQ ID NO: 900090 - RNA, 18 nt, Human
gcucagaaccugaagcaa

SEQ ID NO: 900091 - RNA, 23 nt, Human
gcugggcucgaacuccugaccuc

SEQ ID NO: 900092 - RNA, 24 nt, Human
ggauuauaggcaugagccaccaug

SEQ ID NO: 900093 - RNA, 24 nt, Human
ggcugggcucgaacuccugaccuc

SEQ ID NO: 900094 - RNA, 24 nt, Human
ggucccacauacugcccucccaaa

SEQ ID NO: 900095 - RNA, 21 nt, Human
uaacauacaaacaguacaacu

SEQ ID NO: 900096 - RNA, 21 nt, Human
uacacacagaauccgagaacu

SEQ ID NO: 900097 - RNA, 21 nt, Human
uacagucuaugcucuucacac

SEQ ID NO: 900098 - RNA, 22 nt, Human
uacugcccucccaaaacucuca

SEQ ID NO: 900099 - RNA, 20 nt, Human
ucagaugauccacccaccuc

SEQ ID NO: 900100 - RNA, 24 nt, Human
ucccaaagugcugggauuauaggc

SEQ ID NO: 900101 - RNA, 18 nt, Human
ucccacauacugcccucc

SEQ ID NO: 900102 - RNA, 24 nt, Human
uccgagaacuucaaagucuuugcu

SEQ ID NO: 900103 - RNA, 20 nt, Human
ugaaaccugcaaugcagcua

SEQ ID NO: 900104 - RNA, 21 nt, Human
ugagccaccaugcccagccca

SEQ ID NO: 900105 - RNA, 24 nt, Human
ugauccacccaccucggccuccca

SEQ ID NO: 900106 - RNA, 22 nt, Human
ugcccagcccauauucccuuca

SEQ ID NO: 900107 - RNA, 18 nt, Human
ugggauuauaggcaugag

SEQ ID NO: 900108 - RNA, 22 nt, Human
ugggauuauaggcaugagccac

SEQ ID NO: 900109 - RNA, 23 nt, Human
ugggauuauaggcaugagccacc

SEQ ID NO: 900110 - RNA, 24 nt, Human
ugggauuauaggcaugagccacca

SEQ ID NO: 900111 - RNA, 25 nt, Human
ugggauuauaggcaugagccaccau

SEQ ID NO: 900112 - RNA, 19 nt, Human
ugggcugggcucgaacucc

SEQ ID NO: 900113 - RNA, 22 nt, Human
uguuagggggccauuaauuuua

SEQ ID NO: 900114 - RNA, 19 nt, Human
uuccaccaaacuacagucu

SEQ ID NO: 900115 - RNA, 19 nt, Human
aaaaaaaaaaagaaaaaga

SEQ ID NO: 900116 - RNA, 22 nt, Human
aaaaaagcagacucuagagaua

SEQ ID NO: 900117 - RNA, 23 nt, Human
aaaaggaggggaccuggagggcg

SEQ ID NO: 900118 - RNA, 28 nt, Human
aaaauuccacauuaaggaguuaagaaca

SEQ ID NO: 900119 - RNA, 20 nt, Human
aaacuggcccacaaaaaagc

SEQ ID NO: 900120 - RNA, 23 nt, Human
aaagaaaaaaaaaucccagccca

SEQ ID NO: 900121 - RNA, 22 nt, Human
aaagaaaaagaaaaaaaaaucc

SEQ ID NO: 900122 - RNA, 23 nt, Human
aaagagaaacccagggcgccagg

SEQ ID NO: 900123 - RNA, 22 nt, Human
aaaggagaggggacaggauaaa

SEQ ID NO: 900124 - RNA, 19 nt, Human
aacauggugaaaccccauc

SEQ ID NO: 900125 - RNA, 20 nt, Human
aacauggugaaaccccaucu

SEQ ID NO: 900126 - RNA, 20 nt, Human
aacauggugaaaccccaucu

SEQ ID NO: 900127 - RNA, 21 nt, Human
aacauggugaaaccccaucuc

SEQ ID NO: 900128 - RNA, 24 nt, Human
aagaagucaacaaagauucccagc

SEQ ID NO: 900129 - RNA, 19 nt, Human
aaggaggggaccuggaggg

SEQ ID NO: 900130 - RNA, 18 nt, Human
aagggcagcucuuuuaca

SEQ ID NO: 900131 - RNA, 24 nt, Human
aaucgcuugaacccaaguggcaga

SEQ ID NO: 900132 - RNA, 23 nt, Human
aaugcaaaaaugggaaagggcua

SEQ ID NO: 900133 - RNA, 24 nt, Human
accaacauggugaaaccccaucuc

SEQ ID NO: 900134 - RNA, 24 nt, Human
accccaucucuacuaaaaauacaa

SEQ ID NO: 900135 - RNA, 19 nt, Human
acugcacuccagccugggc

SEQ ID NO: 900136 - RNA, 22 nt, Human
acugcacuccagccugggcugg

SEQ ID NO: 900137 - RNA, 24 nt, Human
acugcacuccagccugggcuggag

SEQ ID NO: 900138 - RNA, 27 nt, Human
agcaagaagucuuuucuccuccccugg

SEQ ID NO: 900139 - RNA, 24 nt, Human
agcacuucgggacgcugagguggg

SEQ ID NO: 900140 - RNA, 24 nt, Human
agccugaccaacauggugaaaccc

SEQ ID NO: 900141 - RNA, 22 nt, Human
aggcaagggcauaggcaaggaa

SEQ ID NO: 900142 - RNA, 23 nt, Human
aggcaggagaaucgcuugaaccc

SEQ ID NO: 900143 - RNA, 24 nt, Human
aggcaggagaaucgcuugaaccca

SEQ ID NO: 900144 - RNA, 24 nt, Human
aggcgcgguggcucacaccuguaa

SEQ ID NO: 900145 - RNA, 20 nt, Human
aggcugaggcaggagaaucg

SEQ ID NO: 900146 - RNA, 24 nt, Human
aggcugaggcaggagaaucgcuug

SEQ ID NO: 900147 - RNA, 24 nt, Human
agguggguggaucaggaggucagg

SEQ ID NO: 900148 - RNA, 22 nt, Human
aucaggaggucaggaguucaag

SEQ ID NO: 900149 - RNA, 24 nt, Human
aucaugccacugcacuccagccug

SEQ ID NO: 900150 - RNA, 22 nt, Human
augccacugcacuccagccugg

SEQ ID NO: 900151 - RNA, 21 nt, Human
auuaucuccccuucugguguu

SEQ ID NO: 900152 - RNA, 18 nt, Human
caaaaaagcagacucuag

SEQ ID NO: 900153 - RNA, 21 nt, Human
caaaaaagcagacucuagaga

SEQ ID NO: 900154 - RNA, 18 nt, Human
caaaacuauuaucucccc

SEQ ID NO: 900155 - RNA, 24 nt, Human
caacauggugaaaccccaucucua

SEQ ID NO: 900156 - RNA, 31 nt, Human; identical to SEQ ID NO: 562574

SEQ ID NO: 900157 - RNA, 19 nt, Human
caagagcauuaggagucug

SEQ ID NO: 900158 - RNA, 24 nt, Human
caagaucaugccacugcacuccag

SEQ ID NO: 900159 - RNA, 22 nt, Human
cacaccugaguuaaacauuuug

SEQ ID NO: 900160 - RNA, 24 nt, Human
cacaccuguaaucccagcacuucg

SEQ ID NO: 900161 - RNA, 23 nt, Human
caccuguaaucccagcacuucgg

SEQ ID NO: 900162 - RNA, 24 nt, Human
caccuguaaucccagcacuucggg

SEQ ID NO: 900163 - RNA, 21 nt, Human
cacuccagccugggcuggagc

SEQ ID NO: 900164 - RNA, 18 nt, Human
cacugcacuccagccugg

SEQ ID NO: 900165 - RNA, 19 nt, Human
cacugcacuccagccuggg

SEQ ID NO: 900166 - RNA, 20 nt, Human
cacugcacuccagccugggc

SEQ ID NO: 900167 - RNA, 20 nt, Human
cacugcacuccagccugggc

SEQ ID NO: 900168 - RNA, 26 nt, Human
cacugcacuccagccugggcuggagc

SEQ ID NO: 900169 - RNA, 20 nt, Human
cagagcaugcagugagccaa

SEQ ID NO: 900170 - RNA, 21 nt, Human
cagcacuucgggacgcugagg

SEQ ID NO: 900171 - RNA, 24 nt, Human
cagcacuucgggacgcugaggugg

SEQ ID NO: 900172 - RNA, 19 nt, Human
cagcaggcguugcaacaug

SEQ ID NO: 900173 - RNA, 19 nt, Human
cagcccaggccaggcgcgg

SEQ ID NO: 900174 - RNA, 20 nt, Human
cauuuugcuggaaaauucca

SEQ ID NO: 900175 - RNA, 19 nt, Human
ccaaagaagucaacaaaga

SEQ ID NO: 900176 - RNA, 20 nt, Human
ccacugcacuccagccuggg

SEQ ID NO: 900177 - RNA, 21 nt, Human
ccacugcacuccagccugggc

SEQ ID NO: 900178 - RNA, 21 nt, Human
ccacugcacuccagccugggc

SEQ ID NO: 900179 - RNA, 26 nt, Human
ccacugcacuccagccugggcuggag

SEQ ID NO: 900180 - RNA, 22 nt, Human
ccaggagaaaggagaggggaca

SEQ ID NO: 900181 - RNA, 25 nt, Human
ccaggccaggcgcgguggcucacac

SEQ ID NO: 900182 - RNA, 22 nt, Human
ccagggaaagaacaagcacucc

SEQ ID NO: 900183 - RNA, 19 nt, Human
cccacaaaaaagcagacuc

SEQ ID NO: 900184 - RNA, 24 nt, Human
ccugaccaacauggugaaacccca

SEQ ID NO: 900185 - RNA, 25 nt, Human
ccugggcuggagcaagaccgggguc

SEQ ID NO: 900186 - RNA, 22 nt, Human
cgccuguaauccgcuacuugag

SEQ ID NO: 900187 - RNA, 18 nt, Human
cucaaaaaaaaaaaaaaa

SEQ ID NO: 900188 - RNA, 24 nt, Human
cucacaccuguaaucccagcacuu

SEQ ID NO: 900189 - RNA, 27 nt, Human
cucacaccuguaaucccagcacuucgg

SEQ ID NO: 900190 - RNA, 18 nt, Human
cugagcccuaggcagacg

SEQ ID NO: 900191 - RNA, 19 nt, Human
cuggcccacaaaaaagcag

SEQ ID NO: 900192 - RNA, 22 nt, Human
cugucucaaaaaaaaaaaaaaa

SEQ ID NO: 900193 - RNA, 27 nt, Human
gagcaagacugucucaaaaaaaaaaaa

SEQ ID NO: 900194 - RNA, 22 nt, Human
gaucaggaggucaggaguucaa

SEQ ID NO: 900195 - RNA, 22 nt, Human
gcacuccagccugggcuggagc

SEQ ID NO: 900196 - RNA, 22 nt, Human
gcaggagaaucgcuugaaccca

SEQ ID NO: 900197 - RNA, 20 nt, Human
gccaagaucaugccacugca

SEQ ID NO: 900198 - RNA, 22 nt, Human
gccacugcacuccagccugggc

SEQ ID NO: 900199 - RNA, 22 nt, Human
gcuacuugagaggcugaggcag

SEQ ID NO: 900200 - RNA, 23 nt, Human
gcuggagcaagacugucucaaaa

SEQ ID NO: 900201 - RNA, 23 nt, Human
ggcagagcaugcagugagccaag

SEQ ID NO: 900202 - RNA, 20 nt, Human
gguaagcuccuaggaggggc

SEQ ID NO: 900203 - RNA, 23 nt, Human
gguggaucaggaggucaggaguu

SEQ ID NO: 900204 - RNA, 28 nt, Human
gguggaucaggaggucaggaguucaaga

SEQ ID NO: 900205 - RNA, 23 nt, Human
gguggcucacaccuguaauccca

SEQ ID NO: 900206 - RNA, 24 nt, Human
gguggcucacaccuguaaucccag

SEQ ID NO: 900207 - RNA, 23 nt, Human
gguuguggccaaguucagaguca

SEQ ID NO: 900208 - RNA, 23 nt, Human
guacagagaaaacaucaaggcuu

SEQ ID NO: 900209 - RNA, 30 nt, Human
guggaucaggaggucaggaguucaagaccc

SEQ ID NO: 900210 - RNA, 21 nt, Human
uaaggaguuaagaacauaaug

SEQ ID NO: 900211 - RNA, 21 nt, Human
uagcacaguauuucacacuuu

SEQ ID NO: 900212 - RNA, 20 nt, Human
uagcuguacagagaaaacau

SEQ ID NO: 900213 - RNA, 23 nt, Human
ucaaaaaaaaaaaaaaaaaagaa

SEQ ID NO: 900214 - RNA, 22 nt, Human
ucagaaaacuuagcuguacaga

SEQ ID NO: 900215 - RNA, 24 nt, Human
ucaggaggucaggaguucaagacc

SEQ ID NO: 900216 - RNA, 23 nt, Human
ucaugccacugcacuccagccug

SEQ ID NO: 900217 - RNA, 20 nt, Human
uccacucuucugaaggcaau

SEQ ID NO: 900218 - RNA, 18 nt, Human
uccgcuacuugagaggcu

SEQ ID NO: 900219 - RNA, 23 nt, Human
ucucuacuaaaaauacaaaaauu

SEQ ID NO: 900220 - RNA, 19 nt, Human
ugaaaccccaucucuacua

SEQ ID NO: 900221 - RNA, 22 nt, Human
ugaaucucaacaguuuccuaga

SEQ ID NO: 900222 - RNA, 24 nt, Human
ugaccaacauggugaaaccccauc

SEQ ID NO: 900223 - RNA, 19 nt, Human
ugagaggcugaggcaggag

SEQ ID NO: 900224 - RNA, 20 nt, Human
ugaggcaggagaaucgcuug

SEQ ID NO: 900225 - RNA, 24 nt, Human
ugaggcaggagaaucgcuugaacc

SEQ ID NO: 900226 - RNA, 25 nt, Human
ugaggcaggagaaucgcuugaaccc

SEQ ID NO: 900227 - RNA, 20 nt, Human
ugagguggguggaucaggag

SEQ ID NO: 900228 - RNA, 21 nt, Human
ugagguggguggaucaggagg

SEQ ID NO: 900229 - RNA, 22 nt, Human
ugagguggguggaucaggaggu

SEQ ID NO: 900230 - RNA, 24 nt, Human
ugagguggguggaucaggagguca

SEQ ID NO: 900231 - RNA, 24 nt, Human
ugcaacaugcucaagggcacccac

SEQ ID NO: 900232 - RNA, 24 nt, Human
ugcucuugaagaagacaagaguug

SEQ ID NO: 900233 - RNA, 18 nt, Human
ugcugccaggagaaagga

SEQ ID NO: 900234 - RNA, 22 nt, Human
uggaucaggaggucaggaguuc

SEQ ID NO: 900235 - RNA, 21 nt, Human
uggcucacaccuguaauccca

SEQ ID NO: 900236 - RNA, 24 nt, Human
uggcucacaccuguaaucccagca

SEQ ID NO: 900237 - RNA, 22 nt, Human
ugggaaagggcuauauacaggu

SEQ ID NO: 900238 - RNA, 26 nt, Human
ugggaaagggcuauauacagguacuu

SEQ ID NO: 900239 - RNA, 22 nt, Human
uggguggaucaggaggucagga

SEQ ID NO: 900240 - RNA, 24 nt, Human
ugguggugggcgccuguaauccgc

SEQ ID NO: 900241 - RNA, 19 nt, Human
uguagaaaagggggcgagg

SEQ ID NO: 900242 - RNA, 19 nt, Human
uguuguguguuugcucuug

SEQ ID NO: 900243 - RNA, 18 nt, Human
uucauaaucacuauacac

SEQ ID NO: 900244 - RNA, 20 nt, Human
uucauugauaguggagauuu

SEQ ID NO: 900245 - RNA, 24 nt, Human
uugagaggcugaggcaggagaauc

SEQ ID NO: 900246 - RNA, 18 nt, Human
uugcuggaaaauuccaca

SEQ ID NO: 900247 - RNA, 24 nt, Human
uuggaacuagaaggcaagggcaua

SEQ ID NO: 900248 - RNA, 19 nt, Human
uuggagaauaacagcaaga

SEQ ID NO: 900249 - RNA, 21 nt, Human
uuguguucuuccuuuucugcu

SEQ ID NO: 900250 - RNA, 23 nt, Human
uuucccccccuuuuuuuuaaaga

SEQ ID NO: 900251 - RNA, 19 nt, Human
uuuugcuggaaaauuccac

SEQ ID NO: 900252 - RNA, 19 nt, Human
accccaagaacacccccac

SEQ ID NO: 900253 - RNA, 20 nt, Human
agaaaguaugcaacacacaa

SEQ ID NO: 900254 - RNA, 21 nt, Human
agaacacccccacaccuggcu

SEQ ID NO: 900255 - RNA, 24 nt, Human
agccaggcgcgcugcuaggggggg

SEQ ID NO: 900256 - RNA, 19 nt, Human
aggaggagcugacgggcug

SEQ ID NO: 900257 - RNA, 19 nt, Human
aggaggagcugacgggcug

SEQ ID NO: 900258 - RNA, 23 nt, Human
agggggggucgccggugaccucg

SEQ ID NO: 900259 - RNA, 23 nt, Human
aucuuccccaccucucccagaug

SEQ ID NO: 900260 - RNA, 19 nt, Human
caacacacaaacuccgucc

SEQ ID NO: 900261 - RNA, 20 nt, Human
caacaccccgaggaggagug

SEQ ID NO: 900262 - RNA, 22 nt, Human
caagaacacccccacaccuggc

SEQ ID NO: 900263 - RNA, 19 nt, Human
cacacaaacuccguccucc

SEQ ID NO: 900264 - RNA, 18 nt, Human
cacccccacaccuggcug

SEQ ID NO: 900265 - RNA, 19 nt, Human
ccaucuuccccaccucucc

SEQ ID NO: 900266 - RNA, 20 nt, Human
ccccaagaacacccccacac

SEQ ID NO: 900267 - RNA, 18 nt, Human
ccccacaccuggcugacc

SEQ ID NO: 900268 - RNA, 18 nt, Human
cccgcugggauucuccgg

SEQ ID NO: 900269 - RNA, 20 nt, Human
ccgcugcugcagccgccgcc

SEQ ID NO: 900270 - RNA, 21 nt, Human
ccgcugcugcagccgccgccu

SEQ ID NO: 900271 - RNA, 25 nt, Human
ccugccaucuuccccaccucuccca

SEQ ID NO: 900272 - RNA, 20 nt, Human
ccuugccugccaucuucccc

SEQ ID NO: 900273 - RNA, 21 nt, Human
cgcggccugcgccccgccagc

SEQ ID NO: 900274 - RNA, 21 nt, Human
cggcgccuccgcucucucgcu

SEQ ID NO: 900275 - RNA, 25 nt, Human
cggugaccucgaaacuugugcaaca

SEQ ID NO: 900276 - RNA, 24 nt, Human
cucccagaugcaucucugaggccc

SEQ ID NO: 900277 - RNA, 27 nt, Human
gaacacccccacaccuggcugaccagg

SEQ ID NO: 900278 - RNA, 22 nt, Human
gcggggguggcagggugggcac

SEQ ID NO: 900279 - RNA, 21 nt, Human
ggauccucggcgccuccgcuc

SEQ ID NO: 900280 - RNA, 24 nt, Human
gggccagagccaggcgcgcugcua

SEQ ID NO: 900281 - RNA, 23 nt, Human
ggucccgcggccugcgccccgcc

SEQ ID NO: 900282 - RNA, 22 nt, Human
guggcagggugggcaccagagu

SEQ ID NO: 900283 - RNA, 23 nt, Human
ucgcuuccccgggcucggguccc

SEQ ID NO: 900284 - RNA, 20 nt, Human
ucggauccucggcgccuccg

SEQ ID NO: 900285 - RNA, 19 nt, Human
ugaaucggauccucggcgc

SEQ ID NO: 900286 - RNA, 19 nt, Human
uggagcgcggggguggcag

SEQ ID NO: 900287 - RNA, 24 nt, Human
uggagcgcggggguggcagggugg

SEQ ID NO: 900288 - RNA, 22 nt, Human
uggauggagccgcugcugcagc

SEQ ID NO: 900289 - RNA, 25 nt, Human
ugggaaggagaccaaaggagacccc

SEQ ID NO: 900290 - RNA, 22 nt, Human
uugugcaacaccccgaggagga

SEQ ID NO: 900291 - RNA, 23 nt, Human
uuuauguugcauacuugaacuac

SEQ ID NO: 900292 - RNA, 24 nt, Human
uuuuuuuuuuuuuuuucaguuuuu

SEQ ID NO: 900293 - RNA, 25 nt, Human
ucuuuggugacgcaaaggcagagau

SEQ ID NO: 900294 - RNA, 23 nt, Human
ugacgcaaaggcagagauauuuu

SEQ ID NO: 900295 - RNA, 19 nt, Human
aaacugauacccacgaacu

SEQ ID NO: 900296 - RNA, 22 nt, Human
aaaguucuuauuagacuuuauu

SEQ ID NO: 900297 - RNA, 21 nt, Human
aacacacuaauaauuuuaaau

SEQ ID NO: 900298 - RNA, 20 nt, Human
aacagacuacacccuguaac

SEQ ID NO: 900299 - RNA, 18 nt, Human
aacuacggaaucuaaaca

SEQ ID NO: 900300 - RNA, 21 nt, Human
aacuacggaaucuaaacagac

SEQ ID NO: 900301 - RNA, 24 nt, Human
aagaguaugaaauuuaucuguagu

SEQ ID NO: 900302 - RNA, 23 nt, Human
accuguuagcaaaagugucacga

SEQ ID NO: 900303 - RNA, 18 nt, Human
agucuacuucaggaugag

SEQ ID NO: 900304 - RNA, 22 nt, Human
auuuuuuuuguuuuuauuuuua

SEQ ID NO: 900305 - RNA, 20 nt, Human
caaaaaaguuccuguaccaa

SEQ ID NO: 900306 - RNA, 18 nt, Human
caaaguguagagucaagg

SEQ ID NO: 900307 - RNA, 20 nt, Human
cacacaaaucacccccaaag

SEQ ID NO: 900308 - RNA, 22 nt, Human
cacacaaaucacccccaaaguc

SEQ ID NO: 900309 - RNA, 20 nt, Human
cacaugugaaugagugaggu

SEQ ID NO: 900310 - RNA, 21 nt, Human
cucaaaguguagagucaagga

SEQ ID NO: 900311 - RNA, 20 nt, Human
cucacaugugaaugagugag

SEQ ID NO: 900312 - RNA, 22 nt, Human
cuccccaggcgcuacacacaaa

SEQ ID NO: 900313 - RNA, 21 nt, Human
cuccuuaggagaggagauaac

SEQ ID NO: 900314 - RNA, 19 nt, Human
cucguggugacugucaugu

SEQ ID NO: 900315 - RNA, 20 nt, Human
cuucaggaugagggacuucu

SEQ ID NO: 900316 - RNA, 21 nt, Human
gccagacuuaguugggaccug

SEQ ID NO: 900317 - RNA, 22 nt, Human
gcucacaugugaaugagugagg

SEQ ID NO: 900318 - RNA, 19 nt, Human
ggaaucuccaaagacaaaa

SEQ ID NO: 900319 - RNA, 22 nt, Human
gggaccugagaguuaagugcug

SEQ ID NO: 900320 - RNA, 20 nt, Human
gguccguguguuuguuuugu

SEQ ID NO: 900321 - RNA, 18 nt, Human
gucccgcagcuggucugg

SEQ ID NO: 900322 - RNA, 26 nt, Human
gucgcucacaugugaaugagugaggu

SEQ ID NO: 900323 - RNA, 21 nt, Human
gucucuuuucugcguagaccc

SEQ ID NO: 900324 - RNA, 19 nt, Human
uaccgaaacugauacccac

SEQ ID NO: 900325 - RNA, 22 nt, Human
uccucuuuuauccccccucccc

SEQ ID NO: 900326 - RNA, 23 nt, Human
uccucuuuuauccccccucccca

SEQ ID NO: 900327 - RNA, 23 nt, Human
ucuccaaagacaaaagaguauga

SEQ ID NO: 900328 - RNA, 22 nt, Human
ucuccuaaagcagcccagccgc

SEQ ID NO: 900329 - RNA, 24 nt, Human
ucuguagugauuauagccaccauu

SEQ ID NO: 900330 - RNA, 21 nt, Human
ucuuaucuucgcuucuuuguu

SEQ ID NO: 900331 - RNA, 22 nt, Human
ucuuucuuaucuucgcuucuuu

SEQ ID NO: 900332 - RNA, 25 nt, Human
ucuuuuguuccuuuuggacacuuug

SEQ ID NO: 900333 - RNA, 20 nt, Human
ugaggccuucuuucuuaucu

SEQ ID NO: 900334 - RNA, 19 nt, Human
ugagggacuucucgcuugg

SEQ ID NO: 900335 - RNA, 25 nt, Human
ugagguaauuggauaugaggccuuc

SEQ ID NO: 900336 - RNA, 22 nt, Human
ugauacccacgaacuacggaau

SEQ ID NO: 900337 - RNA, 21 nt, Human
ugaucagaagugguaccuguu

SEQ ID NO: 900338 - RNA, 24 nt, Human
uggaaucuccaaagacaaaagagu

SEQ ID NO: 900339 - RNA, 22 nt, Human
ugugugucuguucauucauucg

SEQ ID NO: 900340 - RNA, 24 nt, Human
ugugugugucuguucauucauucg

SEQ ID NO: 900341 - RNA, 24 nt, Human
uguguuuguuuuguuuuguuuuug

SEQ ID NO: 900342 - RNA, 22 nt, Human
uguuaggucuucaucuccuuag

SEQ ID NO: 900343 - RNA, 25 nt, Human
uguuuuguuuuccucggaauuuuca

SEQ ID NO: 900344 - RNA, 26 nt, Human
uuaaaauuaauauaaaaacucgauga

SEQ ID NO: 900345 - RNA, 21 nt, Human
uuaaauuuuacacucugcgcu

SEQ ID NO: 900346 - RNA, 18 nt, Human
uuaggucuucaucuccuu

SEQ ID NO: 900347 - RNA, 19 nt, Human
uuccucggaauuuucagcc

SEQ ID NO: 900348 - RNA, 22 nt, Human
uuucugcguagacccagaacaa

SEQ ID NO: 900349 - RNA, 23 nt, Human
uuucuggaccaaacaaacacacu

SEQ ID NO: 900350 - RNA, 20 nt, Human
uuuguuuuguuuuguuuuug

SEQ ID NO: 900351 - RNA, 19 nt, Human
aaagcagcccugcccgccg

SEQ ID NO: 900352 - RNA, 20 nt, Human
agaaaaggccuugcuuggua

SEQ ID NO: 900353 - RNA, 21 nt, Human
agaagggucaauuuacaaaga

SEQ ID NO: 900354 - RNA, 22 nt, Human
agcagggacaggaggaccaaga

SEQ ID NO: 900355 - RNA, 22 nt, Human
aggaggcuucugcaggccuugg

SEQ ID NO: 900356 - RNA, 22 nt, Human
aggaggcuucugcaggccuugg

SEQ ID NO: 900357 - RNA, 20 nt, Human
aucagacuaagaaaagcagc

SEQ ID NO: 900358 - RNA, 21 nt, Human
cagcagcuccggaggccccag

SEQ ID NO: 900359 - RNA, 23 nt, Human
cagcagggacaggaggaccaaga

SEQ ID NO: 900360 - RNA, 19 nt, Human
cagcuccggaggccccagc

SEQ ID NO: 900361 - RNA, 19 nt, Human
caggaggccagcacugugg

SEQ ID NO: 900362 - RNA, 24 nt, Human
caggaggccagcacugugggucau

SEQ ID NO: 900363 - RNA, 19 nt, Human
caggaggcuucugcaggcc

SEQ ID NO: 900364 - RNA, 21 nt, Human
ccaggccaggaggcuucugca

SEQ ID NO: 900365 - RNA, 26 nt, Human
cccgcagcagcuccggaggccccagc

SEQ ID NO: 900366 - RNA, 20 nt, Human
ccgccgccccccacuccaga

SEQ ID NO: 900367 - RNA, 24 nt, Human
ccugcagcagggacaggaggacca

SEQ ID NO: 900368 - RNA, 23 nt, Human
ccuugggcuucccugagggccuc

SEQ ID NO: 900369 - RNA, 25 nt, Human
cgccccccacuccagaagggucaau

SEQ ID NO: 900370 - RNA, 18 nt, Human
gagcccgcagcagcuccg

SEQ ID NO: 900371 - RNA, 19 nt, Human
gcagcccugcccgccgccc

SEQ ID NO: 900372 - RNA, 20 nt, Human
gccccugcagcagggacagg

SEQ ID NO: 900373 - RNA, 18 nt, Human
gcccgccgccccccacuc

SEQ ID NO: 900374 - RNA, 19 nt, Human
gcuccggaggccccagccc

SEQ ID NO: 900375 - RNA, 19 nt, Human
ggccccacaggaggccagc

SEQ ID NO: 900376 - RNA, 20 nt, Human
gucacgaagcagagccugag

SEQ ID NO: 900377 - RNA, 21 nt, Human
guggccccacaggaggccagc

SEQ ID NO: 900378 - RNA, 21 nt, Human
ucccugagggccucgcggcuu

SEQ ID NO: 900379 - RNA, 24 nt, Human
ucccugagggccucgcggcuucug

SEQ ID NO: 900380 - RNA, 19 nt, Human
ucccugagggccucgcggg

SEQ ID NO: 900381 - RNA, 22 nt, Human
ucugcaggccuugggcuucccu

SEQ ID NO: 900382 - RNA, 19 nt, Human
ugagggccucgcggcuucu

SEQ ID NO: 900383 - RNA, 20 nt, Human
ugcagcagggacaggaggac

SEQ ID NO: 900384 - RNA, 18 nt, Human
uuacaaagacaggggcgc

SEQ ID NO: 900385 - RNA, 19 nt, Human
aaaagagaagaauccuuag

SEQ ID NO: 900386 - RNA, 24 nt, Human
aaauagcuauaaaagagaagaauc

SEQ ID NO: 900387 - RNA, 20 nt, Human
agacagcaauaaagccugaa

SEQ ID NO: 900388 - RNA, 24 nt, Human
agacagcaauaaagccugaaccug

SEQ ID NO: 900389 - RNA, 27 nt, Human
aggaguaauagaagucaaccgguaccc

SEQ ID NO: 900390 - RNA, 21 nt, Human
auaaagccugaaccugacacu

SEQ ID NO: 900391 - RNA, 24 nt, Human
auaaagccugaaccugacacucaa

SEQ ID NO: 900392 - RNA, 27 nt, Human
cagcaauaaagccugaaccugacacuc

SEQ ID NO: 900393 - RNA, 21 nt, Human
cauaacaacugcuccaugcag

SEQ ID NO: 900394 - RNA, 18 nt, Human
ccaggccccgccccaagc

SEQ ID NO: 900395 - RNA, 19 nt, Human
cugcuccaugcaggaguaa

SEQ ID NO: 900396 - RNA, 22 nt, Human
cuucacaaauaauuuggaaaau

SEQ ID NO: 900397 - RNA, 22 nt, Human
cuucccgcagccggcgccuucc

SEQ ID NO: 900398 - RNA, 22 nt, Human
gaagacagcaauaaagccugaa

SEQ ID NO: 900399 - RNA, 23 nt, Human
gaagucaacauuaagcccaacuc

SEQ ID NO: 900400 - RNA, 23 nt, Human
gacucugcaucuuaauuccuaaa

SEQ ID NO: 900401 - RNA, 23 nt, Human
uaagcccaacucuauuuucagac

SEQ ID NO: 900402 - RNA, 24 nt, Human
uacagaaguuaaaaagugauguau

SEQ ID NO: 900403 - RNA, 22 nt, Human
uagaaacugcauuuccccucca

SEQ ID NO: 900404 - RNA, 20 nt, Human
uggaaaaucagccuaaaggu

SEQ ID NO: 900405 - RNA, 18 nt, Human
uucaauaagaaucuaaag

SEQ ID NO: 900406 - RNA, 23 nt, Human
uugaagacagcaauaaagccuga

SEQ ID NO: 900407 - RNA, 25 nt, Human
uuuacagucaaagacauuuucagag

SEQ ID NO: 900408 - RNA, 24 nt, Human
aacgugggcugacaccccuccccg

SEQ ID NO: 900409 - RNA, 19 nt, Human
accccaaaggccagcaacg

SEQ ID NO: 900410 - RNA, 21 nt, Human
accucacacacuggucuaagu

SEQ ID NO: 900411 - RNA, 20 nt, Human
acuggucuaaguccaaccuc

SEQ ID NO: 900412 - RNA, 24 nt, Human
acuggucuaaguccaaccucacac

SEQ ID NO: 900413 - RNA, 23 nt, Human
aggcgccccccugcacaaaccuc

SEQ ID NO: 900414 - RNA, 19 nt, Human
agggauguggucaucucug

SEQ ID NO: 900415 - RNA, 21 nt, Human
caacgugggcugacaccccuc

SEQ ID NO: 900416 - RNA, 23 nt, Human
cacaaaccucacgaaguuguccc

SEQ ID NO: 900417 - RNA, 23 nt, Human
cacaccagcagcuuuccccacaa

SEQ ID NO: 900418 - RNA, 22 nt, Human
caccucacacacuggucuaagu

SEQ ID NO: 900419 - RNA, 19 nt, Human
ccaaaggccagcaacgugg

SEQ ID NO: 900420 - RNA, 20 nt, Human
ccaacccccugcugcggccg

SEQ ID NO: 900421 - RNA, 19 nt, Human
ccagcggccccauggcgua

SEQ ID NO: 900422 - RNA, 23 nt, Human
cccacaaaucccaggucuaggcc

SEQ ID NO: 900423 - RNA, 22 nt, Human
ccccaaaggccagcaacguggg

SEQ ID NO: 900424 - RNA, 19 nt, Human
ccccaaagucugugucugg

SEQ ID NO: 900425 - RNA, 21 nt, Human
ccccggggcaucuuuggacgg

SEQ ID NO: 900426 - RNA, 20 nt, Human
ccccugcacaaaccucacga

SEQ ID NO: 900427 - RNA, 22 nt, Human
ccccugcugcggccgcuguuac

SEQ ID NO: 900428 - RNA, 23 nt, Human
ccugcugcggccgcuguuaccac

SEQ ID NO: 900429 - RNA, 18 nt, Human
cgccccccugcacaaacc

SEQ ID NO: 900430 - RNA, 18 nt, Human
cucacgaaguuguccccg

SEQ ID NO: 900431 - RNA, 18 nt, Human
cugcaggucuccuggcug

SEQ ID NO: 900432 - RNA, 21 nt, Human
cugcaggucuccuggcugggu

SEQ ID NO: 900433 - RNA, 18 nt, Human
cuggaaggcgcagggcug

SEQ ID NO: 900434 - RNA, 24 nt, Human
cuggucacaccagcagcuuucccc

SEQ ID NO: 900435 - RNA, 21 nt, Human
cuguccucucagggccuggga

SEQ ID NO: 900436 - RNA, 19 nt, Human
cuucuuagcagggagcugg

SEQ ID NO: 900437 - RNA, 22 nt, Human
gagcuggccacagccaaggcgc

SEQ ID NO: 900438 - RNA, 25 nt, Human
gcgcagggcugcaggucuccuggcu

SEQ ID NO: 900439 - RNA, 20 nt, Human
gggaucggccuucgaggccu

SEQ ID NO: 900440 - RNA, 21 nt, Human
gggcugcaggucuccuggcug

SEQ ID NO: 900441 - RNA, 18 nt, Human
gucuaggccaacccccug

SEQ ID NO: 900442 - RNA, 19 nt, Human
uaggugaagggguccacgu

SEQ ID NO: 900443 - RNA, 18 nt, Human
ucuaggccaacccccugc

SEQ ID NO: 900444 - RNA, 22 nt, Human
ucuguccucucagggccuggga

SEQ ID NO: 900445 - RNA, 19 nt, Human
ugacaccccuccccggggc

SEQ ID NO: 900446 - RNA, 20 nt, Human
uggcgggugcucugguaggu

SEQ ID NO: 900447 - RNA, 22 nt, Human
ugggaccugcuucuggaaggcg

SEQ ID NO: 900448 - RNA, 25 nt, Human
uguggucaucucuguccucucaggg

SEQ ID NO: 900449 - RNA, 25 nt, Human
uuaggguggcuuccuggucuccuuc

SEQ ID NO: 900450 - RNA, 22 nt, Human
uugaccccaaaggccagcaacg

SEQ ID NO: 900451 - RNA, 24 nt, Human
uugaccccaaaggccagcaacgug

SEQ ID NO: 900452 - RNA, 24 nt, Human
uuuuuuuuuucaggugggcacugg

SEQ ID NO: 900453 - RNA, 26 nt, Human
aaaaagaaaaagacauccauaaaaag

SEQ ID NO: 900454 - RNA, 21 nt, Human
aaaaagaaacagauccaugca

SEQ ID NO: 900455 - RNA, 26 nt, Human
aaaaagaaacagauccaugcacucaa

SEQ ID NO: 900456 - RNA, 25 nt, Human
aaaagaaaaagacauccauaaaaag

SEQ ID NO: 900457 - RNA, 23 nt, Human
aaagaaaaagacauccauaaaaa

SEQ ID NO: 900458 - RNA, 22 nt, Human
aagaaaaagacauccauaaaaa

SEQ ID NO: 900459 - RNA, 19 nt, Human
aagcaaggagggaggggug

SEQ ID NO: 900460 - RNA, 18 nt, Human
aaggacagagagagagag

SEQ ID NO: 900461 - RNA, 19 nt, Human
acagagagaggcagagacg

SEQ ID NO: 900462 - RNA, 21 nt, Human
acagagagaggcagagacgga

SEQ ID NO: 900463 - RNA, 20 nt, Human
acgcgccccuagcccggcgu

SEQ ID NO: 900464 - RNA, 24 nt, Human
acuccugggggugggggugggggu

SEQ ID NO: 900465 - RNA, 22 nt, Human
agaacaaaagcccagcaaaaag

SEQ ID NO: 900466 - RNA, 21 nt, Human
agaaccagagccauaaaaaga

SEQ ID NO: 900467 - RNA, 24 nt, Human
agagaacaaaagcccagcaaaaag

SEQ ID NO: 900468 - RNA, 18 nt, Human
agauccaugcacucaacu

SEQ ID NO: 900469 - RNA, 20 nt, Human
aggcagaaugaaaagggccc

SEQ ID NO: 900470 - RNA, 24 nt, Human
aggcagaaugaaaagggcccccag

SEQ ID NO: 900471 - RNA, 19 nt, Human
aggcagagaacaaaagccc

SEQ ID NO: 900472 - RNA, 22 nt, Human
aggcagcagcccgagccacagc

SEQ ID NO: 900473 - RNA, 23 nt, Human
aggcagcagcccgagccacagca

SEQ ID NO: 900474 - RNA, 21 nt, Human
aggccccccaggcagcagccc

SEQ ID NO: 900475 - RNA, 23 nt, Human
caaaagcccagcaaaaaggcggg

SEQ ID NO: 900476 - RNA, 19 nt, Human
caacuccuggggguggggg

SEQ ID NO: 900477 - RNA, 19 nt, Human
cagaaagaaagaaguggug

SEQ ID NO: 900478 - RNA, 24 nt, Human
cagagagagagagacagagagagg

SEQ ID NO: 900479 - RNA, 19 nt, Human
cagagccauaaaaagaaaa

SEQ ID NO: 900480 - RNA, 22 nt, Human
cagagccauaaaaagaaaaaga

SEQ ID NO: 900481 - RNA, 20 nt, Human
cagauccaugcacucaacuc

SEQ ID NO: 900482 - RNA, 23 nt, Human
cagcagcccgagccacagcauuu

SEQ ID NO: 900483 - RNA, 19 nt, Human
ccagcccccggaggccccc

SEQ ID NO: 900484 - RNA, 18 nt, Human
ccaggcagcagcccgagc

SEQ ID NO: 900485 - RNA, 23 nt, Human
cccagcaaaaaggcggggagaaa

SEQ ID NO: 900486 - RNA, 19 nt, Human
cccccagcccccggaggcc

SEQ ID NO: 900487 - RNA, 18 nt, Human
ccccggaggccccccagg

SEQ ID NO: 900488 - RNA, 20 nt, Human
ccuagcccggcgucccgacc

SEQ ID NO: 900489 - RNA, 25 nt, Human
cgccccuagcccggcgucccgaccu

SEQ ID NO: 900490 - RNA, 19 nt, Human
cucaacuccuggggguggg

SEQ ID NO: 900491 - RNA, 21 nt, Human
cugggggugggggugggggug

SEQ ID NO: 900492 - RNA, 21 nt, Human
gaaaaagacauccauaaaaag

SEQ ID NO: 900493 - RNA, 21 nt, Human
gaaagaacuggagaaccagag

SEQ ID NO: 900494 - RNA, 21 nt, Human
gaaccagagccauaaaaagaa

SEQ ID NO: 900495 - RNA, 24 nt, Human
gcagagaacaaaagcccagcaaaa

SEQ ID NO: 900496 - RNA, 19 nt, Human
gccccccaggcagcagccc

SEQ ID NO: 900497 - RNA, 20 nt, Human
gccccccaggcagcagcccg

SEQ ID NO: 900498 - RNA, 22 nt, Human
ggaagcaaggagggaggggugg

SEQ ID NO: 900499 - RNA, 26 nt, Human
ggaagcaaggagggagggguggaagg

SEQ ID NO: 900500 - RNA, 26 nt, Human
gggugggaagcaaggagggaggggug

SEQ ID NO: 900501 - RNA, 21 nt, Human
uaaaaaaagaaacagauccau

SEQ ID NO: 900502 - RNA, 22 nt, Human
uaaauaaaaaaagaaacagauc

SEQ ID NO: 900503 - RNA, 23 nt, Human
uaaauaaaaaaagaaacagaucc

SEQ ID NO: 900504 - RNA, 24 nt, Human
ucaacuccuggggguggggguggg

SEQ ID NO: 900505 - RNA, 22 nt, Human
uccauaaaaaggcagaaagaaa

SEQ ID NO: 900506 - RNA, 19 nt, Human
ugaaaaaauagacagaaau

SEQ ID NO: 900507 - RNA, 22 nt, Human
ugaaaagggcccccagcccccg

SEQ ID NO: 900508 - RNA, 22 nt, Human
ugacagagacagagagaucacc

SEQ ID NO: 900509 - RNA, 21 nt, Human
ugaggaaugggugggaagcaa

SEQ ID NO: 900510 - RNA, 21 nt, Human
ugggggugggagugagggaug

SEQ ID NO: 900511 - RNA, 18 nt, Human
ugggggugggggugggag

SEQ ID NO: 900512 - RNA, 18 nt, Human
uggggguggggguggggg

SEQ ID NO: 900513 - RNA, 25 nt, Human
aaaaagacauucgugcauuuaagcc

SEQ ID NO: 900514 - RNA, 22 nt, Human
aaauaauagugaagaaaaaaac

SEQ ID NO: 900515 - RNA, 20 nt, Human
aaaugaguagagucaacuca

SEQ ID NO: 900516 - RNA, 22 nt, Human
aacucaaugaaauguuugauau

SEQ ID NO: 900517 - RNA, 22 nt, Human
aagcagaggcggcggcagcagc

SEQ ID NO: 900518 - RNA, 19 nt, Human
aaugguagaaauacauacu

SEQ ID NO: 900519 - RNA, 18 nt, Human
aaugucaguggcccaaaa

SEQ ID NO: 900520 - RNA, 18 nt, Human
aauuuuuuuuuucuaaga

SEQ ID NO: 900521 - RNA, 19 nt, Human
acauccuuaucuuucaaag

SEQ ID NO: 900522 - RNA, 18 nt, Human
acaugaugcuuuaucuaa

SEQ ID NO: 900523 - RNA, 19 nt, Human
acugcugagagaggugugg

SEQ ID NO: 900524 - RNA, 18 nt, Human
agaaaugaugaaaaauaa

SEQ ID NO: 900525 - RNA, 18 nt, Human
agaggcggcggcagcagc

SEQ ID NO: 900526 - RNA, 23 nt, Human
agcagcagcggcagcggcggcag

SEQ ID NO: 900527 - RNA, 22 nt, Human
agcagcggcagcggcggcagcc

SEQ ID NO: 900528 - RNA, 24 nt, Human
agcaguagcaauaacagcagcagc

SEQ ID NO: 900529 - RNA, 23 nt, Human
agccaagaagauuauucuugacc

SEQ ID NO: 900530 - RNA, 19 nt, Human
agcggcagcggcggcagcc

SEQ ID NO: 900531 - RNA, 18 nt, Human
aucagagaauuguguuaa

SEQ ID NO: 900532 - RNA, 23 nt, Human
augaaaaauaauagugaagaaaa

SEQ ID NO: 900533 - RNA, 21 nt, Human
auucucagagcuaggaguccc

SEQ ID NO: 900534 - RNA, 22 nt, Human
caaaaguuuugacccaaggaau

SEQ ID NO: 900535 - RNA, 25 nt, Human
caaagacaacucccaagucucccca

SEQ ID NO: 900536 - RNA, 23 nt, Human
caaggaauagauaaagggauuaa

SEQ ID NO: 900537 - RNA, 21 nt, Human
cacaauggugguuacaauggu

SEQ ID NO: 900538 - RNA, 21 nt, Human
cagcagcaguagcaauaacag

SEQ ID NO: 900539 - RNA, 23 nt, Human
cagcagcggcagcggcggcagcc

SEQ ID NO: 900540 - RNA, 21 nt, Human
cagcggcagcggcggcagccg

SEQ ID NO: 900541 - RNA, 21 nt, Human
cauaaucuaaaucuagaggac

SEQ ID NO: 900542 - RNA, 19 nt, Human
caugacaaggacaugauag

SEQ ID NO: 900543 - RNA, 21 nt, Human
cccaaggaauagauaaaggga

SEQ ID NO: 900544 - RNA, 21 nt, Human
cgcccuggggggcgaucauuc

SEQ ID NO: 900545 - RNA, 26 nt, Human
cgccuccaacccgcgcgccccaguuu

SEQ ID NO: 900546 - RNA, 23 nt, Human
cgcgcgccccaguuuacccucuc

SEQ ID NO: 900547 - RNA, 23 nt, Human
cggcagcggcggcagccgcccug

SEQ ID NO: 900548 - RNA, 25 nt, Human
cuccccauauuuuauuuugcacaaa

SEQ ID NO: 900549 - RNA, 19 nt, Human
cugcagugggcgcuggccg

SEQ ID NO: 900550 - RNA, 23 nt, Human
cuguacagcaccgcaucagagaa

SEQ ID NO: 900551 - RNA, 21 nt, Human
gaaaaauaauagugaagaaaa

SEQ ID NO: 900552 - RNA, 21 nt, Human
gacaacucccaagucucccca

SEQ ID NO: 900553 - RNA, 21 nt, Human
gaggcggcggcagcagcagua

SEQ ID NO: 900554 - RNA, 20 nt, Human
gaguaacucaguuguaugaa

SEQ ID NO: 900555 - RNA, 19 nt, Human
gcaaaacuaugacuuuagc

SEQ ID NO: 900556 - RNA, 18 nt, Human
gcagcagcggcagcggcg

SEQ ID NO: 900557 - RNA, 19 nt, Human
gcagcggcagcggcggcag

SEQ ID NO: 900558 - RNA, 19 nt, Human
gcggcagccgcccuggggg

SEQ ID NO: 900559 - RNA, 20 nt, Human
gcugaagcgccuccaacccg

SEQ ID NO: 900560 - RNA, 20 nt, Human
ggcccaaaaaacuuggggua

SEQ ID NO: 900561 - RNA, 25 nt, Human
ggccgcggugcugaagcgccuccaa

SEQ ID NO: 900562 - RNA, 18 nt, Human
ggcggcagccgcccuggg

SEQ ID NO: 900563 - RNA, 21 nt, Human
ggguccugacauaaggaauuu

SEQ ID NO: 900564 - RNA, 18 nt, Human
gucguuuuuccauuuugu

SEQ ID NO: 900565 - RNA, 18 nt, Human
guugcauucaguggagug

SEQ ID NO: 900566 - RNA, 18 nt, Human
uaaaugaaauccuuacau

SEQ ID NO: 900567 - RNA, 23 nt, Human
uaaauuaaaugcuaguacauuua

SEQ ID NO: 900568 - RNA, 18 nt, Human
uaacuccucagggcucau

SEQ ID NO: 900569 - RNA, 23 nt, Human
uacaaugguagaaauacauacug

SEQ ID NO: 900570 - RNA, 26 nt, Human
uacugccaauaaaauguuagcaagag

SEQ ID NO: 900571 - RNA, 22 nt, Human
uagauaaagggauuaacugcug

SEQ ID NO: 900572 - RNA, 23 nt, Human
uagcacaauggugguuacaaugg

SEQ ID NO: 900573 - RNA, 22 nt, Human
uagcuagcccaccucaaaaguu

SEQ ID NO: 900574 - RNA, 22 nt, Human
uauauggguugcauucagugga

SEQ ID NO: 900575 - RNA, 23 nt, Human
uauguaaagggguaagccaagaa

SEQ ID NO: 900576 - RNA, 23 nt, Human
uauguggaaaauacauccaaacu

SEQ ID NO: 900577 - RNA, 19 nt, Human
uauuacuuucacagaagug

SEQ ID NO: 900578 - RNA, 22 nt, Human
ucaacucaaauccaauauuugg

SEQ ID NO: 900579 - RNA, 18 nt, Human
ucuaaaucauuacauccu

SEQ ID NO: 900580 - RNA, 20 nt, Human
ugaaaacaugucacauuugc

SEQ ID NO: 900581 - RNA, 23 nt, Human
ugaaaccacaaagacaacuccca

SEQ ID NO: 900582 - RNA, 19 nt, Human
ugaagaaaaaaacggaagg

SEQ ID NO: 900583 - RNA, 18 nt, Human
ugaagcgccuccaacccg

SEQ ID NO: 900584 - RNA, 21 nt, Human
ugacaguuuuaaaaaaaaaga

SEQ ID NO: 900585 - RNA, 19 nt, Human
ugccccucuuuacucucuu

SEQ ID NO: 900586 - RNA, 19 nt, Human
ugcugagagagguguggag

SEQ ID NO: 900587 - RNA, 19 nt, Human
ugcuuuggagaaaugauga

SEQ ID NO: 900588 - RNA, 19 nt, Human
uggggggcgaucauuccgc

SEQ ID NO: 900589 - RNA, 20 nt, Human
uguacagcaccgcaucagag

SEQ ID NO: 900590 - RNA, 24 nt, Human
uguaggcucuccacucacugcaga

SEQ ID NO: 900591 - RNA, 19 nt, Human
uguguuaacagcaaaauga

SEQ ID NO: 900592 - RNA, 23 nt, Human
uguuugauauauaguuagcuuau

SEQ ID NO: 900593 - RNA, 22 nt, Human
uugaaaccacaaagacaacucc

SEQ ID NO: 900594 - RNA, 23 nt, Human
uugaaaccacaaagacaacuccc

SEQ ID NO: 900595 - RNA, 24 nt, Human
uugaaaccacaaagacaacuccca

SEQ ID NO: 900596 - RNA, 23 nt, Human
uugaaaugaauuacacuuaaaug

SEQ ID NO: 900597 - RNA, 19 nt, Human
uugggguaaaauaaagacu

SEQ ID NO: 900598 - RNA, 26 nt, Human
uuucaaagaaaaucaugguacuaugg

SEQ ID NO: 900599 - RNA, 23 nt, Human
uuugccccucuuuacucucuuuu

SEQ ID NO: 900600 - RNA, 25 nt, Human
uuuuugccccucuuuacucucuuuu

SEQ ID NO: 900601 - RNA, 23 nt, Human
uuuuuuaaagaaauaaaugggau

SEQ ID NO: 900602 - RNA, 23 nt, Human
aaaagaaccaccccuccgccccc

SEQ ID NO: 900603 - RNA, 22 nt, Human
aaccaccccuccgcccccgcca

SEQ ID NO: 900604 - RNA, 27 nt, Human
aaccgacccagaaccccaaacugcccc

SEQ ID NO: 900605 - RNA, 21 nt, Human
aacgucccaggggugggggcg

SEQ ID NO: 900606 - RNA, 20 nt, Human
aacuggucuuuuucugccuc

SEQ ID NO: 900607 - RNA, 23 nt, Human
aagccgcuggaaccgacccagaa

SEQ ID NO: 900608 - RNA, 25 nt, Human
aauacagcucuccaaacagcugguc

SEQ ID NO: 900609 - RNA, 23 nt, Human
acaaccaaaaccuuaaacauaga

SEQ ID NO: 900610 - RNA, 25 nt, Human
acccaccgcaccccgaccggguguc

SEQ ID NO: 900611 - RNA, 25 nt, Human
acccagaaccccaaacugccccgag

SEQ ID NO: 900612 - RNA, 18 nt, Human
acccggggcgcgccaacc

SEQ ID NO: 900613 - RNA, 20 nt, Human
acgcuacuuuuggggaaagg

SEQ ID NO: 900614 - RNA, 19 nt, Human
acuaccaacaaccaaaacc

SEQ ID NO: 900615 - RNA, 22 nt, Human
aggaaaagaaccaccccuccgc

SEQ ID NO: 900616 - RNA, 26 nt, Human
aggaacagcggaaagcgccuucccgc

SEQ ID NO: 900617 - RNA, 22 nt, Human
agggaggccgggccgaggucgc

SEQ ID NO: 900618 - RNA, 19 nt, Human
agggggugcccgacagucc

SEQ ID NO: 900619 - RNA, 24 nt, Human
aggggugggggcggggaagggggu

SEQ ID NO: 900620 - RNA, 21 nt, Human
caccccuccgcccccgccacu

SEQ ID NO: 900621 - RNA, 19 nt, Human
caccgucaggaaacaaggu

SEQ ID NO: 900622 - RNA, 22 nt, Human
cacuggaugcaaggcgguuggu

SEQ ID NO: 900623 - RNA, 21 nt, Human
cagaaccccaaacugccccga

SEQ ID NO: 900624 - RNA, 23 nt, Human
cauagaaaaucaaaguaaacugc

SEQ ID NO: 900625 - RNA, 23 nt, Human
cccaccgcaccccgacgccgacc

SEQ ID NO: 900626 - RNA, 26 nt, Human
cccaccgcaccccgacgccgaccacc

SEQ ID NO: 900627 - RNA, 21 nt, Human
cccagaaccccaaacugcccc

SEQ ID NO: 900628 - RNA, 28 nt, Human
cccagaaccccaaacugccccgaggcgc

SEQ ID NO: 900629 - RNA, 20 nt, Human
ccccaggcccaggcccgccc

SEQ ID NO: 900630 - RNA, 21 nt, Human
cccccaggauuuaagagcgaa

SEQ ID NO: 900631 - RNA, 24 nt, Human
cccccaggauuuaagagcgaaaac

SEQ ID NO: 900632 - RNA, 22 nt, Human
ccccuacccaccgcaccccgac

SEQ ID NO: 900633 - RNA, 21 nt, Human
ccgccgagcagcgggcgguuc

SEQ ID NO: 900634 - RNA, 22 nt, Human
ccgccgucgccaccgcagcugg

SEQ ID NO: 900635 - RNA, 20 nt, Human
ccgcuggaaccgacccagaa

SEQ ID NO: 900636 - RNA, 21 nt, Human
cgacccagaaccccaaacugc

SEQ ID NO: 900637 - RNA, 23 nt, Human
cgacccagaaccccaaacugccc

SEQ ID NO: 900638 - RNA, 22 nt, Human
cgccccaggcccaggcccgccc

SEQ ID NO: 900639 - RNA, 18 nt, Human
cgcccguggccucuggcg

SEQ ID NO: 900640 - RNA, 24 nt, Human
cggcccgcugaggaacagcggaaa

SEQ ID NO: 900641 - RNA, 22 nt, Human
cggccucgcucucccagacgca

SEQ ID NO: 900642 - RNA, 22 nt, Human
cggcuacuaccaacaaccaaaa

SEQ ID NO: 900643 - RNA, 22 nt, Human
cuacguauguagcucuucaacu

SEQ ID NO: 900644 - RNA, 24 nt, Human
cugcgggccgcgcuggucaagggc

SEQ ID NO: 900645 - RNA, 21 nt, Human
cugggugagagcgagcacuuu

SEQ ID NO: 900646 - RNA, 22 nt, Human
cugggugagagcgagcacuuuc

SEQ ID NO: 900647 - RNA, 19 nt, Human
cuugaguuccggcagccuc

SEQ ID NO: 900648 - RNA, 20 nt, Human
gacccagaaccccaaacugc

SEQ ID NO: 900649 - RNA, 19 nt, Human
gagcacuuucugccuaaag

SEQ ID NO: 900650 - RNA, 21 nt, Human
gagcagcgggcgguucagggc

SEQ ID NO: 900651 - RNA, 22 nt, Human
gagcgagcacuuucugccuaaa

SEQ ID NO: 900652 - RNA, 20 nt, Human
gaggaacagcggaaagcgcc

SEQ ID NO: 900653 - RNA, 20 nt, Human
gaguucuaaguugcuuucua

SEQ ID NO: 900654 - RNA, 19 nt, Human
gcagcgggcgguucagggc

SEQ ID NO: 900655 - RNA, 26 nt, Human
gcgagucuuaaauacagcucuccaaa

SEQ ID NO: 900656 - RNA, 19 nt, Human
gcuccggggagguagcgcu

SEQ ID NO: 900657 - RNA, 18 nt, Human
ggaacaagggcgcccgug

SEQ ID NO: 900658 - RNA, 21 nt, Human
ggagaaggaaaagaaccaccc

SEQ ID NO: 900659 - RNA, 20 nt, Human
ggcccgcugaggaacagcgg

SEQ ID NO: 900660 - RNA, 23 nt, Human
ggcccgcugaggaacagcggaaa

SEQ ID NO: 900661 - RNA, 18 nt, Human
ggccgggccgaggucgcg

SEQ ID NO: 900662 - RNA, 23 nt, Human
ggcggaggagaaggaaaagaacc

SEQ ID NO: 900663 - RNA, 22 nt, Human
gucuguaacaaaucgaaacuga

SEQ ID NO: 900664 - RNA, 21 nt, Human
guggacccacgucccaaccca

SEQ ID NO: 900665 - RNA, 20 nt, Human
guuguccucgccccuacccc

SEQ ID NO: 900666 - RNA, 19 nt, Human
uaaaauaaagugccaguua

SEQ ID NO: 900667 - RNA, 23 nt, Human
uaaaauaaagugccaguuaaauu

SEQ ID NO: 900668 - RNA, 21 nt, Human
uaagcaagcuuaaauguuggu

SEQ ID NO: 900669 - RNA, 20 nt, Human
uacaccgucaggaaacaagg

SEQ ID NO: 900670 - RNA, 21 nt, Human
uacagcucuccaaacagcugg

SEQ ID NO: 900671 - RNA, 23 nt, Human
uacagcucuccaaacagcugguc

SEQ ID NO: 900672 - RNA, 22 nt, Human
uacccaccgcaccccgacgccg

SEQ ID NO: 900673 - RNA, 18 nt, Human
uacuaccaacaaccaaaa

SEQ ID NO: 900674 - RNA, 23 nt, Human
uacuccugcguguuaaugagaac

SEQ ID NO: 900675 - RNA, 21 nt, Human
uccaaacagcuggucuacaaa

SEQ ID NO: 900676 - RNA, 20 nt, Human
ucccagaccgucugcaccgc

SEQ ID NO: 900677 - RNA, 19 nt, Human
uccgccgagcagcgggcgg

SEQ ID NO: 900678 - RNA, 23 nt, Human
ucgaaaugcuuuccuugcucggc

SEQ ID NO: 900679 - RNA, 18 nt, Human
ucucccagacgcagggag

SEQ ID NO: 900680 - RNA, 24 nt, Human
ucuguaacaaaucgaaaccggggc

SEQ ID NO: 900681 - RNA, 22 nt, Human
ugacaggacggcgacugugaga

SEQ ID NO: 900682 - RNA, 20 nt, Human
ugcucgagcgcagccccuag

SEQ ID NO: 900683 - RNA, 25 nt, Human
ugcugggugagagcgagcacuuucu

SEQ ID NO: 900684 - RNA, 24 nt, Human
ugcugggugagagcgagcacuuuu

SEQ ID NO: 900685 - RNA, 21 nt, Human
uggaaccgacccagaacccca

SEQ ID NO: 900686 - RNA, 20 nt, Human
uggccggcgggaacaagggc

SEQ ID NO: 900687 - RNA, 24 nt, Human
aaaaagagcauaagaaaccauuaa

SEQ ID NO: 900688 - RNA, 22 nt, Human
agcuagggggauggaugucaua

SEQ ID NO: 900689 - RNA, 18 nt, Human
aguaccuggauggccucu

SEQ ID NO: 900690 - RNA, 22 nt, Human
auaauggugagaucacaaauac

SEQ ID NO: 900691 - RNA, 22 nt, Human
caaagcaguuauuucuuugcaa

SEQ ID NO: 900692 - RNA, 24 nt, Human
ccucuuacaaaucaaaaauaucau

SEQ ID NO: 900693 - RNA, 31 nt, Human
cugaagaagaggucagagaaaauggucuauu

SEQ ID NO: 900694 - RNA, 19 nt, Human
cuugcaaacaaagcaguua

SEQ ID NO: 900695 - RNA, 19 nt, Human
gcaaaucauuuuguaacaa

SEQ ID NO: 900696 - RNA, 21 nt, Human
uaaagauuuacauuauuuuga

SEQ ID NO: 900697 - RNA, 23 nt, Human
uagaaaugauacacucacuuucu

SEQ ID NO: 900698 - RNA, 23 nt, Human
uaggauaguugcugaaaucugcu

SEQ ID NO: 900699 - RNA, 26 nt, Human
uaggauaguugcugaaaucugcuaaa

SEQ ID NO: 900700 - RNA, 27 nt, Human
uaugaaaugaugcagaugucaccaaca

SEQ ID NO: 900701 - RNA, 18 nt, Human
ucccaguuaaaauggaac

SEQ ID NO: 900702 - RNA, 22 nt, Human
ugaaaucugcuaaaauacaaau

SEQ ID NO: 900703 - RNA, 20 nt, Human
ugaaaugaugcagaugucac

SEQ ID NO: 900704 - RNA, 22 nt, Human
ugagcuagggggauggauguca

SEQ ID NO: 900705 - RNA, 19 nt, Human
ugccuuggguccuuaguac

SEQ ID NO: 900706 - RNA, 19 nt, Human
ugcuaaaauacaaauugca

SEQ ID NO: 900707 - RNA, 19 nt, Human
ugcuacuuccuuccucauu

SEQ ID NO: 900708 - RNA, 20 nt, Human
uggugagaucacaaauacca

SEQ ID NO: 900709 - RNA, 19 nt, Human
uguuguuuugguauucuga

SEQ ID NO: 900710 - RNA, 21 nt, Human
uguuguuuugguauucugagg

SEQ ID NO: 900711 - RNA, 18 nt, Human
uucuuugcaaaucauuuu

SEQ ID NO: 900712 - RNA, 25 nt, Human
uucuuugcaaaucauuuuguaacaa

SEQ ID NO: 900713 - RNA, 22 nt, Human
aaaugcccgcgugcacaagaau

SEQ ID NO: 900714 - RNA, 24 nt, Human
accacuacaugaaaugaaucacaa

SEQ ID NO: 900715 - RNA, 18 nt, Human
acgcagagugugcacgca

SEQ ID NO: 900716 - RNA, 20 nt, Human
agaggcagacaacucgggaa

SEQ ID NO: 900717 - RNA, 18 nt, Human
agccugggggcagaggcu

SEQ ID NO: 900718 - RNA, 19 nt, Human
agccugggggcagaggcuc

SEQ ID NO: 900719 - RNA, 21 nt, Human
aggcugagccucgggugcggc

SEQ ID NO: 900720 - RNA, 18 nt, Human
agggccacuuccaaagcc

SEQ ID NO: 900721 - RNA, 27 nt, Human
agugugcacgcaugugcuuggugugca

SEQ ID NO: 900722 - RNA, 18 nt, Human
augcccgcgugcacaaga

SEQ ID NO: 900723 - RNA, 20 nt, Human
cacaccccucaggcugagcc

SEQ ID NO: 900724 - RNA, 23 nt, Human
caccccugcuuagccuacccgcu

SEQ ID NO: 900725 - RNA, 21 nt, Human
cagcauuugaggagaggcaga

SEQ ID NO: 900726 - RNA, 19 nt, Human
caggcccagccugggggca

SEQ ID NO: 900727 - RNA, 18 nt, Human
cagugggagaugcggggc

SEQ ID NO: 900728 - RNA, 21 nt, Human
ccccugcuuagccuacccgcu

SEQ ID NO: 900729 - RNA, 25 nt, Human
ccccugcuuagccuacccgcugcuu

SEQ ID NO: 900730 - RNA, 23 nt, Human
ccucagcaccccugcuuagccua

SEQ ID NO: 900731 - RNA, 18 nt, Human
cugguguguucucuggag

SEQ ID NO: 900732 - RNA, 18 nt, Human
gaagugggagggccuggg

SEQ ID NO: 900733 - RNA, 18 nt, Human
gaggggccauggggcugg

SEQ ID NO: 900734 - RNA, 24 nt, Human
gcacagggagcucaggacuucagc

SEQ ID NO: 900735 - RNA, 21 nt, Human
gcagugggagaugcggggcug

SEQ ID NO: 900736 - RNA, 21 nt, Human
gcugcugagcuggaaagugga

SEQ ID NO: 900737 - RNA, 23 nt, Human
ggacguuauggggcaggaguuuu

SEQ ID NO: 900738 - RNA, 18 nt, Human
ggccauggggcuggggcu

SEQ ID NO: 900739 - RNA, 18 nt, Human
gggaagaagccacaggug

SEQ ID NO: 900740 - RNA, 21 nt, Human
gggaagugggagggccugggc

SEQ ID NO: 900741 - RNA, 22 nt, Human
gggagaugcggggcuggccuuc

SEQ ID NO: 900742 - RNA, 27 nt, Human
uacacugggggaagaagccacagguga

SEQ ID NO: 900743 - RNA, 25 nt, Human
uccucagcaccccugcuuagccuac

SEQ ID NO: 900744 - RNA, 18 nt, Human
ucgagcccacagagaagu

SEQ ID NO: 900745 - RNA, 22 nt, Human
ugaaaugaaucacagacgcaga

SEQ ID NO: 900746 - RNA, 20 nt, Human
ugaggagaggcagacaacuc

SEQ ID NO: 900747 - RNA, 21 nt, Human
ugagggagacgugggggggcu

SEQ ID NO: 900748 - RNA, 19 nt, Human
ugagguguggagaggggcc

SEQ ID NO: 900749 - RNA, 18 nt, Human
ugcaaagggaggucugug

SEQ ID NO: 900750 - RNA, 18 nt, Human
uggacaauugcagcacac

SEQ ID NO: 900751 - RNA, 19 nt, Human
uggagaggggccauggggc

SEQ ID NO: 900752 - RNA, 23 nt, Human
uggagaggggccauggggcuggg

SEQ ID NO: 900753 - RNA, 22 nt, Human
uguauaugagggagacgugggg

SEQ ID NO: 900754 - RNA, 24 nt, Human
uguggagaggggccauggggcugg

SEQ ID NO: 900755 - RNA, 22 nt, Human
aaacagagcagucaagaccagg

SEQ ID NO: 900756 - RNA, 22 nt, Human
aagcccugccaggccccacccc

SEQ ID NO: 900757 - RNA, 21 nt, Human
aaguccuccagguggcagcuc

SEQ ID NO: 900758 - RNA, 23 nt, Human
acagggcugaaggcagcuggagc

SEQ ID NO: 900759 - RNA, 26 nt, Human
acccaggguucugccaacgcagcagc

SEQ ID NO: 900760 - RNA, 18 nt, Human
accgagcaucccuggccc

SEQ ID NO: 900761 - RNA, 18 nt, Human
acgcagcagcagagaggc

SEQ ID NO: 900762 - RNA, 24 nt, Human
agcacggccacugaccucuggcuu

SEQ ID NO: 900763 - RNA, 18 nt, Human
agggccagcucggggucu

SEQ ID NO: 900764 - RNA, 22 nt, Human
agggcugaaggcagcuggagcc

SEQ ID NO: 900765 - RNA, 18 nt, Human
agguggcccuaaugcuuu

SEQ ID NO: 900766 - RNA, 23 nt, Human
caagaccaggaaaacgaggccuc

SEQ ID NO: 900767 - RNA, 28 nt, Human
caagcucaggcccuacacagagccaucu

SEQ ID NO: 900768 - RNA, 21 nt, Human
cacacagcacauggggggcac

SEQ ID NO: 900769 - RNA, 21 nt, Human
cacacagcuuccccgcaacac

SEQ ID NO: 900770 - RNA, 22 nt, Human
cacagcacauggggggcacagg

SEQ ID NO: 900771 - RNA, 19 nt, Human
caccgcuggagggauggcc

SEQ ID NO: 900772 - RNA, 20 nt, Human
caccgugcagcacacagaaa

SEQ ID NO: 900773 - RNA, 20 nt, Human
cagcacauggggggcacagg

SEQ ID NO: 900774 - RNA, 19 nt, Human
ccaaacagagcagucaaga

SEQ ID NO: 900775 - RNA, 21 nt, Human
ccacagggaaaagcccauccc

SEQ ID NO: 900776 - RNA, 19 nt, Human
ccaccagcuucuccuucca

SEQ ID NO: 900777 - RNA, 19 nt, Human
ccaggccccaccccucaug

SEQ ID NO: 900778 - RNA, 23 nt, Human
ccagggccucucgcuggucuccu

SEQ ID NO: 900779 - RNA, 19 nt, Human
cccaaacagagcagucaag

SEQ ID NO: 900780 - RNA, 20 nt, Human
cccacacugagaagcagggc

SEQ ID NO: 900781 - RNA, 23 nt, Human
cccacagggaaaagcccauccca

SEQ ID NO: 900782 - RNA, 22 nt, Human
cccacccaaacagagcagucaa

SEQ ID NO: 900783 - RNA, 18 nt, Human
ccccaaagaaaagcugcc

SEQ ID NO: 900784 - RNA, 25 nt, Human
ccccaaagaaaagcugccugcugca

SEQ ID NO: 900785 - RNA, 22 nt, Human
cccccagagaaucuucucccac

SEQ ID NO: 900786 - RNA, 23 nt, Human
ccccucaugcuggcucugcugug

SEQ ID NO: 900787 - RNA, 22 nt, Human
cccgcaguguccucacagccac

SEQ ID NO: 900788 - RNA, 30 nt, Human
cccgcaguguccucacagccaccacagccu

SEQ ID NO: 900789 - RNA, 20 nt, Human
cccucagccggcuggcaguc

SEQ ID NO: 900790 - RNA, 21 nt, Human
cccucaugcuggcucugcugu

SEQ ID NO: 900791 - RNA, 21 nt, Human
cccugccaggccccaccccuc

SEQ ID NO: 900792 - RNA, 18 nt, Human
ccguggagacccccgccc

SEQ ID NO: 900793 - RNA, 21 nt, Human
ccucccguugggcagcaagcu

SEQ ID NO: 900794 - RNA, 20 nt, Human
ccuccgggugccugcccacc

SEQ ID NO: 900795 - RNA, 25 nt, Human
ccucuggcuucaagcaaaggagagg

SEQ ID NO: 900796 - RNA, 24 nt, Human
ccugagacaccugccccacacuga

SEQ ID NO: 900797 - RNA, 20 nt, Human
ccugcccacccaggguucug

SEQ ID NO: 900798 - RNA, 18 nt, Human
ccugcugcacuucccggg

SEQ ID NO: 900799 - RNA, 23 nt, Human
ccuggcccacagggaaaagccca

SEQ ID NO: 900800 - RNA, 24 nt, Human
cgcaguguccucacagccaccaca

SEQ ID NO: 900801 - RNA, 24 nt, Human
cggaacaggcaaguccuccaggug

SEQ ID NO: 900802 - RNA, 25 nt, Human
cgggugccugcccacccaggguucu

SEQ ID NO: 900803 - RNA, 18 nt, Human
cugcaaccuccuugggag

SEQ ID NO: 900804 - RNA, 19 nt, Human
cugccaacgcagcagcaga

SEQ ID NO: 900805 - RNA, 23 nt, Human
cugccaggccccaccccucaugc

SEQ ID NO: 900806 - RNA, 21 nt, Human
cugggguggccccggcugcac

SEQ ID NO: 900807 - RNA, 24 nt, Human
cuguacgguacuucugcaaccucc

SEQ ID NO: 900808 - RNA, 21 nt, Human
cugugaggggagccuugggag

SEQ ID NO: 900809 - RNA, 19 nt, Human
gaacagagcugcccaugug

SEQ ID NO: 900810 - RNA, 22 nt, Human
gaagcacggggagggaggggca

SEQ ID NO: 900811 - RNA, 22 nt, Human
gaaucuucucccacccaaacag

SEQ ID NO: 900812 - RNA, 19 nt, Human
gacaggcaccaugggcaga

SEQ ID NO: 900813 - RNA, 19 nt, Human
gaccaggaaaacgaggccu

SEQ ID NO: 900814 - RNA, 26 nt, Human
gagaaucuucucccacccaaacagag

SEQ ID NO: 900815 - RNA, 25 nt, Human
gagaggcugugaggggagccuuggg

SEQ ID NO: 900816 - RNA, 18 nt, Human
gcacauggggggcacagg

SEQ ID NO: 900817 - RNA, 28 nt, Human
gcagcagagaggccaagagucacaugaa

SEQ ID NO: 900818 - RNA, 21 nt, Human
gcaguguccucacagccacca

SEQ ID NO: 900819 - RNA, 22 nt, Human
gccccaccccucaugcuggcuc

SEQ ID NO: 900820 - RNA, 21 nt, Human
gcccugccaggccccaccccu

SEQ ID NO: 900821 - RNA, 20 nt, Human
gccugcugcacuucccgggc

SEQ ID NO: 900822 - RNA, 19 nt, Human
gccuugggaggaugugggg

SEQ ID NO: 900823 - RNA, 19 nt, Human
gccuuugcaguuuggcuca

SEQ ID NO: 900824 - RNA, 19 nt, Human
gcucagggcccagggugug

SEQ ID NO: 900825 - RNA, 18 nt, Human
ggaaaagcccaucccagg

SEQ ID NO: 900826 - RNA, 24 nt, Human
gggaaaagcccaucccaggcucug

SEQ ID NO: 900827 - RNA, 19 nt, Human
gggcacaggaugacacagc

SEQ ID NO: 900828 - RNA, 24 nt, Human
gggccagcucggggucugcagcca

SEQ ID NO: 900829 - RNA, 23 nt, Human
gggggcacaggaugacacagcug

SEQ ID NO: 900830 - RNA, 23 nt, Human
gucggaacaggcaaguccuccag

SEQ ID NO: 900831 - RNA, 20 nt, Human
guggagucggaacaggcaag

SEQ ID NO: 900832 - RNA, 22 nt, Human
guggccaccagcuucuccuucc

SEQ ID NO: 900833 - RNA, 22 nt, Human
ucaagcaagcccugccaggccc

SEQ ID NO: 900834 - RNA, 20 nt, Human
ucagggaugaggccugcacc

SEQ ID NO: 900835 - RNA, 22 nt, Human
ucagggcaagucccaccccaaa

SEQ ID NO: 900836 - RNA, 19 nt, Human
uccaccagcaugucagcug

SEQ ID NO: 900837 - RNA, 23 nt, Human
uccaccagcaugucagcugcuuc

SEQ ID NO: 900838 - RNA, 19 nt, Human
ucccgggccgugccaagcc

SEQ ID NO: 900839 - RNA, 18 nt, Human
ucccuggcccacagggaa

SEQ ID NO: 900840 - RNA, 19 nt, Human
uccgagggccagcucgggg

SEQ ID NO: 900841 - RNA, 22 nt, Human
uccuuguguccccucggcccug

SEQ ID NO: 900842 - RNA, 22 nt, Human
ucggcccugcaccaggagggca

SEQ ID NO: 900843 - RNA, 23 nt, Human
ucguccugagacaccugccccac

SEQ ID NO: 900844 - RNA, 22 nt, Human
ucuccugaagggaaaugggggu

SEQ ID NO: 900845 - RNA, 22 nt, Human
ucuccugaagggaaaugggggu

SEQ ID NO: 900846 - RNA, 22 nt, Human
ucugcagccagggacugccagc

SEQ ID NO: 900847 - RNA, 18 nt, Human
ucuggaugcucagggccc

SEQ ID NO: 900848 - RNA, 23 nt, Human
ugaaggcagcuggagcccugcca

SEQ ID NO: 900849 - RNA, 18 nt, Human
ugaccucuggcuucaagc

SEQ ID NO: 900850 - RNA, 21 nt, Human
ugccagcccccaccuggacac

SEQ ID NO: 900851 - RNA, 21 nt, Human
ugcugugaagccauccucccg

SEQ ID NO: 900852 - RNA, 23 nt, Human
uggaugcucagggcccagggugu

SEQ ID NO: 900853 - RNA, 21 nt, Human
ugggaccgagcaucccuggcc

SEQ ID NO: 900854 - RNA, 26 nt, Human
ugggaggauguggggacccccagaga

SEQ ID NO: 900855 - RNA, 24 nt, Human
uggggggcacaggaugacacagga

SEQ ID NO: 900856 - RNA, 22 nt, Human
uguccucacagccaccacagcc

SEQ ID NO: 900857 - RNA, 18 nt, Human
ugugaggggagccuuggg

SEQ ID NO: 900858 - RNA, 22 nt, Human
uuccagguagguccuugugucc

SEQ ID NO: 900859 - RNA, 22 nt, Human
accugggaggaguggaagggcu

SEQ ID NO: 900860 - RNA, 21 nt, Human
agagaugaccugggaggagug

SEQ ID NO: 900861 - RNA, 18 nt, Human
aggaaggaggugguccuu

SEQ ID NO: 900862 - RNA, 18 nt, Human
aggaaggaggugguccuu

SEQ ID NO: 900863 - RNA, 21 nt, Human
cacaggagggaggcgugugag

SEQ ID NO: 900864 - RNA, 23 nt, Human
cccgcaguacaaugaggcaggaa

SEQ ID NO: 900865 - RNA, 20 nt, Human
ccugcagcuuccagaccugc

SEQ ID NO: 900866 - RNA, 23 nt, Human
cuccucccccugcauggagaccc

SEQ ID NO: 900867 - RNA, 23 nt, Human
cuguggggaaagaagcaggccuc

SEQ ID NO: 900868 - RNA, 22 nt, Human
gaccugggaggaguggaagggc

SEQ ID NO: 900869 - RNA, 23 nt, Human
gacgugagagcuguggggaaaga

SEQ ID NO: 900870 - RNA, 19 nt, Human
gagaaucccuucagcggcu

SEQ ID NO: 900871 - RNA, 21 nt, Human
gugagagcuguggggaaagaa

SEQ ID NO: 900872 - RNA, 23 nt, Human
gugagagcuguggggaaagaagc

SEQ ID NO: 900873 - RNA, 24 nt, Human
uccaugcugccggcggcacaggag

SEQ ID NO: 900874 - RNA, 23 nt, Human
uccuugggcuucuuugucacccg

SEQ ID NO: 900875 - RNA, 23 nt, Human
uccuugggcuucuuugucacccg

SEQ ID NO: 900876 - RNA, 22 nt, Human
uggauccuggauggagagcccu

SEQ ID NO: 900877 - RNA, 24 nt, Human
uucuggauccuggauggagagccc

SEQ ID NO: 900878 - RNA, 21 nt, Human
aacucggagacacucacuggu

SEQ ID NO: 900879 - RNA, 20 nt, Human
aagaacacaaagaggagaug

SEQ ID NO: 900880 - RNA, 19 nt, Human
aagaggagaugcugcugcu

SEQ ID NO: 900881 - RNA, 18 nt, Human
aggaagaacacaaagagg

SEQ ID NO: 900882 - RNA, 19 nt, Human
aggaagaacacaaagagga

SEQ ID NO: 900883 - RNA, 18 nt, Human
caaagaggagaugcugcu

SEQ ID NO: 900884 - RNA, 23 nt, Human
caagaggaggaacucggagacac

SEQ ID NO: 900885 - RNA, 25 nt, Human
cugcugcuggggcugccuggagagu

SEQ ID NO: 900886 - RNA, 19 nt, Human
gaggaagaacacaaagagg

SEQ ID NO: 900887 - RNA, 22 nt, Human
uagaagacagugaauucagaaa

SEQ ID NO: 900888 - RNA, 19 nt, Human
ucacugguuugucccucuc

SEQ ID NO: 900889 - RNA, 19 nt, Human
ugccuggagagucccaaga

SEQ ID NO: 900890 - RNA, 19 nt, Human
ugccuggagagucccaaga

SEQ ID NO: 900891 - RNA, 18 nt, Human
ugcugcugcuggggcugc

SEQ ID NO: 900892 - RNA, 22 nt, Human
ugcugcugcuggggcugccugg

SEQ ID NO: 900893 - RNA, 24 nt, Human
ugcugcugcuggggcugccuggag

SEQ ID NO: 900894 - RNA, 23 nt, Human
ugucuggacccagcugcauagaa

SEQ ID NO: 900895 - RNA, 24 nt, Human
ccaacuccucucuuggcauggcca

SEQ ID NO: 900896 - RNA, 23 nt, Human
ccaaggcugagauccaccgaagc

SEQ ID NO: 900897 - RNA, 24 nt, Human
cucucuuggcauggccaaggcuga

SEQ ID NO: 900898 - RNA, 19 nt, Human
uuggcauggccaaggcuga

SEQ ID NO: 900899 - RNA, 24 nt, Human
aaacaccaugccauccccccccca

SEQ ID NO: 900900 - RNA, 19 nt, Human
aaacaggaacugccacaug

SEQ ID NO: 900901 - RNA, 22 nt, Human
aacaaaaugcacaaucauaaga

SEQ ID NO: 900902 - RNA, 20 nt, Human
aaccaguccacaaacaccau

SEQ ID NO: 900903 - RNA, 24 nt, Human
aaccaguccacaaacaccaugcca

SEQ ID NO: 900904 - RNA, 18 nt, Human
aacuugaucuuccuucuc

SEQ ID NO: 900905 - RNA, 23 nt, Human
aagaaaaaaggaacacugcucag

SEQ ID NO: 900906 - RNA, 22 nt, Human
aagaaacagacaucucaaaaaa

SEQ ID NO: 900907 - RNA, 20 nt, Human
aaggaaagacuacuuuaaug

SEQ ID NO: 900908 - RNA, 22 nt, Human
aaucauaagaaacaauggugaa

SEQ ID NO: 900909 - RNA, 24 nt, Human
aaucugccauuugucaguugauuu

SEQ ID NO: 900910 - RNA, 22 nt, Human
aaugcacaaucauaagaaacaa

SEQ ID NO: 900911 - RNA, 21 nt, Human
acaucuggaaagacuagcugu

SEQ ID NO: 900912 - RNA, 18 nt, Human
acccgcggccggcggggu

SEQ ID NO: 900913 - RNA, 26 nt, Human
accucccuuuuccccuccuucccuga

SEQ ID NO: 900914 - RNA, 24 nt, Human
agaagaaacagacaucucaaaaaa

SEQ ID NO: 900915 - RNA, 19 nt, Human
agaaguaauaaaaugcaca

SEQ ID NO: 900916 - RNA, 18 nt, Human
agacaucucaaaaaagcu

SEQ ID NO: 900917 - RNA, 20 nt, Human
agagcucucugcaccucccu

SEQ ID NO: 900918 - RNA, 20 nt, Human
aggaacagcugaacaacaac

SEQ ID NO: 900919 - RNA, 23 nt, Human
aggccggcuccggucuccccgcg

SEQ ID NO: 900920 - RNA, 18 nt, Human
aggccugagggcugggag

SEQ ID NO: 900921 - RNA, 24 nt, Human
aggccugagggcugggagggcucc

SEQ ID NO: 900922 - RNA, 25 nt, Human
aggcgcugagucccggcggcucggc

SEQ ID NO: 900923 - RNA, 18 nt, Human
aggguaggaagagguucg

SEQ ID NO: 900924 - RNA, 18 nt, Human
auauuauauacauauaua

SEQ ID NO: 900925 - RNA, 21 nt, Human
caaaaaccaacaacgcaauug

SEQ ID NO: 900926 - RNA, 22 nt, Human
cacaaacaccaugccauccccc

SEQ ID NO: 900927 - RNA, 20 nt, Human
cacagccuaacggccuccuu

SEQ ID NO: 900928 - RNA, 19 nt, Human
caccaugccaucccccccc

SEQ ID NO: 900929 - RNA, 23 nt, Human
caccaugccaucccccccccaca

SEQ ID NO: 900930 - RNA, 22 nt, Human
cagcugaacaacaacgcaagga

SEQ ID NO: 900931 - RNA, 24 nt, Human
cagguccccgagguaggguaggaa

SEQ ID NO: 900932 - RNA, 22 nt, Human
caucccaagugcccugucuucc

SEQ ID NO: 900933 - RNA, 21 nt, Human
caugccaucccccccccacaa

SEQ ID NO: 900934 - RNA, 23 nt, Human
caugccaucccccccccacaaaa

SEQ ID NO: 900935 - RNA, 21 nt, Human
ccaguccacaaacaccaugcc

SEQ ID NO: 900936 - RNA, 19 nt, Human
ccauuugucaguugauuuc

SEQ ID NO: 900937 - RNA, 23 nt, Human
ccccuccuucccugaaccagucc

SEQ ID NO: 900938 - RNA, 20 nt, Human
ccucccuuuuccccuccuuc

SEQ ID NO: 900939 - RNA, 21 nt, Human
ccucuaauuuuaacauguauc

SEQ ID NO: 900940 - RNA, 19 nt, Human
ccucuggaccgccuuccuc

SEQ ID NO: 900941 - RNA, 20 nt, Human
ccugagggcugggagggcuc

SEQ ID NO: 900942 - RNA, 21 nt, Human
cgcaaggaguuuacaaaacaa

SEQ ID NO: 900943 - RNA, 19 nt, Human
cgcaauugaacaaaacuau

SEQ ID NO: 900944 - RNA, 21 nt, Human
cgcaauugaacaaaacuauga

SEQ ID NO: 900945 - RNA, 18 nt, Human
cgcaggccugagggcugg

SEQ ID NO: 900946 - RNA, 18 nt, Human
cgccauguuuccuccccg

SEQ ID NO: 900947 - RNA, 23 nt, Human
cgcccuccacagccuaacggccu

SEQ ID NO: 900948 - RNA, 21 nt, Human
cgccgcugccaccaggucccc

SEQ ID NO: 900949 - RNA, 19 nt, Human
cgcugagucccggcggcuc

SEQ ID NO: 900950 - RNA, 22 nt, Human
cucucagcgucgucaaaguuua

SEQ ID NO: 900951 - RNA, 22 nt, Human
gaacaaaacuaugauaauuagc

SEQ ID NO: 900952 - RNA, 22 nt, Human
gaccgccuuccucgcccuccac

SEQ ID NO: 900953 - RNA, 21 nt, Human
gcaaaaggccaccuuacugga

SEQ ID NO: 900954 - RNA, 23 nt, Human
gccauguuuccuccccgcuuacc

SEQ ID NO: 900955 - RNA, 24 nt, Human
gccauguuuccuccccgcuuaccg

SEQ ID NO: 900956 - RNA, 19 nt, Human
gccucuggaccgccuuccu

SEQ ID NO: 900957 - RNA, 21 nt, Human
gccugagggcugggagggcuc

SEQ ID NO: 900958 - RNA, 19 nt, Human
gcgccauguuuccuccccg

SEQ ID NO: 900959 - RNA, 22 nt, Human
ggccugagggcugggagggcuc

SEQ ID NO: 900960 - RNA, 19 nt, Human
ggccugggccgagcggggg

SEQ ID NO: 900961 - RNA, 21 nt, Human
ggccugggccgagcgggggag

SEQ ID NO: 900962 - RNA, 25 nt, Human
gggagacccgcggccggcggggucc

SEQ ID NO: 900963 - RNA, 23 nt, Human
ggucuccccgcgcgcucucagcg

SEQ ID NO: 900964 - RNA, 18 nt, Human
ggucuugcugggcuucuu

SEQ ID NO: 900965 - RNA, 21 nt, Human
gucccggcggcucggcgcggu

SEQ ID NO: 900966 - RNA, 23 nt, Human
uaaaaucaaaaacaggaacugcc

SEQ ID NO: 900967 - RNA, 23 nt, Human
uaaaaucaaaaacaggaacugcc

SEQ ID NO: 900968 - RNA, 20 nt, Human
uagaagaaacagacaucuca

SEQ ID NO: 900969 - RNA, 24 nt, Human
uagaagaaacagacaucucaaaaa

SEQ ID NO: 900970 - RNA, 20 nt, Human
uagagcucucugcaccuccc

SEQ ID NO: 900971 - RNA, 23 nt, Human
uagagcucucugcaccucccuuu

SEQ ID NO: 900972 - RNA, 19 nt, Human
uagcaaaaaccaacaacgc

SEQ ID NO: 900973 - RNA, 18 nt, Human
uauacagaaguaauaaaa

SEQ ID NO: 900974 - RNA, 21 nt, Human
uauacagaaguaauaaaaugc

SEQ ID NO: 900975 - RNA, 23 nt, Human
uauagcaaaaaccaacaacgcaa

SEQ ID NO: 900976 - RNA, 24 nt, Human
uauugcauaccaagaaaaaagggg

SEQ ID NO: 900977 - RNA, 18 nt, Human
ucaaaaaagcuuagcguu

SEQ ID NO: 900978 - RNA, 18 nt, Human
uccaaggucacuuugcuc

SEQ ID NO: 900979 - RNA, 18 nt, Human
uccacaaacaccaugcca

SEQ ID NO: 900980 - RNA, 21 nt, Human
uccacaaacaccaugccaucc

SEQ ID NO: 900981 - RNA, 24 nt, Human
ucccugaaccaguccacaaacacc

SEQ ID NO: 900982 - RNA, 25 nt, Human
ucccuuuuccccuccuucccugaac

SEQ ID NO: 900983 - RNA, 19 nt, Human
uccgggcgcauuugggcgg

SEQ ID NO: 900984 - RNA, 20 nt, Human
uccuuuagauacacuguaua

SEQ ID NO: 900985 - RNA, 20 nt, Human
ucucgcccaacugcgacaga

SEQ ID NO: 900986 - RNA, 21 nt, Human
ucucugcaccucccuuuuccc

SEQ ID NO: 900987 - RNA, 20 nt, Human
ucuggaaagacuagcuguug

SEQ ID NO: 900988 - RNA, 19 nt, Human
ucuuggucugggucggugg

SEQ ID NO: 900989 - RNA, 18 nt, Human
ugaacaacaacgcaagga

SEQ ID NO: 900990 - RNA, 20 nt, Human
ugaaccaguccacaaacacc

SEQ ID NO: 900991 - RNA, 22 nt, Human
ugaaccaguccacaaacaccau

SEQ ID NO: 900992 - RNA, 22 nt, Human
ugagcacacuccuuucagauuu

SEQ ID NO: 900993 - RNA, 19 nt, Human
ugcacacaaaacaauggaa

SEQ ID NO: 900994 - RNA, 21 nt, Human
ugcauaccaagaaaaaaggag

SEQ ID NO: 900995 - RNA, 19 nt, Human
ugcccugucuuccaagguc

SEQ ID NO: 900996 - RNA, 20 nt, Human
ugcccugucuuccaagguca

SEQ ID NO: 900997 - RNA, 22 nt, Human
ugcuggggguggggcaaaaggc

SEQ ID NO: 900998 - RNA, 21 nt, Human
uggcuuagagcucucugcacc

SEQ ID NO: 900999 - RNA, 25 nt, Human
ugggaaguuucucuuguaucuuugg

SEQ ID NO: 901000 - RNA, 23 nt, Human
uguauauauagcaaaaaccaaca

SEQ ID NO: 901001 - RNA, 21 nt, Human
uguaucagguacuucagaaca

SEQ ID NO: 901002 - RNA, 18 nt, Human
uuacuaccucuaauuuua

SEQ ID NO: 901003 - RNA, 22 nt, Human
uucauauuauauacauauauau

SEQ ID NO: 901004 - RNA, 22 nt, Human
uugagcucaaacaauauuagaa

SEQ ID NO: 901005 - RNA, 18 nt, Human
uuggucuggaaauggcau

SEQ ID NO: 901006 - RNA, 21 nt, Human
aaaaaaagaaagaaaaaagag

SEQ ID NO: 901007 - RNA, 23 nt, Human
aaaaaugaagacaugaucaagga

SEQ ID NO: 901008 - RNA, 22 nt, Human
aaacucugucucuacuaaaaaa

SEQ ID NO: 901009 - RNA, 21 nt, Human
aaagagagagaaaguagggac

SEQ ID NO: 901010 - RNA, 18 nt, Human
aacacuuugggaggcuga

SEQ ID NO: 901011 - RNA, 24 nt, Human
aacacuuugggaggcugaggcggg

SEQ ID NO: 901012 - RNA, 21 nt, Human
aacaggauuauucugcaugug

SEQ ID NO: 901013 - RNA, 20 nt, Human
aacauggugaaacucugucu

SEQ ID NO: 901014 - RNA, 21 nt, Human
aacauggugaaacucugucuc

SEQ ID NO: 901015 - RNA, 22 nt, Human
aagaaagaaaaaagagagagaa

SEQ ID NO: 901016 - RNA, 20 nt, Human
aagaacacauaaaaccugug

SEQ ID NO: 901017 - RNA, 25 nt, Human
aagcgauucucccaccucagcuuuc

SEQ ID NO: 901018 - RNA, 23 nt, Human
aauaacaguagagacugugacaa

SEQ ID NO: 901019 - RNA, 22 nt, Human
aauauaaacuucauuucucuca

SEQ ID NO: 901020 - RNA, 20 nt, Human
aaugaagacaugaucaagga

SEQ ID NO: 901021 - RNA, 18 nt, Human
aauuagccagucauggug

SEQ ID NO: 901022 - RNA, 20 nt, Human
acaacauucucccugaaucu

SEQ ID NO: 901023 - RNA, 19 nt, Human
acagagagaaaacagagga

SEQ ID NO: 901024 - RNA, 20 nt, Human
acagagcgagaccccaucuc

SEQ ID NO: 901025 - RNA, 24 nt, Human
acagagcgagaccccaucucaaaa

SEQ ID NO: 901026 - RNA, 19 nt, Human
acauggugaaacucugucu

SEQ ID NO: 901027 - RNA, 20 nt, Human
acauuaaaaaaugaagacau

SEQ ID NO: 901028 - RNA, 18 nt, Human
accccaucucaaaaaaaa

SEQ ID NO: 901029 - RNA, 24 nt, Human
acuccuggacucaagcgauucucc

SEQ ID NO: 901030 - RNA, 23 nt, Human
acugcacuccagccuggugacag

SEQ ID NO: 901031 - RNA, 25 nt, Human
acugcacuccagccuggugacagag

SEQ ID NO: 901032 - RNA, 22 nt, Human
acuuauuccagccugacuggag

SEQ ID NO: 901033 - RNA, 24 nt, Human
agaacacauaaaaccugugaagca

SEQ ID NO: 901034 - RNA, 18 nt, Human
agacaaauagacaacaac

SEQ ID NO: 901035 - RNA, 19 nt, Human
agacaaauagacaacaaca

SEQ ID NO: 901036 - RNA, 24 nt, Human
agacaaauagacaacaacauucuc

SEQ ID NO: 901037 - RNA, 18 nt, Human
agccagucaugguggcac

SEQ ID NO: 901038 - RNA, 23 nt, Human
agccuggugacagagcgagaccc

SEQ ID NO: 901039 - RNA, 25 nt, Human
agcuaaccauaauaaaaaaaaaaga

SEQ ID NO: 901040 - RNA, 20 nt, Human
agcuucauuuucccuguuuc

SEQ ID NO: 901041 - RNA, 24 nt, Human
aggcggguggaucacaaggucagg

SEQ ID NO: 901042 - RNA, 19 nt, Human
aggcugaggcggguggauc

SEQ ID NO: 901043 - RNA, 21 nt, Human
aggcugaggcggguggaucac

SEQ ID NO: 901044 - RNA, 19 nt, Human
agugguucacaccuguaau

SEQ ID NO: 901045 - RNA, 23 nt, Human
agugguucacaccuguaauccca

SEQ ID NO: 901046 - RNA, 19 nt, Human
aguguguaacagagagaaa

SEQ ID NO: 901047 - RNA, 21 nt, Human
aguuacgaagaacacauaaaa

SEQ ID NO: 901048 - RNA, 24 nt, Human
auaauauaaacuucauuucucuca

SEQ ID NO: 901049 - RNA, 21 nt, Human
auccuggccaacauggugaaa

SEQ ID NO: 901050 - RNA, 24 nt, Human
aucgcgccacugcacuccagccug

SEQ ID NO: 901051 - RNA, 24 nt, Human
auguggagguugcagugagccgag

SEQ ID NO: 901052 - RNA, 21 nt, Human
caacaacauucucccugaauc

SEQ ID NO: 901053 - RNA, 24 nt, Human
caacacuuugggaggcugaggcgg

SEQ ID NO: 901054 - RNA, 24 nt, Human
caacauggugaaacucugucucua

SEQ ID NO: 901055 - RNA, 20 nt, Human
caagcgauucucccaccuca

SEQ ID NO: 901056 - RNA, 22 nt, Human
cacaacuagggcaagguuaucu

SEQ ID NO: 901057 - RNA, 24 nt, Human
cacaccuguaaucccaacacuuug

SEQ ID NO: 901058 - RNA, 21 nt, Human
cacauuaaaaaaugaagacau

SEQ ID NO: 901059 - RNA, 19 nt, Human
caccuguaaucccaacacu

SEQ ID NO: 901060 - RNA, 24 nt, Human
caccuguaaucccaacacuuuggg

SEQ ID NO: 901061 - RNA, 23 nt, Human
cacuccagccuggugacagagcg

SEQ ID NO: 901062 - RNA, 18 nt, Human
cacugcacuccagccugg

SEQ ID NO: 901063 - RNA, 18 nt, Human
cacugcacuccagccugg

SEQ ID NO: 901064 - RNA, 22 nt, Human
cacugcacuccagccuggugac

SEQ ID NO: 901065 - RNA, 23 nt, Human
cacugcacuccagccuggugaca

SEQ ID NO: 901066 - RNA, 24 nt, Human
cacugcacuccagccuggugacag

SEQ ID NO: 901067 - RNA, 21 nt, Human
cacuguaaccucaaacuccug

SEQ ID NO: 901068 - RNA, 21 nt, Human
cagagcacauuaaaaaaugaa

SEQ ID NO: 901069 - RNA, 24 nt, Human
cagcuacucgggaggcugaggcag

SEQ ID NO: 901070 - RNA, 18 nt, Human
cagcuuuccaggcagugg

SEQ ID NO: 901071 - RNA, 23 nt, Human
caggccgggcacagugguucaca

SEQ ID NO: 901072 - RNA, 24 nt, Human
cagggucuugcuccguugcccagg

SEQ ID NO: 901073 - RNA, 24 nt, Human
caugugguguacauucaaaauuuu

SEQ ID NO: 901074 - RNA, 22 nt, Human
cauuaaaaaaugaagacaugau

SEQ ID NO: 901075 - RNA, 22 nt, Human
ccacaagccgugugacuuuagu

SEQ ID NO: 901076 - RNA, 19 nt, Human
ccacugcacuccagccugg

SEQ ID NO: 901077 - RNA, 19 nt, Human
ccacugcacuccagccugg

SEQ ID NO: 901078 - RNA, 20 nt, Human
ccacugcacuccagccuggu

SEQ ID NO: 901079 - RNA, 23 nt, Human
ccacugcacuccagccuggugac

SEQ ID NO: 901080 - RNA, 19 nt, Human
ccccaucucaaaaaaaaaa

SEQ ID NO: 901081 - RNA, 21 nt, Human
ccucuagucccagcuacucgg

SEQ ID NO: 901082 - RNA, 20 nt, Human
ccuggacucaagcgauucuc

SEQ ID NO: 901083 - RNA, 20 nt, Human
ccuggccaacauggugaaac

SEQ ID NO: 901084 - RNA, 20 nt, Human
ccuggccaacauggugaaac

SEQ ID NO: 901085 - RNA, 24 nt, Human
ccuggccaacauggugaaacucug

SEQ ID NO: 901086 - RNA, 20 nt, Human
cgaaaggcagcuguaaaaca

SEQ ID NO: 901087 - RNA, 24 nt, Human
cgagaccauccuggccaacauggu

SEQ ID NO: 901088 - RNA, 23 nt, Human
cgagaccccaucucaaaaaaaaa

SEQ ID NO: 901089 - RNA, 24 nt, Human
cgagaucgcgccacugcacuccag

SEQ ID NO: 901090 - RNA, 25 nt, Human
cgccacugcacuccagccuggugac

SEQ ID NO: 901091 - RNA, 27 nt, Human
cgggaggcugaggcagaagaauuacuu

SEQ ID NO: 901092 - RNA, 19 nt, Human
cguugcccaggcuggagug

SEQ ID NO: 901093 - RNA, 26 nt, Human
cuaaccauaauaaaaaaaaaagaaag

SEQ ID NO: 901094 - RNA, 18 nt, Human
cuacuaaaaaauacagaa

SEQ ID NO: 901095 - RNA, 23 nt, Human
cuacuccauaaaguuacgaagaa

SEQ ID NO: 901096 - RNA, 24 nt, Human
cucaagcgauucucccaccucagc

SEQ ID NO: 901097 - RNA, 24 nt, Human
cuggccaacauggugaaacucugu

SEQ ID NO: 901098 - RNA, 27 nt, Human
cuggugguggugcuaacucacuguguc

SEQ ID NO: 901099 - RNA, 24 nt, Human
cuuuccaggcagugggggcuauag

SEQ ID NO: 901100 - RNA, 22 nt, Human
gaagcacuuauaauagugccag

SEQ ID NO: 901101 - RNA, 18 nt, Human
gacaacaacauucucccu

SEQ ID NO: 901102 - RNA, 18 nt, Human
gacagagcgagaccccau

SEQ ID NO: 901103 - RNA, 19 nt, Human
gacagagcgagaccccauc

SEQ ID NO: 901104 - RNA, 24 nt, Human
gagaaaacagaggauuuguacagc

SEQ ID NO: 901105 - RNA, 24 nt, Human
gagaaaguagggacaaccgguacc

SEQ ID NO: 901106 - RNA, 23 nt, Human
gagguugcagugagccgagaucg

SEQ ID NO: 901107 - RNA, 18 nt, Human
gcacagugguucacaccu

SEQ ID NO: 901108 - RNA, 23 nt, Human
gcacuccagccuggugacagagc

SEQ ID NO: 901109 - RNA, 24 nt, Human
gccaacauggugaaacucugucuc

SEQ ID NO: 901110 - RNA, 20 nt, Human
gcccaggcuggaguguagug

SEQ ID NO: 901111 - RNA, 20 nt, Human
gccgagaucgcgccacugca

SEQ ID NO: 901112 - RNA, 25 nt, Human
gcuccguugcccaggcuggagugua

SEQ ID NO: 901113 - RNA, 20 nt, Human
ggagguugcagugagccgag

SEQ ID NO: 901114 - RNA, 22 nt, Human
ggagguugcagugagccgagau

SEQ ID NO: 901115 - RNA, 24 nt, Human
ggagguugcagugagccgagaucg

SEQ ID NO: 901116 - RNA, 23 nt, Human
ggcacagugguucacaccuguaa

SEQ ID NO: 901117 - RNA, 24 nt, Human
ggguggaucacaaggucaggagau

SEQ ID NO: 901118 - RNA, 23 nt, Human
guaaaacaggauuauucugcaug

SEQ ID NO: 901119 - RNA, 19 nt, Human
gucucuacuaaaaaauaca

SEQ ID NO: 901120 - RNA, 21 nt, Human
gugaaacucugucucuacuaa

SEQ ID NO: 901121 - RNA, 19 nt, Human
guugcagugagccgagauc

SEQ ID NO: 901122 - RNA, 21 nt, Human
guugcagugagccgagaucgc

SEQ ID NO: 901123 - RNA, 24 nt, Human
uaaagagacacaaaugguaccuac

SEQ ID NO: 901124 - RNA, 20 nt, Human
uaacaguagagacugugaca

SEQ ID NO: 901125 - RNA, 21 nt, Human
uaacaguagagacugugacaa

SEQ ID NO: 901126 - RNA, 26 nt, Human
uaacucacugugucuucagggugugu

SEQ ID NO: 901127 - RNA, 18 nt, Human
uaagagacaaauagacaa

SEQ ID NO: 901128 - RNA, 18 nt, Human
uaagaucacgaaaggcag

SEQ ID NO: 901129 - RNA, 22 nt, Human
uaauauaaacuucauuucucuc

SEQ ID NO: 901130 - RNA, 19 nt, Human
uaggugcacaccaccaugc

SEQ ID NO: 901131 - RNA, 25 nt, Human
uagugccagaacauugugagcacac

SEQ ID NO: 901132 - RNA, 22 nt, Human
uauuccauuuuaugcuuugaga

SEQ ID NO: 901133 - RNA, 18 nt, Human
ucacaaggucaggagauc

SEQ ID NO: 901134 - RNA, 24 nt, Human
ucacaaggucaggagaucgagacc

SEQ ID NO: 901135 - RNA, 23 nt, Human
ucacaccuguaaucccaacacuu

SEQ ID NO: 901136 - RNA, 18 nt, Human
ucacacuggcaguagagc

SEQ ID NO: 901137 - RNA, 23 nt, Human
ucacuguaaccucaaacuccugg

SEQ ID NO: 901138 - RNA, 22 nt, Human
uccagccagagaaaaguacuga

SEQ ID NO: 901139 - RNA, 22 nt, Human
uccagccuggugacagagcgag

SEQ ID NO: 901140 - RNA, 23 nt, Human
uccagccuggugacagagcgaga

SEQ ID NO: 901141 - RNA, 23 nt, Human
ucccagguaaugcauaauaacag

SEQ ID NO: 901142 - RNA, 19 nt, Human
ucccugaaucuggaaaaaa

SEQ ID NO: 901143 - RNA, 21 nt, Human
uccuggacucaagcgauucuc

SEQ ID NO: 901144 - RNA, 23 nt, Human
ucgcgccacugcacuccagccug

SEQ ID NO: 901145 - RNA, 23 nt, Human
ucgggaggcugaggcagaagaau

SEQ ID NO: 901146 - RNA, 23 nt, Human
ucucccaccucagcuuuccaggc

SEQ ID NO: 901147 - RNA, 25 nt, Human
ucucuacuaaaaaauacagaaaauu

SEQ ID NO: 901148 - RNA, 22 nt, Human
ucuugcuccguugcccaggcug

SEQ ID NO: 901149 - RNA, 22 nt, Human
ucuugcuccguugcccaggcug

SEQ ID NO: 901150 - RNA, 23 nt, Human
ucuugcuccguugcccaggcugg

SEQ ID NO: 901151 - RNA, 24 nt, Human
ucuugcuccguugcccaggcugga

SEQ ID NO: 901152 - RNA, 25 nt, Human
ugacagguacagagcacauuaaaaa

SEQ ID NO: 901153 - RNA, 22 nt, Human
ugagacagggucuugcuccguu

SEQ ID NO: 901154 - RNA, 22 nt, Human
ugagccgagaucgcgccacugc

SEQ ID NO: 901155 - RNA, 22 nt, Human
ugaggaggggugacuggagagg

SEQ ID NO: 901156 - RNA, 19 nt, Human
ugaggcagaagaauuacuu

SEQ ID NO: 901157 - RNA, 20 nt, Human
ugaggcagaagaauuacuuc

SEQ ID NO: 901158 - RNA, 20 nt, Human
ugaggcagaagaauuacuuc

SEQ ID NO: 901159 - RNA, 20 nt, Human
ugaggcggguggaucacaag

SEQ ID NO: 901160 - RNA, 24 nt, Human
ugaggcggguggaucacaagguca

SEQ ID NO: 901161 - RNA, 26 nt, Human
ugaggcggguggaucacaaggucagg

SEQ ID NO: 901162 - RNA, 21 nt, Human
ugauauguuauuccauuuuau

SEQ ID NO: 901163 - RNA, 21 nt, Human
ugcccaggcuggaguguagug

SEQ ID NO: 901164 - RNA, 21 nt, Human
ugcccaggcuggaguguagug

SEQ ID NO: 901165 - RNA, 22 nt, Human
ugcccaggcuggaguguagugg

SEQ ID NO: 901166 - RNA, 24 nt, Human
ugcuccguugcccaggcuggagug

SEQ ID NO: 901167 - RNA, 23 nt, Human
uggaucacuguaaccucaaacuc

SEQ ID NO: 901168 - RNA, 24 nt, Human
uggccaacauggugaaacucuguc

SEQ ID NO: 901169 - RNA, 20 nt, Human
ugggaggcugaggcgggugg

SEQ ID NO: 901170 - RNA, 23 nt, Human
ugggaggcugaggcggguggauc

SEQ ID NO: 901171 - RNA, 24 nt, Human
ugggaggcugaggcggguggauca

SEQ ID NO: 901172 - RNA, 24 nt, Human
ugggauguggagguugcagugagc

SEQ ID NO: 901173 - RNA, 21 nt, Human
ugguucacaccuguaauccca

SEQ ID NO: 901174 - RNA, 21 nt, Human
uguggagguugcagugagccg

SEQ ID NO: 901175 - RNA, 19 nt, Human
uguguaacagagagaaaac

SEQ ID NO: 901176 - RNA, 18 nt, Human
uguuugguuuuauuguag

SEQ ID NO: 901177 - RNA, 20 nt, Human
uguuugguuuuauuguaguc

SEQ ID NO: 901178 - RNA, 24 nt, Human
uuccucuagucccagcuacucggg

SEQ ID NO: 901179 - RNA, 18 nt, Human
uugagacagggucuugcu

SEQ ID NO: 901180 - RNA, 18 nt, Human
uugagcacauuuccucca

SEQ ID NO: 901181 - RNA, 19 nt, Human
uugcagugagccgagaucg

SEQ ID NO: 901182 - RNA, 22 nt, Human
uugcagugagccgagaucgcgc

SEQ ID NO: 901183 - RNA, 24 nt, Human
uugcuccguugcccaggcuggagu

SEQ ID NO: 901184 - RNA, 18 nt, Human
uuggcauuauuauuaagg

SEQ ID NO: 901185 - RNA, 25 nt, Human
uugggaggcugaggcggguggauca

SEQ ID NO: 901186 - RNA, 19 nt, Human
uuuaugcuuugagacaggg

SEQ ID NO: 901187 - RNA, 22 nt, Human
uuucaggcugacucagaaggcu

SEQ ID NO: 901188 - RNA, 22 nt, Human
aaaguaggaaaacaacaaagag

SEQ ID NO: 901189 - RNA, 23 nt, Human
aaauaaccuugagaaaguaggaa

SEQ ID NO: 901190 - RNA, 21 nt, Human
aagcaaaaacagaaguaugga

SEQ ID NO: 901191 - RNA, 29 nt, Human
aagcaaaaacagaaguauggagggacccc

SEQ ID NO: 901192 - RNA, 27 nt, Human
aagcaaaaacagaaguauggaugcaug

SEQ ID NO: 901193 - RNA, 23 nt, Human
aaguaggaaaacaacaaagagaa

SEQ ID NO: 901194 - RNA, 18 nt, Human
aagugacuaucagagaga

SEQ ID NO: 901195 - RNA, 22 nt, Human
aagugacuaucagagagagaga

SEQ ID NO: 901196 - RNA, 21 nt, Human
agaaauaccaucauuuauauu

SEQ ID NO: 901197 - RNA, 24 nt, Human
agacauacaacucuucccuguaug

SEQ ID NO: 901198 - RNA, 23 nt, Human
agaccauggcaccaaauccauca

SEQ ID NO: 901199 - RNA, 23 nt, Human
agagcagaaagcuuaauaaaagg

SEQ ID NO: 901200 - RNA, 21 nt, Human
aggcagggcaagggggugggu

SEQ ID NO: 901201 - RNA, 21 nt, Human
aggcauagagaaggugcucuu

SEQ ID NO: 901202 - RNA, 21 nt, Human
aggggcugguucucuggagug

SEQ ID NO: 901203 - RNA, 23 nt, Human
aguuacuaccucugaagcuuaga

SEQ ID NO: 901204 - RNA, 20 nt, Human
auccaaagucggaaauaacc

SEQ ID NO: 901205 - RNA, 23 nt, Human
caaauugaaacucccagaaauau

SEQ ID NO: 901206 - RNA, 21 nt, Human
cacuaagcuuccauacuucaa

SEQ ID NO: 901207 - RNA, 25 nt, Human
cacugaccugcacuuuaauguuuac

SEQ ID NO: 901208 - RNA, 21 nt, Human
caggggcugguucucuggagu

SEQ ID NO: 901209 - RNA, 24 nt, Human
cauaaaaacaagucuuccauagca

SEQ ID NO: 901210 - RNA, 21 nt, Human
cucaugaccagcugcaaaaua

SEQ ID NO: 901211 - RNA, 25 nt, Human
cuccaauaaauaaacuuauauaugg

SEQ ID NO: 901212 - RNA, 18 nt, Human
cuuucagaaauaccauca

SEQ ID NO: 901213 - RNA, 19 nt, Human
gaccauggcaccaaaucca

SEQ ID NO: 901214 - RNA, 18 nt, Human
gaccuucccuccuugcac

SEQ ID NO: 901215 - RNA, 19 nt, Human
gagagagagagagaaagag

SEQ ID NO: 901216 - RNA, 26 nt, Human
gcaccaaauccaucacuccaauaaau

SEQ ID NO: 901217 - RNA, 20 nt, Human
gcucuuggucuggggcuggu

SEQ ID NO: 901218 - RNA, 21 nt, Human
ggcuggugaacugcagguggg

SEQ ID NO: 901219 - RNA, 23 nt, Human
gggcaagggggugggugucaggg

SEQ ID NO: 901220 - RNA, 28 nt, Human
gggcaagggggugggugucaggggcugg

SEQ ID NO: 901221 - RNA, 23 nt, Human
gggcuggugaacugcaggugggu

SEQ ID NO: 901222 - RNA, 19 nt, Human
gggggugggugucaggggc

SEQ ID NO: 901223 - RNA, 23 nt, Human
ggugggugucaggggcugguucu

SEQ ID NO: 901224 - RNA, 21 nt, Human
uaaaaacaagucuuccauagc

SEQ ID NO: 901225 - RNA, 22 nt, Human
uaggaaaacaacaaagagaaaa

SEQ ID NO: 901226 - RNA, 26 nt, Human
uccaaagucggaaauaaccuugagaa

SEQ ID NO: 901227 - RNA, 21 nt, Human
uccaucacuccaauaaauaaa

SEQ ID NO: 901228 - RNA, 24 nt, Human
ucccuguaugagacaaauggaaau

SEQ ID NO: 901229 - RNA, 22 nt, Human
uccuucccacucucagccuuaa

SEQ ID NO: 901230 - RNA, 19 nt, Human
ucucaggucauauuccacu

SEQ ID NO: 901231 - RNA, 19 nt, Human
ucucugauuaggaacuccu

SEQ ID NO: 901232 - RNA, 20 nt, Human
ucugauugaagaaugacagu

SEQ ID NO: 901233 - RNA, 27 nt, Human
ugaaacucccagaaauauaauaaguau

SEQ ID NO: 901234 - RNA, 20 nt, Human
ugcacaucauaaaaacaagu

SEQ ID NO: 901235 - RNA, 19 nt, Human
ugccacaggagacauacaa

SEQ ID NO: 901236 - RNA, 19 nt, Human
ugccacaggagacauacaa

SEQ ID NO: 901237 - RNA, 20 nt, Human
uggcucuguugaccuucccu

SEQ ID NO: 901238 - RNA, 19 nt, Human
uggucuggggcuggugaac

SEQ ID NO: 901239 - RNA, 21 nt, Human
uggucuggggcuggugaacug

SEQ ID NO: 901240 - RNA, 19 nt, Human
uggugaacugcaggugggu

SEQ ID NO: 901241 - RNA, 24 nt, Human
uguaugaaucugguucucuuuaag

SEQ ID NO: 901242 - RNA, 20 nt, Human
ugucaggggcugguucucug

SEQ ID NO: 901243 - RNA, 18 nt, Human
uguugaccuucccuccuu

SEQ ID NO: 901244 - RNA, 18 nt, Human
uugaagcaaaaacagaag

SEQ ID NO: 901245 - RNA, 21 nt, Human
uugccaaguguagucuaugcc

SEQ ID NO: 901246 - RNA, 22 nt, Human
uuggucuggggcuggugaacug

SEQ ID NO: 901247 - RNA, 24 nt, Human
uuuccacuaucugauugaagaaug

SEQ ID NO: 901248 - RNA, 21 nt, Human
uuuugaagcaaaaacagaagu

SEQ ID NO: 901249 - RNA, 27 nt, Human
aaaaauggcaaagagagaccgguaccc

SEQ ID NO: 901250 - RNA, 24 nt, Human
aauaacugacaggugagacccaca

SEQ ID NO: 901251 - RNA, 19 nt, Human
acugcagccuuucucaggg

SEQ ID NO: 901252 - RNA, 21 nt, Human
agcaugggggugaccaucuug

SEQ ID NO: 901253 - RNA, 24 nt, Human
agggaagaugacacaucugaacug

SEQ ID NO: 901254 - RNA, 21 nt, Human
auaaaaucagcaaauaacuga

SEQ ID NO: 901255 - RNA, 19 nt, Human
caaauaacugacaggugag

SEQ ID NO: 901256 - RNA, 19 nt, Human
ccacugcagccuuucucag

SEQ ID NO: 901257 - RNA, 23 nt, Human
ccuccaaaaauggcaaagagaga

SEQ ID NO: 901258 - RNA, 23 nt, Human
cugaggccacugcagccuuucuc

SEQ ID NO: 901259 - RNA, 19 nt, Human
cuuccaugccuccaaaaau

SEQ ID NO: 901260 - RNA, 23 nt, Human
gaucacucugcugugagacugga

SEQ ID NO: 901261 - RNA, 25 nt, Human
ggccugcauaggagaucacucugcu

SEQ ID NO: 901262 - RNA, 21 nt, Human
uaaaaucagcaaauaacugac

SEQ ID NO: 901263 - RNA, 23 nt, Human
uccaaaaauggcaaagagagaca

SEQ ID NO: 901264 - RNA, 19 nt, Human
ugaagggguucagcauggg

SEQ ID NO: 901265 - RNA, 18 nt, Human
uggauguccacaaucauc

SEQ ID NO: 901266 - RNA, 22 nt, Human
aagccuuauuggauaugaugac

SEQ ID NO: 901267 - RNA, 21 nt, Human
agaaaagcaagccuuauugga

SEQ ID NO: 901268 - RNA, 24 nt, Human
cacaauaauaguauaaaacacaga

SEQ ID NO: 901269 - RNA, 18 nt, Human
cacuguacagcaaggggc

SEQ ID NO: 901270 - RNA, 24 nt, Human
ccccuaaaaucagagaaaagcaag

SEQ ID NO: 901271 - RNA, 19 nt, Human
cccuaaaaucagagaaaag

SEQ ID NO: 901272 - RNA, 18 nt, Human
cugaugcacaaaccaggc

SEQ ID NO: 901273 - RNA, 23 nt, Human
gaacugaugcacaaaccaggccu

SEQ ID NO: 901274 - RNA, 19 nt, Human
uacaccccuaaaaucagag

SEQ ID NO: 901275 - RNA, 28 nt, Human
uacaccccuaaaaucagagaaaagcaag

SEQ ID NO: 901276 - RNA, 24 nt, Human
aaagugcugggauuacaggcguga

SEQ ID NO: 901277 - RNA, 19 nt, Human
aagugcugggauuacaggc

SEQ ID NO: 901278 - RNA, 19 nt, Human
aagugcugggauuacaggc

SEQ ID NO: 901279 - RNA, 26 nt, Human
aagugcugggauuacaggcgugagcc

SEQ ID NO: 901280 - RNA, 22 nt, Human
accaaucaggcacuguggcugg

SEQ ID NO: 901281 - RNA, 24 nt, Human
accauguuggccaggcuggucucg

SEQ ID NO: 901282 - RNA, 23 nt, Human
acccaggcuggagugcgguggug

SEQ ID NO: 901283 - RNA, 21 nt, Human
accguacacaaaaauugaagu

SEQ ID NO: 901284 - RNA, 20 nt, Human
aggaaagcacauaaggcuau

SEQ ID NO: 901285 - RNA, 20 nt, Human
aggagcugggauuacaggca

SEQ ID NO: 901286 - RNA, 21 nt, Human
aggagcugggauuacaggcau

SEQ ID NO: 901287 - RNA, 19 nt, Human
aggggccagcccacugccc

SEQ ID NO: 901288 - RNA, 22 nt, Human
aggggccagcccacugcccaga

SEQ ID NO: 901289 - RNA, 24 nt, Human
aggugauccacccaccuuggccuc

SEQ ID NO: 901290 - RNA, 20 nt, Human
agugcgguggugcaaucucg

SEQ ID NO: 901291 - RNA, 24 nt, Human
agugcgguggugcaaucucggcuc

SEQ ID NO: 901292 - RNA, 18 nt, Human
augggguuucaccauguu

SEQ ID NO: 901293 - RNA, 22 nt, Human
augggguuucaccauguuggcc

SEQ ID NO: 901294 - RNA, 23 nt, Human
augggguuucaccauguuggcca

SEQ ID NO: 901295 - RNA, 24 nt, Human
augggguuucaccauguuggccag

SEQ ID NO: 901296 - RNA, 24 nt, Human
auuuuuguauuuuuaguagagaug

SEQ ID NO: 901297 - RNA, 24 nt, Human
caaagugcugggauuacaggcgug

SEQ ID NO: 901298 - RNA, 22 nt, Human
caagugaugcuccugucucagc

SEQ ID NO: 901299 - RNA, 21 nt, Human
cacaccuggcuaauuuuugua

SEQ ID NO: 901300 - RNA, 21 nt, Human
caccauguuggccaggcuggu

SEQ ID NO: 901301 - RNA, 24 nt, Human
caccauguuggccaggcuggucuc

SEQ ID NO: 901302 - RNA, 22 nt, Human
cacccaccuuggccucccaaag

SEQ ID NO: 901303 - RNA, 23 nt, Human
cacccaccuuggccucccaaagu

SEQ ID NO: 901304 - RNA, 24 nt, Human
cacccaggcuggagugcgguggug

SEQ ID NO: 901305 - RNA, 21 nt, Human
cacugcaaccucugccuccca

SEQ ID NO: 901306 - RNA, 21 nt, Human
cacugcaaccucugccuccca

SEQ ID NO: 901307 - RNA, 22 nt, Human
cagcccacugcccagacuuagc

SEQ ID NO: 901308 - RNA, 22 nt, Human
cagccuacugaggagcugggau

SEQ ID NO: 901309 - RNA, 23 nt, Human
caugcaccaucacaccuggcuaa

SEQ ID NO: 901310 - RNA, 23 nt, Human
cauguuggccaggcuggucucga

SEQ ID NO: 901311 - RNA, 20 nt, Human
ccaaagugcugggauuacag

SEQ ID NO: 901312 - RNA, 22 nt, Human
ccaaagugcugggauuacaggc

SEQ ID NO: 901313 - RNA, 22 nt, Human
ccaaagugcugggauuacaggc

SEQ ID NO: 901314 - RNA, 24 nt, Human
ccaaagugcugggauuacaggcgu

SEQ ID NO: 901315 - RNA, 20 nt, Human
cccacugcccagacuuagcc

SEQ ID NO: 901316 - RNA, 19 nt, Human
cccagacuuagccuccagg

SEQ ID NO: 901317 - RNA, 24 nt, Human
ccugaccucaggugauccacccac

SEQ ID NO: 901318 - RNA, 22 nt, Human
cgcucugucacccaggcuggag

SEQ ID NO: 901319 - RNA, 24 nt, Human
cgcucugucacccaggcuggagug

SEQ ID NO: 901320 - RNA, 23 nt, Human
cuaauuuuuguauuuuuaguaga

SEQ ID NO: 901321 - RNA, 23 nt, Human
cucacugcaaccucugccuccca

SEQ ID NO: 901322 - RNA, 24 nt, Human
cucaggugauccacccaccuuggc

SEQ ID NO: 901323 - RNA, 21 nt, Human
cucgcucugucacccaggcug

SEQ ID NO: 901324 - RNA, 24 nt, Human
cucgcucugucacccaggcuggag

SEQ ID NO: 901325 - RNA, 24 nt, Human
cucgcucugucacccaggcuggag

SEQ ID NO: 901326 - RNA, 24 nt, Human
cugaggagcugggauuacaggcau

SEQ ID NO: 901327 - RNA, 24 nt, Human
cugcaaccucugccucccacguuc

SEQ ID NO: 901328 - RNA, 23 nt, Human
gaaagcacauaaggcuauaccaa

SEQ ID NO: 901329 - RNA, 24 nt, Human
gaccucaggugauccacccaccuu

SEQ ID NO: 901330 - RNA, 18 nt, Human
gagaugggguuucaccau

SEQ ID NO: 901331 - RNA, 24 nt, Human
gagaugggguuucaccauguuggc

SEQ ID NO: 901332 - RNA, 20 nt, Human
gaggagcugggauuacaggc

SEQ ID NO: 901333 - RNA, 22 nt, Human
gaggagcugggauuacaggcau

SEQ ID NO: 901334 - RNA, 24 nt, Human
gaggagcugggauuacaggcaugc

SEQ ID NO: 901335 - RNA, 18 nt, Human
gauuacaggcgugagcca

SEQ ID NO: 901336 - RNA, 22 nt, Human
gauuacaggcgugagccacugc

SEQ ID NO: 901337 - RNA, 22 nt, Human
gauuacaggcgugagccacugc

SEQ ID NO: 901338 - RNA, 22 nt, Human
gcaaccucugccucccacguuc

SEQ ID NO: 901339 - RNA, 24 nt, Human
gcuccugucucagccuacugagga

SEQ ID NO: 901340 - RNA, 21 nt, Human
gcucugucacccaggcuggag

SEQ ID NO: 901341 - RNA, 25 nt, Human
gcucugucacccaggcuggagugcg

SEQ ID NO: 901342 - RNA, 23 nt, Human
gcuggucucgagcuccugaccuc

SEQ ID NO: 901343 - RNA, 24 nt, Human
ggcuggucucgagcuccugaccuc

SEQ ID NO: 901344 - RNA, 22 nt, Human
gggguuucaccauguuggccag

SEQ ID NO: 901345 - RNA, 22 nt, Human
ggguuucaccauguuggccagg

SEQ ID NO: 901346 - RNA, 19 nt, Human
ggucucgagcuccugaccu

SEQ ID NO: 901347 - RNA, 23 nt, Human
guagagaugggguuucaccaugu

SEQ ID NO: 901348 - RNA, 20 nt, Human
gucaaauaaaaaauaccgua

SEQ ID NO: 901349 - RNA, 24 nt, Human
gucucgcucugucacccaggcugg

SEQ ID NO: 901350 - RNA, 24 nt, Human
gugauccacccaccuuggccuccc

SEQ ID NO: 901351 - RNA, 21 nt, Human
uaagaugccauucagacugaa

SEQ ID NO: 901352 - RNA, 24 nt, Human
uaauuuuuguauuuuuaguagaga

SEQ ID NO: 901353 - RNA, 22 nt, Human
uacaggcaugcaccaucacacc

SEQ ID NO: 901354 - RNA, 19 nt, Human
uacaggcgugagccacugc

SEQ ID NO: 901355 - RNA, 23 nt, Human
uacaggcgugagccacugcgccc

SEQ ID NO: 901356 - RNA, 24 nt, Human
uacugaggagcugggauuacaggc

SEQ ID NO: 901357 - RNA, 22 nt, Human
uagagaugggguuucaccaugu

SEQ ID NO: 901358 - RNA, 25 nt, Human
uaggaaagcacauaaggcuauacca

SEQ ID NO: 901359 - RNA, 21 nt, Human
uaggauccuuauuauaaaagu

SEQ ID NO: 901360 - RNA, 24 nt, Human
uaguagagaugggguuucaccaug

SEQ ID NO: 901361 - RNA, 26 nt, Human
uaguagagaugggguuucaccauguu

SEQ ID NO: 901362 - RNA, 19 nt, Human
uagucaaauaaaaaauacc

SEQ ID NO: 901363 - RNA, 22 nt, Human
ucacccaggcuggagugcggug

SEQ ID NO: 901364 - RNA, 18 nt, Human
ucacugcaaccucugccu

SEQ ID NO: 901365 - RNA, 19 nt, Human
ucacugcaaccucugccuc

SEQ ID NO: 901366 - RNA, 22 nt, Human
ucacugcaaccucugccuccca

SEQ ID NO: 901367 - RNA, 24 nt, Human
ucacugcaaccucugccucccacg

SEQ ID NO: 901368 - RNA, 27 nt, Human
ucacugcaaccucugccucccacguuc

SEQ ID NO: 901369 - RNA, 24 nt, Human
ucccaaagugcugggauuacaggc

SEQ ID NO: 901370 - RNA, 24 nt, Human
ucgcucugucacccaggcuggagu

SEQ ID NO: 901371 - RNA, 24 nt, Human
ucgcucugucacccaggcuggagu

SEQ ID NO: 901372 - RNA, 21 nt, Human
ucuaaugcucacaccaggggc

SEQ ID NO: 901373 - RNA, 19 nt, Human
ucucgcucugucacccagg

SEQ ID NO: 901374 - RNA, 19 nt, Human
ucucgcucugucacccagg

SEQ ID NO: 901375 - RNA, 23 nt, Human
ucucgcucugucacccaggcugg

SEQ ID NO: 901376 - RNA, 23 nt, Human
ucucgcucugucacccaggcugg

SEQ ID NO: 901377 - RNA, 24 nt, Human
ucucgcucugucacccaggcugga

SEQ ID NO: 901378 - RNA, 24 nt, Human
ucucgcucugucacccaggcugga

SEQ ID NO: 901379 - RNA, 25 nt, Human
ucucgcucugucacccaggcuggag

SEQ ID NO: 901380 - RNA, 26 nt, Human
ucucgcucugucacccaggcuggagu

SEQ ID NO: 901381 - RNA, 21 nt, Human
ugaccucaggugauccaccca

SEQ ID NO: 901382 - RNA, 24 nt, Human
ugaccucaggugauccacccaccu

SEQ ID NO: 901383 - RNA, 21 nt, Human
ugagauaagucucgcucuguc

SEQ ID NO: 901384 - RNA, 24 nt, Human
ugauccacccaccuuggccuccca

SEQ ID NO: 901385 - RNA, 22 nt, Human
ugcgguggugcaaucucggcuc

SEQ ID NO: 901386 - RNA, 23 nt, Human
ugcgguggugcaaucucggcuca

SEQ ID NO: 901387 - RNA, 24 nt, Human
ugcugggauuacaggcgugagcca

SEQ ID NO: 901388 - RNA, 30 nt, Human
ugcuuugcuauuuaaaggcaacagucuuaa

SEQ ID NO: 901389 - RNA, 24 nt, Human
uggagugcgguggugcaaucucgg

SEQ ID NO: 901390 - RNA, 24 nt, Human
uggccaggcuggucucgagcuccu

SEQ ID NO: 901391 - RNA, 21 nt, Human
ugggauuacaggcaugcacca

SEQ ID NO: 901392 - RNA, 24 nt, Human
ugggauuacaggcaugcaccauca

SEQ ID NO: 901393 - RNA, 18 nt, Human
ugggauuacaggcgugag

SEQ ID NO: 901394 - RNA, 19 nt, Human
ugggauuacaggcgugagc

SEQ ID NO: 901395 - RNA, 21 nt, Human
ugggauuacaggcgugagcca

SEQ ID NO: 901396 - RNA, 22 nt, Human
ugggauuacaggcgugagccac

SEQ ID NO: 901397 - RNA, 22 nt, Human
ugggauuacaggcgugagccac

SEQ ID NO: 901398 - RNA, 24 nt, Human
ugggauuacaggcgugagccacug

SEQ ID NO: 901399 - RNA, 26 nt, Human
ugggauuacaggcgugagccacugcg

SEQ ID NO: 901400 - RNA, 24 nt, Human
ugggguuucaccauguuggccagg

SEQ ID NO: 901401 - RNA, 21 nt, Human
uguauuuuuaguagagauggg

SEQ ID NO: 901402 - RNA, 20 nt, Human
ugucacccaggcuggagugc

SEQ ID NO: 901403 - RNA, 18 nt, Human
uuaguagagaugggguuu

SEQ ID NO: 901404 - RNA, 22 nt, Human
uuaguagagaugggguuucacc

SEQ ID NO: 901405 - RNA, 24 nt, Human
uuaguagagaugggguuucaccau

SEQ ID NO: 901406 - RNA, 23 nt, Human
uucaagugaugcuccugucucag

SEQ ID NO: 901407 - RNA, 18 nt, Human
uuggccucccaaagugcu

SEQ ID NO: 901408 - RNA, 23 nt, Human
uuguauuuuuaguagagaugggg

SEQ ID NO: 901409 - RNA, 24 nt, Human
uuucaccauguuggccaggcuggu

SEQ ID NO: 901410 - RNA, 24 nt, Human
uuuuuaguagagaugggguuucac

SEQ ID NO: 901411 - RNA, 20 nt, Human
uuuuuguauuuuuaguagag

SEQ ID NO: 901412 - RNA, 19 nt, Human
uuuuuuuuuuuuuuuugca

SEQ ID NO: 901413 - RNA, 18 nt, Human
uuuuuuuuuuuuuuuuug

SEQ ID NO: 901414 - RNA, 19 nt, Human
uuuuuuuuuuuuuuuuugc

SEQ ID NO: 901415 - RNA, 23 nt, Human
aaagaccucuacccuuucccuca

SEQ ID NO: 901416 - RNA, 18 nt, Human
aagcagcugagcaugagc

SEQ ID NO: 901417 - RNA, 20 nt, Human
aaggaggccgggagguccug

SEQ ID NO: 901418 - RNA, 21 nt, Human
accagaaagaacugcaaccag

SEQ ID NO: 901419 - RNA, 18 nt, Human
acccaagauccuaaccca

SEQ ID NO: 901420 - RNA, 18 nt, Human
accucuacccuuucccuc

SEQ ID NO: 901421 - RNA, 25 nt, Human
agacagaguauugggggcagggcuc

SEQ ID NO: 901422 - RNA, 22 nt, Human
aggagguguuuaggcagcuccc

SEQ ID NO: 901423 - RNA, 19 nt, Human
aggcggggugaggcgggga

SEQ ID NO: 901424 - RNA, 25 nt, Human
agggcaggggacuccagauugagga

SEQ ID NO: 901425 - RNA, 24 nt, Human
aguauugggggcagggcucuggag

SEQ ID NO: 901426 - RNA, 19 nt, Human
aucaagagagccauacccc

SEQ ID NO: 901427 - RNA, 19 nt, Human
augacccagugaccuaugg

SEQ ID NO: 901428 - RNA, 22 nt, Human
augguccagcucuuagagaccu

SEQ ID NO: 901429 - RNA, 20 nt, Human
caaauuggaaagggcuuacc

SEQ ID NO: 901430 - RNA, 19 nt, Human
caagcuggucccugagcca

SEQ ID NO: 901431 - RNA, 20 nt, Human
cacauuuguuuccucucccc

SEQ ID NO: 901432 - RNA, 24 nt, Human
cagaaagaacugcaaccagcagca

SEQ ID NO: 901433 - RNA, 26 nt, Human
cagaacaaaccuccuuuccuucccca

SEQ ID NO: 901434 - RNA, 21 nt, Human
cagacagaguauugggggcag

SEQ ID NO: 901435 - RNA, 20 nt, Human
cagcagcagcucggugaaaa

SEQ ID NO: 901436 - RNA, 22 nt, Human
ccagaaagaacugcaaccagca

SEQ ID NO: 901437 - RNA, 21 nt, Human
ccauaccccaugaagauuguu

SEQ ID NO: 901438 - RNA, 25 nt, Human
cccuccuguucccacaaauuggaaa

SEQ ID NO: 901439 - RNA, 20 nt, Human
cccugugucccugugggucc

SEQ ID NO: 901440 - RNA, 23 nt, Human
ccucacccugcaugggcccugga

SEQ ID NO: 901441 - RNA, 20 nt, Human
ccuccauaagcaaggcuggu

SEQ ID NO: 901442 - RNA, 19 nt, Human
ccuccuuuccuuccccaag

SEQ ID NO: 901443 - RNA, 21 nt, Human
ccuccuuuccuuccccaagcu

SEQ ID NO: 901444 - RNA, 19 nt, Human
ccugugucccugugggucc

SEQ ID NO: 901445 - RNA, 22 nt, Human
cugggauuggacucggcaggag

SEQ ID NO: 901446 - RNA, 24 nt, Human
gaacaaaccuccuuuccuucccca

SEQ ID NO: 901447 - RNA, 21 nt, Human
gccaaugugcaccagaaagaa

SEQ ID NO: 901448 - RNA, 18 nt, Human
ggaggcggggugaggcgg

SEQ ID NO: 901449 - RNA, 18 nt, Human
ggaggugacagccauggg

SEQ ID NO: 901450 - RNA, 21 nt, Human
gucccugagccacacauaggu

SEQ ID NO: 901451 - RNA, 23 nt, Human
uagguuaggcaugagcugagugu

SEQ ID NO: 901452 - RNA, 22 nt, Human
uauugggggcagggcucuggag

SEQ ID NO: 901453 - RNA, 24 nt, Human
ucagauggugguucccagucuggg

SEQ ID NO: 901454 - RNA, 21 nt, Human
ucauaaccuuccuuuuaucca

SEQ ID NO: 901455 - RNA, 21 nt, Human
uccaagacauacccaagaucc

SEQ ID NO: 901456 - RNA, 21 nt, Human
ucccacaaauuggaaagggcu

SEQ ID NO: 901457 - RNA, 23 nt, Human
ucucagauggugguucccagucu

SEQ ID NO: 901458 - RNA, 19 nt, Human
ugacagccaugggccagau

SEQ ID NO: 901459 - RNA, 20 nt, Human
ugagaaaggugaaggaggcc

SEQ ID NO: 901460 - RNA, 24 nt, Human
ugagcaugagcaggaggaggcggg

SEQ ID NO: 901461 - RNA, 20 nt, Human
uggaaagggcuuaccuugug

SEQ ID NO: 901462 - RNA, 23 nt, Human
uggaagguccagaagcagcugag

SEQ ID NO: 901463 - RNA, 22 nt, Human
uguagggcggggguugggccau

SEQ ID NO: 901464 - RNA, 19 nt, Human
uucccagucugggauugga

SEQ ID NO: 901465 - RNA, 20 nt, Human
uuuguuuccucuccccuccu

SEQ ID NO: 901466 - RNA, 25 nt, Human
aaacaucagagaccagcauggagcc

SEQ ID NO: 901467 - RNA, 21 nt, Human
aauccaugaccccauacuugg

SEQ ID NO: 901468 - RNA, 23 nt, Human
acccugcccccaaacugaacuag

SEQ ID NO: 901469 - RNA, 25 nt, Human
agacaggguauggguccaaucucag

SEQ ID NO: 901470 - RNA, 20 nt, Human
agagaccagcauggagccac

SEQ ID NO: 901471 - RNA, 24 nt, Human
agagcuccugcagaaggagggggc

SEQ ID NO: 901472 - RNA, 19 nt, Human
aucagagaccagcauggag

SEQ ID NO: 901473 - RNA, 21 nt, Human
cagagcuccugcagaaggagg

SEQ ID NO: 901474 - RNA, 19 nt, Human
caugaccccauacuuggcc

SEQ ID NO: 901475 - RNA, 22 nt, Human
cauuuuuuuuuaaugucaaggg

SEQ ID NO: 901476 - RNA, 18 nt, Human
ccccauacuuggccacuc

SEQ ID NO: 901477 - RNA, 18 nt, Human
ccucagggagccuggcug

SEQ ID NO: 901478 - RNA, 30 nt, Human
ccugcccccaaacugaacuaggccuggaaa

SEQ ID NO: 901479 - RNA, 21 nt, Human
cugcccccaaacugaacuagg

SEQ ID NO: 901480 - RNA, 19 nt, Human
cugggcauugagaaugaca

SEQ ID NO: 901481 - RNA, 21 nt, Human
gacccugcccccaaacugaac

SEQ ID NO: 901482 - RNA, 19 nt, Human
gccuggcccucagggagcc

SEQ ID NO: 901483 - RNA, 18 nt, Human
ggccuggaauccaugacc

SEQ ID NO: 901484 - RNA, 21 nt, Human
uacuuggccacucaauuccaa

SEQ ID NO: 901485 - RNA, 26 nt, Human
ucaaggcaggguuggagacaggguau

SEQ ID NO: 901486 - RNA, 22 nt, Human
ugagaaugacauucuuggccgc

SEQ ID NO: 901487 - RNA, 24 nt, Human
ugcagaaggagggggcauuuuuuu

SEQ ID NO: 901488 - RNA, 24 nt, Human
ugcagcucagucucugcugacacc

SEQ ID NO: 901489 - RNA, 19 nt, Human
uggaauuuguggccuggaa

SEQ ID NO: 901490 - RNA, 19 nt, Human
ugggagcaggacugacccu

SEQ ID NO: 901491 - RNA, 23 nt, Human
uggucugggggccuggcccucag

SEQ ID NO: 901492 - RNA, 19 nt, Human
uguccaaagaaagggugca

SEQ ID NO: 901493 - RNA, 19 nt, Human
uuuguggccuggaauccau

SEQ ID NO: 901494 - RNA, 19 nt, Human
aaagaucaauaagaaaugg

SEQ ID NO: 901495 - RNA, 20 nt, Human
aaagaucaauaagaaaugga

SEQ ID NO: 901496 - RNA, 19 nt, Human
aaccugaggagcccggacc

SEQ ID NO: 901497 - RNA, 20 nt, Human
aauuauauuuuucacaacua

SEQ ID NO: 901498 - RNA, 24 nt, Human
agagguggcagcagagcuggcagg

SEQ ID NO: 901499 - RNA, 23 nt, Human
aggagcccggaccagcccgcagu

SEQ ID NO: 901500 - RNA, 25 nt, Human
caacuaagccuuuggccaaaaaagu

SEQ ID NO: 901501 - RNA, 19 nt, Human
cagagcuggcaggacagga

SEQ ID NO: 901502 - RNA, 21 nt, Human
ccagcccgcaguagacuugcc

SEQ ID NO: 901503 - RNA, 20 nt, Human
cccauagugcugaagguaga

SEQ ID NO: 901504 - RNA, 22 nt, Human
ccgcaccugucucagauugcuc

SEQ ID NO: 901505 - RNA, 21 nt, Human
ccgcaguagacuugccgcacc

SEQ ID NO: 901506 - RNA, 21 nt, Human
cugaagguagaggugucugug

SEQ ID NO: 901507 - RNA, 24 nt, Human
gaccuguaaagugcaccucuccuc

SEQ ID NO: 901508 - RNA, 25 nt, Human
gagcuggcaggacaggacggcuggg

SEQ ID NO: 901509 - RNA, 28 nt, Human
ggccacuaccuugaauguauaauuuaaa

SEQ ID NO: 901510 - RNA, 21 nt, Human
ggucgggucugaaccugagga

SEQ ID NO: 901511 - RNA, 18 nt, Human
guggcagcagagcuggca

SEQ ID NO: 901512 - RNA, 20 nt, Human
uaaagugcaccucuccucuc

SEQ ID NO: 901513 - RNA, 23 nt, Human
uaagccuuuggccaaaaaaguca

SEQ ID NO: 901514 - RNA, 22 nt, Human
ucacugaauuaaacaguagcaa

SEQ ID NO: 901515 - RNA, 23 nt, Human
ugaaacauacaggcggcuguuag

SEQ ID NO: 901516 - RNA, 21 nt, Human
ugaauuaaacaguagcaaccc

SEQ ID NO: 901517 - RNA, 24 nt, Human
ugcaccucuccucuccacgaaccg

SEQ ID NO: 901518 - RNA, 24 nt, Human
uguaaagugcaccucuccucucca

SEQ ID NO: 901519 - RNA, 21 nt, Human
uguuacauuuggccacuaccu

SEQ ID NO: 901520 - RNA, 24 nt, Human
aagaaaaauacacagcaaaacaga

SEQ ID NO: 901521 - RNA, 22 nt, Human
aagaagcugcccaaauggcuuc

SEQ ID NO: 901522 - RNA, 20 nt, Human
acccauccugauuaaacugc

SEQ ID NO: 901523 - RNA, 24 nt, Human
accucaccugccuuccugauucaa

SEQ ID NO: 901524 - RNA, 18 nt, Human
accuccuacuggaccaaa

SEQ ID NO: 901525 - RNA, 21 nt, Human
agcugucccaaaacccauccc

SEQ ID NO: 901526 - RNA, 22 nt, Human
aguauggagaauaagagaagga

SEQ ID NO: 901527 - RNA, 22 nt, Human
aucauuuuuaaaaaguagauuc

SEQ ID NO: 901528 - RNA, 21 nt, Human
auuccaucuucccacccccag

SEQ ID NO: 901529 - RNA, 26 nt, Human
cacccccagccuuaugaggacagcuc

SEQ ID NO: 901530 - RNA, 26 nt, Human
cagcucagauccccguccggcuaucc

SEQ ID NO: 901531 - RNA, 25 nt, Human
caggacugggcccaggagccccauu

SEQ ID NO: 901532 - RNA, 27 nt, Human
ccaugcccauggagcugucccaaaacc

SEQ ID NO: 901533 - RNA, 23 nt, Human
cccaaauggcuuccugcuaugga

SEQ ID NO: 901534 - RNA, 19 nt, Human
cccauggagcugucccaaa

SEQ ID NO: 901535 - RNA, 21 nt, Human
ccuuaccucaccugccuuccu

SEQ ID NO: 901536 - RNA, 19 nt, Human
cuuccccaugcccauggag

SEQ ID NO: 901537 - RNA, 22 nt, Human
cuugggagucugggaaagguug

SEQ ID NO: 901538 - RNA, 20 nt, Human
gacuauuuaaagccagggga

SEQ ID NO: 901539 - RNA, 22 nt, Human
gagaaggauguuuuauaguccu

SEQ ID NO: 901540 - RNA, 19 nt, Human
gagaaucucuucccuacua

SEQ ID NO: 901541 - RNA, 19 nt, Human
gagucugggaaagguugua

SEQ ID NO: 901542 - RNA, 20 nt, Human
gauccccguccggcuauccc

SEQ ID NO: 901543 - RNA, 19 nt, Human
gccaaucucuucucuucuu

SEQ ID NO: 901544 - RNA, 26 nt, Human
gcccaggagccccauuugccaaucuc

SEQ ID NO: 901545 - RNA, 22 nt, Human
gcuauagcugaaaaaaauuauu

SEQ ID NO: 901546 - RNA, 19 nt, Human
ggagagugauuuggcccuu

SEQ ID NO: 901547 - RNA, 24 nt, Human
ggagcccuuuuucucauuugagaa

SEQ ID NO: 901548 - RNA, 21 nt, Human
gggaaagguuguauaguucuc

SEQ ID NO: 901549 - RNA, 33 nt, Human
uaagagaaggauguuuuauaguccucuguuucu

SEQ ID NO: 901550 - RNA, 24 nt, Human
uaccucaccugccuuccugauuca

SEQ ID NO: 901551 - RNA, 18 nt, Human
uauuuguauguacaugac

SEQ ID NO: 901552 - RNA, 22 nt, Human
ucaccugccuuccugauucaaa

SEQ ID NO: 901553 - RNA, 18 nt, Human
uccaucuucccaccccca

SEQ ID NO: 901554 - RNA, 22 nt, Human
ucuguuucagugccuuccccau

SEQ ID NO: 901555 - RNA, 18 nt, Human
ugccaaucucuucucuuc

SEQ ID NO: 901556 - RNA, 23 nt, Human
uggaaagauguaaucaccaaaga

SEQ ID NO: 901557 - RNA, 21 nt, Human
ugggagucugggaaagguugu

SEQ ID NO: 901558 - RNA, 19 nt, Human
ugguaaguguaaaagauau

SEQ ID NO: 901559 - RNA, 21 nt, Human
ugguaaguguaaaagauaugg

SEQ ID NO: 901560 - RNA, 22 nt, Human
uguaaucaccaaagaagcugcc

SEQ ID NO: 901561 - RNA, 24 nt, Human
uguauguacaugacuauuuaaagc

SEQ ID NO: 901562 - RNA, 24 nt, Human
uuaaagccaggggauuaucuuucu

SEQ ID NO: 901563 - RNA, 21 nt, Human
uucaugcccacugcccuuggg

SEQ ID NO: 901564 - RNA, 24 nt, Human
uucccagaagcccccaugugaucc

SEQ ID NO: 901565 - RNA, 18 nt, Human
uuggagaauuguuuuaag

SEQ ID NO: 901566 - RNA, 18 nt, Human
uuguaagaaaaauacaca

SEQ ID NO: 901567 - RNA, 21 nt, Human
uuucucauuugagaaucucuu

SEQ ID NO: 901568 - RNA, 21 nt, Human
uuugagaaucucuucccuacu

SEQ ID NO: 901569 - RNA, 21 nt, Human
uuuuuuuuuuuuuuugucaaa

SEQ ID NO: 901570 - RNA, 18 nt, Human
uuuuuuuuuuuuuuuuug

SEQ ID NO: 901571 - RNA, 19 nt, Human
uuuuuuuuuuuuuuuuugu

SEQ ID NO: 901572 - RNA, 24 nt, Human
aaaaagcaaaaggaaaagaucaaa

SEQ ID NO: 901573 - RNA, 18 nt, Human
aaacaagugagcaggggu

SEQ ID NO: 901574 - RNA, 23 nt, Human
aaagcaaaaggaaaagaucaaaa

SEQ ID NO: 901575 - RNA, 22 nt, Human
aacccgcggcugcagccucccc

SEQ ID NO: 901576 - RNA, 22 nt, Human
aacgguucccgggagcgggggc

SEQ ID NO: 901577 - RNA, 18 nt, Human
aagcaaaaggaaaagauc

SEQ ID NO: 901578 - RNA, 19 nt, Human
accccuccccugccacccu

SEQ ID NO: 901579 - RNA, 21 nt, Human
acccuaccccuccccugccac

SEQ ID NO: 901580 - RNA, 20 nt, Human
agaaaaggucagagcccagg

SEQ ID NO: 901581 - RNA, 26 nt, Human
agcuguaacaacccgcggcugcagcc

SEQ ID NO: 901582 - RNA, 28 nt, Human
agcuguaacaacccgcggcugcagccuc

SEQ ID NO: 901583 - RNA, 24 nt, Human
aggaaaagaucaaaaaauucagaa

SEQ ID NO: 901584 - RNA, 23 nt, Human
aggagcccagcccauuccaugac

SEQ ID NO: 901585 - RNA, 20 nt, Human
auggagucucuauucaaaaa

SEQ ID NO: 901586 - RNA, 22 nt, Human
cacccugggcaggggaaggggc

SEQ ID NO: 901587 - RNA, 22 nt, Human
cagaggcuucuucuuucugucu

SEQ ID NO: 901588 - RNA, 21 nt, Human
cagggguuuuuccccuggccu

SEQ ID NO: 901589 - RNA, 18 nt, Human
ccccaaccccacuacaag

SEQ ID NO: 901590 - RNA, 20 nt, Human
ccccacuacaagcuacucca

SEQ ID NO: 901591 - RNA, 21 nt, Human
ccccacuacaagcuacuccaa

SEQ ID NO: 901592 - RNA, 25 nt, Human
ccccacuacaagcuacuccaaguug

SEQ ID NO: 901593 - RNA, 18 nt, Human
cccuccccugccacccug

SEQ ID NO: 901594 - RNA, 18 nt, Human
cccugccacccugggcag

SEQ ID NO: 901595 - RNA, 18 nt, Human
ccuaccccuccccugcca

SEQ ID NO: 901596 - RNA, 23 nt, Human
ccuccugucgcaacugcgugguc

SEQ ID NO: 901597 - RNA, 19 nt, Human
ccugagggcaaacaaguga

SEQ ID NO: 901598 - RNA, 21 nt, Human
cggcccgggaacgguucccgg

SEQ ID NO: 901599 - RNA, 23 nt, Human
cuccagcagcuguaacaacccgc

SEQ ID NO: 901600 - RNA, 25 nt, Human
cuggcaguguccagaggcuucuucu

SEQ ID NO: 901601 - RNA, 24 nt, Human
ggaaaagaucaaaaaauucagaaa

SEQ ID NO: 901602 - RNA, 22 nt, Human
ggcaaacaagugagcagggguu

SEQ ID NO: 901603 - RNA, 24 nt, Human
ggcaguguccagaggcuucuucuu

SEQ ID NO: 901604 - RNA, 19 nt, Human
ggccagaggcucaaccccc

SEQ ID NO: 901605 - RNA, 20 nt, Human
gggggaaauuaggccagagg

SEQ ID NO: 901606 - RNA, 20 nt, Human
uaccccaaccccacuacaag

SEQ ID NO: 901607 - RNA, 26 nt, Human
ucaacccccaucucuggcagugucca

SEQ ID NO: 901608 - RNA, 20 nt, Human
ucagaaaaggucagagccca

SEQ ID NO: 901609 - RNA, 18 nt, Human
ucaguguugcagcacaug

SEQ ID NO: 901610 - RNA, 20 nt, Human
uccccuggccuccugucgca

SEQ ID NO: 901611 - RNA, 18 nt, Human
ugcugccccucucugcug

SEQ ID NO: 901612 - RNA, 24 nt, Human
uggggccgaagaucaacggcccgg

SEQ ID NO: 901613 - RNA, 18 nt, Human
ugggggaagcgagggggg

SEQ ID NO: 901614 - RNA, 22 nt, Human
ugucgcaacugcgugguccauu

SEQ ID NO: 901615 - RNA, 21 nt, Human
uucuucuuucugucuucagug

SEQ ID NO: 901616 - RNA, 18 nt, Human
uuggcugccugagggcaa

SEQ ID NO: 901617 - RNA, 23 nt, Human
aaccaaaauucccaugaagucaa

SEQ ID NO: 901618 - RNA, 19 nt, Human
aggguagaagaagggaaga

SEQ ID NO: 901619 - RNA, 19 nt, Human
caaaggcccugacagaacg

SEQ ID NO: 901620 - RNA, 19 nt, Human
caaaggcccugacagaacg

SEQ ID NO: 901621 - RNA, 22 nt, Human
caaaggcccugacagaacgaua

SEQ ID NO: 901622 - RNA, 21 nt, Human
cagcaagugcaagagcagcaa

SEQ ID NO: 901623 - RNA, 22 nt, Human
cagcaagugcaagagcagcaac

SEQ ID NO: 901624 - RNA, 19 nt, Human
ccagcaagugcaagagcag

SEQ ID NO: 901625 - RNA, 23 nt, Human
cccugugaugaacuguaguccuc

SEQ ID NO: 901626 - RNA, 19 nt, Human
uacauagggccaaccagcc

SEQ ID NO: 901627 - RNA, 20 nt, Human
uagggccaaccagcccaccc

SEQ ID NO: 901628 - RNA, 19 nt, Human
uauaugauguaaaauagag

SEQ ID NO: 901629 - RNA, 20 nt, Human
ugaagucaaaauuagacagu

SEQ ID NO: 901630 - RNA, 24 nt, Human
uguacacacaaauggcuuuaugca

SEQ ID NO: 901631 - RNA, 20 nt, Human
uuaggguagaagaagggaag

SEQ ID NO: 901632 - RNA, 23 nt, Human
uucaauacaauuaugggcagaaa

SEQ ID NO: 901633 - RNA, 19 nt, Human
aaagauccuacugaaucuc

SEQ ID NO: 901634 - RNA, 22 nt, Human
aaggaaaucccaaggcaauuca

SEQ ID NO: 901635 - RNA, 30 nt, Human
aauaacaggaaaagccacagaggagaggaa

SEQ ID NO: 901636 - RNA, 19 nt, Human
acccacagaguugcccgag

SEQ ID NO: 901637 - RNA, 21 nt, Human
acccagggcccccacacccac

SEQ ID NO: 901638 - RNA, 18 nt, Human
acucaaaagauccuacug

SEQ ID NO: 901639 - RNA, 23 nt, Human
agaagcacaaauuguaggggaca

SEQ ID NO: 901640 - RNA, 19 nt, Human
agcagcauucacccagggc

SEQ ID NO: 901641 - RNA, 22 nt, Human
agcgaagagcggacgaaaagaa

SEQ ID NO: 901642 - RNA, 19 nt, Human
aggaagagucuggauuccg

SEQ ID NO: 901643 - RNA, 20 nt, Human
aggggacagggugggcaggg

SEQ ID NO: 901644 - RNA, 19 nt, Human
aggguggggagguggggag

SEQ ID NO: 901645 - RNA, 19 nt, Human
auuccgugaagggucaagu

SEQ ID NO: 901646 - RNA, 18 nt, Human
auuguaggggacagggug

SEQ ID NO: 901647 - RNA, 23 nt, Human
auugugcuggaggugauaggcag

SEQ ID NO: 901648 - RNA, 20 nt, Human
auuuagaaaccugauuguuc

SEQ ID NO: 901649 - RNA, 22 nt, Human
caaauaucacaggcccggugag

SEQ ID NO: 901650 - RNA, 19 nt, Human
cacagcucagcuccacucu

SEQ ID NO: 901651 - RNA, 24 nt, Human
cacagcucagcuccacucugcugu

SEQ ID NO: 901652 - RNA, 22 nt, Human
cacccagggcccccacacccac

SEQ ID NO: 901653 - RNA, 24 nt, Human
cacccagggcccccacacccacag

SEQ ID NO: 901654 - RNA, 18 nt, Human
cagcuccacucugcuguu

SEQ ID NO: 901655 - RNA, 19 nt, Human
cauggugggugcuucacac

SEQ ID NO: 901656 - RNA, 19 nt, Human
ccucagcaacagaggugaa

SEQ ID NO: 901657 - RNA, 22 nt, Human
ccucagcaacagaggugaaggc

SEQ ID NO: 901658 - RNA, 20 nt, Human
ccugcccuccuugcucucuc

SEQ ID NO: 901659 - RNA, 26 nt, Human
cucucucuacccaccuccacucaaaa

SEQ ID NO: 901660 - RNA, 26 nt, Human
gaaaucccaaggcaauucaauagaag

SEQ ID NO: 901661 - RNA, 22 nt, Human
gagcggacgaaaagaaaagggu

SEQ ID NO: 901662 - RNA, 24 nt, Human
gauugugcuggaggugauaggcag

SEQ ID NO: 901663 - RNA, 20 nt, Human
gcucagcuccacucugcugu

SEQ ID NO: 901664 - RNA, 22 nt, Human
ggagaaauaagcgaagagcgga

SEQ ID NO: 901665 - RNA, 20 nt, Human
ggagguggggaggaggcaag

SEQ ID NO: 901666 - RNA, 22 nt, Human
ggcgggagaaauaagcgaagag

SEQ ID NO: 901667 - RNA, 19 nt, Human
gggacagggugggcaggga

SEQ ID NO: 901668 - RNA, 18 nt, Human
gguggggagguggggagg

SEQ ID NO: 901669 - RNA, 20 nt, Human
guccacagcucagcuccacu

SEQ ID NO: 901670 - RNA, 18 nt, Human
guccugcccuccuugcuc

SEQ ID NO: 901671 - RNA, 24 nt, Human
uaaaacgacuccaaacaucacuaa

SEQ ID NO: 901672 - RNA, 18 nt, Human
uaagggcaggugggggcc

SEQ ID NO: 901673 - RNA, 19 nt, Human
uaaguguccugcccuccuu

SEQ ID NO: 901674 - RNA, 18 nt, Human
uaggggacagggugggca

SEQ ID NO: 901675 - RNA, 25 nt, Human
ucagcaacagaggugaaggcuccuc

SEQ ID NO: 901676 - RNA, 21 nt, Human
uccaggaagagucuggauucc

SEQ ID NO: 901677 - RNA, 24 nt, Human
uccaggguggggagguggggagga

SEQ ID NO: 901678 - RNA, 21 nt, Human
ucuaccauuuccucagcaaca

SEQ ID NO: 901679 - RNA, 19 nt, Human
ugaggucucaagguggcug

SEQ ID NO: 901680 - RNA, 19 nt, Human
ugccagcaggggcagcagc

SEQ ID NO: 901681 - RNA, 22 nt, Human
ugccugcuaaguguccugcccu

SEQ ID NO: 901682 - RNA, 20 nt, Human
ugcucucucuacccaccucc

SEQ ID NO: 901683 - RNA, 19 nt, Human
ugcuggaggugauaggcag

SEQ ID NO: 901684 - RNA, 22 nt, Human
ugggcagggaaagggagaagga

SEQ ID NO: 901685 - RNA, 18 nt, Human
uggggagguggggaggag

SEQ ID NO: 901686 - RNA, 18 nt, Human
uggggagguggggaggag

SEQ ID NO: 901687 - RNA, 19 nt, Human
uggggagguggggaggagg

SEQ ID NO: 901688 - RNA, 25 nt, Human
uguccugcccuccuugcucucucua

SEQ ID NO: 901689 - RNA, 22 nt, Human
uguuuggcccucagggguucca

SEQ ID NO: 901690 - RNA, 21 nt, Human
uugcucucucuacccaccucc

SEQ ID NO: 901691 - RNA, 22 nt, Human
aaaaaagcucacgaggcccaaa

SEQ ID NO: 901692 - RNA, 22 nt, Human
aaaaagcucacgaggcccaaag

SEQ ID NO: 901693 - RNA, 20 nt, Human
aaaacacagucaaaagaacg

SEQ ID NO: 901694 - RNA, 21 nt, Human
aaaaggagaaaaaagacagaa

SEQ ID NO: 901695 - RNA, 19 nt, Human
aaacaagaggaggaaaugg

SEQ ID NO: 901696 - RNA, 21 nt, Human
aaacaaguucucaucuuccca

SEQ ID NO: 901697 - RNA, 24 nt, Human
aaacacacacacaaacacacacuc

SEQ ID NO: 901698 - RNA, 25 nt, Human
aaacacacacacaaacacacacucu

SEQ ID NO: 901699 - RNA, 18 nt, Human
aaacacacacucucucac

SEQ ID NO: 901700 - RNA, 19 nt, Human
aaacacacacucucucaca

SEQ ID NO: 901701 - RNA, 19 nt, Human
aaacacacaucucaacaag

SEQ ID NO: 901702 - RNA, 18 nt, Human
aaagagcccugcccaaga

SEQ ID NO: 901703 - RNA, 20 nt, Human
aaagcucacgaggcccaaag

SEQ ID NO: 901704 - RNA, 19 nt, Human
aaagcucuuuccaguuacu

SEQ ID NO: 901705 - RNA, 18 nt, Human
aacaagaggaggaaaugg

SEQ ID NO: 901706 - RNA, 20 nt, Human
aaccccagcgccgccgacau

SEQ ID NO: 901707 - RNA, 23 nt, Human
aacccgacagcaaauaaugacua

SEQ ID NO: 901708 - RNA, 23 nt, Human
aagcaagaggaagcuaaacagaa

SEQ ID NO: 901709 - RNA, 19 nt, Human
aagcagauccccuacccuc

SEQ ID NO: 901710 - RNA, 22 nt, Human
aagcagauccccuacccuccaa

SEQ ID NO: 901711 - RNA, 18 nt, Human
aagcaggagacacccaga

SEQ ID NO: 901712 - RNA, 18 nt, Human
aagcaggagacacccaga

SEQ ID NO: 901713 - RNA, 18 nt, Human
aaguaauccacugaggac

SEQ ID NO: 901714 - RNA, 18 nt, Human
aauggcaucuugaagggg

SEQ ID NO: 901715 - RNA, 24 nt, Human
acaaacacacacucucucacaguc

SEQ ID NO: 901716 - RNA, 24 nt, Human
acaaauauuccaaaaauauaaaca

SEQ ID NO: 901717 - RNA, 18 nt, Human
acacacucucucacaguc

SEQ ID NO: 901718 - RNA, 20 nt, Human
acacacucucucacagucaa

SEQ ID NO: 901719 - RNA, 23 nt, Human
acagagcucgguacaggacaggc

SEQ ID NO: 901720 - RNA, 22 nt, Human
acaggacaggcccugggggaag

SEQ ID NO: 901721 - RNA, 21 nt, Human
acccaugggccuacagagugu

SEQ ID NO: 901722 - RNA, 19 nt, Human
acccuuaggguggggcuug

SEQ ID NO: 901723 - RNA, 25 nt, Human
accuccuuccccacagguuugagac

SEQ ID NO: 901724 - RNA, 18 nt, Human
agaaaaccuccuucccca

SEQ ID NO: 901725 - RNA, 23 nt, Human
agaaaagccuggcugggccuaga

SEQ ID NO: 901726 - RNA, 18 nt, Human
agagaaccccacccaccc

SEQ ID NO: 901727 - RNA, 21 nt, Human
agagucugagcuccugcuuuc

SEQ ID NO: 901728 - RNA, 22 nt, Human
agcagaauagaauagcauccau

SEQ ID NO: 901729 - RNA, 19 nt, Human
agccaccgcugagagcacg

SEQ ID NO: 901730 - RNA, 22 nt, Human
agcuggcccgaccucuggccuc

SEQ ID NO: 901731 - RNA, 20 nt, Human
aggaaaagagcccugcccaa

SEQ ID NO: 901732 - RNA, 18 nt, Human
aggaagagcaagaguucu

SEQ ID NO: 901733 - RNA, 23 nt, Human
aggaaggauguaggcuggaacag

SEQ ID NO: 901734 - RNA, 20 nt, Human
aggaccugaaggggaaaaug

SEQ ID NO: 901735 - RNA, 18 nt, Human
aggagcgcccucccaccc

SEQ ID NO: 901736 - RNA, 19 nt, Human
aggaggagggagggaggga

SEQ ID NO: 901737 - RNA, 19 nt, Human
aggagggagggagggagga

SEQ ID NO: 901738 - RNA, 19 nt, Human
aggcaagcauagccuuugg

SEQ ID NO: 901739 - RNA, 23 nt, Human
aggcaccuuaaaagaacugaacc

SEQ ID NO: 901740 - RNA, 19 nt, Human
aggcaggguucugauggga

SEQ ID NO: 901741 - RNA, 25 nt, Human
aggcggccuguacaaagggcgggcc

SEQ ID NO: 901742 - RNA, 21 nt, Human
aggcuggaacagacagagcuc

SEQ ID NO: 901743 - RNA, 19 nt, Human
agggacacucccaccaagc

SEQ ID NO: 901744 - RNA, 21 nt, Human
agggaggcggccuguacaaag

SEQ ID NO: 901745 - RNA, 18 nt, Human
aggugggcaggcaggguu

SEQ ID NO: 901746 - RNA, 23 nt, Human
agguuugagacuauggcuaggug

SEQ ID NO: 901747 - RNA, 18 nt, Human
agugcaggucugaggggc

SEQ ID NO: 901748 - RNA, 23 nt, Human
auaaccuugggacaagaagggaa

SEQ ID NO: 901749 - RNA, 19 nt, Human
augccuggaguacccaaag

SEQ ID NO: 901750 - RNA, 23 nt, Human
auggcaaaacacacacacaaaca

SEQ ID NO: 901751 - RNA, 20 nt, Human
augugcagaguggaaacccu

SEQ ID NO: 901752 - RNA, 18 nt, Human
caaaacacacacacaaac

SEQ ID NO: 901753 - RNA, 21 nt, Human
caaaaugcuuaaaaucuuugg

SEQ ID NO: 901754 - RNA, 20 nt, Human
caagaguucugaggcccuua

SEQ ID NO: 901755 - RNA, 28 nt, Human
cacacacacaaacacacacucucucaca

SEQ ID NO: 901756 - RNA, 20 nt, Human
cacagcuguucacauccccc

SEQ ID NO: 901757 - RNA, 18 nt, Human
cacuggggccacaguuca

SEQ ID NO: 901758 - RNA, 22 nt, Human
cagcaaauaaugacuaggcugg

SEQ ID NO: 901759 - RNA, 20 nt, Human
caggcccuacaacguuaaaa

SEQ ID NO: 901760 - RNA, 19 nt, Human
caggcucagcaccccagcc

SEQ ID NO: 901761 - RNA, 23 nt, Human
cagggaacacagagaugggaaca

SEQ ID NO: 901762 - RNA, 20 nt, Human
cagucaaaagaacggaaauc

SEQ ID NO: 901763 - RNA, 20 nt, Human
caucccuacacaacucaguu

SEQ ID NO: 901764 - RNA, 24 nt, Human
cauggcaaaacacacacacaaaca

SEQ ID NO: 901765 - RNA, 25 nt, Human
cauggcaaaacacacacacaaacac

SEQ ID NO: 901766 - RNA, 18 nt, Human
ccaagccauccugggcuu

SEQ ID NO: 901767 - RNA, 21 nt, Human
ccacgauuaaggcagugaugc

SEQ ID NO: 901768 - RNA, 22 nt, Human
ccagccuuuggaacagaagucc

SEQ ID NO: 901769 - RNA, 23 nt, Human
cccaaaggcauacccuuccuuua

SEQ ID NO: 901770 - RNA, 19 nt, Human
cccaggaaggauguaggcu

SEQ ID NO: 901771 - RNA, 26 nt, Human
ccccacccaccccagggaggccacga

SEQ ID NO: 901772 - RNA, 19 nt, Human
ccccccucucguuuccucc

SEQ ID NO: 901773 - RNA, 18 nt, Human
cccccgggugcccccggc

SEQ ID NO: 901774 - RNA, 18 nt, Human
cccccucaccccaggaag

SEQ ID NO: 901775 - RNA, 24 nt, Human
cccccucucguuuccuccccggac

SEQ ID NO: 901776 - RNA, 21 nt, Human
ccccggccccgaucccccagc

SEQ ID NO: 901777 - RNA, 19 nt, Human
ccccgggugcccccggccc

SEQ ID NO: 901778 - RNA, 28 nt, Human
cccgaccucuggccuccucuucccuggc

SEQ ID NO: 901779 - RNA, 19 nt, Human
cccggaccgggaagggagg

SEQ ID NO: 901780 - RNA, 18 nt, Human
cccugaaaagcagacuua

SEQ ID NO: 901781 - RNA, 25 nt, Human
ccgagggacagcagugguuaaguaa

SEQ ID NO: 901782 - RNA, 23 nt, Human
ccgcuccggcucccgagacuccc

SEQ ID NO: 901783 - RNA, 23 nt, Human
ccgcuguuuccgggccguguggu

SEQ ID NO: 901784 - RNA, 22 nt, Human
ccggcucccgagacuccgacuu

SEQ ID NO: 901785 - RNA, 28 nt, Human
ccucacccuaacacacggugaaacugga

SEQ ID NO: 901786 - RNA, 23 nt, Human
ccucuuauuuuccacccugggaa

SEQ ID NO: 901787 - RNA, 19 nt, Human
ccuuggcauaggccuuaca

SEQ ID NO: 901788 - RNA, 22 nt, Human
cgaccucuggccuccucuuccc

SEQ ID NO: 901789 - RNA, 19 nt, Human
cggagugaaaacaagagga

SEQ ID NO: 901790 - RNA, 25 nt, Human
cggccuccucccugucuugcccucc

SEQ ID NO: 901791 - RNA, 22 nt, Human
cucaaccucucuaguaagggaa

SEQ ID NO: 901792 - RNA, 20 nt, Human
cuccaaauggcaucuugaag

SEQ ID NO: 901793 - RNA, 20 nt, Human
cuccuuuuugggaggccccu

SEQ ID NO: 901794 - RNA, 23 nt, Human
cuccuuuuugggaggccccuugu

SEQ ID NO: 901795 - RNA, 23 nt, Human
cugggugccagacagccuucuga

SEQ ID NO: 901796 - RNA, 22 nt, Human
gaaaacaagaggaggaaauggc

SEQ ID NO: 901797 - RNA, 18 nt, Human
gaaccuggcagguaggca

SEQ ID NO: 901798 - RNA, 25 nt, Human
gacccuggcuagguuuggggguagc

SEQ ID NO: 901799 - RNA, 22 nt, Human
gagaggagacaagcuaacuugg

SEQ ID NO: 901800 - RNA, 21 nt, Human
gaggccacgauuaaggcagug

SEQ ID NO: 901801 - RNA, 21 nt, Human
gaggcccaaagaggagggucc

SEQ ID NO: 901802 - RNA, 20 nt, Human
gaucccccagcggcagcucc

SEQ ID NO: 901803 - RNA, 24 nt, Human
gcagggagaaaaccuccuucccca

SEQ ID NO: 901804 - RNA, 18 nt, Human
gcauaggccuuacaacac

SEQ ID NO: 901805 - RNA, 21 nt, Human
gccccgaucccccagcggcag

SEQ ID NO: 901806 - RNA, 24 nt, Human
gcuuugugauaccugccuccaggg

SEQ ID NO: 901807 - RNA, 21 nt, Human
ggaaaggggguggcacaugcu

SEQ ID NO: 901808 - RNA, 18 nt, Human
ggaagaguccugaguggg

SEQ ID NO: 901809 - RNA, 19 nt, Human
ggaccugaaggggaaaaug

SEQ ID NO: 901810 - RNA, 18 nt, Human
ggagacauagaaaaggcc

SEQ ID NO: 901811 - RNA, 18 nt, Human
ggagggagggagggagga

SEQ ID NO: 901812 - RNA, 19 nt, Human
ggcaggcaggguucugaug

SEQ ID NO: 901813 - RNA, 20 nt, Human
ggccugggcgggggcccgcu

SEQ ID NO: 901814 - RNA, 21 nt, Human
ggccugggcgggggcccgcuc

SEQ ID NO: 901815 - RNA, 20 nt, Human
ggccuguacaaagggcgggc

SEQ ID NO: 901816 - RNA, 24 nt, Human
ggccuuggguccgaagccacagcc

SEQ ID NO: 901817 - RNA, 25 nt, Human
ggcugggccuagacggcacaagauu

SEQ ID NO: 901818 - RNA, 22 nt, Human
ggcugggcugggcuggggggcc

SEQ ID NO: 901819 - RNA, 21 nt, Human
ggcugggcuggggggccuggg

SEQ ID NO: 901820 - RNA, 22 nt, Human
gggaagacacaacaggaaaaga

SEQ ID NO: 901821 - RNA, 21 nt, Human
gggaauggcauuguugggggg

SEQ ID NO: 901822 - RNA, 18 nt, Human
gggaggggcugggacagc

SEQ ID NO: 901823 - RNA, 19 nt, Human
gggccacaagaccugaugg

SEQ ID NO: 901824 - RNA, 20 nt, Human
gggcuccucaguuugggucc

SEQ ID NO: 901825 - RNA, 22 nt, Human
gggcugggcugggcuggggggc

SEQ ID NO: 901826 - RNA, 23 nt, Human
gggcugggcuggggggccugggc

SEQ ID NO: 901827 - RNA, 21 nt, Human
gggcuggggggccugggcggg

SEQ ID NO: 901828 - RNA, 23 nt, Human
ggggggaguugcaggugggcagg

SEQ ID NO: 901829 - RNA, 26 nt, Human
ggggggccugggcggggguuccucga

SEQ ID NO: 901830 - RNA, 22 nt, Human
gucacagugggaagcagauccc

SEQ ID NO: 901831 - RNA, 19 nt, Human
gucuuucagcuucuccccc

SEQ ID NO: 901832 - RNA, 18 nt, Human
gugaugcugagguggggc

SEQ ID NO: 901833 - RNA, 20 nt, Human
gugcucccaauuacagcagc

SEQ ID NO: 901834 - RNA, 18 nt, Human
guguggcaauggaaggga

SEQ ID NO: 901835 - RNA, 21 nt, Human
uaaaacacagucaaaagaacg

SEQ ID NO: 901836 - RNA, 18 nt, Human
uaaacagacacuuaaugg

SEQ ID NO: 901837 - RNA, 18 nt, Human
uaagcaaaaaagcucacg

SEQ ID NO: 901838 - RNA, 19 nt, Human
uaaggcagugaugcugagg

SEQ ID NO: 901839 - RNA, 22 nt, Human
uacaccgggaccccauaggcac

SEQ ID NO: 901840 - RNA, 23 nt, Human
uacaccgggaccccauaggcacc

SEQ ID NO: 901841 - RNA, 26 nt, Human
uauaaacagacacuuaauggcguccu

SEQ ID NO: 901842 - RNA, 19 nt, Human
uaucccaggcacucagccg

SEQ ID NO: 901843 - RNA, 19 nt, Human
ucacagugggaagcagauc

SEQ ID NO: 901844 - RNA, 22 nt, Human
ucagaaacaaaccaggcccaac

SEQ ID NO: 901845 - RNA, 23 nt, Human
ucagaaacaaaccaggcccaaca

SEQ ID NO: 901846 - RNA, 25 nt, Human
ucagcuuagagccucuuauugcuua

SEQ ID NO: 901847 - RNA, 26 nt, Human
uccaaaaauauaaacagacacuuaau

SEQ ID NO: 901848 - RNA, 21 nt, Human
uccacaagaacagacccuggc

SEQ ID NO: 901849 - RNA, 19 nt, Human
ucccagaaaugugaucuuu

SEQ ID NO: 901850 - RNA, 23 nt, Human
ucccagaaaugugaucuuuuguc

SEQ ID NO: 901851 - RNA, 20 nt, Human
ucccagagaaagacugccuu

SEQ ID NO: 901852 - RNA, 24 nt, Human
ucccagccuuuggaacagaagucc

SEQ ID NO: 901853 - RNA, 22 nt, Human
ucccaugcuuuuagcacaaagc

SEQ ID NO: 901854 - RNA, 22 nt, Human
ucccccagcggcagcuccgggc

SEQ ID NO: 901855 - RNA, 20 nt, Human
ucccgagacuccgacuucca

SEQ ID NO: 901856 - RNA, 21 nt, Human
ucccgagacuccgacuuccac

SEQ ID NO: 901857 - RNA, 20 nt, Human
ucccgcgggcccgggcuggc

SEQ ID NO: 901858 - RNA, 20 nt, Human
ucccgggcagggagaaaacc

SEQ ID NO: 901859 - RNA, 19 nt, Human
ucccugcaaccccagcgcc

SEQ ID NO: 901860 - RNA, 20 nt, Human
uccucaguuuggguccaaca

SEQ ID NO: 901861 - RNA, 19 nt, Human
uccuccccggaccgggaag

SEQ ID NO: 901862 - RNA, 24 nt, Human
uccuucucccuuuaggucggacuc

SEQ ID NO: 901863 - RNA, 23 nt, Human
ucucacagucaaacacacaucuc

SEQ ID NO: 901864 - RNA, 24 nt, Human
ucucaucuucccagaaaugugauc

SEQ ID NO: 901865 - RNA, 22 nt, Human
ucugcagcagcuggcuggagaa

SEQ ID NO: 901866 - RNA, 22 nt, Human
ucuggggacucuguuccacuuu

SEQ ID NO: 901867 - RNA, 26 nt, Human
ucuguccucuucccgggcagggagaa

SEQ ID NO: 901868 - RNA, 18 nt, Human
ucuuauugcuuauuuagu

SEQ ID NO: 901869 - RNA, 22 nt, Human
ugaagaggcaccuuaaaagaac

SEQ ID NO: 901870 - RNA, 25 nt, Human
ugaagaggcaccuuaaaagaacuga

SEQ ID NO: 901871 - RNA, 18 nt, Human
ugagagcacgaagcugcu

SEQ ID NO: 901872 - RNA, 20 nt, Human
ugaggaaggcaggcucagca

SEQ ID NO: 901873 - RNA, 19 nt, Human
ugaguggguggugucccug

SEQ ID NO: 901874 - RNA, 22 nt, Human
ugcaccagcaccagcagagaau

SEQ ID NO: 901875 - RNA, 23 nt, Human
ugcagaugcagcagggacacucc

SEQ ID NO: 901876 - RNA, 18 nt, Human
ugcccccggccccgaucc

SEQ ID NO: 901877 - RNA, 20 nt, Human
ugccuggaguacccaaaggc

SEQ ID NO: 901878 - RNA, 23 nt, Human
uggaaagguuuuuuaaacccacu

SEQ ID NO: 901879 - RNA, 21 nt, Human
uggaacagacagagcucggua

SEQ ID NO: 901880 - RNA, 26 nt, Human
uggaagggaugauggggaagaguccu

SEQ ID NO: 901881 - RNA, 26 nt, Human
uggcaauggaagggaugauggggaag

SEQ ID NO: 901882 - RNA, 23 nt, Human
uggcagguaggcagauuccuucu

SEQ ID NO: 901883 - RNA, 19 nt, Human
ugggaauggcauuguuggg

SEQ ID NO: 901884 - RNA, 18 nt, Human
ugggagugaggccuaaaa

SEQ ID NO: 901885 - RNA, 18 nt, Human
ugggcugggcuggggggc

SEQ ID NO: 901886 - RNA, 24 nt, Human
ugggggggaguugcaggugggcag

SEQ ID NO: 901887 - RNA, 21 nt, Human
uguaugccuggaguacccaaa

SEQ ID NO: 901888 - RNA, 23 nt, Human
uguaugccuggaguacccaaagg

SEQ ID NO: 901889 - RNA, 20 nt, Human
ugucuuuucccugcaacccc

SEQ ID NO: 901890 - RNA, 28 nt, Human
uguggcaauggaagggaugauggggaag

SEQ ID NO: 901891 - RNA, 18 nt, Human
uuacagcagcacuuccuc

SEQ ID NO: 901892 - RNA, 22 nt, Human
uuacaggcccaggacuguaacu

SEQ ID NO: 901893 - RNA, 18 nt, Human
uuacuucccgcuguuucc

SEQ ID NO: 901894 - RNA, 24 nt, Human
uucacauccccccucucguuuccu

SEQ ID NO: 901895 - RNA, 20 nt, Human
uuccacagcuguucacaucc

SEQ ID NO: 901896 - RNA, 25 nt, Human
uucccagaaaugugaucuuuuguua

SEQ ID NO: 901897 - RNA, 23 nt, Human
uucccaugcuuuuagcacaaagc

SEQ ID NO: 901898 - RNA, 25 nt, Human
uucccaugcuuuuagcacaaagcag

SEQ ID NO: 901899 - RNA, 20 nt, Human
uuccgggccguguggugagg

SEQ ID NO: 901900 - RNA, 26 nt, Human
uuccugaggcuggaucuagggugugg

SEQ ID NO: 901901 - RNA, 19 nt, Human
uucucaucuucccagaaau

SEQ ID NO: 901902 - RNA, 23 nt, Human
uugcaggugggcaggcaggguuc

SEQ ID NO: 901903 - RNA, 19 nt, Human
uuggacaagucuguuagga

SEQ ID NO: 901904 - RNA, 21 nt, Human
uugggacaagaagggaaggug

SEQ ID NO: 901905 - RNA, 23 nt, Human
uuuaggaaaaagggaccgaggga

SEQ ID NO: 901906 - RNA, 25 nt, Human
uuucaaguuuuggaauacaacaaau

SEQ ID NO: 901907 - RNA, 20 nt, Human
aaaaaaaaccaaagaugaaa

SEQ ID NO: 901908 - RNA, 21 nt, Human
aaaagaaaagugucuagaaaa

SEQ ID NO: 901909 - RNA, 23 nt, Human
aagacccauuaacguuuucuaga

SEQ ID NO: 901910 - RNA, 22 nt, Human
aaguaaauacagguuguaugga

SEQ ID NO: 901911 - RNA, 18 nt, Human
aauaaaguaagcugaaag

SEQ ID NO: 901912 - RNA, 21 nt, Human
agaaaaaaaaaccaaagauga

SEQ ID NO: 901913 - RNA, 23 nt, Human
agaaauguacaaucucaagucuc

SEQ ID NO: 901914 - RNA, 22 nt, Human
agaguaguaagaaauguacaau

SEQ ID NO: 901915 - RNA, 22 nt, Human
auagugaaauuaaaguaaauac

SEQ ID NO: 901916 - RNA, 20 nt, Human
caggcgcaggcugcccuucc

SEQ ID NO: 901917 - RNA, 24 nt, Human
cucaaacuauauuuuagaccuaca

SEQ ID NO: 901918 - RNA, 27 nt, Human
cucuuuacugcaaugucauauucugau

SEQ ID NO: 901919 - RNA, 21 nt, Human
cugcaaugucauauucugauc

SEQ ID NO: 901920 - RNA, 22 nt, Human
gcgcagcagccucgguacccag

SEQ ID NO: 901921 - RNA, 19 nt, Human
guggaugccaaaaaucuuc

SEQ ID NO: 901922 - RNA, 19 nt, Human
uaagcugaaagcauaguga

SEQ ID NO: 901923 - RNA, 23 nt, Human
uacauaucauacaauaaaguaag

SEQ ID NO: 901924 - RNA, 22 nt, Human
ucaagacccauuaacguuuucu

SEQ ID NO: 901925 - RNA, 22 nt, Human
ucuagaaaaaaaaaccaaagau

SEQ ID NO: 901926 - RNA, 21 nt, Human
uguauggauagcucaauuucu

SEQ ID NO: 901927 - RNA, 18 nt, Human
ugucuagaaaaaaaaacc

SEQ ID NO: 901928 - RNA, 21 nt, Human
ugucuagaaaaaaaaaccaaa

SEQ ID NO: 901929 - RNA, 18 nt, Human
uuaagcucuuuacugcaa

SEQ ID NO: 901930 - RNA, 23 nt, Human
agcggccagugggggcggggggc

SEQ ID NO: 901931 - RNA, 22 nt, Human
cccgcgcgcggccgagcggcca

SEQ ID NO: 901932 - RNA, 19 nt, Human
ccgggggcggggccggggg

SEQ ID NO: 901933 - RNA, 18 nt, Human
gcgcggcgcgaggcgggg

SEQ ID NO: 901934 - RNA, 22 nt, Human
ggccagugggggcggggggcag

SEQ ID NO: 901935 - RNA, 20 nt, Human
ggcgcagucacgugcgcgcg

SEQ ID NO: 901936 - RNA, 21 nt, Human
gggcggggccgggggcgcagu

SEQ ID NO: 901937 - RNA, 23 nt, Human
ggggcggggggcaggccgggggc

SEQ ID NO: 901938 - RNA, 21 nt, Human
ugggggcggggggcaggccgg

SEQ ID NO: 901939 - RNA, 23 nt, Human
aaaaggcacaaaauuaguauuac

SEQ ID NO: 901940 - RNA, 22 nt, Human
aaagcccuuuuucaucacaaaa

SEQ ID NO: 901941 - RNA, 19 nt, Human
aaagcucugcaccuccacc

SEQ ID NO: 901942 - RNA, 19 nt, Human
aacuccuuggugggccuug

SEQ ID NO: 901943 - RNA, 25 nt, Human
aagcagacaaaaggcacaaaauuag

SEQ ID NO: 901944 - RNA, 23 nt, Human
aagcccuuuuucaucacaaaaga

SEQ ID NO: 901945 - RNA, 23 nt, Human
acagugcuuucuugcagaguugg

SEQ ID NO: 901946 - RNA, 20 nt, Human
acggcggcugcugcugcugc

SEQ ID NO: 901947 - RNA, 21 nt, Human
agaaaaacuucaaacuucauu

SEQ ID NO: 901948 - RNA, 18 nt, Human
agaaagcagacaaaaggc

SEQ ID NO: 901949 - RNA, 20 nt, Human
agaaagcagacaaaaggcac

SEQ ID NO: 901950 - RNA, 24 nt, Human
agaaagcagacaaaaggcacaaaa

SEQ ID NO: 901951 - RNA, 29 nt, Human
agacaaaaggcacaaaauuaggggacccc

SEQ ID NO: 901952 - RNA, 27 nt, Human
agacaaaaggcacaaaauuaguauuac

SEQ ID NO: 901953 - RNA, 21 nt, Human
agagaagcauucaugcuauug

SEQ ID NO: 901954 - RNA, 19 nt, Human
aggaaaaaauaauccacag

SEQ ID NO: 901955 - RNA, 29 nt, Human
aggcucuggcauaaaucuuuaacagcuuu

SEQ ID NO: 901956 - RNA, 21 nt, Human
caaaaacagggcuauacugga

SEQ ID NO: 901957 - RNA, 23 nt, Human
caaaaacagggcuauacuggaaa

SEQ ID NO: 901958 - RNA, 19 nt, Human
caaaaggcacaaaauuagu

SEQ ID NO: 901959 - RNA, 22 nt, Human
caacuucucaaaaaugaaugac

SEQ ID NO: 901960 - RNA, 21 nt, Human
cacgccaagucacccacgcau

SEQ ID NO: 901961 - RNA, 24 nt, Human
cacgccaagucacccacgcauucc

SEQ ID NO: 901962 - RNA, 22 nt, Human
cacuccccaccccuuauccacc

SEQ ID NO: 901963 - RNA, 19 nt, Human
cagcuuccugccaaccccc

SEQ ID NO: 901964 - RNA, 21 nt, Human
ccaugccaguucaccuucauu

SEQ ID NO: 901965 - RNA, 24 nt, Human
cccggauauggacccgcccagccu

SEQ ID NO: 901966 - RNA, 18 nt, Human
cccuaaauccacgccaag

SEQ ID NO: 901967 - RNA, 21 nt, Human
ccgccgcgguggcggccccgg

SEQ ID NO: 901968 - RNA, 21 nt, Human
ccgggaaaugccuucucuucc

SEQ ID NO: 901969 - RNA, 24 nt, Human
ccuacaaaaacagggcuauacugg

SEQ ID NO: 901970 - RNA, 21 nt, Human
ccucuagcagagugugggggu

SEQ ID NO: 901971 - RNA, 20 nt, Human
ccugccaacccccauccagc

SEQ ID NO: 901972 - RNA, 21 nt, Human
ccuucucuuccuucguguccc

SEQ ID NO: 901973 - RNA, 19 nt, Human
ccuucugccacccucucuu

SEQ ID NO: 901974 - RNA, 24 nt, Human
ccuucugccacccucucuuggauc

SEQ ID NO: 901975 - RNA, 22 nt, Human
cgccaagucacccacgcauucc

SEQ ID NO: 901976 - RNA, 21 nt, Human
cgcccgggccgcgcgugccug

SEQ ID NO: 901977 - RNA, 21 nt, Human
cgggaccuggagggaggggca

SEQ ID NO: 901978 - RNA, 22 nt, Human
cuaaauccacgccaagucaccc

SEQ ID NO: 901979 - RNA, 19 nt, Human
cuccuuggugggccuuggc

SEQ ID NO: 901980 - RNA, 21 nt, Human
cuggucuuaagaaagcagaca

SEQ ID NO: 901981 - RNA, 22 nt, Human
cuuccugccaacccccauccag

SEQ ID NO: 901982 - RNA, 21 nt, Human
cuugaauaaauucauuccucu

SEQ ID NO: 901983 - RNA, 18 nt, Human
gccacccucucuuggauc

SEQ ID NO: 901984 - RNA, 19 nt, Human
gcggccccggcacggcggc

SEQ ID NO: 901985 - RNA, 22 nt, Human
ggaaagcucugcaccuccaccc

SEQ ID NO: 901986 - RNA, 18 nt, Human
ggaccuggagggaggggc

SEQ ID NO: 901987 - RNA, 21 nt, Human
ggacgcccgggccgcgcgugc

SEQ ID NO: 901988 - RNA, 22 nt, Human
ggagggaggggcagccucaccc

SEQ ID NO: 901989 - RNA, 19 nt, Human
ggggugcacuuuucauagu

SEQ ID NO: 901990 - RNA, 24 nt, Human
gggugcccgccgcgguggcggccc

SEQ ID NO: 901991 - RNA, 19 nt, Human
ggguggaaaacuccuuggu

SEQ ID NO: 901992 - RNA, 21 nt, Human
gucacuccccaccccuuaucc

SEQ ID NO: 901993 - RNA, 26 nt, Human
uaaaaaauaaauuaagcauucagcaa

SEQ ID NO: 901994 - RNA, 23 nt, Human
uaagaaagcagacaaaaggcaca

SEQ ID NO: 901995 - RNA, 24 nt, Human
uacaaaaacagggcuauacuggaa

SEQ ID NO: 901996 - RNA, 24 nt, Human
uagcagagugugggggugcacuuu

SEQ ID NO: 901997 - RNA, 21 nt, Human
uaguauuacuacagagaagca

SEQ ID NO: 901998 - RNA, 25 nt, Human
uauauuugucuaauaucuacaaagu

SEQ ID NO: 901999 - RNA, 19 nt, Human
uaucuuugugaguguaaaa

SEQ ID NO: 902000 - RNA, 20 nt, Human
ucagauguuuacauagugca

SEQ ID NO: 902001 - RNA, 26 nt, Human
uccacgccaagucacccacgcauucc

SEQ ID NO: 902002 - RNA, 20 nt, Human
uccccaaacuaaauacaaga

SEQ ID NO: 902003 - RNA, 20 nt, Human
uccccaccccuuauccaccu

SEQ ID NO: 902004 - RNA, 23 nt, Human
ucccuuauggacagugaucgggc

SEQ ID NO: 902005 - RNA, 18 nt, Human
uccugccaacccccaucc

SEQ ID NO: 902006 - RNA, 24 nt, Human
uccuucugccacccucucuuggau

SEQ ID NO: 902007 - RNA, 21 nt, Human
ucugcacgucacuccccaccc

SEQ ID NO: 902008 - RNA, 21 nt, Human
ugacuagcgcugugaccauga

SEQ ID NO: 902009 - RNA, 20 nt, Human
ugauacucuacuacuuuaau

SEQ ID NO: 902010 - RNA, 20 nt, Human
ugcacgucacuccccacccc

SEQ ID NO: 902011 - RNA, 21 nt, Human
ugcacuugaggaaaaaauaau

SEQ ID NO: 902012 - RNA, 19 nt, Human
ugcacuuuucauaguauau

SEQ ID NO: 902013 - RNA, 20 nt, Human
ugcaggcguuauguauguuu

SEQ ID NO: 902014 - RNA, 22 nt, Human
ugcauguuuucaugugcaugca

SEQ ID NO: 902015 - RNA, 21 nt, Human
ugcugcuacagcuccggacgc

SEQ ID NO: 902016 - RNA, 18 nt, Human
ugcugcugcugcuacagc

SEQ ID NO: 902017 - RNA, 23 nt, Human
uggcggccccggcacggcggcug

SEQ ID NO: 902018 - RNA, 18 nt, Human
uguaaaggcuaaaaacug

SEQ ID NO: 902019 - RNA, 21 nt, Human
ugucccagaggugcuccaucc

SEQ ID NO: 902020 - RNA, 21 nt, Human
ugugaacguauacggugugua

SEQ ID NO: 902021 - RNA, 23 nt, Human
uguguacacacacgugccccgaa

SEQ ID NO: 902022 - RNA, 24 nt, Human
ugugugaacguauacgguguguac

SEQ ID NO: 902023 - RNA, 23 nt, Human
uguuuacauagugcaugugugug

SEQ ID NO: 902024 - RNA, 20 nt, Human
uuaacugaaaccauggaaua

SEQ ID NO: 902025 - RNA, 20 nt, Human
uuaagcauucagcaaaaacc

SEQ ID NO: 902026 - RNA, 21 nt, Human
uucauuuugacaggaguugac

SEQ ID NO: 902027 - RNA, 21 nt, Human
uucuaccaggaaugagccacu

SEQ ID NO: 902028 - RNA, 22 nt, Human
uugaggcugugguugugcaugu

SEQ ID NO: 902029 - RNA, 23 nt, Human
uugcagaguuggguuagccagag

SEQ ID NO: 902030 - RNA, 24 nt, Human
uuggauuugauaaauauuggagug

SEQ ID NO: 902031 - RNA, 23 nt, Human
uugugcauguuuucaugugcaug

SEQ ID NO: 902032 - RNA, 25 nt, Human
uuuggcaaagugaaaaauagaaaaa

SEQ ID NO: 902033 - RNA, 21 nt, Human
uuuuuuuuuuuuuuuuguauu

SEQ ID NO: 902034 - RNA, 22 nt, Human
aaaaaacagaguaaggcaccac

SEQ ID NO: 902035 - RNA, 23 nt, Human
aaaaaacagaguaaggcaguggg

SEQ ID NO: 902036 - RNA, 23 nt, Human
aaaugaacaagggaaucauuaaa

SEQ ID NO: 902037 - RNA, 20 nt, Human
aagaaggaaaaaaguaacag

SEQ ID NO: 902038 - RNA, 24 nt, Human
aagcaaggauggaaaaagggaccc

SEQ ID NO: 902039 - RNA, 23 nt, Human
aagucaauguuguuuucaaguau

SEQ ID NO: 902040 - RNA, 19 nt, Human
acacaggcauacagucuuu

SEQ ID NO: 902041 - RNA, 26 nt, Human
acuacaaagaaaucaaagucacugag

SEQ ID NO: 902042 - RNA, 24 nt, Human
acugucaaaugguccagaaaagga

SEQ ID NO: 902043 - RNA, 25 nt, Human
agaaagaaagacacaaacucugaaa

SEQ ID NO: 902044 - RNA, 26 nt, Human
agaaagaaagacacaaacucugaaag

SEQ ID NO: 902045 - RNA, 20 nt, Human
agaaagacacaaacucugaa

SEQ ID NO: 902046 - RNA, 25 nt, Human
agacacagccaccuacaauggcuga

SEQ ID NO: 902047 - RNA, 19 nt, Human
agcaauucuucaaccucac

SEQ ID NO: 902048 - RNA, 22 nt, Human
caaaagcaaggauggaaaaacg

SEQ ID NO: 902049 - RNA, 23 nt, Human
caaaagcaaggauggaaaaacgc

SEQ ID NO: 902050 - RNA, 18 nt, Human
caaagaaaucaaagucac

SEQ ID NO: 902051 - RNA, 19 nt, Human
caaaguccacuugcccuuc

SEQ ID NO: 902052 - RNA, 21 nt, Human
caacacaggaacuauaacuca

SEQ ID NO: 902053 - RNA, 18 nt, Human
caacagacacagccaccu

SEQ ID NO: 902054 - RNA, 21 nt, Human
caccacucuugggaaauuaag

SEQ ID NO: 902055 - RNA, 25 nt, Human
cagaacacaauuuaucagagcacaa

SEQ ID NO: 902056 - RNA, 21 nt, Human
cagcaaaaaugaacaagggaa

SEQ ID NO: 902057 - RNA, 18 nt, Human
caggggaagcaacgagga

SEQ ID NO: 902058 - RNA, 24 nt, Human
ccacuucugggucaucuuucuccu

SEQ ID NO: 902059 - RNA, 20 nt, Human
ccagaaaaggaagauacaca

SEQ ID NO: 902060 - RNA, 18 nt, Human
ccauucugggaggauuua

SEQ ID NO: 902061 - RNA, 22 nt, Human
ccuuuccggcaaaagcaaggau

SEQ ID NO: 902062 - RNA, 22 nt, Human
cgcaaucaggaagcaggucacu

SEQ ID NO: 902063 - RNA, 20 nt, Human
cuaaaggugaaaagaaagaa

SEQ ID NO: 902064 - RNA, 23 nt, Human
cuaaccucuuuaacagaacacaa

SEQ ID NO: 902065 - RNA, 25 nt, Human
cugaaaaauguucugaaauuuuuca

SEQ ID NO: 902066 - RNA, 20 nt, Human
cugggucaucuuucuccucc

SEQ ID NO: 902067 - RNA, 21 nt, Human
cugguugauuuuuuuuuuuaa

SEQ ID NO: 902068 - RNA, 20 nt, Human
cuuauaauuuacaauuuguu

SEQ ID NO: 902069 - RNA, 24 nt, Human
cuucugggucaucuuucuccuccu

SEQ ID NO: 902070 - RNA, 20 nt, Human
gaacaauucuguaguucugu

SEQ ID NO: 902071 - RNA, 22 nt, Human
gcaacagacacagccaccuaca

SEQ ID NO: 902072 - RNA, 23 nt, Human
ggcaccacucuugggaaauuaag

SEQ ID NO: 902073 - RNA, 23 nt, Human
ggucaucuuucuccuccucuugg

SEQ ID NO: 902074 - RNA, 18 nt, Human
gguccagaaaaggaagau

SEQ ID NO: 902075 - RNA, 21 nt, Human
guaaacagagaagaaccucau

SEQ ID NO: 902076 - RNA, 20 nt, Human
uaaacagagaagaaccucau

SEQ ID NO: 902077 - RNA, 22 nt, Human
uaacaaguuuuaagaugguauu

SEQ ID NO: 902078 - RNA, 21 nt, Human
uaauugccagcaauucuucaa

SEQ ID NO: 902079 - RNA, 19 nt, Human
uaccgguugcuaaaucaca

SEQ ID NO: 902080 - RNA, 24 nt, Human
uacuucaguuauggacagaaagaa

SEQ ID NO: 902081 - RNA, 22 nt, Human
uaucagagcacaaagcuuaaac

SEQ ID NO: 902082 - RNA, 22 nt, Human
ucagaaaaaacagaguaaggca

SEQ ID NO: 902083 - RNA, 23 nt, Human
uccaaagggauaacacauaauac

SEQ ID NO: 902084 - RNA, 25 nt, Human
uccggcaaaagcaaggauggaaaaa

SEQ ID NO: 902085 - RNA, 23 nt, Human
uccucaaaaaaaaaaauaaauaa

SEQ ID NO: 902086 - RNA, 21 nt, Human
ucugaaacggagacuucacuu

SEQ ID NO: 902087 - RNA, 27 nt, Human
ucuguaguucuguaggugacuuuuuuu

SEQ ID NO: 902088 - RNA, 23 nt, Human
ugagagggacaggggaagcaacg

SEQ ID NO: 902089 - RNA, 19 nt, Human
ugagcaccauaauaaguag

SEQ ID NO: 902090 - RNA, 20 nt, Human
ugagcgggagagaacaauuc

SEQ ID NO: 902091 - RNA, 24 nt, Human
ugagcgggagagaacaauucugua

SEQ ID NO: 902092 - RNA, 21 nt, Human
ugccagcaauucuucaaccuc

SEQ ID NO: 902093 - RNA, 19 nt, Human
ugccuuguuaccacaaccu

SEQ ID NO: 902094 - RNA, 23 nt, Human
ugccuuguuaccacaaccugguu

SEQ ID NO: 902095 - RNA, 19 nt, Human
uggaaaaacgcauccggcg

SEQ ID NO: 902096 - RNA, 24 nt, Human
uggaaaaacgcauccggcgagaag

SEQ ID NO: 902097 - RNA, 22 nt, Human
ugucaauuuucccaacacagga

SEQ ID NO: 902098 - RNA, 19 nt, Human
ugugcaaaaauaggggauu

SEQ ID NO: 902099 - RNA, 25 nt, Human
uguugagcaccauaauaaguaggug

SEQ ID NO: 902100 - RNA, 22 nt, Human
uguuguguguaucugcugcccc

SEQ ID NO: 902101 - RNA, 22 nt, Human
uuaauugccagcaauucuucaa

SEQ ID NO: 902102 - RNA, 22 nt, Human
uucaaacuuaacuuuaggagca

SEQ ID NO: 902103 - RNA, 25 nt, Human
uucacuuuucacuacaaagaaauca

SEQ ID NO: 902104 - RNA, 22 nt, Human
uuuaauuuuuaacagagguaaa

SEQ ID NO: 902105 - RNA, 18 nt, Human
uuuuaagauuugaucuga

SEQ ID NO: 902106 - RNA, 23 nt, Human
aaaaagcauauuccccagcagug

SEQ ID NO: 902107 - RNA, 24 nt, Human
aaaaagcauauuccccagcagugu

SEQ ID NO: 902108 - RNA, 22 nt, Human
aaaagauaaguagaaaccaagg

SEQ ID NO: 902109 - RNA, 18 nt, Human
aaagcauauuccccagca

SEQ ID NO: 902110 - RNA, 19 nt, Human
aaagcauauuccccagcag

SEQ ID NO: 902111 - RNA, 19 nt, Human
aagcaugacagcauaaaaa

SEQ ID NO: 902112 - RNA, 19 nt, Human
aagccugcacggcccuccg

SEQ ID NO: 902113 - RNA, 23 nt, Human
aagcuaaaguuacauuuagguau

SEQ ID NO: 902114 - RNA, 19 nt, Human
aaggucucccuaagucacc

SEQ ID NO: 902115 - RNA, 21 nt, Human
aauaguauuccaaauaaguac

SEQ ID NO: 902116 - RNA, 26 nt, Human
acccugcgcuccucgcaagcuccagc

SEQ ID NO: 902117 - RNA, 23 nt, Human
accugggccagauccgaggaccc

SEQ ID NO: 902118 - RNA, 20 nt, Human
acuauauaguuccauaaagc

SEQ ID NO: 902119 - RNA, 24 nt, Human
agagccuuucaccagagacugcuc

SEQ ID NO: 902120 - RNA, 25 nt, Human
agcaguaucucagucugggguuugg

SEQ ID NO: 902121 - RNA, 19 nt, Human
agcguccgggccgcuccuc

SEQ ID NO: 902122 - RNA, 22 nt, Human
agcuaaaguuacauuuagguau

SEQ ID NO: 902123 - RNA, 24 nt, Human
aggaccccggcuggcgcgcuccac

SEQ ID NO: 902124 - RNA, 22 nt, Human
aggcgcgacccagggcggcccg

SEQ ID NO: 902125 - RNA, 22 nt, Human
agggaccgccggggaagccugc

SEQ ID NO: 902126 - RNA, 22 nt, Human
aggggcaaaacuacuguacagu

SEQ ID NO: 902127 - RNA, 20 nt, Human
auaugucaaagguuacaucu

SEQ ID NO: 902128 - RNA, 25 nt, Human
aucauagaacucguccucgcuaagg

SEQ ID NO: 902129 - RNA, 25 nt, Human
cacccugcgcuccucgcaagcucca

SEQ ID NO: 902130 - RNA, 21 nt, Human
cagaggucugcgcugccccuc

SEQ ID NO: 902131 - RNA, 24 nt, Human
cagcaauuaaaaucacggacuggc

SEQ ID NO: 902132 - RNA, 18 nt, Human
cagcgaggucgggcagag

SEQ ID NO: 902133 - RNA, 22 nt, Human
cagcgccagccuuccccagcga

SEQ ID NO: 902134 - RNA, 19 nt, Human
cagcguccgggccgcuccu

SEQ ID NO: 902135 - RNA, 24 nt, Human
caguaggucuccacacauauuuua

SEQ ID NO: 902136 - RNA, 24 nt, Human
caucuaaaacauucaagcaugaca

SEQ ID NO: 902137 - RNA, 24 nt, Human
cauuuuuuuucuucuugggggggc

SEQ ID NO: 902138 - RNA, 26 nt, Human
cauuuuuuuuuuaaaagauaaguaga

SEQ ID NO: 902139 - RNA, 22 nt, Human
ccaagggaaaaaaauuuaaaaa

SEQ ID NO: 902140 - RNA, 19 nt, Human
ccccaauuaaaggggcaaa

SEQ ID NO: 902141 - RNA, 24 nt, Human
ccccugggagcaguaucucagucu

SEQ ID NO: 902142 - RNA, 22 nt, Human
ccgccgccgcuggcucggccgc

SEQ ID NO: 902143 - RNA, 25 nt, Human
ccuaagucaccuuugcgcagccugc

SEQ ID NO: 902144 - RNA, 21 nt, Human
ccuccgccgccgcuggcucgg

SEQ ID NO: 902145 - RNA, 20 nt, Human
ccucuauaucugagaauaaa

SEQ ID NO: 902146 - RNA, 19 nt, Human
cgaggagaggucggggacu

SEQ ID NO: 902147 - RNA, 19 nt, Human
cgcagguagggaccgccgg

SEQ ID NO: 902148 - RNA, 22 nt, Human
cgccgcgcccgcccgggccgca

SEQ ID NO: 902149 - RNA, 22 nt, Human
cgcuccacccugcgcuccucgc

SEQ ID NO: 902150 - RNA, 20 nt, Human
cgcugccccuccgccgccgc

SEQ ID NO: 902151 - RNA, 25 nt, Human
cggccugcuccuccuccuccccucc

SEQ ID NO: 902152 - RNA, 22 nt, Human
cucggccgcagacccgcccucc

SEQ ID NO: 902153 - RNA, 19 nt, Human
cugcugugcgcucggcccu

SEQ ID NO: 902154 - RNA, 18 nt, Human
cuucuuggaagauggaag

SEQ ID NO: 902155 - RNA, 18 nt, Human
gaagauggaagggguaac

SEQ ID NO: 902156 - RNA, 22 nt, Human
gaagauggaagggguaacauug

SEQ ID NO: 902157 - RNA, 19 nt, Human
gacccagggcggcccgcaa

SEQ ID NO: 902158 - RNA, 24 nt, Human
gacugcagaaaacuguaaaaguaa

SEQ ID NO: 902159 - RNA, 19 nt, Human
gagcugcugugcgcucggc

SEQ ID NO: 902160 - RNA, 18 nt, Human
gaggcgguggccacgacc

SEQ ID NO: 902161 - RNA, 24 nt, Human
gauaaguagaaaccaagggaaaaa

SEQ ID NO: 902162 - RNA, 21 nt, Human
gauacugacugcagaaaacug

SEQ ID NO: 902163 - RNA, 18 nt, Human
gcaaaacuacuguacagu

SEQ ID NO: 902164 - RNA, 24 nt, Human
gcacaaggccuccuuuuauauagu

SEQ ID NO: 902165 - RNA, 20 nt, Human
gccccaauuaaaggggcaaa

SEQ ID NO: 902166 - RNA, 18 nt, Human
gcccgccagcggcccagg

SEQ ID NO: 902167 - RNA, 23 nt, Human
gccugcuccuccuccuccccucc

SEQ ID NO: 902168 - RNA, 19 nt, Human
gcgccgcgcccgcccgggc

SEQ ID NO: 902169 - RNA, 22 nt, Human
ggaagggguaacauugggagga

SEQ ID NO: 902170 - RNA, 25 nt, Human
ggagcgugcugucacugcuuccaau

SEQ ID NO: 902171 - RNA, 19 nt, Human
ggaggcgcgacccagggcg

SEQ ID NO: 902172 - RNA, 22 nt, Human
ggccgggcagcagcgccagccu

SEQ ID NO: 902173 - RNA, 18 nt, Human
gggaaaaaaauuuaaaaa

SEQ ID NO: 902174 - RNA, 23 nt, Human
gggcagaggcguugcccgccagc

SEQ ID NO: 902175 - RNA, 19 nt, Human
gggcagcagcgccagccuu

SEQ ID NO: 902176 - RNA, 23 nt, Human
gggcggcggcaaggccugcggcg

SEQ ID NO: 902177 - RNA, 18 nt, Human
gggguaacauugggagga

SEQ ID NO: 902178 - RNA, 27 nt, Human
guccgggccgcuccuccccuuccccag

SEQ ID NO: 902179 - RNA, 19 nt, Human
gugccccaauuaaaggggc

SEQ ID NO: 902180 - RNA, 19 nt, Human
guuuggguggauaaauacu

SEQ ID NO: 902181 - RNA, 20 nt, Human
uaaaaagcauauuccccagc

SEQ ID NO: 902182 - RNA, 21 nt, Human
uaaaaagcauauuccccagca

SEQ ID NO: 902183 - RNA, 18 nt, Human
uaaaaauauucaaaauag

SEQ ID NO: 902184 - RNA, 25 nt, Human
uaaugauacugacugcagaaaacug

SEQ ID NO: 902185 - RNA, 19 nt, Human
uaccuaggccccugggagc

SEQ ID NO: 902186 - RNA, 21 nt, Human
uacuauauaguuccauaaagc

SEQ ID NO: 902187 - RNA, 23 nt, Human
uacuuugcaaacuugaaaugcac

SEQ ID NO: 902188 - RNA, 22 nt, Human
uagauuuuauacauauuuucag

SEQ ID NO: 902189 - RNA, 26 nt, Human
uagccaaacacccugacuuguaugca

SEQ ID NO: 902190 - RNA, 21 nt, Human
uaucucagucugggguuuggg

SEQ ID NO: 902191 - RNA, 20 nt, Human
ucaaauguaaacuuaaccau

SEQ ID NO: 902192 - RNA, 24 nt, Human
ucacccgggcucccagagcucccg

SEQ ID NO: 902193 - RNA, 22 nt, Human
ucagagcacuaaguaaaugaaa

SEQ ID NO: 902194 - RNA, 19 nt, Human
uccagucgagccgaggcga

SEQ ID NO: 902195 - RNA, 24 nt, Human
uccccagcgaggucgggcagaggc

SEQ ID NO: 902196 - RNA, 21 nt, Human
uccccagcgccgcuggcgggc

SEQ ID NO: 902197 - RNA, 22 nt, Human
uccccgaggacgcucgagcccg

SEQ ID NO: 902198 - RNA, 24 nt, Human
uccgggccgcuccuccccuucccc

SEQ ID NO: 902199 - RNA, 21 nt, Human
uccggggcucgcggggagagc

SEQ ID NO: 902200 - RNA, 24 nt, Human
ugaaauacuuuuccaguuuaauuc

SEQ ID NO: 902201 - RNA, 18 nt, Human
ugaaaugcacaaggccuc

SEQ ID NO: 902202 - RNA, 23 nt, Human
ugacaagauuuuguuuuuuucuu

SEQ ID NO: 902203 - RNA, 25 nt, Human
ugacugcagaaaacuguaaaaguaa

SEQ ID NO: 902204 - RNA, 25 nt, Human
ugcagaaaacuguaaaaguaaauuc

SEQ ID NO: 902205 - RNA, 24 nt, Human
ugcgcugccccuccgccgccgcug

SEQ ID NO: 902206 - RNA, 21 nt, Human
uggaagauggaagggguaaca

SEQ ID NO: 902207 - RNA, 20 nt, Human
uggagagccuuucaccagag

SEQ ID NO: 902208 - RNA, 22 nt, Human
uggagagccuuucaccagagac

SEQ ID NO: 902209 - RNA, 22 nt, Human
uggcgggcggaggcgcagguag

SEQ ID NO: 902210 - RNA, 18 nt, Human
uggcuccggccgggcagc

SEQ ID NO: 902211 - RNA, 24 nt, Human
ugggugaaaugcaguuaucucaug

SEQ ID NO: 902212 - RNA, 22 nt, Human
uguaaaaguaaauucagagcac

SEQ ID NO: 902213 - RNA, 22 nt, Human
uuacaugagugcaacuuacuuu

SEQ ID NO: 902214 - RNA, 22 nt, Human
uuaugcauuuuuccuaagacuu

SEQ ID NO: 902215 - RNA, 23 nt, Human
uuccaauuuaaaauuccucaccu

SEQ ID NO: 902216 - RNA, 18 nt, Human
uuccccagcaguguucuc

SEQ ID NO: 902217 - RNA, 25 nt, Human
uuuaaaauuccucaccugggccaga

SEQ ID NO: 902218 - RNA, 18 nt, Human
uuucuucuuggaagaugg

SEQ ID NO: 902219 - RNA, 20 nt, Human
uuugcaaacuugaaaugcac

SEQ ID NO: 902220 - RNA, 18 nt, Human
uuuggguggauaaauacu

SEQ ID NO: 902221 - RNA, 20 nt, Human
uuuuguugggugaaaugcag

SEQ ID NO: 902222 - RNA, 23 nt, Human
uuuuuucuugcucuuguuccaau

SEQ ID NO: 902223 - RNA, 23 nt, Human
uuuuuuuucuucuuggaagaugg

SEQ ID NO: 902224 - RNA, 20 nt, Human
uuuuuuuuuuuuggggaaca

SEQ ID NO: 902225 - RNA, 23 nt, Human
aaaaaaaaaaaaaaaggaaagaa

SEQ ID NO: 902226 - RNA, 23 nt, Human
aaaaacagaaacacaagagugcu

SEQ ID NO: 902227 - RNA, 18 nt, Human
aaaaauacaaaaucagcc

SEQ ID NO: 902228 - RNA, 24 nt, Human
aaaaggcuuucagaaccuuuugcc

SEQ ID NO: 902229 - RNA, 22 nt, Human
aaaaguugguuucugcugugac

SEQ ID NO: 902230 - RNA, 20 nt, Human
aaacagaaacacaagagugc

SEQ ID NO: 902231 - RNA, 21 nt, Human
aaauaccaggagccugguccu

SEQ ID NO: 902232 - RNA, 24 nt, Human
aacaaaaaguaguaaaaaguuaaa

SEQ ID NO: 902233 - RNA, 18 nt, Human
aaccagccccugaaauac

SEQ ID NO: 902234 - RNA, 22 nt, Human
aagaaaaaaaaaucagucacuu

SEQ ID NO: 902235 - RNA, 22 nt, Human
aagcagaugacccuccaccaga

SEQ ID NO: 902236 - RNA, 23 nt, Human
aagcagaugacccuccaccagag

SEQ ID NO: 902237 - RNA, 23 nt, Human
aagcagucuugggauuuccuguc

SEQ ID NO: 902238 - RNA, 19 nt, Human
aaggaaagaaaagaaaaaa

SEQ ID NO: 902239 - RNA, 18 nt, Human
aaggagccgguucacaac

SEQ ID NO: 902240 - RNA, 23 nt, Human
aagugcuuccgucacagguguga

SEQ ID NO: 902241 - RNA, 19 nt, Human
aaucaucguaucugaucca

SEQ ID NO: 902242 - RNA, 24 nt, Human
aaucgcuugaacccgggaggcgga

SEQ ID NO: 902243 - RNA, 23 nt, Human
aaugaucaguaagaacucguuaa

SEQ ID NO: 902244 - RNA, 20 nt, Human
aaugcagucacuuucaaugu

SEQ ID NO: 902245 - RNA, 20 nt, Human
acaagagugaaacuccgucu

SEQ ID NO: 902246 - RNA, 21 nt, Human
acaagagugaaacuccgucuc

SEQ ID NO: 902247 - RNA, 23 nt, Human
acuaaaaauacaaaaucagccag

SEQ ID NO: 902248 - RNA, 25 nt, Human
acuccagccugggcaacaagaguga

SEQ ID NO: 902249 - RNA, 26 nt, Human
agaaaggaacccccuggagacacgga

SEQ ID NO: 902250 - RNA, 19 nt, Human
agaagaaaggaacccccug

SEQ ID NO: 902251 - RNA, 24 nt, Human
agcacuuugggagguugaggcagg

SEQ ID NO: 902252 - RNA, 23 nt, Human
agccaggugugguggcgcgugcc

SEQ ID NO: 902253 - RNA, 22 nt, Human
agccuccggucccgggccccag

SEQ ID NO: 902254 - RNA, 26 nt, Human
aggcagacuacuugaggucgggaguu

SEQ ID NO: 902255 - RNA, 24 nt, Human
aggcaggagaaucgcuugaacccg

SEQ ID NO: 902256 - RNA, 22 nt, Human
aggcaggcagacuacuugaggg

SEQ ID NO: 902257 - RNA, 22 nt, Human
aggcaggcagacuacuugaggu

SEQ ID NO: 902258 - RNA, 26 nt, Human
aggcaggcagacuacuugaggucggg

SEQ ID NO: 902259 - RNA, 24 nt, Human
aggcgcaguggcucacgccuguaa

SEQ ID NO: 902260 - RNA, 21 nt, Human
aggcggagguugcggugagcc

SEQ ID NO: 902261 - RNA, 24 nt, Human
aggcggagguugcggugagccgag

SEQ ID NO: 902262 - RNA, 20 nt, Human
aggcugaggcaggagaaucg

SEQ ID NO: 902263 - RNA, 24 nt, Human
aggcugaggcaggagaaucgcuug

SEQ ID NO: 902264 - RNA, 24 nt, Human
aggugugguggcgcgugccuguaa

SEQ ID NO: 902265 - RNA, 21 nt, Human
agguugaggcaggcagacuac

SEQ ID NO: 902266 - RNA, 24 nt, Human
agguugaggcaggcagacuacuug

SEQ ID NO: 902267 - RNA, 23 nt, Human
aguagauucugccucugacccuc

SEQ ID NO: 902268 - RNA, 24 nt, Human
aguggcucacgccuguaaucccag

SEQ ID NO: 902269 - RNA, 21 nt, Human
auaaaacucucugcaggauua

SEQ ID NO: 902270 - RNA, 22 nt, Human
auaaaacucucugcaggauuag

SEQ ID NO: 902271 - RNA, 24 nt, Human
aucaugccauugcacuccagccug

SEQ ID NO: 902272 - RNA, 20 nt, Human
augcagucacuuucaaugug

SEQ ID NO: 902273 - RNA, 21 nt, Human
auucugccucugacccuccca

SEQ ID NO: 902274 - RNA, 24 nt, Human
auugcacuccagccugggcaacaa

SEQ ID NO: 902275 - RNA, 25 nt, Human
auugcacuccagccugggcaacaag

SEQ ID NO: 902276 - RNA, 22 nt, Human
caaagugcuccacugugaucuc

SEQ ID NO: 902277 - RNA, 19 nt, Human
caaccagccccugaaauac

SEQ ID NO: 902278 - RNA, 24 nt, Human
caagauccaucuuucccccacugg

SEQ ID NO: 902279 - RNA, 22 nt, Human
caaggugacaaaaguuagguca

SEQ ID NO: 902280 - RNA, 21 nt, Human
caauccugaauccucagaccc

SEQ ID NO: 902281 - RNA, 19 nt, Human
caccugggcuccacauucc

SEQ ID NO: 902282 - RNA, 21 nt, Human
caccugucacucagaagugcc

SEQ ID NO: 902283 - RNA, 24 nt, Human
cacgccuguaaucccagcacuuug

SEQ ID NO: 902284 - RNA, 24 nt, Human
cacggccaggcgcaguggcucacg

SEQ ID NO: 902285 - RNA, 23 nt, Human
cacuccagccugggcaacaagag

SEQ ID NO: 902286 - RNA, 23 nt, Human
cacuccagccugggcaacaagag

SEQ ID NO: 902287 - RNA, 24 nt, Human
cacuccagccugggcaacaagagu

SEQ ID NO: 902288 - RNA, 25 nt, Human
cacuccagccugggcaacaagagug

SEQ ID NO: 902289 - RNA, 19 nt, Human
cacugcauuauaaagagaa

SEQ ID NO: 902290 - RNA, 20 nt, Human
cacugcauuauaaagagaac

SEQ ID NO: 902291 - RNA, 19 nt, Human
cagaaacaguaacaaaaag

SEQ ID NO: 902292 - RNA, 24 nt, Human
cagacuacuugaggucgggaguuu

SEQ ID NO: 902293 - RNA, 24 nt, Human
cagcacuuugggagguugaggcag

SEQ ID NO: 902294 - RNA, 25 nt, Human
cagcacuuugggagguugaggcagg

SEQ ID NO: 902295 - RNA, 21 nt, Human
cagccuccggucccgggcccc

SEQ ID NO: 902296 - RNA, 24 nt, Human
cagcuacuugggaggcugaggcag

SEQ ID NO: 902297 - RNA, 22 nt, Human
caggagccugguccuagaagag

SEQ ID NO: 902298 - RNA, 20 nt, Human
caguuaauuagaauuacauc

SEQ ID NO: 902299 - RNA, 25 nt, Human
caugaaccccuucccauuacuuccu

SEQ ID NO: 902300 - RNA, 19 nt, Human
cauugcacuccagccuggg

SEQ ID NO: 902301 - RNA, 21 nt, Human
cauugcacuccagccugggca

SEQ ID NO: 902302 - RNA, 22 nt, Human
cauugcacuccagccugggcaa

SEQ ID NO: 902303 - RNA, 23 nt, Human
cauugcacuccagccugggcaac

SEQ ID NO: 902304 - RNA, 24 nt, Human
cauugcacuccagccugggcaaca

SEQ ID NO: 902305 - RNA, 20 nt, Human
ccacauaaaagggcgccgug

SEQ ID NO: 902306 - RNA, 25 nt, Human
ccaucagccuuccuaccguucuucc

SEQ ID NO: 902307 - RNA, 20 nt, Human
ccauugcacuccagccuggg

SEQ ID NO: 902308 - RNA, 21 nt, Human
ccauugcacuccagccugggc

SEQ ID NO: 902309 - RNA, 23 nt, Human
ccauugcacuccagccugggcaa

SEQ ID NO: 902310 - RNA, 24 nt, Human
ccauugcacuccagccugggcaac

SEQ ID NO: 902311 - RNA, 20 nt, Human
ccccaggccccuccaggccc

SEQ ID NO: 902312 - RNA, 20 nt, Human
cccccgccccguaggcccgc

SEQ ID NO: 902313 - RNA, 26 nt, Human
ccccugaaauaccaggagccuggucc

SEQ ID NO: 902314 - RNA, 20 nt, Human
ccccuggagacacggacgcg

SEQ ID NO: 902315 - RNA, 18 nt, Human
cccgcccccgccccguag

SEQ ID NO: 902316 - RNA, 23 nt, Human
cccgggccccaggccccuccagg

SEQ ID NO: 902317 - RNA, 22 nt, Human
cccucccacaggacacaaccgg

SEQ ID NO: 902318 - RNA, 22 nt, Human
cccuggagacacggacgcggug

SEQ ID NO: 902319 - RNA, 21 nt, Human
ccgccccguaggcccgcgacc

SEQ ID NO: 902320 - RNA, 21 nt, Human
ccucccacaggacacaaccgg

SEQ ID NO: 902321 - RNA, 22 nt, Human
ccuccggucccgggccccaggc

SEQ ID NO: 902322 - RNA, 19 nt, Human
ccucgucagccuccggucc

SEQ ID NO: 902323 - RNA, 20 nt, Human
ccucuggauguucucagcuu

SEQ ID NO: 902324 - RNA, 23 nt, Human
ccugaccaacauggugaaaaccc

SEQ ID NO: 902325 - RNA, 24 nt, Human
ccugaccaacauggugaaaacccg

SEQ ID NO: 902326 - RNA, 19 nt, Human
ccuguaaucccagcuacuu

SEQ ID NO: 902327 - RNA, 21 nt, Human
ccuguaaucccagcuacuugg

SEQ ID NO: 902328 - RNA, 24 nt, Human
cgagaucaugccauugcacuccag

SEQ ID NO: 902329 - RNA, 23 nt, Human
cgcagccgggacgccucugaggc

SEQ ID NO: 902330 - RNA, 19 nt, Human
cgcccccgccccguaggcc

SEQ ID NO: 902331 - RNA, 20 nt, Human
cgccccgcccccgccccgua

SEQ ID NO: 902332 - RNA, 23 nt, Human
cgccuguaaucccagcacuuugg

SEQ ID NO: 902333 - RNA, 24 nt, Human
cgccuguaaucccagcacuuuggg

SEQ ID NO: 902334 - RNA, 19 nt, Human
cgcgugucagcgugugcau

SEQ ID NO: 902335 - RNA, 23 nt, Human
cggcaccaaacaccaucgcuucc

SEQ ID NO: 902336 - RNA, 24 nt, Human
cggccaggcgcaguggcucacgcc

SEQ ID NO: 902337 - RNA, 24 nt, Human
cgggaggcggagguugcggugagc

SEQ ID NO: 902338 - RNA, 22 nt, Human
cggucccgggccccaggccccu

SEQ ID NO: 902339 - RNA, 24 nt, Human
cgguucacaaccacagucuggaaa

SEQ ID NO: 902340 - RNA, 24 nt, Human
cgugccuguaaucccagcuacuug

SEQ ID NO: 902341 - RNA, 18 nt, Human
cucaaucugaugcucuga

SEQ ID NO: 902342 - RNA, 21 nt, Human
cucaaucugaugcucugaaac

SEQ ID NO: 902343 - RNA, 22 nt, Human
cucacgccuguaaucccagcac

SEQ ID NO: 902344 - RNA, 24 nt, Human
cucacgccuguaaucccagcacuu

SEQ ID NO: 902345 - RNA, 19 nt, Human
cuccgucucaaaaaaaaaa

SEQ ID NO: 902346 - RNA, 18 nt, Human
cucguuaaaccucccuaa

SEQ ID NO: 902347 - RNA, 21 nt, Human
cucucguguugacaauucuac

SEQ ID NO: 902348 - RNA, 19 nt, Human
cuucugcccacucugguuu

SEQ ID NO: 902349 - RNA, 19 nt, Human
cuugcaaccuuucuuggag

SEQ ID NO: 902350 - RNA, 21 nt, Human
cuugcaaccuuucuuggagaa

SEQ ID NO: 902351 - RNA, 24 nt, Human
gaaacucuucacuucuguuuuauc

SEQ ID NO: 902352 - RNA, 24 nt, Human
gaaucgcagccgggacgccucuga

SEQ ID NO: 902353 - RNA, 19 nt, Human
gacgcggugugcggugaca

SEQ ID NO: 902354 - RNA, 24 nt, Human
gacuacuugaggucgggaguuuga

SEQ ID NO: 902355 - RNA, 23 nt, Human
gagaaucgcuugaacccgggagg

SEQ ID NO: 902356 - RNA, 23 nt, Human
gagaccagccugaccaacauggu

SEQ ID NO: 902357 - RNA, 23 nt, Human
gagaucaugccauugcacuccag

SEQ ID NO: 902358 - RNA, 22 nt, Human
gagguugcggugagccgagauc

SEQ ID NO: 902359 - RNA, 20 nt, Human
gcaaaauacuauucaaguag

SEQ ID NO: 902360 - RNA, 23 nt, Human
gcauacugggaaaaacagaaaca

SEQ ID NO: 902361 - RNA, 21 nt, Human
gccacaauccugaauccucag

SEQ ID NO: 902362 - RNA, 22 nt, Human
gccauugcacuccagccugggc

SEQ ID NO: 902363 - RNA, 24 nt, Human
gccauugcacuccagccugggcaa

SEQ ID NO: 902364 - RNA, 21 nt, Human
gccccaggccccuccaggccc

SEQ ID NO: 902365 - RNA, 23 nt, Human
gccucacugacaacagggcagcg

SEQ ID NO: 902366 - RNA, 20 nt, Human
gccuguaaucccagcuacuu

SEQ ID NO: 902367 - RNA, 20 nt, Human
gcgcaguggcucacgccugu

SEQ ID NO: 902368 - RNA, 19 nt, Human
gcgugcgugcacacaaccg

SEQ ID NO: 902369 - RNA, 18 nt, Human
gcgugucagcgugugcau

SEQ ID NO: 902370 - RNA, 28 nt, Human
gcgugugcaugagugugugcgugcgugc

SEQ ID NO: 902371 - RNA, 21 nt, Human
ggagaaggagccgguuccguc

SEQ ID NO: 902372 - RNA, 18 nt, Human
ggagguugcggugagccg

SEQ ID NO: 902373 - RNA, 20 nt, Human
ggagguugcggugagccgag

SEQ ID NO: 902374 - RNA, 22 nt, Human
ggagguugcggugagccgagau

SEQ ID NO: 902375 - RNA, 23 nt, Human
ggagguugcggugagccgagauc

SEQ ID NO: 902376 - RNA, 24 nt, Human
ggagguugcggugagccgagauca

SEQ ID NO: 902377 - RNA, 19 nt, Human
ggaguuugagaccagccug

SEQ ID NO: 902378 - RNA, 19 nt, Human
ggccccaggccccuccagg

SEQ ID NO: 902379 - RNA, 20 nt, Human
ggccccaggccccuccaggc

SEQ ID NO: 902380 - RNA, 18 nt, Human
gggaaaaacagaaacaca

SEQ ID NO: 902381 - RNA, 20 nt, Human
gggaaaaacagaaacacaag

SEQ ID NO: 902382 - RNA, 19 nt, Human
gggccccaggccccuccag

SEQ ID NO: 902383 - RNA, 21 nt, Human
ggucccgggccccaggccccu

SEQ ID NO: 902384 - RNA, 19 nt, Human
ggucgggaguuugagacca

SEQ ID NO: 902385 - RNA, 24 nt, Human
gguggcgcgugccuguaaucccag

SEQ ID NO: 902386 - RNA, 23 nt, Human
guggcgcgugccuguaaucccag

SEQ ID NO: 902387 - RNA, 24 nt, Human
guugcggugagccgagaucaugcc

SEQ ID NO: 902388 - RNA, 20 nt, Human
uaaaaauacaaaaucagcca

SEQ ID NO: 902389 - RNA, 22 nt, Human
uaaaaauacaaaaucagccagg

SEQ ID NO: 902390 - RNA, 23 nt, Human
uaaaaauacaaaaucagccaggu

SEQ ID NO: 902391 - RNA, 21 nt, Human
uaaaaggcuuucagaaccuuu

SEQ ID NO: 902392 - RNA, 18 nt, Human
uaaaagggcgccgugaag

SEQ ID NO: 902393 - RNA, 18 nt, Human
uacaccacuguaaguaga

SEQ ID NO: 902394 - RNA, 19 nt, Human
uaccagucacggagcgguu

SEQ ID NO: 902395 - RNA, 19 nt, Human
uacugggaaaaacagaaac

SEQ ID NO: 902396 - RNA, 23 nt, Human
uaggccccgaggaugacacagga

SEQ ID NO: 902397 - RNA, 19 nt, Human
uauccaaggugacaaaagu

SEQ ID NO: 902398 - RNA, 21 nt, Human
uauccaaggugacaaaaguua

SEQ ID NO: 902399 - RNA, 19 nt, Human
ucacaguggccacucgagg

SEQ ID NO: 902400 - RNA, 21 nt, Human
ucagccaggugugguggcgcg

SEQ ID NO: 902401 - RNA, 23 nt, Human
ucaugccauugcacuccagccug

SEQ ID NO: 902402 - RNA, 19 nt, Human
uccaucuuucccccacugg

SEQ ID NO: 902403 - RNA, 20 nt, Human
ucccacaggacacaaccgga

SEQ ID NO: 902404 - RNA, 23 nt, Human
uccgucucaaaaaaaaaaaaaaa

SEQ ID NO: 902405 - RNA, 24 nt, Human
uccgucucaaaaaaaaaaaaaaaa

SEQ ID NO: 902406 - RNA, 18 nt, Human
uccugaauccucagaccc

SEQ ID NO: 902407 - RNA, 25 nt, Human
uccuuuagcuacacaugcuaugacu

SEQ ID NO: 902408 - RNA, 24 nt, Human
ucgcuugaacccgggaggcggagg

SEQ ID NO: 902409 - RNA, 18 nt, Human
ucucaaaaaaaaaaaaaa

SEQ ID NO: 902410 - RNA, 19 nt, Human
ucugaaacucuucacuucu

SEQ ID NO: 902411 - RNA, 24 nt, Human
ucugccacauaaaagggcgccgug

SEQ ID NO: 902412 - RNA, 25 nt, Human
ugaaacucuucacuucuguuuuauc

SEQ ID NO: 902413 - RNA, 19 nt, Human
ugacugagagugugcugga

SEQ ID NO: 902414 - RNA, 22 nt, Human
ugacugagagugugcuggaagc

SEQ ID NO: 902415 - RNA, 23 nt, Human
ugagaccagccugaccaacaugg

SEQ ID NO: 902416 - RNA, 24 nt, Human
ugagaccagccugaccaacauggu

SEQ ID NO: 902417 - RNA, 21 nt, Human
ugagauggacacauaccuauu

SEQ ID NO: 902418 - RNA, 22 nt, Human
ugagccgagaucaugccauugc

SEQ ID NO: 902419 - RNA, 20 nt, Human
ugaggcaggagaaucgcuug

SEQ ID NO: 902420 - RNA, 24 nt, Human
ugaggcaggagaaucgcuugaacc

SEQ ID NO: 902421 - RNA, 25 nt, Human
ugaggcaggagaaucgcuugaaccc

SEQ ID NO: 902422 - RNA, 22 nt, Human
ugaggcggaagcagucuuggga

SEQ ID NO: 902423 - RNA, 18 nt, Human
ugaggucgggaguuugag

SEQ ID NO: 902424 - RNA, 19 nt, Human
ugcacuccagccugggcaa

SEQ ID NO: 902425 - RNA, 24 nt, Human
ugccauugcacuccagccugggca

SEQ ID NO: 902426 - RNA, 23 nt, Human
ugccuguaaucccagcuacuugg

SEQ ID NO: 902427 - RNA, 24 nt, Human
ugccuguaaucccagcuacuuggg

SEQ ID NO: 902428 - RNA, 23 nt, Human
ugcgugcgugcacacaaccgacg

SEQ ID NO: 902429 - RNA, 22 nt, Human
ugcuggaagcuaaacaagcccc

SEQ ID NO: 902430 - RNA, 26 nt, Human
uggaaaaauccaauagacacugaaga

SEQ ID NO: 902431 - RNA, 21 nt, Human
uggcgcgugccuguaauccca

SEQ ID NO: 902432 - RNA, 24 nt, Human
uggcgcgugccuguaaucccagcu

SEQ ID NO: 902433 - RNA, 22 nt, Human
uggcucacgccuguaaucccag

SEQ ID NO: 902434 - RNA, 24 nt, Human
uggcucacgccuguaaucccagca

SEQ ID NO: 902435 - RNA, 22 nt, Human
ugggaaaaacagaaacacaaga

SEQ ID NO: 902436 - RNA, 19 nt, Human
ugggaggcugaggcaggag

SEQ ID NO: 902437 - RNA, 23 nt, Human
ugggaggcugaggcaggagaauc

SEQ ID NO: 902438 - RNA, 19 nt, Human
ugggagguugaggcaggca

SEQ ID NO: 902439 - RNA, 19 nt, Human
ugggagguugaggcaggca

SEQ ID NO: 902440 - RNA, 20 nt, Human
ugggagguugaggcaggcag

SEQ ID NO: 902441 - RNA, 19 nt, Human
uggguacacgcgacgugug

SEQ ID NO: 902442 - RNA, 24 nt, Human
ugguggcgcgugccuguaauccca

SEQ ID NO: 902443 - RNA, 19 nt, Human
ugugagaagaaaggaaccc

SEQ ID NO: 902444 - RNA, 20 nt, Human
ugugugcgugcgugcacaca

SEQ ID NO: 902445 - RNA, 21 nt, Human
ugugugcgugcgugcacacaa

SEQ ID NO: 902446 - RNA, 25 nt, Human
ugugugcgugcgugcacagugacac

SEQ ID NO: 902447 - RNA, 24 nt, Human
ugugugcgugcgugcacagugacc

SEQ ID NO: 902448 - RNA, 18 nt, Human
uuaaaauaaccucgacac

SEQ ID NO: 902449 - RNA, 19 nt, Human
uuaaaccucccuaaaugca

SEQ ID NO: 902450 - RNA, 22 nt, Human
uuagcauuugcagaaacaguaa

SEQ ID NO: 902451 - RNA, 24 nt, Human
uugaacccgggaggcggagguugc

SEQ ID NO: 902452 - RNA, 18 nt, Human
uugcggugagccgagauc

SEQ ID NO: 902453 - RNA, 19 nt, Human
uugcggugagccgagauca

SEQ ID NO: 902454 - RNA, 20 nt, Human
uugcggugagccgagaucau

SEQ ID NO: 902455 - RNA, 21 nt, Human
uugcggugagccgagaucaug

SEQ ID NO: 902456 - RNA, 24 nt, Human
uugggaggcugaggcaggagaauc

SEQ ID NO: 902457 - RNA, 26 nt, Human
aaaacaaucaguuauuuugcuaaacu

SEQ ID NO: 902458 - RNA, 20 nt, Human
aaaaucaugcauucuuuucc

SEQ ID NO: 902459 - RNA, 21 nt, Human
aaaaugccaucagaugacaag

SEQ ID NO: 902460 - RNA, 18 nt, Human
aaacauguaacucaaaug

SEQ ID NO: 902461 - RNA, 22 nt, Human
aaagauuuuccaaaugccacau

SEQ ID NO: 902462 - RNA, 19 nt, Human
aaaggucugcggagauucu

SEQ ID NO: 902463 - RNA, 21 nt, Human
aacacaauucaacuacuacac

SEQ ID NO: 902464 - RNA, 26 nt, Human
aacacagaaaaaugaagacuaacacu

SEQ ID NO: 902465 - RNA, 20 nt, Human
aaccccggcuucuccgguac

SEQ ID NO: 902466 - RNA, 19 nt, Human
aagacagugcuugaagccc

SEQ ID NO: 902467 - RNA, 24 nt, Human
aaggcaagcacaggagaaauacac

SEQ ID NO: 902468 - RNA, 25 nt, Human
aaucuuauauccucucccuaaccac

SEQ ID NO: 902469 - RNA, 21 nt, Human
aauuuaauuggaaucuucccu

SEQ ID NO: 902470 - RNA, 19 nt, Human
acacaacacaaagcaagaa

SEQ ID NO: 902471 - RNA, 22 nt, Human
acaggaacauuaccugaagugc

SEQ ID NO: 902472 - RNA, 21 nt, Human
accugcacaaagucccauuuc

SEQ ID NO: 902473 - RNA, 21 nt, Human
acuggcucuccugcuacaccg

SEQ ID NO: 902474 - RNA, 21 nt, Human
acuucuugcccucaggugaac

SEQ ID NO: 902475 - RNA, 19 nt, Human
acuuuagaauaagaggcuu

SEQ ID NO: 902476 - RNA, 24 nt, Human
agaacacaacacaaagcaagaaca

SEQ ID NO: 902477 - RNA, 18 nt, Human
agacugcugcaaaacuca

SEQ ID NO: 902478 - RNA, 20 nt, Human
agccuuggggugcuuugggg

SEQ ID NO: 902479 - RNA, 19 nt, Human
agcuucuuuuuuuaaccca

SEQ ID NO: 902480 - RNA, 18 nt, Human
aggaccagaauccaccug

SEQ ID NO: 902481 - RNA, 20 nt, Human
agguauggauggaagggugg

SEQ ID NO: 902482 - RNA, 23 nt, Human
agguugauuuuuuuucuacaaca

SEQ ID NO: 902483 - RNA, 22 nt, Human
auaacacaauucaacuacuaca

SEQ ID NO: 902484 - RNA, 19 nt, Human
auacaagaucuaaaauaug

SEQ ID NO: 902485 - RNA, 19 nt, Human
auacauuccauuaaucuua

SEQ ID NO: 902486 - RNA, 23 nt, Human
caaagcaagaacaucaauucucu

SEQ ID NO: 902487 - RNA, 27 nt, Human
caaauauccauuaaaaaaguacccucc

SEQ ID NO: 902488 - RNA, 18 nt, Human
caaaugauuuacuacaag

SEQ ID NO: 902489 - RNA, 25 nt, Human
caacacagaaaaaugaagacuaaca

SEQ ID NO: 902490 - RNA, 18 nt, Human
caagucacuuggccucga

SEQ ID NO: 902491 - RNA, 23 nt, Human
cacaacacaaagcaagaacauca

SEQ ID NO: 902492 - RNA, 18 nt, Human
cacacuguggaaacuaca

SEQ ID NO: 902493 - RNA, 22 nt, Human
cacagaaccgggagaaggcaac

SEQ ID NO: 902494 - RNA, 18 nt, Human
cacaggagaaauacacua

SEQ ID NO: 902495 - RNA, 18 nt, Human
caccagcagaauuguucu

SEQ ID NO: 902496 - RNA, 18 nt, Human
cacugcauuccccaaagu

SEQ ID NO: 902497 - RNA, 22 nt, Human
cacuucagaaggcaagcacagg

SEQ ID NO: 902498 - RNA, 18 nt, Human
cagaacacaacacaaagc

SEQ ID NO: 902499 - RNA, 25 nt, Human
cagaacacaacacaaagcaagaaca

SEQ ID NO: 902500 - RNA, 20 nt, Human
cagaggaaaauagagcaaau

SEQ ID NO: 902501 - RNA, 18 nt, Human
cagauggcaacuuuuuau

SEQ ID NO: 902502 - RNA, 18 nt, Human
cagccaauauuaccacga

SEQ ID NO: 902503 - RNA, 24 nt, Human
cagccaauauuaccacgauucuac

SEQ ID NO: 902504 - RNA, 23 nt, Human
caggagucgggggcggggauggc

SEQ ID NO: 902505 - RNA, 19 nt, Human
caggugaacucccaucucu

SEQ ID NO: 902506 - RNA, 20 nt, Human
caugaacauucaaucuuuca

SEQ ID NO: 902507 - RNA, 18 nt, Human
cauuuaaaaagacgaagg

SEQ ID NO: 902508 - RNA, 19 nt, Human
ccaccuggcuuguaggaga

SEQ ID NO: 902509 - RNA, 24 nt, Human
ccacuugcagacagacugcggggc

SEQ ID NO: 902510 - RNA, 21 nt, Human
ccagccuuggggugcuuuggg

SEQ ID NO: 902511 - RNA, 24 nt, Human
ccaguggcaggugguuuagcucuu

SEQ ID NO: 902512 - RNA, 23 nt, Human
cccgcaacgugcagcugacagcu

SEQ ID NO: 902513 - RNA, 19 nt, Human
cccucucccgggccggcug

SEQ ID NO: 902514 - RNA, 21 nt, Human
ccggcuucuccgguacccccg

SEQ ID NO: 902515 - RNA, 18 nt, Human
ccgguacccccgcaacgu

SEQ ID NO: 902516 - RNA, 18 nt, Human
ccugaagugcaggguggu

SEQ ID NO: 902517 - RNA, 24 nt, Human
ccugaagugcagggugguuaccug

SEQ ID NO: 902518 - RNA, 19 nt, Human
ccugcuuccucaugucugu

SEQ ID NO: 902519 - RNA, 21 nt, Human
cgcaggagucgggggcgggga

SEQ ID NO: 902520 - RNA, 22 nt, Human
cgggggcggggauggccacuug

SEQ ID NO: 902521 - RNA, 23 nt, Human
cuaaaacagcauuuaagaaaaac

SEQ ID NO: 902522 - RNA, 23 nt, Human
cuaacacugaguaacagauuagu

SEQ ID NO: 902523 - RNA, 20 nt, Human
cuauaaggcagauggcaacu

SEQ ID NO: 902524 - RNA, 24 nt, Human
cucccgggccggcuggcgggcgcc

SEQ ID NO: 902525 - RNA, 19 nt, Human
cugcggggccggagccgcg

SEQ ID NO: 902526 - RNA, 19 nt, Human
cuucagacuccagcaccag

SEQ ID NO: 902527 - RNA, 22 nt, Human
gaaaauauucuucagacuccag

SEQ ID NO: 902528 - RNA, 19 nt, Human
gaaacccuaaaaccugagc

SEQ ID NO: 902529 - RNA, 23 nt, Human
gaaagaacaaagcauacaccaaa

SEQ ID NO: 902530 - RNA, 23 nt, Human
gaaauacacuaauguuaucuuuc

SEQ ID NO: 902531 - RNA, 23 nt, Human
gaaccgggagaaggcaacccccu

SEQ ID NO: 902532 - RNA, 23 nt, Human
gaagacagugcuugaagcccaaa

SEQ ID NO: 902533 - RNA, 18 nt, Human
gaaggcaagcacaggaga

SEQ ID NO: 902534 - RNA, 27 nt, Human
gaaggcaagcacaggagaaauacacuc

SEQ ID NO: 902535 - RNA, 20 nt, Human
gaagugacuggcucuccugc

SEQ ID NO: 902536 - RNA, 20 nt, Human
gacuccagcaccagcagaau

SEQ ID NO: 902537 - RNA, 27 nt, Human
gaugacaagggagccgagaguauggaa

SEQ ID NO: 902538 - RNA, 22 nt, Human
gcacaaagucccauuuccaaaa

SEQ ID NO: 902539 - RNA, 22 nt, Human
gcagauggcaacuuuuuauaca

SEQ ID NO: 902540 - RNA, 23 nt, Human
gcccucaggugaacucccaucuc

SEQ ID NO: 902541 - RNA, 25 nt, Human
ggaaagaacaaagcauacaccaaag

SEQ ID NO: 902542 - RNA, 20 nt, Human
ggacaaaaaacggggugggg

SEQ ID NO: 902543 - RNA, 19 nt, Human
ggagggacaaaaaacgggg

SEQ ID NO: 902544 - RNA, 24 nt, Human
gggaggaacaaguucaaaugcuuc

SEQ ID NO: 902545 - RNA, 26 nt, Human
gggaggcagagguauggauggaaggg

SEQ ID NO: 902546 - RNA, 20 nt, Human
gggagggaagugacuggcuc

SEQ ID NO: 902547 - RNA, 21 nt, Human
guauggauggaagggugggau

SEQ ID NO: 902548 - RNA, 19 nt, Human
gugcagccggagacgcucc

SEQ ID NO: 902549 - RNA, 23 nt, Human
uaaaaaacauuuuggguggccca

SEQ ID NO: 902550 - RNA, 22 nt, Human
uaaaaaaguacccucuggauaa

SEQ ID NO: 902551 - RNA, 18 nt, Human
uaaaacauguaacucaaa

SEQ ID NO: 902552 - RNA, 19 nt, Human
uaaaauaaagcauaagggc

SEQ ID NO: 902553 - RNA, 21 nt, Human
uaaaaugccagucacgugcag

SEQ ID NO: 902554 - RNA, 21 nt, Human
uaaagacauucaaacaaauua

SEQ ID NO: 902555 - RNA, 25 nt, Human
uaaauaacucuccauuuugaaaaug

SEQ ID NO: 902556 - RNA, 18 nt, Human
uaagacacucacuuaaag

SEQ ID NO: 902557 - RNA, 22 nt, Human
uaaggacaccuucuuauugcuu

SEQ ID NO: 902558 - RNA, 19 nt, Human
uacaagaucuaaaauaugg

SEQ ID NO: 902559 - RNA, 20 nt, Human
uacauuuguuuuccccuuga

SEQ ID NO: 902560 - RNA, 21 nt, Human
uaccugaagugcagggugguu

SEQ ID NO: 902561 - RNA, 21 nt, Human
uagaaaauacuaaaacagcau

SEQ ID NO: 902562 - RNA, 19 nt, Human
uagaacaagaucacucaug

SEQ ID NO: 902563 - RNA, 23 nt, Human
uagaacuauagggaggaacaagu

SEQ ID NO: 902564 - RNA, 21 nt, Human
uagcaaaaauagauuuaugcc

SEQ ID NO: 902565 - RNA, 19 nt, Human
uauagaugcuaguacugac

SEQ ID NO: 902566 - RNA, 23 nt, Human
uaucaaaauaaagacauucaaac

SEQ ID NO: 902567 - RNA, 25 nt, Human
uaucaaaauaaagacauucaaacua

SEQ ID NO: 902568 - RNA, 23 nt, Human
uaucaggaugcaucaccaagcug

SEQ ID NO: 902569 - RNA, 18 nt, Human
ucaaaauaaagacauuca

SEQ ID NO: 902570 - RNA, 25 nt, Human
ucacuaaggagaaauuuccuacuuc

SEQ ID NO: 902571 - RNA, 22 nt, Human
uccaacacagaaaaaugaagac

SEQ ID NO: 902572 - RNA, 19 nt, Human
uccauacucaacagggagg

SEQ ID NO: 902573 - RNA, 18 nt, Human
ucccaaaugaugccacgu

SEQ ID NO: 902574 - RNA, 19 nt, Human
ucccacccccaucucaaau

SEQ ID NO: 902575 - RNA, 21 nt, Human
ucccuaaccacuaaaaugcaa

SEQ ID NO: 902576 - RNA, 18 nt, Human
ucuacagccugcuuccuc

SEQ ID NO: 902577 - RNA, 19 nt, Human
ucucuuaugaauaauuucu

SEQ ID NO: 902578 - RNA, 23 nt, Human
ucugcauauaguucucuaucaua

SEQ ID NO: 902579 - RNA, 20 nt, Human
ucuguauuauucaagacugc

SEQ ID NO: 902580 - RNA, 21 nt, Human
ucuguauuauucaagacugcu

SEQ ID NO: 902581 - RNA, 23 nt, Human
ugacagcucccgcaccggccgca

SEQ ID NO: 902582 - RNA, 24 nt, Human
ugacagugcuacguccauucaggc

SEQ ID NO: 902583 - RNA, 18 nt, Human
ugaggaaaauauagacuu

SEQ ID NO: 902584 - RNA, 22 nt, Human
ugcacaaagucccauuuccaaa

SEQ ID NO: 902585 - RNA, 20 nt, Human
ugccacaugacagugcuacg

SEQ ID NO: 902586 - RNA, 18 nt, Human
ugcccuuaaaucuacagc

SEQ ID NO: 902587 - RNA, 21 nt, Human
ugcuaagcuaagcacaaguga

SEQ ID NO: 902588 - RNA, 18 nt, Human
ugcuugaagcccaaacaa

SEQ ID NO: 902589 - RNA, 21 nt, Human
ugcuuuggggccuggggaggg

SEQ ID NO: 902590 - RNA, 22 nt, Human
uggaauaauuagaaaaaaaaaa

SEQ ID NO: 902591 - RNA, 22 nt, Human
uggaauaauuagaaaaaaaaaa

SEQ ID NO: 902592 - RNA, 22 nt, Human
uggcuuguaggagaggaacuac

SEQ ID NO: 902593 - RNA, 21 nt, Human
uggggugcuuuggggccuggg

SEQ ID NO: 902594 - RNA, 21 nt, Human
uggggugggaagcaggaaaca

SEQ ID NO: 902595 - RNA, 22 nt, Human
ugguuuagcucuuauccaaagu

SEQ ID NO: 902596 - RNA, 18 nt, Human
ugucaugauuugcagaua

SEQ ID NO: 902597 - RNA, 21 nt, Human
ugucugugagcagaauuugga

SEQ ID NO: 902598 - RNA, 21 nt, Human
uguguggaauaaacuguaugu

SEQ ID NO: 902599 - RNA, 25 nt, Human
uuaaaaaacauuuuggguggcccaa

SEQ ID NO: 902600 - RNA, 18 nt, Human
uuaaaagcagaauaugag

SEQ ID NO: 902601 - RNA, 22 nt, Human
uuacaaagucaaacugcugugu

SEQ ID NO: 902602 - RNA, 22 nt, Human
uuacaaugcuaagcuaagcaca

SEQ ID NO: 902603 - RNA, 20 nt, Human
uucacauuguguucaucuug

SEQ ID NO: 902604 - RNA, 23 nt, Human
uucuccgguacccccgcaacgug

SEQ ID NO: 902605 - RNA, 24 nt, Human
uucuccgguacccccgcaacgugc

SEQ ID NO: 902606 - RNA, 22 nt, Human
uucuuuuuugagccagucucug

SEQ ID NO: 902607 - RNA, 22 nt, Human
uuguaggagaggaacuacaugg

SEQ ID NO: 902608 - RNA, 19 nt, Human
aaaccaaaaugccuucccc

SEQ ID NO: 902609 - RNA, 21 nt, Human
aaaccaaaaugccuuccccag

SEQ ID NO: 902610 - RNA, 23 nt, Human
aaaugccuuccccagaguggccc

SEQ ID NO: 902611 - RNA, 20 nt, Human
aacaaagccacccgcuacag

SEQ ID NO: 902612 - RNA, 19 nt, Human
aaccugucccuggcaccca

SEQ ID NO: 902613 - RNA, 21 nt, Human
aagccacaccccugcgccccc

SEQ ID NO: 902614 - RNA, 19 nt, Human
aaugccuuccccagagugg

SEQ ID NO: 902615 - RNA, 21 nt, Human
acaaccaccuccaccugcgug

SEQ ID NO: 902616 - RNA, 27 nt, Human
acacaccugcacccacaaccaccucca

SEQ ID NO: 902617 - RNA, 21 nt, Human
acagcugacacgccaggaaca

SEQ ID NO: 902618 - RNA, 21 nt, Human
acaguggcugugcuugccggg

SEQ ID NO: 902619 - RNA, 24 nt, Human
accauccugcuccucgucugagag

SEQ ID NO: 902620 - RNA, 22 nt, Human
accccugcgccccccacacccc

SEQ ID NO: 902621 - RNA, 22 nt, Human
acccuaaauccauccauccccc

SEQ ID NO: 902622 - RNA, 25 nt, Human
agaaaagcgcacugcuuccgcuccc

SEQ ID NO: 902623 - RNA, 23 nt, Human
agacgugaaggcugacugcagcu

SEQ ID NO: 902624 - RNA, 22 nt, Human
aggaggccuggggucggugccu

SEQ ID NO: 902625 - RNA, 25 nt, Human
aggaggccuggggucggugccugug

SEQ ID NO: 902626 - RNA, 21 nt, Human
aggccuaugcaucugugugug

SEQ ID NO: 902627 - RNA, 18 nt, Human
aggccuggggucggugcc

SEQ ID NO: 902628 - RNA, 22 nt, Human
aggggcccagcacaccugggcc

SEQ ID NO: 902629 - RNA, 22 nt, Human
auccaaacagcacagcguggaa

SEQ ID NO: 902630 - RNA, 20 nt, Human
auccauccaucccccauggc

SEQ ID NO: 902631 - RNA, 21 nt, Human
aucgggggcucugcaggaggc

SEQ ID NO: 902632 - RNA, 21 nt, Human
caaagccacccgcuacagcuc

SEQ ID NO: 902633 - RNA, 19 nt, Human
caaagucaccauccugcuc

SEQ ID NO: 902634 - RNA, 22 nt, Human
caaagucaccauccugcuccuc

SEQ ID NO: 902635 - RNA, 22 nt, Human
cacacaccugcacccacaacca

SEQ ID NO: 902636 - RNA, 19 nt, Human
cacaccccugcgcccccca

SEQ ID NO: 902637 - RNA, 22 nt, Human
caccugcacccacaaccaccuc

SEQ ID NO: 902638 - RNA, 21 nt, Human
cacucggggcuccuccaaacc

SEQ ID NO: 902639 - RNA, 24 nt, Human
caggaucgggggcucugcaggagg

SEQ ID NO: 902640 - RNA, 19 nt, Human
cagguggaacagcugcggc

SEQ ID NO: 902641 - RNA, 18 nt, Human
cauggcaaguggaggccg

SEQ ID NO: 902642 - RNA, 18 nt, Human
ccacaaccaccuccaccu

SEQ ID NO: 902643 - RNA, 18 nt, Human
ccacugaggcucgccagg

SEQ ID NO: 902644 - RNA, 18 nt, Human
ccaggacuuccucucccg

SEQ ID NO: 902645 - RNA, 18 nt, Human
ccaucccccauggcaagu

SEQ ID NO: 902646 - RNA, 20 nt, Human
cccacaaccaccuccaccug

SEQ ID NO: 902647 - RNA, 19 nt, Human
cccacaccccugcacacac

SEQ ID NO: 902648 - RNA, 22 nt, Human
cccacaggcccucccacccuaa

SEQ ID NO: 902649 - RNA, 23 nt, Human
ccccacaccccugcacacaccug

SEQ ID NO: 902650 - RNA, 28 nt, Human
ccccacaccccugcacacaccugcaccc

SEQ ID NO: 902651 - RNA, 24 nt, Human
ccccacaggcccucccacccuaaa

SEQ ID NO: 902652 - RNA, 23 nt, Human
cccccacaccccugcacacaccu

SEQ ID NO: 902653 - RNA, 24 nt, Human
cccccacaccccugcacacaccug

SEQ ID NO: 902654 - RNA, 26 nt, Human
ccccccacaccccugcacacaccugc

SEQ ID NO: 902655 - RNA, 21 nt, Human
ccccugcgccccccacacccc

SEQ ID NO: 902656 - RNA, 22 nt, Human
cccgcagcgccuuguggccccg

SEQ ID NO: 902657 - RNA, 18 nt, Human
cccggccugggugcgggg

SEQ ID NO: 902658 - RNA, 20 nt, Human
cccugggcugcccaggaagg

SEQ ID NO: 902659 - RNA, 24 nt, Human
ccgcucgggguccagaaaagcgca

SEQ ID NO: 902660 - RNA, 20 nt, Human
ccgcugcucuccguggccug

SEQ ID NO: 902661 - RNA, 21 nt, Human
ccgcugcucuccguggccugg

SEQ ID NO: 902662 - RNA, 22 nt, Human
ccgcugcucuccguggccuggc

SEQ ID NO: 902663 - RNA, 21 nt, Human
ccgcugugccuccuccagugc

SEQ ID NO: 902664 - RNA, 18 nt, Human
ccuccauggagcaggcuu

SEQ ID NO: 902665 - RNA, 23 nt, Human
ccuccccgcucgggguccagaaa

SEQ ID NO: 902666 - RNA, 21 nt, Human
ccucgugcagggccugcagcc

SEQ ID NO: 902667 - RNA, 18 nt, Human
ccucugucugcggaccuc

SEQ ID NO: 902668 - RNA, 21 nt, Human
ccugcacacaccugcacccac

SEQ ID NO: 902669 - RNA, 23 nt, Human
ccugcacccacaaccaccuccac

SEQ ID NO: 902670 - RNA, 22 nt, Human
ccugggcccugggcugcccagg

SEQ ID NO: 902671 - RNA, 23 nt, Human
ccugggcccugggcugcccagga

SEQ ID NO: 902672 - RNA, 18 nt, Human
ccuuguggccccgggucc

SEQ ID NO: 902673 - RNA, 20 nt, Human
cgccaggaacacgcagagca

SEQ ID NO: 902674 - RNA, 22 nt, Human
cgccagggacaaagucaccauc

SEQ ID NO: 902675 - RNA, 25 nt, Human
cgucugcuccuccagcggcaccgug

SEQ ID NO: 902676 - RNA, 19 nt, Human
cgugcagggccugcagccg

SEQ ID NO: 902677 - RNA, 18 nt, Human
cguggauccgcugcucuc

SEQ ID NO: 902678 - RNA, 20 nt, Human
cuaagccacaccccugcgcc

SEQ ID NO: 902679 - RNA, 24 nt, Human
cuacagcucagacggcaccgccac

SEQ ID NO: 902680 - RNA, 18 nt, Human
cucagccucugucugcgg

SEQ ID NO: 902681 - RNA, 23 nt, Human
cucagggcuccuauuugaggaug

SEQ ID NO: 902682 - RNA, 21 nt, Human
cuccagcuccgucugcuccuc

SEQ ID NO: 902683 - RNA, 21 nt, Human
cuccugcugcaagguccgcag

SEQ ID NO: 902684 - RNA, 22 nt, Human
cucgccaggacuuccucucccg

SEQ ID NO: 902685 - RNA, 21 nt, Human
cucgugccugggcccugggcu

SEQ ID NO: 902686 - RNA, 21 nt, Human
cugcugcuggggugugacugu

SEQ ID NO: 902687 - RNA, 21 nt, Human
cuugccgggccucucugccuc

SEQ ID NO: 902688 - RNA, 20 nt, Human
gaacagcugcggcuuccagg

SEQ ID NO: 902689 - RNA, 20 nt, Human
gaaggcccugcagagaggcc

SEQ ID NO: 902690 - RNA, 19 nt, Human
gagcguccagguguggggg

SEQ ID NO: 902691 - RNA, 18 nt, Human
gaguggcccuaaccuguc

SEQ ID NO: 902692 - RNA, 18 nt, Human
gccacaccccugcgcccc

SEQ ID NO: 902693 - RNA, 19 nt, Human
gcccagcacaccugggccc

SEQ ID NO: 902694 - RNA, 18 nt, Human
gccccgggucccuccugc

SEQ ID NO: 902695 - RNA, 22 nt, Human
gcccugugcuggucgcccuugc

SEQ ID NO: 902696 - RNA, 24 nt, Human
gcccugugcuggucgcccuugcug

SEQ ID NO: 902697 - RNA, 20 nt, Human
gccuggcuguggccggaggg

SEQ ID NO: 902698 - RNA, 22 nt, Human
gcgcacacgcacacgcagagcg

SEQ ID NO: 902699 - RNA, 21 nt, Human
gcuccuccagcggcaccgugu

SEQ ID NO: 902700 - RNA, 20 nt, Human
gcucgggggcuucuccuacc

SEQ ID NO: 902701 - RNA, 21 nt, Human
gcugcccaggaagguggucug

SEQ ID NO: 902702 - RNA, 20 nt, Human
gcugccgcugugccuccucc

SEQ ID NO: 902703 - RNA, 19 nt, Human
ggaacacagacacaucccc

SEQ ID NO: 902704 - RNA, 20 nt, Human
ggaacacagacacaucccca

SEQ ID NO: 902705 - RNA, 21 nt, Human
ggaaggcccugcagagaggcc

SEQ ID NO: 902706 - RNA, 20 nt, Human
ggacugaggccagacgugaa

SEQ ID NO: 902707 - RNA, 22 nt, Human
ggagcucagcauggccgagagg

SEQ ID NO: 902708 - RNA, 20 nt, Human
ggcaagauggccaggagugc

SEQ ID NO: 902709 - RNA, 24 nt, Human
ggccaggagcucugcccucagggc

SEQ ID NO: 902710 - RNA, 20 nt, Human
ggcccagcacaccugggccc

SEQ ID NO: 902711 - RNA, 20 nt, Human
ggcccucccacccuaaaucc

SEQ ID NO: 902712 - RNA, 21 nt, Human
ggcccugcagagaggccagug

SEQ ID NO: 902713 - RNA, 18 nt, Human
ggcuccuauuugaggaug

SEQ ID NO: 902714 - RNA, 18 nt, Human
ggcugugcuugccgggcc

SEQ ID NO: 902715 - RNA, 21 nt, Human
gggagggagggcucaggaccg

SEQ ID NO: 902716 - RNA, 20 nt, Human
gggcuccuccaaaccugccc

SEQ ID NO: 902717 - RNA, 22 nt, Human
ggggcccagcacaccugggccc

SEQ ID NO: 902718 - RNA, 23 nt, Human
ggggcuccuccaaaccugcccac

SEQ ID NO: 902719 - RNA, 21 nt, Human
gguagugccacuccuggguga

SEQ ID NO: 902720 - RNA, 18 nt, Human
gguccagguggaacagcu

SEQ ID NO: 902721 - RNA, 26 nt, Human
ggucgcuggccuugcgaagccgcugg

SEQ ID NO: 902722 - RNA, 22 nt, Human
gguggucuggcgggccacggcc

SEQ ID NO: 902723 - RNA, 25 nt, Human
guggccccaccaggguggucccggc

SEQ ID NO: 902724 - RNA, 23 nt, Human
guguggaacacagacacaucccc

SEQ ID NO: 902725 - RNA, 20 nt, Human
guguguggggggacuccugg

SEQ ID NO: 902726 - RNA, 22 nt, Human
uaaaaaaccaaaaugccuuccc

SEQ ID NO: 902727 - RNA, 33 nt, Human
uauguguagaggcucacacacgcgcacacggug

SEQ ID NO: 902728 - RNA, 21 nt, Human
uccagggcccccacaggcccu

SEQ ID NO: 902729 - RNA, 19 nt, Human
uccagguggaacagcugcg

SEQ ID NO: 902730 - RNA, 22 nt, Human
ucccaggggcugugguccucgu

SEQ ID NO: 902731 - RNA, 19 nt, Human
ucccaguggccacugaggc

SEQ ID NO: 902732 - RNA, 22 nt, Human
uccccagaguggcccuaaccuu

SEQ ID NO: 902733 - RNA, 18 nt, Human
uccccagaugggggagga

SEQ ID NO: 902734 - RNA, 20 nt, Human
ucccccauggcaaguggagg

SEQ ID NO: 902735 - RNA, 23 nt, Human
uccccgucacaguggcugugcuu

SEQ ID NO: 902736 - RNA, 20 nt, Human
uccuccaaaccugcccacuc

SEQ ID NO: 902737 - RNA, 20 nt, Human
uccugggccacucggggcuc

SEQ ID NO: 902738 - RNA, 21 nt, Human
ucgggggcucugcaggaggcc

SEQ ID NO: 902739 - RNA, 19 nt, Human
ucucccgacgugaucuuuc

SEQ ID NO: 902740 - RNA, 19 nt, Human
ucugcaggaggccuggggu

SEQ ID NO: 902741 - RNA, 22 nt, Human
ugaaggcugacugcagcucgca

SEQ ID NO: 902742 - RNA, 23 nt, Human
ugacacggcaagauggccaggag

SEQ ID NO: 902743 - RNA, 20 nt, Human
ugagaggggcccagcacacc

SEQ ID NO: 902744 - RNA, 22 nt, Human
ugaggccagacgugaaggcuga

SEQ ID NO: 902745 - RNA, 23 nt, Human
ugaggccagacgugaaggcugac

SEQ ID NO: 902746 - RNA, 21 nt, Human
ugcacccacaaccaccuccac

SEQ ID NO: 902747 - RNA, 18 nt, Human
ugcagcucgcagcccacc

SEQ ID NO: 902748 - RNA, 22 nt, Human
ugcagggccugcagccgccgcg

SEQ ID NO: 902749 - RNA, 18 nt, Human
ugccagagccucucggac

SEQ ID NO: 902750 - RNA, 19 nt, Human
ugccguggagcucagcaug

SEQ ID NO: 902751 - RNA, 18 nt, Human
ugccucagccucugucug

SEQ ID NO: 902752 - RNA, 21 nt, Human
ugccucagccucugucugcgg

SEQ ID NO: 902753 - RNA, 19 nt, Human
ugccugggagggagggcuc

SEQ ID NO: 902754 - RNA, 21 nt, Human
ugccugugcagcuccugcugg

SEQ ID NO: 902755 - RNA, 21 nt, Human
ugccugugcugcccgugccgu

SEQ ID NO: 902756 - RNA, 24 nt, Human
ugcggcuuccagggcaugaggcuc

SEQ ID NO: 902757 - RNA, 21 nt, Human
ugcgucgcacagcagaagcug

SEQ ID NO: 902758 - RNA, 21 nt, Human
uggaacacagacacaucccca

SEQ ID NO: 902759 - RNA, 19 nt, Human
uggacagggucuccggaag

SEQ ID NO: 902760 - RNA, 18 nt, Human
uggaggccggacaggggg

SEQ ID NO: 902761 - RNA, 21 nt, Human
uggccaggagugcgucgcaca

SEQ ID NO: 902762 - RNA, 21 nt, Human
uggccuggcuguggccggagg

SEQ ID NO: 902763 - RNA, 23 nt, Human
uggccuggcuguggccggagggc

SEQ ID NO: 902764 - RNA, 21 nt, Human
uggcuguggccggagggcugg

SEQ ID NO: 902765 - RNA, 18 nt, Human
ugggagggagggcucagg

SEQ ID NO: 902766 - RNA, 19 nt, Human
ugggcccugggcugcccag

SEQ ID NO: 902767 - RNA, 20 nt, Human
ugggcugcccaggaaggugg

SEQ ID NO: 902768 - RNA, 19 nt, Human
uguacguauauauaugugu

SEQ ID NO: 902769 - RNA, 20 nt, Human
uguccagggcccccacaggc

SEQ ID NO: 902770 - RNA, 21 nt, Human
ugucccaguggccacugaggc

SEQ ID NO: 902771 - RNA, 24 nt, Human
ugugacuguccagggcccccacag

SEQ ID NO: 902772 - RNA, 21 nt, Human
ugugcugcccgugccguggag

SEQ ID NO: 902773 - RNA, 19 nt, Human
uguggccccgggucccucc

SEQ ID NO: 902774 - RNA, 18 nt, Human
uguggggggacuccuggg

SEQ ID NO: 902775 - RNA, 32 nt, Human
uguguagaggcucacacacgcgcacacgcagu

SEQ ID NO: 902776 - RNA, 25 nt, Human
uuauuaaaaaaguguaaaaugggaa

SEQ ID NO: 902777 - RNA, 21 nt, Human
uuccagggcaugaggcucucc

SEQ ID NO: 902778 - RNA, 18 nt, Human
uuucaagguguggaacac

SEQ ID NO: 902779 - RNA, 19 nt, Human
aaaaugauuuauuguacau

SEQ ID NO: 902780 - RNA, 19 nt, Human
aaacagaaaggaucccaaa

SEQ ID NO: 902781 - RNA, 23 nt, Human
aaacagacacacuugaagucugc

SEQ ID NO: 902782 - RNA, 18 nt, Human
aaggaucccaaagugguu

SEQ ID NO: 902783 - RNA, 19 nt, Human
aaguggcagaaccuggagg

SEQ ID NO: 902784 - RNA, 18 nt, Human
aaucuucucucaaaucca

SEQ ID NO: 902785 - RNA, 19 nt, Human
acaaacaaagaaguagaug

SEQ ID NO: 902786 - RNA, 21 nt, Human
accacacauagcuauaagaaa

SEQ ID NO: 902787 - RNA, 27 nt, Human
acgguguggauuuuuuuuuuuuuuuuu

SEQ ID NO: 902788 - RNA, 18 nt, Human
agcaaaacagaaaggauc

SEQ ID NO: 902789 - RNA, 22 nt, Human
aggggauggugcuuccagacag

SEQ ID NO: 902790 - RNA, 23 nt, Human
aggggauggugcuuccagacagu

SEQ ID NO: 902791 - RNA, 24 nt, Human
agugguuaggggccuugucuaaug

SEQ ID NO: 902792 - RNA, 25 nt, Human
aucacaccacaucaaacagacacac

SEQ ID NO: 902793 - RNA, 23 nt, Human
augccugcagcuuuucuccuugg

SEQ ID NO: 902794 - RNA, 22 nt, Human
augucuuugaccuugcuggggc

SEQ ID NO: 902795 - RNA, 18 nt, Human
caccaguuaccauuuguu

SEQ ID NO: 902796 - RNA, 19 nt, Human
cagaaaccacacauagcua

SEQ ID NO: 902797 - RNA, 19 nt, Human
cagaaaggaucccaaagug

SEQ ID NO: 902798 - RNA, 18 nt, Human
cagaaccuggagggcgag

SEQ ID NO: 902799 - RNA, 23 nt, Human
cagcaaaacagaaaggaucccaa

SEQ ID NO: 902800 - RNA, 23 nt, Human
cagcaaaacagaaaggaucccaa

SEQ ID NO: 902801 - RNA, 25 nt, Human
cagcaaaacagaaaggaucccaaga

SEQ ID NO: 902802 - RNA, 22 nt, Human
cagcaaguggcagaaccuggag

SEQ ID NO: 902803 - RNA, 18 nt, Human
cagguucugagaagcauc

SEQ ID NO: 902804 - RNA, 24 nt, Human
caucaaacagacacacuugaaguc

SEQ ID NO: 902805 - RNA, 24 nt, Human
ccaaggacgguguggauuuuuuuu

SEQ ID NO: 902806 - RNA, 27 nt, Human
ccaaucuucucucaaauccacaaacaa

SEQ ID NO: 902807 - RNA, 22 nt, Human
ccacaucaaacagacacacuug

SEQ ID NO: 902808 - RNA, 21 nt, Human
cccaaucuucucucaaaucca

SEQ ID NO: 902809 - RNA, 21 nt, Human
ccugcagcuuuucuccuuggg

SEQ ID NO: 902810 - RNA, 19 nt, Human
ccuucuguugcuguuuucc

SEQ ID NO: 902811 - RNA, 18 nt, Human
cuguuuucccagcaagug

SEQ ID NO: 902812 - RNA, 23 nt, Human
cuucuguugcuguuuucccagca

SEQ ID NO: 902813 - RNA, 21 nt, Human
gaaccuggagggcgagcggug

SEQ ID NO: 902814 - RNA, 23 nt, Human
gacacacuugaagucugcacuga

SEQ ID NO: 902815 - RNA, 26 nt, Human
gcagcaaaacagaaaggaucccaaaa

SEQ ID NO: 902816 - RNA, 24 nt, Human
ggcgagcgguggcgccgcggacca

SEQ ID NO: 902817 - RNA, 23 nt, Human
uauguuguuguuaacuuucuuga

SEQ ID NO: 902818 - RNA, 28 nt, Human
uauucugcuccuuuuauucugcuuucca

SEQ ID NO: 902819 - RNA, 20 nt, Human
uccacaaacaaagaaguaga

SEQ ID NO: 902820 - RNA, 24 nt, Human
ugacuagaaaagagcaggcaauau

SEQ ID NO: 902821 - RNA, 22 nt, Human
ugcagcaaaacagaaaggaucc

SEQ ID NO: 902822 - RNA, 20 nt, Human
ugccugcagcuuuucuccuu

SEQ ID NO: 902823 - RNA, 21 nt, Human
uggcagaaccuggagggcgag

SEQ ID NO: 902824 - RNA, 21 nt, Human
uggcccaggaguccugcgaua

SEQ ID NO: 902825 - RNA, 21 nt, Human
uguccaaaccaccuugcaccu

SEQ ID NO: 902826 - RNA, 19 nt, Human
uguggcccaggaguccugc

SEQ ID NO: 902827 - RNA, 26 nt, Human
uuaauauccuucuguugcuguuuucc

SEQ ID NO: 902828 - RNA, 20 nt, Human
uugcagcaaaacagaaagga

SEQ ID NO: 902829 - RNA, 23 nt, Human
uugcagcaaaacagaaaggaucc

SEQ ID NO: 902830 - RNA, 25 nt, Human
uuucccagcaaguggcagaaccugg

SEQ ID NO: 902831 - RNA, 28 nt, Human
uuucuauguuguuguuaacuuucuugau

SEQ ID NO: 902832 - RNA, 18 nt, Human
uuuucagcuucauuccau

SEQ ID NO: 902833 - RNA, 24 nt, Human
uuuucccagcaaguggcagaaccu

SEQ ID NO: 902834 - RNA, 20 nt, Human
uuuuuuuuuuuuuaaggaau

SEQ ID NO: 902835 - RNA, 23 nt, Human
uuuuuuuuuuuuuuuuuuuaagg

SEQ ID NO: 902836 - RNA, 19 nt, Human
aaccagagccuccugcccc

SEQ ID NO: 902837 - RNA, 20 nt, Human
aaccaggaaggaaggagaug

SEQ ID NO: 902838 - RNA, 22 nt, Human
aagcagggcacaggcgcacacg

SEQ ID NO: 902839 - RNA, 21 nt, Human
aagggagaggccacucccugc

SEQ ID NO: 902840 - RNA, 22 nt, Human
aaggggaagaagaugcuggaga

SEQ ID NO: 902841 - RNA, 21 nt, Human
acacgcauacacucuccuaca

SEQ ID NO: 902842 - RNA, 22 nt, Human
accggcucccuccucaccgcgc

SEQ ID NO: 902843 - RNA, 22 nt, Human
agaggccacucccugcugggga

SEQ ID NO: 902844 - RNA, 18 nt, Human
aggagcuggaagcugcag

SEQ ID NO: 902845 - RNA, 20 nt, Human
aggagcuggaagcugcaggc

SEQ ID NO: 902846 - RNA, 22 nt, Human
aggcagacugugagaaagagca

SEQ ID NO: 902847 - RNA, 19 nt, Human
agggauccaggacaggagg

SEQ ID NO: 902848 - RNA, 24 nt, Human
cacucacaccugcgcacucgcugc

SEQ ID NO: 902849 - RNA, 22 nt, Human
cagaagggcagugaggcgggga

SEQ ID NO: 902850 - RNA, 21 nt, Human
cagcagcugcugcaggaacca

SEQ ID NO: 902851 - RNA, 18 nt, Human
caggguggaaggggaagg

SEQ ID NO: 902852 - RNA, 22 nt, Human
ccagagccuccugcccccgggg

SEQ ID NO: 902853 - RNA, 20 nt, Human
ccagcagggggaaggcgggg

SEQ ID NO: 902854 - RNA, 21 nt, Human
ccaggacaggagggauggcca

SEQ ID NO: 902855 - RNA, 18 nt, Human
cccucuagccggaucucc

SEQ ID NO: 902856 - RNA, 26 nt, Human
cgccaguacuccuuggcccuugcgcc

SEQ ID NO: 902857 - RNA, 24 nt, Human
cgcugagcugagacgggagggaac

SEQ ID NO: 902858 - RNA, 21 nt, Human
cucccugcuggggauguagag

SEQ ID NO: 902859 - RNA, 21 nt, Human
cuccugcccccggggccaggg

SEQ ID NO: 902860 - RNA, 21 nt, Human
cuccuuggcccuugcgccgcu

SEQ ID NO: 902861 - RNA, 19 nt, Human
gaaggcggggcuacaugag

SEQ ID NO: 902862 - RNA, 22 nt, Human
gagcaguggcagcagcugcugc

SEQ ID NO: 902863 - RNA, 26 nt, Human
gaggccuccuccacucuggggcacuc

SEQ ID NO: 902864 - RNA, 25 nt, Human
gcacaggcgcacacgcauacacucu

SEQ ID NO: 902865 - RNA, 20 nt, Human
gccacucccugcuggggaug

SEQ ID NO: 902866 - RNA, 19 nt, Human
gcccugcuugccugcaagc

SEQ ID NO: 902867 - RNA, 24 nt, Human
ggaaccagagccuccugcccccgg

SEQ ID NO: 902868 - RNA, 22 nt, Human
ggaaggaaggagaugucagagc

SEQ ID NO: 902869 - RNA, 20 nt, Human
ggacaggagggauggccagg

SEQ ID NO: 902870 - RNA, 24 nt, Human
ggacaggugccuugggcugcuccc

SEQ ID NO: 902871 - RNA, 24 nt, Human
ggacccccagcagggggaaggcgg

SEQ ID NO: 902872 - RNA, 19 nt, Human
ggaggagugaggaaccaga

SEQ ID NO: 902873 - RNA, 23 nt, Human
ggcagaagggcagugaggcgggg

SEQ ID NO: 902874 - RNA, 29 nt, Human
ggcgcacacgcauacacucuccuacaugg

SEQ ID NO: 902875 - RNA, 18 nt, Human
gggcacaggcgcacacgc

SEQ ID NO: 902876 - RNA, 19 nt, Human
ggggaagaagaugcuggag

SEQ ID NO: 902877 - RNA, 21 nt, Human
guccauggacgccaguacucc

SEQ ID NO: 902878 - RNA, 18 nt, Human
uaggggguggaggcagga

SEQ ID NO: 902879 - RNA, 21 nt, Human
uccaugguaggggguggaggc

SEQ ID NO: 902880 - RNA, 18 nt, Human
ucuccgagucaccggcuc

SEQ ID NO: 902881 - RNA, 23 nt, Human
ugagaaagagcagcgauguggug

SEQ ID NO: 902882 - RNA, 20 nt, Human
ugccggugggucagaggaca

SEQ ID NO: 902883 - RNA, 20 nt, Human
ugccuugggcugcuccccuc

SEQ ID NO: 902884 - RNA, 25 nt, Human
uggaaugucauagcaauucgcccuc

SEQ ID NO: 902885 - RNA, 19 nt, Human
uggcccuugcgccgcucug

SEQ ID NO: 902886 - RNA, 24 nt, Human
aaacacaaaaucaaaauauuaaac

SEQ ID NO: 902887 - RNA, 20 nt, Human
aaaucuaauauuuuauuucu

SEQ ID NO: 902888 - RNA, 22 nt, Human
aacaaaaaaguacuaacaugaa

SEQ ID NO: 902889 - RNA, 22 nt, Human
aaccaacuugaacacugguccc

SEQ ID NO: 902890 - RNA, 22 nt, Human
aagaaaaacaaaaauaagacaa

SEQ ID NO: 902891 - RNA, 25 nt, Human
aagaaguuacuaagaagagaggagg

SEQ ID NO: 902892 - RNA, 22 nt, Human
aagccaaucaauuuguauguaa

SEQ ID NO: 902893 - RNA, 22 nt, Human
aaguaacacacagaaaugaccc

SEQ ID NO: 902894 - RNA, 20 nt, Human
aaguuaaaacugccuuccac

SEQ ID NO: 902895 - RNA, 20 nt, Human
aauaaaaucuugguaaauga

SEQ ID NO: 902896 - RNA, 21 nt, Human
acacuacagccgccgccuggc

SEQ ID NO: 902897 - RNA, 24 nt, Human
acagauauucuucagaaaguuaaa

SEQ ID NO: 902898 - RNA, 18 nt, Human
accauucauacuuuuucu

SEQ ID NO: 902899 - RNA, 19 nt, Human
acucaacuuauuacacguu

SEQ ID NO: 902900 - RNA, 19 nt, Human
acugaagaaacaaacaaaa

SEQ ID NO: 902901 - RNA, 19 nt, Human
acugaaguucuguggcuca

SEQ ID NO: 902902 - RNA, 23 nt, Human
acugaucuaaaauuaagccacca

SEQ ID NO: 902903 - RNA, 22 nt, Human
acugauuucugugggauuuucc

SEQ ID NO: 902904 - RNA, 22 nt, Human
acuuacugauuucugugggauu

SEQ ID NO: 902905 - RNA, 25 nt, Human
agaaaaauucuuuucuuucugcaaa

SEQ ID NO: 902906 - RNA, 19 nt, Human
agaaaugacccuuuuauga

SEQ ID NO: 902907 - RNA, 22 nt, Human
agacauauuuuagaacaacaua

SEQ ID NO: 902908 - RNA, 19 nt, Human
agccgccgccuggccagga

SEQ ID NO: 902909 - RNA, 22 nt, Human
agguaaauaacauucaaaguca

SEQ ID NO: 902910 - RNA, 24 nt, Human
auaaagaccaaaccaacuugaaca

SEQ ID NO: 902911 - RNA, 24 nt, Human
auaaauccuagaaacccucaugag

SEQ ID NO: 902912 - RNA, 23 nt, Human
auacaaagacuacugucagguug

SEQ ID NO: 902913 - RNA, 20 nt, Human
auagaauacaaagacuacug

SEQ ID NO: 902914 - RNA, 20 nt, Human
augacaagccuauaaacacc

SEQ ID NO: 902915 - RNA, 22 nt, Human
auucuaucacacaaaacugacc

SEQ ID NO: 902916 - RNA, 19 nt, Human
caaaacaguggccuauaac

SEQ ID NO: 902917 - RNA, 28 nt, Human
caaauauaaaauauaaccaaaaacccag

SEQ ID NO: 902918 - RNA, 20 nt, Human
caaaucccgugcggagcucc

SEQ ID NO: 902919 - RNA, 21 nt, Human
caauaaugccaucaucacugu

SEQ ID NO: 902920 - RNA, 19 nt, Human
caauauuuacagaauauca

SEQ ID NO: 902921 - RNA, 18 nt, Human
cacacauaaaggccacca

SEQ ID NO: 902922 - RNA, 21 nt, Human
caccagcccgggcggaccccc

SEQ ID NO: 902923 - RNA, 22 nt, Human
cacuacagccgccgccuggcca

SEQ ID NO: 902924 - RNA, 18 nt, Human
cagguaggaguacauaag

SEQ ID NO: 902925 - RNA, 24 nt, Human
ccaaaaagugugauuccaucgaaa

SEQ ID NO: 902926 - RNA, 22 nt, Human
ccagcccgggcggacccccacc

SEQ ID NO: 902927 - RNA, 19 nt, Human
cccccgagcggggcgggac

SEQ ID NO: 902928 - RNA, 19 nt, Human
ccccgagguccaccagccc

SEQ ID NO: 902929 - RNA, 21 nt, Human
ccgcugucgucggcggcagcu

SEQ ID NO: 902930 - RNA, 20 nt, Human
ccguaagcgucuagucagac

SEQ ID NO: 902931 - RNA, 25 nt, Human
cgagccuggacgaagggcgcugccc

SEQ ID NO: 902932 - RNA, 21 nt, Human
cgggcggacccccaccuuccc

SEQ ID NO: 902933 - RNA, 20 nt, Human
cuaacacuacagccgccgcc

SEQ ID NO: 902934 - RNA, 23 nt, Human
cucacaaaagcuagaaauguccu

SEQ ID NO: 902935 - RNA, 19 nt, Human
cugcccagcggccgcggag

SEQ ID NO: 902936 - RNA, 23 nt, Human
cugggcacccagaaccgcgaaga

SEQ ID NO: 902937 - RNA, 20 nt, Human
cugguccuauacaauuucaa

SEQ ID NO: 902938 - RNA, 24 nt, Human
cuuucggccccgagguccaccuua

SEQ ID NO: 902939 - RNA, 22 nt, Human
gaaaaaacauaaauuaucagca

SEQ ID NO: 902940 - RNA, 23 nt, Human
gaaaacaacauacacguggauaa

SEQ ID NO: 902941 - RNA, 22 nt, Human
gaaucucuuuccacuuagucaa

SEQ ID NO: 902942 - RNA, 19 nt, Human
gacuacugucagguaggag

SEQ ID NO: 902943 - RNA, 18 nt, Human
gccaccaauuccugaguu

SEQ ID NO: 902944 - RNA, 18 nt, Human
gccgcggaggcacugccg

SEQ ID NO: 902945 - RNA, 19 nt, Human
gcuaaacacuggaaaaaau

SEQ ID NO: 902946 - RNA, 18 nt, Human
gcucuuguuucaguguga

SEQ ID NO: 902947 - RNA, 23 nt, Human
ggaauacagcauuauuuugccaa

SEQ ID NO: 902948 - RNA, 21 nt, Human
ggcaaauguggucagggcaau

SEQ ID NO: 902949 - RNA, 23 nt, Human
ggcaauuauucucucugaccuuc

SEQ ID NO: 902950 - RNA, 22 nt, Human
ggccaggagcgcgucgcggccc

SEQ ID NO: 902951 - RNA, 25 nt, Human
ggcggacccccaccuucccucaguc

SEQ ID NO: 902952 - RNA, 25 nt, Human
ggcuuuugaaguaaaauacugguua

SEQ ID NO: 902953 - RNA, 21 nt, Human
gggcacccagaaccgcgaaga

SEQ ID NO: 902954 - RNA, 19 nt, Human
ggucgccgcggcgccgggg

SEQ ID NO: 902955 - RNA, 20 nt, Human
gugcggagcucccagggagg

SEQ ID NO: 902956 - RNA, 22 nt, Human
guggauaagaccaaaguccuaa

SEQ ID NO: 902957 - RNA, 18 nt, Human
uaaaaaaauuaaacuuca

SEQ ID NO: 902958 - RNA, 20 nt, Human
uaaaauauaaccaaaaaccc

SEQ ID NO: 902959 - RNA, 20 nt, Human
uaaaauauaaccaaaaaccc

SEQ ID NO: 902960 - RNA, 22 nt, Human
uaaagaauagguaaauagacaa

SEQ ID NO: 902961 - RNA, 18 nt, Human
uaaauagacaaaccccua

SEQ ID NO: 902962 - RNA, 18 nt, Human
uaaauagacaaaccccua

SEQ ID NO: 902963 - RNA, 24 nt, Human
uaaaugcaaaaagauaacauuuuc

SEQ ID NO: 902964 - RNA, 19 nt, Human
uaacaaaaauaaacaguau

SEQ ID NO: 902965 - RNA, 22 nt, Human
uaacacaaaaaaugacaaaaaa

SEQ ID NO: 902966 - RNA, 19 nt, Human
uaacacacagaaaugaccc

SEQ ID NO: 902967 - RNA, 25 nt, Human
uaacacuacagccgccgccuggcca

SEQ ID NO: 902968 - RNA, 18 nt, Human
uaacauuauaucucagaa

SEQ ID NO: 902969 - RNA, 24 nt, Human
uaagaaaaacaaaaauaagacaaa

SEQ ID NO: 902970 - RNA, 22 nt, Human
uaagacaaaaggacagcaauca

SEQ ID NO: 902971 - RNA, 21 nt, Human
uaagauagcuauauugguuag

SEQ ID NO: 902972 - RNA, 21 nt, Human
uaagccuaguacaagcacuga

SEQ ID NO: 902973 - RNA, 21 nt, Human
uaaggauacuuaagauagcua

SEQ ID NO: 902974 - RNA, 20 nt, Human
uaaucugcagucucauguau

SEQ ID NO: 902975 - RNA, 18 nt, Human
uacauauauuuauaagau

SEQ ID NO: 902976 - RNA, 18 nt, Human
uacuauagaauacaaaga

SEQ ID NO: 902977 - RNA, 21 nt, Human
uagaaagagacucauacaacu

SEQ ID NO: 902978 - RNA, 22 nt, Human
uagccugaacaauaggaaucuu

SEQ ID NO: 902979 - RNA, 22 nt, Human
uauaaaauauaaccaaaaaccc

SEQ ID NO: 902980 - RNA, 18 nt, Human
uauaaacaccuugaauca

SEQ ID NO: 902981 - RNA, 21 nt, Human
uauaaccaaaaacccauuugu

SEQ ID NO: 902982 - RNA, 20 nt, Human
uaugacaagccuauaaacac

SEQ ID NO: 902983 - RNA, 22 nt, Human
uaugacaagccuauaaacaccu

SEQ ID NO: 902984 - RNA, 21 nt, Human
uauuauuccaucauuucucaa

SEQ ID NO: 902985 - RNA, 19 nt, Human
ucaaaauauuaaacugaag

SEQ ID NO: 902986 - RNA, 22 nt, Human
ucaauaccucuacauuuaucuc

SEQ ID NO: 902987 - RNA, 25 nt, Human
ucacacaacagguagaauaaaauga

SEQ ID NO: 902988 - RNA, 19 nt, Human
ucacagaaaccuaaggaua

SEQ ID NO: 902989 - RNA, 25 nt, Human
ucagaccccaacuucucucggccgc

SEQ ID NO: 902990 - RNA, 22 nt, Human
uccaaagcuaacacuacagccg

SEQ ID NO: 902991 - RNA, 23 nt, Human
uccgccgcgucgccgccuuucug

SEQ ID NO: 902992 - RNA, 21 nt, Human
uccuaagaggugggucaccag

SEQ ID NO: 902993 - RNA, 21 nt, Human
uccuagaaacccucaugaggc

SEQ ID NO: 902994 - RNA, 18 nt, Human
ucuccuagguuuuuuugu

SEQ ID NO: 902995 - RNA, 23 nt, Human
ucuccuagguuuuuuuguuuucg

SEQ ID NO: 902996 - RNA, 22 nt, Human
ucucucggccgcugucgucggc

SEQ ID NO: 902997 - RNA, 19 nt, Human
ucugaccuucauuuucauu

SEQ ID NO: 902998 - RNA, 20 nt, Human
ucugggcacccagaaccgcg

SEQ ID NO: 902999 - RNA, 18 nt, Human
ucugugggauuuucccca

SEQ ID NO: 903000 - RNA, 23 nt, Human
ugaaaaaacauaaauuaucagca

SEQ ID NO: 903001 - RNA, 21 nt, Human
ugaaauacaaauaaaauaucu

SEQ ID NO: 903002 - RNA, 26 nt, Human
ugaauaggcagaguguaacagaaugu

SEQ ID NO: 903003 - RNA, 24 nt, Human
ugacaaauauaaaauauaaccaaa

SEQ ID NO: 903004 - RNA, 22 nt, Human
ugauauaaaacaaaaaaguacu

SEQ ID NO: 903005 - RNA, 20 nt, Human
ugccaucaucacuguauguc

SEQ ID NO: 903006 - RNA, 22 nt, Human
ugccaucaucacuguaugucaa

SEQ ID NO: 903007 - RNA, 20 nt, Human
ugcuguacuuacacugcagg

SEQ ID NO: 903008 - RNA, 18 nt, Human
uggacgaagggcgcugcc

SEQ ID NO: 903009 - RNA, 20 nt, Human
uggccaggagcgcgucgcgg

SEQ ID NO: 903010 - RNA, 22 nt, Human
ugggaaaugguucuucacagaa

SEQ ID NO: 903011 - RNA, 20 nt, Human
ugguaaaugaaaaaaacugg

SEQ ID NO: 903012 - RNA, 21 nt, Human
uguauaaagaacagucaugaa

SEQ ID NO: 903013 - RNA, 24 nt, Human
uguauaaagaacagucaugaauaa

SEQ ID NO: 903014 - RNA, 22 nt, Human
uguccugggccagcuacauuuu

SEQ ID NO: 903015 - RNA, 19 nt, Human
ugucugaguaaagaauagg

SEQ ID NO: 903016 - RNA, 24 nt, Human
uguuaacaagguuuacugaugaaa

SEQ ID NO: 903017 - RNA, 18 nt, Human
uuaagccaccaauuccug

SEQ ID NO: 903018 - RNA, 20 nt, Human
uuaugaacaauguuaacauu

SEQ ID NO: 903019 - RNA, 18 nt, Human
uucaauggaaugcgguua

SEQ ID NO: 903020 - RNA, 23 nt, Human
uuugccaagaaaacaugggaaau

SEQ ID NO: 903021 - RNA, 21 nt, Human
uuuggaccaaaugaaaacaac

SEQ ID NO: 903022 - RNA, 20 nt, Human
uuuuuuguuuucggaauauu

SEQ ID NO: 903023 - RNA, 23 nt, Human
aauaguucaauuccaaaauaaaa

SEQ ID NO: 903024 - RNA, 23 nt, Human
acaacucagaggaacccauauuu

SEQ ID NO: 903025 - RNA, 24 nt, Human
acguauguguguguauauauaugu

SEQ ID NO: 903026 - RNA, 18 nt, Human
auguauguguguguauac

SEQ ID NO: 903027 - RNA, 20 nt, Human
auguguguguauacguaugu

SEQ ID NO: 903028 - RNA, 22 nt, Human
auguguguguauauauaugugu

SEQ ID NO: 903029 - RNA, 24 nt, Human
caguaucccugagauaggaaccac

SEQ ID NO: 903030 - RNA, 22 nt, Human
caucugauuuucaaaaccugaa

SEQ ID NO: 903031 - RNA, 21 nt, Human
ccuuaagcacuaagaauaauu

SEQ ID NO: 903032 - RNA, 25 nt, Human
cgucagaaaguccaguaucccugag

SEQ ID NO: 903033 - RNA, 25 nt, Human
cuuuaugaagccuuaagcacuaaga

SEQ ID NO: 903034 - RNA, 19 nt, Human
gaaaaggagaagacaucau

SEQ ID NO: 903035 - RNA, 20 nt, Human
gaaguuuuucucaggacuga

SEQ ID NO: 903036 - RNA, 18 nt, Human
gaauuaugccuacugccc

SEQ ID NO: 903037 - RNA, 23 nt, Human
gagcgcagaguuucagacuugga

SEQ ID NO: 903038 - RNA, 20 nt, Human
gauuuauaaaugcuuucaac

SEQ ID NO: 903039 - RNA, 23 nt, Human
gguauauuuauauauauguaugu

SEQ ID NO: 903040 - RNA, 22 nt, Human
guauauuuauauauauguaugu

SEQ ID NO: 903041 - RNA, 24 nt, Human
guguguguauauauaugugugugu

SEQ ID NO: 903042 - RNA, 24 nt, Human
uauacguauguguguguauauaaa

SEQ ID NO: 903043 - RNA, 27 nt, Human
uauacguauguguguguauauauauua

SEQ ID NO: 903044 - RNA, 24 nt, Human
uauauauauguauguguguguaua

SEQ ID NO: 903045 - RNA, 19 nt, Human
uauauauaugugugugugu

SEQ ID NO: 903046 - RNA, 22 nt, Human
uauauauaugugugugugugug

SEQ ID NO: 903047 - RNA, 24 nt, Human
uauauaugugugugugugugugua

SEQ ID NO: 903048 - RNA, 20 nt, Human
uauauguauguguguguaua

SEQ ID NO: 903049 - RNA, 19 nt, Human
uauaugugugugugugugu

SEQ ID NO: 903050 - RNA, 22 nt, Human
uauguauguguguguauacgua

SEQ ID NO: 903051 - RNA, 19 nt, Human
uauguguguguauacguau

SEQ ID NO: 903052 - RNA, 23 nt, Human
uauguguguguauacguaugugu

SEQ ID NO: 903053 - RNA, 23 nt, Human
uauguguguguauauauaugugu

SEQ ID NO: 903054 - RNA, 25 nt, Human
uauguguguguauauauauguguca

SEQ ID NO: 903055 - RNA, 18 nt, Human
uaugugugugugugugug

SEQ ID NO: 903056 - RNA, 19 nt, Human
uccaguaucccugagauag

SEQ ID NO: 903057 - RNA, 19 nt, Human
ugaaaaaaaucuggcauca

SEQ ID NO: 903058 - RNA, 18 nt, Human
ugaacuaagaaacaaguu

SEQ ID NO: 903059 - RNA, 23 nt, Human
uggcaucagguauauuuauauau

SEQ ID NO: 903060 - RNA, 19 nt, Human
ugguguuuggaaaaggaga

SEQ ID NO: 903061 - RNA, 24 nt, Human
uguauacguauguguguguauaaa

SEQ ID NO: 903062 - RNA, 26 nt, Human
uguauacguauguguguguauauaau

SEQ ID NO: 903063 - RNA, 21 nt, Human
uguauauauaugugugugugu

SEQ ID NO: 903064 - RNA, 22 nt, Human
uguguauacguaugugugugua

SEQ ID NO: 903065 - RNA, 19 nt, Human
uguguauauauaugugugu

SEQ ID NO: 903066 - RNA, 19 nt, Human
uguguauauauaugugugu

SEQ ID NO: 903067 - RNA, 21 nt, Human
uguguauauauaugugugugu

SEQ ID NO: 903068 - RNA, 22 nt, Human
uguguauauauaugugugugug

SEQ ID NO: 903069 - RNA, 18 nt, Human
uguguguauacguaugug

SEQ ID NO: 903070 - RNA, 21 nt, Human
uguguguauacguaugugugu

SEQ ID NO: 903071 - RNA, 19 nt, Human
uguguguauauauaugugu

SEQ ID NO: 903072 - RNA, 21 nt, Human
uguguguauauauaugugugu

SEQ ID NO: 903073 - RNA, 19 nt, Human
uguguguguauacguaugu

SEQ ID NO: 903074 - RNA, 19 nt, Human
uguguguguauacguaugu

SEQ ID NO: 903075 - RNA, 22 nt, Human
uguguguguauacguaugugug

SEQ ID NO: 903076 - RNA, 23 nt, Human
uguguguguauauauaugugugu

SEQ ID NO: 903077 - RNA, 30 nt, Human
uguguguguauauauauguguguguguguu

SEQ ID NO: 903078 - RNA, 20 nt, Human
uguguguguguguguauccc

SEQ ID NO: 903079 - RNA, 26 nt, Human
uuaaaaaaaagguuggaaaaauuacu

SEQ ID NO: 903080 - RNA, 21 nt, Human
uuggauuuauaaaugcuuuca

SEQ ID NO: 903081 - RNA, 25 nt, Human
uuggauuuauaaaugcuuucaacgu

SEQ ID NO: 903082 - RNA, 20 nt, Human
uuuaugaaaaaaaucuggca

SEQ ID NO: 903083 - RNA, 20 nt, Human
uuucaacgugugguguuugg

SEQ ID NO: 903084 - RNA, 18 nt, Human
uuuuuuuuuaaaaaaaag

SEQ ID NO: 903085 - RNA, 23 nt, Human
uuuuuuuuuuuuaaaaaaaaggu

SEQ ID NO: 903086 - RNA, 22 nt, Human
auacaaggcucggucuuuucaa

SEQ ID NO: 903087 - RNA, 18 nt, Human
auguauccauaacauaca

SEQ ID NO: 903088 - RNA, 20 nt, Human
auuuguguucagaauuauuu

SEQ ID NO: 903089 - RNA, 22 nt, Human
caaggauuuuucucuaauggau

SEQ ID NO: 903090 - RNA, 21 nt, Human
cagaauuauuugaugauugcu

SEQ ID NO: 903091 - RNA, 18 nt, Human
caggaggcuaacuccaca

SEQ ID NO: 903092 - RNA, 23 nt, Human
ccaaaccacuuuuuaacuuaaau

SEQ ID NO: 903093 - RNA, 23 nt, Human
ccaagcaccuauuuuuauaacuu

SEQ ID NO: 903094 - RNA, 22 nt, Human
ccaguaaacccacucauauaga

SEQ ID NO: 903095 - RNA, 23 nt, Human
cuuugugcugauguuucaguucc

SEQ ID NO: 903096 - RNA, 21 nt, Human
uaccacaggaggcuaacucca

SEQ ID NO: 903097 - RNA, 19 nt, Human
uagccagaacuuuuaaugu

SEQ ID NO: 903098 - RNA, 22 nt, Human
uagcuucccauggagagauaau

SEQ ID NO: 903099 - RNA, 21 nt, Human
ucaaugggauaacaguucaca

SEQ ID NO: 903100 - RNA, 21 nt, Human
ucagguuauugacuuaggguu

SEQ ID NO: 903101 - RNA, 20 nt, Human
ugagaguacaaaauuaguug

SEQ ID NO: 903102 - RNA, 18 nt, Human
ugcaagaagcauaugaca

SEQ ID NO: 903103 - RNA, 21 nt, Human
uguauccauaacauacauaca

SEQ ID NO: 903104 - RNA, 23 nt, Human
uuccaaaguuagccagaacuuuu

SEQ ID NO: 903105 - RNA, 25 nt, Human
caaaaaaccaaaaauauuuuauugc

SEQ ID NO: 903106 - RNA, 21 nt, Human
cauaaaggaccccaagccuug

SEQ ID NO: 903107 - RNA, 19 nt, Human
cgcugggccgcagcuuucc

SEQ ID NO: 903108 - RNA, 24 nt, Human
cucccaugacaucaggauagagau

SEQ ID NO: 903109 - RNA, 19 nt, Human
gaggcacgggguccuuugg

SEQ ID NO: 903110 - RNA, 18 nt, Human
gcuuggagucuauagcuu

SEQ ID NO: 903111 - RNA, 21 nt, Human
gguccucacuaguccgcgcug

SEQ ID NO: 903112 - RNA, 23 nt, Human
guccgcgcugggccgcagcuuuc

SEQ ID NO: 903113 - RNA, 22 nt, Human
uacaaaaccaaaaaaccaaaaa

SEQ ID NO: 903114 - RNA, 18 nt, Human
ucaggagcuguggagguc

SEQ ID NO: 903115 - RNA, 23 nt, Human
ucaggauagagauugaggcacgg

SEQ ID NO: 903116 - RNA, 20 nt, Human
uccauaaaggaccccaagcc

SEQ ID NO: 903117 - RNA, 19 nt, Human
ugcugagucauccuggggu

SEQ ID NO: 903118 - RNA, 28 nt, Human
uggcaaugucaggagcuguggagguccu

SEQ ID NO: 903119 - RNA, 23 nt, Human
ugggguuccauaaaggaccccaa

SEQ ID NO: 903120 - RNA, 20 nt, Human
uugcugagucauccuggggu

SEQ ID NO: 903121 - RNA, 23 nt, Human
uuuacaaaaccaaaaaaccaaaa

SEQ ID NO: 903122 - RNA, 20 nt, Human
uuugcuaggacucccaugac

SEQ ID NO: 903123 - RNA, 29 nt, Human
uuuuuuuuuuuuuuuuuuuuuuacaaaaa

SEQ ID NO: 903124 - RNA, 21 nt, Human
aaaccagaccugcaaauugua

SEQ ID NO: 903125 - RNA, 21 nt, Human
aaagaggaaccaaaaacugug

SEQ ID NO: 903126 - RNA, 18 nt, Human
aacugaacuucuaggacc

SEQ ID NO: 903127 - RNA, 18 nt, Human
aagucuccuguucuaaag

SEQ ID NO: 903128 - RNA, 19 nt, Human
acaaacagcagaagguaag

SEQ ID NO: 903129 - RNA, 28 nt, Human
acaaacagcagaagguaagccgguaccc

SEQ ID NO: 903130 - RNA, 21 nt, Human
acugaacuucuaggaccacag

SEQ ID NO: 903131 - RNA, 23 nt, Human
agguagucaucaaaaaugauggc

SEQ ID NO: 903132 - RNA, 19 nt, Human
auaaaacacgcucaguaaa

SEQ ID NO: 903133 - RNA, 19 nt, Human
caaacagcagaagguaagc

SEQ ID NO: 903134 - RNA, 19 nt, Human
caaacagcagaagguaagc

SEQ ID NO: 903135 - RNA, 18 nt, Human
cacuggugaugacagggu

SEQ ID NO: 903136 - RNA, 19 nt, Human
cagaggcggcaccgaggag

SEQ ID NO: 903137 - RNA, 20 nt, Human
cagccacccuguacaguacu

SEQ ID NO: 903138 - RNA, 22 nt, Human
cagcggcagggcgcgagcagag

SEQ ID NO: 903139 - RNA, 28 nt, Human
caguaaaaacugaacuucuaggaccaca

SEQ ID NO: 903140 - RNA, 23 nt, Human
ccacagaguuaauuuuacugugu

SEQ ID NO: 903141 - RNA, 20 nt, Human
ccggggcggacgugcagagg

SEQ ID NO: 903142 - RNA, 21 nt, Human
ccuccgagcgccguccgagcg

SEQ ID NO: 903143 - RNA, 19 nt, Human
ccuuaggucaagcucaagu

SEQ ID NO: 903144 - RNA, 21 nt, Human
cgagcagagcggggacgggcg

SEQ ID NO: 903145 - RNA, 19 nt, Human
cgagccgggccgaguccuc

SEQ ID NO: 903146 - RNA, 23 nt, Human
cggaaaagccaccgagggcggcg

SEQ ID NO: 903147 - RNA, 21 nt, Human
cguuccuuuuuauguucugag

SEQ ID NO: 903148 - RNA, 18 nt, Human
cugaacuucuaggaccac

SEQ ID NO: 903149 - RNA, 18 nt, Human
cugguuuucagguaggca

SEQ ID NO: 903150 - RNA, 20 nt, Human
cuucuaggaccacagccacc

SEQ ID NO: 903151 - RNA, 20 nt, Human
gagcagagcggggacgggcg

SEQ ID NO: 903152 - RNA, 20 nt, Human
gagccuggaacaaacagcag

SEQ ID NO: 903153 - RNA, 25 nt, Human
gcagggcgcgagcagagcggggacg

SEQ ID NO: 903154 - RNA, 21 nt, Human
gcccgucggaaaagccaccga

SEQ ID NO: 903155 - RNA, 21 nt, Human
gcgcgggugcgggcuccgggg

SEQ ID NO: 903156 - RNA, 25 nt, Human
gcgcguggggcgcgggugcgggcuc

SEQ ID NO: 903157 - RNA, 23 nt, Human
ggcaccgaggaggggaacgggcu

SEQ ID NO: 903158 - RNA, 19 nt, Human
uaaugcauauccuuagguc

SEQ ID NO: 903159 - RNA, 23 nt, Human
uaaugcauauccuuaggucaagc

SEQ ID NO: 903160 - RNA, 20 nt, Human
uagccucuggccuuuaaccu

SEQ ID NO: 903161 - RNA, 23 nt, Human
ucaagguaagucuaaaaucuguu

SEQ ID NO: 903162 - RNA, 22 nt, Human
ucccggucgcguccagccggga

SEQ ID NO: 903163 - RNA, 18 nt, Human
uccucggcggcgcguggg

SEQ ID NO: 903164 - RNA, 19 nt, Human
ucuaggaccacagccaccc

SEQ ID NO: 903165 - RNA, 20 nt, Human
ucuccuguucuaaaggugag

SEQ ID NO: 903166 - RNA, 21 nt, Human
ugagccuggaacaaacagcag

SEQ ID NO: 903167 - RNA, 23 nt, Human
ugagccuggaacaaacagcagaa

SEQ ID NO: 903168 - RNA, 20 nt, Human
ugccaaucccauucuuucac

SEQ ID NO: 903169 - RNA, 22 nt, Human
uggaacaaacagcagaagguaa

SEQ ID NO: 903170 - RNA, 22 nt, Human
ugggauuaaggaccaaggccac

SEQ ID NO: 903171 - RNA, 22 nt, Human
ugggauuaaggaccaaggccac

SEQ ID NO: 903172 - RNA, 24 nt, Human
ugggauuaaggaccaaggccacug

SEQ ID NO: 903173 - RNA, 18 nt, Human
ugguagcccagccaagca

SEQ ID NO: 903174 - RNA, 19 nt, Human
uguacaguacugaguggga

SEQ ID NO: 903175 - RNA, 18 nt, Human
ugucuguguagcauaagg

SEQ ID NO: 903176 - RNA, 21 nt, Human
uuacauuugacaaucuaugcu

SEQ ID NO: 903177 - RNA, 21 nt, Human
uucccgcacagcacggggcuc

SEQ ID NO: 903178 - RNA, 21 nt, Human
uuggccucaaacaccugugaa

SEQ ID NO: 903179 - RNA, 18 nt, Human
uuuauuaaagccuucaau

SEQ ID NO: 903180 - RNA, 21 nt, Human
aaaacaacaaaacaaagaccc

SEQ ID NO: 903181 - RNA, 25 nt, Human
aaaacaacaaaacaaagacccacaa

SEQ ID NO: 903182 - RNA, 18 nt, Human
aaacaacaaaacaaagac

SEQ ID NO: 903183 - RNA, 25 nt, Human
aaagcaaacaaaacaacaaaacaaa

SEQ ID NO: 903184 - RNA, 32 nt, Human
aaagcaaacaaaacaacaaaacaaagaccccc

SEQ ID NO: 903185 - RNA, 21 nt, Human
aacaaaacaacaaaacaaaga

SEQ ID NO: 903186 - RNA, 25 nt, Human
aacaaaacaacaaaacaaagaccca

SEQ ID NO: 903187 - RNA, 21 nt, Human
aagaucccaaagcaaacaaaa

SEQ ID NO: 903188 - RNA, 21 nt, Human
aagcaaacaaaacaacaaaac

SEQ ID NO: 903189 - RNA, 22 nt, Human
aagcaaacaaaacaacaaaaca

SEQ ID NO: 903190 - RNA, 27 nt, Human
aagcaaacaaaacaacaaaacaaagac

SEQ ID NO: 903191 - RNA, 20 nt, Human
acaaaacaacaaaacaaaga

SEQ ID NO: 903192 - RNA, 22 nt, Human
acaaaacaacaaaacaaagacc

SEQ ID NO: 903193 - RNA, 20 nt, Human
acagagcucuaaaaugagcu

SEQ ID NO: 903194 - RNA, 24 nt, Human
acgggacagauccugggcuucucu

SEQ ID NO: 903195 - RNA, 25 nt, Human
agagaaagcccucccgcagaaaggu

SEQ ID NO: 903196 - RNA, 22 nt, Human
aggagucgcggacaugaucugg

SEQ ID NO: 903197 - RNA, 21 nt, Human
agggaagagcuggggucagug

SEQ ID NO: 903198 - RNA, 18 nt, Human
auccacgucuucgucaga

SEQ ID NO: 903199 - RNA, 19 nt, Human
aucccaaagcaaacaaaac

SEQ ID NO: 903200 - RNA, 22 nt, Human
caaaacaacaaaacaaagaccc

SEQ ID NO: 903201 - RNA, 27 nt, Human
caaaacaacaaaacaaagacccacaac

SEQ ID NO: 903202 - RNA, 23 nt, Human
caaacaaaacaacaaaacaaaga

SEQ ID NO: 903203 - RNA, 24 nt, Human
caaacaaaacaacaaaacaaagac

SEQ ID NO: 903204 - RNA, 22 nt, Human
caaagcaaacaaaacaacaaaa

SEQ ID NO: 903205 - RNA, 21 nt, Human
caacaaaacaaagacccacaa

SEQ ID NO: 903206 - RNA, 23 nt, Human
caacaagaucccaaagcaaacaa

SEQ ID NO: 903207 - RNA, 25 nt, Human
caacaagaucccaaagcaaacaaaa

SEQ ID NO: 903208 - RNA, 19 nt, Human
cagaaaggucaaccugggc

SEQ ID NO: 903209 - RNA, 18 nt, Human
cagagcucuaaaaugagc

SEQ ID NO: 903210 - RNA, 24 nt, Human
cagagucuguggacgcggacugug

SEQ ID NO: 903211 - RNA, 23 nt, Human
cagcagcaagcacgccgagcucc

SEQ ID NO: 903212 - RNA, 20 nt, Human
ccaaagcaaacaaaacaaca

SEQ ID NO: 903213 - RNA, 20 nt, Human
ccaaagcaaacaaaacaaca

SEQ ID NO: 903214 - RNA, 18 nt, Human
ccaacaagaucccaaagc

SEQ ID NO: 903215 - RNA, 24 nt, Human
ccacgccuggcaaacuuuuuuuuc

SEQ ID NO: 903216 - RNA, 22 nt, Human
ccagaaccucgcucuucggcga

SEQ ID NO: 903217 - RNA, 21 nt, Human
ccagaagaagaguuaacuccc

SEQ ID NO: 903218 - RNA, 21 nt, Human
cccaaagcaaacaaaacaaca

SEQ ID NO: 903219 - RNA, 19 nt, Human
ccucccgcagaaaggucaa

SEQ ID NO: 903220 - RNA, 21 nt, Human
cgcccagaaccucgcucuucg

SEQ ID NO: 903221 - RNA, 21 nt, Human
cuaaagcgagagcagauccac

SEQ ID NO: 903222 - RNA, 21 nt, Human
gacaaaaacccagugagacaa

SEQ ID NO: 903223 - RNA, 25 nt, Human
gacaaaaacccagugagacaacagc

SEQ ID NO: 903224 - RNA, 19 nt, Human
gacccgguccaggcagcga

SEQ ID NO: 903225 - RNA, 18 nt, Human
gaugcugggggugcugag

SEQ ID NO: 903226 - RNA, 25 nt, Human
gcacgggacagauccugggcuucuc

SEQ ID NO: 903227 - RNA, 20 nt, Human
gcagcaagggaagagcuggg

SEQ ID NO: 903228 - RNA, 21 nt, Human
gcuaaagcgagagcagaucca

SEQ ID NO: 903229 - RNA, 20 nt, Human
ggccaucacccuccagcagc

SEQ ID NO: 903230 - RNA, 21 nt, Human
ggccaucacccuccagcagca

SEQ ID NO: 903231 - RNA, 18 nt, Human
ggccggagggcguggggc

SEQ ID NO: 903232 - RNA, 24 nt, Human
ggcuccgacaaaaacccagugaga

SEQ ID NO: 903233 - RNA, 21 nt, Human
ggggaggggagcagcggcggc

SEQ ID NO: 903234 - RNA, 20 nt, Human
ggucagugaagggcuaggga

SEQ ID NO: 903235 - RNA, 22 nt, Human
gucuuuaaagauaaaauuuggc

SEQ ID NO: 903236 - RNA, 21 nt, Human
gugagacaacagcacguagag

SEQ ID NO: 903237 - RNA, 19 nt, Human
uccaacaagaucccaaagc

SEQ ID NO: 903238 - RNA, 18 nt, Human
ucgcaggagucgcggaca

SEQ ID NO: 903239 - RNA, 21 nt, Human
ugaaacaaacaagaaaaaguu

SEQ ID NO: 903240 - RNA, 21 nt, Human
ugaaacaaacaagaaaaaguu

SEQ ID NO: 903241 - RNA, 21 nt, Human
ugaauaucuacaagaaacuag

SEQ ID NO: 903242 - RNA, 19 nt, Human
ugagacaacagcacguaga

SEQ ID NO: 903243 - RNA, 27 nt, Human
ugagacaacagcacguagagaaagccc

SEQ ID NO: 903244 - RNA, 18 nt, Human
ugaguccacgccuggcaa

SEQ ID NO: 903245 - RNA, 19 nt, Human
ugcagcaagggaagagcug

SEQ ID NO: 903246 - RNA, 23 nt, Human
uggacgcggacuguguaaagacc

SEQ ID NO: 903247 - RNA, 25 nt, Human
uggcaaacuuuuuuuuccgcgcgga

SEQ ID NO: 903248 - RNA, 20 nt, Human
uggggcuccgacaaaaaccc

SEQ ID NO: 903249 - RNA, 21 nt, Human
uggggcuccgacaaaaaccca

SEQ ID NO: 903250 - RNA, 24 nt, Human
ugucuggggaggggagcagcggcg

SEQ ID NO: 903251 - RNA, 26 nt, Human
aaaaaacaaacauccauuacucaaaa

SEQ ID NO: 903252 - RNA, 24 nt, Human
aaacacuauacaauaauccugcca

SEQ ID NO: 903253 - RNA, 23 nt, Human
aaacagaaacacaaaucagaauu

SEQ ID NO: 903254 - RNA, 19 nt, Human
aaacggguuuggcccaccc

SEQ ID NO: 903255 - RNA, 26 nt, Human
aagcaagaaguaaguuguuuccaggg

SEQ ID NO: 903256 - RNA, 24 nt, Human
aagcauauuccaaacacuauacaa

SEQ ID NO: 903257 - RNA, 21 nt, Human
aaggaaagaauauucuuuuca

SEQ ID NO: 903258 - RNA, 19 nt, Human
aaucacauuccaauuucua

SEQ ID NO: 903259 - RNA, 22 nt, Human
aauuacacaaaaaacaaacauc

SEQ ID NO: 903260 - RNA, 24 nt, Human
acaaaaguuuuaaaaaccaucuuc

SEQ ID NO: 903261 - RNA, 23 nt, Human
acagauucaaauaauccuaugca

SEQ ID NO: 903262 - RNA, 19 nt, Human
acauuuuucaaguuuuguc

SEQ ID NO: 903263 - RNA, 20 nt, Human
accucucuaaccagagcuaa

SEQ ID NO: 903264 - RNA, 21 nt, Human
agugucagaaguaacagaacc

SEQ ID NO: 903265 - RNA, 25 nt, Human
aucuagaaaaguaauucccagucau

SEQ ID NO: 903266 - RNA, 20 nt, Human
augaagcaagaaaaagacag

SEQ ID NO: 903267 - RNA, 19 nt, Human
auguacacauuugugugca

SEQ ID NO: 903268 - RNA, 18 nt, Human
auguauuuugugcuuaag

SEQ ID NO: 903269 - RNA, 27 nt, Human
caaaaaacaaacauccauuacucaaaa

SEQ ID NO: 903270 - RNA, 25 nt, Human
caaaacagaaacacaaaucagaauu

SEQ ID NO: 903271 - RNA, 23 nt, Human
caaaaugaaugucaaaaauauuc

SEQ ID NO: 903272 - RNA, 25 nt, Human
caaacacuauacaauaauccugcca

SEQ ID NO: 903273 - RNA, 19 nt, Human
caaagucaaaacagaaaca

SEQ ID NO: 903274 - RNA, 24 nt, Human
caagaaaaagacagcaaauauuaa

SEQ ID NO: 903275 - RNA, 23 nt, Human
caaggcaagugcuaauuucucca

SEQ ID NO: 903276 - RNA, 18 nt, Human
cacaaaaaacaaacaucc

SEQ ID NO: 903277 - RNA, 19 nt, Human
cacaaaaaacaaacaucca

SEQ ID NO: 903278 - RNA, 24 nt, Human
caccccugggcguucgaacagucc

SEQ ID NO: 903279 - RNA, 23 nt, Human
cagaacccaacaguucuauauua

SEQ ID NO: 903280 - RNA, 22 nt, Human
cauaaaacaaaaguugagacag

SEQ ID NO: 903281 - RNA, 27 nt, Human
caucugaaaaacauauuuuacaaccuu

SEQ ID NO: 903282 - RNA, 24 nt, Human
ccaacccugaaaagagauaugcau

SEQ ID NO: 903283 - RNA, 21 nt, Human
cucugaaacuaaccucucuaa

SEQ ID NO: 903284 - RNA, 22 nt, Human
cuucaagaggcaaucaaaaaga

SEQ ID NO: 903285 - RNA, 22 nt, Human
cuuucugacagacuuacucuaa

SEQ ID NO: 903286 - RNA, 22 nt, Human
gaaugucaaaaauauucaagcu

SEQ ID NO: 903287 - RNA, 22 nt, Human
gaugauauaacuuaaggaaaga

SEQ ID NO: 903288 - RNA, 20 nt, Human
guaacaauuaaaaaauaaaa

SEQ ID NO: 903289 - RNA, 19 nt, Human
gugcuaauuucuccaaccc

SEQ ID NO: 903290 - RNA, 21 nt, Human
gugggcuacuuucaucucuaa

SEQ ID NO: 903291 - RNA, 18 nt, Human
guucuccuaucuaucucc

SEQ ID NO: 903292 - RNA, 24 nt, Human
uaaaacaaaaguugagacagcauu

SEQ ID NO: 903293 - RNA, 23 nt, Human
uaacuuaucaaagcauauuccaa

SEQ ID NO: 903294 - RNA, 22 nt, Human
uacaaccaggcguucuccuauc

SEQ ID NO: 903295 - RNA, 18 nt, Human
uacuauaaaucacauucc

SEQ ID NO: 903296 - RNA, 24 nt, Human
uacucuaaugaagcaagaaaaaga

SEQ ID NO: 903297 - RNA, 23 nt, Human
uacuuuacacuuuuaccaaauac

SEQ ID NO: 903298 - RNA, 22 nt, Human
uagaucauuacuuauaagcucc

SEQ ID NO: 903299 - RNA, 21 nt, Human
ucaaagucaaaacagaaacac

SEQ ID NO: 903300 - RNA, 21 nt, Human
ucagaaguaacagaacccaac

SEQ ID NO: 903301 - RNA, 19 nt, Human
ucagaauuuuaaccuugag

SEQ ID NO: 903302 - RNA, 23 nt, Human
ucaucugaaaaacauauuuuacu

SEQ ID NO: 903303 - RNA, 24 nt, Human
uccaacaguaguaagaucuuuaac

SEQ ID NO: 903304 - RNA, 19 nt, Human
uccacagaagcgggcaaag

SEQ ID NO: 903305 - RNA, 19 nt, Human
uccauuacucaaaacaaua

SEQ ID NO: 903306 - RNA, 21 nt, Human
ucccuggauuccugguuuccu

SEQ ID NO: 903307 - RNA, 25 nt, Human
ucccuggauuccugguuuuccgaug

SEQ ID NO: 903308 - RNA, 23 nt, Human
ucuaugucaaaacuucaagaggc

SEQ ID NO: 903309 - RNA, 22 nt, Human
ugacaguauugguuugugaaua

SEQ ID NO: 903310 - RNA, 18 nt, Human
ugaguaguuucaaaaaaa

SEQ ID NO: 903311 - RNA, 23 nt, Human
uggaaagacacaagcaagaagua

SEQ ID NO: 903312 - RNA, 23 nt, Human
uguacacauuugugugcauuuuc

SEQ ID NO: 903313 - RNA, 22 nt, Human
ugucagaaguaacagaacccaa

SEQ ID NO: 903314 - RNA, 21 nt, Human
uuaaguuauuuauucauuggc

SEQ ID NO: 903315 - RNA, 22 nt, Human
uucaaagucaaaacagaaacac

SEQ ID NO: 903316 - RNA, 24 nt, Human
uucaaauaauccuaugcauacugc

SEQ ID NO: 903317 - RNA, 18 nt, Human
uucauuggcacucuaaua

SEQ ID NO: 903318 - RNA, 20 nt, Human
uuccaggguuuuuaaagcuu

SEQ ID NO: 903319 - RNA, 23 nt, Human
uuccugagugucagaaguaacag

SEQ ID NO: 903320 - RNA, 19 nt, Human
uucuccuaucuaucuccag

SEQ ID NO: 903321 - RNA, 24 nt, Human
uuguacuacaauauauaguauaaa

SEQ ID NO: 903322 - RNA, 22 nt, Human
uuuaaaaaugacucauuugugg

SEQ ID NO: 903323 - RNA, 19 nt, Human
aaacacagugcaacacugc

SEQ ID NO: 903324 - RNA, 21 nt, Human
aacacuuuucuggcaaagaca

SEQ ID NO: 903325 - RNA, 20 nt, Human
accgcuugcccgccaccugg

SEQ ID NO: 903326 - RNA, 19 nt, Human
acuaaaaaaaaaaaaaaaa

SEQ ID NO: 903327 - RNA, 19 nt, Human
auccagucacuuacuggca

SEQ ID NO: 903328 - RNA, 20 nt, Human
caaauccuaaagaccccgcc

SEQ ID NO: 903329 - RNA, 22 nt, Human
caccuggcacuccgggcacccc

SEQ ID NO: 903330 - RNA, 27 nt, Human
cuggcaaaccaaaggugggaacaauug

SEQ ID NO: 903331 - RNA, 30 nt, Human
gcauuuuaacuaaaaaaaaaaaaaaaaaaa

SEQ ID NO: 903332 - RNA, 20 nt, Human
uagaucucaaagcuccagaa

SEQ ID NO: 903333 - RNA, 18 nt, Human
ucucaaagcuccagaaag

SEQ ID NO: 903334 - RNA, 21 nt, Human
ucucaaagcuccagaaaggaa

SEQ ID NO: 903335 - RNA, 24 nt, Human
ugaacacaaaugugccaagaaucc

SEQ ID NO: 903336 - RNA, 19 nt, Human
ugugccaagaauccaguca

SEQ ID NO: 903337 - RNA, 26 nt, Human
uuccuggagcugcaaauccuaaagac

SEQ ID NO: 903338 - RNA, 23 nt, Human
uuguuuuuaaagaaaaaaaaauc

SEQ ID NO: 903339 - RNA, 18 nt, Human
uuugucagaauagcugac

SEQ ID NO: 903340 - RNA, 19 nt, Human
uuuucuggcaaagacaaag

SEQ ID NO: 903341 - RNA, 18 nt, Human
uuuuuuuuuuuuuuuuug

SEQ ID NO: 903342 - RNA, 25 nt, Human
uuuuuuuuuuuuuuuuuuguuuuuu

SEQ ID NO: 903343 - RNA, 19 nt, Human
aguggcaccagaaaaaccc

SEQ ID NO: 903344 - RNA, 22 nt, Human
aguggcaccagaaaaacccauc

SEQ ID NO: 903345 - RNA, 18 nt, Human
caaacuagcuccugaaga

SEQ ID NO: 903346 - RNA, 21 nt, Human
caccagaaaaacccaucucca

SEQ ID NO: 903347 - RNA, 23 nt, Human
caccagaaaaacccaucuccaaa

SEQ ID NO: 903348 - RNA, 19 nt, Human
cagcccaggugucaguggc

SEQ ID NO: 903349 - RNA, 19 nt, Human
cgcugcgccccugcacaaa

SEQ ID NO: 903350 - RNA, 21 nt, Human
gaaaaacccaucuccaaacua

SEQ ID NO: 903351 - RNA, 23 nt, Human
gcaccagaaaaacccaucuccaa

SEQ ID NO: 903352 - RNA, 18 nt, Human
ugggcagcccagguguca

SEQ ID NO: 903353 - RNA, 24 nt, Human
aaccauauucauguuugcguuuuc

SEQ ID NO: 903354 - RNA, 23 nt, Human
agcagugaguggaggguccuggg

SEQ ID NO: 903355 - RNA, 22 nt, Human
ccuuuucuucaguacagggcag

SEQ ID NO: 903356 - RNA, 18 nt, Human
cucaagaauugauaguug

SEQ ID NO: 903357 - RNA, 24 nt, Human
cucuccaaccauauucauguuugc

SEQ ID NO: 903358 - RNA, 25 nt, Human
gaugacggaggcugccccuagagga

SEQ ID NO: 903359 - RNA, 19 nt, Human
gucucuuaacugguucugg

SEQ ID NO: 903360 - RNA, 18 nt, Human
uaacugguucuggugagg

SEQ ID NO: 903361 - RNA, 23 nt, Human
uaggagcagagacauuucuugau

SEQ ID NO: 903362 - RNA, 23 nt, Human
uccauuaaggccuugugcucccc

SEQ ID NO: 903363 - RNA, 18 nt, Human
ucuuaacugguucuggug

SEQ ID NO: 903364 - RNA, 21 nt, Human
uguggcagucaccaucgugcc

SEQ ID NO: 903365 - RNA, 21 nt, Human
aagcuccagccccuggagguc

SEQ ID NO: 903366 - RNA, 19 nt, Human
acaggcagucccagagacc

SEQ ID NO: 903367 - RNA, 18 nt, Human
aggcagaguccucaccua

SEQ ID NO: 903368 - RNA, 22 nt, Human
aggcuggggaguggccugcuuc

SEQ ID NO: 903369 - RNA, 22 nt, Human
caaaacccaguccaaacucagu

SEQ ID NO: 903370 - RNA, 23 nt, Human
caaacuauaaagaaaccugcucu

SEQ ID NO: 903371 - RNA, 24 nt, Human
cacaacggcacaggcagucccaga

SEQ ID NO: 903372 - RNA, 22 nt, Human
caccaaagugaccucggcccug

SEQ ID NO: 903373 - RNA, 18 nt, Human
cagcaggcuggggagugg

SEQ ID NO: 903374 - RNA, 18 nt, Human
cagcccacuccccucucc

SEQ ID NO: 903375 - RNA, 24 nt, Human
cagcccacuccccucuccugcugc

SEQ ID NO: 903376 - RNA, 21 nt, Human
cagcgggggcaggcaccccuc

SEQ ID NO: 903377 - RNA, 20 nt, Human
ccaccuggugacucccgucc

SEQ ID NO: 903378 - RNA, 20 nt, Human
cccagcucuggccaguccca

SEQ ID NO: 903379 - RNA, 22 nt, Human
ccccuggagguccaaaacccag

SEQ ID NO: 903380 - RNA, 19 nt, Human
ccguccacagcucccagcu

SEQ ID NO: 903381 - RNA, 21 nt, Human
ccucugaaggcugcgugacuc

SEQ ID NO: 903382 - RNA, 19 nt, Human
ccuggcuuggccccaccac

SEQ ID NO: 903383 - RNA, 22 nt, Human
cgcucuggagccucaggcagag

SEQ ID NO: 903384 - RNA, 22 nt, Human
cucaagcuauucuccaugaacu

SEQ ID NO: 903385 - RNA, 20 nt, Human
cucagucccuuuagaaagcu

SEQ ID NO: 903386 - RNA, 25 nt, Human
cucccguccacagcucccagcuacc

SEQ ID NO: 903387 - RNA, 24 nt, Human
cugccaccaaagugaccucggccc

SEQ ID NO: 903388 - RNA, 22 nt, Human
cugcugcgauuccagcgcagcu

SEQ ID NO: 903389 - RNA, 22 nt, Human
cugcuucuaagccauuugcccu

SEQ ID NO: 903390 - RNA, 21 nt, Human
cuggaggggcugcccacaacg

SEQ ID NO: 903391 - RNA, 25 nt, Human
cugguggcuggugcugacccuuccc

SEQ ID NO: 903392 - RNA, 23 nt, Human
gaacugccaccaaagugaccucg

SEQ ID NO: 903393 - RNA, 19 nt, Human
gagcacagugagugcuggc

SEQ ID NO: 903394 - RNA, 20 nt, Human
gcaccggagcuccugaguca

SEQ ID NO: 903395 - RNA, 19 nt, Human
gcagagccccaggcagagu

SEQ ID NO: 903396 - RNA, 20 nt, Human
gcagaguccucaccuaaggg

SEQ ID NO: 903397 - RNA, 20 nt, Human
gcugcagcaccggagcuccu

SEQ ID NO: 903398 - RNA, 19 nt, Human
ggaaccaucagcagagccc

SEQ ID NO: 903399 - RNA, 19 nt, Human
ggccagucccaggcuggcc

SEQ ID NO: 903400 - RNA, 24 nt, Human
ggccccaccaccuggugacucccg

SEQ ID NO: 903401 - RNA, 20 nt, Human
ggcugcccacaacggcacag

SEQ ID NO: 903402 - RNA, 18 nt, Human
gggcccagcucuggccag

SEQ ID NO: 903403 - RNA, 21 nt, Human
gugaaccauuuauuuccaaac

SEQ ID NO: 903404 - RNA, 20 nt, Human
gugccucugaaggcugcgug

SEQ ID NO: 903405 - RNA, 24 nt, Human
ucagcgggggcaggcaccccucuu

SEQ ID NO: 903406 - RNA, 20 nt, Human
uccaaaacccaguccaaacu

SEQ ID NO: 903407 - RNA, 23 nt, Human
ucccagcuaccaugaugagcccu

SEQ ID NO: 903408 - RNA, 22 nt, Human
ucggcccugggagcuccaggcc

SEQ ID NO: 903409 - RNA, 19 nt, Human
ucuccaggcuggaggagcu

SEQ ID NO: 903410 - RNA, 22 nt, Human
ucuccaggcuggaggagcucuc

SEQ ID NO: 903411 - RNA, 22 nt, Human
ucuccaugaacugccaccaaag

SEQ ID NO: 903412 - RNA, 21 nt, Human
ucucggcugucagagccuggg

SEQ ID NO: 903413 - RNA, 21 nt, Human
ugacucccguccacagcuccc

SEQ ID NO: 903414 - RNA, 24 nt, Human
ugagucccuggcuuggccccacca

SEQ ID NO: 903415 - RNA, 18 nt, Human
ugagugcuggcagcaggc

SEQ ID NO: 903416 - RNA, 23 nt, Human
uggaggggcugcccacaacggca

SEQ ID NO: 903417 - RNA, 23 nt, Human
uggagguccaaaacccaguccaa

SEQ ID NO: 903418 - RNA, 19 nt, Human
uggcagcaggcuggggagu

SEQ ID NO: 903419 - RNA, 22 nt, Human
uggccuggugcucgccccuugu

SEQ ID NO: 903420 - RNA, 22 nt, Human
uggcggcugcagcaccggagcu

SEQ ID NO: 903421 - RNA, 22 nt, Human
ugggaaguggugggaagaacca

SEQ ID NO: 903422 - RNA, 25 nt, Human
ugguggcuggugcugacccuuccca

SEQ ID NO: 903423 - RNA, 19 nt, Human
ugucagagccugggaagug

SEQ ID NO: 903424 - RNA, 27 nt, Human
ugucuugucaccucaagcuauucucca

SEQ ID NO: 903425 - RNA, 18 nt, Human
ugugaccaggcucugaag

SEQ ID NO: 903426 - RNA, 18 nt, Human
uuuuuuuuuuuuuuuuug

SEQ ID NO: 903427 - RNA, 18 nt, Human
acuuagaagaaaagacaa

SEQ ID NO: 903428 - RNA, 21 nt, Human
acuuagaagaaaagacaaggg

SEQ ID NO: 903429 - RNA, 18 nt, Human
aggcuuccaacaugucac

SEQ ID NO: 903430 - RNA, 22 nt, Human
caacaugucacuuagaagaaaa

SEQ ID NO: 903431 - RNA, 21 nt, Human
gccccgggaugagaaggcuuc

SEQ ID NO: 903432 - RNA, 22 nt, Human
uagaagaaaagacaaggguuuu

SEQ ID NO: 903433 - RNA, 26 nt, Human
ucccugguuucugacaccagaggggc

SEQ ID NO: 903434 - RNA, 18 nt, Human
uggaaaagagauuggccu

SEQ ID NO: 903435 - RNA, 22 nt, Human
uggguucuuguguuuacaguuu

SEQ ID NO: 903436 - RNA, 19 nt, Human
ugucacuuagaagaaaaga

SEQ ID NO: 903437 - RNA, 22 nt, Human
aggaaaguaggaggccaguagc

SEQ ID NO: 903438 - RNA, 21 nt, Human
ccaguagcaaaccccucccag

SEQ ID NO: 903439 - RNA, 23 nt, Human
ccccuggggaacccgguggcacc

SEQ ID NO: 903440 - RNA, 20 nt, Human
cgggucggaggccaggacag

SEQ ID NO: 903441 - RNA, 21 nt, Human
cgguggcacccgcccugagga

SEQ ID NO: 903442 - RNA, 19 nt, Human
gugagcccugcgugcgccu

SEQ ID NO: 903443 - RNA, 19 nt, Human
ucacagagcagggcgggcg

SEQ ID NO: 903444 - RNA, 24 nt, Human
uccccuggggaacccgguggcacc

SEQ ID NO: 903445 - RNA, 22 nt, Human
ucucuagaggagcacuguccac

SEQ ID NO: 903446 - RNA, 21 nt, Human
uguuuuccuguuguuuuuaau

SEQ ID NO: 903447 - RNA, 20 nt, Human
aaaaggcccaagccaucccc

SEQ ID NO: 903448 - RNA, 24 nt, Human
aacccucuacucccagccccugcu

SEQ ID NO: 903449 - RNA, 20 nt, Human
aagccaucccccugagcacc

SEQ ID NO: 903450 - RNA, 19 nt, Human
aaucaccugagccccacag

SEQ ID NO: 903451 - RNA, 21 nt, Human
acagagagggacuguccugga

SEQ ID NO: 903452 - RNA, 26 nt, Human
acccauccuucuccuucuacugccag

SEQ ID NO: 903453 - RNA, 22 nt, Human
acccugaggccccagaaacccu

SEQ ID NO: 903454 - RNA, 19 nt, Human
agaggcuauggggucuggc

SEQ ID NO: 903455 - RNA, 18 nt, Human
agggcuucuguccagucu

SEQ ID NO: 903456 - RNA, 19 nt, Human
augcaugccaugugugugu

SEQ ID NO: 903457 - RNA, 23 nt, Human
cagaaacccucuacucccagccc

SEQ ID NO: 903458 - RNA, 23 nt, Human
caugcaugccauguguguguggu

SEQ ID NO: 903459 - RNA, 20 nt, Human
ccagaaacccucuacuccca

SEQ ID NO: 903460 - RNA, 19 nt, Human
cccacagugggacuauggc

SEQ ID NO: 903461 - RNA, 20 nt, Human
cccagaaacccucuacuccc

SEQ ID NO: 903462 - RNA, 20 nt, Human
ccccagaaacccucuacucc

SEQ ID NO: 903463 - RNA, 21 nt, Human
ccccagaaacccucuacuccc

SEQ ID NO: 903464 - RNA, 18 nt, Human
ccccugagcaccagagcc

SEQ ID NO: 903465 - RNA, 19 nt, Human
ccccugagcaccagagccu

SEQ ID NO: 903466 - RNA, 19 nt, Human
cccugagcaccagagccuc

SEQ ID NO: 903467 - RNA, 22 nt, Human
cccugaggccccagaaacccuc

SEQ ID NO: 903468 - RNA, 19 nt, Human
ccucauggggcucuuggga

SEQ ID NO: 903469 - RNA, 18 nt, Human
ccuucuacugccaggaau

SEQ ID NO: 903470 - RNA, 23 nt, Human
cggugcgcaugugcguacaugca

SEQ ID NO: 903471 - RNA, 21 nt, Human
cuauggggucuggcccuucuc

SEQ ID NO: 903472 - RNA, 21 nt, Human
cuauggggucuggcccuucuc

SEQ ID NO: 903473 - RNA, 20 nt, Human
cugauagcuguugcuuuccc

SEQ ID NO: 903474 - RNA, 19 nt, Human
gacugaacuccagacauac

SEQ ID NO: 903475 - RNA, 21 nt, Human
gagaaaaggcccaagccaucc

SEQ ID NO: 903476 - RNA, 19 nt, Human
gagagaaaaggcccaagcc

SEQ ID NO: 903477 - RNA, 22 nt, Human
gagccccacagaggaggggacu

SEQ ID NO: 903478 - RNA, 23 nt, Human
gaggccccagaaacccucuacuc

SEQ ID NO: 903479 - RNA, 28 nt, Human
gccccagaaacccucuacucccagcccc

SEQ ID NO: 903480 - RNA, 20 nt, Human
gccgaggagguugccccagg

SEQ ID NO: 903481 - RNA, 21 nt, Human
ggauccuagaccaugcuaaug

SEQ ID NO: 903482 - RNA, 22 nt, Human
guagagaaauguuucauccaca

SEQ ID NO: 903483 - RNA, 21 nt, Human
uacaugcaugccaugugugug

SEQ ID NO: 903484 - RNA, 21 nt, Human
uacaugcaugccaugugugug

SEQ ID NO: 903485 - RNA, 20 nt, Human
uacugccaggaaucuaagag

SEQ ID NO: 903486 - RNA, 19 nt, Human
ucccagaacccugaggccc

SEQ ID NO: 903487 - RNA, 21 nt, Human
ucucucugauagcuguugcuu

SEQ ID NO: 903488 - RNA, 20 nt, Human
ucugauagcuguugcuuucc

SEQ ID NO: 903489 - RNA, 23 nt, Human
ugaacuccagacauacagggucc

SEQ ID NO: 903490 - RNA, 18 nt, Human
ugcaugccaugugugugu

SEQ ID NO: 903491 - RNA, 19 nt, Human
ugccccagggcuucugucc

SEQ ID NO: 903492 - RNA, 22 nt, Human
ugccccagggcuucuguccagu

SEQ ID NO: 903493 - RNA, 21 nt, Human
ugcguacaugcaugccaugug

SEQ ID NO: 903494 - RNA, 26 nt, Human
ugcguacaugcaugccaugugugugg

SEQ ID NO: 903495 - RNA, 20 nt, Human
ugcuguagcagaugcgcuga

SEQ ID NO: 903496 - RNA, 19 nt, Human
ugggaagauaaaaugcugu

SEQ ID NO: 903497 - RNA, 21 nt, Human
ugggaagauaaaaugcuguag

SEQ ID NO: 903498 - RNA, 20 nt, Human
ugugugugugguguuugcag

SEQ ID NO: 903499 - RNA, 22 nt, Human
uguuucauccacauuucaauca

SEQ ID NO: 903500 - RNA, 27 nt, Human
uucccagaacccugaggccccagaaac

SEQ ID NO: 903501 - RNA, 21 nt, Human
uucuccuucuacugccaggaa

SEQ ID NO: 903502 - RNA, 18 nt, Human
uugcagggagaggugguc

SEQ ID NO: 903503 - RNA, 21 nt, Human
uuuacccauccuucuccuucu

SEQ ID NO: 903504 - RNA, 23 nt, Human
uuucccagaacccugaggcccca

SEQ ID NO: 903505 - RNA, 19 nt, Human
aaaaaaccaaaggcccuug

SEQ ID NO: 903506 - RNA, 20 nt, Human
aaccuauuacccuucuccuu

SEQ ID NO: 903507 - RNA, 18 nt, Human
aacucuggaaaaaaccaa

SEQ ID NO: 903508 - RNA, 19 nt, Human
aagacaccaggacuugugg

SEQ ID NO: 903509 - RNA, 20 nt, Human
aagaggaaagugggcaaacc

SEQ ID NO: 903510 - RNA, 24 nt, Human
acagagcuguguauaauaacagcc

SEQ ID NO: 903511 - RNA, 22 nt, Human
accaaccuauuacccuucucca

SEQ ID NO: 903512 - RNA, 22 nt, Human
accccacccccagcccauucac

SEQ ID NO: 903513 - RNA, 23 nt, Human
accuauuacccuucuccauucag

SEQ ID NO: 903514 - RNA, 23 nt, Human
acucuuucaaaaaaaauugggga

SEQ ID NO: 903515 - RNA, 19 nt, Human
acuucuuccuaguuccccc

SEQ ID NO: 903516 - RNA, 23 nt, Human
agagagcuauggaggguuccuac

SEQ ID NO: 903517 - RNA, 20 nt, Human
agagcccucaugccccuuuc

SEQ ID NO: 903518 - RNA, 23 nt, Human
aggccaaaaagggaguggcuguu

SEQ ID NO: 903519 - RNA, 21 nt, Human
agggaagcaugaggccuggug

SEQ ID NO: 903520 - RNA, 24 nt, Human
aucauccuccuaugaggagaacuc

SEQ ID NO: 903521 - RNA, 28 nt, Human
caaaaacacucaggccuggagaaggcca

SEQ ID NO: 903522 - RNA, 21 nt, Human
caaauuauggcugcuggauaa

SEQ ID NO: 903523 - RNA, 23 nt, Human
caccccacccccagcccauucac

SEQ ID NO: 903524 - RNA, 21 nt, Human
cagcccauucacugcaaccaa

SEQ ID NO: 903525 - RNA, 21 nt, Human
cagcuguucuuccuaagaaca

SEQ ID NO: 903526 - RNA, 22 nt, Human
caugccccuuucuggcucgaag

SEQ ID NO: 903527 - RNA, 22 nt, Human
cccacacaucagggcagagagc

SEQ ID NO: 903528 - RNA, 22 nt, Human
cccagcccauucacugcaacca

SEQ ID NO: 903529 - RNA, 28 nt, Human
ccccaaaaagaggaaagugggcaaaccc

SEQ ID NO: 903530 - RNA, 19 nt, Human
cccccagcccauucacugc

SEQ ID NO: 903531 - RNA, 18 nt, Human
cccucuucucucuagucc

SEQ ID NO: 903532 - RNA, 19 nt, Human
ccuauuacccuucuccauu

SEQ ID NO: 903533 - RNA, 23 nt, Human
ccuuacuucuuugaggaccccaa

SEQ ID NO: 903534 - RNA, 19 nt, Human
cuaaaccauaguucacacc

SEQ ID NO: 903535 - RNA, 22 nt, Human
cuaacucuggaaaaaaccaaag

SEQ ID NO: 903536 - RNA, 19 nt, Human
cuauggguuccuucuucuu

SEQ ID NO: 903537 - RNA, 18 nt, Human
cuccuaugaggagaacuc

SEQ ID NO: 903538 - RNA, 22 nt, Human
cucgcaagagcccucaugcccc

SEQ ID NO: 903539 - RNA, 19 nt, Human
cucuuucccaugugggcac

SEQ ID NO: 903540 - RNA, 24 nt, Human
gacuuguggagcuggugucuccag

SEQ ID NO: 903541 - RNA, 20 nt, Human
gcuggacacaaaaacacuca

SEQ ID NO: 903542 - RNA, 25 nt, Human
ggagaacucuuucaaaaaaaauugg

SEQ ID NO: 903543 - RNA, 23 nt, Human
ggaggccaaaaagggaguggcug

SEQ ID NO: 903544 - RNA, 18 nt, Human
ggaguucucccagacucu

SEQ ID NO: 903545 - RNA, 19 nt, Human
ggcagagagcuauggaggg

SEQ ID NO: 903546 - RNA, 20 nt, Human
gggacaaaugcauaauugag

SEQ ID NO: 903547 - RNA, 19 nt, Human
guucucccagacucuguuc

SEQ ID NO: 903548 - RNA, 23 nt, Human
uaaaaauaucaggguuugcccuc

SEQ ID NO: 903549 - RNA, 24 nt, Human
uaaagacaccaggacuuguggagc

SEQ ID NO: 903550 - RNA, 26 nt, Human
uaaagacaccaggacuuguggagcug

SEQ ID NO: 903551 - RNA, 21 nt, Human
uaaagggaagcaugaggccug

SEQ ID NO: 903552 - RNA, 21 nt, Human
uagucaacauugccaaaauuc

SEQ ID NO: 903553 - RNA, 23 nt, Human
ucaaaaaaaauuggggaucaaaa

SEQ ID NO: 903554 - RNA, 23 nt, Human
ucacugcaaccaaccuauuaccc

SEQ ID NO: 903555 - RNA, 22 nt, Human
ucccaugugggcacuuugggau

SEQ ID NO: 903556 - RNA, 19 nt, Human
ucccucuucucucuagucc

SEQ ID NO: 903557 - RNA, 22 nt, Human
ucuaacucuggaaaaaaccaaa

SEQ ID NO: 903558 - RNA, 20 nt, Human
ucucugcuuggacucuguuu

SEQ ID NO: 903559 - RNA, 23 nt, Human
ugagcuggacacaaaaacacuca

SEQ ID NO: 903560 - RNA, 24 nt, Human
ugaggaccccaacacagggcugaa

SEQ ID NO: 903561 - RNA, 19 nt, Human
uggaaaaaaccaaaggccc

SEQ ID NO: 903562 - RNA, 21 nt, Human
uggaaacuugaaccuucuaaa

SEQ ID NO: 903563 - RNA, 18 nt, Human
ugggguuggggacaaauc

SEQ ID NO: 903564 - RNA, 21 nt, Human
uguauaauaacagccauuaua

SEQ ID NO: 903565 - RNA, 22 nt, Human
uuaaagggaagcaugaggccug

SEQ ID NO: 903566 - RNA, 23 nt, Human
uucacugcaaccaaccuauuacc

SEQ ID NO: 903567 - RNA, 18 nt, Human
uuccucaagcugauccuu

SEQ ID NO: 903568 - RNA, 23 nt, Human
uuggugaucccuuccaguccucu

SEQ ID NO: 903569 - RNA, 21 nt, Human
uuuaaagacaccaggacuugu

SEQ ID NO: 903570 - RNA, 22 nt, Human
aaggacuuggcccuggcagggg

SEQ ID NO: 903571 - RNA, 27 nt, Human
acaaaacacugaugauaaacauggcag

SEQ ID NO: 903572 - RNA, 20 nt, Human
acccugggaugucccagcac

SEQ ID NO: 903573 - RNA, 23 nt, Human
accuccuuccuccaccccuccag

SEQ ID NO: 903574 - RNA, 18 nt, Human
acggaccguaagcugcaa

SEQ ID NO: 903575 - RNA, 18 nt, Human
agggaagggcugucggcg

SEQ ID NO: 903576 - RNA, 23 nt, Human
agggaagggcugucggcgcugcc

SEQ ID NO: 903577 - RNA, 23 nt, Human
agggcuggaccggcacacgccgg

SEQ ID NO: 903578 - RNA, 25 nt, Human
auggaguuuccccucccuugugccc

SEQ ID NO: 903579 - RNA, 23 nt, Human
caccagcuccugccccgcccccu

SEQ ID NO: 903580 - RNA, 23 nt, Human
cacccggauggggugcuaugauu

SEQ ID NO: 903581 - RNA, 21 nt, Human
caccgcguggccgagcagaaa

SEQ ID NO: 903582 - RNA, 18 nt, Human
caccuccuuccuccaccc

SEQ ID NO: 903583 - RNA, 20 nt, Human
caccuccuuccuccaccccu

SEQ ID NO: 903584 - RNA, 22 nt, Human
caccuccuuccuccaccccucc

SEQ ID NO: 903585 - RNA, 26 nt, Human
caccuccuuccuccaccccuccaggg

SEQ ID NO: 903586 - RNA, 18 nt, Human
cacuggcgagggaagggc

SEQ ID NO: 903587 - RNA, 18 nt, Human
cagcacagugggagaagg

SEQ ID NO: 903588 - RNA, 23 nt, Human
cagcggccacuuguccacuugcu

SEQ ID NO: 903589 - RNA, 19 nt, Human
cagcuccugccccgccccc

SEQ ID NO: 903590 - RNA, 18 nt, Human
caggacccaguccuacca

SEQ ID NO: 903591 - RNA, 19 nt, Human
caguacaaaaauacaaaac

SEQ ID NO: 903592 - RNA, 20 nt, Human
caguacaaaaauacaaaaca

SEQ ID NO: 903593 - RNA, 27 nt, Human
caguucccaggacccuggguucgggag

SEQ ID NO: 903594 - RNA, 19 nt, Human
caucggacaggagggugcc

SEQ ID NO: 903595 - RNA, 21 nt, Human
cauggcgcucucgacagucug

SEQ ID NO: 903596 - RNA, 22 nt, Human
cauguaccccacugggaacaag

SEQ ID NO: 903597 - RNA, 23 nt, Human
ccaaacccacagaaccugacugg

SEQ ID NO: 903598 - RNA, 19 nt, Human
ccaacccaggaguggccga

SEQ ID NO: 903599 - RNA, 20 nt, Human
ccaaugccaaguaaaaaggg

SEQ ID NO: 903600 - RNA, 21 nt, Human
ccacagcacccagugggcgcc

SEQ ID NO: 903601 - RNA, 24 nt, Human
ccacagcacccagugggcgccucu

SEQ ID NO: 903602 - RNA, 18 nt, Human
ccagcaccuuugaugcug

SEQ ID NO: 903603 - RNA, 22 nt, Human
ccagggucugggaauguucucu

SEQ ID NO: 903604 - RNA, 22 nt, Human
cccaacaccuccuuccuccacc

SEQ ID NO: 903605 - RNA, 24 nt, Human
cccaacaccuccuuccuccacccc

SEQ ID NO: 903606 - RNA, 18 nt, Human
cccacagaaccugacugg

SEQ ID NO: 903607 - RNA, 20 nt, Human
cccagcaccuuugaugcugc

SEQ ID NO: 903608 - RNA, 24 nt, Human
cccagcaccuuugaugcugcccaa

SEQ ID NO: 903609 - RNA, 22 nt, Human
cccccgggaucugcaguuccca

SEQ ID NO: 903610 - RNA, 21 nt, Human
ccccgcccccuccugagccca

SEQ ID NO: 903611 - RNA, 19 nt, Human
ccccgugccuggcucauuc

SEQ ID NO: 903612 - RNA, 21 nt, Human
ccccuccuggugcccuaaccc

SEQ ID NO: 903613 - RNA, 21 nt, Human
cccgcccuggcugaagcuaga

SEQ ID NO: 903614 - RNA, 21 nt, Human
cccuccugagcccacagcacc

SEQ ID NO: 903615 - RNA, 19 nt, Human
cccuggcugaagcuagagg

SEQ ID NO: 903616 - RNA, 19 nt, Human
cccuggguucgggagaagg

SEQ ID NO: 903617 - RNA, 19 nt, Human
ccgcagugaggaaauguug

SEQ ID NO: 903618 - RNA, 22 nt, Human
ccggccggcagcuccuucucaa

SEQ ID NO: 903619 - RNA, 18 nt, Human
ccuaacccuuggcuccac

SEQ ID NO: 903620 - RNA, 22 nt, Human
ccuaacccuuggcuccacuguc

SEQ ID NO: 903621 - RNA, 19 nt, Human
ccuccuggugcccuaaccc

SEQ ID NO: 903622 - RNA, 21 nt, Human
ccugauucuggggacagaugc

SEQ ID NO: 903623 - RNA, 18 nt, Human
ccugccccguggcccucu

SEQ ID NO: 903624 - RNA, 23 nt, Human
cgacugagaccccucugccacag

SEQ ID NO: 903625 - RNA, 21 nt, Human
cggacaggagggugccccggg

SEQ ID NO: 903626 - RNA, 22 nt, Human
cggcacacgccggcucaggagg

SEQ ID NO: 903627 - RNA, 26 nt, Human
cggcucaggagggugccagggucugg

SEQ ID NO: 903628 - RNA, 19 nt, Human
cgggucagaaauaucccgc

SEQ ID NO: 903629 - RNA, 19 nt, Human
cuccugagcccacagcacc

SEQ ID NO: 903630 - RNA, 24 nt, Human
cugaauccccccgggaucugcagu

SEQ ID NO: 903631 - RNA, 22 nt, Human
cugagcccacagcacccagugg

SEQ ID NO: 903632 - RNA, 19 nt, Human
cugaggacccugugcccag

SEQ ID NO: 903633 - RNA, 22 nt, Human
cuguccuguccucagcuccgug

SEQ ID NO: 903634 - RNA, 23 nt, Human
cuuggcuccacugucgcgcggcg

SEQ ID NO: 903635 - RNA, 20 nt, Human
gacaggagggugccccgggg

SEQ ID NO: 903636 - RNA, 19 nt, Human
gccaccuggccccuccugg

SEQ ID NO: 903637 - RNA, 27 nt, Human
gcccgcacagcggccacuuguccacca

SEQ ID NO: 903638 - RNA, 23 nt, Human
gcgcggcggcuguggagcguggc

SEQ ID NO: 903639 - RNA, 21 nt, Human
gcggcggcuguggagcguggc

SEQ ID NO: 903640 - RNA, 21 nt, Human
gcucauuucccgggggcugag

SEQ ID NO: 903641 - RNA, 22 nt, Human
gcucauuucccgggggcugaga

SEQ ID NO: 903642 - RNA, 25 nt, Human
gcuccugccccgcccccuccugagc

SEQ ID NO: 903643 - RNA, 21 nt, Human
gcugggcagaguugaggucgu

SEQ ID NO: 903644 - RNA, 21 nt, Human
ggagcguggccccggccggca

SEQ ID NO: 903645 - RNA, 21 nt, Human
ggauggaucucaccacccugg

SEQ ID NO: 903646 - RNA, 18 nt, Human
ggcaggggcucacaugua

SEQ ID NO: 903647 - RNA, 19 nt, Human
ggcucuguuugggaagugg

SEQ ID NO: 903648 - RNA, 22 nt, Human
ggcuggaccggcacacgccggc

SEQ ID NO: 903649 - RNA, 27 nt, Human
gggaaguggauucugccugauucuggg

SEQ ID NO: 903650 - RNA, 19 nt, Human
gggacagaugcugccgacg

SEQ ID NO: 903651 - RNA, 26 nt, Human
gggcagaguugaggucgucggagggg

SEQ ID NO: 903652 - RNA, 20 nt, Human
gggcuggaccggcacacgcc

SEQ ID NO: 903653 - RNA, 22 nt, Human
gggugcagaacaaggcuugaca

SEQ ID NO: 903654 - RNA, 19 nt, Human
ggugccagggucugggaau

SEQ ID NO: 903655 - RNA, 23 nt, Human
gugcccaucuguccccgaguggc

SEQ ID NO: 903656 - RNA, 22 nt, Human
guucccucagugggcccugccc

SEQ ID NO: 903657 - RNA, 18 nt, Human
uaaagugcuccgauacuc

SEQ ID NO: 903658 - RNA, 22 nt, Human
uaagcugcaacagcucacuaca

SEQ ID NO: 903659 - RNA, 22 nt, Human
uacaaauaaaaucgggcuccaa

SEQ ID NO: 903660 - RNA, 23 nt, Human
uacccgcccuggcugaagcuaga

SEQ ID NO: 903661 - RNA, 20 nt, Human
ucacaggagugccucugcca

SEQ ID NO: 903662 - RNA, 21 nt, Human
ucagugggcccugccccgugg

SEQ ID NO: 903663 - RNA, 24 nt, Human
uccacuugcugcaacgucucuagg

SEQ ID NO: 903664 - RNA, 21 nt, Human
ucccaggacccuggguucggg

SEQ ID NO: 903665 - RNA, 19 nt, Human
uccugagcccacagcaccc

SEQ ID NO: 903666 - RNA, 21 nt, Human
uccuugagcgaggcucggccc

SEQ ID NO: 903667 - RNA, 18 nt, Human
ucucaccacccugggaug

SEQ ID NO: 903668 - RNA, 25 nt, Human
ucucaggaccuugucaccaaugggc

SEQ ID NO: 903669 - RNA, 18 nt, Human
ugacggggggcggacagc

SEQ ID NO: 903670 - RNA, 21 nt, Human
ugacuaagaucaugaccacaa

SEQ ID NO: 903671 - RNA, 18 nt, Human
ugaggacccugugcccag

SEQ ID NO: 903672 - RNA, 22 nt, Human
ugauggaguuuccccucccuug

SEQ ID NO: 903673 - RNA, 25 nt, Human
ugccagggucugggaauguucucuu

SEQ ID NO: 903674 - RNA, 22 nt, Human
ugccaucggacaggagggugcc

SEQ ID NO: 903675 - RNA, 20 nt, Human
ugcccuugggaagcagaguu

SEQ ID NO: 903676 - RNA, 22 nt, Human
ugccucggaaaaacagcucgga

SEQ ID NO: 903677 - RNA, 20 nt, Human
uggccgaggggcacuggcga

SEQ ID NO: 903678 - RNA, 21 nt, Human
uggcugaagcuagaggcccgc

SEQ ID NO: 903679 - RNA, 24 nt, Human
ugggaaacagcugguuucaaaacc

SEQ ID NO: 903680 - RNA, 24 nt, Human
ugggaaguggauucugccugauuc

SEQ ID NO: 903681 - RNA, 21 nt, Human
uggggacaccuggccacugug

SEQ ID NO: 903682 - RNA, 20 nt, Human
uggggcucuguuugggaagu

SEQ ID NO: 903683 - RNA, 22 nt, Human
uggggcucuguuugggaagugg

SEQ ID NO: 903684 - RNA, 24 nt, Human
uggggugcagaacaaggcuugaca

SEQ ID NO: 903685 - RNA, 22 nt, Human
ugucccagcaccuuugaugcug

SEQ ID NO: 903686 - RNA, 20 nt, Human
uguggagcguggccccggcc

SEQ ID NO: 903687 - RNA, 20 nt, Human
uucccgggggcugaggaccc

SEQ ID NO: 903688 - RNA, 22 nt, Human
uuuccauuaaaaacuuuccuug

SEQ ID NO: 903689 - RNA, 23 nt, Human
aaaaagaaaaccaaucacauuaa

SEQ ID NO: 903690 - RNA, 20 nt, Human
aaacaaaaagaaaaccaauc

SEQ ID NO: 903691 - RNA, 24 nt, Human
aaacaaaaagaaaaccaaucacau

SEQ ID NO: 903692 - RNA, 22 nt, Human
aaagucacaaauuuugcaaagu

SEQ ID NO: 903693 - RNA, 22 nt, Human
aacucggcggccacuccagccc

SEQ ID NO: 903694 - RNA, 22 nt, Human
aagaagacaacuucccccgccc

SEQ ID NO: 903695 - RNA, 22 nt, Human
aagacaacuucccccgcccucc

SEQ ID NO: 903696 - RNA, 18 nt, Human
aaucuauuaucugacuua

SEQ ID NO: 903697 - RNA, 20 nt, Human
acaaaaagaaaaccaaucac

SEQ ID NO: 903698 - RNA, 22 nt, Human
acaaaaagaaaaccaaucacau

SEQ ID NO: 903699 - RNA, 22 nt, Human
acaacgaaugaacuaaggcaaa

SEQ ID NO: 903700 - RNA, 18 nt, Human
acauugccucauuugcuu

SEQ ID NO: 903701 - RNA, 18 nt, Human
accaccgccuccaacucg

SEQ ID NO: 903702 - RNA, 21 nt, Human
agacaacuucccccgcccucc

SEQ ID NO: 903703 - RNA, 20 nt, Human
agcauugucaccacaugccu

SEQ ID NO: 903704 - RNA, 22 nt, Human
aguaaacaacgaaugaacuaag

SEQ ID NO: 903705 - RNA, 26 nt, Human
aguaaacaacgaaugaacuaaggcaa

SEQ ID NO: 903706 - RNA, 19 nt, Human
auacuaaaucugaguugua

SEQ ID NO: 903707 - RNA, 20 nt, Human
aucuuuauuuuccauggagg

SEQ ID NO: 903708 - RNA, 21 nt, Human
augguauauuuuugguguuug

SEQ ID NO: 903709 - RNA, 18 nt, Human
caccacaugccuuaaaau

SEQ ID NO: 903710 - RNA, 18 nt, Human
caccgccuccaacucggc

SEQ ID NO: 903711 - RNA, 19 nt, Human
cacucauucuaagcugucc

SEQ ID NO: 903712 - RNA, 33 nt, Human
cacuccuacugcugccaccaccgccuccaacua

SEQ ID NO: 903713 - RNA, 24 nt, Human
cacucuacacacuccuacugcugc

SEQ ID NO: 903714 - RNA, 19 nt, Human
cacugugugucagcauccu

SEQ ID NO: 903715 - RNA, 23 nt, Human
ccaaucccgcacucuacacacug

SEQ ID NO: 903716 - RNA, 21 nt, Human
ccaccagguuuaccggccccu

SEQ ID NO: 903717 - RNA, 21 nt, Human
ccgcacucuacacacuccuac

SEQ ID NO: 903718 - RNA, 19 nt, Human
ccggaaaaaaaagaagaca

SEQ ID NO: 903719 - RNA, 21 nt, Human
cgaaugaacuaaggcaaauag

SEQ ID NO: 903720 - RNA, 20 nt, Human
cgccuccaacucggcggcca

SEQ ID NO: 903721 - RNA, 21 nt, Human
cggccccuccggaaaaaaaag

SEQ ID NO: 903722 - RNA, 21 nt, Human
cuggcccccaaucccgcacuc

SEQ ID NO: 903723 - RNA, 19 nt, Human
cuuaauagugaauguuuuc

SEQ ID NO: 903724 - RNA, 18 nt, Human
gcauugucaccacaugcc

SEQ ID NO: 903725 - RNA, 22 nt, Human
gcugccaccaccgccuccaacu

SEQ ID NO: 903726 - RNA, 19 nt, Human
uaaggcaaauagcauuguc

SEQ ID NO: 903727 - RNA, 22 nt, Human
uacacacuccuacugcugccac

SEQ ID NO: 903728 - RNA, 23 nt, Human
uacacauucaaucaaauguguua

SEQ ID NO: 903729 - RNA, 19 nt, Human
uagcuuaaaacaaaaagaa

SEQ ID NO: 903730 - RNA, 25 nt, Human
uagcuuaaaacaaaaagaaaaccaa

SEQ ID NO: 903731 - RNA, 24 nt, Human
uagugaauguuuuccaccugguuu

SEQ ID NO: 903732 - RNA, 21 nt, Human
uauggaaugcagccauaugua

SEQ ID NO: 903733 - RNA, 21 nt, Human
ucacugagguauggaaugcag

SEQ ID NO: 903734 - RNA, 25 nt, Human
ucagauggauuuaaauaaaagaugu

SEQ ID NO: 903735 - RNA, 25 nt, Human
uccuacugcugccaccaccgccucc

SEQ ID NO: 903736 - RNA, 18 nt, Human
ugaacuguuaacuugaaa

SEQ ID NO: 903737 - RNA, 22 nt, Human
ugaauguuuuccaccugguuuc

SEQ ID NO: 903738 - RNA, 23 nt, Human
uggcaacauuacaaaaauauauc

SEQ ID NO: 903739 - RNA, 19 nt, Human
uggcccccaaucccgcacu

SEQ ID NO: 903740 - RNA, 26 nt, Human
uuaaaacaaaaagaaaaccaaucaca

SEQ ID NO: 903741 - RNA, 26 nt, Human
uucaauacacauucaaucaaaugugu

SEQ ID NO: 903742 - RNA, 22 nt, Human
accacaccacugaccggaaacc

SEQ ID NO: 903743 - RNA, 23 nt, Human
cacugaccggaaaccgaucacgc

SEQ ID NO: 903744 - RNA, 20 nt, Human
aaacacaacaaucaugaaca

SEQ ID NO: 903745 - RNA, 25 nt, Human
aaacauuaaaaaauggaaaagauau

SEQ ID NO: 903746 - RNA, 22 nt, Human
aaaucaauccaaaauaagaaua

SEQ ID NO: 903747 - RNA, 19 nt, Human
aaaugacacucaugaucac

SEQ ID NO: 903748 - RNA, 22 nt, Human
aacaaaaaugacacucaugauc

SEQ ID NO: 903749 - RNA, 24 nt, Human
aacaaaaaugacacucaugaucac

SEQ ID NO: 903750 - RNA, 21 nt, Human
aaccuaauaaccaaaaaacuc

SEQ ID NO: 903751 - RNA, 19 nt, Human
aagaaacuuugggccuaaa

SEQ ID NO: 903752 - RNA, 21 nt, Human
aagaaacuuugggccuaaagu

SEQ ID NO: 903753 - RNA, 23 nt, Human
aaguaccaauaguuuaccauuug

SEQ ID NO: 903754 - RNA, 27 nt, Human
aaucacaaaauuaaauaauucuaccuu

SEQ ID NO: 903755 - RNA, 18 nt, Human
aaucuuucucuuuaucug

SEQ ID NO: 903756 - RNA, 20 nt, Human
acaaaaaaaugccaaaacaa

SEQ ID NO: 903757 - RNA, 22 nt, Human
acaaagcacugggaaaaaauca

SEQ ID NO: 903758 - RNA, 21 nt, Human
acaacaaucaugaacaaugca

SEQ ID NO: 903759 - RNA, 24 nt, Human
acaaggcaaaauuuuauuuuuuca

SEQ ID NO: 903760 - RNA, 20 nt, Human
acagaaauacaguguauagu

SEQ ID NO: 903761 - RNA, 23 nt, Human
acauucugauuguugcugcugaa

SEQ ID NO: 903762 - RNA, 18 nt, Human
agaaugucauuaguggaa

SEQ ID NO: 903763 - RNA, 21 nt, Human
aguacaaagcacugggaaaaa

SEQ ID NO: 903764 - RNA, 22 nt, Human
caaaaaacuccacuucuuccca

SEQ ID NO: 903765 - RNA, 23 nt, Human
caaacauuaaaaaauggaaaaga

SEQ ID NO: 903766 - RNA, 21 nt, Human
caacaaucaugaacaaugcac

SEQ ID NO: 903767 - RNA, 26 nt, Human
caauugcuggaacuaauggaccaaau

SEQ ID NO: 903768 - RNA, 26 nt, Human
cacacaaaaaaaugccaaaacaaaaa

SEQ ID NO: 903769 - RNA, 22 nt, Human
cacugaacugauuugaaaaagc

SEQ ID NO: 903770 - RNA, 19 nt, Human
caguugacaguacaaagca

SEQ ID NO: 903771 - RNA, 21 nt, Human
cauuuggccacccuccuuacu

SEQ ID NO: 903772 - RNA, 25 nt, Human
ccaaaaaacuccacuucuucccaga

SEQ ID NO: 903773 - RNA, 23 nt, Human
ccaaaagauaacaauggcuuuga

SEQ ID NO: 903774 - RNA, 18 nt, Human
ccuggagcugccaagaaa

SEQ ID NO: 903775 - RNA, 19 nt, Human
ccuuggauuucuauuucuc

SEQ ID NO: 903776 - RNA, 21 nt, Human
cgaccacugaacaucucuaua

SEQ ID NO: 903777 - RNA, 19 nt, Human
cuacaagaaagcaugguuu

SEQ ID NO: 903778 - RNA, 27 nt, Human
cucuguaagggaaaggacagcauuugg

SEQ ID NO: 903779 - RNA, 20 nt, Human
gaaaauuaaccuaauaacca

SEQ ID NO: 903780 - RNA, 18 nt, Human
gcaauguagaaacaaagc

SEQ ID NO: 903781 - RNA, 21 nt, Human
gccacccuccuuacuuuuggc

SEQ ID NO: 903782 - RNA, 24 nt, Human
gucuuaaaacacaacaaucaugaa

SEQ ID NO: 903783 - RNA, 23 nt, Human
guuuuaaagcucuuagagggcaa

SEQ ID NO: 903784 - RNA, 20 nt, Human
uaaaaagaagaguuauccac

SEQ ID NO: 903785 - RNA, 21 nt, Human
uaaaaagaagaguuauccaca

SEQ ID NO: 903786 - RNA, 19 nt, Human
uaaauguauagaccuggag

SEQ ID NO: 903787 - RNA, 20 nt, Human
uaacugaaaacaggcaacgu

SEQ ID NO: 903788 - RNA, 24 nt, Human
uacaaaaauaggagcaugucaaaa

SEQ ID NO: 903789 - RNA, 23 nt, Human
uaccaguguuaacugaaaacagg

SEQ ID NO: 903790 - RNA, 20 nt, Human
uaucuggcucuuuucucuuc

SEQ ID NO: 903791 - RNA, 20 nt, Human
ucaccaaaagauaacaaugg

SEQ ID NO: 903792 - RNA, 28 nt, Human
ucacugaacugauuugaaaaagccauau

SEQ ID NO: 903793 - RNA, 19 nt, Human
uccaacucucauguuagac

SEQ ID NO: 903794 - RNA, 19 nt, Human
ucuuucucuuuaucuggcu

SEQ ID NO: 903795 - RNA, 25 nt, Human
ugaaacagaucuauuugcucaaugu

SEQ ID NO: 903796 - RNA, 23 nt, Human
ugacaggaauagaaaauauuaaa

SEQ ID NO: 903797 - RNA, 23 nt, Human
ugaggauuaucaugaagauuugc

SEQ ID NO: 903798 - RNA, 20 nt, Human
ugcacccaauacucagauag

SEQ ID NO: 903799 - RNA, 22 nt, Human
ugcugaagcugugguuuuggaa

SEQ ID NO: 903800 - RNA, 23 nt, Human
ugcugacaucccauagauaauau

SEQ ID NO: 903801 - RNA, 22 nt, Human
uggaaaagauauuuaauguuua

SEQ ID NO: 903802 - RNA, 24 nt, Human
uggaaaaucaauccaaaauaagaa

SEQ ID NO: 903803 - RNA, 23 nt, Human
uggaagacuuaaaauuuaagggu

SEQ ID NO: 903804 - RNA, 23 nt, Human
uggagguagaaaacaaguaccaa

SEQ ID NO: 903805 - RNA, 25 nt, Human
uggcuucagccuuggauuucuauuu

SEQ ID NO: 903806 - RNA, 18 nt, Human
uggcuuugacuccaacuc

SEQ ID NO: 903807 - RNA, 24 nt, Human
ugggaaaaaaucacuuauuugggg

SEQ ID NO: 903808 - RNA, 25 nt, Human
ugucagaguaguuauguaaaccuaa

SEQ ID NO: 903809 - RNA, 24 nt, Human
uuaaaacacaacaaucaugaacaa

SEQ ID NO: 903810 - RNA, 24 nt, Human
uuacaaaaauaggagcaugucaaa

SEQ ID NO: 903811 - RNA, 21 nt, Human
uuaguucuacuaccauucauu

SEQ ID NO: 903812 - RNA, 20 nt, Human
uugcaauguagaaacaaagc

SEQ ID NO: 903813 - RNA, 20 nt, Human
uugcuaguuauaugcagcuu

SEQ ID NO: 903814 - RNA, 21 nt, Human
uuuaaucuuucucuuuaucug

SEQ ID NO: 903815 - RNA, 28 nt, Human
uuuggacauucugauuguugcugcugaa

SEQ ID NO: 903816 - RNA, 22 nt, Human
uuuuaagccaccaaaugcaccc

SEQ ID NO: 903817 - RNA, 25 nt, Human
uuuugcaauaggcuggguucacagu

SEQ ID NO: 903818 - RNA, 25 nt, Human
uuuuggagguagaaaacaaguacca

SEQ ID NO: 903819 - RNA, 23 nt, Human
uuuuuggagguagaaaacaagua

SEQ ID NO: 903820 - RNA, 22 nt, Human
aaagaggcagagcuucccgcua

SEQ ID NO: 903821 - RNA, 23 nt, Human
aggcagagcuucccgcuagucuu

SEQ ID NO: 903822 - RNA, 20 nt, Human
aggcaggggguggggaaggc

SEQ ID NO: 903823 - RNA, 23 nt, Human
aggcaggggguggggaaggcggu

SEQ ID NO: 903824 - RNA, 25 nt, Human
aggcaggggguggggaaggcggugg

SEQ ID NO: 903825 - RNA, 18 nt, Human
aggggguggggaaggcgg

SEQ ID NO: 903826 - RNA, 18 nt, Human
auggcaggcagggggugg

SEQ ID NO: 903827 - RNA, 21 nt, Human
cagaauggcaggcagggggug

SEQ ID NO: 903828 - RNA, 21 nt, Human
cauuuucggccaggcugagaa

SEQ ID NO: 903829 - RNA, 21 nt, Human
cggugacauuuggguggauac

SEQ ID NO: 903830 - RNA, 19 nt, Human
cugugcgcagcugcagugg

SEQ ID NO: 903831 - RNA, 21 nt, Human
gccccgaguucccucgcccac

SEQ ID NO: 903832 - RNA, 19 nt, Human
ggcaggcagggggugggga

SEQ ID NO: 903833 - RNA, 18 nt, Human
ggcguugagcaacccucu

SEQ ID NO: 903834 - RNA, 26 nt, Human
gggcguugagcaacccucuuugcuuc

SEQ ID NO: 903835 - RNA, 20 nt, Human
ucgccccgccuccgccacgc

SEQ ID NO: 903836 - RNA, 20 nt, Human
ugagaagaggucagaauggc

SEQ ID NO: 903837 - RNA, 21 nt, Human
ugagaagaggucagaauggca

SEQ ID NO: 903838 - RNA, 19 nt, Human
ugcagggucucaggggcgg

SEQ ID NO: 903839 - RNA, 18 nt, Human
ugggucugcucauuuccu

SEQ ID NO: 903840 - RNA, 20 nt, Human
ugggucugcucauuuccugc

SEQ ID NO: 903841 - RNA, 18 nt, Human
aaaaugaauggucagagc

SEQ ID NO: 903842 - RNA, 20 nt, Human
agggcaauuaacaaguccag

SEQ ID NO: 903843 - RNA, 18 nt, Human
caaaugagcaccaauguu

SEQ ID NO: 903844 - RNA, 20 nt, Human
caacuuccagaccacucucc

SEQ ID NO: 903845 - RNA, 27 nt, Human
caggggcccaggacacccccugagaaa

SEQ ID NO: 903846 - RNA, 22 nt, Human
caggguggcuucaguucaguga

SEQ ID NO: 903847 - RNA, 21 nt, Human
ccagaccacucucccauggcc

SEQ ID NO: 903848 - RNA, 22 nt, Human
ccagaccacucucccauggccu

SEQ ID NO: 903849 - RNA, 23 nt, Human
ccagacuacauuuucuaauaccc

SEQ ID NO: 903850 - RNA, 23 nt, Human
ccaggacacccccugaggcgcag

SEQ ID NO: 903851 - RNA, 23 nt, Human
cccacaguaaguaucaccaaagg

SEQ ID NO: 903852 - RNA, 24 nt, Human
cccccacaucagagccauccaacc

SEQ ID NO: 903853 - RNA, 18 nt, Human
ccccugaggcgcagcugc

SEQ ID NO: 903854 - RNA, 22 nt, Human
ccgaugauguauagugguaaau

SEQ ID NO: 903855 - RNA, 25 nt, Human
cugaggcgcagcugcacagaucucu

SEQ ID NO: 903856 - RNA, 19 nt, Human
cugcaaguggucccccucc

SEQ ID NO: 903857 - RNA, 21 nt, Human
cugcaccccacucugaauccc

SEQ ID NO: 903858 - RNA, 21 nt, Human
gagcaccaauguuggcaugaa

SEQ ID NO: 903859 - RNA, 20 nt, Human
gaggcgcagcugcacagauc

SEQ ID NO: 903860 - RNA, 21 nt, Human
gcccugguccacaauuucugu

SEQ ID NO: 903861 - RNA, 18 nt, Human
gcuccaggguggcuucag

SEQ ID NO: 903862 - RNA, 20 nt, Human
gguccuacaacuuccagacc

SEQ ID NO: 903863 - RNA, 20 nt, Human
guucagugacaaaugagcac

SEQ ID NO: 903864 - RNA, 18 nt, Human
uagguccuacaacuuccc

SEQ ID NO: 903865 - RNA, 18 nt, Human
uauagugguaaauaaagc

SEQ ID NO: 903866 - RNA, 23 nt, Human
ucaccaaaggaugucuuuggccu

SEQ ID NO: 903867 - RNA, 22 nt, Human
ucagccagacuacauuuucuaa

SEQ ID NO: 903868 - RNA, 21 nt, Human
ucaguucagugacaaaugagc

SEQ ID NO: 903869 - RNA, 22 nt, Human
uccuaaagugcuggcugagggc

SEQ ID NO: 903870 - RNA, 20 nt, Human
ucugcaccccacucugaauc

SEQ ID NO: 903871 - RNA, 22 nt, Human
ucugcaccccacucugaauccc

SEQ ID NO: 903872 - RNA, 20 nt, Human
ugacccaaggcaguacucgg

SEQ ID NO: 903873 - RNA, 18 nt, Human
uggcugagggcaauuaac

SEQ ID NO: 903874 - RNA, 21 nt, Human
uuagguccuacaacuuccaga

SEQ ID NO: 903875 - RNA, 23 nt, Human
uuuuuuuuuuuuuuuucucaugg

SEQ ID NO: 903876 - RNA, 22 nt, Human
aaacagaggcagggcccuaagc

SEQ ID NO: 903877 - RNA, 24 nt, Human
aaauacacagcucaccaagggcac

SEQ ID NO: 903878 - RNA, 22 nt, Human
acacagcucaccaagggcaccc

SEQ ID NO: 903879 - RNA, 18 nt, Human
acacccaagacaaaugac

SEQ ID NO: 903880 - RNA, 21 nt, Human
acacuuaguuuuuauuagcca

SEQ ID NO: 903881 - RNA, 20 nt, Human
accacagcagcaucguucug

SEQ ID NO: 903882 - RNA, 18 nt, Human
acccagucaccauucugu

SEQ ID NO: 903883 - RNA, 18 nt, Human
accccaaagaaagaagag

SEQ ID NO: 903884 - RNA, 18 nt, Human
acccugggcuacgcgacc

SEQ ID NO: 903885 - RNA, 23 nt, Human
aggaaauacacagcucaccaagg

SEQ ID NO: 903886 - RNA, 18 nt, Human
aucguucugccuccaccc

SEQ ID NO: 903887 - RNA, 19 nt, Human
augaaacagaggcagggcc

SEQ ID NO: 903888 - RNA, 23 nt, Human
augaaacagaggcagggcccuaa

SEQ ID NO: 903889 - RNA, 22 nt, Human
auuagccacaguuucccacagu

SEQ ID NO: 903890 - RNA, 24 nt, Human
auugccuguccacccucccacagu

SEQ ID NO: 903891 - RNA, 20 nt, Human
caaagggcuaccacagcagc

SEQ ID NO: 903892 - RNA, 21 nt, Human
caaagggcuaccacagcagca

SEQ ID NO: 903893 - RNA, 23 nt, Human
caagacaaaugacccaugcauca

SEQ ID NO: 903894 - RNA, 26 nt, Human
cacugaaccauugccuguccacccuc

SEQ ID NO: 903895 - RNA, 20 nt, Human
cacuuaguuuuuauuagcca

SEQ ID NO: 903896 - RNA, 21 nt, Human
cagccuggggcaugaggggcc

SEQ ID NO: 903897 - RNA, 21 nt, Human
cagcucaccaagggcacccag

SEQ ID NO: 903898 - RNA, 21 nt, Human
caugaaaggcaaagggcuacc

SEQ ID NO: 903899 - RNA, 20 nt, Human
cauugccuguccacccuccc

SEQ ID NO: 903900 - RNA, 21 nt, Human
ccaaagaaagaagagccagaa

SEQ ID NO: 903901 - RNA, 18 nt, Human
ccaagacaaaugacccau

SEQ ID NO: 903902 - RNA, 20 nt, Human
ccaagggcacccagucacca

SEQ ID NO: 903903 - RNA, 24 nt, Human
ccacccucccacaguggcuaaucc

SEQ ID NO: 903904 - RNA, 18 nt, Human
cccaaagaaagaagagcc

SEQ ID NO: 903905 - RNA, 21 nt, Human
cccaaagaaagaagagccaga

SEQ ID NO: 903906 - RNA, 24 nt, Human
cccaugcaucaugaaacagaggca

SEQ ID NO: 903907 - RNA, 22 nt, Human
cccuaagcugcccaagaggccu

SEQ ID NO: 903908 - RNA, 21 nt, Human
cuaaucccuggccuaguugua

SEQ ID NO: 903909 - RNA, 24 nt, Human
cucagguacagagaaccccaaaga

SEQ ID NO: 903910 - RNA, 21 nt, Human
cuuggaguuccugccaacagc

SEQ ID NO: 903911 - RNA, 26 nt, Human
gagaaccccaaagaaagaagagccag

SEQ ID NO: 903912 - RNA, 21 nt, Human
gcgcccccggcgggcuggggc

SEQ ID NO: 903913 - RNA, 20 nt, Human
gcgcugcgcccccggcgggc

SEQ ID NO: 903914 - RNA, 20 nt, Human
gcggcucgggcgcugcgccc

SEQ ID NO: 903915 - RNA, 19 nt, Human
gggauaggacacccaagac

SEQ ID NO: 903916 - RNA, 18 nt, Human
gggcccuaagcugcccaa

SEQ ID NO: 903917 - RNA, 19 nt, Human
guccuaggaggauguaagg

SEQ ID NO: 903918 - RNA, 21 nt, Human
uacacagcucaccaagggcac

SEQ ID NO: 903919 - RNA, 24 nt, Human
uacagagaaccccaaagaaagaag

SEQ ID NO: 903920 - RNA, 19 nt, Human
uaggaaauacacagcucac

SEQ ID NO: 903921 - RNA, 21 nt, Human
uaggacacccaagacaaauga

SEQ ID NO: 903922 - RNA, 19 nt, Human
uaggagagcugcuccagcc

SEQ ID NO: 903923 - RNA, 24 nt, Human
ucaagcaugggcaugaaaggcaaa

SEQ ID NO: 903924 - RNA, 21 nt, Human
ucccacaguggcuaaucccug

SEQ ID NO: 903925 - RNA, 20 nt, Human
uccucagguacagagaaccc

SEQ ID NO: 903926 - RNA, 20 nt, Human
ucgagggccgcggcucgggc

SEQ ID NO: 903927 - RNA, 22 nt, Human
ucggaugccuucugauuacugg

SEQ ID NO: 903928 - RNA, 19 nt, Human
ucguucugccuccacccug

SEQ ID NO: 903929 - RNA, 24 nt, Human
ucucggucccgucucgagggccgc

SEQ ID NO: 903930 - RNA, 19 nt, Human
ucucugagaccuucagcug

SEQ ID NO: 903931 - RNA, 19 nt, Human
ugagcagaucugcaaaguc

SEQ ID NO: 903932 - RNA, 20 nt, Human
ugaggggcccuagagcagga

SEQ ID NO: 903933 - RNA, 24 nt, Human
ugcagucggaugccuucugauuac

SEQ ID NO: 903934 - RNA, 23 nt, Human
ugcuccagccuggggcaugaggg

SEQ ID NO: 903935 - RNA, 21 nt, Human
uuagccacaguuucccacagu

SEQ ID NO: 903936 - RNA, 19 nt, Human
uuccucagguacagagaac

SEQ ID NO: 903937 - RNA, 22 nt, Human
uugcauggcugacacuguugcu

SEQ ID NO: 903938 - RNA, 27 nt, Human
uuuuuuuuuuuuuuuuuuuuuuugggg

SEQ ID NO: 903939 - RNA, 19 nt, Human
aaguggggcggccacagga

SEQ ID NO: 903940 - RNA, 22 nt, Human
acagagucccugcucuggggac

SEQ ID NO: 903941 - RNA, 23 nt, Human
accacgugcccagugugguguga

SEQ ID NO: 903942 - RNA, 19 nt, Human
accccccgccuuccccagg

SEQ ID NO: 903943 - RNA, 25 nt, Human
acccgcggaccccaacccgcccuuc

SEQ ID NO: 903944 - RNA, 26 nt, Human
accggcagugccgcgaggcauggagc

SEQ ID NO: 903945 - RNA, 22 nt, Human
accggcuuccccacacaugugc

SEQ ID NO: 903946 - RNA, 18 nt, Human
accguagccacgggcuaa

SEQ ID NO: 903947 - RNA, 19 nt, Human
agaggggagugcugggggc

SEQ ID NO: 903948 - RNA, 21 nt, Human
agagugaagggaccacuucug

SEQ ID NO: 903949 - RNA, 18 nt, Human
agaguuguuuucaaaugu

SEQ ID NO: 903950 - RNA, 23 nt, Human
agaugcaauuacggauuccacag

SEQ ID NO: 903951 - RNA, 18 nt, Human
agccagguucagcggggg

SEQ ID NO: 903952 - RNA, 21 nt, Human
agccaugagccccgccgcucc

SEQ ID NO: 903953 - RNA, 23 nt, Human
agcggaccaugcuggcugggagc

SEQ ID NO: 903954 - RNA, 18 nt, Human
agcuggccuguaggcaug

SEQ ID NO: 903955 - RNA, 18 nt, Human
aggagagguuaggcugag

SEQ ID NO: 903956 - RNA, 22 nt, Human
aggagcgccggcuucuccccag

SEQ ID NO: 903957 - RNA, 22 nt, Human
aggcagccaccgcaucuucuca

SEQ ID NO: 903958 - RNA, 22 nt, Human
agguggaggcuucucuguugag

SEQ ID NO: 903959 - RNA, 18 nt, Human
agugcugggggcauccgg

SEQ ID NO: 903960 - RNA, 21 nt, Human
augugccaggcgcccagcacc

SEQ ID NO: 903961 - RNA, 22 nt, Human
caacaccacagggaccggacau

SEQ ID NO: 903962 - RNA, 18 nt, Human
caacagaaccugucccuc

SEQ ID NO: 903963 - RNA, 18 nt, Human
caacagaaccugucccuc

SEQ ID NO: 903964 - RNA, 19 nt, Human
caagaugggagccaugagc

SEQ ID NO: 903965 - RNA, 21 nt, Human
caagaugggagccaugagccc

SEQ ID NO: 903966 - RNA, 23 nt, Human
caagggacaguggcagugugcca

SEQ ID NO: 903967 - RNA, 22 nt, Human
cacaggacaugaugccagccca

SEQ ID NO: 903968 - RNA, 24 nt, Human
caccgcaucuucucaggaaagcaa

SEQ ID NO: 903969 - RNA, 21 nt, Human
cacuuuggaaauggcugaggg

SEQ ID NO: 903970 - RNA, 24 nt, Human
cagagaaacccccacagacacugc

SEQ ID NO: 903971 - RNA, 18 nt, Human
cagccaccgcaucuucuc

SEQ ID NO: 903972 - RNA, 21 nt, Human
cagcccaacuccaccaucugc

SEQ ID NO: 903973 - RNA, 19 nt, Human
cagcccaggaugggggcug

SEQ ID NO: 903974 - RNA, 20 nt, Human
cagcccugagcuggcauccc

SEQ ID NO: 903975 - RNA, 23 nt, Human
cagccucgaucucauucacgaaa

SEQ ID NO: 903976 - RNA, 22 nt, Human
cagcgcucucccucugccuuuc

SEQ ID NO: 903977 - RNA, 19 nt, Human
cagcgggggcacagggcug

SEQ ID NO: 903978 - RNA, 18 nt, Human
caggacgggcagggugcc

SEQ ID NO: 903979 - RNA, 19 nt, Human
caggaucccagggugcucc

SEQ ID NO: 903980 - RNA, 23 nt, Human
caggcuucgggaccuggggagcc

SEQ ID NO: 903981 - RNA, 24 nt, Human
cauaaaaacaugcagaagagaaca

SEQ ID NO: 903982 - RNA, 20 nt, Human
ccacacccgucagccucccc

SEQ ID NO: 903983 - RNA, 23 nt, Human
ccacggacagaaaggagaaacgc

SEQ ID NO: 903984 - RNA, 27 nt, Human
ccacggcccagcaggucacacgugugg

SEQ ID NO: 903985 - RNA, 24 nt, Human
ccagacccgcucugagaacauagg

SEQ ID NO: 903986 - RNA, 21 nt, Human
ccagcccucagcggaccaugc

SEQ ID NO: 903987 - RNA, 18 nt, Human
ccaugagccccgccgcuc

SEQ ID NO: 903988 - RNA, 24 nt, Human
cccacagacaccucccacguccgg

SEQ ID NO: 903989 - RNA, 19 nt, Human
cccacgcagggcugcugug

SEQ ID NO: 903990 - RNA, 19 nt, Human
cccaggaugggggcugggg

SEQ ID NO: 903991 - RNA, 20 nt, Human
ccccaacccgcccuucccuc

SEQ ID NO: 903992 - RNA, 21 nt, Human
ccccaacccgcccuucccucc

SEQ ID NO: 903993 - RNA, 22 nt, Human
ccccacacaugugccaggcgcc

SEQ ID NO: 903994 - RNA, 19 nt, Human
ccccacagaccggaucagg

SEQ ID NO: 903995 - RNA, 19 nt, Human
cccccugcuggcagagaaa

SEQ ID NO: 903996 - RNA, 20 nt, Human
ccccucuggggcacccgucu

SEQ ID NO: 903997 - RNA, 18 nt, Human
cccgcccuucccuccguc

SEQ ID NO: 903998 - RNA, 20 nt, Human
ccgcccuggggcuucugcuc

SEQ ID NO: 903999 - RNA, 18 nt, Human
ccgcccuucccuccgucc

SEQ ID NO: 904000 - RNA, 20 nt, Human
ccgcccuucccuccguccug

SEQ ID NO: 904001 - RNA, 19 nt, Human
ccgcgcuggggccagggag

SEQ ID NO: 904002 - RNA, 22 nt, Human
ccgcugggggaggccgugccuc

SEQ ID NO: 904003 - RNA, 22 nt, Human
ccggcgccaggcucagcuccag

SEQ ID NO: 904004 - RNA, 18 nt, Human
ccgucugaguucugcccc

SEQ ID NO: 904005 - RNA, 19 nt, Human
ccgugacuguggggacugg

SEQ ID NO: 904006 - RNA, 22 nt, Human
ccguggaagcugccugccaggu

SEQ ID NO: 904007 - RNA, 18 nt, Human
ccucagggcuccuggaag

SEQ ID NO: 904008 - RNA, 21 nt, Human
ccuccuguugccaugacagcc

SEQ ID NO: 904009 - RNA, 18 nt, Human
ccucggagaccgcccccc

SEQ ID NO: 904010 - RNA, 19 nt, Human
ccucguccccacagaccgg

SEQ ID NO: 904011 - RNA, 20 nt, Human
ccucucccuccaggauccca

SEQ ID NO: 904012 - RNA, 24 nt, Human
ccugccagguccuccccauccuca

SEQ ID NO: 904013 - RNA, 23 nt, Human
ccuggaugggcucugcucagccc

SEQ ID NO: 904014 - RNA, 19 nt, Human
ccuggggcuucugcucugc

SEQ ID NO: 904015 - RNA, 21 nt, Human
cgaaacccacaggcguggccu

SEQ ID NO: 904016 - RNA, 24 nt, Human
cgccagguggccucacucugcccu

SEQ ID NO: 904017 - RNA, 20 nt, Human
cgcuggggccagggaggccg

SEQ ID NO: 904018 - RNA, 19 nt, Human
cgugggcaccaacccugga

SEQ ID NO: 904019 - RNA, 22 nt, Human
cgugggcaccaacccuggaagu

SEQ ID NO: 904020 - RNA, 18 nt, Human
cguucugcguggcuuggc

SEQ ID NO: 904021 - RNA, 19 nt, Human
cucaggcuucgggaccugg

SEQ ID NO: 904022 - RNA, 18 nt, Human
cuccagaaccacggccca

SEQ ID NO: 904023 - RNA, 21 nt, Human
cucccgacagaaccuauuccu

SEQ ID NO: 904024 - RNA, 21 nt, Human
cucccuaguguccugcucucc

SEQ ID NO: 904025 - RNA, 18 nt, Human
cucccucugccuuucucc

SEQ ID NO: 904026 - RNA, 18 nt, Human
cucguccccacagaccgg

SEQ ID NO: 904027 - RNA, 19 nt, Human
cucguccccacagaccgga

SEQ ID NO: 904028 - RNA, 21 nt, Human
cucugugccugccgugcggug

SEQ ID NO: 904029 - RNA, 22 nt, Human
cugaugcugagacacgaucagc

SEQ ID NO: 904030 - RNA, 20 nt, Human
cugcgagcaaacagggugca

SEQ ID NO: 904031 - RNA, 18 nt, Human
cugcucccugcgaggucg

SEQ ID NO: 904032 - RNA, 21 nt, Human
cuggcaguguggaguguccug

SEQ ID NO: 904033 - RNA, 19 nt, Human
cugucccugucuccucuug

SEQ ID NO: 904034 - RNA, 23 nt, Human
cugucccugucuccucuugucac

SEQ ID NO: 904035 - RNA, 22 nt, Human
cuucgggaccuggggagccacc

SEQ ID NO: 904036 - RNA, 22 nt, Human
cuuuggaaauggcugaggacgg

SEQ ID NO: 904037 - RNA, 28 nt, Human
gaaaggagaaacgcagccugugaccagg

SEQ ID NO: 904038 - RNA, 20 nt, Human
gaagggugcucuccuggcuc

SEQ ID NO: 904039 - RNA, 20 nt, Human
gacagcggguggccacaccc

SEQ ID NO: 904040 - RNA, 23 nt, Human
gagaaaagccugagggccgcugg

SEQ ID NO: 904041 - RNA, 23 nt, Human
gagguccauuuuuccuugcucuu

SEQ ID NO: 904042 - RNA, 19 nt, Human
gagucggggaggcgggugg

SEQ ID NO: 904043 - RNA, 21 nt, Human
gagugcugggggcauccggua

SEQ ID NO: 904044 - RNA, 24 nt, Human
gccacaggacaugaugccagccca

SEQ ID NO: 904045 - RNA, 22 nt, Human
gcccaacuccaccaucugcgcc

SEQ ID NO: 904046 - RNA, 24 nt, Human
gcccagcacccccgccagguggcc

SEQ ID NO: 904047 - RNA, 21 nt, Human
gcccuggggcuucugcucugc

SEQ ID NO: 904048 - RNA, 19 nt, Human
gccgccccccagcccccuc

SEQ ID NO: 904049 - RNA, 20 nt, Human
gccucacucugcccucugcc

SEQ ID NO: 904050 - RNA, 19 nt, Human
gccugccagguccucccca

SEQ ID NO: 904051 - RNA, 19 nt, Human
gcugcacacaggacaggcc

SEQ ID NO: 904052 - RNA, 19 nt, Human
gcugcuguggucagcccug

SEQ ID NO: 904053 - RNA, 22 nt, Human
gcuggcagagaaacccccacag

SEQ ID NO: 904054 - RNA, 18 nt, Human
gcugggguaggaggugau

SEQ ID NO: 904055 - RNA, 24 nt, Human
gcuguggugagucggugcuggccg

SEQ ID NO: 904056 - RNA, 22 nt, Human
gcuugggcaccccccgccuucc

SEQ ID NO: 904057 - RNA, 21 nt, Human
ggaaagcaggaaggccccgug

SEQ ID NO: 904058 - RNA, 21 nt, Human
ggagaccgccccccagcccuc

SEQ ID NO: 904059 - RNA, 18 nt, Human
ggagcaggagcgccggcu

SEQ ID NO: 904060 - RNA, 18 nt, Human
ggagcuguggccgcagca

SEQ ID NO: 904061 - RNA, 22 nt, Human
ggagggagagugggggcguggg

SEQ ID NO: 904062 - RNA, 23 nt, Human
ggaggggcaggagggaggccugg

SEQ ID NO: 904063 - RNA, 25 nt, Human
ggagugcugggggcauccgguagga

SEQ ID NO: 904064 - RNA, 21 nt, Human
ggaguguccuggaugggcucu

SEQ ID NO: 904065 - RNA, 22 nt, Human
ggcaaguggggcggccacagga

SEQ ID NO: 904066 - RNA, 23 nt, Human
ggcaggagggaggccugggccug

SEQ ID NO: 904067 - RNA, 21 nt, Human
ggccagagccugaccguagcc

SEQ ID NO: 904068 - RNA, 20 nt, Human
ggccgaggagggcaggaguc

SEQ ID NO: 904069 - RNA, 21 nt, Human
ggccgugacuguggggacugg

SEQ ID NO: 904070 - RNA, 19 nt, Human
ggccuaggguuugggaugc

SEQ ID NO: 904071 - RNA, 20 nt, Human
ggcgugaacagucuucucag

SEQ ID NO: 904072 - RNA, 23 nt, Human
ggcucuggaaaaguuuccccagg

SEQ ID NO: 904073 - RNA, 18 nt, Human
gggaagggcuguggugag

SEQ ID NO: 904074 - RNA, 21 nt, Human
gggaccaggaggcagcguccu

SEQ ID NO: 904075 - RNA, 21 nt, Human
gggagaguugaagaaggugcu

SEQ ID NO: 904076 - RNA, 18 nt, Human
gggagugcugggggcauc

SEQ ID NO: 904077 - RNA, 23 nt, Human
gggcaccccccgccuuccccagg

SEQ ID NO: 904078 - RNA, 22 nt, Human
gggcacccgucugaguucugcc

SEQ ID NO: 904079 - RNA, 19 nt, Human
gggcaggagggaggccugg

SEQ ID NO: 904080 - RNA, 21 nt, Human
gggcaggagggaggccugggc

SEQ ID NO: 904081 - RNA, 19 nt, Human
gggcaggaguccgagggug

SEQ ID NO: 904082 - RNA, 19 nt, Human
gggcggaggcucuucucgu

SEQ ID NO: 904083 - RNA, 22 nt, Human
ggggcacagggcugggcuuggg

SEQ ID NO: 904084 - RNA, 21 nt, Human
gguggugcccgggccgggcgg

SEQ ID NO: 904085 - RNA, 22 nt, Human
gguucagcgggggcacagggcu

SEQ ID NO: 904086 - RNA, 20 nt, Human
gugcccgggccgggcggagg

SEQ ID NO: 904087 - RNA, 23 nt, Human
guggccucacucugcccucugcc

SEQ ID NO: 904088 - RNA, 24 nt, Human
uaaaaauaaauaagcacucuggcg

SEQ ID NO: 904089 - RNA, 21 nt, Human
uaacucgugggcaccaacccu

SEQ ID NO: 904090 - RNA, 19 nt, Human
ucagcggaccaugcuggcu

SEQ ID NO: 904091 - RNA, 20 nt, Human
ucagugucccucguccccac

SEQ ID NO: 904092 - RNA, 20 nt, Human
uccaccaucugcgcccaaac

SEQ ID NO: 904093 - RNA, 20 nt, Human
uccaggaucccagggugcuc

SEQ ID NO: 904094 - RNA, 20 nt, Human
ucccacguccgguguggggc

SEQ ID NO: 904095 - RNA, 23 nt, Human
ucccgcaugucugagaaaagccu

SEQ ID NO: 904096 - RNA, 19 nt, Human
ucccuggggcccgggaugg

SEQ ID NO: 904097 - RNA, 20 nt, Human
uccgguaggaggaggggcag

SEQ ID NO: 904098 - RNA, 20 nt, Human
uccuggaaggugucugccgc

SEQ ID NO: 904099 - RNA, 19 nt, Human
uccuggcucccgcaugucu

SEQ ID NO: 904100 - RNA, 19 nt, Human
uccuguacugugagccugg

SEQ ID NO: 904101 - RNA, 21 nt, Human
uccuguguccuggugucaccc

SEQ ID NO: 904102 - RNA, 18 nt, Human
ucugcccucugcccagga

SEQ ID NO: 904103 - RNA, 19 nt, Human
ucugccuuucuccuuuccu

SEQ ID NO: 904104 - RNA, 21 nt, Human
ugacagggccugcucccugcg

SEQ ID NO: 904105 - RNA, 18 nt, Human
ugaccaggagacgcagcc

SEQ ID NO: 904106 - RNA, 20 nt, Human
ugaccaggagacgcagccca

SEQ ID NO: 904107 - RNA, 25 nt, Human
ugaccggcuuccccacacaugugcc

SEQ ID NO: 904108 - RNA, 18 nt, Human
ugagaacauaggcagcca

SEQ ID NO: 904109 - RNA, 20 nt, Human
ugagaggggagugcuggggg

SEQ ID NO: 904110 - RNA, 21 nt, Human
ugagccauuuugggagaguug

SEQ ID NO: 904111 - RNA, 22 nt, Human
ugagcucaccuccaggggccaa

SEQ ID NO: 904112 - RNA, 19 nt, Human
ugaggacccgcggacccca

SEQ ID NO: 904113 - RNA, 21 nt, Human
ugaggacccgcggaccccaac

SEQ ID NO: 904114 - RNA, 18 nt, Human
ugaggccaaccagggacc

SEQ ID NO: 904115 - RNA, 19 nt, Human
ugaggccaaccagggacca

SEQ ID NO: 904116 - RNA, 20 nt, Human
ugaggccaaccagggaccag

SEQ ID NO: 904117 - RNA, 19 nt, Human
ugaggugacauccuaaagg

SEQ ID NO: 904118 - RNA, 23 nt, Human
ugauccgcgagacacuuuggaaa

SEQ ID NO: 904119 - RNA, 20 nt, Human
ugcacacaggacaggccucg

SEQ ID NO: 904120 - RNA, 19 nt, Human
ugcagacaggcaagggcgg

SEQ ID NO: 904121 - RNA, 18 nt, Human
ugccaggcgcccagcacc

SEQ ID NO: 904122 - RNA, 19 nt, Human
ugccagguccuccccaucc

SEQ ID NO: 904123 - RNA, 21 nt, Human
ugcccacgcagggcugcugug

SEQ ID NO: 904124 - RNA, 23 nt, Human
ugcccaggaaagcaggaaggccc

SEQ ID NO: 904125 - RNA, 19 nt, Human
ugcccuggccagagccuga

SEQ ID NO: 904126 - RNA, 19 nt, Human
ugcucugcucagguagggg

SEQ ID NO: 904127 - RNA, 20 nt, Human
ugcucuuuauuuccaggcac

SEQ ID NO: 904128 - RNA, 23 nt, Human
ugcuggcagagaaacccccacag

SEQ ID NO: 904129 - RNA, 20 nt, Human
ugcuguggucagcccugagc

SEQ ID NO: 904130 - RNA, 19 nt, Human
ugcuugggcuguggcaaug

SEQ ID NO: 904131 - RNA, 24 nt, Human
uggagaagggugcucuccuggcuc

SEQ ID NO: 904132 - RNA, 20 nt, Human
uggagccgcgcuggggccag

SEQ ID NO: 904133 - RNA, 20 nt, Human
uggaggcuucucuguugagg

SEQ ID NO: 904134 - RNA, 19 nt, Human
uggaguguccuggaugggc

SEQ ID NO: 904135 - RNA, 21 nt, Human
uggcacagagcuggccuguag

SEQ ID NO: 904136 - RNA, 23 nt, Human
uggcagagaaacccccacagaca

SEQ ID NO: 904137 - RNA, 23 nt, Human
uggcaguguggaguguccuggau

SEQ ID NO: 904138 - RNA, 21 nt, Human
uggccacacccgucagccucc

SEQ ID NO: 904139 - RNA, 21 nt, Human
uggccgcagcaggugcacucu

SEQ ID NO: 904140 - RNA, 22 nt, Human
uggccuaggguuugggaugcac

SEQ ID NO: 904141 - RNA, 21 nt, Human
uggccuguaggcaugugugca

SEQ ID NO: 904142 - RNA, 18 nt, Human
uggcgugaacagucuucu

SEQ ID NO: 904143 - RNA, 25 nt, Human
uggcuuggccgugacuguggggacu

SEQ ID NO: 904144 - RNA, 23 nt, Human
ugggagaguugaagaaggugcuu

SEQ ID NO: 904145 - RNA, 26 nt, Human
uggggacaccggcagugccgcgaggc

SEQ ID NO: 904146 - RNA, 18 nt, Human
uggggccagggaggccga

SEQ ID NO: 904147 - RNA, 20 nt, Human
uggggcccgggauggagugg

SEQ ID NO: 904148 - RNA, 19 nt, Human
uggugcccgggccgggcgg

SEQ ID NO: 904149 - RNA, 19 nt, Human
uggugucacccccaacagg

SEQ ID NO: 904150 - RNA, 19 nt, Human
uggugucacccccgacagg

SEQ ID NO: 904151 - RNA, 19 nt, Human
uggugucacccccgacagg

SEQ ID NO: 904152 - RNA, 18 nt, Human
uggugucaccccugacag

SEQ ID NO: 904153 - RNA, 19 nt, Human
uggugucaccccugacagg

SEQ ID NO: 904154 - RNA, 24 nt, Human
uguccuggaugggcucugcucagc

SEQ ID NO: 904155 - RNA, 24 nt, Human
ugugaccgggcgauuccggugacc

SEQ ID NO: 904156 - RNA, 24 nt, Human
ugugaucgggcgauuccggugacc

SEQ ID NO: 904157 - RNA, 24 nt, Human
ugugaucgggcgauucuggugacc

SEQ ID NO: 904158 - RNA, 22 nt, Human
ugugaucgggugauuccgaacc

SEQ ID NO: 904159 - RNA, 23 nt, Human
ugugcacagguguguccauguga

SEQ ID NO: 904160 - RNA, 19 nt, Human
ugugcaguggggcugccgu

SEQ ID NO: 904161 - RNA, 19 nt, Human
uguggcaaugggaggucug

SEQ ID NO: 904162 - RNA, 21 nt, Human
uguggcaaugggaggucugcg

SEQ ID NO: 904163 - RNA, 25 nt, Human
uguggggacugggcugcccacgggg

SEQ ID NO: 904164 - RNA, 20 nt, Human
uguggucagcccugagcugg

SEQ ID NO: 904165 - RNA, 20 nt, Human
ugugugcgugccaagggaca

SEQ ID NO: 904166 - RNA, 21 nt, Human
uuaguucugccuuucacacgc

SEQ ID NO: 904167 - RNA, 19 nt, Human
uugagaggggagugcuggg

SEQ ID NO: 904168 - RNA, 23 nt, Human
uugcucuuuauuuccaggcacug

SEQ ID NO: 904169 - RNA, 22 nt, Human
uuucaacacaagggcuuuggag

SEQ ID NO: 904170 - RNA, 18 nt, Human
uuucuccuuuccugaugc

SEQ ID NO: 904171 - RNA, 20 nt, Human
uuugagaggggagugcuggg

SEQ ID NO: 904172 - RNA, 21 nt, Human
aaaccgaaggccaggaagaaa

SEQ ID NO: 904173 - RNA, 26 nt, Human
aagaaacagggcucaagcagugggca

SEQ ID NO: 904174 - RNA, 23 nt, Human
acaucggagagcacagaucuaga

SEQ ID NO: 904175 - RNA, 19 nt, Human
accagggcuccaggcugaa

SEQ ID NO: 904176 - RNA, 23 nt, Human
acccgucgcuucccccagaccuu

SEQ ID NO: 904177 - RNA, 23 nt, Human
acccuguucagugucugcaccuu

SEQ ID NO: 904178 - RNA, 25 nt, Human
agacagagccaggcaggccuuggga

SEQ ID NO: 904179 - RNA, 24 nt, Human
agagcacagaucuagagaaaugga

SEQ ID NO: 904180 - RNA, 28 nt, Human
agcacacaacacacaugcugaagguguu

SEQ ID NO: 904181 - RNA, 18 nt, Human
agccauuccccaccagga

SEQ ID NO: 904182 - RNA, 23 nt, Human
agcggguuggauaaugagagucc

SEQ ID NO: 904183 - RNA, 20 nt, Human
agcuguucacauacacagug

SEQ ID NO: 904184 - RNA, 19 nt, Human
agcuucuggcaaacugcuc

SEQ ID NO: 904185 - RNA, 22 nt, Human
aggaagaaacagggcucaagca

SEQ ID NO: 904186 - RNA, 21 nt, Human
aggcagcggguuggauaauga

SEQ ID NO: 904187 - RNA, 23 nt, Human
aggucugggggugggcccaggag

SEQ ID NO: 904188 - RNA, 24 nt, Human
auagaacuuucuuugacagugaaa

SEQ ID NO: 904189 - RNA, 21 nt, Human
auggcacggaccaugugugug

SEQ ID NO: 904190 - RNA, 23 nt, Human
auggcacggaccaugugugugug

SEQ ID NO: 904191 - RNA, 20 nt, Human
cacacagaucauacggccag

SEQ ID NO: 904192 - RNA, 18 nt, Human
cacacguaucuacugagc

SEQ ID NO: 904193 - RNA, 24 nt, Human
cacagaucauacggccagcccugg

SEQ ID NO: 904194 - RNA, 22 nt, Human
caccccaacccgagguagcuga

SEQ ID NO: 904195 - RNA, 19 nt, Human
cacccugagcuucuggcaa

SEQ ID NO: 904196 - RNA, 19 nt, Human
cacuguguggcacgugagc

SEQ ID NO: 904197 - RNA, 18 nt, Human
cagaucuagagaaaugga

SEQ ID NO: 904198 - RNA, 18 nt, Human
caggagccagaggucagc

SEQ ID NO: 904199 - RNA, 21 nt, Human
cagggcccaagcuguucacau

SEQ ID NO: 904200 - RNA, 18 nt, Human
cagggcggugcaggugga

SEQ ID NO: 904201 - RNA, 19 nt, Human
cagggcucaagcagggcug

SEQ ID NO: 904202 - RNA, 22 nt, Human
ccacccgucgcuucccccagac

SEQ ID NO: 904203 - RNA, 20 nt, Human
ccaggaagaaacagggcuca

SEQ ID NO: 904204 - RNA, 19 nt, Human
ccagggaaaccgaaggcca

SEQ ID NO: 904205 - RNA, 22 nt, Human
ccaguauggcagccacuaacca

SEQ ID NO: 904206 - RNA, 22 nt, Human
cccagccccagccauuccccac

SEQ ID NO: 904207 - RNA, 23 nt, Human
cccuggcugggacccaccagggc

SEQ ID NO: 904208 - RNA, 23 nt, Human
ccuggccccuuaggaagagcagg

SEQ ID NO: 904209 - RNA, 18 nt, Human
ccuggcugagaggguagg

SEQ ID NO: 904210 - RNA, 21 nt, Human
ccuggggaggccccucugccc

SEQ ID NO: 904211 - RNA, 21 nt, Human
cggugcagguggagccagagg

SEQ ID NO: 904212 - RNA, 21 nt, Human
cgugagcacacaacacacaug

SEQ ID NO: 904213 - RNA, 20 nt, Human
cucccaccccaacccgaggu

SEQ ID NO: 904214 - RNA, 20 nt, Human
cucugcucucagggugagcc

SEQ ID NO: 904215 - RNA, 23 nt, Human
cucugcucucagggugagccggg

SEQ ID NO: 904216 - RNA, 22 nt, Human
cugaagccucacgcugcaccca

SEQ ID NO: 904217 - RNA, 24 nt, Human
cugaagguguuugagacccuguuc

SEQ ID NO: 904218 - RNA, 21 nt, Human
cuggcaaacugcucucugccu

SEQ ID NO: 904219 - RNA, 20 nt, Human
gagcagggcggugcaggugg

SEQ ID NO: 904220 - RNA, 21 nt, Human
gagcccccugcacggccucuc

SEQ ID NO: 904221 - RNA, 21 nt, Human
gagcuggggcugagccacagg

SEQ ID NO: 904222 - RNA, 20 nt, Human
gaggucugggggugggccca

SEQ ID NO: 904223 - RNA, 23 nt, Human
gauaaugagaguccggagagaga

SEQ ID NO: 904224 - RNA, 18 nt, Human
gcacaggucucuccuacu

SEQ ID NO: 904225 - RNA, 21 nt, Human
gcacggaccaugugugugugc

SEQ ID NO: 904226 - RNA, 24 nt, Human
gcucccaccccaacccgagguagc

SEQ ID NO: 904227 - RNA, 19 nt, Human
gcuuuugguucaggagguc

SEQ ID NO: 904228 - RNA, 19 nt, Human
ggacccaccagggcuccag

SEQ ID NO: 904229 - RNA, 18 nt, Human
ggagccagaggacaggag

SEQ ID NO: 904230 - RNA, 18 nt, Human
ggagcggcugaggcuagg

SEQ ID NO: 904231 - RNA, 21 nt, Human
ggccaggaagaaacagggcuc

SEQ ID NO: 904232 - RNA, 23 nt, Human
ggguagggcucccucagggugug

SEQ ID NO: 904233 - RNA, 18 nt, Human
guugugugcaugagacac

SEQ ID NO: 904234 - RNA, 24 nt, Human
uaaguuccccagggaaaccgaagg

SEQ ID NO: 904235 - RNA, 24 nt, Human
uaaugagaguccggagagagaagc

SEQ ID NO: 904236 - RNA, 19 nt, Human
uaggaagagcagggcggug

SEQ ID NO: 904237 - RNA, 24 nt, Human
uaggaagagcagggcggugcaggu

SEQ ID NO: 904238 - RNA, 23 nt, Human
uaggucccagaauggccugggga

SEQ ID NO: 904239 - RNA, 25 nt, Human
ucacauacacaguguggaaggaugc

SEQ ID NO: 904240 - RNA, 19 nt, Human
ucagaacugagcccccugc

SEQ ID NO: 904241 - RNA, 22 nt, Human
ucaggaggucugggggugggcc

SEQ ID NO: 904242 - RNA, 21 nt, Human
uccacacagaucauacggcca

SEQ ID NO: 904243 - RNA, 23 nt, Human
ucccagaauggccuggggaguuu

SEQ ID NO: 904244 - RNA, 21 nt, Human
ucccucagggugugugggguc

SEQ ID NO: 904245 - RNA, 22 nt, Human
ucuggcaaacugcucucugccu

SEQ ID NO: 904246 - RNA, 18 nt, Human
ugaaaaugccccgagcug

SEQ ID NO: 904247 - RNA, 18 nt, Human
ugagcccccugcacggcc

SEQ ID NO: 904248 - RNA, 25 nt, Human
ugagcccccugcacggccucugcuc

SEQ ID NO: 904249 - RNA, 18 nt, Human
ugagccgggugccaccac

SEQ ID NO: 904250 - RNA, 19 nt, Human
ugagcuucuggcaaacugc

SEQ ID NO: 904251 - RNA, 20 nt, Human
ugaggcuaggguagggcucc

SEQ ID NO: 904252 - RNA, 24 nt, Human
ugccuggcugagaggguaggagac

SEQ ID NO: 904253 - RNA, 21 nt, Human
uggagccagaggacaggagcc

SEQ ID NO: 904254 - RNA, 23 nt, Human
uggagccagaggacaggagccag

SEQ ID NO: 904255 - RNA, 19 nt, Human
uggcaaacugcucucugcc

SEQ ID NO: 904256 - RNA, 22 nt, Human
uggcacacuuggagagaagccu

SEQ ID NO: 904257 - RNA, 21 nt, Human
uggcugggagggcuguccugg

SEQ ID NO: 904258 - RNA, 23 nt, Human
uggcuggggcucccaccccaacc

SEQ ID NO: 904259 - RNA, 18 nt, Human
ugggaggguccugcccag

SEQ ID NO: 904260 - RNA, 25 nt, Human
uggggcugagccacaggcagggagc

SEQ ID NO: 904261 - RNA, 19 nt, Human
ugggggcuuccuggccccu

SEQ ID NO: 904262 - RNA, 18 nt, Human
ugggggugggcccaggag

SEQ ID NO: 904263 - RNA, 23 nt, Human
uggguugugugcaugagacacug

SEQ ID NO: 904264 - RNA, 21 nt, Human
ugugcacguagguggugugua

SEQ ID NO: 904265 - RNA, 24 nt, Human
uguguacacuggguugugugcaug

SEQ ID NO: 904266 - RNA, 21 nt, Human
ugugugcacguagguggugug

SEQ ID NO: 904267 - RNA, 19 nt, Human
ugugugcaugagacacugu

SEQ ID NO: 904268 - RNA, 19 nt, Human
ugugugcaugagacacugu

SEQ ID NO: 904269 - RNA, 22 nt, Human
ugugugcaugagacacugugug

SEQ ID NO: 904270 - RNA, 19 nt, Human
uguuugcagggcccaagcc

SEQ ID NO: 904271 - RNA, 22 nt, Human
uuccccagggaaaccgaaggcc

SEQ ID NO: 904272 - RNA, 25 nt, Human
uucuuugacagugaaaaugccccga

SEQ ID NO: 904273 - RNA, 18 nt, Human
aaaaagacagccaugaug

SEQ ID NO: 904274 - RNA, 18 nt, Human
aaaaagacagccaugaug

SEQ ID NO: 904275 - RNA, 21 nt, Human
acgcacaaugcuauucccagu

SEQ ID NO: 904276 - RNA, 21 nt, Human
acguggaggucacuuugcucu

SEQ ID NO: 904277 - RNA, 21 nt, Human
agacguggaggucacuuugcu

SEQ ID NO: 904278 - RNA, 19 nt, Human
agccacggagaaaggaaga

SEQ ID NO: 904279 - RNA, 23 nt, Human
aggaagucauguuccccauuucu

SEQ ID NO: 904280 - RNA, 24 nt, Human
auccugggauucccaaaggcaugg

SEQ ID NO: 904281 - RNA, 19 nt, Human
aucucccccacuuuaauuc

SEQ ID NO: 904282 - RNA, 21 nt, Human
auggagcccuuuuccggacac

SEQ ID NO: 904283 - RNA, 18 nt, Human
ccagccacggagaaagga

SEQ ID NO: 904284 - RNA, 18 nt, Human
ccugggauucccaaaggc

SEQ ID NO: 904285 - RNA, 24 nt, Human
cugccaucucccccacuuuaauuc

SEQ ID NO: 904286 - RNA, 22 nt, Human
gccaucucccccacuuuaauuc

SEQ ID NO: 904287 - RNA, 21 nt, Human
gcccuuuuccggacacgcaca

SEQ ID NO: 904288 - RNA, 22 nt, Human
ggacacgcacaaugcuauuccc

SEQ ID NO: 904289 - RNA, 19 nt, Human
ggcaaaaagacagccauga

SEQ ID NO: 904290 - RNA, 22 nt, Human
ggcaaaaagacagccaugaugg

SEQ ID NO: 904291 - RNA, 18 nt, Human
uacagggcacugcggucc

SEQ ID NO: 904292 - RNA, 18 nt, Human
ucacugggugcuagacgg

SEQ ID NO: 904293 - RNA, 25 nt, Human
ucacugggugcuagacggcuggguu

SEQ ID NO: 904294 - RNA, 18 nt, Human
ucacuuugcucugugaug

SEQ ID NO: 904295 - RNA, 21 nt, Human
ucccagaaagcgucugccauc

SEQ ID NO: 904296 - RNA, 18 nt, Human
ucugagggaagcuguggc

SEQ ID NO: 904297 - RNA, 23 nt, Human
ugacggcaggggguggggcaaaa

SEQ ID NO: 904298 - RNA, 25 nt, Human
ugccaucucccccacuuuaauucug

SEQ ID NO: 904299 - RNA, 24 nt, Human
uggaaccaaauggagcccuuuucc

SEQ ID NO: 904300 - RNA, 23 nt, Human
uggccuaagggcaaacagcuggc

SEQ ID NO: 904301 - RNA, 21 nt, Human
uggguuuaggacagggccuga

SEQ ID NO: 904302 - RNA, 23 nt, Human
ugucagagaauacauaucuuggg

SEQ ID NO: 904303 - RNA, 20 nt, Human
uuaauucuguguacuggccu

SEQ ID NO: 904304 - RNA, 18 nt, Human
uuuuuuuuuuuuuuuuug

SEQ ID NO: 904305 - RNA, 19 nt, Human
aaacaaucccccuccccca

SEQ ID NO: 904306 - RNA, 22 nt, Human
aaccaggcaauugucuccaauc

SEQ ID NO: 904307 - RNA, 20 nt, Human
aagcaggugugggcccaaga

SEQ ID NO: 904308 - RNA, 21 nt, Human
aaggacuacacaggaagaggg

SEQ ID NO: 904309 - RNA, 21 nt, Human
aagggcuuugaggugaaaaga

SEQ ID NO: 904310 - RNA, 19 nt, Human
aaucaggugcacgugcccu

SEQ ID NO: 904311 - RNA, 19 nt, Human
acacaugcaucccugcagg

SEQ ID NO: 904312 - RNA, 20 nt, Human
accaagucuucaccugcccc

SEQ ID NO: 904313 - RNA, 18 nt, Human
acccugcaccaccccacu

SEQ ID NO: 904314 - RNA, 30 nt, Human
accuucaccuucagagcccaccuccccauu

SEQ ID NO: 904315 - RNA, 21 nt, Human
agagagaccuucaggcccaga

SEQ ID NO: 904316 - RNA, 18 nt, Human
agaguaggugccaggccu

SEQ ID NO: 904317 - RNA, 24 nt, Human
agauguacagccucccacagccuc

SEQ ID NO: 904318 - RNA, 20 nt, Human
agcagagcuugggccccaag

SEQ ID NO: 904319 - RNA, 18 nt, Human
agcagcugcccagacagc

SEQ ID NO: 904320 - RNA, 27 nt, Human
agccagggccucccucgagcagcugcc

SEQ ID NO: 904321 - RNA, 22 nt, Human
agccccaccccuggcccuccac

SEQ ID NO: 904322 - RNA, 20 nt, Human
agcucucuugcugucuuugc

SEQ ID NO: 904323 - RNA, 24 nt, Human
agcugcacagccccauguaggacc

SEQ ID NO: 904324 - RNA, 23 nt, Human
agcugcagggccucagucuucag

SEQ ID NO: 904325 - RNA, 18 nt, Human
aggaaagauuccaagggg

SEQ ID NO: 904326 - RNA, 21 nt, Human
aggaggcugccuagaaagggc

SEQ ID NO: 904327 - RNA, 18 nt, Human
aggaggguuugugcugac

SEQ ID NO: 904328 - RNA, 19 nt, Human
aggcagggccccgcccuuc

SEQ ID NO: 904329 - RNA, 19 nt, Human
aggcugcagcucucuugcu

SEQ ID NO: 904330 - RNA, 23 nt, Human
aggcugcagcucucuugcugucu

SEQ ID NO: 904331 - RNA, 21 nt, Human
agggcagcaggguucugagca

SEQ ID NO: 904332 - RNA, 18 nt, Human
agggccucccucgagcag

SEQ ID NO: 904333 - RNA, 23 nt, Human
aggugcccagugaagaggggagc

SEQ ID NO: 904334 - RNA, 21 nt, Human
agguggcagauccagggagca

SEQ ID NO: 904335 - RNA, 18 nt, Human
augcuggggccucauccu

SEQ ID NO: 904336 - RNA, 20 nt, Human
caagggcuuugaggugaaaa

SEQ ID NO: 904337 - RNA, 22 nt, Human
cacagcaccagagaagcugaag

SEQ ID NO: 904338 - RNA, 18 nt, Human
cacaugcuccgcccuugc

SEQ ID NO: 904339 - RNA, 27 nt, Human
caccccauucccuagauuaggacucuu

SEQ ID NO: 904340 - RNA, 20 nt, Human
cacuacccuggggugcaugc

SEQ ID NO: 904341 - RNA, 24 nt, Human
cagagcuugggccccaaggaggcu

SEQ ID NO: 904342 - RNA, 20 nt, Human
cagcaccagagaagcugaaa

SEQ ID NO: 904343 - RNA, 22 nt, Human
cagccaugacaucagcuuccuu

SEQ ID NO: 904344 - RNA, 20 nt, Human
cagccauguggccugcuggc

SEQ ID NO: 904345 - RNA, 19 nt, Human
cagccccuugccucccugg

SEQ ID NO: 904346 - RNA, 23 nt, Human
cagccucccacagccucccaccc

SEQ ID NO: 904347 - RNA, 25 nt, Human
cagccucccacagccucccaccccc

SEQ ID NO: 904348 - RNA, 23 nt, Human
cagcuuccucugggccccaagga

SEQ ID NO: 904349 - RNA, 19 nt, Human
cagggaaccaggcaauugu

SEQ ID NO: 904350 - RNA, 18 nt, Human
cagggacacaggugggcc

SEQ ID NO: 904351 - RNA, 25 nt, Human
cagggccccgcccuucccagccccc

SEQ ID NO: 904352 - RNA, 21 nt, Human
caggugauucuagaugucagc

SEQ ID NO: 904353 - RNA, 19 nt, Human
cagucucagccccaccccu

SEQ ID NO: 904354 - RNA, 22 nt, Human
cauaccucugcuaggaacacug

SEQ ID NO: 904355 - RNA, 18 nt, Human
ccaacucucaaccagcag

SEQ ID NO: 904356 - RNA, 23 nt, Human
ccaacuuagcccugccgcccucu

SEQ ID NO: 904357 - RNA, 23 nt, Human
ccauuccuuccagccacuccauc

SEQ ID NO: 904358 - RNA, 21 nt, Human
cccaaggagaaucaggugcac

SEQ ID NO: 904359 - RNA, 18 nt, Human
cccacagccucccacccc

SEQ ID NO: 904360 - RNA, 19 nt, Human
cccacagccucccaccccc

SEQ ID NO: 904361 - RNA, 24 nt, Human
cccaccuucaccuucagagcccac

SEQ ID NO: 904362 - RNA, 24 nt, Human
cccagucucagccccaccccuggc

SEQ ID NO: 904363 - RNA, 21 nt, Human
cccaucacuccucuuucuacc

SEQ ID NO: 904364 - RNA, 19 nt, Human
ccccaccccuggcccucca

SEQ ID NO: 904365 - RNA, 19 nt, Human
cccccucccccaucacucc

SEQ ID NO: 904366 - RNA, 23 nt, Human
ccgcccuucccagcccccaacuc

SEQ ID NO: 904367 - RNA, 18 nt, Human
ccgucucaaaacacagcc

SEQ ID NO: 904368 - RNA, 20 nt, Human
ccgucucaaaacacagccga

SEQ ID NO: 904369 - RNA, 24 nt, Human
ccuagauuaggacucuccuggggc

SEQ ID NO: 904370 - RNA, 19 nt, Human
ccucaggggccugcucucc

SEQ ID NO: 904371 - RNA, 21 nt, Human
ccucauccuugaaauccccag

SEQ ID NO: 904372 - RNA, 18 nt, Human
ccucuuucuaccuugccu

SEQ ID NO: 904373 - RNA, 18 nt, Human
ccugccccgcccugggac

SEQ ID NO: 904374 - RNA, 24 nt, Human
ccugcugggcucucccagucucca

SEQ ID NO: 904375 - RNA, 25 nt, Human
ccuggccagccugagggagaucucg

SEQ ID NO: 904376 - RNA, 23 nt, Human
ccuggggugcaugcuugugcgca

SEQ ID NO: 904377 - RNA, 21 nt, Human
ccuugccuuuuuggcuccagc

SEQ ID NO: 904378 - RNA, 23 nt, Human
ccuugccuuuuuggcuccagcug

SEQ ID NO: 904379 - RNA, 19 nt, Human
cgcagacugaggcgacagc

SEQ ID NO: 904380 - RNA, 21 nt, Human
cgcccucugcucucucuccca

SEQ ID NO: 904381 - RNA, 20 nt, Human
cguauccacuguggcauucu

SEQ ID NO: 904382 - RNA, 21 nt, Human
cucaaaacacagccgacuuuu

SEQ ID NO: 904383 - RNA, 26 nt, Human
cucagccccaccccuggcccuccaca

SEQ ID NO: 904384 - RNA, 21 nt, Human
cuccaccccauucccuagauu

SEQ ID NO: 904385 - RNA, 20 nt, Human
cuccagguggcaggugauuc

SEQ ID NO: 904386 - RNA, 21 nt, Human
cuccaugcuggggccucaucc

SEQ ID NO: 904387 - RNA, 21 nt, Human
cuccucuuucuaccuugccuu

SEQ ID NO: 904388 - RNA, 19 nt, Human
cugcagcucucuugcuguc

SEQ ID NO: 904389 - RNA, 21 nt, Human
cuggcacaggcacccccacgg

SEQ ID NO: 904390 - RNA, 18 nt, Human
cuggggccucauccuuga

SEQ ID NO: 904391 - RNA, 21 nt, Human
cugugccaugucuaccauaga

SEQ ID NO: 904392 - RNA, 22 nt, Human
cuuagaauucccugccccgccc

SEQ ID NO: 904393 - RNA, 18 nt, Human
cuucagagcccaccuccc

SEQ ID NO: 904394 - RNA, 24 nt, Human
cuugccuuuuuggcuccagcugca

SEQ ID NO: 904395 - RNA, 19 nt, Human
gaaacaaucccccuccccc

SEQ ID NO: 904396 - RNA, 19 nt, Human
gaagaacccagugaucacc

SEQ ID NO: 904397 - RNA, 22 nt, Human
gagcagcugcccagacagcuuc

SEQ ID NO: 904398 - RNA, 18 nt, Human
gauccagggagcagagcu

SEQ ID NO: 904399 - RNA, 19 nt, Human
gccaggacccaggcagcag

SEQ ID NO: 904400 - RNA, 21 nt, Human
gccagggccucccucgagcag

SEQ ID NO: 904401 - RNA, 21 nt, Human
gcccaagacacaugcuccgcc

SEQ ID NO: 904402 - RNA, 18 nt, Human
gcccaccuccccauggac

SEQ ID NO: 904403 - RNA, 18 nt, Human
gcccuucccagcccccaa

SEQ ID NO: 904404 - RNA, 21 nt, Human
gccugcucucccaccuucacc

SEQ ID NO: 904405 - RNA, 22 nt, Human
gccugcucucccaccuucaccu

SEQ ID NO: 904406 - RNA, 21 nt, Human
gcuccugcuagcugcgggcac

SEQ ID NO: 904407 - RNA, 22 nt, Human
gcugcaaaaccuggccagccug

SEQ ID NO: 904408 - RNA, 21 nt, Human
ggaaccaggcaauugucucca

SEQ ID NO: 904409 - RNA, 20 nt, Human
ggagguggauuaucugccua

SEQ ID NO: 904410 - RNA, 19 nt, Human
ggcagcacccuaccaaggu

SEQ ID NO: 904411 - RNA, 25 nt, Human
gggccaggacccaggcagcaggagg

SEQ ID NO: 904412 - RNA, 20 nt, Human
gggcuggggggucaccgagg

SEQ ID NO: 904413 - RNA, 18 nt, Human
ggggucaccgaggaggga

SEQ ID NO: 904414 - RNA, 18 nt, Human
ggugggagucaggggagg

SEQ ID NO: 904415 - RNA, 26 nt, Human
gucaccgaggagggauauccggugcc

SEQ ID NO: 904416 - RNA, 24 nt, Human
gucucagccccaccccuggcccuc

SEQ ID NO: 904417 - RNA, 21 nt, Human
gucuuugcccacucuucaagg

SEQ ID NO: 904418 - RNA, 18 nt, Human
gugaaaagaguguggccc

SEQ ID NO: 904419 - RNA, 21 nt, Human
uaagcaggugugggcccaaga

SEQ ID NO: 904420 - RNA, 22 nt, Human
uaagcaggugugggcccaagac

SEQ ID NO: 904421 - RNA, 23 nt, Human
uacacaggaagaggguggcuuug

SEQ ID NO: 904422 - RNA, 22 nt, Human
uacccaggccucaggggccugc

SEQ ID NO: 904423 - RNA, 23 nt, Human
uaccuugccuuuuuggcuccagc

SEQ ID NO: 904424 - RNA, 18 nt, Human
ucaccugccccagggaac

SEQ ID NO: 904425 - RNA, 22 nt, Human
ucagcccagucucagccccacc

SEQ ID NO: 904426 - RNA, 28 nt, Human
uccaagggguugggcuggggggucaccc

SEQ ID NO: 904427 - RNA, 19 nt, Human
uccagccugggaucagagc

SEQ ID NO: 904428 - RNA, 18 nt, Human
uccaugacaggcaugggg

SEQ ID NO: 904429 - RNA, 23 nt, Human
ucccacagccucccacccccagg

SEQ ID NO: 904430 - RNA, 26 nt, Human
ucccagucuccacgggucagguucug

SEQ ID NO: 904431 - RNA, 19 nt, Human
ucccccucccccaucacuc

SEQ ID NO: 904432 - RNA, 21 nt, Human
ucccugaggcagcacccuacc

SEQ ID NO: 904433 - RNA, 23 nt, Human
uccuacaugggugcacaagugcc

SEQ ID NO: 904434 - RNA, 20 nt, Human
uccuuccagccacuccaucc

SEQ ID NO: 904435 - RNA, 20 nt, Human
ucuagaugucagcccagucu

SEQ ID NO: 904436 - RNA, 21 nt, Human
ucucaaaacacagccgacuuu

SEQ ID NO: 904437 - RNA, 21 nt, Human
ugaaaagaguguggcccucau

SEQ ID NO: 904438 - RNA, 20 nt, Human
ugaaacaaucccccuccccc

SEQ ID NO: 904439 - RNA, 20 nt, Human
ugaggugaaaagaguguggc

SEQ ID NO: 904440 - RNA, 22 nt, Human
ugagucagggacacaggugggc

SEQ ID NO: 904441 - RNA, 19 nt, Human
ugauucuagaugucagccc

SEQ ID NO: 904442 - RNA, 19 nt, Human
ugcaccaccccacuggucu

SEQ ID NO: 904443 - RNA, 24 nt, Human
ugccaugucuaccauagaugcccc

SEQ ID NO: 904444 - RNA, 22 nt, Human
ugcccacucuucaagggcuuug

SEQ ID NO: 904445 - RNA, 18 nt, Human
ugccccagggaaccaggc

SEQ ID NO: 904446 - RNA, 21 nt, Human
ugccuagaaagggcagcaggg

SEQ ID NO: 904447 - RNA, 19 nt, Human
ugccugggggauagggagg

SEQ ID NO: 904448 - RNA, 25 nt, Human
ugcuaggaacacuggggacagagca

SEQ ID NO: 904449 - RNA, 20 nt, Human
ugcuagguggcagauccagg

SEQ ID NO: 904450 - RNA, 22 nt, Human
ugcucucccaccuucaccuuca

SEQ ID NO: 904451 - RNA, 19 nt, Human
ugcugggguucaagggugg

SEQ ID NO: 904452 - RNA, 23 nt, Human
uggccagccauguggccugcugg

SEQ ID NO: 904453 - RNA, 20 nt, Human
uggcguauccacuguggcau

SEQ ID NO: 904454 - RNA, 23 nt, Human
uggggacagagcacugggagaga

SEQ ID NO: 904455 - RNA, 22 nt, Human
ugggggaggagggccaggaccc

SEQ ID NO: 904456 - RNA, 19 nt, Human
ugggggugcagauggggga

SEQ ID NO: 904457 - RNA, 25 nt, Human
ugggguggaugggaaggcccacagc

SEQ ID NO: 904458 - RNA, 21 nt, Human
uguggugggguggaugggaag

SEQ ID NO: 904459 - RNA, 20 nt, Human
uucaaggguggaauucuacc

SEQ ID NO: 904460 - RNA, 28 nt, Human
uuccaagggguugggcuggggggucacc

SEQ ID NO: 904461 - RNA, 29 nt, Human
uuccaagggguugggcuggggggucaccc

SEQ ID NO: 904462 - RNA, 19 nt, Human
uugcccacucuucaagggc

SEQ ID NO: 904463 - RNA, 24 nt, Human
uugggccccaaggaggcugccuag

SEQ ID NO: 904464 - RNA, 23 nt, Human
uuucugagcucgggcccaggcug

SEQ ID NO: 904465 - RNA, 22 nt, Human
aguucugucccagugaguccua

SEQ ID NO: 904466 - RNA, 19 nt, Human
aaaagaaugcucugccuuu

SEQ ID NO: 904467 - RNA, 24 nt, Human
aaaaggugucauuuucauauuccu

SEQ ID NO: 904468 - RNA, 21 nt, Human
aaaauagcuaaaauacauugg

SEQ ID NO: 904469 - RNA, 19 nt, Human
aaacagaaagaacccaaag

SEQ ID NO: 904470 - RNA, 27 nt, Human
aaauauccuuucaaacagaaagaaccc

SEQ ID NO: 904471 - RNA, 18 nt, Human
aaaugccacagaugcaga

SEQ ID NO: 904472 - RNA, 18 nt, Human
aagaagaaaacgaagaag

SEQ ID NO: 904473 - RNA, 18 nt, Human
aagagauuugguaaguaa

SEQ ID NO: 904474 - RNA, 23 nt, Human
aagcaaggcucagagucccauag

SEQ ID NO: 904475 - RNA, 18 nt, Human
acacugaggaagaaagcc

SEQ ID NO: 904476 - RNA, 21 nt, Human
acccauacaccauauguaaua

SEQ ID NO: 904477 - RNA, 22 nt, Human
agaagcgaaacaguucagaaca

SEQ ID NO: 904478 - RNA, 20 nt, Human
agacuggcuaacacaacaac

SEQ ID NO: 904479 - RNA, 20 nt, Human
agagacucuuagagaaagag

SEQ ID NO: 904480 - RNA, 19 nt, Human
agagucccauaguuucuuc

SEQ ID NO: 904481 - RNA, 18 nt, Human
agaugccaguguuuuggg

SEQ ID NO: 904482 - RNA, 23 nt, Human
agcgaaccaggccugaaggccca

SEQ ID NO: 904483 - RNA, 18 nt, Human
agcuaccucgccaaggag

SEQ ID NO: 904484 - RNA, 18 nt, Human
agcugugugagugaaaag

SEQ ID NO: 904485 - RNA, 19 nt, Human
aggaaaacaagucaaucca

SEQ ID NO: 904486 - RNA, 23 nt, Human
agguggggggggggacucucagc

SEQ ID NO: 904487 - RNA, 24 nt, Human
agguggggggggggacucucagcc

SEQ ID NO: 904488 - RNA, 21 nt, Human
aggugucauuuucauauuccu

SEQ ID NO: 904489 - RNA, 20 nt, Human
agugaaaaggcaggagugga

SEQ ID NO: 904490 - RNA, 23 nt, Human
auagcaccauucaucagugucuc

SEQ ID NO: 904491 - RNA, 23 nt, Human
aucuaaaugaaaaaaaaaggugg

SEQ ID NO: 904492 - RNA, 25 nt, Human
augggggagcaagaagaaaacgaag

SEQ ID NO: 904493 - RNA, 27 nt, Human
auuggggggagagagagggaaagggag

SEQ ID NO: 904494 - RNA, 22 nt, Human
caaaagaagagcuaaagacagu

SEQ ID NO: 904495 - RNA, 22 nt, Human
caacagacaaaagccccgcucc

SEQ ID NO: 904496 - RNA, 24 nt, Human
caacagacaaaagccccgcucccu

SEQ ID NO: 904497 - RNA, 20 nt, Human
caagaagaaaacgaagaagu

SEQ ID NO: 904498 - RNA, 18 nt, Human
cacacuguuacaaaagcc

SEQ ID NO: 904499 - RNA, 21 nt, Human
cagaaagaacccaaagagaca

SEQ ID NO: 904500 - RNA, 22 nt, Human
cagcaguacacaacugcaacuc

SEQ ID NO: 904501 - RNA, 19 nt, Human
caggaguggaccgguugug

SEQ ID NO: 904502 - RNA, 18 nt, Human
cagggaaacagaguacca

SEQ ID NO: 904503 - RNA, 18 nt, Human
cagucagaagcgaaacag

SEQ ID NO: 904504 - RNA, 18 nt, Human
cagucgggagcuguguga

SEQ ID NO: 904505 - RNA, 26 nt, Human
ccccgcucccuguucacucucucucc

SEQ ID NO: 904506 - RNA, 24 nt, Human
cccgcuaccgugacugcauguccg

SEQ ID NO: 904507 - RNA, 22 nt, Human
ccuacaacacugaggaagaaag

SEQ ID NO: 904508 - RNA, 24 nt, Human
ccuguggcagcaucucggucacuu

SEQ ID NO: 904509 - RNA, 22 nt, Human
cuaacacaacaacauuccauga

SEQ ID NO: 904510 - RNA, 19 nt, Human
cuauucuaacgaaggaggg

SEQ ID NO: 904511 - RNA, 23 nt, Human
cucucucuccucucuacaccuga

SEQ ID NO: 904512 - RNA, 24 nt, Human
cugaagacacaaggaaaacaaguc

SEQ ID NO: 904513 - RNA, 23 nt, Human
cuggcuaacacaacaacauucca

SEQ ID NO: 904514 - RNA, 26 nt, Human
cuuagaacauggaaauaaaaaauaac

SEQ ID NO: 904515 - RNA, 19 nt, Human
cuuucagacuggcuaacac

SEQ ID NO: 904516 - RNA, 21 nt, Human
gaaagaacccaaagagacacc

SEQ ID NO: 904517 - RNA, 22 nt, Human
gaacaaggccugcccugucaaa

SEQ ID NO: 904518 - RNA, 21 nt, Human
gagagacucuuagagaaagag

SEQ ID NO: 904519 - RNA, 18 nt, Human
gauuggggggagagagag

SEQ ID NO: 904520 - RNA, 22 nt, Human
gauuggggggagagagagggaa

SEQ ID NO: 904521 - RNA, 23 nt, Human
ggccaaugggggagcaagaagaa

SEQ ID NO: 904522 - RNA, 18 nt, Human
ggcuacggaaaggaagag

SEQ ID NO: 904523 - RNA, 19 nt, Human
gucuagagaacaacauuca

SEQ ID NO: 904524 - RNA, 23 nt, Human
gucucagguccuguggcagcauc

SEQ ID NO: 904525 - RNA, 23 nt, Human
guggggggggggacucucagccu

SEQ ID NO: 904526 - RNA, 21 nt, Human
guugaaaguccaaaauagcac

SEQ ID NO: 904527 - RNA, 22 nt, Human
uaaaaaauaacuccaucagagc

SEQ ID NO: 904528 - RNA, 25 nt, Human
uaaaauagcuaaaauacauugggua

SEQ ID NO: 904529 - RNA, 22 nt, Human
uaaaugccacagaugcagaaua

SEQ ID NO: 904530 - RNA, 22 nt, Human
uaaguaaauuacaguuuuguga

SEQ ID NO: 904531 - RNA, 19 nt, Human
uaccacaaggaaacaauga

SEQ ID NO: 904532 - RNA, 25 nt, Human
uaccacaaggaaacaaugaguuuca

SEQ ID NO: 904533 - RNA, 21 nt, Human
uagagaacaacauucagggaa

SEQ ID NO: 904534 - RNA, 21 nt, Human
uagcuaaaauacauuggguac

SEQ ID NO: 904535 - RNA, 19 nt, Human
ucaauacccauacaccaua

SEQ ID NO: 904536 - RNA, 27 nt, Human
ucacucucucuccucucuacaccugaa

SEQ ID NO: 904537 - RNA, 22 nt, Human
ucagaacaaggccugcccuguc

SEQ ID NO: 904538 - RNA, 24 nt, Human
ucagguccuguggcagcaucucgg

SEQ ID NO: 904539 - RNA, 18 nt, Human
ucagugucucagguccug

SEQ ID NO: 904540 - RNA, 24 nt, Human
ucuagagaacaacauucagggaaa

SEQ ID NO: 904541 - RNA, 22 nt, Human
ucucuccucucuacaccugaaa

SEQ ID NO: 904542 - RNA, 18 nt, Human
ugaaaaaaaaaggugggg

SEQ ID NO: 904543 - RNA, 24 nt, Human
ugaaaaagggcaacaugcuagaaa

SEQ ID NO: 904544 - RNA, 24 nt, Human
ugaccucaucaauacccauacacc

SEQ ID NO: 904545 - RNA, 20 nt, Human
ugagcguuuucacuugaguc

SEQ ID NO: 904546 - RNA, 24 nt, Human
ugaggaagaaagccacacugaaga

SEQ ID NO: 904547 - RNA, 22 nt, Human
ugcaacucuacauaaaugccac

SEQ ID NO: 904548 - RNA, 21 nt, Human
ugccacagaugcagaauacug

SEQ ID NO: 904549 - RNA, 19 nt, Human
ugccgaaaaaagaaugcuc

SEQ ID NO: 904550 - RNA, 18 nt, Human
uggcagcaucucggucac

SEQ ID NO: 904551 - RNA, 20 nt, Human
ugggagcaaggacaaaaaug

SEQ ID NO: 904552 - RNA, 20 nt, Human
ugguaaguaaauuacaguuu

SEQ ID NO: 904553 - RNA, 20 nt, Human
ugucucagguccuguggcag

SEQ ID NO: 904554 - RNA, 21 nt, Human
uguggcagcaucucggucacu

SEQ ID NO: 904555 - RNA, 20 nt, Human
uguuguagcgaaccaggccu

SEQ ID NO: 904556 - RNA, 19 nt, Human
uugccgaaaaaagaaugcu

SEQ ID NO: 904557 - RNA, 25 nt, Human
uuguuacaucuaaaugaaaaaaaaa

SEQ ID NO: 904558 - RNA, 19 nt, Human
uuucaaacagaaagaaccc

SEQ ID NO: 904559 - RNA, 22 nt, Human
uuuugugauugcucccgcuacc

SEQ ID NO: 904560 - RNA, 19 nt, Human
aacaaugagacccagcugg

SEQ ID NO: 904561 - RNA, 23 nt, Human
aacaccaguauagaaaauacaaa

SEQ ID NO: 904562 - RNA, 19 nt, Human
aagcaggaugauagcauuc

SEQ ID NO: 904563 - RNA, 23 nt, Human
agcccuaaaaaagcggcacagca

SEQ ID NO: 904564 - RNA, 24 nt, Human
agcccuaaaaaagcggcacagcaa

SEQ ID NO: 904565 - RNA, 23 nt, Human
caaauggacaggcaagcaggaug

SEQ ID NO: 904566 - RNA, 18 nt, Human
caaggguuaucucugagc

SEQ ID NO: 904567 - RNA, 19 nt, Human
cacaucuccaaggguuauc

SEQ ID NO: 904568 - RNA, 19 nt, Human
cacaucuccaaggguuauc

SEQ ID NO: 904569 - RNA, 23 nt, Human
caccaguauagaaaauacaaaac

SEQ ID NO: 904570 - RNA, 22 nt, Human
cauaaauaggcaacacaguuaa

SEQ ID NO: 904571 - RNA, 18 nt, Human
cauccagcuggccccaau

SEQ ID NO: 904572 - RNA, 21 nt, Human
ccacaaauggacaggcaagca

SEQ ID NO: 904573 - RNA, 18 nt, Human
ccacaagcucaucuaucu

SEQ ID NO: 904574 - RNA, 27 nt, Human
ccacagaccauccuuuguauucuucaa

SEQ ID NO: 904575 - RNA, 23 nt, Human
cuggaccucucuggcugcaccca

SEQ ID NO: 904576 - RNA, 20 nt, Human
gaaugggcugcauucagccc

SEQ ID NO: 904577 - RNA, 22 nt, Human
uaaaaacauuuauacaggacau

SEQ ID NO: 904578 - RNA, 24 nt, Human
uaccuuauccuacuauaguaauua

SEQ ID NO: 904579 - RNA, 19 nt, Human
uauagaaaauacaaaacua

SEQ ID NO: 904580 - RNA, 20 nt, Human
uauguuuuuuuucccauuca

SEQ ID NO: 904581 - RNA, 22 nt, Human
ucacaauaauacuuauaauuaa

SEQ ID NO: 904582 - RNA, 21 nt, Human
ucacguaagucuacuugcagg

SEQ ID NO: 904583 - RNA, 21 nt, Human
uccuuugaaauccaagucugg

SEQ ID NO: 904584 - RNA, 20 nt, Human
ucuaaaagcaguaaaaacau

SEQ ID NO: 904585 - RNA, 18 nt, Human
ucuaacaccaguauagaa

SEQ ID NO: 904586 - RNA, 21 nt, Human
ucuaauauauuuucccacaga

SEQ ID NO: 904587 - RNA, 23 nt, Human
ucuaucuggaccucucuggcugc

SEQ ID NO: 904588 - RNA, 18 nt, Human
ucucuggcugcacccagg

SEQ ID NO: 904589 - RNA, 23 nt, Human
ucuuugcugcggugugugaggaa

SEQ ID NO: 904590 - RNA, 23 nt, Human
ugcauaaauaggcaacacaguua

SEQ ID NO: 904591 - RNA, 24 nt, Human
ugccaucauuaggacccaacugcu

SEQ ID NO: 904592 - RNA, 19 nt, Human
ugcugguaacuugucuuug

SEQ ID NO: 904593 - RNA, 21 nt, Human
uggucaaaugacucaggauau

SEQ ID NO: 904594 - RNA, 18 nt, Human
uguaaacauauguuuucu

SEQ ID NO: 904595 - RNA, 21 nt, Human
uuaacuaaugcaguucuggaa

SEQ ID NO: 904596 - RNA, 24 nt, Human
uucuucuaaaugugugagcccuaa

SEQ ID NO: 904597 - RNA, 20 nt, Human
uugcggugugaucucuaugu

SEQ ID NO: 904598 - RNA, 22 nt, Human
aaaacaaaaaguagaaacucaa

SEQ ID NO: 904599 - RNA, 20 nt, Human
aaggaacaaaaaguaaugca

SEQ ID NO: 904600 - RNA, 22 nt, Human
aauaaggguccaaaagaagaga

SEQ ID NO: 904601 - RNA, 21 nt, Human
acacauuaaaaaaaacaaaaa

SEQ ID NO: 904602 - RNA, 20 nt, Human
acaucuagcaauguaaaaua

SEQ ID NO: 904603 - RNA, 19 nt, Human
acauuaaaaaaaacaaaaa

SEQ ID NO: 904604 - RNA, 23 nt, Human
agugcucuuguguuuuuaaaaaa

SEQ ID NO: 904605 - RNA, 22 nt, Human
caaaaaguaaugcaagacucaa

SEQ ID NO: 904606 - RNA, 19 nt, Human
cagugcucuuguguuuuua

SEQ ID NO: 904607 - RNA, 22 nt, Human
cgcuaggccccaagacggcgcc

SEQ ID NO: 904608 - RNA, 23 nt, Human
cgcugaugaaguggggugaacac

SEQ ID NO: 904609 - RNA, 23 nt, Human
cggcgccgccugcucggcagcaa

SEQ ID NO: 904610 - RNA, 18 nt, Human
gugaacaccaugccuuua

SEQ ID NO: 904611 - RNA, 23 nt, Human
uaaaauacugacacauuaaaaaa

SEQ ID NO: 904612 - RNA, 27 nt, Human
uaacaucaaucuuacaguacugugcgg

SEQ ID NO: 904613 - RNA, 24 nt, Human
uaggccccaagacggcgccgccug

SEQ ID NO: 904614 - RNA, 19 nt, Human
ugacacauuaaaaaaaaca

SEQ ID NO: 904615 - RNA, 23 nt, Human
ugcaagacucaaaauuuuggagu

SEQ ID NO: 904616 - RNA, 18 nt, Human
uuuuuuuuuuuuuuuuug

SEQ ID NO: 904617 - RNA, 22 nt, Human
uuuuuuuuuuuuuuuuuuguuu

SEQ ID NO: 904618 - RNA, 22 nt, Human
aaaaacacuguagcacgcgcug

SEQ ID NO: 904619 - RNA, 22 nt, Human
aaaacaaaacacacaagugcuu

SEQ ID NO: 904620 - RNA, 19 nt, Human
aaacaaaacacacaagugc

SEQ ID NO: 904621 - RNA, 20 nt, Human
aaacaucacccaucuaaugc

SEQ ID NO: 904622 - RNA, 23 nt, Human
aaacaucacccaucuaaugcuag

SEQ ID NO: 904623 - RNA, 19 nt, Human
aaagacagacacaaaauua

SEQ ID NO: 904624 - RNA, 18 nt, Human
aacccuaggcccuggggg

SEQ ID NO: 904625 - RNA, 20 nt, Human
aagaguuuugugggguuuug

SEQ ID NO: 904626 - RNA, 21 nt, Human
aagggggagaguuaaggaagg

SEQ ID NO: 904627 - RNA, 21 nt, Human
aaucagcuccgaggcagaacu

SEQ ID NO: 904628 - RNA, 23 nt, Human
acacacacgcacacgcacagaca

SEQ ID NO: 904629 - RNA, 20 nt, Human
acagacacaaaauuauaaca

SEQ ID NO: 904630 - RNA, 25 nt, Human
acagggaccccccucagcuuuuccu

SEQ ID NO: 904631 - RNA, 19 nt, Human
acagguuucuaccucccac

SEQ ID NO: 904632 - RNA, 24 nt, Human
acaucaaaaaccaauaaacacaga

SEQ ID NO: 904633 - RNA, 19 nt, Human
accaccaccccgcugccug

SEQ ID NO: 904634 - RNA, 21 nt, Human
acccagcggggcaaaugaucc

SEQ ID NO: 904635 - RNA, 18 nt, Human
accccuuccucuucacuc

SEQ ID NO: 904636 - RNA, 24 nt, Human
acgggcaucucacuagagagccga

SEQ ID NO: 904637 - RNA, 18 nt, Human
agaaagcaaggaaaaauc

SEQ ID NO: 904638 - RNA, 21 nt, Human
agaacacaaacgccagcgccc

SEQ ID NO: 904639 - RNA, 23 nt, Human
agagccccugccacgcccuuccc

SEQ ID NO: 904640 - RNA, 18 nt, Human
agauacucagucaaaaac

SEQ ID NO: 904641 - RNA, 23 nt, Human
agcaguucagaacaucacaaaaa

SEQ ID NO: 904642 - RNA, 18 nt, Human
aggaagaguuuugugggg

SEQ ID NO: 904643 - RNA, 18 nt, Human
aggccccugagaccuccc

SEQ ID NO: 904644 - RNA, 21 nt, Human
agggagcaguucagaacauca

SEQ ID NO: 904645 - RNA, 22 nt, Human
agggagcaguucagaacaucac

SEQ ID NO: 904646 - RNA, 19 nt, Human
agggagggcaaguaugggg

SEQ ID NO: 904647 - RNA, 20 nt, Human
agggcaugaaggggaggaga

SEQ ID NO: 904648 - RNA, 20 nt, Human
aggggaugggaagguggggg

SEQ ID NO: 904649 - RNA, 24 nt, Human
auaaagacagacacaaaauuauaa

SEQ ID NO: 904650 - RNA, 24 nt, Human
auaacaaauauuuaacagcaaaaa

SEQ ID NO: 904651 - RNA, 22 nt, Human
auguccuucauucuucuguguu

SEQ ID NO: 904652 - RNA, 21 nt, Human
caacacagggauccugucagc

SEQ ID NO: 904653 - RNA, 22 nt, Human
caacaucaaaaaccaauaaaca

SEQ ID NO: 904654 - RNA, 21 nt, Human
caaccaccaccccgcugccug

SEQ ID NO: 904655 - RNA, 18 nt, Human
caacccaaucccccugac

SEQ ID NO: 904656 - RNA, 23 nt, Human
caacccuaggcccugggggcugg

SEQ ID NO: 904657 - RNA, 25 nt, Human
caaguugcaauaguuagggaugaua

SEQ ID NO: 904658 - RNA, 19 nt, Human
cacacagguuucuaccucc

SEQ ID NO: 904659 - RNA, 23 nt, Human
caccauguagcuauguugcaagc

SEQ ID NO: 904660 - RNA, 21 nt, Human
caccuggaccagacccagugg

SEQ ID NO: 904661 - RNA, 23 nt, Human
caccuggaccagacccagugggc

SEQ ID NO: 904662 - RNA, 20 nt, Human
cacggcucuucccguccccc

SEQ ID NO: 904663 - RNA, 24 nt, Human
cacucgcccuccccguuccggccc

SEQ ID NO: 904664 - RNA, 24 nt, Human
cagaacaaguagcagcaauaggua

SEQ ID NO: 904665 - RNA, 18 nt, Human
cagaacacaaacgccagc

SEQ ID NO: 904666 - RNA, 24 nt, Human
cagaagaacccguauccuucccca

SEQ ID NO: 904667 - RNA, 22 nt, Human
cagagccccugccacgcccuuc

SEQ ID NO: 904668 - RNA, 22 nt, Human
cagccagccagagcuuucuuca

SEQ ID NO: 904669 - RNA, 18 nt, Human
cagcggggcaaaugaucc

SEQ ID NO: 904670 - RNA, 19 nt, Human
cagcuuuuccuucucugcc

SEQ ID NO: 904671 - RNA, 22 nt, Human
caggagagggaggaggcaaugg

SEQ ID NO: 904672 - RNA, 22 nt, Human
caggaggaggagacgcugaaga

SEQ ID NO: 904673 - RNA, 23 nt, Human
caugcagagccccugccacgccc

SEQ ID NO: 904674 - RNA, 23 nt, Human
ccacacacagguuucuaccuccc

SEQ ID NO: 904675 - RNA, 19 nt, Human
ccacauuccaucuccacca

SEQ ID NO: 904676 - RNA, 19 nt, Human
ccaggaugcuguuccuggg

SEQ ID NO: 904677 - RNA, 18 nt, Human
cccacaaccaccaccccg

SEQ ID NO: 904678 - RNA, 25 nt, Human
cccagccccaugcccccugccccuc

SEQ ID NO: 904679 - RNA, 23 nt, Human
cccaggaggcaucccaaauugcc

SEQ ID NO: 904680 - RNA, 19 nt, Human
cccagggaaggccccugag

SEQ ID NO: 904681 - RNA, 22 nt, Human
ccccaccccugagcugggcuaa

SEQ ID NO: 904682 - RNA, 21 nt, Human
ccccagcauccccaagauucu

SEQ ID NO: 904683 - RNA, 24 nt, Human
ccccagggaaggccccugagaccc

SEQ ID NO: 904684 - RNA, 20 nt, Human
ccccaugcccccugccccuc

SEQ ID NO: 904685 - RNA, 24 nt, Human
cccccaaccccagcuaaaaggguc

SEQ ID NO: 904686 - RNA, 24 nt, Human
cccccuaccaggcuggccaccccc

SEQ ID NO: 904687 - RNA, 20 nt, Human
cccccugccccucaccugga

SEQ ID NO: 904688 - RNA, 21 nt, Human
cccccugccccucaccuggac

SEQ ID NO: 904689 - RNA, 18 nt, Human
ccccguuccggcccccuc

SEQ ID NO: 904690 - RNA, 21 nt, Human
ccccguuccggcccccuccca

SEQ ID NO: 904691 - RNA, 19 nt, Human
ccccugagaccucccagcc

SEQ ID NO: 904692 - RNA, 25 nt, Human
ccccugagaccucccagccccaugc

SEQ ID NO: 904693 - RNA, 21 nt, Human
ccccugccccucaccuggacc

SEQ ID NO: 904694 - RNA, 22 nt, Human
ccccuuccucuucacucacaga

SEQ ID NO: 904695 - RNA, 25 nt, Human
cccgccccgccaagguugacuccug

SEQ ID NO: 904696 - RNA, 24 nt, Human
cccgucagaagaacccguauccuu

SEQ ID NO: 904697 - RNA, 18 nt, Human
cccugccacgcccuuccc

SEQ ID NO: 904698 - RNA, 20 nt, Human
ccgccaagguugacuccugu

SEQ ID NO: 904699 - RNA, 21 nt, Human
ccgccccgccaagguugacuc

SEQ ID NO: 904700 - RNA, 21 nt, Human
ccgcugccugggcugggcuga

SEQ ID NO: 904701 - RNA, 22 nt, Human
ccggcccccucccacacacagg

SEQ ID NO: 904702 - RNA, 19 nt, Human
ccucaccuggaccagaccc

SEQ ID NO: 904703 - RNA, 19 nt, Human
ccugcaaucagcuccgagg

SEQ ID NO: 904704 - RNA, 20 nt, Human
ccugggcagacgcagugggg

SEQ ID NO: 904705 - RNA, 21 nt, Human
ccuucucugcccccuaccagg

SEQ ID NO: 904706 - RNA, 22 nt, Human
cgaaaggaacggagggaaggga

SEQ ID NO: 904707 - RNA, 18 nt, Human
cgauuuucuuguaaaggg

SEQ ID NO: 904708 - RNA, 22 nt, Human
cgcacacgcacagacacgggca

SEQ ID NO: 904709 - RNA, 22 nt, Human
cgccaggacagcuagaacacag

SEQ ID NO: 904710 - RNA, 22 nt, Human
cgcugaagagugcgcccaaggg

SEQ ID NO: 904711 - RNA, 19 nt, Human
cgcugcgcucaccuccccc

SEQ ID NO: 904712 - RNA, 24 nt, Human
cggcucuucccgucccccaacccc

SEQ ID NO: 904713 - RNA, 18 nt, Human
cuaaauaucuauuuugaa

SEQ ID NO: 904714 - RNA, 26 nt, Human
cuacccaggaugcuguuccugggccg

SEQ ID NO: 904715 - RNA, 19 nt, Human
cucacagggaccccccuca

SEQ ID NO: 904716 - RNA, 21 nt, Human
cucagcuuuuccuucucugcc

SEQ ID NO: 904717 - RNA, 23 nt, Human
cuccagaccccagcauccccaag

SEQ ID NO: 904718 - RNA, 18 nt, Human
cucccacaaccaccaccc

SEQ ID NO: 904719 - RNA, 19 nt, Human
cuccccgucagaagaaccc

SEQ ID NO: 904720 - RNA, 20 nt, Human
cucuccuagauacucaguca

SEQ ID NO: 904721 - RNA, 23 nt, Human
cucuucccgucccccaaccccag

SEQ ID NO: 904722 - RNA, 19 nt, Human
cugagaccucccagcccca

SEQ ID NO: 904723 - RNA, 21 nt, Human
cugcggcagccuucccgcagc

SEQ ID NO: 904724 - RNA, 19 nt, Human
cugggcugggcugaggcgg

SEQ ID NO: 904725 - RNA, 21 nt, Human
cuucaggguggcugugagugg

SEQ ID NO: 904726 - RNA, 19 nt, Human
gaaacaucugagacucagg

SEQ ID NO: 904727 - RNA, 21 nt, Human
gaacaggggccaaacaggaaa

SEQ ID NO: 904728 - RNA, 21 nt, Human
gacgcagugggggcgcaggag

SEQ ID NO: 904729 - RNA, 25 nt, Human
gagaccccuuccucuucacucacag

SEQ ID NO: 904730 - RNA, 20 nt, Human
gagcagucugugugguaugg

SEQ ID NO: 904731 - RNA, 18 nt, Human
gagcaguucagaacauca

SEQ ID NO: 904732 - RNA, 19 nt, Human
gagcugaaaggagggacca

SEQ ID NO: 904733 - RNA, 18 nt, Human
gagggcaaagggggagag

SEQ ID NO: 904734 - RNA, 21 nt, Human
gagggugggaaccguggcaua

SEQ ID NO: 904735 - RNA, 21 nt, Human
gaguggcuggagggaagcugg

SEQ ID NO: 904736 - RNA, 21 nt, Human
gauccuucuuuccucccucac

SEQ ID NO: 904737 - RNA, 19 nt, Human
gcccagggccaccagggag

SEQ ID NO: 904738 - RNA, 19 nt, Human
gcccagggccaccagggag

SEQ ID NO: 904739 - RNA, 18 nt, Human
gcugcgcucaccuccccc

SEQ ID NO: 904740 - RNA, 25 nt, Human
gcuggagccagaaggggagcccagu

SEQ ID NO: 904741 - RNA, 22 nt, Human
gcuggccacccccagggaaggc

SEQ ID NO: 904742 - RNA, 18 nt, Human
gcuuucgccucuucccca

SEQ ID NO: 904743 - RNA, 21 nt, Human
ggacgcagcccccgccccgcc

SEQ ID NO: 904744 - RNA, 22 nt, Human
ggagauguucacuccagacccc

SEQ ID NO: 904745 - RNA, 24 nt, Human
ggaggaugcuggggagacagggcc

SEQ ID NO: 904746 - RNA, 22 nt, Human
ggaguggcuggagggaagcugg

SEQ ID NO: 904747 - RNA, 21 nt, Human
ggcagacgcagugggggcgca

SEQ ID NO: 904748 - RNA, 18 nt, Human
ggcagggucacgguggug

SEQ ID NO: 904749 - RNA, 26 nt, Human
ggccugguucagcaggggaugggaag

SEQ ID NO: 904750 - RNA, 19 nt, Human
ggcuagggcaugaagggga

SEQ ID NO: 904751 - RNA, 23 nt, Human
ggcucuucccgucccccaacccc

SEQ ID NO: 904752 - RNA, 18 nt, Human
ggcugggcugaggcgggu

SEQ ID NO: 904753 - RNA, 24 nt, Human
ggcuguguguaacagggccugguu

SEQ ID NO: 904754 - RNA, 24 nt, Human
gggaagcuggagccagaaggggag

SEQ ID NO: 904755 - RNA, 22 nt, Human
gggcagcacaugagccgcgggc

SEQ ID NO: 904756 - RNA, 19 nt, Human
gggccugguucagcagggg

SEQ ID NO: 904757 - RNA, 19 nt, Human
gggccugguucagcagggg

SEQ ID NO: 904758 - RNA, 20 nt, Human
gggcugaggcgggugggucu

SEQ ID NO: 904759 - RNA, 22 nt, Human
gggcugaggcgggugggucuug

SEQ ID NO: 904760 - RNA, 21 nt, Human
gggcugggcugaggcgggugg

SEQ ID NO: 904761 - RNA, 19 nt, Human
ggggaugggaagguggggg

SEQ ID NO: 904762 - RNA, 20 nt, Human
gggggaggggguacaggucc

SEQ ID NO: 904763 - RNA, 18 nt, Human
ggggggaggggguacagg

SEQ ID NO: 904764 - RNA, 23 nt, Human
gggucagggucggucuguggggc

SEQ ID NO: 904765 - RNA, 22 nt, Human
gguggcugugaguggggucagg

SEQ ID NO: 904766 - RNA, 18 nt, Human
guagcacgcgcugacacc

SEQ ID NO: 904767 - RNA, 19 nt, Human
gucagggucggucuguggg

SEQ ID NO: 904768 - RNA, 18 nt, Human
guggcauagggaagggca

SEQ ID NO: 904769 - RNA, 27 nt, Human
uaaaauaauauuauagccaucugggca

SEQ ID NO: 904770 - RNA, 26 nt, Human
uaaacccaaauaaugcccggagccgg

SEQ ID NO: 904771 - RNA, 19 nt, Human
uaaaggaaaaugaaccucc

SEQ ID NO: 904772 - RNA, 19 nt, Human
uaaaugaaacaucugagac

SEQ ID NO: 904773 - RNA, 26 nt, Human
uaaaugaaacaucugagacucaggga

SEQ ID NO: 904774 - RNA, 22 nt, Human
uaacaaauauuuaacagcaaaa

SEQ ID NO: 904775 - RNA, 19 nt, Human
uacaacaucaaaaaccaau

SEQ ID NO: 904776 - RNA, 23 nt, Human
uacccaggaugcuguuccugggc

SEQ ID NO: 904777 - RNA, 18 nt, Human
uagaacacaggcuagggc

SEQ ID NO: 904778 - RNA, 20 nt, Human
uaugaaacacacacgcacac

SEQ ID NO: 904779 - RNA, 19 nt, Human
ucaaaacaaaacacacaag

SEQ ID NO: 904780 - RNA, 23 nt, Human
ucagaacaucacaaaaacacugu

SEQ ID NO: 904781 - RNA, 20 nt, Human
ucagggccagugcacugggg

SEQ ID NO: 904782 - RNA, 23 nt, Human
ucagggcggagggcaaaggggga

SEQ ID NO: 904783 - RNA, 24 nt, Human
uccacacuguuuuuuaguagugga

SEQ ID NO: 904784 - RNA, 23 nt, Human
ucccaaauugccaacacucaaaa

SEQ ID NO: 904785 - RNA, 26 nt, Human
ucccacaaccaccaccccgcugccug

SEQ ID NO: 904786 - RNA, 22 nt, Human
ucccagccccaugcccccugcc

SEQ ID NO: 904787 - RNA, 20 nt, Human
uccuucuuuccucccucaca

SEQ ID NO: 904788 - RNA, 22 nt, Human
ucugaaguuccacuuacugcuc

SEQ ID NO: 904789 - RNA, 18 nt, Human
ucuguguuuucgauuuuc

SEQ ID NO: 904790 - RNA, 20 nt, Human
ugacuccuguucugcuaccc

SEQ ID NO: 904791 - RNA, 22 nt, Human
ugagcaauuuugccaauaaugu

SEQ ID NO: 904792 - RNA, 22 nt, Human
ugagggagccacugaggugcuc

SEQ ID NO: 904793 - RNA, 19 nt, Human
ugccugggcugggcugagg

SEQ ID NO: 904794 - RNA, 20 nt, Human
ugccugggcugggcugaggc

SEQ ID NO: 904795 - RNA, 23 nt, Human
ugccugggcugggcugaggcggg

SEQ ID NO: 904796 - RNA, 21 nt, Human
ugcuucaaucugcaagcccgu

SEQ ID NO: 904797 - RNA, 23 nt, Human
uggacgcagcccccgccccgcca

SEQ ID NO: 904798 - RNA, 22 nt, Human
uggcauagagguggaagggacu

SEQ ID NO: 904799 - RNA, 25 nt, Human
uggcauagggaagggcaaucuccag

SEQ ID NO: 904800 - RNA, 24 nt, Human
ugggccacauuccaucuccaccag

SEQ ID NO: 904801 - RNA, 20 nt, Human
ugggcugggcugaggcgggu

SEQ ID NO: 904802 - RNA, 23 nt, Human
ugggggcgcaggaggaggagacg

SEQ ID NO: 904803 - RNA, 18 nt, Human
uguagcacgcgcugacac

SEQ ID NO: 904804 - RNA, 27 nt, Human
uguaugaaacacacacgcacacgcaca

SEQ ID NO: 904805 - RNA, 21 nt, Human
uguccaaacuggugagggagg

SEQ ID NO: 904806 - RNA, 21 nt, Human
uguguguaacagggccugguu

SEQ ID NO: 904807 - RNA, 20 nt, Human
uucucugcccccuaccaggc

SEQ ID NO: 904808 - RNA, 22 nt, Human
uugacaggagagggaggaggca

SEQ ID NO: 904809 - RNA, 25 nt, Human
uuugaaccauguuuacaauagagca

SEQ ID NO: 904810 - RNA, 23 nt, Human
uuugaauuauaacaaaaauagua

SEQ ID NO: 904811 - RNA, 21 nt, Human
aaacaaacguccaaccaagau

SEQ ID NO: 904812 - RNA, 24 nt, Human
aaaguccauugaucaucacaaaaa

SEQ ID NO: 904813 - RNA, 20 nt, Human
agaaaacaaacguccaacca

SEQ ID NO: 904814 - RNA, 20 nt, Human
aggagaaaacaaacguccaa

SEQ ID NO: 904815 - RNA, 19 nt, Human
aguccauugaucaucacaa

SEQ ID NO: 904816 - RNA, 27 nt, Human
caaaaacccaggaaaugcaacuaagga

SEQ ID NO: 904817 - RNA, 20 nt, Human
cacaaaaacccaggaaaugc

SEQ ID NO: 904818 - RNA, 20 nt, Human
caucacaaaaacccaggaaa

SEQ ID NO: 904819 - RNA, 19 nt, Human
ccaggaaaugcaacuaagg

SEQ ID NO: 904820 - RNA, 20 nt, Human
ccaggaaaugcaacuaagga

SEQ ID NO: 904821 - RNA, 18 nt, Human
ccgcguuccgcuugcccc

SEQ ID NO: 904822 - RNA, 22 nt, Human
cgugcgccuuccaaagcgcucc

SEQ ID NO: 904823 - RNA, 19 nt, Human
gcacaagggggcaggaggg

SEQ ID NO: 904824 - RNA, 18 nt, Human
gcacuggacugcugggug

SEQ ID NO: 904825 - RNA, 19 nt, Human
ggaaacacaggagggaggc

SEQ ID NO: 904826 - RNA, 23 nt, Human
ggccaugggaaacacaggaggga

SEQ ID NO: 904827 - RNA, 19 nt, Human
uaagaacccagagcuaugg

SEQ ID NO: 904828 - RNA, 23 nt, Human
ucacaaaaacccaggaaaugcaa

SEQ ID NO: 904829 - RNA, 20 nt, Human
ugcacuggacugcugggugu

SEQ ID NO: 904830 - RNA, 18 nt, Human
uggggcauggccacuggc

SEQ ID NO: 904831 - RNA, 22 nt, Human
uucgccccgugcgccuuccaaa

SEQ ID NO: 904832 - RNA, 26 nt, Human
uuuuuuuuuuuuuuuugguuguuuuu

SEQ ID NO: 904833 - RNA, 18 nt, Human
uuuuuuuuuuuuuuuuug

SEQ ID NO: 904834 - RNA, 24 nt, Human
aaaacaccugagguacaaaggcac

SEQ ID NO: 904835 - RNA, 19 nt, Human
aacauacaaggaacauaca

SEQ ID NO: 904836 - RNA, 24 nt, Human
aagugccugauccaggcuccugcu

SEQ ID NO: 904837 - RNA, 18 nt, Human
accaggaaggggaaggac

SEQ ID NO: 904838 - RNA, 18 nt, Human
agccuuggggccagggau

SEQ ID NO: 904839 - RNA, 21 nt, Human
aggcaggaagugccugauccg

SEQ ID NO: 904840 - RNA, 19 nt, Human
aggcgcuagacagcuaacu

SEQ ID NO: 904841 - RNA, 23 nt, Human
aggcgcuagacagcuaacucugc

SEQ ID NO: 904842 - RNA, 22 nt, Human
agggaagugucugggcugucca

SEQ ID NO: 904843 - RNA, 23 nt, Human
agggaagugucugggcuguccag

SEQ ID NO: 904844 - RNA, 21 nt, Human
auaaaaacaaacauguaaaca

SEQ ID NO: 904845 - RNA, 23 nt, Human
auaaaaacaaacauguaaacaag

SEQ ID NO: 904846 - RNA, 23 nt, Human
caaaaaucagccugauaggaaca

SEQ ID NO: 904847 - RNA, 24 nt, Human
caccuaaaacaccugagguacaaa

SEQ ID NO: 904848 - RNA, 21 nt, Human
cacuuugauccuagccuuggg

SEQ ID NO: 904849 - RNA, 21 nt, Human
caggaagugccugauccaggc

SEQ ID NO: 904850 - RNA, 18 nt, Human
caggcuccugcugcgaag

SEQ ID NO: 904851 - RNA, 23 nt, Human
cauuuuauuuuuugguaaagcca

SEQ ID NO: 904852 - RNA, 20 nt, Human
ccagggucuuguagacagcg

SEQ ID NO: 904853 - RNA, 19 nt, Human
ccguggacagcuauccccu

SEQ ID NO: 904854 - RNA, 25 nt, Human
cuccagggucuuguagacagcgucc

SEQ ID NO: 904855 - RNA, 23 nt, Human
cugcagccacuuugauccuagcc

SEQ ID NO: 904856 - RNA, 21 nt, Human
gaaggggaaggacagaaaagg

SEQ ID NO: 904857 - RNA, 23 nt, Human
gcaauaccugaggcaggaagugc

SEQ ID NO: 904858 - RNA, 19 nt, Human
gcugcagccacuuugaucc

SEQ ID NO: 904859 - RNA, 18 nt, Human
uaaaaacaaacauguaaa

SEQ ID NO: 904860 - RNA, 25 nt, Human
uaaaacaccugagguacaaaggcac

SEQ ID NO: 904861 - RNA, 20 nt, Human
uaccaggcacguuaucucac

SEQ ID NO: 904862 - RNA, 24 nt, Human
uaccugaggcaggaagugccugau

SEQ ID NO: 904863 - RNA, 18 nt, Human
uagaaaugccauaaaaac

SEQ ID NO: 904864 - RNA, 21 nt, Human
uaguauggucucccucugcuc

SEQ ID NO: 904865 - RNA, 21 nt, Human
ucagaacuuugguucacugaa

SEQ ID NO: 904866 - RNA, 19 nt, Human
uccguggacagcuaucccc

SEQ ID NO: 904867 - RNA, 18 nt, Human
ucucacaccuaaaacacc

SEQ ID NO: 904868 - RNA, 24 nt, Human
ucucacaccuaaaacaccugaggu

SEQ ID NO: 904869 - RNA, 22 nt, Human
ucuuacacaugcagggcacagu

SEQ ID NO: 904870 - RNA, 18 nt, Human
ugaggcaggaagugccug

SEQ ID NO: 904871 - RNA, 22 nt, Human
ugaggcaggaagugccugaucc

SEQ ID NO: 904872 - RNA, 21 nt, Human
uggacagcuauccccuacagu

SEQ ID NO: 904873 - RNA, 19 nt, Human
uggcacaggcugaauggaa

SEQ ID NO: 904874 - RNA, 21 nt, Human
uggggccagggauggcacagg

SEQ ID NO: 904875 - RNA, 20 nt, Human
uguccagcaauaccugaggc

SEQ ID NO: 904876 - RNA, 19 nt, Human
acgccgcgcccccgcgccc

SEQ ID NO: 904877 - RNA, 22 nt, Human
cacgccgcgcccccgcgcccac

SEQ ID NO: 904878 - RNA, 21 nt, Human
ccaccgccgccgccgcuucag

SEQ ID NO: 904879 - RNA, 21 nt, Human
cuucagcccugcagcgugccg

SEQ ID NO: 904880 - RNA, 19 nt, Human
gccgcuucagcccugcagc

SEQ ID NO: 904881 - RNA, 20 nt, Human
guccccaccgccgccgccgc

SEQ ID NO: 904882 - RNA, 20 nt, Human
gugccgcacgccgcgccccc

SEQ ID NO: 904883 - RNA, 21 nt, Human
ucccaagaaaagaaaaugguc

SEQ ID NO: 904884 - RNA, 21 nt, Human
aaaaaugagaucauuucugcc

SEQ ID NO: 904885 - RNA, 21 nt, Human
aaaacacccaaaccugaaaug

SEQ ID NO: 904886 - RNA, 22 nt, Human
aaacaaccaugugauuccaagu

SEQ ID NO: 904887 - RNA, 19 nt, Human
aaacaucuucucuccagag

SEQ ID NO: 904888 - RNA, 21 nt, Human
aaauggcccugaacaaccaag

SEQ ID NO: 904889 - RNA, 18 nt, Human
aagcaacuuuuggcaugu

SEQ ID NO: 904890 - RNA, 22 nt, Human
aagcacuccugcgggugggagg

SEQ ID NO: 904891 - RNA, 21 nt, Human
aagcacugaaauuagccagcc

SEQ ID NO: 904892 - RNA, 22 nt, Human
aagguccuggauucuaaaggag

SEQ ID NO: 904893 - RNA, 20 nt, Human
acaggaaaggacacugcagc

SEQ ID NO: 904894 - RNA, 25 nt, Human
acaguggagggccugggauucugga

SEQ ID NO: 904895 - RNA, 21 nt, Human
acccucagccagcaccacucu

SEQ ID NO: 904896 - RNA, 20 nt, Human
acggcucccgagaacagcag

SEQ ID NO: 904897 - RNA, 19 nt, Human
acuccaugacccgcaaccu

SEQ ID NO: 904898 - RNA, 22 nt, Human
agauucagaaguggccacugca

SEQ ID NO: 904899 - RNA, 24 nt, Human
agcacaagcacugaaauuagccag

SEQ ID NO: 904900 - RNA, 22 nt, Human
agcauccaucaugagaugaaaa

SEQ ID NO: 904901 - RNA, 19 nt, Human
aggaagaacacgugggucc

SEQ ID NO: 904902 - RNA, 24 nt, Human
aggcacagcucaacgccagcuugc

SEQ ID NO: 904903 - RNA, 21 nt, Human
agguagauccagacacugcca

SEQ ID NO: 904904 - RNA, 22 nt, Human
agguccuggauucuaaaggagg

SEQ ID NO: 904905 - RNA, 21 nt, Human
auaagauagaaugcuugacca

SEQ ID NO: 904906 - RNA, 21 nt, Human
auggagcaaacacaguggcag

SEQ ID NO: 904907 - RNA, 18 nt, Human
augggacacaaaacaacc

SEQ ID NO: 904908 - RNA, 23 nt, Human
caacagcauccaucaugagauga

SEQ ID NO: 904909 - RNA, 24 nt, Human
caacagcauccaucaugagaugaa

SEQ ID NO: 904910 - RNA, 21 nt, Human
caaccaagcacaagcacugaa

SEQ ID NO: 904911 - RNA, 22 nt, Human
caagguagauccagacacugcc

SEQ ID NO: 904912 - RNA, 24 nt, Human
cacaaaacaaccaugugauuccaa

SEQ ID NO: 904913 - RNA, 23 nt, Human
cacagaaauaugccccauccaaa

SEQ ID NO: 904914 - RNA, 23 nt, Human
caccaaccaagggcuccuggacc

SEQ ID NO: 904915 - RNA, 23 nt, Human
caccaucugcaccaaccaagggc

SEQ ID NO: 904916 - RNA, 21 nt, Human
cacugaaauuagccagccuuc

SEQ ID NO: 904917 - RNA, 19 nt, Human
cagaaaacacccaaaccug

SEQ ID NO: 904918 - RNA, 23 nt, Human
cagacccucagccagcaccacuc

SEQ ID NO: 904919 - RNA, 28 nt, Human
cagcacagaaauaugccccauccaaagc

SEQ ID NO: 904920 - RNA, 20 nt, Human
cagggguguccuuccaaugu

SEQ ID NO: 904921 - RNA, 22 nt, Human
cagucuuaagagaucuggagaa

SEQ ID NO: 904922 - RNA, 18 nt, Human
caugacccgcaaccuugg

SEQ ID NO: 904923 - RNA, 26 nt, Human
caugcaaggaagaagcacacugccug

SEQ ID NO: 904924 - RNA, 22 nt, Human
cauguuaacauccccagaaaac

SEQ ID NO: 904925 - RNA, 24 nt, Human
ccaggccggguagguggguacaua

SEQ ID NO: 904926 - RNA, 21 nt, Human
ccaguggugggguaagauuug

SEQ ID NO: 904927 - RNA, 19 nt, Human
ccaugacccgcaaccuugg

SEQ ID NO: 904928 - RNA, 24 nt, Human
ccaugcugugggacccacuggguc

SEQ ID NO: 904929 - RNA, 18 nt, Human
cccaaugaucuucccugg

SEQ ID NO: 904930 - RNA, 20 nt, Human
cccacuggguccuaucacca

SEQ ID NO: 904931 - RNA, 21 nt, Human
cccauuccuucaacucaccug

SEQ ID NO: 904932 - RNA, 18 nt, Human
ccccagaaaacacccaaa

SEQ ID NO: 904933 - RNA, 19 nt, Human
ccccagaaaacacccaaac

SEQ ID NO: 904934 - RNA, 21 nt, Human
ccugauccacaggcuuggcac

SEQ ID NO: 904935 - RNA, 20 nt, Human
ccuuccaaugugaagacaaa

SEQ ID NO: 904936 - RNA, 19 nt, Human
cgagaacagcaggaggagg

SEQ ID NO: 904937 - RNA, 26 nt, Human
cuaauaguggcuggaggacucuuccu

SEQ ID NO: 904938 - RNA, 23 nt, Human
cuacauugcacuccuuccauccu

SEQ ID NO: 904939 - RNA, 21 nt, Human
cuccauaucccauuccuucaa

SEQ ID NO: 904940 - RNA, 23 nt, Human
cuccuuccauccuggaagggcca

SEQ ID NO: 904941 - RNA, 18 nt, Human
cucucagacccucagcca

SEQ ID NO: 904942 - RNA, 24 nt, Human
cugaaucccauguuaacaucccca

SEQ ID NO: 904943 - RNA, 19 nt, Human
cugacucccuccuaccaag

SEQ ID NO: 904944 - RNA, 21 nt, Human
cugcaggguagaagguccugg

SEQ ID NO: 904945 - RNA, 21 nt, Human
cuggaccauaaagaauguuga

SEQ ID NO: 904946 - RNA, 19 nt, Human
cuguuugaguucugacauc

SEQ ID NO: 904947 - RNA, 19 nt, Human
gaaccaagcaccaguagga

SEQ ID NO: 904948 - RNA, 19 nt, Human
gaagaacacguggguccag

SEQ ID NO: 904949 - RNA, 20 nt, Human
gaagaacacguggguccaga

SEQ ID NO: 904950 - RNA, 20 nt, Human
gaagggccagagguucaucu

SEQ ID NO: 904951 - RNA, 22 nt, Human
gaccaugggacacaaaacaacc

SEQ ID NO: 904952 - RNA, 22 nt, Human
gagcugaaccaagcaccaguag

SEQ ID NO: 904953 - RNA, 21 nt, Human
gccugaaucccauguuaacau

SEQ ID NO: 904954 - RNA, 22 nt, Human
ggacccacuugacagcgaagga

SEQ ID NO: 904955 - RNA, 20 nt, Human
ggagaaccuggauauacuau

SEQ ID NO: 904956 - RNA, 23 nt, Human
gggggcuguugauauuccugauc

SEQ ID NO: 904957 - RNA, 20 nt, Human
gguaagauuugggguggagc

SEQ ID NO: 904958 - RNA, 20 nt, Human
ggugcauuuuaaaaaucaaa

SEQ ID NO: 904959 - RNA, 22 nt, Human
gguuaggggcauccaggggugu

SEQ ID NO: 904960 - RNA, 23 nt, Human
guacauaaauggagcaaacacag

SEQ ID NO: 904961 - RNA, 20 nt, Human
gucuuaagagaucuggagaa

SEQ ID NO: 904962 - RNA, 19 nt, Human
guggaaguggauguggcuc

SEQ ID NO: 904963 - RNA, 23 nt, Human
uaaaacaucuucucuccagaggg

SEQ ID NO: 904964 - RNA, 25 nt, Human
uaaauaaaccuuacagagauucaga

SEQ ID NO: 904965 - RNA, 24 nt, Human
uaacauccccagaaaacacccaaa

SEQ ID NO: 904966 - RNA, 22 nt, Human
uacauuggacaugcccaacagc

SEQ ID NO: 904967 - RNA, 19 nt, Human
uaccuguguucuagaaugc

SEQ ID NO: 904968 - RNA, 19 nt, Human
uagauccagacacugccac

SEQ ID NO: 904969 - RNA, 20 nt, Human
uagugguuaggggcauccag

SEQ ID NO: 904970 - RNA, 23 nt, Human
uaucuucgugggggacccacuug

SEQ ID NO: 904971 - RNA, 24 nt, Human
uauguuggaagcaacuuuuggcaa

SEQ ID NO: 904972 - RNA, 23 nt, Human
ucacuugggggcacacuugcauc

SEQ ID NO: 904973 - RNA, 27 nt, Human
ucagacccccuggugcugaaagugcca

SEQ ID NO: 904974 - RNA, 18 nt, Human
uccaucaugagaugaaaa

SEQ ID NO: 904975 - RNA, 18 nt, Human
ucccauggucagcccagg

SEQ ID NO: 904976 - RNA, 20 nt, Human
uccccaggccucuauaguac

SEQ ID NO: 904977 - RNA, 19 nt, Human
ucuacaguucuguaaucuc

SEQ ID NO: 904978 - RNA, 19 nt, Human
ucuagaaugcauccaaaac

SEQ ID NO: 904979 - RNA, 24 nt, Human
ucuauaggcacagcucaacgccag

SEQ ID NO: 904980 - RNA, 20 nt, Human
ucuucgugggggacccacuu

SEQ ID NO: 904981 - RNA, 23 nt, Human
ucuuuaggugaccaaccagaccc

SEQ ID NO: 904982 - RNA, 24 nt, Human
ugaaauggcccugaacaaccaagc

SEQ ID NO: 904983 - RNA, 21 nt, Human
ugaaauuagccagccuuccca

SEQ ID NO: 904984 - RNA, 19 nt, Human
ugacaacaucauguugacu

SEQ ID NO: 904985 - RNA, 19 nt, Human
ugacaucacauucuacaug

SEQ ID NO: 904986 - RNA, 21 nt, Human
ugaccaugggacacaaaacaa

SEQ ID NO: 904987 - RNA, 22 nt, Human
ugacccacacucuaggugacau

SEQ ID NO: 904988 - RNA, 18 nt, Human
ugacccgcaaccuuggcg

SEQ ID NO: 904989 - RNA, 21 nt, Human
ugacuacauugcacuccuucc

SEQ ID NO: 904990 - RNA, 24 nt, Human
ugacucccuccuaccaagguagau

SEQ ID NO: 904991 - RNA, 19 nt, Human
ugagccuguuugaguucug

SEQ ID NO: 904992 - RNA, 24 nt, Human
ugcaggaagcacuccugcgggugg

SEQ ID NO: 904993 - RNA, 19 nt, Human
ugcaggguagaagguccug

SEQ ID NO: 904994 - RNA, 19 nt, Human
uggccuaauaguggcugga

SEQ ID NO: 904995 - RNA, 21 nt, Human
ugggauucuggaguaaggcca

SEQ ID NO: 904996 - RNA, 18 nt, Human
uggguccagauaccaagg

SEQ ID NO: 904997 - RNA, 20 nt, Human
uguccugcucucagacccuc

SEQ ID NO: 904998 - RNA, 18 nt, Human
uguccuuccaaugugaag

SEQ ID NO: 904999 - RNA, 22 nt, Human
uucauugacaacaucauguuga

SEQ ID NO: 905000 - RNA, 18 nt, Human
uucccugguagggcucua

SEQ ID NO: 905001 - RNA, 22 nt, Human
uucuacauguagguguauugcu

SEQ ID NO: 905002 - RNA, 23 nt, Human
uugcacuucucuccccaaaccac

SEQ ID NO: 905003 - RNA, 20 nt, Human
uuguaauguaaaaaugagau

SEQ ID NO: 905004 - RNA, 24 nt, Human
uuugacccacacucuaggugacau

SEQ ID NO: 905005 - RNA, 19 nt, Human
aaccggagccccccagccu

SEQ ID NO: 905006 - RNA, 20 nt, Human
aagggaggcugaaggcucau

SEQ ID NO: 905007 - RNA, 21 nt, Human
aaguagccaaggaagggggga

SEQ ID NO: 905008 - RNA, 21 nt, Human
agaaggggagaugcaggagga

SEQ ID NO: 905009 - RNA, 22 nt, Human
agcacuaaguuuucucucuccu

SEQ ID NO: 905010 - RNA, 27 nt, Human
agcacuaaguuuucucucuccugaggg

SEQ ID NO: 905011 - RNA, 23 nt, Human
aggagcagcauuacaaagggagg

SEQ ID NO: 905012 - RNA, 21 nt, Human
aggaggaaggggagguauagc

SEQ ID NO: 905013 - RNA, 20 nt, Human
aggcacaacuacccuccccu

SEQ ID NO: 905014 - RNA, 28 nt, Human
agguauagcgggggaugagccgguaccc

SEQ ID NO: 905015 - RNA, 18 nt, Human
augggacaaggaggaaga

SEQ ID NO: 905016 - RNA, 21 nt, Human
auggugcugggcaguggagag

SEQ ID NO: 905017 - RNA, 18 nt, Human
augucaaaguagccaagg

SEQ ID NO: 905018 - RNA, 23 nt, Human
caaaguagccaaggaagggggga

SEQ ID NO: 905019 - RNA, 20 nt, Human
cacuaaguuuucucucuccu

SEQ ID NO: 905020 - RNA, 18 nt, Human
cagguaguucccaaguga

SEQ ID NO: 905021 - RNA, 21 nt, Human
caugaaggcuccaagaagggc

SEQ ID NO: 905022 - RNA, 22 nt, Human
ccagcauggaggggggaguggg

SEQ ID NO: 905023 - RNA, 23 nt, Human
cccagccccgggcccggcuccgc

SEQ ID NO: 905024 - RNA, 18 nt, Human
ccccgggcccggcuccgc

SEQ ID NO: 905025 - RNA, 20 nt, Human
ccccgggcccggcuccgcuc

SEQ ID NO: 905026 - RNA, 20 nt, Human
ccccuggaccaugaaggcuc

SEQ ID NO: 905027 - RNA, 18 nt, Human
cccggcuccgcuccugcc

SEQ ID NO: 905028 - RNA, 21 nt, Human
ccuaggaguccccagagcugg

SEQ ID NO: 905029 - RNA, 22 nt, Human
ccucagggaaccggagcccccc

SEQ ID NO: 905030 - RNA, 19 nt, Human
ccugagggggaaggaaaga

SEQ ID NO: 905031 - RNA, 19 nt, Human
cuccaagaagggcuggaag

SEQ ID NO: 905032 - RNA, 22 nt, Human
cuccugagggggaaggaaagaa

SEQ ID NO: 905033 - RNA, 21 nt, Human
cugggcaguggagaggagcag

SEQ ID NO: 905034 - RNA, 21 nt, Human
gaaagaaggggagaugcagga

SEQ ID NO: 905035 - RNA, 20 nt, Human
gaaggcuccaagaagggcug

SEQ ID NO: 905036 - RNA, 20 nt, Human
gacaaggaggaagacaggag

SEQ ID NO: 905037 - RNA, 20 nt, Human
gaggaaggggagguauagcg

SEQ ID NO: 905038 - RNA, 20 nt, Human
gccccgggcccggcuccgcu

SEQ ID NO: 905039 - RNA, 20 nt, Human
ggaaagaaggggagaugcag

SEQ ID NO: 905040 - RNA, 25 nt, Human
ggaaccggagccccccagccugugg

SEQ ID NO: 905041 - RNA, 27 nt, Human
ggaggaaggggagguauagcgggggau

SEQ ID NO: 905042 - RNA, 19 nt, Human
guccccagagcuggggggu

SEQ ID NO: 905043 - RNA, 21 nt, Human
guggagaggagcagcauuaca

SEQ ID NO: 905044 - RNA, 18 nt, Human
uacaaagggaggcugaag

SEQ ID NO: 905045 - RNA, 23 nt, Human
uaggcacaacuacccuccccuca

SEQ ID NO: 905046 - RNA, 22 nt, Human
ucagcccugaacagagggcaga

SEQ ID NO: 905047 - RNA, 23 nt, Human
ucagcccugaacagagggcagaa

SEQ ID NO: 905048 - RNA, 18 nt, Human
ucauguccaugguccugg

SEQ ID NO: 905049 - RNA, 21 nt, Human
ucccaagugaccuaggagucc

SEQ ID NO: 905050 - RNA, 21 nt, Human
uccccagagcuggggggugug

SEQ ID NO: 905051 - RNA, 22 nt, Human
ucccucagggaaccggagcccc

SEQ ID NO: 905052 - RNA, 18 nt, Human
ucuccugagggggaagga

SEQ ID NO: 905053 - RNA, 22 nt, Human
ugaaggcuccaagaagggcugg

SEQ ID NO: 905054 - RNA, 19 nt, Human
ugcaggaggaaggggaggg

SEQ ID NO: 905055 - RNA, 18 nt, Human
ugcucaggccaguggggc

SEQ ID NO: 905056 - RNA, 21 nt, Human
uggcaugcucaggccaguggg

SEQ ID NO: 905057 - RNA, 19 nt, Human
ugggacaaggaggaagaca

SEQ ID NO: 905058 - RNA, 21 nt, Human
uggggccccuaccccuggacc

SEQ ID NO: 905059 - RNA, 22 nt, Human
uggggcuugugucagcccugaa

SEQ ID NO: 905060 - RNA, 23 nt, Human
ugggggguguggccuucauggga

SEQ ID NO: 905061 - RNA, 21 nt, Human
ugucagcccugaacagagggc

SEQ ID NO: 905062 - RNA, 18 nt, Human
uuuuuuuuuuucagaccc

SEQ ID NO: 905063 - RNA, 22 nt, Human
uuuuuuuuuuuuuuuuuuucag

SEQ ID NO: 905064 - RNA, 24 nt, Human
aagcaagaguuaaauauaaaccca

SEQ ID NO: 905065 - RNA, 20 nt, Human
acccugccucgggcuucagc

SEQ ID NO: 905066 - RNA, 26 nt, Human
agcaucuaccaccccuucagagcaac

SEQ ID NO: 905067 - RNA, 21 nt, Human
agucuccaccaacugagcagc

SEQ ID NO: 905068 - RNA, 19 nt, Human
auccuccccagccccuccu

SEQ ID NO: 905069 - RNA, 27 nt, Human
auccuccccagccccuccucccagcug

SEQ ID NO: 905070 - RNA, 19 nt, Human
cagcugaggaggggcaaug

SEQ ID NO: 905071 - RNA, 22 nt, Human
cauugcuuggucugaacagauu

SEQ ID NO: 905072 - RNA, 19 nt, Human
ccaauucagagaaagcccg

SEQ ID NO: 905073 - RNA, 19 nt, Human
ccccucagcgagggaccgg

SEQ ID NO: 905074 - RNA, 22 nt, Human
ccccuccucccagcugggcuga

SEQ ID NO: 905075 - RNA, 18 nt, Human
cccuccucccagcugggc

SEQ ID NO: 905076 - RNA, 20 nt, Human
ccuccccagccccuccuccc

SEQ ID NO: 905077 - RNA, 23 nt, Human
cgagcuaacagcagcuucuggga

SEQ ID NO: 905078 - RNA, 22 nt, Human
cgaggaccggcgagcuaacagc

SEQ ID NO: 905079 - RNA, 23 nt, Human
cggaaguaacgcuaggggaaggg

SEQ ID NO: 905080 - RNA, 18 nt, Human
gagcaacuuccaacaugg

SEQ ID NO: 905081 - RNA, 21 nt, Human
gagccgcacgaacccccucag

SEQ ID NO: 905082 - RNA, 21 nt, Human
gcugacuccagucccagcccc

SEQ ID NO: 905083 - RNA, 22 nt, Human
gcugggcugacuccagucccag

SEQ ID NO: 905084 - RNA, 24 nt, Human
ggagaggaagcucgcauugcuugg

SEQ ID NO: 905085 - RNA, 21 nt, Human
gggagcggggcaggggggugg

SEQ ID NO: 905086 - RNA, 21 nt, Human
gggcagggggguggcaggggc

SEQ ID NO: 905087 - RNA, 18 nt, Human
ggggcagggggguggcag

SEQ ID NO: 905088 - RNA, 19 nt, Human
uagcauuaaauaacacucu

SEQ ID NO: 905089 - RNA, 19 nt, Human
uagcauuaaauaacacucu

SEQ ID NO: 905090 - RNA, 19 nt, Human
uaucacaaggaccugaaaa

SEQ ID NO: 905091 - RNA, 21 nt, Human
uauuaaagcaguuaaacuuag

SEQ ID NO: 905092 - RNA, 24 nt, Human
ucccagccccagucuccaccaacu

SEQ ID NO: 905093 - RNA, 19 nt, Human
ugaggaggggcaauggugg

SEQ ID NO: 905094 - RNA, 21 nt, Human
ugaggaggggcaaugguggga

SEQ ID NO: 905095 - RNA, 25 nt, Human
ugccucgggcuucagcugcagaucc

SEQ ID NO: 905096 - RNA, 24 nt, Human
uggcuuccagcaucuaccaccccu

SEQ ID NO: 905097 - RNA, 19 nt, Human
ugggauggugcaacccuau

SEQ ID NO: 905098 - RNA, 21 nt, Human
uggugggagcggggcaggggg

SEQ ID NO: 905099 - RNA, 22 nt, Human
uuaaaugguacaccuaugaagc

SEQ ID NO: 905100 - RNA, 24 nt, Human
uucagagcaacuuccaacauggga

SEQ ID NO: 905101 - RNA, 21 nt, Human
uucagcugcagauccucccca

SEQ ID NO: 905102 - RNA, 19 nt, Human
uugcuuggucugaacagau

SEQ ID NO: 905103 - RNA, 23 nt, Human
uuuccuguuuucuccucaccacu

SEQ ID NO: 905104 - RNA, 26 nt, Human
uuuccuguuuucuccucaccacuuuc

SEQ ID NO: 905105 - RNA, 22 nt, Human
aaaaaaaaaaaaaaaggcaaaa

SEQ ID NO: 905106 - RNA, 24 nt, Human
aaaaaaaaaaaaaaaggcaaaauu

SEQ ID NO: 905107 - RNA, 24 nt, Human
aaaaaaaggaagaaaaggaaaaag

SEQ ID NO: 905108 - RNA, 23 nt, Human
aaaaaagcuuccaauuuugugga

SEQ ID NO: 905109 - RNA, 19 nt, Human
aaaaagccaggaaggcccg

SEQ ID NO: 905110 - RNA, 23 nt, Human
aaaacuucugccccuaacacucc

SEQ ID NO: 905111 - RNA, 23 nt, Human
aaagaaaaaagccaggaaggccc

SEQ ID NO: 905112 - RNA, 18 nt, Human
aaagggaaugauuaggga

SEQ ID NO: 905113 - RNA, 24 nt, Human
aaagggaaugauuagggaaaagga

SEQ ID NO: 905114 - RNA, 18 nt, Human
aacugaagagagaagaca

SEQ ID NO: 905115 - RNA, 20 nt, Human
aacuucugccccuaacacuc

SEQ ID NO: 905116 - RNA, 19 nt, Human
aacuugggcaucucguacc

SEQ ID NO: 905117 - RNA, 24 nt, Human
aagacaccaaccuuaaaauacugc

SEQ ID NO: 905118 - RNA, 27 nt, Human
aaggaugaggaaggaggagggaaggga

SEQ ID NO: 905119 - RNA, 18 nt, Human
acagacaugccacaaggc

SEQ ID NO: 905120 - RNA, 20 nt, Human
acagagcggcagaagaacag

SEQ ID NO: 905121 - RNA, 21 nt, Human
acagagcggcagaagaacaga

SEQ ID NO: 905122 - RNA, 19 nt, Human
acccaaauuguccagcccc

SEQ ID NO: 905123 - RNA, 26 nt, Human
acccaaauuguccagcccccaaacac

SEQ ID NO: 905124 - RNA, 25 nt, Human
accucagcgguugaacaaaggguca

SEQ ID NO: 905125 - RNA, 18 nt, Human
accuccaucacuaauccc

SEQ ID NO: 905126 - RNA, 18 nt, Human
acuucuccucauucuucu

SEQ ID NO: 905127 - RNA, 27 nt, Human
agaagaacagaucgcagcagugugaaa

SEQ ID NO: 905128 - RNA, 20 nt, Human
agacgguauugcacauucuc

SEQ ID NO: 905129 - RNA, 23 nt, Human
agagagaagacagagcggcagaa

SEQ ID NO: 905130 - RNA, 18 nt, Human
agaggggauagauuagaa

SEQ ID NO: 905131 - RNA, 19 nt, Human
agaggggauagauuagaau

SEQ ID NO: 905132 - RNA, 24 nt, Human
agccagacgguauugcacauucuc

SEQ ID NO: 905133 - RNA, 21 nt, Human
agccaggaaggcccguagggc

SEQ ID NO: 905134 - RNA, 22 nt, Human
agcccagacacuggcugcaucu

SEQ ID NO: 905135 - RNA, 27 nt, Human
agccugguccacuccgucuucccacag

SEQ ID NO: 905136 - RNA, 20 nt, Human
agcgcuuaaaaaaaaaaaaa

SEQ ID NO: 905137 - RNA, 20 nt, Human
aggaaggaggagggaaggga

SEQ ID NO: 905138 - RNA, 20 nt, Human
aggaggagggaagggaggag

SEQ ID NO: 905139 - RNA, 20 nt, Human
aggcaagaugacuugugggg

SEQ ID NO: 905140 - RNA, 20 nt, Human
aggcacugcaugcgacagaa

SEQ ID NO: 905141 - RNA, 24 nt, Human
aggcaggaccuaguuucaauccuc

SEQ ID NO: 905142 - RNA, 23 nt, Human
agggaaaggacucagcucagggc

SEQ ID NO: 905143 - RNA, 20 nt, Human
agggaagggaggagguggaa

SEQ ID NO: 905144 - RNA, 22 nt, Human
agggaggaaagaaaaaagccag

SEQ ID NO: 905145 - RNA, 22 nt, Human
agggcuuagauucuccccagga

SEQ ID NO: 905146 - RNA, 20 nt, Human
aggggagguggcagggcagg

SEQ ID NO: 905147 - RNA, 21 nt, Human
agguagggugcuauucguccu

SEQ ID NO: 905148 - RNA, 23 nt, Human
aucuuuacaaagcaguucuauag

SEQ ID NO: 905149 - RNA, 24 nt, Human
auggggaaggugugcaguucaugu

SEQ ID NO: 905150 - RNA, 21 nt, Human
caaagcacagagggcaaagaa

SEQ ID NO: 905151 - RNA, 22 nt, Human
caaauaagaaccucuguccccu

SEQ ID NO: 905152 - RNA, 21 nt, Human
caaauaucauaagcuaaugaa

SEQ ID NO: 905153 - RNA, 23 nt, Human
caaggcaaucagugaugaaaaaa

SEQ ID NO: 905154 - RNA, 19 nt, Human
cacuccgucuucccacagu

SEQ ID NO: 905155 - RNA, 20 nt, Human
cacucgacuauaggcuuucc

SEQ ID NO: 905156 - RNA, 19 nt, Human
cacugaacaaagggaggac

SEQ ID NO: 905157 - RNA, 20 nt, Human
cagagggugaaagaauaggc

SEQ ID NO: 905158 - RNA, 20 nt, Human
cagcucagggcagggcaggg

SEQ ID NO: 905159 - RNA, 23 nt, Human
cagcugggaccccuacugcaauc

SEQ ID NO: 905160 - RNA, 23 nt, Human
cagcuucuauguaacugacccuu

SEQ ID NO: 905161 - RNA, 19 nt, Human
caggaccuaguuucaaucc

SEQ ID NO: 905162 - RNA, 18 nt, Human
caguaccaaacacugcca

SEQ ID NO: 905163 - RNA, 21 nt, Human
ccaagauacagaaaggcagga

SEQ ID NO: 905164 - RNA, 19 nt, Human
ccacaaggcaagaugacuu

SEQ ID NO: 905165 - RNA, 18 nt, Human
ccaccacuuacagucagg

SEQ ID NO: 905166 - RNA, 21 nt, Human
ccagcccccaaacacccacag

SEQ ID NO: 905167 - RNA, 23 nt, Human
ccaguacaggcacugcaugcgac

SEQ ID NO: 905168 - RNA, 22 nt, Human
ccaucuccccugugaccucagc

SEQ ID NO: 905169 - RNA, 23 nt, Human
cccaagauacagaaaggcaggac

SEQ ID NO: 905170 - RNA, 23 nt, Human
cccccagccucucaucuccuggc

SEQ ID NO: 905171 - RNA, 22 nt, Human
cccucucccaccacuuacaguc

SEQ ID NO: 905172 - RNA, 19 nt, Human
ccuaagcaggcacucgacu

SEQ ID NO: 905173 - RNA, 19 nt, Human
ccucugagcaccucugagc

SEQ ID NO: 905174 - RNA, 21 nt, Human
ccucugagcaccucugagcuu

SEQ ID NO: 905175 - RNA, 24 nt, Human
ccucugagcaccucugagcuuggg

SEQ ID NO: 905176 - RNA, 25 nt, Human
ccucugagcaccucugagcuugggg

SEQ ID NO: 905177 - RNA, 19 nt, Human
ccuggcucccagggaaagg

SEQ ID NO: 905178 - RNA, 20 nt, Human
ccuucuggaggaguggggag

SEQ ID NO: 905179 - RNA, 23 nt, Human
cuaggacggggguggggguaggg

SEQ ID NO: 905180 - RNA, 21 nt, Human
cuccuagucauguccuacuuu

SEQ ID NO: 905181 - RNA, 23 nt, Human
cucugcugagaacauucccccca

SEQ ID NO: 905182 - RNA, 25 nt, Human
cugacccugaggggauaaaaacagg

SEQ ID NO: 905183 - RNA, 22 nt, Human
cugauuguguacccccagccuc

SEQ ID NO: 905184 - RNA, 23 nt, Human
cuguuuggcuuugagcaguuggu

SEQ ID NO: 905185 - RNA, 21 nt, Human
cuuagauucuccccaggaccu

SEQ ID NO: 905186 - RNA, 20 nt, Human
cuucaaaaacagccuggucc

SEQ ID NO: 905187 - RNA, 18 nt, Human
cuuuauauauauauauau

SEQ ID NO: 905188 - RNA, 21 nt, Human
gaaaaauacucaaaaaaccca

SEQ ID NO: 905189 - RNA, 20 nt, Human
gaagagagaagacagagcgg

SEQ ID NO: 905190 - RNA, 19 nt, Human
gaagggaggagguggaagg

SEQ ID NO: 905191 - RNA, 18 nt, Human
gaauuugggguaagggag

SEQ ID NO: 905192 - RNA, 19 nt, Human
gacagaaguugggggaaug

SEQ ID NO: 905193 - RNA, 20 nt, Human
gaccucauucugaccucuau

SEQ ID NO: 905194 - RNA, 18 nt, Human
gagagaagacagagcggc

SEQ ID NO: 905195 - RNA, 18 nt, Human
gaggaagaggcuagacag

SEQ ID NO: 905196 - RNA, 19 nt, Human
gaggagggaagggaggagg

SEQ ID NO: 905197 - RNA, 19 nt, Human
gagguggcagggcagggcg

SEQ ID NO: 905198 - RNA, 18 nt, Human
gauuccaccaucuccccu

SEQ ID NO: 905199 - RNA, 22 nt, Human
gcaaaaccaaacaauuuaucca

SEQ ID NO: 905200 - RNA, 20 nt, Human
gcagagguccuaagcugguu

SEQ ID NO: 905201 - RNA, 18 nt, Human
gcaucucugcuccuuuaa

SEQ ID NO: 905202 - RNA, 19 nt, Human
gcguguguuuucuugcuga

SEQ ID NO: 905203 - RNA, 21 nt, Human
gcucaaugaauuugggguaag

SEQ ID NO: 905204 - RNA, 19 nt, Human
gcuucuggagccagagagg

SEQ ID NO: 905205 - RNA, 22 nt, Human
ggaaaacauuuaucucuguguc

SEQ ID NO: 905206 - RNA, 19 nt, Human
ggaggaguggggagaaaag

SEQ ID NO: 905207 - RNA, 20 nt, Human
ggcacugggguguggggagu

SEQ ID NO: 905208 - RNA, 25 nt, Human
gggaaaaggaacaaaaguaaaauau

SEQ ID NO: 905209 - RNA, 18 nt, Human
gggaagggaggaggugga

SEQ ID NO: 905210 - RNA, 23 nt, Human
gggauaaaaacagggaagauucc

SEQ ID NO: 905211 - RNA, 18 nt, Human
ggggagaagaaaggguaa

SEQ ID NO: 905212 - RNA, 24 nt, Human
ggggagagggagacguaacagaaa

SEQ ID NO: 905213 - RNA, 25 nt, Human
ggguaagaaaucaaaccucagcggu

SEQ ID NO: 905214 - RNA, 20 nt, Human
ggguggggugagggagaauu

SEQ ID NO: 905215 - RNA, 22 nt, Human
guaccaaacacugccacccaaa

SEQ ID NO: 905216 - RNA, 20 nt, Human
uaaaaaaagcuuccaauuuu

SEQ ID NO: 905217 - RNA, 23 nt, Human
uaaaaaaagcuuccaauuuugug

SEQ ID NO: 905218 - RNA, 19 nt, Human
uaaaauaaucccagaccca

SEQ ID NO: 905219 - RNA, 19 nt, Human
uaaccccccucccucuccc

SEQ ID NO: 905220 - RNA, 18 nt, Human
uacaaaaaaaaaaaaaaa

SEQ ID NO: 905221 - RNA, 20 nt, Human
uaccauacauauauccaaaa

SEQ ID NO: 905222 - RNA, 23 nt, Human
uaccucugagcaccucugagcuu

SEQ ID NO: 905223 - RNA, 22 nt, Human
uagauuagaauuuuuaaaagca

SEQ ID NO: 905224 - RNA, 23 nt, Human
uagcauaaaacaacuuuagaaac

SEQ ID NO: 905225 - RNA, 25 nt, Human
uagcucuuucucccaccccaccucc

SEQ ID NO: 905226 - RNA, 21 nt, Human
uagucaagaagcagcuucuau

SEQ ID NO: 905227 - RNA, 19 nt, Human
uagugccucuggggaugga

SEQ ID NO: 905228 - RNA, 22 nt, Human
uaucaagaagcaucuuuacaaa

SEQ ID NO: 905229 - RNA, 18 nt, Human
uaucauugaacugaaugu

SEQ ID NO: 905230 - RNA, 21 nt, Human
uauuccagggagagagggagu

SEQ ID NO: 905231 - RNA, 23 nt, Human
ucacuaccuguuacuagcaucua

SEQ ID NO: 905232 - RNA, 22 nt, Human
ucaggugacuuucaagggcaaa

SEQ ID NO: 905233 - RNA, 23 nt, Human
uccacccaacuugugggacaccc

SEQ ID NO: 905234 - RNA, 23 nt, Human
uccaccucacuguuaaagaaaac

SEQ ID NO: 905235 - RNA, 22 nt, Human
ucccacagugugggcaaauggg

SEQ ID NO: 905236 - RNA, 19 nt, Human
uccccaggcucuuuccccu

SEQ ID NO: 905237 - RNA, 18 nt, Human
uccccggaaaaauacuca

SEQ ID NO: 905238 - RNA, 23 nt, Human
uccccggaaaaauacucaaaaaa

SEQ ID NO: 905239 - RNA, 25 nt, Human
ucccugggaagaguaugaaaauggg

SEQ ID NO: 905240 - RNA, 21 nt, Human
uccucaggugacuuucaaggg

SEQ ID NO: 905241 - RNA, 21 nt, Human
uccuuguuauaacaucucggc

SEQ ID NO: 905242 - RNA, 23 nt, Human
ucuaucagagguaaagauccacc

SEQ ID NO: 905243 - RNA, 19 nt, Human
ucucccaccccaccuccaa

SEQ ID NO: 905244 - RNA, 28 nt, Human
ucugcagcuggugcagcagaguaaggac

SEQ ID NO: 905245 - RNA, 23 nt, Human
ucugccccuaacacuccuaguca

SEQ ID NO: 905246 - RNA, 24 nt, Human
ucuuucuucccgucuucuccuccu

SEQ ID NO: 905247 - RNA, 18 nt, Human
ugaaagaauaggcaaaua

SEQ ID NO: 905248 - RNA, 22 nt, Human
ugaacaaagggaggacacacaa

SEQ ID NO: 905249 - RNA, 18 nt, Human
ugagggagggaggaagag

SEQ ID NO: 905250 - RNA, 18 nt, Human
ugaggggauaaaaacagg

SEQ ID NO: 905251 - RNA, 18 nt, Human
ugcaguucaugugugugu

SEQ ID NO: 905252 - RNA, 18 nt, Human
ugcucaaugaauuugggg

SEQ ID NO: 905253 - RNA, 21 nt, Human
ugcuccaaacagagggucuuu

SEQ ID NO: 905254 - RNA, 20 nt, Human
uggaacagccguuccucugu

SEQ ID NO: 905255 - RNA, 20 nt, Human
uggagagaaggguuaugccu

SEQ ID NO: 905256 - RNA, 20 nt, Human
uggccuggcucccagggaaa

SEQ ID NO: 905257 - RNA, 23 nt, Human
ugggaaaaauacuuauuccaggg

SEQ ID NO: 905258 - RNA, 26 nt, Human
ugggacacccagcaaacagccuugga

SEQ ID NO: 905259 - RNA, 25 nt, Human
ugggaugcuaaucuccccagucccc

SEQ ID NO: 905260 - RNA, 24 nt, Human
ugggggaaugaaagaggaaaggga

SEQ ID NO: 905261 - RNA, 19 nt, Human
ugggggcgggcggggggca

SEQ ID NO: 905262 - RNA, 23 nt, Human
ugggggcgggcggggggcagugg

SEQ ID NO: 905263 - RNA, 22 nt, Human
uguccagcccccaaacacccac

SEQ ID NO: 905264 - RNA, 20 nt, Human
uguccuuagggcaugagguu

SEQ ID NO: 905265 - RNA, 21 nt, Human
ugugggaaaaauacuuauucc

SEQ ID NO: 905266 - RNA, 18 nt, Human
uguggggaguagaggcca

SEQ ID NO: 905267 - RNA, 24 nt, Human
uguuaaagaaaacugaagagagaa

SEQ ID NO: 905268 - RNA, 21 nt, Human
uguuuggcuuugagcaguugg

SEQ ID NO: 905269 - RNA, 20 nt, Human
uuaaaaaaaaaaaaaaaaaa

SEQ ID NO: 905270 - RNA, 21 nt, Human
uuaaaaaaaaaaaaaaaaaaa

SEQ ID NO: 905271 - RNA, 26 nt, Human
uuagaaacacacaucggagggcuuag

SEQ ID NO: 905272 - RNA, 31 nt, Human
uuagagcccaacuucaguaccaaacacugcu

SEQ ID NO: 905273 - RNA, 24 nt, Human
uuagcucuuucucccaccccaccu

SEQ ID NO: 905274 - RNA, 21 nt, Human
uucaaaaacagccugguccac

SEQ ID NO: 905275 - RNA, 22 nt, Human
uucuauggguaaauuccagagu

SEQ ID NO: 905276 - RNA, 22 nt, Human
uuggcagcugggaccccuacug

SEQ ID NO: 905277 - RNA, 20 nt, Human
uuuaaaauaaucccagaccc

SEQ ID NO: 905278 - RNA, 19 nt, Human
uuuaaaggggaaaggaaag

SEQ ID NO: 905279 - RNA, 23 nt, Human
uuuuauggggaaggugugcaguu

SEQ ID NO: 905280 - RNA, 19 nt, Human
cacacacccaagcuguggc

SEQ ID NO: 905281 - RNA, 23 nt, Human
cacccaagcuguggcugccgugc

SEQ ID NO: 905282 - RNA, 18 nt, Human
caucuugcacuuuugcua

SEQ ID NO: 905283 - RNA, 18 nt, Human
cccaagcuguggcugccg

SEQ ID NO: 905284 - RNA, 19 nt, Human
cccgggccucuccacuccc

SEQ ID NO: 905285 - RNA, 20 nt, Human
cccgggccucuccacucccu

SEQ ID NO: 905286 - RNA, 20 nt, Human
cccugccucucuucuucucc

SEQ ID NO: 905287 - RNA, 22 nt, Human
cccugccucucuucuucuccua

SEQ ID NO: 905288 - RNA, 20 nt, Human
ccuccuuccuccgcaguccc

SEQ ID NO: 905289 - RNA, 20 nt, Human
ccuggaggagccccaguucu

SEQ ID NO: 905290 - RNA, 23 nt, Human
ccuggaggagccccaguucugac

SEQ ID NO: 905291 - RNA, 24 nt, Human
ccuguccuggguccuccuuccucc

SEQ ID NO: 905292 - RNA, 18 nt, Human
cugccucucuucuucucc

SEQ ID NO: 905293 - RNA, 18 nt, Human
cuggccccgggccucucc

SEQ ID NO: 905294 - RNA, 24 nt, Human
cuggccccgggccucuccacuccc

SEQ ID NO: 905295 - RNA, 21 nt, Human
cuuccuggcucugccccucca

SEQ ID NO: 905296 - RNA, 18 nt, Human
gagccccaguuucuucug

SEQ ID NO: 905297 - RNA, 22 nt, Human
gcacuuuugcuaggguuggagg

SEQ ID NO: 905298 - RNA, 21 nt, Human
gccccgggccucuccacuccc

SEQ ID NO: 905299 - RNA, 19 nt, Human
gcuggguguaguguccaug

SEQ ID NO: 905300 - RNA, 19 nt, Human
ggcucugccccuccauucc

SEQ ID NO: 905301 - RNA, 19 nt, Human
gguccuccuuccuccgcag

SEQ ID NO: 905302 - RNA, 18 nt, Human
ucccagccucucacuccc

SEQ ID NO: 905303 - RNA, 19 nt, Human
ucccagccucucacucccc

SEQ ID NO: 905304 - RNA, 24 nt, Human
uccugguagccccucagagacuca

SEQ ID NO: 905305 - RNA, 21 nt, Human
ucuauuuauuguugcugccac

SEQ ID NO: 905306 - RNA, 23 nt, Human
ucuugcacuuuugcuaggguugg

SEQ ID NO: 905307 - RNA, 20 nt, Human
ugccucucuucuucuccuaa

SEQ ID NO: 905308 - RNA, 20 nt, Human
uggcaagccggccuggaucc

SEQ ID NO: 905309 - RNA, 18 nt, Human
ugggggguguggcaagcc

SEQ ID NO: 905310 - RNA, 23 nt, Human
ugucucugcuuuccuggccccgg

SEQ ID NO: 905311 - RNA, 18 nt, Human
uuaacaaggaugaacaca

SEQ ID NO: 905312 - RNA, 22 nt, Human
uuccuggcucugccccuccauu

SEQ ID NO: 905313 - RNA, 21 nt, Human
uucugggggaucuuccuggcu

SEQ ID NO: 905314 - RNA, 23 nt, Human
uucuguagcuuucuuuucugggg

SEQ ID NO: 905315 - RNA, 26 nt, Human
uuuaacaaggaugaacacacacccaa

SEQ ID NO: 905316 - RNA, 19 nt, Human
uuuauuguugcugccaccc

SEQ ID NO: 905317 - RNA, 22 nt, Human
uuuuuuuuuuuuuuaacaagga

SEQ ID NO: 905318 - RNA, 25 nt, Human
uuuuuuuuuuuuuuuuuuaacaagg

SEQ ID NO: 905319 - RNA, 22 nt, Human
aaaaccaguggaccucuuauca

SEQ ID NO: 905320 - RNA, 23 nt, Human
aaaccaguggaccucuuaucaaa

SEQ ID NO: 905321 - RNA, 24 nt, Human
caguuuuaauaaaaagaaaaaaaa

SEQ ID NO: 905322 - RNA, 26 nt, Human
cuucucggcugcgcgugcccgccacu

SEQ ID NO: 905323 - RNA, 22 nt, Human
uaucacaguuuuaauaaaaaga

SEQ ID NO: 905324 - RNA, 23 nt, Human
uaucacaguuuuaauaaaaagaa

SEQ ID NO: 905325 - RNA, 19 nt, Human
aaaagcaacaggauuugga

SEQ ID NO: 905326 - RNA, 23 nt, Human
aaaauucuuuacauauaaagcuu

SEQ ID NO: 905327 - RNA, 21 nt, Human
aaacaguuacacagcaucuug

SEQ ID NO: 905328 - RNA, 22 nt, Human
aaauagcagaaacuaaaggaau

SEQ ID NO: 905329 - RNA, 19 nt, Human
aagcugccaaacagucacu

SEQ ID NO: 905330 - RNA, 20 nt, Human
aaucaaauuugauaacccga

SEQ ID NO: 905331 - RNA, 19 nt, Human
aaugcacaagacagcugcc

SEQ ID NO: 905332 - RNA, 19 nt, Human
acccaggacugcgcagcag

SEQ ID NO: 905333 - RNA, 24 nt, Human
agcaacaugucccacaacuuuggu

SEQ ID NO: 905334 - RNA, 23 nt, Human
agcagaaacuaaaggaaucaugg

SEQ ID NO: 905335 - RNA, 23 nt, Human
agccaucuauucauuccuccagc

SEQ ID NO: 905336 - RNA, 21 nt, Human
agucacugcuugugccagcag

SEQ ID NO: 905337 - RNA, 23 nt, Human
agucccauucuuugcaugcucca

SEQ ID NO: 905338 - RNA, 21 nt, Human
augguuguugcugagcugugu

SEQ ID NO: 905339 - RNA, 21 nt, Human
auuaacacauaaugcaaguuu

SEQ ID NO: 905340 - RNA, 20 nt, Human
cacccaggacugcgcagcag

SEQ ID NO: 905341 - RNA, 21 nt, Human
cagaauacaaaguacuuaaua

SEQ ID NO: 905342 - RNA, 20 nt, Human
cagagagacugaaugcaccc

SEQ ID NO: 905343 - RNA, 19 nt, Human
cagcaacaugucccacaac

SEQ ID NO: 905344 - RNA, 20 nt, Human
cagcugcccuccagugucag

SEQ ID NO: 905345 - RNA, 22 nt, Human
caguaauacugacagacuucaa

SEQ ID NO: 905346 - RNA, 20 nt, Human
ccaggaggcaggcagaggca

SEQ ID NO: 905347 - RNA, 18 nt, Human
ccagugucaggauccugu

SEQ ID NO: 905348 - RNA, 19 nt, Human
cccuuguagacuauaucug

SEQ ID NO: 905349 - RNA, 27 nt, Human
ccgacuaaaaauauuuuccagcuuuau

SEQ ID NO: 905350 - RNA, 25 nt, Human
ccugaauuuaaaaaacuaaugaaag

SEQ ID NO: 905351 - RNA, 25 nt, Human
cugaaacagccaucuauucauuccu

SEQ ID NO: 905352 - RNA, 21 nt, Human
gaacacaaguaaugcacaaga

SEQ ID NO: 905353 - RNA, 20 nt, Human
gaaugcacccaggacugcgc

SEQ ID NO: 905354 - RNA, 25 nt, Human
gcaccaagaucuucuaaaauucuuu

SEQ ID NO: 905355 - RNA, 21 nt, Human
gcagucuacagcaacaugucc

SEQ ID NO: 905356 - RNA, 21 nt, Human
gugaauggcagccugucuuca

SEQ ID NO: 905357 - RNA, 20 nt, Human
uaaaguggggaccaggaggc

SEQ ID NO: 905358 - RNA, 19 nt, Human
uaacuguuaccaucaaaau

SEQ ID NO: 905359 - RNA, 24 nt, Human
uaauacugacagacuucaaaagca

SEQ ID NO: 905360 - RNA, 24 nt, Human
uaauauccagaacccugaauuuaa

SEQ ID NO: 905361 - RNA, 23 nt, Human
uacacagcaucuuguacugucaa

SEQ ID NO: 905362 - RNA, 23 nt, Human
uacagcaacaugucccacaacuu

SEQ ID NO: 905363 - RNA, 21 nt, Human
uagacuauaucugcugaucau

SEQ ID NO: 905364 - RNA, 23 nt, Human
uagcagaaacuaaaggaaucaug

SEQ ID NO: 905365 - RNA, 27 nt, Human
uagcagaaacuaaaggaaucauggcag

SEQ ID NO: 905366 - RNA, 27 nt, Human
uagcagcaccaagaucuucuaaaauuc

SEQ ID NO: 905367 - RNA, 22 nt, Human
uagcuuaacugaaacagccauc

SEQ ID NO: 905368 - RNA, 23 nt, Human
uagcuuaacugaaacagccaucu

SEQ ID NO: 905369 - RNA, 24 nt, Human
uauguaggcucagauaguagcaau

SEQ ID NO: 905370 - RNA, 19 nt, Human
ucauuccagaaucaucuuu

SEQ ID NO: 905371 - RNA, 21 nt, Human
uccacagaaaaauagcagaaa

SEQ ID NO: 905372 - RNA, 22 nt, Human
uccagaauacaaaguacuuaau

SEQ ID NO: 905373 - RNA, 23 nt, Human
uccugugaaacagcauaucaaaa

SEQ ID NO: 905374 - RNA, 22 nt, Human
ucuaaacuugaagcugccaaac

SEQ ID NO: 905375 - RNA, 19 nt, Human
ucuaccauugguccugggg

SEQ ID NO: 905376 - RNA, 21 nt, Human
ucuuuauuuaaaaauaccagu

SEQ ID NO: 905377 - RNA, 20 nt, Human
ugaaacagcauaucaaaaga

SEQ ID NO: 905378 - RNA, 23 nt, Human
ugcgcagcagucuacagcaacau

SEQ ID NO: 905379 - RNA, 30 nt, Human
ugcugggaacacaaguaaugcacaagacaa

SEQ ID NO: 905380 - RNA, 26 nt, Human
ugggaacacaaguaaugcacaagaca

SEQ ID NO: 905381 - RNA, 28 nt, Human
uucacuuuuauuacuaauaaccccuagg

SEQ ID NO: 905382 - RNA, 21 nt, Human
uucuucuuuauuuaaaaauac

SEQ ID NO: 905383 - RNA, 23 nt, Human
uugcuguauuaaaacaguuacac

SEQ ID NO: 905384 - RNA, 19 nt, Human
uuucaaacaaaguuagcgu

SEQ ID NO: 905385 - RNA, 20 nt, Human
uuuuuuuuuuuuuuuuuugg

SEQ ID NO: 905386 - RNA, 23 nt, Human
aaaaaaaacuugugaauuagcau

SEQ ID NO: 905387 - RNA, 27 nt, Human
aaaaaaaguggaggaauaccgguaccc

SEQ ID NO: 905388 - RNA, 23 nt, Human
aaaaagccaaggcaggcaguggg

SEQ ID NO: 905389 - RNA, 24 nt, Human
aaaaagguaauacaaaaaauagaa

SEQ ID NO: 905390 - RNA, 25 nt, Human
aaaaagguaauacaaaaaauagaaa

SEQ ID NO: 905391 - RNA, 27 nt, Human
aaaaggacacacacaauaauuuacaag

SEQ ID NO: 905392 - RNA, 21 nt, Human
aaaaugaaacaagaauacaaa

SEQ ID NO: 905393 - RNA, 24 nt, Human
aaacaagaauacaaauaaagaaaa

SEQ ID NO: 905394 - RNA, 22 nt, Human
aaaggaagcuaaaagcagacuc

SEQ ID NO: 905395 - RNA, 18 nt, Human
aaauaaccccuuaucaca

SEQ ID NO: 905396 - RNA, 23 nt, Human
aagagauaacaaguuuaauagaa

SEQ ID NO: 905397 - RNA, 22 nt, Human
aagccaaggcaggcaaaaggaa

SEQ ID NO: 905398 - RNA, 18 nt, Human
aagcuaaaagcagacuca

SEQ ID NO: 905399 - RNA, 21 nt, Human
aagcuaaaagcagacucagaa

SEQ ID NO: 905400 - RNA, 22 nt, Human
aauacaaaaaauagaaaaauaa

SEQ ID NO: 905401 - RNA, 23 nt, Human
aauacaaaaaauagaaaaauaag

SEQ ID NO: 905402 - RNA, 18 nt, Human
aaugaggagaacaggaaa

SEQ ID NO: 905403 - RNA, 19 nt, Human
agagauaacaaguuuaaua

SEQ ID NO: 905404 - RNA, 21 nt, Human
agcagugauagggagggggga

SEQ ID NO: 905405 - RNA, 20 nt, Human
agcccaaacuaaggaggcac

SEQ ID NO: 905406 - RNA, 19 nt, Human
aggaaaaaauaugaaaaga

SEQ ID NO: 905407 - RNA, 21 nt, Human
aggagaacaggaaacugcaag

SEQ ID NO: 905408 - RNA, 23 nt, Human
aggcaggcaaaaggaagcuaagg

SEQ ID NO: 905409 - RNA, 27 nt, Human
aggcaggcaaugaggagaacaggaaac

SEQ ID NO: 905410 - RNA, 19 nt, Human
aggcucgaggcagguccgg

SEQ ID NO: 905411 - RNA, 20 nt, Human
agggaggggggacaggcggg

SEQ ID NO: 905412 - RNA, 21 nt, Human
agggaggggggacaggcgggg

SEQ ID NO: 905413 - RNA, 23 nt, Human
agucaaaaguacuaucaaaucug

SEQ ID NO: 905414 - RNA, 20 nt, Human
auaccaaaucucuuaggaaa

SEQ ID NO: 905415 - RNA, 19 nt, Human
auagaaacagcuuauuguc

SEQ ID NO: 905416 - RNA, 18 nt, Human
augaaacaagaauacaaa

SEQ ID NO: 905417 - RNA, 21 nt, Human
auggucaaagagcuaacaaaa

SEQ ID NO: 905418 - RNA, 18 nt, Human
auucuaaaaugaauaaag

SEQ ID NO: 905419 - RNA, 20 nt, Human
caaaaaaaguacaaaaugac

SEQ ID NO: 905420 - RNA, 19 nt, Human
caaaaggaagcuaaaagca

SEQ ID NO: 905421 - RNA, 21 nt, Human
caaaaggaagcuaaaagcaga

SEQ ID NO: 905422 - RNA, 19 nt, Human
caaacagcuguucacgaac

SEQ ID NO: 905423 - RNA, 27 nt, Human
caagcagccaagacauaaagaaaacca

SEQ ID NO: 905424 - RNA, 21 nt, Human
caccaacuaaggcugaaacaa

SEQ ID NO: 905425 - RNA, 22 nt, Human
caccaacuaaggcugaaacaaa

SEQ ID NO: 905426 - RNA, 24 nt, Human
cacgaacagaaaaagccaaggcag

SEQ ID NO: 905427 - RNA, 19 nt, Human
cagaaaaagccaaggcagg

SEQ ID NO: 905428 - RNA, 22 nt, Human
cagauuucuaaggauauuacau

SEQ ID NO: 905429 - RNA, 20 nt, Human
cagccaagacauaaagaaaa

SEQ ID NO: 905430 - RNA, 18 nt, Human
caguagagauaaaacaua

SEQ ID NO: 905431 - RNA, 26 nt, Human
caguagagauaaaacauauucuaaug

SEQ ID NO: 905432 - RNA, 24 nt, Human
caucaaaaaaaguacaaaaugaca

SEQ ID NO: 905433 - RNA, 24 nt, Human
caucaaaaaaaguacaaaaugaca

SEQ ID NO: 905434 - RNA, 20 nt, Human
ccaaacagcuguucacgaac

SEQ ID NO: 905435 - RNA, 20 nt, Human
ccaagacauaaagaaaacca

SEQ ID NO: 905436 - RNA, 18 nt, Human
ccaaggcaggcaaaagga

SEQ ID NO: 905437 - RNA, 18 nt, Human
ccagcgcagaccgauggg

SEQ ID NO: 905438 - RNA, 25 nt, Human
ccagcgcagaccgaugggcuggggu

SEQ ID NO: 905439 - RNA, 22 nt, Human
cccaaacuaaggaggcaccaac

SEQ ID NO: 905440 - RNA, 19 nt, Human
ccggagagacugacuggca

SEQ ID NO: 905441 - RNA, 21 nt, Human
cgaacagaaaaagccaaggca

SEQ ID NO: 905442 - RNA, 23 nt, Human
cgaggcagguccggagagacuga

SEQ ID NO: 905443 - RNA, 21 nt, Human
cgaugggcugggguuucucuc

SEQ ID NO: 905444 - RNA, 18 nt, Human
cgcagaccgaugggcugg

SEQ ID NO: 905445 - RNA, 19 nt, Human
cgcaggacaguccaacgga

SEQ ID NO: 905446 - RNA, 24 nt, Human
cgcgagaaacccggaaccgugcua

SEQ ID NO: 905447 - RNA, 24 nt, Human
cggagggaccaagagccaguagca

SEQ ID NO: 905448 - RNA, 21 nt, Human
cuaaaaggacuugaacuggua

SEQ ID NO: 905449 - RNA, 22 nt, Human
gaaaaaauaugaaaagauauuu

SEQ ID NO: 905450 - RNA, 22 nt, Human
gaagaagggcagaugcgcggcg

SEQ ID NO: 905451 - RNA, 22 nt, Human
gagaaacccggaaccgugcuaa

SEQ ID NO: 905452 - RNA, 21 nt, Human
gagcacugggaggagguucuc

SEQ ID NO: 905453 - RNA, 20 nt, Human
gcagaccgaugggcuggggu

SEQ ID NO: 905454 - RNA, 20 nt, Human
ggagggaccaagagccagua

SEQ ID NO: 905455 - RNA, 20 nt, Human
ggcaaugaggagaacaggaa

SEQ ID NO: 905456 - RNA, 21 nt, Human
ggcgcggugauuucagcagcc

SEQ ID NO: 905457 - RNA, 24 nt, Human
gggcugggguuucucuccgcagga

SEQ ID NO: 905458 - RNA, 19 nt, Human
ggggcggagucagcgaaga

SEQ ID NO: 905459 - RNA, 18 nt, Human
ggucaaagagcuaacaaa

SEQ ID NO: 905460 - RNA, 27 nt, Human
ggugauuucagcagccugaggcucgag

SEQ ID NO: 905461 - RNA, 21 nt, Human
guacugacuucucaaaaacaa

SEQ ID NO: 905462 - RNA, 18 nt, Human
gucuggccagaugcgggg

SEQ ID NO: 905463 - RNA, 23 nt, Human
uaaaacccgaagguaaaauauua

SEQ ID NO: 905464 - RNA, 22 nt, Human
uaaaauaaccccuuaucacaaa

SEQ ID NO: 905465 - RNA, 27 nt, Human
uaaccccuuaucacaaaggagcccaaa

SEQ ID NO: 905466 - RNA, 22 nt, Human
uaacggcaauauugaacaaacc

SEQ ID NO: 905467 - RNA, 22 nt, Human
uaaggaggcaccaacuaaggcu

SEQ ID NO: 905468 - RNA, 20 nt, Human
uaaguguaauaugaauggaa

SEQ ID NO: 905469 - RNA, 22 nt, Human
uaauuuucaagcagccaagaca

SEQ ID NO: 905470 - RNA, 19 nt, Human
uagggaggggggacaggcg

SEQ ID NO: 905471 - RNA, 19 nt, Human
uaugaaaagauauuuacac

SEQ ID NO: 905472 - RNA, 21 nt, Human
ucacauauguuuuccccugcu

SEQ ID NO: 905473 - RNA, 20 nt, Human
ucagaagaaccauguugaca

SEQ ID NO: 905474 - RNA, 18 nt, Human
ucagcagccugaggcucg

SEQ ID NO: 905475 - RNA, 21 nt, Human
ucagcgaagaagggcagaugc

SEQ ID NO: 905476 - RNA, 25 nt, Human
ucccagcgcagaccgaugggcuggg

SEQ ID NO: 905477 - RNA, 20 nt, Human
uccgcaggacaguccaacgg

SEQ ID NO: 905478 - RNA, 20 nt, Human
ucuuugaagagaaaaaaggc

SEQ ID NO: 905479 - RNA, 22 nt, Human
ugaaaagauauuuacacauuga

SEQ ID NO: 905480 - RNA, 26 nt, Human
ugaaacaagaauacaaauaaagaaaa

SEQ ID NO: 905481 - RNA, 26 nt, Human
ugacuucucaaaaacaaguuagaacu

SEQ ID NO: 905482 - RNA, 19 nt, Human
ugagaaaacaccaauaugc

SEQ ID NO: 905483 - RNA, 18 nt, Human
ugcuaaguaacuucccgc

SEQ ID NO: 905484 - RNA, 23 nt, Human
ugcuaaguaacuucccgcuuccu

SEQ ID NO: 905485 - RNA, 18 nt, Human
uggaaggcaggcaaugag

SEQ ID NO: 905486 - RNA, 19 nt, Human
uggaaggcaggcaaugagg

SEQ ID NO: 905487 - RNA, 22 nt, Human
uggaaggcaggcaaugaggaga

SEQ ID NO: 905488 - RNA, 25 nt, Human
ugggucagcucugacgcgaggcggg

SEQ ID NO: 905489 - RNA, 18 nt, Human
uuaauugcaucacauaug

SEQ ID NO: 905490 - RNA, 23 nt, Human
uucacauuuuuugaaaaaacauu

SEQ ID NO: 905491 - RNA, 18 nt, Human
uucacgaacagaaaaagc

SEQ ID NO: 905492 - RNA, 25 nt, Human
uucacgaacagaaaaagccaaggca

SEQ ID NO: 905493 - RNA, 21 nt, Human
uucucuaagcuaugggccaaa

SEQ ID NO: 905494 - RNA, 25 nt, Human
uuuacaaugagcaugucuuauguuu

SEQ ID NO: 905495 - RNA, 22 nt, Human
uuucacaguucucauauaaugg

SEQ ID NO: 905496 - RNA, 19 nt, Human
uuucuaguuuugcauuuuu

SEQ ID NO: 905497 - RNA, 18 nt, Human
uuuuuuuuuuuuuuuuug

SEQ ID NO: 905498 - RNA, 21 nt, Human
aaagagcauucccaauagaaa

SEQ ID NO: 905499 - RNA, 24 nt, Human
aaaggaacuguuaaacugaaaaag

SEQ ID NO: 905500 - RNA, 21 nt, Human
aaaggagagacaaagucaaga

SEQ ID NO: 905501 - RNA, 23 nt, Human
aacggagugaaugcauagcuggu

SEQ ID NO: 905502 - RNA, 26 nt, Human
aagcaagaauagagugaaaagggacc

SEQ ID NO: 905503 - RNA, 23 nt, Human
aagcaguuuacaaacgaaacuca

SEQ ID NO: 905504 - RNA, 19 nt, Human
aaggaacuguuaaacugaa

SEQ ID NO: 905505 - RNA, 18 nt, Human
aaggagagacaaagucaa

SEQ ID NO: 905506 - RNA, 18 nt, Human
aaucuguagacaaaccuc

SEQ ID NO: 905507 - RNA, 23 nt, Human
acgcucaaaaucuguagacaaac

SEQ ID NO: 905508 - RNA, 22 nt, Human
acguggcuggcugaggcuccug

SEQ ID NO: 905509 - RNA, 20 nt, Human
acguuccccccacccccgcc

SEQ ID NO: 905510 - RNA, 21 nt, Human
acguuccccccacccccgccg

SEQ ID NO: 905511 - RNA, 20 nt, Human
acuacugcaaagacgcgggc

SEQ ID NO: 905512 - RNA, 21 nt, Human
agacaaaccucccaauccguc

SEQ ID NO: 905513 - RNA, 27 nt, Human
agacacagacacagguccacuuuccaa

SEQ ID NO: 905514 - RNA, 24 nt, Human
agacacagguccacuuuccaagca

SEQ ID NO: 905515 - RNA, 22 nt, Human
agacaucugcucacuggaaacg

SEQ ID NO: 905516 - RNA, 23 nt, Human
agaggccccaggcccacugagcc

SEQ ID NO: 905517 - RNA, 18 nt, Human
agaugcauuugcuugaaa

SEQ ID NO: 905518 - RNA, 20 nt, Human
agcaccugcucccgggcgac

SEQ ID NO: 905519 - RNA, 23 nt, Human
agccagacgugugccugaaugcc

SEQ ID NO: 905520 - RNA, 21 nt, Human
aggagacccagccggccagcc

SEQ ID NO: 905521 - RNA, 20 nt, Human
aggagagacaaagucaagaa

SEQ ID NO: 905522 - RNA, 24 nt, Human
aggccaacaggcacagugggcggg

SEQ ID NO: 905523 - RNA, 21 nt, Human
aggcuccugggcccgccgccu

SEQ ID NO: 905524 - RNA, 25 nt, Human
agguucccccacguuccccccaccc

SEQ ID NO: 905525 - RNA, 25 nt, Human
agguucccccacguuccccccaccc

SEQ ID NO: 905526 - RNA, 19 nt, Human
augacagucuaaucuaaag

SEQ ID NO: 905527 - RNA, 25 nt, Human
caaaaugggauguaagcuuguucau

SEQ ID NO: 905528 - RNA, 23 nt, Human
caaagagcauucccaauagaaac

SEQ ID NO: 905529 - RNA, 24 nt, Human
cacagacuucaagcaguuuacaaa

SEQ ID NO: 905530 - RNA, 23 nt, Human
cacagccuuuaaauuaaaaaccu

SEQ ID NO: 905531 - RNA, 24 nt, Human
cacggcguggcugaguaacagggu

SEQ ID NO: 905532 - RNA, 19 nt, Human
cacucggaaaggugccgag

SEQ ID NO: 905533 - RNA, 20 nt, Human
cagacgugugccugaaugcc

SEQ ID NO: 905534 - RNA, 21 nt, Human
cagcacugcccagcccugccc

SEQ ID NO: 905535 - RNA, 19 nt, Human
caggaacaccaugaagcca

SEQ ID NO: 905536 - RNA, 25 nt, Human
caugaagccaagagcaauggaacca

SEQ ID NO: 905537 - RNA, 21 nt, Human
ccaagcaagacaucugcucac

SEQ ID NO: 905538 - RNA, 19 nt, Human
ccacugagcccgggaggag

SEQ ID NO: 905539 - RNA, 21 nt, Human
ccagacccagcuccggccggg

SEQ ID NO: 905540 - RNA, 25 nt, Human
cccaccauugacucggaagguuuuc

SEQ ID NO: 905541 - RNA, 22 nt, Human
cccacguuccccccacccccgc

SEQ ID NO: 905542 - RNA, 19 nt, Human
cccagaccccugcggccgc

SEQ ID NO: 905543 - RNA, 23 nt, Human
cccaggcccacugagcccgggag

SEQ ID NO: 905544 - RNA, 18 nt, Human
cccccacccccgccggcc

SEQ ID NO: 905545 - RNA, 21 nt, Human
cccccacguuccccccacccc

SEQ ID NO: 905546 - RNA, 20 nt, Human
ccccccacccccgccggccc

SEQ ID NO: 905547 - RNA, 23 nt, Human
ccccgccggcccgcguggccccc

SEQ ID NO: 905548 - RNA, 18 nt, Human
ccccugcggccgcaacgg

SEQ ID NO: 905549 - RNA, 19 nt, Human
cccgccgccuccguccccc

SEQ ID NO: 905550 - RNA, 22 nt, Human
ccgaccauaacccggucccacc

SEQ ID NO: 905551 - RNA, 18 nt, Human
ccggcccgcguggccccc

SEQ ID NO: 905552 - RNA, 23 nt, Human
ccggcccgcguggcccccgcgua

SEQ ID NO: 905553 - RNA, 21 nt, Human
ccuacacacggcguggcugag

SEQ ID NO: 905554 - RNA, 23 nt, Human
ccugcccagaccccugcggccgc

SEQ ID NO: 905555 - RNA, 21 nt, Human
cgacuccgggcagcccgagac

SEQ ID NO: 905556 - RNA, 21 nt, Human
cgcucagaucccuccagcugc

SEQ ID NO: 905557 - RNA, 23 nt, Human
cgcucagaucccuccagcugcac

SEQ ID NO: 905558 - RNA, 20 nt, Human
cggaaaggugccgaguccca

SEQ ID NO: 905559 - RNA, 21 nt, Human
cggagccaggacaaaggccgg

SEQ ID NO: 905560 - RNA, 19 nt, Human
cggccgggcucccgcuacc

SEQ ID NO: 905561 - RNA, 22 nt, Human
cggguaagacccagcuucuguu

SEQ ID NO: 905562 - RNA, 20 nt, Human
cucaaaaucuucacucaaaa

SEQ ID NO: 905563 - RNA, 23 nt, Human
cucccaauccgucgcacacuccg

SEQ ID NO: 905564 - RNA, 23 nt, Human
cuccugggcccgccgccuccguc

SEQ ID NO: 905565 - RNA, 19 nt, Human
cugaaaucugcaacuacug

SEQ ID NO: 905566 - RNA, 20 nt, Human
cugcagcaccugcucccggg

SEQ ID NO: 905567 - RNA, 22 nt, Human
cuggcugaggcuccugggcccg

SEQ ID NO: 905568 - RNA, 23 nt, Human
cugggcccgccgccuccgucccc

SEQ ID NO: 905569 - RNA, 18 nt, Human
cuuuagauucucugaaua

SEQ ID NO: 905570 - RNA, 20 nt, Human
gacaaaggccggucagaagc

SEQ ID NO: 905571 - RNA, 25 nt, Human
gagaggccccaggcccacugagccc

SEQ ID NO: 905572 - RNA, 21 nt, Human
gaguucuaccuaagguucuau

SEQ ID NO: 905573 - RNA, 20 nt, Human
gccccaggcccacugagccc

SEQ ID NO: 905574 - RNA, 23 nt, Human
gccggcccgcguggcccccgcgu

SEQ ID NO: 905575 - RNA, 22 nt, Human
gccuccguccccccgcuggccu

SEQ ID NO: 905576 - RNA, 18 nt, Human
gcugcagcaccugcuccc

SEQ ID NO: 905577 - RNA, 18 nt, Human
gcuggccuguccccgacu

SEQ ID NO: 905578 - RNA, 23 nt, Human
ggaacaccaugaagccaagagca

SEQ ID NO: 905579 - RNA, 23 nt, Human
ggacaaaggccggucagaagccg

SEQ ID NO: 905580 - RNA, 20 nt, Human
ggaccagcagucagcuggug

SEQ ID NO: 905581 - RNA, 21 nt, Human
ggagacccagccggccagcca

SEQ ID NO: 905582 - RNA, 21 nt, Human
ggagaucguuuccucaagacu

SEQ ID NO: 905583 - RNA, 19 nt, Human
ggccccaggcccacugagc

SEQ ID NO: 905584 - RNA, 19 nt, Human
ggggaggggcggcuauuuc

SEQ ID NO: 905585 - RNA, 27 nt, Human
guaaagcuuccauucagaugcccaaaa

SEQ ID NO: 905586 - RNA, 21 nt, Human
uaaacugaaaaagacuugaca

SEQ ID NO: 905587 - RNA, 23 nt, Human
uaacacgacgacugaaaucugca

SEQ ID NO: 905588 - RNA, 18 nt, Human
uaacccaccauugacucg

SEQ ID NO: 905589 - RNA, 20 nt, Human
ucaaauaauauauacagaua

SEQ ID NO: 905590 - RNA, 19 nt, Human
uccauucagaugcccaaaa

SEQ ID NO: 905591 - RNA, 21 nt, Human
ucccaggcgaaaugaccagcu

SEQ ID NO: 905592 - RNA, 23 nt, Human
ucccaggcgaaaugaccagcucu

SEQ ID NO: 905593 - RNA, 22 nt, Human
uccguagcacagaaaugaggau

SEQ ID NO: 905594 - RNA, 24 nt, Human
ucgaacgcucaaaaucuguagaca

SEQ ID NO: 905595 - RNA, 24 nt, Human
ucgugcugcggguaagacccagcu

SEQ ID NO: 905596 - RNA, 23 nt, Human
ucuaaagcaucuuuacagaugca

SEQ ID NO: 905597 - RNA, 19 nt, Human
ucucuugcaggaaaaggag

SEQ ID NO: 905598 - RNA, 23 nt, Human
ucuguagacaaaccucccaaucc

SEQ ID NO: 905599 - RNA, 24 nt, Human
ucuugcaggaaaaggaguggaugc

SEQ ID NO: 905600 - RNA, 21 nt, Human
ugacucggaaaggagagacaa

SEQ ID NO: 905601 - RNA, 18 nt, Human
ugagucacgugaaacaca

SEQ ID NO: 905602 - RNA, 24 nt, Human
ugcaacuacugcaaagacgcgggc

SEQ ID NO: 905603 - RNA, 19 nt, Human
ugccacagacuucaagcag

SEQ ID NO: 905604 - RNA, 18 nt, Human
ugccacggcgucuccaga

SEQ ID NO: 905605 - RNA, 22 nt, Human
ugccacggcgucuccagacccc

SEQ ID NO: 905606 - RNA, 19 nt, Human
ugcccagaccccugcggcc

SEQ ID NO: 905607 - RNA, 24 nt, Human
ugcccagaccccugcggccgcaac

SEQ ID NO: 905608 - RNA, 21 nt, Human
ugcuacggagccaggacaaag

SEQ ID NO: 905609 - RNA, 19 nt, Human
ugcucacuggaaacggagu

SEQ ID NO: 905610 - RNA, 21 nt, Human
uggugacggcggcgggcacug

SEQ ID NO: 905611 - RNA, 21 nt, Human
uuaaaagcuguuaaaucucau

SEQ ID NO: 905612 - RNA, 23 nt, Human
uuacagaugcauuugcuugaaaa

SEQ ID NO: 905613 - RNA, 22 nt, Human
uuccccccacccccgccggccc

SEQ ID NO: 905614 - RNA, 18 nt, Human
uuuuccucaaauacuaca

SEQ ID NO: 905615 - RNA, 18 nt, Human
aaauuaaacuccaccuuc

SEQ ID NO: 905616 - RNA, 22 nt, Human
aacugcccuacaauggccucac

SEQ ID NO: 905617 - RNA, 26 nt, Human
aagaaaccuagagcggggagaggaug

SEQ ID NO: 905618 - RNA, 22 nt, Human
aagcuccagcucccuucaaauc

SEQ ID NO: 905619 - RNA, 23 nt, Human
acaccagggccccucgauggccc

SEQ ID NO: 905620 - RNA, 21 nt, Human
acacucugcuacccugaccuc

SEQ ID NO: 905621 - RNA, 26 nt, Human
accacggacaccucuaggcccccaaa

SEQ ID NO: 905622 - RNA, 20 nt, Human
acucugcuacccugaccuca

SEQ ID NO: 905623 - RNA, 19 nt, Human
agaacauucucagagccaa

SEQ ID NO: 905624 - RNA, 24 nt, Human
agaacauucucagagccaacacca

SEQ ID NO: 905625 - RNA, 18 nt, Human
agaauggaggccaggugg

SEQ ID NO: 905626 - RNA, 18 nt, Human
agaccccaggucccccag

SEQ ID NO: 905627 - RNA, 20 nt, Human
agagaggauggcgggugggg

SEQ ID NO: 905628 - RNA, 19 nt, Human
agagggcagagaggauggc

SEQ ID NO: 905629 - RNA, 21 nt, Human
agccaacaccagggccccucg

SEQ ID NO: 905630 - RNA, 18 nt, Human
agcccaggaaccacggac

SEQ ID NO: 905631 - RNA, 21 nt, Human
agcuaugugcagggucccugg

SEQ ID NO: 905632 - RNA, 18 nt, Human
agcucacacccccggccc

SEQ ID NO: 905633 - RNA, 22 nt, Human
agcugggagaagccagcucugg

SEQ ID NO: 905634 - RNA, 21 nt, Human
aggaagaagugugaguucuga

SEQ ID NO: 905635 - RNA, 19 nt, Human
aggcaucagaaugaagggg

SEQ ID NO: 905636 - RNA, 20 nt, Human
aggccagggaagaaugaggu

SEQ ID NO: 905637 - RNA, 24 nt, Human
agggcagagaggauggcggguggg

SEQ ID NO: 905638 - RNA, 25 nt, Human
agggggagcaauucuaaguggggcc

SEQ ID NO: 905639 - RNA, 19 nt, Human
agggugcuggaugggggug

SEQ ID NO: 905640 - RNA, 19 nt, Human
aggucccccaggccccguu

SEQ ID NO: 905641 - RNA, 21 nt, Human
aggugacuggucacccagaac

SEQ ID NO: 905642 - RNA, 18 nt, Human
caaagugccaagacuccc

SEQ ID NO: 905643 - RNA, 20 nt, Human
caaccccagcucacaccccc

SEQ ID NO: 905644 - RNA, 18 nt, Human
cacacacagcugaagggu

SEQ ID NO: 905645 - RNA, 18 nt, Human
caccagaccccagguccc

SEQ ID NO: 905646 - RNA, 18 nt, Human
caccagggccccucgaug

SEQ ID NO: 905647 - RNA, 21 nt, Human
cacccagaacauucucagagc

SEQ ID NO: 905648 - RNA, 20 nt, Human
caccucuaggcccccaaauc

SEQ ID NO: 905649 - RNA, 21 nt, Human
caccucuaggcccccaaaucc

SEQ ID NO: 905650 - RNA, 21 nt, Human
cacggacaccucuaggccccc

SEQ ID NO: 905651 - RNA, 18 nt, Human
cacucugcuacccugacc

SEQ ID NO: 905652 - RNA, 25 nt, Human
cacucugcuacccugaccucauccc

SEQ ID NO: 905653 - RNA, 22 nt, Human
cacugaaaaccuagauggaccg

SEQ ID NO: 905654 - RNA, 22 nt, Human
cacuggguuuuucuguccuugu

SEQ ID NO: 905655 - RNA, 18 nt, Human
cagaacauucucagagcc

SEQ ID NO: 905656 - RNA, 25 nt, Human
cagagccuccuucuccuucuugacu

SEQ ID NO: 905657 - RNA, 23 nt, Human
cagaugcaaagucauuauccuug

SEQ ID NO: 905658 - RNA, 20 nt, Human
cagccuccuagaucagcccu

SEQ ID NO: 905659 - RNA, 19 nt, Human
cagcucccuucaaauccag

SEQ ID NO: 905660 - RNA, 18 nt, Human
cagcugaagggugcugga

SEQ ID NO: 905661 - RNA, 20 nt, Human
caggauguuugcaaagugcc

SEQ ID NO: 905662 - RNA, 20 nt, Human
caggugguuguuccuugccu

SEQ ID NO: 905663 - RNA, 23 nt, Human
ccaacugcccuacaauggccuca

SEQ ID NO: 905664 - RNA, 24 nt, Human
ccaccuucagagauaaccuaauuu

SEQ ID NO: 905665 - RNA, 20 nt, Human
ccagaacauucucagagcca

SEQ ID NO: 905666 - RNA, 21 nt, Human
ccagaacauucucagagccaa

SEQ ID NO: 905667 - RNA, 19 nt, Human
ccagcucacacccccggcc

SEQ ID NO: 905668 - RNA, 21 nt, Human
cccaaccccagcucacacccc

SEQ ID NO: 905669 - RNA, 25 nt, Human
cccaaccccagcucacacccccggc

SEQ ID NO: 905670 - RNA, 18 nt, Human
cccaagagaauggaggcc

SEQ ID NO: 905671 - RNA, 24 nt, Human
cccacuuuaaccauagcaguucca

SEQ ID NO: 905672 - RNA, 22 nt, Human
cccccuaccccugcuacaucug

SEQ ID NO: 905673 - RNA, 25 nt, Human
ccccugcuacaucuggaagcuccag

SEQ ID NO: 905674 - RNA, 24 nt, Human
cccggccccuucagagccuccuuc

SEQ ID NO: 905675 - RNA, 24 nt, Human
cccuaccccugcuacaucuggaag

SEQ ID NO: 905676 - RNA, 20 nt, Human
cccugcagcccagcugaacc

SEQ ID NO: 905677 - RNA, 20 nt, Human
ccgugcccugcagcccagcu

SEQ ID NO: 905678 - RNA, 20 nt, Human
ccucccacagccauucugga

SEQ ID NO: 905679 - RNA, 21 nt, Human
ccuccuucuccuucuugacuc

SEQ ID NO: 905680 - RNA, 21 nt, Human
ccugcacagcgguuuauucag

SEQ ID NO: 905681 - RNA, 21 nt, Human
ccugcagcccagcugaaccag

SEQ ID NO: 905682 - RNA, 26 nt, Human
ccuggcucccagccuccuagaucagc

SEQ ID NO: 905683 - RNA, 18 nt, Human
ccuggcuccccagcuccc

SEQ ID NO: 905684 - RNA, 23 nt, Human
cggacaccucuaggcccccaaau

SEQ ID NO: 905685 - RNA, 21 nt, Human
cuacccacagcucuuucucag

SEQ ID NO: 905686 - RNA, 23 nt, Human
cucacacccccggccccuucaga

SEQ ID NO: 905687 - RNA, 20 nt, Human
cuggaacaugcuaacauugg

SEQ ID NO: 905688 - RNA, 25 nt, Human
cuucacccuggcaggguucccuagc

SEQ ID NO: 905689 - RNA, 22 nt, Human
cuucccuacugugggaggggac

SEQ ID NO: 905690 - RNA, 20 nt, Human
cuuugggagaagaaaccuag

SEQ ID NO: 905691 - RNA, 21 nt, Human
gaaaugcaugucgacauuuuu

SEQ ID NO: 905692 - RNA, 18 nt, Human
gacccccagcccuaucuc

SEQ ID NO: 905693 - RNA, 20 nt, Human
gaccucauccccuccugccc

SEQ ID NO: 905694 - RNA, 24 nt, Human
gagcuucccacacucaguguggcc

SEQ ID NO: 905695 - RNA, 20 nt, Human
gaggauggcgggugggggca

SEQ ID NO: 905696 - RNA, 19 nt, Human
gaucagaaaguaggugacu

SEQ ID NO: 905697 - RNA, 22 nt, Human
gcaaagugccaagacuccccca

SEQ ID NO: 905698 - RNA, 22 nt, Human
gcaacuccagagcuucccacac

SEQ ID NO: 905699 - RNA, 22 nt, Human
gcagagaggauggcgggugggg

SEQ ID NO: 905700 - RNA, 20 nt, Human
gccccgacccccagcccuau

SEQ ID NO: 905701 - RNA, 20 nt, Human
gcccuggcuccccagcuccc

SEQ ID NO: 905702 - RNA, 21 nt, Human
gcccuggcuccccagcucccg

SEQ ID NO: 905703 - RNA, 25 nt, Human
gcccuggcuccccagcucccguccu

SEQ ID NO: 905704 - RNA, 18 nt, Human
gcucagugugaggucuca

SEQ ID NO: 905705 - RNA, 25 nt, Human
ggagaagccagcucugguaauuaaa

SEQ ID NO: 905706 - RNA, 20 nt, Human
ggagaggauguuucugaucc

SEQ ID NO: 905707 - RNA, 20 nt, Human
ggcacuucuuugccaggaag

SEQ ID NO: 905708 - RNA, 19 nt, Human
ggcagagaggauggcgggu

SEQ ID NO: 905709 - RNA, 23 nt, Human
ggcagagaggauggcgggugggg

SEQ ID NO: 905710 - RNA, 21 nt, Human
gggagucccaaccccagcuca

SEQ ID NO: 905711 - RNA, 19 nt, Human
gggccccucgauggcccag

SEQ ID NO: 905712 - RNA, 24 nt, Human
gucuuuuuuucuauuuaaauuggc

SEQ ID NO: 905713 - RNA, 19 nt, Human
gugguuguuccuugccuuc

SEQ ID NO: 905714 - RNA, 23 nt, Human
uacccugaccucauccccuccug

SEQ ID NO: 905715 - RNA, 20 nt, Human
uacugugggaggggacaugg

SEQ ID NO: 905716 - RNA, 22 nt, Human
uaggcccccaaauccgucguca

SEQ ID NO: 905717 - RNA, 24 nt, Human
ucacccagaacauucucagagcca

SEQ ID NO: 905718 - RNA, 18 nt, Human
ucagaaaguaggugacug

SEQ ID NO: 905719 - RNA, 21 nt, Human
ucagagccuccuucuccuucu

SEQ ID NO: 905720 - RNA, 23 nt, Human
ucagugugaggucucagcagggg

SEQ ID NO: 905721 - RNA, 23 nt, Human
uccaaaaucccagcccaggaacc

SEQ ID NO: 905722 - RNA, 19 nt, Human
uccagaaagguagcaauca

SEQ ID NO: 905723 - RNA, 22 nt, Human
ucccaacacacacacccucuuc

SEQ ID NO: 905724 - RNA, 22 nt, Human
ucccaaccccagcucacacccc

SEQ ID NO: 905725 - RNA, 26 nt, Human
ucccagccuccuagaucagcccuggc

SEQ ID NO: 905726 - RNA, 21 nt, Human
ucccguggcagcugucuuccc

SEQ ID NO: 905727 - RNA, 19 nt, Human
uccucccaacacacacacc

SEQ ID NO: 905728 - RNA, 23 nt, Human
ucuaacaucuggcccccuacccc

SEQ ID NO: 905729 - RNA, 18 nt, Human
ucugagcugggagaagcc

SEQ ID NO: 905730 - RNA, 20 nt, Human
ucugcaaugcucacucccuu

SEQ ID NO: 905731 - RNA, 20 nt, Human
ugaaaaccuagauggaccga

SEQ ID NO: 905732 - RNA, 22 nt, Human
ugaccucauccccuccugcccc

SEQ ID NO: 905733 - RNA, 18 nt, Human
ugacuggucacccagaac

SEQ ID NO: 905734 - RNA, 22 nt, Human
ugagcagaggacgcucagguua

SEQ ID NO: 905735 - RNA, 23 nt, Human
ugaggucucagcaggggccacug

SEQ ID NO: 905736 - RNA, 19 nt, Human
ugaggugcauucuucucgg

SEQ ID NO: 905737 - RNA, 19 nt, Human
ugcaugucgacauuuuuau

SEQ ID NO: 905738 - RNA, 22 nt, Human
ugccuucacccuggcaggguuc

SEQ ID NO: 905739 - RNA, 18 nt, Human
uggaacaugcuaacauug

SEQ ID NO: 905740 - RNA, 18 nt, Human
uggccucacuggcagugg

SEQ ID NO: 905741 - RNA, 21 nt, Human
uggcuccccagcucccguccu

SEQ ID NO: 905742 - RNA, 23 nt, Human
ugggaaagaggccagggaagaau

SEQ ID NO: 905743 - RNA, 21 nt, Human
ugggagaagccagcucuggua

SEQ ID NO: 905744 - RNA, 19 nt, Human
ugggggcugugggugggaa

SEQ ID NO: 905745 - RNA, 20 nt, Human
ugugcaugucucagugaccu

SEQ ID NO: 905746 - RNA, 20 nt, Human
uuaaacuccaccuucagaga

SEQ ID NO: 905747 - RNA, 23 nt, Human
uuaaaggaaauuaaacuccaccu

SEQ ID NO: 905748 - RNA, 22 nt, Human
uucagagccuccuucuccuucu

SEQ ID NO: 905749 - RNA, 20 nt, Human
uuccagaaggggauuuucag

SEQ ID NO: 905750 - RNA, 23 nt, Human
uucuugacucagugcaggcuggg

SEQ ID NO: 905751 - RNA, 23 nt, Human
uuucagguucccgcucacccacu

SEQ ID NO: 905752 - RNA, 23 nt, Human
uuucucaggggagucccaacccc

SEQ ID NO: 905753 - RNA, 20 nt, Human
aaacgccagggccccuggca

SEQ ID NO: 905754 - RNA, 19 nt, Human
aaauuccaccccacguccc

SEQ ID NO: 905755 - RNA, 21 nt, Human
accccacgucccaaaggucuc

SEQ ID NO: 905756 - RNA, 23 nt, Human
agaaggcucugggcgugugaggg

SEQ ID NO: 905757 - RNA, 22 nt, Human
agaggacacugaggccccucuc

SEQ ID NO: 905758 - RNA, 23 nt, Human
agauaccccaaauuccaccccac

SEQ ID NO: 905759 - RNA, 23 nt, Human
cagcagggacagagucgaggcuc

SEQ ID NO: 905760 - RNA, 23 nt, Human
ccccaaauuccaccccacguccc

SEQ ID NO: 905761 - RNA, 25 nt, Human
ccccaaauuccaccccacgucccaa

SEQ ID NO: 905762 - RNA, 20 nt, Human
ccccacgucccaaaggucuc

SEQ ID NO: 905763 - RNA, 18 nt, Human
cgccagggccccuggcag

SEQ ID NO: 905764 - RNA, 22 nt, Human
cggccgggagcaccugcagcag

SEQ ID NO: 905765 - RNA, 24 nt, Human
cggggcuguccaguccaugucagc

SEQ ID NO: 905766 - RNA, 25 nt, Human
cuucagaggacacugaggccccucu

SEQ ID NO: 905767 - RNA, 20 nt, Human
gcuacagagacacuggccca

SEQ ID NO: 905768 - RNA, 19 nt, Human
ggagcaccugcagcaggug

SEQ ID NO: 905769 - RNA, 19 nt, Human
ggagcaccugcagcaggug

SEQ ID NO: 905770 - RNA, 22 nt, Human
ggcucugggcgugugagggagg

SEQ ID NO: 905771 - RNA, 23 nt, Human
uaagcgaaggaggcaaacgccag

SEQ ID NO: 905772 - RNA, 21 nt, Human
ucacuggggauggcuucagag

SEQ ID NO: 905773 - RNA, 20 nt, Human
ucagggagggcaaggcacag

SEQ ID NO: 905774 - RNA, 18 nt, Human
ucagggcuacagagacac

SEQ ID NO: 905775 - RNA, 19 nt, Human
ucucccagcggggcugucc

SEQ ID NO: 905776 - RNA, 22 nt, Human
ugaggccccucucagggagggc

SEQ ID NO: 905777 - RNA, 19 nt, Human
uguucuguuccuuauguca

SEQ ID NO: 905778 - RNA, 25 nt, Human
uguuguguucuguuccuuaugucag

SEQ ID NO: 905779 - RNA, 22 nt, Human
aagaugguuccgcccugaucua

SEQ ID NO: 905780 - RNA, 19 nt, Human
aagcaaccuucuccagaca

SEQ ID NO: 905781 - RNA, 22 nt, Human
acacaccucgagaaccgggccc

SEQ ID NO: 905782 - RNA, 24 nt, Human
accuucuccagacaccuaauauua

SEQ ID NO: 905783 - RNA, 24 nt, Human
agagaggaagcaauuggaccaaag

SEQ ID NO: 905784 - RNA, 20 nt, Human
agcugccuugguggauccag

SEQ ID NO: 905785 - RNA, 24 nt, Human
agcugccuugguggauccagcccc

SEQ ID NO: 905786 - RNA, 20 nt, Human
agcuguggccgccaacccca

SEQ ID NO: 905787 - RNA, 21 nt, Human
aguacccacccaucccccagc

SEQ ID NO: 905788 - RNA, 25 nt, Human
aguacccacccaucccccagcauac

SEQ ID NO: 905789 - RNA, 20 nt, Human
aguggauccacagcucccuu

SEQ ID NO: 905790 - RNA, 19 nt, Human
caacagagagccugagacc

SEQ ID NO: 905791 - RNA, 20 nt, Human
cacacguguagcuggcacac

SEQ ID NO: 905792 - RNA, 22 nt, Human
cacaugcaucuagaagcuccua

SEQ ID NO: 905793 - RNA, 21 nt, Human
cagcagagcaggauguggaaa

SEQ ID NO: 905794 - RNA, 22 nt, Human
cagccccuuagcccccucuccu

SEQ ID NO: 905795 - RNA, 21 nt, Human
caggagaggcuauaagaaaug

SEQ ID NO: 905796 - RNA, 21 nt, Human
cauacagaacacacguguagc

SEQ ID NO: 905797 - RNA, 27 nt, Human
caucacaagguggaucaccauagucaa

SEQ ID NO: 905798 - RNA, 23 nt, Human
ccaccaccuggccaaugcccgcc

SEQ ID NO: 905799 - RNA, 23 nt, Human
ccagacaccuaauauuaaccauc

SEQ ID NO: 905800 - RNA, 21 nt, Human
cccauacagaacacacgugua

SEQ ID NO: 905801 - RNA, 20 nt, Human
ccccugaauucagugguuca

SEQ ID NO: 905802 - RNA, 24 nt, Human
ccuaauauuaaccaucacaaggug

SEQ ID NO: 905803 - RNA, 26 nt, Human
ccuccugcagagagaagucccagggc

SEQ ID NO: 905804 - RNA, 25 nt, Human
ccugcagcagagcaggauguggaaa

SEQ ID NO: 905805 - RNA, 18 nt, Human
ccuugguggauccagccc

SEQ ID NO: 905806 - RNA, 27 nt, Human
cguccuccaagcaauuccaggaggauu

SEQ ID NO: 905807 - RNA, 23 nt, Human
cuccaccaccuggccaaugcccg

SEQ ID NO: 905808 - RNA, 21 nt, Human
cucuccuccugcagagagaag

SEQ ID NO: 905809 - RNA, 22 nt, Human
cugggugagggucaacaucugg

SEQ ID NO: 905810 - RNA, 21 nt, Human
cuuagcccccucuccugcagc

SEQ ID NO: 905811 - RNA, 19 nt, Human
gaaccgggcccccaccccc

SEQ ID NO: 905812 - RNA, 19 nt, Human
gacaggaugguggguggga

SEQ ID NO: 905813 - RNA, 22 nt, Human
gagaagauucaagucugagaac

SEQ ID NO: 905814 - RNA, 19 nt, Human
gagaaggggacaucuccau

SEQ ID NO: 905815 - RNA, 23 nt, Human
gagagccugagaccaauccagag

SEQ ID NO: 905816 - RNA, 23 nt, Human
gagccugagaccaauccagagga

SEQ ID NO: 905817 - RNA, 20 nt, Human
gcccccacccccauccccug

SEQ ID NO: 905818 - RNA, 20 nt, Human
ggacuuagcuguggccgcca

SEQ ID NO: 905819 - RNA, 21 nt, Human
ggauggugggugggagcuguc

SEQ ID NO: 905820 - RNA, 19 nt, Human
ggccgagaagauucaaguc

SEQ ID NO: 905821 - RNA, 20 nt, Human
gggcaggagcuuggccgggu

SEQ ID NO: 905822 - RNA, 27 nt, Human
gucugagaaccacauggguugcagggg

SEQ ID NO: 905823 - RNA, 25 nt, Human
uaggaugcacaggacaagauggcug

SEQ ID NO: 905824 - RNA, 20 nt, Human
ucauggauccuuccucuguu

SEQ ID NO: 905825 - RNA, 21 nt, Human
uccacaugcaucuagaagcug

SEQ ID NO: 905826 - RNA, 21 nt, Human
uccagccccuuagcccccucu

SEQ ID NO: 905827 - RNA, 27 nt, Human
uccauggguuguguugaaucacaggag

SEQ ID NO: 905828 - RNA, 20 nt, Human
ucccagaguuuucccgcugu

SEQ ID NO: 905829 - RNA, 30 nt, Human
ucuccugcagcagagcaggauguggaaacu

SEQ ID NO: 905830 - RNA, 18 nt, Human
ucucuuggugcuuaucgu

SEQ ID NO: 905831 - RNA, 21 nt, Human
ugaaucacaggagaggcuaua

SEQ ID NO: 905832 - RNA, 26 nt, Human
ugaccaaaggccaacagagagccuga

SEQ ID NO: 905833 - RNA, 19 nt, Human
ugagaaggggacaucucca

SEQ ID NO: 905834 - RNA, 24 nt, Human
ugcaugucagaucauggggaguuu

SEQ ID NO: 905835 - RNA, 18 nt, Human
ugccuugguggauccagc

SEQ ID NO: 905836 - RNA, 21 nt, Human
uggaucaccauagucaaccau

SEQ ID NO: 905837 - RNA, 18 nt, Human
uggauuucugcaugucag

SEQ ID NO: 905838 - RNA, 19 nt, Human
uucuggacaaggcuggauu

SEQ ID NO: 905839 - RNA, 22 nt, Human
uuucguccuccaagcaauucca

SEQ ID NO: 905840 - RNA, 20 nt, Human
uuugggguuguuccucugca

SEQ ID NO: 905841 - RNA, 24 nt, Human
aagcaagccacugcugggagggcu

SEQ ID NO: 905842 - RNA, 22 nt, Human
agcgacaucuggccaggaggga

SEQ ID NO: 905843 - RNA, 22 nt, Human
cagaacugagugugcagugcua

SEQ ID NO: 905844 - RNA, 19 nt, Human
caggagaagaaagcaagcc

SEQ ID NO: 905845 - RNA, 23 nt, Human
gccacacugcagaggacccagcg

SEQ ID NO: 905846 - RNA, 25 nt, Human
ugcagaggacccagcgacaucuggc

SEQ ID NO: 905847 - RNA, 18 nt, Human
ugcugggagggcuggccg

SEQ ID NO: 905848 - RNA, 19 nt, Human
ugcugggagggcuggccgc

SEQ ID NO: 905849 - RNA, 19 nt, Human
ugcugggagggcuggccgc

SEQ ID NO: 905850 - RNA, 19 nt, Human
ugggaaacugggacaucaa

SEQ ID NO: 905851 - RNA, 22 nt, Human
ugggacaucacaggagaagaaa

SEQ ID NO: 905852 - RNA, 25 nt, Human
uuaaaaaaacuuuauugcagcuucu

SEQ ID NO: 905853 - RNA, 21 nt, Human
aaaacccccaaagacauccag

SEQ ID NO: 905854 - RNA, 21 nt, Human
aaaguacccaguuauccaagc

SEQ ID NO: 905855 - RNA, 24 nt, Human
aaagugcugggauuacaggcauga

SEQ ID NO: 905856 - RNA, 22 nt, Human
aaaugacuugccggagcugaac

SEQ ID NO: 905857 - RNA, 21 nt, Human
aagacagagucuugcucuguc

SEQ ID NO: 905858 - RNA, 23 nt, Human
aagauacacuuagcaaaaccccc

SEQ ID NO: 905859 - RNA, 21 nt, Human
aagugaucugccugccuuggc

SEQ ID NO: 905860 - RNA, 24 nt, Human
aagugaucugccugccuuggccuc

SEQ ID NO: 905861 - RNA, 19 nt, Human
aagugcugggauuacaggc

SEQ ID NO: 905862 - RNA, 21 nt, Human
aagugcugggauuacaggcau

SEQ ID NO: 905863 - RNA, 26 nt, Human
aagugcugggauuacaggcaugagcc

SEQ ID NO: 905864 - RNA, 25 nt, Human
aaguggcccuggggagggagaaggc

SEQ ID NO: 905865 - RNA, 18 nt, Human
aauggccauuuaacacug

SEQ ID NO: 905866 - RNA, 21 nt, Human
accauguuggccagguggucu

SEQ ID NO: 905867 - RNA, 18 nt, Human
acccaggaacccguggcc

SEQ ID NO: 905868 - RNA, 19 nt, Human
acccaggcuggagugcagu

SEQ ID NO: 905869 - RNA, 22 nt, Human
acgccaggcuaauuuuuuguau

SEQ ID NO: 905870 - RNA, 20 nt, Human
acggaaaugagaaacgaccc

SEQ ID NO: 905871 - RNA, 21 nt, Human
acgggguuucaccauguuggc

SEQ ID NO: 905872 - RNA, 23 nt, Human
acgggguuucaccauguuggcca

SEQ ID NO: 905873 - RNA, 24 nt, Human
acgggguuucaccauguuggccag

SEQ ID NO: 905874 - RNA, 18 nt, Human
agaaacgacccaggaacc

SEQ ID NO: 905875 - RNA, 23 nt, Human
agacguuuaacucgacggaaaug

SEQ ID NO: 905876 - RNA, 20 nt, Human
agagccaugcugucugccac

SEQ ID NO: 905877 - RNA, 18 nt, Human
aggccucacagugcucag

SEQ ID NO: 905878 - RNA, 23 nt, Human
aggcugcagcugaguuuuagcug

SEQ ID NO: 905879 - RNA, 25 nt, Human
aggcuggagugcaguggcgcgaucu

SEQ ID NO: 905880 - RNA, 24 nt, Human
agguggucuugaacuccuggccuu

SEQ ID NO: 905881 - RNA, 21 nt, Human
agguucaagugauucuucugc

SEQ ID NO: 905882 - RNA, 22 nt, Human
aguacccaguuauccaagcagc

SEQ ID NO: 905883 - RNA, 19 nt, Human
aguagcugggauuauaggc

SEQ ID NO: 905884 - RNA, 24 nt, Human
agugauucuucugcuucagccucc

SEQ ID NO: 905885 - RNA, 20 nt, Human
agugcaguggcgcgaucuug

SEQ ID NO: 905886 - RNA, 24 nt, Human
agugcaguggcgcgaucuugacuc

SEQ ID NO: 905887 - RNA, 23 nt, Human
aguggcgcgaucuugacucacug

SEQ ID NO: 905888 - RNA, 23 nt, Human
aucagcaagggaucccaguccca

SEQ ID NO: 905889 - RNA, 18 nt, Human
aucucuuccacugaagca

SEQ ID NO: 905890 - RNA, 24 nt, Human
caaagugcugggauuacaggcaug

SEQ ID NO: 905891 - RNA, 21 nt, Human
caagauacacuuagcaaaacc

SEQ ID NO: 905892 - RNA, 22 nt, Human
caaguauaacuuacuacuguaa

SEQ ID NO: 905893 - RNA, 22 nt, Human
caagugauucuucugcuucagc

SEQ ID NO: 905894 - RNA, 20 nt, Human
caccauguuggccagguggu

SEQ ID NO: 905895 - RNA, 22 nt, Human
caccauguuggccagguggucu

SEQ ID NO: 905896 - RNA, 23 nt, Human
caccauguuggccagguggucuu

SEQ ID NO: 905897 - RNA, 30 nt, Human
caccauguuggccagguggucuugaacucc

SEQ ID NO: 905898 - RNA, 24 nt, Human
cacccaggcuggagugcaguggcg

SEQ ID NO: 905899 - RNA, 23 nt, Human
cacucuacugcuuguuccccacu

SEQ ID NO: 905900 - RNA, 21 nt, Human
cacugcaaccuccgccuccua

SEQ ID NO: 905901 - RNA, 18 nt, Human
cagagcuucugagguacc

SEQ ID NO: 905902 - RNA, 24 nt, Human
cagcagcacuggccggggguaagg

SEQ ID NO: 905903 - RNA, 24 nt, Human
cagccaagcugauuccucagaagc

SEQ ID NO: 905904 - RNA, 22 nt, Human
cagcccggggccugggucuccc

SEQ ID NO: 905905 - RNA, 20 nt, Human
cagccuccugaguagcuggg

SEQ ID NO: 905906 - RNA, 19 nt, Human
caguggcgcgaucuugacu

SEQ ID NO: 905907 - RNA, 19 nt, Human
caucucaaccugcuuuugu

SEQ ID NO: 905908 - RNA, 23 nt, Human
ccaaagugcugggauuacaggca

SEQ ID NO: 905909 - RNA, 24 nt, Human
ccaaagugcugggauuacaggcau

SEQ ID NO: 905910 - RNA, 21 nt, Human
ccacuccaucaaggucccaga

SEQ ID NO: 905911 - RNA, 22 nt, Human
ccagccuucuuuauuuuuaaga

SEQ ID NO: 905912 - RNA, 23 nt, Human
ccagucccaaagugauuuuaaga

SEQ ID NO: 905913 - RNA, 20 nt, Human
ccagucccacucuacugcuu

SEQ ID NO: 905914 - RNA, 24 nt, Human
cccaaagugcugggauuacaggca

SEQ ID NO: 905915 - RNA, 24 nt, Human
ccccacuccaucaaggucccagaa

SEQ ID NO: 905916 - RNA, 25 nt, Human
ccccacuccaucaaggucccagaag

SEQ ID NO: 905917 - RNA, 20 nt, Human
cccccaaagacauccagagc

SEQ ID NO: 905918 - RNA, 25 nt, Human
cccccaaagacauccagagcuucug

SEQ ID NO: 905919 - RNA, 18 nt, Human
cccuggggagggagaagg

SEQ ID NO: 905920 - RNA, 24 nt, Human
ccgccuccuagguucaagugauuc

SEQ ID NO: 905921 - RNA, 23 nt, Human
ccuagguucaagugauucuucug

SEQ ID NO: 905922 - RNA, 23 nt, Human
ccucacagugcucagcccggggc

SEQ ID NO: 905923 - RNA, 18 nt, Human
ccucuguguaccucaguu

SEQ ID NO: 905924 - RNA, 23 nt, Human
ccugaguagcugggauuauaggc

SEQ ID NO: 905925 - RNA, 24 nt, Human
ccugaguagcugggauuauaggcg

SEQ ID NO: 905926 - RNA, 22 nt, Human
ccugccuuggccucccaaagug

SEQ ID NO: 905927 - RNA, 21 nt, Human
ccuggccuuaagugaucugcc

SEQ ID NO: 905928 - RNA, 23 nt, Human
ccuuuggcuucaucucuuccacu

SEQ ID NO: 905929 - RNA, 21 nt, Human
cgacggaaaugagaaacgacc

SEQ ID NO: 905930 - RNA, 18 nt, Human
cggcucacaccuagaaau

SEQ ID NO: 905931 - RNA, 22 nt, Human
cucaaaauggacgcuuggaagc

SEQ ID NO: 905932 - RNA, 23 nt, Human
cucacagugcucagcccggggcc

SEQ ID NO: 905933 - RNA, 19 nt, Human
cuccuagguucaagugauu

SEQ ID NO: 905934 - RNA, 20 nt, Human
cucugucacccaggcuggag

SEQ ID NO: 905935 - RNA, 23 nt, Human
cugcaaccuccgccuccuagguu

SEQ ID NO: 905936 - RNA, 24 nt, Human
cugcaaccuccgccuccuagguuc

SEQ ID NO: 905937 - RNA, 23 nt, Human
cugccuuggccucccaaagugcu

SEQ ID NO: 905938 - RNA, 23 nt, Human
cugcuucagccuccugaguagcu

SEQ ID NO: 905939 - RNA, 18 nt, Human
cugucacccaggcuggag

SEQ ID NO: 905940 - RNA, 19 nt, Human
cugucacccaggcuggagu

SEQ ID NO: 905941 - RNA, 24 nt, Human
cuguccuuuggcuucaucucuucc

SEQ ID NO: 905942 - RNA, 23 nt, Human
cuuaagugaucugccugccuugg

SEQ ID NO: 905943 - RNA, 19 nt, Human
cuucugagguaccucugug

SEQ ID NO: 905944 - RNA, 24 nt, Human
gagacgggguuucaccauguuggc

SEQ ID NO: 905945 - RNA, 24 nt, Human
gaucacuucuugauaggagcucau

SEQ ID NO: 905946 - RNA, 18 nt, Human
gauuacaggcaugagcca

SEQ ID NO: 905947 - RNA, 21 nt, Human
gauuacaggcaugagccacca

SEQ ID NO: 905948 - RNA, 22 nt, Human
gauuacaggcaugagccaccac

SEQ ID NO: 905949 - RNA, 26 nt, Human
gcaaaacccccaaagacauccagagc

SEQ ID NO: 905950 - RNA, 19 nt, Human
gcagcugaguuuuagcuga

SEQ ID NO: 905951 - RNA, 18 nt, Human
gccaggcuaauuuuuugu

SEQ ID NO: 905952 - RNA, 18 nt, Human
gcccuggggagggagaag

SEQ ID NO: 905953 - RNA, 22 nt, Human
gccuuggccucccaaagugcug

SEQ ID NO: 905954 - RNA, 19 nt, Human
gcucagcccggggccuggg

SEQ ID NO: 905955 - RNA, 25 nt, Human
gcucugucacccaggcuggagugca

SEQ ID NO: 905956 - RNA, 24 nt, Human
gcugcagcugaguuuuagcugacc

SEQ ID NO: 905957 - RNA, 19 nt, Human
gcuggagugcaguggcgcg

SEQ ID NO: 905958 - RNA, 28 nt, Human
ggaaauaaauagaaaaugugaucacggc

SEQ ID NO: 905959 - RNA, 19 nt, Human
ggauuacaggcaugagcca

SEQ ID NO: 905960 - RNA, 23 nt, Human
ggccauuuaacacuguuguucug

SEQ ID NO: 905961 - RNA, 22 nt, Human
ggccugggucucccccaguccc

SEQ ID NO: 905962 - RNA, 24 nt, Human
ggccuuaagugaucugccugccuu

SEQ ID NO: 905963 - RNA, 22 nt, Human
ggcucacaccuagaaauuuaca

SEQ ID NO: 905964 - RNA, 21 nt, Human
ggggguaagggaaugagcuuc

SEQ ID NO: 905965 - RNA, 23 nt, Human
gggguuucaccauguuggccagg

SEQ ID NO: 905966 - RNA, 22 nt, Human
ggguuucaccauguuggccagg

SEQ ID NO: 905967 - RNA, 22 nt, Human
guaaguauaaguaguacuaugu

SEQ ID NO: 905968 - RNA, 23 nt, Human
guagagacgggguuucaccaugu

SEQ ID NO: 905969 - RNA, 18 nt, Human
guagcugggauuauaggc

SEQ ID NO: 905970 - RNA, 19 nt, Human
gucaucuuccccaucucaa

SEQ ID NO: 905971 - RNA, 24 nt, Human
gucuugcucugucacccaggcugg

SEQ ID NO: 905972 - RNA, 24 nt, Human
gugauucuucugcuucagccuccu

SEQ ID NO: 905973 - RNA, 24 nt, Human
uaauuuuuuguauuuuuaguagag

SEQ ID NO: 905974 - RNA, 19 nt, Human
uacacuuagcaaaaccccc

SEQ ID NO: 905975 - RNA, 24 nt, Human
uacaggcaugagccaccacgccca

SEQ ID NO: 905976 - RNA, 21 nt, Human
uaccucaguuuuucucccugu

SEQ ID NO: 905977 - RNA, 22 nt, Human
uaccucaguuuuucucccugug

SEQ ID NO: 905978 - RNA, 22 nt, Human
uagagacgggguuucaccaugu

SEQ ID NO: 905979 - RNA, 26 nt, Human
uagcaaaacccccaaagacauccaga

SEQ ID NO: 905980 - RNA, 20 nt, Human
uagguucaagugauucuucu

SEQ ID NO: 905981 - RNA, 20 nt, Human
uagguucaagugauucuucu

SEQ ID NO: 905982 - RNA, 24 nt, Human
uaguagagacgggguuucaccaug

SEQ ID NO: 905983 - RNA, 25 nt, Human
uaguagagacgggguuucaccaugu

SEQ ID NO: 905984 - RNA, 18 nt, Human
uauuuuuaagaugggguc

SEQ ID NO: 905985 - RNA, 24 nt, Human
ucacccaggcuggagugcaguggc

SEQ ID NO: 905986 - RNA, 19 nt, Human
ucacugcaaccuccgccuc

SEQ ID NO: 905987 - RNA, 24 nt, Human
ucacugcaaccuccgccuccuagg

SEQ ID NO: 905988 - RNA, 25 nt, Human
ucacugcaaccuccgccuccuaggu

SEQ ID NO: 905989 - RNA, 27 nt, Human
ucacugcaaccuccgccuccuagguuc

SEQ ID NO: 905990 - RNA, 20 nt, Human
ucagccuccugaguagcugg

SEQ ID NO: 905991 - RNA, 22 nt, Human
ucagccuccugaguagcuggga

SEQ ID NO: 905992 - RNA, 21 nt, Human
ucauucuguccuuuggcuuca

SEQ ID NO: 905993 - RNA, 23 nt, Human
uccauacaaugagaagacuugga

SEQ ID NO: 905994 - RNA, 24 nt, Human
ucccaaagugcugggauuacaggc

SEQ ID NO: 905995 - RNA, 21 nt, Human
uccuagguucaagugauucuu

SEQ ID NO: 905996 - RNA, 24 nt, Human
uccuagguucaagugauucuucug

SEQ ID NO: 905997 - RNA, 24 nt, Human
uccugaguagcugggauuauaggc

SEQ ID NO: 905998 - RNA, 22 nt, Human
ucgcugggcugagucuucacau

SEQ ID NO: 905999 - RNA, 18 nt, Human
ucuaagaucaaaguaccc

SEQ ID NO: 906000 - RNA, 18 nt, Human
ucuacugcuuguucccca

SEQ ID NO: 906001 - RNA, 19 nt, Human
ucucgcccacgcguccgcg

SEQ ID NO: 906002 - RNA, 26 nt, Human
ucucgcucuacuguccaggcugcagc

SEQ ID NO: 906003 - RNA, 18 nt, Human
ucucugaagguagggauu

SEQ ID NO: 906004 - RNA, 21 nt, Human
ucugaagguagggauuuucau

SEQ ID NO: 906005 - RNA, 20 nt, Human
ucugccacucugugggcuca

SEQ ID NO: 906006 - RNA, 24 nt, Human
ucugucacccaggcuggagugcag

SEQ ID NO: 906007 - RNA, 22 nt, Human
ucuucacauccaggccucacag

SEQ ID NO: 906008 - RNA, 19 nt, Human
ucuuccccaucucaaccug

SEQ ID NO: 906009 - RNA, 21 nt, Human
ucuugaacuccuggccuuaag

SEQ ID NO: 906010 - RNA, 22 nt, Human
ucuugcucugucacccaggcug

SEQ ID NO: 906011 - RNA, 23 nt, Human
ucuugcucugucacccaggcugg

SEQ ID NO: 906012 - RNA, 24 nt, Human
ucuugcucugucacccaggcugga

SEQ ID NO: 906013 - RNA, 23 nt, Human
ugaagguagggauuuucauucug

SEQ ID NO: 906014 - RNA, 23 nt, Human
ugagaaacgacccaggaacccgg

SEQ ID NO: 906015 - RNA, 21 nt, Human
ugagagccaugcugucugcca

SEQ ID NO: 906016 - RNA, 19 nt, Human
ugagucuucacauccaggc

SEQ ID NO: 906017 - RNA, 18 nt, Human
ugccugccuuggccuccc

SEQ ID NO: 906018 - RNA, 24 nt, Human
ugcuucagccuccugaguagcugg

SEQ ID NO: 906019 - RNA, 21 nt, Human
uggagugcaguggcgcgaucu

SEQ ID NO: 906020 - RNA, 23 nt, Human
uggagugcaguggcgcgaucuug

SEQ ID NO: 906021 - RNA, 24 nt, Human
uggccagccaagcugauuccucag

SEQ ID NO: 906022 - RNA, 18 nt, Human
uggccuuaagugaucugc

SEQ ID NO: 906023 - RNA, 20 nt, Human
uggccuuaagugaucugccu

SEQ ID NO: 906024 - RNA, 24 nt, Human
uggccuuaagugaucugccugccu

SEQ ID NO: 906025 - RNA, 18 nt, Human
ugggauuacaggcaugag

SEQ ID NO: 906026 - RNA, 19 nt, Human
ugggauuacaggcaugagc

SEQ ID NO: 906027 - RNA, 22 nt, Human
ugggauuacaggcaugagccac

SEQ ID NO: 906028 - RNA, 23 nt, Human
ugggauuacaggcaugagccacc

SEQ ID NO: 906029 - RNA, 24 nt, Human
ugggauuacaggcaugagccacca

SEQ ID NO: 906030 - RNA, 24 nt, Human
ugggauuacaggcaugagccacca

SEQ ID NO: 906031 - RNA, 19 nt, Human
ugggauuauaggcgccugc

SEQ ID NO: 906032 - RNA, 21 nt, Human
ugggauuauaggcgccugcca

SEQ ID NO: 906033 - RNA, 21 nt, Human
ugggauuauaggcgccugcca

SEQ ID NO: 906034 - RNA, 22 nt, Human
ugggauuauaggcgccugccau

SEQ ID NO: 906035 - RNA, 24 nt, Human
ugggauuauaggcgccugccauua

SEQ ID NO: 906036 - RNA, 18 nt, Human
ugguguugggcugggcua

SEQ ID NO: 906037 - RNA, 21 nt, Human
uguauuuuuaguagagacggg

SEQ ID NO: 906038 - RNA, 20 nt, Human
uguccaggcugcagcugagu

SEQ ID NO: 906039 - RNA, 21 nt, Human
ugugaucacggcucacaccua

SEQ ID NO: 906040 - RNA, 18 nt, Human
uguucugucaucuucccc

SEQ ID NO: 906041 - RNA, 24 nt, Human
uguucugucaucuuccccaucuca

SEQ ID NO: 906042 - RNA, 18 nt, Human
uuaguagagacgggguuu

SEQ ID NO: 906043 - RNA, 22 nt, Human
uuaguagagacgggguuucacc

SEQ ID NO: 906044 - RNA, 24 nt, Human
uuaguagagacgggguuucaccau

SEQ ID NO: 906045 - RNA, 23 nt, Human
uucaagugauucuucugcuucag

SEQ ID NO: 906046 - RNA, 24 nt, Human
uucaagugauucuucugcuucagc

SEQ ID NO: 906047 - RNA, 23 nt, Human
uuccaaggcucaaaauggacgcu

SEQ ID NO: 906048 - RNA, 24 nt, Human
uugccggagcugaacuugcuggcc

SEQ ID NO: 906049 - RNA, 24 nt, Human
uuggccagguggucuugaacuccu

SEQ ID NO: 906050 - RNA, 18 nt, Human
uuggccucccaaagugcu

SEQ ID NO: 906051 - RNA, 19 nt, Human
uuucaccauguuggccagg

SEQ ID NO: 906052 - RNA, 20 nt, Human
uuucaccauguuggccaggu

SEQ ID NO: 906053 - RNA, 24 nt, Human
uuuuuaguagagacgggguuucac

SEQ ID NO: 906054 - RNA, 21 nt, Human
uuuuuguauuuuuaguagaga

SEQ ID NO: 906055 - RNA, 24 nt, Human
uuuuuuguauuuuuaguagagacg

SEQ ID NO: 906056 - RNA, 20 nt, Human
aacgaagauggcggaaagaa

SEQ ID NO: 906057 - RNA, 23 nt, Human
aagaacgaagauguuggaaagaa

SEQ ID NO: 906058 - RNA, 20 nt, Human
auaagaacaauauucuuggu

SEQ ID NO: 906059 - RNA, 27 nt, Human
caaauuuccagcauaagaacaauauuc

SEQ ID NO: 906060 - RNA, 23 nt, Human
caacuaaauuaccaggaagacca

SEQ ID NO: 906061 - RNA, 20 nt, Human
caccgcgaggcccuuuuccc

SEQ ID NO: 906062 - RNA, 19 nt, Human
caggaccuguccuaagccc

SEQ ID NO: 906063 - RNA, 25 nt, Human
ccgcuggcuccuccacacauucacu

SEQ ID NO: 906064 - RNA, 21 nt, Human
cggaaagaacgaagacacaac

SEQ ID NO: 906065 - RNA, 21 nt, Human
cucugcagaccuaccggcuga

SEQ ID NO: 906066 - RNA, 22 nt, Human
gaaagaacgaagauggcggaaa

SEQ ID NO: 906067 - RNA, 19 nt, Human
ggaaagaacgaagauggcc

SEQ ID NO: 906068 - RNA, 19 nt, Human
ucagucuucauuugucuug

SEQ ID NO: 906069 - RNA, 18 nt, Human
ucagugagaaagaacgaa

SEQ ID NO: 906070 - RNA, 18 nt, Human
uccuaagcccgcuggcuc

SEQ ID NO: 906071 - RNA, 18 nt, Human
ugagaaagaacgaagaug

SEQ ID NO: 906072 - RNA, 19 nt, Human
ugagaaagaacgaagaugu

SEQ ID NO: 906073 - RNA, 24 nt, Human
ugcagaccuaccggcugagucucg

SEQ ID NO: 906074 - RNA, 20 nt, Human
uggaaagaacgaagauggcg

SEQ ID NO: 906075 - RNA, 21 nt, Human
uucuugguuucagucuucauu

SEQ ID NO: 906076 - RNA, 18 nt, Human
aaaaacacaaaugaagug

SEQ ID NO: 906077 - RNA, 22 nt, Human
aaaaaguaaauauagcugaaaa

SEQ ID NO: 906078 - RNA, 19 nt, Human
aaaacaucccugcuaccaa

SEQ ID NO: 906079 - RNA, 23 nt, Human
aaaagcuuugaacagaaggguuc

SEQ ID NO: 906080 - RNA, 20 nt, Human
aacuuauuccacccacccug

SEQ ID NO: 906081 - RNA, 22 nt, Human
aagcagcaauacaaaaguauuc

SEQ ID NO: 906082 - RNA, 22 nt, Human
auguccaauauuuaaaaccagu

SEQ ID NO: 906083 - RNA, 24 nt, Human
cacaaaggaaccaggguugucuua

SEQ ID NO: 906084 - RNA, 23 nt, Human
caccuauauuucaaguuuggaaa

SEQ ID NO: 906085 - RNA, 19 nt, Human
caucccugcuaccaauaca

SEQ ID NO: 906086 - RNA, 24 nt, Human
cugaaaauguaaauuaguuauaau

SEQ ID NO: 906087 - RNA, 20 nt, Human
gaaccaggguugucuuaugg

SEQ ID NO: 906088 - RNA, 22 nt, Human
gaagugaaaaaagauuuuuccc

SEQ ID NO: 906089 - RNA, 18 nt, Human
gagaaaaaacccauaccu

SEQ ID NO: 906090 - RNA, 18 nt, Human
gggaacuucuaaguccuu

SEQ ID NO: 906091 - RNA, 21 nt, Human
gugaagggggagaaaaaaccc

SEQ ID NO: 906092 - RNA, 21 nt, Human
uaaaaaguaaauauagcugaa

SEQ ID NO: 906093 - RNA, 21 nt, Human
uaaaaccaguuuguaauuggg

SEQ ID NO: 906094 - RNA, 20 nt, Human
uaaaaugggaaacucaagca

SEQ ID NO: 906095 - RNA, 27 nt, Human
uaaacugguacacacuguucacaccua

SEQ ID NO: 906096 - RNA, 25 nt, Human
uauaaagauuuagcauauauauaua

SEQ ID NO: 906097 - RNA, 20 nt, Human
uauuccacccacccugguga

SEQ ID NO: 906098 - RNA, 22 nt, Human
uccacccacccuggugaagggg

SEQ ID NO: 906099 - RNA, 22 nt, Human
uccacggauugcagcgggccgc

SEQ ID NO: 906100 - RNA, 23 nt, Human
ugaaaaaagauuuuucccccaaa

SEQ ID NO: 906101 - RNA, 21 nt, Human
ugaagggggagaaaaaaccca

SEQ ID NO: 906102 - RNA, 21 nt, Human
ugaaugacagucuuuuuuuuu

SEQ ID NO: 906103 - RNA, 24 nt, Human
ugaaugacagucuuuuuuuuuuua

SEQ ID NO: 906104 - RNA, 20 nt, Human
ugaaugguaugaaugacagu

SEQ ID NO: 906105 - RNA, 22 nt, Human
ugcaagcagcaauacaaaagua

SEQ ID NO: 906106 - RNA, 19 nt, Human
ugcagcgggccgcgccgag

SEQ ID NO: 906107 - RNA, 25 nt, Human
ugguaugaaugacagucuuuuuuuu

SEQ ID NO: 906108 - RNA, 26 nt, Human
ugguaugaaugacagucuuuuuuuuu

SEQ ID NO: 906109 - RNA, 19 nt, Human
uguaauugggggaacuucu

SEQ ID NO: 906110 - RNA, 20 nt, Human
uguucacaccuauauuucaa

SEQ ID NO: 906111 - RNA, 24 nt, Human
uuagauuuuaaaaugggaaacuca

SEQ ID NO: 906112 - RNA, 22 nt, Human
uuuuuuuuuuuuuauuuuacag

SEQ ID NO: 906113 - RNA, 23 nt, Human
uuuuuuuuuuuuuuuuuuauuuu

SEQ ID NO: 906114 - RNA, 21 nt, Human
aaaucgauuuuauugcagcca

SEQ ID NO: 906115 - RNA, 24 nt, Human
aagauuugacauuagguaaaaaua

SEQ ID NO: 906116 - RNA, 21 nt, Human
aagcccuugguaucaaauagc

SEQ ID NO: 906117 - RNA, 18 nt, Human
acaaacaagcagaaaagu

SEQ ID NO: 906118 - RNA, 24 nt, Human
acacuaaaugucaaacuaaaauga

SEQ ID NO: 906119 - RNA, 28 nt, Human
accauaccuaaacugcuuuauaaaacug

SEQ ID NO: 906120 - RNA, 22 nt, Human
agauguaccaaauguaaaacag

SEQ ID NO: 906121 - RNA, 21 nt, Human
agccgccgcgccucacucggg

SEQ ID NO: 906122 - RNA, 18 nt, Human
aggaggagggcggcgggc

SEQ ID NO: 906123 - RNA, 22 nt, Human
aguaaaaaagucgaugcaaccc

SEQ ID NO: 906124 - RNA, 26 nt, Human
auaaagcagaauaauguucuagccuu

SEQ ID NO: 906125 - RNA, 24 nt, Human
auaacucaacauccuuaauuuggu

SEQ ID NO: 906126 - RNA, 21 nt, Human
auuugguauagaugugacauu

SEQ ID NO: 906127 - RNA, 19 nt, Human
caaaauaaaagugagaaag

SEQ ID NO: 906128 - RNA, 24 nt, Human
cacagauguaccaaauguaaaaca

SEQ ID NO: 906129 - RNA, 20 nt, Human
cccaugcuacaaaauaaaaa

SEQ ID NO: 906130 - RNA, 26 nt, Human
cccaugcuacaaaauaaaagugagaa

SEQ ID NO: 906131 - RNA, 22 nt, Human
ccccccaugacauuuaaaaagc

SEQ ID NO: 906132 - RNA, 21 nt, Human
cccccccaugacauuuaaaaa

SEQ ID NO: 906133 - RNA, 20 nt, Human
ccccucaagaaaaguagaau

SEQ ID NO: 906134 - RNA, 21 nt, Human
ccgccgcgccucacucgggcc

SEQ ID NO: 906135 - RNA, 21 nt, Human
ccgccgcgccucacucgggcc

SEQ ID NO: 906136 - RNA, 22 nt, Human
ccgccgcgccucacucgggccu

SEQ ID NO: 906137 - RNA, 20 nt, Human
ccucacucgggccucaugga

SEQ ID NO: 906138 - RNA, 18 nt, Human
ccuccuccaggggccgcu

SEQ ID NO: 906139 - RNA, 18 nt, Human
cgccgcgccucacucggg

SEQ ID NO: 906140 - RNA, 22 nt, Human
cggcucggcugcucggugcuuc

SEQ ID NO: 906141 - RNA, 24 nt, Human
cuaaaaaaggaugcuacauuuuug

SEQ ID NO: 906142 - RNA, 25 nt, Human
cuccaggggccgcugccgcugcgcu

SEQ ID NO: 906143 - RNA, 20 nt, Human
cuccuccgccuccuccucca

SEQ ID NO: 906144 - RNA, 24 nt, Human
cuccuccgccuccuccuccagggg

SEQ ID NO: 906145 - RNA, 22 nt, Human
gaaaaaauaaaaauaaaaaaga

SEQ ID NO: 906146 - RNA, 18 nt, Human
gaaagcuauaauacuccu

SEQ ID NO: 906147 - RNA, 21 nt, Human
gaacaaacaagcagaaaagug

SEQ ID NO: 906148 - RNA, 19 nt, Human
gaugcuacauuuuugcagu

SEQ ID NO: 906149 - RNA, 19 nt, Human
gcuacaaaauaaaagugag

SEQ ID NO: 906150 - RNA, 24 nt, Human
gcuccuccuccuccgccuccuccu

SEQ ID NO: 906151 - RNA, 20 nt, Human
gggaguucaccaaguuggga

SEQ ID NO: 906152 - RNA, 22 nt, Human
uaaaaagcccuugguaucaaau

SEQ ID NO: 906153 - RNA, 24 nt, Human
uaaaacaguggguuauuaacagaa

SEQ ID NO: 906154 - RNA, 23 nt, Human
uaaagcagaugaaaacuugaaug

SEQ ID NO: 906155 - RNA, 19 nt, Human
uaagguaaugaaguuaguc

SEQ ID NO: 906156 - RNA, 20 nt, Human
uaggacgcggggggaaggcg

SEQ ID NO: 906157 - RNA, 23 nt, Human
uauaaagcagaugaaaacuugaa

SEQ ID NO: 906158 - RNA, 20 nt, Human
ucauugggacacuaaauguc

SEQ ID NO: 906159 - RNA, 19 nt, Human
uccuccuccgccuccuccu

SEQ ID NO: 906160 - RNA, 23 nt, Human
ugaaaaaauaaaaauaaaaaaga

SEQ ID NO: 906161 - RNA, 20 nt, Human
ugaaugacaaauaucuagua

SEQ ID NO: 906162 - RNA, 18 nt, Human
ugacauuuucuugcucuc

SEQ ID NO: 906163 - RNA, 21 nt, Human
ugagaaagcuaacuguauuag

SEQ ID NO: 906164 - RNA, 21 nt, Human
uggaauaaaucuucagugaag

SEQ ID NO: 906165 - RNA, 22 nt, Human
ugggacacuaaaugucaaacua

SEQ ID NO: 906166 - RNA, 26 nt, Human
uuacaugcauauuuacaagcaauccu

SEQ ID NO: 906167 - RNA, 22 nt, Human
uuagugcuaaagauuuucaaga

SEQ ID NO: 906168 - RNA, 27 nt, Human
uuccccucaagaaaaguagaauuuaaa

SEQ ID NO: 906169 - RNA, 23 nt, Human
aagacuuggcaccaccaucaaca

SEQ ID NO: 906170 - RNA, 19 nt, Human
aagggaagccaucuuucuc

SEQ ID NO: 906171 - RNA, 19 nt, Human
aaugcaaaucucacauaug

SEQ ID NO: 906172 - RNA, 18 nt, Human
agccaacauggauggugu

SEQ ID NO: 906173 - RNA, 19 nt, Human
aggaguaaaacucagauac

SEQ ID NO: 906174 - RNA, 21 nt, Human
agugaaaacuguaccagaagc

SEQ ID NO: 906175 - RNA, 22 nt, Human
agugcugguguuccagaaggga

SEQ ID NO: 906176 - RNA, 23 nt, Human
auucagugcugguguuccagaag

SEQ ID NO: 906177 - RNA, 26 nt, Human
caacauggaugguguguucaaaauca

SEQ ID NO: 906178 - RNA, 20 nt, Human
caacgucaguagcagugaaa

SEQ ID NO: 906179 - RNA, 21 nt, Human
cacuguguuggagucguagac

SEQ ID NO: 906180 - RNA, 26 nt, Human
cagaccguguguaaauugguuaaaga

SEQ ID NO: 906181 - RNA, 22 nt, Human
caggaggaguaaaacucagaua

SEQ ID NO: 906182 - RNA, 22 nt, Human
cccaaaagaguaauaauuuuca

SEQ ID NO: 906183 - RNA, 20 nt, Human
ccggugguggggcaauaaug

SEQ ID NO: 906184 - RNA, 22 nt, Human
ccggugguggggcaauaauggg

SEQ ID NO: 906185 - RNA, 27 nt, Human
ccggugguggggcaauaaugggagggg

SEQ ID NO: 906186 - RNA, 20 nt, Human
ccucuggaacagaaggcaaa

SEQ ID NO: 906187 - RNA, 18 nt, Human
cuacugcaggugcuucug

SEQ ID NO: 906188 - RNA, 22 nt, Human
cuccucugucacuacugcaggu

SEQ ID NO: 906189 - RNA, 21 nt, Human
cucuucaucaucguccuccuc

SEQ ID NO: 906190 - RNA, 21 nt, Human
cuucuguucccucggcauuca

SEQ ID NO: 906191 - RNA, 23 nt, Human
cuuucuuuuuacuuccuuucucu

SEQ ID NO: 906192 - RNA, 23 nt, Human
gaggagaaauuucuggccguucc

SEQ ID NO: 906193 - RNA, 20 nt, Human
gcccugauaggcgguuugcu

SEQ ID NO: 906194 - RNA, 18 nt, Human
ggaacagaaggcaaaggu

SEQ ID NO: 906195 - RNA, 19 nt, Human
ggcaauaaugggaggggcc

SEQ ID NO: 906196 - RNA, 27 nt, Human
ggcuucuuguagaaaauggaaaaaaga

SEQ ID NO: 906197 - RNA, 18 nt, Human
guaacagcaucaaagcca

SEQ ID NO: 906198 - RNA, 18 nt, Human
gucauacuuuucuuuuug

SEQ ID NO: 906199 - RNA, 22 nt, Human
gucaucuuagucuucuuuuucu

SEQ ID NO: 906200 - RNA, 19 nt, Human
uaccagaagccccuugucc

SEQ ID NO: 906201 - RNA, 18 nt, Human
uacugcaggugcuucugu

SEQ ID NO: 906202 - RNA, 21 nt, Human
uagcaaccuucugucccagug

SEQ ID NO: 906203 - RNA, 22 nt, Human
uaggcgguuugcugaaagaccu

SEQ ID NO: 906204 - RNA, 21 nt, Human
ucaacauuugaaucaccaacu

SEQ ID NO: 906205 - RNA, 18 nt, Human
ucaauuccuucuuuggcu

SEQ ID NO: 906206 - RNA, 21 nt, Human
ucaggaggaguaaaacucaga

SEQ ID NO: 906207 - RNA, 20 nt, Human
ucauacuuuucuuuuugcaa

SEQ ID NO: 906208 - RNA, 20 nt, Human
uccuuuuggacccuaaagaa

SEQ ID NO: 906209 - RNA, 26 nt, Human
ucuccucuggaacagaaggcaaaggu

SEQ ID NO: 906210 - RNA, 21 nt, Human
ucucuucaucugucaucuuag

SEQ ID NO: 906211 - RNA, 18 nt, Human
ucuggccguuccuuuucu

SEQ ID NO: 906212 - RNA, 20 nt, Human
ucugucaucuuagucuucuu

SEQ ID NO: 906213 - RNA, 19 nt, Human
ugcagaccauuucuuuaaa

SEQ ID NO: 906214 - RNA, 24 nt, Human
ugccugagaauauggagaugauuu

SEQ ID NO: 906215 - RNA, 22 nt, Human
ugccugggcuuuuucuccucug

SEQ ID NO: 906216 - RNA, 20 nt, Human
uggaacagaaggcaaagguu

SEQ ID NO: 906217 - RNA, 23 nt, Human
uguccaauuuuuucauaucuugu

SEQ ID NO: 906218 - RNA, 19 nt, Human
uugcuucuuucauucaggu

SEQ ID NO: 906219 - RNA, 21 nt, Human
aaacaggcacaagugcaaaca

SEQ ID NO: 906220 - RNA, 22 nt, Human
aaacaggcacaagugcaaacaa

SEQ ID NO: 906221 - RNA, 22 nt, Human
aagcucagaagccuccugagcu

SEQ ID NO: 906222 - RNA, 21 nt, Human
acaagugcaaacaauucacaa

SEQ ID NO: 906223 - RNA, 23 nt, Human
acacacacacacacacacacaca

SEQ ID NO: 906224 - RNA, 23 nt, Human
acacacacacacacacacacaca

SEQ ID NO: 906225 - RNA, 23 nt, Human
acacacacacacacacacacaca

SEQ ID NO: 906226 - RNA, 23 nt, Human
acacacacacacacacacacaca

SEQ ID NO: 906227 - RNA, 23 nt, Human
acacacacacacacacacacaca

SEQ ID NO: 906228 - RNA, 23 nt, Human
acacacacacacacacacacaca

SEQ ID NO: 906229 - RNA, 23 nt, Human
acacacacacacacacacacaca

SEQ ID NO: 906230 - RNA, 23 nt, Human
acacacacacacacacacacaca

SEQ ID NO: 906231 - RNA, 23 nt, Human
acacacacacacacacacacaca

SEQ ID NO: 906232 - RNA, 23 nt, Human
acacacacacacacacacacacg

SEQ ID NO: 906233 - RNA, 24 nt, Human
acacacacacacacacgauguucu

SEQ ID NO: 906234 - RNA, 22 nt, Human
acaggaguggagagguggaagc

SEQ ID NO: 906235 - RNA, 23 nt, Human
acaggaguggagagguggaagcc

SEQ ID NO: 906236 - RNA, 21 nt, Human
acccagcugcuguccccagca

SEQ ID NO: 906237 - RNA, 25 nt, Human
accccauucuuucucuuucacucag

SEQ ID NO: 906238 - RNA, 19 nt, Human
accuggagggaccugggcu

SEQ ID NO: 906239 - RNA, 20 nt, Human
accuucaccaccgaccccau

SEQ ID NO: 906240 - RNA, 18 nt, Human
acuccacuggccagguag

SEQ ID NO: 906241 - RNA, 22 nt, Human
agaaagcaggucccuucaggcc

SEQ ID NO: 906242 - RNA, 20 nt, Human
agaauacugagaggaggagg

SEQ ID NO: 906243 - RNA, 22 nt, Human
agagcaccuucaccaccgaccc

SEQ ID NO: 906244 - RNA, 24 nt, Human
agccaggccaagaaagcagguccc

SEQ ID NO: 906245 - RNA, 20 nt, Human
aggccauucacaguucuggg

SEQ ID NO: 906246 - RNA, 19 nt, Human
agggcagaggguggggcug

SEQ ID NO: 906247 - RNA, 19 nt, Human
agguccggccuggcccagu

SEQ ID NO: 906248 - RNA, 19 nt, Human
augggucccugaugaccug

SEQ ID NO: 906249 - RNA, 25 nt, Human
auucacaguucugggcggggagggg

SEQ ID NO: 906250 - RNA, 19 nt, Human
caacugccuuuaaaaaacc

SEQ ID NO: 906251 - RNA, 19 nt, Human
caagaaagcaggucccuuc

SEQ ID NO: 906252 - RNA, 21 nt, Human
caagugcaaacaauucacaaa

SEQ ID NO: 906253 - RNA, 23 nt, Human
cacaagugcaaacaauucacaaa

SEQ ID NO: 906254 - RNA, 20 nt, Human
cacacacacacacacacaca

SEQ ID NO: 906255 - RNA, 20 nt, Human
cacacacacacacacacaca

SEQ ID NO: 906256 - RNA, 20 nt, Human
cacacacacacacacacaca

SEQ ID NO: 906257 - RNA, 20 nt, Human
cacacacacacacacacaca

SEQ ID NO: 906258 - RNA, 20 nt, Human
cacacacacacacacacaca

SEQ ID NO: 906259 - RNA, 20 nt, Human
cacacacacacacacacaca

SEQ ID NO: 906260 - RNA, 20 nt, Human
cacacacacacacacacaca

SEQ ID NO: 906261 - RNA, 20 nt, Human
cacacacacacacacacaca

SEQ ID NO: 906262 - RNA, 20 nt, Human
cacacacacacacacacaca

SEQ ID NO: 906263 - RNA, 20 nt, Human
cacacacacacacacacaca

SEQ ID NO: 906264 - RNA, 20 nt, Human
cacacacacacacacacaca

SEQ ID NO: 906265 - RNA, 20 nt, Human
cacacacacacacacacaca

SEQ ID NO: 906266 - RNA, 20 nt, Human
cacacacacacacacacaca

SEQ ID NO: 906267 - RNA, 20 nt, Human
cacacacacacacacacaca

SEQ ID NO: 906268 - RNA, 20 nt, Human
cacacacacacacacacaca

SEQ ID NO: 906269 - RNA, 22 nt, Human
cacacacacacacacacacaca

SEQ ID NO: 906270 - RNA, 22 nt, Human
cacacacacacacacacacaca

SEQ ID NO: 906271 - RNA, 22 nt, Human
cacacacacacacacacacaca

SEQ ID NO: 906272 - RNA, 22 nt, Human
cacacacacacacacacacaca

SEQ ID NO: 906273 - RNA, 22 nt, Human
cacacacacacacacacacaca

SEQ ID NO: 906274 - RNA, 26 nt, Human
cacacacacacacacacacacacaca

SEQ ID NO: 906275 - RNA, 26 nt, Human
cacacacacacacacacacacacaca

SEQ ID NO: 906276 - RNA, 26 nt, Human
cacacacacacacacacacacacaca

SEQ ID NO: 906277 - RNA, 26 nt, Human
cacacacacacacacacacacacaca

SEQ ID NO: 906278 - RNA, 26 nt, Human
cacacacacacacacacacacacaca

SEQ ID NO: 906279 - RNA, 26 nt, Human
cacacacacacacacacacacacaca

SEQ ID NO: 906280 - RNA, 26 nt, Human
cacacacacacacacacacacacaca

SEQ ID NO: 906281 - RNA, 26 nt, Human
cacacacacacacacacacacacaca

SEQ ID NO: 906282 - RNA, 26 nt, Human
cacacacacacacacacacacacaca

SEQ ID NO: 906283 - RNA, 26 nt, Human
cacacacacacacacacacacacaca

SEQ ID NO: 906284 - RNA, 26 nt, Human
cacacacacacacacacacacacaca

SEQ ID NO: 906285 - RNA, 26 nt, Human
cacacacacacacacacacacacgau

SEQ ID NO: 906286 - RNA, 19 nt, Human
cacagcagcccugaagugg

SEQ ID NO: 906287 - RNA, 18 nt, Human
cacucagaaauugucccc

SEQ ID NO: 906288 - RNA, 23 nt, Human
cacuggccagguagacacaggag

SEQ ID NO: 906289 - RNA, 21 nt, Human
cacugggccucucucuuaggc

SEQ ID NO: 906290 - RNA, 23 nt, Human
cagaaauuguccccucacucccu

SEQ ID NO: 906291 - RNA, 22 nt, Human
cagaagccuccugagcucccag

SEQ ID NO: 906292 - RNA, 23 nt, Human
cagcaucaguuaggauaaacucc

SEQ ID NO: 906293 - RNA, 21 nt, Human
cagccuuccugaaacuggcug

SEQ ID NO: 906294 - RNA, 18 nt, Human
cagggccgaggaggacaa

SEQ ID NO: 906295 - RNA, 23 nt, Human
caguaggcugaagggcagagggu

SEQ ID NO: 906296 - RNA, 20 nt, Human
cauaaaaaccaccccguggc

SEQ ID NO: 906297 - RNA, 19 nt, Human
caucucacagcagcccuga

SEQ ID NO: 906298 - RNA, 22 nt, Human
ccagacagggccugggccugcc

SEQ ID NO: 906299 - RNA, 18 nt, Human
cccagugugcccugccug

SEQ ID NO: 906300 - RNA, 21 nt, Human
cccccagccauggccuggagc

SEQ ID NO: 906301 - RNA, 22 nt, Human
ccccucacucccugcccccagc

SEQ ID NO: 906302 - RNA, 19 nt, Human
ccccucucccugacgccca

SEQ ID NO: 906303 - RNA, 25 nt, Human
cccuuaaaaaaaaguccuugcaauu

SEQ ID NO: 906304 - RNA, 26 nt, Human
ccucacccgcacugggccucucucuu

SEQ ID NO: 906305 - RNA, 18 nt, Human
ccucacucccugccccca

SEQ ID NO: 906306 - RNA, 31 nt, Human
ccuccccuuacacacacacacacacacacag

SEQ ID NO: 906307 - RNA, 18 nt, Human
ccugcccccagccauggc

SEQ ID NO: 906308 - RNA, 23 nt, Human
ccuguagaaaggggucuccaucu

SEQ ID NO: 906309 - RNA, 21 nt, Human
ccugucaagcccccagccagc

SEQ ID NO: 906310 - RNA, 19 nt, Human
ccuuccggcgccuuccgcc

SEQ ID NO: 906311 - RNA, 21 nt, Human
cguucuccacugcaggcuggu

SEQ ID NO: 906312 - RNA, 23 nt, Human
cuccugagcucccaggaguguua

SEQ ID NO: 906313 - RNA, 19 nt, Human
cucgagguuugaagcugga

SEQ ID NO: 906314 - RNA, 18 nt, Human
cucucugcuggacccagc

SEQ ID NO: 906315 - RNA, 22 nt, Human
cucucugcuggacccagcugcu

SEQ ID NO: 906316 - RNA, 18 nt, Human
cugcuccuucugggcagc

SEQ ID NO: 906317 - RNA, 18 nt, Human
cuggagcaggccauucac

SEQ ID NO: 906318 - RNA, 25 nt, Human
cuggagcaggccauucacaguucug

SEQ ID NO: 906319 - RNA, 20 nt, Human
cuggccagguagacacagga

SEQ ID NO: 906320 - RNA, 19 nt, Human
cugugcacccagacagggc

SEQ ID NO: 906321 - RNA, 18 nt, Human
gaagagaacaaugggucc

SEQ ID NO: 906322 - RNA, 19 nt, Human
gaagggcagaggguggggc

SEQ ID NO: 906323 - RNA, 22 nt, Human
gagaauacugagaggaggaggc

SEQ ID NO: 906324 - RNA, 21 nt, Human
gagcaggccauucacaguucu

SEQ ID NO: 906325 - RNA, 18 nt, Human
gaggacaaggagacagca

SEQ ID NO: 906326 - RNA, 19 nt, Human
gaugccugugaccuugaca

SEQ ID NO: 906327 - RNA, 21 nt, Human
gccaagaaagcaggucccuuc

SEQ ID NO: 906328 - RNA, 24 nt, Human
gcucucugcuggacccagcugcug

SEQ ID NO: 906329 - RNA, 19 nt, Human
gcuggggcuucacauuuca

SEQ ID NO: 906330 - RNA, 19 nt, Human
gggaggggcuguacaggug

SEQ ID NO: 906331 - RNA, 20 nt, Human
gggcagaggguggggcuggg

SEQ ID NO: 906332 - RNA, 22 nt, Human
gggcagaggguggggcuggggc

SEQ ID NO: 906333 - RNA, 24 nt, Human
gggcagaggguggggcuggggcuu

SEQ ID NO: 906334 - RNA, 18 nt, Human
gggccugcgcccacccag

SEQ ID NO: 906335 - RNA, 20 nt, Human
ggggaggggcuguacaggug

SEQ ID NO: 906336 - RNA, 22 nt, Human
ggguccugcguucuccacugca

SEQ ID NO: 906337 - RNA, 21 nt, Human
gucauccuguagaaagggguc

SEQ ID NO: 906338 - RNA, 23 nt, Human
guccccucacucccugcccccag

SEQ ID NO: 906339 - RNA, 22 nt, Human
guggggcagggccgaggaggac

SEQ ID NO: 906340 - RNA, 20 nt, Human
uaacacaguugccaauccuu

SEQ ID NO: 906341 - RNA, 23 nt, Human
uaauuuaaaacaggcacaagugc

SEQ ID NO: 906342 - RNA, 20 nt, Human
uacacacacacacacacaca

SEQ ID NO: 906343 - RNA, 25 nt, Human
uacacacacacacacacacacacac

SEQ ID NO: 906344 - RNA, 21 nt, Human
uacacacacacacacacacag

SEQ ID NO: 906345 - RNA, 19 nt, Human
uagaaaggguccagacacc

SEQ ID NO: 906346 - RNA, 19 nt, Human
uagguggcaggcauacuug

SEQ ID NO: 906347 - RNA, 22 nt, Human
ucacagcagcccugaagugggg

SEQ ID NO: 906348 - RNA, 21 nt, Human
ucagaagccuccugagcuccc

SEQ ID NO: 906349 - RNA, 24 nt, Human
ucaggacaucagacgugagggagg

SEQ ID NO: 906350 - RNA, 18 nt, Human
uccacugcaggcuggugc

SEQ ID NO: 906351 - RNA, 31 nt, Human
uccccuuacacacacacacacacacacacag

SEQ ID NO: 906352 - RNA, 19 nt, Human
ucccugggcaucuugcugu

SEQ ID NO: 906353 - RNA, 24 nt, Human
ucccuucaggccagaacuuagugg

SEQ ID NO: 906354 - RNA, 23 nt, Human
uccgccucuuccucgcgacuccu

SEQ ID NO: 906355 - RNA, 18 nt, Human
uccugagcucccaggagu

SEQ ID NO: 906356 - RNA, 24 nt, Human
uccuuacauuccugucucuggccc

SEQ ID NO: 906357 - RNA, 20 nt, Human
ucuacuguguuggcugcaga

SEQ ID NO: 906358 - RNA, 25 nt, Human
ucucacagcagcccugaaguggggc

SEQ ID NO: 906359 - RNA, 23 nt, Human
ucuccacugcaggcuggugcuug

SEQ ID NO: 906360 - RNA, 23 nt, Human
ucuccauucuguaaagugagagc

SEQ ID NO: 906361 - RNA, 18 nt, Human
ucugacccuuaaaaaaaa

SEQ ID NO: 906362 - RNA, 21 nt, Human
ucuguccugugcacccagaca

SEQ ID NO: 906363 - RNA, 20 nt, Human
ucuguggaggcagcuggggc

SEQ ID NO: 906364 - RNA, 20 nt, Human
ugaagagaacaauggguccc

SEQ ID NO: 906365 - RNA, 20 nt, Human
ugaagagaacaauggguccc

SEQ ID NO: 906366 - RNA, 23 nt, Human
ugacaugauggaaacccggaggu

SEQ ID NO: 906367 - RNA, 20 nt, Human
ugacccuuaaaaaaaagucc

SEQ ID NO: 906368 - RNA, 18 nt, Human
ugagaacagcagguaucu

SEQ ID NO: 906369 - RNA, 24 nt, Human
ugagagcaccuucaccaccgaccc

SEQ ID NO: 906370 - RNA, 18 nt, Human
ugagaggaggaggcaggc

SEQ ID NO: 906371 - RNA, 22 nt, Human
ugagaggaggaggcaggcaagu

SEQ ID NO: 906372 - RNA, 20 nt, Human
ugaggagagggaagaccugg

SEQ ID NO: 906373 - RNA, 19 nt, Human
ugcacacauggaugccugu

SEQ ID NO: 906374 - RNA, 24 nt, Human
ugccggcaggcuggcugcccagug

SEQ ID NO: 906375 - RNA, 22 nt, Human
uggaagccaggccaagaaagca

SEQ ID NO: 906376 - RNA, 24 nt, Human
uggaauuccaucucacagcagccc

SEQ ID NO: 906377 - RNA, 24 nt, Human
uggacaacugccuuuaaaaaacca

SEQ ID NO: 906378 - RNA, 21 nt, Human
uggagagaauacugagaggag

SEQ ID NO: 906379 - RNA, 24 nt, Human
uggagagaauacugagaggaggaa

SEQ ID NO: 906380 - RNA, 18 nt, Human
uggaggcagcuggggcag

SEQ ID NO: 906381 - RNA, 19 nt, Human
uggaugccugugaccuuga

SEQ ID NO: 906382 - RNA, 22 nt, Human
uggccuggagcaggccauucac

SEQ ID NO: 906383 - RNA, 21 nt, Human
uggcugugggugaccuggagg

SEQ ID NO: 906384 - RNA, 21 nt, Human
ugggcuuugaacacucaauuu

SEQ ID NO: 906385 - RNA, 22 nt, Human
ugggugaccuggagggaccugg

SEQ ID NO: 906386 - RNA, 20 nt, Human
ugucucuguccugugcaccc

SEQ ID NO: 906387 - RNA, 19 nt, Human
uguggagaccagcagucug

SEQ ID NO: 906388 - RNA, 18 nt, Human
uguggaggcagcuggggc

SEQ ID NO: 906389 - RNA, 20 nt, Human
uguguuggcugcagaggcca

SEQ ID NO: 906390 - RNA, 19 nt, Human
uucacaguucugggcgggg

SEQ ID NO: 906391 - RNA, 19 nt, Human
uucuccacugcaggcuggu

SEQ ID NO: 906392 - RNA, 21 nt, Human
uucucuuucacucagaaauug

SEQ ID NO: 906393 - RNA, 28 nt, Human
uugcacacauggaugccuggucagagga

SEQ ID NO: 906394 - RNA, 21 nt, Human
uuggagagaauacugagagga

SEQ ID NO: 906395 - RNA, 23 nt, Human
uuuuuuuuuuuuuuuuugggcuu

SEQ ID NO: 906396 - RNA, 23 nt, Human
uuuuuuuuuuuuuuuuuuuuggg

SEQ ID NO: 906397 - RNA, 19 nt, Human
aaagauuuucuuuuucuuu

SEQ ID NO: 906398 - RNA, 24 nt, Human
aaauacccucuugcuaauucaucc

SEQ ID NO: 906399 - RNA, 21 nt, Human
aacaagcaacacaaaauguau

SEQ ID NO: 906400 - RNA, 23 nt, Human
aacucaaugaauacuuuaaaaaa

SEQ ID NO: 906401 - RNA, 22 nt, Human
aacugaauccaaugauccuagc

SEQ ID NO: 906402 - RNA, 22 nt, Human
acagaguuuuaaaaauggugac

SEQ ID NO: 906403 - RNA, 19 nt, Human
acaugggcacaacugaagu

SEQ ID NO: 906404 - RNA, 23 nt, Human
acucuccacccaaaccuccccca

SEQ ID NO: 906405 - RNA, 21 nt, Human
acugaagucagaucauaccug

SEQ ID NO: 906406 - RNA, 24 nt, Human
acuggcuggguaggggcaaggggg

SEQ ID NO: 906407 - RNA, 21 nt, Human
agaaaacugaaaaucuaauca

SEQ ID NO: 906408 - RNA, 23 nt, Human
agcgggagggggugagaggcaga

SEQ ID NO: 906409 - RNA, 29 nt, Human
agggauaaaaaaguaggaaaggcuuuguu

SEQ ID NO: 906410 - RNA, 21 nt, Human
aggggcaaggggggcgggggc

SEQ ID NO: 906411 - RNA, 21 nt, Human
aggggggcgggggccagcggg

SEQ ID NO: 906412 - RNA, 20 nt, Human
agggggugagaggcagagcc

SEQ ID NO: 906413 - RNA, 23 nt, Human
agucuucuucauuuuuccucagu

SEQ ID NO: 906414 - RNA, 19 nt, Human
agugcuuuuuguuuuccuu

SEQ ID NO: 906415 - RNA, 27 nt, Human
auaaauuaucaaaacuaucguacagaa

SEQ ID NO: 906416 - RNA, 21 nt, Human
augcaguuucugccaauaguu

SEQ ID NO: 906417 - RNA, 18 nt, Human
auucugcaacuuuucgcu

SEQ ID NO: 906418 - RNA, 25 nt, Human
caaaccucccccagcuacugagcau

SEQ ID NO: 906419 - RNA, 23 nt, Human
caacaagcaacacaaaauguauu

SEQ ID NO: 906420 - RNA, 23 nt, Human
caaggggggcgggggccagcggg

SEQ ID NO: 906421 - RNA, 18 nt, Human
cacagcuuucuacucucc

SEQ ID NO: 906422 - RNA, 23 nt, Human
cagcgggagggggugagaggcag

SEQ ID NO: 906423 - RNA, 23 nt, Human
caucacgcugucccaccaauugg

SEQ ID NO: 906424 - RNA, 21 nt, Human
ccacccaaaccucccccagcu

SEQ ID NO: 906425 - RNA, 22 nt, Human
ccccagcuacugagcaugccca

SEQ ID NO: 906426 - RNA, 23 nt, Human
cccccagcuacugagcaugccca

SEQ ID NO: 906427 - RNA, 18 nt, Human
cccucggaggacugucca

SEQ ID NO: 906428 - RNA, 18 nt, Human
cccuggucuguugaaccc

SEQ ID NO: 906429 - RNA, 20 nt, Human
ccuagcacugaaauugcucc

SEQ ID NO: 906430 - RNA, 22 nt, Human
cggugccucagccccuucucag

SEQ ID NO: 906431 - RNA, 27 nt, Human
cucauggucucacugaaacauucuauu

SEQ ID NO: 906432 - RNA, 28 nt, Human
cucuccacccaaaccucccccagcuacu

SEQ ID NO: 906433 - RNA, 22 nt, Human
cuggugcuugucagucuucuuc

SEQ ID NO: 906434 - RNA, 18 nt, Human
cuuuuuuuuuuuuuuuug

SEQ ID NO: 906435 - RNA, 22 nt, Human
cuuuuuuuuuuuuuuuugccag

SEQ ID NO: 906436 - RNA, 24 nt, Human
gaacauuuaggacugccauuuucu

SEQ ID NO: 906437 - RNA, 20 nt, Human
gaauuaaagacuccagagga

SEQ ID NO: 906438 - RNA, 22 nt, Human
gacuauguagcucuuccagagu

SEQ ID NO: 906439 - RNA, 18 nt, Human
gagggggugagaggcaga

SEQ ID NO: 906440 - RNA, 23 nt, Human
gcccuguucucuccucucccuuu

SEQ ID NO: 906441 - RNA, 23 nt, Human
gcggcggugccucagccccuucu

SEQ ID NO: 906442 - RNA, 21 nt, Human
gcuucgccccucggaggacug

SEQ ID NO: 906443 - RNA, 19 nt, Human
gcuuuguucaaacuccucu

SEQ ID NO: 906444 - RNA, 24 nt, Human
ggaaaaugugaucuuuaaaaauau

SEQ ID NO: 906445 - RNA, 19 nt, Human
ggaacugaauccaaugauc

SEQ ID NO: 906446 - RNA, 21 nt, Human
ggagggggugagaggcagagc

SEQ ID NO: 906447 - RNA, 20 nt, Human
ggcgggggccagcgggaggg

SEQ ID NO: 906448 - RNA, 18 nt, Human
gggagggggugagaggca

SEQ ID NO: 906449 - RNA, 18 nt, Human
gggcaaggggggcggggg

SEQ ID NO: 906450 - RNA, 23 nt, Human
gguaggggcaaggggggcggggg

SEQ ID NO: 906451 - RNA, 21 nt, Human
guacagaaaaauuacaaauuc

SEQ ID NO: 906452 - RNA, 29 nt, Human
uaaaauacccucuugcuaauucauccucu

SEQ ID NO: 906453 - RNA, 18 nt, Human
uaacaugcaaauucaucc

SEQ ID NO: 906454 - RNA, 20 nt, Human
uaagaaaagccucuguuuuc

SEQ ID NO: 906455 - RNA, 21 nt, Human
uacagaguuuuaaaaauggug

SEQ ID NO: 906456 - RNA, 21 nt, Human
uacccugcauguggcuaggau

SEQ ID NO: 906457 - RNA, 24 nt, Human
uacuucaacugauacaauggcuac

SEQ ID NO: 906458 - RNA, 18 nt, Human
uagaaaauccuacauguu

SEQ ID NO: 906459 - RNA, 25 nt, Human
uagugcucacaaaaccuuuuaagcu

SEQ ID NO: 906460 - RNA, 18 nt, Human
uauaaauuaucaaaacua

SEQ ID NO: 906461 - RNA, 22 nt, Human
ucagcgaagcggcggugccucu

SEQ ID NO: 906462 - RNA, 22 nt, Human
uccaaugauccuagcacugaaa

SEQ ID NO: 906463 - RNA, 18 nt, Human
uccacccaaaccuccccc

SEQ ID NO: 906464 - RNA, 22 nt, Human
uccacccaaaccucccccagcu

SEQ ID NO: 906465 - RNA, 18 nt, Human
uccccgggcgcacgcugg

SEQ ID NO: 906466 - RNA, 18 nt, Human
ucccggucuccccgggcg

SEQ ID NO: 906467 - RNA, 21 nt, Human
ucuccacccaaaccuccccca

SEQ ID NO: 906468 - RNA, 23 nt, Human
ucugucucaugaacauuuaggac

SEQ ID NO: 906469 - RNA, 19 nt, Human
ucuuccagaguuuuaaagg

SEQ ID NO: 906470 - RNA, 20 nt, Human
ugaauuauucucauguccuc

SEQ ID NO: 906471 - RNA, 20 nt, Human
ugagagucauucaguauuca

SEQ ID NO: 906472 - RNA, 19 nt, Human
ugagcaugcccagcugccc

SEQ ID NO: 906473 - RNA, 23 nt, Human
ugcaaaugcaguuucugccaaua

SEQ ID NO: 906474 - RNA, 20 nt, Human
ugcacaccaucaccaucacu

SEQ ID NO: 906475 - RNA, 24 nt, Human
ugcauaauuaauagaaacuaauga

SEQ ID NO: 906476 - RNA, 18 nt, Human
ugccauuuucuggauuua

SEQ ID NO: 906477 - RNA, 20 nt, Human
ugcccuggucuguugaaccc

SEQ ID NO: 906478 - RNA, 20 nt, Human
ugccucagccccuucucagc

SEQ ID NO: 906479 - RNA, 20 nt, Human
ugcuaccauuaagaaaaaag

SEQ ID NO: 906480 - RNA, 19 nt, Human
uggaagcauuucaccacag

SEQ ID NO: 906481 - RNA, 19 nt, Human
uggcuaggauauaucauaa

SEQ ID NO: 906482 - RNA, 21 nt, Human
uggcuggguaggggcaagggg

SEQ ID NO: 906483 - RNA, 24 nt, Human
uggcuggguaggggcaaggggggc

SEQ ID NO: 906484 - RNA, 18 nt, Human
ugggaacugaauccaaug

SEQ ID NO: 906485 - RNA, 19 nt, Human
uggguaggggcaagggggg

SEQ ID NO: 906486 - RNA, 18 nt, Human
ugugcaaaagaaugguuu

SEQ ID NO: 906487 - RNA, 22 nt, Human
uguggugugcaaaagaaugguu

SEQ ID NO: 906488 - RNA, 24 nt, Human
uuaauuaugcuuagagcaaccaga

SEQ ID NO: 906489 - RNA, 18 nt, Human
uucauggaaaaugugauc

SEQ ID NO: 906490 - RNA, 24 nt, Human
uuuaaaaaagauuuucuuuuucuu

SEQ ID NO: 906491 - RNA, 22 nt, Human
uuuauucugguuuaaaaaagau

SEQ ID NO: 906492 - RNA, 21 nt, Human
uuuuaugccuuuuuuccuuuu

SEQ ID NO: 906493 - RNA, 23 nt, Human
agguacccgagcagguaagagug

SEQ ID NO: 906494 - RNA, 19 nt, Human
cuugcugcugcuguuguug

SEQ ID NO: 906495 - RNA, 20 nt, Human
gcuugcugcugcuguuguug

SEQ ID NO: 906496 - RNA, 21 nt, Human
ggugucagagcuaaagaagga

SEQ ID NO: 906497 - RNA, 23 nt, Human
uagcagcuugcugcugcuguugu

SEQ ID NO: 906498 - RNA, 19 nt, Human
ugcaguagcagcuugcugc

SEQ ID NO: 906499 - RNA, 18 nt, Human
uuguugcaguagcagcuu

SEQ ID NO: 906500 - RNA, 20 nt, Human
aaacucggaaggaacaugua

SEQ ID NO: 906501 - RNA, 24 nt, Human
aacauguaacaacacgccaagucc

SEQ ID NO: 906502 - RNA, 23 nt, Human
aaccccauagagccucacuucca

SEQ ID NO: 906503 - RNA, 23 nt, Human
aagcaggauggagaagaggccgg

SEQ ID NO: 906504 - RNA, 23 nt, Human
aaggcucgcggcucgagggacuc

SEQ ID NO: 906505 - RNA, 19 nt, Human
accaggcacaagugcacgg

SEQ ID NO: 906506 - RNA, 20 nt, Human
acugccugagauuggggggc

SEQ ID NO: 906507 - RNA, 24 nt, Human
acugccugagauuggggggccagc

SEQ ID NO: 906508 - RNA, 21 nt, Human
agaaaggcacagguaggaggc

SEQ ID NO: 906509 - RNA, 20 nt, Human
agacuccagggaggaggagg

SEQ ID NO: 906510 - RNA, 23 nt, Human
agcgaaagaaaacucggaaggaa

SEQ ID NO: 906511 - RNA, 19 nt, Human
aggaggaaggagggcccag

SEQ ID NO: 906512 - RNA, 21 nt, Human
aggaggaggggguuccacggg

SEQ ID NO: 906513 - RNA, 22 nt, Human
aggaggcccagaggguggcagg

SEQ ID NO: 906514 - RNA, 18 nt, Human
aggagggcccaguggggg

SEQ ID NO: 906515 - RNA, 25 nt, Human
aggcgccgggaggggccgggcuggu

SEQ ID NO: 906516 - RNA, 19 nt, Human
agggacccaggcucccauc

SEQ ID NO: 906517 - RNA, 26 nt, Human
agggaggaggaggggguuccacggcu

SEQ ID NO: 906518 - RNA, 22 nt, Human
agggcccagugggggcgggagc

SEQ ID NO: 906519 - RNA, 24 nt, Human
aggggaggggagggggacgcggcc

SEQ ID NO: 906520 - RNA, 20 nt, Human
aggggcacagcagaggggcc

SEQ ID NO: 906521 - RNA, 19 nt, Human
agggggcuugggggcaggc

SEQ ID NO: 906522 - RNA, 23 nt, Human
cacacagggcauaggggcacagc

SEQ ID NO: 906523 - RNA, 18 nt, Human
cacagguaggaggcccag

SEQ ID NO: 906524 - RNA, 23 nt, Human
caccaggaggaaggagggcccaa

SEQ ID NO: 906525 - RNA, 19 nt, Human
cacccgccaggaccccggu

SEQ ID NO: 906526 - RNA, 18 nt, Human
caggcacaagugcacggc

SEQ ID NO: 906527 - RNA, 21 nt, Human
caggccucaguacccaccccc

SEQ ID NO: 906528 - RNA, 20 nt, Human
cagguaggaggcccagaggg

SEQ ID NO: 906529 - RNA, 18 nt, Human
ccacccaagaccuuuagc

SEQ ID NO: 906530 - RNA, 19 nt, Human
ccacccaggggcagagcgg

SEQ ID NO: 906531 - RNA, 22 nt, Human
ccacccccggcucccggggccc

SEQ ID NO: 906532 - RNA, 18 nt, Human
ccagggaggaggaggggg

SEQ ID NO: 906533 - RNA, 20 nt, Human
ccagggccugagcaggccuc

SEQ ID NO: 906534 - RNA, 22 nt, Human
ccauagagccucacuuccaggg

SEQ ID NO: 906535 - RNA, 20 nt, Human
cccacacagggcauaggggc

SEQ ID NO: 906536 - RNA, 21 nt, Human
cccacccccggcucccggggc

SEQ ID NO: 906537 - RNA, 23 nt, Human
cccaggacccugguccaagcagg

SEQ ID NO: 906538 - RNA, 21 nt, Human
cccaggcugugucccucccuc

SEQ ID NO: 906539 - RNA, 23 nt, Human
ccccaaagaggcacggccucacc

SEQ ID NO: 906540 - RNA, 23 nt, Human
ccccauagagccucacuuccagg

SEQ ID NO: 906541 - RNA, 24 nt, Human
cccuagggcagggaccaaguuggg

SEQ ID NO: 906542 - RNA, 23 nt, Human
cccugggguccccaaauuagcac

SEQ ID NO: 906543 - RNA, 20 nt, Human
ccucaccccaacugccugag

SEQ ID NO: 906544 - RNA, 19 nt, Human
ccucccuccacugcccgga

SEQ ID NO: 906545 - RNA, 25 nt, Human
ccucuggggacgaguguaacguaac

SEQ ID NO: 906546 - RNA, 18 nt, Human
ccuggacccgugaggcug

SEQ ID NO: 906547 - RNA, 20 nt, Human
cgagguggccccuguaccug

SEQ ID NO: 906548 - RNA, 22 nt, Human
cgccccgucuagaagauagccc

SEQ ID NO: 906549 - RNA, 23 nt, Human
cgccccgucuagaagauagccca

SEQ ID NO: 906550 - RNA, 21 nt, Human
cgcggguggcgcgcgggggag

SEQ ID NO: 906551 - RNA, 18 nt, Human
cgggggccucgucacaca

SEQ ID NO: 906552 - RNA, 19 nt, Human
cucuccucccagccaccca

SEQ ID NO: 906553 - RNA, 21 nt, Human
cugcccggacgugcuccaagc

SEQ ID NO: 906554 - RNA, 18 nt, Human
cugccgaggcugcaggug

SEQ ID NO: 906555 - RNA, 19 nt, Human
cuggguggcaaaugagggu

SEQ ID NO: 906556 - RNA, 22 nt, Human
cugguccaagcaggauggagaa

SEQ ID NO: 906557 - RNA, 19 nt, Human
gagcaggccucaguaccca

SEQ ID NO: 906558 - RNA, 21 nt, Human
gagccucacuuccagggccug

SEQ ID NO: 906559 - RNA, 26 nt, Human
gaggucccuagggcagggaccaaguu

SEQ ID NO: 906560 - RNA, 19 nt, Human
gcaaaugagggucuccugc

SEQ ID NO: 906561 - RNA, 20 nt, Human
gcaggcgccgggaggggccg

SEQ ID NO: 906562 - RNA, 23 nt, Human
gccaggaccccggugggcgcgac

SEQ ID NO: 906563 - RNA, 18 nt, Human
gcccccaaagaggcacgg

SEQ ID NO: 906564 - RNA, 21 nt, Human
gccgggcgggggcgggcgcgg

SEQ ID NO: 906565 - RNA, 21 nt, Human
gccggggucucgggggccggc

SEQ ID NO: 906566 - RNA, 21 nt, Human
gccuguccuccacccaagacc

SEQ ID NO: 906567 - RNA, 18 nt, Human
gcggaggcagggacccag

SEQ ID NO: 906568 - RNA, 23 nt, Human
gcgggcgcggguggcgcgcgggg

SEQ ID NO: 906569 - RNA, 19 nt, Human
gcucacucggucccugccc

SEQ ID NO: 906570 - RNA, 23 nt, Human
gcugcagguggugacuggaccag

SEQ ID NO: 906571 - RNA, 25 nt, Human
gcuggugggugucuguggucggcgc

SEQ ID NO: 906572 - RNA, 18 nt, Human
gcugugucccucccucca

SEQ ID NO: 906573 - RNA, 22 nt, Human
ggaacauguaacaacacgccaa

SEQ ID NO: 906574 - RNA, 22 nt, Human
ggagaagaggccgggggcggcc

SEQ ID NO: 906575 - RNA, 18 nt, Human
ggaggaggaggggguucc

SEQ ID NO: 906576 - RNA, 20 nt, Human
ggaggcccagaggguggcag

SEQ ID NO: 906577 - RNA, 20 nt, Human
ggcaggucaaugaccccugg

SEQ ID NO: 906578 - RNA, 19 nt, Human
ggccuggcggccggggcug

SEQ ID NO: 906579 - RNA, 19 nt, Human
ggccugggccgcguggagg

SEQ ID NO: 906580 - RNA, 21 nt, Human
ggcguggugacgggugggggc

SEQ ID NO: 906581 - RNA, 20 nt, Human
ggcucgagggacucaggcag

SEQ ID NO: 906582 - RNA, 19 nt, Human
gggaggggccgggcuggug

SEQ ID NO: 906583 - RNA, 22 nt, Human
gggcacagcagaggggccuguc

SEQ ID NO: 906584 - RNA, 23 nt, Human
gggcauaggggcacagcagaggg

SEQ ID NO: 906585 - RNA, 22 nt, Human
gggccucuccucccagccaccc

SEQ ID NO: 906586 - RNA, 24 nt, Human
gggcggccccugggguccccaaau

SEQ ID NO: 906587 - RNA, 18 nt, Human
gggcgggggcgggcgcgg

SEQ ID NO: 906588 - RNA, 18 nt, Human
ggggcugcgcggcgcggg

SEQ ID NO: 906589 - RNA, 19 nt, Human
gggggaggggaggggaggg

SEQ ID NO: 906590 - RNA, 18 nt, Human
ggguggcgcgcgggggag

SEQ ID NO: 906591 - RNA, 24 nt, Human
gggugggggccggggucucggggg

SEQ ID NO: 906592 - RNA, 20 nt, Human
gggugucugugguguggggu

SEQ ID NO: 906593 - RNA, 23 nt, Human
ggguucccccucccccagacucc

SEQ ID NO: 906594 - RNA, 22 nt, Human
gugacaugggggguccuugucu

SEQ ID NO: 906595 - RNA, 21 nt, Human
guggcgcgcgggggaggggag

SEQ ID NO: 906596 - RNA, 26 nt, Human
guggggccugaucucgggguaugguu

SEQ ID NO: 906597 - RNA, 20 nt, Human
gugggggccggggucucggg

SEQ ID NO: 906598 - RNA, 19 nt, Human
guggguggagggugggcag

SEQ ID NO: 906599 - RNA, 23 nt, Human
uaggaggcccagaggguggcagg

SEQ ID NO: 906600 - RNA, 21 nt, Human
uauuugcuucucugggaaaau

SEQ ID NO: 906601 - RNA, 20 nt, Human
ucacuuccagggccugagca

SEQ ID NO: 906602 - RNA, 19 nt, Human
uccagggaggaggaggggg

SEQ ID NO: 906603 - RNA, 18 nt, Human
ucccccucccccagacuc

SEQ ID NO: 906604 - RNA, 22 nt, Human
uccccgggguucccccuccccc

SEQ ID NO: 906605 - RNA, 24 nt, Human
uccccgggguucccccucccccag

SEQ ID NO: 906606 - RNA, 22 nt, Human
ucgccccgucuagaagauagcc

SEQ ID NO: 906607 - RNA, 24 nt, Human
ucucgggaaaagcgggucuguccu

SEQ ID NO: 906608 - RNA, 21 nt, Human
ucugugguguggggugggggc

SEQ ID NO: 906609 - RNA, 18 nt, Human
ugaccccugguucgcccc

SEQ ID NO: 906610 - RNA, 19 nt, Human
ugacgcccaggucaccccc

SEQ ID NO: 906611 - RNA, 21 nt, Human
ugacuggaccaggagguggcc

SEQ ID NO: 906612 - RNA, 20 nt, Human
ugagagggggcuugggggca

SEQ ID NO: 906613 - RNA, 21 nt, Human
ugagcacugggcaccaggcug

SEQ ID NO: 906614 - RNA, 19 nt, Human
ugcccggacgugcuccaag

SEQ ID NO: 906615 - RNA, 18 nt, Human
ugccugagauuggggggc

SEQ ID NO: 906616 - RNA, 20 nt, Human
uggaggcugcgggucccacc

SEQ ID NO: 906617 - RNA, 21 nt, Human
uggcaaaugagggucuccugc

SEQ ID NO: 906618 - RNA, 19 nt, Human
uggccccuguaccugcccu

SEQ ID NO: 906619 - RNA, 18 nt, Human
ugggggccggggucucgg

SEQ ID NO: 906620 - RNA, 22 nt, Human
uguccaaagccaacgugugaga

SEQ ID NO: 906621 - RNA, 19 nt, Human
uguccccgggguucccccu

SEQ ID NO: 906622 - RNA, 21 nt, Human
uguccugucucucuccuacca

SEQ ID NO: 906623 - RNA, 22 nt, Human
ugucucgggaaaagcgggucug

SEQ ID NO: 906624 - RNA, 18 nt, Human
uguggggugggggccggg

SEQ ID NO: 906625 - RNA, 19 nt, Human
uguggguggagggugggca

SEQ ID NO: 906626 - RNA, 25 nt, Human
uuccacggcugacgcccaggucacc

SEQ ID NO: 906627 - RNA, 19 nt, Human
uuccagcgaaagaaaacuc

SEQ ID NO: 906628 - RNA, 24 nt, Human
uuguccacugguugggcccacaca

SEQ ID NO: 906629 - RNA, 20 nt, Human
aaggagaagaaagaagugga

SEQ ID NO: 906630 - RNA, 21 nt, Human
aguacaggcugcccagaagaa

SEQ ID NO: 906631 - RNA, 21 nt, Human
caggcaggggaaagaggaaag

SEQ ID NO: 906632 - RNA, 22 nt, Human
ccagaagaaaggagaagaaaga

SEQ ID NO: 906633 - RNA, 20 nt, Human
gagaguacaggcugcccaga

SEQ ID NO: 906634 - RNA, 24 nt, Human
ggggaaagaggaaagaaaaaacac

SEQ ID NO: 906635 - RNA, 20 nt, Human
aagcaaguccaaagcuacca

SEQ ID NO: 906636 - RNA, 18 nt, Human
acagaagagaagcaggga

SEQ ID NO: 906637 - RNA, 21 nt, Human
agaagcagggagaaauccgcu

SEQ ID NO: 906638 - RNA, 23 nt, Human
agaugaaugugcggguuaugauc

SEQ ID NO: 906639 - RNA, 21 nt, Human
auaaaaaaugcugguuuuccc

SEQ ID NO: 906640 - RNA, 19 nt, Human
cagacagacacauguaaug

SEQ ID NO: 906641 - RNA, 18 nt, Human
cagaccccgaaucugggg

SEQ ID NO: 906642 - RNA, 21 nt, Human
caggaggauguacuuuuauua

SEQ ID NO: 906643 - RNA, 18 nt, Human
ccugggggagaggagcgg

SEQ ID NO: 906644 - RNA, 21 nt, Human
cuccugggggagaggagcggg

SEQ ID NO: 906645 - RNA, 20 nt, Human
cugaggcugcuggcaugagu

SEQ ID NO: 906646 - RNA, 18 nt, Human
cuguaaugauaauuuuuu

SEQ ID NO: 906647 - RNA, 21 nt, Human
cuuaguuucuucuucaaagga

SEQ ID NO: 906648 - RNA, 18 nt, Human
gaaauucccgacuuguca

SEQ ID NO: 906649 - RNA, 19 nt, Human
gaauuuuucacaaauaaug

SEQ ID NO: 906650 - RNA, 23 nt, Human
gagggugugcuggggaggcagac

SEQ ID NO: 906651 - RNA, 22 nt, Human
gaucauuggcgggaugcaccuu

SEQ ID NO: 906652 - RNA, 23 nt, Human
ggagcgucuccgagcagaugcac

SEQ ID NO: 906653 - RNA, 20 nt, Human
ggagucucuaccaaaccaac

SEQ ID NO: 906654 - RNA, 24 nt, Human
gggagaggagcgggggugacagaa

SEQ ID NO: 906655 - RNA, 26 nt, Human
ggugacagaagagaagcagggagaaa

SEQ ID NO: 906656 - RNA, 18 nt, Human
gucaaguaacuggaaaag

SEQ ID NO: 906657 - RNA, 21 nt, Human
gugacagaagagaagcaggga

SEQ ID NO: 906658 - RNA, 22 nt, Human
gugaugaagggcaaugcuuucc

SEQ ID NO: 906659 - RNA, 24 nt, Human
uaccauaaaucaaggagccuccug

SEQ ID NO: 906660 - RNA, 19 nt, Human
ucaggccagacagacacau

SEQ ID NO: 906661 - RNA, 24 nt, Human
uccaaagcuaccauaaaucaagga

SEQ ID NO: 906662 - RNA, 19 nt, Human
ucuaccaaaccaacugaag

SEQ ID NO: 906663 - RNA, 23 nt, Human
ucugugaugaagggcaaugcuuu

SEQ ID NO: 906664 - RNA, 22 nt, Human
ugaagugauaguuagcaggagg

SEQ ID NO: 906665 - RNA, 19 nt, Human
ugaaucgugucaaguaacu

SEQ ID NO: 906666 - RNA, 20 nt, Human
ugaguugacugacaaguuug

SEQ ID NO: 906667 - RNA, 21 nt, Human
ugauaguuagcaggaggaugu

SEQ ID NO: 906668 - RNA, 18 nt, Human
uggcgggaugcaccuuuu

SEQ ID NO: 906669 - RNA, 19 nt, Human
ugggggagaggagcggggg

SEQ ID NO: 906670 - RNA, 19 nt, Human
ugucagaguugaauacuuc

SEQ ID NO: 906671 - RNA, 21 nt, Human
ugucagaguugaauacuucug

SEQ ID NO: 906672 - RNA, 23 nt, Human
aaaauacccacauguaccucuua

SEQ ID NO: 906673 - RNA, 26 nt, Human
augaaacucaaagauacuugaaaaac

SEQ ID NO: 906674 - RNA, 20 nt, Human
caaaauacccacauguaccu

SEQ ID NO: 906675 - RNA, 21 nt, Human
caaaauacccacauguaccuc

SEQ ID NO: 906676 - RNA, 25 nt, Human
caaauauuaauaugucauccaugcu

SEQ ID NO: 906677 - RNA, 24 nt, Human
cacacaaacaccaaacauuguagu

SEQ ID NO: 906678 - RNA, 18 nt, Human
cagccgccgccuccggaa

SEQ ID NO: 906679 - RNA, 18 nt, Human
ccgcagccgccgccuccg

SEQ ID NO: 906680 - RNA, 24 nt, Human
ccgcagccgccgccuccggaauuc

SEQ ID NO: 906681 - RNA, 21 nt, Human
gugcacacaccaggcagauaa

SEQ ID NO: 906682 - RNA, 23 nt, Human
uaaaacaucuuugcugaaauucu

SEQ ID NO: 906683 - RNA, 24 nt, Human
uaaaacaucuuugcugaaauucuc

SEQ ID NO: 906684 - RNA, 23 nt, Human
uaauaugucauccaugcuugccc

SEQ ID NO: 906685 - RNA, 24 nt, Human
uaauuuccacacaaacaccaaaca

SEQ ID NO: 906686 - RNA, 21 nt, Human
uacccacauguaccucuuagc

SEQ ID NO: 906687 - RNA, 19 nt, Human
uauauauauuuaaaacauc

SEQ ID NO: 906688 - RNA, 20 nt, Human
uauauauauuuaaaacaucu

SEQ ID NO: 906689 - RNA, 25 nt, Human
uccaaaauacccacauguacccugu

SEQ ID NO: 906690 - RNA, 18 nt, Human
uccacacaaacaccaaac

SEQ ID NO: 906691 - RNA, 21 nt, Human
uccacaccauuccugaucaca

SEQ ID NO: 906692 - RNA, 21 nt, Human
uccacgggaguuccgcagccg

SEQ ID NO: 906693 - RNA, 25 nt, Human
ucuucaaguaacaaguucucaaucc

SEQ ID NO: 906694 - RNA, 22 nt, Human
uggccaugaaacucaaagauac

SEQ ID NO: 906695 - RNA, 22 nt, Human
ugugugcacacaccaggcagug

SEQ ID NO: 906696 - RNA, 23 nt, Human
uucaaguaacaaguucucaaucc

SEQ ID NO: 906697 - RNA, 21 nt, Human
uuccacacaaacaccaaacau

SEQ ID NO: 906698 - RNA, 21 nt, Human
uuuccacacaaacaccaaaca

SEQ ID NO: 906699 - RNA, 26 nt, Human
uuuccacacaaacaccaaacauugua

SEQ ID NO: 906700 - RNA, 23 nt, Human
uuugcugaaauucucuuauccca

SEQ ID NO: 906701 - RNA, 21 nt, Human
aaaaaaauacaguauacagaa

SEQ ID NO: 906702 - RNA, 24 nt, Human
aaaacagaaaaacaagacaaaaaa

SEQ ID NO: 906703 - RNA, 18 nt, Human
aaacagaaaaacaagaca

SEQ ID NO: 906704 - RNA, 23 nt, Human
aaacagaaaaacaagacaaaaaa

SEQ ID NO: 906705 - RNA, 25 nt, Human
aaacaggcuuuauuucaaccagaca

SEQ ID NO: 906706 - RNA, 21 nt, Human
aaacaucaaacaacuuuucaa

SEQ ID NO: 906707 - RNA, 19 nt, Human
aaaccagcuguaaacucga

SEQ ID NO: 906708 - RNA, 24 nt, Human
aaaccuuuaacauuauuaaagaug

SEQ ID NO: 906709 - RNA, 24 nt, Human
aacaagacaaaaaaggguacaaaa

SEQ ID NO: 906710 - RNA, 21 nt, Human
aaccaacagcaaaucaugaaa

SEQ ID NO: 906711 - RNA, 23 nt, Human
aaccuagcauaaaauaaauccaa

SEQ ID NO: 906712 - RNA, 20 nt, Human
aagaaagguuacagguaggg

SEQ ID NO: 906713 - RNA, 19 nt, Human
aaguaaccaguugaaugag

SEQ ID NO: 906714 - RNA, 22 nt, Human
acaaagaaguaaccaguugaau

SEQ ID NO: 906715 - RNA, 25 nt, Human
acccuaaaucuccugauaugaacaa

SEQ ID NO: 906716 - RNA, 18 nt, Human
agaaacagagggaaugac

SEQ ID NO: 906717 - RNA, 19 nt, Human
agaagacaacuaaaacaga

SEQ ID NO: 906718 - RNA, 22 nt, Human
agacaaaaaaggguacaaaaca

SEQ ID NO: 906719 - RNA, 23 nt, Human
agauuugcugccauucauauucu

SEQ ID NO: 906720 - RNA, 24 nt, Human
agcauaaaauaaauccaaugaaac

SEQ ID NO: 906721 - RNA, 18 nt, Human
aguaaaagaucaucugga

SEQ ID NO: 906722 - RNA, 21 nt, Human
auccaaugaaacacuacauuu

SEQ ID NO: 906723 - RNA, 19 nt, Human
caaaacaaauaacaaaagu

SEQ ID NO: 906724 - RNA, 24 nt, Human
caagaaaaaccagcuguaaacucg

SEQ ID NO: 906725 - RNA, 19 nt, Human
cacuuuacaaacuaccauu

SEQ ID NO: 906726 - RNA, 20 nt, Human
cagaaaaacaagacaaaaaa

SEQ ID NO: 906727 - RNA, 23 nt, Human
cagcaccuucauugauaugaaca

SEQ ID NO: 906728 - RNA, 18 nt, Human
cagcagguucaucugcca

SEQ ID NO: 906729 - RNA, 21 nt, Human
cccuuucaacaauaagcucaa

SEQ ID NO: 906730 - RNA, 24 nt, Human
cggugcucagaaggcagagaaagg

SEQ ID NO: 906731 - RNA, 23 nt, Human
cuagcauaaaauaaauccaauga

SEQ ID NO: 906732 - RNA, 19 nt, Human
cucgaccuacaaauuuaca

SEQ ID NO: 906733 - RNA, 19 nt, Human
gaauucuucaauuaacauc

SEQ ID NO: 906734 - RNA, 24 nt, Human
gauguguuguuacaaaguuccuag

SEQ ID NO: 906735 - RNA, 21 nt, Human
guguuguuacaaaguuccuag

SEQ ID NO: 906736 - RNA, 21 nt, Human
uaaaaaugaaaaaaccuuuaa

SEQ ID NO: 906737 - RNA, 19 nt, Human
uaaaacagaaaaacaagac

SEQ ID NO: 906738 - RNA, 20 nt, Human
uaaaaucuccuagaguaauu

SEQ ID NO: 906739 - RNA, 21 nt, Human
uaaagacacccacaaagaagu

SEQ ID NO: 906740 - RNA, 23 nt, Human
uagauauauacauguacaaaaca

SEQ ID NO: 906741 - RNA, 25 nt, Human
uagcauaaaauaaauccaaugaaac

SEQ ID NO: 906742 - RNA, 19 nt, Human
uagguuuggccacgcugca

SEQ ID NO: 906743 - RNA, 25 nt, Human
uauacagaaaaaaaaccuuuuauau

SEQ ID NO: 906744 - RNA, 23 nt, Human
uauauacauguacaaaacaaaua

SEQ ID NO: 906745 - RNA, 25 nt, Human
ucaacaauaagcucaauacacaaga

SEQ ID NO: 906746 - RNA, 22 nt, Human
ucaguaaaccccagaagaaaaa

SEQ ID NO: 906747 - RNA, 23 nt, Human
ucccaauauuuguacaugacccu

SEQ ID NO: 906748 - RNA, 24 nt, Human
uccugauaugaacaauuaaucuac

SEQ ID NO: 906749 - RNA, 23 nt, Human
ucuucacgggcauuuucaagagc

SEQ ID NO: 906750 - RNA, 24 nt, Human
ugaaaccaacagcaaaucaugaaa

SEQ ID NO: 906751 - RNA, 23 nt, Human
ugaacaauuaugucaaagaaagg

SEQ ID NO: 906752 - RNA, 18 nt, Human
ugauaugaacaauuaugu

SEQ ID NO: 906753 - RNA, 18 nt, Human
ugggaggcuuuucccaau

SEQ ID NO: 906754 - RNA, 25 nt, Human
uguucuguccuucaaaaaucccuuu

SEQ ID NO: 906755 - RNA, 27 nt, Human
uguucuguccuucaaaaaucccuuuca

SEQ ID NO: 906756 - RNA, 25 nt, Human
uuaaucuacugggaggcuuuuccca

SEQ ID NO: 906757 - RNA, 22 nt, Human
uuagaaacugagauugaaguac

SEQ ID NO: 906758 - RNA, 23 nt, Human
uuaguucucuguccuuuugggag

SEQ ID NO: 906759 - RNA, 26 nt, Human
uucagaagacaacuaaaacagaaaaa

SEQ ID NO: 906760 - RNA, 22 nt, Human
uugaaaccaacagcaaaucaug

SEQ ID NO: 906761 - RNA, 21 nt, Human
uugcacaaagauuugcugcca

SEQ ID NO: 906762 - RNA, 19 nt, Human
aaccagcugugaaaccaac

SEQ ID NO: 906763 - RNA, 21 nt, Human
agcuccgcuuccugcgguucc

SEQ ID NO: 906764 - RNA, 26 nt, Human
cacgcgcggaacaaagcgcuucccuc

SEQ ID NO: 906765 - RNA, 18 nt, Human
ccaggcgcgggaaccacg

SEQ ID NO: 906766 - RNA, 21 nt, Human
cccgugcaaguccccgggccg

SEQ ID NO: 906767 - RNA, 23 nt, Human
cccgugcaaguccccgggccgcg

SEQ ID NO: 906768 - RNA, 24 nt, Human
cgcgcacccccaggcgcgggaacc

SEQ ID NO: 906769 - RNA, 21 nt, Human
cgcuucccucuggcccugccc

SEQ ID NO: 906770 - RNA, 19 nt, Human
cggggcgggaacccgagag

SEQ ID NO: 906771 - RNA, 23 nt, Human
cgucgggaaagcugcgcggcgcc

SEQ ID NO: 906772 - RNA, 18 nt, Human
gaacaaagcgcuucccuc

SEQ ID NO: 906773 - RNA, 18 nt, Human
gcacccccaggcgcggga

SEQ ID NO: 906774 - RNA, 19 nt, Human
gccugcucccgcaucccgc

SEQ ID NO: 906775 - RNA, 21 nt, Human
gcggaacaaagcgcuucccuc

SEQ ID NO: 906776 - RNA, 24 nt, Human
gcggcgcgccaggcucgaccagga

SEQ ID NO: 906777 - RNA, 18 nt, Human
gcggggcggggcggggcg

SEQ ID NO: 906778 - RNA, 27 nt, Human
uauugcaaaccagcugugaaaccaaca

SEQ ID NO: 906779 - RNA, 19 nt, Human
ucgcgcucgcugccuccgc

SEQ ID NO: 906780 - RNA, 24 nt, Human
ucggugccucaggcucccagcgac

SEQ ID NO: 906781 - RNA, 23 nt, Human
ugaaaccaacaggggugcuuuag

SEQ ID NO: 906782 - RNA, 20 nt, Human
ugccucaggcucccagcgac

SEQ ID NO: 906783 - RNA, 24 nt, Human
ugccuccgccgccggcggggcggg

SEQ ID NO: 906784 - RNA, 21 nt, Human
ugcgguuccaccccgcacgcc

SEQ ID NO: 906785 - RNA, 19 nt, Human
caccgggaggcuggccagg

SEQ ID NO: 906786 - RNA, 22 nt, Human
caccugaugcaggagcauggga

SEQ ID NO: 906787 - RNA, 23 nt, Human
ccccaccccagccagugccuggc

SEQ ID NO: 906788 - RNA, 22 nt, Human
cggugccaucccucaaaacucc

SEQ ID NO: 906789 - RNA, 21 nt, Human
cucucggcggccuggacggug

SEQ ID NO: 906790 - RNA, 19 nt, Human
ggaagcgggcuucagccuu

SEQ ID NO: 906791 - RNA, 21 nt, Human
ggcugguguccaccgggaggc

SEQ ID NO: 906792 - RNA, 22 nt, Human
uccacugggccaccuuucccca

SEQ ID NO: 906793 - RNA, 30 nt, Human
uccccugucgagcacgugggggcgaaggcu

SEQ ID NO: 906794 - RNA, 22 nt, Human
ugggaagcgggcuucagccuuc

SEQ ID NO: 906795 - RNA, 23 nt, Human
ugggaagcgggcuucagccuucc

SEQ ID NO: 906796 - RNA, 20 nt, Human
ugguguccaccgggaggcug

SEQ ID NO: 906797 - RNA, 19 nt, Human
aaucuucuuuccuugcagc

SEQ ID NO: 906798 - RNA, 18 nt, Human
agaaucuucuuuccuugc

SEQ ID NO: 906799 - RNA, 21 nt, Human
caugucuuaugaggaaggaga

SEQ ID NO: 906800 - RNA, 20 nt, Human
gcaguuuuaaaauguguaau

SEQ ID NO: 906801 - RNA, 24 nt, Human
ggaaggagagagacuuuccacaag

SEQ ID NO: 906802 - RNA, 19 nt, Human
uauguguauuagugugcau

SEQ ID NO: 906803 - RNA, 20 nt, Human
ugacucuucggcuccagcuu

SEQ ID NO: 906804 - RNA, 22 nt, Human
ugaggaaggagagagacuuucc

SEQ ID NO: 906805 - RNA, 23 nt, Human
ugccagauugccucacuugcucu

SEQ ID NO: 906806 - RNA, 21 nt, Human
uguguauguguauuagugugc

SEQ ID NO: 906807 - RNA, 19 nt, Human
uguguauuagugugcaugu

SEQ ID NO: 906808 - RNA, 22 nt, Human
uuaaucuuuugccagauugccu

SEQ ID NO: 906809 - RNA, 20 nt, Human
uuaugucuucucacuuuuag

SEQ ID NO: 906810 - RNA, 21 nt, Human
uucacauuuauuuccaugucu

SEQ ID NO: 906811 - RNA, 24 nt, Human
uucacauuuauuuccaugucuugg

SEQ ID NO: 906812 - RNA, 21 nt, Human
uugccagauugccucacuugc

SEQ ID NO: 906813 - RNA, 21 nt, Human
ccccagaggugcucccacgcc

SEQ ID NO: 906814 - RNA, 19 nt, Human
gaagauacucaagagcggg

SEQ ID NO: 906815 - RNA, 28 nt, Human
gggcaugggacggggcgcagaguccggg

SEQ ID NO: 906816 - RNA, 24 nt, Human
uuuaauaggguggggaagauacuc

SEQ ID NO: 906817 - RNA, 22 nt, Human
uuuuuuuuuuuuuugcaccgga

SEQ ID NO: 906818 - RNA, 22 nt, Human
uuuuuuuuuuuuuuugcaccgg

SEQ ID NO: 906819 - RNA, 20 nt, Human
aggcggaagggcagggcuuc

SEQ ID NO: 906820 - RNA, 21 nt, Human
aggcggaagggcagggcuucu

SEQ ID NO: 906821 - RNA, 19 nt, Human
ccccaccaccgcgaccuuc

SEQ ID NO: 906822 - RNA, 21 nt, Human
cccgccagggcacguccccca

SEQ ID NO: 906823 - RNA, 21 nt, Human
ccgccgcccgggucaugaucc

SEQ ID NO: 906824 - RNA, 26 nt, Human
ccgccgcccgggucaugauccgcuga

SEQ ID NO: 906825 - RNA, 24 nt, Human
ccuucgcggccgccgcccggguca

SEQ ID NO: 906826 - RNA, 19 nt, Human
ucagcgcccgccccgccag

SEQ ID NO: 906827 - RNA, 20 nt, Human
ucccccaccaccgcgacccu

SEQ ID NO: 906828 - RNA, 24 nt, Human
aaaaaagaaaaacacaaaaaacaa

SEQ ID NO: 906829 - RNA, 23 nt, Human
aaaaaagcagcguaaaaaaagac

SEQ ID NO: 906830 - RNA, 22 nt, Human
aaaaacacaaaaaacaaaacag

SEQ ID NO: 906831 - RNA, 23 nt, Human
aaaaagaaaaacacaaaaaacaa

SEQ ID NO: 906832 - RNA, 24 nt, Human
aaaaagaaaaacacaaaaaacaaa

SEQ ID NO: 906833 - RNA, 27 nt, Human
aaaaagcagcguaaaaaaagacaacuc

SEQ ID NO: 906834 - RNA, 23 nt, Human
aaaagaaaaacacaaaaaacaaa

SEQ ID NO: 906835 - RNA, 21 nt, Human
aaacaaaaaaggaguucagga

SEQ ID NO: 906836 - RNA, 23 nt, Human
aaacccccaaaugcaaagcugua

SEQ ID NO: 906837 - RNA, 21 nt, Human
aaaccggcucuauuuaugaca

SEQ ID NO: 906838 - RNA, 23 nt, Human
aaagaugcauuucaaaggccucc

SEQ ID NO: 906839 - RNA, 18 nt, Human
aaagggcuugcaagagaa

SEQ ID NO: 906840 - RNA, 19 nt, Human
aaccgaguagugaaaacac

SEQ ID NO: 906841 - RNA, 27 nt, Human
aaccgaguagugaaaacaccacaaaaa

SEQ ID NO: 906842 - RNA, 26 nt, Human
aagaaaaacacaaaaaacaaaacaaa

SEQ ID NO: 906843 - RNA, 27 nt, Human
aagaaaaacacaaaaaacaaaacaaaa

SEQ ID NO: 906844 - RNA, 22 nt, Human
aagaauggcaugaaauaggaua

SEQ ID NO: 906845 - RNA, 19 nt, Human
aagcauugaaaguuaaggc

SEQ ID NO: 906846 - RNA, 18 nt, Human
aagguuauuagacugaag

SEQ ID NO: 906847 - RNA, 19 nt, Human
aaugaggaaagcagaaaag

SEQ ID NO: 906848 - RNA, 23 nt, Human
acaaaaaaagaaaaacacaaaaa

SEQ ID NO: 906849 - RNA, 18 nt, Human
acaaaaaacaaaacaaaa

SEQ ID NO: 906850 - RNA, 21 nt, Human
acaacauaagacaaaaaaaga

SEQ ID NO: 906851 - RNA, 24 nt, Human
acauacgacuucauuuacaaaaca

SEQ ID NO: 906852 - RNA, 23 nt, Human
accgaguagugaaaacaccacaa

SEQ ID NO: 906853 - RNA, 27 nt, Human
agaacagacaguacaucuacacaaaug

SEQ ID NO: 906854 - RNA, 26 nt, Human
agacaaaaaaagaaaaacacaaaaaa

SEQ ID NO: 906855 - RNA, 19 nt, Human
agcaaucagugagagaaug

SEQ ID NO: 906856 - RNA, 26 nt, Human
aggcauccaaccgaguagugaaaaca

SEQ ID NO: 906857 - RNA, 24 nt, Human
aguaaaacccccaaaugcaaagcu

SEQ ID NO: 906858 - RNA, 27 nt, Human
auaagacaaaaaaagaaaaacacaaaa

SEQ ID NO: 906859 - RNA, 25 nt, Human
auaauacacgaggugucuuccccac

SEQ ID NO: 906860 - RNA, 18 nt, Human
aucuggaaaaaaauaauu

SEQ ID NO: 906861 - RNA, 18 nt, Human
auggcgccgcuucccagc

SEQ ID NO: 906862 - RNA, 19 nt, Human
caaaaaacaaaacaaaaaa

SEQ ID NO: 906863 - RNA, 19 nt, Human
caaaaauacucugaaaaua

SEQ ID NO: 906864 - RNA, 24 nt, Human
cacaaaaaacaaaacaaaaaagga

SEQ ID NO: 906865 - RNA, 22 nt, Human
caccucaaaaauacaagugugc

SEQ ID NO: 906866 - RNA, 19 nt, Human
caugaaauaggauauguaa

SEQ ID NO: 906867 - RNA, 20 nt, Human
cauucaaaaugccuuuaggu

SEQ ID NO: 906868 - RNA, 21 nt, Human
ccgaguagugaaaacaccaca

SEQ ID NO: 906869 - RNA, 21 nt, Human
ccucagagaaguguauguagc

SEQ ID NO: 906870 - RNA, 21 nt, Human
cggccgacgccaauauggcgc

SEQ ID NO: 906871 - RNA, 20 nt, Human
cuacuggaccuacuaaaugc

SEQ ID NO: 906872 - RNA, 18 nt, Human
cuccaugggaggcaaaau

SEQ ID NO: 906873 - RNA, 19 nt, Human
cuggaccuacuaaaugcug

SEQ ID NO: 906874 - RNA, 21 nt, Human
cuuccugcgucucccucucca

SEQ ID NO: 906875 - RNA, 19 nt, Human
cuugcucgcucacuuuccc

SEQ ID NO: 906876 - RNA, 22 nt, Human
cuuguucacuuaagugaggagg

SEQ ID NO: 906877 - RNA, 19 nt, Human
gacugcuauuucuccacuu

SEQ ID NO: 906878 - RNA, 25 nt, Human
gcaaugaacaggagugggaccugga

SEQ ID NO: 906879 - RNA, 23 nt, Human
gcggccgacgccaauauggcgcc

SEQ ID NO: 906880 - RNA, 18 nt, Human
gcucuggaguccuguucu

SEQ ID NO: 906881 - RNA, 22 nt, Human
ggacugcuauuucuccacuugc

SEQ ID NO: 906882 - RNA, 20 nt, Human
gggaccuggaggauacggcu

SEQ ID NO: 906883 - RNA, 22 nt, Human
gguaaagggcuugcaagagaaa

SEQ ID NO: 906884 - RNA, 19 nt, Human
guauuaacauuuggaaaau

SEQ ID NO: 906885 - RNA, 19 nt, Human
guggcuucaaugcuaaagu

SEQ ID NO: 906886 - RNA, 24 nt, Human
guugcuccucaguaaaaaauacca

SEQ ID NO: 906887 - RNA, 22 nt, Human
uaaaacccccaaaugcaaagcu

SEQ ID NO: 906888 - RNA, 25 nt, Human
uaaaacccccaaaugcaaagcugua

SEQ ID NO: 906889 - RNA, 23 nt, Human
uacaaagguccugagccaauuaa

SEQ ID NO: 906890 - RNA, 24 nt, Human
uacaacauaagacaaaaaaagaaa

SEQ ID NO: 906891 - RNA, 22 nt, Human
uacacgaggugucuuccccaca

SEQ ID NO: 906892 - RNA, 20 nt, Human
uacagcaucuacaggucaaa

SEQ ID NO: 906893 - RNA, 25 nt, Human
uauacaaugauuacaacauaagaca

SEQ ID NO: 906894 - RNA, 23 nt, Human
uauuuugauuuuuaauaaagaug

SEQ ID NO: 906895 - RNA, 20 nt, Human
ucaguauccugguuauauuu

SEQ ID NO: 906896 - RNA, 21 nt, Human
ucccccuguucacuuuccucc

SEQ ID NO: 906897 - RNA, 22 nt, Human
uccucagagaaguguauguagc

SEQ ID NO: 906898 - RNA, 20 nt, Human
ucgcucuggaguccuguucu

SEQ ID NO: 906899 - RNA, 23 nt, Human
ucuccagcgaguguuuaucgcuc

SEQ ID NO: 906900 - RNA, 24 nt, Human
ugaaaacaccacaaaaccggcucu

SEQ ID NO: 906901 - RNA, 25 nt, Human
ugaaaacaccacaaaacuggagacc

SEQ ID NO: 906902 - RNA, 19 nt, Human
ugacaguucaaaaaccacu

SEQ ID NO: 906903 - RNA, 18 nt, Human
ugaggaaagcagaaaaga

SEQ ID NO: 906904 - RNA, 20 nt, Human
ugcauucaugaaacuuaaaa

SEQ ID NO: 906905 - RNA, 21 nt, Human
ugcauucaugaaacuuaaaaa

SEQ ID NO: 906906 - RNA, 18 nt, Human
ugcugcuauauaaaaagg

SEQ ID NO: 906907 - RNA, 19 nt, Human
uggcuaagaacugguuccc

SEQ ID NO: 906908 - RNA, 24 nt, Human
uggcugcaucuaugccacuaaaug

SEQ ID NO: 906909 - RNA, 25 nt, Human
ugggaccuggaggauacggcucucu

SEQ ID NO: 906910 - RNA, 21 nt, Human
ugguaacuaugcaacauuugg

SEQ ID NO: 906911 - RNA, 20 nt, Human
ugugccaaucuggaaaaaaa

SEQ ID NO: 906912 - RNA, 27 nt, Human
uuacaacauaagacaaaaaaagaaaaa

SEQ ID NO: 906913 - RNA, 22 nt, Human
uucaaaaugccuuuagguuuca

SEQ ID NO: 906914 - RNA, 24 nt, Human
uucaagcauaauccauauuuaaaa

SEQ ID NO: 906915 - RNA, 21 nt, Human
uuccaugguacaagguaaaca

SEQ ID NO: 906916 - RNA, 21 nt, Human
uucccauaacaagcauugaaa

SEQ ID NO: 906917 - RNA, 20 nt, Human
uuccugcgucucccucucca

SEQ ID NO: 906918 - RNA, 18 nt, Human
uuccuggcuguguaaucu

SEQ ID NO: 906919 - RNA, 19 nt, Human
uugaaaaaagcagcguaaa

SEQ ID NO: 906920 - RNA, 20 nt, Human
uugcuuguucacuuaaguga

SEQ ID NO: 906921 - RNA, 24 nt, Human
uuuuuguuuguuuucaauuuuuuu

SEQ ID NO: 906922 - RNA, 25 nt, Human
aaaaauagaaaagguaaucaaagag

SEQ ID NO: 906923 - RNA, 26 nt, Human
aacuagacacauggucaaacaaagcc

SEQ ID NO: 906924 - RNA, 22 nt, Human
aauuguacagaagaggacacaa

SEQ ID NO: 906925 - RNA, 21 nt, Human
acagaagaggacacaaucuga

SEQ ID NO: 906926 - RNA, 25 nt, Human
acagaagaggacacaaucugauaua

SEQ ID NO: 906927 - RNA, 23 nt, Human
agaaagaaacucuggagccaaag

SEQ ID NO: 906928 - RNA, 24 nt, Human
agaaagaaacucuggagccaaagg

SEQ ID NO: 906929 - RNA, 20 nt, Human
agagcacuucagaaagaaac

SEQ ID NO: 906930 - RNA, 24 nt, Human
agagcuaauuuuauuaugaaaugu

SEQ ID NO: 906931 - RNA, 23 nt, Human
agggacggcggcggcggcggcgg

SEQ ID NO: 906932 - RNA, 21 nt, Human
aguagaaaauacauagagcua

SEQ ID NO: 906933 - RNA, 19 nt, Human
auaaaaauagaaaagguaa

SEQ ID NO: 906934 - RNA, 22 nt, Human
auagacacaacuuuuacuucau

SEQ ID NO: 906935 - RNA, 19 nt, Human
aucugggaccugccugcuc

SEQ ID NO: 906936 - RNA, 28 nt, Human
auguguguguguauauauauauaaugua

SEQ ID NO: 906937 - RNA, 21 nt, Human
cacuucagaaagaaacucugg

SEQ ID NO: 906938 - RNA, 22 nt, Human
cacuucagaaagaaacucugga

SEQ ID NO: 906939 - RNA, 22 nt, Human
cagaagaggacacaaucugaua

SEQ ID NO: 906940 - RNA, 23 nt, Human
cagcagcagcagcagcagcagca

SEQ ID NO: 906941 - RNA, 23 nt, Human
cagcagcagcagcagcagcagcg

SEQ ID NO: 906942 - RNA, 24 nt, Human
cagcagcagcagcagcagcagcgg

SEQ ID NO: 906943 - RNA, 25 nt, Human
cagcagcagcagcagcagcggcugc

SEQ ID NO: 906944 - RNA, 27 nt, Human
cauuuuguuucuccagucaggucuuca

SEQ ID NO: 906945 - RNA, 30 nt, Human
cgcagggacggcggcggcggcggcggcaac

SEQ ID NO: 906946 - RNA, 23 nt, Human
cggcggcagcagcagcagcagca

SEQ ID NO: 906947 - RNA, 23 nt, Human
cggcggcggcggcggcggcagca

SEQ ID NO: 906948 - RNA, 20 nt, Human
gcagcagcagcagcggcugc

SEQ ID NO: 906949 - RNA, 18 nt, Human
gcaguagaaaauacauag

SEQ ID NO: 906950 - RNA, 20 nt, Human
gcccgggucccgggagcaga

SEQ ID NO: 906951 - RNA, 20 nt, Human
gcggcggcggcggcggcagc

SEQ ID NO: 906952 - RNA, 21 nt, Human
ggcagcagcagcagcagcagc

SEQ ID NO: 906953 - RNA, 21 nt, Human
gggagcagagaccgaaggacg

SEQ ID NO: 906954 - RNA, 27 nt, Human
gguaaucaaagagcacuucagaaagaa

SEQ ID NO: 906955 - RNA, 24 nt, Human
uaauacaaagcaucuaaucauaaa

SEQ ID NO: 906956 - RNA, 19 nt, Human
uaucaggaagaaucuugau

SEQ ID NO: 906957 - RNA, 24 nt, Human
uauguauauguguguguguauaua

SEQ ID NO: 906958 - RNA, 22 nt, Human
uauguguguguguauauauaua

SEQ ID NO: 906959 - RNA, 20 nt, Human
ucugggaccugccugcucag

SEQ ID NO: 906960 - RNA, 19 nt, Human
ugcuuuuaccugcuaagau

SEQ ID NO: 906961 - RNA, 19 nt, Human
uguauguauaugugugugu

SEQ ID NO: 906962 - RNA, 19 nt, Human
uguauguauaugugugugu

SEQ ID NO: 906963 - RNA, 22 nt, Human
uguauguauaugugugugugua

SEQ ID NO: 906964 - RNA, 23 nt, Human
uguauguauauguguguguguau

SEQ ID NO: 906965 - RNA, 18 nt, Human
uguguguguauauauaua

SEQ ID NO: 906966 - RNA, 23 nt, Human
uguguguguguauauauauauau

SEQ ID NO: 906967 - RNA, 19 nt, Human
uuuuuugucaauuguacag

SEQ ID NO: 906968 - RNA, 20 nt, Human
agccagcuaaaaacccccac

SEQ ID NO: 906969 - RNA, 18 nt, Human
aggcgcaggugcacagcc

SEQ ID NO: 906970 - RNA, 21 nt, Human
cacagcccggccggcccgccc

SEQ ID NO: 906971 - RNA, 21 nt, Human
caguguggaguggcauggggc

SEQ ID NO: 906972 - RNA, 25 nt, Human
cccccacugugaagucccugccaug

SEQ ID NO: 906973 - RNA, 20 nt, Human
cccugccaugucccagcagu

SEQ ID NO: 906974 - RNA, 23 nt, Human
gaaaaccuuuaauguuccccagg

SEQ ID NO: 906975 - RNA, 22 nt, Human
gaagucccugccaugucccagc

SEQ ID NO: 906976 - RNA, 23 nt, Human
gccagcuaaaaacccccacugug

SEQ ID NO: 906977 - RNA, 23 nt, Human
gggacggugccccaggcggcccg

SEQ ID NO: 906978 - RNA, 21 nt, Human
uccccaggcugagggagcccu

SEQ ID NO: 906979 - RNA, 22 nt, Human
uccccaggcugagggagcccug

SEQ ID NO: 906980 - RNA, 19 nt, Human
ugaagucccugccaugucc

SEQ ID NO: 906981 - RNA, 21 nt, Human
ugagccagcuaaaaaccccca

SEQ ID NO: 906982 - RNA, 24 nt, Human
uguagaaaaccuuuaauguucccc

SEQ ID NO: 906983 - RNA, 18 nt, Human
uuuuuuuuuuuuuuuuug

SEQ ID NO: 906984 - RNA, 20 nt, Human
uuuuuuuuuuuuuuuuuugu

SEQ ID NO: 906985 - RNA, 19 nt, Human
aaaaaacccugaaauuuga

SEQ ID NO: 906986 - RNA, 18 nt, Human
aaaaacuucugaaacagg

SEQ ID NO: 906987 - RNA, 21 nt, Human
aaaaacuucugaaacaggcau

SEQ ID NO: 906988 - RNA, 22 nt, Human
aaacaagcacaauaccacaaaa

SEQ ID NO: 906989 - RNA, 21 nt, Human
aaaccaucuaaagccaaauau

SEQ ID NO: 906990 - RNA, 23 nt, Human
aaaccaucuaaagccaaauauaa

SEQ ID NO: 906991 - RNA, 18 nt, Human
aaagccaaggggugaaaa

SEQ ID NO: 906992 - RNA, 21 nt, Human
aaauggaccauuuggugggga

SEQ ID NO: 906993 - RNA, 21 nt, Human
aacaaaaaaacccugaaauuu

SEQ ID NO: 906994 - RNA, 20 nt, Human
aacaacaaaaaaacccugaa

SEQ ID NO: 906995 - RNA, 19 nt, Human
aacaacaacaaaaaaaccc

SEQ ID NO: 906996 - RNA, 22 nt, Human
aacccaugauuuggcaguccua

SEQ ID NO: 906997 - RNA, 22 nt, Human
aauaacacaacaacaacaaaaa

SEQ ID NO: 906998 - RNA, 22 nt, Human
acaaaacaagcacaauaccaca

SEQ ID NO: 906999 - RNA, 23 nt, Human
acaaaacauaugcauaccaacaa

SEQ ID NO: 907000 - RNA, 25 nt, Human
acaaaacauaugcauaccaacaaag

SEQ ID NO: 907001 - RNA, 22 nt, Human
acaacaacaaaaggcaaaaccc

SEQ ID NO: 907002 - RNA, 21 nt, Human
acaacaacaacaaaaaaaccc

SEQ ID NO: 907003 - RNA, 20 nt, Human
acaauaccacaaaauaacac

SEQ ID NO: 907004 - RNA, 22 nt, Human
acacaacaacaacaaaaaaacc

SEQ ID NO: 907005 - RNA, 23 nt, Human
acagaggauaaauacaacaacaa

SEQ ID NO: 907006 - RNA, 21 nt, Human
acagucagaaaaacugaaauc

SEQ ID NO: 907007 - RNA, 19 nt, Human
acccagaaaauaacaggaa

SEQ ID NO: 907008 - RNA, 18 nt, Human
accuacggccgccgccac

SEQ ID NO: 907009 - RNA, 21 nt, Human
agaaauauaauucacacauaa

SEQ ID NO: 907010 - RNA, 21 nt, Human
agaacugcugaaaaacaaaag

SEQ ID NO: 907011 - RNA, 22 nt, Human
agccgcagccgcagccgcagcc

SEQ ID NO: 907012 - RNA, 21 nt, Human
aggcaaaaugauaaaacccag

SEQ ID NO: 907013 - RNA, 21 nt, Human
aggcacuugcauucagaaaca

SEQ ID NO: 907014 - RNA, 21 nt, Human
agggaugcauucaaauggacc

SEQ ID NO: 907015 - RNA, 21 nt, Human
auaaaaugauuccuaagucaa

SEQ ID NO: 907016 - RNA, 22 nt, Human
auaacaguuccacuccaaaaaa

SEQ ID NO: 907017 - RNA, 24 nt, Human
auacaaaaggaaugguuuuaaccc

SEQ ID NO: 907018 - RNA, 21 nt, Human
auacaacaacaaaaggcaaaa

SEQ ID NO: 907019 - RNA, 20 nt, Human
auuucauacaaaaggaaugg

SEQ ID NO: 907020 - RNA, 18 nt, Human
caaaacaagcacaauacc

SEQ ID NO: 907021 - RNA, 24 nt, Human
caaaaggaaugguuuuaacccaga

SEQ ID NO: 907022 - RNA, 23 nt, Human
caacaacaaaaggcaaaacccau

SEQ ID NO: 907023 - RNA, 24 nt, Human
caacugaacuuuaaaaaauacgaa

SEQ ID NO: 907024 - RNA, 21 nt, Human
caaguauaacacagucauaca

SEQ ID NO: 907025 - RNA, 22 nt, Human
cacaaaacaagcacaauaccac

SEQ ID NO: 907026 - RNA, 26 nt, Human
cacaaaacaagcacaauaccacaaaa

SEQ ID NO: 907027 - RNA, 21 nt, Human
cacaacaacaacaaaaaaacc

SEQ ID NO: 907028 - RNA, 23 nt, Human
cacaauaccacaaaauaacacaa

SEQ ID NO: 907029 - RNA, 20 nt, Human
cacacauaaaaacagucuac

SEQ ID NO: 907030 - RNA, 23 nt, Human
ccacaaaauaacacaacaacaac

SEQ ID NO: 907031 - RNA, 22 nt, Human
ccacuccaaaaaauaaaccuga

SEQ ID NO: 907032 - RNA, 19 nt, Human
cccagaaaauaacaggaau

SEQ ID NO: 907033 - RNA, 20 nt, Human
ccccacggccugcggacgcc

SEQ ID NO: 907034 - RNA, 22 nt, Human
ccccacggccugcggacgcccg

SEQ ID NO: 907035 - RNA, 21 nt, Human
cccgccccacaccuacggccg

SEQ ID NO: 907036 - RNA, 21 nt, Human
ccgcagccgcagccgcagcca

SEQ ID NO: 907037 - RNA, 19 nt, Human
ccgccgccaccgccgaggg

SEQ ID NO: 907038 - RNA, 20 nt, Human
ccgccgccaccgccgagggc

SEQ ID NO: 907039 - RNA, 21 nt, Human
ccggccaaaucucagccgcag

SEQ ID NO: 907040 - RNA, 20 nt, Human
cggccugcggacgcccggcc

SEQ ID NO: 907041 - RNA, 21 nt, Human
cuuucaguuguugacaaucuu

SEQ ID NO: 907042 - RNA, 21 nt, Human
gaaauauaauucacacauaaa

SEQ ID NO: 907043 - RNA, 24 nt, Human
gaacaaguacauaaaaugauuccu

SEQ ID NO: 907044 - RNA, 24 nt, Human
ggaaagucaacugaacuuuaaaaa

SEQ ID NO: 907045 - RNA, 20 nt, Human
ggacgcccggccaaaucuca

SEQ ID NO: 907046 - RNA, 20 nt, Human
ggcaaaaugauaaaacccag

SEQ ID NO: 907047 - RNA, 19 nt, Human
ggcauuuuuuggaccauua

SEQ ID NO: 907048 - RNA, 21 nt, Human
ggccaaaucucagccgcagcc

SEQ ID NO: 907049 - RNA, 21 nt, Human
gugaggcacaaaugugacccu

SEQ ID NO: 907050 - RNA, 22 nt, Human
uaaaaugauuccuaagucaaaa

SEQ ID NO: 907051 - RNA, 24 nt, Human
uaaaugaaacagauccgaucaccu

SEQ ID NO: 907052 - RNA, 21 nt, Human
uaaauuuuagcuugauuugga

SEQ ID NO: 907053 - RNA, 22 nt, Human
uaacacaacaacaacaaaaaaa

SEQ ID NO: 907054 - RNA, 26 nt, Human
uaacacaacaacaacaaaaaaacccu

SEQ ID NO: 907055 - RNA, 20 nt, Human
uaacugaauugccaauugaa

SEQ ID NO: 907056 - RNA, 20 nt, Human
uaauuuagaaacagguuuaa

SEQ ID NO: 907057 - RNA, 19 nt, Human
uacaacaacaaaaggcaaa

SEQ ID NO: 907058 - RNA, 20 nt, Human
uacaacaacaaaaggcaaaa

SEQ ID NO: 907059 - RNA, 21 nt, Human
uaccacaaaauaacacaacaa

SEQ ID NO: 907060 - RNA, 22 nt, Human
uaguagaaauauaauucacaca

SEQ ID NO: 907061 - RNA, 24 nt, Human
uauaaauugugugacaaaacauau

SEQ ID NO: 907062 - RNA, 18 nt, Human
uauauauauauauauaua

SEQ ID NO: 907063 - RNA, 19 nt, Human
uauauauauauauauauau

SEQ ID NO: 907064 - RNA, 24 nt, Human
uauauauauauauuaucaaguaua

SEQ ID NO: 907065 - RNA, 19 nt, Human
ucaaauggaccauuuggug

SEQ ID NO: 907066 - RNA, 20 nt, Human
ucaaauggaccauuuggugg

SEQ ID NO: 907067 - RNA, 24 nt, Human
ucaaguauaacacagucauacaaa

SEQ ID NO: 907068 - RNA, 19 nt, Human
ucacaaaacaagcacaaua

SEQ ID NO: 907069 - RNA, 24 nt, Human
ucagaaaaacugaaauccacggcg

SEQ ID NO: 907070 - RNA, 22 nt, Human
uccaucucgcgugccggacgcg

SEQ ID NO: 907071 - RNA, 21 nt, Human
ugcccccaucccccacggccu

SEQ ID NO: 907072 - RNA, 24 nt, Human
uggcaguccuauacaaaaggggcc

SEQ ID NO: 907073 - RNA, 24 nt, Human
uguaacagucagaaaaacugaaau

SEQ ID NO: 907074 - RNA, 21 nt, Human
uguauuaaaaccaucuaaagc

SEQ ID NO: 907075 - RNA, 25 nt, Human
ugucccuuuuauauccuauuuuagg

SEQ ID NO: 907076 - RNA, 22 nt, Human
ugugugacaaaacauaugcaua

SEQ ID NO: 907077 - RNA, 22 nt, Human
uuauauaaaauaaagccaaggg

SEQ ID NO: 907078 - RNA, 22 nt, Human
uucaaaaacuucugaaacaggc

SEQ ID NO: 907079 - RNA, 24 nt, Human
uucacaaaacaagcacaauaccac

SEQ ID NO: 907080 - RNA, 20 nt, Human
uucaguauuaccaacagagg

SEQ ID NO: 907081 - RNA, 29 nt, Human
uucugaaacaggcauuuuuuggaccauua

SEQ ID NO: 907082 - RNA, 23 nt, Human
uuggaccauuuauaaaauacuaa

SEQ ID NO: 907083 - RNA, 19 nt, Human
uuuauauauauauauauau

SEQ ID NO: 907084 - RNA, 21 nt, Human
uuuuauauauauauauauauu

SEQ ID NO: 907085 - RNA, 20 nt, Human
uuuuauauauauauauauuu

SEQ ID NO: 907086 - RNA, 24 nt, Human
uuuuuugucccuuuuauauccuau

SEQ ID NO: 907087 - RNA, 32 nt, Human; identical to SEQ ID NO: 508996

SEQ ID NO: 907088 - RNA, 19 nt, Human
accuuaccaaccccagcug

SEQ ID NO: 907089 - RNA, 22 nt, Human
caaccucugccccaccauggcc

SEQ ID NO: 907090 - RNA, 19 nt, Human
caccauggcccgaccuuac

SEQ ID NO: 907091 - RNA, 21 nt, Human
cauggcccgaccuuaccaacc

SEQ ID NO: 907092 - RNA, 21 nt, Human
cccgaccuuaccaaccccagc

SEQ ID NO: 907093 - RNA, 23 nt, Human
ccuuaccaaccccagcugcgcaa

SEQ ID NO: 907094 - RNA, 24 nt, Human
cgaccuuaccaaccccagcugcgc

SEQ ID NO: 907095 - RNA, 25 nt, Human
ucccaaccucugccccaccauggcc

SEQ ID NO: 907096 - RNA, 18 nt, Human
uucccaaccucugcccca

SEQ ID NO: 907097 - RNA, 26 nt, Human
aaaaagagaccaaaaaagagacaaaa

SEQ ID NO: 907098 - RNA, 24 nt, Human
aaaauccuucccaaaugucacccu

SEQ ID NO: 907099 - RNA, 26 nt, Human
aaaccaaaguacagaguuauuauaaa

SEQ ID NO: 907100 - RNA, 22 nt, Human
aaaccaggcccaggaccuggga

SEQ ID NO: 907101 - RNA, 21 nt, Human
aaagaacauaauguaauuggc

SEQ ID NO: 907102 - RNA, 20 nt, Human
aaagaacucaaucccaaaac

SEQ ID NO: 907103 - RNA, 22 nt, Human
aaagaacucaaucccaaaacac

SEQ ID NO: 907104 - RNA, 19 nt, Human
aaaugaucaauuagaaggc

SEQ ID NO: 907105 - RNA, 21 nt, Human
aacaaccuucccaaccuucau

SEQ ID NO: 907106 - RNA, 24 nt, Human
aacagaaaagaaaagaaaacccag

SEQ ID NO: 907107 - RNA, 27 nt, Human
aagagaccaaaaaagagacagugggca

SEQ ID NO: 907108 - RNA, 23 nt, Human
aagagaccaaaaaagagaccguu

SEQ ID NO: 907109 - RNA, 19 nt, Human
aagaggaaaaaaauuccaa

SEQ ID NO: 907110 - RNA, 21 nt, Human
aagcccuugaguaacccacgc

SEQ ID NO: 907111 - RNA, 21 nt, Human
aaggcaaaaagaaguuccuuu

SEQ ID NO: 907112 - RNA, 20 nt, Human
aauauaagaaaaagagaccu

SEQ ID NO: 907113 - RNA, 20 nt, Human
aaucacuaagcucugaccua

SEQ ID NO: 907114 - RNA, 20 nt, Human
aaugaauucucaaaccagag

SEQ ID NO: 907115 - RNA, 22 nt, Human
aaugcucauuaugcugagugac

SEQ ID NO: 907116 - RNA, 19 nt, Human
acaaaacaguacauugccu

SEQ ID NO: 907117 - RNA, 24 nt, Human
acacaacuuuagaacaugcaaaga

SEQ ID NO: 907118 - RNA, 18 nt, Human
acaugggcccgugcccag

SEQ ID NO: 907119 - RNA, 20 nt, Human
acccugaaaccaaaguacag

SEQ ID NO: 907120 - RNA, 22 nt, Human
accuacgucaaugggaguccug

SEQ ID NO: 907121 - RNA, 18 nt, Human
accuuuagggagaaggga

SEQ ID NO: 907122 - RNA, 24 nt, Human
acuuugggugguguagauacagau

SEQ ID NO: 907123 - RNA, 18 nt, Human
agaaaaccaggcccagga

SEQ ID NO: 907124 - RNA, 20 nt, Human
agaaaagaaaagaaaaccca

SEQ ID NO: 907125 - RNA, 22 nt, Human
agaaauaaaaaggcugaaagga

SEQ ID NO: 907126 - RNA, 21 nt, Human
agagagagggaggcuuagguu

SEQ ID NO: 907127 - RNA, 22 nt, Human
agagugcaaauauuuuccccau

SEQ ID NO: 907128 - RNA, 20 nt, Human
agaucaguggguucucgugu

SEQ ID NO: 907129 - RNA, 21 nt, Human
agcuggcgcugggcggacgca

SEQ ID NO: 907130 - RNA, 22 nt, Human
aggaucuuuauuuucaucuugu

SEQ ID NO: 907131 - RNA, 23 nt, Human
aggguacuugggcuggugucuac

SEQ ID NO: 907132 - RNA, 24 nt, Human
aguaaccacaagcccuugaguaac

SEQ ID NO: 907133 - RNA, 20 nt, Human
aguaagugauaaaaaacaaa

SEQ ID NO: 907134 - RNA, 25 nt, Human
auaagaaaaagagaccaaaaaagag

SEQ ID NO: 907135 - RNA, 26 nt, Human
caaaaggagcacucuuaguaaggaua

SEQ ID NO: 907136 - RNA, 22 nt, Human
caaaauucauaaagcaaagcau

SEQ ID NO: 907137 - RNA, 24 nt, Human
caacacaaaacaguacauugccuu

SEQ ID NO: 907138 - RNA, 23 nt, Human
cacaagcccuugaguaacccacg

SEQ ID NO: 907139 - RNA, 20 nt, Human
cacugcccaccccccuccgc

SEQ ID NO: 907140 - RNA, 25 nt, Human
cacugcccaccccccuccgcccuuc

SEQ ID NO: 907141 - RNA, 24 nt, Human
cagauucuaaaguaaaauaucgaa

SEQ ID NO: 907142 - RNA, 21 nt, Human
caggcccaggaccugggauuc

SEQ ID NO: 907143 - RNA, 18 nt, Human
cagguguacaugugcacg

SEQ ID NO: 907144 - RNA, 18 nt, Human
cagugugaaucacuaagc

SEQ ID NO: 907145 - RNA, 21 nt, Human
cauagaggagauacaaguaac

SEQ ID NO: 907146 - RNA, 23 nt, Human
caugacuccugccacacacacug

SEQ ID NO: 907147 - RNA, 22 nt, Human
ccaaagugaugcucacaugggc

SEQ ID NO: 907148 - RNA, 18 nt, Human
ccaaaucauggagggaaa

SEQ ID NO: 907149 - RNA, 22 nt, Human
cccaaaacacaauuuucugaua

SEQ ID NO: 907150 - RNA, 23 nt, Human
ccccaugcuucucguccccuagu

SEQ ID NO: 907151 - RNA, 23 nt, Human
ccccuagucacugcccacccccc

SEQ ID NO: 907152 - RNA, 24 nt, Human
cgcgggccggucgggacgcggagc

SEQ ID NO: 907153 - RNA, 23 nt, Human
cggacgcagcgggcggcggcggg

SEQ ID NO: 907154 - RNA, 24 nt, Human
cuaaaugaucaauuagaaggcaaa

SEQ ID NO: 907155 - RNA, 24 nt, Human
cugagugacaauucuaagagcaaa

SEQ ID NO: 907156 - RNA, 27 nt, Human
cugcagauagacaguacagcgcgaguc

SEQ ID NO: 907157 - RNA, 19 nt, Human
cugcccaccccccuccgcc

SEQ ID NO: 907158 - RNA, 22 nt, Human
cuggcauauuuaggaacauucc

SEQ ID NO: 907159 - RNA, 21 nt, Human
gaaaaccaggcccaggaccug

SEQ ID NO: 907160 - RNA, 20 nt, Human
gaccuagcuugccccagugg

SEQ ID NO: 907161 - RNA, 20 nt, Human
gaggagauacaaguaaccac

SEQ ID NO: 907162 - RNA, 23 nt, Human
gcaaauauuuuccccaugcuucu

SEQ ID NO: 907163 - RNA, 18 nt, Human
gcaggaaaauauagggca

SEQ ID NO: 907164 - RNA, 23 nt, Human
gccacuccauuaauucuaaacaa

SEQ ID NO: 907165 - RNA, 19 nt, Human
gcggcggcgggacugaggc

SEQ ID NO: 907166 - RNA, 18 nt, Human
ggacuuagcaggcuggca

SEQ ID NO: 907167 - RNA, 21 nt, Human
ggaggaggguacuugggcugg

SEQ ID NO: 907168 - RNA, 22 nt, Human
ggcaguggugggcccagggcag

SEQ ID NO: 907169 - RNA, 20 nt, Human
gguucucguguuuuuggcuc

SEQ ID NO: 907170 - RNA, 19 nt, Human
guaggagauuccagauucu

SEQ ID NO: 907171 - RNA, 19 nt, Human
gucacugcccaccccccuc

SEQ ID NO: 907172 - RNA, 19 nt, Human
uaaaaaacaaaguguauga

SEQ ID NO: 907173 - RNA, 26 nt, Human
uaaaaaauaaaauuucacuaauuaug

SEQ ID NO: 907174 - RNA, 18 nt, Human
uaaacaaaauccuuccca

SEQ ID NO: 907175 - RNA, 20 nt, Human
uaaacaaaauccuucccaaa

SEQ ID NO: 907176 - RNA, 26 nt, Human
uaaauuaacagaaaagaaaagaaaac

SEQ ID NO: 907177 - RNA, 22 nt, Human
uaacagaaaagaaaagaaaacc

SEQ ID NO: 907178 - RNA, 23 nt, Human
uaaccuccaagccuuaguuuccu

SEQ ID NO: 907179 - RNA, 23 nt, Human
uaagaaaaagagaccaaaaaaga

SEQ ID NO: 907180 - RNA, 20 nt, Human
uaagaaauaaaaaggcugaa

SEQ ID NO: 907181 - RNA, 23 nt, Human
uaagagacaguacaguaagaaau

SEQ ID NO: 907182 - RNA, 28 nt, Human
uaauaaaaaauaaaauuucacuaauuau

SEQ ID NO: 907183 - RNA, 23 nt, Human
uacacaacuuuagaacaugcaaa

SEQ ID NO: 907184 - RNA, 26 nt, Human
uacaugcaaucaagcaaaaaggcugc

SEQ ID NO: 907185 - RNA, 18 nt, Human
uacauuuguaacuugaau

SEQ ID NO: 907186 - RNA, 25 nt, Human
uagaaaaccaggcccaggaccuggg

SEQ ID NO: 907187 - RNA, 18 nt, Human
uagucacugcccaccccc

SEQ ID NO: 907188 - RNA, 18 nt, Human
uauuuaggaacauuccau

SEQ ID NO: 907189 - RNA, 24 nt, Human
uauuuugcaggaaaauauagggca

SEQ ID NO: 907190 - RNA, 23 nt, Human
ucacuaagcucugaccuagcuuu

SEQ ID NO: 907191 - RNA, 18 nt, Human
ucauuuaaccuccaagcc

SEQ ID NO: 907192 - RNA, 19 nt, Human
uccaacuucuggcaaguca

SEQ ID NO: 907193 - RNA, 22 nt, Human
uccaagccuuaguuuccucauc

SEQ ID NO: 907194 - RNA, 23 nt, Human
ucccaaaugucacccugaaacca

SEQ ID NO: 907195 - RNA, 25 nt, Human
ucccaaaugucacccugaaaccaaa

SEQ ID NO: 907196 - RNA, 22 nt, Human
ucccaaccuucauugcuagguu

SEQ ID NO: 907197 - RNA, 19 nt, Human
ucccuguugaagagcccua

SEQ ID NO: 907198 - RNA, 21 nt, Human
ucuggguugcagcuggacuug

SEQ ID NO: 907199 - RNA, 21 nt, Human
ucuuuugccuuucaaagucau

SEQ ID NO: 907200 - RNA, 20 nt, Human
ugaaacaccuacgucaaugg

SEQ ID NO: 907201 - RNA, 21 nt, Human
ugagaucaguggguucucgug

SEQ ID NO: 907202 - RNA, 30 nt, Human
ugagaugacagcauuagaaaaccaggcccc

SEQ ID NO: 907203 - RNA, 21 nt, Human
ugagggacaugacuccugcca

SEQ ID NO: 907204 - RNA, 18 nt, Human
ugauuugcuaccaggaau

SEQ ID NO: 907205 - RNA, 21 nt, Human
ugccccaguggugagaucagu

SEQ ID NO: 907206 - RNA, 19 nt, Human
uggcaguguguguaagaaa

SEQ ID NO: 907207 - RNA, 24 nt, Human
ugggagagcacagugcaagagaca

SEQ ID NO: 907208 - RNA, 18 nt, Human
ugggauucugggcugaga

SEQ ID NO: 907209 - RNA, 19 nt, Human
ugggcaguggugggcccag

SEQ ID NO: 907210 - RNA, 23 nt, Human
uggguugcagcuggacuuguggg

SEQ ID NO: 907211 - RNA, 25 nt, Human
ugucuuucaaagucaaguucacaua

SEQ ID NO: 907212 - RNA, 18 nt, Human
ugugagggacaugacucc

SEQ ID NO: 907213 - RNA, 23 nt, Human
ugugcacacacauacacaacuuu

SEQ ID NO: 907214 - RNA, 22 nt, Human
ugugcacgugcucagaugugca

SEQ ID NO: 907215 - RNA, 19 nt, Human
uguguaagaaauggaucaa

SEQ ID NO: 907216 - RNA, 21 nt, Human
uuaaguaccacaagccccacc

SEQ ID NO: 907217 - RNA, 28 nt, Human
uuaauacccaggguaauacaauauccaa

SEQ ID NO: 907218 - RNA, 24 nt, Human
uuagagugcaaauauuuuccccau

SEQ ID NO: 907219 - RNA, 21 nt, Human
uuagcuaaaaagaaaagcaaa

SEQ ID NO: 907220 - RNA, 25 nt, Human
uuauauuuuuugaagcccgcagauu

SEQ ID NO: 907221 - RNA, 18 nt, Human
uuaucuugauuugcuacc

SEQ ID NO: 907222 - RNA, 22 nt, Human
uucaguuuccacuaucucuggg

SEQ ID NO: 907223 - RNA, 25 nt, Human
uucaucuuguggggacucuuuugcc

SEQ ID NO: 907224 - RNA, 20 nt, Human
uucccuauucuuacaggacu

SEQ ID NO: 907225 - RNA, 22 nt, Human
uugaagagcccuacuuccaaag

SEQ ID NO: 907226 - RNA, 21 nt, Human
uugaaugguaacuaggaucuu

SEQ ID NO: 907227 - RNA, 22 nt, Human
uugcuagguugguccccagcgc

SEQ ID NO: 907228 - RNA, 25 nt, Human
uuuaaaaacuuuccuaguguuccuu

SEQ ID NO: 907229 - RNA, 25 nt, Human
uuuaucuugauuugcuaccaggaau

SEQ ID NO: 907230 - RNA, 19 nt, Human
aacacagcuuggaccagaa

SEQ ID NO: 907231 - RNA, 23 nt, Human
aacacagcuuggaccagaagccc

SEQ ID NO: 907232 - RNA, 20 nt, Human
acugcaccaugaggcagaau

SEQ ID NO: 907233 - RNA, 18 nt, Human
agaggcaggggguggggc

SEQ ID NO: 907234 - RNA, 20 nt, Human
agaggcaggggguggggcag

SEQ ID NO: 907235 - RNA, 21 nt, Human
agaggcaggggguggggcagg

SEQ ID NO: 907236 - RNA, 22 nt, Human
aggcagaaugcagggugcucuc

SEQ ID NO: 907237 - RNA, 19 nt, Human
aggcaggggguggggcagg

SEQ ID NO: 907238 - RNA, 20 nt, Human
aggcaggggguggggcaggc

SEQ ID NO: 907239 - RNA, 20 nt, Human
aggcaggggguggggcaggc

SEQ ID NO: 907240 - RNA, 21 nt, Human
aggcaggggguggggcaggcg

SEQ ID NO: 907241 - RNA, 18 nt, Human
aggggguggggcaggcgu

SEQ ID NO: 907242 - RNA, 19 nt, Human
aggggguggggcaggcgug

SEQ ID NO: 907243 - RNA, 20 nt, Human
agggugcucucaaccagcug

SEQ ID NO: 907244 - RNA, 23 nt, Human
agucaacacagcuuggaccagaa

SEQ ID NO: 907245 - RNA, 22 nt, Human
caacaacggacucaucauccca

SEQ ID NO: 907246 - RNA, 18 nt, Human
ccaccauccacagcuccc

SEQ ID NO: 907247 - RNA, 20 nt, Human
cccauggcgccuggcucccu

SEQ ID NO: 907248 - RNA, 22 nt, Human
cggccaaggcagacaacaacgg

SEQ ID NO: 907249 - RNA, 19 nt, Human
cucccuggaaaggcacagg

SEQ ID NO: 907250 - RNA, 18 nt, Human
cuccugccaccauccaca

SEQ ID NO: 907251 - RNA, 18 nt, Human
cugcugagcugauguugu

SEQ ID NO: 907252 - RNA, 23 nt, Human
cugugaucgcuaacugcaccaug

SEQ ID NO: 907253 - RNA, 21 nt, Human
cuugcugggacacuccugcca

SEQ ID NO: 907254 - RNA, 25 nt, Human
gaugccgccuuucuugcugggacac

SEQ ID NO: 907255 - RNA, 21 nt, Human
ggagagcccagcccaggagau

SEQ ID NO: 907256 - RNA, 19 nt, Human
ggagccggcguuccugcug

SEQ ID NO: 907257 - RNA, 23 nt, Human
ggcaggcgugagguagggguggg

SEQ ID NO: 907258 - RNA, 21 nt, Human
gggcaggcgugagguaggggu

SEQ ID NO: 907259 - RNA, 23 nt, Human
gggguggggcaggcgugagguag

SEQ ID NO: 907260 - RNA, 19 nt, Human
guacuucugaaggccugug

SEQ ID NO: 907261 - RNA, 25 nt, Human
gugcucucaaccagcuggggguugg

SEQ ID NO: 907262 - RNA, 22 nt, Human
uaagaacaacaaccaaaagagg

SEQ ID NO: 907263 - RNA, 23 nt, Human
uaagaacaacaaccaaaagaggc

SEQ ID NO: 907264 - RNA, 23 nt, Human
uacauggagaggagauuaagaac

SEQ ID NO: 907265 - RNA, 26 nt, Human
uacauggagaggagauuaagaacaac

SEQ ID NO: 907266 - RNA, 22 nt, Human
uaggggugggguggggaugaca

SEQ ID NO: 907267 - RNA, 23 nt, Human
uaggggugggguggggaugacag

SEQ ID NO: 907268 - RNA, 26 nt, Human
ucaaacgcaagcacgaguguuuagaa

SEQ ID NO: 907269 - RNA, 18 nt, Human
ucccuggaaaggcacagg

SEQ ID NO: 907270 - RNA, 20 nt, Human
uccugcauuuucaaaggcuc

SEQ ID NO: 907271 - RNA, 19 nt, Human
ugaggcagaaugcagggug

SEQ ID NO: 907272 - RNA, 20 nt, Human
ugggaacuacauggagagga

SEQ ID NO: 907273 - RNA, 23 nt, Human
uggguccucggggagccggcguu

SEQ ID NO: 907274 - RNA, 21 nt, Human
aaaaaaaaaaaaaaaaaggac

SEQ ID NO: 907275 - RNA, 27 nt, Human
aaaaaaaaaaaggacgaccccagaaag

SEQ ID NO: 907276 - RNA, 24 nt, Human
aaaaaaaaaaggacgaccccagaa

SEQ ID NO: 907277 - RNA, 23 nt, Human
aaaaaaaaaggacgaccccagaa

SEQ ID NO: 907278 - RNA, 18 nt, Human
aaaaaaaaggacgacccc

SEQ ID NO: 907279 - RNA, 21 nt, Human
aaaaaaaggacgaccccagaa

SEQ ID NO: 907280 - RNA, 24 nt, Human
aaaaagcuuguauaaaggacagac

SEQ ID NO: 907281 - RNA, 19 nt, Human
aaaauauauauccuacucc

SEQ ID NO: 907282 - RNA, 18 nt, Human
aaacccaacaacccgaga

SEQ ID NO: 907283 - RNA, 19 nt, Human
aacacaggaagagggagag

SEQ ID NO: 907284 - RNA, 18 nt, Human
aacacaggcaugcaugca

SEQ ID NO: 907285 - RNA, 21 nt, Human
aacagcauguacucaacacag

SEQ ID NO: 907286 - RNA, 20 nt, Human
aacauggagaaaccccgucu

SEQ ID NO: 907287 - RNA, 21 nt, Human
aacauggagaaaccccgucuc

SEQ ID NO: 907288 - RNA, 21 nt, Human
aacccuagccccaagccgaga

SEQ ID NO: 907289 - RNA, 19 nt, Human
aaccucgcaagccagcacc

SEQ ID NO: 907290 - RNA, 24 nt, Human
aaccucgcaagccagcaccugccg

SEQ ID NO: 907291 - RNA, 20 nt, Human
aacuaaacuucggaaaccca

SEQ ID NO: 907292 - RNA, 21 nt, Human
aacucuguggccucacuccuc

SEQ ID NO: 907293 - RNA, 18 nt, Human
aagaacccuagccccaag

SEQ ID NO: 907294 - RNA, 23 nt, Human
aagagcgaaacucugucucaaaa

SEQ ID NO: 907295 - RNA, 21 nt, Human
aagagcguuugcucuucacag

SEQ ID NO: 907296 - RNA, 18 nt, Human
aagcgacccucaacauaa

SEQ ID NO: 907297 - RNA, 24 nt, Human
aaucaccugaacccaggaggcaga

SEQ ID NO: 907298 - RNA, 18 nt, Human
aauuagccaggcauggug

SEQ ID NO: 907299 - RNA, 19 nt, Human
acaaacagcauguacucaa

SEQ ID NO: 907300 - RNA, 20 nt, Human
acaagagcgaaacucugucu

SEQ ID NO: 907301 - RNA, 21 nt, Human
acaagagcgaaacucugucuc

SEQ ID NO: 907302 - RNA, 26 nt, Human
acaaugaagggaaccacaugcuaagg

SEQ ID NO: 907303 - RNA, 19 nt, Human
acaggcaaugcccugagaa

SEQ ID NO: 907304 - RNA, 23 nt, Human
accacaaagggcuaaagagcgac

SEQ ID NO: 907305 - RNA, 23 nt, Human
accaccaaauauccgacaaacag

SEQ ID NO: 907306 - RNA, 18 nt, Human
accaccccaggcguccca

SEQ ID NO: 907307 - RNA, 24 nt, Human
acccaggaggcagagguugcagug

SEQ ID NO: 907308 - RNA, 18 nt, Human
accccgucuccacuaaaa

SEQ ID NO: 907309 - RNA, 26 nt, Human
accgccacccucuccuuaaaacccaa

SEQ ID NO: 907310 - RNA, 23 nt, Human
accucgcaagccagcaccugccg

SEQ ID NO: 907311 - RNA, 19 nt, Human
accuggcucccuccagucc

SEQ ID NO: 907312 - RNA, 18 nt, Human
acugcacuccagccucag

SEQ ID NO: 907313 - RNA, 27 nt, Human
acugcacuccagccucagcaacaagag

SEQ ID NO: 907314 - RNA, 19 nt, Human
acugcaugcccucuucccc

SEQ ID NO: 907315 - RNA, 22 nt, Human
agaaaugugauccccucccccc

SEQ ID NO: 907316 - RNA, 19 nt, Human
agacacgaaacagaucaag

SEQ ID NO: 907317 - RNA, 24 nt, Human
agagcaaaugugaguugucuacac

SEQ ID NO: 907318 - RNA, 18 nt, Human
agagcgaaacucugucuc

SEQ ID NO: 907319 - RNA, 24 nt, Human
agaggaaaaagcuuguauaaagga

SEQ ID NO: 907320 - RNA, 22 nt, Human
agaggccuugggaucauggcuc

SEQ ID NO: 907321 - RNA, 24 nt, Human
agagguugcagugagacgagaugg

SEQ ID NO: 907322 - RNA, 25 nt, Human
agauacaaugaagggaaccgguacc

SEQ ID NO: 907323 - RNA, 23 nt, Human
agcagcuuuuaacaagcgacccu

SEQ ID NO: 907324 - RNA, 21 nt, Human
agcaucgaccaccucucacca

SEQ ID NO: 907325 - RNA, 24 nt, Human
agcaucgaccaccucucaccaccc

SEQ ID NO: 907326 - RNA, 22 nt, Human
agccccaagccgagagaagccu

SEQ ID NO: 907327 - RNA, 21 nt, Human
agccccagaauuaacagcugu

SEQ ID NO: 907328 - RNA, 20 nt, Human
agccugcauuaggaaggacc

SEQ ID NO: 907329 - RNA, 18 nt, Human
agcgcccucuucucugcc

SEQ ID NO: 907330 - RNA, 22 nt, Human
agcgcccucuucucugccuccu

SEQ ID NO: 907331 - RNA, 22 nt, Human
aggaaggacccugggaggccac

SEQ ID NO: 907332 - RNA, 24 nt, Human
aggacaaccucgcaagccagcacc

SEQ ID NO: 907333 - RNA, 21 nt, Human
aggcagagguugcagugagac

SEQ ID NO: 907334 - RNA, 24 nt, Human
aggcagagguugcagugagacgag

SEQ ID NO: 907335 - RNA, 21 nt, Human
aggcauggugcuacaucccug

SEQ ID NO: 907336 - RNA, 24 nt, Human
aggcauggugcuacaucccuguaa

SEQ ID NO: 907337 - RNA, 18 nt, Human
aggccuccugggacccca

SEQ ID NO: 907338 - RNA, 21 nt, Human
aggcgggcagaucaccugagg

SEQ ID NO: 907339 - RNA, 22 nt, Human
aggcgggcagaucaccugaggg

SEQ ID NO: 907340 - RNA, 21 nt, Human
agggaggacgucaccuuccaa

SEQ ID NO: 907341 - RNA, 18 nt, Human
agggguagagauucuuuu

SEQ ID NO: 907342 - RNA, 20 nt, Human
aguacugagagauuaaccac

SEQ ID NO: 907343 - RNA, 24 nt, Human
aguggcucacaccuguaaucccag

SEQ ID NO: 907344 - RNA, 19 nt, Human
auauccgacaaacagcaug

SEQ ID NO: 907345 - RNA, 18 nt, Human
aucgaguuguccccagca

SEQ ID NO: 907346 - RNA, 21 nt, Human
aucgaguuguccccagcaaac

SEQ ID NO: 907347 - RNA, 19 nt, Human
aucucggggcacaacgugg

SEQ ID NO: 907348 - RNA, 23 nt, Human
augcaggacaaccucgcaagcca

SEQ ID NO: 907349 - RNA, 20 nt, Human
auggagaaaccccgucucca

SEQ ID NO: 907350 - RNA, 23 nt, Human
auggugccacugcacuccagccu

SEQ ID NO: 907351 - RNA, 25 nt, Human
caaaaaaaaaaaaaaaaaggacgac

SEQ ID NO: 907352 - RNA, 23 nt, Human
caacaagagcgaaacucugucuc

SEQ ID NO: 907353 - RNA, 21 nt, Human
caacauaaccucauacagaua

SEQ ID NO: 907354 - RNA, 19 nt, Human
caacccuccaacagcuccc

SEQ ID NO: 907355 - RNA, 28 nt, Human
caacguggccaccagcaagcacgacauu

SEQ ID NO: 907356 - RNA, 21 nt, Human
caagcgacccucaacauaacc

SEQ ID NO: 907357 - RNA, 21 nt, Human
cacaaugcccagacagcuaaa

SEQ ID NO: 907358 - RNA, 22 nt, Human
cacacaugccuuugagacgcuc

SEQ ID NO: 907359 - RNA, 24 nt, Human
cacaccuguaaucccagcacuuug

SEQ ID NO: 907360 - RNA, 21 nt, Human
cacagcaugaccagcaucgac

SEQ ID NO: 907361 - RNA, 21 nt, Human
caccaaauauccgacaaacag

SEQ ID NO: 907362 - RNA, 18 nt, Human
caccaccccaggcguccc

SEQ ID NO: 907363 - RNA, 21 nt, Human
caccacgaugcagagccccga

SEQ ID NO: 907364 - RNA, 22 nt, Human
caccauaauuaugugucucacu

SEQ ID NO: 907365 - RNA, 22 nt, Human
caccggacccaggcacccaggc

SEQ ID NO: 907366 - RNA, 19 nt, Human
caccuguaaucccagcacu

SEQ ID NO: 907367 - RNA, 24 nt, Human
caccuguaaucccagcacuuuggg

SEQ ID NO: 907368 - RNA, 19 nt, Human
cacgaaacagaucaagaca

SEQ ID NO: 907369 - RNA, 19 nt, Human
cacugcacuccagccucag

SEQ ID NO: 907370 - RNA, 21 nt, Human
cacugcacuccagccucagca

SEQ ID NO: 907371 - RNA, 22 nt, Human
cacugcacuccagccucagcaa

SEQ ID NO: 907372 - RNA, 24 nt, Human
cacugcacuccagccucagcaaca

SEQ ID NO: 907373 - RNA, 19 nt, Human
cagaaagaacccuagcccc

SEQ ID NO: 907374 - RNA, 24 nt, Human
cagaucaccugaggcugggaguuc

SEQ ID NO: 907375 - RNA, 26 nt, Human
cagcaacaagagcgaaacucugucuc

SEQ ID NO: 907376 - RNA, 24 nt, Human
cagcaacaccaaaaaagagcguuu

SEQ ID NO: 907377 - RNA, 24 nt, Human
cagcacuuugggagaccgaggcgg

SEQ ID NO: 907378 - RNA, 21 nt, Human
cagcaugaccagcaucgacca

SEQ ID NO: 907379 - RNA, 24 nt, Human
cagcaugauuccuacauacauuga

SEQ ID NO: 907380 - RNA, 19 nt, Human
cagccaccauuuagugggg

SEQ ID NO: 907381 - RNA, 22 nt, Human
cagccaccggacccaggcaccc

SEQ ID NO: 907382 - RNA, 23 nt, Human
cagccaccggacccaggcaccca

SEQ ID NO: 907383 - RNA, 24 nt, Human
cagccugaccaacauggagaaacc

SEQ ID NO: 907384 - RNA, 19 nt, Human
cagccugcauuaggaagga

SEQ ID NO: 907385 - RNA, 22 nt, Human
cagccugcauuaggaaggaccc

SEQ ID NO: 907386 - RNA, 20 nt, Human
cagcuucuaaugccccaggc

SEQ ID NO: 907387 - RNA, 20 nt, Human
caggcaaugcccugagaacc

SEQ ID NO: 907388 - RNA, 21 nt, Human
cagguccugaugaaucuggag

SEQ ID NO: 907389 - RNA, 19 nt, Human
caucccuguaaucccagcu

SEQ ID NO: 907390 - RNA, 25 nt, Human
cauguacucaacacaggcaugcaug

SEQ ID NO: 907391 - RNA, 24 nt, Human
ccaaagaacucacacaaugcccag

SEQ ID NO: 907392 - RNA, 18 nt, Human
ccacaaagggcuaaagag

SEQ ID NO: 907393 - RNA, 20 nt, Human
ccacccucuccuuaaaaccc

SEQ ID NO: 907394 - RNA, 25 nt, Human
ccaccucucaccaccccaggcgucc

SEQ ID NO: 907395 - RNA, 20 nt, Human
ccacugcacuccagccucag

SEQ ID NO: 907396 - RNA, 20 nt, Human
ccacugcacuccagccucag

SEQ ID NO: 907397 - RNA, 21 nt, Human
ccacugcacuccagccucagc

SEQ ID NO: 907398 - RNA, 21 nt, Human
ccacuucuaagaauucauccu

SEQ ID NO: 907399 - RNA, 21 nt, Human
ccagcaaacaauccaagagca

SEQ ID NO: 907400 - RNA, 23 nt, Human
ccagcaaacaauccaagagcaaa

SEQ ID NO: 907401 - RNA, 23 nt, Human
ccagcaccugccgacccgccugg

SEQ ID NO: 907402 - RNA, 24 nt, Human
ccagcgcccucuucucugccuccu

SEQ ID NO: 907403 - RNA, 22 nt, Human
cccaacacgaguuaccguuucu

SEQ ID NO: 907404 - RNA, 21 nt, Human
cccaagccgagagaagccugc

SEQ ID NO: 907405 - RNA, 25 nt, Human
cccaagucagagcacggccgggguc

SEQ ID NO: 907406 - RNA, 22 nt, Human
cccaccaccaaauauccgacaa

SEQ ID NO: 907407 - RNA, 22 nt, Human
ccccaagccgagagaagccugc

SEQ ID NO: 907408 - RNA, 18 nt, Human
ccccaagccuaagacugc

SEQ ID NO: 907409 - RNA, 25 nt, Human
ccccccaccaccaaauauccgacaa

SEQ ID NO: 907410 - RNA, 18 nt, Human
cccccugucccucugcua

SEQ ID NO: 907411 - RNA, 20 nt, Human
ccccuccccccaccaccaaa

SEQ ID NO: 907412 - RNA, 22 nt, Human
cccgagguggcugugcuuucug

SEQ ID NO: 907413 - RNA, 21 nt, Human
cccgucuccacuaaaaacaca

SEQ ID NO: 907414 - RNA, 20 nt, Human
cccuaggccuccugggaccc

SEQ ID NO: 907415 - RNA, 21 nt, Human
cccuaggccuccugggacccc

SEQ ID NO: 907416 - RNA, 19 nt, Human
cccucuuccccucuuugcc

SEQ ID NO: 907417 - RNA, 18 nt, Human
cccugaauccagaaguuc

SEQ ID NO: 907418 - RNA, 23 nt, Human
cccuggacuggccaugcugcccu

SEQ ID NO: 907419 - RNA, 23 nt, Human
ccuccaggucucuccaccuggcc

SEQ ID NO: 907420 - RNA, 24 nt, Human
ccuccaggucucuccaccuggccu

SEQ ID NO: 907421 - RNA, 22 nt, Human
ccuccugggaccccaagccuaa

SEQ ID NO: 907422 - RNA, 18 nt, Human
ccuccugucucccugcuc

SEQ ID NO: 907423 - RNA, 19 nt, Human
ccuccugucucccugcucc

SEQ ID NO: 907424 - RNA, 20 nt, Human
ccuccugucucccugcuccu

SEQ ID NO: 907425 - RNA, 25 nt, Human
ccucucaccaccccaggcgucccag

SEQ ID NO: 907426 - RNA, 23 nt, Human
ccugaccaacauggagaaacccc

SEQ ID NO: 907427 - RNA, 24 nt, Human
ccugaccaacauggagaaaccccg

SEQ ID NO: 907428 - RNA, 22 nt, Human
ccugaggcugggaguucgagac

SEQ ID NO: 907429 - RNA, 22 nt, Human
ccugcaggccgcugugccgcac

SEQ ID NO: 907430 - RNA, 22 nt, Human
ccuggccccaccacgaugcaga

SEQ ID NO: 907431 - RNA, 19 nt, Human
ccuguaaucccagcuacuc

SEQ ID NO: 907432 - RNA, 21 nt, Human
ccuguaaucccagcuacucgg

SEQ ID NO: 907433 - RNA, 19 nt, Human
ccuuggcccaggacaccug

SEQ ID NO: 907434 - RNA, 24 nt, Human
cgagauggugccacugcacuccag

SEQ ID NO: 907435 - RNA, 20 nt, Human
cgaggcgggcagaucaccug

SEQ ID NO: 907436 - RNA, 22 nt, Human
cggaaacccaacaacccgagag

SEQ ID NO: 907437 - RNA, 24 nt, Human
cggaaggcugggacaggagaauca

SEQ ID NO: 907438 - RNA, 24 nt, Human
cgggcagaucaccugaggcuggga

SEQ ID NO: 907439 - RNA, 28 nt, Human
cuaccaugauccuauuaacacccaaguu

SEQ ID NO: 907440 - RNA, 20 nt, Human
cuagccccaagccgagagaa

SEQ ID NO: 907441 - RNA, 18 nt, Human
cucaaaaaaaaaaaaaaa

SEQ ID NO: 907442 - RNA, 22 nt, Human
cucacaccuguaaucccagcac

SEQ ID NO: 907443 - RNA, 24 nt, Human
cucacaccuguaaucccagcacuu

SEQ ID NO: 907444 - RNA, 20 nt, Human
cucaccaccccaggcguccc

SEQ ID NO: 907445 - RNA, 23 nt, Human
cuccaugaaauccccacacagaa

SEQ ID NO: 907446 - RNA, 22 nt, Human
cuccccccaccaccaaauaucc

SEQ ID NO: 907447 - RNA, 21 nt, Human
cuccugggaccccaagccuaa

SEQ ID NO: 907448 - RNA, 18 nt, Human
cucucucucucucacccc

SEQ ID NO: 907449 - RNA, 19 nt, Human
cucucuggcugcauccuaa

SEQ ID NO: 907450 - RNA, 19 nt, Human
cucugucucaaaaaaaaaa

SEQ ID NO: 907451 - RNA, 22 nt, Human
cucuucacaggcacucccuaaa

SEQ ID NO: 907452 - RNA, 20 nt, Human
cuggaacucacugagacugc

SEQ ID NO: 907453 - RNA, 25 nt, Human
cuggauagaagccgaagucucggcc

SEQ ID NO: 907454 - RNA, 22 nt, Human
cugucccucugcuagggugccu

SEQ ID NO: 907455 - RNA, 23 nt, Human
cugucccucugcuagggugccuu

SEQ ID NO: 907456 - RNA, 20 nt, Human
cuuggcccaggacaccugca

SEQ ID NO: 907457 - RNA, 24 nt, Human
gaccccagaaagaacccuagcccc

SEQ ID NO: 907458 - RNA, 22 nt, Human
gacccuguggggaaggaggcug

SEQ ID NO: 907459 - RNA, 24 nt, Human
gacgaccccagaaagaacccuagc

SEQ ID NO: 907460 - RNA, 22 nt, Human
gacuugaagaaagcugcucuuc

SEQ ID NO: 907461 - RNA, 21 nt, Human
gagaaaccccgucuccacuaa

SEQ ID NO: 907462 - RNA, 23 nt, Human
gagaccagccugaccaacaugga

SEQ ID NO: 907463 - RNA, 18 nt, Human
gaucaccugaggcuggga

SEQ ID NO: 907464 - RNA, 24 nt, Human
gaucaccugaggcugggaguucga

SEQ ID NO: 907465 - RNA, 18 nt, Human
gaucauggcuccugaucc

SEQ ID NO: 907466 - RNA, 23 nt, Human
gauccccuccccccaccaccaaa

SEQ ID NO: 907467 - RNA, 22 nt, Human
gcacaguggcucacaccuguaa

SEQ ID NO: 907468 - RNA, 19 nt, Human
gccacgcacaguggcucac

SEQ ID NO: 907469 - RNA, 20 nt, Human
gcccuggagcggccugaacc

SEQ ID NO: 907470 - RNA, 24 nt, Human
gccucauccuuccuucccaaccuc

SEQ ID NO: 907471 - RNA, 20 nt, Human
gccugcauuaggaaggaccc

SEQ ID NO: 907472 - RNA, 28 nt, Human
ggaaacaaugcgagaguaaccgguaccc

SEQ ID NO: 907473 - RNA, 21 nt, Human
ggaaagccgggauuguaagga

SEQ ID NO: 907474 - RNA, 18 nt, Human
ggacaggagaaucaccug

SEQ ID NO: 907475 - RNA, 24 nt, Human
ggacaggagaaucaccugaaccca

SEQ ID NO: 907476 - RNA, 21 nt, Human
ggaucauggcuccugauccca

SEQ ID NO: 907477 - RNA, 19 nt, Human
ggcagcaacaccaaaaaag

SEQ ID NO: 907478 - RNA, 21 nt, Human
ggcaucugcacgcagugcagc

SEQ ID NO: 907479 - RNA, 19 nt, Human
ggcugugcuuucugccagc

SEQ ID NO: 907480 - RNA, 21 nt, Human
gggagcugggagcaguacagg

SEQ ID NO: 907481 - RNA, 24 nt, Human
ggugcuacaucccuguaaucccag

SEQ ID NO: 907482 - RNA, 26 nt, Human
gugcaucuguauuuacauagaauaac

SEQ ID NO: 907483 - RNA, 23 nt, Human
guugauucacggaagcugucauu

SEQ ID NO: 907484 - RNA, 20 nt, Human
uaaaaacacaaaauuagcca

SEQ ID NO: 907485 - RNA, 22 nt, Human
uaaaaacacaaaauuagccagg

SEQ ID NO: 907486 - RNA, 23 nt, Human
uaaaaacacaaaauuagccaggc

SEQ ID NO: 907487 - RNA, 22 nt, Human
uaaaacccaacacgaguuaccg

SEQ ID NO: 907488 - RNA, 19 nt, Human
uaacagaaaugugaucccc

SEQ ID NO: 907489 - RNA, 25 nt, Human
uaacuagcaaacguguucauucccu

SEQ ID NO: 907490 - RNA, 23 nt, Human
uaauuagacacgaaacagaucaa

SEQ ID NO: 907491 - RNA, 21 nt, Human
uacaauccagcuucuaaugcc

SEQ ID NO: 907492 - RNA, 21 nt, Human
uagaaaaacccagauacaaug

SEQ ID NO: 907493 - RNA, 23 nt, Human
uagaaaaacccagauacaaugaa

SEQ ID NO: 907494 - RNA, 20 nt, Human
uaggccuccugggaccccaa

SEQ ID NO: 907495 - RNA, 23 nt, Human
uaguacugagagauuaaccacaa

SEQ ID NO: 907496 - RNA, 21 nt, Human
uagugggcacuuacaaccugc

SEQ ID NO: 907497 - RNA, 23 nt, Human
uauaaaggacagacugagauaga

SEQ ID NO: 907498 - RNA, 22 nt, Human
uaucugaaacuuacaaguagga

SEQ ID NO: 907499 - RNA, 18 nt, Human
uauuucuccaguucuucu

SEQ ID NO: 907500 - RNA, 20 nt, Human
uauuucuccaguucuucugg

SEQ ID NO: 907501 - RNA, 23 nt, Human
ucacacaaugcccagacagcuaa

SEQ ID NO: 907502 - RNA, 18 nt, Human
ucaccugaggcugggagu

SEQ ID NO: 907503 - RNA, 20 nt, Human
uccagaaguuccacuucuaa

SEQ ID NO: 907504 - RNA, 20 nt, Human
uccaggucucuccaccuggg

SEQ ID NO: 907505 - RNA, 18 nt, Human
ucccaggcccagcucccc

SEQ ID NO: 907506 - RNA, 23 nt, Human
ucccaggcccagcuccccgaccc

SEQ ID NO: 907507 - RNA, 18 nt, Human
ucccagguccaacccagc

SEQ ID NO: 907508 - RNA, 21 nt, Human
uccccacacagaaggcuagau

SEQ ID NO: 907509 - RNA, 23 nt, Human
uccccagcaaacaauccaagagc

SEQ ID NO: 907510 - RNA, 20 nt, Human
uccccccaccaccaaauauc

SEQ ID NO: 907511 - RNA, 22 nt, Human
uccccccaccaccaaauauccg

SEQ ID NO: 907512 - RNA, 18 nt, Human
uccccgugagcgcagggg

SEQ ID NO: 907513 - RNA, 22 nt, Human
ucccugcuccuuggcccaggac

SEQ ID NO: 907514 - RNA, 21 nt, Human
ucccuguaaucccagcuacuc

SEQ ID NO: 907515 - RNA, 23 nt, Human
ucccuguaaucccagcuacucgg

SEQ ID NO: 907516 - RNA, 18 nt, Human
uccugaucccagaaaugc

SEQ ID NO: 907517 - RNA, 21 nt, Human
uccugggaccccaagccuaag

SEQ ID NO: 907518 - RNA, 20 nt, Human
uccugggcuccaugucaccu

SEQ ID NO: 907519 - RNA, 20 nt, Human
uccuuggaucuggcagcaac

SEQ ID NO: 907520 - RNA, 24 nt, Human
ucgaguuguccccagcaaacaauc

SEQ ID NO: 907521 - RNA, 25 nt, Human
ucggaaggcugggacaggagaauca

SEQ ID NO: 907522 - RNA, 23 nt, Human
ucucaccaccccaggcgucccag

SEQ ID NO: 907523 - RNA, 24 nt, Human
ucuccaccuggccucccugccaua

SEQ ID NO: 907524 - RNA, 21 nt, Human
ucucugccuccugucucccug

SEQ ID NO: 907525 - RNA, 19 nt, Human
ucucuggcugcauccuaac

SEQ ID NO: 907526 - RNA, 23 nt, Human
ucugacucuggauagaagccgaa

SEQ ID NO: 907527 - RNA, 21 nt, Human
ucugcacgcagugcagccugg

SEQ ID NO: 907528 - RNA, 24 nt, Human
ucugccuccugucucccugcuccu

SEQ ID NO: 907529 - RNA, 23 nt, Human
ucugucucaaaaaaaaaaaaaaa

SEQ ID NO: 907530 - RNA, 25 nt, Human
ucugucucaaaaaaaaaaaaaaaaa

SEQ ID NO: 907531 - RNA, 24 nt, Human
ucuucugggggagcugggagcagu

SEQ ID NO: 907532 - RNA, 20 nt, Human
ucuuuuggcaaaaauuuuag

SEQ ID NO: 907533 - RNA, 22 nt, Human
ugaaacuuacaaguaggagccu

SEQ ID NO: 907534 - RNA, 20 nt, Human
ugaaccaagccagggcuguu

SEQ ID NO: 907535 - RNA, 24 nt, Human
ugaagaaagcugcucuuccugcag

SEQ ID NO: 907536 - RNA, 21 nt, Human
ugacaggcaaugcccugagaa

SEQ ID NO: 907537 - RNA, 18 nt, Human
ugagaaacuaaacuucgg

SEQ ID NO: 907538 - RNA, 21 nt, Human
ugagaaugucaggaucucagu

SEQ ID NO: 907539 - RNA, 23 nt, Human
ugagaaugucaggaucucaguuu

SEQ ID NO: 907540 - RNA, 21 nt, Human
ugagauagaaaaacccagaua

SEQ ID NO: 907541 - RNA, 20 nt, Human
ugaugaaucuggagcugaca

SEQ ID NO: 907542 - RNA, 25 nt, Human
ugcacgcagugcagccuggcacgug

SEQ ID NO: 907543 - RNA, 20 nt, Human
ugcacuccagccucagcaac

SEQ ID NO: 907544 - RNA, 20 nt, Human
ugcagagccccgagguggcu

SEQ ID NO: 907545 - RNA, 19 nt, Human
ugcagaugcuucugugccc

SEQ ID NO: 907546 - RNA, 18 nt, Human
ugccaaagaacucacaca

SEQ ID NO: 907547 - RNA, 19 nt, Human
ugccaaagaacucacacaa

SEQ ID NO: 907548 - RNA, 26 nt, Human
ugccaaagaacucacacaaugcccag

SEQ ID NO: 907549 - RNA, 19 nt, Human
ugcccagacagcuaaagag

SEQ ID NO: 907550 - RNA, 21 nt, Human
ugcugguauuucuccaguucu

SEQ ID NO: 907551 - RNA, 21 nt, Human
ugcuucacagcaugaccagca

SEQ ID NO: 907552 - RNA, 24 nt, Human
uggaacucacugagacugcuucac

SEQ ID NO: 907553 - RNA, 19 nt, Human
uggcccaggacaccugcag

SEQ ID NO: 907554 - RNA, 21 nt, Human
uggcucacaccuguaauccca

SEQ ID NO: 907555 - RNA, 24 nt, Human
uggcucacaccuguaaucccagca

SEQ ID NO: 907556 - RNA, 21 nt, Human
uggcuccugaucccagaaaug

SEQ ID NO: 907557 - RNA, 20 nt, Human
ugggacaggagaaucaccug

SEQ ID NO: 907558 - RNA, 24 nt, Human
ugggacaggagaaucaccugaacc

SEQ ID NO: 907559 - RNA, 24 nt, Human
ugggagaccgaggcgggcagauca

SEQ ID NO: 907560 - RNA, 19 nt, Human
ugggagcaguacaggaugg

SEQ ID NO: 907561 - RNA, 18 nt, Human
ugggugguucggcauaac

SEQ ID NO: 907562 - RNA, 24 nt, Human
uggugcuacaucccuguaauccca

SEQ ID NO: 907563 - RNA, 25 nt, Human
uguacucaacacaggcaugcaugca

SEQ ID NO: 907564 - RNA, 24 nt, Human
uguaguuuuucucagugacuguau

SEQ ID NO: 907565 - RNA, 21 nt, Human
ugucaggaucucaguuuugcu

SEQ ID NO: 907566 - RNA, 25 nt, Human
ugugauccccuccccccaccaccaa

SEQ ID NO: 907567 - RNA, 24 nt, Human
uuaaaacccaacacgaguuaccgu

SEQ ID NO: 907568 - RNA, 23 nt, Human
uucccuaggccuccugggacccc

SEQ ID NO: 907569 - RNA, 22 nt, Human
uuccugcagaugcuucugugcc

SEQ ID NO: 907570 - RNA, 20 nt, Human
uuccugggcuccaugucacc

SEQ ID NO: 907571 - RNA, 25 nt, Human
uucuaaugccccaggcgagacccug

SEQ ID NO: 907572 - RNA, 28 nt, Human
uucuaaugccccaggcgagacccugugg

SEQ ID NO: 907573 - RNA, 23 nt, Human
uucuucccccugucccucugcua

SEQ ID NO: 907574 - RNA, 23 nt, Human
uugaagaaagcugcuccugugcg

SEQ ID NO: 907575 - RNA, 22 nt, Human
uugaagaaagcugcuccugugg

SEQ ID NO: 907576 - RNA, 22 nt, Human
uugcagugagacgagauggugc

SEQ ID NO: 907577 - RNA, 24 nt, Human
uuggaucuggcagcaacaccaaaa

SEQ ID NO: 907578 - RNA, 21 nt, Human
uuggccacaaacuaaagggag

SEQ ID NO: 907579 - RNA, 20 nt, Human
uuuuucucagugacuguauu

SEQ ID NO: 907580 - RNA, 21 nt, Human
aacaacacuacccuuccacaa

SEQ ID NO: 907581 - RNA, 23 nt, Human
aaucaaauccuuuaaauuggaca

SEQ ID NO: 907582 - RNA, 20 nt, Human
acagacuguaaauacagaac

SEQ ID NO: 907583 - RNA, 18 nt, Human
agcgggacacagaaaccc

SEQ ID NO: 907584 - RNA, 23 nt, Human
aggcccaaaacaauggccagcgg

SEQ ID NO: 907585 - RNA, 22 nt, Human
caaaaauaaaacugucuccuga

SEQ ID NO: 907586 - RNA, 20 nt, Human
caaaacaauggccagcggga

SEQ ID NO: 907587 - RNA, 18 nt, Human
cacaaguguggaaguaga

SEQ ID NO: 907588 - RNA, 18 nt, Human
cacagaaacccagagcuc

SEQ ID NO: 907589 - RNA, 20 nt, Human
cagagcucacaguuccuuuc

SEQ ID NO: 907590 - RNA, 18 nt, Human
ccuuccacaaguguggaa

SEQ ID NO: 907591 - RNA, 18 nt, Human
gacacagaaacccagagc

SEQ ID NO: 907592 - RNA, 19 nt, Human
gacacagaaacccagagcu

SEQ ID NO: 907593 - RNA, 22 nt, Human
gggacacagaaacccagagcuc

SEQ ID NO: 907594 - RNA, 19 nt, Human
guagagacuacagacugua

SEQ ID NO: 907595 - RNA, 23 nt, Human
gucuccugacugccucucuguug

SEQ ID NO: 907596 - RNA, 24 nt, Human
ucuccugacugccucucuguugua

SEQ ID NO: 907597 - RNA, 22 nt, Human
ugaaacuuacaggaauguacac

SEQ ID NO: 907598 - RNA, 20 nt, Human
uggacaccaugguucuucuu

SEQ ID NO: 907599 - RNA, 25 nt, Human
uguaaauacagaacuuuccagguuc

SEQ ID NO: 907600 - RNA, 20 nt, Human
uugcuggugacaacuguccc

SEQ ID NO: 907601 - RNA, 22 nt, Human
aaaagaaaacagaguauaagaa

SEQ ID NO: 907602 - RNA, 22 nt, Human
aaaauaaucaaaguacaaaaca

SEQ ID NO: 907603 - RNA, 19 nt, Human
aaagauggcugcuuggaua

SEQ ID NO: 907604 - RNA, 24 nt, Human
aaaguacuucugccucagcaucuc

SEQ ID NO: 907605 - RNA, 24 nt, Human
aagcacaaaaggggucaauucugg

SEQ ID NO: 907606 - RNA, 21 nt, Human
acaagagcaugugaaggaagc

SEQ ID NO: 907607 - RNA, 25 nt, Human
acaccugaagcauucuuccagccac

SEQ ID NO: 907608 - RNA, 19 nt, Human
acuucugccucagcaucuc

SEQ ID NO: 907609 - RNA, 22 nt, Human
agaacgaacucugcauugugaa

SEQ ID NO: 907610 - RNA, 19 nt, Human
agcauucuuccagccacuc

SEQ ID NO: 907611 - RNA, 18 nt, Human
aggggucaauucuggagu

SEQ ID NO: 907612 - RNA, 22 nt, Human
auaacaccuuuccuccugcaca

SEQ ID NO: 907613 - RNA, 20 nt, Human
augaacuucugacaccugaa

SEQ ID NO: 907614 - RNA, 18 nt, Human
caaaugaaucauaaaacc

SEQ ID NO: 907615 - RNA, 22 nt, Human
caaugaacuucugacaccugaa

SEQ ID NO: 907616 - RNA, 19 nt, Human
cagccagacagccagcccc

SEQ ID NO: 907617 - RNA, 22 nt, Human
cagcguuugagugagcacucca

SEQ ID NO: 907618 - RNA, 19 nt, Human
cagcuggaaaacaagagca

SEQ ID NO: 907619 - RNA, 21 nt, Human
cauucuguuucaguuugggag

SEQ ID NO: 907620 - RNA, 21 nt, Human
ccagacagccagccccgcacc

SEQ ID NO: 907621 - RNA, 19 nt, Human
ccagccagacagccagccc

SEQ ID NO: 907622 - RNA, 19 nt, Human
ccgcaaccucuccaccaag

SEQ ID NO: 907623 - RNA, 21 nt, Human
ccgcaaccucuccaccaagaa

SEQ ID NO: 907624 - RNA, 20 nt, Human
cggugcgagucacuuugcuu

SEQ ID NO: 907625 - RNA, 20 nt, Human
cuggcaaugaggugugugca

SEQ ID NO: 907626 - RNA, 23 nt, Human
cuuaauauacuguugaaccugga

SEQ ID NO: 907627 - RNA, 18 nt, Human
cuucacggugcgagucac

SEQ ID NO: 907628 - RNA, 18 nt, Human
cuucugugcagacuccgc

SEQ ID NO: 907629 - RNA, 23 nt, Human
gaaaacaagagcaugugaaggaa

SEQ ID NO: 907630 - RNA, 23 nt, Human
gaaagcagcuggaaaacaagagc

SEQ ID NO: 907631 - RNA, 24 nt, Human
gagcuuccggaaagauggcugcuu

SEQ ID NO: 907632 - RNA, 23 nt, Human
gcacaaaaggggucaauucugga

SEQ ID NO: 907633 - RNA, 19 nt, Human
ggauaacaccuuuccuccu

SEQ ID NO: 907634 - RNA, 25 nt, Human
uacuucugccucagcaucucggaga

SEQ ID NO: 907635 - RNA, 22 nt, Human
uagcuacuucauucuguuucag

SEQ ID NO: 907636 - RNA, 20 nt, Human
ucaauucuggcucuuuugga

SEQ ID NO: 907637 - RNA, 25 nt, Human
ucuggcucuuuuggaagaaggcugg

SEQ ID NO: 907638 - RNA, 24 nt, Human
ucuuccagccacucuggcgucacu

SEQ ID NO: 907639 - RNA, 19 nt, Human
ugaaaagcacaaaaggggu

SEQ ID NO: 907640 - RNA, 24 nt, Human
ugaaaagcacaaaaggggucaauu

SEQ ID NO: 907641 - RNA, 25 nt, Human
ugaacuucugacaccugaagcauuc

SEQ ID NO: 907642 - RNA, 25 nt, Human
ugaggugugugcacuucugugcaga

SEQ ID NO: 907643 - RNA, 19 nt, Human
ugugugcacuucugugcag

SEQ ID NO: 907644 - RNA, 19 nt, Human
uucauaguccagcguuuga

SEQ ID NO: 907645 - RNA, 25 nt, Human
uugccuuaaagaguggagaaacgug

SEQ ID NO: 907646 - RNA, 21 nt, Human
uuggauaacaccuuuccuccu

SEQ ID NO: 907647 - RNA, 25 nt, Human
uuggauaacaccuuuccuccugcac

SEQ ID NO: 907648 - RNA, 24 nt, Human
aaaaaacccaaaaccaagaaaaca

SEQ ID NO: 907649 - RNA, 18 nt, Human
aaaacaaaaaccccaagc

SEQ ID NO: 907650 - RNA, 24 nt, Human
aaaacccaaaaccaagaaaacaaa

SEQ ID NO: 907651 - RNA, 23 nt, Human
aaaaggaaaaaagcauccucuga

SEQ ID NO: 907652 - RNA, 24 nt, Human
aaaaugcugggauuacaggcguga

SEQ ID NO: 907653 - RNA, 25 nt, Human
aaacaaacacaaguauacuccccuc

SEQ ID NO: 907654 - RNA, 23 nt, Human
aaacacaaguauacuccccucuc

SEQ ID NO: 907655 - RNA, 18 nt, Human
aaaccaagaaaacaaaaa

SEQ ID NO: 907656 - RNA, 21 nt, Human
aaagacagggucaccaaaccc

SEQ ID NO: 907657 - RNA, 23 nt, Human
aaaggaaaaaagcauccucugag

SEQ ID NO: 907658 - RNA, 24 nt, Human
aaagugcugggauuacagguguga

SEQ ID NO: 907659 - RNA, 20 nt, Human
aaagugcuuuuuccccuccu

SEQ ID NO: 907660 - RNA, 26 nt, Human
aaaugcugggauuacaggcgugaacc

SEQ ID NO: 907661 - RNA, 18 nt, Human
aaccccuuucuuuuccca

SEQ ID NO: 907662 - RNA, 19 nt, Human
aagaaaacaaaaaccccaa

SEQ ID NO: 907663 - RNA, 18 nt, Human
aagacagggucaccaaac

SEQ ID NO: 907664 - RNA, 24 nt, Human
aagcacuucaucuguaagaaacag

SEQ ID NO: 907665 - RNA, 23 nt, Human
aaggaaauaaggaauacuaaaac

SEQ ID NO: 907666 - RNA, 18 nt, Human
aaggagccuggaggagag

SEQ ID NO: 907667 - RNA, 18 nt, Human
aagugcugggauuacagg

SEQ ID NO: 907668 - RNA, 19 nt, Human
aagugcugggauuacaggu

SEQ ID NO: 907669 - RNA, 26 nt, Human
aagugcugggauuacaggugugagcc

SEQ ID NO: 907670 - RNA, 20 nt, Human
aaucaccuccaugcauaccu

SEQ ID NO: 907671 - RNA, 19 nt, Human
aauggcuacugauccacag

SEQ ID NO: 907672 - RNA, 22 nt, Human
acaaaaaccccaagccaagaca

SEQ ID NO: 907673 - RNA, 23 nt, Human
acaaaaaccccaagccaagacaa

SEQ ID NO: 907674 - RNA, 20 nt, Human
acaggcacccaccaccucac

SEQ ID NO: 907675 - RNA, 20 nt, Human
acaggguuucaccacguugg

SEQ ID NO: 907676 - RNA, 24 nt, Human
acaggguuucaccacguuggccag

SEQ ID NO: 907677 - RNA, 24 nt, Human
accacguuggccaggcuggucucg

SEQ ID NO: 907678 - RNA, 24 nt, Human
accauguuggucaggcuggucucg

SEQ ID NO: 907679 - RNA, 25 nt, Human
acccaucuuggccucccaaagugcu

SEQ ID NO: 907680 - RNA, 20 nt, Human
accccaagccaagacaaaaa

SEQ ID NO: 907681 - RNA, 24 nt, Human
acgaaggaaacauaugcaaaaaaa

SEQ ID NO: 907682 - RNA, 24 nt, Human
acucacucuguugcccaggcugga

SEQ ID NO: 907683 - RNA, 27 nt, Human
acucuguugcccaggcuggaguagagu

SEQ ID NO: 907684 - RNA, 19 nt, Human
agaaaacaaaaaccccaag

SEQ ID NO: 907685 - RNA, 20 nt, Human
agaaagacagggucaccaaa

SEQ ID NO: 907686 - RNA, 23 nt, Human
agaaagcacuucaucuguaagaa

SEQ ID NO: 907687 - RNA, 27 nt, Human
agaaauauacagucuuuacauuucuuc

SEQ ID NO: 907688 - RNA, 22 nt, Human
agacagaugcacagcacugauu

SEQ ID NO: 907689 - RNA, 26 nt, Human
agccccuggcuggaucuauguuuccc

SEQ ID NO: 907690 - RNA, 31 nt, Human
agcuaauuuuuuguauuuuuaguagagacaa

SEQ ID NO: 907691 - RNA, 21 nt, Human
agggucauauaagaaagacag

SEQ ID NO: 907692 - RNA, 24 nt, Human
aguggcguggucucagcucacugc

SEQ ID NO: 907693 - RNA, 22 nt, Human
auaaaaaaacccaaaaccaaga

SEQ ID NO: 907694 - RNA, 22 nt, Human
auagagcaaaugugcugugucu

SEQ ID NO: 907695 - RNA, 24 nt, Human
aucucgugaucugcccgccuuggc

SEQ ID NO: 907696 - RNA, 20 nt, Human
augagguuucaccauguugg

SEQ ID NO: 907697 - RNA, 21 nt, Human
augagguuucaccauguuggu

SEQ ID NO: 907698 - RNA, 24 nt, Human
augagguuucaccauguuggucag

SEQ ID NO: 907699 - RNA, 23 nt, Human
auuauacaguccaugaugauuca

SEQ ID NO: 907700 - RNA, 24 nt, Human
auuuuuguauuuuuaguagagaug

SEQ ID NO: 907701 - RNA, 22 nt, Human
caaaaaccccaagccaagacaa

SEQ ID NO: 907702 - RNA, 23 nt, Human
caaaaaccccaagccaagacaaa

SEQ ID NO: 907703 - RNA, 21 nt, Human
caaaaccaagaaaacaaaaac

SEQ ID NO: 907704 - RNA, 22 nt, Human
caaaaccaagaaaacaaaaacc

SEQ ID NO: 907705 - RNA, 24 nt, Human
caaaaccaagaaaacaaaaacccc

SEQ ID NO: 907706 - RNA, 28 nt, Human
caaaaccaagaaaacaaaaaccccaagc

SEQ ID NO: 907707 - RNA, 20 nt, Human
caaaagcacaagcuaaauuu

SEQ ID NO: 907708 - RNA, 24 nt, Human
caaaaugcugggauuacaggcgug

SEQ ID NO: 907709 - RNA, 24 nt, Human
caaagugcugggauuacaggugug

SEQ ID NO: 907710 - RNA, 20 nt, Human
caagcgauucuccugccuca

SEQ ID NO: 907711 - RNA, 22 nt, Human
caagcgauucuccugccucagc

SEQ ID NO: 907712 - RNA, 24 nt, Human
caccacacccagcuaauuuuugua

SEQ ID NO: 907713 - RNA, 21 nt, Human
caccacguuggccaggcuggu

SEQ ID NO: 907714 - RNA, 24 nt, Human
caccacguuggccaggcuggucuc

SEQ ID NO: 907715 - RNA, 27 nt, Human
caccacguuggccaggcuggucucgaa

SEQ ID NO: 907716 - RNA, 21 nt, Human
caccauguuggucaggcuggu

SEQ ID NO: 907717 - RNA, 24 nt, Human
caccauguuggucaggcuggucuc

SEQ ID NO: 907718 - RNA, 22 nt, Human
cacccaucuuggccucccaaag

SEQ ID NO: 907719 - RNA, 23 nt, Human
cacccaucuuggccucccaaagu

SEQ ID NO: 907720 - RNA, 24 nt, Human
cacccaucuuggccucccaaagug

SEQ ID NO: 907721 - RNA, 22 nt, Human
cacgccauucuccugccucagc

SEQ ID NO: 907722 - RNA, 24 nt, Human
cacguuggccaggcuggucucgaa

SEQ ID NO: 907723 - RNA, 22 nt, Human
cacucuguugcccaggcuggag

SEQ ID NO: 907724 - RNA, 21 nt, Human
cacugcaaccucugccuccug

SEQ ID NO: 907725 - RNA, 23 nt, Human
cacugcaaccucugccuccuggg

SEQ ID NO: 907726 - RNA, 20 nt, Human
cacuuggccugauuuacuuu

SEQ ID NO: 907727 - RNA, 19 nt, Human
cagccuccuggguagcugg

SEQ ID NO: 907728 - RNA, 21 nt, Human
caggcacccaccaccucaccc

SEQ ID NO: 907729 - RNA, 24 nt, Human
caggguuucaccacguuggccagg

SEQ ID NO: 907730 - RNA, 22 nt, Human
cagguuucaaaaacaugccgcc

SEQ ID NO: 907731 - RNA, 23 nt, Human
caucuaaaaccuaaauaaccacc

SEQ ID NO: 907732 - RNA, 24 nt, Human
ccaaaaccaagaaaacaaaaaccc

SEQ ID NO: 907733 - RNA, 27 nt, Human
ccaaaaccaagaaaacaaaaacccccu

SEQ ID NO: 907734 - RNA, 20 nt, Human
ccaaaaugcugggauuacag

SEQ ID NO: 907735 - RNA, 22 nt, Human
ccaaaaugcugggauuacaggc

SEQ ID NO: 907736 - RNA, 22 nt, Human
ccaaaaugcugggauuacaggc

SEQ ID NO: 907737 - RNA, 24 nt, Human
ccaaaaugcugggauuacaggcgu

SEQ ID NO: 907738 - RNA, 21 nt, Human
ccaaagugcugggauuacagg

SEQ ID NO: 907739 - RNA, 21 nt, Human
ccaaagugcugggauuacagg

SEQ ID NO: 907740 - RNA, 24 nt, Human
ccaaagugcugggauuacaggugu

SEQ ID NO: 907741 - RNA, 23 nt, Human
ccaccgcgccuggccuucuucca

SEQ ID NO: 907742 - RNA, 24 nt, Human
cccaaaaccaagaaaacaaaaacc

SEQ ID NO: 907743 - RNA, 20 nt, Human
cccagguucacgccauucuc

SEQ ID NO: 907744 - RNA, 20 nt, Human
ccccaagccaagacaaaaac

SEQ ID NO: 907745 - RNA, 23 nt, Human
ccccaaguuaauauacagaaaaa

SEQ ID NO: 907746 - RNA, 19 nt, Human
ccccacccccaguaacuaa

SEQ ID NO: 907747 - RNA, 23 nt, Human
ccccaguaacuaaaauggcuacu

SEQ ID NO: 907748 - RNA, 21 nt, Human
ccccccacccccaguaacuaa

SEQ ID NO: 907749 - RNA, 27 nt, Human
ccgacgguagcgauuauuuucaacauu

SEQ ID NO: 907750 - RNA, 23 nt, Human
ccucaggguugugcacguguucu

SEQ ID NO: 907751 - RNA, 24 nt, Human
ccucccagguucacgccauucucc

SEQ ID NO: 907752 - RNA, 21 nt, Human
ccucccguugggauuacaggc

SEQ ID NO: 907753 - RNA, 19 nt, Human
ccuccgccucccagguuca

SEQ ID NO: 907754 - RNA, 24 nt, Human
ccuccuggguucaagcgauucucc

SEQ ID NO: 907755 - RNA, 25 nt, Human
ccucugaguuaauagagcaaaugug

SEQ ID NO: 907756 - RNA, 19 nt, Human
ccucugccuccuggguuca

SEQ ID NO: 907757 - RNA, 23 nt, Human
ccugaccucagguaauccaccca

SEQ ID NO: 907758 - RNA, 24 nt, Human
ccugaccucagguaauccacccau

SEQ ID NO: 907759 - RNA, 26 nt, Human
ccugaucucgugaucugcccgccuug

SEQ ID NO: 907760 - RNA, 19 nt, Human
ccugccucagccucccguu

SEQ ID NO: 907761 - RNA, 24 nt, Human
ccuggccuucuuccacauuuugug

SEQ ID NO: 907762 - RNA, 23 nt, Human
ccuggguagcuggaauuacaggc

SEQ ID NO: 907763 - RNA, 23 nt, Human
ccuggguucaagcgauucuccug

SEQ ID NO: 907764 - RNA, 26 nt, Human
ccuguuuggcuaagguuuuguguugu

SEQ ID NO: 907765 - RNA, 19 nt, Human
cgccucccagguucacgcc

SEQ ID NO: 907766 - RNA, 21 nt, Human
cuaaauauuaacgauaucccc

SEQ ID NO: 907767 - RNA, 23 nt, Human
cuaauuuuuguauuuuuaguaga

SEQ ID NO: 907768 - RNA, 23 nt, Human
cucacucuguugcccaggcugga

SEQ ID NO: 907769 - RNA, 24 nt, Human
cucacucuguugcccaggcuggag

SEQ ID NO: 907770 - RNA, 24 nt, Human
cucacugcaaccucugccuccugg

SEQ ID NO: 907771 - RNA, 24 nt, Human
cucagguaauccacccaucuuggc

SEQ ID NO: 907772 - RNA, 21 nt, Human
cucccguugggauuacaggca

SEQ ID NO: 907773 - RNA, 24 nt, Human
cuccugaucucgugaucugcccgc

SEQ ID NO: 907774 - RNA, 21 nt, Human
cuccuggguucaagcgauucu

SEQ ID NO: 907775 - RNA, 18 nt, Human
cucgugaucugcccgccu

SEQ ID NO: 907776 - RNA, 19 nt, Human
cugcaaccucugccuccug

SEQ ID NO: 907777 - RNA, 23 nt, Human
cugcaaccucugccuccuggguu

SEQ ID NO: 907778 - RNA, 24 nt, Human
cugcaaccucugccuccuggguuc

SEQ ID NO: 907779 - RNA, 23 nt, Human
cugcagccuccgccucccagguu

SEQ ID NO: 907780 - RNA, 23 nt, Human
cugccucagccuccuggguagcu

SEQ ID NO: 907781 - RNA, 19 nt, Human
cuucacauuucauuaucaa

SEQ ID NO: 907782 - RNA, 23 nt, Human
gaaagcacuucaucuguaagaaa

SEQ ID NO: 907783 - RNA, 21 nt, Human
gaaggagccuggaggagagcu

SEQ ID NO: 907784 - RNA, 24 nt, Human
gaccucagguaauccacccaucuu

SEQ ID NO: 907785 - RNA, 20 nt, Human
gagagcucuggcuucuaaug

SEQ ID NO: 907786 - RNA, 24 nt, Human
gagaugagguuucaccauguuggu

SEQ ID NO: 907787 - RNA, 22 nt, Human
gagguuucaccauguuggucag

SEQ ID NO: 907788 - RNA, 19 nt, Human
gauaauaaggaaauaagga

SEQ ID NO: 907789 - RNA, 22 nt, Human
gauuacaggcgugaaccaaugc

SEQ ID NO: 907790 - RNA, 23 nt, Human
gauuacaggcgugaaccaaugca

SEQ ID NO: 907791 - RNA, 18 nt, Human
gauuacaggugugagcca

SEQ ID NO: 907792 - RNA, 20 nt, Human
gauuacaggugugagccacc

SEQ ID NO: 907793 - RNA, 22 nt, Human
gauuacaggugugagccaccgc

SEQ ID NO: 907794 - RNA, 21 nt, Human
gauucuccugccucagccucc

SEQ ID NO: 907795 - RNA, 21 nt, Human
gcagauuaaaaggaaaaaagc

SEQ ID NO: 907796 - RNA, 22 nt, Human
gcagccuccgccucccagguuc

SEQ ID NO: 907797 - RNA, 24 nt, Human
gcccaggcuggaguagaguggcgu

SEQ ID NO: 907798 - RNA, 22 nt, Human
gccgacgguagcgauuauuuuc

SEQ ID NO: 907799 - RNA, 23 nt, Human
gccucccguugggauuacaggca

SEQ ID NO: 907800 - RNA, 20 nt, Human
gccuggaggagagcucuggc

SEQ ID NO: 907801 - RNA, 24 nt, Human
gcgauucuccugccucagccuccc

SEQ ID NO: 907802 - RNA, 23 nt, Human
gcuggucucgaacuccugaccuc

SEQ ID NO: 907803 - RNA, 19 nt, Human
ggcacccaccaccucaccc

SEQ ID NO: 907804 - RNA, 20 nt, Human
ggcuggaguagaguggcgug

SEQ ID NO: 907805 - RNA, 24 nt, Human
ggcuggucucgaacuccugaccuc

SEQ ID NO: 907806 - RNA, 24 nt, Human
ggcuggucucgaacuccugaucuc

SEQ ID NO: 907807 - RNA, 18 nt, Human
ggcuuaagauauucaggc

SEQ ID NO: 907808 - RNA, 24 nt, Human
ggguagcuggaauuacaggcacgc

SEQ ID NO: 907809 - RNA, 27 nt, Human
gggugguuuguuaggaaagucgggucc

SEQ ID NO: 907810 - RNA, 19 nt, Human
ggucucgaacuccugaccu

SEQ ID NO: 907811 - RNA, 19 nt, Human
guaagaaacagcuuuugca

SEQ ID NO: 907812 - RNA, 24 nt, Human
guaauccacccaucuuggccuccc

SEQ ID NO: 907813 - RNA, 18 nt, Human
guauuugauaaagucaac

SEQ ID NO: 907814 - RNA, 21 nt, Human
gucugccauccuaugcugccu

SEQ ID NO: 907815 - RNA, 22 nt, Human
gugaaaaauuuuuuuagaggcu

SEQ ID NO: 907816 - RNA, 28 nt, Human
uaaaaaaacccaaaaccaagaaaacaaa

SEQ ID NO: 907817 - RNA, 28 nt, Human
uaaaaaaacccaaaaccaagaaaacaaa

SEQ ID NO: 907818 - RNA, 24 nt, Human
uaaaaagauaaaacuccaagucua

SEQ ID NO: 907819 - RNA, 21 nt, Human
uaaaauaaauacacaggcuuu

SEQ ID NO: 907820 - RNA, 18 nt, Human
uaaaauggcuacugaucc

SEQ ID NO: 907821 - RNA, 21 nt, Human
uaaaucaccuccaugcauacc

SEQ ID NO: 907822 - RNA, 18 nt, Human
uaaauuucuuucuguuau

SEQ ID NO: 907823 - RNA, 21 nt, Human
uaacucacagaugucuaacuc

SEQ ID NO: 907824 - RNA, 23 nt, Human
uaagaaacagcuuuugcagaaag

SEQ ID NO: 907825 - RNA, 22 nt, Human
uaagaaagacagggucaccaaa

SEQ ID NO: 907826 - RNA, 19 nt, Human
uaaggaauacuaaaacaua

SEQ ID NO: 907827 - RNA, 24 nt, Human
uaauccacccaucuuggccuccca

SEQ ID NO: 907828 - RNA, 22 nt, Human
uaauucaaggaugucuagaaac

SEQ ID NO: 907829 - RNA, 24 nt, Human
uaauuuuuguauuuuuaguagaga

SEQ ID NO: 907830 - RNA, 24 nt, Human
uaauuuuuuguauuuuuaguagag

SEQ ID NO: 907831 - RNA, 25 nt, Human
uaauuuuuuguauuuuuaguagaga

SEQ ID NO: 907832 - RNA, 23 nt, Human
uacagaaaaacaugauucuaaaa

SEQ ID NO: 907833 - RNA, 24 nt, Human
uacaggcacgcgccaccacaccca

SEQ ID NO: 907834 - RNA, 22 nt, Human
uacaggugugagccaccgcgcc

SEQ ID NO: 907835 - RNA, 23 nt, Human
uacaggugugagccaccgcgccu

SEQ ID NO: 907836 - RNA, 18 nt, Human
uacucucuuacccauguu

SEQ ID NO: 907837 - RNA, 23 nt, Human
uacugauccacaacucuuuaugc

SEQ ID NO: 907838 - RNA, 20 nt, Human
uacuuuauucauuuauuuuu

SEQ ID NO: 907839 - RNA, 22 nt, Human
uagagacaggguuucaccacgu

SEQ ID NO: 907840 - RNA, 22 nt, Human
uagagaugagguuucaccaugu

SEQ ID NO: 907841 - RNA, 22 nt, Human
uagaucaaaauauccuuaaacg

SEQ ID NO: 907842 - RNA, 19 nt, Human
uagcagaaauauacagucu

SEQ ID NO: 907843 - RNA, 19 nt, Human
uaguagagacaggguuuca

SEQ ID NO: 907844 - RNA, 26 nt, Human
uaguagagacaggguuucaccacguu

SEQ ID NO: 907845 - RNA, 24 nt, Human
uaguagagaugagguuucaccaug

SEQ ID NO: 907846 - RNA, 26 nt, Human
uaguagagaugagguuucaccauguu

SEQ ID NO: 907847 - RNA, 20 nt, Human
uauaaaaaaacccaaaacca

SEQ ID NO: 907848 - RNA, 22 nt, Human
uauaaaaaaacccaaaaccaag

SEQ ID NO: 907849 - RNA, 25 nt, Human
uauaaaaaaacccaaaaccaagaaa

SEQ ID NO: 907850 - RNA, 21 nt, Human
uauaaagcagguuucaaaaac

SEQ ID NO: 907851 - RNA, 19 nt, Human
uauacagaaaaacaugauu

SEQ ID NO: 907852 - RNA, 22 nt, Human
uauaggcauaaauugugaauuc

SEQ ID NO: 907853 - RNA, 20 nt, Human
uauaguuuccuucuuccugu

SEQ ID NO: 907854 - RNA, 22 nt, Human
uauauaaaaaaacccaaaacca

SEQ ID NO: 907855 - RNA, 19 nt, Human
ucaagcgauucuccugccu

SEQ ID NO: 907856 - RNA, 22 nt, Human
ucacccagcuaauuuuuuguau

SEQ ID NO: 907857 - RNA, 24 nt, Human
ucacucuguugcccaggcuggagu

SEQ ID NO: 907858 - RNA, 24 nt, Human
ucacugcaaccucugccuccuggg

SEQ ID NO: 907859 - RNA, 25 nt, Human
ucacugcaaccucugccuccugggu

SEQ ID NO: 907860 - RNA, 27 nt, Human
ucacugcaaccucugccuccuggguuc

SEQ ID NO: 907861 - RNA, 19 nt, Human
ucacugcagccuccgccuc

SEQ ID NO: 907862 - RNA, 24 nt, Human
ucacugcagccuccgccucccagg

SEQ ID NO: 907863 - RNA, 25 nt, Human
ucacugcagccuccgccucccaggu

SEQ ID NO: 907864 - RNA, 19 nt, Human
ucagcacaauugaaaaagu

SEQ ID NO: 907865 - RNA, 22 nt, Human
ucagccuccuggguagcuggaa

SEQ ID NO: 907866 - RNA, 18 nt, Human
ucaggguugugcacgugu

SEQ ID NO: 907867 - RNA, 21 nt, Human
ucauuuauuuucuggaauagg

SEQ ID NO: 907868 - RNA, 21 nt, Human
uccacccaucuuggccuccca

SEQ ID NO: 907869 - RNA, 18 nt, Human
uccagaccuuaagggaaa

SEQ ID NO: 907870 - RNA, 24 nt, Human
uccaugcauaccuuaaugcuuucu

SEQ ID NO: 907871 - RNA, 24 nt, Human
ucccaaaaugcugggauuacaggc

SEQ ID NO: 907872 - RNA, 23 nt, Human
ucccaaagugcugggauuacagg

SEQ ID NO: 907873 - RNA, 20 nt, Human
ucccagguucacgccauucu

SEQ ID NO: 907874 - RNA, 21 nt, Human
ucccagguucacgccauucuc

SEQ ID NO: 907875 - RNA, 24 nt, Human
ucccagguucacgccauucuccug

SEQ ID NO: 907876 - RNA, 23 nt, Human
uccccaaagaagucucauccaga

SEQ ID NO: 907877 - RNA, 24 nt, Human
uccccccacccccaguaacuaaaa

SEQ ID NO: 907878 - RNA, 18 nt, Human
ucccguugggauuacagg

SEQ ID NO: 907879 - RNA, 27 nt, Human
uccuaaauauuaacgauaucccccaag

SEQ ID NO: 907880 - RNA, 24 nt, Human
uccuggguagcuggaauuacaggc

SEQ ID NO: 907881 - RNA, 21 nt, Human
uccuggguucaagcgauucuc

SEQ ID NO: 907882 - RNA, 24 nt, Human
uccuggguucaagcgauucuccug

SEQ ID NO: 907883 - RNA, 20 nt, Human
uccuuuguuccuucccccca

SEQ ID NO: 907884 - RNA, 22 nt, Human
ucgcucuuguugcccaggcugg

SEQ ID NO: 907885 - RNA, 23 nt, Human
ucgcucuuguugcccaggcugga

SEQ ID NO: 907886 - RNA, 20 nt, Human
ucuaaaauaaauacacaggc

SEQ ID NO: 907887 - RNA, 19 nt, Human
ucuccugccucagccuccc

SEQ ID NO: 907888 - RNA, 24 nt, Human
ucuccugccucagccuccugggua

SEQ ID NO: 907889 - RNA, 23 nt, Human
ucucgaacuccugaccucaggua

SEQ ID NO: 907890 - RNA, 19 nt, Human
ucucgaacuccugaucucg

SEQ ID NO: 907891 - RNA, 21 nt, Human
ucuggcuucuaaugacccacg

SEQ ID NO: 907892 - RNA, 18 nt, Human
ucuguugcccaggcugga

SEQ ID NO: 907893 - RNA, 22 nt, Human
ucuguugcccaggcuggaguag

SEQ ID NO: 907894 - RNA, 23 nt, Human
ucuuccacauuuauuuauuuauu

SEQ ID NO: 907895 - RNA, 23 nt, Human
ucuuccacauuuauuuauuuauu

SEQ ID NO: 907896 - RNA, 20 nt, Human
ucuuggccucccaaagugcu

SEQ ID NO: 907897 - RNA, 22 nt, Human
ucuuguugcccaggcuggacug

SEQ ID NO: 907898 - RNA, 21 nt, Human
ugaaaaauuuuuuuagaggcu

SEQ ID NO: 907899 - RNA, 18 nt, Human
ugaaacaaacacaaguau

SEQ ID NO: 907900 - RNA, 24 nt, Human
ugaaauaaauaaauaauuuaacca

SEQ ID NO: 907901 - RNA, 18 nt, Human
ugaaggcaaucaaucuac

SEQ ID NO: 907902 - RNA, 21 nt, Human
ugaccucagguaauccaccca

SEQ ID NO: 907903 - RNA, 19 nt, Human
ugagacagagacucacucu

SEQ ID NO: 907904 - RNA, 24 nt, Human
ugagacagagacucacucuguugc

SEQ ID NO: 907905 - RNA, 23 nt, Human
ugagacagaguuucgcucuuguu

SEQ ID NO: 907906 - RNA, 24 nt, Human
ugagguuucaccauguuggucagg

SEQ ID NO: 907907 - RNA, 19 nt, Human
ugcaaaaaucacugacacc

SEQ ID NO: 907908 - RNA, 23 nt, Human
ugcagccuccgccucccagguuc

SEQ ID NO: 907909 - RNA, 21 nt, Human
ugcccaggcuggaguagagug

SEQ ID NO: 907910 - RNA, 21 nt, Human
ugcccaggcuggaguagagug

SEQ ID NO: 907911 - RNA, 24 nt, Human
ugcccaggcuggaguagaguggcg

SEQ ID NO: 907912 - RNA, 22 nt, Human
ugcccgccuuggccucccaaaa

SEQ ID NO: 907913 - RNA, 19 nt, Human
ugccucagccucccguugg

SEQ ID NO: 907914 - RNA, 23 nt, Human
ugccucagccuccuggguagcug

SEQ ID NO: 907915 - RNA, 24 nt, Human
ugccucagccuccuggguagcugg

SEQ ID NO: 907916 - RNA, 23 nt, Human
ugcugggauuacaggcgugaacc

SEQ ID NO: 907917 - RNA, 24 nt, Human
ugcugggauuacaggugugagcca

SEQ ID NO: 907918 - RNA, 21 nt, Human
uggaauuacaggcacgcgcca

SEQ ID NO: 907919 - RNA, 22 nt, Human
uggaauuacaggcacgcgccac

SEQ ID NO: 907920 - RNA, 24 nt, Human
uggaauuacaggcacgcgccacca

SEQ ID NO: 907921 - RNA, 24 nt, Human
uggacugcaauagcacgaucucgg

SEQ ID NO: 907922 - RNA, 24 nt, Human
uggccaggcuggucucgaacuccu

SEQ ID NO: 907923 - RNA, 24 nt, Human
uggcguggucucagcucacugcag

SEQ ID NO: 907924 - RNA, 21 nt, Human
uggcuuaagauauucaggcac

SEQ ID NO: 907925 - RNA, 19 nt, Human
ugggauuacaggcacccac

SEQ ID NO: 907926 - RNA, 21 nt, Human
ugggauuacaggcacccacca

SEQ ID NO: 907927 - RNA, 19 nt, Human
ugggauuacaggcgugaac

SEQ ID NO: 907928 - RNA, 21 nt, Human
ugggauuacaggcgugaacca

SEQ ID NO: 907929 - RNA, 21 nt, Human
ugggauuacaggcgugaacca

SEQ ID NO: 907930 - RNA, 21 nt, Human
ugggauuacaggcgugaacca

SEQ ID NO: 907931 - RNA, 24 nt, Human
ugggauuacaggcgugaaccaaug

SEQ ID NO: 907932 - RNA, 24 nt, Human
ugggauuacaggcgugaaccaaug

SEQ ID NO: 907933 - RNA, 18 nt, Human
ugggauuacaggugugag

SEQ ID NO: 907934 - RNA, 19 nt, Human
ugggauuacaggugugagc

SEQ ID NO: 907935 - RNA, 21 nt, Human
ugggauuacaggugugagcca

SEQ ID NO: 907936 - RNA, 22 nt, Human
ugggauuacaggugugagccac

SEQ ID NO: 907937 - RNA, 23 nt, Human
ugggauuacaggugugagccacc

SEQ ID NO: 907938 - RNA, 24 nt, Human
ugggauuacaggugugagccaccg

SEQ ID NO: 907939 - RNA, 23 nt, Human
uggguucaagcgauucuccugcc

SEQ ID NO: 907940 - RNA, 24 nt, Human
uggucaggcuggucucgaacuccu

SEQ ID NO: 907941 - RNA, 25 nt, Human
uguaaauuucuuucuguuauaguuu

SEQ ID NO: 907942 - RNA, 24 nt, Human
uguagggucauauaagaaagacag

SEQ ID NO: 907943 - RNA, 27 nt, Human
ugucuagaaacaaaauaaucugauugc

SEQ ID NO: 907944 - RNA, 30 nt, Human
uguguguguuuuuuuucauuuuguucuuuu

SEQ ID NO: 907945 - RNA, 20 nt, Human
uguugcccaggcuggacugc

SEQ ID NO: 907946 - RNA, 22 nt, Human
uguuguugcucuuuuucuaagu

SEQ ID NO: 907947 - RNA, 18 nt, Human
uuaguagagacaggguuu

SEQ ID NO: 907948 - RNA, 18 nt, Human
uuaguagagaugagguuu

SEQ ID NO: 907949 - RNA, 22 nt, Human
uuaguagagaugagguuucacc

SEQ ID NO: 907950 - RNA, 24 nt, Human
uuaguagagaugagguuucaccau

SEQ ID NO: 907951 - RNA, 20 nt, Human
uuauuuauuuauuuauuuuu

SEQ ID NO: 907952 - RNA, 24 nt, Human
uucaagacgaacuucaauguuuuu

SEQ ID NO: 907953 - RNA, 21 nt, Human
uucaagcgauucuccugccuc

SEQ ID NO: 907954 - RNA, 23 nt, Human
uucaagcgauucuccugccucag

SEQ ID NO: 907955 - RNA, 24 nt, Human
uucaagcgauucuccugccucagc

SEQ ID NO: 907956 - RNA, 20 nt, Human
uuccccccacccccaguaac

SEQ ID NO: 907957 - RNA, 24 nt, Human
uucgcucuuguugcccaggcugga

SEQ ID NO: 907958 - RNA, 24 nt, Human
uugaaaguguaaauuucuuucugu

SEQ ID NO: 907959 - RNA, 25 nt, Human
uugagacagagacucacucuguugc

SEQ ID NO: 907960 - RNA, 18 nt, Human
uugcccaggcuggacugc

SEQ ID NO: 907961 - RNA, 21 nt, Human
uugcccaggcuggaguagagu

SEQ ID NO: 907962 - RNA, 18 nt, Human
uuggccucccaaaaugcu

SEQ ID NO: 907963 - RNA, 19 nt, Human
uugggaucuguaauggucu

SEQ ID NO: 907964 - RNA, 22 nt, Human
uugggaucuguaauggucuuuc

SEQ ID NO: 907965 - RNA, 23 nt, Human
uuguugcccaggcuggacugcaa

SEQ ID NO: 907966 - RNA, 20 nt, Human
uuuauuuuuugagacagagu

SEQ ID NO: 907967 - RNA, 21 nt, Human
uuucaccacguuggccaggcu

SEQ ID NO: 907968 - RNA, 24 nt, Human
uuucaccauguuggucaggcuggu

SEQ ID NO: 907969 - RNA, 24 nt, Human
uuucgcucuuguugcccaggcugg

SEQ ID NO: 907970 - RNA, 20 nt, Human
uuuguuuuuuugagacagag

SEQ ID NO: 907971 - RNA, 24 nt, Human
uuuuuaguagagacaggguuucac

SEQ ID NO: 907972 - RNA, 24 nt, Human
uuuuuaguagagaugagguuucac

SEQ ID NO: 907973 - RNA, 20 nt, Human
uuuuuguauuuuuaguagag

SEQ ID NO: 907974 - RNA, 21 nt, Human
uuuuuguauuuuuaguagaga

SEQ ID NO: 907975 - RNA, 23 nt, Human
aaaaagcuuacuuuagcacucau

SEQ ID NO: 907976 - RNA, 23 nt, Human
aauaccagauugaaugacuaccu

SEQ ID NO: 907977 - RNA, 21 nt, Human
acaaaccccacacaucuguac

SEQ ID NO: 907978 - RNA, 24 nt, Human
acacaacacacacccagucauaaa

SEQ ID NO: 907979 - RNA, 19 nt, Human
accagauugaaugacuacc

SEQ ID NO: 907980 - RNA, 21 nt, Human
auacacacaacacacacccag

SEQ ID NO: 907981 - RNA, 21 nt, Human
caaccaagauauauaauaacu

SEQ ID NO: 907982 - RNA, 24 nt, Human
caaguuaaauauaaacauaaagca

SEQ ID NO: 907983 - RNA, 26 nt, Human
cacugaaacuucaaauauaucuuaca

SEQ ID NO: 907984 - RNA, 24 nt, Human
cagaaauucucucuaaaaacauua

SEQ ID NO: 907985 - RNA, 19 nt, Human
ccacacaucuguacaauaa

SEQ ID NO: 907986 - RNA, 25 nt, Human
ccuaaacacuggaaaagaaaaaaaa

SEQ ID NO: 907987 - RNA, 22 nt, Human
ccuauuggcaaagggcccuaaa

SEQ ID NO: 907988 - RNA, 20 nt, Human
cugguacaauacaacaaccu

SEQ ID NO: 907989 - RNA, 20 nt, Human
cuucaaauauaucuuacaca

SEQ ID NO: 907990 - RNA, 21 nt, Human
gaaagucugugcucauaaaaa

SEQ ID NO: 907991 - RNA, 20 nt, Human
gccggaggacaggggccgcg

SEQ ID NO: 907992 - RNA, 20 nt, Human
gccuagacauuccaguaaga

SEQ ID NO: 907993 - RNA, 20 nt, Human
guuuguacaaaaauacaagu

SEQ ID NO: 907994 - RNA, 29 nt, Human
uacauacacacaacacacacccagucaua

SEQ ID NO: 907995 - RNA, 19 nt, Human
uauaauaacuguacagugc

SEQ ID NO: 907996 - RNA, 23 nt, Human
uaugcaaaucuguuuuaugugau

SEQ ID NO: 907997 - RNA, 24 nt, Human
uauguauuacauacacacaacaca

SEQ ID NO: 907998 - RNA, 26 nt, Human
uauguccauaaaccaaccacccaagg

SEQ ID NO: 907999 - RNA, 24 nt, Human
uauuacauacacacaacacacacc

SEQ ID NO: 908000 - RNA, 19 nt, Human
ucgggccggaggacagggg

SEQ ID NO: 908001 - RNA, 19 nt, Human
ucuuguuuguacaaaaaua

SEQ ID NO: 908002 - RNA, 18 nt, Human
ugaaaaguuggaaagacu

SEQ ID NO: 908003 - RNA, 21 nt, Human
ugaaaaguuggaaagacuguu

SEQ ID NO: 908004 - RNA, 18 nt, Human
ugaaagggcaguaugucc

SEQ ID NO: 908005 - RNA, 19 nt, Human
ugaaugacuaccuauuggc

SEQ ID NO: 908006 - RNA, 20 nt, Human
ugguacaauacaacaaccaa

SEQ ID NO: 908007 - RNA, 23 nt, Human
ugguacaauacaacaaccaagau

SEQ ID NO: 908008 - RNA, 22 nt, Human
uguaaguauuuuacauuuaugu

SEQ ID NO: 908009 - RNA, 22 nt, Human
uguaauguaucauaaaacacaa

SEQ ID NO: 908010 - RNA, 24 nt, Human
uguauuacauacacacaacacaca

SEQ ID NO: 908011 - RNA, 19 nt, Human
ugugaaaagaucaauacca

SEQ ID NO: 908012 - RNA, 23 nt, Human
uuacauacacacaacacacaccc

SEQ ID NO: 908013 - RNA, 21 nt, Human
uuugagaucaccuaaacacug

SEQ ID NO: 908014 - RNA, 23 nt, Human
uuuuacauuuauguauauauucu

SEQ ID NO: 908015 - RNA, 22 nt, Human
caaaaaaacgaacugaaguggg

SEQ ID NO: 908016 - RNA, 23 nt, Human
cacgggccuggcugaggagcagg

SEQ ID NO: 908017 - RNA, 24 nt, Human
cagcagacacaugagccggcgcca

SEQ ID NO: 908018 - RNA, 21 nt, Human
cgauacauggcagcucacgca

SEQ ID NO: 908019 - RNA, 19 nt, Human
cgccacgggccuggcugag

SEQ ID NO: 908020 - RNA, 19 nt, Human
cgggccuggcugaggagca

SEQ ID NO: 908021 - RNA, 22 nt, Human
cuggcgauacauggcagcucac

SEQ ID NO: 908022 - RNA, 19 nt, Human
gcucaugggcaccaccacc

SEQ ID NO: 908023 - RNA, 21 nt, Human
ggcacguucaguaacaaagca

SEQ ID NO: 908024 - RNA, 22 nt, Human
uaccauaaaauuacugucaaaa

SEQ ID NO: 908025 - RNA, 21 nt, Human
uagaacagacaauucaauuca

SEQ ID NO: 908026 - RNA, 19 nt, Human
ucugugcccaguccuagaa

SEQ ID NO: 908027 - RNA, 19 nt, Human
uggcagcucacgcagcgcu

SEQ ID NO: 908028 - RNA, 19 nt, Human
uuuccugcuuaucccccaa

SEQ ID NO: 908029 - RNA, 18 nt, Human
agggccucuucaaggggu

SEQ ID NO: 908030 - RNA, 20 nt, Human
cuucaagggguccagaagag

SEQ ID NO: 908031 - RNA, 21 nt, Human
gguccagaagagugggggccc

SEQ ID NO: 908032 - RNA, 18 nt, Human
ucuccagggagacaggug

SEQ ID NO: 908033 - RNA, 22 nt, Human
uuuuuuuuuuugcagggcagcg

SEQ ID NO: 908034 - RNA, 19 nt, Human
uuuuuuuuuuuugcagggc

SEQ ID NO: 908035 - RNA, 21 nt, Human
uuuuuuuuuuuuuuuuugcag

SEQ ID NO: 908036 - RNA, 23 nt, Human
uuuuuuuuuuuuuuuuugcaggg

SEQ ID NO: 908037 - RNA, 27 nt, Human
aaagaaaaaaauauaauaaaugucuua

SEQ ID NO: 908038 - RNA, 18 nt, Human
aacucuucuccuucucuu

SEQ ID NO: 908039 - RNA, 23 nt, Human
aaguguagaaauuuauuugaacc

SEQ ID NO: 908040 - RNA, 24 nt, Human
aaguguagaaauuuauuugaacca

SEQ ID NO: 908041 - RNA, 22 nt, Human
accaaucaccacgaagucucaa

SEQ ID NO: 908042 - RNA, 25 nt, Human
acuguaacacagagaugucacucug

SEQ ID NO: 908043 - RNA, 23 nt, Human
agguuaucccaaaaaaagggaaa

SEQ ID NO: 908044 - RNA, 23 nt, Human
aguaacuaacgagaaucucuuga

SEQ ID NO: 908045 - RNA, 25 nt, Human
auagcaacagacguggcagcacguc

SEQ ID NO: 908046 - RNA, 23 nt, Human
aucccaaaaaaagggaaaaacuc

SEQ ID NO: 908047 - RNA, 18 nt, Human
caaacaugcaaauggcaa

SEQ ID NO: 908048 - RNA, 18 nt, Human
cagcaagguaauauggua

SEQ ID NO: 908049 - RNA, 21 nt, Human
caggacuuauuauuaagaugg

SEQ ID NO: 908050 - RNA, 23 nt, Human
caucuucaccacaagagagaaaa

SEQ ID NO: 908051 - RNA, 22 nt, Human
ccaaaaaaagggaaaaacucca

SEQ ID NO: 908052 - RNA, 25 nt, Human
ccaaaaaaagggaaaaacuccaaaa

SEQ ID NO: 908053 - RNA, 24 nt, Human
ccaacagcaagguaauaugguauu

SEQ ID NO: 908054 - RNA, 25 nt, Human
ccaaucaccacgaagucucaaacgc

SEQ ID NO: 908055 - RNA, 20 nt, Human
cccagcauucgccgaucaua

SEQ ID NO: 908056 - RNA, 20 nt, Human
ccugcauaauucccuguagc

SEQ ID NO: 908057 - RNA, 22 nt, Human
cucauaaguaguuccauaauga

SEQ ID NO: 908058 - RNA, 22 nt, Human
cuccuucucuccuucccgcaga

SEQ ID NO: 908059 - RNA, 19 nt, Human
cucuccggccuugcucugg

SEQ ID NO: 908060 - RNA, 18 nt, Human
cugaccaaucaccacgaa

SEQ ID NO: 908061 - RNA, 26 nt, Human
cugaccaaucaccacgaagucucaaa

SEQ ID NO: 908062 - RNA, 18 nt, Human
gacguggcagcacgucga

SEQ ID NO: 908063 - RNA, 27 nt, Human
uaaaacgggcaaccauuccaguagucc

SEQ ID NO: 908064 - RNA, 21 nt, Human
uaacaguuccaucuucaccac

SEQ ID NO: 908065 - RNA, 21 nt, Human
uagaaagcaacaaacaugcaa

SEQ ID NO: 908066 - RNA, 18 nt, Human
uagguuaucccaaaaaaa

SEQ ID NO: 908067 - RNA, 18 nt, Human
ucagaacaacccaacagc

SEQ ID NO: 908068 - RNA, 24 nt, Human
ucagaacauuuaagugcuugccaa

SEQ ID NO: 908069 - RNA, 20 nt, Human
uccaucuucaccacaagaga

SEQ ID NO: 908070 - RNA, 19 nt, Human
ucccucgaccugcauaauu

SEQ ID NO: 908071 - RNA, 21 nt, Human
ucccuguagcucuugugccca

SEQ ID NO: 908072 - RNA, 21 nt, Human
ucuccuucucuccuucccgca

SEQ ID NO: 908073 - RNA, 25 nt, Human
ucugaccaaucaccacgaagucuca

SEQ ID NO: 908074 - RNA, 20 nt, Human
ugaccaucuucacuguaacc

SEQ ID NO: 908075 - RNA, 18 nt, Human
ugagcugucagaacaacc

SEQ ID NO: 908076 - RNA, 20 nt, Human
ugcaaauggcaaguguagaa

SEQ ID NO: 908077 - RNA, 22 nt, Human
uggcagcacgucgacaguuaau

SEQ ID NO: 908078 - RNA, 21 nt, Human
ugggaaggaauaaaacgggca

SEQ ID NO: 908079 - RNA, 22 nt, Human
ugggaaggaauaaaacgggcaa

SEQ ID NO: 908080 - RNA, 18 nt, Human
ugucgcaacucuucuccu

SEQ ID NO: 908081 - RNA, 19 nt, Human
uuagggaaaauauugcacu

SEQ ID NO: 908082 - RNA, 19 nt, Human
uucaugcacacaaucauuc

SEQ ID NO: 908083 - RNA, 20 nt, Human
uucaugcacacaaucauucc

SEQ ID NO: 908084 - RNA, 25 nt, Human
uugaucuuaaaacaaccaguuucuu

SEQ ID NO: 908085 - RNA, 26 nt, Human
uugaucuuaaaacaaccaguuucuuu

SEQ ID NO: 908086 - RNA, 21 nt, Human
uugucgcaacucuucuccuuc

SEQ ID NO: 908087 - RNA, 21 nt, Human
uuugaugcguguaucaaacca

SEQ ID NO: 908088 - RNA, 22 nt, Human
uuuuuuuuuuuuuugaucuuaa

SEQ ID NO: 908089 - RNA, 18 nt, Human
uuuuuuuuuuuuuuuuug

SEQ ID NO: 908090 - RNA, 18 nt, Human
aaaaaccauugggggugg

SEQ ID NO: 908091 - RNA, 18 nt, Human
aaagaaaagaauaaagag

SEQ ID NO: 908092 - RNA, 23 nt, Human
aauauuuuuaauaaugcacauua

SEQ ID NO: 908093 - RNA, 19 nt, Human
acacuauggguaaacaaac

SEQ ID NO: 908094 - RNA, 22 nt, Human
acagaacacuauggguaaacaa

SEQ ID NO: 908095 - RNA, 23 nt, Human
acuaagcaauaacuacacagaac

SEQ ID NO: 908096 - RNA, 25 nt, Human
agaaaacaaaagcuaauguaaaaag

SEQ ID NO: 908097 - RNA, 18 nt, Human
aucaaaaaaggccacaac

SEQ ID NO: 908098 - RNA, 22 nt, Human
caaaaaaggccacaacaguuaa

SEQ ID NO: 908099 - RNA, 21 nt, Human
caauccaaacauacaauagcu

SEQ ID NO: 908100 - RNA, 22 nt, Human
cacaaaccaaaaguuuauaaac

SEQ ID NO: 908101 - RNA, 22 nt, Human
cagaacacuauggguaaacaaa

SEQ ID NO: 908102 - RNA, 21 nt, Human
ccucuuggucguucgcucgcg

SEQ ID NO: 908103 - RNA, 20 nt, Human
cuagcagucgaacacccucu

SEQ ID NO: 908104 - RNA, 20 nt, Human
gaaaaaccauugggggugga

SEQ ID NO: 908105 - RNA, 22 nt, Human
gaagagaaaagaucaaauauga

SEQ ID NO: 908106 - RNA, 19 nt, Human
gcacauuaaaaaaaaguau

SEQ ID NO: 908107 - RNA, 20 nt, Human
gccuagacauuugauuggaa

SEQ ID NO: 908108 - RNA, 25 nt, Human
gcucuagcagucgaacacccucuug

SEQ ID NO: 908109 - RNA, 25 nt, Human
uaaaaaaaaguauucaucuuacaaa

SEQ ID NO: 908110 - RNA, 22 nt, Human
uaccauaaucaaagaaaagaau

SEQ ID NO: 908111 - RNA, 24 nt, Human
uacuuuuggccuuaaacaguacca

SEQ ID NO: 908112 - RNA, 20 nt, Human
uagcagucgaacacccucuu

SEQ ID NO: 908113 - RNA, 22 nt, Human
uaucaaauuagaucugcuaaua

SEQ ID NO: 908114 - RNA, 18 nt, Human
uaugaucaaaaaaggccc

SEQ ID NO: 908115 - RNA, 18 nt, Human
ucaaacaagccuagacau

SEQ ID NO: 908116 - RNA, 20 nt, Human
ucccauggugaacauguuua

SEQ ID NO: 908117 - RNA, 19 nt, Human
ugaaguaaaaacugaacau

SEQ ID NO: 908118 - RNA, 20 nt, Human
ugaaguaaauaaaaagagug

SEQ ID NO: 908119 - RNA, 23 nt, Human
ugaaguucacaaaccaaaaguuu

SEQ ID NO: 908120 - RNA, 25 nt, Human
ugaaguucacaaaccaaaaguuuau

SEQ ID NO: 908121 - RNA, 22 nt, Human
ugaucaaaaaaggccacaacag

SEQ ID NO: 908122 - RNA, 23 nt, Human
uguaaaagcugaguugaaacuaa

SEQ ID NO: 908123 - RNA, 20 nt, Human
uuccaaauaagcauaccaua

SEQ ID NO: 908124 - RNA, 19 nt, Human
uucucauauaaguaucuua

SEQ ID NO: 908125 - RNA, 18 nt, Human
uugaaacuaaaagaucua

SEQ ID NO: 908126 - RNA, 23 nt, Human
uugaaacuaaaagaucuauaaaa

SEQ ID NO: 908127 - RNA, 23 nt, Human
uuggccuuaaacaguaccaacuc

SEQ ID NO: 908128 - RNA, 24 nt, Human
uuggccuuaaacaguaccaacucu

SEQ ID NO: 908129 - RNA, 19 nt, Human
uuugacaguuucacugacu

SEQ ID NO: 908130 - RNA, 23 nt, Human
uuuuuuuuuuuuuuuuaagcuuu

SEQ ID NO: 908131 - RNA, 25 nt, Human
uuuuuuuuuuuuuuuuuuuuuaagg

SEQ ID NO: 908132 - RNA, 20 nt, Human
auggugguggcggcggcggc

SEQ ID NO: 908133 - RNA, 21 nt, Human
caccccccuccccgcccccgc

SEQ ID NO: 908134 - RNA, 22 nt, Human
caccccccuccccgcccccgcc

SEQ ID NO: 908135 - RNA, 20 nt, Human
cagggucucccucgggcucu

SEQ ID NO: 908136 - RNA, 19 nt, Human
ccccacgcccucccgcccc

SEQ ID NO: 908137 - RNA, 26 nt, Human
ccccacgcccucccgcccccuucgcc

SEQ ID NO: 908138 - RNA, 25 nt, Human
cccccacgcccucccgcccccuucg

SEQ ID NO: 908139 - RNA, 21 nt, Human
cccccacggccucuuuuccgc

SEQ ID NO: 908140 - RNA, 21 nt, Human
cccccuagcgcgccgcucgcc

SEQ ID NO: 908141 - RNA, 21 nt, Human
ccccgcccccgcccucccccu

SEQ ID NO: 908142 - RNA, 19 nt, Human
ccccuucgcccaccccccu

SEQ ID NO: 908143 - RNA, 18 nt, Human
cccgcccucccccuagcg

SEQ ID NO: 908144 - RNA, 22 nt, Human
cccucccgcccccuucgcccac

SEQ ID NO: 908145 - RNA, 24 nt, Human
cccuucgcccaccccccuccccgc

SEQ ID NO: 908146 - RNA, 23 nt, Human
cccuugguucuccugcccgggac

SEQ ID NO: 908147 - RNA, 21 nt, Human
ccgcccccuucgcccaccccc

SEQ ID NO: 908148 - RNA, 19 nt, Human
ccgcugccgccgccgccac

SEQ ID NO: 908149 - RNA, 18 nt, Human
ccgcugccgcugccgccg

SEQ ID NO: 908150 - RNA, 21 nt, Human
ccgcugccgcugccgccgccg

SEQ ID NO: 908151 - RNA, 19 nt, Human
ccuccccccacgcccuccc

SEQ ID NO: 908152 - RNA, 20 nt, Human
ccuccccgcccccgcccucc

SEQ ID NO: 908153 - RNA, 26 nt, Human
ccucccgcccccuucgcccacccccc

SEQ ID NO: 908154 - RNA, 18 nt, Human
cgcccccuucgcccaccc

SEQ ID NO: 908155 - RNA, 18 nt, Human
cgcugggaggccccccac

SEQ ID NO: 908156 - RNA, 21 nt, Human
cggcggcagcggcggcagcug

SEQ ID NO: 908157 - RNA, 21 nt, Human
cgggccccgcgcgcugauggu

SEQ ID NO: 908158 - RNA, 19 nt, Human
cuccccgcccccgcccucc

SEQ ID NO: 908159 - RNA, 19 nt, Human
cucgcucuggccgggcccc

SEQ ID NO: 908160 - RNA, 27 nt, Human
cugauggugguggcggcggcggcagcg

SEQ ID NO: 908161 - RNA, 22 nt, Human
cugccagcgcugggaggccccc

SEQ ID NO: 908162 - RNA, 19 nt, Human
cugccgcugccgccgccgc

SEQ ID NO: 908163 - RNA, 23 nt, Human
cugcggacauguuccucgggacu

SEQ ID NO: 908164 - RNA, 21 nt, Human
cugcucccccaggagggaggg

SEQ ID NO: 908165 - RNA, 20 nt, Human
cugcuccgcgcccuggcugc

SEQ ID NO: 908166 - RNA, 18 nt, Human
cuucgcccaccccccucc

SEQ ID NO: 908167 - RNA, 21 nt, Human
cuucgcccaccccccuccccg

SEQ ID NO: 908168 - RNA, 21 nt, Human
gacccuccccccacgcccucc

SEQ ID NO: 908169 - RNA, 21 nt, Human
gagagcgagacccucccccca

SEQ ID NO: 908170 - RNA, 23 nt, Human
gaguuucuaagaagcagaggggg

SEQ ID NO: 908171 - RNA, 20 nt, Human
gauggugguggcggcggcgg

SEQ ID NO: 908172 - RNA, 18 nt, Human
gcuccgcgcccuggcugc

SEQ ID NO: 908173 - RNA, 24 nt, Human
gcugauggugguggcggcggcuuu

SEQ ID NO: 908174 - RNA, 18 nt, Human
gcugggaggccccccacg

SEQ ID NO: 908175 - RNA, 18 nt, Human
ggacuaggugugcgugcc

SEQ ID NO: 908176 - RNA, 21 nt, Human
ggacuaggugugcgugccggc

SEQ ID NO: 908177 - RNA, 19 nt, Human
ggaggccccccacggccuc

SEQ ID NO: 908178 - RNA, 19 nt, Human
ggcagcugcucccccagga

SEQ ID NO: 908179 - RNA, 20 nt, Human
ggccucuuuuccgcgucgac

SEQ ID NO: 908180 - RNA, 18 nt, Human
ggcggcagcggcggcagc

SEQ ID NO: 908181 - RNA, 23 nt, Human
ggcggcggcagcggcggcagcug

SEQ ID NO: 908182 - RNA, 20 nt, Human
guggcggcggcggcagcggc

SEQ ID NO: 908183 - RNA, 24 nt, Human
guggcggcggcggcagcggcggca

SEQ ID NO: 908184 - RNA, 20 nt, Human
gugguggcggcggcggcagc

SEQ ID NO: 908185 - RNA, 21 nt, Human
uccccgcccccgcccuccccc

SEQ ID NO: 908186 - RNA, 22 nt, Human
ucccgcccccuucgcccacccc

SEQ ID NO: 908187 - RNA, 21 nt, Human
ucccuugguucuccugcccga

SEQ ID NO: 908188 - RNA, 19 nt, Human
uccgcugccgcugccgccg

SEQ ID NO: 908189 - RNA, 18 nt, Human
ugauggugguggcggcgg

SEQ ID NO: 908190 - RNA, 23 nt, Human
ugcccgggacucugcuccgcgcc

SEQ ID NO: 908191 - RNA, 18 nt, Human
uggcggcggcggcagcgg

SEQ ID NO: 908192 - RNA, 21 nt, Human
uggcugcggacauguuccucg

SEQ ID NO: 908193 - RNA, 20 nt, Human
ugguagucgggagagcgagg

SEQ ID NO: 908194 - RNA, 20 nt, Human
ugguggcggcggcggcagcg

SEQ ID NO: 908195 - RNA, 18 nt, Human
uggugguggcggcggcgg

SEQ ID NO: 908196 - RNA, 18 nt, Human
uggugguggcggcggcgg

SEQ ID NO: 908197 - RNA, 23 nt, Human
uucgcccaccccccuccccgccc

SEQ ID NO: 908198 - RNA, 20 nt, Human
aaaccaggacaagauaagga

SEQ ID NO: 908199 - RNA, 22 nt, Human
aaaccgaggcggauccaagaga

SEQ ID NO: 908200 - RNA, 22 nt, Human
aagaaaggaaaccaggacaaga

SEQ ID NO: 908201 - RNA, 18 nt, Human
aaggcuccggugcccucc

SEQ ID NO: 908202 - RNA, 20 nt, Human
acaagaaaggaaaccaggac

SEQ ID NO: 908203 - RNA, 22 nt, Human
accugcacgugguggugguggg

SEQ ID NO: 908204 - RNA, 20 nt, Human
acgaagcccaugaaagggcc

SEQ ID NO: 908205 - RNA, 21 nt, Human
agaaaggaaaccaggacaaga

SEQ ID NO: 908206 - RNA, 21 nt, Human
agagggcaggugcgggggucc

SEQ ID NO: 908207 - RNA, 24 nt, Human
agagggcaggugcggggguccugg

SEQ ID NO: 908208 - RNA, 20 nt, Human
agagugaagagacggauggg

SEQ ID NO: 908209 - RNA, 20 nt, Human
agauggucacaagaaaggaa

SEQ ID NO: 908210 - RNA, 20 nt, Human
aggcgccuggaagguggggg

SEQ ID NO: 908211 - RNA, 21 nt, Human
aggcgggugguggggggacag

SEQ ID NO: 908212 - RNA, 18 nt, Human
aggugggggcuggcucac

SEQ ID NO: 908213 - RNA, 19 nt, Human
caacauagcaucccagagc

SEQ ID NO: 908214 - RNA, 22 nt, Human
caaguucccccauucucugcuc

SEQ ID NO: 908215 - RNA, 23 nt, Human
caaguucccccauucucugcucu

SEQ ID NO: 908216 - RNA, 23 nt, Human
cacaaccuccccuaugagguagg

SEQ ID NO: 908217 - RNA, 24 nt, Human
cacccuuaccucccgugcuagccu

SEQ ID NO: 908218 - RNA, 18 nt, Human
cagagcuccaccugcacg

SEQ ID NO: 908219 - RNA, 18 nt, Human
ccagggcgaaggcgccug

SEQ ID NO: 908220 - RNA, 23 nt, Human
ccauaccacccuuaccucccgug

SEQ ID NO: 908221 - RNA, 19 nt, Human
ccaugaaagggccugcgac

SEQ ID NO: 908222 - RNA, 18 nt, Human
ccccauucucugcucucc

SEQ ID NO: 908223 - RNA, 22 nt, Human
ccgcccccgccccaucccauac

SEQ ID NO: 908224 - RNA, 20 nt, Human
ccgcuccccagcccgccaaa

SEQ ID NO: 908225 - RNA, 21 nt, Human
ccucccgucccggcugggggc

SEQ ID NO: 908226 - RNA, 18 nt, Human
ccucccgugcuagccuac

SEQ ID NO: 908227 - RNA, 22 nt, Human
ccuccugccuugacccccaggu

SEQ ID NO: 908228 - RNA, 23 nt, Human
ccucggcccaccgcuugccgccc

SEQ ID NO: 908229 - RNA, 20 nt, Human
ccucggggucgcugcccucc

SEQ ID NO: 908230 - RNA, 21 nt, Human
ccugcgacagagugaagagac

SEQ ID NO: 908231 - RNA, 21 nt, Human
ccuggaaggugggggcuggcu

SEQ ID NO: 908232 - RNA, 22 nt, Human
cgccccaacauagcaucccagg

SEQ ID NO: 908233 - RNA, 20 nt, Human
cgcugcccucccgucccggc

SEQ ID NO: 908234 - RNA, 18 nt, Human
cggugcccuccccccacc

SEQ ID NO: 908235 - RNA, 22 nt, Human
cucaagacuucccaccacacuc

SEQ ID NO: 908236 - RNA, 19 nt, Human
cucccgucccggcuggggg

SEQ ID NO: 908237 - RNA, 19 nt, Human
cuccggugcccucccccca

SEQ ID NO: 908238 - RNA, 20 nt, Human
cuccuccgcucaagacuucc

SEQ ID NO: 908239 - RNA, 22 nt, Human
cuccugccuugacccccagguc

SEQ ID NO: 908240 - RNA, 21 nt, Human
cucugcucuccuauugcccua

SEQ ID NO: 908241 - RNA, 19 nt, Human
cuggguggggucugguugg

SEQ ID NO: 908242 - RNA, 18 nt, Human
cuggugccagagggcagg

SEQ ID NO: 908243 - RNA, 18 nt, Human
gacaggaaaccgaggcgg

SEQ ID NO: 908244 - RNA, 22 nt, Human
gagaagggcagauccccuccuc

SEQ ID NO: 908245 - RNA, 20 nt, Human
gagaugcucucugcauagga

SEQ ID NO: 908246 - RNA, 23 nt, Human
gagggcaggugcggggguccugg

SEQ ID NO: 908247 - RNA, 22 nt, Human
gcaggugcggggguccuggggc

SEQ ID NO: 908248 - RNA, 20 nt, Human
ggacaggaaaccgaggcgga

SEQ ID NO: 908249 - RNA, 18 nt, Human
ggggaaaccgaggcccag

SEQ ID NO: 908250 - RNA, 20 nt, Human
ggggaggggcaggugggccu

SEQ ID NO: 908251 - RNA, 21 nt, Human
gggugacuugcccaaaguccu

SEQ ID NO: 908252 - RNA, 19 nt, Human
gguggaauuuguacagcac

SEQ ID NO: 908253 - RNA, 21 nt, Human
gugacuauuugcuuuacauua

SEQ ID NO: 908254 - RNA, 23 nt, Human
gugcggggguccuggggcgggug

SEQ ID NO: 908255 - RNA, 23 nt, Human
guucccccauucucugcucuccu

SEQ ID NO: 908256 - RNA, 21 nt, Human
uaagcaaagcuacaauauaga

SEQ ID NO: 908257 - RNA, 23 nt, Human
uagcauucuucacucuacaaaac

SEQ ID NO: 908258 - RNA, 24 nt, Human
uagggcacccacaaagauggcaga

SEQ ID NO: 908259 - RNA, 24 nt, Human
ucacaagaaaggaaaccaggacaa

SEQ ID NO: 908260 - RNA, 19 nt, Human
ucaccuacuauguaugaug

SEQ ID NO: 908261 - RNA, 19 nt, Human
ucacugggcggucuuccgc

SEQ ID NO: 908262 - RNA, 19 nt, Human
uccaagagaggaguggaga

SEQ ID NO: 908263 - RNA, 19 nt, Human
uccccagggcgaaggcgcc

SEQ ID NO: 908264 - RNA, 23 nt, Human
ucgcuaaugugccuggguggggu

SEQ ID NO: 908265 - RNA, 25 nt, Human
ucggaguccuccugccuugaccccc

SEQ ID NO: 908266 - RNA, 22 nt, Human
ucuggaggcucugugggggagg

SEQ ID NO: 908267 - RNA, 20 nt, Human
ugccccgcccacucgauaca

SEQ ID NO: 908268 - RNA, 25 nt, Human
ugccccgcccacucgauacaaguug

SEQ ID NO: 908269 - RNA, 25 nt, Human
ugccccgcccacucgauaccgacuc

SEQ ID NO: 908270 - RNA, 24 nt, Human
ugcccuagaccgcccccgccccau

SEQ ID NO: 908271 - RNA, 19 nt, Human
ugccuggguggggucuggu

SEQ ID NO: 908272 - RNA, 21 nt, Human
ugccuggguggggucugguug

SEQ ID NO: 908273 - RNA, 19 nt, Human
ugcggggguccuggggcgg

SEQ ID NO: 908274 - RNA, 22 nt, Human
uggcagacgaagcccaugaaag

SEQ ID NO: 908275 - RNA, 21 nt, Human
uggggaaaccgaggcccaggg

SEQ ID NO: 908276 - RNA, 24 nt, Human
uggggccgaccccauuuuaagcaa

SEQ ID NO: 908277 - RNA, 22 nt, Human
uggggggacaggaaaccgaggc

SEQ ID NO: 908278 - RNA, 24 nt, Human
uggugguggggcgcuggggaagcc

SEQ ID NO: 908279 - RNA, 19 nt, Human
ugguggugguggggcgcug

SEQ ID NO: 908280 - RNA, 22 nt, Human
ugguugggaagagaccccugcc

SEQ ID NO: 908281 - RNA, 19 nt, Human
uuaagcaaagcuacaauau

SEQ ID NO: 908282 - RNA, 23 nt, Human
uugccccgcccacucgauacaag

SEQ ID NO: 908283 - RNA, 23 nt, Human
uuuguacagcacuuucaugggga

SEQ ID NO: 908284 - RNA, 18 nt, Human
aaauaaaauaacacugag

SEQ ID NO: 908285 - RNA, 19 nt, Human
aacaguucuggacgguucu

SEQ ID NO: 908286 - RNA, 20 nt, Human
aaccacagcaggugauuuag

SEQ ID NO: 908287 - RNA, 21 nt, Human
aaggugcugagggugcuguga

SEQ ID NO: 908288 - RNA, 23 nt, Human
aaggugcugagggugcugugagg

SEQ ID NO: 908289 - RNA, 21 nt, Human
accccaagagccuucccagca

SEQ ID NO: 908290 - RNA, 21 nt, Human
acccuggaagacgcucagggg

SEQ ID NO: 908291 - RNA, 21 nt, Human
acucugaggagcacagagggg

SEQ ID NO: 908292 - RNA, 18 nt, Human
agacaacaauggcucuga

SEQ ID NO: 908293 - RNA, 18 nt, Human
agagcaucauaaccacag

SEQ ID NO: 908294 - RNA, 23 nt, Human
agagccuucccagcacgcggcau

SEQ ID NO: 908295 - RNA, 21 nt, Human
agauggggcccagaaggcguc

SEQ ID NO: 908296 - RNA, 18 nt, Human
agcaggcuccgcccucca

SEQ ID NO: 908297 - RNA, 20 nt, Human
agcugugugcgcgggugugu

SEQ ID NO: 908298 - RNA, 20 nt, Human
aggcagggaaggugggcugu

SEQ ID NO: 908299 - RNA, 21 nt, Human
aggugauuuacagaaggguug

SEQ ID NO: 908300 - RNA, 24 nt, Human
caauauuucuaaaauaauuaccac

SEQ ID NO: 908301 - RNA, 24 nt, Human
caccccccgauuccagcacacaac

SEQ ID NO: 908302 - RNA, 20 nt, Human
cacccuggaagacgcucagg

SEQ ID NO: 908303 - RNA, 22 nt, Human
cacugcaugccggugcaugggc

SEQ ID NO: 908304 - RNA, 23 nt, Human
cacugcaugccggugcaugggca

SEQ ID NO: 908305 - RNA, 23 nt, Human
cagagcaucauaaccacagcagg

SEQ ID NO: 908306 - RNA, 18 nt, Human
cagagccccaacauccuc

SEQ ID NO: 908307 - RNA, 19 nt, Human
cagagccccaacauccucc

SEQ ID NO: 908308 - RNA, 19 nt, Human
cagcaggcuccgcccucca

SEQ ID NO: 908309 - RNA, 27 nt, Human
cagcaggcuccgcccuccaccccacuc

SEQ ID NO: 908310 - RNA, 24 nt, Human
caggcuccgcccuccaccccacuc

SEQ ID NO: 908311 - RNA, 23 nt, Human
cauaagcaggcuauaagguuuag

SEQ ID NO: 908312 - RNA, 19 nt, Human
ccaacauccuccaugaccc

SEQ ID NO: 908313 - RNA, 22 nt, Human
ccacugcaugccggugcauggg

SEQ ID NO: 908314 - RNA, 23 nt, Human
ccacugcaugccggugcaugggc

SEQ ID NO: 908315 - RNA, 23 nt, Human
cccagacaacaauggcucugagg

SEQ ID NO: 908316 - RNA, 18 nt, Human
ccggugcaugggcagacg

SEQ ID NO: 908317 - RNA, 24 nt, Human
cgagcccagacaacaauggcucug

SEQ ID NO: 908318 - RNA, 18 nt, Human
cgggggaagggugcuggg

SEQ ID NO: 908319 - RNA, 21 nt, Human
cuccagcaggcuccgcccucc

SEQ ID NO: 908320 - RNA, 18 nt, Human
gaaggcagggccuccagc

SEQ ID NO: 908321 - RNA, 19 nt, Human
gacccagcuccuaagacag

SEQ ID NO: 908322 - RNA, 21 nt, Human
ggaaaccgagucagcauggca

SEQ ID NO: 908323 - RNA, 19 nt, Human
ggaacgccgacccagcucc

SEQ ID NO: 908324 - RNA, 21 nt, Human
gggcugugugagagaggaggg

SEQ ID NO: 908325 - RNA, 21 nt, Human
gggggcucccuggcgcgucug

SEQ ID NO: 908326 - RNA, 18 nt, Human
gggucucaggcaacaguu

SEQ ID NO: 908327 - RNA, 20 nt, Human
uaaaauaacacugagggggg

SEQ ID NO: 908328 - RNA, 22 nt, Human
uaagacagacagcuacgcugac

SEQ ID NO: 908329 - RNA, 25 nt, Human
uaagacagacagcuacgcugacacc

SEQ ID NO: 908330 - RNA, 26 nt, Human
ucagagccccaacauccuccaugacc

SEQ ID NO: 908331 - RNA, 22 nt, Human
ucauaaauaaaauaacacugag

SEQ ID NO: 908332 - RNA, 19 nt, Human
uccagcacacaaccugggg

SEQ ID NO: 908333 - RNA, 20 nt, Human
uccagcaggcuccgcccucc

SEQ ID NO: 908334 - RNA, 24 nt, Human
ucccccauaagcaggcuauaaggu

SEQ ID NO: 908335 - RNA, 20 nt, Human
ucuccuggcgcuccccauga

SEQ ID NO: 908336 - RNA, 20 nt, Human
ucucugugaaggcagggccu

SEQ ID NO: 908337 - RNA, 21 nt, Human
ugaacucagagcaucauaacc

SEQ ID NO: 908338 - RNA, 23 nt, Human
ugacccuccucuccuggcgcucc

SEQ ID NO: 908339 - RNA, 23 nt, Human
ugacgcgggggaagggugcuggg

SEQ ID NO: 908340 - RNA, 18 nt, Human
ugagagaggaggggucuc

SEQ ID NO: 908341 - RNA, 19 nt, Human
ugaggagcacagagggggc

SEQ ID NO: 908342 - RNA, 20 nt, Human
ugcugagggugcugugagga

SEQ ID NO: 908343 - RNA, 22 nt, Human
uggaagacgcucaggggacccc

SEQ ID NO: 908344 - RNA, 20 nt, Human
uggcaggagagccacccccc

SEQ ID NO: 908345 - RNA, 23 nt, Human
uggcagggcugugugagagagga

SEQ ID NO: 908346 - RNA, 18 nt, Human
uggcugagggugguggcu

SEQ ID NO: 908347 - RNA, 23 nt, Human
uggcugagggugguggcuuaagg

SEQ ID NO: 908348 - RNA, 19 nt, Human
uggggcagaaacucgagcc

SEQ ID NO: 908349 - RNA, 23 nt, Human
ugugaggcagggaaggugggcug

SEQ ID NO: 908350 - RNA, 23 nt, Human
ugugaggcagggaaggugggcug

SEQ ID NO: 908351 - RNA, 20 nt, Human
uguggcugagggugguggcu

SEQ ID NO: 908352 - RNA, 24 nt, Human
aaagagugaugagaauuaaaacaa

SEQ ID NO: 908353 - RNA, 18 nt, Human
aagcacauacaugguagg

SEQ ID NO: 908354 - RNA, 20 nt, Human
acccugagacacuaaaagaa

SEQ ID NO: 908355 - RNA, 20 nt, Human
acccugagacacuaaaagaa

SEQ ID NO: 908356 - RNA, 22 nt, Human
acccugcuccccugggugcagc

SEQ ID NO: 908357 - RNA, 18 nt, Human
acucccagaggaaagaga

SEQ ID NO: 908358 - RNA, 22 nt, Human
agaaagaacucccauagaugga

SEQ ID NO: 908359 - RNA, 21 nt, Human
agaagccuggccccagcuacc

SEQ ID NO: 908360 - RNA, 19 nt, Human
agagagaaaguggggcagg

SEQ ID NO: 908361 - RNA, 21 nt, Human
agagagaaaguggggcaggga

SEQ ID NO: 908362 - RNA, 21 nt, Human
agagugucugcugcugagaac

SEQ ID NO: 908363 - RNA, 20 nt, Human
agcucuggcuccuccuccag

SEQ ID NO: 908364 - RNA, 22 nt, Human
caaaaggguaucaguggaagca

SEQ ID NO: 908365 - RNA, 23 nt, Human
caacgggcccuccucccugacuc

SEQ ID NO: 908366 - RNA, 25 nt, Human
cacacaucacucugaccagggugcu

SEQ ID NO: 908367 - RNA, 20 nt, Human
caccaggccugaggcaaggc

SEQ ID NO: 908368 - RNA, 21 nt, Human
cacccugcuccccugggugca

SEQ ID NO: 908369 - RNA, 23 nt, Human
cacccugcuccccugggugcagc

SEQ ID NO: 908370 - RNA, 24 nt, Human
cagaggaaagagacugcauggacc

SEQ ID NO: 908371 - RNA, 25 nt, Human
cagcccccugcuggugguccugccu

SEQ ID NO: 908372 - RNA, 21 nt, Human
cagggaucuccccuccacauc

SEQ ID NO: 908373 - RNA, 18 nt, Human
caguaggccaggaagccc

SEQ ID NO: 908374 - RNA, 21 nt, Human
caguccacccugccccugccc

SEQ ID NO: 908375 - RNA, 22 nt, Human
caguucauuccagucaaaaggg

SEQ ID NO: 908376 - RNA, 22 nt, Human
caucaggugcccugggcuccuc

SEQ ID NO: 908377 - RNA, 20 nt, Human
cauucaacccucugagccuc

SEQ ID NO: 908378 - RNA, 18 nt, Human
ccacagggacuccagagg

SEQ ID NO: 908379 - RNA, 21 nt, Human
ccagccaguucauuccaguca

SEQ ID NO: 908380 - RNA, 21 nt, Human
ccaguccacccugccccugcc

SEQ ID NO: 908381 - RNA, 21 nt, Human
ccaugccacucccccagcuac

SEQ ID NO: 908382 - RNA, 23 nt, Human
cccaugccacucccccagcuacc

SEQ ID NO: 908383 - RNA, 22 nt, Human
ccccagcuacccaacgggcccu

SEQ ID NO: 908384 - RNA, 18 nt, Human
ccccaggguggagucucc

SEQ ID NO: 908385 - RNA, 19 nt, Human
cccccaaacuccauccuca

SEQ ID NO: 908386 - RNA, 20 nt, Human
ccccucuuuggggugccccc

SEQ ID NO: 908387 - RNA, 19 nt, Human
ccccugccccaugccacuc

SEQ ID NO: 908388 - RNA, 22 nt, Human
ccccugccccaugccacucccc

SEQ ID NO: 908389 - RNA, 21 nt, Human
cccugccccaugccacucccc

SEQ ID NO: 908390 - RNA, 23 nt, Human
cccugggcuccucccccaaacuc

SEQ ID NO: 908391 - RNA, 22 nt, Human
ccgcgcugcaaccuggccggcu

SEQ ID NO: 908392 - RNA, 22 nt, Human
ccgcgcugcaaccuggccggcu

SEQ ID NO: 908393 - RNA, 22 nt, Human
ccgcgcugcaaccuggccggcu

SEQ ID NO: 908394 - RNA, 22 nt, Human
ccucccugacucccacaaggau

SEQ ID NO: 908395 - RNA, 24 nt, Human
ccucccugacucccacaaggauug

SEQ ID NO: 908396 - RNA, 24 nt, Human
ccugccccacucaccaggccugag

SEQ ID NO: 908397 - RNA, 22 nt, Human
ccugcggcggcggcggcggcuu

SEQ ID NO: 908398 - RNA, 19 nt, Human
ccugcucccuugccggaac

SEQ ID NO: 908399 - RNA, 18 nt, Human
ccugcuggugguccugcc

SEQ ID NO: 908400 - RNA, 18 nt, Human
ccuggccccagcuaccca

SEQ ID NO: 908401 - RNA, 20 nt, Human
ccuggccggcucuauccaac

SEQ ID NO: 908402 - RNA, 24 nt, Human
ccugggcuccucccccaaacuccc

SEQ ID NO: 908403 - RNA, 26 nt, Human
ccuggggcugccgcagcucagacccc

SEQ ID NO: 908404 - RNA, 20 nt, Human
cgagaggagcccaguccacc

SEQ ID NO: 908405 - RNA, 21 nt, Human
cgaugaugcugcccacuuccu

SEQ ID NO: 908406 - RNA, 21 nt, Human
cgcucacaacugcgagugaca

SEQ ID NO: 908407 - RNA, 24 nt, Human
cggcugggccgcucagucccacag

SEQ ID NO: 908408 - RNA, 21 nt, Human
cuccagucccccguccgagcc

SEQ ID NO: 908409 - RNA, 23 nt, Human
cucccccaaacuccauccucacc

SEQ ID NO: 908410 - RNA, 22 nt, Human
cuccccuccacaucaggugccc

SEQ ID NO: 908411 - RNA, 23 nt, Human
cugagccucagcuucuccaucug

SEQ ID NO: 908412 - RNA, 18 nt, Human
cugccccaugccacuccc

SEQ ID NO: 908413 - RNA, 20 nt, Human
cugccccugccuguaccuca

SEQ ID NO: 908414 - RNA, 21 nt, Human
cugccugccccugccuguacc

SEQ ID NO: 908415 - RNA, 22 nt, Human
cugcucccuugccggaacuugu

SEQ ID NO: 908416 - RNA, 22 nt, Human
cuguguaagccuggggagccca

SEQ ID NO: 908417 - RNA, 26 nt, Human
gaaacugcccccacucugaggcacuc

SEQ ID NO: 908418 - RNA, 19 nt, Human
gacacccgccauggugggg

SEQ ID NO: 908419 - RNA, 18 nt, Human
gagugacaucagcugcga

SEQ ID NO: 908420 - RNA, 23 nt, Human
gcccugggcuccucccccaaacu

SEQ ID NO: 908421 - RNA, 21 nt, Human
gccuggccccagcuacccaac

SEQ ID NO: 908422 - RNA, 20 nt, Human
gcggcggcggcggcacggcg

SEQ ID NO: 908423 - RNA, 19 nt, Human
gcggcggcggcggcggcac

SEQ ID NO: 908424 - RNA, 19 nt, Human
gcggcggcggcggcggcgg

SEQ ID NO: 908425 - RNA, 21 nt, Human
gcggcggcggcggcggcggca

SEQ ID NO: 908426 - RNA, 24 nt, Human
gcucuauccaacggaggugacacc

SEQ ID NO: 908427 - RNA, 23 nt, Human
gcucuggcuccuccuccaguccc

SEQ ID NO: 908428 - RNA, 18 nt, Human
gcuuuacagucucgcccu

SEQ ID NO: 908429 - RNA, 25 nt, Human
ggcggcggcggcggcacggcggcug

SEQ ID NO: 908430 - RNA, 20 nt, Human
gggcagggaucuccccucca

SEQ ID NO: 908431 - RNA, 21 nt, Human
gggcccccugcccuggggcug

SEQ ID NO: 908432 - RNA, 18 nt, Human
gugcaucagcauccgcag

SEQ ID NO: 908433 - RNA, 22 nt, Human
gugcccccucuuuggggugccc

SEQ ID NO: 908434 - RNA, 21 nt, Human
guggggcagggaucuccccuc

SEQ ID NO: 908435 - RNA, 23 nt, Human
guggggcagggaucuccccucca

SEQ ID NO: 908436 - RNA, 19 nt, Human
uaagcacauacaugguagg

SEQ ID NO: 908437 - RNA, 21 nt, Human
ucaggcgaggcuggggccaca

SEQ ID NO: 908438 - RNA, 21 nt, Human
ucaggcgaggcuggggccaca

SEQ ID NO: 908439 - RNA, 21 nt, Human
ucaggcgaggcuggggccaca

SEQ ID NO: 908440 - RNA, 18 nt, Human
uccccgggagaggcggcc

SEQ ID NO: 908441 - RNA, 21 nt, Human
uccgcgcugcaaccuggccgg

SEQ ID NO: 908442 - RNA, 21 nt, Human
uccgcgcugcaaccuggccgg

SEQ ID NO: 908443 - RNA, 21 nt, Human
uccgcgcugcaaccuggccgg

SEQ ID NO: 908444 - RNA, 23 nt, Human
ucgcuggggcagccaaagagggg

SEQ ID NO: 908445 - RNA, 20 nt, Human
ucgcuggggcuguccugcgg

SEQ ID NO: 908446 - RNA, 20 nt, Human
ucucacgagcuguguaagcc

SEQ ID NO: 908447 - RNA, 21 nt, Human
ucuggcuccuccuccaguccc

SEQ ID NO: 908448 - RNA, 23 nt, Human
ugacaucagcugcgaacaaugag

SEQ ID NO: 908449 - RNA, 21 nt, Human
ugaccagggugcuuaugugug

SEQ ID NO: 908450 - RNA, 23 nt, Human
ugaggcaaggcucaaaacugcca

SEQ ID NO: 908451 - RNA, 23 nt, Human
ugcagcugcuccuccuuccauuu

SEQ ID NO: 908452 - RNA, 20 nt, Human
ugcaguaggccaggaagccc

SEQ ID NO: 908453 - RNA, 21 nt, Human
ugcccccucuuuggggugccc

SEQ ID NO: 908454 - RNA, 22 nt, Human
ugcccccucuuuggggugcccc

SEQ ID NO: 908455 - RNA, 21 nt, Human
ugccccugccuguaccucagc

SEQ ID NO: 908456 - RNA, 19 nt, Human
ugcccugggcuccuccccc

SEQ ID NO: 908457 - RNA, 23 nt, Human
ugcccugggcuccucccccaaac

SEQ ID NO: 908458 - RNA, 18 nt, Human
ugcccuggggcugccgca

SEQ ID NO: 908459 - RNA, 21 nt, Human
ugcggcggcggcggcggcggc

SEQ ID NO: 908460 - RNA, 23 nt, Human
uggccggcucucgcuggggcagc

SEQ ID NO: 908461 - RNA, 21 nt, Human
uggcuccuccuccaguccccc

SEQ ID NO: 908462 - RNA, 22 nt, Human
ugggcguuagcggcguuuggga

SEQ ID NO: 908463 - RNA, 21 nt, Human
ugggcuccucccccaaacucc

SEQ ID NO: 908464 - RNA, 19 nt, Human
uggggagagaagccuggcc

SEQ ID NO: 908465 - RNA, 21 nt, Human
uggggugcccccugacaagcc

SEQ ID NO: 908466 - RNA, 23 nt, Human
ugguccugccugccccugccugu

SEQ ID NO: 908467 - RNA, 19 nt, Human
ugguggggagagaagccug

SEQ ID NO: 908468 - RNA, 22 nt, Human
ugguggggagagaagccuggcc

SEQ ID NO: 908469 - RNA, 21 nt, Human
uucaaaaacagggauugaaaa

SEQ ID NO: 908470 - RNA, 21 nt, Human
uucaacccucugagccucagc

SEQ ID NO: 908471 - RNA, 21 nt, Human
uugaaaaaacuguacagagug

SEQ ID NO: 908472 - RNA, 23 nt, Human
uugaaaaaacuguacagaguguc

SEQ ID NO: 908473 - RNA, 22 nt, Human
uuggggugcccccugacaagcc

SEQ ID NO: 908474 - RNA, 18 nt, Human
uuuuuuuuuuuuuuuuug

SEQ ID NO: 908475 - RNA, 18 nt, Human
uuuuuuuuuuuuuuuuug

SEQ ID NO: 908476 - RNA, 28 nt, Human
uuuuuuuuuuuuuuuuuuuuuuuggggg

SEQ ID NO: 908477 - RNA, 24 nt, Human
aaaaccaaccaaacaaaaaaaagu

SEQ ID NO: 908478 - RNA, 25 nt, Human
aacaccacuaccacuaacagaaacu

SEQ ID NO: 908479 - RNA, 21 nt, Human
aagacggcagcagauguggug

SEQ ID NO: 908480 - RNA, 22 nt, Human
aagcaaaagaaaggcuaugugg

SEQ ID NO: 908481 - RNA, 20 nt, Human
aaguacaagagcucaugcug

SEQ ID NO: 908482 - RNA, 23 nt, Human
acaaaaaaaagugucaagacggc

SEQ ID NO: 908483 - RNA, 24 nt, Human
acaaaaccaaccaaacaaaaaaaa

SEQ ID NO: 908484 - RNA, 20 nt, Human
acaaauucaacaaagguaaa

SEQ ID NO: 908485 - RNA, 23 nt, Human
acaccacuaccacuaacagaaac

SEQ ID NO: 908486 - RNA, 19 nt, Human
acccaaaaccucgguguug

SEQ ID NO: 908487 - RNA, 21 nt, Human
accuccugagugcaaaggcug

SEQ ID NO: 908488 - RNA, 21 nt, Human
acuauaauuuacauuuaucca

SEQ ID NO: 908489 - RNA, 23 nt, Human
acuuuacaacuaggaaauagcca

SEQ ID NO: 908490 - RNA, 20 nt, Human
agaauuucuccgaaguccac

SEQ ID NO: 908491 - RNA, 22 nt, Human
agagaagcaaaagcaaaagaaa

SEQ ID NO: 908492 - RNA, 22 nt, Human
agugaauucucuacagaggaaa

SEQ ID NO: 908493 - RNA, 24 nt, Human
caaaacaccacuaccacuaacaga

SEQ ID NO: 908494 - RNA, 23 nt, Human
caaagcagacucucaacuuccag

SEQ ID NO: 908495 - RNA, 26 nt, Human
cauuuuuguaaagucucuccccuccc

SEQ ID NO: 908496 - RNA, 18 nt, Human
ccaaaacaccacuaccac

SEQ ID NO: 908497 - RNA, 21 nt, Human
ccaaaacaccacuaccacuaa

SEQ ID NO: 908498 - RNA, 24 nt, Human
ccaaacaaaaaaaagugucaagac

SEQ ID NO: 908499 - RNA, 22 nt, Human
ccaaaggaaagugucggcucac

SEQ ID NO: 908500 - RNA, 20 nt, Human
ccacuaccacuaacagaaac

SEQ ID NO: 908501 - RNA, 19 nt, Human
cccucccagagcccgcccc

SEQ ID NO: 908502 - RNA, 19 nt, Human
ccgcccggagcaggcucgg

SEQ ID NO: 908503 - RNA, 18 nt, Human
ccuccugagugcaaaggc

SEQ ID NO: 908504 - RNA, 19 nt, Human
cgcccggagcaggcucggc

SEQ ID NO: 908505 - RNA, 23 nt, Human
cgcugacauggcuggagcggcgc

SEQ ID NO: 908506 - RNA, 21 nt, Human
cucaaaacaauaaaaacacug

SEQ ID NO: 908507 - RNA, 19 nt, Human
cucccagagcccgccccgu

SEQ ID NO: 908508 - RNA, 26 nt, Human
cucuccuaccuuaaggaaaucaggaa

SEQ ID NO: 908509 - RNA, 18 nt, Human
cuuaaggaaaucaggaaa

SEQ ID NO: 908510 - RNA, 21 nt, Human
cuucuuguaaaggccgccuua

SEQ ID NO: 908511 - RNA, 24 nt, Human
gagagaagcaaaagcaaaagaaag

SEQ ID NO: 908512 - RNA, 23 nt, Human
gagcaggcucggcucgcccuggc

SEQ ID NO: 908513 - RNA, 21 nt, Human
gcaaggaaugaaguguccaaa

SEQ ID NO: 908514 - RNA, 24 nt, Human
gccuuagaaaugguccagaaagca

SEQ ID NO: 908515 - RNA, 18 nt, Human
gcggcgccgccgccgccg

SEQ ID NO: 908516 - RNA, 20 nt, Human
gcucacucaucccccaaacg

SEQ ID NO: 908517 - RNA, 19 nt, Human
gcuuuuaaguggaaggucu

SEQ ID NO: 908518 - RNA, 24 nt, Human
ggcagcagaugugguguguggucc

SEQ ID NO: 908519 - RNA, 19 nt, Human
ggccgccuuagaaaugguc

SEQ ID NO: 908520 - RNA, 18 nt, Human
uaacaaaaccaaccaaac

SEQ ID NO: 908521 - RNA, 25 nt, Human
uaacagaaacuccuaagcucaugcu

SEQ ID NO: 908522 - RNA, 19 nt, Human
uaaguggaaggucuuagcc

SEQ ID NO: 908523 - RNA, 19 nt, Human
uacaagagcucaugcugga

SEQ ID NO: 908524 - RNA, 23 nt, Human
uacaagagcucaugcuggagcag

SEQ ID NO: 908525 - RNA, 24 nt, Human
uacacguuaaauucucuccuaccu

SEQ ID NO: 908526 - RNA, 23 nt, Human
uaccacuaacagaaacuccuaag

SEQ ID NO: 908527 - RNA, 22 nt, Human
uaugagaauuucuccgaagucc

SEQ ID NO: 908528 - RNA, 21 nt, Human
uaugucaacacccaaaaccuc

SEQ ID NO: 908529 - RNA, 24 nt, Human
uccaaaacaccacuaccacuaaca

SEQ ID NO: 908530 - RNA, 22 nt, Human
uccaaauggaaaauaaaagccc

SEQ ID NO: 908531 - RNA, 18 nt, Human
uccacuuuaugucaacac

SEQ ID NO: 908532 - RNA, 24 nt, Human
uccgaaguccacccuccucuccga

SEQ ID NO: 908533 - RNA, 18 nt, Human
uccgacaggaaugucuuc

SEQ ID NO: 908534 - RNA, 23 nt, Human
ugagguacaaagcagacucucaa

SEQ ID NO: 908535 - RNA, 18 nt, Human
ugagugcaaaggcugaag

SEQ ID NO: 908536 - RNA, 21 nt, Human
ugagugcaaaggcugaagucg

SEQ ID NO: 908537 - RNA, 18 nt, Human
ugcaaggaaugaaguguc

SEQ ID NO: 908538 - RNA, 24 nt, Human
uggaaggucuuagccuacuuuguu

SEQ ID NO: 908539 - RNA, 22 nt, Human
ugucaacacccaaaaccucggu

SEQ ID NO: 908540 - RNA, 21 nt, Human
uguccaaaacaccacuaccac

SEQ ID NO: 908541 - RNA, 25 nt, Human
uguccaaaacaccacuaccacuaac

SEQ ID NO: 908542 - RNA, 20 nt, Human
aaacaaagcaaaauagagcc

SEQ ID NO: 908543 - RNA, 20 nt, Human
aaaugcaaaagggcuuaaaa

SEQ ID NO: 908544 - RNA, 22 nt, Human
aaccugucucuuuuuccuucca

SEQ ID NO: 908545 - RNA, 22 nt, Human
aagaagaagaagaggaagagga

SEQ ID NO: 908546 - RNA, 18 nt, Human
aagaagaagaggaagagg

SEQ ID NO: 908547 - RNA, 26 nt, Human
aagaggaagaggagaaggaaaaggag

SEQ ID NO: 908548 - RNA, 21 nt, Human
aaguaccaaggggacggaaug

SEQ ID NO: 908549 - RNA, 19 nt, Human
aaugugaaaggguggaaca

SEQ ID NO: 908550 - RNA, 20 nt, Human
acaccacaaaauguacagac

SEQ ID NO: 908551 - RNA, 18 nt, Human
acccaaucaccuccccca

SEQ ID NO: 908552 - RNA, 22 nt, Human
acccaaucaccucccccaccac

SEQ ID NO: 908553 - RNA, 20 nt, Human
agaaauagaaucagacuuau

SEQ ID NO: 908554 - RNA, 19 nt, Human
agaagaggaagaggagaag

SEQ ID NO: 908555 - RNA, 22 nt, Human
agaggaagaggagaaggaaaag

SEQ ID NO: 908556 - RNA, 20 nt, Human
agauacagugcaccagagau

SEQ ID NO: 908557 - RNA, 24 nt, Human
agauauggaaauugggagaaaacu

SEQ ID NO: 908558 - RNA, 21 nt, Human
agccacccaaucaccuccccc

SEQ ID NO: 908559 - RNA, 23 nt, Human
agcuauaaaauuuuuacauggaa

SEQ ID NO: 908560 - RNA, 18 nt, Human
aggaaaaagaggaggagg

SEQ ID NO: 908561 - RNA, 18 nt, Human
aggaagaagaagaagagg

SEQ ID NO: 908562 - RNA, 19 nt, Human
aggaagaagaagaagagga

SEQ ID NO: 908563 - RNA, 23 nt, Human
aggaagaagaagaagaggaagag

SEQ ID NO: 908564 - RNA, 22 nt, Human
aggaggaagaagaagaagagga

SEQ ID NO: 908565 - RNA, 19 nt, Human
aggaggaggaaaaagagga

SEQ ID NO: 908566 - RNA, 23 nt, Human
aggauggaagagcaaaggaggga

SEQ ID NO: 908567 - RNA, 25 nt, Human
aguaaaaggcaagcuuaacuuuuga

SEQ ID NO: 908568 - RNA, 22 nt, Human
aguaagucccuccuccacauuu

SEQ ID NO: 908569 - RNA, 18 nt, Human
auagugcuguaaacaggc

SEQ ID NO: 908570 - RNA, 18 nt, Human
aucacaauuucucuugua

SEQ ID NO: 908571 - RNA, 22 nt, Human
aucaccucccccaccaccacga

SEQ ID NO: 908572 - RNA, 18 nt, Human
caaaucccaaagaggaaa

SEQ ID NO: 908573 - RNA, 19 nt, Human
caagccucuuucccucuaa

SEQ ID NO: 908574 - RNA, 23 nt, Human
caagcuuaacuuuugaaggcuga

SEQ ID NO: 908575 - RNA, 24 nt, Human
caagcuuaacuuuugaaggcugac

SEQ ID NO: 908576 - RNA, 28 nt, Human
caaguuuaaaacagugauauugcauuua

SEQ ID NO: 908577 - RNA, 25 nt, Human
caauaugaguuuuugacaaaauuuu

SEQ ID NO: 908578 - RNA, 20 nt, Human
cacauuucccucucccuuca

SEQ ID NO: 908579 - RNA, 24 nt, Human
caccacaaaauguacagacaccca

SEQ ID NO: 908580 - RNA, 22 nt, Human
caccaccacgaaacaaaaaaaa

SEQ ID NO: 908581 - RNA, 23 nt, Human
caccaccacgaaacaaaaaaaaa

SEQ ID NO: 908582 - RNA, 27 nt, Human
caccaccacgaaacaaaaaaaaaucug

SEQ ID NO: 908583 - RNA, 25 nt, Human
cagaauacaacauuuuuuauaaccc

SEQ ID NO: 908584 - RNA, 20 nt, Human
cagccacccaaucaccuccc

SEQ ID NO: 908585 - RNA, 18 nt, Human
caggaagggugacaggcg

SEQ ID NO: 908586 - RNA, 24 nt, Human
caggugaaaagaacauaaucacaa

SEQ ID NO: 908587 - RNA, 22 nt, Human
ccaagccucuuucccucuaacc

SEQ ID NO: 908588 - RNA, 20 nt, Human
ccaaucaccucccccaccac

SEQ ID NO: 908589 - RNA, 21 nt, Human
ccacccaaucaccucccccac

SEQ ID NO: 908590 - RNA, 20 nt, Human
ccacgaaacaaaaaaaaauc

SEQ ID NO: 908591 - RNA, 26 nt, Human
ccauccgaaaucuaauacucaguuac

SEQ ID NO: 908592 - RNA, 23 nt, Human
cccaagccucuuucccucuaacc

SEQ ID NO: 908593 - RNA, 22 nt, Human
cccacaggugaaaagaacauaa

SEQ ID NO: 908594 - RNA, 23 nt, Human
cccaucucugcucccacaacgau

SEQ ID NO: 908595 - RNA, 24 nt, Human
ccccaccaccacgaaacaaaaaaa

SEQ ID NO: 908596 - RNA, 21 nt, Human
ccucuuucccucuaaccuguc

SEQ ID NO: 908597 - RNA, 18 nt, Human
ccugucucuuuuuccuuc

SEQ ID NO: 908598 - RNA, 25 nt, Human
cgcaaagaaaaaagaccuuugccag

SEQ ID NO: 908599 - RNA, 18 nt, Human
cgcccaucucugcuccca

SEQ ID NO: 908600 - RNA, 18 nt, Human
cggcuggcaaaugcaaaa

SEQ ID NO: 908601 - RNA, 26 nt, Human
cuccuuuugcuucauuuuagagcuuc

SEQ ID NO: 908602 - RNA, 20 nt, Human
cucugcucccacaacgauac

SEQ ID NO: 908603 - RNA, 22 nt, Human
cugaaacaauaauguaccauga

SEQ ID NO: 908604 - RNA, 21 nt, Human
cugggacagacgcaaagaaaa

SEQ ID NO: 908605 - RNA, 24 nt, Human
cuuucccucuaaccugucucuuuu

SEQ ID NO: 908606 - RNA, 23 nt, Human
gaacacuugaucacacaaaaaua

SEQ ID NO: 908607 - RNA, 19 nt, Human
gaagaagaagaagaggaag

SEQ ID NO: 908608 - RNA, 21 nt, Human
gaagaagaagaagaggaagag

SEQ ID NO: 908609 - RNA, 23 nt, Human
gaagaagaagaagaggaagagga

SEQ ID NO: 908610 - RNA, 18 nt, Human
gaagaagaggaagaggag

SEQ ID NO: 908611 - RNA, 18 nt, Human
gaagaggaagaggagaag

SEQ ID NO: 908612 - RNA, 19 nt, Human
gaagaggagaaggaaaagg

SEQ ID NO: 908613 - RNA, 19 nt, Human
gaaggagugggagaaggug

SEQ ID NO: 908614 - RNA, 19 nt, Human
gaaggcugacucaugaaga

SEQ ID NO: 908615 - RNA, 22 nt, Human
gccacccaaucaccucccccac

SEQ ID NO: 908616 - RNA, 24 nt, Human
gccucuuucccucuaaccugucuc

SEQ ID NO: 908617 - RNA, 20 nt, Human
gcuaauauccuaaaaauaga

SEQ ID NO: 908618 - RNA, 24 nt, Human
ggaaaagcacagaacggcucugca

SEQ ID NO: 908619 - RNA, 22 nt, Human
ggaagaagaagaagaggaagag

SEQ ID NO: 908620 - RNA, 18 nt, Human
ggaggaaaaagaggagga

SEQ ID NO: 908621 - RNA, 20 nt, Human
gggaaaggacugacaggaug

SEQ ID NO: 908622 - RNA, 21 nt, Human
guaaacaggcacacacugauc

SEQ ID NO: 908623 - RNA, 20 nt, Human
uaaccugucucuuuuuccuu

SEQ ID NO: 908624 - RNA, 18 nt, Human
uaagucccuccuccacau

SEQ ID NO: 908625 - RNA, 21 nt, Human
uagugcuguaaacaggcacac

SEQ ID NO: 908626 - RNA, 19 nt, Human
uauagaauuauagauuuua

SEQ ID NO: 908627 - RNA, 20 nt, Human
uaugacugaugacuucuuaa

SEQ ID NO: 908628 - RNA, 23 nt, Human
uauggaaauugggagaaaacuau

SEQ ID NO: 908629 - RNA, 23 nt, Human
uauucauguguaauuaagucaca

SEQ ID NO: 908630 - RNA, 23 nt, Human
ucacacaaaaauaauauaaaaca

SEQ ID NO: 908631 - RNA, 24 nt, Human
ucaccucccccaccaccacgaaac

SEQ ID NO: 908632 - RNA, 24 nt, Human
ucagccacccaaucaccuccccca

SEQ ID NO: 908633 - RNA, 25 nt, Human
ucauagaaauagaaucagacuuaug

SEQ ID NO: 908634 - RNA, 20 nt, Human
uccacauuucccucucccuu

SEQ ID NO: 908635 - RNA, 21 nt, Human
ucccaagccucuuucccucua

SEQ ID NO: 908636 - RNA, 22 nt, Human
ucccaagccucuuucccucuaa

SEQ ID NO: 908637 - RNA, 21 nt, Human
ucccccaccaccacgaaacaa

SEQ ID NO: 908638 - RNA, 22 nt, Human
ucccccaccaccacgaaacaaa

SEQ ID NO: 908639 - RNA, 22 nt, Human
uccuccacauuucccucucccu

SEQ ID NO: 908640 - RNA, 21 nt, Human
ucgauauuucaagacuguccu

SEQ ID NO: 908641 - RNA, 23 nt, Human
ucugcuguuuucuucccaagccu

SEQ ID NO: 908642 - RNA, 24 nt, Human
ucuucuugacauuuuuuuccucuu

SEQ ID NO: 908643 - RNA, 22 nt, Human
ucuuuaugacuggcuucucgug

SEQ ID NO: 908644 - RNA, 18 nt, Human
ucuuugggacccugaauu

SEQ ID NO: 908645 - RNA, 20 nt, Human
ucuuuuuccuuccaguccuu

SEQ ID NO: 908646 - RNA, 19 nt, Human
ugaaaggguggaacaacgc

SEQ ID NO: 908647 - RNA, 19 nt, Human
ugaaauaguacaguaaaca

SEQ ID NO: 908648 - RNA, 18 nt, Human
ugacaggauggaagagca

SEQ ID NO: 908649 - RNA, 20 nt, Human
ugacaggauggaagagcaaa

SEQ ID NO: 908650 - RNA, 18 nt, Human
ugagaagggaaaggacug

SEQ ID NO: 908651 - RNA, 19 nt, Human
ugcaaaagggcuuaaaauc

SEQ ID NO: 908652 - RNA, 23 nt, Human
ugccucuaaaguuucuacaguuc

SEQ ID NO: 908653 - RNA, 21 nt, Human
ugcucccacaacgauacacug

SEQ ID NO: 908654 - RNA, 18 nt, Human
ugcuucagguaaguccug

SEQ ID NO: 908655 - RNA, 20 nt, Human
ugggaggagaacgaggagga

SEQ ID NO: 908656 - RNA, 23 nt, Human
ugggucuucagaauacaacauuu

SEQ ID NO: 908657 - RNA, 23 nt, Human
uguaaugagcaguuucuuuucug

SEQ ID NO: 908658 - RNA, 25 nt, Human
uguauaaacuacagaaugucuuuga

SEQ ID NO: 908659 - RNA, 22 nt, Human
uguaugauguggacuguaugca

SEQ ID NO: 908660 - RNA, 19 nt, Human
ugugcaaaucaugcugcuu

SEQ ID NO: 908661 - RNA, 21 nt, Human
uuaugcagauuguuagauagu

SEQ ID NO: 908662 - RNA, 23 nt, Human
uucaaagucauagaaauagaauc

SEQ ID NO: 908663 - RNA, 25 nt, Human
uucuacaguucugcacauuucaacu

SEQ ID NO: 908664 - RNA, 23 nt, Human
uugacauaaaaguaaaaggcaag

SEQ ID NO: 908665 - RNA, 20 nt, Human
uugacauuuuuuuccucuuu

SEQ ID NO: 908666 - RNA, 18 nt, Human
uugucuuucagagucuug

SEQ ID NO: 908667 - RNA, 25 nt, Human
uuuccuuccaguccuuccuuccucc

SEQ ID NO: 908668 - RNA, 18 nt, Human
uuucucaggccugcugag

SEQ ID NO: 908669 - RNA, 23 nt, Human
uuugggacccugaauuaccuuuu

SEQ ID NO: 908670 - RNA, 22 nt, Human
uuugucuucuugcugaugggag

SEQ ID NO: 908671 - RNA, 22 nt, Human
uuuucuaacaacaaauacaggu

SEQ ID NO: 908672 - RNA, 21 nt, Human
uuuuguagcuuagagcaucau

SEQ ID NO: 908673 - RNA, 24 nt, Human
uuuuugcgucuuacuaaauuuaau

SEQ ID NO: 908674 - RNA, 19 nt, Human
uuuuuuuuuuuuuuuugcg

SEQ ID NO: 908675 - RNA, 18 nt, Human
uuuuuuuuuuuuuuuuug

SEQ ID NO: 908676 - RNA, 19 nt, Human
uuuuuuuuuuuuuuuuugc

SEQ ID NO: 908677 - RNA, 19 nt, Human
aagcuggugggaagauggc

SEQ ID NO: 908678 - RNA, 18 nt, Human
aaggagcuggguccaaac

SEQ ID NO: 908679 - RNA, 26 nt, Human
acaggucagugagcaacagggcuucu

SEQ ID NO: 908680 - RNA, 19 nt, Human
acucugagggggcugggga

SEQ ID NO: 908681 - RNA, 20 nt, Human
acucugagggggcuggggag

SEQ ID NO: 908682 - RNA, 21 nt, Human
acucugagggggcuggggagu

SEQ ID NO: 908683 - RNA, 18 nt, Human
agcuccaggccaggcucu

SEQ ID NO: 908684 - RNA, 21 nt, Human
aggccacagccccccaggaag

SEQ ID NO: 908685 - RNA, 26 nt, Human
agggaccuccuccaucccccuacccc

SEQ ID NO: 908686 - RNA, 26 nt, Human
agggaccuccuccaucccccuacccc

SEQ ID NO: 908687 - RNA, 21 nt, Human
aggucggggcccagccugggc

SEQ ID NO: 908688 - RNA, 18 nt, Human
cacugaggagaacccagg

SEQ ID NO: 908689 - RNA, 19 nt, Human
cacugugcgcaucccaggu

SEQ ID NO: 908690 - RNA, 27 nt, Human
cacuugguucugggcaggggcaggggc

SEQ ID NO: 908691 - RNA, 27 nt, Human
cacuugguucugggcaggggcaggggc

SEQ ID NO: 908692 - RNA, 18 nt, Human
cagcuccaggccaggcuc

SEQ ID NO: 908693 - RNA, 21 nt, Human
cagcuugaccucagacuuugg

SEQ ID NO: 908694 - RNA, 25 nt, Human
cagggcagggaucccucacugagga

SEQ ID NO: 908695 - RNA, 18 nt, Human
caggucagugagcaacag

SEQ ID NO: 908696 - RNA, 21 nt, Human
caggucggggcccagccuggg

SEQ ID NO: 908697 - RNA, 22 nt, Human
cagugguuggaacugagggcac

SEQ ID NO: 908698 - RNA, 22 nt, Human
ccccaauaaauaaagucucagc

SEQ ID NO: 908699 - RNA, 24 nt, Human
cccccaauaaauaaagucucagcu

SEQ ID NO: 908700 - RNA, 25 nt, Human
cccccuacccccaauaaauaaaguc

SEQ ID NO: 908701 - RNA, 25 nt, Human
cccccuacccccaauaaauaaaguc

SEQ ID NO: 908702 - RNA, 19 nt, Human
cccguagccagucauaguc

SEQ ID NO: 908703 - RNA, 22 nt, Human
ccuccaucccccuacccccaau

SEQ ID NO: 908704 - RNA, 22 nt, Human
ccuccaucccccuacccccaau

SEQ ID NO: 908705 - RNA, 18 nt, Human
ccuggcuccagcucaggc

SEQ ID NO: 908706 - RNA, 20 nt, Human
ccuggugguggccuccccgu

SEQ ID NO: 908707 - RNA, 22 nt, Human
cgcaccugccacacauggcuug

SEQ ID NO: 908708 - RNA, 18 nt, Human
cucaggcucccugaccuc

SEQ ID NO: 908709 - RNA, 18 nt, Human
cucugagggggcugggga

SEQ ID NO: 908710 - RNA, 20 nt, Human
cucugggcccagcuugaccu

SEQ ID NO: 908711 - RNA, 20 nt, Human
cugccacggagcuccuccuc

SEQ ID NO: 908712 - RNA, 19 nt, Human
cugcccagggcaggcucag

SEQ ID NO: 908713 - RNA, 23 nt, Human
cugcccagggcaggcucagagug

SEQ ID NO: 908714 - RNA, 21 nt, Human
gaccuccuccaucccccuacc

SEQ ID NO: 908715 - RNA, 21 nt, Human
gaccuccuccaucccccuacc

SEQ ID NO: 908716 - RNA, 21 nt, Human
gaccuggucacaggucaguga

SEQ ID NO: 908717 - RNA, 25 nt, Human
gagcuggggccuggugguggccucc

SEQ ID NO: 908718 - RNA, 19 nt, Human
gcacagacuuggcuccugg

SEQ ID NO: 908719 - RNA, 21 nt, Human
gcuccagcuccaggccaggcu

SEQ ID NO: 908720 - RNA, 21 nt, Human
gcugcagcuguguuugcuggc

SEQ ID NO: 908721 - RNA, 20 nt, Human
ggagcuccuccucgccggcc

SEQ ID NO: 908722 - RNA, 18 nt, Human
ggcaggggcaggggcagg

SEQ ID NO: 908723 - RNA, 18 nt, Human
ggcaggggcaggggcagg

SEQ ID NO: 908724 - RNA, 20 nt, Human
ggcaggggcaggggcagggg

SEQ ID NO: 908725 - RNA, 26 nt, Human
ggccuggugguggccuccccguagcc

SEQ ID NO: 908726 - RNA, 23 nt, Human
ggcucaggccacagccccccagg

SEQ ID NO: 908727 - RNA, 20 nt, Human
ggcuccagcuccaggccagg

SEQ ID NO: 908728 - RNA, 21 nt, Human
ggcugucagcgcaccugccac

SEQ ID NO: 908729 - RNA, 26 nt, Human
gggaccuccuccaucccccuaccccc

SEQ ID NO: 908730 - RNA, 26 nt, Human
gggaccuccuccaucccccuaccccc

SEQ ID NO: 908731 - RNA, 21 nt, Human
gggcaggggcaggggcagggg

SEQ ID NO: 908732 - RNA, 21 nt, Human
gggcaggggcaggggcagggg

SEQ ID NO: 908733 - RNA, 22 nt, Human
gggcaggggcaggggcaggggu

SEQ ID NO: 908734 - RNA, 18 nt, Human
gggcuccagcuccaggcc

SEQ ID NO: 908735 - RNA, 20 nt, Human
gggcuccagcuccaggccag

SEQ ID NO: 908736 - RNA, 21 nt, Human
ggggggcacagacuuggcucc

SEQ ID NO: 908737 - RNA, 20 nt, Human
gguggccuccccguagccag

SEQ ID NO: 908738 - RNA, 18 nt, Human
gucaguggaacccaaagg

SEQ ID NO: 908739 - RNA, 18 nt, Human
gucaguggaacccaaagg

SEQ ID NO: 908740 - RNA, 18 nt, Human
gugguuggaacugagggc

SEQ ID NO: 908741 - RNA, 22 nt, Human
uacucugagggggcuggggagg

SEQ ID NO: 908742 - RNA, 21 nt, Human
ucacugaggagaacccagggc

SEQ ID NO: 908743 - RNA, 23 nt, Human
ucacugaggagaacccagggcuu

SEQ ID NO: 908744 - RNA, 19 nt, Human
ugaggagaacccagggcug

SEQ ID NO: 908745 - RNA, 21 nt, Human
ugaggagaacccagggcugcu

SEQ ID NO: 908746 - RNA, 21 nt, Human
ugagggcaccagcucagcagg

SEQ ID NO: 908747 - RNA, 21 nt, Human
ugccacacauggcuugccauc

SEQ ID NO: 908748 - RNA, 20 nt, Human
ugcccagggcaggcucagag

SEQ ID NO: 908749 - RNA, 20 nt, Human
uggaacccaaaggagcuggg

SEQ ID NO: 908750 - RNA, 20 nt, Human
uggaacccaaaggagcuggg

SEQ ID NO: 908751 - RNA, 19 nt, Human
uggaacugagggcaccagc

SEQ ID NO: 908752 - RNA, 22 nt, Human
ugguccuaguacucugaggggg

SEQ ID NO: 908753 - RNA, 21 nt, Human
uggugggaagauggcccgggc

SEQ ID NO: 908754 - RNA, 23 nt, Human
ugguucugggcaggggcaggggc

SEQ ID NO: 908755 - RNA, 23 nt, Human
ugguucugggcaggggcaggggc

SEQ ID NO: 908756 - RNA, 20 nt, Human
uuggggggcacagacuuggc

SEQ ID NO: 908757 - RNA, 19 nt, Human
aacagaagagacaagaaaa

SEQ ID NO: 908758 - RNA, 22 nt, Human
aagacccuugccaucugaucgg

SEQ ID NO: 908759 - RNA, 19 nt, Human
aagagacaagaaaaugcca

SEQ ID NO: 908760 - RNA, 22 nt, Human
aagagcaacgaagacagaguca

SEQ ID NO: 908761 - RNA, 18 nt, Human
aaggucuuuucaggacuu

SEQ ID NO: 908762 - RNA, 22 nt, Human
aauggguuaucaccaggaggga

SEQ ID NO: 908763 - RNA, 23 nt, Human
aauugauggggaugaagagcaac

SEQ ID NO: 908764 - RNA, 22 nt, Human
acagacaugucacagcaggagc

SEQ ID NO: 908765 - RNA, 23 nt, Human
accacagaucacaaauuaugacc

SEQ ID NO: 908766 - RNA, 26 nt, Human
acccgguggucucuccuuauucugcu

SEQ ID NO: 908767 - RNA, 22 nt, Human
agaagagacaagaaaaugccaa

SEQ ID NO: 908768 - RNA, 18 nt, Human
agaagccugugaugacug

SEQ ID NO: 908769 - RNA, 19 nt, Human
agacucucugcccagaucc

SEQ ID NO: 908770 - RNA, 26 nt, Human
agcgaugaggcaggcgauaagaagga

SEQ ID NO: 908771 - RNA, 18 nt, Human
agguaacuuuauacagaa

SEQ ID NO: 908772 - RNA, 21 nt, Human
aucacggaggacagucugaga

SEQ ID NO: 908773 - RNA, 18 nt, Human
caacagaagagacaagaa

SEQ ID NO: 908774 - RNA, 19 nt, Human
caacgaagacagagucaca

SEQ ID NO: 908775 - RNA, 19 nt, Human
caagaacagcacccaucuc

SEQ ID NO: 908776 - RNA, 23 nt, Human
cacagaucacaaauuaugacccu

SEQ ID NO: 908777 - RNA, 20 nt, Human
caccacagaucacaaauuau

SEQ ID NO: 908778 - RNA, 21 nt, Human
cacccaucucacuggaauccc

SEQ ID NO: 908779 - RNA, 19 nt, Human
cagaagagacaagaaaaug

SEQ ID NO: 908780 - RNA, 22 nt, Human
cagaaugaccaagcacucggca

SEQ ID NO: 908781 - RNA, 23 nt, Human
cagauccgaaagugaaauucuua

SEQ ID NO: 908782 - RNA, 18 nt, Human
caggagccuuuguuagug

SEQ ID NO: 908783 - RNA, 21 nt, Human
caguagguuuuccucgcuccc

SEQ ID NO: 908784 - RNA, 31 nt, Human
cauccagcaccugucagaaugaccaagcacc

SEQ ID NO: 908785 - RNA, 24 nt, Human
ccagcaccugucagaaugaccaag

SEQ ID NO: 908786 - RNA, 26 nt, Human
ccucccgugaugaaauugauggggau

SEQ ID NO: 908787 - RNA, 19 nt, Human
ccuguaaggugggggcagg

SEQ ID NO: 908788 - RNA, 19 nt, Human
ccuuuuucuucucucuuuu

SEQ ID NO: 908789 - RNA, 19 nt, Human
cuauggguccuuuuuuccu

SEQ ID NO: 908790 - RNA, 21 nt, Human
cucaaacuugagcgaugaggc

SEQ ID NO: 908791 - RNA, 18 nt, Human
cucaagaacagcacccau

SEQ ID NO: 908792 - RNA, 18 nt, Human
cucaaguucccugaaccu

SEQ ID NO: 908793 - RNA, 21 nt, Human
cucccgugaugaaauugaugg

SEQ ID NO: 908794 - RNA, 18 nt, Human
cugggagagaugauaaug

SEQ ID NO: 908795 - RNA, 27 nt, Human
cuucaacuguagguacaagacaucggg

SEQ ID NO: 908796 - RNA, 21 nt, Human
cuuccugcggcugggggugag

SEQ ID NO: 908797 - RNA, 18 nt, Human
cuugagugccucccuaac

SEQ ID NO: 908798 - RNA, 18 nt, Human
gaagcuuccccagcgcac

SEQ ID NO: 908799 - RNA, 25 nt, Human
gaaucccggcuggcucuccccgagg

SEQ ID NO: 908800 - RNA, 21 nt, Human
gacugcuugcuucagccaggg

SEQ ID NO: 908801 - RNA, 21 nt, Human
gacuucgggaggcucaaacuu

SEQ ID NO: 908802 - RNA, 24 nt, Human
gagccuuuuguugaggugcaaggc

SEQ ID NO: 908803 - RNA, 21 nt, Human
gaggcagcggcggcggcggac

SEQ ID NO: 908804 - RNA, 24 nt, Human
gaggggaccucuuggaggagaggg

SEQ ID NO: 908805 - RNA, 18 nt, Human
gcagcagagcugcagggg

SEQ ID NO: 908806 - RNA, 19 nt, Human
gcagcagagcugcaggggc

SEQ ID NO: 908807 - RNA, 21 nt, Human
gccaaugccuuuuuuuuuuuc

SEQ ID NO: 908808 - RNA, 18 nt, Human
ggagagaugauaaugagc

SEQ ID NO: 908809 - RNA, 22 nt, Human
ggcugggggugagccagggguu

SEQ ID NO: 908810 - RNA, 19 nt, Human
gggagagaugauaaugagc

SEQ ID NO: 908811 - RNA, 21 nt, Human
uacaaaugaccaaagguuuuu

SEQ ID NO: 908812 - RNA, 19 nt, Human
uaggugacagauauugacu

SEQ ID NO: 908813 - RNA, 21 nt, Human
uauagguaaacaguuaaguca

SEQ ID NO: 908814 - RNA, 27 nt, Human
ucaaaacgaaaccauuguuaucucuga

SEQ ID NO: 908815 - RNA, 21 nt, Human
ucaacagaagagacaagaaaa

SEQ ID NO: 908816 - RNA, 18 nt, Human
ucacagccacagggucgu

SEQ ID NO: 908817 - RNA, 20 nt, Human
ucacugucagccugaucacu

SEQ ID NO: 908818 - RNA, 18 nt, Human
ucacuguccccgugccca

SEQ ID NO: 908819 - RNA, 19 nt, Human
ucaggcaguguuuugcugc

SEQ ID NO: 908820 - RNA, 21 nt, Human
ucaguagguuuuccucgcucu

SEQ ID NO: 908821 - RNA, 18 nt, Human
ucagugggcaaguacuga

SEQ ID NO: 908822 - RNA, 21 nt, Human
uccacagacucucugcccaga

SEQ ID NO: 908823 - RNA, 22 nt, Human
uccccggcagucuugcaaaagc

SEQ ID NO: 908824 - RNA, 19 nt, Human
ucugcaaagacccuugcca

SEQ ID NO: 908825 - RNA, 23 nt, Human
ucugguucuuguucaagugguug

SEQ ID NO: 908826 - RNA, 18 nt, Human
ucuuggaggagagggcuc

SEQ ID NO: 908827 - RNA, 23 nt, Human
ugaaaaagaaaucagcaguggaa

SEQ ID NO: 908828 - RNA, 19 nt, Human
ugaaaugucugcuugcugc

SEQ ID NO: 908829 - RNA, 19 nt, Human
ugaaauucuuacuugcugc

SEQ ID NO: 908830 - RNA, 18 nt, Human
ugagcgaugaggcaggcg

SEQ ID NO: 908831 - RNA, 20 nt, Human
ugaucacuguccccgugccc

SEQ ID NO: 908832 - RNA, 21 nt, Human
ugauuggcugcagggaacugu

SEQ ID NO: 908833 - RNA, 24 nt, Human
ugcuugaugcugaggggaccucuu

SEQ ID NO: 908834 - RNA, 23 nt, Human
uggaaagaacauacuugugggca

SEQ ID NO: 908835 - RNA, 21 nt, Human
uggaaugcacaucugcaaaga

SEQ ID NO: 908836 - RNA, 20 nt, Human
uggaggagccagagagggag

SEQ ID NO: 908837 - RNA, 19 nt, Human
ugggggagggagcagggag

SEQ ID NO: 908838 - RNA, 22 nt, Human
uggguccuuuuuucccucugca

SEQ ID NO: 908839 - RNA, 24 nt, Human
ugugaugacugcuagaaauccacc

SEQ ID NO: 908840 - RNA, 22 nt, Human
uguuccuuguguuuauaugugu

SEQ ID NO: 908841 - RNA, 18 nt, Human
uucacuuucucacagcca

SEQ ID NO: 908842 - RNA, 21 nt, Human
uucaguagaagccugugauga

SEQ ID NO: 908843 - RNA, 19 nt, Human
uucucacagccacaggguc

SEQ ID NO: 908844 - RNA, 24 nt, Human
uugggcugcuugaugcugagggga

SEQ ID NO: 908845 - RNA, 27 nt, Human
uugguugggcugcuugaugcugagggg

SEQ ID NO: 908846 - RNA, 25 nt, Human
uuucaucucuccuuuuucuucucuc

SEQ ID NO: 908847 - RNA, 21 nt, Human
uuucccagugggauucacagu

SEQ ID NO: 908848 - RNA, 21 nt, Human
uuuuuuuuguuuuuguuuucg

SEQ ID NO: 908849 - RNA, 23 nt, Human
uuuuuuuuuucuuuuuucacuuu

SEQ ID NO: 908850 - RNA, 22 nt, Human
aaaaaaaucugacugcccacug

SEQ ID NO: 908851 - RNA, 23 nt, Human
aaaaaaaucugacugcccacuga

SEQ ID NO: 908852 - RNA, 21 nt, Human
aaacaacucucuuaagaccaa

SEQ ID NO: 908853 - RNA, 18 nt, Human
aaacauaacuucaggagc

SEQ ID NO: 908854 - RNA, 21 nt, Human
aaacucccuucauaaaaucag

SEQ ID NO: 908855 - RNA, 24 nt, Human
aacaacaucucaauacacuucagu

SEQ ID NO: 908856 - RNA, 19 nt, Human
aaguauuuggauagggaag

SEQ ID NO: 908857 - RNA, 22 nt, Human
aauaaauggaauagaacucccu

SEQ ID NO: 908858 - RNA, 22 nt, Human
aauauagccacucaagaaccaa

SEQ ID NO: 908859 - RNA, 18 nt, Human
aauaucaggauggaucag

SEQ ID NO: 908860 - RNA, 22 nt, Human
aaugaccauuaacuugucuaca

SEQ ID NO: 908861 - RNA, 21 nt, Human
acaacaagugacccacaagcc

SEQ ID NO: 908862 - RNA, 19 nt, Human
acaaucuuuucugcucccu

SEQ ID NO: 908863 - RNA, 19 nt, Human
acaccaacuuuuaaaagcc

SEQ ID NO: 908864 - RNA, 24 nt, Human
acagaaccauaaaacuuguuucuc

SEQ ID NO: 908865 - RNA, 26 nt, Human
acauaacuucaggagcaagggaacgc

SEQ ID NO: 908866 - RNA, 22 nt, Human
accaagagcgccuuccaaucua

SEQ ID NO: 908867 - RNA, 21 nt, Human
acccggucccagccccacccc

SEQ ID NO: 908868 - RNA, 23 nt, Human
agaaaacaccaacuuuuaaaagc

SEQ ID NO: 908869 - RNA, 21 nt, Human
agaaguauaccugucugggga

SEQ ID NO: 908870 - RNA, 20 nt, Human
agacaaaagauaaauggggg

SEQ ID NO: 908871 - RNA, 19 nt, Human
agaggcaaugaaaugagga

SEQ ID NO: 908872 - RNA, 22 nt, Human
agcaauuugcaauaucaaauac

SEQ ID NO: 908873 - RNA, 25 nt, Human
agccaaguggaccaaacuugucaga

SEQ ID NO: 908874 - RNA, 19 nt, Human
agccaauuccagcggcaca

SEQ ID NO: 908875 - RNA, 19 nt, Human
aggauggaucagggugaga

SEQ ID NO: 908876 - RNA, 22 nt, Human
auacagagcaacauggaguucu

SEQ ID NO: 908877 - RNA, 21 nt, Human
aucaaugccaaugccacucua

SEQ ID NO: 908878 - RNA, 19 nt, Human
aucacugugaaaauguaca

SEQ ID NO: 908879 - RNA, 20 nt, Human
aucaugauugggaaacacug

SEQ ID NO: 908880 - RNA, 18 nt, Human
auccuugcucagaaugcc

SEQ ID NO: 908881 - RNA, 21 nt, Human
augaaacaaaugaaaacagaa

SEQ ID NO: 908882 - RNA, 23 nt, Human
auggaucuauagcuugaagauga

SEQ ID NO: 908883 - RNA, 24 nt, Human
augguguuagcugguuuguuugcu

SEQ ID NO: 908884 - RNA, 20 nt, Human
auuuuuuuaagaaaaagaaa

SEQ ID NO: 908885 - RNA, 22 nt, Human
caaaaauaaguaaaacauucaa

SEQ ID NO: 908886 - RNA, 20 nt, Human
caaaaucaaugccaaugcca

SEQ ID NO: 908887 - RNA, 18 nt, Human
caaagcuaauuugcucca

SEQ ID NO: 908888 - RNA, 23 nt, Human
caacaacuucauuaggacaaugu

SEQ ID NO: 908889 - RNA, 23 nt, Human
caagaaaacgaagagagcugcaa

SEQ ID NO: 908890 - RNA, 21 nt, Human
caaggccccaugaacaacuca

SEQ ID NO: 908891 - RNA, 25 nt, Human
caauaugauuccuauuugaaauuaa

SEQ ID NO: 908892 - RNA, 18 nt, Human
cacaacaagugacccaca

SEQ ID NO: 908893 - RNA, 27 nt, Human
caccaacuuuuaaaagccuuuugccau

SEQ ID NO: 908894 - RNA, 18 nt, Human
cacccccucccucaaaac

SEQ ID NO: 908895 - RNA, 20 nt, Human
cacccccucccucaaaaccc

SEQ ID NO: 908896 - RNA, 19 nt, Human
cacuacaaaaaacaguggc

SEQ ID NO: 908897 - RNA, 19 nt, Human
cacuugugcuucugagagg

SEQ ID NO: 908898 - RNA, 23 nt, Human
cagcaaaguagcggcauugggaa

SEQ ID NO: 908899 - RNA, 24 nt, Human
cagccaguggccucucuggcucaa

SEQ ID NO: 908900 - RNA, 25 nt, Human
cagcccaugacgugcuuugcagucu

SEQ ID NO: 908901 - RNA, 21 nt, Human
cagcggcacaagaaaacgaag

SEQ ID NO: 908902 - RNA, 24 nt, Human
cagcuaaacucccuucauaaaauc

SEQ ID NO: 908903 - RNA, 20 nt, Human
caggucggggucgcgagcag

SEQ ID NO: 908904 - RNA, 22 nt, Human
cagucauaugcugaaguaacac

SEQ ID NO: 908905 - RNA, 18 nt, Human
cauacagaucagcauaua

SEQ ID NO: 908906 - RNA, 21 nt, Human
cauacagaucagcauauacaa

SEQ ID NO: 908907 - RNA, 24 nt, Human
cauggaguucucaaucccagccca

SEQ ID NO: 908908 - RNA, 19 nt, Human
caugguguugcucauucau

SEQ ID NO: 908909 - RNA, 21 nt, Human
caugguguugcucauucauuu

SEQ ID NO: 908910 - RNA, 22 nt, Human
cauguuuagagaacaaaaggga

SEQ ID NO: 908911 - RNA, 25 nt, Human
cauguuuagagaacaaaagggagaa

SEQ ID NO: 908912 - RNA, 21 nt, Human
ccaaaaaugacuuucugcaau

SEQ ID NO: 908913 - RNA, 21 nt, Human
ccacccccaaacauccccuuu

SEQ ID NO: 908914 - RNA, 20 nt, Human
ccaucaccacacacauagca

SEQ ID NO: 908915 - RNA, 18 nt, Human
ccauuuaaaacuuggcug

SEQ ID NO: 908916 - RNA, 21 nt, Human
cccaacaucaaggccccauga

SEQ ID NO: 908917 - RNA, 26 nt, Human
cccaagagaaaagcaaaaucaaugcc

SEQ ID NO: 908918 - RNA, 26 nt, Human
cccacccccaaacauccccuuugaau

SEQ ID NO: 908919 - RNA, 23 nt, Human
cccaucccuacugccuuacccac

SEQ ID NO: 908920 - RNA, 19 nt, Human
cccaugaacaacucaagcc

SEQ ID NO: 908921 - RNA, 22 nt, Human
ccccaugaacaacucaagccaa

SEQ ID NO: 908922 - RNA, 26 nt, Human
cccugccucucccuaaacugcccuuu

SEQ ID NO: 908923 - RNA, 21 nt, Human
ccuaccuaaccccaucccuac

SEQ ID NO: 908924 - RNA, 21 nt, Human
ccucaaaacccuucucccucc

SEQ ID NO: 908925 - RNA, 20 nt, Human
ccuuaggugcaauuuuggau

SEQ ID NO: 908926 - RNA, 26 nt, Human
cgagcagacacagagagcagauaggc

SEQ ID NO: 908927 - RNA, 24 nt, Human
cgagcuauccccuucacccugccu

SEQ ID NO: 908928 - RNA, 26 nt, Human
cgagcuucagaaacaaccuuuugggg

SEQ ID NO: 908929 - RNA, 18 nt, Human
cgaucugguaggagacac

SEQ ID NO: 908930 - RNA, 20 nt, Human
cuaaccccaucccuacugcc

SEQ ID NO: 908931 - RNA, 26 nt, Human
cuacagcaaaaagaguuggcuaaauc

SEQ ID NO: 908932 - RNA, 22 nt, Human
cuaccaaaaugaaauaaaucag

SEQ ID NO: 908933 - RNA, 22 nt, Human
cucaagccaaagcuaauuugcu

SEQ ID NO: 908934 - RNA, 18 nt, Human
cugguuuguuugcuaagg

SEQ ID NO: 908935 - RNA, 26 nt, Human
cuuacccacccccucccucaaaaccc

SEQ ID NO: 908936 - RNA, 19 nt, Human
cuugaauugccaacacagc

SEQ ID NO: 908937 - RNA, 20 nt, Human
gagcaacuuuccuguucagg

SEQ ID NO: 908938 - RNA, 20 nt, Human
gagcuuauuaaaggugucca

SEQ ID NO: 908939 - RNA, 18 nt, Human
gcaaaguagcggcauugg

SEQ ID NO: 908940 - RNA, 19 nt, Human
gcagccaguggccucucug

SEQ ID NO: 908941 - RNA, 19 nt, Human
gccaaaaaaaucugacugc

SEQ ID NO: 908942 - RNA, 19 nt, Human
gccaaugccacucuaacca

SEQ ID NO: 908943 - RNA, 20 nt, Human
gccugaaaauuuaaaagaug

SEQ ID NO: 908944 - RNA, 20 nt, Human
ggaauuccagccagaacugc

SEQ ID NO: 908945 - RNA, 19 nt, Human
gggaaacagagaaccacca

SEQ ID NO: 908946 - RNA, 20 nt, Human
guacugcuuacucuaucccu

SEQ ID NO: 908947 - RNA, 19 nt, Human
gucccagccccacccccaa

SEQ ID NO: 908948 - RNA, 23 nt, Human
gugaguauucuccaaguacucaa

SEQ ID NO: 908949 - RNA, 22 nt, Human
guguccagagcuuuuuuuuuuc

SEQ ID NO: 908950 - RNA, 18 nt, Human
uaaaacuuguuucucuag

SEQ ID NO: 908951 - RNA, 19 nt, Human
uaaaucagagggagaaaac

SEQ ID NO: 908952 - RNA, 23 nt, Human
uaacuucaggagcaacuuuccug

SEQ ID NO: 908953 - RNA, 21 nt, Human
uaagaaauaaggauggauuug

SEQ ID NO: 908954 - RNA, 23 nt, Human
uaagaccaaggcagaacaaaggu

SEQ ID NO: 908955 - RNA, 19 nt, Human
uaagggucuuauuacccgg

SEQ ID NO: 908956 - RNA, 22 nt, Human
uaaucaugauugggaaacacug

SEQ ID NO: 908957 - RNA, 22 nt, Human
uaauucacuuuugcacaacaag

SEQ ID NO: 908958 - RNA, 25 nt, Human
uacaacaauagcacagcuagcaaaa

SEQ ID NO: 908959 - RNA, 23 nt, Human
uaccaagaaggcaaacacuagga

SEQ ID NO: 908960 - RNA, 23 nt, Human
uacccacccccucccucaaaacc

SEQ ID NO: 908961 - RNA, 20 nt, Human
uacugccuuacccacccccu

SEQ ID NO: 908962 - RNA, 25 nt, Human
uagcuucauuauaaguucuuuuuca

SEQ ID NO: 908963 - RNA, 22 nt, Human
uaggagacacugccguugagac

SEQ ID NO: 908964 - RNA, 18 nt, Human
uaggcugcaaaaauacua

SEQ ID NO: 908965 - RNA, 23 nt, Human
uauaagccuaagauacagagcaa

SEQ ID NO: 908966 - RNA, 25 nt, Human
ucaaggccccaugaacaacucaagc

SEQ ID NO: 908967 - RNA, 18 nt, Human
ucacagaaugauaaucac

SEQ ID NO: 908968 - RNA, 18 nt, Human
uccaacugaacaccccug

SEQ ID NO: 908969 - RNA, 22 nt, Human
ucccagccccacccccaaacau

SEQ ID NO: 908970 - RNA, 22 nt, Human
ucccuacugccuuacccacccc

SEQ ID NO: 908971 - RNA, 20 nt, Human
ucccucaaaacccuucuccc

SEQ ID NO: 908972 - RNA, 21 nt, Human
uccuugcugcuucaaguggac

SEQ ID NO: 908973 - RNA, 24 nt, Human
ucucuuaagaccaaggcagaacaa

SEQ ID NO: 908974 - RNA, 23 nt, Human
ucuguauccuagccuuccucagc

SEQ ID NO: 908975 - RNA, 24 nt, Human
ucuuuuucagaaauguucuccccu

SEQ ID NO: 908976 - RNA, 24 nt, Human
ugaaaagaaaugaagaaaacccaa

SEQ ID NO: 908977 - RNA, 22 nt, Human
ugaaacaaaugaaaacagaacc

SEQ ID NO: 908978 - RNA, 24 nt, Human
ugaaauuaauucacuuuugcacaa

SEQ ID NO: 908979 - RNA, 23 nt, Human
ugaacaacucaagccaaagcuaa

SEQ ID NO: 908980 - RNA, 19 nt, Human
ugacccacaagccaauucc

SEQ ID NO: 908981 - RNA, 25 nt, Human
ugagacauacuguacuugcaucccu

SEQ ID NO: 908982 - RNA, 23 nt, Human
ugaguucaagugucugagugucu

SEQ ID NO: 908983 - RNA, 18 nt, Human
ugcaugagguaguauuca

SEQ ID NO: 908984 - RNA, 25 nt, Human
ugcuaagguugacagcaacuuucag

SEQ ID NO: 908985 - RNA, 18 nt, Human
ugcuucaaguggaccacu

SEQ ID NO: 908986 - RNA, 18 nt, Human
uggcucaacagccacgug

SEQ ID NO: 908987 - RNA, 22 nt, Human
uggggcgggggggacaugagcc

SEQ ID NO: 908988 - RNA, 22 nt, Human
uuaaagggggaaacagagaacc

SEQ ID NO: 908989 - RNA, 22 nt, Human
uuaauacuaaaaugcauuaaau

SEQ ID NO: 908990 - RNA, 18 nt, Human
uuacaaagccuuccuagu

SEQ ID NO: 908991 - RNA, 20 nt, Human
uuaccaagaaggcaaacacu

SEQ ID NO: 908992 - RNA, 21 nt, Human
uuaugccaguuuuucaaaguc

SEQ ID NO: 908993 - RNA, 25 nt, Human
uucagaaacaaccuuuugggggcuu

SEQ ID NO: 908994 - RNA, 24 nt, Human
uucagagaucuaaauuguauuuuu

SEQ ID NO: 908995 - RNA, 23 nt, Human
uucauuaucaauauaaagccacc

SEQ ID NO: 908996 - RNA, 20 nt, Human
uucauuugcugucucaguug

SEQ ID NO: 908997 - RNA, 21 nt, Human
uucucaaucccagcccaugac

SEQ ID NO: 908998 - RNA, 23 nt, Human
uugaagcagagaaaacacauuua

SEQ ID NO: 908999 - RNA, 18 nt, Human
uugccaucaccacacaca

SEQ ID NO: 909000 - RNA, 18 nt, Human
uugcugcuucaaguggac

SEQ ID NO: 909001 - RNA, 21 nt, Human
uuguauuuuuuaaaaauauuu

SEQ ID NO: 909002 - RNA, 20 nt, Human
uugucagaaugcuuuggggg

SEQ ID NO: 909003 - RNA, 22 nt, Human
uuguuugcacuuuguuuuuguc

SEQ ID NO: 909004 - RNA, 21 nt, Human
uuugcuccaacugaacacccc

SEQ ID NO: 909005 - RNA, 19 nt, Human
uuuuaaauguaauccucca

SEQ ID NO: 909006 - RNA, 19 nt, Human
uuuucugcucccugguucc

SEQ ID NO: 909007 - RNA, 24 nt, Human
aaacaacaacaaaaagauaaguac

SEQ ID NO: 909008 - RNA, 22 nt, Human
aaacaaccaguaguguacacaa

SEQ ID NO: 909009 - RNA, 19 nt, Human
aaaugguagucaacaaacc

SEQ ID NO: 909010 - RNA, 19 nt, Human
aacaaacaaaugacaggca

SEQ ID NO: 909011 - RNA, 25 nt, Human
aacauuucucuguguuauuccacca

SEQ ID NO: 909012 - RNA, 20 nt, Human
aaccuaaacaacaacaaaaa

SEQ ID NO: 909013 - RNA, 21 nt, Human
aagcaaacagaaagcaauucg

SEQ ID NO: 909014 - RNA, 19 nt, Human
aagcccauguucaaauaua

SEQ ID NO: 909015 - RNA, 21 nt, Human
aauccaaaaccaaagaaagga

SEQ ID NO: 909016 - RNA, 25 nt, Human
aauucacuuuuaauaugauuucuau

SEQ ID NO: 909017 - RNA, 21 nt, Human
acagaaagcaauucgaguaca

SEQ ID NO: 909018 - RNA, 21 nt, Human
acagaugcaugaugccaaaaa

SEQ ID NO: 909019 - RNA, 19 nt, Human
acccaauguuuaauugagu

SEQ ID NO: 909020 - RNA, 18 nt, Human
agaaagaaauuaugaaaa

SEQ ID NO: 909021 - RNA, 24 nt, Human
agcuuuuuuuuuuuuuuuuuuuaa

SEQ ID NO: 909022 - RNA, 19 nt, Human
auaaaucacugaugaaaua

SEQ ID NO: 909023 - RNA, 21 nt, Human
auauauguauguauauaucua

SEQ ID NO: 909024 - RNA, 24 nt, Human
augaagaauauauauauguaugua

SEQ ID NO: 909025 - RNA, 22 nt, Human
augaagcaacuaaagauugaag

SEQ ID NO: 909026 - RNA, 19 nt, Human
caaaaccaaagaaaggaag

SEQ ID NO: 909027 - RNA, 24 nt, Human
caaaaccaaagaaaggaagccaga

SEQ ID NO: 909028 - RNA, 22 nt, Human
caaacagaaagcaauucgagua

SEQ ID NO: 909029 - RNA, 19 nt, Human
caaaccuaaacaacaacaa

SEQ ID NO: 909030 - RNA, 22 nt, Human
caaaccuaaacaacaacaaaaa

SEQ ID NO: 909031 - RNA, 22 nt, Human
caaaggagcagcugaugcccuc

SEQ ID NO: 909032 - RNA, 19 nt, Human
caacugccaaguacaauac

SEQ ID NO: 909033 - RNA, 25 nt, Human
caacugccaaguacaauaccccagu

SEQ ID NO: 909034 - RNA, 21 nt, Human
caagcuuuuuuuuuuuuuuuu

SEQ ID NO: 909035 - RNA, 21 nt, Human
caagcuuuuuuuuuuuuuuuu

SEQ ID NO: 909036 - RNA, 23 nt, Human
cacauuuaacccuaaaaacaaac

SEQ ID NO: 909037 - RNA, 21 nt, Human
caguauaacuuucauauaaaa

SEQ ID NO: 909038 - RNA, 22 nt, Human
cauauaaaaggcccaacuaaaa

SEQ ID NO: 909039 - RNA, 18 nt, Human
ccaagcuuuuuuuuuuuu

SEQ ID NO: 909040 - RNA, 19 nt, Human
ccagcucacucccagggcc

SEQ ID NO: 909041 - RNA, 20 nt, Human
ccagcucacucccagggccu

SEQ ID NO: 909042 - RNA, 22 nt, Human
ccccaguuuccugcaaaggagc

SEQ ID NO: 909043 - RNA, 20 nt, Human
ccucuuguggugacaggaau

SEQ ID NO: 909044 - RNA, 22 nt, Human
cgggcaccagcucacucccagg

SEQ ID NO: 909045 - RNA, 20 nt, Human
cuaaaaacaaacaaaugaca

SEQ ID NO: 909046 - RNA, 23 nt, Human
cuaaacaacaacaaaaagauaag

SEQ ID NO: 909047 - RNA, 21 nt, Human
cuucuggcuguuuuucuuggg

SEQ ID NO: 909048 - RNA, 22 nt, Human
gaagcaacuaaagauugaagca

SEQ ID NO: 909049 - RNA, 19 nt, Human
gguagucaacaaaccuaaa

SEQ ID NO: 909050 - RNA, 24 nt, Human
guacacaagccucuagaagaauuc

SEQ ID NO: 909051 - RNA, 18 nt, Human
guacagaugcaugaugcc

SEQ ID NO: 909052 - RNA, 18 nt, Human
gugcagugguaaagcaaa

SEQ ID NO: 909053 - RNA, 19 nt, Human
guggaauacucuucagcag

SEQ ID NO: 909054 - RNA, 22 nt, Human
guuacccacauuuaacccuaaa

SEQ ID NO: 909055 - RNA, 22 nt, Human
uaaaaaugcuguacacauuuua

SEQ ID NO: 909056 - RNA, 28 nt, Human
uaaaacaaccaguaguguaacuaacgag

SEQ ID NO: 909057 - RNA, 21 nt, Human
uaaaaggcccaacuaaaacaa

SEQ ID NO: 909058 - RNA, 25 nt, Human
uaaguacaguauaacuuucauauaa

SEQ ID NO: 909059 - RNA, 20 nt, Human
uauauauauguauguauaua

SEQ ID NO: 909060 - RNA, 26 nt, Human
ucaacaaaccuaaacaacaacaaaaa

SEQ ID NO: 909061 - RNA, 21 nt, Human
uccaaaaccaaagaaaggaag

SEQ ID NO: 909062 - RNA, 23 nt, Human
uccaaaaccaaagaaaggaagcc

SEQ ID NO: 909063 - RNA, 21 nt, Human
uccuauagcuguuaguacuuc

SEQ ID NO: 909064 - RNA, 24 nt, Human
ucgcacuucuuuuuaaugccuucu

SEQ ID NO: 909065 - RNA, 22 nt, Human
ugaagaauauauauauguaugu

SEQ ID NO: 909066 - RNA, 21 nt, Human
ugaauugaaagugauaaauca

SEQ ID NO: 909067 - RNA, 21 nt, Human
ugccaaaaaguaaaaugaucc

SEQ ID NO: 909068 - RNA, 18 nt, Human
ugccaaguacaauacccc

SEQ ID NO: 909069 - RNA, 19 nt, Human
uggaacugccaucaacaca

SEQ ID NO: 909070 - RNA, 24 nt, Human
uggaugauuucaagccuauaaaag

SEQ ID NO: 909071 - RNA, 21 nt, Human
ugguaaagcaaacagaaagca

SEQ ID NO: 909072 - RNA, 22 nt, Human
uguauguauauaucuauuuccc

SEQ ID NO: 909073 - RNA, 27 nt, Human
uguuccauuuuucuuaccuuacuccca

SEQ ID NO: 909074 - RNA, 27 nt, Human
uuaaaaaugcuguacacauuuuauaac

SEQ ID NO: 909075 - RNA, 19 nt, Human
uuccugcaaaggagcagcu

SEQ ID NO: 909076 - RNA, 22 nt, Human
uugcuucuggcuguuuuucuug

SEQ ID NO: 909077 - RNA, 22 nt, Human
uuuaacccuaaaaacaaacaaa

SEQ ID NO: 909078 - RNA, 24 nt, Human
uuuaauccaaaaccaaagaaagga

SEQ ID NO: 909079 - RNA, 20 nt, Human
uuuuaaugccuucucuuuca

SEQ ID NO: 909080 - RNA, 20 nt, Human
aaacauggcuauguaacacc

SEQ ID NO: 909081 - RNA, 21 nt, Human
aaucaaaaccucagauuucug

SEQ ID NO: 909082 - RNA, 20 nt, Human
acacaccaaaaguauaugaa

SEQ ID NO: 909083 - RNA, 22 nt, Human
gcaguuggaaagaauuaaaacc

SEQ ID NO: 909084 - RNA, 19 nt, Human
ggaaauguagauaugccuu

SEQ ID NO: 909085 - RNA, 19 nt, Human
uaaaaccacagggguauac

SEQ ID NO: 909086 - RNA, 20 nt, Human
uaaacuaauagaaacauggc

SEQ ID NO: 909087 - RNA, 22 nt, Human
uaacacaccaaaaguauaugaa

SEQ ID NO: 909088 - RNA, 19 nt, Human
ugagaugcaagcucugaaa

SEQ ID NO: 909089 - RNA, 23 nt, Human
ugaugaaacauuguaaaaccaca

SEQ ID NO: 909090 - RNA, 22 nt, Human
aucaaauaacggucugucuuca

SEQ ID NO: 909091 - RNA, 24 nt, Human
auggcggcggcaguggcggcuccu

SEQ ID NO: 909092 - RNA, 21 nt, Human
cagacacaaaauggcggcggc

SEQ ID NO: 909093 - RNA, 27 nt, Human
caguggcggcuccagcuccgaaaaugu

SEQ ID NO: 909094 - RNA, 19 nt, Human
ccagcuccgaaaaugucug

SEQ ID NO: 909095 - RNA, 27 nt, Human
ccccgccucccuuccgacuccucuucc

SEQ ID NO: 909096 - RNA, 18 nt, Human
ccuucaaaaaucaucuuc

SEQ ID NO: 909097 - RNA, 20 nt, Human
cgccgccgucucgcggguga

SEQ ID NO: 909098 - RNA, 24 nt, Human
cgccgcggccccccuccgaggucc

SEQ ID NO: 909099 - RNA, 20 nt, Human
cgcgggugaucuccguccac

SEQ ID NO: 909100 - RNA, 21 nt, Human
cggcggcaguggcggcuccag

SEQ ID NO: 909101 - RNA, 27 nt, Human
cggcuccagcuccgaaaaugucugugu

SEQ ID NO: 909102 - RNA, 22 nt, Human
cggcuucaccacaugcugaccg

SEQ ID NO: 909103 - RNA, 20 nt, Human
cuccggcuucaccacaugcu

SEQ ID NO: 909104 - RNA, 23 nt, Human
cucucucgcggcuccggcuucac

SEQ ID NO: 909105 - RNA, 24 nt, Human
gaagccgcucuggauaccccgccu

SEQ ID NO: 909106 - RNA, 25 nt, Human
gcggcggcaguggcggcuccagcuc

SEQ ID NO: 909107 - RNA, 21 nt, Human
gcuccggcuucaccacaugcu

SEQ ID NO: 909108 - RNA, 20 nt, Human
ggggaugggggacgacacag

SEQ ID NO: 909109 - RNA, 23 nt, Human
gggggacgacacagggggaaccu

SEQ ID NO: 909110 - RNA, 22 nt, Human
ggggggaugggggacgacacag

SEQ ID NO: 909111 - RNA, 21 nt, Human
uccacagacacaaaauggcgg

SEQ ID NO: 909112 - RNA, 20 nt, Human
ucccuuccgacuccucuucc

SEQ ID NO: 909113 - RNA, 21 nt, Human
uccguccacuuccagccgcca

SEQ ID NO: 909114 - RNA, 19 nt, Human
uccucuuccucuccccggc

SEQ ID NO: 909115 - RNA, 21 nt, Human
ucgcgggugaucuccguccac

SEQ ID NO: 909116 - RNA, 21 nt, Human
ucuccguccacuuccagccgc

SEQ ID NO: 909117 - RNA, 18 nt, Human
ucugucuucagcuaaagc

SEQ ID NO: 909118 - RNA, 18 nt, Human
ucugucuucagcuaaagc

SEQ ID NO: 909119 - RNA, 18 nt, Human
uggcggcggcaguggcgg

SEQ ID NO: 909120 - RNA, 22 nt, Human
uuuuuuuuuuuuuuuuuccgga

SEQ ID NO: 909121 - RNA, 24 nt, Human
uuuuuuuuuuuuuuuuuccggagu

SEQ ID NO: 909122 - RNA, 25 nt, Human
uuuuuuuuuuuuuuuuuuuuuccgg

SEQ ID NO: 909123 - RNA, 22 nt, Human
aggggcugcgggguggccagga

SEQ ID NO: 909124 - RNA, 21 nt, Human
aggugccuucccuauucccag

SEQ ID NO: 909125 - RNA, 18 nt, Human
caccugggcaggggcugc

SEQ ID NO: 909126 - RNA, 24 nt, Human
caggaaccgagcggagccggggag

SEQ ID NO: 909127 - RNA, 18 nt, Human
ccggggagguauggaagg

SEQ ID NO: 909128 - RNA, 18 nt, Human
gccuucccuauucccaga

SEQ ID NO: 909129 - RNA, 21 nt, Human
ucccuauucccagaugagggu

SEQ ID NO: 909130 - RNA, 22 nt, Human
ugcaaggugccuucccuauucc

SEQ ID NO: 909131 - RNA, 18 nt, Human
ugcuauguccucuugcua

SEQ ID NO: 909132 - RNA, 18 nt, Human
agcuggccucaagagccc

SEQ ID NO: 909133 - RNA, 19 nt, Human
augauaauggcaaaauauc

SEQ ID NO: 909134 - RNA, 19 nt, Human
cagcagggauuacuuuuau

SEQ ID NO: 909135 - RNA, 20 nt, Human
cauuuggaacuaggagggga

SEQ ID NO: 909136 - RNA, 23 nt, Human
ccucaagagccccgcaguccucc

SEQ ID NO: 909137 - RNA, 20 nt, Human
ucucugcucagauuuuguuc

SEQ ID NO: 909138 - RNA, 19 nt, Human
ugauaauggcaaaauaucu

SEQ ID NO: 909139 - RNA, 23 nt, Human
uuuccuaugaccagcagggauug

SEQ ID NO: 909140 - RNA, 18 nt, Human
aacaagagugacagaccu

SEQ ID NO: 909141 - RNA, 21 nt, Human
acaaucaccaaacaaacccaa

SEQ ID NO: 909142 - RNA, 18 nt, Human
agagugacagaccugaaa

SEQ ID NO: 909143 - RNA, 18 nt, Human
agcggaagggccagagga

SEQ ID NO: 909144 - RNA, 20 nt, Human
agggccagaggaauuaagcu

SEQ ID NO: 909145 - RNA, 23 nt, Human
auaaauacacacagcagcuucau

SEQ ID NO: 909146 - RNA, 19 nt, Human
cacacagcagcuucauuag

SEQ ID NO: 909147 - RNA, 18 nt, Human
cagcacagaggacauugg

SEQ ID NO: 909148 - RNA, 22 nt, Human
cagcuucauuagagauuucaau

SEQ ID NO: 909149 - RNA, 19 nt, Human
ccuuuugaauguacacaau

SEQ ID NO: 909150 - RNA, 22 nt, Human
cugaaauuacaaucaccaaaca

SEQ ID NO: 909151 - RNA, 18 nt, Human
cugcuaccuacauuuacc

SEQ ID NO: 909152 - RNA, 21 nt, Human
gacagaccugaaauuacaauc

SEQ ID NO: 909153 - RNA, 18 nt, Human
guauuaggagagccuuuu

SEQ ID NO: 909154 - RNA, 23 nt, Human
ucauauauauuuucucucuuccu

SEQ ID NO: 909155 - RNA, 23 nt, Human
ugaauguacacaauguaacaaga

SEQ ID NO: 909156 - RNA, 23 nt, Human
ugcacugcuaccuacauuuaccu

SEQ ID NO: 909157 - RNA, 21 nt, Human
ugcagaacgucucacuccuga

SEQ ID NO: 909158 - RNA, 22 nt, Human
uguaacugagaagcggaagggc

SEQ ID NO: 909159 - RNA, 21 nt, Human
aaaaaaaagcggcuccaaaga

SEQ ID NO: 909160 - RNA, 27 nt, Human
aaaaaacaagagaagcacauucaaaag

SEQ ID NO: 909161 - RNA, 23 nt, Human
aaaaaauaaaaacagccaaauac

SEQ ID NO: 909162 - RNA, 24 nt, Human
aaaaagcggcuccaaagauagucu

SEQ ID NO: 909163 - RNA, 21 nt, Human
aaaaauacaaaacaaacaccc

SEQ ID NO: 909164 - RNA, 22 nt, Human
aaaacaaaugcccauaaggaaa

SEQ ID NO: 909165 - RNA, 26 nt, Human
aaaagaaaaaaaaagcggcuccaaag

SEQ ID NO: 909166 - RNA, 23 nt, Human
aaaauacaaaacaaacacccuac

SEQ ID NO: 909167 - RNA, 20 nt, Human
aaacaagagaagcacauuca

SEQ ID NO: 909168 - RNA, 19 nt, Human
aaacaggaaaauggacaaa

SEQ ID NO: 909169 - RNA, 27 nt, Human
aaacaggaaaauggacaaaagggaccc

SEQ ID NO: 909170 - RNA, 22 nt, Human
aaagcggcuccaaagauagucu

SEQ ID NO: 909171 - RNA, 22 nt, Human
aacacccuacaauacacaaauc

SEQ ID NO: 909172 - RNA, 23 nt, Human
aacacccuacaauacacaaaucu

SEQ ID NO: 909173 - RNA, 23 nt, Human
aacagucugaagcugccuccaaa

SEQ ID NO: 909174 - RNA, 20 nt, Human
aagcggcuccaaagauaguc

SEQ ID NO: 909175 - RNA, 19 nt, Human
aaucacaugaaacuacaaa

SEQ ID NO: 909176 - RNA, 25 nt, Human
aauuucaaacucucauuuauuagug

SEQ ID NO: 909177 - RNA, 27 nt, Human
acaauacaaaaauacaaaacaaacacc

SEQ ID NO: 909178 - RNA, 18 nt, Human
acacccaccccacacccc

SEQ ID NO: 909179 - RNA, 23 nt, Human
acccaccccacaccccaauuuca

SEQ ID NO: 909180 - RNA, 22 nt, Human
accccacaccccaauuucaaaa

SEQ ID NO: 909181 - RNA, 24 nt, Human
agaaaaaaaaagcggcuccaaaga

SEQ ID NO: 909182 - RNA, 20 nt, Human
agacccauuaaggugaagug

SEQ ID NO: 909183 - RNA, 22 nt, Human
auaaacaaaaaacaagagaagc

SEQ ID NO: 909184 - RNA, 24 nt, Human
auacugauuuacuuugguagcaaa

SEQ ID NO: 909185 - RNA, 23 nt, Human
aucucagucauuucucucuccca

SEQ ID NO: 909186 - RNA, 20 nt, Human
augcuuuugucugugacuau

SEQ ID NO: 909187 - RNA, 25 nt, Human
caaaaaacaagagaagcacauucaa

SEQ ID NO: 909188 - RNA, 22 nt, Human
caaaaauacaaaacaaacaccc

SEQ ID NO: 909189 - RNA, 23 nt, Human
caaaaauacaaaacaaacacccu

SEQ ID NO: 909190 - RNA, 19 nt, Human
cacaggcugcuucucugga

SEQ ID NO: 909191 - RNA, 28 nt, Human
cacccaccccacaccccaauuucaaaac

SEQ ID NO: 909192 - RNA, 22 nt, Human
caccccaauuucaaaacaucau

SEQ ID NO: 909193 - RNA, 26 nt, Human
caccccacaccccaauuucaaaacau

SEQ ID NO: 909194 - RNA, 24 nt, Human
cagucugaagcugccuccaaauau

SEQ ID NO: 909195 - RNA, 20 nt, Human
caugaaacuacaaaauuagc

SEQ ID NO: 909196 - RNA, 18 nt, Human
ccaccccacaccccaauu

SEQ ID NO: 909197 - RNA, 19 nt, Human
ccaccccacaccccaauuu

SEQ ID NO: 909198 - RNA, 18 nt, Human
cccacaccccaauuucaa

SEQ ID NO: 909199 - RNA, 21 nt, Human
cccacaccccaauuucaaaac

SEQ ID NO: 909200 - RNA, 23 nt, Human
ccccacaccccaauuucaaaaca

SEQ ID NO: 909201 - RNA, 19 nt, Human
ccuacaauacacaaaucua

SEQ ID NO: 909202 - RNA, 21 nt, Human
cuagcuaauaaacaaaaaaca

SEQ ID NO: 909203 - RNA, 23 nt, Human
cuagcuaauaaacaaaaaacaag

SEQ ID NO: 909204 - RNA, 24 nt, Human
cucagcaagcagcuaccaccaaua

SEQ ID NO: 909205 - RNA, 24 nt, Human
cuuuuaaaaaauaaaaacagccaa

SEQ ID NO: 909206 - RNA, 22 nt, Human
gaaaaaaaaagcggcuccaaag

SEQ ID NO: 909207 - RNA, 22 nt, Human
gaagaugcauuuucuuuccuuc

SEQ ID NO: 909208 - RNA, 21 nt, Human
gguaauaagggaguuaagaga

SEQ ID NO: 909209 - RNA, 24 nt, Human
gucaauaguucaguaacauuuucu

SEQ ID NO: 909210 - RNA, 23 nt, Human
uaaaaaaaaaaucuuuuaagagc

SEQ ID NO: 909211 - RNA, 21 nt, Human
uaaaaaaaguucauauacaau

SEQ ID NO: 909212 - RNA, 18 nt, Human
uaaaaaauaaaaacagcc

SEQ ID NO: 909213 - RNA, 22 nt, Human
uaaaagaaacagcuuccuuacg

SEQ ID NO: 909214 - RNA, 19 nt, Human
uaacaaaguauauguggug

SEQ ID NO: 909215 - RNA, 22 nt, Human
uacaaaaauacaaaacaaacac

SEQ ID NO: 909216 - RNA, 26 nt, Human
uacaaaaauacaaaacaaacacccua

SEQ ID NO: 909217 - RNA, 23 nt, Human
uacaaaauuagcaaaugucuuga

SEQ ID NO: 909218 - RNA, 23 nt, Human
uacaauacaaaaauacaaaacaa

SEQ ID NO: 909219 - RNA, 25 nt, Human
uaccaccaauaaaacagucugaagc

SEQ ID NO: 909220 - RNA, 18 nt, Human
uaggagagguauguuauu

SEQ ID NO: 909221 - RNA, 30 nt, Human
uccacggauagcaaugcaauaccuaguuuu

SEQ ID NO: 909222 - RNA, 24 nt, Human
ucccaauacaauacucccucucuc

SEQ ID NO: 909223 - RNA, 28 nt, Human
ugaaaaagaaaaaaaaagcggcuccaaa

SEQ ID NO: 909224 - RNA, 20 nt, Human
ugacuugaaacaaaacaaau

SEQ ID NO: 909225 - RNA, 22 nt, Human
ugacuugaaacaaaacaaaugc

SEQ ID NO: 909226 - RNA, 24 nt, Human
ugacuugaaacaaaacaaaugccc

SEQ ID NO: 909227 - RNA, 25 nt, Human
ugauuucuuuauuaucuguaaccuu

SEQ ID NO: 909228 - RNA, 19 nt, Human
uggaaacuaaucacaugaa

SEQ ID NO: 909229 - RNA, 23 nt, Human
ugguggaaaugcuuacaggaacu

SEQ ID NO: 909230 - RNA, 21 nt, Human
ugucugugacuaugcuuuuaa

SEQ ID NO: 909231 - RNA, 19 nt, Human
uguguuuuaaaagaaacag

SEQ ID NO: 909232 - RNA, 25 nt, Human
uuaaaguaaguuaaauucauguauc

SEQ ID NO: 909233 - RNA, 21 nt, Human
uucaaauauucaacaguuuac

SEQ ID NO: 909234 - RNA, 21 nt, Human
uuuacacccaccccacacccc

SEQ ID NO: 909235 - RNA, 19 nt, Human
uuuccauugucuuacuugg

SEQ ID NO: 909236 - RNA, 19 nt, Human
acaaaacaacaggaagcca

SEQ ID NO: 909237 - RNA, 26 nt, Human
acaaaacaacaggaagccauucucug

SEQ ID NO: 909238 - RNA, 23 nt, Human
acacagccagggcucaugggagu

SEQ ID NO: 909239 - RNA, 22 nt, Human
agcuuccuugggaaaagggaaa

SEQ ID NO: 909240 - RNA, 19 nt, Human
aggcaggaaggauggaucu

SEQ ID NO: 909241 - RNA, 20 nt, Human
aggcaggaaggauggaucug

SEQ ID NO: 909242 - RNA, 22 nt, Human
agggaaaaacaaaucuuuuccu

SEQ ID NO: 909243 - RNA, 23 nt, Human
augggagugagugcccgucaccu

SEQ ID NO: 909244 - RNA, 18 nt, Human
cacaaacaaaacagugau

SEQ ID NO: 909245 - RNA, 19 nt, Human
cacaacagcacacagccag

SEQ ID NO: 909246 - RNA, 20 nt, Human
cacguuaagaaaauaaacaa

SEQ ID NO: 909247 - RNA, 28 nt, Human
ccgauaggcacacaacagcacacagcca

SEQ ID NO: 909248 - RNA, 24 nt, Human
ccuugggaaaagggaaaaacaaau

SEQ ID NO: 909249 - RNA, 22 nt, Human
cguuaagaaaauaaacaaaaca

SEQ ID NO: 909250 - RNA, 19 nt, Human
gaaggucaugggccuaaaa

SEQ ID NO: 909251 - RNA, 24 nt, Human
ggaaaaacaaaucuuuuccucaaa

SEQ ID NO: 909252 - RNA, 23 nt, Human
uaagaaaauaaacaaaacaacag

SEQ ID NO: 909253 - RNA, 24 nt, Human
uacacguuaagaaaauaaacaaaa

SEQ ID NO: 909254 - RNA, 20 nt, Human
uagaaaaugcuccagcuggc

SEQ ID NO: 909255 - RNA, 18 nt, Human
ucaaggcaucugggggcu

SEQ ID NO: 909256 - RNA, 18 nt, Human
ucaaggcaucugggggcu

SEQ ID NO: 909257 - RNA, 19 nt, Human
uccgcgcgggccgcccggc

SEQ ID NO: 909258 - RNA, 20 nt, Human
uccgcgcgggccgcccggcg

SEQ ID NO: 909259 - RNA, 22 nt, Human
uccuuggaggcaggaaggaugg

SEQ ID NO: 909260 - RNA, 18 nt, Human
ucucuguguauccuccuu

SEQ ID NO: 909261 - RNA, 24 nt, Human
ugaguuguuuuguuuuuauuuuua

SEQ ID NO: 909262 - RNA, 18 nt, Human
ugcuccagcuggcuuugc

SEQ ID NO: 909263 - RNA, 23 nt, Human
uucucuguguauccuccuuggag

SEQ ID NO: 909264 - RNA, 27 nt, Human
uucucuguguauccuccuuggaggcag

SEQ ID NO: 909265 - RNA, 20 nt, Human
aaugggcugcugaagaaaug

SEQ ID NO: 909266 - RNA, 22 nt, Human
auucuauuagccaagugccacc

SEQ ID NO: 909267 - RNA, 19 nt, Human
caguugcuaaugggcugcu

SEQ ID NO: 909268 - RNA, 24 nt, Human
ccaccugucacuaugaaacuaucc

SEQ ID NO: 909269 - RNA, 20 nt, Human
ccugucacuaugaaacuauc

SEQ ID NO: 909270 - RNA, 27 nt, Human
cuccggggucccuggguggggcaaauc

SEQ ID NO: 909271 - RNA, 19 nt, Human
cuguaggacaucccugggc

SEQ ID NO: 909272 - RNA, 20 nt, Human
gauuucacaagaaggguccg

SEQ ID NO: 909273 - RNA, 19 nt, Human
uaggacaucccugggcucu

SEQ ID NO: 909274 - RNA, 21 nt, Human
uaggacaucccugggcucuca

SEQ ID NO: 909275 - RNA, 18 nt, Human
ucccugggcucucaguug

SEQ ID NO: 909276 - RNA, 18 nt, Human
uccggggucccugggugg

SEQ ID NO: 909277 - RNA, 20 nt, Human
uccuguaggacaucccuggg

SEQ ID NO: 909278 - RNA, 22 nt, Human
ucucaguugcuaaugggcugcu

SEQ ID NO: 909279 - RNA, 18 nt, Human
uuuuuuuuuuuuuuuuug

SEQ ID NO: 909280 - RNA, 21 nt, Human
aaagcagcauagccugaaccc

SEQ ID NO: 909281 - RNA, 19 nt, Human
aacaacacccugagugcac

SEQ ID NO: 909282 - RNA, 20 nt, Human
aacacccugagugcacccuc

SEQ ID NO: 909283 - RNA, 20 nt, Human
aagaagucggccaacgcccc

SEQ ID NO: 909284 - RNA, 21 nt, Human
aagcagcauagccugaaccca

SEQ ID NO: 909285 - RNA, 25 nt, Human
aagcagcauagccugaacccaaaac

SEQ ID NO: 909286 - RNA, 28 nt, Human
aagcagcauagccugaacccaaaacugu

SEQ ID NO: 909287 - RNA, 20 nt, Human
aagcaggaaagcuaaccuaa

SEQ ID NO: 909288 - RNA, 22 nt, Human
aaggcagaagauaaaagcagga

SEQ ID NO: 909289 - RNA, 21 nt, Human
acauagggaggcgcucccugc

SEQ ID NO: 909290 - RNA, 23 nt, Human
acccgcuccacugcgccuauccc

SEQ ID NO: 909291 - RNA, 21 nt, Human
accuaugggccagcccucccu

SEQ ID NO: 909292 - RNA, 23 nt, Human
acgagacgcucuaacaacacccu

SEQ ID NO: 909293 - RNA, 18 nt, Human
acgccccccaagcaaccc

SEQ ID NO: 909294 - RNA, 27 nt, Human
acgccccccaagcaacccgcuccacug

SEQ ID NO: 909295 - RNA, 20 nt, Human
agcagcaccuaugggccagc

SEQ ID NO: 909296 - RNA, 18 nt, Human
aggaagccaacaccuaga

SEQ ID NO: 909297 - RNA, 18 nt, Human
aggaggcguguguccuug

SEQ ID NO: 909298 - RNA, 18 nt, Human
augccagcggcacagggg

SEQ ID NO: 909299 - RNA, 23 nt, Human
caaaacugugaccagagaauccc

SEQ ID NO: 909300 - RNA, 20 nt, Human
caaagcagcauagccugaac

SEQ ID NO: 909301 - RNA, 21 nt, Human
caaagcagcauagccugaacc

SEQ ID NO: 909302 - RNA, 23 nt, Human
caaagcagcauagccugaaccca

SEQ ID NO: 909303 - RNA, 23 nt, Human
cagcaccuaugggccagcccucc

SEQ ID NO: 909304 - RNA, 18 nt, Human
cagcucccgccgcccgua

SEQ ID NO: 909305 - RNA, 26 nt, Human
cagguccccaaggcagaagauaaaag

SEQ ID NO: 909306 - RNA, 25 nt, Human
ccaaaacugugaccagagaauccca

SEQ ID NO: 909307 - RNA, 20 nt, Human
ccaaggcagaagauaaaagc

SEQ ID NO: 909308 - RNA, 24 nt, Human
ccaaggcagaagauaaaagcagga

SEQ ID NO: 909309 - RNA, 19 nt, Human
ccagcccucccuccaaaag

SEQ ID NO: 909310 - RNA, 26 nt, Human
ccagcccucccuccaaaaggcagccu

SEQ ID NO: 909311 - RNA, 22 nt, Human
cccaaaacugugaccagagaau

SEQ ID NO: 909312 - RNA, 22 nt, Human
cccaagcaacccgcuccacugc

SEQ ID NO: 909313 - RNA, 23 nt, Human
cccaaggcagaagauaaaagcag

SEQ ID NO: 909314 - RNA, 22 nt, Human
ccccacggugcucagcaggaau

SEQ ID NO: 909315 - RNA, 19 nt, Human
cccccaagcaacccgcucc

SEQ ID NO: 909316 - RNA, 20 nt, Human
cccccaagcaacccgcucca

SEQ ID NO: 909317 - RNA, 22 nt, Human
ccccugcucccugggugcccca

SEQ ID NO: 909318 - RNA, 20 nt, Human
cccugggugccccacggugc

SEQ ID NO: 909319 - RNA, 23 nt, Human
ccuaaccccaggcucucuaagga

SEQ ID NO: 909320 - RNA, 18 nt, Human
ccuauguccucuguguuc

SEQ ID NO: 909321 - RNA, 18 nt, Human
ccugcucccugggugccc

SEQ ID NO: 909322 - RNA, 20 nt, Human
cgagacgcucuaacaacacc

SEQ ID NO: 909323 - RNA, 22 nt, Human
cgccccccaagcaacccgcucc

SEQ ID NO: 909324 - RNA, 22 nt, Human
cgccgcccguaucccgcuuggc

SEQ ID NO: 909325 - RNA, 24 nt, Human
cuaagaagucggccaacgcccccc

SEQ ID NO: 909326 - RNA, 24 nt, Human
cuauaggaacgaguaggggugcgu

SEQ ID NO: 909327 - RNA, 21 nt, Human
cucacgcugcugagauggacc

SEQ ID NO: 909328 - RNA, 21 nt, Human
cuccaaaaggcagccugugcc

SEQ ID NO: 909329 - RNA, 21 nt, Human
cucccgccgcccguaucccgc

SEQ ID NO: 909330 - RNA, 22 nt, Human
cugaacccaaaacugugaccag

SEQ ID NO: 909331 - RNA, 25 nt, Human
gacuugcaggcuuccucggggggug

SEQ ID NO: 909332 - RNA, 19 nt, Human
gaggacacggguccugagg

SEQ ID NO: 909333 - RNA, 21 nt, Human
gcauagccugaacccaaaacu

SEQ ID NO: 909334 - RNA, 21 nt, Human
gccccccaagcaacccgcucc

SEQ ID NO: 909335 - RNA, 24 nt, Human
gcccgcugccaggcccgcugucuc

SEQ ID NO: 909336 - RNA, 18 nt, Human
ggcccagcugguggcggg

SEQ ID NO: 909337 - RNA, 23 nt, Human
ggggaccucuucucaccagaggg

SEQ ID NO: 909338 - RNA, 22 nt, Human
ggguuuccuauguccucugugu

SEQ ID NO: 909339 - RNA, 18 nt, Human
uaaaagcaggaaagcuaa

SEQ ID NO: 909340 - RNA, 24 nt, Human
uaaaagcaggaaagcuaaccuaac

SEQ ID NO: 909341 - RNA, 25 nt, Human
uaacaacacccugagugcacccuca

SEQ ID NO: 909342 - RNA, 22 nt, Human
uaagaagucggccaacgccccc

SEQ ID NO: 909343 - RNA, 18 nt, Human
uagugcacauaaaaaggg

SEQ ID NO: 909344 - RNA, 20 nt, Human
ucaguguguggugcucugag

SEQ ID NO: 909345 - RNA, 18 nt, Human
uccccagcucccgccgcc

SEQ ID NO: 909346 - RNA, 21 nt, Human
uccccagcucccgccgcccgu

SEQ ID NO: 909347 - RNA, 26 nt, Human
uccccagcucccgccgcccguauccc

SEQ ID NO: 909348 - RNA, 19 nt, Human
ucccgcuuggccccucguc

SEQ ID NO: 909349 - RNA, 19 nt, Human
ucccugcauggcccggccc

SEQ ID NO: 909350 - RNA, 18 nt, Human
ucucugggugcucagugu

SEQ ID NO: 909351 - RNA, 24 nt, Human
ucugacaggaggcguguguccccc

SEQ ID NO: 909352 - RNA, 21 nt, Human
ugagauggaccuggaccgugg

SEQ ID NO: 909353 - RNA, 22 nt, Human
ugcuccaccugcccaaagcagc

SEQ ID NO: 909354 - RNA, 27 nt, Human
ugcucugaggacacggguccugagggc

SEQ ID NO: 909355 - RNA, 23 nt, Human
ugcuggccggugcccagaguggc

SEQ ID NO: 909356 - RNA, 23 nt, Human
ugguggcggggagccagcagcac

SEQ ID NO: 909357 - RNA, 19 nt, Human
uguguggugcucugaggac

SEQ ID NO: 909358 - RNA, 22 nt, Human
uuuuuuuuuuuuuuucacagga

SEQ ID NO: 909359 - RNA, 26 nt, Human
uuuuuuuuuuuuuuuuuuuucacagg

SEQ ID NO: 909360 - RNA, 19 nt, Human
aaggcuacagaccggcccc

SEQ ID NO: 909361 - RNA, 28 nt, Human
accccgaaguccucuucccaagugaccc

SEQ ID NO: 909362 - RNA, 23 nt, Human
acuugcagaggaagacagggugg

SEQ ID NO: 909363 - RNA, 21 nt, Human
acuuucacugugaguaguguu

SEQ ID NO: 909364 - RNA, 21 nt, Human
agaaaaaaauucaagaaaaug

SEQ ID NO: 909365 - RNA, 18 nt, Human
agaaaaacaaaucuuaag

SEQ ID NO: 909366 - RNA, 19 nt, Human
agaaaaacaaaucuuaagc

SEQ ID NO: 909367 - RNA, 24 nt, Human
agagagaugaggauggaggccaaa

SEQ ID NO: 909368 - RNA, 24 nt, Human
agcuggccuccggcgggaaggcca

SEQ ID NO: 909369 - RNA, 18 nt, Human
aggcauguccaggggcuc

SEQ ID NO: 909370 - RNA, 26 nt, Human
auccccuguccaacaccuucucacca

SEQ ID NO: 909371 - RNA, 20 nt, Human
cagaggaugccucagauucc

SEQ ID NO: 909372 - RNA, 18 nt, Human
caggggcuccucccagcc

SEQ ID NO: 909373 - RNA, 27 nt, Human
cauuaaaaaaaauucaaccaacuagcu

SEQ ID NO: 909374 - RNA, 22 nt, Human
ccaaaagcucccguuuggcugg

SEQ ID NO: 909375 - RNA, 19 nt, Human
ccaauccccuguccaacac

SEQ ID NO: 909376 - RNA, 29 nt, Human
ccagccucuaccccgaaguccucuuccca

SEQ ID NO: 909377 - RNA, 29 nt, Human
cccagccucuaccccgaaguccgguuccg

SEQ ID NO: 909378 - RNA, 23 nt, Human
ccccgccgcagcugccgccgccu

SEQ ID NO: 909379 - RNA, 22 nt, Human
cccgaaguccucuucccaagug

SEQ ID NO: 909380 - RNA, 19 nt, Human
cccuagugaagcagcucag

SEQ ID NO: 909381 - RNA, 22 nt, Human
ccgcagcugccgccgccucccc

SEQ ID NO: 909382 - RNA, 20 nt, Human
ccgccgcagcugccgccgcc

SEQ ID NO: 909383 - RNA, 21 nt, Human
ccgccgcagcugccgccgccu

SEQ ID NO: 909384 - RNA, 21 nt, Human
ccggccccgccgcagcugccg

SEQ ID NO: 909385 - RNA, 21 nt, Human
ccguguguaucccagcugugc

SEQ ID NO: 909386 - RNA, 19 nt, Human
ccucuaccccgaaguccuc

SEQ ID NO: 909387 - RNA, 20 nt, Human
ccugucaggcagauagcugg

SEQ ID NO: 909388 - RNA, 19 nt, Human
cucagaagaggggagaagg

SEQ ID NO: 909389 - RNA, 20 nt, Human
cuuucaggacaggcaugucc

SEQ ID NO: 909390 - RNA, 19 nt, Human
gaagacagggugguggcag

SEQ ID NO: 909391 - RNA, 18 nt, Human
gaaggagccagggguuca

SEQ ID NO: 909392 - RNA, 20 nt, Human
gagagaagagucacagccug

SEQ ID NO: 909393 - RNA, 24 nt, Human
gagccugucccacacugucaggcc

SEQ ID NO: 909394 - RNA, 23 nt, Human
gaguggcaguggcucccaaggcu

SEQ ID NO: 909395 - RNA, 26 nt, Human
gauaauggaggcagccgcuuucagga

SEQ ID NO: 909396 - RNA, 22 nt, Human
gcagcucaggccugggggagcc

SEQ ID NO: 909397 - RNA, 26 nt, Human
gccugucccacacugucaggcccuga

SEQ ID NO: 909398 - RNA, 27 nt, Human
gcuaaccacgucacacucauguugugc

SEQ ID NO: 909399 - RNA, 22 nt, Human
gcucccaaggcucucuccucca

SEQ ID NO: 909400 - RNA, 22 nt, Human
gcuccucccagccucuaccccg

SEQ ID NO: 909401 - RNA, 18 nt, Human
gcuggcuuggcccaagag

SEQ ID NO: 909402 - RNA, 19 nt, Human
ggaaacucgcggcuucccg

SEQ ID NO: 909403 - RNA, 21 nt, Human
ggaaagaagagccugucccac

SEQ ID NO: 909404 - RNA, 21 nt, Human
ggaguggcaguggcucccaag

SEQ ID NO: 909405 - RNA, 22 nt, Human
gggcuccucccagccucuaccc

SEQ ID NO: 909406 - RNA, 21 nt, Human
guggagucagaggaugccuca

SEQ ID NO: 909407 - RNA, 21 nt, Human
ucagaagaggggagaaggcca

SEQ ID NO: 909408 - RNA, 25 nt, Human
ucaggacaggcauguccaggggcuc

SEQ ID NO: 909409 - RNA, 18 nt, Human
ucccacacugucaggccc

SEQ ID NO: 909410 - RNA, 22 nt, Human
ucccagccucuaccccgaaguc

SEQ ID NO: 909411 - RNA, 21 nt, Human
ucccugagcacuugcagagga

SEQ ID NO: 909412 - RNA, 20 nt, Human
uccugccgcaggauucccua

SEQ ID NO: 909413 - RNA, 23 nt, Human
ugaaaagagaaaaacaaaucuua

SEQ ID NO: 909414 - RNA, 20 nt, Human
ugaaggagccagggguucau

SEQ ID NO: 909415 - RNA, 18 nt, Human
ugagagaagagucacagc

SEQ ID NO: 909416 - RNA, 21 nt, Human
ugagagaagagucacagccug

SEQ ID NO: 909417 - RNA, 22 nt, Human
ugagaugcgcuccuggcuaugg

SEQ ID NO: 909418 - RNA, 18 nt, Human
ugcagaggaagacagggu

SEQ ID NO: 909419 - RNA, 20 nt, Human
ugcagaggaagacagggugg

SEQ ID NO: 909420 - RNA, 23 nt, Human
ugcuugggggaccuaggcagcug

SEQ ID NO: 909421 - RNA, 23 nt, Human
uggaaaagcugugcagaaaaaaa

SEQ ID NO: 909422 - RNA, 22 nt, Human
uggaggcagacccuguggcucu

SEQ ID NO: 909423 - RNA, 23 nt, Human
uggcaggacuggaguggcagugg

SEQ ID NO: 909424 - RNA, 21 nt, Human
uggcucccaaggcucucuccu

SEQ ID NO: 909425 - RNA, 18 nt, Human
ugggaaagaagagccugu

SEQ ID NO: 909426 - RNA, 21 nt, Human
ugggaauggauaauggaggca

SEQ ID NO: 909427 - RNA, 23 nt, Human
ugggaauggauaauggaggcagc

SEQ ID NO: 909428 - RNA, 25 nt, Human
ugucaagagcucccuaauuuuggga

SEQ ID NO: 909429 - RNA, 21 nt, Human
ugucaggcagauagcuggccu

SEQ ID NO: 909430 - RNA, 22 nt, Human
ugucaggcagauagcuggccuc

SEQ ID NO: 909431 - RNA, 21 nt, Human
uuuuuuuuuuuuuuguuugga

SEQ ID NO: 909432 - RNA, 19 nt, Human
uuuuuuuuuuuuuuuguuu

SEQ ID NO: 909433 - RNA, 20 nt, Human
aagcccccgccccgcccugc

SEQ ID NO: 909434 - RNA, 18 nt, Human
accaccggagccgccccg

SEQ ID NO: 909435 - RNA, 21 nt, Human
caccucaagcccccgccccgc

SEQ ID NO: 909436 - RNA, 23 nt, Human
caccucaagcccccgccccgccc

SEQ ID NO: 909437 - RNA, 22 nt, Human
cacggcccguccccgcgucucu

SEQ ID NO: 909438 - RNA, 26 nt, Human
cccccgccccgcccugcucggccccc

SEQ ID NO: 909439 - RNA, 19 nt, Human
ccccgcuucgccccgcccc

SEQ ID NO: 909440 - RNA, 19 nt, Human
cccgccccgcuucgagggc

SEQ ID NO: 909441 - RNA, 19 nt, Human
cccgcuucgccccgccccg

SEQ ID NO: 909442 - RNA, 19 nt, Human
cccguccccgcgucucugg

SEQ ID NO: 909443 - RNA, 21 nt, Human
ccgcccugcucggccccgccc

SEQ ID NO: 909444 - RNA, 20 nt, Human
ccgcggccgccgcccacuuu

SEQ ID NO: 909445 - RNA, 19 nt, Human
ccugcucggccccgccccg

SEQ ID NO: 909446 - RNA, 21 nt, Human
cucggccccgccccgcuucgc

SEQ ID NO: 909447 - RNA, 20 nt, Human
cugccgccgucuccgccagg

SEQ ID NO: 909448 - RNA, 19 nt, Human
gccgccccgcggcuuggga

SEQ ID NO: 909449 - RNA, 21 nt, Human
gcuugggaaucaccucaagcc

SEQ ID NO: 909450 - RNA, 23 nt, Human
ggaaucaccucaagcccccgccc

SEQ ID NO: 909451 - RNA, 19 nt, Human
uaaauaucuuucaucaaac

SEQ ID NO: 909452 - RNA, 23 nt, Human
uagcagaguuaagauuuuuuuua

SEQ ID NO: 909453 - RNA, 19 nt, Human
uauaguaauaauucaagua

SEQ ID NO: 909454 - RNA, 22 nt, Human
ucaccucaagcccccgccccgc

SEQ ID NO: 909455 - RNA, 21 nt, Human
ucagagccauguagcagaguu

SEQ ID NO: 909456 - RNA, 19 nt, Human
ucccccacagcagucagag

SEQ ID NO: 909457 - RNA, 23 nt, Human
uccccgcaccaccggagccgccc

SEQ ID NO: 909458 - RNA, 19 nt, Human
uccccgcgucucugggccc

SEQ ID NO: 909459 - RNA, 22 nt, Human
uccccgcgucucugggcccagc

SEQ ID NO: 909460 - RNA, 18 nt, Human
ucucugggcccagcuccu

SEQ ID NO: 909461 - RNA, 18 nt, Human
ugaaaagucaacucuguu

SEQ ID NO: 909462 - RNA, 24 nt, Human
uuuuuuaagccuacuacauuuugu

SEQ ID NO: 909463 - RNA, 26 nt, Human
aaagcagaagucaccccaaucaacgg

SEQ ID NO: 909464 - RNA, 21 nt, Human
acaggugguuuacuugguggg

SEQ ID NO: 909465 - RNA, 18 nt, Human
accaaagcagaagucacc

SEQ ID NO: 909466 - RNA, 20 nt, Human
accucgcccaacucuucagc

SEQ ID NO: 909467 - RNA, 22 nt, Human
accucgcccaacucuucagcug

SEQ ID NO: 909468 - RNA, 25 nt, Human
agaagucaccccaucagugcaaguc

SEQ ID NO: 909469 - RNA, 25 nt, Human
agaagucucugcaccucgcccaacu

SEQ ID NO: 909470 - RNA, 22 nt, Human
cagcuccugugacuauuacccu

SEQ ID NO: 909471 - RNA, 19 nt, Human
cccuuauggacgcagaagu

SEQ ID NO: 909472 - RNA, 18 nt, Human
cugugacucucgcccucc

SEQ ID NO: 909473 - RNA, 26 nt, Human
cuuagcaagguuagagugacucuaga

SEQ ID NO: 909474 - RNA, 27 nt, Human
gaaacaauuuuauucuggcagagcugg

SEQ ID NO: 909475 - RNA, 18 nt, Human
ggcagagcugggguggug

SEQ ID NO: 909476 - RNA, 22 nt, Human
ggcucuugccucccagcagccu

SEQ ID NO: 909477 - RNA, 24 nt, Human
gugacucucgcccuccuccccauc

SEQ ID NO: 909478 - RNA, 21 nt, Human
uacuuggugggggugguggaa

SEQ ID NO: 909479 - RNA, 19 nt, Human
ucagggucucucugcugac

SEQ ID NO: 909480 - RNA, 20 nt, Human
uccagcuagaagucucugca

SEQ ID NO: 909481 - RNA, 20 nt, Human
ucgcccaacucuucagcugu

SEQ ID NO: 909482 - RNA, 21 nt, Human
ucgcccaacucuucagcugua

SEQ ID NO: 909483 - RNA, 21 nt, Human
ucucugcaccucgcccaacuc

SEQ ID NO: 909484 - RNA, 22 nt, Human
ucugcaccucgcccaacucuuc

SEQ ID NO: 909485 - RNA, 20 nt, Human
ugacucucgcccuccucccc

SEQ ID NO: 909486 - RNA, 22 nt, Human
ugcaagucucucuagggaacuc

SEQ ID NO: 909487 - RNA, 21 nt, Human
uggacgcagaaguagcagguu

SEQ ID NO: 909488 - RNA, 19 nt, Human
uggcagagcugggguggug

SEQ ID NO: 909489 - RNA, 21 nt, Human
ugggguggugggaggcaacgu

SEQ ID NO: 909490 - RNA, 19 nt, Human
ugugacuauuacccuucaa

SEQ ID NO: 909491 - RNA, 21 nt, Human
uucccuuagcagaguucaggg

SEQ ID NO: 909492 - RNA, 23 nt, Human
uuggugggggugguggaaggacc

SEQ ID NO: 909493 - RNA, 24 nt, Human
aagcccccugcucugcaccucccg

SEQ ID NO: 909494 - RNA, 21 nt, Human
acagcugggugggcagucagu

SEQ ID NO: 909495 - RNA, 23 nt, Human
acccucucugagcagcuuugcug

SEQ ID NO: 909496 - RNA, 19 nt, Human
agagccaggccaguuagag

SEQ ID NO: 909497 - RNA, 23 nt, Human
agcggcggcgcggacagccuggc

SEQ ID NO: 909498 - RNA, 21 nt, Human
agcugggugggcagucagugu

SEQ ID NO: 909499 - RNA, 19 nt, Human
aggagcggugcguuucagg

SEQ ID NO: 909500 - RNA, 20 nt, Human
aggcaggcaaggaggcagag

SEQ ID NO: 909501 - RNA, 23 nt, Human
aguggcgaagcugccgggaagga

SEQ ID NO: 909502 - RNA, 20 nt, Human
caccguguuggggggugccc

SEQ ID NO: 909503 - RNA, 24 nt, Human
caccuuguaggcaggcaaggaggc

SEQ ID NO: 909504 - RNA, 24 nt, Human
cacugcucccuaaagcccccugcc

SEQ ID NO: 909505 - RNA, 23 nt, Human
cagagcagggggagggccggccc

SEQ ID NO: 909506 - RNA, 21 nt, Human
cagaguccucaccagcccuuc

SEQ ID NO: 909507 - RNA, 22 nt, Human
cagccuggcagcucccggcgac

SEQ ID NO: 909508 - RNA, 19 nt, Human
cagcuuugcuggaaagagc

SEQ ID NO: 909509 - RNA, 26 nt, Human
cauguacaaacagaacagaguccaua

SEQ ID NO: 909510 - RNA, 22 nt, Human
ccccgcgcagcacugccaccag

SEQ ID NO: 909511 - RNA, 24 nt, Human
cccgcagcggcggcgcggacagcc

SEQ ID NO: 909512 - RNA, 20 nt, Human
cccgcgcagcacugccacca

SEQ ID NO: 909513 - RNA, 23 nt, Human
cccuaaagcccccugcucugcac

SEQ ID NO: 909514 - RNA, 23 nt, Human
ccucccgccacagcugggugggc

SEQ ID NO: 909515 - RNA, 24 nt, Human
ccugcagaguccuauguccaaacg

SEQ ID NO: 909516 - RNA, 23 nt, Human
ccugcugcaaaccaggcaccuug

SEQ ID NO: 909517 - RNA, 25 nt, Human
cgcagcacugccaccaggcuuuauu

SEQ ID NO: 909518 - RNA, 20 nt, Human
cucacuuccggccucuccac

SEQ ID NO: 909519 - RNA, 24 nt, Human
cucccgccacagcugggugggcag

SEQ ID NO: 909520 - RNA, 20 nt, Human
gacuccgaacgccgccgccc

SEQ ID NO: 909521 - RNA, 18 nt, Human
gagccaggccaguuagag

SEQ ID NO: 909522 - RNA, 19 nt, Human
gcaggugccgucugcccgu

SEQ ID NO: 909523 - RNA, 19 nt, Human
gccucuguccagguggugg

SEQ ID NO: 909524 - RNA, 21 nt, Human
gcggcgcggacagccuggcag

SEQ ID NO: 909525 - RNA, 22 nt, Human
gggaaggaaggcaagcguguuu

SEQ ID NO: 909526 - RNA, 20 nt, Human
ggugcccagugggagguggu

SEQ ID NO: 909527 - RNA, 19 nt, Human
gguggugggggcauccggg

SEQ ID NO: 909528 - RNA, 21 nt, Human
gguggugggggcauccgggga

SEQ ID NO: 909529 - RNA, 25 nt, Human
uaaagcccccugcucugcaccuccc

SEQ ID NO: 909530 - RNA, 21 nt, Human
uacaaacagaacagaguccau

SEQ ID NO: 909531 - RNA, 22 nt, Human
ucacuuccggccucuccccguc

SEQ ID NO: 909532 - RNA, 23 nt, Human
uccaaacgcagaaggcgcagaag

SEQ ID NO: 909533 - RNA, 19 nt, Human
ucccuaaagcccccugcuc

SEQ ID NO: 909534 - RNA, 24 nt, Human
ugagcagcuuugcuggaaagagcg

SEQ ID NO: 909535 - RNA, 19 nt, Human
ugcucugcaccucccgcca

SEQ ID NO: 909536 - RNA, 21 nt, Human
ugcuggaaagagcggagagcc

SEQ ID NO: 909537 - RNA, 24 nt, Human
uggacacccucucugagcagcuuu

SEQ ID NO: 909538 - RNA, 20 nt, Human
uggcugggagccccgcgcag

SEQ ID NO: 909539 - RNA, 22 nt, Human
uggggggugcccagugggaggu

SEQ ID NO: 909540 - RNA, 25 nt, Human
uggguggcaggacaccguguugggg

SEQ ID NO: 909541 - RNA, 19 nt, Human
uggucuacacccagagaac

SEQ ID NO: 909542 - RNA, 25 nt, Human
uguccaaacgcagaaggcgcagaag

SEQ ID NO: 909543 - RNA, 20 nt, Human
ugugcuggacacccucucug

SEQ ID NO: 909544 - RNA, 21 nt, Human
uguuggggggugcccaguggg

SEQ ID NO: 909545 - RNA, 25 nt, Human
uguuggggggugcccagugggaggu

SEQ ID NO: 909546 - RNA, 23 nt, Human
aaacaccaauauuuacaauucuu

SEQ ID NO: 909547 - RNA, 21 nt, Human
aagcagugcuaaaaugcagag

SEQ ID NO: 909548 - RNA, 22 nt, Human
acaaaaaacacacugaucuuag

SEQ ID NO: 909549 - RNA, 20 nt, Human
acagcuacaccuuaccgcca

SEQ ID NO: 909550 - RNA, 19 nt, Human
acccuagaccucuucugcu

SEQ ID NO: 909551 - RNA, 19 nt, Human
aucauuaaacuggaacuga

SEQ ID NO: 909552 - RNA, 19 nt, Human
cagccauggccccugcgug

SEQ ID NO: 909553 - RNA, 22 nt, Human
cagcuacaccuuaccgccaccc

SEQ ID NO: 909554 - RNA, 18 nt, Human
cauuugucucuuccuucu

SEQ ID NO: 909555 - RNA, 21 nt, Human
ccccugcgugacccuagaccu

SEQ ID NO: 909556 - RNA, 24 nt, Human
cguagaccccaacauuugucucuu

SEQ ID NO: 909557 - RNA, 23 nt, Human
cucagccauggccccugcgugac

SEQ ID NO: 909558 - RNA, 20 nt, Human
gugacccuagaccucuucug

SEQ ID NO: 909559 - RNA, 21 nt, Human
guugaaaaagcagugcuaaaa

SEQ ID NO: 909560 - RNA, 18 nt, Human
uaaggcaaaauuaucucc

SEQ ID NO: 909561 - RNA, 18 nt, Human
uaaggcaaaauuaucucc

SEQ ID NO: 909562 - RNA, 20 nt, Human
uacaccuuaccgccacccag

SEQ ID NO: 909563 - RNA, 23 nt, Human
uacaucucuuaacauauacaacu

SEQ ID NO: 909564 - RNA, 21 nt, Human
uagcaaaagugaugcaaaaga

SEQ ID NO: 909565 - RNA, 21 nt, Human
uagcaaaagugaugcaaaauc

SEQ ID NO: 909566 - RNA, 18 nt, Human
uccgcuccgccugccaga

SEQ ID NO: 909567 - RNA, 20 nt, Human
uccguagaccccaacauuug

SEQ ID NO: 909568 - RNA, 21 nt, Human
ucuucagugugagauuaugau

SEQ ID NO: 909569 - RNA, 19 nt, Human
ugaaaaagcagugcuaaaa

SEQ ID NO: 909570 - RNA, 23 nt, Human
ugaaaaagcagugcuaaaaugca

SEQ ID NO: 909571 - RNA, 20 nt, Human
ugagauuaugauuaagcuac

SEQ ID NO: 909572 - RNA, 21 nt, Human
ugccucagccauggccccugc

SEQ ID NO: 909573 - RNA, 21 nt, Human
uggaacugaauccguagaccc

SEQ ID NO: 909574 - RNA, 18 nt, Human
uggccccugcgugacccu

SEQ ID NO: 909575 - RNA, 22 nt, Human
uggugauaaaagaauuggacac

SEQ ID NO: 909576 - RNA, 21 nt, Human
uuacaaaaauaugguguaaga

SEQ ID NO: 909577 - RNA, 23 nt, Human
uuuuuuuuuuuuuuuuuuaacag

SEQ ID NO: 909578 - RNA, 24 nt, Human
aaaaaaacuugugcuaacaacucu

SEQ ID NO: 909579 - RNA, 24 nt, Human
aaacaagugcuuaaaaaaaaaaaa

SEQ ID NO: 909580 - RNA, 23 nt, Human
aaaugucagaaaugccuuguacc

SEQ ID NO: 909581 - RNA, 28 nt, Human
acaagugcuuaaaaaaaaaaaaaaaaaa

SEQ ID NO: 909582 - RNA, 18 nt, Human
caaaacaagugcuuaaaa

SEQ ID NO: 909583 - RNA, 19 nt, Human
cagaaucccucgggccccc

SEQ ID NO: 909584 - RNA, 23 nt, Human
cccaaaacaagugcuuaaaaaaa

SEQ ID NO: 909585 - RNA, 21 nt, Human
ccuucagaaucccucgggccc

SEQ ID NO: 909586 - RNA, 20 nt, Human
cuuaaaaaaaaaaaaaaaga

SEQ ID NO: 909587 - RNA, 20 nt, Human
gaaaugccuuguacccaaaa

SEQ ID NO: 909588 - RNA, 24 nt, Human
ugauuaaacaaauuaccuaaugga

SEQ ID NO: 909589 - RNA, 19 nt, Human
ugccuuguacccaaaacaa

SEQ ID NO: 909590 - RNA, 23 nt, Human
ugucagaaaugccuuguacccaa

SEQ ID NO: 909591 - RNA, 20 nt, Human
uuaaaaaaaaaaaaaaaaaa

SEQ ID NO: 909592 - RNA, 20 nt, Human
uuuauaacaucuaagacugc

SEQ ID NO: 909593 - RNA, 22 nt, Human
agccgcggucacucucgcagcc

SEQ ID NO: 909594 - RNA, 21 nt, Human
cagccccucggcgcgagcgcg

SEQ ID NO: 909595 - RNA, 23 nt, Human
cagccccucggcgcgagcgcggc

SEQ ID NO: 909596 - RNA, 21 nt, Human
cauauagacaauaaacaaagu

SEQ ID NO: 909597 - RNA, 24 nt, Human
uuuuuuuuuuuuuuuuuuuauuuu

SEQ ID NO: 909598 - RNA, 24 nt, Human
acgugacaaaaucuaaaggaagaa

SEQ ID NO: 909599 - RNA, 24 nt, Human
cacaaugagacagucaccaaaucc

SEQ ID NO: 909600 - RNA, 22 nt, Human
cagaaugccugaaacauuacau

SEQ ID NO: 909601 - RNA, 24 nt, Human
cagcuacuauuacaguugcaaaac

SEQ ID NO: 909602 - RNA, 25 nt, Human
cagcuggguccccacgugacaaaau

SEQ ID NO: 909603 - RNA, 22 nt, Human
cucauggcacaaugagacaguc

SEQ ID NO: 909604 - RNA, 18 nt, Human
cugauaucacuccacucc

SEQ ID NO: 909605 - RNA, 21 nt, Human
cugcaccugugcuccauuccc

SEQ ID NO: 909606 - RNA, 22 nt, Human
cugugacauuuuggcucuuucc

SEQ ID NO: 909607 - RNA, 19 nt, Human
gaucgaccugacagucacu

SEQ ID NO: 909608 - RNA, 25 nt, Human
gcacaaugagacagucaccaaaucc

SEQ ID NO: 909609 - RNA, 18 nt, Human
gugcuccauucccucaca

SEQ ID NO: 909610 - RNA, 22 nt, Human
uaaagggaguccacgugccguu

SEQ ID NO: 909611 - RNA, 19 nt, Human
uaggaacugugacauuuug

SEQ ID NO: 909612 - RNA, 18 nt, Human
ucacuggauuaaagggag

SEQ ID NO: 909613 - RNA, 25 nt, Human
ucacuggauuaaagggaguccacgu

SEQ ID NO: 909614 - RNA, 24 nt, Human
ugagacagucaccaaauccaaugu

SEQ ID NO: 909615 - RNA, 18 nt, Human
ugauaucacuccacuccu

SEQ ID NO: 909616 - RNA, 22 nt, Human
ugcaaaaccauuaaucagcuua

SEQ ID NO: 909617 - RNA, 21 nt, Human
ugcuccauucccucacagaua

SEQ ID NO: 909618 - RNA, 21 nt, Human
uuacaguugcaaaaccauuaa

SEQ ID NO: 909619 - RNA, 18 nt, Human
uuuggcucuuuccauguu

SEQ ID NO: 909620 - RNA, 18 nt, Human
aaugcaauuucaaauccu

SEQ ID NO: 909621 - RNA, 26 nt, Human
agaaagaaaacuuaauuuucucuagu

SEQ ID NO: 909622 - RNA, 22 nt, Human
agcaaaucucacauguguaauc

SEQ ID NO: 909623 - RNA, 25 nt, Human
caacagcagcaaaucucacaugugu

SEQ ID NO: 909624 - RNA, 22 nt, Human
gcugacagacuugcgcuccgcc

SEQ ID NO: 909625 - RNA, 23 nt, Human
gcugacagacuugcgcuccgccu

SEQ ID NO: 909626 - RNA, 19 nt, Human
ggagagagagguacugggc

SEQ ID NO: 909627 - RNA, 18 nt, Human
ggccgaggagagagaggu

SEQ ID NO: 909628 - RNA, 24 nt, Human
uauacacugcauucaguccaggag

SEQ ID NO: 909629 - RNA, 24 nt, Human
uguagacagaaauuauacacugca

SEQ ID NO: 909630 - RNA, 19 nt, Human
uguguaaucaaauguggaa

SEQ ID NO: 909631 - RNA, 23 nt, Human
uuucacuugcagguuuaauuucu

SEQ ID NO: 909632 - RNA, 20 nt, Human
aaaaaccaaaccaaaacaga

SEQ ID NO: 909633 - RNA, 27 nt, Human
aaaaaccaaaccaaaacagaaccaaaa

SEQ ID NO: 909634 - RNA, 26 nt, Human
aaaaccaaaccaaaacagaaccaaaa

SEQ ID NO: 909635 - RNA, 22 nt, Human
aaaccaaaacagaaccaaaaaa

SEQ ID NO: 909636 - RNA, 24 nt, Human
aaaccaaaccaaaacagaaccaaa

SEQ ID NO: 909637 - RNA, 24 nt, Human
aaaguguugggauuacaggcguga

SEQ ID NO: 909638 - RNA, 24 nt, Human
aaauaauuggcaaaaaccaaacca

SEQ ID NO: 909639 - RNA, 20 nt, Human
aaaucuacccaucacacacc

SEQ ID NO: 909640 - RNA, 28 nt, Human
aacacaacugaagauaacauuuuugacc

SEQ ID NO: 909641 - RNA, 21 nt, Human
aacauggaaaaaauacagcca

SEQ ID NO: 909642 - RNA, 23 nt, Human
aaccaaaacagaaccaaaaaaau

SEQ ID NO: 909643 - RNA, 20 nt, Human
aaccacauuaaucugauuca

SEQ ID NO: 909644 - RNA, 18 nt, Human
aagcauaacuucagggua

SEQ ID NO: 909645 - RNA, 20 nt, Human
aagucacucuggaccaagcc

SEQ ID NO: 909646 - RNA, 21 nt, Human
aaguguugggauuacaggcgu

SEQ ID NO: 909647 - RNA, 26 nt, Human
aaguguugggauuacaggcgugagcc

SEQ ID NO: 909648 - RNA, 24 nt, Human
acagagcacagaaggaaagcauaa

SEQ ID NO: 909649 - RNA, 18 nt, Human
acaggguuucaccguguu

SEQ ID NO: 909650 - RNA, 19 nt, Human
acaggguuucaccguguua

SEQ ID NO: 909651 - RNA, 20 nt, Human
acaggguuucaccguguuag

SEQ ID NO: 909652 - RNA, 24 nt, Human
acaggguuucaccguguuagccag

SEQ ID NO: 909653 - RNA, 20 nt, Human
acugcaagcucugccuccug

SEQ ID NO: 909654 - RNA, 22 nt, Human
agaaggaaagcauaacuucagg

SEQ ID NO: 909655 - RNA, 18 nt, Human
agacaggguuucaccgug

SEQ ID NO: 909656 - RNA, 21 nt, Human
agccuacagccacugccaucu

SEQ ID NO: 909657 - RNA, 18 nt, Human
agcucugccuccuggguu

SEQ ID NO: 909658 - RNA, 25 nt, Human
agcuggaaagagcgcuggcuggacc

SEQ ID NO: 909659 - RNA, 20 nt, Human
aggccaccaucuuuucuggc

SEQ ID NO: 909660 - RNA, 20 nt, Human
aggccgcgcagccgccgcac

SEQ ID NO: 909661 - RNA, 23 nt, Human
aggcgugagccacugugcccggc

SEQ ID NO: 909662 - RNA, 22 nt, Human
aggcguuggagggccgcauccu

SEQ ID NO: 909663 - RNA, 20 nt, Human
agugccguggcgcgaucucg

SEQ ID NO: 909664 - RNA, 24 nt, Human
agugccguggcgcgaucucggcuc

SEQ ID NO: 909665 - RNA, 26 nt, Human
auaacaaaauaauuggcaaaaaccaa

SEQ ID NO: 909666 - RNA, 21 nt, Human
auucuccugccucagccuccc

SEQ ID NO: 909667 - RNA, 21 nt, Human
caaaccaaaacagaaccaaaa

SEQ ID NO: 909668 - RNA, 24 nt, Human
caaaguguugggauuacaggcgug

SEQ ID NO: 909669 - RNA, 20 nt, Human
caacagcauuuauuaaugaa

SEQ ID NO: 909670 - RNA, 22 nt, Human
caagaggcaccucuggccagca

SEQ ID NO: 909671 - RNA, 25 nt, Human
caccaccuacgcccagcuaauauuu

SEQ ID NO: 909672 - RNA, 18 nt, Human
caccguguuagccaggau

SEQ ID NO: 909673 - RNA, 24 nt, Human
caccguguuagccaggauggccuu

SEQ ID NO: 909674 - RNA, 23 nt, Human
cacugcaagcucugccuccuggg

SEQ ID NO: 909675 - RNA, 20 nt, Human
cagaaccaaaaaaaugacau

SEQ ID NO: 909676 - RNA, 18 nt, Human
cagaaggaaagcauaacu

SEQ ID NO: 909677 - RNA, 22 nt, Human
cagccacugccaucuuccuaac

SEQ ID NO: 909678 - RNA, 19 nt, Human
cagccuccuaagcugcacu

SEQ ID NO: 909679 - RNA, 24 nt, Human
caggguuucaccguguuagccagg

SEQ ID NO: 909680 - RNA, 24 nt, Human
caguagcugggacuacaggugugc

SEQ ID NO: 909681 - RNA, 19 nt, Human
ccaaaacagaaccaaaaag

SEQ ID NO: 909682 - RNA, 18 nt, Human
ccaaaccaaaacagaacc

SEQ ID NO: 909683 - RNA, 20 nt, Human
ccaaaguguugggauuacag

SEQ ID NO: 909684 - RNA, 22 nt, Human
ccaaaguguugggauuacaggc

SEQ ID NO: 909685 - RNA, 22 nt, Human
ccaaaguguugggauuacaggc

SEQ ID NO: 909686 - RNA, 24 nt, Human
ccaaaguguugggauuacaggcgu

SEQ ID NO: 909687 - RNA, 18 nt, Human
ccacugcccgcgcggccu

SEQ ID NO: 909688 - RNA, 19 nt, Human
cccaggcuggagugccgug

SEQ ID NO: 909689 - RNA, 23 nt, Human
cccaguagcugggacuacaggug

SEQ ID NO: 909690 - RNA, 20 nt, Human
ccccucaaaacagaggcaaa

SEQ ID NO: 909691 - RNA, 26 nt, Human
ccccucaaaacagaggcaaauuuggu

SEQ ID NO: 909692 - RNA, 18 nt, Human
ccgcagccggcggcgccg

SEQ ID NO: 909693 - RNA, 24 nt, Human
ccgcgccgucggcuucggccucgc

SEQ ID NO: 909694 - RNA, 19 nt, Human
ccgcgcgcagcggcgcggu

SEQ ID NO: 909695 - RNA, 19 nt, Human
ccgcgcggccucugccucc

SEQ ID NO: 909696 - RNA, 19 nt, Human
ccggcggcggcggcgccuc

SEQ ID NO: 909697 - RNA, 20 nt, Human
ccucgcgcagggccuggcuc

SEQ ID NO: 909698 - RNA, 21 nt, Human
ccugaccucgugaucggcccg

SEQ ID NO: 909699 - RNA, 24 nt, Human
ccugccucagccuccccaguagcu

SEQ ID NO: 909700 - RNA, 19 nt, Human
ccugcucccgcuucuucuc

SEQ ID NO: 909701 - RNA, 18 nt, Human
cgcgcgcgcacuucgcca

SEQ ID NO: 909702 - RNA, 18 nt, Human
cggccggcggcggcggcg

SEQ ID NO: 909703 - RNA, 24 nt, Human
cggcuucggccucgcgcagggccu

SEQ ID NO: 909704 - RNA, 30 nt, Human
cuaauauuuuuuuguauuuuuaguagagaa

SEQ ID NO: 909705 - RNA, 33 nt, Human
cuaauauuuuuuuguauuuuuaguagagacaac

SEQ ID NO: 909706 - RNA, 24 nt, Human
cucacugcaagcucugccuccugg

SEQ ID NO: 909707 - RNA, 24 nt, Human
cucagccuccccaguagcugggac

SEQ ID NO: 909708 - RNA, 22 nt, Human
cuccagccacugccggucgcgc

SEQ ID NO: 909709 - RNA, 24 nt, Human
cuccugaccucgugaucggcccgc

SEQ ID NO: 909710 - RNA, 22 nt, Human
cuccuggguuuuacaccauucu

SEQ ID NO: 909711 - RNA, 20 nt, Human
cucugucucccaggcuggag

SEQ ID NO: 909712 - RNA, 24 nt, Human
cucuucagguuuucuaaguucucc

SEQ ID NO: 909713 - RNA, 19 nt, Human
cugcaagcucugccuccug

SEQ ID NO: 909714 - RNA, 24 nt, Human
cuggaccacacuccuggagcaucu

SEQ ID NO: 909715 - RNA, 26 nt, Human
cuggcuccuacaaugugacugaguga

SEQ ID NO: 909716 - RNA, 18 nt, Human
cuucgccaaggcugggcc

SEQ ID NO: 909717 - RNA, 23 nt, Human
gaaaggucaggagguuuugcauc

SEQ ID NO: 909718 - RNA, 22 nt, Human
gaagccgcagccggcggcgccg

SEQ ID NO: 909719 - RNA, 18 nt, Human
gauuacaggcgugagcca

SEQ ID NO: 909720 - RNA, 19 nt, Human
gauuacaggcgugagccac

SEQ ID NO: 909721 - RNA, 21 nt, Human
gauuacaggcgugagccacug

SEQ ID NO: 909722 - RNA, 26 nt, Human
gcaaaaaccaaaccaaaacagaacca

SEQ ID NO: 909723 - RNA, 22 nt, Human
gcaaauuuggugaaccaagguc

SEQ ID NO: 909724 - RNA, 20 nt, Human
gcagagcccggagcaaucgc

SEQ ID NO: 909725 - RNA, 20 nt, Human
gcagcggcgcggucugggag

SEQ ID NO: 909726 - RNA, 23 nt, Human
gcagcggcgcggucugggaguac

SEQ ID NO: 909727 - RNA, 28 nt, Human
gcauaacuucaggguaggggggaacgcc

SEQ ID NO: 909728 - RNA, 19 nt, Human
gccgcggggucccgaacac

SEQ ID NO: 909729 - RNA, 26 nt, Human
gccuccuggguuuuacaccauucucc

SEQ ID NO: 909730 - RNA, 20 nt, Human
gccucgcccacauaggcagc

SEQ ID NO: 909731 - RNA, 23 nt, Human
gccucggccucccaaaguguugg

SEQ ID NO: 909732 - RNA, 22 nt, Human
gcgccggacccucuccagccuc

SEQ ID NO: 909733 - RNA, 21 nt, Human
ggaaaggucaggagguuuugc

SEQ ID NO: 909734 - RNA, 24 nt, Human
ggaaaggucaggagguuuugcauc

SEQ ID NO: 909735 - RNA, 22 nt, Human
ggcaccggacagccugcccgcc

SEQ ID NO: 909736 - RNA, 23 nt, Human
ggcccucucgcgaagccgcagcc

SEQ ID NO: 909737 - RNA, 20 nt, Human
ggccgggaggcgguggccgc

SEQ ID NO: 909738 - RNA, 24 nt, Human
gugaucggcccgccucggccuccc

SEQ ID NO: 909739 - RNA, 19 nt, Human
gugccguggcgcgaucucg

SEQ ID NO: 909740 - RNA, 24 nt, Human
guuuuuuggaaauauaacaaaaua

SEQ ID NO: 909741 - RNA, 18 nt, Human
uaaaaaccucaguucacc

SEQ ID NO: 909742 - RNA, 23 nt, Human
uaaaauacaauccaauuugggua

SEQ ID NO: 909743 - RNA, 18 nt, Human
uaacaagucacucuggac

SEQ ID NO: 909744 - RNA, 21 nt, Human
uaagauaauuccauagcuaca

SEQ ID NO: 909745 - RNA, 20 nt, Human
uaauuggcaaaaaccaaacc

SEQ ID NO: 909746 - RNA, 22 nt, Human
uacaccauucuccugccucagc

SEQ ID NO: 909747 - RNA, 19 nt, Human
uacagcaggacccaggccg

SEQ ID NO: 909748 - RNA, 26 nt, Human
uacagcaggacccaggccgcgccguc

SEQ ID NO: 909749 - RNA, 23 nt, Human
uacaggcgugagccacugugccc

SEQ ID NO: 909750 - RNA, 23 nt, Human
uacaggcgugagccacugugccc

SEQ ID NO: 909751 - RNA, 22 nt, Human
uagagacaggguuucaccgugu

SEQ ID NO: 909752 - RNA, 19 nt, Human
uaggaaaggucaggagguu

SEQ ID NO: 909753 - RNA, 22 nt, Human
uaggggaaugccacauggaauu

SEQ ID NO: 909754 - RNA, 21 nt, Human
uaguagagacaggguuucacc

SEQ ID NO: 909755 - RNA, 24 nt, Human
uaguagagacaggguuucaccgug

SEQ ID NO: 909756 - RNA, 26 nt, Human
uaguagagacaggguuucaccguguu

SEQ ID NO: 909757 - RNA, 23 nt, Human
uagucuacagcaaaagauggcac

SEQ ID NO: 909758 - RNA, 24 nt, Human
ucaccguguuagccaggauggccu

SEQ ID NO: 909759 - RNA, 18 nt, Human
ucacugcaagcucugccu

SEQ ID NO: 909760 - RNA, 23 nt, Human
ucacugcaagcucugccuccugg

SEQ ID NO: 909761 - RNA, 24 nt, Human
ucacugcaagcucugccuccuggg

SEQ ID NO: 909762 - RNA, 20 nt, Human
ucagccuccccaguagcugg

SEQ ID NO: 909763 - RNA, 21 nt, Human
ucaggccgcgcagccgccgcc

SEQ ID NO: 909764 - RNA, 28 nt, Human
uccaagcacaacagcauuuauuaaugaa

SEQ ID NO: 909765 - RNA, 24 nt, Human
ucccaaaguguugggauuacaggc

SEQ ID NO: 909766 - RNA, 22 nt, Human
uccccaguagcugggacuacag

SEQ ID NO: 909767 - RNA, 24 nt, Human
uccccaguagcugggacuacaggu

SEQ ID NO: 909768 - RNA, 18 nt, Human
uccccgagcacgucggcc

SEQ ID NO: 909769 - RNA, 25 nt, Human
uccccuagauuugacuacauggaua

SEQ ID NO: 909770 - RNA, 24 nt, Human
uccuccaccuccugcacacacuuc

SEQ ID NO: 909771 - RNA, 25 nt, Human
uccugcucccgcuucuucuccucca

SEQ ID NO: 909772 - RNA, 23 nt, Human
ucgcgcgcgcacuucgccaaggc

SEQ ID NO: 909773 - RNA, 18 nt, Human
ucggccggcggcggcggc

SEQ ID NO: 909774 - RNA, 22 nt, Human
ucuccagccuccuccgcgccuc

SEQ ID NO: 909775 - RNA, 18 nt, Human
ucucccaggcuggagugc

SEQ ID NO: 909776 - RNA, 25 nt, Human
ucuccugccucagccuccccaguag

SEQ ID NO: 909777 - RNA, 19 nt, Human
ucugucucccaggcuggag

SEQ ID NO: 909778 - RNA, 19 nt, Human
ucuugcucugucucccagg

SEQ ID NO: 909779 - RNA, 23 nt, Human
ucuugcucugucucccaggcugg

SEQ ID NO: 909780 - RNA, 24 nt, Human
ucuugcucugucucccaggcugga

SEQ ID NO: 909781 - RNA, 22 nt, Human
ugaaaucuacccaucacacacc

SEQ ID NO: 909782 - RNA, 20 nt, Human
ugacugagugagguuaggga

SEQ ID NO: 909783 - RNA, 22 nt, Human
ugagacggagucuugcucuguc

SEQ ID NO: 909784 - RNA, 21 nt, Human
ugccacauggaauuuagaagu

SEQ ID NO: 909785 - RNA, 25 nt, Human
ugcccggccaaauuuuacuauuuuu

SEQ ID NO: 909786 - RNA, 18 nt, Human
ugccguggcgcgaucucg

SEQ ID NO: 909787 - RNA, 21 nt, Human
ugccucagccuccccaguagc

SEQ ID NO: 909788 - RNA, 24 nt, Human
ugccucagccuccccaguagcugg

SEQ ID NO: 909789 - RNA, 24 nt, Human
uggagugccguggcgcgaucucgg

SEQ ID NO: 909790 - RNA, 18 nt, Human
uggcaaaaaccaaaccaa

SEQ ID NO: 909791 - RNA, 23 nt, Human
uggcaaaaaccaaaccaaaacag

SEQ ID NO: 909792 - RNA, 21 nt, Human
ugggacuacaggugugcacca

SEQ ID NO: 909793 - RNA, 18 nt, Human
ugggauuacaggcgugag

SEQ ID NO: 909794 - RNA, 21 nt, Human
ugggauuacaggcgugagcca

SEQ ID NO: 909795 - RNA, 22 nt, Human
ugggauuacaggcgugagccac

SEQ ID NO: 909796 - RNA, 22 nt, Human
ugggauuacaggcgugagccac

SEQ ID NO: 909797 - RNA, 22 nt, Human
ugggauuacaggcgugagccac

SEQ ID NO: 909798 - RNA, 24 nt, Human
ugggauuacaggcgugagccacug

SEQ ID NO: 909799 - RNA, 26 nt, Human
ugggauuacaggcgugagccacugug

SEQ ID NO: 909800 - RNA, 19 nt, Human
uuaacaagucacucuggac

SEQ ID NO: 909801 - RNA, 24 nt, Human
uuaacaagucacucuggaccaagc

SEQ ID NO: 909802 - RNA, 21 nt, Human
uuacaccauucuccugccuca

SEQ ID NO: 909803 - RNA, 18 nt, Human
uuaggauccuucuaacau

SEQ ID NO: 909804 - RNA, 22 nt, Human
uuaguagagacaggguuucacc

SEQ ID NO: 909805 - RNA, 24 nt, Human
uuaguagagacaggguuucaccgu

SEQ ID NO: 909806 - RNA, 21 nt, Human
uucaguguuugaguguacuua

SEQ ID NO: 909807 - RNA, 20 nt, Human
uucauuaggauccuucuaac

SEQ ID NO: 909808 - RNA, 18 nt, Human
uugcucugucucccaggc

SEQ ID NO: 909809 - RNA, 19 nt, Human
uuucaccguguuagccagg

SEQ ID NO: 909810 - RNA, 21 nt, Human
uuugcuuuuuccccuagauuu

SEQ ID NO: 909811 - RNA, 23 nt, Human
uuugcuuuuuccccuagauuuga

SEQ ID NO: 909812 - RNA, 24 nt, Human
uuuucuaaguucuccaucugaaua

SEQ ID NO: 909813 - RNA, 24 nt, Human
uuuuuaguagagacaggguuucac

SEQ ID NO: 909814 - RNA, 22 nt, Human
uuuuuguauuuuuaguagagaa

SEQ ID NO: 909815 - RNA, 21 nt, Human
uuuuuuguauuuuuaguagag

SEQ ID NO: 909816 - RNA, 24 nt, Human
uuuuuuuuuuuugagacggagucu

SEQ ID NO: 909817 - RNA, 23 nt, Human
aaaaggaaaagaaugucaaagaa

SEQ ID NO: 909818 - RNA, 24 nt, Human
aaacacuuacauuguauaguaaua

SEQ ID NO: 909819 - RNA, 21 nt, Human
aaacccacaggcuucuaugga

SEQ ID NO: 909820 - RNA, 23 nt, Human
aaagaagcaagaugaggaucugu

SEQ ID NO: 909821 - RNA, 18 nt, Human
aagaaaacugaacacaua

SEQ ID NO: 909822 - RNA, 19 nt, Human
aagacaacaacaaaaacaa

SEQ ID NO: 909823 - RNA, 22 nt, Human
aagacaacaacaaaaacaauuu

SEQ ID NO: 909824 - RNA, 22 nt, Human
aagcaacauugauguuaaagcc

SEQ ID NO: 909825 - RNA, 23 nt, Human
aagcaacauugauguuaaagccc

SEQ ID NO: 909826 - RNA, 18 nt, Human
aagcaagaugaggaucug

SEQ ID NO: 909827 - RNA, 20 nt, Human
aaguaggucauacaugaaca

SEQ ID NO: 909828 - RNA, 21 nt, Human
aaguaggucauacaugaacau

SEQ ID NO: 909829 - RNA, 20 nt, Human
aauaguaccauuuuaaaccc

SEQ ID NO: 909830 - RNA, 20 nt, Human
agaaagcucaugaaauacga

SEQ ID NO: 909831 - RNA, 19 nt, Human
aggugcagguuccccccac

SEQ ID NO: 909832 - RNA, 22 nt, Human
agguuccccccaccccccccaa

SEQ ID NO: 909833 - RNA, 21 nt, Human
agguuuggagguuaccgugcc

SEQ ID NO: 909834 - RNA, 20 nt, Human
aguaaagagaacagaaagaa

SEQ ID NO: 909835 - RNA, 25 nt, Human
aguaaagagaacagaaagaaggucc

SEQ ID NO: 909836 - RNA, 19 nt, Human
agucuaaaauucugcauau

SEQ ID NO: 909837 - RNA, 22 nt, Human
agugguacuucucucucuuuug

SEQ ID NO: 909838 - RNA, 21 nt, Human
auacaucuaugugugugugcu

SEQ ID NO: 909839 - RNA, 25 nt, Human
auagaagaaaccaucgaaacccaca

SEQ ID NO: 909840 - RNA, 20 nt, Human
auauauacacauauguauac

SEQ ID NO: 909841 - RNA, 21 nt, Human
auauauauauguguguguaua

SEQ ID NO: 909842 - RNA, 21 nt, Human
auauauauguguguguauaua

SEQ ID NO: 909843 - RNA, 23 nt, Human
auccauccauauauauaugugug

SEQ ID NO: 909844 - RNA, 20 nt, Human
augaagcucugaaauaagag

SEQ ID NO: 909845 - RNA, 18 nt, Human
auguaucauauauacaca

SEQ ID NO: 909846 - RNA, 24 nt, Human
caaaaaaaggaaaagaaugucaaa

SEQ ID NO: 909847 - RNA, 19 nt, Human
caaagucuucucuaccccc

SEQ ID NO: 909848 - RNA, 25 nt, Human
caacaaaaacaauuuuaaaaacuga

SEQ ID NO: 909849 - RNA, 21 nt, Human
caacaacaucaaagcaacauu

SEQ ID NO: 909850 - RNA, 21 nt, Human
caacauaaauaaaccauguug

SEQ ID NO: 909851 - RNA, 19 nt, Human
caaguacaauaccauaaua

SEQ ID NO: 909852 - RNA, 25 nt, Human
caaguacaauaccauaauaguacca

SEQ ID NO: 909853 - RNA, 22 nt, Human
cagaagcccacaagaaaacuga

SEQ ID NO: 909854 - RNA, 19 nt, Human
cagcgugucagggugacca

SEQ ID NO: 909855 - RNA, 22 nt, Human
cagcgugucagggugaccagug

SEQ ID NO: 909856 - RNA, 19 nt, Human
cagguuccccccacccccc

SEQ ID NO: 909857 - RNA, 24 nt, Human
cauaauaguaccauuuuaaacccu

SEQ ID NO: 909858 - RNA, 24 nt, Human
cauauauauauguguguguauaua

SEQ ID NO: 909859 - RNA, 27 nt, Human
cauauguauacguuuacauacauggug

SEQ ID NO: 909860 - RNA, 24 nt, Human
caucuuccaugucggagccgaaga

SEQ ID NO: 909861 - RNA, 25 nt, Human
cauucuuuuccuucaaagucuucuc

SEQ ID NO: 909862 - RNA, 21 nt, Human
cccacaagaaaacugaacaca

SEQ ID NO: 909863 - RNA, 19 nt, Human
cccaccccccccaaaaaaa

SEQ ID NO: 909864 - RNA, 19 nt, Human
cccccccaaaaaaaggaaa

SEQ ID NO: 909865 - RNA, 20 nt, Human
ccugaggcuguggacuacaa

SEQ ID NO: 909866 - RNA, 20 nt, Human
cggcgagggcgaacguggcg

SEQ ID NO: 909867 - RNA, 21 nt, Human
cguguguguguauguguaugu

SEQ ID NO: 909868 - RNA, 22 nt, Human
cguuuacauacaugagugugua

SEQ ID NO: 909869 - RNA, 24 nt, Human
cuacauguuugcuucucucuuccu

SEQ ID NO: 909870 - RNA, 21 nt, Human
cuauauacaucuaugugugug

SEQ ID NO: 909871 - RNA, 18 nt, Human
cucucuuccucucuuucc

SEQ ID NO: 909872 - RNA, 21 nt, Human
cucuuccucucuuuccuucug

SEQ ID NO: 909873 - RNA, 21 nt, Human
cucuucucaaaaagacaggaa

SEQ ID NO: 909874 - RNA, 18 nt, Human
cuggucaaccaaaaaggu

SEQ ID NO: 909875 - RNA, 22 nt, Human
cuucucaaaaagacaggaaguc

SEQ ID NO: 909876 - RNA, 18 nt, Human
cuugacuuauuuauuuga

SEQ ID NO: 909877 - RNA, 22 nt, Human
gaaaaauguaccccucguaucc

SEQ ID NO: 909878 - RNA, 23 nt, Human
gaaaauagcaaauggagcuccac

SEQ ID NO: 909879 - RNA, 19 nt, Human
gaacauucaccauucacaa

SEQ ID NO: 909880 - RNA, 22 nt, Human
gagaacagaaagaagguccaac

SEQ ID NO: 909881 - RNA, 25 nt, Human
gagaagaguaaagagaaccgguacc

SEQ ID NO: 909882 - RNA, 21 nt, Human
gcagguuccccccaccccccc

SEQ ID NO: 909883 - RNA, 24 nt, Human
gcagguuccccccaccccccccaa

SEQ ID NO: 909884 - RNA, 31 nt, Human
guauguaucauauauacacauauguauacgg

SEQ ID NO: 909885 - RNA, 24 nt, Human
guuaccaggugcagguucccccca

SEQ ID NO: 909886 - RNA, 22 nt, Human
uaaaaugcgccagaagugacug

SEQ ID NO: 909887 - RNA, 19 nt, Human
uaacaucucuguggaugac

SEQ ID NO: 909888 - RNA, 18 nt, Human
uaaccucaacgacauuug

SEQ ID NO: 909889 - RNA, 23 nt, Human
uacauccauccauauauauaugu

SEQ ID NO: 909890 - RNA, 21 nt, Human
uacauucuuuuccuucaaagu

SEQ ID NO: 909891 - RNA, 24 nt, Human
uaccccucguauccauaagacuug

SEQ ID NO: 909892 - RNA, 21 nt, Human
uacguggaagagauaagugag

SEQ ID NO: 909893 - RNA, 22 nt, Human
uacuggucaaccaaaaaggugg

SEQ ID NO: 909894 - RNA, 26 nt, Human
uacuucucucucuuuugucgggcucc

SEQ ID NO: 909895 - RNA, 23 nt, Human
uauauacacauauguauacguua

SEQ ID NO: 909896 - RNA, 25 nt, Human
uauauuacauccauccauauauaua

SEQ ID NO: 909897 - RNA, 29 nt, Human
uauauuacauccauccauauauauaugug

SEQ ID NO: 909898 - RNA, 25 nt, Human
uauguaucauauauacacauaugua

SEQ ID NO: 909899 - RNA, 26 nt, Human
uauguaucauauauacacauauguaa

SEQ ID NO: 909900 - RNA, 23 nt, Human
uauguguauguaucauauauaca

SEQ ID NO: 909901 - RNA, 19 nt, Human
uaugugugugugcuacaua

SEQ ID NO: 909902 - RNA, 21 nt, Human
uaugugugugugcuacauaua

SEQ ID NO: 909903 - RNA, 20 nt, Human
ucaaagaagcaagaugagga

SEQ ID NO: 909904 - RNA, 19 nt, Human
ucauauauacacauaugua

SEQ ID NO: 909905 - RNA, 21 nt, Human
uccaugucggagccgaagagc

SEQ ID NO: 909906 - RNA, 23 nt, Human
uccccccaccccccccaaaaaaa

SEQ ID NO: 909907 - RNA, 19 nt, Human
ucucuguggaugacuucua

SEQ ID NO: 909908 - RNA, 23 nt, Human
ucuuuguaggaaggggugcagag

SEQ ID NO: 909909 - RNA, 18 nt, Human
ugaaauacgaccgugcag

SEQ ID NO: 909910 - RNA, 18 nt, Human
ugaacaaaacgccuaugg

SEQ ID NO: 909911 - RNA, 22 nt, Human
ugaagcucugaaauaagaguuu

SEQ ID NO: 909912 - RNA, 20 nt, Human
ugacugcuuuaucaucuuug

SEQ ID NO: 909913 - RNA, 18 nt, Human
ugaucugaucugugagaa

SEQ ID NO: 909914 - RNA, 21 nt, Human
ugcacaaaccaggcucauaug

SEQ ID NO: 909915 - RNA, 18 nt, Human
ugcaccccaguuaccagg

SEQ ID NO: 909916 - RNA, 21 nt, Human
ugcagguuccccccacccccc

SEQ ID NO: 909917 - RNA, 20 nt, Human
ugccaagacaacaacaaaaa

SEQ ID NO: 909918 - RNA, 22 nt, Human
ugccaagacaacaacaaaaaca

SEQ ID NO: 909919 - RNA, 20 nt, Human
ugcuucucucuuccucucuu

SEQ ID NO: 909920 - RNA, 22 nt, Human
uggaagagauaagugagaggug

SEQ ID NO: 909921 - RNA, 18 nt, Human
uggcaggaaguccucugc

SEQ ID NO: 909922 - RNA, 28 nt, Human
uggugguaaauauguagaagcauauuuu

SEQ ID NO: 909923 - RNA, 24 nt, Human
uguauacguuuacauacaugagug

SEQ ID NO: 909924 - RNA, 25 nt, Human
uguauagaagaaaccaucgaaaccc

SEQ ID NO: 909925 - RNA, 21 nt, Human
uguauguguauguaucauaua

SEQ ID NO: 909926 - RNA, 21 nt, Human
uguauguguauguaucauaua

SEQ ID NO: 909927 - RNA, 23 nt, Human
uguauguguauguaucauauaua

SEQ ID NO: 909928 - RNA, 23 nt, Human
ugucucucguguguguguaugug

SEQ ID NO: 909929 - RNA, 20 nt, Human
uguguauauaucuagccaca

SEQ ID NO: 909930 - RNA, 19 nt, Human
uguguauguaucauauaua

SEQ ID NO: 909931 - RNA, 25 nt, Human
uguguauguaucauauauacacaua

SEQ ID NO: 909932 - RNA, 25 nt, Human
uguguguauauaucuagccacagug

SEQ ID NO: 909933 - RNA, 19 nt, Human
uguguguguauguguaugu

SEQ ID NO: 909934 - RNA, 25 nt, Human
uucaaagucuucucuacccccaucu

SEQ ID NO: 909935 - RNA, 26 nt, Human
uucaaagucuucucuacccccaucuc

SEQ ID NO: 909936 - RNA, 22 nt, Human
uucaugaagcucugaaauaaga

SEQ ID NO: 909937 - RNA, 22 nt, Human
uuccccccaccccccccaaaaa

SEQ ID NO: 909938 - RNA, 22 nt, Human
uugcaccccaguuaccaggugc

SEQ ID NO: 909939 - RNA, 24 nt, Human
uugcucagugucuaugaugccuca

SEQ ID NO: 909940 - RNA, 19 nt, Human
uuguaggaaggggugcaga

SEQ ID NO: 909941 - RNA, 22 nt, Human
uuugcuacaacauaaauaaacc

SEQ ID NO: 909942 - RNA, 21 nt, Human
uuuguccauuuccuuuaaggc

SEQ ID NO: 909943 - RNA, 19 nt, Human
aaaauaccucuauggaaua

SEQ ID NO: 909944 - RNA, 22 nt, Human
aaaauccaaaauuagggacccc

SEQ ID NO: 909945 - RNA, 19 nt, Human
aacagaaaagcccuauaca

SEQ ID NO: 909946 - RNA, 20 nt, Human
aaggaaacaagcuuguagaa

SEQ ID NO: 909947 - RNA, 19 nt, Human
aaggaugacauugcuggac

SEQ ID NO: 909948 - RNA, 25 nt, Human
aauuuuauaccagaacuccucacua

SEQ ID NO: 909949 - RNA, 19 nt, Human
accccaccccgugguccug

SEQ ID NO: 909950 - RNA, 25 nt, Human
accucuuucuuuguccuucccguug

SEQ ID NO: 909951 - RNA, 22 nt, Human
aggcauucagggacgggaagca

SEQ ID NO: 909952 - RNA, 24 nt, Human
agguccuuggauccaaaacagucc

SEQ ID NO: 909953 - RNA, 18 nt, Human
aggugcccagcacugagc

SEQ ID NO: 909954 - RNA, 21 nt, Human
agucaauaaugccaaagcuaa

SEQ ID NO: 909955 - RNA, 21 nt, Human
agucccagucuagaauuaccc

SEQ ID NO: 909956 - RNA, 22 nt, Human
caaacagaaaagcccuauacaa

SEQ ID NO: 909957 - RNA, 24 nt, Human
caaagcuaaggauagaaaucuauc

SEQ ID NO: 909958 - RNA, 24 nt, Human
caagguagucaaugcuuauucucc

SEQ ID NO: 909959 - RNA, 24 nt, Human
caaggugaaagcccaggcaugguu

SEQ ID NO: 909960 - RNA, 23 nt, Human
caagucaauccagucaauaaugc

SEQ ID NO: 909961 - RNA, 20 nt, Human
cacccccaccaguauuccca

SEQ ID NO: 909962 - RNA, 23 nt, Human
cacccccaccaguauucccaguu

SEQ ID NO: 909963 - RNA, 22 nt, Human
caccucuuucuuuguccuuccc

SEQ ID NO: 909964 - RNA, 19 nt, Human
cagucaauaaugccaaagc

SEQ ID NO: 909965 - RNA, 23 nt, Human
ccaccuccccuggagauuauucc

SEQ ID NO: 909966 - RNA, 18 nt, Human
ccaccucuuucuuugucc

SEQ ID NO: 909967 - RNA, 19 nt, Human
ccagacagcuuuccuugcc

SEQ ID NO: 909968 - RNA, 22 nt, Human
ccagcuacagauuuccuuccac

SEQ ID NO: 909969 - RNA, 19 nt, Human
ccccgugguccugcuacuc

SEQ ID NO: 909970 - RNA, 18 nt, Human
ccccuggagauuauuccc

SEQ ID NO: 909971 - RNA, 21 nt, Human
ccgccgcugccccggcuccug

SEQ ID NO: 909972 - RNA, 21 nt, Human
cgcacaggugcccagcacuga

SEQ ID NO: 909973 - RNA, 23 nt, Human
cuuucugagcuaaaagaacaaaa

SEQ ID NO: 909974 - RNA, 21 nt, Human
gacagucuggcacaaaaaggc

SEQ ID NO: 909975 - RNA, 21 nt, Human
gaggguccuggggugugcucc

SEQ ID NO: 909976 - RNA, 21 nt, Human
ggaaaagugaggguccugggg

SEQ ID NO: 909977 - RNA, 22 nt, Human
ggacagucuggcacaaaaaggc

SEQ ID NO: 909978 - RNA, 23 nt, Human
ggauccaaaacaguccccuaccc

SEQ ID NO: 909979 - RNA, 24 nt, Human
ggcacaaaaaggcauucagggacg

SEQ ID NO: 909980 - RNA, 19 nt, Human
gggagaaaacuuugucugu

SEQ ID NO: 909981 - RNA, 20 nt, Human
gugcauccuugagauguuag

SEQ ID NO: 909982 - RNA, 18 nt, Human
uaagcgacuuguucaagu

SEQ ID NO: 909983 - RNA, 25 nt, Human
uaaggaaaaauccaaaauuagggac

SEQ ID NO: 909984 - RNA, 22 nt, Human
uaaggaaacaagcuuguagaag

SEQ ID NO: 909985 - RNA, 23 nt, Human
uaaggaaacaagcuuguagaagu

SEQ ID NO: 909986 - RNA, 21 nt, Human
uacaaaaugaagcagcgcuaa

SEQ ID NO: 909987 - RNA, 22 nt, Human
uacacgugaaccaaauguuuuc

SEQ ID NO: 909988 - RNA, 24 nt, Human
uagaaaucuaucuucuagcccaau

SEQ ID NO: 909989 - RNA, 20 nt, Human
uaggauuaaaaauaaaauac

SEQ ID NO: 909990 - RNA, 19 nt, Human
uagucauuuugcagcugca

SEQ ID NO: 909991 - RNA, 19 nt, Human
uaguuugcuuuaaguuggu

SEQ ID NO: 909992 - RNA, 19 nt, Human
uauagggagcaaagcagcu

SEQ ID NO: 909993 - RNA, 23 nt, Human
uccccuggagauuauucccagca

SEQ ID NO: 909994 - RNA, 20 nt, Human
uccugcacauguucaccccu

SEQ ID NO: 909995 - RNA, 24 nt, Human
ucucugcugcugaccaugcuucaa

SEQ ID NO: 909996 - RNA, 18 nt, Human
ucugggagaugccccuuc

SEQ ID NO: 909997 - RNA, 18 nt, Human
ugaacaaagaguuguaag

SEQ ID NO: 909998 - RNA, 18 nt, Human
ugaacaaagaguuguaag

SEQ ID NO: 909999 - RNA, 19 nt, Human
ugaacaaagaguuguaagg

SEQ ID NO: 910000 - RNA, 21 nt, Human
ugaaccaaauguuuuccugcc

SEQ ID NO: 910001 - RNA, 18 nt, Human
ugaucaguauuuauaagg

SEQ ID NO: 910002 - RNA, 19 nt, Human
ugccccaccucuuucuuug

SEQ ID NO: 910003 - RNA, 18 nt, Human
ugccccgaggccucuagc

SEQ ID NO: 910004 - RNA, 23 nt, Human
ugccccgaggccucuagcuguuc

SEQ ID NO: 910005 - RNA, 22 nt, Human
ugccccuuccuucucuggcuca

SEQ ID NO: 910006 - RNA, 19 nt, Human
ugcuggacugaaaauggcc

SEQ ID NO: 910007 - RNA, 22 nt, Human
ugcuucaaggugaaagcccagg

SEQ ID NO: 910008 - RNA, 19 nt, Human
uggauccaaaacagucccc

SEQ ID NO: 910009 - RNA, 21 nt, Human
uggcucagaguggcuggcgcc

SEQ ID NO: 910010 - RNA, 24 nt, Human
uggcucagaguggcuggcgccgac

SEQ ID NO: 910011 - RNA, 24 nt, Human
ugggagaaaacuuugucuguaaug

SEQ ID NO: 910012 - RNA, 18 nt, Human
ugggagaugccccuuccu

SEQ ID NO: 910013 - RNA, 20 nt, Human
uguagaaguuaagcgacuug

SEQ ID NO: 910014 - RNA, 20 nt, Human
uguucaguguucccucagcu

SEQ ID NO: 910015 - RNA, 21 nt, Human
uguuuuccugccccgaggccu

SEQ ID NO: 910016 - RNA, 22 nt, Human
uucacccccaccaguauuccca

SEQ ID NO: 910017 - RNA, 20 nt, Human
uucucuggcucagaguggcu

SEQ ID NO: 910018 - RNA, 18 nt, Human
uugccuguuuacacguga

SEQ ID NO: 910019 - RNA, 27 nt, Human
uuuuuuuuuuuuuuuuuuauguugggg

SEQ ID NO: 910020 - RNA, 23 nt, Human
aagaagcucagcuagaaugaugc

SEQ ID NO: 910021 - RNA, 22 nt, Human
aagccaggucauuagcaaagga

SEQ ID NO: 910022 - RNA, 22 nt, Human
aaguaacggcauugacagucau

SEQ ID NO: 910023 - RNA, 20 nt, Human
aaugaagaagcucagcuaga

SEQ ID NO: 910024 - RNA, 20 nt, Human
aauggcaauuacugugugug

SEQ ID NO: 910025 - RNA, 23 nt, Human
agaaaacaaauguuccugacuca

SEQ ID NO: 910026 - RNA, 18 nt, Human
agaagaaggagaaugaag

SEQ ID NO: 910027 - RNA, 20 nt, Human
agaagaaggagaaugaagaa

SEQ ID NO: 910028 - RNA, 20 nt, Human
agaagugggaaaaaaagcau

SEQ ID NO: 910029 - RNA, 20 nt, Human
agccagugcaaaaaugacaa

SEQ ID NO: 910030 - RNA, 19 nt, Human
agcuagaaugaugcaagac

SEQ ID NO: 910031 - RNA, 19 nt, Human
aggucccccacagccucac

SEQ ID NO: 910032 - RNA, 21 nt, Human
aguucuaagaccucaaaccaa

SEQ ID NO: 910033 - RNA, 24 nt, Human
augaugcaagacacuggcagccuc

SEQ ID NO: 910034 - RNA, 21 nt, Human
caacccccaaagauucauccc

SEQ ID NO: 910035 - RNA, 23 nt, Human
caacccccaaagauucauccccu

SEQ ID NO: 910036 - RNA, 22 nt, Human
cacagaaccggauccauuuuga

SEQ ID NO: 910037 - RNA, 24 nt, Human
cagacagaugccuugaaagccagg

SEQ ID NO: 910038 - RNA, 21 nt, Human
cagcuagaaugaugcaagaca

SEQ ID NO: 910039 - RNA, 22 nt, Human
caggggguggggggcuuguguu

SEQ ID NO: 910040 - RNA, 26 nt, Human
cccacagccucacucucgcacccgcc

SEQ ID NO: 910041 - RNA, 21 nt, Human
ccccaaagauucauccccugg

SEQ ID NO: 910042 - RNA, 22 nt, Human
ccccaaagauucauccccugga

SEQ ID NO: 910043 - RNA, 25 nt, Human
ccccacagccucacucucgcacccg

SEQ ID NO: 910044 - RNA, 18 nt, Human
ccccagaguucuaagacc

SEQ ID NO: 910045 - RNA, 24 nt, Human
cccggggccagggcacgcagaagc

SEQ ID NO: 910046 - RNA, 18 nt, Human
ccgccacagaaccggauc

SEQ ID NO: 910047 - RNA, 19 nt, Human
cucccggggccagggcacg

SEQ ID NO: 910048 - RNA, 18 nt, Human
cuucgcggagguucggcc

SEQ ID NO: 910049 - RNA, 18 nt, Human
gaauaucccccagaguuc

SEQ ID NO: 910050 - RNA, 18 nt, Human
gcgcgcaaguaggaggga

SEQ ID NO: 910051 - RNA, 18 nt, Human
ggagauggugugagggaa

SEQ ID NO: 910052 - RNA, 18 nt, Human
gggaaggccaagggucag

SEQ ID NO: 910053 - RNA, 18 nt, Human
ggucaggggguggggggc

SEQ ID NO: 910054 - RNA, 21 nt, Human
uaagaccucaaaccaaccccc

SEQ ID NO: 910055 - RNA, 23 nt, Human
uaagaccucaaaccaacccccaa

SEQ ID NO: 910056 - RNA, 21 nt, Human
uaugggucuuuguggaagaag

SEQ ID NO: 910057 - RNA, 22 nt, Human
uauuacagaagugggaaaaaaa

SEQ ID NO: 910058 - RNA, 19 nt, Human
ucaggccagacagaugccu

SEQ ID NO: 910059 - RNA, 18 nt, Human
uccauucucaucaggcca

SEQ ID NO: 910060 - RNA, 24 nt, Human
ucucgcacccgccacagaaccgga

SEQ ID NO: 910061 - RNA, 21 nt, Human
ucugaaaggaaauuggagaaa

SEQ ID NO: 910062 - RNA, 24 nt, Human
ugaaaguuguacaccuucuccaga

SEQ ID NO: 910063 - RNA, 23 nt, Human
ugccccuucauguuuuguuucug

SEQ ID NO: 910064 - RNA, 20 nt, Human
uggaagaaggagaagaagga

SEQ ID NO: 910065 - RNA, 22 nt, Human
uggaagaaggagaagaaggaga

SEQ ID NO: 910066 - RNA, 24 nt, Human
uggaaucaucaucuuugcggugau

SEQ ID NO: 910067 - RNA, 19 nt, Human
uggaggucccccacagccu

SEQ ID NO: 910068 - RNA, 23 nt, Human
uggugugagggaaggccaagggu

SEQ ID NO: 910069 - RNA, 20 nt, Human
uguggaagaaggagaagaag

SEQ ID NO: 910070 - RNA, 23 nt, Human
uuacuguguguguggcuuuuuuc

SEQ ID NO: 910071 - RNA, 18 nt, Human
uucauguuuuguuucugu

SEQ ID NO: 910072 - RNA, 23 nt, Human
uucuguuugaguaaaaaucucac

SEQ ID NO: 910073 - RNA, 27 nt, Human
aaaaacgcaucucucuaaaggcaacuc

SEQ ID NO: 910074 - RNA, 23 nt, Human
aaaccaucaagcugcucagacaa

SEQ ID NO: 910075 - RNA, 21 nt, Human
aacaccccaauccagcucugc

SEQ ID NO: 910076 - RNA, 20 nt, Human
aacgcacacagaaugaaacg

SEQ ID NO: 910077 - RNA, 23 nt, Human
aagcauggcuggcucauucauac

SEQ ID NO: 910078 - RNA, 23 nt, Human
aagcggucagcccacgggaccau

SEQ ID NO: 910079 - RNA, 19 nt, Human
aaggcagguggacccccuc

SEQ ID NO: 910080 - RNA, 23 nt, Human
accccacaacgcacacagaauga

SEQ ID NO: 910081 - RNA, 20 nt, Human
acccccucccccaccccaca

SEQ ID NO: 910082 - RNA, 22 nt, Human
acccccucccccaccccacaac

SEQ ID NO: 910083 - RNA, 19 nt, Human
accucgcccuguccccgcu

SEQ ID NO: 910084 - RNA, 21 nt, Human
acgagaaagcugaggcccagg

SEQ ID NO: 910085 - RNA, 18 nt, Human
acggagaaaaagagagaa

SEQ ID NO: 910086 - RNA, 20 nt, Human
acggagaaaaagagagaagc

SEQ ID NO: 910087 - RNA, 23 nt, Human
agaaagaaauagauuuauucuca

SEQ ID NO: 910088 - RNA, 19 nt, Human
agaagccaguggcgggcug

SEQ ID NO: 910089 - RNA, 24 nt, Human
agagaagcaaauuacaaagucucc

SEQ ID NO: 910090 - RNA, 20 nt, Human
agagagaagccaguggcggg

SEQ ID NO: 910091 - RNA, 18 nt, Human
agcagugggcugcccccu

SEQ ID NO: 910092 - RNA, 18 nt, Human
aggaaguccuggucuagg

SEQ ID NO: 910093 - RNA, 22 nt, Human
aggcaggaggaagcauggcugg

SEQ ID NO: 910094 - RNA, 18 nt, Human
aggcagguggacccccuc

SEQ ID NO: 910095 - RNA, 21 nt, Human
aggcagguggacccccucccc

SEQ ID NO: 910096 - RNA, 19 nt, Human
agggaccaagagcaguggg

SEQ ID NO: 910097 - RNA, 20 nt, Human
agggaccaagagcagugggc

SEQ ID NO: 910098 - RNA, 23 nt, Human
agggcacagguggauauggccuu

SEQ ID NO: 910099 - RNA, 18 nt, Human
agugguccucagggggcc

SEQ ID NO: 910100 - RNA, 20 nt, Human
auuacaaagucuccgugagg

SEQ ID NO: 910101 - RNA, 28 nt, Human
caacgcacacagaaugaaacggagaaaa

SEQ ID NO: 910102 - RNA, 22 nt, Human
caagagcagugggcugcccccu

SEQ ID NO: 910103 - RNA, 25 nt, Human
caagagucccggccuauggggucuc

SEQ ID NO: 910104 - RNA, 19 nt, Human
cacagaaugaaacggagaa

SEQ ID NO: 910105 - RNA, 18 nt, Human
cacagaguccuagaaaaa

SEQ ID NO: 910106 - RNA, 24 nt, Human
cacucugcucacucagaugucuca

SEQ ID NO: 910107 - RNA, 26 nt, Human
cacucugcucacucagaugucucacc

SEQ ID NO: 910108 - RNA, 28 nt, Human
cacucugcucacucagaugucucaccuu

SEQ ID NO: 910109 - RNA, 21 nt, Human
cagagcacugagcugccccuc

SEQ ID NO: 910110 - RNA, 22 nt, Human
cagccuggacucaacaccccaa

SEQ ID NO: 910111 - RNA, 26 nt, Human
caggcacagggaccaagagcaguggg

SEQ ID NO: 910112 - RNA, 23 nt, Human
cagggcacagguggauauggccu

SEQ ID NO: 910113 - RNA, 19 nt, Human
cagguggauauggccuuga

SEQ ID NO: 910114 - RNA, 18 nt, Human
caguauaguagugguccu

SEQ ID NO: 910115 - RNA, 25 nt, Human
cagugggcugcccccuacucagccu

SEQ ID NO: 910116 - RNA, 23 nt, Human
ccaagagcagugggcugcccccu

SEQ ID NO: 910117 - RNA, 24 nt, Human
ccacugcucauuggucaccccugu

SEQ ID NO: 910118 - RNA, 22 nt, Human
ccagcaggcacagggaccaaga

SEQ ID NO: 910119 - RNA, 21 nt, Human
ccagccagacuaagguggcac

SEQ ID NO: 910120 - RNA, 19 nt, Human
ccagcuucuuccuggggcc

SEQ ID NO: 910121 - RNA, 22 nt, Human
cccaggacccguggcucuguuc

SEQ ID NO: 910122 - RNA, 18 nt, Human
ccccacaacgcacacaga

SEQ ID NO: 910123 - RNA, 21 nt, Human
ccccaccccacaacgcacaca

SEQ ID NO: 910124 - RNA, 24 nt, Human
cccccaccccacaacgcacacaga

SEQ ID NO: 910125 - RNA, 18 nt, Human
cccccagcaggcacaggg

SEQ ID NO: 910126 - RNA, 24 nt, Human
cccccaggucccaaucccaccauc

SEQ ID NO: 910127 - RNA, 23 nt, Human
cccccucccccaccccacaacgc

SEQ ID NO: 910128 - RNA, 24 nt, Human
cccgcucccuguuuggcccagaca

SEQ ID NO: 910129 - RNA, 23 nt, Human
cccucccccaccccacaacgcac

SEQ ID NO: 910130 - RNA, 20 nt, Human
cccuguaucccccagguccc

SEQ ID NO: 910131 - RNA, 18 nt, Human
ccucccacagaacuaagg

SEQ ID NO: 910132 - RNA, 28 nt, Human
ccuccccagccagacuaagguggcaccu

SEQ ID NO: 910133 - RNA, 25 nt, Human
ccucgcccuguccccgcugccugga

SEQ ID NO: 910134 - RNA, 23 nt, Human
ccuggagacccaaagggugggag

SEQ ID NO: 910135 - RNA, 24 nt, Human
ccuggggccccuguaucccccagg

SEQ ID NO: 910136 - RNA, 23 nt, Human
cuccugcccaucaaucccauccu

SEQ ID NO: 910137 - RNA, 21 nt, Human
cuggggccccuguauccccca

SEQ ID NO: 910138 - RNA, 25 nt, Human
gaaauagauuuauucucauguacaa

SEQ ID NO: 910139 - RNA, 23 nt, Human
gaaguccuggucuaggacccagg

SEQ ID NO: 910140 - RNA, 23 nt, Human
gacaaagaauggcuugggaaaga

SEQ ID NO: 910141 - RNA, 19 nt, Human
gacccccucccccacccca

SEQ ID NO: 910142 - RNA, 19 nt, Human
gagaaaaagagagaagcca

SEQ ID NO: 910143 - RNA, 22 nt, Human
gagacccaaagggugggagucc

SEQ ID NO: 910144 - RNA, 20 nt, Human
gcagagcacugagcugcccc

SEQ ID NO: 910145 - RNA, 21 nt, Human
gccgcggcuguuucuaguccu

SEQ ID NO: 910146 - RNA, 23 nt, Human
ggacccccucccccaccccacaa

SEQ ID NO: 910147 - RNA, 24 nt, Human
ggagaaaccaucaagcugcucaga

SEQ ID NO: 910148 - RNA, 22 nt, Human
ggcagggaaguguccuggaggg

SEQ ID NO: 910149 - RNA, 20 nt, Human
gggcagggaaguguccugga

SEQ ID NO: 910150 - RNA, 22 nt, Human
uaagguggcaccucgcccuguc

SEQ ID NO: 910151 - RNA, 24 nt, Human
uagaaaaacgcaucucucuaaagg

SEQ ID NO: 910152 - RNA, 19 nt, Human
uagaaagaaauagauuuau

SEQ ID NO: 910153 - RNA, 25 nt, Human
uagagcauggauugucuuacccgcu

SEQ ID NO: 910154 - RNA, 19 nt, Human
uauaguagugguccucagg

SEQ ID NO: 910155 - RNA, 21 nt, Human
uaucccccaggucccaauccc

SEQ ID NO: 910156 - RNA, 18 nt, Human
ucaacaccccaauccagc

SEQ ID NO: 910157 - RNA, 19 nt, Human
ucaacaccccaauccagcu

SEQ ID NO: 910158 - RNA, 22 nt, Human
ucaacaccccaauccagcucug

SEQ ID NO: 910159 - RNA, 22 nt, Human
ucaaucccauccugcuucuccc

SEQ ID NO: 910160 - RNA, 23 nt, Human
ucaaucccauccugcuucucccc

SEQ ID NO: 910161 - RNA, 23 nt, Human
ucagaggugcagaguagggccca

SEQ ID NO: 910162 - RNA, 21 nt, Human
ucagcccacgggaccauauac

SEQ ID NO: 910163 - RNA, 21 nt, Human
ucagggggccuucgccgcggc

SEQ ID NO: 910164 - RNA, 24 nt, Human
ucccagugcaucuggccagaccag

SEQ ID NO: 910165 - RNA, 19 nt, Human
uccccagggccccucucug

SEQ ID NO: 910166 - RNA, 19 nt, Human
uccucaucguccgccuccc

SEQ ID NO: 910167 - RNA, 21 nt, Human
ucucucacuggcugcaggaau

SEQ ID NO: 910168 - RNA, 24 nt, Human
ucucugcagagcacugagcugccc

SEQ ID NO: 910169 - RNA, 21 nt, Human
ucugcugggacuccgcagagc

SEQ ID NO: 910170 - RNA, 23 nt, Human
ucugcugggacuccgcagagcca

SEQ ID NO: 910171 - RNA, 23 nt, Human
ugaggccaggucucucacuggcu

SEQ ID NO: 910172 - RNA, 18 nt, Human
ugccaggcugaggccagg

SEQ ID NO: 910173 - RNA, 21 nt, Human
ugccuggaguucagggcaggg

SEQ ID NO: 910174 - RNA, 20 nt, Human
ugcucauuggucaccccugu

SEQ ID NO: 910175 - RNA, 20 nt, Human
ugcugggacuccgcagagcc

SEQ ID NO: 910176 - RNA, 20 nt, Human
uggacccccucccccacccc

SEQ ID NO: 910177 - RNA, 21 nt, Human
ugggaaagacuugccaaggug

SEQ ID NO: 910178 - RNA, 24 nt, Human
ugggaaagacuugccaaggugugg

SEQ ID NO: 910179 - RNA, 23 nt, Human
uggggucucccaagccccagggc

SEQ ID NO: 910180 - RNA, 21 nt, Human
ugucucaccuuccccuuccaa

SEQ ID NO: 910181 - RNA, 22 nt, Human
uuccuggggccccuguaucccc

SEQ ID NO: 910182 - RNA, 18 nt, Human
uuuuuuuuuuuuuuuuug

SEQ ID NO: 910183 - RNA, 20 nt, Human
uuuuuuuuuuuuuuuuuggu

SEQ ID NO: 910184 - RNA, 22 nt, Human
uuuuuuuuuuuuuuuuugguag

SEQ ID NO: 910185 - RNA, 25 nt, Human
aaaaaucucuuuacauauagcacac

SEQ ID NO: 910186 - RNA, 22 nt, Human
aaagcuucuuugagcaaaaagu

SEQ ID NO: 910187 - RNA, 20 nt, Human
aagccacaccaucuccuuug

SEQ ID NO: 910188 - RNA, 23 nt, Human
acacacacacacacacacacaca

SEQ ID NO: 910189 - RNA, 23 nt, Human
acacacacacacacacacacaca

SEQ ID NO: 910190 - RNA, 23 nt, Human
acacacacacacacacacacaca

SEQ ID NO: 910191 - RNA, 23 nt, Human
acacacacacacacacacacaca

SEQ ID NO: 910192 - RNA, 23 nt, Human
acacacacacacacacacacaca

SEQ ID NO: 910193 - RNA, 23 nt, Human
acacacacacacacacacacaca

SEQ ID NO: 910194 - RNA, 23 nt, Human
acacacacacacacacacacaca

SEQ ID NO: 910195 - RNA, 22 nt, Human
acacacacacacacacacacag

SEQ ID NO: 910196 - RNA, 23 nt, Human
agaagcugguguugcaaugugaa

SEQ ID NO: 910197 - RNA, 25 nt, Human
agcuuauauacacacacacauauag

SEQ ID NO: 910198 - RNA, 23 nt, Human
aggauguaucagaauucaaauaa

SEQ ID NO: 910199 - RNA, 21 nt, Human
aguaauguaauaccaaacacg

SEQ ID NO: 910200 - RNA, 22 nt, Human
auacauucauuaggcaaguaga

SEQ ID NO: 910201 - RNA, 18 nt, Human
auagagcuccuucaagug

SEQ ID NO: 910202 - RNA, 23 nt, Human
auuugcccaucucaaauuucuac

SEQ ID NO: 910203 - RNA, 19 nt, Human
caaaaugcaauagccauuu

SEQ ID NO: 910204 - RNA, 23 nt, Human
caaguggugcauagcaguaaugu

SEQ ID NO: 910205 - RNA, 21 nt, Human
cacaagcgaccccucucaaac

SEQ ID NO: 910206 - RNA, 22 nt, Human
cacacaagcgaccccucucaaa

SEQ ID NO: 910207 - RNA, 20 nt, Human
cacacacacacacacacaca

SEQ ID NO: 910208 - RNA, 20 nt, Human
cacacacacacacacacaca

SEQ ID NO: 910209 - RNA, 20 nt, Human
cacacacacacacacacaca

SEQ ID NO: 910210 - RNA, 20 nt, Human
cacacacacacacacacaca

SEQ ID NO: 910211 - RNA, 20 nt, Human
cacacacacacacacacaca

SEQ ID NO: 910212 - RNA, 20 nt, Human
cacacacacacacacacaca

SEQ ID NO: 910213 - RNA, 20 nt, Human
cacacacacacacacacaca

SEQ ID NO: 910214 - RNA, 20 nt, Human
cacacacacacacacacaca

SEQ ID NO: 910215 - RNA, 20 nt, Human
cacacacacacacacacaca

SEQ ID NO: 910216 - RNA, 20 nt, Human
cacacacacacacacacaca

SEQ ID NO: 910217 - RNA, 20 nt, Human
cacacacacacacacacaca

SEQ ID NO: 910218 - RNA, 20 nt, Human
cacacacacacacacacaca

SEQ ID NO: 910219 - RNA, 20 nt, Human
cacacacacacacacacaca

SEQ ID NO: 910220 - RNA, 22 nt, Human
cacacacacacacacacacaca

SEQ ID NO: 910221 - RNA, 22 nt, Human
cacacacacacacacacacaca

SEQ ID NO: 910222 - RNA, 22 nt, Human
cacacacacacacacacacaca

SEQ ID NO: 910223 - RNA, 22 nt, Human
cacacacacacacacacacaca

SEQ ID NO: 910224 - RNA, 22 nt, Human
cacacacacacacacacacaca

SEQ ID NO: 910225 - RNA, 22 nt, Human
cacacacacacacacacacaca

SEQ ID NO: 910226 - RNA, 22 nt, Human
cacacacacacacacacacaca

SEQ ID NO: 910227 - RNA, 26 nt, Human
cacacacacacacacacacacacaca

SEQ ID NO: 910228 - RNA, 26 nt, Human
cacacacacacacacacacacacaca

SEQ ID NO: 910229 - RNA, 26 nt, Human
cacacacacacacacacacacacaca

SEQ ID NO: 910230 - RNA, 26 nt, Human
cacacacacacacacacacacacaca

SEQ ID NO: 910231 - RNA, 26 nt, Human
cacacacacacacacacacacacaca

SEQ ID NO: 910232 - RNA, 26 nt, Human
cacacacacacacacacacacacaca

SEQ ID NO: 910233 - RNA, 28 nt, Human
cacacacacacacacacacacacagugg

SEQ ID NO: 910234 - RNA, 28 nt, Human
cacacacacacacacacacaguguuggc

SEQ ID NO: 910235 - RNA, 21 nt, Human
cagcucuuagguguuuaggua

SEQ ID NO: 910236 - RNA, 22 nt, Human
caguguuggcaggauguaucag

SEQ ID NO: 910237 - RNA, 20 nt, Human
cccucaguacuaagagcaaa

SEQ ID NO: 910238 - RNA, 23 nt, Human
cccuccuuaaaaaauccuuagaa

SEQ ID NO: 910239 - RNA, 22 nt, Human
ccucccaaagacacuccagagu

SEQ ID NO: 910240 - RNA, 20 nt, Human
ccugaaguacaauuucccaa

SEQ ID NO: 910241 - RNA, 21 nt, Human
cgaccccucucaaaccauccc

SEQ ID NO: 910242 - RNA, 22 nt, Human
cuccagagugaacuuccuucug

SEQ ID NO: 910243 - RNA, 31 nt, Human
cucuuucacacacacacacacacacacacag

SEQ ID NO: 910244 - RNA, 23 nt, Human
cugcacuguuuccuugcuaagcc

SEQ ID NO: 910245 - RNA, 21 nt, Human
gagucuuugacaagucaaucu

SEQ ID NO: 910246 - RNA, 22 nt, Human
guaauaccaaacacguggcccu

SEQ ID NO: 910247 - RNA, 25 nt, Human
guggagccagcaaucguggccuuca

SEQ ID NO: 910248 - RNA, 21 nt, Human
guggccuucaguguguaugug

SEQ ID NO: 910249 - RNA, 24 nt, Human
uaaagaaugccaucccccuuaaau

SEQ ID NO: 910250 - RNA, 20 nt, Human
uaaauggugauuugaucuua

SEQ ID NO: 910251 - RNA, 19 nt, Human
uaagccacaccaucuccuu

SEQ ID NO: 910252 - RNA, 23 nt, Human
uacacacaaaaugcgaagaaucc

SEQ ID NO: 910253 - RNA, 19 nt, Human
uagccauuugcccaucuca

SEQ ID NO: 910254 - RNA, 21 nt, Human
uagccugccucccaaagacac

SEQ ID NO: 910255 - RNA, 25 nt, Human
uauagcacacacaugcacacaagcg

SEQ ID NO: 910256 - RNA, 22 nt, Human
uauauacacacacacauauaua

SEQ ID NO: 910257 - RNA, 23 nt, Human
uaugugugugcgugcaugggugu

SEQ ID NO: 910258 - RNA, 23 nt, Human
uauuauaucacagugaccacuau

SEQ ID NO: 910259 - RNA, 21 nt, Human
ucagucauuugcuacagcuau

SEQ ID NO: 910260 - RNA, 24 nt, Human
ucccucaguacuaagagcaaaagc

SEQ ID NO: 910261 - RNA, 19 nt, Human
ugagugacauccauacuca

SEQ ID NO: 910262 - RNA, 18 nt, Human
ugagugcccuccaccagc

SEQ ID NO: 910263 - RNA, 18 nt, Human
ugccucagucuucggguu

SEQ ID NO: 910264 - RNA, 28 nt, Human
ugcucuggaacuuucaucccucaacugu

SEQ ID NO: 910265 - RNA, 21 nt, Human
uggcaggauguaucagaauuc

SEQ ID NO: 910266 - RNA, 18 nt, Human
uggccuucaguguguaug

SEQ ID NO: 910267 - RNA, 19 nt, Human
uguaugugugugcgugcau

SEQ ID NO: 910268 - RNA, 20 nt, Human
ugugugcgugcaugggugug

SEQ ID NO: 910269 - RNA, 21 nt, Human
uguuuguucacauguauucag

SEQ ID NO: 910270 - RNA, 21 nt, Human
uguuuguucacauguauucag

SEQ ID NO: 910271 - RNA, 25 nt, Human
uuauauacacacacacauauauauu

SEQ ID NO: 910272 - RNA, 24 nt, Human
uuauuauaucacagugaccacuau

SEQ ID NO: 910273 - RNA, 20 nt, Human
uucacacacacacacacaca

SEQ ID NO: 910274 - RNA, 21 nt, Human
uucacacacacacacacacac

SEQ ID NO: 910275 - RNA, 27 nt, Human
uucucuggcaucauuuagaauucuaag

SEQ ID NO: 910276 - RNA, 20 nt, Human
uucugucucucuuucacaca

SEQ ID NO: 910277 - RNA, 18 nt, Human
uuuguucacauguauuca

SEQ ID NO: 910278 - RNA, 20 nt, Human
aaaagcccaaggggaauguu

SEQ ID NO: 910279 - RNA, 21 nt, Human
aaaugacuugcaauaccagga

SEQ ID NO: 910280 - RNA, 24 nt, Human
aagauaggacgacaaaaugggaca

SEQ ID NO: 910281 - RNA, 26 nt, Human
aagcaaaaggaaaaguggagggaccc

SEQ ID NO: 910282 - RNA, 20 nt, Human
aagcugcuggggcuguugag

SEQ ID NO: 910283 - RNA, 21 nt, Human
acaacuucaaacuccagaaaa

SEQ ID NO: 910284 - RNA, 24 nt, Human
acacaagcacauucuaucaaaacu

SEQ ID NO: 910285 - RNA, 18 nt, Human
accagagccgucagcccc

SEQ ID NO: 910286 - RNA, 18 nt, Human
acccaacagggucaggug

SEQ ID NO: 910287 - RNA, 21 nt, Human
acgacaaaaugggacaagaua

SEQ ID NO: 910288 - RNA, 22 nt, Human
acuuggaggaaugaggcccaga

SEQ ID NO: 910289 - RNA, 19 nt, Human
agaaaggcuuucugccuuu

SEQ ID NO: 910290 - RNA, 19 nt, Human
agacaacuacucauguccc

SEQ ID NO: 910291 - RNA, 22 nt, Human
agaccauaucaaucagaaacuu

SEQ ID NO: 910292 - RNA, 20 nt, Human
agauaggacgacaaaauggg

SEQ ID NO: 910293 - RNA, 22 nt, Human
agcagauagguagcugcacaaa

SEQ ID NO: 910294 - RNA, 18 nt, Human
agcauggcacagcccagu

SEQ ID NO: 910295 - RNA, 21 nt, Human
aggaaaggugauggaaagaaa

SEQ ID NO: 910296 - RNA, 23 nt, Human
aggggcgcgccccugccccgcgc

SEQ ID NO: 910297 - RNA, 18 nt, Human
auaaaucuguaucauaca

SEQ ID NO: 910298 - RNA, 25 nt, Human
auagcaacauaaauaaaucuguauc

SEQ ID NO: 910299 - RNA, 23 nt, Human
auccugcaggucccucucucuca

SEQ ID NO: 910300 - RNA, 21 nt, Human
augccacuuaaaaaugagcac

SEQ ID NO: 910301 - RNA, 22 nt, Human
auggggucuggucagauucucc

SEQ ID NO: 910302 - RNA, 22 nt, Human
caaaaggaaaaguggagcucau

SEQ ID NO: 910303 - RNA, 25 nt, Human
caaagaaacuguugagaauaugacg

SEQ ID NO: 910304 - RNA, 22 nt, Human
caaaucccaaaagauuugagga

SEQ ID NO: 910305 - RNA, 21 nt, Human
caacauaaauaaaucuguauc

SEQ ID NO: 910306 - RNA, 18 nt, Human
caacuucaaacuccagaa

SEQ ID NO: 910307 - RNA, 21 nt, Human
caagaaagcuauuacuggaaa

SEQ ID NO: 910308 - RNA, 20 nt, Human
caagauccucaaugaaauca

SEQ ID NO: 910309 - RNA, 24 nt, Human
caagauccucaaugaaaucagaga

SEQ ID NO: 910310 - RNA, 21 nt, Human
caauaccaggaguacuucaga

SEQ ID NO: 910311 - RNA, 22 nt, Human
cacaguccauuuaggagaugag

SEQ ID NO: 910312 - RNA, 23 nt, Human
caccaagauuccuccuacccaaa

SEQ ID NO: 910313 - RNA, 18 nt, Human
cacugagucaccaugacc

SEQ ID NO: 910314 - RNA, 18 nt, Human
cacugagucaccaugacc

SEQ ID NO: 910315 - RNA, 19 nt, Human
cacuuaaaaaugagcacag

SEQ ID NO: 910316 - RNA, 24 nt, Human
cacuuucuccuuaagaaucauagg

SEQ ID NO: 910317 - RNA, 26 nt, Human
cagaaacuuucuucauaucugugucu

SEQ ID NO: 910318 - RNA, 26 nt, Human
cagaaucaggguccuauauucacuga

SEQ ID NO: 910319 - RNA, 19 nt, Human
cagcaauaggaccacgugc

SEQ ID NO: 910320 - RNA, 21 nt, Human
cagccccgccccucgggcagg

SEQ ID NO: 910321 - RNA, 19 nt, Human
cagcgcgacccucgcccca

SEQ ID NO: 910322 - RNA, 20 nt, Human
caggagaagcuguucaagca

SEQ ID NO: 910323 - RNA, 24 nt, Human
caggaguacuucagaccauaucaa

SEQ ID NO: 910324 - RNA, 18 nt, Human
caggcagacccagaaagc

SEQ ID NO: 910325 - RNA, 23 nt, Human
cagguccuccgcccugccaccuc

SEQ ID NO: 910326 - RNA, 21 nt, Human
ccaagauccucaaugaaauca

SEQ ID NO: 910327 - RNA, 23 nt, Human
ccaccaggauacaacucugacuc

SEQ ID NO: 910328 - RNA, 29 nt, Human
ccaccuccccgagcagcccuucgaugacu

SEQ ID NO: 910329 - RNA, 21 nt, Human
ccacucugcaggggcgcgccc

SEQ ID NO: 910330 - RNA, 22 nt, Human
cccaaauccgguugcacaccug

SEQ ID NO: 910331 - RNA, 19 nt, Human
cccaagagauucuuccauc

SEQ ID NO: 910332 - RNA, 18 nt, Human
ccccaagaaagcuauuac

SEQ ID NO: 910333 - RNA, 21 nt, Human
ccccaagugccaaaucccaaa

SEQ ID NO: 910334 - RNA, 22 nt, Human
ccccgccccucgggcagggggc

SEQ ID NO: 910335 - RNA, 18 nt, Human
ccccgcgcgccgacuccg

SEQ ID NO: 910336 - RNA, 18 nt, Human
ccccgcgcgccgacuccg

SEQ ID NO: 910337 - RNA, 21 nt, Human
ccccucgggcagggggcgggc

SEQ ID NO: 910338 - RNA, 19 nt, Human
cccgccccucgggcagggg

SEQ ID NO: 910339 - RNA, 20 nt, Human
cccugucuucuguggugcgu

SEQ ID NO: 910340 - RNA, 25 nt, Human
ccgagcagcccuucgaugacucccu

SEQ ID NO: 910341 - RNA, 20 nt, Human
ccgccgcguccucaacgucc

SEQ ID NO: 910342 - RNA, 20 nt, Human
ccgccgcguccucaacgucc

SEQ ID NO: 910343 - RNA, 23 nt, Human
ccgccgcguccucaacguccucc

SEQ ID NO: 910344 - RNA, 21 nt, Human
ccuacaauugagaauuagagc

SEQ ID NO: 910345 - RNA, 22 nt, Human
ccucucccaugccacuuaaaaa

SEQ ID NO: 910346 - RNA, 19 nt, Human
ccugccaugucucucccca

SEQ ID NO: 910347 - RNA, 24 nt, Human
ccuuuuagcagacugggcucccgg

SEQ ID NO: 910348 - RNA, 20 nt, Human
cgagguagccagcgcgaccc

SEQ ID NO: 910349 - RNA, 22 nt, Human
cgggccacagccagccgcuuuc

SEQ ID NO: 910350 - RNA, 22 nt, Human
cggucagcgggcuuccggcucu

SEQ ID NO: 910351 - RNA, 20 nt, Human
cuaagcaucucuccuaugcc

SEQ ID NO: 910352 - RNA, 22 nt, Human
cuacagugcagaccaaaacccc

SEQ ID NO: 910353 - RNA, 19 nt, Human
cuacccaaagcugaagaua

SEQ ID NO: 910354 - RNA, 24 nt, Human
cuauuacuggaaaguccagcugcu

SEQ ID NO: 910355 - RNA, 18 nt, Human
cuccgcccugccaccucc

SEQ ID NO: 910356 - RNA, 26 nt, Human
cucuaugcaagaauuucaacagaauu

SEQ ID NO: 910357 - RNA, 25 nt, Human
cucuugcuaguucccaagcugcugg

SEQ ID NO: 910358 - RNA, 25 nt, Human
cugaagauauauuuucaaggaaagg

SEQ ID NO: 910359 - RNA, 19 nt, Human
cugucacccacccugucca

SEQ ID NO: 910360 - RNA, 24 nt, Human
cuuuuagaaccugccagaggagcu

SEQ ID NO: 910361 - RNA, 25 nt, Human
gaacaacuauuuauuucuuuauaca

SEQ ID NO: 910362 - RNA, 19 nt, Human
gaaccugccagaggagcuc

SEQ ID NO: 910363 - RNA, 20 nt, Human
gaacucaaagaacgcaggug

SEQ ID NO: 910364 - RNA, 18 nt, Human
gacacagacuaggcuuua

SEQ ID NO: 910365 - RNA, 19 nt, Human
gagcaaaugacuugcaaua

SEQ ID NO: 910366 - RNA, 19 nt, Human
gaggacucaggagaagcug

SEQ ID NO: 910367 - RNA, 19 nt, Human
gaggcggcggcggcggcgg

SEQ ID NO: 910368 - RNA, 20 nt, Human
gaggcggcggcggcggcggc

SEQ ID NO: 910369 - RNA, 24 nt, Human
gagggaaauacaaaugcccuaaug

SEQ ID NO: 910370 - RNA, 22 nt, Human
gagucacaacuucaaacuccag

SEQ ID NO: 910371 - RNA, 20 nt, Human
gagucaccaugaccucagug

SEQ ID NO: 910372 - RNA, 23 nt, Human
gauagcaacauaaauaaaucugu

SEQ ID NO: 910373 - RNA, 19 nt, Human
gcagacccagaaagccuca

SEQ ID NO: 910374 - RNA, 20 nt, Human
gcagcagcggccggccgcgc

SEQ ID NO: 910375 - RNA, 18 nt, Human
gcaggggcgcgccccugc

SEQ ID NO: 910376 - RNA, 20 nt, Human
gccaaguggaccuuggcuaa

SEQ ID NO: 910377 - RNA, 21 nt, Human
gccgccgcguccucaacgucc

SEQ ID NO: 910378 - RNA, 22 nt, Human
gcuaagaccucaccugaaaguc

SEQ ID NO: 910379 - RNA, 25 nt, Human
gcuacagugcagaccaaaacccagu

SEQ ID NO: 910380 - RNA, 19 nt, Human
gcuacugggugaccacucc

SEQ ID NO: 910381 - RNA, 20 nt, Human
gcucacugagcccccacgag

SEQ ID NO: 910382 - RNA, 23 nt, Human
gcugcuccguagugugcuuuuag

SEQ ID NO: 910383 - RNA, 21 nt, Human
gcugggccaaguggaccuugg

SEQ ID NO: 910384 - RNA, 19 nt, Human
ggagcuccagcaauaggac

SEQ ID NO: 910385 - RNA, 21 nt, Human
ggagcuguaguccggucagcg

SEQ ID NO: 910386 - RNA, 20 nt, Human
ggaugcugagugacagaggc

SEQ ID NO: 910387 - RNA, 23 nt, Human
ggcacagcccaguggggucccca

SEQ ID NO: 910388 - RNA, 18 nt, Human
ggcggcggcggcggcggc

SEQ ID NO: 910389 - RNA, 23 nt, Human
ggcggcggcggcggcggcuacug

SEQ ID NO: 910390 - RNA, 23 nt, Human
ggcuacugggugaccacuccauc

SEQ ID NO: 910391 - RNA, 19 nt, Human
gggucuggucagauucucc

SEQ ID NO: 910392 - RNA, 21 nt, Human
ggucagcgggcuuccggcucu

SEQ ID NO: 910393 - RNA, 18 nt, Human
gucaccaugaccucagug

SEQ ID NO: 910394 - RNA, 18 nt, Human
guccuccccuuuuagcag

SEQ ID NO: 910395 - RNA, 23 nt, Human
guggcugcgcuucuugcaugguu

SEQ ID NO: 910396 - RNA, 22 nt, Human
uaacaaucaccaaaaaggcuuu

SEQ ID NO: 910397 - RNA, 20 nt, Human
uaagaggaugcugagugaca

SEQ ID NO: 910398 - RNA, 20 nt, Human
uacaccaagauuccuccuac

SEQ ID NO: 910399 - RNA, 23 nt, Human
uacaggaaagaaggcugaagaag

SEQ ID NO: 910400 - RNA, 18 nt, Human
uacagugcagaccaaaac

SEQ ID NO: 910401 - RNA, 23 nt, Human
uaggcuacaggaaagaaggcuga

SEQ ID NO: 910402 - RNA, 23 nt, Human
uauaaccaucagugaccagccaa

SEQ ID NO: 910403 - RNA, 21 nt, Human
uauaauuacacuaagcaucuc

SEQ ID NO: 910404 - RNA, 26 nt, Human
uaugcagaagacauacaggcagaccc

SEQ ID NO: 910405 - RNA, 21 nt, Human
ucaagcaaaaggaaaagugga

SEQ ID NO: 910406 - RNA, 22 nt, Human
ucacaacuucaaacuccagaaa

SEQ ID NO: 910407 - RNA, 20 nt, Human
uccagaaaagaugaaguaaa

SEQ ID NO: 910408 - RNA, 21 nt, Human
uccaguguaggcugaccuucu

SEQ ID NO: 910409 - RNA, 19 nt, Human
uccaugcuaggcuacagga

SEQ ID NO: 910410 - RNA, 28 nt, Human
ucccagacaacuacucauguccccaagu

SEQ ID NO: 910411 - RNA, 24 nt, Human
uccccaauuuccccgagguaagau

SEQ ID NO: 910412 - RNA, 18 nt, Human
uccccacucugcaggggc

SEQ ID NO: 910413 - RNA, 22 nt, Human
uccccgagcagcccuucgauga

SEQ ID NO: 910414 - RNA, 19 nt, Human
uccccgagguaagauagga

SEQ ID NO: 910415 - RNA, 22 nt, Human
ucccgaggcggcggcggcggcg

SEQ ID NO: 910416 - RNA, 18 nt, Human
ucgccccaaauccgguug

SEQ ID NO: 910417 - RNA, 27 nt, Human
ucucccgccagccgccgcguccucaac

SEQ ID NO: 910418 - RNA, 19 nt, Human
ucucuccccagcugucucu

SEQ ID NO: 910419 - RNA, 25 nt, Human
ucucugaaguccagauuauucacuc

SEQ ID NO: 910420 - RNA, 19 nt, Human
ucugaaguccagauuauuc

SEQ ID NO: 910421 - RNA, 20 nt, Human
ucugcuaagaccucaccuga

SEQ ID NO: 910422 - RNA, 23 nt, Human
ugaagaagcaaauuuacaaauca

SEQ ID NO: 910423 - RNA, 18 nt, Human
ugaaguaccaucugcuga

SEQ ID NO: 910424 - RNA, 24 nt, Human
ugaagugaggucaguccaauuugg

SEQ ID NO: 910425 - RNA, 21 nt, Human
ugaaguuaauccugucccaca

SEQ ID NO: 910426 - RNA, 18 nt, Human
ugaccagccaaccuccca

SEQ ID NO: 910427 - RNA, 23 nt, Human
ugacucccucuucuggacccucc

SEQ ID NO: 910428 - RNA, 22 nt, Human
ugacuuaaucucugaaguccag

SEQ ID NO: 910429 - RNA, 24 nt, Human
ugaggcccagaugcuccucagaac

SEQ ID NO: 910430 - RNA, 18 nt, Human
ugagggaaauacaaaugc

SEQ ID NO: 910431 - RNA, 22 nt, Human
ugaguagugcucacugagcccc

SEQ ID NO: 910432 - RNA, 22 nt, Human
ugcagaagacauacaggcagac

SEQ ID NO: 910433 - RNA, 23 nt, Human
ugccacuuaaaaaugagcacagg

SEQ ID NO: 910434 - RNA, 26 nt, Human
ugccacuuaaaaaugagcacagguuu

SEQ ID NO: 910435 - RNA, 19 nt, Human
uggaagcauuccaaucuuc

SEQ ID NO: 910436 - RNA, 25 nt, Human
uggaagcauuccaaucuucuuggag

SEQ ID NO: 910437 - RNA, 21 nt, Human
uggcaagcuucccgaggcggc

SEQ ID NO: 910438 - RNA, 24 nt, Human
uggcacagcccaguggggucccca

SEQ ID NO: 910439 - RNA, 19 nt, Human
uggcauggacaaaguggag

SEQ ID NO: 910440 - RNA, 19 nt, Human
ugggcucccggagcagcag

SEQ ID NO: 910441 - RNA, 21 nt, Human
ugggguccccacucugcaggg

SEQ ID NO: 910442 - RNA, 25 nt, Human
ugguagcaggagagucacaacuuca

SEQ ID NO: 910443 - RNA, 22 nt, Human
uggucuggccaucaguccccaa

SEQ ID NO: 910444 - RNA, 22 nt, Human
uguaaaaaguucauuccagugu

SEQ ID NO: 910445 - RNA, 23 nt, Human
uguaucauacaucuauacacaca

SEQ ID NO: 910446 - RNA, 25 nt, Human
ugugaacucaaagaacgcaggugcu

SEQ ID NO: 910447 - RNA, 19 nt, Human
uuaaagucacaaccaucgg

SEQ ID NO: 910448 - RNA, 24 nt, Human
uuaaucucugaaguccagauuauu

SEQ ID NO: 910449 - RNA, 22 nt, Human
uucaaacuccagaaaagaugaa

SEQ ID NO: 910450 - RNA, 19 nt, Human
uucaagcaaaaggaaaagu

SEQ ID NO: 910451 - RNA, 24 nt, Human
uucuuuauacacauuuugcuuuaa

SEQ ID NO: 910452 - RNA, 23 nt, Human
uuuauacacauuuugcuuuaaca

SEQ ID NO: 910453 - RNA, 22 nt, Human
aaaaaaaaaagaaaaaaaagga

SEQ ID NO: 910454 - RNA, 20 nt, Human
aaaaaaaagaaaaaaaagga

SEQ ID NO: 910455 - RNA, 25 nt, Human
aaaaaaagaaaaaaaaggaaaagaa

SEQ ID NO: 910456 - RNA, 24 nt, Human
aaaaaagaaaaaaaaggaaaagaa

SEQ ID NO: 910457 - RNA, 28 nt, Human
aaaaaagaaaaaaaaggaaaagaaauaa

SEQ ID NO: 910458 - RNA, 23 nt, Human
aaaaagaaaaaaaaggaaaagaa

SEQ ID NO: 910459 - RNA, 20 nt, Human
aaaaagaaaaaaaaggaagg

SEQ ID NO: 910460 - RNA, 20 nt, Human
aagaaacacaaaagcacaca

SEQ ID NO: 910461 - RNA, 30 nt, Human
aagaaauaaagaaacacaaaagcacacaaa

SEQ ID NO: 910462 - RNA, 23 nt, Human
aagugcugggacagagccgagcc

SEQ ID NO: 910463 - RNA, 25 nt, Human
acaaaaaaaaaaaaaagaaaaaaaa

SEQ ID NO: 910464 - RNA, 23 nt, Human
acucagaaaguggcugggcugcu

SEQ ID NO: 910465 - RNA, 18 nt, Human
agaaagaaggaagguaga

SEQ ID NO: 910466 - RNA, 24 nt, Human
agcacacaaggagaucgagaaaga

SEQ ID NO: 910467 - RNA, 20 nt, Human
aggaagguagaaagagagac

SEQ ID NO: 910468 - RNA, 18 nt, Human
agggagagccugcccgug

SEQ ID NO: 910469 - RNA, 22 nt, Human
agggagagccugcccgugggau

SEQ ID NO: 910470 - RNA, 21 nt, Human
auaaagaaacacaaaagcaca

SEQ ID NO: 910471 - RNA, 24 nt, Human
caaaagcacacaaggagaucgaga

SEQ ID NO: 910472 - RNA, 22 nt, Human
caccacuuuucucccagacaag

SEQ ID NO: 910473 - RNA, 19 nt, Human
cacgcugcuucugcccucu

SEQ ID NO: 910474 - RNA, 21 nt, Human
cacucagaaaguggcugggcu

SEQ ID NO: 910475 - RNA, 21 nt, Human
cagaauccagcaacuucaucc

SEQ ID NO: 910476 - RNA, 18 nt, Human
ccaaagagccccaggaca

SEQ ID NO: 910477 - RNA, 20 nt, Human
cccacguuacugaauggagu

SEQ ID NO: 910478 - RNA, 21 nt, Human
cugaggugacaaauggcuucu

SEQ ID NO: 910479 - RNA, 20 nt, Human
gagagccugcccgugggauc

SEQ ID NO: 910480 - RNA, 19 nt, Human
gaguugcucauuucggcag

SEQ ID NO: 910481 - RNA, 20 nt, Human
gaguugcucauuucggcagc

SEQ ID NO: 910482 - RNA, 20 nt, Human
ggaguugcucauuucggcag

SEQ ID NO: 910483 - RNA, 25 nt, Human
gggccccuccacgcugcuucugccc

SEQ ID NO: 910484 - RNA, 19 nt, Human
gguaagugggaggaagaug

SEQ ID NO: 910485 - RNA, 18 nt, Human
guacauuugcgaaaagga

SEQ ID NO: 910486 - RNA, 18 nt, Human
uaaagaaacacaaaagca

SEQ ID NO: 910487 - RNA, 27 nt, Human
uaaguaacaaaaaaaaaaaaaagaaaa

SEQ ID NO: 910488 - RNA, 30 nt, Human
uaauuaaguaacaaaaaaaaaaaaaagaaa

SEQ ID NO: 910489 - RNA, 19 nt, Human
uacauuugcgaaaaggagg

SEQ ID NO: 910490 - RNA, 25 nt, Human
ucccagacaagugcugggacagagc

SEQ ID NO: 910491 - RNA, 18 nt, Human
ucucugagcggugcugcu

SEQ ID NO: 910492 - RNA, 19 nt, Human
ugaagacuugugcugcaga

SEQ ID NO: 910493 - RNA, 19 nt, Human
ugccgugaaaucucugagc

SEQ ID NO: 910494 - RNA, 23 nt, Human
uggaguugcucauuucggcagcg

SEQ ID NO: 910495 - RNA, 18 nt, Human
ugggacagagccgagccu

SEQ ID NO: 910496 - RNA, 21 nt, Human
ugggacagagccgagccugcu

SEQ ID NO: 910497 - RNA, 22 nt, Human
ugggacagagccgagccugcug

SEQ ID NO: 910498 - RNA, 24 nt, Human
ugggaggaagauggcguuccaaag

SEQ ID NO: 910499 - RNA, 24 nt, Human
ugggaucagcucccacguuaccuc

SEQ ID NO: 910500 - RNA, 27 nt, Human
uuaaccauaguggcaguucugugaccu

SEQ ID NO: 910501 - RNA, 21 nt, Human
aaaugaccgaaggaacaaagc

SEQ ID NO: 910502 - RNA, 18 nt, Human
aagcaucaaacaugucug

SEQ ID NO: 910503 - RNA, 21 nt, Human
aagcgagcaaacauuuugaga

SEQ ID NO: 910504 - RNA, 23 nt, Human
agcacagcagugucauuguacaa

SEQ ID NO: 910505 - RNA, 22 nt, Human
agggauuggacacaucagcaca

SEQ ID NO: 910506 - RNA, 20 nt, Human
aggguccgguucucuggagu

SEQ ID NO: 910507 - RNA, 19 nt, Human
augcugcagguauuucugu

SEQ ID NO: 910508 - RNA, 19 nt, Human
auuucguccaguccuuucc

SEQ ID NO: 910509 - RNA, 26 nt, Human
caaagcgagcaaacauuuugagacca

SEQ ID NO: 910510 - RNA, 23 nt, Human
cacagcagugucauuguacaaaa

SEQ ID NO: 910511 - RNA, 20 nt, Human
cagauuccaaagcgagcaaa

SEQ ID NO: 910512 - RNA, 22 nt, Human
cagcccacucgaugcaguacug

SEQ ID NO: 910513 - RNA, 19 nt, Human
caggaaggaguugguucuc

SEQ ID NO: 910514 - RNA, 21 nt, Human
cagguaagcccugcugcuucu

SEQ ID NO: 910515 - RNA, 25 nt, Human
cauuuucuucuaguguugccaaggg

SEQ ID NO: 910516 - RNA, 19 nt, Human
ccgcagcuucauuucgucc

SEQ ID NO: 910517 - RNA, 19 nt, Human
ccggcgccuccgggccgcc

SEQ ID NO: 910518 - RNA, 20 nt, Human
ccuuggagagaaaauaggca

SEQ ID NO: 910519 - RNA, 24 nt, Human
cgagcaaacauuuugagaccaaga

SEQ ID NO: 910520 - RNA, 20 nt, Human
gaacaaagcuucagggcucu

SEQ ID NO: 910521 - RNA, 18 nt, Human
gacacgcuggcggguagc

SEQ ID NO: 910522 - RNA, 22 nt, Human
gagcaaacauuuugagaccaag

SEQ ID NO: 910523 - RNA, 18 nt, Human
gaguugguucucccaggg

SEQ ID NO: 910524 - RNA, 24 nt, Human
ggguggugucucccacuauucagg

SEQ ID NO: 910525 - RNA, 19 nt, Human
gucaaacacuggcaucacc

SEQ ID NO: 910526 - RNA, 19 nt, Human
gugucaucgccgccugggc

SEQ ID NO: 910527 - RNA, 20 nt, Human
guuuuuaucaguuuccccau

SEQ ID NO: 910528 - RNA, 22 nt, Human
uaagaccaugucgauaaucccc

SEQ ID NO: 910529 - RNA, 20 nt, Human
ucaaaaauaucaaaguccca

SEQ ID NO: 910530 - RNA, 19 nt, Human
ucaaugaaagagauuuggg

SEQ ID NO: 910531 - RNA, 19 nt, Human
uccaguggucagcuggaag

SEQ ID NO: 910532 - RNA, 22 nt, Human
ucccaagcaucaaacaugucug

SEQ ID NO: 910533 - RNA, 21 nt, Human
uccgauaaucauuccucucca

SEQ ID NO: 910534 - RNA, 21 nt, Human
uccugguuuuuaucaguuucc

SEQ ID NO: 910535 - RNA, 20 nt, Human
uccuuggagagaaaauaggc

SEQ ID NO: 910536 - RNA, 25 nt, Human
uccuuggagagaaaauaggcagugg

SEQ ID NO: 910537 - RNA, 18 nt, Human
ucgccgccugggcgggcg

SEQ ID NO: 910538 - RNA, 19 nt, Human
ucuaaaguuuccuuuaucc

SEQ ID NO: 910539 - RNA, 21 nt, Human
ucuccaguggucagcuggaag

SEQ ID NO: 910540 - RNA, 18 nt, Human
ucuuagcguugacucgga

SEQ ID NO: 910541 - RNA, 25 nt, Human
ugaaaggaccaaggagcucuggcug

SEQ ID NO: 910542 - RNA, 18 nt, Human
ugaagcacaucagcagaa

SEQ ID NO: 910543 - RNA, 24 nt, Human
ugaccgaaggaacaaagcuucagg

SEQ ID NO: 910544 - RNA, 21 nt, Human
ugagaaaaauauucuuccgaa

SEQ ID NO: 910545 - RNA, 18 nt, Human
ugcgaugagugcagcgac

SEQ ID NO: 910546 - RNA, 21 nt, Human
uggcggcggcgccgcggacac

SEQ ID NO: 910547 - RNA, 20 nt, Human
ugggauuuggggaugcugca

SEQ ID NO: 910548 - RNA, 19 nt, Human
uguaagaauucacagauuc

SEQ ID NO: 910549 - RNA, 20 nt, Human
uuggaggaaugauaauuggc

SEQ ID NO: 910550 - RNA, 22 nt, Human
aacagucaagcuaaacagcaau

SEQ ID NO: 910551 - RNA, 20 nt, Human
aaccauguagccauagaggc

SEQ ID NO: 910552 - RNA, 19 nt, Human
aagaaaagcuuguccaagg

SEQ ID NO: 910553 - RNA, 18 nt, Human
aagaggccgggcaggggu

SEQ ID NO: 910554 - RNA, 23 nt, Human
aaugauucaaggucaaauauuaa

SEQ ID NO: 910555 - RNA, 18 nt, Human
agucaagcuaaacagcaa

SEQ ID NO: 910556 - RNA, 23 nt, Human
auggcuuuuauauaauacuuggu

SEQ ID NO: 910557 - RNA, 22 nt, Human
caagaggcccccucuguggcuu

SEQ ID NO: 910558 - RNA, 18 nt, Human
cacaggcaccaaggcuuu

SEQ ID NO: 910559 - RNA, 20 nt, Human
cacuuuuucccucaucaugg

SEQ ID NO: 910560 - RNA, 19 nt, Human
ccccaaaaaugaaaugccu

SEQ ID NO: 910561 - RNA, 22 nt, Human
ccccacuuucggucugcgcccg

SEQ ID NO: 910562 - RNA, 19 nt, Human
cccgaugcgcaccuccgca

SEQ ID NO: 910563 - RNA, 27 nt, Human
ccggcaguagaucacgccgcucuucuu

SEQ ID NO: 910564 - RNA, 21 nt, Human
ccuccgcagaagacaccugcu

SEQ ID NO: 910565 - RNA, 18 nt, Human
ccucugugagccagaaau

SEQ ID NO: 910566 - RNA, 19 nt, Human
ccugcuaguuacagugaac

SEQ ID NO: 910567 - RNA, 26 nt, Human
cggcucggggggauggcgucggcggg

SEQ ID NO: 910568 - RNA, 22 nt, Human
cgucggcggcgucggucuggac

SEQ ID NO: 910569 - RNA, 21 nt, Human
cuaaacagcaaugaugacuuu

SEQ ID NO: 910570 - RNA, 21 nt, Human
cugguggucgcggcgggggcu

SEQ ID NO: 910571 - RNA, 21 nt, Human
gaagcucauggauuccccaaa

SEQ ID NO: 910572 - RNA, 21 nt, Human
gccaaguauuuguucugucau

SEQ ID NO: 910573 - RNA, 22 nt, Human
gccucugugagccagaaauaaa

SEQ ID NO: 910574 - RNA, 19 nt, Human
gcucggggggauggcgucg

SEQ ID NO: 910575 - RNA, 20 nt, Human
ggcucggggggauggcgucc

SEQ ID NO: 910576 - RNA, 21 nt, Human
ggucuggcggggcgagcugga

SEQ ID NO: 910577 - RNA, 21 nt, Human
uaccaucggccagaagaacca

SEQ ID NO: 910578 - RNA, 27 nt, Human
uaccaucggccagaagaaccauguagc

SEQ ID NO: 910579 - RNA, 24 nt, Human
uagaggcugugaagcuaacuaguu

SEQ ID NO: 910580 - RNA, 23 nt, Human
uagcaggucugagucucggccuc

SEQ ID NO: 910581 - RNA, 20 nt, Human
uagcuccuucaccaauaccu

SEQ ID NO: 910582 - RNA, 20 nt, Human
uagugccucguggcugccuc

SEQ ID NO: 910583 - RNA, 18 nt, Human
uauuuuucuucauggaac

SEQ ID NO: 910584 - RNA, 23 nt, Human
ucggcggcgucggucuggacgaa

SEQ ID NO: 910585 - RNA, 23 nt, Human
ucuguaauuugguccuaguugcu

SEQ ID NO: 910586 - RNA, 19 nt, Human
ugaaaugccacuuuuuccc

SEQ ID NO: 910587 - RNA, 21 nt, Human
ugaaaugccacuuuuucccuc

SEQ ID NO: 910588 - RNA, 20 nt, Human
ugacaaggguacacaggaug

SEQ ID NO: 910589 - RNA, 18 nt, Human
ugaggaaaacagucaagc

SEQ ID NO: 910590 - RNA, 18 nt, Human
ugcccagcucggugcggg

SEQ ID NO: 910591 - RNA, 22 nt, Human
ugcgcaccuccgcagaagacac

SEQ ID NO: 910592 - RNA, 18 nt, Human
ugcgggcccugcggacgc

SEQ ID NO: 910593 - RNA, 21 nt, Human
ugcugauaccagucuagagga

SEQ ID NO: 910594 - RNA, 24 nt, Human
uggacgaagaggccgggcaggggu

SEQ ID NO: 910595 - RNA, 22 nt, Human
uggacucguccgagucccggca

SEQ ID NO: 910596 - RNA, 23 nt, Human
ugggagaugagcucacaggcacc

SEQ ID NO: 910597 - RNA, 21 nt, Human
ugguggucgcggcgggggcug

SEQ ID NO: 910598 - RNA, 18 nt, Human
ugguguagugccucgugg

SEQ ID NO: 910599 - RNA, 21 nt, Human
ugucguuuuuuuuuuuuucuu

SEQ ID NO: 910600 - RNA, 23 nt, Human
uuaucuguaauuugguccuaguu

SEQ ID NO: 910601 - RNA, 24 nt, Human
uucacaguguccuuugucggucaa

SEQ ID NO: 910602 - RNA, 20 nt, Human
uuugccaaguauuuguucug

SEQ ID NO: 910603 - RNA, 19 nt, Human
aaccaggggccagcagggc

SEQ ID NO: 910604 - RNA, 24 nt, Human
aagcaccccugccccauggucccg

SEQ ID NO: 910605 - RNA, 19 nt, Human
agagcagcagagcagacug

SEQ ID NO: 910606 - RNA, 25 nt, Human
agaggcagguguuggggagcagccc

SEQ ID NO: 910607 - RNA, 22 nt, Human
agaggccccugagggcggguuu

SEQ ID NO: 910608 - RNA, 20 nt, Human
agcagcagagcagacugccc

SEQ ID NO: 910609 - RNA, 21 nt, Human
aggcaggagagaggccccuga

SEQ ID NO: 910610 - RNA, 23 nt, Human
aggcagggcaggcaggagagagg

SEQ ID NO: 910611 - RNA, 22 nt, Human
aggcagguguuggggagcagcc

SEQ ID NO: 910612 - RNA, 20 nt, Human
agggccuggcugaggcaggg

SEQ ID NO: 910613 - RNA, 23 nt, Human
aggggagcagcugggccugagga

SEQ ID NO: 910614 - RNA, 20 nt, Human
agggguggcccucugagguc

SEQ ID NO: 910615 - RNA, 21 nt, Human
agggguggcccucugaggucu

SEQ ID NO: 910616 - RNA, 24 nt, Human
agugcaggaaugugcugggaggaa

SEQ ID NO: 910617 - RNA, 27 nt, Human
auggucccgaaggccccagaggaccca

SEQ ID NO: 910618 - RNA, 18 nt, Human
caccccugccccaugguc

SEQ ID NO: 910619 - RNA, 29 nt, Human
cagcagagcagacugcccguuuucccccu

SEQ ID NO: 910620 - RNA, 26 nt, Human
cagcggaaccaggggccagcagggcu

SEQ ID NO: 910621 - RNA, 21 nt, Human
cagguguuggggagcagcccu

SEQ ID NO: 910622 - RNA, 20 nt, Human
cagugccaacuucaggggcc

SEQ ID NO: 910623 - RNA, 20 nt, Human
caguguggacacggcagagu

SEQ ID NO: 910624 - RNA, 18 nt, Human
caucucagggccuggcug

SEQ ID NO: 910625 - RNA, 24 nt, Human
ccaugccagguguggugcagaaug

SEQ ID NO: 910626 - RNA, 22 nt, Human
cccagggcugccugcuggcacc

SEQ ID NO: 910627 - RNA, 19 nt, Human
ccccauggucccgaaggcc

SEQ ID NO: 910628 - RNA, 21 nt, Human
cccccagcccagggcugccug

SEQ ID NO: 910629 - RNA, 19 nt, Human
ccccuggggcaguugguug

SEQ ID NO: 910630 - RNA, 19 nt, Human
ccucaagggguggcccucu

SEQ ID NO: 910631 - RNA, 23 nt, Human
ccugaccuugggcucuggaaggu

SEQ ID NO: 910632 - RNA, 20 nt, Human
ccuggacugccuguggccuu

SEQ ID NO: 910633 - RNA, 23 nt, Human
cucagccaggcaucuggggggcc

SEQ ID NO: 910634 - RNA, 21 nt, Human
cucccugaccuugggcucugg

SEQ ID NO: 910635 - RNA, 21 nt, Human
cucugcucuggaaaugcuggg

SEQ ID NO: 910636 - RNA, 21 nt, Human
cucuggaaaugcuggggucag

SEQ ID NO: 910637 - RNA, 19 nt, Human
cugaccuugggcucuggaa

SEQ ID NO: 910638 - RNA, 19 nt, Human
cugaggccacuggcguguc

SEQ ID NO: 910639 - RNA, 23 nt, Human
cugaggccacuggcgugucuccu

SEQ ID NO: 910640 - RNA, 20 nt, Human
cugcaccaugccaggugugg

SEQ ID NO: 910641 - RNA, 24 nt, Human
cuggcagcaggcuuggaggacugg

SEQ ID NO: 910642 - RNA, 24 nt, Human
cuggggcaguugguugccccuccc

SEQ ID NO: 910643 - RNA, 24 nt, Human
cuggggggccagcggaaccagggg

SEQ ID NO: 910644 - RNA, 18 nt, Human
cugggucuguggggcagu

SEQ ID NO: 910645 - RNA, 22 nt, Human
cuuugucgagucacugcccuuc

SEQ ID NO: 910646 - RNA, 26 nt, Human
gaagcaccccugccccauggucccgg

SEQ ID NO: 910647 - RNA, 24 nt, Human
gagcagacugcccguuuuccccca

SEQ ID NO: 910648 - RNA, 18 nt, Human
gagcagcccugucucccu

SEQ ID NO: 910649 - RNA, 19 nt, Human
gaggcagggcaggcaggag

SEQ ID NO: 910650 - RNA, 20 nt, Human
gcagggagcuggcagcaggc

SEQ ID NO: 910651 - RNA, 24 nt, Human
gccaacuucaggggccgggaagag

SEQ ID NO: 910652 - RNA, 22 nt, Human
ggagcagcugggccugaggagg

SEQ ID NO: 910653 - RNA, 18 nt, Human
ggaggcagggggauggag

SEQ ID NO: 910654 - RNA, 20 nt, Human
ggauggagcagagagaggcc

SEQ ID NO: 910655 - RNA, 24 nt, Human
ggcagagugcaggaaugugcuggu

SEQ ID NO: 910656 - RNA, 21 nt, Human
ggccuggccacccucaagggg

SEQ ID NO: 910657 - RNA, 26 nt, Human
ggcugguggcagaggcagcacucagg

SEQ ID NO: 910658 - RNA, 20 nt, Human
gggaguccccuacccccagc

SEQ ID NO: 910659 - RNA, 23 nt, Human
gggcugcgugccuguagggaguc

SEQ ID NO: 910660 - RNA, 19 nt, Human
ggggagcagcugggccuga

SEQ ID NO: 910661 - RNA, 18 nt, Human
ggggauggagcagagaga

SEQ ID NO: 910662 - RNA, 19 nt, Human
ggugcagaugucucccugc

SEQ ID NO: 910663 - RNA, 21 nt, Human
gugucuguuagcugccuggug

SEQ ID NO: 910664 - RNA, 23 nt, Human
guuucaggcccugggccaggcac

SEQ ID NO: 910665 - RNA, 19 nt, Human
uagggaguccccuaccccc

SEQ ID NO: 910666 - RNA, 19 nt, Human
ucacugcccuucuguaggc

SEQ ID NO: 910667 - RNA, 18 nt, Human
ucaggggccgggaagagg

SEQ ID NO: 910668 - RNA, 19 nt, Human
ucccccuggggcaguuggu

SEQ ID NO: 910669 - RNA, 24 nt, Human
ucuaguaucuuuauuauccauucc

SEQ ID NO: 910670 - RNA, 20 nt, Human
ucuguaggcucugcucugga

SEQ ID NO: 910671 - RNA, 18 nt, Human
ugagggcggguuucaggc

SEQ ID NO: 910672 - RNA, 23 nt, Human
ugcagaugucucccugcaccaug

SEQ ID NO: 910673 - RNA, 19 nt, Human
ugccccauggucccgaagg

SEQ ID NO: 910674 - RNA, 22 nt, Human
ugccuggugcccagggagcugu

SEQ ID NO: 910675 - RNA, 20 nt, Human
uggcagaggcagcacucagg

SEQ ID NO: 910676 - RNA, 20 nt, Human
uggcagcaggcuuggaggac

SEQ ID NO: 910677 - RNA, 19 nt, Human
uggcugaggcagggcaggc

SEQ ID NO: 910678 - RNA, 21 nt, Human
ugggaggcagggggauggagc

SEQ ID NO: 910679 - RNA, 21 nt, Human
ugggcuggcggcugugucugu

SEQ ID NO: 910680 - RNA, 24 nt, Human
uggggcaguguggacacggcagag

SEQ ID NO: 910681 - RNA, 21 nt, Human
uggucccgaaggccccagagg

SEQ ID NO: 910682 - RNA, 23 nt, Human
uggucccgaaggccccagaggac

SEQ ID NO: 910683 - RNA, 25 nt, Human
ugguggcagaggcagcacucagguu

SEQ ID NO: 910684 - RNA, 28 nt, Human
uguggacacggcagagugcaggaaugug

SEQ ID NO: 910685 - RNA, 22 nt, Human
uguuggggagcagcccugucuc

SEQ ID NO: 910686 - RNA, 24 nt, Human
uuggccacugggggccuggccacc

SEQ ID NO: 910687 - RNA, 18 nt, Human
uuggggagcagcccuguc

SEQ ID NO: 910688 - RNA, 23 nt, Human
aaaaagucuuugcaacuuaccaa

SEQ ID NO: 910689 - RNA, 21 nt, Human
aaaaccuggaccugaaccagg

SEQ ID NO: 910690 - RNA, 19 nt, Human
aacugaaauacagaaccca

SEQ ID NO: 910691 - RNA, 19 nt, Human
aagauuagaaaagccaaca

SEQ ID NO: 910692 - RNA, 19 nt, Human
aagguccuugaagcaaaca

SEQ ID NO: 910693 - RNA, 21 nt, Human
aagguuuaaacaaauccugag

SEQ ID NO: 910694 - RNA, 24 nt, Human
aauuuucuuuccacgauugaagac

SEQ ID NO: 910695 - RNA, 19 nt, Human
acaagauuagaaaagccaa

SEQ ID NO: 910696 - RNA, 20 nt, Human
acauacuucuguacauaaaa

SEQ ID NO: 910697 - RNA, 18 nt, Human
acugaaauacagaaccca

SEQ ID NO: 910698 - RNA, 22 nt, Human
acugaaauacagaacccagcua

SEQ ID NO: 910699 - RNA, 27 nt, Human
acugcacugcacagcucugggcaagag

SEQ ID NO: 910700 - RNA, 21 nt, Human
agaaauaugaaaaauccaguc

SEQ ID NO: 910701 - RNA, 23 nt, Human
agauaauaaaaccacaacaucac

SEQ ID NO: 910702 - RNA, 23 nt, Human
agcaaaaaaaaaaaaaaaaaucc

SEQ ID NO: 910703 - RNA, 25 nt, Human
agcaaaaaaaaaaaaaaaaauccag

SEQ ID NO: 910704 - RNA, 18 nt, Human
agcaaaaccuggaccuga

SEQ ID NO: 910705 - RNA, 22 nt, Human
aggcgaaaacucaaggguugcc

SEQ ID NO: 910706 - RNA, 23 nt, Human
aggcgagggaggaaugagggggu

SEQ ID NO: 910707 - RNA, 23 nt, Human
aggggguggggacgcgggggagc

SEQ ID NO: 910708 - RNA, 22 nt, Human
aguggugggggugggggugaag

SEQ ID NO: 910709 - RNA, 21 nt, Human
augagcaaaaaaaaaaaaaaa

SEQ ID NO: 910710 - RNA, 22 nt, Human
augaggggguggggacgcgggg

SEQ ID NO: 910711 - RNA, 25 nt, Human
auucuguuugaugucuccucuuuca

SEQ ID NO: 910712 - RNA, 23 nt, Human
caaagcaaaaccuggaccugaac

SEQ ID NO: 910713 - RNA, 24 nt, Human
caaagcaaaaccuggaccugaacc

SEQ ID NO: 910714 - RNA, 23 nt, Human
caaggugcuuuauguuuuucuga

SEQ ID NO: 910715 - RNA, 21 nt, Human
cacaacaucacaauaaauagg

SEQ ID NO: 910716 - RNA, 22 nt, Human
caccacauaaccuaggcacgau

SEQ ID NO: 910717 - RNA, 21 nt, Human
cacugcacagcucugggcaag

SEQ ID NO: 910718 - RNA, 24 nt, Human
cacugcacagcucugggcaagagc

SEQ ID NO: 910719 - RNA, 18 nt, Human
cagaacccagcuagugga

SEQ ID NO: 910720 - RNA, 18 nt, Human
cagccagacuggaagcca

SEQ ID NO: 910721 - RNA, 20 nt, Human
caggaauggaagauaugaua

SEQ ID NO: 910722 - RNA, 21 nt, Human
cauccaaaacuuuuuccuaga

SEQ ID NO: 910723 - RNA, 20 nt, Human
caucuuuguuccucuggcua

SEQ ID NO: 910724 - RNA, 27 nt, Human
ccacugcacugcacagcucugggcaag

SEQ ID NO: 910725 - RNA, 22 nt, Human
ccccaaaauagccacauucuuu

SEQ ID NO: 910726 - RNA, 24 nt, Human
ccccagcaaguugcugggagcacc

SEQ ID NO: 910727 - RNA, 23 nt, Human
cgacucccgagucucuuucaccu

SEQ ID NO: 910728 - RNA, 21 nt, Human
cggaaucaggugcucacuugc

SEQ ID NO: 910729 - RNA, 20 nt, Human
cggcgagaaguccccagcaa

SEQ ID NO: 910730 - RNA, 22 nt, Human
cguucucuaauagaaucagcca

SEQ ID NO: 910731 - RNA, 23 nt, Human
cuagagcccucuucugugucucc

SEQ ID NO: 910732 - RNA, 20 nt, Human
gaaagaacugaaauacagaa

SEQ ID NO: 910733 - RNA, 23 nt, Human
gagccugcucuggcagcagagaa

SEQ ID NO: 910734 - RNA, 18 nt, Human
gauaaagugaagauaagg

SEQ ID NO: 910735 - RNA, 21 nt, Human
gcaaaaccuggaccugaacca

SEQ ID NO: 910736 - RNA, 25 nt, Human
gcaggguaguuuccacauaauccca

SEQ ID NO: 910737 - RNA, 26 nt, Human
gccagaguacaauaagugaacugguc

SEQ ID NO: 910738 - RNA, 23 nt, Human
ggaaugaggggguggggacgcgg

SEQ ID NO: 910739 - RNA, 24 nt, Human
ggcacuuuggaagcagcgacuccc

SEQ ID NO: 910740 - RNA, 18 nt, Human
gggaggaaugagggggug

SEQ ID NO: 910741 - RNA, 19 nt, Human
gggaggaaugagggggugg

SEQ ID NO: 910742 - RNA, 21 nt, Human
ggggguggggacgcgggggag

SEQ ID NO: 910743 - RNA, 18 nt, Human
ggggugggggugaaggcg

SEQ ID NO: 910744 - RNA, 22 nt, Human
guaaaaauagauauauuuaaca

SEQ ID NO: 910745 - RNA, 22 nt, Human
uaaagugaagauaaggccacuc

SEQ ID NO: 910746 - RNA, 18 nt, Human
uaaauccugaagaugaaa

SEQ ID NO: 910747 - RNA, 20 nt, Human
uaacaagauuagaaaagcca

SEQ ID NO: 910748 - RNA, 19 nt, Human
uaacaggaauggaagauau

SEQ ID NO: 910749 - RNA, 24 nt, Human
uaaggccacucuucuuuucagguu

SEQ ID NO: 910750 - RNA, 24 nt, Human
uaauucauagcaacauaguuccuu

SEQ ID NO: 910751 - RNA, 22 nt, Human
uaguucucuucuucuaaauggc

SEQ ID NO: 910752 - RNA, 19 nt, Human
uauacaaguguauggaaca

SEQ ID NO: 910753 - RNA, 20 nt, Human
ucaaauagucaccacauaac

SEQ ID NO: 910754 - RNA, 23 nt, Human
uccaaaccaugaauguaguucuc

SEQ ID NO: 910755 - RNA, 20 nt, Human
uccccaaaauagccacauuc

SEQ ID NO: 910756 - RNA, 19 nt, Human
ucggcggcgagcaguuucu

SEQ ID NO: 910757 - RNA, 24 nt, Human
ucuguacauaaaaauauccaugua

SEQ ID NO: 910758 - RNA, 20 nt, Human
ugagcaaaaaaaaaaaaaaa

SEQ ID NO: 910759 - RNA, 24 nt, Human
ugagcaaaaaaaaaaaaaaaaauc

SEQ ID NO: 910760 - RNA, 25 nt, Human
ugagcaaaaaaaaaaaaaaaaaucc

SEQ ID NO: 910761 - RNA, 21 nt, Human
ugagcuguggcgaaguggugg

SEQ ID NO: 910762 - RNA, 20 nt, Human
ugaggggguggggacgcggg

SEQ ID NO: 910763 - RNA, 18 nt, Human
uggaauacguacauggua

SEQ ID NO: 910764 - RNA, 23 nt, Human
uggcagcagagaaucgcagggua

SEQ ID NO: 910765 - RNA, 22 nt, Human
uggcuauaacaauuguguuuag

SEQ ID NO: 910766 - RNA, 19 nt, Human
uguacugacauuacccuaa

SEQ ID NO: 910767 - RNA, 21 nt, Human
uguacugacauuacccuaagc

SEQ ID NO: 910768 - RNA, 19 nt, Human
ugucaaaaggagaauauaa

SEQ ID NO: 910769 - RNA, 21 nt, Human
uguggcgaaguggugggggug

SEQ ID NO: 910770 - RNA, 22 nt, Human
uuagaaaaauuuaccaagcuaa

SEQ ID NO: 910771 - RNA, 24 nt, Human
uuagaaaagccaacaguuauaaug

SEQ ID NO: 910772 - RNA, 18 nt, Human
uuccuacugcacagcaca

SEQ ID NO: 910773 - RNA, 22 nt, Human
uucuguacauaaaaauauccau

SEQ ID NO: 910774 - RNA, 21 nt, Human
uugaagaccuuuucuccugac

SEQ ID NO: 910775 - RNA, 24 nt, Human
uugaagaccuuuucuccuguccuu

SEQ ID NO: 910776 - RNA, 30 nt, Human
uuggaagcagcgacucccgagucucuuucu

SEQ ID NO: 910777 - RNA, 23 nt, Human
uuuuaggcccaggacauggagcu

SEQ ID NO: 910778 - RNA, 21 nt, Human
ccagcuucugccuguacugcu

SEQ ID NO: 910779 - RNA, 22 nt, Human
ucacaaugcacagcucccucug

SEQ ID NO: 910780 - RNA, 20 nt, Human
uccuguccagcagugauggc

SEQ ID NO: 910781 - RNA, 19 nt, Human
ccacuccggcgccccccga

SEQ ID NO: 910782 - RNA, 23 nt, Human
cuccuuucuccacuccggcgccc

SEQ ID NO: 910783 - RNA, 22 nt, Human
gcagcgcugcccaccgcuggcu

SEQ ID NO: 910784 - RNA, 18 nt, Human
gcugcccaccgcuggcuc

SEQ ID NO: 910785 - RNA, 23 nt, Human
uaauggaaaagcuuuuucugagg

SEQ ID NO: 910786 - RNA, 18 nt, Human
uggcuccuuucuccacuc

SEQ ID NO: 910787 - RNA, 24 nt, Human
aacuccuuuccccacucagucccc

SEQ ID NO: 910788 - RNA, 19 nt, Human
acaugucugggcacagugg

SEQ ID NO: 910789 - RNA, 19 nt, Human
acccacccccugcuccccc

SEQ ID NO: 910790 - RNA, 19 nt, Human
acccacccccugcuccccc

SEQ ID NO: 910791 - RNA, 23 nt, Human
acccugagcacacaugucugggc

SEQ ID NO: 910792 - RNA, 22 nt, Human
agaacccacccccugcuccccc

SEQ ID NO: 910793 - RNA, 19 nt, Human
agaaccuggucaucaggga

SEQ ID NO: 910794 - RNA, 20 nt, Human
agacaucccuaacccucagg

SEQ ID NO: 910795 - RNA, 22 nt, Human
aggauggugaggggcaccacgg

SEQ ID NO: 910796 - RNA, 23 nt, Human
cacagcuuuaaccccugugugcu

SEQ ID NO: 910797 - RNA, 21 nt, Human
cacccacccucuuccuaacaa

SEQ ID NO: 910798 - RNA, 20 nt, Human
cacgguggggggacccagag

SEQ ID NO: 910799 - RNA, 19 nt, Human
caggaccagccucauuccc

SEQ ID NO: 910800 - RNA, 22 nt, Human
cagggagaacccacccccugcu

SEQ ID NO: 910801 - RNA, 22 nt, Human
ccacccccugcucccccaggag

SEQ ID NO: 910802 - RNA, 20 nt, Human
cccacccccugcucccccag

SEQ ID NO: 910803 - RNA, 23 nt, Human
ccccgcgcgggcagcgcucccuc

SEQ ID NO: 910804 - RNA, 24 nt, Human
cccuccgccaccgaccuucaagcc

SEQ ID NO: 910805 - RNA, 20 nt, Human
cccugagcggagggagaggc

SEQ ID NO: 910806 - RNA, 23 nt, Human
ccuaacccucaggcaucgcccac

SEQ ID NO: 910807 - RNA, 24 nt, Human
ccuccgccaccgaccuucaagccc

SEQ ID NO: 910808 - RNA, 24 nt, Human
ccugugagagccacccccuccgcc

SEQ ID NO: 910809 - RNA, 24 nt, Human
cuaggcuuguggaggagcgggugg

SEQ ID NO: 910810 - RNA, 18 nt, Human
cuccgccaccgaccuuca

SEQ ID NO: 910811 - RNA, 19 nt, Human
cuggucaucagggagaacc

SEQ ID NO: 910812 - RNA, 22 nt, Human
gaacccacccccugcuccccca

SEQ ID NO: 910813 - RNA, 21 nt, Human
gaccaucacagaccuaucacc

SEQ ID NO: 910814 - RNA, 19 nt, Human
gagaaagccacccugagca

SEQ ID NO: 910815 - RNA, 22 nt, Human
gagcacacaugucugggcacag

SEQ ID NO: 910816 - RNA, 20 nt, Human
gcacagugggggcugggggc

SEQ ID NO: 910817 - RNA, 18 nt, Human
gcuggagcucaggcagga

SEQ ID NO: 910818 - RNA, 21 nt, Human
ggacuaggcuuguggaggagc

SEQ ID NO: 910819 - RNA, 25 nt, Human
gggcacagugggggcugggggacuc

SEQ ID NO: 910820 - RNA, 19 nt, Human
gggcuggagcucaggcagg

SEQ ID NO: 910821 - RNA, 24 nt, Human
gggcugggggcuggagcucaggca

SEQ ID NO: 910822 - RNA, 19 nt, Human
gugccuuugugggcugggg

SEQ ID NO: 910823 - RNA, 23 nt, Human
uaacaagguucuuccacuuuagg

SEQ ID NO: 910824 - RNA, 24 nt, Human
uaacuccuuuccccacucaguccc

SEQ ID NO: 910825 - RNA, 19 nt, Human
uaggggaagggugggggca

SEQ ID NO: 910826 - RNA, 18 nt, Human
ucacagaccuaucaccgc

SEQ ID NO: 910827 - RNA, 22 nt, Human
ucagcagaccaaggccagggug

SEQ ID NO: 910828 - RNA, 18 nt, Human
ucaguccccaggucugga

SEQ ID NO: 910829 - RNA, 19 nt, Human
uccuagggagaaagccacc

SEQ ID NO: 910830 - RNA, 23 nt, Human
ugacuugcauagagacagaaccu

SEQ ID NO: 910831 - RNA, 25 nt, Human
ugagcacacaugucugggcacagug

SEQ ID NO: 910832 - RNA, 18 nt, Human
ugagggggacccaguacc

SEQ ID NO: 910833 - RNA, 20 nt, Human
uggcuggauggcaagcucuc

SEQ ID NO: 910834 - RNA, 22 nt, Human
ugggagggcucaggagguggca

SEQ ID NO: 910835 - RNA, 19 nt, Human
ugggggcugggggcuggag

SEQ ID NO: 910836 - RNA, 20 nt, Human
ugggggcugggggcuggagc

SEQ ID NO: 910837 - RNA, 20 nt, Human
uggugaggggcaccacggug

SEQ ID NO: 910838 - RNA, 19 nt, Human
ugucacugccacagccacu

SEQ ID NO: 910839 - RNA, 21 nt, Human
ugugcuguggagggugcugag

SEQ ID NO: 910840 - RNA, 19 nt, Human
uucaggguuauaaaacuaa

SEQ ID NO: 910841 - RNA, 21 nt, Human
uuuuuuuuuuuuuuuuucauu

SEQ ID NO: 910842 - RNA, 20 nt, Human
aauugcuuuuuaaauaaaau

SEQ ID NO: 910843 - RNA, 23 nt, Human
cccauguugcagcacauaucaga

SEQ ID NO: 910844 - RNA, 20 nt, Human
gacaaacugcaaacuuaauu

SEQ ID NO: 910845 - RNA, 18 nt, Human
guccuuccuuuuuaaggc

SEQ ID NO: 910846 - RNA, 23 nt, Human
ucaccuuuuaucuugauugauca

SEQ ID NO: 910847 - RNA, 19 nt, Human
ugaauaccucuacacugca

SEQ ID NO: 910848 - RNA, 19 nt, Human
ugcaagaauuccuggaaca

SEQ ID NO: 910849 - RNA, 22 nt, Human
uggauggauagaucaccuuuua

SEQ ID NO: 910850 - RNA, 21 nt, Human
uuaugucugguuuauuucacu

SEQ ID NO: 910851 - RNA, 24 nt, Human
uuuuaugucugguuuauuucacuu

SEQ ID NO: 910852 - RNA, 24 nt, Human
aaaauaaauguauaugaauaaugc

SEQ ID NO: 910853 - RNA, 23 nt, Human
aaucggguggauaacggaguaua

SEQ ID NO: 910854 - RNA, 23 nt, Human
acagcaagauacuugcuuuuggc

SEQ ID NO: 910855 - RNA, 23 nt, Human
agaaaggugugaacaguacuguu

SEQ ID NO: 910856 - RNA, 19 nt, Human
agcagcaccggccgggcac

SEQ ID NO: 910857 - RNA, 18 nt, Human
aggugugaacaguacugu

SEQ ID NO: 910858 - RNA, 22 nt, Human
caagacaccugugauaaagaag

SEQ ID NO: 910859 - RNA, 19 nt, Human
caauagaagaguagaucaa

SEQ ID NO: 910860 - RNA, 24 nt, Human
cacagcaagauacuugcuuuuggc

SEQ ID NO: 910861 - RNA, 19 nt, Human
caccugaaaauguuuauua

SEQ ID NO: 910862 - RNA, 23 nt, Human
cagcagcagcgacagcagcaccg

SEQ ID NO: 910863 - RNA, 20 nt, Human
ccaagagacuacacacagca

SEQ ID NO: 910864 - RNA, 19 nt, Human
ccacuuuaggcuaaaauaa

SEQ ID NO: 910865 - RNA, 22 nt, Human
ccgcucggcgcucuuuccacgc

SEQ ID NO: 910866 - RNA, 19 nt, Human
cuacacacagcaagauacu

SEQ ID NO: 910867 - RNA, 20 nt, Human
cugcccugccacccugcugc

SEQ ID NO: 910868 - RNA, 20 nt, Human
gaagaaaggugugaacagua

SEQ ID NO: 910869 - RNA, 19 nt, Human
gcagcagcagcgacagcag

SEQ ID NO: 910870 - RNA, 23 nt, Human
ggaguauaguuauuccacuuaag

SEQ ID NO: 910871 - RNA, 19 nt, Human
gggcagcagcagcgacagc

SEQ ID NO: 910872 - RNA, 21 nt, Human
gggcagcagcagcgacagcag

SEQ ID NO: 910873 - RNA, 18 nt, Human
uaaccaagagacuacaca

SEQ ID NO: 910874 - RNA, 22 nt, Human
uaguagaucuuuuaaaaaaucu

SEQ ID NO: 910875 - RNA, 21 nt, Human
uauuugccaggucauccuaau

SEQ ID NO: 910876 - RNA, 22 nt, Human
ucagauugcuuggaucuugguc

SEQ ID NO: 910877 - RNA, 19 nt, Human
ucuccaaguguguggcaaa

SEQ ID NO: 910878 - RNA, 22 nt, Human
ucugcccugccacccugcugca

SEQ ID NO: 910879 - RNA, 19 nt, Human
ugaagaaaggugugaacag

SEQ ID NO: 910880 - RNA, 19 nt, Human
uuccacuuaagaagcauuc

SEQ ID NO: 910881 - RNA, 20 nt, Human
uugccaggucauccuaauuu

SEQ ID NO: 910882 - RNA, 25 nt, Human
uugccaggucauccuaauuuucuca

SEQ ID NO: 910883 - RNA, 20 nt, Human
agaccaaauucacugggcca

SEQ ID NO: 910884 - RNA, 20 nt, Human
agagcagagggcagaggaga

SEQ ID NO: 910885 - RNA, 25 nt, Human
aggaaaggaaugagagucuggaucc

SEQ ID NO: 910886 - RNA, 19 nt, Human
agggcagaggagagggaug

SEQ ID NO: 910887 - RNA, 21 nt, Human
ccagagcugggagagaccaaa

SEQ ID NO: 910888 - RNA, 21 nt, Human
ccagaggaaaggaaugagagu

SEQ ID NO: 910889 - RNA, 19 nt, Human
cccagagcugggagagacc

SEQ ID NO: 910890 - RNA, 24 nt, Human
cccugguucagggccaaagggagu

SEQ ID NO: 910891 - RNA, 24 nt, Human
cuaacggugaauuugguuuccccu

SEQ ID NO: 910892 - RNA, 21 nt, Human
cugccaggagcuggaaagagc

SEQ ID NO: 910893 - RNA, 25 nt, Human
ggagagagagagacuccaguggggu

SEQ ID NO: 910894 - RNA, 20 nt, Human
ggccuucagaagaguggccc

SEQ ID NO: 910895 - RNA, 20 nt, Human
uaaugagcucagaguaaggu

SEQ ID NO: 910896 - RNA, 22 nt, Human
uaaugagcucagaguaagguuu

SEQ ID NO: 910897 - RNA, 23 nt, Human
uagauucaggucccaaggaugcc

SEQ ID NO: 910898 - RNA, 24 nt, Human
uaguguggccucucucaaggcuga

SEQ ID NO: 910899 - RNA, 24 nt, Human
ucccccagagcugggagagacccc

SEQ ID NO: 910900 - RNA, 22 nt, Human
uccuugagaucuucucccaaau

SEQ ID NO: 910901 - RNA, 24 nt, Human
uggaaaauaaaucuauuuuauuaa

SEQ ID NO: 910902 - RNA, 20 nt, Human
uggaaagagccgcgaccgcg

SEQ ID NO: 910903 - RNA, 18 nt, Human
uggauccuugagaucuuc

SEQ ID NO: 910904 - RNA, 20 nt, Human
uggcagcaauuagagcagag

SEQ ID NO: 910905 - RNA, 26 nt, Human
ugggagagaccaaauucacugggcca

SEQ ID NO: 910906 - RNA, 23 nt, Human
aaaaaaaaacaaaaaacaaaaaa

SEQ ID NO: 910907 - RNA, 23 nt, Human
aaaaauacaaaagggauacagac

SEQ ID NO: 910908 - RNA, 23 nt, Human
aaaaauccaagaccagcaguucc

SEQ ID NO: 910909 - RNA, 24 nt, Human
aaaaaugggguuugccauccaucu

SEQ ID NO: 910910 - RNA, 19 nt, Human
aaaacaaaaaacaaaaccu

SEQ ID NO: 910911 - RNA, 20 nt, Human
aaaauacaaaagggauacag

SEQ ID NO: 910912 - RNA, 24 nt, Human
aaacagcuggcauuagcuccaaca

SEQ ID NO: 910913 - RNA, 19 nt, Human
aaacugguccaccguccuc

SEQ ID NO: 910914 - RNA, 23 nt, Human
aaagaaauauaacuuaaaaaugg

SEQ ID NO: 910915 - RNA, 23 nt, Human
aacauaguacauuucuaccaucu

SEQ ID NO: 910916 - RNA, 25 nt, Human
aagcaacaaagucugaaaagugcca

SEQ ID NO: 910917 - RNA, 19 nt, Human
aagcacugacauuguuuga

SEQ ID NO: 910918 - RNA, 19 nt, Human
aaggccccaaguaguucaa

SEQ ID NO: 910919 - RNA, 24 nt, Human
aauggaaaaaaaauccaagaccag

SEQ ID NO: 910920 - RNA, 22 nt, Human
acaaaaaacaaaaaacaaaacc

SEQ ID NO: 910921 - RNA, 18 nt, Human
acauuguaaacaagugga

SEQ ID NO: 910922 - RNA, 22 nt, Human
accagaaggacaugggaagcca

SEQ ID NO: 910923 - RNA, 19 nt, Human
accccauccacuggggaag

SEQ ID NO: 910924 - RNA, 24 nt, Human
accccauccacuggggaaggagca

SEQ ID NO: 910925 - RNA, 23 nt, Human
augaucagcugaauuuaauggaa

SEQ ID NO: 910926 - RNA, 22 nt, Human
auucugcacuugacaucacaga

SEQ ID NO: 910927 - RNA, 25 nt, Human
caaaaaacaaaaccuacaccucuaa

SEQ ID NO: 910928 - RNA, 22 nt, Human
cacaagccaggucuucccgucu

SEQ ID NO: 910929 - RNA, 18 nt, Human
cacaugagguccauagcc

SEQ ID NO: 910930 - RNA, 18 nt, Human
cacaugcaaaggggaaag

SEQ ID NO: 910931 - RNA, 20 nt, Human
cacugcaauuccacuuuuaa

SEQ ID NO: 910932 - RNA, 22 nt, Human
cagcaacagugggagcucgaag

SEQ ID NO: 910933 - RNA, 24 nt, Human
cagcugaauuuaauggaaaaaaaa

SEQ ID NO: 910934 - RNA, 24 nt, Human
caggacacaaggguccuaguuccc

SEQ ID NO: 910935 - RNA, 19 nt, Human
caggacacauccgccaaug

SEQ ID NO: 910936 - RNA, 21 nt, Human
ccaaugcucaggacgucuucu

SEQ ID NO: 910937 - RNA, 24 nt, Human
ccccuggccaugugcaaacaguuu

SEQ ID NO: 910938 - RNA, 23 nt, Human
ccugccuccauaaggcucagaca

SEQ ID NO: 910939 - RNA, 21 nt, Human
cgccaaugacaccguccugcc

SEQ ID NO: 910940 - RNA, 21 nt, Human
cuaaaagacauacagguacaa

SEQ ID NO: 910941 - RNA, 20 nt, Human
cuaaccagguuuuugaucuu

SEQ ID NO: 910942 - RNA, 23 nt, Human
cuaaccugccuugcaaaggcugg

SEQ ID NO: 910943 - RNA, 21 nt, Human
cuacaauuacuuaaugcuuag

SEQ ID NO: 910944 - RNA, 21 nt, Human
gaucaagugcuaggacuggau

SEQ ID NO: 910945 - RNA, 22 nt, Human
gcaaaacaacacaaaaauagag

SEQ ID NO: 910946 - RNA, 23 nt, Human
gcagcaacagugggagcucgaag

SEQ ID NO: 910947 - RNA, 18 nt, Human
gccaaugacaccguccug

SEQ ID NO: 910948 - RNA, 24 nt, Human
ggagcucgaagauugcugcacugu

SEQ ID NO: 910949 - RNA, 19 nt, Human
guguggccacacccugucc

SEQ ID NO: 910950 - RNA, 25 nt, Human
uaaaaaaaaacaaaaaacaaaaaac

SEQ ID NO: 910951 - RNA, 20 nt, Human
uaaaggcuuguuuauucccu

SEQ ID NO: 910952 - RNA, 18 nt, Human
uaaugcauauuacaugua

SEQ ID NO: 910953 - RNA, 19 nt, Human
uacacaucauguaccaauc

SEQ ID NO: 910954 - RNA, 24 nt, Human
uacagguacaaguaguaucaaaag

SEQ ID NO: 910955 - RNA, 18 nt, Human
uagccuauauaauaaaac

SEQ ID NO: 910956 - RNA, 24 nt, Human
uaguucaauggcuagcuuuucuca

SEQ ID NO: 910957 - RNA, 28 nt, Human
uaugcacaugagguccauagccuauaua

SEQ ID NO: 910958 - RNA, 18 nt, Human
ucagacaggacacaaggg

SEQ ID NO: 910959 - RNA, 18 nt, Human
ucaggacgucuucuugug

SEQ ID NO: 910960 - RNA, 18 nt, Human
ucauuaucccaaugagau

SEQ ID NO: 910961 - RNA, 25 nt, Human
uccauaaagccacuuggagguuagu

SEQ ID NO: 910962 - RNA, 21 nt, Human
uccucagaaugugaguuccaa

SEQ ID NO: 910963 - RNA, 19 nt, Human
uccuugguggguuaaaggc

SEQ ID NO: 910964 - RNA, 21 nt, Human
uccuugguggguuaaaggccc

SEQ ID NO: 910965 - RNA, 20 nt, Human
ucuauaugcagcguccauaa

SEQ ID NO: 910966 - RNA, 22 nt, Human
ugaaaaaacacugcaauuccac

SEQ ID NO: 910967 - RNA, 24 nt, Human
ugaaaaaacacugcaauuccacuu

SEQ ID NO: 910968 - RNA, 23 nt, Human
ugaaaagugccagggcaauuucu

SEQ ID NO: 910969 - RNA, 20 nt, Human
ugaacugaauuuacacauca

SEQ ID NO: 910970 - RNA, 21 nt, Human
ugacaucacagagcgaacuga

SEQ ID NO: 910971 - RNA, 24 nt, Human
ugagaucaagugcuaggacuggau

SEQ ID NO: 910972 - RNA, 21 nt, Human
ugagauuagcaguccuauguu

SEQ ID NO: 910973 - RNA, 22 nt, Human
ugauacugugugauguggcagg

SEQ ID NO: 910974 - RNA, 20 nt, Human
ugccuugcaaaggcuggcau

SEQ ID NO: 910975 - RNA, 21 nt, Human
ugcugcuuuuaaggcagggaa

SEQ ID NO: 910976 - RNA, 19 nt, Human
uggaaaaaaaauccaagac

SEQ ID NO: 910977 - RNA, 20 nt, Human
uggagcaggacacauccgcc

SEQ ID NO: 910978 - RNA, 22 nt, Human
uggcaggcagcaacagugggag

SEQ ID NO: 910979 - RNA, 27 nt, Human
uguaaaauuacaaaugcauaauugaca

SEQ ID NO: 910980 - RNA, 22 nt, Human
uguccggcauauuugguuuuuc

SEQ ID NO: 910981 - RNA, 19 nt, Human
ugugaguuccaaggcucca

SEQ ID NO: 910982 - RNA, 18 nt, Human
ugugaugaucuuggaauu

SEQ ID NO: 910983 - RNA, 20 nt, Human
ugugaugaucuuggaauuug

SEQ ID NO: 910984 - RNA, 20 nt, Human
ugugcaaacaguuuuacaga

SEQ ID NO: 910985 - RNA, 27 nt, Human
ugugcaaacaguuuuacagaagaaccc

SEQ ID NO: 910986 - RNA, 20 nt, Human
uucaacaaaaauauaaccaa

SEQ ID NO: 910987 - RNA, 24 nt, Human
uucgcgggugagaccagaaggaca

SEQ ID NO: 910988 - RNA, 18 nt, Human
uuucagaaaccaggcugg

SEQ ID NO: 910989 - RNA, 18 nt, Human
uuuuuuuuuuuaaaagga

SEQ ID NO: 910990 - RNA, 18 nt, Human
aaaaaaaagaaacaauga

SEQ ID NO: 910991 - RNA, 24 nt, Human
aaaaaaaccaaccagucuccuaaa

SEQ ID NO: 910992 - RNA, 25 nt, Human
aaaaaaagaaacaaugacaguuuua

SEQ ID NO: 910993 - RNA, 22 nt, Human
aaaaaccaaccagucuccuaaa

SEQ ID NO: 910994 - RNA, 25 nt, Human
aaaacagcaaaaacuuaaggggagc

SEQ ID NO: 910995 - RNA, 18 nt, Human
aaaacugaccccagagac

SEQ ID NO: 910996 - RNA, 19 nt, Human
aaacagggauguucccaaa

SEQ ID NO: 910997 - RNA, 18 nt, Human
aagaaagaagagaacuga

SEQ ID NO: 910998 - RNA, 22 nt, Human
aagaaagaagagaacugagaaa

SEQ ID NO: 910999 - RNA, 23 nt, Human
aagaaagcagaaaccacaaaacu

SEQ ID NO: 911000 - RNA, 19 nt, Human
aagaagagaacugagaaaa

SEQ ID NO: 911001 - RNA, 20 nt, Human
aagaagagaacugagaaaau

SEQ ID NO: 911002 - RNA, 23 nt, Human
aagcagaaaccacaaaacugacc

SEQ ID NO: 911003 - RNA, 26 nt, Human
aagcagaaaccacaaaacugacccca

SEQ ID NO: 911004 - RNA, 23 nt, Human
aaggaccucucuaggccgacuuc

SEQ ID NO: 911005 - RNA, 18 nt, Human
aaggcuucuggaguuaau

SEQ ID NO: 911006 - RNA, 20 nt, Human
aagggugugucacaucuugu

SEQ ID NO: 911007 - RNA, 23 nt, Human
aaguaucuccaacauaaaaucuu

SEQ ID NO: 911008 - RNA, 22 nt, Human
aauacagcuuaucagaagugcu

SEQ ID NO: 911009 - RNA, 20 nt, Human
aauaucuaucaaucaagcau

SEQ ID NO: 911010 - RNA, 19 nt, Human
acaaaaucauacaaaauga

SEQ ID NO: 911011 - RNA, 22 nt, Human
acaguacagaucuccauuuccu

SEQ ID NO: 911012 - RNA, 24 nt, Human
acaguacagaucuccauuucgggg

SEQ ID NO: 911013 - RNA, 22 nt, Human
acauauacagaccuacaucucc

SEQ ID NO: 911014 - RNA, 23 nt, Human
accaguuaaaaaaaaagaaacaa

SEQ ID NO: 911015 - RNA, 23 nt, Human
acccgggagggccccugggagug

SEQ ID NO: 911016 - RNA, 19 nt, Human
acccuggccacuggucugu

SEQ ID NO: 911017 - RNA, 22 nt, Human
acccuguuucuccuccucuuua

SEQ ID NO: 911018 - RNA, 20 nt, Human
accuggcugaaagccagcga

SEQ ID NO: 911019 - RNA, 23 nt, Human
acucacccuguuucuccuccucu

SEQ ID NO: 911020 - RNA, 23 nt, Human
acuggaacgaaggaacccucccg

SEQ ID NO: 911021 - RNA, 22 nt, Human
acuguuuguuggcgagggaaac

SEQ ID NO: 911022 - RNA, 24 nt, Human
agaaaagagauccaauacuuagaa

SEQ ID NO: 911023 - RNA, 20 nt, Human
agaaagaagagaacugagaa

SEQ ID NO: 911024 - RNA, 22 nt, Human
agaaagaagagaacugagaaaa

SEQ ID NO: 911025 - RNA, 21 nt, Human
agaaguaucuccaacauaaaa

SEQ ID NO: 911026 - RNA, 24 nt, Human
agaggaggggcaggugcagcacgg

SEQ ID NO: 911027 - RNA, 22 nt, Human
agagggaaaaaaaccaaccagu

SEQ ID NO: 911028 - RNA, 23 nt, Human
agaggguuucggagggccugugg

SEQ ID NO: 911029 - RNA, 23 nt, Human
agaugugugggaagauggaaaug

SEQ ID NO: 911030 - RNA, 23 nt, Human
agccgcugcuuucucccccgggg

SEQ ID NO: 911031 - RNA, 21 nt, Human
aggaaaacauuuuuggcaaaa

SEQ ID NO: 911032 - RNA, 22 nt, Human
aggagcagucauggguuguugc

SEQ ID NO: 911033 - RNA, 25 nt, Human
aggcaagaaagcagaaaccacaaaa

SEQ ID NO: 911034 - RNA, 19 nt, Human
aggcaggcugcccuccucc

SEQ ID NO: 911035 - RNA, 19 nt, Human
aggccgacuucaaagaugu

SEQ ID NO: 911036 - RNA, 23 nt, Human
aggccuggagaugaccccaaacu

SEQ ID NO: 911037 - RNA, 19 nt, Human
aggcggaucugcucaugug

SEQ ID NO: 911038 - RNA, 22 nt, Human
agggaaaaaaaccaaccagucu

SEQ ID NO: 911039 - RNA, 24 nt, Human
agggauguucccaaaacucaggcc

SEQ ID NO: 911040 - RNA, 22 nt, Human
agggccccugggagugaaaugc

SEQ ID NO: 911041 - RNA, 21 nt, Human
agggggagccgcugcuuucuc

SEQ ID NO: 911042 - RNA, 26 nt, Human
aggucugaggagcagucauggguugu

SEQ ID NO: 911043 - RNA, 18 nt, Human
aguccgugagguuggcug

SEQ ID NO: 911044 - RNA, 22 nt, Human
aguccuuuuuugcaagagaggg

SEQ ID NO: 911045 - RNA, 18 nt, Human
aguguuguugacuugaaa

SEQ ID NO: 911046 - RNA, 19 nt, Human
augaccccaaacuuucugg

SEQ ID NO: 911047 - RNA, 20 nt, Human
augaccccaaacuuucuggu

SEQ ID NO: 911048 - RNA, 25 nt, Human
augagaaaucuggacucagacaagc

SEQ ID NO: 911049 - RNA, 21 nt, Human
augcagcccacauccagcaca

SEQ ID NO: 911050 - RNA, 23 nt, Human
auguugucagggcucaacggguu

SEQ ID NO: 911051 - RNA, 25 nt, Human
auuccauuaagcuccucuauuugga

SEQ ID NO: 911052 - RNA, 19 nt, Human
auuccuggcacaacuucuc

SEQ ID NO: 911053 - RNA, 20 nt, Human
auuccugugagcggcaccuc

SEQ ID NO: 911054 - RNA, 25 nt, Human
caaaacucaggcccacagucucugu

SEQ ID NO: 911055 - RNA, 22 nt, Human
caaaacugaccccagagacuga

SEQ ID NO: 911056 - RNA, 20 nt, Human
caacuucuccacagcuccac

SEQ ID NO: 911057 - RNA, 24 nt, Human
caagaaaagagauccaauacuuag

SEQ ID NO: 911058 - RNA, 18 nt, Human
caagaaagcagaaaccac

SEQ ID NO: 911059 - RNA, 21 nt, Human
caagaaagcagaaaccacaaa

SEQ ID NO: 911060 - RNA, 20 nt, Human
caaggcccuugccuuuuucu

SEQ ID NO: 911061 - RNA, 22 nt, Human
cacaagcaucuccaguggucag

SEQ ID NO: 911062 - RNA, 24 nt, Human
cacagcuccaccuggcugaaagcc

SEQ ID NO: 911063 - RNA, 19 nt, Human
cacagucucuguguccccc

SEQ ID NO: 911064 - RNA, 19 nt, Human
cacccagcuccaagguagg

SEQ ID NO: 911065 - RNA, 20 nt, Human
cacugauccuggagcaaggc

SEQ ID NO: 911066 - RNA, 27 nt, Human
cagaaaaaugaugauguacaaagcuga

SEQ ID NO: 911067 - RNA, 24 nt, Human
cagcaauacuaaagccaaggcccu

SEQ ID NO: 911068 - RNA, 20 nt, Human
cagcauggcggacguugacg

SEQ ID NO: 911069 - RNA, 23 nt, Human
cagcgacagucacuuugacagaa

SEQ ID NO: 911070 - RNA, 19 nt, Human
cagcuuccagggcuccccu

SEQ ID NO: 911071 - RNA, 20 nt, Human
cagcuucuggauggccgccu

SEQ ID NO: 911072 - RNA, 19 nt, Human
caguacagaucuccauuuc

SEQ ID NO: 911073 - RNA, 21 nt, Human
cagucacucgauuggaagucc

SEQ ID NO: 911074 - RNA, 27 nt, Human
cagucucgaccuccagcaauacuaaag

SEQ ID NO: 911075 - RNA, 19 nt, Human
cauaguccccgaaaacagg

SEQ ID NO: 911076 - RNA, 18 nt, Human
caucaacuccaaccauca

SEQ ID NO: 911077 - RNA, 22 nt, Human
caugcaccuugcacugacuucc

SEQ ID NO: 911078 - RNA, 26 nt, Human
cauucagaaaaaugaugauguacaaa

SEQ ID NO: 911079 - RNA, 21 nt, Human
ccaaaacucaggcccacaguc

SEQ ID NO: 911080 - RNA, 18 nt, Human
ccacagucucuguguccc

SEQ ID NO: 911081 - RNA, 23 nt, Human
ccaccagaggaggaguggccaga

SEQ ID NO: 911082 - RNA, 21 nt, Human
ccacgaaugcagucucgaccu

SEQ ID NO: 911083 - RNA, 21 nt, Human
ccagagacugaaaaacaauca

SEQ ID NO: 911084 - RNA, 20 nt, Human
ccagccuacuuuaaucuuca

SEQ ID NO: 911085 - RNA, 24 nt, Human
ccaguuaaaaaaaaagaaacaaug

SEQ ID NO: 911086 - RNA, 25 nt, Human
ccaguuaaaaaaaaagaaacaauga

SEQ ID NO: 911087 - RNA, 18 nt, Human
ccaugaagucugacaagg

SEQ ID NO: 911088 - RNA, 21 nt, Human
ccaugacgauccuguccuugg

SEQ ID NO: 911089 - RNA, 22 nt, Human
cccacauccagcacaggacccu

SEQ ID NO: 911090 - RNA, 19 nt, Human
cccaccuuccugcaggcug

SEQ ID NO: 911091 - RNA, 24 nt, Human
cccagaagcccgauggcucccaag

SEQ ID NO: 911092 - RNA, 21 nt, Human
ccccacugacaucaacuccaa

SEQ ID NO: 911093 - RNA, 21 nt, Human
cccccccugcgcuuuucacca

SEQ ID NO: 911094 - RNA, 18 nt, Human
cccccugcgcuuuucacc

SEQ ID NO: 911095 - RNA, 19 nt, Human
ccccugagggcagccaccc

SEQ ID NO: 911096 - RNA, 18 nt, Human
cccgcugaggcuccccca

SEQ ID NO: 911097 - RNA, 19 nt, Human
cccgcugaggcucccccac

SEQ ID NO: 911098 - RNA, 18 nt, Human
cccuggggaagagaugag

SEQ ID NO: 911099 - RNA, 24 nt, Human
ccgaugagaguuuggaauuauuua

SEQ ID NO: 911100 - RNA, 22 nt, Human
ccggcccauccccaccuuccug

SEQ ID NO: 911101 - RNA, 20 nt, Human
ccuacaguauucuaccugua

SEQ ID NO: 911102 - RNA, 19 nt, Human
ccucagaaccggccaccau

SEQ ID NO: 911103 - RNA, 20 nt, Human
ccugcagcuucuggauggcc

SEQ ID NO: 911104 - RNA, 19 nt, Human
ccuguccuugggcccaggg

SEQ ID NO: 911105 - RNA, 19 nt, Human
ccuuccugcaggcuguucu

SEQ ID NO: 911106 - RNA, 19 nt, Human
cgaaggaacccucccggcc

SEQ ID NO: 911107 - RNA, 24 nt, Human
cgaguccagaucgcauggaucauu

SEQ ID NO: 911108 - RNA, 22 nt, Human
cggaaacagggcauuuacucaa

SEQ ID NO: 911109 - RNA, 24 nt, Human
cuaaguccacugagcuaccaagaa

SEQ ID NO: 911110 - RNA, 20 nt, Human
cuagaugggguccagccacc

SEQ ID NO: 911111 - RNA, 20 nt, Human
cucacagccagcgcugcccu

SEQ ID NO: 911112 - RNA, 20 nt, Human
cucacuaaaaaauacucuca

SEQ ID NO: 911113 - RNA, 26 nt, Human
cuccaacauaaaaucuuagugucaug

SEQ ID NO: 911114 - RNA, 21 nt, Human
cuccaaccaucagcugcccau

SEQ ID NO: 911115 - RNA, 20 nt, Human
cuccaagguagguguuucuc

SEQ ID NO: 911116 - RNA, 24 nt, Human
cuccauuucgggggggcugugauc

SEQ ID NO: 911117 - RNA, 19 nt, Human
cucccggccugggugacgc

SEQ ID NO: 911118 - RNA, 19 nt, Human
cucguccucagaaccggcc

SEQ ID NO: 911119 - RNA, 22 nt, Human
cugcaggcuguucugcagccac

SEQ ID NO: 911120 - RNA, 21 nt, Human
cuggggcucaccaacuuugug

SEQ ID NO: 911121 - RNA, 25 nt, Human
cuugguuguggacguccaaccgacg

SEQ ID NO: 911122 - RNA, 19 nt, Human
cuuuaagucuuccguccuc

SEQ ID NO: 911123 - RNA, 19 nt, Human
cuuuuuggacaauuccuga

SEQ ID NO: 911124 - RNA, 19 nt, Human
gaaaacagcaaaaacuuaa

SEQ ID NO: 911125 - RNA, 23 nt, Human
gaaaacgaaaacagcaaaaacuu

SEQ ID NO: 911126 - RNA, 21 nt, Human
gacgauccuguccuugggccc

SEQ ID NO: 911127 - RNA, 21 nt, Human
gagaaaucuggacucagacaa

SEQ ID NO: 911128 - RNA, 24 nt, Human
gaggcuguuggcucuggguuuucc

SEQ ID NO: 911129 - RNA, 20 nt, Human
gagggaaaaaaaccaaccag

SEQ ID NO: 911130 - RNA, 24 nt, Human
gaggguuucggagggccugugggc

SEQ ID NO: 911131 - RNA, 18 nt, Human
gauccuguccuugggccc

SEQ ID NO: 911132 - RNA, 21 nt, Human
gauggcuaaagccccuccaug

SEQ ID NO: 911133 - RNA, 19 nt, Human
gcaauacuaaagccaaggc

SEQ ID NO: 911134 - RNA, 21 nt, Human
gcagccacugguagaggaggg

SEQ ID NO: 911135 - RNA, 18 nt, Human
gcagcuuugggcagguuc

SEQ ID NO: 911136 - RNA, 20 nt, Human
gcaggcuguucugcagccac

SEQ ID NO: 911137 - RNA, 19 nt, Human
gccacugggcuuggccuca

SEQ ID NO: 911138 - RNA, 21 nt, Human
gccauuucaacaaccuguggu

SEQ ID NO: 911139 - RNA, 25 nt, Human
gcucagugcuggggucacuggacac

SEQ ID NO: 911140 - RNA, 25 nt, Human
gcugggaggcaggcugcccuccucc

SEQ ID NO: 911141 - RNA, 18 nt, Human
gcuuggccucagccucgg

SEQ ID NO: 911142 - RNA, 21 nt, Human
ggaaagagggaaaaaaaccaa

SEQ ID NO: 911143 - RNA, 23 nt, Human
ggaaauugagacacgccucgggu

SEQ ID NO: 911144 - RNA, 18 nt, Human
ggaaggagaccauuccau

SEQ ID NO: 911145 - RNA, 20 nt, Human
ggagaggaauuggccucuuu

SEQ ID NO: 911146 - RNA, 21 nt, Human
ggaggagaggguuucggaggg

SEQ ID NO: 911147 - RNA, 22 nt, Human
ggaggccuggagaugaccccaa

SEQ ID NO: 911148 - RNA, 24 nt, Human
ggcaagaaggaagcaaaggucuag

SEQ ID NO: 911149 - RNA, 21 nt, Human
ggccgaaugagccuccaagga

SEQ ID NO: 911150 - RNA, 18 nt, Human
gggagagcuggcaagaag

SEQ ID NO: 911151 - RNA, 20 nt, Human
gggcauuuacucaagauggc

SEQ ID NO: 911152 - RNA, 24 nt, Human
gggggcugugaucaggugggaccg

SEQ ID NO: 911153 - RNA, 24 nt, Human
gggucauccucugacagaggccug

SEQ ID NO: 911154 - RNA, 21 nt, Human
gguauuguggggugugcuggu

SEQ ID NO: 911155 - RNA, 23 nt, Human
ggucaagaaaagagauccaauac

SEQ ID NO: 911156 - RNA, 19 nt, Human
guggucagaggagcaucug

SEQ ID NO: 911157 - RNA, 24 nt, Human
uaaaaaaaaagaaacaaugacagg

SEQ ID NO: 911158 - RNA, 26 nt, Human
uaaaacaaauaauccacuccggauuu

SEQ ID NO: 911159 - RNA, 18 nt, Human
uaaacauaacauaaaggu

SEQ ID NO: 911160 - RNA, 23 nt, Human
uaacuccuguaccauauuuuccu

SEQ ID NO: 911161 - RNA, 19 nt, Human
uaacuggccccacugacau

SEQ ID NO: 911162 - RNA, 21 nt, Human
uacuagucaugccuugaacac

SEQ ID NO: 911163 - RNA, 22 nt, Human
uacuuaaaaaagguuguuuaca

SEQ ID NO: 911164 - RNA, 22 nt, Human
uacuucauggugaucaauaacc

SEQ ID NO: 911165 - RNA, 20 nt, Human
uagagacacaagcaucucca

SEQ ID NO: 911166 - RNA, 23 nt, Human
uagcaguggcugaugacuuuagc

SEQ ID NO: 911167 - RNA, 25 nt, Human
uagcauaguguaugugguaagccag

SEQ ID NO: 911168 - RNA, 23 nt, Human
uaggaaaacauuuuuggcaaaag

SEQ ID NO: 911169 - RNA, 24 nt, Human
uaggcaagaaagcagaaaccacaa

SEQ ID NO: 911170 - RNA, 18 nt, Human
uaguccccgaaaacaggg

SEQ ID NO: 911171 - RNA, 28 nt, Human
uauacauuacacucacuaaaaaauacuc

SEQ ID NO: 911172 - RNA, 24 nt, Human
uaucaagacagguucaaaaacuag

SEQ ID NO: 911173 - RNA, 20 nt, Human
uauggcaaaugcacucucca

SEQ ID NO: 911174 - RNA, 21 nt, Human
uauggcaaaugcacucuccac

SEQ ID NO: 911175 - RNA, 20 nt, Human
ucaaccaucaaauucaauga

SEQ ID NO: 911176 - RNA, 20 nt, Human
ucaagcaugcaccuugcacu

SEQ ID NO: 911177 - RNA, 26 nt, Human
ucacagcugguagagacacaagcauc

SEQ ID NO: 911178 - RNA, 21 nt, Human
ucaccaguguuuuccgggguc

SEQ ID NO: 911179 - RNA, 24 nt, Human
ucacccagcuccaagguagguguu

SEQ ID NO: 911180 - RNA, 24 nt, Human
ucacuuccaggauuugauccccgc

SEQ ID NO: 911181 - RNA, 24 nt, Human
ucagaaauggaaacccagugacug

SEQ ID NO: 911182 - RNA, 18 nt, Human
ucaugccaccagaggagg

SEQ ID NO: 911183 - RNA, 20 nt, Human
uccaauacuuagaauguuac

SEQ ID NO: 911184 - RNA, 20 nt, Human
uccacugagcuaccaagaag

SEQ ID NO: 911185 - RNA, 22 nt, Human
uccaugacgauccuguccuugg

SEQ ID NO: 911186 - RNA, 18 nt, Human
ucccaaaacucaggccca

SEQ ID NO: 911187 - RNA, 20 nt, Human
ucccaagagucacgaggcug

SEQ ID NO: 911188 - RNA, 20 nt, Human
ucccucugcuccaggucccg

SEQ ID NO: 911189 - RNA, 25 nt, Human
ucccucuguccacuucugaccucuc

SEQ ID NO: 911190 - RNA, 19 nt, Human
ucccuggggaagagaugag

SEQ ID NO: 911191 - RNA, 20 nt, Human
uccucagaaccggccaccau

SEQ ID NO: 911192 - RNA, 20 nt, Human
uccuucuuccaccagcuucc

SEQ ID NO: 911193 - RNA, 24 nt, Human
ucgaccuccagcaauacuaaagcc

SEQ ID NO: 911194 - RNA, 21 nt, Human
ucgagaugacggauggccgaa

SEQ ID NO: 911195 - RNA, 21 nt, Human
ucgcauggaucauuggcucug

SEQ ID NO: 911196 - RNA, 24 nt, Human
ucggccaacuuccuccuuccgugc

SEQ ID NO: 911197 - RNA, 21 nt, Human
ucguuggcaucguagcagccu

SEQ ID NO: 911198 - RNA, 23 nt, Human
ucuccaacauaaaaucuuagugu

SEQ ID NO: 911199 - RNA, 22 nt, Human
ucuccugguucagagcuguugc

SEQ ID NO: 911200 - RNA, 21 nt, Human
ucucucaucugaaggaccucu

SEQ ID NO: 911201 - RNA, 20 nt, Human
ucucugugucccccagcucc

SEQ ID NO: 911202 - RNA, 25 nt, Human
ucucugugucccccagcuccuuggu

SEQ ID NO: 911203 - RNA, 22 nt, Human
ucugaugcagcuuugggcaggu

SEQ ID NO: 911204 - RNA, 20 nt, Human
ucugcagcugauccauuugg

SEQ ID NO: 911205 - RNA, 19 nt, Human
ucugucccucuguccacuu

SEQ ID NO: 911206 - RNA, 19 nt, Human
ucugugccuggagcccagg

SEQ ID NO: 911207 - RNA, 24 nt, Human
ugaaaugcaguccccuucucuguc

SEQ ID NO: 911208 - RNA, 19 nt, Human
ugaagaacugccuucaucg

SEQ ID NO: 911209 - RNA, 19 nt, Human
ugacagaaguggccuggac

SEQ ID NO: 911210 - RNA, 22 nt, Human
ugacagaaguggccuggacucu

SEQ ID NO: 911211 - RNA, 18 nt, Human
ugacagaggccugauggg

SEQ ID NO: 911212 - RNA, 19 nt, Human
ugacccugggcgaugcagg

SEQ ID NO: 911213 - RNA, 23 nt, Human
ugacucacccuguuucuccuccu

SEQ ID NO: 911214 - RNA, 18 nt, Human
ugagcggcaccuccuucc

SEQ ID NO: 911215 - RNA, 21 nt, Human
ugagguacacaguacagaucu

SEQ ID NO: 911216 - RNA, 19 nt, Human
ugaggugagcgcuuugauc

SEQ ID NO: 911217 - RNA, 22 nt, Human
ugagguggcuggcauccagaug

SEQ ID NO: 911218 - RNA, 24 nt, Human
ugcaaagcgggaaaacgaaaacag

SEQ ID NO: 911219 - RNA, 20 nt, Human
ugccccagcucugaugcagc

SEQ ID NO: 911220 - RNA, 21 nt, Human
ugcccucugggauacucuccu

SEQ ID NO: 911221 - RNA, 21 nt, Human
ugccuugaacacugaagacaa

SEQ ID NO: 911222 - RNA, 23 nt, Human
ugcgcuuuucaccauaguccccg

SEQ ID NO: 911223 - RNA, 21 nt, Human
ugcgugcuaugacuucaucca

SEQ ID NO: 911224 - RNA, 18 nt, Human
ugcucugucccucugucc

SEQ ID NO: 911225 - RNA, 24 nt, Human
ugcugggaggcaggcugcccuccu

SEQ ID NO: 911226 - RNA, 22 nt, Human
uggaaacccagugacugacuga

SEQ ID NO: 911227 - RNA, 20 nt, Human
uggaaggcuucuggaguuaa

SEQ ID NO: 911228 - RNA, 23 nt, Human
uggacaccucacagccagcgcug

SEQ ID NO: 911229 - RNA, 18 nt, Human
uggcaagaaggaagcaaa

SEQ ID NO: 911230 - RNA, 22 nt, Human
uggcaagaaggaagcaaaggcc

SEQ ID NO: 911231 - RNA, 19 nt, Human
uggcggaggagaggguuuc

SEQ ID NO: 911232 - RNA, 22 nt, Human
uggcguggacuuugcuuaaagc

SEQ ID NO: 911233 - RNA, 20 nt, Human
uggcucuggguuuuccaggc

SEQ ID NO: 911234 - RNA, 20 nt, Human
uggcugaaagccagcgacag

SEQ ID NO: 911235 - RNA, 23 nt, Human
uggcugggauucucuggccgacu

SEQ ID NO: 911236 - RNA, 23 nt, Human
ugggacccgggagggccccuggg

SEQ ID NO: 911237 - RNA, 20 nt, Human
ugggaggcaggcugcccucc

SEQ ID NO: 911238 - RNA, 19 nt, Human
ugggcaaaguacugggaga

SEQ ID NO: 911239 - RNA, 20 nt, Human
ugggcccaggggucuuccga

SEQ ID NO: 911240 - RNA, 19 nt, Human
ugggcuguucuuccucagc

SEQ ID NO: 911241 - RNA, 24 nt, Human
uggggggaacuggggcucccagug

SEQ ID NO: 911242 - RNA, 23 nt, Human
ugguagaggaggggcaggugcag

SEQ ID NO: 911243 - RNA, 18 nt, Human
ugguauuguggggugugc

SEQ ID NO: 911244 - RNA, 18 nt, Human
uggucagaggagcaucug

SEQ ID NO: 911245 - RNA, 19 nt, Human
ugucgagcagggugugagg

SEQ ID NO: 911246 - RNA, 21 nt, Human
uguggaagagcccagaagccc

SEQ ID NO: 911247 - RNA, 18 nt, Human
ugugucuacagaggucuu

SEQ ID NO: 911248 - RNA, 19 nt, Human
uguucacauagggcugugc

SEQ ID NO: 911249 - RNA, 22 nt, Human
uguucccaaaacucaggcccac

SEQ ID NO: 911250 - RNA, 23 nt, Human
uguugggagagcuggcaagaagg

SEQ ID NO: 911251 - RNA, 21 nt, Human
uuacccuggccacuggucugu

SEQ ID NO: 911252 - RNA, 19 nt, Human
uuacucuuuaauauauaag

SEQ ID NO: 911253 - RNA, 20 nt, Human
uuccaggauuugauccccgc

SEQ ID NO: 911254 - RNA, 19 nt, Human
uuccucagcucugucaccc

SEQ ID NO: 911255 - RNA, 18 nt, Human
uuccucuugguuguggac

SEQ ID NO: 911256 - RNA, 21 nt, Human
uucggggaggcggaucugcuc

SEQ ID NO: 911257 - RNA, 23 nt, Human
uucggggaggcggaucugcucau

SEQ ID NO: 911258 - RNA, 19 nt, Human
uucggucacccagcuccaa

SEQ ID NO: 911259 - RNA, 19 nt, Human
uucuggauggccgccuggc

SEQ ID NO: 911260 - RNA, 19 nt, Human
uugagcagcuccaucuucc

SEQ ID NO: 911261 - RNA, 20 nt, Human
uuuccaggcucacuggaggu

SEQ ID NO: 911262 - RNA, 22 nt, Human
uuucggagggccugugggcuuc

SEQ ID NO: 911263 - RNA, 23 nt, Human
uuuuccucuucuugcccccccug

SEQ ID NO: 911264 - RNA, 23 nt, Human
aaaggagcaggugggugacagau

SEQ ID NO: 911265 - RNA, 23 nt, Human
aaccuagcccccaccccgcuaca

SEQ ID NO: 911266 - RNA, 19 nt, Human
aagggugggauuuaucugc

SEQ ID NO: 911267 - RNA, 21 nt, Human
acagagaacaccucucgccca

SEQ ID NO: 911268 - RNA, 18 nt, Human
acagcucaaggaagggug

SEQ ID NO: 911269 - RNA, 21 nt, Human
agcaacaugcccccccggcac

SEQ ID NO: 911270 - RNA, 22 nt, Human
agcaacaugcccccccggcacg

SEQ ID NO: 911271 - RNA, 20 nt, Human
agcaggugggugacagaugg

SEQ ID NO: 911272 - RNA, 19 nt, Human
aggcucaaggcucaagcag

SEQ ID NO: 911273 - RNA, 23 nt, Human
agggggaagcuccugaggcucag

SEQ ID NO: 911274 - RNA, 19 nt, Human
agggggagggggaagcucc

SEQ ID NO: 911275 - RNA, 23 nt, Human
caacagcugcaacuccuuucagc

SEQ ID NO: 911276 - RNA, 21 nt, Human
caacaugcccccccggcacgg

SEQ ID NO: 911277 - RNA, 18 nt, Human
caagacggggagaaggag

SEQ ID NO: 911278 - RNA, 18 nt, Human
cacagcacagagaacacc

SEQ ID NO: 911279 - RNA, 22 nt, Human
caccccgcuacagcuccccacu

SEQ ID NO: 911280 - RNA, 19 nt, Human
caccucucgcccaacaacu

SEQ ID NO: 911281 - RNA, 18 nt, Human
cagagcaccaaggggaag

SEQ ID NO: 911282 - RNA, 24 nt, Human
cagagcugaggcccaggagcagcu

SEQ ID NO: 911283 - RNA, 20 nt, Human
cagcaacaugcccccccggc

SEQ ID NO: 911284 - RNA, 20 nt, Human
cagcacagagaacaccucuc

SEQ ID NO: 911285 - RNA, 19 nt, Human
cauggagguauaccaaguc

SEQ ID NO: 911286 - RNA, 19 nt, Human
cccaagacggggagaagga

SEQ ID NO: 911287 - RNA, 22 nt, Human
ccccaacgagauaaacacagcc

SEQ ID NO: 911288 - RNA, 20 nt, Human
ccccaagacggggagaagga

SEQ ID NO: 911289 - RNA, 20 nt, Human
ccccaccccgcuacagcucc

SEQ ID NO: 911290 - RNA, 22 nt, Human
ccccaccccgcuacagcucccc

SEQ ID NO: 911291 - RNA, 19 nt, Human
ccccauucccuucccuucc

SEQ ID NO: 911292 - RNA, 23 nt, Human
ccccauucccuucccuucccagc

SEQ ID NO: 911293 - RNA, 24 nt, Human
cccccccggcacggccugcugccu

SEQ ID NO: 911294 - RNA, 23 nt, Human
ccccgcuacagcuccccacugaa

SEQ ID NO: 911295 - RNA, 18 nt, Human
cccugggcagagcugagg

SEQ ID NO: 911296 - RNA, 18 nt, Human
ccggggcggggccgcggg

SEQ ID NO: 911297 - RNA, 23 nt, Human
ccuagcccccaccccgcuacagc

SEQ ID NO: 911298 - RNA, 20 nt, Human
cugcugguccccaccucccc

SEQ ID NO: 911299 - RNA, 21 nt, Human
cuugcuucucccuucucccca

SEQ ID NO: 911300 - RNA, 19 nt, Human
gacagaugggcaggggcag

SEQ ID NO: 911301 - RNA, 21 nt, Human
gagcaggugggugacagaugg

SEQ ID NO: 911302 - RNA, 18 nt, Human
gcaggcucaggaggggag

SEQ ID NO: 911303 - RNA, 21 nt, Human
gcucaaggcucaagcagaggg

SEQ ID NO: 911304 - RNA, 18 nt, Human
ggagcagcugaaaggagg

SEQ ID NO: 911305 - RNA, 18 nt, Human
ggcucagacacugcuugc

SEQ ID NO: 911306 - RNA, 18 nt, Human
ggcuggcccugggcagag

SEQ ID NO: 911307 - RNA, 21 nt, Human
gggaagcuccugaggcucaga

SEQ ID NO: 911308 - RNA, 19 nt, Human
gggcagagcugaggcccag

SEQ ID NO: 911309 - RNA, 20 nt, Human
gggcagugaagaugacagca

SEQ ID NO: 911310 - RNA, 26 nt, Human
gggcagugaagaugacagcaggcuca

SEQ ID NO: 911311 - RNA, 24 nt, Human
ggguccucgagcugccugcagccu

SEQ ID NO: 911312 - RNA, 23 nt, Human
ggugggugacagaugggcagggg

SEQ ID NO: 911313 - RNA, 23 nt, Human
uagaacccguugcgcgccaaccg

SEQ ID NO: 911314 - RNA, 21 nt, Human
ucaaggaagggugggauuuau

SEQ ID NO: 911315 - RNA, 21 nt, Human
ucaggaggggagguggcagaa

SEQ ID NO: 911316 - RNA, 19 nt, Human
ucccagucaaggcucaagg

SEQ ID NO: 911317 - RNA, 24 nt, Human
uccccauucccuucccuucccagc

SEQ ID NO: 911318 - RNA, 19 nt, Human
ucccuucccuucccagcag

SEQ ID NO: 911319 - RNA, 20 nt, Human
uccugaggcucagacacugc

SEQ ID NO: 911320 - RNA, 21 nt, Human
ucugcuaucugccaggccgag

SEQ ID NO: 911321 - RNA, 20 nt, Human
ucugcugguccccaccuccc

SEQ ID NO: 911322 - RNA, 20 nt, Human
ugaaaggagguggaugggga

SEQ ID NO: 911323 - RNA, 18 nt, Human
ugcccccccggcacggcc

SEQ ID NO: 911324 - RNA, 23 nt, Human
ugcugguccccaccuccccaaga

SEQ ID NO: 911325 - RNA, 26 nt, Human
ugcuugcuucucccuucuccccauuc

SEQ ID NO: 911326 - RNA, 20 nt, Human
uucccagcagaaccuggcug

SEQ ID NO: 911327 - RNA, 22 nt, Human
aacuaccgggaaacuagugacc

SEQ ID NO: 911328 - RNA, 24 nt, Human
augugcagcugaacuaccgggaaa

SEQ ID NO: 911329 - RNA, 24 nt, Human
caaaacuuuuuauucaucagagcu

SEQ ID NO: 911330 - RNA, 20 nt, Human
cagcugaacuaccgggaaac

SEQ ID NO: 911331 - RNA, 22 nt, Human
caguacuggaaaucagagguaa

SEQ ID NO: 911332 - RNA, 21 nt, Human
ccaagccaaguacgccaccug

SEQ ID NO: 911333 - RNA, 25 nt, Human
cuagcacuacaaaaggcacaaugaa

SEQ ID NO: 911334 - RNA, 21 nt, Human
gggaaacuagugaccugcaga

SEQ ID NO: 911335 - RNA, 18 nt, Human
gugcagcugaacuaccgg

SEQ ID NO: 911336 - RNA, 25 nt, Human
ucagagguaacagcacauccuuccu

SEQ ID NO: 911337 - RNA, 26 nt, Human
ucagagguaacagcacauccuuccuu

SEQ ID NO: 911338 - RNA, 23 nt, Human
ugcuuuacucugcuguagugguc

SEQ ID NO: 911339 - RNA, 21 nt, Human
aacugcucauggccaucagga

SEQ ID NO: 911340 - RNA, 18 nt, Human
aacuucuauccucuccuc

SEQ ID NO: 911341 - RNA, 25 nt, Human
aagagauguccacauacuucucuca

SEQ ID NO: 911342 - RNA, 22 nt, Human
aaguauuggcagggagagguga

SEQ ID NO: 911343 - RNA, 19 nt, Human
acacaaggauuuaugggug

SEQ ID NO: 911344 - RNA, 21 nt, Human
acucuaagaagccaggaaagg

SEQ ID NO: 911345 - RNA, 24 nt, Human
acucuccacccucuuuuggaacag

SEQ ID NO: 911346 - RNA, 19 nt, Human
acuucuauccucuccucca

SEQ ID NO: 911347 - RNA, 18 nt, Human
agacugaagccgagcaga

SEQ ID NO: 911348 - RNA, 20 nt, Human
agagggacaggaaaagaaga

SEQ ID NO: 911349 - RNA, 22 nt, Human
agcugcagagggcagaagccug

SEQ ID NO: 911350 - RNA, 19 nt, Human
agggacaggaaaagaagag

SEQ ID NO: 911351 - RNA, 22 nt, Human
agggagcagauuugucugagca

SEQ ID NO: 911352 - RNA, 18 nt, Human
aggucccuggugcacucc

SEQ ID NO: 911353 - RNA, 19 nt, Human
aucaggcuccuaucugugu

SEQ ID NO: 911354 - RNA, 22 nt, Human
auuugguggcuaugaugcagga

SEQ ID NO: 911355 - RNA, 19 nt, Human
caaggauuuaugggugugg

SEQ ID NO: 911356 - RNA, 18 nt, Human
caggaaaggucccuggug

SEQ ID NO: 911357 - RNA, 22 nt, Human
ccaagccacuggucccauagac

SEQ ID NO: 911358 - RNA, 18 nt, Human
ccacuggucccauagaca

SEQ ID NO: 911359 - RNA, 20 nt, Human
ccagccccaggcagcuagaa

SEQ ID NO: 911360 - RNA, 18 nt, Human
cccucuuuuggaacagug

SEQ ID NO: 911361 - RNA, 22 nt, Human
ccuggccaaagaugcccaggga

SEQ ID NO: 911362 - RNA, 20 nt, Human
ccuggugcacuccacucucc

SEQ ID NO: 911363 - RNA, 21 nt, Human
cgguaacaggccgaugaacac

SEQ ID NO: 911364 - RNA, 24 nt, Human
cucucaugcuuggucagauuccac

SEQ ID NO: 911365 - RNA, 22 nt, Human
cugaagccgagcagagcauggc

SEQ ID NO: 911366 - RNA, 18 nt, Human
cuguguggccucagcccc

SEQ ID NO: 911367 - RNA, 19 nt, Human
gaaaagaagagauguccac

SEQ ID NO: 911368 - RNA, 20 nt, Human
gaaaagaagagauguccaca

SEQ ID NO: 911369 - RNA, 19 nt, Human
gccagccccaggcagcuag

SEQ ID NO: 911370 - RNA, 21 nt, Human
ggagaaaaugggcucguuuga

SEQ ID NO: 911371 - RNA, 18 nt, Human
gggaacacagguacuaac

SEQ ID NO: 911372 - RNA, 18 nt, Human
ucaccacuggcaucaggg

SEQ ID NO: 911373 - RNA, 23 nt, Human
ucccagcugcagagggcagaagc

SEQ ID NO: 911374 - RNA, 19 nt, Human
ucccauagacagaucucuc

SEQ ID NO: 911375 - RNA, 21 nt, Human
ucccauagacagaucucucuc

SEQ ID NO: 911376 - RNA, 24 nt, Human
ucccuggugcacuccacucuccac

SEQ ID NO: 911377 - RNA, 23 nt, Human
uccuccaucaggcuccuaucugu

SEQ ID NO: 911378 - RNA, 18 nt, Human
ucugagcagggccagccc

SEQ ID NO: 911379 - RNA, 25 nt, Human
ugaaaaaaaaugcaaauuaaaaaaa

SEQ ID NO: 911380 - RNA, 21 nt, Human
uggugcacuccacucuccaca

SEQ ID NO: 911381 - RNA, 22 nt, Human
uggugcacuccacucuccacag

SEQ ID NO: 911382 - RNA, 22 nt, Human
uucacuggacuuuuggccccaa

SEQ ID NO: 911383 - RNA, 20 nt, Human
uuggccccaaaugaaaaaaa

SEQ ID NO: 911384 - RNA, 21 nt, Human
uuuuuuuuuuuuggaguuuca

SEQ ID NO: 911385 - RNA, 23 nt, Human
uuuuuuuuuuuuuuuuuggaguu

SEQ ID NO: 911386 - RNA, 28 nt, Human
uuuuuuuuuuuuuuuuuuuuuuuggggg

SEQ ID NO: 911387 - RNA, 24 nt, Human
aaagccuagucaccacuucaaaac

SEQ ID NO: 911388 - RNA, 20 nt, Human
aaauguauggaggaugaauu

SEQ ID NO: 911389 - RNA, 20 nt, Human
aacaacuugaauucaaaugu

SEQ ID NO: 911390 - RNA, 20 nt, Human
aacuuucucccacugggguu

SEQ ID NO: 911391 - RNA, 18 nt, Human
aaggaaaaaaaaaaguug

SEQ ID NO: 911392 - RNA, 20 nt, Human
acaacuggaucaauucagaa

SEQ ID NO: 911393 - RNA, 22 nt, Human
accaauucaauaccauucuaca

SEQ ID NO: 911394 - RNA, 20 nt, Human
accccacccacuuaaaauua

SEQ ID NO: 911395 - RNA, 18 nt, Human
agaaccauggaaauggag

SEQ ID NO: 911396 - RNA, 19 nt, Human
agaauuccagacugcacca

SEQ ID NO: 911397 - RNA, 20 nt, Human
agaggguaccgaaaccgcag

SEQ ID NO: 911398 - RNA, 22 nt, Human
agagugaagagaauacagcaau

SEQ ID NO: 911399 - RNA, 22 nt, Human
agaucauuuauuggcaaauacu

SEQ ID NO: 911400 - RNA, 24 nt, Human
agccaauuaagaacacucaugaaa

SEQ ID NO: 911401 - RNA, 22 nt, Human
aggagggguaggggcaaugggg

SEQ ID NO: 911402 - RNA, 23 nt, Human
aggcauaggagugugaaucuggg

SEQ ID NO: 911403 - RNA, 21 nt, Human
aggcggcggcggugguggugg

SEQ ID NO: 911404 - RNA, 20 nt, Human
aggcggcggcuguggcggcg

SEQ ID NO: 911405 - RNA, 21 nt, Human
aggcggcggcuguggcggcgg

SEQ ID NO: 911406 - RNA, 22 nt, Human
aggcggcggcuguggcggcggg

SEQ ID NO: 911407 - RNA, 23 nt, Human
aggcggcggcuguggcggcgggu

SEQ ID NO: 911408 - RNA, 19 nt, Human
agggggaggaggaggaggg

SEQ ID NO: 911409 - RNA, 23 nt, Human
agggggaggaggaggaggugggc

SEQ ID NO: 911410 - RNA, 18 nt, Human
agguggucacauuucaug

SEQ ID NO: 911411 - RNA, 22 nt, Human
aguggcgguuguggugcuggug

SEQ ID NO: 911412 - RNA, 19 nt, Human
aucagacuaauucuccuuu

SEQ ID NO: 911413 - RNA, 24 nt, Human
auccuuuuauaugauuuuuaaagg

SEQ ID NO: 911414 - RNA, 22 nt, Human
augaugcugaugaaaagugaaa

SEQ ID NO: 911415 - RNA, 22 nt, Human
augccagggcuacagacaacgg

SEQ ID NO: 911416 - RNA, 23 nt, Human
auuuaucagaggucacucauccu

SEQ ID NO: 911417 - RNA, 23 nt, Human
caaaauggagucucagcaaccag

SEQ ID NO: 911418 - RNA, 19 nt, Human
caaauacucuguugcucuc

SEQ ID NO: 911419 - RNA, 22 nt, Human
caacuggaucaauucagaaguc

SEQ ID NO: 911420 - RNA, 23 nt, Human
caaggguuuuuccugcuccuggg

SEQ ID NO: 911421 - RNA, 30 nt, Human
caauggcaguagcaaagaauuaaacagaag

SEQ ID NO: 911422 - RNA, 19 nt, Human
cacagcauuguaagaaguu

SEQ ID NO: 911423 - RNA, 21 nt, Human
caccacuucaaaacacacuaa

SEQ ID NO: 911424 - RNA, 18 nt, Human
caccauauagauguggcc

SEQ ID NO: 911425 - RNA, 18 nt, Human
cacccccucuucaccugg

SEQ ID NO: 911426 - RNA, 23 nt, Human
cacccugcagcuugaagaucaau

SEQ ID NO: 911427 - RNA, 25 nt, Human
cacgcacucuuauggccggugugcu

SEQ ID NO: 911428 - RNA, 20 nt, Human
cacugguugguaaacucugu

SEQ ID NO: 911429 - RNA, 21 nt, Human
cagcagcauauuuucccuaau

SEQ ID NO: 911430 - RNA, 22 nt, Human
caugcaagaguccaucugagag

SEQ ID NO: 911431 - RNA, 19 nt, Human
cauggcucggacgaacagg

SEQ ID NO: 911432 - RNA, 22 nt, Human
ccaauucaauaccauucuacaa

SEQ ID NO: 911433 - RNA, 18 nt, Human
ccggugugcuuggaguug

SEQ ID NO: 911434 - RNA, 18 nt, Human
ccucaaaggugauugaga

SEQ ID NO: 911435 - RNA, 18 nt, Human
ccugcagcuugaagauca

SEQ ID NO: 911436 - RNA, 22 nt, Human
cuaaauaaccccacccacuuaa

SEQ ID NO: 911437 - RNA, 18 nt, Human
cuccucucuccacacauc

SEQ ID NO: 911438 - RNA, 21 nt, Human
cucuguauccaucuacuggau

SEQ ID NO: 911439 - RNA, 18 nt, Human
cugggaauacugugugcu

SEQ ID NO: 911440 - RNA, 20 nt, Human
cuggguaggucggguacgcg

SEQ ID NO: 911441 - RNA, 29 nt, Human
cuuaacaugcaagaguccaucugagagag

SEQ ID NO: 911442 - RNA, 26 nt, Human
cuuugaacuuucucccacugggguuu

SEQ ID NO: 911443 - RNA, 18 nt, Human
gaaagccuagucaccacu

SEQ ID NO: 911444 - RNA, 19 nt, Human
gaacaggaugaauuauuau

SEQ ID NO: 911445 - RNA, 21 nt, Human
gaacagggugugucugcccgg

SEQ ID NO: 911446 - RNA, 22 nt, Human
gaagacaacucuuguguugucc

SEQ ID NO: 911447 - RNA, 20 nt, Human
gaagccuuuccacacugcac

SEQ ID NO: 911448 - RNA, 21 nt, Human
gacagggaagaauggagacug

SEQ ID NO: 911449 - RNA, 24 nt, Human
gagauauacaccauguuguuuucu

SEQ ID NO: 911450 - RNA, 20 nt, Human
gagggcagagauccugaagg

SEQ ID NO: 911451 - RNA, 22 nt, Human
gauauacaccauguuguuuucu

SEQ ID NO: 911452 - RNA, 27 nt, Human
gauggaggcggcggcgguggugguggu

SEQ ID NO: 911453 - RNA, 24 nt, Human
gcaagaaaagucauguccuccucc

SEQ ID NO: 911454 - RNA, 23 nt, Human
gcacaugccagggcuacagacaa

SEQ ID NO: 911455 - RNA, 18 nt, Human
gcagcagggucaauggca

SEQ ID NO: 911456 - RNA, 20 nt, Human
ggaauaaauuuugagggcag

SEQ ID NO: 911457 - RNA, 22 nt, Human
ggacacacgcacucuuauggcc

SEQ ID NO: 911458 - RNA, 20 nt, Human
ggacaucagaggugucacug

SEQ ID NO: 911459 - RNA, 23 nt, Human
ggaggcggcggcggugguggugg

SEQ ID NO: 911460 - RNA, 21 nt, Human
ggagggggaggaggaggaggu

SEQ ID NO: 911461 - RNA, 24 nt, Human
ggagggggaggaggaggagguggg

SEQ ID NO: 911462 - RNA, 22 nt, Human
ggagggguaggggcaauggggu

SEQ ID NO: 911463 - RNA, 21 nt, Human
ggaggugggcagucgggaccc

SEQ ID NO: 911464 - RNA, 18 nt, Human
ggcggcgguggugguggu

SEQ ID NO: 911465 - RNA, 21 nt, Human
ggcuggcgguaccagugugga

SEQ ID NO: 911466 - RNA, 22 nt, Human
gggacugaagaugaaaugccca

SEQ ID NO: 911467 - RNA, 19 nt, Human
gggcaaugggguucagugg

SEQ ID NO: 911468 - RNA, 23 nt, Human
ggggacugaagaugaaaugccca

SEQ ID NO: 911469 - RNA, 26 nt, Human
ggggcaaugggguucagugguaggag

SEQ ID NO: 911470 - RNA, 18 nt, Human
gggggagggggaggagga

SEQ ID NO: 911471 - RNA, 23 nt, Human
guggaggcggcggcuguggcggc

SEQ ID NO: 911472 - RNA, 24 nt, Human
guggugguggaggcggcggcugug

SEQ ID NO: 911473 - RNA, 20 nt, Human
gugguggugguggaggcggc

SEQ ID NO: 911474 - RNA, 18 nt, Human
guguggcagcaaaaugga

SEQ ID NO: 911475 - RNA, 19 nt, Human
guuguccguugcuuugagu

SEQ ID NO: 911476 - RNA, 22 nt, Human
uaaaacaacaaagaacuuucag

SEQ ID NO: 911477 - RNA, 25 nt, Human
uaaaacaacaaagaacuuucagucu

SEQ ID NO: 911478 - RNA, 27 nt, Human
uaaccaaacuucaaaaccucguagacg

SEQ ID NO: 911479 - RNA, 20 nt, Human
uaauucuccuuuuuuccacu

SEQ ID NO: 911480 - RNA, 21 nt, Human
uagauggugauggagguuuug

SEQ ID NO: 911481 - RNA, 24 nt, Human
uagcaguaauuuaucagaggucac

SEQ ID NO: 911482 - RNA, 22 nt, Human
uaguaauaccucacugguuggu

SEQ ID NO: 911483 - RNA, 26 nt, Human
ucaaaacacacuaaaaauuauacuaa

SEQ ID NO: 911484 - RNA, 23 nt, Human
ucaccacuucaaaacacacuaaa

SEQ ID NO: 911485 - RNA, 24 nt, Human
ucaguguacguugccaggugugcu

SEQ ID NO: 911486 - RNA, 20 nt, Human
ucauguccuccuccuccucg

SEQ ID NO: 911487 - RNA, 21 nt, Human
ucauguccuccuccuccucgu

SEQ ID NO: 911488 - RNA, 19 nt, Human
uccagacugcaccauauag

SEQ ID NO: 911489 - RNA, 24 nt, Human
ucuaaaacacaugagugauugaca

SEQ ID NO: 911490 - RNA, 21 nt, Human
ucuaacuucuuuagauaucaa

SEQ ID NO: 911491 - RNA, 20 nt, Human
ucugaugugagaugucugug

SEQ ID NO: 911492 - RNA, 23 nt, Human
ucuuccaaaacgucagcuggugc

SEQ ID NO: 911493 - RNA, 18 nt, Human
ugaaaucuuuaaggauag

SEQ ID NO: 911494 - RNA, 22 nt, Human
ugaaaugcccagaugcauaugg

SEQ ID NO: 911495 - RNA, 19 nt, Human
ugaauucaaauguauggag

SEQ ID NO: 911496 - RNA, 20 nt, Human
ugacaaaaaacaacuugaau

SEQ ID NO: 911497 - RNA, 19 nt, Human
ugacagcaccucucgguga

SEQ ID NO: 911498 - RNA, 21 nt, Human
ugagugaaaggaaacuuaacc

SEQ ID NO: 911499 - RNA, 20 nt, Human
ugaucagacuaauucuccuu

SEQ ID NO: 911500 - RNA, 24 nt, Human
ugauuccauugaaggaaaaaaaaa

SEQ ID NO: 911501 - RNA, 21 nt, Human
ugcaaguguggagaugaggca

SEQ ID NO: 911502 - RNA, 24 nt, Human
ugccaaaaaguuaaucacaagcuu

SEQ ID NO: 911503 - RNA, 19 nt, Human
ugcuuugaguccuuugagu

SEQ ID NO: 911504 - RNA, 19 nt, Human
uggaaaaaugagagaucau

SEQ ID NO: 911505 - RNA, 18 nt, Human
uggaggcggcggcggugg

SEQ ID NO: 911506 - RNA, 21 nt, Human
uggaggcggcggcgguggugg

SEQ ID NO: 911507 - RNA, 23 nt, Human
uggaggcggcggcggugguggug

SEQ ID NO: 911508 - RNA, 18 nt, Human
uggaucaauucagaaguc

SEQ ID NO: 911509 - RNA, 19 nt, Human
uggaucagggacuuucuga

SEQ ID NO: 911510 - RNA, 23 nt, Human
uggcagguaaaacccagacuucc

SEQ ID NO: 911511 - RNA, 22 nt, Human
uggcuuccuuaauaaggccuca

SEQ ID NO: 911512 - RNA, 21 nt, Human
ugggagaaccagucgaguugc

SEQ ID NO: 911513 - RNA, 21 nt, Human
ugggagcgauggugguauugg

SEQ ID NO: 911514 - RNA, 26 nt, Human
ugggguucagugguaggaggagggcu

SEQ ID NO: 911515 - RNA, 19 nt, Human
uggugguggaggcggcggc

SEQ ID NO: 911516 - RNA, 18 nt, Human
ugguggugguggaggcgg

SEQ ID NO: 911517 - RNA, 22 nt, Human
ugguggugguggaggcggcggc

SEQ ID NO: 911518 - RNA, 21 nt, Human
uguguguggcagcaaaaugga

SEQ ID NO: 911519 - RNA, 24 nt, Human
uuagcaaauagagagaaauauaga

SEQ ID NO: 911520 - RNA, 21 nt, Human
uuaucacuuuuauaacuucca

SEQ ID NO: 911521 - RNA, 22 nt, Human
uucaaauguauggaggaugaau

SEQ ID NO: 911522 - RNA, 20 nt, Human
uuccaagugaucaucacagg

SEQ ID NO: 911523 - RNA, 24 nt, Human
uucgugaucaaugaaguugccaga

SEQ ID NO: 911524 - RNA, 22 nt, Human
uugagggcagagauccugaagg

SEQ ID NO: 911525 - RNA, 20 nt, Human
uugcucccuuucuaacuucu

SEQ ID NO: 911526 - RNA, 19 nt, Human
uuggguaugggauuuugga

SEQ ID NO: 911527 - RNA, 25 nt, Human
uuuaaggauagcaauuauaggguaa

SEQ ID NO: 911528 - RNA, 20 nt, Human
uuuguggaagccaucauggc

SEQ ID NO: 911529 - RNA, 25 nt, Human
uuuguuggaaaaugccaaaaaaaau

SEQ ID NO: 911530 - RNA, 19 nt, Human
aaaaaaccaaaccacaaaa

SEQ ID NO: 911531 - RNA, 25 nt, Human
aaaaaagagacaccaaugugucuaa

SEQ ID NO: 911532 - RNA, 18 nt, Human
aaaaggaaaggaaaaaag

SEQ ID NO: 911533 - RNA, 23 nt, Human
aaaaggccauggagagagaauuu

SEQ ID NO: 911534 - RNA, 18 nt, Human
aaacagcaaaacuaagua

SEQ ID NO: 911535 - RNA, 22 nt, Human
aaaugaaagucaaacugacagg

SEQ ID NO: 911536 - RNA, 21 nt, Human
aaaugacccugaccagauuuu

SEQ ID NO: 911537 - RNA, 25 nt, Human
aacaaaaaaaaccaaaccacaaaaa

SEQ ID NO: 911538 - RNA, 18 nt, Human
aacuaaaauugaaaagcc

SEQ ID NO: 911539 - RNA, 23 nt, Human
aagacugguaaaacugcaaauaa

SEQ ID NO: 911540 - RNA, 19 nt, Human
aagcgacuccaaaaggcca

SEQ ID NO: 911541 - RNA, 26 nt, Human
aauuugaagucacagaaaauauuuua

SEQ ID NO: 911542 - RNA, 22 nt, Human
acaaaaaaaaccaaaccacaaa

SEQ ID NO: 911543 - RNA, 23 nt, Human
acaaaaaacaaaaaaaaccaaac

SEQ ID NO: 911544 - RNA, 20 nt, Human
acaaaaacagcaaaacuaau

SEQ ID NO: 911545 - RNA, 22 nt, Human
acaaaacuuuucaccccaaauc

SEQ ID NO: 911546 - RNA, 19 nt, Human
acaagaauccauuuuggac

SEQ ID NO: 911547 - RNA, 20 nt, Human
accaaaccacaaaaacagca

SEQ ID NO: 911548 - RNA, 24 nt, Human
acuccaaaaggccauggagagaga

SEQ ID NO: 911549 - RNA, 22 nt, Human
acugcacuccaauucuccaaug

SEQ ID NO: 911550 - RNA, 24 nt, Human
agacaccaaugugucuaacuguuc

SEQ ID NO: 911551 - RNA, 19 nt, Human
aggaagaauaagagauucu

SEQ ID NO: 911552 - RNA, 20 nt, Human
aggaaggaaaaggaaucuug

SEQ ID NO: 911553 - RNA, 19 nt, Human
aggaauaggaagaauaaga

SEQ ID NO: 911554 - RNA, 18 nt, Human
aggcaucuagcacucuag

SEQ ID NO: 911555 - RNA, 21 nt, Human
augaagacugguaaaacugca

SEQ ID NO: 911556 - RNA, 24 nt, Human
augccgucgccgccgccgccgucu

SEQ ID NO: 911557 - RNA, 20 nt, Human
auggaguaaaccacaccgcc

SEQ ID NO: 911558 - RNA, 18 nt, Human
auuugaagucacagaaaa

SEQ ID NO: 911559 - RNA, 25 nt, Human
caaaaaaaaccaaaccacaaaaaca

SEQ ID NO: 911560 - RNA, 25 nt, Human
caaaaacagcaaaacuaaguaaaau

SEQ ID NO: 911561 - RNA, 25 nt, Human
caaaacaaaaaacaaaaaaaaccaa

SEQ ID NO: 911562 - RNA, 19 nt, Human
caaaaggaaaggaaaaaag

SEQ ID NO: 911563 - RNA, 25 nt, Human
caaaccacaaaaacagcaaaacuaa

SEQ ID NO: 911564 - RNA, 20 nt, Human
cacaaaaacagcaaaacuaa

SEQ ID NO: 911565 - RNA, 18 nt, Human
cacuuuauuagggaugac

SEQ ID NO: 911566 - RNA, 20 nt, Human
caguugaaaugaaacuaccg

SEQ ID NO: 911567 - RNA, 21 nt, Human
caugaagacugguaaaacugc

SEQ ID NO: 911568 - RNA, 19 nt, Human
ccaaaucuguuccuccuuu

SEQ ID NO: 911569 - RNA, 18 nt, Human
ccacaaaaacagcaaaac

SEQ ID NO: 911570 - RNA, 22 nt, Human
cccaaaucuguuccuccuuuuu

SEQ ID NO: 911571 - RNA, 18 nt, Human
cccaccuuuucuuggaaa

SEQ ID NO: 911572 - RNA, 18 nt, Human
ccgucgccgccgccgccg

SEQ ID NO: 911573 - RNA, 21 nt, Human
ccuccuuuuucuugccacucc

SEQ ID NO: 911574 - RNA, 22 nt, Human
ccucuuguggaaaaaagaaaau

SEQ ID NO: 911575 - RNA, 19 nt, Human
cugacaggggaaaaaggca

SEQ ID NO: 911576 - RNA, 23 nt, Human
cuugagaaauuuguuuggaggcu

SEQ ID NO: 911577 - RNA, 25 nt, Human
gaaacaucaaaaguauggauaagcc

SEQ ID NO: 911578 - RNA, 19 nt, Human
gauagaaggaaggaaaagg

SEQ ID NO: 911579 - RNA, 19 nt, Human
gccgucgccgccgccgccg

SEQ ID NO: 911580 - RNA, 19 nt, Human
gccgucgccgccgccgccg

SEQ ID NO: 911581 - RNA, 19 nt, Human
gccgucgccgccgccgccg

SEQ ID NO: 911582 - RNA, 21 nt, Human
ggauagaaggaaggaaaagga

SEQ ID NO: 911583 - RNA, 21 nt, Human
ggcagaaaauggauagaagga

SEQ ID NO: 911584 - RNA, 24 nt, Human
ggcagaaaauggauagaagggacc

SEQ ID NO: 911585 - RNA, 20 nt, Human
gggaaaaaggcaucuagcac

SEQ ID NO: 911586 - RNA, 19 nt, Human
guaauaaauucuguaauuu

SEQ ID NO: 911587 - RNA, 25 nt, Human
uacagcaagcgacuccaaaaggcca

SEQ ID NO: 911588 - RNA, 22 nt, Human
uaccugugaaaauaaaaaucca

SEQ ID NO: 911589 - RNA, 19 nt, Human
uagcagacacuuuauuagg

SEQ ID NO: 911590 - RNA, 22 nt, Human
uagcagacacuuuauuagggau

SEQ ID NO: 911591 - RNA, 24 nt, Human
uauauucauuuccacaccuuuuua

SEQ ID NO: 911592 - RNA, 25 nt, Human
uaugggcagaaaauggauagaagga

SEQ ID NO: 911593 - RNA, 22 nt, Human
uauuagggaugaccaaaacaaa

SEQ ID NO: 911594 - RNA, 23 nt, Human
ucuaauauauaaaugacccugac

SEQ ID NO: 911595 - RNA, 19 nt, Human
ucuacacaguuucgucacu

SEQ ID NO: 911596 - RNA, 19 nt, Human
ucucuuuugucaucaaagg

SEQ ID NO: 911597 - RNA, 19 nt, Human
ucuguaauuuauucuacca

SEQ ID NO: 911598 - RNA, 23 nt, Human
ugaagaggagacaagaauccauu

SEQ ID NO: 911599 - RNA, 19 nt, Human
ugaccaaaacaaaaaacaa

SEQ ID NO: 911600 - RNA, 25 nt, Human
ugaccaaaacaaaaaacaaaaaaaa

SEQ ID NO: 911601 - RNA, 30 nt, Human
ugaccaaaacaaaaaacaaaaaaaaccaag

SEQ ID NO: 911602 - RNA, 18 nt, Human
ugacugcacuccaauucu

SEQ ID NO: 911603 - RNA, 18 nt, Human
uggaaaacugacaugugu

SEQ ID NO: 911604 - RNA, 23 nt, Human
uggaccauaaaugugagaaauuc

SEQ ID NO: 911605 - RNA, 18 nt, Human
ugugaaaauaaaaaucca

SEQ ID NO: 911606 - RNA, 21 nt, Human
uguggaaaaaagaaaauuuuu

SEQ ID NO: 911607 - RNA, 22 nt, Human
uguggaaaaaagaaaauuuuua

SEQ ID NO: 911608 - RNA, 20 nt, Human
uuaaaugaaagucaaacuga

SEQ ID NO: 911609 - RNA, 18 nt, Human
uuaacauuuacaguuugu

SEQ ID NO: 911610 - RNA, 21 nt, Human
uucaacuaaaauugaaaagcc

SEQ ID NO: 911611 - RNA, 23 nt, Human
uugaaaugaaacuaccgauucaa

SEQ ID NO: 911612 - RNA, 25 nt, Human
uugaauaaacaaguuauuuuaaaua

SEQ ID NO: 911613 - RNA, 22 nt, Human
uugagaaauuuguuuggaggcu

SEQ ID NO: 911614 - RNA, 22 nt, Human
uuuaugaaaaaaaggggaaauu

SEQ ID NO: 911615 - RNA, 22 nt, Human
uuuguaaauaugacuucacuau

SEQ ID NO: 911616 - RNA, 18 nt, Human
uuuuuuuuuuuuuuuucg

SEQ ID NO: 911617 - RNA, 19 nt, Human
uuuuuuuuuuuuuuuucgu

SEQ ID NO: 911618 - RNA, 19 nt, Human
aaaaaaaaaaaaaaaaaga

SEQ ID NO: 911619 - RNA, 19 nt, Human
aaaaaaaaaaaaaagaaaa

SEQ ID NO: 911620 - RNA, 24 nt, Human
aaaaaaagaaaaaauauccuggaa

SEQ ID NO: 911621 - RNA, 20 nt, Human
aaaaacacuaaaaggaaggc

SEQ ID NO: 911622 - RNA, 22 nt, Human
aaaaacacuaaaaggaaggccg

SEQ ID NO: 911623 - RNA, 25 nt, Human
aaaaagauuugauguagugcaacug

SEQ ID NO: 911624 - RNA, 18 nt, Human
aaaaauugagagaauuug

SEQ ID NO: 911625 - RNA, 22 nt, Human
aaaacaaaaacaaugcaaaaga

SEQ ID NO: 911626 - RNA, 25 nt, Human
aaaacaaaaacagaaacaaaaacaa

SEQ ID NO: 911627 - RNA, 20 nt, Human
aaaacaaaaugaaacaaaaa

SEQ ID NO: 911628 - RNA, 28 nt, Human
aaaacaaaaugaaacaaaaaacagagcc

SEQ ID NO: 911629 - RNA, 20 nt, Human
aaaagaaaauucagaacagu

SEQ ID NO: 911630 - RNA, 20 nt, Human
aaaagcagcuaugauaaaac

SEQ ID NO: 911631 - RNA, 20 nt, Human
aaaaugaaacaaaaaacaga

SEQ ID NO: 911632 - RNA, 21 nt, Human
aaaauggaagggaagucaaga

SEQ ID NO: 911633 - RNA, 26 nt, Human
aaacaaaaaacagagccuuauagacc

SEQ ID NO: 911634 - RNA, 22 nt, Human
aaacaaaaacaaaaacaaugca

SEQ ID NO: 911635 - RNA, 25 nt, Human
aaacaaaaacagaaacaaaaacaaa

SEQ ID NO: 911636 - RNA, 22 nt, Human
aaacaagaaagggacagccugg

SEQ ID NO: 911637 - RNA, 23 nt, Human
aaacaccucucgucacccuagau

SEQ ID NO: 911638 - RNA, 25 nt, Human
aaacagaaacaaaaacaaaaacaaa

SEQ ID NO: 911639 - RNA, 27 nt, Human
aaacagaaacaaaaacaaaaacaaugc

SEQ ID NO: 911640 - RNA, 20 nt, Human
aaacagaagguuuagauaau

SEQ ID NO: 911641 - RNA, 21 nt, Human
aaacagagccuuauagacccg

SEQ ID NO: 911642 - RNA, 24 nt, Human
aaacagagccuuauagacccgugc

SEQ ID NO: 911643 - RNA, 19 nt, Human
aaacauguauucaugcccu

SEQ ID NO: 911644 - RNA, 20 nt, Human
aaacccagaguuaaggcugg

SEQ ID NO: 911645 - RNA, 19 nt, Human
aaagaaggcagcaaccugg

SEQ ID NO: 911646 - RNA, 18 nt, Human
aaaggagcauauaaaaug

SEQ ID NO: 911647 - RNA, 27 nt, Human
aaauacacuaaaaacaccucucgucac

SEQ ID NO: 911648 - RNA, 22 nt, Human
aaaugccaacuggcacagacaa

SEQ ID NO: 911649 - RNA, 18 nt, Human
aacaccucucgucacccu

SEQ ID NO: 911650 - RNA, 23 nt, Human
aacagaaaaucauucauccuagc

SEQ ID NO: 911651 - RNA, 20 nt, Human
aacagagcaagacuccaucu

SEQ ID NO: 911652 - RNA, 24 nt, Human
aacaguuuugccccaccaccaccc

SEQ ID NO: 911653 - RNA, 19 nt, Human
aacauggugaaaccccauc

SEQ ID NO: 911654 - RNA, 20 nt, Human
aacauggugaaaccccaucu

SEQ ID NO: 911655 - RNA, 21 nt, Human
aacauggugaaaccccaucuc

SEQ ID NO: 911656 - RNA, 21 nt, Human
aacauggugaaaccccaucuc

SEQ ID NO: 911657 - RNA, 19 nt, Human
aacauggugaaaccccguc

SEQ ID NO: 911658 - RNA, 20 nt, Human
aacauggugaaaccccgucu

SEQ ID NO: 911659 - RNA, 21 nt, Human
aacauggugaaaccccgucuc

SEQ ID NO: 911660 - RNA, 23 nt, Human
aaccacuugaacccgggaggagg

SEQ ID NO: 911661 - RNA, 24 nt, Human
aaccugggcaacagagcaagacuc

SEQ ID NO: 911662 - RNA, 18 nt, Human
aagaucacuugaggucag

SEQ ID NO: 911663 - RNA, 24 nt, Human
aagaucacuugaggucaggaguuc

SEQ ID NO: 911664 - RNA, 18 nt, Human
aagcagcuaugauaaaac

SEQ ID NO: 911665 - RNA, 21 nt, Human
aagcagcuaugauaaaacuga

SEQ ID NO: 911666 - RNA, 18 nt, Human
aagcagugucaauaaaag

SEQ ID NO: 911667 - RNA, 25 nt, Human
aaggugggaagaucacuugagguca

SEQ ID NO: 911668 - RNA, 24 nt, Human
aaucgcuugaacccgggaggcaga

SEQ ID NO: 911669 - RNA, 20 nt, Human
aaucuguuuccucaucucug

SEQ ID NO: 911670 - RNA, 23 nt, Human
aaucuuuguucacuggucaggag

SEQ ID NO: 911671 - RNA, 18 nt, Human
aauuagccaggcauggug

SEQ ID NO: 911672 - RNA, 21 nt, Human
acaaaacaugagaagacugug

SEQ ID NO: 911673 - RNA, 24 nt, Human
acaaaacaugagaagacugugaaa

SEQ ID NO: 911674 - RNA, 21 nt, Human
acaacuuuucaaacuaaagga

SEQ ID NO: 911675 - RNA, 24 nt, Human
acagagcaagacuccaucucaaaa

SEQ ID NO: 911676 - RNA, 24 nt, Human
acagagcaagacuccauuucaaaa

SEQ ID NO: 911677 - RNA, 20 nt, Human
acagagugagacuccgucuc

SEQ ID NO: 911678 - RNA, 22 nt, Human
acagagugagacuccgucucaa

SEQ ID NO: 911679 - RNA, 24 nt, Human
acagagugagacuccgucucaaga

SEQ ID NO: 911680 - RNA, 24 nt, Human
accaauauauugcuauuucaccau

SEQ ID NO: 911681 - RNA, 21 nt, Human
accacaguuuauauccaaaaa

SEQ ID NO: 911682 - RNA, 19 nt, Human
accacugcacuccagccug

SEQ ID NO: 911683 - RNA, 24 nt, Human
accacugcacuccagccuggguga

SEQ ID NO: 911684 - RNA, 18 nt, Human
acccacaccaacgaaagc

SEQ ID NO: 911685 - RNA, 20 nt, Human
acccagaucgcaccacugca

SEQ ID NO: 911686 - RNA, 24 nt, Human
accccgucucuacuaaaaauacaa

SEQ ID NO: 911687 - RNA, 23 nt, Human
accugggcaacagagcaagacuc

SEQ ID NO: 911688 - RNA, 24 nt, Human
accuggucucuacuaaaaauacaa

SEQ ID NO: 911689 - RNA, 21 nt, Human
acgaagaacagcaauaauuaa

SEQ ID NO: 911690 - RNA, 24 nt, Human
acuccagccugggcgacagaguga

SEQ ID NO: 911691 - RNA, 18 nt, Human
acugcacuccaaccuggg

SEQ ID NO: 911692 - RNA, 24 nt, Human
acugcacuccaaccugggcaacag

SEQ ID NO: 911693 - RNA, 24 nt, Human
acugcacuccagccugggcgacag

SEQ ID NO: 911694 - RNA, 26 nt, Human
acugcacuccagccugggcgacagag

SEQ ID NO: 911695 - RNA, 24 nt, Human
acugcacuccagccugggugacag

SEQ ID NO: 911696 - RNA, 26 nt, Human
acugcacuccagccugggugacagag

SEQ ID NO: 911697 - RNA, 22 nt, Human
acuuccacccccacccagcaau

SEQ ID NO: 911698 - RNA, 24 nt, Human
acuugaggucaggaguucaagacc

SEQ ID NO: 911699 - RNA, 22 nt, Human
agaaaacaguuuugccccacca

SEQ ID NO: 911700 - RNA, 20 nt, Human
agaaaaucauucauccuagc

SEQ ID NO: 911701 - RNA, 26 nt, Human
agaaaaucauucauccuagcaagaac

SEQ ID NO: 911702 - RNA, 21 nt, Human
agaaccacuugaacccgggag

SEQ ID NO: 911703 - RNA, 24 nt, Human
agacagaagaaagaguaaagcuga

SEQ ID NO: 911704 - RNA, 26 nt, Human
agacagaagaaagaguaaaggggacc

SEQ ID NO: 911705 - RNA, 22 nt, Human
agacugugaaaaguggagagaa

SEQ ID NO: 911706 - RNA, 23 nt, Human
agacuuccacccccacccagcaa

SEQ ID NO: 911707 - RNA, 19 nt, Human
agagagccuuaaaauauga

SEQ ID NO: 911708 - RNA, 20 nt, Human
agagaggcucucucguccuu

SEQ ID NO: 911709 - RNA, 24 nt, Human
agagcuugcagugagccaaaauug

SEQ ID NO: 911710 - RNA, 18 nt, Human
agaggcugggagcagugg

SEQ ID NO: 911711 - RNA, 20 nt, Human
agagguugcagugaacccag

SEQ ID NO: 911712 - RNA, 24 nt, Human
agagguugcagugaacccagaucg

SEQ ID NO: 911713 - RNA, 23 nt, Human
agauaaucaauaggugccaaaac

SEQ ID NO: 911714 - RNA, 22 nt, Human
agaucacuugaggucaggaguu

SEQ ID NO: 911715 - RNA, 23 nt, Human
agaucacuugaggucaggaguuc

SEQ ID NO: 911716 - RNA, 23 nt, Human
agaucacuugaugucaggaguuc

SEQ ID NO: 911717 - RNA, 21 nt, Human
agauugggguggggagagagg

SEQ ID NO: 911718 - RNA, 20 nt, Human
agcaaaucaagucacucucc

SEQ ID NO: 911719 - RNA, 20 nt, Human
agcacuuugggaggucgagg

SEQ ID NO: 911720 - RNA, 23 nt, Human
agcagggcgugguggcacgugcc

SEQ ID NO: 911721 - RNA, 23 nt, Human
agccgggcgugguggcacaugcc

SEQ ID NO: 911722 - RNA, 22 nt, Human
agccuggccaacauggugaaac

SEQ ID NO: 911723 - RNA, 24 nt, Human
agccuggccaacauggugaaaccc

SEQ ID NO: 911724 - RNA, 19 nt, Human
agccugggcaacaugguga

SEQ ID NO: 911725 - RNA, 22 nt, Human
agccugggcaacauggugaaac

SEQ ID NO: 911726 - RNA, 24 nt, Human
agccugggcaacauggugaaaccc

SEQ ID NO: 911727 - RNA, 24 nt, Human
agccugggcgacagagugagacuc

SEQ ID NO: 911728 - RNA, 24 nt, Human
agccugggugacagagcaagacuc

SEQ ID NO: 911729 - RNA, 20 nt, Human
agcuaugauaaaacugaaca

SEQ ID NO: 911730 - RNA, 23 nt, Human
aggaaaaacaaaaugaaacaaaa

SEQ ID NO: 911731 - RNA, 23 nt, Human
aggaaggcaucaaauuagacuau

SEQ ID NO: 911732 - RNA, 24 nt, Human
aggaggagguugcagugagccgag

SEQ ID NO: 911733 - RNA, 21 nt, Human
aggaggggagagaagaaacuu

SEQ ID NO: 911734 - RNA, 23 nt, Human
aggaguucgagaccagccugggc

SEQ ID NO: 911735 - RNA, 22 nt, Human
aggauaggugauucaaaaacac

SEQ ID NO: 911736 - RNA, 23 nt, Human
aggcagagcuugcagugagccaa

SEQ ID NO: 911737 - RNA, 19 nt, Human
aggcagagguugcagugaa

SEQ ID NO: 911738 - RNA, 22 nt, Human
aggcagcaaccuggaaaugcca

SEQ ID NO: 911739 - RNA, 18 nt, Human
aggcaggaagaucacuug

SEQ ID NO: 911740 - RNA, 18 nt, Human
aggcaggagaaccacuug

SEQ ID NO: 911741 - RNA, 24 nt, Human
aggcaggagaaccacuugaacccg

SEQ ID NO: 911742 - RNA, 22 nt, Human
aggcaggaggaucacuugaacc

SEQ ID NO: 911743 - RNA, 24 nt, Human
aggcaggaggaucacuugaaccug

SEQ ID NO: 911744 - RNA, 18 nt, Human
aggcaggcggaucacuug

SEQ ID NO: 911745 - RNA, 21 nt, Human
aggcaggcggaucacuugagg

SEQ ID NO: 911746 - RNA, 22 nt, Human
aggcaggcggaucacuugaggu

SEQ ID NO: 911747 - RNA, 21 nt, Human
aggccaacuagggagccagga

SEQ ID NO: 911748 - RNA, 21 nt, Human
aggccaaggugggaagaucac

SEQ ID NO: 911749 - RNA, 24 nt, Human
aggcugaggcaggaggaucacuug

SEQ ID NO: 911750 - RNA, 19 nt, Human
aggcuggucugcuaaaaac

SEQ ID NO: 911751 - RNA, 21 nt, Human
aggucgaggcaggcggaucac

SEQ ID NO: 911752 - RNA, 23 nt, Human
aggugggaagaucacuugagguc

SEQ ID NO: 911753 - RNA, 24 nt, Human
agguugaggcaggagaaccacuug

SEQ ID NO: 911754 - RNA, 21 nt, Human
aguaaugaggcacccccuaug

SEQ ID NO: 911755 - RNA, 24 nt, Human
aguggcucacgccuguaauuccag

SEQ ID NO: 911756 - RNA, 24 nt, Human
agugggaguaaucgcuugaacccg

SEQ ID NO: 911757 - RNA, 24 nt, Human
agugguucacgccuguaaucccag

SEQ ID NO: 911758 - RNA, 23 nt, Human
auaaaacaaaucauucugacccc

SEQ ID NO: 911759 - RNA, 22 nt, Human
auaaacauguauucaugcccuc

SEQ ID NO: 911760 - RNA, 21 nt, Human
auaaacuuauaauacaaguuu

SEQ ID NO: 911761 - RNA, 22 nt, Human
auaauacaaguuuccugacaug

SEQ ID NO: 911762 - RNA, 24 nt, Human
aucacuugaggucaggaguucaag

SEQ ID NO: 911763 - RNA, 20 nt, Human
aucacuugagguugggaguu

SEQ ID NO: 911764 - RNA, 21 nt, Human
aucagaaaccacagaacccag

SEQ ID NO: 911765 - RNA, 21 nt, Human
aucagccggaaaaucacacaa

SEQ ID NO: 911766 - RNA, 24 nt, Human
aucgcaccacugcacuccagccug

SEQ ID NO: 911767 - RNA, 22 nt, Human
augaaacaaaaaacagagccuu

SEQ ID NO: 911768 - RNA, 20 nt, Human
augcauuuccugagugaacc

SEQ ID NO: 911769 - RNA, 23 nt, Human
auggccgggcaugccccagcacc

SEQ ID NO: 911770 - RNA, 24 nt, Human
auugcgccacugcacuccagccug

SEQ ID NO: 911771 - RNA, 27 nt, Human
auuucaaaauauauauauauauaugua

SEQ ID NO: 911772 - RNA, 25 nt, Human
caaaaacagaaacaaaaacaaaaac

SEQ ID NO: 911773 - RNA, 22 nt, Human
caaaaagacagaagaaagagua

SEQ ID NO: 911774 - RNA, 23 nt, Human
caaaacaaaaacagaaacaaaaa

SEQ ID NO: 911775 - RNA, 24 nt, Human
caaaauugcgccacugcacuccag

SEQ ID NO: 911776 - RNA, 22 nt, Human
caaacuaaaggaaaacaaauca

SEQ ID NO: 911777 - RNA, 18 nt, Human
caaagaaacaagaaaggg

SEQ ID NO: 911778 - RNA, 21 nt, Human
caaagcagugucaauaaaagc

SEQ ID NO: 911779 - RNA, 23 nt, Human
caaagcagugucaauaaaagcca

SEQ ID NO: 911780 - RNA, 21 nt, Human
caaauacacuaaaaacaccuc

SEQ ID NO: 911781 - RNA, 18 nt, Human
caacaaacuguaaacuaa

SEQ ID NO: 911782 - RNA, 22 nt, Human
caacauggauaaaccuggucuc

SEQ ID NO: 911783 - RNA, 18 nt, Human
caacauggugaaacccca

SEQ ID NO: 911784 - RNA, 22 nt, Human
caacauggugaaaccccgucuc

SEQ ID NO: 911785 - RNA, 24 nt, Human
caacauggugaaaccccgucucua

SEQ ID NO: 911786 - RNA, 21 nt, Human
caagacagaaaacuuuugaca

SEQ ID NO: 911787 - RNA, 24 nt, Human
caagaccagccuggccaacauggu

SEQ ID NO: 911788 - RNA, 24 nt, Human
caaggugggaagaucacuugaggu

SEQ ID NO: 911789 - RNA, 23 nt, Human
caauaacaagaaggauccucuuc

SEQ ID NO: 911790 - RNA, 25 nt, Human
caauaggugccaaaacuuagaugac

SEQ ID NO: 911791 - RNA, 23 nt, Human
caauauauugcuauuucaccaua

SEQ ID NO: 911792 - RNA, 24 nt, Human
caaucuguuuccucaucucugaaa

SEQ ID NO: 911793 - RNA, 25 nt, Human
caauuaaggaacugacaucaaacau

SEQ ID NO: 911794 - RNA, 27 nt, Human
cacacaugucaaaaagacagaagaaag

SEQ ID NO: 911795 - RNA, 24 nt, Human
cacagacaaaaagagccacaacaa

SEQ ID NO: 911796 - RNA, 22 nt, Human
cacagcaaaacuccuacuagcu

SEQ ID NO: 911797 - RNA, 24 nt, Human
cacaguuuauauccaaaaaauaaa

SEQ ID NO: 911798 - RNA, 20 nt, Human
caccaagggugugacaccau

SEQ ID NO: 911799 - RNA, 21 nt, Human
cacccccuaugaccuugccaa

SEQ ID NO: 911800 - RNA, 24 nt, Human
caccuggcaguaaugaggcacccc

SEQ ID NO: 911801 - RNA, 24 nt, Human
cacgccuguaaucccagcacuuug

SEQ ID NO: 911802 - RNA, 24 nt, Human
cacgccuguaauuccagcacuuug

SEQ ID NO: 911803 - RNA, 18 nt, Human
cacuauaaauaaagaaug

SEQ ID NO: 911804 - RNA, 23 nt, Human
cacuccaaccugggcaacagagc

SEQ ID NO: 911805 - RNA, 22 nt, Human
cacuccagccugggcgacagag

SEQ ID NO: 911806 - RNA, 22 nt, Human
cacuccagccugggcgacagag

SEQ ID NO: 911807 - RNA, 24 nt, Human
cacuccagccugggcgacagagug

SEQ ID NO: 911808 - RNA, 22 nt, Human
cacuccagccugggugacagag

SEQ ID NO: 911809 - RNA, 23 nt, Human
cacugcacuccaaccugggcaac

SEQ ID NO: 911810 - RNA, 24 nt, Human
cacugcacuccaaccugggcaaca

SEQ ID NO: 911811 - RNA, 27 nt, Human
cacugcacuccaaccugggcaacagag

SEQ ID NO: 911812 - RNA, 19 nt, Human
cacugcacuccagccuggg

SEQ ID NO: 911813 - RNA, 19 nt, Human
cacugcacuccagccuggg

SEQ ID NO: 911814 - RNA, 21 nt, Human
cacugcacuccagccugggcg

SEQ ID NO: 911815 - RNA, 22 nt, Human
cacugcacuccagccugggcga

SEQ ID NO: 911816 - RNA, 23 nt, Human
cacugcacuccagccugggcgac

SEQ ID NO: 911817 - RNA, 24 nt, Human
cacugcacuccagccugggcgaca

SEQ ID NO: 911818 - RNA, 21 nt, Human
cacugcacuccagccugggug

SEQ ID NO: 911819 - RNA, 22 nt, Human
cacugcacuccagccuggguga

SEQ ID NO: 911820 - RNA, 23 nt, Human
cacugcacuccagccugggugac

SEQ ID NO: 911821 - RNA, 24 nt, Human
cacugcacuccagccugggugaca

SEQ ID NO: 911822 - RNA, 25 nt, Human
cacugcacuccagccugggugacag

SEQ ID NO: 911823 - RNA, 21 nt, Human
cacuggacacacaugucaaaa

SEQ ID NO: 911824 - RNA, 18 nt, Human
cacuucugaucagccgga

SEQ ID NO: 911825 - RNA, 21 nt, Human
cacuugaacccgggaggagga

SEQ ID NO: 911826 - RNA, 23 nt, Human
cacuugaggucaggaguucaaga

SEQ ID NO: 911827 - RNA, 21 nt, Human
cacuuuuggugagaaggcaac

SEQ ID NO: 911828 - RNA, 20 nt, Human
cagaaacaaaaacaaaaaca

SEQ ID NO: 911829 - RNA, 19 nt, Human
cagaagcuuaacuagaggc

SEQ ID NO: 911830 - RNA, 20 nt, Human
cagcaaaacuccuacuagcu

SEQ ID NO: 911831 - RNA, 23 nt, Human
cagcaaccuggaaaugccaacug

SEQ ID NO: 911832 - RNA, 21 nt, Human
cagcaauaacaagaaggaucc

SEQ ID NO: 911833 - RNA, 24 nt, Human
cagcacuuugggaagcggaggcag

SEQ ID NO: 911834 - RNA, 24 nt, Human
cagcacuuugggaggucgaggcag

SEQ ID NO: 911835 - RNA, 28 nt, Human
cagcacuuugggaggucgaggcaggcgg

SEQ ID NO: 911836 - RNA, 25 nt, Human
caucucaaaacaaaaacagaaacaa

SEQ ID NO: 911837 - RNA, 22 nt, Human
cauggcuagcaaguauuagccu

SEQ ID NO: 911838 - RNA, 19 nt, Human
ccaacuggcacagacaaaa

SEQ ID NO: 911839 - RNA, 20 nt, Human
ccaccacccacaccaacgaa

SEQ ID NO: 911840 - RNA, 23 nt, Human
ccacugcacuccaaccugggcaa

SEQ ID NO: 911841 - RNA, 24 nt, Human
ccacugcacuccaaccugggcaac

SEQ ID NO: 911842 - RNA, 20 nt, Human
ccacugcacuccagccuggg

SEQ ID NO: 911843 - RNA, 20 nt, Human
ccacugcacuccagccuggg

SEQ ID NO: 911844 - RNA, 20 nt, Human
ccacugcacuccagccuggg

SEQ ID NO: 911845 - RNA, 20 nt, Human
ccacugcacuccagccuggg

SEQ ID NO: 911846 - RNA, 21 nt, Human
ccacugcacuccagccugggc

SEQ ID NO: 911847 - RNA, 21 nt, Human
ccacugcacuccagccugggc

SEQ ID NO: 911848 - RNA, 23 nt, Human
ccacugcacuccagccugggcga

SEQ ID NO: 911849 - RNA, 24 nt, Human
ccacugcacuccagccugggcgac

SEQ ID NO: 911850 - RNA, 21 nt, Human
ccacugcacuccagccugggu

SEQ ID NO: 911851 - RNA, 21 nt, Human
ccacugcacuccagccugggu

SEQ ID NO: 911852 - RNA, 23 nt, Human
ccacugcacuccagccuggguga

SEQ ID NO: 911853 - RNA, 24 nt, Human
ccacugcacuccagccugggugac

SEQ ID NO: 911854 - RNA, 25 nt, Human
ccacugcacuccagccugggugaca

SEQ ID NO: 911855 - RNA, 23 nt, Human
ccagaaaacaguuuugccccacc

SEQ ID NO: 911856 - RNA, 21 nt, Human
ccagagccuaggaacauaaua

SEQ ID NO: 911857 - RNA, 22 nt, Human
cccaaugaauaagaacacguca

SEQ ID NO: 911858 - RNA, 18 nt, Human
cccaccaccacccacacc

SEQ ID NO: 911859 - RNA, 21 nt, Human
cccaccaccacccacaccaac

SEQ ID NO: 911860 - RNA, 26 nt, Human
cccaccaccacccacaccaacgaaag

SEQ ID NO: 911861 - RNA, 23 nt, Human
cccacccagcaauaacaagaagg

SEQ ID NO: 911862 - RNA, 18 nt, Human
cccagaaaacaguuuugc

SEQ ID NO: 911863 - RNA, 23 nt, Human
cccagaaaacaguuuugccccac

SEQ ID NO: 911864 - RNA, 19 nt, Human
cccauaaaagucuccucau

SEQ ID NO: 911865 - RNA, 21 nt, Human
cccaucuccacuaagaauaca

SEQ ID NO: 911866 - RNA, 19 nt, Human
ccccaccaccacccacacc

SEQ ID NO: 911867 - RNA, 21 nt, Human
ccccaccaccacccacaccaa

SEQ ID NO: 911868 - RNA, 22 nt, Human
ccgggcaugccccagcaccuac

SEQ ID NO: 911869 - RNA, 25 nt, Human
ccuaugaccuugccaaagcaguguc

SEQ ID NO: 911870 - RNA, 19 nt, Human
ccucaucucugaaaaugaa

SEQ ID NO: 911871 - RNA, 23 nt, Human
ccuggccaacauggugaaacccc

SEQ ID NO: 911872 - RNA, 24 nt, Human
ccuggccaacauggugaaacccca

SEQ ID NO: 911873 - RNA, 23 nt, Human
ccugggcaacauggugaaacccc

SEQ ID NO: 911874 - RNA, 24 nt, Human
ccugggcaacauggugaaaccccg

SEQ ID NO: 911875 - RNA, 22 nt, Human
ccugggcgacagagugagacuc

SEQ ID NO: 911876 - RNA, 22 nt, Human
ccugggugacagagcaagacuc

SEQ ID NO: 911877 - RNA, 22 nt, Human
ccuguaaucccagcacuuuggg

SEQ ID NO: 911878 - RNA, 18 nt, Human
ccuguaaucccagcuacu

SEQ ID NO: 911879 - RNA, 21 nt, Human
ccuguaaucccagcuacuaag

SEQ ID NO: 911880 - RNA, 22 nt, Human
ccuguaauuccagcacuuuggg

SEQ ID NO: 911881 - RNA, 19 nt, Human
ccuguaguccuagcuacuc

SEQ ID NO: 911882 - RNA, 19 nt, Human
ccuguguaguggcacuuuu

SEQ ID NO: 911883 - RNA, 21 nt, Human
ccuuugcuugaguuucccaga

SEQ ID NO: 911884 - RNA, 24 nt, Human
cgagaccagccugggcaacauggu

SEQ ID NO: 911885 - RNA, 22 nt, Human
cgagaucagugccacugcacuc

SEQ ID NO: 911886 - RNA, 24 nt, Human
cgaggcaggcggaucacuugaggu

SEQ ID NO: 911887 - RNA, 26 nt, Human
cgccacugcacuccagccugggcgac

SEQ ID NO: 911888 - RNA, 23 nt, Human
cgccuguaaucccagcacuuugg

SEQ ID NO: 911889 - RNA, 23 nt, Human
cgccuguaauuccagcacuuugg

SEQ ID NO: 911890 - RNA, 24 nt, Human
cggaucacuugagguugggaguuu

SEQ ID NO: 911891 - RNA, 24 nt, Human
cgggaggaggagguugcagugagc

SEQ ID NO: 911892 - RNA, 24 nt, Human
cgggaggcugaggcaggaggauca

SEQ ID NO: 911893 - RNA, 22 nt, Human
cgguagcaaaaauaugaguaaa

SEQ ID NO: 911894 - RNA, 24 nt, Human
cgugugucacuggacacacauggu

SEQ ID NO: 911895 - RNA, 23 nt, Human
cuaacuaaaaccuucaagguaaa

SEQ ID NO: 911896 - RNA, 20 nt, Human
cuaacuuugcaaauccuuga

SEQ ID NO: 911897 - RNA, 22 nt, Human
cucaaaacaaaaacagaaacaa

SEQ ID NO: 911898 - RNA, 23 nt, Human
cucaagaaaaaaaaaaaaaaaaa

SEQ ID NO: 911899 - RNA, 24 nt, Human
cucacgccuguaauuccagcacuu

SEQ ID NO: 911900 - RNA, 24 nt, Human
cucagacgaggaaaaauugagaga

SEQ ID NO: 911901 - RNA, 18 nt, Human
cucauuuuauaccuccac

SEQ ID NO: 911902 - RNA, 20 nt, Human
cucuccuuucuugcuaauuu

SEQ ID NO: 911903 - RNA, 22 nt, Human
cucucuagccaaagaaacaaga

SEQ ID NO: 911904 - RNA, 25 nt, Human
cugaaaguguaaaugcccguauuug

SEQ ID NO: 911905 - RNA, 18 nt, Human
cugauacaucacaacuaa

SEQ ID NO: 911906 - RNA, 22 nt, Human
cugauacuaaaaacagauuagu

SEQ ID NO: 911907 - RNA, 18 nt, Human
cuggcacagacaaaaaga

SEQ ID NO: 911908 - RNA, 23 nt, Human
cuggccaacauggugaaacccca

SEQ ID NO: 911909 - RNA, 22 nt, Human
cugguuucuacaagugucaaaa

SEQ ID NO: 911910 - RNA, 23 nt, Human
cuugaugucaggaguucgagacc

SEQ ID NO: 911911 - RNA, 21 nt, Human
cuuggagcuaaagaaggcagc

SEQ ID NO: 911912 - RNA, 20 nt, Human
cuuugcuugaguuucccaga

SEQ ID NO: 911913 - RNA, 23 nt, Human
gaaaaaauaaagaggcugggagc

SEQ ID NO: 911914 - RNA, 20 nt, Human
gaacccgggaggcagagcuu

SEQ ID NO: 911915 - RNA, 18 nt, Human
gaauucagaagacugaua

SEQ ID NO: 911916 - RNA, 22 nt, Human
gacaaucuagaaaacuucaaaa

SEQ ID NO: 911917 - RNA, 24 nt, Human
gagaaaauaggaaaaaccgguacc

SEQ ID NO: 911918 - RNA, 19 nt, Human
gagagagagagaacacugc

SEQ ID NO: 911919 - RNA, 18 nt, Human
gagcuugcagugagccaa

SEQ ID NO: 911920 - RNA, 22 nt, Human
gagguugcagugagccgagauc

SEQ ID NO: 911921 - RNA, 23 nt, Human
gauaggcugggugcagugguuca

SEQ ID NO: 911922 - RNA, 23 nt, Human
gaucacuugaaccuggaggcaga

SEQ ID NO: 911923 - RNA, 23 nt, Human
gaucacuugaggucaggaguuca

SEQ ID NO: 911924 - RNA, 24 nt, Human
gaucacuugaggucaggaguucaa

SEQ ID NO: 911925 - RNA, 24 nt, Human
gaucacuugagguugggaguuuga

SEQ ID NO: 911926 - RNA, 18 nt, Human
gaucacuugaugucagga

SEQ ID NO: 911927 - RNA, 24 nt, Human
gaucacuugaugucaggaguucga

SEQ ID NO: 911928 - RNA, 22 nt, Human
gcaaaagacauauuggaauuag

SEQ ID NO: 911929 - RNA, 19 nt, Human
gcaauguaaaaguaggcca

SEQ ID NO: 911930 - RNA, 20 nt, Human
gcaccacugcacuccagccu

SEQ ID NO: 911931 - RNA, 21 nt, Human
gcacuauugucauucaacccu

SEQ ID NO: 911932 - RNA, 23 nt, Human
gcacuccagccugggcgacagag

SEQ ID NO: 911933 - RNA, 24 nt, Human
gcacuccagccugggugacagagc

SEQ ID NO: 911934 - RNA, 24 nt, Human
gcagaaaaacugugacguggacaa

SEQ ID NO: 911935 - RNA, 22 nt, Human
gcaggagaaccacuugaacccg

SEQ ID NO: 911936 - RNA, 18 nt, Human
gcagugguucacgccugu

SEQ ID NO: 911937 - RNA, 24 nt, Human
gccaacauggugaaaccccaucuc

SEQ ID NO: 911938 - RNA, 24 nt, Human
gccacugcacuccaaccugggcaa

SEQ ID NO: 911939 - RNA, 22 nt, Human
gccacugcacuccagccugggc

SEQ ID NO: 911940 - RNA, 24 nt, Human
gccacugcacuccagccugggcga

SEQ ID NO: 911941 - RNA, 20 nt, Human
gccccaccaccacccacacc

SEQ ID NO: 911942 - RNA, 24 nt, Human
gccuuguaguccuagcuacuuggg

SEQ ID NO: 911943 - RNA, 19 nt, Human
gcugacaaaaauggaaggg

SEQ ID NO: 911944 - RNA, 18 nt, Human
ggacaacagguucgaaaa

SEQ ID NO: 911945 - RNA, 21 nt, Human
ggagaaccacuugaacccggg

SEQ ID NO: 911946 - RNA, 19 nt, Human
ggagagaagaaacuuuucu

SEQ ID NO: 911947 - RNA, 18 nt, Human
ggagguugcagugagccg

SEQ ID NO: 911948 - RNA, 20 nt, Human
ggagguugcagugagccgag

SEQ ID NO: 911949 - RNA, 22 nt, Human
ggagguugcagugagccgagau

SEQ ID NO: 911950 - RNA, 23 nt, Human
ggagguugcagugagccgagauc

SEQ ID NO: 911951 - RNA, 24 nt, Human
ggagguugcagugagccgagauca

SEQ ID NO: 911952 - RNA, 22 nt, Human
ggaguucgagaccagccugggc

SEQ ID NO: 911953 - RNA, 19 nt, Human
ggaguuugagaccagccug

SEQ ID NO: 911954 - RNA, 22 nt, Human
ggaucacuugagguugggaguu

SEQ ID NO: 911955 - RNA, 21 nt, Human
ggcacaugccuguaaucccag

SEQ ID NO: 911956 - RNA, 23 nt, Human
ggcgugguggcacaugccuguaa

SEQ ID NO: 911957 - RNA, 23 nt, Human
ggcugggagcaguggcucacgcc

SEQ ID NO: 911958 - RNA, 24 nt, Human
gggagcaguggcucacgccuguaa

SEQ ID NO: 911959 - RNA, 23 nt, Human
gggaggcugaggcaggaggauca

SEQ ID NO: 911960 - RNA, 20 nt, Human
gggaggucgaggcaggcgga

SEQ ID NO: 911961 - RNA, 24 nt, Human
gggugcagugguucacgccuguaa

SEQ ID NO: 911962 - RNA, 19 nt, Human
ggugagaaggcaacaggga

SEQ ID NO: 911963 - RNA, 24 nt, Human
gguggcacaugccuguaaucccag

SEQ ID NO: 911964 - RNA, 19 nt, Human
gguugggaguuugagacca

SEQ ID NO: 911965 - RNA, 19 nt, Human
guggacaacagguucgaaa

SEQ ID NO: 911966 - RNA, 22 nt, Human
guggugccuuugaaaaaagggu

SEQ ID NO: 911967 - RNA, 25 nt, Human
guugcagugagccgagaucagugcc

SEQ ID NO: 911968 - RNA, 23 nt, Human
guugcuuuguuuugaauuccuau

SEQ ID NO: 911969 - RNA, 21 nt, Human
uaaaaacaccucucgucaccc

SEQ ID NO: 911970 - RNA, 21 nt, Human
uaaaaacacgguagcaaaaau

SEQ ID NO: 911971 - RNA, 21 nt, Human
uaaaaauacaaaaauuagcca

SEQ ID NO: 911972 - RNA, 22 nt, Human
uaaaaauacaaaauuagccggg

SEQ ID NO: 911973 - RNA, 23 nt, Human
uaaaaauacaaaauuagccgggc

SEQ ID NO: 911974 - RNA, 25 nt, Human
uaaaacuuugcuacagucaguuaag

SEQ ID NO: 911975 - RNA, 20 nt, Human
uaaaagaagauacugucuaa

SEQ ID NO: 911976 - RNA, 22 nt, Human
uaaaagguuacagaaaccaaua

SEQ ID NO: 911977 - RNA, 22 nt, Human
uaaaauaauucauggcuucuaa

SEQ ID NO: 911978 - RNA, 22 nt, Human
uaaauucucuggguuuucuuuu

SEQ ID NO: 911979 - RNA, 18 nt, Human
uaacaagaaggauccucu

SEQ ID NO: 911980 - RNA, 25 nt, Human
uaagaaaaaaucuuuccugauuauc

SEQ ID NO: 911981 - RNA, 23 nt, Human
uaagugcacagauauggcaaaca

SEQ ID NO: 911982 - RNA, 19 nt, Human
uaauauaucccagacuugg

SEQ ID NO: 911983 - RNA, 18 nt, Human
uacaauauauagccugaa

SEQ ID NO: 911984 - RNA, 18 nt, Human
uacaaucgacuuuccuuc

SEQ ID NO: 911985 - RNA, 19 nt, Human
uaccaaauuccauauuuag

SEQ ID NO: 911986 - RNA, 24 nt, Human
uaccacauauaaaacuuugcuaca

SEQ ID NO: 911987 - RNA, 25 nt, Human
uacccucaguuauacaaaacaauuu

SEQ ID NO: 911988 - RNA, 20 nt, Human
uaccuccaccaacagauuuc

SEQ ID NO: 911989 - RNA, 23 nt, Human
uagacaauuaaggaacugacauc

SEQ ID NO: 911990 - RNA, 21 nt, Human
uagacuuccacccccacccag

SEQ ID NO: 911991 - RNA, 19 nt, Human
uagagcagacauacuuuuc

SEQ ID NO: 911992 - RNA, 23 nt, Human
uagaggaaauuaacuaaacagaa

SEQ ID NO: 911993 - RNA, 21 nt, Human
uagcaaaaauaugaguaaaua

SEQ ID NO: 911994 - RNA, 19 nt, Human
uagcaaaaucuaacacgug

SEQ ID NO: 911995 - RNA, 24 nt, Human
uagcaagaacaagauuuaaaacaa

SEQ ID NO: 911996 - RNA, 21 nt, Human
uagcaaguauuagccuguguu

SEQ ID NO: 911997 - RNA, 22 nt, Human
uagcagggcgugguggcacgug

SEQ ID NO: 911998 - RNA, 22 nt, Human
uagccaggcaugguggugugcc

SEQ ID NO: 911999 - RNA, 22 nt, Human
uagccgggcgugguggcacaug

SEQ ID NO: 912000 - RNA, 24 nt, Human
uagcuacucgggaggcugaggcag

SEQ ID NO: 912001 - RNA, 18 nt, Human
uagcuagcccauaaaagu

SEQ ID NO: 912002 - RNA, 21 nt, Human
uaggaaaaacaaaaugaaaca

SEQ ID NO: 912003 - RNA, 23 nt, Human
uauacaaaacaauuucagcacug

SEQ ID NO: 912004 - RNA, 19 nt, Human
uauaucccagacuuggagc

SEQ ID NO: 912005 - RNA, 19 nt, Human
uaugcaaaccaucacaagg

SEQ ID NO: 912006 - RNA, 25 nt, Human
uauuagccuguguucuaguucuagc

SEQ ID NO: 912007 - RNA, 19 nt, Human
uauuucaccauaacuguga

SEQ ID NO: 912008 - RNA, 21 nt, Human
uauuucaccauaacugugaua

SEQ ID NO: 912009 - RNA, 23 nt, Human
uauuuugaaaaguauuuacuuag

SEQ ID NO: 912010 - RNA, 19 nt, Human
ucaaaacaaaaacagaaac

SEQ ID NO: 912011 - RNA, 24 nt, Human
ucaaaacaaaaacagaaacaaaaa

SEQ ID NO: 912012 - RNA, 25 nt, Human
ucaaaacaaaaacagaaacaaaaac

SEQ ID NO: 912013 - RNA, 26 nt, Human
ucaaaacaaaaacagaaacaaaaaca

SEQ ID NO: 912014 - RNA, 21 nt, Human
ucaaaauauauauauauauau

SEQ ID NO: 912015 - RNA, 23 nt, Human
ucaaaauauauauauauauaugu

SEQ ID NO: 912016 - RNA, 27 nt, Human
ucaaauacacuaaaaacaccucucguc

SEQ ID NO: 912017 - RNA, 24 nt, Human
ucaagaaaaaaaaaaaaaaaaaaa

SEQ ID NO: 912018 - RNA, 26 nt, Human
ucaagguaaaaacugaaguuucaaga

SEQ ID NO: 912019 - RNA, 21 nt, Human
ucacaccaagggugugacacc

SEQ ID NO: 912020 - RNA, 25 nt, Human
ucacccugauggccgggcaugcccc

SEQ ID NO: 912021 - RNA, 23 nt, Human
ucacgccuguaaucccagcacuu

SEQ ID NO: 912022 - RNA, 22 nt, Human
ucacgccuguaauuccagcacu

SEQ ID NO: 912023 - RNA, 20 nt, Human
ucacuugaugucaggaguuc

SEQ ID NO: 912024 - RNA, 23 nt, Human
ucagcaguccucuugaacacaau

SEQ ID NO: 912025 - RNA, 20 nt, Human
ucagcuagacuuccaccccc

SEQ ID NO: 912026 - RNA, 21 nt, Human
ucagcuagacuuccaccccca

SEQ ID NO: 912027 - RNA, 19 nt, Human
ucagugccacugcacucca

SEQ ID NO: 912028 - RNA, 24 nt, Human
ucaucagaaaccacagaacccaga

SEQ ID NO: 912029 - RNA, 22 nt, Human
ucaucugccaaccaaacauuuc

SEQ ID NO: 912030 - RNA, 22 nt, Human
ucauuuaaaaaaguuauacaga

SEQ ID NO: 912031 - RNA, 19 nt, Human
uccaccaacagauuucaua

SEQ ID NO: 912032 - RNA, 23 nt, Human
uccacuccagccaaacccagaaa

SEQ ID NO: 912033 - RNA, 22 nt, Human
uccacuuacagaagcauagagc

SEQ ID NO: 912034 - RNA, 23 nt, Human
uccagccugggcgacagagugag

SEQ ID NO: 912035 - RNA, 24 nt, Human
uccagccugggcgacagagugaga

SEQ ID NO: 912036 - RNA, 24 nt, Human
uccagccugggugacagagcaaga

SEQ ID NO: 912037 - RNA, 27 nt, Human
uccauuucaaaauauauauauauauau

SEQ ID NO: 912038 - RNA, 23 nt, Human
uccgucucaagaaaaaaaaaaaa

SEQ ID NO: 912039 - RNA, 24 nt, Human
uccucaucucugaaaaugaaggga

SEQ ID NO: 912040 - RNA, 23 nt, Human
ucgcaccacugcacuccagccug

SEQ ID NO: 912041 - RNA, 18 nt, Human
ucgcuugaacccgggagg

SEQ ID NO: 912042 - RNA, 25 nt, Human
ucgggaggcugaggcaggaggauca

SEQ ID NO: 912043 - RNA, 28 nt, Human
ucuaguuuuaacagaaaaucauucaucu

SEQ ID NO: 912044 - RNA, 20 nt, Human
ucucuacuaaaaauacaaaa

SEQ ID NO: 912045 - RNA, 21 nt, Human
ucucuacuaaaaauacaaaaa

SEQ ID NO: 912046 - RNA, 27 nt, Human
ucucucguccuucuuccuaacuuugca

SEQ ID NO: 912047 - RNA, 19 nt, Human
ucucuugaaucuucugaau

SEQ ID NO: 912048 - RNA, 21 nt, Human
ucugccaaccaaacauuuccu

SEQ ID NO: 912049 - RNA, 25 nt, Human
ucuuauggcaaugauuuuuuucuag

SEQ ID NO: 912050 - RNA, 27 nt, Human
ucuucugaauuuugucugauggugaaa

SEQ ID NO: 912051 - RNA, 22 nt, Human
ugaaacaaaaaacagagccuua

SEQ ID NO: 912052 - RNA, 19 nt, Human
ugaaaccccaucuccacua

SEQ ID NO: 912053 - RNA, 22 nt, Human
ugaaaccccaucuccacuaaga

SEQ ID NO: 912054 - RNA, 18 nt, Human
ugaaauacagccugugua

SEQ ID NO: 912055 - RNA, 22 nt, Human
ugaacagaugaaccacaguuua

SEQ ID NO: 912056 - RNA, 25 nt, Human
ugaacagaugaaccacaguuuauau

SEQ ID NO: 912057 - RNA, 19 nt, Human
ugaagggacuaaaguggaa

SEQ ID NO: 912058 - RNA, 19 nt, Human
ugaauagagagaaaauagg

SEQ ID NO: 912059 - RNA, 26 nt, Human
ugacaaaaauggaagggaagucaaga

SEQ ID NO: 912060 - RNA, 23 nt, Human
ugacacauuucugacgaagaaca

SEQ ID NO: 912061 - RNA, 24 nt, Human
ugacaguaacugcuccacuccagc

SEQ ID NO: 912062 - RNA, 19 nt, Human
ugacaucaaacaugaaaac

SEQ ID NO: 912063 - RNA, 18 nt, Human
ugacuucuauguccaccu

SEQ ID NO: 912064 - RNA, 18 nt, Human
ugagaagacugugaaaag

SEQ ID NO: 912065 - RNA, 20 nt, Human
ugagaagacugugaaaagug

SEQ ID NO: 912066 - RNA, 24 nt, Human
ugagaccagccugaccaacaugga

SEQ ID NO: 912067 - RNA, 23 nt, Human
ugagccgagaucagugccacugc

SEQ ID NO: 912068 - RNA, 20 nt, Human
ugaggagcuccaaugcccua

SEQ ID NO: 912069 - RNA, 18 nt, Human
ugaggcaggagaaccacu

SEQ ID NO: 912070 - RNA, 20 nt, Human
ugaggcaggagaaccacuug

SEQ ID NO: 912071 - RNA, 24 nt, Human
ugaggcaggagaaccacuugaacc

SEQ ID NO: 912072 - RNA, 25 nt, Human
ugaggcaggagaaccacuugaaccc

SEQ ID NO: 912073 - RNA, 20 nt, Human
ugaggcaggaggaucacuug

SEQ ID NO: 912074 - RNA, 24 nt, Human
ugaggcaggaggaucacuugaacc

SEQ ID NO: 912075 - RNA, 25 nt, Human
ugaggcaggaggaucacuugaaccu

SEQ ID NO: 912076 - RNA, 20 nt, Human
ugagugaacccaaaugauca

SEQ ID NO: 912077 - RNA, 19 nt, Human
ugauggugaaagugaaaac

SEQ ID NO: 912078 - RNA, 23 nt, Human
ugauucaaaaacacuaaaaggaa

SEQ ID NO: 912079 - RNA, 24 nt, Human
ugccacugcacuccaaccugggca

SEQ ID NO: 912080 - RNA, 24 nt, Human
ugccccaccaccacccacaccaac

SEQ ID NO: 912081 - RNA, 24 nt, Human
ugccuguaaucccagcuacuaagg

SEQ ID NO: 912082 - RNA, 24 nt, Human
ugccuguaguccuagcuacucggg

SEQ ID NO: 912083 - RNA, 21 nt, Human
ugcucaucugccaaccaaaca

SEQ ID NO: 912084 - RNA, 18 nt, Human
uggaagcaaaagacauau

SEQ ID NO: 912085 - RNA, 18 nt, Human
uggauaaaccuggucucu

SEQ ID NO: 912086 - RNA, 22 nt, Human
uggcaagacagaaaacuuuuga

SEQ ID NO: 912087 - RNA, 25 nt, Human
uggcaagacagaaaacuuuugacag

SEQ ID NO: 912088 - RNA, 21 nt, Human
uggcacaugccuguaauccca

SEQ ID NO: 912089 - RNA, 24 nt, Human
uggcaguaaugaggcacccccuuc

SEQ ID NO: 912090 - RNA, 24 nt, Human
uggccaacauggugaaaccccauc

SEQ ID NO: 912091 - RNA, 24 nt, Human
uggcucacgccuguaauuccagca

SEQ ID NO: 912092 - RNA, 21 nt, Human
uggcugacauuaguauaucac

SEQ ID NO: 912093 - RNA, 21 nt, Human
uggcugucuuucucaaaucuu

SEQ ID NO: 912094 - RNA, 18 nt, Human
ugggaagaucacuugagg

SEQ ID NO: 912095 - RNA, 20 nt, Human
ugggaagcggaggcaggaag

SEQ ID NO: 912096 - RNA, 19 nt, Human
ugggaggcuaaagugggag

SEQ ID NO: 912097 - RNA, 24 nt, Human
ugggaggcuaaagugggaguaauc

SEQ ID NO: 912098 - RNA, 25 nt, Human
ugggaggcuaaagugggaguaaucg

SEQ ID NO: 912099 - RNA, 20 nt, Human
ugggaggucgaggcaggcgg

SEQ ID NO: 912100 - RNA, 20 nt, Human
ugggaucaaguauuuccugc

SEQ ID NO: 912101 - RNA, 23 nt, Human
ugggaucaaguauuuccugcauu

SEQ ID NO: 912102 - RNA, 23 nt, Human
uggucaggagccuugggacaccu

SEQ ID NO: 912103 - RNA, 20 nt, Human
uggugccuuugaaaaaaggg

SEQ ID NO: 912104 - RNA, 24 nt, Human
ugguggcacaugccuguaauccca

SEQ ID NO: 912105 - RNA, 22 nt, Human
ugguggcacgugccuguagucc

SEQ ID NO: 912106 - RNA, 21 nt, Human
ugguggugugccuuguagucc

SEQ ID NO: 912107 - RNA, 22 nt, Human
ugguucacgccuguaaucccag

SEQ ID NO: 912108 - RNA, 24 nt, Human
ugguucacgccuguaaucccagca

SEQ ID NO: 912109 - RNA, 19 nt, Human
uguaaaaacacgguagcag

SEQ ID NO: 912110 - RNA, 19 nt, Human
uguaaucccagcuacuaag

SEQ ID NO: 912111 - RNA, 23 nt, Human
ugucuuugaacaaagcaaucugu

SEQ ID NO: 912112 - RNA, 23 nt, Human
uguuacaaagguuucacagcaaa

SEQ ID NO: 912113 - RNA, 22 nt, Human
uuaaaucaaccaaagaauaauu

SEQ ID NO: 912114 - RNA, 19 nt, Human
uuaagcauuucuuuuucca

SEQ ID NO: 912115 - RNA, 20 nt, Human
uuagcagggcgugguggcac

SEQ ID NO: 912116 - RNA, 20 nt, Human
uuagcagggcgugguggcac

SEQ ID NO: 912117 - RNA, 24 nt, Human
uuagcagggcgugguggcacgugc

SEQ ID NO: 912118 - RNA, 23 nt, Human
uuagccaggcaugguggugugcc

SEQ ID NO: 912119 - RNA, 18 nt, Human
uuagccgggcgugguggc

SEQ ID NO: 912120 - RNA, 19 nt, Human
uuagccgggcgugguggca

SEQ ID NO: 912121 - RNA, 24 nt, Human
uuagccgggcgugguggcacaugc

SEQ ID NO: 912122 - RNA, 22 nt, Human
uucacccugauggccgggcaug

SEQ ID NO: 912123 - RNA, 23 nt, Human
uucagaaauauuuuaagaaaaac

SEQ ID NO: 912124 - RNA, 23 nt, Human
uucauccucaguuuaaugggauc

SEQ ID NO: 912125 - RNA, 20 nt, Human
uucuaguucuagcugucuuu

SEQ ID NO: 912126 - RNA, 21 nt, Human
uucucuggguuuucuuuuugc

SEQ ID NO: 912127 - RNA, 22 nt, Human
uugcagugaacccagaucgcac

SEQ ID NO: 912128 - RNA, 22 nt, Human
uugcagugagccaaaauugcgc

SEQ ID NO: 912129 - RNA, 22 nt, Human
uugcagugagccgagaucagug

SEQ ID NO: 912130 - RNA, 23 nt, Human
uugcagugagccgagaucagugc

SEQ ID NO: 912131 - RNA, 23 nt, Human
uugcgccacugcacuccagccug

SEQ ID NO: 912132 - RNA, 21 nt, Human
uugggguggggagagaggcuc

SEQ ID NO: 912133 - RNA, 19 nt, Human
uuggucuuacaaauuacaa

SEQ ID NO: 912134 - RNA, 18 nt, Human
uuggugagaaggcaacag

SEQ ID NO: 912135 - RNA, 18 nt, Human
uuuccaaaagcaaaucaa

SEQ ID NO: 912136 - RNA, 22 nt, Human
uuuccugacaugcauuuccuga

SEQ ID NO: 912137 - RNA, 25 nt, Human
uuucuccucaaaauauauuuucaaa

SEQ ID NO: 912138 - RNA, 25 nt, Human
uuugcaaauccuugagcuagguugc

SEQ ID NO: 912139 - RNA, 24 nt, Human
aaaaaaaaaaaaaaagacauugaa

SEQ ID NO: 912140 - RNA, 20 nt, Human
aaaaaacuugguuaaaaacc

SEQ ID NO: 912141 - RNA, 26 nt, Human
aaaaaagucacccaaaucugcaaugg

SEQ ID NO: 912142 - RNA, 19 nt, Human
aaaaccaaaaccaaaaaug

SEQ ID NO: 912143 - RNA, 18 nt, Human
aaaaucuucacaguaacc

SEQ ID NO: 912144 - RNA, 20 nt, Human
aaacaaaaccaaaaccaaaa

SEQ ID NO: 912145 - RNA, 19 nt, Human
aaacaaugaucuccacuga

SEQ ID NO: 912146 - RNA, 22 nt, Human
aaaccaccugugccuaaggcca

SEQ ID NO: 912147 - RNA, 26 nt, Human
aaacugagaggcugaacuuuaaacau

SEQ ID NO: 912148 - RNA, 23 nt, Human
aaagcugaaccaaauaagggaaa

SEQ ID NO: 912149 - RNA, 20 nt, Human
aaauaaaucagaaaaagccc

SEQ ID NO: 912150 - RNA, 22 nt, Human
aaauacuuauuuuccuuaucuu

SEQ ID NO: 912151 - RNA, 18 nt, Human
aaaucagaaaaagcccca

SEQ ID NO: 912152 - RNA, 19 nt, Human
aacuaaagaguucuccuca

SEQ ID NO: 912153 - RNA, 20 nt, Human
aagcagcagcaaucaagagu

SEQ ID NO: 912154 - RNA, 23 nt, Human
aaggaucuuuaccuucuaggagc

SEQ ID NO: 912155 - RNA, 24 nt, Human
aaggugacagauggugaaaaggga

SEQ ID NO: 912156 - RNA, 18 nt, Human
aaguguccacacaauacu

SEQ ID NO: 912157 - RNA, 22 nt, Human
aaguuaaaaaaaaaaaaagccc

SEQ ID NO: 912158 - RNA, 19 nt, Human
acaaaaccauagaacugcg

SEQ ID NO: 912159 - RNA, 26 nt, Human
acacccuuucaagcacauccaaagag

SEQ ID NO: 912160 - RNA, 18 nt, Human
acccggcagcaccgauua

SEQ ID NO: 912161 - RNA, 18 nt, Human
acuauaucauugugauug

SEQ ID NO: 912162 - RNA, 27 nt, Human
agaaaagaagugaaacaaaagggaccc

SEQ ID NO: 912163 - RNA, 21 nt, Human
agaguaagcuauacagaauac

SEQ ID NO: 912164 - RNA, 22 nt, Human
agccccagauuucaaaaccacc

SEQ ID NO: 912165 - RNA, 20 nt, Human
agggcacggcggcgaagggg

SEQ ID NO: 912166 - RNA, 23 nt, Human
auacaugguaaaugugaccaucc

SEQ ID NO: 912167 - RNA, 18 nt, Human
auguauuugaugaaugaa

SEQ ID NO: 912168 - RNA, 23 nt, Human
auguggagcccauggagggcggu

SEQ ID NO: 912169 - RNA, 24 nt, Human
caacaagucagaaaaauaaaucag

SEQ ID NO: 912170 - RNA, 22 nt, Human
caacugugaaaaaaaaaaucuc

SEQ ID NO: 912171 - RNA, 23 nt, Human
cacacacccuuucaagcacaucc

SEQ ID NO: 912172 - RNA, 28 nt, Human
cacaccauuuaaaauuuacccaaacaaa

SEQ ID NO: 912173 - RNA, 25 nt, Human
cacacccuuucaagcacauccaaag

SEQ ID NO: 912174 - RNA, 22 nt, Human
cacagaaggaggcgcaucauaa

SEQ ID NO: 912175 - RNA, 19 nt, Human
caggcugaaaagacauacu

SEQ ID NO: 912176 - RNA, 24 nt, Human
cauaaccuaagccacaaaggcuaa

SEQ ID NO: 912177 - RNA, 18 nt, Human
cauagaacugcagguaac

SEQ ID NO: 912178 - RNA, 24 nt, Human
caucagagacucuggcuaaaucaa

SEQ ID NO: 912179 - RNA, 18 nt, Human
caugagcccacacuuuug

SEQ ID NO: 912180 - RNA, 19 nt, Human
ccacaaaggcuaaacuacu

SEQ ID NO: 912181 - RNA, 20 nt, Human
ccccagauuucaaaaccacc

SEQ ID NO: 912182 - RNA, 27 nt, Human
ccgccgccuccgccgcgauccccgccg

SEQ ID NO: 912183 - RNA, 18 nt, Human
ccgccgcgauccccgccg

SEQ ID NO: 912184 - RNA, 23 nt, Human
ccgccgcgauccccgccgagucc

SEQ ID NO: 912185 - RNA, 20 nt, Human
ccgccuccgccgcgaucccc

SEQ ID NO: 912186 - RNA, 21 nt, Human
ccgccuccgccgcgauccccg

SEQ ID NO: 912187 - RNA, 24 nt, Human
ccuacaaguggccaagaagagccu

SEQ ID NO: 912188 - RNA, 18 nt, Human
ccuacaccacacugcacu

SEQ ID NO: 912189 - RNA, 19 nt, Human
ccuccgccgcgauccccgc

SEQ ID NO: 912190 - RNA, 21 nt, Human
ccugccauguuucaucaccau

SEQ ID NO: 912191 - RNA, 26 nt, Human
ccugccauguuucaucaccauguccc

SEQ ID NO: 912192 - RNA, 24 nt, Human
cgccccucugcugucuggucaggu

SEQ ID NO: 912193 - RNA, 20 nt, Human
cgccgccgccgacgccgccg

SEQ ID NO: 912194 - RNA, 19 nt, Human
cuacaaucauguuuaugcc

SEQ ID NO: 912195 - RNA, 20 nt, Human
cugcuucaaugaugcuuaga

SEQ ID NO: 912196 - RNA, 22 nt, Human
cuucgcguaacaccuacaccac

SEQ ID NO: 912197 - RNA, 18 nt, Human
cuuucauuuucugucugc

SEQ ID NO: 912198 - RNA, 19 nt, Human
gaaaaaaaaaaaccccaag

SEQ ID NO: 912199 - RNA, 21 nt, Human
gaaaagaagugaaacaaaacc

SEQ ID NO: 912200 - RNA, 19 nt, Human
gagaaauuacuuuucugaa

SEQ ID NO: 912201 - RNA, 20 nt, Human
gagauggauuuggcuuaaaa

SEQ ID NO: 912202 - RNA, 18 nt, Human
gagcuacagaguucuuua

SEQ ID NO: 912203 - RNA, 19 nt, Human
gcaagacauaaaaaaagaa

SEQ ID NO: 912204 - RNA, 25 nt, Human
gcacggcggcgaagggggcgcgggg

SEQ ID NO: 912205 - RNA, 20 nt, Human
gccagucccgcugcugcucc

SEQ ID NO: 912206 - RNA, 19 nt, Human
gccgccgacgccgccgccg

SEQ ID NO: 912207 - RNA, 21 nt, Human
gccgccgccgacgccgccgcc

SEQ ID NO: 912208 - RNA, 22 nt, Human
gccgccgccgacgccgccgccu

SEQ ID NO: 912209 - RNA, 21 nt, Human
gcuccuuaagcugcaagggaa

SEQ ID NO: 912210 - RNA, 20 nt, Human
ggacuugaaauggaaaauua

SEQ ID NO: 912211 - RNA, 20 nt, Human
gggaccugacuuuggaagcc

SEQ ID NO: 912212 - RNA, 21 nt, Human
guaaacgacauaaacaacuga

SEQ ID NO: 912213 - RNA, 24 nt, Human
guggggcuaguccuuuaaagugau

SEQ ID NO: 912214 - RNA, 20 nt, Human
uaaaaaaaagucacccaaaa

SEQ ID NO: 912215 - RNA, 19 nt, Human
uaaaaaaagaagugaccuu

SEQ ID NO: 912216 - RNA, 23 nt, Human
uaaaaaauuccggacuagaaaaa

SEQ ID NO: 912217 - RNA, 18 nt, Human
uaaaaauagaagcauagc

SEQ ID NO: 912218 - RNA, 21 nt, Human
uaaaaauagaagcauagcauu

SEQ ID NO: 912219 - RNA, 23 nt, Human
uaaccuaagccacaaaggcuaaa

SEQ ID NO: 912220 - RNA, 19 nt, Human
uaagaggacuguugucauc

SEQ ID NO: 912221 - RNA, 22 nt, Human
uacaaagguuaaaaaaaaguca

SEQ ID NO: 912222 - RNA, 22 nt, Human
uacugcuucaaugaugcuuaga

SEQ ID NO: 912223 - RNA, 20 nt, Human
uagagucaggccaagacaaa

SEQ ID NO: 912224 - RNA, 23 nt, Human
uagcccuuuuugcuaaaagcuga

SEQ ID NO: 912225 - RNA, 19 nt, Human
uagcuuacaagaugguuuu

SEQ ID NO: 912226 - RNA, 23 nt, Human
uaggcaaaauacgaaaaaaccaa

SEQ ID NO: 912227 - RNA, 20 nt, Human
uauuaugguuggaucaagca

SEQ ID NO: 912228 - RNA, 21 nt, Human
ucaaugacgacgcugcuguuu

SEQ ID NO: 912229 - RNA, 22 nt, Human
ucacaaacuaacucaacuguga

SEQ ID NO: 912230 - RNA, 19 nt, Human
uccacacaauacugagcuc

SEQ ID NO: 912231 - RNA, 24 nt, Human
uccacucugaaucuuuuuuuuugu

SEQ ID NO: 912232 - RNA, 18 nt, Human
uccagccccugucacccu

SEQ ID NO: 912233 - RNA, 22 nt, Human
uccgcgccgccgcuacaauccc

SEQ ID NO: 912234 - RNA, 23 nt, Human
uccgcgccgccgcuacaauccca

SEQ ID NO: 912235 - RNA, 21 nt, Human
uccuacaaguggccaagaaga

SEQ ID NO: 912236 - RNA, 21 nt, Human
ucgaugccaagcauccaagaa

SEQ ID NO: 912237 - RNA, 20 nt, Human
ucuagacuauuuaauacaga

SEQ ID NO: 912238 - RNA, 21 nt, Human
ucucugcagauguaccacuug

SEQ ID NO: 912239 - RNA, 18 nt, Human
ucuuuggggcccaaagaa

SEQ ID NO: 912240 - RNA, 20 nt, Human
ucuuuggggcccaaagaauu

SEQ ID NO: 912241 - RNA, 21 nt, Human
ugaaaaauaaagcuauauuaa

SEQ ID NO: 912242 - RNA, 23 nt, Human
ugaaaaauauuucuaugggaaua

SEQ ID NO: 912243 - RNA, 18 nt, Human
ugaaaagacauacucuau

SEQ ID NO: 912244 - RNA, 19 nt, Human
ugaaacaaaaccauagaac

SEQ ID NO: 912245 - RNA, 20 nt, Human
ugaaacaaaaccauagaacc

SEQ ID NO: 912246 - RNA, 20 nt, Human
ugaacuaaagaguucuccuc

SEQ ID NO: 912247 - RNA, 19 nt, Human
ugaaugaauaucuaaagua

SEQ ID NO: 912248 - RNA, 21 nt, Human
ugaaugaauaucuaaaguaaa

SEQ ID NO: 912249 - RNA, 23 nt, Human
ugacuuuggaagccaaaggaaaa

SEQ ID NO: 912250 - RNA, 19 nt, Human
ugagcuacagaguucuuua

SEQ ID NO: 912251 - RNA, 23 nt, Human
ugagcuacagaguucuuuauuuu

SEQ ID NO: 912252 - RNA, 26 nt, Human
ugaguuuuuccaugaaaaaaaaaaaa

SEQ ID NO: 912253 - RNA, 22 nt, Human
ugauucgcaaacauuuucaaaa

SEQ ID NO: 912254 - RNA, 23 nt, Human
uggaagguaacuucauuuugggg

SEQ ID NO: 912255 - RNA, 24 nt, Human
uggcaagacauaaaaaaagaagug

SEQ ID NO: 912256 - RNA, 18 nt, Human
uggcuuguauuuccacag

SEQ ID NO: 912257 - RNA, 22 nt, Human
ugguaaaugugaccauccccuc

SEQ ID NO: 912258 - RNA, 20 nt, Human
ugguaucuguuacacuccug

SEQ ID NO: 912259 - RNA, 18 nt, Human
uguacagagccgccccuc

SEQ ID NO: 912260 - RNA, 24 nt, Human
uguaguaaacgacauaaacaacug

SEQ ID NO: 912261 - RNA, 20 nt, Human
ugugaaaaaaaaaaucuccu

SEQ ID NO: 912262 - RNA, 21 nt, Human
ugugaaaaaaaaaaucuccuu

SEQ ID NO: 912263 - RNA, 21 nt, Human
uguggagcccauggagggcgg

SEQ ID NO: 912264 - RNA, 26 nt, Human
uuacaaaaaaaaaaaaaaacuugguu

SEQ ID NO: 912265 - RNA, 20 nt, Human
uuagacauaugcccaacuac

SEQ ID NO: 912266 - RNA, 18 nt, Human
uuccuuaggcaggguggg

SEQ ID NO: 912267 - RNA, 21 nt, Human
uuggaagccaaaggaaaagau

SEQ ID NO: 912268 - RNA, 21 nt, Human
uuggggcccaaagaauuacag

SEQ ID NO: 912269 - RNA, 22 nt, Human
uuggugagcuacagaguucuuu

SEQ ID NO: 912270 - RNA, 23 nt, Human
uuucaggcugauauccauuuaau

SEQ ID NO: 912271 - RNA, 26 nt, Human
uuucugaauugcguuucuccaccuug

SEQ ID NO: 912272 - RNA, 18 nt, Human
uuuucaaaacuuacuggg

SEQ ID NO: 912273 - RNA, 19 nt, Human
uuuucaaaacuuacugggc

SEQ ID NO: 912274 - RNA, 22 nt, Human
aaacaaagaguggggugcagaa

SEQ ID NO: 912275 - RNA, 22 nt, Human
ggacauaacuuuauuggaaaca

SEQ ID NO: 912276 - RNA, 23 nt, Human
uaacuuuauuggaaacaaagagu

SEQ ID NO: 912277 - RNA, 18 nt, Human
aagcauggguaaggaaga

SEQ ID NO: 912278 - RNA, 20 nt, Human
aaggaagaggcuuuauggua

SEQ ID NO: 912279 - RNA, 22 nt, Human
accccaaagcauggguaaggaa

SEQ ID NO: 912280 - RNA, 20 nt, Human
acggccaggaggucugcuga

SEQ ID NO: 912281 - RNA, 19 nt, Human
aggcagcagguuccaaggc

SEQ ID NO: 912282 - RNA, 27 nt, Human
aggccuucagcaaagcuguugcagcuc

SEQ ID NO: 912283 - RNA, 23 nt, Human
aggggugcaggguucucgggagc

SEQ ID NO: 912284 - RNA, 20 nt, Human
caggcaccauucucgcccug

SEQ ID NO: 912285 - RNA, 20 nt, Human
cagguuccaaggcacugggg

SEQ ID NO: 912286 - RNA, 23 nt, Human
ccaaggcacuggggcagcccacg

SEQ ID NO: 912287 - RNA, 20 nt, Human
cccugcgcagggccugccac

SEQ ID NO: 912288 - RNA, 22 nt, Human
cccugcgcagggccugccacuu

SEQ ID NO: 912289 - RNA, 20 nt, Human
cuuuauuggugaaugggaau

SEQ ID NO: 912290 - RNA, 20 nt, Human
ggcaggccaggaggcuggcc

SEQ ID NO: 912291 - RNA, 22 nt, Human
ggccugccacuuggggcaggcc

SEQ ID NO: 912292 - RNA, 21 nt, Human
ggugaaugggaaugugugggu

SEQ ID NO: 912293 - RNA, 23 nt, Human
gugccuuuauuggugaaugggaa

SEQ ID NO: 912294 - RNA, 19 nt, Human
ucagcuguuaacaccccaa

SEQ ID NO: 912295 - RNA, 22 nt, Human
ugcgcagggccugccacuuggg

SEQ ID NO: 912296 - RNA, 22 nt, Human
uggccaggccuucagcaaagcu

SEQ ID NO: 912297 - RNA, 22 nt, Human
uuggagcucaauggccauaugu

SEQ ID NO: 912298 - RNA, 22 nt, Human
aaaaaaagaaaacaagcuucaa

SEQ ID NO: 912299 - RNA, 21 nt, Human
aaaacaggacauacuucacuu

SEQ ID NO: 912300 - RNA, 19 nt, Human
aaaagaaaacaagcuucaa

SEQ ID NO: 912301 - RNA, 24 nt, Human
aaaagaaaacaagcuucaauggaa

SEQ ID NO: 912302 - RNA, 20 nt, Human
aagaacaucaacauuuauuu

SEQ ID NO: 912303 - RNA, 19 nt, Human
aaugaaaagcaaaaaaaua

SEQ ID NO: 912304 - RNA, 25 nt, Human
accuagacuuaagaaaccggggguc

SEQ ID NO: 912305 - RNA, 19 nt, Human
agaaaaugaaaagcaaaaa

SEQ ID NO: 912306 - RNA, 18 nt, Human
agcugacaggaguguggc

SEQ ID NO: 912307 - RNA, 21 nt, Human
auaaaaugaugcucugugacc

SEQ ID NO: 912308 - RNA, 20 nt, Human
caaaagcaucagaacuauga

SEQ ID NO: 912309 - RNA, 23 nt, Human
cacaaugaacauaauuacauuug

SEQ ID NO: 912310 - RNA, 21 nt, Human
caccuagacuuaagaaacauc

SEQ ID NO: 912311 - RNA, 25 nt, Human
cacugcaguagcuaaaaugggaaga

SEQ ID NO: 912312 - RNA, 18 nt, Human
cacugcugaagguccaug

SEQ ID NO: 912313 - RNA, 19 nt, Human
cauuugcauuuaaacaaua

SEQ ID NO: 912314 - RNA, 19 nt, Human
cccaguacuucaaaauacc

SEQ ID NO: 912315 - RNA, 19 nt, Human
cgaaguguacauaugggcc

SEQ ID NO: 912316 - RNA, 23 nt, Human
cuuaagaaacaucgaaaucugga

SEQ ID NO: 912317 - RNA, 19 nt, Human
gaacauaauuacauuugua

SEQ ID NO: 912318 - RNA, 21 nt, Human
ggaagaaaaaaagaaaacaag

SEQ ID NO: 912319 - RNA, 26 nt, Human
ggaagaaaaaaagaaaacaagcuucc

SEQ ID NO: 912320 - RNA, 20 nt, Human
gggaagaaaaaaagaaaaca

SEQ ID NO: 912321 - RNA, 21 nt, Human
gggaagaaaaaaagaaaacaa

SEQ ID NO: 912322 - RNA, 20 nt, Human
uaaaaagcaccuuuacuuau

SEQ ID NO: 912323 - RNA, 24 nt, Human
uaaaaagcaccuuuacuuaugugc

SEQ ID NO: 912324 - RNA, 22 nt, Human
uaaaaugaugcucugugaccaa

SEQ ID NO: 912325 - RNA, 19 nt, Human
uaacaugauaaaaaaagaa

SEQ ID NO: 912326 - RNA, 24 nt, Human
uaacuuuagaaaaugaaaagcaaa

SEQ ID NO: 912327 - RNA, 21 nt, Human
uacaaaucaagugugaaacaa

SEQ ID NO: 912328 - RNA, 21 nt, Human
uagcuaaaaugggaagaaaaa

SEQ ID NO: 912329 - RNA, 23 nt, Human
ucugugaccaaaagcaucagaac

SEQ ID NO: 912330 - RNA, 19 nt, Human
ugaaacaaaagcacugcag

SEQ ID NO: 912331 - RNA, 25 nt, Human
ugaacauaauuacauuuguacacaa

SEQ ID NO: 912332 - RNA, 26 nt, Human
uggcacauuuuaaauacauauauaua

SEQ ID NO: 912333 - RNA, 20 nt, Human
ugugaaacaaaagcacugca

SEQ ID NO: 912334 - RNA, 21 nt, Human
uguggcaguaacugcugacau

SEQ ID NO: 912335 - RNA, 21 nt, Human
uugcuguacacauguauucca

SEQ ID NO: 912336 - RNA, 21 nt, Human
uuguuuuuuuuuuuuuuaaga

SEQ ID NO: 912337 - RNA, 22 nt, Human
uuuaaauacauauauauaaaau

SEQ ID NO: 912338 - RNA, 19 nt, Human
uuuuggaauaaacauuuuc

SEQ ID NO: 912339 - RNA, 21 nt, Human
uuuuuuuuuuuuaagaacauc

SEQ ID NO: 912340 - RNA, 22 nt, Human
uuuuuuuuuuuuuuuuuuuaag

SEQ ID NO: 912341 - RNA, 24 nt, Human
aacccccuucacccagauccccac

SEQ ID NO: 912342 - RNA, 21 nt, Human
aagcaaagcacuggguuugug

SEQ ID NO: 912343 - RNA, 18 nt, Human
aagccucugagcggcaac

SEQ ID NO: 912344 - RNA, 22 nt, Human
aaggcaccccuccccccagcuc

SEQ ID NO: 912345 - RNA, 20 nt, Human
aaggcugaccacacccuaca

SEQ ID NO: 912346 - RNA, 21 nt, Human
aauguguccugcugcuucccc

SEQ ID NO: 912347 - RNA, 24 nt, Human
acagggcaagaaauaucauggaac

SEQ ID NO: 912348 - RNA, 21 nt, Human
accaagcaucuccacugaggc

SEQ ID NO: 912349 - RNA, 23 nt, Human
accaaucugauauccccuuucca

SEQ ID NO: 912350 - RNA, 19 nt, Human
acccagauccccacaccaa

SEQ ID NO: 912351 - RNA, 18 nt, Human
accccaggauggcgaggc

SEQ ID NO: 912352 - RNA, 21 nt, Human
acugcacugggcacuaaccua

SEQ ID NO: 912353 - RNA, 19 nt, Human
acuggguguagaaaugugu

SEQ ID NO: 912354 - RNA, 23 nt, Human
agaggagacagucuggcacugca

SEQ ID NO: 912355 - RNA, 19 nt, Human
agccaggaccucagguggg

SEQ ID NO: 912356 - RNA, 23 nt, Human
agccaugaaggaguggagaggaa

SEQ ID NO: 912357 - RNA, 21 nt, Human
agcugggguccuccucccccg

SEQ ID NO: 912358 - RNA, 24 nt, Human
aggcagacaccaggcgcagaccua

SEQ ID NO: 912359 - RNA, 18 nt, Human
agggggccagggugggga

SEQ ID NO: 912360 - RNA, 19 nt, Human
aggugggcagaggacggcu

SEQ ID NO: 912361 - RNA, 22 nt, Human
caacucuagcagagagaaggcc

SEQ ID NO: 912362 - RNA, 21 nt, Human
cacaaccccagccagggcaag

SEQ ID NO: 912363 - RNA, 18 nt, Human
cacagaccugcuguucuc

SEQ ID NO: 912364 - RNA, 21 nt, Human
cacauaagauagccacaggug

SEQ ID NO: 912365 - RNA, 21 nt, Human
caccacaaccccagccagggc

SEQ ID NO: 912366 - RNA, 22 nt, Human
caccacaaccccagccagggca

SEQ ID NO: 912367 - RNA, 22 nt, Human
cacccagauccccacaccaagc

SEQ ID NO: 912368 - RNA, 24 nt, Human
cacccagauccccacaccaagcau

SEQ ID NO: 912369 - RNA, 18 nt, Human
caccccuccccccagcuc

SEQ ID NO: 912370 - RNA, 20 nt, Human
caccccuccccccagcucag

SEQ ID NO: 912371 - RNA, 22 nt, Human
caccggaccccagcgagcaccc

SEQ ID NO: 912372 - RNA, 21 nt, Human
cagcauuggccucagccaggg

SEQ ID NO: 912373 - RNA, 21 nt, Human
caggaccucaggugggcagag

SEQ ID NO: 912374 - RNA, 19 nt, Human
caggcugaagccucugagc

SEQ ID NO: 912375 - RNA, 22 nt, Human
caucuccucuucaccucuaguc

SEQ ID NO: 912376 - RNA, 23 nt, Human
caugggagugcaggggcaggggg

SEQ ID NO: 912377 - RNA, 22 nt, Human
ccaauggccucuccccaucucu

SEQ ID NO: 912378 - RNA, 22 nt, Human
ccaauguguccugcugcuuccc

SEQ ID NO: 912379 - RNA, 21 nt, Human
ccacaaccccagccagggcaa

SEQ ID NO: 912380 - RNA, 23 nt, Human
ccacaccaagcaucuccacugag

SEQ ID NO: 912381 - RNA, 24 nt, Human
ccacuggagucaccacaaccccag

SEQ ID NO: 912382 - RNA, 22 nt, Human
ccaggcagucgcuacucaaccc

SEQ ID NO: 912383 - RNA, 18 nt, Human
ccccaaggcaccccuccc

SEQ ID NO: 912384 - RNA, 19 nt, Human
ccccaaggcaccccucccc

SEQ ID NO: 912385 - RNA, 20 nt, Human
ccccaaggcaccccuccccc

SEQ ID NO: 912386 - RNA, 24 nt, Human
ccccagccagggcaaggcugaggc

SEQ ID NO: 912387 - RNA, 21 nt, Human
ccccagcgagcacccauaagc

SEQ ID NO: 912388 - RNA, 20 nt, Human
ccccagcucaggccagcugg

SEQ ID NO: 912389 - RNA, 19 nt, Human
cccccuccuuccacucuga

SEQ ID NO: 912390 - RNA, 21 nt, Human
cccccuucacccagaucccca

SEQ ID NO: 912391 - RNA, 18 nt, Human
ccccgcgcuggaaagcuc

SEQ ID NO: 912392 - RNA, 22 nt, Human
ccccgcgcuggaaagcucuaac

SEQ ID NO: 912393 - RNA, 21 nt, Human
ccccgcugcccucccggggca

SEQ ID NO: 912394 - RNA, 20 nt, Human
ccccuuuccaucucccuccu

SEQ ID NO: 912395 - RNA, 23 nt, Human
cccggggcagguggaucaugaga

SEQ ID NO: 912396 - RNA, 21 nt, Human
cccucagacacugcacagacc

SEQ ID NO: 912397 - RNA, 22 nt, Human
cccucagacacugcacagaccu

SEQ ID NO: 912398 - RNA, 22 nt, Human
cccuccuuccacucugaggauc

SEQ ID NO: 912399 - RNA, 24 nt, Human
cccuccuuccacucugaggaucuc

SEQ ID NO: 912400 - RNA, 18 nt, Human
ccgaggggccacgguguu

SEQ ID NO: 912401 - RNA, 18 nt, Human
ccgcugcccucccggggc

SEQ ID NO: 912402 - RNA, 28 nt, Human
ccucccggggcagguggaucaugagagc

SEQ ID NO: 912403 - RNA, 23 nt, Human
ccucugggaccuggccagucacu

SEQ ID NO: 912404 - RNA, 19 nt, Human
ccucugggagccaauggcc

SEQ ID NO: 912405 - RNA, 18 nt, Human
ccucuucaccucuagucc

SEQ ID NO: 912406 - RNA, 20 nt, Human
ccuggcccaggaccacggug

SEQ ID NO: 912407 - RNA, 23 nt, Human
cgaggcagacaccaggcgcagac

SEQ ID NO: 912408 - RNA, 22 nt, Human
cggcaacucuagcagagagaag

SEQ ID NO: 912409 - RNA, 21 nt, Human
cggcuucugaggugugauccc

SEQ ID NO: 912410 - RNA, 20 nt, Human
cgggggaaaccaaucugaua

SEQ ID NO: 912411 - RNA, 22 nt, Human
cuacuaacagccaucucccagg

SEQ ID NO: 912412 - RNA, 21 nt, Human
cucccccgccccuggggcccc

SEQ ID NO: 912413 - RNA, 26 nt, Human
cuccggcuggcaggucccuggcgcag

SEQ ID NO: 912414 - RNA, 19 nt, Human
cucuccggcuggcaggucc

SEQ ID NO: 912415 - RNA, 18 nt, Human
cugaggcugcaugugcuc

SEQ ID NO: 912416 - RNA, 22 nt, Human
cuugggaccgcuggaagucagg

SEQ ID NO: 912417 - RNA, 19 nt, Human
gaccuacuaacagccaucu

SEQ ID NO: 912418 - RNA, 19 nt, Human
gagccccaaggcaccccuc

SEQ ID NO: 912419 - RNA, 19 nt, Human
gaggcucccugugacuugg

SEQ ID NO: 912420 - RNA, 19 nt, Human
gaggggccacgguguuuuc

SEQ ID NO: 912421 - RNA, 21 nt, Human
gauccccacaccaagcaucuc

SEQ ID NO: 912422 - RNA, 21 nt, Human
gcauuggccucagccagggcu

SEQ ID NO: 912423 - RNA, 19 nt, Human
gccccaaggcugaccacac

SEQ ID NO: 912424 - RNA, 22 nt, Human
gcgagccccaaggcaccccucc

SEQ ID NO: 912425 - RNA, 21 nt, Human
gcugcuucccccuccuuccac

SEQ ID NO: 912426 - RNA, 24 nt, Human
ggaaagcucuaacucugcgagccc

SEQ ID NO: 912427 - RNA, 21 nt, Human
ggaccacggugugaguaguga

SEQ ID NO: 912428 - RNA, 21 nt, Human
ggaccuggccagucacugggu

SEQ ID NO: 912429 - RNA, 23 nt, Human
ggagcuucacagcauuggccuca

SEQ ID NO: 912430 - RNA, 20 nt, Human
ggaucaugagagcgccuagc

SEQ ID NO: 912431 - RNA, 25 nt, Human
ggaugcuguugugguuacugcagga

SEQ ID NO: 912432 - RNA, 23 nt, Human
ggcuacauucgucuccagguggg

SEQ ID NO: 912433 - RNA, 24 nt, Human
ggcuacauucgucuccaggugggu

SEQ ID NO: 912434 - RNA, 19 nt, Human
gggccacgguguuuucagu

SEQ ID NO: 912435 - RNA, 18 nt, Human
ggggaacagggcaagaaa

SEQ ID NO: 912436 - RNA, 19 nt, Human
ggggccaggguggggagcc

SEQ ID NO: 912437 - RNA, 21 nt, Human
ggggccaggguggggagccag

SEQ ID NO: 912438 - RNA, 22 nt, Human
ggguggagcugaggaggaaugu

SEQ ID NO: 912439 - RNA, 18 nt, Human
guguuugcuuuucucugu

SEQ ID NO: 912440 - RNA, 19 nt, Human
uaagacaaguccuucucuc

SEQ ID NO: 912441 - RNA, 23 nt, Human
uaagacaaguccuucucucugcc

SEQ ID NO: 912442 - RNA, 18 nt, Human
uaaggccccaaggcugac

SEQ ID NO: 912443 - RNA, 19 nt, Human
uaaggccucauccccccuc

SEQ ID NO: 912444 - RNA, 20 nt, Human
uaaggcuccaccgggggaaa

SEQ ID NO: 912445 - RNA, 21 nt, Human
uacauucgucuccaggugggu

SEQ ID NO: 912446 - RNA, 27 nt, Human
uagcagagagaaggccgaggggccacg

SEQ ID NO: 912447 - RNA, 24 nt, Human
uagggggauaggccucccagauua

SEQ ID NO: 912448 - RNA, 20 nt, Human
ucaacccccuucacccagau

SEQ ID NO: 912449 - RNA, 22 nt, Human
ucaccacaaccccagccagggc

SEQ ID NO: 912450 - RNA, 22 nt, Human
ucagacacugcacagaccugcu

SEQ ID NO: 912451 - RNA, 24 nt, Human
ucaggccagcugggguccuccucc

SEQ ID NO: 912452 - RNA, 24 nt, Human
ucaggcccuggcccaggaccacgg

SEQ ID NO: 912453 - RNA, 25 nt, Human
uccacuggagucaccacaaccccag

SEQ ID NO: 912454 - RNA, 18 nt, Human
uccagggggaacagggca

SEQ ID NO: 912455 - RNA, 19 nt, Human
uccaucuccucuucaccuc

SEQ ID NO: 912456 - RNA, 20 nt, Human
ucccccuccuuccacucuga

SEQ ID NO: 912457 - RNA, 24 nt, Human
uccccuuuccaucucccuccuccc

SEQ ID NO: 912458 - RNA, 24 nt, Human
uccccuuuccaucucccuccuucc

SEQ ID NO: 912459 - RNA, 22 nt, Human
ucccucugggagccaauggccu

SEQ ID NO: 912460 - RNA, 18 nt, Human
uccugcugcuucccccuc

SEQ ID NO: 912461 - RNA, 20 nt, Human
ucuaacucugcgagccccaa

SEQ ID NO: 912462 - RNA, 20 nt, Human
ucuccagguggguggagcug

SEQ ID NO: 912463 - RNA, 20 nt, Human
ucuuucugucucucucucuc

SEQ ID NO: 912464 - RNA, 18 nt, Human
ugacuuggacauuaauga

SEQ ID NO: 912465 - RNA, 24 nt, Human
ugcacauuccagggggaacagggc

SEQ ID NO: 912466 - RNA, 22 nt, Human
ugccugggauagggggauaggc

SEQ ID NO: 912467 - RNA, 18 nt, Human
ugcuuuucucugucuucc

SEQ ID NO: 912468 - RNA, 20 nt, Human
ugcuuuucucugucuucccc

SEQ ID NO: 912469 - RNA, 21 nt, Human
uggagucaccacaaccccagc

SEQ ID NO: 912470 - RNA, 23 nt, Human
uggcagcagcccauggccccagc

SEQ ID NO: 912471 - RNA, 21 nt, Human
ugggaggagcagaggagacag

SEQ ID NO: 912472 - RNA, 21 nt, Human
uggggcugacgaggauaggga

SEQ ID NO: 912473 - RNA, 22 nt, Human
uggucagucuccaccggacccc

SEQ ID NO: 912474 - RNA, 23 nt, Human
ugguggguguguggacacugagg

SEQ ID NO: 912475 - RNA, 19 nt, Human
ugucaaagcccugggucca

SEQ ID NO: 912476 - RNA, 23 nt, Human
ugucaggcuggcuccagaggcag

SEQ ID NO: 912477 - RNA, 19 nt, Human
uguggcucuguggagcuuc

SEQ ID NO: 912478 - RNA, 21 nt, Human
uucacccagauccccacacca

SEQ ID NO: 912479 - RNA, 21 nt, Human
uucccaugggagugcaggggc

SEQ ID NO: 912480 - RNA, 18 nt, Human
uucgucuccaggugggug

SEQ ID NO: 912481 - RNA, 21 nt, Human
uugccaauguguccugcugcu

SEQ ID NO: 912482 - RNA, 22 nt, Human
uuucccuccuuccuccucuccc

SEQ ID NO: 912483 - RNA, 18 nt, Human
aaaaaaccaaaaacaaaa

SEQ ID NO: 912484 - RNA, 22 nt, Human
aaaaaaccauaaaaaaccaaaa

SEQ ID NO: 912485 - RNA, 18 nt, Human
aaaaagcuguaaaacuuc

SEQ ID NO: 912486 - RNA, 18 nt, Human
aaaaccaaaaacaaaaaa

SEQ ID NO: 912487 - RNA, 21 nt, Human
aaaauaaaugaggcuaagguu

SEQ ID NO: 912488 - RNA, 22 nt, Human
aaacaaaaauacucaaaagggc

SEQ ID NO: 912489 - RNA, 23 nt, Human
aaacaauggaaaagaaaggcuuc

SEQ ID NO: 912490 - RNA, 19 nt, Human
aaaggcuucuauuagagaa

SEQ ID NO: 912491 - RNA, 24 nt, Human
aacacacacacaaacgcuucagaa

SEQ ID NO: 912492 - RNA, 19 nt, Human
aacccccaaaaccugguua

SEQ ID NO: 912493 - RNA, 22 nt, Human
aaccugaucaacacacacacaa

SEQ ID NO: 912494 - RNA, 19 nt, Human
aacucaacccccaaaaccu

SEQ ID NO: 912495 - RNA, 22 nt, Human
aagacacaacuacaaacgccau

SEQ ID NO: 912496 - RNA, 24 nt, Human
aagcaaaaauaucacacaaccuga

SEQ ID NO: 912497 - RNA, 21 nt, Human
acaaaaauacucaaaagggca

SEQ ID NO: 912498 - RNA, 20 nt, Human
acaaaauuucaguuuggauu

SEQ ID NO: 912499 - RNA, 19 nt, Human
acaagcaccaguuucaaau

SEQ ID NO: 912500 - RNA, 21 nt, Human
acacacacaaacgcuucagaa

SEQ ID NO: 912501 - RNA, 26 nt, Human
accaaaaacaaaaaaaggaaaaaaaa

SEQ ID NO: 912502 - RNA, 24 nt, Human
accaaagaaaacacagcuuuuugg

SEQ ID NO: 912503 - RNA, 24 nt, Human
acgucuuggaaaggguaugaaggu

SEQ ID NO: 912504 - RNA, 23 nt, Human
acuacaaacgccauagaaagcgg

SEQ ID NO: 912505 - RNA, 21 nt, Human
acuuguaaaacauuuuacaau

SEQ ID NO: 912506 - RNA, 22 nt, Human
agaaauaagcacauuuggauaa

SEQ ID NO: 912507 - RNA, 21 nt, Human
agacaacagguuacuguaacc

SEQ ID NO: 912508 - RNA, 23 nt, Human
agauggagcagacuaugagagcu

SEQ ID NO: 912509 - RNA, 19 nt, Human
agucagugacagacaccgg

SEQ ID NO: 912510 - RNA, 24 nt, Human
aguuuggauuaaauuuacacugug

SEQ ID NO: 912511 - RNA, 21 nt, Human
auaccucuuuagaggccaucc

SEQ ID NO: 912512 - RNA, 21 nt, Human
augaaaaguacacaaccugua

SEQ ID NO: 912513 - RNA, 23 nt, Human
augaaaauuuaaacacagaagua

SEQ ID NO: 912514 - RNA, 22 nt, Human
augaagccuguaugaacguacu

SEQ ID NO: 912515 - RNA, 19 nt, Human
augcaaaugcuaacugaaa

SEQ ID NO: 912516 - RNA, 18 nt, Human
caaaaacaaaaaaaggaa

SEQ ID NO: 912517 - RNA, 20 nt, Human
caaaacucaacccccaaaac

SEQ ID NO: 912518 - RNA, 22 nt, Human
caaaacucaacccccaaaaccu

SEQ ID NO: 912519 - RNA, 19 nt, Human
cacuacuuugaaaggagau

SEQ ID NO: 912520 - RNA, 22 nt, Human
cacuucuuaaaagacacaacua

SEQ ID NO: 912521 - RNA, 26 nt, Human
cagcagcaggugcaaccugggagugc

SEQ ID NO: 912522 - RNA, 23 nt, Human
cagguugaaugaagccuguauga

SEQ ID NO: 912523 - RNA, 24 nt, Human
caguugaaacaaaauuucaguuug

SEQ ID NO: 912524 - RNA, 24 nt, Human
cauaaaaaaccaaaaacaaaaaaa

SEQ ID NO: 912525 - RNA, 22 nt, Human
cauaaaacgugugcuaaggcaa

SEQ ID NO: 912526 - RNA, 23 nt, Human
cauccaaucucuuuagaagacaa

SEQ ID NO: 912527 - RNA, 22 nt, Human
cauuuaaaaguccaggacuuaa

SEQ ID NO: 912528 - RNA, 19 nt, Human
cauuuucuucuauuuguuu

SEQ ID NO: 912529 - RNA, 24 nt, Human
cauuuuguuuuucauaaauuuuga

SEQ ID NO: 912530 - RNA, 22 nt, Human
ccaaaaccugguuaucccagau

SEQ ID NO: 912531 - RNA, 22 nt, Human
cccaaaaccugguuaucccaga

SEQ ID NO: 912532 - RNA, 24 nt, Human
ccccgccauggcguuagugagaac

SEQ ID NO: 912533 - RNA, 20 nt, Human
cccgcagccugcuucucgcu

SEQ ID NO: 912534 - RNA, 22 nt, Human
cccuguucaagggcaaacaaaa

SEQ ID NO: 912535 - RNA, 19 nt, Human
ccugcaggacccugugggc

SEQ ID NO: 912536 - RNA, 19 nt, Human
cgccagcagcaggugcaac

SEQ ID NO: 912537 - RNA, 18 nt, Human
cucaaaagggcaacagca

SEQ ID NO: 912538 - RNA, 20 nt, Human
cugcucaccgccagcagcag

SEQ ID NO: 912539 - RNA, 21 nt, Human
cugucaaaggcagcauuugaa

SEQ ID NO: 912540 - RNA, 23 nt, Human
gaacaggcggccaccacgagcca

SEQ ID NO: 912541 - RNA, 21 nt, Human
gacaagcaccaguuucaaauc

SEQ ID NO: 912542 - RNA, 19 nt, Human
gagagcccccucggggggc

SEQ ID NO: 912543 - RNA, 22 nt, Human
gcaggggugugaauuucaucua

SEQ ID NO: 912544 - RNA, 18 nt, Human
gcccuguucaagggcaaa

SEQ ID NO: 912545 - RNA, 24 nt, Human
gcugaacccccugcucaccgccag

SEQ ID NO: 912546 - RNA, 21 nt, Human
gcuggggagagcccccucggg

SEQ ID NO: 912547 - RNA, 19 nt, Human
gugaaugcguccacccaca

SEQ ID NO: 912548 - RNA, 21 nt, Human
uaaaaaaccaaaaacaaaaaa

SEQ ID NO: 912549 - RNA, 23 nt, Human
uaaaaagauacccaacugaaaua

SEQ ID NO: 912550 - RNA, 25 nt, Human
uaaaaagcaccagagagugagcuga

SEQ ID NO: 912551 - RNA, 21 nt, Human
uaacaaauuuaaacaacaaag

SEQ ID NO: 912552 - RNA, 21 nt, Human
uaagguuuggggcucauucua

SEQ ID NO: 912553 - RNA, 22 nt, Human
uaauguguugugagaaaaccgg

SEQ ID NO: 912554 - RNA, 22 nt, Human
uacagaaggucacugacagaca

SEQ ID NO: 912555 - RNA, 21 nt, Human
uacagaguuuauuuguuguuu

SEQ ID NO: 912556 - RNA, 23 nt, Human
uaccauccagaaagccacuacuu

SEQ ID NO: 912557 - RNA, 20 nt, Human
uacuacagaaggucacugac

SEQ ID NO: 912558 - RNA, 28 nt, Human
uagaagacaauucaacuacaaaaagagc

SEQ ID NO: 912559 - RNA, 24 nt, Human
uaucaagcaaaaauaucacacaac

SEQ ID NO: 912560 - RNA, 21 nt, Human
uaucacacaaccugaucaaca

SEQ ID NO: 912561 - RNA, 25 nt, Human
uaucagaaaauuccaagaacuguca

SEQ ID NO: 912562 - RNA, 28 nt, Human
ucaaaccuaguauaacaaguacuccaua

SEQ ID NO: 912563 - RNA, 19 nt, Human
ucaaaggcagcauuugaaa

SEQ ID NO: 912564 - RNA, 25 nt, Human
ucagaaaauuccaagaacugucaaa

SEQ ID NO: 912565 - RNA, 23 nt, Human
ucagugacagacaccgguuucuc

SEQ ID NO: 912566 - RNA, 25 nt, Human
ucauucuagcuauacuucuaauuau

SEQ ID NO: 912567 - RNA, 21 nt, Human
uccccacaacacugcccuguu

SEQ ID NO: 912568 - RNA, 22 nt, Human
uccgcggggcuccacgucgugc

SEQ ID NO: 912569 - RNA, 20 nt, Human
ucucuuuugcaguccccaca

SEQ ID NO: 912570 - RNA, 21 nt, Human
ucugacaguucugcgacaagc

SEQ ID NO: 912571 - RNA, 23 nt, Human
ucugaccaaagaaaacacagcuu

SEQ ID NO: 912572 - RNA, 20 nt, Human
ucuuuuguauaaauugauuu

SEQ ID NO: 912573 - RNA, 20 nt, Human
ugaaaggagaucugagcuau

SEQ ID NO: 912574 - RNA, 19 nt, Human
ugaaggccaaaacucaacc

SEQ ID NO: 912575 - RNA, 24 nt, Human
ugcugaacccccugcucaccgcca

SEQ ID NO: 912576 - RNA, 19 nt, Human
uggaacugcuuaauaucag

SEQ ID NO: 912577 - RNA, 27 nt, Human
uggaaggugggaaaucaauaacaacgg

SEQ ID NO: 912578 - RNA, 19 nt, Human
uggaauuaccauccagaaa

SEQ ID NO: 912579 - RNA, 25 nt, Human
uggcugguuaauuguuucaaauuug

SEQ ID NO: 912580 - RNA, 19 nt, Human
ugguagggcuggagcgacc

SEQ ID NO: 912581 - RNA, 25 nt, Human
uuaauauuacacaugcaaaugcuaa

SEQ ID NO: 912582 - RNA, 24 nt, Human
uuaccacuuucaauagucauuaau

SEQ ID NO: 912583 - RNA, 22 nt, Human
uuagaagacaauucaacuacaa

SEQ ID NO: 912584 - RNA, 21 nt, Human
uucaaaggagaaaaguauuuu

SEQ ID NO: 912585 - RNA, 19 nt, Human
uucaacuacaaaaagagcc

SEQ ID NO: 912586 - RNA, 22 nt, Human
uuuaaacacagaaguauguaag

SEQ ID NO: 912587 - RNA, 22 nt, Human
uuuaauauaucaggaacaaaga

SEQ ID NO: 912588 - RNA, 24 nt, Human
uuucucacuccgguccccgccaug

SEQ ID NO: 912589 - RNA, 19 nt, Human
uuugcaguccccacaacac

SEQ ID NO: 912590 - RNA, 21 nt, Human
cagccgcggcugcagcgugcg

SEQ ID NO: 912591 - RNA, 25 nt, Human
cagccgcggcugcagcgugcggcgg

SEQ ID NO: 912592 - RNA, 21 nt, Human
cggcugcagcgugcggcggag

SEQ ID NO: 912593 - RNA, 28 nt, Human
aaaaacauacaacucuucaugcuccucc

SEQ ID NO: 912594 - RNA, 24 nt, Human
aaacauacaacucuucaugcuccu

SEQ ID NO: 912595 - RNA, 23 nt, Human
aagcacaguaugacauggccgug

SEQ ID NO: 912596 - RNA, 27 nt, Human
aauuuuuuccuuucaauuuuuauucau

SEQ ID NO: 912597 - RNA, 18 nt, Human
acaagaaaggaagcacag

SEQ ID NO: 912598 - RNA, 20 nt, Human
agaaaggaagcacaguauga

SEQ ID NO: 912599 - RNA, 18 nt, Human
augcucacaugaacaaga

SEQ ID NO: 912600 - RNA, 20 nt, Human
cagaaauucacaagucacuc

SEQ ID NO: 912601 - RNA, 21 nt, Human
cagcaaauacuaagcucccac

SEQ ID NO: 912602 - RNA, 21 nt, Human
cagcacuccaaaaacauacaa

SEQ ID NO: 912603 - RNA, 18 nt, Human
cguggguccucuggggcc

SEQ ID NO: 912604 - RNA, 23 nt, Human
cuccagcacuccaaaaacauaca

SEQ ID NO: 912605 - RNA, 22 nt, Human
gccucaucucugcccacaucac

SEQ ID NO: 912606 - RNA, 22 nt, Human
ucaaucaauguuagaugaaggg

SEQ ID NO: 912607 - RNA, 24 nt, Human
uccaaaaacauacaacucuucaug

SEQ ID NO: 912608 - RNA, 23 nt, Human
uccccagggaacggucaguccca

SEQ ID NO: 912609 - RNA, 19 nt, Human
uuaaaguagguacuaguuc

SEQ ID NO: 912610 - RNA, 20 nt, Human
uuaaaugcucacaugaacaa

SEQ ID NO: 912611 - RNA, 24 nt, Human
uuuuuuuuuuuuuuuuaaauuuuu

SEQ ID NO: 912612 - RNA, 19 nt, Human
aaagaaagaggaaaagaac

SEQ ID NO: 912613 - RNA, 19 nt, Human
aagaggaaaagaacagaag

SEQ ID NO: 912614 - RNA, 20 nt, Human
aagaggaaaagaacagaagc

SEQ ID NO: 912615 - RNA, 19 nt, Human
aagcagaaaucugaaggua

SEQ ID NO: 912616 - RNA, 21 nt, Human
aagcagaaaucugaagguagg

SEQ ID NO: 912617 - RNA, 19 nt, Human
aagcucuuccuccaccccu

SEQ ID NO: 912618 - RNA, 23 nt, Human
aagcucuuccuccaccccuaaau

SEQ ID NO: 912619 - RNA, 20 nt, Human
acaggauuuacagcaagaug

SEQ ID NO: 912620 - RNA, 21 nt, Human
agaaagaggaaaagaacagaa

SEQ ID NO: 912621 - RNA, 25 nt, Human
agacacaaaguaaauauauucaaga

SEQ ID NO: 912622 - RNA, 19 nt, Human
agaugcuacacauagcauc

SEQ ID NO: 912623 - RNA, 22 nt, Human
agcaucauucuggauaagcgac

SEQ ID NO: 912624 - RNA, 22 nt, Human
agccaccucugugagaaaaaag

SEQ ID NO: 912625 - RNA, 19 nt, Human
agcgacaaaggaguaagaa

SEQ ID NO: 912626 - RNA, 23 nt, Human
agggaggaagaggaaacauccaa

SEQ ID NO: 912627 - RNA, 18 nt, Human
agguagguguacaaggaa

SEQ ID NO: 912628 - RNA, 18 nt, Human
auaagggaggaagaggaa

SEQ ID NO: 912629 - RNA, 18 nt, Human
caaagcucuuccuccacc

SEQ ID NO: 912630 - RNA, 19 nt, Human
caagaugcuacacauagca

SEQ ID NO: 912631 - RNA, 19 nt, Human
cacagaaccuuaaacagag

SEQ ID NO: 912632 - RNA, 22 nt, Human
caccccuaaaucucugaauuuu

SEQ ID NO: 912633 - RNA, 19 nt, Human
cagcaagaugcuacacaua

SEQ ID NO: 912634 - RNA, 24 nt, Human
ccaauucagguccccuccuuaucc

SEQ ID NO: 912635 - RNA, 20 nt, Human
cccaaagcucuuccuccacc

SEQ ID NO: 912636 - RNA, 22 nt, Human
cccaaagcucuuccuccacccc

SEQ ID NO: 912637 - RNA, 22 nt, Human
ccccuaaaucucugaauuucua

SEQ ID NO: 912638 - RNA, 23 nt, Human
ccccuaaaucucugaauuucuaa

SEQ ID NO: 912639 - RNA, 20 nt, Human
gagaagguugaaaaaagaaa

SEQ ID NO: 912640 - RNA, 19 nt, Human
gagguuggugagguagaca

SEQ ID NO: 912641 - RNA, 25 nt, Human
ggaagaggaaacauccaacaacuug

SEQ ID NO: 912642 - RNA, 21 nt, Human
ggccaaaccuuauaccucccc

SEQ ID NO: 912643 - RNA, 24 nt, Human
uaaauauauucaagagagacacaa

SEQ ID NO: 912644 - RNA, 22 nt, Human
uaaccaaagaguagaauucgaa

SEQ ID NO: 912645 - RNA, 23 nt, Human
uaacuuuaaccaaagaguagaau

SEQ ID NO: 912646 - RNA, 23 nt, Human
uaagcgacaaaggaguaagaaca

SEQ ID NO: 912647 - RNA, 19 nt, Human
uacaggauuuacagcaaga

SEQ ID NO: 912648 - RNA, 27 nt, Human
uacaggauuuacagcaagaggacauac

SEQ ID NO: 912649 - RNA, 20 nt, Human
uagcaucauucuggauaagc

SEQ ID NO: 912650 - RNA, 19 nt, Human
ucagguccccuccuuaucc

SEQ ID NO: 912651 - RNA, 23 nt, Human
uccccaaagcucuuccuccaccc

SEQ ID NO: 912652 - RNA, 21 nt, Human
ucuuccuccaccccuaaaucu

SEQ ID NO: 912653 - RNA, 18 nt, Human
ugaaaaaagaaagagaga

SEQ ID NO: 912654 - RNA, 24 nt, Human
ugaaaucaaaguguaagcagaaau

SEQ ID NO: 912655 - RNA, 25 nt, Human
ugagaagguugaaaaaagaaagaga

SEQ ID NO: 912656 - RNA, 19 nt, Human
uguuuggaguuugaaggag

SEQ ID NO: 912657 - RNA, 21 nt, Human
uucaagagagacacaaagaaa

SEQ ID NO: 912658 - RNA, 21 nt, Human
uucacgagucaucuuuccuua

SEQ ID NO: 912659 - RNA, 21 nt, Human
uuguggugcagagauauaagg

SEQ ID NO: 912660 - RNA, 23 nt, Human
aaacgcccccuccuccccaaucg

SEQ ID NO: 912661 - RNA, 18 nt, Human
aaacucuuagcagcaagc

SEQ ID NO: 912662 - RNA, 20 nt, Human
aacugaugaaauuuccaccu

SEQ ID NO: 912663 - RNA, 19 nt, Human
aagcugauaaacaauagau

SEQ ID NO: 912664 - RNA, 27 nt, Human
accagaaacgcccccuccuccccaauc

SEQ ID NO: 912665 - RNA, 23 nt, Human
acuccagcuguuggcuuugagua

SEQ ID NO: 912666 - RNA, 22 nt, Human
agcaagcagaaagaacuuauua

SEQ ID NO: 912667 - RNA, 23 nt, Human
agcaugaacuuuuucgggaggaa

SEQ ID NO: 912668 - RNA, 26 nt, Human
agcuuggucaacuguaaguaggguuc

SEQ ID NO: 912669 - RNA, 19 nt, Human
aggcgcaaacaacccacga

SEQ ID NO: 912670 - RNA, 18 nt, Human
agugucaacucaauacca

SEQ ID NO: 912671 - RNA, 21 nt, Human
augaacugggaaaaaaagacc

SEQ ID NO: 912672 - RNA, 21 nt, Human
caccucaaguaaucuuuacau

SEQ ID NO: 912673 - RNA, 20 nt, Human
cacuguucacuuuauuuuuu

SEQ ID NO: 912674 - RNA, 23 nt, Human
caggcuaaaagguuaggaucaaa

SEQ ID NO: 912675 - RNA, 23 nt, Human
ccagaaacgcccccuccucccca

SEQ ID NO: 912676 - RNA, 25 nt, Human
ccaggcgaggcgcaaacaacccacg

SEQ ID NO: 912677 - RNA, 26 nt, Human
ccccaggcgaggcgcaaacaacccac

SEQ ID NO: 912678 - RNA, 20 nt, Human
ccccuauuccuuuuuuaacc

SEQ ID NO: 912679 - RNA, 18 nt, Human
ccccugccaguccugauc

SEQ ID NO: 912680 - RNA, 18 nt, Human
ccuccccaaucgugagag

SEQ ID NO: 912681 - RNA, 25 nt, Human
cgcccccuccuccccaaucgugaga

SEQ ID NO: 912682 - RNA, 26 nt, Human
cgcccccuccuccccaaucgugagag

SEQ ID NO: 912683 - RNA, 21 nt, Human
cuacacuggcccucauauccc

SEQ ID NO: 912684 - RNA, 24 nt, Human
cucaaguaaucuuuacauuucuac

SEQ ID NO: 912685 - RNA, 24 nt, Human
cucuacacuggcccucauaucccc

SEQ ID NO: 912686 - RNA, 21 nt, Human
cucuguaacacucuaccccua

SEQ ID NO: 912687 - RNA, 20 nt, Human
gagcaggcuaaaagguuagg

SEQ ID NO: 912688 - RNA, 22 nt, Human
gaggcgcaaacaacccacgacg

SEQ ID NO: 912689 - RNA, 18 nt, Human
gauaucugaaacucgaaa

SEQ ID NO: 912690 - RNA, 24 nt, Human
gcagaaagaacuuauuaaucagug

SEQ ID NO: 912691 - RNA, 21 nt, Human
ggaucaaaugggcauauccuu

SEQ ID NO: 912692 - RNA, 24 nt, Human
gugagcccgggacacgagggcuga

SEQ ID NO: 912693 - RNA, 19 nt, Human
guguacuggcuuucacuuu

SEQ ID NO: 912694 - RNA, 18 nt, Human
uaagaacaaaguuaacuc

SEQ ID NO: 912695 - RNA, 23 nt, Human
uaagaacaaaguuaacucggacg

SEQ ID NO: 912696 - RNA, 25 nt, Human
uaauaaccagaauaauucaugacac

SEQ ID NO: 912697 - RNA, 24 nt, Human
uacuggcuuucacuuuucccacaa

SEQ ID NO: 912698 - RNA, 18 nt, Human
uaucaagagcaagucugc

SEQ ID NO: 912699 - RNA, 26 nt, Human
uauccucaaauauccuaaauauccaa

SEQ ID NO: 912700 - RNA, 18 nt, Human
ucaagaaggauauggaga

SEQ ID NO: 912701 - RNA, 19 nt, Human
uccccaaucgugagagcuc

SEQ ID NO: 912702 - RNA, 18 nt, Human
ucucucgugagcaugaac

SEQ ID NO: 912703 - RNA, 21 nt, Human
ugaacugggaaaaaaagaccu

SEQ ID NO: 912704 - RNA, 18 nt, Human
uggaaguaguauguggcg

SEQ ID NO: 912705 - RNA, 25 nt, Human
uggaaguaguauguggcgagggggu

SEQ ID NO: 912706 - RNA, 22 nt, Human
uggagcugcgaaccagaaacgc

SEQ ID NO: 912707 - RNA, 21 nt, Human
ugggaaaaaaagaccuggagg

SEQ ID NO: 912708 - RNA, 19 nt, Human
ugucucacaguauauggaa

SEQ ID NO: 912709 - RNA, 21 nt, Human
uguugugaggauaagacauga

SEQ ID NO: 912710 - RNA, 22 nt, Human
uguugugaggauaagacaugaa

SEQ ID NO: 912711 - RNA, 24 nt, Human
uuaaagguaaacuuucugcaugau

SEQ ID NO: 912712 - RNA, 24 nt, Human
uuaguaauaaccagaauaauucau

SEQ ID NO: 912713 - RNA, 24 nt, Human
uuaguauuuugcuucaugucuuca

SEQ ID NO: 912714 - RNA, 20 nt, Human
uuggucaacuguaaguaggg

SEQ ID NO: 912715 - RNA, 19 nt, Human
uuucccacaaacucucucg

SEQ ID NO: 912716 - RNA, 23 nt, Human
uuucccacaaacucucucgugag

SEQ ID NO: 912717 - RNA, 23 nt, Human
uuucuuaucguuugcaaacugau

SEQ ID NO: 912718 - RNA, 23 nt, Human
aaacccggcccccuacucccuca

SEQ ID NO: 912719 - RNA, 19 nt, Human
aagcagcuucccgggcucc

SEQ ID NO: 912720 - RNA, 19 nt, Human
acagacccacagaaggacc

SEQ ID NO: 912721 - RNA, 21 nt, Human
aggagccuggaucccacuccu

SEQ ID NO: 912722 - RNA, 18 nt, Human
cacagggaggcuggcaac

SEQ ID NO: 912723 - RNA, 27 nt, Human
caccaggggccagcgagagagcagcag

SEQ ID NO: 912724 - RNA, 22 nt, Human
cagacccacagaaggaccguac

SEQ ID NO: 912725 - RNA, 18 nt, Human
cagcuucccgggcuccau

SEQ ID NO: 912726 - RNA, 23 nt, Human
caguuuuauuagggaagaggggc

SEQ ID NO: 912727 - RNA, 19 nt, Human
ccacagaaggaccguacga

SEQ ID NO: 912728 - RNA, 21 nt, Human
ccaccccuccccacacccucc

SEQ ID NO: 912729 - RNA, 20 nt, Human
ccagaagacacgcugggcag

SEQ ID NO: 912730 - RNA, 19 nt, Human
ccagccagaagacacgcug

SEQ ID NO: 912731 - RNA, 20 nt, Human
ccaggcucugucacagggag

SEQ ID NO: 912732 - RNA, 22 nt, Human
cccaaacccggcccccuacucc

SEQ ID NO: 912733 - RNA, 20 nt, Human
cccacacccuccuuccggga

SEQ ID NO: 912734 - RNA, 21 nt, Human
ccccaccccuccccacacccu

SEQ ID NO: 912735 - RNA, 27 nt, Human
ccccaccccuccccacacccuccuucc

SEQ ID NO: 912736 - RNA, 22 nt, Human
ccccuccccacacccuccuucc

SEQ ID NO: 912737 - RNA, 18 nt, Human
cccggguucaggcuuccu

SEQ ID NO: 912738 - RNA, 21 nt, Human
cccuccuuccugcuuccgguc

SEQ ID NO: 912739 - RNA, 23 nt, Human
cccuccuuccugcuuccggucuu

SEQ ID NO: 912740 - RNA, 19 nt, Human
cccugccccaccccucccc

SEQ ID NO: 912741 - RNA, 21 nt, Human
cccugccccaccccuccccac

SEQ ID NO: 912742 - RNA, 20 nt, Human
cccugcggagaaggggcaga

SEQ ID NO: 912743 - RNA, 24 nt, Human
cccugcuuccugcgcccuccuucc

SEQ ID NO: 912744 - RNA, 20 nt, Human
cccuuagcaacugagggccc

SEQ ID NO: 912745 - RNA, 22 nt, Human
ccgccucuugguugcuuaacuu

SEQ ID NO: 912746 - RNA, 24 nt, Human
ccucaccaggggccagcgagagag

SEQ ID NO: 912747 - RNA, 20 nt, Human
ccuccccacacccuccuucc

SEQ ID NO: 912748 - RNA, 18 nt, Human
ccucuugguugcuuaacu

SEQ ID NO: 912749 - RNA, 19 nt, Human
ccugccccaccccucccca

SEQ ID NO: 912750 - RNA, 18 nt, Human
cugcgcccuccuuccugc

SEQ ID NO: 912751 - RNA, 18 nt, Human
cugcgcccuccuuccugg

SEQ ID NO: 912752 - RNA, 19 nt, Human
gacaaggugcgggcugcag

SEQ ID NO: 912753 - RNA, 18 nt, Human
ggacuugaagaaccggug

SEQ ID NO: 912754 - RNA, 25 nt, Human
ggcccagcagugacaaggugcgggc

SEQ ID NO: 912755 - RNA, 19 nt, Human
ggcucccugccccaccccu

SEQ ID NO: 912756 - RNA, 18 nt, Human
ggcucugucacagggagg

SEQ ID NO: 912757 - RNA, 20 nt, Human
uaaagugccacuugcguggg

SEQ ID NO: 912758 - RNA, 19 nt, Human
uccaugaggugaagucacc

SEQ ID NO: 912759 - RNA, 21 nt, Human
uccaugaggugaagucaccgc

SEQ ID NO: 912760 - RNA, 20 nt, Human
ucccugccccaccccucccc

SEQ ID NO: 912761 - RNA, 21 nt, Human
ucucaaccgaggaugcagggc

SEQ ID NO: 912762 - RNA, 20 nt, Human
ugagggcccaaacccggccc

SEQ ID NO: 912763 - RNA, 21 nt, Human
ugccagagccacagggcccug

SEQ ID NO: 912764 - RNA, 23 nt, Human
ugccccaccccuccccacacccu

SEQ ID NO: 912765 - RNA, 22 nt, Human
ugcccucggcaccgacagaccc

SEQ ID NO: 912766 - RNA, 20 nt, Human
ugccgaggcaagcagcuucc

SEQ ID NO: 912767 - RNA, 24 nt, Human
ugccggagucaguuuuauuaggga

SEQ ID NO: 912768 - RNA, 20 nt, Human
ugcggagaaggggcagacgg

SEQ ID NO: 912769 - RNA, 19 nt, Human
ugcuuccugcgcccuccuu

SEQ ID NO: 912770 - RNA, 19 nt, Human
uggcaacgccauggccugg

SEQ ID NO: 912771 - RNA, 22 nt, Human
uggcccagcagugacaaggugc

SEQ ID NO: 912772 - RNA, 20 nt, Human
ugugggagaggagccuggau

SEQ ID NO: 912773 - RNA, 19 nt, Human
uuauuagggaagaggggcu

SEQ ID NO: 912774 - RNA, 22 nt, Human
uucaccccaucucuugaaccgc

SEQ ID NO: 912775 - RNA, 21 nt, Human
uucugugggagaggagccugg

SEQ ID NO: 912776 - RNA, 19 nt, Human
uuuuuuuuuuuuuaaggga

SEQ ID NO: 912777 - RNA, 26 nt, Human
uuuuuuuuuuuuuugacgcugccgga

SEQ ID NO: 912778 - RNA, 24 nt, Human
uuuuuuuuuuuuuuuuugacgcug

SEQ ID NO: 912779 - RNA, 24 nt, Human
uuuuuuuuuuuuuuuuuuuaaggg

SEQ ID NO: 912780 - RNA, 27 nt, Human
uuuuuuuuuuuuuuuuuuuuuuugggg

SEQ ID NO: 912781 - RNA, 21 nt, Human
aacaaaacaggcagaggccua

SEQ ID NO: 912782 - RNA, 24 nt, Human
aagacaaacaauacaaaggccaaa

SEQ ID NO: 912783 - RNA, 27 nt, Human
acaauacaaaggccaaaguccucugaa

SEQ ID NO: 912784 - RNA, 18 nt, Human
acccgcgcaggcgccccg

SEQ ID NO: 912785 - RNA, 19 nt, Human
agaaagagcauaaaauuau

SEQ ID NO: 912786 - RNA, 21 nt, Human
agacaaaagggcgggaccuga

SEQ ID NO: 912787 - RNA, 22 nt, Human
agacaaaagggcgggaccugag

SEQ ID NO: 912788 - RNA, 21 nt, Human
agacaaacaauacaaaggccc

SEQ ID NO: 912789 - RNA, 21 nt, Human
agccggcacuggcgacagccg

SEQ ID NO: 912790 - RNA, 23 nt, Human
agccggcggccuggcucccgcgc

SEQ ID NO: 912791 - RNA, 21 nt, Human
aggcagaggccuaggccugga

SEQ ID NO: 912792 - RNA, 20 nt, Human
aggggggagcggccccucag

SEQ ID NO: 912793 - RNA, 22 nt, Human
agguaugggauggagucaggag

SEQ ID NO: 912794 - RNA, 21 nt, Human
aggugaggggagggggcgcuc

SEQ ID NO: 912795 - RNA, 22 nt, Human
caaguuaacaugugcuuccucu

SEQ ID NO: 912796 - RNA, 20 nt, Human
cagcgcgcagccgcgcuggc

SEQ ID NO: 912797 - RNA, 18 nt, Human
caggcagaggccuaggcc

SEQ ID NO: 912798 - RNA, 20 nt, Human
ccaaccccggggggaggggg

SEQ ID NO: 912799 - RNA, 20 nt, Human
ccacaggcuaaagccggcac

SEQ ID NO: 912800 - RNA, 22 nt, Human
ccagcgcacugagacaaaaggg

SEQ ID NO: 912801 - RNA, 21 nt, Human
ccccaccccccggcccccagu

SEQ ID NO: 912802 - RNA, 21 nt, Human
cccccaccccccggcccccag

SEQ ID NO: 912803 - RNA, 24 nt, Human
ccccccaaccccggggggaggggg

SEQ ID NO: 912804 - RNA, 22 nt, Human
ccccccaccccccggcccccag

SEQ ID NO: 912805 - RNA, 20 nt, Human
ccccccggcccccagucccc

SEQ ID NO: 912806 - RNA, 20 nt, Human
ccccggggggaggggggagg

SEQ ID NO: 912807 - RNA, 21 nt, Human
ccccggggggaggggggaggu

SEQ ID NO: 912808 - RNA, 24 nt, Human
cccgcaaagccacccgcgcaggcg

SEQ ID NO: 912809 - RNA, 24 nt, Human
cccggggggaggggggaggugagg

SEQ ID NO: 912810 - RNA, 22 nt, Human
cccuggcucccccccacccccc

SEQ ID NO: 912811 - RNA, 18 nt, Human
ccgccgccgccgucugcg

SEQ ID NO: 912812 - RNA, 22 nt, Human
ccgccucucgccgccgccgccg

SEQ ID NO: 912813 - RNA, 19 nt, Human
ccgcgaggggggagcggcc

SEQ ID NO: 912814 - RNA, 22 nt, Human
ccggcccggcugcuggcugcac

SEQ ID NO: 912815 - RNA, 22 nt, Human
ccggcugcuggcugcacagugg

SEQ ID NO: 912816 - RNA, 18 nt, Human
ccgucugcgucccggcug

SEQ ID NO: 912817 - RNA, 33 nt, Human
ccucccgggcugggugcucucugcuccggcccc

SEQ ID NO: 912818 - RNA, 19 nt, Human
ccucgcccuggcucccccc

SEQ ID NO: 912819 - RNA, 21 nt, Human
ccucgcccuggcuccccccca

SEQ ID NO: 912820 - RNA, 24 nt, Human
ccucucgccgccgccgccgucugc

SEQ ID NO: 912821 - RNA, 25 nt, Human
ccucuucuauuacggaaaugagagu

SEQ ID NO: 912822 - RNA, 22 nt, Human
ccugaggucucgcgcaggcgcu

SEQ ID NO: 912823 - RNA, 23 nt, Human
cgcagccgcggugagggaguacc

SEQ ID NO: 912824 - RNA, 22 nt, Human
cgcccuggcucccccccacccc

SEQ ID NO: 912825 - RNA, 19 nt, Human
cgccgccgccgccgucugc

SEQ ID NO: 912826 - RNA, 25 nt, Human
cgccgucugcgucccggcugccgcg

SEQ ID NO: 912827 - RNA, 23 nt, Human
cgcuccugaccccggccccgcuu

SEQ ID NO: 912828 - RNA, 20 nt, Human
cggccccucagucccggccc

SEQ ID NO: 912829 - RNA, 18 nt, Human
cgggaaggcuggcgggcg

SEQ ID NO: 912830 - RNA, 18 nt, Human
cgggacgacagcguccuc

SEQ ID NO: 912831 - RNA, 24 nt, Human
cucagucccggcccggcugcuggc

SEQ ID NO: 912832 - RNA, 21 nt, Human
cucccccccaccccccggccc

SEQ ID NO: 912833 - RNA, 28 nt, Human
cucccccccaccccccggcccccagucc

SEQ ID NO: 912834 - RNA, 24 nt, Human
cucugcuccggcccccccaacccc

SEQ ID NO: 912835 - RNA, 24 nt, Human
cugaccccggccccgcuuuuuucc

SEQ ID NO: 912836 - RNA, 18 nt, Human
cugugguuccaauccugc

SEQ ID NO: 912837 - RNA, 22 nt, Human
gaagccccaccuuucugcccuu

SEQ ID NO: 912838 - RNA, 19 nt, Human
gaggccuaggccuggaagg

SEQ ID NO: 912839 - RNA, 21 nt, Human
gccucucgccgccgccgccgu

SEQ ID NO: 912840 - RNA, 22 nt, Human
gcgcagccgcaggaagcuaggg

SEQ ID NO: 912841 - RNA, 18 nt, Human
gcggccccucagucccgg

SEQ ID NO: 912842 - RNA, 22 nt, Human
gcgggcgcugccaucccggggc

SEQ ID NO: 912843 - RNA, 19 nt, Human
gcuccggcccccccaaccc

SEQ ID NO: 912844 - RNA, 22 nt, Human
gcugugguuccaauccugccac

SEQ ID NO: 912845 - RNA, 20 nt, Human
ggaaaucacugaagcuuuca

SEQ ID NO: 912846 - RNA, 19 nt, Human
ggaggggggaggugagggg

SEQ ID NO: 912847 - RNA, 24 nt, Human
ggaggggggaggugaggggagggg

SEQ ID NO: 912848 - RNA, 18 nt, Human
gggagggggcgcuccuga

SEQ ID NO: 912849 - RNA, 18 nt, Human
gggcgggaccugaggucu

SEQ ID NO: 912850 - RNA, 19 nt, Human
ggggagggggcgcuccuga

SEQ ID NO: 912851 - RNA, 25 nt, Human
ggggaggggggaggugaggggaggg

SEQ ID NO: 912852 - RNA, 18 nt, Human
ggggagggugaugggggg

SEQ ID NO: 912853 - RNA, 19 nt, Human
ggggcuggggguaucggag

SEQ ID NO: 912854 - RNA, 20 nt, Human
gggggaggggggaggugagg

SEQ ID NO: 912855 - RNA, 23 nt, Human
gggggggugagagguuacgugag

SEQ ID NO: 912856 - RNA, 23 nt, Human
ggggggugagagguuacgugagg

SEQ ID NO: 912857 - RNA, 23 nt, Human
ggugauggggggugguccccggg

SEQ ID NO: 912858 - RNA, 25 nt, Human
ggugauggggggugguccccgggag

SEQ ID NO: 912859 - RNA, 24 nt, Human
guaagacaaacaauacaaaggcca

SEQ ID NO: 912860 - RNA, 22 nt, Human
uaagacaaacaauacaaaggcc

SEQ ID NO: 912861 - RNA, 30 nt, Human
uaagacaaacaauacaaaggccaaaguccc

SEQ ID NO: 912862 - RNA, 23 nt, Human
ucccacaggcuaaagccggcacu

SEQ ID NO: 912863 - RNA, 22 nt, Human
ucccccccaccccccggccccc

SEQ ID NO: 912864 - RNA, 25 nt, Human
uccccgggacgacagcguccucccg

SEQ ID NO: 912865 - RNA, 19 nt, Human
ucccgggcugggugcucuc

SEQ ID NO: 912866 - RNA, 20 nt, Human
ucgccgccgccgccgucugc

SEQ ID NO: 912867 - RNA, 21 nt, Human
ugacagaacaaaacaggcaga

SEQ ID NO: 912868 - RNA, 23 nt, Human
ugacuggggggagggugaugggg

SEQ ID NO: 912869 - RNA, 25 nt, Human
ugagacaaaagggcgggaccugagg

SEQ ID NO: 912870 - RNA, 19 nt, Human
ugaggggagggggcgcucc

SEQ ID NO: 912871 - RNA, 22 nt, Human
ugaggugacuggggggagggug

SEQ ID NO: 912872 - RNA, 23 nt, Human
ugccagaaagagcauaaaauuau

SEQ ID NO: 912873 - RNA, 20 nt, Human
ugcuccggcccccccaaccc

SEQ ID NO: 912874 - RNA, 19 nt, Human
uggaagguaugggauggag

SEQ ID NO: 912875 - RNA, 19 nt, Human
uggcucccccccacccccc

SEQ ID NO: 912876 - RNA, 26 nt, Human
uggcucccccccaccccccggccccc

SEQ ID NO: 912877 - RNA, 20 nt, Human
ugggauggagucaggagacc

SEQ ID NO: 912878 - RNA, 19 nt, Human
ugguccccgggcuccgccu

SEQ ID NO: 912879 - RNA, 20 nt, Human
uuagaaucuuauuugccaga

SEQ ID NO: 912880 - RNA, 19 nt, Human
aaaaggagacagucuugga

SEQ ID NO: 912881 - RNA, 21 nt, Human
acaccguugcccccucagccu

SEQ ID NO: 912882 - RNA, 20 nt, Human
acacuccucugcccccacca

SEQ ID NO: 912883 - RNA, 18 nt, Human
agacacuccucugccccc

SEQ ID NO: 912884 - RNA, 21 nt, Human
agccggguaaaaacuccaggg

SEQ ID NO: 912885 - RNA, 26 nt, Human
agcuguuucccugcagacacuccucu

SEQ ID NO: 912886 - RNA, 23 nt, Human
aggaagggaaaagagaagagggc

SEQ ID NO: 912887 - RNA, 23 nt, Human
aggaaugggaggggcaggaggaa

SEQ ID NO: 912888 - RNA, 24 nt, Human
agggcugggaagcaaauggggcuc

SEQ ID NO: 912889 - RNA, 22 nt, Human
cacaccguugcccccucagccu

SEQ ID NO: 912890 - RNA, 20 nt, Human
cacccucuguuccaucccuc

SEQ ID NO: 912891 - RNA, 24 nt, Human
cacccucuguuccaucccucugcu

SEQ ID NO: 912892 - RNA, 21 nt, Human
caggaaugggaggggcaggag

SEQ ID NO: 912893 - RNA, 21 nt, Human
caucggggcagaggagaagcu

SEQ ID NO: 912894 - RNA, 19 nt, Human
caucuucccucuccuggga

SEQ ID NO: 912895 - RNA, 18 nt, Human
ccaccugggcugggauga

SEQ ID NO: 912896 - RNA, 21 nt, Human
cccccaagaaaggaagggcuc

SEQ ID NO: 912897 - RNA, 18 nt, Human
cccucuguuccaucccuc

SEQ ID NO: 912898 - RNA, 20 nt, Human
ccucucucacccucuguucc

SEQ ID NO: 912899 - RNA, 19 nt, Human
cucagggugaugcagaaaa

SEQ ID NO: 912900 - RNA, 19 nt, Human
cuggcuugcaacaaaauuc

SEQ ID NO: 912901 - RNA, 26 nt, Human
cuuacuguugaacuuccuuuuggaau

SEQ ID NO: 912902 - RNA, 19 nt, Human
gagcuucccagagaggcuc

SEQ ID NO: 912903 - RNA, 21 nt, Human
gaggaagagcuucccagagag

SEQ ID NO: 912904 - RNA, 23 nt, Human
gaggaagagcuucccagagaggc

SEQ ID NO: 912905 - RNA, 18 nt, Human
ggaaagcucaggcagagc

SEQ ID NO: 912906 - RNA, 21 nt, Human
ggaaaggaaucuuuaggcaga

SEQ ID NO: 912907 - RNA, 21 nt, Human
gggaagcaaauggggcucagg

SEQ ID NO: 912908 - RNA, 18 nt, Human
gggaggggcaggaggaag

SEQ ID NO: 912909 - RNA, 26 nt, Human
gggcagagguggcaggcaaagccggg

SEQ ID NO: 912910 - RNA, 24 nt, Human
uaaaaacuccagggcugggaagca

SEQ ID NO: 912911 - RNA, 25 nt, Human
uacaggaagggaaaagagaagaggg

SEQ ID NO: 912912 - RNA, 18 nt, Human
ucacugagauucagcugu

SEQ ID NO: 912913 - RNA, 24 nt, Human
uccagggcugggaagcaaaugggg

SEQ ID NO: 912914 - RNA, 25 nt, Human
uccagggcugggaagcaaauggggc

SEQ ID NO: 912915 - RNA, 22 nt, Human
ucccgagagggaagaguguccu

SEQ ID NO: 912916 - RNA, 23 nt, Human
ucuuggaggugcugcuuacuguu

SEQ ID NO: 912917 - RNA, 20 nt, Human
ucuuucuuccucuucugucu

SEQ ID NO: 912918 - RNA, 22 nt, Human
ugacaacuggcuugcaacaaaa

SEQ ID NO: 912919 - RNA, 24 nt, Human
ugagcguuagucaaagguacagga

SEQ ID NO: 912920 - RNA, 20 nt, Human
ugagguggagacggccacug

SEQ ID NO: 912921 - RNA, 20 nt, Human
ugcagaaaaugugauguugc

SEQ ID NO: 912922 - RNA, 19 nt, Human
ugcagacacuccucugccc

SEQ ID NO: 912923 - RNA, 23 nt, Human
ugccucucucacccucuguucca

SEQ ID NO: 912924 - RNA, 19 nt, Human
ugggaagcaaauggggcuc

SEQ ID NO: 912925 - RNA, 23 nt, Human
ugggaagcaaauggggcucaggg

SEQ ID NO: 912926 - RNA, 24 nt, Human
ugggaagcaaauggggcucagggu

SEQ ID NO: 912927 - RNA, 19 nt, Human
ugggacagacgcuuuuuau

SEQ ID NO: 912928 - RNA, 20 nt, Human
ugggagaaggcagggaaagg

SEQ ID NO: 912929 - RNA, 22 nt, Human
ugggagaaggcagggaaaggaa

SEQ ID NO: 912930 - RNA, 24 nt, Human
ugugaacaucuguucuuucuuccu

SEQ ID NO: 912931 - RNA, 23 nt, Human
uguuucccugcagacacuccucu

SEQ ID NO: 912932 - RNA, 21 nt, Human
uuuauuguccuuguuuuuaac

SEQ ID NO: 912933 - RNA, 18 nt, Human
uuuuuuuuuuuuagggau

SEQ ID NO: 912934 - RNA, 19 nt, Human
aauaauaacaauaaagaga

SEQ ID NO: 912935 - RNA, 24 nt, Human
aauaauaauaacaauaaagagaaa

SEQ ID NO: 912936 - RNA, 20 nt, Human
agaaaaaaaugcaaaggccc

SEQ ID NO: 912937 - RNA, 22 nt, Human
agaaaaaaaugcaaaggccuug

SEQ ID NO: 912938 - RNA, 18 nt, Human
gauucugaccaaaacauu

SEQ ID NO: 912939 - RNA, 20 nt, Human
uacaauagcagagaaaauaa

SEQ ID NO: 912940 - RNA, 27 nt, Human
uacaauagcagagaaaauaauaauaau

SEQ ID NO: 912941 - RNA, 19 nt, Human
uuuuuuuuuuuuuuuuuaa

SEQ ID NO: 912942 - RNA, 22 nt, Human
aaaacgaaaaaacacuaaacau

SEQ ID NO: 912943 - RNA, 22 nt, Human
aaacauaaaagauugcuuaacu

SEQ ID NO: 912944 - RNA, 19 nt, Human
agacagcaauuaaaaucag

SEQ ID NO: 912945 - RNA, 22 nt, Human
cagcaauuaaaaucagacagaa

SEQ ID NO: 912946 - RNA, 21 nt, Human
caugacacaacuguuaaauuu

SEQ ID NO: 912947 - RNA, 18 nt, Human
ccuagacuugauauaauc

SEQ ID NO: 912948 - RNA, 18 nt, Human
cugcacaucucuugguuu

SEQ ID NO: 912949 - RNA, 20 nt, Human
cugcccuguuuguauaaagc

SEQ ID NO: 912950 - RNA, 18 nt, Human
gaagaaaugcauccuuua

SEQ ID NO: 912951 - RNA, 22 nt, Human
gucauuagacagcaauuaaaau

SEQ ID NO: 912952 - RNA, 21 nt, Human
uaaaacgaaaaaacacuaaac

SEQ ID NO: 912953 - RNA, 26 nt, Human
uaaaauaaauaagcagacaugugaaa

SEQ ID NO: 912954 - RNA, 22 nt, Human
uaaaccccaauuaauuacaaag

SEQ ID NO: 912955 - RNA, 19 nt, Human
uaaagcuccacaugccucc

SEQ ID NO: 912956 - RNA, 22 nt, Human
uaggugaauacugucuucuuuu

SEQ ID NO: 912957 - RNA, 21 nt, Human
uguacaucuuuucaucgugcu

SEQ ID NO: 912958 - RNA, 21 nt, Human
ugugaaauaagcaaggaugca

SEQ ID NO: 912959 - RNA, 21 nt, Human
uucaucgugcuuuccccguca

SEQ ID NO: 912960 - RNA, 24 nt, Human
uuuuaaaaauauaaaauaaauaag

SEQ ID NO: 912961 - RNA, 19 nt, Human
aaacaacagugacagcuga

SEQ ID NO: 912962 - RNA, 22 nt, Human
aaagacugaaaagaauacaugc

SEQ ID NO: 912963 - RNA, 21 nt, Human
aagaaaacacacauuguuuua

SEQ ID NO: 912964 - RNA, 18 nt, Human
aagacaugccugguccac

SEQ ID NO: 912965 - RNA, 20 nt, Human
aagcagaguccaauauccua

SEQ ID NO: 912966 - RNA, 20 nt, Human
aagcccuaacaggccaagaa

SEQ ID NO: 912967 - RNA, 23 nt, Human
aagguaagcaacagguggggccc

SEQ ID NO: 912968 - RNA, 23 nt, Human
acagagacgcugugcugcagagg

SEQ ID NO: 912969 - RNA, 22 nt, Human
acccaacucucagaaaaagucc

SEQ ID NO: 912970 - RNA, 21 nt, Human
acucacucauucucuccuucu

SEQ ID NO: 912971 - RNA, 22 nt, Human
agaaaaaguccuugucaaccug

SEQ ID NO: 912972 - RNA, 22 nt, Human
agaagcagagggagaauaugau

SEQ ID NO: 912973 - RNA, 20 nt, Human
agagggagggagggagugag

SEQ ID NO: 912974 - RNA, 22 nt, Human
agagggagggagggagugagag

SEQ ID NO: 912975 - RNA, 26 nt, Human
agagggagggagggagugagaggggu

SEQ ID NO: 912976 - RNA, 19 nt, Human
agcaaacaguagacauucu

SEQ ID NO: 912977 - RNA, 22 nt, Human
agcaacagguggggccccacag

SEQ ID NO: 912978 - RNA, 19 nt, Human
agcacucacucauucucuc

SEQ ID NO: 912979 - RNA, 24 nt, Human
agcauaaaaaccuuuacagagacg

SEQ ID NO: 912980 - RNA, 23 nt, Human
agccuggaggugcuccuagaaac

SEQ ID NO: 912981 - RNA, 18 nt, Human
aggaauucuggauccagu

SEQ ID NO: 912982 - RNA, 24 nt, Human
aggauagguacucaaaaccuccug

SEQ ID NO: 912983 - RNA, 22 nt, Human
aggcagcccucccuccagauca

SEQ ID NO: 912984 - RNA, 22 nt, Human
agggaaaucaaacaaaaucaaa

SEQ ID NO: 912985 - RNA, 22 nt, Human
agguacucaaaaccuccugacc

SEQ ID NO: 912986 - RNA, 21 nt, Human
auggauggaaaaaaauuagau

SEQ ID NO: 912987 - RNA, 22 nt, Human
caaaacauuccagugcuuucuc

SEQ ID NO: 912988 - RNA, 20 nt, Human
caaaagacaugccuggucca

SEQ ID NO: 912989 - RNA, 24 nt, Human
caaaagacaugccugguccacuuu

SEQ ID NO: 912990 - RNA, 24 nt, Human
caaaaucaaacacaaaagacugaa

SEQ ID NO: 912991 - RNA, 19 nt, Human
caaagcaaaagacaugccu

SEQ ID NO: 912992 - RNA, 23 nt, Human
caacagguggggccccacagucc

SEQ ID NO: 912993 - RNA, 24 nt, Human
caagaaaacaacagugacagcuga

SEQ ID NO: 912994 - RNA, 19 nt, Human
caagacccagacacaaaaa

SEQ ID NO: 912995 - RNA, 21 nt, Human
cacagaugaguaucauauaga

SEQ ID NO: 912996 - RNA, 18 nt, Human
cagcauauuccuauguau

SEQ ID NO: 912997 - RNA, 23 nt, Human
cauaaaaaccuuuacagagacgc

SEQ ID NO: 912998 - RNA, 20 nt, Human
cauguaucaguaagcaaagc

SEQ ID NO: 912999 - RNA, 23 nt, Human
ccccaguauauacagccuaaaca

SEQ ID NO: 913000 - RNA, 19 nt, Human
ccuguauggguggcaagga

SEQ ID NO: 913001 - RNA, 21 nt, Human
ccuuccuagugguugcaaaau

SEQ ID NO: 913002 - RNA, 20 nt, Human
ccuugucaaccuggcuccua

SEQ ID NO: 913003 - RNA, 21 nt, Human
cgaaagaaaacugauccauga

SEQ ID NO: 913004 - RNA, 21 nt, Human
cucaaaaccuccugaccuucu

SEQ ID NO: 913005 - RNA, 21 nt, Human
cuccaaggucccucaacuccu

SEQ ID NO: 913006 - RNA, 22 nt, Human
cugccuacaagccaguaagggg

SEQ ID NO: 913007 - RNA, 21 nt, Human
cugcuuucaaggcucauccag

SEQ ID NO: 913008 - RNA, 19 nt, Human
gaagagaaaagaagcagag

SEQ ID NO: 913009 - RNA, 23 nt, Human
gaaggagagagggagggagggag

SEQ ID NO: 913010 - RNA, 22 nt, Human
gacagggagauauaacucuaau

SEQ ID NO: 913011 - RNA, 20 nt, Human
gagggagugagagggguuug

SEQ ID NO: 913012 - RNA, 21 nt, Human
gcaaaagacaugccuggucca

SEQ ID NO: 913013 - RNA, 20 nt, Human
gcacugcucucaaagaaaac

SEQ ID NO: 913014 - RNA, 19 nt, Human
gcgagguagaaaucgcuuc

SEQ ID NO: 913015 - RNA, 21 nt, Human
gcugcuucagaagaauacaga

SEQ ID NO: 913016 - RNA, 23 nt, Human
ggaaaagauuucuagguagcaaa

SEQ ID NO: 913017 - RNA, 22 nt, Human
ggagauauaacucuaauagccc

SEQ ID NO: 913018 - RNA, 19 nt, Human
ggagggagggagugagagg

SEQ ID NO: 913019 - RNA, 22 nt, Human
gggaaggagagagggagggagg

SEQ ID NO: 913020 - RNA, 22 nt, Human
gggagggagggagugagagggg

SEQ ID NO: 913021 - RNA, 24 nt, Human
gggagggagugagagggguuuggg

SEQ ID NO: 913022 - RNA, 18 nt, Human
uaaaaaccuuauuaaaaa

SEQ ID NO: 913023 - RNA, 21 nt, Human
uaaaaagcaacauuuaaucau

SEQ ID NO: 913024 - RNA, 26 nt, Human
uaaaacaguaugacacauuucaagca

SEQ ID NO: 913025 - RNA, 25 nt, Human
uaaacauccucuuauauaacaaaga

SEQ ID NO: 913026 - RNA, 21 nt, Human
uaaauaauuccuugcuuagca

SEQ ID NO: 913027 - RNA, 24 nt, Human
uaacaaaacagacuucuccgucca

SEQ ID NO: 913028 - RNA, 22 nt, Human
uaacaaagauuacaaaaccaau

SEQ ID NO: 913029 - RNA, 20 nt, Human
uaacagaauggauggaaaaa

SEQ ID NO: 913030 - RNA, 22 nt, Human
uaacuaagcaaacuuugaacug

SEQ ID NO: 913031 - RNA, 22 nt, Human
uaagcaaacuuugaacuggauc

SEQ ID NO: 913032 - RNA, 21 nt, Human
uaagcaacagguggggcccca

SEQ ID NO: 913033 - RNA, 24 nt, Human
uaagcaacagguggggccccacag

SEQ ID NO: 913034 - RNA, 25 nt, Human
uaagggagauggaaguuaugcgcaa

SEQ ID NO: 913035 - RNA, 21 nt, Human
uaagguguuuguacuauucuu

SEQ ID NO: 913036 - RNA, 20 nt, Human
uaauacagacaaauuacaac

SEQ ID NO: 913037 - RNA, 22 nt, Human
uaauaggaaaauguaagacacu

SEQ ID NO: 913038 - RNA, 27 nt, Human
uacaaaaccaauaauauucacagauga

SEQ ID NO: 913039 - RNA, 25 nt, Human
uacagaaugggagccaaacagcuaa

SEQ ID NO: 913040 - RNA, 19 nt, Human
uacagccuaaacauccucu

SEQ ID NO: 913041 - RNA, 27 nt, Human
uacaugccauguaucaguaagcaaagc

SEQ ID NO: 913042 - RNA, 20 nt, Human
uaccucaaaagguaagcaac

SEQ ID NO: 913043 - RNA, 21 nt, Human
uagaaaauacaaaguguaaca

SEQ ID NO: 913044 - RNA, 19 nt, Human
uaggaauucuggauccagu

SEQ ID NO: 913045 - RNA, 24 nt, Human
uaggggaaggagagagggagggag

SEQ ID NO: 913046 - RNA, 18 nt, Human
uauuuuuugcugaguacu

SEQ ID NO: 913047 - RNA, 18 nt, Human
ucagaaaaaguccuuguc

SEQ ID NO: 913048 - RNA, 23 nt, Human
uccuccaaggucccucaacuccc

SEQ ID NO: 913049 - RNA, 23 nt, Human
ugaaagaggaauggaaaagauuu

SEQ ID NO: 913050 - RNA, 21 nt, Human
ugaaagcauaaaaaccuuuac

SEQ ID NO: 913051 - RNA, 21 nt, Human
ugaacuaugacuuugacauaa

SEQ ID NO: 913052 - RNA, 21 nt, Human
ugacaagacccagacacaaaa

SEQ ID NO: 913053 - RNA, 23 nt, Human
ugcaaaaugugcacugcucucaa

SEQ ID NO: 913054 - RNA, 23 nt, Human
ugcaucaggcagcccucccucca

SEQ ID NO: 913055 - RNA, 24 nt, Human
ugccugguccacuuuucuccagug

SEQ ID NO: 913056 - RNA, 21 nt, Human
ugcuaagcagaguccaauauc

SEQ ID NO: 913057 - RNA, 18 nt, Human
ugcugcagagggaaauca

SEQ ID NO: 913058 - RNA, 25 nt, Human
ugcuuuauguacccuauuuuuugcu

SEQ ID NO: 913059 - RNA, 19 nt, Human
uggauggaaaaaaauuaga

SEQ ID NO: 913060 - RNA, 24 nt, Human
uggcaaggauagguacucaaaacc

SEQ ID NO: 913061 - RNA, 22 nt, Human
uggggggagaaagagaaagaaa

SEQ ID NO: 913062 - RNA, 24 nt, Human
uguaagcccuaacaggccaagacu

SEQ ID NO: 913063 - RNA, 21 nt, Human
ugucaagucagagaacagggg

SEQ ID NO: 913064 - RNA, 22 nt, Human
uguuagaaaguacacaucucag

SEQ ID NO: 913065 - RNA, 18 nt, Human
uuccaaguaaaaaaacca

SEQ ID NO: 913066 - RNA, 18 nt, Human
uugauccuaaaacaguau

SEQ ID NO: 913067 - RNA, 20 nt, Human
uugauccuaaaacaguauga

SEQ ID NO: 913068 - RNA, 23 nt, Human
uugauccuaaaacaguaugacac

SEQ ID NO: 913069 - RNA, 24 nt, Human
uugauccuaaaacaguaugacaca

SEQ ID NO: 913070 - RNA, 22 nt, Human
uuggccgcaguacuacugggca

SEQ ID NO: 913071 - RNA, 19 nt, Human
uuucuagguagcaaacagu

SEQ ID NO: 913072 - RNA, 30 nt, Human
uuuguaagcccuaacaggccaagacugccg

SEQ ID NO: 913073 - RNA, 20 nt, Human
uuuucaauuccaaccuauuc

SEQ ID NO: 913074 - RNA, 21 nt, Human
uuuucacauccuauguaucuc

SEQ ID NO: 913075 - RNA, 24 nt, Human
aaaugcccccacuguaaucccuac

SEQ ID NO: 913076 - RNA, 19 nt, Human
aacaauguuuuuaagaggu

SEQ ID NO: 913077 - RNA, 22 nt, Human
augaaauagaguugugcuuuga

SEQ ID NO: 913078 - RNA, 20 nt, Human
ccgcgccgccccgugacugc

SEQ ID NO: 913079 - RNA, 24 nt, Human
cgguggcggcggccacaccccuga

SEQ ID NO: 913080 - RNA, 26 nt, Human
cucccaggacuaagcucgcggccuag

SEQ ID NO: 913081 - RNA, 26 nt, Human
cuuacgguggcggcggccacaccccu

SEQ ID NO: 913082 - RNA, 18 nt, Human
gaaaugcccccacuguaa

SEQ ID NO: 913083 - RNA, 23 nt, Human
gaaaugcccccacuguaaucccu

SEQ ID NO: 913084 - RNA, 22 nt, Human
gcagacccaggauuccuggcca

SEQ ID NO: 913085 - RNA, 24 nt, Human
gcccccacuguaaucccuaccaua

SEQ ID NO: 913086 - RNA, 18 nt, Human
gccccgugacugcagccc

SEQ ID NO: 913087 - RNA, 23 nt, Human
ggcgacggaggcggcucccagga

SEQ ID NO: 913088 - RNA, 21 nt, Human
ggggagaaugauuccuuuuuc

SEQ ID NO: 913089 - RNA, 19 nt, Human
guggcggcggccacacccc

SEQ ID NO: 913090 - RNA, 26 nt, Human
guugguuuucuuguuaagauaaucug

SEQ ID NO: 913091 - RNA, 21 nt, Human
uaagcucgcggccuagccuua

SEQ ID NO: 913092 - RNA, 19 nt, Human
uaucaagaaagauaauaac

SEQ ID NO: 913093 - RNA, 20 nt, Human
uaucaagaaagauaauaaca

SEQ ID NO: 913094 - RNA, 20 nt, Human
uccuggccagaagcaugaaa

SEQ ID NO: 913095 - RNA, 18 nt, Human
uccuuuuucuagaaucag

SEQ ID NO: 913096 - RNA, 30 nt, Human
ucugacggcggcgacggaggcggcucccuu

SEQ ID NO: 913097 - RNA, 22 nt, Human
ugcagacccaggauuccuggcc

SEQ ID NO: 913098 - RNA, 25 nt, Human
ugggagggaggggagaaugauuccu

SEQ ID NO: 913099 - RNA, 19 nt, Human
ugggcuggggcccuccgcg

SEQ ID NO: 913100 - RNA, 19 nt, Human
uggugggagggaggggaga

SEQ ID NO: 913101 - RNA, 19 nt, Human
uguggugggagggagggga

SEQ ID NO: 913102 - RNA, 19 nt, Human
uuccaaaguugcagaccca

SEQ ID NO: 913103 - RNA, 23 nt, Human
uuuuuuguucuuccaaaaauuua

SEQ ID NO: 913104 - RNA, 18 nt, Human
uuuuuuuuuuuuuuuuug

SEQ ID NO: 913105 - RNA, 24 nt, Human
uuuuuuuuuuuuuuuuuuguucuu

SEQ ID NO: 913106 - RNA, 22 nt, Human
aaaucagaauauggcuaaagug

SEQ ID NO: 913107 - RNA, 19 nt, Human
agaaaaacaaacuugaagg

SEQ ID NO: 913108 - RNA, 19 nt, Human
ccccgagaaaaacaaacuu

SEQ ID NO: 913109 - RNA, 23 nt, Human
gagcauguggauuaucuggcagg

SEQ ID NO: 913110 - RNA, 26 nt, Human
gaugagagagaugcccccgagaaaaa

SEQ ID NO: 913111 - RNA, 20 nt, Human
gauuuguuuuuauuuuccuu

SEQ ID NO: 913112 - RNA, 20 nt, Human
uggcaggcugauguagcugu

SEQ ID NO: 913113 - RNA, 23 nt, Human
uuuauuuuccuuuuuaaaaauca

SEQ ID NO: 913114 - RNA, 18 nt, Human
aaaucccccccacccucc

SEQ ID NO: 913115 - RNA, 21 nt, Human
aauuauggucaucuguuuuca

SEQ ID NO: 913116 - RNA, 21 nt, Human
acaaaucccccccacccuccc

SEQ ID NO: 913117 - RNA, 18 nt, Human
accacgacaaaguugugg

SEQ ID NO: 913118 - RNA, 18 nt, Human
agaucagcacuguccagu

SEQ ID NO: 913119 - RNA, 20 nt, Human
aguauaaacauuuaagaacc

SEQ ID NO: 913120 - RNA, 23 nt, Human
caaaucccccccacccucccaau

SEQ ID NO: 913121 - RNA, 24 nt, Human
caaaucccccccacccucccaauc

SEQ ID NO: 913122 - RNA, 20 nt, Human
cagaaucccuagaucagcac

SEQ ID NO: 913123 - RNA, 26 nt, Human
cauaucccaaagugaaaucagcagga

SEQ ID NO: 913124 - RNA, 19 nt, Human
cauugugcugaacacuuuc

SEQ ID NO: 913125 - RNA, 22 nt, Human
cccagccccuugccauccuuuu

SEQ ID NO: 913126 - RNA, 19 nt, Human
ccccacccucccaaucuaa

SEQ ID NO: 913127 - RNA, 23 nt, Human
ccccacccucccaaucuaaaauc

SEQ ID NO: 913128 - RNA, 21 nt, Human
ccccccacccucccaaucuaa

SEQ ID NO: 913129 - RNA, 21 nt, Human
cccccccacccucccaaucua

SEQ ID NO: 913130 - RNA, 23 nt, Human
ccuuuuagggcaaggaaaccagg

SEQ ID NO: 913131 - RNA, 27 nt, Human
cuacaaaucccccccacccucccaauc

SEQ ID NO: 913132 - RNA, 18 nt, Human
gcaaggaaaccaggcuca

SEQ ID NO: 913133 - RNA, 21 nt, Human
gccucaaacaacuucuuagaa

SEQ ID NO: 913134 - RNA, 19 nt, Human
gugaaaucagcaggagauu

SEQ ID NO: 913135 - RNA, 22 nt, Human
uaaaaagauaaccuacacacau

SEQ ID NO: 913136 - RNA, 23 nt, Human
uaaagauuacuggcucaagacca

SEQ ID NO: 913137 - RNA, 21 nt, Human
uaagauacaauuugcacugaa

SEQ ID NO: 913138 - RNA, 21 nt, Human
uacaaaucccccccacccucc

SEQ ID NO: 913139 - RNA, 21 nt, Human
uauaaagauuacuggcucaag

SEQ ID NO: 913140 - RNA, 21 nt, Human
uauaauaacaacaacuacuga

SEQ ID NO: 913141 - RNA, 24 nt, Human
ucaccugaagauuaucaaugcuau

SEQ ID NO: 913142 - RNA, 21 nt, Human
ucccccccacccucccaaucu

SEQ ID NO: 913143 - RNA, 25 nt, Human
ucccccccacccucccaaucuaaaa

SEQ ID NO: 913144 - RNA, 18 nt, Human
ugaaguguaaacuugaaa

SEQ ID NO: 913145 - RNA, 21 nt, Human
ugggaguguccgguacagggg

SEQ ID NO: 913146 - RNA, 18 nt, Human
uguccaguaacucugcag

SEQ ID NO: 913147 - RNA, 22 nt, Human
uguccgguacaggggccacgag

SEQ ID NO: 913148 - RNA, 22 nt, Human
ugugcugaacacuuucauggau

SEQ ID NO: 913149 - RNA, 21 nt, Human
uuaugcuacaaauccccccca

SEQ ID NO: 913150 - RNA, 21 nt, Human
uucuacgaucagcagugagcu

SEQ ID NO: 913151 - RNA, 24 nt, Human
uuugccucaaacaacuucuuagaa

SEQ ID NO: 913152 - RNA, 19 nt, Human
aagaguugucaucaggggu

SEQ ID NO: 913153 - RNA, 21 nt, Human
aagcaaccucagaguugagau

SEQ ID NO: 913154 - RNA, 23 nt, Human
aaggagucagggacgaaacaagc

SEQ ID NO: 913155 - RNA, 19 nt, Human
acagagaauugcaacacag

SEQ ID NO: 913156 - RNA, 28 nt, Human
agacaagggagugugaggcuugggggug

SEQ ID NO: 913157 - RNA, 19 nt, Human
agagggccuucggguaggg

SEQ ID NO: 913158 - RNA, 19 nt, Human
agccaacuauaggccgaga

SEQ ID NO: 913159 - RNA, 21 nt, Human
agggagugugaggcuuggggg

SEQ ID NO: 913160 - RNA, 19 nt, Human
agggccuucggguaggggc

SEQ ID NO: 913161 - RNA, 18 nt, Human
aggggacaguggcccaaa

SEQ ID NO: 913162 - RNA, 20 nt, Human
aggucuuggcuuaacagucu

SEQ ID NO: 913163 - RNA, 27 nt, Human
caaagugagagagugaggacaaagcca

SEQ ID NO: 913164 - RNA, 21 nt, Human
cagggaggggacaguggccca

SEQ ID NO: 913165 - RNA, 18 nt, Human
cauaagaguugucaucag

SEQ ID NO: 913166 - RNA, 21 nt, Human
ccaacuauaggccgagaugga

SEQ ID NO: 913167 - RNA, 21 nt, Human
ccuccuggugguggaacccug

SEQ ID NO: 913168 - RNA, 22 nt, Human
ccuccuggugguggaacccugg

SEQ ID NO: 913169 - RNA, 21 nt, Human
ccuucggguaggggcaggggu

SEQ ID NO: 913170 - RNA, 22 nt, Human
ccuuggcuggaaagguagaggu

SEQ ID NO: 913171 - RNA, 19 nt, Human
cuauaggccgagauggaug

SEQ ID NO: 913172 - RNA, 19 nt, Human
cuccuggaucucuuagaga

SEQ ID NO: 913173 - RNA, 22 nt, Human
cuggaucagggaggggacagug

SEQ ID NO: 913174 - RNA, 22 nt, Human
cuuggggguggcucccuccugg

SEQ ID NO: 913175 - RNA, 19 nt, Human
gacagagaauugcaacaca

SEQ ID NO: 913176 - RNA, 23 nt, Human
gagggcagaggggcuguuggcag

SEQ ID NO: 913177 - RNA, 22 nt, Human
gcagugcuggagggagacaggc

SEQ ID NO: 913178 - RNA, 20 nt, Human
gccaugggaggggaggaaug

SEQ ID NO: 913179 - RNA, 21 nt, Human
gccucggcagagaaccucggc

SEQ ID NO: 913180 - RNA, 19 nt, Human
ggcgggccaggaugaggug

SEQ ID NO: 913181 - RNA, 19 nt, Human
gggugguugugguaugugg

SEQ ID NO: 913182 - RNA, 20 nt, Human
gggugguugugguauguggc

SEQ ID NO: 913183 - RNA, 22 nt, Human
gguagagaagucaugaaggcca

SEQ ID NO: 913184 - RNA, 18 nt, Human
gguauuucugguuggccu

SEQ ID NO: 913185 - RNA, 18 nt, Human
gguugugguauguggcug

SEQ ID NO: 913186 - RNA, 23 nt, Human
guccuuggggguggcucccuccu

SEQ ID NO: 913187 - RNA, 21 nt, Human
gugcagccugacagguuguga

SEQ ID NO: 913188 - RNA, 24 nt, Human
guggaacccuggaucagggagggg

SEQ ID NO: 913189 - RNA, 25 nt, Human
guuggccucggcagagaaccucggc

SEQ ID NO: 913190 - RNA, 19 nt, Human
uaaggagucagggacgaaa

SEQ ID NO: 913191 - RNA, 20 nt, Human
uccaggugugauucuaaaau

SEQ ID NO: 913192 - RNA, 19 nt, Human
ucuuggcuuaacagucugg

SEQ ID NO: 913193 - RNA, 24 nt, Human
ugaaauggaguggcaguauguagg

SEQ ID NO: 913194 - RNA, 21 nt, Human
ugacagguugugacuugggua

SEQ ID NO: 913195 - RNA, 24 nt, Human
ugagggcagaggggcuguuggcag

SEQ ID NO: 913196 - RNA, 20 nt, Human
ugcagccugacagguuguga

SEQ ID NO: 913197 - RNA, 19 nt, Human
uggaacccuggaucaggga

SEQ ID NO: 913198 - RNA, 26 nt, Human
uggcaggguccuuggggguggcuccc

SEQ ID NO: 913199 - RNA, 24 nt, Human
ugggaggggaggaauggggugcgg

SEQ ID NO: 913200 - RNA, 22 nt, Human
ugugaggcuugggggugguugu

SEQ ID NO: 913201 - RNA, 18 nt, Human
ugugagggcagaggggcu

SEQ ID NO: 913202 - RNA, 18 nt, Human
uguguggacagagggccu

SEQ ID NO: 913203 - RNA, 23 nt, Human
uuccagcuuccaagggguauuuc

SEQ ID NO: 913204 - RNA, 19 nt, Human
uugcaacacaggauuaagg

SEQ ID NO: 913205 - RNA, 19 nt, Human
uuuagugauggcgaucaag

SEQ ID NO: 913206 - RNA, 22 nt, Human
uuugaccacugucaaaguccag

SEQ ID NO: 913207 - RNA, 19 nt, Human
agaguguggacggcagccc

SEQ ID NO: 913208 - RNA, 20 nt, Human
agggggacacaaggugcuga

SEQ ID NO: 913209 - RNA, 18 nt, Human
caaagggaguggggccuc

SEQ ID NO: 913210 - RNA, 21 nt, Human
cagcaggggagggagggcagu

SEQ ID NO: 913211 - RNA, 18 nt, Human
ggggacacaaggugcuga

SEQ ID NO: 913212 - RNA, 21 nt, Human
ucccaggacucugaccgggag

SEQ ID NO: 913213 - RNA, 21 nt, Human
ugaccgggagaguguggacgg

SEQ ID NO: 913214 - RNA, 18 nt, Human
uggacggcagcccuggaa

SEQ ID NO: 913215 - RNA, 19 nt, Human
uuggagagacccagcaggg

SEQ ID NO: 913216 - RNA, 19 nt, Human
aaacaaaaacacguuaaca

SEQ ID NO: 913217 - RNA, 20 nt, Human
aaacaaaauuacuucccaaa

SEQ ID NO: 913218 - RNA, 21 nt, Human
aaacaaaauuacuucccaaac

SEQ ID NO: 913219 - RNA, 24 nt, Human
aaauaaccaccaaagcccgggaac

SEQ ID NO: 913220 - RNA, 22 nt, Human
aagaaauagcaaagcaccucaa

SEQ ID NO: 913221 - RNA, 20 nt, Human
aagagaaaacaaaaggcucu

SEQ ID NO: 913222 - RNA, 24 nt, Human
aagcaccucaaaaauuuagaaaua

SEQ ID NO: 913223 - RNA, 20 nt, Human
aauacuauccauucuccagc

SEQ ID NO: 913224 - RNA, 20 nt, Human
acaaaacacaucucuccucc

SEQ ID NO: 913225 - RNA, 24 nt, Human
acaauacuauccauucuccagcuc

SEQ ID NO: 913226 - RNA, 21 nt, Human
acacacagacccaaaguucca

SEQ ID NO: 913227 - RNA, 21 nt, Human
accaccaaagcccgggaacaa

SEQ ID NO: 913228 - RNA, 20 nt, Human
acccaaaguuccagggagcu

SEQ ID NO: 913229 - RNA, 23 nt, Human
agaaauaaccaccaaagcccggg

SEQ ID NO: 913230 - RNA, 19 nt, Human
agaauccauuggcuggaaa

SEQ ID NO: 913231 - RNA, 23 nt, Human
agacaggaaaaaagagaagggac

SEQ ID NO: 913232 - RNA, 23 nt, Human
agcagaaaacguaguguuaagug

SEQ ID NO: 913233 - RNA, 21 nt, Human
aggaaaaaagagaaaacaaaa

SEQ ID NO: 913234 - RNA, 18 nt, Human
aggucaucaaccacagac

SEQ ID NO: 913235 - RNA, 24 nt, Human
auagacaggaaaaaagagaaaaca

SEQ ID NO: 913236 - RNA, 21 nt, Human
aucaacuuguacagaauauca

SEQ ID NO: 913237 - RNA, 24 nt, Human
auccauucuccagcucuucuccag

SEQ ID NO: 913238 - RNA, 20 nt, Human
caaacaaaaacacguuaaca

SEQ ID NO: 913239 - RNA, 26 nt, Human
caaacaaaaacacguuaacaaucgaa

SEQ ID NO: 913240 - RNA, 23 nt, Human
caaagcaccucaaaaauuuagaa

SEQ ID NO: 913241 - RNA, 19 nt, Human
caaagcccgggaacaaaug

SEQ ID NO: 913242 - RNA, 21 nt, Human
caaagcccgggaacaaaugug

SEQ ID NO: 913243 - RNA, 20 nt, Human
caaaugaacuuacagcugga

SEQ ID NO: 913244 - RNA, 23 nt, Human
caagaaauagcaaagcaccucaa

SEQ ID NO: 913245 - RNA, 22 nt, Human
cacagacccaaaguuccaggga

SEQ ID NO: 913246 - RNA, 19 nt, Human
cagacccaaaguuccaggg

SEQ ID NO: 913247 - RNA, 18 nt, Human
cauccccaagccccucaa

SEQ ID NO: 913248 - RNA, 22 nt, Human
cauccccaagccccucaagggc

SEQ ID NO: 913249 - RNA, 21 nt, Human
ccaccaaagcccgggaacaaa

SEQ ID NO: 913250 - RNA, 21 nt, Human
ccccaagccccucaagggccu

SEQ ID NO: 913251 - RNA, 22 nt, Human
ccccaagccccucaagggccuu

SEQ ID NO: 913252 - RNA, 24 nt, Human
cccgaauauuccugaaaacuuuua

SEQ ID NO: 913253 - RNA, 20 nt, Human
ccuccagagcuggagaacuc

SEQ ID NO: 913254 - RNA, 19 nt, Human
ccucuaaaacgcaucaggg

SEQ ID NO: 913255 - RNA, 21 nt, Human
ccuuuggucucacacagaaau

SEQ ID NO: 913256 - RNA, 23 nt, Human
cucaugugucacacacagaccca

SEQ ID NO: 913257 - RNA, 24 nt, Human
cuugaagaugccucuucuaguccu

SEQ ID NO: 913258 - RNA, 22 nt, Human
gagacagagcauagacaggaaa

SEQ ID NO: 913259 - RNA, 22 nt, Human
gagcuuacaaucuaggcccuaa

SEQ ID NO: 913260 - RNA, 20 nt, Human
gcccgaauauuccugaaaac

SEQ ID NO: 913261 - RNA, 25 nt, Human
gcuggagaacuccaacugugagucu

SEQ ID NO: 913262 - RNA, 19 nt, Human
ggagaacuccaacugugag

SEQ ID NO: 913263 - RNA, 23 nt, Human
uaaugcagcuccuucagcaccuc

SEQ ID NO: 913264 - RNA, 23 nt, Human
uauccauucuccagcucuucucc

SEQ ID NO: 913265 - RNA, 21 nt, Human
ucaugugucacacacagaccc

SEQ ID NO: 913266 - RNA, 23 nt, Human
uccaaacaaacucaccagacagg

SEQ ID NO: 913267 - RNA, 24 nt, Human
uccauuggcuggaaaccgccgacc

SEQ ID NO: 913268 - RNA, 21 nt, Human
ucccaaacaaaaacacguuaa

SEQ ID NO: 913269 - RNA, 22 nt, Human
uccuucagcaccuccagagcug

SEQ ID NO: 913270 - RNA, 18 nt, Human
ucuccagcucuucuccag

SEQ ID NO: 913271 - RNA, 24 nt, Human
ucuccagcucuucuccagauucac

SEQ ID NO: 913272 - RNA, 21 nt, Human
ucugguccuuucuucaguagu

SEQ ID NO: 913273 - RNA, 23 nt, Human
ugaaaacuuuuacccuuuuucaa

SEQ ID NO: 913274 - RNA, 20 nt, Human
ugccucggaaccgcaauagc

SEQ ID NO: 913275 - RNA, 22 nt, Human
ugccucggaaccgcaauagcga

SEQ ID NO: 913276 - RNA, 24 nt, Human
uuaggucugcuacucaaaugaacu

SEQ ID NO: 913277 - RNA, 23 nt, Human
uucaaacaaaauuacuucccaaa

SEQ ID NO: 913278 - RNA, 21 nt, Human
uucaguaguugcugcauggag

SEQ ID NO: 913279 - RNA, 24 nt, Human
uucccaaacaaaaacacguuaaca

SEQ ID NO: 913280 - RNA, 18 nt, Human
uucuccagauucacgagu

SEQ ID NO: 913281 - RNA, 21 nt, Human
uucuccagggugucagccaau

SEQ ID NO: 913282 - RNA, 18 nt, Human
uugaacaaaacacaucuc

SEQ ID NO: 913283 - RNA, 18 nt, Human
uuuucuucucagagaagc

SEQ ID NO: 913284 - RNA, 22 nt, Human
aaauaaccauugccccaccaug

SEQ ID NO: 913285 - RNA, 23 nt, Human
aaccaaauaaccauugccccacc

SEQ ID NO: 913286 - RNA, 19 nt, Human
aacucgccacuuucuccuc

SEQ ID NO: 913287 - RNA, 23 nt, Human
aaucacuauguuuuaaagacaga

SEQ ID NO: 913288 - RNA, 22 nt, Human
accaaagcacaucauuuuguuu

SEQ ID NO: 913289 - RNA, 20 nt, Human
accaaauaaccauugcccca

SEQ ID NO: 913290 - RNA, 22 nt, Human
accaaauaaccauugccccacc

SEQ ID NO: 913291 - RNA, 18 nt, Human
agaacaucaugacuaaaa

SEQ ID NO: 913292 - RNA, 18 nt, Human
agacacuugacuacuacu

SEQ ID NO: 913293 - RNA, 20 nt, Human
auaccaaagucuuuggaaca

SEQ ID NO: 913294 - RNA, 19 nt, Human
augcaguuaagucaauuga

SEQ ID NO: 913295 - RNA, 22 nt, Human
auuucauuuuguuacuggacag

SEQ ID NO: 913296 - RNA, 24 nt, Human
auuucauuuuguuacuggacagaa

SEQ ID NO: 913297 - RNA, 19 nt, Human
caaagcacaucauuuuguu

SEQ ID NO: 913298 - RNA, 19 nt, Human
caacagaauaacuguuacc

SEQ ID NO: 913299 - RNA, 18 nt, Human
caauuacaaguuugaaau

SEQ ID NO: 913300 - RNA, 22 nt, Human
cacuauguuuuaaagacagagu

SEQ ID NO: 913301 - RNA, 20 nt, Human
cccaccaugaacauggggcu

SEQ ID NO: 913302 - RNA, 24 nt, Human
cggaacucgccacuuucuccuccc

SEQ ID NO: 913303 - RNA, 20 nt, Human
cuacagauagaagaaaaaca

SEQ ID NO: 913304 - RNA, 18 nt, Human
cuggaguaaagguugggc

SEQ ID NO: 913305 - RNA, 18 nt, Human
cuguaugucccucccuca

SEQ ID NO: 913306 - RNA, 18 nt, Human
cuguuuugagauuucauu

SEQ ID NO: 913307 - RNA, 20 nt, Human
cuuuuuuuccaaagcuuucu

SEQ ID NO: 913308 - RNA, 24 nt, Human
gagggcaaggacaacagugcaguc

SEQ ID NO: 913309 - RNA, 22 nt, Human
gcaauaucaaagaccuagacac

SEQ ID NO: 913310 - RNA, 30 nt, Human
gccagcucuuuuuuuccaaagcuuucuuuu

SEQ ID NO: 913311 - RNA, 23 nt, Human
ggauccggaacucgccacuuucu

SEQ ID NO: 913312 - RNA, 18 nt, Human
gguaaaaccauuuuuauu

SEQ ID NO: 913313 - RNA, 19 nt, Human
gucccucccucauuucaaa

SEQ ID NO: 913314 - RNA, 22 nt, Human
guggacuguuacaaaugauuuu

SEQ ID NO: 913315 - RNA, 20 nt, Human
uaaaacacaguucacaagaa

SEQ ID NO: 913316 - RNA, 22 nt, Human
uaaccaaaagagcaauaucaaa

SEQ ID NO: 913317 - RNA, 22 nt, Human
uacuuuaaaaaccacuugacua

SEQ ID NO: 913318 - RNA, 19 nt, Human
uagacacuugacuacuacu

SEQ ID NO: 913319 - RNA, 24 nt, Human
uagagguagauaaaacagaaauca

SEQ ID NO: 913320 - RNA, 23 nt, Human
uagguuuuuaggccagccagcuc

SEQ ID NO: 913321 - RNA, 22 nt, Human
uaugucccucccucauuucaaa

SEQ ID NO: 913322 - RNA, 22 nt, Human
uauucuguaugucccucccuca

SEQ ID NO: 913323 - RNA, 18 nt, Human
uccagaaacacagaaaau

SEQ ID NO: 913324 - RNA, 21 nt, Human
ucccucauuucaaaugagagu

SEQ ID NO: 913325 - RNA, 18 nt, Human
ucucucaggaaaaacaca

SEQ ID NO: 913326 - RNA, 18 nt, Human
ucuuuggaacacugcaga

SEQ ID NO: 913327 - RNA, 20 nt, Human
ucuuuggaacacugcagauu

SEQ ID NO: 913328 - RNA, 19 nt, Human
ugacuagcgacuguacugu

SEQ ID NO: 913329 - RNA, 23 nt, Human
ugagguaaaaucauaaaacacag

SEQ ID NO: 913330 - RNA, 18 nt, Human
ugaguaaaauaaccaaau

SEQ ID NO: 913331 - RNA, 20 nt, Human
ugaguaaaauaaccaaauaa

SEQ ID NO: 913332 - RNA, 19 nt, Human
ugcagcugagcucuguuuu

SEQ ID NO: 913333 - RNA, 25 nt, Human
uggauuugugacacacaaacacauc

SEQ ID NO: 913334 - RNA, 18 nt, Human
uggggcuugggaagacag

SEQ ID NO: 913335 - RNA, 18 nt, Human
uguuaauuaaaaaacuua

SEQ ID NO: 913336 - RNA, 22 nt, Human
uuaauccuaacuauagacuacu

SEQ ID NO: 913337 - RNA, 22 nt, Human
uuuaaagacagaguggacuguu

SEQ ID NO: 913338 - RNA, 21 nt, Human
uuugggaaauacccaagucuu

SEQ ID NO: 913339 - RNA, 19 nt, Human
uuuugcagcugagcucugu

SEQ ID NO: 913340 - RNA, 21 nt, Human
uuuuguuacuggacagcgcuu

SEQ ID NO: 913341 - RNA, 19 nt, Human
uuuuuuuuuuuuagugggu

SEQ ID NO: 913342 - RNA, 18 nt, Human
aaacccaaagacuccgga

SEQ ID NO: 913343 - RNA, 21 nt, Human
aacacaguaugugacacagga

SEQ ID NO: 913344 - RNA, 18 nt, Human
aagaagaaaggaaagaag

SEQ ID NO: 913345 - RNA, 18 nt, Human
aagagaaagaagaaagga

SEQ ID NO: 913346 - RNA, 19 nt, Human
acccaaagacuccggacag

SEQ ID NO: 913347 - RNA, 19 nt, Human
acccacaccagugagaugu

SEQ ID NO: 913348 - RNA, 20 nt, Human
agaaagaagaaaggaaagaa

SEQ ID NO: 913349 - RNA, 24 nt, Human
agaaaggaaagaaggaaaaaagga

SEQ ID NO: 913350 - RNA, 24 nt, Human
agagucccuuccaaggccucacac

SEQ ID NO: 913351 - RNA, 19 nt, Human
agcaggugaaucaaaccca

SEQ ID NO: 913352 - RNA, 21 nt, Human
agcaggugaaucaaacccaaa

SEQ ID NO: 913353 - RNA, 24 nt, Human
aggaaagaaggaaaaaaggaaggg

SEQ ID NO: 913354 - RNA, 22 nt, Human
aggaugaugaagccccacuaga

SEQ ID NO: 913355 - RNA, 23 nt, Human
caacagaauauuccaacuucagu

SEQ ID NO: 913356 - RNA, 24 nt, Human
cagaaagagucccuuccaaggccu

SEQ ID NO: 913357 - RNA, 18 nt, Human
caguaugugacacaggag

SEQ ID NO: 913358 - RNA, 20 nt, Human
cauccauacugacacccacu

SEQ ID NO: 913359 - RNA, 22 nt, Human
cauccauacugacacccacucc

SEQ ID NO: 913360 - RNA, 25 nt, Human
cauucagacacauccauacugacac

SEQ ID NO: 913361 - RNA, 20 nt, Human
ccacagccccaugcacccaa

SEQ ID NO: 913362 - RNA, 22 nt, Human
cccacuagacauuacaaacaaa

SEQ ID NO: 913363 - RNA, 18 nt, Human
ccccaugcacccacacca

SEQ ID NO: 913364 - RNA, 23 nt, Human
cccugaucaggucgccucccuca

SEQ ID NO: 913365 - RNA, 23 nt, Human
cucaaauugauguguacccccac

SEQ ID NO: 913366 - RNA, 21 nt, Human
cucacacauucagacacaucc

SEQ ID NO: 913367 - RNA, 22 nt, Human
cuccccugaucaggucgccucc

SEQ ID NO: 913368 - RNA, 21 nt, Human
cugacaaagccaaaaagaaaa

SEQ ID NO: 913369 - RNA, 24 nt, Human
cuguaauauuccuuuuacauucua

SEQ ID NO: 913370 - RNA, 24 nt, Human
cuuucuugcucuuuaaaaaaaucc

SEQ ID NO: 913371 - RNA, 20 nt, Human
gaaaggaaagaaggaaaaaa

SEQ ID NO: 913372 - RNA, 21 nt, Human
gacauuacaaacaacugcaac

SEQ ID NO: 913373 - RNA, 21 nt, Human
gauguguacccccaccucccc

SEQ ID NO: 913374 - RNA, 21 nt, Human
gcaggugaaucaaacccaaag

SEQ ID NO: 913375 - RNA, 20 nt, Human
ggagucccuugauguuucuu

SEQ ID NO: 913376 - RNA, 21 nt, Human
ggccccugacuuugguuguuu

SEQ ID NO: 913377 - RNA, 23 nt, Human
gucccuugauguuucuugaggag

SEQ ID NO: 913378 - RNA, 19 nt, Human
uaaaaacacaguaugugac

SEQ ID NO: 913379 - RNA, 23 nt, Human
uaaaauaaaaacacaguauguga

SEQ ID NO: 913380 - RNA, 18 nt, Human
uacaguaucugcagaaag

SEQ ID NO: 913381 - RNA, 21 nt, Human
uagugagauuaauuuaucuug

SEQ ID NO: 913382 - RNA, 19 nt, Human
ucaggaugaugaagcccca

SEQ ID NO: 913383 - RNA, 21 nt, Human
ucccugacaaagccaaaaaga

SEQ ID NO: 913384 - RNA, 21 nt, Human
uccuucuuuucaggaugauga

SEQ ID NO: 913385 - RNA, 21 nt, Human
ucuugaggagaucuguacacu

SEQ ID NO: 913386 - RNA, 19 nt, Human
ugaaggccccugacuuugg

SEQ ID NO: 913387 - RNA, 20 nt, Human
ugaaggccccugacuuuggu

SEQ ID NO: 913388 - RNA, 22 nt, Human
ugaaggccccugacuuugguug

SEQ ID NO: 913389 - RNA, 21 nt, Human
ugacacaggagucccuugaug

SEQ ID NO: 913390 - RNA, 23 nt, Human
ugacacccacuccacagccccau

SEQ ID NO: 913391 - RNA, 19 nt, Human
ugaucaggucgccucccuc

SEQ ID NO: 913392 - RNA, 19 nt, Human
ugauuuguuuuucaauuuu

SEQ ID NO: 913393 - RNA, 20 nt, Human
uguacacaauuuguugaaug

SEQ ID NO: 913394 - RNA, 18 nt, Human
ugugacacaggagucccu

SEQ ID NO: 913395 - RNA, 20 nt, Human
ugugacacaggagucccuug

SEQ ID NO: 913396 - RNA, 18 nt, Human
uguguauauuacauauau

SEQ ID NO: 913397 - RNA, 19 nt, Human
uguguauauuacauauaug

SEQ ID NO: 913398 - RNA, 21 nt, Human
uuaaaaaaaucccugucuccu

SEQ ID NO: 913399 - RNA, 21 nt, Human
uucaaaugaucuuucuguugg

SEQ ID NO: 913400 - RNA, 24 nt, Human
uucacauuuuaauguuucaguagc

SEQ ID NO: 913401 - RNA, 22 nt, Human
uugauguguacccccaccuccc

SEQ ID NO: 913402 - RNA, 19 nt, Human
uuguacacaauuuguugaa

SEQ ID NO: 913403 - RNA, 25 nt, Human
uuuaaaaagaaagaaagagaaagaa

SEQ ID NO: 913404 - RNA, 21 nt, Human
uuuacauucuauauacacaga

SEQ ID NO: 913405 - RNA, 18 nt, Human
uuuuuuuuuuuuuuuuug

SEQ ID NO: 913406 - RNA, 23 nt, Human
uuuuuuuuuuuuuuuuuugguuu

SEQ ID NO: 913407 - RNA, 25 nt, Human
aagaaagcacccuaacgugagaacu

SEQ ID NO: 913408 - RNA, 18 nt, Human
accccacccuuccugcca

SEQ ID NO: 913409 - RNA, 18 nt, Human
acucuguaauuuuuagcu

SEQ ID NO: 913410 - RNA, 23 nt, Human
agccaauaacagccauggugacc

SEQ ID NO: 913411 - RNA, 18 nt, Human
agcccagcgggacggggu

SEQ ID NO: 913412 - RNA, 21 nt, Human
agcuguggcagcuggccugaa

SEQ ID NO: 913413 - RNA, 22 nt, Human
aggagcgcggccagcccugggc

SEQ ID NO: 913414 - RNA, 18 nt, Human
aggcaggaggcccagcag

SEQ ID NO: 913415 - RNA, 24 nt, Human
agggagccaauaacagccauggug

SEQ ID NO: 913416 - RNA, 23 nt, Human
aggggcucgcugggacacccaga

SEQ ID NO: 913417 - RNA, 22 nt, Human
auauuguguauguacacauagg

SEQ ID NO: 913418 - RNA, 21 nt, Human
caagguggggaggugaccugg

SEQ ID NO: 913419 - RNA, 27 nt, Human
cacccagacuggagucaucgcugaagc

SEQ ID NO: 913420 - RNA, 23 nt, Human
cacuggaaccggugcacgccuuc

SEQ ID NO: 913421 - RNA, 24 nt, Human
cagcagucgccuccagaacacggg

SEQ ID NO: 913422 - RNA, 19 nt, Human
caggagcgcggccagcccu

SEQ ID NO: 913423 - RNA, 19 nt, Human
caggaggcccagcagucgc

SEQ ID NO: 913424 - RNA, 18 nt, Human
caggcagcaaggugggga

SEQ ID NO: 913425 - RNA, 23 nt, Human
cauuacacauuaagaaucaggga

SEQ ID NO: 913426 - RNA, 25 nt, Human
ccaauaacagccauggugaccuccu

SEQ ID NO: 913427 - RNA, 24 nt, Human
ccagcagucgccuccagaacacgg

SEQ ID NO: 913428 - RNA, 25 nt, Human
cccagacuggagucaucgcugaagc

SEQ ID NO: 913429 - RNA, 18 nt, Human
cccugggcggccaggcag

SEQ ID NO: 913430 - RNA, 22 nt, Human
ccuuccugccagccccucccuc

SEQ ID NO: 913431 - RNA, 23 nt, Human
cucgcugggacacccagacugga

SEQ ID NO: 913432 - RNA, 23 nt, Human
cugaagcgcggcugaaagagcug

SEQ ID NO: 913433 - RNA, 22 nt, Human
cuuccugccagccccucccuca

SEQ ID NO: 913434 - RNA, 21 nt, Human
gaaagcacccuaacgugagaa

SEQ ID NO: 913435 - RNA, 19 nt, Human
gaagcgcggcugaaagagc

SEQ ID NO: 913436 - RNA, 24 nt, Human
gaccccacccuuccugccagcccc

SEQ ID NO: 913437 - RNA, 23 nt, Human
gccaggcaggaggcccagcaguc

SEQ ID NO: 913438 - RNA, 24 nt, Human
gcucgcugggacacccagacugga

SEQ ID NO: 913439 - RNA, 24 nt, Human
ggggacagcaagggagccaauaac

SEQ ID NO: 913440 - RNA, 21 nt, Human
guagagcccagcucugcagag

SEQ ID NO: 913441 - RNA, 20 nt, Human
uccugccagccccucccuca

SEQ ID NO: 913442 - RNA, 22 nt, Human
uccugccagccccucccucacu

SEQ ID NO: 913443 - RNA, 18 nt, Human
uccugcgcuggcgguccc

SEQ ID NO: 913444 - RNA, 20 nt, Human
ucuggacacaggcagcaagg

SEQ ID NO: 913445 - RNA, 22 nt, Human
ugaagccuuuugggguagagcc

SEQ ID NO: 913446 - RNA, 23 nt, Human
ugaagcgcggcugaaagagcuga

SEQ ID NO: 913447 - RNA, 19 nt, Human
ugaccuggggaacagcugg

SEQ ID NO: 913448 - RNA, 19 nt, Human
ugagaacuggagacuccaa

SEQ ID NO: 913449 - RNA, 23 nt, Human
ugaggaccccacccuuccugcca

SEQ ID NO: 913450 - RNA, 24 nt, Human
ugccagccccucccucacuuacug

SEQ ID NO: 913451 - RNA, 22 nt, Human
uggacacaggcagcaagguggg

SEQ ID NO: 913452 - RNA, 23 nt, Human
uggcagcacaccugacccucagc

SEQ ID NO: 913453 - RNA, 24 nt, Human
uggggaacagcuggggacagcaag

SEQ ID NO: 913454 - RNA, 18 nt, Human
ugggguagagcccagcuu

SEQ ID NO: 913455 - RNA, 18 nt, Human
uuacacauuaagaaucag

SEQ ID NO: 913456 - RNA, 25 nt, Human
uuccuugagcccagcgggacggggu

SEQ ID NO: 913457 - RNA, 21 nt, Human
accgcgcacgaagaaccgaaa

SEQ ID NO: 913458 - RNA, 18 nt, Human
acuuggcggagcuggagg

SEQ ID NO: 913459 - RNA, 20 nt, Human
agaacgccccagguccacag

SEQ ID NO: 913460 - RNA, 18 nt, Human
agcacagugggcggaagc

SEQ ID NO: 913461 - RNA, 19 nt, Human
aggcguccagcaggacggc

SEQ ID NO: 913462 - RNA, 21 nt, Human
cacagcuuaaggaguuuccca

SEQ ID NO: 913463 - RNA, 22 nt, Human
cacugcuacagcgaaagacaag

SEQ ID NO: 913464 - RNA, 19 nt, Human
cagucagucuucugcagcc

SEQ ID NO: 913465 - RNA, 20 nt, Human
cagugggcggaagccggggu

SEQ ID NO: 913466 - RNA, 23 nt, Human
ccccagaacgccccagguccacu

SEQ ID NO: 913467 - RNA, 23 nt, Human
ccgcgcacgaagaaccgaaacgg

SEQ ID NO: 913468 - RNA, 19 nt, Human
cgaagaaccgaaacggccu

SEQ ID NO: 913469 - RNA, 23 nt, Human
cgacagcccagguccgaggaagg

SEQ ID NO: 913470 - RNA, 19 nt, Human
cgcacgaagaaccgaaacg

SEQ ID NO: 913471 - RNA, 20 nt, Human
cgccccagguccacaguggc

SEQ ID NO: 913472 - RNA, 22 nt, Human
cuccuaguuuuguuuaauagga

SEQ ID NO: 913473 - RNA, 25 nt, Human
cugcagccccagaacgccccagguc

SEQ ID NO: 913474 - RNA, 21 nt, Human
gacggcggcgaauccacagcc

SEQ ID NO: 913475 - RNA, 22 nt, Human
gccaagggauucgagauggaag

SEQ ID NO: 913476 - RNA, 20 nt, Human
gccccagguccacaguggcu

SEQ ID NO: 913477 - RNA, 25 nt, Human
gccccagguccacaguggcugcugg

SEQ ID NO: 913478 - RNA, 21 nt, Human
gccuucuacagggcggaggac

SEQ ID NO: 913479 - RNA, 22 nt, Human
gccuucuacagggcggaggacg

SEQ ID NO: 913480 - RNA, 20 nt, Human
gggcagcacagugggcggaa

SEQ ID NO: 913481 - RNA, 20 nt, Human
gggcggaagccgggguggga

SEQ ID NO: 913482 - RNA, 25 nt, Human
uaaggaguuucccacugcuacagcg

SEQ ID NO: 913483 - RNA, 20 nt, Human
uaguggaucccaccuacuuu

SEQ ID NO: 913484 - RNA, 19 nt, Human
ucugcagccccagaacgcc

SEQ ID NO: 913485 - RNA, 21 nt, Human
ugcaaagugcacagagggagg

SEQ ID NO: 913486 - RNA, 19 nt, Human
ugcacagagggaggccuga

SEQ ID NO: 913487 - RNA, 20 nt, Human
uggcacauccacagucaguc

SEQ ID NO: 913488 - RNA, 18 nt, Human
ugggaguaaagccugggg

SEQ ID NO: 913489 - RNA, 19 nt, Human
uggggcggcuaccgcgcac

SEQ ID NO: 913490 - RNA, 19 nt, Human
ugggguaggggggcggcgg

SEQ ID NO: 913491 - RNA, 18 nt, Human
uuuuuuuuuuuuuuucug

SEQ ID NO: 913492 - RNA, 22 nt, Human
cacgccgccgccgccgccgccc

SEQ ID NO: 913493 - RNA, 18 nt, Human
cacugugccggguuaggc

SEQ ID NO: 913494 - RNA, 18 nt, Human
ccgccgccgcccaggcgc

SEQ ID NO: 913495 - RNA, 19 nt, Human
ccgccgccgccgccgccca

SEQ ID NO: 913496 - RNA, 20 nt, Human
cgccgccgccgccgccgccc

SEQ ID NO: 913497 - RNA, 18 nt, Human
aagaagggaugaugagca

SEQ ID NO: 913498 - RNA, 24 nt, Human
aauaaauguaccccuugggcuucu

SEQ ID NO: 913499 - RNA, 20 nt, Human
acaaagcuguaguauauggu

SEQ ID NO: 913500 - RNA, 22 nt, Human
acuacugaauuucaagucacac

SEQ ID NO: 913501 - RNA, 19 nt, Human
acucuguaccaacacacag

SEQ ID NO: 913502 - RNA, 24 nt, Human
agaagaaauucuuuuacuacugaa

SEQ ID NO: 913503 - RNA, 22 nt, Human
agagcacacauuacucccaaga

SEQ ID NO: 913504 - RNA, 19 nt, Human
cacacacaaaauaggugag

SEQ ID NO: 913505 - RNA, 24 nt, Human
cacacagaauuuacuguucugcaa

SEQ ID NO: 913506 - RNA, 19 nt, Human
cagaauuuacuguucugca

SEQ ID NO: 913507 - RNA, 21 nt, Human
cuccucuacaguuucuuuaaa

SEQ ID NO: 913508 - RNA, 22 nt, Human
cuccucuacaguuucuuuaaaa

SEQ ID NO: 913509 - RNA, 21 nt, Human
gcacaauccuagcaggcaauc

SEQ ID NO: 913510 - RNA, 19 nt, Human
gcacucuguaccaacacac

SEQ ID NO: 913511 - RNA, 19 nt, Human
gccuaccacaaagcuguag

SEQ ID NO: 913512 - RNA, 22 nt, Human
ggaauaaaacuaaaauuucuaa

SEQ ID NO: 913513 - RNA, 21 nt, Human
uaaauuccuauaacuagggac

SEQ ID NO: 913514 - RNA, 20 nt, Human
uacagcaauguaaaacuuuu

SEQ ID NO: 913515 - RNA, 25 nt, Human
uagcaaaacacaagaucauguacaa

SEQ ID NO: 913516 - RNA, 20 nt, Human
uauuuuaucauauuuagaau

SEQ ID NO: 913517 - RNA, 21 nt, Human
ucccuuaaaauauuuacauuu

SEQ ID NO: 913518 - RNA, 22 nt, Human
ugaaaauaauggccuaccacaa

SEQ ID NO: 913519 - RNA, 18 nt, Human
ugcauauuaauaaaacaa

SEQ ID NO: 913520 - RNA, 20 nt, Human
ugguaauaaaugacuucaau

SEQ ID NO: 913521 - RNA, 24 nt, Human
ugguaugaagaagggaugaugagc

SEQ ID NO: 913522 - RNA, 24 nt, Human
uguaauccugaagcagccugcaaa

SEQ ID NO: 913523 - RNA, 22 nt, Human
uuagaaucaaaauaucccuuaa

SEQ ID NO: 913524 - RNA, 23 nt, Human
uuccauaguuaaccauauuuacc

SEQ ID NO: 913525 - RNA, 21 nt, Human
uuuuacuacugaauuucaagu

SEQ ID NO: 913526 - RNA, 22 nt, Human
aaacaaguaaaugccuuucaag

SEQ ID NO: 913527 - RNA, 23 nt, Human
aaagaguuuccaauuucucaaaa

SEQ ID NO: 913528 - RNA, 24 nt, Human
agaacauaccaauauggagaacag

SEQ ID NO: 913529 - RNA, 20 nt, Human
agagcccugcccccccaccc

SEQ ID NO: 913530 - RNA, 21 nt, Human
agagcccugcccccccacccc

SEQ ID NO: 913531 - RNA, 25 nt, Human
agagcccugcccccccacccccccc

SEQ ID NO: 913532 - RNA, 20 nt, Human
agaggaggggguggcaagcu

SEQ ID NO: 913533 - RNA, 21 nt, Human
agaguuuccaauuucucaaaa

SEQ ID NO: 913534 - RNA, 19 nt, Human
agggagaggaggggguggc

SEQ ID NO: 913535 - RNA, 22 nt, Human
agggagaggaggggguggcaag

SEQ ID NO: 913536 - RNA, 18 nt, Human
caaaaaaaacgggaaaug

SEQ ID NO: 913537 - RNA, 18 nt, Human
caacagaaagaguuucca

SEQ ID NO: 913538 - RNA, 23 nt, Human
caacagaaagaguuuccaauuuc

SEQ ID NO: 913539 - RNA, 24 nt, Human
caacuuuauuaauauaauagcaac

SEQ ID NO: 913540 - RNA, 24 nt, Human
caccaaagguuccucaaggacagc

SEQ ID NO: 913541 - RNA, 24 nt, Human
caccaaagguuccucaaggacagc

SEQ ID NO: 913542 - RNA, 26 nt, Human
caccccccccccaaaaaaaacgggaa

SEQ ID NO: 913543 - RNA, 24 nt, Human
cagagcccugcccccccacccccc

SEQ ID NO: 913544 - RNA, 21 nt, Human
cagcugcagcagacugauguu

SEQ ID NO: 913545 - RNA, 20 nt, Human
ccaccccccccccaaaaaaa

SEQ ID NO: 913546 - RNA, 22 nt, Human
cccaaaaaaaacgggaaaugcc

SEQ ID NO: 913547 - RNA, 22 nt, Human
cccaccccccccccaaaaaaaa

SEQ ID NO: 913548 - RNA, 26 nt, Human
cccaccccccccccaaaaaaaacggg

SEQ ID NO: 913549 - RNA, 20 nt, Human
ccccaaaaaaaacgggaaau

SEQ ID NO: 913550 - RNA, 20 nt, Human
cccccaaaaaaaacgggaaa

SEQ ID NO: 913551 - RNA, 23 nt, Human
cccccaccccccccccaaaaaaa

SEQ ID NO: 913552 - RNA, 19 nt, Human
cccugcccccccacccccc

SEQ ID NO: 913553 - RNA, 24 nt, Human
cccugcccccccacccccccccca

SEQ ID NO: 913554 - RNA, 19 nt, Human
ccuacauuucuuguucuga

SEQ ID NO: 913555 - RNA, 20 nt, Human
ccucaaggacagcugccacc

SEQ ID NO: 913556 - RNA, 18 nt, Human
ccugcccccccacccccc

SEQ ID NO: 913557 - RNA, 20 nt, Human
ccuggugaugcucugggcuc

SEQ ID NO: 913558 - RNA, 18 nt, Human
cucaaggacagcugccac

SEQ ID NO: 913559 - RNA, 19 nt, Human
cucaaggacagcugccacc

SEQ ID NO: 913560 - RNA, 25 nt, Human
cugauagcuucccaccacacaccaa

SEQ ID NO: 913561 - RNA, 19 nt, Human
gaauccuuuuccaucccua

SEQ ID NO: 913562 - RNA, 21 nt, Human
gagcccugcccccccaccccc

SEQ ID NO: 913563 - RNA, 20 nt, Human
gaggggguggcaagcugcca

SEQ ID NO: 913564 - RNA, 27 nt, Human
gcccccccaccccccccccaaaaaaaa

SEQ ID NO: 913565 - RNA, 18 nt, Human
gcccugcccccccacccc

SEQ ID NO: 913566 - RNA, 23 nt, Human
gcccugcccccccaccccccccc

SEQ ID NO: 913567 - RNA, 18 nt, Human
gcucugggcucugcuccc

SEQ ID NO: 913568 - RNA, 24 nt, Human
gcucugggcucugcucccuuucug

SEQ ID NO: 913569 - RNA, 18 nt, Human
gggugaagggagaggagg

SEQ ID NO: 913570 - RNA, 19 nt, Human
gggugaagggagaggaggg

SEQ ID NO: 913571 - RNA, 23 nt, Human
uaacuaagccggccaccggaagc

SEQ ID NO: 913572 - RNA, 24 nt, Human
uaacuaagccggccaccggaagcu

SEQ ID NO: 913573 - RNA, 22 nt, Human
uaauagcaacagaaagaguuuc

SEQ ID NO: 913574 - RNA, 25 nt, Human
uagcaggcacuccuggugaugcucu

SEQ ID NO: 913575 - RNA, 23 nt, Human
uauuucuuuuuagaagaucuugg

SEQ ID NO: 913576 - RNA, 22 nt, Human
ucaaggacagcugccaccagag

SEQ ID NO: 913577 - RNA, 21 nt, Human
ucugggugaagggagaggagg

SEQ ID NO: 913578 - RNA, 25 nt, Human
ucuugguugagggagaaccgggguc

SEQ ID NO: 913579 - RNA, 19 nt, Human
ugaagggagaggagggggu

SEQ ID NO: 913580 - RNA, 23 nt, Human
ugagggagaacauaccaauaugg

SEQ ID NO: 913581 - RNA, 24 nt, Human
ugaugcucugggcucugcucccuu

SEQ ID NO: 913582 - RNA, 20 nt, Human
ugcccccccacccccccccc

SEQ ID NO: 913583 - RNA, 25 nt, Human
ugggcgucgcuucacagucaguucc

SEQ ID NO: 913584 - RNA, 19 nt, Human
ugggcucugcucccuuucu

SEQ ID NO: 913585 - RNA, 21 nt, Human
uggugaugcucugggcucugc

SEQ ID NO: 913586 - RNA, 22 nt, Human
uucacagucaguuccucaagca

SEQ ID NO: 913587 - RNA, 20 nt, Human
uuuuuagaagaucuugguug

SEQ ID NO: 913588 - RNA, 25 nt, Human
uuuuucacugggcgucgcuucacag

SEQ ID NO: 913589 - RNA, 22 nt, Human
uuuuuuuuuuuuuuuuaccaga

SEQ ID NO: 913590 - RNA, 22 nt, Human
uuuuuuuuuuuuuuuuuaccag

SEQ ID NO: 913591 - RNA, 22 nt, Human
aaaacaacaaacaugggugaag

SEQ ID NO: 913592 - RNA, 18 nt, Human
aaaacaagauuaaggugg

SEQ ID NO: 913593 - RNA, 19 nt, Human
aaaacaucugagggguggc

SEQ ID NO: 913594 - RNA, 19 nt, Human
aaacaacaaacauggguga

SEQ ID NO: 913595 - RNA, 20 nt, Human
aaacaugggugaaguaagaa

SEQ ID NO: 913596 - RNA, 24 nt, Human
aaauacgugucgguguggucacaa

SEQ ID NO: 913597 - RNA, 22 nt, Human
aacaucugagggguggcuuugc

SEQ ID NO: 913598 - RNA, 19 nt, Human
aacccggcggacgccccuc

SEQ ID NO: 913599 - RNA, 21 nt, Human
acaggcucuuccagcuugaaa

SEQ ID NO: 913600 - RNA, 24 nt, Human
acaggcucuuccagcuugaaacuu

SEQ ID NO: 913601 - RNA, 19 nt, Human
acccgccgccgcaagaaug

SEQ ID NO: 913602 - RNA, 23 nt, Human
aggcaguggcuuccuaacccggc

SEQ ID NO: 913603 - RNA, 20 nt, Human
aucaaguuguuucacuggac

SEQ ID NO: 913604 - RNA, 18 nt, Human
ccaaacccgauggaggag

SEQ ID NO: 913605 - RNA, 26 nt, Human
ccagagugcucccuccccaaacccga

SEQ ID NO: 913606 - RNA, 20 nt, Human
cccaaacccgauggaggagc

SEQ ID NO: 913607 - RNA, 21 nt, Human
cggugcugucucucucuccuc

SEQ ID NO: 913608 - RNA, 26 nt, Human
cucauagucucacugcuggcccugcu

SEQ ID NO: 913609 - RNA, 22 nt, Human
cucuuccagcuugaaacuucag

SEQ ID NO: 913610 - RNA, 20 nt, Human
cugcuggcccugcuuccuug

SEQ ID NO: 913611 - RNA, 21 nt, Human
cuggacugcucccuccucaug

SEQ ID NO: 913612 - RNA, 23 nt, Human
gacaggugcuggguaaaagcuug

SEQ ID NO: 913613 - RNA, 24 nt, Human
guaggauucugugcacacacugcu

SEQ ID NO: 913614 - RNA, 22 nt, Human
gugggacagcagcuacucagaa

SEQ ID NO: 913615 - RNA, 22 nt, Human
uaagaagaggcauaugaaaaca

SEQ ID NO: 913616 - RNA, 18 nt, Human
uccacugagacuucucuu

SEQ ID NO: 913617 - RNA, 25 nt, Human
ucgcugggccaagacguuccuugag

SEQ ID NO: 913618 - RNA, 18 nt, Human
ucucacagucccagagug

SEQ ID NO: 913619 - RNA, 18 nt, Human
ugaaaacaagauuaaggu

SEQ ID NO: 913620 - RNA, 21 nt, Human
ugaggacaauacaggcucuuc

SEQ ID NO: 913621 - RNA, 19 nt, Human
uggcaucuggacugcuccc

SEQ ID NO: 913622 - RNA, 21 nt, Human
ugggacagcagcuacucagaa

SEQ ID NO: 913623 - RNA, 20 nt, Human
ugggaggagaggaggagaaa

SEQ ID NO: 913624 - RNA, 24 nt, Human
uggguaaaagcuuguugagaaaau

SEQ ID NO: 913625 - RNA, 19 nt, Human
uggugggaggagaggagga

SEQ ID NO: 913626 - RNA, 22 nt, Human
uuguuggcaucuggacugcucc

SEQ ID NO: 913627 - RNA, 21 nt, Human
uuuuuuccuuuuauuuugcaa

SEQ ID NO: 913628 - RNA, 19 nt, Human
aaaccaccaggcaucaucu

SEQ ID NO: 913629 - RNA, 24 nt, Human
acagcagcaaggaagcagaagccu

SEQ ID NO: 913630 - RNA, 18 nt, Human
agcaaggaagcagaagcc

SEQ ID NO: 913631 - RNA, 18 nt, Human
aggaucuagaaaagcaag

SEQ ID NO: 913632 - RNA, 20 nt, Human
aguucuacuuauuccuuaac

SEQ ID NO: 913633 - RNA, 18 nt, Human
cacagcagcaaggaagcg

SEQ ID NO: 913634 - RNA, 21 nt, Human
cagcaaaggguagccucgugc

SEQ ID NO: 913635 - RNA, 22 nt, Human
cagcaaggaagcagaagccuua

SEQ ID NO: 913636 - RNA, 21 nt, Human
ccaaaccaccaggcaucaucu

SEQ ID NO: 913637 - RNA, 22 nt, Human
ccacagcagcaaggaagcagaa

SEQ ID NO: 913638 - RNA, 18 nt, Human
ccuacuccaccacagcag

SEQ ID NO: 913639 - RNA, 18 nt, Human
gaagagguuccuggcuuu

SEQ ID NO: 913640 - RNA, 19 nt, Human
gcagcaaaggguagccucg

SEQ ID NO: 913641 - RNA, 22 nt, Human
uaggaaaucuauaacgucaggc

SEQ ID NO: 913642 - RNA, 19 nt, Human
uaucaugguauuucauggu

SEQ ID NO: 913643 - RNA, 21 nt, Human
uccaccacagcagcaaggaag

SEQ ID NO: 913644 - RNA, 18 nt, Human
ucccagcaaacauuguag

SEQ ID NO: 913645 - RNA, 18 nt, Human
ucuaugacagaccugaag

SEQ ID NO: 913646 - RNA, 18 nt, Human
uuccuuaacuguaccugc

SEQ ID NO: 913647 - RNA, 30 nt, Human
uuuugcaucaucaaauuguugucucaagaa

SEQ ID NO: 913648 - RNA, 18 nt, Human
uuuuuuuuuuuuuuuuug

SEQ ID NO: 913649 - RNA, 21 nt, Human
uuuuuuuuuuuuuuuuugcaa

SEQ ID NO: 913650 - RNA, 23 nt, Human
uuuuuuuuuuuuuuuuugcaaau

SEQ ID NO: 913651 - RNA, 24 nt, Human
aaagugcugggauuacaggcguga

SEQ ID NO: 913652 - RNA, 19 nt, Human
aagugcugggauuacaggc

SEQ ID NO: 913653 - RNA, 19 nt, Human
aagugcugggauuacaggc

SEQ ID NO: 913654 - RNA, 26 nt, Human
aagugcugggauuacaggcgugagcc

SEQ ID NO: 913655 - RNA, 19 nt, Human
acaggcgcccgccaccacg

SEQ ID NO: 913656 - RNA, 18 nt, Human
acaggguuucaccguguu

SEQ ID NO: 913657 - RNA, 19 nt, Human
acaggguuucaccguguua

SEQ ID NO: 913658 - RNA, 20 nt, Human
acaggguuucaccguguuag

SEQ ID NO: 913659 - RNA, 24 nt, Human
acaggguuucaccguguuagccag

SEQ ID NO: 913660 - RNA, 24 nt, Human
accucgugauccacccgccuuggc

SEQ ID NO: 913661 - RNA, 24 nt, Human
acugucgcccaggcuggagugcag

SEQ ID NO: 913662 - RNA, 18 nt, Human
agacaggguuucaccgug

SEQ ID NO: 913663 - RNA, 19 nt, Human
agagacaggguuucaccgu

SEQ ID NO: 913664 - RNA, 18 nt, Human
agccuccagaguagcugg

SEQ ID NO: 913665 - RNA, 24 nt, Human
agcucugccucccggguucacgcu

SEQ ID NO: 913666 - RNA, 24 nt, Human
agcuggagaugguggugaacgguc

SEQ ID NO: 913667 - RNA, 20 nt, Human
aggcgcccgccaccacgccu

SEQ ID NO: 913668 - RNA, 25 nt, Human
aggcuggagugcaguagcgcaaucu

SEQ ID NO: 913669 - RNA, 20 nt, Human
aguagagacaggguuucacc

SEQ ID NO: 913670 - RNA, 18 nt, Human
aguagcugggacuacagg

SEQ ID NO: 913671 - RNA, 19 nt, Human
aguagcugggacuacaggc

SEQ ID NO: 913672 - RNA, 20 nt, Human
agugcaguagcgcaaucucg

SEQ ID NO: 913673 - RNA, 24 nt, Human
agugcaguagcgcaaucucggcuc

SEQ ID NO: 913674 - RNA, 19 nt, Human
auccacccgccuuggccuc

SEQ ID NO: 913675 - RNA, 24 nt, Human
caaagugcugggauuacaggcgug

SEQ ID NO: 913676 - RNA, 22 nt, Human
cacccgccuuggccuccaaagu

SEQ ID NO: 913677 - RNA, 23 nt, Human
cacccgccuuggccuccaaagug

SEQ ID NO: 913678 - RNA, 19 nt, Human
caccgcaagcucugccucc

SEQ ID NO: 913679 - RNA, 18 nt, Human
caccguguuagccaggau

SEQ ID NO: 913680 - RNA, 24 nt, Human
caccguguuagccaggauggucuc

SEQ ID NO: 913681 - RNA, 22 nt, Human
cacgcuacucuccugccucagc

SEQ ID NO: 913682 - RNA, 24 nt, Human
caggguuucaccguguuagccagg

SEQ ID NO: 913683 - RNA, 22 nt, Human
ccaaagugcugggauuacaggc

SEQ ID NO: 913684 - RNA, 22 nt, Human
ccaaagugcugggauuacaggc

SEQ ID NO: 913685 - RNA, 24 nt, Human
ccaaagugcugggauuacaggcgu

SEQ ID NO: 913686 - RNA, 24 nt, Human
ccagaguagcugggacuacaggcg

SEQ ID NO: 913687 - RNA, 23 nt, Human
cccggguucacgcuacucuccug

SEQ ID NO: 913688 - RNA, 20 nt, Human
cccugccccaccccuucucc

SEQ ID NO: 913689 - RNA, 21 nt, Human
ccgcaagcucugccucccggg

SEQ ID NO: 913690 - RNA, 22 nt, Human
ccucccggguucacgcuacucu

SEQ ID NO: 913691 - RNA, 20 nt, Human
ccugaccucgugauccaccc

SEQ ID NO: 913692 - RNA, 22 nt, Human
cgcgcccggcccacucugauuu

SEQ ID NO: 913693 - RNA, 24 nt, Human
cucaccgcaagcucugccucccgg

SEQ ID NO: 913694 - RNA, 24 nt, Human
cucagccuccagaguagcugggac

SEQ ID NO: 913695 - RNA, 24 nt, Human
cuccugaccucgugauccacccgc

SEQ ID NO: 913696 - RNA, 22 nt, Human
cucugccuuccuuagagacuga

SEQ ID NO: 913697 - RNA, 23 nt, Human
cugccucagccuccagaguagcu

SEQ ID NO: 913698 - RNA, 22 nt, Human
cuggcgucugugagcagcugga

SEQ ID NO: 913699 - RNA, 23 nt, Human
cuggucuguguccucccgcucuu

SEQ ID NO: 913700 - RNA, 21 nt, Human
gaccucgugauccacccgccu

SEQ ID NO: 913701 - RNA, 21 nt, Human
gaccucgugauccacccgccu

SEQ ID NO: 913702 - RNA, 22 nt, Human
gaccucgugauccacccgccuu

SEQ ID NO: 913703 - RNA, 25 nt, Human
gaguagcugggacuacaggcgcccg

SEQ ID NO: 913704 - RNA, 18 nt, Human
gauuacaggcgugagcca

SEQ ID NO: 913705 - RNA, 22 nt, Human
gauuacaggcgugagccaccgc

SEQ ID NO: 913706 - RNA, 22 nt, Human
gauuacaggcgugagccaccgc

SEQ ID NO: 913707 - RNA, 23 nt, Human
gccuggcuaauuuuuuguauuuu

SEQ ID NO: 913708 - RNA, 19 nt, Human
gcuggagugcaguagcgca

SEQ ID NO: 913709 - RNA, 24 nt, Human
gguacugucgcccaggcuggagug

SEQ ID NO: 913710 - RNA, 20 nt, Human
ggucucgaucuccugaccuc

SEQ ID NO: 913711 - RNA, 22 nt, Human
gugauccacccgccuuggccuc

SEQ ID NO: 913712 - RNA, 22 nt, Human
guuuuuuuuuuuuugagaugga

SEQ ID NO: 913713 - RNA, 24 nt, Human
uaauuuuuuguauuuuuaguagag

SEQ ID NO: 913714 - RNA, 25 nt, Human
uaauuuuuuguauuuuuaguagaga

SEQ ID NO: 913715 - RNA, 22 nt, Human
uacaggcgcccgccaccacgcc

SEQ ID NO: 913716 - RNA, 23 nt, Human
uacaggcgugagccaccgcgccc

SEQ ID NO: 913717 - RNA, 22 nt, Human
uagagacaggguuucaccgugu

SEQ ID NO: 913718 - RNA, 21 nt, Human
uaguagagacaggguuucacc

SEQ ID NO: 913719 - RNA, 24 nt, Human
uaguagagacaggguuucaccgug

SEQ ID NO: 913720 - RNA, 26 nt, Human
uaguagagacaggguuucaccguguu

SEQ ID NO: 913721 - RNA, 24 nt, Human
ucaccgcaagcucugccucccggg

SEQ ID NO: 913722 - RNA, 24 nt, Human
ucaccguguuagccaggauggucu

SEQ ID NO: 913723 - RNA, 23 nt, Human
uccaaagugcugggauuacaggc

SEQ ID NO: 913724 - RNA, 24 nt, Human
uccaaagugcugggauuacaggcg

SEQ ID NO: 913725 - RNA, 24 nt, Human
uccagaguagcugggacuacaggc

SEQ ID NO: 913726 - RNA, 21 nt, Human
ucccggguucacgcuacucuc

SEQ ID NO: 913727 - RNA, 24 nt, Human
ucccggguucacgcuacucuccug

SEQ ID NO: 913728 - RNA, 21 nt, Human
uccuggucuguguccucccgc

SEQ ID NO: 913729 - RNA, 24 nt, Human
ucgcccaggcuggagugcaguagc

SEQ ID NO: 913730 - RNA, 24 nt, Human
ucuccugccucagccuccagagua

SEQ ID NO: 913731 - RNA, 24 nt, Human
ucugguacugucgcccaggcugga

SEQ ID NO: 913732 - RNA, 18 nt, Human
ucuuuuauucugcugcuc

SEQ ID NO: 913733 - RNA, 19 nt, Human
ugcaauucaugacacaguu

SEQ ID NO: 913734 - RNA, 24 nt, Human
ugccucagccuccagaguagcugg

SEQ ID NO: 913735 - RNA, 19 nt, Human
ugccucccggguucacgcu

SEQ ID NO: 913736 - RNA, 24 nt, Human
ugcugggauuacaggcgugagcca

SEQ ID NO: 913737 - RNA, 24 nt, Human
uggagugcaguagcgcaaucucgg

SEQ ID NO: 913738 - RNA, 21 nt, Human
ugggacuacaggcgcccgcca

SEQ ID NO: 913739 - RNA, 22 nt, Human
ugggacuacaggcgcccgccac

SEQ ID NO: 913740 - RNA, 24 nt, Human
ugggacuacaggcgcccgccacca

SEQ ID NO: 913741 - RNA, 18 nt, Human
ugggauuacaggcgugag

SEQ ID NO: 913742 - RNA, 19 nt, Human
ugggauuacaggcgugagc

SEQ ID NO: 913743 - RNA, 21 nt, Human
ugggauuacaggcgugagcca

SEQ ID NO: 913744 - RNA, 22 nt, Human
ugggauuacaggcgugagccac

SEQ ID NO: 913745 - RNA, 23 nt, Human
ugggauuacaggcgugagccacc

SEQ ID NO: 913746 - RNA, 24 nt, Human
ugggauuacaggcgugagccaccg

SEQ ID NO: 913747 - RNA, 24 nt, Human
ugguacugucgcccaggcuggagu

SEQ ID NO: 913748 - RNA, 24 nt, Human
uuaagaucuucaccaacauucucu

SEQ ID NO: 913749 - RNA, 22 nt, Human
uuaguagagacaggguuucacc

SEQ ID NO: 913750 - RNA, 24 nt, Human
uuaguagagacaggguuucaccgu

SEQ ID NO: 913751 - RNA, 23 nt, Human
uuccuggucuguguccucccgcu

SEQ ID NO: 913752 - RNA, 19 nt, Human
uuucaccguguuagccagg

SEQ ID NO: 913753 - RNA, 24 nt, Human
uuuuguguuagucuagauaugaag

SEQ ID NO: 913754 - RNA, 24 nt, Human
uuuuuaguagagacaggguuucac

SEQ ID NO: 913755 - RNA, 21 nt, Human
uuuuuguauuuuuaguagaga

SEQ ID NO: 913756 - RNA, 24 nt, Human
uuuuuuguauuuuuaguagagaca

SEQ ID NO: 913757 - RNA, 25 nt, Human
uuuuuuuuuuugagauggagucugg

SEQ ID NO: 913758 - RNA, 20 nt, Human
aaauaguguggggucgcgga

SEQ ID NO: 913759 - RNA, 21 nt, Human
aagcaagaucgcaaaggccug

SEQ ID NO: 913760 - RNA, 24 nt, Human
aagcccccaaauacgagauuccag

SEQ ID NO: 913761 - RNA, 18 nt, Human
aaucucccuuccccgccc

SEQ ID NO: 913762 - RNA, 27 nt, Human
aaucucccuuccccgcccccuccgccg

SEQ ID NO: 913763 - RNA, 21 nt, Human
acagcacagaaauaguguggg

SEQ ID NO: 913764 - RNA, 19 nt, Human
acagcggcgggagauguuc

SEQ ID NO: 913765 - RNA, 18 nt, Human
acccccggauuucugggc

SEQ ID NO: 913766 - RNA, 21 nt, Human
acuugccccucaucccccccg

SEQ ID NO: 913767 - RNA, 20 nt, Human
agaaguggggaagggggcua

SEQ ID NO: 913768 - RNA, 18 nt, Human
agaggaaggaggggcuug

SEQ ID NO: 913769 - RNA, 21 nt, Human
agaggaaggaggggcuugggu

SEQ ID NO: 913770 - RNA, 22 nt, Human
agaggaaggaggggcuuggguc

SEQ ID NO: 913771 - RNA, 26 nt, Human
agcccgaggcaacaaguuacagcggg

SEQ ID NO: 913772 - RNA, 20 nt, Human
aggaaggaggggcuuggguu

SEQ ID NO: 913773 - RNA, 18 nt, Human
agggaaaagggaguagua

SEQ ID NO: 913774 - RNA, 23 nt, Human
agggagugcgggggucgggaggc

SEQ ID NO: 913775 - RNA, 24 nt, Human
aggggcuuggguuucgcuggucgg

SEQ ID NO: 913776 - RNA, 21 nt, Human
aguagacuggaggaggggcgg

SEQ ID NO: 913777 - RNA, 20 nt, Human
agugggggaggcagccgagg

SEQ ID NO: 913778 - RNA, 26 nt, Human
caagcccccaaauacgagauuccuuu

SEQ ID NO: 913779 - RNA, 25 nt, Human
cacgcagcccgaggcaacaaguuac

SEQ ID NO: 913780 - RNA, 23 nt, Human
cagaacucaaccgugcacagugg

SEQ ID NO: 913781 - RNA, 23 nt, Human
cauaacaaagccaaagggaaaag

SEQ ID NO: 913782 - RNA, 21 nt, Human
ccagaaauucccagagggaca

SEQ ID NO: 913783 - RNA, 26 nt, Human
ccaggaaauacugcugccuuccaagg

SEQ ID NO: 913784 - RNA, 18 nt, Human
ccaugggggguggggggg

SEQ ID NO: 913785 - RNA, 19 nt, Human
cccccugcaggcggccaga

SEQ ID NO: 913786 - RNA, 20 nt, Human
cccccuuccccaagccccca

SEQ ID NO: 913787 - RNA, 20 nt, Human
ccccgcccccuccgccguug

SEQ ID NO: 913788 - RNA, 25 nt, Human
ccccgcccccuccgccguuggcccg

SEQ ID NO: 913789 - RNA, 18 nt, Human
ccccucaucccccccggg

SEQ ID NO: 913790 - RNA, 20 nt, Human
cccuuccccaagcccccaaa

SEQ ID NO: 913791 - RNA, 24 nt, Human
ccgccgcguccccuuuaaaugccc

SEQ ID NO: 913792 - RNA, 19 nt, Human
ccgggggggccccuuccuc

SEQ ID NO: 913793 - RNA, 19 nt, Human
ccguccccuccacuugccc

SEQ ID NO: 913794 - RNA, 20 nt, Human
ccguccccuccacuugcccc

SEQ ID NO: 913795 - RNA, 24 nt, Human
ccuccagccgucgucacacguucg

SEQ ID NO: 913796 - RNA, 19 nt, Human
ccucccaguugggaggacc

SEQ ID NO: 913797 - RNA, 23 nt, Human
ccucuggcuuuuccuuugggggu

SEQ ID NO: 913798 - RNA, 21 nt, Human
cgagucccuccagucccgagg

SEQ ID NO: 913799 - RNA, 22 nt, Human
cgcccccuccgccguuggcccg

SEQ ID NO: 913800 - RNA, 21 nt, Human
cggcucacgagucccuccagu

SEQ ID NO: 913801 - RNA, 20 nt, Human
cggcucugagcccccuuccc

SEQ ID NO: 913802 - RNA, 18 nt, Human
cguggaaggcccagcccg

SEQ ID NO: 913803 - RNA, 23 nt, Human
cucaucccccccgggcagccgcc

SEQ ID NO: 913804 - RNA, 25 nt, Human
cucucugcgagguuacuggcugucc

SEQ ID NO: 913805 - RNA, 18 nt, Human
gaaucucccuuccccgcc

SEQ ID NO: 913806 - RNA, 18 nt, Human
gaccaggaaauacugcug

SEQ ID NO: 913807 - RNA, 19 nt, Human
gacccucuucugccucugu

SEQ ID NO: 913808 - RNA, 21 nt, Human
gacccucuucugccucugugg

SEQ ID NO: 913809 - RNA, 21 nt, Human
gagcccccuuccccaagcccc

SEQ ID NO: 913810 - RNA, 20 nt, Human
gagccggagccggagccgga

SEQ ID NO: 913811 - RNA, 21 nt, Human
gaggaaggaggggcuuggguu

SEQ ID NO: 913812 - RNA, 22 nt, Human
gaguguaagaaguggggaaggg

SEQ ID NO: 913813 - RNA, 19 nt, Human
gaguuuggaguguaagaag

SEQ ID NO: 913814 - RNA, 22 nt, Human
gcccggguaccccccugcaggc

SEQ ID NO: 913815 - RNA, 19 nt, Human
gcugggaugcaaggagaca

SEQ ID NO: 913816 - RNA, 21 nt, Human
ggaauuggaggggacgcggug

SEQ ID NO: 913817 - RNA, 19 nt, Human
ggaccaggaaauacugcug

SEQ ID NO: 913818 - RNA, 19 nt, Human
ggagugggggaggcagccg

SEQ ID NO: 913819 - RNA, 19 nt, Human
gggcggcggcagcagaggu

SEQ ID NO: 913820 - RNA, 19 nt, Human
ggggucgggaggcaagaga

SEQ ID NO: 913821 - RNA, 19 nt, Human
guaaaacaccagaggaagg

SEQ ID NO: 913822 - RNA, 20 nt, Human
guccccuccacuugccccuc

SEQ ID NO: 913823 - RNA, 24 nt, Human
guguggggucgcggugggugaagc

SEQ ID NO: 913824 - RNA, 25 nt, Human
uaaaacaccagaggaagggggaguc

SEQ ID NO: 913825 - RNA, 24 nt, Human
uaacaaagccaaagggaaaaggga

SEQ ID NO: 913826 - RNA, 23 nt, Human
ucccuccacaguagacuggagga

SEQ ID NO: 913827 - RNA, 22 nt, Human
ucccuuccccgcccccuccgcc

SEQ ID NO: 913828 - RNA, 21 nt, Human
ucugcgagguuacuggcuguc

SEQ ID NO: 913829 - RNA, 23 nt, Human
ucugcgagguuacuggcuguccg

SEQ ID NO: 913830 - RNA, 22 nt, Human
uggaggaggggcggucacgcag

SEQ ID NO: 913831 - RNA, 19 nt, Human
ugggaugcaaggagacacc

SEQ ID NO: 913832 - RNA, 23 nt, Human
uggggcgcaggauggagcaaggg

SEQ ID NO: 913833 - RNA, 21 nt, Human
ugggggcggcggcagcagagg

SEQ ID NO: 913834 - RNA, 19 nt, Human
uggggggugggggggaugc

SEQ ID NO: 913835 - RNA, 21 nt, Human
uguuccauggggggugggggg

SEQ ID NO: 913836 - RNA, 19 nt, Human
uguuccucuggcuuuuccu

SEQ ID NO: 913837 - RNA, 21 nt, Human
uuccaagguuugcgcgccacc

SEQ ID NO: 913838 - RNA, 23 nt, Human
uuugggggugcuagaagggagug

SEQ ID NO: 913839 - RNA, 20 nt, Human
aaacccggaaggagcuaaug

SEQ ID NO: 913840 - RNA, 21 nt, Human
aaccaaaucuuuauuagucuc

SEQ ID NO: 913841 - RNA, 19 nt, Human
aaggcucacaucuccccuu

SEQ ID NO: 913842 - RNA, 22 nt, Human
aagggaaccaaagggggagacu

SEQ ID NO: 913843 - RNA, 23 nt, Human
accccagcccaaaugaacuccca

SEQ ID NO: 913844 - RNA, 23 nt, Human
acuccuguucuccccaccaggac

SEQ ID NO: 913845 - RNA, 20 nt, Human
agacaaagccugagagggug

SEQ ID NO: 913846 - RNA, 22 nt, Human
agacugguggaccaccugaggg

SEQ ID NO: 913847 - RNA, 27 nt, Human
aggaggaagaggagucuagcaauccaa

SEQ ID NO: 913848 - RNA, 21 nt, Human
aggcaaggagggagcgcacag

SEQ ID NO: 913849 - RNA, 20 nt, Human
aggcuggagggggaggcaag

SEQ ID NO: 913850 - RNA, 20 nt, Human
agggccaaagugggacaggg

SEQ ID NO: 913851 - RNA, 21 nt, Human
aucaugaaacuucccuccaga

SEQ ID NO: 913852 - RNA, 18 nt, Human
auugggauagaaaggggg

SEQ ID NO: 913853 - RNA, 19 nt, Human
caaggaaggucgccucuuu

SEQ ID NO: 913854 - RNA, 24 nt, Human
caaucaugaaacuucccuccagag

SEQ ID NO: 913855 - RNA, 19 nt, Human
caccuguuccccaaccagg

SEQ ID NO: 913856 - RNA, 23 nt, Human
cagagaaggcucacaucuccccu

SEQ ID NO: 913857 - RNA, 22 nt, Human
cauuauagaugcaaucaugaaa

SEQ ID NO: 913858 - RNA, 22 nt, Human
ccaccccagcccaaaugaacuc

SEQ ID NO: 913859 - RNA, 19 nt, Human
ccagggcagcauuucccag

SEQ ID NO: 913860 - RNA, 19 nt, Human
cccaaggaaggucgccucu

SEQ ID NO: 913861 - RNA, 26 nt, Human
cccagccuccaccccagcccaaauga

SEQ ID NO: 913862 - RNA, 22 nt, Human
cccugagcgccuuagagauaag

SEQ ID NO: 913863 - RNA, 23 nt, Human
ccuaccugucuugcucccugccc

SEQ ID NO: 913864 - RNA, 23 nt, Human
ccuccaccccagcccaaaugaac

SEQ ID NO: 913865 - RNA, 20 nt, Human
ccuccuagguugggggcggg

SEQ ID NO: 913866 - RNA, 20 nt, Human
ccuccuccuagguugggggc

SEQ ID NO: 913867 - RNA, 21 nt, Human
ccuccuccuagguugggggcg

SEQ ID NO: 913868 - RNA, 19 nt, Human
ccuggcugcgcagucuggc

SEQ ID NO: 913869 - RNA, 26 nt, Human
cgcagcggggcauuucccugagcgcc

SEQ ID NO: 913870 - RNA, 20 nt, Human
cggaaggagcuaauggagag

SEQ ID NO: 913871 - RNA, 22 nt, Human
cggaaggagcuaauggagagga

SEQ ID NO: 913872 - RNA, 23 nt, Human
cggaaggagcuaauggagaggau

SEQ ID NO: 913873 - RNA, 23 nt, Human
cuccaccccagcccaaaugaacu

SEQ ID NO: 913874 - RNA, 20 nt, Human
cucuucagcuuugucaaguc

SEQ ID NO: 913875 - RNA, 22 nt, Human
cuuuauuagucucggcagcaga

SEQ ID NO: 913876 - RNA, 27 nt, Human
gaaauguauccauaaaugucuauaaca

SEQ ID NO: 913877 - RNA, 23 nt, Human
gaaccaaagggggagacuggugg

SEQ ID NO: 913878 - RNA, 21 nt, Human
gaaggugcuaccaagugggag

SEQ ID NO: 913879 - RNA, 23 nt, Human
gaccaccugagggcaggcacaga

SEQ ID NO: 913880 - RNA, 18 nt, Human
gaggaugggguccaggag

SEQ ID NO: 913881 - RNA, 21 nt, Human
gaggaugggguccaggaggaa

SEQ ID NO: 913882 - RNA, 20 nt, Human
gccuccaccccagcccaaau

SEQ ID NO: 913883 - RNA, 20 nt, Human
ggaaccaaagggggagacug

SEQ ID NO: 913884 - RNA, 21 nt, Human
ggaaggagcuaauggagagga

SEQ ID NO: 913885 - RNA, 26 nt, Human
ggaagggaaccaaagggggagacugg

SEQ ID NO: 913886 - RNA, 18 nt, Human
ggacagcgcccauacccc

SEQ ID NO: 913887 - RNA, 18 nt, Human
gggaaggaugggacuuaa

SEQ ID NO: 913888 - RNA, 19 nt, Human
gggauagaaagggggaaga

SEQ ID NO: 913889 - RNA, 21 nt, Human
gggauagaaagggggaagaga

SEQ ID NO: 913890 - RNA, 21 nt, Human
gucacagcuauaaagagaggg

SEQ ID NO: 913891 - RNA, 20 nt, Human
guuuacuccuguucucccca

SEQ ID NO: 913892 - RNA, 23 nt, Human
uaacucaggaguguuuuagguau

SEQ ID NO: 913893 - RNA, 19 nt, Human
uacugcuagaaccaaccaa

SEQ ID NO: 913894 - RNA, 18 nt, Human
uagaugcaaucaugaaac

SEQ ID NO: 913895 - RNA, 20 nt, Human
ucaaaggacugauaacucuu

SEQ ID NO: 913896 - RNA, 18 nt, Human
ucaagcgauguuuguacc

SEQ ID NO: 913897 - RNA, 21 nt, Human
ucacuagacaagucaucccug

SEQ ID NO: 913898 - RNA, 24 nt, Human
ucacuagacaagucaucccugauu

SEQ ID NO: 913899 - RNA, 25 nt, Human
ucacuagacaagucaucccugauuc

SEQ ID NO: 913900 - RNA, 21 nt, Human
ucagaaguggucuuggcucag

SEQ ID NO: 913901 - RNA, 19 nt, Human
uccaccccagcccaaauga

SEQ ID NO: 913902 - RNA, 21 nt, Human
ucccaaggaaggucgccucuu

SEQ ID NO: 913903 - RNA, 24 nt, Human
ucccagaaggcucccgcagcgggg

SEQ ID NO: 913904 - RNA, 19 nt, Human
ucccagccuccaccccagc

SEQ ID NO: 913905 - RNA, 18 nt, Human
ucccugccccaccugucc

SEQ ID NO: 913906 - RNA, 18 nt, Human
uccuggguggccagggca

SEQ ID NO: 913907 - RNA, 18 nt, Human
uccuuagcuugaaggccc

SEQ ID NO: 913908 - RNA, 20 nt, Human
ucggcagcagaacuaaugga

SEQ ID NO: 913909 - RNA, 25 nt, Human
ugagggcaggcacagauggggcuuc

SEQ ID NO: 913910 - RNA, 19 nt, Human
ugcccuguuguguuuagag

SEQ ID NO: 913911 - RNA, 21 nt, Human
uggaagggaaccaaaggggga

SEQ ID NO: 913912 - RNA, 19 nt, Human
uggacaugugucaguauuc

SEQ ID NO: 913913 - RNA, 20 nt, Human
uggaccaccugagggcaggc

SEQ ID NO: 913914 - RNA, 18 nt, Human
uggaucaggccccagagg

SEQ ID NO: 913915 - RNA, 22 nt, Human
uggaugguagaggauggggucc

SEQ ID NO: 913916 - RNA, 21 nt, Human
ugggacagggcuuggauggua

SEQ ID NO: 913917 - RNA, 20 nt, Human
ugggaggcuggagggggagg

SEQ ID NO: 913918 - RNA, 20 nt, Human
uggguggccagggcagcauu

SEQ ID NO: 913919 - RNA, 20 nt, Human
ugguggaccaccugagggca

SEQ ID NO: 913920 - RNA, 18 nt, Human
ugucuugcucccugcccc

SEQ ID NO: 913921 - RNA, 23 nt, Human
ugugagaggcauuucuggacgga

SEQ ID NO: 913922 - RNA, 21 nt, Human
ugugggaaggaugggacuuaa

SEQ ID NO: 913923 - RNA, 21 nt, Human
ugugucaguauucacaaaaca

SEQ ID NO: 913924 - RNA, 18 nt, Human
uguuugugggaaggaugg

SEQ ID NO: 913925 - RNA, 25 nt, Human
uucacaaaacaggcaauauauucau

SEQ ID NO: 913926 - RNA, 20 nt, Human
uugaaggcccaccacggucu

SEQ ID NO: 913927 - RNA, 22 nt, Human
uuugucaaguccuuguuuacuc

SEQ ID NO: 913928 - RNA, 24 nt, Human
uuugucaaguccuuguuuacuccu

SEQ ID NO: 913929 - RNA, 21 nt, Human
uuuuuuuuuuuuacugcuaga

SEQ ID NO: 913930 - RNA, 25 nt, Human
uuuuuuuuuuuuuuuuuacugcuag

SEQ ID NO: 913931 - RNA, 24 nt, Human
aagcaagggggcuggaauagggcc

SEQ ID NO: 913932 - RNA, 18 nt, Human
acucuaccaccuccuccc

SEQ ID NO: 913933 - RNA, 21 nt, Human
caccgcuuuggcccacccuuc

SEQ ID NO: 913934 - RNA, 19 nt, Human
caccuccucccuaauucuc

SEQ ID NO: 913935 - RNA, 21 nt, Human
ccacccuucccuccugucccc

SEQ ID NO: 913936 - RNA, 25 nt, Human
ccaccuccucccuaauucucaacuc

SEQ ID NO: 913937 - RNA, 25 nt, Human
ccccacccaacuggcuggcccuccu

SEQ ID NO: 913938 - RNA, 19 nt, Human
ccgcggcucuucucuccuc

SEQ ID NO: 913939 - RNA, 19 nt, Human
ccuccuguccccucucccu

SEQ ID NO: 913940 - RNA, 20 nt, Human
ccuccuguccccucucccuu

SEQ ID NO: 913941 - RNA, 21 nt, Human
ccucuccccgccucagagccc

SEQ ID NO: 913942 - RNA, 20 nt, Human
ccugcccccgggccucggcc

SEQ ID NO: 913943 - RNA, 22 nt, Human
ccuuucuugcccuacccuuccu

SEQ ID NO: 913944 - RNA, 18 nt, Human
cggacucuaccaccuccu

SEQ ID NO: 913945 - RNA, 20 nt, Human
cggcccucucccccacccaa

SEQ ID NO: 913946 - RNA, 23 nt, Human
cucacuacccggacucuaccacc

SEQ ID NO: 913947 - RNA, 29 nt, Human
cuccgggcugggccccccgcggcucuucc

SEQ ID NO: 913948 - RNA, 26 nt, Human
gaagcaagggggcuggaauagggccu

SEQ ID NO: 913949 - RNA, 19 nt, Human
gcccccgggccucggcccu

SEQ ID NO: 913950 - RNA, 18 nt, Human
gcuuuggcccacccuucc

SEQ ID NO: 913951 - RNA, 23 nt, Human
ggcucuucucuccucuccucucc

SEQ ID NO: 913952 - RNA, 18 nt, Human
uaaaccgagaaggaaacc

SEQ ID NO: 913953 - RNA, 24 nt, Human
uaacagaauaaaccgagaaggaaa

SEQ ID NO: 913954 - RNA, 18 nt, Human
uagagugaagcaaggggg

SEQ ID NO: 913955 - RNA, 23 nt, Human
uccugucccuccgcucacuaccc

SEQ ID NO: 913956 - RNA, 20 nt, Human
ugaagcaagggggcuggaau

SEQ ID NO: 913957 - RNA, 22 nt, Human
ugcacuccugcccccgggccuc

SEQ ID NO: 913958 - RNA, 20 nt, Human
ugcccccgggccucggcccu

SEQ ID NO: 913959 - RNA, 20 nt, Human
uggcccacccuucccuccug

SEQ ID NO: 913960 - RNA, 19 nt, Human
uggcuccgggcugggcccc

SEQ ID NO: 913961 - RNA, 20 nt, Human
uggcuccgggcugggccccc

SEQ ID NO: 913962 - RNA, 24 nt, Human
aaaaacacaaggaggcccgggaag

SEQ ID NO: 913963 - RNA, 21 nt, Human
aagaacaguaggacaaggaaa

SEQ ID NO: 913964 - RNA, 19 nt, Human
aagccuuuccauguccacc

SEQ ID NO: 913965 - RNA, 21 nt, Human
aagccuuuccauguccaccag

SEQ ID NO: 913966 - RNA, 25 nt, Human
acagcugggcggggugccggggccc

SEQ ID NO: 913967 - RNA, 21 nt, Human
acccagcucagcagggagggg

SEQ ID NO: 913968 - RNA, 24 nt, Human
agaagaaagagaguuccuuucuag

SEQ ID NO: 913969 - RNA, 21 nt, Human
agaagccuuuccauguccacc

SEQ ID NO: 913970 - RNA, 21 nt, Human
agaggaaaagcucgcagggag

SEQ ID NO: 913971 - RNA, 18 nt, Human
agcacagggggaaggaaa

SEQ ID NO: 913972 - RNA, 22 nt, Human
agcagggagggggcauucugug

SEQ ID NO: 913973 - RNA, 21 nt, Human
aggaaggggcaccucuggguc

SEQ ID NO: 913974 - RNA, 22 nt, Human
aggaggcugcuuccaugccccg

SEQ ID NO: 913975 - RNA, 20 nt, Human
aggcaaaaacacaaggaggc

SEQ ID NO: 913976 - RNA, 23 nt, Human
aggcaaaaacacaaggaggcccg

SEQ ID NO: 913977 - RNA, 21 nt, Human
aggccuccugacucaucccag

SEQ ID NO: 913978 - RNA, 18 nt, Human
aggggcgaggggagggca

SEQ ID NO: 913979 - RNA, 22 nt, Human
aggugggcaggucuuugggaga

SEQ ID NO: 913980 - RNA, 23 nt, Human
agugggccacccccacagcaaug

SEQ ID NO: 913981 - RNA, 19 nt, Human
aucucucccucgcccccca

SEQ ID NO: 913982 - RNA, 18 nt, Human
auuuauagaaggaaggga

SEQ ID NO: 913983 - RNA, 19 nt, Human
caacuacagaggcugagaa

SEQ ID NO: 913984 - RNA, 21 nt, Human
caaugccaaggggcgagggga

SEQ ID NO: 913985 - RNA, 22 nt, Human
cacaccucuccccaagccucca

SEQ ID NO: 913986 - RNA, 19 nt, Human
caccuccaucaucccccaa

SEQ ID NO: 913987 - RNA, 21 nt, Human
caccuccaucaucccccaaac

SEQ ID NO: 913988 - RNA, 26 nt, Human
caccuccaucaucccccaaacagccg

SEQ ID NO: 913989 - RNA, 21 nt, Human
caccucugagaaagucacugu

SEQ ID NO: 913990 - RNA, 23 nt, Human
cagagcaugaggcggcccacucc

SEQ ID NO: 913991 - RNA, 19 nt, Human
cagcaagcguugccgcggu

SEQ ID NO: 913992 - RNA, 19 nt, Human
cagcagggagggggcauuc

SEQ ID NO: 913993 - RNA, 20 nt, Human
cagcagggagggggcauucu

SEQ ID NO: 913994 - RNA, 20 nt, Human
cagcaggguggcaggagagc

SEQ ID NO: 913995 - RNA, 20 nt, Human
cagccaagagcucacaggug

SEQ ID NO: 913996 - RNA, 19 nt, Human
cagcucccugaaccugggc

SEQ ID NO: 913997 - RNA, 21 nt, Human
cagcugagcagcgcaagaaga

SEQ ID NO: 913998 - RNA, 18 nt, Human
caggaagaggguucuuug

SEQ ID NO: 913999 - RNA, 24 nt, Human
caguaggaaugaggcaaaaacaca

SEQ ID NO: 914000 - RNA, 20 nt, Human
cagugggccacccccacagc

SEQ ID NO: 914001 - RNA, 22 nt, Human
caucacgaaaauccagcugcuc

SEQ ID NO: 914002 - RNA, 22 nt, Human
cauccaucaucucugucaccuc

SEQ ID NO: 914003 - RNA, 21 nt, Human
caucucugucaccucugagaa

SEQ ID NO: 914004 - RNA, 25 nt, Human
caugccaggccccagcagagcauga

SEQ ID NO: 914005 - RNA, 19 nt, Human
ccaaacagccggcugcugc

SEQ ID NO: 914006 - RNA, 22 nt, Human
ccacagcaaugcugucagcaca

SEQ ID NO: 914007 - RNA, 19 nt, Human
ccacccccacagcaaugcu

SEQ ID NO: 914008 - RNA, 22 nt, Human
ccagcccagcugccaacuacag

SEQ ID NO: 914009 - RNA, 21 nt, Human
ccagggagucacgguggugca

SEQ ID NO: 914010 - RNA, 18 nt, Human
ccaggggagggcaguggg

SEQ ID NO: 914011 - RNA, 20 nt, Human
ccaggggagggcagugggcc

SEQ ID NO: 914012 - RNA, 22 nt, Human
ccaucaucccccaaacagccgg

SEQ ID NO: 914013 - RNA, 22 nt, Human
ccauguucucuccuucuccaca

SEQ ID NO: 914014 - RNA, 27 nt, Human
ccauguucucuccuucuccacaccucu

SEQ ID NO: 914015 - RNA, 20 nt, Human
ccccaaacagccggcugcug

SEQ ID NO: 914016 - RNA, 18 nt, Human
ccccaagccuccaggccu

SEQ ID NO: 914017 - RNA, 27 nt, Human
ccccaagccuccaggccuccugacucc

SEQ ID NO: 914018 - RNA, 19 nt, Human
ccccagagacccagcucag

SEQ ID NO: 914019 - RNA, 22 nt, Human
cccccacagcaaugcugucagc

SEQ ID NO: 914020 - RNA, 21 nt, Human
cccccagcuccccaggagucc

SEQ ID NO: 914021 - RNA, 22 nt, Human
ccccccagcuccccaggagucc

SEQ ID NO: 914022 - RNA, 22 nt, Human
cccccuccucaaccccaguggc

SEQ ID NO: 914023 - RNA, 19 nt, Human
cccugggagagcccaggag

SEQ ID NO: 914024 - RNA, 19 nt, Human
ccgacagccugacgccccc

SEQ ID NO: 914025 - RNA, 19 nt, Human
ccggcccgcugcugcuucc

SEQ ID NO: 914026 - RNA, 19 nt, Human
ccggggcccgcgggacagc

SEQ ID NO: 914027 - RNA, 19 nt, Human
ccucgccccccagcucccc

SEQ ID NO: 914028 - RNA, 20 nt, Human
cgcuugcuccucucccggcu

SEQ ID NO: 914029 - RNA, 21 nt, Human
cuccacaccucuccccaagcc

SEQ ID NO: 914030 - RNA, 18 nt, Human
cuccaucaucccccaaac

SEQ ID NO: 914031 - RNA, 18 nt, Human
cucccccuccucaacccc

SEQ ID NO: 914032 - RNA, 21 nt, Human
cuccccggggaggggcucccg

SEQ ID NO: 914033 - RNA, 18 nt, Human
cucccggccagcagggug

SEQ ID NO: 914034 - RNA, 23 nt, Human
cuccucccccuccucaaccccag

SEQ ID NO: 914035 - RNA, 22 nt, Human
cucucccucgccccccagcucc

SEQ ID NO: 914036 - RNA, 20 nt, Human
cuggacgaggcaaagaacag

SEQ ID NO: 914037 - RNA, 19 nt, Human
cuuuccauguccaccaggc

SEQ ID NO: 914038 - RNA, 18 nt, Human
gaaaggggaaguucucca

SEQ ID NO: 914039 - RNA, 20 nt, Human
gaagccuuuccauguccacc

SEQ ID NO: 914040 - RNA, 19 nt, Human
gaaguccagcccagcugcc

SEQ ID NO: 914041 - RNA, 20 nt, Human
gacagcagccggacgccugg

SEQ ID NO: 914042 - RNA, 26 nt, Human
gagaaagccagcucccugaaccuggg

SEQ ID NO: 914043 - RNA, 22 nt, Human
gagcaggggggcaggagagaga

SEQ ID NO: 914044 - RNA, 20 nt, Human
gagccaguggggaggggaga

SEQ ID NO: 914045 - RNA, 26 nt, Human
gagcucacaggugccagggcccucgg

SEQ ID NO: 914046 - RNA, 18 nt, Human
gaggcaaaaacacaagga

SEQ ID NO: 914047 - RNA, 23 nt, Human
gaggggagggcagcugggcagag

SEQ ID NO: 914048 - RNA, 25 nt, Human
gaggggagggcagcugggcagagug

SEQ ID NO: 914049 - RNA, 19 nt, Human
gaggguucuuuggggcaag

SEQ ID NO: 914050 - RNA, 22 nt, Human
gcagcagaggguccacagucca

SEQ ID NO: 914051 - RNA, 18 nt, Human
gccauguucucuccuucu

SEQ ID NO: 914052 - RNA, 27 nt, Human
gccccggggggacaugagggccagggg

SEQ ID NO: 914053 - RNA, 21 nt, Human
gcgggacagcuuacaggucuc

SEQ ID NO: 914054 - RNA, 19 nt, Human
gcggggugccggggcccgc

SEQ ID NO: 914055 - RNA, 18 nt, Human
gcuacagauaggugaccg

SEQ ID NO: 914056 - RNA, 23 nt, Human
gcugccaaggaggcugcuuccau

SEQ ID NO: 914057 - RNA, 18 nt, Human
ggagaaggagggacagcu

SEQ ID NO: 914058 - RNA, 18 nt, Human
ggagcaggggggcaggag

SEQ ID NO: 914059 - RNA, 18 nt, Human
ggagggagcaggggggca

SEQ ID NO: 914060 - RNA, 24 nt, Human
ggcaaaaacacaaggaggcccggg

SEQ ID NO: 914061 - RNA, 20 nt, Human
ggcaggcggaccccagcccc

SEQ ID NO: 914062 - RNA, 26 nt, Human
ggcagguggagaaggagggacagcuc

SEQ ID NO: 914063 - RNA, 21 nt, Human
ggccaggggagggcagugggc

SEQ ID NO: 914064 - RNA, 19 nt, Human
ggcugcacucuccucugcc

SEQ ID NO: 914065 - RNA, 18 nt, Human
gggaaggaaagggccugg

SEQ ID NO: 914066 - RNA, 22 nt, Human
gggaggacagggagagaccucu

SEQ ID NO: 914067 - RNA, 20 nt, Human
gggaguccacccucgugacc

SEQ ID NO: 914068 - RNA, 19 nt, Human
gggauccaggccuggagug

SEQ ID NO: 914069 - RNA, 23 nt, Human
gggcagaguggagggagcagggg

SEQ ID NO: 914070 - RNA, 27 nt, Human
gggcagguggagaaggagggacagcuc

SEQ ID NO: 914071 - RNA, 23 nt, Human
gggcgaggggagggcagcugggc

SEQ ID NO: 914072 - RNA, 19 nt, Human
ggggagaggcggagcagca

SEQ ID NO: 914073 - RNA, 21 nt, Human
ggggagggcagcugggcagag

SEQ ID NO: 914074 - RNA, 23 nt, Human
ggggcaccucugggucucagggg

SEQ ID NO: 914075 - RNA, 21 nt, Human
ggggugccggggcccgcggga

SEQ ID NO: 914076 - RNA, 21 nt, Human
ggugagugggacuaagaaaga

SEQ ID NO: 914077 - RNA, 19 nt, Human
gucagccccucccacaggc

SEQ ID NO: 914078 - RNA, 25 nt, Human
gugccggggcccgcgggacagcuua

SEQ ID NO: 914079 - RNA, 20 nt, Human
gugguuggcccugagugggg

SEQ ID NO: 914080 - RNA, 19 nt, Human
uaugcugggguauggaagg

SEQ ID NO: 914081 - RNA, 18 nt, Human
ucacaggugccagggccc

SEQ ID NO: 914082 - RNA, 20 nt, Human
ucaccuccaucaucccccaa

SEQ ID NO: 914083 - RNA, 20 nt, Human
ucacuggggucagcaagcgu

SEQ ID NO: 914084 - RNA, 22 nt, Human
ucagccccucccacaggcucuc

SEQ ID NO: 914085 - RNA, 19 nt, Human
ucaggccucucuccucacu

SEQ ID NO: 914086 - RNA, 21 nt, Human
ucaggggucuccucccccucc

SEQ ID NO: 914087 - RNA, 21 nt, Human
ucaucacgaaaauccagcugc

SEQ ID NO: 914088 - RNA, 23 nt, Human
ucauccaucaucucugucaccuc

SEQ ID NO: 914089 - RNA, 20 nt, Human
uccaucaucucugucaccuc

SEQ ID NO: 914090 - RNA, 20 nt, Human
uccauguccaccaggcuggg

SEQ ID NO: 914091 - RNA, 18 nt, Human
ucccagcugaggaagggg

SEQ ID NO: 914092 - RNA, 24 nt, Human
ucccggcugccaaggaggcugcuu

SEQ ID NO: 914093 - RNA, 21 nt, Human
ucccugggagagcccaggagg

SEQ ID NO: 914094 - RNA, 24 nt, Human
ucccugggagagcccaggaggugg

SEQ ID NO: 914095 - RNA, 18 nt, Human
uccucaaccccaguggcu

SEQ ID NO: 914096 - RNA, 20 nt, Human
ucgcagggaggacagggaga

SEQ ID NO: 914097 - RNA, 23 nt, Human
ucucaggggucuccucccccucc

SEQ ID NO: 914098 - RNA, 21 nt, Human
ucuccucccccuccucaaccc

SEQ ID NO: 914099 - RNA, 19 nt, Human
ucuuugggagauagagacc

SEQ ID NO: 914100 - RNA, 24 nt, Human
ugaggcaaaaacacaaggaggccc

SEQ ID NO: 914101 - RNA, 22 nt, Human
ugaggcugcacucuccucugcc

SEQ ID NO: 914102 - RNA, 22 nt, Human
ugccaacuacagaggcugagaa

SEQ ID NO: 914103 - RNA, 21 nt, Human
ugccaagagaagaaagagagu

SEQ ID NO: 914104 - RNA, 24 nt, Human
ugccaagagaagaaagagaguucc

SEQ ID NO: 914105 - RNA, 27 nt, Human
ugccaagagaagaaagagaguuccuuu

SEQ ID NO: 914106 - RNA, 19 nt, Human
ugccaaggaggcugcuucc

SEQ ID NO: 914107 - RNA, 20 nt, Human
ugccaggccccagcagagca

SEQ ID NO: 914108 - RNA, 20 nt, Human
ugcugcugucagccccuccc

SEQ ID NO: 914109 - RNA, 23 nt, Human
ugcugcugucagccccucccaca

SEQ ID NO: 914110 - RNA, 24 nt, Human
ugcugcugucagccccucccacag

SEQ ID NO: 914111 - RNA, 24 nt, Human
uggaaggaaggaacauccgacagc

SEQ ID NO: 914112 - RNA, 21 nt, Human
uggagggagcaggggggcagg

SEQ ID NO: 914113 - RNA, 18 nt, Human
uggaugagcuccccggca

SEQ ID NO: 914114 - RNA, 23 nt, Human
uggcccagaggggcuucccuggg

SEQ ID NO: 914115 - RNA, 20 nt, Human
uggccuugccggcccgcuga

SEQ ID NO: 914116 - RNA, 27 nt, Human
uggcgugcgcuugcuccucucccggcu

SEQ ID NO: 914117 - RNA, 22 nt, Human
uggcugcugucucagaccccug

SEQ ID NO: 914118 - RNA, 22 nt, Human
ugggacuaagaaagaucgcccc

SEQ ID NO: 914119 - RNA, 22 nt, Human
ugggccacccccacagcaaugc

SEQ ID NO: 914120 - RNA, 18 nt, Human
uggggaggggagaggcgg

SEQ ID NO: 914121 - RNA, 18 nt, Human
ugugcagcgcgucgcugc

SEQ ID NO: 914122 - RNA, 21 nt, Human
ugugggccacacuuaccaaga

SEQ ID NO: 914123 - RNA, 23 nt, Human
uucaucacgaaaauccagcugcu

SEQ ID NO: 914124 - RNA, 24 nt, Human
uuccgcucaucucucccucgcccc

SEQ ID NO: 914125 - RNA, 27 nt, Human
aaaaauaaacagcaugaccacuaaccc

SEQ ID NO: 914126 - RNA, 23 nt, Human
aaaauaaacagcaugaccacuaa

SEQ ID NO: 914127 - RNA, 21 nt, Human
aaacaaacaugcuagacaaac

SEQ ID NO: 914128 - RNA, 19 nt, Human
aaacagcaugaccacuaac

SEQ ID NO: 914129 - RNA, 21 nt, Human
aacagcaugaccacuaacccu

SEQ ID NO: 914130 - RNA, 24 nt, Human
aagaggaaaacaagauuagcacaa

SEQ ID NO: 914131 - RNA, 22 nt, Human
aagcagaaagguagaguuaggg

SEQ ID NO: 914132 - RNA, 20 nt, Human
acaugcccauguucccagaa

SEQ ID NO: 914133 - RNA, 21 nt, Human
acuuuguauagcagagaaaaa

SEQ ID NO: 914134 - RNA, 28 nt, Human
aggaauacuaagaggaaaaccgguaccc

SEQ ID NO: 914135 - RNA, 20 nt, Human
augcccauguucccagaaau

SEQ ID NO: 914136 - RNA, 21 nt, Human
cacaaaauauauuacugcaua

SEQ ID NO: 914137 - RNA, 20 nt, Human
cagacauauagacacaccaa

SEQ ID NO: 914138 - RNA, 24 nt, Human
cagcaugaccacuaacccuaaaau

SEQ ID NO: 914139 - RNA, 18 nt, Human
caugaccacuaacccuaa

SEQ ID NO: 914140 - RNA, 25 nt, Human
cuaaaaugaaugugaaccauuugcc

SEQ ID NO: 914141 - RNA, 21 nt, Human
cuaacccuaaaaugaauguga

SEQ ID NO: 914142 - RNA, 22 nt, Human
cuaagaggaaaacaagauuagc

SEQ ID NO: 914143 - RNA, 20 nt, Human
cuuuguauagcagagaaaaa

SEQ ID NO: 914144 - RNA, 21 nt, Human
gagaaaaauaaacagcaugac

SEQ ID NO: 914145 - RNA, 20 nt, Human
gcaauugaaauucaccugga

SEQ ID NO: 914146 - RNA, 19 nt, Human
ggagagugaagaaaaaaug

SEQ ID NO: 914147 - RNA, 19 nt, Human
uaaacagcaugaccacuaa

SEQ ID NO: 914148 - RNA, 21 nt, Human
uaagaggaacuuuguauagca

SEQ ID NO: 914149 - RNA, 24 nt, Human
uagcagagaaaaauaaacagcaug

SEQ ID NO: 914150 - RNA, 24 nt, Human
uagggucuaugaaaaaaaauaggg

SEQ ID NO: 914151 - RNA, 21 nt, Human
uauauacaugcccauguuccc

SEQ ID NO: 914152 - RNA, 20 nt, Human
uauauauauacaugcccaug

SEQ ID NO: 914153 - RNA, 25 nt, Human
ucccaaaggauuaaacaaacaugcu

SEQ ID NO: 914154 - RNA, 23 nt, Human
ucccagaaaucauuauauuuccu

SEQ ID NO: 914155 - RNA, 22 nt, Human
ugaaaaaaaauagggccagagg

SEQ ID NO: 914156 - RNA, 19 nt, Human
ugaagaaaaaaugaaucac

SEQ ID NO: 914157 - RNA, 23 nt, Human
ugaggcagaccccuaagaggaac

SEQ ID NO: 914158 - RNA, 19 nt, Human
ugagggguggagaagaaga

SEQ ID NO: 914159 - RNA, 21 nt, Human
ugagggguggagaagaagagg

SEQ ID NO: 914160 - RNA, 22 nt, Human
ugggaaauuuucagcaauugaa

SEQ ID NO: 914161 - RNA, 21 nt, Human
uucaaaaauccaaacaaaugu

SEQ ID NO: 914162 - RNA, 18 nt, Human
uugagggguggagaagaa

SEQ ID NO: 914163 - RNA, 22 nt, Human
aaaaacccaaaagaaaggugug

SEQ ID NO: 914164 - RNA, 24 nt, Human
aaguguucucucgaacauuguucc

SEQ ID NO: 914165 - RNA, 20 nt, Human
acccaaaagaaagguguggc

SEQ ID NO: 914166 - RNA, 25 nt, Human
accccacuccccaggcuuccuccca

SEQ ID NO: 914167 - RNA, 21 nt, Human
acccggcgcgcuccacaccac

SEQ ID NO: 914168 - RNA, 21 nt, Human
accuggguccccuucuggcuc

SEQ ID NO: 914169 - RNA, 25 nt, Human
accuucuuugucuuccuucccccaa

SEQ ID NO: 914170 - RNA, 20 nt, Human
agagcaggguuucagggaag

SEQ ID NO: 914171 - RNA, 23 nt, Human
agagcccuugcagagacccacuc

SEQ ID NO: 914172 - RNA, 19 nt, Human
agaguggagaaaggccagg

SEQ ID NO: 914173 - RNA, 19 nt, Human
agauggaggaggcuuggca

SEQ ID NO: 914174 - RNA, 20 nt, Human
agcaggggaaaagacacaug

SEQ ID NO: 914175 - RNA, 18 nt, Human
agcauuuaaaguuguuuu

SEQ ID NO: 914176 - RNA, 23 nt, Human
agccggcuccgggacccggcgcg

SEQ ID NO: 914177 - RNA, 21 nt, Human
aggagcacucacuguuccuga

SEQ ID NO: 914178 - RNA, 18 nt, Human
aggcuuccucccaccagu

SEQ ID NO: 914179 - RNA, 26 nt, Human
aucacacuaaaaggaacacaucauaa

SEQ ID NO: 914180 - RNA, 19 nt, Human
caaaaacccaaaagaaagg

SEQ ID NO: 914181 - RNA, 25 nt, Human
caaagaaucacacuaaaaggaacac

SEQ ID NO: 914182 - RNA, 23 nt, Human
caaggugccagaauugugaaaug

SEQ ID NO: 914183 - RNA, 19 nt, Human
caauagagcaggguuucag

SEQ ID NO: 914184 - RNA, 18 nt, Human
cacccuuuuuacucccuc

SEQ ID NO: 914185 - RNA, 26 nt, Human
cagaaaaaaguccaagaaccuaauag

SEQ ID NO: 914186 - RNA, 19 nt, Human
cagagacccacucccgaag

SEQ ID NO: 914187 - RNA, 18 nt, Human
cagagggcugcacaucuc

SEQ ID NO: 914188 - RNA, 21 nt, Human
cagcaacacucucgcagccca

SEQ ID NO: 914189 - RNA, 23 nt, Human
cagcaacacucucgcagcccagc

SEQ ID NO: 914190 - RNA, 26 nt, Human
cagcacugaugggagauggaggaggc

SEQ ID NO: 914191 - RNA, 20 nt, Human
cagcccagccuccauucccu

SEQ ID NO: 914192 - RNA, 20 nt, Human
cagccgggcaagcagaggac

SEQ ID NO: 914193 - RNA, 21 nt, Human
cagcgguagcacagaaaaaag

SEQ ID NO: 914194 - RNA, 22 nt, Human
cagcugccccuccagacacaga

SEQ ID NO: 914195 - RNA, 22 nt, Human
caggcuuccucccaccagucuc

SEQ ID NO: 914196 - RNA, 23 nt, Human
cauucugggccccuggcucuucc

SEQ ID NO: 914197 - RNA, 20 nt, Human
ccaaucgcaaggugccagaa

SEQ ID NO: 914198 - RNA, 19 nt, Human
ccacagcacugaugggaga

SEQ ID NO: 914199 - RNA, 22 nt, Human
ccacagggcaugcacauccagc

SEQ ID NO: 914200 - RNA, 23 nt, Human
ccacauucaaggcaaccugagca

SEQ ID NO: 914201 - RNA, 23 nt, Human
ccaccagucucugacaauauuuc

SEQ ID NO: 914202 - RNA, 25 nt, Human
ccaccagucucugacaauauuuccu

SEQ ID NO: 914203 - RNA, 22 nt, Human
ccacuccccaggcuuccuccca

SEQ ID NO: 914204 - RNA, 22 nt, Human
ccagagcccuugcagagaccca

SEQ ID NO: 914205 - RNA, 21 nt, Human
ccaggcccaggaccagcucuc

SEQ ID NO: 914206 - RNA, 20 nt, Human
cccagagcccuugcagagac

SEQ ID NO: 914207 - RNA, 24 nt, Human
cccaggcuuccucccaccagucuc

SEQ ID NO: 914208 - RNA, 18 nt, Human
ccccaggcuuccucccac

SEQ ID NO: 914209 - RNA, 23 nt, Human
ccccaggcuuccucccaccaguc

SEQ ID NO: 914210 - RNA, 23 nt, Human
cccccaaagaaacuggacaaaaa

SEQ ID NO: 914211 - RNA, 24 nt, Human
cccccaaagaaacuggacaaaaaa

SEQ ID NO: 914212 - RNA, 19 nt, Human
cccuccagacacagauggc

SEQ ID NO: 914213 - RNA, 22 nt, Human
cccucugacaccaccuuggcuc

SEQ ID NO: 914214 - RNA, 20 nt, Human
ccggcauucugggccccugg

SEQ ID NO: 914215 - RNA, 24 nt, Human
ccuacacuggacccaauuuccuuc

SEQ ID NO: 914216 - RNA, 19 nt, Human
ccuauggcuggcagaggga

SEQ ID NO: 914217 - RNA, 21 nt, Human
ccucugacaccaccuuggcuc

SEQ ID NO: 914218 - RNA, 25 nt, Human
ccuggaccagcugaccagagggcug

SEQ ID NO: 914219 - RNA, 21 nt, Human
ccuggauuaaagguuucugac

SEQ ID NO: 914220 - RNA, 20 nt, Human
ccuggguccccuucuggcuc

SEQ ID NO: 914221 - RNA, 24 nt, Human
cgcuccacaccacugcgcucgcug

SEQ ID NO: 914222 - RNA, 24 nt, Human
cgguagcacagaaaaaaguccaag

SEQ ID NO: 914223 - RNA, 23 nt, Human
cuccacaccacugcgcucgcggc

SEQ ID NO: 914224 - RNA, 22 nt, Human
cucccccggcauucugggcccc

SEQ ID NO: 914225 - RNA, 19 nt, Human
cucccggcauacacuccgg

SEQ ID NO: 914226 - RNA, 19 nt, Human
cugcaccccacuccccagg

SEQ ID NO: 914227 - RNA, 19 nt, Human
cugccaggcccaggaccag

SEQ ID NO: 914228 - RNA, 19 nt, Human
cuggaccagcugaccagag

SEQ ID NO: 914229 - RNA, 21 nt, Human
cuggacccaauuuccuucuga

SEQ ID NO: 914230 - RNA, 22 nt, Human
cuggaucaagacaauguggaga

SEQ ID NO: 914231 - RNA, 18 nt, Human
cuggcuccuacagucaag

SEQ ID NO: 914232 - RNA, 21 nt, Human
cuggcuccuacagucaagggg

SEQ ID NO: 914233 - RNA, 19 nt, Human
cuggguccccuucuggcuc

SEQ ID NO: 914234 - RNA, 19 nt, Human
cuugcagagacccacuccc

SEQ ID NO: 914235 - RNA, 21 nt, Human
cuugcagccagcccacagcac

SEQ ID NO: 914236 - RNA, 20 nt, Human
cuuugggccucaccuuucuc

SEQ ID NO: 914237 - RNA, 19 nt, Human
gaaauucuuccugucagcc

SEQ ID NO: 914238 - RNA, 24 nt, Human
gaaggggaccggcggggaccagcc

SEQ ID NO: 914239 - RNA, 19 nt, Human
gacagccggcuccgggacc

SEQ ID NO: 914240 - RNA, 21 nt, Human
gaccugggacaguuugaaggc

SEQ ID NO: 914241 - RNA, 20 nt, Human
gagaaacagacaagcuguag

SEQ ID NO: 914242 - RNA, 21 nt, Human
gagaaacagacaagcuguagg

SEQ ID NO: 914243 - RNA, 22 nt, Human
gagcauugggacuuuggaaaug

SEQ ID NO: 914244 - RNA, 20 nt, Human
gagcuguaccuucguccaca

SEQ ID NO: 914245 - RNA, 21 nt, Human
gcaacaaagaaucacacuaaa

SEQ ID NO: 914246 - RNA, 24 nt, Human
gcauggagcuccagccucccccac

SEQ ID NO: 914247 - RNA, 20 nt, Human
gccagcagagagcagagagg

SEQ ID NO: 914248 - RNA, 25 nt, Human
gccccuggcucuuccagaguccaca

SEQ ID NO: 914249 - RNA, 21 nt, Human
gccuauggcuggcagagggac

SEQ ID NO: 914250 - RNA, 27 nt, Human
ggacaaguggacucuugguggcuggac

SEQ ID NO: 914251 - RNA, 22 nt, Human
ggaccagcucucuccuacacug

SEQ ID NO: 914252 - RNA, 22 nt, Human
ggagaacuguuucgaggcuugc

SEQ ID NO: 914253 - RNA, 26 nt, Human
ggagaguggagaaaggccaggaaagg

SEQ ID NO: 914254 - RNA, 24 nt, Human
ggaggcuuggcaaaaacccaaaag

SEQ ID NO: 914255 - RNA, 20 nt, Human
ggcaggcaggcgagcuguac

SEQ ID NO: 914256 - RNA, 20 nt, Human
gggagauguuccuucccagg

SEQ ID NO: 914257 - RNA, 24 nt, Human
gggcacuuuaccaacagguuuggg

SEQ ID NO: 914258 - RNA, 19 nt, Human
gggcaugaacacagcugcc

SEQ ID NO: 914259 - RNA, 23 nt, Human
ggguggggagugaggcagcaggg

SEQ ID NO: 914260 - RNA, 19 nt, Human
gguggcaagcagagagaga

SEQ ID NO: 914261 - RNA, 21 nt, Human
guccgagucagcugcauguga

SEQ ID NO: 914262 - RNA, 24 nt, Human
guggguggaaagcucugagcaggg

SEQ ID NO: 914263 - RNA, 25 nt, Human
guguaaguucaggucagguuugguu

SEQ ID NO: 914264 - RNA, 18 nt, Human
guguggaggcuguggcca

SEQ ID NO: 914265 - RNA, 21 nt, Human
uacuuugcuuugguguagaaa

SEQ ID NO: 914266 - RNA, 20 nt, Human
ucaaaagaguuggggggaaa

SEQ ID NO: 914267 - RNA, 23 nt, Human
ucaaaagaguuggggggaaaaaa

SEQ ID NO: 914268 - RNA, 23 nt, Human
ucagaagccucccccggcauucu

SEQ ID NO: 914269 - RNA, 19 nt, Human
ucagaagggcgaggagcac

SEQ ID NO: 914270 - RNA, 18 nt, Human
ucagagagaaaagggaaa

SEQ ID NO: 914271 - RNA, 23 nt, Human
ucauacauuugcguugauuuaaa

SEQ ID NO: 914272 - RNA, 20 nt, Human
uccaagaaccuaauagccug

SEQ ID NO: 914273 - RNA, 24 nt, Human
uccacaccacugcgcucgcggccg

SEQ ID NO: 914274 - RNA, 24 nt, Human
uccacauucaaggcaaccugagca

SEQ ID NO: 914275 - RNA, 27 nt, Human
uccacauucaaggcaaccugagcacag

SEQ ID NO: 914276 - RNA, 20 nt, Human
uccccaggcuuccucccacc

SEQ ID NO: 914277 - RNA, 19 nt, Human
ucccccacaucagaagggc

SEQ ID NO: 914278 - RNA, 18 nt, Human
ucccccggcauucugggc

SEQ ID NO: 914279 - RNA, 23 nt, Human
ucccccggcauucugggccccug

SEQ ID NO: 914280 - RNA, 19 nt, Human
uccccuucuggcuccuaca

SEQ ID NO: 914281 - RNA, 20 nt, Human
ucccugacacuggaggcagg

SEQ ID NO: 914282 - RNA, 18 nt, Human
ucccuguggguggaaagc

SEQ ID NO: 914283 - RNA, 20 nt, Human
ucccuguggguggaaagcuc

SEQ ID NO: 914284 - RNA, 19 nt, Human
uccgggacccggcgcgcuc

SEQ ID NO: 914285 - RNA, 18 nt, Human
uccugcaccccacucccc

SEQ ID NO: 914286 - RNA, 22 nt, Human
ucugacaauauuuccucugccu

SEQ ID NO: 914287 - RNA, 24 nt, Human
ucugcagccgggcaagcagaggac

SEQ ID NO: 914288 - RNA, 20 nt, Human
ucugguguggaggcuguggc

SEQ ID NO: 914289 - RNA, 21 nt, Human
ucuuccuucccccaaagaaac

SEQ ID NO: 914290 - RNA, 22 nt, Human
ugaaauguccaguagcacaggg

SEQ ID NO: 914291 - RNA, 18 nt, Human
ugaccagagggcugcaca

SEQ ID NO: 914292 - RNA, 23 nt, Human
ugaggcagaauccacguccuguu

SEQ ID NO: 914293 - RNA, 19 nt, Human
ugagggagaguggagaaag

SEQ ID NO: 914294 - RNA, 21 nt, Human
ugagugccacucagaagccuc

SEQ ID NO: 914295 - RNA, 23 nt, Human
ugauuuaaauacauuacguacaa

SEQ ID NO: 914296 - RNA, 18 nt, Human
ugcgcaggaccugggaca

SEQ ID NO: 914297 - RNA, 22 nt, Human
uggaagcaagaagauacgcacu

SEQ ID NO: 914298 - RNA, 18 nt, Human
uggacaaaaaaggucaga

SEQ ID NO: 914299 - RNA, 23 nt, Human
uggagaucugguguggaggcugg

SEQ ID NO: 914300 - RNA, 20 nt, Human
uggcaaaaacccaaaagaaa

SEQ ID NO: 914301 - RNA, 22 nt, Human
uggcaagcagagagagagggcu

SEQ ID NO: 914302 - RNA, 24 nt, Human
uggcuuuuccugcaccccacuccc

SEQ ID NO: 914303 - RNA, 27 nt, Human
ugggaccaaggacucaggaagcaaggu

SEQ ID NO: 914304 - RNA, 18 nt, Human
ugggacuuuggaaaugag

SEQ ID NO: 914305 - RNA, 21 nt, Human
ugggagauggaggaggcuugg

SEQ ID NO: 914306 - RNA, 20 nt, Human
ugggccccuggcucuuccag

SEQ ID NO: 914307 - RNA, 21 nt, Human
uggggagugaggcagcagggg

SEQ ID NO: 914308 - RNA, 18 nt, Human
uggggcaggcaggcgagc

SEQ ID NO: 914309 - RNA, 20 nt, Human
uggggcaggcaggcgagcug

SEQ ID NO: 914310 - RNA, 21 nt, Human
ugguggcuggacuggaagggg

SEQ ID NO: 914311 - RNA, 21 nt, Human
ugguguggaggcuguggccag

SEQ ID NO: 914312 - RNA, 22 nt, Human
uguaaguucaggucagguuugg

SEQ ID NO: 914313 - RNA, 21 nt, Human
ugucccagugcugugguacug

SEQ ID NO: 914314 - RNA, 23 nt, Human
uguggagaucugguguggaggcu

SEQ ID NO: 914315 - RNA, 18 nt, Human
ugugugcggaagugcugg

SEQ ID NO: 914316 - RNA, 22 nt, Human
uguucccaaggccaguguccga

SEQ ID NO: 914317 - RNA, 23 nt, Human
uucccaggcaucuggacuacgug

SEQ ID NO: 914318 - RNA, 22 nt, Human
uucccccaaagaaacuggacaa

SEQ ID NO: 914319 - RNA, 19 nt, Human
uuccugcaccccacucccc

SEQ ID NO: 914320 - RNA, 18 nt, Human
uuuuguuuuguuuguuuu

SEQ ID NO: 914321 - RNA, 19 nt, Human
acaguugaggugccaggac

SEQ ID NO: 914322 - RNA, 23 nt, Human
agagcucucccaucaucccagau

SEQ ID NO: 914323 - RNA, 24 nt, Human
agauugaggcagaaugguggucac

SEQ ID NO: 914324 - RNA, 19 nt, Human
aggagcagcaggagagagg

SEQ ID NO: 914325 - RNA, 19 nt, Human
aggcagaaugguggucacc

SEQ ID NO: 914326 - RNA, 19 nt, Human
aggugggcuugcaaaagau

SEQ ID NO: 914327 - RNA, 19 nt, Human
cacccuuguuacccuaggg

SEQ ID NO: 914328 - RNA, 22 nt, Human
caggcgcacgcucacgccaccc

SEQ ID NO: 914329 - RNA, 23 nt, Human
ccagagcucucccaucaucccag

SEQ ID NO: 914330 - RNA, 18 nt, Human
ccaggacugaguuuuggg

SEQ ID NO: 914331 - RNA, 22 nt, Human
ccccuggccaggacagagaggc

SEQ ID NO: 914332 - RNA, 27 nt, Human
ccuggguggggcuuugcugauugucac

SEQ ID NO: 914333 - RNA, 20 nt, Human
gagcagcaggagagaggcag

SEQ ID NO: 914334 - RNA, 23 nt, Human
gcaggugggcuugcaaaagauug

SEQ ID NO: 914335 - RNA, 21 nt, Human
ggaccccaguuguccaccccu

SEQ ID NO: 914336 - RNA, 19 nt, Human
ggccuggguggggcuuugc

SEQ ID NO: 914337 - RNA, 18 nt, Human
ggcggggcuuaggccagg

SEQ ID NO: 914338 - RNA, 21 nt, Human
ggcggggcuuaggccaggagg

SEQ ID NO: 914339 - RNA, 20 nt, Human
gugcagauacagcuggagga

SEQ ID NO: 914340 - RNA, 19 nt, Human
uacccuagggaggcagggu

SEQ ID NO: 914341 - RNA, 26 nt, Human
uccaggauugggacaucugccagagc

SEQ ID NO: 914342 - RNA, 24 nt, Human
ucucccaucaucccagaugggggc

SEQ ID NO: 914343 - RNA, 18 nt, Human
ucugccagagcucuccca

SEQ ID NO: 914344 - RNA, 18 nt, Human
ugccaggacugaguuuug

SEQ ID NO: 914345 - RNA, 19 nt, Human
ugcccgaaggccgccaggc

SEQ ID NO: 914346 - RNA, 23 nt, Human
ugggcggggcuuaggccaggagg

SEQ ID NO: 914347 - RNA, 20 nt, Human
ugggggccuggguggggcuu

SEQ ID NO: 914348 - RNA, 23 nt, Human
ugguggucaccuuggcccaucug

SEQ ID NO: 914349 - RNA, 19 nt, Human
ugucacaguugaggugcca

SEQ ID NO: 914350 - RNA, 19 nt, Human
aaaaagcagcuuaaaauau

SEQ ID NO: 914351 - RNA, 24 nt, Human
aaaggagggauguucaggacucug

SEQ ID NO: 914352 - RNA, 23 nt, Human
acacugggcuagaggagccuggc

SEQ ID NO: 914353 - RNA, 20 nt, Human
acagaaaggguuacuucuga

SEQ ID NO: 914354 - RNA, 24 nt, Human
agagaaacugaagcacagcuggua

SEQ ID NO: 914355 - RNA, 21 nt, Human
agccgaugccugugagugaca

SEQ ID NO: 914356 - RNA, 19 nt, Human
agggagcaggaggacgggg

SEQ ID NO: 914357 - RNA, 21 nt, Human
agggagcaggaggacggggag

SEQ ID NO: 914358 - RNA, 19 nt, Human
agggauguucaggacucug

SEQ ID NO: 914359 - RNA, 23 nt, Human
agggauguucaggacucugcagc

SEQ ID NO: 914360 - RNA, 25 nt, Human
auaaauacaaccugagaacauccau

SEQ ID NO: 914361 - RNA, 21 nt, Human
cacaccuaaguuccguucucu

SEQ ID NO: 914362 - RNA, 21 nt, Human
cacugccugccuacuccaguu

SEQ ID NO: 914363 - RNA, 23 nt, Human
caggacucugcagcucugugucc

SEQ ID NO: 914364 - RNA, 19 nt, Human
cauugccucucccuucugc

SEQ ID NO: 914365 - RNA, 24 nt, Human
ccacacaggcucauucucaacugg

SEQ ID NO: 914366 - RNA, 21 nt, Human
ccacccuuugucuucucuuug

SEQ ID NO: 914367 - RNA, 22 nt, Human
ccaguccccuccaagagcccug

SEQ ID NO: 914368 - RNA, 20 nt, Human
ccccugaaaaagcagcuuaa

SEQ ID NO: 914369 - RNA, 24 nt, Human
ccccugaaaaagcagcuuaaaaua

SEQ ID NO: 914370 - RNA, 20 nt, Human
cccuaaaaaauacagaaggg

SEQ ID NO: 914371 - RNA, 20 nt, Human
cccugccgcacgccuggccu

SEQ ID NO: 914372 - RNA, 23 nt, Human
ccuaaaaaauacagaaggggaca

SEQ ID NO: 914373 - RNA, 19 nt, Human
ccuacagcagcuuacccag

SEQ ID NO: 914374 - RNA, 22 nt, Human
ccuacagcagcuuacccagggc

SEQ ID NO: 914375 - RNA, 22 nt, Human
ccuggccuuugggccagggcca

SEQ ID NO: 914376 - RNA, 22 nt, Human
ccuggggcccugggccacuagg

SEQ ID NO: 914377 - RNA, 22 nt, Human
cgaaauaaauacaaccugagaa

SEQ ID NO: 914378 - RNA, 24 nt, Human
cuauuuauccccugaaaaagcagc

SEQ ID NO: 914379 - RNA, 18 nt, Human
cugaagcacagcugguau

SEQ ID NO: 914380 - RNA, 24 nt, Human
cugaguccccaccaguccccucca

SEQ ID NO: 914381 - RNA, 18 nt, Human
cugggccuagcuguagag

SEQ ID NO: 914382 - RNA, 21 nt, Human
cuuccggagcaccugucuuca

SEQ ID NO: 914383 - RNA, 22 nt, Human
gaaauaaauacaaccugagaac

SEQ ID NO: 914384 - RNA, 24 nt, Human
gagaacauccauuucaaugucccc

SEQ ID NO: 914385 - RNA, 24 nt, Human
gcacagaaaggguuacuucugacc

SEQ ID NO: 914386 - RNA, 19 nt, Human
ggcuagaggagccuggccu

SEQ ID NO: 914387 - RNA, 18 nt, Human
gggcuaggcugggccuag

SEQ ID NO: 914388 - RNA, 20 nt, Human
gggcugggcuaggcugggcc

SEQ ID NO: 914389 - RNA, 21 nt, Human
uaaaauaugggugcacauuuu

SEQ ID NO: 914390 - RNA, 20 nt, Human
uacaaccugagaacauccau

SEQ ID NO: 914391 - RNA, 24 nt, Human
uacccagggcaaagugagagaaac

SEQ ID NO: 914392 - RNA, 23 nt, Human
uacuucugacccuacagcagcuu

SEQ ID NO: 914393 - RNA, 19 nt, Human
uagagacacaccuaaguuc

SEQ ID NO: 914394 - RNA, 24 nt, Human
uccaagagcccugaugcugcuucc

SEQ ID NO: 914395 - RNA, 22 nt, Human
uccccaccaguccccuccaaga

SEQ ID NO: 914396 - RNA, 22 nt, Human
ucugcagcucuguguccagccc

SEQ ID NO: 914397 - RNA, 22 nt, Human
ugaaaaagcagcuuaaaauaug

SEQ ID NO: 914398 - RNA, 21 nt, Human
ugaaggguguuuguucugggc

SEQ ID NO: 914399 - RNA, 25 nt, Human
ugagagaaacugaagcacagcuggu

SEQ ID NO: 914400 - RNA, 21 nt, Human
ugccaggaggcugagaguccc

SEQ ID NO: 914401 - RNA, 19 nt, Human
ugccucucccuucugcagc

SEQ ID NO: 914402 - RNA, 22 nt, Human
uggcacagaaaggguuacuucu

SEQ ID NO: 914403 - RNA, 24 nt, Human
uggccugagccgaugccugugagu

SEQ ID NO: 914404 - RNA, 24 nt, Human
ugggccagggccacacacugggcu

SEQ ID NO: 914405 - RNA, 19 nt, Human
ugggcugggcuaggcuggg

SEQ ID NO: 914406 - RNA, 20 nt, Human
ugggcugggcuaggcugggc

SEQ ID NO: 914407 - RNA, 20 nt, Human
uguucugggcugggcuaggc

SEQ ID NO: 914408 - RNA, 24 nt, Human
uuaaaauaugggugcacauuuugc

SEQ ID NO: 914409 - RNA, 26 nt, Human
uucaauguccccaaacacuauuuauc

SEQ ID NO: 914410 - RNA, 24 nt, Human
uucucuguuuggaggcugcaccca

SEQ ID NO: 914411 - RNA, 20 nt, Human
uugccucucccuucugcagc

SEQ ID NO: 914412 - RNA, 22 nt, Human
aaccaggcucccggcucccccg

SEQ ID NO: 914413 - RNA, 22 nt, Human
aagcaagaacauaaacacggaa

SEQ ID NO: 914414 - RNA, 24 nt, Human
aagcacggcuccaacacggccgug

SEQ ID NO: 914415 - RNA, 18 nt, Human
aagccugccuuggagcug

SEQ ID NO: 914416 - RNA, 18 nt, Human
acccuggcguggcccgcg

SEQ ID NO: 914417 - RNA, 21 nt, Human
acccuggcguggcccgcgccg

SEQ ID NO: 914418 - RNA, 19 nt, Human
acugggcuugauuucugcu

SEQ ID NO: 914419 - RNA, 18 nt, Human
aggcaggaggagacguga

SEQ ID NO: 914420 - RNA, 19 nt, Human
agggcuuucggggcuuuga

SEQ ID NO: 914421 - RNA, 18 nt, Human
augggacauugauggcag

SEQ ID NO: 914422 - RNA, 18 nt, Human
caagcaagaacauaaaca

SEQ ID NO: 914423 - RNA, 19 nt, Human
cagcaguaaaaucaaaugc

SEQ ID NO: 914424 - RNA, 24 nt, Human
ccaagcaagcacggcuccaacacg

SEQ ID NO: 914425 - RNA, 19 nt, Human
ccacgcgccgggcugccuc

SEQ ID NO: 914426 - RNA, 24 nt, Human
cccccaggguggccgccggggcgg

SEQ ID NO: 914427 - RNA, 21 nt, Human
cccgcgaggcucucccggggg

SEQ ID NO: 914428 - RNA, 22 nt, Human
ccucuggaucuggaagcuucug

SEQ ID NO: 914429 - RNA, 20 nt, Human
ccugggcccuggggguuggg

SEQ ID NO: 914430 - RNA, 23 nt, Human
cgccggggcgggcgggauggggg

SEQ ID NO: 914431 - RNA, 26 nt, Human
cgccugcagggggcgcacgcgcggug

SEQ ID NO: 914432 - RNA, 19 nt, Human
cggggcgggcgggaugggg

SEQ ID NO: 914433 - RNA, 25 nt, Human
cgggggccgccugcaggggggacac

SEQ ID NO: 914434 - RNA, 19 nt, Human
cuggaagcuucugggagcu

SEQ ID NO: 914435 - RNA, 19 nt, Human
cuucaugcugcacacgagc

SEQ ID NO: 914436 - RNA, 21 nt, Human
cuucugggagcuucaggcccu

SEQ ID NO: 914437 - RNA, 21 nt, Human
cuugggguagcugaaggagcu

SEQ ID NO: 914438 - RNA, 20 nt, Human
gagcuggaggaugcugugag

SEQ ID NO: 914439 - RNA, 19 nt, Human
gcagagaggagcagacaaa

SEQ ID NO: 914440 - RNA, 19 nt, Human
gcagcuugggguagcugaa

SEQ ID NO: 914441 - RNA, 23 nt, Human
gccaauggcgcgccguccccucc

SEQ ID NO: 914442 - RNA, 22 nt, Human
gcccuguggggugaggccuggg

SEQ ID NO: 914443 - RNA, 18 nt, Human
gcucucccgggggccgcc

SEQ ID NO: 914444 - RNA, 18 nt, Human
gcuuucggggcuuugagg

SEQ ID NO: 914445 - RNA, 21 nt, Human
ggaaauagaaucaucucugcu

SEQ ID NO: 914446 - RNA, 23 nt, Human
ggagacaugucuccuuugauugc

SEQ ID NO: 914447 - RNA, 19 nt, Human
ggagcccagcacuccgcaa

SEQ ID NO: 914448 - RNA, 21 nt, Human
ggaggcucuucccaggagaca

SEQ ID NO: 914449 - RNA, 23 nt, Human
ggccugggacugggcuugauuuc

SEQ ID NO: 914450 - RNA, 19 nt, Human
ggcguggcccgcgccgccc

SEQ ID NO: 914451 - RNA, 18 nt, Human
gggagacccuggcguggc

SEQ ID NO: 914452 - RNA, 19 nt, Human
gggauggggguuggcgggg

SEQ ID NO: 914453 - RNA, 22 nt, Human
guucugagagaccucuccuuca

SEQ ID NO: 914454 - RNA, 19 nt, Human
uaaaaucaaaugcgcgcca

SEQ ID NO: 914455 - RNA, 18 nt, Human
ucaagcaagaacauaaac

SEQ ID NO: 914456 - RNA, 25 nt, Human
ucccccgcgaggcucucccgggggc

SEQ ID NO: 914457 - RNA, 22 nt, Human
ucccgggggccgccugcagggg

SEQ ID NO: 914458 - RNA, 22 nt, Human
ucucaggcaaacugcuuaacuu

SEQ ID NO: 914459 - RNA, 24 nt, Human
ucugagagaccucuccuucaugcu

SEQ ID NO: 914460 - RNA, 18 nt, Human
ucugcugugcuggcuuug

SEQ ID NO: 914461 - RNA, 19 nt, Human
ucuggaagcuucugggagc

SEQ ID NO: 914462 - RNA, 21 nt, Human
ucuggaucuggaagcuucugg

SEQ ID NO: 914463 - RNA, 26 nt, Human
ucuggcggcccgcgcuggucccuccu

SEQ ID NO: 914464 - RNA, 21 nt, Human
ugaacacaggcugagagcuga

SEQ ID NO: 914465 - RNA, 18 nt, Human
ugagaaagcucauugcag

SEQ ID NO: 914466 - RNA, 25 nt, Human
uggggguugggggaagccugccuug

SEQ ID NO: 914467 - RNA, 19 nt, Human
ugucucccgggcccaggcc

SEQ ID NO: 914468 - RNA, 23 nt, Human
ugugaaaucagcaguaaaaucaa

SEQ ID NO: 914469 - RNA, 24 nt, Human
ugugagaaggaagggaggccucca

SEQ ID NO: 914470 - RNA, 24 nt, Human
uuaaauagccuugcggugucuccc

SEQ ID NO: 914471 - RNA, 21 nt, Human
uucucugggcaccacuccugg

SEQ ID NO: 914472 - RNA, 18 nt, Human
uuuccuggcaaguucugc

SEQ ID NO: 914473 - RNA, 26 nt, Human
uuucggggcuuugagguugugggagg

SEQ ID NO: 914474 - RNA, 21 nt, Human
uuugcuggacgguugugggga

SEQ ID NO: 914475 - RNA, 21 nt, Human
aaaaaagagccacugauggca

SEQ ID NO: 914476 - RNA, 18 nt, Human
aaaugacaccaaucauuu

SEQ ID NO: 914477 - RNA, 21 nt, Human
aaaugggaaaaugacaccaau

SEQ ID NO: 914478 - RNA, 19 nt, Human
aacauaguaagaccccauc

SEQ ID NO: 914479 - RNA, 20 nt, Human
aacauaguaagaccccaucu

SEQ ID NO: 914480 - RNA, 21 nt, Human
aacauaguaagaccccaucuc

SEQ ID NO: 914481 - RNA, 19 nt, Human
aagaccccaucucuguuuu

SEQ ID NO: 914482 - RNA, 21 nt, Human
aagaucuggcacagagaaaca

SEQ ID NO: 914483 - RNA, 23 nt, Human
aagcaggaaaaaagagccacuga

SEQ ID NO: 914484 - RNA, 21 nt, Human
agaaacaaggggagacagggc

SEQ ID NO: 914485 - RNA, 25 nt, Human
agacugccaccagaaaggcccaugg

SEQ ID NO: 914486 - RNA, 22 nt, Human
agccugggcaacauaguaagac

SEQ ID NO: 914487 - RNA, 24 nt, Human
agccugggcaacauaguaagaccc

SEQ ID NO: 914488 - RNA, 21 nt, Human
agcggcgucugggcccagagc

SEQ ID NO: 914489 - RNA, 21 nt, Human
agcuuaugccugcaaucccag

SEQ ID NO: 914490 - RNA, 18 nt, Human
aggaccccugcgcucgcg

SEQ ID NO: 914491 - RNA, 24 nt, Human
aggaucgcuugagcccaggaguuc

SEQ ID NO: 914492 - RNA, 29 nt, Human
aggcacuaaaggcugguucagccgagcuu

SEQ ID NO: 914493 - RNA, 23 nt, Human
aggcagaaggaucgcuugagccc

SEQ ID NO: 914494 - RNA, 24 nt, Human
aggcagaaggaucgcuugagccca

SEQ ID NO: 914495 - RNA, 18 nt, Human
aggcaggaaaccguggaa

SEQ ID NO: 914496 - RNA, 20 nt, Human
aguaagaggaccccugcgcu

SEQ ID NO: 914497 - RNA, 22 nt, Human
aucccagcacuucgggaggcca

SEQ ID NO: 914498 - RNA, 23 nt, Human
auuacagaaaaugguuuuauaaa

SEQ ID NO: 914499 - RNA, 19 nt, Human
cagaaaggcccauggaagc

SEQ ID NO: 914500 - RNA, 24 nt, Human
cagcacuucgggaggccaaggcag

SEQ ID NO: 914501 - RNA, 23 nt, Human
cagugauaagauccagcccuauu

SEQ ID NO: 914502 - RNA, 19 nt, Human
caguuacagaaucucaaag

SEQ ID NO: 914503 - RNA, 23 nt, Human
caguuacagaaucucaaagccaa

SEQ ID NO: 914504 - RNA, 21 nt, Human
cauaguaagaccccaucucug

SEQ ID NO: 914505 - RNA, 19 nt, Human
ccagcaccggcgguggacg

SEQ ID NO: 914506 - RNA, 20 nt, Human
ccagcaccggcgguggacgg

SEQ ID NO: 914507 - RNA, 20 nt, Human
ccucggguguccuucccgga

SEQ ID NO: 914508 - RNA, 24 nt, Human
ccugggcaacauaguaagacccca

SEQ ID NO: 914509 - RNA, 21 nt, Human
cgggaggccaaggcagaagga

SEQ ID NO: 914510 - RNA, 22 nt, Human
cucgcggggugcccgccuuacc

SEQ ID NO: 914511 - RNA, 23 nt, Human
cuuaugccugcaaucccagcacu

SEQ ID NO: 914512 - RNA, 20 nt, Human
gaaaaaaaucccuguaugga

SEQ ID NO: 914513 - RNA, 18 nt, Human
gacaccagccugggcaac

SEQ ID NO: 914514 - RNA, 18 nt, Human
gacagggcagugauaaga

SEQ ID NO: 914515 - RNA, 21 nt, Human
gaccaaaaggaggucauaaaa

SEQ ID NO: 914516 - RNA, 21 nt, Human
gagcucugggcagaacagccu

SEQ ID NO: 914517 - RNA, 21 nt, Human
gaggaccccugcgcucgcggg

SEQ ID NO: 914518 - RNA, 24 nt, Human
gaucgcuugagcccaggaguucga

SEQ ID NO: 914519 - RNA, 22 nt, Human
gcccagcaugguagcuuaugcc

SEQ ID NO: 914520 - RNA, 22 nt, Human
gcccaggaguucgacaccagcc

SEQ ID NO: 914521 - RNA, 19 nt, Human
gccugcaaucccagcacuu

SEQ ID NO: 914522 - RNA, 20 nt, Human
gcuucgcucucugacuuuca

SEQ ID NO: 914523 - RNA, 23 nt, Human
ggaucgcuugagcccaggaguuc

SEQ ID NO: 914524 - RNA, 18 nt, Human
ggcccagagcugggugcc

SEQ ID NO: 914525 - RNA, 23 nt, Human
gggaagagacggauaagauaaug

SEQ ID NO: 914526 - RNA, 21 nt, Human
gggucucccaggggccucggg

SEQ ID NO: 914527 - RNA, 22 nt, Human
uaagaaauuaaagugaaucugu

SEQ ID NO: 914528 - RNA, 22 nt, Human
uaauuacucuaugagaaaaaaa

SEQ ID NO: 914529 - RNA, 22 nt, Human
uaccccgcggggaggggucagg

SEQ ID NO: 914530 - RNA, 22 nt, Human
uagcuuaugccugcaaucccag

SEQ ID NO: 914531 - RNA, 24 nt, Human
uagcuuaugccugcaaucccagca

SEQ ID NO: 914532 - RNA, 19 nt, Human
uaugccugcaaucccagca

SEQ ID NO: 914533 - RNA, 20 nt, Human
uaugccugcaaucccagcac

SEQ ID NO: 914534 - RNA, 24 nt, Human
ucaggcccagcaugguagcuuaug

SEQ ID NO: 914535 - RNA, 18 nt, Human
ucagggaggcaggaaacc

SEQ ID NO: 914536 - RNA, 22 nt, Human
ucagggaggcaggaaaccgugg

SEQ ID NO: 914537 - RNA, 23 nt, Human
ucgacaccagccugggcaacaua

SEQ ID NO: 914538 - RNA, 21 nt, Human
ucgcuugagcccaggaguucg

SEQ ID NO: 914539 - RNA, 24 nt, Human
ucugcaguuacagaaucucaaagc

SEQ ID NO: 914540 - RNA, 18 nt, Human
ugaagaucuggcacagag

SEQ ID NO: 914541 - RNA, 24 nt, Human
ugagaaaaaaaucccuguauggaa

SEQ ID NO: 914542 - RNA, 25 nt, Human
ugagaaaaaaaucccuguauggaaa

SEQ ID NO: 914543 - RNA, 23 nt, Human
ugagcccaggaguucgacaccag

SEQ ID NO: 914544 - RNA, 21 nt, Human
ugauuacagaaaaugguuuua

SEQ ID NO: 914545 - RNA, 23 nt, Human
ugccaucagcaguaagaggaccc

SEQ ID NO: 914546 - RNA, 23 nt, Human
ugccugcaaucccagcacuucgg

SEQ ID NO: 914547 - RNA, 25 nt, Human
uggaacugacacucaaggggaaugu

SEQ ID NO: 914548 - RNA, 21 nt, Human
uggcaaaugggaaaaugacac

SEQ ID NO: 914549 - RNA, 22 nt, Human
ugggcaacauaguaagacccca

SEQ ID NO: 914550 - RNA, 24 nt, Human
ugguagcuuaugccugcaauccca

SEQ ID NO: 914551 - RNA, 20 nt, Human
uugauuacagaaaaugguuu

SEQ ID NO: 914552 - RNA, 20 nt, Human
uuuuuuuaaaaaaaagaaau

SEQ ID NO: 914553 - RNA, 22 nt, Human
uuuuuuuuuuuuuuuuuuuaag

SEQ ID NO: 914554 - RNA, 26 nt, Human
aaacaggaacaaauacuggcuuaaac

SEQ ID NO: 914555 - RNA, 19 nt, Human
aaagugcugagacuacagg

SEQ ID NO: 914556 - RNA, 25 nt, Human
aaagugcugagacuacaggcaaggg

SEQ ID NO: 914557 - RNA, 21 nt, Human
aaccgaaacgacugcagacua

SEQ ID NO: 914558 - RNA, 21 nt, Human
aagaaaagauggguguuaaaa

SEQ ID NO: 914559 - RNA, 20 nt, Human
aaucagaauguaacacagua

SEQ ID NO: 914560 - RNA, 21 nt, Human
acccgccaggcugccaaccga

SEQ ID NO: 914561 - RNA, 21 nt, Human
acugcuaccugucuccagccc

SEQ ID NO: 914562 - RNA, 19 nt, Human
agcugcuuagccccagcuc

SEQ ID NO: 914563 - RNA, 18 nt, Human
aucucccacccgccaggc

SEQ ID NO: 914564 - RNA, 24 nt, Human
auguuuuaguaucugauaguuuca

SEQ ID NO: 914565 - RNA, 27 nt, Human
caaagugcugagacuacaggcaagggc

SEQ ID NO: 914566 - RNA, 27 nt, Human
caagcgacccucccaccucagccuccc

SEQ ID NO: 914567 - RNA, 27 nt, Human
caagcgacccucccaccucagccuccc

SEQ ID NO: 914568 - RNA, 19 nt, Human
caaucagaauguaacacag

SEQ ID NO: 914569 - RNA, 24 nt, Human
caccucagccucccaaagugcuga

SEQ ID NO: 914570 - RNA, 21 nt, Human
caggaaagcuuuagaaagaaa

SEQ ID NO: 914571 - RNA, 23 nt, Human
caggaacaaauacuggcuuaaac

SEQ ID NO: 914572 - RNA, 21 nt, Human
ccaaccgaaacgacugcagac

SEQ ID NO: 914573 - RNA, 21 nt, Human
cccaaagcucucuucuggucc

SEQ ID NO: 914574 - RNA, 21 nt, Human
cccgcgcggucuucucagccg

SEQ ID NO: 914575 - RNA, 27 nt, Human
cccucccaccucagccucccaaagugc

SEQ ID NO: 914576 - RNA, 21 nt, Human
ccgcgcggucuucucagccgc

SEQ ID NO: 914577 - RNA, 26 nt, Human
ccuaggauuuccuagaagguggaccu

SEQ ID NO: 914578 - RNA, 24 nt, Human
cucaagcgacccucccaccucagc

SEQ ID NO: 914579 - RNA, 21 nt, Human
cucccaaagugcugagacuac

SEQ ID NO: 914580 - RNA, 24 nt, Human
gaacuccugaacucaagcgacccu

SEQ ID NO: 914581 - RNA, 23 nt, Human
gcgacccucccaccucagccucc

SEQ ID NO: 914582 - RNA, 20 nt, Human
ggccgccgcaucucccaccc

SEQ ID NO: 914583 - RNA, 28 nt, Human
uaagacagaagcauuguaaaacaggaac

SEQ ID NO: 914584 - RNA, 23 nt, Human
uaucacauccggcaugaagcccc

SEQ ID NO: 914585 - RNA, 18 nt, Human
ucagccucccaaagugcu

SEQ ID NO: 914586 - RNA, 26 nt, Human
uccaaacugccuucguacuucuaacc

SEQ ID NO: 914587 - RNA, 24 nt, Human
ucccaaagugcugagacuacaggc

SEQ ID NO: 914588 - RNA, 18 nt, Human
ucccaaauaaacgagucc

SEQ ID NO: 914589 - RNA, 19 nt, Human
uccucuauuuuaagaaugu

SEQ ID NO: 914590 - RNA, 21 nt, Human
ugagacuacaggcaagggcca

SEQ ID NO: 914591 - RNA, 22 nt, Human
ugagacuacaggcaagggccac

SEQ ID NO: 914592 - RNA, 24 nt, Human
ugagacuacaggcaagggccacca

SEQ ID NO: 914593 - RNA, 22 nt, Human
ugcugagacuacaggcaagggc

SEQ ID NO: 914594 - RNA, 22 nt, Human
ugucuccagccccgcgcggucu

SEQ ID NO: 914595 - RNA, 20 nt, Human
uucuuugcagcagguggccg

SEQ ID NO: 914596 - RNA, 21 nt, Human
uuuauauauaaggcaaacauu

SEQ ID NO: 914597 - RNA, 26 nt, Human
uuuuuuuuuuuugagacuaggucuca

SEQ ID NO: 914598 - RNA, 18 nt, Human
uuuuuuuuuuuuuuuuug

SEQ ID NO: 914599 - RNA, 22 nt, Human
aaaaauauuuucucccaaauua

SEQ ID NO: 914600 - RNA, 19 nt, Human
aaagacacaacuucacaaa

SEQ ID NO: 914601 - RNA, 23 nt, Human
acaaaacauaauaaaagauaaac

SEQ ID NO: 914602 - RNA, 19 nt, Human
agcagcagcgauuuucucc

SEQ ID NO: 914603 - RNA, 24 nt, Human
agguaauuagugaaaagacacaac

SEQ ID NO: 914604 - RNA, 24 nt, Human
ccaucucagcagcagcgauuuucu

SEQ ID NO: 914605 - RNA, 21 nt, Human
ccuuaucuuccucuucuccuu

SEQ ID NO: 914606 - RNA, 22 nt, Human
cugccaaaaaauggguucaaag

SEQ ID NO: 914607 - RNA, 20 nt, Human
cuuccucuucuccuuagccc

SEQ ID NO: 914608 - RNA, 23 nt, Human
ggagcggagcgggucggaggagc

SEQ ID NO: 914609 - RNA, 19 nt, Human
gggcggcgcggggccgagc

SEQ ID NO: 914610 - RNA, 23 nt, Human
gggcggcgcggggccgagcggag

SEQ ID NO: 914611 - RNA, 24 nt, Human
gggcggcgcggggccgagcggagc

SEQ ID NO: 914612 - RNA, 24 nt, Human
guuauggauagauauaaggaaaua

SEQ ID NO: 914613 - RNA, 27 nt, Human
uccaucucagcagcagcgauuuucucc

SEQ ID NO: 914614 - RNA, 21 nt, Human
ucuuccucuucuccuuagccc

SEQ ID NO: 914615 - RNA, 25 nt, Human
ugaaaagacacaacuucacaaaaca

SEQ ID NO: 914616 - RNA, 28 nt, Human
uggagaaacaguuucuucuucuggaguc

SEQ ID NO: 914617 - RNA, 18 nt, Human
uuuagcauuuuugacuag

SEQ ID NO: 914618 - RNA, 21 nt, Human
aaagcacgggacaugcgccag

SEQ ID NO: 914619 - RNA, 22 nt, Human
aagcgaccucuccagggaacau

SEQ ID NO: 914620 - RNA, 22 nt, Human
aagggagacagauuuggccgca

SEQ ID NO: 914621 - RNA, 23 nt, Human
aaggucccuccacccccacagcc

SEQ ID NO: 914622 - RNA, 18 nt, Human
acagcagcguccacaaag

SEQ ID NO: 914623 - RNA, 22 nt, Human
acagcagcugacggcuuccccc

SEQ ID NO: 914624 - RNA, 21 nt, Human
acaugcgccagcugagcuggu

SEQ ID NO: 914625 - RNA, 25 nt, Human
accccgugugguucagggagugagg

SEQ ID NO: 914626 - RNA, 24 nt, Human
acccucuggaccuggguaugcagg

SEQ ID NO: 914627 - RNA, 22 nt, Human
accgcagcaggugggaagcggg

SEQ ID NO: 914628 - RNA, 21 nt, Human
agccuggcgaugcucacagcc

SEQ ID NO: 914629 - RNA, 24 nt, Human
aggcccuugacacugaggcugcuc

SEQ ID NO: 914630 - RNA, 18 nt, Human
agggugccugggacugga

SEQ ID NO: 914631 - RNA, 26 nt, Human
agggugcuguucggcugagggagcua

SEQ ID NO: 914632 - RNA, 19 nt, Human
aggguucauccuggcaagg

SEQ ID NO: 914633 - RNA, 20 nt, Human
augcagggugggcauggggc

SEQ ID NO: 914634 - RNA, 22 nt, Human
augcgccagcugagcuggugcc

SEQ ID NO: 914635 - RNA, 24 nt, Human
cacccccacaucugcucacuccca

SEQ ID NO: 914636 - RNA, 18 nt, Human
cacugaggcugcucccgc

SEQ ID NO: 914637 - RNA, 20 nt, Human
cacuggggagcccccaggga

SEQ ID NO: 914638 - RNA, 26 nt, Human
cacuuucggccucagugccacggccc

SEQ ID NO: 914639 - RNA, 18 nt, Human
cagaggugucugcacagc

SEQ ID NO: 914640 - RNA, 21 nt, Human
cagaugcagggugcuguucgg

SEQ ID NO: 914641 - RNA, 21 nt, Human
cagcgacugcuucaauccccc

SEQ ID NO: 914642 - RNA, 22 nt, Human
caggcaguccuggugcugcuga

SEQ ID NO: 914643 - RNA, 22 nt, Human
caggccgcucacaccccugggg

SEQ ID NO: 914644 - RNA, 22 nt, Human
cagggaacacccgcacccagac

SEQ ID NO: 914645 - RNA, 20 nt, Human
cagugcucuggacaccuggg

SEQ ID NO: 914646 - RNA, 23 nt, Human
caugcgccagcugagcuggugcc

SEQ ID NO: 914647 - RNA, 20 nt, Human
ccacagcagccuggcgaugc

SEQ ID NO: 914648 - RNA, 23 nt, Human
ccacuggggagcccccagggaga

SEQ ID NO: 914649 - RNA, 18 nt, Human
cccaaugaccuccaagcc

SEQ ID NO: 914650 - RNA, 21 nt, Human
cccaaugaccuccaagcccaa

SEQ ID NO: 914651 - RNA, 30 nt, Human
cccacagcagccuggcgaugcucacagccu

SEQ ID NO: 914652 - RNA, 24 nt, Human
cccacagcgcgucauccccucacc

SEQ ID NO: 914653 - RNA, 21 nt, Human
cccacaucugcucacucccaa

SEQ ID NO: 914654 - RNA, 20 nt, Human
ccccacagccagggcagagc

SEQ ID NO: 914655 - RNA, 19 nt, Human
ccccaggccgcucacaccc

SEQ ID NO: 914656 - RNA, 20 nt, Human
ccccaggccgcucacacccc

SEQ ID NO: 914657 - RNA, 18 nt, Human
ccccagggagaccagccc

SEQ ID NO: 914658 - RNA, 21 nt, Human
ccccagggagaccagcccucc

SEQ ID NO: 914659 - RNA, 24 nt, Human
ccccagggagaccagcccuccacc

SEQ ID NO: 914660 - RNA, 25 nt, Human
cccccacagcagccuggcgaugcuc

SEQ ID NO: 914661 - RNA, 22 nt, Human
ccccgugugguucagggaguga

SEQ ID NO: 914662 - RNA, 23 nt, Human
ccccuggggggccacagaggugu

SEQ ID NO: 914663 - RNA, 19 nt, Human
cccgcacccagaccgugcc

SEQ ID NO: 914664 - RNA, 21 nt, Human
cccgcccccacagcagccugg

SEQ ID NO: 914665 - RNA, 18 nt, Human
cccuccacccccacagcc

SEQ ID NO: 914666 - RNA, 20 nt, Human
ccgcgcgcucgggcggcggg

SEQ ID NO: 914667 - RNA, 19 nt, Human
ccgggaggcgggugcuucc

SEQ ID NO: 914668 - RNA, 23 nt, Human
ccucagugccacggcccccuccc

SEQ ID NO: 914669 - RNA, 21 nt, Human
ccuggcaaggucccuccaccc

SEQ ID NO: 914670 - RNA, 22 nt, Human
ccuggcagagcagauggcuggc

SEQ ID NO: 914671 - RNA, 18 nt, Human
ccuggggcugcuguggug

SEQ ID NO: 914672 - RNA, 28 nt, Human
ccuggggcugcugugguggacggacccu

SEQ ID NO: 914673 - RNA, 24 nt, Human
ccuggggggccacagaggugucug

SEQ ID NO: 914674 - RNA, 24 nt, Human
cgcagcaggugggaagcggguccc

SEQ ID NO: 914675 - RNA, 23 nt, Human
cucccaaugaccuccaagcccaa

SEQ ID NO: 914676 - RNA, 21 nt, Human
cugaggcugcucccgccccca

SEQ ID NO: 914677 - RNA, 20 nt, Human
cugcuucaaucccccagaug

SEQ ID NO: 914678 - RNA, 18 nt, Human
cuggugcugcugagaugg

SEQ ID NO: 914679 - RNA, 19 nt, Human
cuucacaaagcgaccucuc

SEQ ID NO: 914680 - RNA, 20 nt, Human
cuugacacugaggcugcucc

SEQ ID NO: 914681 - RNA, 21 nt, Human
gagcagauggcuggcuguggc

SEQ ID NO: 914682 - RNA, 21 nt, Human
gagggugccugggacuggagg

SEQ ID NO: 914683 - RNA, 23 nt, Human
gcaggcuccccuccugaagcgga

SEQ ID NO: 914684 - RNA, 19 nt, Human
gcaguccuggugcugcuga

SEQ ID NO: 914685 - RNA, 23 nt, Human
gccacccccacaucugcucacuc

SEQ ID NO: 914686 - RNA, 19 nt, Human
gcugcugugguggacggac

SEQ ID NO: 914687 - RNA, 20 nt, Human
gcuucaaucccccagaugca

SEQ ID NO: 914688 - RNA, 21 nt, Human
ggaccuggguaugcagggugg

SEQ ID NO: 914689 - RNA, 18 nt, Human
ggagaccagcccuccacc

SEQ ID NO: 914690 - RNA, 23 nt, Human
ggcagguuuuauugucacagcag

SEQ ID NO: 914691 - RNA, 19 nt, Human
ggcccgggcccgcugggga

SEQ ID NO: 914692 - RNA, 18 nt, Human
ggcccuugacacugaggc

SEQ ID NO: 914693 - RNA, 19 nt, Human
gggacgggggucagcgacu

SEQ ID NO: 914694 - RNA, 19 nt, Human
gggcccgggcagacgacgg

SEQ ID NO: 914695 - RNA, 22 nt, Human
gggugcuuccggggccgcgcgc

SEQ ID NO: 914696 - RNA, 23 nt, Human
gucauccccucaccagccggcac

SEQ ID NO: 914697 - RNA, 18 nt, Human
gugccugggacuggaggg

SEQ ID NO: 914698 - RNA, 18 nt, Human
gugcuggguugccaggga

SEQ ID NO: 914699 - RNA, 20 nt, Human
gugugguucagggagugagg

SEQ ID NO: 914700 - RNA, 22 nt, Human
uaaaccccgugugguucaggga

SEQ ID NO: 914701 - RNA, 22 nt, Human
ucacagccugcugaugguuucu

SEQ ID NO: 914702 - RNA, 19 nt, Human
ucagggagugagggcccgg

SEQ ID NO: 914703 - RNA, 18 nt, Human
uccacaaagcacgggaca

SEQ ID NO: 914704 - RNA, 22 nt, Human
ucccaggcaguccuggugcugc

SEQ ID NO: 914705 - RNA, 18 nt, Human
uccccaggccgcucacac

SEQ ID NO: 914706 - RNA, 19 nt, Human
uccccaggccgcucacacc

SEQ ID NO: 914707 - RNA, 19 nt, Human
uccuggugcugcugagaug

SEQ ID NO: 914708 - RNA, 22 nt, Human
ucugcacagcagggcuuccucc

SEQ ID NO: 914709 - RNA, 18 nt, Human
ugcagggugggcaugggg

SEQ ID NO: 914710 - RNA, 19 nt, Human
ugcagggugggcauggggc

SEQ ID NO: 914711 - RNA, 19 nt, Human
ugccacggcccccucccca

SEQ ID NO: 914712 - RNA, 18 nt, Human
ugcucuggacaccugggg

SEQ ID NO: 914713 - RNA, 23 nt, Human
ugcucuggacaccugggguugcu

SEQ ID NO: 914714 - RNA, 22 nt, Human
ugcugcugagaugggcgcugcc

SEQ ID NO: 914715 - RNA, 19 nt, Human
ugcugugcucgccaccaug

SEQ ID NO: 914716 - RNA, 22 nt, Human
uggagugcggccagccuggcug

SEQ ID NO: 914717 - RNA, 18 nt, Human
uggcaaggucccuccacc

SEQ ID NO: 914718 - RNA, 22 nt, Human
uggcaaggucccuccaccccca

SEQ ID NO: 914719 - RNA, 24 nt, Human
uggccacccccacaucugcucacu

SEQ ID NO: 914720 - RNA, 18 nt, Human
uggcuggcuguggccgug

SEQ ID NO: 914721 - RNA, 19 nt, Human
ugggaagcgggucccaagg

SEQ ID NO: 914722 - RNA, 19 nt, Human
ugggaggcccaugaaggga

SEQ ID NO: 914723 - RNA, 19 nt, Human
uggggggccacagaggugu

SEQ ID NO: 914724 - RNA, 19 nt, Human
uggugccacccuggcagag

SEQ ID NO: 914725 - RNA, 22 nt, Human
uggugccacccuggcagagcag

SEQ ID NO: 914726 - RNA, 19 nt, Human
uguggccgugugguggugc

SEQ ID NO: 914727 - RNA, 19 nt, Human
aaaccuauguuuaauuuaa

SEQ ID NO: 914728 - RNA, 23 nt, Human
aacaaugaaagcacagguagaaa

SEQ ID NO: 914729 - RNA, 18 nt, Human
aauacaaaagaagauaga

SEQ ID NO: 914730 - RNA, 20 nt, Human
acaaugaaagcacagguaga

SEQ ID NO: 914731 - RNA, 19 nt, Human
auacugcuuuuaacuguag

SEQ ID NO: 914732 - RNA, 19 nt, Human
caacaaagaugccuuacuu

SEQ ID NO: 914733 - RNA, 21 nt, Human
caacacaaaagacuaauucug

SEQ ID NO: 914734 - RNA, 21 nt, Human
cacacaauuaaaacaaaugua

SEQ ID NO: 914735 - RNA, 23 nt, Human
cacagguagaaaauaaacaacac

SEQ ID NO: 914736 - RNA, 20 nt, Human
cagaggcccggaagugaaaa

SEQ ID NO: 914737 - RNA, 22 nt, Human
cagaggcccggaagugaaaaaa

SEQ ID NO: 914738 - RNA, 19 nt, Human
caguacuccacugaaggag

SEQ ID NO: 914739 - RNA, 19 nt, Human
cugacgcauauaucuuccu

SEQ ID NO: 914740 - RNA, 22 nt, Human
cugugcugucuuugacaacaaa

SEQ ID NO: 914741 - RNA, 22 nt, Human
uaaaaauacugcuuuuaacugu

SEQ ID NO: 914742 - RNA, 21 nt, Human
uaaacaacacaaaagacuaau

SEQ ID NO: 914743 - RNA, 18 nt, Human
ugaaaaaacaaugaaagc

SEQ ID NO: 914744 - RNA, 19 nt, Human
ugaaaaaacaaugaaagca

SEQ ID NO: 914745 - RNA, 21 nt, Human
ugaaaaaacaaugaaagcaca

SEQ ID NO: 914746 - RNA, 19 nt, Human
ugaaagcacagguagaaaa

SEQ ID NO: 914747 - RNA, 25 nt, Human
ugaaagcacagguagaaaauaaaca

SEQ ID NO: 914748 - RNA, 24 nt, Human
uuaauacccugugcugucuuugac

SEQ ID NO: 914749 - RNA, 23 nt, Human
uugaauuaauugaugagguuuau

SEQ ID NO: 914750 - RNA, 19 nt, Human
uugacucugcuccaaauau

SEQ ID NO: 914751 - RNA, 18 nt, Human
uuuuuuuuuuuuuuuuug

SEQ ID NO: 914752 - RNA, 24 nt, Human
aagcagaacucagguaccauguag

SEQ ID NO: 914753 - RNA, 19 nt, Human
aaugaaccagcugagcccc

SEQ ID NO: 914754 - RNA, 21 nt, Human
acaauauuucaaaacaagccc

SEQ ID NO: 914755 - RNA, 21 nt, Human
aggaaaaacaacauaaaugaa

SEQ ID NO: 914756 - RNA, 22 nt, Human
aggaaaaacaacauaaaugaaa

SEQ ID NO: 914757 - RNA, 21 nt, Human
aggaagcagaacucagguacc

SEQ ID NO: 914758 - RNA, 21 nt, Human
caaagguugcuccuaacgugg

SEQ ID NO: 914759 - RNA, 27 nt, Human
caacauaaaugaaccagcugagcccca

SEQ ID NO: 914760 - RNA, 24 nt, Human
gguacaggaaaaacaacauaaaug

SEQ ID NO: 914761 - RNA, 22 nt, Human
uaaaugaaccagcugagcccca

SEQ ID NO: 914762 - RNA, 20 nt, Human
uacaggaaaaacaacauaaa

SEQ ID NO: 914763 - RNA, 22 nt, Human
uacucugaagucuccaauauac

SEQ ID NO: 914764 - RNA, 25 nt, Human
uacucugaagucuccaauauacaaa

SEQ ID NO: 914765 - RNA, 18 nt, Human
ucaaaacaagcccuucaa

SEQ ID NO: 914766 - RNA, 22 nt, Human
ucaaaacaagcccuucaagacu

SEQ ID NO: 914767 - RNA, 22 nt, Human
ucuccaauauacaaagguugcu

SEQ ID NO: 914768 - RNA, 18 nt, Human
uggaaaauaugguaacuu

SEQ ID NO: 914769 - RNA, 20 nt, Human
uggaaaauaugguaacuuga

SEQ ID NO: 914770 - RNA, 31 nt, Human
uuccuugcugguuacucugaagucuccaauu

SEQ ID NO: 914771 - RNA, 20 nt, Human
uugaugggucaaucccaguu

SEQ ID NO: 914772 - RNA, 18 nt, Human
aaauguguuuauacuaua

SEQ ID NO: 914773 - RNA, 19 nt, Human
aaguaccccgggauuugac

SEQ ID NO: 914774 - RNA, 22 nt, Human
acacuacacuucagcugcugca

SEQ ID NO: 914775 - RNA, 19 nt, Human
acccguccgagcccuccuc

SEQ ID NO: 914776 - RNA, 20 nt, Human
accgccagucccaagaaaaa

SEQ ID NO: 914777 - RNA, 21 nt, Human
acuacacuucagcugcugcag

SEQ ID NO: 914778 - RNA, 23 nt, Human
aggaaccccggugguccugggag

SEQ ID NO: 914779 - RNA, 18 nt, Human
cacaaguaccccgggauu

SEQ ID NO: 914780 - RNA, 25 nt, Human
cacaaguaccccgggauuugacccc

SEQ ID NO: 914781 - RNA, 21 nt, Human
cagaggcucacaacgagguca

SEQ ID NO: 914782 - RNA, 21 nt, Human
cagcagagagaagaagccacg

SEQ ID NO: 914783 - RNA, 21 nt, Human
cagucccaagaaaacacuaca

SEQ ID NO: 914784 - RNA, 18 nt, Human
cauaaguaaacuagucaa

SEQ ID NO: 914785 - RNA, 19 nt, Human
ccccggugguccugggagg

SEQ ID NO: 914786 - RNA, 22 nt, Human
cccuaggccucgggaaaguguc

SEQ ID NO: 914787 - RNA, 19 nt, Human
ccgagcccuccucgagggc

SEQ ID NO: 914788 - RNA, 19 nt, Human
cgccagucccaagaaaaca

SEQ ID NO: 914789 - RNA, 22 nt, Human
cgccgaacucccgggaaagcaa

SEQ ID NO: 914790 - RNA, 23 nt, Human
cgucagcagcggggaaguuguuu

SEQ ID NO: 914791 - RNA, 25 nt, Human
cugcagccccagcaaacgccgaacu

SEQ ID NO: 914792 - RNA, 21 nt, Human
cuucaggaaccccgguggucc

SEQ ID NO: 914793 - RNA, 21 nt, Human
gagaagaagccacgcuaaaga

SEQ ID NO: 914794 - RNA, 18 nt, Human
gcuaaagagucuccacaa

SEQ ID NO: 914795 - RNA, 21 nt, Human
ggagauggaacccgggagaga

SEQ ID NO: 914796 - RNA, 22 nt, Human
ggauuugaccccuccagccccc

SEQ ID NO: 914797 - RNA, 22 nt, Human
guucagaggcucacaacgaggu

SEQ ID NO: 914798 - RNA, 19 nt, Human
uaggccucgggaaaguguc

SEQ ID NO: 914799 - RNA, 22 nt, Human
ucaaaaucguucagaggcucac

SEQ ID NO: 914800 - RNA, 18 nt, Human
ucagcagagagaagaagc

SEQ ID NO: 914801 - RNA, 24 nt, Human
ucccaagaaaacacuacacuucag

SEQ ID NO: 914802 - RNA, 20 nt, Human
ucccgggccucgucuuccuc

SEQ ID NO: 914803 - RNA, 24 nt, Human
ucucuagaaaugccuuuucucgag

SEQ ID NO: 914804 - RNA, 23 nt, Human
ucuucaggaaccccggugguccu

SEQ ID NO: 914805 - RNA, 22 nt, Human
ucuucauagacaggagaugggc

SEQ ID NO: 914806 - RNA, 24 nt, Human
ugaaaauuaagcaaaugaaucugu

SEQ ID NO: 914807 - RNA, 20 nt, Human
ugaaacaguaauauggagaa

SEQ ID NO: 914808 - RNA, 21 nt, Human
ugaaacaguaauauggagaca

SEQ ID NO: 914809 - RNA, 21 nt, Human
uuuugggugucauuuagucag

SEQ ID NO: 914810 - RNA, 20 nt, Human
uuuuuaauagcaaaaaugug

SEQ ID NO: 914811 - RNA, 21 nt, Human
acaaaaaggggcuacugucaa

SEQ ID NO: 914812 - RNA, 22 nt, Human
acagcuuugagggcacaugggg

SEQ ID NO: 914813 - RNA, 23 nt, Human
agacagguagggaauauguccag

SEQ ID NO: 914814 - RNA, 19 nt, Human
aggaauguuagcuccucug

SEQ ID NO: 914815 - RNA, 21 nt, Human
auggggcagaggcccucgaag

SEQ ID NO: 914816 - RNA, 21 nt, Human
cacugcauguggcggcagggc

SEQ ID NO: 914817 - RNA, 18 nt, Human
cagaggcccucgaagguc

SEQ ID NO: 914818 - RNA, 20 nt, Human
cauccauugauugucgcugc

SEQ ID NO: 914819 - RNA, 20 nt, Human
cugcgccacccacgugcugc

SEQ ID NO: 914820 - RNA, 18 nt, Human
gcgccacccacgugcugc

SEQ ID NO: 914821 - RNA, 18 nt, Human
gggcagggaggucgcagg

SEQ ID NO: 914822 - RNA, 23 nt, Human
uaaaaaaaggaacacgugcucac

SEQ ID NO: 914823 - RNA, 19 nt, Human
uccauggcguuaccaaggc

SEQ ID NO: 914824 - RNA, 20 nt, Human
uccauggcguuaccaaggcu

SEQ ID NO: 914825 - RNA, 21 nt, Human
uccauggcguuaccaaggcug

SEQ ID NO: 914826 - RNA, 21 nt, Human
uccauggcguuaccaaggcug

SEQ ID NO: 914827 - RNA, 24 nt, Human
ucgcagggcuccaugauuguggga

SEQ ID NO: 914828 - RNA, 19 nt, Human
ucgcugcaguccauggcgu

SEQ ID NO: 914829 - RNA, 18 nt, Human
ucuuugggccacaggccu

SEQ ID NO: 914830 - RNA, 22 nt, Human
ucuuuuuuuauacacaauacuu

SEQ ID NO: 914831 - RNA, 21 nt, Human
ugaaauaagacagguagggaa

SEQ ID NO: 914832 - RNA, 21 nt, Human
uggcggcagggcagggagguc

SEQ ID NO: 914833 - RNA, 21 nt, Human
uguccagugcaaacagaggac

SEQ ID NO: 914834 - RNA, 18 nt, Human
ugugaaacacaaaaaggg

SEQ ID NO: 914835 - RNA, 22 nt, Human
uuggguuuuuacuauuuugggu

SEQ ID NO: 914836 - RNA, 22 nt, Human
uuuuuggguuuuuacuauuuug

SEQ ID NO: 914837 - RNA, 18 nt, Human
uuuuuuuuuuuuuugggu

SEQ ID NO: 914838 - RNA, 21 nt, Human
agggugcacgugaaggggugg

SEQ ID NO: 914839 - RNA, 21 nt, Human
caacacaagaacagccuaaca

SEQ ID NO: 914840 - RNA, 24 nt, Human
cagucucagguauuuuuuuuccuu

SEQ ID NO: 914841 - RNA, 18 nt, Human
ugaagggguggcaaggga

SEQ ID NO: 914842 - RNA, 21 nt, Human
uggagacagcagcaaauucag

SEQ ID NO: 914843 - RNA, 20 nt, Human
agagauggcauccucgcucc

SEQ ID NO: 914844 - RNA, 20 nt, Human
agcuggcccugaacuccugg

SEQ ID NO: 914845 - RNA, 24 nt, Human
agcuggcccugaacuccugggcuc

SEQ ID NO: 914846 - RNA, 19 nt, Human
aggcaggagaggggcccug

SEQ ID NO: 914847 - RNA, 18 nt, Human
aguagcugggauuacagg

SEQ ID NO: 914848 - RNA, 22 nt, Human
auuauccaaagcuggcccugaa

SEQ ID NO: 914849 - RNA, 18 nt, Human
cagaguagcugggauuac

SEQ ID NO: 914850 - RNA, 20 nt, Human
cagaguagcugggauuacag

SEQ ID NO: 914851 - RNA, 21 nt, Human
cagaguagcugggauuacagg

SEQ ID NO: 914852 - RNA, 21 nt, Human
cagaguagcugggauuacagg

SEQ ID NO: 914853 - RNA, 24 nt, Human
cagaguagcugggauuacaggugu

SEQ ID NO: 914854 - RNA, 22 nt, Human
caggagccuuccccaaaccagu

SEQ ID NO: 914855 - RNA, 22 nt, Human
cauucaguuuugagagggcugu

SEQ ID NO: 914856 - RNA, 19 nt, Human
ccagcagagccguccaggc

SEQ ID NO: 914857 - RNA, 19 nt, Human
ccauuauccaaagcuggcc

SEQ ID NO: 914858 - RNA, 18 nt, Human
cccugaacuccugggcuc

SEQ ID NO: 914859 - RNA, 21 nt, Human
ccuccagggugaccagcacuu

SEQ ID NO: 914860 - RNA, 20 nt, Human
ccucgcucccauuauccaaa

SEQ ID NO: 914861 - RNA, 22 nt, Human
cuguaccuggccucaccauuca

SEQ ID NO: 914862 - RNA, 19 nt, Human
gaggagagccgggcucagg

SEQ ID NO: 914863 - RNA, 19 nt, Human
gaguagcugggauuacagg

SEQ ID NO: 914864 - RNA, 24 nt, Human
gaguagcugggauuacaggugugc

SEQ ID NO: 914865 - RNA, 21 nt, Human
gagugaggagagccgggcuca

SEQ ID NO: 914866 - RNA, 18 nt, Human
gauuacaggugugcgcca

SEQ ID NO: 914867 - RNA, 21 nt, Human
gauuacaggugugcgccacug

SEQ ID NO: 914868 - RNA, 24 nt, Human
gauuacaggugugcgccacuguac

SEQ ID NO: 914869 - RNA, 21 nt, Human
gcaggagaggggcccugugga

SEQ ID NO: 914870 - RNA, 19 nt, Human
gccacuguaccuggccuca

SEQ ID NO: 914871 - RNA, 24 nt, Human
ggagccuuccccaaaccagugcac

SEQ ID NO: 914872 - RNA, 18 nt, Human
ggagccuuccccaaaccg

SEQ ID NO: 914873 - RNA, 18 nt, Human
gggagaccagcagagccg

SEQ ID NO: 914874 - RNA, 21 nt, Human
ggggacggggagaccagcaga

SEQ ID NO: 914875 - RNA, 18 nt, Human
guagcugggauuacaggu

SEQ ID NO: 914876 - RNA, 22 nt, Human
ucagaguagcugggauuacagg

SEQ ID NO: 914877 - RNA, 24 nt, Human
ucagaguagcugggauuacaggug

SEQ ID NO: 914878 - RNA, 22 nt, Human
uccccaaaccagugcaccucca

SEQ ID NO: 914879 - RNA, 18 nt, Human
uccugggcucacuugauu

SEQ ID NO: 914880 - RNA, 24 nt, Human
ugaggugagugaggagagccgggc

SEQ ID NO: 914881 - RNA, 21 nt, Human
ugccucaggcuucagaguagc

SEQ ID NO: 914882 - RNA, 22 nt, Human
ugccucaggcuucagaguagcu

SEQ ID NO: 914883 - RNA, 24 nt, Human
ugccucaggcuucagaguagcugg

SEQ ID NO: 914884 - RNA, 21 nt, Human
ugggauuacaggugugcgcca

SEQ ID NO: 914885 - RNA, 22 nt, Human
ugggauuacaggugugcgccac

SEQ ID NO: 914886 - RNA, 22 nt, Human
ugggauuacaggugugcgccac

SEQ ID NO: 914887 - RNA, 22 nt, Human
ugggauuacaggugugcgccac

SEQ ID NO: 914888 - RNA, 24 nt, Human
ugggauuacaggugugcgccacug

SEQ ID NO: 914889 - RNA, 19 nt, Human
uguggaggggccgccuggg

SEQ ID NO: 914890 - RNA, 20 nt, Human
uuccccaaaccagugcaccu

SEQ ID NO: 914891 - RNA, 20 nt, Human
aauccuuuuuuuuuuuuuuu

SEQ ID NO: 914892 - RNA, 20 nt, Human
aauccuuuuuuuuuuuuuuu

SEQ ID NO: 914893 - RNA, 19 nt, Human
aggcaggagaggggcccug

SEQ ID NO: 914894 - RNA, 22 nt, Human
aggggacggggagaccagcaga

SEQ ID NO: 914895 - RNA, 21 nt, Human
aggugaguggggagagccagg

SEQ ID NO: 914896 - RNA, 19 nt, Human
ccagcagagcuguccaggc

SEQ ID NO: 914897 - RNA, 18 nt, Human
ccccaaaccaguacaccu

SEQ ID NO: 914898 - RNA, 18 nt, Human
ccccagagggcugugggg

SEQ ID NO: 914899 - RNA, 19 nt, Human
ccccagagggcuguggggg

SEQ ID NO: 914900 - RNA, 21 nt, Human
ccccagagggcugugggggcc

SEQ ID NO: 914901 - RNA, 21 nt, Human
ccuccagggugaccagcacuu

SEQ ID NO: 914902 - RNA, 21 nt, Human
gcaggagaggggcccugugga

SEQ ID NO: 914903 - RNA, 18 nt, Human
ggcugaggugagugggga

SEQ ID NO: 914904 - RNA, 19 nt, Human
ggggagaccagcagagcug

SEQ ID NO: 914905 - RNA, 22 nt, Human
uccccaaaccaguacaccucca

SEQ ID NO: 914906 - RNA, 19 nt, Human
ucccuugccuaauugcucc

SEQ ID NO: 914907 - RNA, 23 nt, Human
ugaggugaguggggagagccagg

SEQ ID NO: 914908 - RNA, 19 nt, Human
ugaguggggagagccaggg

SEQ ID NO: 914909 - RNA, 19 nt, Human
ugccugagggcugagguga

SEQ ID NO: 914910 - RNA, 20 nt, Human
ugccugagggcugaggugag

SEQ ID NO: 914911 - RNA, 24 nt, Human
uguggaggggcugccugagggcug

SEQ ID NO: 914912 - RNA, 24 nt, Human
uucaaauccuuuuuuuuuuuuuuu

SEQ ID NO: 914913 - RNA, 29 nt, Human
uucaaauccuuuuuuuuuuuuuuuuuuuu

SEQ ID NO: 914914 - RNA, 21 nt, Human
aagaaucauucuuaaagccaa

SEQ ID NO: 914915 - RNA, 21 nt, Human
aagcccgaggccuuuuccggc

SEQ ID NO: 914916 - RNA, 23 nt, Human
accaccggcgucccccgccgguc

SEQ ID NO: 914917 - RNA, 18 nt, Human
acgcacagcuugggaacg

SEQ ID NO: 914918 - RNA, 19 nt, Human
acugaacucucacucaagu

SEQ ID NO: 914919 - RNA, 21 nt, Human
cacagcuugggaacgcagagg

SEQ ID NO: 914920 - RNA, 22 nt, Human
cacugacagccagugccuuggc

SEQ ID NO: 914921 - RNA, 18 nt, Human
cagaggaugccaaguucu

SEQ ID NO: 914922 - RNA, 21 nt, Human
ccacucccguaacugaacgug

SEQ ID NO: 914923 - RNA, 26 nt, Human
ccagaacgcacagcuugggaacgcag

SEQ ID NO: 914924 - RNA, 24 nt, Human
cccaauguugauaccugcccacaa

SEQ ID NO: 914925 - RNA, 19 nt, Human
cccacaaaauauucucacc

SEQ ID NO: 914926 - RNA, 23 nt, Human
cccacccucaccauucacagacc

SEQ ID NO: 914927 - RNA, 19 nt, Human
cccggugcccccgcagccg

SEQ ID NO: 914928 - RNA, 20 nt, Human
ccgcugccgccaccaccggc

SEQ ID NO: 914929 - RNA, 22 nt, Human
ccgcugccgccaccaccggcgu

SEQ ID NO: 914930 - RNA, 20 nt, Human
cggcccggugcccccgcagc

SEQ ID NO: 914931 - RNA, 20 nt, Human
cuacuagaccagcuuggcca

SEQ ID NO: 914932 - RNA, 18 nt, Human
cuagaccagcuuggccau

SEQ ID NO: 914933 - RNA, 18 nt, Human
cucccacccucaccauuc

SEQ ID NO: 914934 - RNA, 26 nt, Human
cucucugcgcugucuugucuccugac

SEQ ID NO: 914935 - RNA, 23 nt, Human
cuguggaugcaggccuaccccuc

SEQ ID NO: 914936 - RNA, 19 nt, Human
cuuccccaauguugauacc

SEQ ID NO: 914937 - RNA, 19 nt, Human
gaagacaaccuuuacugca

SEQ ID NO: 914938 - RNA, 21 nt, Human
gacugaacucucacucaaguu

SEQ ID NO: 914939 - RNA, 22 nt, Human
gccuuggccuggauccucucug

SEQ ID NO: 914940 - RNA, 23 nt, Human
ggaugcaggccuaccccuccuca

SEQ ID NO: 914941 - RNA, 19 nt, Human
ggcccggugcccccgcagc

SEQ ID NO: 914942 - RNA, 18 nt, Human
gguggcgccgcggcccgg

SEQ ID NO: 914943 - RNA, 21 nt, Human
guggaugcaggccuaccccuc

SEQ ID NO: 914944 - RNA, 24 nt, Human
uauaagaaucauucuuaaagccaa

SEQ ID NO: 914945 - RNA, 23 nt, Human
ucacaacaaacuuggggcggugc

SEQ ID NO: 914946 - RNA, 19 nt, Human
ucacagaccaucacgacac

SEQ ID NO: 914947 - RNA, 27 nt, Human
ucaguagcugguccagaaccggggucc

SEQ ID NO: 914948 - RNA, 19 nt, Human
uccccaauguugauaccug

SEQ ID NO: 914949 - RNA, 26 nt, Human
uccccacacuuacuuacuuacugcuc

SEQ ID NO: 914950 - RNA, 20 nt, Human
uccucaguccagccucaucu

SEQ ID NO: 914951 - RNA, 24 nt, Human
ugacagccagugccuuggccugga

SEQ ID NO: 914952 - RNA, 18 nt, Human
ugacucccacccucacca

SEQ ID NO: 914953 - RNA, 18 nt, Human
ugauaccugcccacaaaa

SEQ ID NO: 914954 - RNA, 22 nt, Human
ugcaguuguaaauuugcauuua

SEQ ID NO: 914955 - RNA, 23 nt, Human
ugccaagcccgaggccuuuuccg

SEQ ID NO: 914956 - RNA, 20 nt, Human
ugucuugucuccugacuccc

SEQ ID NO: 914957 - RNA, 21 nt, Human
ugucuugucuccugacuccca

SEQ ID NO: 914958 - RNA, 20 nt, Human
uuaauauuucacaauuccug

SEQ ID NO: 914959 - RNA, 23 nt, Human
uuccucguguuaggggcaaaggu

SEQ ID NO: 914960 - RNA, 19 nt, Human
uugacgcugauuuaggcau

SEQ ID NO: 914961 - RNA, 24 nt, Human
uuuuuuuuuuuuuuuuuuuuucag

SEQ ID NO: 914962 - RNA, 20 nt, Human
aaaaaaagaaaaaaaaaagu

SEQ ID NO: 914963 - RNA, 20 nt, Human
aaaaaacgccuuucaacuga

SEQ ID NO: 914964 - RNA, 22 nt, Human
aaacaaaagcaaaaaguuauga

SEQ ID NO: 914965 - RNA, 23 nt, Human
aaacaaaagcaaaaaguuaugaa

SEQ ID NO: 914966 - RNA, 25 nt, Human
aaacaaaagcaaaaaguuaugaauu

SEQ ID NO: 914967 - RNA, 18 nt, Human
aaaccaaagaaaaauagg

SEQ ID NO: 914968 - RNA, 26 nt, Human
aaaggcaccaccauuccauaccaaag

SEQ ID NO: 914969 - RNA, 23 nt, Human
aaagguuaaaaaaaaaaaauuca

SEQ ID NO: 914970 - RNA, 23 nt, Human
aaagucacauucccaucaugcaa

SEQ ID NO: 914971 - RNA, 23 nt, Human
aaauauauacuaagcacaauaua

SEQ ID NO: 914972 - RNA, 22 nt, Human
aacauauuccuaucuccuacca

SEQ ID NO: 914973 - RNA, 20 nt, Human
aacaugguaaaccccggucu

SEQ ID NO: 914974 - RNA, 21 nt, Human
aacaugguaaaccccggucuc

SEQ ID NO: 914975 - RNA, 18 nt, Human
aagagaagaaggucaaag

SEQ ID NO: 914976 - RNA, 24 nt, Human
aagcaaacaaaauaaacacucucc

SEQ ID NO: 914977 - RNA, 23 nt, Human
aagcaggagagaaaugagccaug

SEQ ID NO: 914978 - RNA, 23 nt, Human
aagcuauucacaaacccugcuca

SEQ ID NO: 914979 - RNA, 21 nt, Human
aaggcaccaccauuccauacc

SEQ ID NO: 914980 - RNA, 24 nt, Human
aaucacuucaaccagggaggcaga

SEQ ID NO: 914981 - RNA, 19 nt, Human
aaucagauccccuaaccug

SEQ ID NO: 914982 - RNA, 18 nt, Human
aauucaggugguuccuuc

SEQ ID NO: 914983 - RNA, 18 nt, Human
acaaaacccugggcaggg

SEQ ID NO: 914984 - RNA, 22 nt, Human
acacugcaggacaaaaaugaac

SEQ ID NO: 914985 - RNA, 23 nt, Human
acagagcaagacucugucuaaaa

SEQ ID NO: 914986 - RNA, 25 nt, Human
acaugccucaaaaagcaaacaaaau

SEQ ID NO: 914987 - RNA, 22 nt, Human
acgacacagagaaacguguguc

SEQ ID NO: 914988 - RNA, 19 nt, Human
acugaaaugaggagcccug

SEQ ID NO: 914989 - RNA, 24 nt, Human
acugcacuccagccugggcaacag

SEQ ID NO: 914990 - RNA, 24 nt, Human
acugcacuccagccugggcaacag

SEQ ID NO: 914991 - RNA, 22 nt, Human
agaaaacauuccuccacucaaa

SEQ ID NO: 914992 - RNA, 22 nt, Human
agaaaaguggcuugaggccaag

SEQ ID NO: 914993 - RNA, 18 nt, Human
agaaauuggaagagaaau

SEQ ID NO: 914994 - RNA, 21 nt, Human
agagcaagacucugucuaaaa

SEQ ID NO: 914995 - RNA, 23 nt, Human
agagccgcugggaguccugagac

SEQ ID NO: 914996 - RNA, 21 nt, Human
agaggcaagggaauugcuucc

SEQ ID NO: 914997 - RNA, 20 nt, Human
agaggcaggcagaucaccug

SEQ ID NO: 914998 - RNA, 24 nt, Human
agagguugcagugagcuaaaaucg

SEQ ID NO: 914999 - RNA, 22 nt, Human
agaucaccugaggucaggaguu

SEQ ID NO: 915000 - RNA, 25 nt, Human
agaucaccugaggucaggaguuuga

SEQ ID NO: 915001 - RNA, 22 nt, Human
agcaaugaacagaagagacauu

SEQ ID NO: 915002 - RNA, 24 nt, Human
agcacacaagugacauauaaacau

SEQ ID NO: 915003 - RNA, 18 nt, Human
agcaguacaacuugcuuc

SEQ ID NO: 915004 - RNA, 24 nt, Human
agccugggcaacagagcaagacuc

SEQ ID NO: 915005 - RNA, 20 nt, Human
agccugggcaacaugguaaa

SEQ ID NO: 915006 - RNA, 23 nt, Human
agccugggcaacaugguaaaccc

SEQ ID NO: 915007 - RNA, 22 nt, Human
agcucauggggguugggguggg

SEQ ID NO: 915008 - RNA, 19 nt, Human
aggcacacuucccuuuugg

SEQ ID NO: 915009 - RNA, 19 nt, Human
aggcagaggcaggcagauc

SEQ ID NO: 915010 - RNA, 19 nt, Human
aggcagagguugcagugag

SEQ ID NO: 915011 - RNA, 20 nt, Human
aggcagagguugcagugagc

SEQ ID NO: 915012 - RNA, 23 nt, Human
aggcagagguugcagugagcuaa

SEQ ID NO: 915013 - RNA, 26 nt, Human
aggcagaucaccugaggucaggaguu

SEQ ID NO: 915014 - RNA, 22 nt, Human
aggcaggagaaucacuucaacc

SEQ ID NO: 915015 - RNA, 22 nt, Human
aggcaggcagaucaccugaggu

SEQ ID NO: 915016 - RNA, 26 nt, Human
aggcaggcagaucaccugaggucagg

SEQ ID NO: 915017 - RNA, 19 nt, Human
aggcugaggcaggagaauc

SEQ ID NO: 915018 - RNA, 21 nt, Human
aggcuggggaaauaugucuuc

SEQ ID NO: 915019 - RNA, 24 nt, Human
agggaggcagagguugcagugagc

SEQ ID NO: 915020 - RNA, 20 nt, Human
aggugaagcgaggugggggg

SEQ ID NO: 915021 - RNA, 21 nt, Human
aggugaagcgagguggggggc

SEQ ID NO: 915022 - RNA, 24 nt, Human
aggugugguggcucacaccuguaa

SEQ ID NO: 915023 - RNA, 21 nt, Human
agucaaacuucuugguuuccu

SEQ ID NO: 915024 - RNA, 24 nt, Human
aucgugccacugcacuccagccug

SEQ ID NO: 915025 - RNA, 25 nt, Human
auggggcagcgggagggggcugaaa

SEQ ID NO: 915026 - RNA, 21 nt, Human
auugaguaggaaagcucaaag

SEQ ID NO: 915027 - RNA, 21 nt, Human
caaaaaacgccuuucaacuga

SEQ ID NO: 915028 - RNA, 20 nt, Human
caaacagccaccagggccag

SEQ ID NO: 915029 - RNA, 18 nt, Human
caaagcuauucacaaacc

SEQ ID NO: 915030 - RNA, 23 nt, Human
caaagcuauucacaaacccugcu

SEQ ID NO: 915031 - RNA, 23 nt, Human
caacagcaacuucacaagguaac

SEQ ID NO: 915032 - RNA, 24 nt, Human
cacaaccccaaagaggaguccucu

SEQ ID NO: 915033 - RNA, 24 nt, Human
cacaccuguaaucccagcacucug

SEQ ID NO: 915034 - RNA, 24 nt, Human
cacagaaagaaucaguaauuucca

SEQ ID NO: 915035 - RNA, 22 nt, Human
caccacaggucaaacucaucuu

SEQ ID NO: 915036 - RNA, 20 nt, Human
caccuguaaucccagcacuc

SEQ ID NO: 915037 - RNA, 24 nt, Human
caccuguaaucccagcacucuggg

SEQ ID NO: 915038 - RNA, 19 nt, Human
cacgacacagagaaacgug

SEQ ID NO: 915039 - RNA, 22 nt, Human
cacuccugucuauccccccacc

SEQ ID NO: 915040 - RNA, 19 nt, Human
cacucucccucucacuccu

SEQ ID NO: 915041 - RNA, 18 nt, Human
cacugcacuccagccugg

SEQ ID NO: 915042 - RNA, 19 nt, Human
cacugcacuccagccuggg

SEQ ID NO: 915043 - RNA, 21 nt, Human
cacugcacuccagccugggca

SEQ ID NO: 915044 - RNA, 23 nt, Human
cacugcacuccagccugggcaac

SEQ ID NO: 915045 - RNA, 24 nt, Human
cacugcacuccagccugggcaaca

SEQ ID NO: 915046 - RNA, 27 nt, Human
cacugcacuccagccugggcaacagag

SEQ ID NO: 915047 - RNA, 18 nt, Human
cagaagccucauaguacu

SEQ ID NO: 915048 - RNA, 24 nt, Human
cagaucaccugaggucaggaguuu

SEQ ID NO: 915049 - RNA, 18 nt, Human
cagcacucugggaggcag

SEQ ID NO: 915050 - RNA, 26 nt, Human
cagccaaggacaagagcaguagacau

SEQ ID NO: 915051 - RNA, 24 nt, Human
cagcuacucgggaggcugaggcag

SEQ ID NO: 915052 - RNA, 22 nt, Human
cagcucacagacacugcaggac

SEQ ID NO: 915053 - RNA, 19 nt, Human
caggacaaaaaugaacacc

SEQ ID NO: 915054 - RNA, 18 nt, Human
caggaugagagcacagua

SEQ ID NO: 915055 - RNA, 22 nt, Human
caguagacauucuuugcggaac

SEQ ID NO: 915056 - RNA, 19 nt, Human
cagucaaguggaauaugua

SEQ ID NO: 915057 - RNA, 23 nt, Human
cagugcaaugaaacacacgcucc

SEQ ID NO: 915058 - RNA, 18 nt, Human
cauaacaccagugaauca

SEQ ID NO: 915059 - RNA, 21 nt, Human
caucaaauauauacuaagcac

SEQ ID NO: 915060 - RNA, 20 nt, Human
caucagggugcaaucugagg

SEQ ID NO: 915061 - RNA, 26 nt, Human
caugcaagcacauuaaaauauauggc

SEQ ID NO: 915062 - RNA, 18 nt, Human
ccaaacagccaccagggc

SEQ ID NO: 915063 - RNA, 24 nt, Human
ccaaaggaaagcauucaaagcuag

SEQ ID NO: 915064 - RNA, 21 nt, Human
ccaauccauagacagcccgcc

SEQ ID NO: 915065 - RNA, 19 nt, Human
ccacgacacagagaaacgu

SEQ ID NO: 915066 - RNA, 20 nt, Human
ccacugcacuccagccuggg

SEQ ID NO: 915067 - RNA, 20 nt, Human
ccacugcacuccagccuggg

SEQ ID NO: 915068 - RNA, 21 nt, Human
ccacugcacuccagccugggc

SEQ ID NO: 915069 - RNA, 23 nt, Human
ccacugcacuccagccugggcaa

SEQ ID NO: 915070 - RNA, 24 nt, Human
ccacugcacuccagccugggcaac

SEQ ID NO: 915071 - RNA, 21 nt, Human
ccagaaaaguggcuugaggcc

SEQ ID NO: 915072 - RNA, 20 nt, Human
ccagucaaguggaauaugua

SEQ ID NO: 915073 - RNA, 23 nt, Human
ccauuccauaccaaaggcaagga

SEQ ID NO: 915074 - RNA, 23 nt, Human
cccaauauucuuuggaccagaaa

SEQ ID NO: 915075 - RNA, 22 nt, Human
cccacauguuugcugggccaaa

SEQ ID NO: 915076 - RNA, 24 nt, Human
cccaguaggaacacaaaaaacgcc

SEQ ID NO: 915077 - RNA, 21 nt, Human
ccccaaagaggaguccucucc

SEQ ID NO: 915078 - RNA, 22 nt, Human
ccccaauccauagacagcccgc

SEQ ID NO: 915079 - RNA, 23 nt, Human
ccccccuagagccccacaucacc

SEQ ID NO: 915080 - RNA, 21 nt, Human
cccccuuccacaguccauuuc

SEQ ID NO: 915081 - RNA, 23 nt, Human
ccggucucaagaaauauacugaa

SEQ ID NO: 915082 - RNA, 21 nt, Human
ccguaugcuaagcccagugcc

SEQ ID NO: 915083 - RNA, 24 nt, Human
ccuaaaccagggcaucagggugca

SEQ ID NO: 915084 - RNA, 18 nt, Human
ccucaaaaagcaaacaaa

SEQ ID NO: 915085 - RNA, 21 nt, Human
ccuccuccuucagcucuccca

SEQ ID NO: 915086 - RNA, 20 nt, Human
ccugcauaaagugugaaaac

SEQ ID NO: 915087 - RNA, 20 nt, Human
ccugccccacgacacagaga

SEQ ID NO: 915088 - RNA, 22 nt, Human
ccugggcaacagagcaagacuc

SEQ ID NO: 915089 - RNA, 22 nt, Human
ccugggcaacaugguaaacccc

SEQ ID NO: 915090 - RNA, 23 nt, Human
ccugggcaacaugguaaaccccg

SEQ ID NO: 915091 - RNA, 23 nt, Human
ccuuggaccccaggaaacuaccc

SEQ ID NO: 915092 - RNA, 22 nt, Human
cggaaagugucacccacucucc

SEQ ID NO: 915093 - RNA, 19 nt, Human
cgggagggggcugaaaaca

SEQ ID NO: 915094 - RNA, 24 nt, Human
cgggcguagucccagcuacucggg

SEQ ID NO: 915095 - RNA, 22 nt, Human
cggucucaagaaauauacugaa

SEQ ID NO: 915096 - RNA, 24 nt, Human
cuaaaagucacauucccaucaugc

SEQ ID NO: 915097 - RNA, 19 nt, Human
cuagaaaacauuccuccac

SEQ ID NO: 915098 - RNA, 23 nt, Human
cuagaaaacauuccuccacucaa

SEQ ID NO: 915099 - RNA, 19 nt, Human
cuagagccccacaucaccg

SEQ ID NO: 915100 - RNA, 22 nt, Human
cuagagccccacaucaccguga

SEQ ID NO: 915101 - RNA, 23 nt, Human
cucacaccuguaaucccagcacu

SEQ ID NO: 915102 - RNA, 24 nt, Human
cucacaccuguaaucccagcacuc

SEQ ID NO: 915103 - RNA, 22 nt, Human
cucacuccugucuaucccccca

SEQ ID NO: 915104 - RNA, 20 nt, Human
cucagagcauggggcagcgg

SEQ ID NO: 915105 - RNA, 23 nt, Human
cucauaguacucugaggccaagc

SEQ ID NO: 915106 - RNA, 18 nt, Human
cucccaguucuaggauuc

SEQ ID NO: 915107 - RNA, 26 nt, Human
cucuuucuuacgcuuccuggagucuu

SEQ ID NO: 915108 - RNA, 21 nt, Human
cugagaugugcugaagaggca

SEQ ID NO: 915109 - RNA, 20 nt, Human
cuuccauggguuuuuguuuu

SEQ ID NO: 915110 - RNA, 23 nt, Human
cuucccuagguggagaaguaccc

SEQ ID NO: 915111 - RNA, 22 nt, Human
gaaguagaggucuccaauugug

SEQ ID NO: 915112 - RNA, 20 nt, Human
gaagucuacaggcugguguu

SEQ ID NO: 915113 - RNA, 22 nt, Human
gagcauggggcagcgggagggg

SEQ ID NO: 915114 - RNA, 19 nt, Human
gagguggggggcggagagg

SEQ ID NO: 915115 - RNA, 24 nt, Human
gaucaccugaggucaggaguuuga

SEQ ID NO: 915116 - RNA, 24 nt, Human
gaugagauguuuucucuagcuguu

SEQ ID NO: 915117 - RNA, 22 nt, Human
gcaaggaauuuuuguucugcaa

SEQ ID NO: 915118 - RNA, 20 nt, Human
gcacaaccuggucaaaagca

SEQ ID NO: 915119 - RNA, 24 nt, Human
gcacuccagccugggcaacagagc

SEQ ID NO: 915120 - RNA, 21 nt, Human
gcaggagaaucacuucaacca

SEQ ID NO: 915121 - RNA, 19 nt, Human
gcagggcucagagugucua

SEQ ID NO: 915122 - RNA, 20 nt, Human
gccaaggacaagagcaguag

SEQ ID NO: 915123 - RNA, 22 nt, Human
gccacugcacuccagccugggc

SEQ ID NO: 915124 - RNA, 24 nt, Human
gccacugcacuccagccugggcaa

SEQ ID NO: 915125 - RNA, 20 nt, Human
gcuaaaaucgugccacugca

SEQ ID NO: 915126 - RNA, 25 nt, Human
gcuguuguaaggaaaggaaacauua

SEQ ID NO: 915127 - RNA, 18 nt, Human
gcuuuugcaacaucuuga

SEQ ID NO: 915128 - RNA, 19 nt, Human
ggauauggcagcuuuucug

SEQ ID NO: 915129 - RNA, 25 nt, Human
ggcccuuuagguuucaaauggagaa

SEQ ID NO: 915130 - RNA, 18 nt, Human
gggaggcagaggcaggca

SEQ ID NO: 915131 - RNA, 23 nt, Human
gggaggcugaggcaggagaauca

SEQ ID NO: 915132 - RNA, 18 nt, Human
gggcagagagccgcuggg

SEQ ID NO: 915133 - RNA, 18 nt, Human
ggggguugggguggggaa

SEQ ID NO: 915134 - RNA, 24 nt, Human
gguggcucacaccuguaaucccag

SEQ ID NO: 915135 - RNA, 22 nt, Human
guccaguucuguugccuuugac

SEQ ID NO: 915136 - RNA, 18 nt, Human
guggaagggcacuuuaug

SEQ ID NO: 915137 - RNA, 23 nt, Human
guggcucacaccuguaaucccag

SEQ ID NO: 915138 - RNA, 18 nt, Human
gugugguggcucacaccu

SEQ ID NO: 915139 - RNA, 24 nt, Human
uaaaaucgugccacugcacuccag

SEQ ID NO: 915140 - RNA, 23 nt, Human
uaaacacuaguaauuugaacuuc

SEQ ID NO: 915141 - RNA, 18 nt, Human
uaaagcaaaagacgcccu

SEQ ID NO: 915142 - RNA, 24 nt, Human
uaaagguuaaaaaaaaaaaauuca

SEQ ID NO: 915143 - RNA, 18 nt, Human
uaaagugugaaaacacca

SEQ ID NO: 915144 - RNA, 23 nt, Human
uaacaccagugaaucaauaguau

SEQ ID NO: 915145 - RNA, 18 nt, Human
uaagcacaauauauaaua

SEQ ID NO: 915146 - RNA, 20 nt, Human
uaauaguauaucaucuuuua

SEQ ID NO: 915147 - RNA, 20 nt, Human
uacaacuugcuucuuguuuu

SEQ ID NO: 915148 - RNA, 22 nt, Human
uacaggcugguguugcaaacca

SEQ ID NO: 915149 - RNA, 18 nt, Human
uacgcuuccuggagucuu

SEQ ID NO: 915150 - RNA, 19 nt, Human
uagaaacaaaagcaaaaag

SEQ ID NO: 915151 - RNA, 18 nt, Human
uagccaaacagccaccag

SEQ ID NO: 915152 - RNA, 26 nt, Human
uagcucucuuuaacacaaugguacca

SEQ ID NO: 915153 - RNA, 21 nt, Human
uagcugacacaggaugagagc

SEQ ID NO: 915154 - RNA, 21 nt, Human
uaggccuuugauccuauucug

SEQ ID NO: 915155 - RNA, 23 nt, Human
uaguagaaacaaaagcaaaaagu

SEQ ID NO: 915156 - RNA, 21 nt, Human
uaguggccacagccuaggcug

SEQ ID NO: 915157 - RNA, 21 nt, Human
uaucaaccagugaaggcauca

SEQ ID NO: 915158 - RNA, 19 nt, Human
uaucaucuuuuaaacacua

SEQ ID NO: 915159 - RNA, 21 nt, Human
uaugugguucuggggucaugu

SEQ ID NO: 915160 - RNA, 18 nt, Human
ucaaacagugauuugggc

SEQ ID NO: 915161 - RNA, 26 nt, Human
ucacaaccccaaagaggagggaacgc

SEQ ID NO: 915162 - RNA, 18 nt, Human
ucacacagcaccucccaa

SEQ ID NO: 915163 - RNA, 19 nt, Human
ucacuguaauaauccacaa

SEQ ID NO: 915164 - RNA, 24 nt, Human
ucacuuugggaagcucugcaaagu

SEQ ID NO: 915165 - RNA, 24 nt, Human
ucaguuuuccuuuuaaggaaaaau

SEQ ID NO: 915166 - RNA, 18 nt, Human
ucauggggguuggggugg

SEQ ID NO: 915167 - RNA, 18 nt, Human
uccacgaggcacacuucc

SEQ ID NO: 915168 - RNA, 20 nt, Human
uccauagacagcccgccagc

SEQ ID NO: 915169 - RNA, 20 nt, Human
uccaugggcaauuacuccug

SEQ ID NO: 915170 - RNA, 20 nt, Human
ucccaaguagucuaauguac

SEQ ID NO: 915171 - RNA, 21 nt, Human
ucccucauguuuaacucuuuu

SEQ ID NO: 915172 - RNA, 23 nt, Human
uccuucaauacucuuuacauugc

SEQ ID NO: 915173 - RNA, 21 nt, Human
uccuuccagucacugcucuag

SEQ ID NO: 915174 - RNA, 25 nt, Human
ucgggaggcugaggcaggagaauca

SEQ ID NO: 915175 - RNA, 23 nt, Human
ucgugccacugcacuccagccug

SEQ ID NO: 915176 - RNA, 18 nt, Human
ucuccacuuccuuccuga

SEQ ID NO: 915177 - RNA, 20 nt, Human
ucucccucucacuccugucu

SEQ ID NO: 915178 - RNA, 21 nt, Human
ucucuacuaaaaauauaaaaa

SEQ ID NO: 915179 - RNA, 21 nt, Human
ucuuaaauuugaauagcacuu

SEQ ID NO: 915180 - RNA, 21 nt, Human
ucuuaaugcuaagguuguuuu

SEQ ID NO: 915181 - RNA, 22 nt, Human
ucuucaauuuaagaaaaacugg

SEQ ID NO: 915182 - RNA, 20 nt, Human
ucuugguuuccuagugggcu

SEQ ID NO: 915183 - RNA, 24 nt, Human
ugaaaagaugacauuaguuguguu

SEQ ID NO: 915184 - RNA, 22 nt, Human
ugaaaccccaauccauagacag

SEQ ID NO: 915185 - RNA, 22 nt, Human
ugaaaguaauccaguuuuccca

SEQ ID NO: 915186 - RNA, 20 nt, Human
ugagagcacaguaaaacuua

SEQ ID NO: 915187 - RNA, 22 nt, Human
ugagaugugcugaagaggcaag

SEQ ID NO: 915188 - RNA, 21 nt, Human
ugagcaggcaauggggcucca

SEQ ID NO: 915189 - RNA, 26 nt, Human
ugagccaugccucuuuuucaguuuag

SEQ ID NO: 915190 - RNA, 19 nt, Human
ugaggcaggagaaucacuu

SEQ ID NO: 915191 - RNA, 24 nt, Human
ugaggcaggagaaucacuucaacc

SEQ ID NO: 915192 - RNA, 18 nt, Human
ugaggucaggaguuugaa

SEQ ID NO: 915193 - RNA, 23 nt, Human
ugaggucaggaguuugaaaccag

SEQ ID NO: 915194 - RNA, 26 nt, Human
ugaguaaauuaucaugauuacaugaa

SEQ ID NO: 915195 - RNA, 22 nt, Human
ugcaauacaaagagaguaaauc

SEQ ID NO: 915196 - RNA, 21 nt, Human
ugcaaugcagggcucagagug

SEQ ID NO: 915197 - RNA, 24 nt, Human
ugccacugcacuccagccugggca

SEQ ID NO: 915198 - RNA, 20 nt, Human
ugccccauuuuuuucccaca

SEQ ID NO: 915199 - RNA, 21 nt, Human
ugccucaaaaagcaaacaaaa

SEQ ID NO: 915200 - RNA, 18 nt, Human
ugcugagagauucuccac

SEQ ID NO: 915201 - RNA, 24 nt, Human
uggaauauggaacacgccuccucc

SEQ ID NO: 915202 - RNA, 18 nt, Human
uggccuggccucuuaucu

SEQ ID NO: 915203 - RNA, 21 nt, Human
uggcucacaccuguaauccca

SEQ ID NO: 915204 - RNA, 24 nt, Human
uggcucacaccuguaaucccagca

SEQ ID NO: 915205 - RNA, 18 nt, Human
ugggaggcagaggcaggc

SEQ ID NO: 915206 - RNA, 20 nt, Human
ugggaggcagaggcaggcag

SEQ ID NO: 915207 - RNA, 24 nt, Human
ugggaggcagaggcaggcagauca

SEQ ID NO: 915208 - RNA, 23 nt, Human
ugggcaacaugguaaaccccggu

SEQ ID NO: 915209 - RNA, 20 nt, Human
ugggguggggaagaaaauga

SEQ ID NO: 915210 - RNA, 20 nt, Human
uggguacuugguggguugug

SEQ ID NO: 915211 - RNA, 22 nt, Human
uggguugugguuauuccuaugg

SEQ ID NO: 915212 - RNA, 19 nt, Human
uggguuuuuguuuuuuugu

SEQ ID NO: 915213 - RNA, 24 nt, Human
ugguggcucacaccuguaauccca

SEQ ID NO: 915214 - RNA, 20 nt, Human
ugguuuucucucucauucca

SEQ ID NO: 915215 - RNA, 22 nt, Human
uguacagaaagaaaagaaagga

SEQ ID NO: 915216 - RNA, 23 nt, Human
uguaccuaugaauuuaaacaugu

SEQ ID NO: 915217 - RNA, 18 nt, Human
ugugaaaacaccaagcug

SEQ ID NO: 915218 - RNA, 22 nt, Human
uguugcuuccauggguuuuugu

SEQ ID NO: 915219 - RNA, 26 nt, Human
uuaaaucauguauguggcuauaucaa

SEQ ID NO: 915220 - RNA, 22 nt, Human
uuacaguugaaaggcuggggaa

SEQ ID NO: 915221 - RNA, 19 nt, Human
uucaaccagggaggcagag

SEQ ID NO: 915222 - RNA, 18 nt, Human
uucccuuuugggcuaaag

SEQ ID NO: 915223 - RNA, 24 nt, Human
uuccugagcagccaugguuuucuc

SEQ ID NO: 915224 - RNA, 18 nt, Human
uucggccagguguggugg

SEQ ID NO: 915225 - RNA, 19 nt, Human
uucuagcacaaccugguca

SEQ ID NO: 915226 - RNA, 22 nt, Human
uucuaggauucaauuucuccug

SEQ ID NO: 915227 - RNA, 18 nt, Human
uucucucucauuccacag

SEQ ID NO: 915228 - RNA, 18 nt, Human
uucuugguuuccuagugg

SEQ ID NO: 915229 - RNA, 21 nt, Human
uugaaaaacagaauguuucca

SEQ ID NO: 915230 - RNA, 22 nt, Human
uugcagugagcuaaaaucgugc

SEQ ID NO: 915231 - RNA, 25 nt, Human
uuucucuauagcucucuuuaacaca

SEQ ID NO: 915232 - RNA, 23 nt, Human
uuucugugaggagagaaauuauc

SEQ ID NO: 915233 - RNA, 20 nt, Human
aaacaagaaagaggcggcgg

SEQ ID NO: 915234 - RNA, 18 nt, Human
aacagacaaaacacagag

SEQ ID NO: 915235 - RNA, 26 nt, Human
aaccaaaaaacacaaccaacaccaag

SEQ ID NO: 915236 - RNA, 20 nt, Human
aagccccucucagggguccc

SEQ ID NO: 915237 - RNA, 23 nt, Human
aaggacucaaaugcgauuggccg

SEQ ID NO: 915238 - RNA, 21 nt, Human
acaaugccccugucccugcug

SEQ ID NO: 915239 - RNA, 19 nt, Human
acacacgugcuuccgucuc

SEQ ID NO: 915240 - RNA, 18 nt, Human
acacagcacccucgucuc

SEQ ID NO: 915241 - RNA, 19 nt, Human
acagcacccucgucucggc

SEQ ID NO: 915242 - RNA, 18 nt, Human
acaggcucuuggcgucuc

SEQ ID NO: 915243 - RNA, 21 nt, Human
accaacaccaaguauaucucc

SEQ ID NO: 915244 - RNA, 22 nt, Human
agacaaaacacagagcccugcc

SEQ ID NO: 915245 - RNA, 26 nt, Human
agacaaaacacagagcccugccuggg

SEQ ID NO: 915246 - RNA, 24 nt, Human
agacaccccuucugaccucugccc

SEQ ID NO: 915247 - RNA, 18 nt, Human
agacgggguguggcgggg

SEQ ID NO: 915248 - RNA, 19 nt, Human
agccuggggaagaggaggc

SEQ ID NO: 915249 - RNA, 21 nt, Human
agccuggggaagaggaggccu

SEQ ID NO: 915250 - RNA, 22 nt, Human
aggaaccaaaaaacacaaccaa

SEQ ID NO: 915251 - RNA, 20 nt, Human
aggaagcugccccagggcag

SEQ ID NO: 915252 - RNA, 23 nt, Human
aggcaggcacagcagagaaccaa

SEQ ID NO: 915253 - RNA, 21 nt, Human
agggggacccgagcugcgacc

SEQ ID NO: 915254 - RNA, 23 nt, Human
agguuguaacagacaaaacacag

SEQ ID NO: 915255 - RNA, 19 nt, Human
aucaugggggacagcgggg

SEQ ID NO: 915256 - RNA, 19 nt, Human
aucaugggggacagcgggg

SEQ ID NO: 915257 - RNA, 19 nt, Human
augggggacagcggggugg

SEQ ID NO: 915258 - RNA, 22 nt, Human
caaaaaacacaaccaacaccaa

SEQ ID NO: 915259 - RNA, 23 nt, Human
caaguccccagcccugagcuccg

SEQ ID NO: 915260 - RNA, 23 nt, Human
caaugccccugucccugcuggcc

SEQ ID NO: 915261 - RNA, 20 nt, Human
cacaagaauggaaaugaaau

SEQ ID NO: 915262 - RNA, 22 nt, Human
cacagccaucaccaauaagccc

SEQ ID NO: 915263 - RNA, 20 nt, Human
caccaauaagccccucucag

SEQ ID NO: 915264 - RNA, 23 nt, Human
caccacugggagcgcugcccucu

SEQ ID NO: 915265 - RNA, 19 nt, Human
caccccacaggcucuuggc

SEQ ID NO: 915266 - RNA, 18 nt, Human
caccugcugcuccgaguc

SEQ ID NO: 915267 - RNA, 21 nt, Human
cacugaggcccccaaacccaa

SEQ ID NO: 915268 - RNA, 24 nt, Human
cagcacccucgucucggcgcuuug

SEQ ID NO: 915269 - RNA, 19 nt, Human
cagccguccccucugcagg

SEQ ID NO: 915270 - RNA, 23 nt, Human
cagcggagggaggcugcccugga

SEQ ID NO: 915271 - RNA, 21 nt, Human
caggacacaggcaggcacagc

SEQ ID NO: 915272 - RNA, 24 nt, Human
caggcaggcacagcagagaaccaa

SEQ ID NO: 915273 - RNA, 18 nt, Human
caguggagcacgucagcc

SEQ ID NO: 915274 - RNA, 23 nt, Human
caguuuggccauaaaaaugggac

SEQ ID NO: 915275 - RNA, 21 nt, Human
caugggggacagcgggguggg

SEQ ID NO: 915276 - RNA, 23 nt, Human
caugucuccacguggagggggcg

SEQ ID NO: 915277 - RNA, 22 nt, Human
ccaaaaaacacaaccaacacca

SEQ ID NO: 915278 - RNA, 19 nt, Human
ccaaacccaagcugagggc

SEQ ID NO: 915279 - RNA, 20 nt, Human
ccacaccaggcucugccagg

SEQ ID NO: 915280 - RNA, 24 nt, Human
ccagauguccugcacugaggcccc

SEQ ID NO: 915281 - RNA, 18 nt, Human
ccaggucccagacacccc

SEQ ID NO: 915282 - RNA, 20 nt, Human
ccagguuucgggggaacggg

SEQ ID NO: 915283 - RNA, 22 nt, Human
cccaaacccaagcugagggcag

SEQ ID NO: 915284 - RNA, 23 nt, Human
cccacagccaucaccaauaagcc

SEQ ID NO: 915285 - RNA, 24 nt, Human
cccacagccaucaccaauaagccc

SEQ ID NO: 915286 - RNA, 22 nt, Human
cccagcccugagcuccgccagc

SEQ ID NO: 915287 - RNA, 18 nt, Human
ccccagaggccaccgcga

SEQ ID NO: 915288 - RNA, 26 nt, Human
ccccagaggccaccgcgaacagccuu

SEQ ID NO: 915289 - RNA, 20 nt, Human
ccccuccucggagacaucac

SEQ ID NO: 915290 - RNA, 21 nt, Human
cccuaggccaugucuccaccg

SEQ ID NO: 915291 - RNA, 18 nt, Human
ccgagcucugggccucag

SEQ ID NO: 915292 - RNA, 21 nt, Human
ccgagcucugggccucagcgg

SEQ ID NO: 915293 - RNA, 22 nt, Human
ccggccgucggcauccgugcag

SEQ ID NO: 915294 - RNA, 18 nt, Human
ccguccccucugcaggcc

SEQ ID NO: 915295 - RNA, 22 nt, Human
ccucccgcucuguccugccaug

SEQ ID NO: 915296 - RNA, 19 nt, Human
ccuccugcccccgccccuc

SEQ ID NO: 915297 - RNA, 22 nt, Human
ccuccugcccccgccccucggc

SEQ ID NO: 915298 - RNA, 25 nt, Human
ccuggcccuccagcugguccccugg

SEQ ID NO: 915299 - RNA, 23 nt, Human
ccugggaggugggcgucagggcc

SEQ ID NO: 915300 - RNA, 24 nt, Human
ccuguggcccaaggcccggccucc

SEQ ID NO: 915301 - RNA, 19 nt, Human
cgacgggacgugaacagcg

SEQ ID NO: 915302 - RNA, 24 nt, Human
cgcccggggccacaccugcugcuc

SEQ ID NO: 915303 - RNA, 22 nt, Human
cggcggcgggggcgcccgaggg

SEQ ID NO: 915304 - RNA, 26 nt, Human
cgggggcagccggagcagaaguggag

SEQ ID NO: 915305 - RNA, 22 nt, Human
cgucagggccccacugcggcgg

SEQ ID NO: 915306 - RNA, 18 nt, Human
cgucucagaccccacacc

SEQ ID NO: 915307 - RNA, 24 nt, Human
cgucucagaccccacaccaggcuc

SEQ ID NO: 915308 - RNA, 18 nt, Human
cucagaccccacaccagg

SEQ ID NO: 915309 - RNA, 20 nt, Human
cuccggccgucucagacccc

SEQ ID NO: 915310 - RNA, 20 nt, Human
cucgaggggcaccugggagg

SEQ ID NO: 915311 - RNA, 22 nt, Human
cucuguccugccauggagaaaa

SEQ ID NO: 915312 - RNA, 19 nt, Human
cugaccucugccccugccu

SEQ ID NO: 915313 - RNA, 22 nt, Human
cugggaugcaaaccaguguuug

SEQ ID NO: 915314 - RNA, 22 nt, Human
cuggggaagaggaggccuggcc

SEQ ID NO: 915315 - RNA, 23 nt, Human
cuuguccugauggaugcugggag

SEQ ID NO: 915316 - RNA, 23 nt, Human
gaaccaaaaaacacaaccaacac

SEQ ID NO: 915317 - RNA, 22 nt, Human
gaaccugggaugcaaaccagug

SEQ ID NO: 915318 - RNA, 20 nt, Human
gacagggcgggggcugaugg

SEQ ID NO: 915319 - RNA, 22 nt, Human
gacggcggcgggggcgcccgag

SEQ ID NO: 915320 - RNA, 19 nt, Human
gacucccugggaggacugg

SEQ ID NO: 915321 - RNA, 20 nt, Human
gagcagaaguggagcucggc

SEQ ID NO: 915322 - RNA, 18 nt, Human
gaguggaggggcugcucu

SEQ ID NO: 915323 - RNA, 19 nt, Human
gaguguguguccucgcugg

SEQ ID NO: 915324 - RNA, 24 nt, Human
gauuggccgcucgggagggugggu

SEQ ID NO: 915325 - RNA, 19 nt, Human
gcagcgccuucgggggcag

SEQ ID NO: 915326 - RNA, 23 nt, Human
gcccacguucucaguggacagca

SEQ ID NO: 915327 - RNA, 19 nt, Human
gcucagguccccagaggcc

SEQ ID NO: 915328 - RNA, 20 nt, Human
gcucgggaccccagccgucc

SEQ ID NO: 915329 - RNA, 22 nt, Human
ggaaccaaaaaacacaaccaac

SEQ ID NO: 915330 - RNA, 24 nt, Human
ggaagugggcauuggucccgaccc

SEQ ID NO: 915331 - RNA, 20 nt, Human
ggagggggcggggagccuga

SEQ ID NO: 915332 - RNA, 19 nt, Human
ggcagccuggggaagagga

SEQ ID NO: 915333 - RNA, 21 nt, Human
ggcaggaggguccgcuuccca

SEQ ID NO: 915334 - RNA, 22 nt, Human
ggcucugccaggucuggagagg

SEQ ID NO: 915335 - RNA, 20 nt, Human
ggcugccgaccggggugccg

SEQ ID NO: 915336 - RNA, 21 nt, Human
gggaacggggacgugucggga

SEQ ID NO: 915337 - RNA, 28 nt, Human
gggaagugggcauuggucaccaagguau

SEQ ID NO: 915338 - RNA, 20 nt, Human
gggacagagccuggcaggag

SEQ ID NO: 915339 - RNA, 21 nt, Human
gggacagagccuggcaggaga

SEQ ID NO: 915340 - RNA, 19 nt, Human
gggacuggguuggggacag

SEQ ID NO: 915341 - RNA, 21 nt, Human
gggacuggguuggggacaggc

SEQ ID NO: 915342 - RNA, 21 nt, Human
gggaggcugcccuggacgcgg

SEQ ID NO: 915343 - RNA, 21 nt, Human
gggcagcgccuucgggggcag

SEQ ID NO: 915344 - RNA, 22 nt, Human
gggcagggugggugacucugcc

SEQ ID NO: 915345 - RNA, 20 nt, Human
gggcggggagccugaccuuc

SEQ ID NO: 915346 - RNA, 19 nt, Human
gguccuggggaagggcagg

SEQ ID NO: 915347 - RNA, 21 nt, Human
guggaguguguguccucgcug

SEQ ID NO: 915348 - RNA, 22 nt, Human
guggggacugagggcuguggag

SEQ ID NO: 915349 - RNA, 20 nt, Human
guugguuuguuugugucuuu

SEQ ID NO: 915350 - RNA, 21 nt, Human
uacaguacaggaauuuggaca

SEQ ID NO: 915351 - RNA, 20 nt, Human
uaccauggugaaggacccca

SEQ ID NO: 915352 - RNA, 21 nt, Human
uaucaugggggacagcggggu

SEQ ID NO: 915353 - RNA, 24 nt, Human
ucagcggagggaggcugcccugga

SEQ ID NO: 915354 - RNA, 21 nt, Human
ucaugggggacagcggggugg

SEQ ID NO: 915355 - RNA, 24 nt, Human
ucaugggggacagcgggguggguc

SEQ ID NO: 915356 - RNA, 22 nt, Human
uccacuccagcuccucacaucc

SEQ ID NO: 915357 - RNA, 19 nt, Human
ucccaaaggugcagcuucc

SEQ ID NO: 915358 - RNA, 20 nt, Human
ucccacguggauggaggcag

SEQ ID NO: 915359 - RNA, 22 nt, Human
ucccagacaccccuucugaccu

SEQ ID NO: 915360 - RNA, 26 nt, Human
uccccagaggccaccgcgaacagccu

SEQ ID NO: 915361 - RNA, 18 nt, Human
uccccggggggugccugc

SEQ ID NO: 915362 - RNA, 19 nt, Human
uccccggggggugccugcu

SEQ ID NO: 915363 - RNA, 22 nt, Human
ucccgcucuguccugccaugga

SEQ ID NO: 915364 - RNA, 21 nt, Human
ucccugggaggacuggugugg

SEQ ID NO: 915365 - RNA, 22 nt, Human
ucccugggaggacugguguggc

SEQ ID NO: 915366 - RNA, 24 nt, Human
uccuccugcccccgccccucggca

SEQ ID NO: 915367 - RNA, 20 nt, Human
uccugggcagaguggagggg

SEQ ID NO: 915368 - RNA, 18 nt, Human
uccuggggaagggcaggg

SEQ ID NO: 915369 - RNA, 21 nt, Human
ucuccggccgucucagacccc

SEQ ID NO: 915370 - RNA, 21 nt, Human
ucugccgagcucuggccucca

SEQ ID NO: 915371 - RNA, 19 nt, Human
ucuggugccagggcucugg

SEQ ID NO: 915372 - RNA, 21 nt, Human
ugaaaaggaaccaaaaaacac

SEQ ID NO: 915373 - RNA, 25 nt, Human
ugaaaaggaaccaaaaaacacaacc

SEQ ID NO: 915374 - RNA, 21 nt, Human
ugaccucugccccugccuccc

SEQ ID NO: 915375 - RNA, 22 nt, Human
ugagaugacaaugccccugucc

SEQ ID NO: 915376 - RNA, 19 nt, Human
ugagcuggucuccuguggc

SEQ ID NO: 915377 - RNA, 23 nt, Human
ugagcuggucuccuguggcccaa

SEQ ID NO: 915378 - RNA, 26 nt, Human
ugaggcccccaaacccaagcugaggg

SEQ ID NO: 915379 - RNA, 21 nt, Human
ugagggcaggaggguccgcuu

SEQ ID NO: 915380 - RNA, 19 nt, Human
ugcagggggaggacgaggu

SEQ ID NO: 915381 - RNA, 18 nt, Human
ugccagggcucugggcag

SEQ ID NO: 915382 - RNA, 18 nt, Human
ugccccagggcagucugg

SEQ ID NO: 915383 - RNA, 22 nt, Human
ugccgcccgcccggggccacac

SEQ ID NO: 915384 - RNA, 21 nt, Human
ugccugggcccuccaugccag

SEQ ID NO: 915385 - RNA, 19 nt, Human
ugcucgaggggcaccuggg

SEQ ID NO: 915386 - RNA, 21 nt, Human
uggaagugggggauucccaca

SEQ ID NO: 915387 - RNA, 20 nt, Human
uggacacugcccacguucuc

SEQ ID NO: 915388 - RNA, 24 nt, Human
uggagaggaauucuucccaaaggu

SEQ ID NO: 915389 - RNA, 23 nt, Human
uggagggugaugagucggaaaca

SEQ ID NO: 915390 - RNA, 20 nt, Human
uggcaucccuggggggaguu

SEQ ID NO: 915391 - RNA, 19 nt, Human
uggccuccaaccagcaccc

SEQ ID NO: 915392 - RNA, 22 nt, Human
ugggacuggguuggggacaggc

SEQ ID NO: 915393 - RNA, 24 nt, Human
ugggcagaguggaggggcugcucu

SEQ ID NO: 915394 - RNA, 27 nt, Human
ugggcagcgccuucggggaggacaccc

SEQ ID NO: 915395 - RNA, 23 nt, Human
ugggcagggcgacucgaggacuc

SEQ ID NO: 915396 - RNA, 22 nt, Human
ugggccucagcggggugggcag

SEQ ID NO: 915397 - RNA, 18 nt, Human
uggggccaggaguggcug

SEQ ID NO: 915398 - RNA, 18 nt, Human
uggggccaggaguggcug

SEQ ID NO: 915399 - RNA, 23 nt, Human
uggggcccccggggcucaggucc

SEQ ID NO: 915400 - RNA, 19 nt, Human
ugggguggggacugagggc

SEQ ID NO: 915401 - RNA, 21 nt, Human
ugggguggggacugagggcug

SEQ ID NO: 915402 - RNA, 23 nt, Human
uggguggcagccuggggaagagg

SEQ ID NO: 915403 - RNA, 21 nt, Human
uggugggucuggauuggaggc

SEQ ID NO: 915404 - RNA, 18 nt, Human
uguaacagacaaaacaca

SEQ ID NO: 915405 - RNA, 23 nt, Human
uguccugcacugaggcccccaaa

SEQ ID NO: 915406 - RNA, 19 nt, Human
uguguccucgcuggggacc

SEQ ID NO: 915407 - RNA, 23 nt, Human
uguuugugucuuuuuuguucuuu

SEQ ID NO: 915408 - RNA, 24 nt, Human
uugagaugacaaugccccuguccc

SEQ ID NO: 915409 - RNA, 26 nt, Human
aagccaccucugucccuccaauguuc

SEQ ID NO: 915410 - RNA, 23 nt, Human
acacacacacacacacauauaca

SEQ ID NO: 915411 - RNA, 24 nt, Human
acacacacacacacauauacacag

SEQ ID NO: 915412 - RNA, 22 nt, Human
acacacacacacauauacacaa

SEQ ID NO: 915413 - RNA, 22 nt, Human
acacacucacccccccccaaca

SEQ ID NO: 915414 - RNA, 22 nt, Human
acccccccccaacacacacaca

SEQ ID NO: 915415 - RNA, 21 nt, Human
accccggcccggggaggcagc

SEQ ID NO: 915416 - RNA, 20 nt, Human
augaguacuucacugaguuu

SEQ ID NO: 915417 - RNA, 19 nt, Human
cacacacacacacacauau

SEQ ID NO: 915418 - RNA, 24 nt, Human
cacacgcgcgcacacacucacccc

SEQ ID NO: 915419 - RNA, 22 nt, Human
caccgaagccaccucugucccu

SEQ ID NO: 915420 - RNA, 23 nt, Human
caccgaagccaccucugucccuu

SEQ ID NO: 915421 - RNA, 22 nt, Human
cagacugcgcucggcucgcgcc

SEQ ID NO: 915422 - RNA, 20 nt, Human
cagccgcauccccccggcgg

SEQ ID NO: 915423 - RNA, 27 nt, Human
ccaacacacacacacacacauauacac

SEQ ID NO: 915424 - RNA, 21 nt, Human
cccaacacacacacacacaca

SEQ ID NO: 915425 - RNA, 20 nt, Human
cccccaaaucagucaucuug

SEQ ID NO: 915426 - RNA, 24 nt, Human
cccccaaaucagucaucuuggccu

SEQ ID NO: 915427 - RNA, 31 nt, Human
ccccccccaacacacacacacacacauauag

SEQ ID NO: 915428 - RNA, 19 nt, Human
cccggcgcgccgcgcuccg

SEQ ID NO: 915429 - RNA, 24 nt, Human
cccuccaccgccgugcucccgagg

SEQ ID NO: 915430 - RNA, 19 nt, Human
ccggcgcgcucagccccac

SEQ ID NO: 915431 - RNA, 21 nt, Human
ccucugucccuccaauguuca

SEQ ID NO: 915432 - RNA, 20 nt, Human
cgccgcgcuccgcuccgccc

SEQ ID NO: 915433 - RNA, 19 nt, Human
cgcgcacacacucaccccc

SEQ ID NO: 915434 - RNA, 21 nt, Human
cgcgcacacacucaccccccc

SEQ ID NO: 915435 - RNA, 23 nt, Human
cgcuccgcccgcucggcccggca

SEQ ID NO: 915436 - RNA, 22 nt, Human
cgcucggcccggcagacugcgc

SEQ ID NO: 915437 - RNA, 18 nt, Human
cucggcucgcgccccggc

SEQ ID NO: 915438 - RNA, 25 nt, Human
cuuuuaaaaugcacacgcgcgcaca

SEQ ID NO: 915439 - RNA, 21 nt, Human
gacccgcccucucuacacccc

SEQ ID NO: 915440 - RNA, 21 nt, Human
gcgcacacacucacccccccc

SEQ ID NO: 915441 - RNA, 21 nt, Human
gcgccgcgcuccgcuccgccc

SEQ ID NO: 915442 - RNA, 18 nt, Human
gcgcgcacacacucaccc

SEQ ID NO: 915443 - RNA, 18 nt, Human
gcgcuccgcuccgcccgc

SEQ ID NO: 915444 - RNA, 24 nt, Human
ggccgccuccuauguccccuccac

SEQ ID NO: 915445 - RNA, 20 nt, Human
uaaagcgaguagcccccaaa

SEQ ID NO: 915446 - RNA, 23 nt, Human
uaaagcgaguagcccccaaauca

SEQ ID NO: 915447 - RNA, 23 nt, Human
uacacaaagucagaaauagcuag

SEQ ID NO: 915448 - RNA, 19 nt, Human
ucagccccacucggcucgc

SEQ ID NO: 915449 - RNA, 22 nt, Human
uccaauguucaugucuguccga

SEQ ID NO: 915450 - RNA, 22 nt, Human
uccaccgccgugcucccgaggc

SEQ ID NO: 915451 - RNA, 19 nt, Human
uccccccggcggcggcccc

SEQ ID NO: 915452 - RNA, 19 nt, Human
ucccgaggccggggacccg

SEQ ID NO: 915453 - RNA, 24 nt, Human
ucggcucgcgccccggcccguauc

SEQ ID NO: 915454 - RNA, 20 nt, Human
ucggcucgcuccgcccgcuc

SEQ ID NO: 915455 - RNA, 20 nt, Human
uguaaagcgaguagccccca

SEQ ID NO: 915456 - RNA, 20 nt, Human
uguaaagcgaguagccccca

SEQ ID NO: 915457 - RNA, 18 nt, Human
uuuuuuuuuuuuuuuuug

SEQ ID NO: 915458 - RNA, 20 nt, Human
aaacccgacucugcucccac

SEQ ID NO: 915459 - RNA, 21 nt, Human
aaagcccucccaaacccgacu

SEQ ID NO: 915460 - RNA, 27 nt, Human
aaagcccucccaaacccgacucugcuc

SEQ ID NO: 915461 - RNA, 24 nt, Human
aaauaaccauuuaaacaugagggu

SEQ ID NO: 915462 - RNA, 18 nt, Human
aacccgacucugcuccca

SEQ ID NO: 915463 - RNA, 26 nt, Human
aacccgacucugcucccacccuccca

SEQ ID NO: 915464 - RNA, 21 nt, Human
aagaaggaaauagaucgaggg

SEQ ID NO: 915465 - RNA, 30 nt, Human
acaaaacccaaauaaacccacgaagucauu

SEQ ID NO: 915466 - RNA, 18 nt, Human
acacagcacaucccccuc

SEQ ID NO: 915467 - RNA, 18 nt, Human
acacagcacaucccccuc

SEQ ID NO: 915468 - RNA, 22 nt, Human
acacagcacaucccccuccucu

SEQ ID NO: 915469 - RNA, 19 nt, Human
acacuuuccauacacauua

SEQ ID NO: 915470 - RNA, 21 nt, Human
acagaaacccgccuggccucc

SEQ ID NO: 915471 - RNA, 23 nt, Human
acagcacaucccccuccucuuca

SEQ ID NO: 915472 - RNA, 20 nt, Human
acagcgcacaagccagcggc

SEQ ID NO: 915473 - RNA, 24 nt, Human
acccacgaagucaucucuagcccc

SEQ ID NO: 915474 - RNA, 18 nt, Human
accccauauccagcucuc

SEQ ID NO: 915475 - RNA, 20 nt, Human
acccgacucugcucccaccc

SEQ ID NO: 915476 - RNA, 18 nt, Human
accucccaccccgccccg

SEQ ID NO: 915477 - RNA, 21 nt, Human
agaaacaaaacccaaauaaac

SEQ ID NO: 915478 - RNA, 18 nt, Human
agaaacccgccuggccuc

SEQ ID NO: 915479 - RNA, 19 nt, Human
agaaacccgccuggccucc

SEQ ID NO: 915480 - RNA, 22 nt, Human
agaaccagguguccaagagccc

SEQ ID NO: 915481 - RNA, 19 nt, Human
agacaagagcaaaugcagc

SEQ ID NO: 915482 - RNA, 23 nt, Human
agacaagagcaaaugcagcaggg

SEQ ID NO: 915483 - RNA, 23 nt, Human
agagaagccgguaggaacccgag

SEQ ID NO: 915484 - RNA, 18 nt, Human
agagcccagccgcuuucc

SEQ ID NO: 915485 - RNA, 24 nt, Human
agagcccagccgcuuuccugcccc

SEQ ID NO: 915486 - RNA, 18 nt, Human
agagcggggcaacaagga

SEQ ID NO: 915487 - RNA, 19 nt, Human
agccagcggccucaggccu

SEQ ID NO: 915488 - RNA, 21 nt, Human
agccuggggcuugggugauca

SEQ ID NO: 915489 - RNA, 19 nt, Human
aggaagaaggaaauagauc

SEQ ID NO: 915490 - RNA, 20 nt, Human
aggacccuugugcugggucu

SEQ ID NO: 915491 - RNA, 21 nt, Human
aggagcagauccaaacuucca

SEQ ID NO: 915492 - RNA, 21 nt, Human
aggagcagauccaaacuucca

SEQ ID NO: 915493 - RNA, 22 nt, Human
aggcagguggaacaccugcagg

SEQ ID NO: 915494 - RNA, 23 nt, Human
aggcagguggaacaccugcagga

SEQ ID NO: 915495 - RNA, 19 nt, Human
aggcgucgcuguggaccgc

SEQ ID NO: 915496 - RNA, 20 nt, Human
aggcugaggccaggucaaaa

SEQ ID NO: 915497 - RNA, 18 nt, Human
aggcugcagucucauugc

SEQ ID NO: 915498 - RNA, 22 nt, Human
aggcuggaagacagcuuuccaa

SEQ ID NO: 915499 - RNA, 18 nt, Human
aggggaggagggcugggc

SEQ ID NO: 915500 - RNA, 21 nt, Human
aggggcuaagacagccugggg

SEQ ID NO: 915501 - RNA, 21 nt, Human
aggggcuccccgcccgggccc

SEQ ID NO: 915502 - RNA, 21 nt, Human
auaaacccacgaagucaucuc

SEQ ID NO: 915503 - RNA, 21 nt, Human
auccucauguaacuaggaagc

SEQ ID NO: 915504 - RNA, 19 nt, Human
aucucaucccaaaucccca

SEQ ID NO: 915505 - RNA, 21 nt, Human
caaaacccacaucaagccucc

SEQ ID NO: 915506 - RNA, 24 nt, Human
caaaacccacaucaagccuccaaa

SEQ ID NO: 915507 - RNA, 18 nt, Human
caccacacucuaagaugg

SEQ ID NO: 915508 - RNA, 24 nt, Human
cacccccgcucccucaccgcgcca

SEQ ID NO: 915509 - RNA, 19 nt, Human
cacccucccaucuagccca

SEQ ID NO: 915510 - RNA, 20 nt, Human
cacccucccaucuagcccaa

SEQ ID NO: 915511 - RNA, 21 nt, Human
cacccuucucccuaacucccg

SEQ ID NO: 915512 - RNA, 21 nt, Human
caccgcaaccuccgccuccug

SEQ ID NO: 915513 - RNA, 21 nt, Human
caccucacguuuggacaccac

SEQ ID NO: 915514 - RNA, 19 nt, Human
cacgccccgcccucccgcc

SEQ ID NO: 915515 - RNA, 19 nt, Human
cacuccuuccaaaaaagcc

SEQ ID NO: 915516 - RNA, 23 nt, Human
cagaaacaaaacccaaauaaacc

SEQ ID NO: 915517 - RNA, 20 nt, Human
cagccgcuuuccugccccuc

SEQ ID NO: 915518 - RNA, 19 nt, Human
cagcggccgccccgcccgc

SEQ ID NO: 915519 - RNA, 18 nt, Human
cagcggccucaggccucc

SEQ ID NO: 915520 - RNA, 18 nt, Human
caggaagccacuccuucc

SEQ ID NO: 915521 - RNA, 22 nt, Human
caggucaaaacccacaucaagc

SEQ ID NO: 915522 - RNA, 19 nt, Human
caucccggagcuuaacgag

SEQ ID NO: 915523 - RNA, 18 nt, Human
cauucaaaaugguuucac

SEQ ID NO: 915524 - RNA, 19 nt, Human
ccagcggccucaggccucc

SEQ ID NO: 915525 - RNA, 18 nt, Human
ccaggguuuggcucuuuc

SEQ ID NO: 915526 - RNA, 21 nt, Human
ccauaucucaucccaaauccc

SEQ ID NO: 915527 - RNA, 20 nt, Human
ccauuuaaacaugagggucc

SEQ ID NO: 915528 - RNA, 18 nt, Human
cccaaauaaacccacgaa

SEQ ID NO: 915529 - RNA, 25 nt, Human
cccaaggcugaggccaggucaaaac

SEQ ID NO: 915530 - RNA, 21 nt, Human
cccacccucccaucuagccca

SEQ ID NO: 915531 - RNA, 21 nt, Human
cccaucugccucuuccagaag

SEQ ID NO: 915532 - RNA, 21 nt, Human
cccaucugccucuuccagaag

SEQ ID NO: 915533 - RNA, 18 nt, Human
ccccacgccccgcccucc

SEQ ID NO: 915534 - RNA, 18 nt, Human
cccccaaugcagaacaac

SEQ ID NO: 915535 - RNA, 24 nt, Human
cccccggaccgauccccacccccg

SEQ ID NO: 915536 - RNA, 21 nt, Human
ccccgcccgccccuccucccc

SEQ ID NO: 915537 - RNA, 20 nt, Human
ccccgcucccucaccgcgcc

SEQ ID NO: 915538 - RNA, 21 nt, Human
ccccgcucccucaccgcgcca

SEQ ID NO: 915539 - RNA, 18 nt, Human
ccccggggagcccgccgg

SEQ ID NO: 915540 - RNA, 21 nt, Human
ccccgugccggagccggaagg

SEQ ID NO: 915541 - RNA, 18 nt, Human
ccccuuccuggggccaag

SEQ ID NO: 915542 - RNA, 18 nt, Human
ccccuuccuggggccaag

SEQ ID NO: 915543 - RNA, 22 nt, Human
ccccuuccuggggccaaggcag

SEQ ID NO: 915544 - RNA, 22 nt, Human
ccccuuccuggggccaaggcag

SEQ ID NO: 915545 - RNA, 23 nt, Human
cccgacucugcucccacccuccc

SEQ ID NO: 915546 - RNA, 25 nt, Human
cccgauccccgaccccauauccagc

SEQ ID NO: 915547 - RNA, 21 nt, Human
cccggggcggcggcggcggcg

SEQ ID NO: 915548 - RNA, 20 nt, Human
cccgugccggagccggaagg

SEQ ID NO: 915549 - RNA, 21 nt, Human
cccgugccggagccggaaggg

SEQ ID NO: 915550 - RNA, 27 nt, Human
cccucccaaacccgacucugcucccac

SEQ ID NO: 915551 - RNA, 22 nt, Human
cccucccgccccgccccgggga

SEQ ID NO: 915552 - RNA, 19 nt, Human
cccugcaguccccuggccc

SEQ ID NO: 915553 - RNA, 21 nt, Human
cccuggccccguccuccccgu

SEQ ID NO: 915554 - RNA, 22 nt, Human
ccgacucugcucccacccuccc

SEQ ID NO: 915555 - RNA, 24 nt, Human
ccgauccccacccccgcucccuca

SEQ ID NO: 915556 - RNA, 24 nt, Human
ccgauccccgaccccauauccagc

SEQ ID NO: 915557 - RNA, 18 nt, Human
ccgcaaccuccgccuccu

SEQ ID NO: 915558 - RNA, 22 nt, Human
ccgcaaccuccgccuccugggu

SEQ ID NO: 915559 - RNA, 23 nt, Human
ccgcccgccccuccuccccgggc

SEQ ID NO: 915560 - RNA, 21 nt, Human
ccgcccgggccccccaacgcc

SEQ ID NO: 915561 - RNA, 19 nt, Human
ccgcuccgcaccccgcccc

SEQ ID NO: 915562 - RNA, 22 nt, Human
ccgggccugacagaaacccgcc

SEQ ID NO: 915563 - RNA, 21 nt, Human
ccggggcggcggcggcggcuu

SEQ ID NO: 915564 - RNA, 19 nt, Human
ccuaacucccgauccccga

SEQ ID NO: 915565 - RNA, 21 nt, Human
ccucccaucuagcccaaauac

SEQ ID NO: 915566 - RNA, 22 nt, Human
ccuccccgggccugacagaaac

SEQ ID NO: 915567 - RNA, 21 nt, Human
ccuccccgggccugacagaac

SEQ ID NO: 915568 - RNA, 20 nt, Human
ccucccgccccgccccgggg

SEQ ID NO: 915569 - RNA, 21 nt, Human
ccuccgaacgccucggggccc

SEQ ID NO: 915570 - RNA, 19 nt, Human
ccucggggccccgugccgg

SEQ ID NO: 915571 - RNA, 26 nt, Human
ccugcaguccccuggccccguccucc

SEQ ID NO: 915572 - RNA, 18 nt, Human
ccuggccccguccucccc

SEQ ID NO: 915573 - RNA, 23 nt, Human
ccuggggccaaggcagugguuug

SEQ ID NO: 915574 - RNA, 23 nt, Human
ccuggggccaaggcagugguuug

SEQ ID NO: 915575 - RNA, 21 nt, Human
ccugguugagggggugagaag

SEQ ID NO: 915576 - RNA, 25 nt, Human
ccuugugcugggucuacuggguauc

SEQ ID NO: 915577 - RNA, 19 nt, Human
cgaccccauauccagcucu

SEQ ID NO: 915578 - RNA, 27 nt, Human
cgccauggucgcgcccgucccguuacc

SEQ ID NO: 915579 - RNA, 27 nt, Human
cgccccgcccgccccuccuccccgggc

SEQ ID NO: 915580 - RNA, 19 nt, Human
cggaaggggaggagggcug

SEQ ID NO: 915581 - RNA, 19 nt, Human
cggaccgauccccaccccc

SEQ ID NO: 915582 - RNA, 20 nt, Human
cggcuagaaguaagagugcc

SEQ ID NO: 915583 - RNA, 21 nt, Human
cggggccccgugccggagccg

SEQ ID NO: 915584 - RNA, 25 nt, Human
cuaacucccgauccccgaccccaua

SEQ ID NO: 915585 - RNA, 24 nt, Human
cuacaagucugaccauaucucauc

SEQ ID NO: 915586 - RNA, 22 nt, Human
cuagccccaagguaucuuaaaa

SEQ ID NO: 915587 - RNA, 23 nt, Human
cuagccccaagguaucuuaaaag

SEQ ID NO: 915588 - RNA, 23 nt, Human
cucauugcuaaagcccucccaaa

SEQ ID NO: 915589 - RNA, 23 nt, Human
cuccaaacuggauuuccuggauc

SEQ ID NO: 915590 - RNA, 19 nt, Human
cucccaaacccgacucugc

SEQ ID NO: 915591 - RNA, 22 nt, Human
cucccacccucccaucuagccc

SEQ ID NO: 915592 - RNA, 22 nt, Human
cucccccggaccgauccccacc

SEQ ID NO: 915593 - RNA, 19 nt, Human
cugccccucaccaucccau

SEQ ID NO: 915594 - RNA, 26 nt, Human
cuggggcuugggugaucaucacaggg

SEQ ID NO: 915595 - RNA, 19 nt, Human
cuucagagaugcugcgccu

SEQ ID NO: 915596 - RNA, 19 nt, Human
cuucagagaugcugcgccu

SEQ ID NO: 915597 - RNA, 21 nt, Human
cuugcuggcuguaacucucca

SEQ ID NO: 915598 - RNA, 18 nt, Human
cuuugggguuaucuacaa

SEQ ID NO: 915599 - RNA, 21 nt, Human
gaaggcagguggaacaccugc

SEQ ID NO: 915600 - RNA, 20 nt, Human
gaaggggaggagggcugggc

SEQ ID NO: 915601 - RNA, 18 nt, Human
gacaagagcaaaugcagc

SEQ ID NO: 915602 - RNA, 20 nt, Human
gacaagagcaaaugcagcag

SEQ ID NO: 915603 - RNA, 19 nt, Human
gaccccauauccagcucuc

SEQ ID NO: 915604 - RNA, 19 nt, Human
gagcagauccaaacuucca

SEQ ID NO: 915605 - RNA, 19 nt, Human
gagcagauccaaacuucca

SEQ ID NO: 915606 - RNA, 27 nt, Human
gagcaggugcacacacagcacaucccc

SEQ ID NO: 915607 - RNA, 20 nt, Human
gaggcugcuggaagacagcu

SEQ ID NO: 915608 - RNA, 19 nt, Human
gaggcuggaagacagcuuu

SEQ ID NO: 915609 - RNA, 18 nt, Human
gaggugucucugcuaaaa

SEQ ID NO: 915610 - RNA, 19 nt, Human
gaucucugauucugaucug

SEQ ID NO: 915611 - RNA, 21 nt, Human
gaucugcuaaaagucuagagc

SEQ ID NO: 915612 - RNA, 18 nt, Human
gcaccuugcuggcuguaa

SEQ ID NO: 915613 - RNA, 21 nt, Human
gcagcagggcgaggugucuga

SEQ ID NO: 915614 - RNA, 20 nt, Human
gcagcggccgccccgcccgc

SEQ ID NO: 915615 - RNA, 23 nt, Human
gccaccucacguuuggacaccac

SEQ ID NO: 915616 - RNA, 23 nt, Human
gccagcggccucaggccuccccc

SEQ ID NO: 915617 - RNA, 27 nt, Human
gccccggggagcccgccggcccgcuuc

SEQ ID NO: 915618 - RNA, 22 nt, Human
gcccgccccuccuccccgggcc

SEQ ID NO: 915619 - RNA, 26 nt, Human
gcccggggcggcggcggcggcggcga

SEQ ID NO: 915620 - RNA, 19 nt, Human
gccgccccgcccgccccuc

SEQ ID NO: 915621 - RNA, 18 nt, Human
gccugggaggaggucaga

SEQ ID NO: 915622 - RNA, 19 nt, Human
gcggcggcgaaagaggggg

SEQ ID NO: 915623 - RNA, 18 nt, Human
gcggcggcggcgaaagag

SEQ ID NO: 915624 - RNA, 20 nt, Human
gcggcggcggcgaaagaggg

SEQ ID NO: 915625 - RNA, 22 nt, Human
gcggcggcggcgaaagaggggg

SEQ ID NO: 915626 - RNA, 24 nt, Human
gcggcggcggcgaaagaggggggc

SEQ ID NO: 915627 - RNA, 26 nt, Human
gcggcggcggcgaaagaggggggcgg

SEQ ID NO: 915628 - RNA, 20 nt, Human
gcggggcaacaaggaaaaag

SEQ ID NO: 915629 - RNA, 23 nt, Human
gcuuccuuuuuuuuuuuuuauuu

SEQ ID NO: 915630 - RNA, 24 nt, Human
ggagacagaucuccuacaagguca

SEQ ID NO: 915631 - RNA, 26 nt, Human
ggaggcaggcuuuacagagaggacuu

SEQ ID NO: 915632 - RNA, 18 nt, Human
ggcaggcuccgaaggcag

SEQ ID NO: 915633 - RNA, 20 nt, Human
ggcggcggcggcgaaagagg

SEQ ID NO: 915634 - RNA, 19 nt, Human
ggcuaagacagccuggggc

SEQ ID NO: 915635 - RNA, 18 nt, Human
ggcuccccgcccgggccc

SEQ ID NO: 915636 - RNA, 21 nt, Human
ggcuuggccagguuuggaggc

SEQ ID NO: 915637 - RNA, 26 nt, Human
gggaaccccuuuuuaaccuggguguc

SEQ ID NO: 915638 - RNA, 19 nt, Human
gggaggagggcugggcagg

SEQ ID NO: 915639 - RNA, 20 nt, Human
gggcggugcagccgcccugc

SEQ ID NO: 915640 - RNA, 19 nt, Human
ggggcggcggcggcggcgg

SEQ ID NO: 915641 - RNA, 20 nt, Human
ggggcggcggcggcggcggc

SEQ ID NO: 915642 - RNA, 22 nt, Human
gggggcaccuugcuggcuguaa

SEQ ID NO: 915643 - RNA, 18 nt, Human
gggucuacuggguaucuc

SEQ ID NO: 915644 - RNA, 18 nt, Human
gguaagcagaaggugggg

SEQ ID NO: 915645 - RNA, 22 nt, Human
gguuacaagguaccaaaaaggg

SEQ ID NO: 915646 - RNA, 21 nt, Human
guaggcugaugaaauaugauu

SEQ ID NO: 915647 - RNA, 18 nt, Human
guccaagagcccagccgc

SEQ ID NO: 915648 - RNA, 24 nt, Human
gucgcuguggaccgcgggaggggc

SEQ ID NO: 915649 - RNA, 24 nt, Human
guggcaggcuccgaaggcaggugg

SEQ ID NO: 915650 - RNA, 20 nt, Human
guggcucaguucugagggcc

SEQ ID NO: 915651 - RNA, 21 nt, Human
uaaagcccucccaaacccgac

SEQ ID NO: 915652 - RNA, 25 nt, Human
uaacauguugcccaagcuggagggu

SEQ ID NO: 915653 - RNA, 23 nt, Human
uaacgaggugucucugcuaaaaa

SEQ ID NO: 915654 - RNA, 21 nt, Human
uaacucccgauccccgacccc

SEQ ID NO: 915655 - RNA, 23 nt, Human
uaagaauguguuacacuuuccau

SEQ ID NO: 915656 - RNA, 21 nt, Human
uaagacagccuggggcuuggg

SEQ ID NO: 915657 - RNA, 23 nt, Human
uacacccuucucccuaacucccg

SEQ ID NO: 915658 - RNA, 22 nt, Human
uacuggguaucucuuuaauuga

SEQ ID NO: 915659 - RNA, 22 nt, Human
uauggccccuuccuggggccaa

SEQ ID NO: 915660 - RNA, 22 nt, Human
uauggccccuuccuggggccaa

SEQ ID NO: 915661 - RNA, 23 nt, Human
uauuccagacaggauggaggaau

SEQ ID NO: 915662 - RNA, 24 nt, Human
ucaccgcaaccuccgccuccuggg

SEQ ID NO: 915663 - RNA, 25 nt, Human
ucaccgcaaccuccgccuccugggu

SEQ ID NO: 915664 - RNA, 20 nt, Human
ucagcaaagauggggagggu

SEQ ID NO: 915665 - RNA, 24 nt, Human
ucauaacauguugcccaagcugga

SEQ ID NO: 915666 - RNA, 21 nt, Human
uccaaacuuccauucuucauu

SEQ ID NO: 915667 - RNA, 21 nt, Human
uccaaacuuccauucuucauu

SEQ ID NO: 915668 - RNA, 18 nt, Human
uccaagagcccagccgcu

SEQ ID NO: 915669 - RNA, 21 nt, Human
uccagacaggauggaggaaua

SEQ ID NO: 915670 - RNA, 20 nt, Human
uccagcagccccagugaagu

SEQ ID NO: 915671 - RNA, 20 nt, Human
uccagcagccccagugaagu

SEQ ID NO: 915672 - RNA, 22 nt, Human
uccauaaauuacaaaguuaauc

SEQ ID NO: 915673 - RNA, 23 nt, Human
uccauacacauuauggcaacaug

SEQ ID NO: 915674 - RNA, 23 nt, Human
uccauagcacuugguucuggaag

SEQ ID NO: 915675 - RNA, 18 nt, Human
ucccaaagggaaauaacc

SEQ ID NO: 915676 - RNA, 23 nt, Human
uccccacccccgcucccucaccc

SEQ ID NO: 915677 - RNA, 18 nt, Human
ucccccggaccgaucccc

SEQ ID NO: 915678 - RNA, 21 nt, Human
ucccccuccucuucagcuaaa

SEQ ID NO: 915679 - RNA, 22 nt, Human
uccccgcccgggccccccaacg

SEQ ID NO: 915680 - RNA, 20 nt, Human
uccccgggccugacagaaac

SEQ ID NO: 915681 - RNA, 18 nt, Human
ucccgccccgccccgggg

SEQ ID NO: 915682 - RNA, 23 nt, Human
uccuggccagagcagccuguggc

SEQ ID NO: 915683 - RNA, 22 nt, Human
ucgcuguggaccgcgggagggg

SEQ ID NO: 915684 - RNA, 19 nt, Human
ucugaaguuuucccaaagg

SEQ ID NO: 915685 - RNA, 24 nt, Human
ucugccucuuccagaagguuuccc

SEQ ID NO: 915686 - RNA, 24 nt, Human
ucugccucuuccagaagguuuccc

SEQ ID NO: 915687 - RNA, 20 nt, Human
ugaaauuucagaaacaaaac

SEQ ID NO: 915688 - RNA, 25 nt, Human
ugaccauaucucaucccaaaucccc

SEQ ID NO: 915689 - RNA, 19 nt, Human
ugagaagaugcaggaaugu

SEQ ID NO: 915690 - RNA, 29 nt, Human
ugagaucucugguguugaccugguguauu

SEQ ID NO: 915691 - RNA, 19 nt, Human
ugaggccaggucaaaaccc

SEQ ID NO: 915692 - RNA, 22 nt, Human
ugaggccaggucaaaacccaca

SEQ ID NO: 915693 - RNA, 18 nt, Human
ugagucaggcacagagac

SEQ ID NO: 915694 - RNA, 18 nt, Human
ugagucaggcacagagac

SEQ ID NO: 915695 - RNA, 23 nt, Human
ugcggcaguuguucagaccuacc

SEQ ID NO: 915696 - RNA, 19 nt, Human
uggauuuccuggaucacau

SEQ ID NO: 915697 - RNA, 22 nt, Human
uggcucaguucugagggccugg

SEQ ID NO: 915698 - RNA, 23 nt, Human
uggcucaguucugagggccuggg

SEQ ID NO: 915699 - RNA, 21 nt, Human
uggcuguaacucuccaggcac

SEQ ID NO: 915700 - RNA, 18 nt, Human
ugggaggaggucagaagg

SEQ ID NO: 915701 - RNA, 23 nt, Human
ugggaggaggucagaaggaagaa

SEQ ID NO: 915702 - RNA, 22 nt, Human
uggggagaaaaaaucaagggua

SEQ ID NO: 915703 - RNA, 21 nt, Human
ugggugaucaucacaggguuc

SEQ ID NO: 915704 - RNA, 23 nt, Human
uguaccucccccaaugcagaaca

SEQ ID NO: 915705 - RNA, 18 nt, Human
ugucacaggcugcagucu

SEQ ID NO: 915706 - RNA, 18 nt, Human
uguccaagagcccagccg

SEQ ID NO: 915707 - RNA, 19 nt, Human
ugugcacaauacuccauaa

SEQ ID NO: 915708 - RNA, 18 nt, Human
uuccaaaaaagccugugg

SEQ ID NO: 915709 - RNA, 21 nt, Human
uuccugguugagggggugaga

SEQ ID NO: 915710 - RNA, 25 nt, Human
uuccugguugagggggugggguucc

SEQ ID NO: 915711 - RNA, 29 nt, Human
uuccuuuuuuuuuuuuuauuuuuugagaa

SEQ ID NO: 915712 - RNA, 24 nt, Human
uugcggcaguuguucagaccuacc

SEQ ID NO: 915713 - RNA, 24 nt, Human
uugguucuggaaggacccuugugc

SEQ ID NO: 915714 - RNA, 25 nt, Human
uuuuuuauuuuuugagauggaguuu

SEQ ID NO: 915715 - RNA, 30 nt, Human
uuuuuuuuuuugcuuccuuuuuuuuuuuuu

SEQ ID NO: 915716 - RNA, 22 nt, Human
uuuuuuuuuuuuuuugcuuccu

SEQ ID NO: 915717 - RNA, 19 nt, Human
uuuuuuuuuuuuuuuugcu

SEQ ID NO: 915718 - RNA, 18 nt, Human
uuuuuuuuuuuuuuuuug

SEQ ID NO: 915719 - RNA, 21 nt, Human
uuuuuuuuuuuuuuuuugcuu

SEQ ID NO: 915720 - RNA, 21 nt, Human
aagaauggggggucugggugg

SEQ ID NO: 915721 - RNA, 28 nt, Human
acacaucuucagggauggagggaacgcc

SEQ ID NO: 915722 - RNA, 25 nt, Human
acacaucuuggccccaaaaggacuc

SEQ ID NO: 915723 - RNA, 22 nt, Human
agcacagagagccuggcuccgg

SEQ ID NO: 915724 - RNA, 25 nt, Human
aggaagaauggggggucuggguggc

SEQ ID NO: 915725 - RNA, 19 nt, Human
aggacuccaggugacagca

SEQ ID NO: 915726 - RNA, 19 nt, Human
aggcugggggcccuccucg

SEQ ID NO: 915727 - RNA, 18 nt, Human
agggagggugguaggcag

SEQ ID NO: 915728 - RNA, 26 nt, Human
agggccugugaguggggaggagagcu

SEQ ID NO: 915729 - RNA, 23 nt, Human
agggcuuugggaagagaguuuga

SEQ ID NO: 915730 - RNA, 20 nt, Human
agggggccaggggccuuuau

SEQ ID NO: 915731 - RNA, 19 nt, Human
aguugaggguuuauugcca

SEQ ID NO: 915732 - RNA, 18 nt, Human
auccacagcagccgucag

SEQ ID NO: 915733 - RNA, 19 nt, Human
auuccaaaugagcacugca

SEQ ID NO: 915734 - RNA, 24 nt, Human
caacaagcccucucucaagggggc

SEQ ID NO: 915735 - RNA, 18 nt, Human
caaggcaagggauccucc

SEQ ID NO: 915736 - RNA, 19 nt, Human
cacagagagccuggcuccg

SEQ ID NO: 915737 - RNA, 21 nt, Human
cacagcagccgucagccgggc

SEQ ID NO: 915738 - RNA, 24 nt, Human
cacaucuuggccccaaaaggacuc

SEQ ID NO: 915739 - RNA, 21 nt, Human
caccaacaagcccucucucaa

SEQ ID NO: 915740 - RNA, 18 nt, Human
caccccuggccagcccuc

SEQ ID NO: 915741 - RNA, 20 nt, Human
cacggccccacuucuccccg

SEQ ID NO: 915742 - RNA, 20 nt, Human
cagcagcucugggcucccag

SEQ ID NO: 915743 - RNA, 26 nt, Human
caucuuggccccaaaaggacuccagg

SEQ ID NO: 915744 - RNA, 18 nt, Human
ccaggcuucugagggaag

SEQ ID NO: 915745 - RNA, 18 nt, Human
ccccacaggaggggagcc

SEQ ID NO: 915746 - RNA, 21 nt, Human
cccccaguuuuacucacagac

SEQ ID NO: 915747 - RNA, 18 nt, Human
ccccccugccacccagga

SEQ ID NO: 915748 - RNA, 19 nt, Human
ccccucauccugggcauuu

SEQ ID NO: 915749 - RNA, 21 nt, Human
cccugccacccaggaggcccc

SEQ ID NO: 915750 - RNA, 21 nt, Human
cccuggccagcccucccucga

SEQ ID NO: 915751 - RNA, 19 nt, Human
cccuggggccggggguggg

SEQ ID NO: 915752 - RNA, 23 nt, Human
ccucaccaacaagcccucucuca

SEQ ID NO: 915753 - RNA, 20 nt, Human
ccuccuuccuggccuccugg

SEQ ID NO: 915754 - RNA, 22 nt, Human
ccuccuuccuggccuccugggc

SEQ ID NO: 915755 - RNA, 21 nt, Human
ccucucucaagggggccaggg

SEQ ID NO: 915756 - RNA, 23 nt, Human
ccuuccuggccuccugggccagg

SEQ ID NO: 915757 - RNA, 21 nt, Human
cgaccccgggugcacacacau

SEQ ID NO: 915758 - RNA, 18 nt, Human
cggcauccacagcagccg

SEQ ID NO: 915759 - RNA, 19 nt, Human
cucaccccugccugggagu

SEQ ID NO: 915760 - RNA, 23 nt, Human
cuccuuccuggccuccugggcca

SEQ ID NO: 915761 - RNA, 20 nt, Human
cugccccccugccacccagg

SEQ ID NO: 915762 - RNA, 21 nt, Human
cugcugccccccugccaccca

SEQ ID NO: 915763 - RNA, 23 nt, Human
cugcugccccccugccacccagg

SEQ ID NO: 915764 - RNA, 22 nt, Human
cuguuagggcuuugggaagaga

SEQ ID NO: 915765 - RNA, 21 nt, Human
gagcugcugccccccugccac

SEQ ID NO: 915766 - RNA, 23 nt, Human
gagcugcugccccccugccaccc

SEQ ID NO: 915767 - RNA, 18 nt, Human
gauccccucauccugggc

SEQ ID NO: 915768 - RNA, 22 nt, Human
gccagucucccaggcugggggc

SEQ ID NO: 915769 - RNA, 23 nt, Human
gcuguggcgggggaccucagcca

SEQ ID NO: 915770 - RNA, 22 nt, Human
ggaggcagacagggcccuccuu

SEQ ID NO: 915771 - RNA, 18 nt, Human
ggcccuggggccgggggu

SEQ ID NO: 915772 - RNA, 25 nt, Human
ggcugggggcccuccucgugggugc

SEQ ID NO: 915773 - RNA, 19 nt, Human
gggcuuugggaagagaguu

SEQ ID NO: 915774 - RNA, 18 nt, Human
ggggucuggguggccagg

SEQ ID NO: 915775 - RNA, 24 nt, Human
ggucuggguggccaggggucuugg

SEQ ID NO: 915776 - RNA, 23 nt, Human
gucacugauccccucauccuggg

SEQ ID NO: 915777 - RNA, 25 nt, Human
gucagcccucaccaacaagcccucu

SEQ ID NO: 915778 - RNA, 19 nt, Human
gucccaccccuggccagcc

SEQ ID NO: 915779 - RNA, 21 nt, Human
uacccugcggucuuggggcac

SEQ ID NO: 915780 - RNA, 22 nt, Human
uaggaagaauggggggucuggg

SEQ ID NO: 915781 - RNA, 18 nt, Human
uaggcagggggugcaccc

SEQ ID NO: 915782 - RNA, 23 nt, Human
uauuccucaugggacaggcuggc

SEQ ID NO: 915783 - RNA, 18 nt, Human
ucagcagcucugggcucc

SEQ ID NO: 915784 - RNA, 21 nt, Human
ucagcccucaccaacaagccc

SEQ ID NO: 915785 - RNA, 23 nt, Human
ucagccgggcauggcccagagca

SEQ ID NO: 915786 - RNA, 25 nt, Human
ucagggauggaugcaauaagagcca

SEQ ID NO: 915787 - RNA, 18 nt, Human
ucaugggacaggcugggc

SEQ ID NO: 915788 - RNA, 22 nt, Human
ucccaggcugggggcccuccuc

SEQ ID NO: 915789 - RNA, 20 nt, Human
uccuagacagucacugaucc

SEQ ID NO: 915790 - RNA, 21 nt, Human
uccucaugggacaggcugggc

SEQ ID NO: 915791 - RNA, 22 nt, Human
uccugacugcuaguggugccuu

SEQ ID NO: 915792 - RNA, 18 nt, Human
uccugggcauuugagccc

SEQ ID NO: 915793 - RNA, 21 nt, Human
uccugggcauuugagccccca

SEQ ID NO: 915794 - RNA, 20 nt, Human
uccuuccuggccuccugggc

SEQ ID NO: 915795 - RNA, 21 nt, Human
ucgugggugccccggacgugu

SEQ ID NO: 915796 - RNA, 23 nt, Human
ucucccaggcugggggcccuccu

SEQ ID NO: 915797 - RNA, 22 nt, Human
ucuggguggccaggggucuugg

SEQ ID NO: 915798 - RNA, 22 nt, Human
ugacagcaacagccacacaucu

SEQ ID NO: 915799 - RNA, 21 nt, Human
ugaguggggaggagagcugcu

SEQ ID NO: 915800 - RNA, 18 nt, Human
ugccaguguuaggaagaa

SEQ ID NO: 915801 - RNA, 19 nt, Human
ugccaguguuaggaagaau

SEQ ID NO: 915802 - RNA, 18 nt, Human
ugccugggagugaauggc

SEQ ID NO: 915803 - RNA, 25 nt, Human
uggaugcaauaagagccacaccucg

SEQ ID NO: 915804 - RNA, 25 nt, Human
ugggaagagaguuugacguggaggc

SEQ ID NO: 915805 - RNA, 21 nt, Human
ugggagugaauggccacgacc

SEQ ID NO: 915806 - RNA, 18 nt, Human
ugggcccuggggccgggg

SEQ ID NO: 915807 - RNA, 21 nt, Human
uggggaggagagcugcugccc

SEQ ID NO: 915808 - RNA, 27 nt, Human
ugggggcccuccucguggggggacacc

SEQ ID NO: 915809 - RNA, 23 nt, Human
uggguggccaggggucuugggag

SEQ ID NO: 915810 - RNA, 23 nt, Human
ugguaggcagggggugcacccag

SEQ ID NO: 915811 - RNA, 25 nt, Human
ugguaggcagggggugcacccagag

SEQ ID NO: 915812 - RNA, 21 nt, Human
uuuuauguggugggcccuggg

SEQ ID NO: 915813 - RNA, 23 nt, Human
caaaauucuaggacacaucaaga

SEQ ID NO: 915814 - RNA, 21 nt, Human
caccuggagccuuagcggcgg

SEQ ID NO: 915815 - RNA, 22 nt, Human
ccgccgggagcgagugcaggga

SEQ ID NO: 915816 - RNA, 21 nt, Human
cgcgaagagccgccgggagcg

SEQ ID NO: 915817 - RNA, 20 nt, Human
cuaguggaccccugcaggag

SEQ ID NO: 915818 - RNA, 19 nt, Human
gaggauggagggcuagugg

SEQ ID NO: 915819 - RNA, 18 nt, Human
gcaccuggagccuuagcg

SEQ ID NO: 915820 - RNA, 24 nt, Human
guccagucgccucaccgugacuca

SEQ ID NO: 915821 - RNA, 19 nt, Human
uaagagaguguggguccag

SEQ ID NO: 915822 - RNA, 18 nt, Human
uacaaaaaccauguuauc

SEQ ID NO: 915823 - RNA, 26 nt, Human
uacauuuauuguuacaaaaaccaugu

SEQ ID NO: 915824 - RNA, 18 nt, Human
uagaaauggaaugccuuc

SEQ ID NO: 915825 - RNA, 22 nt, Human
uggaaugccuucaauggcucaa

SEQ ID NO: 915826 - RNA, 21 nt, Human
uggaccccugcaggagcccca

SEQ ID NO: 915827 - RNA, 19 nt, Human
uggcaaaauucuaggacac

SEQ ID NO: 915828 - RNA, 19 nt, Human
uguagaggauggagggcua

SEQ ID NO: 915829 - RNA, 21 nt, Human
ugugccaggaaauauccuaca

SEQ ID NO: 915830 - RNA, 22 nt, Human
uuuuuuuuuuuuuaaagaaaca

SEQ ID NO: 915831 - RNA, 23 nt, Human
aaaaaacaaaaggggccaacaga

SEQ ID NO: 915832 - RNA, 25 nt, Human
aaaaaacaaaaggggccaacagaaa

SEQ ID NO: 915833 - RNA, 25 nt, Human
aaaaacgacaaccgagaccaacuga

SEQ ID NO: 915834 - RNA, 23 nt, Human
aaaacaaaaggggccaacagaaa

SEQ ID NO: 915835 - RNA, 21 nt, Human
aaacaaaaggggccaacagaa

SEQ ID NO: 915836 - RNA, 20 nt, Human
aaacaagcgccgagaccagg

SEQ ID NO: 915837 - RNA, 23 nt, Human
aagcaguugucacgaaggcugug

SEQ ID NO: 915838 - RNA, 19 nt, Human
aagcgccgagaccagggug

SEQ ID NO: 915839 - RNA, 18 nt, Human
accucuugucugcaccuc

SEQ ID NO: 915840 - RNA, 21 nt, Human
accuggauggccucaugggcc

SEQ ID NO: 915841 - RNA, 20 nt, Human
acucgaucacucccuuuguu

SEQ ID NO: 915842 - RNA, 24 nt, Human
agaaaacagcucaggugauggggg

SEQ ID NO: 915843 - RNA, 21 nt, Human
agagcaggaugaggugaaugu

SEQ ID NO: 915844 - RNA, 19 nt, Human
agcagccauaaucaggaaa

SEQ ID NO: 915845 - RNA, 19 nt, Human
agccacaagcacaaagacu

SEQ ID NO: 915846 - RNA, 18 nt, Human
agcugggccuacuaccug

SEQ ID NO: 915847 - RNA, 22 nt, Human
aggaacgggauagguugagggg

SEQ ID NO: 915848 - RNA, 21 nt, Human
aggaacucucccauuucccca

SEQ ID NO: 915849 - RNA, 22 nt, Human
aggagcagcaagaaaaaacgac

SEQ ID NO: 915850 - RNA, 25 nt, Human
aggggccaacagaaaacagcucagg

SEQ ID NO: 915851 - RNA, 21 nt, Human
agguugaggggcaugaugggg

SEQ ID NO: 915852 - RNA, 18 nt, Human
aguugaaaaaauucaaug

SEQ ID NO: 915853 - RNA, 23 nt, Human
augggccucccucuugaaaagac

SEQ ID NO: 915854 - RNA, 25 nt, Human
caacagaaaacagcucaggugaugg

SEQ ID NO: 915855 - RNA, 22 nt, Human
caacaugaaaucuggcccuguc

SEQ ID NO: 915856 - RNA, 21 nt, Human
caaccacgcugaggcaggccc

SEQ ID NO: 915857 - RNA, 18 nt, Human
caagacagacccugaauc

SEQ ID NO: 915858 - RNA, 18 nt, Human
caaggguccucugccucc

SEQ ID NO: 915859 - RNA, 22 nt, Human
caaggguccucugccuccaaga

SEQ ID NO: 915860 - RNA, 19 nt, Human
caauagcagcaacuuuccc

SEQ ID NO: 915861 - RNA, 26 nt, Human
caaugaugucucuccugcaggagaaa

SEQ ID NO: 915862 - RNA, 18 nt, Human
cacaagcacaaagacugc

SEQ ID NO: 915863 - RNA, 20 nt, Human
cacagcauccccagggucaa

SEQ ID NO: 915864 - RNA, 21 nt, Human
cacagcauccccagggucaac

SEQ ID NO: 915865 - RNA, 19 nt, Human
cacccugugcagcaggagc

SEQ ID NO: 915866 - RNA, 22 nt, Human
caccgucugucccucucagagc

SEQ ID NO: 915867 - RNA, 19 nt, Human
caccucuugucugcaccuc

SEQ ID NO: 915868 - RNA, 20 nt, Human
cacucccuuuguuuuccucu

SEQ ID NO: 915869 - RNA, 19 nt, Human
cagaagacacuagcagagu

SEQ ID NO: 915870 - RNA, 19 nt, Human
cagaagucucccacuuuuc

SEQ ID NO: 915871 - RNA, 23 nt, Human
cagcaagaaaaaacgacaaccga

SEQ ID NO: 915872 - RNA, 23 nt, Human
cagcaggagcguuaaggccaaaa

SEQ ID NO: 915873 - RNA, 21 nt, Human
cagguggcuccagcuuccccu

SEQ ID NO: 915874 - RNA, 23 nt, Human
cagugauugauuggucuugccug

SEQ ID NO: 915875 - RNA, 22 nt, Human
cauuuccccagcugggccuacu

SEQ ID NO: 915876 - RNA, 21 nt, Human
ccaaggguccucugccuccaa

SEQ ID NO: 915877 - RNA, 20 nt, Human
ccaccaaggguccucugccu

SEQ ID NO: 915878 - RNA, 21 nt, Human
ccccagaagaucgccagggag

SEQ ID NO: 915879 - RNA, 20 nt, Human
ccccagcugggccuacuacc

SEQ ID NO: 915880 - RNA, 24 nt, Human
ccccaggacacaggcugagcacca

SEQ ID NO: 915881 - RNA, 24 nt, Human
ccgccacugggggcuccccagggg

SEQ ID NO: 915882 - RNA, 24 nt, Human
ccucagaagacacuagcagagucc

SEQ ID NO: 915883 - RNA, 23 nt, Human
ccucugccuccaagacagacccu

SEQ ID NO: 915884 - RNA, 20 nt, Human
ccugaaucaauagcagcaac

SEQ ID NO: 915885 - RNA, 24 nt, Human
ccuuaccuggauggccucaugggc

SEQ ID NO: 915886 - RNA, 26 nt, Human
cgaggcucacucgaucacucccuuug

SEQ ID NO: 915887 - RNA, 21 nt, Human
cggcgcagggagggcggggcg

SEQ ID NO: 915888 - RNA, 18 nt, Human
cgggauagguugaggggc

SEQ ID NO: 915889 - RNA, 23 nt, Human
cgucugucccucucagagccgca

SEQ ID NO: 915890 - RNA, 21 nt, Human
cguuaaggccaaaaaacaaaa

SEQ ID NO: 915891 - RNA, 20 nt, Human
cuaaaacaagcgccgagacc

SEQ ID NO: 915892 - RNA, 20 nt, Human
cucccauuuccccagcuggg

SEQ ID NO: 915893 - RNA, 22 nt, Human
cugguugguggcgccgcuuccu

SEQ ID NO: 915894 - RNA, 21 nt, Human
cuuuccuccccuucccccgag

SEQ ID NO: 915895 - RNA, 18 nt, Human
gaaaagacccucacucug

SEQ ID NO: 915896 - RNA, 21 nt, Human
gaaaagaucccuuagcagcca

SEQ ID NO: 915897 - RNA, 23 nt, Human
gacccugaaucaauagcagcaac

SEQ ID NO: 915898 - RNA, 24 nt, Human
gagcagcaagaaaaaacgacaacc

SEQ ID NO: 915899 - RNA, 18 nt, Human
gagcaggaugaggugaau

SEQ ID NO: 915900 - RNA, 18 nt, Human
gaucgccagggaggaaaa

SEQ ID NO: 915901 - RNA, 21 nt, Human
ggaaagcaguugucacgaagg

SEQ ID NO: 915902 - RNA, 24 nt, Human
ggaaagcaguugucacgaaggcuc

SEQ ID NO: 915903 - RNA, 27 nt, Human
ggaacucucccauuuccccagcugggc

SEQ ID NO: 915904 - RNA, 21 nt, Human
ggagaaauucacagcaucccc

SEQ ID NO: 915905 - RNA, 18 nt, Human
ggagggcggggcgaggcu

SEQ ID NO: 915906 - RNA, 23 nt, Human
gggugcagaauagagggucaggg

SEQ ID NO: 915907 - RNA, 31 nt, Human
ggugauggggggaggagcagcaagaaaaaag

SEQ ID NO: 915908 - RNA, 18 nt, Human
gucacgaaggcugugugg

SEQ ID NO: 915909 - RNA, 20 nt, Human
gugcagaauagagggucagg

SEQ ID NO: 915910 - RNA, 22 nt, Human
uaaaaagauccaaaugugacug

SEQ ID NO: 915911 - RNA, 22 nt, Human
uaaaacaagcgccgagaccagg

SEQ ID NO: 915912 - RNA, 21 nt, Human
uaaaugaauuacuguucagaa

SEQ ID NO: 915913 - RNA, 21 nt, Human
uaccugccugcccuguucacu

SEQ ID NO: 915914 - RNA, 18 nt, Human
uaccuggauggccucaug

SEQ ID NO: 915915 - RNA, 21 nt, Human
uagcagaguccagggugaugc

SEQ ID NO: 915916 - RNA, 22 nt, Human
uauacaguguuuaaaaagaucc

SEQ ID NO: 915917 - RNA, 21 nt, Human
uaucaccagcugugggcccca

SEQ ID NO: 915918 - RNA, 21 nt, Human
ucacccugugcagcaggagcu

SEQ ID NO: 915919 - RNA, 20 nt, Human
ucaggugauggggggaggag

SEQ ID NO: 915920 - RNA, 20 nt, Human
uccaagacagacccugaauc

SEQ ID NO: 915921 - RNA, 22 nt, Human
uccccagcugggccuacuaccu

SEQ ID NO: 915922 - RNA, 19 nt, Human
uccccaggccugcguuccu

SEQ ID NO: 915923 - RNA, 23 nt, Human
ucccccgagccagcagaucuccu

SEQ ID NO: 915924 - RNA, 24 nt, Human
uccugugcugucacugcuccaggg

SEQ ID NO: 915925 - RNA, 24 nt, Human
ucuccugcaggagaaauucacagc

SEQ ID NO: 915926 - RNA, 19 nt, Human
ucuccugugcugucacugc

SEQ ID NO: 915927 - RNA, 21 nt, Human
ugaaucaauagcagcaacuuu

SEQ ID NO: 915928 - RNA, 24 nt, Human
ugaaucaauagcagcaacuuuccc

SEQ ID NO: 915929 - RNA, 21 nt, Human
ugaauuacuguucagaagucu

SEQ ID NO: 915930 - RNA, 21 nt, Human
ugaggcaggcccuuaccugga

SEQ ID NO: 915931 - RNA, 18 nt, Human
ugccagugagcccaguga

SEQ ID NO: 915932 - RNA, 22 nt, Human
ugcccuguucacucuggugcca

SEQ ID NO: 915933 - RNA, 24 nt, Human
ugccugcccuguucacucuggugc

SEQ ID NO: 915934 - RNA, 20 nt, Human
ugcuccagggccucugccuc

SEQ ID NO: 915935 - RNA, 23 nt, Human
ugcugggggagaggcauccacag

SEQ ID NO: 915936 - RNA, 20 nt, Human
uggccucaugggccucccuc

SEQ ID NO: 915937 - RNA, 20 nt, Human
uggcuccagcuuccccucgu

SEQ ID NO: 915938 - RNA, 23 nt, Human
ugggacagguuuuccaggcacug

SEQ ID NO: 915939 - RNA, 23 nt, Human
ugggccccagaagaucgccaggg

SEQ ID NO: 915940 - RNA, 19 nt, Human
uggggggaggagcagcaag

SEQ ID NO: 915941 - RNA, 23 nt, Human
ugguggcgccgcuuccuggguuu

SEQ ID NO: 915942 - RNA, 21 nt, Human
ugguugguggcgccgcuuccu

SEQ ID NO: 915943 - RNA, 21 nt, Human
uguucugccucuucuaaaaca

SEQ ID NO: 915944 - RNA, 19 nt, Human
uuauuuguaggcagaagga

SEQ ID NO: 915945 - RNA, 22 nt, Human
uuguaggcagaaggaacgggau

SEQ ID NO: 915946 - RNA, 22 nt, Human
uuuguaggcagaaggaacggga

SEQ ID NO: 915947 - RNA, 24 nt, Human
uuuuccucuuuccuccccuucccc

SEQ ID NO: 915948 - RNA, 21 nt, Human
uuuuuuuuuuuuuuuuuuaag

SEQ ID NO: 915949 - RNA, 20 nt, Human
acaccgaggagcacacggag

SEQ ID NO: 915950 - RNA, 21 nt, Human
agggaaguaacaccgaggagc

SEQ ID NO: 915951 - RNA, 23 nt, Human
caccgaggagcacacggagauau

SEQ ID NO: 915952 - RNA, 22 nt, Human
cacgggaccccauguccgggcc

SEQ ID NO: 915953 - RNA, 20 nt, Human
cagccccucgggccccuugg

SEQ ID NO: 915954 - RNA, 20 nt, Human
cagccucccacacgcagccc

SEQ ID NO: 915955 - RNA, 18 nt, Human
ccacacgcagccccucgg

SEQ ID NO: 915956 - RNA, 22 nt, Human
ccccauguccgggcccgccacg

SEQ ID NO: 915957 - RNA, 23 nt, Human
cccgccacgagggaggcagaggc

SEQ ID NO: 915958 - RNA, 19 nt, Human
cccggcgcuggguccccuc

SEQ ID NO: 915959 - RNA, 20 nt, Human
cccucauaugaaagggaagu

SEQ ID NO: 915960 - RNA, 22 nt, Human
ccgcgcgcggccuccgcuccuc

SEQ ID NO: 915961 - RNA, 19 nt, Human
cgcccuccucccucccccc

SEQ ID NO: 915962 - RNA, 20 nt, Human
cgcgcgcggccuccgcuccu

SEQ ID NO: 915963 - RNA, 25 nt, Human
cucugcgcccaugcccacgcccucc

SEQ ID NO: 915964 - RNA, 18 nt, Human
gaccccauguccgggccc

SEQ ID NO: 915965 - RNA, 25 nt, Human
gcacggcgcgacagucagugcgggg

SEQ ID NO: 915966 - RNA, 24 nt, Human
gcccacgcccuccucccucccccc

SEQ ID NO: 915967 - RNA, 18 nt, Human
ggccgagggacucaggcc

SEQ ID NO: 915968 - RNA, 24 nt, Human
ggccgagggacucaggccacggga

SEQ ID NO: 915969 - RNA, 20 nt, Human
gggaccccauguccgggccc

SEQ ID NO: 915970 - RNA, 19 nt, Human
ggguguggggcuggggggg

SEQ ID NO: 915971 - RNA, 19 nt, Human
ggguguggggcuggggggg

SEQ ID NO: 915972 - RNA, 23 nt, Human
ggguguggggcugggggggccag

SEQ ID NO: 915973 - RNA, 21 nt, Human
gugcggggaaggugcgcgcgg

SEQ ID NO: 915974 - RNA, 19 nt, Human
guguggggcugggggggcc

SEQ ID NO: 915975 - RNA, 26 nt, Human
uaacaccgaggagcacacggagauau

SEQ ID NO: 915976 - RNA, 21 nt, Human
uccccagccucccacacgcag

SEQ ID NO: 915977 - RNA, 22 nt, Human
ucugcgcccaugcccacgcccu

SEQ ID NO: 915978 - RNA, 18 nt, Human
ugcggggaaggugcgcgc

SEQ ID NO: 915979 - RNA, 20 nt, Human
ugcggggaaggugcgcgcgg

SEQ ID NO: 915980 - RNA, 18 nt, Human
uguggggcugggggggcc

SEQ ID NO: 915981 - RNA, 22 nt, Human
uuuuuuuuuuuuuuuuuggggu

SEQ ID NO: 915982 - RNA, 19 nt, Human
aaagugcuuggauuacagg

SEQ ID NO: 915983 - RNA, 24 nt, Human
aaagugcuuggauuacagguguga

SEQ ID NO: 915984 - RNA, 19 nt, Human
aaccaccgcacccggucug

SEQ ID NO: 915985 - RNA, 24 nt, Human
accauguuggccaggauggucuug

SEQ ID NO: 915986 - RNA, 25 nt, Human
acccgccucggccucccaaagugcu

SEQ ID NO: 915987 - RNA, 24 nt, Human
acccggcuaauuuuuuuguauuuu

SEQ ID NO: 915988 - RNA, 18 nt, Human
acgggguuucaccauguu

SEQ ID NO: 915989 - RNA, 23 nt, Human
acgggguuucaccauguuggcca

SEQ ID NO: 915990 - RNA, 24 nt, Human
acgggguuucaccauguuggccag

SEQ ID NO: 915991 - RNA, 18 nt, Human
agagucacccgcuccacc

SEQ ID NO: 915992 - RNA, 19 nt, Human
agccuccugaguagcuggg

SEQ ID NO: 915993 - RNA, 21 nt, Human
agccuccugaguagcugggac

SEQ ID NO: 915994 - RNA, 25 nt, Human
aggcuggagugcaguggcgugaucu

SEQ ID NO: 915995 - RNA, 19 nt, Human
aggugugaaccaccgcacc

SEQ ID NO: 915996 - RNA, 19 nt, Human
aguagcugggacuacaggc

SEQ ID NO: 915997 - RNA, 19 nt, Human
aguagcugggacuacaggc

SEQ ID NO: 915998 - RNA, 20 nt, Human
agucaagauggaagggucuc

SEQ ID NO: 915999 - RNA, 22 nt, Human
agucucuguugauucugcaaga

SEQ ID NO: 916000 - RNA, 19 nt, Human
agugcaguggcgugaucuc

SEQ ID NO: 916001 - RNA, 20 nt, Human
agugcaguggcgugaucucg

SEQ ID NO: 916002 - RNA, 23 nt, Human
agugcaguggcgugaucucggcu

SEQ ID NO: 916003 - RNA, 24 nt, Human
agugcaguggcgugaucucggcuc

SEQ ID NO: 916004 - RNA, 24 nt, Human
augauccacccgccucggccuccc

SEQ ID NO: 916005 - RNA, 24 nt, Human
auuuuaguagagacgggguuucac

SEQ ID NO: 916006 - RNA, 24 nt, Human
caaagugcuuggauuacaggugug

SEQ ID NO: 916007 - RNA, 23 nt, Human
caaccuccaccucccggguucaa

SEQ ID NO: 916008 - RNA, 22 nt, Human
caagcgauucuccugccuuagc

SEQ ID NO: 916009 - RNA, 18 nt, Human
caccauguuggccaggau

SEQ ID NO: 916010 - RNA, 22 nt, Human
caccauguuggccaggaugguc

SEQ ID NO: 916011 - RNA, 23 nt, Human
caccauguuggccaggauggucu

SEQ ID NO: 916012 - RNA, 24 nt, Human
caccauguuggccaggauggucuu

SEQ ID NO: 916013 - RNA, 23 nt, Human
cacccgccucggccucccaaagu

SEQ ID NO: 916014 - RNA, 21 nt, Human
cacugcaaccuccaccucccg

SEQ ID NO: 916015 - RNA, 23 nt, Human
cacugcaaccuccaccucccggg

SEQ ID NO: 916016 - RNA, 20 nt, Human
cagagucuugcuuugucaac

SEQ ID NO: 916017 - RNA, 19 nt, Human
caggcuggagugcaguggc

SEQ ID NO: 916018 - RNA, 21 nt, Human
ccaaagugcuuggauuacagg

SEQ ID NO: 916019 - RNA, 24 nt, Human
ccaaagugcuuggauuacaggugu

SEQ ID NO: 916020 - RNA, 24 nt, Human
ccaccucccggguucaagcgauuc

SEQ ID NO: 916021 - RNA, 20 nt, Human
cccggguucaagcgauucuc

SEQ ID NO: 916022 - RNA, 23 nt, Human
cccggguucaagcgauucuccug

SEQ ID NO: 916023 - RNA, 24 nt, Human
ccucccggguucaagcgauucucc

SEQ ID NO: 916024 - RNA, 20 nt, Human
ccugaccucaugauccaccc

SEQ ID NO: 916025 - RNA, 23 nt, Human
ccugaguagcugggacuacaggc

SEQ ID NO: 916026 - RNA, 23 nt, Human
ccugaguagcugggacuacaggc

SEQ ID NO: 916027 - RNA, 23 nt, Human
ccugccuuagccuccugaguagc

SEQ ID NO: 916028 - RNA, 25 nt, Human
cgccucggccucccaaagugcuugg

SEQ ID NO: 916029 - RNA, 24 nt, Human
cucacugcaaccuccaccucccgg

SEQ ID NO: 916030 - RNA, 24 nt, Human
cuccugaccucaugauccacccgc

SEQ ID NO: 916031 - RNA, 20 nt, Human
cucuacacaggcaacaaggc

SEQ ID NO: 916032 - RNA, 18 nt, Human
cugcaaccuccaccuccc

SEQ ID NO: 916033 - RNA, 23 nt, Human
cugcaaccuccaccucccggguu

SEQ ID NO: 916034 - RNA, 24 nt, Human
cugcaaccuccaccucccggguuc

SEQ ID NO: 916035 - RNA, 23 nt, Human
cugccuuagccuccugaguagcu

SEQ ID NO: 916036 - RNA, 24 nt, Human
cuuagccuccugaguagcugggac

SEQ ID NO: 916037 - RNA, 20 nt, Human
cuuggauuacaggugugaac

SEQ ID NO: 916038 - RNA, 24 nt, Human
gacagagucuugcuuugucaacag

SEQ ID NO: 916039 - RNA, 22 nt, Human
gaccucaugauccacccgccuc

SEQ ID NO: 916040 - RNA, 24 nt, Human
gagacgggguuucaccauguuggc

SEQ ID NO: 916041 - RNA, 24 nt, Human
gaguagcugggacuacaggcgugc

SEQ ID NO: 916042 - RNA, 20 nt, Human
gaguucugaggccgccuuuc

SEQ ID NO: 916043 - RNA, 23 nt, Human
gauuacaggugugaaccaccgca

SEQ ID NO: 916044 - RNA, 19 nt, Human
gcuggagugcaguggcgug

SEQ ID NO: 916045 - RNA, 21 nt, Human
ggauuacaggugugaaccacc

SEQ ID NO: 916046 - RNA, 22 nt, Human
ggauuacaggugugaaccaccg

SEQ ID NO: 916047 - RNA, 22 nt, Human
ggcuggagugcaguggcgugau

SEQ ID NO: 916048 - RNA, 23 nt, Human
gggguuucaccauguuggccagg

SEQ ID NO: 916049 - RNA, 22 nt, Human
ggguuucaccauguuggccagg

SEQ ID NO: 916050 - RNA, 20 nt, Human
ggucuugaucuccugaccuc

SEQ ID NO: 916051 - RNA, 24 nt, Human
gguuucaccauguuggccaggaug

SEQ ID NO: 916052 - RNA, 23 nt, Human
guagagacgggguuucaccaugu

SEQ ID NO: 916053 - RNA, 24 nt, Human
gucuugcuuugucaacaggcugga

SEQ ID NO: 916054 - RNA, 25 nt, Human
uaacacaaaagcccacuucagucuc

SEQ ID NO: 916055 - RNA, 23 nt, Human
uacaggcgugcaccgccacaccc

SEQ ID NO: 916056 - RNA, 23 nt, Human
uacaggugugaaccaccgcaccc

SEQ ID NO: 916057 - RNA, 22 nt, Human
uagagacgggguuucaccaugu

SEQ ID NO: 916058 - RNA, 24 nt, Human
uaguagagacgggguuucaccaug

SEQ ID NO: 916059 - RNA, 26 nt, Human
uaguagagacgggguuucaccauguu

SEQ ID NO: 916060 - RNA, 24 nt, Human
ucaacaggcuggagugcaguggcg

SEQ ID NO: 916061 - RNA, 24 nt, Human
ucaccauguuggccaggauggucu

SEQ ID NO: 916062 - RNA, 23 nt, Human
ucacugcaaccuccaccucccgg

SEQ ID NO: 916063 - RNA, 24 nt, Human
ucacugcaaccuccaccucccggg

SEQ ID NO: 916064 - RNA, 25 nt, Human
ucacugcaaccuccaccucccgggu

SEQ ID NO: 916065 - RNA, 27 nt, Human
ucacugcaaccuccaccucccggguuc

SEQ ID NO: 916066 - RNA, 23 nt, Human
ucccaaagugcuuggauuacagg

SEQ ID NO: 916067 - RNA, 21 nt, Human
ucccggguucaagcgauucuc

SEQ ID NO: 916068 - RNA, 24 nt, Human
ucccggguucaagcgauucuccug

SEQ ID NO: 916069 - RNA, 24 nt, Human
uccugaguagcugggacuacaggc

SEQ ID NO: 916070 - RNA, 19 nt, Human
ucuacacaggcaacaaggc

SEQ ID NO: 916071 - RNA, 24 nt, Human
ucuccugccuuagccuccugagua

SEQ ID NO: 916072 - RNA, 21 nt, Human
ucucugguuacuuccuuaacc

SEQ ID NO: 916073 - RNA, 22 nt, Human
ucuugcuuugucaacaggcugg

SEQ ID NO: 916074 - RNA, 23 nt, Human
ucuugcuuugucaacaggcugga

SEQ ID NO: 916075 - RNA, 19 nt, Human
ugaguucugaggccgccuu

SEQ ID NO: 916076 - RNA, 20 nt, Human
ugccuuagccuccugaguaa

SEQ ID NO: 916077 - RNA, 24 nt, Human
ugccuuagccuccugaguagcugg

SEQ ID NO: 916078 - RNA, 20 nt, Human
uggagugcaguggcgugauc

SEQ ID NO: 916079 - RNA, 23 nt, Human
uggagugcaguggcgugaucucg

SEQ ID NO: 916080 - RNA, 24 nt, Human
uggagugcaguggcgugaucucgg

SEQ ID NO: 916081 - RNA, 20 nt, Human
uggauuacaggugugaacca

SEQ ID NO: 916082 - RNA, 23 nt, Human
uggauuacaggugugaaccaccg

SEQ ID NO: 916083 - RNA, 22 nt, Human
uggcaguaccaccguaacuugc

SEQ ID NO: 916084 - RNA, 24 nt, Human
uggccaggauggucuugaucuccu

SEQ ID NO: 916085 - RNA, 20 nt, Human
uggcgugaucucggcucacu

SEQ ID NO: 916086 - RNA, 21 nt, Human
ugggacuacaggcgugcaccg

SEQ ID NO: 916087 - RNA, 24 nt, Human
ugggacuacaggcgugcaccgcca

SEQ ID NO: 916088 - RNA, 18 nt, Human
uuaguagagacgggguuu

SEQ ID NO: 916089 - RNA, 22 nt, Human
uuaguagagacgggguuucacc

SEQ ID NO: 916090 - RNA, 24 nt, Human
uuaguagagacgggguuucaccau

SEQ ID NO: 916091 - RNA, 20 nt, Human
uucaagcgauucuccugccu

SEQ ID NO: 916092 - RNA, 24 nt, Human
uucaagcgauucuccugccuuagc

SEQ ID NO: 916093 - RNA, 22 nt, Human
uuggauuacaggugugaaccac

SEQ ID NO: 916094 - RNA, 24 nt, Human
uuggauuacaggugugaaccaccg

SEQ ID NO: 916095 - RNA, 19 nt, Human
uuucaccauguuggccagg

SEQ ID NO: 916096 - RNA, 20 nt, Human
uuucaccauguuggccagga

SEQ ID NO: 916097 - RNA, 23 nt, Human
uuugucaacaggcuggagugcag

SEQ ID NO: 916098 - RNA, 20 nt, Human
uuuuuguauuuuaguagaga

SEQ ID NO: 916099 - RNA, 20 nt, Human
uuuuuuguauuuuaguagag

SEQ ID NO: 916100 - RNA, 24 nt, Human
uuuuuuuguauuuuaguagagacg

SEQ ID NO: 916101 - RNA, 21 nt, Human
aacuguuuucacauuggaaau

SEQ ID NO: 916102 - RNA, 21 nt, Human
aagaaaacaaaugcgauuuaa

SEQ ID NO: 916103 - RNA, 18 nt, Human
aauaaaggagcagggaga

SEQ ID NO: 916104 - RNA, 21 nt, Human
aaucucaaguagcauuuagaa

SEQ ID NO: 916105 - RNA, 20 nt, Human
acugaagaaaacaaaugcga

SEQ ID NO: 916106 - RNA, 18 nt, Human
agagaagcagagcucucg

SEQ ID NO: 916107 - RNA, 18 nt, Human
aggaacaucgacccauaa

SEQ ID NO: 916108 - RNA, 24 nt, Human
aggcagguaacagaaagaauaagg

SEQ ID NO: 916109 - RNA, 23 nt, Human
agguguagaccaaguccagaaag

SEQ ID NO: 916110 - RNA, 21 nt, Human
aguaaaaucaguauagaauaa

SEQ ID NO: 916111 - RNA, 22 nt, Human
cacuuucuucuaaggccuggag

SEQ ID NO: 916112 - RNA, 22 nt, Human
caguauuguggauuucagaugg

SEQ ID NO: 916113 - RNA, 19 nt, Human
cauuccagugacugucagg

SEQ ID NO: 916114 - RNA, 23 nt, Human
cgacccauaacaugcaacaaaaa

SEQ ID NO: 916115 - RNA, 21 nt, Human
cugcucccugcacacguuuuu

SEQ ID NO: 916116 - RNA, 21 nt, Human
gacauuacaaguaacagcaac

SEQ ID NO: 916117 - RNA, 22 nt, Human
gacccauaacaugcaacaaaaa

SEQ ID NO: 916118 - RNA, 23 nt, Human
gcaaucucaaguagcauuuagaa

SEQ ID NO: 916119 - RNA, 22 nt, Human
gguaacagaaagaauaaggggc

SEQ ID NO: 916120 - RNA, 28 nt, Human
uaaaaccaaaagaacaacuuuaauaagc

SEQ ID NO: 916121 - RNA, 20 nt, Human
uaacaugcaacaaaaaugaa

SEQ ID NO: 916122 - RNA, 24 nt, Human
uaguuucacuuucuucuaaggccu

SEQ ID NO: 916123 - RNA, 20 nt, Human
ucagaccaggaguaaacggc

SEQ ID NO: 916124 - RNA, 23 nt, Human
ucagaccaggaguaaacggccuu

SEQ ID NO: 916125 - RNA, 19 nt, Human
ugacauuacaaguaacagc

SEQ ID NO: 916126 - RNA, 21 nt, Human
ugagaugggaaaguaaaauca

SEQ ID NO: 916127 - RNA, 21 nt, Human
ugagaugggaaaguaaaauca

SEQ ID NO: 916128 - RNA, 19 nt, Human
ugcacacguuuuugagaug

SEQ ID NO: 916129 - RNA, 21 nt, Human
uggggcucggguaggagggcu

SEQ ID NO: 916130 - RNA, 21 nt, Human
uguaaaaccaaaagaacaacu

SEQ ID NO: 916131 - RNA, 20 nt, Human
uucagagaagcagagcucuc

SEQ ID NO: 916132 - RNA, 23 nt, Human
uucagauggggaaaauaaucaga

SEQ ID NO: 916133 - RNA, 24 nt, Human
aaacaggguccauagugccuaugg

SEQ ID NO: 916134 - RNA, 20 nt, Human
aacagcuucaguggugggac

SEQ ID NO: 916135 - RNA, 19 nt, Human
acuggccuggcccaacagc

SEQ ID NO: 916136 - RNA, 24 nt, Human
aggcagagaagaccaugggaguuc

SEQ ID NO: 916137 - RNA, 24 nt, Human
aggcgggggugaccuccgcagcuu

SEQ ID NO: 916138 - RNA, 18 nt, Human
cacgggccguucccccuc

SEQ ID NO: 916139 - RNA, 18 nt, Human
cagaggcagaaucugggg

SEQ ID NO: 916140 - RNA, 20 nt, Human
cccgacacaucugcuggcca

SEQ ID NO: 916141 - RNA, 21 nt, Human
ccgcggcugacuucacuccgu

SEQ ID NO: 916142 - RNA, 26 nt, Human
cgccucacccucucaccaggcccgac

SEQ ID NO: 916143 - RNA, 22 nt, Human
cgggggaggcaggagcaggggc

SEQ ID NO: 916144 - RNA, 22 nt, Human
cgguagacgguaaguuccuccc

SEQ ID NO: 916145 - RNA, 19 nt, Human
cgucucgccucacccucuc

SEQ ID NO: 916146 - RNA, 25 nt, Human
cucacccucucaccaggcccgacac

SEQ ID NO: 916147 - RNA, 25 nt, Human
cucgccucacccucucaccaggccc

SEQ ID NO: 916148 - RNA, 19 nt, Human
gcccugggcgaucgggccc

SEQ ID NO: 916149 - RNA, 19 nt, Human
gccguucccccucacggga

SEQ ID NO: 916150 - RNA, 20 nt, Human
ggaggcaggagcaggggcuc

SEQ ID NO: 916151 - RNA, 24 nt, Human
ggccaggcagagaagaccauggga

SEQ ID NO: 916152 - RNA, 21 nt, Human
uaaaagguuaaaagugcagag

SEQ ID NO: 916153 - RNA, 22 nt, Human
ucaagguucaaauacuuuuuau

SEQ ID NO: 916154 - RNA, 19 nt, Human
ucccacgugaauccagggu

SEQ ID NO: 916155 - RNA, 20 nt, Human
ucccugagcuaaggccaggc

SEQ ID NO: 916156 - RNA, 23 nt, Human
uccgcagcuuccggggcccuggg

SEQ ID NO: 916157 - RNA, 19 nt, Human
uccgcgcgcguucacgggc

SEQ ID NO: 916158 - RNA, 21 nt, Human
uccgcgcgcguucacgggccg

SEQ ID NO: 916159 - RNA, 22 nt, Human
uccgcgcgcguucacgggccgu

SEQ ID NO: 916160 - RNA, 20 nt, Human
ucgccucacccucucaccaa

SEQ ID NO: 916161 - RNA, 18 nt, Human
ugaccuccgcagcuuccu

SEQ ID NO: 916162 - RNA, 26 nt, Human
uggccuggcccaacagcuucaguggg

SEQ ID NO: 916163 - RNA, 18 nt, Human
aaggagcugagaaacuuc

SEQ ID NO: 916164 - RNA, 21 nt, Human
acagggccuuggagggaugag

SEQ ID NO: 916165 - RNA, 24 nt, Human
acccugaaggccucccggcgacac

SEQ ID NO: 916166 - RNA, 21 nt, Human
acucugcgaacagcaccaauc

SEQ ID NO: 916167 - RNA, 20 nt, Human
acugcacguccauuaaauuu

SEQ ID NO: 916168 - RNA, 24 nt, Human
agagggaaccggaggagagggugc

SEQ ID NO: 916169 - RNA, 22 nt, Human
agagggcccaagggguccccuc

SEQ ID NO: 916170 - RNA, 18 nt, Human
agccauggggugagaggg

SEQ ID NO: 916171 - RNA, 23 nt, Human
agcuggaggcugauggagccagg

SEQ ID NO: 916172 - RNA, 20 nt, Human
aggccuacucugcgaacagc

SEQ ID NO: 916173 - RNA, 20 nt, Human
agggaaguggggcugggguc

SEQ ID NO: 916174 - RNA, 21 nt, Human
agggauguagcaccuucucca

SEQ ID NO: 916175 - RNA, 19 nt, Human
aggugggggaggggaagcc

SEQ ID NO: 916176 - RNA, 23 nt, Human
auagcaggguuagaacagcuggg

SEQ ID NO: 916177 - RNA, 22 nt, Human
auguagcaccuucuccaacccc

SEQ ID NO: 916178 - RNA, 22 nt, Human
auguccaugguugcugugcgca

SEQ ID NO: 916179 - RNA, 19 nt, Human
auguccccuucccccccac

SEQ ID NO: 916180 - RNA, 24 nt, Human
cacauugcaaaagucucacgccaa

SEQ ID NO: 916181 - RNA, 19 nt, Human
cacgccaaaaaagcuagac

SEQ ID NO: 916182 - RNA, 23 nt, Human
cacuguggcucccaucccuuucu

SEQ ID NO: 916183 - RNA, 21 nt, Human
cagagggcccaaggggucccc

SEQ ID NO: 916184 - RNA, 19 nt, Human
caggagagagugaagggca

SEQ ID NO: 916185 - RNA, 24 nt, Human
cauuaaauuaaacccaauggaaaa

SEQ ID NO: 916186 - RNA, 21 nt, Human
ccacacaggcugcucgacugg

SEQ ID NO: 916187 - RNA, 19 nt, Human
ccccagagggcccaagggg

SEQ ID NO: 916188 - RNA, 21 nt, Human
cccccgggcaaaggccuacuc

SEQ ID NO: 916189 - RNA, 22 nt, Human
cccccuuugucucuccccuucc

SEQ ID NO: 916190 - RNA, 21 nt, Human
cccuugaaugucugucaaagg

SEQ ID NO: 916191 - RNA, 23 nt, Human
ccgccaaacagaguccucggcag

SEQ ID NO: 916192 - RNA, 20 nt, Human
ccgugggugggggccauggg

SEQ ID NO: 916193 - RNA, 21 nt, Human
ccucaggcccucccacuccuc

SEQ ID NO: 916194 - RNA, 21 nt, Human
ccuccauaugguuccuagccc

SEQ ID NO: 916195 - RNA, 22 nt, Human
ccuccuccuuccaggagcccca

SEQ ID NO: 916196 - RNA, 19 nt, Human
ccuggcuucccacuggacu

SEQ ID NO: 916197 - RNA, 19 nt, Human
ccuuugucucuccccuucc

SEQ ID NO: 916198 - RNA, 18 nt, Human
cgcagagacagggccuug

SEQ ID NO: 916199 - RNA, 18 nt, Human
cucaggcccucccacucc

SEQ ID NO: 916200 - RNA, 18 nt, Human
cuccuccuuccaggagcc

SEQ ID NO: 916201 - RNA, 21 nt, Human
cucggugguugggaaggaaca

SEQ ID NO: 916202 - RNA, 23 nt, Human
cuucuggggaugaaacucagucc

SEQ ID NO: 916203 - RNA, 23 nt, Human
gaacaucuaggguaaaaaaccau

SEQ ID NO: 916204 - RNA, 23 nt, Human
gaagccccagagggcccaagggg

SEQ ID NO: 916205 - RNA, 20 nt, Human
gagcacugaaggugggaaca

SEQ ID NO: 916206 - RNA, 21 nt, Human
gagcacugaaggugggaacau

SEQ ID NO: 916207 - RNA, 24 nt, Human
gagcacugaaggugggaacaucua

SEQ ID NO: 916208 - RNA, 20 nt, Human
gagccccaguuccuccaggg

SEQ ID NO: 916209 - RNA, 20 nt, Human
gagcugagaaacuucugggg

SEQ ID NO: 916210 - RNA, 22 nt, Human
gauaaccugguuucaccuucuc

SEQ ID NO: 916211 - RNA, 22 nt, Human
gaucucacuccugucuuuccac

SEQ ID NO: 916212 - RNA, 20 nt, Human
gccaaccaagggggucugga

SEQ ID NO: 916213 - RNA, 18 nt, Human
gccacucacauccugcca

SEQ ID NO: 916214 - RNA, 19 nt, Human
gccuuggagggaugagcug

SEQ ID NO: 916215 - RNA, 22 nt, Human
gggaagccccagagggcccaag

SEQ ID NO: 916216 - RNA, 20 nt, Human
gggccuuggagggaugagcu

SEQ ID NO: 916217 - RNA, 19 nt, Human
ggggaggggaagccccaga

SEQ ID NO: 916218 - RNA, 19 nt, Human
gggugccauucucugggcc

SEQ ID NO: 916219 - RNA, 19 nt, Human
gucuauggagggcguggag

SEQ ID NO: 916220 - RNA, 21 nt, Human
gugaagggcacuguggcuccc

SEQ ID NO: 916221 - RNA, 20 nt, Human
gugaucaccuagggacagcu

SEQ ID NO: 916222 - RNA, 21 nt, Human
gugccaaccaagggggucugg

SEQ ID NO: 916223 - RNA, 22 nt, Human
guggagcacugaaggugggaac

SEQ ID NO: 916224 - RNA, 24 nt, Human
uaaguucugugaucaccuagggac

SEQ ID NO: 916225 - RNA, 23 nt, Human
uaccccaaccaggugggggaggg

SEQ ID NO: 916226 - RNA, 23 nt, Human
uagcccagggucugccaucuccu

SEQ ID NO: 916227 - RNA, 21 nt, Human
ucaccuucucugaaggucuau

SEQ ID NO: 916228 - RNA, 22 nt, Human
ucagagcgggggcuggggaggc

SEQ ID NO: 916229 - RNA, 24 nt, Human
uccagggaaguggggcuggggucc

SEQ ID NO: 916230 - RNA, 22 nt, Human
ucccagauaaccugguuucacc

SEQ ID NO: 916231 - RNA, 18 nt, Human
ucccccccacccugaagg

SEQ ID NO: 916232 - RNA, 22 nt, Human
uccccuucccccccacccugaa

SEQ ID NO: 916233 - RNA, 19 nt, Human
ucccucggugcuuccugcc

SEQ ID NO: 916234 - RNA, 18 nt, Human
uccugccacugaaggagg

SEQ ID NO: 916235 - RNA, 26 nt, Human
uccugcccauguccccuuccccccca

SEQ ID NO: 916236 - RNA, 18 nt, Human
ucggugguugggaaggaa

SEQ ID NO: 916237 - RNA, 21 nt, Human
ucucacgccaaaaaagcuaga

SEQ ID NO: 916238 - RNA, 24 nt, Human
ucucugggcccucccccacauuua

SEQ ID NO: 916239 - RNA, 18 nt, Human
ugaagaaaggaagcugga

SEQ ID NO: 916240 - RNA, 20 nt, Human
ugaagaaaggaagcuggagg

SEQ ID NO: 916241 - RNA, 24 nt, Human
ugaaggacagaaugaagaaaggaa

SEQ ID NO: 916242 - RNA, 18 nt, Human
ugagagggaaccggagga

SEQ ID NO: 916243 - RNA, 23 nt, Human
ugcccuugaaugucugucaaagg

SEQ ID NO: 916244 - RNA, 19 nt, Human
ugcuuccugcccauguccc

SEQ ID NO: 916245 - RNA, 22 nt, Human
uggaaaacacacgugugaccug

SEQ ID NO: 916246 - RNA, 21 nt, Human
uggaaggugggugggagggua

SEQ ID NO: 916247 - RNA, 21 nt, Human
uggagagccuccuccuccuuc

SEQ ID NO: 916248 - RNA, 22 nt, Human
uggagcacugaaggugggaaca

SEQ ID NO: 916249 - RNA, 21 nt, Human
uggagccugguggauuccauc

SEQ ID NO: 916250 - RNA, 20 nt, Human
uggagggaugagcuggagcc

SEQ ID NO: 916251 - RNA, 23 nt, Human
uggagggaugagcuggagccugg

SEQ ID NO: 916252 - RNA, 19 nt, Human
uggcucccaucccuuucuc

SEQ ID NO: 916253 - RNA, 19 nt, Human
ugggaagagggauguagca

SEQ ID NO: 916254 - RNA, 21 nt, Human
ugggagcaaagggauggccgu

SEQ ID NO: 916255 - RNA, 25 nt, Human
ugggugggaggguauguguuagggu

SEQ ID NO: 916256 - RNA, 19 nt, Human
uguccccuucccccccacc

SEQ ID NO: 916257 - RNA, 22 nt, Human
uucccagauaaccugguuucac

SEQ ID NO: 916258 - RNA, 21 nt, Human
uuccucuauguauggcaucaa

SEQ ID NO: 916259 - RNA, 22 nt, Human
uugcucuaccccaaccaggugg

SEQ ID NO: 916260 - RNA, 18 nt, Human
uuucuucaagcuacugau

SEQ ID NO: 916261 - RNA, 18 nt, Human
aaccaguuucagauguga

SEQ ID NO: 916262 - RNA, 21 nt, Human
aagaguccuggguaguguugg

SEQ ID NO: 916263 - RNA, 23 nt, Human
acaggaacagucuuucuggggau

SEQ ID NO: 916264 - RNA, 19 nt, Human
acuggccuauggcccuggu

SEQ ID NO: 916265 - RNA, 22 nt, Human
agaaacagcagaaggccaugga

SEQ ID NO: 916266 - RNA, 20 nt, Human
agcaagaguccuggguagug

SEQ ID NO: 916267 - RNA, 19 nt, Human
agccugguuggcguugacc

SEQ ID NO: 916268 - RNA, 18 nt, Human
agggcugggccuccucca

SEQ ID NO: 916269 - RNA, 22 nt, Human
aggggaggugccacacucaagg

SEQ ID NO: 916270 - RNA, 24 nt, Human
aggggggcuugggaggggaggugc

SEQ ID NO: 916271 - RNA, 19 nt, Human
aggugccacacucaaggug

SEQ ID NO: 916272 - RNA, 26 nt, Human
aguagcugagaggaugucaagggggg

SEQ ID NO: 916273 - RNA, 20 nt, Human
caaauccuugccuuggcuca

SEQ ID NO: 916274 - RNA, 22 nt, Human
cacagcagagggaaacaaaucc

SEQ ID NO: 916275 - RNA, 24 nt, Human
caccgccacagcagagggaaacaa

SEQ ID NO: 916276 - RNA, 19 nt, Human
cacgcccgccuacccaccc

SEQ ID NO: 916277 - RNA, 23 nt, Human
cacgcccgccuacccacccugua

SEQ ID NO: 916278 - RNA, 20 nt, Human
cagccacuugcuuggggcug

SEQ ID NO: 916279 - RNA, 24 nt, Human
cagccccaggucggcuccugcauu

SEQ ID NO: 916280 - RNA, 18 nt, Human
caggcccggccuagucac

SEQ ID NO: 916281 - RNA, 20 nt, Human
cagggaugugcagccccagg

SEQ ID NO: 916282 - RNA, 18 nt, Human
cagggcucucggcaacca

SEQ ID NO: 916283 - RNA, 19 nt, Human
caggggccuccccggggcc

SEQ ID NO: 916284 - RNA, 25 nt, Human
cagucaccgccacagcagagggaaa

SEQ ID NO: 916285 - RNA, 27 nt, Human
cagugucccugcagccacuugcuuggu

SEQ ID NO: 916286 - RNA, 18 nt, Human
caguuucagaugugaggg

SEQ ID NO: 916287 - RNA, 21 nt, Human
cauucuuaccucagaugaggg

SEQ ID NO: 916288 - RNA, 23 nt, Human
ccaggcccggccuagucacuggc

SEQ ID NO: 916289 - RNA, 24 nt, Human
ccaggucggcuccugcauuugcug

SEQ ID NO: 916290 - RNA, 19 nt, Human
ccaguuucagaugugaggg

SEQ ID NO: 916291 - RNA, 20 nt, Human
ccuaguccggccccgauggg

SEQ ID NO: 916292 - RNA, 19 nt, Human
ccucagaggcuccgggccu

SEQ ID NO: 916293 - RNA, 20 nt, Human
ccugggcuuggcugcccacu

SEQ ID NO: 916294 - RNA, 18 nt, Human
cgcaaggggacuggugcc

SEQ ID NO: 916295 - RNA, 24 nt, Human
cgcccgggaccugagggaaggccc

SEQ ID NO: 916296 - RNA, 25 nt, Human
cucuggucccgaggggccggaaagc

SEQ ID NO: 916297 - RNA, 21 nt, Human
cugcauuugcugggcccccag

SEQ ID NO: 916298 - RNA, 24 nt, Human
gagaaacagcagaaggccauggaa

SEQ ID NO: 916299 - RNA, 19 nt, Human
gagaggaugucaagggggg

SEQ ID NO: 916300 - RNA, 22 nt, Human
gcagccccaggucggcuccugc

SEQ ID NO: 916301 - RNA, 20 nt, Human
gccacagcagagggaaacaa

SEQ ID NO: 916302 - RNA, 24 nt, Human
gcccgccuacccacccuguaggcc

SEQ ID NO: 916303 - RNA, 19 nt, Human
gccgagucgggccuuguug

SEQ ID NO: 916304 - RNA, 18 nt, Human
gccugggcuuggcugccc

SEQ ID NO: 916305 - RNA, 24 nt, Human
gcgaggcccuucgguucgcaaggg

SEQ ID NO: 916306 - RNA, 25 nt, Human
ggaaagccccagcaggccuucuucc

SEQ ID NO: 916307 - RNA, 22 nt, Human
ggagcuguucugguccagaagc

SEQ ID NO: 916308 - RNA, 22 nt, Human
ggcaucagugucccugcagcca

SEQ ID NO: 916309 - RNA, 19 nt, Human
ggccggcccaggagcugug

SEQ ID NO: 916310 - RNA, 28 nt, Human
ggccuggacuggccgaugccucagaggc

SEQ ID NO: 916311 - RNA, 24 nt, Human
gggcagggaugugcagccccaggu

SEQ ID NO: 916312 - RNA, 23 nt, Human
gggccuccuccauccacugcgag

SEQ ID NO: 916313 - RNA, 20 nt, Human
gggcucucggcaaccaguuu

SEQ ID NO: 916314 - RNA, 22 nt, Human
ggggaggugccacacucaaggu

SEQ ID NO: 916315 - RNA, 22 nt, Human
guccagaagcagucaccgccac

SEQ ID NO: 916316 - RNA, 22 nt, Human
gugcagccccaggucggcuccu

SEQ ID NO: 916317 - RNA, 20 nt, Human
ucaagccuggucagcucccg

SEQ ID NO: 916318 - RNA, 18 nt, Human
ucccugcagccacuugcu

SEQ ID NO: 916319 - RNA, 18 nt, Human
uccugacaggaacagucu

SEQ ID NO: 916320 - RNA, 22 nt, Human
uccuguagaaaauaccugggag

SEQ ID NO: 916321 - RNA, 25 nt, Human
ucggguggggcucuggucccgaggg

SEQ ID NO: 916322 - RNA, 22 nt, Human
ucgguucgcaaggggacuggug

SEQ ID NO: 916323 - RNA, 21 nt, Human
ugccaggcuagccugguuggc

SEQ ID NO: 916324 - RNA, 21 nt, Human
ugccaggcuagccugguuggc

SEQ ID NO: 916325 - RNA, 23 nt, Human
ugccgggccgcagcguaggcccc

SEQ ID NO: 916326 - RNA, 19 nt, Human
ugccucagaggcuccgggc

SEQ ID NO: 916327 - RNA, 22 nt, Human
ugccucagaggcuccgggccug

SEQ ID NO: 916328 - RNA, 23 nt, Human
ugcugggcccccagaacauuuuu

SEQ ID NO: 916329 - RNA, 20 nt, Human
uggcguugaccucagggcug

SEQ ID NO: 916330 - RNA, 20 nt, Human
uggcucagggcucucggcaa

SEQ ID NO: 916331 - RNA, 22 nt, Human
ugggagcuggagcuguucuggu

SEQ ID NO: 916332 - RNA, 18 nt, Human
uggggcucuggucccgag

SEQ ID NO: 916333 - RNA, 22 nt, Human
ugguaggccaggggccucccuc

SEQ ID NO: 916334 - RNA, 26 nt, Human
ugguuggcguugaccucagggcuggg

SEQ ID NO: 916335 - RNA, 21 nt, Human
ugucuggaguuggaaccaggu

SEQ ID NO: 916336 - RNA, 21 nt, Human
uugcugggcccccagaacauu

SEQ ID NO: 916337 - RNA, 21 nt, Human
uuuuuuuuuuuuuuuucucag

SEQ ID NO: 916338 - RNA, 18 nt, Human
aaaaaaguccguuccuuc

SEQ ID NO: 916339 - RNA, 21 nt, Human
aagacaagcgugcccuccccu

SEQ ID NO: 916340 - RNA, 20 nt, Human
acagagaaacaacauauuaa

SEQ ID NO: 916341 - RNA, 19 nt, Human
agacauuuggcauacuaag

SEQ ID NO: 916342 - RNA, 21 nt, Human
aggcagcggcgcgggccccgg

SEQ ID NO: 916343 - RNA, 22 nt, Human
aguaagggagcaaugcugggga

SEQ ID NO: 916344 - RNA, 23 nt, Human
cacuaucucccucacuuuuuuug

SEQ ID NO: 916345 - RNA, 28 nt, Human
cauaaaaugggaguggcuaugcuucuga

SEQ ID NO: 916346 - RNA, 21 nt, Human
ccauauccacgccuccuuccc

SEQ ID NO: 916347 - RNA, 18 nt, Human
ccccacagaguccccagg

SEQ ID NO: 916348 - RNA, 23 nt, Human
ccuccuucccggcuggcccucag

SEQ ID NO: 916349 - RNA, 24 nt, Human
ccuccuucccggcuggcccucagg

SEQ ID NO: 916350 - RNA, 23 nt, Human
ccuuguccuuguaaguaguccua

SEQ ID NO: 916351 - RNA, 21 nt, Human
cgccgggcucuacgggucccc

SEQ ID NO: 916352 - RNA, 20 nt, Human
cuaucucccucacuuuuuuu

SEQ ID NO: 916353 - RNA, 19 nt, Human
cucaacgggcuacagagaa

SEQ ID NO: 916354 - RNA, 22 nt, Human
cuccccucacuaucucccucac

SEQ ID NO: 916355 - RNA, 22 nt, Human
gcccucaggaucucgcugucuu

SEQ ID NO: 916356 - RNA, 22 nt, Human
gcgcccgcucaccuggaccagc

SEQ ID NO: 916357 - RNA, 22 nt, Human
gcgcccgcucaccugggccagc

SEQ ID NO: 916358 - RNA, 21 nt, Human
ggccccggacuuggcagcagc

SEQ ID NO: 916359 - RNA, 23 nt, Human
guuauagcaaaagaugacauuug

SEQ ID NO: 916360 - RNA, 22 nt, Human
uaaauaucuuuucauuuaucuc

SEQ ID NO: 916361 - RNA, 24 nt, Human
uaauagaaaugugacuuacucaua

SEQ ID NO: 916362 - RNA, 21 nt, Human
uacaacuggaaaaauggaaac

SEQ ID NO: 916363 - RNA, 22 nt, Human
ucaagacauuuggcauacuaag

SEQ ID NO: 916364 - RNA, 19 nt, Human
ucaccuggaccagcgcgcc

SEQ ID NO: 916365 - RNA, 25 nt, Human
uccccacagaguccccaggacgcgc

SEQ ID NO: 916366 - RNA, 20 nt, Human
uccccgagccgcggcgcggg

SEQ ID NO: 916367 - RNA, 21 nt, Human
ucgcugucuuuacgugaaccg

SEQ ID NO: 916368 - RNA, 20 nt, Human
ucucuuuuuuugguaaaugu

SEQ ID NO: 916369 - RNA, 21 nt, Human
ugauaauuuccccauuuucca

SEQ ID NO: 916370 - RNA, 18 nt, Human
uggaaaaauggaaaccuu

SEQ ID NO: 916371 - RNA, 22 nt, Human
uggcuaugcuucugaaucgcau

SEQ ID NO: 916372 - RNA, 24 nt, Human
uuagcuauccugggguugcucccu

SEQ ID NO: 916373 - RNA, 22 nt, Human
uuuauauuugaucucuuuuuuu

SEQ ID NO: 916374 - RNA, 18 nt, Human
uuuuuugguaaauguggu

SEQ ID NO: 916375 - RNA, 18 nt, Human
uuuuuuuuuuuuuuuuug

SEQ ID NO: 916376 - RNA, 22 nt, Human
uuuuuuuuuuuuuuuuugccuu

SEQ ID NO: 916377 - RNA, 26 nt, Human
uuuuuuuuuuuuuuuuuuugccuuga

SEQ ID NO: 916378 - RNA, 20 nt, Human
cucaaaaccaggaaggaauc

SEQ ID NO: 916379 - RNA, 20 nt, Human
gguagguacuggcuucucuc

SEQ ID NO: 916380 - RNA, 18 nt, Human
uacuggcuucucuccuca

SEQ ID NO: 916381 - RNA, 23 nt, Human
agcauaaaaggcagcagaagaaa

SEQ ID NO: 916382 - RNA, 19 nt, Human
ggaagggaggugcacaagg

SEQ ID NO: 916383 - RNA, 23 nt, Human
gguugcggggaagggaggugcac

SEQ ID NO: 916384 - RNA, 21 nt, Human
uaaaaggcagcagaagaaagc

SEQ ID NO: 916385 - RNA, 23 nt, Human
aaagcccucuccaacacccaccc

SEQ ID NO: 916386 - RNA, 20 nt, Human
aacacggacauacauguacc

SEQ ID NO: 916387 - RNA, 21 nt, Human
aacccuaugagguagcuccug

SEQ ID NO: 916388 - RNA, 20 nt, Human
aaccucucaagaucagacac

SEQ ID NO: 916389 - RNA, 23 nt, Human
aaccucucaagaucagacaccaa

SEQ ID NO: 916390 - RNA, 20 nt, Human
aacugaggccuuuaaaaggu

SEQ ID NO: 916391 - RNA, 23 nt, Human
acagacauuucugugacaucccu

SEQ ID NO: 916392 - RNA, 19 nt, Human
acgcugauuggcugaggag

SEQ ID NO: 916393 - RNA, 19 nt, Human
agacccauuucacagguga

SEQ ID NO: 916394 - RNA, 20 nt, Human
agacccccuuuuuuuagagg

SEQ ID NO: 916395 - RNA, 20 nt, Human
agacccccuuuuuuuagagg

SEQ ID NO: 916396 - RNA, 23 nt, Human
agaggaggaaacuaaggcuuaga

SEQ ID NO: 916397 - RNA, 19 nt, Human
aggaggaaagaggcuggag

SEQ ID NO: 916398 - RNA, 19 nt, Human
aggcauggaggagauuuga

SEQ ID NO: 916399 - RNA, 23 nt, Human
aggccaaagcccagggcaucaga

SEQ ID NO: 916400 - RNA, 25 nt, Human
aucagacaccaaaccauaguucagc

SEQ ID NO: 916401 - RNA, 25 nt, Human
caacacggacauacauguaccuccu

SEQ ID NO: 916402 - RNA, 19 nt, Human
caagagggagguccuuugc

SEQ ID NO: 916403 - RNA, 22 nt, Human
caaggccaaagcccagggcauc

SEQ ID NO: 916404 - RNA, 20 nt, Human
cacagcacccaggcacuagg

SEQ ID NO: 916405 - RNA, 22 nt, Human
cacagcacccaggcacuagggc

SEQ ID NO: 916406 - RNA, 19 nt, Human
caccaaaccauaguucagc

SEQ ID NO: 916407 - RNA, 23 nt, Human
cagcaggagaugugguccagcau

SEQ ID NO: 916408 - RNA, 25 nt, Human
caggagaugugguccagcauuuggg

SEQ ID NO: 916409 - RNA, 21 nt, Human
cagggcaucagaaugagcuuc

SEQ ID NO: 916410 - RNA, 19 nt, Human
cagucagacaaagccccug

SEQ ID NO: 916411 - RNA, 26 nt, Human
caucaaccucucaagaucagacacca

SEQ ID NO: 916412 - RNA, 21 nt, Human
caucccuaacuucccaccugc

SEQ ID NO: 916413 - RNA, 26 nt, Human
ccaacacccaccccaauccuggauuc

SEQ ID NO: 916414 - RNA, 19 nt, Human
ccaaggcuuggcauagcca

SEQ ID NO: 916415 - RNA, 20 nt, Human
ccagaacagcaggagaugug

SEQ ID NO: 916416 - RNA, 23 nt, Human
ccccugggaggaggggagcugaa

SEQ ID NO: 916417 - RNA, 20 nt, Human
cgggaccaaugaauggagcu

SEQ ID NO: 916418 - RNA, 21 nt, Human
cuccaacacccaccccaaucc

SEQ ID NO: 916419 - RNA, 27 nt, Human
cucuccaacacccaccccaauccuggg

SEQ ID NO: 916420 - RNA, 19 nt, Human
cuggcaaggccaaagccca

SEQ ID NO: 916421 - RNA, 22 nt, Human
cuugagauccccccauucaucc

SEQ ID NO: 916422 - RNA, 22 nt, Human
cuugccagggcccacgccccca

SEQ ID NO: 916423 - RNA, 27 nt, Human
gagcccagcaggcccggugcggcggga

SEQ ID NO: 916424 - RNA, 18 nt, Human
gaggaggaggaaagaggc

SEQ ID NO: 916425 - RNA, 20 nt, Human
gagugcacuugccagggccc

SEQ ID NO: 916426 - RNA, 20 nt, Human
gccccccugggaggagggga

SEQ ID NO: 916427 - RNA, 24 nt, Human
gcugcaauaaguuacccuuucccc

SEQ ID NO: 916428 - RNA, 20 nt, Human
ggagcugcgggaggaggagg

SEQ ID NO: 916429 - RNA, 20 nt, Human
gggaggaggaggaaagaggc

SEQ ID NO: 916430 - RNA, 20 nt, Human
gggaggaggaggaaagaggc

SEQ ID NO: 916431 - RNA, 19 nt, Human
gguuuagggcugggccagg

SEQ ID NO: 916432 - RNA, 21 nt, Human
uaaaagguuacaucaaccucu

SEQ ID NO: 916433 - RNA, 21 nt, Human
uaacuucccaccugcuaccuc

SEQ ID NO: 916434 - RNA, 22 nt, Human
uaccucaggccacagcacccag

SEQ ID NO: 916435 - RNA, 21 nt, Human
ucaagaucagacaccaaacca

SEQ ID NO: 916436 - RNA, 22 nt, Human
uccaacacccaccccaauccug

SEQ ID NO: 916437 - RNA, 19 nt, Human
uccaggcuggugcccagga

SEQ ID NO: 916438 - RNA, 24 nt, Human
ucccuaacuucccaccugcuaccu

SEQ ID NO: 916439 - RNA, 22 nt, Human
ucuccaacacccaccccaaucc

SEQ ID NO: 916440 - RNA, 22 nt, Human
ugagauucccaaggcuuggcau

SEQ ID NO: 916441 - RNA, 21 nt, Human
ugcaacacggacauacaugua

SEQ ID NO: 916442 - RNA, 23 nt, Human
ugccaucuccuuuaaucugcauc

SEQ ID NO: 916443 - RNA, 21 nt, Human
ugccugcccuugguggcccca

SEQ ID NO: 916444 - RNA, 19 nt, Human
uggcugaggagugcacuug

SEQ ID NO: 916445 - RNA, 23 nt, Human
ugggcaagguccaggcuggugcc

SEQ ID NO: 916446 - RNA, 20 nt, Human
ugguacugccuggggcugcu

SEQ ID NO: 916447 - RNA, 22 nt, Human
uuauuaagugcuaagcacugua

SEQ ID NO: 916448 - RNA, 20 nt, Human
uucacaggugagcgaacuga

SEQ ID NO: 916449 - RNA, 24 nt, Human
uucacaggugagcgaacugaggcc

SEQ ID NO: 916450 - RNA, 19 nt, Human
uucauccucuugauugucc

SEQ ID NO: 916451 - RNA, 24 nt, Human
uucccaaggcuuggcauagccaug

SEQ ID NO: 916452 - RNA, 26 nt, Human
uucccaccugcuaccucaggccacag

SEQ ID NO: 916453 - RNA, 22 nt, Human
uucccuggcaaggccaaagccc

SEQ ID NO: 916454 - RNA, 22 nt, Human
uuccugaacaccacauccaggc

SEQ ID NO: 916455 - RNA, 24 nt, Human
uuguccacaacagccucugccaug

SEQ ID NO: 916456 - RNA, 20 nt, Human
uuuagagacccccuuuuuuu

SEQ ID NO: 916457 - RNA, 24 nt, Human
uuuagggcugggccaggaagggcc

SEQ ID NO: 916458 - RNA, 21 nt, Human
uuuuuuuuuuuuuuuuucauu

SEQ ID NO: 916459 - RNA, 18 nt, Human
aaagugcuggaaggcggg

SEQ ID NO: 916460 - RNA, 19 nt, Human
acccauuucuuuaguccca

SEQ ID NO: 916461 - RNA, 23 nt, Human
agaggcagcccggcaggcccuca

SEQ ID NO: 916462 - RNA, 19 nt, Human
agcccggcaggcccucagg

SEQ ID NO: 916463 - RNA, 20 nt, Human
aggaagccugggagugcccu

SEQ ID NO: 916464 - RNA, 23 nt, Human
aggcagcccggcaggcccucagg

SEQ ID NO: 916465 - RNA, 24 nt, Human
aggggcaaaguccaacgggcaucu

SEQ ID NO: 916466 - RNA, 18 nt, Human
aggggcugggccagugug

SEQ ID NO: 916467 - RNA, 20 nt, Human
agugcccuugcugggggcug

SEQ ID NO: 916468 - RNA, 22 nt, Human
caggcccucagggaggcugggg

SEQ ID NO: 916469 - RNA, 24 nt, Human
caguggcugggcuuggccuggcag

SEQ ID NO: 916470 - RNA, 20 nt, Human
ccaacgggcaucccacuccu

SEQ ID NO: 916471 - RNA, 23 nt, Human
cccagccuggaaugacagaaagu

SEQ ID NO: 916472 - RNA, 22 nt, Human
ccccucucucagaaucggagac

SEQ ID NO: 916473 - RNA, 22 nt, Human
ccugggagugcccuugcugggg

SEQ ID NO: 916474 - RNA, 23 nt, Human
ccuucaggaccagccucgggcag

SEQ ID NO: 916475 - RNA, 22 nt, Human
cucagaaucggagacacgagga

SEQ ID NO: 916476 - RNA, 19 nt, Human
cugcccgggagggcagugg

SEQ ID NO: 916477 - RNA, 18 nt, Human
cugggccagugugagggg

SEQ ID NO: 916478 - RNA, 20 nt, Human
gaaggcgggguuagugggag

SEQ ID NO: 916479 - RNA, 22 nt, Human
gaggcuggggcugggggcaggg

SEQ ID NO: 916480 - RNA, 22 nt, Human
gagugcccuugcugggggcugg

SEQ ID NO: 916481 - RNA, 19 nt, Human
gccugggagugcccuugcu

SEQ ID NO: 916482 - RNA, 25 nt, Human
ggaggcuggggcugggggcaggggu

SEQ ID NO: 916483 - RNA, 20 nt, Human
ggaggcuggggcugggggcc

SEQ ID NO: 916484 - RNA, 23 nt, Human
ggagugcccuugcugggggcugg

SEQ ID NO: 916485 - RNA, 24 nt, Human
ggagugcccuugcugggggcuggg

SEQ ID NO: 916486 - RNA, 25 nt, Human
ggcugaauggacgaggucagcuggg

SEQ ID NO: 916487 - RNA, 18 nt, Human
ggcuggggcugggggcag

SEQ ID NO: 916488 - RNA, 19 nt, Human
gggaggccccaccgucuuc

SEQ ID NO: 916489 - RNA, 18 nt, Human
gggaggcuggggcugggg

SEQ ID NO: 916490 - RNA, 18 nt, Human
gggagucaguuguccuug

SEQ ID NO: 916491 - RNA, 19 nt, Human
gggcugggggcagggguac

SEQ ID NO: 916492 - RNA, 18 nt, Human
ggggcagguggggaggcc

SEQ ID NO: 916493 - RNA, 21 nt, Human
ggguggggcagugugaggggc

SEQ ID NO: 916494 - RNA, 22 nt, Human
gucagcuggggccggugagagg

SEQ ID NO: 916495 - RNA, 24 nt, Human
uauccaaaggaggguccggcggag

SEQ ID NO: 916496 - RNA, 18 nt, Human
ucccagcccccagggaac

SEQ ID NO: 916497 - RNA, 22 nt, Human
ucggagacacgaggaauaucca

SEQ ID NO: 916498 - RNA, 25 nt, Human
ucgggguggggcagugugaggggcu

SEQ ID NO: 916499 - RNA, 21 nt, Human
ucucccaggccuggucuaugg

SEQ ID NO: 916500 - RNA, 20 nt, Human
ugagcugaugggggagucag

SEQ ID NO: 916501 - RNA, 30 nt, Human
ugccugggcccagaucugcccgggagggcc

SEQ ID NO: 916502 - RNA, 18 nt, Human
ugcugggggcuggggcag

SEQ ID NO: 916503 - RNA, 23 nt, Human
uggaaugacagaaagugcuggaa

SEQ ID NO: 916504 - RNA, 20 nt, Human
uggcaggggcugaauggacg

SEQ ID NO: 916505 - RNA, 23 nt, Human
ugggcuuggccuggcaggggcug

SEQ ID NO: 916506 - RNA, 22 nt, Human
aaaaauaguaauuucacaugac

SEQ ID NO: 916507 - RNA, 18 nt, Human
aaacagccaaauaucaaa

SEQ ID NO: 916508 - RNA, 21 nt, Human
aaauaaacagccaaauaucaa

SEQ ID NO: 916509 - RNA, 23 nt, Human
aaauauccgucccucuuccccac

SEQ ID NO: 916510 - RNA, 21 nt, Human
aaguuauaugaguaacagccc

SEQ ID NO: 916511 - RNA, 23 nt, Human
aaugacaaaaauaaacagccaaa

SEQ ID NO: 916512 - RNA, 22 nt, Human
acacucuugaaaaucuacccaa

SEQ ID NO: 916513 - RNA, 23 nt, Human
accacuuuacaagauguaaaauu

SEQ ID NO: 916514 - RNA, 26 nt, Human
aggaaaaaaacacuaaucaauuaaaa

SEQ ID NO: 916515 - RNA, 27 nt, Human
aggaaaaaaacacuaaucaauuaaaaa

SEQ ID NO: 916516 - RNA, 20 nt, Human
aguaauuucacaugacaggu

SEQ ID NO: 916517 - RNA, 18 nt, Human
agugaagggcaaaaggaa

SEQ ID NO: 916518 - RNA, 22 nt, Human
aguggcuaagguaaggggaaga

SEQ ID NO: 916519 - RNA, 21 nt, Human
aguuauaugaguaacagcccu

SEQ ID NO: 916520 - RNA, 21 nt, Human
cacaguucagcagugcaaaaa

SEQ ID NO: 916521 - RNA, 21 nt, Human
cagccaaauaucaaaacuaga

SEQ ID NO: 916522 - RNA, 22 nt, Human
cccucauuuaaagggguuuuaa

SEQ ID NO: 916523 - RNA, 18 nt, Human
cccuccccaccacuuuac

SEQ ID NO: 916524 - RNA, 21 nt, Human
ccucaaauagugaagggcaaa

SEQ ID NO: 916525 - RNA, 20 nt, Human
cuaaaacaagaccuugaaau

SEQ ID NO: 916526 - RNA, 20 nt, Human
cugauacaugacuaacacag

SEQ ID NO: 916527 - RNA, 18 nt, Human
cuggcuuuuucuucaucc

SEQ ID NO: 916528 - RNA, 22 nt, Human
gccuggaccacauagagggcuc

SEQ ID NO: 916529 - RNA, 23 nt, Human
gggguuuuaaggauuaaauauca

SEQ ID NO: 916530 - RNA, 23 nt, Human
guaacagcccuugucuucuuagu

SEQ ID NO: 916531 - RNA, 18 nt, Human
gucaugucaaaugugagg

SEQ ID NO: 916532 - RNA, 20 nt, Human
uaaaguaguuauccuaaaac

SEQ ID NO: 916533 - RNA, 18 nt, Human
uaaccaccugauaaaauu

SEQ ID NO: 916534 - RNA, 23 nt, Human
uagacuuucaaauaauacaguuu

SEQ ID NO: 916535 - RNA, 27 nt, Human
uagcaaugaagguggagaaguuaaaua

SEQ ID NO: 916536 - RNA, 24 nt, Human
uauaaaugacaaaucaagaaauua

SEQ ID NO: 916537 - RNA, 23 nt, Human
uauauuguuuuaauauaugaauu

SEQ ID NO: 916538 - RNA, 18 nt, Human
uaucagugcuguucgaag

SEQ ID NO: 916539 - RNA, 23 nt, Human
uccccuccccaccacuuuacaag

SEQ ID NO: 916540 - RNA, 21 nt, Human
uccuaaaacaagaccuugaaa

SEQ ID NO: 916541 - RNA, 25 nt, Human
ucuaagccuggaguuaaauugaagu

SEQ ID NO: 916542 - RNA, 23 nt, Human
ucugaaagcagagauaauacugg

SEQ ID NO: 916543 - RNA, 19 nt, Human
ucugaacugauacaugacu

SEQ ID NO: 916544 - RNA, 19 nt, Human
ucuguuuccccuccccacc

SEQ ID NO: 916545 - RNA, 18 nt, Human
ugaaauaauggaaaauga

SEQ ID NO: 916546 - RNA, 21 nt, Human
ugaagggcaaaaggaaacugg

SEQ ID NO: 916547 - RNA, 18 nt, Human
ugacaaaaauaaacagcc

SEQ ID NO: 916548 - RNA, 21 nt, Human
ugacaaaaauaaacagccaaa

SEQ ID NO: 916549 - RNA, 18 nt, Human
ugccuggaccacauagag

SEQ ID NO: 916550 - RNA, 21 nt, Human
ugccuggaccacauagagggc

SEQ ID NO: 916551 - RNA, 27 nt, Human
uggaaaaugacaaaaauaaacagccaa

SEQ ID NO: 916552 - RNA, 22 nt, Human
ugucaaaugugaggaaaaaaac

SEQ ID NO: 916553 - RNA, 23 nt, Human
uuaaaaauauccgucccucuucc

SEQ ID NO: 916554 - RNA, 22 nt, Human
uucacacucuugaaaaucuacc

SEQ ID NO: 916555 - RNA, 20 nt, Human
uucuguuuccccuccccacc

SEQ ID NO: 916556 - RNA, 24 nt, Human
uucuucauccaaaaauaggccauu

SEQ ID NO: 916557 - RNA, 18 nt, Human
aaaaaguacacacccgag

SEQ ID NO: 916558 - RNA, 21 nt, Human
aaacacacacuccucgcuacc

SEQ ID NO: 916559 - RNA, 23 nt, Human
aaagaaaaagagccaguugagag

SEQ ID NO: 916560 - RNA, 22 nt, Human
aaagagccaguugagagcagac

SEQ ID NO: 916561 - RNA, 19 nt, Human
aaauacacacucacaaaca

SEQ ID NO: 916562 - RNA, 23 nt, Human
aaauacacacucacaaacacaca

SEQ ID NO: 916563 - RNA, 21 nt, Human
aaauacugaaagugcagagau

SEQ ID NO: 916564 - RNA, 20 nt, Human
aaccugccaauccgcaucca

SEQ ID NO: 916565 - RNA, 19 nt, Human
aagauccuucaugcucuuc

SEQ ID NO: 916566 - RNA, 21 nt, Human
aagcaaaaaguacacacccga

SEQ ID NO: 916567 - RNA, 22 nt, Human
acaaagcaaaaaguacacaccc

SEQ ID NO: 916568 - RNA, 21 nt, Human
acaauugauacugccauugau

SEQ ID NO: 916569 - RNA, 21 nt, Human
agacgagaaagaggcagcuag

SEQ ID NO: 916570 - RNA, 18 nt, Human
aggcaguggagggagggg

SEQ ID NO: 916571 - RNA, 18 nt, Human
aggcucuugacacuguug

SEQ ID NO: 916572 - RNA, 21 nt, Human
aggggcacaaaaaugcaagcu

SEQ ID NO: 916573 - RNA, 21 nt, Human
aguaaacagcaaaaaauauaa

SEQ ID NO: 916574 - RNA, 27 nt, Human
auuucuuucucuucuuccuucccuaga

SEQ ID NO: 916575 - RNA, 20 nt, Human
caacuucuggguaccacacc

SEQ ID NO: 916576 - RNA, 20 nt, Human
cacacuccucgcuaccugaa

SEQ ID NO: 916577 - RNA, 18 nt, Human
cagacgagaaagaggcag

SEQ ID NO: 916578 - RNA, 19 nt, Human
caggcucuugacacuguug

SEQ ID NO: 916579 - RNA, 25 nt, Human
cauccagaauuccaucuaauuacuc

SEQ ID NO: 916580 - RNA, 24 nt, Human
ccaaacuuuuucaaauagccccaa

SEQ ID NO: 916581 - RNA, 20 nt, Human
ccccaaacacccguaggacc

SEQ ID NO: 916582 - RNA, 22 nt, Human
ccccaaacacccguaggaccuc

SEQ ID NO: 916583 - RNA, 24 nt, Human
ccccccuucuucuucaguaauccc

SEQ ID NO: 916584 - RNA, 22 nt, Human
cccuaagccaaaauaaguucac

SEQ ID NO: 916585 - RNA, 20 nt, Human
cgagaaagaggcagcuagca

SEQ ID NO: 916586 - RNA, 22 nt, Human
cuacacaaaaagaaaaagagcc

SEQ ID NO: 916587 - RNA, 19 nt, Human
cuagaagagaagacccaca

SEQ ID NO: 916588 - RNA, 18 nt, Human
cucaagagagagagucau

SEQ ID NO: 916589 - RNA, 19 nt, Human
cucaagagagagagucaug

SEQ ID NO: 916590 - RNA, 20 nt, Human
cucagauuucuuucuuuuuu

SEQ ID NO: 916591 - RNA, 21 nt, Human
cucagauuucuuucuuuuuuu

SEQ ID NO: 916592 - RNA, 22 nt, Human
cucagauuucuuucuuuuuuuu

SEQ ID NO: 916593 - RNA, 23 nt, Human
cucagauuucuuucuuuuuuuuu

SEQ ID NO: 916594 - RNA, 22 nt, Human
cucucuccuucuguacuuccca

SEQ ID NO: 916595 - RNA, 21 nt, Human
cugaaagauggcaauccauuc

SEQ ID NO: 916596 - RNA, 18 nt, Human
cuguacuuuaguccuugc

SEQ ID NO: 916597 - RNA, 21 nt, Human
cuuucuguccucaaagucuca

SEQ ID NO: 916598 - RNA, 22 nt, Human
gacaauugauacugccauugau

SEQ ID NO: 916599 - RNA, 22 nt, Human
gaccucucuccucuugcuguac

SEQ ID NO: 916600 - RNA, 23 nt, Human
gagugaugggcagacgagaaaga

SEQ ID NO: 916601 - RNA, 20 nt, Human
gcagggcaagaguugaggau

SEQ ID NO: 916602 - RNA, 22 nt, Human
gccuaugauucucuccuacuug

SEQ ID NO: 916603 - RNA, 20 nt, Human
gcggagagcagggcaagagu

SEQ ID NO: 916604 - RNA, 20 nt, Human
ggcaguggagggaggggcuu

SEQ ID NO: 916605 - RNA, 20 nt, Human
gggcaagaguugaggauagg

SEQ ID NO: 916606 - RNA, 22 nt, Human
uaaaacaaauugcuagaacuuu

SEQ ID NO: 916607 - RNA, 24 nt, Human
uaaaguucuuuggggugccaguuu

SEQ ID NO: 916608 - RNA, 18 nt, Human
uaagggaaacuacacaaa

SEQ ID NO: 916609 - RNA, 21 nt, Human
uaauuuuuagcuuaguaaaca

SEQ ID NO: 916610 - RNA, 21 nt, Human
uacacaaaaagaaaaagagcc

SEQ ID NO: 916611 - RNA, 23 nt, Human
uacacacucacaaacacacacuc

SEQ ID NO: 916612 - RNA, 18 nt, Human
uacuagaagagaagaccc

SEQ ID NO: 916613 - RNA, 19 nt, Human
uagaaagaugggaaaauaa

SEQ ID NO: 916614 - RNA, 20 nt, Human
uagaaagaugggaaaauaag

SEQ ID NO: 916615 - RNA, 21 nt, Human
uagaagagaagacccacaggc

SEQ ID NO: 916616 - RNA, 18 nt, Human
uagcuuaguaaacagcaa

SEQ ID NO: 916617 - RNA, 22 nt, Human
uaucuaucauauuuccccuucc

SEQ ID NO: 916618 - RNA, 22 nt, Human
ucaaccugccaauccgcaucca

SEQ ID NO: 916619 - RNA, 22 nt, Human
ucaugcucuuccuccuucuucc

SEQ ID NO: 916620 - RNA, 26 nt, Human
ucaugcucuuccuccuucuuccauuu

SEQ ID NO: 916621 - RNA, 20 nt, Human
ucauucacccuuuguuuccc

SEQ ID NO: 916622 - RNA, 19 nt, Human
ucccagaaagcucagauuu

SEQ ID NO: 916623 - RNA, 22 nt, Human
uccccaaacacccguaggaccu

SEQ ID NO: 916624 - RNA, 19 nt, Human
uccccucacugauacuaga

SEQ ID NO: 916625 - RNA, 23 nt, Human
uccuucaguuugaugcuuggggu

SEQ ID NO: 916626 - RNA, 22 nt, Human
ucuacagaaccagaagucaacu

SEQ ID NO: 916627 - RNA, 24 nt, Human
ucucucaaauacacacucacaaac

SEQ ID NO: 916628 - RNA, 21 nt, Human
ucuuccuccuucuuccauuuc

SEQ ID NO: 916629 - RNA, 18 nt, Human
ucuuucucuucuuccuuc

SEQ ID NO: 916630 - RNA, 23 nt, Human
ucuuucuuuuuuuuuccccccuu

SEQ ID NO: 916631 - RNA, 29 nt, Human
ucuuucuuuuuuuuuccccccuucccucc

SEQ ID NO: 916632 - RNA, 21 nt, Human
ugagggaggaggguccuuaua

SEQ ID NO: 916633 - RNA, 20 nt, Human
ugccaauccgcauccauaga

SEQ ID NO: 916634 - RNA, 20 nt, Human
ugccucugaggcaguggagg

SEQ ID NO: 916635 - RNA, 23 nt, Human
uggcguccaggcucuugacacuu

SEQ ID NO: 916636 - RNA, 19 nt, Human
ugggugggacugaguaguu

SEQ ID NO: 916637 - RNA, 25 nt, Human
ugucugugaagguuagaauguuucc

SEQ ID NO: 916638 - RNA, 21 nt, Human
ugugaagguuagaauguuucc

SEQ ID NO: 916639 - RNA, 20 nt, Human
uuacugccucugaggcagug

SEQ ID NO: 916640 - RNA, 23 nt, Human
uucacagaccaaacuuuuucaaa

SEQ ID NO: 916641 - RNA, 19 nt, Human
uucaguaaucccuccccuc

SEQ ID NO: 916642 - RNA, 18 nt, Human
uuccucccagaaagcuca

SEQ ID NO: 916643 - RNA, 21 nt, Human
uuccuccugggucggccucuc

SEQ ID NO: 916644 - RNA, 21 nt, Human
uucuuuuuuuuuccccccuuc

SEQ ID NO: 916645 - RNA, 19 nt, Human
uugacacuguugugagaag

SEQ ID NO: 916646 - RNA, 21 nt, Human
uuggaaaauacugaaagugca

SEQ ID NO: 916647 - RNA, 21 nt, Human
uuguucuucuucauucacccu

SEQ ID NO: 916648 - RNA, 19 nt, Human
uuugcagucaccagggaaa

SEQ ID NO: 916649 - RNA, 20 nt, Human
uuuggggugccaguuugcug

SEQ ID NO: 916650 - RNA, 18 nt, Human
agaaaaaguccagacagc

SEQ ID NO: 916651 - RNA, 18 nt, Human
cugcgucucagugggaca

SEQ ID NO: 916652 - RNA, 21 nt, Human
gaacgcgacccucacacccuc

SEQ ID NO: 916653 - RNA, 20 nt, Human
gacagcaggaacgcgacccu

SEQ ID NO: 916654 - RNA, 20 nt, Human
ucagggcaaguguaaguaug

SEQ ID NO: 916655 - RNA, 18 nt, Human
uuuuuuuuuuuuuuuuug

SEQ ID NO: 916656 - RNA, 23 nt, Human
aaaaagguaucccaagcuacccu

SEQ ID NO: 916657 - RNA, 21 nt, Human
aaacagaauugcagaccugug

SEQ ID NO: 916658 - RNA, 26 nt, Human
aaaggccuucucuccugcccauuggu

SEQ ID NO: 916659 - RNA, 20 nt, Human
aaaggguuuaaacaguugcu

SEQ ID NO: 916660 - RNA, 22 nt, Human
aacaaaugcagucauggaagau

SEQ ID NO: 916661 - RNA, 22 nt, Human
aaccaagugaaccuagacagaa

SEQ ID NO: 916662 - RNA, 19 nt, Human
aaccaggccacuaaggcuu

SEQ ID NO: 916663 - RNA, 21 nt, Human
aagagcuagggagcuaaauuu

SEQ ID NO: 916664 - RNA, 19 nt, Human
aagcaggcaauggagccaa

SEQ ID NO: 916665 - RNA, 19 nt, Human
aagcgucucaaggguccca

SEQ ID NO: 916666 - RNA, 19 nt, Human
aaggaaaauuuugguuugg

SEQ ID NO: 916667 - RNA, 20 nt, Human
aaggaugggguuccugggcu

SEQ ID NO: 916668 - RNA, 22 nt, Human
aagugaccuucuacagcagggc

SEQ ID NO: 916669 - RNA, 22 nt, Human
aaucaaaacacacuuacuccaa

SEQ ID NO: 916670 - RNA, 23 nt, Human
aaucaaaacacacuuacuccaaa

SEQ ID NO: 916671 - RNA, 20 nt, Human
acaggaguggggaaggcaag

SEQ ID NO: 916672 - RNA, 18 nt, Human
acauuguggauaaggaaa

SEQ ID NO: 916673 - RNA, 22 nt, Human
acgcagcuuucagaaaacaauc

SEQ ID NO: 916674 - RNA, 20 nt, Human
acuguaaaguggaagagaca

SEQ ID NO: 916675 - RNA, 19 nt, Human
agaaaacaaucucuucacc

SEQ ID NO: 916676 - RNA, 20 nt, Human
agaaaacagcuaccaaaaag

SEQ ID NO: 916677 - RNA, 18 nt, Human
agaaggagguucuggcgc

SEQ ID NO: 916678 - RNA, 18 nt, Human
agaauucgagggagggac

SEQ ID NO: 916679 - RNA, 21 nt, Human
agacaggaggugggggcaagg

SEQ ID NO: 916680 - RNA, 20 nt, Human
agacauuuuaauaucuggug

SEQ ID NO: 916681 - RNA, 24 nt, Human
agacucugcuuccaagacuaauag

SEQ ID NO: 916682 - RNA, 22 nt, Human
agagccugaacccccaaaccaa

SEQ ID NO: 916683 - RNA, 20 nt, Human
agagcuagggagcuaaauuu

SEQ ID NO: 916684 - RNA, 22 nt, Human
agagggcagguggagagaggac

SEQ ID NO: 916685 - RNA, 19 nt, Human
agauaagagggcaggugga

SEQ ID NO: 916686 - RNA, 18 nt, Human
agcugagggccucugugg

SEQ ID NO: 916687 - RNA, 19 nt, Human
agcugagggccucuguggg

SEQ ID NO: 916688 - RNA, 21 nt, Human
aggaagagggccaaguguggc

SEQ ID NO: 916689 - RNA, 23 nt, Human
aggaagagggccaaguguggcuc

SEQ ID NO: 916690 - RNA, 21 nt, Human
aggacugguaggaggcugagg

SEQ ID NO: 916691 - RNA, 22 nt, Human
aggagguggcugcguaccaagg

SEQ ID NO: 916692 - RNA, 19 nt, Human
aggcccaguggccucugua

SEQ ID NO: 916693 - RNA, 21 nt, Human
aggcgggggugggggcacagg

SEQ ID NO: 916694 - RNA, 24 nt, Human
aggcucucagcucugucacagccu

SEQ ID NO: 916695 - RNA, 23 nt, Human
agggagggacaggaaagggcagg

SEQ ID NO: 916696 - RNA, 20 nt, Human
agggcugugcucucugcagc

SEQ ID NO: 916697 - RNA, 24 nt, Human
aggugggcuucuugggcaauuucu

SEQ ID NO: 916698 - RNA, 21 nt, Human
aggugggggcaaggccccggu

SEQ ID NO: 916699 - RNA, 21 nt, Human
aucaaaacacacuuacuccaa

SEQ ID NO: 916700 - RNA, 25 nt, Human
augaaaaccagauacaacaaagagg

SEQ ID NO: 916701 - RNA, 27 nt, Human
augaaaaccagauacaacaaagaggau

SEQ ID NO: 916702 - RNA, 18 nt, Human
augguccaaaaaaaaaaa

SEQ ID NO: 916703 - RNA, 18 nt, Human
augguccaaaaaaaaaaa

SEQ ID NO: 916704 - RNA, 23 nt, Human
augguccaaaaaaaaaaagguga

SEQ ID NO: 916705 - RNA, 20 nt, Human
caacaccugccuaaggcaaa

SEQ ID NO: 916706 - RNA, 23 nt, Human
caacuggaauggacugaugggaa

SEQ ID NO: 916707 - RNA, 21 nt, Human
caagaggccuccccauucucc

SEQ ID NO: 916708 - RNA, 24 nt, Human
caagugaccuucuacagcagggcc

SEQ ID NO: 916709 - RNA, 18 nt, Human
caccaacccagacucugc

SEQ ID NO: 916710 - RNA, 20 nt, Human
cacccuuuucccucgccaua

SEQ ID NO: 916711 - RNA, 18 nt, Human
caccugccuaaggcaaag

SEQ ID NO: 916712 - RNA, 21 nt, Human
cagaagaaaagaacuaaucau

SEQ ID NO: 916713 - RNA, 23 nt, Human
cagacacuggaauuuuuuuuuuu

SEQ ID NO: 916714 - RNA, 19 nt, Human
cagaguggaagcgucucaa

SEQ ID NO: 916715 - RNA, 26 nt, Human
cagaguuccaggagaggccagggugg

SEQ ID NO: 916716 - RNA, 24 nt, Human
caggaggugggggcaaggccccgg

SEQ ID NO: 916717 - RNA, 23 nt, Human
caggccacuaaggcuuuuuuuuu

SEQ ID NO: 916718 - RNA, 21 nt, Human
cauggaagauggcagagacug

SEQ ID NO: 916719 - RNA, 24 nt, Human
cauugaaaaaucuacuuuaacaaa

SEQ ID NO: 916720 - RNA, 21 nt, Human
cauugcuggcagaggcuggag

SEQ ID NO: 916721 - RNA, 18 nt, Human
ccaaaaagggagggggga

SEQ ID NO: 916722 - RNA, 23 nt, Human
ccaacaauuccacaacuucccgg

SEQ ID NO: 916723 - RNA, 24 nt, Human
ccaacaauuccacaacuucccgga

SEQ ID NO: 916724 - RNA, 19 nt, Human
cccagaaacugcugacugc

SEQ ID NO: 916725 - RNA, 19 nt, Human
cccaggacuguacucagcc

SEQ ID NO: 916726 - RNA, 22 nt, Human
cccccaggacuguacucagccc

SEQ ID NO: 916727 - RNA, 20 nt, Human
cccccaggacuguacucagg

SEQ ID NO: 916728 - RNA, 22 nt, Human
cccgaccccccagauuuuagga

SEQ ID NO: 916729 - RNA, 24 nt, Human
cccgguaguggcggcggucgggcc

SEQ ID NO: 916730 - RNA, 18 nt, Human
cccugagcuaccucccuu

SEQ ID NO: 916731 - RNA, 18 nt, Human
ccgccaggcccccucagg

SEQ ID NO: 916732 - RNA, 19 nt, Human
ccgccaggcccccucaggc

SEQ ID NO: 916733 - RNA, 23 nt, Human
ccuccuuugcuauccacaccaac

SEQ ID NO: 916734 - RNA, 19 nt, Human
ccugaacccccaaaccaag

SEQ ID NO: 916735 - RNA, 19 nt, Human
ccuuaauuagucccuggga

SEQ ID NO: 916736 - RNA, 20 nt, Human
ccuuugaacaaccaggccac

SEQ ID NO: 916737 - RNA, 20 nt, Human
cgccauagacccuacucucc

SEQ ID NO: 916738 - RNA, 22 nt, Human
cgcucggggccccacgcugcgg

SEQ ID NO: 916739 - RNA, 21 nt, Human
cuagagccugaacccccaaac

SEQ ID NO: 916740 - RNA, 23 nt, Human
cucaguaagcauacugaagugag

SEQ ID NO: 916741 - RNA, 21 nt, Human
cuccacacaggcucucagcuc

SEQ ID NO: 916742 - RNA, 23 nt, Human
cuccauaacagagccaaaaacug

SEQ ID NO: 916743 - RNA, 19 nt, Human
cuccuuucccugccuccca

SEQ ID NO: 916744 - RNA, 26 nt, Human
cugaaacccuacuggagaagucagca

SEQ ID NO: 916745 - RNA, 24 nt, Human
cugcuguggggucugcagguuggg

SEQ ID NO: 916746 - RNA, 21 nt, Human
cuggaggcgggggugggggca

SEQ ID NO: 916747 - RNA, 24 nt, Human
cuggaggcgggggugggggcacag

SEQ ID NO: 916748 - RNA, 19 nt, Human
cuggcagaggcuggaggug

SEQ ID NO: 916749 - RNA, 23 nt, Human
cuggucccucauuggucuuuguc

SEQ ID NO: 916750 - RNA, 20 nt, Human
cuguccugggcagaugcccc

SEQ ID NO: 916751 - RNA, 19 nt, Human
cuguggggucugcagguug

SEQ ID NO: 916752 - RNA, 27 nt, Human
gaaagccuccccauccgcuccacacag

SEQ ID NO: 916753 - RNA, 18 nt, Human
gaaccuagacagaaggug

SEQ ID NO: 916754 - RNA, 19 nt, Human
gaaccucauuggcgcuccu

SEQ ID NO: 916755 - RNA, 20 nt, Human
gaagcccaugaagaacugag

SEQ ID NO: 916756 - RNA, 23 nt, Human
gaaggugggugagggaggacugg

SEQ ID NO: 916757 - RNA, 18 nt, Human
gaggacacugagaggagg

SEQ ID NO: 916758 - RNA, 22 nt, Human
gagguggcugcguaccaaggua

SEQ ID NO: 916759 - RNA, 20 nt, Human
gcaaggagaaaagacaggag

SEQ ID NO: 916760 - RNA, 22 nt, Human
gcagauauuauuccucuguacc

SEQ ID NO: 916761 - RNA, 19 nt, Human
gccccgguaguggcggcgg

SEQ ID NO: 916762 - RNA, 19 nt, Human
gccgcgcucgggcuccgcc

SEQ ID NO: 916763 - RNA, 18 nt, Human
gccugaccaacugacugc

SEQ ID NO: 916764 - RNA, 22 nt, Human
gcgcucggggccccacgcugcg

SEQ ID NO: 916765 - RNA, 20 nt, Human
gcggaaaacuggaggcgggg

SEQ ID NO: 916766 - RNA, 23 nt, Human
gcuccaggcaagggcugugcucc

SEQ ID NO: 916767 - RNA, 23 nt, Human
gcugaagcagaaagcugaguccu

SEQ ID NO: 916768 - RNA, 21 nt, Human
gcuggagguggcagggaaagg

SEQ ID NO: 916769 - RNA, 23 nt, Human
gcuggagguggcagggaaagggg

SEQ ID NO: 916770 - RNA, 22 nt, Human
ggaaaagggacaggugggagga

SEQ ID NO: 916771 - RNA, 20 nt, Human
ggaaagacaggauagauggg

SEQ ID NO: 916772 - RNA, 23 nt, Human
ggaaagacaggauagaugggagg

SEQ ID NO: 916773 - RNA, 27 nt, Human
ggaaaggacuccucuaacagcccggga

SEQ ID NO: 916774 - RNA, 22 nt, Human
ggaaucgauccuagagccugaa

SEQ ID NO: 916775 - RNA, 23 nt, Human
ggaauuuuuccaaaccccucuau

SEQ ID NO: 916776 - RNA, 22 nt, Human
ggagaaaacagcuaccaaaaag

SEQ ID NO: 916777 - RNA, 23 nt, Human
ggcaguuaaggugagaaggguug

SEQ ID NO: 916778 - RNA, 20 nt, Human
ggcgggggugggggcacagg

SEQ ID NO: 916779 - RNA, 18 nt, Human
ggcggggguugcagggaa

SEQ ID NO: 916780 - RNA, 21 nt, Human
ggcggugggcuggagggcggg

SEQ ID NO: 916781 - RNA, 21 nt, Human
ggcuccgccaggcccccucag

SEQ ID NO: 916782 - RNA, 22 nt, Human
ggcuggagguggcagggaaagg

SEQ ID NO: 916783 - RNA, 23 nt, Human
gggaaccucauuggcgcuccuuu

SEQ ID NO: 916784 - RNA, 18 nt, Human
gggaccagaaggugggcu

SEQ ID NO: 916785 - RNA, 23 nt, Human
gggaguuuaaaggacuacuaggg

SEQ ID NO: 916786 - RNA, 19 nt, Human
gggcaugccuuucauuucu

SEQ ID NO: 916787 - RNA, 22 nt, Human
gggcuggagggcggggguugca

SEQ ID NO: 916788 - RNA, 19 nt, Human
ggggaggugacggacgugg

SEQ ID NO: 916789 - RNA, 19 nt, Human
ggggauggggaggugacgg

SEQ ID NO: 916790 - RNA, 22 nt, Human
gggguugcagggaaccucauug

SEQ ID NO: 916791 - RNA, 21 nt, Human
gguucuggcgcuuuggagagg

SEQ ID NO: 916792 - RNA, 18 nt, Human
guacaggaggaaugggug

SEQ ID NO: 916793 - RNA, 22 nt, Human
guuccugggcuccaggcaaggg

SEQ ID NO: 916794 - RNA, 21 nt, Human
uaacaugcacagcaugcagga

SEQ ID NO: 916795 - RNA, 20 nt, Human
uaccagcaaaguucacaguu

SEQ ID NO: 916796 - RNA, 18 nt, Human
uagaagcaaaucaucuag

SEQ ID NO: 916797 - RNA, 25 nt, Human
uagagccugaacccccaaaccaagu

SEQ ID NO: 916798 - RNA, 18 nt, Human
uauaauacaagucccaau

SEQ ID NO: 916799 - RNA, 21 nt, Human
uaugagaucuuuucacggggu

SEQ ID NO: 916800 - RNA, 23 nt, Human
ucaagaugaugcagagauccuuu

SEQ ID NO: 916801 - RNA, 23 nt, Human
ucagaagaaaagaacuaaucauu

SEQ ID NO: 916802 - RNA, 20 nt, Human
ucagaguggaagcgucucaa

SEQ ID NO: 916803 - RNA, 22 nt, Human
ucagcccugaccagcuacugug

SEQ ID NO: 916804 - RNA, 23 nt, Human
ucaguuccugaugacaaaccaag

SEQ ID NO: 916805 - RNA, 23 nt, Human
ucauaauguacuuggagaaaaac

SEQ ID NO: 916806 - RNA, 19 nt, Human
ucauggaagauggcagaga

SEQ ID NO: 916807 - RNA, 19 nt, Human
ucaugggggacacagacgg

SEQ ID NO: 916808 - RNA, 22 nt, Human
uccaaaccccucuauggaggca

SEQ ID NO: 916809 - RNA, 22 nt, Human
uccacagcagguucagaguucc

SEQ ID NO: 916810 - RNA, 20 nt, Human
uccaggcaagggcugugcuc

SEQ ID NO: 916811 - RNA, 28 nt, Human
uccauaacagagccaaaaaccggggucc

SEQ ID NO: 916812 - RNA, 25 nt, Human
ucccaauaacaugcacaggguaccc

SEQ ID NO: 916813 - RNA, 18 nt, Human
uccgugagugggaagagu

SEQ ID NO: 916814 - RNA, 19 nt, Human
uccuucuggaaucgauccu

SEQ ID NO: 916815 - RNA, 23 nt, Human
ucucaagggucccacaguggagg

SEQ ID NO: 916816 - RNA, 18 nt, Human
ucugaaucagaguggaag

SEQ ID NO: 916817 - RNA, 28 nt, Human
ucugcagguugggaccagaaggugggcu

SEQ ID NO: 916818 - RNA, 19 nt, Human
ucuggaaucgauccuagag

SEQ ID NO: 916819 - RNA, 23 nt, Human
ugaaaacggaggugcugguacag

SEQ ID NO: 916820 - RNA, 22 nt, Human
ugaaacccucugugucuccaag

SEQ ID NO: 916821 - RNA, 23 nt, Human
ugaacccccaaaccaagugcucc

SEQ ID NO: 916822 - RNA, 24 nt, Human
ugaacccccaaaccaagugcuccu

SEQ ID NO: 916823 - RNA, 20 nt, Human
ugaaccuagacagaaggugg

SEQ ID NO: 916824 - RNA, 20 nt, Human
ugacacacaaagaaaucgga

SEQ ID NO: 916825 - RNA, 18 nt, Human
ugaccucaaaugaagaga

SEQ ID NO: 916826 - RNA, 19 nt, Human
ugagaaagccuccccaucc

SEQ ID NO: 916827 - RNA, 21 nt, Human
ugagaaguggugucucaggag

SEQ ID NO: 916828 - RNA, 18 nt, Human
ugagagaagugcccagaa

SEQ ID NO: 916829 - RNA, 18 nt, Human
ugagaguguagggaaggu

SEQ ID NO: 916830 - RNA, 23 nt, Human
ugagcugagggccucuguggggg

SEQ ID NO: 916831 - RNA, 20 nt, Human
ugaggcaccuacugagagaa

SEQ ID NO: 916832 - RNA, 20 nt, Human
ugaggugacuguguaaacgg

SEQ ID NO: 916833 - RNA, 22 nt, Human
ugagucuagugaugaaaaccag

SEQ ID NO: 916834 - RNA, 21 nt, Human
ugcacagcaugcaggaggugg

SEQ ID NO: 916835 - RNA, 22 nt, Human
ugcagccagaggcccaguggcc

SEQ ID NO: 916836 - RNA, 30 nt, Human
ugcaggauaaagcuauucuuauccuuugaa

SEQ ID NO: 916837 - RNA, 21 nt, Human
ugcccagaaacugcugacugc

SEQ ID NO: 916838 - RNA, 25 nt, Human
ugccuucaugggggacacagacggg

SEQ ID NO: 916839 - RNA, 23 nt, Human
uggaagagacagaagggacauug

SEQ ID NO: 916840 - RNA, 19 nt, Human
uggauucucacauaccauc

SEQ ID NO: 916841 - RNA, 20 nt, Human
uggcaagggaggugaaaugg

SEQ ID NO: 916842 - RNA, 26 nt, Human
ugggaccagaaggugggcuucuuggg

SEQ ID NO: 916843 - RNA, 19 nt, Human
ugggaggaagaccaaugag

SEQ ID NO: 916844 - RNA, 20 nt, Human
ugggaggacacaggaguggg

SEQ ID NO: 916845 - RNA, 20 nt, Human
ugggaggacacaggaguggg

SEQ ID NO: 916846 - RNA, 24 nt, Human
ugggagggggacagcucauugcug

SEQ ID NO: 916847 - RNA, 25 nt, Human
ugggagggggacagcucauugcugg

SEQ ID NO: 916848 - RNA, 24 nt, Human
ugggcuggagggcggggguugcag

SEQ ID NO: 916849 - RNA, 18 nt, Human
ugggggacacagacgggg

SEQ ID NO: 916850 - RNA, 18 nt, Human
ugguuggaagcaggcaau

SEQ ID NO: 916851 - RNA, 18 nt, Human
uuaaaaagcaaaauauuu

SEQ ID NO: 916852 - RNA, 22 nt, Human
uucaccgcgcucggggccccac

SEQ ID NO: 916853 - RNA, 21 nt, Human
uucaugggggacacagacggg

SEQ ID NO: 916854 - RNA, 19 nt, Human
uuccccccgaccccccaga

SEQ ID NO: 916855 - RNA, 24 nt, Human
uucccggauuuucaauuaagaaaa

SEQ ID NO: 916856 - RNA, 18 nt, Human
uuccuugugggugcugag

SEQ ID NO: 916857 - RNA, 21 nt, Human
uugcagaccugugagaaaacu

SEQ ID NO: 916858 - RNA, 21 nt, Human
uuuaggaagggagguuuaaga

SEQ ID NO: 916859 - RNA, 22 nt, Human
uuuuuuuccuggucccucauug

SEQ ID NO: 916860 - RNA, 23 nt, Human
uuuuuuuuugaacccagcucuga

SEQ ID NO: 916861 - RNA, 20 nt, Human
aaaguuuuauuggaauacag

SEQ ID NO: 916862 - RNA, 23 nt, Human
aagcuugcugacccuugcucuaa

SEQ ID NO: 916863 - RNA, 19 nt, Human
aguccucccaaagaacaaa

SEQ ID NO: 916864 - RNA, 20 nt, Human
aguguccauaaauaaaguuu

SEQ ID NO: 916865 - RNA, 22 nt, Human
aguucagaaaucaucaauuucc

SEQ ID NO: 916866 - RNA, 20 nt, Human
caagguuuuaauaaaaugac

SEQ ID NO: 916867 - RNA, 21 nt, Human
cacagguuuugacuauugcuc

SEQ ID NO: 916868 - RNA, 20 nt, Human
caggguuuuaaggugguaga

SEQ ID NO: 916869 - RNA, 18 nt, Human
cuccaccuggguuaaaca

SEQ ID NO: 916870 - RNA, 19 nt, Human
ucaguguccauaaauaaag

SEQ ID NO: 916871 - RNA, 21 nt, Human
ugcucuauuuuuccucccugg

SEQ ID NO: 916872 - RNA, 25 nt, Human
ugcucuauuuuuccucccuggugau

SEQ ID NO: 916873 - RNA, 21 nt, Human
ugcugacccuugcucuaaguc

SEQ ID NO: 916874 - RNA, 21 nt, Human
uggcaguccccugggcuucau

SEQ ID NO: 916875 - RNA, 21 nt, Human
uguguugucuauggcugcuuu

SEQ ID NO: 916876 - RNA, 18 nt, Human
uuaaagaucuccaccugg

SEQ ID NO: 916877 - RNA, 18 nt, Human
uuauuggaauacagccac

SEQ ID NO: 916878 - RNA, 20 nt, Human
uucaguguccauaaauaaag

SEQ ID NO: 916879 - RNA, 19 nt, Human
uucuagaucaggguuuuaa

SEQ ID NO: 916880 - RNA, 23 nt, Human
uugcucuauuuuuccucccuggu

SEQ ID NO: 916881 - RNA, 22 nt, Human
uugguugguggcaacuagcccu

SEQ ID NO: 916882 - RNA, 22 nt, Human
uuuuccaacugcugacauuuau

SEQ ID NO: 916883 - RNA, 23 nt, Human
uuuuuuuuuuuuuuuuuuuucag

SEQ ID NO: 916884 - RNA, 21 nt, Human
aaaaugagugcuagacucuca

SEQ ID NO: 916885 - RNA, 24 nt, Human
aaacaaagccaacaccucuaagcc

SEQ ID NO: 916886 - RNA, 27 nt, Human
aaacaagaaugagaaaccagaguccuu

SEQ ID NO: 916887 - RNA, 23 nt, Human
aagaaagaaaacaagaaugagaa

SEQ ID NO: 916888 - RNA, 21 nt, Human
aagccaacaccucuaagcugg

SEQ ID NO: 916889 - RNA, 19 nt, Human
aauaaauauuuuuuaaagu

SEQ ID NO: 916890 - RNA, 23 nt, Human
acacacacacacacacacacaca

SEQ ID NO: 916891 - RNA, 23 nt, Human
acacacacacacacacacacaca

SEQ ID NO: 916892 - RNA, 23 nt, Human
acacacacacacacacacacaca

SEQ ID NO: 916893 - RNA, 23 nt, Human
acacacacacacacacacacaca

SEQ ID NO: 916894 - RNA, 29 nt, Human
acacacacacacacacacacacacucuuc

SEQ ID NO: 916895 - RNA, 24 nt, Human
acacacacacacacacacacacag

SEQ ID NO: 916896 - RNA, 27 nt, Human
acacacacacacacacacacacucuuc

SEQ ID NO: 916897 - RNA, 22 nt, Human
acacacacacucuuccacaggc

SEQ ID NO: 916898 - RNA, 20 nt, Human
acuacacugaaauacugaca

SEQ ID NO: 916899 - RNA, 21 nt, Human
agauaaauuaacuacacugaa

SEQ ID NO: 916900 - RNA, 20 nt, Human
agcuuuucaaaauaaaagca

SEQ ID NO: 916901 - RNA, 22 nt, Human
agguuuccccaaauuagcauau

SEQ ID NO: 916902 - RNA, 22 nt, Human
caaacauuacacucaaguacuu

SEQ ID NO: 916903 - RNA, 26 nt, Human
caacacagaauagauuuuaacagaau

SEQ ID NO: 916904 - RNA, 23 nt, Human
caaggaauaacucacuaaaugaa

SEQ ID NO: 916905 - RNA, 20 nt, Human
cacacacacacacacacaca

SEQ ID NO: 916906 - RNA, 20 nt, Human
cacacacacacacacacaca

SEQ ID NO: 916907 - RNA, 20 nt, Human
cacacacacacacacacaca

SEQ ID NO: 916908 - RNA, 20 nt, Human
cacacacacacacacacaca

SEQ ID NO: 916909 - RNA, 20 nt, Human
cacacacacacacacacaca

SEQ ID NO: 916910 - RNA, 20 nt, Human
cacacacacacacacacaca

SEQ ID NO: 916911 - RNA, 20 nt, Human
cacacacacacacacacaca

SEQ ID NO: 916912 - RNA, 20 nt, Human
cacacacacacacacacaca

SEQ ID NO: 916913 - RNA, 20 nt, Human
cacacacacacacacacaca

SEQ ID NO: 916914 - RNA, 22 nt, Human
cacacacacacacacacacaca

SEQ ID NO: 916915 - RNA, 22 nt, Human
cacacacacacacacacacaca

SEQ ID NO: 916916 - RNA, 22 nt, Human
cacacacacacacacacacaca

SEQ ID NO: 916917 - RNA, 22 nt, Human
cacacacacacacacacacaca

SEQ ID NO: 916918 - RNA, 26 nt, Human
cacacacacacacacacacacacaca

SEQ ID NO: 916919 - RNA, 26 nt, Human
cacacacacacacacacacacacaca

SEQ ID NO: 916920 - RNA, 26 nt, Human
cacacacacacacacacacacacaca

SEQ ID NO: 916921 - RNA, 26 nt, Human
cacacacacacacacacacacacaca

SEQ ID NO: 916922 - RNA, 26 nt, Human
cacacacacacacacacacacacaca

SEQ ID NO: 916923 - RNA, 26 nt, Human
cacacacacacacacacacacacaca

SEQ ID NO: 916924 - RNA, 26 nt, Human
cacacacacacacacacacacacaca

SEQ ID NO: 916925 - RNA, 28 nt, Human
cacacacacacacacacacucuuccaca

SEQ ID NO: 916926 - RNA, 18 nt, Human
caucaucuguuuaaucuu

SEQ ID NO: 916927 - RNA, 19 nt, Human
ccacacacacacacacaca

SEQ ID NO: 916928 - RNA, 21 nt, Human
ccacacacacacacacacaca

SEQ ID NO: 916929 - RNA, 24 nt, Human
cuagguuuccccaaauuagcauau

SEQ ID NO: 916930 - RNA, 31 nt, Human
cucucugccacacacacacacacacacacag

SEQ ID NO: 916931 - RNA, 21 nt, Human
gagauguuuauauuugcaaaa

SEQ ID NO: 916932 - RNA, 24 nt, Human
ggaagaaugagaccuuccuacaaa

SEQ ID NO: 916933 - RNA, 22 nt, Human
uaacagaauuucucucucucuc

SEQ ID NO: 916934 - RNA, 22 nt, Human
uaacucacuaaaugaauaaugc

SEQ ID NO: 916935 - RNA, 19 nt, Human
uaagcugccauaucuguua

SEQ ID NO: 916936 - RNA, 20 nt, Human
uacaacaauauuaugucaca

SEQ ID NO: 916937 - RNA, 21 nt, Human
uacacucaaguacuuuaugaa

SEQ ID NO: 916938 - RNA, 18 nt, Human
uacauccaaacaaagcca

SEQ ID NO: 916939 - RNA, 19 nt, Human
uacauccaaacaaagccaa

SEQ ID NO: 916940 - RNA, 22 nt, Human
uacauccaaacaaagccaacac

SEQ ID NO: 916941 - RNA, 25 nt, Human
uagaugcaauuauaaauguacccua

SEQ ID NO: 916942 - RNA, 18 nt, Human
ucaaauccuaauugcaac

SEQ ID NO: 916943 - RNA, 21 nt, Human
ucucaucaucuguuuaaucuu

SEQ ID NO: 916944 - RNA, 19 nt, Human
ucugacugaagaaaugacc

SEQ ID NO: 916945 - RNA, 21 nt, Human
ucugauucuuaggaauuuuuu

SEQ ID NO: 916946 - RNA, 26 nt, Human
ucuuccacaggcauccacacaggggu

SEQ ID NO: 916947 - RNA, 22 nt, Human
ugaaagaggcacugaagaagua

SEQ ID NO: 916948 - RNA, 20 nt, Human
ugaagaaguaggaaaggcag

SEQ ID NO: 916949 - RNA, 19 nt, Human
ugcaacagagcuuucagug

SEQ ID NO: 916950 - RNA, 23 nt, Human
ugcauguaugcuuucugugugug

SEQ ID NO: 916951 - RNA, 24 nt, Human
ugccacacacacacacacacacag

SEQ ID NO: 916952 - RNA, 22 nt, Human
ugucucagaauuuaaaacacug

SEQ ID NO: 916953 - RNA, 23 nt, Human
uguuaggguuauaucauagaugu

SEQ ID NO: 916954 - RNA, 23 nt, Human
uguuauagaaaaugagugcuaga

SEQ ID NO: 916955 - RNA, 27 nt, Human
uuaaacacagcaacagguuacaguaag

SEQ ID NO: 916956 - RNA, 20 nt, Human
uuucucucucucucuuucuc

SEQ ID NO: 916957 - RNA, 23 nt, Human
uuugcaaaauuucaacaauuauc

SEQ ID NO: 916958 - RNA, 19 nt, Human
uuuuugguuugaaggaucc

SEQ ID NO: 916959 - RNA, 23 nt, Human
aaagccgcguccucgcgcccccg

SEQ ID NO: 916960 - RNA, 24 nt, Human
acccacgcacgcaauccagccaug

SEQ ID NO: 916961 - RNA, 24 nt, Human
acuguaauuagcuauuccaguugu

SEQ ID NO: 916962 - RNA, 19 nt, Human
agccagggagcuucagucc

SEQ ID NO: 916963 - RNA, 18 nt, Human
aggaccccggggauucag

SEQ ID NO: 916964 - RNA, 19 nt, Human
auggcucagcaagcaugcc

SEQ ID NO: 916965 - RNA, 18 nt, Human
augggcgccccagcagac

SEQ ID NO: 916966 - RNA, 21 nt, Human
caaaaucaucuagaacccaga

SEQ ID NO: 916967 - RNA, 21 nt, Human
cagagacucuggcaaccccau

SEQ ID NO: 916968 - RNA, 19 nt, Human
caucuagaacccagagacu

SEQ ID NO: 916969 - RNA, 26 nt, Human
cauuuccaucuuaagaaauuguuuuc

SEQ ID NO: 916970 - RNA, 22 nt, Human
ccaaggaccccggggauucagg

SEQ ID NO: 916971 - RNA, 20 nt, Human
ccaauugcacauucuccucg

SEQ ID NO: 916972 - RNA, 22 nt, Human
ccagcagacccgccugcacaaa

SEQ ID NO: 916973 - RNA, 20 nt, Human
ccauuuccaucuuaagaaag

SEQ ID NO: 916974 - RNA, 19 nt, Human
cccacgcacgcaauccagc

SEQ ID NO: 916975 - RNA, 21 nt, Human
cccacgcacgcaauccagcca

SEQ ID NO: 916976 - RNA, 23 nt, Human
cccacgcacgcaauccagccaug

SEQ ID NO: 916977 - RNA, 18 nt, Human
cccccgacaccgucuucc

SEQ ID NO: 916978 - RNA, 22 nt, Human
cccccgcguccccgccgccgcc

SEQ ID NO: 916979 - RNA, 23 nt, Human
cccccgcguccccgccgccgccu

SEQ ID NO: 916980 - RNA, 21 nt, Human
ccccgacaccgucuuccccca

SEQ ID NO: 916981 - RNA, 22 nt, Human
ccccgccgccgccucgggccgc

SEQ ID NO: 916982 - RNA, 25 nt, Human
ccccgccgcugucauagcgcgcccg

SEQ ID NO: 916983 - RNA, 18 nt, Human
ccccgcguccccgccgcc

SEQ ID NO: 916984 - RNA, 20 nt, Human
cccgaauauuauucucauua

SEQ ID NO: 916985 - RNA, 23 nt, Human
cccgacaccgucuucccccacuc

SEQ ID NO: 916986 - RNA, 24 nt, Human
cccguggacgaggcgaccuccccc

SEQ ID NO: 916987 - RNA, 25 nt, Human
cccguggacgaggcgaccucccccu

SEQ ID NO: 916988 - RNA, 28 nt, Human
cccucuucuguuuuguaccauccuugau

SEQ ID NO: 916989 - RNA, 23 nt, Human
ccgcccggcuugcucucccgggg

SEQ ID NO: 916990 - RNA, 22 nt, Human
ccgcugucauagcgcgcccgcc

SEQ ID NO: 916991 - RNA, 18 nt, Human
ccucgcgcccccgcgucc

SEQ ID NO: 916992 - RNA, 21 nt, Human
cgacaccgucuucccccacuc

SEQ ID NO: 916993 - RNA, 18 nt, Human
cgcaacgccgcggggucc

SEQ ID NO: 916994 - RNA, 19 nt, Human
cgcaacgccgcgggguccc

SEQ ID NO: 916995 - RNA, 21 nt, Human
cgccccagcagacccgccugc

SEQ ID NO: 916996 - RNA, 19 nt, Human
cgccgcugucauagcgcgc

SEQ ID NO: 916997 - RNA, 22 nt, Human
cggggcgagcgcaacgccgcgg

SEQ ID NO: 916998 - RNA, 21 nt, Human
cucagcaagcaugccaccaaa

SEQ ID NO: 916999 - RNA, 18 nt, Human
cugucuuuuuccguuccc

SEQ ID NO: 917000 - RNA, 20 nt, Human
gaacccagagacucuggcaa

SEQ ID NO: 917001 - RNA, 19 nt, Human
ggacgaggcgaccuccccc

SEQ ID NO: 917002 - RNA, 22 nt, Human
ggacgggcccggggaggugggc

SEQ ID NO: 917003 - RNA, 23 nt, Human
ggcugcuuuuacaucaucucuac

SEQ ID NO: 917004 - RNA, 22 nt, Human
gggaacccguccacuuacauuc

SEQ ID NO: 917005 - RNA, 19 nt, Human
gggcgcccuuggcaccgag

SEQ ID NO: 917006 - RNA, 19 nt, Human
gucuuuuuccguucccucu

SEQ ID NO: 917007 - RNA, 21 nt, Human
uaagaaauuguuuucacuuag

SEQ ID NO: 917008 - RNA, 20 nt, Human
uacaauguauuguuuccaga

SEQ ID NO: 917009 - RNA, 26 nt, Human
uagaacccagagacucuggcaacccc

SEQ ID NO: 917010 - RNA, 24 nt, Human
uagaucagguuuuuuucuccaaua

SEQ ID NO: 917011 - RNA, 26 nt, Human
uaguaauuauggcucagcaagcaugc

SEQ ID NO: 917012 - RNA, 18 nt, Human
ucccccgacaccgucuuc

SEQ ID NO: 917013 - RNA, 25 nt, Human
uccccgccgccgccucgggccgccg

SEQ ID NO: 917014 - RNA, 18 nt, Human
uccguuggaaaccccgcc

SEQ ID NO: 917015 - RNA, 20 nt, Human
uccucgcgcccccgcguccc

SEQ ID NO: 917016 - RNA, 24 nt, Human
ucgauggcucuccaaggaccccgg

SEQ ID NO: 917017 - RNA, 21 nt, Human
ucucaguggagcuagagugaa

SEQ ID NO: 917018 - RNA, 22 nt, Human
ucuccaaggaccccggggauuc

SEQ ID NO: 917019 - RNA, 24 nt, Human
ugaacacuacuucauacaaugaaa

SEQ ID NO: 917020 - RNA, 18 nt, Human
uguaucuucagccaggga

SEQ ID NO: 917021 - RNA, 22 nt, Human
uucccccacuccggcuuucagg

SEQ ID NO: 917022 - RNA, 18 nt, Human
uuccguucccucuucugu

SEQ ID NO: 917023 - RNA, 23 nt, Human
uucucauuagugagugcaaagca

SEQ ID NO: 917024 - RNA, 18 nt, Human
uuggaaaccccgccgcug

SEQ ID NO: 917025 - RNA, 22 nt, Human
uuuaaaaucccgaauauuauuc

SEQ ID NO: 917026 - RNA, 20 nt, Human
uuucucaguggagcuagagu

SEQ ID NO: 917027 - RNA, 22 nt, Human
uuucucaguggagcuagaguga

SEQ ID NO: 917028 - RNA, 25 nt, Human
uuucucaguggagcuagagugaaua

SEQ ID NO: 917029 - RNA, 23 nt, Human
uuuuccguucccucuucuguuuu

SEQ ID NO: 917030 - RNA, 23 nt, Human
aggagggaggaauccugguuccc

SEQ ID NO: 917031 - RNA, 25 nt, Human
augaagauggggaaggaaauggcac

SEQ ID NO: 917032 - RNA, 22 nt, Human
auucacucuccaaagcaguaca

SEQ ID NO: 917033 - RNA, 22 nt, Human
caaaacuuacaaagaagucaaa

SEQ ID NO: 917034 - RNA, 21 nt, Human
caggugcgccuuccccgcgcc

SEQ ID NO: 917035 - RNA, 21 nt, Human
ccccaggugcgccuuccccgc

SEQ ID NO: 917036 - RNA, 19 nt, Human
uacaaagaagucaaaaguc

SEQ ID NO: 917037 - RNA, 22 nt, Human
uacaaagaagucaaaagucuua

SEQ ID NO: 917038 - RNA, 22 nt, Human
ucuccaaagcaguacaaaacuu

SEQ ID NO: 917039 - RNA, 18 nt, Human
uggcaccacugcuguuug

SEQ ID NO: 917040 - RNA, 22 nt, Human
ugguaggagggaggaauccugg

SEQ ID NO: 917041 - RNA, 19 nt, Human
ugugaugcuggggaaaagu

SEQ ID NO: 917042 - RNA, 24 nt, Human
uuucucauaagaagagaguuuuau

SEQ ID NO: 917043 - RNA, 29 nt, Human
uuuuuuuuuuuuuuuuuuucucauaagaa

SEQ ID NO: 917044 - RNA, 20 nt, Human
acacagaggaacaugcuaaa

SEQ ID NO: 917045 - RNA, 19 nt, Human
accauuucccccuuuauca

SEQ ID NO: 917046 - RNA, 21 nt, Human
agaggaacaugcuaaacugca

SEQ ID NO: 917047 - RNA, 24 nt, Human
aggaacaugcuaaacugcaccaaa

SEQ ID NO: 917048 - RNA, 20 nt, Human
aggcaggcuccgugcgcuuc

SEQ ID NO: 917049 - RNA, 18 nt, Human
cacuaaaaaccauuuccc

SEQ ID NO: 917050 - RNA, 26 nt, Human
cuagaagccucaugaaagguaacuga

SEQ ID NO: 917051 - RNA, 22 nt, Human
ggaacaugcuaaacugcaccaa

SEQ ID NO: 917052 - RNA, 27 nt, Human
ugcagaacacagaggaacaugcuaaac

SEQ ID NO: 917053 - RNA, 18 nt, Human
uggcuagaagccucauga

SEQ ID NO: 917054 - RNA, 22 nt, Human
aggcgcgggcccagacauuccc

SEQ ID NO: 917055 - RNA, 22 nt, Human
agggacguggcggccuuuagag

SEQ ID NO: 917056 - RNA, 21 nt, Human
caccgcgcauccucccggccc

SEQ ID NO: 917057 - RNA, 24 nt, Human
ccccacaccgcgcauccucccggc

SEQ ID NO: 917058 - RNA, 21 nt, Human
cccucccggcccgcccgggcc

SEQ ID NO: 917059 - RNA, 19 nt, Human
cccuccgccggcacgaagc

SEQ ID NO: 917060 - RNA, 20 nt, Human
ccgcccgggcccccuccgcc

SEQ ID NO: 917061 - RNA, 18 nt, Human
ccucccggcccgcccggg

SEQ ID NO: 917062 - RNA, 21 nt, Human
ccucccggcccggcgccggcc

SEQ ID NO: 917063 - RNA, 18 nt, Human
cgcccgggcccccuccgc

SEQ ID NO: 917064 - RNA, 21 nt, Human
gcagccccucccggcccgccc

SEQ ID NO: 917065 - RNA, 18 nt, Human
gcccgggcccccuccgcc

SEQ ID NO: 917066 - RNA, 18 nt, Human
gcggugaugggguaggcg

SEQ ID NO: 917067 - RNA, 19 nt, Human
gggcagccccucccggccc

SEQ ID NO: 917068 - RNA, 24 nt, Human
gguaggcgcagggccuggggcagc

SEQ ID NO: 917069 - RNA, 19 nt, Human
ucagagccccacaccgcgc

SEQ ID NO: 917070 - RNA, 18 nt, Human
ucccggcccgcccgggcc

SEQ ID NO: 917071 - RNA, 18 nt, Human
ugccugcgcgcgccgcag

SEQ ID NO: 917072 - RNA, 20 nt, Human
uucagagccccacaccgcgc

SEQ ID NO: 917073 - RNA, 19 nt, Human
agaggacggugugggugcu

SEQ ID NO: 917074 - RNA, 23 nt, Human
cacuaccucucuccccacucuca

SEQ ID NO: 917075 - RNA, 18 nt, Human
cagucucuuccucuuucu

SEQ ID NO: 917076 - RNA, 18 nt, Human
caguguugagaaaaccaa

SEQ ID NO: 917077 - RNA, 22 nt, Human
ccagaccacguccucgcgcucc

SEQ ID NO: 917078 - RNA, 18 nt, Human
cccucucucucucucucc

SEQ ID NO: 917079 - RNA, 21 nt, Human
cccuguguccucucuccuuca

SEQ ID NO: 917080 - RNA, 18 nt, Human
cccuuccucccucuccca

SEQ ID NO: 917081 - RNA, 23 nt, Human
ccucccgggcccgcaauggggac

SEQ ID NO: 917082 - RNA, 18 nt, Human
ccucccuuuucucuuucc

SEQ ID NO: 917083 - RNA, 20 nt, Human
ccugucucuuacggucucuc

SEQ ID NO: 917084 - RNA, 18 nt, Human
cgcgcuccgauuggcugc

SEQ ID NO: 917085 - RNA, 19 nt, Human
cucacuuucugugucuccc

SEQ ID NO: 917086 - RNA, 19 nt, Human
cucauucucucccucucuc

SEQ ID NO: 917087 - RNA, 20 nt, Human
cucucagucauccccugugu

SEQ ID NO: 917088 - RNA, 22 nt, Human
cucuccccacucucacuuucug

SEQ ID NO: 917089 - RNA, 18 nt, Human
cucucucucucucucucu

SEQ ID NO: 917090 - RNA, 18 nt, Human
cucucucucucucucucu

SEQ ID NO: 917091 - RNA, 23 nt, Human
cucucucucuuccuuuuacacua

SEQ ID NO: 917092 - RNA, 18 nt, Human
cucuuccucuuucucucu

SEQ ID NO: 917093 - RNA, 19 nt, Human
cuucacacucagucucuuc

SEQ ID NO: 917094 - RNA, 24 nt, Human
cuuccagucucucucucacucauu

SEQ ID NO: 917095 - RNA, 21 nt, Human
cuuuuugucucuuugucuccu

SEQ ID NO: 917096 - RNA, 19 nt, Human
gaccagaccacgcccccug

SEQ ID NO: 917097 - RNA, 21 nt, Human
gacucacagggucucuuccuu

SEQ ID NO: 917098 - RNA, 21 nt, Human
gaugcccugaguggucccaga

SEQ ID NO: 917099 - RNA, 18 nt, Human
gcggcaccuaggcagucu

SEQ ID NO: 917100 - RNA, 19 nt, Human
uaccuccagaccacguccu

SEQ ID NO: 917101 - RNA, 19 nt, Human
ucacuuucucccuuccucc

SEQ ID NO: 917102 - RNA, 22 nt, Human
ucagucauccccuguguccucu

SEQ ID NO: 917103 - RNA, 20 nt, Human
ucagucucuuccucuuucuc

SEQ ID NO: 917104 - RNA, 19 nt, Human
ucauucucucucucucucu

SEQ ID NO: 917105 - RNA, 21 nt, Human
uccccacucucacuuucugug

SEQ ID NO: 917106 - RNA, 25 nt, Human
ucccucucucucucucuccaaucuu

SEQ ID NO: 917107 - RNA, 20 nt, Human
ucccucugaucucugucucu

SEQ ID NO: 917108 - RNA, 19 nt, Human
ucgcgcuccgauuggcugc

SEQ ID NO: 917109 - RNA, 21 nt, Human
ucucccuuccucccucuccca

SEQ ID NO: 917110 - RNA, 19 nt, Human
ucuccugucucuuacgguc

SEQ ID NO: 917111 - RNA, 21 nt, Human
ucuccugucucuuacggucuc

SEQ ID NO: 917112 - RNA, 19 nt, Human
ucucucacucauucucucc

SEQ ID NO: 917113 - RNA, 18 nt, Human
ucucucuccaaucuuucu

SEQ ID NO: 917114 - RNA, 23 nt, Human
ucucucucuccaaucuuucuguu

SEQ ID NO: 917115 - RNA, 25 nt, Human
ucugccguuuccucccuuuucucuu

SEQ ID NO: 917116 - RNA, 22 nt, Human
ucugucucauucucucucucuc

SEQ ID NO: 917117 - RNA, 20 nt, Human
ucugucucuuccagucucuc

SEQ ID NO: 917118 - RNA, 21 nt, Human
ucugugucucccucugaucuc

SEQ ID NO: 917119 - RNA, 19 nt, Human
ucuuacggucucucucucu

SEQ ID NO: 917120 - RNA, 23 nt, Human
ugaucucugucucuuccagucuc

SEQ ID NO: 917121 - RNA, 27 nt, Human
ugccguuuccucccuuuucucuuuccg

SEQ ID NO: 917122 - RNA, 22 nt, Human
ugucucauucucucucucucuc

SEQ ID NO: 917123 - RNA, 23 nt, Human
ugucucuuccagucucucucuca

SEQ ID NO: 917124 - RNA, 22 nt, Human
uuccucccuuuucucuuuccga

SEQ ID NO: 917125 - RNA, 23 nt, Human
uucucacuuucucccuuccuccc

SEQ ID NO: 917126 - RNA, 21 nt, Human
uuucccuucucacuuucuccc

SEQ ID NO: 917127 - RNA, 23 nt, Human
uuugucucuuagcugcugucucu

SEQ ID NO: 917128 - RNA, 24 nt, Human
uuuuacacuaccucucuccccacu

SEQ ID NO: 917129 - RNA, 23 nt, Human
aggaugaugcagcucugcccagc

SEQ ID NO: 917130 - RNA, 19 nt, Human
agggggagggggacaaggc

SEQ ID NO: 917131 - RNA, 20 nt, Human
agugaggagggcaccagucc

SEQ ID NO: 917132 - RNA, 23 nt, Human
caacccccaccugcaaggaugau

SEQ ID NO: 917133 - RNA, 18 nt, Human
cacacugcagacauggca

SEQ ID NO: 917134 - RNA, 26 nt, Human
cacccgaacauguacaaaaauaacuu

SEQ ID NO: 917135 - RNA, 21 nt, Human
cagagccuccgcaccgcuccc

SEQ ID NO: 917136 - RNA, 22 nt, Human
cagccaccggggcuggggggca

SEQ ID NO: 917137 - RNA, 18 nt, Human
cauauggugggguugagg

SEQ ID NO: 917138 - RNA, 19 nt, Human
ccacacccgaacauguaca

SEQ ID NO: 917139 - RNA, 20 nt, Human
ccaguaugggccccagaugc

SEQ ID NO: 917140 - RNA, 19 nt, Human
ccuccgcaccgcucccucg

SEQ ID NO: 917141 - RNA, 22 nt, Human
cuccgcaccgcucccucgugcc

SEQ ID NO: 917142 - RNA, 21 nt, Human
cugcgcugcagaccucgaucc

SEQ ID NO: 917143 - RNA, 21 nt, Human
gagggggagggggacaaggga

SEQ ID NO: 917144 - RNA, 21 nt, Human
gcuguagaacccacacccgaa

SEQ ID NO: 917145 - RNA, 19 nt, Human
ggcacacugcagacauggc

SEQ ID NO: 917146 - RNA, 18 nt, Human
ggcuggggggcacacugc

SEQ ID NO: 917147 - RNA, 30 nt, Human
uacaaaaauaacuuacacagcaacccccag

SEQ ID NO: 917148 - RNA, 19 nt, Human
uacacagcaacccccaccu

SEQ ID NO: 917149 - RNA, 24 nt, Human
uagaacccacacccgaacauguac

SEQ ID NO: 917150 - RNA, 19 nt, Human
ucccgaagcugcgcugcag

SEQ ID NO: 917151 - RNA, 24 nt, Human
ucccgaagcugcgcugcagaccuc

SEQ ID NO: 917152 - RNA, 23 nt, Human
ugaggagggcaccaguccggagg

SEQ ID NO: 917153 - RNA, 20 nt, Human
ugaugcagcucugcccagcc

SEQ ID NO: 917154 - RNA, 21 nt, Human
uggcaccgcgggagccaacca

SEQ ID NO: 917155 - RNA, 21 nt, Human
ugggagugaggagggcaccag

SEQ ID NO: 917156 - RNA, 24 nt, Human
ugggagugaggagggcaccagucc

SEQ ID NO: 917157 - RNA, 22 nt, Human
uggugggguugagggggagggg

SEQ ID NO: 917158 - RNA, 20 nt, Human
uugagggggagggggacaag

SEQ ID NO: 917159 - RNA, 27 nt, Human
uuuuuuuuuuuuuuuuuuuuuuugggg

SEQ ID NO: 917160 - RNA, 22 nt, Human
aaaacaaaacacaagguacgga

SEQ ID NO: 917161 - RNA, 21 nt, Human
aaaacaaaucaagaccuucaa

SEQ ID NO: 917162 - RNA, 19 nt, Human
aaaagaacaacacaacucu

SEQ ID NO: 917163 - RNA, 18 nt, Human
aaacaaaacacaagguac

SEQ ID NO: 917164 - RNA, 23 nt, Human
aaacaggaaaagacugaaaucug

SEQ ID NO: 917165 - RNA, 24 nt, Human
aaacaggaaaagacugaaaucugg

SEQ ID NO: 917166 - RNA, 22 nt, Human
aaagauccuugcuuugaccccc

SEQ ID NO: 917167 - RNA, 20 nt, Human
aacagaaaaaaagacaugcu

SEQ ID NO: 917168 - RNA, 22 nt, Human
aaccuaacucuuaacacaccaa

SEQ ID NO: 917169 - RNA, 22 nt, Human
aacuguaguacaaaucuuuccu

SEQ ID NO: 917170 - RNA, 24 nt, Human
aagcuuaccaacugaauagccuga

SEQ ID NO: 917171 - RNA, 24 nt, Human
aauaaguaauaaacaaacugggaa

SEQ ID NO: 917172 - RNA, 20 nt, Human
aauagagagaccagaaugaa

SEQ ID NO: 917173 - RNA, 23 nt, Human
acaaaacauuuucccucuccucc

SEQ ID NO: 917174 - RNA, 24 nt, Human
acaacacaacucuuuacaacagaa

SEQ ID NO: 917175 - RNA, 20 nt, Human
acacagauucuacgcucccu

SEQ ID NO: 917176 - RNA, 24 nt, Human
acagaaaaaaagacaugcuaucca

SEQ ID NO: 917177 - RNA, 20 nt, Human
accaaagagaauauauuugg

SEQ ID NO: 917178 - RNA, 21 nt, Human
acuaauuaacagaaaaaaaga

SEQ ID NO: 917179 - RNA, 20 nt, Human
agcauuguaggcuguguggu

SEQ ID NO: 917180 - RNA, 18 nt, Human
aggagaagggagugagaa

SEQ ID NO: 917181 - RNA, 24 nt, Human
aggauccuggucucuccagccucc

SEQ ID NO: 917182 - RNA, 20 nt, Human
aggccagaguacacaacuaa

SEQ ID NO: 917183 - RNA, 21 nt, Human
agguuacaccauuagccacca

SEQ ID NO: 917184 - RNA, 22 nt, Human
aguguuuuuuuguaaagccucu

SEQ ID NO: 917185 - RNA, 23 nt, Human
caacacaacucuuuacaacagaa

SEQ ID NO: 917186 - RNA, 21 nt, Human
caacagaagaacuguaguaca

SEQ ID NO: 917187 - RNA, 23 nt, Human
caacugaauagccugaugacugg

SEQ ID NO: 917188 - RNA, 22 nt, Human
caacugcugcuccucaggccag

SEQ ID NO: 917189 - RNA, 26 nt, Human
caauaggcagauuugggcaaacgcuc

SEQ ID NO: 917190 - RNA, 24 nt, Human
caauucuauaucagaaaugaagga

SEQ ID NO: 917191 - RNA, 19 nt, Human
caauuuuccuaguuuaaaa

SEQ ID NO: 917192 - RNA, 24 nt, Human
cacaacuaauuaacagaaaaaaag

SEQ ID NO: 917193 - RNA, 21 nt, Human
caccagcaacugcugcuccuc

SEQ ID NO: 917194 - RNA, 25 nt, Human
caccuacgaugacugaauggauaau

SEQ ID NO: 917195 - RNA, 21 nt, Human
cagaaaaaaagacaugcuauc

SEQ ID NO: 917196 - RNA, 22 nt, Human
cagaaaaaaagacaugcuaucc

SEQ ID NO: 917197 - RNA, 21 nt, Human
cagaagaacuguaguacaaau

SEQ ID NO: 917198 - RNA, 24 nt, Human
cagaauacuuguagaaaaucccaa

SEQ ID NO: 917199 - RNA, 23 nt, Human
cagcuaugaagcaaaaugacuaa

SEQ ID NO: 917200 - RNA, 22 nt, Human
caugaaaugagcaccauuguga

SEQ ID NO: 917201 - RNA, 21 nt, Human
cauuuuguacaccaaagagaa

SEQ ID NO: 917202 - RNA, 21 nt, Human
ccacaggguugucaugguagc

SEQ ID NO: 917203 - RNA, 27 nt, Human
ccacaggguugucaugguagcuguuau

SEQ ID NO: 917204 - RNA, 24 nt, Human
ccagaguacacaacuaauuaacag

SEQ ID NO: 917205 - RNA, 21 nt, Human
ccccaugaaaugagcaccauu

SEQ ID NO: 917206 - RNA, 18 nt, Human
cccuaacgagguguaagg

SEQ ID NO: 917207 - RNA, 20 nt, Human
ccuucuaugcagccuggaag

SEQ ID NO: 917208 - RNA, 20 nt, Human
cgccaucggggucagugcuc

SEQ ID NO: 917209 - RNA, 24 nt, Human
cuagagagaacgaucagauuacuc

SEQ ID NO: 917210 - RNA, 20 nt, Human
cugcugcuccucaggccagu

SEQ ID NO: 917211 - RNA, 18 nt, Human
cuggaagcuuaccaacug

SEQ ID NO: 917212 - RNA, 24 nt, Human
cuggaagcuuaucuuguauacugg

SEQ ID NO: 917213 - RNA, 20 nt, Human
cuggaaggauccuggucucu

SEQ ID NO: 917214 - RNA, 20 nt, Human
cuuaaauauugcugaaacca

SEQ ID NO: 917215 - RNA, 20 nt, Human
cuuuauguuaaaccuaacuc

SEQ ID NO: 917216 - RNA, 21 nt, Human
cuuuccuuccacuuuguuucc

SEQ ID NO: 917217 - RNA, 20 nt, Human
cuuuuuuuuuuuuuuaaccc

SEQ ID NO: 917218 - RNA, 20 nt, Human
gacuuuuuuuuuuuuuuaaa

SEQ ID NO: 917219 - RNA, 18 nt, Human
gaugacugaauggauaau

SEQ ID NO: 917220 - RNA, 21 nt, Human
gggugaaagauccuugcuuug

SEQ ID NO: 917221 - RNA, 20 nt, Human
gucucuccagccuccuucuu

SEQ ID NO: 917222 - RNA, 27 nt, Human
uaaaaccaaucagacuuuuuuuuuuuu

SEQ ID NO: 917223 - RNA, 19 nt, Human
uaaaucaaaacaaaacaca

SEQ ID NO: 917224 - RNA, 25 nt, Human
uaacaaaaacaggaaaagacugaaa

SEQ ID NO: 917225 - RNA, 28 nt, Human
uaacagaaaaaaagacaugcuauccaaa

SEQ ID NO: 917226 - RNA, 27 nt, Human
uacaaaacauuuucccucuccuccuuc

SEQ ID NO: 917227 - RNA, 19 nt, Human
uagcuagagagaacgauca

SEQ ID NO: 917228 - RNA, 22 nt, Human
uauaucagaaaugaaggaaaca

SEQ ID NO: 917229 - RNA, 18 nt, Human
uauauguguauguaugca

SEQ ID NO: 917230 - RNA, 22 nt, Human
uauccugugucuaccagagggc

SEQ ID NO: 917231 - RNA, 19 nt, Human
uauguguauguaugcaugu

SEQ ID NO: 917232 - RNA, 20 nt, Human
uauguguauguaugcaugug

SEQ ID NO: 917233 - RNA, 24 nt, Human
uauguuauuaaaucaaaacaaaac

SEQ ID NO: 917234 - RNA, 18 nt, Human
ucaaagaauuauucucca

SEQ ID NO: 917235 - RNA, 22 nt, Human
ucagaaaugaaggaaacacuuu

SEQ ID NO: 917236 - RNA, 18 nt, Human
ucaggagaaaauaaccuu

SEQ ID NO: 917237 - RNA, 22 nt, Human
ucaguggaaguacccuuugaga

SEQ ID NO: 917238 - RNA, 22 nt, Human
uccaauuguagccggcuggcua

SEQ ID NO: 917239 - RNA, 24 nt, Human
ucucagguuacaccauuagccacc

SEQ ID NO: 917240 - RNA, 28 nt, Human
ucuccagccuccuucuucgggggccgcc

SEQ ID NO: 917241 - RNA, 23 nt, Human
ucucuccagccuccuucuucggu

SEQ ID NO: 917242 - RNA, 22 nt, Human
ucuuugggacucugacuccaau

SEQ ID NO: 917243 - RNA, 23 nt, Human
ucuuugggacucugacuccaauu

SEQ ID NO: 917244 - RNA, 19 nt, Human
ugaaaacaaguaucaagug

SEQ ID NO: 917245 - RNA, 23 nt, Human
ugaaaugagcaccauugugaaga

SEQ ID NO: 917246 - RNA, 22 nt, Human
ugaaaugugcaucauucuaaaa

SEQ ID NO: 917247 - RNA, 18 nt, Human
ugaauagccugaugacug

SEQ ID NO: 917248 - RNA, 18 nt, Human
ugaauggauaauacccca

SEQ ID NO: 917249 - RNA, 23 nt, Human
ugaauggauaauaccccaugaaa

SEQ ID NO: 917250 - RNA, 26 nt, Human
ugacaacacccuguuucucuucccua

SEQ ID NO: 917251 - RNA, 19 nt, Human
ugagaagaaauuacuuucu

SEQ ID NO: 917252 - RNA, 22 nt, Human
ugagcaucuuuccuuccacuuu

SEQ ID NO: 917253 - RNA, 23 nt, Human
ugagguuuucagggaaggguugg

SEQ ID NO: 917254 - RNA, 21 nt, Human
ugcuugaaaauucaauuagag

SEQ ID NO: 917255 - RNA, 19 nt, Human
uggcaaaggcaaagaguua

SEQ ID NO: 917256 - RNA, 18 nt, Human
ugggaagucaucuucuua

SEQ ID NO: 917257 - RNA, 23 nt, Human
uguagaaaaucccaauagauuca

SEQ ID NO: 917258 - RNA, 27 nt, Human
uguagaaaaucccaauagauucaacua

SEQ ID NO: 917259 - RNA, 19 nt, Human
uguauauauguguauguau

SEQ ID NO: 917260 - RNA, 22 nt, Human
uguguauauauguguauguaug

SEQ ID NO: 917261 - RNA, 19 nt, Human
uguguguauauauguguau

SEQ ID NO: 917262 - RNA, 23 nt, Human
uguguguauauauguguauguau

SEQ ID NO: 917263 - RNA, 21 nt, Human
uguguguguauauauguguau

SEQ ID NO: 917264 - RNA, 23 nt, Human
uguguguguauauauguguaugu

SEQ ID NO: 917265 - RNA, 23 nt, Human
uguuauuaaaucaaaacaaaaca

SEQ ID NO: 917266 - RNA, 18 nt, Human
uguucagcuggaaggauc

SEQ ID NO: 917267 - RNA, 18 nt, Human
uuaacaaaaacaggaaaa

SEQ ID NO: 917268 - RNA, 25 nt, Human
uuaacaaaaacaggaaaagacugaa

SEQ ID NO: 917269 - RNA, 18 nt, Human
uuacaaaacauuuucccu

SEQ ID NO: 917270 - RNA, 19 nt, Human
uuagccaccagcaacugcu

SEQ ID NO: 917271 - RNA, 19 nt, Human
uuccuuccacuuuguuucc

SEQ ID NO: 917272 - RNA, 21 nt, Human
uuccuucucuguaccugagca

SEQ ID NO: 917273 - RNA, 23 nt, Human
uuguggcugacuuuguucagcug

SEQ ID NO: 917274 - RNA, 24 nt, Human
uuuauccuuuauguguguuaaaau

SEQ ID NO: 917275 - RNA, 18 nt, Human
aaacucucugggacccac

SEQ ID NO: 917276 - RNA, 22 nt, Human
aacacaacucucaacaaaggca

SEQ ID NO: 917277 - RNA, 25 nt, Human
aagaaaggcacaaaaaggaccaaca

SEQ ID NO: 917278 - RNA, 21 nt, Human
aagcagccaaggauacccuaa

SEQ ID NO: 917279 - RNA, 23 nt, Human
acaaaaaggaccaacaaauaaua

SEQ ID NO: 917280 - RNA, 28 nt, Human
acacaacucucaacaaagggggaacgcc

SEQ ID NO: 917281 - RNA, 22 nt, Human
acagagggaauccuacacucca

SEQ ID NO: 917282 - RNA, 18 nt, Human
acaguaaagcagccaagg

SEQ ID NO: 917283 - RNA, 19 nt, Human
accaccucugcccucuccu

SEQ ID NO: 917284 - RNA, 24 nt, Human
acucucaacaaaggcaauuccagc

SEQ ID NO: 917285 - RNA, 21 nt, Human
acucuuuuuccugggggcagg

SEQ ID NO: 917286 - RNA, 23 nt, Human
aggcauugagagggugaaaugcu

SEQ ID NO: 917287 - RNA, 21 nt, Human
aggccuugcgguaccaggaga

SEQ ID NO: 917288 - RNA, 23 nt, Human
auggaauggaacacugcucccaa

SEQ ID NO: 917289 - RNA, 26 nt, Human
caacacuagggagccauauucccaga

SEQ ID NO: 917290 - RNA, 22 nt, Human
caagaaaggcacaaaaaggacc

SEQ ID NO: 917291 - RNA, 24 nt, Human
caagaaaggcacaaaaaggaccaa

SEQ ID NO: 917292 - RNA, 22 nt, Human
caccucugcccucuccuggggg

SEQ ID NO: 917293 - RNA, 21 nt, Human
cagaaagaaacuaggcugaca

SEQ ID NO: 917294 - RNA, 22 nt, Human
cagaaagaaacuaggcugacua

SEQ ID NO: 917295 - RNA, 20 nt, Human
cagcaauccuccugccuccc

SEQ ID NO: 917296 - RNA, 22 nt, Human
cagcaauccuccugccuccccc

SEQ ID NO: 917297 - RNA, 18 nt, Human
caggaacagccugggcag

SEQ ID NO: 917298 - RNA, 24 nt, Human
caucuggcgaacgggaaaggugag

SEQ ID NO: 917299 - RNA, 24 nt, Human
cauggagugggccccacccugcaa

SEQ ID NO: 917300 - RNA, 22 nt, Human
ccaccacaguaaagcagccaag

SEQ ID NO: 917301 - RNA, 22 nt, Human
ccagaaagaaacuaggcugaca

SEQ ID NO: 917302 - RNA, 19 nt, Human
ccaggaaauuuaaggggga

SEQ ID NO: 917303 - RNA, 21 nt, Human
ccaucuggcgaacgggaaagg

SEQ ID NO: 917304 - RNA, 21 nt, Human
cccaaaggaauccagccccuc

SEQ ID NO: 917305 - RNA, 21 nt, Human
ccccagaggcuaaaugaccuc

SEQ ID NO: 917306 - RNA, 19 nt, Human
ccuacacuccaaacucucu

SEQ ID NO: 917307 - RNA, 18 nt, Human
ccuccugccucccccucc

SEQ ID NO: 917308 - RNA, 19 nt, Human
ccuccugccucccccucca

SEQ ID NO: 917309 - RNA, 23 nt, Human
cggccaccacaguaaagcagcca

SEQ ID NO: 917310 - RNA, 20 nt, Human
cuggcgaacgggaaagguga

SEQ ID NO: 917311 - RNA, 20 nt, Human
gacaaccaccucugcccucu

SEQ ID NO: 917312 - RNA, 18 nt, Human
gacaacugaaugugaccu

SEQ ID NO: 917313 - RNA, 22 nt, Human
gacugcugucuucauggagugg

SEQ ID NO: 917314 - RNA, 19 nt, Human
gcacguaagguagcucugc

SEQ ID NO: 917315 - RNA, 24 nt, Human
gccugaugacaacugaaugugacc

SEQ ID NO: 917316 - RNA, 22 nt, Human
gcucccaaaggaauccagcccc

SEQ ID NO: 917317 - RNA, 18 nt, Human
ggaauacugaugguucca

SEQ ID NO: 917318 - RNA, 18 nt, Human
ggauccaggaggccuugc

SEQ ID NO: 917319 - RNA, 18 nt, Human
gggggcagguggagaagg

SEQ ID NO: 917320 - RNA, 24 nt, Human
guagcaacacugucucagacacca

SEQ ID NO: 917321 - RNA, 26 nt, Human
gugaacacaacucucaacaaaggcug

SEQ ID NO: 917322 - RNA, 22 nt, Human
uaccaggagaggaauacugaug

SEQ ID NO: 917323 - RNA, 22 nt, Human
uacugacauggugcuuuggauc

SEQ ID NO: 917324 - RNA, 20 nt, Human
ucuuaaggcaugacugcugu

SEQ ID NO: 917325 - RNA, 25 nt, Human
ugcagaagggguggggacaaccacc

SEQ ID NO: 917326 - RNA, 20 nt, Human
ugcagaagggguggggacac

SEQ ID NO: 917327 - RNA, 18 nt, Human
ugccuggggcaacugcug

SEQ ID NO: 917328 - RNA, 21 nt, Human
ugccuggggcaacugcugcag

SEQ ID NO: 917329 - RNA, 20 nt, Human
uggaacacugcucccaaagg

SEQ ID NO: 917330 - RNA, 22 nt, Human
uggcgaacgggaaaggugaggc

SEQ ID NO: 917331 - RNA, 18 nt, Human
uggggcaacugcugcaga

SEQ ID NO: 917332 - RNA, 23 nt, Human
uggggcaauuucagcuuaaugga

SEQ ID NO: 917333 - RNA, 20 nt, Human
uggggggcccucucaccagu

SEQ ID NO: 917334 - RNA, 23 nt, Human
ugguauugcaaguauuucacccc

SEQ ID NO: 917335 - RNA, 26 nt, Human
uguccucagagaaguagagaugauuc

SEQ ID NO: 917336 - RNA, 20 nt, Human
uuuaagggggagacucuuuu

SEQ ID NO: 917337 - RNA, 25 nt, Human
aguguguccagccuggugcuuaggg

SEQ ID NO: 917338 - RNA, 23 nt, Human
cacugggaggugaauuugaaaag

SEQ ID NO: 917339 - RNA, 23 nt, Human
cagauagugugcgaguuuuuccu

SEQ ID NO: 917340 - RNA, 26 nt, Human
cagcaggugggacuagguagucaugc

SEQ ID NO: 917341 - RNA, 20 nt, Human
ccaguguguccagccuggug

SEQ ID NO: 917342 - RNA, 20 nt, Human
ccuucaggucuaccuggcug

SEQ ID NO: 917343 - RNA, 21 nt, Human
ccuucaggucuaccuggcuga

SEQ ID NO: 917344 - RNA, 23 nt, Human
cuugagguauguuuuuaucuuca

SEQ ID NO: 917345 - RNA, 21 nt, Human
gacuagguagucaugcugacg

SEQ ID NO: 917346 - RNA, 21 nt, Human
gccagcugugccagcaggugg

SEQ ID NO: 917347 - RNA, 23 nt, Human
uagacaauauguccgggaggucc

SEQ ID NO: 917348 - RNA, 28 nt, Human
uaggguagacaauauguccgggaggucc

SEQ ID NO: 917349 - RNA, 20 nt, Human
uauuuugagggugguucacu

SEQ ID NO: 917350 - RNA, 22 nt, Human
ucccacacucugacauuccagu

SEQ ID NO: 917351 - RNA, 18 nt, Human
ugggagcccaggugguca

SEQ ID NO: 917352 - RNA, 22 nt, Human
uugauguuugaugauuuuucuc

SEQ ID NO: 917353 - RNA, 20 nt, Human
aaggggcugcccagaggagg

SEQ ID NO: 917354 - RNA, 21 nt, Human
aaggggcugcccagaggaggg

SEQ ID NO: 917355 - RNA, 21 nt, Human
aagugugaaagcugauaugcc

SEQ ID NO: 917356 - RNA, 24 nt, Human
agaguccuggguuccagaggccuc

SEQ ID NO: 917357 - RNA, 18 nt, Human
aggcagcggcgggggggc

SEQ ID NO: 917358 - RNA, 20 nt, Human
aggcagcggcgggggggcgg

SEQ ID NO: 917359 - RNA, 20 nt, Human
aggcagcggcgggggggcgg

SEQ ID NO: 917360 - RNA, 22 nt, Human
aggcagcggcgggggggcggug

SEQ ID NO: 917361 - RNA, 18 nt, Human
aggcggaggcgggcccga

SEQ ID NO: 917362 - RNA, 20 nt, Human
agggauggggccccccuucu

SEQ ID NO: 917363 - RNA, 21 nt, Human
aggggcaggcggccagggagu

SEQ ID NO: 917364 - RNA, 21 nt, Human
agggggugggagagagugcau

SEQ ID NO: 917365 - RNA, 25 nt, Human
agggggugggagagagugcaugggg

SEQ ID NO: 917366 - RNA, 24 nt, Human
aggguagggauggggccccccuuc

SEQ ID NO: 917367 - RNA, 21 nt, Human
aguggugggagguagcaggag

SEQ ID NO: 917368 - RNA, 21 nt, Human
augauggugucuggguggcuu

SEQ ID NO: 917369 - RNA, 21 nt, Human
caagcaccagcugaaggcagg

SEQ ID NO: 917370 - RNA, 19 nt, Human
caccagcugaaggcagggc

SEQ ID NO: 917371 - RNA, 20 nt, Human
cacuggggucccccugcagc

SEQ ID NO: 917372 - RNA, 27 nt, Human
cagaggccuccuuuggagcagaggccc

SEQ ID NO: 917373 - RNA, 18 nt, Human
caggaaucgcagcaagca

SEQ ID NO: 917374 - RNA, 26 nt, Human
ccagaguccuggguuccagaggccuc

SEQ ID NO: 917375 - RNA, 22 nt, Human
ccccagaguccuggguuccaga

SEQ ID NO: 917376 - RNA, 18 nt, Human
cccgagcucggaccccgg

SEQ ID NO: 917377 - RNA, 22 nt, Human
ccuagcacucggcagcucacca

SEQ ID NO: 917378 - RNA, 22 nt, Human
ccuccuugggaaccacaggggc

SEQ ID NO: 917379 - RNA, 20 nt, Human
ccuccuuuggagcagaggcu

SEQ ID NO: 917380 - RNA, 24 nt, Human
ccucuuguaaaaccccagaguccu

SEQ ID NO: 917381 - RNA, 26 nt, Human
ccucuuguaaaaccccagaguccugg

SEQ ID NO: 917382 - RNA, 24 nt, Human
ccucuuguaaaaccccagaguugg

SEQ ID NO: 917383 - RNA, 21 nt, Human
ccuggguuccagaggccuccu

SEQ ID NO: 917384 - RNA, 24 nt, Human
cgcagcaagcaccagcugaaggca

SEQ ID NO: 917385 - RNA, 26 nt, Human
cugcugggacaguggugggagguagc

SEQ ID NO: 917386 - RNA, 22 nt, Human
cuggaguucuggucgaggugau

SEQ ID NO: 917387 - RNA, 22 nt, Human
gacaguggugggagguagcagg

SEQ ID NO: 917388 - RNA, 19 nt, Human
gaggaaaggggcugcccag

SEQ ID NO: 917389 - RNA, 20 nt, Human
gaggaaaggggcugcccaga

SEQ ID NO: 917390 - RNA, 19 nt, Human
gcccuagugggagaggaag

SEQ ID NO: 917391 - RNA, 25 nt, Human
gcccucuuguaaaaccccagagucc

SEQ ID NO: 917392 - RNA, 23 nt, Human
gcggcucucauacauaccccucc

SEQ ID NO: 917393 - RNA, 20 nt, Human
ggagaggaaguuggcacugg

SEQ ID NO: 917394 - RNA, 24 nt, Human
ggcacuggggucccccugcagcug

SEQ ID NO: 917395 - RNA, 21 nt, Human
ggcgggggggcgguggcuaua

SEQ ID NO: 917396 - RNA, 25 nt, Human
gggacaguggugggagguagcagga

SEQ ID NO: 917397 - RNA, 23 nt, Human
gggugccuagcacucggcagcuc

SEQ ID NO: 917398 - RNA, 18 nt, Human
guagagacccccucaaag

SEQ ID NO: 917399 - RNA, 22 nt, Human
gugauggucuccucacaccaug

SEQ ID NO: 917400 - RNA, 22 nt, Human
uagagacccccucaaagugcca

SEQ ID NO: 917401 - RNA, 21 nt, Human
uagcaggagagcggcucucau

SEQ ID NO: 917402 - RNA, 24 nt, Human
uagggauggggccccccuucuguc

SEQ ID NO: 917403 - RNA, 20 nt, Human
uccuggguuccagaggccuc

SEQ ID NO: 917404 - RNA, 23 nt, Human
uccuuuggagcagaggcccugga

SEQ ID NO: 917405 - RNA, 19 nt, Human
ucgaggugauggucuccuc

SEQ ID NO: 917406 - RNA, 23 nt, Human
ucuggaguucuggucgaggugau

SEQ ID NO: 917407 - RNA, 25 nt, Human
ucuuguaaaaccccagaguccuggg

SEQ ID NO: 917408 - RNA, 18 nt, Human
ugcauggggaaaguguga

SEQ ID NO: 917409 - RNA, 24 nt, Human
ugcccagaggaggggccagggcag

SEQ ID NO: 917410 - RNA, 24 nt, Human
ugggagaggaaguuggcacugggg

SEQ ID NO: 917411 - RNA, 24 nt, Human
ugggagaggaaguuggcacugguc

SEQ ID NO: 917412 - RNA, 21 nt, Human
ugggagguagcaggagagcgg

SEQ ID NO: 917413 - RNA, 21 nt, Human
uggggagguagagacccccuc

SEQ ID NO: 917414 - RNA, 24 nt, Human
uuaguucuggagcccccagaagag

SEQ ID NO: 917415 - RNA, 23 nt, Human
uuggagcagaggcccuggaaggg

SEQ ID NO: 917416 - RNA, 20 nt, Human
uuggugcagcuugcccuucc

SEQ ID NO: 917417 - RNA, 25 nt, Human
aaaaacauaacuccaguucuuacca

SEQ ID NO: 917418 - RNA, 22 nt, Human
aaaacaaaaacaaaaacaaaaa

SEQ ID NO: 917419 - RNA, 26 nt, Human
aaaacaaaaacaaaaacaaaaaacaa

SEQ ID NO: 917420 - RNA, 23 nt, Human
aaaacaaagcaccuuucauuuca

SEQ ID NO: 917421 - RNA, 19 nt, Human
aaaacuaaagugcaacaga

SEQ ID NO: 917422 - RNA, 19 nt, Human
aaaagccuuauuguuucac

SEQ ID NO: 917423 - RNA, 24 nt, Human
aaaaugagcauuacgagaaacuca

SEQ ID NO: 917424 - RNA, 22 nt, Human
aaacaaaaacaaaaaacaauga

SEQ ID NO: 917425 - RNA, 23 nt, Human
aaacuaaagugcaacagaagcaa

SEQ ID NO: 917426 - RNA, 23 nt, Human
aagaagcaaagcaguauuaagca

SEQ ID NO: 917427 - RNA, 18 nt, Human
aagcagcagcagaagaau

SEQ ID NO: 917428 - RNA, 24 nt, Human
aagccauaaagaauacgaaaaagc

SEQ ID NO: 917429 - RNA, 18 nt, Human
acaaagguguacuaggca

SEQ ID NO: 917430 - RNA, 24 nt, Human
acccucaucucagaauaaccccau

SEQ ID NO: 917431 - RNA, 23 nt, Human
acgccgggucuaguuguacuggc

SEQ ID NO: 917432 - RNA, 20 nt, Human
agaaaacaagcauggaauau

SEQ ID NO: 917433 - RNA, 18 nt, Human
agaacacucaggcuuucu

SEQ ID NO: 917434 - RNA, 21 nt, Human
agaagccagguuauuuuaugc

SEQ ID NO: 917435 - RNA, 21 nt, Human
agaauaaccccaucuaagaac

SEQ ID NO: 917436 - RNA, 22 nt, Human
agaggaaagggaaaggaaagga

SEQ ID NO: 917437 - RNA, 21 nt, Human
agaucuugacuggcuguggcc

SEQ ID NO: 917438 - RNA, 19 nt, Human
agauuguguucuugcaagc

SEQ ID NO: 917439 - RNA, 22 nt, Human
aggaggcagggaagggagacgg

SEQ ID NO: 917440 - RNA, 21 nt, Human
agggaagggagacggagagga

SEQ ID NO: 917441 - RNA, 20 nt, Human
agugcaagaaaacaucauua

SEQ ID NO: 917442 - RNA, 18 nt, Human
aucacaucaaaugagaua

SEQ ID NO: 917443 - RNA, 27 nt, Human
augcagcagguuuuggaauacagggau

SEQ ID NO: 917444 - RNA, 21 nt, Human
augccagugaaugagaaaaca

SEQ ID NO: 917445 - RNA, 28 nt, Human
augucauauuuucaaauuuaaaaacaua

SEQ ID NO: 917446 - RNA, 27 nt, Human
caaaaacaaaaacaaaaaacaaugauc

SEQ ID NO: 917447 - RNA, 18 nt, Human
caaagcaaagaaauacac

SEQ ID NO: 917448 - RNA, 22 nt, Human
caaagcaccuuucauuucaaaa

SEQ ID NO: 917449 - RNA, 25 nt, Human
caaauauaaggcaauuaauauuuua

SEQ ID NO: 917450 - RNA, 19 nt, Human
caaauuuaaaaacauaacu

SEQ ID NO: 917451 - RNA, 23 nt, Human
cacccaauaaaaauacucuacaa

SEQ ID NO: 917452 - RNA, 18 nt, Human
cagaagaauacaucccau

SEQ ID NO: 917453 - RNA, 23 nt, Human
cagaauaaccccaucuaagaaca

SEQ ID NO: 917454 - RNA, 20 nt, Human
cagcagcagaagaauacauc

SEQ ID NO: 917455 - RNA, 24 nt, Human
cagcagcagaagaauacaucccau

SEQ ID NO: 917456 - RNA, 22 nt, Human
cagcagguuuuggaauacaggg

SEQ ID NO: 917457 - RNA, 22 nt, Human
caugccagugaaugagaaaaca

SEQ ID NO: 917458 - RNA, 20 nt, Human
ccaucuaagaacacucaggc

SEQ ID NO: 917459 - RNA, 27 nt, Human
cccgcagaaugcugggcaccggggacg

SEQ ID NO: 917460 - RNA, 18 nt, Human
cuaagacccucaucucag

SEQ ID NO: 917461 - RNA, 20 nt, Human
cugucugccugccuuuuugu

SEQ ID NO: 917462 - RNA, 26 nt, Human
cuugaaaaaaacaaaaacaaaaacaa

SEQ ID NO: 917463 - RNA, 20 nt, Human
cuugcaagcccacucucagc

SEQ ID NO: 917464 - RNA, 25 nt, Human
gaaaaaaacaaaaacaaaaacaaaa

SEQ ID NO: 917465 - RNA, 22 nt, Human
gaauaaccccaucuaagaacac

SEQ ID NO: 917466 - RNA, 21 nt, Human
gccauaaagaauacgaaaaag

SEQ ID NO: 917467 - RNA, 22 nt, Human
gcccuggccagcuccuuuccug

SEQ ID NO: 917468 - RNA, 21 nt, Human
gcugacuguaagcccaaucca

SEQ ID NO: 917469 - RNA, 20 nt, Human
ggaaaggaaaggaggcaggg

SEQ ID NO: 917470 - RNA, 20 nt, Human
ggaaaggaggcagggaaggg

SEQ ID NO: 917471 - RNA, 19 nt, Human
ggaaagggaaaggaaagga

SEQ ID NO: 917472 - RNA, 19 nt, Human
ggaagggagacggagagga

SEQ ID NO: 917473 - RNA, 19 nt, Human
ggaagggagacggagagga

SEQ ID NO: 917474 - RNA, 23 nt, Human
gggaucuaggcaaguuaaaaaua

SEQ ID NO: 917475 - RNA, 25 nt, Human
guaggcuaagacccucaucucagaa

SEQ ID NO: 917476 - RNA, 22 nt, Human
gugaauuguauuaaaacuauga

SEQ ID NO: 917477 - RNA, 21 nt, Human
uaaaaaacaaagcaccuuuca

SEQ ID NO: 917478 - RNA, 23 nt, Human
uaaaaaacaaagcaccuuucauu

SEQ ID NO: 917479 - RNA, 19 nt, Human
uaaccccaucuaagaacac

SEQ ID NO: 917480 - RNA, 27 nt, Human
uaagcagcagcagaagaauacauccca

SEQ ID NO: 917481 - RNA, 21 nt, Human
uacaaagcaaagaaauacacu

SEQ ID NO: 917482 - RNA, 21 nt, Human
uagaaaacuaaagugcaacag

SEQ ID NO: 917483 - RNA, 22 nt, Human
uaggaaaggguuagggauagaa

SEQ ID NO: 917484 - RNA, 27 nt, Human
uaggaaaggguuagggauagaagccag

SEQ ID NO: 917485 - RNA, 19 nt, Human
uaggaaauacauagucuac

SEQ ID NO: 917486 - RNA, 23 nt, Human
uauauaaggcaucugugaccaag

SEQ ID NO: 917487 - RNA, 23 nt, Human
uaugacaauauuauauaaagaaa

SEQ ID NO: 917488 - RNA, 23 nt, Human
uccaacuuuuccauuuuucaaaa

SEQ ID NO: 917489 - RNA, 25 nt, Human
ugaaaaaaacaaaaacaaaaacaaa

SEQ ID NO: 917490 - RNA, 22 nt, Human
ugaacgcacaaauuccagagaa

SEQ ID NO: 917491 - RNA, 19 nt, Human
ugaauauaauuaaaaaaca

SEQ ID NO: 917492 - RNA, 21 nt, Human
ugacuguguuaaaaaaaaaaa

SEQ ID NO: 917493 - RNA, 18 nt, Human
ugagaaaacaagcaugga

SEQ ID NO: 917494 - RNA, 19 nt, Human
ugagaaaacaagcauggaa

SEQ ID NO: 917495 - RNA, 21 nt, Human
ugagaaaacaagcauggaaua

SEQ ID NO: 917496 - RNA, 19 nt, Human
ugagaacagcauggugauc

SEQ ID NO: 917497 - RNA, 21 nt, Human
ugagaacagcauggugaucac

SEQ ID NO: 917498 - RNA, 18 nt, Human
ugcaauggcacuuucaaa

SEQ ID NO: 917499 - RNA, 24 nt, Human
ugcagguagaaaacuaaagugcaa

SEQ ID NO: 917500 - RNA, 22 nt, Human
ugccaacaaagucugcucuaaa

SEQ ID NO: 917501 - RNA, 20 nt, Human
ugucaauaaaaagaagcaaa

SEQ ID NO: 917502 - RNA, 18 nt, Human
uguguagauacauaugua

SEQ ID NO: 917503 - RNA, 23 nt, Human
uuaauccgccugccccgcagaau

SEQ ID NO: 917504 - RNA, 19 nt, Human
uuagugcaagaaaacauca

SEQ ID NO: 917505 - RNA, 19 nt, Human
uugauggcuugcugugucu

SEQ ID NO: 917506 - RNA, 19 nt, Human
aaaaagaaaagcaaggaaa

SEQ ID NO: 917507 - RNA, 18 nt, Human
aaacaaacaaaaacuccc

SEQ ID NO: 917508 - RNA, 18 nt, Human
aaacagagcaggacacaa

SEQ ID NO: 917509 - RNA, 26 nt, Human
aaacagagcaggacacaaaagaagaa

SEQ ID NO: 917510 - RNA, 21 nt, Human
aaaccucaacaaccacaaaua

SEQ ID NO: 917511 - RNA, 26 nt, Human
aaaccucaacaaccacaaauagcucu

SEQ ID NO: 917512 - RNA, 24 nt, Human
aaagaaaugagaaaggaaaccagg

SEQ ID NO: 917513 - RNA, 22 nt, Human
aaagaagaauccccuaauguug

SEQ ID NO: 917514 - RNA, 23 nt, Human
aaagguaagcaaaagucugguca

SEQ ID NO: 917515 - RNA, 18 nt, Human
aacacacuguuuggaagu

SEQ ID NO: 917516 - RNA, 20 nt, Human
aaccaggaggcagagucugg

SEQ ID NO: 917517 - RNA, 21 nt, Human
aagaaaagcaaggaaaauagc

SEQ ID NO: 917518 - RNA, 23 nt, Human
aagaaaugagaaaggaaaccagg

SEQ ID NO: 917519 - RNA, 22 nt, Human
aagaagaaaaguggauaaagga

SEQ ID NO: 917520 - RNA, 18 nt, Human
acauuuaaaccucugcua

SEQ ID NO: 917521 - RNA, 23 nt, Human
accaaacagagcaggacacaaaa

SEQ ID NO: 917522 - RNA, 22 nt, Human
accccugcaaaaaaaacaguca

SEQ ID NO: 917523 - RNA, 20 nt, Human
agaacagaccccuuuaaaaa

SEQ ID NO: 917524 - RNA, 18 nt, Human
agaaugucuucuccacug

SEQ ID NO: 917525 - RNA, 22 nt, Human
agaguaaacaagggagagcuuc

SEQ ID NO: 917526 - RNA, 19 nt, Human
agauaaauaaaccuagucu

SEQ ID NO: 917527 - RNA, 19 nt, Human
agcaggacacaaaagaaga

SEQ ID NO: 917528 - RNA, 27 nt, Human
agcuaccaaaaaauaggggagaaagga

SEQ ID NO: 917529 - RNA, 22 nt, Human
aggaaaaaauacaaaaaguguc

SEQ ID NO: 917530 - RNA, 23 nt, Human
aggaaaagaagaaacaaacaaaa

SEQ ID NO: 917531 - RNA, 24 nt, Human
aggaaaagaagaaacaaacaaaaa

SEQ ID NO: 917532 - RNA, 24 nt, Human
aggaaaagguaagcaaaagucugg

SEQ ID NO: 917533 - RNA, 24 nt, Human
aggaagaagaaaaguggauaaagg

SEQ ID NO: 917534 - RNA, 20 nt, Human
agggacagggagaaagccaa

SEQ ID NO: 917535 - RNA, 22 nt, Human
aguaaacaagggagagcuuccu

SEQ ID NO: 917536 - RNA, 25 nt, Human
agugacacuagaaacuagacauuug

SEQ ID NO: 917537 - RNA, 22 nt, Human
aguggauaaaggaaaagaagaa

SEQ ID NO: 917538 - RNA, 22 nt, Human
auuccacaaggaagacugauuu

SEQ ID NO: 917539 - RNA, 23 nt, Human
caaaaaaaacagucagcuuuuca

SEQ ID NO: 917540 - RNA, 22 nt, Human
caaaagucuggucaccagaaug

SEQ ID NO: 917541 - RNA, 23 nt, Human
caaacaaaaacucccaaagugaa

SEQ ID NO: 917542 - RNA, 22 nt, Human
caaaccucaacaaccacaaaua

SEQ ID NO: 917543 - RNA, 18 nt, Human
caagacauauacuaaacc

SEQ ID NO: 917544 - RNA, 20 nt, Human
caagacauauacuaaacccg

SEQ ID NO: 917545 - RNA, 19 nt, Human
cagagcaggacacaaaaga

SEQ ID NO: 917546 - RNA, 27 nt, Human
cagagcaggacacaaaagaagaaucuu

SEQ ID NO: 917547 - RNA, 19 nt, Human
cagcagcauacccugggac

SEQ ID NO: 917548 - RNA, 28 nt, Human
caggacacaaaagaagaauccccuaaug

SEQ ID NO: 917549 - RNA, 22 nt, Human
cauauggcccaccaaacagagc

SEQ ID NO: 917550 - RNA, 25 nt, Human
ccaguaaugauagcuacaguuagaa

SEQ ID NO: 917551 - RNA, 19 nt, Human
cccaaugugguaacagagu

SEQ ID NO: 917552 - RNA, 23 nt, Human
cccaccaaacagagcaggacaca

SEQ ID NO: 917553 - RNA, 24 nt, Human
cccaccaaacagagcaggacacaa

SEQ ID NO: 917554 - RNA, 30 nt, Human
cccaccaaacagagcaggacacaaaagaag

SEQ ID NO: 917555 - RNA, 24 nt, Human
cuacaguuagaaagaaaugagaaa

SEQ ID NO: 917556 - RNA, 28 nt, Human
cuacugcaaccugguuggggggcccucc

SEQ ID NO: 917557 - RNA, 27 nt, Human
cucaagacauauacuaaacccggaccu

SEQ ID NO: 917558 - RNA, 18 nt, Human
cuggaaaaaugaucccau

SEQ ID NO: 917559 - RNA, 21 nt, Human
cuuaaggaaaaaauacaaaaa

SEQ ID NO: 917560 - RNA, 23 nt, Human
cuuaaggaaaaaauacaaaaagu

SEQ ID NO: 917561 - RNA, 19 nt, Human
gaaaagcaaggaaaauagc

SEQ ID NO: 917562 - RNA, 22 nt, Human
gaaacaaacaaaaacucccaaa

SEQ ID NO: 917563 - RNA, 20 nt, Human
gaagaagaaaaguggauaaa

SEQ ID NO: 917564 - RNA, 21 nt, Human
gaagaagaaaaguggauaaag

SEQ ID NO: 917565 - RNA, 21 nt, Human
gaagaagaaaaguggauaaag

SEQ ID NO: 917566 - RNA, 20 nt, Human
gaagugaguuggacucuuaa

SEQ ID NO: 917567 - RNA, 21 nt, Human
gagaaaggaagggacagggag

SEQ ID NO: 917568 - RNA, 22 nt, Human
gagagcuuccucaaaugaggau

SEQ ID NO: 917569 - RNA, 23 nt, Human
gaguaaacaagggagagcuuccu

SEQ ID NO: 917570 - RNA, 19 nt, Human
gauaaaggaaaagaagaaa

SEQ ID NO: 917571 - RNA, 21 nt, Human
gcaagcuucaaugccuuccaa

SEQ ID NO: 917572 - RNA, 22 nt, Human
ggaaaagaagaaacaaacaaaa

SEQ ID NO: 917573 - RNA, 22 nt, Human
ggaagaagaaaaguggauaaag

SEQ ID NO: 917574 - RNA, 21 nt, Human
ggcagagucugggaauucaca

SEQ ID NO: 917575 - RNA, 23 nt, Human
gguacauuuaaaccucugcuaua

SEQ ID NO: 917576 - RNA, 19 nt, Human
gucagcuuuucaaaccuca

SEQ ID NO: 917577 - RNA, 23 nt, Human
gugcaagcuucaaugccuuccaa

SEQ ID NO: 917578 - RNA, 18 nt, Human
uaaaaaagaaaagcaagg

SEQ ID NO: 917579 - RNA, 24 nt, Human
uaaaagagcacggcuuuaaagaua

SEQ ID NO: 917580 - RNA, 19 nt, Human
uaaaggcagcauuccacaa

SEQ ID NO: 917581 - RNA, 18 nt, Human
uaacagaguaaacaaggg

SEQ ID NO: 917582 - RNA, 22 nt, Human
uaacccuaaaccaaguuccccu

SEQ ID NO: 917583 - RNA, 21 nt, Human
uacaguuagaaagaaaugaga

SEQ ID NO: 917584 - RNA, 19 nt, Human
uacccugggacuccauacc

SEQ ID NO: 917585 - RNA, 25 nt, Human
uagucuaccaggaagaagaaaagug

SEQ ID NO: 917586 - RNA, 23 nt, Human
uauaucacaaacugcuguuuuug

SEQ ID NO: 917587 - RNA, 20 nt, Human
uauggcccaccaaacagagc

SEQ ID NO: 917588 - RNA, 18 nt, Human
ucacaaacugcuguuuuu

SEQ ID NO: 917589 - RNA, 22 nt, Human
ucagauaaauaaaccuagucua

SEQ ID NO: 917590 - RNA, 18 nt, Human
ucagcuuuucaaaccuca

SEQ ID NO: 917591 - RNA, 25 nt, Human
uccacaauauaaacuguaacauuug

SEQ ID NO: 917592 - RNA, 22 nt, Human
uccacugcagaacagaccccuu

SEQ ID NO: 917593 - RNA, 23 nt, Human
uccuuccaacgucuuaacccuaa

SEQ ID NO: 917594 - RNA, 22 nt, Human
ucuaccaggaagaagaaaagug

SEQ ID NO: 917595 - RNA, 26 nt, Human
ucuccacugcagaacagaccccuuua

SEQ ID NO: 917596 - RNA, 19 nt, Human
ucuuaagcugguaaauccc

SEQ ID NO: 917597 - RNA, 22 nt, Human
ugaagacagagggguucuuugu

SEQ ID NO: 917598 - RNA, 22 nt, Human
ugauuugaggauugaagugauu

SEQ ID NO: 917599 - RNA, 21 nt, Human
ugcaacaguagaggggcagaa

SEQ ID NO: 917600 - RNA, 19 nt, Human
ugcaagcuucaaugccuuc

SEQ ID NO: 917601 - RNA, 23 nt, Human
ugcaagcuucaaugccuuccaaa

SEQ ID NO: 917602 - RNA, 22 nt, Human
uggaaaaaugaucccauaagga

SEQ ID NO: 917603 - RNA, 20 nt, Human
uggcaauuacuuacagagaa

SEQ ID NO: 917604 - RNA, 22 nt, Human
uggcucuaaauaaucagcauuu

SEQ ID NO: 917605 - RNA, 19 nt, Human
ugggcagaggcaaaagcaa

SEQ ID NO: 917606 - RNA, 21 nt, Human
ugggcagaggcaaaagcaagc

SEQ ID NO: 917607 - RNA, 25 nt, Human
ugggcagaggcaaaagcaagcagcc

SEQ ID NO: 917608 - RNA, 19 nt, Human
uggggaaaacaaaaauugg

SEQ ID NO: 917609 - RNA, 22 nt, Human
ugguugggcagaggcaaaagcc

SEQ ID NO: 917610 - RNA, 24 nt, Human
uguacaucaaucaaucgcuaaagc

SEQ ID NO: 917611 - RNA, 22 nt, Human
uguuguuguuuuauuaaagacc

SEQ ID NO: 917612 - RNA, 23 nt, Human
uuaaaagagcacggcuuuaaaga

SEQ ID NO: 917613 - RNA, 23 nt, Human
uuagaaagaaaugagaaaggaaa

SEQ ID NO: 917614 - RNA, 19 nt, Human
uucaucagugacacuagaa

SEQ ID NO: 917615 - RNA, 23 nt, Human
uuccaacgucuuaacccuaaacc

SEQ ID NO: 917616 - RNA, 21 nt, Human
uuccacaaggaagacugauuu

SEQ ID NO: 917617 - RNA, 18 nt, Human
uuccccaaugugguaaca

SEQ ID NO: 917618 - RNA, 24 nt, Human
uuccuuagauuuccuuccaacguc

SEQ ID NO: 917619 - RNA, 18 nt, Human
uugaagacagagggguuc

SEQ ID NO: 917620 - RNA, 22 nt, Human
uugaggauugaagugauuugcc

SEQ ID NO: 917621 - RNA, 18 nt, Human
uuggacucuuaagcuggu

SEQ ID NO: 917622 - RNA, 18 nt, Human
uuuguuuuguuuuguuuu

SEQ ID NO: 917623 - RNA, 20 nt, Human
aacugugucaucuuccagca

SEQ ID NO: 917624 - RNA, 23 nt, Human
agagggggcagguuccucggaga

SEQ ID NO: 917625 - RNA, 23 nt, Human
agagggggcagguuccucggaga

SEQ ID NO: 917626 - RNA, 18 nt, Human
agcucagcagaggccagc

SEQ ID NO: 917627 - RNA, 21 nt, Human
caacugugucaucuuccagca

SEQ ID NO: 917628 - RNA, 24 nt, Human
cagguuccucggagagaaggcaac

SEQ ID NO: 917629 - RNA, 24 nt, Human
cagguuccucggagagaaggcaac

SEQ ID NO: 917630 - RNA, 18 nt, Human
ccagcacaugggccagcc

SEQ ID NO: 917631 - RNA, 18 nt, Human
ccagcacaugggccagcc

SEQ ID NO: 917632 - RNA, 19 nt, Human
ccuggucuccucucucucc

SEQ ID NO: 917633 - RNA, 25 nt, Human
cucagcagcuguccuggucuccucu

SEQ ID NO: 917634 - RNA, 18 nt, Human
cucucucucccccacucc

SEQ ID NO: 917635 - RNA, 21 nt, Human
gggaagcugggccagagggaa

SEQ ID NO: 917636 - RNA, 20 nt, Human
ucagcagaggccagccccuu

SEQ ID NO: 917637 - RNA, 22 nt, Human
ucagcagaggccagccccuucc

SEQ ID NO: 917638 - RNA, 24 nt, Human
ucagcagcuguccuggucuccucu

SEQ ID NO: 917639 - RNA, 22 nt, Human
ucuguugggggaagacccagcu

SEQ ID NO: 917640 - RNA, 19 nt, Human
ugggaagcugggccagagg

SEQ ID NO: 917641 - RNA, 20 nt, Human
uggucuccucucucuccccc

SEQ ID NO: 917642 - RNA, 24 nt, Human
uggugggaaaggagagggggcagg

SEQ ID NO: 917643 - RNA, 24 nt, Human
uggugggaaaggagagggggcagg

SEQ ID NO: 917644 - RNA, 19 nt, Human
uguccuggucuccucucuc

SEQ ID NO: 917645 - RNA, 26 nt, Human
uguccuggucuccucucucuccccca

SEQ ID NO: 917646 - RNA, 25 nt, Human
uuuuuuuuuuugcagaagaagagcc

SEQ ID NO: 917647 - RNA, 18 nt, Human
uuuuuuuuuuuuuuuuug

SEQ ID NO: 917648 - RNA, 18 nt, Human
uuuuuuuuuuuuuuuuug

SEQ ID NO: 917649 - RNA, 19 nt, Human
uuuuuuuuuuuuuuuuugc

SEQ ID NO: 917650 - RNA, 19 nt, Human
agcaggccguggcuccugg

SEQ ID NO: 917651 - RNA, 27 nt, Human
agggccgaggccagagccaccaggaga

SEQ ID NO: 917652 - RNA, 23 nt, Human
ccuccgagcuuccagggcugccc

SEQ ID NO: 917653 - RNA, 22 nt, Human
gagacugggagucaccuuccac

SEQ ID NO: 917654 - RNA, 20 nt, Human
gagcuuccagggcugcccag

SEQ ID NO: 917655 - RNA, 20 nt, Human
ggauccagcagggccgaggc

SEQ ID NO: 917656 - RNA, 24 nt, Human
uccuccgagcuuccagggcugccc

SEQ ID NO: 917657 - RNA, 19 nt, Human
ugaggccccgggucuagga

SEQ ID NO: 917658 - RNA, 19 nt, Human
ugcccaggccaggcugaag

SEQ ID NO: 917659 - RNA, 20 nt, Human
uggacucggggagcaggcug

SEQ ID NO: 917660 - RNA, 21 nt, Human
uggguacuaccccaugagccu

SEQ ID NO: 917661 - RNA, 21 nt, Human
acaacaaauuaacgacacaga

SEQ ID NO: 917662 - RNA, 19 nt, Human
aggaaggagagcggggagg

SEQ ID NO: 917663 - RNA, 20 nt, Human
aggaaggagagcggggaggg

SEQ ID NO: 917664 - RNA, 19 nt, Human
aggagagcggggagggcgg

SEQ ID NO: 917665 - RNA, 18 nt, Human
ccaggaaggagagcgggg

SEQ ID NO: 917666 - RNA, 18 nt, Human
ccccgcagcucgcccagg

SEQ ID NO: 917667 - RNA, 18 nt, Human
cccgcagcucgcccagga

SEQ ID NO: 917668 - RNA, 21 nt, Human
ccgcggccgccccauccccgc

SEQ ID NO: 917669 - RNA, 25 nt, Human
cgacacagaguagcucaaaaccgug

SEQ ID NO: 917670 - RNA, 19 nt, Human
cgccccauccccgcagcuc

SEQ ID NO: 917671 - RNA, 21 nt, Human
cgccccauccccgcagcucgc

SEQ ID NO: 917672 - RNA, 24 nt, Human
cgcggcggcgacggcggcucaggc

SEQ ID NO: 917673 - RNA, 23 nt, Human
cgcucgggcucccgcggccgccc

SEQ ID NO: 917674 - RNA, 22 nt, Human
cggcucaggcgcgcggcaacgg

SEQ ID NO: 917675 - RNA, 24 nt, Human
cgggcggcggcggcggcgguuccu

SEQ ID NO: 917676 - RNA, 24 nt, Human
cugugcagcggcgguggcggcuuu

SEQ ID NO: 917677 - RNA, 21 nt, Human
gaaccuaugugcaaacaacaa

SEQ ID NO: 917678 - RNA, 27 nt, Human
gagacgcgggcggcggcggcggcgacg

SEQ ID NO: 917679 - RNA, 23 nt, Human
gcggcggcggcggcgguuccugc

SEQ ID NO: 917680 - RNA, 26 nt, Human
ggagacgcgggcggcggcggcggcgg

SEQ ID NO: 917681 - RNA, 23 nt, Human
ggcggcggcggcggcgguuccug

SEQ ID NO: 917682 - RNA, 21 nt, Human
gggagggcggcgcgcggcagg

SEQ ID NO: 917683 - RNA, 26 nt, Human
guagcucaagcagccauuuugcuccc

SEQ ID NO: 917684 - RNA, 23 nt, Human
gugcagcggcgguggcggcagca

SEQ ID NO: 917685 - RNA, 23 nt, Human
uccugcgcgcgcucgggcucccu

SEQ ID NO: 917686 - RNA, 24 nt, Human
ucgggcucccgcggccgccccauu

SEQ ID NO: 917687 - RNA, 18 nt, Human
ucgucugaagaacuuugc

SEQ ID NO: 917688 - RNA, 23 nt, Human
ucugaagaacuuugccagauuaa

SEQ ID NO: 917689 - RNA, 19 nt, Human
ugaagaacuuugccagauu

SEQ ID NO: 917690 - RNA, 21 nt, Human
ugccagauuaagccaggcccc

SEQ ID NO: 917691 - RNA, 27 nt, Human
ugcuuucuaaaagcugugcaugugccu

SEQ ID NO: 917692 - RNA, 23 nt, Human
uggaaccuaugugcaaacaacaa

SEQ ID NO: 917693 - RNA, 23 nt, Human
uggcggcagcaagcccugcgcgc

SEQ ID NO: 917694 - RNA, 22 nt, Human
ugugcaaacaacaaauuaacga

SEQ ID NO: 917695 - RNA, 20 nt, Human
aaaacagaugaauccccagg

SEQ ID NO: 917696 - RNA, 19 nt, Human
aaacagaugaauccccagg

SEQ ID NO: 917697 - RNA, 22 nt, Human
aaacuacaacacaaaagaauga

SEQ ID NO: 917698 - RNA, 21 nt, Human
aaccaaacaccacgucaacug

SEQ ID NO: 917699 - RNA, 21 nt, Human
acgggcggguaguggccggac

SEQ ID NO: 917700 - RNA, 22 nt, Human
agggaagugaagaaaacagaug

SEQ ID NO: 917701 - RNA, 22 nt, Human
agugaagaaaacagaugaaucc

SEQ ID NO: 917702 - RNA, 24 nt, Human
agugacaggaggguccauucauug

SEQ ID NO: 917703 - RNA, 22 nt, Human
auggaaccaaacaccacgucaa

SEQ ID NO: 917704 - RNA, 22 nt, Human
caacacaaaagaaugaaccuuu

SEQ ID NO: 917705 - RNA, 18 nt, Human
caacaggaucucagaugc

SEQ ID NO: 917706 - RNA, 19 nt, Human
caccacgucaacuggaacu

SEQ ID NO: 917707 - RNA, 21 nt, Human
caccacgucaacuggaacucu

SEQ ID NO: 917708 - RNA, 18 nt, Human
caccgccggcagccgggu

SEQ ID NO: 917709 - RNA, 22 nt, Human
cagcagcacaggcugaaguuag

SEQ ID NO: 917710 - RNA, 24 nt, Human
cagcagcacaggcugaaguuagcu

SEQ ID NO: 917711 - RNA, 19 nt, Human
cagcccaggccccgcccca

SEQ ID NO: 917712 - RNA, 18 nt, Human
cagccgggucccgccccu

SEQ ID NO: 917713 - RNA, 24 nt, Human
ccaccgccggcagccgggucccgc

SEQ ID NO: 917714 - RNA, 21 nt, Human
cccagcagcacaggcugaagu

SEQ ID NO: 917715 - RNA, 27 nt, Human
ccccaggguaccccgccauggaaccaa

SEQ ID NO: 917716 - RNA, 24 nt, Human
ccccgccccaccgccgccgccaga

SEQ ID NO: 917717 - RNA, 21 nt, Human
ccgccccaccgccgccgccag

SEQ ID NO: 917718 - RNA, 19 nt, Human
ccgccgccgccagagccgc

SEQ ID NO: 917719 - RNA, 21 nt, Human
ccgccgccgccagagccgccg

SEQ ID NO: 917720 - RNA, 18 nt, Human
ccgcgcacgcgcgcuucg

SEQ ID NO: 917721 - RNA, 23 nt, Human
ccgcgcacgcgcgcuucgacccc

SEQ ID NO: 917722 - RNA, 21 nt, Human
ccggcagccgggucccgcccc

SEQ ID NO: 917723 - RNA, 18 nt, Human
cgaccccacguucacagc

SEQ ID NO: 917724 - RNA, 20 nt, Human
cucccccagcuagacccacc

SEQ ID NO: 917725 - RNA, 19 nt, Human
cuggcuguggccuguccca

SEQ ID NO: 917726 - RNA, 20 nt, Human
gaccccacguucacagcccc

SEQ ID NO: 917727 - RNA, 19 nt, Human
gaggaugggugcaggaugu

SEQ ID NO: 917728 - RNA, 18 nt, Human
gagugacaggagggucca

SEQ ID NO: 917729 - RNA, 24 nt, Human
gcaaacgaaggcugaagaucaaga

SEQ ID NO: 917730 - RNA, 20 nt, Human
ggaagugaagaaaacagaug

SEQ ID NO: 917731 - RNA, 24 nt, Human
ggccggaccccuggcuguggccug

SEQ ID NO: 917732 - RNA, 23 nt, Human
ggcucuacggaggggugaggaug

SEQ ID NO: 917733 - RNA, 23 nt, Human
gggcggguaguggccggaccccu

SEQ ID NO: 917734 - RNA, 24 nt, Human
ggugaggaugggugcaggauguca

SEQ ID NO: 917735 - RNA, 21 nt, Human
gugagacugcaacuguccccu

SEQ ID NO: 917736 - RNA, 19 nt, Human
uaaauucuguucagcagag

SEQ ID NO: 917737 - RNA, 23 nt, Human
uaccccgccauggaaccaaacac

SEQ ID NO: 917738 - RNA, 21 nt, Human
ucacagugacaagggacaugg

SEQ ID NO: 917739 - RNA, 18 nt, Human
ucagcagagugacaggag

SEQ ID NO: 917740 - RNA, 18 nt, Human
uccccaggguaccccgcc

SEQ ID NO: 917741 - RNA, 21 nt, Human
uccccaggguaccccgccaug

SEQ ID NO: 917742 - RNA, 24 nt, Human
ugaauccccaggguaccccgccau

SEQ ID NO: 917743 - RNA, 22 nt, Human
ugacaagggacauggggugcgg

SEQ ID NO: 917744 - RNA, 21 nt, Human
ugcaaagggaagugaagaaaa

SEQ ID NO: 917745 - RNA, 20 nt, Human
aaaaacagcaacaacaacaa

SEQ ID NO: 917746 - RNA, 18 nt, Human
aaaacaccaaaaacagca

SEQ ID NO: 917747 - RNA, 20 nt, Human
aaaacaccaaaaacagcaac

SEQ ID NO: 917748 - RNA, 25 nt, Human
aaacagaugugagguaauuuuccau

SEQ ID NO: 917749 - RNA, 25 nt, Human
aaauguaacuuuaauacacauuuca

SEQ ID NO: 917750 - RNA, 27 nt, Human
aacaccaaaaacagcaacaacaacaau

SEQ ID NO: 917751 - RNA, 27 nt, Human
aagcaaaacaccaaaaacagcaacaac

SEQ ID NO: 917752 - RNA, 19 nt, Human
aagggucuuccauucuugc

SEQ ID NO: 917753 - RNA, 21 nt, Human
aaucacaggucaucuaccuuc

SEQ ID NO: 917754 - RNA, 23 nt, Human
aaugaaagaucaucugaacagaa

SEQ ID NO: 917755 - RNA, 22 nt, Human
acagagcccgggaaccucagcc

SEQ ID NO: 917756 - RNA, 21 nt, Human
accaaaaacagcaacaacaac

SEQ ID NO: 917757 - RNA, 21 nt, Human
acgcccaacaggaacacauug

SEQ ID NO: 917758 - RNA, 23 nt, Human
acuacaaccuacauuaagacauu

SEQ ID NO: 917759 - RNA, 24 nt, Human
agaaaaguauauuccaauuaugaa

SEQ ID NO: 917760 - RNA, 19 nt, Human
agcaaaacaccaaaaacag

SEQ ID NO: 917761 - RNA, 23 nt, Human
agcaacaacaacaaugcacugaa

SEQ ID NO: 917762 - RNA, 23 nt, Human
agcauuucgaaccuuuagaaacu

SEQ ID NO: 917763 - RNA, 20 nt, Human
agggaugcugggaucgggug

SEQ ID NO: 917764 - RNA, 21 nt, Human
agggaugcugggaucgggugu

SEQ ID NO: 917765 - RNA, 22 nt, Human
auaauguucucucaucccaaag

SEQ ID NO: 917766 - RNA, 20 nt, Human
auuuuccaucuaaagugacu

SEQ ID NO: 917767 - RNA, 27 nt, Human
caaaaacagcaacaacaacuggagacc

SEQ ID NO: 917768 - RNA, 21 nt, Human
caaaacaccaaaaacagcaac

SEQ ID NO: 917769 - RNA, 23 nt, Human
caagggucuuccauucuugcuuu

SEQ ID NO: 917770 - RNA, 21 nt, Human
caccaaaaacagcaacaacaa

SEQ ID NO: 917771 - RNA, 24 nt, Human
cagcaacaacaacaaugcacugaa

SEQ ID NO: 917772 - RNA, 21 nt, Human
cagcgguaaucuucggcaaaa

SEQ ID NO: 917773 - RNA, 20 nt, Human
cagucuaaucacaggucauc

SEQ ID NO: 917774 - RNA, 21 nt, Human
cagucuaaucacaggucaucu

SEQ ID NO: 917775 - RNA, 20 nt, Human
caucugaacagaagcaauac

SEQ ID NO: 917776 - RNA, 25 nt, Human
cauucuugcuuuaaaauaaacaaag

SEQ ID NO: 917777 - RNA, 20 nt, Human
cccaaguaacccuccuauac

SEQ ID NO: 917778 - RNA, 18 nt, Human
ccgccggugccgccgccc

SEQ ID NO: 917779 - RNA, 23 nt, Human
ccuccaacuggagcaccucggac

SEQ ID NO: 917780 - RNA, 23 nt, Human
cgggaaccucagccuccaacugg

SEQ ID NO: 917781 - RNA, 22 nt, Human
cuaaagugacuacaaccuacau

SEQ ID NO: 917782 - RNA, 20 nt, Human
cuccgccggugccgccgccc

SEQ ID NO: 917783 - RNA, 22 nt, Human
cugaaaagcaaaacaccaaaaa

SEQ ID NO: 917784 - RNA, 19 nt, Human
cugaagaaaacagauguga

SEQ ID NO: 917785 - RNA, 23 nt, Human
cugcaggacgcgagcugaacacg

SEQ ID NO: 917786 - RNA, 20 nt, Human
cugcaggcagggaugcuggg

SEQ ID NO: 917787 - RNA, 23 nt, Human
cuggccccaaguaacccuccuau

SEQ ID NO: 917788 - RNA, 24 nt, Human
gaguccccucaugcaaguuuuuga

SEQ ID NO: 917789 - RNA, 21 nt, Human
gcccagucuaaucacagguca

SEQ ID NO: 917790 - RNA, 19 nt, Human
guauguguauacauauaua

SEQ ID NO: 917791 - RNA, 20 nt, Human
uaaaauagcugccucuaggc

SEQ ID NO: 917792 - RNA, 18 nt, Human
uaaaauuauuccugcuga

SEQ ID NO: 917793 - RNA, 19 nt, Human
uaaguuucaaaaacaucaa

SEQ ID NO: 917794 - RNA, 21 nt, Human
uaaucuucggcaaaaacacua

SEQ ID NO: 917795 - RNA, 19 nt, Human
uacccauauaaguauguaa

SEQ ID NO: 917796 - RNA, 20 nt, Human
uagaacgauucucuaaguaa

SEQ ID NO: 917797 - RNA, 25 nt, Human
uagaccauaaauaccagaugguaaa

SEQ ID NO: 917798 - RNA, 20 nt, Human
uaggaugcacacuaauguga

SEQ ID NO: 917799 - RNA, 20 nt, Human
uauauucaccaaugcauaua

SEQ ID NO: 917800 - RNA, 22 nt, Human
uauggaacuuucauucuagaug

SEQ ID NO: 917801 - RNA, 18 nt, Human
uauguguauacauauaua

SEQ ID NO: 917802 - RNA, 25 nt, Human
ucaacacugaguauaacauuucagu

SEQ ID NO: 917803 - RNA, 22 nt, Human
ucacuuugauguauuccaucuu

SEQ ID NO: 917804 - RNA, 20 nt, Human
ucccaaagaaugauaaucug

SEQ ID NO: 917805 - RNA, 23 nt, Human
ucccugguuauacaaaaucccca

SEQ ID NO: 917806 - RNA, 22 nt, Human
ucucucuaccacuaaauaaaca

SEQ ID NO: 917807 - RNA, 18 nt, Human
ucuucggcaaaaacacua

SEQ ID NO: 917808 - RNA, 23 nt, Human
ugaaaagcaaaacaccaaaaaca

SEQ ID NO: 917809 - RNA, 24 nt, Human
ugaaaagcaaaacaccaaaaacag

SEQ ID NO: 917810 - RNA, 22 nt, Human
ugaaacgugcaccuccugagaa

SEQ ID NO: 917811 - RNA, 24 nt, Human
ugaaagaucaucugaacagaagca

SEQ ID NO: 917812 - RNA, 21 nt, Human
ugaccgaagaaaucaacacua

SEQ ID NO: 917813 - RNA, 18 nt, Human
ugagaacuaacuguuccu

SEQ ID NO: 917814 - RNA, 22 nt, Human
ugccucuaggcugaaaaaaaaa

SEQ ID NO: 917815 - RNA, 21 nt, Human
ugcugaaauaaaaucaagaca

SEQ ID NO: 917816 - RNA, 18 nt, Human
uggagcaccucggacagc

SEQ ID NO: 917817 - RNA, 20 nt, Human
uggccccaaguaacccuccu

SEQ ID NO: 917818 - RNA, 27 nt, Human
uggccccaaguaacccuccuauacuuu

SEQ ID NO: 917819 - RNA, 19 nt, Human
uguaaguauguguauacau

SEQ ID NO: 917820 - RNA, 22 nt, Human
uguaaguauguguauacauaua

SEQ ID NO: 917821 - RNA, 26 nt, Human
uguauacauauauauucaccaaugca

SEQ ID NO: 917822 - RNA, 23 nt, Human
ugugugcauauguuuaaauacaa

SEQ ID NO: 917823 - RNA, 19 nt, Human
uguuucuccccagccgccc

SEQ ID NO: 917824 - RNA, 19 nt, Human
uucagucuacugauuuacu

SEQ ID NO: 917825 - RNA, 18 nt, Human
uugaaggaguccccucau

SEQ ID NO: 917826 - RNA, 22 nt, Human
uugaugaaacgugcaccuccug

SEQ ID NO: 917827 - RNA, 22 nt, Human
uuucaagggucuuccauucuug

SEQ ID NO: 917828 - RNA, 18 nt, Human
aaauaacaaaaaacaaag

SEQ ID NO: 917829 - RNA, 21 nt, Human
aagacagucacagaaaagaug

SEQ ID NO: 917830 - RNA, 20 nt, Human
aagaggggcucaguauggca

SEQ ID NO: 917831 - RNA, 23 nt, Human
aagaguacgacugggauaaaacg

SEQ ID NO: 917832 - RNA, 20 nt, Human
aaggaauggaggucccugag

SEQ ID NO: 917833 - RNA, 19 nt, Human
acgcacguagucaaacagu

SEQ ID NO: 917834 - RNA, 22 nt, Human
aggaagaggggcucaguauggc

SEQ ID NO: 917835 - RNA, 22 nt, Human
aggaauggaggucccugagccu

SEQ ID NO: 917836 - RNA, 24 nt, Human
aggaggccccuggagcagccuggc

SEQ ID NO: 917837 - RNA, 20 nt, Human
aggagggguggacagcaggu

SEQ ID NO: 917838 - RNA, 21 nt, Human
agggaaaaauaaagaccaccc

SEQ ID NO: 917839 - RNA, 19 nt, Human
agggcugggccaugccaag

SEQ ID NO: 917840 - RNA, 24 nt, Human
aggugcccagacaugugggagugg

SEQ ID NO: 917841 - RNA, 21 nt, Human
agguuugaagaggcaaggggg

SEQ ID NO: 917842 - RNA, 21 nt, Human
agucacagaaaagaugggcuu

SEQ ID NO: 917843 - RNA, 20 nt, Human
aguggaaagguggagggggc

SEQ ID NO: 917844 - RNA, 22 nt, Human
augccaggcuguaauguuucug

SEQ ID NO: 917845 - RNA, 18 nt, Human
augcuaggaagaggggcu

SEQ ID NO: 917846 - RNA, 23 nt, Human
caaaccuggaagaguacgacugg

SEQ ID NO: 917847 - RNA, 21 nt, Human
caacgcagggagagcaggcag

SEQ ID NO: 917848 - RNA, 21 nt, Human
caagggcccuggaaaacaaug

SEQ ID NO: 917849 - RNA, 18 nt, Human
cacagaaaagaugggcuu

SEQ ID NO: 917850 - RNA, 22 nt, Human
caccccaugcauuguccauccc

SEQ ID NO: 917851 - RNA, 21 nt, Human
cagcccagggcaggugcccag

SEQ ID NO: 917852 - RNA, 22 nt, Human
cagcccagggcaggugcccagg

SEQ ID NO: 917853 - RNA, 24 nt, Human
ccacagugcugugucgaggcagcu

SEQ ID NO: 917854 - RNA, 22 nt, Human
ccaccaccaccgcucgcuaugg

SEQ ID NO: 917855 - RNA, 18 nt, Human
ccagugucacauggcugg

SEQ ID NO: 917856 - RNA, 22 nt, Human
cccagaugggaggccaugugcu

SEQ ID NO: 917857 - RNA, 26 nt, Human
ccccuggagcagccuggccucagccc

SEQ ID NO: 917858 - RNA, 20 nt, Human
ccuggccucagcccagggcc

SEQ ID NO: 917859 - RNA, 18 nt, Human
cucaaggaauggaggucc

SEQ ID NO: 917860 - RNA, 20 nt, Human
cugggccaugccaagacaaa

SEQ ID NO: 917861 - RNA, 23 nt, Human
gagcaggcaggagcuaccccagu

SEQ ID NO: 917862 - RNA, 18 nt, Human
gagggcgcaggaggcccc

SEQ ID NO: 917863 - RNA, 22 nt, Human
gagguuguugaguggaaaggug

SEQ ID NO: 917864 - RNA, 18 nt, Human
gcaaagagaagcuguagg

SEQ ID NO: 917865 - RNA, 26 nt, Human
gcacaccuccaggaaccaguuaugaa

SEQ ID NO: 917866 - RNA, 19 nt, Human
gcccuggacuggggaagcc

SEQ ID NO: 917867 - RNA, 23 nt, Human
gcgugccugggcaauagggacca

SEQ ID NO: 917868 - RNA, 23 nt, Human
gcugggcgggauggagaggagac

SEQ ID NO: 917869 - RNA, 18 nt, Human
ggaaauggcgugccuggg

SEQ ID NO: 917870 - RNA, 18 nt, Human
ggacaggggugggagguu

SEQ ID NO: 917871 - RNA, 21 nt, Human
ggacaggggugggagguuguu

SEQ ID NO: 917872 - RNA, 18 nt, Human
ggacuggggaagccgaug

SEQ ID NO: 917873 - RNA, 23 nt, Human
ggaggccccuggagcagccuggc

SEQ ID NO: 917874 - RNA, 20 nt, Human
ggcaauagggacaggccaca

SEQ ID NO: 917875 - RNA, 21 nt, Human
ggcaucacaguggccucuggu

SEQ ID NO: 917876 - RNA, 18 nt, Human
ggcuuugugcaugggcug

SEQ ID NO: 917877 - RNA, 23 nt, Human
gggaaaggagcaggggagcccug

SEQ ID NO: 917878 - RNA, 26 nt, Human
gggcugggccaugccaagacaaucuc

SEQ ID NO: 917879 - RNA, 20 nt, Human
ggugagggcgcaggaggccc

SEQ ID NO: 917880 - RNA, 21 nt, Human
guuguugaguggaaaggugga

SEQ ID NO: 917881 - RNA, 24 nt, Human
uaacaaaaaacaaaguagguccca

SEQ ID NO: 917882 - RNA, 25 nt, Human
uccaaaccuggaagaguacgacugg

SEQ ID NO: 917883 - RNA, 18 nt, Human
uccacaaauggcaaagag

SEQ ID NO: 917884 - RNA, 22 nt, Human
uccacaaauggcaaagagaagc

SEQ ID NO: 917885 - RNA, 22 nt, Human
uccggaccaugcagcaggacag

SEQ ID NO: 917886 - RNA, 20 nt, Human
ugaaaagguugguacaucuc

SEQ ID NO: 917887 - RNA, 18 nt, Human
ugaacucagauguaucgc

SEQ ID NO: 917888 - RNA, 21 nt, Human
ugccaagacaaucucaaggaa

SEQ ID NO: 917889 - RNA, 23 nt, Human
ugcccagacaugugggaguggga

SEQ ID NO: 917890 - RNA, 18 nt, Human
uggcugggcgggauggag

SEQ ID NO: 917891 - RNA, 21 nt, Human
uggcugggcgggauggagagg

SEQ ID NO: 917892 - RNA, 25 nt, Human
ugggaggccaugugcuuggaccggc

SEQ ID NO: 917893 - RNA, 22 nt, Human
ugggcaauagggacaggccaca

SEQ ID NO: 917894 - RNA, 19 nt, Human
uguaauguuucugugugga

SEQ ID NO: 917895 - RNA, 18 nt, Human
uguggcaggugagggcgc

SEQ ID NO: 917896 - RNA, 23 nt, Human
uguugaggagggguggacagcag

SEQ ID NO: 917897 - RNA, 20 nt, Human
uuguugaguggaaaggugga

SEQ ID NO: 917898 - RNA, 22 nt, Human
uuguugaguggaaagguggagg

SEQ ID NO: 917899 - RNA, 21 nt, Human
uuuuuuuuuuuuuaaagguug

SEQ ID NO: 917900 - RNA, 22 nt, Human
uuuuuuuuuuuuuuuuuaaagg

SEQ ID NO: 917901 - RNA, 18 nt, Human
aaaacagauucuccaagc

SEQ ID NO: 917902 - RNA, 20 nt, Human
aaagggcuggggaaccagca

SEQ ID NO: 917903 - RNA, 20 nt, Human
aaagggcuggggaaccagca

SEQ ID NO: 917904 - RNA, 22 nt, Human
aaccccaagggugccccaaagg

SEQ ID NO: 917905 - RNA, 23 nt, Human
aagggugccccaaaggcacagug

SEQ ID NO: 917906 - RNA, 21 nt, Human
accccaagggugccccaaagg

SEQ ID NO: 917907 - RNA, 20 nt, Human
acugggcaccauuucagccg

SEQ ID NO: 917908 - RNA, 23 nt, Human
agaagaaacagaggaaucuaaag

SEQ ID NO: 917909 - RNA, 20 nt, Human
agagagaacauggccaagaa

SEQ ID NO: 917910 - RNA, 24 nt, Human
aggaggggggcggaggggcagagc

SEQ ID NO: 917911 - RNA, 22 nt, Human
aggcacaguggcagugaggcuu

SEQ ID NO: 917912 - RNA, 24 nt, Human
caagaauuauccagguagaagaaa

SEQ ID NO: 917913 - RNA, 23 nt, Human
caagccagggcagggaaaagggc

SEQ ID NO: 917914 - RNA, 24 nt, Human
ccaggccaggcaugcuggaccaca

SEQ ID NO: 917915 - RNA, 23 nt, Human
cgcccaggccaggcaugcuggac

SEQ ID NO: 917916 - RNA, 19 nt, Human
cugcuucuggggcuggcgg

SEQ ID NO: 917917 - RNA, 18 nt, Human
gaaaagggcuggggaacc

SEQ ID NO: 917918 - RNA, 18 nt, Human
gaaaugguagugccgggu

SEQ ID NO: 917919 - RNA, 19 nt, Human
gaggggcagagcugaccug

SEQ ID NO: 917920 - RNA, 18 nt, Human
gcagggaaaagggcuggg

SEQ ID NO: 917921 - RNA, 20 nt, Human
ggaggggcagagcugaccug

SEQ ID NO: 917922 - RNA, 21 nt, Human
gggaaccagcaggaggggggc

SEQ ID NO: 917923 - RNA, 22 nt, Human
gggcagggaaaagggcugggga

SEQ ID NO: 917924 - RNA, 23 nt, Human
ggggaaccagcaggaggggggcg

SEQ ID NO: 917925 - RNA, 19 nt, Human
ucaguggagauugaaaaca

SEQ ID NO: 917926 - RNA, 25 nt, Human
uccaagccagggcagggaaaagggc

SEQ ID NO: 917927 - RNA, 22 nt, Human
uccagguagaagaaacagagga

SEQ ID NO: 917928 - RNA, 22 nt, Human
uccaucacugcugauggacugg

SEQ ID NO: 917929 - RNA, 18 nt, Human
uccgaagacgaccccuca

SEQ ID NO: 917930 - RNA, 21 nt, Human
ugaaaacagauucuccaagcc

SEQ ID NO: 917931 - RNA, 28 nt, Human
ugaaaacagauucuccaagccagggcag

SEQ ID NO: 917932 - RNA, 24 nt, Human
uggcagugaggcuugcucuggccu

SEQ ID NO: 917933 - RNA, 19 nt, Human
uggccuaguccuccagcaa

SEQ ID NO: 917934 - RNA, 20 nt, Human
uggccuaguccuccagcaaa

SEQ ID NO: 917935 - RNA, 22 nt, Human
ugggcaccauuucagccguucu

SEQ ID NO: 917936 - RNA, 23 nt, Human
uuccucacagccgcugccuagau

SEQ ID NO: 917937 - RNA, 20 nt, Human
acaaaccacauccccuaucc

SEQ ID NO: 917938 - RNA, 23 nt, Human
agaugguaguaugguucuaaagc

SEQ ID NO: 917939 - RNA, 24 nt, Human
cacccguggaaaugcugcucaggg

SEQ ID NO: 917940 - RNA, 19 nt, Human
caugucuuuauuucagagu

SEQ ID NO: 917941 - RNA, 19 nt, Human
cuaaagcucacuccauggc

SEQ ID NO: 917942 - RNA, 22 nt, Human
cucaugcucaugucuuuauuuc

SEQ ID NO: 917943 - RNA, 18 nt, Human
cuggagaugguaguaugg

SEQ ID NO: 917944 - RNA, 22 nt, Human
cuggagaugguaguaugguucu

SEQ ID NO: 917945 - RNA, 19 nt, Human
cuguccucugaagaaacac

SEQ ID NO: 917946 - RNA, 21 nt, Human
cuuggcagcucucaauucucc

SEQ ID NO: 917947 - RNA, 23 nt, Human
cuuggcagcucucaauucuccuu

SEQ ID NO: 917948 - RNA, 21 nt, Human
gagaagcuaucaaaauacuca

SEQ ID NO: 917949 - RNA, 24 nt, Human
ggcaggaaguggacaaaagggacc

SEQ ID NO: 917950 - RNA, 30 nt, Human
gucaagagagagggagggcugggaacucaa

SEQ ID NO: 917951 - RNA, 22 nt, Human
guuugggccuggagaugguagu

SEQ ID NO: 917952 - RNA, 21 nt, Human
uaaagcucacuccauggcagg

SEQ ID NO: 917953 - RNA, 19 nt, Human
uaacaaaccacauccccua

SEQ ID NO: 917954 - RNA, 23 nt, Human
uauuucagaguuugggccuggag

SEQ ID NO: 917955 - RNA, 24 nt, Human
ucaaaauacucauccuuuguaaca

SEQ ID NO: 917956 - RNA, 19 nt, Human
ucacuccauggcaggaagu

SEQ ID NO: 917957 - RNA, 23 nt, Human
ucugagcuuuguuauaaaccugc

SEQ ID NO: 917958 - RNA, 20 nt, Human
uggcagcucucaauucuccu

SEQ ID NO: 917959 - RNA, 21 nt, Human
uucaaggaaugagaagcuauc

SEQ ID NO: 917960 - RNA, 25 nt, Human
uuuuuugcucaugcucaugucuuua

SEQ ID NO: 917961 - RNA, 23 nt, Human
aaagaccucccccaaagcacguc

SEQ ID NO: 917962 - RNA, 19 nt, Human
aaagcacguccacaccccc

SEQ ID NO: 917963 - RNA, 26 nt, Human
agaccucccccaaagcacguccacac

SEQ ID NO: 917964 - RNA, 18 nt, Human
agcauuccacugcccagu

SEQ ID NO: 917965 - RNA, 22 nt, Human
agccaaacaccugcccaggcuc

SEQ ID NO: 917966 - RNA, 24 nt, Human
aggcggaagccagacccggcggaa

SEQ ID NO: 917967 - RNA, 27 nt, Human
aggcggcaucgggagagcaggcgggcc

SEQ ID NO: 917968 - RNA, 22 nt, Human
cacacccccucggcagcgucug

SEQ ID NO: 917969 - RNA, 18 nt, Human
cacucugcuugccaacgu

SEQ ID NO: 917970 - RNA, 22 nt, Human
cacugcccagucggacuuccac

SEQ ID NO: 917971 - RNA, 22 nt, Human
caggagccguccugguucgagc

SEQ ID NO: 917972 - RNA, 24 nt, Human
caucuuaguguaaugagcugaaaa

SEQ ID NO: 917973 - RNA, 24 nt, Human
ccaaacaccugcccaggcucugcu

SEQ ID NO: 917974 - RNA, 20 nt, Human
ccccaaagcacguccacacc

SEQ ID NO: 917975 - RNA, 18 nt, Human
cccccggggucgccgggg

SEQ ID NO: 917976 - RNA, 20 nt, Human
cccccucggcagcgucugcc

SEQ ID NO: 917977 - RNA, 21 nt, Human
ccccucuuggguuauggaaau

SEQ ID NO: 917978 - RNA, 23 nt, Human
ccuccaucagcauuccacugccc

SEQ ID NO: 917979 - RNA, 21 nt, Human
ccuucugcgagggcgcgagga

SEQ ID NO: 917980 - RNA, 19 nt, Human
cggcagcgucugccuccau

SEQ ID NO: 917981 - RNA, 20 nt, Human
cguccacacccccucggcag

SEQ ID NO: 917982 - RNA, 19 nt, Human
cuuaaagaccucccccaaa

SEQ ID NO: 917983 - RNA, 24 nt, Human
gccugcgguccggggccgcucggc

SEQ ID NO: 917984 - RNA, 25 nt, Human
gcggcaucgggagagcaggcgggcc

SEQ ID NO: 917985 - RNA, 23 nt, Human
guccggggccgcucggcaggcgg

SEQ ID NO: 917986 - RNA, 31 nt, Human
uaaaaauaacaaauacuaagccaaacaccuu

SEQ ID NO: 917987 - RNA, 18 nt, Human
uaagccaaacaccugccc

SEQ ID NO: 917988 - RNA, 20 nt, Human
uaagccaaacaccugcccag

SEQ ID NO: 917989 - RNA, 23 nt, Human
uacaguuaaacaauagacuuaaa

SEQ ID NO: 917990 - RNA, 24 nt, Human
ucccccaaagcacguccacacccc

SEQ ID NO: 917991 - RNA, 19 nt, Human
ucucuugugggccgggugg

SEQ ID NO: 917992 - RNA, 20 nt, Human
ucucuugugggccggguggu

SEQ ID NO: 917993 - RNA, 20 nt, Human
ucuggugggcucuggauggu

SEQ ID NO: 917994 - RNA, 19 nt, Human
ucuugugggccgggugguu

SEQ ID NO: 917995 - RNA, 21 nt, Human
ugcccaggcucugcugccuca

SEQ ID NO: 917996 - RNA, 24 nt, Human
uguugucucuugugggccgggugg

SEQ ID NO: 917997 - RNA, 24 nt, Human
uuccacagccucagaccccccucu

SEQ ID NO: 917998 - RNA, 21 nt, Human
aguaugcugcuuccaacauaa

SEQ ID NO: 917999 - RNA, 22 nt, Human
caacauaauuucucagagaaca

SEQ ID NO: 918000 - RNA, 20 nt, Human
cagagaacaaagacugacca

SEQ ID NO: 918001 - RNA, 23 nt, Human
cauuuuuauaauaaaacugaaaa

SEQ ID NO: 918002 - RNA, 24 nt, Human
cugcuuccaacauaauuucucaga

SEQ ID NO: 918003 - RNA, 21 nt, Human
uaaauacauguguucaaacaa

SEQ ID NO: 918004 - RNA, 21 nt, Human
ucuguuuuauaaauacaugug

SEQ ID NO: 918005 - RNA, 22 nt, Human
ucuguuuuauaaauacaugugu

SEQ ID NO: 918006 - RNA, 20 nt, Human
ugcuuccaacauaauuucuc

SEQ ID NO: 918007 - RNA, 20 nt, Human
uucagagggguagucuuuuu

SEQ ID NO: 918008 - RNA, 20 nt, Human
caguaccacuggcccagagc

SEQ ID NO: 918009 - RNA, 23 nt, Human
ccagacuguuuucuacuaacucc

SEQ ID NO: 918010 - RNA, 20 nt, Human
ccuucacugcagugcuuaga

SEQ ID NO: 918011 - RNA, 23 nt, Human
gcaccagcauccagacuguuuuc

SEQ ID NO: 918012 - RNA, 18 nt, Human
guaccacuggcccagagc

SEQ ID NO: 918013 - RNA, 25 nt, Human
uaguggcaccagcauccagacuguu

SEQ ID NO: 918014 - RNA, 22 nt, Human
ucaguaccacuggcccagagca

SEQ ID NO: 918015 - RNA, 20 nt, Human
ugccugaaacuucaaugaga

SEQ ID NO: 918016 - RNA, 19 nt, Human
uucaaugagauccauucca

SEQ ID NO: 918017 - RNA, 25 nt, Human
aacucacuuagaacaguccagcccc

SEQ ID NO: 918018 - RNA, 25 nt, Human
aagcucccccacccgaacucacuua

SEQ ID NO: 918019 - RNA, 21 nt, Human
aaggccaccacaggcugaggg

SEQ ID NO: 918020 - RNA, 18 nt, Human
agucaggaugcaaggcca

SEQ ID NO: 918021 - RNA, 18 nt, Human
auauggggagaaaagggu

SEQ ID NO: 918022 - RNA, 24 nt, Human
caacaaggaacaaucgcgccccuc

SEQ ID NO: 918023 - RNA, 23 nt, Human
caaggaacaaucgcgccccuccu

SEQ ID NO: 918024 - RNA, 21 nt, Human
caccucggccaggaucggggg

SEQ ID NO: 918025 - RNA, 20 nt, Human
cacuggggauauggcagggu

SEQ ID NO: 918026 - RNA, 21 nt, Human
cacuucucccuaccccuaaaa

SEQ ID NO: 918027 - RNA, 23 nt, Human
cagaaucuagacccccccugucu

SEQ ID NO: 918028 - RNA, 19 nt, Human
cagagucagccccaccccc

SEQ ID NO: 918029 - RNA, 19 nt, Human
cagccccacccccaccuca

SEQ ID NO: 918030 - RNA, 18 nt, Human
cagcucacuccuagaacc

SEQ ID NO: 918031 - RNA, 22 nt, Human
caggguuucgccuucaagcaca

SEQ ID NO: 918032 - RNA, 23 nt, Human
cauuuugcagagucagccccacc

SEQ ID NO: 918033 - RNA, 18 nt, Human
ccaacccccucagaaucu

SEQ ID NO: 918034 - RNA, 23 nt, Human
ccaacccccucagaaucuagacc

SEQ ID NO: 918035 - RNA, 20 nt, Human
ccagaacaaggggcugagaa

SEQ ID NO: 918036 - RNA, 24 nt, Human
ccagagguuuccugccuugcccaa

SEQ ID NO: 918037 - RNA, 18 nt, Human
ccccaccucagcaggccc

SEQ ID NO: 918038 - RNA, 22 nt, Human
ccccaccucagcaggccccagc

SEQ ID NO: 918039 - RNA, 24 nt, Human
ccccaccucagcaggccccagcuc

SEQ ID NO: 918040 - RNA, 20 nt, Human
ccccauggagaaaaugaggu

SEQ ID NO: 918041 - RNA, 25 nt, Human
cccccaccucagcaggccccagcuc

SEQ ID NO: 918042 - RNA, 23 nt, Human
cccccucagaaucuagacccccc

SEQ ID NO: 918043 - RNA, 21 nt, Human
ccccuaaaaucgggacaccuc

SEQ ID NO: 918044 - RNA, 20 nt, Human
ccccucagaaucuagacccc

SEQ ID NO: 918045 - RNA, 21 nt, Human
cccuccuuugcccuuggaguc

SEQ ID NO: 918046 - RNA, 23 nt, Human
cccuccuuugcccuuggagucuc

SEQ ID NO: 918047 - RNA, 20 nt, Human
ccgccacgccucgcgaugcc

SEQ ID NO: 918048 - RNA, 21 nt, Human
ccgccacgccucgcgaugccu

SEQ ID NO: 918049 - RNA, 18 nt, Human
ccuaccccuaaaaucggg

SEQ ID NO: 918050 - RNA, 21 nt, Human
ccucagaaucuagaccccccc

SEQ ID NO: 918051 - RNA, 21 nt, Human
ccuccugaagagcauggcugu

SEQ ID NO: 918052 - RNA, 18 nt, Human
ccucggccaggaucgggg

SEQ ID NO: 918053 - RNA, 22 nt, Human
ccugaagagcauggcugucuuc

SEQ ID NO: 918054 - RNA, 19 nt, Human
cgagguuuuuuuuuuuuuu

SEQ ID NO: 918055 - RNA, 21 nt, Human
cgagguuuuuuuuuuuuuuuu

SEQ ID NO: 918056 - RNA, 22 nt, Human
cgcgcggaauggacgcggccac

SEQ ID NO: 918057 - RNA, 24 nt, Human
cggaauggacgcggccacuaagcg

SEQ ID NO: 918058 - RNA, 21 nt, Human
cuccagagguuuccugccuug

SEQ ID NO: 918059 - RNA, 21 nt, Human
cuccucgccguagcugcgaac

SEQ ID NO: 918060 - RNA, 19 nt, Human
cuucacagagcagccuccc

SEQ ID NO: 918061 - RNA, 21 nt, Human
gaacaguccagccccgcccag

SEQ ID NO: 918062 - RNA, 25 nt, Human
gaagcucccccacccgaacucacuu

SEQ ID NO: 918063 - RNA, 23 nt, Human
gacuggcacuggggauauggcag

SEQ ID NO: 918064 - RNA, 23 nt, Human
gagaacauccagucaggaugcaa

SEQ ID NO: 918065 - RNA, 20 nt, Human
gcaaggccaccacaggcuga

SEQ ID NO: 918066 - RNA, 23 nt, Human
gcacagccaagacacccuccuuu

SEQ ID NO: 918067 - RNA, 26 nt, Human
gcacagccaagacacccuccuuugcc

SEQ ID NO: 918068 - RNA, 18 nt, Human
gcccuuggagucuccucc

SEQ ID NO: 918069 - RNA, 22 nt, Human
gccuugcccaauauccaccaac

SEQ ID NO: 918070 - RNA, 22 nt, Human
ggaacaaucgcgccccuccucg

SEQ ID NO: 918071 - RNA, 26 nt, Human
ggagaaaaugaggucuccagagguuu

SEQ ID NO: 918072 - RNA, 19 nt, Human
ggagcucuggguucuugcc

SEQ ID NO: 918073 - RNA, 18 nt, Human
ggggacuggcacugggga

SEQ ID NO: 918074 - RNA, 18 nt, Human
guccaaacagauaugggg

SEQ ID NO: 918075 - RNA, 21 nt, Human
uagcugcgaacagggcugacc

SEQ ID NO: 918076 - RNA, 22 nt, Human
uauuaguauccacacuggggag

SEQ ID NO: 918077 - RNA, 23 nt, Human
uccagucaggaugcaaggccacc

SEQ ID NO: 918078 - RNA, 19 nt, Human
ucgcgccccuccucgccgu

SEQ ID NO: 918079 - RNA, 24 nt, Human
ugaagcucccccacccgaacucac

SEQ ID NO: 918080 - RNA, 24 nt, Human
ugcccagaacaaggggcugagaac

SEQ ID NO: 918081 - RNA, 20 nt, Human
uggagaaaaugaggucucca

SEQ ID NO: 918082 - RNA, 24 nt, Human
uggagaaaaugaggucuccagagg

SEQ ID NO: 918083 - RNA, 18 nt, Human
uggcacuggggauauggc

SEQ ID NO: 918084 - RNA, 18 nt, Human
uguccaaacagauauggg

SEQ ID NO: 918085 - RNA, 21 nt, Human
uuugagagugugcuccaagag

SEQ ID NO: 918086 - RNA, 21 nt, Human
uuuuuguuuugagagugugcu

SEQ ID NO: 918087 - RNA, 18 nt, Human
uuuuuuuuuuuuguuuug

SEQ ID NO: 918088 - RNA, 18 nt, Human
uuuuuuuuuuuuuuuuug

SEQ ID NO: 918089 - RNA, 24 nt, Human
uuuuuuuuuuuuuuuuuuuguuuu

SEQ ID NO: 918090 - RNA, 23 nt, Human
aaaaaagaaaucagacagacaug

SEQ ID NO: 918091 - RNA, 20 nt, Human
aaaaagccauggcagcagcg

SEQ ID NO: 918092 - RNA, 23 nt, Human
aaaauaaaaacaacaacaaagaa

SEQ ID NO: 918093 - RNA, 25 nt, Human
aaacauaacuuaugacaauuauguu

SEQ ID NO: 918094 - RNA, 23 nt, Human
aaauaaauucaaaaaucugaaac

SEQ ID NO: 918095 - RNA, 20 nt, Human
aacagaaaugcaaaccgaga

SEQ ID NO: 918096 - RNA, 24 nt, Human
aacaggaaaaaaaaagaaaucaga

SEQ ID NO: 918097 - RNA, 21 nt, Human
aaccgagacaccccugcaaac

SEQ ID NO: 918098 - RNA, 19 nt, Human
aagcagugccaaaaaguuc

SEQ ID NO: 918099 - RNA, 26 nt, Human
acaacaacaaagaaucaaaacagaga

SEQ ID NO: 918100 - RNA, 27 nt, Human
acagaacacaguuguagaaagacaccg

SEQ ID NO: 918101 - RNA, 19 nt, Human
acagacacaaacugacacg

SEQ ID NO: 918102 - RNA, 19 nt, Human
acaugacaauaacucaucc

SEQ ID NO: 918103 - RNA, 20 nt, Human
accauugucugaaccguggc

SEQ ID NO: 918104 - RNA, 24 nt, Human
accccgugagaaccuuauuacacc

SEQ ID NO: 918105 - RNA, 18 nt, Human
acccgcucgcccacucgc

SEQ ID NO: 918106 - RNA, 23 nt, Human
acccgcucgcccacucgcccgcc

SEQ ID NO: 918107 - RNA, 24 nt, Human
accugauaacaaaaauauauacca

SEQ ID NO: 918108 - RNA, 23 nt, Human
agaagguggcuggaguggggaga

SEQ ID NO: 918109 - RNA, 21 nt, Human
agacuacaagacgagaaaaac

SEQ ID NO: 918110 - RNA, 23 nt, Human
agagccuaguuuuaugaaaaagc

SEQ ID NO: 918111 - RNA, 24 nt, Human
agccuucagcuccagcugcagcuu

SEQ ID NO: 918112 - RNA, 21 nt, Human
agcuucuccccuagccccucc

SEQ ID NO: 918113 - RNA, 20 nt, Human
aggaaaaaaaaagaaaucag

SEQ ID NO: 918114 - RNA, 25 nt, Human
aggagggagcggauuuagggguuca

SEQ ID NO: 918115 - RNA, 20 nt, Human
aggucucuagagcauauagu

SEQ ID NO: 918116 - RNA, 21 nt, Human
aggugcgaagccagggaaguu

SEQ ID NO: 918117 - RNA, 22 nt, Human
auccaaagcagugccaaaaagu

SEQ ID NO: 918118 - RNA, 23 nt, Human
augcaccugauaacaaaaauaua

SEQ ID NO: 918119 - RNA, 21 nt, Human
auuacaccauaaagacacgcc

SEQ ID NO: 918120 - RNA, 20 nt, Human
caaaacagagaugucuaaac

SEQ ID NO: 918121 - RNA, 24 nt, Human
caacaacaaagaaucaaaacagag

SEQ ID NO: 918122 - RNA, 19 nt, Human
caacugugugggguuccga

SEQ ID NO: 918123 - RNA, 21 nt, Human
caagggggugcgagaaaguca

SEQ ID NO: 918124 - RNA, 21 nt, Human
cacagcucaacgccugccucc

SEQ ID NO: 918125 - RNA, 23 nt, Human
cacuccggccgccgggacagucu

SEQ ID NO: 918126 - RNA, 19 nt, Human
cacuuggacaauagcaaag

SEQ ID NO: 918127 - RNA, 19 nt, Human
cagaguuugcagaugaaaa

SEQ ID NO: 918128 - RNA, 19 nt, Human
cagcagcgacgacaauagc

SEQ ID NO: 918129 - RNA, 22 nt, Human
cagcaggcggagcccuggcccc

SEQ ID NO: 918130 - RNA, 18 nt, Human
cagcccccugagagugcc

SEQ ID NO: 918131 - RNA, 21 nt, Human
caggaaaaaaaaagaaaucag

SEQ ID NO: 918132 - RNA, 22 nt, Human
caggcggagcccuggccccgcu

SEQ ID NO: 918133 - RNA, 22 nt, Human
cagggaaguuuguuuguuuugu

SEQ ID NO: 918134 - RNA, 19 nt, Human
caguccauccaccauacag

SEQ ID NO: 918135 - RNA, 22 nt, Human
cagugccaaaaaguucaguaaa

SEQ ID NO: 918136 - RNA, 18 nt, Human
cauaguccaacaggaaaa

SEQ ID NO: 918137 - RNA, 23 nt, Human
ccaggcaggugcgaagccaggga

SEQ ID NO: 918138 - RNA, 18 nt, Human
ccaggccgcgcugcucac

SEQ ID NO: 918139 - RNA, 18 nt, Human
cccacucgcccgcccggg

SEQ ID NO: 918140 - RNA, 26 nt, Human
ccgccgccgccgccgcaggauuccag

SEQ ID NO: 918141 - RNA, 18 nt, Human
ccgccgccgccgccgccg

SEQ ID NO: 918142 - RNA, 21 nt, Human
ccgccgccgccgccgccgcag

SEQ ID NO: 918143 - RNA, 21 nt, Human
ccgcucgcccacucgcccgcc

SEQ ID NO: 918144 - RNA, 18 nt, Human
ccgcugucgccgccgccg

SEQ ID NO: 918145 - RNA, 24 nt, Human
ccgcugucgccgccgccgccgccg

SEQ ID NO: 918146 - RNA, 22 nt, Human
ccuccuuacuaccagcagagcc

SEQ ID NO: 918147 - RNA, 23 nt, Human
ccuucagcuccagcugcagcuuc

SEQ ID NO: 918148 - RNA, 31 nt, Human
cgagaaaaacauuauacggucacguagaggg

SEQ ID NO: 918149 - RNA, 18 nt, Human
cgagacaccccugcaaac

SEQ ID NO: 918150 - RNA, 19 nt, Human
cgagacagacacaaacuga

SEQ ID NO: 918151 - RNA, 21 nt, Human
cgcccgggcccuggcucgccc

SEQ ID NO: 918152 - RNA, 23 nt, Human
cgccgccgccgccgcaggauucc

SEQ ID NO: 918153 - RNA, 19 nt, Human
cgggguugggaguugcaac

SEQ ID NO: 918154 - RNA, 18 nt, Human
cguccaggccgcgcugcu

SEQ ID NO: 918155 - RNA, 22 nt, Human
cgugugugugugccuuuuccuu

SEQ ID NO: 918156 - RNA, 24 nt, Human
cucauaauaaacuuggcucuuucc

SEQ ID NO: 918157 - RNA, 24 nt, Human
cuccccuagccccuccuuuaauuu

SEQ ID NO: 918158 - RNA, 22 nt, Human
cucuuccugucaccugcuuggg

SEQ ID NO: 918159 - RNA, 23 nt, Human
cugguggaagaagaaaaugccga

SEQ ID NO: 918160 - RNA, 19 nt, Human
cuuuuuuguuuuuauuuuu

SEQ ID NO: 918161 - RNA, 26 nt, Human
gaaagacaccgaaaaaguuggagacc

SEQ ID NO: 918162 - RNA, 21 nt, Human
gaaaugagggcgacgccguuu

SEQ ID NO: 918163 - RNA, 25 nt, Human
gagccuucagcuccagcugcagcuu

SEQ ID NO: 918164 - RNA, 22 nt, Human
gaguggggagaugugcacagcu

SEQ ID NO: 918165 - RNA, 23 nt, Human
gcccucaaugaaaaagccauggc

SEQ ID NO: 918166 - RNA, 19 nt, Human
gcucgcccgcugucgccgc

SEQ ID NO: 918167 - RNA, 18 nt, Human
gcugcagcuucuccccua

SEQ ID NO: 918168 - RNA, 22 nt, Human
ggcagcagcgacgacaauagcc

SEQ ID NO: 918169 - RNA, 24 nt, Human
gggaugguguucagcgagguggga

SEQ ID NO: 918170 - RNA, 20 nt, Human
gggguaggcgggagcgaggg

SEQ ID NO: 918171 - RNA, 19 nt, Human
guaaaagcugguggaagaa

SEQ ID NO: 918172 - RNA, 21 nt, Human
guuggucuuauugcuggcgcu

SEQ ID NO: 918173 - RNA, 18 nt, Human
guuuuuuaaaccuuucug

SEQ ID NO: 918174 - RNA, 25 nt, Human
uaaaaacaacaacaaagaaucaaaa

SEQ ID NO: 918175 - RNA, 23 nt, Human
uaaaauaaaaacaacaacaaaga

SEQ ID NO: 918176 - RNA, 21 nt, Human
uaauuugucuuuuuuuuccuu

SEQ ID NO: 918177 - RNA, 18 nt, Human
uacacucuuggaaaacua

SEQ ID NO: 918178 - RNA, 23 nt, Human
uagaaagacaccgaaaaaguuaa

SEQ ID NO: 918179 - RNA, 24 nt, Human
uaggcccucaaugaaaaagccaug

SEQ ID NO: 918180 - RNA, 19 nt, Human
uauauaccauugucugaac

SEQ ID NO: 918181 - RNA, 18 nt, Human
uaucuagaguuugugccu

SEQ ID NO: 918182 - RNA, 21 nt, Human
uauguucacaaacauagucca

SEQ ID NO: 918183 - RNA, 22 nt, Human
uauguucacaaacauaguccaa

SEQ ID NO: 918184 - RNA, 19 nt, Human
ucaacauucaacuaauauc

SEQ ID NO: 918185 - RNA, 25 nt, Human
ucaguaaaagcugguggaagaagaa

SEQ ID NO: 918186 - RNA, 22 nt, Human
uccaacaggaaaaaaaaagaaa

SEQ ID NO: 918187 - RNA, 26 nt, Human
ucgcccgcugucgccgccgccgccgg

SEQ ID NO: 918188 - RNA, 21 nt, Human
ucgccgccgccgccgccgccg

SEQ ID NO: 918189 - RNA, 22 nt, Human
ucgccgccgccgccgccgccgc

SEQ ID NO: 918190 - RNA, 24 nt, Human
ugaaaaagccuccuaugagaugcc

SEQ ID NO: 918191 - RNA, 20 nt, Human
ugaaacauaacuuaugacaa

SEQ ID NO: 918192 - RNA, 22 nt, Human
ugagaaccuuauuacaccauaa

SEQ ID NO: 918193 - RNA, 23 nt, Human
ugaggccccccaucucuuccugu

SEQ ID NO: 918194 - RNA, 23 nt, Human
ugcaaaccgagacaccccugcaa

SEQ ID NO: 918195 - RNA, 20 nt, Human
ugccaaaaaguucaguaaaa

SEQ ID NO: 918196 - RNA, 22 nt, Human
ugccuugucugaggucucuaga

SEQ ID NO: 918197 - RNA, 19 nt, Human
ugccuuuuaaaauaaaaac

SEQ ID NO: 918198 - RNA, 18 nt, Human
ugcgaggccccaggcagg

SEQ ID NO: 918199 - RNA, 22 nt, Human
uggaaaacuauaagcacaugua

SEQ ID NO: 918200 - RNA, 27 nt, Human
uggaagaagaaaaugccgacgggggga

SEQ ID NO: 918201 - RNA, 19 nt, Human
uggagaagguggcuggagu

SEQ ID NO: 918202 - RNA, 21 nt, Human
uggcagcagcgacgacaauag

SEQ ID NO: 918203 - RNA, 24 nt, Human
uggguuguuggcuuuuuguuuuuu

SEQ ID NO: 918204 - RNA, 23 nt, Human
ugguugaggccccccaucucuuc

SEQ ID NO: 918205 - RNA, 21 nt, Human
ugguuucugccuuccaacuuu

SEQ ID NO: 918206 - RNA, 18 nt, Human
ugucuaaacugcgcgaag

SEQ ID NO: 918207 - RNA, 22 nt, Human
uucugccuuccaacuuuuuugu

SEQ ID NO: 918208 - RNA, 25 nt, Human
uucugccuuccaacuuuuuuguuuu

SEQ ID NO: 918209 - RNA, 29 nt, Human
uugaccccaauccaaagcagugccaaaaa

SEQ ID NO: 918210 - RNA, 20 nt, Human
uuggggguugaggaaggggg

SEQ ID NO: 918211 - RNA, 19 nt, Human
uuugcagaugaaaaggcau

SEQ ID NO: 918212 - RNA, 18 nt, Human
uuuuacuuuuuugucuuu

SEQ ID NO: 918213 - RNA, 21 nt, Human
aauaccauaucacagcacaaa

SEQ ID NO: 918214 - RNA, 22 nt, Human
aaugcacauucaucaaaguggc

SEQ ID NO: 918215 - RNA, 21 nt, Human
acccgcagcuucugcggcuuc

SEQ ID NO: 918216 - RNA, 23 nt, Human
acccggcgccucacaggacaccc

SEQ ID NO: 918217 - RNA, 24 nt, Human
agaggaaauauccaaauuguaauc

SEQ ID NO: 918218 - RNA, 23 nt, Human
aggagaggaaauauccaaauugu

SEQ ID NO: 918219 - RNA, 20 nt, Human
aucaucuucaucaucaccgu

SEQ ID NO: 918220 - RNA, 20 nt, Human
caccgggaagcgccacccgg

SEQ ID NO: 918221 - RNA, 23 nt, Human
cacgacaccgggaagcgccaccc

SEQ ID NO: 918222 - RNA, 19 nt, Human
cagcacaaaaacauacccc

SEQ ID NO: 918223 - RNA, 23 nt, Human
cagcagcuccauggugaccgcua

SEQ ID NO: 918224 - RNA, 19 nt, Human
caggcccuggaaagggucg

SEQ ID NO: 918225 - RNA, 23 nt, Human
caucuucaucaucaccguccaag

SEQ ID NO: 918226 - RNA, 21 nt, Human
ccauaucacagcacaaaaaca

SEQ ID NO: 918227 - RNA, 21 nt, Human
cccagcagcuccauggugacc

SEQ ID NO: 918228 - RNA, 20 nt, Human
ccgccgccacccggugcugc

SEQ ID NO: 918229 - RNA, 21 nt, Human
cgggaagcgccacccggaggc

SEQ ID NO: 918230 - RNA, 30 nt, Human
cugcccgacguacucucccagcagcuccaa

SEQ ID NO: 918231 - RNA, 20 nt, Human
gacaccgggaagcgccaccc

SEQ ID NO: 918232 - RNA, 21 nt, Human
gcagcuucugcggcuucccuu

SEQ ID NO: 918233 - RNA, 24 nt, Human
gcagcuucugcggcuucccuuccu

SEQ ID NO: 918234 - RNA, 18 nt, Human
gugcauauuugacguggg

SEQ ID NO: 918235 - RNA, 24 nt, Human
guuauuuuuauauuuaaugcccaa

SEQ ID NO: 918236 - RNA, 20 nt, Human
uaagcuuccagaacacgaca

SEQ ID NO: 918237 - RNA, 18 nt, Human
uaccagagggucgaauaa

SEQ ID NO: 918238 - RNA, 25 nt, Human
uaccauaucacagcacaaaaacaua

SEQ ID NO: 918239 - RNA, 23 nt, Human
uaugaauucaggguuuccuuggg

SEQ ID NO: 918240 - RNA, 24 nt, Human
ucaauaaucuuuuuaaagcaaaau

SEQ ID NO: 918241 - RNA, 20 nt, Human
ucaugucaguucucugaaau

SEQ ID NO: 918242 - RNA, 19 nt, Human
ucucugaaauguuacugcc

SEQ ID NO: 918243 - RNA, 21 nt, Human
ugcacauucaucaaaguggca

SEQ ID NO: 918244 - RNA, 25 nt, Human
ugcaucaucuucaucaucaccgucc

SEQ ID NO: 918245 - RNA, 19 nt, Human
ugggccacgccagacaaca

SEQ ID NO: 918246 - RNA, 23 nt, Human
ugggucucuuucaaggacucucc

SEQ ID NO: 918247 - RNA, 20 nt, Human
uguaaucaaugcagauuguu

SEQ ID NO: 918248 - RNA, 19 nt, Human
uguauaaauaccauaucac

SEQ ID NO: 918249 - RNA, 22 nt, Human
uuuuuggccguuuugcagaugg

SEQ ID NO: 918250 - RNA, 23 nt, Human
aaagagacuugugaggagcaaag

SEQ ID NO: 918251 - RNA, 18 nt, Human
aaagugcucuuaucaucg

SEQ ID NO: 918252 - RNA, 19 nt, Human
aagagaaagagacuuguga

SEQ ID NO: 918253 - RNA, 23 nt, Human
acacugaaggaugccaagaaaag

SEQ ID NO: 918254 - RNA, 24 nt, Human
acccgcucgccucccgcuuccccu

SEQ ID NO: 918255 - RNA, 18 nt, Human
agaaagagacuugugagg

SEQ ID NO: 918256 - RNA, 23 nt, Human
agacuugugaggagcaaaggaac

SEQ ID NO: 918257 - RNA, 22 nt, Human
agagaaagagacuugugaggag

SEQ ID NO: 918258 - RNA, 19 nt, Human
aggagguagcgggcuuggc

SEQ ID NO: 918259 - RNA, 21 nt, Human
aguuucagaauugacaucagg

SEQ ID NO: 918260 - RNA, 19 nt, Human
caacuuuaguuucagaauu

SEQ ID NO: 918261 - RNA, 25 nt, Human
cccgcucgccucccgcuuccccucc

SEQ ID NO: 918262 - RNA, 19 nt, Human
cccgcuuccccuccagucc

SEQ ID NO: 918263 - RNA, 24 nt, Human
ccuacccgcucgccucccgcuucc

SEQ ID NO: 918264 - RNA, 23 nt, Human
ccucccgcuuccccuccaguccc

SEQ ID NO: 918265 - RNA, 21 nt, Human
ccucuuacaggagguagcggg

SEQ ID NO: 918266 - RNA, 24 nt, Human
cgccucccgcuuccccuccagucc

SEQ ID NO: 918267 - RNA, 19 nt, Human
cucgccucccgcuuccccu

SEQ ID NO: 918268 - RNA, 22 nt, Human
gagcaaaggaacaccuacccgc

SEQ ID NO: 918269 - RNA, 19 nt, Human
gaugccaagaaaaguuugc

SEQ ID NO: 918270 - RNA, 24 nt, Human
gccucccgcuuccccuccaguccu

SEQ ID NO: 918271 - RNA, 23 nt, Human
gcucgccucccgcuuccccucca

SEQ ID NO: 918272 - RNA, 20 nt, Human
uaaaaaguuguuuuaccaac

SEQ ID NO: 918273 - RNA, 19 nt, Human
uaaaagagaaagagacuug

SEQ ID NO: 918274 - RNA, 24 nt, Human
uaaacacugaaggaugccaagaaa

SEQ ID NO: 918275 - RNA, 26 nt, Human
uacaaggaacuuucauauauuuuuug

SEQ ID NO: 918276 - RNA, 23 nt, Human
uaguuuccauguauucaaaaaau

SEQ ID NO: 918277 - RNA, 19 nt, Human
uauacauacacauauauau

SEQ ID NO: 918278 - RNA, 19 nt, Human
uauauacauacacauauau

SEQ ID NO: 918279 - RNA, 23 nt, Human
uauauacauacacauauauaucu

SEQ ID NO: 918280 - RNA, 21 nt, Human
uccaguccucuuacaggaggu

SEQ ID NO: 918281 - RNA, 21 nt, Human
uccccauaaacacugaaggau

SEQ ID NO: 918282 - RNA, 20 nt, Human
ugggugucaaccuggcuuuu

SEQ ID NO: 918283 - RNA, 25 nt, Human
ugugaggagcaaaggaacaccuacc

SEQ ID NO: 918284 - RNA, 18 nt, Human
uuaagaaguuucuguauu

SEQ ID NO: 918285 - RNA, 22 nt, Human
uuggguuugagacgcacucgag

SEQ ID NO: 918286 - RNA, 25 nt, Human
uuuugggugucaaccuggcuuuggg

SEQ ID NO: 918287 - RNA, 24 nt, Human
uuuuuuuuuuuuuuuuuuucaaug

SEQ ID NO: 918288 - RNA, 19 nt, Human
ggaggggagcugggcgggg

SEQ ID NO: 918289 - RNA, 20 nt, Human
uguggaggggagcugggcgg

SEQ ID NO: 918290 - RNA, 25 nt, Human
uuuuuuuuuuuuuuuuuuuucaagg

SEQ ID NO: 918291 - RNA, 19 nt, Human
aagacagaguccugaucuc

SEQ ID NO: 918292 - RNA, 18 nt, Human
agaguccugaucucgccc

SEQ ID NO: 918293 - RNA, 24 nt, Human
caccgugcuccuggccuuagaacu

SEQ ID NO: 918294 - RNA, 22 nt, Human
cagaguccugaucucgcccuuc

SEQ ID NO: 918295 - RNA, 19 nt, Human
cagcagaggagcaguaacg

SEQ ID NO: 918296 - RNA, 21 nt, Human
cgcagccuggucuucccgcgg

SEQ ID NO: 918297 - RNA, 22 nt, Human
cggcggcugcgggccagcggaa

SEQ ID NO: 918298 - RNA, 21 nt, Human
cgggcgaggagcggccguuug

SEQ ID NO: 918299 - RNA, 19 nt, Human
cggggcguggccgccgggc

SEQ ID NO: 918300 - RNA, 22 nt, Human
cuggccuuagaacaauaccaga

SEQ ID NO: 918301 - RNA, 20 nt, Human
gaacaauaccagacacuccc

SEQ ID NO: 918302 - RNA, 24 nt, Human
gaucucgcccuucucugcccccac

SEQ ID NO: 918303 - RNA, 18 nt, Human
gcacucggagccgagcuc

SEQ ID NO: 918304 - RNA, 19 nt, Human
gccaucuugcgucuggguc

SEQ ID NO: 918305 - RNA, 20 nt, Human
gcgcucgcugcggcuccugg

SEQ ID NO: 918306 - RNA, 19 nt, Human
gcggcggcgaaggcaggcg

SEQ ID NO: 918307 - RNA, 24 nt, Human
gcgggcgaggagcgacggcggcgg

SEQ ID NO: 918308 - RNA, 26 nt, Human
ggaccagaaacgaaggcagcagagga

SEQ ID NO: 918309 - RNA, 24 nt, Human
ggacuccucugggcgggcggcgag

SEQ ID NO: 918310 - RNA, 19 nt, Human
ggcgaggagcgacggcggc

SEQ ID NO: 918311 - RNA, 26 nt, Human
ggggacuccucugggcgggcggcgag

SEQ ID NO: 918312 - RNA, 26 nt, Human
guaggcccgagggaggcgaccuucau

SEQ ID NO: 918313 - RNA, 18 nt, Human
gucgccaucuugcgucug

SEQ ID NO: 918314 - RNA, 20 nt, Human
gucuggguccggucgggucc

SEQ ID NO: 918315 - RNA, 23 nt, Human
uagaacaauaccagacacuccca

SEQ ID NO: 918316 - RNA, 21 nt, Human
ucuucccgcgggcgaggagcu

SEQ ID NO: 918317 - RNA, 22 nt, Human
ugccgaagucgcggcggcugcg

SEQ ID NO: 918318 - RNA, 23 nt, Human
ugcuccuggccuuagaacaauac

SEQ ID NO: 918319 - RNA, 21 nt, Human
uggccgccgggcgcucgcugc

SEQ ID NO: 918320 - RNA, 18 nt, Human
ugggagacuagccagagg

SEQ ID NO: 918321 - RNA, 18 nt, Human
uuaacaaagacagagucc

SEQ ID NO: 918322 - RNA, 22 nt, Human
aaaaacaacuacccacccccaa

SEQ ID NO: 918323 - RNA, 20 nt, Human
aaaacaacuacccacccccc

SEQ ID NO: 918324 - RNA, 18 nt, Human
aaaacauagcagggaaca

SEQ ID NO: 918325 - RNA, 20 nt, Human
aaacaacuacccacccccaa

SEQ ID NO: 918326 - RNA, 18 nt, Human
aaacacacacauccccaa

SEQ ID NO: 918327 - RNA, 23 nt, Human
aaacacacacauccccaagagaa

SEQ ID NO: 918328 - RNA, 21 nt, Human
aaccaaaaacaacuacccacc

SEQ ID NO: 918329 - RNA, 24 nt, Human
aagagaacaagcagccacuggccg

SEQ ID NO: 918330 - RNA, 20 nt, Human
aaguccccggccccucccuc

SEQ ID NO: 918331 - RNA, 23 nt, Human
acacacacauccccaagagaaca

SEQ ID NO: 918332 - RNA, 21 nt, Human
acacauccccaagagaacaag

SEQ ID NO: 918333 - RNA, 20 nt, Human
acagagagaaacugcaaaca

SEQ ID NO: 918334 - RNA, 23 nt, Human
acagcagugagcagagcccgggc

SEQ ID NO: 918335 - RNA, 25 nt, Human
accuucuucagccccugcuucgcug

SEQ ID NO: 918336 - RNA, 18 nt, Human
acuucugccccacagcuc

SEQ ID NO: 918337 - RNA, 19 nt, Human
agaagagggcaggagacag

SEQ ID NO: 918338 - RNA, 19 nt, Human
agaggcaggccccaggcag

SEQ ID NO: 918339 - RNA, 23 nt, Human
agaggcaggccccaggcaggcuc

SEQ ID NO: 918340 - RNA, 23 nt, Human
agccacuggccgagaucuacacc

SEQ ID NO: 918341 - RNA, 22 nt, Human
agcccuccaggcagaagagggc

SEQ ID NO: 918342 - RNA, 19 nt, Human
agcucuuccucagcagccc

SEQ ID NO: 918343 - RNA, 22 nt, Human
aggcagaagagggcaggagaca

SEQ ID NO: 918344 - RNA, 23 nt, Human
aggcagggccugacaccugggga

SEQ ID NO: 918345 - RNA, 19 nt, Human
agggccccaggauccaccu

SEQ ID NO: 918346 - RNA, 22 nt, Human
agugaaaaggccaacgucagga

SEQ ID NO: 918347 - RNA, 24 nt, Human
aucccuccuuccauagggccccag

SEQ ID NO: 918348 - RNA, 23 nt, Human
caaaauuuacugaagagaaacau

SEQ ID NO: 918349 - RNA, 18 nt, Human
caaacagccacuacaggu

SEQ ID NO: 918350 - RNA, 24 nt, Human
caaguugaggaaacugagucacga

SEQ ID NO: 918351 - RNA, 19 nt, Human
cacauccccaagagaacaa

SEQ ID NO: 918352 - RNA, 26 nt, Human
cacauccccaagagaacaagcagcca

SEQ ID NO: 918353 - RNA, 21 nt, Human
cacauccucucuucucuucuu

SEQ ID NO: 918354 - RNA, 18 nt, Human
cagaaguggucccagguu

SEQ ID NO: 918355 - RNA, 22 nt, Human
cagagcccccagccacaccuuc

SEQ ID NO: 918356 - RNA, 21 nt, Human
cagcagcccuggcuccuucug

SEQ ID NO: 918357 - RNA, 23 nt, Human
cagcagggguggaacgccaaagc

SEQ ID NO: 918358 - RNA, 18 nt, Human
caugccuccuucccaccg

SEQ ID NO: 918359 - RNA, 25 nt, Human
ccacaccuucuucagccccugcuuc

SEQ ID NO: 918360 - RNA, 19 nt, Human
ccagaggacucugcugugu

SEQ ID NO: 918361 - RNA, 22 nt, Human
ccagccacaccuucuucagccc

SEQ ID NO: 918362 - RNA, 23 nt, Human
ccaucugaagcccaggcacccca

SEQ ID NO: 918363 - RNA, 18 nt, Human
cccaagagaacaagcagc

SEQ ID NO: 918364 - RNA, 23 nt, Human
cccacagcucuuccucagcagcc

SEQ ID NO: 918365 - RNA, 18 nt, Human
cccagcacccuccuugcu

SEQ ID NO: 918366 - RNA, 19 nt, Human
ccccaccacaucccuccuu

SEQ ID NO: 918367 - RNA, 18 nt, Human
ccccagucaaguucccug

SEQ ID NO: 918368 - RNA, 19 nt, Human
ccccagucaaguucccugu

SEQ ID NO: 918369 - RNA, 22 nt, Human
ccccccccaccacaucccuccu

SEQ ID NO: 918370 - RNA, 24 nt, Human
ccccccccaccacaucccuccuuc

SEQ ID NO: 918371 - RNA, 20 nt, Human
cccccucuuccuccugcucc

SEQ ID NO: 918372 - RNA, 18 nt, Human
cccccucuuccuccuucu

SEQ ID NO: 918373 - RNA, 19 nt, Human
cccccucuuccuccuucuc

SEQ ID NO: 918374 - RNA, 20 nt, Human
cccccucuuccuccuucucc

SEQ ID NO: 918375 - RNA, 23 nt, Human
ccccucuuccuccucccccucuu

SEQ ID NO: 918376 - RNA, 21 nt, Human
ccccucuuccuccugcuccuc

SEQ ID NO: 918377 - RNA, 18 nt, Human
ccccucuuccuccuucuc

SEQ ID NO: 918378 - RNA, 18 nt, Human
cccggccccucccucagu

SEQ ID NO: 918379 - RNA, 22 nt, Human
cccucaguguggccccccccac

SEQ ID NO: 918380 - RNA, 20 nt, Human
cccuccugagcccacccgcu

SEQ ID NO: 918381 - RNA, 27 nt, Human
ccggccccucccucaguguggcccccc

SEQ ID NO: 918382 - RNA, 18 nt, Human
ccucaguguggccccccc

SEQ ID NO: 918383 - RNA, 19 nt, Human
ccuccaggucccacguggc

SEQ ID NO: 918384 - RNA, 28 nt, Human
ccucccucaguguggccccccccaccag

SEQ ID NO: 918385 - RNA, 18 nt, Human
ccuccuccugcugugggu

SEQ ID NO: 918386 - RNA, 23 nt, Human
ccuccuccuuccccucuuccucc

SEQ ID NO: 918387 - RNA, 20 nt, Human
ccuccucuuucucuuccuca

SEQ ID NO: 918388 - RNA, 18 nt, Human
ccuccuuccccucuuccu

SEQ ID NO: 918389 - RNA, 21 nt, Human
ccuccuucuccucccccucuu

SEQ ID NO: 918390 - RNA, 21 nt, Human
ccuccuugcuggagugaaggc

SEQ ID NO: 918391 - RNA, 27 nt, Human
ccugcggggcuucacuuccuccgcggg

SEQ ID NO: 918392 - RNA, 21 nt, Human
ccuuccccucuuccuccuccc

SEQ ID NO: 918393 - RNA, 19 nt, Human
cgaccuggcuucccugucc

SEQ ID NO: 918394 - RNA, 22 nt, Human
cgccaaagcacaaagcuuccug

SEQ ID NO: 918395 - RNA, 20 nt, Human
cggaacagcagugagcagag

SEQ ID NO: 918396 - RNA, 21 nt, Human
cucagcagcccuggcuccuuc

SEQ ID NO: 918397 - RNA, 20 nt, Human
cuccaggcagaagagggcag

SEQ ID NO: 918398 - RNA, 22 nt, Human
cuccaggcagaagagggcagga

SEQ ID NO: 918399 - RNA, 20 nt, Human
cuccucccccucuuccuccu

SEQ ID NO: 918400 - RNA, 21 nt, Human
cuccuccuuccccucuucccc

SEQ ID NO: 918401 - RNA, 22 nt, Human
cuccucuuucucuuccucacug

SEQ ID NO: 918402 - RNA, 18 nt, Human
cugagcccacccgcuggg

SEQ ID NO: 918403 - RNA, 22 nt, Human
cugccccacagcucuuccucag

SEQ ID NO: 918404 - RNA, 24 nt, Human
cuggcuccuucuggcagaggcagg

SEQ ID NO: 918405 - RNA, 19 nt, Human
cuggggcagggcccugccc

SEQ ID NO: 918406 - RNA, 21 nt, Human
cuggggcagggcccugcccua

SEQ ID NO: 918407 - RNA, 18 nt, Human
cugguugguccuccugca

SEQ ID NO: 918408 - RNA, 19 nt, Human
cuuccccucuuccuccucc

SEQ ID NO: 918409 - RNA, 25 nt, Human
gaagaaaagggaaucuaacacagag

SEQ ID NO: 918410 - RNA, 21 nt, Human
gaaggagugcuucggucuucu

SEQ ID NO: 918411 - RNA, 21 nt, Human
gagagaaacugcaaacagcca

SEQ ID NO: 918412 - RNA, 18 nt, Human
gaguaacagcaggggugg

SEQ ID NO: 918413 - RNA, 19 nt, Human
gcaaaccaaaaacaacuac

SEQ ID NO: 918414 - RNA, 22 nt, Human
gcaaaccaaaaacaacuaccca

SEQ ID NO: 918415 - RNA, 23 nt, Human
gcaauguguacucgcuucaggga

SEQ ID NO: 918416 - RNA, 21 nt, Human
gccccucccucaguguggccc

SEQ ID NO: 918417 - RNA, 23 nt, Human
gccuccccugcggggcuucacuu

SEQ ID NO: 918418 - RNA, 24 nt, Human
gccugacaccuggggacacugacg

SEQ ID NO: 918419 - RNA, 19 nt, Human
ggaacagcagugagcagag

SEQ ID NO: 918420 - RNA, 23 nt, Human
ggaacccccuccugagcccaccc

SEQ ID NO: 918421 - RNA, 19 nt, Human
ggcagcaagagagguagag

SEQ ID NO: 918422 - RNA, 22 nt, Human
ggccgagaucuacaccggcaaa

SEQ ID NO: 918423 - RNA, 21 nt, Human
ggccugaugaugacgcaaacc

SEQ ID NO: 918424 - RNA, 19 nt, Human
ggcuaugugggcucagguc

SEQ ID NO: 918425 - RNA, 21 nt, Human
gugggcaugcucagcucaaag

SEQ ID NO: 918426 - RNA, 23 nt, Human
uaaaaacacacacauccccaaga

SEQ ID NO: 918427 - RNA, 25 nt, Human
uaggaaggcagaaguggucccaggu

SEQ ID NO: 918428 - RNA, 21 nt, Human
ucagcagcccuggcuccuucu

SEQ ID NO: 918429 - RNA, 24 nt, Human
ucagcagcccuggcuccuucuggc

SEQ ID NO: 918430 - RNA, 23 nt, Human
ucagggaacccccuccugagccc

SEQ ID NO: 918431 - RNA, 24 nt, Human
uccaccucuugccaggaugguggg

SEQ ID NO: 918432 - RNA, 24 nt, Human
uccagcugguggaaaguaaggggg

SEQ ID NO: 918433 - RNA, 19 nt, Human
ucccgugucugguuggucc

SEQ ID NO: 918434 - RNA, 24 nt, Human
ucccucugccccagucaaguuccc

SEQ ID NO: 918435 - RNA, 22 nt, Human
ucccugcugccugccaggggaa

SEQ ID NO: 918436 - RNA, 23 nt, Human
uccucaaaguccagaggacucug

SEQ ID NO: 918437 - RNA, 22 nt, Human
uccuccucccgaucauccucuu

SEQ ID NO: 918438 - RNA, 18 nt, Human
uccuccucuuucucuucc

SEQ ID NO: 918439 - RNA, 21 nt, Human
ucuacaccggcaaagcagagg

SEQ ID NO: 918440 - RNA, 23 nt, Human
ucuucagccccugcuucgcuggg

SEQ ID NO: 918441 - RNA, 21 nt, Human
ucuuccuccucccccucuucc

SEQ ID NO: 918442 - RNA, 24 nt, Human
ucuuccuccuccuuccccucuucc

SEQ ID NO: 918443 - RNA, 22 nt, Human
ucuuccuccuucuccucccccc

SEQ ID NO: 918444 - RNA, 25 nt, Human
ucuucucuucuuacacuucuuccuc

SEQ ID NO: 918445 - RNA, 24 nt, Human
ugaaaaggccaacgucaggaggca

SEQ ID NO: 918446 - RNA, 20 nt, Human
ugaaacugcugaagaaaagg

SEQ ID NO: 918447 - RNA, 18 nt, Human
ugaaugcugccuuccugg

SEQ ID NO: 918448 - RNA, 19 nt, Human
ugacagcacucaaauaacu

SEQ ID NO: 918449 - RNA, 24 nt, Human
ugacgcaaaccaaaaacaacuacc

SEQ ID NO: 918450 - RNA, 22 nt, Human
ugacggaugagaaagauggcug

SEQ ID NO: 918451 - RNA, 18 nt, Human
ugagaaagauggcugagc

SEQ ID NO: 918452 - RNA, 22 nt, Human
ugaggaaacugagucacgagua

SEQ ID NO: 918453 - RNA, 22 nt, Human
ugccaggauggugggcucuggc

SEQ ID NO: 918454 - RNA, 22 nt, Human
ugcccuauagacugcacaggac

SEQ ID NO: 918455 - RNA, 25 nt, Human
ugcucagauaaaaacacacacaucc

SEQ ID NO: 918456 - RNA, 20 nt, Human
ugcugugugugcuucggguu

SEQ ID NO: 918457 - RNA, 21 nt, Human
uggaaaggagcugcucagaua

SEQ ID NO: 918458 - RNA, 19 nt, Human
uggaacgccaaagcacaaa

SEQ ID NO: 918459 - RNA, 18 nt, Human
uggcagaggcaggcccca

SEQ ID NO: 918460 - RNA, 20 nt, Human
uggcagaggcaggccccagg

SEQ ID NO: 918461 - RNA, 24 nt, Human
uggccccccccaccacaucccucc

SEQ ID NO: 918462 - RNA, 18 nt, Human
uggccugggugccagugg

SEQ ID NO: 918463 - RNA, 19 nt, Human
uguccagaggaccaggcca

SEQ ID NO: 918464 - RNA, 22 nt, Human
uguuaggggcuaugggcccggc

SEQ ID NO: 918465 - RNA, 22 nt, Human
uuauucuccucuuccuccuccc

SEQ ID NO: 918466 - RNA, 18 nt, Human
uucaaaugucccugcugc

SEQ ID NO: 918467 - RNA, 27 nt, Human
uuccuccuucuccucccccucuucccu

SEQ ID NO: 918468 - RNA, 18 nt, Human
uucuccucuuccuccucc

SEQ ID NO: 918469 - RNA, 24 nt, Human
uucucuucuuacacuucuuccucc

SEQ ID NO: 918470 - RNA, 23 nt, Human
aagaagaaaaauaagauguagga

SEQ ID NO: 918471 - RNA, 21 nt, Human
aagugauucuucugccucagc

SEQ ID NO: 918472 - RNA, 19 nt, Human
aauaagauguaggaagaga

SEQ ID NO: 918473 - RNA, 21 nt, Human
acaauggaagauacuacuaaa

SEQ ID NO: 918474 - RNA, 18 nt, Human
acgggguuucaccguguu

SEQ ID NO: 918475 - RNA, 19 nt, Human
acgggguuucaccguguua

SEQ ID NO: 918476 - RNA, 20 nt, Human
acgggguuucaccguguuag

SEQ ID NO: 918477 - RNA, 24 nt, Human
acgggguuucaccguguuagccag

SEQ ID NO: 918478 - RNA, 26 nt, Human
agaagaaaaauaagauguaggaagag

SEQ ID NO: 918479 - RNA, 18 nt, Human
agccuccugaguagcuag

SEQ ID NO: 918480 - RNA, 21 nt, Human
aguagcuaggauuacaggcau

SEQ ID NO: 918481 - RNA, 24 nt, Human
agugauucuucugccucagccucc

SEQ ID NO: 918482 - RNA, 20 nt, Human
agugcaauggcgcaaucucg

SEQ ID NO: 918483 - RNA, 24 nt, Human
agugcaauggcgcaaucucggcuc

SEQ ID NO: 918484 - RNA, 21 nt, Human
auuaucaaaaguguaucagau

SEQ ID NO: 918485 - RNA, 24 nt, Human
auuuuugcacuuuuaguagagacg

SEQ ID NO: 918486 - RNA, 24 nt, Human
caaccuccaccuccuggguugaag

SEQ ID NO: 918487 - RNA, 18 nt, Human
caccguguuagccaggau

SEQ ID NO: 918488 - RNA, 24 nt, Human
caccguguuagccaggauggucuc

SEQ ID NO: 918489 - RNA, 21 nt, Human
cacuacaaccuccaccuccug

SEQ ID NO: 918490 - RNA, 19 nt, Human
cagccuccugaguagcuag

SEQ ID NO: 918491 - RNA, 20 nt, Human
ccaccacgcccggcuaauuu

SEQ ID NO: 918492 - RNA, 24 nt, Human
ccuccaccuccuggguugaaguga

SEQ ID NO: 918493 - RNA, 23 nt, Human
ccugaguagcuaggauuacaggc

SEQ ID NO: 918494 - RNA, 24 nt, Human
ccugaguagcuaggauuacaggca

SEQ ID NO: 918495 - RNA, 24 nt, Human
cgggguuucaccguguuagccagg

SEQ ID NO: 918496 - RNA, 18 nt, Human
cuacaaccuccaccuccu

SEQ ID NO: 918497 - RNA, 23 nt, Human
cuacaaccuccaccuccuggguu

SEQ ID NO: 918498 - RNA, 18 nt, Human
cuacagcacaucacccua

SEQ ID NO: 918499 - RNA, 27 nt, Human
cucacuacaaccuccaccuccuggguu

SEQ ID NO: 918500 - RNA, 24 nt, Human
cucacuauaucuguuaacaguucu

SEQ ID NO: 918501 - RNA, 18 nt, Human
cucaugauccgccugccu

SEQ ID NO: 918502 - RNA, 24 nt, Human
cuccugaguagcuaggauuacagg

SEQ ID NO: 918503 - RNA, 24 nt, Human
cuccugaucucaugauccgccugc

SEQ ID NO: 918504 - RNA, 24 nt, Human
cugaguagcuaggauuacaggcau

SEQ ID NO: 918505 - RNA, 23 nt, Human
cugccucagccuccugaguagcu

SEQ ID NO: 918506 - RNA, 20 nt, Human
cuguuaacaguucugaagaa

SEQ ID NO: 918507 - RNA, 24 nt, Human
cuuuuaguagagacgggguuucac

SEQ ID NO: 918508 - RNA, 24 nt, Human
gagacgggguuucaccguguuagc

SEQ ID NO: 918509 - RNA, 22 nt, Human
gaguagcuaggauuacaggcau

SEQ ID NO: 918510 - RNA, 24 nt, Human
gaguagcuaggauuacaggcaugc

SEQ ID NO: 918511 - RNA, 24 nt, Human
gaucucaugauccgccugccuuag

SEQ ID NO: 918512 - RNA, 18 nt, Human
gauuacaggcaugcgcca

SEQ ID NO: 918513 - RNA, 19 nt, Human
gcuggagugcaauggcgca

SEQ ID NO: 918514 - RNA, 19 nt, Human
ggauuacaggcaugcgcca

SEQ ID NO: 918515 - RNA, 22 nt, Human
ggauuacaggcaugcgccacca

SEQ ID NO: 918516 - RNA, 23 nt, Human
gggguuucaccguguuagccagg

SEQ ID NO: 918517 - RNA, 21 nt, Human
guaaaguuguugggcacagag

SEQ ID NO: 918518 - RNA, 23 nt, Human
guagagacgggguuucaccgugu

SEQ ID NO: 918519 - RNA, 20 nt, Human
guagcuaggauuacaggcau

SEQ ID NO: 918520 - RNA, 24 nt, Human
gugauucuucugccucagccuccu

SEQ ID NO: 918521 - RNA, 24 nt, Human
uaauuuuugcacuuuuaguagaga

SEQ ID NO: 918522 - RNA, 21 nt, Human
uacagcacaucacccuagaca

SEQ ID NO: 918523 - RNA, 23 nt, Human
uacaggcaugcgccaccacgccc

SEQ ID NO: 918524 - RNA, 25 nt, Human
uacaucauuacuaccacauucaucc

SEQ ID NO: 918525 - RNA, 21 nt, Human
uacuguauacaaagaagaaaa

SEQ ID NO: 918526 - RNA, 22 nt, Human
uaggaagagaucuguuauaaua

SEQ ID NO: 918527 - RNA, 21 nt, Human
uaggauuacaggcaugcgcca

SEQ ID NO: 918528 - RNA, 22 nt, Human
uaggauuacaggcaugcgccac

SEQ ID NO: 918529 - RNA, 24 nt, Human
uaggauuacaggcaugcgccacca

SEQ ID NO: 918530 - RNA, 21 nt, Human
uaguagagacgggguuucacc

SEQ ID NO: 918531 - RNA, 24 nt, Human
uaguagagacgggguuucaccgug

SEQ ID NO: 918532 - RNA, 26 nt, Human
uaguagagacgggguuucaccguguu

SEQ ID NO: 918533 - RNA, 26 nt, Human
uaguagagacgggguuucaccguugg

SEQ ID NO: 918534 - RNA, 24 nt, Human
ucaccguguuagccaggauggucu

SEQ ID NO: 918535 - RNA, 24 nt, Human
ucacuacaaccuccaccuccuggg

SEQ ID NO: 918536 - RNA, 25 nt, Human
ucacuacaaccuccaccuccugggu

SEQ ID NO: 918537 - RNA, 27 nt, Human
ucacuacaaccuccaccuccuggguug

SEQ ID NO: 918538 - RNA, 22 nt, Human
ucagaauuguaaaaacaaaacu

SEQ ID NO: 918539 - RNA, 19 nt, Human
uccaguuugugaaccguug

SEQ ID NO: 918540 - RNA, 19 nt, Human
uccugaguagcuaggauua

SEQ ID NO: 918541 - RNA, 24 nt, Human
uccugaguagcuaggauuacaggc

SEQ ID NO: 918542 - RNA, 21 nt, Human
ucuacagcacaucacccuaga

SEQ ID NO: 918543 - RNA, 23 nt, Human
ucuacagcacaucacccuagaca

SEQ ID NO: 918544 - RNA, 21 nt, Human
ugagcauuuuaguacaaauaa

SEQ ID NO: 918545 - RNA, 23 nt, Human
ugccucagccuccugaguagcua

SEQ ID NO: 918546 - RNA, 24 nt, Human
ugccucagccuccugaguagcuag

SEQ ID NO: 918547 - RNA, 21 nt, Human
ugccugagcuggagugcaaug

SEQ ID NO: 918548 - RNA, 24 nt, Human
ugccugagcuggagugcaauggcg

SEQ ID NO: 918549 - RNA, 23 nt, Human
uggagugcaauggcgcaaucucg

SEQ ID NO: 918550 - RNA, 24 nt, Human
uggagugcaauggcgcaaucucgg

SEQ ID NO: 918551 - RNA, 24 nt, Human
uggcgcaaucucggcucacuacaa

SEQ ID NO: 918552 - RNA, 19 nt, Human
ugggcacagaggugaccug

SEQ ID NO: 918553 - RNA, 22 nt, Human
uguauaaaugacuuacuuuuaa

SEQ ID NO: 918554 - RNA, 22 nt, Human
uguugccugagcuggagugcaa

SEQ ID NO: 918555 - RNA, 21 nt, Human
uuaaacaaauauggguuacuc

SEQ ID NO: 918556 - RNA, 18 nt, Human
uuaguagagacgggguuu

SEQ ID NO: 918557 - RNA, 22 nt, Human
uuaguagagacgggguuucacc

SEQ ID NO: 918558 - RNA, 24 nt, Human
uuaguagagacgggguuucaccgu

SEQ ID NO: 918559 - RNA, 23 nt, Human
uugaagugauucuucugccucag

SEQ ID NO: 918560 - RNA, 19 nt, Human
uuucaccguguuagccagg

SEQ ID NO: 918561 - RNA, 24 nt, Human
uuuugcucuuguugccugagcugg

SEQ ID NO: 918562 - RNA, 20 nt, Human
uuuuugcacuuuuaguagag

SEQ ID NO: 918563 - RNA, 20 nt, Human
aggaagcgcgcccgccgccc

SEQ ID NO: 918564 - RNA, 24 nt, Human
aggcgggcuuugaggccugccccu

SEQ ID NO: 918565 - RNA, 24 nt, Human
cacucggccugcgccucgcugcgc

SEQ ID NO: 918566 - RNA, 19 nt, Human
ccacucggccugcgccucg

SEQ ID NO: 918567 - RNA, 19 nt, Human
ccccucgggcgggagugag

SEQ ID NO: 918568 - RNA, 22 nt, Human
ccucgggcgggagugagggagu

SEQ ID NO: 918569 - RNA, 25 nt, Human
cgaagccgccgugugaagucggggg

SEQ ID NO: 918570 - RNA, 19 nt, Human
cggccggguaggcgcgggg

SEQ ID NO: 918571 - RNA, 20 nt, Human
cggccggguaggcgcggggc

SEQ ID NO: 918572 - RNA, 19 nt, Human
cgggggaagcgggaaggag

SEQ ID NO: 918573 - RNA, 20 nt, Human
cugggcccgcguggucuccg

SEQ ID NO: 918574 - RNA, 20 nt, Human
gagcccgcgccgagggccag

SEQ ID NO: 918575 - RNA, 24 nt, Human
gcggggccaaggcgggcuuugagg

SEQ ID NO: 918576 - RNA, 21 nt, Human
ggagcccgcgccgagggccag

SEQ ID NO: 918577 - RNA, 19 nt, Human
ggcccacucggccugcgcc

SEQ ID NO: 918578 - RNA, 20 nt, Human
ggcgggagugagggaguugg

SEQ ID NO: 918579 - RNA, 18 nt, Human
gggcgggaaagcggggcc

SEQ ID NO: 918580 - RNA, 19 nt, Human
gggcgggagugagggaguu

SEQ ID NO: 918581 - RNA, 23 nt, Human
ucgcugggcccgcguggucuccg

SEQ ID NO: 918582 - RNA, 21 nt, Human
ugcgggcuccgggccguccgu

SEQ ID NO: 918583 - RNA, 18 nt, Human
uuuuuuuuuuuuuuuucg

SEQ ID NO: 918584 - RNA, 23 nt, Human
uuuuuuuuuuuuuuuucgcuggg

SEQ ID NO: 918585 - RNA, 21 nt, Human
uuuuuuuuuuuuuuuuucgcu

SEQ ID NO: 918586 - RNA, 24 nt, Human
uuuuuuuuuuuuuuuuuucgcugg

SEQ ID NO: 918587 - RNA, 22 nt, Human
aagcauaucuuuuagucaucag

SEQ ID NO: 918588 - RNA, 22 nt, Human
aauaaggcuuuuagcuucauau

SEQ ID NO: 918589 - RNA, 18 nt, Human
aaucaaacuuuaaacaau

SEQ ID NO: 918590 - RNA, 22 nt, Human
acaccuguucucauuuuuaaac

SEQ ID NO: 918591 - RNA, 23 nt, Human
accccaacaaauuaguuugauau

SEQ ID NO: 918592 - RNA, 19 nt, Human
accuuccuuacaccuacua

SEQ ID NO: 918593 - RNA, 22 nt, Human
agacacacacacacaaaaaaaa

SEQ ID NO: 918594 - RNA, 23 nt, Human
aguauacuaaauacucugcuaca

SEQ ID NO: 918595 - RNA, 22 nt, Human
auagcguguaauaaagcauauc

SEQ ID NO: 918596 - RNA, 22 nt, Human
auccaauuauacucuuaguuau

SEQ ID NO: 918597 - RNA, 23 nt, Human
augaaauuaaucaucaccuuuga

SEQ ID NO: 918598 - RNA, 21 nt, Human
auggagcuuaacauuuuagcc

SEQ ID NO: 918599 - RNA, 20 nt, Human
auuacagaauuuuaugugga

SEQ ID NO: 918600 - RNA, 20 nt, Human
caaaguacuaaugcagagac

SEQ ID NO: 918601 - RNA, 21 nt, Human
caaaguacuaaugcagagaca

SEQ ID NO: 918602 - RNA, 24 nt, Human
caaauaauugagaacaugcaaugu

SEQ ID NO: 918603 - RNA, 24 nt, Human
caaguaggauaaaucuaucaagua

SEQ ID NO: 918604 - RNA, 21 nt, Human
caccccuuuucccagccacua

SEQ ID NO: 918605 - RNA, 23 nt, Human
cacuuuguaaggucauuaaagcc

SEQ ID NO: 918606 - RNA, 23 nt, Human
cagagacacacacacacaaaaaa

SEQ ID NO: 918607 - RNA, 22 nt, Human
caggccuacugugaaaagcaaa

SEQ ID NO: 918608 - RNA, 24 nt, Human
cauaccacuaugaaaaaacuuacc

SEQ ID NO: 918609 - RNA, 23 nt, Human
cauccaugacuccuuaacugccc

SEQ ID NO: 918610 - RNA, 26 nt, Human
ccaaaacuucaaauuacacacccaag

SEQ ID NO: 918611 - RNA, 22 nt, Human
ccauccaugacuccuuaacugc

SEQ ID NO: 918612 - RNA, 21 nt, Human
ccucgcacaccccuuuuccca

SEQ ID NO: 918613 - RNA, 23 nt, Human
cgcaaauaauugagaacaugcaa

SEQ ID NO: 918614 - RNA, 19 nt, Human
cuacaccaagggaaaaaau

SEQ ID NO: 918615 - RNA, 22 nt, Human
cucacaccuguucucauuuuua

SEQ ID NO: 918616 - RNA, 19 nt, Human
cucgcacaccccuuuuccc

SEQ ID NO: 918617 - RNA, 22 nt, Human
cugcuacaaaauauuucuccca

SEQ ID NO: 918618 - RNA, 18 nt, Human
cuuggacaaaggcaacau

SEQ ID NO: 918619 - RNA, 20 nt, Human
cuuguaaaaucucuacccca

SEQ ID NO: 918620 - RNA, 21 nt, Human
gcaaagauauuucaguccaaa

SEQ ID NO: 918621 - RNA, 23 nt, Human
guacaauuaagcuauuauugacu

SEQ ID NO: 918622 - RNA, 23 nt, Human
gucuguuucuggcuuaugucacu

SEQ ID NO: 918623 - RNA, 21 nt, Human
gugaagaaauugucaucuaca

SEQ ID NO: 918624 - RNA, 20 nt, Human
guugugcuaucaaauacuag

SEQ ID NO: 918625 - RNA, 19 nt, Human
uaaaauuuucauccucauc

SEQ ID NO: 918626 - RNA, 20 nt, Human
uaagcuaauaaaacuucccc

SEQ ID NO: 918627 - RNA, 22 nt, Human
uaaguauuuuggaaaacucaca

SEQ ID NO: 918628 - RNA, 20 nt, Human
uaauauaaauaaggcuuuua

SEQ ID NO: 918629 - RNA, 18 nt, Human
uaauauagugaccucuag

SEQ ID NO: 918630 - RNA, 22 nt, Human
uacaccuacuacuaccacauug

SEQ ID NO: 918631 - RNA, 18 nt, Human
uacucacccgguugugcu

SEQ ID NO: 918632 - RNA, 19 nt, Human
uagaaccagaauagcauac

SEQ ID NO: 918633 - RNA, 23 nt, Human
uagaucccgcaaauaauugagaa

SEQ ID NO: 918634 - RNA, 19 nt, Human
uagcagcaugguuccaaau

SEQ ID NO: 918635 - RNA, 24 nt, Human
uagcauacuguauaauuuagugga

SEQ ID NO: 918636 - RNA, 21 nt, Human
uagcguguaauaaagcauauc

SEQ ID NO: 918637 - RNA, 21 nt, Human
uagugaccucuaguuccaucc

SEQ ID NO: 918638 - RNA, 23 nt, Human
ucaggccuacugugaaaagcaaa

SEQ ID NO: 918639 - RNA, 26 nt, Human
ucauuaaagccuaauugguccucaga

SEQ ID NO: 918640 - RNA, 19 nt, Human
ucauuuggggaagguaugc

SEQ ID NO: 918641 - RNA, 22 nt, Human
uccccaguuccccucgcacacc

SEQ ID NO: 918642 - RNA, 24 nt, Human
uccccaguuccccucgcacacccc

SEQ ID NO: 918643 - RNA, 21 nt, Human
ucgcacaccccuuuucccagc

SEQ ID NO: 918644 - RNA, 21 nt, Human
ucuuggguagcagcaugguuc

SEQ ID NO: 918645 - RNA, 25 nt, Human
ugaaaaaacuuaccuuccuuacacc

SEQ ID NO: 918646 - RNA, 18 nt, Human
ugaaaaaauacuuguguu

SEQ ID NO: 918647 - RNA, 18 nt, Human
ugaaaagcaaauacagac

SEQ ID NO: 918648 - RNA, 20 nt, Human
ugaaaagcaaauacagacug

SEQ ID NO: 918649 - RNA, 21 nt, Human
ugacuccuuaacugccccuga

SEQ ID NO: 918650 - RNA, 22 nt, Human
ugacuuguaaaaucucuacccc

SEQ ID NO: 918651 - RNA, 22 nt, Human
uggaaaaauaacaaaguacuaa

SEQ ID NO: 918652 - RNA, 25 nt, Human
uguaacugaacugcacauauaauau

SEQ ID NO: 918653 - RNA, 18 nt, Human
uguuccuacaccaaggga

SEQ ID NO: 918654 - RNA, 20 nt, Human
uuaaacaaucaggucccucu

SEQ ID NO: 918655 - RNA, 20 nt, Human
uuaaagccuaauugcuaaau

SEQ ID NO: 918656 - RNA, 22 nt, Human
uuccccucgcacaccccuuuuc

SEQ ID NO: 918657 - RNA, 20 nt, Human
uugcauaccacuaugaaaaa

SEQ ID NO: 918658 - RNA, 22 nt, Human
uugcauugaaaaaauacuugug

SEQ ID NO: 918659 - RNA, 25 nt, Human
uugcuaaaucaacuucuaaguauac

SEQ ID NO: 918660 - RNA, 20 nt, Human
uugcuguuuuguaaacucug

SEQ ID NO: 918661 - RNA, 23 nt, Human
uuguuacaguuacauauaugaau

SEQ ID NO: 918662 - RNA, 20 nt, Human
uuuuacacauuaagcauccc

SEQ ID NO: 918663 - RNA, 19 nt, Human
aaaaaaguguuuccuccca

SEQ ID NO: 918664 - RNA, 18 nt, Human
aaaagacccacaccagcc

SEQ ID NO: 918665 - RNA, 23 nt, Human
aaagaucuacaggggucagacaa

SEQ ID NO: 918666 - RNA, 24 nt, Human
aaagugcugggauuacaggcauga

SEQ ID NO: 918667 - RNA, 23 nt, Human
aacaauagugaaaaauugggggc

SEQ ID NO: 918668 - RNA, 25 nt, Human
aaccaccaaaagacugugagaacaa

SEQ ID NO: 918669 - RNA, 22 nt, Human
aaccgaaugccaacauucuacc

SEQ ID NO: 918670 - RNA, 22 nt, Human
aagacccacaccagccccagcc

SEQ ID NO: 918671 - RNA, 21 nt, Human
aagcacagugccuggcaugga

SEQ ID NO: 918672 - RNA, 24 nt, Human
aagcagcugggaauacaggcaugu

SEQ ID NO: 918673 - RNA, 23 nt, Human
aaggaagaaggcacugcaaggag

SEQ ID NO: 918674 - RNA, 23 nt, Human
aaggaucgcuugagccugggaga

SEQ ID NO: 918675 - RNA, 22 nt, Human
aaggucaaaaaaccaugggcuc

SEQ ID NO: 918676 - RNA, 19 nt, Human
aagugcugggauuacaggc

SEQ ID NO: 918677 - RNA, 21 nt, Human
aagugcugggauuacaggcau

SEQ ID NO: 918678 - RNA, 24 nt, Human
aaugcaguggcaccaucucggcuc

SEQ ID NO: 918679 - RNA, 19 nt, Human
aaugcccccauaaagcaau

SEQ ID NO: 918680 - RNA, 24 nt, Human
acagagcaaggcccugucuugggg

SEQ ID NO: 918681 - RNA, 21 nt, Human
acagagcgcugcacagcacca

SEQ ID NO: 918682 - RNA, 19 nt, Human
acagggaaaacaugauaca

SEQ ID NO: 918683 - RNA, 26 nt, Human
accaggcugccccugacaaaaaaagu

SEQ ID NO: 918684 - RNA, 22 nt, Human
accauguuggccaggcuggucu

SEQ ID NO: 918685 - RNA, 22 nt, Human
acccacaccagccccagccuca

SEQ ID NO: 918686 - RNA, 26 nt, Human
accgaaugccaacauucuaccaacca

SEQ ID NO: 918687 - RNA, 20 nt, Human
accgaaugccaacauucuag

SEQ ID NO: 918688 - RNA, 22 nt, Human
accuagugguggcagggagugu

SEQ ID NO: 918689 - RNA, 26 nt, Human
acgccuggcuauuauuauuauuuuuu

SEQ ID NO: 918690 - RNA, 23 nt, Human
acuccagccugggagacagagca

SEQ ID NO: 918691 - RNA, 18 nt, Human
acugcacuccagccuggg

SEQ ID NO: 918692 - RNA, 24 nt, Human
acugcacuccagccugggagacag

SEQ ID NO: 918693 - RNA, 19 nt, Human
acuuugcuguuugagaucu

SEQ ID NO: 918694 - RNA, 18 nt, Human
agacucuggucccuccag

SEQ ID NO: 918695 - RNA, 22 nt, Human
agacuguuguacugagcaacca

SEQ ID NO: 918696 - RNA, 18 nt, Human
agaggucuuaccugggcu

SEQ ID NO: 918697 - RNA, 20 nt, Human
agagucaaaaggugcuucuc

SEQ ID NO: 918698 - RNA, 23 nt, Human
agauaauucaccauguuggccag

SEQ ID NO: 918699 - RNA, 24 nt, Human
agauaauucaccauguuggccagg

SEQ ID NO: 918700 - RNA, 19 nt, Human
agccaccacacuuggccua

SEQ ID NO: 918701 - RNA, 21 nt, Human
agccaccacacuuggccuaaa

SEQ ID NO: 918702 - RNA, 23 nt, Human
aggagucacagauuauuaaaacu

SEQ ID NO: 918703 - RNA, 22 nt, Human
aggcagaaggaucgcuugagcc

SEQ ID NO: 918704 - RNA, 24 nt, Human
aggcagaaggaucgcuugagccug

SEQ ID NO: 918705 - RNA, 18 nt, Human
aggcagcagagcauggca

SEQ ID NO: 918706 - RNA, 18 nt, Human
aggcaguggggauggcuc

SEQ ID NO: 918707 - RNA, 18 nt, Human
aggcugaggcagaaggau

SEQ ID NO: 918708 - RNA, 20 nt, Human
aggcugaggcagaaggaucg

SEQ ID NO: 918709 - RNA, 24 nt, Human
aggcugaggcagaaggaucgcuug

SEQ ID NO: 918710 - RNA, 23 nt, Human
aggcugcaguaagccaugaucau

SEQ ID NO: 918711 - RNA, 19 nt, Human
aggugauuuggagcugggc

SEQ ID NO: 918712 - RNA, 21 nt, Human
agugguggcagggaguguacg

SEQ ID NO: 918713 - RNA, 24 nt, Human
aucaugccacugcacuccagccug

SEQ ID NO: 918714 - RNA, 19 nt, Human
aucccccaagccccagaaa

SEQ ID NO: 918715 - RNA, 22 nt, Human
augauuuucaaaaaccacagag

SEQ ID NO: 918716 - RNA, 21 nt, Human
augugaaucagcucaugcccc

SEQ ID NO: 918717 - RNA, 21 nt, Human
auucuccugccucagccuccc

SEQ ID NO: 918718 - RNA, 24 nt, Human
auuuuuuuguauuuuuaguagaga

SEQ ID NO: 918719 - RNA, 22 nt, Human
caaagugcugggauuacaggca

SEQ ID NO: 918720 - RNA, 23 nt, Human
caaagugcugggauuacaggcau

SEQ ID NO: 918721 - RNA, 23 nt, Human
caaccuccaccucccagguucaa

SEQ ID NO: 918722 - RNA, 20 nt, Human
caacuaaaagcuuccugcca

SEQ ID NO: 918723 - RNA, 24 nt, Human
caagacuguuguacugagcaacca

SEQ ID NO: 918724 - RNA, 22 nt, Human
caagccauucuccugccucagc

SEQ ID NO: 918725 - RNA, 22 nt, Human
caagccccagaaauggccuagg

SEQ ID NO: 918726 - RNA, 23 nt, Human
caaugcaauggccuuugucucuu

SEQ ID NO: 918727 - RNA, 21 nt, Human
caccauguuggccaggcuggu

SEQ ID NO: 918728 - RNA, 24 nt, Human
caccauguuggccaggcuggucuu

SEQ ID NO: 918729 - RNA, 27 nt, Human
caccauguuggccaggcuggucuugaa

SEQ ID NO: 918730 - RNA, 21 nt, Human
caccucaagugaucugcccac

SEQ ID NO: 918731 - RNA, 24 nt, Human
caccucaagugaucugcccaccuc

SEQ ID NO: 918732 - RNA, 19 nt, Human
caccucccagguucaagcc

SEQ ID NO: 918733 - RNA, 19 nt, Human
caccuugaaaagcagccaa

SEQ ID NO: 918734 - RNA, 23 nt, Human
cacuccagccugggagacagagc

SEQ ID NO: 918735 - RNA, 21 nt, Human
cacucccucuuuuugcuccca

SEQ ID NO: 918736 - RNA, 21 nt, Human
cacugcaaccuccaccuccca

SEQ ID NO: 918737 - RNA, 18 nt, Human
cacugcacuccagccugg

SEQ ID NO: 918738 - RNA, 19 nt, Human
cacugcacuccagccuggg

SEQ ID NO: 918739 - RNA, 22 nt, Human
cacugcacuccagccugggaga

SEQ ID NO: 918740 - RNA, 24 nt, Human
cacugcacuccagccugggagaca

SEQ ID NO: 918741 - RNA, 25 nt, Human
cacugcacuccagccugggagacag

SEQ ID NO: 918742 - RNA, 19 nt, Human
cacuuagucgcccacagag

SEQ ID NO: 918743 - RNA, 25 nt, Human
cagcacaggacagcauucauccccc

SEQ ID NO: 918744 - RNA, 18 nt, Human
cagcaucccaggcugcuc

SEQ ID NO: 918745 - RNA, 21 nt, Human
cagcaucccaggcugcucaga

SEQ ID NO: 918746 - RNA, 20 nt, Human
cagcauucaucccccaagcc

SEQ ID NO: 918747 - RNA, 24 nt, Human
cagcucagacucuggucccuccag

SEQ ID NO: 918748 - RNA, 18 nt, Human
cagcugggaauacaggca

SEQ ID NO: 918749 - RNA, 22 nt, Human
caggccuggcuggaaggaccag

SEQ ID NO: 918750 - RNA, 18 nt, Human
cagguaaacaaggaagaa

SEQ ID NO: 918751 - RNA, 23 nt, Human
caguagaagguaagguggcugau

SEQ ID NO: 918752 - RNA, 22 nt, Human
caguuaaggucacuuuagguac

SEQ ID NO: 918753 - RNA, 18 nt, Human
caucccccaagccccaga

SEQ ID NO: 918754 - RNA, 22 nt, Human
caugauaguguggcuugaugga

SEQ ID NO: 918755 - RNA, 18 nt, Human
caugcagucucagcuacc

SEQ ID NO: 918756 - RNA, 20 nt, Human
caugcagucucagcuaccag

SEQ ID NO: 918757 - RNA, 24 nt, Human
cauguuggccaggcuggucuugaa

SEQ ID NO: 918758 - RNA, 23 nt, Human
cauucuaccaaccaggccccacu

SEQ ID NO: 918759 - RNA, 21 nt, Human
ccaaaacacucaugacuuaga

SEQ ID NO: 918760 - RNA, 18 nt, Human
ccaacagggaaaacauga

SEQ ID NO: 918761 - RNA, 19 nt, Human
ccacugcacuccagccugg

SEQ ID NO: 918762 - RNA, 20 nt, Human
ccacugcacuccagccuggg

SEQ ID NO: 918763 - RNA, 22 nt, Human
ccacugcacuccagccugggag

SEQ ID NO: 918764 - RNA, 24 nt, Human
ccacugcacuccagccugggagac

SEQ ID NO: 918765 - RNA, 21 nt, Human
ccagccucauccacauucagu

SEQ ID NO: 918766 - RNA, 20 nt, Human
ccauuuuauagguaagaaaa

SEQ ID NO: 918767 - RNA, 25 nt, Human
cccaagccccagaaauggccuagga

SEQ ID NO: 918768 - RNA, 25 nt, Human
cccacaccagccccagccucaucca

SEQ ID NO: 918769 - RNA, 20 nt, Human
cccagguucaagccauucuc

SEQ ID NO: 918770 - RNA, 21 nt, Human
ccccaagccccagaaauggcc

SEQ ID NO: 918771 - RNA, 18 nt, Human
cccccaagccccagaaau

SEQ ID NO: 918772 - RNA, 18 nt, Human
cccgggaacccgagccag

SEQ ID NO: 918773 - RNA, 24 nt, Human
ccucccagguucaagccauucucc

SEQ ID NO: 918774 - RNA, 18 nt, Human
ccuucuggcauaggcaga

SEQ ID NO: 918775 - RNA, 22 nt, Human
ccuuugaacaaccugucgguuu

SEQ ID NO: 918776 - RNA, 23 nt, Human
cgagaagcagucaaauuaaucaa

SEQ ID NO: 918777 - RNA, 24 nt, Human
cgcucuguugcccaggcuggaaug

SEQ ID NO: 918778 - RNA, 24 nt, Human
cggcauguaggcuuuguuucuugg

SEQ ID NO: 918779 - RNA, 22 nt, Human
cuagcucacagaacacaacuga

SEQ ID NO: 918780 - RNA, 27 nt, Human
cucaagugaucugcccaccucggccuc

SEQ ID NO: 918781 - RNA, 24 nt, Human
cucacugcaaccuccaccucccag

SEQ ID NO: 918782 - RNA, 21 nt, Human
cucgcaaagugcugggauuac

SEQ ID NO: 918783 - RNA, 22 nt, Human
cucuccuguauccccaguaccu

SEQ ID NO: 918784 - RNA, 19 nt, Human
cucugaaccaggcugcccc

SEQ ID NO: 918785 - RNA, 23 nt, Human
cucuguugcccaggcuggaaugc

SEQ ID NO: 918786 - RNA, 23 nt, Human
cugcaaccuccaccucccagguu

SEQ ID NO: 918787 - RNA, 24 nt, Human
cugcaaccuccaccucccagguuc

SEQ ID NO: 918788 - RNA, 20 nt, Human
cugcaaggagcucugggccu

SEQ ID NO: 918789 - RNA, 20 nt, Human
cugcacagcaccacaaccga

SEQ ID NO: 918790 - RNA, 22 nt, Human
cugcacagcaccacaaccgaua

SEQ ID NO: 918791 - RNA, 23 nt, Human
cugccucagccucccaagcagcu

SEQ ID NO: 918792 - RNA, 21 nt, Human
cugcucugaccugcugcucgg

SEQ ID NO: 918793 - RNA, 19 nt, Human
cugcuuagaguuggguggc

SEQ ID NO: 918794 - RNA, 24 nt, Human
cuggaguccuagucuaggggagcc

SEQ ID NO: 918795 - RNA, 18 nt, Human
cuggccagcuagagaggu

SEQ ID NO: 918796 - RNA, 19 nt, Human
cuggccuccuggcugcucu

SEQ ID NO: 918797 - RNA, 19 nt, Human
cuguuuucucugccaggaa

SEQ ID NO: 918798 - RNA, 26 nt, Human
cuguuuucucugccaggaaugugcuc

SEQ ID NO: 918799 - RNA, 29 nt, Human
cuguuuucucugccaggaaugugcucccc

SEQ ID NO: 918800 - RNA, 20 nt, Human
cuuuacgcuugauucucucc

SEQ ID NO: 918801 - RNA, 18 nt, Human
gaaaacaauaaacuaugg

SEQ ID NO: 918802 - RNA, 19 nt, Human
gaaggcacugcaaggagcu

SEQ ID NO: 918803 - RNA, 24 nt, Human
gaauuuuagaaccacaaggucaaa

SEQ ID NO: 918804 - RNA, 20 nt, Human
gacagagcaaggcccugucu

SEQ ID NO: 918805 - RNA, 22 nt, Human
gagauaauucaccauguuggcc

SEQ ID NO: 918806 - RNA, 24 nt, Human
gagauaauucaccauguuggccag

SEQ ID NO: 918807 - RNA, 20 nt, Human
gaggacggcugggagaacag

SEQ ID NO: 918808 - RNA, 21 nt, Human
gaucaugccacugcacuccag

SEQ ID NO: 918809 - RNA, 18 nt, Human
gaucgcuugagccuggga

SEQ ID NO: 918810 - RNA, 18 nt, Human
gauuacaggcaugagcca

SEQ ID NO: 918811 - RNA, 21 nt, Human
gauuacaggcaugagccacca

SEQ ID NO: 918812 - RNA, 22 nt, Human
gauuacaggcaugagccaccac

SEQ ID NO: 918813 - RNA, 19 nt, Human
gcaaagugcugggauuaca

SEQ ID NO: 918814 - RNA, 24 nt, Human
gcaaagugcugggauuacaggcau

SEQ ID NO: 918815 - RNA, 24 nt, Human
gcacuccagccugggagacagagc

SEQ ID NO: 918816 - RNA, 19 nt, Human
gccaugaucaugccacugc

SEQ ID NO: 918817 - RNA, 20 nt, Human
gcccaggcuggaaugcagug

SEQ ID NO: 918818 - RNA, 21 nt, Human
gccccagccucauccacauuc

SEQ ID NO: 918819 - RNA, 25 nt, Human
gccugccucuccagccaugcuggcc

SEQ ID NO: 918820 - RNA, 19 nt, Human
gcggcgcacagucggggag

SEQ ID NO: 918821 - RNA, 21 nt, Human
gcgugaguggcacuuagucgc

SEQ ID NO: 918822 - RNA, 21 nt, Human
gcucgguucccugccuaugcc

SEQ ID NO: 918823 - RNA, 23 nt, Human
gcugcacagcaccacaaccgaua

SEQ ID NO: 918824 - RNA, 20 nt, Human
gcuggaaugcaguggcacca

SEQ ID NO: 918825 - RNA, 20 nt, Human
gcuggacugcuuugccagug

SEQ ID NO: 918826 - RNA, 23 nt, Human
ggaauuuuagaaccacaagguca

SEQ ID NO: 918827 - RNA, 23 nt, Human
ggagcucugggccuggcucagug

SEQ ID NO: 918828 - RNA, 19 nt, Human
ggauuacaggcaugagcca

SEQ ID NO: 918829 - RNA, 20 nt, Human
ggccaggcaguggggauggc

SEQ ID NO: 918830 - RNA, 21 nt, Human
ggccaggcaguggggauggcu

SEQ ID NO: 918831 - RNA, 24 nt, Human
ggcuggucuugaacuccucaccuc

SEQ ID NO: 918832 - RNA, 23 nt, Human
gggacaccuugaaaagcagccaa

SEQ ID NO: 918833 - RNA, 18 nt, Human
gggcucccucaucugcag

SEQ ID NO: 918834 - RNA, 21 nt, Human
gggcucccucaucugcagcuc

SEQ ID NO: 918835 - RNA, 22 nt, Human
gguggcugaucauuuuuccaua

SEQ ID NO: 918836 - RNA, 19 nt, Human
guccaggcugcagaauguc

SEQ ID NO: 918837 - RNA, 21 nt, Human
gugaucugcccaccucggccu

SEQ ID NO: 918838 - RNA, 20 nt, Human
guggauggcaaaugaauucc

SEQ ID NO: 918839 - RNA, 19 nt, Human
uaacaaauucacuucuggg

SEQ ID NO: 918840 - RNA, 20 nt, Human
uaagaaaauugggucagagg

SEQ ID NO: 918841 - RNA, 19 nt, Human
uaagagaaugcccccauaa

SEQ ID NO: 918842 - RNA, 21 nt, Human
uaagccucaugguguuggcag

SEQ ID NO: 918843 - RNA, 18 nt, Human
uaaguaaaacacuaggac

SEQ ID NO: 918844 - RNA, 21 nt, Human
uacaggcaugagccaccacac

SEQ ID NO: 918845 - RNA, 22 nt, Human
uacaggcaugugccaccacgcc

SEQ ID NO: 918846 - RNA, 18 nt, Human
uacaggcuuacaaccuag

SEQ ID NO: 918847 - RNA, 21 nt, Human
uaccaacagggaaaacaugau

SEQ ID NO: 918848 - RNA, 19 nt, Human
uaggaaccugcaaguccua

SEQ ID NO: 918849 - RNA, 20 nt, Human
uauccaggcuacauaccaac

SEQ ID NO: 918850 - RNA, 25 nt, Human
ucaagccauucuccugccucagccu

SEQ ID NO: 918851 - RNA, 19 nt, Human
ucacccuuucucucuccaa

SEQ ID NO: 918852 - RNA, 18 nt, Human
ucaccucaagugaucugc

SEQ ID NO: 918853 - RNA, 23 nt, Human
ucacugcaaccuccaccucccag

SEQ ID NO: 918854 - RNA, 24 nt, Human
ucacugcaaccuccaccucccagg

SEQ ID NO: 918855 - RNA, 27 nt, Human
ucacugcaaccuccaccucccagguuc

SEQ ID NO: 918856 - RNA, 23 nt, Human
ucagaaugugaaucagcucaugc

SEQ ID NO: 918857 - RNA, 20 nt, Human
ucagccucccaagcagcugg

SEQ ID NO: 918858 - RNA, 23 nt, Human
ucagcucaugccccucuucugcu

SEQ ID NO: 918859 - RNA, 23 nt, Human
ucaugccacugcacuccagccug

SEQ ID NO: 918860 - RNA, 23 nt, Human
uccaacuaaaagcuuccugccau

SEQ ID NO: 918861 - RNA, 21 nt, Human
uccacauucaguuaaggucac

SEQ ID NO: 918862 - RNA, 24 nt, Human
uccaccucccagguucaagccauu

SEQ ID NO: 918863 - RNA, 21 nt, Human
ucccagggcuggggaauaaau

SEQ ID NO: 918864 - RNA, 24 nt, Human
ucccagggcuggggaauaaauaag

SEQ ID NO: 918865 - RNA, 21 nt, Human
ucccagguucaagccauucuc

SEQ ID NO: 918866 - RNA, 24 nt, Human
ucccagguucaagccauucuccug

SEQ ID NO: 918867 - RNA, 22 nt, Human
uccugccauggccguccaggcu

SEQ ID NO: 918868 - RNA, 24 nt, Human
uccuucagaaugugaaucagcuca

SEQ ID NO: 918869 - RNA, 24 nt, Human
ucgcaaagugcugggauuacaggc

SEQ ID NO: 918870 - RNA, 23 nt, Human
ucgcuugagccugggagaucaag

SEQ ID NO: 918871 - RNA, 24 nt, Human
ucgcuugagccugggagaucaagg

SEQ ID NO: 918872 - RNA, 22 nt, Human
ucggcccgggaacccgagccag

SEQ ID NO: 918873 - RNA, 24 nt, Human
ucgguucccugccuaugccugccu

SEQ ID NO: 918874 - RNA, 19 nt, Human
ucuccagccaugcuggccu

SEQ ID NO: 918875 - RNA, 20 nt, Human
ucuccaucuuuggcagguga

SEQ ID NO: 918876 - RNA, 23 nt, Human
ucuccugccucagccucccaagc

SEQ ID NO: 918877 - RNA, 19 nt, Human
ucucgcucuguugcccagg

SEQ ID NO: 918878 - RNA, 23 nt, Human
ucucgcucuguugcccaggcugg

SEQ ID NO: 918879 - RNA, 24 nt, Human
ucucgcucuguugcccaggcugga

SEQ ID NO: 918880 - RNA, 26 nt, Human
ucucgcucuguugcccaggcuggaau

SEQ ID NO: 918881 - RNA, 27 nt, Human
ucucgcucuguugcccaggcuggaaug

SEQ ID NO: 918882 - RNA, 26 nt, Human
ucugcagcuccuucucugggggccgc

SEQ ID NO: 918883 - RNA, 22 nt, Human
ucugcccaccucggccucgcaa

SEQ ID NO: 918884 - RNA, 19 nt, Human
ucugcuuucacccuuucuc

SEQ ID NO: 918885 - RNA, 22 nt, Human
ucuguacaguuucuccugcuua

SEQ ID NO: 918886 - RNA, 18 nt, Human
ucuguugcccaggcugga

SEQ ID NO: 918887 - RNA, 24 nt, Human
ucuguugcccaggcuggaaugcag

SEQ ID NO: 918888 - RNA, 18 nt, Human
ugaaaagcagccaaaaga

SEQ ID NO: 918889 - RNA, 22 nt, Human
ugaaaagcagccaaaagaccca

SEQ ID NO: 918890 - RNA, 24 nt, Human
ugaaaagcagccaaaagacccaca

SEQ ID NO: 918891 - RNA, 27 nt, Human
ugaaaagcagccaaaagacccacacca

SEQ ID NO: 918892 - RNA, 22 nt, Human
ugaacaaacaccugcugaaugc

SEQ ID NO: 918893 - RNA, 18 nt, Human
ugaaggcuccagcugcag

SEQ ID NO: 918894 - RNA, 23 nt, Human
ugaaggcuccagcugcaggagga

SEQ ID NO: 918895 - RNA, 18 nt, Human
ugacagcuccuauuuccc

SEQ ID NO: 918896 - RNA, 23 nt, Human
ugacagcucuucagagaggucuu

SEQ ID NO: 918897 - RNA, 20 nt, Human
ugaccucugagcucugaacc

SEQ ID NO: 918898 - RNA, 21 nt, Human
ugaccugcugcucgguucccu

SEQ ID NO: 918899 - RNA, 24 nt, Human
ugagccugggagaucaaggcugca

SEQ ID NO: 918900 - RNA, 24 nt, Human
ugagcucugaaccaggcugccccu

SEQ ID NO: 918901 - RNA, 25 nt, Human
ugaggcagaaggaucgcuugagccu

SEQ ID NO: 918902 - RNA, 19 nt, Human
ugaggcuugagagcaaguc

SEQ ID NO: 918903 - RNA, 21 nt, Human
ugaguggcacuuagucgccca

SEQ ID NO: 918904 - RNA, 22 nt, Human
ugaucugcccaccucggccucg

SEQ ID NO: 918905 - RNA, 22 nt, Human
ugcaaauuccuugagaacaaag

SEQ ID NO: 918906 - RNA, 21 nt, Human
ugcaaggagcucugggccugg

SEQ ID NO: 918907 - RNA, 27 nt, Human
ugcaaucccggagcaccucuggcugcc

SEQ ID NO: 918908 - RNA, 20 nt, Human
ugcaauggccuuugucucuu

SEQ ID NO: 918909 - RNA, 22 nt, Human
ugcaguaagccaugaucaugcc

SEQ ID NO: 918910 - RNA, 22 nt, Human
ugcaguggcaccaucucggcuc

SEQ ID NO: 918911 - RNA, 24 nt, Human
ugcccaggcuggaaugcaguggca

SEQ ID NO: 918912 - RNA, 24 nt, Human
ugccucagccucccaagcagcugg

SEQ ID NO: 918913 - RNA, 23 nt, Human
ugccugccucuccagccaugcug

SEQ ID NO: 918914 - RNA, 19 nt, Human
uggaaacuggcucugggag

SEQ ID NO: 918915 - RNA, 24 nt, Human
uggaaugcaguggcaccaucucgg

SEQ ID NO: 918916 - RNA, 22 nt, Human
uggaccagaagacggaggcugg

SEQ ID NO: 918917 - RNA, 19 nt, Human
uggaggugacgagcaacga

SEQ ID NO: 918918 - RNA, 19 nt, Human
uggaguccuagucuagggg

SEQ ID NO: 918919 - RNA, 24 nt, Human
uggagucucgcucuguugcccagg

SEQ ID NO: 918920 - RNA, 19 nt, Human
uggcaccaucucggcucac

SEQ ID NO: 918921 - RNA, 18 nt, Human
uggcauggaggugacgag

SEQ ID NO: 918922 - RNA, 24 nt, Human
uggccaggcuggucuugaacuccu

SEQ ID NO: 918923 - RNA, 22 nt, Human
uggcucuggccaggcagugggg

SEQ ID NO: 918924 - RNA, 23 nt, Human
uggcucuugagggccacauuggg

SEQ ID NO: 918925 - RNA, 18 nt, Human
ugggaauacaggcaugug

SEQ ID NO: 918926 - RNA, 22 nt, Human
ugggaauacaggcaugugccac

SEQ ID NO: 918927 - RNA, 24 nt, Human
ugggaauacaggcaugugccacca

SEQ ID NO: 918928 - RNA, 18 nt, Human
ugggauuacaggcaugag

SEQ ID NO: 918929 - RNA, 19 nt, Human
ugggauuacaggcaugagc

SEQ ID NO: 918930 - RNA, 22 nt, Human
ugggauuacaggcaugagccac

SEQ ID NO: 918931 - RNA, 23 nt, Human
ugggauuacaggcaugagccacc

SEQ ID NO: 918932 - RNA, 24 nt, Human
ugggauuacaggcaugagccacca

SEQ ID NO: 918933 - RNA, 24 nt, Human
ugggauuacaggcaugagccacca

SEQ ID NO: 918934 - RNA, 20 nt, Human
ugggcagccuugggaaaauu

SEQ ID NO: 918935 - RNA, 22 nt, Human
uguacaguuucuccugcuuaga

SEQ ID NO: 918936 - RNA, 19 nt, Human
ugugcagaaagagaaggau

SEQ ID NO: 918937 - RNA, 22 nt, Human
ugugccuaguguaaggcugugg

SEQ ID NO: 918938 - RNA, 19 nt, Human
uuagaguuggguggcagcu

SEQ ID NO: 918939 - RNA, 21 nt, Human
uuaguagagauaauucaccau

SEQ ID NO: 918940 - RNA, 22 nt, Human
uuaguagagauaauucaccaug

SEQ ID NO: 918941 - RNA, 24 nt, Human
uucaaauaacaauagugaaaaauu

SEQ ID NO: 918942 - RNA, 21 nt, Human
uucaagccauucuccugccuc

SEQ ID NO: 918943 - RNA, 18 nt, Human
uucaccauguuggccagg

SEQ ID NO: 918944 - RNA, 20 nt, Human
uucaccauguuggccaggcu

SEQ ID NO: 918945 - RNA, 20 nt, Human
uucagcaucccaggcugcuc

SEQ ID NO: 918946 - RNA, 18 nt, Human
uucccagaagagcagaaa

SEQ ID NO: 918947 - RNA, 20 nt, Human
uucccagaagagcagaaagc

SEQ ID NO: 918948 - RNA, 21 nt, Human
uuccuguaucucuccaacuaa

SEQ ID NO: 918949 - RNA, 19 nt, Human
uucuuggguaaccuccccu

SEQ ID NO: 918950 - RNA, 19 nt, Human
uugagaccaaaacacucau

SEQ ID NO: 918951 - RNA, 18 nt, Human
uuggcaggugagaagagg

SEQ ID NO: 918952 - RNA, 19 nt, Human
uuggcaggugagaagagga

SEQ ID NO: 918953 - RNA, 22 nt, Human
uuggggggaaaaaaaauuaggc

SEQ ID NO: 918954 - RNA, 24 nt, Human
uugggucagaggaaaaagugcuag

SEQ ID NO: 918955 - RNA, 22 nt, Human
uuuaguagagauaauucaccau

SEQ ID NO: 918956 - RNA, 24 nt, Human
uuuauaauuaagagcauuuaucca

SEQ ID NO: 918957 - RNA, 21 nt, Human
uuuuuguauuuuuaguagaga

SEQ ID NO: 918958 - RNA, 21 nt, Human
uuuuuuguauuuuuaguagag

SEQ ID NO: 918959 - RNA, 24 nt, Human
uuuuuuguauuuuuaguagagaua

SEQ ID NO: 918960 - RNA, 24 nt, Human
aagggcccacacagcagagaacag

SEQ ID NO: 918961 - RNA, 20 nt, Human
aaugaagggguggcucccaa

SEQ ID NO: 918962 - RNA, 25 nt, Human
acuuuuuuuaaaaaaugaaggggug

SEQ ID NO: 918963 - RNA, 21 nt, Human
agaaggccccggccgucgguc

SEQ ID NO: 918964 - RNA, 21 nt, Human
agagaacagcagaggacagaa

SEQ ID NO: 918965 - RNA, 19 nt, Human
agaggcaggcccggcugca

SEQ ID NO: 918966 - RNA, 20 nt, Human
caagaccucagaccgucaga

SEQ ID NO: 918967 - RNA, 20 nt, Human
caagccaggggccggggagc

SEQ ID NO: 918968 - RNA, 23 nt, Human
caagccaggggccggggagccgg

SEQ ID NO: 918969 - RNA, 23 nt, Human
cacaaguccucccugcugggccu

SEQ ID NO: 918970 - RNA, 22 nt, Human
cacacagcagagaacagcagag

SEQ ID NO: 918971 - RNA, 21 nt, Human
cagcuccgaccugcgcccaag

SEQ ID NO: 918972 - RNA, 24 nt, Human
ccacucagaggcaggcccggcugc

SEQ ID NO: 918973 - RNA, 24 nt, Human
cccaaaagcuaccgcugagcuucu

SEQ ID NO: 918974 - RNA, 22 nt, Human
cccaagccaggggccggggagc

SEQ ID NO: 918975 - RNA, 19 nt, Human
cccuggcuggcuccucucu

SEQ ID NO: 918976 - RNA, 25 nt, Human
cccuggcuggcuccucucuccuuuc

SEQ ID NO: 918977 - RNA, 22 nt, Human
ccggcccacccagcuccgaccu

SEQ ID NO: 918978 - RNA, 23 nt, Human
ccggcccacccagcuccgaccug

SEQ ID NO: 918979 - RNA, 21 nt, Human
ccgucagaaggccccggccgu

SEQ ID NO: 918980 - RNA, 21 nt, Human
ccucagaccgucagaaggccc

SEQ ID NO: 918981 - RNA, 22 nt, Human
ccucagaccgucagaaggcccc

SEQ ID NO: 918982 - RNA, 23 nt, Human
ccucccuggcuggcuccucucuc

SEQ ID NO: 918983 - RNA, 23 nt, Human
ccucgcccucuuauccuuccccc

SEQ ID NO: 918984 - RNA, 20 nt, Human
ccucucuccuuucccaccca

SEQ ID NO: 918985 - RNA, 18 nt, Human
ccucuuauccuucccccc

SEQ ID NO: 918986 - RNA, 21 nt, Human
cgagaggacgcucuccuggug

SEQ ID NO: 918987 - RNA, 19 nt, Human
cgaugagcuccucgcccuc

SEQ ID NO: 918988 - RNA, 24 nt, Human
cgcccaagccaggggccggggagc

SEQ ID NO: 918989 - RNA, 20 nt, Human
cggagcauggacugagaagc

SEQ ID NO: 918990 - RNA, 20 nt, Human
cggucacagagaaauacuuu

SEQ ID NO: 918991 - RNA, 21 nt, Human
cguccugcuucccaaaagcua

SEQ ID NO: 918992 - RNA, 24 nt, Human
cuaagacuuuaagggcccacacag

SEQ ID NO: 918993 - RNA, 19 nt, Human
cucccugcugggccugguc

SEQ ID NO: 918994 - RNA, 27 nt, Human
cucccuggcuggcuccucucuccuuuc

SEQ ID NO: 918995 - RNA, 22 nt, Human
cuccgaccugcgcccaagaagc

SEQ ID NO: 918996 - RNA, 18 nt, Human
cuccucucuccuuuccca

SEQ ID NO: 918997 - RNA, 23 nt, Human
cuccucucuccuuucccacccaa

SEQ ID NO: 918998 - RNA, 18 nt, Human
cuggcccaagcaagaccu

SEQ ID NO: 918999 - RNA, 19 nt, Human
gauucauguagaaaaucac

SEQ ID NO: 919000 - RNA, 19 nt, Human
gcauggacugagaagcaag

SEQ ID NO: 919001 - RNA, 22 nt, Human
gcccacacagcagagaacagca

SEQ ID NO: 919002 - RNA, 20 nt, Human
gcccucuuauccuucccccc

SEQ ID NO: 919003 - RNA, 25 nt, Human
ggcccacccagcuccgaccugcgcc

SEQ ID NO: 919004 - RNA, 18 nt, Human
gggcccacacagcagaga

SEQ ID NO: 919005 - RNA, 18 nt, Human
guccugcuucccaaaagc

SEQ ID NO: 919006 - RNA, 23 nt, Human
uagaaaaucacaaagccuucucg

SEQ ID NO: 919007 - RNA, 20 nt, Human
ucacacucagaauuuaauuu

SEQ ID NO: 919008 - RNA, 21 nt, Human
ucacagagaaauacuuuuuuu

SEQ ID NO: 919009 - RNA, 24 nt, Human
ucacugcagcugccccucccuggc

SEQ ID NO: 919010 - RNA, 21 nt, Human
ucccaaaagcuaccgcugagc

SEQ ID NO: 919011 - RNA, 20 nt, Human
ucccugcugggccuggucac

SEQ ID NO: 919012 - RNA, 23 nt, Human
uccgcggaccgugacaggaggug

SEQ ID NO: 919013 - RNA, 22 nt, Human
ucuuggcuaagacuuuaagggc

SEQ ID NO: 919014 - RNA, 23 nt, Human
ugaagggguggcucccaaacgcc

SEQ ID NO: 919015 - RNA, 18 nt, Human
ugaauggagggagcagaa

SEQ ID NO: 919016 - RNA, 23 nt, Human
ugacgguggcagaacugcggcac

SEQ ID NO: 919017 - RNA, 18 nt, Human
ugagcuccucgcccucuu

SEQ ID NO: 919018 - RNA, 19 nt, Human
uggagggagcagaaaucuc

SEQ ID NO: 919019 - RNA, 20 nt, Human
uggcccaagcaagaccucag

SEQ ID NO: 919020 - RNA, 23 nt, Human
uggcccaagcaagaccucagacc

SEQ ID NO: 919021 - RNA, 19 nt, Human
uggcuccucucuccuuucc

SEQ ID NO: 919022 - RNA, 18 nt, Human
ugucacagggcuaugucu

SEQ ID NO: 919023 - RNA, 18 nt, Human
ugucacagggcuaugucu

SEQ ID NO: 919024 - RNA, 20 nt, Human
uucacacucagaauuuaauu

SEQ ID NO: 919025 - RNA, 18 nt, Human
uuccccccuccgcggacc

SEQ ID NO: 919026 - RNA, 24 nt, Human
uuucacacucagaauuuaauuucu

SEQ ID NO: 919027 - RNA, 20 nt, Human
uuucuccaaaaguuguuucu

SEQ ID NO: 919028 - RNA, 23 nt, Human
uuuuuuuuuuuuuuuuucacacu

SEQ ID NO: 919029 - RNA, 26 nt, Human
aaaaaacaccacucaauacuuacuaa

SEQ ID NO: 919030 - RNA, 21 nt, Human
aaaaacaccacucaauacuua

SEQ ID NO: 919031 - RNA, 26 nt, Human
aaaaagcagacagcugauugcaucac

SEQ ID NO: 919032 - RNA, 21 nt, Human
aaaaucaccagcacaccacug

SEQ ID NO: 919033 - RNA, 18 nt, Human
aaagaagccagucagaca

SEQ ID NO: 919034 - RNA, 26 nt, Human
aaagagcagcauaaagcacaccccgu

SEQ ID NO: 919035 - RNA, 23 nt, Human
aaaggaacagaacacaagccacg

SEQ ID NO: 919036 - RNA, 20 nt, Human
aaccuuaaaaagcagacagc

SEQ ID NO: 919037 - RNA, 21 nt, Human
aaucacagccacagcucccgc

SEQ ID NO: 919038 - RNA, 28 nt, Human
aaugacaaaaguaacuguuuaaaaggga

SEQ ID NO: 919039 - RNA, 22 nt, Human
acaccacugcaauccacugagc

SEQ ID NO: 919040 - RNA, 18 nt, Human
acacuguauauaggaagg

SEQ ID NO: 919041 - RNA, 19 nt, Human
acaugguauuguauaaaaa

SEQ ID NO: 919042 - RNA, 22 nt, Human
acugcaauccacugagcucacc

SEQ ID NO: 919043 - RNA, 18 nt, Human
agaaaaaaaaaacaccac

SEQ ID NO: 919044 - RNA, 20 nt, Human
agacuuacagagaacagccu

SEQ ID NO: 919045 - RNA, 20 nt, Human
agagaucauaggauuuguau

SEQ ID NO: 919046 - RNA, 26 nt, Human
agcaaauagggaagcuaaaaauacaa

SEQ ID NO: 919047 - RNA, 18 nt, Human
agcugauugcaucacuua

SEQ ID NO: 919048 - RNA, 19 nt, Human
aggaacagaacacaagcca

SEQ ID NO: 919049 - RNA, 21 nt, Human
aggcaaaagaagccagucaga

SEQ ID NO: 919050 - RNA, 25 nt, Human
aggggaucaacaaaccgcaaagagc

SEQ ID NO: 919051 - RNA, 22 nt, Human
agggugaguggagcacaguggg

SEQ ID NO: 919052 - RNA, 25 nt, Human
agggugaguggagcacaguggguua

SEQ ID NO: 919053 - RNA, 21 nt, Human
augaauucuuagaauacagag

SEQ ID NO: 919054 - RNA, 21 nt, Human
augucaaccuuuacucagcuu

SEQ ID NO: 919055 - RNA, 22 nt, Human
caaaagaagccagucagacacc

SEQ ID NO: 919056 - RNA, 19 nt, Human
caaaaucaccagcacacca

SEQ ID NO: 919057 - RNA, 26 nt, Human
caaacuucuggucuuaaucaaguuca

SEQ ID NO: 919058 - RNA, 22 nt, Human
caaauagggaagcuaaaaauac

SEQ ID NO: 919059 - RNA, 22 nt, Human
caagagggguaaacguauccag

SEQ ID NO: 919060 - RNA, 22 nt, Human
caagauggaacuccaaccaaca

SEQ ID NO: 919061 - RNA, 22 nt, Human
caaucccaaccuuaaaaagcag

SEQ ID NO: 919062 - RNA, 19 nt, Human
caccacucaauacuuacua

SEQ ID NO: 919063 - RNA, 20 nt, Human
cacucucuagguauugagag

SEQ ID NO: 919064 - RNA, 21 nt, Human
cacucucuagguauugagagu

SEQ ID NO: 919065 - RNA, 21 nt, Human
cacugugcaaaaucaccagca

SEQ ID NO: 919066 - RNA, 23 nt, Human
cacugugcaaaaucaccagcaca

SEQ ID NO: 919067 - RNA, 18 nt, Human
cagaacacaagccacguc

SEQ ID NO: 919068 - RNA, 26 nt, Human
cagcacaaucccaaccuuaaaaagca

SEQ ID NO: 919069 - RNA, 23 nt, Human
cagcagcacggcagcuccuccaa

SEQ ID NO: 919070 - RNA, 18 nt, Human
cagcauaaagcacacccc

SEQ ID NO: 919071 - RNA, 19 nt, Human
caggucaaagacugugcuu

SEQ ID NO: 919072 - RNA, 23 nt, Human
ccaaaacuuaaaagacuuacaga

SEQ ID NO: 919073 - RNA, 19 nt, Human
ccacugcaauccacugagc

SEQ ID NO: 919074 - RNA, 18 nt, Human
ccuagacauaaugccagg

SEQ ID NO: 919075 - RNA, 20 nt, Human
cucuaaccccucucucaauc

SEQ ID NO: 919076 - RNA, 24 nt, Human
cucuccauccuuuuuccuuuuaaa

SEQ ID NO: 919077 - RNA, 23 nt, Human
cucucccucuccauccucucuua

SEQ ID NO: 919078 - RNA, 27 nt, Human
cuucucuccauccuuuuuccuuuuaaa

SEQ ID NO: 919079 - RNA, 19 nt, Human
cuuuccauccuucucucca

SEQ ID NO: 919080 - RNA, 23 nt, Human
gaacaagaaggaauaauuccugu

SEQ ID NO: 919081 - RNA, 21 nt, Human
gaacagccucaggagguuagg

SEQ ID NO: 919082 - RNA, 22 nt, Human
gaacagccucaggagguuaggg

SEQ ID NO: 919083 - RNA, 19 nt, Human
gaacuccaaccaacaccag

SEQ ID NO: 919084 - RNA, 20 nt, Human
gaaggucccagagagcuuuu

SEQ ID NO: 919085 - RNA, 18 nt, Human
gaccagaggcaaugacaa

SEQ ID NO: 919086 - RNA, 18 nt, Human
gacucaucucccaaacuu

SEQ ID NO: 919087 - RNA, 18 nt, Human
gagguggagaucuagaug

SEQ ID NO: 919088 - RNA, 18 nt, Human
gccucuaaccccucucuc

SEQ ID NO: 919089 - RNA, 22 nt, Human
gcggaccagggcauagggugag

SEQ ID NO: 919090 - RNA, 21 nt, Human
gcuguuuuugaauauucuguu

SEQ ID NO: 919091 - RNA, 21 nt, Human
gcuuuccauccuucucuccau

SEQ ID NO: 919092 - RNA, 18 nt, Human
ggaauaauuccugugcca

SEQ ID NO: 919093 - RNA, 22 nt, Human
ggaggaagaggauuacagggag

SEQ ID NO: 919094 - RNA, 20 nt, Human
guggagcacaguggguuagc

SEQ ID NO: 919095 - RNA, 22 nt, Human
uaaaagacuuacagagaacagc

SEQ ID NO: 919096 - RNA, 24 nt, Human
uaaaugugugccuuaucuuccuca

SEQ ID NO: 919097 - RNA, 22 nt, Human
uaacagcuuuuugccuccugcu

SEQ ID NO: 919098 - RNA, 20 nt, Human
uaagaaacacccacaugaau

SEQ ID NO: 919099 - RNA, 20 nt, Human
uaaguccaggcuuuccaucc

SEQ ID NO: 919100 - RNA, 25 nt, Human
uacaccaucuugaggcaaaagaagc

SEQ ID NO: 919101 - RNA, 23 nt, Human
uagggugaguggagcacaguggg

SEQ ID NO: 919102 - RNA, 22 nt, Human
uaguauaaaccucacaggauga

SEQ ID NO: 919103 - RNA, 24 nt, Human
uauacaaagccacugcuuuagucc

SEQ ID NO: 919104 - RNA, 18 nt, Human
uaucauuguaauagauga

SEQ ID NO: 919105 - RNA, 19 nt, Human
uauccagcagaauguaagg

SEQ ID NO: 919106 - RNA, 18 nt, Human
ucaccagcacaccacugc

SEQ ID NO: 919107 - RNA, 20 nt, Human
ucacuugaagguuaucauug

SEQ ID NO: 919108 - RNA, 25 nt, Human
ucauuagaagguaacagcuuuuuuc

SEQ ID NO: 919109 - RNA, 25 nt, Human
uccauuccuauuuagacaaaugacc

SEQ ID NO: 919110 - RNA, 23 nt, Human
uccuuuuuccuuuuaaaaagaag

SEQ ID NO: 919111 - RNA, 24 nt, Human
ucuccagaaguuuuuucuaaaggu

SEQ ID NO: 919112 - RNA, 25 nt, Human
ucuccagaaguuuuuucuaaagguu

SEQ ID NO: 919113 - RNA, 20 nt, Human
ucuccauccucucuuaggga

SEQ ID NO: 919114 - RNA, 22 nt, Human
ugaaagaacagucuuuugauac

SEQ ID NO: 919115 - RNA, 21 nt, Human
ugcaaaaucaccagcacacca

SEQ ID NO: 919116 - RNA, 19 nt, Human
ugccuccugcuuccagaug

SEQ ID NO: 919117 - RNA, 23 nt, Human
ugccuccugcuuccagaugauuu

SEQ ID NO: 919118 - RNA, 22 nt, Human
ugcuaaagaagcucauguuaag

SEQ ID NO: 919119 - RNA, 21 nt, Human
uggaacuccaaccaacaccag

SEQ ID NO: 919120 - RNA, 20 nt, Human
ugggacccgccucuaacccc

SEQ ID NO: 919121 - RNA, 21 nt, Human
uguagccagguguccguguac

SEQ ID NO: 919122 - RNA, 18 nt, Human
ugucugcuacgugugaga

SEQ ID NO: 919123 - RNA, 28 nt, Human
uuaguccaaccaaaacuuaaaagacuua

SEQ ID NO: 919124 - RNA, 20 nt, Human
uuccuuuugguuaaaaacca

SEQ ID NO: 919125 - RNA, 24 nt, Human
uucucuccagaaguuuuuucuaaa

SEQ ID NO: 919126 - RNA, 24 nt, Human
uuguauaaaaagaaaaaaaaaaca

SEQ ID NO: 919127 - RNA, 22 nt, Human
uuguauuaucccuugcaagaug

SEQ ID NO: 919128 - RNA, 29 nt, Human
uuugccuccugcuuccagaugauuuccuc

SEQ ID NO: 919129 - RNA, 18 nt, Human
uuuguguucugccugagg

SEQ ID NO: 919130 - RNA, 23 nt, Human
aagaggagagaccggccccgucg

SEQ ID NO: 919131 - RNA, 22 nt, Human
agaaggaggcaacugcggggaa

SEQ ID NO: 919132 - RNA, 31 nt, Human
caaugggcucucgcuucuguccugagguucu

SEQ ID NO: 919133 - RNA, 25 nt, Human
cagccgggcugagcugagcaggagc

SEQ ID NO: 919134 - RNA, 19 nt, Human
cuguccugagguucuuggg

SEQ ID NO: 919135 - RNA, 21 nt, Human
gagcugagcaggagcaauggg

SEQ ID NO: 919136 - RNA, 20 nt, Human
gagguucuuggguggugagc

SEQ ID NO: 919137 - RNA, 20 nt, Human
gcaggaggucuuacguggug

SEQ ID NO: 919138 - RNA, 22 nt, Human
gggcaggaggucuuacguggug

SEQ ID NO: 919139 - RNA, 24 nt, Human
uccgcagccgggcugagcugagca

SEQ ID NO: 919140 - RNA, 20 nt, Human
ucuguccugagguucuuggg

SEQ ID NO: 919141 - RNA, 21 nt, Human
aaaacaaaacgugagauuaga

SEQ ID NO: 919142 - RNA, 22 nt, Human
aaagaggaugguuuagggagag

SEQ ID NO: 919143 - RNA, 22 nt, Human
aaccaucuaaccauacauuuaa

SEQ ID NO: 919144 - RNA, 23 nt, Human
aagaggaagccugggguuuuaaa

SEQ ID NO: 919145 - RNA, 20 nt, Human
aagcacucaacuuagaaaca

SEQ ID NO: 919146 - RNA, 19 nt, Human
aagcaggaggcacagaggg

SEQ ID NO: 919147 - RNA, 20 nt, Human
aagcagguuaucaaagcuua

SEQ ID NO: 919148 - RNA, 24 nt, Human
aagcuuacagacugacagaaguga

SEQ ID NO: 919149 - RNA, 18 nt, Human
aagguuuugggccaagug

SEQ ID NO: 919150 - RNA, 19 nt, Human
acuccagccugggccacag

SEQ ID NO: 919151 - RNA, 24 nt, Human
acuccagccugggccacagaguga

SEQ ID NO: 919152 - RNA, 18 nt, Human
acugcacuccagccuggg

SEQ ID NO: 919153 - RNA, 24 nt, Human
acugcacuccagccugggccacag

SEQ ID NO: 919154 - RNA, 18 nt, Human
agacugcagaucaaaaac

SEQ ID NO: 919155 - RNA, 21 nt, Human
agcagagaguaagguacaucu

SEQ ID NO: 919156 - RNA, 24 nt, Human
aggaagcaggaggcacagagggag

SEQ ID NO: 919157 - RNA, 18 nt, Human
aggaggcucaggcgggag

SEQ ID NO: 919158 - RNA, 24 nt, Human
aggcaggagagaaaggaagcagga

SEQ ID NO: 919159 - RNA, 18 nt, Human
aggcgggaggaucaccug

SEQ ID NO: 919160 - RNA, 24 nt, Human
aggcucaggcgggaggaucaccug

SEQ ID NO: 919161 - RNA, 22 nt, Human
aggugaugacaaauccuaaagc

SEQ ID NO: 919162 - RNA, 22 nt, Human
agucguucagaaucccucuugu

SEQ ID NO: 919163 - RNA, 24 nt, Human
aucaugccacugcacuccagccug

SEQ ID NO: 919164 - RNA, 22 nt, Human
augccacugcacuccagccugg

SEQ ID NO: 919165 - RNA, 26 nt, Human
caaaacaggauucugcuacucagaug

SEQ ID NO: 919166 - RNA, 22 nt, Human
caaaaggccauaaccuucagau

SEQ ID NO: 919167 - RNA, 21 nt, Human
caagcacucaacuuagaaaca

SEQ ID NO: 919168 - RNA, 21 nt, Human
cacagaaacacguagcacguc

SEQ ID NO: 919169 - RNA, 22 nt, Human
cacuccagccugggccacagag

SEQ ID NO: 919170 - RNA, 23 nt, Human
cacuccagccugggccacagagu

SEQ ID NO: 919171 - RNA, 24 nt, Human
cacuccagccugggccacagagug

SEQ ID NO: 919172 - RNA, 18 nt, Human
cacugcacuccagccugg

SEQ ID NO: 919173 - RNA, 19 nt, Human
cacugcacuccagccuggg

SEQ ID NO: 919174 - RNA, 20 nt, Human
cacugcacuccagccugggc

SEQ ID NO: 919175 - RNA, 24 nt, Human
cacugcacuccagccugggccaca

SEQ ID NO: 919176 - RNA, 19 nt, Human
cagagaguaagguacaucu

SEQ ID NO: 919177 - RNA, 23 nt, Human
cagagugagagacuccaucucuu

SEQ ID NO: 919178 - RNA, 24 nt, Human
caucuguagucccagauacucagg

SEQ ID NO: 919179 - RNA, 24 nt, Human
ccaagcacucaacuuagaaacaaa

SEQ ID NO: 919180 - RNA, 24 nt, Human
ccacagagugagagacuccaucuc

SEQ ID NO: 919181 - RNA, 20 nt, Human
ccacugcacuccagccuggg

SEQ ID NO: 919182 - RNA, 21 nt, Human
ccacugcacuccagccugggc

SEQ ID NO: 919183 - RNA, 24 nt, Human
ccacugcacuccagccugggccac

SEQ ID NO: 919184 - RNA, 23 nt, Human
ccauagucacaagucugggagau

SEQ ID NO: 919185 - RNA, 23 nt, Human
ccaucuguuuuuguaaaagacac

SEQ ID NO: 919186 - RNA, 21 nt, Human
ccucuugucaaaaggccauaa

SEQ ID NO: 919187 - RNA, 19 nt, Human
ccugggguuuuacaccuuc

SEQ ID NO: 919188 - RNA, 24 nt, Human
ccugucaaaccccaagcacucaac

SEQ ID NO: 919189 - RNA, 21 nt, Human
ccuucgccuccgcuucaggga

SEQ ID NO: 919190 - RNA, 20 nt, Human
cgcuggggcuuaaacucccc

SEQ ID NO: 919191 - RNA, 20 nt, Human
cguucagaaucccucuuguc

SEQ ID NO: 919192 - RNA, 22 nt, Human
cuaagaaaggccaacagagaua

SEQ ID NO: 919193 - RNA, 20 nt, Human
cucugaguuugguaagugcu

SEQ ID NO: 919194 - RNA, 20 nt, Human
cucuugucaaaaggccauaa

SEQ ID NO: 919195 - RNA, 21 nt, Human
cuucagggagcuacugcgucc

SEQ ID NO: 919196 - RNA, 20 nt, Human
gaaaaggaggcagaugagaa

SEQ ID NO: 919197 - RNA, 23 nt, Human
gacugacagaagugagaaaagga

SEQ ID NO: 919198 - RNA, 18 nt, Human
gagaaaaggaggcagaug

SEQ ID NO: 919199 - RNA, 19 nt, Human
gagaggcaggagagaaagg

SEQ ID NO: 919200 - RNA, 22 nt, Human
gaucaccugagcccaggauuuc

SEQ ID NO: 919201 - RNA, 21 nt, Human
gaucaugccacugcacuccag

SEQ ID NO: 919202 - RNA, 24 nt, Human
gcacuccagccugggccacagagu

SEQ ID NO: 919203 - RNA, 21 nt, Human
gcaguuaaagaggaugguuua

SEQ ID NO: 919204 - RNA, 20 nt, Human
gcauggaaaagcuucacaga

SEQ ID NO: 919205 - RNA, 22 nt, Human
gccacugcacuccagccugggc

SEQ ID NO: 919206 - RNA, 18 nt, Human
ggagcacugaauggaaac

SEQ ID NO: 919207 - RNA, 24 nt, Human
ggaggcagaugagaaagugggaug

SEQ ID NO: 919208 - RNA, 18 nt, Human
ggccaagugggucuauga

SEQ ID NO: 919209 - RNA, 23 nt, Human
uaaacuccccuucgccuccgcuu

SEQ ID NO: 919210 - RNA, 27 nt, Human
uaaccuucagauugaugaagcaaaaca

SEQ ID NO: 919211 - RNA, 23 nt, Human
uaauuuuuagaagacaugagaca

SEQ ID NO: 919212 - RNA, 24 nt, Human
uacagacugacagaagugagaaaa

SEQ ID NO: 919213 - RNA, 19 nt, Human
uacuaccacaccagcaggc

SEQ ID NO: 919214 - RNA, 21 nt, Human
uagaagcaguuaaagaggaug

SEQ ID NO: 919215 - RNA, 24 nt, Human
uagauuccugagcaccaucagauu

SEQ ID NO: 919216 - RNA, 20 nt, Human
uagcagagaguaagguacag

SEQ ID NO: 919217 - RNA, 22 nt, Human
uagcagagaguaagguacaucu

SEQ ID NO: 919218 - RNA, 20 nt, Human
uaggcugaccauaagcaaag

SEQ ID NO: 919219 - RNA, 20 nt, Human
uaugccaucuguuuuuguaa

SEQ ID NO: 919220 - RNA, 21 nt, Human
ucaacuuagaaacaaaaagcg

SEQ ID NO: 919221 - RNA, 18 nt, Human
ucaagugaagagagagaa

SEQ ID NO: 919222 - RNA, 24 nt, Human
ucacaagucugggagauggacuac

SEQ ID NO: 919223 - RNA, 26 nt, Human
ucacuaccugucaaaccccaagcacu

SEQ ID NO: 919224 - RNA, 20 nt, Human
ucaggcgggaggaucaccug

SEQ ID NO: 919225 - RNA, 23 nt, Human
ucaugccacugcacuccagccug

SEQ ID NO: 919226 - RNA, 23 nt, Human
uccagccugggccacagagugag

SEQ ID NO: 919227 - RNA, 24 nt, Human
uccagccugggccacagagugaga

SEQ ID NO: 919228 - RNA, 24 nt, Human
ucucuuaaaaacaaaacgugagau

SEQ ID NO: 919229 - RNA, 28 nt, Human
ugacagaagugagaaaaggaggcagaag

SEQ ID NO: 919230 - RNA, 21 nt, Human
ugagacaaaauuagccaggcu

SEQ ID NO: 919231 - RNA, 27 nt, Human
ugagcccaggauuucaaggaccaaagu

SEQ ID NO: 919232 - RNA, 21 nt, Human
ugagccuuggcugccucugug

SEQ ID NO: 919233 - RNA, 21 nt, Human
ugcaaucaaacauaggcugac

SEQ ID NO: 919234 - RNA, 22 nt, Human
ugcaaugagcuaugaucaugcc

SEQ ID NO: 919235 - RNA, 21 nt, Human
uggagcacugaauggaaacag

SEQ ID NO: 919236 - RNA, 19 nt, Human
ugggauggggagcagagga

SEQ ID NO: 919237 - RNA, 21 nt, Human
ugggguuuuacaccuuccggc

SEQ ID NO: 919238 - RNA, 22 nt, Human
ugucaaaccccaagcacucaac

SEQ ID NO: 919239 - RNA, 23 nt, Human
ugugaucagauuacuaccacacc

SEQ ID NO: 919240 - RNA, 20 nt, Human
uuuaaguaaacaaaagcgag

SEQ ID NO: 919241 - RNA, 22 nt, Human
uuuuuuuuuuuuuuuaacaaga

SEQ ID NO: 919242 - RNA, 24 nt, Human
uuuuuuuuuuuuuuuuuuaacaag

SEQ ID NO: 919243 - RNA, 21 nt, Human
aagagcagacccagggucaca

SEQ ID NO: 919244 - RNA, 24 nt, Human
acacagugaugaggcuggcacuga

SEQ ID NO: 919245 - RNA, 23 nt, Human
accacagccuccagcucauggcu

SEQ ID NO: 919246 - RNA, 19 nt, Human
aggaagccggugagucaag

SEQ ID NO: 919247 - RNA, 19 nt, Human
aggcagaagcacagagccu

SEQ ID NO: 919248 - RNA, 24 nt, Human
aggcagaagcacagagccuggcuc

SEQ ID NO: 919249 - RNA, 20 nt, Human
aggccccaccacagcuccac

SEQ ID NO: 919250 - RNA, 23 nt, Human
agggcccacuccagguagaugac

SEQ ID NO: 919251 - RNA, 20 nt, Human
aguuaacugcagugcaacua

SEQ ID NO: 919252 - RNA, 22 nt, Human
caacuaaugagacacugcacau

SEQ ID NO: 919253 - RNA, 18 nt, Human
cacacccugcagcacacc

SEQ ID NO: 919254 - RNA, 18 nt, Human
cacagcuccacgaugugg

SEQ ID NO: 919255 - RNA, 18 nt, Human
caccagcaggggcucaac

SEQ ID NO: 919256 - RNA, 23 nt, Human
caccagcaggggcucaacugauc

SEQ ID NO: 919257 - RNA, 24 nt, Human
caccagcaggggcucaacugaucc

SEQ ID NO: 919258 - RNA, 25 nt, Human
cacccugcagcacaccagcaggggc

SEQ ID NO: 919259 - RNA, 20 nt, Human
caccucaucacacccugcag

SEQ ID NO: 919260 - RNA, 21 nt, Human
caccucaucacacccugcagc

SEQ ID NO: 919261 - RNA, 24 nt, Human
caccucaucacacccugcagcaca

SEQ ID NO: 919262 - RNA, 20 nt, Human
cagagccaggggcuaugugu

SEQ ID NO: 919263 - RNA, 22 nt, Human
cagagugugccuggggauauga

SEQ ID NO: 919264 - RNA, 23 nt, Human
caggccccaccacagcuccacga

SEQ ID NO: 919265 - RNA, 24 nt, Human
caggggcuauguguggacuuaggg

SEQ ID NO: 919266 - RNA, 18 nt, Human
ccacagcuccacgaugug

SEQ ID NO: 919267 - RNA, 26 nt, Human
ccacuugccauucaugacugcaggcc

SEQ ID NO: 919268 - RNA, 19 nt, Human
cccaggcccucucccucuc

SEQ ID NO: 919269 - RNA, 21 nt, Human
ccucccagcuccuacccaggc

SEQ ID NO: 919270 - RNA, 20 nt, Human
ccugaagaaggggagggccc

SEQ ID NO: 919271 - RNA, 21 nt, Human
cuccacgaugugggccccacu

SEQ ID NO: 919272 - RNA, 24 nt, Human
cucccagcuccuacccaggcccuc

SEQ ID NO: 919273 - RNA, 21 nt, Human
gcuggcacugagggcucccac

SEQ ID NO: 919274 - RNA, 21 nt, Human
ggagggaguuggccacaaggg

SEQ ID NO: 919275 - RNA, 18 nt, Human
ggaguuggccacaagggg

SEQ ID NO: 919276 - RNA, 21 nt, Human
ggcagggugcccugcaggagc

SEQ ID NO: 919277 - RNA, 19 nt, Human
gggcagggugcccugcagg

SEQ ID NO: 919278 - RNA, 21 nt, Human
guacugaagccccauaguuga

SEQ ID NO: 919279 - RNA, 19 nt, Human
guggagggcacccaugucc

SEQ ID NO: 919280 - RNA, 20 nt, Human
guggagggcacccaugucca

SEQ ID NO: 919281 - RNA, 18 nt, Human
uagaugacauggccaggg

SEQ ID NO: 919282 - RNA, 23 nt, Human
ucacacccugcagcacaccagca

SEQ ID NO: 919283 - RNA, 18 nt, Human
ucagugagaaggggaggg

SEQ ID NO: 919284 - RNA, 18 nt, Human
ucccagcuccuacccagg

SEQ ID NO: 919285 - RNA, 19 nt, Human
ucccagcuccuacccaggc

SEQ ID NO: 919286 - RNA, 20 nt, Human
uccggaagagccaggccuug

SEQ ID NO: 919287 - RNA, 22 nt, Human
uccuugcuggcacgaaccacag

SEQ ID NO: 919288 - RNA, 25 nt, Human
ucuccagaugccuacagcacaccag

SEQ ID NO: 919289 - RNA, 22 nt, Human
ucugggcagggugcccugcagg

SEQ ID NO: 919290 - RNA, 18 nt, Human
ugaaaauuaucuuccucc

SEQ ID NO: 919291 - RNA, 19 nt, Human
ugaaaauuaucuuccuccc

SEQ ID NO: 919292 - RNA, 19 nt, Human
ugaagccccauaguugaaa

SEQ ID NO: 919293 - RNA, 21 nt, Human
ugaaggugggggucagggggc

SEQ ID NO: 919294 - RNA, 21 nt, Human
ugagaacaggccuuaaaggca

SEQ ID NO: 919295 - RNA, 22 nt, Human
ugaguggaagugggggacacag

SEQ ID NO: 919296 - RNA, 21 nt, Human
ugauucaaggccugaagaagg

SEQ ID NO: 919297 - RNA, 21 nt, Human
ugcagugcagguaugcauggu

SEQ ID NO: 919298 - RNA, 23 nt, Human
ugcugagaacaggccuuaaaggc

SEQ ID NO: 919299 - RNA, 20 nt, Human
uggagacauucaguggccag

SEQ ID NO: 919300 - RNA, 18 nt, Human
uggcucggggcgcugcag

SEQ ID NO: 919301 - RNA, 20 nt, Human
ugggcagggugcccugcagg

SEQ ID NO: 919302 - RNA, 18 nt, Human
ugggggacacaggcaggc

SEQ ID NO: 919303 - RNA, 21 nt, Human
uucaugacugcaggccccacc

SEQ ID NO: 919304 - RNA, 22 nt, Human
uuccugaguggaagugggggac

SEQ ID NO: 919305 - RNA, 18 nt, Human
aauagaaacaagacacca

SEQ ID NO: 919306 - RNA, 23 nt, Human
acaaauaaaauacuuuuuaucac

SEQ ID NO: 919307 - RNA, 20 nt, Human
caagacaccaagauauuuaa

SEQ ID NO: 919308 - RNA, 21 nt, Human
caauagaaacaagacaccaag

SEQ ID NO: 919309 - RNA, 23 nt, Human
cacaucaagacuaucuacaaaaa

SEQ ID NO: 919310 - RNA, 23 nt, Human
cagaagaaaagcaugcauaucau

SEQ ID NO: 919311 - RNA, 19 nt, Human
ccacacaauagaaacaaga

SEQ ID NO: 919312 - RNA, 22 nt, Human
ugccaaacgguucucgagcucc

SEQ ID NO: 919313 - RNA, 24 nt, Human
aaaaaaaaaaaaaaaagcauuuca

SEQ ID NO: 919314 - RNA, 23 nt, Human
aaaaagaugauguggaggccaaa

SEQ ID NO: 919315 - RNA, 20 nt, Human
aaacacccugaaauuaaaac

SEQ ID NO: 919316 - RNA, 23 nt, Human
aaacagcaaccuaaccccacgcc

SEQ ID NO: 919317 - RNA, 25 nt, Human
aaacuggucuuucucuauaaagucu

SEQ ID NO: 919318 - RNA, 22 nt, Human
aaaggcaaaguagccaucuauc

SEQ ID NO: 919319 - RNA, 20 nt, Human
aagaauuucaggccaguugu

SEQ ID NO: 919320 - RNA, 20 nt, Human
aagaccacuuaccccaaauc

SEQ ID NO: 919321 - RNA, 24 nt, Human
aagacuucagugagccaugacugu

SEQ ID NO: 919322 - RNA, 23 nt, Human
aagcauuucaaacuaacagcggu

SEQ ID NO: 919323 - RNA, 20 nt, Human
aagucagccccagacagugg

SEQ ID NO: 919324 - RNA, 22 nt, Human
acagcaaaugggcugcagugaa

SEQ ID NO: 919325 - RNA, 19 nt, Human
acagcaaccuaaccccacg

SEQ ID NO: 919326 - RNA, 18 nt, Human
acauccagccugggaagu

SEQ ID NO: 919327 - RNA, 20 nt, Human
accucuuuggcacgaccauu

SEQ ID NO: 919328 - RNA, 23 nt, Human
acugugcugugaauggcacaacu

SEQ ID NO: 919329 - RNA, 21 nt, Human
acuucagugagccaugacugu

SEQ ID NO: 919330 - RNA, 18 nt, Human
agacagugggaagguggu

SEQ ID NO: 919331 - RNA, 19 nt, Human
agcacuugucccccaagug

SEQ ID NO: 919332 - RNA, 20 nt, Human
agcauaguaaaaccccaccu

SEQ ID NO: 919333 - RNA, 18 nt, Human
aggcagggggaucacuug

SEQ ID NO: 919334 - RNA, 23 nt, Human
aggcagggggaucacuugagccc

SEQ ID NO: 919335 - RNA, 24 nt, Human
aggccaguugugguggcucaugcc

SEQ ID NO: 919336 - RNA, 22 nt, Human
aggcugaggcagcggggucaag

SEQ ID NO: 919337 - RNA, 22 nt, Human
agucuggacagcauaguaaaac

SEQ ID NO: 919338 - RNA, 24 nt, Human
agucuggacagcauaguaaaaccc

SEQ ID NO: 919339 - RNA, 24 nt, Human
aguugugguggcucaugccuguaa

SEQ ID NO: 919340 - RNA, 24 nt, Human
aucacuugagcccaggaguuuaag

SEQ ID NO: 919341 - RNA, 27 nt, Human
caaaguagccaucuaucucaaggggcc

SEQ ID NO: 919342 - RNA, 19 nt, Human
caaccuaaccccacgccaa

SEQ ID NO: 919343 - RNA, 24 nt, Human
cacaccuguggccccaguuauuug

SEQ ID NO: 919344 - RNA, 24 nt, Human
caccucuauaaaaaauuuuaaaaa

SEQ ID NO: 919345 - RNA, 20 nt, Human
cagcauaguaaaaccccacc

SEQ ID NO: 919346 - RNA, 24 nt, Human
caguuauuugggaggcugaggcag

SEQ ID NO: 919347 - RNA, 20 nt, Human
caugucaccugggccuguga

SEQ ID NO: 919348 - RNA, 20 nt, Human
ccacgccaagcugggcuguu

SEQ ID NO: 919349 - RNA, 25 nt, Human
ccauggcgugcuucuuccgucuccc

SEQ ID NO: 919350 - RNA, 23 nt, Human
ccauuuaaaaaaaaaaaaaaaaa

SEQ ID NO: 919351 - RNA, 22 nt, Human
ccccaaauccacauucugcaag

SEQ ID NO: 919352 - RNA, 19 nt, Human
ccuccagccuggacaagag

SEQ ID NO: 919353 - RNA, 23 nt, Human
ccucuuuggcacgaccauugcuu

SEQ ID NO: 919354 - RNA, 20 nt, Human
ccuguaaucucaccaguuug

SEQ ID NO: 919355 - RNA, 22 nt, Human
ccuguaaucucaccaguuuggg

SEQ ID NO: 919356 - RNA, 19 nt, Human
ccuucaagaccacuuaccc

SEQ ID NO: 919357 - RNA, 22 nt, Human
cuaaaugaauccuucaagacca

SEQ ID NO: 919358 - RNA, 25 nt, Human
cucaugccuguaaucucaccaguuu

SEQ ID NO: 919359 - RNA, 18 nt, Human
cucauuucagaaacaucg

SEQ ID NO: 919360 - RNA, 21 nt, Human
cugcaagacaguucaagaaga

SEQ ID NO: 919361 - RNA, 23 nt, Human
cuggacagcauaguaaaacccca

SEQ ID NO: 919362 - RNA, 19 nt, Human
cuggcugccacugcacaag

SEQ ID NO: 919363 - RNA, 19 nt, Human
cuucaagaccacuuacccc

SEQ ID NO: 919364 - RNA, 18 nt, Human
gaccauugcuucuucuuu

SEQ ID NO: 919365 - RNA, 20 nt, Human
gagcagcagugauguuugga

SEQ ID NO: 919366 - RNA, 24 nt, Human
gaucacuugagcccaggaguuuaa

SEQ ID NO: 919367 - RNA, 23 nt, Human
gcaaaugggcugcagugaacagu

SEQ ID NO: 919368 - RNA, 18 nt, Human
gcaagucagccccagaca

SEQ ID NO: 919369 - RNA, 19 nt, Human
gccugggaaguacacaggc

SEQ ID NO: 919370 - RNA, 23 nt, Human
gcgugcuucuuccgucucccagg

SEQ ID NO: 919371 - RNA, 23 nt, Human
ggaaggugguguuaugccugggg

SEQ ID NO: 919372 - RNA, 20 nt, Human
ggaggcugaggcagcggggu

SEQ ID NO: 919373 - RNA, 22 nt, Human
ggaucacuugagcccaggaguu

SEQ ID NO: 919374 - RNA, 22 nt, Human
gggaaguacacaggcgucaagg

SEQ ID NO: 919375 - RNA, 24 nt, Human
gggaucacuugagcccaggaguuu

SEQ ID NO: 919376 - RNA, 24 nt, Human
gggcuuugguggaggucauggggc

SEQ ID NO: 919377 - RNA, 27 nt, Human
gguggcucaugccuguaaucucaccag

SEQ ID NO: 919378 - RNA, 22 nt, Human
guggcucaugccuguaaucuca

SEQ ID NO: 919379 - RNA, 22 nt, Human
uaaaaaaaaaaaaaaaaagcau

SEQ ID NO: 919380 - RNA, 19 nt, Human
uaauguagcuucacaucca

SEQ ID NO: 919381 - RNA, 21 nt, Human
uaccccaaauccacauucugc

SEQ ID NO: 919382 - RNA, 20 nt, Human
ucaacagaauuucugugcaa

SEQ ID NO: 919383 - RNA, 18 nt, Human
ucaccaguuugggaggcc

SEQ ID NO: 919384 - RNA, 24 nt, Human
ucaggccaguugugguggcucaug

SEQ ID NO: 919385 - RNA, 21 nt, Human
uccaagauuccaugucaccuu

SEQ ID NO: 919386 - RNA, 21 nt, Human
uccagagaaguuuuucuucag

SEQ ID NO: 919387 - RNA, 20 nt, Human
uccuccagccuggacaagag

SEQ ID NO: 919388 - RNA, 22 nt, Human
uccuucaagaccacuuacccca

SEQ ID NO: 919389 - RNA, 23 nt, Human
ucuccaaaggaauucucaacugu

SEQ ID NO: 919390 - RNA, 24 nt, Human
ucuccauuuaaaaaaaaaaaaaaa

SEQ ID NO: 919391 - RNA, 22 nt, Human
ucuccgagcagcagugauguuu

SEQ ID NO: 919392 - RNA, 21 nt, Human
ucuuccgucucccagguuagg

SEQ ID NO: 919393 - RNA, 18 nt, Human
ugaaauuaaaacaugaaa

SEQ ID NO: 919394 - RNA, 22 nt, Human
ugaaauuaaaacaugaaauauu

SEQ ID NO: 919395 - RNA, 18 nt, Human
ugaccccucaucucacac

SEQ ID NO: 919396 - RNA, 22 nt, Human
ugacuaaaugaauccuucaaga

SEQ ID NO: 919397 - RNA, 23 nt, Human
ugagcccaggaguuuaagaccag

SEQ ID NO: 919398 - RNA, 24 nt, Human
ugaggcagcggggucaagacuuca

SEQ ID NO: 919399 - RNA, 23 nt, Human
ugaguuauuugaaacagcaaccu

SEQ ID NO: 919400 - RNA, 21 nt, Human
ugcagugaacagugcacaccc

SEQ ID NO: 919401 - RNA, 24 nt, Human
ugccuguaaucucaccaguuuggg

SEQ ID NO: 919402 - RNA, 21 nt, Human
ugcuccaagauuccaugucac

SEQ ID NO: 919403 - RNA, 22 nt, Human
uggacagcauaguaaaacccca

SEQ ID NO: 919404 - RNA, 23 nt, Human
uggcacaacucacaugguaaugu

SEQ ID NO: 919405 - RNA, 22 nt, Human
uggcgugcuucuuccgucuccc

SEQ ID NO: 919406 - RNA, 24 nt, Human
uggcucaugccuguaaucucacca

SEQ ID NO: 919407 - RNA, 19 nt, Human
ugggaaggugguguuaugc

SEQ ID NO: 919408 - RNA, 25 nt, Human
ugggaaggugguguuaugccugggg

SEQ ID NO: 919409 - RNA, 26 nt, Human
ugggaaggugguguuaugccugggga

SEQ ID NO: 919410 - RNA, 24 nt, Human
ugggaggccaaggcagggggauca

SEQ ID NO: 919411 - RNA, 24 nt, Human
ugggaggcugaggcagcgggguca

SEQ ID NO: 919412 - RNA, 28 nt, Human
ugggcacacaacaaccacaguucauaca

SEQ ID NO: 919413 - RNA, 19 nt, Human
ugggguggagguguucggu

SEQ ID NO: 919414 - RNA, 24 nt, Human
ugguggcucaugccuguaaucuca

SEQ ID NO: 919415 - RNA, 21 nt, Human
ugucccccaaguguaaacacc

SEQ ID NO: 919416 - RNA, 21 nt, Human
ugugcaagucagccccagaca

SEQ ID NO: 919417 - RNA, 20 nt, Human
uucaagaccacuuaccccaa

SEQ ID NO: 919418 - RNA, 24 nt, Human
uucaagaccacuuaccccaaaucc

SEQ ID NO: 919419 - RNA, 21 nt, Human
uucagugagccaugacuguac

SEQ ID NO: 919420 - RNA, 28 nt, Human
uugaaacagcaaccuaaccccacgccaa

SEQ ID NO: 919421 - RNA, 22 nt, Human
uugagcccaggaguuuaagacc

SEQ ID NO: 919422 - RNA, 24 nt, Human
uuuaaaaaaaaaaaaaaaaagcau

SEQ ID NO: 919423 - RNA, 21 nt, Human
uuucaaaugaugaauuucuua

SEQ ID NO: 919424 - RNA, 22 nt, Human
aacaggugugggccacccuggg

SEQ ID NO: 919425 - RNA, 26 nt, Human
acuacagaagucccauggggcagacg

SEQ ID NO: 919426 - RNA, 19 nt, Human
agacgggagccacaggccc

SEQ ID NO: 919427 - RNA, 20 nt, Human
agagcacccccaaaggacag

SEQ ID NO: 919428 - RNA, 26 nt, Human
agccacaggcccagacuccacagccc

SEQ ID NO: 919429 - RNA, 22 nt, Human
caguagguccccgcccggaucu

SEQ ID NO: 919430 - RNA, 23 nt, Human
ccacaggcccagacuccacagcc

SEQ ID NO: 919431 - RNA, 23 nt, Human
cccaaaggacaguagguccccgc

SEQ ID NO: 919432 - RNA, 20 nt, Human
cccacagcacccgagggacc

SEQ ID NO: 919433 - RNA, 21 nt, Human
cccccaaaggacaguaggucc

SEQ ID NO: 919434 - RNA, 24 nt, Human
cccccaaaggacaguagguccccg

SEQ ID NO: 919435 - RNA, 21 nt, Human
cccuggggugagcugccuccc

SEQ ID NO: 919436 - RNA, 20 nt, Human
cguccagaccccaagugucc

SEQ ID NO: 919437 - RNA, 21 nt, Human
cucccgccgccguugcgucca

SEQ ID NO: 919438 - RNA, 31 nt, Human
cuggcccacagcacccgagggacccugcagg

SEQ ID NO: 919439 - RNA, 25 nt, Human
gaacaggugugggccacccuggggu

SEQ ID NO: 919440 - RNA, 20 nt, Human
ggcccagacuccacagcccc

SEQ ID NO: 919441 - RNA, 19 nt, Human
guagaagagcacccccaaa

SEQ ID NO: 919442 - RNA, 19 nt, Human
uagaagagcacccccaaag

SEQ ID NO: 919443 - RNA, 21 nt, Human
uagaagagcacccccaaagga

SEQ ID NO: 919444 - RNA, 20 nt, Human
uaggaacaggugugggccac

SEQ ID NO: 919445 - RNA, 21 nt, Human
ucccagaggccuggaaggacc

SEQ ID NO: 919446 - RNA, 24 nt, Human
ucccagaggccuggaaggaccucg

SEQ ID NO: 919447 - RNA, 22 nt, Human
ucccauggggcagacgggagcc

SEQ ID NO: 919448 - RNA, 22 nt, Human
ucccgccgccguugcguccaga

SEQ ID NO: 919449 - RNA, 23 nt, Human
ucccgccgccguugcguccagaa

SEQ ID NO: 919450 - RNA, 25 nt, Human
ucuuuccccucuaaacuguucuaga

SEQ ID NO: 919451 - RNA, 18 nt, Human
ugcuaggaacaggugugg

SEQ ID NO: 919452 - RNA, 19 nt, Human
aaacagaaaaugggggacc

SEQ ID NO: 919453 - RNA, 21 nt, Human
aaagccccaccuccaaauacc

SEQ ID NO: 919454 - RNA, 21 nt, Human
aaauaacuuuaaaaagaacau

SEQ ID NO: 919455 - RNA, 24 nt, Human
aaccacugagaaaguaggaaacag

SEQ ID NO: 919456 - RNA, 22 nt, Human
aauuucuuuucaaugaaaccac

SEQ ID NO: 919457 - RNA, 21 nt, Human
accacugagaaaguaggaaac

SEQ ID NO: 919458 - RNA, 20 nt, Human
agaaguccaagaucaaggug

SEQ ID NO: 919459 - RNA, 21 nt, Human
agccccaccuccaaauaccau

SEQ ID NO: 919460 - RNA, 21 nt, Human
aggcauguuccacucuccccc

SEQ ID NO: 919461 - RNA, 24 nt, Human
auaaauaacuuuaaaaagaacauu

SEQ ID NO: 919462 - RNA, 18 nt, Human
auuucucacaauucugga

SEQ ID NO: 919463 - RNA, 25 nt, Human
caacauuagaauucugggggcacac

SEQ ID NO: 919464 - RNA, 22 nt, Human
cacuaaucccauucaugagcgc

SEQ ID NO: 919465 - RNA, 21 nt, Human
cagauuuguuuucuggugagg

SEQ ID NO: 919466 - RNA, 19 nt, Human
ccaaaagccccaccuccaa

SEQ ID NO: 919467 - RNA, 19 nt, Human
ccagaaugucaaugcccau

SEQ ID NO: 919468 - RNA, 18 nt, Human
cccaccuccaaauaccau

SEQ ID NO: 919469 - RNA, 19 nt, Human
cccccagucauaccccaag

SEQ ID NO: 919470 - RNA, 24 nt, Human
cucacaauucuggaggcugagaag

SEQ ID NO: 919471 - RNA, 22 nt, Human
cucccccagucauaccccaagu

SEQ ID NO: 919472 - RNA, 19 nt, Human
cucucugggucucuuuaua

SEQ ID NO: 919473 - RNA, 24 nt, Human
cucuuugcuauuccugccuuuaac

SEQ ID NO: 919474 - RNA, 23 nt, Human
cugcgccugcuccggcccacuua

SEQ ID NO: 919475 - RNA, 22 nt, Human
cuuaccaaaagccccaccucca

SEQ ID NO: 919476 - RNA, 20 nt, Human
cuuuuagcacuuggcaacuc

SEQ ID NO: 919477 - RNA, 24 nt, Human
gccccaccuccaaauaccaucaca

SEQ ID NO: 919478 - RNA, 19 nt, Human
ggaggcugagaaguccaag

SEQ ID NO: 919479 - RNA, 22 nt, Human
ggccgaggggccuucuuccucg

SEQ ID NO: 919480 - RNA, 28 nt, Human
gggaaccaguggaggauagccgguaccc

SEQ ID NO: 919481 - RNA, 21 nt, Human
uaaaaaaaaacuuccaaugaa

SEQ ID NO: 919482 - RNA, 23 nt, Human
uaaguaacuucauuugcaaaaug

SEQ ID NO: 919483 - RNA, 19 nt, Human
uaccaucacauuggaaaug

SEQ ID NO: 919484 - RNA, 21 nt, Human
uagcagcaagucuacguccau

SEQ ID NO: 919485 - RNA, 20 nt, Human
uauaagggcacuaaucccau

SEQ ID NO: 919486 - RNA, 22 nt, Human
uaucauaguacuugguaaauac

SEQ ID NO: 919487 - RNA, 19 nt, Human
uaucugcucccuaaguaac

SEQ ID NO: 919488 - RNA, 23 nt, Human
uaucugcucccuaaguaacuuca

SEQ ID NO: 919489 - RNA, 21 nt, Human
uauugugcggaaaaggcaugu

SEQ ID NO: 919490 - RNA, 23 nt, Human
ucaaugcccaucggacgcacaag

SEQ ID NO: 919491 - RNA, 19 nt, Human
uccucgugucgcagccggu

SEQ ID NO: 919492 - RNA, 25 nt, Human
ucuacugcagacauuaaauaagaau

SEQ ID NO: 919493 - RNA, 21 nt, Human
ucuuauucuuguuuuccagaa

SEQ ID NO: 919494 - RNA, 21 nt, Human
ugaaaccacugagaaaguagg

SEQ ID NO: 919495 - RNA, 24 nt, Human
ugagaaguccaagaucaaggugcu

SEQ ID NO: 919496 - RNA, 18 nt, Human
ugaggacccacuuccugg

SEQ ID NO: 919497 - RNA, 22 nt, Human
ugaggacccacuuccugguucg

SEQ ID NO: 919498 - RNA, 22 nt, Human
ugccuuuaaccccuucuaauuu

SEQ ID NO: 919499 - RNA, 18 nt, Human
uggaggcugagaagucca

SEQ ID NO: 919500 - RNA, 22 nt, Human
ugggaaagcacugggaaaggaa

SEQ ID NO: 919501 - RNA, 18 nt, Human
ugggaaaggaacuccagg

SEQ ID NO: 919502 - RNA, 24 nt, Human
ugggggcacacaaacauucagucu

SEQ ID NO: 919503 - RNA, 21 nt, Human
uguacugaaaauauguccuug

SEQ ID NO: 919504 - RNA, 21 nt, Human
uguuccacucucccccaguca

SEQ ID NO: 919505 - RNA, 19 nt, Human
uguuugucuucucccuuuc

SEQ ID NO: 919506 - RNA, 25 nt, Human
uugaaguaaguaugguagcauaauc

SEQ ID NO: 919507 - RNA, 24 nt, Human
uuuaaaaagaacauuuuuauacuc

SEQ ID NO: 919508 - RNA, 21 nt, Human
uuucucacaauucuggaggcu

SEQ ID NO: 919509 - RNA, 23 nt, Human
acaaggcaagcacacacuagggc

SEQ ID NO: 919510 - RNA, 25 nt, Human
acaaggcaagcacacacuagggcag

SEQ ID NO: 919511 - RNA, 18 nt, Human
caacucauacugccagcu

SEQ ID NO: 919512 - RNA, 22 nt, Human
caacucauacugccagcuaagc

SEQ ID NO: 919513 - RNA, 20 nt, Human
cacaaguuuacaaguaacag

SEQ ID NO: 919514 - RNA, 21 nt, Human
cacacagaaaaacucccagac

SEQ ID NO: 919515 - RNA, 19 nt, Human
cacacuagggcagcugggc

SEQ ID NO: 919516 - RNA, 25 nt, Human
cagaaaaacucccagacauucauga

SEQ ID NO: 919517 - RNA, 20 nt, Human
cauacugccagcuaagcauc

SEQ ID NO: 919518 - RNA, 24 nt, Human
ccagacauucaugacuucauccac

SEQ ID NO: 919519 - RNA, 28 nt, Human
ccccacacagaaaaacucccagacauuc

SEQ ID NO: 919520 - RNA, 18 nt, Human
cccccuggcucuucaccu

SEQ ID NO: 919521 - RNA, 24 nt, Human
ccucaaaagguuuaucuuuccacc

SEQ ID NO: 919522 - RNA, 19 nt, Human
gacuucauccacccugccu

SEQ ID NO: 919523 - RNA, 22 nt, Human
gggcagcugggccauccuggcc

SEQ ID NO: 919524 - RNA, 20 nt, Human
gucucugucuccuccccaca

SEQ ID NO: 919525 - RNA, 18 nt, Human
uagcaaagacccucagga

SEQ ID NO: 919526 - RNA, 19 nt, Human
uaucuuuccaccacacuag

SEQ ID NO: 919527 - RNA, 19 nt, Human
uccaccacacuagcaaaga

SEQ ID NO: 919528 - RNA, 21 nt, Human
uccaccacacuagcaaagacc

SEQ ID NO: 919529 - RNA, 19 nt, Human
uccccacacagaaaaacuc

SEQ ID NO: 919530 - RNA, 22 nt, Human
uccccacacagaaaaacuccca

SEQ ID NO: 919531 - RNA, 21 nt, Human
ugacccccuggcucuucaccu

SEQ ID NO: 919532 - RNA, 21 nt, Human
uggcagauaggccauauuucc

SEQ ID NO: 919533 - RNA, 24 nt, Human
aaagugcugggauuacaggcguga

SEQ ID NO: 919534 - RNA, 25 nt, Human
aacaaaaaauaccaguaauuaaucu

SEQ ID NO: 919535 - RNA, 22 nt, Human
aaccaagaacaacaaugcuagc

SEQ ID NO: 919536 - RNA, 20 nt, Human
aacuccugaccucgugaucc

SEQ ID NO: 919537 - RNA, 24 nt, Human
aagcagcaucaccucuagagucca

SEQ ID NO: 919538 - RNA, 19 nt, Human
aagugcugggauuacaggc

SEQ ID NO: 919539 - RNA, 19 nt, Human
aagugcugggauuacaggc

SEQ ID NO: 919540 - RNA, 26 nt, Human
aagugcugggauuacaggcgugagcc

SEQ ID NO: 919541 - RNA, 24 nt, Human
aauuacaggcaucuaccaccaugc

SEQ ID NO: 919542 - RNA, 21 nt, Human
acaggcaucuaccaccaugcc

SEQ ID NO: 919543 - RNA, 21 nt, Human
accaagaacaacaaugcuagc

SEQ ID NO: 919544 - RNA, 21 nt, Human
agaagacaagccaagaucuau

SEQ ID NO: 919545 - RNA, 24 nt, Human
agcgauucuccugccucagccucc

SEQ ID NO: 919546 - RNA, 18 nt, Human
aggaaaaaagcuucuaau

SEQ ID NO: 919547 - RNA, 25 nt, Human
aggcuggagugcaguggcaugaucu

SEQ ID NO: 919548 - RNA, 21 nt, Human
aguagcuggaauuacaggcau

SEQ ID NO: 919549 - RNA, 20 nt, Human
agugcaguggcaugaucucg

SEQ ID NO: 919550 - RNA, 23 nt, Human
agugcaguggcaugaucucggcu

SEQ ID NO: 919551 - RNA, 24 nt, Human
agugcaguggcaugaucucggcuc

SEQ ID NO: 919552 - RNA, 18 nt, Human
agugcugggauuacaggc

SEQ ID NO: 919553 - RNA, 24 nt, Human
caaagugcugggauuacaggcgug

SEQ ID NO: 919554 - RNA, 23 nt, Human
caacuuacuucuagaauguauua

SEQ ID NO: 919555 - RNA, 22 nt, Human
caagcgauucuccugccucagc

SEQ ID NO: 919556 - RNA, 22 nt, Human
caccauauuguccagggcgguc

SEQ ID NO: 919557 - RNA, 19 nt, Human
cagccuccugaguagcugg

SEQ ID NO: 919558 - RNA, 19 nt, Human
caugcuucuugguagucuu

SEQ ID NO: 919559 - RNA, 19 nt, Human
cauugcccaggcuggagug

SEQ ID NO: 919560 - RNA, 20 nt, Human
ccaaagugcugggauuacag

SEQ ID NO: 919561 - RNA, 22 nt, Human
ccaaagugcugggauuacaggc

SEQ ID NO: 919562 - RNA, 22 nt, Human
ccaaagugcugggauuacaggc

SEQ ID NO: 919563 - RNA, 24 nt, Human
ccaaagugcugggauuacaggcgu

SEQ ID NO: 919564 - RNA, 19 nt, Human
cccaggcuggagugcagug

SEQ ID NO: 919565 - RNA, 23 nt, Human
cccaggcuggagugcaguggcau

SEQ ID NO: 919566 - RNA, 24 nt, Human
ccuccuggguucaagcgauucucc

SEQ ID NO: 919567 - RNA, 18 nt, Human
ccucgugauccacccucc

SEQ ID NO: 919568 - RNA, 21 nt, Human
ccucgugauccacccuccuca

SEQ ID NO: 919569 - RNA, 24 nt, Human
ccucucuccauugcccaggcugga

SEQ ID NO: 919570 - RNA, 20 nt, Human
ccugaaucucgcagugacgc

SEQ ID NO: 919571 - RNA, 23 nt, Human
ccugaguagcuggaauuacaggc

SEQ ID NO: 919572 - RNA, 23 nt, Human
ccugccucagccuccugaguagc

SEQ ID NO: 919573 - RNA, 24 nt, Human
ccugccucagccuccugaguagcu

SEQ ID NO: 919574 - RNA, 23 nt, Human
ccuggguucaagcgauucuccug

SEQ ID NO: 919575 - RNA, 24 nt, Human
cgugauccacccuccucagccuuc

SEQ ID NO: 919576 - RNA, 23 nt, Human
cucacacagagaggcaaacagcu

SEQ ID NO: 919577 - RNA, 18 nt, Human
cuccugaccucgugaucc

SEQ ID NO: 919578 - RNA, 21 nt, Human
cuccuggguucaagcgauucu

SEQ ID NO: 919579 - RNA, 19 nt, Human
cucuagaguccaacagaau

SEQ ID NO: 919580 - RNA, 24 nt, Human
cucuccauugcccaggcuggagug

SEQ ID NO: 919581 - RNA, 23 nt, Human
cucucuccauugcccaggcugga

SEQ ID NO: 919582 - RNA, 24 nt, Human
cugaguagcuggaauuacaggcau

SEQ ID NO: 919583 - RNA, 24 nt, Human
cuggagugcaguggcaugaucucg

SEQ ID NO: 919584 - RNA, 22 nt, Human
gaccucgugauccacccuccuc

SEQ ID NO: 919585 - RNA, 24 nt, Human
gaccucgugauccacccuccucag

SEQ ID NO: 919586 - RNA, 21 nt, Human
gagacagagccucucuccauu

SEQ ID NO: 919587 - RNA, 25 nt, Human
gaguagcuggaauuacaggcaucua

SEQ ID NO: 919588 - RNA, 18 nt, Human
gauuacaggcgugagcca

SEQ ID NO: 919589 - RNA, 21 nt, Human
gauuacaggcgugagccaccg

SEQ ID NO: 919590 - RNA, 24 nt, Human
gauuacaggcgugagccaccguac

SEQ ID NO: 919591 - RNA, 24 nt, Human
gcgauucuccugccucagccuccu

SEQ ID NO: 919592 - RNA, 23 nt, Human
ggcggucuccaacuccugaccuc

SEQ ID NO: 919593 - RNA, 18 nt, Human
guacaaugcugagaaccu

SEQ ID NO: 919594 - RNA, 18 nt, Human
gucuauuuaauuuucuuu

SEQ ID NO: 919595 - RNA, 24 nt, Human
gugauccacccuccucagccuucc

SEQ ID NO: 919596 - RNA, 27 nt, Human
uaauuuuucugugcguuuuuaguagag

SEQ ID NO: 919597 - RNA, 28 nt, Human
uaauuuuucugugcguuuuuaguagaga

SEQ ID NO: 919598 - RNA, 25 nt, Human
uacaaugcugagaaccugggucacc

SEQ ID NO: 919599 - RNA, 22 nt, Human
uacaggcgugagccaccguacc

SEQ ID NO: 919600 - RNA, 22 nt, Human
uacaggcgugagccaccguacc

SEQ ID NO: 919601 - RNA, 23 nt, Human
uacaggcgugagccaccguaccu

SEQ ID NO: 919602 - RNA, 22 nt, Human
uaccaccaugccuggcuaauuu

SEQ ID NO: 919603 - RNA, 21 nt, Human
uagauguauccagauagaaca

SEQ ID NO: 919604 - RNA, 24 nt, Human
uagggcuucaccauauuguccagg

SEQ ID NO: 919605 - RNA, 26 nt, Human
uaguagagauagggcuucaccauauu

SEQ ID NO: 919606 - RNA, 21 nt, Human
uaugaaguuuaguauuuuugu

SEQ ID NO: 919607 - RNA, 18 nt, Human
uaugccaaaagugaagau

SEQ ID NO: 919608 - RNA, 19 nt, Human
ucaagcgauucuccugccu

SEQ ID NO: 919609 - RNA, 24 nt, Human
ucacggcaaucuucgccuccuggg

SEQ ID NO: 919610 - RNA, 25 nt, Human
ucacggcaaucuucgccuccugggu

SEQ ID NO: 919611 - RNA, 22 nt, Human
ucagccuccugaguagcuggaa

SEQ ID NO: 919612 - RNA, 23 nt, Human
uccaaagugcugggauuacaggc

SEQ ID NO: 919613 - RNA, 24 nt, Human
uccaaagugcugggauuacaggcg

SEQ ID NO: 919614 - RNA, 21 nt, Human
uccacccuccucagccuucca

SEQ ID NO: 919615 - RNA, 24 nt, Human
uccauugcccaggcuggagugcag

SEQ ID NO: 919616 - RNA, 28 nt, Human
ucccuugccauaugccaaaagugaagau

SEQ ID NO: 919617 - RNA, 21 nt, Human
uccucagccuuccaaagugcu

SEQ ID NO: 919618 - RNA, 24 nt, Human
uccugaguagcuggaauuacaggc

SEQ ID NO: 919619 - RNA, 21 nt, Human
uccuggguucaagcgauucuc

SEQ ID NO: 919620 - RNA, 24 nt, Human
uccuggguucaagcgauucuccug

SEQ ID NO: 919621 - RNA, 22 nt, Human
uccuuaaaauaaacaaaaaaua

SEQ ID NO: 919622 - RNA, 21 nt, Human
ucuauuugaaaagggccauaa

SEQ ID NO: 919623 - RNA, 28 nt, Human
ucuccaacuccugaccucgugauccacc

SEQ ID NO: 919624 - RNA, 25 nt, Human
ucuccauugcccaggcuggagugca

SEQ ID NO: 919625 - RNA, 24 nt, Human
ucuccugccucagccuccugagua

SEQ ID NO: 919626 - RNA, 21 nt, Human
ucucuccauugcccaggcugg

SEQ ID NO: 919627 - RNA, 21 nt, Human
ucucuccauugcccaggcugg

SEQ ID NO: 919628 - RNA, 22 nt, Human
ucucuccauugcccaggcugga

SEQ ID NO: 919629 - RNA, 24 nt, Human
ucucuccauugcccaggcuggagu

SEQ ID NO: 919630 - RNA, 23 nt, Human
ucugugcguuuuuaguagagaua

SEQ ID NO: 919631 - RNA, 29 nt, Human
ugaaaccaagaacaacaaugcuagcaaac

SEQ ID NO: 919632 - RNA, 21 nt, Human
ugagaaccugggucaccuaau

SEQ ID NO: 919633 - RNA, 22 nt, Human
ugagcaaaguaaaaaauaaugu

SEQ ID NO: 919634 - RNA, 18 nt, Human
ugcccaggcuggagugca

SEQ ID NO: 919635 - RNA, 22 nt, Human
ugcccaggcuggagugcagugg

SEQ ID NO: 919636 - RNA, 24 nt, Human
ugcccaggcuggagugcaguggca

SEQ ID NO: 919637 - RNA, 24 nt, Human
ugccucagccuccugaguagcugg

SEQ ID NO: 919638 - RNA, 24 nt, Human
ugcugggauuacaggcgugagcca

SEQ ID NO: 919639 - RNA, 19 nt, Human
uggaauuacaggcaucuac

SEQ ID NO: 919640 - RNA, 21 nt, Human
uggaauuacaggcaucuacca

SEQ ID NO: 919641 - RNA, 24 nt, Human
uggaauuacaggcaucuaccacca

SEQ ID NO: 919642 - RNA, 19 nt, Human
uggagugcaguggcaugau

SEQ ID NO: 919643 - RNA, 24 nt, Human
uggagugcaguggcaugaucucgg

SEQ ID NO: 919644 - RNA, 22 nt, Human
ugggauauuuauuaaaaaguau

SEQ ID NO: 919645 - RNA, 18 nt, Human
ugggauuacaggcgugag

SEQ ID NO: 919646 - RNA, 21 nt, Human
ugggauuacaggcgugagcca

SEQ ID NO: 919647 - RNA, 22 nt, Human
ugggauuacaggcgugagccac

SEQ ID NO: 919648 - RNA, 23 nt, Human
ugggauuacaggcgugagccacc

SEQ ID NO: 919649 - RNA, 23 nt, Human
ugggauuacaggcgugagccacc

SEQ ID NO: 919650 - RNA, 24 nt, Human
ugggauuacaggcgugagccaccg

SEQ ID NO: 919651 - RNA, 19 nt, Human
ugggucaccuaaugaaauu

SEQ ID NO: 919652 - RNA, 23 nt, Human
uggguucaagcgauucuccugcc

SEQ ID NO: 919653 - RNA, 19 nt, Human
uuagaagacaagccaagau

SEQ ID NO: 919654 - RNA, 23 nt, Human
uuagaagacaguuuagcaaccag

SEQ ID NO: 919655 - RNA, 18 nt, Human
uuaguagagauagggcuu

SEQ ID NO: 919656 - RNA, 24 nt, Human
uuaguagagauagggcuucaccau

SEQ ID NO: 919657 - RNA, 21 nt, Human
uucaagcgauucuccugccuc

SEQ ID NO: 919658 - RNA, 23 nt, Human
uucaagcgauucuccugccucag

SEQ ID NO: 919659 - RNA, 24 nt, Human
uucaagcgauucuccugccucagc

SEQ ID NO: 919660 - RNA, 24 nt, Human
uugcccaggcuggagugcaguggc

SEQ ID NO: 919661 - RNA, 24 nt, Human
uuuuuaguagagauagggcuucac

SEQ ID NO: 919662 - RNA, 18 nt, Human
aagacaaaggcauggagc

SEQ ID NO: 919663 - RNA, 18 nt, Human
aagcgggcucaggcagac

SEQ ID NO: 919664 - RNA, 18 nt, Human
acacagagccgcgcccgg

SEQ ID NO: 919665 - RNA, 20 nt, Human
acucagccacgucucagugg

SEQ ID NO: 919666 - RNA, 21 nt, Human
agacaaaggcauggagcugua

SEQ ID NO: 919667 - RNA, 19 nt, Human
aggaagauuucacucagcc

SEQ ID NO: 919668 - RNA, 24 nt, Human
aggcagacgccccgcguuucuccg

SEQ ID NO: 919669 - RNA, 24 nt, Human
auggagcuguauggaugacacacc

SEQ ID NO: 919670 - RNA, 19 nt, Human
auuucacucagccacgucu

SEQ ID NO: 919671 - RNA, 21 nt, Human
caagacccuucaaccucgucc

SEQ ID NO: 919672 - RNA, 20 nt, Human
cacagcacggugccaagggc

SEQ ID NO: 919673 - RNA, 18 nt, Human
caccacccaccgcccugc

SEQ ID NO: 919674 - RNA, 23 nt, Human
cagagagcuuuucaaugagaccc

SEQ ID NO: 919675 - RNA, 22 nt, Human
cagaucaaacuccacccugcag

SEQ ID NO: 919676 - RNA, 18 nt, Human
cagcccuggcucgugguu

SEQ ID NO: 919677 - RNA, 23 nt, Human
caucagagagcuuuucaaugaga

SEQ ID NO: 919678 - RNA, 21 nt, Human
caugcaagccccagcccuggc

SEQ ID NO: 919679 - RNA, 24 nt, Human
cccuccaacacugagcugucccgg

SEQ ID NO: 919680 - RNA, 19 nt, Human
ccgacgguugggggugagg

SEQ ID NO: 919681 - RNA, 21 nt, Human
ccucccagcgugggcccaccc

SEQ ID NO: 919682 - RNA, 22 nt, Human
ccugcucaacguucgauucacc

SEQ ID NO: 919683 - RNA, 18 nt, Human
ccuucaaccucgucccga

SEQ ID NO: 919684 - RNA, 22 nt, Human
ccuucaaccucgucccgacccc

SEQ ID NO: 919685 - RNA, 20 nt, Human
cgcucggcacuccacaccac

SEQ ID NO: 919686 - RNA, 22 nt, Human
cucagcccagcccguguccucc

SEQ ID NO: 919687 - RNA, 20 nt, Human
cuccacaccacccaccgccc

SEQ ID NO: 919688 - RNA, 24 nt, Human
cugccagaucaaacuccacccugc

SEQ ID NO: 919689 - RNA, 24 nt, Human
cuucaaccucgucccgaccccagc

SEQ ID NO: 919690 - RNA, 20 nt, Human
gacaaugacaugcaagcccc

SEQ ID NO: 919691 - RNA, 19 nt, Human
gacacaccuugaccacuga

SEQ ID NO: 919692 - RNA, 22 nt, Human
gacgguugggggugaggccgcu

SEQ ID NO: 919693 - RNA, 24 nt, Human
gccgggacuugcucagguugcugg

SEQ ID NO: 919694 - RNA, 25 nt, Human
gcgggcucaggcagacgccccgcgu

SEQ ID NO: 919695 - RNA, 19 nt, Human
gcucccggcaacgccucgg

SEQ ID NO: 919696 - RNA, 18 nt, Human
gcuggccucugaaauacu

SEQ ID NO: 919697 - RNA, 25 nt, Human
ggccgggacuugcucagguugcugg

SEQ ID NO: 919698 - RNA, 24 nt, Human
gggcagggccgggacuugcucagg

SEQ ID NO: 919699 - RNA, 19 nt, Human
gguugggggugaggccgcu

SEQ ID NO: 919700 - RNA, 22 nt, Human
uagaggcccugcucagcccagc

SEQ ID NO: 919701 - RNA, 20 nt, Human
ucaaugagacccccaaugug

SEQ ID NO: 919702 - RNA, 19 nt, Human
ucaucagagagcuuuucaa

SEQ ID NO: 919703 - RNA, 21 nt, Human
uccacacagcacggugccaag

SEQ ID NO: 919704 - RNA, 23 nt, Human
uccacacagcacggugccaaggg

SEQ ID NO: 919705 - RNA, 25 nt, Human
uccacccugcagcaauuagcaagga

SEQ ID NO: 919706 - RNA, 19 nt, Human
ucguugucgaugacuccua

SEQ ID NO: 919707 - RNA, 21 nt, Human
ucuccgaguccacacagagcc

SEQ ID NO: 919708 - RNA, 20 nt, Human
ucuuaguucaggggugaaga

SEQ ID NO: 919709 - RNA, 19 nt, Human
ugaaauacucccugugucu

SEQ ID NO: 919710 - RNA, 21 nt, Human
ugacacaccuugaccacugac

SEQ ID NO: 919711 - RNA, 21 nt, Human
ugacaugcaagccccagcccu

SEQ ID NO: 919712 - RNA, 22 nt, Human
ugccaagggcagucuugacgcu

SEQ ID NO: 919713 - RNA, 23 nt, Human
ugccaagggcagucuugacgcug

SEQ ID NO: 919714 - RNA, 18 nt, Human
ugccgggcucgcugaggg

SEQ ID NO: 919715 - RNA, 20 nt, Human
ugcucagguugcuggguguu

SEQ ID NO: 919716 - RNA, 19 nt, Human
uggccucugaaauacuccc

SEQ ID NO: 919717 - RNA, 21 nt, Human
uggcucgugguucagguggcc

SEQ ID NO: 919718 - RNA, 20 nt, Human
ugucccgggacgccugccgg

SEQ ID NO: 919719 - RNA, 19 nt, Human
uucuccgaguccacacaga

SEQ ID NO: 919720 - RNA, 26 nt, Human
uugcuggguguucaugaaggaggauc

SEQ ID NO: 919721 - RNA, 24 nt, Human
acccacucccacccucuggcaccc

SEQ ID NO: 919722 - RNA, 24 nt, Human
acugcuucccagcuggcucuccug

SEQ ID NO: 919723 - RNA, 18 nt, Human
aggaggcggccggacgcg

SEQ ID NO: 919724 - RNA, 22 nt, Human
agggcagcucgggguaccccgg

SEQ ID NO: 919725 - RNA, 25 nt, Human
augcuggguuccauuccagcugcac

SEQ ID NO: 919726 - RNA, 24 nt, Human
caagagggcagcucgggguacccc

SEQ ID NO: 919727 - RNA, 29 nt, Human
cacauacacacacgcgcacccacucccaa

SEQ ID NO: 919728 - RNA, 21 nt, Human
cacucagcuguccaguuacac

SEQ ID NO: 919729 - RNA, 19 nt, Human
cagcggagcgcggggcccc

SEQ ID NO: 919730 - RNA, 23 nt, Human
cagcuggcucuccugggaaguuc

SEQ ID NO: 919731 - RNA, 21 nt, Human
cagcuuccucauggccggaug

SEQ ID NO: 919732 - RNA, 22 nt, Human
ccacucccacccucuggcaccc

SEQ ID NO: 919733 - RNA, 23 nt, Human
ccucacauacacacacgcgcacc

SEQ ID NO: 919734 - RNA, 28 nt, Human
ccucauggccggaugguccaguacugcu

SEQ ID NO: 919735 - RNA, 22 nt, Human
ccucugggucgcccuccggccc

SEQ ID NO: 919736 - RNA, 23 nt, Human
cggcccgggccgcuaggaggcgg

SEQ ID NO: 919737 - RNA, 26 nt, Human
cggggcgggcagcguggucgcggccc

SEQ ID NO: 919738 - RNA, 18 nt, Human
cuccaaugcuggguucca

SEQ ID NO: 919739 - RNA, 18 nt, Human
cucccacccucuggcacc

SEQ ID NO: 919740 - RNA, 21 nt, Human
gcacccacucccacccucugg

SEQ ID NO: 919741 - RNA, 23 nt, Human
gcggagcgcggggccccgggcuc

SEQ ID NO: 919742 - RNA, 19 nt, Human
ggccggaugguccaguacu

SEQ ID NO: 919743 - RNA, 21 nt, Human
gggcagcguggucgcggcccg

SEQ ID NO: 919744 - RNA, 24 nt, Human
gggcagcguggucgcggcccgggc

SEQ ID NO: 919745 - RNA, 18 nt, Human
gggcucggggcggggcgg

SEQ ID NO: 919746 - RNA, 21 nt, Human
ggggcggggcgggcagcgugg

SEQ ID NO: 919747 - RNA, 25 nt, Human
ggggcggggcgggcagcguggucgc

SEQ ID NO: 919748 - RNA, 19 nt, Human
ggucuguauuccacaggga

SEQ ID NO: 919749 - RNA, 22 nt, Human
uacacacacgcgcacccacucc

SEQ ID NO: 919750 - RNA, 20 nt, Human
uacacggucuguauuccacc

SEQ ID NO: 919751 - RNA, 20 nt, Human
uaccaaaaaauauuacuaua

SEQ ID NO: 919752 - RNA, 19 nt, Human
uagaguuuaugacacucag

SEQ ID NO: 919753 - RNA, 18 nt, Human
uaugacacucagcugucc

SEQ ID NO: 919754 - RNA, 19 nt, Human
uaugacacucagcugucca

SEQ ID NO: 919755 - RNA, 29 nt, Human
uauuuuagaguuuaugacacucagcuggu

SEQ ID NO: 919756 - RNA, 20 nt, Human
ucacugcagcggagcgcggu

SEQ ID NO: 919757 - RNA, 23 nt, Human
ucccacccucuggcacccauccu

SEQ ID NO: 919758 - RNA, 22 nt, Human
uccugggaaguuccuggaccca

SEQ ID NO: 919759 - RNA, 19 nt, Human
ucuggcacccauccucccc

SEQ ID NO: 919760 - RNA, 24 nt, Human
ugaccagccgccccgccaaggagu

SEQ ID NO: 919761 - RNA, 24 nt, Human
ugcuggguuccauuccagcugcac

SEQ ID NO: 919762 - RNA, 22 nt, Human
uggacggaaugcggcucucucc

SEQ ID NO: 919763 - RNA, 24 nt, Human
ugugcacgagggagcagcccaaga

SEQ ID NO: 919764 - RNA, 23 nt, Human
aacaagugggccugaagccugag

SEQ ID NO: 919765 - RNA, 23 nt, Human
acuccauuucaaguggguaaugu

SEQ ID NO: 919766 - RNA, 22 nt, Human
agccugagcaguguagccagcu

SEQ ID NO: 919767 - RNA, 19 nt, Human
gccagcuguguggggagca

SEQ ID NO: 919768 - RNA, 23 nt, Human
uggaagaugcuguugcuacccag

SEQ ID NO: 919769 - RNA, 22 nt, Human
uuuuuuuuuuuuuugccacgga

SEQ ID NO: 919770 - RNA, 23 nt, Human
uuuuuuuuuuuuuuuugccacgg

SEQ ID NO: 919771 - RNA, 21 nt, Human
aaaaaggugagggggcagggg

SEQ ID NO: 919772 - RNA, 18 nt, Human
aaacagauugaugcagac

SEQ ID NO: 919773 - RNA, 26 nt, Human
aaagcaguuuuauuccugagaugagg

SEQ ID NO: 919774 - RNA, 22 nt, Human
aacucccaaauaacuacagccc

SEQ ID NO: 919775 - RNA, 23 nt, Human
aacuugaaagcuuccacuagugg

SEQ ID NO: 919776 - RNA, 22 nt, Human
aagaaaugacuucaaaaucaag

SEQ ID NO: 919777 - RNA, 24 nt, Human
aagggcacaggauuugaacugaag

SEQ ID NO: 919778 - RNA, 25 nt, Human
aaguacacaucuagaaagugaacaa

SEQ ID NO: 919779 - RNA, 21 nt, Human
acagauaugagugaggaccau

SEQ ID NO: 919780 - RNA, 20 nt, Human
acauugacauuguugccauu

SEQ ID NO: 919781 - RNA, 22 nt, Human
acccuuguuagugagcacucca

SEQ ID NO: 919782 - RNA, 19 nt, Human
acugaacuuggccaugcau

SEQ ID NO: 919783 - RNA, 19 nt, Human
acugcauugagauuucaac

SEQ ID NO: 919784 - RNA, 23 nt, Human
agaacacugcauuucacaaagca

SEQ ID NO: 919785 - RNA, 19 nt, Human
agacaauacuuucagccuc

SEQ ID NO: 919786 - RNA, 20 nt, Human
agauaaauuaggcacaucag

SEQ ID NO: 919787 - RNA, 18 nt, Human
agcagcaaauaagggcac

SEQ ID NO: 919788 - RNA, 18 nt, Human
aggugagggggcaggggg

SEQ ID NO: 919789 - RNA, 19 nt, Human
aucuggauuaucuaauuca

SEQ ID NO: 919790 - RNA, 18 nt, Human
augacacuuuuacacuga

SEQ ID NO: 919791 - RNA, 20 nt, Human
auuccaccaaaagcaccaua

SEQ ID NO: 919792 - RNA, 24 nt, Human
caacaugcuucuaacuaacuugaa

SEQ ID NO: 919793 - RNA, 24 nt, Human
caagcagcaaauaagggcacagga

SEQ ID NO: 919794 - RNA, 26 nt, Human
caagugaaacugccaauacuucuuuu

SEQ ID NO: 919795 - RNA, 24 nt, Human
cacaguguuucaacaguggagugu

SEQ ID NO: 919796 - RNA, 22 nt, Human
cacauaauucacagacuauacc

SEQ ID NO: 919797 - RNA, 24 nt, Human
caccauaacagguuaugaaacucc

SEQ ID NO: 919798 - RNA, 19 nt, Human
cacugcauuucacaaagca

SEQ ID NO: 919799 - RNA, 20 nt, Human
cacugcuguguagucggacc

SEQ ID NO: 919800 - RNA, 25 nt, Human
cacuguacuuugaguuuccuagaga

SEQ ID NO: 919801 - RNA, 22 nt, Human
cacuguauauccugacugaaau

SEQ ID NO: 919802 - RNA, 18 nt, Human
cagaauagaagagugggc

SEQ ID NO: 919803 - RNA, 21 nt, Human
caguggagugugguugucaug

SEQ ID NO: 919804 - RNA, 22 nt, Human
caugaaaaugcaguauugacac

SEQ ID NO: 919805 - RNA, 22 nt, Human
cauguuaaauugaaaaagggau

SEQ ID NO: 919806 - RNA, 21 nt, Human
cauuguuaucaguuaaaaucc

SEQ ID NO: 919807 - RNA, 18 nt, Human
cauuguugccauuguccu

SEQ ID NO: 919808 - RNA, 18 nt, Human
ccagccauuuuuuucccc

SEQ ID NO: 919809 - RNA, 21 nt, Human
cccauaggcauuggccaggcu

SEQ ID NO: 919810 - RNA, 19 nt, Human
cccuuuacccucuuuauuc

SEQ ID NO: 919811 - RNA, 22 nt, Human
ccuccuucauuccaauuacuuc

SEQ ID NO: 919812 - RNA, 19 nt, Human
cgggaaagggguuggggga

SEQ ID NO: 919813 - RNA, 21 nt, Human
cuauaguguauuuguaccuga

SEQ ID NO: 919814 - RNA, 22 nt, Human
cuauaguuggggccauguugac

SEQ ID NO: 919815 - RNA, 20 nt, Human
cucaugccccagggcagacc

SEQ ID NO: 919816 - RNA, 21 nt, Human
cugaacuuggccaugcaucaa

SEQ ID NO: 919817 - RNA, 23 nt, Human
cuguaaacacugaacuuggccau

SEQ ID NO: 919818 - RNA, 21 nt, Human
gaaagggguugggggaagccc

SEQ ID NO: 919819 - RNA, 18 nt, Human
gaacugaagggaacuacu

SEQ ID NO: 919820 - RNA, 19 nt, Human
gaacuuucaccaccacuaa

SEQ ID NO: 919821 - RNA, 24 nt, Human
gcagaccauguuaaauugaaaaag

SEQ ID NO: 919822 - RNA, 19 nt, Human
gcagcaaauaagggcacag

SEQ ID NO: 919823 - RNA, 20 nt, Human
gcaugagaaaugaguuaaca

SEQ ID NO: 919824 - RNA, 18 nt, Human
gcugcuucacugaaugaa

SEQ ID NO: 919825 - RNA, 18 nt, Human
ggcacuauaguuggggcc

SEQ ID NO: 919826 - RNA, 20 nt, Human
ggccacccauaggcauuggc

SEQ ID NO: 919827 - RNA, 19 nt, Human
guacuauccuauaaacaca

SEQ ID NO: 919828 - RNA, 22 nt, Human
gucugaacuaaaaaaagacaaa

SEQ ID NO: 919829 - RNA, 20 nt, Human
gugagggggcaggggguucc

SEQ ID NO: 919830 - RNA, 22 nt, Human
guggcguuaagagagaacacug

SEQ ID NO: 919831 - RNA, 18 nt, Human
uaaaauccauauggcuuu

SEQ ID NO: 919832 - RNA, 24 nt, Human
uaaauaauaaaaauuccaccaaaa

SEQ ID NO: 919833 - RNA, 18 nt, Human
uaacuugaaagcuuccac

SEQ ID NO: 919834 - RNA, 25 nt, Human
uaacuugaaagcuuccacuagugag

SEQ ID NO: 919835 - RNA, 18 nt, Human
uaauggcaugagaaauga

SEQ ID NO: 919836 - RNA, 20 nt, Human
uacaacuaaacagaccuggc

SEQ ID NO: 919837 - RNA, 20 nt, Human
uacaaugauguaucuggauu

SEQ ID NO: 919838 - RNA, 24 nt, Human
uacacaucuagaaagugaacaaag

SEQ ID NO: 919839 - RNA, 22 nt, Human
uacaccuuaccugaaugaacac

SEQ ID NO: 919840 - RNA, 20 nt, Human
uaccacuauaaaugugguca

SEQ ID NO: 919841 - RNA, 19 nt, Human
uaccuugggggaaauaauu

SEQ ID NO: 919842 - RNA, 22 nt, Human
uacuuucagccuccuucauucc

SEQ ID NO: 919843 - RNA, 23 nt, Human
uagauuaaaaccaguugacagcc

SEQ ID NO: 919844 - RNA, 24 nt, Human
uagcaaaaagcagacaguuucaaa

SEQ ID NO: 919845 - RNA, 21 nt, Human
uagcaucauagauuaaaacca

SEQ ID NO: 919846 - RNA, 19 nt, Human
uagggcuccggcaagggcg

SEQ ID NO: 919847 - RNA, 20 nt, Human
uauccugacugaaauaacua

SEQ ID NO: 919848 - RNA, 22 nt, Human
uaugaaggaucacucaugacua

SEQ ID NO: 919849 - RNA, 22 nt, Human
uaugacacuuuuacacugauuu

SEQ ID NO: 919850 - RNA, 19 nt, Human
uauugcuuacgucagcaag

SEQ ID NO: 919851 - RNA, 21 nt, Human
ucacagacgugagaagaagaa

SEQ ID NO: 919852 - RNA, 18 nt, Human
ucagaccaauaaccacua

SEQ ID NO: 919853 - RNA, 18 nt, Human
ucaguuggugaccugaag

SEQ ID NO: 919854 - RNA, 19 nt, Human
ucccaaauaacuacagccc

SEQ ID NO: 919855 - RNA, 18 nt, Human
uccuucauuccaauuacu

SEQ ID NO: 919856 - RNA, 23 nt, Human
ucuagaaagugaacaaaggaaac

SEQ ID NO: 919857 - RNA, 22 nt, Human
ucucaguggccucugggcucac

SEQ ID NO: 919858 - RNA, 21 nt, Human
ucucugcagucugaagcuaca

SEQ ID NO: 919859 - RNA, 18 nt, Human
ucugaacuaaaaaaagac

SEQ ID NO: 919860 - RNA, 24 nt, Human
ucuguaaacacugaacuuggccau

SEQ ID NO: 919861 - RNA, 24 nt, Human
ucuguuaugggccuggggaacgug

SEQ ID NO: 919862 - RNA, 23 nt, Human
ugaaaaugcaguauugacacuau

SEQ ID NO: 919863 - RNA, 24 nt, Human
ugaaacugcagaaauagcaaaaag

SEQ ID NO: 919864 - RNA, 19 nt, Human
ugaaauaacuaacuugaaa

SEQ ID NO: 919865 - RNA, 21 nt, Human
ugaaaugaaaagcacacgucc

SEQ ID NO: 919866 - RNA, 18 nt, Human
ugacaacaugcuucuaac

SEQ ID NO: 919867 - RNA, 18 nt, Human
ugacacugcaccugaugg

SEQ ID NO: 919868 - RNA, 24 nt, Human
ugacagcggucuccuaaaaugcua

SEQ ID NO: 919869 - RNA, 21 nt, Human
ugacuucaguuggugacccca

SEQ ID NO: 919870 - RNA, 18 nt, Human
ugagauuucaacacugua

SEQ ID NO: 919871 - RNA, 19 nt, Human
ugagggggcaggggguucc

SEQ ID NO: 919872 - RNA, 19 nt, Human
ugaguguagaacuuucacc

SEQ ID NO: 919873 - RNA, 18 nt, Human
ugccccagggcagaccgg

SEQ ID NO: 919874 - RNA, 22 nt, Human
uggcaugagaaaugaguuaaca

SEQ ID NO: 919875 - RNA, 18 nt, Human
uggccaggcuggucugcu

SEQ ID NO: 919876 - RNA, 29 nt, Human
uggccaggcuggucugcuguugacuaggg

SEQ ID NO: 919877 - RNA, 30 nt, Human
uggccaggcuggucugcuguugacuagggg

SEQ ID NO: 919878 - RNA, 19 nt, Human
uggccucugggcucacuuu

SEQ ID NO: 919879 - RNA, 19 nt, Human
uggggaacguguacuaucc

SEQ ID NO: 919880 - RNA, 19 nt, Human
ugggggaagcccaggaagg

SEQ ID NO: 919881 - RNA, 21 nt, Human
ugggggaagcccaggaagggu

SEQ ID NO: 919882 - RNA, 19 nt, Human
uggucugcuguugacuagg

SEQ ID NO: 919883 - RNA, 26 nt, Human
uggugggaaggggguugaccggaacg

SEQ ID NO: 919884 - RNA, 26 nt, Human
uggugggaaggggguugaccggaacg

SEQ ID NO: 919885 - RNA, 26 nt, Human
ugucaguaaucugcauucucaguggc

SEQ ID NO: 919886 - RNA, 21 nt, Human
ugugaacaaaugaauaguugc

SEQ ID NO: 919887 - RNA, 22 nt, Human
uuaucaaggauuugauggggaa

SEQ ID NO: 919888 - RNA, 18 nt, Human
uucaaaaucaagagaaaa

SEQ ID NO: 919889 - RNA, 20 nt, Human
uucaaaggugaaaaaaauuu

SEQ ID NO: 919890 - RNA, 19 nt, Human
uucaacaguggaguguggu

SEQ ID NO: 919891 - RNA, 20 nt, Human
uucaacaguggagugugguu

SEQ ID NO: 919892 - RNA, 23 nt, Human
uucauuguuaucaguuaaaaucc

SEQ ID NO: 919893 - RNA, 20 nt, Human
uucccuuuacccucuuuauu

SEQ ID NO: 919894 - RNA, 22 nt, Human
uucccuuuacccucuuuauucu

SEQ ID NO: 919895 - RNA, 19 nt, Human
uugaacugaagggaacuac

SEQ ID NO: 919896 - RNA, 24 nt, Human
uuucuaauuauuacaauaaauagu

SEQ ID NO: 919897 - RNA, 22 nt, Human
aaggaaaagaucugggaaugaa

SEQ ID NO: 919898 - RNA, 21 nt, Human
aaggagcccaagccagagggc

SEQ ID NO: 919899 - RNA, 20 nt, Human
acacccuggggcugcccuuc

SEQ ID NO: 919900 - RNA, 25 nt, Human
accccagccugaagagugaugccau

SEQ ID NO: 919901 - RNA, 21 nt, Human
augaagcccuguggccaggaa

SEQ ID NO: 919902 - RNA, 23 nt, Human
caacuucugggccuccaggcacu

SEQ ID NO: 919903 - RNA, 21 nt, Human
cacacccuggggcugcccuuc

SEQ ID NO: 919904 - RNA, 25 nt, Human
caccccagccugaagagugaugcca

SEQ ID NO: 919905 - RNA, 21 nt, Human
caggccccagccagaaaaagg

SEQ ID NO: 919906 - RNA, 18 nt, Human
cauguccaaucucccaca

SEQ ID NO: 919907 - RNA, 24 nt, Human
ccccagccugaagagugaugccau

SEQ ID NO: 919908 - RNA, 21 nt, Human
ccuccaggcacucuucccacc

SEQ ID NO: 919909 - RNA, 26 nt, Human
ccuguggccaggaagauagacagggc

SEQ ID NO: 919910 - RNA, 22 nt, Human
cgcaacaucauuggcccagggg

SEQ ID NO: 919911 - RNA, 19 nt, Human
gaaggaaaagaucugggaa

SEQ ID NO: 919912 - RNA, 22 nt, Human
gcagcaacuucugggccuccag

SEQ ID NO: 919913 - RNA, 20 nt, Human
gcccaagccagagggcaagu

SEQ ID NO: 919914 - RNA, 18 nt, Human
gcccgggccgcgcgggga

SEQ ID NO: 919915 - RNA, 22 nt, Human
gcccgggccgcgcggggaccuc

SEQ ID NO: 919916 - RNA, 23 nt, Human
gggagcacaccccagccugaaga

SEQ ID NO: 919917 - RNA, 19 nt, Human
gggaguccgagaagagcug

SEQ ID NO: 919918 - RNA, 22 nt, Human
gggcuccccauuauccccaccc

SEQ ID NO: 919919 - RNA, 19 nt, Human
ggugggugggugaggguag

SEQ ID NO: 919920 - RNA, 20 nt, Human
gucuuucuugauagccaagu

SEQ ID NO: 919921 - RNA, 22 nt, Human
ucccaccauagcaaugugggca

SEQ ID NO: 919922 - RNA, 20 nt, Human
ucccaguccccuucucugca

SEQ ID NO: 919923 - RNA, 21 nt, Human
uccccaccccuuuggucccag

SEQ ID NO: 919924 - RNA, 23 nt, Human
ugaagagugaugccauuggccag

SEQ ID NO: 919925 - RNA, 19 nt, Human
ugcaaugggcacgcauaga

SEQ ID NO: 919926 - RNA, 22 nt, Human
uggaaggaaaagaucugggaau

SEQ ID NO: 919927 - RNA, 23 nt, Human
ugggcaaaacuggugucaggccc

SEQ ID NO: 919928 - RNA, 25 nt, Human
ugggcaaaacuggugucaggcccca

SEQ ID NO: 919929 - RNA, 19 nt, Human
ugucauagccguuggcugu

SEQ ID NO: 919930 - RNA, 21 nt, Human
uucccaaugucuuucuugaua

SEQ ID NO: 919931 - RNA, 20 nt, Human
uuuucaggcucugucauugg

SEQ ID NO: 919932 - RNA, 22 nt, Human
aaaaaaccuacauucaaaguac

SEQ ID NO: 919933 - RNA, 25 nt, Human
aaaaauaugugcuccuuaaugcucc

SEQ ID NO: 919934 - RNA, 20 nt, Human
aaaaaugucauuuccccaaa

SEQ ID NO: 919935 - RNA, 18 nt, Human
aaaagauacccaaaaucc

SEQ ID NO: 919936 - RNA, 19 nt, Human
aaacaaaagcugacaacag

SEQ ID NO: 919937 - RNA, 22 nt, Human
aaauacauucucaaggaaugca

SEQ ID NO: 919938 - RNA, 26 nt, Human
aagcacugaaguucuuuaugugagcu

SEQ ID NO: 919939 - RNA, 18 nt, Human
aauggaaaacacuccaaa

SEQ ID NO: 919940 - RNA, 21 nt, Human
acaacaaaaaaaccuacauuc

SEQ ID NO: 919941 - RNA, 24 nt, Human
acaacaaaaaaaccuacauucaaa

SEQ ID NO: 919942 - RNA, 20 nt, Human
acacucaauuaaaaauuucu

SEQ ID NO: 919943 - RNA, 25 nt, Human
acacugcaguuuaccuaaauuacac

SEQ ID NO: 919944 - RNA, 23 nt, Human
acaguagcaaauaaucuaacuuc

SEQ ID NO: 919945 - RNA, 21 nt, Human
accuugaagaaucuuuacaua

SEQ ID NO: 919946 - RNA, 21 nt, Human
acugccaacucuguuuaucug

SEQ ID NO: 919947 - RNA, 25 nt, Human
acugugcuuuuucucuccauuaaaa

SEQ ID NO: 919948 - RNA, 22 nt, Human
acuuauacaucuggauuguuug

SEQ ID NO: 919949 - RNA, 22 nt, Human
agagaaaaagacauaacuaaaa

SEQ ID NO: 919950 - RNA, 18 nt, Human
agauauugaaagcagcuu

SEQ ID NO: 919951 - RNA, 21 nt, Human
agcauggaguaagaggaggga

SEQ ID NO: 919952 - RNA, 21 nt, Human
agccaaaaaaaaaaagauagg

SEQ ID NO: 919953 - RNA, 26 nt, Human
agccaucagcccaccucuccuucaaa

SEQ ID NO: 919954 - RNA, 22 nt, Human
agcgguucuuuuucuuaaaguu

SEQ ID NO: 919955 - RNA, 20 nt, Human
aggaaacuuucaaggcaaau

SEQ ID NO: 919956 - RNA, 20 nt, Human
aggaaggaggaaauguccuc

SEQ ID NO: 919957 - RNA, 21 nt, Human
agguggcggcggcgagagcgg

SEQ ID NO: 919958 - RNA, 18 nt, Human
agugaaauaccaagaaug

SEQ ID NO: 919959 - RNA, 24 nt, Human
auaacuaaacuacuucaaacccaa

SEQ ID NO: 919960 - RNA, 22 nt, Human
auggaaaacacuccaaaauaca

SEQ ID NO: 919961 - RNA, 19 nt, Human
caaaagauacccaaaaucc

SEQ ID NO: 919962 - RNA, 25 nt, Human
caaaagauacccaaaauccugagug

SEQ ID NO: 919963 - RNA, 24 nt, Human
caaaagcugacaacaguuuuauug

SEQ ID NO: 919964 - RNA, 18 nt, Human
caacaaaaaaaccuacau

SEQ ID NO: 919965 - RNA, 26 nt, Human
caacaacaaaaaaaccuacauucaaa

SEQ ID NO: 919966 - RNA, 22 nt, Human
caacauugaaagcucaaaagaa

SEQ ID NO: 919967 - RNA, 23 nt, Human
caacauugaaagcucaaaagaag

SEQ ID NO: 919968 - RNA, 23 nt, Human
caaucccuggcuuaauaaacaca

SEQ ID NO: 919969 - RNA, 19 nt, Human
cacaaucccuggcuuaaua

SEQ ID NO: 919970 - RNA, 19 nt, Human
cagccggggcggcggggcc

SEQ ID NO: 919971 - RNA, 23 nt, Human
cauacagagaaaaagacauaacu

SEQ ID NO: 919972 - RNA, 21 nt, Human
ccagccaaaaaaaaaaagaua

SEQ ID NO: 919973 - RNA, 20 nt, Human
cccagccaaaaaaaaaaaga

SEQ ID NO: 919974 - RNA, 22 nt, Human
cccccaccccagccaaaaaaaa

SEQ ID NO: 919975 - RNA, 20 nt, Human
cccccgaaugaccaaauagg

SEQ ID NO: 919976 - RNA, 21 nt, Human
cccuaacagggcuaagcaaag

SEQ ID NO: 919977 - RNA, 21 nt, Human
cccuuguuaccuugaagaauc

SEQ ID NO: 919978 - RNA, 23 nt, Human
ccggcgccggcuccgcuuccccu

SEQ ID NO: 919979 - RNA, 20 nt, Human
ccucccgccgcuugcccccc

SEQ ID NO: 919980 - RNA, 23 nt, Human
ccucccgccgcuugccccccgaa

SEQ ID NO: 919981 - RNA, 24 nt, Human
ccucucuaaaaauuccucucaaaa

SEQ ID NO: 919982 - RNA, 23 nt, Human
ccucuuuuguuaaaacuugaccc

SEQ ID NO: 919983 - RNA, 19 nt, Human
cggggcggcggggccgggc

SEQ ID NO: 919984 - RNA, 19 nt, Human
cgugggcucccagccgagg

SEQ ID NO: 919985 - RNA, 18 nt, Human
cugagaguacuucuccuu

SEQ ID NO: 919986 - RNA, 24 nt, Human
cugggggaagucccacaaucccug

SEQ ID NO: 919987 - RNA, 23 nt, Human
gaaaacacuccaaaauacauuag

SEQ ID NO: 919988 - RNA, 27 nt, Human
gaaaacacuccaaaauacauuagcuaa

SEQ ID NO: 919989 - RNA, 21 nt, Human
gaccuucagaaacugguguga

SEQ ID NO: 919990 - RNA, 21 nt, Human
gagguggcggcggcgagagcg

SEQ ID NO: 919991 - RNA, 19 nt, Human
gcagccggggcggcggggc

SEQ ID NO: 919992 - RNA, 20 nt, Human
gcagccucgugggcucccag

SEQ ID NO: 919993 - RNA, 21 nt, Human
gccaucuuaguauuuacugug

SEQ ID NO: 919994 - RNA, 22 nt, Human
gcgcagccggcgccggcuccgc

SEQ ID NO: 919995 - RNA, 18 nt, Human
gcgugcgcagccggggcg

SEQ ID NO: 919996 - RNA, 21 nt, Human
gcuaaaaccauuguaugaacg

SEQ ID NO: 919997 - RNA, 23 nt, Human
ggcaggaugcggcagccucgugg

SEQ ID NO: 919998 - RNA, 21 nt, Human
gguuaaaaugcacagcaagua

SEQ ID NO: 919999 - RNA, 18 nt, Human
guggcggcggcgagagcg

SEQ ID NO: 920000 - RNA, 19 nt, Human
uaaaacaaaagcugacaac

SEQ ID NO: 920001 - RNA, 24 nt, Human
uaaaguuagguguguuuacacuca

SEQ ID NO: 920002 - RNA, 18 nt, Human
uaagaaauaugguccaaa

SEQ ID NO: 920003 - RNA, 22 nt, Human
uaagauauauccagcucugaaa

SEQ ID NO: 920004 - RNA, 25 nt, Human
uacaacucagccaucagcccaccuc

SEQ ID NO: 920005 - RNA, 22 nt, Human
uacacagagaacaaaaauuaca

SEQ ID NO: 920006 - RNA, 21 nt, Human
uacugugacuacauaccucuu

SEQ ID NO: 920007 - RNA, 20 nt, Human
uaguuugauuguauaauuuc

SEQ ID NO: 920008 - RNA, 23 nt, Human
uauuauguuaaacacugcaguuu

SEQ ID NO: 920009 - RNA, 21 nt, Human
uauuuuggaucauuuuuuucu

SEQ ID NO: 920010 - RNA, 24 nt, Human
ucaaaacccaaacccuuguuaccu

SEQ ID NO: 920011 - RNA, 18 nt, Human
ucaaggaaauuuuaaaau

SEQ ID NO: 920012 - RNA, 19 nt, Human
ucagaaacuggugugauuc

SEQ ID NO: 920013 - RNA, 20 nt, Human
uccaaaauacauuagcuaau

SEQ ID NO: 920014 - RNA, 24 nt, Human
ucccuauaaugccaggauuauuua

SEQ ID NO: 920015 - RNA, 21 nt, Human
ucgcgugcgcagccggggcgg

SEQ ID NO: 920016 - RNA, 21 nt, Human
ucggccgcgcacguuuccccu

SEQ ID NO: 920017 - RNA, 21 nt, Human
ucugagaguacuucuccuuca

SEQ ID NO: 920018 - RNA, 20 nt, Human
ugaaaauacaaaauuaucac

SEQ ID NO: 920019 - RNA, 21 nt, Human
ugaaaauacaaaauuaucacu

SEQ ID NO: 920020 - RNA, 19 nt, Human
ugaaauaccaagaaugcag

SEQ ID NO: 920021 - RNA, 21 nt, Human
ugacaauauucucacaguagc

SEQ ID NO: 920022 - RNA, 22 nt, Human
ugacaauauucucacaguagca

SEQ ID NO: 920023 - RNA, 18 nt, Human
ugaccaaugcccccaccc

SEQ ID NO: 920024 - RNA, 23 nt, Human
ugacugacuugaaguagugaaau

SEQ ID NO: 920025 - RNA, 21 nt, Human
ugcaagcaaaacugagcauuu

SEQ ID NO: 920026 - RNA, 21 nt, Human
uggcggcggcgagagcggcuu

SEQ ID NO: 920027 - RNA, 22 nt, Human
uguaaaauggaaaacacuccaa

SEQ ID NO: 920028 - RNA, 23 nt, Human
ugugaccaaugcccccaccccag

SEQ ID NO: 920029 - RNA, 22 nt, Human
ugugcuccuuaaugcuccaaug

SEQ ID NO: 920030 - RNA, 18 nt, Human
uuaaauguaggugcaugu

SEQ ID NO: 920031 - RNA, 24 nt, Human
uuacauacauccaaucauauccau

SEQ ID NO: 920032 - RNA, 23 nt, Human
uuaccuugaagaaucuuuacaua

SEQ ID NO: 920033 - RNA, 18 nt, Human
uuaguacuuaaaaagugg

SEQ ID NO: 920034 - RNA, 24 nt, Human
uuauuugaaaauuuucuuuuucuu

SEQ ID NO: 920035 - RNA, 23 nt, Human
uucaaacccaaugcagaggaaac

SEQ ID NO: 920036 - RNA, 19 nt, Human
uucuauauucaucagauuu

SEQ ID NO: 920037 - RNA, 25 nt, Human
uugaaaauacaaaauuaucacuaua

SEQ ID NO: 920038 - RNA, 23 nt, Human
uuuauagauaacaacaacaaaaa

SEQ ID NO: 920039 - RNA, 24 nt, Human
uuuuggguuuuauuugaaaauuuu

SEQ ID NO: 920040 - RNA, 18 nt, Human
uuuuuuuuuuuagaagga

SEQ ID NO: 920041 - RNA, 28 nt, Human
aaaacagaaagcaaaacaaaagggaccc

SEQ ID NO: 920042 - RNA, 27 nt, Human
aaaagcaaaacagaaagcaaaacaaaa

SEQ ID NO: 920043 - RNA, 22 nt, Human
aaacagaaagcaaaacaaaauc

SEQ ID NO: 920044 - RNA, 24 nt, Human
aaacagaaagcaaaacaaaaucca

SEQ ID NO: 920045 - RNA, 23 nt, Human
aaagcaaaacaaaauccauagcc

SEQ ID NO: 920046 - RNA, 20 nt, Human
aaauuugacaaacacuguca

SEQ ID NO: 920047 - RNA, 26 nt, Human
aacaagcaauaaaaccauguauuaca

SEQ ID NO: 920048 - RNA, 21 nt, Human
aacauuauaaaucugaccacu

SEQ ID NO: 920049 - RNA, 23 nt, Human
aagcaaaacagaaagcaaaacaa

SEQ ID NO: 920050 - RNA, 22 nt, Human
accccaacaaagcaacuuugcc

SEQ ID NO: 920051 - RNA, 22 nt, Human
accuugcacccaguaaaagcca

SEQ ID NO: 920052 - RNA, 26 nt, Human
agaaagcaaaacaaaauccauagcca

SEQ ID NO: 920053 - RNA, 22 nt, Human
agcaaaacagaaagcaaaacaa

SEQ ID NO: 920054 - RNA, 22 nt, Human
agguaaaaaucaaacuauuuua

SEQ ID NO: 920055 - RNA, 21 nt, Human
aguuguaauagcggcauauuu

SEQ ID NO: 920056 - RNA, 21 nt, Human
caaaacaaaauccauagccau

SEQ ID NO: 920057 - RNA, 20 nt, Human
caaaacagaaagcaaaacaa

SEQ ID NO: 920058 - RNA, 25 nt, Human
caaaagcaaaacagaaagcaaaaca

SEQ ID NO: 920059 - RNA, 22 nt, Human
caaagcaacuuugccauuucua

SEQ ID NO: 920060 - RNA, 18 nt, Human
caacaaagcaacuuugcc

SEQ ID NO: 920061 - RNA, 19 nt, Human
caacaaagcaacuuugcca

SEQ ID NO: 920062 - RNA, 19 nt, Human
cagcaccccaacaaagcaa

SEQ ID NO: 920063 - RNA, 21 nt, Human
caucaguaucagcaccccaac

SEQ ID NO: 920064 - RNA, 23 nt, Human
cccauauccaugcuaacaucauc

SEQ ID NO: 920065 - RNA, 18 nt, Human
gaguggcaacauuuuaug

SEQ ID NO: 920066 - RNA, 20 nt, Human
gcaaaacaaaauccauagcc

SEQ ID NO: 920067 - RNA, 23 nt, Human
gcaaaacagaaagcaaaacaaaa

SEQ ID NO: 920068 - RNA, 22 nt, Human
guaucagcaccccaacaaagca

SEQ ID NO: 920069 - RNA, 22 nt, Human
uaacauacacaaaucuauauau

SEQ ID NO: 920070 - RNA, 20 nt, Human
uaacauuauaaaucugacca

SEQ ID NO: 920071 - RNA, 22 nt, Human
uaagcaggucucuuuguacaaa

SEQ ID NO: 920072 - RNA, 27 nt, Human
uacaaaacucaggucaggaaaagaagc

SEQ ID NO: 920073 - RNA, 21 nt, Human
uaccuugcacccaguaaaagc

SEQ ID NO: 920074 - RNA, 20 nt, Human
ucaggaaaagaagcucaaac

SEQ ID NO: 920075 - RNA, 21 nt, Human
ucaguaucagcaccccaacaa

SEQ ID NO: 920076 - RNA, 22 nt, Human
ugauacaaaacucaggucagga

SEQ ID NO: 920077 - RNA, 23 nt, Human
uguacaaaagcaaaacagaaagc

SEQ ID NO: 920078 - RNA, 20 nt, Human
uuacuaaguuaacaucucau

SEQ ID NO: 920079 - RNA, 20 nt, Human
aaaaaggcuucuggcagccc

SEQ ID NO: 920080 - RNA, 22 nt, Human
aagacaguguuuuauuacaaau

SEQ ID NO: 920081 - RNA, 21 nt, Human
aggcuucuggcagcccagcuc

SEQ ID NO: 920082 - RNA, 19 nt, Human
cacugcagagugaaaaagg

SEQ ID NO: 920083 - RNA, 20 nt, Human
ccaacccaugaagcaacccu

SEQ ID NO: 920084 - RNA, 18 nt, Human
cccuucucuccuuugccc

SEQ ID NO: 920085 - RNA, 21 nt, Human
ccgccgcggcugaacucuccu

SEQ ID NO: 920086 - RNA, 21 nt, Human
ccucacaacacggcgagagga

SEQ ID NO: 920087 - RNA, 20 nt, Human
ccuccaacccaugaagcaac

SEQ ID NO: 920088 - RNA, 24 nt, Human
ccuccaacccaugaagcaacccug

SEQ ID NO: 920089 - RNA, 19 nt, Human
cgagaggaagccaaucaca

SEQ ID NO: 920090 - RNA, 18 nt, Human
cuggcagcccagcucugc

SEQ ID NO: 920091 - RNA, 25 nt, Human
ggcugaacucucaucuugacucgcu

SEQ ID NO: 920092 - RNA, 24 nt, Human
guuuuuuuuuuuuuuuucucccuu

SEQ ID NO: 920093 - RNA, 18 nt, Human
uauauuguguaugggugu

SEQ ID NO: 920094 - RNA, 21 nt, Human
uauuacaaauuaggcaaaugu

SEQ ID NO: 920095 - RNA, 24 nt, Human
uccgucuccauccuuccuuccuuu

SEQ ID NO: 920096 - RNA, 21 nt, Human
ucucccuucucuccuuugccc

SEQ ID NO: 920097 - RNA, 19 nt, Human
ucugcugcugcugccgccg

SEQ ID NO: 920098 - RNA, 21 nt, Human
ucuggcagcccagcucugccc

SEQ ID NO: 920099 - RNA, 20 nt, Human
ugaagcaacccugaaaagac

SEQ ID NO: 920100 - RNA, 23 nt, Human
ugcugccgccgcggcugaacucu

SEQ ID NO: 920101 - RNA, 19 nt, Human
uggcagcccagcucugccc

SEQ ID NO: 920102 - RNA, 21 nt, Human
ugggugugugugguuuuuuuu

SEQ ID NO: 920103 - RNA, 23 nt, Human
ugguauauuguguaugggugugu

SEQ ID NO: 920104 - RNA, 18 nt, Human
uguguaugggugugugug

SEQ ID NO: 920105 - RNA, 26 nt, Human
aaaugcaccuaaaacuagaaaauggu

SEQ ID NO: 920106 - RNA, 24 nt, Human
aacaaagcaauugaaaacuggaag

SEQ ID NO: 920107 - RNA, 18 nt, Human
aagcauuaacacuucaga

SEQ ID NO: 920108 - RNA, 23 nt, Human
aaggaacacaguauaggaggaaa

SEQ ID NO: 920109 - RNA, 22 nt, Human
aaguggcaaaugcaccuaaaac

SEQ ID NO: 920110 - RNA, 22 nt, Human
acaaagaaaaaaacaaucuuca

SEQ ID NO: 920111 - RNA, 19 nt, Human
acaaaucagaacacuacca

SEQ ID NO: 920112 - RNA, 24 nt, Human
acaaaucagaacacuaccaguaaa

SEQ ID NO: 920113 - RNA, 18 nt, Human
agaauuuuuccaaacaau

SEQ ID NO: 920114 - RNA, 18 nt, Human
agacagugaaucaggucu

SEQ ID NO: 920115 - RNA, 22 nt, Human
agauaaauuaauaauuuacaga

SEQ ID NO: 920116 - RNA, 21 nt, Human
aggaaaggggcgucucuggag

SEQ ID NO: 920117 - RNA, 22 nt, Human
aggugugugugugugugugugu

SEQ ID NO: 920118 - RNA, 19 nt, Human
aguugcuagagagauaaau

SEQ ID NO: 920119 - RNA, 20 nt, Human
auaaauauuaacauguagcc

SEQ ID NO: 920120 - RNA, 27 nt, Human
augaaagacaaucgaacaacaccaaaa

SEQ ID NO: 920121 - RNA, 21 nt, Human
augucucuaucacauuaagca

SEQ ID NO: 920122 - RNA, 20 nt, Human
caaagaaaaaaacaaucuuc

SEQ ID NO: 920123 - RNA, 23 nt, Human
caaaucagaacacuaccaguaaa

SEQ ID NO: 920124 - RNA, 22 nt, Human
caacaaagcaauugaaaacugg

SEQ ID NO: 920125 - RNA, 22 nt, Human
caagaaaccaggccauauacag

SEQ ID NO: 920126 - RNA, 23 nt, Human
cacccgccgccgccuccggacuc

SEQ ID NO: 920127 - RNA, 25 nt, Human
cacuaccaguaaaaacaaagaaaaa

SEQ ID NO: 920128 - RNA, 24 nt, Human
cagaacucaagacuuuggagagcc

SEQ ID NO: 920129 - RNA, 26 nt, Human
cagcaauacagcaaaauuuguaagaa

SEQ ID NO: 920130 - RNA, 24 nt, Human
caguguaaaugcagaaaaucugcc

SEQ ID NO: 920131 - RNA, 19 nt, Human
cauaguaaauaaaccaucu

SEQ ID NO: 920132 - RNA, 20 nt, Human
ccaaaaggaaaaacugaagu

SEQ ID NO: 920133 - RNA, 24 nt, Human
ccaaacaaugugaauuuacaagcc

SEQ ID NO: 920134 - RNA, 20 nt, Human
ccaguaaaaacaaagaaaaa

SEQ ID NO: 920135 - RNA, 31 nt, Human
ccgccgccgccuccggacucuguacgccugg

SEQ ID NO: 920136 - RNA, 18 nt, Human
ccgccggggcgcuggucc

SEQ ID NO: 920137 - RNA, 23 nt, Human
ccgccuccggacucuguacgccu

SEQ ID NO: 920138 - RNA, 22 nt, Human
ccuccgagaagugccgggccag

SEQ ID NO: 920139 - RNA, 25 nt, Human
ccuccggacucuguacgccugaucu

SEQ ID NO: 920140 - RNA, 26 nt, Human
cgaggugggguucaaagggacaacuu

SEQ ID NO: 920141 - RNA, 23 nt, Human
cgauuugucgagauucacauuua

SEQ ID NO: 920142 - RNA, 27 nt, Human
cgccuccggacucuguacgccugaucu

SEQ ID NO: 920143 - RNA, 18 nt, Human
cgccugaucucggcuacg

SEQ ID NO: 920144 - RNA, 19 nt, Human
cucacaaaucagaacacua

SEQ ID NO: 920145 - RNA, 19 nt, Human
cucaccggcuugggcucag

SEQ ID NO: 920146 - RNA, 18 nt, Human
cucacuggucccggcugc

SEQ ID NO: 920147 - RNA, 21 nt, Human
cuccacacuuccucugaagaa

SEQ ID NO: 920148 - RNA, 21 nt, Human
cuccgagaagugccgggccag

SEQ ID NO: 920149 - RNA, 27 nt, Human
cugcaaacagccaucuccacacuuccu

SEQ ID NO: 920150 - RNA, 31 nt, Human
cuguuagaggugugugugugugugugugugg

SEQ ID NO: 920151 - RNA, 21 nt, Human
cuuaagcauuaacacuucaga

SEQ ID NO: 920152 - RNA, 18 nt, Human
gaagaagccgaggugggg

SEQ ID NO: 920153 - RNA, 18 nt, Human
gagaacagcaauacagca

SEQ ID NO: 920154 - RNA, 21 nt, Human
gaggaaaggggcgucucugga

SEQ ID NO: 920155 - RNA, 21 nt, Human
gccagccggggcuggagcugg

SEQ ID NO: 920156 - RNA, 21 nt, Human
gccgccgccuccggacucugu

SEQ ID NO: 920157 - RNA, 18 nt, Human
gcugccgggacccuccga

SEQ ID NO: 920158 - RNA, 21 nt, Human
ggagagccucaaagagaacag

SEQ ID NO: 920159 - RNA, 22 nt, Human
gggacccuccgagaagugccgg

SEQ ID NO: 920160 - RNA, 21 nt, Human
gggccagccggggcuggagcu

SEQ ID NO: 920161 - RNA, 19 nt, Human
guaaaaacaaagaaaaaaa

SEQ ID NO: 920162 - RNA, 22 nt, Human
guagccaacaaagcaauugaaa

SEQ ID NO: 920163 - RNA, 21 nt, Human
gugugugugugugugugugag

SEQ ID NO: 920164 - RNA, 20 nt, Human
gugugugugugugugugugu

SEQ ID NO: 920165 - RNA, 21 nt, Human
guugccaauaaaacauuaaaa

SEQ ID NO: 920166 - RNA, 26 nt, Human
uaaaaacaagaaaccaggccauauac

SEQ ID NO: 920167 - RNA, 20 nt, Human
uaacauguagccaacaaagc

SEQ ID NO: 920168 - RNA, 20 nt, Human
uacaaacaaaccuccaaaag

SEQ ID NO: 920169 - RNA, 22 nt, Human
uagaaaauggugcaucggucau

SEQ ID NO: 920170 - RNA, 22 nt, Human
uagucgccaaaagugaaaagag

SEQ ID NO: 920171 - RNA, 19 nt, Human
ucagagaaggaaaaggggg

SEQ ID NO: 920172 - RNA, 25 nt, Human
uccacacuuccucugaagaagccga

SEQ ID NO: 920173 - RNA, 24 nt, Human
uccguagaggcacucacugguccc

SEQ ID NO: 920174 - RNA, 26 nt, Human
uccucugaagaagccgaggugggguu

SEQ ID NO: 920175 - RNA, 20 nt, Human
uccuucgccgccucugcugu

SEQ ID NO: 920176 - RNA, 18 nt, Human
ucucaccggcuugggcuc

SEQ ID NO: 920177 - RNA, 22 nt, Human
ugaaaaagcagcauacguugcc

SEQ ID NO: 920178 - RNA, 21 nt, Human
ugaaauaccuuggugaaaucu

SEQ ID NO: 920179 - RNA, 22 nt, Human
ugaagggcaaacaccaaguggc

SEQ ID NO: 920180 - RNA, 22 nt, Human
ugaauuuacaagcagugcacug

SEQ ID NO: 920181 - RNA, 21 nt, Human
ugcagaaaaucugccaucuuu

SEQ ID NO: 920182 - RNA, 22 nt, Human
uggcaaaugcaccuaaaacuag

SEQ ID NO: 920183 - RNA, 19 nt, Human
ugggaagggcugugcgaag

SEQ ID NO: 920184 - RNA, 18 nt, Human
ugggguucaaagggacaa

SEQ ID NO: 920185 - RNA, 18 nt, Human
uguacuuuuaaacuugaa

SEQ ID NO: 920186 - RNA, 21 nt, Human
uguacuuuuaaacuugaacac

SEQ ID NO: 920187 - RNA, 18 nt, Human
ugucucgucugccuuccu

SEQ ID NO: 920188 - RNA, 20 nt, Human
uguguguguguguguguaag

SEQ ID NO: 920189 - RNA, 18 nt, Human
ugugugugugugugugug

SEQ ID NO: 920190 - RNA, 18 nt, Human
ugugugugugugugugug

SEQ ID NO: 920191 - RNA, 18 nt, Human
ugugugugugugugugug

SEQ ID NO: 920192 - RNA, 18 nt, Human
ugugugugugugugugug

SEQ ID NO: 920193 - RNA, 18 nt, Human
ugugugugugugugugug

SEQ ID NO: 920194 - RNA, 21 nt, Human
ugugugugugugugugugugu

SEQ ID NO: 920195 - RNA, 21 nt, Human
ugugugugugugugugugugu

SEQ ID NO: 920196 - RNA, 21 nt, Human
ugugugugugugugugugugu

SEQ ID NO: 920197 - RNA, 21 nt, Human
ugugugugugugugugugugu

SEQ ID NO: 920198 - RNA, 21 nt, Human
ugugugugugugugugugugu

SEQ ID NO: 920199 - RNA, 21 nt, Human
ugugugugugugugugugugu

SEQ ID NO: 920200 - RNA, 21 nt, Human
ugugugugugugugugugugu

SEQ ID NO: 920201 - RNA, 22 nt, Human
ugugugugugugugugugugua

SEQ ID NO: 920202 - RNA, 22 nt, Human
ugugugugugugugugugugug

SEQ ID NO: 920203 - RNA, 22 nt, Human
ugugugugugugugugugugug

SEQ ID NO: 920204 - RNA, 22 nt, Human
ugugugugugugugugugugug

SEQ ID NO: 920205 - RNA, 24 nt, Human
uuagagaugucucuaucacauuaa

SEQ ID NO: 920206 - RNA, 20 nt, Human
uucagagaaggaaaaggggg

SEQ ID NO: 920207 - RNA, 19 nt, Human
uuuaaacuugaacacgggu

SEQ ID NO: 920208 - RNA, 19 nt, Human
uuuacagaggguuguucug

SEQ ID NO: 920209 - RNA, 23 nt, Human
uuuuuugaacguuacuagcuaua

SEQ ID NO: 920210 - RNA, 22 nt, Human
aaaauucuaaacgccuccaccc

SEQ ID NO: 920211 - RNA, 22 nt, Human
aaacggggcucaaucacacccc

SEQ ID NO: 920212 - RNA, 27 nt, Human
aaagaaacaagcaucgaaagcuacaug

SEQ ID NO: 920213 - RNA, 26 nt, Human
aaagagcccgucagccaugggcagga

SEQ ID NO: 920214 - RNA, 20 nt, Human
aacgccuccaccccuaaccu

SEQ ID NO: 920215 - RNA, 20 nt, Human
aagaaacaagcaucgaaagc

SEQ ID NO: 920216 - RNA, 25 nt, Human
aagcaucgaaagcuacaugaagggg

SEQ ID NO: 920217 - RNA, 18 nt, Human
acaugaagggggugcagc

SEQ ID NO: 920218 - RNA, 24 nt, Human
agaaaucccucagccccuuuuguc

SEQ ID NO: 920219 - RNA, 23 nt, Human
agugacaacaaagacggaaagaa

SEQ ID NO: 920220 - RNA, 23 nt, Human
cacagcuccagaagugagccggg

SEQ ID NO: 920221 - RNA, 19 nt, Human
caccccgucccgcgcuggc

SEQ ID NO: 920222 - RNA, 18 nt, Human
cagccccuuuugucuugg

SEQ ID NO: 920223 - RNA, 23 nt, Human
cagggucugcgccgaaagagccc

SEQ ID NO: 920224 - RNA, 20 nt, Human
cauccuagaguccccaagga

SEQ ID NO: 920225 - RNA, 19 nt, Human
ccaaggacagcccucccgu

SEQ ID NO: 920226 - RNA, 18 nt, Human
ccccaaggacagcccucc

SEQ ID NO: 920227 - RNA, 27 nt, Human
ccccagggucugcgccgaaagagcccc

SEQ ID NO: 920228 - RNA, 22 nt, Human
cccccugcgcccucccgcccgc

SEQ ID NO: 920229 - RNA, 19 nt, Human
cccuccccgcucgguccug

SEQ ID NO: 920230 - RNA, 18 nt, Human
cccuuucccuccccgcuc

SEQ ID NO: 920231 - RNA, 22 nt, Human
ccguggaccccggcuagggccc

SEQ ID NO: 920232 - RNA, 25 nt, Human
ccuaaccugcaggugcaaacagcac

SEQ ID NO: 920233 - RNA, 21 nt, Human
cgaccugggcccgcgggcagc

SEQ ID NO: 920234 - RNA, 20 nt, Human
cgcucgguccugcgcccacc

SEQ ID NO: 920235 - RNA, 18 nt, Human
cggccccccugcgcccuc

SEQ ID NO: 920236 - RNA, 19 nt, Human
cggcuagggcccccagagu

SEQ ID NO: 920237 - RNA, 22 nt, Human
cuaaaacacaaaaugccgagcc

SEQ ID NO: 920238 - RNA, 22 nt, Human
cuccagaagugagccgggccag

SEQ ID NO: 920239 - RNA, 19 nt, Human
cucgggguccgggcgaauc

SEQ ID NO: 920240 - RNA, 21 nt, Human
cugggcccgcgggcagcggga

SEQ ID NO: 920241 - RNA, 20 nt, Human
gacaacaaagacggaaagaa

SEQ ID NO: 920242 - RNA, 23 nt, Human
gacaacaaagacggaaagaaaca

SEQ ID NO: 920243 - RNA, 22 nt, Human
gacauuugcaaguaaauaauau

SEQ ID NO: 920244 - RNA, 21 nt, Human
gacgccgaccugggcccgcgg

SEQ ID NO: 920245 - RNA, 18 nt, Human
gcaggaucgcggguaggu

SEQ ID NO: 920246 - RNA, 19 nt, Human
gccuccaccccuaaccugc

SEQ ID NO: 920247 - RNA, 18 nt, Human
ggaggugauggagaaggc

SEQ ID NO: 920248 - RNA, 21 nt, Human
ggcaggaucgcggguaggugg

SEQ ID NO: 920249 - RNA, 18 nt, Human
gguggguaaauaucuugc

SEQ ID NO: 920250 - RNA, 20 nt, Human
uaaaacacaaaaugccgagc

SEQ ID NO: 920251 - RNA, 25 nt, Human
uaaccugcaggugcaaacagcaccc

SEQ ID NO: 920252 - RNA, 25 nt, Human
uaagaugacaaaucccuagggguca

SEQ ID NO: 920253 - RNA, 21 nt, Human
uagaggagacugaaaaagaua

SEQ ID NO: 920254 - RNA, 18 nt, Human
uagaguccccaaggacag

SEQ ID NO: 920255 - RNA, 24 nt, Human
uagaguccccaaggacagcccucc

SEQ ID NO: 920256 - RNA, 24 nt, Human
uauuucauugccggcagcuacuuu

SEQ ID NO: 920257 - RNA, 28 nt, Human
ucacagcuccagaagugaggggaacgcc

SEQ ID NO: 920258 - RNA, 24 nt, Human
ucaggugguuuucccgcacgaacu

SEQ ID NO: 920259 - RNA, 19 nt, Human
uccccaaggacagcccucc

SEQ ID NO: 920260 - RNA, 18 nt, Human
ucgcggguagguggguca

SEQ ID NO: 920261 - RNA, 18 nt, Human
ucgggggcugcccggcgc

SEQ ID NO: 920262 - RNA, 24 nt, Human
ucuaaaacacaaaaugccgagccc

SEQ ID NO: 920263 - RNA, 22 nt, Human
ucuaaacgccuccaccccuaac

SEQ ID NO: 920264 - RNA, 21 nt, Human
ucucacagcuccagaagugag

SEQ ID NO: 920265 - RNA, 18 nt, Human
ugacaacaaagacggaaa

SEQ ID NO: 920266 - RNA, 21 nt, Human
ugacaacaaagacggaaagaa

SEQ ID NO: 920267 - RNA, 23 nt, Human
ugcggaaaauggucgagauagca

SEQ ID NO: 920268 - RNA, 19 nt, Human
uggagaggugcggaaaaug

SEQ ID NO: 920269 - RNA, 22 nt, Human
uuugcaaguaaauaauaugcag

SEQ ID NO: 920270 - RNA, 18 nt, Human
uuuucccuuucccucccc

SEQ ID NO: 920271 - RNA, 19 nt, Human
uuuuuuuuuuuagaggaga

SEQ ID NO: 920272 - RNA, 22 nt, Human
uuuuuuuuuuuuagaggagacu

SEQ ID NO: 920273 - RNA, 22 nt, Human
uuuuuuuuuuuuuuuuuagagg

SEQ ID NO: 920274 - RNA, 25 nt, Human
aaaacacgaauccugauaaugccaa

SEQ ID NO: 920275 - RNA, 23 nt, Human
aaacaugcuaaaaacaugguguu

SEQ ID NO: 920276 - RNA, 23 nt, Human
aaagccaggaccaggaugaagga

SEQ ID NO: 920277 - RNA, 18 nt, Human
acacagacuuccgcccaa

SEQ ID NO: 920278 - RNA, 23 nt, Human
acagucaggagaaacugaagaga

SEQ ID NO: 920279 - RNA, 20 nt, Human
accccaaagcaccucacgcc

SEQ ID NO: 920280 - RNA, 21 nt, Human
accccaaagcaccucacgccc

SEQ ID NO: 920281 - RNA, 21 nt, Human
acggcaaugcaagcagaaagu

SEQ ID NO: 920282 - RNA, 23 nt, Human
acucugagaagcugagggacaaa

SEQ ID NO: 920283 - RNA, 23 nt, Human
agagaaaggcugagucugcagcg

SEQ ID NO: 920284 - RNA, 23 nt, Human
agagcaguucucagccugugccc

SEQ ID NO: 920285 - RNA, 23 nt, Human
agccagaccagcugcaguuugga

SEQ ID NO: 920286 - RNA, 24 nt, Human
agcgggugagguccccgugcucag

SEQ ID NO: 920287 - RNA, 23 nt, Human
agcugaaucccacuccuggccuc

SEQ ID NO: 920288 - RNA, 18 nt, Human
aggaagccccccaggccu

SEQ ID NO: 920289 - RNA, 24 nt, Human
aggcagccgcccaccaaggcccca

SEQ ID NO: 920290 - RNA, 21 nt, Human
aggcagguggaggcuggagaa

SEQ ID NO: 920291 - RNA, 22 nt, Human
aggcagguggaggcuggagaag

SEQ ID NO: 920292 - RNA, 23 nt, Human
aggcugugccaccuucacuggca

SEQ ID NO: 920293 - RNA, 18 nt, Human
agggcuggccggacucug

SEQ ID NO: 920294 - RNA, 21 nt, Human
agggggcgcccugcugcagcu

SEQ ID NO: 920295 - RNA, 22 nt, Human
caaaacaguaagccagaccagc

SEQ ID NO: 920296 - RNA, 24 nt, Human
caaagcaccucacgcccagcuccc

SEQ ID NO: 920297 - RNA, 24 nt, Human
caaagccugaaaagauggccaucu

SEQ ID NO: 920298 - RNA, 21 nt, Human
caaggagggggcaggaagccc

SEQ ID NO: 920299 - RNA, 24 nt, Human
caccaaagccugaaaagauggcca

SEQ ID NO: 920300 - RNA, 21 nt, Human
cacccuacucuccacucccac

SEQ ID NO: 920301 - RNA, 24 nt, Human
cacccuacucuccacucccacccc

SEQ ID NO: 920302 - RNA, 23 nt, Human
cacccugcacaacucacaagacc

SEQ ID NO: 920303 - RNA, 23 nt, Human
cacccugcuuucccucccgugcu

SEQ ID NO: 920304 - RNA, 23 nt, Human
caccugcuuccaccacccaagag

SEQ ID NO: 920305 - RNA, 25 nt, Human
cacuccuggccucacuccccagccc

SEQ ID NO: 920306 - RNA, 23 nt, Human
cagagagcugagacacaggccca

SEQ ID NO: 920307 - RNA, 20 nt, Human
cagccgcccaccaaggcccc

SEQ ID NO: 920308 - RNA, 23 nt, Human
cagccgcccaccaaggccccacc

SEQ ID NO: 920309 - RNA, 25 nt, Human
cagccgcccaccaaggccccaccug

SEQ ID NO: 920310 - RNA, 23 nt, Human
cagcggaugccccccugcagucc

SEQ ID NO: 920311 - RNA, 21 nt, Human
cagcugaaucccacuccuggc

SEQ ID NO: 920312 - RNA, 22 nt, Human
cagcugaaucccacuccuggcc

SEQ ID NO: 920313 - RNA, 21 nt, Human
cagggcagggaggccaggccc

SEQ ID NO: 920314 - RNA, 22 nt, Human
ccacccagacugcucuugggcc

SEQ ID NO: 920315 - RNA, 20 nt, Human
ccacccuacucuccacuccc

SEQ ID NO: 920316 - RNA, 21 nt, Human
ccacccuacucuccacuccca

SEQ ID NO: 920317 - RNA, 23 nt, Human
ccacccuggacuauugacucacu

SEQ ID NO: 920318 - RNA, 20 nt, Human
ccacuccuggccucacuccc

SEQ ID NO: 920319 - RNA, 19 nt, Human
ccacugccccugucucagg

SEQ ID NO: 920320 - RNA, 21 nt, Human
ccagagagcugagacacaggc

SEQ ID NO: 920321 - RNA, 19 nt, Human
ccaggccccacccuggacu

SEQ ID NO: 920322 - RNA, 19 nt, Human
cccaaagcaccucacgccc

SEQ ID NO: 920323 - RNA, 24 nt, Human
cccacugcaggauggcugcagaga

SEQ ID NO: 920324 - RNA, 22 nt, Human
ccccacaaaacacgaauccuga

SEQ ID NO: 920325 - RNA, 22 nt, Human
ccccacccuggacuauugacuc

SEQ ID NO: 920326 - RNA, 23 nt, Human
ccccaggccuuaccuccugaguc

SEQ ID NO: 920327 - RNA, 23 nt, Human
cccccacugcaggauggcugcag

SEQ ID NO: 920328 - RNA, 24 nt, Human
cccccaggccuuaccuccugaguc

SEQ ID NO: 920329 - RNA, 20 nt, Human
cccgggggcaggcagguggg

SEQ ID NO: 920330 - RNA, 21 nt, Human
ccgugacaccugcuuccacca

SEQ ID NO: 920331 - RNA, 26 nt, Human
ccucacuccccagcccguuucucucc

SEQ ID NO: 920332 - RNA, 19 nt, Human
ccucuacaaacccugaggg

SEQ ID NO: 920333 - RNA, 18 nt, Human
ccugcacaacucacaaga

SEQ ID NO: 920334 - RNA, 25 nt, Human
ccugcacaacucacaagaccacccu

SEQ ID NO: 920335 - RNA, 19 nt, Human
ccuggccucacuccccagc

SEQ ID NO: 920336 - RNA, 18 nt, Human
cgaauccugauaaugcca

SEQ ID NO: 920337 - RNA, 21 nt, Human
cggaugccccccugcaguccu

SEQ ID NO: 920338 - RNA, 20 nt, Human
cggcaaaacaguaagccaga

SEQ ID NO: 920339 - RNA, 21 nt, Human
cgggcagggccaccuuccaga

SEQ ID NO: 920340 - RNA, 24 nt, Human
cucacccccacugcaggauggcug

SEQ ID NO: 920341 - RNA, 18 nt, Human
cuccccagcccguuucuc

SEQ ID NO: 920342 - RNA, 18 nt, Human
cuccuggccucacucccc

SEQ ID NO: 920343 - RNA, 24 nt, Human
cugauaaugccaacgguucugucc

SEQ ID NO: 920344 - RNA, 21 nt, Human
cugcacaacucacaagaccac

SEQ ID NO: 920345 - RNA, 21 nt, Human
cugcagcugaaucccacuccu

SEQ ID NO: 920346 - RNA, 18 nt, Human
cugcaguccucuacaaac

SEQ ID NO: 920347 - RNA, 22 nt, Human
cuucacccugcacaacucacaa

SEQ ID NO: 920348 - RNA, 19 nt, Human
gagagcugagacacaggcc

SEQ ID NO: 920349 - RNA, 18 nt, Human
gcaggugggcaaggaggg

SEQ ID NO: 920350 - RNA, 23 nt, Human
gcuggguggccgugucucagcuc

SEQ ID NO: 920351 - RNA, 21 nt, Human
ggaacacaagggcuggccgga

SEQ ID NO: 920352 - RNA, 26 nt, Human
ggaauucucucaggggaauucuaccc

SEQ ID NO: 920353 - RNA, 21 nt, Human
ggagaggggggugacacggcu

SEQ ID NO: 920354 - RNA, 18 nt, Human
ggcaggcaggugggcaag

SEQ ID NO: 920355 - RNA, 21 nt, Human
ggcaggggcugaagagaaggg

SEQ ID NO: 920356 - RNA, 23 nt, Human
ggcugaagagaaggggacagccc

SEQ ID NO: 920357 - RNA, 23 nt, Human
gggcaggggcugaagagaagggg

SEQ ID NO: 920358 - RNA, 19 nt, Human
ggggaggggugcaggggga

SEQ ID NO: 920359 - RNA, 18 nt, Human
guccuccuguucccgauu

SEQ ID NO: 920360 - RNA, 19 nt, Human
guccucuacaaacccugag

SEQ ID NO: 920361 - RNA, 18 nt, Human
guggcccucugaguggaa

SEQ ID NO: 920362 - RNA, 19 nt, Human
uacggcaaugcaagcagaa

SEQ ID NO: 920363 - RNA, 20 nt, Human
uaguuagcaccuccaccagu

SEQ ID NO: 920364 - RNA, 19 nt, Human
ucacugcaguggggaggag

SEQ ID NO: 920365 - RNA, 19 nt, Human
ucaggagaaacugaagaga

SEQ ID NO: 920366 - RNA, 19 nt, Human
uccaccacccaagagcagu

SEQ ID NO: 920367 - RNA, 25 nt, Human
uccacucccacccccacaaaacacg

SEQ ID NO: 920368 - RNA, 21 nt, Human
uccaucagcaccacugccccu

SEQ ID NO: 920369 - RNA, 21 nt, Human
ucccauccuaugccacguccu

SEQ ID NO: 920370 - RNA, 22 nt, Human
uccccaaucagggcagggaggc

SEQ ID NO: 920371 - RNA, 22 nt, Human
ucccgugcugcccgggggcagg

SEQ ID NO: 920372 - RNA, 19 nt, Human
ucuacaaacccugagggac

SEQ ID NO: 920373 - RNA, 20 nt, Human
ucuccacucccacccccaca

SEQ ID NO: 920374 - RNA, 22 nt, Human
ucucucaggggaauucuacccc

SEQ ID NO: 920375 - RNA, 19 nt, Human
ucucucccaugcccagcuc

SEQ ID NO: 920376 - RNA, 21 nt, Human
ucugagacaaguguguaaauu

SEQ ID NO: 920377 - RNA, 21 nt, Human
ugaaaccaacaagcgugcuca

SEQ ID NO: 920378 - RNA, 23 nt, Human
ugaaggaacgcacagauacggca

SEQ ID NO: 920379 - RNA, 24 nt, Human
ugacaagacaaacuguauaggaaa

SEQ ID NO: 920380 - RNA, 21 nt, Human
ugacaccugcuuccaccaccc

SEQ ID NO: 920381 - RNA, 19 nt, Human
ugagaagcugagggacaaa

SEQ ID NO: 920382 - RNA, 21 nt, Human
ugagaagcugagggacaaaga

SEQ ID NO: 920383 - RNA, 24 nt, Human
ugagaucacagucaggagaaacug

SEQ ID NO: 920384 - RNA, 20 nt, Human
ugccccccugcaguccucuc

SEQ ID NO: 920385 - RNA, 20 nt, Human
uggagggagaggggggugac

SEQ ID NO: 920386 - RNA, 18 nt, Human
uggaucagacaggcaggu

SEQ ID NO: 920387 - RNA, 20 nt, Human
uggcaaagggagccgugagu

SEQ ID NO: 920388 - RNA, 19 nt, Human
uggccggacucugagaagc

SEQ ID NO: 920389 - RNA, 19 nt, Human
uggcugcagagaaaggcug

SEQ ID NO: 920390 - RNA, 19 nt, Human
uggcugcagagaaaggcug

SEQ ID NO: 920391 - RNA, 20 nt, Human
ugggccaccaaagccugaaa

SEQ ID NO: 920392 - RNA, 20 nt, Human
uggggaggaggaaagugugg

SEQ ID NO: 920393 - RNA, 21 nt, Human
uggggcacgggaacacaaggg

SEQ ID NO: 920394 - RNA, 25 nt, Human
uuccaagucaaaccaggacaccugc

SEQ ID NO: 920395 - RNA, 22 nt, Human
uucugagacaaguguguaaauu

SEQ ID NO: 920396 - RNA, 26 nt, Human
uugaaaccaacaagcgugcucacccc

SEQ ID NO: 920397 - RNA, 27 nt, Human
uugaaaccaacaagcgugcucaccccc

SEQ ID NO: 920398 - RNA, 24 nt, Human
uugaacugacucuggcaaagggag

SEQ ID NO: 920399 - RNA, 22 nt, Human
uugggccaccaaagccugaaaa

SEQ ID NO: 920400 - RNA, 23 nt, Human
uuuuuggcuuuugacacuuuauc

SEQ ID NO: 920401 - RNA, 25 nt, Human
uuuuuuuuuuuuuuuuggcuuuuga

SEQ ID NO: 920402 - RNA, 18 nt, Human
uuuuuuuuuuuuuuuuug

SEQ ID NO: 920403 - RNA, 25 nt, Human
uuuuuuuuuuuuuuuuuuggcuuuu

SEQ ID NO: 920404 - RNA, 22 nt, Human
uuuuuuuuuuuuuuuuuuuggc

SEQ ID NO: 920405 - RNA, 24 nt, Human
aaacaagaagggauugaagcaagg

SEQ ID NO: 920406 - RNA, 24 nt, Human
aaacaauacauaugucacugaaac

SEQ ID NO: 920407 - RNA, 23 nt, Human
aagccaggagcaagcccagggga

SEQ ID NO: 920408 - RNA, 20 nt, Human
aagcccaccaagagcaacag

SEQ ID NO: 920409 - RNA, 23 nt, Human
acacauccauagccagagaggcc

SEQ ID NO: 920410 - RNA, 20 nt, Human
accucgugaccuugaaguca

SEQ ID NO: 920411 - RNA, 23 nt, Human
agagauccagaagccugcaagga

SEQ ID NO: 920412 - RNA, 18 nt, Human
agaggugggaggggaacc

SEQ ID NO: 920413 - RNA, 18 nt, Human
aggaauacaggauaaugg

SEQ ID NO: 920414 - RNA, 20 nt, Human
aggaggccccagcagcuuuc

SEQ ID NO: 920415 - RNA, 20 nt, Human
aggaggccggggacaaagcu

SEQ ID NO: 920416 - RNA, 20 nt, Human
aggcaguggcuggcuggaga

SEQ ID NO: 920417 - RNA, 24 nt, Human
aggggagaugcuguuccaugcugg

SEQ ID NO: 920418 - RNA, 18 nt, Human
aguagguggcggggagaa

SEQ ID NO: 920419 - RNA, 19 nt, Human
auuuauaguuguaucccuu

SEQ ID NO: 920420 - RNA, 20 nt, Human
caagcccaggggagaugcug

SEQ ID NO: 920421 - RNA, 18 nt, Human
caaggagacccaugggca

SEQ ID NO: 920422 - RNA, 23 nt, Human
caagucagaaaucccccagugca

SEQ ID NO: 920423 - RNA, 20 nt, Human
cacaucuucagccuaguccc

SEQ ID NO: 920424 - RNA, 24 nt, Human
cacaucuucagccuagucccugcc

SEQ ID NO: 920425 - RNA, 20 nt, Human
caccaaguacccacacaucc

SEQ ID NO: 920426 - RNA, 21 nt, Human
caccaaguacccacacaucca

SEQ ID NO: 920427 - RNA, 24 nt, Human
caccaaguacccacacauccauag

SEQ ID NO: 920428 - RNA, 19 nt, Human
cagcagcuuucaagaaugg

SEQ ID NO: 920429 - RNA, 24 nt, Human
cagcccucuagcuuggaagggaga

SEQ ID NO: 920430 - RNA, 22 nt, Human
caggugagggacccccaggcau

SEQ ID NO: 920431 - RNA, 24 nt, Human
ccaggacagaaaggaaacugggca

SEQ ID NO: 920432 - RNA, 22 nt, Human
cccacacauccauagccagaga

SEQ ID NO: 920433 - RNA, 25 nt, Human
ccccaggcauucucccugcccgcac

SEQ ID NO: 920434 - RNA, 21 nt, Human
ccccagugcaacuuaagacaa

SEQ ID NO: 920435 - RNA, 25 nt, Human
cccccacccgacagacugacccuug

SEQ ID NO: 920436 - RNA, 19 nt, Human
cccccuuccccauuccagc

SEQ ID NO: 920437 - RNA, 22 nt, Human
cccgcaccgagucucucuucac

SEQ ID NO: 920438 - RNA, 24 nt, Human
ccugccaagcccaccaagagcaac

SEQ ID NO: 920439 - RNA, 22 nt, Human
ccuggccacacguaugacucug

SEQ ID NO: 920440 - RNA, 25 nt, Human
cucuucuaccuuccugagcuaaaag

SEQ ID NO: 920441 - RNA, 24 nt, Human
cucuuuucauauuccucacaaccc

SEQ ID NO: 920442 - RNA, 26 nt, Human
cugacccuugucccccuuccccauuc

SEQ ID NO: 920443 - RNA, 23 nt, Human
cugccugaauacaggaagcaaga

SEQ ID NO: 920444 - RNA, 19 nt, Human
cugcugggaccugcgccgu

SEQ ID NO: 920445 - RNA, 21 nt, Human
cuggcuacuuccuggccacac

SEQ ID NO: 920446 - RNA, 23 nt, Human
cuucacccuggcuacuuccuggc

SEQ ID NO: 920447 - RNA, 20 nt, Human
gaacccagaagucuucagua

SEQ ID NO: 920448 - RNA, 25 nt, Human
gacaaacagagagaagucaccuucc

SEQ ID NO: 920449 - RNA, 23 nt, Human
gccaagcccaccaagagcaacag

SEQ ID NO: 920450 - RNA, 21 nt, Human
gcccagaccacagucauaggg

SEQ ID NO: 920451 - RNA, 21 nt, Human
gcccgcaccgagucucucuuc

SEQ ID NO: 920452 - RNA, 22 nt, Human
ggaaaggggccuaaagcccaga

SEQ ID NO: 920453 - RNA, 20 nt, Human
gggaaggaaaggggccuaaa

SEQ ID NO: 920454 - RNA, 21 nt, Human
gggaaggaaaggggccuaaag

SEQ ID NO: 920455 - RNA, 22 nt, Human
guccccaccaaguacccacaca

SEQ ID NO: 920456 - RNA, 19 nt, Human
gugaaaaugggggcuugcu

SEQ ID NO: 920457 - RNA, 19 nt, Human
guucuauuaucuguccccc

SEQ ID NO: 920458 - RNA, 18 nt, Human
uaagacaaacagagagaa

SEQ ID NO: 920459 - RNA, 22 nt, Human
uaagacaaacagagagaaguca

SEQ ID NO: 920460 - RNA, 19 nt, Human
uagcuccuccguccccacc

SEQ ID NO: 920461 - RNA, 25 nt, Human
uaucccuuugugugauauaguuagg

SEQ ID NO: 920462 - RNA, 19 nt, Human
ucacaagccaggagcaagc

SEQ ID NO: 920463 - RNA, 20 nt, Human
ucauauuccucacaacccca

SEQ ID NO: 920464 - RNA, 20 nt, Human
uccagaagccugcaaggagg

SEQ ID NO: 920465 - RNA, 21 nt, Human
ucccccaucccuaacccagau

SEQ ID NO: 920466 - RNA, 26 nt, Human
ucuauuaucugucccccaucccuaac

SEQ ID NO: 920467 - RNA, 19 nt, Human
ucugaccagagauccagaa

SEQ ID NO: 920468 - RNA, 22 nt, Human
ugaagcaaggagacccaugggc

SEQ ID NO: 920469 - RNA, 19 nt, Human
ugaccagagauccagaagc

SEQ ID NO: 920470 - RNA, 20 nt, Human
ugaccagagauccagaagcc

SEQ ID NO: 920471 - RNA, 21 nt, Human
ugacccuugucccccuucccc

SEQ ID NO: 920472 - RNA, 21 nt, Human
ugggccucaagucagaaaucc

SEQ ID NO: 920473 - RNA, 18 nt, Human
ugucuccaggacagaaag

SEQ ID NO: 920474 - RNA, 24 nt, Human
uuaaguaauuaauccuaacuauau

SEQ ID NO: 920475 - RNA, 22 nt, Human
uucauauuccucacaaccccag

SEQ ID NO: 920476 - RNA, 21 nt, Human
uuccucacaaccccagcuguu

SEQ ID NO: 920477 - RNA, 18 nt, Human
uuccuggccacacguaug

SEQ ID NO: 920478 - RNA, 22 nt, Human
uuucauauuccucacaacccca

SEQ ID NO: 920479 - RNA, 20 nt, Human
uuuuuuuuuuuuuuuugggu

SEQ ID NO: 920480 - RNA, 19 nt, Human
uuuuuuuuuuuuuuuuuug

SEQ ID NO: 920481 - RNA, 23 nt, Human
uuuuuuuuuuuuuuuuuuugggu

SEQ ID NO: 920482 - RNA, 23 nt, Human
uuuuuuuuuuuuuuuuuuuuggg

SEQ ID NO: 920483 - RNA, 19 nt, Human
acaaaguguaggggaaaau

SEQ ID NO: 920484 - RNA, 18 nt, Human
gggaaucccauggucagg

SEQ ID NO: 920485 - RNA, 21 nt, Human
ucagguagaaagagggauucc

SEQ ID NO: 920486 - RNA, 21 nt, Human
uggucagguagaaagagggau

SEQ ID NO: 920487 - RNA, 18 nt, Human
uguuuuaaugacaaagug

SEQ ID NO: 920488 - RNA, 19 nt, Human
aaaaggaaacagggccaaa

SEQ ID NO: 920489 - RNA, 22 nt, Human
aaacaaaagugcacaugcagaa

SEQ ID NO: 920490 - RNA, 21 nt, Human
aaacccugacaugcccaaugg

SEQ ID NO: 920491 - RNA, 22 nt, Human
aaagaggccucucaucucccuc

SEQ ID NO: 920492 - RNA, 19 nt, Human
aaccccaagugccgccccc

SEQ ID NO: 920493 - RNA, 20 nt, Human
aaccccaagugccgccccca

SEQ ID NO: 920494 - RNA, 19 nt, Human
aagaggcuccagcuggguc

SEQ ID NO: 920495 - RNA, 24 nt, Human
aagcagaagacacagaaugccacc

SEQ ID NO: 920496 - RNA, 21 nt, Human
aaugccaccuuccucaagcac

SEQ ID NO: 920497 - RNA, 18 nt, Human
aauguggacaucagagcc

SEQ ID NO: 920498 - RNA, 22 nt, Human
acacagaaugccacccuccuca

SEQ ID NO: 920499 - RNA, 19 nt, Human
acccugucaccagggcugg

SEQ ID NO: 920500 - RNA, 20 nt, Human
accuucaccuccagcugggc

SEQ ID NO: 920501 - RNA, 23 nt, Human
accuuccucaagcacgcaagcua

SEQ ID NO: 920502 - RNA, 25 nt, Human
acgcagcccagagaagagggaacgc

SEQ ID NO: 920503 - RNA, 18 nt, Human
acugggcaacugaugucc

SEQ ID NO: 920504 - RNA, 19 nt, Human
acuucugaucauccuccuc

SEQ ID NO: 920505 - RNA, 23 nt, Human
agaggaaggggcugcagaaaaug

SEQ ID NO: 920506 - RNA, 25 nt, Human
agauagccaggcaguagcccugggu

SEQ ID NO: 920507 - RNA, 24 nt, Human
agcagaguaggaaggacgccagga

SEQ ID NO: 920508 - RNA, 25 nt, Human
agccagacuguggcaugggggccca

SEQ ID NO: 920509 - RNA, 24 nt, Human
agccagcuuccugccuagggccca

SEQ ID NO: 920510 - RNA, 19 nt, Human
agccuggacccaaggccuc

SEQ ID NO: 920511 - RNA, 22 nt, Human
agcuugcugagacagggguugg

SEQ ID NO: 920512 - RNA, 18 nt, Human
aggaggcaugaggggccg

SEQ ID NO: 920513 - RNA, 21 nt, Human
aggaggcugaugggggcuccc

SEQ ID NO: 920514 - RNA, 22 nt, Human
aggaggcugaugggggcucccg

SEQ ID NO: 920515 - RNA, 20 nt, Human
aggcaggcccugcacguucu

SEQ ID NO: 920516 - RNA, 24 nt, Human
aggcgcagaagaccgucagaagcu

SEQ ID NO: 920517 - RNA, 23 nt, Human
aggcuggacacuauccaggggcc

SEQ ID NO: 920518 - RNA, 21 nt, Human
aggggcuggcuuugaggcugc

SEQ ID NO: 920519 - RNA, 23 nt, Human
aggucccaggggggcagugcugu

SEQ ID NO: 920520 - RNA, 18 nt, Human
aggugcuuccuggcucag

SEQ ID NO: 920521 - RNA, 20 nt, Human
aucaagauccaggcgcagaa

SEQ ID NO: 920522 - RNA, 19 nt, Human
aucucucauuuccugcagg

SEQ ID NO: 920523 - RNA, 18 nt, Human
auggaacugagguggcag

SEQ ID NO: 920524 - RNA, 21 nt, Human
auggccaaacccugacaugcc

SEQ ID NO: 920525 - RNA, 23 nt, Human
caaagaggccucucaucucccuc

SEQ ID NO: 920526 - RNA, 24 nt, Human
cacacagcuaauguccuccucaca

SEQ ID NO: 920527 - RNA, 21 nt, Human
cacaugacugggcaacugaug

SEQ ID NO: 920528 - RNA, 21 nt, Human
caccacuggccagagcagagu

SEQ ID NO: 920529 - RNA, 21 nt, Human
cagaaaccccaagugccgccc

SEQ ID NO: 920530 - RNA, 18 nt, Human
cagaaauauacaaggcug

SEQ ID NO: 920531 - RNA, 20 nt, Human
cagaagacacagaaugccac

SEQ ID NO: 920532 - RNA, 18 nt, Human
cagaaugccacccuccuc

SEQ ID NO: 920533 - RNA, 25 nt, Human
cagagccacuguccuccucugcugg

SEQ ID NO: 920534 - RNA, 20 nt, Human
cagcuccuuccgcuucuccc

SEQ ID NO: 920535 - RNA, 18 nt, Human
caggagggaacugaggcu

SEQ ID NO: 920536 - RNA, 18 nt, Human
caggcggcgacucucccc

SEQ ID NO: 920537 - RNA, 18 nt, Human
cagggcugguggucucag

SEQ ID NO: 920538 - RNA, 23 nt, Human
cagggcugguggucucaggugcu

SEQ ID NO: 920539 - RNA, 18 nt, Human
caguagcccuggguggca

SEQ ID NO: 920540 - RNA, 22 nt, Human
caguuuggaacgaccacacaaa

SEQ ID NO: 920541 - RNA, 23 nt, Human
caugcccaauggcccuccugcag

SEQ ID NO: 920542 - RNA, 21 nt, Human
cauggaggcuuucaguuucuc

SEQ ID NO: 920543 - RNA, 22 nt, Human
cauggccaaacccugacaugcc

SEQ ID NO: 920544 - RNA, 23 nt, Human
cauggccaaacccugacaugccc

SEQ ID NO: 920545 - RNA, 23 nt, Human
ccaagugccgcccccaaagcccu

SEQ ID NO: 920546 - RNA, 24 nt, Human
ccacacacuucugaucauccuccu

SEQ ID NO: 920547 - RNA, 22 nt, Human
ccacagccuggcugagcaaugu

SEQ ID NO: 920548 - RNA, 20 nt, Human
ccacccuccucaaggaggca

SEQ ID NO: 920549 - RNA, 27 nt, Human
ccagaaaccccaagugccgcccccaaa

SEQ ID NO: 920550 - RNA, 18 nt, Human
ccagagcagaguaggaag

SEQ ID NO: 920551 - RNA, 21 nt, Human
cccagaaaccccaagugccgc

SEQ ID NO: 920552 - RNA, 25 nt, Human
cccagaaaccccaagugccgccccc

SEQ ID NO: 920553 - RNA, 26 nt, Human
cccagccccagccccagcccagaggc

SEQ ID NO: 920554 - RNA, 19 nt, Human
ccccaaagcccuggggcag

SEQ ID NO: 920555 - RNA, 19 nt, Human
ccccaagggaggagcagcg

SEQ ID NO: 920556 - RNA, 24 nt, Human
ccccaagugccgcccccaaagccc

SEQ ID NO: 920557 - RNA, 24 nt, Human
ccccagcccagaggccaggccaga

SEQ ID NO: 920558 - RNA, 27 nt, Human
cccccaacugagggaugaaccuagagc

SEQ ID NO: 920559 - RNA, 24 nt, Human
ccccccaacugagggaugaaccua

SEQ ID NO: 920560 - RNA, 18 nt, Human
ccccccuuucucucuuuc

SEQ ID NO: 920561 - RNA, 18 nt, Human
ccccuuaaauuccucuuc

SEQ ID NO: 920562 - RNA, 21 nt, Human
cccugcacguucucacuccuc

SEQ ID NO: 920563 - RNA, 18 nt, Human
cccuuaaauuccucuucc

SEQ ID NO: 920564 - RNA, 21 nt, Human
ccgcccccaaagcccuggggc

SEQ ID NO: 920565 - RNA, 20 nt, Human
ccgcgggccuuccccaagca

SEQ ID NO: 920566 - RNA, 19 nt, Human
ccgcuccgccacucgcuuc

SEQ ID NO: 920567 - RNA, 18 nt, Human
ccgcuucucccuuagccc

SEQ ID NO: 920568 - RNA, 22 nt, Human
ccggccccacgcagcccagaga

SEQ ID NO: 920569 - RNA, 21 nt, Human
ccggucccgugucacaugcuc

SEQ ID NO: 920570 - RNA, 22 nt, Human
ccuaaggcaagauggcagggga

SEQ ID NO: 920571 - RNA, 21 nt, Human
ccucccugggggcagccucag

SEQ ID NO: 920572 - RNA, 20 nt, Human
ccucuuccacucuugaaucc

SEQ ID NO: 920573 - RNA, 21 nt, Human
ccugcacugugccuggagcag

SEQ ID NO: 920574 - RNA, 19 nt, Human
ccugcagccauugcuguag

SEQ ID NO: 920575 - RNA, 20 nt, Human
ccugcaucucacccauggag

SEQ ID NO: 920576 - RNA, 23 nt, Human
ccuggggaucgcagcaggauaaa

SEQ ID NO: 920577 - RNA, 19 nt, Human
ccugggggcugggguucuc

SEQ ID NO: 920578 - RNA, 19 nt, Human
ccuuuaccucaucgaaagc

SEQ ID NO: 920579 - RNA, 18 nt, Human
cgccgaggucccgccgcu

SEQ ID NO: 920580 - RNA, 18 nt, Human
cggaaugccaccuuccuc

SEQ ID NO: 920581 - RNA, 20 nt, Human
cggccccacgcagcccagag

SEQ ID NO: 920582 - RNA, 28 nt, Human
cgugugugcucccagccccagccccagc

SEQ ID NO: 920583 - RNA, 19 nt, Human
cuacuaccucaagaacaaa

SEQ ID NO: 920584 - RNA, 21 nt, Human
cucacugcccagcaccuuguu

SEQ ID NO: 920585 - RNA, 18 nt, Human
cucagugggguuggggaa

SEQ ID NO: 920586 - RNA, 19 nt, Human
cuccagcugggcccgauau

SEQ ID NO: 920587 - RNA, 26 nt, Human
cucccagaagccagcuuccugccuag

SEQ ID NO: 920588 - RNA, 19 nt, Human
cucccagccccagccccag

SEQ ID NO: 920589 - RNA, 22 nt, Human
cucccagccccagccccagccc

SEQ ID NO: 920590 - RNA, 21 nt, Human
cugaguccucuuggcucucag

SEQ ID NO: 920591 - RNA, 27 nt, Human
cugcagcaggggccuccugggggcugg

SEQ ID NO: 920592 - RNA, 20 nt, Human
cugggccucaaccugugacc

SEQ ID NO: 920593 - RNA, 18 nt, Human
cuggugggggaaggcugu

SEQ ID NO: 920594 - RNA, 21 nt, Human
cugugccuggagccggggucc

SEQ ID NO: 920595 - RNA, 21 nt, Human
cugugcuguauucagaaguca

SEQ ID NO: 920596 - RNA, 21 nt, Human
cuuccgcuucucccuuagccc

SEQ ID NO: 920597 - RNA, 23 nt, Human
cuuccuggcucagcucucccaaa

SEQ ID NO: 920598 - RNA, 23 nt, Human
cuugauggauggccagaagggau

SEQ ID NO: 920599 - RNA, 24 nt, Human
gaaaauguccuuguuuugcaaaaa

SEQ ID NO: 920600 - RNA, 20 nt, Human
gacaguacaauaacgauaac

SEQ ID NO: 920601 - RNA, 23 nt, Human
gaccugcacugugccuggagcag

SEQ ID NO: 920602 - RNA, 21 nt, Human
gaccuggguggccugccucag

SEQ ID NO: 920603 - RNA, 18 nt, Human
gauggacuugauggaugg

SEQ ID NO: 920604 - RNA, 18 nt, Human
gauggauggccagaaggg

SEQ ID NO: 920605 - RNA, 19 nt, Human
gcacccacagacucugccc

SEQ ID NO: 920606 - RNA, 22 nt, Human
gccaccuccuucagguggacuc

SEQ ID NO: 920607 - RNA, 21 nt, Human
gccagccauggcugcuggugg

SEQ ID NO: 920608 - RNA, 23 nt, Human
gcccaauggcccuccugcagcca

SEQ ID NO: 920609 - RNA, 24 nt, Human
gcccagccugcuaaaggauggaaa

SEQ ID NO: 920610 - RNA, 28 nt, Human
gccccagccccagcccagaggccaggcc

SEQ ID NO: 920611 - RNA, 23 nt, Human
gcggggauggaacugagguggca

SEQ ID NO: 920612 - RNA, 20 nt, Human
gcgugugugcucccagcccc

SEQ ID NO: 920613 - RNA, 21 nt, Human
gcucccagccccagccccagc

SEQ ID NO: 920614 - RNA, 26 nt, Human
gcucucucccccacaggggucuccac

SEQ ID NO: 920615 - RNA, 18 nt, Human
gcugcaguuagcuacuug

SEQ ID NO: 920616 - RNA, 21 nt, Human
ggaaacagggccaaagagaga

SEQ ID NO: 920617 - RNA, 22 nt, Human
ggagaugggagcugcagggggc

SEQ ID NO: 920618 - RNA, 19 nt, Human
ggauggugccucuggccca

SEQ ID NO: 920619 - RNA, 18 nt, Human
ggcaccuggcaccacugg

SEQ ID NO: 920620 - RNA, 22 nt, Human
ggcagauggagggaaagccaga

SEQ ID NO: 920621 - RNA, 23 nt, Human
ggcccagaagccugcaucucacc

SEQ ID NO: 920622 - RNA, 21 nt, Human
ggcccagaaggcccuagggug

SEQ ID NO: 920623 - RNA, 20 nt, Human
ggcccgauauagccguuccc

SEQ ID NO: 920624 - RNA, 18 nt, Human
ggccugccucagcugcuc

SEQ ID NO: 920625 - RNA, 19 nt, Human
ggcugguggucucaggugc

SEQ ID NO: 920626 - RNA, 20 nt, Human
gggaacagggcagaaaggcc

SEQ ID NO: 920627 - RNA, 22 nt, Human
gggagaccucagagcuugcuga

SEQ ID NO: 920628 - RNA, 21 nt, Human
gggccggggugucucccgagg

SEQ ID NO: 920629 - RNA, 22 nt, Human
ggggcuucccacccucccuggg

SEQ ID NO: 920630 - RNA, 23 nt, Human
gggugcccucagccugagagggc

SEQ ID NO: 920631 - RNA, 20 nt, Human
gguggcaccuggcaccacug

SEQ ID NO: 920632 - RNA, 24 nt, Human
gguggcuuggcuaaagccccagcc

SEQ ID NO: 920633 - RNA, 19 nt, Human
ggugggaggaggggcuggc

SEQ ID NO: 920634 - RNA, 18 nt, Human
uaaauuccucuuccacuc

SEQ ID NO: 920635 - RNA, 20 nt, Human
uaccucaagaacaaagugac

SEQ ID NO: 920636 - RNA, 18 nt, Human
uagcccuggguggcaccu

SEQ ID NO: 920637 - RNA, 20 nt, Human
uagcucacugagaggaaggg

SEQ ID NO: 920638 - RNA, 20 nt, Human
uagcugcccagcuccacagu

SEQ ID NO: 920639 - RNA, 22 nt, Human
uagguggcuuggcuaaagcccc

SEQ ID NO: 920640 - RNA, 24 nt, Human
uaggugggaggaggggcuggcuuu

SEQ ID NO: 920641 - RNA, 18 nt, Human
ucaaggaggcaagcacgg

SEQ ID NO: 920642 - RNA, 24 nt, Human
ucacaugacugggcaacugauguc

SEQ ID NO: 920643 - RNA, 26 nt, Human
ucacugagaggaaggggcugcagaaa

SEQ ID NO: 920644 - RNA, 20 nt, Human
ucagcucucccaaaucucuc

SEQ ID NO: 920645 - RNA, 20 nt, Human
ucaggacugucauccaugcc

SEQ ID NO: 920646 - RNA, 23 nt, Human
ucagugggguuggggaacagggc

SEQ ID NO: 920647 - RNA, 21 nt, Human
ucaguuucucugauaagaucu

SEQ ID NO: 920648 - RNA, 21 nt, Human
uccacagucuccacacacuuc

SEQ ID NO: 920649 - RNA, 24 nt, Human
uccaggauuccuucuccuccccgg

SEQ ID NO: 920650 - RNA, 21 nt, Human
ucccacccucccugggggcag

SEQ ID NO: 920651 - RNA, 27 nt, Human
ucccagaaaccccaagugccgccccca

SEQ ID NO: 920652 - RNA, 22 nt, Human
ucccagaagccagcuuccugcc

SEQ ID NO: 920653 - RNA, 20 nt, Human
ucccagccccagccccagcc

SEQ ID NO: 920654 - RNA, 21 nt, Human
ucccagccccagccccagccc

SEQ ID NO: 920655 - RNA, 22 nt, Human
ucccugggggcagccucagaag

SEQ ID NO: 920656 - RNA, 26 nt, Human
uccuucagguggacucucguuggugg

SEQ ID NO: 920657 - RNA, 20 nt, Human
ucgcugaccuuguucccucc

SEQ ID NO: 920658 - RNA, 24 nt, Human
ucucacuccucucccagaagccag

SEQ ID NO: 920659 - RNA, 24 nt, Human
ucucaggugcuaggaaaggcuugg

SEQ ID NO: 920660 - RNA, 25 nt, Human
ucucaucucccucaagaggcuccag

SEQ ID NO: 920661 - RNA, 25 nt, Human
ucucccucaagaggcuccagcuggg

SEQ ID NO: 920662 - RNA, 24 nt, Human
ucucugcagcaggggccuccuggg

SEQ ID NO: 920663 - RNA, 23 nt, Human
ucucuuucaguaaacaaaaguug

SEQ ID NO: 920664 - RNA, 23 nt, Human
ucugcacccacagacucugcccu

SEQ ID NO: 920665 - RNA, 19 nt, Human
ucuuguccaccuuuaccuc

SEQ ID NO: 920666 - RNA, 20 nt, Human
ugaccugugcagcaggccuc

SEQ ID NO: 920667 - RNA, 19 nt, Human
ugagaggaaggggcugcag

SEQ ID NO: 920668 - RNA, 20 nt, Human
ugagaggaaggggcugcaga

SEQ ID NO: 920669 - RNA, 21 nt, Human
ugaggagggcacgaagguccu

SEQ ID NO: 920670 - RNA, 19 nt, Human
ugaggcuccaauuccuggc

SEQ ID NO: 920671 - RNA, 19 nt, Human
ugagguggcaggucccagg

SEQ ID NO: 920672 - RNA, 22 nt, Human
ugagguggcaggucccaggggg

SEQ ID NO: 920673 - RNA, 24 nt, Human
ugagguggcaggucccaggggggc

SEQ ID NO: 920674 - RNA, 18 nt, Human
ugcaaaaaaggaaacagg

SEQ ID NO: 920675 - RNA, 22 nt, Human
ugcacaaggaggcugauggggg

SEQ ID NO: 920676 - RNA, 18 nt, Human
ugcacuggccaccuccuu

SEQ ID NO: 920677 - RNA, 23 nt, Human
ugccauucacugagaccugcacu

SEQ ID NO: 920678 - RNA, 30 nt, Human
ugcccagcuccacagucuccacacacuucc

SEQ ID NO: 920679 - RNA, 23 nt, Human
ugccgcccccaaagcccuggggc

SEQ ID NO: 920680 - RNA, 18 nt, Human
ugccuacccaccaggccc

SEQ ID NO: 920681 - RNA, 21 nt, Human
ugccuaggaauagcuggagau

SEQ ID NO: 920682 - RNA, 24 nt, Human
ugccuaggaauagcuggagauggg

SEQ ID NO: 920683 - RNA, 20 nt, Human
ugccuagggcccagccugcu

SEQ ID NO: 920684 - RNA, 19 nt, Human
ugccucagcugcuccacag

SEQ ID NO: 920685 - RNA, 25 nt, Human
ugccuggagcagguggcccagaagc

SEQ ID NO: 920686 - RNA, 19 nt, Human
ugccugggacgguucugca

SEQ ID NO: 920687 - RNA, 21 nt, Human
ugcuccggccccacgcagccc

SEQ ID NO: 920688 - RNA, 19 nt, Human
ugcugggggcaaacacugg

SEQ ID NO: 920689 - RNA, 23 nt, Human
ugcugggggcaaacacugguggc

SEQ ID NO: 920690 - RNA, 25 nt, Human
ugcuggggucucugaguccucuugg

SEQ ID NO: 920691 - RNA, 19 nt, Human
ugcuggugggggaaggcug

SEQ ID NO: 920692 - RNA, 24 nt, Human
uggagaugggagcugcagggggcu

SEQ ID NO: 920693 - RNA, 21 nt, Human
uggagcagguggcccagaagc

SEQ ID NO: 920694 - RNA, 24 nt, Human
uggauggccagaagggauggugcc

SEQ ID NO: 920695 - RNA, 24 nt, Human
uggcaccacuggccagagcagagu

SEQ ID NO: 920696 - RNA, 19 nt, Human
uggccugccucagcugcuc

SEQ ID NO: 920697 - RNA, 20 nt, Human
uggcugcuggugggggaagg

SEQ ID NO: 920698 - RNA, 24 nt, Human
uggcugggccucaaccugugaccu

SEQ ID NO: 920699 - RNA, 19 nt, Human
ugggaggaggggcuggcuu

SEQ ID NO: 920700 - RNA, 19 nt, Human
ugggaggcugcucagagcc

SEQ ID NO: 920701 - RNA, 23 nt, Human
ugggcagguccuaucggaagcug

SEQ ID NO: 920702 - RNA, 18 nt, Human
uggggauggggaacagag

SEQ ID NO: 920703 - RNA, 23 nt, Human
uggggcagauggagggaaagcca

SEQ ID NO: 920704 - RNA, 22 nt, Human
uggggucucugaguccucuugg

SEQ ID NO: 920705 - RNA, 20 nt, Human
uggggugcccucagccugag

SEQ ID NO: 920706 - RNA, 25 nt, Human
ugguaggaggcaugaggggccgggg

SEQ ID NO: 920707 - RNA, 19 nt, Human
uggucacuugagguggccc

SEQ ID NO: 920708 - RNA, 21 nt, Human
uggugggggaaggcuguuccu

SEQ ID NO: 920709 - RNA, 19 nt, Human
uguagaagcagaagcacau

SEQ ID NO: 920710 - RNA, 18 nt, Human
ugucaggcaggacgcugu

SEQ ID NO: 920711 - RNA, 23 nt, Human
uguccuuguuuugcaaaaaagga

SEQ ID NO: 920712 - RNA, 24 nt, Human
uguccuuguuuugcaaaaaaggaa

SEQ ID NO: 920713 - RNA, 22 nt, Human
uguuguugcauccuuuggagga

SEQ ID NO: 920714 - RNA, 20 nt, Human
uucauaagcagaagacacag

SEQ ID NO: 920715 - RNA, 19 nt, Human
uucccugggcugcaaggga

SEQ ID NO: 920716 - RNA, 23 nt, Human
uuccucuuccacucuugaauccu

SEQ ID NO: 920717 - RNA, 20 nt, Human
uuccugcaggaccugggugg

SEQ ID NO: 920718 - RNA, 23 nt, Human
uucucauagcugcccagcuccac

SEQ ID NO: 920719 - RNA, 22 nt, Human
uucugaucauccuccuccucca

SEQ ID NO: 920720 - RNA, 26 nt, Human
uugaggcugccuuagccaugaggcuc

SEQ ID NO: 920721 - RNA, 30 nt, Human
uuguugcauccuuuggaggaguuccugggg

SEQ ID NO: 920722 - RNA, 19 nt, Human
uuugauccaggauuccuuc

SEQ ID NO: 920723 - RNA, 21 nt, Human
uuuuuuuuuuuuuuuuuccau

SEQ ID NO: 920724 - RNA, 24 nt, Human
aagccaggugagcgugaggccaaa

SEQ ID NO: 920725 - RNA, 18 nt, Human
aaggagccccaggccugc

SEQ ID NO: 920726 - RNA, 19 nt, Human
acagcugggccacggccga

SEQ ID NO: 920727 - RNA, 20 nt, Human
accacggugaagaagguaca

SEQ ID NO: 920728 - RNA, 24 nt, Human
accacggugaagaagguacagaga

SEQ ID NO: 920729 - RNA, 24 nt, Human
acuccauugccacaggggguaugg

SEQ ID NO: 920730 - RNA, 23 nt, Human
acuccugccccuccaggacccac

SEQ ID NO: 920731 - RNA, 23 nt, Human
acuguccugccacgauccaggag

SEQ ID NO: 920732 - RNA, 18 nt, Human
agaaggagccccaggccu

SEQ ID NO: 920733 - RNA, 23 nt, Human
agaaggagccccaggccugcagg

SEQ ID NO: 920734 - RNA, 24 nt, Human
agaaguaaagccaggugagcguga

SEQ ID NO: 920735 - RNA, 18 nt, Human
agacaggaggacagaugg

SEQ ID NO: 920736 - RNA, 21 nt, Human
agcagaguugcuucagguaga

SEQ ID NO: 920737 - RNA, 21 nt, Human
agcauccacacacuccauugc

SEQ ID NO: 920738 - RNA, 24 nt, Human
agcauggugacugcugccacagcc

SEQ ID NO: 920739 - RNA, 22 nt, Human
agccacacacccacccuggcca

SEQ ID NO: 920740 - RNA, 19 nt, Human
agcccagccacccuggggg

SEQ ID NO: 920741 - RNA, 22 nt, Human
agcccagccacccugggggcag

SEQ ID NO: 920742 - RNA, 22 nt, Human
agcccuaggccccauacuuccc

SEQ ID NO: 920743 - RNA, 25 nt, Human
agcucacucuuuuggccaucuccag

SEQ ID NO: 920744 - RNA, 19 nt, Human
aggccugcaggggcaucug

SEQ ID NO: 920745 - RNA, 21 nt, Human
agguaccgguggcugugagcu

SEQ ID NO: 920746 - RNA, 24 nt, Human
agguucccucuguucaggcccacu

SEQ ID NO: 920747 - RNA, 20 nt, Human
auggccaccaccguggaagc

SEQ ID NO: 920748 - RNA, 21 nt, Human
caacggcagccguagaugccc

SEQ ID NO: 920749 - RNA, 23 nt, Human
cacacccacccuggccauaucca

SEQ ID NO: 920750 - RNA, 18 nt, Human
cacccugggggcagaggc

SEQ ID NO: 920751 - RNA, 21 nt, Human
caccucccacucguccuccca

SEQ ID NO: 920752 - RNA, 23 nt, Human
cacggauccaggauccaaagccc

SEQ ID NO: 920753 - RNA, 18 nt, Human
cacuccauugccacaggg

SEQ ID NO: 920754 - RNA, 22 nt, Human
cacuccugccccuccaggaccc

SEQ ID NO: 920755 - RNA, 19 nt, Human
cagacaggaggacagaugg

SEQ ID NO: 920756 - RNA, 19 nt, Human
cagaguugcuucagguaga

SEQ ID NO: 920757 - RNA, 22 nt, Human
cagcagagaacucaggugccuc

SEQ ID NO: 920758 - RNA, 24 nt, Human
cagcagagaacucaggugccuccu

SEQ ID NO: 920759 - RNA, 20 nt, Human
cagcagcaccucccacucgu

SEQ ID NO: 920760 - RNA, 19 nt, Human
cagcagcuguggucacaag

SEQ ID NO: 920761 - RNA, 20 nt, Human
cagcuuguucuucuaaagca

SEQ ID NO: 920762 - RNA, 22 nt, Human
caggacccacggauccaggauc

SEQ ID NO: 920763 - RNA, 22 nt, Human
caggagacagggagucccccuc

SEQ ID NO: 920764 - RNA, 20 nt, Human
caggaugaccaccagcccga

SEQ ID NO: 920765 - RNA, 20 nt, Human
caggcgcccauggaggcccc

SEQ ID NO: 920766 - RNA, 21 nt, Human
caggugggacagacaugucuu

SEQ ID NO: 920767 - RNA, 19 nt, Human
caggugggcccugcccugu

SEQ ID NO: 920768 - RNA, 18 nt, Human
cagucuguggacuccugg

SEQ ID NO: 920769 - RNA, 23 nt, Human
caugcaggaauggcgcugugccc

SEQ ID NO: 920770 - RNA, 21 nt, Human
cauggccaccaccguggaagc

SEQ ID NO: 920771 - RNA, 22 nt, Human
cauugcagcuggcuuccuccug

SEQ ID NO: 920772 - RNA, 24 nt, Human
cauugcagcuggcuuccuccuggg

SEQ ID NO: 920773 - RNA, 24 nt, Human
ccaaaggugaaggugaggagcagg

SEQ ID NO: 920774 - RNA, 21 nt, Human
ccaagcccuaggccccauacu

SEQ ID NO: 920775 - RNA, 28 nt, Human
ccacacacccacccuggccauauccaga

SEQ ID NO: 920776 - RNA, 20 nt, Human
ccacccugggggcagaggcu

SEQ ID NO: 920777 - RNA, 19 nt, Human
ccacggcccuggcgccugg

SEQ ID NO: 920778 - RNA, 20 nt, Human
ccaggagagcauggugacug

SEQ ID NO: 920779 - RNA, 22 nt, Human
ccagucgcuccaguagcccaug

SEQ ID NO: 920780 - RNA, 27 nt, Human
cccacagcugggccacggccggggucc

SEQ ID NO: 920781 - RNA, 21 nt, Human
cccagccacccugggggcaga

SEQ ID NO: 920782 - RNA, 24 nt, Human
cccauggaggcccccagcuugucc

SEQ ID NO: 920783 - RNA, 24 nt, Human
cccgcuccuggggcaggggguugg

SEQ ID NO: 920784 - RNA, 20 nt, Human
cccuaggccccauacuuccc

SEQ ID NO: 920785 - RNA, 23 nt, Human
cccuuucacgcugcccagggucc

SEQ ID NO: 920786 - RNA, 22 nt, Human
ccuaggccccauacuucccaga

SEQ ID NO: 920787 - RNA, 23 nt, Human
ccucaggcgcccauggaggcccc

SEQ ID NO: 920788 - RNA, 21 nt, Human
ccugaaccacuccugccccuc

SEQ ID NO: 920789 - RNA, 21 nt, Human
ccuggaagaagguaccggugg

SEQ ID NO: 920790 - RNA, 19 nt, Human
ccuggcccucaggcgccca

SEQ ID NO: 920791 - RNA, 23 nt, Human
ccuggcgccuggcccucaggccg

SEQ ID NO: 920792 - RNA, 21 nt, Human
cgugucuccacauugcagcug

SEQ ID NO: 920793 - RNA, 22 nt, Human
cuccuggguuaggugacccuuc

SEQ ID NO: 920794 - RNA, 20 nt, Human
cucguaguacugcaggggcu

SEQ ID NO: 920795 - RNA, 21 nt, Human
cucgugcccacggcccuggcc

SEQ ID NO: 920796 - RNA, 20 nt, Human
cuggacaccugggcauggga

SEQ ID NO: 920797 - RNA, 24 nt, Human
cuggccauauccagaacacuucua

SEQ ID NO: 920798 - RNA, 19 nt, Human
cuggccugugggacuccag

SEQ ID NO: 920799 - RNA, 24 nt, Human
cuucccagaaggagccccaggccu

SEQ ID NO: 920800 - RNA, 20 nt, Human
gaaccagaggcgcucccacg

SEQ ID NO: 920801 - RNA, 18 nt, Human
gacauagugccaggacca

SEQ ID NO: 920802 - RNA, 19 nt, Human
gacuccagaaacucaguca

SEQ ID NO: 920803 - RNA, 20 nt, Human
gaggacagauggcacaggug

SEQ ID NO: 920804 - RNA, 25 nt, Human
gaggcugcggcugacaaggggcugg

SEQ ID NO: 920805 - RNA, 20 nt, Human
gcagaaacuauaacagcagc

SEQ ID NO: 920806 - RNA, 21 nt, Human
gcagcuggcuuccuccugggc

SEQ ID NO: 920807 - RNA, 24 nt, Human
gcccacaaggaggcuguggagccc

SEQ ID NO: 920808 - RNA, 20 nt, Human
gcggcugacaaggggcugga

SEQ ID NO: 920809 - RNA, 19 nt, Human
gcuuccaggucgggauaca

SEQ ID NO: 920810 - RNA, 23 nt, Human
gcuuccuccugggcugaaccucc

SEQ ID NO: 920811 - RNA, 21 nt, Human
ggagcgcugguagcgcuucca

SEQ ID NO: 920812 - RNA, 22 nt, Human
ggcugugagcugggcuccugga

SEQ ID NO: 920813 - RNA, 22 nt, Human
ggggcaggauaacagcagagaa

SEQ ID NO: 920814 - RNA, 22 nt, Human
ggguauggcauggcccaugacc

SEQ ID NO: 920815 - RNA, 20 nt, Human
guaguacugcaggggcuggu

SEQ ID NO: 920816 - RNA, 23 nt, Human
gugagcaggacacacaaaggcuc

SEQ ID NO: 920817 - RNA, 19 nt, Human
guuccaagugcuuuccaug

SEQ ID NO: 920818 - RNA, 24 nt, Human
uaccaggcccuguccgaggcccug

SEQ ID NO: 920819 - RNA, 30 nt, Human
uaccaggcccuguccgaggcccuggagacc

SEQ ID NO: 920820 - RNA, 20 nt, Human
uaccaggugggcccugcccu

SEQ ID NO: 920821 - RNA, 19 nt, Human
uagccacacacccacccug

SEQ ID NO: 920822 - RNA, 19 nt, Human
uaggccccauacuucccag

SEQ ID NO: 920823 - RNA, 22 nt, Human
uaggccccauacuucccagaag

SEQ ID NO: 920824 - RNA, 18 nt, Human
uaguacugcaggggcugg

SEQ ID NO: 920825 - RNA, 24 nt, Human
ucagaagagggggaccaagcccua

SEQ ID NO: 920826 - RNA, 26 nt, Human
ucagcagcaccucccacucguccucc

SEQ ID NO: 920827 - RNA, 19 nt, Human
ucaggcccacuuagccacc

SEQ ID NO: 920828 - RNA, 18 nt, Human
ucaggcccgcuccugggg

SEQ ID NO: 920829 - RNA, 22 nt, Human
uccaacgcuggccugugggacu

SEQ ID NO: 920830 - RNA, 21 nt, Human
uccacacacuccauugccaca

SEQ ID NO: 920831 - RNA, 21 nt, Human
uccacagaggcagugauauca

SEQ ID NO: 920832 - RNA, 20 nt, Human
uccagcugcuccuaggggac

SEQ ID NO: 920833 - RNA, 24 nt, Human
uccaggauccaaagcccagccacc

SEQ ID NO: 920834 - RNA, 22 nt, Human
ucccacagcugggccacggccg

SEQ ID NO: 920835 - RNA, 22 nt, Human
ucccagagcacuccgaguucag

SEQ ID NO: 920836 - RNA, 23 nt, Human
ucccagagcacuccgaguucaga

SEQ ID NO: 920837 - RNA, 18 nt, Human
uccugccacgauccagga

SEQ ID NO: 920838 - RNA, 23 nt, Human
ucuaccaggugggcccugcccug

SEQ ID NO: 920839 - RNA, 24 nt, Human
ucugcuggacaccugggcauggga

SEQ ID NO: 920840 - RNA, 19 nt, Human
ucuguaccaggcccugucc

SEQ ID NO: 920841 - RNA, 19 nt, Human
ugacaggaagagcagaguu

SEQ ID NO: 920842 - RNA, 21 nt, Human
ugacugcugccacagccccca

SEQ ID NO: 920843 - RNA, 18 nt, Human
ugaugugggaaccugagg

SEQ ID NO: 920844 - RNA, 23 nt, Human
ugcagcuggcuuccuccugggcu

SEQ ID NO: 920845 - RNA, 18 nt, Human
ugcagggagaggagaugg

SEQ ID NO: 920846 - RNA, 19 nt, Human
ugcagggagaggagauggu

SEQ ID NO: 920847 - RNA, 18 nt, Human
ugccacagcccccacaug

SEQ ID NO: 920848 - RNA, 25 nt, Human
ugcccacggcccuggcgccuggccc

SEQ ID NO: 920849 - RNA, 18 nt, Human
ugcccagaggugcacagc

SEQ ID NO: 920850 - RNA, 20 nt, Human
ugcccugcagggagaucagc

SEQ ID NO: 920851 - RNA, 22 nt, Human
ugccuugaggucugcuggacac

SEQ ID NO: 920852 - RNA, 18 nt, Human
uggaagaagguaccggug

SEQ ID NO: 920853 - RNA, 21 nt, Human
uggaagaagguaccgguggcu

SEQ ID NO: 920854 - RNA, 19 nt, Human
uggaggugucuuguccaca

SEQ ID NO: 920855 - RNA, 23 nt, Human
uggcacagacaggaggacagaug

SEQ ID NO: 920856 - RNA, 18 nt, Human
uggcacaggugagcaucc

SEQ ID NO: 920857 - RNA, 18 nt, Human
uggcccaugacccaucaa

SEQ ID NO: 920858 - RNA, 19 nt, Human
uggcccaugacccaucaaa

SEQ ID NO: 920859 - RNA, 19 nt, Human
uggccugugggacuccaga

SEQ ID NO: 920860 - RNA, 21 nt, Human
uggcucaggcccgcuccuggg

SEQ ID NO: 920861 - RNA, 22 nt, Human
uggcuuccuccugggcugaacc

SEQ ID NO: 920862 - RNA, 26 nt, Human
ugggagcgcugguagcgcuuccaacg

SEQ ID NO: 920863 - RNA, 22 nt, Human
ugggcugaaccuccuugugcuu

SEQ ID NO: 920864 - RNA, 21 nt, Human
uggggcaggauaacagcagag

SEQ ID NO: 920865 - RNA, 20 nt, Human
uggguuggggaggaggacgu

SEQ ID NO: 920866 - RNA, 22 nt, Human
uguccuggggcucagagcagag

SEQ ID NO: 920867 - RNA, 23 nt, Human
ugucucaccauacucgugcccac

SEQ ID NO: 920868 - RNA, 19 nt, Human
ugugcagccagugcagguu

SEQ ID NO: 920869 - RNA, 21 nt, Human
uguggucacaaggauggguac

SEQ ID NO: 920870 - RNA, 21 nt, Human
uuccaccagcucuccuaggcu

SEQ ID NO: 920871 - RNA, 20 nt, Human
uucuguaccaggcccugucc

SEQ ID NO: 920872 - RNA, 24 nt, Human
uugcagcuggcuuccuccugggcu

SEQ ID NO: 920873 - RNA, 22 nt, Human
uuguggacuucccaccagaagu

SEQ ID NO: 920874 - RNA, 24 nt, Human
uuuuuuuuuuuuuuuuuuuucaag

SEQ ID NO: 920875 - RNA, 20 nt, Human
aaggccucccugaacucgcc

SEQ ID NO: 920876 - RNA, 19 nt, Human
acagggggucccacgccug

SEQ ID NO: 920877 - RNA, 22 nt, Human
acaugagcccguucugcagaga

SEQ ID NO: 920878 - RNA, 24 nt, Human
acccccaugggggguggcaggggc

SEQ ID NO: 920879 - RNA, 21 nt, Human
acccugugcccaccuccuuga

SEQ ID NO: 920880 - RNA, 18 nt, Human
accgagacacucugccgg

SEQ ID NO: 920881 - RNA, 24 nt, Human
agcacuuugggaggcugaggcagg

SEQ ID NO: 920882 - RNA, 22 nt, Human
aggcagcaccagcgcagagccc

SEQ ID NO: 920883 - RNA, 20 nt, Human
aggcaggcggaucacgaggu

SEQ ID NO: 920884 - RNA, 24 nt, Human
aggcaggcggaucacgaggucagg

SEQ ID NO: 920885 - RNA, 18 nt, Human
aggcccgaggcagcucga

SEQ ID NO: 920886 - RNA, 19 nt, Human
aggcgaggccgggcccaga

SEQ ID NO: 920887 - RNA, 24 nt, Human
aggcggaucacgaggucaggaguu

SEQ ID NO: 920888 - RNA, 21 nt, Human
aggcugaggcaggcggaucac

SEQ ID NO: 920889 - RNA, 21 nt, Human
aggcugaggcaggcggaucac

SEQ ID NO: 920890 - RNA, 23 nt, Human
agggagcaggcaucagcuccagu

SEQ ID NO: 920891 - RNA, 18 nt, Human
aggggcgggugcgggggu

SEQ ID NO: 920892 - RNA, 21 nt, Human
aggggugacuggcccaggagg

SEQ ID NO: 920893 - RNA, 24 nt, Human
cacccccuaccucacccugugccc

SEQ ID NO: 920894 - RNA, 25 nt, Human
cacccccuaccucacccugugccca

SEQ ID NO: 920895 - RNA, 22 nt, Human
cacgccugucaucccagcacuu

SEQ ID NO: 920896 - RNA, 24 nt, Human
cacgccugucaucccagcacuuug

SEQ ID NO: 920897 - RNA, 24 nt, Human
cagcacuuugggaggcugaggcag

SEQ ID NO: 920898 - RNA, 26 nt, Human
cagcacuuugggaggcugaggcaggc

SEQ ID NO: 920899 - RNA, 25 nt, Human
caggaguucucucucagaccagccu

SEQ ID NO: 920900 - RNA, 20 nt, Human
caggggccucgggcgggcuu

SEQ ID NO: 920901 - RNA, 24 nt, Human
ccaccuggggccaugcccagcugc

SEQ ID NO: 920902 - RNA, 19 nt, Human
ccagaagugccgcgggggc

SEQ ID NO: 920903 - RNA, 20 nt, Human
ccagaagugccgcgggggca

SEQ ID NO: 920904 - RNA, 20 nt, Human
ccaggcacguggcccaugcc

SEQ ID NO: 920905 - RNA, 23 nt, Human
ccaugcccacgacgcccacgacc

SEQ ID NO: 920906 - RNA, 19 nt, Human
cccacgacgcccacgacca

SEQ ID NO: 920907 - RNA, 21 nt, Human
cccacgacgcccacgaccacg

SEQ ID NO: 920908 - RNA, 19 nt, Human
cccccuaccucacccugug

SEQ ID NO: 920909 - RNA, 22 nt, Human
ccccuaccucacccugugccca

SEQ ID NO: 920910 - RNA, 22 nt, Human
ccccuaccucacccugugcccc

SEQ ID NO: 920911 - RNA, 19 nt, Human
ccucccugaacucgccacc

SEQ ID NO: 920912 - RNA, 23 nt, Human
ccuccuugaaggccucccugaac

SEQ ID NO: 920913 - RNA, 22 nt, Human
ccugucaucccagcacuuuggg

SEQ ID NO: 920914 - RNA, 19 nt, Human
cgaggccgggcccagaccc

SEQ ID NO: 920915 - RNA, 21 nt, Human
cgcacgccugucaucccagca

SEQ ID NO: 920916 - RNA, 23 nt, Human
cgccugucaucccagcacuuugg

SEQ ID NO: 920917 - RNA, 19 nt, Human
cgcuccgagacgauggugc

SEQ ID NO: 920918 - RNA, 22 nt, Human
cggaucacgaggucaggaguuc

SEQ ID NO: 920919 - RNA, 21 nt, Human
cguggcccaugcccacgacgc

SEQ ID NO: 920920 - RNA, 20 nt, Human
cuccaguucuucucgaugcc

SEQ ID NO: 920921 - RNA, 19 nt, Human
cucucagaccagccuggcc

SEQ ID NO: 920922 - RNA, 21 nt, Human
cuucacgggccgggugcagug

SEQ ID NO: 920923 - RNA, 20 nt, Human
cuuccugggcucggcugugg

SEQ ID NO: 920924 - RNA, 22 nt, Human
cuucucaaagguagcucccuuc

SEQ ID NO: 920925 - RNA, 25 nt, Human
cuugugccgggccucggucacccuc

SEQ ID NO: 920926 - RNA, 19 nt, Human
gaucacgaggucaggaguu

SEQ ID NO: 920927 - RNA, 18 nt, Human
gcacuucucaaagguagc

SEQ ID NO: 920928 - RNA, 20 nt, Human
gcagagcccugccccagccc

SEQ ID NO: 920929 - RNA, 22 nt, Human
gcagagcccugccccagcccag

SEQ ID NO: 920930 - RNA, 20 nt, Human
gcagcaccagcgcagagccc

SEQ ID NO: 920931 - RNA, 21 nt, Human
gcagcucgaggcgccgcgcgg

SEQ ID NO: 920932 - RNA, 22 nt, Human
gcaggcagcaccagcgcagagc

SEQ ID NO: 920933 - RNA, 19 nt, Human
gcagucuccuacuugugcc

SEQ ID NO: 920934 - RNA, 22 nt, Human
gcccacgaccacggaggggacg

SEQ ID NO: 920935 - RNA, 19 nt, Human
gcccacgacgcccacgacc

SEQ ID NO: 920936 - RNA, 18 nt, Human
ggagacggacggcggggg

SEQ ID NO: 920937 - RNA, 23 nt, Human
ggcccgaggcagcucgaggcgcc

SEQ ID NO: 920938 - RNA, 22 nt, Human
ggcugggggaggggugacuggc

SEQ ID NO: 920939 - RNA, 19 nt, Human
gggaauggcagaacuggga

SEQ ID NO: 920940 - RNA, 23 nt, Human
gggaauggcagaacugggauggc

SEQ ID NO: 920941 - RNA, 18 nt, Human
gggauggcaggcagcacc

SEQ ID NO: 920942 - RNA, 18 nt, Human
gggcaggcgaggccgggc

SEQ ID NO: 920943 - RNA, 20 nt, Human
gggcugggggaggggugacu

SEQ ID NO: 920944 - RNA, 20 nt, Human
ggggacgcacuuccugggcu

SEQ ID NO: 920945 - RNA, 20 nt, Human
ggggugcgcugggggaaugg

SEQ ID NO: 920946 - RNA, 21 nt, Human
gggugcgggggugcgcugggg

SEQ ID NO: 920947 - RNA, 18 nt, Human
ggugcaguggcgcacgcc

SEQ ID NO: 920948 - RNA, 20 nt, Human
ggugcaguggcgcacgccug

SEQ ID NO: 920949 - RNA, 21 nt, Human
ggugcaguggcgcacgccugu

SEQ ID NO: 920950 - RNA, 20 nt, Human
gugcggcggcccauccagua

SEQ ID NO: 920951 - RNA, 24 nt, Human
guggggaaggacaaggggucagua

SEQ ID NO: 920952 - RNA, 21 nt, Human
guucuucucgaugccaggcac

SEQ ID NO: 920953 - RNA, 18 nt, Human
uaccugcucgggccucag

SEQ ID NO: 920954 - RNA, 23 nt, Human
uacugcgcggcgggcagcgacag

SEQ ID NO: 920955 - RNA, 19 nt, Human
uagcccagcaggccgaaga

SEQ ID NO: 920956 - RNA, 24 nt, Human
uauuugggugggcugggggagggg

SEQ ID NO: 920957 - RNA, 18 nt, Human
ucacgaggucaggaguuc

SEQ ID NO: 920958 - RNA, 18 nt, Human
ucagaaaagaccuucacg

SEQ ID NO: 920959 - RNA, 21 nt, Human
ucagaccagccuggccaacau

SEQ ID NO: 920960 - RNA, 18 nt, Human
ucaguaccugcucgggcc

SEQ ID NO: 920961 - RNA, 21 nt, Human
ucccugaacucgccaccuggg

SEQ ID NO: 920962 - RNA, 19 nt, Human
uccucaggggcccgagcgg

SEQ ID NO: 920963 - RNA, 21 nt, Human
ucucaaagguagcucccuuca

SEQ ID NO: 920964 - RNA, 21 nt, Human
ucucucagaccagccuggcca

SEQ ID NO: 920965 - RNA, 20 nt, Human
ucugcagagagagggagcag

SEQ ID NO: 920966 - RNA, 18 nt, Human
ugaacucgccaccugggg

SEQ ID NO: 920967 - RNA, 24 nt, Human
ugaggcaggcggaucacgagguca

SEQ ID NO: 920968 - RNA, 23 nt, Human
ugcagagggucagaccagagcag

SEQ ID NO: 920969 - RNA, 19 nt, Human
uggcccccuccccgacagg

SEQ ID NO: 920970 - RNA, 24 nt, Human
uggcgcacgccugucaucccagca

SEQ ID NO: 920971 - RNA, 18 nt, Human
ugggaggcugaggcaggc

SEQ ID NO: 920972 - RNA, 20 nt, Human
ugggaggcugaggcaggcgg

SEQ ID NO: 920973 - RNA, 24 nt, Human
ugggaggcugaggcaggcggauca

SEQ ID NO: 920974 - RNA, 18 nt, Human
ugggggguggcaggggcc

SEQ ID NO: 920975 - RNA, 20 nt, Human
ugggugggcugggggagggg

SEQ ID NO: 920976 - RNA, 22 nt, Human
uucacggccaaccgagacacuc

SEQ ID NO: 920977 - RNA, 20 nt, Human
uuggcccccuccccgacagg

SEQ ID NO: 920978 - RNA, 25 nt, Human
uugggaggcugaggcaggcggauca

SEQ ID NO: 920979 - RNA, 21 nt, Human
uuuuuuuuuuuuuuuuuucag

SEQ ID NO: 920980 - RNA, 23 nt, Human
acagggcagguccagccuggggc

SEQ ID NO: 920981 - RNA, 25 nt, Human
cacuuuugcacacgcgugcugagga

SEQ ID NO: 920982 - RNA, 18 nt, Human
cagcagcaguccuggggg

SEQ ID NO: 920983 - RNA, 20 nt, Human
cagcagcaguccugggggug

SEQ ID NO: 920984 - RNA, 18 nt, Human
cagcccaaguucagguca

SEQ ID NO: 920985 - RNA, 24 nt, Human
caggcccccagagugggccgaagg

SEQ ID NO: 920986 - RNA, 20 nt, Human
cagggcagguccagccuggg

SEQ ID NO: 920987 - RNA, 18 nt, Human
cagguccagccuggggcc

SEQ ID NO: 920988 - RNA, 18 nt, Human
cccacugcagcauuucca

SEQ ID NO: 920989 - RNA, 19 nt, Human
ccccacugcagcauuucca

SEQ ID NO: 920990 - RNA, 18 nt, Human
ccugaacaaacaccuccg

SEQ ID NO: 920991 - RNA, 23 nt, Human
ccugaacaaacaccuccggguca

SEQ ID NO: 920992 - RNA, 23 nt, Human
cugcagcauuuccaggcccccag

SEQ ID NO: 920993 - RNA, 22 nt, Human
cuggggccugcuccccacugca

SEQ ID NO: 920994 - RNA, 21 nt, Human
gagagccgccugaacaaacac

SEQ ID NO: 920995 - RNA, 20 nt, Human
gagccgccugaacaaacacc

SEQ ID NO: 920996 - RNA, 19 nt, Human
gaguaaaaggcauuuucuu

SEQ ID NO: 920997 - RNA, 21 nt, Human
gccugaacaaacaccuccggg

SEQ ID NO: 920998 - RNA, 18 nt, Human
gccuggggccugcucccc

SEQ ID NO: 920999 - RNA, 21 nt, Human
ggacguguccaggcuccagca

SEQ ID NO: 921000 - RNA, 18 nt, Human
ggcagguccagccugggg

SEQ ID NO: 921001 - RNA, 23 nt, Human
ggccugcuccccacugcagcauu

SEQ ID NO: 921002 - RNA, 26 nt, Human
ucaauggcgucacaguaauccugagc

SEQ ID NO: 921003 - RNA, 22 nt, Human
uccccacugcagcauuuccagg

SEQ ID NO: 921004 - RNA, 18 nt, Human
uccuggggguggggguug

SEQ ID NO: 921005 - RNA, 19 nt, Human
ugaggggccgguccucggg

SEQ ID NO: 921006 - RNA, 20 nt, Human
uggggguggggguugugggc

SEQ ID NO: 921007 - RNA, 22 nt, Human
uguucacuuuugcacacgcgug

SEQ ID NO: 921008 - RNA, 25 nt, Human
uuggcacagaacugcacgaugaggg

SEQ ID NO: 921009 - RNA, 19 nt, Human
uuuccacauuaaguagcag

SEQ ID NO: 921010 - RNA, 21 nt, Human
uuuuuuuuuuuuuuugcaucu

SEQ ID NO: 921011 - RNA, 25 nt, Human
uuuuuuuuuuuuuuugcaucuuuga

SEQ ID NO: 921012 - RNA, 24 nt, Human
aaaaccugguuacuauucucuagg

SEQ ID NO: 921013 - RNA, 22 nt, Human
aaaguuacaaucaacggcugag

SEQ ID NO: 921014 - RNA, 26 nt, Human
aauguuaaaaacaugauuaggaaaaa

SEQ ID NO: 921015 - RNA, 18 nt, Human
accacuuuuuugcaccug

SEQ ID NO: 921016 - RNA, 19 nt, Human
agaaaaagucuggcacgug

SEQ ID NO: 921017 - RNA, 23 nt, Human
agagcuacugguuuaagguacaa

SEQ ID NO: 921018 - RNA, 18 nt, Human
agauacuauaagccauaa

SEQ ID NO: 921019 - RNA, 18 nt, Human
agaugugaccaucuauca

SEQ ID NO: 921020 - RNA, 18 nt, Human
aggauguuugaaccacug

SEQ ID NO: 921021 - RNA, 18 nt, Human
agugcaugcccaccgaua

SEQ ID NO: 921022 - RNA, 18 nt, Human
aguuaaaaacaaaaccug

SEQ ID NO: 921023 - RNA, 25 nt, Human
caauauacuuauuaucacgguuuua

SEQ ID NO: 921024 - RNA, 22 nt, Human
cagaucuaccuaaucagaaucu

SEQ ID NO: 921025 - RNA, 21 nt, Human
cccacucuacccaucccccca

SEQ ID NO: 921026 - RNA, 22 nt, Human
cccccaauaucuauagaacagg

SEQ ID NO: 921027 - RNA, 24 nt, Human
cccccaauaucuauagaacaggau

SEQ ID NO: 921028 - RNA, 22 nt, Human
ccuuaagauaugguagauugca

SEQ ID NO: 921029 - RNA, 24 nt, Human
gcccaccgauaacaaaaucuauua

SEQ ID NO: 921030 - RNA, 21 nt, Human
gcccagggcgcggcccugagc

SEQ ID NO: 921031 - RNA, 21 nt, Human
uaaaauguuaaaaacaugauu

SEQ ID NO: 921032 - RNA, 24 nt, Human
uaagaaaaagucuggcacgugacu

SEQ ID NO: 921033 - RNA, 21 nt, Human
uacuccagaucuaccuaauca

SEQ ID NO: 921034 - RNA, 23 nt, Human
uaggagcuauuauuaagcuuuca

SEQ ID NO: 921035 - RNA, 18 nt, Human
uauuaagcuuucaaucuu

SEQ ID NO: 921036 - RNA, 26 nt, Human
uauuauuaagcuuucaaucuuuggag

SEQ ID NO: 921037 - RNA, 19 nt, Human
uauucagaauuuccuguuc

SEQ ID NO: 921038 - RNA, 21 nt, Human
ucccacucuacccaucccccc

SEQ ID NO: 921039 - RNA, 20 nt, Human
ucuguggcaacaauauacuu

SEQ ID NO: 921040 - RNA, 23 nt, Human
ugcaugcccaccgauaacaaaau

SEQ ID NO: 921041 - RNA, 19 nt, Human
uuaaaguuaaaaacaaaac

SEQ ID NO: 921042 - RNA, 21 nt, Human
uuaaugucauuaaccaaaugg

SEQ ID NO: 921043 - RNA, 20 nt, Human
uucaaaucugaugcucuuac

SEQ ID NO: 921044 - RNA, 21 nt, Human
aaggcagcccuguccccauua

SEQ ID NO: 921045 - RNA, 20 nt, Human
acauuucauagaagugggau

SEQ ID NO: 921046 - RNA, 20 nt, Human
accaagaugguggcugggca

SEQ ID NO: 921047 - RNA, 21 nt, Human
accacgccgugcagccauccc

SEQ ID NO: 921048 - RNA, 21 nt, Human
acccacacugugucaccccca

SEQ ID NO: 921049 - RNA, 19 nt, Human
acccacgaauccucucccu

SEQ ID NO: 921050 - RNA, 22 nt, Human
acccccaggucccccuccccag

SEQ ID NO: 921051 - RNA, 26 nt, Human
acccccaggucccccuccccaguccc

SEQ ID NO: 921052 - RNA, 24 nt, Human
accccgcagcugggaggagggagu

SEQ ID NO: 921053 - RNA, 20 nt, Human
agaaggcagcccugucccca

SEQ ID NO: 921054 - RNA, 18 nt, Human
agacaggaggaucacccg

SEQ ID NO: 921055 - RNA, 18 nt, Human
agacaggaggaucacccg

SEQ ID NO: 921056 - RNA, 24 nt, Human
agacaggaggaucacccgagccca

SEQ ID NO: 921057 - RNA, 19 nt, Human
agagcugggggcucagggc

SEQ ID NO: 921058 - RNA, 25 nt, Human
agauggagaagccagaccccaggug

SEQ ID NO: 921059 - RNA, 21 nt, Human
aggaaagaaauuaaaccaaga

SEQ ID NO: 921060 - RNA, 20 nt, Human
aggagcuggggugacaggug

SEQ ID NO: 921061 - RNA, 21 nt, Human
aggccauguccugaggcucug

SEQ ID NO: 921062 - RNA, 18 nt, Human
aucgaaggggcaggggga

SEQ ID NO: 921063 - RNA, 25 nt, Human
augguggcccacaccuguaauccca

SEQ ID NO: 921064 - RNA, 18 nt, Human
cacaaaucgugcugcugu

SEQ ID NO: 921065 - RNA, 24 nt, Human
cacaccuguaaucccagcaccuug

SEQ ID NO: 921066 - RNA, 21 nt, Human
cacccacacugugucaccccc

SEQ ID NO: 921067 - RNA, 18 nt, Human
caccgcuguacaggugag

SEQ ID NO: 921068 - RNA, 22 nt, Human
caccucaccccgcagcugggag

SEQ ID NO: 921069 - RNA, 19 nt, Human
caccuggcaguggcccugg

SEQ ID NO: 921070 - RNA, 21 nt, Human
caccuggcaguggcccuggcc

SEQ ID NO: 921071 - RNA, 21 nt, Human
caccuguaaucccagcaccuu

SEQ ID NO: 921072 - RNA, 23 nt, Human
caccuguaaucccagcaccuugg

SEQ ID NO: 921073 - RNA, 22 nt, Human
cacugagcgugacauccucaag

SEQ ID NO: 921074 - RNA, 23 nt, Human
cagaagccccucaagggggugug

SEQ ID NO: 921075 - RNA, 20 nt, Human
cagaaggcagcccugucccc

SEQ ID NO: 921076 - RNA, 21 nt, Human
cagaaggcagcccugucccca

SEQ ID NO: 921077 - RNA, 24 nt, Human
cagaggccuucuggcaggagcccg

SEQ ID NO: 921078 - RNA, 18 nt, Human
cagccccucccucccucc

SEQ ID NO: 921079 - RNA, 19 nt, Human
caggucccccuccccaguc

SEQ ID NO: 921080 - RNA, 25 nt, Human
caggugagccccucccagccccucc

SEQ ID NO: 921081 - RNA, 22 nt, Human
ccacaccuguaaucccagcacc

SEQ ID NO: 921082 - RNA, 24 nt, Human
ccacacugugucacccccaguugu

SEQ ID NO: 921083 - RNA, 21 nt, Human
ccagaacauucucaucaccca

SEQ ID NO: 921084 - RNA, 23 nt, Human
ccagccccucccucccucccucc

SEQ ID NO: 921085 - RNA, 23 nt, Human
cccacaccuguaaucccagcacc

SEQ ID NO: 921086 - RNA, 22 nt, Human
ccccucaaggggguguggagau

SEQ ID NO: 921087 - RNA, 19 nt, Human
ccccucccagccccucccu

SEQ ID NO: 921088 - RNA, 21 nt, Human
ccccucccuacaggugagccc

SEQ ID NO: 921089 - RNA, 20 nt, Human
ccccucccucccucccuccc

SEQ ID NO: 921090 - RNA, 22 nt, Human
cccuacaggugagccccuccca

SEQ ID NO: 921091 - RNA, 21 nt, Human
cccuccccagucccggcaccc

SEQ ID NO: 921092 - RNA, 21 nt, Human
cccucgaggccagcuucccag

SEQ ID NO: 921093 - RNA, 22 nt, Human
cccuuugcuccauuuccaagga

SEQ ID NO: 921094 - RNA, 19 nt, Human
ccgcacuguggccuggguc

SEQ ID NO: 921095 - RNA, 22 nt, Human
ccgcuguacaggugagccccuc

SEQ ID NO: 921096 - RNA, 21 nt, Human
ccuccugcgaucgaaggggcu

SEQ ID NO: 921097 - RNA, 20 nt, Human
ccucgaggccaccucacccc

SEQ ID NO: 921098 - RNA, 22 nt, Human
ccucggggacccucgaggccag

SEQ ID NO: 921099 - RNA, 23 nt, Human
ccugcgaucgaaggggccggggc

SEQ ID NO: 921100 - RNA, 18 nt, Human
ccuggccuugcccaccca

SEQ ID NO: 921101 - RNA, 19 nt, Human
ccuucuggcaggagcccgg

SEQ ID NO: 921102 - RNA, 20 nt, Human
ccuucugugucuggugucuc

SEQ ID NO: 921103 - RNA, 24 nt, Human
cucaucacccagaaggcagcccug

SEQ ID NO: 921104 - RNA, 21 nt, Human
cucccugggugucagguuaca

SEQ ID NO: 921105 - RNA, 23 nt, Human
cucucacugagcgugacauccuc

SEQ ID NO: 921106 - RNA, 21 nt, Human
cugucaacgguggccucagag

SEQ ID NO: 921107 - RNA, 21 nt, Human
gagcccgggggauccaggcag

SEQ ID NO: 921108 - RNA, 20 nt, Human
gaucacagcguacccuucug

SEQ ID NO: 921109 - RNA, 23 nt, Human
gcccuggccuugcccacccacac

SEQ ID NO: 921110 - RNA, 19 nt, Human
gcccuggccuugcccaccu

SEQ ID NO: 921111 - RNA, 19 nt, Human
ggagaagccagaccccagg

SEQ ID NO: 921112 - RNA, 23 nt, Human
ggagauggagaagccagacccca

SEQ ID NO: 921113 - RNA, 18 nt, Human
ggaggagggaguggucag

SEQ ID NO: 921114 - RNA, 21 nt, Human
ggcccacaccuguaaucccag

SEQ ID NO: 921115 - RNA, 24 nt, Human
gggcaugguggcccacaccuguaa

SEQ ID NO: 921116 - RNA, 18 nt, Human
ggggguauaccagucacc

SEQ ID NO: 921117 - RNA, 24 nt, Human
gguggcccacaccuguaaucccag

SEQ ID NO: 921118 - RNA, 18 nt, Human
guggcccuggccuugccc

SEQ ID NO: 921119 - RNA, 23 nt, Human
guggcugggcaugguggcccaca

SEQ ID NO: 921120 - RNA, 21 nt, Human
uaagacaggaggaucacccga

SEQ ID NO: 921121 - RNA, 23 nt, Human
uaagacaggaggaucacccgagc

SEQ ID NO: 921122 - RNA, 24 nt, Human
uaagacaggaggaucacccgagcc

SEQ ID NO: 921123 - RNA, 19 nt, Human
uacaggugagccccucccu

SEQ ID NO: 921124 - RNA, 19 nt, Human
uaugcugucaacgguggcc

SEQ ID NO: 921125 - RNA, 21 nt, Human
ucacccccaggucccccuccc

SEQ ID NO: 921126 - RNA, 26 nt, Human
ucagaggccuucuggcaggagcccgg

SEQ ID NO: 921127 - RNA, 20 nt, Human
uccaaggaaagaaauuaaac

SEQ ID NO: 921128 - RNA, 21 nt, Human
uccaaggaaagaaauuaaacc

SEQ ID NO: 921129 - RNA, 18 nt, Human
ucccagccccucccuccc

SEQ ID NO: 921130 - RNA, 18 nt, Human
uccccagucccggcaccc

SEQ ID NO: 921131 - RNA, 22 nt, Human
uccccagucccggcacccacga

SEQ ID NO: 921132 - RNA, 20 nt, Human
ucccuacaggugagccccuc

SEQ ID NO: 921133 - RNA, 21 nt, Human
ucgaggccagcuucccagcac

SEQ ID NO: 921134 - RNA, 18 nt, Human
ugaaagcccuuugcucca

SEQ ID NO: 921135 - RNA, 23 nt, Human
ugacaggugccugcgaccccggc

SEQ ID NO: 921136 - RNA, 18 nt, Human
ugaggagugaggagcugg

SEQ ID NO: 921137 - RNA, 22 nt, Human
ugagugggugaggagugaggag

SEQ ID NO: 921138 - RNA, 18 nt, Human
ugcgugcaggucucaucc

SEQ ID NO: 921139 - RNA, 24 nt, Human
uggaaggcuaagacaggaggauca

SEQ ID NO: 921140 - RNA, 20 nt, Human
uggaauacuaugcagccaug

SEQ ID NO: 921141 - RNA, 20 nt, Human
uggagaagccagaccccagg

SEQ ID NO: 921142 - RNA, 22 nt, Human
uggagauggagaagccagaccc

SEQ ID NO: 921143 - RNA, 21 nt, Human
uggcaguggcccuggccuugc

SEQ ID NO: 921144 - RNA, 24 nt, Human
uggcccacaccuguaaucccagca

SEQ ID NO: 921145 - RNA, 23 nt, Human
uggcugggcaugguggcccacag

SEQ ID NO: 921146 - RNA, 19 nt, Human
ugggcagaugugauuuugg

SEQ ID NO: 921147 - RNA, 21 nt, Human
ugggugaggagugaggagcug

SEQ ID NO: 921148 - RNA, 19 nt, Human
ugucaacgguggccucaga

SEQ ID NO: 921149 - RNA, 19 nt, Human
ugugagugggugaggagug

SEQ ID NO: 921150 - RNA, 23 nt, Human
ugugguaaaauacaaaaucuacc

SEQ ID NO: 921151 - RNA, 22 nt, Human
uucaccacgccgugcagccauc

SEQ ID NO: 921152 - RNA, 19 nt, Human
uugcgugcaggucucaucc

SEQ ID NO: 921153 - RNA, 25 nt, Human
uuggaaggcuaagacaggaggauca

SEQ ID NO: 921154 - RNA, 23 nt, Human
uuuguuuuguuuuguuuauugug

SEQ ID NO: 921155 - RNA, 20 nt, Human
uuuuggggguauaccaguca

SEQ ID NO: 921156 - RNA, 23 nt, Human
uuuuuuuuuuuugguuuuguuuu

SEQ ID NO: 921157 - RNA, 20 nt, Human
uuuuuuuuuuuuuuuuuugg

SEQ ID NO: 921158 - RNA, 24 nt, Human
uuuuuuuuuuuuuuuuuugguuuu

SEQ ID NO: 921159 - RNA, 21 nt, Human
agaaagcgcucccuagccccg

SEQ ID NO: 921160 - RNA, 20 nt, Human
agaggguauccuggccgagg

SEQ ID NO: 921161 - RNA, 18 nt, Human
aggccgcacgcagcccca

SEQ ID NO: 921162 - RNA, 20 nt, Human
auggagcaggucaguggcag

SEQ ID NO: 921163 - RNA, 21 nt, Human
auggcagaggguauccuggcc

SEQ ID NO: 921164 - RNA, 23 nt, Human
caaacugguccgggccacuuggg

SEQ ID NO: 921165 - RNA, 22 nt, Human
cacagccuucagaaagggcagg

SEQ ID NO: 921166 - RNA, 20 nt, Human
caccccggcucugacugucg

SEQ ID NO: 921167 - RNA, 28 nt, Human
cacgcagccccaaacugguccgggccac

SEQ ID NO: 921168 - RNA, 23 nt, Human
cacuccaaccucuuccacagccu

SEQ ID NO: 921169 - RNA, 19 nt, Human
cagaaagggcaggcgcagc

SEQ ID NO: 921170 - RNA, 18 nt, Human
cagccccaaacugguccg

SEQ ID NO: 921171 - RNA, 23 nt, Human
caggaacagucacugucucuccu

SEQ ID NO: 921172 - RNA, 22 nt, Human
cccgcuggcaccccggcucuga

SEQ ID NO: 921173 - RNA, 21 nt, Human
ccuaaagucucucuuccuuca

SEQ ID NO: 921174 - RNA, 28 nt, Human
cgccgaccuacguaccugguugcuugag

SEQ ID NO: 921175 - RNA, 21 nt, Human
cucacacugaagggcagcucc

SEQ ID NO: 921176 - RNA, 22 nt, Human
cucccaccgcagcgccgagcug

SEQ ID NO: 921177 - RNA, 18 nt, Human
cuccccaggccuuuuggc

SEQ ID NO: 921178 - RNA, 18 nt, Human
cucugacugucgcccucc

SEQ ID NO: 921179 - RNA, 24 nt, Human
cugcuugccuaaagucucucuucc

SEQ ID NO: 921180 - RNA, 21 nt, Human
cuugccuaaagucucucuucc

SEQ ID NO: 921181 - RNA, 26 nt, Human
gaaagggcaggcgcagcucugcgaag

SEQ ID NO: 921182 - RNA, 20 nt, Human
gcccacuccaaccucuucca

SEQ ID NO: 921183 - RNA, 22 nt, Human
gcccacuccaaccucuuccaca

SEQ ID NO: 921184 - RNA, 25 nt, Human
gccccaaacugguccgggccacuug

SEQ ID NO: 921185 - RNA, 19 nt, Human
ggaggccccgggacucaga

SEQ ID NO: 921186 - RNA, 22 nt, Human
uaagugccugucacuuugcucc

SEQ ID NO: 921187 - RNA, 18 nt, Human
uauccugauggugugggg

SEQ ID NO: 921188 - RNA, 20 nt, Human
ucccacauaauggagagcuc

SEQ ID NO: 921189 - RNA, 21 nt, Human
ucccgggagaaagcgcucccu

SEQ ID NO: 921190 - RNA, 18 nt, Human
uccuggccgagguccuaa

SEQ ID NO: 921191 - RNA, 21 nt, Human
uccuggccgagguccuaaggc

SEQ ID NO: 921192 - RNA, 26 nt, Human
ucugcagcacgaggaggccccgggac

SEQ ID NO: 921193 - RNA, 18 nt, Human
ugaggaaugggucccaca

SEQ ID NO: 921194 - RNA, 22 nt, Human
ugaggcaggccgcacgcagccc

SEQ ID NO: 921195 - RNA, 18 nt, Human
ugcaucuaagugccuguc

SEQ ID NO: 921196 - RNA, 22 nt, Human
ugccuaaagucucucuuccuuc

SEQ ID NO: 921197 - RNA, 21 nt, Human
uggcagaggguauccuggccg

SEQ ID NO: 921198 - RNA, 21 nt, Human
uggcaggaacagucacugucc

SEQ ID NO: 921199 - RNA, 18 nt, Human
uggccgagguccuaaggc

SEQ ID NO: 921200 - RNA, 22 nt, Human
uggccgcuucgcagaacgacgg

SEQ ID NO: 921201 - RNA, 24 nt, Human
uggcggucgcgucccgcuggcacc

SEQ ID NO: 921202 - RNA, 24 nt, Human
ugggaaggacuguggcaggaacag

SEQ ID NO: 921203 - RNA, 22 nt, Human
ugggcugcuugccuaaagucuc

SEQ ID NO: 921204 - RNA, 18 nt, Human
uggugaggaauggguccc

SEQ ID NO: 921205 - RNA, 22 nt, Human
ugguguggggguguggaacagg

SEQ ID NO: 921206 - RNA, 19 nt, Human
aaagugcuggaauuauagg

SEQ ID NO: 921207 - RNA, 24 nt, Human
aaagugcuggaauuauagguguga

SEQ ID NO: 921208 - RNA, 26 nt, Human
aagugcuggaauuauaggugugagcc

SEQ ID NO: 921209 - RNA, 18 nt, Human
aauuauaggugugagcca

SEQ ID NO: 921210 - RNA, 21 nt, Human
aauuauaggugugagccacca

SEQ ID NO: 921211 - RNA, 18 nt, Human
acaguucacugcagccuc

SEQ ID NO: 921212 - RNA, 24 nt, Human
accucaggcugcugaggggccugg

SEQ ID NO: 921213 - RNA, 24 nt, Human
acuacaggcgcgugccaccacauu

SEQ ID NO: 921214 - RNA, 18 nt, Human
acugcagccucaaccucc

SEQ ID NO: 921215 - RNA, 24 nt, Human
acugcagccucaaccuccuggcuu

SEQ ID NO: 921216 - RNA, 24 nt, Human
agcaccuuucaccuggacaauggc

SEQ ID NO: 921217 - RNA, 22 nt, Human
agguccuuagcaccuuucaccu

SEQ ID NO: 921218 - RNA, 19 nt, Human
aggugugagccaccacgcc

SEQ ID NO: 921219 - RNA, 19 nt, Human
aggugugagccaccacgcc

SEQ ID NO: 921220 - RNA, 19 nt, Human
aguagccacccagaccccc

SEQ ID NO: 921221 - RNA, 23 nt, Human
aguagcugggacuacaggcgcgu

SEQ ID NO: 921222 - RNA, 19 nt, Human
auggggucuugccauguug

SEQ ID NO: 921223 - RNA, 24 nt, Human
auggggucuugccauguugcccag

SEQ ID NO: 921224 - RNA, 24 nt, Human
caaagugcuggaauuauaggugug

SEQ ID NO: 921225 - RNA, 22 nt, Human
caagugauccuccugccucagc

SEQ ID NO: 921226 - RNA, 27 nt, Human
caagugauccuccugccucagccuccc

SEQ ID NO: 921227 - RNA, 27 nt, Human
caagugauccuccugccucagccuccc

SEQ ID NO: 921228 - RNA, 19 nt, Human
cacccagacccccaaauag

SEQ ID NO: 921229 - RNA, 24 nt, Human
caccccagccuuccgaguagcugg

SEQ ID NO: 921230 - RNA, 19 nt, Human
cacugcagccucaaccucc

SEQ ID NO: 921231 - RNA, 22 nt, Human
cagccucaaccuccuggcuuca

SEQ ID NO: 921232 - RNA, 21 nt, Human
cagcuuccuggccaggcuccc

SEQ ID NO: 921233 - RNA, 23 nt, Human
cagcuuccuggccaggcucccag

SEQ ID NO: 921234 - RNA, 23 nt, Human
caggcucccagccuccagccaca

SEQ ID NO: 921235 - RNA, 19 nt, Human
cagguccuuagcaccuuuc

SEQ ID NO: 921236 - RNA, 22 nt, Human
caguagccacccagacccccaa

SEQ ID NO: 921237 - RNA, 24 nt, Human
caguagccacccagacccccaaau

SEQ ID NO: 921238 - RNA, 20 nt, Human
cauagccugggaacaggggg

SEQ ID NO: 921239 - RNA, 23 nt, Human
cauguugcccaggcugguguuga

SEQ ID NO: 921240 - RNA, 24 nt, Human
cauguugcccaggcugguguugaa

SEQ ID NO: 921241 - RNA, 21 nt, Human
ccaaagugcuggaauuauagg

SEQ ID NO: 921242 - RNA, 24 nt, Human
ccaaagugcuggaauuauaggugu

SEQ ID NO: 921243 - RNA, 20 nt, Human
ccaccacauucagcucauuu

SEQ ID NO: 921244 - RNA, 23 nt, Human
ccaccccagccuuccgaguagcu

SEQ ID NO: 921245 - RNA, 20 nt, Human
ccauagccugggaacagggg

SEQ ID NO: 921246 - RNA, 19 nt, Human
ccauguugcccaggcuggu

SEQ ID NO: 921247 - RNA, 23 nt, Human
cccucugcaaggcccuccaguag

SEQ ID NO: 921248 - RNA, 19 nt, Human
ccucaggcugcugaggggc

SEQ ID NO: 921249 - RNA, 21 nt, Human
ccucaggcugcugaggggccu

SEQ ID NO: 921250 - RNA, 24 nt, Human
ccugccucagccucccaaagugcu

SEQ ID NO: 921251 - RNA, 19 nt, Human
ccugcuuucuucuuucugu

SEQ ID NO: 921252 - RNA, 19 nt, Human
ccuggacaauggcgacagc

SEQ ID NO: 921253 - RNA, 23 nt, Human
ccuggccugcuuucuucuuucug

SEQ ID NO: 921254 - RNA, 24 nt, Human
ccuggcuucaagggccaccccagc

SEQ ID NO: 921255 - RNA, 21 nt, Human
ccuggucucaagugauccucc

SEQ ID NO: 921256 - RNA, 22 nt, Human
ccuggucucaagugauccuccu

SEQ ID NO: 921257 - RNA, 23 nt, Human
ccuggucucaagugauccuccug

SEQ ID NO: 921258 - RNA, 18 nt, Human
ccuguucugccccuucac

SEQ ID NO: 921259 - RNA, 20 nt, Human
cucaagugauccuccugccu

SEQ ID NO: 921260 - RNA, 24 nt, Human
cucaagugauccuccugccucagc

SEQ ID NO: 921261 - RNA, 21 nt, Human
cuccuggcuucaagggccacc

SEQ ID NO: 921262 - RNA, 19 nt, Human
cucugucacccaggcugga

SEQ ID NO: 921263 - RNA, 19 nt, Human
cugccccucugcaaggccc

SEQ ID NO: 921264 - RNA, 19 nt, Human
cugccccucugcaaggccc

SEQ ID NO: 921265 - RNA, 24 nt, Human
cugccucagccucccaaagugcug

SEQ ID NO: 921266 - RNA, 22 nt, Human
cuggcuucaagggccaccccag

SEQ ID NO: 921267 - RNA, 23 nt, Human
cuuagcaccuuucaccuggacaa

SEQ ID NO: 921268 - RNA, 21 nt, Human
cuucaagggccaccccagccu

SEQ ID NO: 921269 - RNA, 21 nt, Human
cuuggacucaaaagccauuug

SEQ ID NO: 921270 - RNA, 20 nt, Human
cuuucuguccccacugccac

SEQ ID NO: 921271 - RNA, 22 nt, Human
cuuugaaggacaccaccucagg

SEQ ID NO: 921272 - RNA, 21 nt, Human
gaaccugccuguucugccccu

SEQ ID NO: 921273 - RNA, 21 nt, Human
gacuggacacaagagugggaa

SEQ ID NO: 921274 - RNA, 20 nt, Human
gaguagcugggacuacaggc

SEQ ID NO: 921275 - RNA, 26 nt, Human
gaguagcugggacuacaggcgcgugc

SEQ ID NO: 921276 - RNA, 20 nt, Human
gcccaggcugguguugaauu

SEQ ID NO: 921277 - RNA, 21 nt, Human
ggacaccaccucaggcugcug

SEQ ID NO: 921278 - RNA, 20 nt, Human
gggaacaggggguccugggg

SEQ ID NO: 921279 - RNA, 22 nt, Human
ggggucuugccauguugcccag

SEQ ID NO: 921280 - RNA, 22 nt, Human
gggucuugccauguugcccagg

SEQ ID NO: 921281 - RNA, 24 nt, Human
ggucucaagugauccuccugccuc

SEQ ID NO: 921282 - RNA, 24 nt, Human
ggucucugucacccaggcuggagu

SEQ ID NO: 921283 - RNA, 19 nt, Human
guccugggucgagggaacc

SEQ ID NO: 921284 - RNA, 21 nt, Human
gucucugucacccaggcugga

SEQ ID NO: 921285 - RNA, 24 nt, Human
gucuugccauguugcccaggcugg

SEQ ID NO: 921286 - RNA, 24 nt, Human
gugauccuccugccucagccuccc

SEQ ID NO: 921287 - RNA, 20 nt, Human
uacaggcgcgugccaccaca

SEQ ID NO: 921288 - RNA, 19 nt, Human
uagaaauggggucuugcca

SEQ ID NO: 921289 - RNA, 22 nt, Human
uagaaauggggucuugccaugu

SEQ ID NO: 921290 - RNA, 20 nt, Human
uaggggucgcaagcacgggg

SEQ ID NO: 921291 - RNA, 23 nt, Human
uauaggugugagccaccacgccu

SEQ ID NO: 921292 - RNA, 20 nt, Human
ucaagggccaccccagccuu

SEQ ID NO: 921293 - RNA, 19 nt, Human
ucacugcagccucaaccuc

SEQ ID NO: 921294 - RNA, 23 nt, Human
ucacugcagccucaaccuccugg

SEQ ID NO: 921295 - RNA, 24 nt, Human
ucacugcagccucaaccuccuggc

SEQ ID NO: 921296 - RNA, 20 nt, Human
ucagggauuugcaggaagca

SEQ ID NO: 921297 - RNA, 19 nt, Human
ucagucacaguucacugca

SEQ ID NO: 921298 - RNA, 23 nt, Human
ucccaaagugcuggaauuauagg

SEQ ID NO: 921299 - RNA, 23 nt, Human
uccgaguagcugggacuacaggc

SEQ ID NO: 921300 - RNA, 24 nt, Human
uccgaguagcugggacuacaggcg

SEQ ID NO: 921301 - RNA, 27 nt, Human
uccuccugccucagccucccaaagugc

SEQ ID NO: 921302 - RNA, 18 nt, Human
uccugggucgagggaacc

SEQ ID NO: 921303 - RNA, 25 nt, Human
ucucugucacccaggcuggaguaua

SEQ ID NO: 921304 - RNA, 18 nt, Human
ucugucacccaggcugga

SEQ ID NO: 921305 - RNA, 20 nt, Human
ucuucuuucuguccccacug

SEQ ID NO: 921306 - RNA, 23 nt, Human
ucuugccauguugcccaggcugg

SEQ ID NO: 921307 - RNA, 24 nt, Human
ucuugccauguugcccaggcuggu

SEQ ID NO: 921308 - RNA, 21 nt, Human
ugaugcagugcucugcucuuu

SEQ ID NO: 921309 - RNA, 19 nt, Human
ugccagccgucacgcugcg

SEQ ID NO: 921310 - RNA, 18 nt, Human
ugccauguugcccaggcu

SEQ ID NO: 921311 - RNA, 21 nt, Human
ugccauguugcccaggcuggu

SEQ ID NO: 921312 - RNA, 24 nt, Human
ugcccaggcugguguugaauuccu

SEQ ID NO: 921313 - RNA, 24 nt, Human
ugccucagccucccaaagugcugg

SEQ ID NO: 921314 - RNA, 18 nt, Human
uggaauuauaggugugag

SEQ ID NO: 921315 - RNA, 19 nt, Human
uggaauuauaggugugagc

SEQ ID NO: 921316 - RNA, 22 nt, Human
uggaauuauaggugugagccac

SEQ ID NO: 921317 - RNA, 24 nt, Human
uggaauuauaggugugagccacca

SEQ ID NO: 921318 - RNA, 22 nt, Human
uggccaggcucccagccuccag

SEQ ID NO: 921319 - RNA, 24 nt, Human
uggccaggcucccagccuccagcc

SEQ ID NO: 921320 - RNA, 21 nt, Human
ugggaaaauccauuuguuugg

SEQ ID NO: 921321 - RNA, 20 nt, Human
ugggaacaggggguccuggg

SEQ ID NO: 921322 - RNA, 21 nt, Human
ugggacuacaggcgcgugcca

SEQ ID NO: 921323 - RNA, 22 nt, Human
ugggacuacaggcgcgugccac

SEQ ID NO: 921324 - RNA, 24 nt, Human
ugggacuacaggcgcgugccacca

SEQ ID NO: 921325 - RNA, 24 nt, Human
uggggucuugccauguugcccagg

SEQ ID NO: 921326 - RNA, 18 nt, Human
ugggucgagggaaccugc

SEQ ID NO: 921327 - RNA, 24 nt, Human
ugggucucugucacccaggcugga

SEQ ID NO: 921328 - RNA, 23 nt, Human
uggucucaagugauccuccugcc

SEQ ID NO: 921329 - RNA, 24 nt, Human
uggucucaagugauccuccugccu

SEQ ID NO: 921330 - RNA, 24 nt, Human
uguagaaauggggucuugccaugu

SEQ ID NO: 921331 - RNA, 22 nt, Human
ugucaugguccugccuucucug

SEQ ID NO: 921332 - RNA, 21 nt, Human
ugugagccaccacgccuggcc

SEQ ID NO: 921333 - RNA, 20 nt, Human
uuagcaccuuucaccuggac

SEQ ID NO: 921334 - RNA, 24 nt, Human
uucacugcagccucaaccuccugg

SEQ ID NO: 921335 - RNA, 24 nt, Human
uuccgaguagcugggacuacaggc

SEQ ID NO: 921336 - RNA, 24 nt, Human
uuguagaaauggggucuugccaug

SEQ ID NO: 921337 - RNA, 24 nt, Human
uuuguagaaauggggucuugccau

SEQ ID NO: 921338 - RNA, 21 nt, Human
uuuuuuuuuuuuagguacuca

SEQ ID NO: 921339 - RNA, 23 nt, Human
uuuuuuuuuuuuuuuuuuuuagg

SEQ ID NO: 921340 - RNA, 26 nt, Human
acacaacuccuuuaugaaaggaaacc

SEQ ID NO: 921341 - RNA, 24 nt, Human
acuggaguggaagggcuggggaca

SEQ ID NO: 921342 - RNA, 23 nt, Human
augaaaggaaaccgagggccaca

SEQ ID NO: 921343 - RNA, 22 nt, Human
ccgcugcuccggugcggcuugg

SEQ ID NO: 921344 - RNA, 22 nt, Human
ggaguggaagggcuggggacac

SEQ ID NO: 921345 - RNA, 20 nt, Human
ggcuggggacacaacuccuu

SEQ ID NO: 921346 - RNA, 18 nt, Human
gggcuggggacacaacuc

SEQ ID NO: 921347 - RNA, 19 nt, Human
uacuggaguggaagggcug

SEQ ID NO: 921348 - RNA, 21 nt, Human
ugaaaggaaaccgagggccac

SEQ ID NO: 921349 - RNA, 23 nt, Human
uggaagggcuggggacacaacuc

SEQ ID NO: 921350 - RNA, 19 nt, Human
aacuauguacacacaaagu

SEQ ID NO: 921351 - RNA, 18 nt, Human
acaaagugugcauccaag

SEQ ID NO: 921352 - RNA, 23 nt, Human
acucucgcuuuaaggauggggac

SEQ ID NO: 921353 - RNA, 21 nt, Human
agaaagaugcauccucuugcc

SEQ ID NO: 921354 - RNA, 21 nt, Human
agccgcggcagcucuguagcc

SEQ ID NO: 921355 - RNA, 22 nt, Human
agcucuguagccucaggaccuc

SEQ ID NO: 921356 - RNA, 19 nt, Human
aguugacuacaaaugccug

SEQ ID NO: 921357 - RNA, 25 nt, Human
auagcagcagcagaagucuuuaaag

SEQ ID NO: 921358 - RNA, 23 nt, Human
cacacaaagugugcauccaagag

SEQ ID NO: 921359 - RNA, 24 nt, Human
caccaggaagaaagaugcauccuc

SEQ ID NO: 921360 - RNA, 22 nt, Human
cagcaauggcgcccggggcccu

SEQ ID NO: 921361 - RNA, 18 nt, Human
cagcgcaggaccgggcag

SEQ ID NO: 921362 - RNA, 21 nt, Human
caggaccgggcagcgcgcggg

SEQ ID NO: 921363 - RNA, 25 nt, Human
cauauuacauacauguuuauacaua

SEQ ID NO: 921364 - RNA, 24 nt, Human
ccacugaguuaaagguaacuaugu

SEQ ID NO: 921365 - RNA, 19 nt, Human
ccgagcuacggccccuccc

SEQ ID NO: 921366 - RNA, 19 nt, Human
ccggaggaggagagcagcc

SEQ ID NO: 921367 - RNA, 23 nt, Human
ccucccgcugagcagcgcaggac

SEQ ID NO: 921368 - RNA, 23 nt, Human
cgccagcaauggcgcccggggcc

SEQ ID NO: 921369 - RNA, 21 nt, Human
cggccccgagcuacggccccu

SEQ ID NO: 921370 - RNA, 20 nt, Human
cgggccggggcuggcgacgg

SEQ ID NO: 921371 - RNA, 18 nt, Human
cguccggaucccggcgcu

SEQ ID NO: 921372 - RNA, 23 nt, Human
cuacggccccucccagccggagg

SEQ ID NO: 921373 - RNA, 21 nt, Human
cuuguggcaaucauuuuccuu

SEQ ID NO: 921374 - RNA, 18 nt, Human
gaaucaccaaaaucaaga

SEQ ID NO: 921375 - RNA, 23 nt, Human
gacucucgcuuuaaggaugggga

SEQ ID NO: 921376 - RNA, 22 nt, Human
ggcgggcugagaccgggcggcg

SEQ ID NO: 921377 - RNA, 25 nt, Human
gggcugagaccgggcggcgcuccca

SEQ ID NO: 921378 - RNA, 22 nt, Human
uaaaucaaacaucauucauaga

SEQ ID NO: 921379 - RNA, 24 nt, Human
uagaaaacaggccagcuucaccug

SEQ ID NO: 921380 - RNA, 21 nt, Human
uauguacacacaaagugugca

SEQ ID NO: 921381 - RNA, 21 nt, Human
ucccagccggaggaggagagc

SEQ ID NO: 921382 - RNA, 21 nt, Human
uccccucacagcccccgcgaa

SEQ ID NO: 921383 - RNA, 24 nt, Human
ucucccacaggcggggcguccaga

SEQ ID NO: 921384 - RNA, 23 nt, Human
ugagcagcgcaggaccgggcagc

SEQ ID NO: 921385 - RNA, 22 nt, Human
ugaguuaaagguaacuauguac

SEQ ID NO: 921386 - RNA, 21 nt, Human
ugcccgggcugcccggcaagg

SEQ ID NO: 921387 - RNA, 23 nt, Human
ugcccgggcugcccggcaagggc

SEQ ID NO: 921388 - RNA, 21 nt, Human
ugccgaggcgcucgugugcca

SEQ ID NO: 921389 - RNA, 20 nt, Human
uguagagucagcuaaaggaa

SEQ ID NO: 921390 - RNA, 23 nt, Human
uguuugcugccagccucuacuug

SEQ ID NO: 921391 - RNA, 21 nt, Human
uuacuuucuuuucucuuagga

SEQ ID NO: 921392 - RNA, 19 nt, Human
uuccuuuagaaaacaggcc

SEQ ID NO: 921393 - RNA, 19 nt, Human
uugcuccccguccggaucc

SEQ ID NO: 921394 - RNA, 21 nt, Human
uugguucucccauacauuuua

SEQ ID NO: 921395 - RNA, 24 nt, Human
uuugguggaaggcuuggaguuuuu

SEQ ID NO: 921396 - RNA, 20 nt, Human
aaaaacagcucaggaggugg

SEQ ID NO: 921397 - RNA, 20 nt, Human
acccaggcgcccgggucgcc

SEQ ID NO: 921398 - RNA, 18 nt, Human
agugcagccggggcugcc

SEQ ID NO: 921399 - RNA, 23 nt, Human
cacacccaggcgcccgggucgcc

SEQ ID NO: 921400 - RNA, 24 nt, Human
cacacccaggcgcccgggucgccu

SEQ ID NO: 921401 - RNA, 19 nt, Human
cagcucaggaggugggugg

SEQ ID NO: 921402 - RNA, 19 nt, Human
ccccggcuccgggcgcggc

SEQ ID NO: 921403 - RNA, 27 nt, Human
cccgcgaagacgucccgcaacagcagc

SEQ ID NO: 921404 - RNA, 22 nt, Human
cggcuagagugcagccggggcu

SEQ ID NO: 921405 - RNA, 23 nt, Human
cuccugcgcgccucugcuuuccu

SEQ ID NO: 921406 - RNA, 19 nt, Human
cucggccaccuuccccucg

SEQ ID NO: 921407 - RNA, 22 nt, Human
cuggcugcggcgcgagccuccc

SEQ ID NO: 921408 - RNA, 21 nt, Human
gaagagagccagaucccgucg

SEQ ID NO: 921409 - RNA, 18 nt, Human
gagugcagccggggcugc

SEQ ID NO: 921410 - RNA, 22 nt, Human
gcaacagcagccacacacccag

SEQ ID NO: 921411 - RNA, 22 nt, Human
gcgcgcuguuguggcgcgcguc

SEQ ID NO: 921412 - RNA, 24 nt, Human
gcgcgcuguuguggcgcgcgucug

SEQ ID NO: 921413 - RNA, 21 nt, Human
gcggcuagagugcagccgggg

SEQ ID NO: 921414 - RNA, 18 nt, Human
gcuccuccugcgcgccuc

SEQ ID NO: 921415 - RNA, 19 nt, Human
gcugcggcgcgagccuccc

SEQ ID NO: 921416 - RNA, 19 nt, Human
ggagagcagcaagaacuug

SEQ ID NO: 921417 - RNA, 23 nt, Human
gucaacccuaaaucguucuaaag

SEQ ID NO: 921418 - RNA, 21 nt, Human
ucggccccggcuccgggcgcg

SEQ ID NO: 921419 - RNA, 27 nt, Human
ugccuccaacugcagaaggugguguuu

SEQ ID NO: 921420 - RNA, 20 nt, Human
ugcgcagcuuggggcgcgcu

SEQ ID NO: 921421 - RNA, 22 nt, Human
uuugcagagcugcgcagcuugg

SEQ ID NO: 921422 - RNA, 19 nt, Human
aaacaggugcccuauuuua

SEQ ID NO: 921423 - RNA, 18 nt, Human
aaaugcugagggcuaccc

SEQ ID NO: 921424 - RNA, 19 nt, Human
aaccccauaaaaagaaggg

SEQ ID NO: 921425 - RNA, 19 nt, Human
aagaaggggauauuugggg

SEQ ID NO: 921426 - RNA, 21 nt, Human
aagaaggggauauuuggggac

SEQ ID NO: 921427 - RNA, 28 nt, Human
agcuggacucacagcagcucccugccug

SEQ ID NO: 921428 - RNA, 23 nt, Human
auuacauuuuacaaaacagcaac

SEQ ID NO: 921429 - RNA, 21 nt, Human
cagcggaaccgcucacugcuc

SEQ ID NO: 921430 - RNA, 19 nt, Human
cagcuggacucacagcagc

SEQ ID NO: 921431 - RNA, 19 nt, Human
cagggcagggggcagcgga

SEQ ID NO: 921432 - RNA, 23 nt, Human
ccacauauacauuacauuuuaca

SEQ ID NO: 921433 - RNA, 18 nt, Human
ccccauaaaaagaagggg

SEQ ID NO: 921434 - RNA, 22 nt, Human
ccccuccaaaugcugagggcua

SEQ ID NO: 921435 - RNA, 18 nt, Human
cccucagugccuaaccag

SEQ ID NO: 921436 - RNA, 21 nt, Human
ccguccagaacccucagugcc

SEQ ID NO: 921437 - RNA, 21 nt, Human
cgacgggaacagguuccccuc

SEQ ID NO: 921438 - RNA, 21 nt, Human
cgggaacagguuccccuccaa

SEQ ID NO: 921439 - RNA, 20 nt, Human
cuggagggaccaccugggug

SEQ ID NO: 921440 - RNA, 21 nt, Human
gacccccgacgccggucccag

SEQ ID NO: 921441 - RNA, 18 nt, Human
gacucacagcagcucccu

SEQ ID NO: 921442 - RNA, 24 nt, Human
gaucucucggucccuuccuuaacc

SEQ ID NO: 921443 - RNA, 18 nt, Human
gcccaggguuccuggagc

SEQ ID NO: 921444 - RNA, 23 nt, Human
ggaaccgcucacugcucccauca

SEQ ID NO: 921445 - RNA, 25 nt, Human
uaaaaaccacauauacaaccuucag

SEQ ID NO: 921446 - RNA, 23 nt, Human
uaaccccauaaaaagaaggggau

SEQ ID NO: 921447 - RNA, 21 nt, Human
ugaucucucggucccuuccuu

SEQ ID NO: 921448 - RNA, 18 nt, Human
ugccuaaccaggcuggag

SEQ ID NO: 921449 - RNA, 20 nt, Human
ugcucccaucagcccagggu

SEQ ID NO: 921450 - RNA, 21 nt, Human
ugcugagggcuacccaggcau

SEQ ID NO: 921451 - RNA, 21 nt, Human
uuccccuccaaaugcugaggg

SEQ ID NO: 921452 - RNA, 20 nt, Human
uuuuuuuuugugaaacaggg

SEQ ID NO: 921453 - RNA, 22 nt, Human
uuuuuuuuuugugaaacaggug

SEQ ID NO: 921454 - RNA, 25 nt, Human
uuuuuuuuuuugugaaacaggugcc

SEQ ID NO: 921455 - RNA, 18 nt, Human
uuuuuuuuuuuuuuuuug

SEQ ID NO: 921456 - RNA, 19 nt, Human
uuuuuuuuuuuuuuuuugu

SEQ ID NO: 921457 - RNA, 21 nt, Human
caagauuaaagauuccacugg

SEQ ID NO: 921458 - RNA, 21 nt, Human
cauaggauuuauacauacaag

SEQ ID NO: 921459 - RNA, 21 nt, Human
cccacgccgcggccccggggc

SEQ ID NO: 921460 - RNA, 25 nt, Human
ccccacgccgcggccccggggcccc

SEQ ID NO: 921461 - RNA, 18 nt, Human
ccccggggcccgccgccc

SEQ ID NO: 921462 - RNA, 24 nt, Human
cccgcggccggacacuggcggagc

SEQ ID NO: 921463 - RNA, 21 nt, Human
cggcguccgccugcccgcccc

SEQ ID NO: 921464 - RNA, 25 nt, Human
gaaagacuaaaauuagguauaagaa

SEQ ID NO: 921465 - RNA, 18 nt, Human
gcccgccccacgccgcgg

SEQ ID NO: 921466 - RNA, 25 nt, Human
gguauaagaacaugauuugaaagga

SEQ ID NO: 921467 - RNA, 24 nt, Human
uacaagcauuacaguacauucauu

SEQ ID NO: 921468 - RNA, 20 nt, Human
uacauacaagcauuacagua

SEQ ID NO: 921469 - RNA, 20 nt, Human
uacauacaagcauuacagua

SEQ ID NO: 921470 - RNA, 19 nt, Human
ugaaagacuaaaauuaggu

SEQ ID NO: 921471 - RNA, 21 nt, Human
uguuggauucaaaugcugcau

SEQ ID NO: 921472 - RNA, 20 nt, Human
aauugaucaaugacaaccgc

SEQ ID NO: 921473 - RNA, 19 nt, Human
aggagaagggaggcucaca

SEQ ID NO: 921474 - RNA, 19 nt, Human
cacccagcacuccuggacc

SEQ ID NO: 921475 - RNA, 19 nt, Human
cacuccuggaccauuuccc

SEQ ID NO: 921476 - RNA, 19 nt, Human
cagugcugccuccuuugag

SEQ ID NO: 921477 - RNA, 23 nt, Human
cucacacccagcacuccuggacc

SEQ ID NO: 921478 - RNA, 22 nt, Human
gagaagggaggcucacacccag

SEQ ID NO: 921479 - RNA, 24 nt, Human
ggcagccggugaggacgcuacagc

SEQ ID NO: 921480 - RNA, 19 nt, Human
ggcucacacccagcacucc

SEQ ID NO: 921481 - RNA, 24 nt, Human
ggucagugcugccuccuuugagug

SEQ ID NO: 921482 - RNA, 21 nt, Human
uccggcuugaggagaagggag

SEQ ID NO: 921483 - RNA, 23 nt, Human
uuucacaaagguuuucacugcuc

SEQ ID NO: 921484 - RNA, 18 nt, Human
aaaccccagccacaucca

SEQ ID NO: 921485 - RNA, 18 nt, Human
aaagaagugaggcagagg

SEQ ID NO: 921486 - RNA, 22 nt, Human
aaagcagcugcuccagccaccu

SEQ ID NO: 921487 - RNA, 21 nt, Human
aaaugacccuuucuuggaagg

SEQ ID NO: 921488 - RNA, 22 nt, Human
aacaccucccugcaacacuucu

SEQ ID NO: 921489 - RNA, 19 nt, Human
aacccagaaggaggaagcc

SEQ ID NO: 921490 - RNA, 18 nt, Human
aagagaguggcugccuuc

SEQ ID NO: 921491 - RNA, 20 nt, Human
aagcagcugcuccagccacc

SEQ ID NO: 921492 - RNA, 23 nt, Human
aagcagcugcuccagccaccugu

SEQ ID NO: 921493 - RNA, 23 nt, Human
aaggaccaucccagccuguggcc

SEQ ID NO: 921494 - RNA, 18 nt, Human
aaucccuccaucuccacu

SEQ ID NO: 921495 - RNA, 24 nt, Human
aauggggccuucaguagcccuucc

SEQ ID NO: 921496 - RNA, 26 nt, Human
acacacccacacucacacccacccac

SEQ ID NO: 921497 - RNA, 20 nt, Human
accaaaucaggaccuguauc

SEQ ID NO: 921498 - RNA, 24 nt, Human
accaagacaacagccuuccaucac

SEQ ID NO: 921499 - RNA, 24 nt, Human
accaaucuuaggaaucuccaucau

SEQ ID NO: 921500 - RNA, 27 nt, Human
acccacacacacccauacacccauucc

SEQ ID NO: 921501 - RNA, 23 nt, Human
accccaagagaaugggggcagga

SEQ ID NO: 921502 - RNA, 22 nt, Human
accucagucuuccuccucccag

SEQ ID NO: 921503 - RNA, 26 nt, Human
accucagucuuccuccucccagccuc

SEQ ID NO: 921504 - RNA, 24 nt, Human
acguacacacccacacucacaccc

SEQ ID NO: 921505 - RNA, 19 nt, Human
acuuugaugaagcccucgg

SEQ ID NO: 921506 - RNA, 26 nt, Human
agaacucaaggugauccuccggccgg

SEQ ID NO: 921507 - RNA, 23 nt, Human
agaaucccaagcauggacaaccu

SEQ ID NO: 921508 - RNA, 22 nt, Human
agaggagccugugaaacccaga

SEQ ID NO: 921509 - RNA, 20 nt, Human
agccaccuguaggauggcac

SEQ ID NO: 921510 - RNA, 25 nt, Human
agcugcccuucucuccuucccccag

SEQ ID NO: 921511 - RNA, 20 nt, Human
agcugcuccagccaccugua

SEQ ID NO: 921512 - RNA, 21 nt, Human
agcugcuccagccaccuguag

SEQ ID NO: 921513 - RNA, 18 nt, Human
aggaaaccccagccacau

SEQ ID NO: 921514 - RNA, 22 nt, Human
aggaaggggaacgagcaagagg

SEQ ID NO: 921515 - RNA, 23 nt, Human
aggaaggggaacgagcaagaggg

SEQ ID NO: 921516 - RNA, 22 nt, Human
aggcuaccagaggccauuggcu

SEQ ID NO: 921517 - RNA, 20 nt, Human
agggaugcugggagcagagc

SEQ ID NO: 921518 - RNA, 19 nt, Human
aggugaucagguugcaaag

SEQ ID NO: 921519 - RNA, 18 nt, Human
aggugcucugaauggacc

SEQ ID NO: 921520 - RNA, 18 nt, Human
auagcccagcaggagcuc

SEQ ID NO: 921521 - RNA, 19 nt, Human
auccauuacccagggaugg

SEQ ID NO: 921522 - RNA, 21 nt, Human
caaagcagcugcuccagccac

SEQ ID NO: 921523 - RNA, 20 nt, Human
caagauccgcacaaccuccc

SEQ ID NO: 921524 - RNA, 26 nt, Human
caagauccgcacaaccucccuucccc

SEQ ID NO: 921525 - RNA, 18 nt, Human
caagggauacaccaagac

SEQ ID NO: 921526 - RNA, 22 nt, Human
cacacccacccacacacaccca

SEQ ID NO: 921527 - RNA, 21 nt, Human
caccaagacaacagccuucca

SEQ ID NO: 921528 - RNA, 20 nt, Human
cacccacacacacccauaca

SEQ ID NO: 921529 - RNA, 19 nt, Human
cacccacccacacacaccu

SEQ ID NO: 921530 - RNA, 25 nt, Human
cacucacacccacccacacacaccc

SEQ ID NO: 921531 - RNA, 25 nt, Human
cacugcacuggccccuauccaagaa

SEQ ID NO: 921532 - RNA, 25 nt, Human
cagaguucucuucuuaacaccuccc

SEQ ID NO: 921533 - RNA, 24 nt, Human
cagccagacguggauagacacccu

SEQ ID NO: 921534 - RNA, 19 nt, Human
cagcccaucaagagcaccc

SEQ ID NO: 921535 - RNA, 22 nt, Human
caggaccuguaucccucagcuu

SEQ ID NO: 921536 - RNA, 22 nt, Human
caggcaccuugguaggaugagg

SEQ ID NO: 921537 - RNA, 22 nt, Human
cagggcaaccggaaagucacgg

SEQ ID NO: 921538 - RNA, 19 nt, Human
cagguccugggcagcacug

SEQ ID NO: 921539 - RNA, 21 nt, Human
caggugccauugcuccuucug

SEQ ID NO: 921540 - RNA, 19 nt, Human
ccaaacuugacuuugggcu

SEQ ID NO: 921541 - RNA, 23 nt, Human
ccacaauaccaggaaaccccagc

SEQ ID NO: 921542 - RNA, 20 nt, Human
ccagaggccauuggcucucc

SEQ ID NO: 921543 - RNA, 19 nt, Human
ccagcccaucaagagcacc

SEQ ID NO: 921544 - RNA, 22 nt, Human
cccacacacacccauacaccca

SEQ ID NO: 921545 - RNA, 22 nt, Human
cccagccccucccugaccccaa

SEQ ID NO: 921546 - RNA, 27 nt, Human
ccccaccacaccagugaugggccucuc

SEQ ID NO: 921547 - RNA, 24 nt, Human
cccuccaucuccacucccagcaac

SEQ ID NO: 921548 - RNA, 20 nt, Human
cccucgguuccaucauccca

SEQ ID NO: 921549 - RNA, 21 nt, Human
ccuccacaauaccaggaaacc

SEQ ID NO: 921550 - RNA, 20 nt, Human
ccucccugcaacacuucuca

SEQ ID NO: 921551 - RNA, 26 nt, Human
ccugaccccaagagaaugggggcagg

SEQ ID NO: 921552 - RNA, 21 nt, Human
ccugcaagccuagucccugcu

SEQ ID NO: 921553 - RNA, 19 nt, Human
ccugcccaccaaaauagcc

SEQ ID NO: 921554 - RNA, 19 nt, Human
ccuggcccauuaucucacc

SEQ ID NO: 921555 - RNA, 21 nt, Human
ccuggcccauuaucucaccug

SEQ ID NO: 921556 - RNA, 19 nt, Human
cgcacaaccucccuucccc

SEQ ID NO: 921557 - RNA, 19 nt, Human
cuaaagaagugaggcagag

SEQ ID NO: 921558 - RNA, 23 nt, Human
cucaauaaucccuccaucuccac

SEQ ID NO: 921559 - RNA, 19 nt, Human
cucacacccacccacacac

SEQ ID NO: 921560 - RNA, 23 nt, Human
cucagagcucagggauccauuuc

SEQ ID NO: 921561 - RNA, 19 nt, Human
cucccagccucaccauccu

SEQ ID NO: 921562 - RNA, 20 nt, Human
cucuccucuaccgaaaagga

SEQ ID NO: 921563 - RNA, 19 nt, Human
cugcccuucucuccuuccc

SEQ ID NO: 921564 - RNA, 21 nt, Human
cugcccuucucuccuuccccc

SEQ ID NO: 921565 - RNA, 24 nt, Human
cugccuugcccaagccuaagggag

SEQ ID NO: 921566 - RNA, 20 nt, Human
cugguccugguggagguugc

SEQ ID NO: 921567 - RNA, 20 nt, Human
cuggugacucgccaaaaaaa

SEQ ID NO: 921568 - RNA, 22 nt, Human
cuuccaucacuguuugcacaga

SEQ ID NO: 921569 - RNA, 19 nt, Human
cuuggcucagagcucaggg

SEQ ID NO: 921570 - RNA, 20 nt, Human
gaagccagcccugggggcca

SEQ ID NO: 921571 - RNA, 22 nt, Human
gaauauauucugagauccaggg

SEQ ID NO: 921572 - RNA, 20 nt, Human
gacaagcaagagaguggcug

SEQ ID NO: 921573 - RNA, 24 nt, Human
gacccagcuauccuggcacagcug

SEQ ID NO: 921574 - RNA, 21 nt, Human
gagagcaagggcagguggcug

SEQ ID NO: 921575 - RNA, 21 nt, Human
gaggagagaaggggaagggau

SEQ ID NO: 921576 - RNA, 18 nt, Human
gaggguuaggugauuugg

SEQ ID NO: 921577 - RNA, 19 nt, Human
gauacaccaagacaacagc

SEQ ID NO: 921578 - RNA, 18 nt, Human
gauccgcacaaccucccu

SEQ ID NO: 921579 - RNA, 22 nt, Human
gcaaccugauggcagggaggcc

SEQ ID NO: 921580 - RNA, 21 nt, Human
gcaagaggggucagggccaga

SEQ ID NO: 921581 - RNA, 19 nt, Human
gcauggacaaccugggugc

SEQ ID NO: 921582 - RNA, 22 nt, Human
gcccaagccuaagggagagccc

SEQ ID NO: 921583 - RNA, 20 nt, Human
gcccuucccagccccucccu

SEQ ID NO: 921584 - RNA, 21 nt, Human
gcuuuaagcccuggcacugcc

SEQ ID NO: 921585 - RNA, 20 nt, Human
gcuuuuccuuuccucucacu

SEQ ID NO: 921586 - RNA, 20 nt, Human
ggacaagcaagagaguggcu

SEQ ID NO: 921587 - RNA, 20 nt, Human
ggacagggccgucagagagg

SEQ ID NO: 921588 - RNA, 19 nt, Human
ggagaguggugaugcuggg

SEQ ID NO: 921589 - RNA, 19 nt, Human
ggaggaagccagcccuggg

SEQ ID NO: 921590 - RNA, 18 nt, Human
ggagggcucgggucacug

SEQ ID NO: 921591 - RNA, 20 nt, Human
ggcagguggcugccuugccc

SEQ ID NO: 921592 - RNA, 23 nt, Human
gggcuuuaagcccuggcacugcc

SEQ ID NO: 921593 - RNA, 20 nt, Human
ggggaaagcaaugaaaaugg

SEQ ID NO: 921594 - RNA, 20 nt, Human
gguccugguggagguugcag

SEQ ID NO: 921595 - RNA, 20 nt, Human
guacguacacacccacacuc

SEQ ID NO: 921596 - RNA, 18 nt, Human
gugaggcagaggaggaga

SEQ ID NO: 921597 - RNA, 24 nt, Human
gugaggcagaggaggagagaaggg

SEQ ID NO: 921598 - RNA, 20 nt, Human
gugaugcuggggaugccaaa

SEQ ID NO: 921599 - RNA, 23 nt, Human
guggagggcucgggucacuggug

SEQ ID NO: 921600 - RNA, 22 nt, Human
gugguggggacgcgcuggccag

SEQ ID NO: 921601 - RNA, 21 nt, Human
guucucuucuuaacaccuccc

SEQ ID NO: 921602 - RNA, 20 nt, Human
guugcagugcagaccaggcu

SEQ ID NO: 921603 - RNA, 21 nt, Human
guugcagugcagaccaggcug

SEQ ID NO: 921604 - RNA, 20 nt, Human
uaagcccuggcacugcccag

SEQ ID NO: 921605 - RNA, 21 nt, Human
uaagggagagcccaccccacc

SEQ ID NO: 921606 - RNA, 25 nt, Human
uacacacccacacucacacccaccc

SEQ ID NO: 921607 - RNA, 25 nt, Human
uacagccagcccaucaagagcaccc

SEQ ID NO: 921608 - RNA, 22 nt, Human
uaccaggaaaccccagccacau

SEQ ID NO: 921609 - RNA, 24 nt, Human
uaccaggaaaccccagccacaucc

SEQ ID NO: 921610 - RNA, 24 nt, Human
uacgacauggccaacaguggcagg

SEQ ID NO: 921611 - RNA, 22 nt, Human
uagcccagcaggagcuccaccc

SEQ ID NO: 921612 - RNA, 19 nt, Human
uagcccuucccagccccuc

SEQ ID NO: 921613 - RNA, 22 nt, Human
uauccaagaaacacaugccaga

SEQ ID NO: 921614 - RNA, 22 nt, Human
ucaauaaucccuccaucuccac

SEQ ID NO: 921615 - RNA, 21 nt, Human
ucagaacucaaggugaucagg

SEQ ID NO: 921616 - RNA, 18 nt, Human
ucagagagguggggaugg

SEQ ID NO: 921617 - RNA, 19 nt, Human
ucagagagguggggaugga

SEQ ID NO: 921618 - RNA, 18 nt, Human
ucagcuuggguucccauc

SEQ ID NO: 921619 - RNA, 24 nt, Human
ucaguagcccuucccagccccucc

SEQ ID NO: 921620 - RNA, 19 nt, Human
ucauuuuuauaggguuggg

SEQ ID NO: 921621 - RNA, 18 nt, Human
uccaacucauuuucugcu

SEQ ID NO: 921622 - RNA, 21 nt, Human
uccaucaucccacccugaaca

SEQ ID NO: 921623 - RNA, 19 nt, Human
uccaucaucuuaccaucca

SEQ ID NO: 921624 - RNA, 26 nt, Human
uccauuacccagggaugggagcuguu

SEQ ID NO: 921625 - RNA, 24 nt, Human
ucccagcaaccugauggcagggag

SEQ ID NO: 921626 - RNA, 18 nt, Human
ucccccagaaucccaagc

SEQ ID NO: 921627 - RNA, 20 nt, Human
ucccucagcuuggguuccca

SEQ ID NO: 921628 - RNA, 26 nt, Human
ucccugaccccaagagaaugggggcc

SEQ ID NO: 921629 - RNA, 18 nt, Human
ucccugcccaccaaaaua

SEQ ID NO: 921630 - RNA, 21 nt, Human
uccucccagccucaccauccu

SEQ ID NO: 921631 - RNA, 21 nt, Human
ucgggguaauggggugccgag

SEQ ID NO: 921632 - RNA, 22 nt, Human
ucugaaaugacccuuucuugga

SEQ ID NO: 921633 - RNA, 21 nt, Human
ucugagauccagggcaaccgg

SEQ ID NO: 921634 - RNA, 20 nt, Human
ucugcucaauaaucccucca

SEQ ID NO: 921635 - RNA, 23 nt, Human
ucuuaccauccauuacccaggga

SEQ ID NO: 921636 - RNA, 18 nt, Human
ugaaaaugguggcagcug

SEQ ID NO: 921637 - RNA, 24 nt, Human
ugaaacccagaaggaggaagccag

SEQ ID NO: 921638 - RNA, 22 nt, Human
ugaauggacccagcuauccugg

SEQ ID NO: 921639 - RNA, 19 nt, Human
ugagcuuagguguggagcg

SEQ ID NO: 921640 - RNA, 23 nt, Human
ugaggcagaggaggagagaaggg

SEQ ID NO: 921641 - RNA, 25 nt, Human
ugauuuggggacaagcaagagagug

SEQ ID NO: 921642 - RNA, 21 nt, Human
ugccagaugcuuuuccuuucc

SEQ ID NO: 921643 - RNA, 20 nt, Human
ugccagggccuggaaucucu

SEQ ID NO: 921644 - RNA, 23 nt, Human
ugcccuagagucaagauccgcac

SEQ ID NO: 921645 - RNA, 20 nt, Human
ugcucagaacucaaggugau

SEQ ID NO: 921646 - RNA, 18 nt, Human
uggacugggugcccuggc

SEQ ID NO: 921647 - RNA, 24 nt, Human
uggguucccaucaugcugcugggg

SEQ ID NO: 921648 - RNA, 18 nt, Human
ugguguggagggcucggg

SEQ ID NO: 921649 - RNA, 18 nt, Human
ugguguggagggcucggg

SEQ ID NO: 921650 - RNA, 23 nt, Human
ugugaaacccagaaggaggaagc

SEQ ID NO: 921651 - RNA, 22 nt, Human
uguggagcggccgcugaguggu

SEQ ID NO: 921652 - RNA, 26 nt, Human
uguggagcggccgcugaguggugggg

SEQ ID NO: 921653 - RNA, 22 nt, Human
uucccagccccucccugacccc

SEQ ID NO: 921654 - RNA, 20 nt, Human
uuccuaccaaaucaggaccu

SEQ ID NO: 921655 - RNA, 22 nt, Human
uucucuccuucccccagaaucc

SEQ ID NO: 921656 - RNA, 21 nt, Human
uucugcucaauaaucccucca

SEQ ID NO: 921657 - RNA, 20 nt, Human
uugguacguacacacccaca

SEQ ID NO: 921658 - RNA, 22 nt, Human
uugguacguacacacccacacu

SEQ ID NO: 921659 - RNA, 20 nt, Human
uuucuuggaaggaccauccc

SEQ ID NO: 921660 - RNA, 22 nt, Human
aacaaaaucauucacauccugg

SEQ ID NO: 921661 - RNA, 18 nt, Human
aauguccuacuuaggugg

SEQ ID NO: 921662 - RNA, 20 nt, Human
auaagacaauaagaggcaag

SEQ ID NO: 921663 - RNA, 25 nt, Human
aucguccuuaggucacaaaauaaaa

SEQ ID NO: 921664 - RNA, 20 nt, Human
caaaaucauucacauccugg

SEQ ID NO: 921665 - RNA, 21 nt, Human
caaguagaaaaaagacuaagc

SEQ ID NO: 921666 - RNA, 23 nt, Human
caccuccucucggaguucaaagc

SEQ ID NO: 921667 - RNA, 23 nt, Human
cacucugguaaaauacucaucuu

SEQ ID NO: 921668 - RNA, 24 nt, Human
cagcagaaguuagaacaacaaacc

SEQ ID NO: 921669 - RNA, 21 nt, Human
ccccagcacuccggcccggcc

SEQ ID NO: 921670 - RNA, 22 nt, Human
ccccagcacuccggcccggccg

SEQ ID NO: 921671 - RNA, 21 nt, Human
cuuagguggcuacagugaaca

SEQ ID NO: 921672 - RNA, 21 nt, Human
gacagcagaaguuagaacaac

SEQ ID NO: 921673 - RNA, 18 nt, Human
gccccagcacuccggccc

SEQ ID NO: 921674 - RNA, 19 nt, Human
ggcccggccgccagcucga

SEQ ID NO: 921675 - RNA, 18 nt, Human
guacuguauauauacaua

SEQ ID NO: 921676 - RNA, 21 nt, Human
guagaaaaaagacuaagcacu

SEQ ID NO: 921677 - RNA, 21 nt, Human
gugaucuuuucaccaucgucc

SEQ ID NO: 921678 - RNA, 22 nt, Human
uaaaaagcagguuuaaagcuga

SEQ ID NO: 921679 - RNA, 19 nt, Human
uaagaggcaaguggaggug

SEQ ID NO: 921680 - RNA, 20 nt, Human
uagaaaaaagacuaagcacu

SEQ ID NO: 921681 - RNA, 22 nt, Human
uagaaaaaagacuaagcacucc

SEQ ID NO: 921682 - RNA, 27 nt, Human
uagaagaaaaacaauuauacucucauu

SEQ ID NO: 921683 - RNA, 18 nt, Human
uaggucacaaaauaaaag

SEQ ID NO: 921684 - RNA, 19 nt, Human
uauguacuguauauauaca

SEQ ID NO: 921685 - RNA, 19 nt, Human
ucaacaauuuugugguguc

SEQ ID NO: 921686 - RNA, 20 nt, Human
ucacauccugguuacuguuc

SEQ ID NO: 921687 - RNA, 24 nt, Human
ucaccagugucuuauuuuuugugg

SEQ ID NO: 921688 - RNA, 21 nt, Human
uccacauauugauucugaaau

SEQ ID NO: 921689 - RNA, 24 nt, Human
uccauaccgcggauaugaauggaa

SEQ ID NO: 921690 - RNA, 23 nt, Human
ucgacagcagaaguuagaacaac

SEQ ID NO: 921691 - RNA, 22 nt, Human
ucggaguucaaagccccagcac

SEQ ID NO: 921692 - RNA, 24 nt, Human
ucuauguacuguauauauacauua

SEQ ID NO: 921693 - RNA, 18 nt, Human
ugaaugcuuaaagaaguu

SEQ ID NO: 921694 - RNA, 21 nt, Human
ugaucaacauuguuaaaaguc

SEQ ID NO: 921695 - RNA, 22 nt, Human
ugauguaacaaaaucauucaca

SEQ ID NO: 921696 - RNA, 25 nt, Human
ugccuguuguauauacugugagugu

SEQ ID NO: 921697 - RNA, 23 nt, Human
uggaaaagcaaguagaaaaaaga

SEQ ID NO: 921698 - RNA, 21 nt, Human
uggagguguggcuggcauuua

SEQ ID NO: 921699 - RNA, 23 nt, Human
ugggggguggagagccgccggca

SEQ ID NO: 921700 - RNA, 27 nt, Human
uguaacaaaaucauucacauccugguu

SEQ ID NO: 921701 - RNA, 25 nt, Human
ugucuuauuuuuuguggcaacuuca

SEQ ID NO: 921702 - RNA, 24 nt, Human
ugugaguguuuggaaaagcaagua

SEQ ID NO: 921703 - RNA, 26 nt, Human
uguggcaacuucagaaucggcacauu

SEQ ID NO: 921704 - RNA, 23 nt, Human
uguggcuggcauuuagugggcac

SEQ ID NO: 921705 - RNA, 23 nt, Human
uuaaaaagcagguuuaaagcuga

SEQ ID NO: 921706 - RNA, 19 nt, Human
uucaaagccccagcacucc

SEQ ID NO: 921707 - RNA, 23 nt, Human
uucuauguacuguauauauacau

SEQ ID NO: 921708 - RNA, 21 nt, Human
uugauucugaaaucauauaau

SEQ ID NO: 921709 - RNA, 20 nt, Human
uuuacauuaaauagaagaaa

SEQ ID NO: 921710 - RNA, 22 nt, Human
aaagagacuggcccagggguac

SEQ ID NO: 921711 - RNA, 23 nt, Human
aagaaagaagagaccaccucuga

SEQ ID NO: 921712 - RNA, 19 nt, Human
aaguucauguguuuccacu

SEQ ID NO: 921713 - RNA, 22 nt, Human
acugaaguguagggggugccug

SEQ ID NO: 921714 - RNA, 21 nt, Human
agccaagacugugguccacga

SEQ ID NO: 921715 - RNA, 25 nt, Human
augcagcuccagauccuggccaccc

SEQ ID NO: 921716 - RNA, 25 nt, Human
cacacaguguuacugugagcucuca

SEQ ID NO: 921717 - RNA, 22 nt, Human
caccuuuggcaaugguccccaa

SEQ ID NO: 921718 - RNA, 20 nt, Human
ccacuggugcugaagaugaa

SEQ ID NO: 921719 - RNA, 21 nt, Human
cugaaguaaggcacaacacaa

SEQ ID NO: 921720 - RNA, 24 nt, Human
cugaaguaaggcacaacacaauuc

SEQ ID NO: 921721 - RNA, 18 nt, Human
cuggugcugaagaugaac

SEQ ID NO: 921722 - RNA, 21 nt, Human
cuggugcugaagaugaacauc

SEQ ID NO: 921723 - RNA, 26 nt, Human
cuguggcagaagucccuguugcucau

SEQ ID NO: 921724 - RNA, 25 nt, Human
ggggugccugagagcugagccucgu

SEQ ID NO: 921725 - RNA, 24 nt, Human
gucccuguugcucaucccuuugau

SEQ ID NO: 921726 - RNA, 23 nt, Human
uaagugucuuuccuccugagucc

SEQ ID NO: 921727 - RNA, 23 nt, Human
uagagaugcagcuccagauccug

SEQ ID NO: 921728 - RNA, 18 nt, Human
uagggggugccugagagc

SEQ ID NO: 921729 - RNA, 27 nt, Human
ucacuguggcagaagucccuguugcuc

SEQ ID NO: 921730 - RNA, 20 nt, Human
uccauugucacuguggcaga

SEQ ID NO: 921731 - RNA, 27 nt, Human
ugaaguaaggcacaacacaauuccauu

SEQ ID NO: 921732 - RNA, 22 nt, Human
ugcacacgugcgggggugaggu

SEQ ID NO: 921733 - RNA, 18 nt, Human
ugcacagagggcagguga

SEQ ID NO: 921734 - RNA, 22 nt, Human
ugccuggccuccuccucuucuu

SEQ ID NO: 921735 - RNA, 21 nt, Human
ugcgagucaugcacacgugcg

SEQ ID NO: 921736 - RNA, 22 nt, Human
uggccccuuagagaugcagcuc

SEQ ID NO: 921737 - RNA, 21 nt, Human
uggugcugaagaugaacauca

SEQ ID NO: 921738 - RNA, 24 nt, Human
uuacaagaaagaagagaccaccuu

SEQ ID NO: 921739 - RNA, 23 nt, Human
uuuccgcauaaauauugcuuuua

SEQ ID NO: 921740 - RNA, 26 nt, Human
aacucuuuguccuucccaguggguuu

SEQ ID NO: 921741 - RNA, 24 nt, Human
aagcaaacggucuacgucaccaag

SEQ ID NO: 921742 - RNA, 26 nt, Human
aagcaaacggucuacgucaccaagac

SEQ ID NO: 921743 - RNA, 21 nt, Human
aagcaagaaugaacgguucua

SEQ ID NO: 921744 - RNA, 23 nt, Human
acccugccacccaugcuguaugg

SEQ ID NO: 921745 - RNA, 23 nt, Human
accguguggaccugccacagagg

SEQ ID NO: 921746 - RNA, 18 nt, Human
agcuggggaggcccuuau

SEQ ID NO: 921747 - RNA, 18 nt, Human
aggcuuggccuaugagag

SEQ ID NO: 921748 - RNA, 18 nt, Human
aucaauacaaucacccca

SEQ ID NO: 921749 - RNA, 27 nt, Human
caagaaugaacgguucuauacucucga

SEQ ID NO: 921750 - RNA, 19 nt, Human
caccuagcccagauccagc

SEQ ID NO: 921751 - RNA, 20 nt, Human
cagcaguucccuagcccggu

SEQ ID NO: 921752 - RNA, 18 nt, Human
cagcugggcucuggggcc

SEQ ID NO: 921753 - RNA, 21 nt, Human
cagggcacaggagcugcucag

SEQ ID NO: 921754 - RNA, 26 nt, Human
caggggucaccuagcccagauccagc

SEQ ID NO: 921755 - RNA, 24 nt, Human
cauccugaacuuccagcaguuccc

SEQ ID NO: 921756 - RNA, 20 nt, Human
cccacucagaggucugaggc

SEQ ID NO: 921757 - RNA, 20 nt, Human
ccccaggggucaccuagccc

SEQ ID NO: 921758 - RNA, 23 nt, Human
cccccagggcacaggagcugcuc

SEQ ID NO: 921759 - RNA, 19 nt, Human
ccggcgcagcgaggagcag

SEQ ID NO: 921760 - RNA, 19 nt, Human
ccugccauggagacggggg

SEQ ID NO: 921761 - RNA, 20 nt, Human
cgaagaaagaaacccgggac

SEQ ID NO: 921762 - RNA, 24 nt, Human
cggcaaacucuuuguccuucccag

SEQ ID NO: 921763 - RNA, 19 nt, Human
cggcgcagcgaggagcaga

SEQ ID NO: 921764 - RNA, 18 nt, Human
cuagcccagauccagccu

SEQ ID NO: 921765 - RNA, 19 nt, Human
cucaggguuggcuuccuuc

SEQ ID NO: 921766 - RNA, 18 nt, Human
cugccaggaggacacaga

SEQ ID NO: 921767 - RNA, 19 nt, Human
cugggacgcuggcacagag

SEQ ID NO: 921768 - RNA, 21 nt, Human
cuuggccuaugagaggagggg

SEQ ID NO: 921769 - RNA, 19 nt, Human
gagcacggggguguugggg

SEQ ID NO: 921770 - RNA, 21 nt, Human
gaggcuguguggcuuccucag

SEQ ID NO: 921771 - RNA, 18 nt, Human
gcccccgagaguggcugg

SEQ ID NO: 921772 - RNA, 19 nt, Human
gccugcuucggguguggag

SEQ ID NO: 921773 - RNA, 19 nt, Human
gcucaggguuggcuuccuu

SEQ ID NO: 921774 - RNA, 20 nt, Human
ggaaugggacacaaagcaag

SEQ ID NO: 921775 - RNA, 19 nt, Human
ggaggcccuuauacugggg

SEQ ID NO: 921776 - RNA, 20 nt, Human
ggcaaacucuuuguccuucc

SEQ ID NO: 921777 - RNA, 23 nt, Human
ggcacaggagcugcucaggaacg

SEQ ID NO: 921778 - RNA, 22 nt, Human
ggcgcagcgaggagcagaaacg

SEQ ID NO: 921779 - RNA, 19 nt, Human
ggcuggugcagagcacggg

SEQ ID NO: 921780 - RNA, 21 nt, Human
gggaagcagcuucuuacucag

SEQ ID NO: 921781 - RNA, 21 nt, Human
gguuuugaucaauacaaucac

SEQ ID NO: 921782 - RNA, 25 nt, Human
ucaaaaauggucuacgucaccaaga

SEQ ID NO: 921783 - RNA, 19 nt, Human
ucaccuagcccagauccag

SEQ ID NO: 921784 - RNA, 23 nt, Human
uccaagcccugcccacccacacc

SEQ ID NO: 921785 - RNA, 25 nt, Human
ucccucggauccccgaaaggcggca

SEQ ID NO: 921786 - RNA, 23 nt, Human
uccgcggcuggaguuaaagaagc

SEQ ID NO: 921787 - RNA, 18 nt, Human
uccguggugcugcugggc

SEQ ID NO: 921788 - RNA, 20 nt, Human
uccguggugcugcugggcgg

SEQ ID NO: 921789 - RNA, 21 nt, Human
uccucagcugggcucuggggc

SEQ ID NO: 921790 - RNA, 21 nt, Human
ucucccggggcaggccucggc

SEQ ID NO: 921791 - RNA, 20 nt, Human
ucugugacugcccccagggc

SEQ ID NO: 921792 - RNA, 20 nt, Human
ugacugcccccagggcacag

SEQ ID NO: 921793 - RNA, 20 nt, Human
ugaguccucguucagcaaac

SEQ ID NO: 921794 - RNA, 22 nt, Human
ugaucaauacaaucaccccacg

SEQ ID NO: 921795 - RNA, 20 nt, Human
ugccaggaggacacagaugg

SEQ ID NO: 921796 - RNA, 22 nt, Human
ugccaggaggacacagauggac

SEQ ID NO: 921797 - RNA, 23 nt, Human
ugcccacccacaccguguggacc

SEQ ID NO: 921798 - RNA, 21 nt, Human
ugcucaggaacggauucugac

SEQ ID NO: 921799 - RNA, 21 nt, Human
uggaggcuguguggcuuccuc

SEQ ID NO: 921800 - RNA, 21 nt, Human
ugggcucuggggcccacucag

SEQ ID NO: 921801 - RNA, 21 nt, Human
ugguggggaucccuggccuag

SEQ ID NO: 921802 - RNA, 18 nt, Human
uguguuugaggggcugcc

SEQ ID NO: 921803 - RNA, 22 nt, Human
uucaaaaauggucuacgucacc

SEQ ID NO: 921804 - RNA, 19 nt, Human
uuccucagcugggcucugg

SEQ ID NO: 921805 - RNA, 18 nt, Human
uuugaucaauacaaucac

SEQ ID NO: 921806 - RNA, 21 nt, Human
uuuuuuuuuuuuuuuuuuaag

SEQ ID NO: 921807 - RNA, 21 nt, Human
agcccggacagcugaggccgg

SEQ ID NO: 921808 - RNA, 19 nt, Human
agccggcgccgccacgcgc

SEQ ID NO: 921809 - RNA, 20 nt, Human
aguccaugggccuguggaau

SEQ ID NO: 921810 - RNA, 21 nt, Human
cagcucaaagcccuguggcgg

SEQ ID NO: 921811 - RNA, 20 nt, Human
cagugcagcucaaagcccug

SEQ ID NO: 921812 - RNA, 18 nt, Human
caugggccuguggaaugu

SEQ ID NO: 921813 - RNA, 19 nt, Human
ccuguggcggacuacaggg

SEQ ID NO: 921814 - RNA, 22 nt, Human
cucaaagaaagaugucccugug

SEQ ID NO: 921815 - RNA, 21 nt, Human
ggccgcgguggcuagggagcc

SEQ ID NO: 921816 - RNA, 18 nt, Human
ggcggcgggcgccguccu

SEQ ID NO: 921817 - RNA, 23 nt, Human
ggcuagggagccggcgccgccac

SEQ ID NO: 921818 - RNA, 22 nt, Human
gggacugggguugcucgcgggc

SEQ ID NO: 921819 - RNA, 28 nt, Human
uccaugggccuguggaaugugaggggag

SEQ ID NO: 921820 - RNA, 20 nt, Human
uuauuaaaaaaaaaaaaaaa

SEQ ID NO: 921821 - RNA, 23 nt, Human
aaagaaaacacguaagagccaca

SEQ ID NO: 921822 - RNA, 22 nt, Human
aagagcggagggggaagcagag

SEQ ID NO: 921823 - RNA, 23 nt, Human
aagagcggagggggaagcagaga

SEQ ID NO: 921824 - RNA, 24 nt, Human
acaggcacccucggugcugccucc

SEQ ID NO: 921825 - RNA, 20 nt, Human
agaaaacacguaagagccac

SEQ ID NO: 921826 - RNA, 22 nt, Human
agcaaaugcugagaaaagccag

SEQ ID NO: 921827 - RNA, 20 nt, Human
agcggagggggaagcagaga

SEQ ID NO: 921828 - RNA, 23 nt, Human
agggcacauaucccaaaugcugc

SEQ ID NO: 921829 - RNA, 26 nt, Human
cagcagcaaaugcugagaaaagccag

SEQ ID NO: 921830 - RNA, 22 nt, Human
caguggcuuuuuugcacagccu

SEQ ID NO: 921831 - RNA, 24 nt, Human
caguggcuuuuuugcacagccugc

SEQ ID NO: 921832 - RNA, 20 nt, Human
ccucugaggcuggcaguucc

SEQ ID NO: 921833 - RNA, 21 nt, Human
cuccugggcccacagcugugc

SEQ ID NO: 921834 - RNA, 24 nt, Human
cuccugggcccacagcugugccug

SEQ ID NO: 921835 - RNA, 21 nt, Human
cugaggcuggcaguuccuucc

SEQ ID NO: 921836 - RNA, 18 nt, Human
cugugccugcagaggagc

SEQ ID NO: 921837 - RNA, 19 nt, Human
gagcaccugagcuggcucc

SEQ ID NO: 921838 - RNA, 21 nt, Human
gcaaaugcugagaaaagccag

SEQ ID NO: 921839 - RNA, 22 nt, Human
gccugcagaggagcugcuccaa

SEQ ID NO: 921840 - RNA, 22 nt, Human
gcuugcuucaaacaggcacccu

SEQ ID NO: 921841 - RNA, 21 nt, Human
ggaggggagcaccugagcugg

SEQ ID NO: 921842 - RNA, 19 nt, Human
gggaagcagagagagugcc

SEQ ID NO: 921843 - RNA, 24 nt, Human
gguggaggggagcaccugagcugg

SEQ ID NO: 921844 - RNA, 19 nt, Human
guagucccaggagaggccc

SEQ ID NO: 921845 - RNA, 24 nt, Human
gugcugccuccucugaggcuggca

SEQ ID NO: 921846 - RNA, 24 nt, Human
uaugcagggucaagagcggagggg

SEQ ID NO: 921847 - RNA, 23 nt, Human
ucccaaaugcugcuugcuucaaa

SEQ ID NO: 921848 - RNA, 20 nt, Human
ugccugggaauaguccaggc

SEQ ID NO: 921849 - RNA, 20 nt, Human
uggaggggagcaccugagcu

SEQ ID NO: 921850 - RNA, 20 nt, Human
uggcuccugggcccacagcu

SEQ ID NO: 921851 - RNA, 22 nt, Human
ugugccugcagaggagcugcuc

SEQ ID NO: 921852 - RNA, 18 nt, Human
aaacagaccgagaagccc

SEQ ID NO: 921853 - RNA, 20 nt, Human
aacagagcaagacccugucu

SEQ ID NO: 921854 - RNA, 23 nt, Human
aacggcugacaacucagaccaug

SEQ ID NO: 921855 - RNA, 24 nt, Human
aagaaaaccagacauauacagcug

SEQ ID NO: 921856 - RNA, 18 nt, Human
aagaugacagaaguaggg

SEQ ID NO: 921857 - RNA, 24 nt, Human
acagagcaagacccugucuuaaag

SEQ ID NO: 921858 - RNA, 20 nt, Human
acagguuaagggaugggaag

SEQ ID NO: 921859 - RNA, 24 nt, Human
acugcacuggagccuggguaacag

SEQ ID NO: 921860 - RNA, 22 nt, Human
agagacgccaggcaggcuugag

SEQ ID NO: 921861 - RNA, 22 nt, Human
agccuggguguagggcaggccu

SEQ ID NO: 921862 - RNA, 24 nt, Human
agcggcggcggcgacuagcgagca

SEQ ID NO: 921863 - RNA, 21 nt, Human
agcuggauguaguggugcacg

SEQ ID NO: 921864 - RNA, 21 nt, Human
agcuggauguaguggugcacg

SEQ ID NO: 921865 - RNA, 24 nt, Human
agcuggauguaguggugcacggcu

SEQ ID NO: 921866 - RNA, 28 nt, Human
aggaaaccacaaucuggagacacagucc

SEQ ID NO: 921867 - RNA, 23 nt, Human
aggcaggaggauugcuugagccc

SEQ ID NO: 921868 - RNA, 24 nt, Human
aggcaggaggauugcuugagccca

SEQ ID NO: 921869 - RNA, 18 nt, Human
aggcagggcacggcagga

SEQ ID NO: 921870 - RNA, 21 nt, Human
aggcugaggcaggaggauugc

SEQ ID NO: 921871 - RNA, 24 nt, Human
aggcugaggcaggaggauugcuug

SEQ ID NO: 921872 - RNA, 20 nt, Human
agguccuggaaacagggcca

SEQ ID NO: 921873 - RNA, 24 nt, Human
aggucgaggcugcagugagccaug

SEQ ID NO: 921874 - RNA, 24 nt, Human
aucacaccacugcacuggagccug

SEQ ID NO: 921875 - RNA, 21 nt, Human
augggcccccagcccugcaac

SEQ ID NO: 921876 - RNA, 19 nt, Human
auugcuugagcccaggagg

SEQ ID NO: 921877 - RNA, 22 nt, Human
auuggcuggcagcagagggcag

SEQ ID NO: 921878 - RNA, 18 nt, Human
caccaagguccacagcgg

SEQ ID NO: 921879 - RNA, 20 nt, Human
cacugcacuggagccugggu

SEQ ID NO: 921880 - RNA, 23 nt, Human
cacugcacuggagccuggguaac

SEQ ID NO: 921881 - RNA, 24 nt, Human
cacugcacuggagccuggguaaca

SEQ ID NO: 921882 - RNA, 20 nt, Human
cagccagagcaggugagcag

SEQ ID NO: 921883 - RNA, 18 nt, Human
cagcuggauguaguggug

SEQ ID NO: 921884 - RNA, 23 nt, Human
caggagacacuggccucaaccca

SEQ ID NO: 921885 - RNA, 24 nt, Human
cagggcccugagagcucaggcagg

SEQ ID NO: 921886 - RNA, 24 nt, Human
ccacugcacuggagccuggguaac

SEQ ID NO: 921887 - RNA, 19 nt, Human
ccagcccugcaaccccacc

SEQ ID NO: 921888 - RNA, 20 nt, Human
cccagcccugcaaccccacc

SEQ ID NO: 921889 - RNA, 24 nt, Human
cccagcccugcaaccccaccaagg

SEQ ID NO: 921890 - RNA, 25 nt, Human
ccccucaagauucucacaggggcug

SEQ ID NO: 921891 - RNA, 18 nt, Human
cccugagagcucaggcag

SEQ ID NO: 921892 - RNA, 18 nt, Human
ccucaagauucucacagg

SEQ ID NO: 921893 - RNA, 25 nt, Human
cggcuguagucccagcuacuugcga

SEQ ID NO: 921894 - RNA, 22 nt, Human
cucaacccaguguggguccccu

SEQ ID NO: 921895 - RNA, 21 nt, Human
cucagaccauggagccgcagc

SEQ ID NO: 921896 - RNA, 19 nt, Human
cucuggcugggccaggucc

SEQ ID NO: 921897 - RNA, 22 nt, Human
cuggccgggccugagagcagca

SEQ ID NO: 921898 - RNA, 20 nt, Human
cuggcugggccagguccugg

SEQ ID NO: 921899 - RNA, 23 nt, Human
cugggccagguccuggaaacagg

SEQ ID NO: 921900 - RNA, 19 nt, Human
cuguagucccagcuacuug

SEQ ID NO: 921901 - RNA, 18 nt, Human
cuucagaagccccugaag

SEQ ID NO: 921902 - RNA, 23 nt, Human
gaaaaccagacauauacagcugg

SEQ ID NO: 921903 - RNA, 19 nt, Human
gacccugucuuaaagagga

SEQ ID NO: 921904 - RNA, 19 nt, Human
gagaugaagcccagguggu

SEQ ID NO: 921905 - RNA, 18 nt, Human
gagccgcagccgaguucg

SEQ ID NO: 921906 - RNA, 18 nt, Human
gaggagaggccugaggca

SEQ ID NO: 921907 - RNA, 22 nt, Human
gaugacagaaguagggguaaga

SEQ ID NO: 921908 - RNA, 20 nt, Human
gcagcagagggcaggcuaga

SEQ ID NO: 921909 - RNA, 19 nt, Human
gcaggagggcggggagagg

SEQ ID NO: 921910 - RNA, 20 nt, Human
gccaaggcccuuggcaacag

SEQ ID NO: 921911 - RNA, 19 nt, Human
gccaugaucacaccacugc

SEQ ID NO: 921912 - RNA, 23 nt, Human
gccaugaucacaccacugcacuu

SEQ ID NO: 921913 - RNA, 24 nt, Human
gcccaggaggucgaggcugcagug

SEQ ID NO: 921914 - RNA, 21 nt, Human
gccugccuacuagaggagagg

SEQ ID NO: 921915 - RNA, 24 nt, Human
gcggcggcggcgacuagcgagcac

SEQ ID NO: 921916 - RNA, 22 nt, Human
ggagauguggacaugggccccc

SEQ ID NO: 921917 - RNA, 23 nt, Human
ggagggcggggagagggacaucc

SEQ ID NO: 921918 - RNA, 24 nt, Human
ggcaacagguuaagggaugggaag

SEQ ID NO: 921919 - RNA, 24 nt, Human
ggccugaggcaccagccugggugu

SEQ ID NO: 921920 - RNA, 21 nt, Human
gggaaggcugugggcucccag

SEQ ID NO: 921921 - RNA, 18 nt, Human
gggaugggaaggcugugg

SEQ ID NO: 921922 - RNA, 19 nt, Human
gggaugggaaggcuguggg

SEQ ID NO: 921923 - RNA, 21 nt, Human
gggaugggaaggcugugggcu

SEQ ID NO: 921924 - RNA, 21 nt, Human
uaacagagcaagacccugucu

SEQ ID NO: 921925 - RNA, 20 nt, Human
uaaccuggccugccuacuag

SEQ ID NO: 921926 - RNA, 24 nt, Human
uaguggugcacggcuguaguccca

SEQ ID NO: 921927 - RNA, 23 nt, Human
uauuggcuggcagcagagggcag

SEQ ID NO: 921928 - RNA, 23 nt, Human
ucaaaacagaccgagaagcccac

SEQ ID NO: 921929 - RNA, 23 nt, Human
ucacaccacugcacuggagccug

SEQ ID NO: 921930 - RNA, 26 nt, Human
ucaggcagggcacggcaggaaacuca

SEQ ID NO: 921931 - RNA, 18 nt, Human
ucaguaagucuggggucu

SEQ ID NO: 921932 - RNA, 21 nt, Human
uccacuuguucucacagcagg

SEQ ID NO: 921933 - RNA, 18 nt, Human
ucccugagaagaugacag

SEQ ID NO: 921934 - RNA, 25 nt, Human
ucccugagaagaugacagaaguagg

SEQ ID NO: 921935 - RNA, 28 nt, Human
ucccugagaagaugacagaaguaggggu

SEQ ID NO: 921936 - RNA, 21 nt, Human
uccuggaaacagggccaaggc

SEQ ID NO: 921937 - RNA, 19 nt, Human
ugagagcagcaaggccacu

SEQ ID NO: 921938 - RNA, 21 nt, Human
ugagaugaagcccaggugguu

SEQ ID NO: 921939 - RNA, 24 nt, Human
ugaggcaggaggauugcuugagcc

SEQ ID NO: 921940 - RNA, 25 nt, Human
ugaggcaggaggauugcuugagccc

SEQ ID NO: 921941 - RNA, 22 nt, Human
ugcagugagccaugaucacacc

SEQ ID NO: 921942 - RNA, 24 nt, Human
ugcgaggcugaggcaggaggauug

SEQ ID NO: 921943 - RNA, 24 nt, Human
uggaaauggagauguggacauggg

SEQ ID NO: 921944 - RNA, 21 nt, Human
uggcagcagagggcaggcuag

SEQ ID NO: 921945 - RNA, 23 nt, Human
uggcugggccagguccuggaaac

SEQ ID NO: 921946 - RNA, 20 nt, Human
ugggcccccagcccugcaac

SEQ ID NO: 921947 - RNA, 19 nt, Human
uggggucugaaaacuuguc

SEQ ID NO: 921948 - RNA, 18 nt, Human
uggugcacggcuguaguc

SEQ ID NO: 921949 - RNA, 21 nt, Human
uggugcacggcuguaguccca

SEQ ID NO: 921950 - RNA, 25 nt, Human
uugagaugaagcccaggugguucac

SEQ ID NO: 921951 - RNA, 20 nt, Human
uugcgaggcugaggcaggag

SEQ ID NO: 921952 - RNA, 24 nt, Human
uugcuugagcccaggaggucgagg

SEQ ID NO: 921953 - RNA, 20 nt, Human
aaaaauaagucucuaguccc

SEQ ID NO: 921954 - RNA, 20 nt, Human
aaaagaaaaaaagaauuagg

SEQ ID NO: 921955 - RNA, 23 nt, Human
aaaauaacacuuccaggauacgg

SEQ ID NO: 921956 - RNA, 21 nt, Human
aaacaggaaaaaugcaaucgc

SEQ ID NO: 921957 - RNA, 22 nt, Human
aaacaggaaaaaugcaaucgca

SEQ ID NO: 921958 - RNA, 22 nt, Human
aaacaggaaaaaugcaaucgca

SEQ ID NO: 921959 - RNA, 21 nt, Human
aagcagaaggaugaugcaauc

SEQ ID NO: 921960 - RNA, 24 nt, Human
accgccucaccuccuuccuccccu

SEQ ID NO: 921961 - RNA, 27 nt, Human
accugggcaaccucaagcaaugcuuua

SEQ ID NO: 921962 - RNA, 30 nt, Human
acucgcaguaucccaagaacuaaaccaguu

SEQ ID NO: 921963 - RNA, 24 nt, Human
agaacucagcaagcauucgaauaa

SEQ ID NO: 921964 - RNA, 22 nt, Human
aggcgaaacuaccugggcaacc

SEQ ID NO: 921965 - RNA, 19 nt, Human
agucuuacagcgagcucaa

SEQ ID NO: 921966 - RNA, 19 nt, Human
agucuuacagcgagcucaa

SEQ ID NO: 921967 - RNA, 19 nt, Human
agucuuacagcgagcucaa

SEQ ID NO: 921968 - RNA, 18 nt, Human
agugguuucaggaaggac

SEQ ID NO: 921969 - RNA, 18 nt, Human
agugguuucaggaaggac

SEQ ID NO: 921970 - RNA, 18 nt, Human
agugguuucaggaaggac

SEQ ID NO: 921971 - RNA, 22 nt, Human
aguguaaggcgaaacuaccuga

SEQ ID NO: 921972 - RNA, 19 nt, Human
augccugcacuugaggcug

SEQ ID NO: 921973 - RNA, 22 nt, Human
caaaaauaagucuuugggcuuc

SEQ ID NO: 921974 - RNA, 22 nt, Human
caaaaauaagucuuugggcuuc

SEQ ID NO: 921975 - RNA, 18 nt, Human
caccuccuuccuccccuc

SEQ ID NO: 921976 - RNA, 26 nt, Human
caccuccuuccuccccucaucuuccu

SEQ ID NO: 921977 - RNA, 24 nt, Human
cacgccuauaauccuaacacuuug

SEQ ID NO: 921978 - RNA, 23 nt, Human
cacuguucacucgcaguauccca

SEQ ID NO: 921979 - RNA, 23 nt, Human
cagcgagcucaaaaauaagucuc

SEQ ID NO: 921980 - RNA, 22 nt, Human
ccaagaacuaaaccaguagcaa

SEQ ID NO: 921981 - RNA, 24 nt, Human
ccacucaaaaaugccugcacuuga

SEQ ID NO: 921982 - RNA, 18 nt, Human
cccaagagagagaacgcc

SEQ ID NO: 921983 - RNA, 18 nt, Human
cccaagagagagaacgcc

SEQ ID NO: 921984 - RNA, 27 nt, Human
ccccucaucuuccuaucucaaaccaaa

SEQ ID NO: 921985 - RNA, 18 nt, Human
ccccuuaccgccucaccu

SEQ ID NO: 921986 - RNA, 19 nt, Human
ccccuuaccgccucaccuc

SEQ ID NO: 921987 - RNA, 22 nt, Human
ccgccucaccuccuuccucccc

SEQ ID NO: 921988 - RNA, 22 nt, Human
ccuauaauccuaacacuuuggg

SEQ ID NO: 921989 - RNA, 23 nt, Human
ccuauaauccuaacacuuuggga

SEQ ID NO: 921990 - RNA, 23 nt, Human
ccuuaccgccucaccuccuuccu

SEQ ID NO: 921991 - RNA, 20 nt, Human
cucaaaccaaaacgacaaug

SEQ ID NO: 921992 - RNA, 20 nt, Human
cucacgccuauaauccuaac

SEQ ID NO: 921993 - RNA, 24 nt, Human
cucacgccuauaauccuaacacuu

SEQ ID NO: 921994 - RNA, 24 nt, Human
cucgcaguaucccaagaacuaaac

SEQ ID NO: 921995 - RNA, 19 nt, Human
cuugcugugggaggaauau

SEQ ID NO: 921996 - RNA, 21 nt, Human
gcaaccucaagcaaugcuuua

SEQ ID NO: 921997 - RNA, 20 nt, Human
gccgggcgugguggcucacg

SEQ ID NO: 921998 - RNA, 20 nt, Human
gccucaccuccuuccucccc

SEQ ID NO: 921999 - RNA, 23 nt, Human
gccucaccuccuuccuccccuca

SEQ ID NO: 922000 - RNA, 20 nt, Human
gcucuaagaauggggauaaa

SEQ ID NO: 922001 - RNA, 26 nt, Human
ggccacucaaaaaugccugcacuuga

SEQ ID NO: 922002 - RNA, 23 nt, Human
ggcgugguggcucacgccuauaa

SEQ ID NO: 922003 - RNA, 24 nt, Human
gggccagcggaaguugggcgcggg

SEQ ID NO: 922004 - RNA, 24 nt, Human
gggccagcggaaguugggcgcggg

SEQ ID NO: 922005 - RNA, 19 nt, Human
gguggcucacgccuauaau

SEQ ID NO: 922006 - RNA, 23 nt, Human
gguggcucacgccuauaauccua

SEQ ID NO: 922007 - RNA, 19 nt, Human
gugaaagggagcucuacua

SEQ ID NO: 922008 - RNA, 23 nt, Human
uaacacuuugggaggccgaggug

SEQ ID NO: 922009 - RNA, 26 nt, Human
uaacacuuugggaggccgaggugcag

SEQ ID NO: 922010 - RNA, 21 nt, Human
uaacucacacacgcucaucuu

SEQ ID NO: 922011 - RNA, 22 nt, Human
uaaggcgaaacuaccugggcaa

SEQ ID NO: 922012 - RNA, 18 nt, Human
uaagucucuagucccaaa

SEQ ID NO: 922013 - RNA, 18 nt, Human
uaccugggcaaccucaag

SEQ ID NO: 922014 - RNA, 18 nt, Human
uaggcucauuuuccuguc

SEQ ID NO: 922015 - RNA, 20 nt, Human
ucagcaagcauucgaauaag

SEQ ID NO: 922016 - RNA, 23 nt, Human
ucagucuuacagcgagcucaaaa

SEQ ID NO: 922017 - RNA, 23 nt, Human
ucagucuuacagcgagcucaaaa

SEQ ID NO: 922018 - RNA, 23 nt, Human
ucagucuuacagcgagcucaaaa

SEQ ID NO: 922019 - RNA, 23 nt, Human
uccccucaucuuccuaucucaaa

SEQ ID NO: 922020 - RNA, 19 nt, Human
ugcacugggacaagaagug

SEQ ID NO: 922021 - RNA, 19 nt, Human
uggcucacgccuauaaucc

SEQ ID NO: 922022 - RNA, 21 nt, Human
uggcucacgccuauaauccua

SEQ ID NO: 922023 - RNA, 27 nt, Human
ugggcaaccucaagcaaugcuuuacac

SEQ ID NO: 922024 - RNA, 24 nt, Human
uggggauaaaagcuguugggcgcc

SEQ ID NO: 922025 - RNA, 22 nt, Human
ugguggcucacgccuauaaucc

SEQ ID NO: 922026 - RNA, 25 nt, Human
uguaaacaagcagaaggaugaugca

SEQ ID NO: 922027 - RNA, 25 nt, Human
uguaaucaggccacucaaaaaugcc

SEQ ID NO: 922028 - RNA, 20 nt, Human
uuaggcucauuuuccugucu

SEQ ID NO: 922029 - RNA, 24 nt, Human
uucacucgcaguaucccaagaacu

SEQ ID NO: 922030 - RNA, 25 nt, Human
uucacucgcaguaucccaagaacua

SEQ ID NO: 922031 - RNA, 22 nt, Human
uuuuccugucuuaacucacaca

SEQ ID NO: 922032 - RNA, 27 nt, Human
aaaaaaauaacaagcuuugacacaaaa

SEQ ID NO: 922033 - RNA, 19 nt, Human
aacaagcuuugacacaaaa

SEQ ID NO: 922034 - RNA, 22 nt, Human
agacaaaugacaaacacaaaau

SEQ ID NO: 922035 - RNA, 23 nt, Human
agacaaaugacaaacacaaaauu

SEQ ID NO: 922036 - RNA, 23 nt, Human
agcuuugacacaaaaucuaagca

SEQ ID NO: 922037 - RNA, 27 nt, Human
cacaaaaucuaagcaucugggacauac

SEQ ID NO: 922038 - RNA, 22 nt, Human
cacuuacagauacauacguaug

SEQ ID NO: 922039 - RNA, 19 nt, Human
cuccuccgcuacaaacccc

SEQ ID NO: 922040 - RNA, 21 nt, Human
cuccuccgcuacaaaccccgg

SEQ ID NO: 922041 - RNA, 22 nt, Human
cucucaauucugccucuucauc

SEQ ID NO: 922042 - RNA, 25 nt, Human
cucuuaaguuagacaagaguaaaua

SEQ ID NO: 922043 - RNA, 25 nt, Human
gacaacaucuguaucuuaagcuggc

SEQ ID NO: 922044 - RNA, 25 nt, Human
ggccuuagggaacuucuaaaauguc

SEQ ID NO: 922045 - RNA, 23 nt, Human
uaaaaugucgacaacaucuguau

SEQ ID NO: 922046 - RNA, 24 nt, Human
uacuucauuaaaaaaagagugaaa

SEQ ID NO: 922047 - RNA, 19 nt, Human
uagccucucaauucugccu

SEQ ID NO: 922048 - RNA, 23 nt, Human
uauacaaagaaaauguucaauuc

SEQ ID NO: 922049 - RNA, 26 nt, Human
uauguauaacaauaaaauuaguguaa

SEQ ID NO: 922050 - RNA, 23 nt, Human
ugacacaaaaucuaagcaucugc

SEQ ID NO: 922051 - RNA, 18 nt, Human
ugaugaguacacagauau

SEQ ID NO: 922052 - RNA, 22 nt, Human
uguuguaaaacuauaauagaca

SEQ ID NO: 922053 - RNA, 21 nt, Human
uuaaaaaaagagugaaaaugu

SEQ ID NO: 922054 - RNA, 20 nt, Human
uucaaaaaugaagacuaccc

SEQ ID NO: 922055 - RNA, 22 nt, Human
uuuauauaaaauucagaaacau

SEQ ID NO: 922056 - RNA, 24 nt, Human
uuuguaguaugaaauacuucauua

SEQ ID NO: 922057 - RNA, 22 nt, Human
aaacaacgaaggaacauccuga

SEQ ID NO: 922058 - RNA, 22 nt, Human
aaagaaacaaggcauuuagccc

SEQ ID NO: 922059 - RNA, 18 nt, Human
aaauguaaggacuugaaa

SEQ ID NO: 922060 - RNA, 18 nt, Human
aacaaaaucauacaacaa

SEQ ID NO: 922061 - RNA, 25 nt, Human
aacaacgaaggaacauccugaaaga

SEQ ID NO: 922062 - RNA, 20 nt, Human
aagucucaaauuuacaaaaa

SEQ ID NO: 922063 - RNA, 21 nt, Human
aaucauacaacaaaaauugcu

SEQ ID NO: 922064 - RNA, 21 nt, Human
acaacgaaggaacauccugaa

SEQ ID NO: 922065 - RNA, 20 nt, Human
accccaaguccaaacacaac

SEQ ID NO: 922066 - RNA, 18 nt, Human
agaaggaggaggaagagc

SEQ ID NO: 922067 - RNA, 19 nt, Human
agagagcgggucccggaga

SEQ ID NO: 922068 - RNA, 22 nt, Human
agagucccccccaccccccccu

SEQ ID NO: 922069 - RNA, 19 nt, Human
aggaacagcagcaggccca

SEQ ID NO: 922070 - RNA, 21 nt, Human
aggcggcggcggcggcagccg

SEQ ID NO: 922071 - RNA, 22 nt, Human
aggcggcggcggcggcagccgg

SEQ ID NO: 922072 - RNA, 21 nt, Human
auauaucuguugcaucacaca

SEQ ID NO: 922073 - RNA, 22 nt, Human
aucacacaauaagccaaacauu

SEQ ID NO: 922074 - RNA, 19 nt, Human
auuaugguuugaaaucacg

SEQ ID NO: 922075 - RNA, 23 nt, Human
caaacauuucuuguaacuuugau

SEQ ID NO: 922076 - RNA, 18 nt, Human
caccccccccuccccaac

SEQ ID NO: 922077 - RNA, 19 nt, Human
caccccccccuccccaacc

SEQ ID NO: 922078 - RNA, 27 nt, Human
caccccccccuccccaaccacguuccg

SEQ ID NO: 922079 - RNA, 25 nt, Human
caccgcggcggcgacggcggcagcc

SEQ ID NO: 922080 - RNA, 20 nt, Human
cagaauaucuuacuaggaac

SEQ ID NO: 922081 - RNA, 22 nt, Human
ccaaucaugauagcaaaaaugu

SEQ ID NO: 922082 - RNA, 27 nt, Human
ccaccccccccuccccaaccacguucc

SEQ ID NO: 922083 - RNA, 25 nt, Human
cccaagauugagauucuuauggaac

SEQ ID NO: 922084 - RNA, 25 nt, Human
cccaaguccaaacacaacaugacuu

SEQ ID NO: 922085 - RNA, 19 nt, Human
ccccaagauugagauucuu

SEQ ID NO: 922086 - RNA, 20 nt, Human
ccccaccccccccuccccaa

SEQ ID NO: 922087 - RNA, 21 nt, Human
ccccaccccccccuccccaac

SEQ ID NO: 922088 - RNA, 19 nt, Human
cccccaccccccccucccc

SEQ ID NO: 922089 - RNA, 24 nt, Human
cccccaccccccccuccccaacca

SEQ ID NO: 922090 - RNA, 31 nt, Human
cccccaccccccccuccccaaccacguuccc

SEQ ID NO: 922091 - RNA, 22 nt, Human
ccccccaccccccccuccccaa

SEQ ID NO: 922092 - RNA, 18 nt, Human
ccccccccuccccaacca

SEQ ID NO: 922093 - RNA, 18 nt, Human
ccccccccuccccaacca

SEQ ID NO: 922094 - RNA, 18 nt, Human
cccccccuccccaaccac

SEQ ID NO: 922095 - RNA, 23 nt, Human
ccgaggcggcggcggcggcagcc

SEQ ID NO: 922096 - RNA, 19 nt, Human
ccuuaaaguugaggaugga

SEQ ID NO: 922097 - RNA, 19 nt, Human
cggccgaggcggcggcggc

SEQ ID NO: 922098 - RNA, 21 nt, Human
cggcggcggcggcagccgggg

SEQ ID NO: 922099 - RNA, 18 nt, Human
cggcugucggcgcccucg

SEQ ID NO: 922100 - RNA, 21 nt, Human
cggggagggggucaccgcggc

SEQ ID NO: 922101 - RNA, 22 nt, Human
cuagagucccccccaccccccc

SEQ ID NO: 922102 - RNA, 19 nt, Human
cuccauggcuagaugagca

SEQ ID NO: 922103 - RNA, 20 nt, Human
cuccauggcuagaugagcag

SEQ ID NO: 922104 - RNA, 21 nt, Human
cucucccuguuccaaccccaa

SEQ ID NO: 922105 - RNA, 18 nt, Human
cuggggaaggggcggagg

SEQ ID NO: 922106 - RNA, 19 nt, Human
gaagagccgaggacucaug

SEQ ID NO: 922107 - RNA, 20 nt, Human
gaaggaggaggaagagccga

SEQ ID NO: 922108 - RNA, 21 nt, Human
gagagggaggcagagagcggg

SEQ ID NO: 922109 - RNA, 19 nt, Human
gagcagccgcaggcgggca

SEQ ID NO: 922110 - RNA, 21 nt, Human
gcggcggcggcagccggggag

SEQ ID NO: 922111 - RNA, 20 nt, Human
gcgggccaggucaggcuggg

SEQ ID NO: 922112 - RNA, 23 nt, Human
gcuguacucuccuuuggagguga

SEQ ID NO: 922113 - RNA, 20 nt, Human
ggaaacaacgaaggaacauc

SEQ ID NO: 922114 - RNA, 20 nt, Human
ggaagagccgaggacucaug

SEQ ID NO: 922115 - RNA, 24 nt, Human
ggaaggggcggaggaggggaggag

SEQ ID NO: 922116 - RNA, 24 nt, Human
ggcggaggaggggaggagccgggc

SEQ ID NO: 922117 - RNA, 18 nt, Human
gggaggagccgggcugcg

SEQ ID NO: 922118 - RNA, 26 nt, Human
gggccaggucaggcuggggaaggggc

SEQ ID NO: 922119 - RNA, 22 nt, Human
gggcccccggcugucggcgccc

SEQ ID NO: 922120 - RNA, 21 nt, Human
ggggagggggucaccgcggcg

SEQ ID NO: 922121 - RNA, 20 nt, Human
gguaaacuccauggcuagau

SEQ ID NO: 922122 - RNA, 19 nt, Human
gucccccccaccccccccu

SEQ ID NO: 922123 - RNA, 26 nt, Human
gucggccgaggcggcggcggcggcaa

SEQ ID NO: 922124 - RNA, 20 nt, Human
gucuagagucccccccaccc

SEQ ID NO: 922125 - RNA, 18 nt, Human
uacaaaaaaaaaaaaaaa

SEQ ID NO: 922126 - RNA, 25 nt, Human
uacuaggaacagcagcaggcccagc

SEQ ID NO: 922127 - RNA, 18 nt, Human
uacucauggaaacaacga

SEQ ID NO: 922128 - RNA, 20 nt, Human
uagagucccccccacccccc

SEQ ID NO: 922129 - RNA, 18 nt, Human
uccaaacacaacaugacu

SEQ ID NO: 922130 - RNA, 24 nt, Human
uccaaccccaaguccaaacacaac

SEQ ID NO: 922131 - RNA, 23 nt, Human
ucccccccaccccccccucccca

SEQ ID NO: 922132 - RNA, 19 nt, Human
uccgggcccccggcugucg

SEQ ID NO: 922133 - RNA, 19 nt, Human
uccucuagguccggagcag

SEQ ID NO: 922134 - RNA, 20 nt, Human
ucuagagucccccccacccc

SEQ ID NO: 922135 - RNA, 19 nt, Human
ucuccuuuggaggugaagg

SEQ ID NO: 922136 - RNA, 21 nt, Human
ugaaagggcuauauaucuguu

SEQ ID NO: 922137 - RNA, 20 nt, Human
ugagcguguagcugacaugg

SEQ ID NO: 922138 - RNA, 19 nt, Human
ugauagcaaaaauguggca

SEQ ID NO: 922139 - RNA, 24 nt, Human
ugauagcaaaaauguggcaguuuc

SEQ ID NO: 922140 - RNA, 21 nt, Human
ugcguccgggcccccggcugu

SEQ ID NO: 922141 - RNA, 20 nt, Human
uggagagggaggcagagagc

SEQ ID NO: 922142 - RNA, 20 nt, Human
uguuaaaaguuucaacaaag

SEQ ID NO: 922143 - RNA, 18 nt, Human
uugaaagggcuauauauc

SEQ ID NO: 922144 - RNA, 18 nt, Human
uuggagagggaggcagag

SEQ ID NO: 922145 - RNA, 23 nt, Human
uuuaagauaguuuucaauaacuc

SEQ ID NO: 922146 - RNA, 24 nt, Human
uuuaucaacaaugccaacuccccu

SEQ ID NO: 922147 - RNA, 19 nt, Human
aaaaagacaaaacucaggg

SEQ ID NO: 922148 - RNA, 19 nt, Human
aaccagaaccgccaguccu

SEQ ID NO: 922149 - RNA, 22 nt, Human
aaccagaaccgccaguccuucc

SEQ ID NO: 922150 - RNA, 22 nt, Human
aagcggccgagggccauggagc

SEQ ID NO: 922151 - RNA, 19 nt, Human
aagcugggcgcgacccgug

SEQ ID NO: 922152 - RNA, 24 nt, Human
acaacagagcacaggcacagaacc

SEQ ID NO: 922153 - RNA, 18 nt, Human
acagagcacaggcacaga

SEQ ID NO: 922154 - RNA, 20 nt, Human
accgccaguccuucccucca

SEQ ID NO: 922155 - RNA, 24 nt, Human
accucauacccacugcuaaggcua

SEQ ID NO: 922156 - RNA, 24 nt, Human
acugcuaaggcuaaaggaaaaaga

SEQ ID NO: 922157 - RNA, 24 nt, Human
agacaaaacucagucucagguccg

SEQ ID NO: 922158 - RNA, 21 nt, Human
aggugcaggaaagcugggccg

SEQ ID NO: 922159 - RNA, 25 nt, Human
cacugcuaaggcuaaaggaaaaaga

SEQ ID NO: 922160 - RNA, 22 nt, Human
cagaguaaaaaccagaaccgcc

SEQ ID NO: 922161 - RNA, 24 nt, Human
cagaguaaaaaccagaaccgccag

SEQ ID NO: 922162 - RNA, 20 nt, Human
ccaguccuucccuccaacac

SEQ ID NO: 922163 - RNA, 19 nt, Human
ccccgggggugcgcgcggc

SEQ ID NO: 922164 - RNA, 19 nt, Human
ccccugcacaccucauacc

SEQ ID NO: 922165 - RNA, 21 nt, Human
cccggcugcaguguggaggga

SEQ ID NO: 922166 - RNA, 19 nt, Human
ccuccaacacaacagagca

SEQ ID NO: 922167 - RNA, 19 nt, Human
cggcaggagcaggaggcgg

SEQ ID NO: 922168 - RNA, 18 nt, Human
gagcacaggcacagaacc

SEQ ID NO: 922169 - RNA, 21 nt, Human
gagcagaggcggcugggaagg

SEQ ID NO: 922170 - RNA, 20 nt, Human
gaggagcagaggcggcuggg

SEQ ID NO: 922171 - RNA, 18 nt, Human
gccgccaauaaaaaagaa

SEQ ID NO: 922172 - RNA, 23 nt, Human
ggcggagugaagccacccagcuc

SEQ ID NO: 922173 - RNA, 19 nt, Human
gggagagcccucuuuggaa

SEQ ID NO: 922174 - RNA, 24 nt, Human
gggcggagugaagccacccagcuc

SEQ ID NO: 922175 - RNA, 20 nt, Human
gugaagccacccagcucccc

SEQ ID NO: 922176 - RNA, 22 nt, Human
uaaauaaaguucacagaguaaa

SEQ ID NO: 922177 - RNA, 23 nt, Human
ucagaaaacagucuaggugggca

SEQ ID NO: 922178 - RNA, 19 nt, Human
ucucagguccggagggcuc

SEQ ID NO: 922179 - RNA, 18 nt, Human
ugccggagccgaagcccc

SEQ ID NO: 922180 - RNA, 25 nt, Human
ugccggagccgaagccccgggggug

SEQ ID NO: 922181 - RNA, 22 nt, Human
uggaaugggcggagugaagcca

SEQ ID NO: 922182 - RNA, 19 nt, Human
ugggaaggacagcagaggc

SEQ ID NO: 922183 - RNA, 23 nt, Human
uucacagaguaaaaaccagaacc

SEQ ID NO: 922184 - RNA, 27 nt, Human
aaaaaauaaaacaaccaaccaggaccc

SEQ ID NO: 922185 - RNA, 23 nt, Human
aaaacaaccaaccaggacccaaa

SEQ ID NO: 922186 - RNA, 20 nt, Human
aaaacccaaccaauccacug

SEQ ID NO: 922187 - RNA, 27 nt, Human
aaaauaaaggccaacucaguauucauu

SEQ ID NO: 922188 - RNA, 26 nt, Human
aaaauauguacaucaaugcgcaccag

SEQ ID NO: 922189 - RNA, 24 nt, Human
aaacaaccaaccaggacccaaaac

SEQ ID NO: 922190 - RNA, 18 nt, Human
aaacccccaggaacccaa

SEQ ID NO: 922191 - RNA, 23 nt, Human
aaccaaccaggacccaaaacuca

SEQ ID NO: 922192 - RNA, 21 nt, Human
aacucaguauucauuuccccc

SEQ ID NO: 922193 - RNA, 22 nt, Human
aagacccugcacaaaacccaac

SEQ ID NO: 922194 - RNA, 20 nt, Human
aagcugcuuucucuuuccac

SEQ ID NO: 922195 - RNA, 21 nt, Human
aagggaaaaugggccucacag

SEQ ID NO: 922196 - RNA, 19 nt, Human
acaaaaccaaaaaaaaaaa

SEQ ID NO: 922197 - RNA, 22 nt, Human
acaaccaaccaggacccaaaac

SEQ ID NO: 922198 - RNA, 23 nt, Human
acaaccaaccaggacccaaaacu

SEQ ID NO: 922199 - RNA, 21 nt, Human
acagggcgaaucuucucaaaa

SEQ ID NO: 922200 - RNA, 23 nt, Human
acccccaggaacccaagcaagug

SEQ ID NO: 922201 - RNA, 18 nt, Human
acgcugggggaggggugg

SEQ ID NO: 922202 - RNA, 22 nt, Human
agaaaacccccaggaacccaag

SEQ ID NO: 922203 - RNA, 21 nt, Human
agaguucugugugcauguggg

SEQ ID NO: 922204 - RNA, 18 nt, Human
agcaagugggaacugagg

SEQ ID NO: 922205 - RNA, 20 nt, Human
aggcccagcacgccgggccc

SEQ ID NO: 922206 - RNA, 21 nt, Human
aggggcagaagacacaagugg

SEQ ID NO: 922207 - RNA, 20 nt, Human
aggggguaaaauuuuggagg

SEQ ID NO: 922208 - RNA, 22 nt, Human
agggguugugugaacagggcag

SEQ ID NO: 922209 - RNA, 26 nt, Human
auaaaacaaccaaccaggacccaaaa

SEQ ID NO: 922210 - RNA, 19 nt, Human
auagaaaacaacugaugcc

SEQ ID NO: 922211 - RNA, 21 nt, Human
auauacaauaccccuuucagc

SEQ ID NO: 922212 - RNA, 24 nt, Human
aucagaaaacccccaggaacccaa

SEQ ID NO: 922213 - RNA, 23 nt, Human
auccacccaggaaggcgccuggu

SEQ ID NO: 922214 - RNA, 21 nt, Human
auucauuucccccccacccaa

SEQ ID NO: 922215 - RNA, 22 nt, Human
caaaacccaaccaauccacugu

SEQ ID NO: 922216 - RNA, 23 nt, Human
caacuccauuuagggaggggggu

SEQ ID NO: 922217 - RNA, 26 nt, Human
caacugggucuccucuucagcagucc

SEQ ID NO: 922218 - RNA, 18 nt, Human
caagucccaagcagcgug

SEQ ID NO: 922219 - RNA, 20 nt, Human
caagucccaagcagcguggg

SEQ ID NO: 922220 - RNA, 19 nt, Human
cacagaaaguugaaggucc

SEQ ID NO: 922221 - RNA, 20 nt, Human
cacagaagccauaacagggu

SEQ ID NO: 922222 - RNA, 21 nt, Human
caccagugaucagaaaacccc

SEQ ID NO: 922223 - RNA, 19 nt, Human
cagaagccauaacagggug

SEQ ID NO: 922224 - RNA, 21 nt, Human
caggcccagcacgccgggccc

SEQ ID NO: 922225 - RNA, 19 nt, Human
cagugggauauacaauacc

SEQ ID NO: 922226 - RNA, 20 nt, Human
cauagaaaacaacugaugcc

SEQ ID NO: 922227 - RNA, 22 nt, Human
caugaggaauaaugaacuuagc

SEQ ID NO: 922228 - RNA, 19 nt, Human
ccaggacccaaaacucaau

SEQ ID NO: 922229 - RNA, 22 nt, Human
cccaagcaagugggaacugagg

SEQ ID NO: 922230 - RNA, 18 nt, Human
cccccccacccaacucca

SEQ ID NO: 922231 - RNA, 24 nt, Human
cccugcacaaaacccaaccaaucc

SEQ ID NO: 922232 - RNA, 24 nt, Human
ccuagcagacccaggacgcagacu

SEQ ID NO: 922233 - RNA, 24 nt, Human
ccugcacaaaacccaaccaaucca

SEQ ID NO: 922234 - RNA, 18 nt, Human
cgaaccuagcagacccag

SEQ ID NO: 922235 - RNA, 21 nt, Human
cggcuuguuucuguuuuccuc

SEQ ID NO: 922236 - RNA, 21 nt, Human
cuagcagacccaggacgcaga

SEQ ID NO: 922237 - RNA, 18 nt, Human
cucacagaagccauaaca

SEQ ID NO: 922238 - RNA, 18 nt, Human
cucacugaaguauuuuau

SEQ ID NO: 922239 - RNA, 21 nt, Human
cucacugaaguauuuuaucaa

SEQ ID NO: 922240 - RNA, 21 nt, Human
cugaugccaaagugaaggaga

SEQ ID NO: 922241 - RNA, 22 nt, Human
cugcacaaaacccaaccaaucc

SEQ ID NO: 922242 - RNA, 20 nt, Human
cugcaguccacagggguugu

SEQ ID NO: 922243 - RNA, 22 nt, Human
cuggaagccuccuucacgcugg

SEQ ID NO: 922244 - RNA, 21 nt, Human
cugguggcugcuguuuucccu

SEQ ID NO: 922245 - RNA, 27 nt, Human
cuuucaggcccagcacgccgggcccaa

SEQ ID NO: 922246 - RNA, 23 nt, Human
gacuaagaauggugagcccacgg

SEQ ID NO: 922247 - RNA, 20 nt, Human
gagaaaauucaaaccucuaa

SEQ ID NO: 922248 - RNA, 21 nt, Human
gaugccaaagugaaggagaga

SEQ ID NO: 922249 - RNA, 21 nt, Human
gcagcgugggcugguggggug

SEQ ID NO: 922250 - RNA, 18 nt, Human
gccaaagugaaggagaga

SEQ ID NO: 922251 - RNA, 22 nt, Human
gccaaagugaaggagagaacug

SEQ ID NO: 922252 - RNA, 18 nt, Human
ggcaagguuccagguggg

SEQ ID NO: 922253 - RNA, 20 nt, Human
ggggagggguggggaugaug

SEQ ID NO: 922254 - RNA, 20 nt, Human
uaaaacaaccaaccaggacc

SEQ ID NO: 922255 - RNA, 21 nt, Human
uaaaacaaccaaccaggaccc

SEQ ID NO: 922256 - RNA, 22 nt, Human
uaaaacaaccaaccaggaccca

SEQ ID NO: 922257 - RNA, 23 nt, Human
uaaaacaaccaaccaggacccaa

SEQ ID NO: 922258 - RNA, 24 nt, Human
uaaaacaaccaaccaggacccaaa

SEQ ID NO: 922259 - RNA, 22 nt, Human
uaacccaagacccugcacaaaa

SEQ ID NO: 922260 - RNA, 23 nt, Human
uacaaaaccaaaaaaaaaaauac

SEQ ID NO: 922261 - RNA, 26 nt, Human
uacaaaaccaaaaaaaaaaauacuca

SEQ ID NO: 922262 - RNA, 18 nt, Human
uauguacaucaaugcgca

SEQ ID NO: 922263 - RNA, 20 nt, Human
uauucauuucccccccaccc

SEQ ID NO: 922264 - RNA, 20 nt, Human
ucaaaaagugaagccaacug

SEQ ID NO: 922265 - RNA, 19 nt, Human
ucagcuggggaaaagggaa

SEQ ID NO: 922266 - RNA, 20 nt, Human
ucaggauccuuucaagggcu

SEQ ID NO: 922267 - RNA, 20 nt, Human
ucaggauccuuucaagggcu

SEQ ID NO: 922268 - RNA, 24 nt, Human
ucaguauucauuucccccccaccc

SEQ ID NO: 922269 - RNA, 24 nt, Human
uccacagggguugugugaacaggg

SEQ ID NO: 922270 - RNA, 19 nt, Human
uccagaacucaaauccagc

SEQ ID NO: 922271 - RNA, 19 nt, Human
uccccagacuggaggaaaa

SEQ ID NO: 922272 - RNA, 18 nt, Human
ucccccccacccaacucc

SEQ ID NO: 922273 - RNA, 21 nt, Human
ucgcagaaaaaaguucugagu

SEQ ID NO: 922274 - RNA, 18 nt, Human
ucucaaaaagugaagcca

SEQ ID NO: 922275 - RNA, 22 nt, Human
ucucucuccuccccagacugga

SEQ ID NO: 922276 - RNA, 22 nt, Human
ucugccagcuaaaacuugcacc

SEQ ID NO: 922277 - RNA, 23 nt, Human
ugacagggugaaguaccuggaag

SEQ ID NO: 922278 - RNA, 22 nt, Human
ugagaaaggacuaagaauggug

SEQ ID NO: 922279 - RNA, 21 nt, Human
ugagaagcuggucucacugaa

SEQ ID NO: 922280 - RNA, 24 nt, Human
ugaugagaagcuggucucacugaa

SEQ ID NO: 922281 - RNA, 21 nt, Human
ugcacaaaacccaaccaaucc

SEQ ID NO: 922282 - RNA, 22 nt, Human
ugcacaaaacccaaccaaucca

SEQ ID NO: 922283 - RNA, 27 nt, Human
ugcauguagugugacuuuccccucggg

SEQ ID NO: 922284 - RNA, 19 nt, Human
uggaaagggguuuggggua

SEQ ID NO: 922285 - RNA, 19 nt, Human
uggaugagugaauuugggu

SEQ ID NO: 922286 - RNA, 24 nt, Human
ugggaaggggcagaagacacaagu

SEQ ID NO: 922287 - RNA, 18 nt, Human
ugggagcagggagugagc

SEQ ID NO: 922288 - RNA, 19 nt, Human
uggggugggcaagauaggu

SEQ ID NO: 922289 - RNA, 22 nt, Human
ugggucuccucuucagcagucc

SEQ ID NO: 922290 - RNA, 19 nt, Human
ugguggcugcuguuuuccc

SEQ ID NO: 922291 - RNA, 20 nt, Human
uguugcugcggcuuguuucu

SEQ ID NO: 922292 - RNA, 25 nt, Human
uguuuucccuuuccccccucucuca

SEQ ID NO: 922293 - RNA, 19 nt, Human
uucagcaucuccccacccc

SEQ ID NO: 922294 - RNA, 20 nt, Human
uucccuuuccccccucucuc

SEQ ID NO: 922295 - RNA, 25 nt, Human
uugagcccucucagugcagugggau

SEQ ID NO: 922296 - RNA, 18 nt, Human
uuucccccccacccaacu

SEQ ID NO: 922297 - RNA, 24 nt, Human
uuuuaaaaauaaaggccaacucag

SEQ ID NO: 922298 - RNA, 19 nt, Human
uuuuuuuuuuuuuuuuuaa

SEQ ID NO: 922299 - RNA, 22 nt, Human
aaaauaccuucucccccugccc

SEQ ID NO: 922300 - RNA, 23 nt, Human
aaaauaccuucucccccugcccc

SEQ ID NO: 922301 - RNA, 24 nt, Human
aaaauaccuucucccccugcccca

SEQ ID NO: 922302 - RNA, 22 nt, Human
acagugggcggggagggggcag

SEQ ID NO: 922303 - RNA, 19 nt, Human
acgggggaaggggugcgug

SEQ ID NO: 922304 - RNA, 22 nt, Human
aggaggggaggggugacggggu

SEQ ID NO: 922305 - RNA, 22 nt, Human
caccuggcugaggcuggcggga

SEQ ID NO: 922306 - RNA, 19 nt, Human
cacuucuugguccucaguu

SEQ ID NO: 922307 - RNA, 25 nt, Human
cagcaaaaaauagaagacgucccuc

SEQ ID NO: 922308 - RNA, 21 nt, Human
cagugggcggggagggggcag

SEQ ID NO: 922309 - RNA, 21 nt, Human
cccaccuccauccuggccucg

SEQ ID NO: 922310 - RNA, 20 nt, Human
cccccggagcccugucacuc

SEQ ID NO: 922311 - RNA, 22 nt, Human
cccccugccccagacagugggc

SEQ ID NO: 922312 - RNA, 22 nt, Human
ccccggagcccugucacucgug

SEQ ID NO: 922313 - RNA, 18 nt, Human
ccccucuggcaacguccc

SEQ ID NO: 922314 - RNA, 18 nt, Human
cccucggcuccuggggac

SEQ ID NO: 922315 - RNA, 18 nt, Human
cccucuggcaacgucccc

SEQ ID NO: 922316 - RNA, 23 nt, Human
ccuccaggcggccacucuggucc

SEQ ID NO: 922317 - RNA, 21 nt, Human
ccucccaguccggagguccca

SEQ ID NO: 922318 - RNA, 22 nt, Human
ccucggguggcccccucggcuc

SEQ ID NO: 922319 - RNA, 19 nt, Human
cuauggcuucucugagacu

SEQ ID NO: 922320 - RNA, 25 nt, Human
cucgaaaauaccuucucccccugcc

SEQ ID NO: 922321 - RNA, 23 nt, Human
cugguccuggcuacugauccuug

SEQ ID NO: 922322 - RNA, 23 nt, Human
gacagugggcggggagggggcag

SEQ ID NO: 922323 - RNA, 23 nt, Human
gaggucccaggggggcuauggcu

SEQ ID NO: 922324 - RNA, 23 nt, Human
gcuccuggggacucugcuccccu

SEQ ID NO: 922325 - RNA, 20 nt, Human
ggaccuccaggcggccacuc

SEQ ID NO: 922326 - RNA, 20 nt, Human
gggcggggagggggcagcaa

SEQ ID NO: 922327 - RNA, 24 nt, Human
gggcggggagggggcagcaaaaaa

SEQ ID NO: 922328 - RNA, 21 nt, Human
ggggaaggggugcguguggca

SEQ ID NO: 922329 - RNA, 19 nt, Human
ggguggcccccucggcucc

SEQ ID NO: 922330 - RNA, 21 nt, Human
gucacucguguucacacgggg

SEQ ID NO: 922331 - RNA, 23 nt, Human
uaaauacgggugcgggaaagucc

SEQ ID NO: 922332 - RNA, 22 nt, Human
uauugcacauggacccuauaua

SEQ ID NO: 922333 - RNA, 19 nt, Human
ucacacgggggaaggggug

SEQ ID NO: 922334 - RNA, 21 nt, Human
ucccccggagcccugucacuc

SEQ ID NO: 922335 - RNA, 21 nt, Human
ucccucccuauugcacaugga

SEQ ID NO: 922336 - RNA, 19 nt, Human
ucccugcucaggaggggag

SEQ ID NO: 922337 - RNA, 19 nt, Human
ucgaaaauaccuucucccc

SEQ ID NO: 922338 - RNA, 19 nt, Human
ucggguggcccccucggcu

SEQ ID NO: 922339 - RNA, 22 nt, Human
ucugagacuucccccggagccc

SEQ ID NO: 922340 - RNA, 22 nt, Human
ugaggcuggcgggacucuuggc

SEQ ID NO: 922341 - RNA, 22 nt, Human
ugaguggcaacuucacgacuuu

SEQ ID NO: 922342 - RNA, 22 nt, Human
uggcaacgucccccugcuuggc

SEQ ID NO: 922343 - RNA, 21 nt, Human
uggcagaagcagcuguauaaa

SEQ ID NO: 922344 - RNA, 18 nt, Human
uggccucggguggccccc

SEQ ID NO: 922345 - RNA, 23 nt, Human
uggcgggacucuuggcacauucu

SEQ ID NO: 922346 - RNA, 22 nt, Human
uuccuggucccgucucuggccc

SEQ ID NO: 922347 - RNA, 24 nt, Human
uugaguggcaacuucacgacuuuu

SEQ ID NO: 922348 - RNA, 20 nt, Human
uuuuuuuuuuugaguggcaa

SEQ ID NO: 922349 - RNA, 22 nt, Human
uuuuuuuuuuuuuuuugagugg

SEQ ID NO: 922350 - RNA, 18 nt, Human
uuuuuuuuuuuuuuuuug

SEQ ID NO: 922351 - RNA, 18 nt, Human
aaaauagagccuaagggc

SEQ ID NO: 922352 - RNA, 20 nt, Human
aaagggccucaccuggaaac

SEQ ID NO: 922353 - RNA, 24 nt, Human
aaauucaguccuuggaggcgaaag

SEQ ID NO: 922354 - RNA, 23 nt, Human
aacaggaagcggaacccccaagg

SEQ ID NO: 922355 - RNA, 20 nt, Human
accaguccacccccagcccc

SEQ ID NO: 922356 - RNA, 22 nt, Human
accaguccacccccagccccaa

SEQ ID NO: 922357 - RNA, 24 nt, Human
acccccagccccaaccccaaccac

SEQ ID NO: 922358 - RNA, 20 nt, Human
acggggggcagggcggucgc

SEQ ID NO: 922359 - RNA, 20 nt, Human
acuccauucagggaacugaa

SEQ ID NO: 922360 - RNA, 18 nt, Human
acuggagaaagggccuca

SEQ ID NO: 922361 - RNA, 21 nt, Human
agcggaacccccaaggcggcc

SEQ ID NO: 922362 - RNA, 22 nt, Human
aggcggcagcugcggcgggaug

SEQ ID NO: 922363 - RNA, 18 nt, Human
aggcggccgagcagagug

SEQ ID NO: 922364 - RNA, 21 nt, Human
agugagcaccauuaagaccau

SEQ ID NO: 922365 - RNA, 18 nt, Human
agugcuccaaggugaugg

SEQ ID NO: 922366 - RNA, 18 nt, Human
caaccccaaccacccucc

SEQ ID NO: 922367 - RNA, 20 nt, Human
caagucaguaagagcuucug

SEQ ID NO: 922368 - RNA, 22 nt, Human
cacaccaguccacccccagccc

SEQ ID NO: 922369 - RNA, 24 nt, Human
cacauuuuuacauaaauuacacac

SEQ ID NO: 922370 - RNA, 31 nt, Human
caccaguccacccccagccccaaccccaacc

SEQ ID NO: 922371 - RNA, 22 nt, Human
cacccccagccccaaccccaac

SEQ ID NO: 922372 - RNA, 21 nt, Human
cacccuccgcugccacggccu

SEQ ID NO: 922373 - RNA, 21 nt, Human
cacccuccgcugccacggccu

SEQ ID NO: 922374 - RNA, 18 nt, Human
caccuggaaacuguagga

SEQ ID NO: 922375 - RNA, 23 nt, Human
cacggccuccagcaccugacucc

SEQ ID NO: 922376 - RNA, 23 nt, Human
cacuauguacagucagugcucca

SEQ ID NO: 922377 - RNA, 24 nt, Human
cacugcuggagggggugauggccu

SEQ ID NO: 922378 - RNA, 19 nt, Human
cacuggcaaccaaccgggg

SEQ ID NO: 922379 - RNA, 19 nt, Human
cagcagcgucugggcuggc

SEQ ID NO: 922380 - RNA, 25 nt, Human
cagcuuuccuggaaaacagcacaau

SEQ ID NO: 922381 - RNA, 19 nt, Human
caguccagccacagugcug

SEQ ID NO: 922382 - RNA, 18 nt, Human
ccacccccagccccaacc

SEQ ID NO: 922383 - RNA, 23 nt, Human
ccacccccagccccaaccccaac

SEQ ID NO: 922384 - RNA, 19 nt, Human
ccagccccaaccccaacca

SEQ ID NO: 922385 - RNA, 19 nt, Human
ccauuaagaccauuuucua

SEQ ID NO: 922386 - RNA, 24 nt, Human
ccauuaagaccauuuucuagcugc

SEQ ID NO: 922387 - RNA, 21 nt, Human
cccagccccaaccccaaccac

SEQ ID NO: 922388 - RNA, 28 nt, Human
cccagccccaaccccaaccacccuccgc

SEQ ID NO: 922389 - RNA, 19 nt, Human
ccccaaccccaaccacccu

SEQ ID NO: 922390 - RNA, 21 nt, Human
ccccaaccccaaccacccucc

SEQ ID NO: 922391 - RNA, 21 nt, Human
ccccaaccccaaccacccucc

SEQ ID NO: 922392 - RNA, 24 nt, Human
ccccaaccccaaccacccuccgcu

SEQ ID NO: 922393 - RNA, 20 nt, Human
ccccagccccaaccccaacc

SEQ ID NO: 922394 - RNA, 23 nt, Human
ccccagccccaaccccaaccacc

SEQ ID NO: 922395 - RNA, 18 nt, Human
ccccagcuccucugcccc

SEQ ID NO: 922396 - RNA, 20 nt, Human
cccccagccccaaccccaac

SEQ ID NO: 922397 - RNA, 22 nt, Human
cccccagccccaaccccaacca

SEQ ID NO: 922398 - RNA, 25 nt, Human
cccccagccccaaccccaaccaccc

SEQ ID NO: 922399 - RNA, 24 nt, Human
cccucacaccaguccacccccagc

SEQ ID NO: 922400 - RNA, 19 nt, Human
ccgccgugcucuccggccc

SEQ ID NO: 922401 - RNA, 21 nt, Human
ccgcggcgaggcggcagcugc

SEQ ID NO: 922402 - RNA, 19 nt, Human
ccgugcucuccggcccggc

SEQ ID NO: 922403 - RNA, 22 nt, Human
ccucagugaagcgcccuccuug

SEQ ID NO: 922404 - RNA, 21 nt, Human
ccuccagcaccugacuccauu

SEQ ID NO: 922405 - RNA, 22 nt, Human
ccuccagcaccugacuccauuc

SEQ ID NO: 922406 - RNA, 26 nt, Human
ccugaccccagcuccucugccccagc

SEQ ID NO: 922407 - RNA, 24 nt, Human
ccugacuccauucagggaacugaa

SEQ ID NO: 922408 - RNA, 24 nt, Human
ccuguauuuuaaugagaaaaaaaa

SEQ ID NO: 922409 - RNA, 21 nt, Human
ccuugguggcggccccuccug

SEQ ID NO: 922410 - RNA, 18 nt, Human
cgaggcggcagcugcggc

SEQ ID NO: 922411 - RNA, 20 nt, Human
cgccgagcugugcccaccgc

SEQ ID NO: 922412 - RNA, 19 nt, Human
cggacaguguucacugcug

SEQ ID NO: 922413 - RNA, 22 nt, Human
cggcagagagggguggccccug

SEQ ID NO: 922414 - RNA, 20 nt, Human
cggcaguccagccacagugc

SEQ ID NO: 922415 - RNA, 22 nt, Human
cggccgcggcgaggcggcagcu

SEQ ID NO: 922416 - RNA, 21 nt, Human
cucauacaugaaaaauagagc

SEQ ID NO: 922417 - RNA, 20 nt, Human
cuccgcgccgagcugugccc

SEQ ID NO: 922418 - RNA, 18 nt, Human
cuccuugguggcggcccc

SEQ ID NO: 922419 - RNA, 25 nt, Human
cuggaacaggaagcggaacccccaa

SEQ ID NO: 922420 - RNA, 20 nt, Human
cugggccugggacaaaggug

SEQ ID NO: 922421 - RNA, 19 nt, Human
cuucaggcaccaaacagcc

SEQ ID NO: 922422 - RNA, 24 nt, Human
gcaacacuggacauguuuccauac

SEQ ID NO: 922423 - RNA, 22 nt, Human
gccauccuucaggcaccaaaca

SEQ ID NO: 922424 - RNA, 18 nt, Human
gcccaccgcuccggccgc

SEQ ID NO: 922425 - RNA, 18 nt, Human
gccccaaccccaaccacc

SEQ ID NO: 922426 - RNA, 21 nt, Human
gccccagcugcugcuccuugg

SEQ ID NO: 922427 - RNA, 23 nt, Human
ggagaaagggccucaccuggaaa

SEQ ID NO: 922428 - RNA, 20 nt, Human
ggcaagagggguggguguuu

SEQ ID NO: 922429 - RNA, 23 nt, Human
ggcccggccgcggcgaggcggca

SEQ ID NO: 922430 - RNA, 19 nt, Human
ggccgcggcgaggcggcag

SEQ ID NO: 922431 - RNA, 19 nt, Human
gggaagaaggaucaugugu

SEQ ID NO: 922432 - RNA, 19 nt, Human
gggguccuggugcccgugg

SEQ ID NO: 922433 - RNA, 20 nt, Human
ggugaugaagggaagaagga

SEQ ID NO: 922434 - RNA, 21 nt, Human
gucagcagcgucugggcuggc

SEQ ID NO: 922435 - RNA, 23 nt, Human
uaaagugagcaccauuaagacca

SEQ ID NO: 922436 - RNA, 19 nt, Human
uacguacaauucacaccuc

SEQ ID NO: 922437 - RNA, 19 nt, Human
ucaguccuuggaggcgaaa

SEQ ID NO: 922438 - RNA, 19 nt, Human
ucccgccgccgugcucucc

SEQ ID NO: 922439 - RNA, 24 nt, Human
uccuaaggccgcgcucccgccgcc

SEQ ID NO: 922440 - RNA, 20 nt, Human
uccucugccccagcugcugc

SEQ ID NO: 922441 - RNA, 21 nt, Human
uccuggugcccguggcgcggc

SEQ ID NO: 922442 - RNA, 19 nt, Human
uccuucaggcaccaaacag

SEQ ID NO: 922443 - RNA, 22 nt, Human
ucucccaguugucacuuggucu

SEQ ID NO: 922444 - RNA, 22 nt, Human
ucuuaauggcaagagggguggg

SEQ ID NO: 922445 - RNA, 22 nt, Human
ugaaaguggguauuuauuugga

SEQ ID NO: 922446 - RNA, 21 nt, Human
ugaagggaagaaggaucaugu

SEQ ID NO: 922447 - RNA, 19 nt, Human
ugaccccagcuccucugcc

SEQ ID NO: 922448 - RNA, 19 nt, Human
ugcuggagggggugauggc

SEQ ID NO: 922449 - RNA, 18 nt, Human
uggcaagaccaugcggug

SEQ ID NO: 922450 - RNA, 26 nt, Human
uggcaagagggguggguguuuugaaa

SEQ ID NO: 922451 - RNA, 18 nt, Human
uggcagcggccaugcucc

SEQ ID NO: 922452 - RNA, 21 nt, Human
uggccccugaccccagcuccu

SEQ ID NO: 922453 - RNA, 23 nt, Human
ugggaagugugagaaaggaugag

SEQ ID NO: 922454 - RNA, 22 nt, Human
ugggacuucuuaauggcaagag

SEQ ID NO: 922455 - RNA, 22 nt, Human
uggugaugaagggaagaaggau

SEQ ID NO: 922456 - RNA, 20 nt, Human
uguacacacauuuuuacaua

SEQ ID NO: 922457 - RNA, 18 nt, Human
ugugugggaagugugaga

SEQ ID NO: 922458 - RNA, 19 nt, Human
uucacuggcaaccaaccgg

SEQ ID NO: 922459 - RNA, 20 nt, Human
aggucugccccaccccggcc

SEQ ID NO: 922460 - RNA, 23 nt, Human
cccagccuggccccgcgccgguu

SEQ ID NO: 922461 - RNA, 19 nt, Human
ccccgcgcugugcgccuuc

SEQ ID NO: 922462 - RNA, 19 nt, Human
ccccggccgccucaggccu

SEQ ID NO: 922463 - RNA, 22 nt, Human
ccccggccgccucaggccucag

SEQ ID NO: 922464 - RNA, 18 nt, Human
ccuggccccgcgcugugc

SEQ ID NO: 922465 - RNA, 19 nt, Human
ccuggccccgcgcugugcg

SEQ ID NO: 922466 - RNA, 22 nt, Human
cgccgggaggucugccccaccc

SEQ ID NO: 922467 - RNA, 22 nt, Human
gccccgcgcugugcgccuucgc

SEQ ID NO: 922468 - RNA, 18 nt, Human
ggccccgcgcugugcgcc

SEQ ID NO: 922469 - RNA, 23 nt, Human
gggaggucugccccaccccggcc

SEQ ID NO: 922470 - RNA, 26 nt, Human
gggcggggcuagccgggggcgggggc

SEQ ID NO: 922471 - RNA, 23 nt, Human
uacagaaccauuaaauacaacuu

SEQ ID NO: 922472 - RNA, 20 nt, Human
ucgggcucgccgggaggucu

SEQ ID NO: 922473 - RNA, 21 nt, Human
ugccccaccccggccgccuca

SEQ ID NO: 922474 - RNA, 23 nt, Human
aaaaaccuuuaaaaccaaaaaaa

SEQ ID NO: 922475 - RNA, 24 nt, Human
aaaagaaaaaaaaaaaaacaaaaa

SEQ ID NO: 922476 - RNA, 18 nt, Human
aaaauaacggauacacug

SEQ ID NO: 922477 - RNA, 19 nt, Human
aaagcaucccaaccaauga

SEQ ID NO: 922478 - RNA, 21 nt, Human
aaccacaaguuuauuccaucc

SEQ ID NO: 922479 - RNA, 19 nt, Human
aagaagacacucgaucugc

SEQ ID NO: 922480 - RNA, 23 nt, Human
aaggaagaagacacucgaucugc

SEQ ID NO: 922481 - RNA, 22 nt, Human
acacaagccauugagagaagcc

SEQ ID NO: 922482 - RNA, 24 nt, Human
acauaguuuuuuuaaaaaauaaaa

SEQ ID NO: 922483 - RNA, 24 nt, Human
acccagaguccucaacacaagcca

SEQ ID NO: 922484 - RNA, 19 nt, Human
acccaucccacauuccauc

SEQ ID NO: 922485 - RNA, 21 nt, Human
acgcagccuggcguggcccuu

SEQ ID NO: 922486 - RNA, 18 nt, Human
agaaaacuaucuucccug

SEQ ID NO: 922487 - RNA, 22 nt, Human
agacaauaagcacaugaccugg

SEQ ID NO: 922488 - RNA, 21 nt, Human
agacccccccaccuucacacc

SEQ ID NO: 922489 - RNA, 24 nt, Human
agacccccccaccuucacaccaaa

SEQ ID NO: 922490 - RNA, 20 nt, Human
agagcacccuugauauaaaa

SEQ ID NO: 922491 - RNA, 23 nt, Human
agagggcuagagcacgccaccag

SEQ ID NO: 922492 - RNA, 24 nt, Human
agaguccucaacacaagccauuga

SEQ ID NO: 922493 - RNA, 19 nt, Human
agcgggggccuccuggagg

SEQ ID NO: 922494 - RNA, 22 nt, Human
aggcacagaagcuaccagaacc

SEQ ID NO: 922495 - RNA, 21 nt, Human
auacauuuucaaaagcuugcc

SEQ ID NO: 922496 - RNA, 20 nt, Human
aucaaguuaguucuucaaau

SEQ ID NO: 922497 - RNA, 28 nt, Human
caaaaaagaaaaaaaaaaaaacaaaaaa

SEQ ID NO: 922498 - RNA, 22 nt, Human
caaagcaucccaaccaaugaaa

SEQ ID NO: 922499 - RNA, 18 nt, Human
caacucagcuccuagagc

SEQ ID NO: 922500 - RNA, 21 nt, Human
caagcacggggaucagggugc

SEQ ID NO: 922501 - RNA, 26 nt, Human
cacccagaguccucaacacaagccau

SEQ ID NO: 922502 - RNA, 21 nt, Human
caccuccuuugauaauccuug

SEQ ID NO: 922503 - RNA, 31 nt, Human
caccuucacaccaaaaaagaaaaaaaaaaaa

SEQ ID NO: 922504 - RNA, 20 nt, Human
cagcagcacucagugaagaa

SEQ ID NO: 922505 - RNA, 22 nt, Human
cagcuccuagagcaacugucuu

SEQ ID NO: 922506 - RNA, 19 nt, Human
caggcacagaagcuaccag

SEQ ID NO: 922507 - RNA, 18 nt, Human
cauaaagugaacguugaa

SEQ ID NO: 922508 - RNA, 21 nt, Human
cauacaacuuuaaaagacuac

SEQ ID NO: 922509 - RNA, 21 nt, Human
cauuaacaaaaaccuuuaaaa

SEQ ID NO: 922510 - RNA, 26 nt, Human
ccaccugaagacaucuuaugguaggu

SEQ ID NO: 922511 - RNA, 24 nt, Human
ccaccuucacaccaaaaaagaaaa

SEQ ID NO: 922512 - RNA, 18 nt, Human
cccaggacucuuucuucg

SEQ ID NO: 922513 - RNA, 21 nt, Human
ccccauccuuggacaaggcca

SEQ ID NO: 922514 - RNA, 23 nt, Human
ccccccaccuucacaccaaaaaa

SEQ ID NO: 922515 - RNA, 21 nt, Human
ccccgcgcgcccgagccucag

SEQ ID NO: 922516 - RNA, 25 nt, Human
ccuucacaccaaaaaagaaaaaaaa

SEQ ID NO: 922517 - RNA, 19 nt, Human
ccuugaguguccaccuccu

SEQ ID NO: 922518 - RNA, 19 nt, Human
cggcccggaggaggggcgg

SEQ ID NO: 922519 - RNA, 20 nt, Human
cgggcggagcgcgcccggcg

SEQ ID NO: 922520 - RNA, 22 nt, Human
cuacacagugcuuccuuuuucc

SEQ ID NO: 922521 - RNA, 18 nt, Human
cucaccuugacacuuaac

SEQ ID NO: 922522 - RNA, 21 nt, Human
cuuaugguagguggguuucug

SEQ ID NO: 922523 - RNA, 19 nt, Human
gaaguacaaaucccaggac

SEQ ID NO: 922524 - RNA, 18 nt, Human
gagacaauaagcacauga

SEQ ID NO: 922525 - RNA, 21 nt, Human
gagcugguaacugagagggcu

SEQ ID NO: 922526 - RNA, 23 nt, Human
gccucagugcggcccggaggagg

SEQ ID NO: 922527 - RNA, 19 nt, Human
gcggagcgcgcccggcgcc

SEQ ID NO: 922528 - RNA, 20 nt, Human
ggacaaggccaccugaagac

SEQ ID NO: 922529 - RNA, 21 nt, Human
ggagagagaauaaacacagua

SEQ ID NO: 922530 - RNA, 20 nt, Human
ggcccggcagccgcaugcga

SEQ ID NO: 922531 - RNA, 26 nt, Human
gggugcacaauuagggccaggagcac

SEQ ID NO: 922532 - RNA, 19 nt, Human
gucuugagagaaugugagg

SEQ ID NO: 922533 - RNA, 25 nt, Human
gugcggcccggaggaggggcgggcg

SEQ ID NO: 922534 - RNA, 20 nt, Human
guuucugugggagucagcgg

SEQ ID NO: 922535 - RNA, 20 nt, Human
uaaaaugccugacccccauc

SEQ ID NO: 922536 - RNA, 20 nt, Human
uaagcacaugaccuggcaaa

SEQ ID NO: 922537 - RNA, 24 nt, Human
uaauagacccccccaccuucacac

SEQ ID NO: 922538 - RNA, 26 nt, Human
uacaaaaugagacaauaagcacauga

SEQ ID NO: 922539 - RNA, 18 nt, Human
uaccaccuccggcccggc

SEQ ID NO: 922540 - RNA, 19 nt, Human
uacccaggcacagaagcua

SEQ ID NO: 922541 - RNA, 19 nt, Human
uauaaaaugccugaccccc

SEQ ID NO: 922542 - RNA, 27 nt, Human
ucacaccaaaaaagaaaaaaaaaaaaa

SEQ ID NO: 922543 - RNA, 23 nt, Human
ucagcuccuagagcaacugucuu

SEQ ID NO: 922544 - RNA, 31 nt, Human
uccaaaccagcaacucagcuccuagagcaac

SEQ ID NO: 922545 - RNA, 22 nt, Human
uccuuggacaaggccaccugac

SEQ ID NO: 922546 - RNA, 19 nt, Human
ucucaccuauuacccaucc

SEQ ID NO: 922547 - RNA, 21 nt, Human
ucucaccuauuacccauccca

SEQ ID NO: 922548 - RNA, 19 nt, Human
ugaaaacacaugugcuggg

SEQ ID NO: 922549 - RNA, 18 nt, Human
ugaagaaugccuaguggc

SEQ ID NO: 922550 - RNA, 18 nt, Human
ugagagaagccagaaaug

SEQ ID NO: 922551 - RNA, 18 nt, Human
ugagagaagccagaaaug

SEQ ID NO: 922552 - RNA, 18 nt, Human
ugcaaaauaccacugaga

SEQ ID NO: 922553 - RNA, 22 nt, Human
ugccuaguggccucuugaaaac

SEQ ID NO: 922554 - RNA, 18 nt, Human
uggaaagcagacaauuca

SEQ ID NO: 922555 - RNA, 29 nt, Human
ugguaaacaauacaaaauuaaauacauuu

SEQ ID NO: 922556 - RNA, 23 nt, Human
ugguaacugagagggcuagagca

SEQ ID NO: 922557 - RNA, 31 nt, Human
ugugaaauaaaacucacaucaacauuuuaaa

SEQ ID NO: 922558 - RNA, 19 nt, Human
uguguagauauauacaagu

SEQ ID NO: 922559 - RNA, 22 nt, Human
uguguagauauauacaagugug

SEQ ID NO: 922560 - RNA, 18 nt, Human
uguguguagauauauaca

SEQ ID NO: 922561 - RNA, 23 nt, Human
uguguguagauauauacaagugu

SEQ ID NO: 922562 - RNA, 18 nt, Human
uguucagagcacccuuga

SEQ ID NO: 922563 - RNA, 25 nt, Human
uuaaaaccaaaaaaagaacgcuccu

SEQ ID NO: 922564 - RNA, 24 nt, Human
uuaacaaaaaccuuuaaaaccaaa

SEQ ID NO: 922565 - RNA, 22 nt, Human
uuaacacucgguuuacucccac

SEQ ID NO: 922566 - RNA, 23 nt, Human
uuccuugaguguccaccuccuuu

SEQ ID NO: 922567 - RNA, 21 nt, Human
uugaccaacuuaacauuucug

SEQ ID NO: 922568 - RNA, 27 nt, Human
uuguaagcagcuccauuuauuugagua

SEQ ID NO: 922569 - RNA, 24 nt, Human
uuucucaccuugacacuuaacacu

SEQ ID NO: 922570 - RNA, 21 nt, Human
uuucuuuugaucugcuuuccu

SEQ ID NO: 922571 - RNA, 23 nt, Human
agagcccagcugacagaaacuag

SEQ ID NO: 922572 - RNA, 23 nt, Human
aggaaggcauuggacaacagcca

SEQ ID NO: 922573 - RNA, 26 nt, Human
caaaugucccuccuuguccacauuuc

SEQ ID NO: 922574 - RNA, 19 nt, Human
caaggaaggcauuggacac

SEQ ID NO: 922575 - RNA, 20 nt, Human
cagaaacuagcugugaccac

SEQ ID NO: 922576 - RNA, 21 nt, Human
cagaaacuagcugugaccaca

SEQ ID NO: 922577 - RNA, 24 nt, Human
cagccagcuuucucccagagagcc

SEQ ID NO: 922578 - RNA, 25 nt, Human
cagccagcuuucucccagagagccc

SEQ ID NO: 922579 - RNA, 18 nt, Human
cagcuuucucccagagag

SEQ ID NO: 922580 - RNA, 18 nt, Human
cagugcugaggcugcuaa

SEQ ID NO: 922581 - RNA, 18 nt, Human
cauuggacaacagccagc

SEQ ID NO: 922582 - RNA, 18 nt, Human
ccaggaucuggaguuuca

SEQ ID NO: 922583 - RNA, 21 nt, Human
cccaaggagcuauuucccucu

SEQ ID NO: 922584 - RNA, 18 nt, Human
cucuuagccaggaucugg

SEQ ID NO: 922585 - RNA, 22 nt, Human
gacagaaacuagcugugaccac

SEQ ID NO: 922586 - RNA, 18 nt, Human
gagcagagccacagaggg

SEQ ID NO: 922587 - RNA, 21 nt, Human
gccaagcuacccauacggaaa

SEQ ID NO: 922588 - RNA, 21 nt, Human
gcugcuaaagauggucucuca

SEQ ID NO: 922589 - RNA, 18 nt, Human
ggcaaggagcugggaaaa

SEQ ID NO: 922590 - RNA, 21 nt, Human
ggcaggccuggcagugcugag

SEQ ID NO: 922591 - RNA, 22 nt, Human
ucccagagagcccagcugacag

SEQ ID NO: 922592 - RNA, 21 nt, Human
ugacagaaacuagcugugacc

SEQ ID NO: 922593 - RNA, 19 nt, Human
ugagcagagccacagaggg

SEQ ID NO: 922594 - RNA, 23 nt, Human
ugccaaggaaggcauuggacaac

SEQ ID NO: 922595 - RNA, 23 nt, Human
uuggacaacagccagcuuucucc

SEQ ID NO: 922596 - RNA, 24 nt, Human
uuuuuugggcuccuaaagguuuua

SEQ ID NO: 922597 - RNA, 19 nt, Human
uuuuuuuuuuuugggcucc

SEQ ID NO: 922598 - RNA, 18 nt, Human
uuuuuuuuuuuuuuuuug

SEQ ID NO: 922599 - RNA, 25 nt, Human
uuuuuuuuuuuuuuuuuuuuuuggg

SEQ ID NO: 922600 - RNA, 19 nt, Human
ccccgggggcaggagcgcc

SEQ ID NO: 922601 - RNA, 21 nt, Human
ccguggcgacaagcgggcgcg

SEQ ID NO: 922602 - RNA, 18 nt, Human
cgacaagcgggcgcgggg

SEQ ID NO: 922603 - RNA, 18 nt, Human
gccagaagcgaucacagg

SEQ ID NO: 922604 - RNA, 20 nt, Human
ggacgguuagggaggccagc

SEQ ID NO: 922605 - RNA, 20 nt, Human
gggcgcggggucgugcagcg

SEQ ID NO: 922606 - RNA, 20 nt, Human
ucaccccgggggcaggagcu

SEQ ID NO: 922607 - RNA, 22 nt, Human
aaaaaaaaugucaaaggacagc

SEQ ID NO: 922608 - RNA, 21 nt, Human
aaaagcacauccaacuaaauc

SEQ ID NO: 922609 - RNA, 24 nt, Human
aaaggacauuuaaaagcacaucca

SEQ ID NO: 922610 - RNA, 24 nt, Human
acauccaacuaaaucaaaaaaggg

SEQ ID NO: 922611 - RNA, 23 nt, Human
agaggguugaaaagccccugagc

SEQ ID NO: 922612 - RNA, 25 nt, Human
aggauuagaaaucacacuaguucau

SEQ ID NO: 922613 - RNA, 24 nt, Human
caaaaaaaaaaauuaaacuagauc

SEQ ID NO: 922614 - RNA, 23 nt, Human
caacgcgauaccggaaggacugg

SEQ ID NO: 922615 - RNA, 20 nt, Human
caacuaaaucaaaaaaggga

SEQ ID NO: 922616 - RNA, 23 nt, Human
cacagagggcagcgaaugcggca

SEQ ID NO: 922617 - RNA, 23 nt, Human
caccauggauaggagucccccca

SEQ ID NO: 922618 - RNA, 23 nt, Human
cagaaaagccacagagggcagcg

SEQ ID NO: 922619 - RNA, 21 nt, Human
cagaacacagggaagaacagc

SEQ ID NO: 922620 - RNA, 20 nt, Human
cagcagaaaagccacagagg

SEQ ID NO: 922621 - RNA, 22 nt, Human
ccagcgguggcgucgcugcucc

SEQ ID NO: 922622 - RNA, 30 nt, Human
ccucaugcaggcaaaggacauuuaaaagcu

SEQ ID NO: 922623 - RNA, 24 nt, Human
cucaaaaagguccccuuuccaccu

SEQ ID NO: 922624 - RNA, 21 nt, Human
gacaacucaaaaagguccccu

SEQ ID NO: 922625 - RNA, 19 nt, Human
gcagaacacagggaagaac

SEQ ID NO: 922626 - RNA, 22 nt, Human
gccccugagcaacgcgauaccg

SEQ ID NO: 922627 - RNA, 18 nt, Human
gccuugcccagcgguggc

SEQ ID NO: 922628 - RNA, 24 nt, Human
ggaaggacuggguaggccggcugg

SEQ ID NO: 922629 - RNA, 18 nt, Human
ggaguccccccacggccu

SEQ ID NO: 922630 - RNA, 22 nt, Human
ggaguccccccacggccucggc

SEQ ID NO: 922631 - RNA, 22 nt, Human
gggcagcgaaugcggcagcggg

SEQ ID NO: 922632 - RNA, 22 nt, Human
gggcggcagaacacagggaaga

SEQ ID NO: 922633 - RNA, 23 nt, Human
uaaaagcacauccaacuaaauca

SEQ ID NO: 922634 - RNA, 18 nt, Human
uaggacuacaggcugcca

SEQ ID NO: 922635 - RNA, 23 nt, Human
uccaaguuacauuuccucuaaaa

SEQ ID NO: 922636 - RNA, 24 nt, Human
uccucuaaaaaaaaaaaugucaaa

SEQ ID NO: 922637 - RNA, 21 nt, Human
ugacagaggguugaaaagccc

SEQ ID NO: 922638 - RNA, 23 nt, Human
ugcggcagcgggcggcagaacac

SEQ ID NO: 922639 - RNA, 24 nt, Human
ugggauauguugcaaaaaaaaaaa

SEQ ID NO: 922640 - RNA, 22 nt, Human
uggguaggccggcuggugcggu

SEQ ID NO: 922641 - RNA, 21 nt, Human
uggugcgguggaagcgaagcc

SEQ ID NO: 922642 - RNA, 24 nt, Human
uuaaaagcacauccaacuaaauca

SEQ ID NO: 922643 - RNA, 18 nt, Human
uucaacaccauggauagg

SEQ ID NO: 922644 - RNA, 19 nt, Human
uucauccuucauuaucagg

SEQ ID NO: 922645 - RNA, 24 nt, Human
uuguuuuuaaaagacaccucucag

SEQ ID NO: 922646 - RNA, 19 nt, Human
aaacagcccuuuaucaaga

SEQ ID NO: 922647 - RNA, 21 nt, Human
aaacagcccuuuaucaagagu

SEQ ID NO: 922648 - RNA, 24 nt, Human
acagggccccugcaugcugagcaa

SEQ ID NO: 922649 - RNA, 18 nt, Human
agcaccagggcacgcacc

SEQ ID NO: 922650 - RNA, 21 nt, Human
aggcagccuugggcugugccc

SEQ ID NO: 922651 - RNA, 24 nt, Human
agggcugcucggggcaccagagug

SEQ ID NO: 922652 - RNA, 23 nt, Human
cagccagacaucccuccaggcau

SEQ ID NO: 922653 - RNA, 22 nt, Human
caggcugggccugagggguggg

SEQ ID NO: 922654 - RNA, 21 nt, Human
cccuccaggcaugucuucuga

SEQ ID NO: 922655 - RNA, 19 nt, Human
cccucgggggcauccccuu

SEQ ID NO: 922656 - RNA, 18 nt, Human
cgacagggccccugcaug

SEQ ID NO: 922657 - RNA, 24 nt, Human
cggcugcuugcccacagggcugcu

SEQ ID NO: 922658 - RNA, 21 nt, Human
cuagcuggacuggcacccucg

SEQ ID NO: 922659 - RNA, 18 nt, Human
cucggggcaccagagugg

SEQ ID NO: 922660 - RNA, 21 nt, Human
gccccugcaugcugagcaaca

SEQ ID NO: 922661 - RNA, 20 nt, Human
gcggcggcugcuugcccaca

SEQ ID NO: 922662 - RNA, 19 nt, Human
ggagcuugggggccaggcu

SEQ ID NO: 922663 - RNA, 23 nt, Human
ggcggcugcuugcccacagggcu

SEQ ID NO: 922664 - RNA, 23 nt, Human
gggcacgcaccguggggaggcag

SEQ ID NO: 922665 - RNA, 24 nt, Human
uagcuggacuggcacccucggggg

SEQ ID NO: 922666 - RNA, 25 nt, Human
uagcuggacuggcacccucgggggc

SEQ ID NO: 922667 - RNA, 22 nt, Human
uccauggcaaaacagcccuuua

SEQ ID NO: 922668 - RNA, 18 nt, Human
ucccagagcuuccucgug

SEQ ID NO: 922669 - RNA, 22 nt, Human
uggcacccucgggggcaucccc

SEQ ID NO: 922670 - RNA, 24 nt, Human
uggggagcuugggggccaggcugg

SEQ ID NO: 922671 - RNA, 20 nt, Human
uuuuuuuuuuuuuuuuccau

SEQ ID NO: 922672 - RNA, 25 nt, Human
uuuuuuuuuuuuuuuuuuuccaugg

SEQ ID NO: 922673 - RNA, 22 nt, Human
aaagagcagaucccaugaccaa

SEQ ID NO: 922674 - RNA, 24 nt, Human
aaagaucugcgaagauuuuuuuua

SEQ ID NO: 922675 - RNA, 22 nt, Human
aaagcuccccagggacuuaaag

SEQ ID NO: 922676 - RNA, 20 nt, Human
aaaguuccagauggaccugg

SEQ ID NO: 922677 - RNA, 22 nt, Human
aaccacaaggaacaguucuccu

SEQ ID NO: 922678 - RNA, 24 nt, Human
aacccagugaccuugauacgaucc

SEQ ID NO: 922679 - RNA, 19 nt, Human
aaccuaaacagcucucucc

SEQ ID NO: 922680 - RNA, 18 nt, Human
aagaugcagacacuuugc

SEQ ID NO: 922681 - RNA, 22 nt, Human
aaugggacugcugaugccugug

SEQ ID NO: 922682 - RNA, 18 nt, Human
aauguuauccagggguga

SEQ ID NO: 922683 - RNA, 21 nt, Human
accaggaggccacgacaggcc

SEQ ID NO: 922684 - RNA, 21 nt, Human
acccuggauucgcagacuugg

SEQ ID NO: 922685 - RNA, 21 nt, Human
acgaugcagcaggaagcagaa

SEQ ID NO: 922686 - RNA, 20 nt, Human
acuauguaauaaaugagcca

SEQ ID NO: 922687 - RNA, 24 nt, Human
acuuaaagccccaagaagggaugg

SEQ ID NO: 922688 - RNA, 18 nt, Human
agagcccaccccaaaugg

SEQ ID NO: 922689 - RNA, 25 nt, Human
agagcccaccucuccccagcugccc

SEQ ID NO: 922690 - RNA, 18 nt, Human
agaugcagacacuuugcc

SEQ ID NO: 922691 - RNA, 20 nt, Human
agcaccagccaguaaaaccc

SEQ ID NO: 922692 - RNA, 21 nt, Human
agccagcugcccugcuccugg

SEQ ID NO: 922693 - RNA, 26 nt, Human
agccuccugggccgccuccaccccuu

SEQ ID NO: 922694 - RNA, 22 nt, Human
agcuggaagcaacuccagggac

SEQ ID NO: 922695 - RNA, 22 nt, Human
aggagaccuacagggaaagcuc

SEQ ID NO: 922696 - RNA, 23 nt, Human
aggaguuuuacagacuaaaggaa

SEQ ID NO: 922697 - RNA, 22 nt, Human
agggcagcgcggggccucuggu

SEQ ID NO: 922698 - RNA, 18 nt, Human
agguucuggcugagccug

SEQ ID NO: 922699 - RNA, 22 nt, Human
auaaaugagccaccaugagcaa

SEQ ID NO: 922700 - RNA, 22 nt, Human
auacagaguuuuaauuuuuuuu

SEQ ID NO: 922701 - RNA, 24 nt, Human
auacuugguggcaaauguuaucca

SEQ ID NO: 922702 - RNA, 22 nt, Human
auccccaaaaaggcaaaagcug

SEQ ID NO: 922703 - RNA, 20 nt, Human
augugugugugugugugugu

SEQ ID NO: 922704 - RNA, 24 nt, Human
caaaaagaucggaaaaccuaaaca

SEQ ID NO: 922705 - RNA, 23 nt, Human
caaagagcagaucccaugaccaa

SEQ ID NO: 922706 - RNA, 23 nt, Human
caagaauagagcugggaucucaa

SEQ ID NO: 922707 - RNA, 23 nt, Human
caagaucagacagcagagugaac

SEQ ID NO: 922708 - RNA, 20 nt, Human
caagcccacccucccaagau

SEQ ID NO: 922709 - RNA, 22 nt, Human
caagcuacuugccagaaacuca

SEQ ID NO: 922710 - RNA, 24 nt, Human
caagggauaaccugcagccggggc

SEQ ID NO: 922711 - RNA, 23 nt, Human
caccaagcauccccaaaaaggca

SEQ ID NO: 922712 - RNA, 22 nt, Human
caccaugagcaagaaacaauga

SEQ ID NO: 922713 - RNA, 21 nt, Human
cacuugcaaugcccaugggaa

SEQ ID NO: 922714 - RNA, 18 nt, Human
cagcaccugcuuuggaag

SEQ ID NO: 922715 - RNA, 21 nt, Human
cagccagcugcccugcuccug

SEQ ID NO: 922716 - RNA, 18 nt, Human
cagcugagggcugggguu

SEQ ID NO: 922717 - RNA, 18 nt, Human
cagcugcccugcuccugg

SEQ ID NO: 922718 - RNA, 18 nt, Human
cagcuuagcagguccccu

SEQ ID NO: 922719 - RNA, 20 nt, Human
cagcuuaucggguacaccaa

SEQ ID NO: 922720 - RNA, 19 nt, Human
caggacaggggacacaccc

SEQ ID NO: 922721 - RNA, 21 nt, Human
caggccccgcacgguggcacu

SEQ ID NO: 922722 - RNA, 18 nt, Human
caggcugggagccccugg

SEQ ID NO: 922723 - RNA, 18 nt, Human
caguacgugccuucagug

SEQ ID NO: 922724 - RNA, 23 nt, Human
caguagggggcuaagaaugacaa

SEQ ID NO: 922725 - RNA, 21 nt, Human
caguccucccuccccagcacc

SEQ ID NO: 922726 - RNA, 23 nt, Human
caguuaccucccucccucuagga

SEQ ID NO: 922727 - RNA, 23 nt, Human
cauuuuuacacaaagcugcugau

SEQ ID NO: 922728 - RNA, 22 nt, Human
ccaacucuagcccuaccauggc

SEQ ID NO: 922729 - RNA, 20 nt, Human
ccaagcuacuugccagaaac

SEQ ID NO: 922730 - RNA, 28 nt, Human
ccagggcagcgcggggccucuggugggg

SEQ ID NO: 922731 - RNA, 20 nt, Human
ccaguaaaacccagugaccu

SEQ ID NO: 922732 - RNA, 19 nt, Human
ccauuggagccuuugcucu

SEQ ID NO: 922733 - RNA, 20 nt, Human
cccaacucuagcccuaccau

SEQ ID NO: 922734 - RNA, 26 nt, Human
cccaaguuacaaauagcaagaguuaa

SEQ ID NO: 922735 - RNA, 25 nt, Human
cccaugccaugggcaucuccaaagg

SEQ ID NO: 922736 - RNA, 26 nt, Human
ccccuggauggucacacagcuggcuc

SEQ ID NO: 922737 - RNA, 23 nt, Human
cccgggaucccgagcacugacuc

SEQ ID NO: 922738 - RNA, 25 nt, Human
cccuggcugggggcuaggagcucau

SEQ ID NO: 922739 - RNA, 20 nt, Human
ccugagauguugaagagccc

SEQ ID NO: 922740 - RNA, 21 nt, Human
ccugaugcugagaaccucucc

SEQ ID NO: 922741 - RNA, 19 nt, Human
ccugggccgccuccacccc

SEQ ID NO: 922742 - RNA, 18 nt, Human
ccugucagguguggcugg

SEQ ID NO: 922743 - RNA, 18 nt, Human
ccuguuccagccacagcc

SEQ ID NO: 922744 - RNA, 20 nt, Human
ccuugugucagauggcagac

SEQ ID NO: 922745 - RNA, 18 nt, Human
cgggaucccgagcacuga

SEQ ID NO: 922746 - RNA, 19 nt, Human
cuaaacagcucucuccuga

SEQ ID NO: 922747 - RNA, 18 nt, Human
cucauagacugagaaaga

SEQ ID NO: 922748 - RNA, 19 nt, Human
cuccaaaggggguccuggg

SEQ ID NO: 922749 - RNA, 21 nt, Human
cuccagggacaugugcccccu

SEQ ID NO: 922750 - RNA, 19 nt, Human
cucccagcucccgaaucca

SEQ ID NO: 922751 - RNA, 24 nt, Human
cucccagcucccgaauccaccccc

SEQ ID NO: 922752 - RNA, 23 nt, Human
cucccgaauccaccccugccaug

SEQ ID NO: 922753 - RNA, 25 nt, Human
cucccuggaaaagcauuccaaugga

SEQ ID NO: 922754 - RNA, 23 nt, Human
cugaaaagcagagcccaccucuc

SEQ ID NO: 922755 - RNA, 18 nt, Human
cugcagcuuaucggguac

SEQ ID NO: 922756 - RNA, 23 nt, Human
cuggaugaugucugccuggaacc

SEQ ID NO: 922757 - RNA, 21 nt, Human
cugucuucagccuccugggcc

SEQ ID NO: 922758 - RNA, 20 nt, Human
gaaccuaacguagaggcugg

SEQ ID NO: 922759 - RNA, 24 nt, Human
gaacucaaaagggcugacuggcag

SEQ ID NO: 922760 - RNA, 24 nt, Human
gaagugaauucaguuaccucccuc

SEQ ID NO: 922761 - RNA, 19 nt, Human
gaccuugucccccucccac

SEQ ID NO: 922762 - RNA, 21 nt, Human
gagcaagggauaaccugcagc

SEQ ID NO: 922763 - RNA, 19 nt, Human
gaggccacgacaggccuug

SEQ ID NO: 922764 - RNA, 19 nt, Human
gagguucuggcugagccug

SEQ ID NO: 922765 - RNA, 24 nt, Human
gagguucuggcugagccugugggc

SEQ ID NO: 922766 - RNA, 18 nt, Human
gaucccgagcacugacuc

SEQ ID NO: 922767 - RNA, 21 nt, Human
gcacacaugacugauggaggu

SEQ ID NO: 922768 - RNA, 24 nt, Human
gcagaaguguggcucucaacaagg

SEQ ID NO: 922769 - RNA, 19 nt, Human
gcaucacucaggcucccug

SEQ ID NO: 922770 - RNA, 21 nt, Human
gcccaccucuccccagcugcc

SEQ ID NO: 922771 - RNA, 21 nt, Human
gcggagggcugggggucugca

SEQ ID NO: 922772 - RNA, 20 nt, Human
gcuagcacggugcaccgggg

SEQ ID NO: 922773 - RNA, 22 nt, Human
gcucccugaaguccagcucccu

SEQ ID NO: 922774 - RNA, 24 nt, Human
ggaaagcuccccagggacuuaaag

SEQ ID NO: 922775 - RNA, 21 nt, Human
ggaagcuccucacuuagcuuc

SEQ ID NO: 922776 - RNA, 18 nt, Human
ggagaacagccauucaca

SEQ ID NO: 922777 - RNA, 18 nt, Human
ggaggguuggcugagaug

SEQ ID NO: 922778 - RNA, 22 nt, Human
ggcugagccugugggcagugcc

SEQ ID NO: 922779 - RNA, 27 nt, Human
gggaaucagcugggauuccucgugucg

SEQ ID NO: 922780 - RNA, 23 nt, Human
gggccagggcagcgcggggccuc

SEQ ID NO: 922781 - RNA, 20 nt, Human
ggggucacuuuugcagaguc

SEQ ID NO: 922782 - RNA, 19 nt, Human
gguggagguggccugaugc

SEQ ID NO: 922783 - RNA, 19 nt, Human
ggugggagguggaggcagg

SEQ ID NO: 922784 - RNA, 20 nt, Human
guagcccugggccuagaguu

SEQ ID NO: 922785 - RNA, 18 nt, Human
gucacuuuugcagaguca

SEQ ID NO: 922786 - RNA, 20 nt, Human
gugaaccaggaggccacgac

SEQ ID NO: 922787 - RNA, 22 nt, Human
gugcaggcugggagccccuggg

SEQ ID NO: 922788 - RNA, 22 nt, Human
guggaagggggugggaggugga

SEQ ID NO: 922789 - RNA, 24 nt, Human
guggcugguggcucagacuuuggg

SEQ ID NO: 922790 - RNA, 18 nt, Human
gugugugugugugugugu

SEQ ID NO: 922791 - RNA, 20 nt, Human
uaaaacccagugaccuugau

SEQ ID NO: 922792 - RNA, 19 nt, Human
uacaccaagagguucuggc

SEQ ID NO: 922793 - RNA, 19 nt, Human
uacaccaguggcuucuggu

SEQ ID NO: 922794 - RNA, 19 nt, Human
uagagucccccaaagaugc

SEQ ID NO: 922795 - RNA, 24 nt, Human
uauaugugugugugugugugugag

SEQ ID NO: 922796 - RNA, 21 nt, Human
uauauuagacucucuugauug

SEQ ID NO: 922797 - RNA, 18 nt, Human
uaugugugugugugugug

SEQ ID NO: 922798 - RNA, 21 nt, Human
uaugugugugugugugugugu

SEQ ID NO: 922799 - RNA, 19 nt, Human
ucacacagcuggcuccugg

SEQ ID NO: 922800 - RNA, 18 nt, Human
ucacucaggcucccugaa

SEQ ID NO: 922801 - RNA, 18 nt, Human
ucagacagcagagugaac

SEQ ID NO: 922802 - RNA, 19 nt, Human
ucaucuacccauguagauu

SEQ ID NO: 922803 - RNA, 20 nt, Human
ucauuggagguuggucucca

SEQ ID NO: 922804 - RNA, 22 nt, Human
uccaccccuacucuagaauaca

SEQ ID NO: 922805 - RNA, 19 nt, Human
ucccaaggaaaggcuuuga

SEQ ID NO: 922806 - RNA, 23 nt, Human
ucccacacccuucugccuuugac

SEQ ID NO: 922807 - RNA, 22 nt, Human
ucccagcucccgaauccacccc

SEQ ID NO: 922808 - RNA, 20 nt, Human
uccccagccagggcuguugg

SEQ ID NO: 922809 - RNA, 22 nt, Human
uccccagcugcccugacaccuc

SEQ ID NO: 922810 - RNA, 23 nt, Human
ucccccuccaccccuggaugguc

SEQ ID NO: 922811 - RNA, 19 nt, Human
uccgcagaaccuaacguag

SEQ ID NO: 922812 - RNA, 19 nt, Human
uccugggccgccuccaccc

SEQ ID NO: 922813 - RNA, 19 nt, Human
ucuaagcccccuugcuucc

SEQ ID NO: 922814 - RNA, 22 nt, Human
ucuauccuggcauuggggugga

SEQ ID NO: 922815 - RNA, 23 nt, Human
ucuccccagcugcccugacaccu

SEQ ID NO: 922816 - RNA, 21 nt, Human
ucuggauauucacaaagaccc

SEQ ID NO: 922817 - RNA, 18 nt, Human
ucugugcaccugucuuca

SEQ ID NO: 922818 - RNA, 20 nt, Human
ugaaaacaugagccaaugcc

SEQ ID NO: 922819 - RNA, 19 nt, Human
ugaaaagcagagcccaccu

SEQ ID NO: 922820 - RNA, 22 nt, Human
ugaaaguuccagauggaccugg

SEQ ID NO: 922821 - RNA, 18 nt, Human
ugaaggaagcagcaacuu

SEQ ID NO: 922822 - RNA, 20 nt, Human
ugaaguccagcucccucucu

SEQ ID NO: 922823 - RNA, 20 nt, Human
ugacaaagagcagaucccau

SEQ ID NO: 922824 - RNA, 23 nt, Human
ugacaugcauguacugauccgga

SEQ ID NO: 922825 - RNA, 24 nt, Human
ugaccauuggagccuuugcucuua

SEQ ID NO: 922826 - RNA, 24 nt, Human
ugagacucugagucuuaacuucca

SEQ ID NO: 922827 - RNA, 23 nt, Human
ugagaugggcugggcugaaacag

SEQ ID NO: 922828 - RNA, 18 nt, Human
ugagggcuggggucugag

SEQ ID NO: 922829 - RNA, 20 nt, Human
ugagggcuggggucugaguu

SEQ ID NO: 922830 - RNA, 18 nt, Human
ugaguuccucugaaaagc

SEQ ID NO: 922831 - RNA, 21 nt, Human
ugaugcugaaggaagcagcaa

SEQ ID NO: 922832 - RNA, 18 nt, Human
ugcagacacuuugccuca

SEQ ID NO: 922833 - RNA, 20 nt, Human
ugcagcuacucaguaaauua

SEQ ID NO: 922834 - RNA, 20 nt, Human
ugcagucacucccaugggcc

SEQ ID NO: 922835 - RNA, 25 nt, Human
ugcauguacugauccggagaagccu

SEQ ID NO: 922836 - RNA, 19 nt, Human
ugccauaggaccugggucc

SEQ ID NO: 922837 - RNA, 20 nt, Human
ugcccugacaccuccccagg

SEQ ID NO: 922838 - RNA, 21 nt, Human
ugcccuggggcaggggagacc

SEQ ID NO: 922839 - RNA, 23 nt, Human
ugccucaggugacuugaauggga

SEQ ID NO: 922840 - RNA, 22 nt, Human
ugcucuaggagagagagcagga

SEQ ID NO: 922841 - RNA, 23 nt, Human
uggacccaaggcccaccggugcc

SEQ ID NO: 922842 - RNA, 19 nt, Human
uggaggcaggcuggccccu

SEQ ID NO: 922843 - RNA, 20 nt, Human
uggauauucacaaagacccc

SEQ ID NO: 922844 - RNA, 21 nt, Human
uggauauucacaaagacccca

SEQ ID NO: 922845 - RNA, 19 nt, Human
uggauuaaacagugcagag

SEQ ID NO: 922846 - RNA, 25 nt, Human
uggauucgcagacuuggggcaucac

SEQ ID NO: 922847 - RNA, 21 nt, Human
uggcaaggggcuacguggaaa

SEQ ID NO: 922848 - RNA, 22 nt, Human
uggcacuugcaaugcccauggg

SEQ ID NO: 922849 - RNA, 20 nt, Human
uggcagcuggaagcaacucc

SEQ ID NO: 922850 - RNA, 20 nt, Human
uggcaugggcagaagugugg

SEQ ID NO: 922851 - RNA, 26 nt, Human
uggcucccucugaacacagcgaggac

SEQ ID NO: 922852 - RNA, 18 nt, Human
uggcugaaaacaugagcc

SEQ ID NO: 922853 - RNA, 20 nt, Human
uggcugaaggcagcuaucac

SEQ ID NO: 922854 - RNA, 19 nt, Human
uggcugagaugggcugggc

SEQ ID NO: 922855 - RNA, 20 nt, Human
ugggaaagcaucacucaggc

SEQ ID NO: 922856 - RNA, 20 nt, Human
ugggagccccugggugaggc

SEQ ID NO: 922857 - RNA, 21 nt, Human
ugggagguggaggcaggcugg

SEQ ID NO: 922858 - RNA, 22 nt, Human
ugggagguggaggcaggcuggc

SEQ ID NO: 922859 - RNA, 22 nt, Human
ugggauucccagccuucugggu

SEQ ID NO: 922860 - RNA, 19 nt, Human
ugggcagccagcugagggc

SEQ ID NO: 922861 - RNA, 23 nt, Human
ugggcagccagcugagggcuggg

SEQ ID NO: 922862 - RNA, 19 nt, Human
uggggagagggcuauagcu

SEQ ID NO: 922863 - RNA, 22 nt, Human
uggggagagggcuauagcuucu

SEQ ID NO: 922864 - RNA, 22 nt, Human
uggggcaucaccacuccugcaa

SEQ ID NO: 922865 - RNA, 18 nt, Human
uggguggagaggaauagc

SEQ ID NO: 922866 - RNA, 21 nt, Human
ugguggggcuggggccucaug

SEQ ID NO: 922867 - RNA, 23 nt, Human
ugguggggcuggggccucauggu

SEQ ID NO: 922868 - RNA, 18 nt, Human
ugguugacuuugccuggu

SEQ ID NO: 922869 - RNA, 21 nt, Human
ugguuuucccccuccaccccu

SEQ ID NO: 922870 - RNA, 21 nt, Human
uguauaugugugugugugugu

SEQ ID NO: 922871 - RNA, 25 nt, Human
uguauaugugugugugugugugugg

SEQ ID NO: 922872 - RNA, 22 nt, Human
ugucacaggccuuggcagcugg

SEQ ID NO: 922873 - RNA, 23 nt, Human
ugucacaggccuuggcagcugga

SEQ ID NO: 922874 - RNA, 22 nt, Human
uguguauaugugugugugugug

SEQ ID NO: 922875 - RNA, 23 nt, Human
uguguguauaugugugugugugu

SEQ ID NO: 922876 - RNA, 24 nt, Human
uguguguauaugugugugugugug

SEQ ID NO: 922877 - RNA, 19 nt, Human
uguguguguauaugugugu

SEQ ID NO: 922878 - RNA, 20 nt, Human
uguguguguauaugugugug

SEQ ID NO: 922879 - RNA, 21 nt, Human
uguguguguauaugugugugu

SEQ ID NO: 922880 - RNA, 24 nt, Human
uguguguguauaugugugugugug

SEQ ID NO: 922881 - RNA, 21 nt, Human
uguguguguguauaugugugu

SEQ ID NO: 922882 - RNA, 21 nt, Human
uguguguguguguauaugugu

SEQ ID NO: 922883 - RNA, 30 nt, Human
uguguguguguguauauguguguguguguu

SEQ ID NO: 922884 - RNA, 18 nt, Human
ugugugugugugugugug

SEQ ID NO: 922885 - RNA, 24 nt, Human
uguguguguguguguguuaaugug

SEQ ID NO: 922886 - RNA, 18 nt, Human
uuaaacagugcagagcag

SEQ ID NO: 922887 - RNA, 18 nt, Human
uucacaguccucccuccc

SEQ ID NO: 922888 - RNA, 21 nt, Human
uuccagcagccaccaagggug

SEQ ID NO: 922889 - RNA, 19 nt, Human
uuccaggaacgaaauugcc

SEQ ID NO: 922890 - RNA, 25 nt, Human
uucccagcaccagccaguaaaaccc

SEQ ID NO: 922891 - RNA, 18 nt, Human
uucccucagaacucccua

SEQ ID NO: 922892 - RNA, 21 nt, Human
uucuaagcccccuugcuuccc

SEQ ID NO: 922893 - RNA, 24 nt, Human
uuguguguguguguauaugugugu

SEQ ID NO: 922894 - RNA, 21 nt, Human
uuuaaggacaaauaaaaggcg

SEQ ID NO: 922895 - RNA, 23 nt, Human
aaaaacagcagcaggagagaggc

SEQ ID NO: 922896 - RNA, 23 nt, Human
aaaacaagagauuuuccccaaaa

SEQ ID NO: 922897 - RNA, 24 nt, Human
aaaggaaggcagcuggggcuugga

SEQ ID NO: 922898 - RNA, 18 nt, Human
aagaaaagagaaccuggg

SEQ ID NO: 922899 - RNA, 24 nt, Human
aagaaucuugccuucccuccuuuc

SEQ ID NO: 922900 - RNA, 22 nt, Human
aagcuugggaauccaaaaggaa

SEQ ID NO: 922901 - RNA, 19 nt, Human
aaggaaggcagcuggggcu

SEQ ID NO: 922902 - RNA, 21 nt, Human
aagggacagcggucccacagc

SEQ ID NO: 922903 - RNA, 24 nt, Human
aauaagaaacaaauccggugucca

SEQ ID NO: 922904 - RNA, 24 nt, Human
acacauccugaagcuugggaaucc

SEQ ID NO: 922905 - RNA, 28 nt, Human
acaccaccacacccucuuucccaugggc

SEQ ID NO: 922906 - RNA, 21 nt, Human
acagcagcaggagagaggccu

SEQ ID NO: 922907 - RNA, 19 nt, Human
acagcuggacacggcacag

SEQ ID NO: 922908 - RNA, 18 nt, Human
acauacacucuuuccagc

SEQ ID NO: 922909 - RNA, 22 nt, Human
acucggggcuggggcgggcgcg

SEQ ID NO: 922910 - RNA, 22 nt, Human
agaaaggauucucccaguugga

SEQ ID NO: 922911 - RNA, 18 nt, Human
agagggcagggcaagaag

SEQ ID NO: 922912 - RNA, 21 nt, Human
agcaaguaaagucagggcuaa

SEQ ID NO: 922913 - RNA, 18 nt, Human
aggagggugggggcuaca

SEQ ID NO: 922914 - RNA, 22 nt, Human
aggcggcgggacucggggcugg

SEQ ID NO: 922915 - RNA, 23 nt, Human
auacauacacucuuuccagcaug

SEQ ID NO: 922916 - RNA, 20 nt, Human
auguaucugggcaagcugag

SEQ ID NO: 922917 - RNA, 24 nt, Human
caaaaacagcagcaggagagaggc

SEQ ID NO: 922918 - RNA, 18 nt, Human
caagauaccuccuccucu

SEQ ID NO: 922919 - RNA, 24 nt, Human
caagcugaggcccaggaggaggcc

SEQ ID NO: 922920 - RNA, 18 nt, Human
caauaagaaaagagaacc

SEQ ID NO: 922921 - RNA, 24 nt, Human
cacacccucuuucccaugggccaa

SEQ ID NO: 922922 - RNA, 18 nt, Human
caccacacccucuuuccc

SEQ ID NO: 922923 - RNA, 22 nt, Human
caccaccacacccucuuuccca

SEQ ID NO: 922924 - RNA, 23 nt, Human
cacccucuuucccaugggccaag

SEQ ID NO: 922925 - RNA, 21 nt, Human
cacccucuuucccaugggccu

SEQ ID NO: 922926 - RNA, 21 nt, Human
cagaggcagcuuggcaggagg

SEQ ID NO: 922927 - RNA, 19 nt, Human
cagcagcaggagagaggcc

SEQ ID NO: 922928 - RNA, 21 nt, Human
cagggagggggaaagaaucuu

SEQ ID NO: 922929 - RNA, 25 nt, Human
caugggccucuucauuaauagccac

SEQ ID NO: 922930 - RNA, 22 nt, Human
ccaccuaucugacccucaucuc

SEQ ID NO: 922931 - RNA, 23 nt, Human
ccacuaccugggaaaaucaaaaa

SEQ ID NO: 922932 - RNA, 21 nt, Human
ccaguuggaaaagaaggaaag

SEQ ID NO: 922933 - RNA, 21 nt, Human
cccacagcuggaagagggaac

SEQ ID NO: 922934 - RNA, 18 nt, Human
ccccaaaagugaaggaau

SEQ ID NO: 922935 - RNA, 21 nt, Human
cccgcgcugcggcgggaggga

SEQ ID NO: 922936 - RNA, 26 nt, Human
cccggccccagcccggcgcgcucggc

SEQ ID NO: 922937 - RNA, 20 nt, Human
cccuccuuuccucucuccca

SEQ ID NO: 922938 - RNA, 23 nt, Human
cccuggaaguuaguccucccacc

SEQ ID NO: 922939 - RNA, 18 nt, Human
ccgcuccgcuccggcccc

SEQ ID NO: 922940 - RNA, 20 nt, Human
ccggccccagcccggcgcgc

SEQ ID NO: 922941 - RNA, 22 nt, Human
ccggccccggccccagcccggc

SEQ ID NO: 922942 - RNA, 23 nt, Human
cgcuccggccccggccccagccc

SEQ ID NO: 922943 - RNA, 18 nt, Human
cgggcgcgcucccucucc

SEQ ID NO: 922944 - RNA, 21 nt, Human
cguuccucaauaagaaaagag

SEQ ID NO: 922945 - RNA, 23 nt, Human
cucaggcucugcucuugccucug

SEQ ID NO: 922946 - RNA, 19 nt, Human
cucccaccuaucugacccu

SEQ ID NO: 922947 - RNA, 19 nt, Human
cucccagcucgcggcuccg

SEQ ID NO: 922948 - RNA, 23 nt, Human
cucccucauauauauauauauau

SEQ ID NO: 922949 - RNA, 24 nt, Human
cucccucauauauauauauauaua

SEQ ID NO: 922950 - RNA, 25 nt, Human
cuccgcuccggccccggccccagcc

SEQ ID NO: 922951 - RNA, 21 nt, Human
cucggcucccggcucccggcc

SEQ ID NO: 922952 - RNA, 23 nt, Human
cucucccacuaccugggaaaauc

SEQ ID NO: 922953 - RNA, 24 nt, Human
cucuccgcuccgcuccggccccgg

SEQ ID NO: 922954 - RNA, 20 nt, Human
cugcggcgggagggaaggcg

SEQ ID NO: 922955 - RNA, 22 nt, Human
cuggggcgggcgcgcucccucu

SEQ ID NO: 922956 - RNA, 23 nt, Human
cuuuccagcaugauaaaaucugg

SEQ ID NO: 922957 - RNA, 21 nt, Human
gacccucaucucucuucccac

SEQ ID NO: 922958 - RNA, 21 nt, Human
gagggugggggcuacagagag

SEQ ID NO: 922959 - RNA, 19 nt, Human
gcagcaggagagaggccug

SEQ ID NO: 922960 - RNA, 18 nt, Human
gcucccggcacagcgcuc

SEQ ID NO: 922961 - RNA, 19 nt, Human
gcuggggcgggcgcgcucc

SEQ ID NO: 922962 - RNA, 18 nt, Human
ggacucggggcuggggcg

SEQ ID NO: 922963 - RNA, 19 nt, Human
ggacucggggcuggggcgg

SEQ ID NO: 922964 - RNA, 23 nt, Human
ggcaagaaggcagggagaaagga

SEQ ID NO: 922965 - RNA, 24 nt, Human
ggcccaggaggaggccccgagggc

SEQ ID NO: 922966 - RNA, 20 nt, Human
ggccggugggcccgcgcugc

SEQ ID NO: 922967 - RNA, 20 nt, Human
ggccggugggcccgcgcugc

SEQ ID NO: 922968 - RNA, 23 nt, Human
ggcgcgcucggcucccggcuccc

SEQ ID NO: 922969 - RNA, 23 nt, Human
gggaacacauccugaagcuuggg

SEQ ID NO: 922970 - RNA, 21 nt, Human
gggaaggcggcgggacucggg

SEQ ID NO: 922971 - RNA, 18 nt, Human
gggacagcggucccacag

SEQ ID NO: 922972 - RNA, 23 nt, Human
gggacucggggcuggggcgggcg

SEQ ID NO: 922973 - RNA, 21 nt, Human
gggcucauaguagcugcaugg

SEQ ID NO: 922974 - RNA, 19 nt, Human
gggcuggggcgggcgcgcu

SEQ ID NO: 922975 - RNA, 21 nt, Human
uacagagagggcagggcaaga

SEQ ID NO: 922976 - RNA, 23 nt, Human
uaccugggaaaaucaaaaacagc

SEQ ID NO: 922977 - RNA, 21 nt, Human
uaggacaagggaacccuucca

SEQ ID NO: 922978 - RNA, 22 nt, Human
uccagcugcagggcaggccugu

SEQ ID NO: 922979 - RNA, 19 nt, Human
uccauuguugcuaacgggu

SEQ ID NO: 922980 - RNA, 19 nt, Human
ucccaagauaccuccuccu

SEQ ID NO: 922981 - RNA, 19 nt, Human
ucccaccuaucugacccuc

SEQ ID NO: 922982 - RNA, 18 nt, Human
ucccagaggcagcuuggc

SEQ ID NO: 922983 - RNA, 18 nt, Human
ucccaugggccaagugcc

SEQ ID NO: 922984 - RNA, 19 nt, Human
ucccaugggccaagugcca

SEQ ID NO: 922985 - RNA, 22 nt, Human
uccccaaaagugaaggaauaag

SEQ ID NO: 922986 - RNA, 23 nt, Human
ucuaggacaagggaacccuucca

SEQ ID NO: 922987 - RNA, 25 nt, Human
ucuguaccacaugcuucagcaggga

SEQ ID NO: 922988 - RNA, 19 nt, Human
ugaaggaauaagaaacaaa

SEQ ID NO: 922989 - RNA, 19 nt, Human
ugagacaguuucuucucuu

SEQ ID NO: 922990 - RNA, 21 nt, Human
ugaggcccaggaggaggcccc

SEQ ID NO: 922991 - RNA, 21 nt, Human
ugcauucccaaacugcagucu

SEQ ID NO: 922992 - RNA, 21 nt, Human
ugccaaggaccuaacaccaaa

SEQ ID NO: 922993 - RNA, 24 nt, Human
ugccuucccuccuuuccucucucc

SEQ ID NO: 922994 - RNA, 24 nt, Human
ugcggcgggagggaaggcggcggg

SEQ ID NO: 922995 - RNA, 19 nt, Human
uggaaaagaaggaaagugc

SEQ ID NO: 922996 - RNA, 18 nt, Human
uggcaggagggugggggc

SEQ ID NO: 922997 - RNA, 24 nt, Human
uggcaggagggugggggcuacaga

SEQ ID NO: 922998 - RNA, 20 nt, Human
uggccgugagaucugagaca

SEQ ID NO: 922999 - RNA, 19 nt, Human
ugggggcuacagagagggc

SEQ ID NO: 923000 - RNA, 21 nt, Human
uuaauagccacuguguucucu

SEQ ID NO: 923001 - RNA, 22 nt, Human
uuccuucuuggcacccuggaag

SEQ ID NO: 923002 - RNA, 19 nt, Human
uucuuccuucuuggcaccc

SEQ ID NO: 923003 - RNA, 18 nt, Human
uuggcaggaggguggggg

SEQ ID NO: 923004 - RNA, 23 nt, Human
uuucuuccuucccagaggcagcu

SEQ ID NO: 923005 - RNA, 21 nt, Human
uuucuuccuucuuggcacccu

SEQ ID NO: 923006 - RNA, 20 nt, Human
uuuuuuguguguucacuggg

SEQ ID NO: 923007 - RNA, 18 nt, Human
uuuuuuuuuuuguguguu

SEQ ID NO: 923008 - RNA, 20 nt, Human
uuuuuuuuuuuuuuugugug

SEQ ID NO: 923009 - RNA, 26 nt, Human
aaaacgcaacaaagaggucucugcca

SEQ ID NO: 923010 - RNA, 24 nt, Human
aaaacgccuuaguccuggacccug

SEQ ID NO: 923011 - RNA, 22 nt, Human
aaacaagcaaacacagaccagc

SEQ ID NO: 923012 - RNA, 23 nt, Human
aaagcacaaaacgcaacaaagag

SEQ ID NO: 923013 - RNA, 18 nt, Human
aagcacaaaacgcaacaa

SEQ ID NO: 923014 - RNA, 20 nt, Human
aaggggcagagcagcugggg

SEQ ID NO: 923015 - RNA, 22 nt, Human
acgcaacaaagaggucucugcc

SEQ ID NO: 923016 - RNA, 20 nt, Human
acgggagggguucaggccug

SEQ ID NO: 923017 - RNA, 18 nt, Human
agagcagcugggggacaa

SEQ ID NO: 923018 - RNA, 23 nt, Human
agcugggggacaaggaaaaccug

SEQ ID NO: 923019 - RNA, 22 nt, Human
aggaaaguggguagaaaagggg

SEQ ID NO: 923020 - RNA, 21 nt, Human
caaacaagcaaacacagacca

SEQ ID NO: 923021 - RNA, 20 nt, Human
caaagcacaaaacgcaacaa

SEQ ID NO: 923022 - RNA, 19 nt, Human
cacaaaacgcaacaaagag

SEQ ID NO: 923023 - RNA, 19 nt, Human
caccucccucccucagccu

SEQ ID NO: 923024 - RNA, 21 nt, Human
cagccaaaggugggcaaacaa

SEQ ID NO: 923025 - RNA, 21 nt, Human
caguccaucuuccaggcaccc

SEQ ID NO: 923026 - RNA, 21 nt, Human
caucaaagcacaaaacgcaac

SEQ ID NO: 923027 - RNA, 22 nt, Human
caucaaagcacaaaacgcaaca

SEQ ID NO: 923028 - RNA, 24 nt, Human
ccaggcacccaggaggagcaaggg

SEQ ID NO: 923029 - RNA, 23 nt, Human
ccccagaucuuaggguccugccc

SEQ ID NO: 923030 - RNA, 19 nt, Human
ccccaggcucucgggacuc

SEQ ID NO: 923031 - RNA, 21 nt, Human
ccccaggcucucgggacucgg

SEQ ID NO: 923032 - RNA, 19 nt, Human
cccgggcugggcgcgcccc

SEQ ID NO: 923033 - RNA, 19 nt, Human
cccguccuucuccaccucc

SEQ ID NO: 923034 - RNA, 20 nt, Human
cccguccuucuccaccuccc

SEQ ID NO: 923035 - RNA, 23 nt, Human
cccguccuucuccaccucccucc

SEQ ID NO: 923036 - RNA, 20 nt, Human
ccgccgaggggagggcgcgg

SEQ ID NO: 923037 - RNA, 21 nt, Human
ccgccgaggggagggcgcggg

SEQ ID NO: 923038 - RNA, 20 nt, Human
ccuccacuuccuccugggag

SEQ ID NO: 923039 - RNA, 20 nt, Human
ccucccucagccucuccucc

SEQ ID NO: 923040 - RNA, 21 nt, Human
ccucgcucccucgcgcucccc

SEQ ID NO: 923041 - RNA, 19 nt, Human
ccucucccguccuucucca

SEQ ID NO: 923042 - RNA, 19 nt, Human
ccucuccgcgugugucucu

SEQ ID NO: 923043 - RNA, 18 nt, Human
ccucucucugccucuccc

SEQ ID NO: 923044 - RNA, 21 nt, Human
ccucugccgggcucacccucc

SEQ ID NO: 923045 - RNA, 21 nt, Human
ccugcccugugggucuccugu

SEQ ID NO: 923046 - RNA, 24 nt, Human
ccuguucccgguuuucuggauuuu

SEQ ID NO: 923047 - RNA, 22 nt, Human
cgacucggggucccggcggcgg

SEQ ID NO: 923048 - RNA, 18 nt, Human
cgaggggagggcgcggga

SEQ ID NO: 923049 - RNA, 22 nt, Human
cgcccccaggcucucgggacuc

SEQ ID NO: 923050 - RNA, 19 nt, Human
cgcccgggcugggcgcgcc

SEQ ID NO: 923051 - RNA, 24 nt, Human
cggggugggcgguggggcuggggu

SEQ ID NO: 923052 - RNA, 26 nt, Human
cguccuucuccaccucccucccucaa

SEQ ID NO: 923053 - RNA, 22 nt, Human
cucaggaccuccuuuccccaga

SEQ ID NO: 923054 - RNA, 25 nt, Human
cucaggaccuccuuuccccagaucu

SEQ ID NO: 923055 - RNA, 20 nt, Human
cucccucgcgcuccccggcc

SEQ ID NO: 923056 - RNA, 20 nt, Human
cuccgcgugugucucugccu

SEQ ID NO: 923057 - RNA, 23 nt, Human
cugcccugugggucuccuguguc

SEQ ID NO: 923058 - RNA, 21 nt, Human
cugccgggcucacccuccggu

SEQ ID NO: 923059 - RNA, 30 nt, Human
cuggagucagggaagaaggggaaaggggcc

SEQ ID NO: 923060 - RNA, 20 nt, Human
cuggcaggggugggcaucag

SEQ ID NO: 923061 - RNA, 22 nt, Human
cuggcgccccccgcugugugcc

SEQ ID NO: 923062 - RNA, 23 nt, Human
cugucucacaucccaccucccgc

SEQ ID NO: 923063 - RNA, 23 nt, Human
cugugccucgcucccucgcgcuc

SEQ ID NO: 923064 - RNA, 22 nt, Human
gcaucaaagcacaaaacgcaac

SEQ ID NO: 923065 - RNA, 18 nt, Human
gcauuccuggcaucaaag

SEQ ID NO: 923066 - RNA, 18 nt, Human
gcccgggcugggcgcgcc

SEQ ID NO: 923067 - RNA, 21 nt, Human
gcggcgagaggaggaggaggg

SEQ ID NO: 923068 - RNA, 24 nt, Human
ggaagaaggggaaaggggcagagc

SEQ ID NO: 923069 - RNA, 19 nt, Human
ggcgguggggcuggggugc

SEQ ID NO: 923070 - RNA, 18 nt, Human
ggcuggggugcgcgacuc

SEQ ID NO: 923071 - RNA, 20 nt, Human
gggcgcgggagcgggaggag

SEQ ID NO: 923072 - RNA, 22 nt, Human
gggcgcgggagcgggaggaggg

SEQ ID NO: 923073 - RNA, 21 nt, Human
gggcugugcggcgagaggagg

SEQ ID NO: 923074 - RNA, 21 nt, Human
ggggaguagaauugugaaggg

SEQ ID NO: 923075 - RNA, 21 nt, Human
ggggugggcgguggggcuggg

SEQ ID NO: 923076 - RNA, 23 nt, Human
gggugggcgguggggcuggggug

SEQ ID NO: 923077 - RNA, 20 nt, Human
ggugauuaagggaagauucc

SEQ ID NO: 923078 - RNA, 22 nt, Human
ggugggcgguggggcuggggug

SEQ ID NO: 923079 - RNA, 18 nt, Human
gucagggaagaaggggaa

SEQ ID NO: 923080 - RNA, 22 nt, Human
guccuucuccaccucccucccu

SEQ ID NO: 923081 - RNA, 18 nt, Human
gucugugcugggcucccc

SEQ ID NO: 923082 - RNA, 23 nt, Human
gugcggcgagaggaggaggaggg

SEQ ID NO: 923083 - RNA, 23 nt, Human
gugcugggcucccccgcgcaggc

SEQ ID NO: 923084 - RNA, 20 nt, Human
uagcaggcgaggggaagagc

SEQ ID NO: 923085 - RNA, 22 nt, Human
uccaggggagaggaucugggga

SEQ ID NO: 923086 - RNA, 23 nt, Human
uccaucuuccaggcacccaggag

SEQ ID NO: 923087 - RNA, 18 nt, Human
ucccucagccucuccucc

SEQ ID NO: 923088 - RNA, 19 nt, Human
uccugagugucucugcgug

SEQ ID NO: 923089 - RNA, 19 nt, Human
ucgcugagccaggucugug

SEQ ID NO: 923090 - RNA, 19 nt, Human
ucucggugucucuccccuc

SEQ ID NO: 923091 - RNA, 19 nt, Human
ucucggugucucuccccuc

SEQ ID NO: 923092 - RNA, 20 nt, Human
ucucucugccucucccgucc

SEQ ID NO: 923093 - RNA, 20 nt, Human
ucucucugccucucccgucc

SEQ ID NO: 923094 - RNA, 18 nt, Human
ugacuggcaggggugggc

SEQ ID NO: 923095 - RNA, 21 nt, Human
ugacuggcaggggugggcauc

SEQ ID NO: 923096 - RNA, 22 nt, Human
ugccaguccaucuuccaggcac

SEQ ID NO: 923097 - RNA, 20 nt, Human
ugcccugugggucuccugug

SEQ ID NO: 923098 - RNA, 21 nt, Human
ugccgggcucacccuccgguc

SEQ ID NO: 923099 - RNA, 19 nt, Human
uggcaggggugggcaucag

SEQ ID NO: 923100 - RNA, 22 nt, Human
uggcaucaaagcacaaaacgca

SEQ ID NO: 923101 - RNA, 18 nt, Human
ugggcgguggggcugggg

SEQ ID NO: 923102 - RNA, 21 nt, Human
ugucucacaucccaccucccg

SEQ ID NO: 923103 - RNA, 18 nt, Human
ugucucugccucugccgg

SEQ ID NO: 923104 - RNA, 24 nt, Human
uguguccaggggagaggaucuggg

SEQ ID NO: 923105 - RNA, 19 nt, Human
ugugugccccaccggggac

SEQ ID NO: 923106 - RNA, 23 nt, Human
uucucaggaccuccuuuccccag

SEQ ID NO: 923107 - RNA, 21 nt, Human
aaaaaaccaacuuccuacaag

SEQ ID NO: 923108 - RNA, 21 nt, Human
aaaaccaaaacaaaacaacaa

SEQ ID NO: 923109 - RNA, 24 nt, Human
aaacaaaacaacaacaaaaacaaa

SEQ ID NO: 923110 - RNA, 20 nt, Human
aaacaaaaccaaaacaaaac

SEQ ID NO: 923111 - RNA, 23 nt, Human
aaacaacaacaaaaacaaccuaa

SEQ ID NO: 923112 - RNA, 25 nt, Human
aaacaaccuaacccaaccacaaaac

SEQ ID NO: 923113 - RNA, 24 nt, Human
aaacagaaaauaaaagaggggacc

SEQ ID NO: 923114 - RNA, 21 nt, Human
aaaccaaaacaaaacaacaac

SEQ ID NO: 923115 - RNA, 24 nt, Human
aaaccaaaacaaaacaacaacaaa

SEQ ID NO: 923116 - RNA, 25 nt, Human
aaaccaaaacaaaacaacaacaaaa

SEQ ID NO: 923117 - RNA, 25 nt, Human
aaagucauugagcuuucgggggaaa

SEQ ID NO: 923118 - RNA, 23 nt, Human
aaagugcagggauuacaggcaua

SEQ ID NO: 923119 - RNA, 19 nt, Human
aaagugcugggauuacagg

SEQ ID NO: 923120 - RNA, 23 nt, Human
aaagugcugggauuacaggcaua

SEQ ID NO: 923121 - RNA, 25 nt, Human
aacaaaaacaaccuaacccaaccac

SEQ ID NO: 923122 - RNA, 18 nt, Human
aacaccccuaaguaaaca

SEQ ID NO: 923123 - RNA, 23 nt, Human
aaccacaaaacucuaggagccaa

SEQ ID NO: 923124 - RNA, 20 nt, Human
aacuccaaaaacaaacaaaa

SEQ ID NO: 923125 - RNA, 26 nt, Human
aagaaagaagugaagaggagggaccc

SEQ ID NO: 923126 - RNA, 18 nt, Human
aagacucuuagcuugaaa

SEQ ID NO: 923127 - RNA, 21 nt, Human
aagccaccacacucggcccca

SEQ ID NO: 923128 - RNA, 19 nt, Human
aaguagcugggacuacagg

SEQ ID NO: 923129 - RNA, 20 nt, Human
aaguagcugggacuacaggc

SEQ ID NO: 923130 - RNA, 25 nt, Human
aaguagcugggacuacaggcgcccg

SEQ ID NO: 923131 - RNA, 19 nt, Human
aagugcugggauuacaggc

SEQ ID NO: 923132 - RNA, 21 nt, Human
aagugcugggauuacaggcau

SEQ ID NO: 923133 - RNA, 26 nt, Human
aagugcugggauuacaggcauaagcc

SEQ ID NO: 923134 - RNA, 21 nt, Human
aaucccauuucucuucugcca

SEQ ID NO: 923135 - RNA, 23 nt, Human
aaucuggaaaauccaagcacaag

SEQ ID NO: 923136 - RNA, 24 nt, Human
aaugacagugcacucugugccucu

SEQ ID NO: 923137 - RNA, 24 nt, Human
aaugcagugacgugaucucggcuc

SEQ ID NO: 923138 - RNA, 20 nt, Human
aaugcaguggugugaucucg

SEQ ID NO: 923139 - RNA, 24 nt, Human
aaugcaguggugugaucucgguuc

SEQ ID NO: 923140 - RNA, 18 nt, Human
acaacaacaaaaacaacc

SEQ ID NO: 923141 - RNA, 26 nt, Human
acaacaacaaaaacaaccuaacccaa

SEQ ID NO: 923142 - RNA, 20 nt, Human
acagcagagauacacgugga

SEQ ID NO: 923143 - RNA, 19 nt, Human
acaggcgcccgccaccacg

SEQ ID NO: 923144 - RNA, 18 nt, Human
acaggguuucaccguguu

SEQ ID NO: 923145 - RNA, 19 nt, Human
acaggguuucaccguguua

SEQ ID NO: 923146 - RNA, 20 nt, Human
acaggguuucaccguguuag

SEQ ID NO: 923147 - RNA, 24 nt, Human
acaggguuucaccguguuagccag

SEQ ID NO: 923148 - RNA, 19 nt, Human
accaaaacaaaacaacaac

SEQ ID NO: 923149 - RNA, 22 nt, Human
accaaacuccaaaaacaaacaa

SEQ ID NO: 923150 - RNA, 22 nt, Human
accauguuggccaggcuggucu

SEQ ID NO: 923151 - RNA, 28 nt, Human
acccaaccacaaaacucuaggagccaaa

SEQ ID NO: 923152 - RNA, 23 nt, Human
accccuaaguaaacaccaaucuu

SEQ ID NO: 923153 - RNA, 18 nt, Human
acgagguuucaccauguu

SEQ ID NO: 923154 - RNA, 20 nt, Human
acgagguuucaccauguugg

SEQ ID NO: 923155 - RNA, 24 nt, Human
acgagguuucaccauguuggccag

SEQ ID NO: 923156 - RNA, 20 nt, Human
acuccaaaaacaaacaaaaa

SEQ ID NO: 923157 - RNA, 24 nt, Human
acuccaaaaacaaacaaaaauaga

SEQ ID NO: 923158 - RNA, 24 nt, Human
acucugucgcucaggcugaaaugc

SEQ ID NO: 923159 - RNA, 21 nt, Human
acugugcuuccacuccucuuc

SEQ ID NO: 923160 - RNA, 21 nt, Human
agaaaacaagagccaauccca

SEQ ID NO: 923161 - RNA, 18 nt, Human
agaaagcucccccuagaa

SEQ ID NO: 923162 - RNA, 18 nt, Human
agacaggguuucaccgug

SEQ ID NO: 923163 - RNA, 18 nt, Human
agagcacccaaagaugaa

SEQ ID NO: 923164 - RNA, 18 nt, Human
agccaccacacucggccc

SEQ ID NO: 923165 - RNA, 22 nt, Human
agccaccacacucggccccaga

SEQ ID NO: 923166 - RNA, 25 nt, Human
aggcgggaaugcaguggugugaucu

SEQ ID NO: 923167 - RNA, 24 nt, Human
aggcugaaaugcagugacgugauc

SEQ ID NO: 923168 - RNA, 22 nt, Human
agggauuacaggcauaagccac

SEQ ID NO: 923169 - RNA, 24 nt, Human
agggauuacaggcauaagccacca

SEQ ID NO: 923170 - RNA, 24 nt, Human
aggugagcugcccgccuuggcuuc

SEQ ID NO: 923171 - RNA, 22 nt, Human
agguucccgccauucuccugcc

SEQ ID NO: 923172 - RNA, 22 nt, Human
agguuucaccauguuggccagg

SEQ ID NO: 923173 - RNA, 20 nt, Human
aguagagacaggguuucacc

SEQ ID NO: 923174 - RNA, 18 nt, Human
agucauugagcuuucggg

SEQ ID NO: 923175 - RNA, 18 nt, Human
agugcugggauuacaggc

SEQ ID NO: 923176 - RNA, 19 nt, Human
auaaaacgugguucugccc

SEQ ID NO: 923177 - RNA, 21 nt, Human
auagccuuaagagcauuuaaa

SEQ ID NO: 923178 - RNA, 19 nt, Human
aucccauuucucuucugca

SEQ ID NO: 923179 - RNA, 22 nt, Human
augaaucucugaaauuucagag

SEQ ID NO: 923180 - RNA, 21 nt, Human
auucuccugccucagccuccc

SEQ ID NO: 923181 - RNA, 22 nt, Human
auuuuguauuuuuaguacagac

SEQ ID NO: 923182 - RNA, 25 nt, Human
caaaaauagaaaauaaaaaaccaac

SEQ ID NO: 923183 - RNA, 22 nt, Human
caaaacaaaacaacaacaaaaa

SEQ ID NO: 923184 - RNA, 23 nt, Human
caaaacaaaacaacaacaaaaac

SEQ ID NO: 923185 - RNA, 22 nt, Human
caaaaccaaaacaaaacaacaa

SEQ ID NO: 923186 - RNA, 19 nt, Human
caaaaguagaagcugaaag

SEQ ID NO: 923187 - RNA, 24 nt, Human
caaagugcagggauuacaggcaua

SEQ ID NO: 923188 - RNA, 24 nt, Human
caaagugcugggauuacaggcaua

SEQ ID NO: 923189 - RNA, 20 nt, Human
caacaaaaacaaccuaaccc

SEQ ID NO: 923190 - RNA, 25 nt, Human
caacaaaaacaaccuaacccaacca

SEQ ID NO: 923191 - RNA, 25 nt, Human
caacaacaaaaacaaccuaacccaa

SEQ ID NO: 923192 - RNA, 22 nt, Human
caaccacaaaacucuaggagcc

SEQ ID NO: 923193 - RNA, 23 nt, Human
caaccuccaccuccuggguucaa

SEQ ID NO: 923194 - RNA, 22 nt, Human
caagugauucuccugccucagc

SEQ ID NO: 923195 - RNA, 21 nt, Human
caccauguuggccaggcuggu

SEQ ID NO: 923196 - RNA, 22 nt, Human
caccauguuggccaggcugguc

SEQ ID NO: 923197 - RNA, 24 nt, Human
caccauguuggccaggcuggucuu

SEQ ID NO: 923198 - RNA, 22 nt, Human
caccccuaaguaaacaccaauc

SEQ ID NO: 923199 - RNA, 21 nt, Human
caccgcgcccggccccaaaau

SEQ ID NO: 923200 - RNA, 18 nt, Human
caccguguuagccaggau

SEQ ID NO: 923201 - RNA, 24 nt, Human
caccguguuagccaggauggucuc

SEQ ID NO: 923202 - RNA, 23 nt, Human
caccugccucggccucccaaagu

SEQ ID NO: 923203 - RNA, 23 nt, Human
caccugggagagguacaaaaaac

SEQ ID NO: 923204 - RNA, 19 nt, Human
cacucugucgcucaggcug

SEQ ID NO: 923205 - RNA, 21 nt, Human
cacugcaaccuccaccuccug

SEQ ID NO: 923206 - RNA, 23 nt, Human
cacugcaaccuccaccuccuggg

SEQ ID NO: 923207 - RNA, 20 nt, Human
cacugcacagugagcagagc

SEQ ID NO: 923208 - RNA, 22 nt, Human
cagaacccugcaaucugugaca

SEQ ID NO: 923209 - RNA, 24 nt, Human
cagagagcacccaaagaugaacac

SEQ ID NO: 923210 - RNA, 20 nt, Human
cagcagcuugcaggaaaggg

SEQ ID NO: 923211 - RNA, 21 nt, Human
caggcgcccgccaccacgccu

SEQ ID NO: 923212 - RNA, 20 nt, Human
cagggccugggcuggguucc

SEQ ID NO: 923213 - RNA, 24 nt, Human
caggguuucaccguguuagccagg

SEQ ID NO: 923214 - RNA, 18 nt, Human
caugaaaucaguuuugcu

SEQ ID NO: 923215 - RNA, 24 nt, Human
cauguuggccaggcuggucuugaa

SEQ ID NO: 923216 - RNA, 24 nt, Human
ccaaagugcagggauuacaggcau

SEQ ID NO: 923217 - RNA, 23 nt, Human
ccaaagugcugggauuacaggca

SEQ ID NO: 923218 - RNA, 24 nt, Human
ccaaagugcugggauuacaggcau

SEQ ID NO: 923219 - RNA, 23 nt, Human
ccaaccacaaaacucuaggagcc

SEQ ID NO: 923220 - RNA, 24 nt, Human
ccaccuccuggguucaagugauuc

SEQ ID NO: 923221 - RNA, 21 nt, Human
ccacgcccugucaccugcagu

SEQ ID NO: 923222 - RNA, 20 nt, Human
ccacguugcuccucccuggc

SEQ ID NO: 923223 - RNA, 22 nt, Human
ccagccaagcacguuaaaguca

SEQ ID NO: 923224 - RNA, 21 nt, Human
ccaguaacagcauaagguaaa

SEQ ID NO: 923225 - RNA, 24 nt, Human
cccaaagugcugggauuacaggca

SEQ ID NO: 923226 - RNA, 23 nt, Human
cccaaguagcugggacuacaggc

SEQ ID NO: 923227 - RNA, 23 nt, Human
cccaaguagcugggacuacaggc

SEQ ID NO: 923228 - RNA, 22 nt, Human
cccgaguagcuggauuacaggc

SEQ ID NO: 923229 - RNA, 23 nt, Human
cccgaguagcuggauuacaggcg

SEQ ID NO: 923230 - RNA, 22 nt, Human
cccgccuuggcuucccaaagug

SEQ ID NO: 923231 - RNA, 26 nt, Human
cccuaaguaaacaccaaucuugccca

SEQ ID NO: 923232 - RNA, 22 nt, Human
ccuccaccuccuggguucaagu

SEQ ID NO: 923233 - RNA, 24 nt, Human
ccucccagguucccgccauucucc

SEQ ID NO: 923234 - RNA, 21 nt, Human
ccuccuggguucaagugauuc

SEQ ID NO: 923235 - RNA, 24 nt, Human
ccuccuggguucaagugauucucc

SEQ ID NO: 923236 - RNA, 18 nt, Human
ccugaccucaggugagcu

SEQ ID NO: 923237 - RNA, 19 nt, Human
ccugaccucgugauccacc

SEQ ID NO: 923238 - RNA, 21 nt, Human
ccugaccucgugauccaccug

SEQ ID NO: 923239 - RNA, 23 nt, Human
ccuggguucaagugauucuccuc

SEQ ID NO: 923240 - RNA, 23 nt, Human
ccuggguucaagugauucuccug

SEQ ID NO: 923241 - RNA, 18 nt, Human
cgcggagaagcccccucc

SEQ ID NO: 923242 - RNA, 21 nt, Human
cgcggagaagcccccucccca

SEQ ID NO: 923243 - RNA, 21 nt, Human
cuaaacacagcagaaaagaug

SEQ ID NO: 923244 - RNA, 24 nt, Human
cucacugcaaccuccaccuccugg

SEQ ID NO: 923245 - RNA, 27 nt, Human
cucacugcaaccuccaccuccuggguu

SEQ ID NO: 923246 - RNA, 24 nt, Human
cucagccucccaaguagcugggac

SEQ ID NO: 923247 - RNA, 24 nt, Human
cuccaaaaacaaacaaaaauagaa

SEQ ID NO: 923248 - RNA, 20 nt, Human
cucccuggccuuccaucucc

SEQ ID NO: 923249 - RNA, 24 nt, Human
cuccugaccucgugauccaccugc

SEQ ID NO: 923250 - RNA, 21 nt, Human
cuccuggguucaagugauucu

SEQ ID NO: 923251 - RNA, 18 nt, Human
cucugucgcucaggcuga

SEQ ID NO: 923252 - RNA, 23 nt, Human
cugcaaccuccaccuccuggguu

SEQ ID NO: 923253 - RNA, 19 nt, Human
cugcacagugagcagagcu

SEQ ID NO: 923254 - RNA, 23 nt, Human
cugccucagccucccaaguagcu

SEQ ID NO: 923255 - RNA, 23 nt, Human
cugccucagccucccgaguagcu

SEQ ID NO: 923256 - RNA, 23 nt, Human
cugccucggccucccaaagugcu

SEQ ID NO: 923257 - RNA, 18 nt, Human
cuggcagagagcacccaa

SEQ ID NO: 923258 - RNA, 19 nt, Human
cuguccugccuugucagaa

SEQ ID NO: 923259 - RNA, 18 nt, Human
cuuagaaagcucccccua

SEQ ID NO: 923260 - RNA, 21 nt, Human
gaaaacaagagccaaucccau

SEQ ID NO: 923261 - RNA, 21 nt, Human
gaaucacagucacgauaaaac

SEQ ID NO: 923262 - RNA, 24 nt, Human
gaccucaggugagcugcccgccuu

SEQ ID NO: 923263 - RNA, 22 nt, Human
gaccucgugauccaccugccuc

SEQ ID NO: 923264 - RNA, 22 nt, Human
gaccucgugauccaccugccuc

SEQ ID NO: 923265 - RNA, 24 nt, Human
gaccucgugauccaccugccucgg

SEQ ID NO: 923266 - RNA, 23 nt, Human
gaggaaaugccugucucaaccac

SEQ ID NO: 923267 - RNA, 23 nt, Human
gagguuucaccauguuggccagg

SEQ ID NO: 923268 - RNA, 28 nt, Human
gauccuuuuauuuucccaaacggggccu

SEQ ID NO: 923269 - RNA, 18 nt, Human
gauuacaggcauaagcca

SEQ ID NO: 923270 - RNA, 18 nt, Human
gauuacaggcauaagcca

SEQ ID NO: 923271 - RNA, 21 nt, Human
gauuacaggcauaagccacca

SEQ ID NO: 923272 - RNA, 22 nt, Human
gauuacaggcauaagccaccgc

SEQ ID NO: 923273 - RNA, 18 nt, Human
gauuacaggcgccugcca

SEQ ID NO: 923274 - RNA, 21 nt, Human
gauucuccugccucagccucc

SEQ ID NO: 923275 - RNA, 22 nt, Human
gcaaccuccaccuccuggguuc

SEQ ID NO: 923276 - RNA, 20 nt, Human
gcaacugugcuuccacuccu

SEQ ID NO: 923277 - RNA, 23 nt, Human
gcagaaaacaagagccaauccca

SEQ ID NO: 923278 - RNA, 19 nt, Human
gccauucuccugccucagc

SEQ ID NO: 923279 - RNA, 20 nt, Human
gccucagccucccaaguagc

SEQ ID NO: 923280 - RNA, 20 nt, Human
gccucagccucccgaguagc

SEQ ID NO: 923281 - RNA, 24 nt, Human
gccuggcuaauuuuuuuguauuuu

SEQ ID NO: 923282 - RNA, 23 nt, Human
gccuuggcuucccaaagugcagg

SEQ ID NO: 923283 - RNA, 19 nt, Human
gcugaaaugcagugacgug

SEQ ID NO: 923284 - RNA, 23 nt, Human
ggaaugcaguggugugaucucgg

SEQ ID NO: 923285 - RNA, 19 nt, Human
ggauuacaggcauaagcca

SEQ ID NO: 923286 - RNA, 22 nt, Human
ggauuacaggcauaagccaccg

SEQ ID NO: 923287 - RNA, 20 nt, Human
ggauuacaggcgccugccac

SEQ ID NO: 923288 - RNA, 22 nt, Human
ggauuacaggcgccugccacca

SEQ ID NO: 923289 - RNA, 19 nt, Human
ggcuggggcugaguggcuu

SEQ ID NO: 923290 - RNA, 24 nt, Human
ggcuggucuugaacgccugaccuc

SEQ ID NO: 923291 - RNA, 26 nt, Human
gggaagcacagcagcuugcaggaaag

SEQ ID NO: 923292 - RNA, 23 nt, Human
gggaaugcaguggugugaucucg

SEQ ID NO: 923293 - RNA, 24 nt, Human
gggaaugcaguggugugaucucgg

SEQ ID NO: 923294 - RNA, 23 nt, Human
gggaggaggaaaugccugucuca

SEQ ID NO: 923295 - RNA, 21 nt, Human
gggaggcagggccugggcugg

SEQ ID NO: 923296 - RNA, 23 nt, Human
gggauuacaggcauaagccacca

SEQ ID NO: 923297 - RNA, 21 nt, Human
ggggaagcacagcagcuugca

SEQ ID NO: 923298 - RNA, 20 nt, Human
gggucaagaagcgggaggag

SEQ ID NO: 923299 - RNA, 20 nt, Human
ggucucgaucuccugaccuc

SEQ ID NO: 923300 - RNA, 18 nt, Human
ggucuugaacgccugacc

SEQ ID NO: 923301 - RNA, 21 nt, Human
ggugacucgggguaaaugugg

SEQ ID NO: 923302 - RNA, 24 nt, Human
gugauccaccugccucggccuccc

SEQ ID NO: 923303 - RNA, 24 nt, Human
gugauucuccugccucagccuccc

SEQ ID NO: 923304 - RNA, 23 nt, Human
guuccacguugcuccucccuggc

SEQ ID NO: 923305 - RNA, 21 nt, Human
uaaaaaaccaacuuccuacaa

SEQ ID NO: 923306 - RNA, 24 nt, Human
uaaauuuuguauuuuuaguacaga

SEQ ID NO: 923307 - RNA, 18 nt, Human
uaacaugucaaugacagu

SEQ ID NO: 923308 - RNA, 19 nt, Human
uaacaugucaaugacagug

SEQ ID NO: 923309 - RNA, 20 nt, Human
uaagaaagaagugaagagga

SEQ ID NO: 923310 - RNA, 23 nt, Human
uaagccaccacacucggccccag

SEQ ID NO: 923311 - RNA, 24 nt, Human
uaaggcaaaguaaaauucaggacc

SEQ ID NO: 923312 - RNA, 21 nt, Human
uaagguaaaaaugugauuucc

SEQ ID NO: 923313 - RNA, 22 nt, Human
uaaguaaacaccaaucuugccc

SEQ ID NO: 923314 - RNA, 23 nt, Human
uaaguaaacaccaaucuugccca

SEQ ID NO: 923315 - RNA, 21 nt, Human
uacaggcauaagccaccacac

SEQ ID NO: 923316 - RNA, 23 nt, Human
uacaggcauaagccaccgcgccc

SEQ ID NO: 923317 - RNA, 22 nt, Human
uacaggcgcccgccaccacgcc

SEQ ID NO: 923318 - RNA, 24 nt, Human
uacaggcgccugccaccacacuca

SEQ ID NO: 923319 - RNA, 20 nt, Human
uagaagcugaaagugucccc

SEQ ID NO: 923320 - RNA, 22 nt, Human
uagagacaggguuucaccgugu

SEQ ID NO: 923321 - RNA, 19 nt, Human
uagcuggauuacaggcgcc

SEQ ID NO: 923322 - RNA, 20 nt, Human
uaggcuugucuguggcagcu

SEQ ID NO: 923323 - RNA, 24 nt, Human
uaguacagacgagguuucaccaug

SEQ ID NO: 923324 - RNA, 21 nt, Human
uaguagagacaggguuucacc

SEQ ID NO: 923325 - RNA, 24 nt, Human
uaguagagacaggguuucaccgug

SEQ ID NO: 923326 - RNA, 26 nt, Human
uaguagagacaggguuucaccguguu

SEQ ID NO: 923327 - RNA, 20 nt, Human
ucaaggcaucuuaaacuuca

SEQ ID NO: 923328 - RNA, 19 nt, Human
ucaagugauucuccugccu

SEQ ID NO: 923329 - RNA, 24 nt, Human
ucaccguguuagccaggauggucu

SEQ ID NO: 923330 - RNA, 22 nt, Human
ucacucugucgcucaggcugaa

SEQ ID NO: 923331 - RNA, 23 nt, Human
ucacugcaaccuccaccuccugg

SEQ ID NO: 923332 - RNA, 24 nt, Human
ucacugcaaccuccaccuccuggg

SEQ ID NO: 923333 - RNA, 25 nt, Human
ucacugcaaccuccaccuccugggu

SEQ ID NO: 923334 - RNA, 27 nt, Human
ucacugcaaccuccaccuccuggguuc

SEQ ID NO: 923335 - RNA, 18 nt, Human
ucacuguaagcuccgccu

SEQ ID NO: 923336 - RNA, 19 nt, Human
ucacuguaagcuccgccuc

SEQ ID NO: 923337 - RNA, 19 nt, Human
ucacuguaagcuccgccuc

SEQ ID NO: 923338 - RNA, 23 nt, Human
ucacuguaagcuccgccucccag

SEQ ID NO: 923339 - RNA, 24 nt, Human
ucacuguaagcuccgccucccagg

SEQ ID NO: 923340 - RNA, 20 nt, Human
ucagccucccaaguagcugg

SEQ ID NO: 923341 - RNA, 21 nt, Human
ucagccucccgaguagcugga

SEQ ID NO: 923342 - RNA, 20 nt, Human
uccaaaaacaaacaaaaaua

SEQ ID NO: 923343 - RNA, 24 nt, Human
uccaagcacaagacucuuagcuug

SEQ ID NO: 923344 - RNA, 24 nt, Human
ucccaaagugcagggauuacaggc

SEQ ID NO: 923345 - RNA, 24 nt, Human
ucccaaagugcugggauuacaggc

SEQ ID NO: 923346 - RNA, 24 nt, Human
ucccaaguagcugggacuacaggc

SEQ ID NO: 923347 - RNA, 21 nt, Human
ucccagguucccgccauucuc

SEQ ID NO: 923348 - RNA, 24 nt, Human
ucccagguucccgccauucuccug

SEQ ID NO: 923349 - RNA, 21 nt, Human
uccccuaucucuuuacauaca

SEQ ID NO: 923350 - RNA, 23 nt, Human
ucccgaguagcuggauuacaggc

SEQ ID NO: 923351 - RNA, 18 nt, Human
ucccggaagucucucuuu

SEQ ID NO: 923352 - RNA, 19 nt, Human
uccgccacgcccugucacc

SEQ ID NO: 923353 - RNA, 24 nt, Human
uccugccuugucagaacccugcaa

SEQ ID NO: 923354 - RNA, 21 nt, Human
uccuggguucaagugauucuc

SEQ ID NO: 923355 - RNA, 24 nt, Human
uccuggguucaagugauucuccug

SEQ ID NO: 923356 - RNA, 18 nt, Human
ucggccucccaaagugcu

SEQ ID NO: 923357 - RNA, 26 nt, Human
ucuccugccucagccucccaaguagc

SEQ ID NO: 923358 - RNA, 24 nt, Human
ucuccugccucagccucccgagua

SEQ ID NO: 923359 - RNA, 20 nt, Human
ucucgcucugcugcccaggc

SEQ ID NO: 923360 - RNA, 22 nt, Human
ucucgcucugcugcccaggcgg

SEQ ID NO: 923361 - RNA, 23 nt, Human
ucucgcucugcugcccaggcggg

SEQ ID NO: 923362 - RNA, 24 nt, Human
ucucgcucugcugcccaggcggga

SEQ ID NO: 923363 - RNA, 23 nt, Human
ucugccuccaaauccaggcaacu

SEQ ID NO: 923364 - RNA, 24 nt, Human
ucugucgcucaggcugaaaugcag

SEQ ID NO: 923365 - RNA, 19 nt, Human
ugaaaagccugacaacucu

SEQ ID NO: 923366 - RNA, 23 nt, Human
ugaaaguguccccacucuugacu

SEQ ID NO: 923367 - RNA, 19 nt, Human
ugaaaugcagugacgugau

SEQ ID NO: 923368 - RNA, 24 nt, Human
ugaaaugcagugacgugaucucgg

SEQ ID NO: 923369 - RNA, 24 nt, Human
ugaccucaggugagcugcccgccu

SEQ ID NO: 923370 - RNA, 19 nt, Human
ugagacaaaccagccaagc

SEQ ID NO: 923371 - RNA, 22 nt, Human
ugagacggagucucgcucugcu

SEQ ID NO: 923372 - RNA, 18 nt, Human
ugagcugcccgccuuggc

SEQ ID NO: 923373 - RNA, 20 nt, Human
ugauucuccugccucagccu

SEQ ID NO: 923374 - RNA, 19 nt, Human
ugcaaucugugacaccgca

SEQ ID NO: 923375 - RNA, 18 nt, Human
ugcagugacgugaucucg

SEQ ID NO: 923376 - RNA, 22 nt, Human
ugcagugacgugaucucggcuc

SEQ ID NO: 923377 - RNA, 18 nt, Human
ugcccaagaaaaaucaca

SEQ ID NO: 923378 - RNA, 22 nt, Human
ugcccaggcgggaaugcagugg

SEQ ID NO: 923379 - RNA, 24 nt, Human
ugccucagccucccaaguagcugg

SEQ ID NO: 923380 - RNA, 24 nt, Human
ugccucagccucccgaguagcugg

SEQ ID NO: 923381 - RNA, 21 nt, Human
ugccucggccucccaaagugc

SEQ ID NO: 923382 - RNA, 24 nt, Human
ugccucggccucccaaagugcugg

SEQ ID NO: 923383 - RNA, 24 nt, Human
ugcugggauuacaggcauaagcca

SEQ ID NO: 923384 - RNA, 23 nt, Human
uggauaugcaaaucaaauguccu

SEQ ID NO: 923385 - RNA, 19 nt, Human
uggauuacaggcgccugcc

SEQ ID NO: 923386 - RNA, 23 nt, Human
uggauuacaggcgccugccacca

SEQ ID NO: 923387 - RNA, 24 nt, Human
uggccaggcuggucuugaacgccu

SEQ ID NO: 923388 - RNA, 19 nt, Human
uggcuggggcugaguggcu

SEQ ID NO: 923389 - RNA, 21 nt, Human
ugggacuacaggcgcccgcca

SEQ ID NO: 923390 - RNA, 22 nt, Human
ugggacuacaggcgcccgccac

SEQ ID NO: 923391 - RNA, 24 nt, Human
ugggacuacaggcgcccgccacca

SEQ ID NO: 923392 - RNA, 18 nt, Human
ugggauuacaggcauaag

SEQ ID NO: 923393 - RNA, 21 nt, Human
ugggauuacaggcauaagcca

SEQ ID NO: 923394 - RNA, 22 nt, Human
ugggauuacaggcauaagccac

SEQ ID NO: 923395 - RNA, 23 nt, Human
ugggauuacaggcauaagccacc

SEQ ID NO: 923396 - RNA, 24 nt, Human
ugggauuacaggcauaagccaccg

SEQ ID NO: 923397 - RNA, 24 nt, Human
ugggauuacaggcauaagccaccg

SEQ ID NO: 923398 - RNA, 19 nt, Human
ugggcuggguucccggaga

SEQ ID NO: 923399 - RNA, 23 nt, Human
uggguucaagugauucuccugcc

SEQ ID NO: 923400 - RNA, 24 nt, Human
uggguucaagugauucuccugccu

SEQ ID NO: 923401 - RNA, 24 nt, Human
uggugugaucucgguucacuguaa

SEQ ID NO: 923402 - RNA, 19 nt, Human
ugucacagcagagauacac

SEQ ID NO: 923403 - RNA, 19 nt, Human
uguccuaaacacagcagaa

SEQ ID NO: 923404 - RNA, 22 nt, Human
uguccugccuugucagaacccu

SEQ ID NO: 923405 - RNA, 24 nt, Human
ugucucaaccacuaacuaauuugc

SEQ ID NO: 923406 - RNA, 22 nt, Human
ugugucacagcagagauacacg

SEQ ID NO: 923407 - RNA, 24 nt, Human
uguuuacauaaaacgugguucugc

SEQ ID NO: 923408 - RNA, 22 nt, Human
uuaaucuggaaaauccaagcac

SEQ ID NO: 923409 - RNA, 23 nt, Human
uuaaucuggaaaauccaagcaca

SEQ ID NO: 923410 - RNA, 24 nt, Human
uuagcuugaaaagccugacaacuc

SEQ ID NO: 923411 - RNA, 24 nt, Human
uuaguacagacgagguuucaccau

SEQ ID NO: 923412 - RNA, 22 nt, Human
uuaguagagacaggguuucacc

SEQ ID NO: 923413 - RNA, 24 nt, Human
uuaguagagacaggguuucaccgu

SEQ ID NO: 923414 - RNA, 21 nt, Human
uuauaacaucaugucauccua

SEQ ID NO: 923415 - RNA, 18 nt, Human
uucaaauuaaucuggaaa

SEQ ID NO: 923416 - RNA, 21 nt, Human
uucaagugauucuccugccuc

SEQ ID NO: 923417 - RNA, 23 nt, Human
uucaagugauucuccugccucag

SEQ ID NO: 923418 - RNA, 24 nt, Human
uucaagugauucuccugccucagc

SEQ ID NO: 923419 - RNA, 23 nt, Human
uugagacaguuucacucugucgc

SEQ ID NO: 923420 - RNA, 20 nt, Human
uugcaggaaaggccuggcug

SEQ ID NO: 923421 - RNA, 24 nt, Human
uuucaccauguuggccaggcuggu

SEQ ID NO: 923422 - RNA, 19 nt, Human
uuucaccguguuagccagg

SEQ ID NO: 923423 - RNA, 24 nt, Human
uuucacucugucgcucaggcugaa

SEQ ID NO: 923424 - RNA, 23 nt, Human
uuuccagcacagacgugcacaga

SEQ ID NO: 923425 - RNA, 26 nt, Human
uuuugagacaguuucacucugucgcu

SEQ ID NO: 923426 - RNA, 24 nt, Human
uuuuuaguacagacgagguuucac

SEQ ID NO: 923427 - RNA, 24 nt, Human
uuuuuaguagagacaggguuucac

SEQ ID NO: 923428 - RNA, 21 nt, Human
uuuuuguauuuuuaguagaga

SEQ ID NO: 923429 - RNA, 21 nt, Human
uuuuuuguauuuuuaguagag

SEQ ID NO: 923430 - RNA, 24 nt, Human
uuuuuuguauuuuuaguagagaca

SEQ ID NO: 923431 - RNA, 21 nt, Human
uuuuuuucuguuugagacgga

SEQ ID NO: 923432 - RNA, 23 nt, Human
aacacacccaacacaacacaaga

SEQ ID NO: 923433 - RNA, 22 nt, Human
acaacaccagggugugucaugc

SEQ ID NO: 923434 - RNA, 22 nt, Human
acacaagauguugguaaguuag

SEQ ID NO: 923435 - RNA, 19 nt, Human
acacacccaacacaacaca

SEQ ID NO: 923436 - RNA, 22 nt, Human
acccaacacaacacaagauguu

SEQ ID NO: 923437 - RNA, 21 nt, Human
agagcgcccauguuuccacag

SEQ ID NO: 923438 - RNA, 20 nt, Human
agguaacuacagagcagagc

SEQ ID NO: 923439 - RNA, 19 nt, Human
caaaacacacccaacacaa

SEQ ID NO: 923440 - RNA, 20 nt, Human
caaaacacacccaacacaac

SEQ ID NO: 923441 - RNA, 21 nt, Human
caagugacaaaacacacccaa

SEQ ID NO: 923442 - RNA, 18 nt, Human
cacacccaacacaacaca

SEQ ID NO: 923443 - RNA, 21 nt, Human
cauggcagggcgcucucugcc

SEQ ID NO: 923444 - RNA, 18 nt, Human
cauuggaguagguguugc

SEQ ID NO: 923445 - RNA, 19 nt, Human
cccacacauuggaguaggu

SEQ ID NO: 923446 - RNA, 23 nt, Human
cuagacuguccuccccaucugug

SEQ ID NO: 923447 - RNA, 18 nt, Human
cuguuugauggcuuucuc

SEQ ID NO: 923448 - RNA, 21 nt, Human
gggcaggaagagguggggacu

SEQ ID NO: 923449 - RNA, 22 nt, Human
gggcaggaagagguggggacuu

SEQ ID NO: 923450 - RNA, 22 nt, Human
uaagagugcauucuauugcaga

SEQ ID NO: 923451 - RNA, 20 nt, Human
uagcaagcagaaugacuugc

SEQ ID NO: 923452 - RNA, 21 nt, Human
uauugcagaaaaugcaguuau

SEQ ID NO: 923453 - RNA, 21 nt, Human
ucuagacuguccuccccaucu

SEQ ID NO: 923454 - RNA, 21 nt, Human
ucuccaagugacaaaacacac

SEQ ID NO: 923455 - RNA, 18 nt, Human
ucuuggguggggucacac

SEQ ID NO: 923456 - RNA, 22 nt, Human
ugacaaaacacacccaacacaa

SEQ ID NO: 923457 - RNA, 22 nt, Human
ugacaaaacacacccaacacaa

SEQ ID NO: 923458 - RNA, 21 nt, Human
ugacuugcuugccuuuucccu

SEQ ID NO: 923459 - RNA, 19 nt, Human
ugaugccuagcaagcagaa

SEQ ID NO: 923460 - RNA, 20 nt, Human
ugccauuucaggaucccaca

SEQ ID NO: 923461 - RNA, 24 nt, Human
ugccuuuucccuuaguagguaacu

SEQ ID NO: 923462 - RNA, 23 nt, Human
uggggucacacuaguucuccaag

SEQ ID NO: 923463 - RNA, 19 nt, Human
ugucaugcucuuggguggg

SEQ ID NO: 923464 - RNA, 21 nt, Human
uguccagacugagaauuaaga

SEQ ID NO: 923465 - RNA, 23 nt, Human
uguccagacugagaauuaagagc

SEQ ID NO: 923466 - RNA, 24 nt, Human
uuaguaguuaaaauuaagagugcc

SEQ ID NO: 923467 - RNA, 19 nt, Human
uuggguggggucacacuag

SEQ ID NO: 923468 - RNA, 18 nt, Human
uuuuuuuuuuuuuuuuug

SEQ ID NO: 923469 - RNA, 21 nt, Human
aaagugcccuacccuuaccua

SEQ ID NO: 923470 - RNA, 18 nt, Human
acaauggaaggcauaaaa

SEQ ID NO: 923471 - RNA, 24 nt, Human
acacugucaaacacuggaaagggg

SEQ ID NO: 923472 - RNA, 24 nt, Human
acagagcuuucuccauguagcuau

SEQ ID NO: 923473 - RNA, 19 nt, Human
acccccuuuauaccacugg

SEQ ID NO: 923474 - RNA, 19 nt, Human
agagggcggauggcggcgg

SEQ ID NO: 923475 - RNA, 18 nt, Human
aggaggccagaagaggag

SEQ ID NO: 923476 - RNA, 20 nt, Human
aggcaagauggugcaagaag

SEQ ID NO: 923477 - RNA, 19 nt, Human
aggggcgccacaauggacc

SEQ ID NO: 923478 - RNA, 25 nt, Human
agugcccuacccuuaccuaaauggc

SEQ ID NO: 923479 - RNA, 21 nt, Human
caacauauacccccuuuauac

SEQ ID NO: 923480 - RNA, 19 nt, Human
caagauggugcaagaaguc

SEQ ID NO: 923481 - RNA, 21 nt, Human
caaucuaguccauuaggcaag

SEQ ID NO: 923482 - RNA, 20 nt, Human
caccacagugaugaauccaa

SEQ ID NO: 923483 - RNA, 20 nt, Human
cacuggaaaggggcgccaca

SEQ ID NO: 923484 - RNA, 21 nt, Human
cagugaugaauccacagagcu

SEQ ID NO: 923485 - RNA, 22 nt, Human
ccagaagaggaggaaugcuaca

SEQ ID NO: 923486 - RNA, 20 nt, Human
cccccucaccuggggauggg

SEQ ID NO: 923487 - RNA, 22 nt, Human
cccccuuuauaccacugacccc

SEQ ID NO: 923488 - RNA, 27 nt, Human
cgaauggcacacugucaaacacuggaa

SEQ ID NO: 923489 - RNA, 23 nt, Human
cucggggucuccgcuucccuaag

SEQ ID NO: 923490 - RNA, 18 nt, Human
gagcaguccaggaggcca

SEQ ID NO: 923491 - RNA, 21 nt, Human
ggaggaaugcuacaagccaca

SEQ ID NO: 923492 - RNA, 19 nt, Human
ggaggccagaagaggagga

SEQ ID NO: 923493 - RNA, 22 nt, Human
gggcaaggguaagagaugaagg

SEQ ID NO: 923494 - RNA, 23 nt, Human
ggggauggggggguagagagggc

SEQ ID NO: 923495 - RNA, 22 nt, Human
ggguuccucggggucuccgcuu

SEQ ID NO: 923496 - RNA, 24 nt, Human
uaaaucccauagcaugacugaagg

SEQ ID NO: 923497 - RNA, 20 nt, Human
uaauauaccaccaccaagac

SEQ ID NO: 923498 - RNA, 24 nt, Human
uaauuuaaaaaaagggggaagggg

SEQ ID NO: 923499 - RNA, 23 nt, Human
uaccacugaccccaaacugacuc

SEQ ID NO: 923500 - RNA, 22 nt, Human
uagcagacauggagaacaccac

SEQ ID NO: 923501 - RNA, 18 nt, Human
uauacccccuuuauacca

SEQ ID NO: 923502 - RNA, 22 nt, Human
uccugaacucaccccccucacc

SEQ ID NO: 923503 - RNA, 19 nt, Human
ucgaauggcacacugucaa

SEQ ID NO: 923504 - RNA, 20 nt, Human
ucgaauggcacacugucaaa

SEQ ID NO: 923505 - RNA, 19 nt, Human
ucuccgcuuccugaacuca

SEQ ID NO: 923506 - RNA, 18 nt, Human
ugaaggggagcaguccag

SEQ ID NO: 923507 - RNA, 20 nt, Human
ugcaacauauacccccuuua

SEQ ID NO: 923508 - RNA, 20 nt, Human
uggaaaggggcgccacaaug

SEQ ID NO: 923509 - RNA, 20 nt, Human
uggagaacaccacagugaug

SEQ ID NO: 923510 - RNA, 19 nt, Human
uggcacacugucaaacacu

SEQ ID NO: 923511 - RNA, 18 nt, Human
uggcuagcagacauggag

SEQ ID NO: 923512 - RNA, 23 nt, Human
uggggauggggggguagagaggg

SEQ ID NO: 923513 - RNA, 22 nt, Human
uggguuccucggggucuccgcu

SEQ ID NO: 923514 - RNA, 24 nt, Human
uuaaaagugcccuacccuuaccua

SEQ ID NO: 923515 - RNA, 24 nt, Human
uucacuguguuugacgucaucaca

SEQ ID NO: 923516 - RNA, 26 nt, Human
uuuaauuuaaaaaaagggggaagggg

SEQ ID NO: 923517 - RNA, 24 nt, Human
aagaaagaaacauuuaaaauacac

SEQ ID NO: 923518 - RNA, 21 nt, Human
aauguguauccagaccuauug

SEQ ID NO: 923519 - RNA, 19 nt, Human
acagaggcaacuucaguca

SEQ ID NO: 923520 - RNA, 20 nt, Human
agauggauauuaaguugcuu

SEQ ID NO: 923521 - RNA, 21 nt, Human
agcaggccuucugauaggaag

SEQ ID NO: 923522 - RNA, 20 nt, Human
agcuagucuaauacuccugg

SEQ ID NO: 923523 - RNA, 20 nt, Human
agcuagucuaauacuccugg

SEQ ID NO: 923524 - RNA, 21 nt, Human
agggaaaccauuuauauuuga

SEQ ID NO: 923525 - RNA, 20 nt, Human
aguagcugcugcacaugugu

SEQ ID NO: 923526 - RNA, 23 nt, Human
augaagggaaaccauuuauauuu

SEQ ID NO: 923527 - RNA, 20 nt, Human
caccuguguagagaaccgug

SEQ ID NO: 923528 - RNA, 21 nt, Human
cacuucugaggagaagcuccg

SEQ ID NO: 923529 - RNA, 23 nt, Human
caggauacaguagcugcugcaca

SEQ ID NO: 923530 - RNA, 25 nt, Human
caugaaaauucuccuaaaugacagu

SEQ ID NO: 923531 - RNA, 25 nt, Human
ccaaguaugagucaaauucuauacu

SEQ ID NO: 923532 - RNA, 18 nt, Human
ccagcaaaguuggaaggc

SEQ ID NO: 923533 - RNA, 20 nt, Human
ccagcaaaguuggaaggccc

SEQ ID NO: 923534 - RNA, 20 nt, Human
ccagccaacacagaggcaac

SEQ ID NO: 923535 - RNA, 21 nt, Human
ccagugguuacaauaccugag

SEQ ID NO: 923536 - RNA, 18 nt, Human
ccuccggcggcucagcuc

SEQ ID NO: 923537 - RNA, 19 nt, Human
ccuucugauaggaagugaa

SEQ ID NO: 923538 - RNA, 18 nt, Human
cuaguuaaaaaaaaaauc

SEQ ID NO: 923539 - RNA, 20 nt, Human
cucagcucgcgggcagcgcu

SEQ ID NO: 923540 - RNA, 21 nt, Human
cucucauaaauuuacuaucau

SEQ ID NO: 923541 - RNA, 20 nt, Human
cugcaagugaagguuucuuc

SEQ ID NO: 923542 - RNA, 19 nt, Human
cuuucagaacuaguuaaaa

SEQ ID NO: 923543 - RNA, 22 nt, Human
gagaaguauugugauaacugag

SEQ ID NO: 923544 - RNA, 19 nt, Human
gagccggaggggacucagg

SEQ ID NO: 923545 - RNA, 21 nt, Human
gaggagaagcuccguaagagg

SEQ ID NO: 923546 - RNA, 18 nt, Human
gcuuaaaaacaaaguucc

SEQ ID NO: 923547 - RNA, 20 nt, Human
guagcugcugcacaugugug

SEQ ID NO: 923548 - RNA, 22 nt, Human
gugaaugacagagaaaccucgu

SEQ ID NO: 923549 - RNA, 19 nt, Human
uaaaaaaaaaaucuagggg

SEQ ID NO: 923550 - RNA, 20 nt, Human
uaaaauacacaucuucguuu

SEQ ID NO: 923551 - RNA, 18 nt, Human
uaaagugacuaguaguuu

SEQ ID NO: 923552 - RNA, 22 nt, Human
uaacugaguccuccaaagguuu

SEQ ID NO: 923553 - RNA, 22 nt, Human
uaggcuccauaggagccggagg

SEQ ID NO: 923554 - RNA, 23 nt, Human
uaguaauuguuuucaacaugaag

SEQ ID NO: 923555 - RNA, 22 nt, Human
uagugaauacaucuacaacuac

SEQ ID NO: 923556 - RNA, 24 nt, Human
uauccagaccuauugcuuaaaaac

SEQ ID NO: 923557 - RNA, 19 nt, Human
ucaggauacaguagcugcu

SEQ ID NO: 923558 - RNA, 22 nt, Human
uccaaauauaauggcuuuuccc

SEQ ID NO: 923559 - RNA, 26 nt, Human
uccacagucagggagguuaccagagc

SEQ ID NO: 923560 - RNA, 19 nt, Human
ucccaugaagggaaaccau

SEQ ID NO: 923561 - RNA, 21 nt, Human
ucguugcccgcggcuccuccu

SEQ ID NO: 923562 - RNA, 25 nt, Human
ucuuuuaguucuucaacaguucuaa

SEQ ID NO: 923563 - RNA, 25 nt, Human
ugaauacaucuacaacuacaguaaa

SEQ ID NO: 923564 - RNA, 20 nt, Human
ugacuuuggaaggcgauggu

SEQ ID NO: 923565 - RNA, 18 nt, Human
ugagguggaugaaauauc

SEQ ID NO: 923566 - RNA, 18 nt, Human
ugcccgcggcuccuccuc

SEQ ID NO: 923567 - RNA, 18 nt, Human
ugggacuuggaacuuucu

SEQ ID NO: 923568 - RNA, 21 nt, Human
uggugggacuuggaacuuucu

SEQ ID NO: 923569 - RNA, 28 nt, Human
uguaaagugacuaguaguuuggcaggua

SEQ ID NO: 923570 - RNA, 20 nt, Human
uguagagugcugacuuugga

SEQ ID NO: 923571 - RNA, 23 nt, Human
uuaaaaaaaaaaucuaggggaaa

SEQ ID NO: 923572 - RNA, 29 nt, Human
uuaauaacaauguucagugguuucuuccu

SEQ ID NO: 923573 - RNA, 21 nt, Human
uucaaugaauaaaagauaaaa

SEQ ID NO: 923574 - RNA, 25 nt, Human
uucagaacuaguuaaaaaaaaaauc

SEQ ID NO: 923575 - RNA, 22 nt, Human
uucauuuaagaaguguuuuuuu

SEQ ID NO: 923576 - RNA, 18 nt, Human
uucugcaagugaagguuu

SEQ ID NO: 923577 - RNA, 21 nt, Human
uuggaaggcgaugguaccacu

SEQ ID NO: 923578 - RNA, 21 nt, Human
uuuggauauuaaauacaucau

SEQ ID NO: 923579 - RNA, 23 nt, Human
uuuuucaaguuccagaauuuucu

SEQ ID NO: 923580 - RNA, 23 nt, Human
aaacagcaucagagcagagcuca

SEQ ID NO: 923581 - RNA, 21 nt, Human
aaagaacacuauugcugcugc

SEQ ID NO: 923582 - RNA, 21 nt, Human
aagagcuuccugucaccacac

SEQ ID NO: 923583 - RNA, 22 nt, Human
aagcauacuucuccaggcgagu

SEQ ID NO: 923584 - RNA, 22 nt, Human
acaaaguacagggggaucuccg

SEQ ID NO: 923585 - RNA, 18 nt, Human
acuacaaucuccauuacc

SEQ ID NO: 923586 - RNA, 22 nt, Human
acuacaaucuccauuaccguga

SEQ ID NO: 923587 - RNA, 23 nt, Human
agaaaaugacugaacacauccuc

SEQ ID NO: 923588 - RNA, 18 nt, Human
agagcgggaagagcuggg

SEQ ID NO: 923589 - RNA, 22 nt, Human
aggaguucaccaauaaagaaaa

SEQ ID NO: 923590 - RNA, 24 nt, Human
aggcgagugaguggaggcagguua

SEQ ID NO: 923591 - RNA, 19 nt, Human
agggacuggaaggcagccu

SEQ ID NO: 923592 - RNA, 23 nt, Human
agugaaggggccgagggacugga

SEQ ID NO: 923593 - RNA, 23 nt, Human
aguggccagaugcucagggcgcc

SEQ ID NO: 923594 - RNA, 20 nt, Human
augucagaaagcuuugagca

SEQ ID NO: 923595 - RNA, 20 nt, Human
auuugcagcacaaaccuucc

SEQ ID NO: 923596 - RNA, 23 nt, Human
caaaaccagaguccaaauccugg

SEQ ID NO: 923597 - RNA, 21 nt, Human
caaacagcaucagagcagagc

SEQ ID NO: 923598 - RNA, 22 nt, Human
caacagcaugacaaauaucacc

SEQ ID NO: 923599 - RNA, 26 nt, Human
caacagcaugacaaauaucaccaaaa

SEQ ID NO: 923600 - RNA, 28 nt, Human
cacaaccccaggucugcugcagucgucc

SEQ ID NO: 923601 - RNA, 21 nt, Human
cagcaucagagcagagcucaa

SEQ ID NO: 923602 - RNA, 24 nt, Human
cagcaugacaaauaucaccaaaau

SEQ ID NO: 923603 - RNA, 24 nt, Human
cagccucacucagaagcagcucua

SEQ ID NO: 923604 - RNA, 22 nt, Human
cagcuguugugcacaaccccag

SEQ ID NO: 923605 - RNA, 25 nt, Human
ccagccgacacacagcuuuccacag

SEQ ID NO: 923606 - RNA, 24 nt, Human
ccccaaacagcaucagagcagagc

SEQ ID NO: 923607 - RNA, 22 nt, Human
cccucuggcaauaaucugccgg

SEQ ID NO: 923608 - RNA, 20 nt, Human
ccugaggcccagccucacuc

SEQ ID NO: 923609 - RNA, 22 nt, Human
ccuggccuggaauguccaagaa

SEQ ID NO: 923610 - RNA, 18 nt, Human
cgcugaggucccuuccac

SEQ ID NO: 923611 - RNA, 18 nt, Human
cuccugcaagcuaccaag

SEQ ID NO: 923612 - RNA, 23 nt, Human
cucgcugaaagcauacuucucca

SEQ ID NO: 923613 - RNA, 21 nt, Human
cugcagucguccuccugaggc

SEQ ID NO: 923614 - RNA, 18 nt, Human
cugcugcagucguccucc

SEQ ID NO: 923615 - RNA, 19 nt, Human
gaagauaaaggccagcccu

SEQ ID NO: 923616 - RNA, 19 nt, Human
gaagauaucaagcagcccu

SEQ ID NO: 923617 - RNA, 18 nt, Human
gaguagcaggcguucaac

SEQ ID NO: 923618 - RNA, 20 nt, Human
gcagaacacucuaauucgaa

SEQ ID NO: 923619 - RNA, 19 nt, Human
gcccucuggcaauaaucug

SEQ ID NO: 923620 - RNA, 23 nt, Human
gcugcugauggggaggucauuca

SEQ ID NO: 923621 - RNA, 22 nt, Human
ggaagagcuggguucugcggac

SEQ ID NO: 923622 - RNA, 24 nt, Human
ggaauucuguuuauaccuuaauaa

SEQ ID NO: 923623 - RNA, 21 nt, Human
ggacuggaaggcagccuggug

SEQ ID NO: 923624 - RNA, 19 nt, Human
ggagccagaggcaaaacca

SEQ ID NO: 923625 - RNA, 25 nt, Human
gggaaacccugguccacucagcucc

SEQ ID NO: 923626 - RNA, 19 nt, Human
ggggaggagcugugcgaca

SEQ ID NO: 923627 - RNA, 22 nt, Human
guggccagaugcucagggcgcc

SEQ ID NO: 923628 - RNA, 19 nt, Human
uaaguccuugcuuauguca

SEQ ID NO: 923629 - RNA, 22 nt, Human
uaccgugaggaagucuucuuca

SEQ ID NO: 923630 - RNA, 30 nt, Human
uagaacagcagaacacucuaauucgaaagg

SEQ ID NO: 923631 - RNA, 21 nt, Human
ucagaggagcuacugcugugu

SEQ ID NO: 923632 - RNA, 19 nt, Human
ucagggcgccauccucucc

SEQ ID NO: 923633 - RNA, 21 nt, Human
ucagggcgccauccucucgaa

SEQ ID NO: 923634 - RNA, 21 nt, Human
ucaugucagaaagcuuugagc

SEQ ID NO: 923635 - RNA, 19 nt, Human
uccacagguagcucuggcu

SEQ ID NO: 923636 - RNA, 19 nt, Human
ucccugggcaggcccagga

SEQ ID NO: 923637 - RNA, 20 nt, Human
ucccugggcaggcccaggaa

SEQ ID NO: 923638 - RNA, 22 nt, Human
uccucaguguucccugggcagg

SEQ ID NO: 923639 - RNA, 20 nt, Human
uccucucgaagauaaaggcu

SEQ ID NO: 923640 - RNA, 18 nt, Human
uccugcaaguccacaaag

SEQ ID NO: 923641 - RNA, 18 nt, Human
ucucuggggaaacccugg

SEQ ID NO: 923642 - RNA, 21 nt, Human
ucucuggggaaacccuggucc

SEQ ID NO: 923643 - RNA, 25 nt, Human
ucucuggggaaacccugguccacuc

SEQ ID NO: 923644 - RNA, 23 nt, Human
ucugcacaggcuuuccgcaugcc

SEQ ID NO: 923645 - RNA, 19 nt, Human
ugaagagcgggaagagcug

SEQ ID NO: 923646 - RNA, 28 nt, Human
ugacaaauaucaccaaaauuugcagcac

SEQ ID NO: 923647 - RNA, 19 nt, Human
ugcaaagguggaagugaag

SEQ ID NO: 923648 - RNA, 22 nt, Human
ugcaaagguggaagugaagggg

SEQ ID NO: 923649 - RNA, 20 nt, Human
ugcagucguccuccugaggc

SEQ ID NO: 923650 - RNA, 19 nt, Human
ugcaucuucugacaaucug

SEQ ID NO: 923651 - RNA, 18 nt, Human
ugcggaccccaggggagg

SEQ ID NO: 923652 - RNA, 19 nt, Human
uggaauguccaagaaggcc

SEQ ID NO: 923653 - RNA, 18 nt, Human
uggccagaugcucagggc

SEQ ID NO: 923654 - RNA, 18 nt, Human
ugugguauuuguaacuca

SEQ ID NO: 923655 - RNA, 18 nt, Human
uuccacagguagcucugg

SEQ ID NO: 923656 - RNA, 19 nt, Human
uucgcugaggucccuucca

SEQ ID NO: 923657 - RNA, 19 nt, Human
aaaggugcacuuuuuuaca

SEQ ID NO: 923658 - RNA, 27 nt, Human
acccuaaaaagucauuucuuggagaag

SEQ ID NO: 923659 - RNA, 21 nt, Human
acgcgcugccggguaccacgg

SEQ ID NO: 923660 - RNA, 19 nt, Human
acuguguguaaaauacugc

SEQ ID NO: 923661 - RNA, 19 nt, Human
agauuaaucugagaguuac

SEQ ID NO: 923662 - RNA, 19 nt, Human
agcucauggauguuccuuc

SEQ ID NO: 923663 - RNA, 23 nt, Human
aggcccuugaucacaagcguauc

SEQ ID NO: 923664 - RNA, 24 nt, Human
augcagcaggugucacagaaggac

SEQ ID NO: 923665 - RNA, 20 nt, Human
cacagaaggacccuguccca

SEQ ID NO: 923666 - RNA, 21 nt, Human
cacccagccuggugaugcagc

SEQ ID NO: 923667 - RNA, 24 nt, Human
cacccuaaaaagucauuucuugga

SEQ ID NO: 923668 - RNA, 20 nt, Human
caggugucacagaaggaccc

SEQ ID NO: 923669 - RNA, 24 nt, Human
ccagccuggugaugcagcaggugu

SEQ ID NO: 923670 - RNA, 20 nt, Human
cccugucccagcugguacug

SEQ ID NO: 923671 - RNA, 21 nt, Human
cgcgcugccggguaccacggc

SEQ ID NO: 923672 - RNA, 19 nt, Human
cgcugccggguaccacggc

SEQ ID NO: 923673 - RNA, 24 nt, Human
cugccggguaccacggcuuucuuu

SEQ ID NO: 923674 - RNA, 22 nt, Human
cugugaguucuggcaauugugu

SEQ ID NO: 923675 - RNA, 18 nt, Human
cuuuccaguuuuacuggg

SEQ ID NO: 923676 - RNA, 22 nt, Human
gacuggcuauuucuccgacuuc

SEQ ID NO: 923677 - RNA, 21 nt, Human
gcaggugucacagaaggaccc

SEQ ID NO: 923678 - RNA, 23 nt, Human
gugaugcagcaggugucacagaa

SEQ ID NO: 923679 - RNA, 23 nt, Human
uaaaaccagaacuguguguaaaa

SEQ ID NO: 923680 - RNA, 18 nt, Human
uaaaacuaaaggugcacu

SEQ ID NO: 923681 - RNA, 21 nt, Human
uaaucugagaguuacuauuaa

SEQ ID NO: 923682 - RNA, 21 nt, Human
uaggaugguguggccucugau

SEQ ID NO: 923683 - RNA, 22 nt, Human
ucaucuucuucauccucuucug

SEQ ID NO: 923684 - RNA, 23 nt, Human
ucuaccacaacugaagaaauuuc

SEQ ID NO: 923685 - RNA, 21 nt, Human
ucuuuaucaugggaugaaggu

SEQ ID NO: 923686 - RNA, 24 nt, Human
ugaacgcgcugccggguaccacgg

SEQ ID NO: 923687 - RNA, 23 nt, Human
ugaguucuggcaauuguguccgu

SEQ ID NO: 923688 - RNA, 25 nt, Human
ugggaugauucuggaaagauucuuu

SEQ ID NO: 923689 - RNA, 20 nt, Human
ugguguggccucugaucugu

SEQ ID NO: 923690 - RNA, 19 nt, Human
uuccugauguucaucugcc

SEQ ID NO: 923691 - RNA, 21 nt, Human
uucgccuuuuugucaaaccug

SEQ ID NO: 923692 - RNA, 24 nt, Human
uugaaugcaucuuguuuauaacug

SEQ ID NO: 923693 - RNA, 23 nt, Human
uugacuggcuauuucuccgacuu

SEQ ID NO: 923694 - RNA, 18 nt, Human
uuggagaagcgauggaug

SEQ ID NO: 923695 - RNA, 20 nt, Human
uuuccugugagguuucggug

SEQ ID NO: 923696 - RNA, 23 nt, Human
acaaguccagcgggcugagcucu

SEQ ID NO: 923697 - RNA, 18 nt, Human
acaugggcccaggccugg

SEQ ID NO: 923698 - RNA, 23 nt, Human
acccucuugcccagggcacaugg

SEQ ID NO: 923699 - RNA, 27 nt, Human
agaccccacucugagaaggccagcggu

SEQ ID NO: 923700 - RNA, 18 nt, Human
agauggggcuugggcugg

SEQ ID NO: 923701 - RNA, 18 nt, Human
agauggggcuugggcugg

SEQ ID NO: 923702 - RNA, 21 nt, Human
agggcacaugggcccaggccu

SEQ ID NO: 923703 - RNA, 23 nt, Human
aggugccagcccaccgguuucau

SEQ ID NO: 923704 - RNA, 19 nt, Human
agugguagggggcgggagg

SEQ ID NO: 923705 - RNA, 23 nt, Human
augcucuguuuccccaagagugg

SEQ ID NO: 923706 - RNA, 21 nt, Human
cacccucuugcccagggcaca

SEQ ID NO: 923707 - RNA, 18 nt, Human
cagcacagaugcucuguu

SEQ ID NO: 923708 - RNA, 21 nt, Human
cagcaugggaagaccccacuc

SEQ ID NO: 923709 - RNA, 22 nt, Human
cagcguguccucuuugucucuu

SEQ ID NO: 923710 - RNA, 23 nt, Human
ccagcccaccgguuucauauccg

SEQ ID NO: 923711 - RNA, 24 nt, Human
ccagcguguccucuuugucucuuu

SEQ ID NO: 923712 - RNA, 22 nt, Human
ccaggccuggucagcacagaug

SEQ ID NO: 923713 - RNA, 19 nt, Human
ccauggcacaugccuaggc

SEQ ID NO: 923714 - RNA, 21 nt, Human
cccaggggcugggaucucucu

SEQ ID NO: 923715 - RNA, 18 nt, Human
ccccuggguacaauggcu

SEQ ID NO: 923716 - RNA, 21 nt, Human
cccguggagugguagggggcg

SEQ ID NO: 923717 - RNA, 25 nt, Human
cucagcuguguacugggccaucugc

SEQ ID NO: 923718 - RNA, 23 nt, Human
cuguguacugggccaucugcucc

SEQ ID NO: 923719 - RNA, 23 nt, Human
gagugagcuucggccagagccaa

SEQ ID NO: 923720 - RNA, 22 nt, Human
gcccaggccuggucagcacaga

SEQ ID NO: 923721 - RNA, 23 nt, Human
gcccguggagugguagggggcgg

SEQ ID NO: 923722 - RNA, 19 nt, Human
ggaggggagagcugggcug

SEQ ID NO: 923723 - RNA, 20 nt, Human
ggcuggagauggggcuuggg

SEQ ID NO: 923724 - RNA, 21 nt, Human
ggcuugggcuggggauagggu

SEQ ID NO: 923725 - RNA, 26 nt, Human
gggagagcugggcuggccaggagccu

SEQ ID NO: 923726 - RNA, 19 nt, Human
ggggcuggagauggggcuu

SEQ ID NO: 923727 - RNA, 20 nt, Human
guccucuuugucucuuucuc

SEQ ID NO: 923728 - RNA, 19 nt, Human
uacugggccaucugcuccg

SEQ ID NO: 923729 - RNA, 22 nt, Human
uaggguguggccaggaaugugg

SEQ ID NO: 923730 - RNA, 24 nt, Human
uccauggcacaugccuaggcuugg

SEQ ID NO: 923731 - RNA, 19 nt, Human
ucugcuccggugugguauu

SEQ ID NO: 923732 - RNA, 19 nt, Human
ugcccaggugccagcccac

SEQ ID NO: 923733 - RNA, 21 nt, Human
uggaagcacugugcccaggug

SEQ ID NO: 923734 - RNA, 21 nt, Human
uggaaggggcugggacugggg

SEQ ID NO: 923735 - RNA, 21 nt, Human
uggaggggagagcugggcugg

SEQ ID NO: 923736 - RNA, 18 nt, Human
uggagugggcccaggguc

SEQ ID NO: 923737 - RNA, 23 nt, Human
ugggaagaccccacucugagaag

SEQ ID NO: 923738 - RNA, 24 nt, Human
ugggcccagggucccaggggcugg

SEQ ID NO: 923739 - RNA, 19 nt, Human
ugggcuggggauagggugu

SEQ ID NO: 923740 - RNA, 24 nt, Human
uggggcuggagauggggcuugggc

SEQ ID NO: 923741 - RNA, 18 nt, Human
ugggggcagcagcauggg

SEQ ID NO: 923742 - RNA, 20 nt, Human
ugggggcagcagcaugggaa

SEQ ID NO: 923743 - RNA, 19 nt, Human
ugguagggggcgggaggua

SEQ ID NO: 923744 - RNA, 26 nt, Human
ugugcaggaacagggagugggaacgc

SEQ ID NO: 923745 - RNA, 22 nt, Human
ugugcccaggugccagcccacc

SEQ ID NO: 923746 - RNA, 23 nt, Human
aaaccaggugcuccagggcccug

SEQ ID NO: 923747 - RNA, 23 nt, Human
aaacugacaagcagcucagauaa

SEQ ID NO: 923748 - RNA, 22 nt, Human
aaccaguagcuggguggacaga

SEQ ID NO: 923749 - RNA, 21 nt, Human
aagcagcucagauaaagauuc

SEQ ID NO: 923750 - RNA, 23 nt, Human
aagcuuuuauuuuaacccaggga

SEQ ID NO: 923751 - RNA, 21 nt, Human
aaugaaccaguagcugggugg

SEQ ID NO: 923752 - RNA, 25 nt, Human
accaggugcuccagggcccuguucc

SEQ ID NO: 923753 - RNA, 19 nt, Human
agcuggguggacagaacau

SEQ ID NO: 923754 - RNA, 18 nt, Human
agggcccuguuccucucc

SEQ ID NO: 923755 - RNA, 23 nt, Human
caaacugacaagcagcucagaua

SEQ ID NO: 923756 - RNA, 27 nt, Human
caccagaaagcuuuuauuuuaacccag

SEQ ID NO: 923757 - RNA, 25 nt, Human
caguagcuggguggacagaacauac

SEQ ID NO: 923758 - RNA, 23 nt, Human
caucgcaacucccaccaacccua

SEQ ID NO: 923759 - RNA, 18 nt, Human
ccaagcgccucccguaaa

SEQ ID NO: 923760 - RNA, 20 nt, Human
ccagggccagggaggccgaa

SEQ ID NO: 923761 - RNA, 22 nt, Human
ccagggccagggaggccgaagc

SEQ ID NO: 923762 - RNA, 23 nt, Human
cccagggccagggaggccgaagc

SEQ ID NO: 923763 - RNA, 23 nt, Human
cccgaaaccaggugcuccagggc

SEQ ID NO: 923764 - RNA, 21 nt, Human
ccuagggacagacgaacaaac

SEQ ID NO: 923765 - RNA, 22 nt, Human
cgaaaccaggugcuccagggcc

SEQ ID NO: 923766 - RNA, 23 nt, Human
cgaacaaacugacaagcagcuca

SEQ ID NO: 923767 - RNA, 18 nt, Human
cguaaccaagcgccuccc

SEQ ID NO: 923768 - RNA, 21 nt, Human
cguaaccaagcgccucccgua

SEQ ID NO: 923769 - RNA, 24 nt, Human
cguaaccaagcgccucccguaaac

SEQ ID NO: 923770 - RNA, 20 nt, Human
cuagggacagacgaacaaac

SEQ ID NO: 923771 - RNA, 22 nt, Human
cuccagggcccuguuccucucc

SEQ ID NO: 923772 - RNA, 18 nt, Human
gauuccuaucuggauccc

SEQ ID NO: 923773 - RNA, 18 nt, Human
gcacuaaaagauguaaga

SEQ ID NO: 923774 - RNA, 23 nt, Human
guaaccaagcgccucccguaaac

SEQ ID NO: 923775 - RNA, 19 nt, Human
guagcuggguggacagaac

SEQ ID NO: 923776 - RNA, 21 nt, Human
uaaaagauguaagagguaggu

SEQ ID NO: 923777 - RNA, 24 nt, Human
uggacagaacauacgcacuaaaag

SEQ ID NO: 923778 - RNA, 27 nt, Human
uggcaauaucaucgcaacucccaccaa

SEQ ID NO: 923779 - RNA, 27 nt, Human
ccucucgugggggaaccgggcgaaggu

SEQ ID NO: 923780 - RNA, 19 nt, Human
gagcggccccgcggcggcg

SEQ ID NO: 923781 - RNA, 25 nt, Human
gcccggugguggcacguggggagcg

SEQ ID NO: 923782 - RNA, 18 nt, Human
uacacgagccgcgguggc

SEQ ID NO: 923783 - RNA, 22 nt, Human
ugggggaaccgggcgaaggugc

SEQ ID NO: 923784 - RNA, 20 nt, Human
cagaauccagcuugccugac

SEQ ID NO: 923785 - RNA, 24 nt, Human
cagcgucuugcuacauugcccagg

SEQ ID NO: 923786 - RNA, 21 nt, Human
ccagaauccagcuugccugac

SEQ ID NO: 923787 - RNA, 21 nt, Human
gcuggucuggaacuccugugc

SEQ ID NO: 923788 - RNA, 24 nt, Human
uacauugcccaggcuggucuggaa

SEQ ID NO: 923789 - RNA, 18 nt, Human
uagagacagcgucuugcu

SEQ ID NO: 923790 - RNA, 19 nt, Human
ucucucugcaaaggugggg

SEQ ID NO: 923791 - RNA, 23 nt, Human
ucuugcuacauugcccaggcugg

SEQ ID NO: 923792 - RNA, 24 nt, Human
ugcccaggcuggucuggaacuccu

SEQ ID NO: 923793 - RNA, 27 nt, Human
ugcuacauugcccaggcuggucuggaa

SEQ ID NO: 923794 - RNA, 23 nt, Human
acaagcccaggcagcucugugac

SEQ ID NO: 923795 - RNA, 24 nt, Human
accuccgucuccaggggcaggagc

SEQ ID NO: 923796 - RNA, 18 nt, Human
acucgaucaccuccagga

SEQ ID NO: 923797 - RNA, 20 nt, Human
agcaacuuuggguccauggg

SEQ ID NO: 923798 - RNA, 20 nt, Human
agcgggcgcugggcuggcug

SEQ ID NO: 923799 - RNA, 19 nt, Human
aggugaugggccacgggau

SEQ ID NO: 923800 - RNA, 22 nt, Human
caccuccgucuccaggggcagg

SEQ ID NO: 923801 - RNA, 24 nt, Human
caccuccgucuccaggggcaggag

SEQ ID NO: 923802 - RNA, 21 nt, Human
cagcugcuucagcaacuuugg

SEQ ID NO: 923803 - RNA, 18 nt, Human
ccagggggagugguuggu

SEQ ID NO: 923804 - RNA, 23 nt, Human
ccccgcgccggaucccgaggugc

SEQ ID NO: 923805 - RNA, 18 nt, Human
cccgaggugcuugccacc

SEQ ID NO: 923806 - RNA, 19 nt, Human
cccgcgccgggauccaggg

SEQ ID NO: 923807 - RNA, 24 nt, Human
ccggucuuaccgucccagggggag

SEQ ID NO: 923808 - RNA, 19 nt, Human
ccucucggccuucucugcc

SEQ ID NO: 923809 - RNA, 18 nt, Human
ccuucucugccuuccuca

SEQ ID NO: 923810 - RNA, 20 nt, Human
ccuucucugccuuccucagc

SEQ ID NO: 923811 - RNA, 23 nt, Human
cgggcgcugggcuggcuggcugu

SEQ ID NO: 923812 - RNA, 23 nt, Human
cuggccccacgccuaccggucuu

SEQ ID NO: 923813 - RNA, 21 nt, Human
gaaccacgaucuccccuucaa

SEQ ID NO: 923814 - RNA, 20 nt, Human
gaucaccuccaggaucuccc

SEQ ID NO: 923815 - RNA, 23 nt, Human
gauccuucuccuuccugagcgcu

SEQ ID NO: 923816 - RNA, 23 nt, Human
gcagcucugugacuuucccgcgc

SEQ ID NO: 923817 - RNA, 25 nt, Human
gcaucuccucauugcuggugaacuc

SEQ ID NO: 923818 - RNA, 18 nt, Human
gccuuccucagcugcuuc

SEQ ID NO: 923819 - RNA, 20 nt, Human
gcuggggcuggagucaucuc

SEQ ID NO: 923820 - RNA, 27 nt, Human
ggaacucccucucggccuucucugccu

SEQ ID NO: 923821 - RNA, 21 nt, Human
ggccacgggaugagugggacc

SEQ ID NO: 923822 - RNA, 22 nt, Human
gggagugguugguuuuccaggg

SEQ ID NO: 923823 - RNA, 24 nt, Human
ucagcaacuuuggguccaugggug

SEQ ID NO: 923824 - RNA, 19 nt, Human
ucauugcuggugaacucga

SEQ ID NO: 923825 - RNA, 25 nt, Human
uccaggaucuccccgcgccggaucc

SEQ ID NO: 923826 - RNA, 25 nt, Human
ucuccucauugcuggugaacucgau

SEQ ID NO: 923827 - RNA, 20 nt, Human
ugagcgggcgcugggcuggc

SEQ ID NO: 923828 - RNA, 22 nt, Human
ugccuuccucagcugcuucagc

SEQ ID NO: 923829 - RNA, 22 nt, Human
ugcuguggcuggggauccuucu

SEQ ID NO: 923830 - RNA, 22 nt, Human
ugcuuuaaacuggggcuuuaug

SEQ ID NO: 923831 - RNA, 24 nt, Human
uggagucaucucuggguuccacau

SEQ ID NO: 923832 - RNA, 18 nt, Human
uggcaacugcuguggcug

SEQ ID NO: 923833 - RNA, 22 nt, Human
uggcuguccuggccccacgccu

SEQ ID NO: 923834 - RNA, 21 nt, Human
ugggccacgggaugaguggga

SEQ ID NO: 923835 - RNA, 19 nt, Human
uggggcuuuauguggccag

SEQ ID NO: 923836 - RNA, 21 nt, Human
uggggucccggcacagcaucu

SEQ ID NO: 923837 - RNA, 22 nt, Human
uggguggcaacugcuguggcug

SEQ ID NO: 923838 - RNA, 24 nt, Human
uucccgcgccgggauccagggcuc

SEQ ID NO: 923839 - RNA, 21 nt, Human
uuccucagcugcuucagcaac

SEQ ID NO: 923840 - RNA, 26 nt, Human
aaaaaaacuaugcaaaagaacuugaa

SEQ ID NO: 923841 - RNA, 30 nt, Human
aaaaacccacaccuucucgcuucugcccuu

SEQ ID NO: 923842 - RNA, 25 nt, Human
aaacccacaccuucucgcuucugcc

SEQ ID NO: 923843 - RNA, 21 nt, Human
aaagaacuugaauccaaugag

SEQ ID NO: 923844 - RNA, 22 nt, Human
aaagaacuugaauccaaugagc

SEQ ID NO: 923845 - RNA, 19 nt, Human
aaauagcugcauaaaucug

SEQ ID NO: 923846 - RNA, 23 nt, Human
aaaugucuuuuuaaacaaauucc

SEQ ID NO: 923847 - RNA, 23 nt, Human
aaauucccccaccauuccacacc

SEQ ID NO: 923848 - RNA, 23 nt, Human
aaccccuaccccacucugaacag

SEQ ID NO: 923849 - RNA, 20 nt, Human
aacuaucucccaccacagca

SEQ ID NO: 923850 - RNA, 19 nt, Human
aagcaaacccaacuccgau

SEQ ID NO: 923851 - RNA, 19 nt, Human
acaggcuccuuucucccuc

SEQ ID NO: 923852 - RNA, 19 nt, Human
acaggggccagcaggcccc

SEQ ID NO: 923853 - RNA, 20 nt, Human
accccuggagaccaagguca

SEQ ID NO: 923854 - RNA, 22 nt, Human
acccuuguguggugcagcccca

SEQ ID NO: 923855 - RNA, 20 nt, Human
agacgagguggguggaccag

SEQ ID NO: 923856 - RNA, 20 nt, Human
agagcuggggguacaaggcc

SEQ ID NO: 923857 - RNA, 24 nt, Human
agcacgacgggggcaggguggggc

SEQ ID NO: 923858 - RNA, 23 nt, Human
agggguuagaaaaaaacuaugca

SEQ ID NO: 923859 - RNA, 19 nt, Human
agggucuuugggggcggga

SEQ ID NO: 923860 - RNA, 22 nt, Human
agguggguggaccaggacgcga

SEQ ID NO: 923861 - RNA, 21 nt, Human
auccagugcaaacuuuccuuc

SEQ ID NO: 923862 - RNA, 24 nt, Human
caaaagaacuugaauccaaugagc

SEQ ID NO: 923863 - RNA, 20 nt, Human
caaaauaagcaaacccaacu

SEQ ID NO: 923864 - RNA, 21 nt, Human
caaaauaagcaaacccaacuc

SEQ ID NO: 923865 - RNA, 24 nt, Human
caaagacacacucaccccucaaag

SEQ ID NO: 923866 - RNA, 21 nt, Human
caaauucccccaccauuccac

SEQ ID NO: 923867 - RNA, 19 nt, Human
cacaaggcgccauggcugc

SEQ ID NO: 923868 - RNA, 24 nt, Human
cacccacaaaggaggcugcacaag

SEQ ID NO: 923869 - RNA, 20 nt, Human
cagcaaaaacagugaucugg

SEQ ID NO: 923870 - RNA, 22 nt, Human
cagccagguggggggacuggcg

SEQ ID NO: 923871 - RNA, 23 nt, Human
caggaucaggacagccagagcug

SEQ ID NO: 923872 - RNA, 18 nt, Human
caggcuccuuucucccuc

SEQ ID NO: 923873 - RNA, 23 nt, Human
cagggaauguaugaaaauagcug

SEQ ID NO: 923874 - RNA, 19 nt, Human
caugcaaagacacacucac

SEQ ID NO: 923875 - RNA, 21 nt, Human
cauuuagcucugaccuucacc

SEQ ID NO: 923876 - RNA, 22 nt, Human
ccagagccaucagggggcacag

SEQ ID NO: 923877 - RNA, 19 nt, Human
cccacaccuucucgcuucu

SEQ ID NO: 923878 - RNA, 21 nt, Human
ccccaccauuccacaccccug

SEQ ID NO: 923879 - RNA, 24 nt, Human
ccccagaacccgggccgggggaca

SEQ ID NO: 923880 - RNA, 23 nt, Human
ccccagucauguugcucucucua

SEQ ID NO: 923881 - RNA, 21 nt, Human
cccccaccauuccacaccccu

SEQ ID NO: 923882 - RNA, 23 nt, Human
ccccucaaagggugggggaugga

SEQ ID NO: 923883 - RNA, 18 nt, Human
ccccuggacuccaacagg

SEQ ID NO: 923884 - RNA, 26 nt, Human
ccccuggagaccaaggucaagguggg

SEQ ID NO: 923885 - RNA, 23 nt, Human
ccccuuggaaaaaaacccacacc

SEQ ID NO: 923886 - RNA, 22 nt, Human
ccgcccgccugcccgcugggga

SEQ ID NO: 923887 - RNA, 18 nt, Human
ccuccuguaggaggaagg

SEQ ID NO: 923888 - RNA, 19 nt, Human
ccugaggagcugcuucccc

SEQ ID NO: 923889 - RNA, 19 nt, Human
ccugugcaguggaagcgag

SEQ ID NO: 923890 - RNA, 18 nt, Human
ccuuaaggagccauuuag

SEQ ID NO: 923891 - RNA, 21 nt, Human
cgcuuucggccccgcuggccc

SEQ ID NO: 923892 - RNA, 26 nt, Human
cggaaaaccccuaccccacucugaac

SEQ ID NO: 923893 - RNA, 19 nt, Human
cuaaaaaguucauccuuaa

SEQ ID NO: 923894 - RNA, 21 nt, Human
cuaugcaaaagaacuugaauc

SEQ ID NO: 923895 - RNA, 18 nt, Human
cuccgcccgccugcccgc

SEQ ID NO: 923896 - RNA, 18 nt, Human
cuccuucuucccagagcc

SEQ ID NO: 923897 - RNA, 22 nt, Human
cugagccuucccugcucagcaa

SEQ ID NO: 923898 - RNA, 21 nt, Human
cuggagaccaaggucaaggug

SEQ ID NO: 923899 - RNA, 22 nt, Human
cugggaaggguggcaaaaggga

SEQ ID NO: 923900 - RNA, 20 nt, Human
cugugcaguggaagcgaggu

SEQ ID NO: 923901 - RNA, 25 nt, Human
cuucugccugcaggaugggccacag

SEQ ID NO: 923902 - RNA, 19 nt, Human
cuuuccuucaggggaggga

SEQ ID NO: 923903 - RNA, 20 nt, Human
cuuucuccuuccugggccug

SEQ ID NO: 923904 - RNA, 27 nt, Human
gcaaaagaacuugaauccaaugagcaa

SEQ ID NO: 923905 - RNA, 25 nt, Human
gcaaacuuuccuucaggggagggaa

SEQ ID NO: 923906 - RNA, 22 nt, Human
gcacaggcuccuuucucccucc

SEQ ID NO: 923907 - RNA, 18 nt, Human
gccagccccucuccccuc

SEQ ID NO: 923908 - RNA, 18 nt, Human
gccaucagggggcacagg

SEQ ID NO: 923909 - RNA, 20 nt, Human
gccuuucuccuuccugggcc

SEQ ID NO: 923910 - RNA, 21 nt, Human
ggaaacaugcaaagacacacu

SEQ ID NO: 923911 - RNA, 18 nt, Human
ggacaucacccagccagg

SEQ ID NO: 923912 - RNA, 23 nt, Human
ggagccauuuagcucugaccuuc

SEQ ID NO: 923913 - RNA, 21 nt, Human
ggaucggguaacggcggaaaa

SEQ ID NO: 923914 - RNA, 24 nt, Human
ggcugcacaaggcgccauggcugc

SEQ ID NO: 923915 - RNA, 21 nt, Human
gggagggaagacaggaucagg

SEQ ID NO: 923916 - RNA, 24 nt, Human
gggccagcaggccccggcagggaa

SEQ ID NO: 923917 - RNA, 23 nt, Human
gggcccuggggacccuugugugg

SEQ ID NO: 923918 - RNA, 20 nt, Human
gggggcccuggggacccuug

SEQ ID NO: 923919 - RNA, 21 nt, Human
gggggcgcugccagagcuggg

SEQ ID NO: 923920 - RNA, 19 nt, Human
ggguacaaggcccaccugg

SEQ ID NO: 923921 - RNA, 18 nt, Human
gggucuuugggggcggga

SEQ ID NO: 923922 - RNA, 23 nt, Human
gucaaacuaucucccaccacagc

SEQ ID NO: 923923 - RNA, 19 nt, Human
guccuuuucuccagccccu

SEQ ID NO: 923924 - RNA, 23 nt, Human
uaagcaaacccaacuccgcuuuc

SEQ ID NO: 923925 - RNA, 18 nt, Human
uacaaggcccaccugggg

SEQ ID NO: 923926 - RNA, 18 nt, Human
uacauauaucuaucucca

SEQ ID NO: 923927 - RNA, 23 nt, Human
uagacgagguggguggaccagga

SEQ ID NO: 923928 - RNA, 18 nt, Human
uaugcaaaagaacuugaa

SEQ ID NO: 923929 - RNA, 23 nt, Human
ucauguugcucucucuacauaua

SEQ ID NO: 923930 - RNA, 20 nt, Human
uccccuuggaaaaaaaccca

SEQ ID NO: 923931 - RNA, 21 nt, Human
uccuggguccaguccuggcuc

SEQ ID NO: 923932 - RNA, 22 nt, Human
ucuccuuccugggccugugcag

SEQ ID NO: 923933 - RNA, 20 nt, Human
ucugggggccucucagggcc

SEQ ID NO: 923934 - RNA, 21 nt, Human
ucuguccuuuucuccagcccc

SEQ ID NO: 923935 - RNA, 23 nt, Human
ugaacagggaauguaugaaaaua

SEQ ID NO: 923936 - RNA, 20 nt, Human
ugaguauauacauauauaca

SEQ ID NO: 923937 - RNA, 22 nt, Human
ugaucugggggccucucagggc

SEQ ID NO: 923938 - RNA, 19 nt, Human
ugcucagcaaaaacaguga

SEQ ID NO: 923939 - RNA, 21 nt, Human
ugcuucaccgacgcuccaucc

SEQ ID NO: 923940 - RNA, 20 nt, Human
uggaaaaaaacccacaccuu

SEQ ID NO: 923941 - RNA, 24 nt, Human
uggaaaaaaacccacaccuucucg

SEQ ID NO: 923942 - RNA, 22 nt, Human
uggaggaagcugaacugaggca

SEQ ID NO: 923943 - RNA, 18 nt, Human
uggaucggguaacggcgg

SEQ ID NO: 923944 - RNA, 23 nt, Human
uggcaaaagggacuagcgcagca

SEQ ID NO: 923945 - RNA, 18 nt, Human
uggcugagcucuucucca

SEQ ID NO: 923946 - RNA, 21 nt, Human
ugggaaggguggcaaaaggga

SEQ ID NO: 923947 - RNA, 18 nt, Human
uggggcuccccacguuca

SEQ ID NO: 923948 - RNA, 22 nt, Human
ugggggccucucagggccucuu

SEQ ID NO: 923949 - RNA, 23 nt, Human
uggggguacaaggcccaccuggg

SEQ ID NO: 923950 - RNA, 24 nt, Human
uggggguucagucaaacuaucucc

SEQ ID NO: 923951 - RNA, 20 nt, Human
uucccagagcccauccuccu

SEQ ID NO: 923952 - RNA, 21 nt, Human
uuuuuuuuuuuuuuugugaaa

SEQ ID NO: 923953 - RNA, 18 nt, Human
uuuuuuuuuuuuuuuuug

SEQ ID NO: 923954 - RNA, 19 nt, Human
uuuuuuuuuuuuuuuuugu

SEQ ID NO: 923955 - RNA, 18 nt, Human
aaagcugcucccagccuu

SEQ ID NO: 923956 - RNA, 21 nt, Human
aacaugccuaaacaaaaaaga

SEQ ID NO: 923957 - RNA, 20 nt, Human
aagaaaaacuaaagucaccc

SEQ ID NO: 923958 - RNA, 22 nt, Human
aagcacuccuaagcugaagaaa

SEQ ID NO: 923959 - RNA, 23 nt, Human
acaccaaguccacacugguaagc

SEQ ID NO: 923960 - RNA, 21 nt, Human
acccccaacaaagggcaaugc

SEQ ID NO: 923961 - RNA, 19 nt, Human
acggccccgagagcaacaa

SEQ ID NO: 923962 - RNA, 19 nt, Human
acguacuguaugagguaaa

SEQ ID NO: 923963 - RNA, 19 nt, Human
aguccagguccagaccuac

SEQ ID NO: 923964 - RNA, 27 nt, Human
caaaaccaagucuccuaggaccacuaa

SEQ ID NO: 923965 - RNA, 22 nt, Human
cacaggaaugggggagaugaga

SEQ ID NO: 923966 - RNA, 18 nt, Human
caccuccccaguagugac

SEQ ID NO: 923967 - RNA, 20 nt, Human
cacggccccgagagcaacaa

SEQ ID NO: 923968 - RNA, 26 nt, Human
cagaucuccacgacaaagacagcuca

SEQ ID NO: 923969 - RNA, 21 nt, Human
cauacccccaacaaagggcag

SEQ ID NO: 923970 - RNA, 22 nt, Human
ccagaucuccacgacaaagaca

SEQ ID NO: 923971 - RNA, 18 nt, Human
ccaguagugacaugugca

SEQ ID NO: 923972 - RNA, 18 nt, Human
ccauggucauggaaccug

SEQ ID NO: 923973 - RNA, 19 nt, Human
ccccgagagcaacaaccac

SEQ ID NO: 923974 - RNA, 26 nt, Human
ccuaggaccacuaaaccuaugauggg

SEQ ID NO: 923975 - RNA, 27 nt, Human
ccucaucguggaagcuagagcaggaac

SEQ ID NO: 923976 - RNA, 19 nt, Human
ccucuuugccaguagggca

SEQ ID NO: 923977 - RNA, 24 nt, Human
ccucuuugccaguagggcaggcca

SEQ ID NO: 923978 - RNA, 21 nt, Human
ccugugugguggggacaaggc

SEQ ID NO: 923979 - RNA, 22 nt, Human
ccuuccugucaccucuuugcca

SEQ ID NO: 923980 - RNA, 19 nt, Human
cgccgagaaagcguuccga

SEQ ID NO: 923981 - RNA, 24 nt, Human
cuaacaccaaguccacacugguaa

SEQ ID NO: 923982 - RNA, 20 nt, Human
cuccaagcagccgugagucc

SEQ ID NO: 923983 - RNA, 20 nt, Human
cuccacacggccccgagagc

SEQ ID NO: 923984 - RNA, 19 nt, Human
cuccuaagcugaagaaaaa

SEQ ID NO: 923985 - RNA, 20 nt, Human
cuccuaggaccacuaaaccu

SEQ ID NO: 923986 - RNA, 24 nt, Human
cugaagaaaaacuaaagucacccc

SEQ ID NO: 923987 - RNA, 23 nt, Human
gcauguguguucauacaugcaua

SEQ ID NO: 923988 - RNA, 18 nt, Human
ggaagaauaaauaauagu

SEQ ID NO: 923989 - RNA, 19 nt, Human
ggacgcuccaagcagccgu

SEQ ID NO: 923990 - RNA, 19 nt, Human
ggagaugagagccaaggga

SEQ ID NO: 923991 - RNA, 21 nt, Human
ggcacaggaaugggggagaug

SEQ ID NO: 923992 - RNA, 24 nt, Human
gggggagaugagagccaagggaca

SEQ ID NO: 923993 - RNA, 22 nt, Human
ggugaaauaaaacaagcuuuga

SEQ ID NO: 923994 - RNA, 22 nt, Human
guaacacucauucacaucuuua

SEQ ID NO: 923995 - RNA, 20 nt, Human
gucauggaaccuggccaagg

SEQ ID NO: 923996 - RNA, 20 nt, Human
guugacaguaguacugcugc

SEQ ID NO: 923997 - RNA, 20 nt, Human
uaaacagcguggcuaacacu

SEQ ID NO: 923998 - RNA, 28 nt, Human
uacaguggugaaauaaaacaagcuuuga

SEQ ID NO: 923999 - RNA, 22 nt, Human
uacuccacacggccccgagagc

SEQ ID NO: 924000 - RNA, 20 nt, Human
ucaggccccauaugcuaaaa

SEQ ID NO: 924001 - RNA, 26 nt, Human
ucauacaugcauacccccaacaaagg

SEQ ID NO: 924002 - RNA, 23 nt, Human
uccacgacaaagacagcucaacc

SEQ ID NO: 924003 - RNA, 19 nt, Human
uccagguccagaccuacuc

SEQ ID NO: 924004 - RNA, 19 nt, Human
ucuccuaggaccacuaaac

SEQ ID NO: 924005 - RNA, 21 nt, Human
ucucuucaggaggaaggcugu

SEQ ID NO: 924006 - RNA, 22 nt, Human
ugaagaaaaacuaaagucaccc

SEQ ID NO: 924007 - RNA, 25 nt, Human
ugagguaaacagcguggcuaacacc

SEQ ID NO: 924008 - RNA, 22 nt, Human
ugcaaaguuccagaucuccacg

SEQ ID NO: 924009 - RNA, 18 nt, Human
uggccaagguuucaagca

SEQ ID NO: 924010 - RNA, 23 nt, Human
ugggcuuucaacuguaacacuca

SEQ ID NO: 924011 - RNA, 18 nt, Human
uguccuguguggugggga

SEQ ID NO: 924012 - RNA, 25 nt, Human
uguguucauacaugcauacccccaa

SEQ ID NO: 924013 - RNA, 22 nt, Human
uucaacuguaacacucauucac

SEQ ID NO: 924014 - RNA, 19 nt, Human
uuggaacaaacagacuccc

SEQ ID NO: 924015 - RNA, 18 nt, Human
uuuuuuuuuuuuuuuuug

SEQ ID NO: 924016 - RNA, 19 nt, Human
aaaagcuaaaacugaaccu

SEQ ID NO: 924017 - RNA, 21 nt, Human
aaaaguaauaaaauacacuga

SEQ ID NO: 924018 - RNA, 21 nt, Human
aaacaaaaucuacauccaacc

SEQ ID NO: 924019 - RNA, 29 nt, Human
aacagacaugaggugggugcuggauucaa

SEQ ID NO: 924020 - RNA, 18 nt, Human
aagaagaagaagaagaag

SEQ ID NO: 924021 - RNA, 20 nt, Human
aagaagaagaagaagaagaa

SEQ ID NO: 924022 - RNA, 22 nt, Human
aagaagaagaagaagaagaaga

SEQ ID NO: 924023 - RNA, 21 nt, Human
aagaagaagaagaagaagaca

SEQ ID NO: 924024 - RNA, 22 nt, Human
aagaagaagaagaagaagacaa

SEQ ID NO: 924025 - RNA, 21 nt, Human
aagaagaagaagaagacaacu

SEQ ID NO: 924026 - RNA, 22 nt, Human
aagaagaagaagacaacuuaga

SEQ ID NO: 924027 - RNA, 24 nt, Human
aagaagaagaagacaacuuagaaa

SEQ ID NO: 924028 - RNA, 20 nt, Human
aagaagaagacaacuuagaa

SEQ ID NO: 924029 - RNA, 24 nt, Human
acaccugcugcauagcacaagacu

SEQ ID NO: 924030 - RNA, 20 nt, Human
acacuauaacucacugaaug

SEQ ID NO: 924031 - RNA, 21 nt, Human
accaaagaagaagaagaagaa

SEQ ID NO: 924032 - RNA, 22 nt, Human
accaauaucuccuucuuaccac

SEQ ID NO: 924033 - RNA, 24 nt, Human
accacaaccacagaaugggaggca

SEQ ID NO: 924034 - RNA, 19 nt, Human
accaccacaaccacagaau

SEQ ID NO: 924035 - RNA, 24 nt, Human
accaccaccacaaccacagaaugg

SEQ ID NO: 924036 - RNA, 22 nt, Human
accuuggcaaaauaaaccccag

SEQ ID NO: 924037 - RNA, 22 nt, Human
agaagaagaagaagaagaagaa

SEQ ID NO: 924038 - RNA, 22 nt, Human
agaagaagaagaagaagaagaa

SEQ ID NO: 924039 - RNA, 22 nt, Human
agaagaagaagaagaagaagaa

SEQ ID NO: 924040 - RNA, 25 nt, Human
agaagaagaagaagacaacuuagaa

SEQ ID NO: 924041 - RNA, 22 nt, Human
agaagaagaagacaacuuagaa

SEQ ID NO: 924042 - RNA, 23 nt, Human
agaagaagaagacaacuuagaag

SEQ ID NO: 924043 - RNA, 24 nt, Human
agaagaagacaacuuagaagggaa

SEQ ID NO: 924044 - RNA, 21 nt, Human
agaagggaaagcaacaaagag

SEQ ID NO: 924045 - RNA, 21 nt, Human
agaccuaaugcacacccacaa

SEQ ID NO: 924046 - RNA, 18 nt, Human
agcaugucacaaaaaguu

SEQ ID NO: 924047 - RNA, 20 nt, Human
aggaaaaguaaggcucguca

SEQ ID NO: 924048 - RNA, 20 nt, Human
aggucuuucuguucuggagu

SEQ ID NO: 924049 - RNA, 21 nt, Human
augaaguaaggucuuucuguu

SEQ ID NO: 924050 - RNA, 18 nt, Human
auggaugagagacaaaac

SEQ ID NO: 924051 - RNA, 26 nt, Human
caaauuaaaaagaacguaacagggcc

SEQ ID NO: 924052 - RNA, 19 nt, Human
caacagcccaacaauaguu

SEQ ID NO: 924053 - RNA, 23 nt, Human
caagauaaagcaguucagaccua

SEQ ID NO: 924054 - RNA, 24 nt, Human
caaggaauauauccuuuaccaaug

SEQ ID NO: 924055 - RNA, 25 nt, Human
cacagccuuuaagccucugcccucc

SEQ ID NO: 924056 - RNA, 23 nt, Human
cagcauuaaaaguaauaaaauac

SEQ ID NO: 924057 - RNA, 23 nt, Human
cagccuuuucucuuucagguugu

SEQ ID NO: 924058 - RNA, 19 nt, Human
cagcucaagagcaaggcaa

SEQ ID NO: 924059 - RNA, 20 nt, Human
ccaaagaagaagaagaagaa

SEQ ID NO: 924060 - RNA, 20 nt, Human
ccacaaaggaaaaguaaggc

SEQ ID NO: 924061 - RNA, 18 nt, Human
ccaccacaaccacagaau

SEQ ID NO: 924062 - RNA, 19 nt, Human
ccauaaaaugaacauucca

SEQ ID NO: 924063 - RNA, 22 nt, Human
ccauaaaaugaacauuccauuc

SEQ ID NO: 924064 - RNA, 23 nt, Human
cccuucugucccacaccugggag

SEQ ID NO: 924065 - RNA, 24 nt, Human
ccuguguuuugcaaugcaggguca

SEQ ID NO: 924066 - RNA, 20 nt, Human
ccuucuuaccaccaccacaa

SEQ ID NO: 924067 - RNA, 21 nt, Human
cuacauacauguuuuccaaau

SEQ ID NO: 924068 - RNA, 22 nt, Human
cucacacauacaaacauguuua

SEQ ID NO: 924069 - RNA, 24 nt, Human
cuccuucuuaccaccaccacaacc

SEQ ID NO: 924070 - RNA, 20 nt, Human
cuggaguaauaaauucuacu

SEQ ID NO: 924071 - RNA, 28 nt, Human
cuuaaggaccaaagaagaagaagaagaa

SEQ ID NO: 924072 - RNA, 19 nt, Human
cuuuaagccucugcccucc

SEQ ID NO: 924073 - RNA, 20 nt, Human
gaacaugagcuucugaccua

SEQ ID NO: 924074 - RNA, 19 nt, Human
gaagaagaagaagaagaag

SEQ ID NO: 924075 - RNA, 19 nt, Human
gaagaagaagaagaagaag

SEQ ID NO: 924076 - RNA, 19 nt, Human
gaagaagaagaagaagaag

SEQ ID NO: 924077 - RNA, 19 nt, Human
gaagaagaagaagaagaag

SEQ ID NO: 924078 - RNA, 21 nt, Human
gaagagcuggcuucauuuuug

SEQ ID NO: 924079 - RNA, 18 nt, Human
gacugccauccgcaucuc

SEQ ID NO: 924080 - RNA, 18 nt, Human
ggaauauauccuuuacca

SEQ ID NO: 924081 - RNA, 19 nt, Human
gguaugaacacaauaugcc

SEQ ID NO: 924082 - RNA, 20 nt, Human
uaaaaacaaaaucuacaucc

SEQ ID NO: 924083 - RNA, 22 nt, Human
uaaaacugaaccuuuagaaaau

SEQ ID NO: 924084 - RNA, 20 nt, Human
uaaaacuuaaaacaacugcc

SEQ ID NO: 924085 - RNA, 19 nt, Human
uaacaggauagggucaaca

SEQ ID NO: 924086 - RNA, 21 nt, Human
uaaggucuuucuguucuggag

SEQ ID NO: 924087 - RNA, 25 nt, Human
uaauaaauaagaaaugccaccuucc

SEQ ID NO: 924088 - RNA, 20 nt, Human
uaccaccaccacaaccacag

SEQ ID NO: 924089 - RNA, 23 nt, Human
uaccaccaccacaaccacagaau

SEQ ID NO: 924090 - RNA, 19 nt, Human
uagcaugucacaaaaaguu

SEQ ID NO: 924091 - RNA, 22 nt, Human
uagggaaguuaaaaaaaaucag

SEQ ID NO: 924092 - RNA, 20 nt, Human
uaucagaacaugagcuucug

SEQ ID NO: 924093 - RNA, 27 nt, Human
uaucuccuucuuaccaccaccacaacc

SEQ ID NO: 924094 - RNA, 19 nt, Human
ucaaaacaauagguuuuuc

SEQ ID NO: 924095 - RNA, 18 nt, Human
ucaaugauaaaaacaaaa

SEQ ID NO: 924096 - RNA, 20 nt, Human
ucacauuuaaauaacaggau

SEQ ID NO: 924097 - RNA, 19 nt, Human
ucacuuaaggaccaaagaa

SEQ ID NO: 924098 - RNA, 28 nt, Human
ucacuuaaggaccaaagaagaagaagaa

SEQ ID NO: 924099 - RNA, 22 nt, Human
ucauuuuaagacagcauuaaaa

SEQ ID NO: 924100 - RNA, 20 nt, Human
uccacuagucuucuccuaga

SEQ ID NO: 924101 - RNA, 20 nt, Human
uccaucuaccggcugugagg

SEQ ID NO: 924102 - RNA, 18 nt, Human
uccauuuucaguuuccau

SEQ ID NO: 924103 - RNA, 21 nt, Human
ucccucugccccuucuguccc

SEQ ID NO: 924104 - RNA, 24 nt, Human
uccuucuuaccaccaccacaacca

SEQ ID NO: 924105 - RNA, 26 nt, Human
uccuucuuaccaccaccacaaccaca

SEQ ID NO: 924106 - RNA, 21 nt, Human
uccuuuaccaaugaaugauaa

SEQ ID NO: 924107 - RNA, 22 nt, Human
ucuacauccaaccuacuccaaa

SEQ ID NO: 924108 - RNA, 23 nt, Human
ugaaagccaugcgauuuggcucg

SEQ ID NO: 924109 - RNA, 22 nt, Human
ugagaacagacaugaggugggu

SEQ ID NO: 924110 - RNA, 18 nt, Human
ugagagacaaaacugugg

SEQ ID NO: 924111 - RNA, 19 nt, Human
ugagagacaaaacuguggu

SEQ ID NO: 924112 - RNA, 20 nt, Human
ugagcuucugaccuaaucca

SEQ ID NO: 924113 - RNA, 19 nt, Human
ugaggaagagcuggcuuca

SEQ ID NO: 924114 - RNA, 21 nt, Human
ugcacacccacaaaaugcccc

SEQ ID NO: 924115 - RNA, 19 nt, Human
ugccauaaaaugaacauuc

SEQ ID NO: 924116 - RNA, 22 nt, Human
ugccaucucuucaaauccaggu

SEQ ID NO: 924117 - RNA, 22 nt, Human
ugcgaaaucuacacaucaauaa

SEQ ID NO: 924118 - RNA, 19 nt, Human
ugcuggcacaaacagggcg

SEQ ID NO: 924119 - RNA, 18 nt, Human
uggaaagcacuaccaaca

SEQ ID NO: 924120 - RNA, 26 nt, Human
uggcacauccugucuccaccuuuggu

SEQ ID NO: 924121 - RNA, 19 nt, Human
ugugaggaagagcuggcuu

SEQ ID NO: 924122 - RNA, 23 nt, Human
uguucuguggcaaaaaccgaggg

SEQ ID NO: 924123 - RNA, 21 nt, Human
uuccaauaaguuauuccugaa

SEQ ID NO: 924124 - RNA, 23 nt, Human
uuccaucuaccggcugugaggaa

SEQ ID NO: 924125 - RNA, 19 nt, Human
uuccugaagggaggggaga

SEQ ID NO: 924126 - RNA, 19 nt, Human
uucucuccaccucgaaauc

SEQ ID NO: 924127 - RNA, 21 nt, Human
uucugcugacaucaagcagcc

SEQ ID NO: 924128 - RNA, 24 nt, Human
uucugucccacaccugggagggcu

SEQ ID NO: 924129 - RNA, 25 nt, Human
uuggcacauccugucuccaccuuug

SEQ ID NO: 924130 - RNA, 21 nt, Human
uuggcucgacugccauccgca

SEQ ID NO: 924131 - RNA, 22 nt, Human
uuggcucgacugccauccgcau

SEQ ID NO: 924132 - RNA, 19 nt, Human
uuucucucucucucucuca

SEQ ID NO: 924133 - RNA, 20 nt, Human
uuuguuaaauuacugaaaac

SEQ ID NO: 924134 - RNA, 21 nt, Human
aaggcaacgggucaagaacac

SEQ ID NO: 924135 - RNA, 21 nt, Human
acauggagcaccuggcagagc

SEQ ID NO: 924136 - RNA, 22 nt, Human
accgagguucagagaggcagag

SEQ ID NO: 924137 - RNA, 19 nt, Human
agagacacugaggaccugg

SEQ ID NO: 924138 - RNA, 23 nt, Human
aggacagagauucaggaagagaa

SEQ ID NO: 924139 - RNA, 24 nt, Human
auggagcaccuggcagagcugccg

SEQ ID NO: 924140 - RNA, 19 nt, Human
auucaggaagagaagaaca

SEQ ID NO: 924141 - RNA, 24 nt, Human
auugacaaggaggauacaagggca

SEQ ID NO: 924142 - RNA, 18 nt, Human
cacguuacacuccucagg

SEQ ID NO: 924143 - RNA, 22 nt, Human
ccacccacggagguagccgccu

SEQ ID NO: 924144 - RNA, 18 nt, Human
ccagagaaaggcaacggg

SEQ ID NO: 924145 - RNA, 23 nt, Human
ccauccuucuagaacuccaggcu

SEQ ID NO: 924146 - RNA, 22 nt, Human
cccacaguccauugagguggcu

SEQ ID NO: 924147 - RNA, 18 nt, Human
cccugcuugagacugggg

SEQ ID NO: 924148 - RNA, 19 nt, Human
cccugcuugagacugggga

SEQ ID NO: 924149 - RNA, 18 nt, Human
cucacucuccauccuucu

SEQ ID NO: 924150 - RNA, 21 nt, Human
cucacucuccauccuucuaga

SEQ ID NO: 924151 - RNA, 18 nt, Human
cuccucaggucucccgga

SEQ ID NO: 924152 - RNA, 23 nt, Human
cucuccauccuucuagaacucca

SEQ ID NO: 924153 - RNA, 24 nt, Human
gaacacagcacacaccccuucugc

SEQ ID NO: 924154 - RNA, 22 nt, Human
gaacuuccuuuauugacaagga

SEQ ID NO: 924155 - RNA, 24 nt, Human
gcagagcugccgaugggucugcca

SEQ ID NO: 924156 - RNA, 20 nt, Human
uaccagagaaaggcaacggg

SEQ ID NO: 924157 - RNA, 20 nt, Human
ucaauuuacuuaagccuccc

SEQ ID NO: 924158 - RNA, 22 nt, Human
ucaggaagagaagaacaaggcu

SEQ ID NO: 924159 - RNA, 21 nt, Human
ugaagaaaccgagguucagag

SEQ ID NO: 924160 - RNA, 19 nt, Human
ugacaaggaggauacaagg

SEQ ID NO: 924161 - RNA, 22 nt, Human
ugacaaggaggauacaagggca

SEQ ID NO: 924162 - RNA, 21 nt, Human
uggagcaccuggcagagcugc

SEQ ID NO: 924163 - RNA, 23 nt, Human
uggauccccucacucuccauccu

SEQ ID NO: 924164 - RNA, 27 nt, Human
uggcaggacagagauucaggaagagaa

SEQ ID NO: 924165 - RNA, 22 nt, Human
ugggaccauguguggcaggaca

SEQ ID NO: 924166 - RNA, 20 nt, Human
ugggguaagacaccaguacc

SEQ ID NO: 924167 - RNA, 21 nt, Human
uuccuggacuaaguuagggaa

SEQ ID NO: 924168 - RNA, 26 nt, Human
uuccuuuauugacaaggaggauacaa

SEQ ID NO: 924169 - RNA, 21 nt, Human
aacccccgcgcccgaccacac

SEQ ID NO: 924170 - RNA, 23 nt, Human
aacccccgcgcccgaccacaccc

SEQ ID NO: 924171 - RNA, 18 nt, Human
aagagagguacaaaugua

SEQ ID NO: 924172 - RNA, 24 nt, Human
aagguuaaagugaccaucuucugg

SEQ ID NO: 924173 - RNA, 18 nt, Human
aaguccgcucuccugccc

SEQ ID NO: 924174 - RNA, 24 nt, Human
acaacccccgcgcccgaccacacc

SEQ ID NO: 924175 - RNA, 18 nt, Human
acacgggccaaggcgggg

SEQ ID NO: 924176 - RNA, 20 nt, Human
acagcugaaggggagggggc

SEQ ID NO: 924177 - RNA, 22 nt, Human
accacacccggacaaggagguc

SEQ ID NO: 924178 - RNA, 19 nt, Human
acggccgggccgacggggg

SEQ ID NO: 924179 - RNA, 20 nt, Human
acuucaggacaccaguccca

SEQ ID NO: 924180 - RNA, 20 nt, Human
agaauacaagagagguacaa

SEQ ID NO: 924181 - RNA, 25 nt, Human
aggacucucgguggcggaggagggg

SEQ ID NO: 924182 - RNA, 18 nt, Human
aggcagggggacccccuc

SEQ ID NO: 924183 - RNA, 20 nt, Human
aucugcgacacgggccaagg

SEQ ID NO: 924184 - RNA, 19 nt, Human
auuuuagaauacaagagag

SEQ ID NO: 924185 - RNA, 18 nt, Human
caacccccgcgcccgacc

SEQ ID NO: 924186 - RNA, 24 nt, Human
cacaacccccgcgcccgaccacac

SEQ ID NO: 924187 - RNA, 18 nt, Human
cacagaagccaccuuaac

SEQ ID NO: 924188 - RNA, 19 nt, Human
cacagaagccaccuuaacc

SEQ ID NO: 924189 - RNA, 23 nt, Human
cacagcucggaagcgcuucgugg

SEQ ID NO: 924190 - RNA, 22 nt, Human
caccagagggcgcgcacggccc

SEQ ID NO: 924191 - RNA, 27 nt, Human
caccuuaaccucucgggcagcgguucc

SEQ ID NO: 924192 - RNA, 21 nt, Human
caggcacgaugucacagcuga

SEQ ID NO: 924193 - RNA, 23 nt, Human
caggcagggggacccccucccag

SEQ ID NO: 924194 - RNA, 23 nt, Human
ccacagaagccaccuuaaccucu

SEQ ID NO: 924195 - RNA, 20 nt, Human
ccacccacgagggggaugcc

SEQ ID NO: 924196 - RNA, 21 nt, Human
cccaggggccggaagaggaga

SEQ ID NO: 924197 - RNA, 18 nt, Human
cccaguagcccgcacaug

SEQ ID NO: 924198 - RNA, 21 nt, Human
cccaguagcccgcacauguca

SEQ ID NO: 924199 - RNA, 26 nt, Human
ccccacaacccccgcgcccgaccaca

SEQ ID NO: 924200 - RNA, 20 nt, Human
cccccacaacccccgcgccc

SEQ ID NO: 924201 - RNA, 24 nt, Human
cccccacaacccccgcgcccgacc

SEQ ID NO: 924202 - RNA, 23 nt, Human
cccccgcgcccgaccacacccgg

SEQ ID NO: 924203 - RNA, 20 nt, Human
ccccgcgcccgaccacaccc

SEQ ID NO: 924204 - RNA, 23 nt, Human
cccggcgccgggggacggccggg

SEQ ID NO: 924205 - RNA, 23 nt, Human
ccgccuccggggcgcaaccccag

SEQ ID NO: 924206 - RNA, 22 nt, Human
ccgcgcccgaccacacccggac

SEQ ID NO: 924207 - RNA, 18 nt, Human
ccggcucuacagcagcag

SEQ ID NO: 924208 - RNA, 19 nt, Human
ccgggccggggguuggggc

SEQ ID NO: 924209 - RNA, 18 nt, Human
ccggggguuggggcugga

SEQ ID NO: 924210 - RNA, 21 nt, Human
ccgggucucuucccgcugccg

SEQ ID NO: 924211 - RNA, 24 nt, Human
ccuacgggaauccugguaaaugac

SEQ ID NO: 924212 - RNA, 21 nt, Human
ccuucauuuuacagaugggga

SEQ ID NO: 924213 - RNA, 21 nt, Human
cgguggcggaggaggggacuc

SEQ ID NO: 924214 - RNA, 26 nt, Human
gaagaugcaucucuccgggucucuuc

SEQ ID NO: 924215 - RNA, 18 nt, Human
gaccacacccggacaagg

SEQ ID NO: 924216 - RNA, 23 nt, Human
gagcgcgcggggcccggcggggg

SEQ ID NO: 924217 - RNA, 21 nt, Human
gcaucucuccgggucucuucc

SEQ ID NO: 924218 - RNA, 23 nt, Human
gccaccuuaaccucucgggcagc

SEQ ID NO: 924219 - RNA, 18 nt, Human
gcccccacaacccccgcg

SEQ ID NO: 924220 - RNA, 20 nt, Human
gccggccugggcgcccggcu

SEQ ID NO: 924221 - RNA, 21 nt, Human
gccuaaaggagagaagggccc

SEQ ID NO: 924222 - RNA, 21 nt, Human
gcgcccccacaacccccgcgc

SEQ ID NO: 924223 - RNA, 22 nt, Human
gcgcggggcccggcgggggcgc

SEQ ID NO: 924224 - RNA, 24 nt, Human
gcucggggucccacagaggauuuc

SEQ ID NO: 924225 - RNA, 21 nt, Human
ggaauucccgggacugggcac

SEQ ID NO: 924226 - RNA, 18 nt, Human
ggccggggguuggggcug

SEQ ID NO: 924227 - RNA, 18 nt, Human
ggccugggcgcccggcuc

SEQ ID NO: 924228 - RNA, 23 nt, Human
ggcucuaaguccgcucuccugcc

SEQ ID NO: 924229 - RNA, 18 nt, Human
gggcagggaccgagggaa

SEQ ID NO: 924230 - RNA, 26 nt, Human
gggccggggugccggggacccaggag

SEQ ID NO: 924231 - RNA, 22 nt, Human
ggggguaagcuggccuaaagga

SEQ ID NO: 924232 - RNA, 19 nt, Human
gguauauuucgccuuccca

SEQ ID NO: 924233 - RNA, 21 nt, Human
gugcacugcaaagagcuccuu

SEQ ID NO: 924234 - RNA, 21 nt, Human
gugcagggucuugcucggggu

SEQ ID NO: 924235 - RNA, 21 nt, Human
guguguguuggaaggggcugg

SEQ ID NO: 924236 - RNA, 20 nt, Human
guguguuggaaggggcuggg

SEQ ID NO: 924237 - RNA, 24 nt, Human
uacaaaacgcccuacgggaauccu

SEQ ID NO: 924238 - RNA, 24 nt, Human
uauuuacaguuguacauauacaau

SEQ ID NO: 924239 - RNA, 20 nt, Human
ucacagcugaaggggagggg

SEQ ID NO: 924240 - RNA, 23 nt, Human
uccuucauuuuacagauggggaa

SEQ ID NO: 924241 - RNA, 23 nt, Human
ucugcgacacgggccaaggcggg

SEQ ID NO: 924242 - RNA, 18 nt, Human
ucuugcucggggucccac

SEQ ID NO: 924243 - RNA, 20 nt, Human
ugaggaaacgggcagggacc

SEQ ID NO: 924244 - RNA, 18 nt, Human
ugcaaagagcuccuuccu

SEQ ID NO: 924245 - RNA, 22 nt, Human
ugcaaagagcuccuuccucauc

SEQ ID NO: 924246 - RNA, 24 nt, Human
ugcaaagagcuccuuccucauccg

SEQ ID NO: 924247 - RNA, 18 nt, Human
ugcugaggggcccucggg

SEQ ID NO: 924248 - RNA, 18 nt, Human
uggaaggggcugggggua

SEQ ID NO: 924249 - RNA, 18 nt, Human
uggcggaggaggggacuc

SEQ ID NO: 924250 - RNA, 19 nt, Human
uguguguguuggaaggggc

SEQ ID NO: 924251 - RNA, 22 nt, Human
uguguguguuggaaggggcugg

SEQ ID NO: 924252 - RNA, 19 nt, Human
aacuugaccaauuuguaca

SEQ ID NO: 924253 - RNA, 25 nt, Human
acacacaccacauuuguauucuacc

SEQ ID NO: 924254 - RNA, 25 nt, Human
agaggcccggggugcggagguacug

SEQ ID NO: 924255 - RNA, 26 nt, Human
agagucccacccgagagggucacauu

SEQ ID NO: 924256 - RNA, 18 nt, Human
agcucuccagguggccag

SEQ ID NO: 924257 - RNA, 22 nt, Human
aggcaggcgcucgggugcucca

SEQ ID NO: 924258 - RNA, 22 nt, Human
agguacugguggcacucgagcu

SEQ ID NO: 924259 - RNA, 19 nt, Human
auaaaacaacacacaccac

SEQ ID NO: 924260 - RNA, 25 nt, Human
augagaacagauaaaauguaaacaa

SEQ ID NO: 924261 - RNA, 21 nt, Human
caaucuggaaccaaaaccaaa

SEQ ID NO: 924262 - RNA, 24 nt, Human
cagaaaaguacaacuuaaaaauac

SEQ ID NO: 924263 - RNA, 21 nt, Human
ccaaaauacuauacccacugu

SEQ ID NO: 924264 - RNA, 25 nt, Human
ccaaaauacuauacccacuguacag

SEQ ID NO: 924265 - RNA, 18 nt, Human
ccagaggcccggggugcg

SEQ ID NO: 924266 - RNA, 25 nt, Human
cccucuucccaccaccaggaguucc

SEQ ID NO: 924267 - RNA, 19 nt, Human
ccucaccccgccccuuccc

SEQ ID NO: 924268 - RNA, 24 nt, Human
ccucaccccgccccuucccgggaa

SEQ ID NO: 924269 - RNA, 25 nt, Human
ccucucaaaaacaaaaacgguuuug

SEQ ID NO: 924270 - RNA, 19 nt, Human
ccuuuuggcaccgcuagcg

SEQ ID NO: 924271 - RNA, 23 nt, Human
cgacuccucucuguccucacccc

SEQ ID NO: 924272 - RNA, 25 nt, Human
cgagaauaaacccucgacuccucuc

SEQ ID NO: 924273 - RNA, 21 nt, Human
cgccccuucccgggaagacuc

SEQ ID NO: 924274 - RNA, 24 nt, Human
cuuuaaaauuauauauugcgugcu

SEQ ID NO: 924275 - RNA, 25 nt, Human
gaggcccggggugcggagguacugg

SEQ ID NO: 924276 - RNA, 22 nt, Human
gaguuuggugagagaguugcgc

SEQ ID NO: 924277 - RNA, 18 nt, Human
gccccgacgugcguccuc

SEQ ID NO: 924278 - RNA, 20 nt, Human
gcccucucaaaaacaaaaac

SEQ ID NO: 924279 - RNA, 18 nt, Human
gccgccgccaccaggcag

SEQ ID NO: 924280 - RNA, 20 nt, Human
ggaagggcgcgagugacaga

SEQ ID NO: 924281 - RNA, 23 nt, Human
ggcgcccucucaaaaacaaaaac

SEQ ID NO: 924282 - RNA, 20 nt, Human
ggcgggcaugcacugcgccu

SEQ ID NO: 924283 - RNA, 22 nt, Human
ggugagcucauccaagaagucc

SEQ ID NO: 924284 - RNA, 19 nt, Human
uacagcagucauuauaaaa

SEQ ID NO: 924285 - RNA, 24 nt, Human
uagucuuugacaugagaacagaua

SEQ ID NO: 924286 - RNA, 19 nt, Human
ucagcaccagaugugggac

SEQ ID NO: 924287 - RNA, 18 nt, Human
uccuccacagaaaaguac

SEQ ID NO: 924288 - RNA, 20 nt, Human
uccucuacugcgagaauaaa

SEQ ID NO: 924289 - RNA, 24 nt, Human
ugagaacagauaaaauguaaacaa

SEQ ID NO: 924290 - RNA, 20 nt, Human
uggaaccaaaaccaaaauac

SEQ ID NO: 924291 - RNA, 19 nt, Human
uggcaccgcuagcgcaagg

SEQ ID NO: 924292 - RNA, 30 nt, Human
uguacagcagucauuauaaaacaacacacc

SEQ ID NO: 924293 - RNA, 18 nt, Human
uuaaaaucugcgcccucg

SEQ ID NO: 924294 - RNA, 24 nt, Human
uucaaaaggcacaauuuccuccac

SEQ ID NO: 924295 - RNA, 22 nt, Human
uucagggugagcucauccaaga

SEQ ID NO: 924296 - RNA, 21 nt, Human
uuccuccacagaaaaguacaa

SEQ ID NO: 924297 - RNA, 20 nt, Human
uuggaagggcgcgagugaca

SEQ ID NO: 924298 - RNA, 24 nt, Human
aaagugcugggauuacaggcguga

SEQ ID NO: 924299 - RNA, 20 nt, Human
aaccuccgucuccugugcuc

SEQ ID NO: 924300 - RNA, 19 nt, Human
aagugcugggauuacaggc

SEQ ID NO: 924301 - RNA, 19 nt, Human
aagugcugggauuacaggc

SEQ ID NO: 924302 - RNA, 24 nt, Human
accauguugcccaggcuggucucg

SEQ ID NO: 924303 - RNA, 25 nt, Human
accauguugcccaggcuggucucga

SEQ ID NO: 924304 - RNA, 20 nt, Human
acccaccucugccucccaaa

SEQ ID NO: 924305 - RNA, 24 nt, Human
accuccaagagcgccaccgcggag

SEQ ID NO: 924306 - RNA, 20 nt, Human
aggcaugugccaccaccccc

SEQ ID NO: 924307 - RNA, 18 nt, Human
agugcugggauuacaggc

SEQ ID NO: 924308 - RNA, 23 nt, Human
aguggcuggaaccacaggcaugu

SEQ ID NO: 924309 - RNA, 19 nt, Human
augugccaccacccccagc

SEQ ID NO: 924310 - RNA, 24 nt, Human
auuucaccauguugcccaggcugg

SEQ ID NO: 924311 - RNA, 24 nt, Human
auuuuuguauuuuuuugguagaga

SEQ ID NO: 924312 - RNA, 26 nt, Human
auuuuuguauuuuuuugguagagaca

SEQ ID NO: 924313 - RNA, 24 nt, Human
caaagugcugggauuacaggcgug

SEQ ID NO: 924314 - RNA, 24 nt, Human
caccacccccagcugauuuuugua

SEQ ID NO: 924315 - RNA, 24 nt, Human
caccauguugcccaggcuggucuc

SEQ ID NO: 924316 - RNA, 27 nt, Human
caccauguugcccaggcuggucucgaa

SEQ ID NO: 924317 - RNA, 22 nt, Human
cacccaccucugccucccaaag

SEQ ID NO: 924318 - RNA, 23 nt, Human
cacccaccucugccucccaaagu

SEQ ID NO: 924319 - RNA, 22 nt, Human
cacccagguugaaaagcagugg

SEQ ID NO: 924320 - RNA, 25 nt, Human
cacccagguugaaaagcaguggggc

SEQ ID NO: 924321 - RNA, 24 nt, Human
caccucgaccuccugaguggcugg

SEQ ID NO: 924322 - RNA, 24 nt, Human
caccucugccucccaaagugcugg

SEQ ID NO: 924323 - RNA, 24 nt, Human
caggauuucaccauguugcccagg

SEQ ID NO: 924324 - RNA, 18 nt, Human
caucccgccaccucgacc

SEQ ID NO: 924325 - RNA, 20 nt, Human
caucccgccaccucgaccuc

SEQ ID NO: 924326 - RNA, 21 nt, Human
cauguugcccaggcuggucuc

SEQ ID NO: 924327 - RNA, 23 nt, Human
cauguugcccaggcuggucucga

SEQ ID NO: 924328 - RNA, 24 nt, Human
cauguugcccaggcuggucucgaa

SEQ ID NO: 924329 - RNA, 22 nt, Human
ccaaagugcugggauuacaggc

SEQ ID NO: 924330 - RNA, 22 nt, Human
ccaaagugcugggauuacaggc

SEQ ID NO: 924331 - RNA, 24 nt, Human
ccaaagugcugggauuacaggcgu

SEQ ID NO: 924332 - RNA, 22 nt, Human
cccgccaccucgaccuccugag

SEQ ID NO: 924333 - RNA, 24 nt, Human
ccuggacuugagugauccacccac

SEQ ID NO: 924334 - RNA, 27 nt, Human
ccuggacuugagugauccacccaccuc

SEQ ID NO: 924335 - RNA, 18 nt, Human
cgggcgggcccugagggc

SEQ ID NO: 924336 - RNA, 24 nt, Human
cuccugaguggcuggaaccacagg

SEQ ID NO: 924337 - RNA, 23 nt, Human
gacuugagugauccacccaccuc

SEQ ID NO: 924338 - RNA, 21 nt, Human
gagcgccaccgcggagcgggc

SEQ ID NO: 924339 - RNA, 18 nt, Human
gauuacaggcgugaguca

SEQ ID NO: 924340 - RNA, 21 nt, Human
gauuacaggcgugagucauug

SEQ ID NO: 924341 - RNA, 24 nt, Human
gauuacaggcgugagucauugugc

SEQ ID NO: 924342 - RNA, 21 nt, Human
gcaguggggcgaucucagcuc

SEQ ID NO: 924343 - RNA, 21 nt, Human
ggcgaucucagcucacagcaa

SEQ ID NO: 924344 - RNA, 21 nt, Human
gggcgggcggggccgcggggc

SEQ ID NO: 924345 - RNA, 21 nt, Human
gguagagacaggauuucacca

SEQ ID NO: 924346 - RNA, 21 nt, Human
guagagacaggauuucaccau

SEQ ID NO: 924347 - RNA, 22 nt, Human
guagagacaggauuucaccaug

SEQ ID NO: 924348 - RNA, 24 nt, Human
gugauccacccaccucugccuccc

SEQ ID NO: 924349 - RNA, 18 nt, Human
guuuugagacagggucug

SEQ ID NO: 924350 - RNA, 22 nt, Human
uagagacaggauuucaccaugu

SEQ ID NO: 924351 - RNA, 22 nt, Human
ucacagcaaccuccgucuccug

SEQ ID NO: 924352 - RNA, 23 nt, Human
ucacagcaaccuccgucuccugu

SEQ ID NO: 924353 - RNA, 24 nt, Human
ucccaaagugcugggauuacaggc

SEQ ID NO: 924354 - RNA, 18 nt, Human
uccgacaccaccuccaag

SEQ ID NO: 924355 - RNA, 19 nt, Human
uccgacaccaccuccaaga

SEQ ID NO: 924356 - RNA, 24 nt, Human
uccugaguggcuggaaccacaggc

SEQ ID NO: 924357 - RNA, 26 nt, Human
ucuccgacaccaccuccaagagcgcc

SEQ ID NO: 924358 - RNA, 23 nt, Human
ucucgaacuccuggacuugagug

SEQ ID NO: 924359 - RNA, 19 nt, Human
ucugguucugucacccagg

SEQ ID NO: 924360 - RNA, 24 nt, Human
ucugguucugucacccagguugaa

SEQ ID NO: 924361 - RNA, 18 nt, Human
ucugucacccagguugaa

SEQ ID NO: 924362 - RNA, 24 nt, Human
ucugucacccagguugaaaagcag

SEQ ID NO: 924363 - RNA, 22 nt, Human
ugagacagggucugguucuguc

SEQ ID NO: 924364 - RNA, 24 nt, Human
ugagggcugagccaggcuuaagag

SEQ ID NO: 924365 - RNA, 24 nt, Human
ugagugauccacccaccucugccu

SEQ ID NO: 924366 - RNA, 24 nt, Human
ugauccacccaccucugccuccca

SEQ ID NO: 924367 - RNA, 23 nt, Human
ugccaccacccccagcugauuuu

SEQ ID NO: 924368 - RNA, 24 nt, Human
ugcccaggcuggucucgaacuccu

SEQ ID NO: 924369 - RNA, 24 nt, Human
ugcugggauuacaggcgugaguca

SEQ ID NO: 924370 - RNA, 21 nt, Human
uggaaccacaggcaugugcca

SEQ ID NO: 924371 - RNA, 24 nt, Human
uggaaccacaggcaugugccacca

SEQ ID NO: 924372 - RNA, 22 nt, Human
uggacuugagugauccacccac

SEQ ID NO: 924373 - RNA, 18 nt, Human
ugggauuacaggcgugag

SEQ ID NO: 924374 - RNA, 21 nt, Human
ugggauuacaggcgugaguca

SEQ ID NO: 924375 - RNA, 21 nt, Human
ugggauuacaggcgugaguca

SEQ ID NO: 924376 - RNA, 21 nt, Human
ugggauuacaggcgugaguca

SEQ ID NO: 924377 - RNA, 22 nt, Human
ugggauuacaggcgugagucau

SEQ ID NO: 924378 - RNA, 24 nt, Human
ugggauuacaggcgugagucauug

SEQ ID NO: 924379 - RNA, 26 nt, Human
ugggauuacaggcgugagucauugac

SEQ ID NO: 924380 - RNA, 21 nt, Human
ugguagagacaggauuucacc

SEQ ID NO: 924381 - RNA, 24 nt, Human
ugguagagacaggauuucaccaug

SEQ ID NO: 924382 - RNA, 25 nt, Human
uugagacagggucugguucugucac

SEQ ID NO: 924383 - RNA, 24 nt, Human
uugguagagacaggauuucaccau

SEQ ID NO: 924384 - RNA, 23 nt, Human
uuucaccauguugcccaggcugg

SEQ ID NO: 924385 - RNA, 24 nt, Human
uuucaccauguugcccaggcuggu

SEQ ID NO: 924386 - RNA, 22 nt, Human
uuuuuguauuuuuuugguagag

SEQ ID NO: 924387 - RNA, 20 nt, Human
uuuuuuugguagagacaggg

SEQ ID NO: 924388 - RNA, 20 nt, Human
aaaaaauccagaagugagga

SEQ ID NO: 924389 - RNA, 19 nt, Human
aaaaauccagaagugagga

SEQ ID NO: 924390 - RNA, 19 nt, Human
aaaagaaaaaagaaaauga

SEQ ID NO: 924391 - RNA, 20 nt, Human
aaacaaaucccaaacauccc

SEQ ID NO: 924392 - RNA, 21 nt, Human
aaacaaaucccaaacaucccu

SEQ ID NO: 924393 - RNA, 19 nt, Human
aaacagaaggaaaauauga

SEQ ID NO: 924394 - RNA, 21 nt, Human
aaacagaaggaaaauaugacu

SEQ ID NO: 924395 - RNA, 20 nt, Human
aaccugcgguggcacuccuu

SEQ ID NO: 924396 - RNA, 20 nt, Human
aagucaaccuuacauugcaa

SEQ ID NO: 924397 - RNA, 24 nt, Human
aauccugcuucucucucagcuuca

SEQ ID NO: 924398 - RNA, 23 nt, Human
acacgggucacagcaccuuuuau

SEQ ID NO: 924399 - RNA, 20 nt, Human
acccggaggagccccugggg

SEQ ID NO: 924400 - RNA, 23 nt, Human
accgagcucuaaaagaaaaaaga

SEQ ID NO: 924401 - RNA, 22 nt, Human
accgugaugaccucgaagguug

SEQ ID NO: 924402 - RNA, 23 nt, Human
acgccgccucuaguggggaagcc

SEQ ID NO: 924403 - RNA, 22 nt, Human
acgccggacccuccagcgcagu

SEQ ID NO: 924404 - RNA, 23 nt, Human
acucacaccaguggauggcacuc

SEQ ID NO: 924405 - RNA, 19 nt, Human
acuccucacacacagccgc

SEQ ID NO: 924406 - RNA, 18 nt, Human
aggucugccuuccacgcc

SEQ ID NO: 924407 - RNA, 21 nt, Human
aggugcggcucagcacgccuc

SEQ ID NO: 924408 - RNA, 20 nt, Human
aucauacaaccugaugugac

SEQ ID NO: 924409 - RNA, 19 nt, Human
caaaacgaauucuccacug

SEQ ID NO: 924410 - RNA, 22 nt, Human
caaaacgaauucuccacugaga

SEQ ID NO: 924411 - RNA, 24 nt, Human
caauggcuggaucuaaugucuucc

SEQ ID NO: 924412 - RNA, 20 nt, Human
cacacagccgcgcgacccuc

SEQ ID NO: 924413 - RNA, 22 nt, Human
cacggagccacggguccaaaac

SEQ ID NO: 924414 - RNA, 22 nt, Human
cagcugcacggagccacggguc

SEQ ID NO: 924415 - RNA, 26 nt, Human
cauaaaacuaaaacacaauauuggcc

SEQ ID NO: 924416 - RNA, 22 nt, Human
caucccucugcaguucuugccc

SEQ ID NO: 924417 - RNA, 21 nt, Human
cauguuaacauaaaacuaaaa

SEQ ID NO: 924418 - RNA, 24 nt, Human
ccagaauggauacauuuucuacug

SEQ ID NO: 924419 - RNA, 21 nt, Human
ccagcgcagucccaugccgga

SEQ ID NO: 924420 - RNA, 22 nt, Human
ccaugccggacacagcgaggcg

SEQ ID NO: 924421 - RNA, 21 nt, Human
cccaaacaucccucugcaguu

SEQ ID NO: 924422 - RNA, 21 nt, Human
cccaugccggacacagcgagg

SEQ ID NO: 924423 - RNA, 23 nt, Human
ccccggcccaggacuuacugccu

SEQ ID NO: 924424 - RNA, 24 nt, Human
cccugggggcagcagggaggcuca

SEQ ID NO: 924425 - RNA, 18 nt, Human
ccucaugguuucagccca

SEQ ID NO: 924426 - RNA, 22 nt, Human
ccuccccgcaagacucacacca

SEQ ID NO: 924427 - RNA, 22 nt, Human
ccugccagaggucccuucuaga

SEQ ID NO: 924428 - RNA, 23 nt, Human
cgagcucuaaaagaaaaaagaaa

SEQ ID NO: 924429 - RNA, 20 nt, Human
cgaguccacagcugcacgga

SEQ ID NO: 924430 - RNA, 23 nt, Human
cgcgaaccugcgguggcacuccu

SEQ ID NO: 924431 - RNA, 18 nt, Human
cuaaacaaaucccaaaca

SEQ ID NO: 924432 - RNA, 24 nt, Human
cuccuugcacucguacuccuugau

SEQ ID NO: 924433 - RNA, 20 nt, Human
cugccaccugugaauacugu

SEQ ID NO: 924434 - RNA, 23 nt, Human
cugccaccugugaauacugucug

SEQ ID NO: 924435 - RNA, 19 nt, Human
cugcugccugcugccaccu

SEQ ID NO: 924436 - RNA, 21 nt, Human
cugcuucucucucagcuucac

SEQ ID NO: 924437 - RNA, 20 nt, Human
cuuggcacagaacguuuucc

SEQ ID NO: 924438 - RNA, 23 nt, Human
cuuuaugaauacaucugugcacc

SEQ ID NO: 924439 - RNA, 24 nt, Human
gcagaugcggccccggcccaggac

SEQ ID NO: 924440 - RNA, 21 nt, Human
ggaauugaaguuuaaacagaa

SEQ ID NO: 924441 - RNA, 20 nt, Human
ggggaagccaugagccuucc

SEQ ID NO: 924442 - RNA, 22 nt, Human
guacaggaggucugccuuccac

SEQ ID NO: 924443 - RNA, 24 nt, Human
guggauggcacucgaguccacagc

SEQ ID NO: 924444 - RNA, 22 nt, Human
uaaaaaaaaaaaaggaaaaaaa

SEQ ID NO: 924445 - RNA, 19 nt, Human
uaaaacucuggccugccag

SEQ ID NO: 924446 - RNA, 21 nt, Human
uaacauaaaacuaaaacacaa

SEQ ID NO: 924447 - RNA, 22 nt, Human
uaaggggaggcagaugcggccc

SEQ ID NO: 924448 - RNA, 21 nt, Human
uaagucaaccuuacauugcaa

SEQ ID NO: 924449 - RNA, 20 nt, Human
uccacagagccugguggcca

SEQ ID NO: 924450 - RNA, 26 nt, Human
uccagcaaacacaucuaaacaaaucc

SEQ ID NO: 924451 - RNA, 18 nt, Human
ucccugcugccugcugcc

SEQ ID NO: 924452 - RNA, 22 nt, Human
ucugcgcgaaccugcgguggca

SEQ ID NO: 924453 - RNA, 19 nt, Human
ugaccucgaagguugcagg

SEQ ID NO: 924454 - RNA, 24 nt, Human
ugcacggagccacggguccaaaac

SEQ ID NO: 924455 - RNA, 25 nt, Human
ugccccgagucucccggaacgcagc

SEQ ID NO: 924456 - RNA, 18 nt, Human
uggaaaucgauucaugga

SEQ ID NO: 924457 - RNA, 21 nt, Human
uggagauacucugcaaagcua

SEQ ID NO: 924458 - RNA, 22 nt, Human
uggagccccauccaguuuaaaa

SEQ ID NO: 924459 - RNA, 26 nt, Human
uggagccccauccaguuuaaaacucu

SEQ ID NO: 924460 - RNA, 18 nt, Human
uggaugccacaaauggga

SEQ ID NO: 924461 - RNA, 21 nt, Human
uggccauaacagucuugaaca

SEQ ID NO: 924462 - RNA, 19 nt, Human
ugggggcagcagggaggcu

SEQ ID NO: 924463 - RNA, 22 nt, Human
uuggcacagaacguuuuccugu

SEQ ID NO: 924464 - RNA, 27 nt, Human
uuucccgaacccugugucgggcgaaca

SEQ ID NO: 924465 - RNA, 19 nt, Human
uuuggaugccacaaauggg

SEQ ID NO: 924466 - RNA, 19 nt, Human
aagaaagagagccaugacu

SEQ ID NO: 924467 - RNA, 23 nt, Human
agagggauggccaagaaagagag

SEQ ID NO: 924468 - RNA, 19 nt, Human
aguauauuauaaacuucau

SEQ ID NO: 924469 - RNA, 18 nt, Human
cacuuuuggcuacuucug

SEQ ID NO: 924470 - RNA, 24 nt, Human
caguaagucacuuuuggcuacuuc

SEQ ID NO: 924471 - RNA, 23 nt, Human
gagagccaugacuccuuucucca

SEQ ID NO: 924472 - RNA, 18 nt, Human
gcacaucgaaauuugggg

SEQ ID NO: 924473 - RNA, 24 nt, Human
gccaagaaagagagccaugacucc

SEQ ID NO: 924474 - RNA, 22 nt, Human
gccaugacuccuuucuccauuu

SEQ ID NO: 924475 - RNA, 22 nt, Human
uaggagcccuucugaauaguuu

SEQ ID NO: 924476 - RNA, 21 nt, Human
uauaaacuucauuacagaggg

SEQ ID NO: 924477 - RNA, 26 nt, Human
ugacuccuuucuccauuuuuauaaga

SEQ ID NO: 924478 - RNA, 24 nt, Human
ugcaucuacagacucuaaauguag

SEQ ID NO: 924479 - RNA, 25 nt, Human
ugcaucuacagacucuaaauguagg

SEQ ID NO: 924480 - RNA, 22 nt, Human
uuaggagcccuucugaauaguu

SEQ ID NO: 924481 - RNA, 22 nt, Human
uugcaaggcuauggaguuguau

SEQ ID NO: 924482 - RNA, 23 nt, Human
uuuuuuccauuuauaccauuucu

SEQ ID NO: 924483 - RNA, 27 nt, Human
uuuuuugguugcauaugcaucuacaga

SEQ ID NO: 924484 - RNA, 19 nt, Human
uuuuuuuuuuuaaaaaggc

SEQ ID NO: 924485 - RNA, 20 nt, Human
aaaacacaaaaaauggaggg

SEQ ID NO: 924486 - RNA, 21 nt, Human
aacaggaggcaaaacacaaaa

SEQ ID NO: 924487 - RNA, 18 nt, Human
aauacacccuugaaaccc

SEQ ID NO: 924488 - RNA, 20 nt, Human
acacucacacagauacguac

SEQ ID NO: 924489 - RNA, 20 nt, Human
acauuauuuagccccaaucc

SEQ ID NO: 924490 - RNA, 33 nt, Human
acccccacacucacacagauacguacacagaag

SEQ ID NO: 924491 - RNA, 23 nt, Human
acgugagagggucgugaucgauu

SEQ ID NO: 924492 - RNA, 19 nt, Human
agaaagagcguggcacuca

SEQ ID NO: 924493 - RNA, 22 nt, Human
agaaggaagcgguuuauucggc

SEQ ID NO: 924494 - RNA, 26 nt, Human
agcaagcaggggguaggugacagggg

SEQ ID NO: 924495 - RNA, 24 nt, Human
aggagacagggggagccaaggggg

SEQ ID NO: 924496 - RNA, 27 nt, Human
aggcaaaacacaaaaaaagccuuucgg

SEQ ID NO: 924497 - RNA, 24 nt, Human
aggcaaaacacaaaaaauggaggg

SEQ ID NO: 924498 - RNA, 23 nt, Human
agugagggaagcagggauuagga

SEQ ID NO: 924499 - RNA, 22 nt, Human
aguuuugcuucuuuuuccuuuu

SEQ ID NO: 924500 - RNA, 20 nt, Human
auuccugucccuuuuaaggg

SEQ ID NO: 924501 - RNA, 21 nt, Human
caaaacacaaaaaauggaggg

SEQ ID NO: 924502 - RNA, 20 nt, Human
caacucuaaggggguccacg

SEQ ID NO: 924503 - RNA, 21 nt, Human
cacaaucuggaagugagggaa

SEQ ID NO: 924504 - RNA, 23 nt, Human
cacacccaugcaugcaggcuuaa

SEQ ID NO: 924505 - RNA, 21 nt, Human
cacagagggcacauaccccca

SEQ ID NO: 924506 - RNA, 22 nt, Human
cacccuugaaacccccacacuc

SEQ ID NO: 924507 - RNA, 21 nt, Human
caggaggcaaaacacaaaaaa

SEQ ID NO: 924508 - RNA, 23 nt, Human
caguaugagagggucugucucuc

SEQ ID NO: 924509 - RNA, 18 nt, Human
cauauauacacacaugcg

SEQ ID NO: 924510 - RNA, 23 nt, Human
caugcaggcuuaacacacauagc

SEQ ID NO: 924511 - RNA, 19 nt, Human
ccaggcuaccugccuuuag

SEQ ID NO: 924512 - RNA, 19 nt, Human
cccaggagaccagggagcu

SEQ ID NO: 924513 - RNA, 22 nt, Human
ccccaauccuguacuuuaauuc

SEQ ID NO: 924514 - RNA, 23 nt, Human
ccccacacccaugcaugcaggcu

SEQ ID NO: 924515 - RNA, 25 nt, Human
cccccacacccaugcaugcaggcuu

SEQ ID NO: 924516 - RNA, 24 nt, Human
cccuucuggacucuuccuuccuuc

SEQ ID NO: 924517 - RNA, 18 nt, Human
ccuugguuucaggucugg

SEQ ID NO: 924518 - RNA, 19 nt, Human
cggcccaggccugguuucg

SEQ ID NO: 924519 - RNA, 19 nt, Human
cucaagagccgagcucccc

SEQ ID NO: 924520 - RNA, 22 nt, Human
cucaagagccgagcuccccgag

SEQ ID NO: 924521 - RNA, 23 nt, Human
cucacaacucuaaggggguccac

SEQ ID NO: 924522 - RNA, 18 nt, Human
cucagaguauucaauuuc

SEQ ID NO: 924523 - RNA, 22 nt, Human
cuccaauaauuaaaccagaugg

SEQ ID NO: 924524 - RNA, 21 nt, Human
cugaagccaccucagagcugg

SEQ ID NO: 924525 - RNA, 23 nt, Human
cuucccaggagaccagggagcuc

SEQ ID NO: 924526 - RNA, 18 nt, Human
gacucuguaaaacccuac

SEQ ID NO: 924527 - RNA, 24 nt, Human
gagagggucugucucucuucucuc

SEQ ID NO: 924528 - RNA, 21 nt, Human
gagccaagggggaguauggca

SEQ ID NO: 924529 - RNA, 22 nt, Human
gagcuccccgagugagcaauuc

SEQ ID NO: 924530 - RNA, 23 nt, Human
gagcuccccgagugagcaauucc

SEQ ID NO: 924531 - RNA, 19 nt, Human
gaguucucuguggcccuuc

SEQ ID NO: 924532 - RNA, 21 nt, Human
gauauaagagcuucagaaaga

SEQ ID NO: 924533 - RNA, 18 nt, Human
ggaaguuucacaaugucu

SEQ ID NO: 924534 - RNA, 21 nt, Human
gggcacauacccccacaccca

SEQ ID NO: 924535 - RNA, 21 nt, Human
ggggguaggugacaggggcug

SEQ ID NO: 924536 - RNA, 19 nt, Human
gguaggugacaggggcugc

SEQ ID NO: 924537 - RNA, 21 nt, Human
guggcccuucuggacucuucc

SEQ ID NO: 924538 - RNA, 22 nt, Human
guuuaauuaguuauuuccgauc

SEQ ID NO: 924539 - RNA, 23 nt, Human
guuucaggucugguuccuaggcg

SEQ ID NO: 924540 - RNA, 20 nt, Human
uaacacacauagcacacgug

SEQ ID NO: 924541 - RNA, 18 nt, Human
uaacuaccaggcuuaggu

SEQ ID NO: 924542 - RNA, 25 nt, Human
uaagggaagaaugagguacacacuu

SEQ ID NO: 924543 - RNA, 20 nt, Human
uaauucauucgaguaaggga

SEQ ID NO: 924544 - RNA, 18 nt, Human
uacacccuugaaaccccc

SEQ ID NO: 924545 - RNA, 24 nt, Human
uauauacacacaugcguguuccug

SEQ ID NO: 924546 - RNA, 20 nt, Human
uauggcagcagaggagaggg

SEQ ID NO: 924547 - RNA, 18 nt, Human
uaugucuuucugggguug

SEQ ID NO: 924548 - RNA, 23 nt, Human
ucacauuauuuagccccaauccu

SEQ ID NO: 924549 - RNA, 23 nt, Human
ucagaguggaacagaacagaaga

SEQ ID NO: 924550 - RNA, 21 nt, Human
uccccgagugagcaauuccug

SEQ ID NO: 924551 - RNA, 19 nt, Human
uccuaggcgccaggcuacc

SEQ ID NO: 924552 - RNA, 22 nt, Human
ucucuguggcccuucuggacuc

SEQ ID NO: 924553 - RNA, 22 nt, Human
ugagcaauuccugucccuuuua

SEQ ID NO: 924554 - RNA, 18 nt, Human
ugauaagggaagaaugag

SEQ ID NO: 924555 - RNA, 23 nt, Human
uggaacagaacagaccgggaagu

SEQ ID NO: 924556 - RNA, 20 nt, Human
uggaggggaucagugcggga

SEQ ID NO: 924557 - RNA, 21 nt, Human
uggcagcagaggagagggguc

SEQ ID NO: 924558 - RNA, 21 nt, Human
ugggaaucgauucuccaauaa

SEQ ID NO: 924559 - RNA, 21 nt, Human
uggucagaguggaacagaaca

SEQ ID NO: 924560 - RNA, 21 nt, Human
ugguuucgggucugguuccuu

SEQ ID NO: 924561 - RNA, 23 nt, Human
uguuuaauuaguuauuuccgauc

SEQ ID NO: 924562 - RNA, 18 nt, Human
uuccugucccuuuuaagg

SEQ ID NO: 924563 - RNA, 18 nt, Human
uucggccaggagcaucag

SEQ ID NO: 924564 - RNA, 19 nt, Human
uucucuguggcccuucugg

SEQ ID NO: 924565 - RNA, 22 nt, Human
uuucucuuccuggacuugggaa

SEQ ID NO: 924566 - RNA, 19 nt, Human
uuuuuuuuuuuuuuuuuaa

SEQ ID NO: 924567 - RNA, 19 nt, Human
aaagcuuuucacauccagc

SEQ ID NO: 924568 - RNA, 19 nt, Human
aaagggagaggggugcggu

SEQ ID NO: 924569 - RNA, 22 nt, Human
aaccagcgccaccgccggccuc

SEQ ID NO: 924570 - RNA, 18 nt, Human
aacggggcugcaacaccc

SEQ ID NO: 924571 - RNA, 22 nt, Human
aagagguguugguguugccgcc

SEQ ID NO: 924572 - RNA, 24 nt, Human
aagcuucccccaagaugggcuccg

SEQ ID NO: 924573 - RNA, 19 nt, Human
aggagcgccaacacuacca

SEQ ID NO: 924574 - RNA, 19 nt, Human
aggagcgccaacacuacca

SEQ ID NO: 924575 - RNA, 23 nt, Human
cacaccagauccuccuuggaggc

SEQ ID NO: 924576 - RNA, 20 nt, Human
cacauguaggaaacuguagu

SEQ ID NO: 924577 - RNA, 23 nt, Human
caccuccacgaaggcgcugcgcu

SEQ ID NO: 924578 - RNA, 22 nt, Human
cacuuuagcaaggcucuuugga

SEQ ID NO: 924579 - RNA, 26 nt, Human
cagcagcugaugcuaaugacuugagg

SEQ ID NO: 924580 - RNA, 20 nt, Human
cagcgggugguggaggaggg

SEQ ID NO: 924581 - RNA, 18 nt, Human
cccaggaggccaggggag

SEQ ID NO: 924582 - RNA, 25 nt, Human
ccccgugcguauuuccccggagucc

SEQ ID NO: 924583 - RNA, 22 nt, Human
ccccuccuccugcaggcuggcc

SEQ ID NO: 924584 - RNA, 19 nt, Human
ccgccgccgccgccagcgu

SEQ ID NO: 924585 - RNA, 18 nt, Human
ccgccggccuccgccgcc

SEQ ID NO: 924586 - RNA, 19 nt, Human
ccgccggccuccgccgccu

SEQ ID NO: 924587 - RNA, 21 nt, Human
ccggccuccgccgccuccucc

SEQ ID NO: 924588 - RNA, 25 nt, Human
ccuccugcaggcuggccgcgcgggc

SEQ ID NO: 924589 - RNA, 22 nt, Human
cgggagccucguuugugcgcua

SEQ ID NO: 924590 - RNA, 19 nt, Human
cuccuccugcaggcuggcc

SEQ ID NO: 924591 - RNA, 27 nt, Human
cugauuugcgcagcuagucgggcggcc

SEQ ID NO: 924592 - RNA, 21 nt, Human
cugcaaguugacuccuucaac

SEQ ID NO: 924593 - RNA, 24 nt, Human
cuggccgcgcgggcagccuucuuc

SEQ ID NO: 924594 - RNA, 26 nt, Human
cuuuccuuugccgccgcccguggcga

SEQ ID NO: 924595 - RNA, 22 nt, Human
gaauaggcaaggauuguaacau

SEQ ID NO: 924596 - RNA, 19 nt, Human
gaggcggccguucucuucc

SEQ ID NO: 924597 - RNA, 18 nt, Human
gagucugcuccacuucag

SEQ ID NO: 924598 - RNA, 22 nt, Human
gagucugcuccacuucaggacc

SEQ ID NO: 924599 - RNA, 19 nt, Human
gccgccgccccugacgauu

SEQ ID NO: 924600 - RNA, 25 nt, Human
gccgccgcccguggcgaugccgucg

SEQ ID NO: 924601 - RNA, 21 nt, Human
gccuggugacugcagucccag

SEQ ID NO: 924602 - RNA, 18 nt, Human
gcgcagcuaguugccugg

SEQ ID NO: 924603 - RNA, 21 nt, Human
gggaaucucgggcuucuuuuu

SEQ ID NO: 924604 - RNA, 22 nt, Human
gggauggaguugccgaggccgu

SEQ ID NO: 924605 - RNA, 20 nt, Human
gggcguggaggagccgccgc

SEQ ID NO: 924606 - RNA, 18 nt, Human
ggggauggaguugccgag

SEQ ID NO: 924607 - RNA, 25 nt, Human
gggugguggaggaggggauggaguu

SEQ ID NO: 924608 - RNA, 22 nt, Human
ggugguggaggaggggauggag

SEQ ID NO: 924609 - RNA, 25 nt, Human
guauagaaucucccaaauaaggcca

SEQ ID NO: 924610 - RNA, 24 nt, Human
gugguggaggaggggauggaguug

SEQ ID NO: 924611 - RNA, 22 nt, Human
uaaggccaccuggaaccgggaa

SEQ ID NO: 924612 - RNA, 23 nt, Human
uacaacgcggccccuaccaaacc

SEQ ID NO: 924613 - RNA, 23 nt, Human
uagaaucucccaaauaaggccac

SEQ ID NO: 924614 - RNA, 21 nt, Human
uagcaaggcucuuuggagucc

SEQ ID NO: 924615 - RNA, 22 nt, Human
uagcuccagggauucucuagcc

SEQ ID NO: 924616 - RNA, 21 nt, Human
uauagaaucucccaaauaagg

SEQ ID NO: 924617 - RNA, 26 nt, Human
uccaggccgaaguagcugcccgaggc

SEQ ID NO: 924618 - RNA, 24 nt, Human
ucccgcgccgucggcuguccccuc

SEQ ID NO: 924619 - RNA, 25 nt, Human
uccgggaauuuccucuuuccuuugg

SEQ ID NO: 924620 - RNA, 24 nt, Human
uccucaguuucccuucuguccuug

SEQ ID NO: 924621 - RNA, 23 nt, Human
ucgcuggggaaucucgggcuucu

SEQ ID NO: 924622 - RNA, 23 nt, Human
ucucuugaacuugcugagcgaaa

SEQ ID NO: 924623 - RNA, 21 nt, Human
ucuucaggagcgccaacacua

SEQ ID NO: 924624 - RNA, 19 nt, Human
ugacagagagcuggacacc

SEQ ID NO: 924625 - RNA, 22 nt, Human
ugacagagagcuggacacccag

SEQ ID NO: 924626 - RNA, 21 nt, Human
ugacugcagucccaggaggcc

SEQ ID NO: 924627 - RNA, 23 nt, Human
ugacugcagucccaggaggccag

SEQ ID NO: 924628 - RNA, 20 nt, Human
ugacuugaggucuuuaacag

SEQ ID NO: 924629 - RNA, 20 nt, Human
ugacuugccccuuuagugca

SEQ ID NO: 924630 - RNA, 20 nt, Human
ugaguugcgggucucuccuc

SEQ ID NO: 924631 - RNA, 23 nt, Human
ugauaaacgggcgucgucucucu

SEQ ID NO: 924632 - RNA, 24 nt, Human
ugcaaucgaguguuuccuuuugcc

SEQ ID NO: 924633 - RNA, 18 nt, Human
ugcacaccagauccuccu

SEQ ID NO: 924634 - RNA, 22 nt, Human
ugcaggcuggccgcgcgggcag

SEQ ID NO: 924635 - RNA, 21 nt, Human
ugcagucccaggaggccaggg

SEQ ID NO: 924636 - RNA, 21 nt, Human
ugccgaggccgucucgggagc

SEQ ID NO: 924637 - RNA, 21 nt, Human
ugcggugugcacaccagaucc

SEQ ID NO: 924638 - RNA, 21 nt, Human
uggaagagugggcuggagaga

SEQ ID NO: 924639 - RNA, 24 nt, Human
uggaagagugggcuggagagaggu

SEQ ID NO: 924640 - RNA, 23 nt, Human
uggagaagcugugacagagagcu

SEQ ID NO: 924641 - RNA, 21 nt, Human
uggagagggccuuuccccguu

SEQ ID NO: 924642 - RNA, 19 nt, Human
uggaggccgggaggggccg

SEQ ID NO: 924643 - RNA, 21 nt, Human
uggaggccgggaggggccguu

SEQ ID NO: 924644 - RNA, 22 nt, Human
ugggcuccggaaagcuuuucac

SEQ ID NO: 924645 - RNA, 22 nt, Human
ugugacagagagcuggacaccc

SEQ ID NO: 924646 - RNA, 20 nt, Human
uuagugcagcagcugaugcu

SEQ ID NO: 924647 - RNA, 21 nt, Human
uuaguuugauccucucccagc

SEQ ID NO: 924648 - RNA, 21 nt, Human
uucaccuccacgaaggcgcug

SEQ ID NO: 924649 - RNA, 24 nt, Human
uucgcuaaugaguugcgggucucu

SEQ ID NO: 924650 - RNA, 19 nt, Human
uugaggucuuuaacagccu

SEQ ID NO: 924651 - RNA, 25 nt, Human
uuggaagagugggcuggagagaggu

SEQ ID NO: 924652 - RNA, 18 nt, Human
aacacacccuugaaaccc

SEQ ID NO: 924653 - RNA, 21 nt, Human
aacacacccuugaaacccccc

SEQ ID NO: 924654 - RNA, 23 nt, Human
aacaggaggcaaaaaaacaaaca

SEQ ID NO: 924655 - RNA, 26 nt, Human
aacaggaggcaaaaaaacaaacaaaa

SEQ ID NO: 924656 - RNA, 23 nt, Human
agggcacauacccccacacccga

SEQ ID NO: 924657 - RNA, 23 nt, Human
cacauacccccacacccgaacac

SEQ ID NO: 924658 - RNA, 23 nt, Human
cacccuugaaaccccccacacuc

SEQ ID NO: 924659 - RNA, 21 nt, Human
cacggagggcacauaccccca

SEQ ID NO: 924660 - RNA, 27 nt, Human
cagggaacucccuuuccugcugcgacu

SEQ ID NO: 924661 - RNA, 19 nt, Human
cccacacccgaacacauau

SEQ ID NO: 924662 - RNA, 31 nt, Human
cccccacacucacacaguuaccuacacggaa

SEQ ID NO: 924663 - RNA, 23 nt, Human
ccccccacacucacacaguuacc

SEQ ID NO: 924664 - RNA, 25 nt, Human
cuaacacacccuugaaaccccccac

SEQ ID NO: 924665 - RNA, 22 nt, Human
cuccaauaauuaaaccagacgg

SEQ ID NO: 924666 - RNA, 22 nt, Human
cuggggguugaauuccugugga

SEQ ID NO: 924667 - RNA, 23 nt, Human
cuucccaggagaccagggaacuc

SEQ ID NO: 924668 - RNA, 23 nt, Human
cuuccgcugaagccaccucacag

SEQ ID NO: 924669 - RNA, 20 nt, Human
cuugccuucagugauaaggg

SEQ ID NO: 924670 - RNA, 22 nt, Human
gaaaccccccacacucacacag

SEQ ID NO: 924671 - RNA, 23 nt, Human
gaagaagccacacuucccagggg

SEQ ID NO: 924672 - RNA, 21 nt, Human
gacuuccgcugaagccaccuc

SEQ ID NO: 924673 - RNA, 19 nt, Human
gaguucucuguggcccuuc

SEQ ID NO: 924674 - RNA, 22 nt, Human
ggagaagaagccacacuuccca

SEQ ID NO: 924675 - RNA, 20 nt, Human
ggagaggagacuggggagcc

SEQ ID NO: 924676 - RNA, 21 nt, Human
gggaaagaaccacacaugcug

SEQ ID NO: 924677 - RNA, 22 nt, Human
guuuaaucaguuauuuccgauc

SEQ ID NO: 924678 - RNA, 24 nt, Human
uaacacacccuugaaaccccccac

SEQ ID NO: 924679 - RNA, 25 nt, Human
uaagggaagaaugagguacacacuu

SEQ ID NO: 924680 - RNA, 24 nt, Human
uacacacacgcguguucuugucug

SEQ ID NO: 924681 - RNA, 24 nt, Human
uauauacacacacgcguguucuug

SEQ ID NO: 924682 - RNA, 23 nt, Human
uauggcagcagaggagagguguc

SEQ ID NO: 924683 - RNA, 19 nt, Human
uaugucuuucuggggguug

SEQ ID NO: 924684 - RNA, 22 nt, Human
ucccuuguucuuccucaucucu

SEQ ID NO: 924685 - RNA, 18 nt, Human
uccuaacacacccuugaa

SEQ ID NO: 924686 - RNA, 22 nt, Human
uccuuaggauuuugagcguugu

SEQ ID NO: 924687 - RNA, 22 nt, Human
ucucuguggcccuucuggacuc

SEQ ID NO: 924688 - RNA, 24 nt, Human
ucuguggcccuucuggacucuucu

SEQ ID NO: 924689 - RNA, 21 nt, Human
ugagcguuguuccuaacacac

SEQ ID NO: 924690 - RNA, 18 nt, Human
ugauaagggaagaaugag

SEQ ID NO: 924691 - RNA, 20 nt, Human
uggaggggaucagugcggga

SEQ ID NO: 924692 - RNA, 21 nt, Human
ugggaaucgauucuccaauaa

SEQ ID NO: 924693 - RNA, 23 nt, Human
ugggcuacagagauuggaggaga

SEQ ID NO: 924694 - RNA, 23 nt, Human
uguuuaaucaguuauuuccgauc

SEQ ID NO: 924695 - RNA, 22 nt, Human
uuacauuucucuuccuggacuu

SEQ ID NO: 924696 - RNA, 22 nt, Human
uuccuguggagucuugagcuga

SEQ ID NO: 924697 - RNA, 19 nt, Human
uucucuguggcccuucugg

SEQ ID NO: 924698 - RNA, 21 nt, Human
uuggaggagaucaggagagga

SEQ ID NO: 924699 - RNA, 21 nt, Human
uuggaggagaucaggagagga

SEQ ID NO: 924700 - RNA, 22 nt, Human
uuucucuuccuggacuugggaa

SEQ ID NO: 924701 - RNA, 19 nt, Human
uuucuggggguugaauucc

SEQ ID NO: 924702 - RNA, 24 nt, Human
uuuguuuaaucaguuauuuccgau

SEQ ID NO: 924703 - RNA, 20 nt, Human
uuuugagcguuguuccuaac

SEQ ID NO: 924704 - RNA, 20 nt, Human
aagucgcagaaacuaaccac

SEQ ID NO: 924705 - RNA, 19 nt, Human
aaguuuaauacaaacuaca

SEQ ID NO: 924706 - RNA, 22 nt, Human
accgcagccuggcacuaaaaca

SEQ ID NO: 924707 - RNA, 19 nt, Human
aggaaaggccugccuugua

SEQ ID NO: 924708 - RNA, 20 nt, Human
aggcuggucucuccaccccc

SEQ ID NO: 924709 - RNA, 25 nt, Human
caaaccaguagccugcccacaacgc

SEQ ID NO: 924710 - RNA, 24 nt, Human
caagucgcagaaacuaaccaccga

SEQ ID NO: 924711 - RNA, 21 nt, Human
ccaccgcagccuggcacuaaa

SEQ ID NO: 924712 - RNA, 21 nt, Human
cccccuguaggaaaggccugc

SEQ ID NO: 924713 - RNA, 21 nt, Human
ccccuguaggaaaggccugcc

SEQ ID NO: 924714 - RNA, 20 nt, Human
gaaaaaaaaaauacagaaga

SEQ ID NO: 924715 - RNA, 18 nt, Human
gaagaaaggcuggucucu

SEQ ID NO: 924716 - RNA, 18 nt, Human
uaaccaccgacaccaggc

SEQ ID NO: 924717 - RNA, 18 nt, Human
uaagacaccacaauucgg

SEQ ID NO: 924718 - RNA, 23 nt, Human
ucucauggcugcccaccgcagcc

SEQ ID NO: 924719 - RNA, 18 nt, Human
ucuuguguuuuacuaaug

SEQ ID NO: 924720 - RNA, 23 nt, Human
uggaaaaaaaaaauacagaagag

SEQ ID NO: 924721 - RNA, 19 nt, Human
uucaaguuuaauacaaacu

SEQ ID NO: 924722 - RNA, 24 nt, Human
uuccuaucagcagucccaacacaa

SEQ ID NO: 924723 - RNA, 21 nt, Human
uugcucuacuaauacaucaua

SEQ ID NO: 924724 - RNA, 21 nt, Human
agcccugggccgcgaagccuu

SEQ ID NO: 924725 - RNA, 21 nt, Human
aggccugugugcggcugggug

SEQ ID NO: 924726 - RNA, 20 nt, Human
cagcacaggcaccuaggcag

SEQ ID NO: 924727 - RNA, 19 nt, Human
cagcauagggcacccaggu

SEQ ID NO: 924728 - RNA, 23 nt, Human
cgcacggacgaucacacgcgugg

SEQ ID NO: 924729 - RNA, 22 nt, Human
cuccagggucccauacugugga

SEQ ID NO: 924730 - RNA, 18 nt, Human
gcccugggccgcgaagcc

SEQ ID NO: 924731 - RNA, 21 nt, Human
gggcacagguggacacccagc

SEQ ID NO: 924732 - RNA, 23 nt, Human
uagcccuccagggucccauacug

SEQ ID NO: 924733 - RNA, 23 nt, Human
uauucagcuucuagguggaggca

SEQ ID NO: 924734 - RNA, 22 nt, Human
uggacccgcguucucagcgcca

SEQ ID NO: 924735 - RNA, 22 nt, Human
uggaguuuggaggggcaggucu

SEQ ID NO: 924736 - RNA, 24 nt, Human
uggaguuuggaggggcaggucugg

SEQ ID NO: 924737 - RNA, 21 nt, Human
uucuagguggaggcaugagaa

SEQ ID NO: 924738 - RNA, 24 nt, Human
agcgcagaaacacgucccuuggcg

SEQ ID NO: 924739 - RNA, 22 nt, Human
cgagcgcagaaacacgucccuu

SEQ ID NO: 924740 - RNA, 21 nt, Human
aaaacacuuuuaucucaauug

SEQ ID NO: 924741 - RNA, 23 nt, Human
aaacaaagauaagcaagagccua

SEQ ID NO: 924742 - RNA, 26 nt, Human
aacccagcauacaaaaaccuauacua

SEQ ID NO: 924743 - RNA, 19 nt, Human
aagagucaaacuauuuuaa

SEQ ID NO: 924744 - RNA, 25 nt, Human
aagcaacagaaauccauugugagac

SEQ ID NO: 924745 - RNA, 20 nt, Human
aaguagaacaauuuugcaaa

SEQ ID NO: 924746 - RNA, 21 nt, Human
acaaaaaccuauacuaaacaa

SEQ ID NO: 924747 - RNA, 22 nt, Human
acaaugaauuauaacaaagucc

SEQ ID NO: 924748 - RNA, 19 nt, Human
acccagcauacaaaaaccu

SEQ ID NO: 924749 - RNA, 18 nt, Human
acuuuauguagcacagua

SEQ ID NO: 924750 - RNA, 19 nt, Human
agaaaacauuucuaccucu

SEQ ID NO: 924751 - RNA, 24 nt, Human
agaacgguaaauccuuuccaagua

SEQ ID NO: 924752 - RNA, 23 nt, Human
agauggguuugucugaugaggau

SEQ ID NO: 924753 - RNA, 25 nt, Human
agggaaaugagaagggguggacagg

SEQ ID NO: 924754 - RNA, 23 nt, Human
agggaaggugaaaugaguaagaa

SEQ ID NO: 924755 - RNA, 21 nt, Human
auugcaaauaaucucacacgu

SEQ ID NO: 924756 - RNA, 23 nt, Human
caaagccaaaaagacuggcaagc

SEQ ID NO: 924757 - RNA, 28 nt, Human
cacuauacauacacacacucucaguaua

SEQ ID NO: 924758 - RNA, 25 nt, Human
caguauacuacuguuccccuuauua

SEQ ID NO: 924759 - RNA, 21 nt, Human
cauaaacuucgugggagaggg

SEQ ID NO: 924760 - RNA, 30 nt, Human
cauacaaaaaccuauacuaaacaaagaagg

SEQ ID NO: 924761 - RNA, 24 nt, Human
cauacacacacucucaguauacua

SEQ ID NO: 924762 - RNA, 31 nt, Human
cauacacuauacauacacacacucucaguag

SEQ ID NO: 924763 - RNA, 21 nt, Human
ccaaaaagacuggcaagcuug

SEQ ID NO: 924764 - RNA, 22 nt, Human
ccagcauacaaaaaccuauacu

SEQ ID NO: 924765 - RNA, 21 nt, Human
cuugugugaaaccucaagcuc

SEQ ID NO: 924766 - RNA, 20 nt, Human
gcuugugugaaaccucaagc

SEQ ID NO: 924767 - RNA, 21 nt, Human
gggaacaguaaugacuguagc

SEQ ID NO: 924768 - RNA, 19 nt, Human
guauuuagauauacacaua

SEQ ID NO: 924769 - RNA, 24 nt, Human
guccaaaaaaauguaugacuauuc

SEQ ID NO: 924770 - RNA, 18 nt, Human
uaaaaaaguuccucaugu

SEQ ID NO: 924771 - RNA, 27 nt, Human
uaaaaggcaaacccagcauacaaaaac

SEQ ID NO: 924772 - RNA, 24 nt, Human
uaagacaaaacuacguacuacaga

SEQ ID NO: 924773 - RNA, 23 nt, Human
uaagcaagagccuaugcaaauac

SEQ ID NO: 924774 - RNA, 18 nt, Human
uaagccaccacuaacuca

SEQ ID NO: 924775 - RNA, 18 nt, Human
uaagguuaagggaaauga

SEQ ID NO: 924776 - RNA, 19 nt, Human
uaagguuaagggaaaugag

SEQ ID NO: 924777 - RNA, 22 nt, Human
uauacacauaauuauauaugca

SEQ ID NO: 924778 - RNA, 24 nt, Human
uauauaugcauaucaaaaacuaua

SEQ ID NO: 924779 - RNA, 23 nt, Human
uaugaucaguacauuuuuccuau

SEQ ID NO: 924780 - RNA, 19 nt, Human
ucaagcaacagaaauccau

SEQ ID NO: 924781 - RNA, 21 nt, Human
ucaccaaaucucagucacuac

SEQ ID NO: 924782 - RNA, 22 nt, Human
ucagccagaucaccaaaucuca

SEQ ID NO: 924783 - RNA, 19 nt, Human
ucuagagagaacagcuaca

SEQ ID NO: 924784 - RNA, 19 nt, Human
ugaaaagaugguauaaauu

SEQ ID NO: 924785 - RNA, 25 nt, Human
ugaaaugaguaagaaaaaaaaauca

SEQ ID NO: 924786 - RNA, 19 nt, Human
ugacuauucaucaacaccc

SEQ ID NO: 924787 - RNA, 21 nt, Human
ugagaagggguggacagggca

SEQ ID NO: 924788 - RNA, 28 nt, Human
ugagaagggguggacagggcagguuucc

SEQ ID NO: 924789 - RNA, 18 nt, Human
ugagugccacacugguga

SEQ ID NO: 924790 - RNA, 19 nt, Human
ugcaaaacaaagauaagca

SEQ ID NO: 924791 - RNA, 19 nt, Human
ugcaaaacaaagauaagca

SEQ ID NO: 924792 - RNA, 22 nt, Human
ugcaaauaaucucacacgugca

SEQ ID NO: 924793 - RNA, 20 nt, Human
uggauacaugauugaugugg

SEQ ID NO: 924794 - RNA, 28 nt, Human
uguaaaauaaauacuaugguauuucuuc

SEQ ID NO: 924795 - RNA, 21 nt, Human
uuaguaaauggcuugugugaa

SEQ ID NO: 924796 - RNA, 19 nt, Human
uuucuaaguagaacaauuu

SEQ ID NO: 924797 - RNA, 23 nt, Human
aaagugcuggauuaugggcguga

SEQ ID NO: 924798 - RNA, 20 nt, Human
aagacagggucucgcucugu

SEQ ID NO: 924799 - RNA, 18 nt, Human
aagccccucuuggccacc

SEQ ID NO: 924800 - RNA, 18 nt, Human
aagccccucuuggccacc

SEQ ID NO: 924801 - RNA, 19 nt, Human
aaguagcugggauuacagg

SEQ ID NO: 924802 - RNA, 25 nt, Human
aaguagcugggauuacaggcgcccg

SEQ ID NO: 924803 - RNA, 24 nt, Human
aauuuuguauuuuuaguggagacg

SEQ ID NO: 924804 - RNA, 24 nt, Human
accauguuggccaggauggucucg

SEQ ID NO: 924805 - RNA, 19 nt, Human
acccaggcuggagugcagu

SEQ ID NO: 924806 - RNA, 22 nt, Human
accugaacuccacagacaccau

SEQ ID NO: 924807 - RNA, 18 nt, Human
acgggguuucaccauguu

SEQ ID NO: 924808 - RNA, 23 nt, Human
acgggguuucaccauguuggcca

SEQ ID NO: 924809 - RNA, 24 nt, Human
acgggguuucaccauguuggccag

SEQ ID NO: 924810 - RNA, 18 nt, Human
agacaccauccagaguga

SEQ ID NO: 924811 - RNA, 24 nt, Human
agcgauucuccugccucagccucc

SEQ ID NO: 924812 - RNA, 22 nt, Human
agcucacugcagccugcgccuc

SEQ ID NO: 924813 - RNA, 21 nt, Human
agcuugggcugaggucucugu

SEQ ID NO: 924814 - RNA, 19 nt, Human
aggacuggaggcggcagca

SEQ ID NO: 924815 - RNA, 24 nt, Human
aggaggcaggcuggcccaggcagg

SEQ ID NO: 924816 - RNA, 20 nt, Human
aggcaggcuggcccaggcag

SEQ ID NO: 924817 - RNA, 20 nt, Human
aggcgcccgccaccacgccc

SEQ ID NO: 924818 - RNA, 24 nt, Human
aggugaucugcccgccucggcuuc

SEQ ID NO: 924819 - RNA, 22 nt, Human
aguggagacgggguuucaccau

SEQ ID NO: 924820 - RNA, 26 nt, Human
augcugguuuuguuuuguuuuuuuuu

SEQ ID NO: 924821 - RNA, 23 nt, Human
caaagugcuggauuaugggcgug

SEQ ID NO: 924822 - RNA, 22 nt, Human
caagcgauucuccugccucagc

SEQ ID NO: 924823 - RNA, 27 nt, Human
caagcgauucuccugccucagccuccc

SEQ ID NO: 924824 - RNA, 20 nt, Human
cacaggguuuccuuccuggu

SEQ ID NO: 924825 - RNA, 23 nt, Human
cacaggguuuccuuccugguucu

SEQ ID NO: 924826 - RNA, 18 nt, Human
caccauguuggccaggau

SEQ ID NO: 924827 - RNA, 22 nt, Human
caccauguuggccaggaugguc

SEQ ID NO: 924828 - RNA, 24 nt, Human
caccauguuggccaggauggucuc

SEQ ID NO: 924829 - RNA, 20 nt, Human
caccccccaacccccgagcc

SEQ ID NO: 924830 - RNA, 20 nt, Human
caccccccaacccccgagcc

SEQ ID NO: 924831 - RNA, 24 nt, Human
caccccccaacccccgagcccacu

SEQ ID NO: 924832 - RNA, 21 nt, Human
caccuacugugugcccagccg

SEQ ID NO: 924833 - RNA, 21 nt, Human
cacugcgcagcccacaggaag

SEQ ID NO: 924834 - RNA, 19 nt, Human
cagcagccccugaaggaca

SEQ ID NO: 924835 - RNA, 19 nt, Human
cagcagggacagagccgca

SEQ ID NO: 924836 - RNA, 21 nt, Human
caggcgcccgccaccacgccc

SEQ ID NO: 924837 - RNA, 24 nt, Human
caggcggugauggugggagaaagg

SEQ ID NO: 924838 - RNA, 21 nt, Human
ccaaagugcuggauuaugggc

SEQ ID NO: 924839 - RNA, 23 nt, Human
ccaaagugcuggauuaugggcgu

SEQ ID NO: 924840 - RNA, 23 nt, Human
ccaacccccgagcccacugcgca

SEQ ID NO: 924841 - RNA, 22 nt, Human
ccaaguagcugggauuacaggc

SEQ ID NO: 924842 - RNA, 20 nt, Human
ccacaggaagagugcaggcu

SEQ ID NO: 924843 - RNA, 20 nt, Human
ccacaggguuuccuuccugg

SEQ ID NO: 924844 - RNA, 21 nt, Human
ccacaggguuuccuuccuggu

SEQ ID NO: 924845 - RNA, 19 nt, Human
ccaccacgcccggcaggau

SEQ ID NO: 924846 - RNA, 19 nt, Human
ccaguccuggcaccuugca

SEQ ID NO: 924847 - RNA, 23 nt, Human
cccaacccccgagcccacugcgc

SEQ ID NO: 924848 - RNA, 23 nt, Human
cccaaguagcugggauuacaggc

SEQ ID NO: 924849 - RNA, 24 nt, Human
cccaaguagcugggauuacaggcg

SEQ ID NO: 924850 - RNA, 21 nt, Human
ccccagaugcccaggaggagc

SEQ ID NO: 924851 - RNA, 18 nt, Human
cccccaacccccgagccc

SEQ ID NO: 924852 - RNA, 20 nt, Human
cccccaacccccgagcccac

SEQ ID NO: 924853 - RNA, 19 nt, Human
ccccccaacccccgagccc

SEQ ID NO: 924854 - RNA, 19 nt, Human
cccccgagcccacugcgca

SEQ ID NO: 924855 - RNA, 22 nt, Human
cccccgagcccacugcgcagcc

SEQ ID NO: 924856 - RNA, 22 nt, Human
ccccgagcccacugcgcagccc

SEQ ID NO: 924857 - RNA, 22 nt, Human
ccccugaaggacacaggcggug

SEQ ID NO: 924858 - RNA, 21 nt, Human
cccgccaccacgcccagcuaa

SEQ ID NO: 924859 - RNA, 18 nt, Human
cccggcaccccccaaccc

SEQ ID NO: 924860 - RNA, 23 nt, Human
cccggcaccccccaacccccgag

SEQ ID NO: 924861 - RNA, 22 nt, Human
cccuggcuuugggcugcccucc

SEQ ID NO: 924862 - RNA, 23 nt, Human
ccgagcaggcugccccgaacacu

SEQ ID NO: 924863 - RNA, 21 nt, Human
ccuccaaguccacccacuucc

SEQ ID NO: 924864 - RNA, 24 nt, Human
ccuccuggagucaagcgauucucc

SEQ ID NO: 924865 - RNA, 22 nt, Human
ccugaccucaggugaucugccc

SEQ ID NO: 924866 - RNA, 23 nt, Human
ccugccucagccucccaaguagc

SEQ ID NO: 924867 - RNA, 24 nt, Human
ccugccucagccucccaaguagcu

SEQ ID NO: 924868 - RNA, 20 nt, Human
ccuggagucaagcgauucuc

SEQ ID NO: 924869 - RNA, 23 nt, Human
ccuggagucaagcgauucuccug

SEQ ID NO: 924870 - RNA, 20 nt, Human
ccuggcaccuugcaggugga

SEQ ID NO: 924871 - RNA, 22 nt, Human
ccuguccccagaugcccaggag

SEQ ID NO: 924872 - RNA, 29 nt, Human
ccuugcacuggucccaaggaagccccucc

SEQ ID NO: 924873 - RNA, 18 nt, Human
ccuugccguuccuccucc

SEQ ID NO: 924874 - RNA, 19 nt, Human
ccuuguccugagcuugggc

SEQ ID NO: 924875 - RNA, 20 nt, Human
cgcagcccacaggaagagug

SEQ ID NO: 924876 - RNA, 22 nt, Human
cgccccggcaccccccaacccc

SEQ ID NO: 924877 - RNA, 25 nt, Human
cgccccggcaccccccaacccccga

SEQ ID NO: 924878 - RNA, 24 nt, Human
cgccucggcuucccaaagugcugg

SEQ ID NO: 924879 - RNA, 24 nt, Human
cgcucugucacccaggcuggagug

SEQ ID NO: 924880 - RNA, 18 nt, Human
cggcaccccccaaccccc

SEQ ID NO: 924881 - RNA, 23 nt, Human
cuaaagcaccuacugugugccca

SEQ ID NO: 924882 - RNA, 24 nt, Human
cuaauuuuguauuuuuaguggaga

SEQ ID NO: 924883 - RNA, 24 nt, Human
cucacugcagccugcgccuccugg

SEQ ID NO: 924884 - RNA, 25 nt, Human
cucacugcagccugcgccuccugga

SEQ ID NO: 924885 - RNA, 23 nt, Human
cucagccucccaaguagcuggga

SEQ ID NO: 924886 - RNA, 23 nt, Human
cuccaaguccacccacuuccugc

SEQ ID NO: 924887 - RNA, 20 nt, Human
cuccacagacaccauccaga

SEQ ID NO: 924888 - RNA, 26 nt, Human
cuccugaccucaggugaucugcccgc

SEQ ID NO: 924889 - RNA, 24 nt, Human
cucgcucugucacccaggcuggag

SEQ ID NO: 924890 - RNA, 19 nt, Human
cugaaggacacaggcggug

SEQ ID NO: 924891 - RNA, 24 nt, Human
cugauggcggagggugguggggag

SEQ ID NO: 924892 - RNA, 20 nt, Human
cugccccugagcacagcccu

SEQ ID NO: 924893 - RNA, 24 nt, Human
cuggauuaugggcgugagccacca

SEQ ID NO: 924894 - RNA, 19 nt, Human
gacagagccgcacugaagc

SEQ ID NO: 924895 - RNA, 24 nt, Human
gaccucaggugaucugcccgccuc

SEQ ID NO: 924896 - RNA, 24 nt, Human
gagacgggguuucaccauguuggc

SEQ ID NO: 924897 - RNA, 18 nt, Human
gauuacaggcgcccgcca

SEQ ID NO: 924898 - RNA, 18 nt, Human
gauuaugggcgugagcca

SEQ ID NO: 924899 - RNA, 21 nt, Human
gauuaugggcgugagccacca

SEQ ID NO: 924900 - RNA, 22 nt, Human
gauuaugggcgugagccaccac

SEQ ID NO: 924901 - RNA, 20 nt, Human
gcaggcugauggcggagggu

SEQ ID NO: 924902 - RNA, 19 nt, Human
gcccuggacuuucccuccc

SEQ ID NO: 924903 - RNA, 20 nt, Human
gcccuggacuuucccuccca

SEQ ID NO: 924904 - RNA, 24 nt, Human
gcgauucuccugccucagccuccc

SEQ ID NO: 924905 - RNA, 28 nt, Human
gcgcagcccacaggaagaggggaacgcc

SEQ ID NO: 924906 - RNA, 25 nt, Human
gcucugucacccaggcuggagugca

SEQ ID NO: 924907 - RNA, 20 nt, Human
gcuggagugcagugguacca

SEQ ID NO: 924908 - RNA, 21 nt, Human
ggagauccugaggccaggagg

SEQ ID NO: 924909 - RNA, 22 nt, Human
ggauuaugggcgugagccacca

SEQ ID NO: 924910 - RNA, 22 nt, Human
ggccccuggcuuugggcugccc

SEQ ID NO: 924911 - RNA, 18 nt, Human
ggcggcagcagggacaga

SEQ ID NO: 924912 - RNA, 19 nt, Human
ggcgugagccaccacgccc

SEQ ID NO: 924913 - RNA, 22 nt, Human
gggcagccuccacaggguuucc

SEQ ID NO: 924914 - RNA, 20 nt, Human
gggcggggugggccccuggc

SEQ ID NO: 924915 - RNA, 18 nt, Human
ggggcccuggacuuuccc

SEQ ID NO: 924916 - RNA, 22 nt, Human
ggggcggggugggccccuggcc

SEQ ID NO: 924917 - RNA, 18 nt, Human
gggggcccuggacuuucc

SEQ ID NO: 924918 - RNA, 23 nt, Human
gggguuucaccauguuggccagg

SEQ ID NO: 924919 - RNA, 18 nt, Human
gggugggguggggcgggg

SEQ ID NO: 924920 - RNA, 18 nt, Human
gggugggguggggugggg

SEQ ID NO: 924921 - RNA, 22 nt, Human
ggguuucaccauguuggccagg

SEQ ID NO: 924922 - RNA, 20 nt, Human
ggucucgaacuccugaccuc

SEQ ID NO: 924923 - RNA, 18 nt, Human
ggugguggggaggguggg

SEQ ID NO: 924924 - RNA, 22 nt, Human
ggugguggggaggguggggggg

SEQ ID NO: 924925 - RNA, 24 nt, Human
gguuucaccauguuggccaggaug

SEQ ID NO: 924926 - RNA, 21 nt, Human
guagaagguggggcaagcccc

SEQ ID NO: 924927 - RNA, 18 nt, Human
guagcugggauuacaggc

SEQ ID NO: 924928 - RNA, 24 nt, Human
gucucgcucugucacccaggcugg

SEQ ID NO: 924929 - RNA, 24 nt, Human
gugaucugcccgccucggcuuccc

SEQ ID NO: 924930 - RNA, 23 nt, Human
guggagacgggguuucaccaugu

SEQ ID NO: 924931 - RNA, 19 nt, Human
guggggcaagccccucccu

SEQ ID NO: 924932 - RNA, 21 nt, Human
gugguggggaggguggggggg

SEQ ID NO: 924933 - RNA, 22 nt, Human
uaagacagggucucgcucuguc

SEQ ID NO: 924934 - RNA, 24 nt, Human
uacaggcgcccgccaccacgccca

SEQ ID NO: 924935 - RNA, 24 nt, Human
uaguggagacgggguuucaccaug

SEQ ID NO: 924936 - RNA, 24 nt, Human
ucaccauguuggccaggauggucu

SEQ ID NO: 924937 - RNA, 24 nt, Human
ucacccaggcuggagugcaguggu

SEQ ID NO: 924938 - RNA, 23 nt, Human
ucacugcagccugcgccuccugg

SEQ ID NO: 924939 - RNA, 19 nt, Human
ucagagcucacugcagccu

SEQ ID NO: 924940 - RNA, 18 nt, Human
ucagccucccaaguagcu

SEQ ID NO: 924941 - RNA, 20 nt, Human
ucagccucccaaguagcugg

SEQ ID NO: 924942 - RNA, 20 nt, Human
ucaguccaggguggaagcau

SEQ ID NO: 924943 - RNA, 21 nt, Human
uccaaaggucaaagggcagcc

SEQ ID NO: 924944 - RNA, 23 nt, Human
ucccaaagugcuggauuaugggc

SEQ ID NO: 924945 - RNA, 24 nt, Human
ucccaaguagcugggauuacaggc

SEQ ID NO: 924946 - RNA, 21 nt, Human
ucccucccaguccuggcaccu

SEQ ID NO: 924947 - RNA, 19 nt, Human
ucgccccggcaccccccaa

SEQ ID NO: 924948 - RNA, 24 nt, Human
ucgcucugucacccaggcuggagu

SEQ ID NO: 924949 - RNA, 26 nt, Human
ucuccugccucagccucccaaguagc

SEQ ID NO: 924950 - RNA, 19 nt, Human
ucucgaacuccugaccuca

SEQ ID NO: 924951 - RNA, 19 nt, Human
ucucgcucugucacccagg

SEQ ID NO: 924952 - RNA, 23 nt, Human
ucucgcucugucacccaggcugg

SEQ ID NO: 924953 - RNA, 24 nt, Human
ucucgcucugucacccaggcugga

SEQ ID NO: 924954 - RNA, 26 nt, Human
ucucgcucugucacccaggcuggagu

SEQ ID NO: 924955 - RNA, 27 nt, Human
ucucgcucugucacccaggcuggagug

SEQ ID NO: 924956 - RNA, 24 nt, Human
ucugucacccaggcuggagugcag

SEQ ID NO: 924957 - RNA, 18 nt, Human
ucuuggccacccugagag

SEQ ID NO: 924958 - RNA, 18 nt, Human
ugaccucaggugaucugc

SEQ ID NO: 924959 - RNA, 20 nt, Human
ugaccucaggugaucugccc

SEQ ID NO: 924960 - RNA, 24 nt, Human
ugaccucaggugaucugcccgccu

SEQ ID NO: 924961 - RNA, 18 nt, Human
ugcccaggaggagcaaga

SEQ ID NO: 924962 - RNA, 21 nt, Human
ugccccgaacacucaguccag

SEQ ID NO: 924963 - RNA, 25 nt, Human
ugccccugagcacagcccuugucug

SEQ ID NO: 924964 - RNA, 24 nt, Human
ugccucagccucccaaguagcugg

SEQ ID NO: 924965 - RNA, 23 nt, Human
uggagucaagcgauucuccugcc

SEQ ID NO: 924966 - RNA, 19 nt, Human
uggagugcagugguaccau

SEQ ID NO: 924967 - RNA, 20 nt, Human
uggagugcagugguaccauc

SEQ ID NO: 924968 - RNA, 21 nt, Human
uggagugcagugguaccauca

SEQ ID NO: 924969 - RNA, 23 nt, Human
uggauuaugggcgugagccacca

SEQ ID NO: 924970 - RNA, 24 nt, Human
uggccaggauggucucgaacuccu

SEQ ID NO: 924971 - RNA, 18 nt, Human
uggcggaggguggugggg

SEQ ID NO: 924972 - RNA, 21 nt, Human
ugggauuacaggcgcccgcca

SEQ ID NO: 924973 - RNA, 22 nt, Human
ugggauuacaggcgcccgccac

SEQ ID NO: 924974 - RNA, 24 nt, Human
ugggauuacaggcgcccgccacca

SEQ ID NO: 924975 - RNA, 21 nt, Human
ugggcugcccuccagcagccc

SEQ ID NO: 924976 - RNA, 23 nt, Human
uggggagggugggggggcccugg

SEQ ID NO: 924977 - RNA, 21 nt, Human
uggggcaagccccucccucaa

SEQ ID NO: 924978 - RNA, 18 nt, Human
ugggguggggcggggugg

SEQ ID NO: 924979 - RNA, 20 nt, Human
uggggugggguggggcgggg

SEQ ID NO: 924980 - RNA, 21 nt, Human
uggggugggguggggcggggu

SEQ ID NO: 924981 - RNA, 19 nt, Human
ugguaccaucagagcucac

SEQ ID NO: 924982 - RNA, 24 nt, Human
ugguaccaucagagcucacugcag

SEQ ID NO: 924983 - RNA, 21 nt, Human
ugguggggagggugggggggc

SEQ ID NO: 924984 - RNA, 21 nt, Human
uguuccuguccccagaugccc

SEQ ID NO: 924985 - RNA, 18 nt, Human
uuaguggagacgggguuu

SEQ ID NO: 924986 - RNA, 22 nt, Human
uuaguggagacgggguuucacc

SEQ ID NO: 924987 - RNA, 24 nt, Human
uuaguggagacgggguuucaccau

SEQ ID NO: 924988 - RNA, 24 nt, Human
uuccugguucugagacuucccagg

SEQ ID NO: 924989 - RNA, 18 nt, Human
uugcagguggagagggcu

SEQ ID NO: 924990 - RNA, 23 nt, Human
uuguauuuuuaguggagacgggg

SEQ ID NO: 924991 - RNA, 19 nt, Human
uuucaccauguuggccagg

SEQ ID NO: 924992 - RNA, 20 nt, Human
uuucaccauguuggccagga

SEQ ID NO: 924993 - RNA, 20 nt, Human
uuucagaggguggggugggg

SEQ ID NO: 924994 - RNA, 19 nt, Human
uuuccuuccugguucugag

SEQ ID NO: 924995 - RNA, 23 nt, Human
uuugggcugcccuccagcagccc

SEQ ID NO: 924996 - RNA, 19 nt, Human
uuuuguauuuuuaguggag

SEQ ID NO: 924997 - RNA, 20 nt, Human
uuuuguauuuuuaguggaga

SEQ ID NO: 924998 - RNA, 25 nt, Human
uuuuguuuuuuuuuuuaagacaggg

SEQ ID NO: 924999 - RNA, 24 nt, Human
uuuuuaguggagacgggguuucac

SEQ ID NO: 925000 - RNA, 20 nt, Human
uuuuuuuuaagacagggucu

SEQ ID NO: 925001 - RNA, 22 nt, Human
uuuuuuuuuuuaagacaggguc

SEQ ID NO: 925002 - RNA, 24 nt, Human
uuuuuuuuuuuaagacagggucuc

SEQ ID NO: 925003 - RNA, 18 nt, Human
aaaugaccaaccccugga

SEQ ID NO: 925004 - RNA, 18 nt, Human
aaccgaggauccagaagc

SEQ ID NO: 925005 - RNA, 18 nt, Human
aagaagccugaaucauag

SEQ ID NO: 925006 - RNA, 24 nt, Human
accccuggagaguaggaggggcag

SEQ ID NO: 925007 - RNA, 22 nt, Human
agcugaaccagcaaaugggggu

SEQ ID NO: 925008 - RNA, 21 nt, Human
agugaaaccaauaaaaucuaa

SEQ ID NO: 925009 - RNA, 27 nt, Human
auacaaggccauccaucccuccacggg

SEQ ID NO: 925010 - RNA, 22 nt, Human
cagaaaccgaggauccagaagc

SEQ ID NO: 925011 - RNA, 20 nt, Human
cagggaccuccaagcuugac

SEQ ID NO: 925012 - RNA, 20 nt, Human
cauuucagcagccuugaaau

SEQ ID NO: 925013 - RNA, 20 nt, Human
ccaaccccuggagaguagga

SEQ ID NO: 925014 - RNA, 20 nt, Human
ccacugggggccauccgacc

SEQ ID NO: 925015 - RNA, 22 nt, Human
cccugacuaaacccacuggggg

SEQ ID NO: 925016 - RNA, 21 nt, Human
ccugaaucauagcugaaccag

SEQ ID NO: 925017 - RNA, 23 nt, Human
ccuucauuggcuuccagguguga

SEQ ID NO: 925018 - RNA, 24 nt, Human
cgaggauccagaagcccugacuaa

SEQ ID NO: 925019 - RNA, 19 nt, Human
cggcacuugugauuuuuau

SEQ ID NO: 925020 - RNA, 21 nt, Human
cucccaggagcugaaggugaa

SEQ ID NO: 925021 - RNA, 22 nt, Human
cugaaucauagcugaaccagca

SEQ ID NO: 925022 - RNA, 18 nt, Human
gacccagucaggcggcaa

SEQ ID NO: 925023 - RNA, 19 nt, Human
gagaguaggaggggcagug

SEQ ID NO: 925024 - RNA, 19 nt, Human
gaguucuccaguucccuuc

SEQ ID NO: 925025 - RNA, 19 nt, Human
ggacaagaauggagggagg

SEQ ID NO: 925026 - RNA, 18 nt, Human
ggcauggagcacagaugg

SEQ ID NO: 925027 - RNA, 18 nt, Human
gggagggccugaagaagc

SEQ ID NO: 925028 - RNA, 21 nt, Human
gggggugggggaagaugaagg

SEQ ID NO: 925029 - RNA, 24 nt, Human
guucauggauuguuccuuuuguuu

SEQ ID NO: 925030 - RNA, 22 nt, Human
ucagcagccuugaaaugaccaa

SEQ ID NO: 925031 - RNA, 24 nt, Human
uccagaagcccugacuaaacccac

SEQ ID NO: 925032 - RNA, 23 nt, Human
uccaggugugcagguggcuuggg

SEQ ID NO: 925033 - RNA, 22 nt, Human
ucccauggugcacuggcaugcc

SEQ ID NO: 925034 - RNA, 20 nt, Human
ucccuggagacuaagaacau

SEQ ID NO: 925035 - RNA, 18 nt, Human
uccuuaauuucaucaucc

SEQ ID NO: 925036 - RNA, 22 nt, Human
ucucagggguccauauacaagg

SEQ ID NO: 925037 - RNA, 21 nt, Human
ucucuugccacaaguucaggu

SEQ ID NO: 925038 - RNA, 19 nt, Human
ucugguucagggaccucca

SEQ ID NO: 925039 - RNA, 23 nt, Human
ugaaucauagcugaaccagcaaa

SEQ ID NO: 925040 - RNA, 19 nt, Human
ugacuaaacccacuggggg

SEQ ID NO: 925041 - RNA, 19 nt, Human
ugacucagcuguucuccuu

SEQ ID NO: 925042 - RNA, 21 nt, Human
ugauuuuuauccauuucccuu

SEQ ID NO: 925043 - RNA, 20 nt, Human
ugccucugguucagggaccu

SEQ ID NO: 925044 - RNA, 19 nt, Human
ugcugggaacucccaggag

SEQ ID NO: 925045 - RNA, 24 nt, Human
ugggagcucugguagggcaagggc

SEQ ID NO: 925046 - RNA, 23 nt, Human
uguuuuguuuucucaauugcuca

SEQ ID NO: 925047 - RNA, 18 nt, Human
uugaauuuagaaagcaca

SEQ ID NO: 925048 - RNA, 21 nt, Human
aauacaaauauaaaaagggga

SEQ ID NO: 925049 - RNA, 18 nt, Human
agagccaggaucuuugga

SEQ ID NO: 925050 - RNA, 22 nt, Human
agcaaaggacuuggccuucccg

SEQ ID NO: 925051 - RNA, 18 nt, Human
augcccucuaccaccucc

SEQ ID NO: 925052 - RNA, 24 nt, Human
cacaaauuguacauuauuuacacc

SEQ ID NO: 925053 - RNA, 22 nt, Human
caggacaaaccagucccccucu

SEQ ID NO: 925054 - RNA, 21 nt, Human
cgggggcucaggcucaacuga

SEQ ID NO: 925055 - RNA, 23 nt, Human
cugguuccgaugucagucucaga

SEQ ID NO: 925056 - RNA, 23 nt, Human
gaacagucugcagucaaagccga

SEQ ID NO: 925057 - RNA, 18 nt, Human
gagcucacagcaaaggac

SEQ ID NO: 925058 - RNA, 20 nt, Human
gagggcuggggaacuuucuu

SEQ ID NO: 925059 - RNA, 23 nt, Human
gcuccuuauuguuacuguucagu

SEQ ID NO: 925060 - RNA, 23 nt, Human
gggacagagcucacagcaaagga

SEQ ID NO: 925061 - RNA, 19 nt, Human
gggcuggggaacuuucuuu

SEQ ID NO: 925062 - RNA, 18 nt, Human
gugggugaacagucugca

SEQ ID NO: 925063 - RNA, 21 nt, Human
guuucuucuuuuccuggcguc

SEQ ID NO: 925064 - RNA, 21 nt, Human
uaagccagguuucuuuuucuu

SEQ ID NO: 925065 - RNA, 20 nt, Human
uagcagcccccgcgccgggg

SEQ ID NO: 925066 - RNA, 19 nt, Human
uauaaaaaggggaaagucc

SEQ ID NO: 925067 - RNA, 18 nt, Human
ucaguaagccagguuucu

SEQ ID NO: 925068 - RNA, 20 nt, Human
ucccggugacaaacccagca

SEQ ID NO: 925069 - RNA, 20 nt, Human
uccucuucagccaagcucug

SEQ ID NO: 925070 - RNA, 22 nt, Human
ucuccugccuuuguuguuucuu

SEQ ID NO: 925071 - RNA, 23 nt, Human
ucuccugccuuuguuguuucuuc

SEQ ID NO: 925072 - RNA, 24 nt, Human
ucugcagucaaagccgaugcuggg

SEQ ID NO: 925073 - RNA, 28 nt, Human
ucuuuucugggcuguucucucugcagag

SEQ ID NO: 925074 - RNA, 19 nt, Human
ugaaaguggcuguucuccu

SEQ ID NO: 925075 - RNA, 24 nt, Human
ugaaaguggcuguucuccugccuu

SEQ ID NO: 925076 - RNA, 23 nt, Human
ugacaaacccagcaguagaaauc

SEQ ID NO: 925077 - RNA, 19 nt, Human
ugcagagccaggaucuuug

SEQ ID NO: 925078 - RNA, 21 nt, Human
uggaagaauguggagggcugg

SEQ ID NO: 925079 - RNA, 21 nt, Human
uggcgucuggguuuuucuccc

SEQ ID NO: 925080 - RNA, 19 nt, Human
uggggaacuuucuuuucug

SEQ ID NO: 925081 - RNA, 24 nt, Human
uggggaacuuucuuuucugggcug

SEQ ID NO: 925082 - RNA, 19 nt, Human
uggguguccuguaguguag

SEQ ID NO: 925083 - RNA, 20 nt, Human
uguggagggcuggggaacuu

SEQ ID NO: 925084 - RNA, 21 nt, Human
uuccucuucagccaagcucug

SEQ ID NO: 925085 - RNA, 25 nt, Human
uugucauuuucaagucugaaagugg

SEQ ID NO: 925086 - RNA, 24 nt, Human
uuuuuuuuuuuuuuuuuuaauaag

SEQ ID NO: 925087 - RNA, 20 nt, Human
aagcaggugugagugacugc

SEQ ID NO: 925088 - RNA, 24 nt, Human
gcaggcaacaccagccccagucgg

SEQ ID NO: 925089 - RNA, 18 nt, Human
gccuugguggauguagga

SEQ ID NO: 925090 - RNA, 21 nt, Human
ggaggcaggcaacaccagccc

SEQ ID NO: 925091 - RNA, 20 nt, Human
ggccagagcgcccgccuugg

SEQ ID NO: 925092 - RNA, 23 nt, Human
gggcgugagugcuacauucugaa

SEQ ID NO: 925093 - RNA, 18 nt, Human
ugggcuuaaggaagggag

SEQ ID NO: 925094 - RNA, 26 nt, Human
uuuuuuuuuuuuuucgggugaaauua

SEQ ID NO: 925095 - RNA, 19 nt, Human
uuuuuuuuuuuuuuuuucg

SEQ ID NO: 925096 - RNA, 22 nt, Human
uuuuuuuuuuuuuuuuuucggg

SEQ ID NO: 925097 - RNA, 26 nt, Human
aaacaacaacaacaaaaaacucagaa

SEQ ID NO: 925098 - RNA, 19 nt, Human
aacaacaaaaaacucagaa

SEQ ID NO: 925099 - RNA, 21 nt, Human
aacaacaacaaaaaacucaga

SEQ ID NO: 925100 - RNA, 22 nt, Human
acaaugaggagccacuuuugaa

SEQ ID NO: 925101 - RNA, 20 nt, Human
acagagagcaaaugaagggu

SEQ ID NO: 925102 - RNA, 24 nt, Human
caacaacaaaaaacucagaagcua

SEQ ID NO: 925103 - RNA, 25 nt, Human
caacaacaaaaaacucagaagcuau

SEQ ID NO: 925104 - RNA, 22 nt, Human
cauauuuacgcugaaguacaau

SEQ ID NO: 925105 - RNA, 24 nt, Human
gcugaaguacaaugaggagccagu

SEQ ID NO: 925106 - RNA, 23 nt, Human
uaaaaacaacaacaacaaaaaac

SEQ ID NO: 925107 - RNA, 20 nt, Human
uauuagaaugguacuuuuaa

SEQ ID NO: 925108 - RNA, 23 nt, Human
ucaauaaaaacaacaacaacaaa

SEQ ID NO: 925109 - RNA, 21 nt, Human
ugaaggguugcuauuuuuaag

SEQ ID NO: 925110 - RNA, 24 nt, Human
ugaggagccacuuuugaagaagua

SEQ ID NO: 925111 - RNA, 26 nt, Human
uucaauaaaaacaacaacaacaaaaa

SEQ ID NO: 925112 - RNA, 20 nt, Human
uucuugugagucagcuuggu

SEQ ID NO: 925113 - RNA, 20 nt, Human
uugcuauuuuuaagaggucu

SEQ ID NO: 925114 - RNA, 19 nt, Human
uugguggcacagagagcaa

SEQ ID NO: 925115 - RNA, 18 nt, Human
uuucauggccgauguucc

SEQ ID NO: 925116 - RNA, 18 nt, Human
aaccgcaugacagccccc

SEQ ID NO: 925117 - RNA, 18 nt, Human
acgacagagacgcacgcg

SEQ ID NO: 925118 - RNA, 21 nt, Human
acggcgccgacccggucaacu

SEQ ID NO: 925119 - RNA, 18 nt, Human
cagcagcaaguuccucca

SEQ ID NO: 925120 - RNA, 20 nt, Human
cagcccccucggcagggucc

SEQ ID NO: 925121 - RNA, 22 nt, Human
cauuuuauuccucaggacgcua

SEQ ID NO: 925122 - RNA, 25 nt, Human
ccagcagcgcccgcugacgcuuccc

SEQ ID NO: 925123 - RNA, 19 nt, Human
cccccgccgccgucagcgc

SEQ ID NO: 925124 - RNA, 18 nt, Human
ccccucggcagggucccc

SEQ ID NO: 925125 - RNA, 18 nt, Human
cccgcugacgcuucccuc

SEQ ID NO: 925126 - RNA, 18 nt, Human
cccucggagccgugccca

SEQ ID NO: 925127 - RNA, 22 nt, Human
cccucggagccgugcccagccu

SEQ ID NO: 925128 - RNA, 19 nt, Human
ccgccgccgucagcgcugc

SEQ ID NO: 925129 - RNA, 21 nt, Human
ccgccgccgucagcgcugcgc

SEQ ID NO: 925130 - RNA, 23 nt, Human
ccgccgucagcgcugcgccccgg

SEQ ID NO: 925131 - RNA, 18 nt, Human
ccgggcccaggugugagg

SEQ ID NO: 925132 - RNA, 21 nt, Human
ccuggcaugcauaugcggugg

SEQ ID NO: 925133 - RNA, 20 nt, Human
ccuggcggagcaggucagug

SEQ ID NO: 925134 - RNA, 24 nt, Human
cgugcccagccuggcaugcauaug

SEQ ID NO: 925135 - RNA, 23 nt, Human
cguguccacgacagagacgcacg

SEQ ID NO: 925136 - RNA, 20 nt, Human
cuccccccgccgccgucagc

SEQ ID NO: 925137 - RNA, 20 nt, Human
cugcgccccgggagcuccgg

SEQ ID NO: 925138 - RNA, 21 nt, Human
gaagcuggccugcccgggccc

SEQ ID NO: 925139 - RNA, 19 nt, Human
gaaggcagcgcucaggacc

SEQ ID NO: 925140 - RNA, 19 nt, Human
gacccggucaacuccgcgg

SEQ ID NO: 925141 - RNA, 19 nt, Human
gaccgacggcgccgacccg

SEQ ID NO: 925142 - RNA, 20 nt, Human
gcaaguuccuccagcacgaa

SEQ ID NO: 925143 - RNA, 26 nt, Human
gcccgcugacgcuucccucugcgguc

SEQ ID NO: 925144 - RNA, 20 nt, Human
gcggggcgggggcuccaggu

SEQ ID NO: 925145 - RNA, 22 nt, Human
gcucaggaccgacggcgccgac

SEQ ID NO: 925146 - RNA, 23 nt, Human
gcuccagguggggccgcggcgga

SEQ ID NO: 925147 - RNA, 21 nt, Human
ggaaaccgcaugacagccccc

SEQ ID NO: 925148 - RNA, 22 nt, Human
ggccauggcgcggggcgggggc

SEQ ID NO: 925149 - RNA, 18 nt, Human
gggacuguucugcuccca

SEQ ID NO: 925150 - RNA, 23 nt, Human
ggggcgggggcuccagguggggc

SEQ ID NO: 925151 - RNA, 22 nt, Human
ucccucugcggucucggcgcaa

SEQ ID NO: 925152 - RNA, 19 nt, Human
uccuccagcacgaagcugg

SEQ ID NO: 925153 - RNA, 24 nt, Human
ugcccgggcccaggugugagggac

SEQ ID NO: 925154 - RNA, 26 nt, Human
uggcaugcauaugcggugguuaagga

SEQ ID NO: 925155 - RNA, 22 nt, Human
agauguagcuaggggcugggga

SEQ ID NO: 925156 - RNA, 23 nt, Human
aggaagggaucccagcaggguuu

SEQ ID NO: 925157 - RNA, 24 nt, Human
aggagcucugggaaaaccugugga

SEQ ID NO: 925158 - RNA, 21 nt, Human
aggagucacaggguggaucug

SEQ ID NO: 925159 - RNA, 22 nt, Human
agggaagagguuacagggggag

SEQ ID NO: 925160 - RNA, 23 nt, Human
agggaagagguuacagggggagg

SEQ ID NO: 925161 - RNA, 21 nt, Human
agggaucccagcaggguuucu

SEQ ID NO: 925162 - RNA, 21 nt, Human
agguuacagggggaggagcug

SEQ ID NO: 925163 - RNA, 19 nt, Human
auggaaagaggccagaaac

SEQ ID NO: 925164 - RNA, 19 nt, Human
cacaggguggaucugugga

SEQ ID NO: 925165 - RNA, 26 nt, Human
cacagucugacugcacagagccgccu

SEQ ID NO: 925166 - RNA, 23 nt, Human
cagcugccuuucugauuuccagc

SEQ ID NO: 925167 - RNA, 23 nt, Human
ccacaccaagguugaugaaggaa

SEQ ID NO: 925168 - RNA, 23 nt, Human
cccacagucugacugcacagagc

SEQ ID NO: 925169 - RNA, 23 nt, Human
ccugagagacugcugugcacccc

SEQ ID NO: 925170 - RNA, 19 nt, Human
ccugggggaaagggcagcc

SEQ ID NO: 925171 - RNA, 18 nt, Human
cugcucuggggcuggcag

SEQ ID NO: 925172 - RNA, 19 nt, Human
cugcucuggggcuggcagg

SEQ ID NO: 925173 - RNA, 19 nt, Human
cugcucuggggcuggcagg

SEQ ID NO: 925174 - RNA, 21 nt, Human
cugugcaccccacagucugac

SEQ ID NO: 925175 - RNA, 18 nt, Human
cuuuuccuuuucucucuc

SEQ ID NO: 925176 - RNA, 23 nt, Human
gaaagaggccagaaaccccagcc

SEQ ID NO: 925177 - RNA, 24 nt, Human
gaagagguuacagggggaggagcu

SEQ ID NO: 925178 - RNA, 20 nt, Human
gaaggaagggaucccagcag

SEQ ID NO: 925179 - RNA, 20 nt, Human
gagcauccuccacaccaagg

SEQ ID NO: 925180 - RNA, 23 nt, Human
gaggagucacaggguggaucugu

SEQ ID NO: 925181 - RNA, 18 nt, Human
gaucuguggagggaagag

SEQ ID NO: 925182 - RNA, 22 nt, Human
gcucuggggcuggcagguugcc

SEQ ID NO: 925183 - RNA, 21 nt, Human
ggaagagguuacagggggagg

SEQ ID NO: 925184 - RNA, 20 nt, Human
ggagggaagagguuacaggg

SEQ ID NO: 925185 - RNA, 21 nt, Human
ggagggggagguggaagcgcu

SEQ ID NO: 925186 - RNA, 19 nt, Human
ggaucuguggagggaagag

SEQ ID NO: 925187 - RNA, 25 nt, Human
ggccagaaaccccagccugagagac

SEQ ID NO: 925188 - RNA, 22 nt, Human
gggaaguaggacuguccaggga

SEQ ID NO: 925189 - RNA, 19 nt, Human
ggggcuggggagggggagg

SEQ ID NO: 925190 - RNA, 25 nt, Human
gggggaaagggcagccaggcagagg

SEQ ID NO: 925191 - RNA, 20 nt, Human
guccagggaaggguggagag

SEQ ID NO: 925192 - RNA, 19 nt, Human
guggagggaagagguuaca

SEQ ID NO: 925193 - RNA, 23 nt, Human
guuggcaggaggcacugaggcuc

SEQ ID NO: 925194 - RNA, 22 nt, Human
uagcuaggggcuggggaggggg

SEQ ID NO: 925195 - RNA, 22 nt, Human
uccaagaggagcucugggaaaa

SEQ ID NO: 925196 - RNA, 23 nt, Human
uccacaccaagguugaugaagga

SEQ ID NO: 925197 - RNA, 25 nt, Human
ucucucugauuguuuuaauuguucu

SEQ ID NO: 925198 - RNA, 23 nt, Human
ucuguuggcaggaggcacugagg

SEQ ID NO: 925199 - RNA, 19 nt, Human
ugaaggaagggaucccagc

SEQ ID NO: 925200 - RNA, 18 nt, Human
ugacugcacagagccgcc

SEQ ID NO: 925201 - RNA, 23 nt, Human
ugagcauccuccacaccaagguu

SEQ ID NO: 925202 - RNA, 24 nt, Human
ugauuggauggaaagaggccagaa

SEQ ID NO: 925203 - RNA, 19 nt, Human
ugccugggggaaagggcag

SEQ ID NO: 925204 - RNA, 22 nt, Human
ugccugggggaaagggcagcca

SEQ ID NO: 925205 - RNA, 25 nt, Human
ugcucuggggcuggcagguugccug

SEQ ID NO: 925206 - RNA, 19 nt, Human
uggaaagaggccagaaacc

SEQ ID NO: 925207 - RNA, 22 nt, Human
uggaaagaggccagaaacccca

SEQ ID NO: 925208 - RNA, 19 nt, Human
uggaaggggugauuggaug

SEQ ID NO: 925209 - RNA, 24 nt, Human
uggauggaaagaggccagaaaccc

SEQ ID NO: 925210 - RNA, 18 nt, Human
ugggaaaaccuguggaua

SEQ ID NO: 925211 - RNA, 22 nt, Human
uggggagggggagguggaagcg

SEQ ID NO: 925212 - RNA, 23 nt, Human
ugguaggcugcugaauuuccugg

SEQ ID NO: 925213 - RNA, 20 nt, Human
uguggauaaaaccaaaugcc

SEQ ID NO: 925214 - RNA, 20 nt, Human
uugagcauccuccacaccaa

SEQ ID NO: 925215 - RNA, 21 nt, Human
uugccugguauuaugcccaag

SEQ ID NO: 925216 - RNA, 21 nt, Human
uuucugcucuggggcuggcag

SEQ ID NO: 925217 - RNA, 22 nt, Human
uuucugcucuggggcuggcagg

SEQ ID NO: 925218 - RNA, 19 nt, Human
aaaaaaaacagacaaauca

SEQ ID NO: 925219 - RNA, 23 nt, Human
aaaaaaaacagacaaaucagggu

SEQ ID NO: 925220 - RNA, 19 nt, Human
aaaaaaacagacaaaucag

SEQ ID NO: 925221 - RNA, 22 nt, Human
aaaacagacaaaucaguuguca

SEQ ID NO: 925222 - RNA, 22 nt, Human
aaacagacaaaucaguugucag

SEQ ID NO: 925223 - RNA, 22 nt, Human
aaacagcaacgagauguggaac

SEQ ID NO: 925224 - RNA, 19 nt, Human
aaacaggggccauuuaaac

SEQ ID NO: 925225 - RNA, 24 nt, Human
aaacauggcacuuucaacguucuc

SEQ ID NO: 925226 - RNA, 21 nt, Human
aaagccuauuuuuaaaagucu

SEQ ID NO: 925227 - RNA, 20 nt, Human
aacagguaggucuucaaagc

SEQ ID NO: 925228 - RNA, 20 nt, Human
aagaaagacaaaaucuacac

SEQ ID NO: 925229 - RNA, 23 nt, Human
aagaaagacaaaaucuacacuga

SEQ ID NO: 925230 - RNA, 21 nt, Human
aagacaaaaucuacacugaaa

SEQ ID NO: 925231 - RNA, 23 nt, Human
acauggcacuuucaacguucucu

SEQ ID NO: 925232 - RNA, 24 nt, Human
acuuugucauuuguuucuuuaagu

SEQ ID NO: 925233 - RNA, 19 nt, Human
agacaaaaucuacacugaa

SEQ ID NO: 925234 - RNA, 19 nt, Human
agagaaaaaaaacagacaa

SEQ ID NO: 925235 - RNA, 22 nt, Human
aggaagaugcaggcuccacaaa

SEQ ID NO: 925236 - RNA, 25 nt, Human
aucaacagagaucacgcaaaaggaa

SEQ ID NO: 925237 - RNA, 23 nt, Human
auggaaaaagacagagaaaaaaa

SEQ ID NO: 925238 - RNA, 23 nt, Human
auggcacuuucaacguucucuuc

SEQ ID NO: 925239 - RNA, 20 nt, Human
auuccuuccucccacaccuc

SEQ ID NO: 925240 - RNA, 22 nt, Human
caaauauaagaaagccuauuuu

SEQ ID NO: 925241 - RNA, 22 nt, Human
caagaaagacaaaaucuacacu

SEQ ID NO: 925242 - RNA, 21 nt, Human
caauuccagagugccaucaac

SEQ ID NO: 925243 - RNA, 18 nt, Human
caccaaaaauaacagcaa

SEQ ID NO: 925244 - RNA, 22 nt, Human
cauggaaaaagacagagaaaaa

SEQ ID NO: 925245 - RNA, 20 nt, Human
ccacaacacuuauuuuguag

SEQ ID NO: 925246 - RNA, 21 nt, Human
ccuuccucccacaccucuuca

SEQ ID NO: 925247 - RNA, 19 nt, Human
cgcaaaaggaaacauggca

SEQ ID NO: 925248 - RNA, 24 nt, Human
cuucaaagaauucauaacacccaa

SEQ ID NO: 925249 - RNA, 22 nt, Human
gagcucacaagcuuuucuccgg

SEQ ID NO: 925250 - RNA, 21 nt, Human
ggaaaaagacagagaaaaaaa

SEQ ID NO: 925251 - RNA, 22 nt, Human
uaaaauguauuccuuccuccca

SEQ ID NO: 925252 - RNA, 20 nt, Human
uagauaaaccacaacacuua

SEQ ID NO: 925253 - RNA, 19 nt, Human
uagauugaaauaaacuaua

SEQ ID NO: 925254 - RNA, 24 nt, Human
uauaagagucauggaaaaagacag

SEQ ID NO: 925255 - RNA, 21 nt, Human
ucaaccaugaaacagaagugu

SEQ ID NO: 925256 - RNA, 21 nt, Human
ucacaagcuuuucuccgguaa

SEQ ID NO: 925257 - RNA, 23 nt, Human
ucuaaaaugacuuaacugaaaca

SEQ ID NO: 925258 - RNA, 18 nt, Human
ucuccgguaauuucuugu

SEQ ID NO: 925259 - RNA, 23 nt, Human
ugucaguauccauggccucugau

SEQ ID NO: 925260 - RNA, 18 nt, Human
ugucucaaccaugaaaca

SEQ ID NO: 925261 - RNA, 20 nt, Human
uucacuacaacauuuuauaa

SEQ ID NO: 925262 - RNA, 22 nt, Human
uucacuacaacauuuuauaaaa

SEQ ID NO: 925263 - RNA, 21 nt, Human
uuccucccacaccucuucaaa

SEQ ID NO: 925264 - RNA, 24 nt, Human
uuuuuaacauacuuaaaacuccua

SEQ ID NO: 925265 - RNA, 18 nt, Human
aaugacgcucuuuucaga

SEQ ID NO: 925266 - RNA, 18 nt, Human
acacgguagagcccuggc

SEQ ID NO: 925267 - RNA, 18 nt, Human
accagcgcugcgggcgcg

SEQ ID NO: 925268 - RNA, 21 nt, Human
acccucacgccuguguccucu

SEQ ID NO: 925269 - RNA, 20 nt, Human
acgggcucggggccggcguc

SEQ ID NO: 925270 - RNA, 20 nt, Human
aggcauagacguccacggac

SEQ ID NO: 925271 - RNA, 21 nt, Human
aggccagggagguggcgcugg

SEQ ID NO: 925272 - RNA, 24 nt, Human
aggggcuucagcugagcgggggcc

SEQ ID NO: 925273 - RNA, 21 nt, Human
agggggaccacgggcuguggg

SEQ ID NO: 925274 - RNA, 21 nt, Human
aggggugucggcugggccagc

SEQ ID NO: 925275 - RNA, 28 nt, Human
aguaccuaucacacuuuuggcaaaugac

SEQ ID NO: 925276 - RNA, 24 nt, Human
auccugcugcuccuugggcugcag

SEQ ID NO: 925277 - RNA, 27 nt, Human
aucuggaggggcuucagcugagcgggg

SEQ ID NO: 925278 - RNA, 21 nt, Human
auggacuuggccacgaucuug

SEQ ID NO: 925279 - RNA, 18 nt, Human
caccuggaccugcagggg

SEQ ID NO: 925280 - RNA, 21 nt, Human
cacgguagagcccuggccgcu

SEQ ID NO: 925281 - RNA, 23 nt, Human
cagcacaaugcaccgcuugcccu

SEQ ID NO: 925282 - RNA, 19 nt, Human
cagcaggcccuucaggauc

SEQ ID NO: 925283 - RNA, 23 nt, Human
cagcgcgggccagauccucuccc

SEQ ID NO: 925284 - RNA, 22 nt, Human
cagcgugccggggacgucucgg

SEQ ID NO: 925285 - RNA, 23 nt, Human
cagcgugccggggacgucucggc

SEQ ID NO: 925286 - RNA, 18 nt, Human
cagguacgguggcaggug

SEQ ID NO: 925287 - RNA, 19 nt, Human
ccaagcaucacgcucugcu

SEQ ID NO: 925288 - RNA, 19 nt, Human
cccaaaggcauagacgucc

SEQ ID NO: 925289 - RNA, 24 nt, Human
cccaaaggcauagacguccacgga

SEQ ID NO: 925290 - RNA, 19 nt, Human
cccagaagucguagaagcg

SEQ ID NO: 925291 - RNA, 18 nt, Human
ccccaccugggaggcugg

SEQ ID NO: 925292 - RNA, 22 nt, Human
ccccgcgccgcgcccgggcucc

SEQ ID NO: 925293 - RNA, 18 nt, Human
cccggcgccucggcugcc

SEQ ID NO: 925294 - RNA, 19 nt, Human
cccggcgccucggcugccu

SEQ ID NO: 925295 - RNA, 20 nt, Human
cccuuggcgcuggacuccca

SEQ ID NO: 925296 - RNA, 19 nt, Human
ccgagguggccaucuccag

SEQ ID NO: 925297 - RNA, 18 nt, Human
ccgcgccgccuucgcccg

SEQ ID NO: 925298 - RNA, 21 nt, Human
ccgcugucgaaggugcugucc

SEQ ID NO: 925299 - RNA, 24 nt, Human
ccggcaccagcugcggagaaccuu

SEQ ID NO: 925300 - RNA, 18 nt, Human
ccggccgcgccgccuucg

SEQ ID NO: 925301 - RNA, 19 nt, Human
ccggcgcugcaggggcugc

SEQ ID NO: 925302 - RNA, 18 nt, Human
ccggggacgucucggcgg

SEQ ID NO: 925303 - RNA, 18 nt, Human
ccgucgauucccgccagg

SEQ ID NO: 925304 - RNA, 22 nt, Human
ccgugggcugcugguaggcccc

SEQ ID NO: 925305 - RNA, 19 nt, Human
ccucacggucgccgccgcc

SEQ ID NO: 925306 - RNA, 21 nt, Human
ccuugugugcaggaacagcag

SEQ ID NO: 925307 - RNA, 21 nt, Human
cgaugggguccgggccgggcu

SEQ ID NO: 925308 - RNA, 21 nt, Human
cgaugguggacuuccugccgu

SEQ ID NO: 925309 - RNA, 21 nt, Human
cgccaugcccgcgggccccgc

SEQ ID NO: 925310 - RNA, 21 nt, Human
cgcccgaggcuccgccaugcc

SEQ ID NO: 925311 - RNA, 22 nt, Human
cgcccgaggcuccgccaugccc

SEQ ID NO: 925312 - RNA, 23 nt, Human
cgcccgggcuccaucagcgugcc

SEQ ID NO: 925313 - RNA, 21 nt, Human
cgcgggccagauccucucccg

SEQ ID NO: 925314 - RNA, 22 nt, Human
cggccuccggcuccucgggcuc

SEQ ID NO: 925315 - RNA, 23 nt, Human
cgggcgcgggggcggcggggcgu

SEQ ID NO: 925316 - RNA, 25 nt, Human
cggucggcaggucugggagggccgg

SEQ ID NO: 925317 - RNA, 22 nt, Human
cuccgggggcucccggcugcgc

SEQ ID NO: 925318 - RNA, 21 nt, Human
cuccuugggcugcagcgcggg

SEQ ID NO: 925319 - RNA, 19 nt, Human
cugaggugguggcacggga

SEQ ID NO: 925320 - RNA, 19 nt, Human
cugcagcgcgggccagauc

SEQ ID NO: 925321 - RNA, 24 nt, Human
cugccuccaagcccggcggcuccu

SEQ ID NO: 925322 - RNA, 21 nt, Human
cugcgccgcagaaagcgcugg

SEQ ID NO: 925323 - RNA, 22 nt, Human
cugcggcaggacgggccccucg

SEQ ID NO: 925324 - RNA, 25 nt, Human
cuuggggucuuccacccagagccuc

SEQ ID NO: 925325 - RNA, 20 nt, Human
cuuucccuucaguuucuugg

SEQ ID NO: 925326 - RNA, 20 nt, Human
gcacaaugcaccgcuugccc

SEQ ID NO: 925327 - RNA, 20 nt, Human
gcagaaagcgcuggggcccc

SEQ ID NO: 925328 - RNA, 24 nt, Human
gcgccgccuucgcccgaggcuccg

SEQ ID NO: 925329 - RNA, 21 nt, Human
gcgggcgcgggggcggcgggg

SEQ ID NO: 925330 - RNA, 22 nt, Human
gcugcgggcgcgggggcggcgg

SEQ ID NO: 925331 - RNA, 19 nt, Human
gcuggggccccggccgcgc

SEQ ID NO: 925332 - RNA, 19 nt, Human
ggaccccuggccuuguccg

SEQ ID NO: 925333 - RNA, 20 nt, Human
ggccccggccgcgccgccuu

SEQ ID NO: 925334 - RNA, 19 nt, Human
ggcccgggcugcccagccu

SEQ ID NO: 925335 - RNA, 19 nt, Human
ggccggcguccgcgggggc

SEQ ID NO: 925336 - RNA, 27 nt, Human
ggcggcggggcguccgcgggcgcgcuc

SEQ ID NO: 925337 - RNA, 26 nt, Human
gggcaggcgcgguuucgacagcggcu

SEQ ID NO: 925338 - RNA, 23 nt, Human
gggcggcggggcguccgcgggcg

SEQ ID NO: 925339 - RNA, 26 nt, Human
gggcugcagcgcgggccagauccucu

SEQ ID NO: 925340 - RNA, 18 nt, Human
gggcugcccacauccugc

SEQ ID NO: 925341 - RNA, 22 nt, Human
gggcuucagcugagcgggggcc

SEQ ID NO: 925342 - RNA, 22 nt, Human
gggggcggcggggcguccgcgg

SEQ ID NO: 925343 - RNA, 18 nt, Human
guccuugggcuuucccuu

SEQ ID NO: 925344 - RNA, 19 nt, Human
gucgccgccgccuccuccc

SEQ ID NO: 925345 - RNA, 21 nt, Human
gugauggggggcacaacagga

SEQ ID NO: 925346 - RNA, 21 nt, Human
uaccuuuccuccuuguuuuug

SEQ ID NO: 925347 - RNA, 19 nt, Human
ucagaguggccaggcccaa

SEQ ID NO: 925348 - RNA, 22 nt, Human
uccaagcccggcggcuccuccu

SEQ ID NO: 925349 - RNA, 18 nt, Human
uccgggccgggcuccugc

SEQ ID NO: 925350 - RNA, 21 nt, Human
uccugcugcuccuugggcugc

SEQ ID NO: 925351 - RNA, 24 nt, Human
uccugcugcuccuugggcugcagc

SEQ ID NO: 925352 - RNA, 26 nt, Human
ucgacagcggcugcgaugggguccuu

SEQ ID NO: 925353 - RNA, 23 nt, Human
ucggcugccuccaagcccggcgg

SEQ ID NO: 925354 - RNA, 18 nt, Human
ucggggccggcguccgcg

SEQ ID NO: 925355 - RNA, 21 nt, Human
ucgguggaugauggguggcgu

SEQ ID NO: 925356 - RNA, 22 nt, Human
ucucuugggccaccucauccgg

SEQ ID NO: 925357 - RNA, 19 nt, Human
ucuggaggggcuucagcug

SEQ ID NO: 925358 - RNA, 23 nt, Human
ugagcaagcggcugcaggggcgc

SEQ ID NO: 925359 - RNA, 24 nt, Human
ugaguacacgguagagcccuggcc

SEQ ID NO: 925360 - RNA, 19 nt, Human
ugaucucguaccuuuccuc

SEQ ID NO: 925361 - RNA, 21 nt, Human
ugauggguggcguccuugugu

SEQ ID NO: 925362 - RNA, 18 nt, Human
ugcaggaacagcaggccc

SEQ ID NO: 925363 - RNA, 19 nt, Human
ugcccuuggcgcuggacuc

SEQ ID NO: 925364 - RNA, 21 nt, Human
ugccuccaagcccggcggcuc

SEQ ID NO: 925365 - RNA, 19 nt, Human
ugcgcuaccagcgcugcgg

SEQ ID NO: 925366 - RNA, 25 nt, Human
uggagggggaccacgggcugugggg

SEQ ID NO: 925367 - RNA, 25 nt, Human
uggcaggugggggggaaccggcugg

SEQ ID NO: 925368 - RNA, 23 nt, Human
ugggccaccucauccggcgucuc

SEQ ID NO: 925369 - RNA, 23 nt, Human
uggggggcacaacaggaaucggg

SEQ ID NO: 925370 - RNA, 21 nt, Human
ugggguccgggccgggcuccu

SEQ ID NO: 925371 - RNA, 23 nt, Human
uggggucuuccacccagagccuc

SEQ ID NO: 925372 - RNA, 19 nt, Human
ugucacauuucaggucucg

SEQ ID NO: 925373 - RNA, 18 nt, Human
uguccuugggcuuucccu

SEQ ID NO: 925374 - RNA, 20 nt, Human
uguuggggugcugcaggccu

SEQ ID NO: 925375 - RNA, 18 nt, Human
uucaggaucugccggcac

SEQ ID NO: 925376 - RNA, 22 nt, Human
uuccucacggucgccgccgccu

SEQ ID NO: 925377 - RNA, 20 nt, Human
uugcagauacacuccccaau

SEQ ID NO: 925378 - RNA, 21 nt, Human
uuucaggaucgugcacuuucu

SEQ ID NO: 925379 - RNA, 23 nt, Human
uuucaggaucgugcacuuucuca

SEQ ID NO: 925380 - RNA, 23 nt, Human
aucuuccuugcucaguuuuguug

SEQ ID NO: 925381 - RNA, 22 nt, Human
ccauggugggcccugguguggg

SEQ ID NO: 925382 - RNA, 19 nt, Human
gauucugagaacacaagcu

SEQ ID NO: 925383 - RNA, 20 nt, Human
uccauggugggcccuggugu

SEQ ID NO: 925384 - RNA, 19 nt, Human
uccguggccggggauugcc

SEQ ID NO: 925385 - RNA, 19 nt, Human
ugagaacacaagcuccaug

SEQ ID NO: 925386 - RNA, 20 nt, Human
ugagaacacaagcuccaugg

SEQ ID NO: 925387 - RNA, 20 nt, Human
uggccggggauugccaacau

SEQ ID NO: 925388 - RNA, 22 nt, Human
uggccggggauugccaacauga

SEQ ID NO: 925389 - RNA, 18 nt, Human
aaaacaaaagacuaucuc

SEQ ID NO: 925390 - RNA, 21 nt, Human
acccacucuacccccacauua

SEQ ID NO: 925391 - RNA, 18 nt, Human
agucacaaagagggaaga

SEQ ID NO: 925392 - RNA, 21 nt, Human
auccauccaucugcucacaua

SEQ ID NO: 925393 - RNA, 18 nt, Human
augaacuucuucaaucuu

SEQ ID NO: 925394 - RNA, 19 nt, Human
cagcugauucucuuccuca

SEQ ID NO: 925395 - RNA, 22 nt, Human
cagcugauucucuuccucagcu

SEQ ID NO: 925396 - RNA, 24 nt, Human
cauccaucugcucacauaaaacca

SEQ ID NO: 925397 - RNA, 19 nt, Human
cauccugauuuucuagcaa

SEQ ID NO: 925398 - RNA, 22 nt, Human
ccaaucuuuaaaaacuuucaug

SEQ ID NO: 925399 - RNA, 22 nt, Human
cccccacauuaaaaacuacaag

SEQ ID NO: 925400 - RNA, 22 nt, Human
cuaguuuaauaaaauauccaaa

SEQ ID NO: 925401 - RNA, 22 nt, Human
cugacccacucuacccccacau

SEQ ID NO: 925402 - RNA, 22 nt, Human
cugggcaguacuagaaaucuau

SEQ ID NO: 925403 - RNA, 18 nt, Human
uaaaaacaaaagacuauc

SEQ ID NO: 925404 - RNA, 24 nt, Human
uaaaauauccaaauaacuaaccaa

SEQ ID NO: 925405 - RNA, 21 nt, Human
uaaaugacaacuuuauagacu

SEQ ID NO: 925406 - RNA, 22 nt, Human
uaaaugacaacuuuauagacug

SEQ ID NO: 925407 - RNA, 26 nt, Human
uaaaugacaacuuuauagacugcuua

SEQ ID NO: 925408 - RNA, 21 nt, Human
uaagaaaaugauuacguggca

SEQ ID NO: 925409 - RNA, 23 nt, Human
uaaggcuaaggaauagucacaaa

SEQ ID NO: 925410 - RNA, 23 nt, Human
uacaauuaaaaacuccuccucag

SEQ ID NO: 925411 - RNA, 23 nt, Human
uaggaaaggguccaucauccauc

SEQ ID NO: 925412 - RNA, 19 nt, Human
uauagauaaacucaaugug

SEQ ID NO: 925413 - RNA, 21 nt, Human
uauccaaauaacuaaccaauu

SEQ ID NO: 925414 - RNA, 22 nt, Human
uauuuuaguuuuuuuauacaaa

SEQ ID NO: 925415 - RNA, 26 nt, Human
ucuaagaaaaugauuacguggcagac

SEQ ID NO: 925416 - RNA, 22 nt, Human
ugaaaaagauaauacguuagua

SEQ ID NO: 925417 - RNA, 21 nt, Human
ugaaauuagauuuccugggca

SEQ ID NO: 925418 - RNA, 28 nt, Human
ugagaacccuaaguaugcuagauaauca

SEQ ID NO: 925419 - RNA, 22 nt, Human
ugaggaggcucauuaggaaagg

SEQ ID NO: 925420 - RNA, 21 nt, Human
ugcauauaugauuuguauaug

SEQ ID NO: 925421 - RNA, 19 nt, Human
ugcuagauaaucaacuagg

SEQ ID NO: 925422 - RNA, 22 nt, Human
ugggcaguacuagaaaucuaua

SEQ ID NO: 925423 - RNA, 25 nt, Human
ugucugcauauaugauuuguauaug

SEQ ID NO: 925424 - RNA, 18 nt, Human
uuaaaaacuccuccucag

SEQ ID NO: 925425 - RNA, 18 nt, Human
uuugguuaaaucuggugg

SEQ ID NO: 925426 - RNA, 20 nt, Human
aaaagcauuauaacucacag

SEQ ID NO: 925427 - RNA, 22 nt, Human
aaacaaaacaaaacaaaacaaa

SEQ ID NO: 925428 - RNA, 22 nt, Human
aaacaaaacaaaacaaaacuga

SEQ ID NO: 925429 - RNA, 24 nt, Human
aaacaaaacaaaacaaaacugaaa

SEQ ID NO: 925430 - RNA, 24 nt, Human
aacaaaacaaaacugaaaagggaa

SEQ ID NO: 925431 - RNA, 25 nt, Human
aagagaaaaacaaaacaaaacaaaa

SEQ ID NO: 925432 - RNA, 21 nt, Human
acaaaacaaaacaaaacaaaa

SEQ ID NO: 925433 - RNA, 23 nt, Human
acaaaacaaaacaaaacaaaacu

SEQ ID NO: 925434 - RNA, 19 nt, Human
acaaaacaaaacaaaacug

SEQ ID NO: 925435 - RNA, 22 nt, Human
acaaaacaaaacaaaacugaaa

SEQ ID NO: 925436 - RNA, 21 nt, Human
acccauggugaugaauaagcc

SEQ ID NO: 925437 - RNA, 20 nt, Human
accccuuucuccccagcuuc

SEQ ID NO: 925438 - RNA, 25 nt, Human
acgcuguauccguuguugaggggga

SEQ ID NO: 925439 - RNA, 24 nt, Human
agacuuagauaaggugugaggugg

SEQ ID NO: 925440 - RNA, 23 nt, Human
agagaaaaacaaaacaaaacaaa

SEQ ID NO: 925441 - RNA, 19 nt, Human
aggaaggaaacaucagaga

SEQ ID NO: 925442 - RNA, 24 nt, Human
aggcucagaaaccuccucuaccag

SEQ ID NO: 925443 - RNA, 23 nt, Human
aguuauauucugaaggggcugua

SEQ ID NO: 925444 - RNA, 21 nt, Human
auccguguucuucccccucaa

SEQ ID NO: 925445 - RNA, 20 nt, Human
augaagucuaaaugaacccc

SEQ ID NO: 925446 - RNA, 21 nt, Human
caaaacaaaacaaaacaaaac

SEQ ID NO: 925447 - RNA, 22 nt, Human
caaaacaaaacaaaacaaaacu

SEQ ID NO: 925448 - RNA, 25 nt, Human
caaaacaaaacaaaacaaaacugaa

SEQ ID NO: 925449 - RNA, 23 nt, Human
cauccguguucuucccccucacu

SEQ ID NO: 925450 - RNA, 21 nt, Human
cauuauaacucacagcacaca

SEQ ID NO: 925451 - RNA, 22 nt, Human
ccccucacucccccgcgaaaca

SEQ ID NO: 925452 - RNA, 22 nt, Human
ccccuccgaccucgcuacgccu

SEQ ID NO: 925453 - RNA, 24 nt, Human
ccuccgaccucgcuacgccucucc

SEQ ID NO: 925454 - RNA, 23 nt, Human
cgaaacaaaauauacggaaauac

SEQ ID NO: 925455 - RNA, 23 nt, Human
cgcgaaacaaaauauacggaaau

SEQ ID NO: 925456 - RNA, 18 nt, Human
cucacaugaucccuccaa

SEQ ID NO: 925457 - RNA, 18 nt, Human
cucucccacgcaggucag

SEQ ID NO: 925458 - RNA, 23 nt, Human
cugagugaaagagaaaaacaaaa

SEQ ID NO: 925459 - RNA, 20 nt, Human
gaaaacaaugaggaagaagu

SEQ ID NO: 925460 - RNA, 28 nt, Human
gaaaacaaugaggaagaaguaccauagc

SEQ ID NO: 925461 - RNA, 23 nt, Human
gagaaaaacaaaacaaaacaaaa

SEQ ID NO: 925462 - RNA, 21 nt, Human
gagaaauaaauuugauaacaa

SEQ ID NO: 925463 - RNA, 24 nt, Human
gaucacuuuuuaaguaaacaucac

SEQ ID NO: 925464 - RNA, 18 nt, Human
gcuaugagggaaaagggg

SEQ ID NO: 925465 - RNA, 19 nt, Human
gcugcuuugggagguagcu

SEQ ID NO: 925466 - RNA, 22 nt, Human
gcugcuuugggagguagcuggg

SEQ ID NO: 925467 - RNA, 23 nt, Human
ggaaauacaagugcuugguacua

SEQ ID NO: 925468 - RNA, 24 nt, Human
ggaagaaguaccauagccuacagg

SEQ ID NO: 925469 - RNA, 20 nt, Human
ggagaaugaagucacucucc

SEQ ID NO: 925470 - RNA, 18 nt, Human
ggcagaaaauucagaauu

SEQ ID NO: 925471 - RNA, 21 nt, Human
ggcuacaaggauaaggaagga

SEQ ID NO: 925472 - RNA, 21 nt, Human
uaagcccuugggcuaggcuca

SEQ ID NO: 925473 - RNA, 18 nt, Human
uaaguaaacaucaccaga

SEQ ID NO: 925474 - RNA, 28 nt, Human
uaaguaaacaucaccagaagaaucucuu

SEQ ID NO: 925475 - RNA, 22 nt, Human
uacaaaguccauuuuacuuaac

SEQ ID NO: 925476 - RNA, 24 nt, Human
uacaagugauuuuccuaaauucac

SEQ ID NO: 925477 - RNA, 19 nt, Human
uacaauaaauguuaggcua

SEQ ID NO: 925478 - RNA, 27 nt, Human
uaccagccuguuucauaagaauuacac

SEQ ID NO: 925479 - RNA, 21 nt, Human
uaccauagccuacaggcaccu

SEQ ID NO: 925480 - RNA, 19 nt, Human
uagaaaacaaugaggaaga

SEQ ID NO: 925481 - RNA, 20 nt, Human
uagcauacagaagcucgaaa

SEQ ID NO: 925482 - RNA, 20 nt, Human
uagcugggagaaaaggcaac

SEQ ID NO: 925483 - RNA, 22 nt, Human
uaguagagacaagaauuuuuaa

SEQ ID NO: 925484 - RNA, 28 nt, Human
ucccccgcgaaacaaaauauacggaaau

SEQ ID NO: 925485 - RNA, 23 nt, Human
uccguguucuucccccucacucc

SEQ ID NO: 925486 - RNA, 26 nt, Human
uccucuaccagccuguuucauaagaa

SEQ ID NO: 925487 - RNA, 20 nt, Human
ucucccuuuccccuccgacc

SEQ ID NO: 925488 - RNA, 21 nt, Human
ugaaaagggaacuuucacuac

SEQ ID NO: 925489 - RNA, 23 nt, Human
ugaagucacucucccucccuaga

SEQ ID NO: 925490 - RNA, 23 nt, Human
ugagaacagggcuauuuaaacug

SEQ ID NO: 925491 - RNA, 23 nt, Human
ugcccaauaauaagcacgcugua

SEQ ID NO: 925492 - RNA, 18 nt, Human
ugcuguacaauuacaaag

SEQ ID NO: 925493 - RNA, 22 nt, Human
ugcuguacaauuacaaagucca

SEQ ID NO: 925494 - RNA, 21 nt, Human
uguguucaucaacuuuagcac

SEQ ID NO: 925495 - RNA, 20 nt, Human
uuaccuagaaaacaaugagg

SEQ ID NO: 925496 - RNA, 19 nt, Human
uuauaauaguagagacaag

SEQ ID NO: 925497 - RNA, 18 nt, Human
uucacaacuuucacauuu

SEQ ID NO: 925498 - RNA, 23 nt, Human
uucuuucaggucucucucuuaaa

SEQ ID NO: 925499 - RNA, 22 nt, Human
aaagacagagucucggucuguc

SEQ ID NO: 925500 - RNA, 21 nt, Human
aaccugcaaacuaaaucuaag

SEQ ID NO: 925501 - RNA, 20 nt, Human
aagcagacagaaauuucaca

SEQ ID NO: 925502 - RNA, 24 nt, Human
aaggaaagcagacagaaauuucac

SEQ ID NO: 925503 - RNA, 20 nt, Human
acagacaacuacaauauaug

SEQ ID NO: 925504 - RNA, 19 nt, Human
acaguaagcaacggggaga

SEQ ID NO: 925505 - RNA, 19 nt, Human
acauagaaugguggagacc

SEQ ID NO: 925506 - RNA, 18 nt, Human
acaugccaccacugcggg

SEQ ID NO: 925507 - RNA, 18 nt, Human
acuuuguuacccaggcug
